United States Patent 7,341,835 (METHODS OF ANALYSIS OF ALTERNATIVE SPLICING IN MOUSE) - sequence listing, part 5

SEQ ID NO: 159075 - DNA, 25 bp, Mus musculus
aaagtgtggagagcctcaagtcaga

SEQ ID NO: 159076 - DNA, 25 bp, Mus musculus
aaagtgtgtggtgcaacagaatggg

SEQ ID NO: 159077 - DNA, 25 bp, Mus musculus
aaagtgttcagtgatgtgatggagg

SEQ ID NO: 159078 - DNA, 25 bp, Mus musculus
aaagtgttggacagattgtaggtga

SEQ ID NO: 159079 - DNA, 25 bp, Mus musculus
aaagttaaaaacagcctcaccattg

SEQ ID NO: 159080 - DNA, 25 bp, Mus musculus
aaagttaaaaatcgcctcaccattg

SEQ ID NO: 159081 - DNA, 25 bp, Mus musculus
aaagttaacagaaacttcagaaaag

SEQ ID NO: 159082 - DNA, 25 bp, Mus musculus
aaagttaaccagagtttgagtgaca

SEQ ID NO: 159083 - DNA, 25 bp, Mus musculus
aaagttaacccacagacaaggaata

SEQ ID NO: 159084 - DNA, 25 bp, Mus musculus
aaagttactcaggtggctggtggtg

SEQ ID NO: 159085 - DNA, 25 bp, Mus musculus
aaagttagaaaagagtatgctgtca

SEQ ID NO: 159086 - DNA, 25 bp, Mus musculus
aaagttagaaaagcatccgcagaca

SEQ ID NO: 159087 - DNA, 25 bp, Mus musculus
aaagttagaaaaggcatctgtggca

SEQ ID NO: 159088 - DNA, 25 bp, Mus musculus
aaagttagaaatttcaacgttgaag

SEQ ID NO: 159089 - DNA, 25 bp, Mus musculus
aaagttagcttgaacatcacaagtg

SEQ ID NO: 159090 - DNA, 25 bp, Mus musculus
aaagttaggaccacgagtattgtta

SEQ ID NO: 159091 - DNA, 25 bp, Mus musculus
aaagttcaagagctgtttgacaact

SEQ ID NO: 159092 - DNA, 25 bp, Mus musculus
aaagttcaagcaagactgtacattt

SEQ ID NO: 159093 - DNA, 25 bp, Mus musculus
aaagttcaagcaagtaaaccggcct

SEQ ID NO: 159094 - DNA, 25 bp, Mus musculus
aaagttcaaggagtctcatgaacag

SEQ ID NO: 159095 - DNA, 25 bp, Mus musculus
aaagttcagagctggcttccatgga

SEQ ID NO: 159096 - DNA, 25 bp, Mus musculus
aaagttcagccctgaaaagtcccaa

SEQ ID NO: 159097 - DNA, 25 bp, Mus musculus
aaagttcagccctgagaagagcctg

SEQ ID NO: 159098 - DNA, 25 bp, Mus musculus
aaagttcatggagtcgctggggagc

SEQ ID NO: 159099 - DNA, 25 bp, Mus musculus
aaagttcatgggtgtttgccagctt

SEQ ID NO: 159100 - DNA, 25 bp, Mus musculus
aaagttcccactggcgctgaagtgg

SEQ ID NO: 159101 - DNA, 25 bp, Mus musculus
aaagttcccactggggctgaagtgg

SEQ ID NO: 159102 - DNA, 25 bp, Mus musculus
aaagttccctccggatggttcagcc

SEQ ID NO: 159103 - DNA, 25 bp, Mus musculus
aaagttcgaggtcacgttcatgaat

SEQ ID NO: 159104 - DNA, 25 bp, Mus musculus
aaagttctgagaaagacaactgagg

SEQ ID NO: 159105 - DNA, 25 bp, Mus musculus
aaagttcttcagagagatgacataa

SEQ ID NO: 159106 - DNA, 25 bp, Mus musculus
aaagttcttcagagggtttcatatg

SEQ ID NO: 159107 - DNA, 25 bp, Mus musculus
aaagttcttcagagggtttcatctg

SEQ ID NO: 159108 - DNA, 25 bp, Mus musculus
aaagttgaaacaagggggagaagcg

SEQ ID NO: 159109 - DNA, 25 bp, Mus musculus
aaagttgaagagatccacgtctctc

SEQ ID NO: 159110 - DNA, 25 bp, Mus musculus
aaagttgaagaggcacagagaactg

SEQ ID NO: 159111 - DNA, 25 bp, Mus musculus
aaagttgacagtcccacagtcaaca

SEQ ID NO: 159112 - DNA, 25 bp, Mus musculus
aaagttgagcttaatgctttaatga

SEQ ID NO: 159113 - DNA, 25 bp, Mus musculus
aaagttgagcttaatgtttgttaac

SEQ ID NO: 159114 - DNA, 25 bp, Mus musculus
aaagttgagttattggtaacttcaa

SEQ ID NO: 159115 - DNA, 25 bp, Mus musculus
aaagttgcagatactcagcctcagg

SEQ ID NO: 159116 - DNA, 25 bp, Mus musculus
aaagttgcaggatgtgtttgagttt

SEQ ID NO: 159117 - DNA, 25 bp, Mus musculus
aaagttgctgaggttgccaagaagt

SEQ ID NO: 159118 - DNA, 25 bp, Mus musculus
aaagttggacaagatgcaagttctg

SEQ ID NO: 159119 - DNA, 25 bp, Mus musculus
aaagttggtccttctggagcccctg

SEQ ID NO: 159120 - DNA, 25 bp, Mus musculus
aaagttgtcaacaagctcattcagt

SEQ ID NO: 159121 - DNA, 25 bp, Mus musculus
aaagttgtgcattggactcgttact

SEQ ID NO: 159122 - DNA, 25 bp, Mus musculus
aaagtttcagcaacccagcatgtac

SEQ ID NO: 159123 - DNA, 25 bp, Mus musculus
aaagtttcatccagggtcacaaacc

SEQ ID NO: 159124 - DNA, 25 bp, Mus musculus
aaagtttctgtgaagatgggaaata

SEQ ID NO: 159125 - DNA, 25 bp, Mus musculus
aaagtttcttgggaggaagtccaca

SEQ ID NO: 159126 - DNA, 25 bp, Mus musculus
aaagtttgaccccccagacttctgg

SEQ ID NO: 159127 - DNA, 25 bp, Mus musculus
aaagtttgagagtggatgtaaagcc

SEQ ID NO: 159128 - DNA, 25 bp, Mus musculus
aaagtttgaggtgggatgtgtgtgg

SEQ ID NO: 159129 - DNA, 25 bp, Mus musculus
aaagtttgccttagagcacggcatc

SEQ ID NO: 159130 - DNA, 25 bp, Mus musculus
aaagtttggaagaatgacatacggc

SEQ ID NO: 159131 - DNA, 25 bp, Mus musculus
aaagtttggaagttgccatccagtg

SEQ ID NO: 159132 - DNA, 25 bp, Mus musculus
aaagtttggaggccacctatgaaaa

SEQ ID NO: 159133 - DNA, 25 bp, Mus musculus
aaagtttggagtttgttgaaggatc

SEQ ID NO: 159134 - DNA, 25 bp, Mus musculus
aaagtttgtaaagcctcttcggtga

SEQ ID NO: 159135 - DNA, 25 bp, Mus musculus
aaagttttacagtggaaagcccatg

SEQ ID NO: 159136 - DNA, 25 bp, Mus musculus
aaagttttgagagaagcagaagata

SEQ ID NO: 159137 - DNA, 25 bp, Mus musculus
aaagttttttcagagatcccgcccg

SEQ ID NO: 159138 - DNA, 25 bp, Mus musculus
aaataaaaaaattcatctacaggct

SEQ ID NO: 159139 - DNA, 25 bp, Mus musculus
aaataaaaaaggggcctgctgactc

SEQ ID NO: 159140 - DNA, 25 bp, Mus musculus
aaataaaaactcaggtcctttgcaa

SEQ ID NO: 159141 - DNA, 25 bp, Mus musculus
aaataaaaagcagatgcatgttcct

SEQ ID NO: 159142 - DNA, 25 bp, Mus musculus
aaataaaaagcagatgtcatatgcc

SEQ ID NO: 159143 - DNA, 25 bp, Mus musculus
aaataaaaaggtgcttgagcaggcc

SEQ ID NO: 159144 - DNA, 25 bp, Mus musculus
aaataaaacaggtggcttcggtgct

SEQ ID NO: 159145 - DNA, 25 bp, Mus musculus
aaataaaacaggttcgggagcagcg

SEQ ID NO: 159146 - DNA, 25 bp, Mus musculus
aaataaagaaactactcactggcct

SEQ ID NO: 159147 - DNA, 25 bp, Mus musculus
aaataaataaggaagcagtatggtt

SEQ ID NO: 159148 - DNA, 25 bp, Mus musculus
aaataaatagataataccaaacgtc

SEQ ID NO: 159149 - DNA, 25 bp, Mus musculus
aaataaattgaagggtatttcaaca

SEQ ID NO: 159150 - DNA, 25 bp, Mus musculus
aaataacaaagagctactgctttct

SEQ ID NO: 159151 - DNA, 25 bp, Mus musculus
aaataacaaagatgctactacacac

SEQ ID NO: 159152 - DNA, 25 bp, Mus musculus
aaataacaaagcggagtatgtccag

SEQ ID NO: 159153 - DNA, 25 bp, Mus musculus
aaataacaaaggctcaccatcatgg

SEQ ID NO: 159154 - DNA, 25 bp, Mus musculus
aaataaccagagtatgctggataaa

SEQ ID NO: 159155 - DNA, 25 bp, Mus musculus
aaataaccagatatcagtttttctt

SEQ ID NO: 159156 - DNA, 25 bp, Mus musculus
aaataaccaggtgaagcaagatgcc

SEQ ID NO: 159157 - DNA, 25 bp, Mus musculus
aaataactgggctgttttacctcta

SEQ ID NO: 159158 - DNA, 25 bp, Mus musculus
aaataagaatgaagagcatggctcc

SEQ ID NO: 159159 - DNA, 25 bp, Mus musculus
aaataagagatccagcccactcaag

SEQ ID NO: 159160 - DNA, 25 bp, Mus musculus
aaataagagctggagcattttctgc

SEQ ID NO: 159161 - DNA, 25 bp, Mus musculus
aaataagccttgtacactggacact

SEQ ID NO: 159162 - DNA, 25 bp, Mus musculus
aaataagggcacacctagtcaggtg

SEQ ID NO: 159163 - DNA, 25 bp, Mus musculus
aaataagggccacacctagtcaggt

SEQ ID NO: 159164 - DNA, 25 bp, Mus musculus
aaataataaagcatattcaaaagaa

SEQ ID NO: 159165 - DNA, 25 bp, Mus musculus
aaataataaagggacagatatggct

SEQ ID NO: 159166 - DNA, 25 bp, Mus musculus
aaataatactagaagatacatcact

SEQ ID NO: 159167 - DNA, 25 bp, Mus musculus
aaataatcaaagatcttgtttttag

SEQ ID NO: 159168 - DNA, 25 bp, Mus musculus
aaataatcaaatgggttgtgtggtg

SEQ ID NO: 159169 - DNA, 25 bp, Mus musculus
aaataatcagagctgagggaataaa

SEQ ID NO: 159170 - DNA, 25 bp, Mus musculus
aaataatcagaggtatgccttcatg

SEQ ID NO: 159171 - DNA, 25 bp, Mus musculus
aaataatcagtatgaagctgctctt

SEQ ID NO: 159172 - DNA, 25 bp, Mus musculus
aaataatcagtgtaagctgctctta

SEQ ID NO: 159173 - DNA, 25 bp, Mus musculus
aaataatgacttgggacaaaagaaa

SEQ ID NO: 159174 - DNA, 25 bp, Mus musculus
aaataatgcaaaagactaacctaac

SEQ ID NO: 159175 - DNA, 25 bp, Mus musculus
aaataatggcgcccagagcataaat

SEQ ID NO: 159176 - DNA, 25 bp, Mus musculus
aaataatggcggctattgatacaga

SEQ ID NO: 159177 - DNA, 25 bp, Mus musculus
aaataatggtgatggtcttctccat

SEQ ID NO: 159178 - DNA, 25 bp, Mus musculus
aaataatgttgaaggaagccaaaaa

SEQ ID NO: 159179 - DNA, 25 bp, Mus musculus
aaataattaaggaaagggctgtgag

SEQ ID NO: 159180 - DNA, 25 bp, Mus musculus
aaataattcactgctaaaatacatt

SEQ ID NO: 159181 - DNA, 25 bp, Mus musculus
aaataattcatccaggtcaagtgga

SEQ ID NO: 159182 - DNA, 25 bp, Mus musculus
aaataattcatccaggttcttaaat

SEQ ID NO: 159183 - DNA, 25 bp, Mus musculus
aaataattcctaccacagaaactgc

SEQ ID NO: 159184 - DNA, 25 bp, Mus musculus
aaataattgatgctgtgaaggctgg

SEQ ID NO: 159185 - DNA, 25 bp, Mus musculus
aaataatttcagctgccagtgaagg

SEQ ID NO: 159186 - DNA, 25 bp, Mus musculus
aaatacaactcagatcccaagcagt

SEQ ID NO: 159187 - DNA, 25 bp, Mus musculus
aaatacaactcagatctccatcaga

SEQ ID NO: 159188 - DNA, 25 bp, Mus musculus
aaatacaacttcaggtgaaaatttt

SEQ ID NO: 159189 - DNA, 25 bp, Mus musculus
aaatacaatatggggctgccggtgg

SEQ ID NO: 159190 - DNA, 25 bp, Mus musculus
aaatacaatgacccctgacaagctg

SEQ ID NO: 159191 - DNA, 25 bp, Mus musculus
aaatacaatgccctcaagacccctg

SEQ ID NO: 159192 - DNA, 25 bp, Mus musculus
aaatacaatgcctttaacttgtttg

SEQ ID NO: 159193 - DNA, 25 bp, Mus musculus
aaatacacgccttccttcaggcaaa

SEQ ID NO: 159194 - DNA, 25 bp, Mus musculus
aaatacacgctgatgttcctctgct

SEQ ID NO: 159195 - DNA, 25 bp, Mus musculus
aaatacactctgattactacaaggg

SEQ ID NO: 159196 - DNA, 25 bp, Mus musculus
aaatacagatgtctctttaaggagg

SEQ ID NO: 159197 - DNA, 25 bp, Mus musculus
aaatacagtaaatggaagatcaaga

SEQ ID NO: 159198 - DNA, 25 bp, Mus musculus
aaatacataaatatgcaaacaggga

SEQ ID NO: 159199 - DNA, 25 bp, Mus musculus
aaatacataaatatgtaaagaacat

SEQ ID NO: 159200 - DNA, 25 bp, Mus musculus
aaatacatagcgacagcgaaggacg

SEQ ID NO: 159201 - DNA, 25 bp, Mus musculus
aaatacattcaggaagccgaaatgt

SEQ ID NO: 159202 - DNA, 25 bp, Mus musculus
aaatacattttcacggacaagccct

SEQ ID NO: 159203 - DNA, 25 bp, Mus musculus
aaataccaagcctagtgctaccaag

SEQ ID NO: 159204 - DNA, 25 bp, Mus musculus
aaataccatatcagtgccttgtatg

SEQ ID NO: 159205 - DNA, 25 bp, Mus musculus
aaataccatgatttctaggcaaggc

SEQ ID NO: 159206 - DNA, 25 bp, Mus musculus
aaatacccaagtaccagcaagtctt

SEQ ID NO: 159207 - DNA, 25 bp, Mus musculus
aaataccccccggtgccacattctg

SEQ ID NO: 159208 - DNA, 25 bp, Mus musculus
aaatacccggccccagcctgcagag

SEQ ID NO: 159209 - DNA, 25 bp, Mus musculus
aaatacccttttcagactcttgtgt

SEQ ID NO: 159210 - DNA, 25 bp, Mus musculus
aaatacccttttcaggtcgtgcatg

SEQ ID NO: 159211 - DNA, 25 bp, Mus musculus
aaataccgtaggtggtcaactattc

SEQ ID NO: 159212 - DNA, 25 bp, Mus musculus
aaatacctcaagggtgaggatcctt

SEQ ID NO: 159213 - DNA, 25 bp, Mus musculus
aaatacctccagttcagaagaagag

SEQ ID NO: 159214 - DNA, 25 bp, Mus musculus
aaatacctctcaaaaatagtgatct

SEQ ID NO: 159215 - DNA, 25 bp, Mus musculus
aaatacctggatcctgagcatgctg

SEQ ID NO: 159216 - DNA, 25 bp, Mus musculus
aaatacctggatgaggagaaacttg

SEQ ID NO: 159217 - DNA, 25 bp, Mus musculus
aaataccttcaagatgctgggtgcc

SEQ ID NO: 159218 - DNA, 25 bp, Mus musculus
aaataccttcaagccaccttcaaga

SEQ ID NO: 159219 - DNA, 25 bp, Mus musculus
aaataccttcgagatgctgggtgcc

SEQ ID NO: 159220 - DNA, 25 bp, Mus musculus
aaataccttcgagccttcccagagg

SEQ ID NO: 159221 - DNA, 25 bp, Mus musculus
aaatacgattcagatggttacggct

SEQ ID NO: 159222 - DNA, 25 bp, Mus musculus
aaatacgctgctgagataggacggg

SEQ ID NO: 159223 - DNA, 25 bp, Mus musculus
aaatacgctgctgagcttcacctgg

SEQ ID NO: 159224 - DNA, 25 bp, Mus musculus
aaatacggaagcaaggaaaatccaa

SEQ ID NO: 159225 - DNA, 25 bp, Mus musculus
aaatacgtcaaagagcagtgactta

SEQ ID NO: 159226 - DNA, 25 bp, Mus musculus
aaatacgttccaggagttacagctt

SEQ ID NO: 159227 - DNA, 25 bp, Mus musculus
aaatacgttcgcaactcacggatga

SEQ ID NO: 159228 - DNA, 25 bp, Mus musculus
aaatactacatttttttccagaggc

SEQ ID NO: 159229 - DNA, 25 bp, Mus musculus
aaatactcacagaaagaagaatcct

SEQ ID NO: 159230 - DNA, 25 bp, Mus musculus
aaatactcatctcaggacagctccc

SEQ ID NO: 159231 - DNA, 25 bp, Mus musculus
aaatactcatctcagggctgtccaa

SEQ ID NO: 159232 - DNA, 25 bp, Mus musculus
aaatactctcctgggttgtgttatt

SEQ ID NO: 159233 - DNA, 25 bp, Mus musculus
aaatactgaagtgtattccttaccg

SEQ ID NO: 159234 - DNA, 25 bp, Mus musculus
aaatactgagctgactaagccccag

SEQ ID NO: 159235 - DNA, 25 bp, Mus musculus
aaatactgcttcaacttctcttgca

SEQ ID NO: 159236 - DNA, 25 bp, Mus musculus
aaatactggaattacaggctgaccc

SEQ ID NO: 159237 - DNA, 25 bp, Mus musculus
aaatactgtcttctctgcctcccga

SEQ ID NO: 159238 - DNA, 25 bp, Mus musculus
aaatacttaacgtctcattcttgcg

SEQ ID NO: 159239 - DNA, 25 bp, Mus musculus
aaatacttcacagagaaatattact

SEQ ID NO: 159240 - DNA, 25 bp, Mus musculus
aaatacttcacagagagcatgtgac

SEQ ID NO: 159241 - DNA, 25 bp, Mus musculus
aaatacttcttcatccacatctaca

SEQ ID NO: 159242 - DNA, 25 bp, Mus musculus
aaatacttggagaaactggaggtac

SEQ ID NO: 159243 - DNA, 25 bp, Mus musculus
aaatactttccagaacacttcagtt

SEQ ID NO: 159244 - DNA, 25 bp, Mus musculus
aaatactttgctgccttctgatagg

SEQ ID NO: 159245 - DNA, 25 bp, Mus musculus
aaatactttgttgaaccaagactct

SEQ ID NO: 159246 - DNA, 25 bp, Mus musculus
aaatagaaaataaaatcttggcaat

SEQ ID NO: 159247 - DNA, 25 bp, Mus musculus
aaatagaagaggactccatataacc

SEQ ID NO: 159248 - DNA, 25 bp, Mus musculus
aaatagaagaggccttctttctaga

SEQ ID NO: 159249 - DNA, 25 bp, Mus musculus
aaatagaagaggtagtagaagagga

SEQ ID NO: 159250 - DNA, 25 bp, Mus musculus
aaatagaccagatctcacaggaaaa

SEQ ID NO: 159251 - DNA, 25 bp, Mus musculus
aaatagataataccaaacgtctatg

SEQ ID NO: 159252 - DNA, 25 bp, Mus musculus
aaatagatctaaaggagctgtgaaa

SEQ ID NO: 159253 - DNA, 25 bp, Mus musculus
aaatagcatgattcagctactagtg

SEQ ID NO: 159254 - DNA, 25 bp, Mus musculus
aaatagccagccaagtctgaaacta

SEQ ID NO: 159255 - DNA, 25 bp, Mus musculus
aaatagccagcctgtcaagactctt

SEQ ID NO: 159256 - DNA, 25 bp, Mus musculus
aaatagcgatgtctggaataaaagc

SEQ ID NO: 159257 - DNA, 25 bp, Mus musculus
aaatagctcctaggttgggagtcta

SEQ ID NO: 159258 - DNA, 25 bp, Mus musculus
aaatagctcctatacctgactgtca

SEQ ID NO: 159259 - DNA, 25 bp, Mus musculus
aaataggaaataggttaaatggaat

SEQ ID NO: 159260 - DNA, 25 bp, Mus musculus
aaataggccagagtgggtcatctct

SEQ ID NO: 159261 - DNA, 25 bp, Mus musculus
aaataggccagagtggtggttcccg

SEQ ID NO: 159262 - DNA, 25 bp, Mus musculus
aaatagtacaggcagtgggaactca

SEQ ID NO: 159263 - DNA, 25 bp, Mus musculus
aaatagtccaacagaaagcaaagat

SEQ ID NO: 159264 - DNA, 25 bp, Mus musculus
aaatagtccaacaggtgactgttca

SEQ ID NO: 159265 - DNA, 25 bp, Mus musculus
aaatagtccaacatcttcagcaaac

SEQ ID NO: 159266 - DNA, 25 bp, Mus musculus
aaatagtgaaagtcctcaggactcc

SEQ ID NO: 159267 - DNA, 25 bp, Mus musculus
aaatagttggtgtttggcacagact

SEQ ID NO: 159268 - DNA, 25 bp, Mus musculus
aaatataaaaagaggaaactgcact

SEQ ID NO: 159269 - DNA, 25 bp, Mus musculus
aaatataaaaaggtaacaactgatt

SEQ ID NO: 159270 - DNA, 25 bp, Mus musculus
aaatataaaatggaagctttaaatg

SEQ ID NO: 159271 - DNA, 25 bp, Mus musculus
aaatataaaatgggtcaaatagaaa

SEQ ID NO: 159272 - DNA, 25 bp, Mus musculus
aaatataatagatgtggtatctacc

SEQ ID NO: 159273 - DNA, 25 bp, Mus musculus
aaatatacaaggctcaaactcagaa

SEQ ID NO: 159274 - DNA, 25 bp, Mus musculus
aaatatagccttcaggaaacaaagc

SEQ ID NO: 159275 - DNA, 25 bp, Mus musculus
aaatatcaagccgcctgtttctgga

SEQ ID NO: 159276 - DNA, 25 bp, Mus musculus
aaatatcaagccgcgttttacgatg

SEQ ID NO: 159277 - DNA, 25 bp, Mus musculus
aaatatcacaggctaatgttatctg

SEQ ID NO: 159278 - DNA, 25 bp, Mus musculus
aaatatcacgaacacactaaatata

SEQ ID NO: 159279 - DNA, 25 bp, Mus musculus
aaatatcagaggccacctatgaaaa

SEQ ID NO: 159280 - DNA, 25 bp, Mus musculus
aaatatcatatctggccatcagaca

SEQ ID NO: 159281 - DNA, 25 bp, Mus musculus
aaatatcatatctgtgtgaaaatag

SEQ ID NO: 159282 - DNA, 25 bp, Mus musculus
aaatatcattagcaacgctgttcct

SEQ ID NO: 159283 - DNA, 25 bp, Mus musculus
aaatatccagagcgacgagatttat

SEQ ID NO: 159284 - DNA, 25 bp, Mus musculus
aaatatccagatttagagcgacgag

SEQ ID NO: 159285 - DNA, 25 bp, Mus musculus
aaatatccaggaaggctcagcaaca

SEQ ID NO: 159286 - DNA, 25 bp, Mus musculus
aaatatctaaccagcagatagtcta

SEQ ID NO: 159287 - DNA, 25 bp, Mus musculus
aaatatcttcagagactggaagtga

SEQ ID NO: 159288 - DNA, 25 bp, Mus musculus
aaatatctttatatcttaaaagatg

SEQ ID NO: 159289 - DNA, 25 bp, Mus musculus
aaatatctttgtatcttaaaagatg

SEQ ID NO: 159290 - DNA, 25 bp, Mus musculus
aaatatgaacaggcatgtaatgaat

SEQ ID NO: 159291 - DNA, 25 bp, Mus musculus
aaatatgaagacactccagcaactg

SEQ ID NO: 159292 - DNA, 25 bp, Mus musculus
aaatatgaagccactctgatatctg

SEQ ID NO: 159293 - DNA, 25 bp, Mus musculus
aaatatgacaactgttggctggctc

SEQ ID NO: 159294 - DNA, 25 bp, Mus musculus
aaatatgacatggagtggaagacat

SEQ ID NO: 159295 - DNA, 25 bp, Mus musculus
aaatatgaggagcaccagctagcca

SEQ ID NO: 159296 - DNA, 25 bp, Mus musculus
aaatatgagtggaaggtggcccaga

SEQ ID NO: 159297 - DNA, 25 bp, Mus musculus
aaatatgagtggaaggtgggattgg

SEQ ID NO: 159298 - DNA, 25 bp, Mus musculus
aaatatgatgaccgagaggaagaca

SEQ ID NO: 159299 - DNA, 25 bp, Mus musculus
aaatatgcacgaaggatggcgagac

SEQ ID NO: 159300 - DNA, 25 bp, Mus musculus
aaatatgcagaaaatacaacctcca

SEQ ID NO: 159301 - DNA, 25 bp, Mus musculus
aaatatgcaggaggggaagcagatc

SEQ ID NO: 159302 - DNA, 25 bp, Mus musculus
aaatatgcagtgagcatgtttttga

SEQ ID NO: 159303 - DNA, 25 bp, Mus musculus
aaatatgcccagcgagccagagccc

SEQ ID NO: 159304 - DNA, 25 bp, Mus musculus
aaatatgcccaggtgaagcctgacg

SEQ ID NO: 159305 - DNA, 25 bp, Mus musculus
aaatatgcccttgaaagcagaccgc

SEQ ID NO: 159306 - DNA, 25 bp, Mus musculus
aaatatgctgcagagcttcacttgg

SEQ ID NO: 159307 - DNA, 25 bp, Mus musculus
aaatatgcttttaaggcagcccacc

SEQ ID NO: 159308 - DNA, 25 bp, Mus musculus
aaatatgggccaaatgaaaattctt

SEQ ID NO: 159309 - DNA, 25 bp, Mus musculus
aaatatggttttgctgtacagagag

SEQ ID NO: 159310 - DNA, 25 bp, Mus musculus
aaatatgtcagatttcaactattgc

SEQ ID NO: 159311 - DNA, 25 bp, Mus musculus
aaatatgtggggatgatccttagtg

SEQ ID NO: 159312 - DNA, 25 bp, Mus musculus
aaatatgtggggtacgatctttgcg

SEQ ID NO: 159313 - DNA, 25 bp, Mus musculus
aaatattacatgggtcattcacatg

SEQ ID NO: 159314 - DNA, 25 bp, Mus musculus
aaatattagaggagtcgctaagatt

SEQ ID NO: 159315 - DNA, 25 bp, Mus musculus
aaatattccaagttcagtggtcacc

SEQ ID NO: 159316 - DNA, 25 bp, Mus musculus
aaatattccataagatcatctttag

SEQ ID NO: 159317 - DNA, 25 bp, Mus musculus
aaatattctcccagagatcttcaaa

SEQ ID NO: 159318 - DNA, 25 bp, Mus musculus
aaatattgaaatcgcatcatattta

SEQ ID NO: 159319 - DNA, 25 bp, Mus musculus
aaatattgaagtttaccatagtttc

SEQ ID NO: 159320 - DNA, 25 bp, Mus musculus
aaatattgatgctgctgtccggcgg

SEQ ID NO: 159321 - DNA, 25 bp, Mus musculus
aaatattgcatagggtaaatgagaa

SEQ ID NO: 159322 - DNA, 25 bp, Mus musculus
aaatatttagattgaggatgggtac

SEQ ID NO: 159323 - DNA, 25 bp, Mus musculus
aaatatttcagacaggattggtagc

SEQ ID NO: 159324 - DNA, 25 bp, Mus musculus
aaatatttggagccagacacttgtc

SEQ ID NO: 159325 - DNA, 25 bp, Mus musculus
aaatattttatataattggcctaca

SEQ ID NO: 159326 - DNA, 25 bp, Mus musculus
aaatattttctcagcaagccccgcc

SEQ ID NO: 159327 - DNA, 25 bp, Mus musculus
aaatattttgaggttccatctgtcc

SEQ ID NO: 159328 - DNA, 25 bp, Mus musculus
aaatcaaaactactaaatggaaatg

SEQ ID NO: 159329 - DNA, 25 bp, Mus musculus
aaatcaaaagaatgctgtgtctgct

SEQ ID NO: 159330 - DNA, 25 bp, Mus musculus
aaatcaaaagagaagctgctgtatg

SEQ ID NO: 159331 - DNA, 25 bp, Mus musculus
aaatcaaaaggtgtgatccttgcac

SEQ ID NO: 159332 - DNA, 25 bp, Mus musculus
aaatcaaaccaaaaggcatcatagc

SEQ ID NO: 159333 - DNA, 25 bp, Mus musculus
aaatcaaagtgaaagttaatgaaat

SEQ ID NO: 159334 - DNA, 25 bp, Mus musculus
aaatcaaatggcagaggtcactttt

SEQ ID NO: 159335 - DNA, 25 bp, Mus musculus
aaatcaaatggcagtatatatgttt

SEQ ID NO: 159336 - DNA, 25 bp, Mus musculus
aaatcaaccaagctgctcttctcag

SEQ ID NO: 159337 - DNA, 25 bp, Mus musculus
aaatcaagaagaaggattccaagga

SEQ ID NO: 159338 - DNA, 25 bp, Mus musculus
aaatcaagagaagcgagccagagcc

SEQ ID NO: 159339 - DNA, 25 bp, Mus musculus
aaatcaagatgtcattaaagcgata

SEQ ID NO: 159340 - DNA, 25 bp, Mus musculus
aaatcaagcagaaaatgagtccact

SEQ ID NO: 159341 - DNA, 25 bp, Mus musculus
aaatcaagcaggagccatgcagtgg

SEQ ID NO: 159342 - DNA, 25 bp, Mus musculus
aaatcaaggagcttgtagtgaagaa

SEQ ID NO: 159343 - DNA, 25 bp, Mus musculus
aaatcacacaatatgtagctggcac

SEQ ID NO: 159344 - DNA, 25 bp, Mus musculus
aaatcacacagttttcagatatgta

SEQ ID NO: 159345 - DNA, 25 bp, Mus musculus
aaatcacagaataccacctcctcaa

SEQ ID NO: 159346 - DNA, 25 bp, Mus musculus
aaatcacagagaacacccagatcga

SEQ ID NO: 159347 - DNA, 25 bp, Mus musculus
aaatcacagagaagcagaacaagcc

SEQ ID NO: 159348 - DNA, 25 bp, Mus musculus
aaatcacatcaggtgacagagttag

SEQ ID NO: 159349 - DNA, 25 bp, Mus musculus
aaatcacatgatggagcctcaaggc

SEQ ID NO: 159350 - DNA, 25 bp, Mus musculus
aaatcaccacagtttcgttatcagc

SEQ ID NO: 159351 - DNA, 25 bp, Mus musculus
aaatcaccagatggtctcagcacta

SEQ ID NO: 159352 - DNA, 25 bp, Mus musculus
aaatcaccgcactgattttggctct

SEQ ID NO: 159353 - DNA, 25 bp, Mus musculus
aaatcaccgcactgcttcaggaccc

SEQ ID NO: 159354 - DNA, 25 bp, Mus musculus
aaatcacggaaggtgtctcagacat

SEQ ID NO: 159355 - DNA, 25 bp, Mus musculus
aaatcactgacaagcaaggaaagac

SEQ ID NO: 159356 - DNA, 25 bp, Mus musculus
aaatcactggctgagaacccttctg

SEQ ID NO: 159357 - DNA, 25 bp, Mus musculus
aaatcacttttcctactttcactct

SEQ ID NO: 159358 - DNA, 25 bp, Mus musculus
aaatcagaatgagttgcaagcacat

SEQ ID NO: 159359 - DNA, 25 bp, Mus musculus
aaatcagacaaaagattcgcctaaa

SEQ ID NO: 159360 - DNA, 25 bp, Mus musculus
aaatcagacaagaaccctaattccc

SEQ ID NO: 159361 - DNA, 25 bp, Mus musculus
aaatcagacaagctatggtatctcc

SEQ ID NO: 159362 - DNA, 25 bp, Mus musculus
aaatcagacagatccgagacactaa

SEQ ID NO: 159363 - DNA, 25 bp, Mus musculus
aaatcagacagtgatttcaatcaga

SEQ ID NO: 159364 - DNA, 25 bp, Mus musculus
aaatcagagttgaaaccgacagagc

SEQ ID NO: 159365 - DNA, 25 bp, Mus musculus
aaatcagatagtcttccccgctggc

SEQ ID NO: 159366 - DNA, 25 bp, Mus musculus
aaatcagcatcagattccaaatcta

SEQ ID NO: 159367 - DNA, 25 bp, Mus musculus
aaatcagcatcagtctggagcaaaa

SEQ ID NO: 159368 - DNA, 25 bp, Mus musculus
aaatcagtaattatggatgggatca

SEQ ID NO: 159369 - DNA, 25 bp, Mus musculus
aaatcatagaggacattaaggacgc

SEQ ID NO: 159370 - DNA, 25 bp, Mus musculus
aaatcatcaccagaataagcctgca

SEQ ID NO: 159371 - DNA, 25 bp, Mus musculus
aaatcatcgaagtctttgtccagga

SEQ ID NO: 159372 - DNA, 25 bp, Mus musculus
aaatcattagataacaactattcca

SEQ ID NO: 159373 - DNA, 25 bp, Mus musculus
aaatcattattttagacacagaatg

SEQ ID NO: 159374 - DNA, 25 bp, Mus musculus
aaatcattcagtctgtgtatgaaga

SEQ ID NO: 159375 - DNA, 25 bp, Mus musculus
aaatccaaaaggacacatgtatgat

SEQ ID NO: 159376 - DNA, 25 bp, Mus musculus
aaatccaaaaggatctggagactca

SEQ ID NO: 159377 - DNA, 25 bp, Mus musculus
aaatccaaaataccaccaagctcct

SEQ ID NO: 159378 - DNA, 25 bp, Mus musculus
aaatccaaaatcaggcaccccgtgg

SEQ ID NO: 159379 - DNA, 25 bp, Mus musculus
aaatccaaaatcaggttgctggctc

SEQ ID NO: 159380 - DNA, 25 bp, Mus musculus
aaatccaaactttatgatggttaat

SEQ ID NO: 159381 - DNA, 25 bp, Mus musculus
aaatccaagaggcggtggtggtgca

SEQ ID NO: 159382 - DNA, 25 bp, Mus musculus
aaatccaagccaagtgccctccaag

SEQ ID NO: 159383 - DNA, 25 bp, Mus musculus
aaatccaagtgggtattccatgtct

SEQ ID NO: 159384 - DNA, 25 bp, Mus musculus
aaatccacaggcagtgaggaatggt

SEQ ID NO: 159385 - DNA, 25 bp, Mus musculus
aaatccacccgagaagacagcatga

SEQ ID NO: 159386 - DNA, 25 bp, Mus musculus
aaatccacccgagcactgtctatgg

SEQ ID NO: 159387 - DNA, 25 bp, Mus musculus
aaatccaccgcggagatggatggcc

SEQ ID NO: 159388 - DNA, 25 bp, Mus musculus
aaatccaccgcgggaccttctgtct

SEQ ID NO: 159389 - DNA, 25 bp, Mus musculus
aaatccactagactctggaactgta

SEQ ID NO: 159390 - DNA, 25 bp, Mus musculus
aaatccactaggagacttaatggag

SEQ ID NO: 159391 - DNA, 25 bp, Mus musculus
aaatccagaattgattacaacaacc

SEQ ID NO: 159392 - DNA, 25 bp, Mus musculus
aaatccagacacgcagttacagacc

SEQ ID NO: 159393 - DNA, 25 bp, Mus musculus
aaatccagacacgcattcctgggag

SEQ ID NO: 159394 - DNA, 25 bp, Mus musculus
aaatccagaggatctctctcaacac

SEQ ID NO: 159395 - DNA, 25 bp, Mus musculus
aaatccagaggcagcaagaaaagca

SEQ ID NO: 159396 - DNA, 25 bp, Mus musculus
aaatccagaggcagttagccttaca

SEQ ID NO: 159397 - DNA, 25 bp, Mus musculus
aaatccagaggtgaaaatccagggc

SEQ ID NO: 159398 - DNA, 25 bp, Mus musculus
aaatccagcagacccgagaagccct

SEQ ID NO: 159399 - DNA, 25 bp, Mus musculus
aaatccagtacaggtgaatatactg

SEQ ID NO: 159400 - DNA, 25 bp, Mus musculus
aaatccataaagaggatggagatat

SEQ ID NO: 159401 - DNA, 25 bp, Mus musculus
aaatccatggacatgatgttgacgg

SEQ ID NO: 159402 - DNA, 25 bp, Mus musculus
aaatccatggacatgcacaatatcg

SEQ ID NO: 159403 - DNA, 25 bp, Mus musculus
aaatcccaagtagcatgctacaaat

SEQ ID NO: 159404 - DNA, 25 bp, Mus musculus
aaatccccagatcccagcctcctgc

SEQ ID NO: 159405 - DNA, 25 bp, Mus musculus
aaatccccagctattgcagatccca

SEQ ID NO: 159406 - DNA, 25 bp, Mus musculus
aaatccccaggtgtgactgcacaga

SEQ ID NO: 159407 - DNA, 25 bp, Mus musculus
aaatccccagtgaatggaactccca

SEQ ID NO: 159408 - DNA, 25 bp, Mus musculus
aaatcccgcaaggtcccgcacacca

SEQ ID NO: 159409 - DNA, 25 bp, Mus musculus
aaatccctgcacttgtggatggaga

SEQ ID NO: 159410 - DNA, 25 bp, Mus musculus
aaatcccttccagaagtcttgtgtg

SEQ ID NO: 159411 - DNA, 25 bp, Mus musculus
aaatcccttccagaatgtcaagtgc

SEQ ID NO: 159412 - DNA, 25 bp, Mus musculus
aaatcccttgctaacagagaagtcc

SEQ ID NO: 159413 - DNA, 25 bp, Mus musculus
aaatccgagaggtcgaaggatctca

SEQ ID NO: 159414 - DNA, 25 bp, Mus musculus
aaatccgatggggagcctttacttt

SEQ ID NO: 159415 - DNA, 25 bp, Mus musculus
aaatccgatggttttcagacaaatt

SEQ ID NO: 159416 - DNA, 25 bp, Mus musculus
aaatccggcagagtgaccgtcttct

SEQ ID NO: 159417 - DNA, 25 bp, Mus musculus
aaatcctagagagcctttccacgtc

SEQ ID NO: 159418 - DNA, 25 bp, Mus musculus
aaatcctatcaagaggcaggaagcg

SEQ ID NO: 159419 - DNA, 25 bp, Mus musculus
aaatcctatcaaggctcatcagcag

SEQ ID NO: 159420 - DNA, 25 bp, Mus musculus
aaatcctccttcagctgataatact

SEQ ID NO: 159421 - DNA, 25 bp, Mus musculus
aaatcctgaagaagattaacttgag

SEQ ID NO: 159422 - DNA, 25 bp, Mus musculus
aaatcctgcaccaggaagagttggg

SEQ ID NO: 159423 - DNA, 25 bp, Mus musculus
aaatcctgcaggactacaaatctct

SEQ ID NO: 159424 - DNA, 25 bp, Mus musculus
aaatcctgcaggagccagcaggggt

SEQ ID NO: 159425 - DNA, 25 bp, Mus musculus
aaatcctggagcgttcactgtgagc

SEQ ID NO: 159426 - DNA, 25 bp, Mus musculus
aaatcctgtggtgggagcatgccgg

SEQ ID NO: 159427 - DNA, 25 bp, Mus musculus
aaatccttacgatgctgatgacatc

SEQ ID NO: 159428 - DNA, 25 bp, Mus musculus
aaatccttacggcatttttctgtgc

SEQ ID NO: 159429 - DNA, 25 bp, Mus musculus
aaatccttcctgaaacttcatggct

SEQ ID NO: 159430 - DNA, 25 bp, Mus musculus
aaatccttcctggaaggccggatgg

SEQ ID NO: 159431 - DNA, 25 bp, Mus musculus
aaatccttcgcgtctcagaataact

SEQ ID NO: 159432 - DNA, 25 bp, Mus musculus
aaatcgaagcagaaaatgaacaggt

SEQ ID NO: 159433 - DNA, 25 bp, Mus musculus
aaatcgaagcccttggtccagaata

SEQ ID NO: 159434 - DNA, 25 bp, Mus musculus
aaatcgagaatttatagctaaaagg

SEQ ID NO: 159435 - DNA, 25 bp, Mus musculus
aaatcgagtacaggagttattcctg

SEQ ID NO: 159436 - DNA, 25 bp, Mus musculus
aaatcgataaccagagccaaccttt

SEQ ID NO: 159437 - DNA, 25 bp, Mus musculus
aaatcgataaccaggtgagaaaggc

SEQ ID NO: 159438 - DNA, 25 bp, Mus musculus
aaatcgattcaaggatcgcattgta

SEQ ID NO: 159439 - DNA, 25 bp, Mus musculus
aaatcgctcagtcctgcatctggcc

SEQ ID NO: 159440 - DNA, 25 bp, Mus musculus
aaatcgctcagtgccacatatgtgc

SEQ ID NO: 159441 - DNA, 25 bp, Mus musculus
aaatcggaagatcttagatgagttt

SEQ ID NO: 159442 - DNA, 25 bp, Mus musculus
aaatcggggcggtgtgaatgacaga

SEQ ID NO: 159443 - DNA, 25 bp, Mus musculus
aaatcgtccttgaaagccctctggg

SEQ ID NO: 159444 - DNA, 25 bp, Mus musculus
aaatctaaactgacccccgtcagag

SEQ ID NO: 159445 - DNA, 25 bp, Mus musculus
aaatctaaactggatcgaagtaaac

SEQ ID NO: 159446 - DNA, 25 bp, Mus musculus
aaatctaacaattctctacattttg

SEQ ID NO: 159447 - DNA, 25 bp, Mus musculus
aaatctaccagaacaatctggaact

SEQ ID NO: 159448 - DNA, 25 bp, Mus musculus
aaatctaccagttgagaaatgtgat

SEQ ID NO: 159449 - DNA, 25 bp, Mus musculus
aaatctaggtatggtctgccggaag

SEQ ID NO: 159450 - DNA, 25 bp, Mus musculus
aaatctatataggcaaaggtgattt

SEQ ID NO: 159451 - DNA, 25 bp, Mus musculus
aaatctatcaaaggtgatttcaatc

SEQ ID NO: 159452 - DNA, 25 bp, Mus musculus
aaatctatgaaagccctggtttggt

SEQ ID NO: 159453 - DNA, 25 bp, Mus musculus
aaatctatgaaatcagcaaccgctg

SEQ ID NO: 159454 - DNA, 25 bp, Mus musculus
aaatctatgggcatgctagcaaaaa

SEQ ID NO: 159455 - DNA, 25 bp, Mus musculus
aaatctatgggcatggcatcgtctt

SEQ ID NO: 159456 - DNA, 25 bp, Mus musculus
aaatctattacaggtgaatacattg

SEQ ID NO: 159457 - DNA, 25 bp, Mus musculus
aaatctattcagtattaatataaac

SEQ ID NO: 159458 - DNA, 25 bp, Mus musculus
aaatctcaagaaaggatggatgatc

SEQ ID NO: 159459 - DNA, 25 bp, Mus musculus
aaatctcaagaaggtggatttttcc

SEQ ID NO: 159460 - DNA, 25 bp, Mus musculus
aaatctcaagacaaaaagatattta

SEQ ID NO: 159461 - DNA, 25 bp, Mus musculus
aaatctcaagctgcgagcctgcgga

SEQ ID NO: 159462 - DNA, 25 bp, Mus musculus
aaatctcaaggtctatcctaaagta

SEQ ID NO: 159463 - DNA, 25 bp, Mus musculus
aaatctcagaaaatggctcctcggt

SEQ ID NO: 159464 - DNA, 25 bp, Mus musculus
aaatctccaggtcccgtcaggaagc

SEQ ID NO: 159465 - DNA, 25 bp, Mus musculus
aaatctctaaaactgaagcaccttc

SEQ ID NO: 159466 - DNA, 25 bp, Mus musculus
aaatctctaaaacttctatcatcct

SEQ ID NO: 159467 - DNA, 25 bp, Mus musculus
aaatctctcaaaggatcctgctggc

SEQ ID NO: 159468 - DNA, 25 bp, Mus musculus
aaatctctcaaaggatgacatttgc

SEQ ID NO: 159469 - DNA, 25 bp, Mus musculus
aaatctctgagcgtgccttcatcaa

SEQ ID NO: 159470 - DNA, 25 bp, Mus musculus
aaatctctttccgggtgaacagaga

SEQ ID NO: 159471 - DNA, 25 bp, Mus musculus
aaatctgaagtgcagcgtaagtatg

SEQ ID NO: 159472 - DNA, 25 bp, Mus musculus
aaatctgagagaggtgaaccaccaa

SEQ ID NO: 159473 - DNA, 25 bp, Mus musculus
aaatctgataactgatttgaatagg

SEQ ID NO: 159474 - DNA, 25 bp, Mus musculus
aaatctgataagtcctttgcaaaca

SEQ ID NO: 159475 - DNA, 25 bp, Mus musculus
aaatctgatagggaaaacatcagag

SEQ ID NO: 159476 - DNA, 25 bp, Mus musculus
aaatctgcacttcgtggggagcagg

SEQ ID NO: 159477 - DNA, 25 bp, Mus musculus
aaatctgcagatctcataggatggt

SEQ ID NO: 159478 - DNA, 25 bp, Mus musculus
aaatctgcagatgtgaatcctaaat

SEQ ID NO: 159479 - DNA, 25 bp, Mus musculus
aaatctgctagcatagatattttga

SEQ ID NO: 159480 - DNA, 25 bp, Mus musculus
aaatctgggttagagatgagacctg

SEQ ID NO: 159481 - DNA, 25 bp, Mus musculus
aaatctggtaaagacgagatgctcc

SEQ ID NO: 159482 - DNA, 25 bp, Mus musculus
aaatctgtaacggaaggtgcatctg

SEQ ID NO: 159483 - DNA, 25 bp, Mus musculus
aaatctgtcagggccagagaacagc

SEQ ID NO: 159484 - DNA, 25 bp, Mus musculus
aaatctgtcagggggagatgactgc

SEQ ID NO: 159485 - DNA, 25 bp, Mus musculus
aaatctgtcaggtatacagatatgg

SEQ ID NO: 159486 - DNA, 25 bp, Mus musculus
aaatctgttcaacagcactgttgcc

SEQ ID NO: 159487 - DNA, 25 bp, Mus musculus
aaatctgttcaacagggaccaaatg

SEQ ID NO: 159488 - DNA, 25 bp, Mus musculus
aaatctgttggtgttctggctgatg

SEQ ID NO: 159489 - DNA, 25 bp, Mus musculus
aaatcttaaataaaggtatggcctc

SEQ ID NO: 159490 - DNA, 25 bp, Mus musculus
aaatcttacaggaggccacatggtg

SEQ ID NO: 159491 - DNA, 25 bp, Mus musculus
aaatcttatcagacaaagtaaatca

SEQ ID NO: 159492 - DNA, 25 bp, Mus musculus
aaatcttctcagatcatagcagaac

SEQ ID NO: 159493 - DNA, 25 bp, Mus musculus
aaatcttgcatctgaaagctgggtg

SEQ ID NO: 159494 - DNA, 25 bp, Mus musculus
aaatcttgcatgacaacctggactg

SEQ ID NO: 159495 - DNA, 25 bp, Mus musculus
aaatcttgggaagagacaaagacat

SEQ ID NO: 159496 - DNA, 25 bp, Mus musculus
aaatctttaaaatcgatcaaatggg

SEQ ID NO: 159497 - DNA, 25 bp, Mus musculus
aaatctttaagctgggaggaagaga

SEQ ID NO: 159498 - DNA, 25 bp, Mus musculus
aaatctttcaacgccaaccactctg

SEQ ID NO: 159499 - DNA, 25 bp, Mus musculus
aaatgaaaaaggcccaagaggatgc

SEQ ID NO: 159500 - DNA, 25 bp, Mus musculus
aaatgaaaaaggttaaggagctgaa

SEQ ID NO: 159501 - DNA, 25 bp, Mus musculus
aaatgaaaaatatggaattgccatg

SEQ ID NO: 159502 - DNA, 25 bp, Mus musculus
aaatgaaaaatggaatgactgtact

SEQ ID NO: 159503 - DNA, 25 bp, Mus musculus
aaatgaaaactgagggagatgagac

SEQ ID NO: 159504 - DNA, 25 bp, Mus musculus
aaatgaaaagatgaaaactttattc

SEQ ID NO: 159505 - DNA, 25 bp, Mus musculus
aaatgaaagctcaggactctcggct

SEQ ID NO: 159506 - DNA, 25 bp, Mus musculus
aaatgaaagtggatcagcatggaga

SEQ ID NO: 159507 - DNA, 25 bp, Mus musculus
aaatgaaatgtctggatgctaatga

SEQ ID NO: 159508 - DNA, 25 bp, Mus musculus
aaatgaaatgtgcagagccagtgtt

SEQ ID NO: 159509 - DNA, 25 bp, Mus musculus
aaatgaaattggacaggtccttcat

SEQ ID NO: 159510 - DNA, 25 bp, Mus musculus
aaatgaacaagctgagtatgagttt

SEQ ID NO: 159511 - DNA, 25 bp, Mus musculus
aaatgaacagctctggagtgcacag

SEQ ID NO: 159512 - DNA, 25 bp, Mus musculus
aaatgaacaggcaccacgccccact

SEQ ID NO: 159513 - DNA, 25 bp, Mus musculus
aaatgaacaggcctattcctggcca

SEQ ID NO: 159514 - DNA, 25 bp, Mus musculus
aaatgaacaggtgtgcggaccaaaa

SEQ ID NO: 159515 - DNA, 25 bp, Mus musculus
aaatgaaccgtgaggggaactggta

SEQ ID NO: 159516 - DNA, 25 bp, Mus musculus
aaatgaagaaagaacatgcatacca

SEQ ID NO: 159517 - DNA, 25 bp, Mus musculus
aaatgaagaagatgggcttaggtca

SEQ ID NO: 159518 - DNA, 25 bp, Mus musculus
aaatgaagaagtggaactatggaca

SEQ ID NO: 159519 - DNA, 25 bp, Mus musculus
aaatgaagagataggcgctcacatc

SEQ ID NO: 159520 - DNA, 25 bp, Mus musculus
aaatgaagagatggttacgccccaa

SEQ ID NO: 159521 - DNA, 25 bp, Mus musculus
aaatgaagaggtgtttatggagatg

SEQ ID NO: 159522 - DNA, 25 bp, Mus musculus
aaatgaagccatgtgcacagccctg

SEQ ID NO: 159523 - DNA, 25 bp, Mus musculus
aaatgaagctgaaggcatcatagac

SEQ ID NO: 159524 - DNA, 25 bp, Mus musculus
aaatgaaggaggaattttattgagc

SEQ ID NO: 159525 - DNA, 25 bp, Mus musculus
aaatgaaggaggcaagtcttctggc

SEQ ID NO: 159526 - DNA, 25 bp, Mus musculus
aaatgaatactcagcaatgtgggct

SEQ ID NO: 159527 - DNA, 25 bp, Mus musculus
aaatgaatactcaggatactgggaa

SEQ ID NO: 159528 - DNA, 25 bp, Mus musculus
aaatgaatctgatcctggcctgtgt

SEQ ID NO: 159529 - DNA, 25 bp, Mus musculus
aaatgaatttcaaggggctgaggcg

SEQ ID NO: 159530 - DNA, 25 bp, Mus musculus
aaatgacaatgaagaaaggaagtgg

SEQ ID NO: 159531 - DNA, 25 bp, Mus musculus
aaatgacacatgatgctatcatgaa

SEQ ID NO: 159532 - DNA, 25 bp, Mus musculus
aaatgacacatgatggctatttgaa

SEQ ID NO: 159533 - DNA, 25 bp, Mus musculus
aaatgacatttctgttggaggcctc

SEQ ID NO: 159534 - DNA, 25 bp, Mus musculus
aaatgaccaaggaccctctgtcatt

SEQ ID NO: 159535 - DNA, 25 bp, Mus musculus
aaatgaccgaggtgaaggcagctac

SEQ ID NO: 159536 - DNA, 25 bp, Mus musculus
aaatgactaagtacctacagtccaa

SEQ ID NO: 159537 - DNA, 25 bp, Mus musculus
aaatgactaagttacagtgctagca

SEQ ID NO: 159538 - DNA, 25 bp, Mus musculus
aaatgactgaccgggagagggataa

SEQ ID NO: 159539 - DNA, 25 bp, Mus musculus
aaatgactgcaagattatttatgtg

SEQ ID NO: 159540 - DNA, 25 bp, Mus musculus
aaatgactggcatggaggtgcaatc

SEQ ID NO: 159541 - DNA, 25 bp, Mus musculus
aaatgactgggaaggatttaatgcc

SEQ ID NO: 159542 - DNA, 25 bp, Mus musculus
aaatgacttcgcactgaaaatcaaa

SEQ ID NO: 159543 - DNA, 25 bp, Mus musculus
aaatgacttcggagatgataggagg

SEQ ID NO: 159544 - DNA, 25 bp, Mus musculus
aaatgagaaagaagggagcctagct

SEQ ID NO: 159545 - DNA, 25 bp, Mus musculus
aaatgagaaagatatagcaggttct

SEQ ID NO: 159546 - DNA, 25 bp, Mus musculus
aaatgagaaagattctgaagcaagt

SEQ ID NO: 159547 - DNA, 25 bp, Mus musculus
aaatgagaagaattcagggatacac

SEQ ID NO: 159548 - DNA, 25 bp, Mus musculus
aaatgagaagagaagacactaccac

SEQ ID NO: 159549 - DNA, 25 bp, Mus musculus
aaatgagacgagaatgatgtcactg

SEQ ID NO: 159550 - DNA, 25 bp, Mus musculus
aaatgagacggaagctgccactttt

SEQ ID NO: 159551 - DNA, 25 bp, Mus musculus
aaatgagacgtgctggagatcaaag

SEQ ID NO: 159552 - DNA, 25 bp, Mus musculus
aaatgagagctcagccctagtcgag

SEQ ID NO: 159553 - DNA, 25 bp, Mus musculus
aaatgagatatttgtggtagtgtga

SEQ ID NO: 159554 - DNA, 25 bp, Mus musculus
aaatgagcaaagccaaacaccatgt

SEQ ID NO: 159555 - DNA, 25 bp, Mus musculus
aaatgagcaatctgtaaagaaaacg

SEQ ID NO: 159556 - DNA, 25 bp, Mus musculus
aaatgagctgaacattatccacaag

SEQ ID NO: 159557 - DNA, 25 bp, Mus musculus
aaatgaggaccagtgggcatgggtc

SEQ ID NO: 159558 - DNA, 25 bp, Mus musculus
aaatgagggtagcaggagctgcaaa

SEQ ID NO: 159559 - DNA, 25 bp, Mus musculus
aaatgagtaagagatttgaaaaatt

SEQ ID NO: 159560 - DNA, 25 bp, Mus musculus
aaatgagtattttgatgttgccttc

SEQ ID NO: 159561 - DNA, 25 bp, Mus musculus
aaatgagtattttggtataggcaga

SEQ ID NO: 159562 - DNA, 25 bp, Mus musculus
aaatgataacagagcaacccgatag

SEQ ID NO: 159563 - DNA, 25 bp, Mus musculus
aaatgataacagagcatacaagcaa

SEQ ID NO: 159564 - DNA, 25 bp, Mus musculus
aaatgataacagagtcaatcccctt

SEQ ID NO: 159565 - DNA, 25 bp, Mus musculus
aaatgataagaatggcacacgaaac

SEQ ID NO: 159566 - DNA, 25 bp, Mus musculus
aaatgataagctgaatgatatggaa

SEQ ID NO: 159567 - DNA, 25 bp, Mus musculus
aaatgataagctgggtaaaactcca

SEQ ID NO: 159568 - DNA, 25 bp, Mus musculus
aaatgataaggaacatgacattgaa

SEQ ID NO: 159569 - DNA, 25 bp, Mus musculus
aaatgatccagaaagatcaagagca

SEQ ID NO: 159570 - DNA, 25 bp, Mus musculus
aaatgatccaggtactgcagggtgc

SEQ ID NO: 159571 - DNA, 25 bp, Mus musculus
aaatgatctccaaggactcaggcag

SEQ ID NO: 159572 - DNA, 25 bp, Mus musculus
aaatgatcttgaactcacagaagga

SEQ ID NO: 159573 - DNA, 25 bp, Mus musculus
aaatgatgaaaggcatccttacttc

SEQ ID NO: 159574 - DNA, 25 bp, Mus musculus
aaatgatgaatggcaagtgactgtc

SEQ ID NO: 159575 - DNA, 25 bp, Mus musculus
aaatgatgaatggcagtcactacag

SEQ ID NO: 159576 - DNA, 25 bp, Mus musculus
aaatgatggcagagtgttcaacttc

SEQ ID NO: 159577 - DNA, 25 bp, Mus musculus
aaatgatgtttacaagtatgagacc

SEQ ID NO: 159578 - DNA, 25 bp, Mus musculus
aaatgattcggatatcaggatagtt

SEQ ID NO: 159579 - DNA, 25 bp, Mus musculus
aaatgattcgtccaaggcggttggc

SEQ ID NO: 159580 - DNA, 25 bp, Mus musculus
aaatgattgactctggtgtgagata

SEQ ID NO: 159581 - DNA, 25 bp, Mus musculus
aaatgattggacagcctgccgggcc

SEQ ID NO: 159582 - DNA, 25 bp, Mus musculus
aaatgattggacaggcatcaagatt

SEQ ID NO: 159583 - DNA, 25 bp, Mus musculus
aaatgcaaaaggaccctgatagaac

SEQ ID NO: 159584 - DNA, 25 bp, Mus musculus
aaatgcaaaggcaggaaggagccaa

SEQ ID NO: 159585 - DNA, 25 bp, Mus musculus
aaatgcaaaggtttcatcacttcat

SEQ ID NO: 159586 - DNA, 25 bp, Mus musculus
aaatgcaagtttgtcaatatacagt

SEQ ID NO: 159587 - DNA, 25 bp, Mus musculus
aaatgcagaaagcaggattcctcta

SEQ ID NO: 159588 - DNA, 25 bp, Mus musculus
aaatgcagaaagcaggtcatccggg

SEQ ID NO: 159589 - DNA, 25 bp, Mus musculus
aaatgcagaatgcagagtacagttg

SEQ ID NO: 159590 - DNA, 25 bp, Mus musculus
aaatgcagaatgcaggtggaccctc

SEQ ID NO: 159591 - DNA, 25 bp, Mus musculus
aaatgcagacgtcttgtagaaattt

SEQ ID NO: 159592 - DNA, 25 bp, Mus musculus
aaatgcagagcaggtttgacatggc

SEQ ID NO: 159593 - DNA, 25 bp, Mus musculus
aaatgcaggctacgaatttaaagag

SEQ ID NO: 159594 - DNA, 25 bp, Mus musculus
aaatgcagtggctggcatgctacaa

SEQ ID NO: 159595 - DNA, 25 bp, Mus musculus
aaatgcataagttggttgatcgtgt

SEQ ID NO: 159596 - DNA, 25 bp, Mus musculus
aaatgcattcagaggtggggtaagt

SEQ ID NO: 159597 - DNA, 25 bp, Mus musculus
aaatgccagtaacaggcacatccag

SEQ ID NO: 159598 - DNA, 25 bp, Mus musculus
aaatgcccagctcctaacctcgagg

SEQ ID NO: 159599 - DNA, 25 bp, Mus musculus
aaatgccgagctgccacaggcaccg

SEQ ID NO: 159600 - DNA, 25 bp, Mus musculus
aaatgcctcagcccagcgtaagcgg

SEQ ID NO: 159601 - DNA, 25 bp, Mus musculus
aaatgcgaagggtatgtcggagacc

SEQ ID NO: 159602 - DNA, 25 bp, Mus musculus
aaatgcgaagtgtgcaagtatgttg

SEQ ID NO: 159603 - DNA, 25 bp, Mus musculus
aaatgcgactggaagaactaaagag

SEQ ID NO: 159604 - DNA, 25 bp, Mus musculus
aaatgcgactggtggcaattaacag

SEQ ID NO: 159605 - DNA, 25 bp, Mus musculus
aaatgcgccagttgatgaaggttgt

SEQ ID NO: 159606 - DNA, 25 bp, Mus musculus
aaatgcggttagtcgagaactgata

SEQ ID NO: 159607 - DNA, 25 bp, Mus musculus
aaatgcgttcacagagtgcaaattc

SEQ ID NO: 159608 - DNA, 25 bp, Mus musculus
aaatgctaaggtttatgggaccgtc

SEQ ID NO: 159609 - DNA, 25 bp, Mus musculus
aaatgctacaaagacatccttctac

SEQ ID NO: 159610 - DNA, 25 bp, Mus musculus
aaatgctatgtgctgagccacctct

SEQ ID NO: 159611 - DNA, 25 bp, Mus musculus
aaatgctcccgctaagtcgtcagcg

SEQ ID NO: 159612 - DNA, 25 bp, Mus musculus
aaatgctcccgctagtgttgcagag

SEQ ID NO: 159613 - DNA, 25 bp, Mus musculus
aaatgctgaaggacgcattcagctt

SEQ ID NO: 159614 - DNA, 25 bp, Mus musculus
aaatgctgagatggtgcagtcactg

SEQ ID NO: 159615 - DNA, 25 bp, Mus musculus
aaatgctgcaagcaccttctagcac

SEQ ID NO: 159616 - DNA, 25 bp, Mus musculus
aaatgctgcaagtatagaacattgc

SEQ ID NO: 159617 - DNA, 25 bp, Mus musculus
aaatgctgctgacatgttctactgg

SEQ ID NO: 159618 - DNA, 25 bp, Mus musculus
aaatgctggaccctcccaggcccaa

SEQ ID NO: 159619 - DNA, 25 bp, Mus musculus
aaatgcttcagggccgcctttttgc

SEQ ID NO: 159620 - DNA, 25 bp, Mus musculus
aaatgcttccagagtcttgtgatat

SEQ ID NO: 159621 - DNA, 25 bp, Mus musculus
aaatgcttcgagaacagaaagagca

SEQ ID NO: 159622 - DNA, 25 bp, Mus musculus
aaatgcttgggtaagcagtggattc

SEQ ID NO: 159623 - DNA, 25 bp, Mus musculus
aaatgcttgggtcaccagtggattc

SEQ ID NO: 159624 - DNA, 25 bp, Mus musculus
aaatgcttgttaaggctgctgaaaa

SEQ ID NO: 159625 - DNA, 25 bp, Mus musculus
aaatggaaaaacagctctcctctca

SEQ ID NO: 159626 - DNA, 25 bp, Mus musculus
aaatggaacaaggacctctgcttgc

SEQ ID NO: 159627 - DNA, 25 bp, Mus musculus
aaatggaacaagtacaaccctcagc

SEQ ID NO: 159628 - DNA, 25 bp, Mus musculus
aaatggaactagtaacaaggacgag

SEQ ID NO: 159629 - DNA, 25 bp, Mus musculus
aaatggaagaaggtatcaactggca

SEQ ID NO: 159630 - DNA, 25 bp, Mus musculus
aaatggacacgctccccagaggtcc

SEQ ID NO: 159631 - DNA, 25 bp, Mus musculus
aaatggacaggaatctgaatttttg

SEQ ID NO: 159632 - DNA, 25 bp, Mus musculus
aaatggacagttgtctcaaaagggc

SEQ ID NO: 159633 - DNA, 25 bp, Mus musculus
aaatggacggacaaaggagacaaca

SEQ ID NO: 159634 - DNA, 25 bp, Mus musculus
aaatggacggaggaagtgtgaacgc

SEQ ID NO: 159635 - DNA, 25 bp, Mus musculus
aaatggacgttcagagttactacct

SEQ ID NO: 159636 - DNA, 25 bp, Mus musculus
aaatggactttttgatcgatgatga

SEQ ID NO: 159637 - DNA, 25 bp, Mus musculus
aaatggagacccaggtgataactcc

SEQ ID NO: 159638 - DNA, 25 bp, Mus musculus
aaatggagagaggtaagaagtatgg

SEQ ID NO: 159639 - DNA, 25 bp, Mus musculus
aaatggagagcaaagaaccccagct

SEQ ID NO: 159640 - DNA, 25 bp, Mus musculus
aaatggagaggaaggcgcgggctgg

SEQ ID NO: 159641 - DNA, 25 bp, Mus musculus
aaatggagagtctggatgtggatag

SEQ ID NO: 159642 - DNA, 25 bp, Mus musculus
aaatggagatataatcatgtgtgca

SEQ ID NO: 159643 - DNA, 25 bp, Mus musculus
aaatggagcaaagaactgagattgc

SEQ ID NO: 159644 - DNA, 25 bp, Mus musculus
aaatggagcaaaggcaccatcggtt

SEQ ID NO: 159645 - DNA, 25 bp, Mus musculus
aaatggagcaggagccctgcctagc

SEQ ID NO: 159646 - DNA, 25 bp, Mus musculus
aaatggaggaaaggttacagcaggc

SEQ ID NO: 159647 - DNA, 25 bp, Mus musculus
aaatggatacacaactattgtccca

SEQ ID NO: 159648 - DNA, 25 bp, Mus musculus
aaatggatccaccagcactgccccc

SEQ ID NO: 159649 - DNA, 25 bp, Mus musculus
aaatggatcccactgatgccaagta

SEQ ID NO: 159650 - DNA, 25 bp, Mus musculus
aaatggatccttgctaatttgaaat

SEQ ID NO: 159651 - DNA, 25 bp, Mus musculus
aaatggatctgctgcgaaagccatc

SEQ ID NO: 159652 - DNA, 25 bp, Mus musculus
aaatggattaaagctatcccctctg

SEQ ID NO: 159653 - DNA, 25 bp, Mus musculus
aaatggcaaagtacccaggcaagac

SEQ ID NO: 159654 - DNA, 25 bp, Mus musculus
aaatggcaacctcctctgacctctg

SEQ ID NO: 159655 - DNA, 25 bp, Mus musculus
aaatggccatgataacagctatctt

SEQ ID NO: 159656 - DNA, 25 bp, Mus musculus
aaatggccatgtcagggatgagagg

SEQ ID NO: 159657 - DNA, 25 bp, Mus musculus
aaatggcccatgattttgttcttta

SEQ ID NO: 159658 - DNA, 25 bp, Mus musculus
aaatggcccatgtgctctgtaacag

SEQ ID NO: 159659 - DNA, 25 bp, Mus musculus
aaatggcccattgaaaagagtcatc

SEQ ID NO: 159660 - DNA, 25 bp, Mus musculus
aaatggctcaagcaggaacctagca

SEQ ID NO: 159661 - DNA, 25 bp, Mus musculus
aaatggctcaagcagggccacaatg

SEQ ID NO: 159662 - DNA, 25 bp, Mus musculus
aaatggctcaagcaggtaacaaatc

SEQ ID NO: 159663 - DNA, 25 bp, Mus musculus
aaatggctcaaggaacagtgagcag

SEQ ID NO: 159664 - DNA, 25 bp, Mus musculus
aaatggctcagggggagcaccgtct

SEQ ID NO: 159665 - DNA, 25 bp, Mus musculus
aaatggctgacaaagagcttccact

SEQ ID NO: 159666 - DNA, 25 bp, Mus musculus
aaatggctgacaaagggcactggtt

SEQ ID NO: 159667 - DNA, 25 bp, Mus musculus
aaatgggacaggagacaattacaat

SEQ ID NO: 159668 - DNA, 25 bp, Mus musculus
aaatgggacaggagtgtctcttctt

SEQ ID NO: 159669 - DNA, 25 bp, Mus musculus
aaatgggacctcacctacccaaagc

SEQ ID NO: 159670 - DNA, 25 bp, Mus musculus
aaatgggacctcagagtaatataaa

SEQ ID NO: 159671 - DNA, 25 bp, Mus musculus
aaatgggaggaggcacttgaatatt

SEQ ID NO: 159672 - DNA, 25 bp, Mus musculus
aaatgggcaaggtgaaattggtgca

SEQ ID NO: 159673 - DNA, 25 bp, Mus musculus
aaatgggcagagagaaatgtcacca

SEQ ID NO: 159674 - DNA, 25 bp, Mus musculus
aaatgggccaaggaaaatgatgaag

SEQ ID NO: 159675 - DNA, 25 bp, Mus musculus
aaatgggccagatacaatttgttta

SEQ ID NO: 159676 - DNA, 25 bp, Mus musculus
aaatggggcttctagccagagccat

SEQ ID NO: 159677 - DNA, 25 bp, Mus musculus
aaatggtcatcagagctgtactggc

SEQ ID NO: 159678 - DNA, 25 bp, Mus musculus
aaatggtcatcagtgtcctcctatc

SEQ ID NO: 159679 - DNA, 25 bp, Mus musculus
aaatggtcgatgaagagtttgattt

SEQ ID NO: 159680 - DNA, 25 bp, Mus musculus
aaatggtcgatggtggatgtacagt

SEQ ID NO: 159681 - DNA, 25 bp, Mus musculus
aaatggtctagcaagccgggtatcc

SEQ ID NO: 159682 - DNA, 25 bp, Mus musculus
aaatggtctagcaagggcaatgaca

SEQ ID NO: 159683 - DNA, 25 bp, Mus musculus
aaatggtgagcccatcttctgatac

SEQ ID NO: 159684 - DNA, 25 bp, Mus musculus
aaatggtgaggccatcttctgatac

SEQ ID NO: 159685 - DNA, 25 bp, Mus musculus
aaatggtgtataatgaatttcagaa

SEQ ID NO: 159686 - DNA, 25 bp, Mus musculus
aaatggtgtataatggcatttgagc

SEQ ID NO: 159687 - DNA, 25 bp, Mus musculus
aaatggttcctcagaacctgggagg

SEQ ID NO: 159688 - DNA, 25 bp, Mus musculus
aaatggttgaagacacaggaggcag

SEQ ID NO: 159689 - DNA, 25 bp, Mus musculus
aaatggtttacagactgttttccaa

SEQ ID NO: 159690 - DNA, 25 bp, Mus musculus
aaatggtttacaggtttactgctag

SEQ ID NO: 159691 - DNA, 25 bp, Mus musculus
aaatggtttgcgtttgcagtatgaa

SEQ ID NO: 159692 - DNA, 25 bp, Mus musculus
aaatgtaacagagggaaaacagttg

SEQ ID NO: 159693 - DNA, 25 bp, Mus musculus
aaatgtaacagagggttcccatctc

SEQ ID NO: 159694 - DNA, 25 bp, Mus musculus
aaatgtaacagagggtttgaagatc

SEQ ID NO: 159695 - DNA, 25 bp, Mus musculus
aaatgtaagtatgccatttgtcaca

SEQ ID NO: 159696 - DNA, 25 bp, Mus musculus
aaatgtacagagaaatttgtatgaa

SEQ ID NO: 159697 - DNA, 25 bp, Mus musculus
aaatgtacaggagctgaagttcctc

SEQ ID NO: 159698 - DNA, 25 bp, Mus musculus
aaatgtacagtctaaatccagtgaa

SEQ ID NO: 159699 - DNA, 25 bp, Mus musculus
aaatgtactcaattagcatgacagg

SEQ ID NO: 159700 - DNA, 25 bp, Mus musculus
aaatgtattgaggaaaaggagaagg

SEQ ID NO: 159701 - DNA, 25 bp, Mus musculus
aaatgtcaaagctggcaagatgtca

SEQ ID NO: 159702 - DNA, 25 bp, Mus musculus
aaatgtcaaaggatgaccttgatct

SEQ ID NO: 159703 - DNA, 25 bp, Mus musculus
aaatgtcaaggtatacatctattct

SEQ ID NO: 159704 - DNA, 25 bp, Mus musculus
aaatgtcaccttcagctacccctgc

SEQ ID NO: 159705 - DNA, 25 bp, Mus musculus
aaatgtcagccatgcaagtgcaatg

SEQ ID NO: 159706 - DNA, 25 bp, Mus musculus
aaatgtcagtgcgattcccaacttt

SEQ ID NO: 159707 - DNA, 25 bp, Mus musculus
aaatgtcatcaaagggaatgatgaa

SEQ ID NO: 159708 - DNA, 25 bp, Mus musculus
aaatgtcatcaaagggtctgagtgg

SEQ ID NO: 159709 - DNA, 25 bp, Mus musculus
aaatgtccacaccggtgatcctaag

SEQ ID NO: 159710 - DNA, 25 bp, Mus musculus
aaatgtcccaggccgctagtcagac

SEQ ID NO: 159711 - DNA, 25 bp, Mus musculus
aaatgtcccagggcggcaatctgct

SEQ ID NO: 159712 - DNA, 25 bp, Mus musculus
aaatgtcctgcagggtttcaaagat

SEQ ID NO: 159713 - DNA, 25 bp, Mus musculus
aaatgtctacgaagagatctcaaga

SEQ ID NO: 159714 - DNA, 25 bp, Mus musculus
aaatgtctacgagaagatctcaaga

SEQ ID NO: 159715 - DNA, 25 bp, Mus musculus
aaatgtgaaaaagtattcaaacata

SEQ ID NO: 159716 - DNA, 25 bp, Mus musculus
aaatgtgaaacgctaccattgtggc

SEQ ID NO: 159717 - DNA, 25 bp, Mus musculus
aaatgtgaaaggctaccttggaccg

SEQ ID NO: 159718 - DNA, 25 bp, Mus musculus
aaatgtgaaaggctggcacagaagt

SEQ ID NO: 159719 - DNA, 25 bp, Mus musculus
aaatgtgaaggggctctttcctgca

SEQ ID NO: 159720 - DNA, 25 bp, Mus musculus
aaatgtgaaggttggtacagaggag

SEQ ID NO: 159721 - DNA, 25 bp, Mus musculus
aaatgtgacaggctaaactgtgaca

SEQ ID NO: 159722 - DNA, 25 bp, Mus musculus
aaatgtgatgcatgtggcatgaacg

SEQ ID NO: 159723 - DNA, 25 bp, Mus musculus
aaatgtgcagattgtgggttgaatg

SEQ ID NO: 159724 - DNA, 25 bp, Mus musculus
aaatgtgcagccaagaagtccagga

SEQ ID NO: 159725 - DNA, 25 bp, Mus musculus
aaatgtgctggccatgcctttttat

SEQ ID NO: 159726 - DNA, 25 bp, Mus musculus
aaatgtggaagaggaaccgggcaaa

SEQ ID NO: 159727 - DNA, 25 bp, Mus musculus
aaatgtggctaccctggtcatctga

SEQ ID NO: 159728 - DNA, 25 bp, Mus musculus
aaatgtgggcgaggaatcttatggc

SEQ ID NO: 159729 - DNA, 25 bp, Mus musculus
aaatgtggggctggcatggaaaata

SEQ ID NO: 159730 - DNA, 25 bp, Mus musculus
aaatgtggggctggtgtcaggcatg

SEQ ID NO: 159731 - DNA, 25 bp, Mus musculus
aaatgtgtaagcggccatgtattct

SEQ ID NO: 159732 - DNA, 25 bp, Mus musculus
aaatgtgtaagcggtatttggaggt

SEQ ID NO: 159733 - DNA, 25 bp, Mus musculus
aaatgtgtaagctgctggctctaca

SEQ ID NO: 159734 - DNA, 25 bp, Mus musculus
aaatgtgtccccagaaccaaggaga

SEQ ID NO: 159735 - DNA, 25 bp, Mus musculus
aaatgtgttcaagaacaaggttggc

SEQ ID NO: 159736 - DNA, 25 bp, Mus musculus
aaatgtgttgcaacagaccaactgg

SEQ ID NO: 159737 - DNA, 25 bp, Mus musculus
aaatgttaaaatgtgtcccctgcac

SEQ ID NO: 159738 - DNA, 25 bp, Mus musculus
aaatgttacaggcatcaaaaagttt

SEQ ID NO: 159739 - DNA, 25 bp, Mus musculus
aaatgttacaggtcatggaaaatgg

SEQ ID NO: 159740 - DNA, 25 bp, Mus musculus
aaatgttgcttgatggtgaaattga

SEQ ID NO: 159741 - DNA, 25 bp, Mus musculus
aaatgttgggcgaagatctgcaagt

SEQ ID NO: 159742 - DNA, 25 bp, Mus musculus
aaatgttgggcgtgtgcatgtagcc

SEQ ID NO: 159743 - DNA, 25 bp, Mus musculus
aaatgttgtggcagaataccagagt

SEQ ID NO: 159744 - DNA, 25 bp, Mus musculus
aaatgttgtgtcctctgttgtgcat

SEQ ID NO: 159745 - DNA, 25 bp, Mus musculus
aaatgtttacaagccaacaactatt

SEQ ID NO: 159746 - DNA, 25 bp, Mus musculus
aaatgtttccaaggatctgttaaga

SEQ ID NO: 159747 - DNA, 25 bp, Mus musculus
aaatgtttccaagtgttcatggatg

SEQ ID NO: 159748 - DNA, 25 bp, Mus musculus
aaatgtttctggtggaacaccagta

SEQ ID NO: 159749 - DNA, 25 bp, Mus musculus
aaatgtttctgtgtgagtgcatgcg

SEQ ID NO: 159750 - DNA, 25 bp, Mus musculus
aaatgtttgaagcgacagcagtctc

SEQ ID NO: 159751 - DNA, 25 bp, Mus musculus
aaatgtttgccagaaatgtgcaaac

SEQ ID NO: 159752 - DNA, 25 bp, Mus musculus
aaatgtttgccagacacgcgaaaag

SEQ ID NO: 159753 - DNA, 25 bp, Mus musculus
aaatgtttggtcaatttggtaaaat

SEQ ID NO: 159754 - DNA, 25 bp, Mus musculus
aaatgttttctggagtgacactagc

SEQ ID NO: 159755 - DNA, 25 bp, Mus musculus
aaattaaaaatgatgtcttcatttg

SEQ ID NO: 159756 - DNA, 25 bp, Mus musculus
aaattaaacctaatgcttgcattgg

SEQ ID NO: 159757 - DNA, 25 bp, Mus musculus
aaattaaagaagtataataagccca

SEQ ID NO: 159758 - DNA, 25 bp, Mus musculus
aaattaaagtggcagcttgacttgg

SEQ ID NO: 159759 - DNA, 25 bp, Mus musculus
aaattaaatgccttgatgggaaccc

SEQ ID NO: 159760 - DNA, 25 bp, Mus musculus
aaattaacagagtgtccaagcacga

SEQ ID NO: 159761 - DNA, 25 bp, Mus musculus
aaattaagacgaagatggccaagct

SEQ ID NO: 159762 - DNA, 25 bp, Mus musculus
aaattaagacgaagggcaaggaggc

SEQ ID NO: 159763 - DNA, 25 bp, Mus musculus
aaattaatatatgatcctgaaaaag

SEQ ID NO: 159764 - DNA, 25 bp, Mus musculus
aaattaatgtggcagatatcattaa

SEQ ID NO: 159765 - DNA, 25 bp, Mus musculus
aaattacaaatacgatacactaaag

SEQ ID NO: 159766 - DNA, 25 bp, Mus musculus
aaattacacaaacattacttcatat

SEQ ID NO: 159767 - DNA, 25 bp, Mus musculus
aaattaccccaagcattcttgaagt

SEQ ID NO: 159768 - DNA, 25 bp, Mus musculus
aaattaccctaagttatacattgat

SEQ ID NO: 159769 - DNA, 25 bp, Mus musculus
aaattacctgagcacccagttgatg

SEQ ID NO: 159770 - DNA, 25 bp, Mus musculus
aaattacgtgaagagagggcacatc

SEQ ID NO: 159771 - DNA, 25 bp, Mus musculus
aaattactatagagaataggtcaaa

SEQ ID NO: 159772 - DNA, 25 bp, Mus musculus
aaattactataggctgcagaagagg

SEQ ID NO: 159773 - DNA, 25 bp, Mus musculus
aaattactgcaacagctttttctaa

SEQ ID NO: 159774 - DNA, 25 bp, Mus musculus
aaattagatggcttccctttccctc

SEQ ID NO: 159775 - DNA, 25 bp, Mus musculus
aaattagcatctgacattgagattc

SEQ ID NO: 159776 - DNA, 25 bp, Mus musculus
aaattagcttttatggcgcgagctt

SEQ ID NO: 159777 - DNA, 25 bp, Mus musculus
aaattaggagttgaatgcccaaagg

SEQ ID NO: 159778 - DNA, 25 bp, Mus musculus
aaattaggcagcaaaacataaagaa

SEQ ID NO: 159779 - DNA, 25 bp, Mus musculus
aaattagtgcaggaaaacccaacca

SEQ ID NO: 159780 - DNA, 25 bp, Mus musculus
aaattataagcaaattctacggtga

SEQ ID NO: 159781 - DNA, 25 bp, Mus musculus
aaattataatcaggctggccagcta

SEQ ID NO: 159782 - DNA, 25 bp, Mus musculus
aaattataattgcttctacttctca

SEQ ID NO: 159783 - DNA, 25 bp, Mus musculus
aaattatatggtttgacggatgaaa

SEQ ID NO: 159784 - DNA, 25 bp, Mus musculus
aaattatcatccaggccattcccca

SEQ ID NO: 159785 - DNA, 25 bp, Mus musculus
aaattatccttaagatgactgctta

SEQ ID NO: 159786 - DNA, 25 bp, Mus musculus
aaattatgaacagattgatgacatt

SEQ ID NO: 159787 - DNA, 25 bp, Mus musculus
aaattatgacactatttttgaagac

SEQ ID NO: 159788 - DNA, 25 bp, Mus musculus
aaattattagggatgccagtaaagc

SEQ ID NO: 159789 - DNA, 25 bp, Mus musculus
aaattattcaagaacaggacgcggg

SEQ ID NO: 159790 - DNA, 25 bp, Mus musculus
aaattattcaagagatcatcgatga

SEQ ID NO: 159791 - DNA, 25 bp, Mus musculus
aaattattgttaaaggaaattcgat

SEQ ID NO: 159792 - DNA, 25 bp, Mus musculus
aaattatttcagagtgccagaaggc

SEQ ID NO: 159793 - DNA, 25 bp, Mus musculus
aaattatttcaggtggatctaaaga

SEQ ID NO: 159794 - DNA, 25 bp, Mus musculus
aaattcaagtgacaatgccttagcc

SEQ ID NO: 159795 - DNA, 25 bp, Mus musculus
aaattcaagttttttgatttgtcta

SEQ ID NO: 159796 - DNA, 25 bp, Mus musculus
aaattcacaaaagggaaggatctgt

SEQ ID NO: 159797 - DNA, 25 bp, Mus musculus
aaattcacatgagctgtttcagaaa

SEQ ID NO: 159798 - DNA, 25 bp, Mus musculus
aaattcacattcaggcacaccaaga

SEQ ID NO: 159799 - DNA, 25 bp, Mus musculus
aaattcacgacgggatgtttcggaa

SEQ ID NO: 159800 - DNA, 25 bp, Mus musculus
aaattcactgttcagcccacagtga

SEQ ID NO: 159801 - DNA, 25 bp, Mus musculus
aaattcactgttcaggcatccgaag

SEQ ID NO: 159802 - DNA, 25 bp, Mus musculus
aaattcagaaaggagttcgtgaagt

SEQ ID NO: 159803 - DNA, 25 bp, Mus musculus
aaattcagagactgcctctttaagc

SEQ ID NO: 159804 - DNA, 25 bp, Mus musculus
aaattcatagtgaccatctttccac

SEQ ID NO: 159805 - DNA, 25 bp, Mus musculus
aaattcatatgggtaactgtgctga

SEQ ID NO: 159806 - DNA, 25 bp, Mus musculus
aaattcatgaacgagtttttcttaa

SEQ ID NO: 159807 - DNA, 25 bp, Mus musculus
aaattcatgcagatgaatgagaaca

SEQ ID NO: 159808 - DNA, 25 bp, Mus musculus
aaattcatgcgagggagaactggtg

SEQ ID NO: 159809 - DNA, 25 bp, Mus musculus
aaattccaaaacactgtaacatggc

SEQ ID NO: 159810 - DNA, 25 bp, Mus musculus
aaattccaagcaattttcaacatgg

SEQ ID NO: 159811 - DNA, 25 bp, Mus musculus
aaattccaagccatcttctcttcga

SEQ ID NO: 159812 - DNA, 25 bp, Mus musculus
aaattccaaggaacctggtggccat

SEQ ID NO: 159813 - DNA, 25 bp, Mus musculus
aaattccaaggtccccctggagcct

SEQ ID NO: 159814 - DNA, 25 bp, Mus musculus
aaattccaaggtgtgagactgctga

SEQ ID NO: 159815 - DNA, 25 bp, Mus musculus
aaattccacaagctgatcaacgtca

SEQ ID NO: 159816 - DNA, 25 bp, Mus musculus
aaattccaccagcagtatgagcccc

SEQ ID NO: 159817 - DNA, 25 bp, Mus musculus
aaattccaccccggccccagctgga

SEQ ID NO: 159818 - DNA, 25 bp, Mus musculus
aaattccacttgactgggacgtgga

SEQ ID NO: 159819 - DNA, 25 bp, Mus musculus
aaattccatattattataaatgagg

SEQ ID NO: 159820 - DNA, 25 bp, Mus musculus
aaattccatttaattgtaaatgaag

SEQ ID NO: 159821 - DNA, 25 bp, Mus musculus
aaattcccaatgagttgccatataa

SEQ ID NO: 159822 - DNA, 25 bp, Mus musculus
aaattcccaggtgaagcctttgatc

SEQ ID NO: 159823 - DNA, 25 bp, Mus musculus
aaattcccatctcatttgaaaatgt

SEQ ID NO: 159824 - DNA, 25 bp, Mus musculus
aaattcctcaaggagtcacctggga

SEQ ID NO: 159825 - DNA, 25 bp, Mus musculus
aaattcctcaaggcacttaggcaga

SEQ ID NO: 159826 - DNA, 25 bp, Mus musculus
aaattcctcaagggggaggataaga

SEQ ID NO: 159827 - DNA, 25 bp, Mus musculus
aaattcctgctgctgaactaacctt

SEQ ID NO: 159828 - DNA, 25 bp, Mus musculus
aaattccttcaggtgcacgcctcct

SEQ ID NO: 159829 - DNA, 25 bp, Mus musculus
aaattcgaactggtgttgatcagtg

SEQ ID NO: 159830 - DNA, 25 bp, Mus musculus
aaattcgcagggctatgtgctcaaa

SEQ ID NO: 159831 - DNA, 25 bp, Mus musculus
aaattctaagatgggatgtgaccag

SEQ ID NO: 159832 - DNA, 25 bp, Mus musculus
aaattctcaaaacccaatgatgagt

SEQ ID NO: 159833 - DNA, 25 bp, Mus musculus
aaattctcaaaatgttcaagccata

SEQ ID NO: 159834 - DNA, 25 bp, Mus musculus
aaattctcaagccagtaaaaaagaa

SEQ ID NO: 159835 - DNA, 25 bp, Mus musculus
aaattctcaagtcacgaacccctgc

SEQ ID NO: 159836 - DNA, 25 bp, Mus musculus
aaattctcacctccctagcactgta

SEQ ID NO: 159837 - DNA, 25 bp, Mus musculus
aaattctcagcacagcagccctcct

SEQ ID NO: 159838 - DNA, 25 bp, Mus musculus
aaattctcaggacagcagccctcct

SEQ ID NO: 159839 - DNA, 25 bp, Mus musculus
aaattctcagtcaggagagaattca

SEQ ID NO: 159840 - DNA, 25 bp, Mus musculus
aaattctccaaggtggctggacccg

SEQ ID NO: 159841 - DNA, 25 bp, Mus musculus
aaattctggatgaagctgtagcaat

SEQ ID NO: 159842 - DNA, 25 bp, Mus musculus
aaattctggtgagtatgcagctgat

SEQ ID NO: 159843 - DNA, 25 bp, Mus musculus
aaattcttataaatgtttatgtctg

SEQ ID NO: 159844 - DNA, 25 bp, Mus musculus
aaattcttcaacgagcgggctgagc

SEQ ID NO: 159845 - DNA, 25 bp, Mus musculus
aaattgaaactggaagcatatattc

SEQ ID NO: 159846 - DNA, 25 bp, Mus musculus
aaattgaacctgcaggtactaacac

SEQ ID NO: 159847 - DNA, 25 bp, Mus musculus
aaattgaacctgcaggtcttttcat

SEQ ID NO: 159848 - DNA, 25 bp, Mus musculus
aaattgaacgagaagtaaacactct

SEQ ID NO: 159849 - DNA, 25 bp, Mus musculus
aaattgaagctggaaagcaaagata

SEQ ID NO: 159850 - DNA, 25 bp, Mus musculus
aaattgaagctgggtgttgaccaga

SEQ ID NO: 159851 - DNA, 25 bp, Mus musculus
aaattgaagggtatttcaacaatcc

SEQ ID NO: 159852 - DNA, 25 bp, Mus musculus
aaattgaatcagctgaactggaccc

SEQ ID NO: 159853 - DNA, 25 bp, Mus musculus
aaattgaatcaggtgaactggaccc

SEQ ID NO: 159854 - DNA, 25 bp, Mus musculus
aaattgacaaccaatatcagtctct

SEQ ID NO: 159855 - DNA, 25 bp, Mus musculus
aaattgacaaccagacacgcataac

SEQ ID NO: 159856 - DNA, 25 bp, Mus musculus
aaattgacaggtagctacatcaagc

SEQ ID NO: 159857 - DNA, 25 bp, Mus musculus
aaattgacccaaagatcttggcata

SEQ ID NO: 159858 - DNA, 25 bp, Mus musculus
aaattgaccctgagacgatccagaa

SEQ ID NO: 159859 - DNA, 25 bp, Mus musculus
aaattgactacagaacacaagactt

SEQ ID NO: 159860 - DNA, 25 bp, Mus musculus
aaattgactacagatttcatatata

SEQ ID NO: 159861 - DNA, 25 bp, Mus musculus
aaattgactacaggaaactataagt

SEQ ID NO: 159862 - DNA, 25 bp, Mus musculus
aaattgagcaggccgcttggacatc

SEQ ID NO: 159863 - DNA, 25 bp, Mus musculus
aaattgagtattgggaatattacag

SEQ ID NO: 159864 - DNA, 25 bp, Mus musculus
aaattgagtgctcctgtgctgtgtt

SEQ ID NO: 159865 - DNA, 25 bp, Mus musculus
aaattgagtgggacgacttggccca

SEQ ID NO: 159866 - DNA, 25 bp, Mus musculus
aaattgcaccaggatctttctcaag

SEQ ID NO: 159867 - DNA, 25 bp, Mus musculus
aaattgcaccaggtgatgttattgt

SEQ ID NO: 159868 - DNA, 25 bp, Mus musculus
aaattgcagaagggagagagtggct

SEQ ID NO: 159869 - DNA, 25 bp, Mus musculus
aaattgcagaaggtgcacatcaggg

SEQ ID NO: 159870 - DNA, 25 bp, Mus musculus
aaattgccaagcctgtctcgctgct

SEQ ID NO: 159871 - DNA, 25 bp, Mus musculus
aaattgccaaggcagaagaggagct

SEQ ID NO: 159872 - DNA, 25 bp, Mus musculus
aaattgcctggaaggttgagattga

SEQ ID NO: 159873 - DNA, 25 bp, Mus musculus
aaattgcctgtacacagagttctgc

SEQ ID NO: 159874 - DNA, 25 bp, Mus musculus
aaattgctaagaacaccagaaccgt

SEQ ID NO: 159875 - DNA, 25 bp, Mus musculus
aaattgctacagggtggttatgctg

SEQ ID NO: 159876 - DNA, 25 bp, Mus musculus
aaattgctcaagagacattttaagt

SEQ ID NO: 159877 - DNA, 25 bp, Mus musculus
aaattgctcaagagtcctaaacctg

SEQ ID NO: 159878 - DNA, 25 bp, Mus musculus
aaattgctcaggaaaatggacaaag

SEQ ID NO: 159879 - DNA, 25 bp, Mus musculus
aaattgctcagtgagcaaccctaat

SEQ ID NO: 159880 - DNA, 25 bp, Mus musculus
aaattgctctaaagatgactgctta

SEQ ID NO: 159881 - DNA, 25 bp, Mus musculus
aaattgctgagcaagagatgcctgc

SEQ ID NO: 159882 - DNA, 25 bp, Mus musculus
aaattgctgtggcactcagaaagaa

SEQ ID NO: 159883 - DNA, 25 bp, Mus musculus
aaattgctttccagagacttcctgc

SEQ ID NO: 159884 - DNA, 25 bp, Mus musculus
aaattggacaggattggcccctgcc

SEQ ID NO: 159885 - DNA, 25 bp, Mus musculus
aaattggacaggtccttcattttga

SEQ ID NO: 159886 - DNA, 25 bp, Mus musculus
aaattggaccactcaaatgggcata

SEQ ID NO: 159887 - DNA, 25 bp, Mus musculus
aaattggccaacaaggtcgtataca

SEQ ID NO: 159888 - DNA, 25 bp, Mus musculus
aaattggccatgctctgcatgccca

SEQ ID NO: 159889 - DNA, 25 bp, Mus musculus
aaattggctgagctccccttggcta

SEQ ID NO: 159890 - DNA, 25 bp, Mus musculus
aaattggcttccctgagatcctgtt

SEQ ID NO: 159891 - DNA, 25 bp, Mus musculus
aaattgtagaaaactgtggtgtcat

SEQ ID NO: 159892 - DNA, 25 bp, Mus musculus
aaattgtatttacagatttatgaca

SEQ ID NO: 159893 - DNA, 25 bp, Mus musculus
aaattgtatttacaggatcttgctg

SEQ ID NO: 159894 - DNA, 25 bp, Mus musculus
aaattgtcagatactgctcatcatt

SEQ ID NO: 159895 - DNA, 25 bp, Mus musculus
aaattgtccgatgccatgaacacat

SEQ ID NO: 159896 - DNA, 25 bp, Mus musculus
aaattgtctactggtgcattgaaga

SEQ ID NO: 159897 - DNA, 25 bp, Mus musculus
aaattgtcttcagagattttcacag

SEQ ID NO: 159898 - DNA, 25 bp, Mus musculus
aaattgtgaaagaggtcctgtaata

SEQ ID NO: 159899 - DNA, 25 bp, Mus musculus
aaattgtgaaggccctgtctcaaag

SEQ ID NO: 159900 - DNA, 25 bp, Mus musculus
aaattgtgaaggtttgtctgggcac

SEQ ID NO: 159901 - DNA, 25 bp, Mus musculus
aaattgttaccaaagtgtgcaactg

SEQ ID NO: 159902 - DNA, 25 bp, Mus musculus
aaattgtttatagaaatacaatatt

SEQ ID NO: 159903 - DNA, 25 bp, Mus musculus
aaattgtttatagagatttgaagtt

SEQ ID NO: 159904 - DNA, 25 bp, Mus musculus
aaatttaaaaagggagatgagtacg

SEQ ID NO: 159905 - DNA, 25 bp, Mus musculus
aaatttaaaaggttgcagtgtgtgc

SEQ ID NO: 159906 - DNA, 25 bp, Mus musculus
aaatttaaagtaggaggagccaagc

SEQ ID NO: 159907 - DNA, 25 bp, Mus musculus
aaatttaacgccaaggtaaacgatg

SEQ ID NO: 159908 - DNA, 25 bp, Mus musculus
aaatttacaatctttaagaaataga

SEQ ID NO: 159909 - DNA, 25 bp, Mus musculus
aaatttacagagcagcatggcccag

SEQ ID NO: 159910 - DNA, 25 bp, Mus musculus
aaatttatctgaggtgagaagtctg

SEQ ID NO: 159911 - DNA, 25 bp, Mus musculus
aaatttcaaagaggtaactcacggt

SEQ ID NO: 159912 - DNA, 25 bp, Mus musculus
aaatttcactgaggttaatctataa

SEQ ID NO: 159913 - DNA, 25 bp, Mus musculus
aaatttcagcatcaggggttcggca

SEQ ID NO: 159914 - DNA, 25 bp, Mus musculus
aaatttcatggctacctctgtcgcg

SEQ ID NO: 159915 - DNA, 25 bp, Mus musculus
aaatttccacggaggttaatctata

SEQ ID NO: 159916 - DNA, 25 bp, Mus musculus
aaatttccagaaatcaacactattt

SEQ ID NO: 159917 - DNA, 25 bp, Mus musculus
aaatttccagggctatgtgcttcac

SEQ ID NO: 159918 - DNA, 25 bp, Mus musculus
aaatttccagttaaacctgctgatc

SEQ ID NO: 159919 - DNA, 25 bp, Mus musculus
aaatttcccctcagcaaatccagtt

SEQ ID NO: 159920 - DNA, 25 bp, Mus musculus
aaatttcccctgcaaaaatctggaa

SEQ ID NO: 159921 - DNA, 25 bp, Mus musculus
aaatttcccctgcaatactgccgaa

SEQ ID NO: 159922 - DNA, 25 bp, Mus musculus
aaatttcctaaaggagatataatca

SEQ ID NO: 159923 - DNA, 25 bp, Mus musculus
aaatttcctaatcaccctcatgttc

SEQ ID NO: 159924 - DNA, 25 bp, Mus musculus
aaatttctaaacaggatttggtgag

SEQ ID NO: 159925 - DNA, 25 bp, Mus musculus
aaatttctggagcctatcttccagc

SEQ ID NO: 159926 - DNA, 25 bp, Mus musculus
aaatttcttgtgaaaatgaacaagc

SEQ ID NO: 159927 - DNA, 25 bp, Mus musculus
aaatttgataatgcaaacccgtggc

SEQ ID NO: 159928 - DNA, 25 bp, Mus musculus
aaatttgcaccccaggggtggctcc

SEQ ID NO: 159929 - DNA, 25 bp, Mus musculus
aaatttgcatgcaaggcttgttccc

SEQ ID NO: 159930 - DNA, 25 bp, Mus musculus
aaatttgcatgcaaggtacagaaga

SEQ ID NO: 159931 - DNA, 25 bp, Mus musculus
aaatttgccgttaaacctgaagaat

SEQ ID NO: 159932 - DNA, 25 bp, Mus musculus
aaatttgccgttaaatgtgggaact

SEQ ID NO: 159933 - DNA, 25 bp, Mus musculus
aaatttggaagctacgcttacacaa

SEQ ID NO: 159934 - DNA, 25 bp, Mus musculus
aaatttggagacagaagcttaacaa

SEQ ID NO: 159935 - DNA, 25 bp, Mus musculus
aaatttggagctgacatcaacaaag

SEQ ID NO: 159936 - DNA, 25 bp, Mus musculus
aaatttggaggaattgatattttgg

SEQ ID NO: 159937 - DNA, 25 bp, Mus musculus
aaatttgggagttatgcatatccca

SEQ ID NO: 159938 - DNA, 25 bp, Mus musculus
aaatttgtcaaagaactactatcca

SEQ ID NO: 159939 - DNA, 25 bp, Mus musculus
aaatttgttagaaagcctgcaaggt

SEQ ID NO: 159940 - DNA, 25 bp, Mus musculus
aaatttgttcccaggcaaattccat

SEQ ID NO: 159941 - DNA, 25 bp, Mus musculus
aaattttgtagctgggattgacttc

SEQ ID NO: 159942 - DNA, 25 bp, Mus musculus
aaatttttataaaggcagctgctgg

SEQ ID NO: 159943 - DNA, 25 bp, Mus musculus
aacaaaaaaaagctgctgatcactg

SEQ ID NO: 159944 - DNA, 25 bp, Mus musculus
aacaaaaaaagctccgactgattga

SEQ ID NO: 159945 - DNA, 25 bp, Mus musculus
aacaaaaaagacaggtgttcacaaa

SEQ ID NO: 159946 - DNA, 25 bp, Mus musculus
aacaaaaaaggcctgatggaatcgg

SEQ ID NO: 159947 - DNA, 25 bp, Mus musculus
aacaaaaaatcagtggttagccagc

SEQ ID NO: 159948 - DNA, 25 bp, Mus musculus
aacaaaaaatcagttcccaagagtt

SEQ ID NO: 159949 - DNA, 25 bp, Mus musculus
aacaaaaacaacatggctgggctcc

SEQ ID NO: 159950 - DNA, 25 bp, Mus musculus
aacaaaaaccaagaggaaagcatag

SEQ ID NO: 159951 - DNA, 25 bp, Mus musculus
aacaaaaacttctggaattattgaa

SEQ ID NO: 159952 - DNA, 25 bp, Mus musculus
aacaaaaatctaggcatggtctgcc

SEQ ID NO: 159953 - DNA, 25 bp, Mus musculus
aacaaaaatggctcaaactcagaaa

SEQ ID NO: 159954 - DNA, 25 bp, Mus musculus
aacaaaacagattaatagagacaga

SEQ ID NO: 159955 - DNA, 25 bp, Mus musculus
aacaaaacagattgcctgcagttac

SEQ ID NO: 159956 - DNA, 25 bp, Mus musculus
aacaaaacaggcattggcagagatg

SEQ ID NO: 159957 - DNA, 25 bp, Mus musculus
aacaaaaccaaaactgccttaggat

SEQ ID NO: 159958 - DNA, 25 bp, Mus musculus
aacaaaaccaagaaaccaagccgca

SEQ ID NO: 159959 - DNA, 25 bp, Mus musculus
aacaaaacctttggtagatgccagc

SEQ ID NO: 159960 - DNA, 25 bp, Mus musculus
aacaaaactcaaaagattgctttat

SEQ ID NO: 159961 - DNA, 25 bp, Mus musculus
aacaaaactcagggaccaagagccc

SEQ ID NO: 159962 - DNA, 25 bp, Mus musculus
aacaaaagaaagaagacccactgcc

SEQ ID NO: 159963 - DNA, 25 bp, Mus musculus
aacaaaagaaagatataagcataca

SEQ ID NO: 159964 - DNA, 25 bp, Mus musculus
aacaaaagagatgtcttctcacagg

SEQ ID NO: 159965 - DNA, 25 bp, Mus musculus
aacaaaataaatggtctactgaaag

SEQ ID NO: 159966 - DNA, 25 bp, Mus musculus
aacaaaatatagtgtcatcatgctg

SEQ ID NO: 159967 - DNA, 25 bp, Mus musculus
aacaaaatcaaggatcatgggctct

SEQ ID NO: 159968 - DNA, 25 bp, Mus musculus
aacaaaatccggcagagtgaccgtc

SEQ ID NO: 159969 - DNA, 25 bp, Mus musculus
aacaaaatctaacaattctctacat

SEQ ID NO: 159970 - DNA, 25 bp, Mus musculus
aacaaacaacatgccctgcctgccc

SEQ ID NO: 159971 - DNA, 25 bp, Mus musculus
aacaaacaagatacatttatataat

SEQ ID NO: 159972 - DNA, 25 bp, Mus musculus
aacaaacaagggaatggcgtttacg

SEQ ID NO: 159973 - DNA, 25 bp, Mus musculus
aacaaacaattcctccatctgctaa

SEQ ID NO: 159974 - DNA, 25 bp, Mus musculus
aacaaacacaaaaaatcttctctga

SEQ ID NO: 159975 - DNA, 25 bp, Mus musculus
aacaaacagactaaagactatgctg

SEQ ID NO: 159976 - DNA, 25 bp, Mus musculus
aacaaacagagacaggcatccgtcc

SEQ ID NO: 159977 - DNA, 25 bp, Mus musculus
aacaaaccagactgacctcggactc

SEQ ID NO: 159978 - DNA, 25 bp, Mus musculus
aacaaaccagatcccccacctgtgc

SEQ ID NO: 159979 - DNA, 25 bp, Mus musculus
aacaaaccgaagagatacttggaga

SEQ ID NO: 159980 - DNA, 25 bp, Mus musculus
aacaaacgaacaagactctgacacc

SEQ ID NO: 159981 - DNA, 25 bp, Mus musculus
aacaaacgaacaagcaggttcagga

SEQ ID NO: 159982 - DNA, 25 bp, Mus musculus
aacaaacgaacaatagtagaaaatg

SEQ ID NO: 159983 - DNA, 25 bp, Mus musculus
aacaaactaattatagtcctattgt

SEQ ID NO: 159984 - DNA, 25 bp, Mus musculus
aacaaactcaagatgggaagtcatt

SEQ ID NO: 159985 - DNA, 25 bp, Mus musculus
aacaaactcaaggccctcatcaaaa

SEQ ID NO: 159986 - DNA, 25 bp, Mus musculus
aacaaactccgtcaggcccctgatt

SEQ ID NO: 159987 - DNA, 25 bp, Mus musculus
aacaaactccgtcagtacctcttgt

SEQ ID NO: 159988 - DNA, 25 bp, Mus musculus
aacaaactgaaggctcgatgagaga

SEQ ID NO: 159989 - DNA, 25 bp, Mus musculus
aacaaactggttattaaatagatcg

SEQ ID NO: 159990 - DNA, 25 bp, Mus musculus
aacaaactttagggactccagctac

SEQ ID NO: 159991 - DNA, 25 bp, Mus musculus
aacaaactttagggagtatagtcat

SEQ ID NO: 159992 - DNA, 25 bp, Mus musculus
aacaaagaagaaaaggactgcattt

SEQ ID NO: 159993 - DNA, 25 bp, Mus musculus
aacaaagaagctcttagccccccaa

SEQ ID NO: 159994 - DNA, 25 bp, Mus musculus
aacaaagagaagtgcagcccccttc

SEQ ID NO: 159995 - DNA, 25 bp, Mus musculus
aacaaagagagctggaaagtctttg

SEQ ID NO: 159996 - DNA, 25 bp, Mus musculus
aacaaagatcctctgagtgccagca

SEQ ID NO: 159997 - DNA, 25 bp, Mus musculus
aacaaagatggctgcatgagagcga

SEQ ID NO: 159998 - DNA, 25 bp, Mus musculus
aacaaagcaattgcctgtaccccag

SEQ ID NO: 159999 - DNA, 25 bp, Mus musculus
aacaaagcacagaaggaacagattc

SEQ ID NO: 160000 - DNA, 25 bp, Mus musculus
aacaaagcagaagagaatggaagtg

SEQ ID NO: 160001 - DNA, 25 bp, Mus musculus
aacaaagccaccaagatcctgagac

SEQ ID NO: 160002 - DNA, 25 bp, Mus musculus
aacaaagccagaaaaaaaatcagtt

SEQ ID NO: 160003 - DNA, 25 bp, Mus musculus
aacaaagccagaaaatcactgtgag

SEQ ID NO: 160004 - DNA, 25 bp, Mus musculus
aacaaagctaggaggactcacacac

SEQ ID NO: 160005 - DNA, 25 bp, Mus musculus
aacaaaggagctgacaaaccaagtg

SEQ ID NO: 160006 - DNA, 25 bp, Mus musculus
aacaaaggatccagatgcagaactc

SEQ ID NO: 160007 - DNA, 25 bp, Mus musculus
aacaaaggatccagtttatttatat

SEQ ID NO: 160008 - DNA, 25 bp, Mus musculus
aacaaaggattatggtaccaagcgc

SEQ ID NO: 160009 - DNA, 25 bp, Mus musculus
aacaaaggctgcagaacatgaagtt

SEQ ID NO: 160010 - DNA, 25 bp, Mus musculus
aacaaagggcacaggctcgtcccct

SEQ ID NO: 160011 - DNA, 25 bp, Mus musculus
aacaaaggtggcgggcgagaacttt

SEQ ID NO: 160012 - DNA, 25 bp, Mus musculus
aacaaagtagcagacagtgttactt

SEQ ID NO: 160013 - DNA, 25 bp, Mus musculus
aacaaagtcagctttctctggtctt

SEQ ID NO: 160014 - DNA, 25 bp, Mus musculus
aacaaagtgcgatgcgctgttcctg

SEQ ID NO: 160015 - DNA, 25 bp, Mus musculus
aacaaagtgcgatgcgtcgtccccc

SEQ ID NO: 160016 - DNA, 25 bp, Mus musculus
aacaaagttagcttgaacatcacaa

SEQ ID NO: 160017 - DNA, 25 bp, Mus musculus
aacaaagttcatggagtcgctgggg

SEQ ID NO: 160018 - DNA, 25 bp, Mus musculus
aacaaagttcatgggtgtttgccag

SEQ ID NO: 160019 - DNA, 25 bp, Mus musculus
aacaaagtttgggggagcattctct

SEQ ID NO: 160020 - DNA, 25 bp, Mus musculus
aacaaataagacggttagcacattg

SEQ ID NO: 160021 - DNA, 25 bp, Mus musculus
aacaaataagatgttctcaaacagt

SEQ ID NO: 160022 - DNA, 25 bp, Mus musculus
aacaaataagcctggggaactcatt

SEQ ID NO: 160023 - DNA, 25 bp, Mus musculus
aacaaatcatagaggacattaagga

SEQ ID NO: 160024 - DNA, 25 bp, Mus musculus
aacaaatcccaggagcaagtgtcgt

SEQ ID NO: 160025 - DNA, 25 bp, Mus musculus
aacaaatcccagttgtaggccatcg

SEQ ID NO: 160026 - DNA, 25 bp, Mus musculus
aacaaatgaacaggcaccacgcccc

SEQ ID NO: 160027 - DNA, 25 bp, Mus musculus
aacaaatgtacagagaaatttgtat

SEQ ID NO: 160028 - DNA, 25 bp, Mus musculus
aacaaatgtacaggagctgaagttc

SEQ ID NO: 160029 - DNA, 25 bp, Mus musculus
aacaaattaaagaagtataataagc

SEQ ID NO: 160030 - DNA, 25 bp, Mus musculus
aacaaattcaagtgctaaactgaaa

SEQ ID NO: 160031 - DNA, 25 bp, Mus musculus
aacaaattcccatctcatttgaaaa

SEQ ID NO: 160032 - DNA, 25 bp, Mus musculus
aacaaattgaagctggaaagcaaag

SEQ ID NO: 160033 - DNA, 25 bp, Mus musculus
aacaaattgaagctgggtgttgacc

SEQ ID NO: 160034 - DNA, 25 bp, Mus musculus
aacaacaaaaatggctcaaactcag

SEQ ID NO: 160035 - DNA, 25 bp, Mus musculus
aacaacaaagaagggattcacccct

SEQ ID NO: 160036 - DNA, 25 bp, Mus musculus
aacaacaaagaatctgaagcaggaa

SEQ ID NO: 160037 - DNA, 25 bp, Mus musculus
aacaacaaagaggaagcctgcactt

SEQ ID NO: 160038 - DNA, 25 bp, Mus musculus
aacaacaagaacaaggagttgggag

SEQ ID NO: 160039 - DNA, 25 bp, Mus musculus
aacaacaagaacaaggtgctctgtt

SEQ ID NO: 160040 - DNA, 25 bp, Mus musculus
aacaacaagacccctcctcctcgat

SEQ ID NO: 160041 - DNA, 25 bp, Mus musculus
aacaacaataggtgtttcaccaaaa

SEQ ID NO: 160042 - DNA, 25 bp, Mus musculus
aacaacaatgagagtgctgcaaaga

SEQ ID NO: 160043 - DNA, 25 bp, Mus musculus
aacaacacctggagagtgagaagat

SEQ ID NO: 160044 - DNA, 25 bp, Mus musculus
aacaacactgaaaggggcatctgat

SEQ ID NO: 160045 - DNA, 25 bp, Mus musculus
aacaacactgaatatctcctgggct

SEQ ID NO: 160046 - DNA, 25 bp, Mus musculus
aacaacactgacaggggcatctgat

SEQ ID NO: 160047 - DNA, 25 bp, Mus musculus
aacaacagaaaaggcagccggagca

SEQ ID NO: 160048 - DNA, 25 bp, Mus musculus
aacaacagaaatgtgaaaaactcaa

SEQ ID NO: 160049 - DNA, 25 bp, Mus musculus
aacaacagcttgcaaattacaggcc

SEQ ID NO: 160050 - DNA, 25 bp, Mus musculus
aacaacagctttacgatcatcactc

SEQ ID NO: 160051 - DNA, 25 bp, Mus musculus
aacaacagctttacgatcatcttga

SEQ ID NO: 160052 - DNA, 25 bp, Mus musculus
aacaacatcaaagaaaaattcaacg

SEQ ID NO: 160053 - DNA, 25 bp, Mus musculus
aacaacatcatgaacaacgtgggca

SEQ ID NO: 160054 - DNA, 25 bp, Mus musculus
aacaacatgaacagaagagagaggg

SEQ ID NO: 160055 - DNA, 25 bp, Mus musculus
aacaacatgccctgcctgccccaac

SEQ ID NO: 160056 - DNA, 25 bp, Mus musculus
aacaacattgagcagagtctgcgag

SEQ ID NO: 160057 - DNA, 25 bp, Mus musculus
aacaaccaagagaagcaattggaat

SEQ ID NO: 160058 - DNA, 25 bp, Mus musculus
aacaaccaagcacttgtttcagcat

SEQ ID NO: 160059 - DNA, 25 bp, Mus musculus
aacaaccaggagccctacacaggtc

SEQ ID NO: 160060 - DNA, 25 bp, Mus musculus
aacaaccagtctaagttctttcgag

SEQ ID NO: 160061 - DNA, 25 bp, Mus musculus
aacaacccaaaccaggtgtatatca

SEQ ID NO: 160062 - DNA, 25 bp, Mus musculus
aacaacccaccatgtatgcttgaga

SEQ ID NO: 160063 - DNA, 25 bp, Mus musculus
aacaaccccgtcaaggtccgatctg

SEQ ID NO: 160064 - DNA, 25 bp, Mus musculus
aacaaccctctgggacaggtattct

SEQ ID NO: 160065 - DNA, 25 bp, Mus musculus
aacaaccgagaccagatcatcttca

SEQ ID NO: 160066 - DNA, 25 bp, Mus musculus
aacaacctagagcttcaggatctca

SEQ ID NO: 160067 - DNA, 25 bp, Mus musculus
aacaacctagctcccgatggtcact

SEQ ID NO: 160068 - DNA, 25 bp, Mus musculus
aacaacctgaaagattttgatagac

SEQ ID NO: 160069 - DNA, 25 bp, Mus musculus
aacaacctgtacctgcaaatgagca

SEQ ID NO: 160070 - DNA, 25 bp, Mus musculus
aacaaccttgaccttattcaatccc

SEQ ID NO: 160071 - DNA, 25 bp, Mus musculus
aacaacgaagagcaagctgaactac

SEQ ID NO: 160072 - DNA, 25 bp, Mus musculus
aacaacgaaggcgagatctgcatca

SEQ ID NO: 160073 - DNA, 25 bp, Mus musculus
aacaacgaatcctttgtcatctaca

SEQ ID NO: 160074 - DNA, 25 bp, Mus musculus
aacaacgacaagttctccaccccct

SEQ ID NO: 160075 - DNA, 25 bp, Mus musculus
aacaacgcagccactcttggggatg

SEQ ID NO: 160076 - DNA, 25 bp, Mus musculus
aacaacgcagccctacaaaggctgg

SEQ ID NO: 160077 - DNA, 25 bp, Mus musculus
aacaacgcaggactaaattcggaga

SEQ ID NO: 160078 - DNA, 25 bp, Mus musculus
aacaacgcgggggaccttatggatt

SEQ ID NO: 160079 - DNA, 25 bp, Mus musculus
aacaacggcactgcgctcttggaat

SEQ ID NO: 160080 - DNA, 25 bp, Mus musculus
aacaactaaacaggaatgcttcgtg

SEQ ID NO: 160081 - DNA, 25 bp, Mus musculus
aacaactaacatgcaatgatcttcc

SEQ ID NO: 160082 - DNA, 25 bp, Mus musculus
aacaactatatacaggctacagaca

SEQ ID NO: 160083 - DNA, 25 bp, Mus musculus
aacaactccaggaagagctgatctt

SEQ ID NO: 160084 - DNA, 25 bp, Mus musculus
aacaactctgagtaccaaggcaaag

SEQ ID NO: 160085 - DNA, 25 bp, Mus musculus
aacaactgaacgtttggatgaagca

SEQ ID NO: 160086 - DNA, 25 bp, Mus musculus
aacaactgagtgaagaaactgatct

SEQ ID NO: 160087 - DNA, 25 bp, Mus musculus
aacaactgagtgaagaggagatgca

SEQ ID NO: 160088 - DNA, 25 bp, Mus musculus
aacaactgccagagggtaacatctg

SEQ ID NO: 160089 - DNA, 25 bp, Mus musculus
aacaactgccagagggttgcatctg

SEQ ID NO: 160090 - DNA, 25 bp, Mus musculus
aacaactggcactggacagagagag

SEQ ID NO: 160091 - DNA, 25 bp, Mus musculus
aacaactggcactggacaggtacct

SEQ ID NO: 160092 - DNA, 25 bp, Mus musculus
aacaactgtttaaggaatcacgcct

SEQ ID NO: 160093 - DNA, 25 bp, Mus musculus
aacaactgtttaaggaatccctctt

SEQ ID NO: 160094 - DNA, 25 bp, Mus musculus
aacaacttgacaggcttagaatcag

SEQ ID NO: 160095 - DNA, 25 bp, Mus musculus
aacaagaaaaatatgttccaagtga

SEQ ID NO: 160096 - DNA, 25 bp, Mus musculus
aacaagaaaacaaagaactgcggac

SEQ ID NO: 160097 - DNA, 25 bp, Mus musculus
aacaagaaaatactgaattttctca

SEQ ID NO: 160098 - DNA, 25 bp, Mus musculus
aacaagaaactcgggtgccctccaa

SEQ ID NO: 160099 - DNA, 25 bp, Mus musculus
aacaagaaagaaatggcaaaagatg

SEQ ID NO: 160100 - DNA, 25 bp, Mus musculus
aacaagaaatacgatgaggatgatg

SEQ ID NO: 160101 - DNA, 25 bp, Mus musculus
aacaagaaatacggtgaagctctgg

SEQ ID NO: 160102 - DNA, 25 bp, Mus musculus
aacaagaaatgcaagattttgctgg

SEQ ID NO: 160103 - DNA, 25 bp, Mus musculus
aacaagaacaaggagttgggagcgg

SEQ ID NO: 160104 - DNA, 25 bp, Mus musculus
aacaagaacaaggtgctctgttttg

SEQ ID NO: 160105 - DNA, 25 bp, Mus musculus
aacaagaacactccagggtttcctg

SEQ ID NO: 160106 - DNA, 25 bp, Mus musculus
aacaagaagaaaaagaacgtttgct

SEQ ID NO: 160107 - DNA, 25 bp, Mus musculus
aacaagaatcagcttcagaggatta

SEQ ID NO: 160108 - DNA, 25 bp, Mus musculus
aacaagaatcaggttgtggagttga

SEQ ID NO: 160109 - DNA, 25 bp, Mus musculus
aacaagaattgccaacagtagtcgg

SEQ ID NO: 160110 - DNA, 25 bp, Mus musculus
aacaagacacccagaatgggctaca

SEQ ID NO: 160111 - DNA, 25 bp, Mus musculus
aacaagacaggtcgattgagtgata

SEQ ID NO: 160112 - DNA, 25 bp, Mus musculus
aacaagaccaagagaccacagcagt

SEQ ID NO: 160113 - DNA, 25 bp, Mus musculus
aacaagaccaagaggttgaaaggaa

SEQ ID NO: 160114 - DNA, 25 bp, Mus musculus
aacaagacccctcctcctcgattac

SEQ ID NO: 160115 - DNA, 25 bp, Mus musculus
aacaagaccttcaggatcaagatta

SEQ ID NO: 160116 - DNA, 25 bp, Mus musculus
aacaagactaccaagctccacttcg

SEQ ID NO: 160117 - DNA, 25 bp, Mus musculus
aacaagactaccaagtgaacacctt

SEQ ID NO: 160118 - DNA, 25 bp, Mus musculus
aacaagactcagaataagcctgcac

SEQ ID NO: 160119 - DNA, 25 bp, Mus musculus
aacaagactgtccacagatacttgg

SEQ ID NO: 160120 - DNA, 25 bp, Mus musculus
aacaagagaccaggtgaaaaaactg

SEQ ID NO: 160121 - DNA, 25 bp, Mus musculus
aacaagagaggcaatgggtgacaag

SEQ ID NO: 160122 - DNA, 25 bp, Mus musculus
aacaagagatggaatacgaccataa

SEQ ID NO: 160123 - DNA, 25 bp, Mus musculus
aacaagagcaggagaacaaaatcca

SEQ ID NO: 160124 - DNA, 25 bp, Mus musculus
aacaagagcaggagcgcctttgacc

SEQ ID NO: 160125 - DNA, 25 bp, Mus musculus
aacaagagccccagaaccaaggctc

SEQ ID NO: 160126 - DNA, 25 bp, Mus musculus
aacaagagccccttcctctgcccct

SEQ ID NO: 160127 - DNA, 25 bp, Mus musculus
aacaagaggaaatacagaagcttaa

SEQ ID NO: 160128 - DNA, 25 bp, Mus musculus
aacaagaggcagatgggcatatcaa

SEQ ID NO: 160129 - DNA, 25 bp, Mus musculus
aacaagataaggggatggtaataac

SEQ ID NO: 160130 - DNA, 25 bp, Mus musculus
aacaagatcggttctctttgtagct

SEQ ID NO: 160131 - DNA, 25 bp, Mus musculus
aacaagatcgttggaatgccaagat

SEQ ID NO: 160132 - DNA, 25 bp, Mus musculus
aacaagatgggaggcacctccaagt

SEQ ID NO: 160133 - DNA, 25 bp, Mus musculus
aacaagattaatgaaccaccaaagc

SEQ ID NO: 160134 - DNA, 25 bp, Mus musculus
aacaagattacggccgaagactgta

SEQ ID NO: 160135 - DNA, 25 bp, Mus musculus
aacaagattacggtacagcaaggga

SEQ ID NO: 160136 - DNA, 25 bp, Mus musculus
aacaagattgcagagaacaatgacc

SEQ ID NO: 160137 - DNA, 25 bp, Mus musculus
aacaagattgcagagtgaaccatga

SEQ ID NO: 160138 - DNA, 25 bp, Mus musculus
aacaagcaaaaagctattgaccttc

SEQ ID NO: 160139 - DNA, 25 bp, Mus musculus
aacaagcaagaaagaagacatctgc

SEQ ID NO: 160140 - DNA, 25 bp, Mus musculus
aacaagcaagatccgctgatcttag

SEQ ID NO: 160141 - DNA, 25 bp, Mus musculus
aacaagcaaggaatccaagtgaata

SEQ ID NO: 160142 - DNA, 25 bp, Mus musculus
aacaagcacaagttctgcctatctt

SEQ ID NO: 160143 - DNA, 25 bp, Mus musculus
aacaagcacaatgggtgtgttttac

SEQ ID NO: 160144 - DNA, 25 bp, Mus musculus
aacaagcactctcaggctaccggct

SEQ ID NO: 160145 - DNA, 25 bp, Mus musculus
aacaagcagcaacgtcggagtcttc

SEQ ID NO: 160146 - DNA, 25 bp, Mus musculus
aacaagcatagcgggtttggcttgt

SEQ ID NO: 160147 - DNA, 25 bp, Mus musculus
aacaagcatcagggggtccgcctac

SEQ ID NO: 160148 - DNA, 25 bp, Mus musculus
aacaagcatcccaggctgcgagaca

SEQ ID NO: 160149 - DNA, 25 bp, Mus musculus
aacaagcattgcaggaagaattctt

SEQ ID NO: 160150 - DNA, 25 bp, Mus musculus
aacaagccagggcctcctgctgcca

SEQ ID NO: 160151 - DNA, 25 bp, Mus musculus
aacaagcccaggagacaatcaggct

SEQ ID NO: 160152 - DNA, 25 bp, Mus musculus
aacaagcccatctggctcttgctgc

SEQ ID NO: 160153 - DNA, 25 bp, Mus musculus
aacaagcccatgaagtgcccccgcc

SEQ ID NO: 160154 - DNA, 25 bp, Mus musculus
aacaagccgtggcaaggagatgaga

SEQ ID NO: 160155 - DNA, 25 bp, Mus musculus
aacaagccgtggcattaaaaaaata

SEQ ID NO: 160156 - DNA, 25 bp, Mus musculus
aacaagcctccagaaatcgacatca

SEQ ID NO: 160157 - DNA, 25 bp, Mus musculus
aacaagcctgccaagaccctaccac

SEQ ID NO: 160158 - DNA, 25 bp, Mus musculus
aacaagcctggcagcaaccttagtg

SEQ ID NO: 160159 - DNA, 25 bp, Mus musculus
aacaagcctggcagtgtcagcagct

SEQ ID NO: 160160 - DNA, 25 bp, Mus musculus
aacaagcgcagatattaaactaacc

SEQ ID NO: 160161 - DNA, 25 bp, Mus musculus
aacaagcggagtttggtgaaagtga

SEQ ID NO: 160162 - DNA, 25 bp, Mus musculus
aacaagctaacaactgtgccaccaa

SEQ ID NO: 160163 - DNA, 25 bp, Mus musculus
aacaagctgaagagcatggagaagc

SEQ ID NO: 160164 - DNA, 25 bp, Mus musculus
aacaagctgagtgtaagggttcccg

SEQ ID NO: 160165 - DNA, 25 bp, Mus musculus
aacaagctgcagcccacttcttaga

SEQ ID NO: 160166 - DNA, 25 bp, Mus musculus
aacaagctgcaggcttctccagtgg

SEQ ID NO: 160167 - DNA, 25 bp, Mus musculus
aacaaggaagacagaacctctggtt

SEQ ID NO: 160168 - DNA, 25 bp, Mus musculus
aacaaggaagttgagaatgaaaagt

SEQ ID NO: 160169 - DNA, 25 bp, Mus musculus
aacaaggaagttgagaatttcagga

SEQ ID NO: 160170 - DNA, 25 bp, Mus musculus
aacaaggaagttgaggtttaatagt

SEQ ID NO: 160171 - DNA, 25 bp, Mus musculus
aacaaggacgagaaaacgcagaggt

SEQ ID NO: 160172 - DNA, 25 bp, Mus musculus
aacaaggacgagaaggaccacttga

SEQ ID NO: 160173 - DNA, 25 bp, Mus musculus
aacaaggaggacagctacaagccca

SEQ ID NO: 160174 - DNA, 25 bp, Mus musculus
aacaaggcaaagccgacgcagtatg

SEQ ID NO: 160175 - DNA, 25 bp, Mus musculus
aacaaggccaagttgtgctggtaac

SEQ ID NO: 160176 - DNA, 25 bp, Mus musculus
aacaaggccaggactgtggcggcca

SEQ ID NO: 160177 - DNA, 25 bp, Mus musculus
aacaagggctacagctccggaccaa

SEQ ID NO: 160178 - DNA, 25 bp, Mus musculus
aacaaggggcaggtaccacagagag

SEQ ID NO: 160179 - DNA, 25 bp, Mus musculus
aacaaggtaggctgtcagccatctt

SEQ ID NO: 160180 - DNA, 25 bp, Mus musculus
aacaaggtcaagtcagtaggacaaa

SEQ ID NO: 160181 - DNA, 25 bp, Mus musculus
aacaaggtgttccaggagcgcatca

SEQ ID NO: 160182 - DNA, 25 bp, Mus musculus
aacaaggtgttccaggtaggtgcat

SEQ ID NO: 160183 - DNA, 25 bp, Mus musculus
aacaagtacagcttctggcctccaa

SEQ ID NO: 160184 - DNA, 25 bp, Mus musculus
aacaagtcaaagaggcaaaagcaaa

SEQ ID NO: 160185 - DNA, 25 bp, Mus musculus
aacaagtcaggctccaaaaacaggt

SEQ ID NO: 160186 - DNA, 25 bp, Mus musculus
aacaagtgcaagatgatttaccttg

SEQ ID NO: 160187 - DNA, 25 bp, Mus musculus
aacaagtgccagagaggagttttgc

SEQ ID NO: 160188 - DNA, 25 bp, Mus musculus
aacaagtgccaggtacatattttta

SEQ ID NO: 160189 - DNA, 25 bp, Mus musculus
aacaagtgcgctctgaaaacctgga

SEQ ID NO: 160190 - DNA, 25 bp, Mus musculus
aacaagtgcggtaattaccctctta

SEQ ID NO: 160191 - DNA, 25 bp, Mus musculus
aacaagtggggacaccattaccatg

SEQ ID NO: 160192 - DNA, 25 bp, Mus musculus
aacaagtgtgccagccaggtgggca

SEQ ID NO: 160193 - DNA, 25 bp, Mus musculus
aacaagtgttcagagccggaaacaa

SEQ ID NO: 160194 - DNA, 25 bp, Mus musculus
aacaagtgttcaggcctccttcttt

SEQ ID NO: 160195 - DNA, 25 bp, Mus musculus
aacaagttcgacgccttaaaagatg

SEQ ID NO: 160196 - DNA, 25 bp, Mus musculus
aacaagttctcaggaacaatcctca

SEQ ID NO: 160197 - DNA, 25 bp, Mus musculus
aacaagttgaggaacaatacgaaga

SEQ ID NO: 160198 - DNA, 25 bp, Mus musculus
aacaagttgaggaggaggcccaaga

SEQ ID NO: 160199 - DNA, 25 bp, Mus musculus
aacaagtttcttagacctctcacag

SEQ ID NO: 160200 - DNA, 25 bp, Mus musculus
aacaagttttccagtgaagccatgg

SEQ ID NO: 160201 - DNA, 25 bp, Mus musculus
aacaataaagctgcagtgttgaagt

SEQ ID NO: 160202 - DNA, 25 bp, Mus musculus
aacaataacctccagggaggtatgg

SEQ ID NO: 160203 - DNA, 25 bp, Mus musculus
aacaataagactgggatgtttcttt

SEQ ID NO: 160204 - DNA, 25 bp, Mus musculus
aacaataagactgggtaaatttgat

SEQ ID NO: 160205 - DNA, 25 bp, Mus musculus
aacaataatgaagacaactggattg

SEQ ID NO: 160206 - DNA, 25 bp, Mus musculus
aacaatacaggtggccaagaaggaa

SEQ ID NO: 160207 - DNA, 25 bp, Mus musculus
aacaatacagtcaggatggctaaag

SEQ ID NO: 160208 - DNA, 25 bp, Mus musculus
aacaatactcagggaggagactccc

SEQ ID NO: 160209 - DNA, 25 bp, Mus musculus
aacaatagaatacatggcccctgaa

SEQ ID NO: 160210 - DNA, 25 bp, Mus musculus
aacaatagcacaggaatgattggca

SEQ ID NO: 160211 - DNA, 25 bp, Mus musculus
aacaatagtaaaggctggacccgac

SEQ ID NO: 160212 - DNA, 25 bp, Mus musculus
aacaatagtatctttacggacgagt

SEQ ID NO: 160213 - DNA, 25 bp, Mus musculus
aacaatatcaaggaagtgcttctct

SEQ ID NO: 160214 - DNA, 25 bp, Mus musculus
aacaatcacagacagcttacctcta

SEQ ID NO: 160215 - DNA, 25 bp, Mus musculus
aacaatcacagaggccagaagagag

SEQ ID NO: 160216 - DNA, 25 bp, Mus musculus
aacaatcacaggtgtagatgtcagc

SEQ ID NO: 160217 - DNA, 25 bp, Mus musculus
aacaatcacgacagcctgcctggcc

SEQ ID NO: 160218 - DNA, 25 bp, Mus musculus
aacaatcagctgaaggaactcagag

SEQ ID NO: 160219 - DNA, 25 bp, Mus musculus
aacaatcagctgaagtgtgggagta

SEQ ID NO: 160220 - DNA, 25 bp, Mus musculus
aacaatcatggctgcttgtgcctcc

SEQ ID NO: 160221 - DNA, 25 bp, Mus musculus
aacaatcctactccaggtctggttc

SEQ ID NO: 160222 - DNA, 25 bp, Mus musculus
aacaatcctgagcaggttgtggatg

SEQ ID NO: 160223 - DNA, 25 bp, Mus musculus
aacaatcctgaggtactgtactgat

SEQ ID NO: 160224 - DNA, 25 bp, Mus musculus
aacaatccttacgggaaggtgcaca

SEQ ID NO: 160225 - DNA, 25 bp, Mus musculus
aacaatccttacggtgataaaattg

SEQ ID NO: 160226 - DNA, 25 bp, Mus musculus
aacaatctagagcccttactccctc

SEQ ID NO: 160227 - DNA, 25 bp, Mus musculus
aacaatctggctcttctgtcagttt

SEQ ID NO: 160228 - DNA, 25 bp, Mus musculus
aacaatcttcaggtggctgtgaaga

SEQ ID NO: 160229 - DNA, 25 bp, Mus musculus
aacaatgaaaatcttcagaagcagc

SEQ ID NO: 160230 - DNA, 25 bp, Mus musculus
aacaatgaaaatgttcagaagcagc

SEQ ID NO: 160231 - DNA, 25 bp, Mus musculus
aacaatgaagcaggtttagatgacg

SEQ ID NO: 160232 - DNA, 25 bp, Mus musculus
aacaatgaagtaaaacaagatactc

SEQ ID NO: 160233 - DNA, 25 bp, Mus musculus
aacaatgagccgtggaagaagccaa

SEQ ID NO: 160234 - DNA, 25 bp, Mus musculus
aacaatgcaagaaaacgaagtccat

SEQ ID NO: 160235 - DNA, 25 bp, Mus musculus
aacaatgcaggggttgacaacttcg

SEQ ID NO: 160236 - DNA, 25 bp, Mus musculus
aacaatggcaagattgagctccggg

SEQ ID NO: 160237 - DNA, 25 bp, Mus musculus
aacaatggcaatcatgaggcagtga

SEQ ID NO: 160238 - DNA, 25 bp, Mus musculus
aacaatggcctagaggtaatcaagg

SEQ ID NO: 160239 - DNA, 25 bp, Mus musculus
aacaatgtagagatcccctatttca

SEQ ID NO: 160240 - DNA, 25 bp, Mus musculus
aacaatgtcacgaacttgtttcctg

SEQ ID NO: 160241 - DNA, 25 bp, Mus musculus
aacaatgtctttggtttcaacagct

SEQ ID NO: 160242 - DNA, 25 bp, Mus musculus
aacaatgtgaaagtacatttgcaag

SEQ ID NO: 160243 - DNA, 25 bp, Mus musculus
aacaatgtgacagtccatatgttgt

SEQ ID NO: 160244 - DNA, 25 bp, Mus musculus
aacaatgtggaagtcttcagtaact

SEQ ID NO: 160245 - DNA, 25 bp, Mus musculus
aacaatgtggatcaggaatcctttc

SEQ ID NO: 160246 - DNA, 25 bp, Mus musculus
aacaatgtttgcctgggaaatgctc

SEQ ID NO: 160247 - DNA, 25 bp, Mus musculus
aacaattctgtttcgatctatgtaa

SEQ ID NO: 160248 - DNA, 25 bp, Mus musculus
aacaattctgtttcggacttgccat

SEQ ID NO: 160249 - DNA, 25 bp, Mus musculus
aacaattgaagtcagaaggagacaa

SEQ ID NO: 160250 - DNA, 25 bp, Mus musculus
aacaattggaatgaaggctcagatc

SEQ ID NO: 160251 - DNA, 25 bp, Mus musculus
aacaatttcagcatctctgagtttt

SEQ ID NO: 160252 - DNA, 25 bp, Mus musculus
aacaatttcagtcatctcctgaaga

SEQ ID NO: 160253 - DNA, 25 bp, Mus musculus
aacaatttcatacatgctatgctga

SEQ ID NO: 160254 - DNA, 25 bp, Mus musculus
aacaatttcatagatgctatgctga

SEQ ID NO: 160255 - DNA, 25 bp, Mus musculus
aacaatttccaggtcatgagcatgg

SEQ ID NO: 160256 - DNA, 25 bp, Mus musculus
aacaatttgcataaagactgaccat

SEQ ID NO: 160257 - DNA, 25 bp, Mus musculus
aacaattttcagcagtacccctcta

SEQ ID NO: 160258 - DNA, 25 bp, Mus musculus
aacacaaaaaatcttctctgatgat

SEQ ID NO: 160259 - DNA, 25 bp, Mus musculus
aacacaaaaacagatggatgagaca

SEQ ID NO: 160260 - DNA, 25 bp, Mus musculus
aacacaaaaagcttcctagaggaag

SEQ ID NO: 160261 - DNA, 25 bp, Mus musculus
aacacaaaaatgggttctctgtctg

SEQ ID NO: 160262 - DNA, 25 bp, Mus musculus
aacacaaaacaggttcagacagtaa

SEQ ID NO: 160263 - DNA, 25 bp, Mus musculus
aacacaaaacgaaacctcgtgttgc

SEQ ID NO: 160264 - DNA, 25 bp, Mus musculus
aacacaaacaccgtgcctaaattgt

SEQ ID NO: 160265 - DNA, 25 bp, Mus musculus
aacacaaacacgagagtccctgacc

SEQ ID NO: 160266 - DNA, 25 bp, Mus musculus
aacacaaacacgtgagtccctgacc

SEQ ID NO: 160267 - DNA, 25 bp, Mus musculus
aacacaaaggaaagatttctcgaat

SEQ ID NO: 160268 - DNA, 25 bp, Mus musculus
aacacaaaggaaaggcattagcaaa

SEQ ID NO: 160269 - DNA, 25 bp, Mus musculus
aacacaaaggcagagtcagttgttc

SEQ ID NO: 160270 - DNA, 25 bp, Mus musculus
aacacaaaggtaagaaagcacgctt

SEQ ID NO: 160271 - DNA, 25 bp, Mus musculus
aacacaacaaagattatcagagact

SEQ ID NO: 160272 - DNA, 25 bp, Mus musculus
aacacaacatgtgggatcacatgca

SEQ ID NO: 160273 - DNA, 25 bp, Mus musculus
aacacaacctgttcaagaaaattga

SEQ ID NO: 160274 - DNA, 25 bp, Mus musculus
aacacaagaacaggcaaggccctca

SEQ ID NO: 160275 - DNA, 25 bp, Mus musculus
aacacaagaaggctacatggatgca

SEQ ID NO: 160276 - DNA, 25 bp, Mus musculus
aacacaagagaattcatacaggaga

SEQ ID NO: 160277 - DNA, 25 bp, Mus musculus
aacacaagatggcccgcagaggacg

SEQ ID NO: 160278 - DNA, 25 bp, Mus musculus
aacacaagcccaaggaggataagct

SEQ ID NO: 160279 - DNA, 25 bp, Mus musculus
aacacaagcccaagtgcccaccttg

SEQ ID NO: 160280 - DNA, 25 bp, Mus musculus
aacacaaggaaggagcagctgcaag

SEQ ID NO: 160281 - DNA, 25 bp, Mus musculus
aacacaaggaggcatggtccaggta

SEQ ID NO: 160282 - DNA, 25 bp, Mus musculus
aacacaataaggctcatgcacaatt

SEQ ID NO: 160283 - DNA, 25 bp, Mus musculus
aacacaatcaagcccccactgtgtt

SEQ ID NO: 160284 - DNA, 25 bp, Mus musculus
aacacaatcaaggcacttcggagga

SEQ ID NO: 160285 - DNA, 25 bp, Mus musculus
aacacaatcaaggtccacaggatga

SEQ ID NO: 160286 - DNA, 25 bp, Mus musculus
aacacaatcagatgtcgtttggtca

SEQ ID NO: 160287 - DNA, 25 bp, Mus musculus
aacacaatcagccgcataactcatc

SEQ ID NO: 160288 - DNA, 25 bp, Mus musculus
aacacaatcagccgtcattcagtct

SEQ ID NO: 160289 - DNA, 25 bp, Mus musculus
aacacaatcagtcgaagggggcaga

SEQ ID NO: 160290 - DNA, 25 bp, Mus musculus
aacacaatttcaataacttacagtc

SEQ ID NO: 160291 - DNA, 25 bp, Mus musculus
aacacaatttcaatgtgttacagca

SEQ ID NO: 160292 - DNA, 25 bp, Mus musculus
aacacaatttcagactacaaaagtc

SEQ ID NO: 160293 - DNA, 25 bp, Mus musculus
aacacacaaagattcagagctggag

SEQ ID NO: 160294 - DNA, 25 bp, Mus musculus
aacacacaaaggttggttcctgtac

SEQ ID NO: 160295 - DNA, 25 bp, Mus musculus
aacacacaagaatcgcagaatgcat

SEQ ID NO: 160296 - DNA, 25 bp, Mus musculus
aacacacaagattcttccagatgat

SEQ ID NO: 160297 - DNA, 25 bp, Mus musculus
aacacacaagcctccatgcattgct

SEQ ID NO: 160298 - DNA, 25 bp, Mus musculus
aacacacaccaagtttttcaagaca

SEQ ID NO: 160299 - DNA, 25 bp, Mus musculus
aacacacacttgaagatcaagacat

SEQ ID NO: 160300 - DNA, 25 bp, Mus musculus
aacacacacttgaagatctttctgc

SEQ ID NO: 160301 - DNA, 25 bp, Mus musculus
aacacacagacttgtcccggccaca

SEQ ID NO: 160302 - DNA, 25 bp, Mus musculus
aacacacagcagatgcattacacgg

SEQ ID NO: 160303 - DNA, 25 bp, Mus musculus
aacacacaggtaagggcagatgtca

SEQ ID NO: 160304 - DNA, 25 bp, Mus musculus
aacacaccacaggctttgctactgg

SEQ ID NO: 160305 - DNA, 25 bp, Mus musculus
aacacaccacagggaaaccaggaac

SEQ ID NO: 160306 - DNA, 25 bp, Mus musculus
aacacaccccaggacaccatcttgc

SEQ ID NO: 160307 - DNA, 25 bp, Mus musculus
aacacacccggacgatgacagctat

SEQ ID NO: 160308 - DNA, 25 bp, Mus musculus
aacacacctgacttatttattttgg

SEQ ID NO: 160309 - DNA, 25 bp, Mus musculus
aacacacgggggagaggccatttgt

SEQ ID NO: 160310 - DNA, 25 bp, Mus musculus
aacacacgtgacaaataaccctggc

SEQ ID NO: 160311 - DNA, 25 bp, Mus musculus
aacacacgtggaagagccggctttc

SEQ ID NO: 160312 - DNA, 25 bp, Mus musculus
aacacacgtgggaaggtggcgtttt

SEQ ID NO: 160313 - DNA, 25 bp, Mus musculus
aacacacgtggtggtacccgggaga

SEQ ID NO: 160314 - DNA, 25 bp, Mus musculus
aacacactcttcagtgggcccggga

SEQ ID NO: 160315 - DNA, 25 bp, Mus musculus
aacacactgacggagcgcttctggg

SEQ ID NO: 160316 - DNA, 25 bp, Mus musculus
aacacactggaaggatttgccagtc

SEQ ID NO: 160317 - DNA, 25 bp, Mus musculus
aacacactggaagtatttttgaaca

SEQ ID NO: 160318 - DNA, 25 bp, Mus musculus
aacacacttttccagttccccacac

SEQ ID NO: 160319 - DNA, 25 bp, Mus musculus
aacacagaaaaagcctgaaaatgaa

SEQ ID NO: 160320 - DNA, 25 bp, Mus musculus
aacacagaaaaaggtctgcagaatg

SEQ ID NO: 160321 - DNA, 25 bp, Mus musculus
aacacagaaaagaaggctggtgagg

SEQ ID NO: 160322 - DNA, 25 bp, Mus musculus
aacacagaaaccgatcatcccagca

SEQ ID NO: 160323 - DNA, 25 bp, Mus musculus
aacacagaaaccggtgctcccttgc

SEQ ID NO: 160324 - DNA, 25 bp, Mus musculus
aacacagaacattagctcaggtacc

SEQ ID NO: 160325 - DNA, 25 bp, Mus musculus
aacacagacacaaagctcaagttca

SEQ ID NO: 160326 - DNA, 25 bp, Mus musculus
aacacagagagcttctcaggatgga

SEQ ID NO: 160327 - DNA, 25 bp, Mus musculus
aacacagagcaccgggcaagagtcc

SEQ ID NO: 160328 - DNA, 25 bp, Mus musculus
aacacagagcaccggggactcctga

SEQ ID NO: 160329 - DNA, 25 bp, Mus musculus
aacacagagcagaggaatgtctaca

SEQ ID NO: 160330 - DNA, 25 bp, Mus musculus
aacacagagtttcaaggcaaacgaa

SEQ ID NO: 160331 - DNA, 25 bp, Mus musculus
aacacagcacccttatcttcaaagt

SEQ ID NO: 160332 - DNA, 25 bp, Mus musculus
aacacagcagcaccataggttcccc

SEQ ID NO: 160333 - DNA, 25 bp, Mus musculus
aacacagcaggtcatcaccatcttc

SEQ ID NO: 160334 - DNA, 25 bp, Mus musculus
aacacagccaaagatcggaaccgct

SEQ ID NO: 160335 - DNA, 25 bp, Mus musculus
aacacagccatggatgtgcagcagc

SEQ ID NO: 160336 - DNA, 25 bp, Mus musculus
aacacagccatggctgtgtgcaata

SEQ ID NO: 160337 - DNA, 25 bp, Mus musculus
aacacagccggatgttctttggcaa

SEQ ID NO: 160338 - DNA, 25 bp, Mus musculus
aacacaggacatcaggctctgtgtg

SEQ ID NO: 160339 - DNA, 25 bp, Mus musculus
aacacaggacccaagtacattcacc

SEQ ID NO: 160340 - DNA, 25 bp, Mus musculus
aacacaggagctccttctggccgca

SEQ ID NO: 160341 - DNA, 25 bp, Mus musculus
aacacagtccaaggtcacacggtta

SEQ ID NO: 160342 - DNA, 25 bp, Mus musculus
aacacagtctcagctgccacccgat

SEQ ID NO: 160343 - DNA, 25 bp, Mus musculus
aacacagtctcagctgcctcctggt

SEQ ID NO: 160344 - DNA, 25 bp, Mus musculus
aacacagtgccaggcaggtcggata

SEQ ID NO: 160345 - DNA, 25 bp, Mus musculus
aacacagtgccagggagcccagagg

SEQ ID NO: 160346 - DNA, 25 bp, Mus musculus
aacacagtgtaaaaacagaaagtgt

SEQ ID NO: 160347 - DNA, 25 bp, Mus musculus
aacacagttatgaacatcagaaagc

SEQ ID NO: 160348 - DNA, 25 bp, Mus musculus
aacacagttatgtatgcaattggca

SEQ ID NO: 160349 - DNA, 25 bp, Mus musculus
aacacagttgctcctgaattcggac

SEQ ID NO: 160350 - DNA, 25 bp, Mus musculus
aacacataaaggcaagaaaactgga

SEQ ID NO: 160351 - DNA, 25 bp, Mus musculus
aacacataccaggttacaaggacag

SEQ ID NO: 160352 - DNA, 25 bp, Mus musculus
aacacatagcagataaacttctgca

SEQ ID NO: 160353 - DNA, 25 bp, Mus musculus
aacacatataaggaggaatttggct

SEQ ID NO: 160354 - DNA, 25 bp, Mus musculus
aacacatcacttgtcttccccaggg

SEQ ID NO: 160355 - DNA, 25 bp, Mus musculus
aacacatctgctctcctctgatgaa

SEQ ID NO: 160356 - DNA, 25 bp, Mus musculus
aacacatgaacaggagtccttgcca

SEQ ID NO: 160357 - DNA, 25 bp, Mus musculus
aacacatgaaggttcatgaatctca

SEQ ID NO: 160358 - DNA, 25 bp, Mus musculus
aacacatgaagtgttgtcctgcttg

SEQ ID NO: 160359 - DNA, 25 bp, Mus musculus
aacacatgagtaaggtagcctccaa

SEQ ID NO: 160360 - DNA, 25 bp, Mus musculus
aacacatggtgacagtccctctgag

SEQ ID NO: 160361 - DNA, 25 bp, Mus musculus
aacacatgtaaggtatcgcaaacgc

SEQ ID NO: 160362 - DNA, 25 bp, Mus musculus
aacacatgtaagtccaacccctgtc

SEQ ID NO: 160363 - DNA, 25 bp, Mus musculus
aacacattccaaagtatagcacatt

SEQ ID NO: 160364 - DNA, 25 bp, Mus musculus
aacacattccaaagtttatgttttg

SEQ ID NO: 160365 - DNA, 25 bp, Mus musculus
aacacattgaagcaataccttctga

SEQ ID NO: 160366 - DNA, 25 bp, Mus musculus
aacacattgcaggctgcagatgtgt

SEQ ID NO: 160367 - DNA, 25 bp, Mus musculus
aacacattgcagttggaacaagagg

SEQ ID NO: 160368 - DNA, 25 bp, Mus musculus
aacaccaaaaggccgaggggcaaag

SEQ ID NO: 160369 - DNA, 25 bp, Mus musculus
aacaccaaaagtgcccatggaggct

SEQ ID NO: 160370 - DNA, 25 bp, Mus musculus
aacaccaaaatctgtagattgtttc

SEQ ID NO: 160371 - DNA, 25 bp, Mus musculus
aacaccaaaggcgacctggcgagaa

SEQ ID NO: 160372 - DNA, 25 bp, Mus musculus
aacaccaaagtggacatgacttgtg

SEQ ID NO: 160373 - DNA, 25 bp, Mus musculus
aacaccaacaaagggcgagaacttt

SEQ ID NO: 160374 - DNA, 25 bp, Mus musculus
aacaccaacagatgttctgatggca

SEQ ID NO: 160375 - DNA, 25 bp, Mus musculus
aacaccaacaggggtggtggatttc

SEQ ID NO: 160376 - DNA, 25 bp, Mus musculus
aacaccaaccttcacctgggcctag

SEQ ID NO: 160377 - DNA, 25 bp, Mus musculus
aacaccaagagaggtattgtggcca

SEQ ID NO: 160378 - DNA, 25 bp, Mus musculus
aacaccaagagcttactggcggttt

SEQ ID NO: 160379 - DNA, 25 bp, Mus musculus
aacaccacaagagcatcgcaacatg

SEQ ID NO: 160380 - DNA, 25 bp, Mus musculus
aacaccaccaatgtgagaggagaga

SEQ ID NO: 160381 - DNA, 25 bp, Mus musculus
aacaccaccagagccctgcaggccc

SEQ ID NO: 160382 - DNA, 25 bp, Mus musculus
aacaccactgcagcagatccacaga

SEQ ID NO: 160383 - DNA, 25 bp, Mus musculus
aacaccagaagggccggcccaccag

SEQ ID NO: 160384 - DNA, 25 bp, Mus musculus
aacaccaggaaagattaattgcctg

SEQ ID NO: 160385 - DNA, 25 bp, Mus musculus
aacaccaggacttgcttgtgacgaa

SEQ ID NO: 160386 - DNA, 25 bp, Mus musculus
aacaccaggacttggactattttga

SEQ ID NO: 160387 - DNA, 25 bp, Mus musculus
aacaccaggcagagagatcgcctta

SEQ ID NO: 160388 - DNA, 25 bp, Mus musculus
aacaccagtgataaactcgatgacc

SEQ ID NO: 160389 - DNA, 25 bp, Mus musculus
aacaccatccagcacgtgcaggctc

SEQ ID NO: 160390 - DNA, 25 bp, Mus musculus
aacaccatctttgcacccaggattc

SEQ ID NO: 160391 - DNA, 25 bp, Mus musculus
aacaccatctttgcatgaaagcccc

SEQ ID NO: 160392 - DNA, 25 bp, Mus musculus
aacaccatctttggattcaattttt

SEQ ID NO: 160393 - DNA, 25 bp, Mus musculus
aacaccatgaggcaaaagcaaaaga

SEQ ID NO: 160394 - DNA, 25 bp, Mus musculus
aacaccatggacaaaagcttcaatt

SEQ ID NO: 160395 - DNA, 25 bp, Mus musculus
aacaccatggtgtttcctggctctc

SEQ ID NO: 160396 - DNA, 25 bp, Mus musculus
aacaccattaaaagggggaggagtg

SEQ ID NO: 160397 - DNA, 25 bp, Mus musculus
aacaccattgaaatcccagcctgca

SEQ ID NO: 160398 - DNA, 25 bp, Mus musculus
aacaccattgaaggtcctcaacttt

SEQ ID NO: 160399 - DNA, 25 bp, Mus musculus
aacacccagagaagagtaaactggt

SEQ ID NO: 160400 - DNA, 25 bp, Mus musculus
aacacccagagggaagtgggctaaa

SEQ ID NO: 160401 - DNA, 25 bp, Mus musculus
aacacccagcttcagctgtttgttc

SEQ ID NO: 160402 - DNA, 25 bp, Mus musculus
aacacccaggcctgcagtggggact

SEQ ID NO: 160403 - DNA, 25 bp, Mus musculus
aacacccatggacactccagcacgg

SEQ ID NO: 160404 - DNA, 25 bp, Mus musculus
aacaccccctcagtggccacagtta

SEQ ID NO: 160405 - DNA, 25 bp, Mus musculus
aacaccccgggcttgcccaggtggc

SEQ ID NO: 160406 - DNA, 25 bp, Mus musculus
aacacccctgtggatatgactccct

SEQ ID NO: 160407 - DNA, 25 bp, Mus musculus
aacacccctgtggattccactgtat

SEQ ID NO: 160408 - DNA, 25 bp, Mus musculus
aacaccccttcagtgcctgtgctga

SEQ ID NO: 160409 - DNA, 25 bp, Mus musculus
aacaccctagatgtgctcctggagg

SEQ ID NO: 160410 - DNA, 25 bp, Mus musculus
aacaccctgacctaagtcgaatggt

SEQ ID NO: 160411 - DNA, 25 bp, Mus musculus
aacaccctgatgcttcctttgcagc

SEQ ID NO: 160412 - DNA, 25 bp, Mus musculus
aacaccctgggaaacaagggagcag

SEQ ID NO: 160413 - DNA, 25 bp, Mus musculus
aacaccctgggaaatgtgtgtctgt

SEQ ID NO: 160414 - DNA, 25 bp, Mus musculus
aacaccctgggcattggggctttcc

SEQ ID NO: 160415 - DNA, 25 bp, Mus musculus
aacaccctgggttttagatgcctct

SEQ ID NO: 160416 - DNA, 25 bp, Mus musculus
aacaccctgtgtgtgttttgggaag

SEQ ID NO: 160417 - DNA, 25 bp, Mus musculus
aacaccgaaaaccccagatctgtgc

SEQ ID NO: 160418 - DNA, 25 bp, Mus musculus
aacaccgacgagtccatttcgggct

SEQ ID NO: 160419 - DNA, 25 bp, Mus musculus
aacaccgctgccaggcacaatggaa

SEQ ID NO: 160420 - DNA, 25 bp, Mus musculus
aacaccggcaagatagttgaagtat

SEQ ID NO: 160421 - DNA, 25 bp, Mus musculus
aacaccgggaaaaagcaagaccaca

SEQ ID NO: 160422 - DNA, 25 bp, Mus musculus
aacacctaaagccttagggtcagca

SEQ ID NO: 160423 - DNA, 25 bp, Mus musculus
aacacctaaagcggactcctctgat

SEQ ID NO: 160424 - DNA, 25 bp, Mus musculus
aacacctaacccggctggccaaggt

SEQ ID NO: 160425 - DNA, 25 bp, Mus musculus
aacacctagagagttgcttcagatc

SEQ ID NO: 160426 - DNA, 25 bp, Mus musculus
aacacctcaaaggccacgagaccca

SEQ ID NO: 160427 - DNA, 25 bp, Mus musculus
aacacctcgaaggaatggaagaaag

SEQ ID NO: 160428 - DNA, 25 bp, Mus musculus
aacacctcgaaggtacacaactgga

SEQ ID NO: 160429 - DNA, 25 bp, Mus musculus
aacacctctactgccgcccacggac

SEQ ID NO: 160430 - DNA, 25 bp, Mus musculus
aacacctctgcagttacggacgagt

SEQ ID NO: 160431 - DNA, 25 bp, Mus musculus
aacacctgcagatgcaagttgttct

SEQ ID NO: 160432 - DNA, 25 bp, Mus musculus
aacacctgctctatgtgctgatgga

SEQ ID NO: 160433 - DNA, 25 bp, Mus musculus
aacacctggagagtgagaagatgct

SEQ ID NO: 160434 - DNA, 25 bp, Mus musculus
aacacctggccaaagggtcattatc

SEQ ID NO: 160435 - DNA, 25 bp, Mus musculus
aacacctggccaaaggtcagcctcc

SEQ ID NO: 160436 - DNA, 25 bp, Mus musculus
aacacctggccaaaggtcggacatc

SEQ ID NO: 160437 - DNA, 25 bp, Mus musculus
aacaccttatcaagcactggagggc

SEQ ID NO: 160438 - DNA, 25 bp, Mus musculus
aacaccttatcaaggctcagaggca

SEQ ID NO: 160439 - DNA, 25 bp, Mus musculus
aacaccttcttttgcttctgcagtg

SEQ ID NO: 160440 - DNA, 25 bp, Mus musculus
aacaccttcttttggcgtgcccaca

SEQ ID NO: 160441 - DNA, 25 bp, Mus musculus
aacaccttgcagaacattccaggat

SEQ ID NO: 160442 - DNA, 25 bp, Mus musculus
aacaccttgcatcccacgagtccta

SEQ ID NO: 160443 - DNA, 25 bp, Mus musculus
aacacgaacgcagggcactgcagaa

SEQ ID NO: 160444 - DNA, 25 bp, Mus musculus
aacacgaagaggtatatgtggttgc

SEQ ID NO: 160445 - DNA, 25 bp, Mus musculus
aacacgacaaggtgtccaggcctca

SEQ ID NO: 160446 - DNA, 25 bp, Mus musculus
aacacgaccaggtctcccagtggac

SEQ ID NO: 160447 - DNA, 25 bp, Mus musculus
aacacgcaagacagcagtccgttcc

SEQ ID NO: 160448 - DNA, 25 bp, Mus musculus
aacacgcaagggtgagatctttggc

SEQ ID NO: 160449 - DNA, 25 bp, Mus musculus
aacacgcccacccaggaaatcctga

SEQ ID NO: 160450 - DNA, 25 bp, Mus musculus
aacacgcccacccaggaatccatca

SEQ ID NO: 160451 - DNA, 25 bp, Mus musculus
aacacgccctgaaccgcttgggtgt

SEQ ID NO: 160452 - DNA, 25 bp, Mus musculus
aacacgccgcggggagaccatgaga

SEQ ID NO: 160453 - DNA, 25 bp, Mus musculus
aacacgccgcggggatccacctgat

SEQ ID NO: 160454 - DNA, 25 bp, Mus musculus
aacacgccttggccggaatgtgtat

SEQ ID NO: 160455 - DNA, 25 bp, Mus musculus
aacacgccttggggttctctgtgta

SEQ ID NO: 160456 - DNA, 25 bp, Mus musculus
aacacgcgcaagccctgaggtgcgc

SEQ ID NO: 160457 - DNA, 25 bp, Mus musculus
aacacgctcagaaatgacctgcagc

SEQ ID NO: 160458 - DNA, 25 bp, Mus musculus
aacacggcatagatttcaccgagat

SEQ ID NO: 160459 - DNA, 25 bp, Mus musculus
aacacggcataggaccactgcaaag

SEQ ID NO: 160460 - DNA, 25 bp, Mus musculus
aacacggcataggagctggtggcca

SEQ ID NO: 160461 - DNA, 25 bp, Mus musculus
aacacggctcaagcaaggaccatgg

SEQ ID NO: 160462 - DNA, 25 bp, Mus musculus
aacacggctgggaagaccctgtttg

SEQ ID NO: 160463 - DNA, 25 bp, Mus musculus
aacacggtagatctagccttttctg

SEQ ID NO: 160464 - DNA, 25 bp, Mus musculus
aacacggtagatctagttacaacct

SEQ ID NO: 160465 - DNA, 25 bp, Mus musculus
aacacgtcacaatgatttctatggg

SEQ ID NO: 160466 - DNA, 25 bp, Mus musculus
aacactaaaataaatatccatggga

SEQ ID NO: 160467 - DNA, 25 bp, Mus musculus
aacactaaaataaatcatacctgcg

SEQ ID NO: 160468 - DNA, 25 bp, Mus musculus
aacactaaagcagaggtgaaagaca

SEQ ID NO: 160469 - DNA, 25 bp, Mus musculus
aacactaaggaaacaggtctggaac

SEQ ID NO: 160470 - DNA, 25 bp, Mus musculus
aacactaaggatcatggatatacca

SEQ ID NO: 160471 - DNA, 25 bp, Mus musculus
aacactacaaatcccctagtgagct

SEQ ID NO: 160472 - DNA, 25 bp, Mus musculus
aacactacatgaagtattacaatga

SEQ ID NO: 160473 - DNA, 25 bp, Mus musculus
aacactactgaccacgatgatgcca

SEQ ID NO: 160474 - DNA, 25 bp, Mus musculus
aacactagctagaggcaactcgcca

SEQ ID NO: 160475 - DNA, 25 bp, Mus musculus
aacactagctagagggtacaaagga

SEQ ID NO: 160476 - DNA, 25 bp, Mus musculus
aacactaggattgcgattttctacc

SEQ ID NO: 160477 - DNA, 25 bp, Mus musculus
aacactagtgccagcttcggtggtg

SEQ ID NO: 160478 - DNA, 25 bp, Mus musculus
aacactatagtgaagcccctggtca

SEQ ID NO: 160479 - DNA, 25 bp, Mus musculus
aacactatagtgaaggtgtttccta

SEQ ID NO: 160480 - DNA, 25 bp, Mus musculus
aacactatcacagacacgtgcgacc

SEQ ID NO: 160481 - DNA, 25 bp, Mus musculus
aacactatcacagacgatctagaag

SEQ ID NO: 160482 - DNA, 25 bp, Mus musculus
aacactatccaggtcaggctgctac

SEQ ID NO: 160483 - DNA, 25 bp, Mus musculus
aacactatccagtgggatctgccgc

SEQ ID NO: 160484 - DNA, 25 bp, Mus musculus
aacactcaaagattgacatggtaca

SEQ ID NO: 160485 - DNA, 25 bp, Mus musculus
aacactcaaaggagttgcaagcaca

SEQ ID NO: 160486 - DNA, 25 bp, Mus musculus
aacactcagcagcgaatgagcatgc

SEQ ID NO: 160487 - DNA, 25 bp, Mus musculus
aacactcatctaagggagatgaagg

SEQ ID NO: 160488 - DNA, 25 bp, Mus musculus
aacactccaggtcgcagacactttg

SEQ ID NO: 160489 - DNA, 25 bp, Mus musculus
aacactcctctacacttagcctgtg

SEQ ID NO: 160490 - DNA, 25 bp, Mus musculus
aacactcgaccacaggaagaagagc

SEQ ID NO: 160491 - DNA, 25 bp, Mus musculus
aacactctactggatgactggaaac

SEQ ID NO: 160492 - DNA, 25 bp, Mus musculus
aacactctcctctcagaggctctgg

SEQ ID NO: 160493 - DNA, 25 bp, Mus musculus
aacactctctaatatgtttatggag

SEQ ID NO: 160494 - DNA, 25 bp, Mus musculus
aacactcttcaaaggctttggagac

SEQ ID NO: 160495 - DNA, 25 bp, Mus musculus
aacactgaaaggggcatctgatgat

SEQ ID NO: 160496 - DNA, 25 bp, Mus musculus
aacactgaagttatgagagagattc

SEQ ID NO: 160497 - DNA, 25 bp, Mus musculus
aacactgaagttatgcagggatggc

SEQ ID NO: 160498 - DNA, 25 bp, Mus musculus
aacactgacagggatcaagtttgtg

SEQ ID NO: 160499 - DNA, 25 bp, Mus musculus
aacactgacgcttttgtcaatcttg

SEQ ID NO: 160500 - DNA, 25 bp, Mus musculus
aacactgactttgccttcaatctca

SEQ ID NO: 160501 - DNA, 25 bp, Mus musculus
aacactgagacccaagggcctgatt

SEQ ID NO: 160502 - DNA, 25 bp, Mus musculus
aacactgagcaacagtccaacttta

SEQ ID NO: 160503 - DNA, 25 bp, Mus musculus
aacactgagcaagagtccaacttta

SEQ ID NO: 160504 - DNA, 25 bp, Mus musculus
aacactgagggcagggcctacgtcg

SEQ ID NO: 160505 - DNA, 25 bp, Mus musculus
aacactgatcaagaaaatcttgttg

SEQ ID NO: 160506 - DNA, 25 bp, Mus musculus
aacactgatgcaaagttccaggtgt

SEQ ID NO: 160507 - DNA, 25 bp, Mus musculus
aacactgcagaggactagagtgtct

SEQ ID NO: 160508 - DNA, 25 bp, Mus musculus
aacactgcagggtctccaactgact

SEQ ID NO: 160509 - DNA, 25 bp, Mus musculus
aacactgccccaggaaagggtcacg

SEQ ID NO: 160510 - DNA, 25 bp, Mus musculus
aacactgcttgggaaatcctcaagg

SEQ ID NO: 160511 - DNA, 25 bp, Mus musculus
aacactgcttggttcgttccaccag

SEQ ID NO: 160512 - DNA, 25 bp, Mus musculus
aacactgcttggttggtgttaaggg

SEQ ID NO: 160513 - DNA, 25 bp, Mus musculus
aacactggcagaggtacggagtttg

SEQ ID NO: 160514 - DNA, 25 bp, Mus musculus
aacactggccgagggatggaattcg

SEQ ID NO: 160515 - DNA, 25 bp, Mus musculus
aacactggccggacccacattgtgg

SEQ ID NO: 160516 - DNA, 25 bp, Mus musculus
aacactggccggagaagctggaggg

SEQ ID NO: 160517 - DNA, 25 bp, Mus musculus
aacactggccggcacaatatgacga

SEQ ID NO: 160518 - DNA, 25 bp, Mus musculus
aacactggcgagaagaccaccatgc

SEQ ID NO: 160519 - DNA, 25 bp, Mus musculus
aacactgggcgcaggtttacctatt

SEQ ID NO: 160520 - DNA, 25 bp, Mus musculus
aacactgtccaacactggccagtgt

SEQ ID NO: 160521 - DNA, 25 bp, Mus musculus
aacactgtctagcaccatcaaaaag

SEQ ID NO: 160522 - DNA, 25 bp, Mus musculus
aacactgttttgagagtggagtcaa

SEQ ID NO: 160523 - DNA, 25 bp, Mus musculus
aacacttaaagtatcaagagagcct

SEQ ID NO: 160524 - DNA, 25 bp, Mus musculus
aacacttatccaggctgaataaaaa

SEQ ID NO: 160525 - DNA, 25 bp, Mus musculus
aacacttatccagggtgtattgaga

SEQ ID NO: 160526 - DNA, 25 bp, Mus musculus
aacacttcaacagttatcagagact

SEQ ID NO: 160527 - DNA, 25 bp, Mus musculus
aacacttcattggccccagagcagc

SEQ ID NO: 160528 - DNA, 25 bp, Mus musculus
aacacttccaacaagaggaaaaagc

SEQ ID NO: 160529 - DNA, 25 bp, Mus musculus
aacacttctctcaggcaggcaacct

SEQ ID NO: 160530 - DNA, 25 bp, Mus musculus
aacacttgaaacagttccctggcag

SEQ ID NO: 160531 - DNA, 25 bp, Mus musculus
aacacttgaaaccagcgtgcagggt

SEQ ID NO: 160532 - DNA, 25 bp, Mus musculus
aacacttggtgatgaagatgaatgt

SEQ ID NO: 160533 - DNA, 25 bp, Mus musculus
aacacttggtggtgtgaatgagtgt

SEQ ID NO: 160534 - DNA, 25 bp, Mus musculus
aacacttggttatgaggaggatgtt

SEQ ID NO: 160535 - DNA, 25 bp, Mus musculus
aacacttgttatcagttgaatctgg

SEQ ID NO: 160536 - DNA, 25 bp, Mus musculus
aacactttctgtccacttcagtcca

SEQ ID NO: 160537 - DNA, 25 bp, Mus musculus
aacactttgaagtcttgaagaacca

SEQ ID NO: 160538 - DNA, 25 bp, Mus musculus
aacactttgagaagcaccaggcgtt

SEQ ID NO: 160539 - DNA, 25 bp, Mus musculus
aacactttgcaaaggcaaaatcatg

SEQ ID NO: 160540 - DNA, 25 bp, Mus musculus
aacagaaaaaaattgaggagacttc

SEQ ID NO: 160541 - DNA, 25 bp, Mus musculus
aacagaaaacggaggatggacagtc

SEQ ID NO: 160542 - DNA, 25 bp, Mus musculus
aacagaaaaggagtgtgtgagggag

SEQ ID NO: 160543 - DNA, 25 bp, Mus musculus
aacagaaaaggcagccggagcatat

SEQ ID NO: 160544 - DNA, 25 bp, Mus musculus
aacagaaaatgcacgagcctggtta

SEQ ID NO: 160545 - DNA, 25 bp, Mus musculus
aacagaaacaagctccttgctcgga

SEQ ID NO: 160546 - DNA, 25 bp, Mus musculus
aacagaaacacacaggcagatgtca

SEQ ID NO: 160547 - DNA, 25 bp, Mus musculus
aacagaaacaggtgattttttcagc

SEQ ID NO: 160548 - DNA, 25 bp, Mus musculus
aacagaaaccagattcatccagtgg

SEQ ID NO: 160549 - DNA, 25 bp, Mus musculus
aacagaaatgaaggctccagccagg

SEQ ID NO: 160550 - DNA, 25 bp, Mus musculus
aacagaaatgctgagatggtgcagt

SEQ ID NO: 160551 - DNA, 25 bp, Mus musculus
aacagaacagatgacacttctcaag

SEQ ID NO: 160552 - DNA, 25 bp, Mus musculus
aacagaacaggatttgtgcaggaat

SEQ ID NO: 160553 - DNA, 25 bp, Mus musculus
aacagaacagtgctcttggctccag

SEQ ID NO: 160554 - DNA, 25 bp, Mus musculus
aacagaaccagccaacagccatcat

SEQ ID NO: 160555 - DNA, 25 bp, Mus musculus
aacagaaccagcccatcattcaggt

SEQ ID NO: 160556 - DNA, 25 bp, Mus musculus
aacagaacgagcagcttttgaaatc

SEQ ID NO: 160557 - DNA, 25 bp, Mus musculus
aacagaacgagcaggcgaaggagat

SEQ ID NO: 160558 - DNA, 25 bp, Mus musculus
aacagaagaaaaattcatcgttaaa

SEQ ID NO: 160559 - DNA, 25 bp, Mus musculus
aacagaagaaagaggaagtttgttt

SEQ ID NO: 160560 - DNA, 25 bp, Mus musculus
aacagaagaaagaggttatggcttt

SEQ ID NO: 160561 - DNA, 25 bp, Mus musculus
aacagaagaacagatggaggccttt

SEQ ID NO: 160562 - DNA, 25 bp, Mus musculus
aacagaagaacagtgtcccagcaga

SEQ ID NO: 160563 - DNA, 25 bp, Mus musculus
aacagaagagaaagaaagaccagag

SEQ ID NO: 160564 - DNA, 25 bp, Mus musculus
aacagaagaggaacaagttgatctg

SEQ ID NO: 160565 - DNA, 25 bp, Mus musculus
aacagaagaggatgaaacaagtgaa

SEQ ID NO: 160566 - DNA, 25 bp, Mus musculus
aacagaagagtctgaggttatgcga

SEQ ID NO: 160567 - DNA, 25 bp, Mus musculus
aacagaagatgaagatgtctggtga

SEQ ID NO: 160568 - DNA, 25 bp, Mus musculus
aacagaagcaacaggaggctgatcg

SEQ ID NO: 160569 - DNA, 25 bp, Mus musculus
aacagaagcagagcagcagaccaca

SEQ ID NO: 160570 - DNA, 25 bp, Mus musculus
aacagaagcgagacggtgttctgaa

SEQ ID NO: 160571 - DNA, 25 bp, Mus musculus
aacagaagcgcaaggtgtcagacaa

SEQ ID NO: 160572 - DNA, 25 bp, Mus musculus
aacagaagctgacatcatgttcatg

SEQ ID NO: 160573 - DNA, 25 bp, Mus musculus
aacagaagctgcatgtctgctggta

SEQ ID NO: 160574 - DNA, 25 bp, Mus musculus
aacagaaggagctccatctgtagca

SEQ ID NO: 160575 - DNA, 25 bp, Mus musculus
aacagaaggcgacatcccaggcatc

SEQ ID NO: 160576 - DNA, 25 bp, Mus musculus
aacagaagtggaagagacaatgaat

SEQ ID NO: 160577 - DNA, 25 bp, Mus musculus
aacagaatatcacatacacaaaatt

SEQ ID NO: 160578 - DNA, 25 bp, Mus musculus
aacagaatatcagatacacaaaatt

SEQ ID NO: 160579 - DNA, 25 bp, Mus musculus
aacagaatcgaggtacaaccagcat

SEQ ID NO: 160580 - DNA, 25 bp, Mus musculus
aacagaatgcaggctggtgagattg

SEQ ID NO: 160581 - DNA, 25 bp, Mus musculus
aacagaattccaggacagagatttc

SEQ ID NO: 160582 - DNA, 25 bp, Mus musculus
aacagacaaaaattaactgaaacag

SEQ ID NO: 160583 - DNA, 25 bp, Mus musculus
aacagacaaaagccaaccatattct

SEQ ID NO: 160584 - DNA, 25 bp, Mus musculus
aacagacaaagcaagctaccaagag

SEQ ID NO: 160585 - DNA, 25 bp, Mus musculus
aacagacaaagcaaggagtaatata

SEQ ID NO: 160586 - DNA, 25 bp, Mus musculus
aacagacaacctgacagatcgttac

SEQ ID NO: 160587 - DNA, 25 bp, Mus musculus
aacagacaactcaacagcacagtca

SEQ ID NO: 160588 - DNA, 25 bp, Mus musculus
aacagacaactcaattagcaatagc

SEQ ID NO: 160589 - DNA, 25 bp, Mus musculus
aacagacaagagagatgcctcagga

SEQ ID NO: 160590 - DNA, 25 bp, Mus musculus
aacagacaagcctttgaggacctct

SEQ ID NO: 160591 - DNA, 25 bp, Mus musculus
aacagacaagggtgtgtctgcagca

SEQ ID NO: 160592 - DNA, 25 bp, Mus musculus
aacagacaatgaagataaaattgct

SEQ ID NO: 160593 - DNA, 25 bp, Mus musculus
aacagacaatgaagtgtttgctggt

SEQ ID NO: 160594 - DNA, 25 bp, Mus musculus
aacagacacaagttttgagaaatgg

SEQ ID NO: 160595 - DNA, 25 bp, Mus musculus
aacagacacagctcacagacttcgg

SEQ ID NO: 160596 - DNA, 25 bp, Mus musculus
aacagacacaggtaccagagagatg

SEQ ID NO: 160597 - DNA, 25 bp, Mus musculus
aacagacacaggtggggtgaactga

SEQ ID NO: 160598 - DNA, 25 bp, Mus musculus
aacagaccagagatgggcagcagtg

SEQ ID NO: 160599 - DNA, 25 bp, Mus musculus
aacagaccatgcaagtgaacgaagc

SEQ ID NO: 160600 - DNA, 25 bp, Mus musculus
aacagaccatgcaagtggaaagtac

SEQ ID NO: 160601 - DNA, 25 bp, Mus musculus
aacagaccccaaaggagccaagtca

SEQ ID NO: 160602 - DNA, 25 bp, Mus musculus
aacagaccgcagaagttatatgagt

SEQ ID NO: 160603 - DNA, 25 bp, Mus musculus
aacagacctcgcggaaaactgtcct

SEQ ID NO: 160604 - DNA, 25 bp, Mus musculus
aacagacctcgcgggcccatcctcc

SEQ ID NO: 160605 - DNA, 25 bp, Mus musculus
aacagacgaccttgttgccgctggt

SEQ ID NO: 160606 - DNA, 25 bp, Mus musculus
aacagactaaagactatgctgagtc

SEQ ID NO: 160607 - DNA, 25 bp, Mus musculus
aacagagacaaaggaacaagttgat

SEQ ID NO: 160608 - DNA, 25 bp, Mus musculus
aacagagacaggcatccgtccctgc

SEQ ID NO: 160609 - DNA, 25 bp, Mus musculus
aacagagagaaataatgaagcattg

SEQ ID NO: 160610 - DNA, 25 bp, Mus musculus
aacagagagaaggcttcgtgagctt

SEQ ID NO: 160611 - DNA, 25 bp, Mus musculus
aacagagagaagggcccgagggctg

SEQ ID NO: 160612 - DNA, 25 bp, Mus musculus
aacagagagagccgaagccgaaagc

SEQ ID NO: 160613 - DNA, 25 bp, Mus musculus
aacagagagagccgaatattaatta

SEQ ID NO: 160614 - DNA, 25 bp, Mus musculus
aacagagagaggtgaaacctttgtc

SEQ ID NO: 160615 - DNA, 25 bp, Mus musculus
aacagagagcagatcttgagtgcac

SEQ ID NO: 160616 - DNA, 25 bp, Mus musculus
aacagagatgattctgacaatggag

SEQ ID NO: 160617 - DNA, 25 bp, Mus musculus
aacagagatggatggacagtctgag

SEQ ID NO: 160618 - DNA, 25 bp, Mus musculus
aacagagatttgctggatctcatgg

SEQ ID NO: 160619 - DNA, 25 bp, Mus musculus
aacagagatttgtctcaatggaaac

SEQ ID NO: 160620 - DNA, 25 bp, Mus musculus
aacagagcaagtgacaaatgacctc

SEQ ID NO: 160621 - DNA, 25 bp, Mus musculus
aacagagcaatctctggcaaacatt

SEQ ID NO: 160622 - DNA, 25 bp, Mus musculus
aacagagccttcaagaagttgctct

SEQ ID NO: 160623 - DNA, 25 bp, Mus musculus
aacagagctacagaatcatacgatg

SEQ ID NO: 160624 - DNA, 25 bp, Mus musculus
aacagagctacagtggcacctgaca

SEQ ID NO: 160625 - DNA, 25 bp, Mus musculus
aacagaggatccagcaaccagacct

SEQ ID NO: 160626 - DNA, 25 bp, Mus musculus
aacagaggatccaggagctcgaaca

SEQ ID NO: 160627 - DNA, 25 bp, Mus musculus
aacagaggcgtgcagatccaagcaa

SEQ ID NO: 160628 - DNA, 25 bp, Mus musculus
aacagaggctgtgggtctgcagctg

SEQ ID NO: 160629 - DNA, 25 bp, Mus musculus
aacagaggcttccagatgggaacca

SEQ ID NO: 160630 - DNA, 25 bp, Mus musculus
aacagaggcttccaggtcagaagcc

SEQ ID NO: 160631 - DNA, 25 bp, Mus musculus
aacagagtaccactcattcggcgac

SEQ ID NO: 160632 - DNA, 25 bp, Mus musculus
aacagagtagctatggacgtggagg

SEQ ID NO: 160633 - DNA, 25 bp, Mus musculus
aacagagtcattgattaggttatac

SEQ ID NO: 160634 - DNA, 25 bp, Mus musculus
aacagagtccatgagtttacaggaa

SEQ ID NO: 160635 - DNA, 25 bp, Mus musculus
aacagagtccgggagactcgatctg

SEQ ID NO: 160636 - DNA, 25 bp, Mus musculus
aacagagtggatcacattccaggtc

SEQ ID NO: 160637 - DNA, 25 bp, Mus musculus
aacagataagaaagatggcttgcca

SEQ ID NO: 160638 - DNA, 25 bp, Mus musculus
aacagataagccctccctgaccctg

SEQ ID NO: 160639 - DNA, 25 bp, Mus musculus
aacagatagaagaagaaaagcagca

SEQ ID NO: 160640 - DNA, 25 bp, Mus musculus
aacagatagaagatcaacaacccct

SEQ ID NO: 160641 - DNA, 25 bp, Mus musculus
aacagatagagaaaaagtaaagaca

SEQ ID NO: 160642 - DNA, 25 bp, Mus musculus
aacagatagagaaaagtacaacaga

SEQ ID NO: 160643 - DNA, 25 bp, Mus musculus
aacagatagcctaggttcaaccagg

SEQ ID NO: 160644 - DNA, 25 bp, Mus musculus
aacagatcacaagggttctcttgga

SEQ ID NO: 160645 - DNA, 25 bp, Mus musculus
aacagatcagtatggtccatattgt

SEQ ID NO: 160646 - DNA, 25 bp, Mus musculus
aacagatccagcaattcttggccac

SEQ ID NO: 160647 - DNA, 25 bp, Mus musculus
aacagatccaggttcaggggcacat

SEQ ID NO: 160648 - DNA, 25 bp, Mus musculus
aacagatcgaagttaaaattgaaga

SEQ ID NO: 160649 - DNA, 25 bp, Mus musculus
aacagatgaacctgtcctaaaggaa

SEQ ID NO: 160650 - DNA, 25 bp, Mus musculus
aacagatgacaggtctgaggagggc

SEQ ID NO: 160651 - DNA, 25 bp, Mus musculus
aacagatgcgaacatgtggatgagt

SEQ ID NO: 160652 - DNA, 25 bp, Mus musculus
aacagatgcgaagatgtggatgagt

SEQ ID NO: 160653 - DNA, 25 bp, Mus musculus
aacagatggaatctgtctctctcct

SEQ ID NO: 160654 - DNA, 25 bp, Mus musculus
aacagattcagagcctctctcccag

SEQ ID NO: 160655 - DNA, 25 bp, Mus musculus
aacagattcagcagcagcaacagca

SEQ ID NO: 160656 - DNA, 25 bp, Mus musculus
aacagatttcacgtgtcaccatgct

SEQ ID NO: 160657 - DNA, 25 bp, Mus musculus
aacagatttcctctgcccctcagct

SEQ ID NO: 160658 - DNA, 25 bp, Mus musculus
aacagcaaaggtcaatatccaacac

SEQ ID NO: 160659 - DNA, 25 bp, Mus musculus
aacagcaacgttttacaaacctgaa

SEQ ID NO: 160660 - DNA, 25 bp, Mus musculus
aacagcaagatccaccaatgtttcc

SEQ ID NO: 160661 - DNA, 25 bp, Mus musculus
aacagcaagcggaatatctccatgc

SEQ ID NO: 160662 - DNA, 25 bp, Mus musculus
aacagcaagcggatttcccttttct

SEQ ID NO: 160663 - DNA, 25 bp, Mus musculus
aacagcaagcggttcagcagaggac

SEQ ID NO: 160664 - DNA, 25 bp, Mus musculus
aacagcaatggcctccaactggagg

SEQ ID NO: 160665 - DNA, 25 bp, Mus musculus
aacagcaatgggccaccagaatgcc

SEQ ID NO: 160666 - DNA, 25 bp, Mus musculus
aacagcacagattctaccagtggag

SEQ ID NO: 160667 - DNA, 25 bp, Mus musculus
aacagcacaggcgtggtgactgtga

SEQ ID NO: 160668 - DNA, 25 bp, Mus musculus
aacagcaccaaggaggagacagcct

SEQ ID NO: 160669 - DNA, 25 bp, Mus musculus
aacagcactaacaggaatgcagaaa

SEQ ID NO: 160670 - DNA, 25 bp, Mus musculus
aacagcagaaagagcacagagaacc

SEQ ID NO: 160671 - DNA, 25 bp, Mus musculus
aacagcagaaagaggagttcgtgag

SEQ ID NO: 160672 - DNA, 25 bp, Mus musculus
aacagcagaaggtagagcttgagat

SEQ ID NO: 160673 - DNA, 25 bp, Mus musculus
aacagcagagaactggggaacccga

SEQ ID NO: 160674 - DNA, 25 bp, Mus musculus
aacagcagagcaagagacgaattat

SEQ ID NO: 160675 - DNA, 25 bp, Mus musculus
aacagcagatctggatccctagccc

SEQ ID NO: 160676 - DNA, 25 bp, Mus musculus
aacagcagcagcagcaacagcaaca

SEQ ID NO: 160677 - DNA, 25 bp, Mus musculus
aacagcagcaggaaaatgggaagga

SEQ ID NO: 160678 - DNA, 25 bp, Mus musculus
aacagcagcagtgtgaggatgaccc

SEQ ID NO: 160679 - DNA, 25 bp, Mus musculus
aacagcagccgcccctgccttagac

SEQ ID NO: 160680 - DNA, 25 bp, Mus musculus
aacagcaggatgtcgatcagatgtt

SEQ ID NO: 160681 - DNA, 25 bp, Mus musculus
aacagcagtgaccagctcactaagg

SEQ ID NO: 160682 - DNA, 25 bp, Mus musculus
aacagcataaacgatatgtgtcaca

SEQ ID NO: 160683 - DNA, 25 bp, Mus musculus
aacagcataaggcttgctcttcagc

SEQ ID NO: 160684 - DNA, 25 bp, Mus musculus
aacagcatcaaacaatttgtcgtcc

SEQ ID NO: 160685 - DNA, 25 bp, Mus musculus
aacagcatcaaacatggaggaatcg

SEQ ID NO: 160686 - DNA, 25 bp, Mus musculus
aacagcatggcagaggctcctcttc

SEQ ID NO: 160687 - DNA, 25 bp, Mus musculus
aacagcattgctgaggttgaaaatg

SEQ ID NO: 160688 - DNA, 25 bp, Mus musculus
aacagccaaagaaaactaactgctt

SEQ ID NO: 160689 - DNA, 25 bp, Mus musculus
aacagccaaggaggcaccgagatgg

SEQ ID NO: 160690 - DNA, 25 bp, Mus musculus
aacagccaaggcttccaagcagcat

SEQ ID NO: 160691 - DNA, 25 bp, Mus musculus
aacagccactgaaagactcgccagt

SEQ ID NO: 160692 - DNA, 25 bp, Mus musculus
aacagccagaggcagagtgaagaaa

SEQ ID NO: 160693 - DNA, 25 bp, Mus musculus
aacagccagcaagaaaccgaagaaa

SEQ ID NO: 160694 - DNA, 25 bp, Mus musculus
aacagccaggaggctctgcagaagc

SEQ ID NO: 160695 - DNA, 25 bp, Mus musculus
aacagccatgcggcttctccatgat

SEQ ID NO: 160696 - DNA, 25 bp, Mus musculus
aacagccatggcttctccatgatca

SEQ ID NO: 160697 - DNA, 25 bp, Mus musculus
aacagcccaatggtgcaggtttcgc

SEQ ID NO: 160698 - DNA, 25 bp, Mus musculus
aacagcccaatggtttcgccacgtt

SEQ ID NO: 160699 - DNA, 25 bp, Mus musculus
aacagcccagatgttctccgccatg

SEQ ID NO: 160700 - DNA, 25 bp, Mus musculus
aacagccccaccaagctcagtaaca

SEQ ID NO: 160701 - DNA, 25 bp, Mus musculus
aacagccccagcgagacagaggctt

SEQ ID NO: 160702 - DNA, 25 bp, Mus musculus
aacagccccagcgagagctagctga

SEQ ID NO: 160703 - DNA, 25 bp, Mus musculus
aacagccccagcgagtccttcgggg

SEQ ID NO: 160704 - DNA, 25 bp, Mus musculus
aacagccctatgaggtgccattgac

SEQ ID NO: 160705 - DNA, 25 bp, Mus musculus
aacagccctggaaatgtggactccg

SEQ ID NO: 160706 - DNA, 25 bp, Mus musculus
aacagccctggcactgaagatccac

SEQ ID NO: 160707 - DNA, 25 bp, Mus musculus
aacagcctaaaaaagcattcaactc

SEQ ID NO: 160708 - DNA, 25 bp, Mus musculus
aacagcctgggcatatggcctccat

SEQ ID NO: 160709 - DNA, 25 bp, Mus musculus
aacagccttagctacatcaaaatag

SEQ ID NO: 160710 - DNA, 25 bp, Mus musculus
aacagccttagctaccgccaccaga

SEQ ID NO: 160711 - DNA, 25 bp, Mus musculus
aacagccttcaaagaatgtctgtaa

SEQ ID NO: 160712 - DNA, 25 bp, Mus musculus
aacagcgaagccttggagctggtga

SEQ ID NO: 160713 - DNA, 25 bp, Mus musculus
aacagcgacgcagaaaaccaacaga

SEQ ID NO: 160714 - DNA, 25 bp, Mus musculus
aacagcgacgcagaggagcctttgg

SEQ ID NO: 160715 - DNA, 25 bp, Mus musculus
aacagcgatggtgagaaggccacta

SEQ ID NO: 160716 - DNA, 25 bp, Mus musculus
aacagcgcaggacccagaagctggg

SEQ ID NO: 160717 - DNA, 25 bp, Mus musculus
aacagcgcgggatgggggcacagca

SEQ ID NO: 160718 - DNA, 25 bp, Mus musculus
aacagcgctacctccttctggccgg

SEQ ID NO: 160719 - DNA, 25 bp, Mus musculus
aacagcggctcagagcaatcaggac

SEQ ID NO: 160720 - DNA, 25 bp, Mus musculus
aacagcggctcagaggaaagaatac

SEQ ID NO: 160721 - DNA, 25 bp, Mus musculus
aacagctaaaggcagaccattccac

SEQ ID NO: 160722 - DNA, 25 bp, Mus musculus
aacagctacttcgtaagaatgtctt

SEQ ID NO: 160723 - DNA, 25 bp, Mus musculus
aacagctagagaccaaaaccaacaa

SEQ ID NO: 160724 - DNA, 25 bp, Mus musculus
aacagctcaagatggtgaggaagaa

SEQ ID NO: 160725 - DNA, 25 bp, Mus musculus
aacagctcagagagaatccaccttg

SEQ ID NO: 160726 - DNA, 25 bp, Mus musculus
aacagctccaagatgagcgtgaagc

SEQ ID NO: 160727 - DNA, 25 bp, Mus musculus
aacagctccagcagagtcaggggat

SEQ ID NO: 160728 - DNA, 25 bp, Mus musculus
aacagctcctaacttatctacactg

SEQ ID NO: 160729 - DNA, 25 bp, Mus musculus
aacagctctgggatgtcacagccgc

SEQ ID NO: 160730 - DNA, 25 bp, Mus musculus
aacagctgaacctgaatctcctgga

SEQ ID NO: 160731 - DNA, 25 bp, Mus musculus
aacagctgaggaaggtgtcttgctg

SEQ ID NO: 160732 - DNA, 25 bp, Mus musculus
aacagctgagtttacaatccaagag

SEQ ID NO: 160733 - DNA, 25 bp, Mus musculus
aacagctgagtttacaattttctaa

SEQ ID NO: 160734 - DNA, 25 bp, Mus musculus
aacagctgagtttagaatccaagag

SEQ ID NO: 160735 - DNA, 25 bp, Mus musculus
aacagctgagtttagaattttctaa

SEQ ID NO: 160736 - DNA, 25 bp, Mus musculus
aacagctgcaggaatagtgattgac

SEQ ID NO: 160737 - DNA, 25 bp, Mus musculus
aacagctggaaggtgatttcaatct

SEQ ID NO: 160738 - DNA, 25 bp, Mus musculus
aacagctggggcagaagtggcagtg

SEQ ID NO: 160739 - DNA, 25 bp, Mus musculus
aacagctgggtccagcggctggagg

SEQ ID NO: 160740 - DNA, 25 bp, Mus musculus
aacagctgtgtcactacttcgatga

SEQ ID NO: 160741 - DNA, 25 bp, Mus musculus
aacagcttcagagagatggtgtctt

SEQ ID NO: 160742 - DNA, 25 bp, Mus musculus
aacagcttcagagagctgccaggcc

SEQ ID NO: 160743 - DNA, 25 bp, Mus musculus
aacagcttcagagagtgtttaattc

SEQ ID NO: 160744 - DNA, 25 bp, Mus musculus
aacagcttgagcccgcacagcccaa

SEQ ID NO: 160745 - DNA, 25 bp, Mus musculus
aacagcttgcaaattacaggcctga

SEQ ID NO: 160746 - DNA, 25 bp, Mus musculus
aacagctttacgatcatcactccgt

SEQ ID NO: 160747 - DNA, 25 bp, Mus musculus
aacagctttacgatcatcttgactg

SEQ ID NO: 160748 - DNA, 25 bp, Mus musculus
aacagctttgctcagtatgggtgag

SEQ ID NO: 160749 - DNA, 25 bp, Mus musculus
aacaggaaaatcagtgtctttacat

SEQ ID NO: 160750 - DNA, 25 bp, Mus musculus
aacaggaaagatcgcaaaagatgcc

SEQ ID NO: 160751 - DNA, 25 bp, Mus musculus
aacaggaaattcagcctcaagtacc

SEQ ID NO: 160752 - DNA, 25 bp, Mus musculus
aacaggaaattcaggcgatgctggg

SEQ ID NO: 160753 - DNA, 25 bp, Mus musculus
aacaggaactggtggattgtctgga

SEQ ID NO: 160754 - DNA, 25 bp, Mus musculus
aacaggaagcgtggaggatgagcat

SEQ ID NO: 160755 - DNA, 25 bp, Mus musculus
aacaggaagcttcagattataccga

SEQ ID NO: 160756 - DNA, 25 bp, Mus musculus
aacaggaagcttcaggctatgtctt

SEQ ID NO: 160757 - DNA, 25 bp, Mus musculus
aacaggaatatgtagatttgggtat

SEQ ID NO: 160758 - DNA, 25 bp, Mus musculus
aacaggaatatgtggcatcagctat

SEQ ID NO: 160759 - DNA, 25 bp, Mus musculus
aacaggaatgatccaagcagcccca

SEQ ID NO: 160760 - DNA, 25 bp, Mus musculus
aacaggacaaaaacagtacaacgta

SEQ ID NO: 160761 - DNA, 25 bp, Mus musculus
aacaggacacagagatgactcgttg

SEQ ID NO: 160762 - DNA, 25 bp, Mus musculus
aacaggaccttttcggactgggtga

SEQ ID NO: 160763 - DNA, 25 bp, Mus musculus
aacaggaccttttcggatcaagatt

SEQ ID NO: 160764 - DNA, 25 bp, Mus musculus
aacaggaccttttcgtgggagccaa

SEQ ID NO: 160765 - DNA, 25 bp, Mus musculus
aacaggagcaagaagcagcaaagct

SEQ ID NO: 160766 - DNA, 25 bp, Mus musculus
aacaggagcagatcaggaatctttc

SEQ ID NO: 160767 - DNA, 25 bp, Mus musculus
aacaggagcagatccgctctcacat

SEQ ID NO: 160768 - DNA, 25 bp, Mus musculus
aacaggaggagctgatccgagcaca

SEQ ID NO: 160769 - DNA, 25 bp, Mus musculus
aacaggagttgacacatggtttggg

SEQ ID NO: 160770 - DNA, 25 bp, Mus musculus
aacaggatcgcaatagtcggtgctg

SEQ ID NO: 160771 - DNA, 25 bp, Mus musculus
aacaggatcggatctaccgttacca

SEQ ID NO: 160772 - DNA, 25 bp, Mus musculus
aacaggatcggtctctccagtgttc

SEQ ID NO: 160773 - DNA, 25 bp, Mus musculus
aacaggatgaccaggtagagacctt

SEQ ID NO: 160774 - DNA, 25 bp, Mus musculus
aacaggatgaccagtttcagaaagc

SEQ ID NO: 160775 - DNA, 25 bp, Mus musculus
aacaggatgagtacgccatgaacga

SEQ ID NO: 160776 - DNA, 25 bp, Mus musculus
aacaggatgagtacggtgggaatgc

SEQ ID NO: 160777 - DNA, 25 bp, Mus musculus
aacaggcaggacaagaaggcaaatt

SEQ ID NO: 160778 - DNA, 25 bp, Mus musculus
aacaggccaattgttcctgtaccag

SEQ ID NO: 160779 - DNA, 25 bp, Mus musculus
aacaggccacaggaaagcacagaca

SEQ ID NO: 160780 - DNA, 25 bp, Mus musculus
aacaggccaggaaggaaaaacagga

SEQ ID NO: 160781 - DNA, 25 bp, Mus musculus
aacaggccaggtggccttgctaaaa

SEQ ID NO: 160782 - DNA, 25 bp, Mus musculus
aacaggccagtaggagttaaaggga

SEQ ID NO: 160783 - DNA, 25 bp, Mus musculus
aacaggccatggatgcccgggtagt

SEQ ID NO: 160784 - DNA, 25 bp, Mus musculus
aacaggccctgttggtccccctgga

SEQ ID NO: 160785 - DNA, 25 bp, Mus musculus
aacaggcctaaaggctttgatgaca

SEQ ID NO: 160786 - DNA, 25 bp, Mus musculus
aacaggcctccccaggtccccctga

SEQ ID NO: 160787 - DNA, 25 bp, Mus musculus
aacaggcggaggaaacctatgagaa

SEQ ID NO: 160788 - DNA, 25 bp, Mus musculus
aacaggcggaggctagacaaatggc

SEQ ID NO: 160789 - DNA, 25 bp, Mus musculus
aacaggctaggtgctggtgttgatg

SEQ ID NO: 160790 - DNA, 25 bp, Mus musculus
aacaggctaggttgcaggaagcaga

SEQ ID NO: 160791 - DNA, 25 bp, Mus musculus
aacaggcttaatatcagaaaggaac

SEQ ID NO: 160792 - DNA, 25 bp, Mus musculus
aacaggcttaatatgagaaaggaac

SEQ ID NO: 160793 - DNA, 25 bp, Mus musculus
aacaggcttaggtgccacattctgg

SEQ ID NO: 160794 - DNA, 25 bp, Mus musculus
aacagggaagttaggcacaatcact

SEQ ID NO: 160795 - DNA, 25 bp, Mus musculus
aacagggcaaaggggtttcctgaga

SEQ ID NO: 160796 - DNA, 25 bp, Mus musculus
aacagggcaacaggctgaaccatta

SEQ ID NO: 160797 - DNA, 25 bp, Mus musculus
aacagggcagagaagctggcttgct

SEQ ID NO: 160798 - DNA, 25 bp, Mus musculus
aacagggcagctgggcaccacaaga

SEQ ID NO: 160799 - DNA, 25 bp, Mus musculus
aacagggcccagagggtcgttgctc

SEQ ID NO: 160800 - DNA, 25 bp, Mus musculus
aacaggggcagtcccaggacggccc

SEQ ID NO: 160801 - DNA, 25 bp, Mus musculus
aacaggggcagtgtttgccaagaat

SEQ ID NO: 160802 - DNA, 25 bp, Mus musculus
aacaggggtggcagactctcttctg

SEQ ID NO: 160803 - DNA, 25 bp, Mus musculus
aacaggggtggcaggcgcaccaacc

SEQ ID NO: 160804 - DNA, 25 bp, Mus musculus
aacagggtcaaaggataattcctta

SEQ ID NO: 160805 - DNA, 25 bp, Mus musculus
aacagggtcaaaggccacattgaat

SEQ ID NO: 160806 - DNA, 25 bp, Mus musculus
aacaggtaagctatgaaaaaagatt

SEQ ID NO: 160807 - DNA, 25 bp, Mus musculus
aacaggtagaaaagagaagcccgtg

SEQ ID NO: 160808 - DNA, 25 bp, Mus musculus
aacaggtcaaaatgtcctgcaggtc

SEQ ID NO: 160809 - DNA, 25 bp, Mus musculus
aacaggtcaaggagagtgtcactga

SEQ ID NO: 160810 - DNA, 25 bp, Mus musculus
aacaggtcttgtcaaacacgctgga

SEQ ID NO: 160811 - DNA, 25 bp, Mus musculus
aacaggtgaagcatgatcagcaagt

SEQ ID NO: 160812 - DNA, 25 bp, Mus musculus
aacaggtgaagcatggggccactgt

SEQ ID NO: 160813 - DNA, 25 bp, Mus musculus
aacaggtgatccagagaagagttta

SEQ ID NO: 160814 - DNA, 25 bp, Mus musculus
aacaggtggaaggtacagttaaaga

SEQ ID NO: 160815 - DNA, 25 bp, Mus musculus
aacaggtggagcagggctcaaactc

SEQ ID NO: 160816 - DNA, 25 bp, Mus musculus
aacaggtgtgaacaggttccacccg

SEQ ID NO: 160817 - DNA, 25 bp, Mus musculus
aacagtaagtctatatggagacacc

SEQ ID NO: 160818 - DNA, 25 bp, Mus musculus
aacagtaataagtgcgtgaagactc

SEQ ID NO: 160819 - DNA, 25 bp, Mus musculus
aacagtacagattgctaagaagcct

SEQ ID NO: 160820 - DNA, 25 bp, Mus musculus
aacagtaccctcggcgcttgttctc

SEQ ID NO: 160821 - DNA, 25 bp, Mus musculus
aacagtacctcccaagccggccgtt

SEQ ID NO: 160822 - DNA, 25 bp, Mus musculus
aacagtaggctaccggtgatggtgt

SEQ ID NO: 160823 - DNA, 25 bp, Mus musculus
aacagtaggtttgtagtgagcttag

SEQ ID NO: 160824 - DNA, 25 bp, Mus musculus
aacagtatccaaaggagtgtgcagc

SEQ ID NO: 160825 - DNA, 25 bp, Mus musculus
aacagtatccaaagttcaattttgt

SEQ ID NO: 160826 - DNA, 25 bp, Mus musculus
aacagtatgaagttttcaggggctc

SEQ ID NO: 160827 - DNA, 25 bp, Mus musculus
aacagtatgtgtgcagttatgaggg

SEQ ID NO: 160828 - DNA, 25 bp, Mus musculus
aacagtcacagactgtatgagagtg

SEQ ID NO: 160829 - DNA, 25 bp, Mus musculus
aacagtcacagagagtggtgaaggc

SEQ ID NO: 160830 - DNA, 25 bp, Mus musculus
aacagtcacagatggctttatggat

SEQ ID NO: 160831 - DNA, 25 bp, Mus musculus
aacagtcacagcgtattgtcagggc

SEQ ID NO: 160832 - DNA, 25 bp, Mus musculus
aacagtcacaggcagatattgtaaa

SEQ ID NO: 160833 - DNA, 25 bp, Mus musculus
aacagtccaaaccatagacagaagt

SEQ ID NO: 160834 - DNA, 25 bp, Mus musculus
aacagtccagattccttctggaacc

SEQ ID NO: 160835 - DNA, 25 bp, Mus musculus
aacagtcctgactatgccacctgct

SEQ ID NO: 160836 - DNA, 25 bp, Mus musculus
aacagtcctgattctttaagaaata

SEQ ID NO: 160837 - DNA, 25 bp, Mus musculus
aacagtctcttcctctgctctgcct

SEQ ID NO: 160838 - DNA, 25 bp, Mus musculus
aacagtgaagcaggcagggcatttt

SEQ ID NO: 160839 - DNA, 25 bp, Mus musculus
aacagtgatgctgatgagtgccttg

SEQ ID NO: 160840 - DNA, 25 bp, Mus musculus
aacagtgatgctggacaccgcctta

SEQ ID NO: 160841 - DNA, 25 bp, Mus musculus
aacagtgtatacagtggcccatcat

SEQ ID NO: 160842 - DNA, 25 bp, Mus musculus
aacagtgtcaaccagtgctcagagt

SEQ ID NO: 160843 - DNA, 25 bp, Mus musculus
aacagtgtcaaccatcttgctctac

SEQ ID NO: 160844 - DNA, 25 bp, Mus musculus
aacagttaaaaggttttcagcagac

SEQ ID NO: 160845 - DNA, 25 bp, Mus musculus
aacagttacctagatattgctgttg

SEQ ID NO: 160846 - DNA, 25 bp, Mus musculus
aacagttacctaggcttttcactgg

SEQ ID NO: 160847 - DNA, 25 bp, Mus musculus
aacagttagaggaaagaacaggctg

SEQ ID NO: 160848 - DNA, 25 bp, Mus musculus
aacagttagaggttcgagaaatggc

SEQ ID NO: 160849 - DNA, 25 bp, Mus musculus
aacagttatctgcagaatgtgtatg

SEQ ID NO: 160850 - DNA, 25 bp, Mus musculus
aacagttcacagcagatgtaaagaa

SEQ ID NO: 160851 - DNA, 25 bp, Mus musculus
aacagttcacagcaggtttaaaaaa

SEQ ID NO: 160852 - DNA, 25 bp, Mus musculus
aacagttcactcaagagttcacaag

SEQ ID NO: 160853 - DNA, 25 bp, Mus musculus
aacagttcactcaaggagctctgtg

SEQ ID NO: 160854 - DNA, 25 bp, Mus musculus
aacagttcagatttcaactattgca

SEQ ID NO: 160855 - DNA, 25 bp, Mus musculus
aacagttcagtcattgttctaggtg

SEQ ID NO: 160856 - DNA, 25 bp, Mus musculus
aacagttcagtcttcctgtaaggac

SEQ ID NO: 160857 - DNA, 25 bp, Mus musculus
aacagttcatgaaatcttttgagca

SEQ ID NO: 160858 - DNA, 25 bp, Mus musculus
aacagttcatgaggttacgtcccca

SEQ ID NO: 160859 - DNA, 25 bp, Mus musculus
aacagttccaggaagggaacataat

SEQ ID NO: 160860 - DNA, 25 bp, Mus musculus
aacagttccagtcactattaccttg

SEQ ID NO: 160861 - DNA, 25 bp, Mus musculus
aacagttcttccaatcccacatgta

SEQ ID NO: 160862 - DNA, 25 bp, Mus musculus
aacagttgataaagactccattagc

SEQ ID NO: 160863 - DNA, 25 bp, Mus musculus
aacagttgatttgagggatggagag

SEQ ID NO: 160864 - DNA, 25 bp, Mus musculus
aacagttgtctacttacagctctga

SEQ ID NO: 160865 - DNA, 25 bp, Mus musculus
aacagtttctcaagggttgagctcc

SEQ ID NO: 160866 - DNA, 25 bp, Mus musculus
aacagtttggaggacgtaccatgcg

SEQ ID NO: 160867 - DNA, 25 bp, Mus musculus
aacagtttggaggctcacccgggtg

SEQ ID NO: 160868 - DNA, 25 bp, Mus musculus
aacagtttgggggacatcctgcagg

SEQ ID NO: 160869 - DNA, 25 bp, Mus musculus
aacataaaaaagaggacgaggcgga

SEQ ID NO: 160870 - DNA, 25 bp, Mus musculus
aacataaaaaagcttgcacacacaa

SEQ ID NO: 160871 - DNA, 25 bp, Mus musculus
aacataaaagaaattgcatgtgtgt

SEQ ID NO: 160872 - DNA, 25 bp, Mus musculus
aacataaacaaggcataatcaaccc

SEQ ID NO: 160873 - DNA, 25 bp, Mus musculus
aacataaacagaaagcttcacggaa

SEQ ID NO: 160874 - DNA, 25 bp, Mus musculus
aacataaacagtctgatgaaagtga

SEQ ID NO: 160875 - DNA, 25 bp, Mus musculus
aacataaagacagaggttcttgcag

SEQ ID NO: 160876 - DNA, 25 bp, Mus musculus
aacataaagagcagatcaaattgct

SEQ ID NO: 160877 - DNA, 25 bp, Mus musculus
aacataaagagcagttctcctattt

SEQ ID NO: 160878 - DNA, 25 bp, Mus musculus
aacataacaacattcccgtcaataa

SEQ ID NO: 160879 - DNA, 25 bp, Mus musculus
aacataacctggagacagcctgtgc

SEQ ID NO: 160880 - DNA, 25 bp, Mus musculus
aacataagcgtattatttatgtggc

SEQ ID NO: 160881 - DNA, 25 bp, Mus musculus
aacataatagcctgctttttctctt

SEQ ID NO: 160882 - DNA, 25 bp, Mus musculus
aacataataggtgagcacatagatt

SEQ ID NO: 160883 - DNA, 25 bp, Mus musculus
aacataatgcatgccaagtggcagc

SEQ ID NO: 160884 - DNA, 25 bp, Mus musculus
aacataatggactccctggaactgg

SEQ ID NO: 160885 - DNA, 25 bp, Mus musculus
aacataatggatggagaggagaaga

SEQ ID NO: 160886 - DNA, 25 bp, Mus musculus
aacataattagcttgaagtcaatgg

SEQ ID NO: 160887 - DNA, 25 bp, Mus musculus
aacataattccccagaaattgatga

SEQ ID NO: 160888 - DNA, 25 bp, Mus musculus
aacataattccccaggcgttaagca

SEQ ID NO: 160889 - DNA, 25 bp, Mus musculus
aacatacaaagacgacgctcacctg

SEQ ID NO: 160890 - DNA, 25 bp, Mus musculus
aacatacaaagctggcttaatggtg

SEQ ID NO: 160891 - DNA, 25 bp, Mus musculus
aacatacattccagggccttatttt

SEQ ID NO: 160892 - DNA, 25 bp, Mus musculus
aacataccagaatccacacaggcga

SEQ ID NO: 160893 - DNA, 25 bp, Mus musculus
aacataccagagtcctctgatgggc

SEQ ID NO: 160894 - DNA, 25 bp, Mus musculus
aacatacccagtgccttgccatctc

SEQ ID NO: 160895 - DNA, 25 bp, Mus musculus
aacatacccagtgtgtcatcaataa

SEQ ID NO: 160896 - DNA, 25 bp, Mus musculus
aacatacctgacaggagtggggata

SEQ ID NO: 160897 - DNA, 25 bp, Mus musculus
aacatactacgttgatcacctcaac

SEQ ID NO: 160898 - DNA, 25 bp, Mus musculus
aacatagactgtgaagtatttcggc

SEQ ID NO: 160899 - DNA, 25 bp, Mus musculus
aacatagagaggaactacaagaatc

SEQ ID NO: 160900 - DNA, 25 bp, Mus musculus
aacatagcaattaaggaactagagg

SEQ ID NO: 160901 - DNA, 25 bp, Mus musculus
aacatagcaattaagggagtggcca

SEQ ID NO: 160902 - DNA, 25 bp, Mus musculus
aacatagccagatgaggaagctgga

SEQ ID NO: 160903 - DNA, 25 bp, Mus musculus
aacatatagaagattttaaacagtt

SEQ ID NO: 160904 - DNA, 25 bp, Mus musculus
aacatatcactactggggaaacagg

SEQ ID NO: 160905 - DNA, 25 bp, Mus musculus
aacatatcactactgtggtcgtgca

SEQ ID NO: 160906 - DNA, 25 bp, Mus musculus
aacatatggaataaatttcaagaat

SEQ ID NO: 160907 - DNA, 25 bp, Mus musculus
aacatatggaatgcaaattgaagaa

SEQ ID NO: 160908 - DNA, 25 bp, Mus musculus
aacatatggccagaatgaccatact

SEQ ID NO: 160909 - DNA, 25 bp, Mus musculus
aacatatggtactgagtactctctg

SEQ ID NO: 160910 - DNA, 25 bp, Mus musculus
aacatattaaaggaggtcctggcca

SEQ ID NO: 160911 - DNA, 25 bp, Mus musculus
aacatattggctccctgaccctgag

SEQ ID NO: 160912 - DNA, 25 bp, Mus musculus
aacatatttattgcatccgatatca

SEQ ID NO: 160913 - DNA, 25 bp, Mus musculus
aacatatttattggatgactaggac

SEQ ID NO: 160914 - DNA, 25 bp, Mus musculus
aacatatttattggtgaagccgagc

SEQ ID NO: 160915 - DNA, 25 bp, Mus musculus
aacatatttgagaagatagatgaag

SEQ ID NO: 160916 - DNA, 25 bp, Mus musculus
aacatatttgaggcggaggcagcgc

SEQ ID NO: 160917 - DNA, 25 bp, Mus musculus
aacatattttaatttcaggaattga

SEQ ID NO: 160918 - DNA, 25 bp, Mus musculus
aacatattttatccaagtttggcaa

SEQ ID NO: 160919 - DNA, 25 bp, Mus musculus
aacatatttttaagtaggaaaatga

SEQ ID NO: 160920 - DNA, 25 bp, Mus musculus
aacatatttttaagtgtgatcccac

SEQ ID NO: 160921 - DNA, 25 bp, Mus musculus
aacatcaaaataaaccaggcgatgc

SEQ ID NO: 160922 - DNA, 25 bp, Mus musculus
aacatcaaagccattggtgtcagca

SEQ ID NO: 160923 - DNA, 25 bp, Mus musculus
aacatcaaagtaatcccctccccgc

SEQ ID NO: 160924 - DNA, 25 bp, Mus musculus
aacatcaacgagaggacggcctggg

SEQ ID NO: 160925 - DNA, 25 bp, Mus musculus
aacatcaacggttctcccatggcgc

SEQ ID NO: 160926 - DNA, 25 bp, Mus musculus
aacatcaacttcaagccctccaacc

SEQ ID NO: 160927 - DNA, 25 bp, Mus musculus
aacatcaacttcaagggccagctag

SEQ ID NO: 160928 - DNA, 25 bp, Mus musculus
aacatcaagacaaaccaggtgatga

SEQ ID NO: 160929 - DNA, 25 bp, Mus musculus
aacatcaagactggagtacctgcaa

SEQ ID NO: 160930 - DNA, 25 bp, Mus musculus
aacatcaataatgacaccacctact

SEQ ID NO: 160931 - DNA, 25 bp, Mus musculus
aacatcaatagtggagattttgtat

SEQ ID NO: 160932 - DNA, 25 bp, Mus musculus
aacatcaatagtgtaattattgaga

SEQ ID NO: 160933 - DNA, 25 bp, Mus musculus
aacatcacactcaatgacgaggctg

SEQ ID NO: 160934 - DNA, 25 bp, Mus musculus
aacatcacagagtcccacccaggag

SEQ ID NO: 160935 - DNA, 25 bp, Mus musculus
aacatcacagatgtctcccaattgg

SEQ ID NO: 160936 - DNA, 25 bp, Mus musculus
aacatcacagattgctgaaagacag

SEQ ID NO: 160937 - DNA, 25 bp, Mus musculus
aacatcacagcaaagtctcgactgc

SEQ ID NO: 160938 - DNA, 25 bp, Mus musculus
aacatcacaggtggtagcaggaact

SEQ ID NO: 160939 - DNA, 25 bp, Mus musculus
aacatcacagttcatagccagagaa

SEQ ID NO: 160940 - DNA, 25 bp, Mus musculus
aacatcacattggcgtcttctggga

SEQ ID NO: 160941 - DNA, 25 bp, Mus musculus
aacatcacccccgccactggcttgg

SEQ ID NO: 160942 - DNA, 25 bp, Mus musculus
aacatcacccccggtggtgaagggc

SEQ ID NO: 160943 - DNA, 25 bp, Mus musculus
aacatcacccccgtgctccccctgc

SEQ ID NO: 160944 - DNA, 25 bp, Mus musculus
aacatcaccttggatggcaaggtca

SEQ ID NO: 160945 - DNA, 25 bp, Mus musculus
aacatcacgaagaaacttgtggaaa

SEQ ID NO: 160946 - DNA, 25 bp, Mus musculus
aacatcacgaaggctttacaatgtg

SEQ ID NO: 160947 - DNA, 25 bp, Mus musculus
aacatcactcacgagctctttgaca

SEQ ID NO: 160948 - DNA, 25 bp, Mus musculus
aacatcactgtcgtcactgcggccg

SEQ ID NO: 160949 - DNA, 25 bp, Mus musculus
aacatcagaaagggtctgccgtcat

SEQ ID NO: 160950 - DNA, 25 bp, Mus musculus
aacatcagaaagtgactcagacccg

SEQ ID NO: 160951 - DNA, 25 bp, Mus musculus
aacatcagaattggaaaagtcagaa

SEQ ID NO: 160952 - DNA, 25 bp, Mus musculus
aacatcaggtccaagagtctgaagg

SEQ ID NO: 160953 - DNA, 25 bp, Mus musculus
aacatcaggtccaagtccgtaattg

SEQ ID NO: 160954 - DNA, 25 bp, Mus musculus
aacatcatcacgaaactgaggctcc

SEQ ID NO: 160955 - DNA, 25 bp, Mus musculus
aacatcatcagacttgcgtgcggga

SEQ ID NO: 160956 - DNA, 25 bp, Mus musculus
aacatcatcagatagagactagctg

SEQ ID NO: 160957 - DNA, 25 bp, Mus musculus
aacatcatcgctgtgttttctcgtg

SEQ ID NO: 160958 - DNA, 25 bp, Mus musculus
aacatcatcttggtggagaggcttc

SEQ ID NO: 160959 - DNA, 25 bp, Mus musculus
aacatcatgcaggatccaaacgaag

SEQ ID NO: 160960 - DNA, 25 bp, Mus musculus
aacatcatgcagttaaaccatatga

SEQ ID NO: 160961 - DNA, 25 bp, Mus musculus
aacatcatgcatgctaagtggcagt

SEQ ID NO: 160962 - DNA, 25 bp, Mus musculus
aacatcattgatgggaatccggaaa

SEQ ID NO: 160963 - DNA, 25 bp, Mus musculus
aacatcattgatggtcctgcttggc

SEQ ID NO: 160964 - DNA, 25 bp, Mus musculus
aacatcattgcatatgatcactctc

SEQ ID NO: 160965 - DNA, 25 bp, Mus musculus
aacatcattgcatccatgccgagct

SEQ ID NO: 160966 - DNA, 25 bp, Mus musculus
aacatccaaaagtttgcagtcctgg

SEQ ID NO: 160967 - DNA, 25 bp, Mus musculus
aacatccaaacattgtgcgtctcca

SEQ ID NO: 160968 - DNA, 25 bp, Mus musculus
aacatccaaacattgtgttaccgga

SEQ ID NO: 160969 - DNA, 25 bp, Mus musculus
aacatccaaagacacacaggaccag

SEQ ID NO: 160970 - DNA, 25 bp, Mus musculus
aacatccaatgtctcttcagatgga

SEQ ID NO: 160971 - DNA, 25 bp, Mus musculus
aacatccacggagtcaggacggggc

SEQ ID NO: 160972 - DNA, 25 bp, Mus musculus
aacatccacttatcacttcattgta

SEQ ID NO: 160973 - DNA, 25 bp, Mus musculus
aacatccacttatctcttcattgta

SEQ ID NO: 160974 - DNA, 25 bp, Mus musculus
aacatccagagccgtctgggtacat

SEQ ID NO: 160975 - DNA, 25 bp, Mus musculus
aacatccagctgttgcacaaacagc

SEQ ID NO: 160976 - DNA, 25 bp, Mus musculus
aacatccaggcttgccctctgtttt

SEQ ID NO: 160977 - DNA, 25 bp, Mus musculus
aacatccatccttcatgattgtcta

SEQ ID NO: 160978 - DNA, 25 bp, Mus musculus
aacatcccagattgctgaagctaaa

SEQ ID NO: 160979 - DNA, 25 bp, Mus musculus
aacatcccagccaaagcaaaatcaa

SEQ ID NO: 160980 - DNA, 25 bp, Mus musculus
aacatcccagcccactggtttgttg

SEQ ID NO: 160981 - DNA, 25 bp, Mus musculus
aacatccccaatacctgtcctagcc

SEQ ID NO: 160982 - DNA, 25 bp, Mus musculus
aacatccctgctcattattccccca

SEQ ID NO: 160983 - DNA, 25 bp, Mus musculus
aacatcccttcagaatacacatgcc

SEQ ID NO: 160984 - DNA, 25 bp, Mus musculus
aacatccgaaaaagccggagcctca

SEQ ID NO: 160985 - DNA, 25 bp, Mus musculus
aacatccgggacaacgaggagaaca

SEQ ID NO: 160986 - DNA, 25 bp, Mus musculus
aacatcctacaggaacttctgggtc

SEQ ID NO: 160987 - DNA, 25 bp, Mus musculus
aacatcctacaggtatttcgaactc

SEQ ID NO: 160988 - DNA, 25 bp, Mus musculus
aacatcctaggcttcatcgcctccg

SEQ ID NO: 160989 - DNA, 25 bp, Mus musculus
aacatcctcaaagcgacccctgaac

SEQ ID NO: 160990 - DNA, 25 bp, Mus musculus
aacatcctcaaaggatacaacttct

SEQ ID NO: 160991 - DNA, 25 bp, Mus musculus
aacatcctcatcagatgttttaagg

SEQ ID NO: 160992 - DNA, 25 bp, Mus musculus
aacatcctgccctatgaccactcta

SEQ ID NO: 160993 - DNA, 25 bp, Mus musculus
aacatcctgccctttctctctttag

SEQ ID NO: 160994 - DNA, 25 bp, Mus musculus
aacatccttcaagaaaccctgaagc

SEQ ID NO: 160995 - DNA, 25 bp, Mus musculus
aacatccttcaagactgcaggcacc

SEQ ID NO: 160996 - DNA, 25 bp, Mus musculus
aacatccttcaaggtctgtgattgc

SEQ ID NO: 160997 - DNA, 25 bp, Mus musculus
aacatcgagaagcaactgcgctcca

SEQ ID NO: 160998 - DNA, 25 bp, Mus musculus
aacatcgagaagtatcagcggtgca

SEQ ID NO: 160999 - DNA, 25 bp, Mus musculus
aacatcgagacctttgccactcaag

SEQ ID NO: 161000 - DNA, 25 bp, Mus musculus
aacatcggaacctctaccactacag

SEQ ID NO: 161001 - DNA, 25 bp, Mus musculus
aacatcggaagaactctcagctggt

SEQ ID NO: 161002 - DNA, 25 bp, Mus musculus
aacatcggctcagggtcttggagga

SEQ ID NO: 161003 - DNA, 25 bp, Mus musculus
aacatcgggtgacagggccctggat

SEQ ID NO: 161004 - DNA, 25 bp, Mus musculus
aacatcggtacaggacagctttgca

SEQ ID NO: 161005 - DNA, 25 bp, Mus musculus
aacatcggtacagtggcaggacagc

SEQ ID NO: 161006 - DNA, 25 bp, Mus musculus
aacatcgtagagggagattcatttt

SEQ ID NO: 161007 - DNA, 25 bp, Mus musculus
aacatcgtttatagagacttaaaac

SEQ ID NO: 161008 - DNA, 25 bp, Mus musculus
aacatctaaggtgccaagtgctggt

SEQ ID NO: 161009 - DNA, 25 bp, Mus musculus
aacatctacgagcagggcacaactg

SEQ ID NO: 161010 - DNA, 25 bp, Mus musculus
aacatctactttgactgcagcagaa

SEQ ID NO: 161011 - DNA, 25 bp, Mus musculus
aacatctactttgctcagcagatat

SEQ ID NO: 161012 - DNA, 25 bp, Mus musculus
aacatctagacagttcgaacctcag

SEQ ID NO: 161013 - DNA, 25 bp, Mus musculus
aacatctccattccaacctggtctt

SEQ ID NO: 161014 - DNA, 25 bp, Mus musculus
aacatctgaaaccagagtccagctt

SEQ ID NO: 161015 - DNA, 25 bp, Mus musculus
aacatctgaaactgaactcggagag

SEQ ID NO: 161016 - DNA, 25 bp, Mus musculus
aacatctgaaacttttgttttcctg

SEQ ID NO: 161017 - DNA, 25 bp, Mus musculus
aacatctgatggaacctgtaccatc

SEQ ID NO: 161018 - DNA, 25 bp, Mus musculus
aacatctgatggtctatctccacga

SEQ ID NO: 161019 - DNA, 25 bp, Mus musculus
aacatctgcagctctcccttttctt

SEQ ID NO: 161020 - DNA, 25 bp, Mus musculus
aacatctgcagtgggccggatgtac

SEQ ID NO: 161021 - DNA, 25 bp, Mus musculus
aacatctggaaggtatctcagacga

SEQ ID NO: 161022 - DNA, 25 bp, Mus musculus
aacatctggggtcctgctcctgcaa

SEQ ID NO: 161023 - DNA, 25 bp, Mus musculus
aacatctgtaaccagaatggattga

SEQ ID NO: 161024 - DNA, 25 bp, Mus musculus
aacatctgtcctgaggagtgtgcag

SEQ ID NO: 161025 - DNA, 25 bp, Mus musculus
aacatctgtgcactgctgaagaagg

SEQ ID NO: 161026 - DNA, 25 bp, Mus musculus
aacatcttcaaaaactgcacctact

SEQ ID NO: 161027 - DNA, 25 bp, Mus musculus
aacatcttcacgctaatgaaccgga

SEQ ID NO: 161028 - DNA, 25 bp, Mus musculus
aacatcttcacgtctcgaaaaggtg

SEQ ID NO: 161029 - DNA, 25 bp, Mus musculus
aacatcttcagcctggcagaaaact

SEQ ID NO: 161030 - DNA, 25 bp, Mus musculus
aacatcttcctggcttctgctgtaa

SEQ ID NO: 161031 - DNA, 25 bp, Mus musculus
aacatcttgagatcttcaactttct

SEQ ID NO: 161032 - DNA, 25 bp, Mus musculus
aacatcttggaacctaggtcctgtc

SEQ ID NO: 161033 - DNA, 25 bp, Mus musculus
aacatctttatctcaaattctggaa

SEQ ID NO: 161034 - DNA, 25 bp, Mus musculus
aacatctttatctcacacgccggtg

SEQ ID NO: 161035 - DNA, 25 bp, Mus musculus
aacatcttttccaggtgcagagtgg

SEQ ID NO: 161036 - DNA, 25 bp, Mus musculus
aacatgaacaagcgattatacacag

SEQ ID NO: 161037 - DNA, 25 bp, Mus musculus
aacatgaacaagcgcttgtacacag

SEQ ID NO: 161038 - DNA, 25 bp, Mus musculus
aacatgaacagaagagagaggggga

SEQ ID NO: 161039 - DNA, 25 bp, Mus musculus
aacatgaacatccagtaataatatc

SEQ ID NO: 161040 - DNA, 25 bp, Mus musculus
aacatgaactgttggcccttgattg

SEQ ID NO: 161041 - DNA, 25 bp, Mus musculus
aacatgaagagggtaaatagctgtg

SEQ ID NO: 161042 - DNA, 25 bp, Mus musculus
aacatgaagaggtattgactgaata

SEQ ID NO: 161043 - DNA, 25 bp, Mus musculus
aacatgaagattgagagccagcggg

SEQ ID NO: 161044 - DNA, 25 bp, Mus musculus
aacatgaagttggtgagcccgagtt

SEQ ID NO: 161045 - DNA, 25 bp, Mus musculus
aacatgaatgtgaccgagataatca

SEQ ID NO: 161046 - DNA, 25 bp, Mus musculus
aacatgacaagagaaagcgccaagg

SEQ ID NO: 161047 - DNA, 25 bp, Mus musculus
aacatgacagaagctgattggccat

SEQ ID NO: 161048 - DNA, 25 bp, Mus musculus
aacatgacagacagtttcgcatttg

SEQ ID NO: 161049 - DNA, 25 bp, Mus musculus
aacatgacatagatcctataaggtg

SEQ ID NO: 161050 - DNA, 25 bp, Mus musculus
aacatgacatagggtacatgtggat

SEQ ID NO: 161051 - DNA, 25 bp, Mus musculus
aacatgaccaggccatgtgaaactt

SEQ ID NO: 161052 - DNA, 25 bp, Mus musculus
aacatgaccctggaggtgagaaagt

SEQ ID NO: 161053 - DNA, 25 bp, Mus musculus
aacatgagaaagcatgctctctgtt

SEQ ID NO: 161054 - DNA, 25 bp, Mus musculus
aacatgagacccagctttccctgct

SEQ ID NO: 161055 - DNA, 25 bp, Mus musculus
aacatgagcaaagggccacaatacc

SEQ ID NO: 161056 - DNA, 25 bp, Mus musculus
aacatgagcctcctgatgctgctcc

SEQ ID NO: 161057 - DNA, 25 bp, Mus musculus
aacatgatccaggcgtctcttttct

SEQ ID NO: 161058 - DNA, 25 bp, Mus musculus
aacatgatgaagaatagaattgctg

SEQ ID NO: 161059 - DNA, 25 bp, Mus musculus
aacatgatgatgaacttgttcctag

SEQ ID NO: 161060 - DNA, 25 bp, Mus musculus
aacatgatgtcagcgtcaatactat

SEQ ID NO: 161061 - DNA, 25 bp, Mus musculus
aacatgcacaaggttcacctgctgt

SEQ ID NO: 161062 - DNA, 25 bp, Mus musculus
aacatgcacagcctatttaagagtg

SEQ ID NO: 161063 - DNA, 25 bp, Mus musculus
aacatgcagaagtcgatgcagaacc

SEQ ID NO: 161064 - DNA, 25 bp, Mus musculus
aacatgcagagagtagcagtgctgt

SEQ ID NO: 161065 - DNA, 25 bp, Mus musculus
aacatgcagagtgctgtgtgttcct

SEQ ID NO: 161066 - DNA, 25 bp, Mus musculus
aacatgcagatggtgtcagtggatt

SEQ ID NO: 161067 - DNA, 25 bp, Mus musculus
aacatgcattttcacgacatccatg

SEQ ID NO: 161068 - DNA, 25 bp, Mus musculus
aacatgccggagttctctggggtgc

SEQ ID NO: 161069 - DNA, 25 bp, Mus musculus
aacatgcctctaggttccagcagca

SEQ ID NO: 161070 - DNA, 25 bp, Mus musculus
aacatgcctgaagacgttattgctc

SEQ ID NO: 161071 - DNA, 25 bp, Mus musculus
aacatgcctgaaggctctggtgtcc

SEQ ID NO: 161072 - DNA, 25 bp, Mus musculus
aacatgcgtacggctggcctcaaac

SEQ ID NO: 161073 - DNA, 25 bp, Mus musculus
aacatgcgtccaagctgtttcctct

SEQ ID NO: 161074 - DNA, 25 bp, Mus musculus
aacatgcgtccaaggcaaatttcag

SEQ ID NO: 161075 - DNA, 25 bp, Mus musculus
aacatgcgtccaagtatctagcatt

SEQ ID NO: 161076 - DNA, 25 bp, Mus musculus
aacatgctcaaattcggggcttcct

SEQ ID NO: 161077 - DNA, 25 bp, Mus musculus
aacatgctcaaattcggtgcagccc

SEQ ID NO: 161078 - DNA, 25 bp, Mus musculus
aacatgctcaagccaaaccaacaac

SEQ ID NO: 161079 - DNA, 25 bp, Mus musculus
aacatgctcacaaggtgcagacctg

SEQ ID NO: 161080 - DNA, 25 bp, Mus musculus
aacatgctcttcgtctgctgggatt

SEQ ID NO: 161081 - DNA, 25 bp, Mus musculus
aacatgctcttcgtgttccgctact

SEQ ID NO: 161082 - DNA, 25 bp, Mus musculus
aacatgctgaataggtatctgatca

SEQ ID NO: 161083 - DNA, 25 bp, Mus musculus
aacatgctgaataggtgaattgaga

SEQ ID NO: 161084 - DNA, 25 bp, Mus musculus
aacatgctggttgtcacaggtggtg

SEQ ID NO: 161085 - DNA, 25 bp, Mus musculus
aacatgcttggagtgttcctaactt

SEQ ID NO: 161086 - DNA, 25 bp, Mus musculus
aacatgctttcagaaattccctgcg

SEQ ID NO: 161087 - DNA, 25 bp, Mus musculus
aacatgctttcagaagacctggcgg

SEQ ID NO: 161088 - DNA, 25 bp, Mus musculus
aacatggaaaagaaaatagatatca

SEQ ID NO: 161089 - DNA, 25 bp, Mus musculus
aacatggaaaagatatcaccagtaa

SEQ ID NO: 161090 - DNA, 25 bp, Mus musculus
aacatggaaactaaggcattactca

SEQ ID NO: 161091 - DNA, 25 bp, Mus musculus
aacatggaaactaaggctggccttg

SEQ ID NO: 161092 - DNA, 25 bp, Mus musculus
aacatggaaagcaatcactctgtgg

SEQ ID NO: 161093 - DNA, 25 bp, Mus musculus
aacatggaagacagagctgcatgag

SEQ ID NO: 161094 - DNA, 25 bp, Mus musculus
aacatggaagtgaaggatgcgaacg

SEQ ID NO: 161095 - DNA, 25 bp, Mus musculus
aacatggacacaggtatacaaggag

SEQ ID NO: 161096 - DNA, 25 bp, Mus musculus
aacatggactttggaggacagaaaa

SEQ ID NO: 161097 - DNA, 25 bp, Mus musculus
aacatggactttggagtctgaatat

SEQ ID NO: 161098 - DNA, 25 bp, Mus musculus
aacatggaggaggattgtccggagc

SEQ ID NO: 161099 - DNA, 25 bp, Mus musculus
aacatggaggcccctggtgaccatt

SEQ ID NO: 161100 - DNA, 25 bp, Mus musculus
aacatggagggccctggtgaccatt

SEQ ID NO: 161101 - DNA, 25 bp, Mus musculus
aacatggagtacaggatcaataagc

SEQ ID NO: 161102 - DNA, 25 bp, Mus musculus
aacatggcaaaagatgccagtctaa

SEQ ID NO: 161103 - DNA, 25 bp, Mus musculus
aacatggcaaaagatgtgtggtatc

SEQ ID NO: 161104 - DNA, 25 bp, Mus musculus
aacatggcaatgggctacaggggaa

SEQ ID NO: 161105 - DNA, 25 bp, Mus musculus
aacatggcactgggtggtgaaagtg

SEQ ID NO: 161106 - DNA, 25 bp, Mus musculus
aacatggcagcagagtcactcggca

SEQ ID NO: 161107 - DNA, 25 bp, Mus musculus
aacatggcaggctctacacagagag

SEQ ID NO: 161108 - DNA, 25 bp, Mus musculus
aacatggcaggtaagaaagtgctca

SEQ ID NO: 161109 - DNA, 25 bp, Mus musculus
aacatggctgagcctttcagtgcta

SEQ ID NO: 161110 - DNA, 25 bp, Mus musculus
aacatggctgagtgctacggagccc

SEQ ID NO: 161111 - DNA, 25 bp, Mus musculus
aacatggcttcaggttgatatcaaa

SEQ ID NO: 161112 - DNA, 25 bp, Mus musculus
aacatggtgagcaagttgagctctg

SEQ ID NO: 161113 - DNA, 25 bp, Mus musculus
aacatgtatagactttgatgaatgt

SEQ ID NO: 161114 - DNA, 25 bp, Mus musculus
aacatgtatagctttagatgagcag

SEQ ID NO: 161115 - DNA, 25 bp, Mus musculus
aacatgtcaggggagctgaaggacc

SEQ ID NO: 161116 - DNA, 25 bp, Mus musculus
aacatgtcccagcttacataattgg

SEQ ID NO: 161117 - DNA, 25 bp, Mus musculus
aacatgtcccagtttgacccattga

SEQ ID NO: 161118 - DNA, 25 bp, Mus musculus
aacatgtgaagatttctgctcctaa

SEQ ID NO: 161119 - DNA, 25 bp, Mus musculus
aacatgtgcagataacaatcgaaag

SEQ ID NO: 161120 - DNA, 25 bp, Mus musculus
aacatgtggagtgaaaaatctctca

SEQ ID NO: 161121 - DNA, 25 bp, Mus musculus
aacatgttcaaaggagcctttgacc

SEQ ID NO: 161122 - DNA, 25 bp, Mus musculus
aacatgttcaaagttagcatattat

SEQ ID NO: 161123 - DNA, 25 bp, Mus musculus
aacatgttcttctcggacctactaa

SEQ ID NO: 161124 - DNA, 25 bp, Mus musculus
aacatgtttaagaaggtgcccacta

SEQ ID NO: 161125 - DNA, 25 bp, Mus musculus
aacattaaaaggagtgcaagatccc

SEQ ID NO: 161126 - DNA, 25 bp, Mus musculus
aacattaacttgaaggtagaagact

SEQ ID NO: 161127 - DNA, 25 bp, Mus musculus
aacattacaagaagacgctgcagct

SEQ ID NO: 161128 - DNA, 25 bp, Mus musculus
aacattacaaggtgggagagggccg

SEQ ID NO: 161129 - DNA, 25 bp, Mus musculus
aacattagaaaaacataaatgcagt

SEQ ID NO: 161130 - DNA, 25 bp, Mus musculus
aacattataagattccccccctagg

SEQ ID NO: 161131 - DNA, 25 bp, Mus musculus
aacattataggatatcgtgctttta

SEQ ID NO: 161132 - DNA, 25 bp, Mus musculus
aacattatgcagagatgcacacaag

SEQ ID NO: 161133 - DNA, 25 bp, Mus musculus
aacattatgcagagcttctgaacaa

SEQ ID NO: 161134 - DNA, 25 bp, Mus musculus
aacattatgcagaggatgattctga

SEQ ID NO: 161135 - DNA, 25 bp, Mus musculus
aacattattaaagacacacttttta

SEQ ID NO: 161136 - DNA, 25 bp, Mus musculus
aacattattaaagataattgctgtg

SEQ ID NO: 161137 - DNA, 25 bp, Mus musculus
aacattattgcttcacctctgctct

SEQ ID NO: 161138 - DNA, 25 bp, Mus musculus
aacattcaagctctgcctcacgtgt

SEQ ID NO: 161139 - DNA, 25 bp, Mus musculus
aacattcaaggaagccatcactcct

SEQ ID NO: 161140 - DNA, 25 bp, Mus musculus
aacattcaaggaatgtatgtgcatg

SEQ ID NO: 161141 - DNA, 25 bp, Mus musculus
aacattcaaggcccttctgaaactg

SEQ ID NO: 161142 - DNA, 25 bp, Mus musculus
aacattcaagggtatccagaagttg

SEQ ID NO: 161143 - DNA, 25 bp, Mus musculus
aacattcaaggtgtcaactctgccc

SEQ ID NO: 161144 - DNA, 25 bp, Mus musculus
aacattcaatagaggatatccatgc

SEQ ID NO: 161145 - DNA, 25 bp, Mus musculus
aacattccaccatgccagcagcacc

SEQ ID NO: 161146 - DNA, 25 bp, Mus musculus
aacattccagatacacttcagagcc

SEQ ID NO: 161147 - DNA, 25 bp, Mus musculus
aacattccagggagattccagactt

SEQ ID NO: 161148 - DNA, 25 bp, Mus musculus
aacattccagggagggtcccacctc

SEQ ID NO: 161149 - DNA, 25 bp, Mus musculus
aacattcctatgaagcccacattca

SEQ ID NO: 161150 - DNA, 25 bp, Mus musculus
aacattcctatgaaggaagagcagc

SEQ ID NO: 161151 - DNA, 25 bp, Mus musculus
aacattcgacagggaagaagaaaaa

SEQ ID NO: 161152 - DNA, 25 bp, Mus musculus
aacattcgacagggaagggaacaaa

SEQ ID NO: 161153 - DNA, 25 bp, Mus musculus
aacattctaccgctcctggaggatg

SEQ ID NO: 161154 - DNA, 25 bp, Mus musculus
aacattctaccgctgaaaaagcagt

SEQ ID NO: 161155 - DNA, 25 bp, Mus musculus
aacattctaccgctttgatgcagca

SEQ ID NO: 161156 - DNA, 25 bp, Mus musculus
aacattctcaccgacatcactcagc

SEQ ID NO: 161157 - DNA, 25 bp, Mus musculus
aacattgaagagcatgcctctgcag

SEQ ID NO: 161158 - DNA, 25 bp, Mus musculus
aacattgaagagcatgcctctggag

SEQ ID NO: 161159 - DNA, 25 bp, Mus musculus
aacattgacctggtgatctccttct

SEQ ID NO: 161160 - DNA, 25 bp, Mus musculus
aacattgacttcatggtggcttgca

SEQ ID NO: 161161 - DNA, 25 bp, Mus musculus
aacattgagcagagtctgcgagaaa

SEQ ID NO: 161162 - DNA, 25 bp, Mus musculus
aacattgaggaataggtacctggca

SEQ ID NO: 161163 - DNA, 25 bp, Mus musculus
aacattgatgaagcgtcaggaactg

SEQ ID NO: 161164 - DNA, 25 bp, Mus musculus
aacattgatgtcacgaagccagcga

SEQ ID NO: 161165 - DNA, 25 bp, Mus musculus
aacattgatgtcacgccgcataact

SEQ ID NO: 161166 - DNA, 25 bp, Mus musculus
aacattgatgtcacggtctattaca

SEQ ID NO: 161167 - DNA, 25 bp, Mus musculus
aacattgcagggccgtgcaggcctg

SEQ ID NO: 161168 - DNA, 25 bp, Mus musculus
aacattgcaggtaaagatgagcctt

SEQ ID NO: 161169 - DNA, 25 bp, Mus musculus
aacattgcataggtagccaaggagc

SEQ ID NO: 161170 - DNA, 25 bp, Mus musculus
aacattgccaaatgcaagctgtgca

SEQ ID NO: 161171 - DNA, 25 bp, Mus musculus
aacattgccagaaagagaaatgctt

SEQ ID NO: 161172 - DNA, 25 bp, Mus musculus
aacattgccgcccaggactgctcct

SEQ ID NO: 161173 - DNA, 25 bp, Mus musculus
aacattgctggacatttcaatgatg

SEQ ID NO: 161174 - DNA, 25 bp, Mus musculus
aacattgctggatcctctcccagtc

SEQ ID NO: 161175 - DNA, 25 bp, Mus musculus
aacattggagccatgtcaagctacc

SEQ ID NO: 161176 - DNA, 25 bp, Mus musculus
aacattgtcttctgggtgctgggag

SEQ ID NO: 161177 - DNA, 25 bp, Mus musculus
aacattgtcttctggttctctgtgt

SEQ ID NO: 161178 - DNA, 25 bp, Mus musculus
aacattgtggggacaaaacacagaa

SEQ ID NO: 161179 - DNA, 25 bp, Mus musculus
aacattgttacagaattgaattaga

SEQ ID NO: 161180 - DNA, 25 bp, Mus musculus
aacatttaagagtgaatgccatcca

SEQ ID NO: 161181 - DNA, 25 bp, Mus musculus
aacatttaaggagattactttgcaa

SEQ ID NO: 161182 - DNA, 25 bp, Mus musculus
aacatttaaggcaattctgccttga

SEQ ID NO: 161183 - DNA, 25 bp, Mus musculus
aacatttacagctcccctctccaca

SEQ ID NO: 161184 - DNA, 25 bp, Mus musculus
aacatttaccagggaagacagtgat

SEQ ID NO: 161185 - DNA, 25 bp, Mus musculus
aacatttatggtgaagtatttgttt

SEQ ID NO: 161186 - DNA, 25 bp, Mus musculus
aacatttccaggttcagctcctaat

SEQ ID NO: 161187 - DNA, 25 bp, Mus musculus
aacatttctgtattactatgaatat

SEQ ID NO: 161188 - DNA, 25 bp, Mus musculus
aacatttgaaagagccccggcagcc

SEQ ID NO: 161189 - DNA, 25 bp, Mus musculus
aacatttgtgggagatcaagttctt

SEQ ID NO: 161190 - DNA, 25 bp, Mus musculus
aacatttgtggggaacagacaagtc

SEQ ID NO: 161191 - DNA, 25 bp, Mus musculus
aacattttaaagacatttgagaact

SEQ ID NO: 161192 - DNA, 25 bp, Mus musculus
aacattttaaagctgccatccatcc

SEQ ID NO: 161193 - DNA, 25 bp, Mus musculus
aacattttattcatccaacaactat

SEQ ID NO: 161194 - DNA, 25 bp, Mus musculus
aacattttattcatgcttaggtgga

SEQ ID NO: 161195 - DNA, 25 bp, Mus musculus
aacattttattcatttttctggata

SEQ ID NO: 161196 - DNA, 25 bp, Mus musculus
aacattttcaagacatttgagaact

SEQ ID NO: 161197 - DNA, 25 bp, Mus musculus
aacattttccctcctgtccttcctg

SEQ ID NO: 161198 - DNA, 25 bp, Mus musculus
aacattttgagcgttggtgttgtga

SEQ ID NO: 161199 - DNA, 25 bp, Mus musculus
aacattttgaggactactgttgaag

SEQ ID NO: 161200 - DNA, 25 bp, Mus musculus
aaccaaaactgccttaggattcttt

SEQ ID NO: 161201 - DNA, 25 bp, Mus musculus
aaccaaaagctagagacaagcgaga

SEQ ID NO: 161202 - DNA, 25 bp, Mus musculus
aaccaaaagcttgtgggcgaaacgc

SEQ ID NO: 161203 - DNA, 25 bp, Mus musculus
aaccaaaatcagggccctgtggaca

SEQ ID NO: 161204 - DNA, 25 bp, Mus musculus
aaccaaacaaggttatatctgaaga

SEQ ID NO: 161205 - DNA, 25 bp, Mus musculus
aaccaaacaccagtatttctctgag

SEQ ID NO: 161206 - DNA, 25 bp, Mus musculus
aaccaaacagaacagatgacacttc

SEQ ID NO: 161207 - DNA, 25 bp, Mus musculus
aaccaaacagagtctccttaaagaa

SEQ ID NO: 161208 - DNA, 25 bp, Mus musculus
aaccaaaccaccgctgaagacgatg

SEQ ID NO: 161209 - DNA, 25 bp, Mus musculus
aaccaaaccaccgctgcagcccact

SEQ ID NO: 161210 - DNA, 25 bp, Mus musculus
aaccaaaccctttgcactgagcagc

SEQ ID NO: 161211 - DNA, 25 bp, Mus musculus
aaccaaaccgtaggcctgtagctcc

SEQ ID NO: 161212 - DNA, 25 bp, Mus musculus
aaccaaacctctcagtgaaaactga

SEQ ID NO: 161213 - DNA, 25 bp, Mus musculus
aaccaaagaagatgccgctccaatt

SEQ ID NO: 161214 - DNA, 25 bp, Mus musculus
aaccaaagaagtacggcgagctcct

SEQ ID NO: 161215 - DNA, 25 bp, Mus musculus
aaccaaagaggatatagatctgatt

SEQ ID NO: 161216 - DNA, 25 bp, Mus musculus
aaccaaagattaaggtacacaggtt

SEQ ID NO: 161217 - DNA, 25 bp, Mus musculus
aaccaaagattaagttgctcaggaa

SEQ ID NO: 161218 - DNA, 25 bp, Mus musculus
aaccaaagcatggagggtgatgagg

SEQ ID NO: 161219 - DNA, 25 bp, Mus musculus
aaccaaatcaagggccgatgatgca

SEQ ID NO: 161220 - DNA, 25 bp, Mus musculus
aaccaaatcagatgtcatggcaccc

SEQ ID NO: 161221 - DNA, 25 bp, Mus musculus
aaccaacaacctccagagtcttcga

SEQ ID NO: 161222 - DNA, 25 bp, Mus musculus
aaccaacagaggaattcatcagaga

SEQ ID NO: 161223 - DNA, 25 bp, Mus musculus
aaccaacagcagagaactggggaac

SEQ ID NO: 161224 - DNA, 25 bp, Mus musculus
aaccaacagggcatgaaagaagtga

SEQ ID NO: 161225 - DNA, 25 bp, Mus musculus
aaccaaccaaagccagacccacact

SEQ ID NO: 161226 - DNA, 25 bp, Mus musculus
aaccaacgtcaatcgctgcctcgag

SEQ ID NO: 161227 - DNA, 25 bp, Mus musculus
aaccaactcgaacagctctcgtggc

SEQ ID NO: 161228 - DNA, 25 bp, Mus musculus
aaccaacttctccagaaagcttccc

SEQ ID NO: 161229 - DNA, 25 bp, Mus musculus
aaccaacttctccagaagcttccct

SEQ ID NO: 161230 - DNA, 25 bp, Mus musculus
aaccaagaaaccaagccgcaatgaa

SEQ ID NO: 161231 - DNA, 25 bp, Mus musculus
aaccaagaaaggggagatctttgag

SEQ ID NO: 161232 - DNA, 25 bp, Mus musculus
aaccaagaaagtgctctcttccctg

SEQ ID NO: 161233 - DNA, 25 bp, Mus musculus
aaccaagaagagtttgtccctgatt

SEQ ID NO: 161234 - DNA, 25 bp, Mus musculus
aaccaagaaggcctcaggtccaggc

SEQ ID NO: 161235 - DNA, 25 bp, Mus musculus
aaccaagacccaaacttactgctcc

SEQ ID NO: 161236 - DNA, 25 bp, Mus musculus
aaccaagacctggaggaggtgatca

SEQ ID NO: 161237 - DNA, 25 bp, Mus musculus
aaccaagatgaatgagcgccaacct

SEQ ID NO: 161238 - DNA, 25 bp, Mus musculus
aaccaagatgctgtgcagaatgagc

SEQ ID NO: 161239 - DNA, 25 bp, Mus musculus
aaccaagatgttattgcttcaggag

SEQ ID NO: 161240 - DNA, 25 bp, Mus musculus
aaccaagcacttgtttctagtttat

SEQ ID NO: 161241 - DNA, 25 bp, Mus musculus
aaccaagcagccaggggactctgat

SEQ ID NO: 161242 - DNA, 25 bp, Mus musculus
aaccaagcaggagaactactttctc

SEQ ID NO: 161243 - DNA, 25 bp, Mus musculus
aaccaagcaggaggttgaggtgagc

SEQ ID NO: 161244 - DNA, 25 bp, Mus musculus
aaccaagcattccggagaaaacaac

SEQ ID NO: 161245 - DNA, 25 bp, Mus musculus
aaccaagcattccggctactcctgg

SEQ ID NO: 161246 - DNA, 25 bp, Mus musculus
aaccaagccggccctgggcagtgac

SEQ ID NO: 161247 - DNA, 25 bp, Mus musculus
aaccaaggagtcaaatattggagat

SEQ ID NO: 161248 - DNA, 25 bp, Mus musculus
aaccaaggataaggacaaagccaag

SEQ ID NO: 161249 - DNA, 25 bp, Mus musculus
aaccaatagaccaagacaacaaaac

SEQ ID NO: 161250 - DNA, 25 bp, Mus musculus
aaccaatctattaggcatcagacca

SEQ ID NO: 161251 - DNA, 25 bp, Mus musculus
aaccaatctattagggaaagagata

SEQ ID NO: 161252 - DNA, 25 bp, Mus musculus
aaccaatgaggaatacttggacctc

SEQ ID NO: 161253 - DNA, 25 bp, Mus musculus
aaccaatgaggaatacttggatctc

SEQ ID NO: 161254 - DNA, 25 bp, Mus musculus
aaccaatggttgacaggcaataccc

SEQ ID NO: 161255 - DNA, 25 bp, Mus musculus
aaccaatgtcaatcgctgcctcgag

SEQ ID NO: 161256 - DNA, 25 bp, Mus musculus
aaccacaaagaggaaatgcaggctc

SEQ ID NO: 161257 - DNA, 25 bp, Mus musculus
aaccacaagaagacccactccgagg

SEQ ID NO: 161258 - DNA, 25 bp, Mus musculus
aaccacaagcaacgatgcctacttc

SEQ ID NO: 161259 - DNA, 25 bp, Mus musculus
aaccacaagcgactcgtcctcccac

SEQ ID NO: 161260 - DNA, 25 bp, Mus musculus
aaccacaagcgagcctagaagagga

SEQ ID NO: 161261 - DNA, 25 bp, Mus musculus
aaccacaagcgagctaatgtctgcg

SEQ ID NO: 161262 - DNA, 25 bp, Mus musculus
aaccacaagcgagttcacatgagac

SEQ ID NO: 161263 - DNA, 25 bp, Mus musculus
aaccacaaggcgctacagcaacgtt

SEQ ID NO: 161264 - DNA, 25 bp, Mus musculus
aaccacaatctgcatgttaacaagc

SEQ ID NO: 161265 - DNA, 25 bp, Mus musculus
aaccacaattatgcctctgatgaag

SEQ ID NO: 161266 - DNA, 25 bp, Mus musculus
aaccacaattatggaatccccctac

SEQ ID NO: 161267 - DNA, 25 bp, Mus musculus
aaccacaattttcaggatgacgatc

SEQ ID NO: 161268 - DNA, 25 bp, Mus musculus
aaccacacagcaatgtttgcagaga

SEQ ID NO: 161269 - DNA, 25 bp, Mus musculus
aaccacacagcttgttcggtttggc

SEQ ID NO: 161270 - DNA, 25 bp, Mus musculus
aaccacagaagacagttgctcagac

SEQ ID NO: 161271 - DNA, 25 bp, Mus musculus
aaccacagaaggccctgacccctcc

SEQ ID NO: 161272 - DNA, 25 bp, Mus musculus
aaccacagaaggtgcagacctctga

SEQ ID NO: 161273 - DNA, 25 bp, Mus musculus
aaccacagaaggttatagaagctgc

SEQ ID NO: 161274 - DNA, 25 bp, Mus musculus
aaccacagactgcagttttcagata

SEQ ID NO: 161275 - DNA, 25 bp, Mus musculus
aaccacagatgactacagctgtgga

SEQ ID NO: 161276 - DNA, 25 bp, Mus musculus
aaccacagatttattctgtgatgag

SEQ ID NO: 161277 - DNA, 25 bp, Mus musculus
aaccacagatttcacctgggccact

SEQ ID NO: 161278 - DNA, 25 bp, Mus musculus
aaccacagcaccaagatatcattaa

SEQ ID NO: 161279 - DNA, 25 bp, Mus musculus
aaccacagcgagggggcgctcctgg

SEQ ID NO: 161280 - DNA, 25 bp, Mus musculus
aaccacagcttcacacagagaccct

SEQ ID NO: 161281 - DNA, 25 bp, Mus musculus
aaccacagtaaggtcacgaagttgg

SEQ ID NO: 161282 - DNA, 25 bp, Mus musculus
aaccacatccctccctccaaagctg

SEQ ID NO: 161283 - DNA, 25 bp, Mus musculus
aaccacatccgtggttttttggcaa

SEQ ID NO: 161284 - DNA, 25 bp, Mus musculus
aaccacatccgtttggaaatgatgt

SEQ ID NO: 161285 - DNA, 25 bp, Mus musculus
aaccacatgttcactatgaggagag

SEQ ID NO: 161286 - DNA, 25 bp, Mus musculus
aaccacattgggtgggtgcaggagt

SEQ ID NO: 161287 - DNA, 25 bp, Mus musculus
aaccacatttaaatgattatagatc

SEQ ID NO: 161288 - DNA, 25 bp, Mus musculus
aaccacatttaagtcagattatcgc

SEQ ID NO: 161289 - DNA, 25 bp, Mus musculus
aaccacattttgctatgagcttgga

SEQ ID NO: 161290 - DNA, 25 bp, Mus musculus
aaccacattttggtgtgatggagtc

SEQ ID NO: 161291 - DNA, 25 bp, Mus musculus
aaccaccaggaacagagagaacatt

SEQ ID NO: 161292 - DNA, 25 bp, Mus musculus
aaccaccataggatacgacttgatg

SEQ ID NO: 161293 - DNA, 25 bp, Mus musculus
aaccaccatatttgaaaatgctgtg

SEQ ID NO: 161294 - DNA, 25 bp, Mus musculus
aaccaccatatttgaatcatttcca

SEQ ID NO: 161295 - DNA, 25 bp, Mus musculus
aaccaccatatttgacgcggaaaag

SEQ ID NO: 161296 - DNA, 25 bp, Mus musculus
aaccacccccacgacccactgatgt

SEQ ID NO: 161297 - DNA, 25 bp, Mus musculus
aaccaccccttcaggcagagagcca

SEQ ID NO: 161298 - DNA, 25 bp, Mus musculus
aaccaccctctgggcatggctatct

SEQ ID NO: 161299 - DNA, 25 bp, Mus musculus
aaccaccgaccaggcagccacctgg

SEQ ID NO: 161300 - DNA, 25 bp, Mus musculus
aaccaccgaccaggtcgtccgtact

SEQ ID NO: 161301 - DNA, 25 bp, Mus musculus
aaccaccgctcaacgaaacggaagg

SEQ ID NO: 161302 - DNA, 25 bp, Mus musculus
aaccacctcaggagtgaagcgtgtc

SEQ ID NO: 161303 - DNA, 25 bp, Mus musculus
aaccacctggagagcatcttcctgg

SEQ ID NO: 161304 - DNA, 25 bp, Mus musculus
aaccacctggcgctcgagcacgggt

SEQ ID NO: 161305 - DNA, 25 bp, Mus musculus
aaccacctggcgctggttacccgcg

SEQ ID NO: 161306 - DNA, 25 bp, Mus musculus
aaccacgaagaggaaatgcaggctc

SEQ ID NO: 161307 - DNA, 25 bp, Mus musculus
aaccacgaggaggaaatgcaggctc

SEQ ID NO: 161308 - DNA, 25 bp, Mus musculus
aaccacgaggaggaaatggcctcca

SEQ ID NO: 161309 - DNA, 25 bp, Mus musculus
aaccacgaggaggtggccaccaaca

SEQ ID NO: 161310 - DNA, 25 bp, Mus musculus
aaccacgctgcagcaccacaaagat

SEQ ID NO: 161311 - DNA, 25 bp, Mus musculus
aaccacgctggccagacagctgcag

SEQ ID NO: 161312 - DNA, 25 bp, Mus musculus
aaccacgctggccagataaggctag

SEQ ID NO: 161313 - DNA, 25 bp, Mus musculus
aaccacgctggccagctgcctcacc

SEQ ID NO: 161314 - DNA, 25 bp, Mus musculus
aaccacgctggccaggtattgttag

SEQ ID NO: 161315 - DNA, 25 bp, Mus musculus
aaccacgctggggtctccaatgaca

SEQ ID NO: 161316 - DNA, 25 bp, Mus musculus
aaccacggaaccaaggtggctatgg

SEQ ID NO: 161317 - DNA, 25 bp, Mus musculus
aaccacgtcacctctcacatctcca

SEQ ID NO: 161318 - DNA, 25 bp, Mus musculus
aaccacgtggttcagacagctgtca

SEQ ID NO: 161319 - DNA, 25 bp, Mus musculus
aaccacgtggttcagggtctggaga

SEQ ID NO: 161320 - DNA, 25 bp, Mus musculus
aaccactcaggaccctggaaccctc

SEQ ID NO: 161321 - DNA, 25 bp, Mus musculus
aaccactcagggcttcacacctacc

SEQ ID NO: 161322 - DNA, 25 bp, Mus musculus
aaccactcatatgatacagatttca

SEQ ID NO: 161323 - DNA, 25 bp, Mus musculus
aaccactcatatgatttcaaccagt

SEQ ID NO: 161324 - DNA, 25 bp, Mus musculus
aaccactcttgtaaagtaccagtgc

SEQ ID NO: 161325 - DNA, 25 bp, Mus musculus
aaccactcttgtaaagttacaagcc

SEQ ID NO: 161326 - DNA, 25 bp, Mus musculus
aaccactgcaggatttctggcacca

SEQ ID NO: 161327 - DNA, 25 bp, Mus musculus
aaccactgctaagatttgaattctg

SEQ ID NO: 161328 - DNA, 25 bp, Mus musculus
aaccactgtggattacgctcgattt

SEQ ID NO: 161329 - DNA, 25 bp, Mus musculus
aaccacttgcgaaggggcttcgcct

SEQ ID NO: 161330 - DNA, 25 bp, Mus musculus
aaccacttggctatgggagaggaga

SEQ ID NO: 161331 - DNA, 25 bp, Mus musculus
aaccacttggctatgggggcggggc

SEQ ID NO: 161332 - DNA, 25 bp, Mus musculus
aaccactttgaccggaagaagacgg

SEQ ID NO: 161333 - DNA, 25 bp, Mus musculus
aaccactttgaccgggatcactccg

SEQ ID NO: 161334 - DNA, 25 bp, Mus musculus
aaccagaaagagtccaaagctgccc

SEQ ID NO: 161335 - DNA, 25 bp, Mus musculus
aaccagaaagatacctcagaataca

SEQ ID NO: 161336 - DNA, 25 bp, Mus musculus
aaccagaaagatatactgcaggcaa

SEQ ID NO: 161337 - DNA, 25 bp, Mus musculus
aaccagaaaggtgatctgtaaatcg

SEQ ID NO: 161338 - DNA, 25 bp, Mus musculus
aaccagaacaatcgattggaagaat

SEQ ID NO: 161339 - DNA, 25 bp, Mus musculus
aaccagaacaatcgggaacagactg

SEQ ID NO: 161340 - DNA, 25 bp, Mus musculus
aaccagaaccaccacctggggccag

SEQ ID NO: 161341 - DNA, 25 bp, Mus musculus
aaccagaagaaagagtgtgaggaga

SEQ ID NO: 161342 - DNA, 25 bp, Mus musculus
aaccagaagctaggacctacagact

SEQ ID NO: 161343 - DNA, 25 bp, Mus musculus
aaccagaagctggaatcctttctgc

SEQ ID NO: 161344 - DNA, 25 bp, Mus musculus
aaccagaagtgcctgacagaggagg

SEQ ID NO: 161345 - DNA, 25 bp, Mus musculus
aaccagaagtgcctgctcttgctcc

SEQ ID NO: 161346 - DNA, 25 bp, Mus musculus
aaccagaatccagtatctcttgctc

SEQ ID NO: 161347 - DNA, 25 bp, Mus musculus
aaccagaatccagtttcagatacac

SEQ ID NO: 161348 - DNA, 25 bp, Mus musculus
aaccagacacagcacctgcagtggc

SEQ ID NO: 161349 - DNA, 25 bp, Mus musculus
aaccagacagaataagaatgagcgg

SEQ ID NO: 161350 - DNA, 25 bp, Mus musculus
aaccagacagatggagaaagacgaa

SEQ ID NO: 161351 - DNA, 25 bp, Mus musculus
aaccagacagctgtgccaccgcatg

SEQ ID NO: 161352 - DNA, 25 bp, Mus musculus
aaccagacaggcacctgtgctcagc

SEQ ID NO: 161353 - DNA, 25 bp, Mus musculus
aaccagacattgaggcaccacctac

SEQ ID NO: 161354 - DNA, 25 bp, Mus musculus
aaccagacctgccccaggatccggt

SEQ ID NO: 161355 - DNA, 25 bp, Mus musculus
aaccagactgagatggaccacacag

SEQ ID NO: 161356 - DNA, 25 bp, Mus musculus
aaccagagaggacctgagctgtccc

SEQ ID NO: 161357 - DNA, 25 bp, Mus musculus
aaccagagcaaattcagaaatggat

SEQ ID NO: 161358 - DNA, 25 bp, Mus musculus
aaccagagccatgagggatcttaaa

SEQ ID NO: 161359 - DNA, 25 bp, Mus musculus
aaccagagccatgcggtgctcttag

SEQ ID NO: 161360 - DNA, 25 bp, Mus musculus
aaccagagccatgtagaaccaggcc

SEQ ID NO: 161361 - DNA, 25 bp, Mus musculus
aaccagagccatgtggaaccaggcc

SEQ ID NO: 161362 - DNA, 25 bp, Mus musculus
aaccagagcctggcagaagatgagt

SEQ ID NO: 161363 - DNA, 25 bp, Mus musculus
aaccagagcctgggtcatacttcca

SEQ ID NO: 161364 - DNA, 25 bp, Mus musculus
aaccagaggagattggattccagat

SEQ ID NO: 161365 - DNA, 25 bp, Mus musculus
aaccagaggtggtggaatgatgcgt

SEQ ID NO: 161366 - DNA, 25 bp, Mus musculus
aaccagagtcagaaaaatataactg

SEQ ID NO: 161367 - DNA, 25 bp, Mus musculus
aaccagatatcagaatggtcattta

SEQ ID NO: 161368 - DNA, 25 bp, Mus musculus
aaccagatcagaaaccagtaaagtg

SEQ ID NO: 161369 - DNA, 25 bp, Mus musculus
aaccagcaaaggaagtggggataaa

SEQ ID NO: 161370 - DNA, 25 bp, Mus musculus
aaccagcaaaggtcctttccagtct

SEQ ID NO: 161371 - DNA, 25 bp, Mus musculus
aaccagcaacagctcctgaggaagc

SEQ ID NO: 161372 - DNA, 25 bp, Mus musculus
aaccagcaagctcctgggcctgctc

SEQ ID NO: 161373 - DNA, 25 bp, Mus musculus
aaccagcaagtgcgactgtatctgg

SEQ ID NO: 161374 - DNA, 25 bp, Mus musculus
aaccagcacgaagccccccagcacc

SEQ ID NO: 161375 - DNA, 25 bp, Mus musculus
aaccagcagcccagggtcaggtacc

SEQ ID NO: 161376 - DNA, 25 bp, Mus musculus
aaccagcagggtggcccacgcgctg

SEQ ID NO: 161377 - DNA, 25 bp, Mus musculus
aaccagcagttcacgattctcgagc

SEQ ID NO: 161378 - DNA, 25 bp, Mus musculus
aaccagcatgggagagttgcagctt

SEQ ID NO: 161379 - DNA, 25 bp, Mus musculus
aaccagccaaggactaactacgacc

SEQ ID NO: 161380 - DNA, 25 bp, Mus musculus
aaccagccaaggcaggatggaaccg

SEQ ID NO: 161381 - DNA, 25 bp, Mus musculus
aaccagccagtaattgggtgctgta

SEQ ID NO: 161382 - DNA, 25 bp, Mus musculus
aaccagccgcaagggaaggtgtgat

SEQ ID NO: 161383 - DNA, 25 bp, Mus musculus
aaccagccgcagagccccaaggacg

SEQ ID NO: 161384 - DNA, 25 bp, Mus musculus
aaccagcctcaggaagcaggccagc

SEQ ID NO: 161385 - DNA, 25 bp, Mus musculus
aaccagcgaccagatgaccaatgca

SEQ ID NO: 161386 - DNA, 25 bp, Mus musculus
aaccagcgaccagtcttgtgccatt

SEQ ID NO: 161387 - DNA, 25 bp, Mus musculus
aaccagcgctcttctgttatgttct

SEQ ID NO: 161388 - DNA, 25 bp, Mus musculus
aaccagcggagttcaatgcgagctc

SEQ ID NO: 161389 - DNA, 25 bp, Mus musculus
aaccagcggagtttcagtctggaag

SEQ ID NO: 161390 - DNA, 25 bp, Mus musculus
aaccagctccaaccctttgcggaag

SEQ ID NO: 161391 - DNA, 25 bp, Mus musculus
aaccagctccaggaagcagtcatga

SEQ ID NO: 161392 - DNA, 25 bp, Mus musculus
aaccagctcgaaaaaacaatggcaa

SEQ ID NO: 161393 - DNA, 25 bp, Mus musculus
aaccagctcgacttgagcagcggca

SEQ ID NO: 161394 - DNA, 25 bp, Mus musculus
aaccagctcgtcttgagcagcggca

SEQ ID NO: 161395 - DNA, 25 bp, Mus musculus
aaccagctgtggttcggggccagga

SEQ ID NO: 161396 - DNA, 25 bp, Mus musculus
aaccaggaaaatatgggctggcgct

SEQ ID NO: 161397 - DNA, 25 bp, Mus musculus
aaccaggaaaatctttacatgagga

SEQ ID NO: 161398 - DNA, 25 bp, Mus musculus
aaccaggaaaatgtttacatgagga

SEQ ID NO: 161399 - DNA, 25 bp, Mus musculus
aaccaggaactcgaggctcctggag

SEQ ID NO: 161400 - DNA, 25 bp, Mus musculus
aaccaggacaggattccccctctgt

SEQ ID NO: 161401 - DNA, 25 bp, Mus musculus
aaccaggacccccaggtgatgctgg

SEQ ID NO: 161402 - DNA, 25 bp, Mus musculus
aaccaggacctaggctggcacgctt

SEQ ID NO: 161403 - DNA, 25 bp, Mus musculus
aaccaggagactaagccttctgatg

SEQ ID NO: 161404 - DNA, 25 bp, Mus musculus
aaccaggagagcaagctgatcatcc

SEQ ID NO: 161405 - DNA, 25 bp, Mus musculus
aaccaggataacacctgacactgaa

SEQ ID NO: 161406 - DNA, 25 bp, Mus musculus
aaccaggataacacgtccctagctg

SEQ ID NO: 161407 - DNA, 25 bp, Mus musculus
aaccaggcaccaggcaccaacagag

SEQ ID NO: 161408 - DNA, 25 bp, Mus musculus
aaccaggcacttaaggaaattgggg

SEQ ID NO: 161409 - DNA, 25 bp, Mus musculus
aaccaggcatgctccctgacctcag

SEQ ID NO: 161410 - DNA, 25 bp, Mus musculus
aaccaggccaagaagggggatggaa

SEQ ID NO: 161411 - DNA, 25 bp, Mus musculus
aaccaggcccgtgaccacctctctg

SEQ ID NO: 161412 - DNA, 25 bp, Mus musculus
aaccagggagtaaagggacatctct

SEQ ID NO: 161413 - DNA, 25 bp, Mus musculus
aaccaggggcaaggtttcagccaca

SEQ ID NO: 161414 - DNA, 25 bp, Mus musculus
aaccaggtcaaggctctggataagc

SEQ ID NO: 161415 - DNA, 25 bp, Mus musculus
aaccaggtcaagggcaagcctgacc

SEQ ID NO: 161416 - DNA, 25 bp, Mus musculus
aaccaggtggacatgacagtggccg

SEQ ID NO: 161417 - DNA, 25 bp, Mus musculus
aaccagtaagggcaaagatgacgtt

SEQ ID NO: 161418 - DNA, 25 bp, Mus musculus
aaccagtaccaggaatgggcacccc

SEQ ID NO: 161419 - DNA, 25 bp, Mus musculus
aaccagtaccagtcctcttctccaa

SEQ ID NO: 161420 - DNA, 25 bp, Mus musculus
aaccagtacttgacaggttcttgtc

SEQ ID NO: 161421 - DNA, 25 bp, Mus musculus
aaccagtataaccctttaatggcta

SEQ ID NO: 161422 - DNA, 25 bp, Mus musculus
aaccagtatggaccgatgggtccca

SEQ ID NO: 161423 - DNA, 25 bp, Mus musculus
aaccagtatggaccggtgtgttcct

SEQ ID NO: 161424 - DNA, 25 bp, Mus musculus
aaccagtcagctcagaccctgctgg

SEQ ID NO: 161425 - DNA, 25 bp, Mus musculus
aaccagtcagctcagctttgcggag

SEQ ID NO: 161426 - DNA, 25 bp, Mus musculus
aaccagtcagtacagcaaacaattg

SEQ ID NO: 161427 - DNA, 25 bp, Mus musculus
aaccagtcagtacaggttcatcgtt

SEQ ID NO: 161428 - DNA, 25 bp, Mus musculus
aaccagtctaagttctttcgagttt

SEQ ID NO: 161429 - DNA, 25 bp, Mus musculus
aaccagtctgcctaactctgtggcc

SEQ ID NO: 161430 - DNA, 25 bp, Mus musculus
aaccagtctggcaggatcttgtgct

SEQ ID NO: 161431 - DNA, 25 bp, Mus musculus
aaccagtgcaccctggaacagcttc

SEQ ID NO: 161432 - DNA, 25 bp, Mus musculus
aaccagtgccaaaagaattcagaag

SEQ ID NO: 161433 - DNA, 25 bp, Mus musculus
aaccagtgccaaaagtgctggaccc

SEQ ID NO: 161434 - DNA, 25 bp, Mus musculus
aaccagtgtgtggatgtggacgagt

SEQ ID NO: 161435 - DNA, 25 bp, Mus musculus
aaccagtgtgtggcccgccacctct

SEQ ID NO: 161436 - DNA, 25 bp, Mus musculus
aaccagttaagagagaacagagttt

SEQ ID NO: 161437 - DNA, 25 bp, Mus musculus
aaccagttccatagtgatgttaatt

SEQ ID NO: 161438 - DNA, 25 bp, Mus musculus
aaccataatcgaaggttggctgctg

SEQ ID NO: 161439 - DNA, 25 bp, Mus musculus
aaccatactatgcattatccaattg

SEQ ID NO: 161440 - DNA, 25 bp, Mus musculus
aaccatactatttgcttttgccaag

SEQ ID NO: 161441 - DNA, 25 bp, Mus musculus
aaccatagagagacactacgcacag

SEQ ID NO: 161442 - DNA, 25 bp, Mus musculus
aaccatagctcaccgtgtctcttct

SEQ ID NO: 161443 - DNA, 25 bp, Mus musculus
aaccatagctcatcgggttcacacc

SEQ ID NO: 161444 - DNA, 25 bp, Mus musculus
aaccatagggttctacagtgagtcg

SEQ ID NO: 161445 - DNA, 25 bp, Mus musculus
aaccatatttggtcacctggagaga

SEQ ID NO: 161446 - DNA, 25 bp, Mus musculus
aaccatcaaaaaggcaaacataaat

SEQ ID NO: 161447 - DNA, 25 bp, Mus musculus
aaccatcaacaagcaaatccgcgac

SEQ ID NO: 161448 - DNA, 25 bp, Mus musculus
aaccatcaggctgctgattttccga

SEQ ID NO: 161449 - DNA, 25 bp, Mus musculus
aaccatcagggtgctgattttccga

SEQ ID NO: 161450 - DNA, 25 bp, Mus musculus
aaccatcatgagatatctgccaaga

SEQ ID NO: 161451 - DNA, 25 bp, Mus musculus
aaccatcccaggtgacaccgcttgg

SEQ ID NO: 161452 - DNA, 25 bp, Mus musculus
aaccatcccccatgcggctgggtat

SEQ ID NO: 161453 - DNA, 25 bp, Mus musculus
aaccatccggaagaaagcaaaagag

SEQ ID NO: 161454 - DNA, 25 bp, Mus musculus
aaccatcctgaggcctgactaccag

SEQ ID NO: 161455 - DNA, 25 bp, Mus musculus
aaccatcgatagtgtccggatgcga

SEQ ID NO: 161456 - DNA, 25 bp, Mus musculus
aaccatctctaagatgtaaagaagg

SEQ ID NO: 161457 - DNA, 25 bp, Mus musculus
aaccatctgaaagctgggttgcagg

SEQ ID NO: 161458 - DNA, 25 bp, Mus musculus
aaccatctgatggcctgctggtgac

SEQ ID NO: 161459 - DNA, 25 bp, Mus musculus
aaccatctggagaatgtgaggtgga

SEQ ID NO: 161460 - DNA, 25 bp, Mus musculus
aaccatcttcaaggacctgccgctg

SEQ ID NO: 161461 - DNA, 25 bp, Mus musculus
aaccatgaaaagaagagatgagacc

SEQ ID NO: 161462 - DNA, 25 bp, Mus musculus
aaccatgaagaggaagttggtgtcc

SEQ ID NO: 161463 - DNA, 25 bp, Mus musculus
aaccatgaaggggactcctctcgaa

SEQ ID NO: 161464 - DNA, 25 bp, Mus musculus
aaccatgaagtttctctgtgctctc

SEQ ID NO: 161465 - DNA, 25 bp, Mus musculus
aaccatgacatgtactatgcgtcgg

SEQ ID NO: 161466 - DNA, 25 bp, Mus musculus
aaccatgagaaagagccactggcaa

SEQ ID NO: 161467 - DNA, 25 bp, Mus musculus
aaccatgagccactgccagcgttcc

SEQ ID NO: 161468 - DNA, 25 bp, Mus musculus
aaccatgaggaggaagtcaacaccc

SEQ ID NO: 161469 - DNA, 25 bp, Mus musculus
aaccatgcaatcaatgtttgcaaaa

SEQ ID NO: 161470 - DNA, 25 bp, Mus musculus
aaccatgccaaacagagcatgctgg

SEQ ID NO: 161471 - DNA, 25 bp, Mus musculus
aaccatgccaaacagctgcagagaa

SEQ ID NO: 161472 - DNA, 25 bp, Mus musculus
aaccatgccgcctgctaagccccag

SEQ ID NO: 161473 - DNA, 25 bp, Mus musculus
aaccatggaaggctcacccacgggc

SEQ ID NO: 161474 - DNA, 25 bp, Mus musculus
aaccatggacctagtccaaggcggt

SEQ ID NO: 161475 - DNA, 25 bp, Mus musculus
aaccatggcagaacaaaaatcagat

SEQ ID NO: 161476 - DNA, 25 bp, Mus musculus
aaccatggcagaattttctcagcgt

SEQ ID NO: 161477 - DNA, 25 bp, Mus musculus
aaccatggcagagcacctgacccag

SEQ ID NO: 161478 - DNA, 25 bp, Mus musculus
aaccatggcagagcgatggcagcac

SEQ ID NO: 161479 - DNA, 25 bp, Mus musculus
aaccatggcaggtacagagctatcg

SEQ ID NO: 161480 - DNA, 25 bp, Mus musculus
aaccatggcccgtattcggaaacta

SEQ ID NO: 161481 - DNA, 25 bp, Mus musculus
aaccatggcccgtgatgcttcattt

SEQ ID NO: 161482 - DNA, 25 bp, Mus musculus
aaccatggcccgtgtgtcagtggtg

SEQ ID NO: 161483 - DNA, 25 bp, Mus musculus
aaccatgggaagatcccaacgctgg

SEQ ID NO: 161484 - DNA, 25 bp, Mus musculus
aaccatgggaccggtccaacgggcg

SEQ ID NO: 161485 - DNA, 25 bp, Mus musculus
aaccatgtccagattcggaaactaa

SEQ ID NO: 161486 - DNA, 25 bp, Mus musculus
aaccatgttccggcttttccccagt

SEQ ID NO: 161487 - DNA, 25 bp, Mus musculus
aaccatgtttgcagccagcagcaag

SEQ ID NO: 161488 - DNA, 25 bp, Mus musculus
aaccattacagccatccccaggcag

SEQ ID NO: 161489 - DNA, 25 bp, Mus musculus
aaccattatcaagttctcagatgaa

SEQ ID NO: 161490 - DNA, 25 bp, Mus musculus
aaccattcaaaatacaagtcctggt

SEQ ID NO: 161491 - DNA, 25 bp, Mus musculus
aaccattcaaatcctggttgaagct

SEQ ID NO: 161492 - DNA, 25 bp, Mus musculus
aaccattcagtttgcaggagacata

SEQ ID NO: 161493 - DNA, 25 bp, Mus musculus
aaccattcatctgggaatgattttg

SEQ ID NO: 161494 - DNA, 25 bp, Mus musculus
aaccattgtaaaacttatggaacga

SEQ ID NO: 161495 - DNA, 25 bp, Mus musculus
aaccatttgaacagccctgctttaa

SEQ ID NO: 161496 - DNA, 25 bp, Mus musculus
aaccatttgaacaggtcttatgcaa

SEQ ID NO: 161497 - DNA, 25 bp, Mus musculus
aaccattttgacaagaagcagacag

SEQ ID NO: 161498 - DNA, 25 bp, Mus musculus
aaccattttgacaaggaccatggcg

SEQ ID NO: 161499 - DNA, 25 bp, Mus musculus
aacccaaaacaagctaatgtctgcg

SEQ ID NO: 161500 - DNA, 25 bp, Mus musculus
aacccaaaacaagttgctcccaaat

SEQ ID NO: 161501 - DNA, 25 bp, Mus musculus
aacccaaaagatcttcccctgatgg

SEQ ID NO: 161502 - DNA, 25 bp, Mus musculus
aacccaaaccaggtgtatatcaaca

SEQ ID NO: 161503 - DNA, 25 bp, Mus musculus
aacccaaactggatcctctgaagct

SEQ ID NO: 161504 - DNA, 25 bp, Mus musculus
aacccaacagcccactgagtgtttc

SEQ ID NO: 161505 - DNA, 25 bp, Mus musculus
aacccaaccaggtgatgagactatc

SEQ ID NO: 161506 - DNA, 25 bp, Mus musculus
aacccaaccatatgagagtctgtgg

SEQ ID NO: 161507 - DNA, 25 bp, Mus musculus
aacccaacccggaggaccaggactg

SEQ ID NO: 161508 - DNA, 25 bp, Mus musculus
aacccaactgatccccagctcaagg

SEQ ID NO: 161509 - DNA, 25 bp, Mus musculus
aacccaagaaaatgatctgaatttc

SEQ ID NO: 161510 - DNA, 25 bp, Mus musculus
aacccaagagacttctctacccagg

SEQ ID NO: 161511 - DNA, 25 bp, Mus musculus
aacccaagaggctggggtctcagaa

SEQ ID NO: 161512 - DNA, 25 bp, Mus musculus
aacccaagagtgatggaaagaactc

SEQ ID NO: 161513 - DNA, 25 bp, Mus musculus
aacccaagcccaggacaccgtgcat

SEQ ID NO: 161514 - DNA, 25 bp, Mus musculus
aacccaagcccagttccacaagagg

SEQ ID NO: 161515 - DNA, 25 bp, Mus musculus
aacccaagcggaaggagcatagtga

SEQ ID NO: 161516 - DNA, 25 bp, Mus musculus
aacccaaggtgctacagtggggata

SEQ ID NO: 161517 - DNA, 25 bp, Mus musculus
aacccaagtcatcttggctgaagag

SEQ ID NO: 161518 - DNA, 25 bp, Mus musculus
aacccaatatttcagctaaactctg

SEQ ID NO: 161519 - DNA, 25 bp, Mus musculus
aacccaatatttcaggtttcacaga

SEQ ID NO: 161520 - DNA, 25 bp, Mus musculus
aacccaatccagagctaagctagga

SEQ ID NO: 161521 - DNA, 25 bp, Mus musculus
aacccaatccagcatacagagctaa

SEQ ID NO: 161522 - DNA, 25 bp, Mus musculus
aacccaatctctgcgattttattga

SEQ ID NO: 161523 - DNA, 25 bp, Mus musculus
aacccacaaacaggtcagcccttct

SEQ ID NO: 161524 - DNA, 25 bp, Mus musculus
aacccacacatagagagactgagaa

SEQ ID NO: 161525 - DNA, 25 bp, Mus musculus
aacccacagagatataaactacact

SEQ ID NO: 161526 - DNA, 25 bp, Mus musculus
aacccaccaagaataaagcgctaac

SEQ ID NO: 161527 - DNA, 25 bp, Mus musculus
aacccaccagagagtgctgatccca

SEQ ID NO: 161528 - DNA, 25 bp, Mus musculus
aacccaccagagcccgagacagtga

SEQ ID NO: 161529 - DNA, 25 bp, Mus musculus
aacccaccatgtatgcttgagagtt

SEQ ID NO: 161530 - DNA, 25 bp, Mus musculus
aacccacccaggaacaattgtgaga

SEQ ID NO: 161531 - DNA, 25 bp, Mus musculus
aacccacgaagggcgaatcgccagg

SEQ ID NO: 161532 - DNA, 25 bp, Mus musculus
aacccacgcaagatggctgccagca

SEQ ID NO: 161533 - DNA, 25 bp, Mus musculus
aacccagaagcaagacgcgggcgat

SEQ ID NO: 161534 - DNA, 25 bp, Mus musculus
aacccagaagcaaggggtggatgag

SEQ ID NO: 161535 - DNA, 25 bp, Mus musculus
aacccagaagttctcctgattctgg

SEQ ID NO: 161536 - DNA, 25 bp, Mus musculus
aacccagacacaagcattcccacta

SEQ ID NO: 161537 - DNA, 25 bp, Mus musculus
aacccagagaagagtgacagcagct

SEQ ID NO: 161538 - DNA, 25 bp, Mus musculus
aacccagagaaggcccagcttggga

SEQ ID NO: 161539 - DNA, 25 bp, Mus musculus
aacccagaggagatgctgtctatgt

SEQ ID NO: 161540 - DNA, 25 bp, Mus musculus
aacccagaggagggagtgagctact

SEQ ID NO: 161541 - DNA, 25 bp, Mus musculus
aacccagataccagattaagcttgc

SEQ ID NO: 161542 - DNA, 25 bp, Mus musculus
aacccagataccattaaaaagagaa

SEQ ID NO: 161543 - DNA, 25 bp, Mus musculus
aacccagatcccaaacctagagact

SEQ ID NO: 161544 - DNA, 25 bp, Mus musculus
aacccagattcaaactgccgtggtg

SEQ ID NO: 161545 - DNA, 25 bp, Mus musculus
aacccagattccaggataacataaa

SEQ ID NO: 161546 - DNA, 25 bp, Mus musculus
aacccagcacctgcgcttagatccg

SEQ ID NO: 161547 - DNA, 25 bp, Mus musculus
aacccagcacctgcggaaaatttcc

SEQ ID NO: 161548 - DNA, 25 bp, Mus musculus
aacccagcagccatccttgcagcct

SEQ ID NO: 161549 - DNA, 25 bp, Mus musculus
aacccagcagtatgaatattctttg

SEQ ID NO: 161550 - DNA, 25 bp, Mus musculus
aacccagcatgagtccgcagagtcc

SEQ ID NO: 161551 - DNA, 25 bp, Mus musculus
aacccagcccagagatacattgttg

SEQ ID NO: 161552 - DNA, 25 bp, Mus musculus
aacccaggcaagttctgcctgctga

SEQ ID NO: 161553 - DNA, 25 bp, Mus musculus
aacccaggcaccagaaacctcatcc

SEQ ID NO: 161554 - DNA, 25 bp, Mus musculus
aacccaggcaccagccagtaagtgc

SEQ ID NO: 161555 - DNA, 25 bp, Mus musculus
aacccaggcaccaggttgctccagg

SEQ ID NO: 161556 - DNA, 25 bp, Mus musculus
aacccaggcaccagtgtgtccattg

SEQ ID NO: 161557 - DNA, 25 bp, Mus musculus
aacccaggcactcggggtcctgaga

SEQ ID NO: 161558 - DNA, 25 bp, Mus musculus
aacccaggccaaggaggagtcagaa

SEQ ID NO: 161559 - DNA, 25 bp, Mus musculus
aacccaggctccaccaaacgtggtc

SEQ ID NO: 161560 - DNA, 25 bp, Mus musculus
aacccaggctcccactggcctcatg

SEQ ID NO: 161561 - DNA, 25 bp, Mus musculus
aacccagtaatttgtactataccaa

SEQ ID NO: 161562 - DNA, 25 bp, Mus musculus
aacccagtaccaaggacctgtgtta

SEQ ID NO: 161563 - DNA, 25 bp, Mus musculus
aacccatcaatcaggtgaatccccc

SEQ ID NO: 161564 - DNA, 25 bp, Mus musculus
aacccatcaatcaggtgactgtgac

SEQ ID NO: 161565 - DNA, 25 bp, Mus musculus
aacccatcagccagaccacagatga

SEQ ID NO: 161566 - DNA, 25 bp, Mus musculus
aacccatcaggaaggatcatcgaat

SEQ ID NO: 161567 - DNA, 25 bp, Mus musculus
aacccatcaggctgacatcaaagaa

SEQ ID NO: 161568 - DNA, 25 bp, Mus musculus
aacccatcctggagggctcctgtga

SEQ ID NO: 161569 - DNA, 25 bp, Mus musculus
aacccatcctggagtgtacaactct

SEQ ID NO: 161570 - DNA, 25 bp, Mus musculus
aacccatcgcaggtgcagaccataa

SEQ ID NO: 161571 - DNA, 25 bp, Mus musculus
aacccatctcagatcttctgcccaa

SEQ ID NO: 161572 - DNA, 25 bp, Mus musculus
aacccatgtggcagtggtccccagt

SEQ ID NO: 161573 - DNA, 25 bp, Mus musculus
aacccattcctgcctaaattttaag

SEQ ID NO: 161574 - DNA, 25 bp, Mus musculus
aacccattctcaaaaatttcaaagg

SEQ ID NO: 161575 - DNA, 25 bp, Mus musculus
aacccatttcggatgttcctgcctt

SEQ ID NO: 161576 - DNA, 25 bp, Mus musculus
aaccccaaaacggacctacgagcag

SEQ ID NO: 161577 - DNA, 25 bp, Mus musculus
aaccccaaatctgtgctgaagagac

SEQ ID NO: 161578 - DNA, 25 bp, Mus musculus
aaccccaaatgaccactgagattcc

SEQ ID NO: 161579 - DNA, 25 bp, Mus musculus
aaccccaaatgaccagagaacttca

SEQ ID NO: 161580 - DNA, 25 bp, Mus musculus
aaccccaacttctcggtctactata

SEQ ID NO: 161581 - DNA, 25 bp, Mus musculus
aaccccacaaaatcatgcaaatcaa

SEQ ID NO: 161582 - DNA, 25 bp, Mus musculus
aaccccacagcagaaactgcagttg

SEQ ID NO: 161583 - DNA, 25 bp, Mus musculus
aaccccacagcaggagtggacagca

SEQ ID NO: 161584 - DNA, 25 bp, Mus musculus
aaccccacagccaaggcctggccac

SEQ ID NO: 161585 - DNA, 25 bp, Mus musculus
aaccccacagtaaactacattttgt

SEQ ID NO: 161586 - DNA, 25 bp, Mus musculus
aaccccaccatcatgatttaagcag

SEQ ID NO: 161587 - DNA, 25 bp, Mus musculus
aaccccacccaggtggaggatgcgg

SEQ ID NO: 161588 - DNA, 25 bp, Mus musculus
aaccccacccagtttctgtgttgtg

SEQ ID NO: 161589 - DNA, 25 bp, Mus musculus
aaccccagagcggctccggagttga

SEQ ID NO: 161590 - DNA, 25 bp, Mus musculus
aaccccagagcgggagctcttggct

SEQ ID NO: 161591 - DNA, 25 bp, Mus musculus
aaccccagagcggttttgctgtatt

SEQ ID NO: 161592 - DNA, 25 bp, Mus musculus
aaccccagcttcacgctgtccctga

SEQ ID NO: 161593 - DNA, 25 bp, Mus musculus
aaccccaggaggacctggggtcaga

SEQ ID NO: 161594 - DNA, 25 bp, Mus musculus
aaccccaggcagaaagtaaatccgt

SEQ ID NO: 161595 - DNA, 25 bp, Mus musculus
aaccccagggacagctgactttaag

SEQ ID NO: 161596 - DNA, 25 bp, Mus musculus
aaccccataccacatgtgagatcca

SEQ ID NO: 161597 - DNA, 25 bp, Mus musculus
aaccccataccagatgtgagatcca

SEQ ID NO: 161598 - DNA, 25 bp, Mus musculus
aaccccataggaggccgctacgacc

SEQ ID NO: 161599 - DNA, 25 bp, Mus musculus
aaccccatcactgggaaaaggactg

SEQ ID NO: 161600 - DNA, 25 bp, Mus musculus
aaccccatcactgggtttggtaaag

SEQ ID NO: 161601 - DNA, 25 bp, Mus musculus
aaccccatggagacatatgaggacc

SEQ ID NO: 161602 - DNA, 25 bp, Mus musculus
aacccccaatatgaacattttccct

SEQ ID NO: 161603 - DNA, 25 bp, Mus musculus
aacccccagcctccagtgatgccac

SEQ ID NO: 161604 - DNA, 25 bp, Mus musculus
aacccccatacggtgcctcctgaga

SEQ ID NO: 161605 - DNA, 25 bp, Mus musculus
aacccccccacaggtcatcctgttc

SEQ ID NO: 161606 - DNA, 25 bp, Mus musculus
aacccccctaagggcagcagcaatg

SEQ ID NO: 161607 - DNA, 25 bp, Mus musculus
aacccccggagtttcaagccacaga

SEQ ID NO: 161608 - DNA, 25 bp, Mus musculus
aaccccctcttcaactctggctcca

SEQ ID NO: 161609 - DNA, 25 bp, Mus musculus
aaccccgacccagactcattacagg

SEQ ID NO: 161610 - DNA, 25 bp, Mus musculus
aaccccgagaaagggtatatgtatt

SEQ ID NO: 161611 - DNA, 25 bp, Mus musculus
aaccccgccaagctctcggggataa

SEQ ID NO: 161612 - DNA, 25 bp, Mus musculus
aaccccgcttttcagatcctggatg

SEQ ID NO: 161613 - DNA, 25 bp, Mus musculus
aaccccgggaggaagctatgctcta

SEQ ID NO: 161614 - DNA, 25 bp, Mus musculus
aaccccggtggcaagagactgctta

SEQ ID NO: 161615 - DNA, 25 bp, Mus musculus
aaccccgtcaaggtccgatctgacc

SEQ ID NO: 161616 - DNA, 25 bp, Mus musculus
aaccccgtcctgtgtgtcaccccgc

SEQ ID NO: 161617 - DNA, 25 bp, Mus musculus
aaccccgttcagcagagagtacttc

SEQ ID NO: 161618 - DNA, 25 bp, Mus musculus
aaccccgttctggagctgagaaggg

SEQ ID NO: 161619 - DNA, 25 bp, Mus musculus
aaccccgtttattagtgcttacaga

SEQ ID NO: 161620 - DNA, 25 bp, Mus musculus
aacccctatggctggccacagattg

SEQ ID NO: 161621 - DNA, 25 bp, Mus musculus
aacccctcagcaagccccgcccaac

SEQ ID NO: 161622 - DNA, 25 bp, Mus musculus
aacccctctcctccataagcagccg

SEQ ID NO: 161623 - DNA, 25 bp, Mus musculus
aacccctcttatcctactagttgta

SEQ ID NO: 161624 - DNA, 25 bp, Mus musculus
aacccctcttcagacagagagcctg

SEQ ID NO: 161625 - DNA, 25 bp, Mus musculus
aacccctcttcaggttatccgtgtt

SEQ ID NO: 161626 - DNA, 25 bp, Mus musculus
aacccgactgaatgctcggattggg

SEQ ID NO: 161627 - DNA, 25 bp, Mus musculus
aacccgatggagggaccttgccagg

SEQ ID NO: 161628 - DNA, 25 bp, Mus musculus
aacccgcactcagctgtttgaaata

SEQ ID NO: 161629 - DNA, 25 bp, Mus musculus
aacccgcactcaggggaaggagcca

SEQ ID NO: 161630 - DNA, 25 bp, Mus musculus
aacccgccattcagggtgtcctgga

SEQ ID NO: 161631 - DNA, 25 bp, Mus musculus
aacccgctactgtatcccttttggc

SEQ ID NO: 161632 - DNA, 25 bp, Mus musculus
aacccggaggacaaaggctatgtgc

SEQ ID NO: 161633 - DNA, 25 bp, Mus musculus
aacccggaggaggttctgctgcctt

SEQ ID NO: 161634 - DNA, 25 bp, Mus musculus
aacccggagtctggcacatccagga

SEQ ID NO: 161635 - DNA, 25 bp, Mus musculus
aacccggcagaactacacatactca

SEQ ID NO: 161636 - DNA, 25 bp, Mus musculus
aacccggctagagcgccacttagcc

SEQ ID NO: 161637 - DNA, 25 bp, Mus musculus
aacccgtgaggtcaatatccaacac

SEQ ID NO: 161638 - DNA, 25 bp, Mus musculus
aaccctaaagatcctgttgtctcaa

SEQ ID NO: 161639 - DNA, 25 bp, Mus musculus
aaccctaaaggccttgcatcaaaca

SEQ ID NO: 161640 - DNA, 25 bp, Mus musculus
aaccctacagggtgactacaaccag

SEQ ID NO: 161641 - DNA, 25 bp, Mus musculus
aaccctacagtaggcttcgagctgt

SEQ ID NO: 161642 - DNA, 25 bp, Mus musculus
aaccctacagtagggtctcactgtg

SEQ ID NO: 161643 - DNA, 25 bp, Mus musculus
aaccctacgcacagagtatgatagg

SEQ ID NO: 161644 - DNA, 25 bp, Mus musculus
aaccctatcgaagaagaaccgatcg

SEQ ID NO: 161645 - DNA, 25 bp, Mus musculus
aaccctcaaccgtgttaggagtgga

SEQ ID NO: 161646 - DNA, 25 bp, Mus musculus
aaccctcaggtatccaacgcttgta

SEQ ID NO: 161647 - DNA, 25 bp, Mus musculus
aaccctcatgcattaagtcttgtga

SEQ ID NO: 161648 - DNA, 25 bp, Mus musculus
aaccctcatgcattatgaagaagtc

SEQ ID NO: 161649 - DNA, 25 bp, Mus musculus
aaccctccaaatccggccaaagata

SEQ ID NO: 161650 - DNA, 25 bp, Mus musculus
aaccctccaacatattcgattcttg

SEQ ID NO: 161651 - DNA, 25 bp, Mus musculus
aaccctccactagctggcattccta

SEQ ID NO: 161652 - DNA, 25 bp, Mus musculus
aaccctccagaaagccatcgatctg

SEQ ID NO: 161653 - DNA, 25 bp, Mus musculus
aaccctccagagaagatacggactc

SEQ ID NO: 161654 - DNA, 25 bp, Mus musculus
aaccctccggagatggcgtcagaca

SEQ ID NO: 161655 - DNA, 25 bp, Mus musculus
aaccctctataccagactttgtacc

SEQ ID NO: 161656 - DNA, 25 bp, Mus musculus
aaccctctcagtgtgtgactttctt

SEQ ID NO: 161657 - DNA, 25 bp, Mus musculus
aaccctctccagcaggcacctccag

SEQ ID NO: 161658 - DNA, 25 bp, Mus musculus
aaccctctgagaagagatggcgtca

SEQ ID NO: 161659 - DNA, 25 bp, Mus musculus
aaccctctgccctgctataacggag

SEQ ID NO: 161660 - DNA, 25 bp, Mus musculus
aaccctctgcgaagatggaatgaaa

SEQ ID NO: 161661 - DNA, 25 bp, Mus musculus
aaccctctggctcatacatgtctca

SEQ ID NO: 161662 - DNA, 25 bp, Mus musculus
aaccctctgggaaaggtattctcta

SEQ ID NO: 161663 - DNA, 25 bp, Mus musculus
aaccctctgggacaggtattctcta

SEQ ID NO: 161664 - DNA, 25 bp, Mus musculus
aaccctgaaattatatcattggata

SEQ ID NO: 161665 - DNA, 25 bp, Mus musculus
aaccctgaagatattgtgaacaagg

SEQ ID NO: 161666 - DNA, 25 bp, Mus musculus
aaccctgaaggatcctcgctctgca

SEQ ID NO: 161667 - DNA, 25 bp, Mus musculus
aaccctgaaggatgatgactgggga

SEQ ID NO: 161668 - DNA, 25 bp, Mus musculus
aaccctgacctgtgctgctccgcag

SEQ ID NO: 161669 - DNA, 25 bp, Mus musculus
aaccctgacctgtggttcctgcacg

SEQ ID NO: 161670 - DNA, 25 bp, Mus musculus
aaccctgactttactaggacctggc

SEQ ID NO: 161671 - DNA, 25 bp, Mus musculus
aaccctgactttgtggctgttccat

SEQ ID NO: 161672 - DNA, 25 bp, Mus musculus
aaccctgagcgcccccgtggaatgg

SEQ ID NO: 161673 - DNA, 25 bp, Mus musculus
aaccctgataatggcagcccagcca

SEQ ID NO: 161674 - DNA, 25 bp, Mus musculus
aaccctgcaactgatgagatgcgca

SEQ ID NO: 161675 - DNA, 25 bp, Mus musculus
aaccctgccatcagatacaagcgga

SEQ ID NO: 161676 - DNA, 25 bp, Mus musculus
aaccctgccattctgatgaagttcc

SEQ ID NO: 161677 - DNA, 25 bp, Mus musculus
aaccctgccattcttattctgagga

SEQ ID NO: 161678 - DNA, 25 bp, Mus musculus
aaccctgcccagctgaggcaaaagg

SEQ ID NO: 161679 - DNA, 25 bp, Mus musculus
aaccctgcccaggtgaggcaaaagg

SEQ ID NO: 161680 - DNA, 25 bp, Mus musculus
aaccctgcctcagcccatacccagc

SEQ ID NO: 161681 - DNA, 25 bp, Mus musculus
aaccctggacgaccggcgtgtgcag

SEQ ID NO: 161682 - DNA, 25 bp, Mus musculus
aaccctggacgaccgtatctggact

SEQ ID NO: 161683 - DNA, 25 bp, Mus musculus
aaccctggactgctgtaagtgtgga

SEQ ID NO: 161684 - DNA, 25 bp, Mus musculus
aaccctggagctgccgcagtggcaa

SEQ ID NO: 161685 - DNA, 25 bp, Mus musculus
aaccctggcactgtgaaaattccac

SEQ ID NO: 161686 - DNA, 25 bp, Mus musculus
aaccctggcaggtgcacaggctgct

SEQ ID NO: 161687 - DNA, 25 bp, Mus musculus
aaccctgggaaaggtgctgggtgtg

SEQ ID NO: 161688 - DNA, 25 bp, Mus musculus
aaccctgtccaggtagctctggctg

SEQ ID NO: 161689 - DNA, 25 bp, Mus musculus
aaccctgttgggaactgttgacaag

SEQ ID NO: 161690 - DNA, 25 bp, Mus musculus
aacccttcaagatcccgattcgctc

SEQ ID NO: 161691 - DNA, 25 bp, Mus musculus
aacccttcgagaagcctggaaagga

SEQ ID NO: 161692 - DNA, 25 bp, Mus musculus
aacccttcgcggcgggataaataag

SEQ ID NO: 161693 - DNA, 25 bp, Mus musculus
aacccttcgcggcgggcaaatgacc

SEQ ID NO: 161694 - DNA, 25 bp, Mus musculus
aacccttgcttgtcggaatctgatg

SEQ ID NO: 161695 - DNA, 25 bp, Mus musculus
aacccttgtgaactgaagaataatg

SEQ ID NO: 161696 - DNA, 25 bp, Mus musculus
aacccttgtgatgtggtgaagactc

SEQ ID NO: 161697 - DNA, 25 bp, Mus musculus
aaccctttagatgctagtggaggtt

SEQ ID NO: 161698 - DNA, 25 bp, Mus musculus
aaccctttagatggtgtggatccag

SEQ ID NO: 161699 - DNA, 25 bp, Mus musculus
aaccctttatgctatgaaaccacta

SEQ ID NO: 161700 - DNA, 25 bp, Mus musculus
aaccctttatgctcaatatgaagat

SEQ ID NO: 161701 - DNA, 25 bp, Mus musculus
aaccctttatgctgattctctgacc

SEQ ID NO: 161702 - DNA, 25 bp, Mus musculus
aaccctttcagatctcgctgcctac

SEQ ID NO: 161703 - DNA, 25 bp, Mus musculus
aaccctttcagccgttaaccacatc

SEQ ID NO: 161704 - DNA, 25 bp, Mus musculus
aaccgaaaccgcaggcttatgatgg

SEQ ID NO: 161705 - DNA, 25 bp, Mus musculus
aaccgaagagatacttggagatgaa

SEQ ID NO: 161706 - DNA, 25 bp, Mus musculus
aaccgaatcacagctgccttcacca

SEQ ID NO: 161707 - DNA, 25 bp, Mus musculus
aaccgaatcgccatctatgagaaaa

SEQ ID NO: 161708 - DNA, 25 bp, Mus musculus
aaccgaatggacagggtaaagaagg

SEQ ID NO: 161709 - DNA, 25 bp, Mus musculus
aaccgacccccaggctcaacagtgt

SEQ ID NO: 161710 - DNA, 25 bp, Mus musculus
aaccgacctgagacttcattgaacc

SEQ ID NO: 161711 - DNA, 25 bp, Mus musculus
aaccgacctgagcaagaaattatca

SEQ ID NO: 161712 - DNA, 25 bp, Mus musculus
aaccgactcaataaggtcactcttc

SEQ ID NO: 161713 - DNA, 25 bp, Mus musculus
aaccgacttaaaacttcaggttgtg

SEQ ID NO: 161714 - DNA, 25 bp, Mus musculus
aaccgagaccagatcatcttcatgg

SEQ ID NO: 161715 - DNA, 25 bp, Mus musculus
aaccgaggaaggtccatgcgaagtg

SEQ ID NO: 161716 - DNA, 25 bp, Mus musculus
aaccgagtcacacgataagcccctg

SEQ ID NO: 161717 - DNA, 25 bp, Mus musculus
aaccgagtcatttaaggctgcaagc

SEQ ID NO: 161718 - DNA, 25 bp, Mus musculus
aaccgatcagtatatacacttctga

SEQ ID NO: 161719 - DNA, 25 bp, Mus musculus
aaccgatccagagaaggcctactca

SEQ ID NO: 161720 - DNA, 25 bp, Mus musculus
aaccgatccagtggaagaggcagag

SEQ ID NO: 161721 - DNA, 25 bp, Mus musculus
aaccgatctagaatacctgaagaaa

SEQ ID NO: 161722 - DNA, 25 bp, Mus musculus
aaccgcaagaaggaggaacaagaat

SEQ ID NO: 161723 - DNA, 25 bp, Mus musculus
aaccgcaagaaggaggttatgaatg

SEQ ID NO: 161724 - DNA, 25 bp, Mus musculus
aaccgcacggccttcaacactgacc

SEQ ID NO: 161725 - DNA, 25 bp, Mus musculus
aaccgcagacaagggttctccagac

SEQ ID NO: 161726 - DNA, 25 bp, Mus musculus
aaccgcagagaggaactggcccaaa

SEQ ID NO: 161727 - DNA, 25 bp, Mus musculus
aaccgcatccaggtcttggataaat

SEQ ID NO: 161728 - DNA, 25 bp, Mus musculus
aaccgcatccaggttaaacgctccc

SEQ ID NO: 161729 - DNA, 25 bp, Mus musculus
aaccgcatggaccagctccatttct

SEQ ID NO: 161730 - DNA, 25 bp, Mus musculus
aaccgccaaagccgagggttgatgc

SEQ ID NO: 161731 - DNA, 25 bp, Mus musculus
aaccgccaaaggctttctcctgggc

SEQ ID NO: 161732 - DNA, 25 bp, Mus musculus
aaccgccagattgggcctgtcccag

SEQ ID NO: 161733 - DNA, 25 bp, Mus musculus
aaccgcccagcggtcagagtacacc

SEQ ID NO: 161734 - DNA, 25 bp, Mus musculus
aaccgcccagggttcgctgatcacc

SEQ ID NO: 161735 - DNA, 25 bp, Mus musculus
aaccgcccaggtgctttttgaagaa

SEQ ID NO: 161736 - DNA, 25 bp, Mus musculus
aaccgccgatcggagaatgtcgtgt

SEQ ID NO: 161737 - DNA, 25 bp, Mus musculus
aaccgcctcactggaatcccagctg

SEQ ID NO: 161738 - DNA, 25 bp, Mus musculus
aaccgcctgaggcacagaccccaca

SEQ ID NO: 161739 - DNA, 25 bp, Mus musculus
aaccgcctgagtcaaatcagaaaat

SEQ ID NO: 161740 - DNA, 25 bp, Mus musculus
aaccgcctggctgaagagagggccc

SEQ ID NO: 161741 - DNA, 25 bp, Mus musculus
aaccgcgagtctactcggaaaaaga

SEQ ID NO: 161742 - DNA, 25 bp, Mus musculus
aaccgcgagtctactgtctgccaaa

SEQ ID NO: 161743 - DNA, 25 bp, Mus musculus
aaccgcgccatggtctgccaggaac

SEQ ID NO: 161744 - DNA, 25 bp, Mus musculus
aaccgcgccatgtgatctcagcgcc

SEQ ID NO: 161745 - DNA, 25 bp, Mus musculus
aaccgcggttacagggcatctgact

SEQ ID NO: 161746 - DNA, 25 bp, Mus musculus
aaccgctatggcaacgtgatcgcct

SEQ ID NO: 161747 - DNA, 25 bp, Mus musculus
aaccgctcagaacagcatcccctac

SEQ ID NO: 161748 - DNA, 25 bp, Mus musculus
aaccgctcagaacaggtcttcacat

SEQ ID NO: 161749 - DNA, 25 bp, Mus musculus
aaccgctcaggtagtagtctggaag

SEQ ID NO: 161750 - DNA, 25 bp, Mus musculus
aaccgctcagttcatctcaaagaag

SEQ ID NO: 161751 - DNA, 25 bp, Mus musculus
aaccgcttcgagaagaatttccgtg

SEQ ID NO: 161752 - DNA, 25 bp, Mus musculus
aaccgcttcgagaaggtgccgacaa

SEQ ID NO: 161753 - DNA, 25 bp, Mus musculus
aaccgctttaacttggggtgagtca

SEQ ID NO: 161754 - DNA, 25 bp, Mus musculus
aaccggacactcagacaggaccccg

SEQ ID NO: 161755 - DNA, 25 bp, Mus musculus
aaccggacactcagcctgcagcctg

SEQ ID NO: 161756 - DNA, 25 bp, Mus musculus
aaccggagcacgggattcgagttct

SEQ ID NO: 161757 - DNA, 25 bp, Mus musculus
aaccggcagaagagcctagattcag

SEQ ID NO: 161758 - DNA, 25 bp, Mus musculus
aaccggcagaagcttcaaactctcc

SEQ ID NO: 161759 - DNA, 25 bp, Mus musculus
aaccggcagtggcgccgtccagagg

SEQ ID NO: 161760 - DNA, 25 bp, Mus musculus
aaccggcattgatgtccagctcgcc

SEQ ID NO: 161761 - DNA, 25 bp, Mus musculus
aaccggccaccagccccttcacaga

SEQ ID NO: 161762 - DNA, 25 bp, Mus musculus
aaccggccaccaggttatcctacac

SEQ ID NO: 161763 - DNA, 25 bp, Mus musculus
aaccggccagctgcttgacatctag

SEQ ID NO: 161764 - DNA, 25 bp, Mus musculus
aaccggccagctgtctcctgaagga

SEQ ID NO: 161765 - DNA, 25 bp, Mus musculus
aaccggcccagcaatggcaattggc

SEQ ID NO: 161766 - DNA, 25 bp, Mus musculus
aaccggcttaatcgtgattttgctc

SEQ ID NO: 161767 - DNA, 25 bp, Mus musculus
aaccggcttaatggtgattttgctc

SEQ ID NO: 161768 - DNA, 25 bp, Mus musculus
aaccgggacctgacgtgtgctgtga

SEQ ID NO: 161769 - DNA, 25 bp, Mus musculus
aaccgggcagctgcccacggagcag

SEQ ID NO: 161770 - DNA, 25 bp, Mus musculus
aaccgggcggcagtgccatggcaga

SEQ ID NO: 161771 - DNA, 25 bp, Mus musculus
aaccggtcaacaatgcatattcctg

SEQ ID NO: 161772 - DNA, 25 bp, Mus musculus
aaccggttcactgctcttccgaatc

SEQ ID NO: 161773 - DNA, 25 bp, Mus musculus
aaccggtttgccaagggtatgtcgg

SEQ ID NO: 161774 - DNA, 25 bp, Mus musculus
aaccggtttgtatgaactccagttc

SEQ ID NO: 161775 - DNA, 25 bp, Mus musculus
aaccgtacctggtctgacagagaca

SEQ ID NO: 161776 - DNA, 25 bp, Mus musculus
aaccgtaggcctgtagctccctact

SEQ ID NO: 161777 - DNA, 25 bp, Mus musculus
aaccgtaggtgtggctatttcaatg

SEQ ID NO: 161778 - DNA, 25 bp, Mus musculus
aaccgtcaaggtcacggtctcggtc

SEQ ID NO: 161779 - DNA, 25 bp, Mus musculus
aaccgtcacaaaccacttccattga

SEQ ID NO: 161780 - DNA, 25 bp, Mus musculus
aaccgtccagttggttctgaccaga

SEQ ID NO: 161781 - DNA, 25 bp, Mus musculus
aaccgtcggcgagctgaagcgctgc

SEQ ID NO: 161782 - DNA, 25 bp, Mus musculus
aaccgtgacattgccctcccctttt

SEQ ID NO: 161783 - DNA, 25 bp, Mus musculus
aaccgtgcaggactagcctgagagg

SEQ ID NO: 161784 - DNA, 25 bp, Mus musculus
aaccgtgcgcgcagggtttcactta

SEQ ID NO: 161785 - DNA, 25 bp, Mus musculus
aaccgtgcgcgcaggtacagcgcag

SEQ ID NO: 161786 - DNA, 25 bp, Mus musculus
aaccgtgtgtgtctgctgctgacaa

SEQ ID NO: 161787 - DNA, 25 bp, Mus musculus
aacctaaaccagcagaaaaaattca

SEQ ID NO: 161788 - DNA, 25 bp, Mus musculus
aacctaaaccagcaggaatccatca

SEQ ID NO: 161789 - DNA, 25 bp, Mus musculus
aacctaaagaagcatgtcatttgct

SEQ ID NO: 161790 - DNA, 25 bp, Mus musculus
aacctaaatggggggatcgcagccg

SEQ ID NO: 161791 - DNA, 25 bp, Mus musculus
aacctaaatggtggagccactttgg

SEQ ID NO: 161792 - DNA, 25 bp, Mus musculus
aacctaacactaaggatcatggata

SEQ ID NO: 161793 - DNA, 25 bp, Mus musculus
aacctaacagcaaatgggaagtaaa

SEQ ID NO: 161794 - DNA, 25 bp, Mus musculus
aacctaacggcctatggtgatgaag

SEQ ID NO: 161795 - DNA, 25 bp, Mus musculus
aacctaacggcctgatgggagccag

SEQ ID NO: 161796 - DNA, 25 bp, Mus musculus
aacctaagccagcaggcctcagggc

SEQ ID NO: 161797 - DNA, 25 bp, Mus musculus
aacctaagccagcagggcctgggct

SEQ ID NO: 161798 - DNA, 25 bp, Mus musculus
aacctaagcttccagagcagaacat

SEQ ID NO: 161799 - DNA, 25 bp, Mus musculus
aacctaaggaagatcctgtctctac

SEQ ID NO: 161800 - DNA, 25 bp, Mus musculus
aacctacaagctaccacatttgaag

SEQ ID NO: 161801 - DNA, 25 bp, Mus musculus
aacctacaagttgttatccgatgca

SEQ ID NO: 161802 - DNA, 25 bp, Mus musculus
aacctacacagcgtacggcatgtcg

SEQ ID NO: 161803 - DNA, 25 bp, Mus musculus
aacctacatctgataaggaaggaaa

SEQ ID NO: 161804 - DNA, 25 bp, Mus musculus
aacctaccaggagcctgccaccacc

SEQ ID NO: 161805 - DNA, 25 bp, Mus musculus
aacctaccggctgagcatggtggct

SEQ ID NO: 161806 - DNA, 25 bp, Mus musculus
aacctactttacatgctcttcctca

SEQ ID NO: 161807 - DNA, 25 bp, Mus musculus
aacctagaagaagaggaatgggtac

SEQ ID NO: 161808 - DNA, 25 bp, Mus musculus
aacctagaaggaaggtatcatgcca

SEQ ID NO: 161809 - DNA, 25 bp, Mus musculus
aacctagagaagaagcgagatgagc

SEQ ID NO: 161810 - DNA, 25 bp, Mus musculus
aacctagagaagcgagatgagcgca

SEQ ID NO: 161811 - DNA, 25 bp, Mus musculus
aacctagagcgggtgactgagatac

SEQ ID NO: 161812 - DNA, 25 bp, Mus musculus
aacctagataagaaggacttcctag

SEQ ID NO: 161813 - DNA, 25 bp, Mus musculus
aacctagcagaagcgctcctggagc

SEQ ID NO: 161814 - DNA, 25 bp, Mus musculus
aacctagccaagtgcattgttggtg

SEQ ID NO: 161815 - DNA, 25 bp, Mus musculus
aacctagccgctgtggtgactgggc

SEQ ID NO: 161816 - DNA, 25 bp, Mus musculus
aacctagcctcccgttgttctacac

SEQ ID NO: 161817 - DNA, 25 bp, Mus musculus
aacctagctacagaactgtgccgga

SEQ ID NO: 161818 - DNA, 25 bp, Mus musculus
aacctaggatagagattgttgtggt

SEQ ID NO: 161819 - DNA, 25 bp, Mus musculus
aacctagttgctgccttgcgctggc

SEQ ID NO: 161820 - DNA, 25 bp, Mus musculus
aacctatgaagggctgcaattttga

SEQ ID NO: 161821 - DNA, 25 bp, Mus musculus
aacctatggggcctcagactcatcc

SEQ ID NO: 161822 - DNA, 25 bp, Mus musculus
aacctattttggaagagcagtcagt

SEQ ID NO: 161823 - DNA, 25 bp, Mus musculus
aacctattttggttgataatccctc

SEQ ID NO: 161824 - DNA, 25 bp, Mus musculus
aacctcaaagcctctccgaccagtc

SEQ ID NO: 161825 - DNA, 25 bp, Mus musculus
aacctcaaataaagaagatacatta

SEQ ID NO: 161826 - DNA, 25 bp, Mus musculus
aacctcaacaccaagatgataccct

SEQ ID NO: 161827 - DNA, 25 bp, Mus musculus
aacctcaacgtcatcctggccagat

SEQ ID NO: 161828 - DNA, 25 bp, Mus musculus
aacctcaactgtgtgtgcaacagaa

SEQ ID NO: 161829 - DNA, 25 bp, Mus musculus
aacctcaagaacaagctcggaagtg

SEQ ID NO: 161830 - DNA, 25 bp, Mus musculus
aacctcaagggctgtgaggtggtcc

SEQ ID NO: 161831 - DNA, 25 bp, Mus musculus
aacctcacacaggtggctgtgggca

SEQ ID NO: 161832 - DNA, 25 bp, Mus musculus
aacctcacacagtacagatctcaag

SEQ ID NO: 161833 - DNA, 25 bp, Mus musculus
aacctcaccaaaggctattcggaaa

SEQ ID NO: 161834 - DNA, 25 bp, Mus musculus
aacctcaccaagtaccgggaagcta

SEQ ID NO: 161835 - DNA, 25 bp, Mus musculus
aacctcaccagcatgtccaaaattc

SEQ ID NO: 161836 - DNA, 25 bp, Mus musculus
aacctcagaaacagaacttacacat

SEQ ID NO: 161837 - DNA, 25 bp, Mus musculus
aacctcagaaacatcattcaagact

SEQ ID NO: 161838 - DNA, 25 bp, Mus musculus
aacctcagaaaggagattaacaagt

SEQ ID NO: 161839 - DNA, 25 bp, Mus musculus
aacctcagaaaggaggcatcatagc

SEQ ID NO: 161840 - DNA, 25 bp, Mus musculus
aacctcagacgacaatttccaagga

SEQ ID NO: 161841 - DNA, 25 bp, Mus musculus
aacctcagcaaagccagtggccgca

SEQ ID NO: 161842 - DNA, 25 bp, Mus musculus
aacctcagcacttttctgtacttcc

SEQ ID NO: 161843 - DNA, 25 bp, Mus musculus
aacctcagcatcatgatccaggacc

SEQ ID NO: 161844 - DNA, 25 bp, Mus musculus
aacctcataaaggttgacctatcaa

SEQ ID NO: 161845 - DNA, 25 bp, Mus musculus
aacctcatcgccatcgacctggaac

SEQ ID NO: 161846 - DNA, 25 bp, Mus musculus
aacctcatctctgatcgctggggtg

SEQ ID NO: 161847 - DNA, 25 bp, Mus musculus
aacctcatctctgtgatgggtcact

SEQ ID NO: 161848 - DNA, 25 bp, Mus musculus
aacctcatcttctggggggcagctg

SEQ ID NO: 161849 - DNA, 25 bp, Mus musculus
aacctcatcttgtacttgttgactg

SEQ ID NO: 161850 - DNA, 25 bp, Mus musculus
aacctccaaagatggaaaagccgaa

SEQ ID NO: 161851 - DNA, 25 bp, Mus musculus
aacctccaaagctcatttttccaaa

SEQ ID NO: 161852 - DNA, 25 bp, Mus musculus
aacctccaaaggacacaccagccat

SEQ ID NO: 161853 - DNA, 25 bp, Mus musculus
aacctccaagcctgaagggcacgag

SEQ ID NO: 161854 - DNA, 25 bp, Mus musculus
aacctccaaggagtgtctaaaacct

SEQ ID NO: 161855 - DNA, 25 bp, Mus musculus
aacctccacgctgaatgaaaagtcc

SEQ ID NO: 161856 - DNA, 25 bp, Mus musculus
aacctccaggaggagatctcagacc

SEQ ID NO: 161857 - DNA, 25 bp, Mus musculus
aacctccaggccacaatcggctatc

SEQ ID NO: 161858 - DNA, 25 bp, Mus musculus
aacctcccaagactcctacaggaaa

SEQ ID NO: 161859 - DNA, 25 bp, Mus musculus
aacctcccagaactccgaggtgact

SEQ ID NO: 161860 - DNA, 25 bp, Mus musculus
aacctcccatcagcaagccccgccc

SEQ ID NO: 161861 - DNA, 25 bp, Mus musculus
aacctcccatcatttgaggctcttt

SEQ ID NO: 161862 - DNA, 25 bp, Mus musculus
aacctccccttcaggccagaaggtt

SEQ ID NO: 161863 - DNA, 25 bp, Mus musculus
aacctcccgagcaggcagcaaacag

SEQ ID NO: 161864 - DNA, 25 bp, Mus musculus
aacctcccttgtggtgtgaacattg

SEQ ID NO: 161865 - DNA, 25 bp, Mus musculus
aacctccgaacctgattcacagatg

SEQ ID NO: 161866 - DNA, 25 bp, Mus musculus
aacctccgcaagaatggaatcatca

SEQ ID NO: 161867 - DNA, 25 bp, Mus musculus
aacctccggtaaagtgacaaaacat

SEQ ID NO: 161868 - DNA, 25 bp, Mus musculus
aacctccgtgaaaaccaggcgacta

SEQ ID NO: 161869 - DNA, 25 bp, Mus musculus
aacctcctaggaaagctgtagagga

SEQ ID NO: 161870 - DNA, 25 bp, Mus musculus
aacctcctaggaataggtgaaggga

SEQ ID NO: 161871 - DNA, 25 bp, Mus musculus
aacctcgtgaggactctcattagac

SEQ ID NO: 161872 - DNA, 25 bp, Mus musculus
aacctcgtgagttacaggactctca

SEQ ID NO: 161873 - DNA, 25 bp, Mus musculus
aacctctaaaaagaggttgtggatg

SEQ ID NO: 161874 - DNA, 25 bp, Mus musculus
aacctctaaaatggtgcacctccgc

SEQ ID NO: 161875 - DNA, 25 bp, Mus musculus
aacctctaacaccgcaagccccgcc

SEQ ID NO: 161876 - DNA, 25 bp, Mus musculus
aacctctcaacctgtctgcaaacag

SEQ ID NO: 161877 - DNA, 25 bp, Mus musculus
aacctctcaagaaagatgcgccagg

SEQ ID NO: 161878 - DNA, 25 bp, Mus musculus
aacctctcaagaaaggacagatcgt

SEQ ID NO: 161879 - DNA, 25 bp, Mus musculus
aacctctcacagatgaatcagcaga

SEQ ID NO: 161880 - DNA, 25 bp, Mus musculus
aacctctcagtgaaaactgaaccga

SEQ ID NO: 161881 - DNA, 25 bp, Mus musculus
aacctctccacgtgctttagctctg

SEQ ID NO: 161882 - DNA, 25 bp, Mus musculus
aacctctcccaatcctgtgatagtc

SEQ ID NO: 161883 - DNA, 25 bp, Mus musculus
aacctctcccagctccctggctgag

SEQ ID NO: 161884 - DNA, 25 bp, Mus musculus
aacctctcccaggtgtgtgacggga

SEQ ID NO: 161885 - DNA, 25 bp, Mus musculus
aacctctccggctggatgagcctgc

SEQ ID NO: 161886 - DNA, 25 bp, Mus musculus
aacctctctgcccactcagccagtt

SEQ ID NO: 161887 - DNA, 25 bp, Mus musculus
aacctctgaaactataattttattc

SEQ ID NO: 161888 - DNA, 25 bp, Mus musculus
aacctctgaaactgaactttctaag

SEQ ID NO: 161889 - DNA, 25 bp, Mus musculus
aacctctgaacctaacacagaagaa

SEQ ID NO: 161890 - DNA, 25 bp, Mus musculus
aacctctgaacctacactttcctga

SEQ ID NO: 161891 - DNA, 25 bp, Mus musculus
aacctctgaacctagtgctacaata

SEQ ID NO: 161892 - DNA, 25 bp, Mus musculus
aacctctgaacctataattttattc

SEQ ID NO: 161893 - DNA, 25 bp, Mus musculus
aacctctgaacctatactttggcaa

SEQ ID NO: 161894 - DNA, 25 bp, Mus musculus
aacctctgaacctcatagttttggg

SEQ ID NO: 161895 - DNA, 25 bp, Mus musculus
aacctctgaacctccaccactggtc

SEQ ID NO: 161896 - DNA, 25 bp, Mus musculus
aacctctgaacctctccttcttcta

SEQ ID NO: 161897 - DNA, 25 bp, Mus musculus
aacctctgaacctgacagagatttc

SEQ ID NO: 161898 - DNA, 25 bp, Mus musculus
aacctctgaacctgacccagaagct

SEQ ID NO: 161899 - DNA, 25 bp, Mus musculus
aacctctgaacctgctccgccccca

SEQ ID NO: 161900 - DNA, 25 bp, Mus musculus
aacctctgaacctgtggatattgtc

SEQ ID NO: 161901 - DNA, 25 bp, Mus musculus
aacctctgaactatgcctgtgtctt

SEQ ID NO: 161902 - DNA, 25 bp, Mus musculus
aacctctgaacttgtggcagggctg

SEQ ID NO: 161903 - DNA, 25 bp, Mus musculus
aacctctgaagagttacatgctgca

SEQ ID NO: 161904 - DNA, 25 bp, Mus musculus
aacctctgaggacagaacttatttg

SEQ ID NO: 161905 - DNA, 25 bp, Mus musculus
aacctctgattgcagttccaactac

SEQ ID NO: 161906 - DNA, 25 bp, Mus musculus
aacctctgcaaggtttgtctgggca

SEQ ID NO: 161907 - DNA, 25 bp, Mus musculus
aacctctgcagcttgcactgaggcc

SEQ ID NO: 161908 - DNA, 25 bp, Mus musculus
aacctctgcggcggtatctgacctc

SEQ ID NO: 161909 - DNA, 25 bp, Mus musculus
aacctctgcgtacagatgtggagat

SEQ ID NO: 161910 - DNA, 25 bp, Mus musculus
aacctctggaaacagaaaggacttc

SEQ ID NO: 161911 - DNA, 25 bp, Mus musculus
aacctctgggaggatgttggatgga

SEQ ID NO: 161912 - DNA, 25 bp, Mus musculus
aacctctgggtgaagggagcagtag

SEQ ID NO: 161913 - DNA, 25 bp, Mus musculus
aacctctgtcacatgggaccatctg

SEQ ID NO: 161914 - DNA, 25 bp, Mus musculus
aacctctgtctacccttatgagcta

SEQ ID NO: 161915 - DNA, 25 bp, Mus musculus
aacctcttcaatgaggggaagcgct

SEQ ID NO: 161916 - DNA, 25 bp, Mus musculus
aacctcttcaggcccgcactttgcg

SEQ ID NO: 161917 - DNA, 25 bp, Mus musculus
aacctcttcttctttgtactaggcg

SEQ ID NO: 161918 - DNA, 25 bp, Mus musculus
aacctcttgacctggaagggaacat

SEQ ID NO: 161919 - DNA, 25 bp, Mus musculus
aacctgaaaacattattatgttagt

SEQ ID NO: 161920 - DNA, 25 bp, Mus musculus
aacctgaaaaggacaagaagatgcc

SEQ ID NO: 161921 - DNA, 25 bp, Mus musculus
aacctgaaagattttgatagactgc

SEQ ID NO: 161922 - DNA, 25 bp, Mus musculus
aacctgaaatctgcctccaacattg

SEQ ID NO: 161923 - DNA, 25 bp, Mus musculus
aacctgaagaacaaggcagctgcag

SEQ ID NO: 161924 - DNA, 25 bp, Mus musculus
aacctgaagcggtgctcactcctgg

SEQ ID NO: 161925 - DNA, 25 bp, Mus musculus
aacctgaagggcagacaagatgaac

SEQ ID NO: 161926 - DNA, 25 bp, Mus musculus
aacctgaagggcagggacattagtc

SEQ ID NO: 161927 - DNA, 25 bp, Mus musculus
aacctgaagggcaggtttggcatag

SEQ ID NO: 161928 - DNA, 25 bp, Mus musculus
aacctgaatcagggcagcgctgtat

SEQ ID NO: 161929 - DNA, 25 bp, Mus musculus
aacctgaatgaacagcttctaccta

SEQ ID NO: 161930 - DNA, 25 bp, Mus musculus
aacctgagaagcaggctgtgcagct

SEQ ID NO: 161931 - DNA, 25 bp, Mus musculus
aacctgagaagcaggtctgttctcc

SEQ ID NO: 161932 - DNA, 25 bp, Mus musculus
aacctgagaatctgcccgagagcat

SEQ ID NO: 161933 - DNA, 25 bp, Mus musculus
aacctgagcaataagagcggtctca

SEQ ID NO: 161934 - DNA, 25 bp, Mus musculus
aacctgagcacagtgagcatgtttt

SEQ ID NO: 161935 - DNA, 25 bp, Mus musculus
aacctgaggagagagaacctggtcc

SEQ ID NO: 161936 - DNA, 25 bp, Mus musculus
aacctgaggagagagtgttccagaa

SEQ ID NO: 161937 - DNA, 25 bp, Mus musculus
aacctgataagaagattatttccaa

SEQ ID NO: 161938 - DNA, 25 bp, Mus musculus
aacctgatagaagagcttcggaaat

SEQ ID NO: 161939 - DNA, 25 bp, Mus musculus
aacctgatagaagagtggtagatga

SEQ ID NO: 161940 - DNA, 25 bp, Mus musculus
aacctgatgaggagatactggagtg

SEQ ID NO: 161941 - DNA, 25 bp, Mus musculus
aacctgcaaacactgccccccaaac

SEQ ID NO: 161942 - DNA, 25 bp, Mus musculus
aacctgcaaccaagatgagtccttc

SEQ ID NO: 161943 - DNA, 25 bp, Mus musculus
aacctgcaaccaagatttaaacgag

SEQ ID NO: 161944 - DNA, 25 bp, Mus musculus
aacctgcaagctcagatgtatagac

SEQ ID NO: 161945 - DNA, 25 bp, Mus musculus
aacctgcatgccatgatcaaagctg

SEQ ID NO: 161946 - DNA, 25 bp, Mus musculus
aacctgccagatgcagagaagaaaa

SEQ ID NO: 161947 - DNA, 25 bp, Mus musculus
aacctgccaggatatgctctccatt

SEQ ID NO: 161948 - DNA, 25 bp, Mus musculus
aacctgccatgggaaggagatgcgt

SEQ ID NO: 161949 - DNA, 25 bp, Mus musculus
aacctgccatgggagctggactgtg

SEQ ID NO: 161950 - DNA, 25 bp, Mus musculus
aacctgcccaaacgtgtgcccaatt

SEQ ID NO: 161951 - DNA, 25 bp, Mus musculus
aacctgcccaaggagctggagggtg

SEQ ID NO: 161952 - DNA, 25 bp, Mus musculus
aacctgcctatgcaacccccagtcc

SEQ ID NO: 161953 - DNA, 25 bp, Mus musculus
aacctgcctatgcaagactcatttc

SEQ ID NO: 161954 - DNA, 25 bp, Mus musculus
aacctgcgccagcacgcagggattg

SEQ ID NO: 161955 - DNA, 25 bp, Mus musculus
aacctgcgccaggtgaccatctcgg

SEQ ID NO: 161956 - DNA, 25 bp, Mus musculus
aacctgctgaagattcagatattaa

SEQ ID NO: 161957 - DNA, 25 bp, Mus musculus
aacctgctgaagggagcatttccag

SEQ ID NO: 161958 - DNA, 25 bp, Mus musculus
aacctgctgctagcccgggccccat

SEQ ID NO: 161959 - DNA, 25 bp, Mus musculus
aacctgctgctagccctgctcttgg

SEQ ID NO: 161960 - DNA, 25 bp, Mus musculus
aacctgctgtataccctggtcagcc

SEQ ID NO: 161961 - DNA, 25 bp, Mus musculus
aacctgctgtataccggtcagctgc

SEQ ID NO: 161962 - DNA, 25 bp, Mus musculus
aacctgctgttctggctagccggat

SEQ ID NO: 161963 - DNA, 25 bp, Mus musculus
aacctggaaaacactggccaaaaga

SEQ ID NO: 161964 - DNA, 25 bp, Mus musculus
aacctggaaagttaggaagaagagc

SEQ ID NO: 161965 - DNA, 25 bp, Mus musculus
aacctggaagacctggataactgga

SEQ ID NO: 161966 - DNA, 25 bp, Mus musculus
aacctggacaagcctggacaaacta

SEQ ID NO: 161967 - DNA, 25 bp, Mus musculus
aacctggaccaatgggtcctcttgg

SEQ ID NO: 161968 - DNA, 25 bp, Mus musculus
aacctggacctagaggcctttatcc

SEQ ID NO: 161969 - DNA, 25 bp, Mus musculus
aacctggacgagagggcagccctgg

SEQ ID NO: 161970 - DNA, 25 bp, Mus musculus
aacctggagggaaaagcagttcaat

SEQ ID NO: 161971 - DNA, 25 bp, Mus musculus
aacctggatgaaagtgaggcagcag

SEQ ID NO: 161972 - DNA, 25 bp, Mus musculus
aacctggcagaggaaaactccaggg

SEQ ID NO: 161973 - DNA, 25 bp, Mus musculus
aacctggcgcccaatgaaccagaat

SEQ ID NO: 161974 - DNA, 25 bp, Mus musculus
aacctggcgcggcactcctagaaca

SEQ ID NO: 161975 - DNA, 25 bp, Mus musculus
aacctggctacaaggctgagggaaa

SEQ ID NO: 161976 - DNA, 25 bp, Mus musculus
aacctggctacaagggatgggcata

SEQ ID NO: 161977 - DNA, 25 bp, Mus musculus
aacctggctgtgggtggtgagaagc

SEQ ID NO: 161978 - DNA, 25 bp, Mus musculus
aacctggctgttgctcgtcttgggg

SEQ ID NO: 161979 - DNA, 25 bp, Mus musculus
aacctgggatagaagggcttcttgg

SEQ ID NO: 161980 - DNA, 25 bp, Mus musculus
aacctgggcaggagctcggggagac

SEQ ID NO: 161981 - DNA, 25 bp, Mus musculus
aacctgggccagaaggtccggctgg

SEQ ID NO: 161982 - DNA, 25 bp, Mus musculus
aacctgggctctgtgggggcagctg

SEQ ID NO: 161983 - DNA, 25 bp, Mus musculus
aacctgggctttgctgggacccatg

SEQ ID NO: 161984 - DNA, 25 bp, Mus musculus
aacctgggggcagccgaggaagtgg

SEQ ID NO: 161985 - DNA, 25 bp, Mus musculus
aacctggtaaagtggttcatcggaa

SEQ ID NO: 161986 - DNA, 25 bp, Mus musculus
aacctggtctacaaagtggatccca

SEQ ID NO: 161987 - DNA, 25 bp, Mus musculus
aacctggtgacgacggtgaagctgg

SEQ ID NO: 161988 - DNA, 25 bp, Mus musculus
aacctggttggcaaagtgatcggaa

SEQ ID NO: 161989 - DNA, 25 bp, Mus musculus
aacctgtaagtgctgtgacccaatt

SEQ ID NO: 161990 - DNA, 25 bp, Mus musculus
aacctgtaagttcacttgttcaaag

SEQ ID NO: 161991 - DNA, 25 bp, Mus musculus
aacctgtatagaagtgggaagatgc

SEQ ID NO: 161992 - DNA, 25 bp, Mus musculus
aacctgtcaaaccagggttctctaa

SEQ ID NO: 161993 - DNA, 25 bp, Mus musculus
aacctgtcaaaccaggttaaggagc

SEQ ID NO: 161994 - DNA, 25 bp, Mus musculus
aacctgtcaggaccaccaatgaatg

SEQ ID NO: 161995 - DNA, 25 bp, Mus musculus
aacctgtcaggatataaatgaatgt

SEQ ID NO: 161996 - DNA, 25 bp, Mus musculus
aacctgtcaggtgactcaagtgcaa

SEQ ID NO: 161997 - DNA, 25 bp, Mus musculus
aacctgtcaggtgactccaatgaag

SEQ ID NO: 161998 - DNA, 25 bp, Mus musculus
aacctgtccgggcagccaaggagat

SEQ ID NO: 161999 - DNA, 25 bp, Mus musculus
aacctgtcttaagaccttcacagcc

SEQ ID NO: 162000 - DNA, 25 bp, Mus musculus
aacctgtgaaaagagtggacaagat

SEQ ID NO: 162001 - DNA, 25 bp, Mus musculus
aacctgtgaggtcatgcacttctga

SEQ ID NO: 162002 - DNA, 25 bp, Mus musculus
aacctgtgtctaaggaaacagcaag

SEQ ID NO: 162003 - DNA, 25 bp, Mus musculus
aacctgtgtctaagtgtctgtgctt

SEQ ID NO: 162004 - DNA, 25 bp, Mus musculus
aacctgtgtgtagccccatgtggaa

SEQ ID NO: 162005 - DNA, 25 bp, Mus musculus
aacctgtgttctgatatagatgagt

SEQ ID NO: 162006 - DNA, 25 bp, Mus musculus
aacctgttacgcttgtacttcatcc

SEQ ID NO: 162007 - DNA, 25 bp, Mus musculus
aacctgttggagagaagacacagtt

SEQ ID NO: 162008 - DNA, 25 bp, Mus musculus
aacctgttgttctgaggactctcat

SEQ ID NO: 162009 - DNA, 25 bp, Mus musculus
aacctgttgttctggattccaccca

SEQ ID NO: 162010 - DNA, 25 bp, Mus musculus
aaccttaaaagaatgctgatgctgt

SEQ ID NO: 162011 - DNA, 25 bp, Mus musculus
aaccttaaagacgatgaacgtgtcg

SEQ ID NO: 162012 - DNA, 25 bp, Mus musculus
aaccttaagaccagagtagcttatc

SEQ ID NO: 162013 - DNA, 25 bp, Mus musculus
aaccttacagctcaccaacaagaag

SEQ ID NO: 162014 - DNA, 25 bp, Mus musculus
aaccttacagctcacgaaatggaga

SEQ ID NO: 162015 - DNA, 25 bp, Mus musculus
aaccttacagctcagcaacaagaag

SEQ ID NO: 162016 - DNA, 25 bp, Mus musculus
aaccttacagctcaggaaatggaga

SEQ ID NO: 162017 - DNA, 25 bp, Mus musculus
aaccttacataaactatactatgca

SEQ ID NO: 162018 - DNA, 25 bp, Mus musculus
aaccttattttacagtgaaaatgtg

SEQ ID NO: 162019 - DNA, 25 bp, Mus musculus
aaccttcaactacagccttacctgc

SEQ ID NO: 162020 - DNA, 25 bp, Mus musculus
aaccttcatgaaaggaatacagatg

SEQ ID NO: 162021 - DNA, 25 bp, Mus musculus
aaccttcatgaaagttccgacgaga

SEQ ID NO: 162022 - DNA, 25 bp, Mus musculus
aaccttccaacaagacgatccacgc

SEQ ID NO: 162023 - DNA, 25 bp, Mus musculus
aaccttccagggctcactgatcacc

SEQ ID NO: 162024 - DNA, 25 bp, Mus musculus
aaccttcccaggaaactccatggaa

SEQ ID NO: 162025 - DNA, 25 bp, Mus musculus
aaccttcccaggcacatctccctaa

SEQ ID NO: 162026 - DNA, 25 bp, Mus musculus
aaccttccccttgtgctttgatgac

SEQ ID NO: 162027 - DNA, 25 bp, Mus musculus
aaccttccccttgtgctttggtctc

SEQ ID NO: 162028 - DNA, 25 bp, Mus musculus
aaccttccctggcacagcaagcttc

SEQ ID NO: 162029 - DNA, 25 bp, Mus musculus
aaccttcctgacctgggcggccctc

SEQ ID NO: 162030 - DNA, 25 bp, Mus musculus
aaccttcctgagtgagctcattgcc

SEQ ID NO: 162031 - DNA, 25 bp, Mus musculus
aaccttcctggggtctgtgatgtga

SEQ ID NO: 162032 - DNA, 25 bp, Mus musculus
aaccttcgaggcgtggtgcaagatt

SEQ ID NO: 162033 - DNA, 25 bp, Mus musculus
aaccttctagaagctcttctgtgcc

SEQ ID NO: 162034 - DNA, 25 bp, Mus musculus
aaccttctgttgccttgaagtttgc

SEQ ID NO: 162035 - DNA, 25 bp, Mus musculus
aaccttgaaccagaatgtctgtaag

SEQ ID NO: 162036 - DNA, 25 bp, Mus musculus
aaccttgagaggcttatacccctag

SEQ ID NO: 162037 - DNA, 25 bp, Mus musculus
aaccttgatcaggatcttcccaaca

SEQ ID NO: 162038 - DNA, 25 bp, Mus musculus
aaccttgcaccaagaagttaagtgt

SEQ ID NO: 162039 - DNA, 25 bp, Mus musculus
aaccttgcaggccctgtggttctca

SEQ ID NO: 162040 - DNA, 25 bp, Mus musculus
aaccttgctggcaccatcggtttca

SEQ ID NO: 162041 - DNA, 25 bp, Mus musculus
aaccttggctgggggatgggctctt

SEQ ID NO: 162042 - DNA, 25 bp, Mus musculus
aaccttgtggaactgtaccttcact

SEQ ID NO: 162043 - DNA, 25 bp, Mus musculus
aaccttgtggagatgggcagcagtg

SEQ ID NO: 162044 - DNA, 25 bp, Mus musculus
aacctttccagtatactcctgatca

SEQ ID NO: 162045 - DNA, 25 bp, Mus musculus
aacctttctaaacagggaacagcag

SEQ ID NO: 162046 - DNA, 25 bp, Mus musculus
aacctttctagatgatttaagccag

SEQ ID NO: 162047 - DNA, 25 bp, Mus musculus
aacctttctcataggtggaattggg

SEQ ID NO: 162048 - DNA, 25 bp, Mus musculus
aacctttgaatggtaaccaatggag

SEQ ID NO: 162049 - DNA, 25 bp, Mus musculus
aacctttgacctgggaattcctcaa

SEQ ID NO: 162050 - DNA, 25 bp, Mus musculus
aacctttgaggtctcagagcttttc

SEQ ID NO: 162051 - DNA, 25 bp, Mus musculus
aacctttgagttcctcatgaaggtc

SEQ ID NO: 162052 - DNA, 25 bp, Mus musculus
aacctttggtgctttacatggtgag

SEQ ID NO: 162053 - DNA, 25 bp, Mus musculus
aacctttgtggcagtcttcccaggc

SEQ ID NO: 162054 - DNA, 25 bp, Mus musculus
aacctttgtggcagtctttcagcca

SEQ ID NO: 162055 - DNA, 25 bp, Mus musculus
aaccttttctctaggcaagaatcaa

SEQ ID NO: 162056 - DNA, 25 bp, Mus musculus
aaccttttgacaaggtcagggcccg

SEQ ID NO: 162057 - DNA, 25 bp, Mus musculus
aacgaaaactacaagaaatatgtgg

SEQ ID NO: 162058 - DNA, 25 bp, Mus musculus
aacgaaataatttgaagaggacatt

SEQ ID NO: 162059 - DNA, 25 bp, Mus musculus
aacgaaccaaggagaaagaactgag

SEQ ID NO: 162060 - DNA, 25 bp, Mus musculus
aacgaacccaggagttccgactctg

SEQ ID NO: 162061 - DNA, 25 bp, Mus musculus
aacgaaccccaagctttgtgacgac

SEQ ID NO: 162062 - DNA, 25 bp, Mus musculus
aacgaaccccaagggaaccatcagc

SEQ ID NO: 162063 - DNA, 25 bp, Mus musculus
aacgaacctaacagcaaatgggaag

SEQ ID NO: 162064 - DNA, 25 bp, Mus musculus
aacgaacggacaaggagatcagcag

SEQ ID NO: 162065 - DNA, 25 bp, Mus musculus
aacgaagaaagacccaggagagcat

SEQ ID NO: 162066 - DNA, 25 bp, Mus musculus
aacgaagaggcccaggtgcgggcga

SEQ ID NO: 162067 - DNA, 25 bp, Mus musculus
aacgaagatgcctggtacggagtca

SEQ ID NO: 162068 - DNA, 25 bp, Mus musculus
aacgaaggcgagatctgcatcaaag

SEQ ID NO: 162069 - DNA, 25 bp, Mus musculus
aacgaatcacaggattagtcgtatc

SEQ ID NO: 162070 - DNA, 25 bp, Mus musculus
aacgaatcattacagacacacctgc

SEQ ID NO: 162071 - DNA, 25 bp, Mus musculus
aacgaatcattacaggtcctgagat

SEQ ID NO: 162072 - DNA, 25 bp, Mus musculus
aacgaatccttagtggccaataggt

SEQ ID NO: 162073 - DNA, 25 bp, Mus musculus
aacgaatcctttgtcatctacatca

SEQ ID NO: 162074 - DNA, 25 bp, Mus musculus
aacgaatcgaaggcctggacatacg

SEQ ID NO: 162075 - DNA, 25 bp, Mus musculus
aacgaatgtttcctgcaatcctgaa

SEQ ID NO: 162076 - DNA, 25 bp, Mus musculus
aacgaattgtcaagcaataccaaga

SEQ ID NO: 162077 - DNA, 25 bp, Mus musculus
aacgaattttagatgcacagagact

SEQ ID NO: 162078 - DNA, 25 bp, Mus musculus
aacgaattttgttaagagcaggatt

SEQ ID NO: 162079 - DNA, 25 bp, Mus musculus
aacgacaaaactaatatccagggga

SEQ ID NO: 162080 - DNA, 25 bp, Mus musculus
aacgacaaaactgctaacccagtag

SEQ ID NO: 162081 - DNA, 25 bp, Mus musculus
aacgacaaacaaaaagtactacaag

SEQ ID NO: 162082 - DNA, 25 bp, Mus musculus
aacgacaacagcccaaggagctcgg

SEQ ID NO: 162083 - DNA, 25 bp, Mus musculus
aacgacaagttctccaccccctcca

SEQ ID NO: 162084 - DNA, 25 bp, Mus musculus
aacgacacttggacgttcatgaggg

SEQ ID NO: 162085 - DNA, 25 bp, Mus musculus
aacgacagacagctattatctggaa

SEQ ID NO: 162086 - DNA, 25 bp, Mus musculus
aacgacagcagacagaagtgggagc

SEQ ID NO: 162087 - DNA, 25 bp, Mus musculus
aacgacagctgatggttccagcatc

SEQ ID NO: 162088 - DNA, 25 bp, Mus musculus
aacgacatcgaagacatgctccagc

SEQ ID NO: 162089 - DNA, 25 bp, Mus musculus
aacgacattgtgtacctcatccgtt

SEQ ID NO: 162090 - DNA, 25 bp, Mus musculus
aacgaccaagacgcaaatggaactt

SEQ ID NO: 162091 - DNA, 25 bp, Mus musculus
aacgacccaggccagatgaacgatg

SEQ ID NO: 162092 - DNA, 25 bp, Mus musculus
aacgacccccagggagaggcagagt

SEQ ID NO: 162093 - DNA, 25 bp, Mus musculus
aacgacctggccagtaaaagctggc

SEQ ID NO: 162094 - DNA, 25 bp, Mus musculus
aacgacgatagggtccaggtggagt

SEQ ID NO: 162095 - DNA, 25 bp, Mus musculus
aacgacgtaggtcaccccttctctc

SEQ ID NO: 162096 - DNA, 25 bp, Mus musculus
aacgacgtgaaagactggaggccag

SEQ ID NO: 162097 - DNA, 25 bp, Mus musculus
aacgagaaaggtgagatctcaatgg

SEQ ID NO: 162098 - DNA, 25 bp, Mus musculus
aacgagaagccagaaagaaagatca

SEQ ID NO: 162099 - DNA, 25 bp, Mus musculus
aacgagaaggatctggtgaaactag

SEQ ID NO: 162100 - DNA, 25 bp, Mus musculus
aacgagacatgcactccaccacgca

SEQ ID NO: 162101 - DNA, 25 bp, Mus musculus
aacgagacatgcactccgcttacaa

SEQ ID NO: 162102 - DNA, 25 bp, Mus musculus
aacgagactctgcggcactctgtcc

SEQ ID NO: 162103 - DNA, 25 bp, Mus musculus
aacgagagattaggttccaaggagc

SEQ ID NO: 162104 - DNA, 25 bp, Mus musculus
aacgagatccgcagtatgttccgga

SEQ ID NO: 162105 - DNA, 25 bp, Mus musculus
aacgagatccgcagtggtttctctg

SEQ ID NO: 162106 - DNA, 25 bp, Mus musculus
aacgagcaagcttctacatacaaac

SEQ ID NO: 162107 - DNA, 25 bp, Mus musculus
aacgagcagcaagtggtggaatctg

SEQ ID NO: 162108 - DNA, 25 bp, Mus musculus
aacgagccaagttcaagcgcaaata

SEQ ID NO: 162109 - DNA, 25 bp, Mus musculus
aacgagccggtccgtgttcaccttg

SEQ ID NO: 162110 - DNA, 25 bp, Mus musculus
aacgagcggaggaggtcccaggtaa

SEQ ID NO: 162111 - DNA, 25 bp, Mus musculus
aacgagctgcagcaggagttaaaaa

SEQ ID NO: 162112 - DNA, 25 bp, Mus musculus
aacgaggacaaggaaccttacagca

SEQ ID NO: 162113 - DNA, 25 bp, Mus musculus
aacgaggacaagtgccaatgcaaga

SEQ ID NO: 162114 - DNA, 25 bp, Mus musculus
aacgaggaggcaaagatttttatca

SEQ ID NO: 162115 - DNA, 25 bp, Mus musculus
aacgaggcttgaagaaagaacaagt

SEQ ID NO: 162116 - DNA, 25 bp, Mus musculus
aacgagggagctagcaaaatcggaa

SEQ ID NO: 162117 - DNA, 25 bp, Mus musculus
aacgagggagctaggaggccacgca

SEQ ID NO: 162118 - DNA, 25 bp, Mus musculus
aacgaggtcattctgtcagacccgc

SEQ ID NO: 162119 - DNA, 25 bp, Mus musculus
aacgaggtgcactgccaacctaggc

SEQ ID NO: 162120 - DNA, 25 bp, Mus musculus
aacgagtaacctggagtttctgaca

SEQ ID NO: 162121 - DNA, 25 bp, Mus musculus
aacgagtagaagatgaaagtctgga

SEQ ID NO: 162122 - DNA, 25 bp, Mus musculus
aacgagtgcaaggctgatatagaat

SEQ ID NO: 162123 - DNA, 25 bp, Mus musculus
aacgagtgcaaggtttgacttttgc

SEQ ID NO: 162124 - DNA, 25 bp, Mus musculus
aacgagtgcgtccagtatcagcatg

SEQ ID NO: 162125 - DNA, 25 bp, Mus musculus
aacgagtgtagtaggtctgttcctg

SEQ ID NO: 162126 - DNA, 25 bp, Mus musculus
aacgagttagaaaagccatagattg

SEQ ID NO: 162127 - DNA, 25 bp, Mus musculus
aacgagttagaaaagctatagagaa

SEQ ID NO: 162128 - DNA, 25 bp, Mus musculus
aacgatacaagtgaccttattcaat

SEQ ID NO: 162129 - DNA, 25 bp, Mus musculus
aacgataccaacgtggtccactgac

SEQ ID NO: 162130 - DNA, 25 bp, Mus musculus
aacgatatcatgcctctgacagctg

SEQ ID NO: 162131 - DNA, 25 bp, Mus musculus
aacgatatgacgaatgggtgaagac

SEQ ID NO: 162132 - DNA, 25 bp, Mus musculus
aacgatatgacgtgggcgacccagc

SEQ ID NO: 162133 - DNA, 25 bp, Mus musculus
aacgatgaaatcaaggaacaagcaa

SEQ ID NO: 162134 - DNA, 25 bp, Mus musculus
aacgatgaaatcaaggaagactctt

SEQ ID NO: 162135 - DNA, 25 bp, Mus musculus
aacgatgaaatcaaggtaactatgg

SEQ ID NO: 162136 - DNA, 25 bp, Mus musculus
aacgatgacactgcaccatctgtgg

SEQ ID NO: 162137 - DNA, 25 bp, Mus musculus
aacgatgaccccagtgtcctttatt

SEQ ID NO: 162138 - DNA, 25 bp, Mus musculus
aacgatgaggacaatctcctcaact

SEQ ID NO: 162139 - DNA, 25 bp, Mus musculus
aacgatgaggaccaggtggtagtta

SEQ ID NO: 162140 - DNA, 25 bp, Mus musculus
aacgatggtgtgaagaaaagaaagt

SEQ ID NO: 162141 - DNA, 25 bp, Mus musculus
aacgatggtgtgaaggaatcttctg

SEQ ID NO: 162142 - DNA, 25 bp, Mus musculus
aacgattcaagctcttgcttctagt

SEQ ID NO: 162143 - DNA, 25 bp, Mus musculus
aacgattcaaggaggagccccgaac

SEQ ID NO: 162144 - DNA, 25 bp, Mus musculus
aacgattcagaggatcgacgagaat

SEQ ID NO: 162145 - DNA, 25 bp, Mus musculus
aacgattccatacctgtgttgcgtg

SEQ ID NO: 162146 - DNA, 25 bp, Mus musculus
aacgattccatgtatggcatttcaa

SEQ ID NO: 162147 - DNA, 25 bp, Mus musculus
aacgattccattgtgacaccatcac

SEQ ID NO: 162148 - DNA, 25 bp, Mus musculus
aacgatttctgatcgtctgccgtag

SEQ ID NO: 162149 - DNA, 25 bp, Mus musculus
aacgcaaaatagaacaggtagtaga

SEQ ID NO: 162150 - DNA, 25 bp, Mus musculus
aacgcaaagaggtaaatgatctgaa

SEQ ID NO: 162151 - DNA, 25 bp, Mus musculus
aacgcaaagagtaacttgtttgaat

SEQ ID NO: 162152 - DNA, 25 bp, Mus musculus
aacgcaacgtcatccccgctggcat

SEQ ID NO: 162153 - DNA, 25 bp, Mus musculus
aacgcacaagacaagatctggagca

SEQ ID NO: 162154 - DNA, 25 bp, Mus musculus
aacgcacaatctcagaatggcttca

SEQ ID NO: 162155 - DNA, 25 bp, Mus musculus
aacgcaccgatggagggtccgaagt

SEQ ID NO: 162156 - DNA, 25 bp, Mus musculus
aacgcaccggtaaaggtagctggag

SEQ ID NO: 162157 - DNA, 25 bp, Mus musculus
aacgcacgacgcagtggaagaacgg

SEQ ID NO: 162158 - DNA, 25 bp, Mus musculus
aacgcagagtctgtactcccacaat

SEQ ID NO: 162159 - DNA, 25 bp, Mus musculus
aacgcaggacatagaaattgctttt

SEQ ID NO: 162160 - DNA, 25 bp, Mus musculus
aacgcaggacataggttgaatgcta

SEQ ID NO: 162161 - DNA, 25 bp, Mus musculus
aacgcaggagatggacttccagctg

SEQ ID NO: 162162 - DNA, 25 bp, Mus musculus
aacgcagtaggtcccttcccactga

SEQ ID NO: 162163 - DNA, 25 bp, Mus musculus
aacgcatcaactgtccagcagaagg

SEQ ID NO: 162164 - DNA, 25 bp, Mus musculus
aacgcatcgtattgacgacagtgtg

SEQ ID NO: 162165 - DNA, 25 bp, Mus musculus
aacgcatcttgcagaccatgctcaa

SEQ ID NO: 162166 - DNA, 25 bp, Mus musculus
aacgcatgaaacggccttcctggga

SEQ ID NO: 162167 - DNA, 25 bp, Mus musculus
aacgcattcagccagaagacatgtt

SEQ ID NO: 162168 - DNA, 25 bp, Mus musculus
aacgcattgaagtggtggaagaact

SEQ ID NO: 162169 - DNA, 25 bp, Mus musculus
aacgccaatgaaacttccatagaga

SEQ ID NO: 162170 - DNA, 25 bp, Mus musculus
aacgccactaaatagtgaggatgac

SEQ ID NO: 162171 - DNA, 25 bp, Mus musculus
aacgccacttgaccaaatgtgatct

SEQ ID NO: 162172 - DNA, 25 bp, Mus musculus
aacgccatagaaaagtttcacttta

SEQ ID NO: 162173 - DNA, 25 bp, Mus musculus
aacgccatagaagtttcactcacct

SEQ ID NO: 162174 - DNA, 25 bp, Mus musculus
aacgccatagcatcaaaagacgtac

SEQ ID NO: 162175 - DNA, 25 bp, Mus musculus
aacgccatagtggcattgaaccagt

SEQ ID NO: 162176 - DNA, 25 bp, Mus musculus
aacgccatcaaacaggttactatga

SEQ ID NO: 162177 - DNA, 25 bp, Mus musculus
aacgccatcaaacagtcaaaatatc

SEQ ID NO: 162178 - DNA, 25 bp, Mus musculus
aacgccatccagggtggagcttttg

SEQ ID NO: 162179 - DNA, 25 bp, Mus musculus
aacgccatccaggtccctaagcctt

SEQ ID NO: 162180 - DNA, 25 bp, Mus musculus
aacgccatggctgacaagatcctga

SEQ ID NO: 162181 - DNA, 25 bp, Mus musculus
aacgcccaggcgtagaccccgactg

SEQ ID NO: 162182 - DNA, 25 bp, Mus musculus
aacgcccgttcacgatcctcagcgt

SEQ ID NO: 162183 - DNA, 25 bp, Mus musculus
aacgccggagcagggtccccagaag

SEQ ID NO: 162184 - DNA, 25 bp, Mus musculus
aacgccggcccgtgtggatctgcag

SEQ ID NO: 162185 - DNA, 25 bp, Mus musculus
aacgccggcttggtgcctgttccgg

SEQ ID NO: 162186 - DNA, 25 bp, Mus musculus
aacgccgggaaaggtaatgatgtgg

SEQ ID NO: 162187 - DNA, 25 bp, Mus musculus
aacgcctatcaccagctcctcaggt

SEQ ID NO: 162188 - DNA, 25 bp, Mus musculus
aacgcctatcaccagttatcctacc

SEQ ID NO: 162189 - DNA, 25 bp, Mus musculus
aacgcctctagtaaccctgacctca

SEQ ID NO: 162190 - DNA, 25 bp, Mus musculus
aacgcctgctgcagctggacccaac

SEQ ID NO: 162191 - DNA, 25 bp, Mus musculus
aacgcgaaagcaggtccccagcctg

SEQ ID NO: 162192 - DNA, 25 bp, Mus musculus
aacgcgaagtctgtgattcgtaaga

SEQ ID NO: 162193 - DNA, 25 bp, Mus musculus
aacgcgcagaactgggattgtcttt

SEQ ID NO: 162194 - DNA, 25 bp, Mus musculus
aacgcgcagaactgggggatgcaga

SEQ ID NO: 162195 - DNA, 25 bp, Mus musculus
aacgcgcagaactggttcttcccca

SEQ ID NO: 162196 - DNA, 25 bp, Mus musculus
aacgcgccacacctggccgccgccg

SEQ ID NO: 162197 - DNA, 25 bp, Mus musculus
aacgcgcccacgccggtgtctgcag

SEQ ID NO: 162198 - DNA, 25 bp, Mus musculus
aacgcgcccacgccgtatatcaagg

SEQ ID NO: 162199 - DNA, 25 bp, Mus musculus
aacgcggagggccgcaacaccaaga

SEQ ID NO: 162200 - DNA, 25 bp, Mus musculus
aacgcggccagcggggacaatccca

SEQ ID NO: 162201 - DNA, 25 bp, Mus musculus
aacgcggccagcgggttcccgagga

SEQ ID NO: 162202 - DNA, 25 bp, Mus musculus
aacgcggcgttctgatgagtgaccc

SEQ ID NO: 162203 - DNA, 25 bp, Mus musculus
aacgcggcgttctggttttttgcat

SEQ ID NO: 162204 - DNA, 25 bp, Mus musculus
aacgcggggatcagggcagagatgg

SEQ ID NO: 162205 - DNA, 25 bp, Mus musculus
aacgcgtgcgcagactttcctcttc

SEQ ID NO: 162206 - DNA, 25 bp, Mus musculus
aacgcgttgctggtacaattaccag

SEQ ID NO: 162207 - DNA, 25 bp, Mus musculus
aacgcgtttgggtctcttacaaagt

SEQ ID NO: 162208 - DNA, 25 bp, Mus musculus
aacgctaagaaaggaccctcaacac

SEQ ID NO: 162209 - DNA, 25 bp, Mus musculus
aacgctataggtatgtgtatcacag

SEQ ID NO: 162210 - DNA, 25 bp, Mus musculus
aacgctccaaaaaaggcaaattgaa

SEQ ID NO: 162211 - DNA, 25 bp, Mus musculus
aacgctcgatgcggccaaagagatg

SEQ ID NO: 162212 - DNA, 25 bp, Mus musculus
aacgctcgatgcgggtggtaggaat

SEQ ID NO: 162213 - DNA, 25 bp, Mus musculus
aacgctcgatgcgttcacaatcttc

SEQ ID NO: 162214 - DNA, 25 bp, Mus musculus
aacgctgaagaagatcggtcagcac

SEQ ID NO: 162215 - DNA, 25 bp, Mus musculus
aacgctgaagaagattcgccggtac

SEQ ID NO: 162216 - DNA, 25 bp, Mus musculus
aacgctgactttgagaagctgaagc

SEQ ID NO: 162217 - DNA, 25 bp, Mus musculus
aacgctgccgccaagttgaagttca

SEQ ID NO: 162218 - DNA, 25 bp, Mus musculus
aacgctgcttcggtggtgtagtgga

SEQ ID NO: 162219 - DNA, 25 bp, Mus musculus
aacgctgtcctgtggaggtgtaaag

SEQ ID NO: 162220 - DNA, 25 bp, Mus musculus
aacgctgtgacagatctgagcactg

SEQ ID NO: 162221 - DNA, 25 bp, Mus musculus
aacgctgtgacagcacctccgtccg

SEQ ID NO: 162222 - DNA, 25 bp, Mus musculus
aacgcttaagggaacaggaagaaga

SEQ ID NO: 162223 - DNA, 25 bp, Mus musculus
aacgcttccgatccttacctcgtga

SEQ ID NO: 162224 - DNA, 25 bp, Mus musculus
aacgcttcctagcagaggaaaagaa

SEQ ID NO: 162225 - DNA, 25 bp, Mus musculus
aacgcttcctagcaggagtgatgat

SEQ ID NO: 162226 - DNA, 25 bp, Mus musculus
aacgcttgcgttcgggaagatgctg

SEQ ID NO: 162227 - DNA, 25 bp, Mus musculus
aacggaaaaatggaagtatagtctt

SEQ ID NO: 162228 - DNA, 25 bp, Mus musculus
aacggaaaaatgtgctccagctgag

SEQ ID NO: 162229 - DNA, 25 bp, Mus musculus
aacggaaatatcagttactactcaa

SEQ ID NO: 162230 - DNA, 25 bp, Mus musculus
aacggaaatctagtgttctccagtt

SEQ ID NO: 162231 - DNA, 25 bp, Mus musculus
aacggaaatgatcagcctcagtccg

SEQ ID NO: 162232 - DNA, 25 bp, Mus musculus
aacggaaggaaaagaatgtggagaa

SEQ ID NO: 162233 - DNA, 25 bp, Mus musculus
aacggaagtacccggacagagagag

SEQ ID NO: 162234 - DNA, 25 bp, Mus musculus
aacggaagttggttgctgcatccca

SEQ ID NO: 162235 - DNA, 25 bp, Mus musculus
aacggaatcgcaacaaactgacaag

SEQ ID NO: 162236 - DNA, 25 bp, Mus musculus
aacggaatcgcaaggacagatccag

SEQ ID NO: 162237 - DNA, 25 bp, Mus musculus
aacggaatgacttgtgtgcaaacaa

SEQ ID NO: 162238 - DNA, 25 bp, Mus musculus
aacggacaaggagatcagcaggctc

SEQ ID NO: 162239 - DNA, 25 bp, Mus musculus
aacggacagccagatgccaaagctg

SEQ ID NO: 162240 - DNA, 25 bp, Mus musculus
aacggacagccagcaggcgtctgta

SEQ ID NO: 162241 - DNA, 25 bp, Mus musculus
aacggacaggagacctgaactataa

SEQ ID NO: 162242 - DNA, 25 bp, Mus musculus
aacggacccaaagaggtctctcacc

SEQ ID NO: 162243 - DNA, 25 bp, Mus musculus
aacggacccaaagaggtgtgaggtt

SEQ ID NO: 162244 - DNA, 25 bp, Mus musculus
aacggactgctgaccttggggcttg

SEQ ID NO: 162245 - DNA, 25 bp, Mus musculus
aacggagacatgaggatgcagagag

SEQ ID NO: 162246 - DNA, 25 bp, Mus musculus
aacggagagagcgtcgtatacaacg

SEQ ID NO: 162247 - DNA, 25 bp, Mus musculus
aacggagagaggaggacagttacta

SEQ ID NO: 162248 - DNA, 25 bp, Mus musculus
aacggagagaggagggagatggtgt

SEQ ID NO: 162249 - DNA, 25 bp, Mus musculus
aacggagagatagatctagctagtg

SEQ ID NO: 162250 - DNA, 25 bp, Mus musculus
aacggaggtagtcttgtcctgggtg

SEQ ID NO: 162251 - DNA, 25 bp, Mus musculus
aacggagtctccgggaacgtgccaa

SEQ ID NO: 162252 - DNA, 25 bp, Mus musculus
aacggagtctccggggatgaattgt

SEQ ID NO: 162253 - DNA, 25 bp, Mus musculus
aacggagttggtgaatgataccaat

SEQ ID NO: 162254 - DNA, 25 bp, Mus musculus
aacggatatgagaagtcaaactaca

SEQ ID NO: 162255 - DNA, 25 bp, Mus musculus
aacggatccagaaggaactgactga

SEQ ID NO: 162256 - DNA, 25 bp, Mus musculus
aacggatccagaaggttgctttcac

SEQ ID NO: 162257 - DNA, 25 bp, Mus musculus
aacggatctgtgattataaaagctt

SEQ ID NO: 162258 - DNA, 25 bp, Mus musculus
aacggatggaagtgtcatctgccag

SEQ ID NO: 162259 - DNA, 25 bp, Mus musculus
aacggatgttaaggagagggcgcga

SEQ ID NO: 162260 - DNA, 25 bp, Mus musculus
aacggatgttaaggtgccaagtcgg

SEQ ID NO: 162261 - DNA, 25 bp, Mus musculus
aacggatttgtcccactcacttaca

SEQ ID NO: 162262 - DNA, 25 bp, Mus musculus
aacggatttgttggatggatttatt

SEQ ID NO: 162263 - DNA, 25 bp, Mus musculus
aacggattttggcaagtcaagcatt

SEQ ID NO: 162264 - DNA, 25 bp, Mus musculus
aacggcactgcgctcttggaatttg

SEQ ID NO: 162265 - DNA, 25 bp, Mus musculus
aacggcagaggattcgtaaacttca

SEQ ID NO: 162266 - DNA, 25 bp, Mus musculus
aacggcagatgataatgttcacttt

SEQ ID NO: 162267 - DNA, 25 bp, Mus musculus
aacggcagatgtggtacacggatga

SEQ ID NO: 162268 - DNA, 25 bp, Mus musculus
aacggcagctggaaccaccatctgg

SEQ ID NO: 162269 - DNA, 25 bp, Mus musculus
aacggcagctggcctcctatgctgc

SEQ ID NO: 162270 - DNA, 25 bp, Mus musculus
aacggcatcaggcgcagatagatca

SEQ ID NO: 162271 - DNA, 25 bp, Mus musculus
aacggcatgtatcctcctccaccac

SEQ ID NO: 162272 - DNA, 25 bp, Mus musculus
aacggcatgtgacctgacctagttt

SEQ ID NO: 162273 - DNA, 25 bp, Mus musculus
aacggccccagaaattactgtgctt

SEQ ID NO: 162274 - DNA, 25 bp, Mus musculus
aacggccccagaagctgactgcgga

SEQ ID NO: 162275 - DNA, 25 bp, Mus musculus
aacggccctgattgaagatattttt

SEQ ID NO: 162276 - DNA, 25 bp, Mus musculus
aacggccgccgcagatataaagact

SEQ ID NO: 162277 - DNA, 25 bp, Mus musculus
aacggcgagaagggagaagtcggac

SEQ ID NO: 162278 - DNA, 25 bp, Mus musculus
aacggcgatgctttccgtcagaata

SEQ ID NO: 162279 - DNA, 25 bp, Mus musculus
aacggcgcctcggctggacattgtg

SEQ ID NO: 162280 - DNA, 25 bp, Mus musculus
aacggcgcctcggtggagtcttacc

SEQ ID NO: 162281 - DNA, 25 bp, Mus musculus
aacggcgctccgccgattcctttgt

SEQ ID NO: 162282 - DNA, 25 bp, Mus musculus
aacggcgctccgccggtgagcacga

SEQ ID NO: 162283 - DNA, 25 bp, Mus musculus
aacggcggccgaggtctgtctgcag

SEQ ID NO: 162284 - DNA, 25 bp, Mus musculus
aacggctacttctgggaacatcatg

SEQ ID NO: 162285 - DNA, 25 bp, Mus musculus
aacggctccaggctgctggcaatgc

SEQ ID NO: 162286 - DNA, 25 bp, Mus musculus
aacggctctgcctgcagtggggact

SEQ ID NO: 162287 - DNA, 25 bp, Mus musculus
aacggctctgcgttgctgctctcca

SEQ ID NO: 162288 - DNA, 25 bp, Mus musculus
aacggctgctggaagtgagagggtc

SEQ ID NO: 162289 - DNA, 25 bp, Mus musculus
aacggcttgtctgtgccaccaaatg

SEQ ID NO: 162290 - DNA, 25 bp, Mus musculus
aacgggaaagaagtgagaagataaa

SEQ ID NO: 162291 - DNA, 25 bp, Mus musculus
aacgggaatgctgatcactggagat

SEQ ID NO: 162292 - DNA, 25 bp, Mus musculus
aacgggaattctcgcccgaacctct

SEQ ID NO: 162293 - DNA, 25 bp, Mus musculus
aacgggacagcaaaggccgggtagg

SEQ ID NO: 162294 - DNA, 25 bp, Mus musculus
aacgggacagcaaaggttctggccg

SEQ ID NO: 162295 - DNA, 25 bp, Mus musculus
aacgggagacaggtacttgtggaag

SEQ ID NO: 162296 - DNA, 25 bp, Mus musculus
aacgggattcctgcctgctccagga

SEQ ID NO: 162297 - DNA, 25 bp, Mus musculus
aacgggcagagggaatccggagatc

SEQ ID NO: 162298 - DNA, 25 bp, Mus musculus
aacgggctgagatctcttgatgcta

SEQ ID NO: 162299 - DNA, 25 bp, Mus musculus
aacgggctgaggtctgtgcagacgt

SEQ ID NO: 162300 - DNA, 25 bp, Mus musculus
aacgggctgggacaggaaatgctgt

SEQ ID NO: 162301 - DNA, 25 bp, Mus musculus
aacggggaatgacagccgccgccat

SEQ ID NO: 162302 - DNA, 25 bp, Mus musculus
aacggggactgagcggtcttgacga

SEQ ID NO: 162303 - DNA, 25 bp, Mus musculus
aacggggagaaaagctggcactcga

SEQ ID NO: 162304 - DNA, 25 bp, Mus musculus
aacggggagaagtactgcggtgaga

SEQ ID NO: 162305 - DNA, 25 bp, Mus musculus
aacggggccatcgatgtgcagaaga

SEQ ID NO: 162306 - DNA, 25 bp, Mus musculus
aacggggccatcgtgattcgagtca

SEQ ID NO: 162307 - DNA, 25 bp, Mus musculus
aacgggtatccaaagcggctggaga

SEQ ID NO: 162308 - DNA, 25 bp, Mus musculus
aacgggtatgagtggcccaggatgg

SEQ ID NO: 162309 - DNA, 25 bp, Mus musculus
aacggtcagaagctccccgcaggcc

SEQ ID NO: 162310 - DNA, 25 bp, Mus musculus
aacggtctcatacaggtgagaaacc

SEQ ID NO: 162311 - DNA, 25 bp, Mus musculus
aacggtcttccgacatagactgact

SEQ ID NO: 162312 - DNA, 25 bp, Mus musculus
aacggtgaaggtgtggaatgtcatt

SEQ ID NO: 162313 - DNA, 25 bp, Mus musculus
aacggtgcccatcagattatctgca

SEQ ID NO: 162314 - DNA, 25 bp, Mus musculus
aacggtgcggcagcgtgcttccggc

SEQ ID NO: 162315 - DNA, 25 bp, Mus musculus
aacggtgtaaagctggaccgtgtat

SEQ ID NO: 162316 - DNA, 25 bp, Mus musculus
aacggtgtgcagttcatggaccgtc

SEQ ID NO: 162317 - DNA, 25 bp, Mus musculus
aacgtaaagagctacaagaaaatca

SEQ ID NO: 162318 - DNA, 25 bp, Mus musculus
aacgtaatgcctcagttccactgat

SEQ ID NO: 162319 - DNA, 25 bp, Mus musculus
aacgtacacagatatgaggaattaa

SEQ ID NO: 162320 - DNA, 25 bp, Mus musculus
aacgtacacaggtttgcagctagaa

SEQ ID NO: 162321 - DNA, 25 bp, Mus musculus
aacgtacctgcataaagacagaccc

SEQ ID NO: 162322 - DNA, 25 bp, Mus musculus
aacgtacctgcataagaattgaatt

SEQ ID NO: 162323 - DNA, 25 bp, Mus musculus
aacgtactaaaactgtgcagggcta

SEQ ID NO: 162324 - DNA, 25 bp, Mus musculus
aacgtatacgacacgggccggactg

SEQ ID NO: 162325 - DNA, 25 bp, Mus musculus
aacgtatgatggaaatttctatggc

SEQ ID NO: 162326 - DNA, 25 bp, Mus musculus
aacgtatttaacagacaaatggtgg

SEQ ID NO: 162327 - DNA, 25 bp, Mus musculus
aacgtatttaacagacaatcatggc

SEQ ID NO: 162328 - DNA, 25 bp, Mus musculus
aacgtcaaactggagcaggcagact

SEQ ID NO: 162329 - DNA, 25 bp, Mus musculus
aacgtcaaactggaggaaagcacag

SEQ ID NO: 162330 - DNA, 25 bp, Mus musculus
aacgtcaacaagcttgctcaggacc

SEQ ID NO: 162331 - DNA, 25 bp, Mus musculus
aacgtcaaccctccacgccatcaaa

SEQ ID NO: 162332 - DNA, 25 bp, Mus musculus
aacgtcaacccttcagaaagccatc

SEQ ID NO: 162333 - DNA, 25 bp, Mus musculus
aacgtcaagaagagtggtcttaggt

SEQ ID NO: 162334 - DNA, 25 bp, Mus musculus
aacgtcaagaaggagatccagctgc

SEQ ID NO: 162335 - DNA, 25 bp, Mus musculus
aacgtcaatgcacaggatgcagaag

SEQ ID NO: 162336 - DNA, 25 bp, Mus musculus
aacgtcacaataaagatctgggaca

SEQ ID NO: 162337 - DNA, 25 bp, Mus musculus
aacgtcacaataaaggtactagtac

SEQ ID NO: 162338 - DNA, 25 bp, Mus musculus
aacgtcacaggcatatatcgagcag

SEQ ID NO: 162339 - DNA, 25 bp, Mus musculus
aacgtcacattagcctttggagctg

SEQ ID NO: 162340 - DNA, 25 bp, Mus musculus
aacgtcacattagggtccgcaagca

SEQ ID NO: 162341 - DNA, 25 bp, Mus musculus
aacgtccacaagcttgtgacacagc

SEQ ID NO: 162342 - DNA, 25 bp, Mus musculus
aacgtcccagggtgatgtgaacaga

SEQ ID NO: 162343 - DNA, 25 bp, Mus musculus
aacgtcccctccaagagcaaagctg

SEQ ID NO: 162344 - DNA, 25 bp, Mus musculus
aacgtcccggagcttggccagagtc

SEQ ID NO: 162345 - DNA, 25 bp, Mus musculus
aacgtcctcaacgtgtattttgtta

SEQ ID NO: 162346 - DNA, 25 bp, Mus musculus
aacgtcggcaatggctatgacattg

SEQ ID NO: 162347 - DNA, 25 bp, Mus musculus
aacgtcgtggtgccgatctctgaga

SEQ ID NO: 162348 - DNA, 25 bp, Mus musculus
aacgtctgcagaagcaacctcttac

SEQ ID NO: 162349 - DNA, 25 bp, Mus musculus
aacgtctgcagaaggccaagatgga

SEQ ID NO: 162350 - DNA, 25 bp, Mus musculus
aacgtgacaacagcactgtttgaag

SEQ ID NO: 162351 - DNA, 25 bp, Mus musculus
aacgtgagagatctgaagcagataa

SEQ ID NO: 162352 - DNA, 25 bp, Mus musculus
aacgtgataagaatttattctctcc

SEQ ID NO: 162353 - DNA, 25 bp, Mus musculus
aacgtgatacgatgagcagctctca

SEQ ID NO: 162354 - DNA, 25 bp, Mus musculus
aacgtgatcaaaggtatgagggtgc

SEQ ID NO: 162355 - DNA, 25 bp, Mus musculus
aacgtgcaatcacaggtggataccc

SEQ ID NO: 162356 - DNA, 25 bp, Mus musculus
aacgtgcagaggggtaccccaagat

SEQ ID NO: 162357 - DNA, 25 bp, Mus musculus
aacgtgccggcagaggtggtttgtg

SEQ ID NO: 162358 - DNA, 25 bp, Mus musculus
aacgtgccggcagcagagacttgct

SEQ ID NO: 162359 - DNA, 25 bp, Mus musculus
aacgtgccgtagcggggatgatgag

SEQ ID NO: 162360 - DNA, 25 bp, Mus musculus
aacgtgcgcctgcaggtctctgcaa

SEQ ID NO: 162361 - DNA, 25 bp, Mus musculus
aacgtgcgcctgcaggtggtggtgg

SEQ ID NO: 162362 - DNA, 25 bp, Mus musculus
aacgtgcgcctgcaggttcacattg

SEQ ID NO: 162363 - DNA, 25 bp, Mus musculus
aacgtgctccccttctgctgcagaa

SEQ ID NO: 162364 - DNA, 25 bp, Mus musculus
aacgtggaaatacttcggatatcat

SEQ ID NO: 162365 - DNA, 25 bp, Mus musculus
aacgtggaagcagcctgtgattctc

SEQ ID NO: 162366 - DNA, 25 bp, Mus musculus
aacgtggaagccctctgctcatcac

SEQ ID NO: 162367 - DNA, 25 bp, Mus musculus
aacgtggaatatcagaagtgacaga

SEQ ID NO: 162368 - DNA, 25 bp, Mus musculus
aacgtggactgaggtgctgcactgt

SEQ ID NO: 162369 - DNA, 25 bp, Mus musculus
aacgtggattccctccatccatatc

SEQ ID NO: 162370 - DNA, 25 bp, Mus musculus
aacgtggggttgagactcacacatg

SEQ ID NO: 162371 - DNA, 25 bp, Mus musculus
aacgtggtgaagaaggttcattatg

SEQ ID NO: 162372 - DNA, 25 bp, Mus musculus
aacgtggtttatatgcattcacatc

SEQ ID NO: 162373 - DNA, 25 bp, Mus musculus
aacgtggtttatatgcttgtgggct

SEQ ID NO: 162374 - DNA, 25 bp, Mus musculus
aacgtggtttgaaagtatccctgga

SEQ ID NO: 162375 - DNA, 25 bp, Mus musculus
aacgtgtcggaagtgatgggaccag

SEQ ID NO: 162376 - DNA, 25 bp, Mus musculus
aacgtgtgcaccaggagcacctgag

SEQ ID NO: 162377 - DNA, 25 bp, Mus musculus
aacgtgtgctaggtctcctcctgcc

SEQ ID NO: 162378 - DNA, 25 bp, Mus musculus
aacgtgtgctaggtttctgccacct

SEQ ID NO: 162379 - DNA, 25 bp, Mus musculus
aacgtgttagactcccatttccaga

SEQ ID NO: 162380 - DNA, 25 bp, Mus musculus
aacgtgttcttgacagctaccaggg

SEQ ID NO: 162381 - DNA, 25 bp, Mus musculus
aacgtgttcttggtttctgccagct

SEQ ID NO: 162382 - DNA, 25 bp, Mus musculus
aacgttaaaggatatcacttataca

SEQ ID NO: 162383 - DNA, 25 bp, Mus musculus
aacgttaatgtggttcgtctccaac

SEQ ID NO: 162384 - DNA, 25 bp, Mus musculus
aacgttacccaaaggtggctctgcg

SEQ ID NO: 162385 - DNA, 25 bp, Mus musculus
aacgttctacttttctggaggcatt

SEQ ID NO: 162386 - DNA, 25 bp, Mus musculus
aacgttctggaagcctttgcttcct

SEQ ID NO: 162387 - DNA, 25 bp, Mus musculus
aacgttgggaaggaagaacgctgtg

SEQ ID NO: 162388 - DNA, 25 bp, Mus musculus
aacgttgtcattgagcaagaagaga

SEQ ID NO: 162389 - DNA, 25 bp, Mus musculus
aacgtttcaacgattgtactgcatc

SEQ ID NO: 162390 - DNA, 25 bp, Mus musculus
aacgtttcagccagattctggctgg

SEQ ID NO: 162391 - DNA, 25 bp, Mus musculus
aacgtttccaggtatgagatgtacg

SEQ ID NO: 162392 - DNA, 25 bp, Mus musculus
aacgtttccagtgcaaacatactct

SEQ ID NO: 162393 - DNA, 25 bp, Mus musculus
aacgttttcacactgacttgaattt

SEQ ID NO: 162394 - DNA, 25 bp, Mus musculus
aacgttttgctggccttcagtgggg

SEQ ID NO: 162395 - DNA, 25 bp, Mus musculus
aacgttttggcaaggagaggccagc

SEQ ID NO: 162396 - DNA, 25 bp, Mus musculus
aactaaaaatgtcccatctgcaggt

SEQ ID NO: 162397 - DNA, 25 bp, Mus musculus
aactaaaatcagcaccgtgcgagtc

SEQ ID NO: 162398 - DNA, 25 bp, Mus musculus
aactaaacaggaatgcttcgtggca

SEQ ID NO: 162399 - DNA, 25 bp, Mus musculus
aactaaagatgcagctttgcagaaa

SEQ ID NO: 162400 - DNA, 25 bp, Mus musculus
aactaaagatgcaggaacctccttc

SEQ ID NO: 162401 - DNA, 25 bp, Mus musculus
aactaaagccaaaaccaacagcagc

SEQ ID NO: 162402 - DNA, 25 bp, Mus musculus
aactaaagccggagactcttcctga

SEQ ID NO: 162403 - DNA, 25 bp, Mus musculus
aactaaagccggagcgtgtttggtg

SEQ ID NO: 162404 - DNA, 25 bp, Mus musculus
aactaaatcatccatgcatcatcaa

SEQ ID NO: 162405 - DNA, 25 bp, Mus musculus
aactaacaaggacaatcagtacctt

SEQ ID NO: 162406 - DNA, 25 bp, Mus musculus
aactaacaaggatattacaaatgaa

SEQ ID NO: 162407 - DNA, 25 bp, Mus musculus
aactaacagagatgattctgacaat

SEQ ID NO: 162408 - DNA, 25 bp, Mus musculus
aactaacatgcaatgatcttcccaa

SEQ ID NO: 162409 - DNA, 25 bp, Mus musculus
aactaaccccgaaggcaaataagat

SEQ ID NO: 162410 - DNA, 25 bp, Mus musculus
aactaaccctacagggtgactacaa

SEQ ID NO: 162411 - DNA, 25 bp, Mus musculus
aactaactgagaaatgcaaacagat

SEQ ID NO: 162412 - DNA, 25 bp, Mus musculus
aactaactgagttttagaagccaaa

SEQ ID NO: 162413 - DNA, 25 bp, Mus musculus
aactaagactaaatgggtgaccgag

SEQ ID NO: 162414 - DNA, 25 bp, Mus musculus
aactaagcaagaacaatactacaag

SEQ ID NO: 162415 - DNA, 25 bp, Mus musculus
aactaagcaagaagactaagaacat

SEQ ID NO: 162416 - DNA, 25 bp, Mus musculus
aactaagcaagaagtggtggtaatc

SEQ ID NO: 162417 - DNA, 25 bp, Mus musculus
aactaagcaagaatgagctgaagag

SEQ ID NO: 162418 - DNA, 25 bp, Mus musculus
aactaagcagaacaagccatccagt

SEQ ID NO: 162419 - DNA, 25 bp, Mus musculus
aactaagcaggaagcagaacaagcc

SEQ ID NO: 162420 - DNA, 25 bp, Mus musculus
aactaagccgcccagccaccatcac

SEQ ID NO: 162421 - DNA, 25 bp, Mus musculus
aactaagcctaaggtgctgtgctcc

SEQ ID NO: 162422 - DNA, 25 bp, Mus musculus
aactaaggcccagggctgtaccatg

SEQ ID NO: 162423 - DNA, 25 bp, Mus musculus
aactaaggcccaggtccctatttgt

SEQ ID NO: 162424 - DNA, 25 bp, Mus musculus
aactaaggcggcaggaccctgagcc

SEQ ID NO: 162425 - DNA, 25 bp, Mus musculus
aactaataaaaacagaacagttgaa

SEQ ID NO: 162426 - DNA, 25 bp, Mus musculus
aactaatcaaggacactgacatcaa

SEQ ID NO: 162427 - DNA, 25 bp, Mus musculus
aactaatgaaagaggttaggaattt

SEQ ID NO: 162428 - DNA, 25 bp, Mus musculus
aactaatggcagttggatcctccag

SEQ ID NO: 162429 - DNA, 25 bp, Mus musculus
aactaatgggttatattatgggcaa

SEQ ID NO: 162430 - DNA, 25 bp, Mus musculus
aactaattatagtcctattgtcgat

SEQ ID NO: 162431 - DNA, 25 bp, Mus musculus
aactaattgatgagatggttggtaa

SEQ ID NO: 162432 - DNA, 25 bp, Mus musculus
aactacaaaagcagaatgattgaag

SEQ ID NO: 162433 - DNA, 25 bp, Mus musculus
aactacaaagacaggagcgaatccg

SEQ ID NO: 162434 - DNA, 25 bp, Mus musculus
aactacaaagacaggtgtaacgtgg

SEQ ID NO: 162435 - DNA, 25 bp, Mus musculus
aactacaaagacagttcagggcgac

SEQ ID NO: 162436 - DNA, 25 bp, Mus musculus
aactacaacaacgagcatcgaggag

SEQ ID NO: 162437 - DNA, 25 bp, Mus musculus
aactacaacatggagcatatccgtg

SEQ ID NO: 162438 - DNA, 25 bp, Mus musculus
aactacaagggacaggtgctgaagc

SEQ ID NO: 162439 - DNA, 25 bp, Mus musculus
aactacaataagtgtttcctcaatg

SEQ ID NO: 162440 - DNA, 25 bp, Mus musculus
aactacaatccagaggagtctctgt

SEQ ID NO: 162441 - DNA, 25 bp, Mus musculus
aactacacaatggagcatatccgtg

SEQ ID NO: 162442 - DNA, 25 bp, Mus musculus
aactacaccctgacaactggagtgg

SEQ ID NO: 162443 - DNA, 25 bp, Mus musculus
aactacaccctgtccccagaattcc

SEQ ID NO: 162444 - DNA, 25 bp, Mus musculus
aactacacgagacctgtgttcctgt

SEQ ID NO: 162445 - DNA, 25 bp, Mus musculus
aactacactactgactccatgcctg

SEQ ID NO: 162446 - DNA, 25 bp, Mus musculus
aactacagcgagagtctatataaac

SEQ ID NO: 162447 - DNA, 25 bp, Mus musculus
aactacaggctttttcttacttctc

SEQ ID NO: 162448 - DNA, 25 bp, Mus musculus
aactacaggtcaccttgttggagtg

SEQ ID NO: 162449 - DNA, 25 bp, Mus musculus
aactacagtacagctaggtagaagc

SEQ ID NO: 162450 - DNA, 25 bp, Mus musculus
aactacagtgaagatcgttaccaga

SEQ ID NO: 162451 - DNA, 25 bp, Mus musculus
aactacatcaggaactggtttgagg

SEQ ID NO: 162452 - DNA, 25 bp, Mus musculus
aactacatcgacatttggctgtaca

SEQ ID NO: 162453 - DNA, 25 bp, Mus musculus
aactacatcgacggctaccagagac

SEQ ID NO: 162454 - DNA, 25 bp, Mus musculus
aactacatgctgcagctgctgttga

SEQ ID NO: 162455 - DNA, 25 bp, Mus musculus
aactacatgctgcagttggtgcttc

SEQ ID NO: 162456 - DNA, 25 bp, Mus musculus
aactacattaaagttctttcagatt

SEQ ID NO: 162457 - DNA, 25 bp, Mus musculus
aactacattgccaaccgaggtccct

SEQ ID NO: 162458 - DNA, 25 bp, Mus musculus
aactacattgttttcatcttccaca

SEQ ID NO: 162459 - DNA, 25 bp, Mus musculus
aactaccaagcatctatatttgcgg

SEQ ID NO: 162460 - DNA, 25 bp, Mus musculus
aactaccacccaggaactaaggcaa

SEQ ID NO: 162461 - DNA, 25 bp, Mus musculus
aactaccacccaggctgacccttcc

SEQ ID NO: 162462 - DNA, 25 bp, Mus musculus
aactacccacctttggaatgactat

SEQ ID NO: 162463 - DNA, 25 bp, Mus musculus
aactacccagccacttactggacca

SEQ ID NO: 162464 - DNA, 25 bp, Mus musculus
aactacccaggctccttctagatca

SEQ ID NO: 162465 - DNA, 25 bp, Mus musculus
aactacctcaactaatttgtgatcc

SEQ ID NO: 162466 - DNA, 25 bp, Mus musculus
aactacctctagacgccagccttct

SEQ ID NO: 162467 - DNA, 25 bp, Mus musculus
aactacctggacttccaccgctgtg

SEQ ID NO: 162468 - DNA, 25 bp, Mus musculus
aactacctggatagcatgtacatca

SEQ ID NO: 162469 - DNA, 25 bp, Mus musculus
aactacctggatgcccagtactatg

SEQ ID NO: 162470 - DNA, 25 bp, Mus musculus
aactacctgggtctcagcctgggat

SEQ ID NO: 162471 - DNA, 25 bp, Mus musculus
aactacgattatccagataagtagc

SEQ ID NO: 162472 - DNA, 25 bp, Mus musculus
aactacgattcatcccatcagattg

SEQ ID NO: 162473 - DNA, 25 bp, Mus musculus
aactacgattccatgtacacggctt

SEQ ID NO: 162474 - DNA, 25 bp, Mus musculus
aactacggaaagaatgatgaagtgg

SEQ ID NO: 162475 - DNA, 25 bp, Mus musculus
aactacggaaagatcagaaacatcg

SEQ ID NO: 162476 - DNA, 25 bp, Mus musculus
aactacggaaaggtgactcagaact

SEQ ID NO: 162477 - DNA, 25 bp, Mus musculus
aactactacaggtattaagttcctg

SEQ ID NO: 162478 - DNA, 25 bp, Mus musculus
aactactacgccatggagatgctct

SEQ ID NO: 162479 - DNA, 25 bp, Mus musculus
aactactatgaagacatccgttctc

SEQ ID NO: 162480 - DNA, 25 bp, Mus musculus
aactactcacaggatgagcagaagc

SEQ ID NO: 162481 - DNA, 25 bp, Mus musculus
aactactgagacaggatttacatgg

SEQ ID NO: 162482 - DNA, 25 bp, Mus musculus
aactactgagactaaagcaagaaat

SEQ ID NO: 162483 - DNA, 25 bp, Mus musculus
aactactgaggcaaggcagcaaatt

SEQ ID NO: 162484 - DNA, 25 bp, Mus musculus
aactactgcgaggaggcggtgggag

SEQ ID NO: 162485 - DNA, 25 bp, Mus musculus
aactactgcggctcaggatacttgg

SEQ ID NO: 162486 - DNA, 25 bp, Mus musculus
aactactggcacgatcctcaccacg

SEQ ID NO: 162487 - DNA, 25 bp, Mus musculus
aactactggccctgctctctgctct

SEQ ID NO: 162488 - DNA, 25 bp, Mus musculus
aactactgtaggaacccagcccaac

SEQ ID NO: 162489 - DNA, 25 bp, Mus musculus
aactacttaaactccgactgattga

SEQ ID NO: 162490 - DNA, 25 bp, Mus musculus
aactacttaaagctctggattactg

SEQ ID NO: 162491 - DNA, 25 bp, Mus musculus
aactacttgcagattctcttctggc

SEQ ID NO: 162492 - DNA, 25 bp, Mus musculus
aactacttgcaggccacagacaagc

SEQ ID NO: 162493 - DNA, 25 bp, Mus musculus
aactagaaacccagaactggagcaa

SEQ ID NO: 162494 - DNA, 25 bp, Mus musculus
aactagaaaccctgaactggagcaa

SEQ ID NO: 162495 - DNA, 25 bp, Mus musculus
aactagaaatatgcggctatggatg

SEQ ID NO: 162496 - DNA, 25 bp, Mus musculus
aactagaatatgacttgggtcagca

SEQ ID NO: 162497 - DNA, 25 bp, Mus musculus
aactagaatatggtggcccatattt

SEQ ID NO: 162498 - DNA, 25 bp, Mus musculus
aactagacaagatgtcttgggaagg

SEQ ID NO: 162499 - DNA, 25 bp, Mus musculus
aactagaccctgataatgcactgct

SEQ ID NO: 162500 - DNA, 25 bp, Mus musculus
aactagaggaggcctcattgcatac

SEQ ID NO: 162501 - DNA, 25 bp, Mus musculus
aactagaggaggcctcctcctggac

SEQ ID NO: 162502 - DNA, 25 bp, Mus musculus
aactagcctggcatcccagccttta

SEQ ID NO: 162503 - DNA, 25 bp, Mus musculus
aactagctaaggctcaaactcagaa

SEQ ID NO: 162504 - DNA, 25 bp, Mus musculus
aactagctgggatactaacaaaacc

SEQ ID NO: 162505 - DNA, 25 bp, Mus musculus
aactaggccagatttaccttatgag

SEQ ID NO: 162506 - DNA, 25 bp, Mus musculus
aactaggccagctgctcagccatct

SEQ ID NO: 162507 - DNA, 25 bp, Mus musculus
aactagggaacatattcaaaagaaa

SEQ ID NO: 162508 - DNA, 25 bp, Mus musculus
aactagtccccagcaagcaagagga

SEQ ID NO: 162509 - DNA, 25 bp, Mus musculus
aactataaagccagagccatcgtga

SEQ ID NO: 162510 - DNA, 25 bp, Mus musculus
aactatactgagatcgccttacagc

SEQ ID NO: 162511 - DNA, 25 bp, Mus musculus
aactatagaggtgccttggagcact

SEQ ID NO: 162512 - DNA, 25 bp, Mus musculus
aactatatacacaggccatcctgga

SEQ ID NO: 162513 - DNA, 25 bp, Mus musculus
aactatatacaggctacagacaaga

SEQ ID NO: 162514 - DNA, 25 bp, Mus musculus
aactatattcacagaattggcagag

SEQ ID NO: 162515 - DNA, 25 bp, Mus musculus
aactatattcacaggagtcgatagc

SEQ ID NO: 162516 - DNA, 25 bp, Mus musculus
aactatcccgtggtctccattgagg

SEQ ID NO: 162517 - DNA, 25 bp, Mus musculus
aactatcctgtggtctccattgaag

SEQ ID NO: 162518 - DNA, 25 bp, Mus musculus
aactatcgcaggattgggtttcctt

SEQ ID NO: 162519 - DNA, 25 bp, Mus musculus
aactatcgcagggatcccaggctgg

SEQ ID NO: 162520 - DNA, 25 bp, Mus musculus
aactatctcagcatcaagatgacct

SEQ ID NO: 162521 - DNA, 25 bp, Mus musculus
aactatcttgcttcgaagccagaca

SEQ ID NO: 162522 - DNA, 25 bp, Mus musculus
aactatgaaatgggtgggatgctat

SEQ ID NO: 162523 - DNA, 25 bp, Mus musculus
aactatgacgctgatttccaaagag

SEQ ID NO: 162524 - DNA, 25 bp, Mus musculus
aactatgcaggtattgcagctcggg

SEQ ID NO: 162525 - DNA, 25 bp, Mus musculus
aactatgcaggtgtgcattggaatt

SEQ ID NO: 162526 - DNA, 25 bp, Mus musculus
aactatgcagtaaagacgctccttg

SEQ ID NO: 162527 - DNA, 25 bp, Mus musculus
aactatgctgagctggtgaagcaca

SEQ ID NO: 162528 - DNA, 25 bp, Mus musculus
aactatggaggaggaaattatggaa

SEQ ID NO: 162529 - DNA, 25 bp, Mus musculus
aactatggattcagtggggtgatgc

SEQ ID NO: 162530 - DNA, 25 bp, Mus musculus
aactatggcatggttacagtacctt

SEQ ID NO: 162531 - DNA, 25 bp, Mus musculus
aactatggcggagtgacaaagaatt

SEQ ID NO: 162532 - DNA, 25 bp, Mus musculus
aactatggcggagtttcaacaccgt

SEQ ID NO: 162533 - DNA, 25 bp, Mus musculus
aactatggcttctttctccttgtgg

SEQ ID NO: 162534 - DNA, 25 bp, Mus musculus
aactatggtgaaccgtgtgtgtctg

SEQ ID NO: 162535 - DNA, 25 bp, Mus musculus
aactatggtgaactctgtctgcaat

SEQ ID NO: 162536 - DNA, 25 bp, Mus musculus
aactatggtgaaggctcttgctgag

SEQ ID NO: 162537 - DNA, 25 bp, Mus musculus
aactattcaagagcccccaatttta

SEQ ID NO: 162538 - DNA, 25 bp, Mus musculus
aactattcacacctcctggaggacc

SEQ ID NO: 162539 - DNA, 25 bp, Mus musculus
aactattcacaggctcagcagcagc

SEQ ID NO: 162540 - DNA, 25 bp, Mus musculus
aactattcgagcaggtggggcgagc

SEQ ID NO: 162541 - DNA, 25 bp, Mus musculus
aactattgagacccgatcctggcag

SEQ ID NO: 162542 - DNA, 25 bp, Mus musculus
aactattgagaggccctggcccagc

SEQ ID NO: 162543 - DNA, 25 bp, Mus musculus
aactattgagagtgtatgggcaagg

SEQ ID NO: 162544 - DNA, 25 bp, Mus musculus
aactattgtggaaggatacgccaat

SEQ ID NO: 162545 - DNA, 25 bp, Mus musculus
aactatttatgaattcacagacaca

SEQ ID NO: 162546 - DNA, 25 bp, Mus musculus
aactatttatgatactgcatttttc

SEQ ID NO: 162547 - DNA, 25 bp, Mus musculus
aactatttccagcactggccagtgt

SEQ ID NO: 162548 - DNA, 25 bp, Mus musculus
aactatttgacatggcctctgaaga

SEQ ID NO: 162549 - DNA, 25 bp, Mus musculus
aactcaaaaagcagcctttacttgt

SEQ ID NO: 162550 - DNA, 25 bp, Mus musculus
aactcaaaagattgctttattcacc

SEQ ID NO: 162551 - DNA, 25 bp, Mus musculus
aactcaaacagaaatggtgaggaca

SEQ ID NO: 162552 - DNA, 25 bp, Mus musculus
aactcaaagatttctgttttggtcg

SEQ ID NO: 162553 - DNA, 25 bp, Mus musculus
aactcaacaaggagatggcttcaga

SEQ ID NO: 162554 - DNA, 25 bp, Mus musculus
aactcaacatcgacagcatcaatag

SEQ ID NO: 162555 - DNA, 25 bp, Mus musculus
aactcaacatgtatggttttcggaa

SEQ ID NO: 162556 - DNA, 25 bp, Mus musculus
aactcaagaaagatagatttgaatc

SEQ ID NO: 162557 - DNA, 25 bp, Mus musculus
aactcaagaatgatagatttgaatc

SEQ ID NO: 162558 - DNA, 25 bp, Mus musculus
aactcaagatgctgatcatatgatg

SEQ ID NO: 162559 - DNA, 25 bp, Mus musculus
aactcaagcagctggtggcccggcc

SEQ ID NO: 162560 - DNA, 25 bp, Mus musculus
aactcaaggaggcagagacccgtgc

SEQ ID NO: 162561 - DNA, 25 bp, Mus musculus
aactcaatgaaaatgtcatggtttt

SEQ ID NO: 162562 - DNA, 25 bp, Mus musculus
aactcacaacggacgcctccttggc

SEQ ID NO: 162563 - DNA, 25 bp, Mus musculus
aactcacaacgggattgtcttgggg

SEQ ID NO: 162564 - DNA, 25 bp, Mus musculus
aactcacaactttgctcggaaaacg

SEQ ID NO: 162565 - DNA, 25 bp, Mus musculus
aactcacaagaagaaacatgtcatt

SEQ ID NO: 162566 - DNA, 25 bp, Mus musculus
aactcacaagaagacttccaactga

SEQ ID NO: 162567 - DNA, 25 bp, Mus musculus
aactcacaagaagtcgcaatgtgtc

SEQ ID NO: 162568 - DNA, 25 bp, Mus musculus
aactcacaagagcaaagccaaagtg

SEQ ID NO: 162569 - DNA, 25 bp, Mus musculus
aactcacaaggtatcgaagtgagaa

SEQ ID NO: 162570 - DNA, 25 bp, Mus musculus
aactcacacagagcactggcctgag

SEQ ID NO: 162571 - DNA, 25 bp, Mus musculus
aactcacactcaagaataaatttgt

SEQ ID NO: 162572 - DNA, 25 bp, Mus musculus
aactcacactcaaggataagtttgt

SEQ ID NO: 162573 - DNA, 25 bp, Mus musculus
aactcacagaaaagcctcatataga

SEQ ID NO: 162574 - DNA, 25 bp, Mus musculus
aactcacagaaagcctcatatagat

SEQ ID NO: 162575 - DNA, 25 bp, Mus musculus
aactcacccaagtgcaaaacatgtc

SEQ ID NO: 162576 - DNA, 25 bp, Mus musculus
aactcacccaagtgttgcccaccaa

SEQ ID NO: 162577 - DNA, 25 bp, Mus musculus
aactcaccgaaaagaggactaggaa

SEQ ID NO: 162578 - DNA, 25 bp, Mus musculus
aactcaccgccataaaaagatgcag

SEQ ID NO: 162579 - DNA, 25 bp, Mus musculus
aactcactaacagcatcaaggtgta

SEQ ID NO: 162580 - DNA, 25 bp, Mus musculus
aactcactcagaagagaagagcagc

SEQ ID NO: 162581 - DNA, 25 bp, Mus musculus
aactcactcagtgtcaacagggagg

SEQ ID NO: 162582 - DNA, 25 bp, Mus musculus
aactcactgcccaggtggaagaact

SEQ ID NO: 162583 - DNA, 25 bp, Mus musculus
aactcactgcccaggtggagcaact

SEQ ID NO: 162584 - DNA, 25 bp, Mus musculus
aactcactgtgaatgggaacacagc

SEQ ID NO: 162585 - DNA, 25 bp, Mus musculus
aactcagaaatgattcccgttgcgc

SEQ ID NO: 162586 - DNA, 25 bp, Mus musculus
aactcagaacagaagcccacaagga

SEQ ID NO: 162587 - DNA, 25 bp, Mus musculus
aactcagaacagaaggagtgtgtaa

SEQ ID NO: 162588 - DNA, 25 bp, Mus musculus
aactcagacaaagctaaaaatatct

SEQ ID NO: 162589 - DNA, 25 bp, Mus musculus
aactcagacacctgctcaacatggc

SEQ ID NO: 162590 - DNA, 25 bp, Mus musculus
aactcagacacctggcagtgcttaa

SEQ ID NO: 162591 - DNA, 25 bp, Mus musculus
aactcagacaggagcagagcccggg

SEQ ID NO: 162592 - DNA, 25 bp, Mus musculus
aactcagcaaggagaagacagacga

SEQ ID NO: 162593 - DNA, 25 bp, Mus musculus
aactcagcaggaactatgaatggga

SEQ ID NO: 162594 - DNA, 25 bp, Mus musculus
aactcagcagggcatctgaagttga

SEQ ID NO: 162595 - DNA, 25 bp, Mus musculus
aactcagcgggtggatacccttcgc

SEQ ID NO: 162596 - DNA, 25 bp, Mus musculus
aactcagcgggttcttccagttctt

SEQ ID NO: 162597 - DNA, 25 bp, Mus musculus
aactcagcgtcagggccgcgttggc

SEQ ID NO: 162598 - DNA, 25 bp, Mus musculus
aactcaggagaggagccatttattg

SEQ ID NO: 162599 - DNA, 25 bp, Mus musculus
aactcaggagaggctgctcccaggt

SEQ ID NO: 162600 - DNA, 25 bp, Mus musculus
aactcaggagaggtacttggaaggc

SEQ ID NO: 162601 - DNA, 25 bp, Mus musculus
aactcaggcagcttgatcagtggac

SEQ ID NO: 162602 - DNA, 25 bp, Mus musculus
aactcaggcagcttggaggaagagt

SEQ ID NO: 162603 - DNA, 25 bp, Mus musculus
aactcaggccagatattcagaaacc

SEQ ID NO: 162604 - DNA, 25 bp, Mus musculus
aactcaggccagatcaaaaaaggga

SEQ ID NO: 162605 - DNA, 25 bp, Mus musculus
aactcaggccgggaaccgatgatgt

SEQ ID NO: 162606 - DNA, 25 bp, Mus musculus
aactcagggatggaggcaaattcca

SEQ ID NO: 162607 - DNA, 25 bp, Mus musculus
aactcaggttcatgatggatgacat

SEQ ID NO: 162608 - DNA, 25 bp, Mus musculus
aactcagtgagagttgtagtgcaag

SEQ ID NO: 162609 - DNA, 25 bp, Mus musculus
aactcagtggagagatgaataagtt

SEQ ID NO: 162610 - DNA, 25 bp, Mus musculus
aactcagttgcagcgacaagttcta

SEQ ID NO: 162611 - DNA, 25 bp, Mus musculus
aactcagttttagcctgcggagccc

SEQ ID NO: 162612 - DNA, 25 bp, Mus musculus
aactcagttttagtgcattgcagaa

SEQ ID NO: 162613 - DNA, 25 bp, Mus musculus
aactcagttttagtggcatcccctg

SEQ ID NO: 162614 - DNA, 25 bp, Mus musculus
aactcataaattatatgcaggacag

SEQ ID NO: 162615 - DNA, 25 bp, Mus musculus
aactcataaattgttggggtttctt

SEQ ID NO: 162616 - DNA, 25 bp, Mus musculus
aactcatattactgaagatgagcta

SEQ ID NO: 162617 - DNA, 25 bp, Mus musculus
aactcatattactggtgatgaatct

SEQ ID NO: 162618 - DNA, 25 bp, Mus musculus
aactcatattactgtatcatccaga

SEQ ID NO: 162619 - DNA, 25 bp, Mus musculus
aactcatcaagtgctcggcgctctc

SEQ ID NO: 162620 - DNA, 25 bp, Mus musculus
aactcatcagactgtgtcagaagtt

SEQ ID NO: 162621 - DNA, 25 bp, Mus musculus
aactcatcagtctgtatatctgtga

SEQ ID NO: 162622 - DNA, 25 bp, Mus musculus
aactcatcctgactctcactcatgg

SEQ ID NO: 162623 - DNA, 25 bp, Mus musculus
aactcatggacaagattaatgccgc

SEQ ID NO: 162624 - DNA, 25 bp, Mus musculus
aactcatttccaaggctggtcttga

SEQ ID NO: 162625 - DNA, 25 bp, Mus musculus
aactcatttccaagtccttccaggg

SEQ ID NO: 162626 - DNA, 25 bp, Mus musculus
aactccaacctgaactctctctctt

SEQ ID NO: 162627 - DNA, 25 bp, Mus musculus
aactccaacctggaacgagtggagt

SEQ ID NO: 162628 - DNA, 25 bp, Mus musculus
aactccaatgtcacagaaaagaaaa

SEQ ID NO: 162629 - DNA, 25 bp, Mus musculus
aactccaattctaggatgtggttag

SEQ ID NO: 162630 - DNA, 25 bp, Mus musculus
aactccacactctggtacatccaaa

SEQ ID NO: 162631 - DNA, 25 bp, Mus musculus
aactccacagaccctgctcacacta

SEQ ID NO: 162632 - DNA, 25 bp, Mus musculus
aactccacagagcaggagcttgaac

SEQ ID NO: 162633 - DNA, 25 bp, Mus musculus
aactccacaggatctttggaagctc

SEQ ID NO: 162634 - DNA, 25 bp, Mus musculus
aactccacagtcaggtgacactgct

SEQ ID NO: 162635 - DNA, 25 bp, Mus musculus
aactccacctctgcacagaagaatg

SEQ ID NO: 162636 - DNA, 25 bp, Mus musculus
aactccagaaaacggtttcaggcac

SEQ ID NO: 162637 - DNA, 25 bp, Mus musculus
aactccagcagcatccacaggattt

SEQ ID NO: 162638 - DNA, 25 bp, Mus musculus
aactccagcaggtctcggacaaaat

SEQ ID NO: 162639 - DNA, 25 bp, Mus musculus
aactccagcccagtccaaggcgacc

SEQ ID NO: 162640 - DNA, 25 bp, Mus musculus
aactccagcccccggcctccacctc

SEQ ID NO: 162641 - DNA, 25 bp, Mus musculus
aactccaggaacagctcaaggccgt

SEQ ID NO: 162642 - DNA, 25 bp, Mus musculus
aactccaggaagagctgatcttttc

SEQ ID NO: 162643 - DNA, 25 bp, Mus musculus
aactccaggtcaaagtgattgtgtg

SEQ ID NO: 162644 - DNA, 25 bp, Mus musculus
aactccagttctaattgtaatcgtg

SEQ ID NO: 162645 - DNA, 25 bp, Mus musculus
aactccatcaaggagctgaatgagc

SEQ ID NO: 162646 - DNA, 25 bp, Mus musculus
aactccatcagacggctggaagagg

SEQ ID NO: 162647 - DNA, 25 bp, Mus musculus
aactccatcatgtccttcagtgctg

SEQ ID NO: 162648 - DNA, 25 bp, Mus musculus
aactccatctgcagggttatcaaga

SEQ ID NO: 162649 - DNA, 25 bp, Mus musculus
aactccatctttggtctggctccca

SEQ ID NO: 162650 - DNA, 25 bp, Mus musculus
aactccatgactacctcatgagcac

SEQ ID NO: 162651 - DNA, 25 bp, Mus musculus
aactccatgcaagtgccaaatttac

SEQ ID NO: 162652 - DNA, 25 bp, Mus musculus
aactcccaactacagaaaagcagtc

SEQ ID NO: 162653 - DNA, 25 bp, Mus musculus
aactccccagagcaccccttgggag

SEQ ID NO: 162654 - DNA, 25 bp, Mus musculus
aactccccaggaagctacagggaac

SEQ ID NO: 162655 - DNA, 25 bp, Mus musculus
aactcccggctagagaacatgaatg

SEQ ID NO: 162656 - DNA, 25 bp, Mus musculus
aactcccggctagagatcggaatgt

SEQ ID NO: 162657 - DNA, 25 bp, Mus musculus
aactcccgtgagcacttcattcaag

SEQ ID NO: 162658 - DNA, 25 bp, Mus musculus
aactcccgtgaggttcttgtagtgc

SEQ ID NO: 162659 - DNA, 25 bp, Mus musculus
aactccctgcagcttgacgtggccg

SEQ ID NO: 162660 - DNA, 25 bp, Mus musculus
aactccctgttaagcatcaacattt

SEQ ID NO: 162661 - DNA, 25 bp, Mus musculus
aactccgacatcgatcctgcagtag

SEQ ID NO: 162662 - DNA, 25 bp, Mus musculus
aactccgacatcggcagacagacac

SEQ ID NO: 162663 - DNA, 25 bp, Mus musculus
aactccgacatcgtgatccgggcca

SEQ ID NO: 162664 - DNA, 25 bp, Mus musculus
aactccgacgtgtggagaggatgcc

SEQ ID NO: 162665 - DNA, 25 bp, Mus musculus
aactccgactaaatagctggaccac

SEQ ID NO: 162666 - DNA, 25 bp, Mus musculus
aactccgtcaggcccctgatttcta

SEQ ID NO: 162667 - DNA, 25 bp, Mus musculus
aactccgtcagtacctcttgtgtcc

SEQ ID NO: 162668 - DNA, 25 bp, Mus musculus
aactccgtctgtaagaatgacatac

SEQ ID NO: 162669 - DNA, 25 bp, Mus musculus
aactccgttctctgggttaccacag

SEQ ID NO: 162670 - DNA, 25 bp, Mus musculus
aactccgttgttcaagtcagaaacc

SEQ ID NO: 162671 - DNA, 25 bp, Mus musculus
aactcctaaaattatttcagctgcc

SEQ ID NO: 162672 - DNA, 25 bp, Mus musculus
aactcctatataagtaactttgaaa

SEQ ID NO: 162673 - DNA, 25 bp, Mus musculus
aactcctatataagtggtaagccaa

SEQ ID NO: 162674 - DNA, 25 bp, Mus musculus
aactcctcaagatggagagacgtta

SEQ ID NO: 162675 - DNA, 25 bp, Mus musculus
aactcctcaagggttggtggtcgga

SEQ ID NO: 162676 - DNA, 25 bp, Mus musculus
aactcctcccgctttgggaaattca

SEQ ID NO: 162677 - DNA, 25 bp, Mus musculus
aactcctcgaaagatgttccggcac

SEQ ID NO: 162678 - DNA, 25 bp, Mus musculus
aactcctcggagagacctccattgc

SEQ ID NO: 162679 - DNA, 25 bp, Mus musculus
aactcctgagaggttgatcgtgtcc

SEQ ID NO: 162680 - DNA, 25 bp, Mus musculus
aactcctgagatatgaatctgaaaa

SEQ ID NO: 162681 - DNA, 25 bp, Mus musculus
aactcctgttgaggatattttcttt

SEQ ID NO: 162682 - DNA, 25 bp, Mus musculus
aactcctgttgaggcctggaatgtc

SEQ ID NO: 162683 - DNA, 25 bp, Mus musculus
aactccttaaattgggaagatgctg

SEQ ID NO: 162684 - DNA, 25 bp, Mus musculus
aactccttcagcgcatcatgactga

SEQ ID NO: 162685 - DNA, 25 bp, Mus musculus
aactccttcaggtccatctctgtaa

SEQ ID NO: 162686 - DNA, 25 bp, Mus musculus
aactccttccctgcacctccgcacc

SEQ ID NO: 162687 - DNA, 25 bp, Mus musculus
aactcctttggactggtgcagtcag

SEQ ID NO: 162688 - DNA, 25 bp, Mus musculus
aactcgaacagctctcgtggcgctc

SEQ ID NO: 162689 - DNA, 25 bp, Mus musculus
aactcgatgagcctgtttgagctga

SEQ ID NO: 162690 - DNA, 25 bp, Mus musculus
aactcgcaaaccagctccttaattg

SEQ ID NO: 162691 - DNA, 25 bp, Mus musculus
aactcgcactatggtccacgcttca

SEQ ID NO: 162692 - DNA, 25 bp, Mus musculus
aactcgccacagagctcagcagtca

SEQ ID NO: 162693 - DNA, 25 bp, Mus musculus
aactcgcggagtcagaaggtagcag

SEQ ID NO: 162694 - DNA, 25 bp, Mus musculus
aactcgcggagtcaggctcttgtct

SEQ ID NO: 162695 - DNA, 25 bp, Mus musculus
aactcgcggcctaaactccagtctt

SEQ ID NO: 162696 - DNA, 25 bp, Mus musculus
aactcgcggcggaagactgctagct

SEQ ID NO: 162697 - DNA, 25 bp, Mus musculus
aactcggacctggagcagaagtatt

SEQ ID NO: 162698 - DNA, 25 bp, Mus musculus
aactcggacctggagtgggaccctg

SEQ ID NO: 162699 - DNA, 25 bp, Mus musculus
aactcggacctggatgctaaaagga

SEQ ID NO: 162700 - DNA, 25 bp, Mus musculus
aactcggacctggtcataagggcta

SEQ ID NO: 162701 - DNA, 25 bp, Mus musculus
aactcggagcagaaatgcatcgcca

SEQ ID NO: 162702 - DNA, 25 bp, Mus musculus
aactcggagcagatcggtgcagcct

SEQ ID NO: 162703 - DNA, 25 bp, Mus musculus
aactcggagcaggcagctggccgtg

SEQ ID NO: 162704 - DNA, 25 bp, Mus musculus
aactcggagcagtgggaccctgaag

SEQ ID NO: 162705 - DNA, 25 bp, Mus musculus
aactcggcaggcagaatgggaaaca

SEQ ID NO: 162706 - DNA, 25 bp, Mus musculus
aactcggccctacagtgcctgagca

SEQ ID NO: 162707 - DNA, 25 bp, Mus musculus
aactcggctggggtcattctcagag

SEQ ID NO: 162708 - DNA, 25 bp, Mus musculus
aactcgggcagagatgggtggccta

SEQ ID NO: 162709 - DNA, 25 bp, Mus musculus
aactcggggtttgcctgaagagaag

SEQ ID NO: 162710 - DNA, 25 bp, Mus musculus
aactcgtgtattcagggggagatga

SEQ ID NO: 162711 - DNA, 25 bp, Mus musculus
aactcgtttgtagggacagtgatgc

SEQ ID NO: 162712 - DNA, 25 bp, Mus musculus
aactctacaagcacttgcagaagca

SEQ ID NO: 162713 - DNA, 25 bp, Mus musculus
aactctacaccctagaggagagctg

SEQ ID NO: 162714 - DNA, 25 bp, Mus musculus
aactctacaccctggtggtgtctgt

SEQ ID NO: 162715 - DNA, 25 bp, Mus musculus
aactctaccacaagatgctggtggt

SEQ ID NO: 162716 - DNA, 25 bp, Mus musculus
aactctaccacagtgactcatgttc

SEQ ID NO: 162717 - DNA, 25 bp, Mus musculus
aactctactttcattctctttacag

SEQ ID NO: 162718 - DNA, 25 bp, Mus musculus
aactctactttcattctttagtaac

SEQ ID NO: 162719 - DNA, 25 bp, Mus musculus
aactctagcattgaggcctttgctg

SEQ ID NO: 162720 - DNA, 25 bp, Mus musculus
aactctatcaagatctgggataaaa

SEQ ID NO: 162721 - DNA, 25 bp, Mus musculus
aactctatcatattgcagcacccaa

SEQ ID NO: 162722 - DNA, 25 bp, Mus musculus
aactctattcagctcccattttcgc

SEQ ID NO: 162723 - DNA, 25 bp, Mus musculus
aactctcacacacagctttcttctg

SEQ ID NO: 162724 - DNA, 25 bp, Mus musculus
aactctcacacacaggacacagaag

SEQ ID NO: 162725 - DNA, 25 bp, Mus musculus
aactctcaccaaaatgtgagcgtgt

SEQ ID NO: 162726 - DNA, 25 bp, Mus musculus
aactctcagagaaccgagcccgaaa

SEQ ID NO: 162727 - DNA, 25 bp, Mus musculus
aactctcatcaggtgaaaacatgat

SEQ ID NO: 162728 - DNA, 25 bp, Mus musculus
aactctcatcagttcttacccaaga

SEQ ID NO: 162729 - DNA, 25 bp, Mus musculus
aactctcatgcacttcccagtcaag

SEQ ID NO: 162730 - DNA, 25 bp, Mus musculus
aactctcatgcagttcccagtcaag

SEQ ID NO: 162731 - DNA, 25 bp, Mus musculus
aactctccaaggccgacgtggaaag

SEQ ID NO: 162732 - DNA, 25 bp, Mus musculus
aactctccagagtgctacaataacc

SEQ ID NO: 162733 - DNA, 25 bp, Mus musculus
aactctcccagggctttctgagggt

SEQ ID NO: 162734 - DNA, 25 bp, Mus musculus
aactctcccctcgtaccagtaatgt

SEQ ID NO: 162735 - DNA, 25 bp, Mus musculus
aactctcccctgtcctggagtgggc

SEQ ID NO: 162736 - DNA, 25 bp, Mus musculus
aactctcctgctgggacacccctca

SEQ ID NO: 162737 - DNA, 25 bp, Mus musculus
aactctcctgctgggtctgtgatgg

SEQ ID NO: 162738 - DNA, 25 bp, Mus musculus
aactctcgtggaagcacaagcccaa

SEQ ID NO: 162739 - DNA, 25 bp, Mus musculus
aactctcgtggaggctgctctgaca

SEQ ID NO: 162740 - DNA, 25 bp, Mus musculus
aactctctctggctgagtgactggg

SEQ ID NO: 162741 - DNA, 25 bp, Mus musculus
aactctgaaaaagtcctaatcaaag

SEQ ID NO: 162742 - DNA, 25 bp, Mus musculus
aactctgaaagatattaccaggaga

SEQ ID NO: 162743 - DNA, 25 bp, Mus musculus
aactctgaacctctatgaagtctta

SEQ ID NO: 162744 - DNA, 25 bp, Mus musculus
aactctgaagaaggctccttcccct

SEQ ID NO: 162745 - DNA, 25 bp, Mus musculus
aactctgacgtccattacagaagac

SEQ ID NO: 162746 - DNA, 25 bp, Mus musculus
aactctgagaaggtctattacaatg

SEQ ID NO: 162747 - DNA, 25 bp, Mus musculus
aactctgagtaccaaggcaaagacc

SEQ ID NO: 162748 - DNA, 25 bp, Mus musculus
aactctgatcagagtgccagaaggc

SEQ ID NO: 162749 - DNA, 25 bp, Mus musculus
aactctgcgagcagccaccactggt

SEQ ID NO: 162750 - DNA, 25 bp, Mus musculus
aactctgcggcacatggtgatgagt

SEQ ID NO: 162751 - DNA, 25 bp, Mus musculus
aactctgcgggaccttctgtcattc

SEQ ID NO: 162752 - DNA, 25 bp, Mus musculus
aactctgctctgcagtgcctgagca

SEQ ID NO: 162753 - DNA, 25 bp, Mus musculus
aactctggaagatgggtgtgtttta

SEQ ID NO: 162754 - DNA, 25 bp, Mus musculus
aactctggaaggaaaaaaatctgga

SEQ ID NO: 162755 - DNA, 25 bp, Mus musculus
aactctggaaggctgtcaagaaaca

SEQ ID NO: 162756 - DNA, 25 bp, Mus musculus
aactctgggaatagattccaagagc

SEQ ID NO: 162757 - DNA, 25 bp, Mus musculus
aactctgttgtgtagatgaacgaga

SEQ ID NO: 162758 - DNA, 25 bp, Mus musculus
aactcttagagtaccagcgcgggat

SEQ ID NO: 162759 - DNA, 25 bp, Mus musculus
aactcttattgggctgtgcctaaga

SEQ ID NO: 162760 - DNA, 25 bp, Mus musculus
aactcttattgttggaaatctacat

SEQ ID NO: 162761 - DNA, 25 bp, Mus musculus
aactcttcaagagagatcctggctt

SEQ ID NO: 162762 - DNA, 25 bp, Mus musculus
aactcttcaagatcctaaatttgac

SEQ ID NO: 162763 - DNA, 25 bp, Mus musculus
aactcttccatgtgctccccacact

SEQ ID NO: 162764 - DNA, 25 bp, Mus musculus
aactcttcccagagaccgtgaagaa

SEQ ID NO: 162765 - DNA, 25 bp, Mus musculus
aactcttcccaggctttgacctaga

SEQ ID NO: 162766 - DNA, 25 bp, Mus musculus
aactcttgacaggaaggagggggag

SEQ ID NO: 162767 - DNA, 25 bp, Mus musculus
aactcttgagggaggccttaaccat

SEQ ID NO: 162768 - DNA, 25 bp, Mus musculus
aactcttgatagtgatctttccaga

SEQ ID NO: 162769 - DNA, 25 bp, Mus musculus
aactcttgcaaggtctggttttgca

SEQ ID NO: 162770 - DNA, 25 bp, Mus musculus
aactcttggcattgaccttggccca

SEQ ID NO: 162771 - DNA, 25 bp, Mus musculus
aactctttcgatatgtcttgtcgtt

SEQ ID NO: 162772 - DNA, 25 bp, Mus musculus
aactctttcgtctccttttaccaga

SEQ ID NO: 162773 - DNA, 25 bp, Mus musculus
aactgaaaaaaggctgtgacctctc

SEQ ID NO: 162774 - DNA, 25 bp, Mus musculus
aactgaaaaaggacggctcctctaa

SEQ ID NO: 162775 - DNA, 25 bp, Mus musculus
aactgaaaatgatacagtgtgacag

SEQ ID NO: 162776 - DNA, 25 bp, Mus musculus
aactgaaaatggtgttttcgatgtg

SEQ ID NO: 162777 - DNA, 25 bp, Mus musculus
aactgaaactattaggcaggaacag

SEQ ID NO: 162778 - DNA, 25 bp, Mus musculus
aactgaaagctgtcctctattgtat

SEQ ID NO: 162779 - DNA, 25 bp, Mus musculus
aactgaaagctgttttaaaggacac

SEQ ID NO: 162780 - DNA, 25 bp, Mus musculus
aactgaaagtgacaactggaacctt

SEQ ID NO: 162781 - DNA, 25 bp, Mus musculus
aactgaaagtgggtccctgaagtca

SEQ ID NO: 162782 - DNA, 25 bp, Mus musculus
aactgaacagagacactcctgagga

SEQ ID NO: 162783 - DNA, 25 bp, Mus musculus
aactgaacagagatgatgattctga

SEQ ID NO: 162784 - DNA, 25 bp, Mus musculus
aactgaacagagtaccatttaggtc

SEQ ID NO: 162785 - DNA, 25 bp, Mus musculus
aactgaacagtaaccgatttcgcag

SEQ ID NO: 162786 - DNA, 25 bp, Mus musculus
aactgaacagtgtaccatctatatt

SEQ ID NO: 162787 - DNA, 25 bp, Mus musculus
aactgaactggacaggtacctctaa

SEQ ID NO: 162788 - DNA, 25 bp, Mus musculus
aactgaagaagaggttaggaatttg

SEQ ID NO: 162789 - DNA, 25 bp, Mus musculus
aactgaagacgagttggtgtcagaa

SEQ ID NO: 162790 - DNA, 25 bp, Mus musculus
aactgaagacgagttttcgtttctc

SEQ ID NO: 162791 - DNA, 25 bp, Mus musculus
aactgaagactatcaccttaaccaa

SEQ ID NO: 162792 - DNA, 25 bp, Mus musculus
aactgaagactgtcactagatgcaa

SEQ ID NO: 162793 - DNA, 25 bp, Mus musculus
aactgaagatgaaaaaggtcattta

SEQ ID NO: 162794 - DNA, 25 bp, Mus musculus
aactgaagcaggaggaggagacgct

SEQ ID NO: 162795 - DNA, 25 bp, Mus musculus
aactgaagcagggaacccagggggc

SEQ ID NO: 162796 - DNA, 25 bp, Mus musculus
aactgaagcagggagggcaagctcc

SEQ ID NO: 162797 - DNA, 25 bp, Mus musculus
aactgaagcagggagtaatgcatga

SEQ ID NO: 162798 - DNA, 25 bp, Mus musculus
aactgaagcaggtgtccatcctgtc

SEQ ID NO: 162799 - DNA, 25 bp, Mus musculus
aactgaagcgcctttcagtggaatg

SEQ ID NO: 162800 - DNA, 25 bp, Mus musculus
aactgaagcgttctgagaagaagta

SEQ ID NO: 162801 - DNA, 25 bp, Mus musculus
aactgaatgtgtttcctttgccaag

SEQ ID NO: 162802 - DNA, 25 bp, Mus musculus
aactgacaagatttagccttcagaa

SEQ ID NO: 162803 - DNA, 25 bp, Mus musculus
aactgacaaggtattcatgctagcc

SEQ ID NO: 162804 - DNA, 25 bp, Mus musculus
aactgacacgagtgcgcaaacttct

SEQ ID NO: 162805 - DNA, 25 bp, Mus musculus
aactgacacgcaacagatagtaaat

SEQ ID NO: 162806 - DNA, 25 bp, Mus musculus
aactgacacggtaagtcttctttta

SEQ ID NO: 162807 - DNA, 25 bp, Mus musculus
aactgacagaaaggaaacatggagc

SEQ ID NO: 162808 - DNA, 25 bp, Mus musculus
aactgacattgggagaatcccgggc

SEQ ID NO: 162809 - DNA, 25 bp, Mus musculus
aactgaccaggacaagagtgaagcc

SEQ ID NO: 162810 - DNA, 25 bp, Mus musculus
aactgacccgaagggtcacagacga

SEQ ID NO: 162811 - DNA, 25 bp, Mus musculus
aactgactagatcttgatatggaag

SEQ ID NO: 162812 - DNA, 25 bp, Mus musculus
aactgactctacagccactacgaag

SEQ ID NO: 162813 - DNA, 25 bp, Mus musculus
aactgactctacaggcattgggcat

SEQ ID NO: 162814 - DNA, 25 bp, Mus musculus
aactgactgagactaaaatacaaat

SEQ ID NO: 162815 - DNA, 25 bp, Mus musculus
aactgagaaaacagaagattctagt

SEQ ID NO: 162816 - DNA, 25 bp, Mus musculus
aactgagaaaacaggatctgacttt

SEQ ID NO: 162817 - DNA, 25 bp, Mus musculus
aactgagaaaagttttgctcatgga

SEQ ID NO: 162818 - DNA, 25 bp, Mus musculus
aactgagaacaaagcaacaagcaac

SEQ ID NO: 162819 - DNA, 25 bp, Mus musculus
aactgagaacaaagcaacaataaat

SEQ ID NO: 162820 - DNA, 25 bp, Mus musculus
aactgagaattcaagtctgtcacct

SEQ ID NO: 162821 - DNA, 25 bp, Mus musculus
aactgagaccatgcagaggcctcca

SEQ ID NO: 162822 - DNA, 25 bp, Mus musculus
aactgagatgtgtctacattgggcc

SEQ ID NO: 162823 - DNA, 25 bp, Mus musculus
aactgagcatgagcttttatgggag

SEQ ID NO: 162824 - DNA, 25 bp, Mus musculus
aactgagcatgaggtctcagacagc

SEQ ID NO: 162825 - DNA, 25 bp, Mus musculus
aactgaggaatcagcttaccaacaa

SEQ ID NO: 162826 - DNA, 25 bp, Mus musculus
aactgaggaatcagtattcgcctgg

SEQ ID NO: 162827 - DNA, 25 bp, Mus musculus
aactgaggagaagtgtgagaaactt

SEQ ID NO: 162828 - DNA, 25 bp, Mus musculus
aactgaggagacttcttcgagggca

SEQ ID NO: 162829 - DNA, 25 bp, Mus musculus
aactgaggagagatcaggaatcttt

SEQ ID NO: 162830 - DNA, 25 bp, Mus musculus
aactgaggagatctagatccagaga

SEQ ID NO: 162831 - DNA, 25 bp, Mus musculus
aactgaggagggtggccaaacagag

SEQ ID NO: 162832 - DNA, 25 bp, Mus musculus
aactgaggaggtcccgatcacatag

SEQ ID NO: 162833 - DNA, 25 bp, Mus musculus
aactgagtgaagaaactgatctccg

SEQ ID NO: 162834 - DNA, 25 bp, Mus musculus
aactgagtgaagaggagatgcatgc

SEQ ID NO: 162835 - DNA, 25 bp, Mus musculus
aactgagtgggagttgtgacacagg

SEQ ID NO: 162836 - DNA, 25 bp, Mus musculus
aactgataaaattctaccagtggag

SEQ ID NO: 162837 - DNA, 25 bp, Mus musculus
aactgataaactccagggattccct

SEQ ID NO: 162838 - DNA, 25 bp, Mus musculus
aactgatcacagaaggccagcaaca

SEQ ID NO: 162839 - DNA, 25 bp, Mus musculus
aactgatgaccaaacgggctgtaaa

SEQ ID NO: 162840 - DNA, 25 bp, Mus musculus
aactgatgaccgcccagctctcaaa

SEQ ID NO: 162841 - DNA, 25 bp, Mus musculus
aactgattcaaggaggcttggcaaa

SEQ ID NO: 162842 - DNA, 25 bp, Mus musculus
aactgattcagacattgcagatggt

SEQ ID NO: 162843 - DNA, 25 bp, Mus musculus
aactgattgacccttcccatgcttc

SEQ ID NO: 162844 - DNA, 25 bp, Mus musculus
aactgcaaacgggaggatatgatgg

SEQ ID NO: 162845 - DNA, 25 bp, Mus musculus
aactgcaaacggtggttggcactta

SEQ ID NO: 162846 - DNA, 25 bp, Mus musculus
aactgcaaactgccacgtcctcccc

SEQ ID NO: 162847 - DNA, 25 bp, Mus musculus
aactgcaaactggcacgtcctcccc

SEQ ID NO: 162848 - DNA, 25 bp, Mus musculus
aactgcaaagaaccgggtggtgggt

SEQ ID NO: 162849 - DNA, 25 bp, Mus musculus
aactgcaagagcagtttgacaactt

SEQ ID NO: 162850 - DNA, 25 bp, Mus musculus
aactgcaagagctttctatccaagg

SEQ ID NO: 162851 - DNA, 25 bp, Mus musculus
aactgcaaggattccagccccagtc

SEQ ID NO: 162852 - DNA, 25 bp, Mus musculus
aactgcacaaacagagcagctctgg

SEQ ID NO: 162853 - DNA, 25 bp, Mus musculus
aactgcacaagcaagagtaaaaaga

SEQ ID NO: 162854 - DNA, 25 bp, Mus musculus
aactgcacagagatcccaagtgtcc

SEQ ID NO: 162855 - DNA, 25 bp, Mus musculus
aactgcacagaggggctctttagag

SEQ ID NO: 162856 - DNA, 25 bp, Mus musculus
aactgcaccttcagcagagcacaca

SEQ ID NO: 162857 - DNA, 25 bp, Mus musculus
aactgcaccttcaggacgccgaggc

SEQ ID NO: 162858 - DNA, 25 bp, Mus musculus
aactgcactgccagcacggggtctg

SEQ ID NO: 162859 - DNA, 25 bp, Mus musculus
aactgcactgctccatgctggcaga

SEQ ID NO: 162860 - DNA, 25 bp, Mus musculus
aactgcagaacggatcgagcgtttg

SEQ ID NO: 162861 - DNA, 25 bp, Mus musculus
aactgcagaagggagaactttctgg

SEQ ID NO: 162862 - DNA, 25 bp, Mus musculus
aactgcagaaggtgctgatggaatg

SEQ ID NO: 162863 - DNA, 25 bp, Mus musculus
aactgcagaatgtttaccgagagaa

SEQ ID NO: 162864 - DNA, 25 bp, Mus musculus
aactgcagatgacctcctcctgggg

SEQ ID NO: 162865 - DNA, 25 bp, Mus musculus
aactgcagcattcaggtcaaggaag

SEQ ID NO: 162866 - DNA, 25 bp, Mus musculus
aactgcaggcagggaggtgtgagca

SEQ ID NO: 162867 - DNA, 25 bp, Mus musculus
aactgcaggctcaagaaatagccag

SEQ ID NO: 162868 - DNA, 25 bp, Mus musculus
aactgcagtgaccaacattgatcgc

SEQ ID NO: 162869 - DNA, 25 bp, Mus musculus
aactgcagtgaccaccattcctgcg

SEQ ID NO: 162870 - DNA, 25 bp, Mus musculus
aactgcatcaggctcactctttggg

SEQ ID NO: 162871 - DNA, 25 bp, Mus musculus
aactgcatcagtgaacggctcttta

SEQ ID NO: 162872 - DNA, 25 bp, Mus musculus
aactgcattatctggtgaccatctc

SEQ ID NO: 162873 - DNA, 25 bp, Mus musculus
aactgcattcaggacaggggtccga

SEQ ID NO: 162874 - DNA, 25 bp, Mus musculus
aactgcattttaggagtgcatgcgg

SEQ ID NO: 162875 - DNA, 25 bp, Mus musculus
aactgccaaaacgaaaacagataca

SEQ ID NO: 162876 - DNA, 25 bp, Mus musculus
aactgccaaatcaacatcaacgatt

SEQ ID NO: 162877 - DNA, 25 bp, Mus musculus
aactgccaagagtctgacagcaaat

SEQ ID NO: 162878 - DNA, 25 bp, Mus musculus
aactgccagagggtaacatctgccg

SEQ ID NO: 162879 - DNA, 25 bp, Mus musculus
aactgccagagggttgcatctgatg

SEQ ID NO: 162880 - DNA, 25 bp, Mus musculus
aactgccaggagaatcccagtgagt

SEQ ID NO: 162881 - DNA, 25 bp, Mus musculus
aactgccatctacaggctgtttgat

SEQ ID NO: 162882 - DNA, 25 bp, Mus musculus
aactgccatctacagtggctacagc

SEQ ID NO: 162883 - DNA, 25 bp, Mus musculus
aactgccatgcgcagtacaacccgg

SEQ ID NO: 162884 - DNA, 25 bp, Mus musculus
aactgccatgcttcctctaacagca

SEQ ID NO: 162885 - DNA, 25 bp, Mus musculus
aactgcccaccaggattctcagtcc

SEQ ID NO: 162886 - DNA, 25 bp, Mus musculus
aactgccccatccagaggccatgga

SEQ ID NO: 162887 - DNA, 25 bp, Mus musculus
aactgccctaagaggttatcaagaa

SEQ ID NO: 162888 - DNA, 25 bp, Mus musculus
aactgccctccacagagttccccac

SEQ ID NO: 162889 - DNA, 25 bp, Mus musculus
aactgccctccacagcccctacttc

SEQ ID NO: 162890 - DNA, 25 bp, Mus musculus
aactgccctccacaggagcaggcga

SEQ ID NO: 162891 - DNA, 25 bp, Mus musculus
aactgccgggttcatcgtggcagaa

SEQ ID NO: 162892 - DNA, 25 bp, Mus musculus
aactgcctaacaagtggtggaccaa

SEQ ID NO: 162893 - DNA, 25 bp, Mus musculus
aactgcctaaggagcctcaaggcat

SEQ ID NO: 162894 - DNA, 25 bp, Mus musculus
aactgcctcgtcatctgggagggca

SEQ ID NO: 162895 - DNA, 25 bp, Mus musculus
aactgcctcgtcatgcacaccaaga

SEQ ID NO: 162896 - DNA, 25 bp, Mus musculus
aactgcctgacagctggctgaaggg

SEQ ID NO: 162897 - DNA, 25 bp, Mus musculus
aactgcctgcagtggatacattgtt

SEQ ID NO: 162898 - DNA, 25 bp, Mus musculus
aactgcctggcccggaagatgcaag

SEQ ID NO: 162899 - DNA, 25 bp, Mus musculus
aactgcctggcccggtcacagcaaa

SEQ ID NO: 162900 - DNA, 25 bp, Mus musculus
aactgccttacagacgtggctcttt

SEQ ID NO: 162901 - DNA, 25 bp, Mus musculus
aactgcgcaggttacatccaggcat

SEQ ID NO: 162902 - DNA, 25 bp, Mus musculus
aactgctaactctaaactgcgaggc

SEQ ID NO: 162903 - DNA, 25 bp, Mus musculus
aactgctaactctagcatatgaaac

SEQ ID NO: 162904 - DNA, 25 bp, Mus musculus
aactgctacaggaggaaccccctcc

SEQ ID NO: 162905 - DNA, 25 bp, Mus musculus
aactgctagataaggtcctggagac

SEQ ID NO: 162906 - DNA, 25 bp, Mus musculus
aactgctagataaggtcctggagga

SEQ ID NO: 162907 - DNA, 25 bp, Mus musculus
aactgctcaaacaagtgtgatgctc

SEQ ID NO: 162908 - DNA, 25 bp, Mus musculus
aactgctcaatagtgaaattccaca

SEQ ID NO: 162909 - DNA, 25 bp, Mus musculus
aactgctcacagagtcagtccgacc

SEQ ID NO: 162910 - DNA, 25 bp, Mus musculus
aactgctcaggaataaagctggctg

SEQ ID NO: 162911 - DNA, 25 bp, Mus musculus
aactgctcatttatgataattagca

SEQ ID NO: 162912 - DNA, 25 bp, Mus musculus
aactgctccacttctatcagcaatc

SEQ ID NO: 162913 - DNA, 25 bp, Mus musculus
aactgctcccgtttgagcccggttc

SEQ ID NO: 162914 - DNA, 25 bp, Mus musculus
aactgctcgtaccaggcacagaaga

SEQ ID NO: 162915 - DNA, 25 bp, Mus musculus
aactgctctggatttctttgacttg

SEQ ID NO: 162916 - DNA, 25 bp, Mus musculus
aactgctgaagacgtgactgcgccc

SEQ ID NO: 162917 - DNA, 25 bp, Mus musculus
aactgctgaagttagacacaccaga

SEQ ID NO: 162918 - DNA, 25 bp, Mus musculus
aactgctgcaacaccagcacagtgg

SEQ ID NO: 162919 - DNA, 25 bp, Mus musculus
aactgctgcatgcagaacccttacc

SEQ ID NO: 162920 - DNA, 25 bp, Mus musculus
aactgctgcatgcagctggtgcaga

SEQ ID NO: 162921 - DNA, 25 bp, Mus musculus
aactgctgctcctccgttccctgcc

SEQ ID NO: 162922 - DNA, 25 bp, Mus musculus
aactgctgcttctggatttatttat

SEQ ID NO: 162923 - DNA, 25 bp, Mus musculus
aactgctgcttctggctggccggcc

SEQ ID NO: 162924 - DNA, 25 bp, Mus musculus
aactgctgcttctgggtgccggtga

SEQ ID NO: 162925 - DNA, 25 bp, Mus musculus
aactgctggatgatcctagcaaaca

SEQ ID NO: 162926 - DNA, 25 bp, Mus musculus
aactgctggatgatgaagttctcat

SEQ ID NO: 162927 - DNA, 25 bp, Mus musculus
aactgctgggcagctccagatgaaa

SEQ ID NO: 162928 - DNA, 25 bp, Mus musculus
aactgctgtctccaggtgacattcc

SEQ ID NO: 162929 - DNA, 25 bp, Mus musculus
aactgcttaaacaaggtgattctgc

SEQ ID NO: 162930 - DNA, 25 bp, Mus musculus
aactgcttccctgtgctggtccaca

SEQ ID NO: 162931 - DNA, 25 bp, Mus musculus
aactgcttccctgtggtattattca

SEQ ID NO: 162932 - DNA, 25 bp, Mus musculus
aactgcttggaaggctgcccaccaa

SEQ ID NO: 162933 - DNA, 25 bp, Mus musculus
aactgcttgtataagctggaaaaca

SEQ ID NO: 162934 - DNA, 25 bp, Mus musculus
aactggaaagaatgtcttgattgtt

SEQ ID NO: 162935 - DNA, 25 bp, Mus musculus
aactggaaaggatataattgacact

SEQ ID NO: 162936 - DNA, 25 bp, Mus musculus
aactggaagcaggacaacaatcctc

SEQ ID NO: 162937 - DNA, 25 bp, Mus musculus
aactggaatgaggccctgctccctg

SEQ ID NO: 162938 - DNA, 25 bp, Mus musculus
aactggacaaagaaacaacttcctg

SEQ ID NO: 162939 - DNA, 25 bp, Mus musculus
aactggacaaaggactgaggtctgg

SEQ ID NO: 162940 - DNA, 25 bp, Mus musculus
aactggacaaaggatgttgggaagt

SEQ ID NO: 162941 - DNA, 25 bp, Mus musculus
aactggacaagaaggagaagatccg

SEQ ID NO: 162942 - DNA, 25 bp, Mus musculus
aactggacaaggccctgtgtgctgc

SEQ ID NO: 162943 - DNA, 25 bp, Mus musculus
aactggacaagtgtcttcttggtgt

SEQ ID NO: 162944 - DNA, 25 bp, Mus musculus
aactggacagagccaatgcagagat

SEQ ID NO: 162945 - DNA, 25 bp, Mus musculus
aactggacaggtacctctaagtcag

SEQ ID NO: 162946 - DNA, 25 bp, Mus musculus
aactggacctccggggatataaaat

SEQ ID NO: 162947 - DNA, 25 bp, Mus musculus
aactggacctgacaggtgatctgga

SEQ ID NO: 162948 - DNA, 25 bp, Mus musculus
aactggactctaaactggtcagcct

SEQ ID NO: 162949 - DNA, 25 bp, Mus musculus
aactggagacaatggtctgtgggag

SEQ ID NO: 162950 - DNA, 25 bp, Mus musculus
aactggagacagcaggcacaccaag

SEQ ID NO: 162951 - DNA, 25 bp, Mus musculus
aactggagccaccccaaatctgcca

SEQ ID NO: 162952 - DNA, 25 bp, Mus musculus
aactggagcgctgctgggaacgctt

SEQ ID NO: 162953 - DNA, 25 bp, Mus musculus
aactggagcgtctggtgctacaagt

SEQ ID NO: 162954 - DNA, 25 bp, Mus musculus
aactggagctgatagaaacatcttt

SEQ ID NO: 162955 - DNA, 25 bp, Mus musculus
aactggagctgccagcatttgacat

SEQ ID NO: 162956 - DNA, 25 bp, Mus musculus
aactggagcttgcaggaataacaga

SEQ ID NO: 162957 - DNA, 25 bp, Mus musculus
aactggaggacaagggcaggattct

SEQ ID NO: 162958 - DNA, 25 bp, Mus musculus
aactggaggacaaggtgactgcaaa

SEQ ID NO: 162959 - DNA, 25 bp, Mus musculus
aactggagttacagcttcgttacga

SEQ ID NO: 162960 - DNA, 25 bp, Mus musculus
aactggataacagtgcctccggagc

SEQ ID NO: 162961 - DNA, 25 bp, Mus musculus
aactggatgaaggacattgatggtg

SEQ ID NO: 162962 - DNA, 25 bp, Mus musculus
aactggatgatacctggaaaaatgg

SEQ ID NO: 162963 - DNA, 25 bp, Mus musculus
aactggatgcagaccttcaatttgg

SEQ ID NO: 162964 - DNA, 25 bp, Mus musculus
aactggcaagcctctatggaaggag

SEQ ID NO: 162965 - DNA, 25 bp, Mus musculus
aactggcaagtttacaggctggtga

SEQ ID NO: 162966 - DNA, 25 bp, Mus musculus
aactggcaccagctggagaacatag

SEQ ID NO: 162967 - DNA, 25 bp, Mus musculus
aactggcactggacagagagagatg

SEQ ID NO: 162968 - DNA, 25 bp, Mus musculus
aactggcactggacaggtacctcta

SEQ ID NO: 162969 - DNA, 25 bp, Mus musculus
aactggcagaacagctgattttact

SEQ ID NO: 162970 - DNA, 25 bp, Mus musculus
aactggcagccagcgctcctgttgt

SEQ ID NO: 162971 - DNA, 25 bp, Mus musculus
aactggcagggagatctgctggcag

SEQ ID NO: 162972 - DNA, 25 bp, Mus musculus
aactggccacaatttactggtttac

SEQ ID NO: 162973 - DNA, 25 bp, Mus musculus
aactggccagacaccttgttgccaa

SEQ ID NO: 162974 - DNA, 25 bp, Mus musculus
aactggccagagagcaatggaagta

SEQ ID NO: 162975 - DNA, 25 bp, Mus musculus
aactggccagaggacacggatgctc

SEQ ID NO: 162976 - DNA, 25 bp, Mus musculus
aactggccagatccgtctaccttga

SEQ ID NO: 162977 - DNA, 25 bp, Mus musculus
aactggccagccccctgcctttcta

SEQ ID NO: 162978 - DNA, 25 bp, Mus musculus
aactggccagttcagcttccaaagg

SEQ ID NO: 162979 - DNA, 25 bp, Mus musculus
aactggccagttcaggatttccact

SEQ ID NO: 162980 - DNA, 25 bp, Mus musculus
aactggcctgaagacattgtctttc

SEQ ID NO: 162981 - DNA, 25 bp, Mus musculus
aactggccttccacgagttcgagga

SEQ ID NO: 162982 - DNA, 25 bp, Mus musculus
aactggcgacaggcccacatgcagg

SEQ ID NO: 162983 - DNA, 25 bp, Mus musculus
aactggcgacaggctctgatgggcg

SEQ ID NO: 162984 - DNA, 25 bp, Mus musculus
aactggcgcctagagaagcctcccc

SEQ ID NO: 162985 - DNA, 25 bp, Mus musculus
aactggcggaagctcaagatgacag

SEQ ID NO: 162986 - DNA, 25 bp, Mus musculus
aactggctacctttctgaaggacgg

SEQ ID NO: 162987 - DNA, 25 bp, Mus musculus
aactggctcaacagatccaaaaggt

SEQ ID NO: 162988 - DNA, 25 bp, Mus musculus
aactggctcatcagccacggcaagc

SEQ ID NO: 162989 - DNA, 25 bp, Mus musculus
aactggctgaaagataagcccctgg

SEQ ID NO: 162990 - DNA, 25 bp, Mus musculus
aactggctgactgctgatctgcctg

SEQ ID NO: 162991 - DNA, 25 bp, Mus musculus
aactggctgactgctgtacacttcc

SEQ ID NO: 162992 - DNA, 25 bp, Mus musculus
aactggctgactgctgtagtggatc

SEQ ID NO: 162993 - DNA, 25 bp, Mus musculus
aactggctgggtggaaccaggccca

SEQ ID NO: 162994 - DNA, 25 bp, Mus musculus
aactgggaaaccatgtggtgctcta

SEQ ID NO: 162995 - DNA, 25 bp, Mus musculus
aactgggaaagggagccttctctgt

SEQ ID NO: 162996 - DNA, 25 bp, Mus musculus
aactgggaaatgatgagaatggctt

SEQ ID NO: 162997 - DNA, 25 bp, Mus musculus
aactgggaaatgatgtggttgagaa

SEQ ID NO: 162998 - DNA, 25 bp, Mus musculus
aactgggaccgtgcctgcaggtgta

SEQ ID NO: 162999 - DNA, 25 bp, Mus musculus
aactgggaggagcagatattcagtg

SEQ ID NO: 163000 - DNA, 25 bp, Mus musculus
aactgggcacgccggagctccctgt

SEQ ID NO: 163001 - DNA, 25 bp, Mus musculus
aactgggcagaatgaacacgaaagc

SEQ ID NO: 163002 - DNA, 25 bp, Mus musculus
aactgggcagagaagaatatcaaga

SEQ ID NO: 163003 - DNA, 25 bp, Mus musculus
aactgggccgctctctgcctctctc

SEQ ID NO: 163004 - DNA, 25 bp, Mus musculus
aactgggcgtctgggcaagacctgc

SEQ ID NO: 163005 - DNA, 25 bp, Mus musculus
aactgggctgttttggtgtgcacat

SEQ ID NO: 163006 - DNA, 25 bp, Mus musculus
aactgggcttcttggtgtctgaccg

SEQ ID NO: 163007 - DNA, 25 bp, Mus musculus
aactgggcttgcagattttcttcta

SEQ ID NO: 163008 - DNA, 25 bp, Mus musculus
aactggggcgatccggaacctggtg

SEQ ID NO: 163009 - DNA, 25 bp, Mus musculus
aactggggcgatccgggaaggccat

SEQ ID NO: 163010 - DNA, 25 bp, Mus musculus
aactgggtcaaggacacggcaaatg

SEQ ID NO: 163011 - DNA, 25 bp, Mus musculus
aactgggtcaagtcaccctgtgaag

SEQ ID NO: 163012 - DNA, 25 bp, Mus musculus
aactggtacagtacaatatctccct

SEQ ID NO: 163013 - DNA, 25 bp, Mus musculus
aactggtatgatcctcatgggtgtt

SEQ ID NO: 163014 - DNA, 25 bp, Mus musculus
aactggtgaagcttatgtgcgagct

SEQ ID NO: 163015 - DNA, 25 bp, Mus musculus
aactggtgactactggaataccagt

SEQ ID NO: 163016 - DNA, 25 bp, Mus musculus
aactggtgcccagggtgctggtgtt

SEQ ID NO: 163017 - DNA, 25 bp, Mus musculus
aactggttgccaagaaggggtagag

SEQ ID NO: 163018 - DNA, 25 bp, Mus musculus
aactggtttatcagagatttgaagt

SEQ ID NO: 163019 - DNA, 25 bp, Mus musculus
aactggtttatcaggacccagcatg

SEQ ID NO: 163020 - DNA, 25 bp, Mus musculus
aactgtaaataggtttgagtacagt

SEQ ID NO: 163021 - DNA, 25 bp, Mus musculus
aactgtaaccgtgggactcgatctg

SEQ ID NO: 163022 - DNA, 25 bp, Mus musculus
aactgtaataaggatgaggctgtgg

SEQ ID NO: 163023 - DNA, 25 bp, Mus musculus
aactgtaccatccctgagatctgga

SEQ ID NO: 163024 - DNA, 25 bp, Mus musculus
aactgtaccatcgctgagatctgga

SEQ ID NO: 163025 - DNA, 25 bp, Mus musculus
aactgtacctatggagtaatggttc

SEQ ID NO: 163026 - DNA, 25 bp, Mus musculus
aactgtacctatggatgtgctgggc

SEQ ID NO: 163027 - DNA, 25 bp, Mus musculus
aactgtacgcggagactgcggccca

SEQ ID NO: 163028 - DNA, 25 bp, Mus musculus
aactgtagacctggccttccctccg

SEQ ID NO: 163029 - DNA, 25 bp, Mus musculus
aactgtatcagctgcgaatccctcg

SEQ ID NO: 163030 - DNA, 25 bp, Mus musculus
aactgtatgaccagaattatcccat

SEQ ID NO: 163031 - DNA, 25 bp, Mus musculus
aactgtatgcagaaatttacacaga

SEQ ID NO: 163032 - DNA, 25 bp, Mus musculus
aactgtatgcagcatctgtctgagc

SEQ ID NO: 163033 - DNA, 25 bp, Mus musculus
aactgtatttggaataaccacagtc

SEQ ID NO: 163034 - DNA, 25 bp, Mus musculus
aactgtccagggccaaggaatatgt

SEQ ID NO: 163035 - DNA, 25 bp, Mus musculus
aactgtccagggtgaccaacgccag

SEQ ID NO: 163036 - DNA, 25 bp, Mus musculus
aactgtccgggggcctcgcctgctc

SEQ ID NO: 163037 - DNA, 25 bp, Mus musculus
aactgtcctgatgaggtttatcagc

SEQ ID NO: 163038 - DNA, 25 bp, Mus musculus
aactgtcgaggaagttttctgaaaa

SEQ ID NO: 163039 - DNA, 25 bp, Mus musculus
aactgtctaaattgatcagggacca

SEQ ID NO: 163040 - DNA, 25 bp, Mus musculus
aactgtctccgattttactcctaaa

SEQ ID NO: 163041 - DNA, 25 bp, Mus musculus
aactgtctttatccgtctaccttga

SEQ ID NO: 163042 - DNA, 25 bp, Mus musculus
aactgtgaacgaagggaacaagtca

SEQ ID NO: 163043 - DNA, 25 bp, Mus musculus
aactgtgaagtgctttgtttaattg

SEQ ID NO: 163044 - DNA, 25 bp, Mus musculus
aactgtgaattagatgcaacgtgta

SEQ ID NO: 163045 - DNA, 25 bp, Mus musculus
aactgtgaattgtagcaccatcccg

SEQ ID NO: 163046 - DNA, 25 bp, Mus musculus
aactgtgacaactgtgatgatccgg

SEQ ID NO: 163047 - DNA, 25 bp, Mus musculus
aactgtgaccatggtttgggatcaa

SEQ ID NO: 163048 - DNA, 25 bp, Mus musculus
aactgtgactccaaacatccagaac

SEQ ID NO: 163049 - DNA, 25 bp, Mus musculus
aactgtgagtggacatcatcgaagg

SEQ ID NO: 163050 - DNA, 25 bp, Mus musculus
aactgtgcaggctatgtggtggttg

SEQ ID NO: 163051 - DNA, 25 bp, Mus musculus
aactgtgcaggtgacagtaaccagc

SEQ ID NO: 163052 - DNA, 25 bp, Mus musculus
aactgtggaacaggtcccctgttcc

SEQ ID NO: 163053 - DNA, 25 bp, Mus musculus
aactgtggaagattcttgacaagtg

SEQ ID NO: 163054 - DNA, 25 bp, Mus musculus
aactgtggagaagggtcaactgctg

SEQ ID NO: 163055 - DNA, 25 bp, Mus musculus
aactgtggagaagggtttcaaagct

SEQ ID NO: 163056 - DNA, 25 bp, Mus musculus
aactgtggaggcagctgtgtctgag

SEQ ID NO: 163057 - DNA, 25 bp, Mus musculus
aactgtggagtatcacggtgatcgt

SEQ ID NO: 163058 - DNA, 25 bp, Mus musculus
aactgtgggcagaaatccctagcct

SEQ ID NO: 163059 - DNA, 25 bp, Mus musculus
aactgtgtaggtgcaggcaaccata

SEQ ID NO: 163060 - DNA, 25 bp, Mus musculus
aactgtgtcgctcctgggaccattt

SEQ ID NO: 163061 - DNA, 25 bp, Mus musculus
aactgtgtgcggagactgcggccca

SEQ ID NO: 163062 - DNA, 25 bp, Mus musculus
aactgtgtggacatcaacgaatgca

SEQ ID NO: 163063 - DNA, 25 bp, Mus musculus
aactgtgttagactttcctggaacg

SEQ ID NO: 163064 - DNA, 25 bp, Mus musculus
aactgtgtttggagtaacaactgtt

SEQ ID NO: 163065 - DNA, 25 bp, Mus musculus
aactgttaccggaacagaaatcatc

SEQ ID NO: 163066 - DNA, 25 bp, Mus musculus
aactgttaccggaacggcacgacgc

SEQ ID NO: 163067 - DNA, 25 bp, Mus musculus
aactgttacgaaatctcataagcgc

SEQ ID NO: 163068 - DNA, 25 bp, Mus musculus
aactgttacgatccatcttttttgt

SEQ ID NO: 163069 - DNA, 25 bp, Mus musculus
aactgttattccagcccaggaggaa

SEQ ID NO: 163070 - DNA, 25 bp, Mus musculus
aactgttcaagaatgccatgagagc

SEQ ID NO: 163071 - DNA, 25 bp, Mus musculus
aactgttcaagctgggaggcaccat

SEQ ID NO: 163072 - DNA, 25 bp, Mus musculus
aactgttcaagttgtcccccatatt

SEQ ID NO: 163073 - DNA, 25 bp, Mus musculus
aactgttcagacgcctccttggcat

SEQ ID NO: 163074 - DNA, 25 bp, Mus musculus
aactgttcaggtagcaacaattgca

SEQ ID NO: 163075 - DNA, 25 bp, Mus musculus
aactgttctaaaggtgctttccagc

SEQ ID NO: 163076 - DNA, 25 bp, Mus musculus
aactgttgaataagttcgtgtgtaa

SEQ ID NO: 163077 - DNA, 25 bp, Mus musculus
aactgtttaaggaatcacgcctacg

SEQ ID NO: 163078 - DNA, 25 bp, Mus musculus
aactgtttaaggaatccctcttcgg

SEQ ID NO: 163079 - DNA, 25 bp, Mus musculus
aactgtttggaggccaatgaggcga

SEQ ID NO: 163080 - DNA, 25 bp, Mus musculus
aactgttttcacaggaactggtgac

SEQ ID NO: 163081 - DNA, 25 bp, Mus musculus
aactgttttctccaggaaggaactc

SEQ ID NO: 163082 - DNA, 25 bp, Mus musculus
aacttaaaaaggagcttcgacgcac

SEQ ID NO: 163083 - DNA, 25 bp, Mus musculus
aacttaaaaaggtgattgaagcctc

SEQ ID NO: 163084 - DNA, 25 bp, Mus musculus
aacttaaaaaggtgtcctcagatag

SEQ ID NO: 163085 - DNA, 25 bp, Mus musculus
aacttaaaagatactgagagaagtg

SEQ ID NO: 163086 - DNA, 25 bp, Mus musculus
aacttaaaagatgattcataatacc

SEQ ID NO: 163087 - DNA, 25 bp, Mus musculus
aacttaaacataaaggtgactgatt

SEQ ID NO: 163088 - DNA, 25 bp, Mus musculus
aacttaaattgagtaggaagagtgg

SEQ ID NO: 163089 - DNA, 25 bp, Mus musculus
aacttaacagcaggctctctggagt

SEQ ID NO: 163090 - DNA, 25 bp, Mus musculus
aacttaacagtgaaagatttccgag

SEQ ID NO: 163091 - DNA, 25 bp, Mus musculus
aacttaacagtgaggaatgatattg

SEQ ID NO: 163092 - DNA, 25 bp, Mus musculus
aacttaaggagagctaacatttaga

SEQ ID NO: 163093 - DNA, 25 bp, Mus musculus
aacttaaggagagctcacattcagg

SEQ ID NO: 163094 - DNA, 25 bp, Mus musculus
aacttaatgaggacatggcttgcag

SEQ ID NO: 163095 - DNA, 25 bp, Mus musculus
aacttaatgtaccagctcaaacagg

SEQ ID NO: 163096 - DNA, 25 bp, Mus musculus
aacttaatgtaccagtgtatctcta

SEQ ID NO: 163097 - DNA, 25 bp, Mus musculus
aacttaatgtcagccataacaaact

SEQ ID NO: 163098 - DNA, 25 bp, Mus musculus
aacttacaacaacctgaaggagctc

SEQ ID NO: 163099 - DNA, 25 bp, Mus musculus
aacttacacctcgttttactgcaat

SEQ ID NO: 163100 - DNA, 25 bp, Mus musculus
aacttacagagctatctaaactctg

SEQ ID NO: 163101 - DNA, 25 bp, Mus musculus
aacttacaggaagttgtgccagcca

SEQ ID NO: 163102 - DNA, 25 bp, Mus musculus
aacttacaggaggttgtgccagcca

SEQ ID NO: 163103 - DNA, 25 bp, Mus musculus
aacttacaggccttacttctctata

SEQ ID NO: 163104 - DNA, 25 bp, Mus musculus
aacttacaggtgcttttgggtcgca

SEQ ID NO: 163105 - DNA, 25 bp, Mus musculus
aacttaccagacttggtggttctcc

SEQ ID NO: 163106 - DNA, 25 bp, Mus musculus
aacttaccaggtggatcccactgct

SEQ ID NO: 163107 - DNA, 25 bp, Mus musculus
aacttaccatgaggatccagcaatg

SEQ ID NO: 163108 - DNA, 25 bp, Mus musculus
aacttacctgagagcactgtggaca

SEQ ID NO: 163109 - DNA, 25 bp, Mus musculus
aacttacctgagcacagttcccaga

SEQ ID NO: 163110 - DNA, 25 bp, Mus musculus
aacttacgagagtatttggaggtag

SEQ ID NO: 163111 - DNA, 25 bp, Mus musculus
aacttagaaactcctatcacgctca

SEQ ID NO: 163112 - DNA, 25 bp, Mus musculus
aacttagaggagagccaagttgaag

SEQ ID NO: 163113 - DNA, 25 bp, Mus musculus
aacttagaggaggcacagaccccac

SEQ ID NO: 163114 - DNA, 25 bp, Mus musculus
aacttagcacgaatgtgtgagaaaa

SEQ ID NO: 163115 - DNA, 25 bp, Mus musculus
aacttaggcgtgtataagtgagggg

SEQ ID NO: 163116 - DNA, 25 bp, Mus musculus
aacttagggatggagcctcccaagc

SEQ ID NO: 163117 - DNA, 25 bp, Mus musculus
aacttaggtgctggctacgccgagg

SEQ ID NO: 163118 - DNA, 25 bp, Mus musculus
aacttagtattccaggaaaagatgg

SEQ ID NO: 163119 - DNA, 25 bp, Mus musculus
aacttagtgagtgtgtcccttcttt

SEQ ID NO: 163120 - DNA, 25 bp, Mus musculus
aacttataaaagacggcatccagct

SEQ ID NO: 163121 - DNA, 25 bp, Mus musculus
aacttataaagatgattatagatct

SEQ ID NO: 163122 - DNA, 25 bp, Mus musculus
aacttataagagagatgctaacatt

SEQ ID NO: 163123 - DNA, 25 bp, Mus musculus
aacttataagagaggtagaaatggg

SEQ ID NO: 163124 - DNA, 25 bp, Mus musculus
aacttataaggcgtctcttttctcc

SEQ ID NO: 163125 - DNA, 25 bp, Mus musculus
aacttatccagagttgtttcttgag

SEQ ID NO: 163126 - DNA, 25 bp, Mus musculus
aacttatccagatcacctcagcatc

SEQ ID NO: 163127 - DNA, 25 bp, Mus musculus
aacttatccagtgaagaagttgcaa

SEQ ID NO: 163128 - DNA, 25 bp, Mus musculus
aacttatgacatgatgatgcagtcc

SEQ ID NO: 163129 - DNA, 25 bp, Mus musculus
aacttatggagcggcactggagcaa

SEQ ID NO: 163130 - DNA, 25 bp, Mus musculus
aacttatggagcggtcgtgtatcag

SEQ ID NO: 163131 - DNA, 25 bp, Mus musculus
aacttatggcaggtccaaacatcac

SEQ ID NO: 163132 - DNA, 25 bp, Mus musculus
aacttattattcaagattaaaccag

SEQ ID NO: 163133 - DNA, 25 bp, Mus musculus
aacttattcagagatttcctctgag

SEQ ID NO: 163134 - DNA, 25 bp, Mus musculus
aacttcaaacccagctctgcatgcc

SEQ ID NO: 163135 - DNA, 25 bp, Mus musculus
aacttcaaacccagggcaagacaga

SEQ ID NO: 163136 - DNA, 25 bp, Mus musculus
aacttcaaccgaagtgagtccattc

SEQ ID NO: 163137 - DNA, 25 bp, Mus musculus
aacttcaaccgagttgagtccattc

SEQ ID NO: 163138 - DNA, 25 bp, Mus musculus
aacttcaactccaggcctctagact

SEQ ID NO: 163139 - DNA, 25 bp, Mus musculus
aacttcaactccaggtatctccaca

SEQ ID NO: 163140 - DNA, 25 bp, Mus musculus
aacttcaagaagcatacagtttctt

SEQ ID NO: 163141 - DNA, 25 bp, Mus musculus
aacttcaagaagtaccagtacatat

SEQ ID NO: 163142 - DNA, 25 bp, Mus musculus
aacttcaaggaggtttgcggggagc

SEQ ID NO: 163143 - DNA, 25 bp, Mus musculus
aacttcaaggctgtagagaggcatc

SEQ ID NO: 163144 - DNA, 25 bp, Mus musculus
aacttcaatgaattcctgttccgcc

SEQ ID NO: 163145 - DNA, 25 bp, Mus musculus
aacttcacaccaggagagcactgtg

SEQ ID NO: 163146 - DNA, 25 bp, Mus musculus
aacttcacaccagtcttcgctgata

SEQ ID NO: 163147 - DNA, 25 bp, Mus musculus
aacttcaccatagaaaacgggagtg

SEQ ID NO: 163148 - DNA, 25 bp, Mus musculus
aacttcaccatgcttataggagaca

SEQ ID NO: 163149 - DNA, 25 bp, Mus musculus
aacttcacctaccaggaccctgtcc

SEQ ID NO: 163150 - DNA, 25 bp, Mus musculus
aacttcagaaccaggtgaccaacgc

SEQ ID NO: 163151 - DNA, 25 bp, Mus musculus
aacttcagaaggaataaaagctgtg

SEQ ID NO: 163152 - DNA, 25 bp, Mus musculus
aacttcagacaccaggaagcccctg

SEQ ID NO: 163153 - DNA, 25 bp, Mus musculus
aacttcagcaaggaccataattttg

SEQ ID NO: 163154 - DNA, 25 bp, Mus musculus
aacttcagcagagactccaagaagc

SEQ ID NO: 163155 - DNA, 25 bp, Mus musculus
aacttcaggaaattcactgagggcc

SEQ ID NO: 163156 - DNA, 25 bp, Mus musculus
aacttcagtcccagaagccaaacac

SEQ ID NO: 163157 - DNA, 25 bp, Mus musculus
aacttcagtgcttatccctctgaag

SEQ ID NO: 163158 - DNA, 25 bp, Mus musculus
aacttcatcaacagagctggcatgt

SEQ ID NO: 163159 - DNA, 25 bp, Mus musculus
aacttcatccgaaaggcacagtgtt

SEQ ID NO: 163160 - DNA, 25 bp, Mus musculus
aacttcatccgaaagggactcctct

SEQ ID NO: 163161 - DNA, 25 bp, Mus musculus
aacttcattaagcagaggtgacagc

SEQ ID NO: 163162 - DNA, 25 bp, Mus musculus
aacttcattgatgccaaagacccgg

SEQ ID NO: 163163 - DNA, 25 bp, Mus musculus
aacttccaaagtgggatccggcact

SEQ ID NO: 163164 - DNA, 25 bp, Mus musculus
aacttccaacaggttgactacagtc

SEQ ID NO: 163165 - DNA, 25 bp, Mus musculus
aacttccatatcagctggaaggacg

SEQ ID NO: 163166 - DNA, 25 bp, Mus musculus
aacttcccaaggcactgtgcttgca

SEQ ID NO: 163167 - DNA, 25 bp, Mus musculus
aacttcccagatgctggcttggaga

SEQ ID NO: 163168 - DNA, 25 bp, Mus musculus
aacttccccttcagctcttggggtg

SEQ ID NO: 163169 - DNA, 25 bp, Mus musculus
aacttccccttcaggagtcgctttc

SEQ ID NO: 163170 - DNA, 25 bp, Mus musculus
aacttccccttcaggcctgcctttt

SEQ ID NO: 163171 - DNA, 25 bp, Mus musculus
aacttccgagcgggggaacctgatt

SEQ ID NO: 163172 - DNA, 25 bp, Mus musculus
aacttcctccagacagcctggcagg

SEQ ID NO: 163173 - DNA, 25 bp, Mus musculus
aacttcctccagctgcagaatctgt

SEQ ID NO: 163174 - DNA, 25 bp, Mus musculus
aacttcctccaggactggacagtaa

SEQ ID NO: 163175 - DNA, 25 bp, Mus musculus
aacttcctcgtcccatctctccaac

SEQ ID NO: 163176 - DNA, 25 bp, Mus musculus
aacttcctttcacgtgactgactta

SEQ ID NO: 163177 - DNA, 25 bp, Mus musculus
aacttcgacagtattccggaacctg

SEQ ID NO: 163178 - DNA, 25 bp, Mus musculus
aacttcgaggaatgtttaaatgggt

SEQ ID NO: 163179 - DNA, 25 bp, Mus musculus
aacttcgagggcagagagtctcgct

SEQ ID NO: 163180 - DNA, 25 bp, Mus musculus
aacttcgagggcagagttaatgttc

SEQ ID NO: 163181 - DNA, 25 bp, Mus musculus
aacttcgccaggtcctagagtcgcg

SEQ ID NO: 163182 - DNA, 25 bp, Mus musculus
aacttcgtagaagtgttaaatgaat

SEQ ID NO: 163183 - DNA, 25 bp, Mus musculus
aacttcgtcgttccgccgccaccat

SEQ ID NO: 163184 - DNA, 25 bp, Mus musculus
aacttcgtgcaggtgacccggtttg

SEQ ID NO: 163185 - DNA, 25 bp, Mus musculus
aacttctacaaaggaagtaaccagg

SEQ ID NO: 163186 - DNA, 25 bp, Mus musculus
aacttctacaggtttccgtggacga

SEQ ID NO: 163187 - DNA, 25 bp, Mus musculus
aacttctcagacaattgacatatat

SEQ ID NO: 163188 - DNA, 25 bp, Mus musculus
aacttctcagatttactgaaactaa

SEQ ID NO: 163189 - DNA, 25 bp, Mus musculus
aacttctcaggggcagatttactga

SEQ ID NO: 163190 - DNA, 25 bp, Mus musculus
aacttctcataaaaatggatgagac

SEQ ID NO: 163191 - DNA, 25 bp, Mus musculus
aacttctcataaaattcccatggct

SEQ ID NO: 163192 - DNA, 25 bp, Mus musculus
aacttctccagaaagcttccctggc

SEQ ID NO: 163193 - DNA, 25 bp, Mus musculus
aacttctccagaagcttccctgttt

SEQ ID NO: 163194 - DNA, 25 bp, Mus musculus
aacttctccagaggcaagttcaagg

SEQ ID NO: 163195 - DNA, 25 bp, Mus musculus
aacttctccaggtttggaggagacc

SEQ ID NO: 163196 - DNA, 25 bp, Mus musculus
aacttctcctcagtgtttacaaaat

SEQ ID NO: 163197 - DNA, 25 bp, Mus musculus
aacttctctatctgccaaagtaaac

SEQ ID NO: 163198 - DNA, 25 bp, Mus musculus
aacttctgaaacttacttacagcta

SEQ ID NO: 163199 - DNA, 25 bp, Mus musculus
aacttctgatgtttcttccagcaag

SEQ ID NO: 163200 - DNA, 25 bp, Mus musculus
aacttctgcctagcatcaacgatat

SEQ ID NO: 163201 - DNA, 25 bp, Mus musculus
aacttctgcctaggtatgtctatat

SEQ ID NO: 163202 - DNA, 25 bp, Mus musculus
aacttctgcctaggtcctcaacttt

SEQ ID NO: 163203 - DNA, 25 bp, Mus musculus
aacttctggcagagacttggcagtg

SEQ ID NO: 163204 - DNA, 25 bp, Mus musculus
aacttctggcagaggcattgaagac

SEQ ID NO: 163205 - DNA, 25 bp, Mus musculus
aacttctgggccaacaaattactcc

SEQ ID NO: 163206 - DNA, 25 bp, Mus musculus
aacttcttcaaaggatcccagagag

SEQ ID NO: 163207 - DNA, 25 bp, Mus musculus
aacttcttcagaaggtcgtgaaaat

SEQ ID NO: 163208 - DNA, 25 bp, Mus musculus
aacttcttccagagaatttgtttca

SEQ ID NO: 163209 - DNA, 25 bp, Mus musculus
aacttcttccagcttcacccctcat

SEQ ID NO: 163210 - DNA, 25 bp, Mus musculus
aacttcttccaggctgaaggaagga

SEQ ID NO: 163211 - DNA, 25 bp, Mus musculus
aacttcttgacagggtcctgcaggc

SEQ ID NO: 163212 - DNA, 25 bp, Mus musculus
aacttctttaccaggtatgactacg

SEQ ID NO: 163213 - DNA, 25 bp, Mus musculus
aacttctttactatgcggagcaact

SEQ ID NO: 163214 - DNA, 25 bp, Mus musculus
aacttctttcgggaggcagcccgcg

SEQ ID NO: 163215 - DNA, 25 bp, Mus musculus
aacttctttcggtgaagaatgctcg

SEQ ID NO: 163216 - DNA, 25 bp, Mus musculus
aacttctttgaggaggtattcacag

SEQ ID NO: 163217 - DNA, 25 bp, Mus musculus
aacttcttttcacaatgctcatgat

SEQ ID NO: 163218 - DNA, 25 bp, Mus musculus
aacttgaaaagcaagaacgggagaa

SEQ ID NO: 163219 - DNA, 25 bp, Mus musculus
aacttgaaaagtttgataacttaca

SEQ ID NO: 163220 - DNA, 25 bp, Mus musculus
aacttgaaactgaagaagctattgc

SEQ ID NO: 163221 - DNA, 25 bp, Mus musculus
aacttgaaactgaagaagctcataa

SEQ ID NO: 163222 - DNA, 25 bp, Mus musculus
aacttgaaagagtcacatcagtttc

SEQ ID NO: 163223 - DNA, 25 bp, Mus musculus
aacttgaaagctatccttcaccagc

SEQ ID NO: 163224 - DNA, 25 bp, Mus musculus
aacttgaaagcttatctgagtccat

SEQ ID NO: 163225 - DNA, 25 bp, Mus musculus
aacttgaacaatgattttgtggtgg

SEQ ID NO: 163226 - DNA, 25 bp, Mus musculus
aacttgaacaatgttatgatggtta

SEQ ID NO: 163227 - DNA, 25 bp, Mus musculus
aacttgaagaaaaggaaatgttatt

SEQ ID NO: 163228 - DNA, 25 bp, Mus musculus
aacttgaagaaaaggaagatgagga

SEQ ID NO: 163229 - DNA, 25 bp, Mus musculus
aacttgacaggcttagaatcagact

SEQ ID NO: 163230 - DNA, 25 bp, Mus musculus
aacttgagagctttggatatacaac

SEQ ID NO: 163231 - DNA, 25 bp, Mus musculus
aacttgatatcatccgagttagaac

SEQ ID NO: 163232 - DNA, 25 bp, Mus musculus
aacttgatgaaattacttctgaaaa

SEQ ID NO: 163233 - DNA, 25 bp, Mus musculus
aacttgatgaaattatacgacctcc

SEQ ID NO: 163234 - DNA, 25 bp, Mus musculus
aacttgatgaagaagatgaagtgga

SEQ ID NO: 163235 - DNA, 25 bp, Mus musculus
aacttgatgaagagtcagaagatga

SEQ ID NO: 163236 - DNA, 25 bp, Mus musculus
aacttgcagatcagacccagcatgt

SEQ ID NO: 163237 - DNA, 25 bp, Mus musculus
aacttgccaagaacatactaaaagc

SEQ ID NO: 163238 - DNA, 25 bp, Mus musculus
aacttgcccaaggagaatgacccca

SEQ ID NO: 163239 - DNA, 25 bp, Mus musculus
aacttgcccaaggagttctggcagg

SEQ ID NO: 163240 - DNA, 25 bp, Mus musculus
aacttgctccctcgcttagcgctct

SEQ ID NO: 163241 - DNA, 25 bp, Mus musculus
aacttgctgttctttatcctgggtg

SEQ ID NO: 163242 - DNA, 25 bp, Mus musculus
aacttggaccgcagccctctgccag

SEQ ID NO: 163243 - DNA, 25 bp, Mus musculus
aacttggaccggaactgtccgactg

SEQ ID NO: 163244 - DNA, 25 bp, Mus musculus
aacttggagagtggacagaaaacat

SEQ ID NO: 163245 - DNA, 25 bp, Mus musculus
aacttgggttgtaggcttctccagt

SEQ ID NO: 163246 - DNA, 25 bp, Mus musculus
aacttggtccaggcaaacagggagg

SEQ ID NO: 163247 - DNA, 25 bp, Mus musculus
aacttggtggatggatgagtttcat

SEQ ID NO: 163248 - DNA, 25 bp, Mus musculus
aacttgtaaagcttgtagaccctgg

SEQ ID NO: 163249 - DNA, 25 bp, Mus musculus
aacttgtaaagtcccacgagtccta

SEQ ID NO: 163250 - DNA, 25 bp, Mus musculus
aacttgtagctgttctagtaagcag

SEQ ID NO: 163251 - DNA, 25 bp, Mus musculus
aacttgtagtagacccttaagccct

SEQ ID NO: 163252 - DNA, 25 bp, Mus musculus
aacttgtccaaacataggaattcca

SEQ ID NO: 163253 - DNA, 25 bp, Mus musculus
aacttgtccaaacatgactttctgg

SEQ ID NO: 163254 - DNA, 25 bp, Mus musculus
aacttgtccaatttcgaggactcca

SEQ ID NO: 163255 - DNA, 25 bp, Mus musculus
aacttgtccatggaggtcttcactt

SEQ ID NO: 163256 - DNA, 25 bp, Mus musculus
aacttgtccattttgttgcatattc

SEQ ID NO: 163257 - DNA, 25 bp, Mus musculus
aacttgtcgaaccacactaaacaag

SEQ ID NO: 163258 - DNA, 25 bp, Mus musculus
aacttgtgaatggaggttggagacc

SEQ ID NO: 163259 - DNA, 25 bp, Mus musculus
aacttgtgaggttctctaatgatct

SEQ ID NO: 163260 - DNA, 25 bp, Mus musculus
aacttgtgggaagctcccctatttt

SEQ ID NO: 163261 - DNA, 25 bp, Mus musculus
aacttgtgggaagggcatttgtgta

SEQ ID NO: 163262 - DNA, 25 bp, Mus musculus
aacttgttaaggctcaggccatcca

SEQ ID NO: 163263 - DNA, 25 bp, Mus musculus
aacttgttgttgagccaccttctcc

SEQ ID NO: 163264 - DNA, 25 bp, Mus musculus
aacttgttgttgaggcagcatatta

SEQ ID NO: 163265 - DNA, 25 bp, Mus musculus
aacttgtttgaatggtaaatgatct

SEQ ID NO: 163266 - DNA, 25 bp, Mus musculus
aactttaatgtagaaagattaatgg

SEQ ID NO: 163267 - DNA, 25 bp, Mus musculus
aactttagctcggttttgtacaaag

SEQ ID NO: 163268 - DNA, 25 bp, Mus musculus
aactttcagccgatcaacttctgag

SEQ ID NO: 163269 - DNA, 25 bp, Mus musculus
aactttcagtgggtggtgatagtga

SEQ ID NO: 163270 - DNA, 25 bp, Mus musculus
aactttcatagatcctgaagggtcc

SEQ ID NO: 163271 - DNA, 25 bp, Mus musculus
aactttccactatttgctgcctgcg

SEQ ID NO: 163272 - DNA, 25 bp, Mus musculus
aactttccagacccagcatgtagtc

SEQ ID NO: 163273 - DNA, 25 bp, Mus musculus
aactttctccaagatggcctagact

SEQ ID NO: 163274 - DNA, 25 bp, Mus musculus
aactttctccaaggtggcctagact

SEQ ID NO: 163275 - DNA, 25 bp, Mus musculus
aactttctgcagcctccatctcacc

SEQ ID NO: 163276 - DNA, 25 bp, Mus musculus
aactttgaatgctcacactgcctcc

SEQ ID NO: 163277 - DNA, 25 bp, Mus musculus
aactttgacaagatcctggctgagt

SEQ ID NO: 163278 - DNA, 25 bp, Mus musculus
aactttgacctcaaggtcctaaatg

SEQ ID NO: 163279 - DNA, 25 bp, Mus musculus
aactttgatgtcctagcagggcggt

SEQ ID NO: 163280 - DNA, 25 bp, Mus musculus
aactttgcaggataaggtagctaaa

SEQ ID NO: 163281 - DNA, 25 bp, Mus musculus
aactttgcggagatgatgatggact

SEQ ID NO: 163282 - DNA, 25 bp, Mus musculus
aactttgcgggtgagatggattctc

SEQ ID NO: 163283 - DNA, 25 bp, Mus musculus
aactttgggatgaaggtgactgtcc

SEQ ID NO: 163284 - DNA, 25 bp, Mus musculus
aactttgtaagagaaataaagaaag

SEQ ID NO: 163285 - DNA, 25 bp, Mus musculus
aactttgtagccatcctcccgccac

SEQ ID NO: 163286 - DNA, 25 bp, Mus musculus
aactttgtagttggtgatgatgaaa

SEQ ID NO: 163287 - DNA, 25 bp, Mus musculus
aactttgtcaagtccaagacaggcc

SEQ ID NO: 163288 - DNA, 25 bp, Mus musculus
aactttgtggacctctgcagggccc

SEQ ID NO: 163289 - DNA, 25 bp, Mus musculus
aactttgttatggctgaatcagaga

SEQ ID NO: 163290 - DNA, 25 bp, Mus musculus
aactttgttttccagccaaatagag

SEQ ID NO: 163291 - DNA, 25 bp, Mus musculus
aacttttacaagacagtccagcagc

SEQ ID NO: 163292 - DNA, 25 bp, Mus musculus
aacttttacaaggtggtacagcaac

SEQ ID NO: 163293 - DNA, 25 bp, Mus musculus
aacttttatggccttgaactcagaa

SEQ ID NO: 163294 - DNA, 25 bp, Mus musculus
aacttttcagctgccaaaagcctat

SEQ ID NO: 163295 - DNA, 25 bp, Mus musculus
aacttttcagttggcaggcagagct

SEQ ID NO: 163296 - DNA, 25 bp, Mus musculus
aacttttccagtgtgtccattgtcc

SEQ ID NO: 163297 - DNA, 25 bp, Mus musculus
aacttttccatgatcatcgatggcg

SEQ ID NO: 163298 - DNA, 25 bp, Mus musculus
aacttttcttgagcgttggtgatga

SEQ ID NO: 163299 - DNA, 25 bp, Mus musculus
aacttttcttgagtgattccacaca

SEQ ID NO: 163300 - DNA, 25 bp, Mus musculus
aacttttttgctctctggagccaat

SEQ ID NO: 163301 - DNA, 25 bp, Mus musculus
aacttttttgtaagaagacaagatg

SEQ ID NO: 163302 - DNA, 25 bp, Mus musculus
aagaaaaaaagaccccagcgcatct

SEQ ID NO: 163303 - DNA, 25 bp, Mus musculus
aagaaaaaaattgacatcctgctga

SEQ ID NO: 163304 - DNA, 25 bp, Mus musculus
aagaaaaacaaagggaatgtgacta

SEQ ID NO: 163305 - DNA, 25 bp, Mus musculus
aagaaaaacaaatgcaatttcaagt

SEQ ID NO: 163306 - DNA, 25 bp, Mus musculus
aagaaaaacaagagacagaaccctg

SEQ ID NO: 163307 - DNA, 25 bp, Mus musculus
aagaaaaacaagagagtctcactat

SEQ ID NO: 163308 - DNA, 25 bp, Mus musculus
aagaaaaacaagagcagtcagcacg

SEQ ID NO: 163309 - DNA, 25 bp, Mus musculus
aagaaaaacaagagggtggagatgg

SEQ ID NO: 163310 - DNA, 25 bp, Mus musculus
aagaaaaacaagggaagcttagata

SEQ ID NO: 163311 - DNA, 25 bp, Mus musculus
aagaaaaaccagaaccagatggaag

SEQ ID NO: 163312 - DNA, 25 bp, Mus musculus
aagaaaaaccagaagaacaggagaa

SEQ ID NO: 163313 - DNA, 25 bp, Mus musculus
aagaaaaaccagaagcctgtgccat

SEQ ID NO: 163314 - DNA, 25 bp, Mus musculus
aagaaaaataaattcggagctgtct

SEQ ID NO: 163315 - DNA, 25 bp, Mus musculus
aagaaaacaaaaagtgtgaacatgg

SEQ ID NO: 163316 - DNA, 25 bp, Mus musculus
aagaaaacaaagaactgcggacatc

SEQ ID NO: 163317 - DNA, 25 bp, Mus musculus
aagaaaacagagaaacctgatcagg

SEQ ID NO: 163318 - DNA, 25 bp, Mus musculus
aagaaaacagagacgaagacatcat

SEQ ID NO: 163319 - DNA, 25 bp, Mus musculus
aagaaaacagatgatccagaggagt

SEQ ID NO: 163320 - DNA, 25 bp, Mus musculus
aagaaaacagatggtacaaagaagc

SEQ ID NO: 163321 - DNA, 25 bp, Mus musculus
aagaaaacagccccttcgaggaatt

SEQ ID NO: 163322 - DNA, 25 bp, Mus musculus
aagaaaacagctttgtttactagcg

SEQ ID NO: 163323 - DNA, 25 bp, Mus musculus
aagaaaacaggctatggtgaaataa

SEQ ID NO: 163324 - DNA, 25 bp, Mus musculus
aagaaaacagtgacaacataagatc

SEQ ID NO: 163325 - DNA, 25 bp, Mus musculus
aagaaaacagtgctctgcagttttg

SEQ ID NO: 163326 - DNA, 25 bp, Mus musculus
aagaaaacagttgagtggtaccgaa

SEQ ID NO: 163327 - DNA, 25 bp, Mus musculus
aagaaaacataacaacattcccgtc

SEQ ID NO: 163328 - DNA, 25 bp, Mus musculus
aagaaaacatcaaggaacaataaaa

SEQ ID NO: 163329 - DNA, 25 bp, Mus musculus
aagaaaaccaacagggcatgaaaga

SEQ ID NO: 163330 - DNA, 25 bp, Mus musculus
aagaaaaccttcagttggatcctcc

SEQ ID NO: 163331 - DNA, 25 bp, Mus musculus
aagaaaactatgcaggtgtgcattg

SEQ ID NO: 163332 - DNA, 25 bp, Mus musculus
aagaaaactgcaaagaaccgggtgg

SEQ ID NO: 163333 - DNA, 25 bp, Mus musculus
aagaaaactgtggcaacataacatg

SEQ ID NO: 163334 - DNA, 25 bp, Mus musculus
aagaaaactgttcattcgtatcttg

SEQ ID NO: 163335 - DNA, 25 bp, Mus musculus
aagaaaagaaagaatgcgtccacca

SEQ ID NO: 163336 - DNA, 25 bp, Mus musculus
aagaaaagactatctaagctggaac

SEQ ID NO: 163337 - DNA, 25 bp, Mus musculus
aagaaaagaggagcgctggccgccg

SEQ ID NO: 163338 - DNA, 25 bp, Mus musculus
aagaaaagctgagagaaacgaagtg

SEQ ID NO: 163339 - DNA, 25 bp, Mus musculus
aagaaaagctgcaagctttcagaaa

SEQ ID NO: 163340 - DNA, 25 bp, Mus musculus
aagaaaagctgcaagttgcagaatt

SEQ ID NO: 163341 - DNA, 25 bp, Mus musculus
aagaaaaggcagcattctcatacaa

SEQ ID NO: 163342 - DNA, 25 bp, Mus musculus
aagaaaaggccagcctgccgggagt

SEQ ID NO: 163343 - DNA, 25 bp, Mus musculus
aagaaaagtgatgggattcgaagag

SEQ ID NO: 163344 - DNA, 25 bp, Mus musculus
aagaaaataaagaataaactagaca

SEQ ID NO: 163345 - DNA, 25 bp, Mus musculus
aagaaaataagtaccatgaaagcag

SEQ ID NO: 163346 - DNA, 25 bp, Mus musculus
aagaaaatactgaattttctcagcg

SEQ ID NO: 163347 - DNA, 25 bp, Mus musculus
aagaaaatagctccggtacctcgcg

SEQ ID NO: 163348 - DNA, 25 bp, Mus musculus
aagaaaatatggccaacagcaggct

SEQ ID NO: 163349 - DNA, 25 bp, Mus musculus
aagaaaatatggctttacaagatga

SEQ ID NO: 163350 - DNA, 25 bp, Mus musculus
aagaaaatattgaagtttaccatag

SEQ ID NO: 163351 - DNA, 25 bp, Mus musculus
aagaaaatatttagattgaggatgg

SEQ ID NO: 163352 - DNA, 25 bp, Mus musculus
aagaaaatcatatgtgacaaataca

SEQ ID NO: 163353 - DNA, 25 bp, Mus musculus
aagaaaatccagcagacccgagaag

SEQ ID NO: 163354 - DNA, 25 bp, Mus musculus
aagaaaatgagaaagaagggagcct

SEQ ID NO: 163355 - DNA, 25 bp, Mus musculus
aagaaaatgagaaagatatagcagg

SEQ ID NO: 163356 - DNA, 25 bp, Mus musculus
aagaaaatgagaaagattctgaagc

SEQ ID NO: 163357 - DNA, 25 bp, Mus musculus
aagaaaatgagtaagagatttgaaa

SEQ ID NO: 163358 - DNA, 25 bp, Mus musculus
aagaaaatgctgaaggacgcattca

SEQ ID NO: 163359 - DNA, 25 bp, Mus musculus
aagaaaatggaagcttggctgaaga

SEQ ID NO: 163360 - DNA, 25 bp, Mus musculus
aagaaaatggaaggtcactacgttc

SEQ ID NO: 163361 - DNA, 25 bp, Mus musculus
aagaaaatggatgagtatgtggcaa

SEQ ID NO: 163362 - DNA, 25 bp, Mus musculus
aagaaaatggatgtcattgctagaa

SEQ ID NO: 163363 - DNA, 25 bp, Mus musculus
aagaaaatggatgttaccattgagc

SEQ ID NO: 163364 - DNA, 25 bp, Mus musculus
aagaaaatgtcaaggtatacatcta

SEQ ID NO: 163365 - DNA, 25 bp, Mus musculus
aagaaaattaaagatgaactaatga

SEQ ID NO: 163366 - DNA, 25 bp, Mus musculus
aagaaaattaaaggaaattgatcgt

SEQ ID NO: 163367 - DNA, 25 bp, Mus musculus
aagaaaattattgatattttcattt

SEQ ID NO: 163368 - DNA, 25 bp, Mus musculus
aagaaaattcatgcgagggagaact

SEQ ID NO: 163369 - DNA, 25 bp, Mus musculus
aagaaaattgagcccagagtgccca

SEQ ID NO: 163370 - DNA, 25 bp, Mus musculus
aagaaaattgagcccagcgggccca

SEQ ID NO: 163371 - DNA, 25 bp, Mus musculus
aagaaaattgtgcccagggattgtg

SEQ ID NO: 163372 - DNA, 25 bp, Mus musculus
aagaaacaaacggctcttgctgagc

SEQ ID NO: 163373 - DNA, 25 bp, Mus musculus
aagaaacacagagagcttctcagga

SEQ ID NO: 163374 - DNA, 25 bp, Mus musculus
aagaaacacttaaagtatcaagaga

SEQ ID NO: 163375 - DNA, 25 bp, Mus musculus
aagaaacagcaggtgattcaggatt

SEQ ID NO: 163376 - DNA, 25 bp, Mus musculus
aagaaacagccaaagaaaactaact

SEQ ID NO: 163377 - DNA, 25 bp, Mus musculus
aagaaacatccggcatttgtagaaa

SEQ ID NO: 163378 - DNA, 25 bp, Mus musculus
aagaaacatgcactgataaagcagt

SEQ ID NO: 163379 - DNA, 25 bp, Mus musculus
aagaaacatggatgtaaacagaaag

SEQ ID NO: 163380 - DNA, 25 bp, Mus musculus
aagaaacatgggattactgctgggc

SEQ ID NO: 163381 - DNA, 25 bp, Mus musculus
aagaaacccctcagcaagccccgcc

SEQ ID NO: 163382 - DNA, 25 bp, Mus musculus
aagaaacctcgagatcccaaacggc

SEQ ID NO: 163383 - DNA, 25 bp, Mus musculus
aagaaacgagagcttaaagaagccc

SEQ ID NO: 163384 - DNA, 25 bp, Mus musculus
aagaaacggaaggcatgaaagaagt

SEQ ID NO: 163385 - DNA, 25 bp, Mus musculus
aagaaactaaatcatccatgcatca

SEQ ID NO: 163386 - DNA, 25 bp, Mus musculus
aagaaactaccagagcagaagaatc

SEQ ID NO: 163387 - DNA, 25 bp, Mus musculus
aagaaactaccagatgctggcatcg

SEQ ID NO: 163388 - DNA, 25 bp, Mus musculus
aagaaactaccaggtgacaaacagc

SEQ ID NO: 163389 - DNA, 25 bp, Mus musculus
aagaaactaccaggtgcactaggcc

SEQ ID NO: 163390 - DNA, 25 bp, Mus musculus
aagaaactagaagatgaaatgaaga

SEQ ID NO: 163391 - DNA, 25 bp, Mus musculus
aagaaactaggactaactgaagaag

SEQ ID NO: 163392 - DNA, 25 bp, Mus musculus
aagaaactccaggctgcgctggctg

SEQ ID NO: 163393 - DNA, 25 bp, Mus musculus
aagaaactcttttttctcctcttgc

SEQ ID NO: 163394 - DNA, 25 bp, Mus musculus
aagaaactgaacagagtaccattta

SEQ ID NO: 163395 - DNA, 25 bp, Mus musculus
aagaaactgctctggatttctttga

SEQ ID NO: 163396 - DNA, 25 bp, Mus musculus
aagaaactgggaccgtgcctgcagg

SEQ ID NO: 163397 - DNA, 25 bp, Mus musculus
aagaaagaaagatggttgtccctgc

SEQ ID NO: 163398 - DNA, 25 bp, Mus musculus
aagaaagaaatggcaaaagatgtga

SEQ ID NO: 163399 - DNA, 25 bp, Mus musculus
aagaaagaagacccactgccacagg

SEQ ID NO: 163400 - DNA, 25 bp, Mus musculus
aagaaagaagagctgctgaatgcca

SEQ ID NO: 163401 - DNA, 25 bp, Mus musculus
aagaaagaagatagtaaaaagtatg

SEQ ID NO: 163402 - DNA, 25 bp, Mus musculus
aagaaagaagatgtcagcccagcca

SEQ ID NO: 163403 - DNA, 25 bp, Mus musculus
aagaaagaaggatagatataagcgc

SEQ ID NO: 163404 - DNA, 25 bp, Mus musculus
aagaaagaagtgttgccgggaaaga

SEQ ID NO: 163405 - DNA, 25 bp, Mus musculus
aagaaagaatccagagaggaagacg

SEQ ID NO: 163406 - DNA, 25 bp, Mus musculus
aagaaagaatgctcaaaggtgacac

SEQ ID NO: 163407 - DNA, 25 bp, Mus musculus
aagaaagaattgaaggtgcctgaaa

SEQ ID NO: 163408 - DNA, 25 bp, Mus musculus
aagaaagactatcatgttccaagat

SEQ ID NO: 163409 - DNA, 25 bp, Mus musculus
aagaaagactatcatttatttccga

SEQ ID NO: 163410 - DNA, 25 bp, Mus musculus
aagaaagagagaccagagggacaag

SEQ ID NO: 163411 - DNA, 25 bp, Mus musculus
aagaaagagagatggcagcagcagc

SEQ ID NO: 163412 - DNA, 25 bp, Mus musculus
aagaaagagcgagatggacagagac

SEQ ID NO: 163413 - DNA, 25 bp, Mus musculus
aagaaagagcgatacttggtaacgt

SEQ ID NO: 163414 - DNA, 25 bp, Mus musculus
aagaaagagctgaggatcatctgtc

SEQ ID NO: 163415 - DNA, 25 bp, Mus musculus
aagaaagagggacgatgggtgatct

SEQ ID NO: 163416 - DNA, 25 bp, Mus musculus
aagaaagagggacggataccaagct

SEQ ID NO: 163417 - DNA, 25 bp, Mus musculus
aagaaagataatcagattataccga

SEQ ID NO: 163418 - DNA, 25 bp, Mus musculus
aagaaagataatcagccgtggggcc

SEQ ID NO: 163419 - DNA, 25 bp, Mus musculus
aagaaagatcaggaaaagactgata

SEQ ID NO: 163420 - DNA, 25 bp, Mus musculus
aagaaagatcaggcgagtactaaca

SEQ ID NO: 163421 - DNA, 25 bp, Mus musculus
aagaaagatgacagtgaacgtcctg

SEQ ID NO: 163422 - DNA, 25 bp, Mus musculus
aagaaagatgtgtacactcttttct

SEQ ID NO: 163423 - DNA, 25 bp, Mus musculus
aagaaagcaaaagaggagtggttcc

SEQ ID NO: 163424 - DNA, 25 bp, Mus musculus
aagaaagcaaaagggaagaaggatg

SEQ ID NO: 163425 - DNA, 25 bp, Mus musculus
aagaaagcaaggaaggaaggtctga

SEQ ID NO: 163426 - DNA, 25 bp, Mus musculus
aagaaagcagggctttctgtgagac

SEQ ID NO: 163427 - DNA, 25 bp, Mus musculus
aagaaagcagggtgaaggaggaggg

SEQ ID NO: 163428 - DNA, 25 bp, Mus musculus
aagaaagccaacattctcaccgaca

SEQ ID NO: 163429 - DNA, 25 bp, Mus musculus
aagaaagccagagaaggtgtgatgg

SEQ ID NO: 163430 - DNA, 25 bp, Mus musculus
aagaaagccagcagcattagattga

SEQ ID NO: 163431 - DNA, 25 bp, Mus musculus
aagaaagccatcaacgacctagaca

SEQ ID NO: 163432 - DNA, 25 bp, Mus musculus
aagaaagccatcaagttgcctgcag

SEQ ID NO: 163433 - DNA, 25 bp, Mus musculus
aagaaagctcaggaagtggaggtac

SEQ ID NO: 163434 - DNA, 25 bp, Mus musculus
aagaaagctggacctgggctgaaga

SEQ ID NO: 163435 - DNA, 25 bp, Mus musculus
aagaaagctgtattttaaatcttct

SEQ ID NO: 163436 - DNA, 25 bp, Mus musculus
aagaaagctgtggaaatcagtcagc

SEQ ID NO: 163437 - DNA, 25 bp, Mus musculus
aagaaagctgtggtaattccaccaa

SEQ ID NO: 163438 - DNA, 25 bp, Mus musculus
aagaaagcttcgaagaaaagcaatg

SEQ ID NO: 163439 - DNA, 25 bp, Mus musculus
aagaaagcttttgaaataggaccaa

SEQ ID NO: 163440 - DNA, 25 bp, Mus musculus
aagaaaggaaaaggatgtgaggaag

SEQ ID NO: 163441 - DNA, 25 bp, Mus musculus
aagaaaggacagccctcccacagaa

SEQ ID NO: 163442 - DNA, 25 bp, Mus musculus
aagaaaggcgagtctacgtgacact

SEQ ID NO: 163443 - DNA, 25 bp, Mus musculus
aagaaagggttgctgttgcatgtgg

SEQ ID NO: 163444 - DNA, 25 bp, Mus musculus
aagaaaggttacaagagtgaaacat

SEQ ID NO: 163445 - DNA, 25 bp, Mus musculus
aagaaagtcaggtatgctgcaagac

SEQ ID NO: 163446 - DNA, 25 bp, Mus musculus
aagaaagtccgactggaactggaaa

SEQ ID NO: 163447 - DNA, 25 bp, Mus musculus
aagaaagtctcaatcgtcctttttc

SEQ ID NO: 163448 - DNA, 25 bp, Mus musculus
aagaaagtcttacagcttgggcaat

SEQ ID NO: 163449 - DNA, 25 bp, Mus musculus
aagaaagtcttacagtccattttga

SEQ ID NO: 163450 - DNA, 25 bp, Mus musculus
aagaaagtgaaagaccattgcagca

SEQ ID NO: 163451 - DNA, 25 bp, Mus musculus
aagaaagttgcaaaaatcttggcaa

SEQ ID NO: 163452 - DNA, 25 bp, Mus musculus
aagaaagttgcaaatgattcattcc

SEQ ID NO: 163453 - DNA, 25 bp, Mus musculus
aagaaagtttggaagaatgacatac

SEQ ID NO: 163454 - DNA, 25 bp, Mus musculus
aagaaagtttggaagttgccatcca

SEQ ID NO: 163455 - DNA, 25 bp, Mus musculus
aagaaataaccagatatcagttttt

SEQ ID NO: 163456 - DNA, 25 bp, Mus musculus
aagaaataaccaggtgaagcaagat

SEQ ID NO: 163457 - DNA, 25 bp, Mus musculus
aagaaataagcagatccttgtaaga

SEQ ID NO: 163458 - DNA, 25 bp, Mus musculus
aagaaataaggatcgttcatctaac

SEQ ID NO: 163459 - DNA, 25 bp, Mus musculus
aagaaataaggtttgacaactcact

SEQ ID NO: 163460 - DNA, 25 bp, Mus musculus
aagaaataatcaaatgggttgtgtg

SEQ ID NO: 163461 - DNA, 25 bp, Mus musculus
aagaaatacgatgaggatgatgcca

SEQ ID NO: 163462 - DNA, 25 bp, Mus musculus
aagaaatacggtgaagctctgggca

SEQ ID NO: 163463 - DNA, 25 bp, Mus musculus
aagaaatagaggtacaacataagag

SEQ ID NO: 163464 - DNA, 25 bp, Mus musculus
aagaaatataaggactgaggatctc

SEQ ID NO: 163465 - DNA, 25 bp, Mus musculus
aagaaatatcacaggctaatgttat

SEQ ID NO: 163466 - DNA, 25 bp, Mus musculus
aagaaatatgaagacactccagcaa

SEQ ID NO: 163467 - DNA, 25 bp, Mus musculus
aagaaatatgaagcacaagcccaag

SEQ ID NO: 163468 - DNA, 25 bp, Mus musculus
aagaaatatgaagccactctgatat

SEQ ID NO: 163469 - DNA, 25 bp, Mus musculus
aagaaatcaaagagaaaatggatca

SEQ ID NO: 163470 - DNA, 25 bp, Mus musculus
aagaaatcaaagatatagatgtcag

SEQ ID NO: 163471 - DNA, 25 bp, Mus musculus
aagaaatcaaggaaacactcataga

SEQ ID NO: 163472 - DNA, 25 bp, Mus musculus
aagaaatcagacagatccgagacac

SEQ ID NO: 163473 - DNA, 25 bp, Mus musculus
aagaaatcagacagtgatttcaatc

SEQ ID NO: 163474 - DNA, 25 bp, Mus musculus
aagaaatccagcgtgcgagaagatg

SEQ ID NO: 163475 - DNA, 25 bp, Mus musculus
aagaaatccgatggggagcctttac

SEQ ID NO: 163476 - DNA, 25 bp, Mus musculus
aagaaatccgatggttttcagacaa

SEQ ID NO: 163477 - DNA, 25 bp, Mus musculus
aagaaatccggcaacttgaattggt

SEQ ID NO: 163478 - DNA, 25 bp, Mus musculus
aagaaatccgggcagtttaggacac

SEQ ID NO: 163479 - DNA, 25 bp, Mus musculus
aagaaatcctgcaggagccagcagg

SEQ ID NO: 163480 - DNA, 25 bp, Mus musculus
aagaaatcgagcgccaggctccgat

SEQ ID NO: 163481 - DNA, 25 bp, Mus musculus
aagaaatcgctcagtcctgcatctg

SEQ ID NO: 163482 - DNA, 25 bp, Mus musculus
aagaaatcgctcagtgccacatatg

SEQ ID NO: 163483 - DNA, 25 bp, Mus musculus
aagaaatctattcagtattaatata

SEQ ID NO: 163484 - DNA, 25 bp, Mus musculus
aagaaatctgcccttagtggggagc

SEQ ID NO: 163485 - DNA, 25 bp, Mus musculus
aagaaatcttggccaggaccctgcc

SEQ ID NO: 163486 - DNA, 25 bp, Mus musculus
aagaaatgaatgcagcagcagcagt

SEQ ID NO: 163487 - DNA, 25 bp, Mus musculus
aagaaatgaccaaggaccctctgtc

SEQ ID NO: 163488 - DNA, 25 bp, Mus musculus
aagaaatgatgaaaggcatccttac

SEQ ID NO: 163489 - DNA, 25 bp, Mus musculus
aagaaatgatggttcaacttctgta

SEQ ID NO: 163490 - DNA, 25 bp, Mus musculus
aagaaatgattggtggcttccggaa

SEQ ID NO: 163491 - DNA, 25 bp, Mus musculus
aagaaatgcaaaatccgggaggaga

SEQ ID NO: 163492 - DNA, 25 bp, Mus musculus
aagaaatgcaaacccagccatacat

SEQ ID NO: 163493 - DNA, 25 bp, Mus musculus
aagaaatgcaagattttgctggaag

SEQ ID NO: 163494 - DNA, 25 bp, Mus musculus
aagaaatgcttccagagtcttgtga

SEQ ID NO: 163495 - DNA, 25 bp, Mus musculus
aagaaatggaaggtggtgtagtgga

SEQ ID NO: 163496 - DNA, 25 bp, Mus musculus
aagaaatggaagtggctaccaagga

SEQ ID NO: 163497 - DNA, 25 bp, Mus musculus
aagaaatggaggtgacagctactaa

SEQ ID NO: 163498 - DNA, 25 bp, Mus musculus
aagaaatggctcaaggaacagtgag

SEQ ID NO: 163499 - DNA, 25 bp, Mus musculus
aagaaatgtatatgcccccaagcct

SEQ ID NO: 163500 - DNA, 25 bp, Mus musculus
aagaaatgtgcaattcctaaatgca

SEQ ID NO: 163501 - DNA, 25 bp, Mus musculus
aagaaatgtgcacttggatctcagt

SEQ ID NO: 163502 - DNA, 25 bp, Mus musculus
aagaaatgttgctgcccaggttctt

SEQ ID NO: 163503 - DNA, 25 bp, Mus musculus
aagaaattaaagtggcagcttgact

SEQ ID NO: 163504 - DNA, 25 bp, Mus musculus
aagaaattcagagactgcctcttta

SEQ ID NO: 163505 - DNA, 25 bp, Mus musculus
aagaaattcgaactggtgttgatca

SEQ ID NO: 163506 - DNA, 25 bp, Mus musculus
aagaaatttcaaagaggtaactcac

SEQ ID NO: 163507 - DNA, 25 bp, Mus musculus
aagaaatttcctaatcaccctcatg

SEQ ID NO: 163508 - DNA, 25 bp, Mus musculus
aagaaatttgccgaggccttgggaa

SEQ ID NO: 163509 - DNA, 25 bp, Mus musculus
aagaaatttggtgtccagggaagcc

SEQ ID NO: 163510 - DNA, 25 bp, Mus musculus
aagaacaaaaaaggcctgatggaat

SEQ ID NO: 163511 - DNA, 25 bp, Mus musculus
aagaacaaaaatgcaagctgggcgt

SEQ ID NO: 163512 - DNA, 25 bp, Mus musculus
aagaacaaaaggctgacgaatgaca

SEQ ID NO: 163513 - DNA, 25 bp, Mus musculus
aagaacaaacaagatacatttatat

SEQ ID NO: 163514 - DNA, 25 bp, Mus musculus
aagaacaaacaagggaatggcgttt

SEQ ID NO: 163515 - DNA, 25 bp, Mus musculus
aagaacaaagatggctgcatgagag

SEQ ID NO: 163516 - DNA, 25 bp, Mus musculus
aagaacaacctggcttcctgctacc

SEQ ID NO: 163517 - DNA, 25 bp, Mus musculus
aagaacaacctgtacctgcaaatga

SEQ ID NO: 163518 - DNA, 25 bp, Mus musculus
aagaacaacgaagagcaagctgaac

SEQ ID NO: 163519 - DNA, 25 bp, Mus musculus
aagaacaacggctcggaagtggcct

SEQ ID NO: 163520 - DNA, 25 bp, Mus musculus
aagaacaactgaacgtttggatgaa

SEQ ID NO: 163521 - DNA, 25 bp, Mus musculus
aagaacaagccagggcctcctgctg

SEQ ID NO: 163522 - DNA, 25 bp, Mus musculus
aagaacaatggctcggaagtggcct

SEQ ID NO: 163523 - DNA, 25 bp, Mus musculus
aagaacacagaacttgtccttttct

SEQ ID NO: 163524 - DNA, 25 bp, Mus musculus
aagaacacagtgccctggttcccaa

SEQ ID NO: 163525 - DNA, 25 bp, Mus musculus
aagaacaccaaagagtgagtaaagg

SEQ ID NO: 163526 - DNA, 25 bp, Mus musculus
aagaacaccaaattttaagagtggt

SEQ ID NO: 163527 - DNA, 25 bp, Mus musculus
aagaacaccttcagtgagatgattc

SEQ ID NO: 163528 - DNA, 25 bp, Mus musculus
aagaacacgcaagacagcagtccgt

SEQ ID NO: 163529 - DNA, 25 bp, Mus musculus
aagaacacgcaagggtgagatcttt

SEQ ID NO: 163530 - DNA, 25 bp, Mus musculus
aagaacactgatgaaatcatgcacc

SEQ ID NO: 163531 - DNA, 25 bp, Mus musculus
aagaacactttgagaagcaccaggc

SEQ ID NO: 163532 - DNA, 25 bp, Mus musculus
aagaacagaagcagagcagcagacc

SEQ ID NO: 163533 - DNA, 25 bp, Mus musculus
aagaacagacatcatgatcgggagg

SEQ ID NO: 163534 - DNA, 25 bp, Mus musculus
aagaacagggcagctgggcaccaca

SEQ ID NO: 163535 - DNA, 25 bp, Mus musculus
aagaacagtttggaggacgtaccat

SEQ ID NO: 163536 - DNA, 25 bp, Mus musculus
aagaacagtttggaggctcacccgg

SEQ ID NO: 163537 - DNA, 25 bp, Mus musculus
aagaacatatagaagattttaaaca

SEQ ID NO: 163538 - DNA, 25 bp, Mus musculus
aagaacatccagaacaactggcggg

SEQ ID NO: 163539 - DNA, 25 bp, Mus musculus
aagaacatccaggtcctgcctggca

SEQ ID NO: 163540 - DNA, 25 bp, Mus musculus
aagaacatcgagaagccaggtctct

SEQ ID NO: 163541 - DNA, 25 bp, Mus musculus
aagaacatggagccccctggtgacc

SEQ ID NO: 163542 - DNA, 25 bp, Mus musculus
aagaacatggaggcccctggtgacc

SEQ ID NO: 163543 - DNA, 25 bp, Mus musculus
aagaacattaaaaggagtgcaagat

SEQ ID NO: 163544 - DNA, 25 bp, Mus musculus
aagaaccaagcaatgtcttcaatga

SEQ ID NO: 163545 - DNA, 25 bp, Mus musculus
aagaaccaagccggccctgggcagt

SEQ ID NO: 163546 - DNA, 25 bp, Mus musculus
aagaaccacaaagaggaaatgcagg

SEQ ID NO: 163547 - DNA, 25 bp, Mus musculus
aagaaccacaagaagacccactccg

SEQ ID NO: 163548 - DNA, 25 bp, Mus musculus
aagaaccaccataggatacgacttg

SEQ ID NO: 163549 - DNA, 25 bp, Mus musculus
aagaaccacgaagaggaaatgcagg

SEQ ID NO: 163550 - DNA, 25 bp, Mus musculus
aagaaccacgagcaggtcctgcgca

SEQ ID NO: 163551 - DNA, 25 bp, Mus musculus
aagaaccacgaggaggaaatgcagg

SEQ ID NO: 163552 - DNA, 25 bp, Mus musculus
aagaaccacgaggaggaaatggcct

SEQ ID NO: 163553 - DNA, 25 bp, Mus musculus
aagaaccacgaggaggtggccacca

SEQ ID NO: 163554 - DNA, 25 bp, Mus musculus
aagaaccatcaacaagcaaatccgc

SEQ ID NO: 163555 - DNA, 25 bp, Mus musculus
aagaaccatgccgcctgctaagccc

SEQ ID NO: 163556 - DNA, 25 bp, Mus musculus
aagaacccaactgatccccagctca

SEQ ID NO: 163557 - DNA, 25 bp, Mus musculus
aagaacccaggtggaaagcacaagg

SEQ ID NO: 163558 - DNA, 25 bp, Mus musculus
aagaaccggccagctgcttgacatc

SEQ ID NO: 163559 - DNA, 25 bp, Mus musculus
aagaaccggccagctgtctcctgaa

SEQ ID NO: 163560 - DNA, 25 bp, Mus musculus
aagaacctaaagaagcatgtcattt

SEQ ID NO: 163561 - DNA, 25 bp, Mus musculus
aagaacctaaggaagatcctgtctc

SEQ ID NO: 163562 - DNA, 25 bp, Mus musculus
aagaacctcatcttgtacttgttga

SEQ ID NO: 163563 - DNA, 25 bp, Mus musculus
aagaacctccaggaggagatctcag

SEQ ID NO: 163564 - DNA, 25 bp, Mus musculus
aagaacctgcaggatagaaagagtg

SEQ ID NO: 163565 - DNA, 25 bp, Mus musculus
aagaacctgcagtaccatcccactg

SEQ ID NO: 163566 - DNA, 25 bp, Mus musculus
aagaaccttgtggagatgggcagca

SEQ ID NO: 163567 - DNA, 25 bp, Mus musculus
aagaacgaaaagggaactgtgaagc

SEQ ID NO: 163568 - DNA, 25 bp, Mus musculus
aagaacgaacccaggagttccgact

SEQ ID NO: 163569 - DNA, 25 bp, Mus musculus
aagaacgatatgacgaatgggtgaa

SEQ ID NO: 163570 - DNA, 25 bp, Mus musculus
aagaacgatatgacgtgggcgaccc

SEQ ID NO: 163571 - DNA, 25 bp, Mus musculus
aagaacggcgatgctttccgtcaga

SEQ ID NO: 163572 - DNA, 25 bp, Mus musculus
aagaacggtctgacctgcagcaaat

SEQ ID NO: 163573 - DNA, 25 bp, Mus musculus
aagaactaaaggataacttcaagct

SEQ ID NO: 163574 - DNA, 25 bp, Mus musculus
aagaactaaatgaatgccatgagag

SEQ ID NO: 163575 - DNA, 25 bp, Mus musculus
aagaactaaatgcgaaatcaccagg

SEQ ID NO: 163576 - DNA, 25 bp, Mus musculus
aagaactaactgagaaatgcaaaca

SEQ ID NO: 163577 - DNA, 25 bp, Mus musculus
aagaactaactgagttttagaagcc

SEQ ID NO: 163578 - DNA, 25 bp, Mus musculus
aagaactacaataagtgtttcctca

SEQ ID NO: 163579 - DNA, 25 bp, Mus musculus
aagaactacaccctgacaactggag

SEQ ID NO: 163580 - DNA, 25 bp, Mus musculus
aagaactacaccctgtccccagaat

SEQ ID NO: 163581 - DNA, 25 bp, Mus musculus
aagaactactgagactaaagcaaga

SEQ ID NO: 163582 - DNA, 25 bp, Mus musculus
aagaactactgaggcaaggcagcaa

SEQ ID NO: 163583 - DNA, 25 bp, Mus musculus
aagaactatgctgagctggtgaagc

SEQ ID NO: 163584 - DNA, 25 bp, Mus musculus
aagaactatgtgcaacctcaagccc

SEQ ID NO: 163585 - DNA, 25 bp, Mus musculus
aagaactattgagacccgatcctgg

SEQ ID NO: 163586 - DNA, 25 bp, Mus musculus
aagaactattgagaggccctggccc

SEQ ID NO: 163587 - DNA, 25 bp, Mus musculus
aagaactattgagagtgtatgggca

SEQ ID NO: 163588 - DNA, 25 bp, Mus musculus
aagaactcaagaatgatagatttga

SEQ ID NO: 163589 - DNA, 25 bp, Mus musculus
aagaactcaagattgatagatttga

SEQ ID NO: 163590 - DNA, 25 bp, Mus musculus
aagaactcagcaaggagaagacaga

SEQ ID NO: 163591 - DNA, 25 bp, Mus musculus
aagaactccagtgtttcccgagaga

SEQ ID NO: 163592 - DNA, 25 bp, Mus musculus
aagaactcctgagaggttgatcgtg

SEQ ID NO: 163593 - DNA, 25 bp, Mus musculus
aagaactgacggcacaggcccgact

SEQ ID NO: 163594 - DNA, 25 bp, Mus musculus
aagaactgacggcactgatggagga

SEQ ID NO: 163595 - DNA, 25 bp, Mus musculus
aagaactgatcacagaaggccagca

SEQ ID NO: 163596 - DNA, 25 bp, Mus musculus
aagaactgcagaagggagaactttc

SEQ ID NO: 163597 - DNA, 25 bp, Mus musculus
aagaactgcagaaggtgctgatgga

SEQ ID NO: 163598 - DNA, 25 bp, Mus musculus
aagaactgcagaattgagctccttg

SEQ ID NO: 163599 - DNA, 25 bp, Mus musculus
aagaactgcatcaggctcactcttt

SEQ ID NO: 163600 - DNA, 25 bp, Mus musculus
aagaactgcatcagtgaacggctct

SEQ ID NO: 163601 - DNA, 25 bp, Mus musculus
aagaactgctgtctattgcatctgc

SEQ ID NO: 163602 - DNA, 25 bp, Mus musculus
aagaactggagaaaccatggaatgg

SEQ ID NO: 163603 - DNA, 25 bp, Mus musculus
aagaactggagcgctgctgggaacg

SEQ ID NO: 163604 - DNA, 25 bp, Mus musculus
aagaactggagtattttaaccacat

SEQ ID NO: 163605 - DNA, 25 bp, Mus musculus
aagaactgtccagggccaaggaata

SEQ ID NO: 163606 - DNA, 25 bp, Mus musculus
aagaactgtccagggtgaccaacgc

SEQ ID NO: 163607 - DNA, 25 bp, Mus musculus
aagaactgtgaagtgctttgtttaa

SEQ ID NO: 163608 - DNA, 25 bp, Mus musculus
aagaactgtgtttggagtaacaact

SEQ ID NO: 163609 - DNA, 25 bp, Mus musculus
aagaacttacctgagagcactgtgg

SEQ ID NO: 163610 - DNA, 25 bp, Mus musculus
aagaacttacctgagcacagttccc

SEQ ID NO: 163611 - DNA, 25 bp, Mus musculus
aagaacttataaggcgtctcttttc

SEQ ID NO: 163612 - DNA, 25 bp, Mus musculus
aagaacttgtaaagcttgtagaccc

SEQ ID NO: 163613 - DNA, 25 bp, Mus musculus
aagaagaaaaaagattataagagat

SEQ ID NO: 163614 - DNA, 25 bp, Mus musculus
aagaagaaaaagaacgtttgctgaa

SEQ ID NO: 163615 - DNA, 25 bp, Mus musculus
aagaagaaaaagggtgatcctgata

SEQ ID NO: 163616 - DNA, 25 bp, Mus musculus
aagaagaaaacaggctatggtgaaa

SEQ ID NO: 163617 - DNA, 25 bp, Mus musculus
aagaagaaaagctcaacagaggcag

SEQ ID NO: 163618 - DNA, 25 bp, Mus musculus
aagaagaaaaggaagagcatggctc

SEQ ID NO: 163619 - DNA, 25 bp, Mus musculus
aagaagaaaaggaatagtctcaaga

SEQ ID NO: 163620 - DNA, 25 bp, Mus musculus
aagaagaaaaggactgcatttaccc

SEQ ID NO: 163621 - DNA, 25 bp, Mus musculus
aagaagaaaaggctacagaaacttg

SEQ ID NO: 163622 - DNA, 25 bp, Mus musculus
aagaagaaaagtgttgccgggaaag

SEQ ID NO: 163623 - DNA, 25 bp, Mus musculus
aagaagaaagaagatagtaaaaagt

SEQ ID NO: 163624 - DNA, 25 bp, Mus musculus
aagaagaaagagaagcagggtcccg

SEQ ID NO: 163625 - DNA, 25 bp, Mus musculus
aagaagaaagaggatgctctggagg

SEQ ID NO: 163626 - DNA, 25 bp, Mus musculus
aagaagaaagcagcacacacaggcc

SEQ ID NO: 163627 - DNA, 25 bp, Mus musculus
aagaagaaaggactgacagacgaag

SEQ ID NO: 163628 - DNA, 25 bp, Mus musculus
aagaagaaaggatacaagacccttt

SEQ ID NO: 163629 - DNA, 25 bp, Mus musculus
aagaagaaaggttcatcctcaacct

SEQ ID NO: 163630 - DNA, 25 bp, Mus musculus
aagaagaaataaggtttgacaactc

SEQ ID NO: 163631 - DNA, 25 bp, Mus musculus
aagaagaaatatctgccacctctga

SEQ ID NO: 163632 - DNA, 25 bp, Mus musculus
aagaagaaatctctgtcatagacat

SEQ ID NO: 163633 - DNA, 25 bp, Mus musculus
aagaagaaatctgtgtactttattg

SEQ ID NO: 163634 - DNA, 25 bp, Mus musculus
aagaagaacaaggatgtccccgtgg

SEQ ID NO: 163635 - DNA, 25 bp, Mus musculus
aagaagaaccacgagcaggtcctgc

SEQ ID NO: 163636 - DNA, 25 bp, Mus musculus
aagaagaactgagattcctactgga

SEQ ID NO: 163637 - DNA, 25 bp, Mus musculus
aagaagaagaaaaggctacagaaac

SEQ ID NO: 163638 - DNA, 25 bp, Mus musculus
aagaagaagaaaagtgttgccggga

SEQ ID NO: 163639 - DNA, 25 bp, Mus musculus
aagaagaagaaagaggatgctctgg

SEQ ID NO: 163640 - DNA, 25 bp, Mus musculus
aagaagaagaagaggtctaagagtg

SEQ ID NO: 163641 - DNA, 25 bp, Mus musculus
aagaagaagaaggcgtcccatgaga

SEQ ID NO: 163642 - DNA, 25 bp, Mus musculus
aagaagaagaagggtcctgggctgt

SEQ ID NO: 163643 - DNA, 25 bp, Mus musculus
aagaagaagaaggtgaccggagagg

SEQ ID NO: 163644 - DNA, 25 bp, Mus musculus
aagaagaagaaggttttcgcatttc

SEQ ID NO: 163645 - DNA, 25 bp, Mus musculus
aagaagaagaggcacactggagcgg

SEQ ID NO: 163646 - DNA, 25 bp, Mus musculus
aagaagaagaggcttctgtgtcagt

SEQ ID NO: 163647 - DNA, 25 bp, Mus musculus
aagaagaagaggtctaagagtgtca

SEQ ID NO: 163648 - DNA, 25 bp, Mus musculus
aagaagaagaggtgagtaatctggt

SEQ ID NO: 163649 - DNA, 25 bp, Mus musculus
aagaagaagatgcagctgagaaggt

SEQ ID NO: 163650 - DNA, 25 bp, Mus musculus
aagaagaagcagcaacagttggagg

SEQ ID NO: 163651 - DNA, 25 bp, Mus musculus
aagaagaagcaggtcacgatctaga

SEQ ID NO: 163652 - DNA, 25 bp, Mus musculus
aagaagaagcaggtttcttcgtttg

SEQ ID NO: 163653 - DNA, 25 bp, Mus musculus
aagaagaaggattccaaggaaatag

SEQ ID NO: 163654 - DNA, 25 bp, Mus musculus
aagaagaaggcgtcccatgagaatt

SEQ ID NO: 163655 - DNA, 25 bp, Mus musculus
aagaagaagggtcctgggctgtcct

SEQ ID NO: 163656 - DNA, 25 bp, Mus musculus
aagaagaaggtgaccggagaggagg

SEQ ID NO: 163657 - DNA, 25 bp, Mus musculus
aagaagaaggttttcgcatttccag

SEQ ID NO: 163658 - DNA, 25 bp, Mus musculus
aagaagaatacaagaagagggcagc

SEQ ID NO: 163659 - DNA, 25 bp, Mus musculus
aagaagaatacaagatcaaatgcct

SEQ ID NO: 163660 - DNA, 25 bp, Mus musculus
aagaagaatatgccccagagaagat

SEQ ID NO: 163661 - DNA, 25 bp, Mus musculus
aagaagaatgggctctacttgaatc

SEQ ID NO: 163662 - DNA, 25 bp, Mus musculus
aagaagaatgggtctttccttccag

SEQ ID NO: 163663 - DNA, 25 bp, Mus musculus
aagaagaattctaatgttttgtgat

SEQ ID NO: 163664 - DNA, 25 bp, Mus musculus
aagaagacaaaaagagttcaaaatt

SEQ ID NO: 163665 - DNA, 25 bp, Mus musculus
aagaagacacagagggctgacagct

SEQ ID NO: 163666 - DNA, 25 bp, Mus musculus
aagaagacaccctgatatctgcaca

SEQ ID NO: 163667 - DNA, 25 bp, Mus musculus
aagaagacagagccaagtcagaaca

SEQ ID NO: 163668 - DNA, 25 bp, Mus musculus
aagaagacagatgagcttccccaac

SEQ ID NO: 163669 - DNA, 25 bp, Mus musculus
aagaagacagatgttaaggaagaag

SEQ ID NO: 163670 - DNA, 25 bp, Mus musculus
aagaagacagccaaggacactgcca

SEQ ID NO: 163671 - DNA, 25 bp, Mus musculus
aagaagacaggacaggaagctctct

SEQ ID NO: 163672 - DNA, 25 bp, Mus musculus
aagaagacaggtaaacacaagacgt

SEQ ID NO: 163673 - DNA, 25 bp, Mus musculus
aagaagacagttcaaaagaccccct

SEQ ID NO: 163674 - DNA, 25 bp, Mus musculus
aagaagaccagaagctctgactatg

SEQ ID NO: 163675 - DNA, 25 bp, Mus musculus
aagaagacctcccagatggtgttag

SEQ ID NO: 163676 - DNA, 25 bp, Mus musculus
aagaagagaaataataactgccatg

SEQ ID NO: 163677 - DNA, 25 bp, Mus musculus
aagaagagaaatattacagcgactg

SEQ ID NO: 163678 - DNA, 25 bp, Mus musculus
aagaagagaagaagcgcaggaaagg

SEQ ID NO: 163679 - DNA, 25 bp, Mus musculus
aagaagagaatgcccaggctgaagc

SEQ ID NO: 163680 - DNA, 25 bp, Mus musculus
aagaagagactacaactaaagcaag

SEQ ID NO: 163681 - DNA, 25 bp, Mus musculus
aagaagagactacggccttattttg

SEQ ID NO: 163682 - DNA, 25 bp, Mus musculus
aagaagagagagtacctcagccctg

SEQ ID NO: 163683 - DNA, 25 bp, Mus musculus
aagaagagatacaggtctcgttcca

SEQ ID NO: 163684 - DNA, 25 bp, Mus musculus
aagaagagatacagttctaggtctc

SEQ ID NO: 163685 - DNA, 25 bp, Mus musculus
aagaagagcagagaaacttttccat

SEQ ID NO: 163686 - DNA, 25 bp, Mus musculus
aagaagagcaggaaccccagaacat

SEQ ID NO: 163687 - DNA, 25 bp, Mus musculus
aagaagagcagggctgtgtctggct

SEQ ID NO: 163688 - DNA, 25 bp, Mus musculus
aagaagagctcaaaatgttaccaga

SEQ ID NO: 163689 - DNA, 25 bp, Mus musculus
aagaagagctcaaagccaagcactc

SEQ ID NO: 163690 - DNA, 25 bp, Mus musculus
aagaagaggaggacgagcaagagga

SEQ ID NO: 163691 - DNA, 25 bp, Mus musculus
aagaagaggctgggatcagtacctg

SEQ ID NO: 163692 - DNA, 25 bp, Mus musculus
aagaagagtacacaatgggtacccc

SEQ ID NO: 163693 - DNA, 25 bp, Mus musculus
aagaagagtgcagatgggatgcttt

SEQ ID NO: 163694 - DNA, 25 bp, Mus musculus
aagaagagttggaagcctcgtcttc

SEQ ID NO: 163695 - DNA, 25 bp, Mus musculus
aagaagagttggaaggtcatagaac

SEQ ID NO: 163696 - DNA, 25 bp, Mus musculus
aagaagagtttcctggagaaggaac

SEQ ID NO: 163697 - DNA, 25 bp, Mus musculus
aagaagataaacagatacagacaga

SEQ ID NO: 163698 - DNA, 25 bp, Mus musculus
aagaagataaacagtgtggcctacc

SEQ ID NO: 163699 - DNA, 25 bp, Mus musculus
aagaagatagatcctggatgacttg

SEQ ID NO: 163700 - DNA, 25 bp, Mus musculus
aagaagatagcgaaacagagataaa

SEQ ID NO: 163701 - DNA, 25 bp, Mus musculus
aagaagatcaaggaacgcatccgaa

SEQ ID NO: 163702 - DNA, 25 bp, Mus musculus
aagaagatccatgagaaattgttcc

SEQ ID NO: 163703 - DNA, 25 bp, Mus musculus
aagaagatgaaggagaaggaggagg

SEQ ID NO: 163704 - DNA, 25 bp, Mus musculus
aagaagatgaaggagagcccatcgc

SEQ ID NO: 163705 - DNA, 25 bp, Mus musculus
aagaagatgaccgcggagggcatcc

SEQ ID NO: 163706 - DNA, 25 bp, Mus musculus
aagaagatgatccccagtgtttcca

SEQ ID NO: 163707 - DNA, 25 bp, Mus musculus
aagaagatgatcgtcttcaagcctt

SEQ ID NO: 163708 - DNA, 25 bp, Mus musculus
aagaagatgcagctgagaaggtaga

SEQ ID NO: 163709 - DNA, 25 bp, Mus musculus
aagaagatggatgcagattcctggc

SEQ ID NO: 163710 - DNA, 25 bp, Mus musculus
aagaagatggccctctctttcagcg

SEQ ID NO: 163711 - DNA, 25 bp, Mus musculus
aagaagatggccgtggcaaccctgg

SEQ ID NO: 163712 - DNA, 25 bp, Mus musculus
aagaagatgggcctgacggaggatg

SEQ ID NO: 163713 - DNA, 25 bp, Mus musculus
aagaagattagttgaagaacagtca

SEQ ID NO: 163714 - DNA, 25 bp, Mus musculus
aagaagattattgatattttcattt

SEQ ID NO: 163715 - DNA, 25 bp, Mus musculus
aagaagattccagtcctgcaccgag

SEQ ID NO: 163716 - DNA, 25 bp, Mus musculus
aagaagattggatttaccttcaaga

SEQ ID NO: 163717 - DNA, 25 bp, Mus musculus
aagaagatttaccactcggccctga

SEQ ID NO: 163718 - DNA, 25 bp, Mus musculus
aagaagcaaaaaggcagaagactta

SEQ ID NO: 163719 - DNA, 25 bp, Mus musculus
aagaagcaaaaaggtctgtctgtta

SEQ ID NO: 163720 - DNA, 25 bp, Mus musculus
aagaagcaaaggaatattttgcaga

SEQ ID NO: 163721 - DNA, 25 bp, Mus musculus
aagaagcaaggtgaaggctcctcgg

SEQ ID NO: 163722 - DNA, 25 bp, Mus musculus
aagaagcaatatggtattcatgcag

SEQ ID NO: 163723 - DNA, 25 bp, Mus musculus
aagaagcaatgaactcccaggctgt

SEQ ID NO: 163724 - DNA, 25 bp, Mus musculus
aagaagcaatgatggagcaggaaat

SEQ ID NO: 163725 - DNA, 25 bp, Mus musculus
aagaagcacacacagacactggatc

SEQ ID NO: 163726 - DNA, 25 bp, Mus musculus
aagaagcacacacaggggcagttcc

SEQ ID NO: 163727 - DNA, 25 bp, Mus musculus
aagaagcacacagatcgcaagtcct

SEQ ID NO: 163728 - DNA, 25 bp, Mus musculus
aagaagcacagagagagattaagaa

SEQ ID NO: 163729 - DNA, 25 bp, Mus musculus
aagaagcaccagagggtgtctttaa

SEQ ID NO: 163730 - DNA, 25 bp, Mus musculus
aagaagcaccagaggtctgagttct

SEQ ID NO: 163731 - DNA, 25 bp, Mus musculus
aagaagcactacagactgcagttct

SEQ ID NO: 163732 - DNA, 25 bp, Mus musculus
aagaagcactcagcacggcagctgc

SEQ ID NO: 163733 - DNA, 25 bp, Mus musculus
aagaagcagaaggcttctcagaacc

SEQ ID NO: 163734 - DNA, 25 bp, Mus musculus
aagaagcagaccaaggtggaattcc

SEQ ID NO: 163735 - DNA, 25 bp, Mus musculus
aagaagcagaccaagttccagaatc

SEQ ID NO: 163736 - DNA, 25 bp, Mus musculus
aagaagcagatcttgaggttacgga

SEQ ID NO: 163737 - DNA, 25 bp, Mus musculus
aagaagcagcgatgggccagggctt

SEQ ID NO: 163738 - DNA, 25 bp, Mus musculus
aagaagcaggaagtgtacttgatgt

SEQ ID NO: 163739 - DNA, 25 bp, Mus musculus
aagaagcaggtccccaagaagctta

SEQ ID NO: 163740 - DNA, 25 bp, Mus musculus
aagaagccaaggcatgttatttgaa

SEQ ID NO: 163741 - DNA, 25 bp, Mus musculus
aagaagccaagtcccatggcctcgc

SEQ ID NO: 163742 - DNA, 25 bp, Mus musculus
aagaagccaagttggcgagaggctc

SEQ ID NO: 163743 - DNA, 25 bp, Mus musculus
aagaagccacaggaatcctgacctc

SEQ ID NO: 163744 - DNA, 25 bp, Mus musculus
aagaagccacggatggtctcagcac

SEQ ID NO: 163745 - DNA, 25 bp, Mus musculus
aagaagccacggctttctcagggcc

SEQ ID NO: 163746 - DNA, 25 bp, Mus musculus
aagaagccagatgtgaactggggct

SEQ ID NO: 163747 - DNA, 25 bp, Mus musculus
aagaagccagcagggctgtgggaca

SEQ ID NO: 163748 - DNA, 25 bp, Mus musculus
aagaagccagcccctctttgctggg

SEQ ID NO: 163749 - DNA, 25 bp, Mus musculus
aagaagccaggccctctttgctggg

SEQ ID NO: 163750 - DNA, 25 bp, Mus musculus
aagaagccatacgaattagtcctac

SEQ ID NO: 163751 - DNA, 25 bp, Mus musculus
aagaagcccaaagcatccaaagaca

SEQ ID NO: 163752 - DNA, 25 bp, Mus musculus
aagaagcccaaggatgatgaaaaca

SEQ ID NO: 163753 - DNA, 25 bp, Mus musculus
aagaagcccagcaaggaccgccttc

SEQ ID NO: 163754 - DNA, 25 bp, Mus musculus
aagaagccccaactcaggaatggat

SEQ ID NO: 163755 - DNA, 25 bp, Mus musculus
aagaagccccaactgaggaatggat

SEQ ID NO: 163756 - DNA, 25 bp, Mus musculus
aagaagcccccacctagatcaagca

SEQ ID NO: 163757 - DNA, 25 bp, Mus musculus
aagaagcccccacctgaagaaaatg

SEQ ID NO: 163758 - DNA, 25 bp, Mus musculus
aagaagccctgaactatcctccatg

SEQ ID NO: 163759 - DNA, 25 bp, Mus musculus
aagaagccctgaactgtactctctc

SEQ ID NO: 163760 - DNA, 25 bp, Mus musculus
aagaagcgaccttcctatgaaagga

SEQ ID NO: 163761 - DNA, 25 bp, Mus musculus
aagaagcggcctgcatgacccgccg

SEQ ID NO: 163762 - DNA, 25 bp, Mus musculus
aagaagctatatccaggaccagcgc

SEQ ID NO: 163763 - DNA, 25 bp, Mus musculus
aagaagctatggcagaaagccctgc

SEQ ID NO: 163764 - DNA, 25 bp, Mus musculus
aagaagctatggcagagtgctggga

SEQ ID NO: 163765 - DNA, 25 bp, Mus musculus
aagaagctatggcagctacttaaaa

SEQ ID NO: 163766 - DNA, 25 bp, Mus musculus
aagaagctatggcaggtgattggag

SEQ ID NO: 163767 - DNA, 25 bp, Mus musculus
aagaagctatggcagtggttttatg

SEQ ID NO: 163768 - DNA, 25 bp, Mus musculus
aagaagctcaagtccattacaatgc

SEQ ID NO: 163769 - DNA, 25 bp, Mus musculus
aagaagctcagagtctacagtgccc

SEQ ID NO: 163770 - DNA, 25 bp, Mus musculus
aagaagctgaaagaggtggaagcgg

SEQ ID NO: 163771 - DNA, 25 bp, Mus musculus
aagaagctgaatataaactgtcatt

SEQ ID NO: 163772 - DNA, 25 bp, Mus musculus
aagaagctgacatgccatatgaaca

SEQ ID NO: 163773 - DNA, 25 bp, Mus musculus
aagaagctgacgaggaaggggaaga

SEQ ID NO: 163774 - DNA, 25 bp, Mus musculus
aagaagctgacgagggttatcagct

SEQ ID NO: 163775 - DNA, 25 bp, Mus musculus
aagaagctgctagagcactgggaaa

SEQ ID NO: 163776 - DNA, 25 bp, Mus musculus
aagaagctggggacagcactgggtt

SEQ ID NO: 163777 - DNA, 25 bp, Mus musculus
aagaagctggtcaagggtctagaga

SEQ ID NO: 163778 - DNA, 25 bp, Mus musculus
aagaagctgtaaagaggatagtgcc

SEQ ID NO: 163779 - DNA, 25 bp, Mus musculus
aagaagcttctggaggctctttcac

SEQ ID NO: 163780 - DNA, 25 bp, Mus musculus
aagaagcttgctcaggatggctgca

SEQ ID NO: 163781 - DNA, 25 bp, Mus musculus
aagaagcttgctcaggctcctcgga

SEQ ID NO: 163782 - DNA, 25 bp, Mus musculus
aagaaggaaaagaatctgcaggcac

SEQ ID NO: 163783 - DNA, 25 bp, Mus musculus
aagaaggaaaaggtagagcagatcc

SEQ ID NO: 163784 - DNA, 25 bp, Mus musculus
aagaaggaaagattgaagactgaga

SEQ ID NO: 163785 - DNA, 25 bp, Mus musculus
aagaaggaaagatttctaagctcct

SEQ ID NO: 163786 - DNA, 25 bp, Mus musculus
aagaaggaagaactaggctcctacg

SEQ ID NO: 163787 - DNA, 25 bp, Mus musculus
aagaaggaagaactgactcagattt

SEQ ID NO: 163788 - DNA, 25 bp, Mus musculus
aagaaggaagatgcaggttttgatg

SEQ ID NO: 163789 - DNA, 25 bp, Mus musculus
aagaaggaagcaggaggtgactttg

SEQ ID NO: 163790 - DNA, 25 bp, Mus musculus
aagaaggaaggatccaggccagtgg

SEQ ID NO: 163791 - DNA, 25 bp, Mus musculus
aagaaggacctaagctgcagaatcg

SEQ ID NO: 163792 - DNA, 25 bp, Mus musculus
aagaaggagactggcttttcagttt

SEQ ID NO: 163793 - DNA, 25 bp, Mus musculus
aagaaggagcctaaggaaccacggg

SEQ ID NO: 163794 - DNA, 25 bp, Mus musculus
aagaaggagctaattcgatgactgc

SEQ ID NO: 163795 - DNA, 25 bp, Mus musculus
aagaaggaggacattttccgtagat

SEQ ID NO: 163796 - DNA, 25 bp, Mus musculus
aagaaggaggacgaggatataaatg

SEQ ID NO: 163797 - DNA, 25 bp, Mus musculus
aagaaggaggggtgaggctgctggc

SEQ ID NO: 163798 - DNA, 25 bp, Mus musculus
aagaaggaggtggaactgacagaga

SEQ ID NO: 163799 - DNA, 25 bp, Mus musculus
aagaaggcaaagagagacacaccct

SEQ ID NO: 163800 - DNA, 25 bp, Mus musculus
aagaaggcaaatagcacccaggagc

SEQ ID NO: 163801 - DNA, 25 bp, Mus musculus
aagaaggcaaatgctatgctggatg

SEQ ID NO: 163802 - DNA, 25 bp, Mus musculus
aagaaggcaaccaagcattatgaga

SEQ ID NO: 163803 - DNA, 25 bp, Mus musculus
aagaaggcaagattactgtgtagcc

SEQ ID NO: 163804 - DNA, 25 bp, Mus musculus
aagaaggcaaggaggtggatacgac

SEQ ID NO: 163805 - DNA, 25 bp, Mus musculus
aagaaggcacaggaagcatttctta

SEQ ID NO: 163806 - DNA, 25 bp, Mus musculus
aagaaggcacctgactttgtgttct

SEQ ID NO: 163807 - DNA, 25 bp, Mus musculus
aagaaggcagaggtatgatgatgtt

SEQ ID NO: 163808 - DNA, 25 bp, Mus musculus
aagaaggcagataaggaaaagggga

SEQ ID NO: 163809 - DNA, 25 bp, Mus musculus
aagaaggcagcccagatactcagca

SEQ ID NO: 163810 - DNA, 25 bp, Mus musculus
aagaaggcagccgacgctgaagctg

SEQ ID NO: 163811 - DNA, 25 bp, Mus musculus
aagaaggcaggcctccacttacagg

SEQ ID NO: 163812 - DNA, 25 bp, Mus musculus
aagaaggccaccgacgcattccaca

SEQ ID NO: 163813 - DNA, 25 bp, Mus musculus
aagaaggccgtcagaactcggtata

SEQ ID NO: 163814 - DNA, 25 bp, Mus musculus
aagaaggccgtcagatgggtttcaa

SEQ ID NO: 163815 - DNA, 25 bp, Mus musculus
aagaaggccgtcagtgcctgatgcc

SEQ ID NO: 163816 - DNA, 25 bp, Mus musculus
aagaaggcgaggaagaaaaaagtca

SEQ ID NO: 163817 - DNA, 25 bp, Mus musculus
aagaaggcgaggaaggcattgggag

SEQ ID NO: 163818 - DNA, 25 bp, Mus musculus
aagaaggctaatgcttctgtgaaga

SEQ ID NO: 163819 - DNA, 25 bp, Mus musculus
aagaaggctcagcggaacctgcctc

SEQ ID NO: 163820 - DNA, 25 bp, Mus musculus
aagaagggacaggtgccattgacat

SEQ ID NO: 163821 - DNA, 25 bp, Mus musculus
aagaagggacaggtgtatcatccct

SEQ ID NO: 163822 - DNA, 25 bp, Mus musculus
aagaagggactacatattctgtccc

SEQ ID NO: 163823 - DNA, 25 bp, Mus musculus
aagaagggactacatgacattaaga

SEQ ID NO: 163824 - DNA, 25 bp, Mus musculus
aagaagggcaaagatgagtggttct

SEQ ID NO: 163825 - DNA, 25 bp, Mus musculus
aagaagggcaagaagcctggaattg

SEQ ID NO: 163826 - DNA, 25 bp, Mus musculus
aagaagggcaagaagtatttaggtc

SEQ ID NO: 163827 - DNA, 25 bp, Mus musculus
aagaagggcaagacgggcgcagttc

SEQ ID NO: 163828 - DNA, 25 bp, Mus musculus
aagaagggcagcgccctcggagccc

SEQ ID NO: 163829 - DNA, 25 bp, Mus musculus
aagaagggcagcgtggccaagcggc

SEQ ID NO: 163830 - DNA, 25 bp, Mus musculus
aagaagggctgccaggagatggaca

SEQ ID NO: 163831 - DNA, 25 bp, Mus musculus
aagaagggctgccaggttgaattct

SEQ ID NO: 163832 - DNA, 25 bp, Mus musculus
aagaaggggctggactgtaacagaa

SEQ ID NO: 163833 - DNA, 25 bp, Mus musculus
aagaaggggctggggaacagaaggc

SEQ ID NO: 163834 - DNA, 25 bp, Mus musculus
aagaagggggcaagggtggaccact

SEQ ID NO: 163835 - DNA, 25 bp, Mus musculus
aagaaggtgaaagacactcgtaatc

SEQ ID NO: 163836 - DNA, 25 bp, Mus musculus
aagaaggtgaaagtctcacacaggt

SEQ ID NO: 163837 - DNA, 25 bp, Mus musculus
aagaaggtgtctggccctctccagg

SEQ ID NO: 163838 - DNA, 25 bp, Mus musculus
aagaagtaaagcaagagcaccagaa

SEQ ID NO: 163839 - DNA, 25 bp, Mus musculus
aagaagtaaagcaaggctgtggctc

SEQ ID NO: 163840 - DNA, 25 bp, Mus musculus
aagaagtacttcttgcacgatgaca

SEQ ID NO: 163841 - DNA, 25 bp, Mus musculus
aagaagtagaaagatctaaaggggt

SEQ ID NO: 163842 - DNA, 25 bp, Mus musculus
aagaagtatgtggaggaacatgtgt

SEQ ID NO: 163843 - DNA, 25 bp, Mus musculus
aagaagtatgtggaggccatgggaa

SEQ ID NO: 163844 - DNA, 25 bp, Mus musculus
aagaagtcaagccaggtgcccagga

SEQ ID NO: 163845 - DNA, 25 bp, Mus musculus
aagaagtcaagggaaaagtatgtcc

SEQ ID NO: 163846 - DNA, 25 bp, Mus musculus
aagaagtcagactgtgttgtcaaat

SEQ ID NO: 163847 - DNA, 25 bp, Mus musculus
aagaagtcagccaagaaggtgaagg

SEQ ID NO: 163848 - DNA, 25 bp, Mus musculus
aagaagtcaggacaaaagactgtgt

SEQ ID NO: 163849 - DNA, 25 bp, Mus musculus
aagaagtcatactggtgaacggcct

SEQ ID NO: 163850 - DNA, 25 bp, Mus musculus
aagaagtcctgagtttatccatgct

SEQ ID NO: 163851 - DNA, 25 bp, Mus musculus
aagaagtcctggtctttgcctgcct

SEQ ID NO: 163852 - DNA, 25 bp, Mus musculus
aagaagtcctgtggaagtgtttgtc

SEQ ID NO: 163853 - DNA, 25 bp, Mus musculus
aagaagtctagaaattctgtgcaag

SEQ ID NO: 163854 - DNA, 25 bp, Mus musculus
aagaagtctagggcacttgatgcac

SEQ ID NO: 163855 - DNA, 25 bp, Mus musculus
aagaagtctgagggagccagaatca

SEQ ID NO: 163856 - DNA, 25 bp, Mus musculus
aagaagtctggcaaaatgaacacta

SEQ ID NO: 163857 - DNA, 25 bp, Mus musculus
aagaagtcttaacggtgtagtggag

SEQ ID NO: 163858 - DNA, 25 bp, Mus musculus
aagaagtcttaagggtgtagtggag

SEQ ID NO: 163859 - DNA, 25 bp, Mus musculus
aagaagtgagaacggagcacctccc

SEQ ID NO: 163860 - DNA, 25 bp, Mus musculus
aagaagtgaggccgggagcaggctg

SEQ ID NO: 163861 - DNA, 25 bp, Mus musculus
aagaagtgcatctggcctcgaactc

SEQ ID NO: 163862 - DNA, 25 bp, Mus musculus
aagaagtgccaggaatccgaatctt

SEQ ID NO: 163863 - DNA, 25 bp, Mus musculus
aagaagtgccaggagaaatctgagc

SEQ ID NO: 163864 - DNA, 25 bp, Mus musculus
aagaagtggaggcaggactctgact

SEQ ID NO: 163865 - DNA, 25 bp, Mus musculus
aagaagtgggacaggagaacgagaa

SEQ ID NO: 163866 - DNA, 25 bp, Mus musculus
aagaagtgggcacaagacagacaag

SEQ ID NO: 163867 - DNA, 25 bp, Mus musculus
aagaagtgggcacaagagtcagctc

SEQ ID NO: 163868 - DNA, 25 bp, Mus musculus
aagaagtggggtgccgccatgctgc

SEQ ID NO: 163869 - DNA, 25 bp, Mus musculus
aagaagtgtggtgctgataatacta

SEQ ID NO: 163870 - DNA, 25 bp, Mus musculus
aagaagtgtggtggattgaaccagc

SEQ ID NO: 163871 - DNA, 25 bp, Mus musculus
aagaagttatgctgcaggcacacgg

SEQ ID NO: 163872 - DNA, 25 bp, Mus musculus
aagaagttcaagattgatgaccagc

SEQ ID NO: 163873 - DNA, 25 bp, Mus musculus
aagaagttccaacctagatacttgt

SEQ ID NO: 163874 - DNA, 25 bp, Mus musculus
aagaagttccaagaccccagatgga

SEQ ID NO: 163875 - DNA, 25 bp, Mus musculus
aagaagttcgggcaggtgcagtaag

SEQ ID NO: 163876 - DNA, 25 bp, Mus musculus
aagaagttggcatgaaagctgcact

SEQ ID NO: 163877 - DNA, 25 bp, Mus musculus
aagaagtttgatcaattcttcaaag

SEQ ID NO: 163878 - DNA, 25 bp, Mus musculus
aagaagtttgatgaattcttcaaag

SEQ ID NO: 163879 - DNA, 25 bp, Mus musculus
aagaagtttgcagctaggagccctg

SEQ ID NO: 163880 - DNA, 25 bp, Mus musculus
aagaagtttgcagtgtgtgacatcc

SEQ ID NO: 163881 - DNA, 25 bp, Mus musculus
aagaagttttcagagattgctggcc

SEQ ID NO: 163882 - DNA, 25 bp, Mus musculus
aagaataaaagatgcctcaggaaca

SEQ ID NO: 163883 - DNA, 25 bp, Mus musculus
aagaataacctggcttcctgctacc

SEQ ID NO: 163884 - DNA, 25 bp, Mus musculus
aagaatacaagaagagggcagcagc

SEQ ID NO: 163885 - DNA, 25 bp, Mus musculus
aagaatacaagatcaaatgcctgtg

SEQ ID NO: 163886 - DNA, 25 bp, Mus musculus
aagaatacagggaaaatggagaact

SEQ ID NO: 163887 - DNA, 25 bp, Mus musculus
aagaatacaggtatggttttctaat

SEQ ID NO: 163888 - DNA, 25 bp, Mus musculus
aagaatacatggcaaaagaaaaaca

SEQ ID NO: 163889 - DNA, 25 bp, Mus musculus
aagaataccgcaagggcctgctgaa

SEQ ID NO: 163890 - DNA, 25 bp, Mus musculus
aagaatacctcaggtgcctgaaaaa

SEQ ID NO: 163891 - DNA, 25 bp, Mus musculus
aagaatacgcgggtcagataacact

SEQ ID NO: 163892 - DNA, 25 bp, Mus musculus
aagaataggaggcggtaaccataga

SEQ ID NO: 163893 - DNA, 25 bp, Mus musculus
aagaatagggcacaggtatattgaa

SEQ ID NO: 163894 - DNA, 25 bp, Mus musculus
aagaatattcacagattatttatag

SEQ ID NO: 163895 - DNA, 25 bp, Mus musculus
aagaatattgagacggccagagcag

SEQ ID NO: 163896 - DNA, 25 bp, Mus musculus
aagaatattgccaggagttggcatc

SEQ ID NO: 163897 - DNA, 25 bp, Mus musculus
aagaatatttaaaaacatatgacat

SEQ ID NO: 163898 - DNA, 25 bp, Mus musculus
aagaatcaaacatttttaagacaat

SEQ ID NO: 163899 - DNA, 25 bp, Mus musculus
aagaatcaagaaactgatctcagaa

SEQ ID NO: 163900 - DNA, 25 bp, Mus musculus
aagaatcacagacgcagtatgagat

SEQ ID NO: 163901 - DNA, 25 bp, Mus musculus
aagaatcacagctcgccaaatccat

SEQ ID NO: 163902 - DNA, 25 bp, Mus musculus
aagaatcacagggctggaccctgcg

SEQ ID NO: 163903 - DNA, 25 bp, Mus musculus
aagaatcagagacaccagagaagaa

SEQ ID NO: 163904 - DNA, 25 bp, Mus musculus
aagaatcagagagacaactggcagg

SEQ ID NO: 163905 - DNA, 25 bp, Mus musculus
aagaatccaccacagataactctct

SEQ ID NO: 163906 - DNA, 25 bp, Mus musculus
aagaatccaccacaggaggaaaaag

SEQ ID NO: 163907 - DNA, 25 bp, Mus musculus
aagaatccagaaaatgtaaagcaat

SEQ ID NO: 163908 - DNA, 25 bp, Mus musculus
aagaatccagaaacttggaaaagag

SEQ ID NO: 163909 - DNA, 25 bp, Mus musculus
aagaatccagagaggaagacgactg

SEQ ID NO: 163910 - DNA, 25 bp, Mus musculus
aagaatccatttgatgaagctcaac

SEQ ID NO: 163911 - DNA, 25 bp, Mus musculus
aagaatcccaaaagatctagatcca

SEQ ID NO: 163912 - DNA, 25 bp, Mus musculus
aagaatccgcaatgccctggctttc

SEQ ID NO: 163913 - DNA, 25 bp, Mus musculus
aagaatccgcaatgcttctggaatt

SEQ ID NO: 163914 - DNA, 25 bp, Mus musculus
aagaatctaagccaggttgccatga

SEQ ID NO: 163915 - DNA, 25 bp, Mus musculus
aagaatctagagctgatcataagcc

SEQ ID NO: 163916 - DNA, 25 bp, Mus musculus
aagaatctattattggtactggcgg

SEQ ID NO: 163917 - DNA, 25 bp, Mus musculus
aagaatctgaaggtccagcctgatg

SEQ ID NO: 163918 - DNA, 25 bp, Mus musculus
aagaatctgaggcctgtgagaagca

SEQ ID NO: 163919 - DNA, 25 bp, Mus musculus
aagaatgaaaggcgttgcagctcag

SEQ ID NO: 163920 - DNA, 25 bp, Mus musculus
aagaatgaaggaataacagccttgt

SEQ ID NO: 163921 - DNA, 25 bp, Mus musculus
aagaatgaaggctgaacttccactt

SEQ ID NO: 163922 - DNA, 25 bp, Mus musculus
aagaatgaagtgtatcccctactct

SEQ ID NO: 163923 - DNA, 25 bp, Mus musculus
aagaatgacattggctcgtgagctg

SEQ ID NO: 163924 - DNA, 25 bp, Mus musculus
aagaatgacatttttgccattggct

SEQ ID NO: 163925 - DNA, 25 bp, Mus musculus
aagaatgagaaaaaggattcagaat

SEQ ID NO: 163926 - DNA, 25 bp, Mus musculus
aagaatgaggaagaaaaagagagag

SEQ ID NO: 163927 - DNA, 25 bp, Mus musculus
aagaatgatggtcgaatcgatgctc

SEQ ID NO: 163928 - DNA, 25 bp, Mus musculus
aagaatgattttaggttacagccaa

SEQ ID NO: 163929 - DNA, 25 bp, Mus musculus
aagaatgccacaactgatgccttaa

SEQ ID NO: 163930 - DNA, 25 bp, Mus musculus
aagaatgccacgctgagcaccatca

SEQ ID NO: 163931 - DNA, 25 bp, Mus musculus
aagaatgccgatggagctgtcttgc

SEQ ID NO: 163932 - DNA, 25 bp, Mus musculus
aagaatgctaacaagagtgaaattc

SEQ ID NO: 163933 - DNA, 25 bp, Mus musculus
aagaatgctggcagaaggagctaac

SEQ ID NO: 163934 - DNA, 25 bp, Mus musculus
aagaatgctgttttgaatcagcggt

SEQ ID NO: 163935 - DNA, 25 bp, Mus musculus
aagaatggagagaggaggctgctcc

SEQ ID NO: 163936 - DNA, 25 bp, Mus musculus
aagaatggagagagtttggaagaac

SEQ ID NO: 163937 - DNA, 25 bp, Mus musculus
aagaatggaggtccgctggggagaa

SEQ ID NO: 163938 - DNA, 25 bp, Mus musculus
aagaatggcatgattgaggactggg

SEQ ID NO: 163939 - DNA, 25 bp, Mus musculus
aagaatggcgtgcattttctgcagc

SEQ ID NO: 163940 - DNA, 25 bp, Mus musculus
aagaatgggataatactgtgaatga

SEQ ID NO: 163941 - DNA, 25 bp, Mus musculus
aagaatgggcatgtctacacctgca

SEQ ID NO: 163942 - DNA, 25 bp, Mus musculus
aagaatggttatgataattagcacc

SEQ ID NO: 163943 - DNA, 25 bp, Mus musculus
aagaatgtacgccaggccagcgtct

SEQ ID NO: 163944 - DNA, 25 bp, Mus musculus
aagaatgtagcccggagccttctga

SEQ ID NO: 163945 - DNA, 25 bp, Mus musculus
aagaatgtcagcaggatggcacgct

SEQ ID NO: 163946 - DNA, 25 bp, Mus musculus
aagaatgtcgaagcggaggccaaaa

SEQ ID NO: 163947 - DNA, 25 bp, Mus musculus
aagaatgtgctggaattgtctgtaa

SEQ ID NO: 163948 - DNA, 25 bp, Mus musculus
aagaatgtgctgggttttctgtctc

SEQ ID NO: 163949 - DNA, 25 bp, Mus musculus
aagaatgtggagccactgtatggct

SEQ ID NO: 163950 - DNA, 25 bp, Mus musculus
aagaatgtggcaaaaaaacatttca

SEQ ID NO: 163951 - DNA, 25 bp, Mus musculus
aagaatgtggccaggcctgcaccac

SEQ ID NO: 163952 - DNA, 25 bp, Mus musculus
aagaatgtggcgctttggagtctct

SEQ ID NO: 163953 - DNA, 25 bp, Mus musculus
aagaatgtgtcctgattaccgacag

SEQ ID NO: 163954 - DNA, 25 bp, Mus musculus
aagaatgtgtcctgtcccacgctca

SEQ ID NO: 163955 - DNA, 25 bp, Mus musculus
aagaattaagtcagtggtgcagtcc

SEQ ID NO: 163956 - DNA, 25 bp, Mus musculus
aagaattagccctctttgaaccctg

SEQ ID NO: 163957 - DNA, 25 bp, Mus musculus
aagaattagccctgtcttcttcccg

SEQ ID NO: 163958 - DNA, 25 bp, Mus musculus
aagaattaggactcagtggcaatgt

SEQ ID NO: 163959 - DNA, 25 bp, Mus musculus
aagaattcaggggggaggatgactt

SEQ ID NO: 163960 - DNA, 25 bp, Mus musculus
aagaattcagtgaacagagtatctg

SEQ ID NO: 163961 - DNA, 25 bp, Mus musculus
aagaattccaaatagcatagcttgt

SEQ ID NO: 163962 - DNA, 25 bp, Mus musculus
aagaattccaaatgcttacttttct

SEQ ID NO: 163963 - DNA, 25 bp, Mus musculus
aagaattccacggacctagactcag

SEQ ID NO: 163964 - DNA, 25 bp, Mus musculus
aagaattccagaattcagtagcttt

SEQ ID NO: 163965 - DNA, 25 bp, Mus musculus
aagaattccagacacaagtacccac

SEQ ID NO: 163966 - DNA, 25 bp, Mus musculus
aagaattccagacagcttttcaaga

SEQ ID NO: 163967 - DNA, 25 bp, Mus musculus
aagaattccattatgtgagctctca

SEQ ID NO: 163968 - DNA, 25 bp, Mus musculus
aagaattccttgaatccgacgtgga

SEQ ID NO: 163969 - DNA, 25 bp, Mus musculus
aagaattccttgatccaaacgcaca

SEQ ID NO: 163970 - DNA, 25 bp, Mus musculus
aagaattcgaagagccacctaacaa

SEQ ID NO: 163971 - DNA, 25 bp, Mus musculus
aagaattctaatgttttgtgatcca

SEQ ID NO: 163972 - DNA, 25 bp, Mus musculus
aagaattctagggtactcaatgcaa

SEQ ID NO: 163973 - DNA, 25 bp, Mus musculus
aagaattgaaggtgcctgaaaaagc

SEQ ID NO: 163974 - DNA, 25 bp, Mus musculus
aagaattgcagagggtaattttcaa

SEQ ID NO: 163975 - DNA, 25 bp, Mus musculus
aagaattgcagttgcctcttttgtc

SEQ ID NO: 163976 - DNA, 25 bp, Mus musculus
aagaattgccaacagtagtcggaaa

SEQ ID NO: 163977 - DNA, 25 bp, Mus musculus
aagaatttcaagactgcgagtgcta

SEQ ID NO: 163978 - DNA, 25 bp, Mus musculus
aagaatttccattcgagcatcagac

SEQ ID NO: 163979 - DNA, 25 bp, Mus musculus
aagaatttgatgaggacagtggtga

SEQ ID NO: 163980 - DNA, 25 bp, Mus musculus
aagaatttgctgtagacattttaag

SEQ ID NO: 163981 - DNA, 25 bp, Mus musculus
aagaatttgggagggctggagacag

SEQ ID NO: 163982 - DNA, 25 bp, Mus musculus
aagaatttgtcagttggttactggc

SEQ ID NO: 163983 - DNA, 25 bp, Mus musculus
aagaatttgtccagccccagcatct

SEQ ID NO: 163984 - DNA, 25 bp, Mus musculus
aagaatttgtggaagaggagacaga

SEQ ID NO: 163985 - DNA, 25 bp, Mus musculus
aagaatttttatgttgagctaccaa

SEQ ID NO: 163986 - DNA, 25 bp, Mus musculus
aagacaaaaagagttcaaaattggg

SEQ ID NO: 163987 - DNA, 25 bp, Mus musculus
aagacaaaagactgacacatgcagc

SEQ ID NO: 163988 - DNA, 25 bp, Mus musculus
aagacaaaagatttgcaacagcatg

SEQ ID NO: 163989 - DNA, 25 bp, Mus musculus
aagacaaaattagagaggaggaaaa

SEQ ID NO: 163990 - DNA, 25 bp, Mus musculus
aagacaaaattagtccatttcagtc

SEQ ID NO: 163991 - DNA, 25 bp, Mus musculus
aagacaaagacaggatgagagacaa

SEQ ID NO: 163992 - DNA, 25 bp, Mus musculus
aagacaaagacccaggagattagcc

SEQ ID NO: 163993 - DNA, 25 bp, Mus musculus
aagacaaaggaaacagaggctacaa

SEQ ID NO: 163994 - DNA, 25 bp, Mus musculus
aagacaaaggggaagacatctttgg

SEQ ID NO: 163995 - DNA, 25 bp, Mus musculus
aagacaacaaaaatgaaaagaaagt

SEQ ID NO: 163996 - DNA, 25 bp, Mus musculus
aagacaagacagagagtggaggatg

SEQ ID NO: 163997 - DNA, 25 bp, Mus musculus
aagacaagacagggtgttgacgatg

SEQ ID NO: 163998 - DNA, 25 bp, Mus musculus
aagacaagaccggacaatacactgc

SEQ ID NO: 163999 - DNA, 25 bp, Mus musculus
aagacaagacgtggacacgcatccc

SEQ ID NO: 164000 - DNA, 25 bp, Mus musculus
aagacaagcaagagtccggccacaa

SEQ ID NO: 164001 - DNA, 25 bp, Mus musculus
aagacaagctgaccttcattgacat

SEQ ID NO: 164002 - DNA, 25 bp, Mus musculus
aagacaaggtttctacatgaaggaa

SEQ ID NO: 164003 - DNA, 25 bp, Mus musculus
aagacaagtgcagatgaaatcatgc

SEQ ID NO: 164004 - DNA, 25 bp, Mus musculus
aagacaatagcacccaggcagacaa

SEQ ID NO: 164005 - DNA, 25 bp, Mus musculus
aagacaatcaaaagggaagttgtcc

SEQ ID NO: 164006 - DNA, 25 bp, Mus musculus
aagacaatcagggcaagaaaattcc

SEQ ID NO: 164007 - DNA, 25 bp, Mus musculus
aagacaattaaaaagacgctgaacc

SEQ ID NO: 164008 - DNA, 25 bp, Mus musculus
aagacacaaaaaaaaggcagtggac

SEQ ID NO: 164009 - DNA, 25 bp, Mus musculus
aagacacaacagagcaggttaggaa

SEQ ID NO: 164010 - DNA, 25 bp, Mus musculus
aagacacaagaaatttacccaataa

SEQ ID NO: 164011 - DNA, 25 bp, Mus musculus
aagacacaattgaattaaacagact

SEQ ID NO: 164012 - DNA, 25 bp, Mus musculus
aagacacagcctgcttctacctggc

SEQ ID NO: 164013 - DNA, 25 bp, Mus musculus
aagacacagcgtgcttttacttggc

SEQ ID NO: 164014 - DNA, 25 bp, Mus musculus
aagacacagcgtggccttgggtgga

SEQ ID NO: 164015 - DNA, 25 bp, Mus musculus
aagacacagtgctgccacgaccctt

SEQ ID NO: 164016 - DNA, 25 bp, Mus musculus
aagacaccagcaccaatggaacagt

SEQ ID NO: 164017 - DNA, 25 bp, Mus musculus
aagacaccatttcagacctcaagtg

SEQ ID NO: 164018 - DNA, 25 bp, Mus musculus
aagacacccacagggataaggaagg

SEQ ID NO: 164019 - DNA, 25 bp, Mus musculus
aagacacccagaatgggctacacat

SEQ ID NO: 164020 - DNA, 25 bp, Mus musculus
aagacacccaggccagccacgctga

SEQ ID NO: 164021 - DNA, 25 bp, Mus musculus
aagacacctctcagaaaagttgtat

SEQ ID NO: 164022 - DNA, 25 bp, Mus musculus
aagacacgccagtggctgtttacct

SEQ ID NO: 164023 - DNA, 25 bp, Mus musculus
aagacacgccagtgggttcttctgt

SEQ ID NO: 164024 - DNA, 25 bp, Mus musculus
aagacactaaccctgagctcttggc

SEQ ID NO: 164025 - DNA, 25 bp, Mus musculus
aagacactagggtggctaccgtctc

SEQ ID NO: 164026 - DNA, 25 bp, Mus musculus
aagacactcaggtccctccagctat

SEQ ID NO: 164027 - DNA, 25 bp, Mus musculus
aagacactgaaaagcgccatggcta

SEQ ID NO: 164028 - DNA, 25 bp, Mus musculus
aagacactgcagcggaccttacaga

SEQ ID NO: 164029 - DNA, 25 bp, Mus musculus
aagacactgcagttcatcgtggcag

SEQ ID NO: 164030 - DNA, 25 bp, Mus musculus
aagacactggctgatctgcatcccc

SEQ ID NO: 164031 - DNA, 25 bp, Mus musculus
aagacacttgtgcggaggcccactg

SEQ ID NO: 164032 - DNA, 25 bp, Mus musculus
aagacacttgtgcgggtgactcagg

SEQ ID NO: 164033 - DNA, 25 bp, Mus musculus
aagacagacaaggcttcagaagagg

SEQ ID NO: 164034 - DNA, 25 bp, Mus musculus
aagacagacatggggagtcttctga

SEQ ID NO: 164035 - DNA, 25 bp, Mus musculus
aagacagacctgtcaagagaatcca

SEQ ID NO: 164036 - DNA, 25 bp, Mus musculus
aagacagactaaagaagtttccaga

SEQ ID NO: 164037 - DNA, 25 bp, Mus musculus
aagacagacttaggcgctaactggg

SEQ ID NO: 164038 - DNA, 25 bp, Mus musculus
aagacagagcaaggtcctgtttatt

SEQ ID NO: 164039 - DNA, 25 bp, Mus musculus
aagacagatcagaagcacaattata

SEQ ID NO: 164040 - DNA, 25 bp, Mus musculus
aagacagatcagaaggcttatggta

SEQ ID NO: 164041 - DNA, 25 bp, Mus musculus
aagacagatctgcagggcgacactc

SEQ ID NO: 164042 - DNA, 25 bp, Mus musculus
aagacagcacactagaaaccccatt

SEQ ID NO: 164043 - DNA, 25 bp, Mus musculus
aagacagcacagaccggaagaaaga

SEQ ID NO: 164044 - DNA, 25 bp, Mus musculus
aagacagcagcaaaggccgtttggg

SEQ ID NO: 164045 - DNA, 25 bp, Mus musculus
aagacagcaggctgcctttgatatt

SEQ ID NO: 164046 - DNA, 25 bp, Mus musculus
aagacagcagggagtgtgtgcctct

SEQ ID NO: 164047 - DNA, 25 bp, Mus musculus
aagacagcagggtttcaatgccctg

SEQ ID NO: 164048 - DNA, 25 bp, Mus musculus
aagacagcgaagggctcacaactca

SEQ ID NO: 164049 - DNA, 25 bp, Mus musculus
aagacagcggcagacactctgggtt

SEQ ID NO: 164050 - DNA, 25 bp, Mus musculus
aagacagcggcattgactcgggact

SEQ ID NO: 164051 - DNA, 25 bp, Mus musculus
aagacagcggccctggcccagcgcc

SEQ ID NO: 164052 - DNA, 25 bp, Mus musculus
aagacagctccagtttttcagccgt

SEQ ID NO: 164053 - DNA, 25 bp, Mus musculus
aagacagctccagtttttcaggaat

SEQ ID NO: 164054 - DNA, 25 bp, Mus musculus
aagacagctggcagaactcaacaaa

SEQ ID NO: 164055 - DNA, 25 bp, Mus musculus
aagacaggagactctaaagttgcag

SEQ ID NO: 164056 - DNA, 25 bp, Mus musculus
aagacaggagactctgtcttcctgt

SEQ ID NO: 164057 - DNA, 25 bp, Mus musculus
aagacaggagagatgagacaccaat

SEQ ID NO: 164058 - DNA, 25 bp, Mus musculus
aagacaggagggagaaagagagagc

SEQ ID NO: 164059 - DNA, 25 bp, Mus musculus
aagacagtgacagccctggagatgg

SEQ ID NO: 164060 - DNA, 25 bp, Mus musculus
aagacagtgacggccctggagatgg

SEQ ID NO: 164061 - DNA, 25 bp, Mus musculus
aagacagtgaggggaaacaggcact

SEQ ID NO: 164062 - DNA, 25 bp, Mus musculus
aagacagtgatgaggatgaagatga

SEQ ID NO: 164063 - DNA, 25 bp, Mus musculus
aagacagttacggtaaattctacat

SEQ ID NO: 164064 - DNA, 25 bp, Mus musculus
aagacagttacggtatgcttccctg

SEQ ID NO: 164065 - DNA, 25 bp, Mus musculus
aagacataatgaaggtttatggagg

SEQ ID NO: 164066 - DNA, 25 bp, Mus musculus
aagacatacaacatgctgttgtgaa

SEQ ID NO: 164067 - DNA, 25 bp, Mus musculus
aagacatacaggtgtaaggtctgcc

SEQ ID NO: 164068 - DNA, 25 bp, Mus musculus
aagacatagggaatctgtccttgaa

SEQ ID NO: 164069 - DNA, 25 bp, Mus musculus
aagacatatgggctgatgtgatggc

SEQ ID NO: 164070 - DNA, 25 bp, Mus musculus
aagacatatgggtggagccttttgc

SEQ ID NO: 164071 - DNA, 25 bp, Mus musculus
aagacatcaagtgctgtaacagttg

SEQ ID NO: 164072 - DNA, 25 bp, Mus musculus
aagacatcagaagactcaaatggtc

SEQ ID NO: 164073 - DNA, 25 bp, Mus musculus
aagacatcatcacaggagcgaggca

SEQ ID NO: 164074 - DNA, 25 bp, Mus musculus
aagacatccagaaactgaaggatga

SEQ ID NO: 164075 - DNA, 25 bp, Mus musculus
aagacatccagccggatggcgcaga

SEQ ID NO: 164076 - DNA, 25 bp, Mus musculus
aagacatccgagagctagcccacca

SEQ ID NO: 164077 - DNA, 25 bp, Mus musculus
aagacatccgagaggccatcaaaaa

SEQ ID NO: 164078 - DNA, 25 bp, Mus musculus
aagacatcgctgaccctgtctctac

SEQ ID NO: 164079 - DNA, 25 bp, Mus musculus
aagacatctactaaaccgcccagaa

SEQ ID NO: 164080 - DNA, 25 bp, Mus musculus
aagacatctatgaggaccggcacga

SEQ ID NO: 164081 - DNA, 25 bp, Mus musculus
aagacatctatgcagtgaatgggat

SEQ ID NO: 164082 - DNA, 25 bp, Mus musculus
aagacatctgcaagtgcacgttggt

SEQ ID NO: 164083 - DNA, 25 bp, Mus musculus
aagacatcttcaggcgctttggccg

SEQ ID NO: 164084 - DNA, 25 bp, Mus musculus
aagacatgaagaaatattatcacaa

SEQ ID NO: 164085 - DNA, 25 bp, Mus musculus
aagacatgaggactttcagtcagaa

SEQ ID NO: 164086 - DNA, 25 bp, Mus musculus
aagacatgcagcctctatttaaggt

SEQ ID NO: 164087 - DNA, 25 bp, Mus musculus
aagacatggaagggctgggactgct

SEQ ID NO: 164088 - DNA, 25 bp, Mus musculus
aagacatgtattcgtaacaataaag

SEQ ID NO: 164089 - DNA, 25 bp, Mus musculus
aagacatgtcagcttctctgtccac

SEQ ID NO: 164090 - DNA, 25 bp, Mus musculus
aagacattagaagatctcaggaaaa

SEQ ID NO: 164091 - DNA, 25 bp, Mus musculus
aagacattatggaggacactatcga

SEQ ID NO: 164092 - DNA, 25 bp, Mus musculus
aagacattcacgattgttggtgacg

SEQ ID NO: 164093 - DNA, 25 bp, Mus musculus
aagacattctggagccagcagggcc

SEQ ID NO: 164094 - DNA, 25 bp, Mus musculus
aagacattctggagggatgagacac

SEQ ID NO: 164095 - DNA, 25 bp, Mus musculus
aagacattcttgaggtggagtcttt

SEQ ID NO: 164096 - DNA, 25 bp, Mus musculus
aagacattgagggtcacttttcata

SEQ ID NO: 164097 - DNA, 25 bp, Mus musculus
aagacattgatgacctttggcaaga

SEQ ID NO: 164098 - DNA, 25 bp, Mus musculus
aagacattgctagcatttgaagaca

SEQ ID NO: 164099 - DNA, 25 bp, Mus musculus
aagacattggcgtatttgctgcctg

SEQ ID NO: 164100 - DNA, 25 bp, Mus musculus
aagaccaaaacgccagccacctgct

SEQ ID NO: 164101 - DNA, 25 bp, Mus musculus
aagaccaaaacgggggagcagtgcc

SEQ ID NO: 164102 - DNA, 25 bp, Mus musculus
aagaccaaaggccagccttttgacc

SEQ ID NO: 164103 - DNA, 25 bp, Mus musculus
aagaccaacagaacttgacgagagg

SEQ ID NO: 164104 - DNA, 25 bp, Mus musculus
aagaccaagagaccacagcagttta

SEQ ID NO: 164105 - DNA, 25 bp, Mus musculus
aagaccaagagcaagaccaggtgct

SEQ ID NO: 164106 - DNA, 25 bp, Mus musculus
aagaccaagagcaaggcgacggtgt

SEQ ID NO: 164107 - DNA, 25 bp, Mus musculus
aagaccaagaggttgaaaggaaatg

SEQ ID NO: 164108 - DNA, 25 bp, Mus musculus
aagaccaagatccagatcttactct

SEQ ID NO: 164109 - DNA, 25 bp, Mus musculus
aagaccaagcaccagaatgcaaggg

SEQ ID NO: 164110 - DNA, 25 bp, Mus musculus
aagaccaagcaccagctgcgatact

SEQ ID NO: 164111 - DNA, 25 bp, Mus musculus
aagaccaagccccagctgcgatact

SEQ ID NO: 164112 - DNA, 25 bp, Mus musculus
aagaccaagcgctggaaggtaggcc

SEQ ID NO: 164113 - DNA, 25 bp, Mus musculus
aagaccaagcggatctctttcctgc

SEQ ID NO: 164114 - DNA, 25 bp, Mus musculus
aagaccaatgtgaagatatcaatga

SEQ ID NO: 164115 - DNA, 25 bp, Mus musculus
aagaccaatgtgaagatattgatga

SEQ ID NO: 164116 - DNA, 25 bp, Mus musculus
aagaccacaaagaaacatggtgaag

SEQ ID NO: 164117 - DNA, 25 bp, Mus musculus
aagaccacaaatgggcgacttccag

SEQ ID NO: 164118 - DNA, 25 bp, Mus musculus
aagaccacaaattgatccagctgat

SEQ ID NO: 164119 - DNA, 25 bp, Mus musculus
aagaccacaacagcatgtagttcat

SEQ ID NO: 164120 - DNA, 25 bp, Mus musculus
aagaccacacagagacttgaaaatc

SEQ ID NO: 164121 - DNA, 25 bp, Mus musculus
aagaccacacagagtttatggttca

SEQ ID NO: 164122 - DNA, 25 bp, Mus musculus
aagaccagaagctctgactatgcat

SEQ ID NO: 164123 - DNA, 25 bp, Mus musculus
aagaccagcaaactgcctactcgcc

SEQ ID NO: 164124 - DNA, 25 bp, Mus musculus
aagaccagcaaactgcggggactga

SEQ ID NO: 164125 - DNA, 25 bp, Mus musculus
aagaccagcaaactggcaccgacag

SEQ ID NO: 164126 - DNA, 25 bp, Mus musculus
aagaccagcaggctagatatggatt

SEQ ID NO: 164127 - DNA, 25 bp, Mus musculus
aagaccagcaggttacagtcgggct

SEQ ID NO: 164128 - DNA, 25 bp, Mus musculus
aagaccaggcagggtctcctggaag

SEQ ID NO: 164129 - DNA, 25 bp, Mus musculus
aagaccagggaggtgactgacttac

SEQ ID NO: 164130 - DNA, 25 bp, Mus musculus
aagaccaggtggcaggtatttcccc

SEQ ID NO: 164131 - DNA, 25 bp, Mus musculus
aagaccatcaaggcactagatgggg

SEQ ID NO: 164132 - DNA, 25 bp, Mus musculus
aagaccatcaccctggaggtcgagc

SEQ ID NO: 164133 - DNA, 25 bp, Mus musculus
aagaccatcagattatgggacagtc

SEQ ID NO: 164134 - DNA, 25 bp, Mus musculus
aagaccatcttgcagtgcgccctca

SEQ ID NO: 164135 - DNA, 25 bp, Mus musculus
aagaccatgaagggctgccaacagt

SEQ ID NO: 164136 - DNA, 25 bp, Mus musculus
aagaccatgaagttggacaactttt

SEQ ID NO: 164137 - DNA, 25 bp, Mus musculus
aagaccatggaagagatctgtgaag

SEQ ID NO: 164138 - DNA, 25 bp, Mus musculus
aagaccattggagaaggagaggaat

SEQ ID NO: 164139 - DNA, 25 bp, Mus musculus
aagacccaaagcgtctgatggctat

SEQ ID NO: 164140 - DNA, 25 bp, Mus musculus
aagacccaagcttggatctagcaat

SEQ ID NO: 164141 - DNA, 25 bp, Mus musculus
aagacccacacctcacaaattgaag

SEQ ID NO: 164142 - DNA, 25 bp, Mus musculus
aagacccacgcaaactacagctgaa

SEQ ID NO: 164143 - DNA, 25 bp, Mus musculus
aagacccagaaatttgtatgcccgg

SEQ ID NO: 164144 - DNA, 25 bp, Mus musculus
aagacccagaggacacaaagatcga

SEQ ID NO: 164145 - DNA, 25 bp, Mus musculus
aagacccagaggaggaagagtttgc

SEQ ID NO: 164146 - DNA, 25 bp, Mus musculus
aagacccagcagaataactgccatg

SEQ ID NO: 164147 - DNA, 25 bp, Mus musculus
aagacccagcccagaacaagcctgc

SEQ ID NO: 164148 - DNA, 25 bp, Mus musculus
aagacccagcccaggtgaggaattt

SEQ ID NO: 164149 - DNA, 25 bp, Mus musculus
aagacccagcccaggttccgagtcc

SEQ ID NO: 164150 - DNA, 25 bp, Mus musculus
aagacccatctttcgactaagatgc

SEQ ID NO: 164151 - DNA, 25 bp, Mus musculus
aagacccattgagaagagatgaggc

SEQ ID NO: 164152 - DNA, 25 bp, Mus musculus
aagaccccactcagagatgctgagc

SEQ ID NO: 164153 - DNA, 25 bp, Mus musculus
aagaccccactgactcatcccagga

SEQ ID NO: 164154 - DNA, 25 bp, Mus musculus
aagaccccaggccagcgctcagccc

SEQ ID NO: 164155 - DNA, 25 bp, Mus musculus
aagacccccgctgcaggctttgctt

SEQ ID NO: 164156 - DNA, 25 bp, Mus musculus
aagacccccgctggtctcagctatc

SEQ ID NO: 164157 - DNA, 25 bp, Mus musculus
aagacccccgctgttggagacagga

SEQ ID NO: 164158 - DNA, 25 bp, Mus musculus
aagaccccgggtcttgttgcagcat

SEQ ID NO: 164159 - DNA, 25 bp, Mus musculus
aagaccccttggaggagaggatgct

SEQ ID NO: 164160 - DNA, 25 bp, Mus musculus
aagacccgctgtctgggaagagcat

SEQ ID NO: 164161 - DNA, 25 bp, Mus musculus
aagaccctcacctccacgccctaat

SEQ ID NO: 164162 - DNA, 25 bp, Mus musculus
aagaccctcatatagaaaaatactg

SEQ ID NO: 164163 - DNA, 25 bp, Mus musculus
aagaccctgacagcaagaccatcac

SEQ ID NO: 164164 - DNA, 25 bp, Mus musculus
aagaccctgcagggagagagaatca

SEQ ID NO: 164165 - DNA, 25 bp, Mus musculus
aagaccctgccagggatggcgcggc

SEQ ID NO: 164166 - DNA, 25 bp, Mus musculus
aagaccctgggaagactaaaatgtc

SEQ ID NO: 164167 - DNA, 25 bp, Mus musculus
aagaccctgtgtcacgaacccctgc

SEQ ID NO: 164168 - DNA, 25 bp, Mus musculus
aagacccttaaagatgaccttgctt

SEQ ID NO: 164169 - DNA, 25 bp, Mus musculus
aagaccgactgaagcacggtgcaac

SEQ ID NO: 164170 - DNA, 25 bp, Mus musculus
aagaccggcttctcctcggaccaga

SEQ ID NO: 164171 - DNA, 25 bp, Mus musculus
aagaccgtgactctcaactccgaag

SEQ ID NO: 164172 - DNA, 25 bp, Mus musculus
aagacctaaatgactggcttcccca

SEQ ID NO: 164173 - DNA, 25 bp, Mus musculus
aagacctaaatggagaactgttcct

SEQ ID NO: 164174 - DNA, 25 bp, Mus musculus
aagacctaatgaaagctgcaccgcc

SEQ ID NO: 164175 - DNA, 25 bp, Mus musculus
aagacctaatgcgcctagaaaagga

SEQ ID NO: 164176 - DNA, 25 bp, Mus musculus
aagacctacaaggtcggacatcaaa

SEQ ID NO: 164177 - DNA, 25 bp, Mus musculus
aagacctacagctgcaccaaagcca

SEQ ID NO: 164178 - DNA, 25 bp, Mus musculus
aagacctacaggaatcacaggttca

SEQ ID NO: 164179 - DNA, 25 bp, Mus musculus
aagacctactcccagtgaccttcag

SEQ ID NO: 164180 - DNA, 25 bp, Mus musculus
aagacctatccagcccaccagaacc

SEQ ID NO: 164181 - DNA, 25 bp, Mus musculus
aagacctattcccgacataggaggc

SEQ ID NO: 164182 - DNA, 25 bp, Mus musculus
aagacctcactccagtcccgctcgg

SEQ ID NO: 164183 - DNA, 25 bp, Mus musculus
aagacctcactgacctctcactgcc

SEQ ID NO: 164184 - DNA, 25 bp, Mus musculus
aagacctcactgtttctctatataa

SEQ ID NO: 164185 - DNA, 25 bp, Mus musculus
aagacctccaagatctcctacctct

SEQ ID NO: 164186 - DNA, 25 bp, Mus musculus
aagacctccagagtggtggattgtc

SEQ ID NO: 164187 - DNA, 25 bp, Mus musculus
aagacctcccagatggtgttagcag

SEQ ID NO: 164188 - DNA, 25 bp, Mus musculus
aagacctgatcctgtggaagaggtg

SEQ ID NO: 164189 - DNA, 25 bp, Mus musculus
aagacctgcaagccctacctgacct

SEQ ID NO: 164190 - DNA, 25 bp, Mus musculus
aagacctgcaaggaatctccggttc

SEQ ID NO: 164191 - DNA, 25 bp, Mus musculus
aagacctgcaaggtccccaacccta

SEQ ID NO: 164192 - DNA, 25 bp, Mus musculus
aagacctggaggaggtgatcacagt

SEQ ID NO: 164193 - DNA, 25 bp, Mus musculus
aagacctggaggattacctgttgca

SEQ ID NO: 164194 - DNA, 25 bp, Mus musculus
aagacctggcacagtcaggttttca

SEQ ID NO: 164195 - DNA, 25 bp, Mus musculus
aagacctggcacattcctcttcaga

SEQ ID NO: 164196 - DNA, 25 bp, Mus musculus
aagacctggccaactgtaacagaag

SEQ ID NO: 164197 - DNA, 25 bp, Mus musculus
aagacctggccagtatattattctc

SEQ ID NO: 164198 - DNA, 25 bp, Mus musculus
aagaccttaccaaggaccgtagcct

SEQ ID NO: 164199 - DNA, 25 bp, Mus musculus
aagaccttcaggatcaagattatag

SEQ ID NO: 164200 - DNA, 25 bp, Mus musculus
aagaccttgagagctgttctgccaa

SEQ ID NO: 164201 - DNA, 25 bp, Mus musculus
aagaccttgagccaaagccctgttt

SEQ ID NO: 164202 - DNA, 25 bp, Mus musculus
aagacctttaaccagcaagccccgc

SEQ ID NO: 164203 - DNA, 25 bp, Mus musculus
aagacctttaccaagagctgggtcg

SEQ ID NO: 164204 - DNA, 25 bp, Mus musculus
aagacctttccccagagcccgactc

SEQ ID NO: 164205 - DNA, 25 bp, Mus musculus
aagacctttccccaggcccggagca

SEQ ID NO: 164206 - DNA, 25 bp, Mus musculus
aagacgaaagaatcctgtggaagaa

SEQ ID NO: 164207 - DNA, 25 bp, Mus musculus
aagacgaaaggtacctgttgttctg

SEQ ID NO: 164208 - DNA, 25 bp, Mus musculus
aagacgaactaggtcctgtgccatt

SEQ ID NO: 164209 - DNA, 25 bp, Mus musculus
aagacgaagaaaggccacggaacac

SEQ ID NO: 164210 - DNA, 25 bp, Mus musculus
aagacgaagaaaggctacttcgtgt

SEQ ID NO: 164211 - DNA, 25 bp, Mus musculus
aagacgaaggaagacgtgggagagt

SEQ ID NO: 164212 - DNA, 25 bp, Mus musculus
aagacgaaggaagaggtgggagagt

SEQ ID NO: 164213 - DNA, 25 bp, Mus musculus
aagacgaattacctattgaagtgga

SEQ ID NO: 164214 - DNA, 25 bp, Mus musculus
aagacgacaaaggtcccccctgtgg

SEQ ID NO: 164215 - DNA, 25 bp, Mus musculus
aagacgagctgtaaggtgacagaag

SEQ ID NO: 164216 - DNA, 25 bp, Mus musculus
aagacgagctgtaagtgagcttcac

SEQ ID NO: 164217 - DNA, 25 bp, Mus musculus
aagacgaggagtggttccgatctaa

SEQ ID NO: 164218 - DNA, 25 bp, Mus musculus
aagacgaggcgggacatgttctcag

SEQ ID NO: 164219 - DNA, 25 bp, Mus musculus
aagacgaggcgggccatccgggtat

SEQ ID NO: 164220 - DNA, 25 bp, Mus musculus
aagacgatgaggagaaagaaaagaa

SEQ ID NO: 164221 - DNA, 25 bp, Mus musculus
aagacgcaaaagagtgtgaagattg

SEQ ID NO: 164222 - DNA, 25 bp, Mus musculus
aagacgcaattcagtcaggatggct

SEQ ID NO: 164223 - DNA, 25 bp, Mus musculus
aagacgcctatgcaggagcatctgc

SEQ ID NO: 164224 - DNA, 25 bp, Mus musculus
aagacgcctatggctcagaggactc

SEQ ID NO: 164225 - DNA, 25 bp, Mus musculus
aagacgcctctcatggtcgctgtct

SEQ ID NO: 164226 - DNA, 25 bp, Mus musculus
aagacggaaagctcatcaagcaatc

SEQ ID NO: 164227 - DNA, 25 bp, Mus musculus
aagacggaaaggagagatctgtagg

SEQ ID NO: 164228 - DNA, 25 bp, Mus musculus
aagacggaaggactggaaatggcag

SEQ ID NO: 164229 - DNA, 25 bp, Mus musculus
aagacggacaccatgatatctttac

SEQ ID NO: 164230 - DNA, 25 bp, Mus musculus
aagacggacagtgttacgaagcgga

SEQ ID NO: 164231 - DNA, 25 bp, Mus musculus
aagacggactgaggaaaacaaaaat

SEQ ID NO: 164232 - DNA, 25 bp, Mus musculus
aagacggtgagcagggatatcgctc

SEQ ID NO: 164233 - DNA, 25 bp, Mus musculus
aagacggtgcttggcctgttcttct

SEQ ID NO: 164234 - DNA, 25 bp, Mus musculus
aagacgtcagataatcaaattaaat

SEQ ID NO: 164235 - DNA, 25 bp, Mus musculus
aagacgtcaggtaatcaaattaaat

SEQ ID NO: 164236 - DNA, 25 bp, Mus musculus
aagacgtcgcggccgcatggcggac

SEQ ID NO: 164237 - DNA, 25 bp, Mus musculus
aagacgtcgtgtggcatgtgggcac

SEQ ID NO: 164238 - DNA, 25 bp, Mus musculus
aagacgtgaaattgcaagctttctc

SEQ ID NO: 164239 - DNA, 25 bp, Mus musculus
aagacgtgaatatccgctccattca

SEQ ID NO: 164240 - DNA, 25 bp, Mus musculus
aagacgtgggcgatggttgtggagt

SEQ ID NO: 164241 - DNA, 25 bp, Mus musculus
aagacgtgggcggctgttttgagct

SEQ ID NO: 164242 - DNA, 25 bp, Mus musculus
aagacgtttgtcctgctgtgtttca

SEQ ID NO: 164243 - DNA, 25 bp, Mus musculus
aagactaaatgggtgaccgaggtcc

SEQ ID NO: 164244 - DNA, 25 bp, Mus musculus
aagactaaggcagggcctagtaact

SEQ ID NO: 164245 - DNA, 25 bp, Mus musculus
aagactacagatgggcagcagattt

SEQ ID NO: 164246 - DNA, 25 bp, Mus musculus
aagactacagctcgacatgggttac

SEQ ID NO: 164247 - DNA, 25 bp, Mus musculus
aagactacaggacctgcagggacct

SEQ ID NO: 164248 - DNA, 25 bp, Mus musculus
aagactacagttgcagctcgacatg

SEQ ID NO: 164249 - DNA, 25 bp, Mus musculus
aagactaccaacagctcttcgcggc

SEQ ID NO: 164250 - DNA, 25 bp, Mus musculus
aagactaccaagctccacttcgaag

SEQ ID NO: 164251 - DNA, 25 bp, Mus musculus
aagactaccaagtgaacacctttat

SEQ ID NO: 164252 - DNA, 25 bp, Mus musculus
aagactactacagtcacctgaagaa

SEQ ID NO: 164253 - DNA, 25 bp, Mus musculus
aagactatcatgttccaagatgcct

SEQ ID NO: 164254 - DNA, 25 bp, Mus musculus
aagactatcatttatttccgagaga

SEQ ID NO: 164255 - DNA, 25 bp, Mus musculus
aagactatgactcagacaagctatt

SEQ ID NO: 164256 - DNA, 25 bp, Mus musculus
aagactatgcgcaagaaaggaaaga

SEQ ID NO: 164257 - DNA, 25 bp, Mus musculus
aagactcaaagagcaacttgatttc

SEQ ID NO: 164258 - DNA, 25 bp, Mus musculus
aagactccagagatctacctggcgt

SEQ ID NO: 164259 - DNA, 25 bp, Mus musculus
aagactccagtgagagttgctggaa

SEQ ID NO: 164260 - DNA, 25 bp, Mus musculus
aagactcccaggagattaccaagga

SEQ ID NO: 164261 - DNA, 25 bp, Mus musculus
aagactcccaggagttgaccctgga

SEQ ID NO: 164262 - DNA, 25 bp, Mus musculus
aagactccgccacctccgccttact

SEQ ID NO: 164263 - DNA, 25 bp, Mus musculus
aagactccgtgtgtcacattagctt

SEQ ID NO: 164264 - DNA, 25 bp, Mus musculus
aagactcctctgattcagatgccac

SEQ ID NO: 164265 - DNA, 25 bp, Mus musculus
aagactccttggcgcttagtgctgc

SEQ ID NO: 164266 - DNA, 25 bp, Mus musculus
aagactcgaaacttatagctctcat

SEQ ID NO: 164267 - DNA, 25 bp, Mus musculus
aagactcgatgtgtttacagtggat

SEQ ID NO: 164268 - DNA, 25 bp, Mus musculus
aagactctagatattagctcaatca

SEQ ID NO: 164269 - DNA, 25 bp, Mus musculus
aagactctaggatcaagtgagctgt

SEQ ID NO: 164270 - DNA, 25 bp, Mus musculus
aagactctagtctttcaggttccat

SEQ ID NO: 164271 - DNA, 25 bp, Mus musculus
aagactctcaccaagcggacagaga

SEQ ID NO: 164272 - DNA, 25 bp, Mus musculus
aagactctcaccaaggctctggcct

SEQ ID NO: 164273 - DNA, 25 bp, Mus musculus
aagactctcagaccaaatacacact

SEQ ID NO: 164274 - DNA, 25 bp, Mus musculus
aagactctcaggccggggagcgtca

SEQ ID NO: 164275 - DNA, 25 bp, Mus musculus
aagactctcccagggatgaacaggc

SEQ ID NO: 164276 - DNA, 25 bp, Mus musculus
aagactctgaaacagagatggctcc

SEQ ID NO: 164277 - DNA, 25 bp, Mus musculus
aagactctgaaacaggtcctgccta

SEQ ID NO: 164278 - DNA, 25 bp, Mus musculus
aagactctgcttttggcaactcgtt

SEQ ID NO: 164279 - DNA, 25 bp, Mus musculus
aagactctgtcggggctggtgagat

SEQ ID NO: 164280 - DNA, 25 bp, Mus musculus
aagactgaaccagctctccaggagg

SEQ ID NO: 164281 - DNA, 25 bp, Mus musculus
aagactgaactaagacagaaagaca

SEQ ID NO: 164282 - DNA, 25 bp, Mus musculus
aagactgactccgtatgaggttgat

SEQ ID NO: 164283 - DNA, 25 bp, Mus musculus
aagactgagaacaggtccaaagaga

SEQ ID NO: 164284 - DNA, 25 bp, Mus musculus
aagactgagaacaggtctaggtcca

SEQ ID NO: 164285 - DNA, 25 bp, Mus musculus
aagactgagaagatgggtaatgcca

SEQ ID NO: 164286 - DNA, 25 bp, Mus musculus
aagactgcaaagaggctgatttatc

SEQ ID NO: 164287 - DNA, 25 bp, Mus musculus
aagactgcagagaacttcagagccc

SEQ ID NO: 164288 - DNA, 25 bp, Mus musculus
aagactgcagatgcccccgaaaaag

SEQ ID NO: 164289 - DNA, 25 bp, Mus musculus
aagactgcagcaaatgaagctggtg

SEQ ID NO: 164290 - DNA, 25 bp, Mus musculus
aagactgcaggaagaaagtctgcac

SEQ ID NO: 164291 - DNA, 25 bp, Mus musculus
aagactgcaggaagcttgggatccg

SEQ ID NO: 164292 - DNA, 25 bp, Mus musculus
aagactgcaggaggtctccaggtgg

SEQ ID NO: 164293 - DNA, 25 bp, Mus musculus
aagactgcgagcacgtagaagaccc

SEQ ID NO: 164294 - DNA, 25 bp, Mus musculus
aagactgcgaggaccgtcacgacgg

SEQ ID NO: 164295 - DNA, 25 bp, Mus musculus
aagactgctccagggaaaatagaga

SEQ ID NO: 164296 - DNA, 25 bp, Mus musculus
aagactgctccaggtcctggaggcc

SEQ ID NO: 164297 - DNA, 25 bp, Mus musculus
aagactgctgacagaaatcttaaaa

SEQ ID NO: 164298 - DNA, 25 bp, Mus musculus
aagactggagagaagctgaagaagg

SEQ ID NO: 164299 - DNA, 25 bp, Mus musculus
aagactggagtccagcaatccaaac

SEQ ID NO: 164300 - DNA, 25 bp, Mus musculus
aagactggatactgcctgtgcctca

SEQ ID NO: 164301 - DNA, 25 bp, Mus musculus
aagactggatactggtaacagcatg

SEQ ID NO: 164302 - DNA, 25 bp, Mus musculus
aagactggcaaggttactttggagt

SEQ ID NO: 164303 - DNA, 25 bp, Mus musculus
aagactggcacatgaggtcgggtgg

SEQ ID NO: 164304 - DNA, 25 bp, Mus musculus
aagactggcaggacagtttcttgaa

SEQ ID NO: 164305 - DNA, 25 bp, Mus musculus
aagactgtaccaggcccagtctgtg

SEQ ID NO: 164306 - DNA, 25 bp, Mus musculus
aagactgtaccagggccacacccta

SEQ ID NO: 164307 - DNA, 25 bp, Mus musculus
aagactgtaccagtgacttcaatgc

SEQ ID NO: 164308 - DNA, 25 bp, Mus musculus
aagactgtccacagatacttggata

SEQ ID NO: 164309 - DNA, 25 bp, Mus musculus
aagactgtcgctcctgtgcggcaca

SEQ ID NO: 164310 - DNA, 25 bp, Mus musculus
aagactgtgaaagtgtatgagaagt

SEQ ID NO: 164311 - DNA, 25 bp, Mus musculus
aagactgtggacgatgtcataaagg

SEQ ID NO: 164312 - DNA, 25 bp, Mus musculus
aagactgtggacgggattctctgct

SEQ ID NO: 164313 - DNA, 25 bp, Mus musculus
aagactgtggagaccacagacagca

SEQ ID NO: 164314 - DNA, 25 bp, Mus musculus
aagactgtggaggtcttctgcgagt

SEQ ID NO: 164315 - DNA, 25 bp, Mus musculus
aagacttaatcaccgtcattaccca

SEQ ID NO: 164316 - DNA, 25 bp, Mus musculus
aagacttaatgtttgtgtgtctaaa

SEQ ID NO: 164317 - DNA, 25 bp, Mus musculus
aagacttagagaaggaagggaacat

SEQ ID NO: 164318 - DNA, 25 bp, Mus musculus
aagacttcaacaaggtaatgcaggt

SEQ ID NO: 164319 - DNA, 25 bp, Mus musculus
aagacttcaagaggacgctggtaga

SEQ ID NO: 164320 - DNA, 25 bp, Mus musculus
aagacttcacactgttccaggcttt

SEQ ID NO: 164321 - DNA, 25 bp, Mus musculus
aagacttcaccacagtgtttacaaa

SEQ ID NO: 164322 - DNA, 25 bp, Mus musculus
aagacttctccaggctagaaaatgc

SEQ ID NO: 164323 - DNA, 25 bp, Mus musculus
aagacttgcactggttgttcatcgc

SEQ ID NO: 164324 - DNA, 25 bp, Mus musculus
aagacttgccgggtggagacagagt

SEQ ID NO: 164325 - DNA, 25 bp, Mus musculus
aagacttggagcactttgaggaaac

SEQ ID NO: 164326 - DNA, 25 bp, Mus musculus
aagacttgtattaagatgggcgtat

SEQ ID NO: 164327 - DNA, 25 bp, Mus musculus
aagacttgtctctggcgtgggtgac

SEQ ID NO: 164328 - DNA, 25 bp, Mus musculus
aagactttagtcctgcactagaaac

SEQ ID NO: 164329 - DNA, 25 bp, Mus musculus
aagactttggtggcacgcggtgtcg

SEQ ID NO: 164330 - DNA, 25 bp, Mus musculus
aagacttttgggctctatacaacca

SEQ ID NO: 164331 - DNA, 25 bp, Mus musculus
aagactttttacaaagtgattggag

SEQ ID NO: 164332 - DNA, 25 bp, Mus musculus
aagagaaaaaagaatggaatggcaa

SEQ ID NO: 164333 - DNA, 25 bp, Mus musculus
aagagaaaaaagatttgatgttgaa

SEQ ID NO: 164334 - DNA, 25 bp, Mus musculus
aagagaaaacaggcatgtaatgaat

SEQ ID NO: 164335 - DNA, 25 bp, Mus musculus
aagagaaaacaggtctcagcatcag

SEQ ID NO: 164336 - DNA, 25 bp, Mus musculus
aagagaaaagaaccaagaaagaaga

SEQ ID NO: 164337 - DNA, 25 bp, Mus musculus
aagagaaaaggtctttcgcaccttc

SEQ ID NO: 164338 - DNA, 25 bp, Mus musculus
aagagaaaagtgttaatggccagca

SEQ ID NO: 164339 - DNA, 25 bp, Mus musculus
aagagaaaagttttggcatacaaat

SEQ ID NO: 164340 - DNA, 25 bp, Mus musculus
aagagaaaatgaaagcagaccgcgc

SEQ ID NO: 164341 - DNA, 25 bp, Mus musculus
aagagaaactggacagagccaatgc

SEQ ID NO: 164342 - DNA, 25 bp, Mus musculus
aagagaaagagagtgtaatccacct

SEQ ID NO: 164343 - DNA, 25 bp, Mus musculus
aagagaaagtgtttatgggaccgtc

SEQ ID NO: 164344 - DNA, 25 bp, Mus musculus
aagagaaatacagatgtctctttaa

SEQ ID NO: 164345 - DNA, 25 bp, Mus musculus
aagagaaatcaagggcttaaggaat

SEQ ID NO: 164346 - DNA, 25 bp, Mus musculus
aagagaaatcaagtttgcttttcct

SEQ ID NO: 164347 - DNA, 25 bp, Mus musculus
aagagaaatggttcccataacaact

SEQ ID NO: 164348 - DNA, 25 bp, Mus musculus
aagagaacaaattgaaatggatgca

SEQ ID NO: 164349 - DNA, 25 bp, Mus musculus
aagagaacaagaggtttgaagatca

SEQ ID NO: 164350 - DNA, 25 bp, Mus musculus
aagagaaccagcattggattgcaat

SEQ ID NO: 164351 - DNA, 25 bp, Mus musculus
aagagaaccggcatggagagtagaa

SEQ ID NO: 164352 - DNA, 25 bp, Mus musculus
aagagaacttggtctctgggccagg

SEQ ID NO: 164353 - DNA, 25 bp, Mus musculus
aagagaagaaaaagctctcttaaga

SEQ ID NO: 164354 - DNA, 25 bp, Mus musculus
aagagaagaaagaggaagatggacg

SEQ ID NO: 164355 - DNA, 25 bp, Mus musculus
aagagaagaagaataacccatggct

SEQ ID NO: 164356 - DNA, 25 bp, Mus musculus
aagagaagaagaattaactctgctg

SEQ ID NO: 164357 - DNA, 25 bp, Mus musculus
aagagaagaagaatttgggcttcct

SEQ ID NO: 164358 - DNA, 25 bp, Mus musculus
aagagaagaagcgcaggaaaggtgg

SEQ ID NO: 164359 - DNA, 25 bp, Mus musculus
aagagaagagacactgcagcggaag

SEQ ID NO: 164360 - DNA, 25 bp, Mus musculus
aagagaagatccagggcttggaccg

SEQ ID NO: 164361 - DNA, 25 bp, Mus musculus
aagagaagatgagattctgttttga

SEQ ID NO: 164362 - DNA, 25 bp, Mus musculus
aagagaagatgagatttctgctttc

SEQ ID NO: 164363 - DNA, 25 bp, Mus musculus
aagagaagattgaagccatggctga

SEQ ID NO: 164364 - DNA, 25 bp, Mus musculus
aagagaagcagcttgtgaaaaagca

SEQ ID NO: 164365 - DNA, 25 bp, Mus musculus
aagagaagcccaaggagggtgtgaa

SEQ ID NO: 164366 - DNA, 25 bp, Mus musculus
aagagaagcccgagttcgtgagtgt

SEQ ID NO: 164367 - DNA, 25 bp, Mus musculus
aagagaagctgttgcaggaagaggc

SEQ ID NO: 164368 - DNA, 25 bp, Mus musculus
aagagaagcttcgagcagcagtttt

SEQ ID NO: 164369 - DNA, 25 bp, Mus musculus
aagagaaggaggaagaggaggacga

SEQ ID NO: 164370 - DNA, 25 bp, Mus musculus
aagagaaggatgcatcttcctggtc

SEQ ID NO: 164371 - DNA, 25 bp, Mus musculus
aagagaaggatggcatccccatcag

SEQ ID NO: 164372 - DNA, 25 bp, Mus musculus
aagagaagggcagtgttgctgaagc

SEQ ID NO: 164373 - DNA, 25 bp, Mus musculus
aagagaataaaacagaaacatggag

SEQ ID NO: 164374 - DNA, 25 bp, Mus musculus
aagagaataaatggcttgttggcag

SEQ ID NO: 164375 - DNA, 25 bp, Mus musculus
aagagaataggagaaagcatccacc

SEQ ID NO: 164376 - DNA, 25 bp, Mus musculus
aagagaatatgaccacctatctaga

SEQ ID NO: 164377 - DNA, 25 bp, Mus musculus
aagagaatatgagatcctgcaacga

SEQ ID NO: 164378 - DNA, 25 bp, Mus musculus
aagagaatatgagttccagcagcac

SEQ ID NO: 164379 - DNA, 25 bp, Mus musculus
aagagaatcgagcctagaataccca

SEQ ID NO: 164380 - DNA, 25 bp, Mus musculus
aagagaatgatagcttggagatttc

SEQ ID NO: 164381 - DNA, 25 bp, Mus musculus
aagagaatgcccaggctgaagcgca

SEQ ID NO: 164382 - DNA, 25 bp, Mus musculus
aagagaattgagcgtttatcactcc

SEQ ID NO: 164383 - DNA, 25 bp, Mus musculus
aagagacaaaaaagagttgatcaag

SEQ ID NO: 164384 - DNA, 25 bp, Mus musculus
aagagacaaaagaggcttttcagat

SEQ ID NO: 164385 - DNA, 25 bp, Mus musculus
aagagacaaaagagtttcaactcct

SEQ ID NO: 164386 - DNA, 25 bp, Mus musculus
aagagacaaggcatagtgcagtcgg

SEQ ID NO: 164387 - DNA, 25 bp, Mus musculus
aagagacacaagggtaaggaatcag

SEQ ID NO: 164388 - DNA, 25 bp, Mus musculus
aagagacacaagggtgctgatggag

SEQ ID NO: 164389 - DNA, 25 bp, Mus musculus
aagagacagaggctgcttggtgcgg

SEQ ID NO: 164390 - DNA, 25 bp, Mus musculus
aagagacagaggctgctttgggaga

SEQ ID NO: 164391 - DNA, 25 bp, Mus musculus
aagagacagtgcattctgtgagtgt

SEQ ID NO: 164392 - DNA, 25 bp, Mus musculus
aagagacagtgtgggacttctgctg

SEQ ID NO: 164393 - DNA, 25 bp, Mus musculus
aagagacatcaaggcagaagactta

SEQ ID NO: 164394 - DNA, 25 bp, Mus musculus
aagagacatcagaagatggtgagga

SEQ ID NO: 164395 - DNA, 25 bp, Mus musculus
aagagacatcagaagttttagagcg

SEQ ID NO: 164396 - DNA, 25 bp, Mus musculus
aagagacattaaagggtatagtgcc

SEQ ID NO: 164397 - DNA, 25 bp, Mus musculus
aagagaccaggtgaaaaaactgcag

SEQ ID NO: 164398 - DNA, 25 bp, Mus musculus
aagagacctccggaaatttgtgaga

SEQ ID NO: 164399 - DNA, 25 bp, Mus musculus
aagagacgaaagacaatgcagggtg

SEQ ID NO: 164400 - DNA, 25 bp, Mus musculus
aagagacgaaagctccggtctgata

SEQ ID NO: 164401 - DNA, 25 bp, Mus musculus
aagagactaaaagatatggagggaa

SEQ ID NO: 164402 - DNA, 25 bp, Mus musculus
aagagactaaaagtgctgaagaggt

SEQ ID NO: 164403 - DNA, 25 bp, Mus musculus
aagagactacaactaaagcaagctt

SEQ ID NO: 164404 - DNA, 25 bp, Mus musculus
aagagactacggccttattttggcg

SEQ ID NO: 164405 - DNA, 25 bp, Mus musculus
aagagactcacaaggtgaaactaat

SEQ ID NO: 164406 - DNA, 25 bp, Mus musculus
aagagactgaaggaggaagctgacc

SEQ ID NO: 164407 - DNA, 25 bp, Mus musculus
aagagactgaaggagtctccagcct

SEQ ID NO: 164408 - DNA, 25 bp, Mus musculus
aagagactgctggtgacaagggaga

SEQ ID NO: 164409 - DNA, 25 bp, Mus musculus
aagagacttcacagctcaggcgggg

SEQ ID NO: 164410 - DNA, 25 bp, Mus musculus
aagagacttggttgaaaggccactt

SEQ ID NO: 164411 - DNA, 25 bp, Mus musculus
aagagactttcaggctgtggacctt

SEQ ID NO: 164412 - DNA, 25 bp, Mus musculus
aagagactttcaggttccagctgtg

SEQ ID NO: 164413 - DNA, 25 bp, Mus musculus
aagagagaaagaatctggaggtgaa

SEQ ID NO: 164414 - DNA, 25 bp, Mus musculus
aagagagaaggggaacagccagagg

SEQ ID NO: 164415 - DNA, 25 bp, Mus musculus
aagagagacccaggcactccagaaa

SEQ ID NO: 164416 - DNA, 25 bp, Mus musculus
aagagagagaggtacctgtgtcgtg

SEQ ID NO: 164417 - DNA, 25 bp, Mus musculus
aagagagagcaaggttgtagttccc

SEQ ID NO: 164418 - DNA, 25 bp, Mus musculus
aagagagatcagaagtaacaggaga

SEQ ID NO: 164419 - DNA, 25 bp, Mus musculus
aagagagatgataaggagagacccc

SEQ ID NO: 164420 - DNA, 25 bp, Mus musculus
aagagagatgataaggtccagagtt

SEQ ID NO: 164421 - DNA, 25 bp, Mus musculus
aagagagcaaagctgtcattctgtg

SEQ ID NO: 164422 - DNA, 25 bp, Mus musculus
aagagagcaaaggcttatttcaaaa

SEQ ID NO: 164423 - DNA, 25 bp, Mus musculus
aagagagcaaaggtgtcattctgtg

SEQ ID NO: 164424 - DNA, 25 bp, Mus musculus
aagagagcaagctcatcattctggc

SEQ ID NO: 164425 - DNA, 25 bp, Mus musculus
aagagagcaggtgtaaaagaagaga

SEQ ID NO: 164426 - DNA, 25 bp, Mus musculus
aagagagcatctgattgtggggaaa

SEQ ID NO: 164427 - DNA, 25 bp, Mus musculus
aagagagccaaatctgccaaggcac

SEQ ID NO: 164428 - DNA, 25 bp, Mus musculus
aagagagcggacaaggagatctgac

SEQ ID NO: 164429 - DNA, 25 bp, Mus musculus
aagagagctaacgagatgaacgtga

SEQ ID NO: 164430 - DNA, 25 bp, Mus musculus
aagagagctaacgaggttgactgcc

SEQ ID NO: 164431 - DNA, 25 bp, Mus musculus
aagagaggaaaagaacaaattacct

SEQ ID NO: 164432 - DNA, 25 bp, Mus musculus
aagagaggaagcatcaacaccccct

SEQ ID NO: 164433 - DNA, 25 bp, Mus musculus
aagagaggaagtaaaactcaaaaga

SEQ ID NO: 164434 - DNA, 25 bp, Mus musculus
aagagaggaggcgcaggcaggggtg

SEQ ID NO: 164435 - DNA, 25 bp, Mus musculus
aagagaggcggattgcggccaagat

SEQ ID NO: 164436 - DNA, 25 bp, Mus musculus
aagagaggtgaaacggaaggtggag

SEQ ID NO: 164437 - DNA, 25 bp, Mus musculus
aagagaggtgaggaagaccctggac

SEQ ID NO: 164438 - DNA, 25 bp, Mus musculus
aagagaggtgccggcctccgcccag

SEQ ID NO: 164439 - DNA, 25 bp, Mus musculus
aagagagtaagacaaacccaggaga

SEQ ID NO: 164440 - DNA, 25 bp, Mus musculus
aagagagtaagacaattgcgtgaag

SEQ ID NO: 164441 - DNA, 25 bp, Mus musculus
aagagagtactggcggtgtctcttt

SEQ ID NO: 164442 - DNA, 25 bp, Mus musculus
aagagagtctaccatatttggtata

SEQ ID NO: 164443 - DNA, 25 bp, Mus musculus
aagagagtgccaggaaatagccttt

SEQ ID NO: 164444 - DNA, 25 bp, Mus musculus
aagagagtgccaggctttggggact

SEQ ID NO: 164445 - DNA, 25 bp, Mus musculus
aagagatacaaacggtctccctgca

SEQ ID NO: 164446 - DNA, 25 bp, Mus musculus
aagagatacaggtctcgttccagaa

SEQ ID NO: 164447 - DNA, 25 bp, Mus musculus
aagagatacagttctaggtctcgtt

SEQ ID NO: 164448 - DNA, 25 bp, Mus musculus
aagagatatctcagaaagtgtcacc

SEQ ID NO: 164449 - DNA, 25 bp, Mus musculus
aagagatcctcgagtgaggacgacg

SEQ ID NO: 164450 - DNA, 25 bp, Mus musculus
aagagatgaaggactcgctggccga

SEQ ID NO: 164451 - DNA, 25 bp, Mus musculus
aagagatgacagctgaggaccgaac

SEQ ID NO: 164452 - DNA, 25 bp, Mus musculus
aagagatgacgtcaggggaggagaa

SEQ ID NO: 164453 - DNA, 25 bp, Mus musculus
aagagatgagtaagctcaatcagaa

SEQ ID NO: 164454 - DNA, 25 bp, Mus musculus
aagagatgcttctgtactcacttct

SEQ ID NO: 164455 - DNA, 25 bp, Mus musculus
aagagatgcttctgtggcctacctg

SEQ ID NO: 164456 - DNA, 25 bp, Mus musculus
aagagatggaagatcaccgcctccg

SEQ ID NO: 164457 - DNA, 25 bp, Mus musculus
aagagatggaatacgaccataagcg

SEQ ID NO: 164458 - DNA, 25 bp, Mus musculus
aagagatggagtcatgcacttctga

SEQ ID NO: 164459 - DNA, 25 bp, Mus musculus
aagagatggagttttttggaccata

SEQ ID NO: 164460 - DNA, 25 bp, Mus musculus
aagagatggcagatactttggcaaa

SEQ ID NO: 164461 - DNA, 25 bp, Mus musculus
aagagatggcaggtgtatggtggct

SEQ ID NO: 164462 - DNA, 25 bp, Mus musculus
aagagatggccatatacgcctacta

SEQ ID NO: 164463 - DNA, 25 bp, Mus musculus
aagagattaaaaggatcttgctgca

SEQ ID NO: 164464 - DNA, 25 bp, Mus musculus
aagagattaaatgagaataaggctc

SEQ ID NO: 164465 - DNA, 25 bp, Mus musculus
aagagattacaaggagctagaggaa

SEQ ID NO: 164466 - DNA, 25 bp, Mus musculus
aagagattacaaggctctaagggat

SEQ ID NO: 164467 - DNA, 25 bp, Mus musculus
aagagattagtggccaagcccagcc

SEQ ID NO: 164468 - DNA, 25 bp, Mus musculus
aagagattcaaagcagaataccaga

SEQ ID NO: 164469 - DNA, 25 bp, Mus musculus
aagagattgaaagctacgggaaaga

SEQ ID NO: 164470 - DNA, 25 bp, Mus musculus
aagagattgaaagctgaaaggaagt

SEQ ID NO: 164471 - DNA, 25 bp, Mus musculus
aagagattgagcaggtttaccgaca

SEQ ID NO: 164472 - DNA, 25 bp, Mus musculus
aagagattgcaaggtacaaaagaaa

SEQ ID NO: 164473 - DNA, 25 bp, Mus musculus
aagagattgcaagttctgattcaaa

SEQ ID NO: 164474 - DNA, 25 bp, Mus musculus
aagagatttctattctctacatttt

SEQ ID NO: 164475 - DNA, 25 bp, Mus musculus
aagagatttctgctgaatgtgggag

SEQ ID NO: 164476 - DNA, 25 bp, Mus musculus
aagagcaaaaacatagccaaggaca

SEQ ID NO: 164477 - DNA, 25 bp, Mus musculus
aagagcaaaaagggcatcctggtca

SEQ ID NO: 164478 - DNA, 25 bp, Mus musculus
aagagcaaaatgtttcaaatgtatt

SEQ ID NO: 164479 - DNA, 25 bp, Mus musculus
aagagcaaactcagagggccccccc

SEQ ID NO: 164480 - DNA, 25 bp, Mus musculus
aagagcaaactcaggagaggaaacg

SEQ ID NO: 164481 - DNA, 25 bp, Mus musculus
aagagcaaagaaatctgcaggtgga

SEQ ID NO: 164482 - DNA, 25 bp, Mus musculus
aagagcaaagctcaggaacggcgag

SEQ ID NO: 164483 - DNA, 25 bp, Mus musculus
aagagcaaagctcaggctctcatgc

SEQ ID NO: 164484 - DNA, 25 bp, Mus musculus
aagagcaacatgaccatgtggagct

SEQ ID NO: 164485 - DNA, 25 bp, Mus musculus
aagagcaagatatgaaatcgtggac

SEQ ID NO: 164486 - DNA, 25 bp, Mus musculus
aagagcaagatgatttttgaatgtc

SEQ ID NO: 164487 - DNA, 25 bp, Mus musculus
aagagcaagcacgcccccagaggta

SEQ ID NO: 164488 - DNA, 25 bp, Mus musculus
aagagcaagcagaaacacaggaaaa

SEQ ID NO: 164489 - DNA, 25 bp, Mus musculus
aagagcaagcaggaaaaggaagttc

SEQ ID NO: 164490 - DNA, 25 bp, Mus musculus
aagagcaagctaacgcctactctgt

SEQ ID NO: 164491 - DNA, 25 bp, Mus musculus
aagagcaagtagctgatattgacgg

SEQ ID NO: 164492 - DNA, 25 bp, Mus musculus
aagagcacacattgaaaagggcagg

SEQ ID NO: 164493 - DNA, 25 bp, Mus musculus
aagagcacagcttctccagcctcca

SEQ ID NO: 164494 - DNA, 25 bp, Mus musculus
aagagcacaggaaagaagattcttg

SEQ ID NO: 164495 - DNA, 25 bp, Mus musculus
aagagcacagtgctggctgcgagga

SEQ ID NO: 164496 - DNA, 25 bp, Mus musculus
aagagcacagtgggtgttggacgtc

SEQ ID NO: 164497 - DNA, 25 bp, Mus musculus
aagagcacagtggtttattgctgtg

SEQ ID NO: 164498 - DNA, 25 bp, Mus musculus
aagagcaccagaattcatcctacaa

SEQ ID NO: 164499 - DNA, 25 bp, Mus musculus
aagagcacttttgagcacaagtgca

SEQ ID NO: 164500 - DNA, 25 bp, Mus musculus
aagagcacttttggactacattgca

SEQ ID NO: 164501 - DNA, 25 bp, Mus musculus
aagagcagacagataaaggagctgg

SEQ ID NO: 164502 - DNA, 25 bp, Mus musculus
aagagcagaggaagctgaaccaata

SEQ ID NO: 164503 - DNA, 25 bp, Mus musculus
aagagcagattgcagagttcaaaga

SEQ ID NO: 164504 - DNA, 25 bp, Mus musculus
aagagcagcaaggagctggaagaca

SEQ ID NO: 164505 - DNA, 25 bp, Mus musculus
aagagcagcaatgttaagtcttctt

SEQ ID NO: 164506 - DNA, 25 bp, Mus musculus
aagagcagcagagtggtaggattga

SEQ ID NO: 164507 - DNA, 25 bp, Mus musculus
aagagcagcagatcagacctactgt

SEQ ID NO: 164508 - DNA, 25 bp, Mus musculus
aagagcaggagaacaaaatccagtc

SEQ ID NO: 164509 - DNA, 25 bp, Mus musculus
aagagcaggagcgcctttgacctga

SEQ ID NO: 164510 - DNA, 25 bp, Mus musculus
aagagcaggagctgacattcacact

SEQ ID NO: 164511 - DNA, 25 bp, Mus musculus
aagagcaggagctgtctgaggagga

SEQ ID NO: 164512 - DNA, 25 bp, Mus musculus
aagagcagggccagatgtagtgctg

SEQ ID NO: 164513 - DNA, 25 bp, Mus musculus
aagagcagggccagtgctgagcagc

SEQ ID NO: 164514 - DNA, 25 bp, Mus musculus
aagagcaggtttgagatgttctcaa

SEQ ID NO: 164515 - DNA, 25 bp, Mus musculus
aagagcagtgcaaaggtgattctta

SEQ ID NO: 164516 - DNA, 25 bp, Mus musculus
aagagcatcctggtgaccagccagg

SEQ ID NO: 164517 - DNA, 25 bp, Mus musculus
aagagcatctctcggattgggctat

SEQ ID NO: 164518 - DNA, 25 bp, Mus musculus
aagagcatgggaagcaaatgaagaa

SEQ ID NO: 164519 - DNA, 25 bp, Mus musculus
aagagcatgtcggctaccttgagag

SEQ ID NO: 164520 - DNA, 25 bp, Mus musculus
aagagccaaacgagccacaatcatg

SEQ ID NO: 164521 - DNA, 25 bp, Mus musculus
aagagccaagaaggtaaggcgagtt

SEQ ID NO: 164522 - DNA, 25 bp, Mus musculus
aagagccaatggaccttgccaccat

SEQ ID NO: 164523 - DNA, 25 bp, Mus musculus
aagagccaatgggtctcataacaac

SEQ ID NO: 164524 - DNA, 25 bp, Mus musculus
aagagccacctcaggatggtagagc

SEQ ID NO: 164525 - DNA, 25 bp, Mus musculus
aagagccactgggctcctagcttac

SEQ ID NO: 164526 - DNA, 25 bp, Mus musculus
aagagccactggggggaggggttgc

SEQ ID NO: 164527 - DNA, 25 bp, Mus musculus
aagagccagaaaagagctggactac

SEQ ID NO: 164528 - DNA, 25 bp, Mus musculus
aagagccaggatgcgctcctccgcc

SEQ ID NO: 164529 - DNA, 25 bp, Mus musculus
aagagccaggcaggtgcttcagaac

SEQ ID NO: 164530 - DNA, 25 bp, Mus musculus
aagagccatgaagccgaggaaagca

SEQ ID NO: 164531 - DNA, 25 bp, Mus musculus
aagagcccaaagggggaccaggctc

SEQ ID NO: 164532 - DNA, 25 bp, Mus musculus
aagagcccacagtcgaaggatctca

SEQ ID NO: 164533 - DNA, 25 bp, Mus musculus
aagagcccagcaaaggaagccaccc

SEQ ID NO: 164534 - DNA, 25 bp, Mus musculus
aagagcccaggttgtctgttctttc

SEQ ID NO: 164535 - DNA, 25 bp, Mus musculus
aagagcccagtgccatgtcggaccc

SEQ ID NO: 164536 - DNA, 25 bp, Mus musculus
aagagccccagaaccaaggctctgg

SEQ ID NO: 164537 - DNA, 25 bp, Mus musculus
aagagccccagagtggtaaacagct

SEQ ID NO: 164538 - DNA, 25 bp, Mus musculus
aagagccccagtcacgcggtgttta

SEQ ID NO: 164539 - DNA, 25 bp, Mus musculus
aagagccggagtccgtctacagaga

SEQ ID NO: 164540 - DNA, 25 bp, Mus musculus
aagagccgtctctacttaagaagct

SEQ ID NO: 164541 - DNA, 25 bp, Mus musculus
aagagccgtctgggcaagcaggagg

SEQ ID NO: 164542 - DNA, 25 bp, Mus musculus
aagagccgtctggtgtggagggtgc

SEQ ID NO: 164543 - DNA, 25 bp, Mus musculus
aagagccgtgagccagcttcaccta

SEQ ID NO: 164544 - DNA, 25 bp, Mus musculus
aagagcctagaggagaaagtctcgc

SEQ ID NO: 164545 - DNA, 25 bp, Mus musculus
aagagcctccagggacagtgtcttg

SEQ ID NO: 164546 - DNA, 25 bp, Mus musculus
aagagcctgaaggaagagagatata

SEQ ID NO: 164547 - DNA, 25 bp, Mus musculus
aagagcctgaaggttaaaatgagct

SEQ ID NO: 164548 - DNA, 25 bp, Mus musculus
aagagcctgtgcaagggcggcctga

SEQ ID NO: 164549 - DNA, 25 bp, Mus musculus
aagagcgagcgaagagagcaaagac

SEQ ID NO: 164550 - DNA, 25 bp, Mus musculus
aagagcgaggagacgagcaaaaatc

SEQ ID NO: 164551 - DNA, 25 bp, Mus musculus
aagagcgaggaggtggaagatatca

SEQ ID NO: 164552 - DNA, 25 bp, Mus musculus
aagagcgagtcgaattggcagaggg

SEQ ID NO: 164553 - DNA, 25 bp, Mus musculus
aagagcgatgtggtatgccctgatg

SEQ ID NO: 164554 - DNA, 25 bp, Mus musculus
aagagcgatgtgtggtccttcggtg

SEQ ID NO: 164555 - DNA, 25 bp, Mus musculus
aagagcgcagatctcccctagccta

SEQ ID NO: 164556 - DNA, 25 bp, Mus musculus
aagagcgcaggtccaacttcagtga

SEQ ID NO: 164557 - DNA, 25 bp, Mus musculus
aagagcgcgcgatttctaacgagcg

SEQ ID NO: 164558 - DNA, 25 bp, Mus musculus
aagagcgcgcgtggaaagaagaaag

SEQ ID NO: 164559 - DNA, 25 bp, Mus musculus
aagagcggagcagattgaggacata

SEQ ID NO: 164560 - DNA, 25 bp, Mus musculus
aagagcggagcaggaaggagatgac

SEQ ID NO: 164561 - DNA, 25 bp, Mus musculus
aagagcggaggcaggcaaaacccac

SEQ ID NO: 164562 - DNA, 25 bp, Mus musculus
aagagcggaggccaacaccctgcag

SEQ ID NO: 164563 - DNA, 25 bp, Mus musculus
aagagcgtggagataacaaaacagg

SEQ ID NO: 164564 - DNA, 25 bp, Mus musculus
aagagcgtgggtgtggtggcttaag

SEQ ID NO: 164565 - DNA, 25 bp, Mus musculus
aagagctaaggaagggtcttctact

SEQ ID NO: 164566 - DNA, 25 bp, Mus musculus
aagagctagagatatgtgtcacaaa

SEQ ID NO: 164567 - DNA, 25 bp, Mus musculus
aagagctcaaaatgttaccagactt

SEQ ID NO: 164568 - DNA, 25 bp, Mus musculus
aagagctcaaagccaagcactcgcc

SEQ ID NO: 164569 - DNA, 25 bp, Mus musculus
aagagctcaagaagttaagtgttaa

SEQ ID NO: 164570 - DNA, 25 bp, Mus musculus
aagagctcaaggatgcaggagctgg

SEQ ID NO: 164571 - DNA, 25 bp, Mus musculus
aagagctcagagcagaaaacttata

SEQ ID NO: 164572 - DNA, 25 bp, Mus musculus
aagagctcagctttgggattccctc

SEQ ID NO: 164573 - DNA, 25 bp, Mus musculus
aagagctcaggtgtaccagctggac

SEQ ID NO: 164574 - DNA, 25 bp, Mus musculus
aagagctccgggactgaagtgtcct

SEQ ID NO: 164575 - DNA, 25 bp, Mus musculus
aagagctccgggtctgaagtgtcct

SEQ ID NO: 164576 - DNA, 25 bp, Mus musculus
aagagctctcagcacgggggcgtga

SEQ ID NO: 164577 - DNA, 25 bp, Mus musculus
aagagctctcaggtactgtactgat

SEQ ID NO: 164578 - DNA, 25 bp, Mus musculus
aagagctctcaggttcctcagtggt

SEQ ID NO: 164579 - DNA, 25 bp, Mus musculus
aagagctgaagtgggagaaaaaaca

SEQ ID NO: 164580 - DNA, 25 bp, Mus musculus
aagagctgaggatcatctgtcccta

SEQ ID NO: 164581 - DNA, 25 bp, Mus musculus
aagagctggagagacaaaagataga

SEQ ID NO: 164582 - DNA, 25 bp, Mus musculus
aagagctggagcattttctgcagct

SEQ ID NO: 164583 - DNA, 25 bp, Mus musculus
aagagctgggagatcatcacagttg

SEQ ID NO: 164584 - DNA, 25 bp, Mus musculus
aagagctggggtctgatcttgctct

SEQ ID NO: 164585 - DNA, 25 bp, Mus musculus
aagagctggtggaaggatcatcgaa

SEQ ID NO: 164586 - DNA, 25 bp, Mus musculus
aagagctgtcagggacggtcaagac

SEQ ID NO: 164587 - DNA, 25 bp, Mus musculus
aagagcttacataggtccccttccc

SEQ ID NO: 164588 - DNA, 25 bp, Mus musculus
aagagcttacatagtgcaactacag

SEQ ID NO: 164589 - DNA, 25 bp, Mus musculus
aagagcttagcctatcttcagagcc

SEQ ID NO: 164590 - DNA, 25 bp, Mus musculus
aagagcttcctgagcctcctctttc

SEQ ID NO: 164591 - DNA, 25 bp, Mus musculus
aagagcttcgagaaggccaaagaat

SEQ ID NO: 164592 - DNA, 25 bp, Mus musculus
aagagcttcgcctgaaacctcagct

SEQ ID NO: 164593 - DNA, 25 bp, Mus musculus
aagagcttctactggtgcagtcaga

SEQ ID NO: 164594 - DNA, 25 bp, Mus musculus
aagagcttctgagtctatcctgaac

SEQ ID NO: 164595 - DNA, 25 bp, Mus musculus
aagagcttgagttcatcacgctgat

SEQ ID NO: 164596 - DNA, 25 bp, Mus musculus
aagagcttgctacaatgggtgacaa

SEQ ID NO: 164597 - DNA, 25 bp, Mus musculus
aagagcttgtgccattcctgccaaa

SEQ ID NO: 164598 - DNA, 25 bp, Mus musculus
aagagcttgtgttattggattttta

SEQ ID NO: 164599 - DNA, 25 bp, Mus musculus
aagagctttactctggactttggag

SEQ ID NO: 164600 - DNA, 25 bp, Mus musculus
aagaggaaaaagcgaccagctacat

SEQ ID NO: 164601 - DNA, 25 bp, Mus musculus
aagaggaaaagagtgtttgagcacc

SEQ ID NO: 164602 - DNA, 25 bp, Mus musculus
aagaggaaagacaaagtcagcatac

SEQ ID NO: 164603 - DNA, 25 bp, Mus musculus
aagaggaaagacagctacaaccaag

SEQ ID NO: 164604 - DNA, 25 bp, Mus musculus
aagaggaaagagatgagccgccaga

SEQ ID NO: 164605 - DNA, 25 bp, Mus musculus
aagaggaaaggagttctctgaacga

SEQ ID NO: 164606 - DNA, 25 bp, Mus musculus
aagaggaaaggtaccagcagtgctg

SEQ ID NO: 164607 - DNA, 25 bp, Mus musculus
aagaggaaatacagaagcttaacaa

SEQ ID NO: 164608 - DNA, 25 bp, Mus musculus
aagaggaaatcagtgttgaagatga

SEQ ID NO: 164609 - DNA, 25 bp, Mus musculus
aagaggaaatggagcctgtgacctt

SEQ ID NO: 164610 - DNA, 25 bp, Mus musculus
aagaggaaattgatgagctccttca

SEQ ID NO: 164611 - DNA, 25 bp, Mus musculus
aagaggaacaggatctcatcatgtt

SEQ ID NO: 164612 - DNA, 25 bp, Mus musculus
aagaggaacatgcagaggcacggac

SEQ ID NO: 164613 - DNA, 25 bp, Mus musculus
aagaggaacatgggatgtgaagtgt

SEQ ID NO: 164614 - DNA, 25 bp, Mus musculus
aagaggaagaaggaggttccatttt

SEQ ID NO: 164615 - DNA, 25 bp, Mus musculus
aagaggaagaagtctgttcccagtt

SEQ ID NO: 164616 - DNA, 25 bp, Mus musculus
aagaggaagaggatacagtcatcac

SEQ ID NO: 164617 - DNA, 25 bp, Mus musculus
aagaggaagtgctggaaagcacaga

SEQ ID NO: 164618 - DNA, 25 bp, Mus musculus
aagaggaagtgctggttcctacagc

SEQ ID NO: 164619 - DNA, 25 bp, Mus musculus
aagaggacaccaagggtccaccaac

SEQ ID NO: 164620 - DNA, 25 bp, Mus musculus
aagaggacaggcttttccctgggct

SEQ ID NO: 164621 - DNA, 25 bp, Mus musculus
aagaggacatcgatccctttgacgt

SEQ ID NO: 164622 - DNA, 25 bp, Mus musculus
aagaggacattcaaagtaccattac

SEQ ID NO: 164623 - DNA, 25 bp, Mus musculus
aagaggacattcgccaatggcagtg

SEQ ID NO: 164624 - DNA, 25 bp, Mus musculus
aagaggacattcgtctgtattcatg

SEQ ID NO: 164625 - DNA, 25 bp, Mus musculus
aagaggacccgcaaggttaataact

SEQ ID NO: 164626 - DNA, 25 bp, Mus musculus
aagaggaccgaggatccagatcgag

SEQ ID NO: 164627 - DNA, 25 bp, Mus musculus
aagaggaccgaggcgttatcgaact

SEQ ID NO: 164628 - DNA, 25 bp, Mus musculus
aagaggacctaaaggagacttggga

SEQ ID NO: 164629 - DNA, 25 bp, Mus musculus
aagaggacctccaagacagggtttt

SEQ ID NO: 164630 - DNA, 25 bp, Mus musculus
aagaggacctccaagcgctcatcga

SEQ ID NO: 164631 - DNA, 25 bp, Mus musculus
aagaggagaaaacgatgggatattc

SEQ ID NO: 164632 - DNA, 25 bp, Mus musculus
aagaggagaaaacggcacacatgtt

SEQ ID NO: 164633 - DNA, 25 bp, Mus musculus
aagaggagaaagaggacagagctgc

SEQ ID NO: 164634 - DNA, 25 bp, Mus musculus
aagaggagaaagggaagaaggcaga

SEQ ID NO: 164635 - DNA, 25 bp, Mus musculus
aagaggagaagagcagccagcaccc

SEQ ID NO: 164636 - DNA, 25 bp, Mus musculus
aagaggagaagagggtccacctggc

SEQ ID NO: 164637 - DNA, 25 bp, Mus musculus
aagaggagagaaaagggagctgtga

SEQ ID NO: 164638 - DNA, 25 bp, Mus musculus
aagaggagagaagcagaaaaaaaaa

SEQ ID NO: 164639 - DNA, 25 bp, Mus musculus
aagaggagagccaggttctcgaggc

SEQ ID NO: 164640 - DNA, 25 bp, Mus musculus
aagaggagagtgatgctgttgtgtc

SEQ ID NO: 164641 - DNA, 25 bp, Mus musculus
aagaggagcagggcttctattttga

SEQ ID NO: 164642 - DNA, 25 bp, Mus musculus
aagaggagcagtaaaagctggcagg

SEQ ID NO: 164643 - DNA, 25 bp, Mus musculus
aagaggagccatgaatgtatcattg

SEQ ID NO: 164644 - DNA, 25 bp, Mus musculus
aagaggagcctgtagaccaggatgg

SEQ ID NO: 164645 - DNA, 25 bp, Mus musculus
aagaggagctggcactgcccttttt

SEQ ID NO: 164646 - DNA, 25 bp, Mus musculus
aagaggaggacgagcaagaggaggc

SEQ ID NO: 164647 - DNA, 25 bp, Mus musculus
aagaggaggaggaggaggagtagga

SEQ ID NO: 164648 - DNA, 25 bp, Mus musculus
aagaggaggaggaggctccgccccc

SEQ ID NO: 164649 - DNA, 25 bp, Mus musculus
aagaggaggagggtccggaccgctg

SEQ ID NO: 164650 - DNA, 25 bp, Mus musculus
aagaggaggccacagcaggtttcca

SEQ ID NO: 164651 - DNA, 25 bp, Mus musculus
aagaggagggggcatgaatcctaca

SEQ ID NO: 164652 - DNA, 25 bp, Mus musculus
aagaggaggggttatcatgcttttg

SEQ ID NO: 164653 - DNA, 25 bp, Mus musculus
aagaggagttggaaaatcttcaagc

SEQ ID NO: 164654 - DNA, 25 bp, Mus musculus
aagaggataaattaggaatccccac

SEQ ID NO: 164655 - DNA, 25 bp, Mus musculus
aagaggatagtgaagatgaagatga

SEQ ID NO: 164656 - DNA, 25 bp, Mus musculus
aagaggatctctgggtctgaaaagg

SEQ ID NO: 164657 - DNA, 25 bp, Mus musculus
aagaggatgagatcgactggggtga

SEQ ID NO: 164658 - DNA, 25 bp, Mus musculus
aagaggattgcgaggatcgccacga

SEQ ID NO: 164659 - DNA, 25 bp, Mus musculus
aagaggcaagacctggggatctggg

SEQ ID NO: 164660 - DNA, 25 bp, Mus musculus
aagaggcacagatcttagatgagtt

SEQ ID NO: 164661 - DNA, 25 bp, Mus musculus
aagaggcacaggctcgaagcaccaa

SEQ ID NO: 164662 - DNA, 25 bp, Mus musculus
aagaggcagaggaacgggtttccgc

SEQ ID NO: 164663 - DNA, 25 bp, Mus musculus
aagaggcagagggtgctctggcctc

SEQ ID NO: 164664 - DNA, 25 bp, Mus musculus
aagaggcagatcagcagggatggca

SEQ ID NO: 164665 - DNA, 25 bp, Mus musculus
aagaggcagccaggagcccttgaac

SEQ ID NO: 164666 - DNA, 25 bp, Mus musculus
aagaggcagggtgctgaggggtggt

SEQ ID NO: 164667 - DNA, 25 bp, Mus musculus
aagaggcatttagagagacactgta

SEQ ID NO: 164668 - DNA, 25 bp, Mus musculus
aagaggccaaaggaaatttgtgaga

SEQ ID NO: 164669 - DNA, 25 bp, Mus musculus
aagaggccaaagtaacctcaggctt

SEQ ID NO: 164670 - DNA, 25 bp, Mus musculus
aagaggcccaggtgcgggcgagtca

SEQ ID NO: 164671 - DNA, 25 bp, Mus musculus
aagaggccctggaagaagaaaggca

SEQ ID NO: 164672 - DNA, 25 bp, Mus musculus
aagaggcctgggaggcccggcacaa

SEQ ID NO: 164673 - DNA, 25 bp, Mus musculus
aagaggcctttcagcttcaagaaaa

SEQ ID NO: 164674 - DNA, 25 bp, Mus musculus
aagaggcctttcaggtctgcctcgg

SEQ ID NO: 164675 - DNA, 25 bp, Mus musculus
aagaggcggctcaggtgttatagac

SEQ ID NO: 164676 - DNA, 25 bp, Mus musculus
aagaggcggctcaggtttctcccat

SEQ ID NO: 164677 - DNA, 25 bp, Mus musculus
aagaggcgtgatcagaggtcaacag

SEQ ID NO: 164678 - DNA, 25 bp, Mus musculus
aagaggcgtgatcaggggttcttat

SEQ ID NO: 164679 - DNA, 25 bp, Mus musculus
aagaggctacagtctgcctttcagt

SEQ ID NO: 164680 - DNA, 25 bp, Mus musculus
aagaggctgaatgggagccatcgag

SEQ ID NO: 164681 - DNA, 25 bp, Mus musculus
aagaggctgggctggagaaagaggt

SEQ ID NO: 164682 - DNA, 25 bp, Mus musculus
aagaggcttccaaggctaaggtggc

SEQ ID NO: 164683 - DNA, 25 bp, Mus musculus
aagaggcttcctctctttggcaccg

SEQ ID NO: 164684 - DNA, 25 bp, Mus musculus
aagaggcttcctgtctttggcaccg

SEQ ID NO: 164685 - DNA, 25 bp, Mus musculus
aagaggctttggtcatccagcactt

SEQ ID NO: 164686 - DNA, 25 bp, Mus musculus
aagagggacgatgggtgatctacaa

SEQ ID NO: 164687 - DNA, 25 bp, Mus musculus
aagagggacggataccaagctaaac

SEQ ID NO: 164688 - DNA, 25 bp, Mus musculus
aagagggagagaatatgctggctta

SEQ ID NO: 164689 - DNA, 25 bp, Mus musculus
aagagggagatccacttaaatggat

SEQ ID NO: 164690 - DNA, 25 bp, Mus musculus
aagagggaggaggaacgctatcaag

SEQ ID NO: 164691 - DNA, 25 bp, Mus musculus
aagagggagtagaggaacattgacc

SEQ ID NO: 164692 - DNA, 25 bp, Mus musculus
aagagggagtcggttctggccgaga

SEQ ID NO: 164693 - DNA, 25 bp, Mus musculus
aagagggatatcaagtttgcttgtc

SEQ ID NO: 164694 - DNA, 25 bp, Mus musculus
aagagggcaaatatggttatgtcct

SEQ ID NO: 164695 - DNA, 25 bp, Mus musculus
aagagggcgaatattcgcctcccac

SEQ ID NO: 164696 - DNA, 25 bp, Mus musculus
aagagggcgaattgtggagccccgg

SEQ ID NO: 164697 - DNA, 25 bp, Mus musculus
aagagggcgaggcagaggtagaggt

SEQ ID NO: 164698 - DNA, 25 bp, Mus musculus
aagaggggaagcatccacaaactaa

SEQ ID NO: 164699 - DNA, 25 bp, Mus musculus
aagagggtgaagaaactgaaggctc

SEQ ID NO: 164700 - DNA, 25 bp, Mus musculus
aagaggtcaaagaggcgccagctga

SEQ ID NO: 164701 - DNA, 25 bp, Mus musculus
aagaggtcagagacacctaccgcta

SEQ ID NO: 164702 - DNA, 25 bp, Mus musculus
aagaggtctgctcagaaaaaactgg

SEQ ID NO: 164703 - DNA, 25 bp, Mus musculus
aagaggtcttggtccacagatgagc

SEQ ID NO: 164704 - DNA, 25 bp, Mus musculus
aagaggtgaagcagaatgatatgga

SEQ ID NO: 164705 - DNA, 25 bp, Mus musculus
aagaggtgactgcccctgtcttagg

SEQ ID NO: 164706 - DNA, 25 bp, Mus musculus
aagaggtgattgaggacgcctcatg

SEQ ID NO: 164707 - DNA, 25 bp, Mus musculus
aagaggtgcaggcggctggaggaag

SEQ ID NO: 164708 - DNA, 25 bp, Mus musculus
aagaggtgcaggctggttcgagcca

SEQ ID NO: 164709 - DNA, 25 bp, Mus musculus
aagaggtgccagctacatcagaaga

SEQ ID NO: 164710 - DNA, 25 bp, Mus musculus
aagaggtggagatcagcagagtggt

SEQ ID NO: 164711 - DNA, 25 bp, Mus musculus
aagaggtggaggatgacaaaatccc

SEQ ID NO: 164712 - DNA, 25 bp, Mus musculus
aagaggtggaggccccagtcaaaac

SEQ ID NO: 164713 - DNA, 25 bp, Mus musculus
aagaggtggcaacgagtctccagtt

SEQ ID NO: 164714 - DNA, 25 bp, Mus musculus
aagaggtgtcacgacgaggaacaag

SEQ ID NO: 164715 - DNA, 25 bp, Mus musculus
aagaggttgaagagaactctgataa

SEQ ID NO: 164716 - DNA, 25 bp, Mus musculus
aagaggttgaagagatgaaaagaaa

SEQ ID NO: 164717 - DNA, 25 bp, Mus musculus
aagaggttgaagagatttgacatcc

SEQ ID NO: 164718 - DNA, 25 bp, Mus musculus
aagagtaaacgcaggtgacctggcc

SEQ ID NO: 164719 - DNA, 25 bp, Mus musculus
aagagtaaatggaaggttgctttta

SEQ ID NO: 164720 - DNA, 25 bp, Mus musculus
aagagtaatgaggactctctgattc

SEQ ID NO: 164721 - DNA, 25 bp, Mus musculus
aagagtacacaatgggtaccccaat

SEQ ID NO: 164722 - DNA, 25 bp, Mus musculus
aagagtacacagctccttccatcca

SEQ ID NO: 164723 - DNA, 25 bp, Mus musculus
aagagtacacaggtgtgtgccatcc

SEQ ID NO: 164724 - DNA, 25 bp, Mus musculus
aagagtacagatatggagaaagaga

SEQ ID NO: 164725 - DNA, 25 bp, Mus musculus
aagagtatacaagattatcctgtcc

SEQ ID NO: 164726 - DNA, 25 bp, Mus musculus
aagagtatacaaggtatcagtactt

SEQ ID NO: 164727 - DNA, 25 bp, Mus musculus
aagagtatatcgcggacctgtactc

SEQ ID NO: 164728 - DNA, 25 bp, Mus musculus
aagagtattgtggaggaattaattc

SEQ ID NO: 164729 - DNA, 25 bp, Mus musculus
aagagtcaggaaaggaatcccaatc

SEQ ID NO: 164730 - DNA, 25 bp, Mus musculus
aagagtcaggaaaggcacatgaatg

SEQ ID NO: 164731 - DNA, 25 bp, Mus musculus
aagagtcaggaaaggtgccctggga

SEQ ID NO: 164732 - DNA, 25 bp, Mus musculus
aagagtccacctgggatcatgggct

SEQ ID NO: 164733 - DNA, 25 bp, Mus musculus
aagagtccagcaagaggaccagagt

SEQ ID NO: 164734 - DNA, 25 bp, Mus musculus
aagagtcggacaataataaaagact

SEQ ID NO: 164735 - DNA, 25 bp, Mus musculus
aagagtctccgacgggcactatgaa

SEQ ID NO: 164736 - DNA, 25 bp, Mus musculus
aagagtctgaggatcctaaacactt

SEQ ID NO: 164737 - DNA, 25 bp, Mus musculus
aagagtctgctcagggcggcttcat

SEQ ID NO: 164738 - DNA, 25 bp, Mus musculus
aagagtctggacaacatgtgcatcg

SEQ ID NO: 164739 - DNA, 25 bp, Mus musculus
aagagtctgtgctgcaggctgtgac

SEQ ID NO: 164740 - DNA, 25 bp, Mus musculus
aagagtcttctctggcttttctcat

SEQ ID NO: 164741 - DNA, 25 bp, Mus musculus
aagagtcttctctgtcacttgcctc

SEQ ID NO: 164742 - DNA, 25 bp, Mus musculus
aagagtgaaggcttcagatgctagc

SEQ ID NO: 164743 - DNA, 25 bp, Mus musculus
aagagtgaatatgttttgcattttc

SEQ ID NO: 164744 - DNA, 25 bp, Mus musculus
aagagtgaatgaaggctttaacaga

SEQ ID NO: 164745 - DNA, 25 bp, Mus musculus
aagagtgaccagccgtgggaatggt

SEQ ID NO: 164746 - DNA, 25 bp, Mus musculus
aagagtgactcaggaagccataatt

SEQ ID NO: 164747 - DNA, 25 bp, Mus musculus
aagagtgagggtgatctgcaattcg

SEQ ID NO: 164748 - DNA, 25 bp, Mus musculus
aagagtgaggtgggccagacatcag

SEQ ID NO: 164749 - DNA, 25 bp, Mus musculus
aagagtgcaatgcaggacagtggtg

SEQ ID NO: 164750 - DNA, 25 bp, Mus musculus
aagagtgcaatgcagtccgtggtgg

SEQ ID NO: 164751 - DNA, 25 bp, Mus musculus
aagagtgcagatgggatgctttatt

SEQ ID NO: 164752 - DNA, 25 bp, Mus musculus
aagagtgcagcatcgccctgagcaa

SEQ ID NO: 164753 - DNA, 25 bp, Mus musculus
aagagtgcagctcagagacatgtcc

SEQ ID NO: 164754 - DNA, 25 bp, Mus musculus
aagagtgcagttttggttctaacat

SEQ ID NO: 164755 - DNA, 25 bp, Mus musculus
aagagtgccaggctgaacctgtggc

SEQ ID NO: 164756 - DNA, 25 bp, Mus musculus
aagagtgctggacaggccggggccc

SEQ ID NO: 164757 - DNA, 25 bp, Mus musculus
aagagtggcggaacatgaagttcct

SEQ ID NO: 164758 - DNA, 25 bp, Mus musculus
aagagtggcggtcctggagtttgaa

SEQ ID NO: 164759 - DNA, 25 bp, Mus musculus
aagagtgggaagaacttccattaca

SEQ ID NO: 164760 - DNA, 25 bp, Mus musculus
aagagtgggtaccaggcacaggcta

SEQ ID NO: 164761 - DNA, 25 bp, Mus musculus
aagagtgtcctagaatcaataagct

SEQ ID NO: 164762 - DNA, 25 bp, Mus musculus
aagagtgtcttaggttcttgtagtg

SEQ ID NO: 164763 - DNA, 25 bp, Mus musculus
aagagtgtttgctcagtgctggcct

SEQ ID NO: 164764 - DNA, 25 bp, Mus musculus
aagagttccacagaggttctatggt

SEQ ID NO: 164765 - DNA, 25 bp, Mus musculus
aagagttgcagctaggacttctctc

SEQ ID NO: 164766 - DNA, 25 bp, Mus musculus
aagagttgcctacatgtagctgaga

SEQ ID NO: 164767 - DNA, 25 bp, Mus musculus
aagagttgcgagcgaatacaggagg

SEQ ID NO: 164768 - DNA, 25 bp, Mus musculus
aagagttgcgaggccaggtggttgc

SEQ ID NO: 164769 - DNA, 25 bp, Mus musculus
aagagttggaagcctcgtcttccct

SEQ ID NO: 164770 - DNA, 25 bp, Mus musculus
aagagttggaaggtcatagaactct

SEQ ID NO: 164771 - DNA, 25 bp, Mus musculus
aagagttggcaggaatagtgggcag

SEQ ID NO: 164772 - DNA, 25 bp, Mus musculus
aagagttggtccatatatttcttct

SEQ ID NO: 164773 - DNA, 25 bp, Mus musculus
aagagttggtgaagaaacttgtgga

SEQ ID NO: 164774 - DNA, 25 bp, Mus musculus
aagagtttcctagattgcttcctga

SEQ ID NO: 164775 - DNA, 25 bp, Mus musculus
aagagtttcctggagaaggaacttg

SEQ ID NO: 164776 - DNA, 25 bp, Mus musculus
aagagtttggcagagtatacgaagc

SEQ ID NO: 164777 - DNA, 25 bp, Mus musculus
aagagtttggcagtgtcaaaggtcc

SEQ ID NO: 164778 - DNA, 25 bp, Mus musculus
aagataaaaaaggctgcctcaccaa

SEQ ID NO: 164779 - DNA, 25 bp, Mus musculus
aagataaaaagcaggggttccttgt

SEQ ID NO: 164780 - DNA, 25 bp, Mus musculus
aagataaaacagaaagagtaggaaa

SEQ ID NO: 164781 - DNA, 25 bp, Mus musculus
aagataaacagatacagacagaagc

SEQ ID NO: 164782 - DNA, 25 bp, Mus musculus
aagataaacagtgtggcctaccaac

SEQ ID NO: 164783 - DNA, 25 bp, Mus musculus
aagataaacttgaaagatgacagtc

SEQ ID NO: 164784 - DNA, 25 bp, Mus musculus
aagataaagagggctacacatcttt

SEQ ID NO: 164785 - DNA, 25 bp, Mus musculus
aagataaagcgaggctgaaaggaaa

SEQ ID NO: 164786 - DNA, 25 bp, Mus musculus
aagataaagcgagtttcactttcag

SEQ ID NO: 164787 - DNA, 25 bp, Mus musculus
aagataaaggaccctgatgctaaga

SEQ ID NO: 164788 - DNA, 25 bp, Mus musculus
aagataaagtttttggaagctttgc

SEQ ID NO: 164789 - DNA, 25 bp, Mus musculus
aagataaagtttttggtatgctggt

SEQ ID NO: 164790 - DNA, 25 bp, Mus musculus
aagataaataggtgaggctgctggc

SEQ ID NO: 164791 - DNA, 25 bp, Mus musculus
aagataaatagttcaattatcagat

SEQ ID NO: 164792 - DNA, 25 bp, Mus musculus
aagataacaagactcagattagccc

SEQ ID NO: 164793 - DNA, 25 bp, Mus musculus
aagataacccggcactgaatgcaca

SEQ ID NO: 164794 - DNA, 25 bp, Mus musculus
aagataacctaagtaccagcagtgc

SEQ ID NO: 164795 - DNA, 25 bp, Mus musculus
aagataagagatatgccagaatttc

SEQ ID NO: 164796 - DNA, 25 bp, Mus musculus
aagataagctaaaagaattgggata

SEQ ID NO: 164797 - DNA, 25 bp, Mus musculus
aagataagctaaaagcatggctgct

SEQ ID NO: 164798 - DNA, 25 bp, Mus musculus
aagataaggagcagaatgagaagac

SEQ ID NO: 164799 - DNA, 25 bp, Mus musculus
aagataataaaggtagtggatggct

SEQ ID NO: 164800 - DNA, 25 bp, Mus musculus
aagataataaagtacaaaatggttc

SEQ ID NO: 164801 - DNA, 25 bp, Mus musculus
aagataatcagattataccgaaaag

SEQ ID NO: 164802 - DNA, 25 bp, Mus musculus
aagataatcagccgtggggccaatt

SEQ ID NO: 164803 - DNA, 25 bp, Mus musculus
aagatacaatattagaaggaacaac

SEQ ID NO: 164804 - DNA, 25 bp, Mus musculus
aagatacagccctgctggtagctgc

SEQ ID NO: 164805 - DNA, 25 bp, Mus musculus
aagatacaggaagactccttctaat

SEQ ID NO: 164806 - DNA, 25 bp, Mus musculus
aagataccaagctaatgagcgagtg

SEQ ID NO: 164807 - DNA, 25 bp, Mus musculus
aagataccagagtatacccgcaatg

SEQ ID NO: 164808 - DNA, 25 bp, Mus musculus
aagatacccaagagccagaaactcc

SEQ ID NO: 164809 - DNA, 25 bp, Mus musculus
aagatacgaaggaagaagttctaag

SEQ ID NO: 164810 - DNA, 25 bp, Mus musculus
aagatacgaagtgatgtcctggtgg

SEQ ID NO: 164811 - DNA, 25 bp, Mus musculus
aagatactctcagagatgctggagt

SEQ ID NO: 164812 - DNA, 25 bp, Mus musculus
aagatactgggatctcgctggaaag

SEQ ID NO: 164813 - DNA, 25 bp, Mus musculus
aagatactggggtctcactatgcag

SEQ ID NO: 164814 - DNA, 25 bp, Mus musculus
aagatacttacagattggccaggat

SEQ ID NO: 164815 - DNA, 25 bp, Mus musculus
aagatacttacagtcacatgtggcc

SEQ ID NO: 164816 - DNA, 25 bp, Mus musculus
aagatacttccaatcacttccatgt

SEQ ID NO: 164817 - DNA, 25 bp, Mus musculus
aagatacttgcaagggtgactcagg

SEQ ID NO: 164818 - DNA, 25 bp, Mus musculus
aagatagagcggggaaaaatggagt

SEQ ID NO: 164819 - DNA, 25 bp, Mus musculus
aagataggaggctccctgctatgtg

SEQ ID NO: 164820 - DNA, 25 bp, Mus musculus
aagataggcagcatgtctgatgaaa

SEQ ID NO: 164821 - DNA, 25 bp, Mus musculus
aagataggcagcatttccagacagt

SEQ ID NO: 164822 - DNA, 25 bp, Mus musculus
aagataggcctgagacttccttacc

SEQ ID NO: 164823 - DNA, 25 bp, Mus musculus
aagataggctgagcatcccagcctt

SEQ ID NO: 164824 - DNA, 25 bp, Mus musculus
aagataggctggagtcccctccccc

SEQ ID NO: 164825 - DNA, 25 bp, Mus musculus
aagatagtaacaggagactgaagtc

SEQ ID NO: 164826 - DNA, 25 bp, Mus musculus
aagatagttaaagagggttgccccg

SEQ ID NO: 164827 - DNA, 25 bp, Mus musculus
aagatataaaattcacagaggagat

SEQ ID NO: 164828 - DNA, 25 bp, Mus musculus
aagatataaaggattctaaggtgaa

SEQ ID NO: 164829 - DNA, 25 bp, Mus musculus
aagatatacgggctgattcgctact

SEQ ID NO: 164830 - DNA, 25 bp, Mus musculus
aagatatacgggctggccaagccca

SEQ ID NO: 164831 - DNA, 25 bp, Mus musculus
aagatatacgggctggtccaaaagg

SEQ ID NO: 164832 - DNA, 25 bp, Mus musculus
aagatatcaaaaagggaatcttact

SEQ ID NO: 164833 - DNA, 25 bp, Mus musculus
aagatatcaacttgattcgaggaac

SEQ ID NO: 164834 - DNA, 25 bp, Mus musculus
aagatatctcagcaaagctaccacg

SEQ ID NO: 164835 - DNA, 25 bp, Mus musculus
aagatatgcaaatagagtaaaggag

SEQ ID NO: 164836 - DNA, 25 bp, Mus musculus
aagatatgcaaatagggtgaaagaa

SEQ ID NO: 164837 - DNA, 25 bp, Mus musculus
aagatatggaggccaggaaacaagc

SEQ ID NO: 164838 - DNA, 25 bp, Mus musculus
aagatatggattcagattactcggg

SEQ ID NO: 164839 - DNA, 25 bp, Mus musculus
aagatatggattcagggctgaggca

SEQ ID NO: 164840 - DNA, 25 bp, Mus musculus
aagatatgtggtgacatccacgggc

SEQ ID NO: 164841 - DNA, 25 bp, Mus musculus
aagatattaaatgggacctacacac

SEQ ID NO: 164842 - DNA, 25 bp, Mus musculus
aagatattcaggtccttaaaattct

SEQ ID NO: 164843 - DNA, 25 bp, Mus musculus
aagatattccagcctcactgcagtg

SEQ ID NO: 164844 - DNA, 25 bp, Mus musculus
aagatattcctccatacgaacagca

SEQ ID NO: 164845 - DNA, 25 bp, Mus musculus
aagatattgataaacgccaccgctc

SEQ ID NO: 164846 - DNA, 25 bp, Mus musculus
aagatattgataaagttcaacttct

SEQ ID NO: 164847 - DNA, 25 bp, Mus musculus
aagatatttcacggacgtcagggcc

SEQ ID NO: 164848 - DNA, 25 bp, Mus musculus
aagatcaaagcattcgctatggagt

SEQ ID NO: 164849 - DNA, 25 bp, Mus musculus
aagatcaaagcctcagcgttctcac

SEQ ID NO: 164850 - DNA, 25 bp, Mus musculus
aagatcaagaggtcagggccaaaac

SEQ ID NO: 164851 - DNA, 25 bp, Mus musculus
aagatcaatcaagatgactgtgatg

SEQ ID NO: 164852 - DNA, 25 bp, Mus musculus
aagatcaatggacagctcggctcca

SEQ ID NO: 164853 - DNA, 25 bp, Mus musculus
aagatcaatgggcagcagcaatgac

SEQ ID NO: 164854 - DNA, 25 bp, Mus musculus
aagatcacaacccagttcccacttg

SEQ ID NO: 164855 - DNA, 25 bp, Mus musculus
aagatcacctcagaggatacaagca

SEQ ID NO: 164856 - DNA, 25 bp, Mus musculus
aagatcacttcaagtgggtaaagca

SEQ ID NO: 164857 - DNA, 25 bp, Mus musculus
aagatcagagatggacagcagcatc

SEQ ID NO: 164858 - DNA, 25 bp, Mus musculus
aagatcagagatgttactctcgtcc

SEQ ID NO: 164859 - DNA, 25 bp, Mus musculus
aagatcagaggatcccactgacctt

SEQ ID NO: 164860 - DNA, 25 bp, Mus musculus
aagatcagcaagcagcttcaggatc

SEQ ID NO: 164861 - DNA, 25 bp, Mus musculus
aagatcagcaagctgattaccagga

SEQ ID NO: 164862 - DNA, 25 bp, Mus musculus
aagatcaggggctggaaaacgagaa

SEQ ID NO: 164863 - DNA, 25 bp, Mus musculus
aagatcatcaagggccactccagaa

SEQ ID NO: 164864 - DNA, 25 bp, Mus musculus
aagatcatccggaagaagattcctt

SEQ ID NO: 164865 - DNA, 25 bp, Mus musculus
aagatcatcgaaatgaagattggat

SEQ ID NO: 164866 - DNA, 25 bp, Mus musculus
aagatcatcgaaatgatgccagaat

SEQ ID NO: 164867 - DNA, 25 bp, Mus musculus
aagatcatcgaaatggaaatcagag

SEQ ID NO: 164868 - DNA, 25 bp, Mus musculus
aagatcatctcacaggttcaaaaga

SEQ ID NO: 164869 - DNA, 25 bp, Mus musculus
aagatcatctcacagtctgttgcag

SEQ ID NO: 164870 - DNA, 25 bp, Mus musculus
aagatcatgggtgtggctggagggc

SEQ ID NO: 164871 - DNA, 25 bp, Mus musculus
aagatcattaaggaacgagaactgg

SEQ ID NO: 164872 - DNA, 25 bp, Mus musculus
aagatccacaaagaggcggttacag

SEQ ID NO: 164873 - DNA, 25 bp, Mus musculus
aagatccagacaacggccccacctg

SEQ ID NO: 164874 - DNA, 25 bp, Mus musculus
aagatccagtccccgctgctgcctg

SEQ ID NO: 164875 - DNA, 25 bp, Mus musculus
aagatccatctaaatgggtacaagt

SEQ ID NO: 164876 - DNA, 25 bp, Mus musculus
aagatccatgaaaagcaagatgggc

SEQ ID NO: 164877 - DNA, 25 bp, Mus musculus
aagatccatgagaaattgttcccct

SEQ ID NO: 164878 - DNA, 25 bp, Mus musculus
aagatcccctgaaacatgctggtgt

SEQ ID NO: 164879 - DNA, 25 bp, Mus musculus
aagatcccgagaatacgcagaccaa

SEQ ID NO: 164880 - DNA, 25 bp, Mus musculus
aagatccctgcaaggaaagagtgcc

SEQ ID NO: 164881 - DNA, 25 bp, Mus musculus
aagatccgagccttcatcctcccca

SEQ ID NO: 164882 - DNA, 25 bp, Mus musculus
aagatccggaaccagcctctgacct

SEQ ID NO: 164883 - DNA, 25 bp, Mus musculus
aagatcctctcggtaaatggccaag

SEQ ID NO: 164884 - DNA, 25 bp, Mus musculus
aagatcctgataaacttcccacgac

SEQ ID NO: 164885 - DNA, 25 bp, Mus musculus
aagatcctggagcacttggaatctc

SEQ ID NO: 164886 - DNA, 25 bp, Mus musculus
aagatcctgggggcagtgtatgggg

SEQ ID NO: 164887 - DNA, 25 bp, Mus musculus
aagatccttctttgttgggtgggac

SEQ ID NO: 164888 - DNA, 25 bp, Mus musculus
aagatcctttcaggagcccagctcc

SEQ ID NO: 164889 - DNA, 25 bp, Mus musculus
aagatcctttcaggtgctgtaggag

SEQ ID NO: 164890 - DNA, 25 bp, Mus musculus
aagatcctttgtgtggttcttcttg

SEQ ID NO: 164891 - DNA, 25 bp, Mus musculus
aagatcgaaataaattgaaaaacat

SEQ ID NO: 164892 - DNA, 25 bp, Mus musculus
aagatcgatgagctttcactctact

SEQ ID NO: 164893 - DNA, 25 bp, Mus musculus
aagatcgcctccagcctatttaaga

SEQ ID NO: 164894 - DNA, 25 bp, Mus musculus
aagatcgcctccaggccagcagcaa

SEQ ID NO: 164895 - DNA, 25 bp, Mus musculus
aagatcgcctgtagcaaagtccgag

SEQ ID NO: 164896 - DNA, 25 bp, Mus musculus
aagatcgtgcccgatgaacgagacc

SEQ ID NO: 164897 - DNA, 25 bp, Mus musculus
aagatctaaccatataccagaggag

SEQ ID NO: 164898 - DNA, 25 bp, Mus musculus
aagatctaagtacaccaaatgaaaa

SEQ ID NO: 164899 - DNA, 25 bp, Mus musculus
aagatctcaaagtgagaaaacaaga

SEQ ID NO: 164900 - DNA, 25 bp, Mus musculus
aagatctcgaaacggtaataagcca

SEQ ID NO: 164901 - DNA, 25 bp, Mus musculus
aagatctcgaaacttcagaggatga

SEQ ID NO: 164902 - DNA, 25 bp, Mus musculus
aagatctctacagaggaaggcatta

SEQ ID NO: 164903 - DNA, 25 bp, Mus musculus
aagatctctgccaatccatagtacc

SEQ ID NO: 164904 - DNA, 25 bp, Mus musculus
aagatctctggaagggtttctctgt

SEQ ID NO: 164905 - DNA, 25 bp, Mus musculus
aagatctctggaaggtgagcctcag

SEQ ID NO: 164906 - DNA, 25 bp, Mus musculus
aagatctctggcaatccatagtacc

SEQ ID NO: 164907 - DNA, 25 bp, Mus musculus
aagatctctgtacgcatgtgacacc

SEQ ID NO: 164908 - DNA, 25 bp, Mus musculus
aagatctgaaagttgggatggctac

SEQ ID NO: 164909 - DNA, 25 bp, Mus musculus
aagatctgacaaggacccacattgt

SEQ ID NO: 164910 - DNA, 25 bp, Mus musculus
aagatctgacccaagagattgctat

SEQ ID NO: 164911 - DNA, 25 bp, Mus musculus
aagatctgacccaagcttatgatgg

SEQ ID NO: 164912 - DNA, 25 bp, Mus musculus
aagatctgcaaaatcatggaccagg

SEQ ID NO: 164913 - DNA, 25 bp, Mus musculus
aagatctgcactgaacagtcaaatt

SEQ ID NO: 164914 - DNA, 25 bp, Mus musculus
aagatctgcccagaggacgaggcgg

SEQ ID NO: 164915 - DNA, 25 bp, Mus musculus
aagatctggaagtgccaaagtagaa

SEQ ID NO: 164916 - DNA, 25 bp, Mus musculus
aagatctggcaggccctcagaatat

SEQ ID NO: 164917 - DNA, 25 bp, Mus musculus
aagatctggcaggggactctcctgc

SEQ ID NO: 164918 - DNA, 25 bp, Mus musculus
aagatctgtgacgggtttcgtgcta

SEQ ID NO: 164919 - DNA, 25 bp, Mus musculus
aagatctgttgaagagcaagttgct

SEQ ID NO: 164920 - DNA, 25 bp, Mus musculus
aagatctgttttagcaatcccacag

SEQ ID NO: 164921 - DNA, 25 bp, Mus musculus
aagatcttctcagtcctagaccaaa

SEQ ID NO: 164922 - DNA, 25 bp, Mus musculus
aagatcttctgattcctgccgtttg

SEQ ID NO: 164923 - DNA, 25 bp, Mus musculus
aagatcttctggcacagcttgccct

SEQ ID NO: 164924 - DNA, 25 bp, Mus musculus
aagatcttgaagccatgatcaaagc

SEQ ID NO: 164925 - DNA, 25 bp, Mus musculus
aagatcttgaaggataccagaatac

SEQ ID NO: 164926 - DNA, 25 bp, Mus musculus
aagatcttgtggtcaagagcaatct

SEQ ID NO: 164927 - DNA, 25 bp, Mus musculus
aagatctttaaaaggctactgaaag

SEQ ID NO: 164928 - DNA, 25 bp, Mus musculus
aagatcttttcgcagaagccacaga

SEQ ID NO: 164929 - DNA, 25 bp, Mus musculus
aagatgaaaccttccgacttgtctc

SEQ ID NO: 164930 - DNA, 25 bp, Mus musculus
aagatgaaatcaaggttccgtgttg

SEQ ID NO: 164931 - DNA, 25 bp, Mus musculus
aagatgaaatcaagtatgcaaccca

SEQ ID NO: 164932 - DNA, 25 bp, Mus musculus
aagatgaaatttcaggtcacgttca

SEQ ID NO: 164933 - DNA, 25 bp, Mus musculus
aagatgaacagcaattatagtgaac

SEQ ID NO: 164934 - DNA, 25 bp, Mus musculus
aagatgaagacagggaacagacatc

SEQ ID NO: 164935 - DNA, 25 bp, Mus musculus
aagatgaagacagttcagagtgcag

SEQ ID NO: 164936 - DNA, 25 bp, Mus musculus
aagatgaaggagaaggaggaggtaa

SEQ ID NO: 164937 - DNA, 25 bp, Mus musculus
aagatgaaggagagcccatcgcacc

SEQ ID NO: 164938 - DNA, 25 bp, Mus musculus
aagatgaagggcagagggaaggctc

SEQ ID NO: 164939 - DNA, 25 bp, Mus musculus
aagatgaagggcaggctccggcttc

SEQ ID NO: 164940 - DNA, 25 bp, Mus musculus
aagatgaagtcagagggtgctggtg

SEQ ID NO: 164941 - DNA, 25 bp, Mus musculus
aagatgaatatccagagactaagtc

SEQ ID NO: 164942 - DNA, 25 bp, Mus musculus
aagatgaatatgaaaaggtggacaa

SEQ ID NO: 164943 - DNA, 25 bp, Mus musculus
aagatgaattacaggaaatgcttga

SEQ ID NO: 164944 - DNA, 25 bp, Mus musculus
aagatgaatttcagactctgaattc

SEQ ID NO: 164945 - DNA, 25 bp, Mus musculus
aagatgacaaccccaagcatccaac

SEQ ID NO: 164946 - DNA, 25 bp, Mus musculus
aagatgacaagttgaccccaaagat

SEQ ID NO: 164947 - DNA, 25 bp, Mus musculus
aagatgacaatgggggtgaagcttc

SEQ ID NO: 164948 - DNA, 25 bp, Mus musculus
aagatgacacagaccattctttaaa

SEQ ID NO: 164949 - DNA, 25 bp, Mus musculus
aagatgacagcaaaaatgtatttgt

SEQ ID NO: 164950 - DNA, 25 bp, Mus musculus
aagatgacagcaaacataaaggtag

SEQ ID NO: 164951 - DNA, 25 bp, Mus musculus
aagatgacagtgaacgtcctgtttc

SEQ ID NO: 164952 - DNA, 25 bp, Mus musculus
aagatgaccaaacgttagaaaagtc

SEQ ID NO: 164953 - DNA, 25 bp, Mus musculus
aagatgacccaggagttgcaagcac

SEQ ID NO: 164954 - DNA, 25 bp, Mus musculus
aagatgaccgtgccgaacgtgctgg

SEQ ID NO: 164955 - DNA, 25 bp, Mus musculus
aagatgacctaggaaacacactgga

SEQ ID NO: 164956 - DNA, 25 bp, Mus musculus
aagatgaccttttcggggtcatctt

SEQ ID NO: 164957 - DNA, 25 bp, Mus musculus
aagatgactaagatgctaaaaggat

SEQ ID NO: 164958 - DNA, 25 bp, Mus musculus
aagatgactgccttgggctggtgag

SEQ ID NO: 164959 - DNA, 25 bp, Mus musculus
aagatgagaaaggtcatttactaca

SEQ ID NO: 164960 - DNA, 25 bp, Mus musculus
aagatgagaatgcacctgtctgctc

SEQ ID NO: 164961 - DNA, 25 bp, Mus musculus
aagatgagacaggagacaatcaggc

SEQ ID NO: 164962 - DNA, 25 bp, Mus musculus
aagatgagatacaagggtcaatata

SEQ ID NO: 164963 - DNA, 25 bp, Mus musculus
aagatgagatacaaggtgtagtggc

SEQ ID NO: 164964 - DNA, 25 bp, Mus musculus
aagatgagatcctgggcaacttcac

SEQ ID NO: 164965 - DNA, 25 bp, Mus musculus
aagatgagattctgttttgaagttt

SEQ ID NO: 164966 - DNA, 25 bp, Mus musculus
aagatgagattgatgatgaatatga

SEQ ID NO: 164967 - DNA, 25 bp, Mus musculus
aagatgagatttctgctttcacttt

SEQ ID NO: 164968 - DNA, 25 bp, Mus musculus
aagatgagcagctgtggcggctttt

SEQ ID NO: 164969 - DNA, 25 bp, Mus musculus
aagatgagctggatccagccatatt

SEQ ID NO: 164970 - DNA, 25 bp, Mus musculus
aagatgagtatgggaagagtcactc

SEQ ID NO: 164971 - DNA, 25 bp, Mus musculus
aagatgagtctcaggaacctgacag

SEQ ID NO: 164972 - DNA, 25 bp, Mus musculus
aagatgagtctcaggttccacgagt

SEQ ID NO: 164973 - DNA, 25 bp, Mus musculus
aagatgagtgatgaaaacaacgaat

SEQ ID NO: 164974 - DNA, 25 bp, Mus musculus
aagatgagtgatgctgcaggtgatt

SEQ ID NO: 164975 - DNA, 25 bp, Mus musculus
aagatgataacacctgctctcatcg

SEQ ID NO: 164976 - DNA, 25 bp, Mus musculus
aagatgataacagctgctctcatcg

SEQ ID NO: 164977 - DNA, 25 bp, Mus musculus
aagatgatagcctcgtggaactgga

SEQ ID NO: 164978 - DNA, 25 bp, Mus musculus
aagatgatagggatgcaaacttggt

SEQ ID NO: 164979 - DNA, 25 bp, Mus musculus
aagatgatccgccagtttacagacc

SEQ ID NO: 164980 - DNA, 25 bp, Mus musculus
aagatgatctctgggacctggaatt

SEQ ID NO: 164981 - DNA, 25 bp, Mus musculus
aagatgatgaaagccctctctatag

SEQ ID NO: 164982 - DNA, 25 bp, Mus musculus
aagatgatgaggctgagaaggcaga

SEQ ID NO: 164983 - DNA, 25 bp, Mus musculus
aagatgatgagtctgatgacagtca

SEQ ID NO: 164984 - DNA, 25 bp, Mus musculus
aagatgatgatgagaagggcaggtc

SEQ ID NO: 164985 - DNA, 25 bp, Mus musculus
aagatgatggacaagaaaaagaata

SEQ ID NO: 164986 - DNA, 25 bp, Mus musculus
aagatgatggacaaggtggagtttg

SEQ ID NO: 164987 - DNA, 25 bp, Mus musculus
aagatgatggctgagatccggggtt

SEQ ID NO: 164988 - DNA, 25 bp, Mus musculus
aagatgatgtccaagtacaaatata

SEQ ID NO: 164989 - DNA, 25 bp, Mus musculus
aagatgattttggaagttgctttaa

SEQ ID NO: 164990 - DNA, 25 bp, Mus musculus
aagatgcaagatgcagagagaaatt

SEQ ID NO: 164991 - DNA, 25 bp, Mus musculus
aagatgcaatcaaagttgtcctggg

SEQ ID NO: 164992 - DNA, 25 bp, Mus musculus
aagatgcactccatgaatgggttca

SEQ ID NO: 164993 - DNA, 25 bp, Mus musculus
aagatgcagaaattgctgcccggga

SEQ ID NO: 164994 - DNA, 25 bp, Mus musculus
aagatgcagaagacggacaagacga

SEQ ID NO: 164995 - DNA, 25 bp, Mus musculus
aagatgcagaagtgtatgagagagg

SEQ ID NO: 164996 - DNA, 25 bp, Mus musculus
aagatgcagaagttcctgctttgta

SEQ ID NO: 164997 - DNA, 25 bp, Mus musculus
aagatgcaggagaagattcgatgaa

SEQ ID NO: 164998 - DNA, 25 bp, Mus musculus
aagatgcccaggaaatagcagacac

SEQ ID NO: 164999 - DNA, 25 bp, Mus musculus
aagatgcccaggtggctgctgagat

SEQ ID NO: 165000 - DNA, 25 bp, Mus musculus
aagatgcctggtacggagtcaaata

SEQ ID NO: 165001 - DNA, 25 bp, Mus musculus
aagatgcctttgacgtcctattacc

SEQ ID NO: 165002 - DNA, 25 bp, Mus musculus
aagatgcgcatgggaggctttgtgg

SEQ ID NO: 165003 - DNA, 25 bp, Mus musculus
aagatgctaatggcccagatggagt

SEQ ID NO: 165004 - DNA, 25 bp, Mus musculus
aagatgctaatggcctctttatggc

SEQ ID NO: 165005 - DNA, 25 bp, Mus musculus
aagatgctaatggcctggtccagat

SEQ ID NO: 165006 - DNA, 25 bp, Mus musculus
aagatgctagaagaatataaaaata

SEQ ID NO: 165007 - DNA, 25 bp, Mus musculus
aagatgctagaaggtcccttcagca

SEQ ID NO: 165008 - DNA, 25 bp, Mus musculus
aagatgctaggagttaaccagctta

SEQ ID NO: 165009 - DNA, 25 bp, Mus musculus
aagatgctaggcaagtcttggaagg

SEQ ID NO: 165010 - DNA, 25 bp, Mus musculus
aagatgctagggtaataatcttcag

SEQ ID NO: 165011 - DNA, 25 bp, Mus musculus
aagatgctctcacaggtccgctaca

SEQ ID NO: 165012 - DNA, 25 bp, Mus musculus
aagatgctgcaggcaccagaaagca

SEQ ID NO: 165013 - DNA, 25 bp, Mus musculus
aagatgctgcaggtctgggaaggcc

SEQ ID NO: 165014 - DNA, 25 bp, Mus musculus
aagatgctgtcagggatggtgaaga

SEQ ID NO: 165015 - DNA, 25 bp, Mus musculus
aagatgcttgagaagatgaggtgaa

SEQ ID NO: 165016 - DNA, 25 bp, Mus musculus
aagatggaaaagctggtggacaata

SEQ ID NO: 165017 - DNA, 25 bp, Mus musculus
aagatggaagaaaatctgggtttgg

SEQ ID NO: 165018 - DNA, 25 bp, Mus musculus
aagatggaagaagccctctgggcgt

SEQ ID NO: 165019 - DNA, 25 bp, Mus musculus
aagatggaagggctctctaaataca

SEQ ID NO: 165020 - DNA, 25 bp, Mus musculus
aagatggatggagagaatgccacgg

SEQ ID NO: 165021 - DNA, 25 bp, Mus musculus
aagatggatggagaggttacagctg

SEQ ID NO: 165022 - DNA, 25 bp, Mus musculus
aagatggatttgacggagccacggc

SEQ ID NO: 165023 - DNA, 25 bp, Mus musculus
aagatggattttaaggtgagactgt

SEQ ID NO: 165024 - DNA, 25 bp, Mus musculus
aagatggcagaatagtgattgacgg

SEQ ID NO: 165025 - DNA, 25 bp, Mus musculus
aagatggcagagctcgtcagtgtct

SEQ ID NO: 165026 - DNA, 25 bp, Mus musculus
aagatggcgaaattgggaaagaaag

SEQ ID NO: 165027 - DNA, 25 bp, Mus musculus
aagatggcgaatcaccgcctccgac

SEQ ID NO: 165028 - DNA, 25 bp, Mus musculus
aagatggcgctggcgatggagacct

SEQ ID NO: 165029 - DNA, 25 bp, Mus musculus
aagatggcgggccggactatgcaag

SEQ ID NO: 165030 - DNA, 25 bp, Mus musculus
aagatggcgggccgggtttctgttg

SEQ ID NO: 165031 - DNA, 25 bp, Mus musculus
aagatggctatccagatattgctgt

SEQ ID NO: 165032 - DNA, 25 bp, Mus musculus
aagatgggagaagagacaattggga

SEQ ID NO: 165033 - DNA, 25 bp, Mus musculus
aagatgggagaccgggtgacactgg

SEQ ID NO: 165034 - DNA, 25 bp, Mus musculus
aagatgggaggcacctccaagtgga

SEQ ID NO: 165035 - DNA, 25 bp, Mus musculus
aagatgggattgatgatgattctga

SEQ ID NO: 165036 - DNA, 25 bp, Mus musculus
aagatggtgcagattccatggagag

SEQ ID NO: 165037 - DNA, 25 bp, Mus musculus
aagatggtggccagggttttaatgt

SEQ ID NO: 165038 - DNA, 25 bp, Mus musculus
aagatggtggtgagtgcctatgaag

SEQ ID NO: 165039 - DNA, 25 bp, Mus musculus
aagatggttcaagtgggtgttccag

SEQ ID NO: 165040 - DNA, 25 bp, Mus musculus
aagatggttcaagtgttcctgtcca

SEQ ID NO: 165041 - DNA, 25 bp, Mus musculus
aagatgtaactgcttggacccttct

SEQ ID NO: 165042 - DNA, 25 bp, Mus musculus
aagatgtacagaagtttgcccggct

SEQ ID NO: 165043 - DNA, 25 bp, Mus musculus
aagatgtacagattttccagggcag

SEQ ID NO: 165044 - DNA, 25 bp, Mus musculus
aagatgtacagctgggtccttggct

SEQ ID NO: 165045 - DNA, 25 bp, Mus musculus
aagatgtacaggggtggcaaaatat

SEQ ID NO: 165046 - DNA, 25 bp, Mus musculus
aagatgtaccttgaaaccatgtaga

SEQ ID NO: 165047 - DNA, 25 bp, Mus musculus
aagatgtaccttgaaaccatgtgaa

SEQ ID NO: 165048 - DNA, 25 bp, Mus musculus
aagatgtcagtgctctcttccctga

SEQ ID NO: 165049 - DNA, 25 bp, Mus musculus
aagatgtcagttcatatggagagac

SEQ ID NO: 165050 - DNA, 25 bp, Mus musculus
aagatgtcatttgaagctgaggagg

SEQ ID NO: 165051 - DNA, 25 bp, Mus musculus
aagatgtcatttgggaggactcaga

SEQ ID NO: 165052 - DNA, 25 bp, Mus musculus
aagatgtcctcggtgactcagaaga

SEQ ID NO: 165053 - DNA, 25 bp, Mus musculus
aagatgtcgccctgatgattcgggc

SEQ ID NO: 165054 - DNA, 25 bp, Mus musculus
aagatgtgaagatgatcagtgcaga

SEQ ID NO: 165055 - DNA, 25 bp, Mus musculus
aagatgtgcagaaagacgctccttg

SEQ ID NO: 165056 - DNA, 25 bp, Mus musculus
aagatgtgcaggtcttgcctcagca

SEQ ID NO: 165057 - DNA, 25 bp, Mus musculus
aagatgtggagactggcacccagct

SEQ ID NO: 165058 - DNA, 25 bp, Mus musculus
aagatgtggcccaagataaagactg

SEQ ID NO: 165059 - DNA, 25 bp, Mus musculus
aagatgtggcccaaggacactcctc

SEQ ID NO: 165060 - DNA, 25 bp, Mus musculus
aagatgtgtaggggagctgtcccga

SEQ ID NO: 165061 - DNA, 25 bp, Mus musculus
aagatgttaggggagcttctggagg

SEQ ID NO: 165062 - DNA, 25 bp, Mus musculus
aagatgttattgcttcaggagctct

SEQ ID NO: 165063 - DNA, 25 bp, Mus musculus
aagatgttgaaagatgatgccacag

SEQ ID NO: 165064 - DNA, 25 bp, Mus musculus
aagatgtttccaggagccctgacat

SEQ ID NO: 165065 - DNA, 25 bp, Mus musculus
aagattaaagctaaggaatattgta

SEQ ID NO: 165066 - DNA, 25 bp, Mus musculus
aagattaaaggaaccaatgaagatg

SEQ ID NO: 165067 - DNA, 25 bp, Mus musculus
aagattaaatttccaaggcccgaga

SEQ ID NO: 165068 - DNA, 25 bp, Mus musculus
aagattaagagctgggccagcaaga

SEQ ID NO: 165069 - DNA, 25 bp, Mus musculus
aagattaatgaaccaccaaagccag

SEQ ID NO: 165070 - DNA, 25 bp, Mus musculus
aagattacaaagtgcgggtcgatga

SEQ ID NO: 165071 - DNA, 25 bp, Mus musculus
aagattagaaggacctcttcctgat

SEQ ID NO: 165072 - DNA, 25 bp, Mus musculus
aagattagacctggttggctcaaaa

SEQ ID NO: 165073 - DNA, 25 bp, Mus musculus
aagattatccagagtcctattgtcg

SEQ ID NO: 165074 - DNA, 25 bp, Mus musculus
aagattatccagggaaaggaagatg

SEQ ID NO: 165075 - DNA, 25 bp, Mus musculus
aagattattgatattttcatttctt

SEQ ID NO: 165076 - DNA, 25 bp, Mus musculus
aagattatttttaagaggcaagaaa

SEQ ID NO: 165077 - DNA, 25 bp, Mus musculus
aagattcaaaaggataaaccagaaa

SEQ ID NO: 165078 - DNA, 25 bp, Mus musculus
aagattcaagaacttggggacatca

SEQ ID NO: 165079 - DNA, 25 bp, Mus musculus
aagattcagaaagattccaggttga

SEQ ID NO: 165080 - DNA, 25 bp, Mus musculus
aagattcagagccaggttgtaaaag

SEQ ID NO: 165081 - DNA, 25 bp, Mus musculus
aagattcattattgaagaagttccg

SEQ ID NO: 165082 - DNA, 25 bp, Mus musculus
aagattccagaaggagaaaaaaaag

SEQ ID NO: 165083 - DNA, 25 bp, Mus musculus
aagattccagtcctgcaccgaggct

SEQ ID NO: 165084 - DNA, 25 bp, Mus musculus
aagattcccacctgttgcccatctt

SEQ ID NO: 165085 - DNA, 25 bp, Mus musculus
aagattcctgccagggtgactctga

SEQ ID NO: 165086 - DNA, 25 bp, Mus musculus
aagattcctgccagggtgactctgg

SEQ ID NO: 165087 - DNA, 25 bp, Mus musculus
aagattcctgccaggtgactctggt

SEQ ID NO: 165088 - DNA, 25 bp, Mus musculus
aagattccttaactcatgcagatgt

SEQ ID NO: 165089 - DNA, 25 bp, Mus musculus
aagattccttaactgcaacaagttt

SEQ ID NO: 165090 - DNA, 25 bp, Mus musculus
aagattctcagagttctgaacttca

SEQ ID NO: 165091 - DNA, 25 bp, Mus musculus
aagattcttaagagaatacggacgg

SEQ ID NO: 165092 - DNA, 25 bp, Mus musculus
aagattcttaagagcatggataaga

SEQ ID NO: 165093 - DNA, 25 bp, Mus musculus
aagattgaagatcgagcgtttggaa

SEQ ID NO: 165094 - DNA, 25 bp, Mus musculus
aagattgaagccatggctgagcaag

SEQ ID NO: 165095 - DNA, 25 bp, Mus musculus
aagattgaggagaagaaggtggcag

SEQ ID NO: 165096 - DNA, 25 bp, Mus musculus
aagattgcaaagtatggtataagga

SEQ ID NO: 165097 - DNA, 25 bp, Mus musculus
aagattgcagagaacaatgacctac

SEQ ID NO: 165098 - DNA, 25 bp, Mus musculus
aagattgcagagtgaaccatgagcc

SEQ ID NO: 165099 - DNA, 25 bp, Mus musculus
aagattgccctcacgatcaacaagg

SEQ ID NO: 165100 - DNA, 25 bp, Mus musculus
aagattgccctcacgcataaaaata

SEQ ID NO: 165101 - DNA, 25 bp, Mus musculus
aagattgctccaagtaaggccccca

SEQ ID NO: 165102 - DNA, 25 bp, Mus musculus
aagattggaaggagacttcaaaaga

SEQ ID NO: 165103 - DNA, 25 bp, Mus musculus
aagattggaaggtattcccatctgt

SEQ ID NO: 165104 - DNA, 25 bp, Mus musculus
aagattggaagtggttctgtgtata

SEQ ID NO: 165105 - DNA, 25 bp, Mus musculus
aagattggaagttcctgtggaagac

SEQ ID NO: 165106 - DNA, 25 bp, Mus musculus
aagattggccatgtgttcaagcgct

SEQ ID NO: 165107 - DNA, 25 bp, Mus musculus
aagattggggacacggcatcctttg

SEQ ID NO: 165108 - DNA, 25 bp, Mus musculus
aagattgtcaagagcaactgcaatg

SEQ ID NO: 165109 - DNA, 25 bp, Mus musculus
aagattgtcaagatgaaatgtcctg

SEQ ID NO: 165110 - DNA, 25 bp, Mus musculus
aagattgtccagacggctgctcttc

SEQ ID NO: 165111 - DNA, 25 bp, Mus musculus
aagattgtctggagatggctgcagc

SEQ ID NO: 165112 - DNA, 25 bp, Mus musculus
aagattgtgtgctgttccacctccc

SEQ ID NO: 165113 - DNA, 25 bp, Mus musculus
aagattgttggataaaagcttatac

SEQ ID NO: 165114 - DNA, 25 bp, Mus musculus
aagatttaaaaggtatgggtgagag

SEQ ID NO: 165115 - DNA, 25 bp, Mus musculus
aagatttccagaggataacgaaaag

SEQ ID NO: 165116 - DNA, 25 bp, Mus musculus
aagatttcctctccaagcttttcat

SEQ ID NO: 165117 - DNA, 25 bp, Mus musculus
aagatttcctctccacccatctgct

SEQ ID NO: 165118 - DNA, 25 bp, Mus musculus
aagatttctgaaaattaatgagtta

SEQ ID NO: 165119 - DNA, 25 bp, Mus musculus
aagatttctggggtgatgactacaa

SEQ ID NO: 165120 - DNA, 25 bp, Mus musculus
aagatttcttcccaggagaaatatg

SEQ ID NO: 165121 - DNA, 25 bp, Mus musculus
aagatttggaagatggagaactctc

SEQ ID NO: 165122 - DNA, 25 bp, Mus musculus
aagatttggaagggtggatgtcact

SEQ ID NO: 165123 - DNA, 25 bp, Mus musculus
aagatttggaagtcaagaagttttc

SEQ ID NO: 165124 - DNA, 25 bp, Mus musculus
aagatttggacgacagtgatcacag

SEQ ID NO: 165125 - DNA, 25 bp, Mus musculus
aagattttcttggggacagtgaaat

SEQ ID NO: 165126 - DNA, 25 bp, Mus musculus
aagattttgagaaggtcatcttgga

SEQ ID NO: 165127 - DNA, 25 bp, Mus musculus
aagatttttctcagtaccaacaaaa

SEQ ID NO: 165128 - DNA, 25 bp, Mus musculus
aagattttttcagtattggaaaagt

SEQ ID NO: 165129 - DNA, 25 bp, Mus musculus
aagcaaaaacacagaatctgctgga

SEQ ID NO: 165130 - DNA, 25 bp, Mus musculus
aagcaaaaacacaggcagagctcag

SEQ ID NO: 165131 - DNA, 25 bp, Mus musculus
aagcaaaaaccatgccttttgcctt

SEQ ID NO: 165132 - DNA, 25 bp, Mus musculus
aagcaaaaaccatgtgtgagtgtta

SEQ ID NO: 165133 - DNA, 25 bp, Mus musculus
aagcaaaaagctattgaccttctgt

SEQ ID NO: 165134 - DNA, 25 bp, Mus musculus
aagcaaaaaggcagaagacttattt

SEQ ID NO: 165135 - DNA, 25 bp, Mus musculus
aagcaaaaaggtctgtctgttactt

SEQ ID NO: 165136 - DNA, 25 bp, Mus musculus
aagcaaaacagggagccacccaaga

SEQ ID NO: 165137 - DNA, 25 bp, Mus musculus
aagcaaaactgaaggatctgaacca

SEQ ID NO: 165138 - DNA, 25 bp, Mus musculus
aagcaaaactgaaggatggcgtggt

SEQ ID NO: 165139 - DNA, 25 bp, Mus musculus
aagcaaaagcaggcggaacatgttc

SEQ ID NO: 165140 - DNA, 25 bp, Mus musculus
aagcaaaagctaaggatgaccagac

SEQ ID NO: 165141 - DNA, 25 bp, Mus musculus
aagcaaacatgtttccttttagacc

SEQ ID NO: 165142 - DNA, 25 bp, Mus musculus
aagcaaacccaggaagagcggtcga

SEQ ID NO: 165143 - DNA, 25 bp, Mus musculus
aagcaaacccaggagacacaccctg

SEQ ID NO: 165144 - DNA, 25 bp, Mus musculus
aagcaaacccagttgagcaaaaaga

SEQ ID NO: 165145 - DNA, 25 bp, Mus musculus
aagcaaagagaaagaaaaatttcct

SEQ ID NO: 165146 - DNA, 25 bp, Mus musculus
aagcaaagagaaccaacttcttgtt

SEQ ID NO: 165147 - DNA, 25 bp, Mus musculus
aagcaaagagcgtgctaatgcgcga

SEQ ID NO: 165148 - DNA, 25 bp, Mus musculus
aagcaaagagggaagaagacatgag

SEQ ID NO: 165149 - DNA, 25 bp, Mus musculus
aagcaaagatcattgcttgtctttc

SEQ ID NO: 165150 - DNA, 25 bp, Mus musculus
aagcaaagccaagatctccaagcca

SEQ ID NO: 165151 - DNA, 25 bp, Mus musculus
aagcaaagccaagatgtttgaagct

SEQ ID NO: 165152 - DNA, 25 bp, Mus musculus
aagcaaaggaatattttgcagagtc

SEQ ID NO: 165153 - DNA, 25 bp, Mus musculus
aagcaaaggactgtggtcaatgtgc

SEQ ID NO: 165154 - DNA, 25 bp, Mus musculus
aagcaaaggcaaagactctgagcag

SEQ ID NO: 165155 - DNA, 25 bp, Mus musculus
aagcaaagtggccaaagtgaggaca

SEQ ID NO: 165156 - DNA, 25 bp, Mus musculus
aagcaaatatgcaacacagatatgt

SEQ ID NO: 165157 - DNA, 25 bp, Mus musculus
aagcaaatcctagagagcctttcca

SEQ ID NO: 165158 - DNA, 25 bp, Mus musculus
aagcaacagagagtgcactgacctt

SEQ ID NO: 165159 - DNA, 25 bp, Mus musculus
aagcaacagagtggatcacattcca

SEQ ID NO: 165160 - DNA, 25 bp, Mus musculus
aagcaacagagttcttgcctctcgc

SEQ ID NO: 165161 - DNA, 25 bp, Mus musculus
aagcaacaggaactttgcatcatgc

SEQ ID NO: 165162 - DNA, 25 bp, Mus musculus
aagcaacagggatgaagtacaactt

SEQ ID NO: 165163 - DNA, 25 bp, Mus musculus
aagcaacatcacagcaaagtctcga

SEQ ID NO: 165164 - DNA, 25 bp, Mus musculus
aagcaacatcacaggtggtagcagg

SEQ ID NO: 165165 - DNA, 25 bp, Mus musculus
aagcaacatcacagttcatagccag

SEQ ID NO: 165166 - DNA, 25 bp, Mus musculus
aagcaacatcatcagacttgcgtgc

SEQ ID NO: 165167 - DNA, 25 bp, Mus musculus
aagcaacatcatcagatagagacta

SEQ ID NO: 165168 - DNA, 25 bp, Mus musculus
aagcaacccgaagcagaagcaggta

SEQ ID NO: 165169 - DNA, 25 bp, Mus musculus
aagcaacctccagctctcttccggc

SEQ ID NO: 165170 - DNA, 25 bp, Mus musculus
aagcaacgaaagatgtgatacaaag

SEQ ID NO: 165171 - DNA, 25 bp, Mus musculus
aagcaacgaaagctcctgcaaagca

SEQ ID NO: 165172 - DNA, 25 bp, Mus musculus
aagcaacgatagtatttttgacagt

SEQ ID NO: 165173 - DNA, 25 bp, Mus musculus
aagcaacggcagctggaaccaccat

SEQ ID NO: 165174 - DNA, 25 bp, Mus musculus
aagcaacggcagctggcctcctatg

SEQ ID NO: 165175 - DNA, 25 bp, Mus musculus
aagcaacggccctgattgaagatat

SEQ ID NO: 165176 - DNA, 25 bp, Mus musculus
aagcaactaagattcctctcgtggc

SEQ ID NO: 165177 - DNA, 25 bp, Mus musculus
aagcaactaaggttcagagaaacag

SEQ ID NO: 165178 - DNA, 25 bp, Mus musculus
aagcaactccgcctccctgcctctg

SEQ ID NO: 165179 - DNA, 25 bp, Mus musculus
aagcaactccggagcctggtgaaaa

SEQ ID NO: 165180 - DNA, 25 bp, Mus musculus
aagcaactgtggaagaatttgagca

SEQ ID NO: 165181 - DNA, 25 bp, Mus musculus
aagcaactgtggaagattcttgaca

SEQ ID NO: 165182 - DNA, 25 bp, Mus musculus
aagcaactttttctgctaatgcctc

SEQ ID NO: 165183 - DNA, 25 bp, Mus musculus
aagcaagaagaaagagaagcagggt

SEQ ID NO: 165184 - DNA, 25 bp, Mus musculus
aagcaagaaggacctagaccgcgac

SEQ ID NO: 165185 - DNA, 25 bp, Mus musculus
aagcaagaaggcacttgctatcagc

SEQ ID NO: 165186 - DNA, 25 bp, Mus musculus
aagcaagaagggtcttgttgcagca

SEQ ID NO: 165187 - DNA, 25 bp, Mus musculus
aagcaagaatacaggtatggttttc

SEQ ID NO: 165188 - DNA, 25 bp, Mus musculus
aagcaagaattaagtcagtggtgca

SEQ ID NO: 165189 - DNA, 25 bp, Mus musculus
aagcaagacccagatcctctcttct

SEQ ID NO: 165190 - DNA, 25 bp, Mus musculus
aagcaagacccaggacctgttccgc

SEQ ID NO: 165191 - DNA, 25 bp, Mus musculus
aagcaagatatggaggccaggaaac

SEQ ID NO: 165192 - DNA, 25 bp, Mus musculus
aagcaagatgctaggcaagtcttgg

SEQ ID NO: 165193 - DNA, 25 bp, Mus musculus
aagcaagcaagcagacttgtccttc

SEQ ID NO: 165194 - DNA, 25 bp, Mus musculus
aagcaagcagacttgtccttctcat

SEQ ID NO: 165195 - DNA, 25 bp, Mus musculus
aagcaagcagcaggagaaaaaaatg

SEQ ID NO: 165196 - DNA, 25 bp, Mus musculus
aagcaagcagttgtttcttgagata

SEQ ID NO: 165197 - DNA, 25 bp, Mus musculus
aagcaagcatgaatgaagtcttaca

SEQ ID NO: 165198 - DNA, 25 bp, Mus musculus
aagcaagcatgagaaaggctgggat

SEQ ID NO: 165199 - DNA, 25 bp, Mus musculus
aagcaaggacacagggtctcttaca

SEQ ID NO: 165200 - DNA, 25 bp, Mus musculus
aagcaaggaggggctgagaaaataa

SEQ ID NO: 165201 - DNA, 25 bp, Mus musculus
aagcaaggccagatgctgaaattac

SEQ ID NO: 165202 - DNA, 25 bp, Mus musculus
aagcaaggccagatggatgctgttc

SEQ ID NO: 165203 - DNA, 25 bp, Mus musculus
aagcaaggccagatgtgatgctgtt

SEQ ID NO: 165204 - DNA, 25 bp, Mus musculus
aagcaaggtaacccagcatgtagtc

SEQ ID NO: 165205 - DNA, 25 bp, Mus musculus
aagcaaggtgaaggctcctcgggag

SEQ ID NO: 165206 - DNA, 25 bp, Mus musculus
aagcaaggtgaccagggtattcctg

SEQ ID NO: 165207 - DNA, 25 bp, Mus musculus
aagcaagtcagaaggcttcggagtt

SEQ ID NO: 165208 - DNA, 25 bp, Mus musculus
aagcaagtcagaagttttggggtta

SEQ ID NO: 165209 - DNA, 25 bp, Mus musculus
aagcaagtcagatgaatggaaactt

SEQ ID NO: 165210 - DNA, 25 bp, Mus musculus
aagcaagtgcaagcaatagctgtct

SEQ ID NO: 165211 - DNA, 25 bp, Mus musculus
aagcaagtgcaaggcaaaggcagag

SEQ ID NO: 165212 - DNA, 25 bp, Mus musculus
aagcaagtgcaaggtttctgaaaga

SEQ ID NO: 165213 - DNA, 25 bp, Mus musculus
aagcaagtgccaattcctgaatgcc

SEQ ID NO: 165214 - DNA, 25 bp, Mus musculus
aagcaagtgtctgaacgagaagaac

SEQ ID NO: 165215 - DNA, 25 bp, Mus musculus
aagcaatacaaagcttcaagaaaaa

SEQ ID NO: 165216 - DNA, 25 bp, Mus musculus
aagcaatacaaagtacctacgcatg

SEQ ID NO: 165217 - DNA, 25 bp, Mus musculus
aagcaatcaaagcttatttccaaag

SEQ ID NO: 165218 - DNA, 25 bp, Mus musculus
aagcaatcaaaggtgagacgacaag

SEQ ID NO: 165219 - DNA, 25 bp, Mus musculus
aagcaatcaaggctttacaagatga

SEQ ID NO: 165220 - DNA, 25 bp, Mus musculus
aagcaatgccagaggagtctaagtc

SEQ ID NO: 165221 - DNA, 25 bp, Mus musculus
aagcaatgccagaggagtctaatga

SEQ ID NO: 165222 - DNA, 25 bp, Mus musculus
aagcaatgccagagtctgttataat

SEQ ID NO: 165223 - DNA, 25 bp, Mus musculus
aagcaatggaatcctctggcaagcg

SEQ ID NO: 165224 - DNA, 25 bp, Mus musculus
aagcaatggctcagggccatcgaag

SEQ ID NO: 165225 - DNA, 25 bp, Mus musculus
aagcaatgtcaggcgtccgacctcc

SEQ ID NO: 165226 - DNA, 25 bp, Mus musculus
aagcaattctggatatgctctccat

SEQ ID NO: 165227 - DNA, 25 bp, Mus musculus
aagcaattgaaatcacagctcccga

SEQ ID NO: 165228 - DNA, 25 bp, Mus musculus
aagcaattgaaatcagggaagctgc

SEQ ID NO: 165229 - DNA, 25 bp, Mus musculus
aagcaattgcaggactctgatgggg

SEQ ID NO: 165230 - DNA, 25 bp, Mus musculus
aagcacaacagagacacagtgtcgt

SEQ ID NO: 165231 - DNA, 25 bp, Mus musculus
aagcacaactcaagcctaccaccac

SEQ ID NO: 165232 - DNA, 25 bp, Mus musculus
aagcacaactcaaggtgaaatttga

SEQ ID NO: 165233 - DNA, 25 bp, Mus musculus
aagcacaagaaaaggctgcagaaga

SEQ ID NO: 165234 - DNA, 25 bp, Mus musculus
aagcacaagcccaaggctgctgaca

SEQ ID NO: 165235 - DNA, 25 bp, Mus musculus
aagcacaatggcatctgtaagcact

SEQ ID NO: 165236 - DNA, 25 bp, Mus musculus
aagcacacaagcggatgaaggttaa

SEQ ID NO: 165237 - DNA, 25 bp, Mus musculus
aagcacacacagacactggatccct

SEQ ID NO: 165238 - DNA, 25 bp, Mus musculus
aagcacacacaggggcagttccaga

SEQ ID NO: 165239 - DNA, 25 bp, Mus musculus
aagcacacagggttttggtaaaact

SEQ ID NO: 165240 - DNA, 25 bp, Mus musculus
aagcacacagttcctagtcactcga

SEQ ID NO: 165241 - DNA, 25 bp, Mus musculus
aagcacacccagaactgagcacaac

SEQ ID NO: 165242 - DNA, 25 bp, Mus musculus
aagcacacccaggtgccagcctcac

SEQ ID NO: 165243 - DNA, 25 bp, Mus musculus
aagcacaccggagtgcaatcaaaac

SEQ ID NO: 165244 - DNA, 25 bp, Mus musculus
aagcacaccggagtggtgacaaatg

SEQ ID NO: 165245 - DNA, 25 bp, Mus musculus
aagcacacttgttgtttacctgctg

SEQ ID NO: 165246 - DNA, 25 bp, Mus musculus
aagcacagaaggaacagattctggt

SEQ ID NO: 165247 - DNA, 25 bp, Mus musculus
aagcacagacaaagtggacaccatg

SEQ ID NO: 165248 - DNA, 25 bp, Mus musculus
aagcacagcaactttctccggctgt

SEQ ID NO: 165249 - DNA, 25 bp, Mus musculus
aagcacagcccccagctcgtagtgc

SEQ ID NO: 165250 - DNA, 25 bp, Mus musculus
aagcacagcgtggtcacctccagcc

SEQ ID NO: 165251 - DNA, 25 bp, Mus musculus
aagcacaggattgaggtccagaagg

SEQ ID NO: 165252 - DNA, 25 bp, Mus musculus
aagcacaggccttgggctggagcac

SEQ ID NO: 165253 - DNA, 25 bp, Mus musculus
aagcacatcaaggaacagagagacc

SEQ ID NO: 165254 - DNA, 25 bp, Mus musculus
aagcacatccagaaggagcttgtgg

SEQ ID NO: 165255 - DNA, 25 bp, Mus musculus
aagcacatcgtatggcgcccagaat

SEQ ID NO: 165256 - DNA, 25 bp, Mus musculus
aagcacatgagctgggctgtagcag

SEQ ID NO: 165257 - DNA, 25 bp, Mus musculus
aagcacattagctcggttatgtaca

SEQ ID NO: 165258 - DNA, 25 bp, Mus musculus
aagcacattagctcggttttgtaca

SEQ ID NO: 165259 - DNA, 25 bp, Mus musculus
aagcaccaaagcttcgcataaggaa

SEQ ID NO: 165260 - DNA, 25 bp, Mus musculus
aagcaccaaagtaccatttaggtcc

SEQ ID NO: 165261 - DNA, 25 bp, Mus musculus
aagcaccaacaaagttattcatggt

SEQ ID NO: 165262 - DNA, 25 bp, Mus musculus
aagcaccaagagcccgaccgtccgc

SEQ ID NO: 165263 - DNA, 25 bp, Mus musculus
aagcaccagagggtgtctttaagaa

SEQ ID NO: 165264 - DNA, 25 bp, Mus musculus
aagcaccagaggtctgagttcttcc

SEQ ID NO: 165265 - DNA, 25 bp, Mus musculus
aagcaccaggtccccggcgctactt

SEQ ID NO: 165266 - DNA, 25 bp, Mus musculus
aagcacccaatgtcagaatacaaga

SEQ ID NO: 165267 - DNA, 25 bp, Mus musculus
aagcacccagaaggcaagatcctca

SEQ ID NO: 165268 - DNA, 25 bp, Mus musculus
aagcacccagttaaatcatcgggtt

SEQ ID NO: 165269 - DNA, 25 bp, Mus musculus
aagcaccccccaaggatcgtgaact

SEQ ID NO: 165270 - DNA, 25 bp, Mus musculus
aagcaccctcagcagtcccgtctac

SEQ ID NO: 165271 - DNA, 25 bp, Mus musculus
aagcaccctcagggaacagaagtca

SEQ ID NO: 165272 - DNA, 25 bp, Mus musculus
aagcaccctgaggagcaccactccc

SEQ ID NO: 165273 - DNA, 25 bp, Mus musculus
aagcaccgaatgcacaatctctgct

SEQ ID NO: 165274 - DNA, 25 bp, Mus musculus
aagcaccgaggagagcactgcctgc

SEQ ID NO: 165275 - DNA, 25 bp, Mus musculus
aagcaccgaggagagccggatggcg

SEQ ID NO: 165276 - DNA, 25 bp, Mus musculus
aagcaccgaggcaaatacctcgcta

SEQ ID NO: 165277 - DNA, 25 bp, Mus musculus
aagcaccgaggcaaatcctggatgg

SEQ ID NO: 165278 - DNA, 25 bp, Mus musculus
aagcaccgaggcaatctacgggctg

SEQ ID NO: 165279 - DNA, 25 bp, Mus musculus
aagcaccgcaggtatcagcctagca

SEQ ID NO: 165280 - DNA, 25 bp, Mus musculus
aagcaccggaacaggttcaagttct

SEQ ID NO: 165281 - DNA, 25 bp, Mus musculus
aagcacctagagacaagtaagcagc

SEQ ID NO: 165282 - DNA, 25 bp, Mus musculus
aagcacctatgagagtcatcagaga

SEQ ID NO: 165283 - DNA, 25 bp, Mus musculus
aagcacctatgagtacttacagcta

SEQ ID NO: 165284 - DNA, 25 bp, Mus musculus
aagcacctcctgattccactgtatc

SEQ ID NO: 165285 - DNA, 25 bp, Mus musculus
aagcacctctccagattcactaaaa

SEQ ID NO: 165286 - DNA, 25 bp, Mus musculus
aagcacctctccagcgttccctgct

SEQ ID NO: 165287 - DNA, 25 bp, Mus musculus
aagcacctctccagtctctagataa

SEQ ID NO: 165288 - DNA, 25 bp, Mus musculus
aagcacctgccaatgttctctcggg

SEQ ID NO: 165289 - DNA, 25 bp, Mus musculus
aagcaccttggacaaagtctcgact

SEQ ID NO: 165290 - DNA, 25 bp, Mus musculus
aagcaccttggtgaccagaatggag

SEQ ID NO: 165291 - DNA, 25 bp, Mus musculus
aagcacctttctcagtacattcgct

SEQ ID NO: 165292 - DNA, 25 bp, Mus musculus
aagcacgaagcaataagtcctatga

SEQ ID NO: 165293 - DNA, 25 bp, Mus musculus
aagcacgaggatggatgcgagttca

SEQ ID NO: 165294 - DNA, 25 bp, Mus musculus
aagcacgatctggagatgaaaccaa

SEQ ID NO: 165295 - DNA, 25 bp, Mus musculus
aagcacgatctggatatgatgaatg

SEQ ID NO: 165296 - DNA, 25 bp, Mus musculus
aagcacgcacctggaagggtctgtt

SEQ ID NO: 165297 - DNA, 25 bp, Mus musculus
aagcacgggaaagaaaacaaacatt

SEQ ID NO: 165298 - DNA, 25 bp, Mus musculus
aagcacgggaaagaaacactcatca

SEQ ID NO: 165299 - DNA, 25 bp, Mus musculus
aagcacggggtagtgatccattgta

SEQ ID NO: 165300 - DNA, 25 bp, Mus musculus
aagcacgtcaaccaggaaaccaaaa

SEQ ID NO: 165301 - DNA, 25 bp, Mus musculus
aagcactaacgtttgatccccagaa

SEQ ID NO: 165302 - DNA, 25 bp, Mus musculus
aagcactaactccagaactttcctc

SEQ ID NO: 165303 - DNA, 25 bp, Mus musculus
aagcactacagactgcagttctata

SEQ ID NO: 165304 - DNA, 25 bp, Mus musculus
aagcactatcccgctcgggcaaagt

SEQ ID NO: 165305 - DNA, 25 bp, Mus musculus
aagcactcagcacggcagctgcgac

SEQ ID NO: 165306 - DNA, 25 bp, Mus musculus
aagcactcatccagctcttcttaca

SEQ ID NO: 165307 - DNA, 25 bp, Mus musculus
aagcactccataaactaaagctgca

SEQ ID NO: 165308 - DNA, 25 bp, Mus musculus
aagcactccatgtgtgtctgaagac

SEQ ID NO: 165309 - DNA, 25 bp, Mus musculus
aagcactctcaggctaccggctctc

SEQ ID NO: 165310 - DNA, 25 bp, Mus musculus
aagcactgctcatgggggcacctat

SEQ ID NO: 165311 - DNA, 25 bp, Mus musculus
aagcactggcaggtccaggaggtcc

SEQ ID NO: 165312 - DNA, 25 bp, Mus musculus
aagcactgggtatctctctttctct

SEQ ID NO: 165313 - DNA, 25 bp, Mus musculus
aagcactgggtattttcttgttacc

SEQ ID NO: 165314 - DNA, 25 bp, Mus musculus
aagcactgtgttttcagtaaatgaa

SEQ ID NO: 165315 - DNA, 25 bp, Mus musculus
aagcacttagttggtcgaccgcccc

SEQ ID NO: 165316 - DNA, 25 bp, Mus musculus
aagcacttatgaaggtccttcagta

SEQ ID NO: 165317 - DNA, 25 bp, Mus musculus
aagcacttcaccagtaaaaagccat

SEQ ID NO: 165318 - DNA, 25 bp, Mus musculus
aagcacttcaggaagctgatgaaga

SEQ ID NO: 165319 - DNA, 25 bp, Mus musculus
aagcacttcctgagctttctatcgg

SEQ ID NO: 165320 - DNA, 25 bp, Mus musculus
aagcacttcctgaggatgttgatcc

SEQ ID NO: 165321 - DNA, 25 bp, Mus musculus
aagcacttggggccctagagaaaca

SEQ ID NO: 165322 - DNA, 25 bp, Mus musculus
aagcactttggtaaacttcctacag

SEQ ID NO: 165323 - DNA, 25 bp, Mus musculus
aagcagaaaaaaaggtttatgaagc

SEQ ID NO: 165324 - DNA, 25 bp, Mus musculus
aagcagaaatttacctaaagccttt

SEQ ID NO: 165325 - DNA, 25 bp, Mus musculus
aagcagaacagccttccagaaatgc

SEQ ID NO: 165326 - DNA, 25 bp, Mus musculus
aagcagaacagggcggcagatcaaa

SEQ ID NO: 165327 - DNA, 25 bp, Mus musculus
aagcagaacaggtttgccagatctg

SEQ ID NO: 165328 - DNA, 25 bp, Mus musculus
aagcagaacctggattcagatggtc

SEQ ID NO: 165329 - DNA, 25 bp, Mus musculus
aagcagaacctgggggctaaactct

SEQ ID NO: 165330 - DNA, 25 bp, Mus musculus
aagcagaagaaaagactggacaatc

SEQ ID NO: 165331 - DNA, 25 bp, Mus musculus
aagcagaagaaaggggctcgctccc

SEQ ID NO: 165332 - DNA, 25 bp, Mus musculus
aagcagaagagaatggaagtgaggc

SEQ ID NO: 165333 - DNA, 25 bp, Mus musculus
aagcagaagaggagagtgataatga

SEQ ID NO: 165334 - DNA, 25 bp, Mus musculus
aagcagaagaggatcctgggcatgc

SEQ ID NO: 165335 - DNA, 25 bp, Mus musculus
aagcagaagagtgggacggctgttc

SEQ ID NO: 165336 - DNA, 25 bp, Mus musculus
aagcagaagcaaattgtggaccggg

SEQ ID NO: 165337 - DNA, 25 bp, Mus musculus
aagcagaagggttaggatgatgctg

SEQ ID NO: 165338 - DNA, 25 bp, Mus musculus
aagcagaaggtattgtcatcactag

SEQ ID NO: 165339 - DNA, 25 bp, Mus musculus
aagcagaagtcgacagagcacactc

SEQ ID NO: 165340 - DNA, 25 bp, Mus musculus
aagcagaataccaaccacagccaca

SEQ ID NO: 165341 - DNA, 25 bp, Mus musculus
aagcagaatatgaagagcgggcagc

SEQ ID NO: 165342 - DNA, 25 bp, Mus musculus
aagcagaatatgaaggcatgatggg

SEQ ID NO: 165343 - DNA, 25 bp, Mus musculus
aagcagaatatgaaggtgtgatgaa

SEQ ID NO: 165344 - DNA, 25 bp, Mus musculus
aagcagaatcgtatcgaattaaaga

SEQ ID NO: 165345 - DNA, 25 bp, Mus musculus
aagcagaatcgttttggatcccaga

SEQ ID NO: 165346 - DNA, 25 bp, Mus musculus
aagcagacagaatttcagcatatgt

SEQ ID NO: 165347 - DNA, 25 bp, Mus musculus
aagcagacagaccgtgcgagtccag

SEQ ID NO: 165348 - DNA, 25 bp, Mus musculus
aagcagacagatgagcgttcggccg

SEQ ID NO: 165349 - DNA, 25 bp, Mus musculus
aagcagacaggttcagctcctaatc

SEQ ID NO: 165350 - DNA, 25 bp, Mus musculus
aagcagaccaaggtggaattcccag

SEQ ID NO: 165351 - DNA, 25 bp, Mus musculus
aagcagaccaaggtggaattccctg

SEQ ID NO: 165352 - DNA, 25 bp, Mus musculus
aagcagaccaagttccagaatctac

SEQ ID NO: 165353 - DNA, 25 bp, Mus musculus
aagcagaccagccctagtcgaggga

SEQ ID NO: 165354 - DNA, 25 bp, Mus musculus
aagcagacccgggcagatatcaaga

SEQ ID NO: 165355 - DNA, 25 bp, Mus musculus
aagcagactaggaatctcgatctgc

SEQ ID NO: 165356 - DNA, 25 bp, Mus musculus
aagcagactgcaggaaactacaacc

SEQ ID NO: 165357 - DNA, 25 bp, Mus musculus
aagcagactgggattgtcttgagaa

SEQ ID NO: 165358 - DNA, 25 bp, Mus musculus
aagcagagaaagccgagtccatcta

SEQ ID NO: 165359 - DNA, 25 bp, Mus musculus
aagcagagaagagtgtagctgcaac

SEQ ID NO: 165360 - DNA, 25 bp, Mus musculus
aagcagagaatggagcctgtgacct

SEQ ID NO: 165361 - DNA, 25 bp, Mus musculus
aagcagagaatgtggacatctcgtg

SEQ ID NO: 165362 - DNA, 25 bp, Mus musculus
aagcagagacaaattgaacaagaaa

SEQ ID NO: 165363 - DNA, 25 bp, Mus musculus
aagcagagaggagaaaaggaggacg

SEQ ID NO: 165364 - DNA, 25 bp, Mus musculus
aagcagagcaaaagactgggaacct

SEQ ID NO: 165365 - DNA, 25 bp, Mus musculus
aagcagagcaaaagggaagcagtgc

SEQ ID NO: 165366 - DNA, 25 bp, Mus musculus
aagcagagcaagatctggtgctttg

SEQ ID NO: 165367 - DNA, 25 bp, Mus musculus
aagcagaggagactctaacacgtga

SEQ ID NO: 165368 - DNA, 25 bp, Mus musculus
aagcagaggagatgggtggtggaag

SEQ ID NO: 165369 - DNA, 25 bp, Mus musculus
aagcagaggaggaggtcacgctcac

SEQ ID NO: 165370 - DNA, 25 bp, Mus musculus
aagcagaggcgatgctttttaaatt

SEQ ID NO: 165371 - DNA, 25 bp, Mus musculus
aagcagagtacaaggtggtaaatct

SEQ ID NO: 165372 - DNA, 25 bp, Mus musculus
aagcagataccgggcccaacgaagg

SEQ ID NO: 165373 - DNA, 25 bp, Mus musculus
aagcagataccgggtggggacgacg

SEQ ID NO: 165374 - DNA, 25 bp, Mus musculus
aagcagatagcagtagtcctaccgg

SEQ ID NO: 165375 - DNA, 25 bp, Mus musculus
aagcagatccaggagctggtggaag

SEQ ID NO: 165376 - DNA, 25 bp, Mus musculus
aagcagatccaggaggacttcttcc

SEQ ID NO: 165377 - DNA, 25 bp, Mus musculus
aagcagatccggagtagcccctgga

SEQ ID NO: 165378 - DNA, 25 bp, Mus musculus
aagcagatcttgaggttacggaaac

SEQ ID NO: 165379 - DNA, 25 bp, Mus musculus
aagcagatgaagatcatccatgaag

SEQ ID NO: 165380 - DNA, 25 bp, Mus musculus
aagcagatgctcagcaaccagacct

SEQ ID NO: 165381 - DNA, 25 bp, Mus musculus
aagcagatgggacagcaaagagccc

SEQ ID NO: 165382 - DNA, 25 bp, Mus musculus
aagcagatggtctggtgtagccgtc

SEQ ID NO: 165383 - DNA, 25 bp, Mus musculus
aagcagatttaaagaacccaatatg

SEQ ID NO: 165384 - DNA, 25 bp, Mus musculus
aagcagcaaaatggcccaccaagaa

SEQ ID NO: 165385 - DNA, 25 bp, Mus musculus
aagcagcaaaatggtaaccctggca

SEQ ID NO: 165386 - DNA, 25 bp, Mus musculus
aagcagcaaccatgcgtgagtgcat

SEQ ID NO: 165387 - DNA, 25 bp, Mus musculus
aagcagcaacgtcggagtcttctaa

SEQ ID NO: 165388 - DNA, 25 bp, Mus musculus
aagcagcaatggagcttggcatgga

SEQ ID NO: 165389 - DNA, 25 bp, Mus musculus
aagcagcaatggaggaattttgaca

SEQ ID NO: 165390 - DNA, 25 bp, Mus musculus
aagcagcaatggaggcaggtggaag

SEQ ID NO: 165391 - DNA, 25 bp, Mus musculus
aagcagcaccaaggaaacgtgtccc

SEQ ID NO: 165392 - DNA, 25 bp, Mus musculus
aagcagcaccaagtgtgggttgttt

SEQ ID NO: 165393 - DNA, 25 bp, Mus musculus
aagcagcacgagcgggtattcccct

SEQ ID NO: 165394 - DNA, 25 bp, Mus musculus
aagcagcagaggaagacgttcacag

SEQ ID NO: 165395 - DNA, 25 bp, Mus musculus
aagcagcagatgttcaagtttggac

SEQ ID NO: 165396 - DNA, 25 bp, Mus musculus
aagcagcagcaaagtctgcatctgg

SEQ ID NO: 165397 - DNA, 25 bp, Mus musculus
aagcagcagcaacctcattgggcgc

SEQ ID NO: 165398 - DNA, 25 bp, Mus musculus
aagcagcagcccatacaatcctcct

SEQ ID NO: 165399 - DNA, 25 bp, Mus musculus
aagcagcagcgaaatgaccagccca

SEQ ID NO: 165400 - DNA, 25 bp, Mus musculus
aagcagcagcgaaatggttgtactt

SEQ ID NO: 165401 - DNA, 25 bp, Mus musculus
aagcagcagcgcaagaccttcacag

SEQ ID NO: 165402 - DNA, 25 bp, Mus musculus
aagcagcaggagacagtgacccgcc

SEQ ID NO: 165403 - DNA, 25 bp, Mus musculus
aagcagcaggagatgaggcccgccc

SEQ ID NO: 165404 - DNA, 25 bp, Mus musculus
aagcagcaggggaccagcctcatcc

SEQ ID NO: 165405 - DNA, 25 bp, Mus musculus
aagcagcatgcactgcgcaatgagc

SEQ ID NO: 165406 - DNA, 25 bp, Mus musculus
aagcagccaccaaggacggaattaa

SEQ ID NO: 165407 - DNA, 25 bp, Mus musculus
aagcagccaccaagtgctgagggtt

SEQ ID NO: 165408 - DNA, 25 bp, Mus musculus
aagcagccagatttagatcatgcct

SEQ ID NO: 165409 - DNA, 25 bp, Mus musculus
aagcagccaggccccatgaagctca

SEQ ID NO: 165410 - DNA, 25 bp, Mus musculus
aagcagccaggggactctgatggtt

SEQ ID NO: 165411 - DNA, 25 bp, Mus musculus
aagcagccagtctcaatggaaactt

SEQ ID NO: 165412 - DNA, 25 bp, Mus musculus
aagcagcccaagcagctggagattc

SEQ ID NO: 165413 - DNA, 25 bp, Mus musculus
aagcagccccagagctgaactccca

SEQ ID NO: 165414 - DNA, 25 bp, Mus musculus
aagcagccgagcctcgggatggatg

SEQ ID NO: 165415 - DNA, 25 bp, Mus musculus
aagcagcctccgaaagagcccagtg

SEQ ID NO: 165416 - DNA, 25 bp, Mus musculus
aagcagcgatgggccagggctttga

SEQ ID NO: 165417 - DNA, 25 bp, Mus musculus
aagcagcggccacaggccactgcag

SEQ ID NO: 165418 - DNA, 25 bp, Mus musculus
aagcagctaaagactgtttttgtta

SEQ ID NO: 165419 - DNA, 25 bp, Mus musculus
aagcagctaaagagaggatcacctt

SEQ ID NO: 165420 - DNA, 25 bp, Mus musculus
aagcagctagagcgacagcagttgg

SEQ ID NO: 165421 - DNA, 25 bp, Mus musculus
aagcagctgacccgactcagcctta

SEQ ID NO: 165422 - DNA, 25 bp, Mus musculus
aagcagctgagcctccccctgcagg

SEQ ID NO: 165423 - DNA, 25 bp, Mus musculus
aagcagctgccagactctgatagac

SEQ ID NO: 165424 - DNA, 25 bp, Mus musculus
aagcagctggacagggtccgcaagc

SEQ ID NO: 165425 - DNA, 25 bp, Mus musculus
aagcagctggaggtggtcaagctgc

SEQ ID NO: 165426 - DNA, 25 bp, Mus musculus
aagcagctggagttgaactttctag

SEQ ID NO: 165427 - DNA, 25 bp, Mus musculus
aagcaggaaagcagaaaaccgtcaa

SEQ ID NO: 165428 - DNA, 25 bp, Mus musculus
aagcaggaaagcgaggatgagaagc

SEQ ID NO: 165429 - DNA, 25 bp, Mus musculus
aagcaggaaagttccaggggaacat

SEQ ID NO: 165430 - DNA, 25 bp, Mus musculus
aagcaggaactcaggtggccactct

SEQ ID NO: 165431 - DNA, 25 bp, Mus musculus
aagcaggaagcaggaagcctgtgaa

SEQ ID NO: 165432 - DNA, 25 bp, Mus musculus
aagcaggaagtgtacttgatgtgtg

SEQ ID NO: 165433 - DNA, 25 bp, Mus musculus
aagcaggaatagcctgcacaggttt

SEQ ID NO: 165434 - DNA, 25 bp, Mus musculus
aagcaggacagagaagaaggtgcag

SEQ ID NO: 165435 - DNA, 25 bp, Mus musculus
aagcaggaccagagggtcctcctgg

SEQ ID NO: 165436 - DNA, 25 bp, Mus musculus
aagcaggaccaggcggttgtggatc

SEQ ID NO: 165437 - DNA, 25 bp, Mus musculus
aagcaggacgcccaggaactgtatg

SEQ ID NO: 165438 - DNA, 25 bp, Mus musculus
aagcaggacgcccaggtctttcaac

SEQ ID NO: 165439 - DNA, 25 bp, Mus musculus
aagcaggagcccaacttgcaggtgg

SEQ ID NO: 165440 - DNA, 25 bp, Mus musculus
aagcaggagtgcactgccccccaaa

SEQ ID NO: 165441 - DNA, 25 bp, Mus musculus
aagcaggatgcgaagaaagccttca

SEQ ID NO: 165442 - DNA, 25 bp, Mus musculus
aagcaggcaacagatcagcacggcc

SEQ ID NO: 165443 - DNA, 25 bp, Mus musculus
aagcaggcaaggagacggaagagta

SEQ ID NO: 165444 - DNA, 25 bp, Mus musculus
aagcaggcaaggtatacttgaaggc

SEQ ID NO: 165445 - DNA, 25 bp, Mus musculus
aagcaggcaaggtgaccacattagt

SEQ ID NO: 165446 - DNA, 25 bp, Mus musculus
aagcaggcagtgaggccaggttcca

SEQ ID NO: 165447 - DNA, 25 bp, Mus musculus
aagcaggccaagcaggcttgtgatg

SEQ ID NO: 165448 - DNA, 25 bp, Mus musculus
aagcagggaagcctggacccccagg

SEQ ID NO: 165449 - DNA, 25 bp, Mus musculus
aagcagggaccaggccctctgccaa

SEQ ID NO: 165450 - DNA, 25 bp, Mus musculus
aagcagggaccatggttggggtgct

SEQ ID NO: 165451 - DNA, 25 bp, Mus musculus
aagcagggaggtaaagcgttcggct

SEQ ID NO: 165452 - DNA, 25 bp, Mus musculus
aagcagggccctcaggaacaatggc

SEQ ID NO: 165453 - DNA, 25 bp, Mus musculus
aagcagggccctcaggccaggggga

SEQ ID NO: 165454 - DNA, 25 bp, Mus musculus
aagcagggcctgctcaggctgtggc

SEQ ID NO: 165455 - DNA, 25 bp, Mus musculus
aagcagggtaccgcgagatactact

SEQ ID NO: 165456 - DNA, 25 bp, Mus musculus
aagcaggtactaaaatggatcgtaa

SEQ ID NO: 165457 - DNA, 25 bp, Mus musculus
aagcaggtccccaagaagcttaaga

SEQ ID NO: 165458 - DNA, 25 bp, Mus musculus
aagcaggtctgggtattggatggcc

SEQ ID NO: 165459 - DNA, 25 bp, Mus musculus
aagcaggtgaagatgacgatggctc

SEQ ID NO: 165460 - DNA, 25 bp, Mus musculus
aagcaggttccagacaatcctcctg

SEQ ID NO: 165461 - DNA, 25 bp, Mus musculus
aagcaggttccagctctcccaggaa

SEQ ID NO: 165462 - DNA, 25 bp, Mus musculus
aagcaggtttagaagacagcgtgga

SEQ ID NO: 165463 - DNA, 25 bp, Mus musculus
aagcagtacaaacctctttctcatc

SEQ ID NO: 165464 - DNA, 25 bp, Mus musculus
aagcagtaccagtttgctagtggtg

SEQ ID NO: 165465 - DNA, 25 bp, Mus musculus
aagcagtatgttgatgcaacgtgta

SEQ ID NO: 165466 - DNA, 25 bp, Mus musculus
aagcagtatgttgatggagatcagt

SEQ ID NO: 165467 - DNA, 25 bp, Mus musculus
aagcagtcaggatgatgcagctagt

SEQ ID NO: 165468 - DNA, 25 bp, Mus musculus
aagcagtcagggcaatggcagcgct

SEQ ID NO: 165469 - DNA, 25 bp, Mus musculus
aagcagtccagatttcatcctgatg

SEQ ID NO: 165470 - DNA, 25 bp, Mus musculus
aagcagtccagccctattctgaaaa

SEQ ID NO: 165471 - DNA, 25 bp, Mus musculus
aagcagtccagctcgtctgatcctt

SEQ ID NO: 165472 - DNA, 25 bp, Mus musculus
aagcagtccaggttcttactctgta

SEQ ID NO: 165473 - DNA, 25 bp, Mus musculus
aagcagtccagttcgataccgttcc

SEQ ID NO: 165474 - DNA, 25 bp, Mus musculus
aagcagtccagttcgatttgatatc

SEQ ID NO: 165475 - DNA, 25 bp, Mus musculus
aagcagtcccggctgagtttgaatg

SEQ ID NO: 165476 - DNA, 25 bp, Mus musculus
aagcagtgcaagacagcacacccta

SEQ ID NO: 165477 - DNA, 25 bp, Mus musculus
aagcagtgccgaaagtggctatgca

SEQ ID NO: 165478 - DNA, 25 bp, Mus musculus
aagcagtgctagttgggtgcaaagc

SEQ ID NO: 165479 - DNA, 25 bp, Mus musculus
aagcagtggaggctctttgccgaca

SEQ ID NO: 165480 - DNA, 25 bp, Mus musculus
aagcagtggctcaagaccctgaagg

SEQ ID NO: 165481 - DNA, 25 bp, Mus musculus
aagcagtggctcaaggctatcgagg

SEQ ID NO: 165482 - DNA, 25 bp, Mus musculus
aagcagtggtccagggatgaactgt

SEQ ID NO: 165483 - DNA, 25 bp, Mus musculus
aagcagttaattgagtgtgttctca

SEQ ID NO: 165484 - DNA, 25 bp, Mus musculus
aagcagttttaaaagcaagtctgcg

SEQ ID NO: 165485 - DNA, 25 bp, Mus musculus
aagcagttttaaaagcctggctccg

SEQ ID NO: 165486 - DNA, 25 bp, Mus musculus
aagcagttttaaaagtccagccatt

SEQ ID NO: 165487 - DNA, 25 bp, Mus musculus
aagcagttttgaattacctgaagac

SEQ ID NO: 165488 - DNA, 25 bp, Mus musculus
aagcagttttgttagttttcatgga

SEQ ID NO: 165489 - DNA, 25 bp, Mus musculus
aagcataaaagaatgatgccagcat

SEQ ID NO: 165490 - DNA, 25 bp, Mus musculus
aagcataaagaccagtttcccaact

SEQ ID NO: 165491 - DNA, 25 bp, Mus musculus
aagcataaagatctgggcagtgaat

SEQ ID NO: 165492 - DNA, 25 bp, Mus musculus
aagcataaaggaacatgcctctgga

SEQ ID NO: 165493 - DNA, 25 bp, Mus musculus
aagcataaggccaaggtttcctttg

SEQ ID NO: 165494 - DNA, 25 bp, Mus musculus
aagcatactgttgagcctgagaaat

SEQ ID NO: 165495 - DNA, 25 bp, Mus musculus
aagcatagcgggtttggcttgtgct

SEQ ID NO: 165496 - DNA, 25 bp, Mus musculus
aagcatcaagatgacttacaagatg

SEQ ID NO: 165497 - DNA, 25 bp, Mus musculus
aagcatcagaaaggcaacatgtcgg

SEQ ID NO: 165498 - DNA, 25 bp, Mus musculus
aagcatcagttcagaaaccaactta

SEQ ID NO: 165499 - DNA, 25 bp, Mus musculus
aagcatcatacagaccagagggatt

SEQ ID NO: 165500 - DNA, 25 bp, Mus musculus
aagcatccagagcaagaagagtatc

SEQ ID NO: 165501 - DNA, 25 bp, Mus musculus
aagcatccagggcttatcagagcaa

SEQ ID NO: 165502 - DNA, 25 bp, Mus musculus
aagcatcccaggctgcgagacaaaa

SEQ ID NO: 165503 - DNA, 25 bp, Mus musculus
aagcatcttctggtaaatccatttc

SEQ ID NO: 165504 - DNA, 25 bp, Mus musculus
aagcatctttcatgataaaggtgat

SEQ ID NO: 165505 - DNA, 25 bp, Mus musculus
aagcatgaagacgtggccattcgtg

SEQ ID NO: 165506 - DNA, 25 bp, Mus musculus
aagcatgacttaacctgtgtgaacg

SEQ ID NO: 165507 - DNA, 25 bp, Mus musculus
aagcatgagacacacgcgcttgttc

SEQ ID NO: 165508 - DNA, 25 bp, Mus musculus
aagcatgccaaggaggagtcagaca

SEQ ID NO: 165509 - DNA, 25 bp, Mus musculus
aagcatgccaaggaggtgagacgga

SEQ ID NO: 165510 - DNA, 25 bp, Mus musculus
aagcatgccaggcaagaaaaggaac

SEQ ID NO: 165511 - DNA, 25 bp, Mus musculus
aagcatgcggatccccggatccaaa

SEQ ID NO: 165512 - DNA, 25 bp, Mus musculus
aagcatgcggtttctgatgtctggt

SEQ ID NO: 165513 - DNA, 25 bp, Mus musculus
aagcatggaagaaaaagagagagag

SEQ ID NO: 165514 - DNA, 25 bp, Mus musculus
aagcatggaaggatttagacaagag

SEQ ID NO: 165515 - DNA, 25 bp, Mus musculus
aagcatggaaggtggaaaaaaccca

SEQ ID NO: 165516 - DNA, 25 bp, Mus musculus
aagcatggaccatggtggagtttgg

SEQ ID NO: 165517 - DNA, 25 bp, Mus musculus
aagcatggatgagttggcagagttg

SEQ ID NO: 165518 - DNA, 25 bp, Mus musculus
aagcatggccgaccgcattccagag

SEQ ID NO: 165519 - DNA, 25 bp, Mus musculus
aagcatgggaggaagggagatataa

SEQ ID NO: 165520 - DNA, 25 bp, Mus musculus
aagcatggtgaacgcttctagggac

SEQ ID NO: 165521 - DNA, 25 bp, Mus musculus
aagcatggtgaacgggacctattaa

SEQ ID NO: 165522 - DNA, 25 bp, Mus musculus
aagcatgtgaaagactggaagaagc

SEQ ID NO: 165523 - DNA, 25 bp, Mus musculus
aagcatgtgaaagccctctcaccag

SEQ ID NO: 165524 - DNA, 25 bp, Mus musculus
aagcatgtgtaggacccagccacct

SEQ ID NO: 165525 - DNA, 25 bp, Mus musculus
aagcatgtgtccatcctgtcctcag

SEQ ID NO: 165526 - DNA, 25 bp, Mus musculus
aagcattaaagcccagtgccccttc

SEQ ID NO: 165527 - DNA, 25 bp, Mus musculus
aagcattacaggaagggtctgcttg

SEQ ID NO: 165528 - DNA, 25 bp, Mus musculus
aagcattacaggaaggtgtcagaca

SEQ ID NO: 165529 - DNA, 25 bp, Mus musculus
aagcattagaagtcttcccagagtt

SEQ ID NO: 165530 - DNA, 25 bp, Mus musculus
aagcattagatatgactgaaatggc

SEQ ID NO: 165531 - DNA, 25 bp, Mus musculus
aagcattagatgaagaattcatcct

SEQ ID NO: 165532 - DNA, 25 bp, Mus musculus
aagcattagcagcattcacagctct

SEQ ID NO: 165533 - DNA, 25 bp, Mus musculus
aagcattagcagggttggtttcccc

SEQ ID NO: 165534 - DNA, 25 bp, Mus musculus
aagcattatgtctggatctcttaga

SEQ ID NO: 165535 - DNA, 25 bp, Mus musculus
aagcattcagctccctgccccccat

SEQ ID NO: 165536 - DNA, 25 bp, Mus musculus
aagcattccggagaaaacaacgggg

SEQ ID NO: 165537 - DNA, 25 bp, Mus musculus
aagcattccggctactcctggatgg

SEQ ID NO: 165538 - DNA, 25 bp, Mus musculus
aagcattctgggggtcaaccggatg

SEQ ID NO: 165539 - DNA, 25 bp, Mus musculus
aagcattgattaatggaccacagac

SEQ ID NO: 165540 - DNA, 25 bp, Mus musculus
aagcattgcaggaagaattctttca

SEQ ID NO: 165541 - DNA, 25 bp, Mus musculus
aagcattggtctcatctgccatggt

SEQ ID NO: 165542 - DNA, 25 bp, Mus musculus
aagcattggtctcatctgtctgcaa

SEQ ID NO: 165543 - DNA, 25 bp, Mus musculus
aagcattggtgatgttatctatgcg

SEQ ID NO: 165544 - DNA, 25 bp, Mus musculus
aagcatttaatgcctcctgcctgtc

SEQ ID NO: 165545 - DNA, 25 bp, Mus musculus
aagcatttagaatgcacaaaacaac

SEQ ID NO: 165546 - DNA, 25 bp, Mus musculus
aagcatttcaagacccactccctct

SEQ ID NO: 165547 - DNA, 25 bp, Mus musculus
aagcatttcaaggagaaatacccag

SEQ ID NO: 165548 - DNA, 25 bp, Mus musculus
aagcatttcaagggtctcatatacc

SEQ ID NO: 165549 - DNA, 25 bp, Mus musculus
aagcattttctagaaaatggaacta

SEQ ID NO: 165550 - DNA, 25 bp, Mus musculus
aagcattttctagatggaagctcta

SEQ ID NO: 165551 - DNA, 25 bp, Mus musculus
aagccaaaaagaagaagcacttaaa

SEQ ID NO: 165552 - DNA, 25 bp, Mus musculus
aagccaaaaagagcaagaagcggaa

SEQ ID NO: 165553 - DNA, 25 bp, Mus musculus
aagccaaaaggtgaaacctcaggac

SEQ ID NO: 165554 - DNA, 25 bp, Mus musculus
aagccaaagaaggctcggcgcatcc

SEQ ID NO: 165555 - DNA, 25 bp, Mus musculus
aagccaaagaagtatccgagttcca

SEQ ID NO: 165556 - DNA, 25 bp, Mus musculus
aagccaaaggtgtgtgccaaaacca

SEQ ID NO: 165557 - DNA, 25 bp, Mus musculus
aagccaactctcctctgctaagtat

SEQ ID NO: 165558 - DNA, 25 bp, Mus musculus
aagccaagagtgagagtggatcatg

SEQ ID NO: 165559 - DNA, 25 bp, Mus musculus
aagccaagcccatgtaaaacagact

SEQ ID NO: 165560 - DNA, 25 bp, Mus musculus
aagccaagctggagaaattttcctc

SEQ ID NO: 165561 - DNA, 25 bp, Mus musculus
aagccaagttcaagcggtatgaata

SEQ ID NO: 165562 - DNA, 25 bp, Mus musculus
aagccaatagtaggaattccaggca

SEQ ID NO: 165563 - DNA, 25 bp, Mus musculus
aagccaatgagagaggacacaatgt

SEQ ID NO: 165564 - DNA, 25 bp, Mus musculus
aagccacaagagataagatgaaaga

SEQ ID NO: 165565 - DNA, 25 bp, Mus musculus
aagccacaagtgcctccaaaaccat

SEQ ID NO: 165566 - DNA, 25 bp, Mus musculus
aagccacacaggttcctttggtttc

SEQ ID NO: 165567 - DNA, 25 bp, Mus musculus
aagccacagccaggatatccctgtg

SEQ ID NO: 165568 - DNA, 25 bp, Mus musculus
aagccaccaaaggagtaacctatct

SEQ ID NO: 165569 - DNA, 25 bp, Mus musculus
aagccaccaaaggttacagagaata

SEQ ID NO: 165570 - DNA, 25 bp, Mus musculus
aagccaccaagatcctgagacattt

SEQ ID NO: 165571 - DNA, 25 bp, Mus musculus
aagccacccgaatggctgttgatgg

SEQ ID NO: 165572 - DNA, 25 bp, Mus musculus
aagccacctccagtcgcagatatgg

SEQ ID NO: 165573 - DNA, 25 bp, Mus musculus
aagccaccttcagaatgaagaggaa

SEQ ID NO: 165574 - DNA, 25 bp, Mus musculus
aagccaccttcagtgattttatagg

SEQ ID NO: 165575 - DNA, 25 bp, Mus musculus
aagccacgagaggtgagggagttta

SEQ ID NO: 165576 - DNA, 25 bp, Mus musculus
aagccacgaggaaagcgtcatcatc

SEQ ID NO: 165577 - DNA, 25 bp, Mus musculus
aagccacgctatggacgcactgaca

SEQ ID NO: 165578 - DNA, 25 bp, Mus musculus
aagccacgctatgggattccaacct

SEQ ID NO: 165579 - DNA, 25 bp, Mus musculus
aagccacggatggaggaggagacaa

SEQ ID NO: 165580 - DNA, 25 bp, Mus musculus
aagccactctagcagtgttccgaat

SEQ ID NO: 165581 - DNA, 25 bp, Mus musculus
aagccactgaagactgagataccag

SEQ ID NO: 165582 - DNA, 25 bp, Mus musculus
aagccactgacgtggacgacaacct

SEQ ID NO: 165583 - DNA, 25 bp, Mus musculus
aagccactgatgcttctctgcgagg

SEQ ID NO: 165584 - DNA, 25 bp, Mus musculus
aagccactgcgtctcttggcctgtg

SEQ ID NO: 165585 - DNA, 25 bp, Mus musculus
aagccactggagaggaactgtccga

SEQ ID NO: 165586 - DNA, 25 bp, Mus musculus
aagccactgtcagaagagaaaactg

SEQ ID NO: 165587 - DNA, 25 bp, Mus musculus
aagccactgtcagagctaaacagaa

SEQ ID NO: 165588 - DNA, 25 bp, Mus musculus
aagccactttccaaggaatttgaag

SEQ ID NO: 165589 - DNA, 25 bp, Mus musculus
aagccagaaaaaaaatcagttcgag

SEQ ID NO: 165590 - DNA, 25 bp, Mus musculus
aagccagaaaatcactgtgagcctt

SEQ ID NO: 165591 - DNA, 25 bp, Mus musculus
aagccagaaatggggctggtgtcat

SEQ ID NO: 165592 - DNA, 25 bp, Mus musculus
aagccagaacagcaccgggttgtag

SEQ ID NO: 165593 - DNA, 25 bp, Mus musculus
aagccagacagccccaggatcctct

SEQ ID NO: 165594 - DNA, 25 bp, Mus musculus
aagccagacagggttgccatacccc

SEQ ID NO: 165595 - DNA, 25 bp, Mus musculus
aagccagaccaggatcaagttactg

SEQ ID NO: 165596 - DNA, 25 bp, Mus musculus
aagccagaccagttccaagaattac

SEQ ID NO: 165597 - DNA, 25 bp, Mus musculus
aagccagaccgagatgccttggatg

SEQ ID NO: 165598 - DNA, 25 bp, Mus musculus
aagccagaccgaggatcaaccattc

SEQ ID NO: 165599 - DNA, 25 bp, Mus musculus
aagccagagaaggaaaaggaaacac

SEQ ID NO: 165600 - DNA, 25 bp, Mus musculus
aagccagagaagtgtgtgacaactt

SEQ ID NO: 165601 - DNA, 25 bp, Mus musculus
aagccagagagatgggtgtgattgc

SEQ ID NO: 165602 - DNA, 25 bp, Mus musculus
aagccagagagccctggcacaaaaa

SEQ ID NO: 165603 - DNA, 25 bp, Mus musculus
aagccagagagggtctgcgagcttt

SEQ ID NO: 165604 - DNA, 25 bp, Mus musculus
aagccagagagtgctcaacctcaca

SEQ ID NO: 165605 - DNA, 25 bp, Mus musculus
aagccagagggagccgtgtgcccag

SEQ ID NO: 165606 - DNA, 25 bp, Mus musculus
aagccagagggaggcttcagttgtg

SEQ ID NO: 165607 - DNA, 25 bp, Mus musculus
aagccagagtacgggcgtcctagtg

SEQ ID NO: 165608 - DNA, 25 bp, Mus musculus
aagccagataaaggatgccccaggt

SEQ ID NO: 165609 - DNA, 25 bp, Mus musculus
aagccagatcgacagcaaagagccc

SEQ ID NO: 165610 - DNA, 25 bp, Mus musculus
aagccagatcgccctacatgaagat

SEQ ID NO: 165611 - DNA, 25 bp, Mus musculus
aagccagcagaaaccacagatgaca

SEQ ID NO: 165612 - DNA, 25 bp, Mus musculus
aagccagcaggcctcagggctggct

SEQ ID NO: 165613 - DNA, 25 bp, Mus musculus
aagccagcagggcctgggctggtgc

SEQ ID NO: 165614 - DNA, 25 bp, Mus musculus
aagccagcagggctgtgggacatgt

SEQ ID NO: 165615 - DNA, 25 bp, Mus musculus
aagccagccacaggcccaggccttg

SEQ ID NO: 165616 - DNA, 25 bp, Mus musculus
aagccagcctgagcgagccagagga

SEQ ID NO: 165617 - DNA, 25 bp, Mus musculus
aagccagcctggagccatcgtggct

SEQ ID NO: 165618 - DNA, 25 bp, Mus musculus
aagccagcctgtccagcaccatggc

SEQ ID NO: 165619 - DNA, 25 bp, Mus musculus
aagccagcggaaatggtccttctcg

SEQ ID NO: 165620 - DNA, 25 bp, Mus musculus
aagccagcgtggggaaacctgctcg

SEQ ID NO: 165621 - DNA, 25 bp, Mus musculus
aagccagcgtggggtctgagatccc

SEQ ID NO: 165622 - DNA, 25 bp, Mus musculus
aagccagctaaaggtatgctaacag

SEQ ID NO: 165623 - DNA, 25 bp, Mus musculus
aagccaggaacctctcagtcaacag

SEQ ID NO: 165624 - DNA, 25 bp, Mus musculus
aagccaggaacttctcagccagcca

SEQ ID NO: 165625 - DNA, 25 bp, Mus musculus
aagccaggagattagagtgggcctg

SEQ ID NO: 165626 - DNA, 25 bp, Mus musculus
aagccaggagtgggcctgaggcagg

SEQ ID NO: 165627 - DNA, 25 bp, Mus musculus
aagccaggccagcagccctagctag

SEQ ID NO: 165628 - DNA, 25 bp, Mus musculus
aagccaggccagcagcttcaccaat

SEQ ID NO: 165629 - DNA, 25 bp, Mus musculus
aagccagggagtgtggtcttctcag

SEQ ID NO: 165630 - DNA, 25 bp, Mus musculus
aagccagggcggttaaactcacttt

SEQ ID NO: 165631 - DNA, 25 bp, Mus musculus
aagccaggtgcaccagcgagcctgt

SEQ ID NO: 165632 - DNA, 25 bp, Mus musculus
aagccagtaaacaaggccagggcca

SEQ ID NO: 165633 - DNA, 25 bp, Mus musculus
aagccagtcaatcaggaatgtcaag

SEQ ID NO: 165634 - DNA, 25 bp, Mus musculus
aagccagtctggagttggtgtggac

SEQ ID NO: 165635 - DNA, 25 bp, Mus musculus
aagccagtgggagtgtgcagccaca

SEQ ID NO: 165636 - DNA, 25 bp, Mus musculus
aagccagtgtgaataaatttgtgga

SEQ ID NO: 165637 - DNA, 25 bp, Mus musculus
aagccagtgtgttaagccaaattta

SEQ ID NO: 165638 - DNA, 25 bp, Mus musculus
aagccagtgtgttaagtattttgga

SEQ ID NO: 165639 - DNA, 25 bp, Mus musculus
aagccataaagaggaaaccactgag

SEQ ID NO: 165640 - DNA, 25 bp, Mus musculus
aagccataaagaggaaccaggccat

SEQ ID NO: 165641 - DNA, 25 bp, Mus musculus
aagccataccggcgaacgcccgttc

SEQ ID NO: 165642 - DNA, 25 bp, Mus musculus
aagccatacgaattagtcctacatt

SEQ ID NO: 165643 - DNA, 25 bp, Mus musculus
aagccatactatgatccctcaagaa

SEQ ID NO: 165644 - DNA, 25 bp, Mus musculus
aagccatcaacgacctagacagaga

SEQ ID NO: 165645 - DNA, 25 bp, Mus musculus
aagccatcaagttgcctgcaggagg

SEQ ID NO: 165646 - DNA, 25 bp, Mus musculus
aagccatcagaaggagtgaaaaggc

SEQ ID NO: 165647 - DNA, 25 bp, Mus musculus
aagccatcagacatattggctggat

SEQ ID NO: 165648 - DNA, 25 bp, Mus musculus
aagccatcaggaaatcccttgagga

SEQ ID NO: 165649 - DNA, 25 bp, Mus musculus
aagccatcaggaagggatgcggtaa

SEQ ID NO: 165650 - DNA, 25 bp, Mus musculus
aagccatcaggtccatggagagact

SEQ ID NO: 165651 - DNA, 25 bp, Mus musculus
aagccatcgatgcagtgaagcctgg

SEQ ID NO: 165652 - DNA, 25 bp, Mus musculus
aagccatctaagcccagagtgacct

SEQ ID NO: 165653 - DNA, 25 bp, Mus musculus
aagccatgaaaggaacagagtgggt

SEQ ID NO: 165654 - DNA, 25 bp, Mus musculus
aagccatgaccacagctgttggtct

SEQ ID NO: 165655 - DNA, 25 bp, Mus musculus
aagccatgaggcaagaaactacatt

SEQ ID NO: 165656 - DNA, 25 bp, Mus musculus
aagccatgatgaacagctcatgcgt

SEQ ID NO: 165657 - DNA, 25 bp, Mus musculus
aagccatgcattggaatttgaactc

SEQ ID NO: 165658 - DNA, 25 bp, Mus musculus
aagccatgctctctggtcttgtgca

SEQ ID NO: 165659 - DNA, 25 bp, Mus musculus
aagccatgctgcaggtgctgggccc

SEQ ID NO: 165660 - DNA, 25 bp, Mus musculus
aagccatgctggccaagacggaaga

SEQ ID NO: 165661 - DNA, 25 bp, Mus musculus
aagccattacaatgtgagatctgtg

SEQ ID NO: 165662 - DNA, 25 bp, Mus musculus
aagccattgctgcatgcctgtggtc

SEQ ID NO: 165663 - DNA, 25 bp, Mus musculus
aagccattgcttttgggactcgctt

SEQ ID NO: 165664 - DNA, 25 bp, Mus musculus
aagccatttacagggggtgatgtgc

SEQ ID NO: 165665 - DNA, 25 bp, Mus musculus
aagccatttacagttgtaacagttg

SEQ ID NO: 165666 - DNA, 25 bp, Mus musculus
aagcccaacgcaaatctggtgcaat

SEQ ID NO: 165667 - DNA, 25 bp, Mus musculus
aagcccaagtatgatcagggagtgg

SEQ ID NO: 165668 - DNA, 25 bp, Mus musculus
aagcccacagaaacgcatcccactg

SEQ ID NO: 165669 - DNA, 25 bp, Mus musculus
aagcccacagtccatggagacaact

SEQ ID NO: 165670 - DNA, 25 bp, Mus musculus
aagcccaccaggccatcatgattgg

SEQ ID NO: 165671 - DNA, 25 bp, Mus musculus
aagcccacctatccacccatgaacc

SEQ ID NO: 165672 - DNA, 25 bp, Mus musculus
aagcccactcagtgaatggcattac

SEQ ID NO: 165673 - DNA, 25 bp, Mus musculus
aagcccagaaagaactagaagaaca

SEQ ID NO: 165674 - DNA, 25 bp, Mus musculus
aagcccagaaaggatgtataataaa

SEQ ID NO: 165675 - DNA, 25 bp, Mus musculus
aagcccagaagcacagcaagaaggc

SEQ ID NO: 165676 - DNA, 25 bp, Mus musculus
aagcccagaagccctacccatgtct

SEQ ID NO: 165677 - DNA, 25 bp, Mus musculus
aagcccagaagctgtgattggactg

SEQ ID NO: 165678 - DNA, 25 bp, Mus musculus
aagcccagacgcacgaagctctttg

SEQ ID NO: 165679 - DNA, 25 bp, Mus musculus
aagcccagcaagattctgtgatgag

SEQ ID NO: 165680 - DNA, 25 bp, Mus musculus
aagcccagcaaggaccgccttcaac

SEQ ID NO: 165681 - DNA, 25 bp, Mus musculus
aagcccagcacacaggaggtctggc

SEQ ID NO: 165682 - DNA, 25 bp, Mus musculus
aagcccagcagatttggcctggcac

SEQ ID NO: 165683 - DNA, 25 bp, Mus musculus
aagcccagcagctacattttcttaa

SEQ ID NO: 165684 - DNA, 25 bp, Mus musculus
aagcccagcagctctactgacagtc

SEQ ID NO: 165685 - DNA, 25 bp, Mus musculus
aagcccagcaggaggagactgcagt

SEQ ID NO: 165686 - DNA, 25 bp, Mus musculus
aagcccagcaggccagtgtgctttc

SEQ ID NO: 165687 - DNA, 25 bp, Mus musculus
aagcccagcagggcagccaatgaag

SEQ ID NO: 165688 - DNA, 25 bp, Mus musculus
aagcccagcagtattcggaggccct

SEQ ID NO: 165689 - DNA, 25 bp, Mus musculus
aagcccagctactaaaggagatcca

SEQ ID NO: 165690 - DNA, 25 bp, Mus musculus
aagcccaggtacaagatcaagtctc

SEQ ID NO: 165691 - DNA, 25 bp, Mus musculus
aagcccaggtcaaactctggttccc

SEQ ID NO: 165692 - DNA, 25 bp, Mus musculus
aagcccaggtccatggtaccaacca

SEQ ID NO: 165693 - DNA, 25 bp, Mus musculus
aagcccaggtgttcatgaagcctgg

SEQ ID NO: 165694 - DNA, 25 bp, Mus musculus
aagcccaggtttaattcagaagtga

SEQ ID NO: 165695 - DNA, 25 bp, Mus musculus
aagcccataggaacctggctgctgt

SEQ ID NO: 165696 - DNA, 25 bp, Mus musculus
aagcccataggcctggtcagaaaga

SEQ ID NO: 165697 - DNA, 25 bp, Mus musculus
aagcccataggttacaaggacagca

SEQ ID NO: 165698 - DNA, 25 bp, Mus musculus
aagcccatcagaaaatcaccgtgct

SEQ ID NO: 165699 - DNA, 25 bp, Mus musculus
aagcccatctgggcttttctccaga

SEQ ID NO: 165700 - DNA, 25 bp, Mus musculus
aagcccattatctccagcctgctat

SEQ ID NO: 165701 - DNA, 25 bp, Mus musculus
aagcccattcaaccatggatgtgta

SEQ ID NO: 165702 - DNA, 25 bp, Mus musculus
aagccccaactgaggaatggataca

SEQ ID NO: 165703 - DNA, 25 bp, Mus musculus
aagccccaactgtggaatggataca

SEQ ID NO: 165704 - DNA, 25 bp, Mus musculus
aagccccaagaggatgattattgga

SEQ ID NO: 165705 - DNA, 25 bp, Mus musculus
aagccccaggagccctcccaggccc

SEQ ID NO: 165706 - DNA, 25 bp, Mus musculus
aagccccagggcaaggattctgtac

SEQ ID NO: 165707 - DNA, 25 bp, Mus musculus
aagccccagggcaaggtggctgcct

SEQ ID NO: 165708 - DNA, 25 bp, Mus musculus
aagcccccaaaggttgctttcacta

SEQ ID NO: 165709 - DNA, 25 bp, Mus musculus
aagcccccaagttcctggccttcac

SEQ ID NO: 165710 - DNA, 25 bp, Mus musculus
aagcccccacagctccttcccagct

SEQ ID NO: 165711 - DNA, 25 bp, Mus musculus
aagcccccacctagatcaagcactg

SEQ ID NO: 165712 - DNA, 25 bp, Mus musculus
aagcccccacctgaagaaaatggag

SEQ ID NO: 165713 - DNA, 25 bp, Mus musculus
aagccccccaaggaggagtcaggcc

SEQ ID NO: 165714 - DNA, 25 bp, Mus musculus
aagccccccttttctgaatgaagat

SEQ ID NO: 165715 - DNA, 25 bp, Mus musculus
aagcccccgtccagacactactttg

SEQ ID NO: 165716 - DNA, 25 bp, Mus musculus
aagccccggagaagagccctaggcg

SEQ ID NO: 165717 - DNA, 25 bp, Mus musculus
aagccccggagaaggagtgagagag

SEQ ID NO: 165718 - DNA, 25 bp, Mus musculus
aagccccggatgtggatggaaaagc

SEQ ID NO: 165719 - DNA, 25 bp, Mus musculus
aagccccggatgtggttgccaaaac

SEQ ID NO: 165720 - DNA, 25 bp, Mus musculus
aagcccctatcccaggaatttgaag

SEQ ID NO: 165721 - DNA, 25 bp, Mus musculus
aagcccctccagcaggaagaactag

SEQ ID NO: 165722 - DNA, 25 bp, Mus musculus
aagcccctctctcaggaatttgaag

SEQ ID NO: 165723 - DNA, 25 bp, Mus musculus
aagcccctggggtgtccgatccgta

SEQ ID NO: 165724 - DNA, 25 bp, Mus musculus
aagcccgagcaggacttggatgttg

SEQ ID NO: 165725 - DNA, 25 bp, Mus musculus
aagcccgaggccagagcatcccagc

SEQ ID NO: 165726 - DNA, 25 bp, Mus musculus
aagcccgaggtctcctctgatgaag

SEQ ID NO: 165727 - DNA, 25 bp, Mus musculus
aagcccgcaaaagctccctccaaca

SEQ ID NO: 165728 - DNA, 25 bp, Mus musculus
aagcccgcaggacagagagtcgata

SEQ ID NO: 165729 - DNA, 25 bp, Mus musculus
aagcccggagaagatggtgaacctg

SEQ ID NO: 165730 - DNA, 25 bp, Mus musculus
aagcccggagggatccttttgtggc

SEQ ID NO: 165731 - DNA, 25 bp, Mus musculus
aagcccggcctcgggtgtttctgtt

SEQ ID NO: 165732 - DNA, 25 bp, Mus musculus
aagcccgggtaacatccggatatgt

SEQ ID NO: 165733 - DNA, 25 bp, Mus musculus
aagccctaaatgatggtgagctcca

SEQ ID NO: 165734 - DNA, 25 bp, Mus musculus
aagccctacactattaggaaacctg

SEQ ID NO: 165735 - DNA, 25 bp, Mus musculus
aagccctacagaaacctgtgggaaa

SEQ ID NO: 165736 - DNA, 25 bp, Mus musculus
aagccctaccaggggtttctctgtg

SEQ ID NO: 165737 - DNA, 25 bp, Mus musculus
aagccctaccagggtgtgggaacaa

SEQ ID NO: 165738 - DNA, 25 bp, Mus musculus
aagccctagggcagaaaacaaaaat

SEQ ID NO: 165739 - DNA, 25 bp, Mus musculus
aagccctatttcaggaaactcccat

SEQ ID NO: 165740 - DNA, 25 bp, Mus musculus
aagccctatttcaggttgtctactt

SEQ ID NO: 165741 - DNA, 25 bp, Mus musculus
aagccctccaagaaagataaactca

SEQ ID NO: 165742 - DNA, 25 bp, Mus musculus
aagccctcccaatgattttcagaat

SEQ ID NO: 165743 - DNA, 25 bp, Mus musculus
aagccctccgtctggctggttcttc

SEQ ID NO: 165744 - DNA, 25 bp, Mus musculus
aagccctcgaaggttgcagctccac

SEQ ID NO: 165745 - DNA, 25 bp, Mus musculus
aagccctctacagtttcaggcctgg

SEQ ID NO: 165746 - DNA, 25 bp, Mus musculus
aagccctgaactatcctccatgtga

SEQ ID NO: 165747 - DNA, 25 bp, Mus musculus
aagccctgaactgtactctctctat

SEQ ID NO: 165748 - DNA, 25 bp, Mus musculus
aagccctgaaggcactaagtgaccg

SEQ ID NO: 165749 - DNA, 25 bp, Mus musculus
aagccctgaatgttctccctcctga

SEQ ID NO: 165750 - DNA, 25 bp, Mus musculus
aagccctgaccacagactactggtg

SEQ ID NO: 165751 - DNA, 25 bp, Mus musculus
aagccctgaggtcacttggtcgctc

SEQ ID NO: 165752 - DNA, 25 bp, Mus musculus
aagccctgaggtgtggttcccagga

SEQ ID NO: 165753 - DNA, 25 bp, Mus musculus
aagccctggaggcactggttccagt

SEQ ID NO: 165754 - DNA, 25 bp, Mus musculus
aagccctggatccaggtgaaccttc

SEQ ID NO: 165755 - DNA, 25 bp, Mus musculus
aagccctggcacacgccccaaggaa

SEQ ID NO: 165756 - DNA, 25 bp, Mus musculus
aagccctggctgggggatgggctct

SEQ ID NO: 165757 - DNA, 25 bp, Mus musculus
aagccctgggcttgaagaaccagta

SEQ ID NO: 165758 - DNA, 25 bp, Mus musculus
aagccctgtcagagtttgtagacac

SEQ ID NO: 165759 - DNA, 25 bp, Mus musculus
aagccctgtcagtgtttgtagacac

SEQ ID NO: 165760 - DNA, 25 bp, Mus musculus
aagccctgtgacgaatggcacacga

SEQ ID NO: 165761 - DNA, 25 bp, Mus musculus
aagccctgtgagcactctgactctg

SEQ ID NO: 165762 - DNA, 25 bp, Mus musculus
aagccctgtgaggacctggaacgag

SEQ ID NO: 165763 - DNA, 25 bp, Mus musculus
aagccctgtgaggttgaacttccgg

SEQ ID NO: 165764 - DNA, 25 bp, Mus musculus
aagcccttaccagcccagctttgcc

SEQ ID NO: 165765 - DNA, 25 bp, Mus musculus
aagcccttcaagagcttctgcagtt

SEQ ID NO: 165766 - DNA, 25 bp, Mus musculus
aagcccttcaaggatatggactatt

SEQ ID NO: 165767 - DNA, 25 bp, Mus musculus
aagcccttcacagctgacattatct

SEQ ID NO: 165768 - DNA, 25 bp, Mus musculus
aagcccttcacagtggagattgtgg

SEQ ID NO: 165769 - DNA, 25 bp, Mus musculus
aagccctttatctgacttgttggca

SEQ ID NO: 165770 - DNA, 25 bp, Mus musculus
aagccctttatctgtgaggtctgcc

SEQ ID NO: 165771 - DNA, 25 bp, Mus musculus
aagccgaaagcgaatattaattaac

SEQ ID NO: 165772 - DNA, 25 bp, Mus musculus
aagccgaagagtgtaggcttgtgac

SEQ ID NO: 165773 - DNA, 25 bp, Mus musculus
aagccgactcagatccgtgatgagt

SEQ ID NO: 165774 - DNA, 25 bp, Mus musculus
aagccgactggcagcaccgagtgcc

SEQ ID NO: 165775 - DNA, 25 bp, Mus musculus
aagccgaggtcacacatgaaattat

SEQ ID NO: 165776 - DNA, 25 bp, Mus musculus
aagccgaggtcacagatgaaattat

SEQ ID NO: 165777 - DNA, 25 bp, Mus musculus
aagccgattgccgacgtgttcttaa

SEQ ID NO: 165778 - DNA, 25 bp, Mus musculus
aagccgcaaagaagttccaccaggt

SEQ ID NO: 165779 - DNA, 25 bp, Mus musculus
aagccgcagaccggactccagattc

SEQ ID NO: 165780 - DNA, 25 bp, Mus musculus
aagccgccagggaaggctccccaga

SEQ ID NO: 165781 - DNA, 25 bp, Mus musculus
aagccgccattaaggtgtctagtca

SEQ ID NO: 165782 - DNA, 25 bp, Mus musculus
aagccgcgacatggcctcagtgagc

SEQ ID NO: 165783 - DNA, 25 bp, Mus musculus
aagccgcgccatggatttggtgagc

SEQ ID NO: 165784 - DNA, 25 bp, Mus musculus
aagccggaaggagtcccagccaagc

SEQ ID NO: 165785 - DNA, 25 bp, Mus musculus
aagccggataatgacggcgtggagc

SEQ ID NO: 165786 - DNA, 25 bp, Mus musculus
aagccggataatgtgctagaatttg

SEQ ID NO: 165787 - DNA, 25 bp, Mus musculus
aagccggcatcagctgatttccaaa

SEQ ID NO: 165788 - DNA, 25 bp, Mus musculus
aagccggcctcggtgtggtacatgg

SEQ ID NO: 165789 - DNA, 25 bp, Mus musculus
aagccgggaagcctatcctctactc

SEQ ID NO: 165790 - DNA, 25 bp, Mus musculus
aagccgggtactggaaattggcgag

SEQ ID NO: 165791 - DNA, 25 bp, Mus musculus
aagccggtctccagcttcctgcgct

SEQ ID NO: 165792 - DNA, 25 bp, Mus musculus
aagccggtctccagtgttcacaccg

SEQ ID NO: 165793 - DNA, 25 bp, Mus musculus
aagccggtgccgggctttcaggtag

SEQ ID NO: 165794 - DNA, 25 bp, Mus musculus
aagccggtggcccagcctgcagcat

SEQ ID NO: 165795 - DNA, 25 bp, Mus musculus
aagccgtaaccgagccccaatccat

SEQ ID NO: 165796 - DNA, 25 bp, Mus musculus
aagccgtacagtaagcactaccccg

SEQ ID NO: 165797 - DNA, 25 bp, Mus musculus
aagccgtcaccccaaaattttgtga

SEQ ID NO: 165798 - DNA, 25 bp, Mus musculus
aagccgtcagacaaggaggaaggct

SEQ ID NO: 165799 - DNA, 25 bp, Mus musculus
aagccgtcagacaaggtaaggaatt

SEQ ID NO: 165800 - DNA, 25 bp, Mus musculus
aagccgtgcagagcaagccatacag

SEQ ID NO: 165801 - DNA, 25 bp, Mus musculus
aagccgtgcagagcatctactgccg

SEQ ID NO: 165802 - DNA, 25 bp, Mus musculus
aagcctaaaaagacggcacaaacac

SEQ ID NO: 165803 - DNA, 25 bp, Mus musculus
aagcctaaaaaggtggtgctgtgat

SEQ ID NO: 165804 - DNA, 25 bp, Mus musculus
aagcctaagaaacgagcaaaaaatt

SEQ ID NO: 165805 - DNA, 25 bp, Mus musculus
aagcctaagaaggcaccgacagccc

SEQ ID NO: 165806 - DNA, 25 bp, Mus musculus
aagcctaagcctgatttctttattc

SEQ ID NO: 165807 - DNA, 25 bp, Mus musculus
aagcctaagccttgctcagctcctt

SEQ ID NO: 165808 - DNA, 25 bp, Mus musculus
aagcctaatatggcggtgtggctac

SEQ ID NO: 165809 - DNA, 25 bp, Mus musculus
aagcctaatgtaaaggggctctttc

SEQ ID NO: 165810 - DNA, 25 bp, Mus musculus
aagcctacaaagaggcctttgccag

SEQ ID NO: 165811 - DNA, 25 bp, Mus musculus
aagcctacaatctgaatgaagaaag

SEQ ID NO: 165812 - DNA, 25 bp, Mus musculus
aagcctacagtctgaatgaagaaag

SEQ ID NO: 165813 - DNA, 25 bp, Mus musculus
aagcctaccagaaagccttgtgcct

SEQ ID NO: 165814 - DNA, 25 bp, Mus musculus
aagcctaccagaaagtttgcttacc

SEQ ID NO: 165815 - DNA, 25 bp, Mus musculus
aagcctacccatctgacagatcaca

SEQ ID NO: 165816 - DNA, 25 bp, Mus musculus
aagcctactgtttacagtacagcaa

SEQ ID NO: 165817 - DNA, 25 bp, Mus musculus
aagcctagggagccgtgtggagcaa

SEQ ID NO: 165818 - DNA, 25 bp, Mus musculus
aagcctatactacctacaataccct

SEQ ID NO: 165819 - DNA, 25 bp, Mus musculus
aagcctatattggtgctggccaaca

SEQ ID NO: 165820 - DNA, 25 bp, Mus musculus
aagcctatccagagaaccattctga

SEQ ID NO: 165821 - DNA, 25 bp, Mus musculus
aagcctatggagtggcaaaaactac

SEQ ID NO: 165822 - DNA, 25 bp, Mus musculus
aagcctatggagtgttggcagatat

SEQ ID NO: 165823 - DNA, 25 bp, Mus musculus
aagcctcaagacgaaagtaggtggg

SEQ ID NO: 165824 - DNA, 25 bp, Mus musculus
aagcctcactgaaagctgggaagtc

SEQ ID NO: 165825 - DNA, 25 bp, Mus musculus
aagcctcagaaggatgcgggctcct

SEQ ID NO: 165826 - DNA, 25 bp, Mus musculus
aagcctcagcagggatcacatgcag

SEQ ID NO: 165827 - DNA, 25 bp, Mus musculus
aagcctcatcaagagggctgggtca

SEQ ID NO: 165828 - DNA, 25 bp, Mus musculus
aagcctcatcggaaatttgtatgcc

SEQ ID NO: 165829 - DNA, 25 bp, Mus musculus
aagcctccaagtatgagaaagagct

SEQ ID NO: 165830 - DNA, 25 bp, Mus musculus
aagcctccagaaatcgacatcacct

SEQ ID NO: 165831 - DNA, 25 bp, Mus musculus
aagcctccatcaggattccatggac

SEQ ID NO: 165832 - DNA, 25 bp, Mus musculus
aagcctccgctgggtggtaaatgca

SEQ ID NO: 165833 - DNA, 25 bp, Mus musculus
aagcctcctaggcacccgagggact

SEQ ID NO: 165834 - DNA, 25 bp, Mus musculus
aagcctcctcttgtgatgaagctca

SEQ ID NO: 165835 - DNA, 25 bp, Mus musculus
aagcctcctgctcctgagtcagtgg

SEQ ID NO: 165836 - DNA, 25 bp, Mus musculus
aagcctcgaaacagaggcgctccag

SEQ ID NO: 165837 - DNA, 25 bp, Mus musculus
aagcctcgaaacatgagcatgccca

SEQ ID NO: 165838 - DNA, 25 bp, Mus musculus
aagcctcgcaaactatttcaatgga

SEQ ID NO: 165839 - DNA, 25 bp, Mus musculus
aagcctctccaaggtggcccagctg

SEQ ID NO: 165840 - DNA, 25 bp, Mus musculus
aagcctctctggaactgaaaagctc

SEQ ID NO: 165841 - DNA, 25 bp, Mus musculus
aagcctctctggagtccatgtatct

SEQ ID NO: 165842 - DNA, 25 bp, Mus musculus
aagcctctgaactggaaatcccacc

SEQ ID NO: 165843 - DNA, 25 bp, Mus musculus
aagcctcttgctcagccacagaaca

SEQ ID NO: 165844 - DNA, 25 bp, Mus musculus
aagcctcttgctcagggtcctctta

SEQ ID NO: 165845 - DNA, 25 bp, Mus musculus
aagcctgaaaagatcccaccaaata

SEQ ID NO: 165846 - DNA, 25 bp, Mus musculus
aagcctgaacctggctgcttttgct

SEQ ID NO: 165847 - DNA, 25 bp, Mus musculus
aagcctgaaggtctccaccagctcc

SEQ ID NO: 165848 - DNA, 25 bp, Mus musculus
aagcctgacgaggggtctccgggca

SEQ ID NO: 165849 - DNA, 25 bp, Mus musculus
aagcctgagagtgaatgggcaagag

SEQ ID NO: 165850 - DNA, 25 bp, Mus musculus
aagcctgagagtggtaatcttttgg

SEQ ID NO: 165851 - DNA, 25 bp, Mus musculus
aagcctgagcctgaagagacttgct

SEQ ID NO: 165852 - DNA, 25 bp, Mus musculus
aagcctgagtgaggatcatggctgc

SEQ ID NO: 165853 - DNA, 25 bp, Mus musculus
aagcctgcaaaaggaggtgttcctg

SEQ ID NO: 165854 - DNA, 25 bp, Mus musculus
aagcctgcatcaggtcctagaccaa

SEQ ID NO: 165855 - DNA, 25 bp, Mus musculus
aagcctgccaagaccctaccactga

SEQ ID NO: 165856 - DNA, 25 bp, Mus musculus
aagcctgccaagttctggaaattgg

SEQ ID NO: 165857 - DNA, 25 bp, Mus musculus
aagcctgcggggacttgactgcgtt

SEQ ID NO: 165858 - DNA, 25 bp, Mus musculus
aagcctgctaacaggtgatattttt

SEQ ID NO: 165859 - DNA, 25 bp, Mus musculus
aagcctgctggtcctacagtggagc

SEQ ID NO: 165860 - DNA, 25 bp, Mus musculus
aagcctggaggttcatgtctcaact

SEQ ID NO: 165861 - DNA, 25 bp, Mus musculus
aagcctggagttatgcctcttgact

SEQ ID NO: 165862 - DNA, 25 bp, Mus musculus
aagcctggcaagggctactgacagt

SEQ ID NO: 165863 - DNA, 25 bp, Mus musculus
aagcctggcaagtcacgtgacttct

SEQ ID NO: 165864 - DNA, 25 bp, Mus musculus
aagcctggcagcaaccttagtgtcc

SEQ ID NO: 165865 - DNA, 25 bp, Mus musculus
aagcctggcagtgtcagcagctatg

SEQ ID NO: 165866 - DNA, 25 bp, Mus musculus
aagcctggccctaagggcaactccg

SEQ ID NO: 165867 - DNA, 25 bp, Mus musculus
aagcctgggagcgagttaagagaaa

SEQ ID NO: 165868 - DNA, 25 bp, Mus musculus
aagcctgggctgagatgaggtgcca

SEQ ID NO: 165869 - DNA, 25 bp, Mus musculus
aagcctggggatggtgtgaccccac

SEQ ID NO: 165870 - DNA, 25 bp, Mus musculus
aagcctggtgacaagaagactagca

SEQ ID NO: 165871 - DNA, 25 bp, Mus musculus
aagcctggtggacccatggatgaag

SEQ ID NO: 165872 - DNA, 25 bp, Mus musculus
aagcctgtcgcacgagtctgagatt

SEQ ID NO: 165873 - DNA, 25 bp, Mus musculus
aagcctgtcggggtgaatcggcact

SEQ ID NO: 165874 - DNA, 25 bp, Mus musculus
aagcctgtgagcaaaaacctgtgct

SEQ ID NO: 165875 - DNA, 25 bp, Mus musculus
aagcctgtgagcaaagaggcaagag

SEQ ID NO: 165876 - DNA, 25 bp, Mus musculus
aagcctgttcctctgaaaaggaaaa

SEQ ID NO: 165877 - DNA, 25 bp, Mus musculus
aagccttaaattgggtgcttccaat

SEQ ID NO: 165878 - DNA, 25 bp, Mus musculus
aagccttaaattggttctactagtg

SEQ ID NO: 165879 - DNA, 25 bp, Mus musculus
aagccttagaggacgtagagatttt

SEQ ID NO: 165880 - DNA, 25 bp, Mus musculus
aagccttattccagaactttgtgcc

SEQ ID NO: 165881 - DNA, 25 bp, Mus musculus
aagccttcaaggcgccccccacagg

SEQ ID NO: 165882 - DNA, 25 bp, Mus musculus
aagccttcaaggtgaagtacatgga

SEQ ID NO: 165883 - DNA, 25 bp, Mus musculus
aagccttcacatggtctcttcagat

SEQ ID NO: 165884 - DNA, 25 bp, Mus musculus
aagccttcagaatctgggatactaa

SEQ ID NO: 165885 - DNA, 25 bp, Mus musculus
aagccttcagacacctagatgttca

SEQ ID NO: 165886 - DNA, 25 bp, Mus musculus
aagccttcattcaacgtgatgaaag

SEQ ID NO: 165887 - DNA, 25 bp, Mus musculus
aagccttcattcaagggttttatgg

SEQ ID NO: 165888 - DNA, 25 bp, Mus musculus
aagccttcctgtcagtgctctggat

SEQ ID NO: 165889 - DNA, 25 bp, Mus musculus
aagccttcgataccgacatccatgc

SEQ ID NO: 165890 - DNA, 25 bp, Mus musculus
aagccttctaagctacctgaaccag

SEQ ID NO: 165891 - DNA, 25 bp, Mus musculus
aagccttctcaggccagattttagc

SEQ ID NO: 165892 - DNA, 25 bp, Mus musculus
aagccttgataggaccttcgagaag

SEQ ID NO: 165893 - DNA, 25 bp, Mus musculus
aagccttgataggagctgtttactt

SEQ ID NO: 165894 - DNA, 25 bp, Mus musculus
aagccttgcatagtcccagaagtat

SEQ ID NO: 165895 - DNA, 25 bp, Mus musculus
aagccttgctgattttcagaaagaa

SEQ ID NO: 165896 - DNA, 25 bp, Mus musculus
aagccttggagaaaacagagaaaca

SEQ ID NO: 165897 - DNA, 25 bp, Mus musculus
aagccttggtccggagaaacattca

SEQ ID NO: 165898 - DNA, 25 bp, Mus musculus
aagccttgtacaaaggtctctggta

SEQ ID NO: 165899 - DNA, 25 bp, Mus musculus
aagccttgtacaaaggttggtgttc

SEQ ID NO: 165900 - DNA, 25 bp, Mus musculus
aagccttgtataaagtacactggac

SEQ ID NO: 165901 - DNA, 25 bp, Mus musculus
aagccttgttcaggacgcacccctc

SEQ ID NO: 165902 - DNA, 25 bp, Mus musculus
aagccttgttcagggggagctggtg

SEQ ID NO: 165903 - DNA, 25 bp, Mus musculus
aagcctttcaggatgaagaccttga

SEQ ID NO: 165904 - DNA, 25 bp, Mus musculus
aagcctttcaggtgcctctcccacc

SEQ ID NO: 165905 - DNA, 25 bp, Mus musculus
aagcctttccattgtaaatcttagt

SEQ ID NO: 165906 - DNA, 25 bp, Mus musculus
aagcctttgcaaaacatggcagaag

SEQ ID NO: 165907 - DNA, 25 bp, Mus musculus
aagcctttgcaaaagactggctgga

SEQ ID NO: 165908 - DNA, 25 bp, Mus musculus
aagcctttgcaaaagtgatctgcaa

SEQ ID NO: 165909 - DNA, 25 bp, Mus musculus
aagcctttgctgcccagtttgaagg

SEQ ID NO: 165910 - DNA, 25 bp, Mus musculus
aagcctttgctggggacacccagaa

SEQ ID NO: 165911 - DNA, 25 bp, Mus musculus
aagcgaactgacaagttggatggct

SEQ ID NO: 165912 - DNA, 25 bp, Mus musculus
aagcgaactgggttacattccgaaa

SEQ ID NO: 165913 - DNA, 25 bp, Mus musculus
aagcgaagaataggtgtgatgaatg

SEQ ID NO: 165914 - DNA, 25 bp, Mus musculus
aagcgaatcaaagagatggatctgt

SEQ ID NO: 165915 - DNA, 25 bp, Mus musculus
aagcgaatccccaggcacagaagga

SEQ ID NO: 165916 - DNA, 25 bp, Mus musculus
aagcgaatccccagtatgcagtgta

SEQ ID NO: 165917 - DNA, 25 bp, Mus musculus
aagcgaatccgaaatgaagcagatg

SEQ ID NO: 165918 - DNA, 25 bp, Mus musculus
aagcgaatccgtgaaatggccaaac

SEQ ID NO: 165919 - DNA, 25 bp, Mus musculus
aagcgaattgttgggatgattgcga

SEQ ID NO: 165920 - DNA, 25 bp, Mus musculus
aagcgacagaaagatgtccgacccc

SEQ ID NO: 165921 - DNA, 25 bp, Mus musculus
aagcgacatctcaggtgtcgttgac

SEQ ID NO: 165922 - DNA, 25 bp, Mus musculus
aagcgacatgcgtactgagcgcttt

SEQ ID NO: 165923 - DNA, 25 bp, Mus musculus
aagcgacatggtaagaatgattgat

SEQ ID NO: 165924 - DNA, 25 bp, Mus musculus
aagcgacccaagttgcatttaaata

SEQ ID NO: 165925 - DNA, 25 bp, Mus musculus
aagcgacccaagttgctggacaaat

SEQ ID NO: 165926 - DNA, 25 bp, Mus musculus
aagcgactccgattctgacagtgga

SEQ ID NO: 165927 - DNA, 25 bp, Mus musculus
aagcgagaagactgagaaaagcttg

SEQ ID NO: 165928 - DNA, 25 bp, Mus musculus
aagcgagaagagaaaaggaacaccg

SEQ ID NO: 165929 - DNA, 25 bp, Mus musculus
aagcgagacagggactctgatggtt

SEQ ID NO: 165930 - DNA, 25 bp, Mus musculus
aagcgagcactcaggagttttggga

SEQ ID NO: 165931 - DNA, 25 bp, Mus musculus
aagcgaggacgggctgtccttgttg

SEQ ID NO: 165932 - DNA, 25 bp, Mus musculus
aagcgaggatggtcatgaaagtcca

SEQ ID NO: 165933 - DNA, 25 bp, Mus musculus
aagcgaggcagttgttctccatggc

SEQ ID NO: 165934 - DNA, 25 bp, Mus musculus
aagcgaggccaggcgggctgggaag

SEQ ID NO: 165935 - DNA, 25 bp, Mus musculus
aagcgaggccctggtcacaggctct

SEQ ID NO: 165936 - DNA, 25 bp, Mus musculus
aagcgaggccgaggttgcttcctag

SEQ ID NO: 165937 - DNA, 25 bp, Mus musculus
aagcgagggcggcagacgccagtgc

SEQ ID NO: 165938 - DNA, 25 bp, Mus musculus
aagcgagtctttcaggaagaagacc

SEQ ID NO: 165939 - DNA, 25 bp, Mus musculus
aagcgatgaagcagaactgcggaca

SEQ ID NO: 165940 - DNA, 25 bp, Mus musculus
aagcgatgaagcagtatcaggagga

SEQ ID NO: 165941 - DNA, 25 bp, Mus musculus
aagcgatgataactttgtgatgtct

SEQ ID NO: 165942 - DNA, 25 bp, Mus musculus
aagcgatggaggtagaaaatcttct

SEQ ID NO: 165943 - DNA, 25 bp, Mus musculus
aagcgcaaaggaaaatgactcaggc

SEQ ID NO: 165944 - DNA, 25 bp, Mus musculus
aagcgcaaagggcccacatggtata

SEQ ID NO: 165945 - DNA, 25 bp, Mus musculus
aagcgcaacaggtcacctggaggaa

SEQ ID NO: 165946 - DNA, 25 bp, Mus musculus
aagcgcaagtattttccgccaagag

SEQ ID NO: 165947 - DNA, 25 bp, Mus musculus
aagcgcaccagagaatccgtgacct

SEQ ID NO: 165948 - DNA, 25 bp, Mus musculus
aagcgcagaaccctgttctgcagga

SEQ ID NO: 165949 - DNA, 25 bp, Mus musculus
aagcgcagcgggagaacagttaact

SEQ ID NO: 165950 - DNA, 25 bp, Mus musculus
aagcgcatcgtgaaggagatgctcc

SEQ ID NO: 165951 - DNA, 25 bp, Mus musculus
aagcgcatctgtgagatggcagcct

SEQ ID NO: 165952 - DNA, 25 bp, Mus musculus
aagcgcatttaaatcgttctgatga

SEQ ID NO: 165953 - DNA, 25 bp, Mus musculus
aagcgccacacccccagaggaaatg

SEQ ID NO: 165954 - DNA, 25 bp, Mus musculus
aagcgccattgaagtgtggggcttt

SEQ ID NO: 165955 - DNA, 25 bp, Mus musculus
aagcgccccagcagatggtaacaaa

SEQ ID NO: 165956 - DNA, 25 bp, Mus musculus
aagcgccggaggactgcatgagttt

SEQ ID NO: 165957 - DNA, 25 bp, Mus musculus
aagcgcgccaagagaaaattcagga

SEQ ID NO: 165958 - DNA, 25 bp, Mus musculus
aagcgcgccaagagacgaggatggc

SEQ ID NO: 165959 - DNA, 25 bp, Mus musculus
aagcgcgccctggccaacagcctcg

SEQ ID NO: 165960 - DNA, 25 bp, Mus musculus
aagcgcgcctttaaagtgaaggaca

SEQ ID NO: 165961 - DNA, 25 bp, Mus musculus
aagcgcggatgacaacctcaagtct

SEQ ID NO: 165962 - DNA, 25 bp, Mus musculus
aagcgcggatgggtaactcgtcctc

SEQ ID NO: 165963 - DNA, 25 bp, Mus musculus
aagcgctacactcaagatgacagca

SEQ ID NO: 165964 - DNA, 25 bp, Mus musculus
aagcgctacataaggtatctttccg

SEQ ID NO: 165965 - DNA, 25 bp, Mus musculus
aagcgctcaggctcagtttatgaac

SEQ ID NO: 165966 - DNA, 25 bp, Mus musculus
aagcgctcagtttagcgtgcaacgc

SEQ ID NO: 165967 - DNA, 25 bp, Mus musculus
aagcgctctacaggggaggtggatg

SEQ ID NO: 165968 - DNA, 25 bp, Mus musculus
aagcgctgagtgaaaatgtgctatt

SEQ ID NO: 165969 - DNA, 25 bp, Mus musculus
aagcgctgcagctattatctggaaa

SEQ ID NO: 165970 - DNA, 25 bp, Mus musculus
aagcgctggacgggtggagtgtcat

SEQ ID NO: 165971 - DNA, 25 bp, Mus musculus
aagcgctggagcgaccgccaggctc

SEQ ID NO: 165972 - DNA, 25 bp, Mus musculus
aagcgctgggtgaaagtgttgacag

SEQ ID NO: 165973 - DNA, 25 bp, Mus musculus
aagcgctgtcttcgagagaaaagtt

SEQ ID NO: 165974 - DNA, 25 bp, Mus musculus
aagcgctgtcttcggctcttcatag

SEQ ID NO: 165975 - DNA, 25 bp, Mus musculus
aagcgctgtgcaggggagcaccgcg

SEQ ID NO: 165976 - DNA, 25 bp, Mus musculus
aagcggacaagtattccaccaaaga

SEQ ID NO: 165977 - DNA, 25 bp, Mus musculus
aagcggacatcatggagtatgctgt

SEQ ID NO: 165978 - DNA, 25 bp, Mus musculus
aagcggaccgaggacttgtgtgagg

SEQ ID NO: 165979 - DNA, 25 bp, Mus musculus
aagcggagaagtcaggttccaagga

SEQ ID NO: 165980 - DNA, 25 bp, Mus musculus
aagcggagagaggtcttatcagctg

SEQ ID NO: 165981 - DNA, 25 bp, Mus musculus
aagcggagagcaagactggtagtgg

SEQ ID NO: 165982 - DNA, 25 bp, Mus musculus
aagcggaggataggtcggccagtga

SEQ ID NO: 165983 - DNA, 25 bp, Mus musculus
aagcggagtgttggtaactaaatga

SEQ ID NO: 165984 - DNA, 25 bp, Mus musculus
aagcggcagtagagtcagatacaga

SEQ ID NO: 165985 - DNA, 25 bp, Mus musculus
aagcggccaaggatccatctgcagt

SEQ ID NO: 165986 - DNA, 25 bp, Mus musculus
aagcggccagggacgatccgtaagg

SEQ ID NO: 165987 - DNA, 25 bp, Mus musculus
aagcggccagggagagacgacatgc

SEQ ID NO: 165988 - DNA, 25 bp, Mus musculus
aagcggccataaactgtacattttc

SEQ ID NO: 165989 - DNA, 25 bp, Mus musculus
aagcggcctcactagtgttcccagg

SEQ ID NO: 165990 - DNA, 25 bp, Mus musculus
aagcggcctcactatcagacatgca

SEQ ID NO: 165991 - DNA, 25 bp, Mus musculus
aagcggcctgcatgacccgccggga

SEQ ID NO: 165992 - DNA, 25 bp, Mus musculus
aagcggcctggcccggacttagcat

SEQ ID NO: 165993 - DNA, 25 bp, Mus musculus
aagcggcggcgggttaacttcggct

SEQ ID NO: 165994 - DNA, 25 bp, Mus musculus
aagcggcggcgggttggagttcaag

SEQ ID NO: 165995 - DNA, 25 bp, Mus musculus
aagcggctacaggcggcaggaaatg

SEQ ID NO: 165996 - DNA, 25 bp, Mus musculus
aagcgggaattggtctcggtgtgat

SEQ ID NO: 165997 - DNA, 25 bp, Mus musculus
aagcgggaattggtctgggcgtcat

SEQ ID NO: 165998 - DNA, 25 bp, Mus musculus
aagcgggaattggtcttggagttct

SEQ ID NO: 165999 - DNA, 25 bp, Mus musculus
aagcgggatctctaccagaagtgga

SEQ ID NO: 166000 - DNA, 25 bp, Mus musculus
aagcgggcagagaggaactaggaag

SEQ ID NO: 166001 - DNA, 25 bp, Mus musculus
aagcgggcagagatgaacgggcttg

SEQ ID NO: 166002 - DNA, 25 bp, Mus musculus
aagcgggcagagtctgctcattgaa

SEQ ID NO: 166003 - DNA, 25 bp, Mus musculus
aagcgggcagagttttatctttaag

SEQ ID NO: 166004 - DNA, 25 bp, Mus musculus
aagcgggcaggtccatggagagact

SEQ ID NO: 166005 - DNA, 25 bp, Mus musculus
aagcgggcagtcagaaaatgggtaa

SEQ ID NO: 166006 - DNA, 25 bp, Mus musculus
aagcgggccgagatgtggtgatcta

SEQ ID NO: 166007 - DNA, 25 bp, Mus musculus
aagcgggccgaggttggatcatggt

SEQ ID NO: 166008 - DNA, 25 bp, Mus musculus
aagcggggggaagtgggcacataca

SEQ ID NO: 166009 - DNA, 25 bp, Mus musculus
aagcgggtcaagttacagatttggg

SEQ ID NO: 166010 - DNA, 25 bp, Mus musculus
aagcggtcttaagaatcaacataaa

SEQ ID NO: 166011 - DNA, 25 bp, Mus musculus
aagcgtacgaggcagaaatgctgag

SEQ ID NO: 166012 - DNA, 25 bp, Mus musculus
aagcgtagaagccgaactcccgtcg

SEQ ID NO: 166013 - DNA, 25 bp, Mus musculus
aagcgtagcaagcccgtcctggaca

SEQ ID NO: 166014 - DNA, 25 bp, Mus musculus
aagcgtatcagcagtgtagtgattt

SEQ ID NO: 166015 - DNA, 25 bp, Mus musculus
aagcgtcaaaccggtgcccaaacac

SEQ ID NO: 166016 - DNA, 25 bp, Mus musculus
aagcgtcaaactccctgaattcctt

SEQ ID NO: 166017 - DNA, 25 bp, Mus musculus
aagcgtctaaagcttcaagttatat

SEQ ID NO: 166018 - DNA, 25 bp, Mus musculus
aagcgtctaaaggaaattgatggga

SEQ ID NO: 166019 - DNA, 25 bp, Mus musculus
aagcgtctacaaacttcaccaaact

SEQ ID NO: 166020 - DNA, 25 bp, Mus musculus
aagcgtctacaaagcccggttcctg

SEQ ID NO: 166021 - DNA, 25 bp, Mus musculus
aagcgtctctcgaatctacactgac

SEQ ID NO: 166022 - DNA, 25 bp, Mus musculus
aagcgtctctcgaggttgcctgata

SEQ ID NO: 166023 - DNA, 25 bp, Mus musculus
aagcgtctttccagcccctgctggc

SEQ ID NO: 166024 - DNA, 25 bp, Mus musculus
aagcgtctttccaggtcatcctgtt

SEQ ID NO: 166025 - DNA, 25 bp, Mus musculus
aagcgtgcatggttctgcagcttcc

SEQ ID NO: 166026 - DNA, 25 bp, Mus musculus
aagcgtgggaaaaagaccaaagatt

SEQ ID NO: 166027 - DNA, 25 bp, Mus musculus
aagcgtgggaaactgctctcctatg

SEQ ID NO: 166028 - DNA, 25 bp, Mus musculus
aagcgtggttgatctggtggctctg

SEQ ID NO: 166029 - DNA, 25 bp, Mus musculus
aagcgtgttagatatcgatgagtgc

SEQ ID NO: 166030 - DNA, 25 bp, Mus musculus
aagcgtttgcaggccatcgaagacg

SEQ ID NO: 166031 - DNA, 25 bp, Mus musculus
aagcgtttggaggtgccctccaaga

SEQ ID NO: 166032 - DNA, 25 bp, Mus musculus
aagcgttttcagaaaagatgtcttt

SEQ ID NO: 166033 - DNA, 25 bp, Mus musculus
aagctaaaagaattgggatatgacc

SEQ ID NO: 166034 - DNA, 25 bp, Mus musculus
aagctaaaagcatggctgctcgctg

SEQ ID NO: 166035 - DNA, 25 bp, Mus musculus
aagctaaacaagagcatgaaggaag

SEQ ID NO: 166036 - DNA, 25 bp, Mus musculus
aagctaaagacgggccagcaggcct

SEQ ID NO: 166037 - DNA, 25 bp, Mus musculus
aagctaaagatggagaaggagagga

SEQ ID NO: 166038 - DNA, 25 bp, Mus musculus
aagctaacaactgtgccaccaaatg

SEQ ID NO: 166039 - DNA, 25 bp, Mus musculus
aagctaacaatcttggcaaagcgca

SEQ ID NO: 166040 - DNA, 25 bp, Mus musculus
aagctaacagggacagttaaaggta

SEQ ID NO: 166041 - DNA, 25 bp, Mus musculus
aagctaacggggaataaaagctgtg

SEQ ID NO: 166042 - DNA, 25 bp, Mus musculus
aagctaactgataaaattctaccag

SEQ ID NO: 166043 - DNA, 25 bp, Mus musculus
aagctaactgataaactccagggat

SEQ ID NO: 166044 - DNA, 25 bp, Mus musculus
aagctaagaaactgccaggagtagg

SEQ ID NO: 166045 - DNA, 25 bp, Mus musculus
aagctaatgcagtcccaccccctgt

SEQ ID NO: 166046 - DNA, 25 bp, Mus musculus
aagctacaccatccccccgcaggct

SEQ ID NO: 166047 - DNA, 25 bp, Mus musculus
aagctacagatatgggacacagcag

SEQ ID NO: 166048 - DNA, 25 bp, Mus musculus
aagctaccaaacgcaagcaccagga

SEQ ID NO: 166049 - DNA, 25 bp, Mus musculus
aagctaccggggagcattcagcctg

SEQ ID NO: 166050 - DNA, 25 bp, Mus musculus
aagctaccggggagtaacaatgaag

SEQ ID NO: 166051 - DNA, 25 bp, Mus musculus
aagctacgaagcaggctgcaccctg

SEQ ID NO: 166052 - DNA, 25 bp, Mus musculus
aagctacggtctctgctgcgctaca

SEQ ID NO: 166053 - DNA, 25 bp, Mus musculus
aagctactccagaaaaatcttcaaa

SEQ ID NO: 166054 - DNA, 25 bp, Mus musculus
aagctagaacaacagcgacagctat

SEQ ID NO: 166055 - DNA, 25 bp, Mus musculus
aagctagaacaacaggtgttgggag

SEQ ID NO: 166056 - DNA, 25 bp, Mus musculus
aagctagaccaactttgcagagttc

SEQ ID NO: 166057 - DNA, 25 bp, Mus musculus
aagctagactgggtctatggctatc

SEQ ID NO: 166058 - DNA, 25 bp, Mus musculus
aagctagaggagggcatggataatt

SEQ ID NO: 166059 - DNA, 25 bp, Mus musculus
aagctagagttcaaaggcggcgagt

SEQ ID NO: 166060 - DNA, 25 bp, Mus musculus
aagctaggaggactcacacacgaga

SEQ ID NO: 166061 - DNA, 25 bp, Mus musculus
aagctagtagagctggaggtggagt

SEQ ID NO: 166062 - DNA, 25 bp, Mus musculus
aagctagtagagtatatggaggaac

SEQ ID NO: 166063 - DNA, 25 bp, Mus musculus
aagctagtagcagaagctgggaggg

SEQ ID NO: 166064 - DNA, 25 bp, Mus musculus
aagctagttggaaaggcatttacac

SEQ ID NO: 166065 - DNA, 25 bp, Mus musculus
aagctatacaaggtgggcctgggtc

SEQ ID NO: 166066 - DNA, 25 bp, Mus musculus
aagctatatcggagacacagcttca

SEQ ID NO: 166067 - DNA, 25 bp, Mus musculus
aagctatcaactgagacattgtctt

SEQ ID NO: 166068 - DNA, 25 bp, Mus musculus
aagctatgaggtaactgtggagaac

SEQ ID NO: 166069 - DNA, 25 bp, Mus musculus
aagctatgaggtcatggagggaatg

SEQ ID NO: 166070 - DNA, 25 bp, Mus musculus
aagctatggcagaaagccctgcagg

SEQ ID NO: 166071 - DNA, 25 bp, Mus musculus
aagctatggcagagtgctgggatta

SEQ ID NO: 166072 - DNA, 25 bp, Mus musculus
aagctatggcagctacttaaaattc

SEQ ID NO: 166073 - DNA, 25 bp, Mus musculus
aagctatggcaggtgattggagttg

SEQ ID NO: 166074 - DNA, 25 bp, Mus musculus
aagctatggcagtggttttatgaag

SEQ ID NO: 166075 - DNA, 25 bp, Mus musculus
aagctatggtaaaagtttcatttga

SEQ ID NO: 166076 - DNA, 25 bp, Mus musculus
aagctattaagaagaagacaaaaaa

SEQ ID NO: 166077 - DNA, 25 bp, Mus musculus
aagctattcccagctccaccagaga

SEQ ID NO: 166078 - DNA, 25 bp, Mus musculus
aagctattctgctcgtcagcacatc

SEQ ID NO: 166079 - DNA, 25 bp, Mus musculus
aagctcaaaagctttgcagccagct

SEQ ID NO: 166080 - DNA, 25 bp, Mus musculus
aagctcaaaaggcactaagcaagag

SEQ ID NO: 166081 - DNA, 25 bp, Mus musculus
aagctcaaaggagagaaatgtcaac

SEQ ID NO: 166082 - DNA, 25 bp, Mus musculus
aagctcaacaaggctctccagagca

SEQ ID NO: 166083 - DNA, 25 bp, Mus musculus
aagctcaagaagaaagagttcgaca

SEQ ID NO: 166084 - DNA, 25 bp, Mus musculus
aagctcaagttaaagagaatgaaaa

SEQ ID NO: 166085 - DNA, 25 bp, Mus musculus
aagctcaagttttctacagagatcc

SEQ ID NO: 166086 - DNA, 25 bp, Mus musculus
aagctcaatggctacacggatgcag

SEQ ID NO: 166087 - DNA, 25 bp, Mus musculus
aagctcacgagaagatgtgtatgtc

SEQ ID NO: 166088 - DNA, 25 bp, Mus musculus
aagctcacgcctctcttctgtatta

SEQ ID NO: 166089 - DNA, 25 bp, Mus musculus
aagctcacgcctcttgaccagcagt

SEQ ID NO: 166090 - DNA, 25 bp, Mus musculus
aagctcactgtggaggagctgaagt

SEQ ID NO: 166091 - DNA, 25 bp, Mus musculus
aagctcacttgaaggacacccagct

SEQ ID NO: 166092 - DNA, 25 bp, Mus musculus
aagctcagaaacaggcggaaaaact

SEQ ID NO: 166093 - DNA, 25 bp, Mus musculus
aagctcagaaagcctttccctaaca

SEQ ID NO: 166094 - DNA, 25 bp, Mus musculus
aagctcagaaagctgtgtatgatcg

SEQ ID NO: 166095 - DNA, 25 bp, Mus musculus
aagctcagagggaagctcacaagat

SEQ ID NO: 166096 - DNA, 25 bp, Mus musculus
aagctcagagggaattgaagttaaa

SEQ ID NO: 166097 - DNA, 25 bp, Mus musculus
aagctcagagggatcagaaacatcg

SEQ ID NO: 166098 - DNA, 25 bp, Mus musculus
aagctcagatcaggtaagggagcac

SEQ ID NO: 166099 - DNA, 25 bp, Mus musculus
aagctcagcagaaaatgaaaattga

SEQ ID NO: 166100 - DNA, 25 bp, Mus musculus
aagctcagcaggaaataacagtcca

SEQ ID NO: 166101 - DNA, 25 bp, Mus musculus
aagctcagccacgggggccgtgaaa

SEQ ID NO: 166102 - DNA, 25 bp, Mus musculus
aagctcagcccagtgtcgtgtggcc

SEQ ID NO: 166103 - DNA, 25 bp, Mus musculus
aagctcagctcagcacaatcctgga

SEQ ID NO: 166104 - DNA, 25 bp, Mus musculus
aagctcaggaggcctcctgatgacg

SEQ ID NO: 166105 - DNA, 25 bp, Mus musculus
aagctcaggctgcaagcctgaggaa

SEQ ID NO: 166106 - DNA, 25 bp, Mus musculus
aagctcaggctggcaaatgaggaga

SEQ ID NO: 166107 - DNA, 25 bp, Mus musculus
aagctcatagcgggatcctgccggc

SEQ ID NO: 166108 - DNA, 25 bp, Mus musculus
aagctcatcctgagccttgagccag

SEQ ID NO: 166109 - DNA, 25 bp, Mus musculus
aagctcatcctgagttctccacacc

SEQ ID NO: 166110 - DNA, 25 bp, Mus musculus
aagctcatggccagggcattgttca

SEQ ID NO: 166111 - DNA, 25 bp, Mus musculus
aagctcatgggccctgcaccctttc

SEQ ID NO: 166112 - DNA, 25 bp, Mus musculus
aagctcatgggtacttccgccagct

SEQ ID NO: 166113 - DNA, 25 bp, Mus musculus
aagctcattactacactgctctgct

SEQ ID NO: 166114 - DNA, 25 bp, Mus musculus
aagctccaaaggaccagtccatgat

SEQ ID NO: 166115 - DNA, 25 bp, Mus musculus
aagctccaaaggttgtcgctgcttg

SEQ ID NO: 166116 - DNA, 25 bp, Mus musculus
aagctccaagaggtgtgtgatagca

SEQ ID NO: 166117 - DNA, 25 bp, Mus musculus
aagctccaaggcgtctgaatttcct

SEQ ID NO: 166118 - DNA, 25 bp, Mus musculus
aagctccacaggggatctttccagc

SEQ ID NO: 166119 - DNA, 25 bp, Mus musculus
aagctccagcacaggatgcgggctc

SEQ ID NO: 166120 - DNA, 25 bp, Mus musculus
aagctccagcaccagctcttttgat

SEQ ID NO: 166121 - DNA, 25 bp, Mus musculus
aagctccagcaccagcttgctttct

SEQ ID NO: 166122 - DNA, 25 bp, Mus musculus
aagctccaggagctgattcagaaag

SEQ ID NO: 166123 - DNA, 25 bp, Mus musculus
aagctccaggaggcactgaagaaac

SEQ ID NO: 166124 - DNA, 25 bp, Mus musculus
aagctccaggaggttatttccatgc

SEQ ID NO: 166125 - DNA, 25 bp, Mus musculus
aagctcccaaagcaaatccagtttg

SEQ ID NO: 166126 - DNA, 25 bp, Mus musculus
aagctcccagagggaattcctgagc

SEQ ID NO: 166127 - DNA, 25 bp, Mus musculus
aagctcccgccaaacgccatgagaa

SEQ ID NO: 166128 - DNA, 25 bp, Mus musculus
aagctccgagggcagctactgcaag

SEQ ID NO: 166129 - DNA, 25 bp, Mus musculus
aagctccgagtctggatcatctctg

SEQ ID NO: 166130 - DNA, 25 bp, Mus musculus
aagctccgcccagacggctcagagg

SEQ ID NO: 166131 - DNA, 25 bp, Mus musculus
aagctcctcacctgcctgcagcaac

SEQ ID NO: 166132 - DNA, 25 bp, Mus musculus
aagctcctctcttagactatccccc

SEQ ID NO: 166133 - DNA, 25 bp, Mus musculus
aagctcctctggaaagacccccctt

SEQ ID NO: 166134 - DNA, 25 bp, Mus musculus
aagctcctgaagacccagggggcaa

SEQ ID NO: 166135 - DNA, 25 bp, Mus musculus
aagctcctgaaggaagaagaactga

SEQ ID NO: 166136 - DNA, 25 bp, Mus musculus
aagctcctggagcaagaaaagcaga

SEQ ID NO: 166137 - DNA, 25 bp, Mus musculus
aagctcctggcggaggccatgaagc

SEQ ID NO: 166138 - DNA, 25 bp, Mus musculus
aagctcctggcggatgccatgaagc

SEQ ID NO: 166139 - DNA, 25 bp, Mus musculus
aagctcctggtacagtgacagctct

SEQ ID NO: 166140 - DNA, 25 bp, Mus musculus
aagctccttaagaaggcagatgagg

SEQ ID NO: 166141 - DNA, 25 bp, Mus musculus
aagctcgcaaaggctggcaaaaccc

SEQ ID NO: 166142 - DNA, 25 bp, Mus musculus
aagctcgcctcagagtgtgttcagt

SEQ ID NO: 166143 - DNA, 25 bp, Mus musculus
aagctcgcctcagagttccctggca

SEQ ID NO: 166144 - DNA, 25 bp, Mus musculus
aagctcggtcaagggggagtgcaga

SEQ ID NO: 166145 - DNA, 25 bp, Mus musculus
aagctctaagttaggcaagagttca

SEQ ID NO: 166146 - DNA, 25 bp, Mus musculus
aagctctacaaggtctccaacggtg

SEQ ID NO: 166147 - DNA, 25 bp, Mus musculus
aagctctaccggcttgatctcagtg

SEQ ID NO: 166148 - DNA, 25 bp, Mus musculus
aagctctatgactttgtgaagacag

SEQ ID NO: 166149 - DNA, 25 bp, Mus musculus
aagctctcagctcagcggaacctgc

SEQ ID NO: 166150 - DNA, 25 bp, Mus musculus
aagctctcagctcagcggtcacaca

SEQ ID NO: 166151 - DNA, 25 bp, Mus musculus
aagctctcatctgaaaataatgatg

SEQ ID NO: 166152 - DNA, 25 bp, Mus musculus
aagctctccccgatggctcattgcg

SEQ ID NO: 166153 - DNA, 25 bp, Mus musculus
aagctctccccggattgacttggcc

SEQ ID NO: 166154 - DNA, 25 bp, Mus musculus
aagctctccccgtctaaaagttggt

SEQ ID NO: 166155 - DNA, 25 bp, Mus musculus
aagctctctttcagggagacatagc

SEQ ID NO: 166156 - DNA, 25 bp, Mus musculus
aagctctgacttctgtttctcttca

SEQ ID NO: 166157 - DNA, 25 bp, Mus musculus
aagctctgcaaggacatccaggcag

SEQ ID NO: 166158 - DNA, 25 bp, Mus musculus
aagctctgctgacagggcagtttca

SEQ ID NO: 166159 - DNA, 25 bp, Mus musculus
aagctctgctgactgtgcagaatcg

SEQ ID NO: 166160 - DNA, 25 bp, Mus musculus
aagctctgcttgtgggccacccctt

SEQ ID NO: 166161 - DNA, 25 bp, Mus musculus
aagctctggagctgccatcaacacc

SEQ ID NO: 166162 - DNA, 25 bp, Mus musculus
aagctctggaggttgctgaacgaaa

SEQ ID NO: 166163 - DNA, 25 bp, Mus musculus
aagctctgggggtgaaatgggagag

SEQ ID NO: 166164 - DNA, 25 bp, Mus musculus
aagctctgggtacccgctttcttga

SEQ ID NO: 166165 - DNA, 25 bp, Mus musculus
aagctctggtgatgatgtggccctc

SEQ ID NO: 166166 - DNA, 25 bp, Mus musculus
aagctctggtgatgtactccaacct

SEQ ID NO: 166167 - DNA, 25 bp, Mus musculus
aagctctgttactgccaggcatctg

SEQ ID NO: 166168 - DNA, 25 bp, Mus musculus
aagctctgttactgcccatgaaacc

SEQ ID NO: 166169 - DNA, 25 bp, Mus musculus
aagctcttacaggcaccaacagaga

SEQ ID NO: 166170 - DNA, 25 bp, Mus musculus
aagctcttatgtgagacgtggaatc

SEQ ID NO: 166171 - DNA, 25 bp, Mus musculus
aagctcttgactcgagaagtcgtca

SEQ ID NO: 166172 - DNA, 25 bp, Mus musculus
aagctgaaaagaagatccagccgca

SEQ ID NO: 166173 - DNA, 25 bp, Mus musculus
aagctgaaacccagatccttactga

SEQ ID NO: 166174 - DNA, 25 bp, Mus musculus
aagctgaaagaggtggaagcggcaa

SEQ ID NO: 166175 - DNA, 25 bp, Mus musculus
aagctgaaccaagtctgtgatgagg

SEQ ID NO: 166176 - DNA, 25 bp, Mus musculus
aagctgaaccacaggaattcaaacc

SEQ ID NO: 166177 - DNA, 25 bp, Mus musculus
aagctgaaccacaggatgtgaacta

SEQ ID NO: 166178 - DNA, 25 bp, Mus musculus
aagctgaaccctcacctgtgccagg

SEQ ID NO: 166179 - DNA, 25 bp, Mus musculus
aagctgaagaaaaggccttggcaat

SEQ ID NO: 166180 - DNA, 25 bp, Mus musculus
aagctgaagagagagagaagacagt

SEQ ID NO: 166181 - DNA, 25 bp, Mus musculus
aagctgaagagcatggagaagcaca

SEQ ID NO: 166182 - DNA, 25 bp, Mus musculus
aagctgaagcctgcaggtctccacc

SEQ ID NO: 166183 - DNA, 25 bp, Mus musculus
aagctgaagttcggttcctgtgtga

SEQ ID NO: 166184 - DNA, 25 bp, Mus musculus
aagctgaatataaactgtcattatt

SEQ ID NO: 166185 - DNA, 25 bp, Mus musculus
aagctgaatgccatcaaactacaac

SEQ ID NO: 166186 - DNA, 25 bp, Mus musculus
aagctgacaggaagactcttcaaga

SEQ ID NO: 166187 - DNA, 25 bp, Mus musculus
aagctgacaggttgccatgcctttg

SEQ ID NO: 166188 - DNA, 25 bp, Mus musculus
aagctgaccaaagcggagaagctgc

SEQ ID NO: 166189 - DNA, 25 bp, Mus musculus
aagctgaccaagggactgcacagga

SEQ ID NO: 166190 - DNA, 25 bp, Mus musculus
aagctgaccaagttacagtccatca

SEQ ID NO: 166191 - DNA, 25 bp, Mus musculus
aagctgacccccaagaggccattaa

SEQ ID NO: 166192 - DNA, 25 bp, Mus musculus
aagctgacccccaaggccatcgccc

SEQ ID NO: 166193 - DNA, 25 bp, Mus musculus
aagctgacgaggaaggggaagaaga

SEQ ID NO: 166194 - DNA, 25 bp, Mus musculus
aagctgacgagggttatcagctctt

SEQ ID NO: 166195 - DNA, 25 bp, Mus musculus
aagctgactcaggaatttgaagcct

SEQ ID NO: 166196 - DNA, 25 bp, Mus musculus
aagctgacttgcaggttgatatgtc

SEQ ID NO: 166197 - DNA, 25 bp, Mus musculus
aagctgagagaaacgaagtgagaag

SEQ ID NO: 166198 - DNA, 25 bp, Mus musculus
aagctgagagcactctgtggagggg

SEQ ID NO: 166199 - DNA, 25 bp, Mus musculus
aagctgagcagaaaggcgctctaat

SEQ ID NO: 166200 - DNA, 25 bp, Mus musculus
aagctgagcaggcggaggaagaagg

SEQ ID NO: 166201 - DNA, 25 bp, Mus musculus
aagctgagccctgcgccaaaacgac

SEQ ID NO: 166202 - DNA, 25 bp, Mus musculus
aagctgaggaggtcataacttcctc

SEQ ID NO: 166203 - DNA, 25 bp, Mus musculus
aagctgaggcggggcatcgtgaagc

SEQ ID NO: 166204 - DNA, 25 bp, Mus musculus
aagctgagtatagaggtgctccaga

SEQ ID NO: 166205 - DNA, 25 bp, Mus musculus
aagctgagtgtaagggttcccgaga

SEQ ID NO: 166206 - DNA, 25 bp, Mus musculus
aagctgataaccacggctctgaagc

SEQ ID NO: 166207 - DNA, 25 bp, Mus musculus
aagctgataaccacgtctctgggtc

SEQ ID NO: 166208 - DNA, 25 bp, Mus musculus
aagctgatcaaggtcttggataaac

SEQ ID NO: 166209 - DNA, 25 bp, Mus musculus
aagctgatcaggctctaagggatgg

SEQ ID NO: 166210 - DNA, 25 bp, Mus musculus
aagctgatcgaagagttagcaatag

SEQ ID NO: 166211 - DNA, 25 bp, Mus musculus
aagctgatgacacagattctgagct

SEQ ID NO: 166212 - DNA, 25 bp, Mus musculus
aagctgatgccagtcattgcattca

SEQ ID NO: 166213 - DNA, 25 bp, Mus musculus
aagctgatgccagtcattgtataca

SEQ ID NO: 166214 - DNA, 25 bp, Mus musculus
aagctgatgtcattctcccatgtgt

SEQ ID NO: 166215 - DNA, 25 bp, Mus musculus
aagctgcaagactaggtttgccaga

SEQ ID NO: 166216 - DNA, 25 bp, Mus musculus
aagctgcaagccctgagcttgtccc

SEQ ID NO: 166217 - DNA, 25 bp, Mus musculus
aagctgcaagccctggctgctttta

SEQ ID NO: 166218 - DNA, 25 bp, Mus musculus
aagctgcaagctttcagaaagagtt

SEQ ID NO: 166219 - DNA, 25 bp, Mus musculus
aagctgcaagttgcagaattaagaa

SEQ ID NO: 166220 - DNA, 25 bp, Mus musculus
aagctgcacacttacgtccacgcca

SEQ ID NO: 166221 - DNA, 25 bp, Mus musculus
aagctgcacatcaagacctgtgttc

SEQ ID NO: 166222 - DNA, 25 bp, Mus musculus
aagctgcacatcaaggtccctttgt

SEQ ID NO: 166223 - DNA, 25 bp, Mus musculus
aagctgcacttcagacgaattatca

SEQ ID NO: 166224 - DNA, 25 bp, Mus musculus
aagctgcagaggagcaactttcagc

SEQ ID NO: 166225 - DNA, 25 bp, Mus musculus
aagctgcagagtttcatgatggcta

SEQ ID NO: 166226 - DNA, 25 bp, Mus musculus
aagctgcagatttgggacacagcag

SEQ ID NO: 166227 - DNA, 25 bp, Mus musculus
aagctgcagcaagagttccactgtt

SEQ ID NO: 166228 - DNA, 25 bp, Mus musculus
aagctgcagcccacttcttagatgc

SEQ ID NO: 166229 - DNA, 25 bp, Mus musculus
aagctgcagccccagggcctgcttc

SEQ ID NO: 166230 - DNA, 25 bp, Mus musculus
aagctgcagcgctatgcttggcgca

SEQ ID NO: 166231 - DNA, 25 bp, Mus musculus
aagctgcagcgctatgtgatgtaca

SEQ ID NO: 166232 - DNA, 25 bp, Mus musculus
aagctgcaggagtggcatctcccac

SEQ ID NO: 166233 - DNA, 25 bp, Mus musculus
aagctgcagttccaggaggaggact

SEQ ID NO: 166234 - DNA, 25 bp, Mus musculus
aagctgcagttccaggtccctgagg

SEQ ID NO: 166235 - DNA, 25 bp, Mus musculus
aagctgcatgaccagtgtagtccat

SEQ ID NO: 166236 - DNA, 25 bp, Mus musculus
aagctgccaaccaggactgggcaaa

SEQ ID NO: 166237 - DNA, 25 bp, Mus musculus
aagctgccaaccagttgtctaatgg

SEQ ID NO: 166238 - DNA, 25 bp, Mus musculus
aagctgccaggctctgggtgctcta

SEQ ID NO: 166239 - DNA, 25 bp, Mus musculus
aagctgcccagaaggagtcgaaagc

SEQ ID NO: 166240 - DNA, 25 bp, Mus musculus
aagctgccccccaggtcaagtggct

SEQ ID NO: 166241 - DNA, 25 bp, Mus musculus
aagctgccccccaggtcttgactca

SEQ ID NO: 166242 - DNA, 25 bp, Mus musculus
aagctgccgacacagccacagcatt

SEQ ID NO: 166243 - DNA, 25 bp, Mus musculus
aagctgccgggcatgtctaggccat

SEQ ID NO: 166244 - DNA, 25 bp, Mus musculus
aagctgcctaccagatatgaaagat

SEQ ID NO: 166245 - DNA, 25 bp, Mus musculus
aagctgcggaaggatgatccagtca

SEQ ID NO: 166246 - DNA, 25 bp, Mus musculus
aagctgcgggaaaccgctgaagctg

SEQ ID NO: 166247 - DNA, 25 bp, Mus musculus
aagctgctagagcactgggaaaaca

SEQ ID NO: 166248 - DNA, 25 bp, Mus musculus
aagctgctagtggagcaccaaggag

SEQ ID NO: 166249 - DNA, 25 bp, Mus musculus
aagctgctagtggaggagtttcatt

SEQ ID NO: 166250 - DNA, 25 bp, Mus musculus
aagctgctatcgggggaggagtgtc

SEQ ID NO: 166251 - DNA, 25 bp, Mus musculus
aagctgctatgcgtttctaatgtgg

SEQ ID NO: 166252 - DNA, 25 bp, Mus musculus
aagctgctcgactggctggtggaca

SEQ ID NO: 166253 - DNA, 25 bp, Mus musculus
aagctgctgagactataagcggaaa

SEQ ID NO: 166254 - DNA, 25 bp, Mus musculus
aagctgctgagactttccagttctc

SEQ ID NO: 166255 - DNA, 25 bp, Mus musculus
aagctgctgagatggctccgagcga

SEQ ID NO: 166256 - DNA, 25 bp, Mus musculus
aagctgctgaggctcacaactcagt

SEQ ID NO: 166257 - DNA, 25 bp, Mus musculus
aagctgctgagggccttgcgggtga

SEQ ID NO: 166258 - DNA, 25 bp, Mus musculus
aagctgctgagtgaagagagacttc

SEQ ID NO: 166259 - DNA, 25 bp, Mus musculus
aagctgctgatgaaccacgccttca

SEQ ID NO: 166260 - DNA, 25 bp, Mus musculus
aagctgctgatgaaggagagagaag

SEQ ID NO: 166261 - DNA, 25 bp, Mus musculus
aagctgctgatgaagggtccgcagg

SEQ ID NO: 166262 - DNA, 25 bp, Mus musculus
aagctgctgatggtcgacacccgca

SEQ ID NO: 166263 - DNA, 25 bp, Mus musculus
aagctgctgcagccctgccagtttg

SEQ ID NO: 166264 - DNA, 25 bp, Mus musculus
aagctgctggcagaagctggaatgc

SEQ ID NO: 166265 - DNA, 25 bp, Mus musculus
aagctgctgggcaccaagccaaagg

SEQ ID NO: 166266 - DNA, 25 bp, Mus musculus
aagctgctgggccctaatgctggcc

SEQ ID NO: 166267 - DNA, 25 bp, Mus musculus
aagctgcttagagagttttgtcaag

SEQ ID NO: 166268 - DNA, 25 bp, Mus musculus
aagctgctttctggcttgctggaac

SEQ ID NO: 166269 - DNA, 25 bp, Mus musculus
aagctggaaaacagctttcctagca

SEQ ID NO: 166270 - DNA, 25 bp, Mus musculus
aagctggaaaagccgctggacgact

SEQ ID NO: 166271 - DNA, 25 bp, Mus musculus
aagctggaaaagccgtcccgcacgg

SEQ ID NO: 166272 - DNA, 25 bp, Mus musculus
aagctggaaatggaaccagtgacct

SEQ ID NO: 166273 - DNA, 25 bp, Mus musculus
aagctggaagaagagacttttcatg

SEQ ID NO: 166274 - DNA, 25 bp, Mus musculus
aagctggaagaagctgggagggcag

SEQ ID NO: 166275 - DNA, 25 bp, Mus musculus
aagctggaagctgaaattaaaaagc

SEQ ID NO: 166276 - DNA, 25 bp, Mus musculus
aagctggaaggggctgcagtgctag

SEQ ID NO: 166277 - DNA, 25 bp, Mus musculus
aagctggacagaactcagcagatat

SEQ ID NO: 166278 - DNA, 25 bp, Mus musculus
aagctggagaagaatatggagaaga

SEQ ID NO: 166279 - DNA, 25 bp, Mus musculus
aagctggagaaggcattcggggcac

SEQ ID NO: 166280 - DNA, 25 bp, Mus musculus
aagctggagaatggcaaagcgcaag

SEQ ID NO: 166281 - DNA, 25 bp, Mus musculus
aagctggagaggaaggcacagagaa

SEQ ID NO: 166282 - DNA, 25 bp, Mus musculus
aagctggagatcaggattgacttgt

SEQ ID NO: 166283 - DNA, 25 bp, Mus musculus
aagctggagcagcttgaacttgaga

SEQ ID NO: 166284 - DNA, 25 bp, Mus musculus
aagctggagcaggaaagatctatac

SEQ ID NO: 166285 - DNA, 25 bp, Mus musculus
aagctggaggaggccaagcacattg

SEQ ID NO: 166286 - DNA, 25 bp, Mus musculus
aagctggatagaaggaagcaggcca

SEQ ID NO: 166287 - DNA, 25 bp, Mus musculus
aagctggatagtaaggtgaacatca

SEQ ID NO: 166288 - DNA, 25 bp, Mus musculus
aagctggatcaggatgcgggctcct

SEQ ID NO: 166289 - DNA, 25 bp, Mus musculus
aagctggatctgaagatccttcttg

SEQ ID NO: 166290 - DNA, 25 bp, Mus musculus
aagctggatctgaaggcggcacgtt

SEQ ID NO: 166291 - DNA, 25 bp, Mus musculus
aagctggcaaggcttttgctgttgg

SEQ ID NO: 166292 - DNA, 25 bp, Mus musculus
aagctggcaaggtacggactcgaga

SEQ ID NO: 166293 - DNA, 25 bp, Mus musculus
aagctggcaaggttcgaacctcaga

SEQ ID NO: 166294 - DNA, 25 bp, Mus musculus
aagctggccttgcaggtctctcttc

SEQ ID NO: 166295 - DNA, 25 bp, Mus musculus
aagctggcgggtagaatcattttgg

SEQ ID NO: 166296 - DNA, 25 bp, Mus musculus
aagctggctctctgaacccccacat

SEQ ID NO: 166297 - DNA, 25 bp, Mus musculus
aagctggctttgaagaatcaggccc

SEQ ID NO: 166298 - DNA, 25 bp, Mus musculus
aagctgggaaagaagatgaaagcag

SEQ ID NO: 166299 - DNA, 25 bp, Mus musculus
aagctgggaaagaagggactcgtac

SEQ ID NO: 166300 - DNA, 25 bp, Mus musculus
aagctgggaattcatatgactgtga

SEQ ID NO: 166301 - DNA, 25 bp, Mus musculus
aagctgggaattcatgtctgcccgg

SEQ ID NO: 166302 - DNA, 25 bp, Mus musculus
aagctgggcactcagggcccaggac

SEQ ID NO: 166303 - DNA, 25 bp, Mus musculus
aagctgggcactcaggtgaagccaa

SEQ ID NO: 166304 - DNA, 25 bp, Mus musculus
aagctgggcccaggggagaaatacg

SEQ ID NO: 166305 - DNA, 25 bp, Mus musculus
aagctgggcccagtatcgttgatct

SEQ ID NO: 166306 - DNA, 25 bp, Mus musculus
aagctgggcgagtacatggagaagc

SEQ ID NO: 166307 - DNA, 25 bp, Mus musculus
aagctggggctggacgttgagatca

SEQ ID NO: 166308 - DNA, 25 bp, Mus musculus
aagctgggtttgccgattcccaccc

SEQ ID NO: 166309 - DNA, 25 bp, Mus musculus
aagctgggtttgccggattatcaca

SEQ ID NO: 166310 - DNA, 25 bp, Mus musculus
aagctggtatgttgccagatggatt

SEQ ID NO: 166311 - DNA, 25 bp, Mus musculus
aagctggtcaagggtctagagacat

SEQ ID NO: 166312 - DNA, 25 bp, Mus musculus
aagctggtgaagagcatattccgcg

SEQ ID NO: 166313 - DNA, 25 bp, Mus musculus
aagctggtgagaagaacagcagtgg

SEQ ID NO: 166314 - DNA, 25 bp, Mus musculus
aagctggtgtggatggagaggtccc

SEQ ID NO: 166315 - DNA, 25 bp, Mus musculus
aagctggtttcagaggaggcctttc

SEQ ID NO: 166316 - DNA, 25 bp, Mus musculus
aagctgtaaagaggatagtgccatg

SEQ ID NO: 166317 - DNA, 25 bp, Mus musculus
aagctgtacaggttgggcttaggtc

SEQ ID NO: 166318 - DNA, 25 bp, Mus musculus
aagctgtactacgtaaccaccaaag

SEQ ID NO: 166319 - DNA, 25 bp, Mus musculus
aagctgtagtgcagttgaacactgc

SEQ ID NO: 166320 - DNA, 25 bp, Mus musculus
aagctgtagtgccaactactcaaaa

SEQ ID NO: 166321 - DNA, 25 bp, Mus musculus
aagctgtcacccatatggcccacac

SEQ ID NO: 166322 - DNA, 25 bp, Mus musculus
aagctgtcacccatggtccgacttt

SEQ ID NO: 166323 - DNA, 25 bp, Mus musculus
aagctgtcagcattctgcctacatg

SEQ ID NO: 166324 - DNA, 25 bp, Mus musculus
aagctgtcagtgggtttcaccagct

SEQ ID NO: 166325 - DNA, 25 bp, Mus musculus
aagctgtcagttctgagaagtcaga

SEQ ID NO: 166326 - DNA, 25 bp, Mus musculus
aagctgtcccctcagttccccagtg

SEQ ID NO: 166327 - DNA, 25 bp, Mus musculus
aagctgtccttgaagagcccacctg

SEQ ID NO: 166328 - DNA, 25 bp, Mus musculus
aagctgtctttacagtatgtaggcc

SEQ ID NO: 166329 - DNA, 25 bp, Mus musculus
aagctgtgcggatgccgggagacag

SEQ ID NO: 166330 - DNA, 25 bp, Mus musculus
aagctgtggcacaaggcaaagacat

SEQ ID NO: 166331 - DNA, 25 bp, Mus musculus
aagctgtggctataatgtgcaagat

SEQ ID NO: 166332 - DNA, 25 bp, Mus musculus
aagctgtgtccaagctgtcagtaga

SEQ ID NO: 166333 - DNA, 25 bp, Mus musculus
aagctgtgttcagccctgacagaag

SEQ ID NO: 166334 - DNA, 25 bp, Mus musculus
aagctgtgttcaggctcttcaaacg

SEQ ID NO: 166335 - DNA, 25 bp, Mus musculus
aagctgttaacagttcaaggcctgg

SEQ ID NO: 166336 - DNA, 25 bp, Mus musculus
aagctgttcccatttatgtacaggt

SEQ ID NO: 166337 - DNA, 25 bp, Mus musculus
aagctgtttgaggcgatggattgta

SEQ ID NO: 166338 - DNA, 25 bp, Mus musculus
aagcttacaggagtgccaggaggta

SEQ ID NO: 166339 - DNA, 25 bp, Mus musculus
aagcttaccagtgattttgaggaag

SEQ ID NO: 166340 - DNA, 25 bp, Mus musculus
aagcttacttcagccctgcattttg

SEQ ID NO: 166341 - DNA, 25 bp, Mus musculus
aagcttacttctacagtgatggaga

SEQ ID NO: 166342 - DNA, 25 bp, Mus musculus
aagcttattgtggggcatgaaggat

SEQ ID NO: 166343 - DNA, 25 bp, Mus musculus
aagcttatttggtatgctaacagaa

SEQ ID NO: 166344 - DNA, 25 bp, Mus musculus
aagcttcaacaaaggtgatctgcaa

SEQ ID NO: 166345 - DNA, 25 bp, Mus musculus
aagcttccaagtatgaggatgaaat

SEQ ID NO: 166346 - DNA, 25 bp, Mus musculus
aagcttccacgacagctccctcttg

SEQ ID NO: 166347 - DNA, 25 bp, Mus musculus
aagcttccagagcagaacatcatga

SEQ ID NO: 166348 - DNA, 25 bp, Mus musculus
aagcttccctggcacagaaacatca

SEQ ID NO: 166349 - DNA, 25 bp, Mus musculus
aagcttccctgtttttagcaacctt

SEQ ID NO: 166350 - DNA, 25 bp, Mus musculus
aagcttcctgatgctccattgctga

SEQ ID NO: 166351 - DNA, 25 bp, Mus musculus
aagcttcctggtgcaaatagtctac

SEQ ID NO: 166352 - DNA, 25 bp, Mus musculus
aagcttcgagcagcagtttttactc

SEQ ID NO: 166353 - DNA, 25 bp, Mus musculus
aagcttcggcaaaaatgagtctcat

SEQ ID NO: 166354 - DNA, 25 bp, Mus musculus
aagcttcggtgtcaggaggacatgt

SEQ ID NO: 166355 - DNA, 25 bp, Mus musculus
aagcttcgtggctggcggactattt

SEQ ID NO: 166356 - DNA, 25 bp, Mus musculus
aagcttcgtggctggtttgactcag

SEQ ID NO: 166357 - DNA, 25 bp, Mus musculus
aagcttctccaagactctaaaaaac

SEQ ID NO: 166358 - DNA, 25 bp, Mus musculus
aagcttctccaagaggctactgaaa

SEQ ID NO: 166359 - DNA, 25 bp, Mus musculus
aagcttctgagaaagattgtctaaa

SEQ ID NO: 166360 - DNA, 25 bp, Mus musculus
aagcttctgaggagctagaagcgat

SEQ ID NO: 166361 - DNA, 25 bp, Mus musculus
aagcttcttttgggatccgagcacc

SEQ ID NO: 166362 - DNA, 25 bp, Mus musculus
aagcttgaagaagaccttccccagg

SEQ ID NO: 166363 - DNA, 25 bp, Mus musculus
aagcttgagaaaaaccatggtgaat

SEQ ID NO: 166364 - DNA, 25 bp, Mus musculus
aagcttgagtgtgcgcgggtcactc

SEQ ID NO: 166365 - DNA, 25 bp, Mus musculus
aagcttgccagggcaagaaatacag

SEQ ID NO: 166366 - DNA, 25 bp, Mus musculus
aagcttgcccagtatgtgggatcct

SEQ ID NO: 166367 - DNA, 25 bp, Mus musculus
aagcttgccccagcggggacgaagc

SEQ ID NO: 166368 - DNA, 25 bp, Mus musculus
aagcttgccccagctgacgagatga

SEQ ID NO: 166369 - DNA, 25 bp, Mus musculus
aagcttgctcaggatggctgcagca

SEQ ID NO: 166370 - DNA, 25 bp, Mus musculus
aagcttgctcaggctcctcggatta

SEQ ID NO: 166371 - DNA, 25 bp, Mus musculus
aagcttgctgagactctccgctggt

SEQ ID NO: 166372 - DNA, 25 bp, Mus musculus
aagcttgctgaggcctcttaagcaa

SEQ ID NO: 166373 - DNA, 25 bp, Mus musculus
aagcttgctgagggtttcccagtgt

SEQ ID NO: 166374 - DNA, 25 bp, Mus musculus
aagcttgcttaaaacatgctaattc

SEQ ID NO: 166375 - DNA, 25 bp, Mus musculus
aagcttggagaagggtcttatggaa

SEQ ID NO: 166376 - DNA, 25 bp, Mus musculus
aagcttggagttgactgtgttccct

SEQ ID NO: 166377 - DNA, 25 bp, Mus musculus
aagcttggagttgggaatgagcaat

SEQ ID NO: 166378 - DNA, 25 bp, Mus musculus
aagcttgggaggggtcatccttcgg

SEQ ID NO: 166379 - DNA, 25 bp, Mus musculus
aagcttggtatttggaatgcagaaa

SEQ ID NO: 166380 - DNA, 25 bp, Mus musculus
aagcttggtattttgaagtccctgg

SEQ ID NO: 166381 - DNA, 25 bp, Mus musculus
aagcttgtgaaggaatctgattgcc

SEQ ID NO: 166382 - DNA, 25 bp, Mus musculus
aagctttaaacaagaggctcaagat

SEQ ID NO: 166383 - DNA, 25 bp, Mus musculus
aagctttaaacaaggggcgcagaga

SEQ ID NO: 166384 - DNA, 25 bp, Mus musculus
aagctttacaataagattacatctc

SEQ ID NO: 166385 - DNA, 25 bp, Mus musculus
aagctttcaaagccattggcacagc

SEQ ID NO: 166386 - DNA, 25 bp, Mus musculus
aagctttcaccaaccaatcaaagtt

SEQ ID NO: 166387 - DNA, 25 bp, Mus musculus
aagctttcaccaagtgtggattcgc

SEQ ID NO: 166388 - DNA, 25 bp, Mus musculus
aagctttcatagtgcctgcagtccg

SEQ ID NO: 166389 - DNA, 25 bp, Mus musculus
aagctttccagcacctcctaccggc

SEQ ID NO: 166390 - DNA, 25 bp, Mus musculus
aagctttccaggtctttgactcaga

SEQ ID NO: 166391 - DNA, 25 bp, Mus musculus
aagctttgcagatctgaacgatgct

SEQ ID NO: 166392 - DNA, 25 bp, Mus musculus
aagctttgctcgaagttgtccagtc

SEQ ID NO: 166393 - DNA, 25 bp, Mus musculus
aagctttggagggctccactctagc

SEQ ID NO: 166394 - DNA, 25 bp, Mus musculus
aagcttttacatgaaggtgcatctg

SEQ ID NO: 166395 - DNA, 25 bp, Mus musculus
aagcttttagagtcgctgactcccc

SEQ ID NO: 166396 - DNA, 25 bp, Mus musculus
aagcttttagtacagagtcttgctg

SEQ ID NO: 166397 - DNA, 25 bp, Mus musculus
aagcttttagtgccaaagcctcact

SEQ ID NO: 166398 - DNA, 25 bp, Mus musculus
aagcttttagtgttgtaggaagtgt

SEQ ID NO: 166399 - DNA, 25 bp, Mus musculus
aagcttttcttctggcggcatcgct

SEQ ID NO: 166400 - DNA, 25 bp, Mus musculus
aagctttttagatgggagaccgtta

SEQ ID NO: 166401 - DNA, 25 bp, Mus musculus
aaggaaaaaagcacctgacgttcac

SEQ ID NO: 166402 - DNA, 25 bp, Mus musculus
aaggaaaaaagtctgatgccaacgc

SEQ ID NO: 166403 - DNA, 25 bp, Mus musculus
aaggaaaacaggacccatcctctgt

SEQ ID NO: 166404 - DNA, 25 bp, Mus musculus
aaggaaaacagtctataaagcacca

SEQ ID NO: 166405 - DNA, 25 bp, Mus musculus
aaggaaaaccaagggctcaccttgt

SEQ ID NO: 166406 - DNA, 25 bp, Mus musculus
aaggaaaaccaggcacgcatcgagg

SEQ ID NO: 166407 - DNA, 25 bp, Mus musculus
aaggaaaagaatctgcaggcacacg

SEQ ID NO: 166408 - DNA, 25 bp, Mus musculus
aaggaaaagaggccttggaagatcg

SEQ ID NO: 166409 - DNA, 25 bp, Mus musculus
aaggaaaaggagctctgtcaggtgg

SEQ ID NO: 166410 - DNA, 25 bp, Mus musculus
aaggaaaaggggctgtctacagaat

SEQ ID NO: 166411 - DNA, 25 bp, Mus musculus
aaggaaacacagatacctctgaaat

SEQ ID NO: 166412 - DNA, 25 bp, Mus musculus
aaggaaacagttcagggcgacagct

SEQ ID NO: 166413 - DNA, 25 bp, Mus musculus
aaggaaacatagagaggaactacaa

SEQ ID NO: 166414 - DNA, 25 bp, Mus musculus
aaggaaactcagactaaggctggac

SEQ ID NO: 166415 - DNA, 25 bp, Mus musculus
aaggaaagaaaagggctgaagaaga

SEQ ID NO: 166416 - DNA, 25 bp, Mus musculus
aaggaaagaaccagatttctgctta

SEQ ID NO: 166417 - DNA, 25 bp, Mus musculus
aaggaaagaatcttctcaaaacaca

SEQ ID NO: 166418 - DNA, 25 bp, Mus musculus
aaggaaagcaaggaatcttcaaagt

SEQ ID NO: 166419 - DNA, 25 bp, Mus musculus
aaggaaagcaaggcatgccgctttt

SEQ ID NO: 166420 - DNA, 25 bp, Mus musculus
aaggaaagcagcccatacccagcca

SEQ ID NO: 166421 - DNA, 25 bp, Mus musculus
aaggaaagccagcggaaatggtcct

SEQ ID NO: 166422 - DNA, 25 bp, Mus musculus
aaggaaagctgccttcaccttccac

SEQ ID NO: 166423 - DNA, 25 bp, Mus musculus
aaggaaaggagtgactggtcagaaa

SEQ ID NO: 166424 - DNA, 25 bp, Mus musculus
aaggaaataaaatggttatgtcctt

SEQ ID NO: 166425 - DNA, 25 bp, Mus musculus
aaggaaataatccctccatattaca

SEQ ID NO: 166426 - DNA, 25 bp, Mus musculus
aaggaaatacagatgctggcccgtg

SEQ ID NO: 166427 - DNA, 25 bp, Mus musculus
aaggaaatccttacgatgctgatga

SEQ ID NO: 166428 - DNA, 25 bp, Mus musculus
aaggaaatccttacggcatttttct

SEQ ID NO: 166429 - DNA, 25 bp, Mus musculus
aaggaaatctatgatgattctttta

SEQ ID NO: 166430 - DNA, 25 bp, Mus musculus
aaggaaatctgaaaaaagacgagat

SEQ ID NO: 166431 - DNA, 25 bp, Mus musculus
aaggaaatctgataactgatttgaa

SEQ ID NO: 166432 - DNA, 25 bp, Mus musculus
aaggaaatctgataagtcctttgca

SEQ ID NO: 166433 - DNA, 25 bp, Mus musculus
aaggaaatctgatctccaagagggt

SEQ ID NO: 166434 - DNA, 25 bp, Mus musculus
aaggaaatctgccttaagaactgtc

SEQ ID NO: 166435 - DNA, 25 bp, Mus musculus
aaggaaatctgggtcttcggatcag

SEQ ID NO: 166436 - DNA, 25 bp, Mus musculus
aaggaaatctggtaaagacgagatg

SEQ ID NO: 166437 - DNA, 25 bp, Mus musculus
aaggaaatctgtattatgttccact

SEQ ID NO: 166438 - DNA, 25 bp, Mus musculus
aaggaaatgacaaatggttatgagc

SEQ ID NO: 166439 - DNA, 25 bp, Mus musculus
aaggaaatgcgccagttgatgaagg

SEQ ID NO: 166440 - DNA, 25 bp, Mus musculus
aaggaaattcgcagggctatgtgct

SEQ ID NO: 166441 - DNA, 25 bp, Mus musculus
aaggaacaaataagacggttagcac

SEQ ID NO: 166442 - DNA, 25 bp, Mus musculus
aaggaacaaataagcctggggaact

SEQ ID NO: 166443 - DNA, 25 bp, Mus musculus
aaggaacaagactgggatcagatcc

SEQ ID NO: 166444 - DNA, 25 bp, Mus musculus
aaggaacaagctagtggggtagtgt

SEQ ID NO: 166445 - DNA, 25 bp, Mus musculus
aaggaacaaggacagggagatttga

SEQ ID NO: 166446 - DNA, 25 bp, Mus musculus
aaggaacaaggtctgcaaacagcat

SEQ ID NO: 166447 - DNA, 25 bp, Mus musculus
aaggaacactgcttgggaaatcctc

SEQ ID NO: 166448 - DNA, 25 bp, Mus musculus
aaggaacactgcttggttcgttcca

SEQ ID NO: 166449 - DNA, 25 bp, Mus musculus
aaggaacactgcttggttggtgtta

SEQ ID NO: 166450 - DNA, 25 bp, Mus musculus
aaggaacagaacggagtgcaagatc

SEQ ID NO: 166451 - DNA, 25 bp, Mus musculus
aaggaacagaacgggaggaactata

SEQ ID NO: 166452 - DNA, 25 bp, Mus musculus
aaggaacagagtgacttaaccactc

SEQ ID NO: 166453 - DNA, 25 bp, Mus musculus
aaggaacagcaggcagttcctggca

SEQ ID NO: 166454 - DNA, 25 bp, Mus musculus
aaggaacataaacaaggcataatca

SEQ ID NO: 166455 - DNA, 25 bp, Mus musculus
aaggaacataaacagtctgatgaaa

SEQ ID NO: 166456 - DNA, 25 bp, Mus musculus
aaggaacatggggcagcaggagcaa

SEQ ID NO: 166457 - DNA, 25 bp, Mus musculus
aaggaacatgggtgtagtgattttg

SEQ ID NO: 166458 - DNA, 25 bp, Mus musculus
aaggaacatgtttccagagtgtgga

SEQ ID NO: 166459 - DNA, 25 bp, Mus musculus
aaggaaccaagaagagtttgtccct

SEQ ID NO: 166460 - DNA, 25 bp, Mus musculus
aaggaaccaagaaggcctcaggtcc

SEQ ID NO: 166461 - DNA, 25 bp, Mus musculus
aaggaaccagaggaattctggaact

SEQ ID NO: 166462 - DNA, 25 bp, Mus musculus
aaggaaccatgaaaagaagagatga

SEQ ID NO: 166463 - DNA, 25 bp, Mus musculus
aaggaaccatggcacagcgatggca

SEQ ID NO: 166464 - DNA, 25 bp, Mus musculus
aaggaacccacaggtgattcacata

SEQ ID NO: 166465 - DNA, 25 bp, Mus musculus
aaggaacccacagttacagatcaac

SEQ ID NO: 166466 - DNA, 25 bp, Mus musculus
aaggaacgaaataatttgaagagga

SEQ ID NO: 166467 - DNA, 25 bp, Mus musculus
aaggaacgaattttagatgcacaga

SEQ ID NO: 166468 - DNA, 25 bp, Mus musculus
aaggaacgaattttgttaagagcag

SEQ ID NO: 166469 - DNA, 25 bp, Mus musculus
aaggaacgcagcaactgctgctgag

SEQ ID NO: 166470 - DNA, 25 bp, Mus musculus
aaggaacgcattcagccagaagaca

SEQ ID NO: 166471 - DNA, 25 bp, Mus musculus
aaggaacggaatgacttgtgtgcaa

SEQ ID NO: 166472 - DNA, 25 bp, Mus musculus
aaggaacgtcccggagcttggccag

SEQ ID NO: 166473 - DNA, 25 bp, Mus musculus
aaggaactctggaagatgggtgtgt

SEQ ID NO: 166474 - DNA, 25 bp, Mus musculus
aaggaactctttgggcctgccttaa

SEQ ID NO: 166475 - DNA, 25 bp, Mus musculus
aaggaactgaaagtgcctttgaagg

SEQ ID NO: 166476 - DNA, 25 bp, Mus musculus
aaggaactgaagcgcctttcagtgg

SEQ ID NO: 166477 - DNA, 25 bp, Mus musculus
aaggaactgaagcgttctgagaaga

SEQ ID NO: 166478 - DNA, 25 bp, Mus musculus
aaggaactgaaggagtctttgtctg

SEQ ID NO: 166479 - DNA, 25 bp, Mus musculus
aaggaactgcaggggaagcacaggc

SEQ ID NO: 166480 - DNA, 25 bp, Mus musculus
aaggaactgcaggttgacgtgattg

SEQ ID NO: 166481 - DNA, 25 bp, Mus musculus
aaggaactgggcagaatgaacacga

SEQ ID NO: 166482 - DNA, 25 bp, Mus musculus
aaggaactgggcagagaagaatatc

SEQ ID NO: 166483 - DNA, 25 bp, Mus musculus
aaggaactggtctctcatggaactt

SEQ ID NO: 166484 - DNA, 25 bp, Mus musculus
aaggaactgtggaggcagctgtgtc

SEQ ID NO: 166485 - DNA, 25 bp, Mus musculus
aaggaacttatccagtgaagaagtt

SEQ ID NO: 166486 - DNA, 25 bp, Mus musculus
aaggaagaaagcaaggaaggaaggt

SEQ ID NO: 166487 - DNA, 25 bp, Mus musculus
aaggaagaactaggctcctacgcgc

SEQ ID NO: 166488 - DNA, 25 bp, Mus musculus
aaggaagaactgactcagatttcat

SEQ ID NO: 166489 - DNA, 25 bp, Mus musculus
aaggaagaagaaaagacaccgaagt

SEQ ID NO: 166490 - DNA, 25 bp, Mus musculus
aaggaagaagaggaaaggattttgc

SEQ ID NO: 166491 - DNA, 25 bp, Mus musculus
aaggaagaagatgtagaatgtgggc

SEQ ID NO: 166492 - DNA, 25 bp, Mus musculus
aaggaagaagcacagagagagatta

SEQ ID NO: 166493 - DNA, 25 bp, Mus musculus
aaggaagaagcaggtgattaaagtt

SEQ ID NO: 166494 - DNA, 25 bp, Mus musculus
aaggaagaaggagaaagcaagctgt

SEQ ID NO: 166495 - DNA, 25 bp, Mus musculus
aaggaagaaggagagctcactacta

SEQ ID NO: 166496 - DNA, 25 bp, Mus musculus
aaggaagaagttacagattcatggt

SEQ ID NO: 166497 - DNA, 25 bp, Mus musculus
aaggaagaatgtggcaaaaaaacat

SEQ ID NO: 166498 - DNA, 25 bp, Mus musculus
aaggaagaatgtggcgctttggagt

SEQ ID NO: 166499 - DNA, 25 bp, Mus musculus
aaggaagacagaacctctggtttgc

SEQ ID NO: 166500 - DNA, 25 bp, Mus musculus
aaggaagacagtgatgaggatgaag

SEQ ID NO: 166501 - DNA, 25 bp, Mus musculus
aaggaagacttcaagaggacgctgg

SEQ ID NO: 166502 - DNA, 25 bp, Mus musculus
aaggaagaggaacaggatctcatca

SEQ ID NO: 166503 - DNA, 25 bp, Mus musculus
aaggaagaggaagaggatacagtca

SEQ ID NO: 166504 - DNA, 25 bp, Mus musculus
aaggaagaggggatatgtggtacat

SEQ ID NO: 166505 - DNA, 25 bp, Mus musculus
aaggaagagggtaaactggtgcagg

SEQ ID NO: 166506 - DNA, 25 bp, Mus musculus
aaggaagataaagccatcccgatgt

SEQ ID NO: 166507 - DNA, 25 bp, Mus musculus
aaggaagatacatgttgtcaggtgg

SEQ ID NO: 166508 - DNA, 25 bp, Mus musculus
aaggaagatgacaagagaagaaaga

SEQ ID NO: 166509 - DNA, 25 bp, Mus musculus
aaggaagatggaggaaagacaaatg

SEQ ID NO: 166510 - DNA, 25 bp, Mus musculus
aaggaagattgatgtcggcagctct

SEQ ID NO: 166511 - DNA, 25 bp, Mus musculus
aaggaagcaagatttcctttcctgg

SEQ ID NO: 166512 - DNA, 25 bp, Mus musculus
aaggaagcagaatcgtatcgaatta

SEQ ID NO: 166513 - DNA, 25 bp, Mus musculus
aaggaagcagaatcgttttggatcc

SEQ ID NO: 166514 - DNA, 25 bp, Mus musculus
aaggaagcagagatgcccggaaccg

SEQ ID NO: 166515 - DNA, 25 bp, Mus musculus
aaggaagcaggaggtgactttggct

SEQ ID NO: 166516 - DNA, 25 bp, Mus musculus
aaggaagccaaaaagaagaagcact

SEQ ID NO: 166517 - DNA, 25 bp, Mus musculus
aaggaagccaaaaagagcaagaagc

SEQ ID NO: 166518 - DNA, 25 bp, Mus musculus
aaggaagccaagatttctcagctga

SEQ ID NO: 166519 - DNA, 25 bp, Mus musculus
aaggaagccctggaggcactggttc

SEQ ID NO: 166520 - DNA, 25 bp, Mus musculus
aaggaagcctctgtgcctctgggca

SEQ ID NO: 166521 - DNA, 25 bp, Mus musculus
aaggaagcttttagtacagagtctt

SEQ ID NO: 166522 - DNA, 25 bp, Mus musculus
aaggaagcttttagtgccaaagcct

SEQ ID NO: 166523 - DNA, 25 bp, Mus musculus
aaggaagcttttagtgttgtaggaa

SEQ ID NO: 166524 - DNA, 25 bp, Mus musculus
aaggaaggaatggtgagccttcccg

SEQ ID NO: 166525 - DNA, 25 bp, Mus musculus
aaggaaggagaccggggaatcaagg

SEQ ID NO: 166526 - DNA, 25 bp, Mus musculus
aaggaaggagggtctctaatctatg

SEQ ID NO: 166527 - DNA, 25 bp, Mus musculus
aaggaaggcaagaagagacttgagg

SEQ ID NO: 166528 - DNA, 25 bp, Mus musculus
aaggaagggaggtgcatggagactc

SEQ ID NO: 166529 - DNA, 25 bp, Mus musculus
aaggaagtataactcagggaatggg

SEQ ID NO: 166530 - DNA, 25 bp, Mus musculus
aaggaagtcggtgtgttatctctga

SEQ ID NO: 166531 - DNA, 25 bp, Mus musculus
aaggaagtggaaagcgtgactccag

SEQ ID NO: 166532 - DNA, 25 bp, Mus musculus
aaggaagtggaggcagagttcctca

SEQ ID NO: 166533 - DNA, 25 bp, Mus musculus
aaggaagtggaggtggaggaatgtg

SEQ ID NO: 166534 - DNA, 25 bp, Mus musculus
aaggaagtggtataggatcttgaaa

SEQ ID NO: 166535 - DNA, 25 bp, Mus musculus
aaggaagtgtctatggacgaccata

SEQ ID NO: 166536 - DNA, 25 bp, Mus musculus
aaggaagttgagaatgaaaagtccc

SEQ ID NO: 166537 - DNA, 25 bp, Mus musculus
aaggaagttgagaatttcaggaatt

SEQ ID NO: 166538 - DNA, 25 bp, Mus musculus
aaggaagttgaggtttaatagtctt

SEQ ID NO: 166539 - DNA, 25 bp, Mus musculus
aaggaataccaggaaaatagtgatg

SEQ ID NO: 166540 - DNA, 25 bp, Mus musculus
aaggaataccaggaaatgataatgc

SEQ ID NO: 166541 - DNA, 25 bp, Mus musculus
aaggaatacgtgctgcccagttttg

SEQ ID NO: 166542 - DNA, 25 bp, Mus musculus
aaggaataggcgaggacgcggacct

SEQ ID NO: 166543 - DNA, 25 bp, Mus musculus
aaggaatagtgtgataattggcctt

SEQ ID NO: 166544 - DNA, 25 bp, Mus musculus
aaggaatagtgtgtgcagcttatga

SEQ ID NO: 166545 - DNA, 25 bp, Mus musculus
aaggaatatacagctggcagggaag

SEQ ID NO: 166546 - DNA, 25 bp, Mus musculus
aaggaatcaagttactggacagtga

SEQ ID NO: 166547 - DNA, 25 bp, Mus musculus
aaggaatccaacgatgcagatcttt

SEQ ID NO: 166548 - DNA, 25 bp, Mus musculus
aaggaatcctgaggctccagccagg

SEQ ID NO: 166549 - DNA, 25 bp, Mus musculus
aaggaatgaatgcgggctttgaaga

SEQ ID NO: 166550 - DNA, 25 bp, Mus musculus
aaggaatgccaaccaggcagcgggc

SEQ ID NO: 166551 - DNA, 25 bp, Mus musculus
aaggaatgccccaaagcaaaatcaa

SEQ ID NO: 166552 - DNA, 25 bp, Mus musculus
aaggaatgcccgaaggagccgggtc

SEQ ID NO: 166553 - DNA, 25 bp, Mus musculus
aaggaatgcccgaaggtagagaaac

SEQ ID NO: 166554 - DNA, 25 bp, Mus musculus
aaggaatgcggcctccttccctggg

SEQ ID NO: 166555 - DNA, 25 bp, Mus musculus
aaggaatgggagaatgaagggggag

SEQ ID NO: 166556 - DNA, 25 bp, Mus musculus
aaggaatgggagacgtacgcagcag

SEQ ID NO: 166557 - DNA, 25 bp, Mus musculus
aaggaatgtgtgttggcgctaccct

SEQ ID NO: 166558 - DNA, 25 bp, Mus musculus
aaggaattaagcaagatgagaagcc

SEQ ID NO: 166559 - DNA, 25 bp, Mus musculus
aaggaattaagcaaggctgtggact

SEQ ID NO: 166560 - DNA, 25 bp, Mus musculus
aaggaattacagccgaagaagcagg

SEQ ID NO: 166561 - DNA, 25 bp, Mus musculus
aaggaattcaaaagaattactcaga

SEQ ID NO: 166562 - DNA, 25 bp, Mus musculus
aaggaattcaagatggtcaaataaa

SEQ ID NO: 166563 - DNA, 25 bp, Mus musculus
aaggaattctccaagaatgggaaat

SEQ ID NO: 166564 - DNA, 25 bp, Mus musculus
aaggaatttctaaagaagttggcat

SEQ ID NO: 166565 - DNA, 25 bp, Mus musculus
aaggacaaaatggcagtggcagccc

SEQ ID NO: 166566 - DNA, 25 bp, Mus musculus
aaggacaaagagcatctaaagaaaa

SEQ ID NO: 166567 - DNA, 25 bp, Mus musculus
aaggacaaagcagaaaatggatcga

SEQ ID NO: 166568 - DNA, 25 bp, Mus musculus
aaggacaaagcagacgttgattccg

SEQ ID NO: 166569 - DNA, 25 bp, Mus musculus
aaggacaaccacgagatgtctgcag

SEQ ID NO: 166570 - DNA, 25 bp, Mus musculus
aaggacaaccacgtcattcacccat

SEQ ID NO: 166571 - DNA, 25 bp, Mus musculus
aaggacaagaacttagtgatgtgga

SEQ ID NO: 166572 - DNA, 25 bp, Mus musculus
aaggacaagaagaaagccggtggct

SEQ ID NO: 166573 - DNA, 25 bp, Mus musculus
aaggacaagaagaattaaagcacgc

SEQ ID NO: 166574 - DNA, 25 bp, Mus musculus
aaggacaagataaacttgatgggaa

SEQ ID NO: 166575 - DNA, 25 bp, Mus musculus
aaggacaagatatatctcacagaca

SEQ ID NO: 166576 - DNA, 25 bp, Mus musculus
aaggacaagatgtatatcacttgtg

SEQ ID NO: 166577 - DNA, 25 bp, Mus musculus
aaggacaaggttgttgacctcctgt

SEQ ID NO: 166578 - DNA, 25 bp, Mus musculus
aaggacaataaaaggaaagacaaag

SEQ ID NO: 166579 - DNA, 25 bp, Mus musculus
aaggacaatgaggatggcagtacct

SEQ ID NO: 166580 - DNA, 25 bp, Mus musculus
aaggacacaagggtgaagagggtga

SEQ ID NO: 166581 - DNA, 25 bp, Mus musculus
aaggacacagggtctcttacaaagt

SEQ ID NO: 166582 - DNA, 25 bp, Mus musculus
aaggacacatggaagatctcaggcc

SEQ ID NO: 166583 - DNA, 25 bp, Mus musculus
aaggacaccttaggtattggaaaag

SEQ ID NO: 166584 - DNA, 25 bp, Mus musculus
aaggacacgagttgcctagcagagc

SEQ ID NO: 166585 - DNA, 25 bp, Mus musculus
aaggacacgcaccagtggtatgtgt

SEQ ID NO: 166586 - DNA, 25 bp, Mus musculus
aaggacacgcatggggtgtgatttt

SEQ ID NO: 166587 - DNA, 25 bp, Mus musculus
aaggacacggtccagctgcccacca

SEQ ID NO: 166588 - DNA, 25 bp, Mus musculus
aaggacactggcagcagggcagttt

SEQ ID NO: 166589 - DNA, 25 bp, Mus musculus
aaggacactgtcaacggcagggtca

SEQ ID NO: 166590 - DNA, 25 bp, Mus musculus
aaggacactgtcaagggcagggtca

SEQ ID NO: 166591 - DNA, 25 bp, Mus musculus
aaggacagaacaactgagattcctg

SEQ ID NO: 166592 - DNA, 25 bp, Mus musculus
aaggacagaagaagaagaaaggacc

SEQ ID NO: 166593 - DNA, 25 bp, Mus musculus
aaggacagaagagatctgctggcag

SEQ ID NO: 166594 - DNA, 25 bp, Mus musculus
aaggacagaagggctctgcgtttgt

SEQ ID NO: 166595 - DNA, 25 bp, Mus musculus
aaggacagaagtcctccacagagca

SEQ ID NO: 166596 - DNA, 25 bp, Mus musculus
aaggacagacaggctttccagggct

SEQ ID NO: 166597 - DNA, 25 bp, Mus musculus
aaggacagaggacctgaaggctgaa

SEQ ID NO: 166598 - DNA, 25 bp, Mus musculus
aaggacagagggtagacaaacacat

SEQ ID NO: 166599 - DNA, 25 bp, Mus musculus
aaggacagcaaggtggtgtgggacc

SEQ ID NO: 166600 - DNA, 25 bp, Mus musculus
aaggacagccctcccacagaattcc

SEQ ID NO: 166601 - DNA, 25 bp, Mus musculus
aaggacaggacctttcctagcaaga

SEQ ID NO: 166602 - DNA, 25 bp, Mus musculus
aaggacaggacgagtattatatagt

SEQ ID NO: 166603 - DNA, 25 bp, Mus musculus
aaggacaggacggaaaaagagagag

SEQ ID NO: 166604 - DNA, 25 bp, Mus musculus
aaggacagtaaaggaggcagcccgc

SEQ ID NO: 166605 - DNA, 25 bp, Mus musculus
aaggacagtactctcccatggctat

SEQ ID NO: 166606 - DNA, 25 bp, Mus musculus
aaggacagtcactcggaggcttact

SEQ ID NO: 166607 - DNA, 25 bp, Mus musculus
aaggacagtgtggacgggcagtctc

SEQ ID NO: 166608 - DNA, 25 bp, Mus musculus
aaggacagtgtggaggggcagtctc

SEQ ID NO: 166609 - DNA, 25 bp, Mus musculus
aaggacatagtttcaggcaccagta

SEQ ID NO: 166610 - DNA, 25 bp, Mus musculus
aaggacatcgtcacgagctgaggtc

SEQ ID NO: 166611 - DNA, 25 bp, Mus musculus
aaggacatctggaagtaacttgaat

SEQ ID NO: 166612 - DNA, 25 bp, Mus musculus
aaggacattagattgatcagggacc

SEQ ID NO: 166613 - DNA, 25 bp, Mus musculus
aaggacattgagacagaaagacatg

SEQ ID NO: 166614 - DNA, 25 bp, Mus musculus
aaggaccacagagggtggctgtctg

SEQ ID NO: 166615 - DNA, 25 bp, Mus musculus
aaggaccacccagctgtggctgcga

SEQ ID NO: 166616 - DNA, 25 bp, Mus musculus
aaggaccaggacaaaggccttcatc

SEQ ID NO: 166617 - DNA, 25 bp, Mus musculus
aaggaccatgatgatttctggctct

SEQ ID NO: 166618 - DNA, 25 bp, Mus musculus
aaggaccatgcaggttcgcaacgtt

SEQ ID NO: 166619 - DNA, 25 bp, Mus musculus
aaggaccatggcatcaaccctagga

SEQ ID NO: 166620 - DNA, 25 bp, Mus musculus
aaggaccattctggatgcagaccac

SEQ ID NO: 166621 - DNA, 25 bp, Mus musculus
aaggacccaagcaaccgacgccgag

SEQ ID NO: 166622 - DNA, 25 bp, Mus musculus
aaggacccagggaaggtgctgtggg

SEQ ID NO: 166623 - DNA, 25 bp, Mus musculus
aaggacccggagggttgctatcggc

SEQ ID NO: 166624 - DNA, 25 bp, Mus musculus
aaggacccgtgtgagaaagtcagct

SEQ ID NO: 166625 - DNA, 25 bp, Mus musculus
aaggacccgtgtgaggctgaaaaga

SEQ ID NO: 166626 - DNA, 25 bp, Mus musculus
aaggaccctaacagagtacacacga

SEQ ID NO: 166627 - DNA, 25 bp, Mus musculus
aaggaccctcaggcattatgagaga

SEQ ID NO: 166628 - DNA, 25 bp, Mus musculus
aaggaccctcaggtactaggcggcc

SEQ ID NO: 166629 - DNA, 25 bp, Mus musculus
aaggaccgagagggttacacatcat

SEQ ID NO: 166630 - DNA, 25 bp, Mus musculus
aaggaccgagaggtgagacgtggaa

SEQ ID NO: 166631 - DNA, 25 bp, Mus musculus
aaggaccgagaggtgatctgtaaat

SEQ ID NO: 166632 - DNA, 25 bp, Mus musculus
aaggaccgaggattgaagtgagtga

SEQ ID NO: 166633 - DNA, 25 bp, Mus musculus
aaggaccgatcacaggtcacttggc

SEQ ID NO: 166634 - DNA, 25 bp, Mus musculus
aaggaccgcctgagattgtcgcagc

SEQ ID NO: 166635 - DNA, 25 bp, Mus musculus
aaggaccgctacagctcccaagtgc

SEQ ID NO: 166636 - DNA, 25 bp, Mus musculus
aaggacctaagctgcagaatcgagg

SEQ ID NO: 166637 - DNA, 25 bp, Mus musculus
aaggacctactaagatcgagagcga

SEQ ID NO: 166638 - DNA, 25 bp, Mus musculus
aaggacctccaggacctcagggtct

SEQ ID NO: 166639 - DNA, 25 bp, Mus musculus
aaggacctcccacagtgttatcttt

SEQ ID NO: 166640 - DNA, 25 bp, Mus musculus
aaggacctggaactgctggcctctg

SEQ ID NO: 166641 - DNA, 25 bp, Mus musculus
aaggaccttctcttggtcttcatgc

SEQ ID NO: 166642 - DNA, 25 bp, Mus musculus
aaggacgacagatctatgtaagagc

SEQ ID NO: 166643 - DNA, 25 bp, Mus musculus
aaggacgacagggccccaaaggaga

SEQ ID NO: 166644 - DNA, 25 bp, Mus musculus
aaggacgagaaaacgcagaggtgac

SEQ ID NO: 166645 - DNA, 25 bp, Mus musculus
aaggacgagaaggaccacttgattg

SEQ ID NO: 166646 - DNA, 25 bp, Mus musculus
aaggacgatgatgtttgtgatcctg

SEQ ID NO: 166647 - DNA, 25 bp, Mus musculus
aaggacgatttggggctcatcacaa

SEQ ID NO: 166648 - DNA, 25 bp, Mus musculus
aaggacgatttgggtgtcctgctcc

SEQ ID NO: 166649 - DNA, 25 bp, Mus musculus
aaggacgcaaggaaatgcccggaac

SEQ ID NO: 166650 - DNA, 25 bp, Mus musculus
aaggacggaataggggtcgaggatg

SEQ ID NO: 166651 - DNA, 25 bp, Mus musculus
aaggacggtcctagcctcagcgttc

SEQ ID NO: 166652 - DNA, 25 bp, Mus musculus
aaggacggttgtgaggtagatgttg

SEQ ID NO: 166653 - DNA, 25 bp, Mus musculus
aaggacgtctttcagacagacatga

SEQ ID NO: 166654 - DNA, 25 bp, Mus musculus
aaggacgtgccaagcccagcactat

SEQ ID NO: 166655 - DNA, 25 bp, Mus musculus
aaggactatggcagcagttttttat

SEQ ID NO: 166656 - DNA, 25 bp, Mus musculus
aaggactcagatacctgatggcgca

SEQ ID NO: 166657 - DNA, 25 bp, Mus musculus
aaggactcaggctcaaaatggaaag

SEQ ID NO: 166658 - DNA, 25 bp, Mus musculus
aaggactccagaaaacatctcgggc

SEQ ID NO: 166659 - DNA, 25 bp, Mus musculus
aaggactccaggcatgtcatgttac

SEQ ID NO: 166660 - DNA, 25 bp, Mus musculus
aaggactctgatggtgatggccgag

SEQ ID NO: 166661 - DNA, 25 bp, Mus musculus
aaggactgaagggagtggaaaatgt

SEQ ID NO: 166662 - DNA, 25 bp, Mus musculus
aaggactgaccaggttccccaggat

SEQ ID NO: 166663 - DNA, 25 bp, Mus musculus
aaggactgaggcaggcagaagaagc

SEQ ID NO: 166664 - DNA, 25 bp, Mus musculus
aaggactgctaagtcttcagcaaac

SEQ ID NO: 166665 - DNA, 25 bp, Mus musculus
aaggactgggaaagggtgactgtgg

SEQ ID NO: 166666 - DNA, 25 bp, Mus musculus
aaggactgggagagaaatatccacc

SEQ ID NO: 166667 - DNA, 25 bp, Mus musculus
aaggactgggagagggtgttacgtt

SEQ ID NO: 166668 - DNA, 25 bp, Mus musculus
aaggactggtgtgagccttctctga

SEQ ID NO: 166669 - DNA, 25 bp, Mus musculus
aaggactgtggtcaatgtgcggaat

SEQ ID NO: 166670 - DNA, 25 bp, Mus musculus
aaggacttaagggaacgaatggagc

SEQ ID NO: 166671 - DNA, 25 bp, Mus musculus
aaggacttatatatgacattatgca

SEQ ID NO: 166672 - DNA, 25 bp, Mus musculus
aaggacttcactggaccttcaggca

SEQ ID NO: 166673 - DNA, 25 bp, Mus musculus
aaggacttcactggaccttcatctc

SEQ ID NO: 166674 - DNA, 25 bp, Mus musculus
aaggacttccggattaagcaatgca

SEQ ID NO: 166675 - DNA, 25 bp, Mus musculus
aaggacttcctggcgagaaaggtcc

SEQ ID NO: 166676 - DNA, 25 bp, Mus musculus
aaggacttgaggaacttcctgtaga

SEQ ID NO: 166677 - DNA, 25 bp, Mus musculus
aaggactttatggtagcttttccca

SEQ ID NO: 166678 - DNA, 25 bp, Mus musculus
aaggactttatggtctttagtagct

SEQ ID NO: 166679 - DNA, 25 bp, Mus musculus
aaggactttgaaaaccaaatcactg

SEQ ID NO: 166680 - DNA, 25 bp, Mus musculus
aaggactttgaaaacttgtctttgc

SEQ ID NO: 166681 - DNA, 25 bp, Mus musculus
aaggactttgggattttcagaaaga

SEQ ID NO: 166682 - DNA, 25 bp, Mus musculus
aaggagaaaagggtgctcggggatt

SEQ ID NO: 166683 - DNA, 25 bp, Mus musculus
aaggagaaacacagcttttcttctc

SEQ ID NO: 166684 - DNA, 25 bp, Mus musculus
aaggagaaacacaggtggaaaagga

SEQ ID NO: 166685 - DNA, 25 bp, Mus musculus
aaggagaaagcagccgtgaagccgc

SEQ ID NO: 166686 - DNA, 25 bp, Mus musculus
aaggagaaaggaaaggccttcgata

SEQ ID NO: 166687 - DNA, 25 bp, Mus musculus
aaggagaaaggcgccctggctctgg

SEQ ID NO: 166688 - DNA, 25 bp, Mus musculus
aaggagaaaggcgctgacttcctgg

SEQ ID NO: 166689 - DNA, 25 bp, Mus musculus
aaggagaaagtgaggacttttgctg

SEQ ID NO: 166690 - DNA, 25 bp, Mus musculus
aaggagaacaaggctgaatcagaga

SEQ ID NO: 166691 - DNA, 25 bp, Mus musculus
aaggagaacaagtgccagaaccagc

SEQ ID NO: 166692 - DNA, 25 bp, Mus musculus
aaggagaacagcaaacctctgaagg

SEQ ID NO: 166693 - DNA, 25 bp, Mus musculus
aaggagaacagcatgttgttttgct

SEQ ID NO: 166694 - DNA, 25 bp, Mus musculus
aaggagaaccaggagctctggttag

SEQ ID NO: 166695 - DNA, 25 bp, Mus musculus
aaggagaacgggaggctgccggcgt

SEQ ID NO: 166696 - DNA, 25 bp, Mus musculus
aaggagaacgtggacttatggtctg

SEQ ID NO: 166697 - DNA, 25 bp, Mus musculus
aaggagaacgttgacatttggtcag

SEQ ID NO: 166698 - DNA, 25 bp, Mus musculus
aaggagaactgcaggcatcagaagg

SEQ ID NO: 166699 - DNA, 25 bp, Mus musculus
aaggagaactgcaggttctcccatg

SEQ ID NO: 166700 - DNA, 25 bp, Mus musculus
aaggagaagaagaatttggaatttt

SEQ ID NO: 166701 - DNA, 25 bp, Mus musculus
aaggagaagaagcaatgtctgaccg

SEQ ID NO: 166702 - DNA, 25 bp, Mus musculus
aaggagaagaagggctccagcacca

SEQ ID NO: 166703 - DNA, 25 bp, Mus musculus
aaggagaagagaacagaaagccttg

SEQ ID NO: 166704 - DNA, 25 bp, Mus musculus
aaggagaagcaggtctccctgggac

SEQ ID NO: 166705 - DNA, 25 bp, Mus musculus
aaggagaagcccaacaggagggcct

SEQ ID NO: 166706 - DNA, 25 bp, Mus musculus
aaggagaagctggtccctccaggag

SEQ ID NO: 166707 - DNA, 25 bp, Mus musculus
aaggagaagtaaatgacattaaaga

SEQ ID NO: 166708 - DNA, 25 bp, Mus musculus
aaggagaagtaaatgactttaagaa

SEQ ID NO: 166709 - DNA, 25 bp, Mus musculus
aaggagaagtaaatgcttgacaaaa

SEQ ID NO: 166710 - DNA, 25 bp, Mus musculus
aaggagaagtgaacaaagtctggtt

SEQ ID NO: 166711 - DNA, 25 bp, Mus musculus
aaggagaattatgagctacagaagt

SEQ ID NO: 166712 - DNA, 25 bp, Mus musculus
aaggagaattatgaggtctacaagc

SEQ ID NO: 166713 - DNA, 25 bp, Mus musculus
aaggagacaagaccccagcgcatct

SEQ ID NO: 166714 - DNA, 25 bp, Mus musculus
aaggagacaagggtgatatgggacc

SEQ ID NO: 166715 - DNA, 25 bp, Mus musculus
aaggagacacgggcttgccaggtgt

SEQ ID NO: 166716 - DNA, 25 bp, Mus musculus
aaggagacagagcaggtggctgtag

SEQ ID NO: 166717 - DNA, 25 bp, Mus musculus
aaggagacagagcaggtgttttaga

SEQ ID NO: 166718 - DNA, 25 bp, Mus musculus
aaggagacagccatgatcaactggg

SEQ ID NO: 166719 - DNA, 25 bp, Mus musculus
aaggagacagccatgatcctacaga

SEQ ID NO: 166720 - DNA, 25 bp, Mus musculus
aaggagacagcgaggtggattaagt

SEQ ID NO: 166721 - DNA, 25 bp, Mus musculus
aaggagacagcttggtcacatacca

SEQ ID NO: 166722 - DNA, 25 bp, Mus musculus
aaggagaccagaaggactccatgaa

SEQ ID NO: 166723 - DNA, 25 bp, Mus musculus
aaggagaccagagcctcagcttaag

SEQ ID NO: 166724 - DNA, 25 bp, Mus musculus
aaggagactcttacggaattaattc

SEQ ID NO: 166725 - DNA, 25 bp, Mus musculus
aaggagactcttacggtcttaccac

SEQ ID NO: 166726 - DNA, 25 bp, Mus musculus
aaggagactgaaggccttcggatgc

SEQ ID NO: 166727 - DNA, 25 bp, Mus musculus
aaggagactgaaggtgctgggggga

SEQ ID NO: 166728 - DNA, 25 bp, Mus musculus
aaggagactggctgtgcttgccatc

SEQ ID NO: 166729 - DNA, 25 bp, Mus musculus
aaggagactggcttttcagtttccc

SEQ ID NO: 166730 - DNA, 25 bp, Mus musculus
aaggagactggcttttcccacagtc

SEQ ID NO: 166731 - DNA, 25 bp, Mus musculus
aaggagacttggagacccagaccca

SEQ ID NO: 166732 - DNA, 25 bp, Mus musculus
aaggagacttggagctgaccacagt

SEQ ID NO: 166733 - DNA, 25 bp, Mus musculus
aaggagagaaaacggtgtattgagg

SEQ ID NO: 166734 - DNA, 25 bp, Mus musculus
aaggagagaaaagattaatacacaa

SEQ ID NO: 166735 - DNA, 25 bp, Mus musculus
aaggagagaaaagcatctgtccatc

SEQ ID NO: 166736 - DNA, 25 bp, Mus musculus
aaggagagaaagatcagccacaacc

SEQ ID NO: 166737 - DNA, 25 bp, Mus musculus
aaggagagaagggccaatcaggcga

SEQ ID NO: 166738 - DNA, 25 bp, Mus musculus
aaggagagacagcagtcttcccaga

SEQ ID NO: 166739 - DNA, 25 bp, Mus musculus
aaggagagagccatcattgacatgt

SEQ ID NO: 166740 - DNA, 25 bp, Mus musculus
aaggagagagctttccctcctccac

SEQ ID NO: 166741 - DNA, 25 bp, Mus musculus
aaggagagaggagcaagtgtcgttc

SEQ ID NO: 166742 - DNA, 25 bp, Mus musculus
aaggagagaggcagatgtgagccca

SEQ ID NO: 166743 - DNA, 25 bp, Mus musculus
aaggagagcaaggctctgtacaact

SEQ ID NO: 166744 - DNA, 25 bp, Mus musculus
aaggagagcacagcgttgaatctgc

SEQ ID NO: 166745 - DNA, 25 bp, Mus musculus
aaggagagcctgggcccccagattg

SEQ ID NO: 166746 - DNA, 25 bp, Mus musculus
aaggagagcctgtgtgctgatattt

SEQ ID NO: 166747 - DNA, 25 bp, Mus musculus
aaggagagctaacatttagaggaga

SEQ ID NO: 166748 - DNA, 25 bp, Mus musculus
aaggagagctcacattcaggggttg

SEQ ID NO: 166749 - DNA, 25 bp, Mus musculus
aaggagagggaagtccagcggtggt

SEQ ID NO: 166750 - DNA, 25 bp, Mus musculus
aaggagagtcgggtgttaggagcaa

SEQ ID NO: 166751 - DNA, 25 bp, Mus musculus
aaggagataaaaggacggactgtgg

SEQ ID NO: 166752 - DNA, 25 bp, Mus musculus
aaggagatcagggcatcacaggtcc

SEQ ID NO: 166753 - DNA, 25 bp, Mus musculus
aaggagatcaggtaatcacaggtcc

SEQ ID NO: 166754 - DNA, 25 bp, Mus musculus
aaggagatccgagagactacaggag

SEQ ID NO: 166755 - DNA, 25 bp, Mus musculus
aaggagatgaagaaatccatgcgac

SEQ ID NO: 166756 - DNA, 25 bp, Mus musculus
aaggagatgaagggttggtgaaatt

SEQ ID NO: 166757 - DNA, 25 bp, Mus musculus
aaggagatgccccagctgaaaaaaa

SEQ ID NO: 166758 - DNA, 25 bp, Mus musculus
aaggagatgccccagctgagaaaaa

SEQ ID NO: 166759 - DNA, 25 bp, Mus musculus
aaggagatggaggcaaccaaactga

SEQ ID NO: 166760 - DNA, 25 bp, Mus musculus
aaggagatgtgggagcgagaggcgt

SEQ ID NO: 166761 - DNA, 25 bp, Mus musculus
aaggagattccagcctccaccgtcg

SEQ ID NO: 166762 - DNA, 25 bp, Mus musculus
aaggagattccagtactacagagcc

SEQ ID NO: 166763 - DNA, 25 bp, Mus musculus
aaggagattgagaagtggatgacta

SEQ ID NO: 166764 - DNA, 25 bp, Mus musculus
aaggagattgagaagtttctagatc

SEQ ID NO: 166765 - DNA, 25 bp, Mus musculus
aaggagattgcccaggatgccctga

SEQ ID NO: 166766 - DNA, 25 bp, Mus musculus
aaggagcaaggggtcagccaggggc

SEQ ID NO: 166767 - DNA, 25 bp, Mus musculus
aaggagcacctaagggcagccagtc

SEQ ID NO: 166768 - DNA, 25 bp, Mus musculus
aaggagcacctaagggtgctggaga

SEQ ID NO: 166769 - DNA, 25 bp, Mus musculus
aaggagcagcacaaggccgaggccg

SEQ ID NO: 166770 - DNA, 25 bp, Mus musculus
aaggagcagcccggacaccaaggac

SEQ ID NO: 166771 - DNA, 25 bp, Mus musculus
aaggagcagctgcccagagcataaa

SEQ ID NO: 166772 - DNA, 25 bp, Mus musculus
aaggagcagcttggctatattgtct

SEQ ID NO: 166773 - DNA, 25 bp, Mus musculus
aaggagcaggacatggctgccaact

SEQ ID NO: 166774 - DNA, 25 bp, Mus musculus
aaggagcagtctcatggagccagat

SEQ ID NO: 166775 - DNA, 25 bp, Mus musculus
aaggagcataactcaggtccaaagg

SEQ ID NO: 166776 - DNA, 25 bp, Mus musculus
aaggagcatcagaatttcagatgac

SEQ ID NO: 166777 - DNA, 25 bp, Mus musculus
aaggagcatcagattccagaatttg

SEQ ID NO: 166778 - DNA, 25 bp, Mus musculus
aaggagcattttgagaaagcaattg

SEQ ID NO: 166779 - DNA, 25 bp, Mus musculus
aaggagcattttgaggttttctctg

SEQ ID NO: 166780 - DNA, 25 bp, Mus musculus
aaggagccaaactaggaaatgccgc

SEQ ID NO: 166781 - DNA, 25 bp, Mus musculus
aaggagccaagaggagtgaatggtg

SEQ ID NO: 166782 - DNA, 25 bp, Mus musculus
aaggagccaagaggggtctccaatg

SEQ ID NO: 166783 - DNA, 25 bp, Mus musculus
aaggagccagaagcgacttgaagag

SEQ ID NO: 166784 - DNA, 25 bp, Mus musculus
aaggagccagatgagaaaaccaagg

SEQ ID NO: 166785 - DNA, 25 bp, Mus musculus
aaggagccagcttcacttcttcctt

SEQ ID NO: 166786 - DNA, 25 bp, Mus musculus
aaggagccagctttcttggattcca

SEQ ID NO: 166787 - DNA, 25 bp, Mus musculus
aaggagcccaggccggctcaacatt

SEQ ID NO: 166788 - DNA, 25 bp, Mus musculus
aaggagccccgcagggccagttcct

SEQ ID NO: 166789 - DNA, 25 bp, Mus musculus
aaggagccctgcaggtactccctgg

SEQ ID NO: 166790 - DNA, 25 bp, Mus musculus
aaggagccgagtgcagttcctccat

SEQ ID NO: 166791 - DNA, 25 bp, Mus musculus
aaggagccgctggcttacagggttc

SEQ ID NO: 166792 - DNA, 25 bp, Mus musculus
aaggagcctaaggaaccacgggaag

SEQ ID NO: 166793 - DNA, 25 bp, Mus musculus
aaggagcctgttttggacccaacag

SEQ ID NO: 166794 - DNA, 25 bp, Mus musculus
aaggagccttagctgccagcggcaa

SEQ ID NO: 166795 - DNA, 25 bp, Mus musculus
aaggagccttgccctgtgtgtcaaa

SEQ ID NO: 166796 - DNA, 25 bp, Mus musculus
aaggagcgagagtaccccaggctgg

SEQ ID NO: 166797 - DNA, 25 bp, Mus musculus
aaggagcgagagtttccactgtatc

SEQ ID NO: 166798 - DNA, 25 bp, Mus musculus
aaggagcggacgtgacgtatgactt

SEQ ID NO: 166799 - DNA, 25 bp, Mus musculus
aaggagcggcaaaagagctttatgg

SEQ ID NO: 166800 - DNA, 25 bp, Mus musculus
aaggagcggcaaaagagtgatagaa

SEQ ID NO: 166801 - DNA, 25 bp, Mus musculus
aaggagcggcacatttgacctgctg

SEQ ID NO: 166802 - DNA, 25 bp, Mus musculus
aaggagcgggcaggatcctcttcgc

SEQ ID NO: 166803 - DNA, 25 bp, Mus musculus
aaggagcgggcaggggcctccctgt

SEQ ID NO: 166804 - DNA, 25 bp, Mus musculus
aaggagctagactctgaggaccaag

SEQ ID NO: 166805 - DNA, 25 bp, Mus musculus
aaggagctagactctgagtacagca

SEQ ID NO: 166806 - DNA, 25 bp, Mus musculus
aaggagctaggatgaacagcaactt

SEQ ID NO: 166807 - DNA, 25 bp, Mus musculus
aaggagctagtgacattcattttta

SEQ ID NO: 166808 - DNA, 25 bp, Mus musculus
aaggagctcagaaggagtgaaaagg

SEQ ID NO: 166809 - DNA, 25 bp, Mus musculus
aaggagctcagcaagtattcgactc

SEQ ID NO: 166810 - DNA, 25 bp, Mus musculus
aaggagctcatgaaggagctctttg

SEQ ID NO: 166811 - DNA, 25 bp, Mus musculus
aaggagctcttcctgggcctctcca

SEQ ID NO: 166812 - DNA, 25 bp, Mus musculus
aaggagctgaacaagtactctacgc

SEQ ID NO: 166813 - DNA, 25 bp, Mus musculus
aaggagctgacaggggttccacagc

SEQ ID NO: 166814 - DNA, 25 bp, Mus musculus
aaggagctgaggtgggctggtatgt

SEQ ID NO: 166815 - DNA, 25 bp, Mus musculus
aaggagctgcaggagaagaggagga

SEQ ID NO: 166816 - DNA, 25 bp, Mus musculus
aaggagctggaggaggtgcgctcca

SEQ ID NO: 166817 - DNA, 25 bp, Mus musculus
aaggagctgggagactccctgacaa

SEQ ID NO: 166818 - DNA, 25 bp, Mus musculus
aaggagctggtacagacttacgttc

SEQ ID NO: 166819 - DNA, 25 bp, Mus musculus
aaggagctgtataaggtacatttga

SEQ ID NO: 166820 - DNA, 25 bp, Mus musculus
aaggagctgttcagagtaggtggcg

SEQ ID NO: 166821 - DNA, 25 bp, Mus musculus
aaggagcttagtgctttgggctccg

SEQ ID NO: 166822 - DNA, 25 bp, Mus musculus
aaggagcttcaggcacgcatcgagg

SEQ ID NO: 166823 - DNA, 25 bp, Mus musculus
aaggagcttgctaatgacggtgcag

SEQ ID NO: 166824 - DNA, 25 bp, Mus musculus
aaggaggaaaatgggatggagacaa

SEQ ID NO: 166825 - DNA, 25 bp, Mus musculus
aaggaggaaaatggtgaggaggttg

SEQ ID NO: 166826 - DNA, 25 bp, Mus musculus
aaggaggaagagagacgggtccagt

SEQ ID NO: 166827 - DNA, 25 bp, Mus musculus
aaggaggaagcagagggctgagccc

SEQ ID NO: 166828 - DNA, 25 bp, Mus musculus
aaggaggacagattaattgtggtga

SEQ ID NO: 166829 - DNA, 25 bp, Mus musculus
aaggaggacagcagtaccagcgctg

SEQ ID NO: 166830 - DNA, 25 bp, Mus musculus
aaggaggacagctacaagcccatcg

SEQ ID NO: 166831 - DNA, 25 bp, Mus musculus
aaggaggacaggacaaaagaggctg

SEQ ID NO: 166832 - DNA, 25 bp, Mus musculus
aaggaggacggtgtgccgatgctct

SEQ ID NO: 166833 - DNA, 25 bp, Mus musculus
aaggaggagagatactgttatctgt

SEQ ID NO: 166834 - DNA, 25 bp, Mus musculus
aaggaggagagcaataaactggtct

SEQ ID NO: 166835 - DNA, 25 bp, Mus musculus
aaggaggagagcaccaatggaacag

SEQ ID NO: 166836 - DNA, 25 bp, Mus musculus
aaggaggagaggctgtgacctctct

SEQ ID NO: 166837 - DNA, 25 bp, Mus musculus
aaggaggagagttgctcttctggat

SEQ ID NO: 166838 - DNA, 25 bp, Mus musculus
aaggaggaggagggcagaaggctgg

SEQ ID NO: 166839 - DNA, 25 bp, Mus musculus
aaggaggaggagtcaagttggaccc

SEQ ID NO: 166840 - DNA, 25 bp, Mus musculus
aaggaggaggatggcttccgccttt

SEQ ID NO: 166841 - DNA, 25 bp, Mus musculus
aaggaggaggcagagcgcccgctgc

SEQ ID NO: 166842 - DNA, 25 bp, Mus musculus
aaggaggaggccgaagaagcactta

SEQ ID NO: 166843 - DNA, 25 bp, Mus musculus
aaggaggattattaattggaggctc

SEQ ID NO: 166844 - DNA, 25 bp, Mus musculus
aaggaggattctgataatcagcctt

SEQ ID NO: 166845 - DNA, 25 bp, Mus musculus
aaggaggattgtgacctgcctgttc

SEQ ID NO: 166846 - DNA, 25 bp, Mus musculus
aaggaggcagtcttggattacctgt

SEQ ID NO: 166847 - DNA, 25 bp, Mus musculus
aaggaggcagtgttttgtcaagtta

SEQ ID NO: 166848 - DNA, 25 bp, Mus musculus
aaggaggccaagcctttcatcacct

SEQ ID NO: 166849 - DNA, 25 bp, Mus musculus
aaggaggccatgagcataccaacat

SEQ ID NO: 166850 - DNA, 25 bp, Mus musculus
aaggaggccatgagcatccagaggt

SEQ ID NO: 166851 - DNA, 25 bp, Mus musculus
aaggaggccatgagcgtaatctgca

SEQ ID NO: 166852 - DNA, 25 bp, Mus musculus
aaggaggccgagcagaaggagggag

SEQ ID NO: 166853 - DNA, 25 bp, Mus musculus
aaggagggaagataattatgccacc

SEQ ID NO: 166854 - DNA, 25 bp, Mus musculus
aaggagggcaaaggtcccaatgctc

SEQ ID NO: 166855 - DNA, 25 bp, Mus musculus
aaggagggcacaggctggcaacatg

SEQ ID NO: 166856 - DNA, 25 bp, Mus musculus
aaggagggcagaatctagatcttga

SEQ ID NO: 166857 - DNA, 25 bp, Mus musculus
aaggagggcctggtttctcacttga

SEQ ID NO: 166858 - DNA, 25 bp, Mus musculus
aaggaggggaaaatgcgtcccatga

SEQ ID NO: 166859 - DNA, 25 bp, Mus musculus
aaggaggggaaaatggcattgtatc

SEQ ID NO: 166860 - DNA, 25 bp, Mus musculus
aaggaggggaaaatgttttcgcatt

SEQ ID NO: 166861 - DNA, 25 bp, Mus musculus
aaggaggggaaagaggtgctggtgg

SEQ ID NO: 166862 - DNA, 25 bp, Mus musculus
aaggaggggacgcgaggcgaggccg

SEQ ID NO: 166863 - DNA, 25 bp, Mus musculus
aaggaggtagaagaggaacgtacga

SEQ ID NO: 166864 - DNA, 25 bp, Mus musculus
aaggaggtccagctgctcggcactg

SEQ ID NO: 166865 - DNA, 25 bp, Mus musculus
aaggaggtccagctgttcatgactg

SEQ ID NO: 166866 - DNA, 25 bp, Mus musculus
aaggaggtccggagtcaccggcctg

SEQ ID NO: 166867 - DNA, 25 bp, Mus musculus
aaggaggtgaagcccaggacccagg

SEQ ID NO: 166868 - DNA, 25 bp, Mus musculus
aaggaggtgaagtatttaggtcagt

SEQ ID NO: 166869 - DNA, 25 bp, Mus musculus
aaggaggtggcaatgccccagttcc

SEQ ID NO: 166870 - DNA, 25 bp, Mus musculus
aaggaggtggcaatggaaaaagatc

SEQ ID NO: 166871 - DNA, 25 bp, Mus musculus
aaggaggtggcagggttaaggcagc

SEQ ID NO: 166872 - DNA, 25 bp, Mus musculus
aaggagtacaccaccacgcccggct

SEQ ID NO: 166873 - DNA, 25 bp, Mus musculus
aaggagtacgaggagattatgcggg

SEQ ID NO: 166874 - DNA, 25 bp, Mus musculus
aaggagtatgagggagccgtctacc

SEQ ID NO: 166875 - DNA, 25 bp, Mus musculus
aaggagtattcatggctgctcgctg

SEQ ID NO: 166876 - DNA, 25 bp, Mus musculus
aaggagtcacctctgtctggtagca

SEQ ID NO: 166877 - DNA, 25 bp, Mus musculus
aaggagtccatggcaacgggcagca

SEQ ID NO: 166878 - DNA, 25 bp, Mus musculus
aaggagtcggtgcttggctctggct

SEQ ID NO: 166879 - DNA, 25 bp, Mus musculus
aaggagtgaggagtcaccactactt

SEQ ID NO: 166880 - DNA, 25 bp, Mus musculus
aaggagtgccaaggccggcagagga

SEQ ID NO: 166881 - DNA, 25 bp, Mus musculus
aaggagtgggggtgggcttaggctc

SEQ ID NO: 166882 - DNA, 25 bp, Mus musculus
aaggagttagaaacaggtgagaact

SEQ ID NO: 166883 - DNA, 25 bp, Mus musculus
aaggagttcaggaggacccgctctc

SEQ ID NO: 166884 - DNA, 25 bp, Mus musculus
aaggagttgaaagattcccccacag

SEQ ID NO: 166885 - DNA, 25 bp, Mus musculus
aaggagttgaaaggagtgagcagcg

SEQ ID NO: 166886 - DNA, 25 bp, Mus musculus
aaggataactcaattcctctattgt

SEQ ID NO: 166887 - DNA, 25 bp, Mus musculus
aaggataactctctggacgcccctg

SEQ ID NO: 166888 - DNA, 25 bp, Mus musculus
aaggataataaacaaatttctttca

SEQ ID NO: 166889 - DNA, 25 bp, Mus musculus
aaggataccctgctgggggctctct

SEQ ID NO: 166890 - DNA, 25 bp, Mus musculus
aaggatacgagcaatcatttccatg

SEQ ID NO: 166891 - DNA, 25 bp, Mus musculus
aaggatacgagcagtagtaccgttg

SEQ ID NO: 166892 - DNA, 25 bp, Mus musculus
aaggatacgccacaagaactggaac

SEQ ID NO: 166893 - DNA, 25 bp, Mus musculus
aaggatacgccacaagtaatcagcc

SEQ ID NO: 166894 - DNA, 25 bp, Mus musculus
aaggatactccagatgccaacgcaa

SEQ ID NO: 166895 - DNA, 25 bp, Mus musculus
aaggatatcgacgtgatcatgggtg

SEQ ID NO: 166896 - DNA, 25 bp, Mus musculus
aaggatatcgatggccgccctgtca

SEQ ID NO: 166897 - DNA, 25 bp, Mus musculus
aaggatattagggtctctgctactg

SEQ ID NO: 166898 - DNA, 25 bp, Mus musculus
aaggatattcctaggaccttctacc

SEQ ID NO: 166899 - DNA, 25 bp, Mus musculus
aaggatattttcaggtgaaccagaa

SEQ ID NO: 166900 - DNA, 25 bp, Mus musculus
aaggatcaaaagcaggaggagccat

SEQ ID NO: 166901 - DNA, 25 bp, Mus musculus
aaggatcaaggcagagatgctttat

SEQ ID NO: 166902 - DNA, 25 bp, Mus musculus
aaggatcaaggtcagatctatacct

SEQ ID NO: 166903 - DNA, 25 bp, Mus musculus
aaggatcacaaagacctgtgcccct

SEQ ID NO: 166904 - DNA, 25 bp, Mus musculus
aaggatcacaaagtgagtttcctgc

SEQ ID NO: 166905 - DNA, 25 bp, Mus musculus
aaggatcacgaggttgtacttgttt

SEQ ID NO: 166906 - DNA, 25 bp, Mus musculus
aaggatccagacttggagaagaaca

SEQ ID NO: 166907 - DNA, 25 bp, Mus musculus
aaggatccagatgcagaactctcag

SEQ ID NO: 166908 - DNA, 25 bp, Mus musculus
aaggatccagcgtctgttgacattt

SEQ ID NO: 166909 - DNA, 25 bp, Mus musculus
aaggatccaggaccacaagccagct

SEQ ID NO: 166910 - DNA, 25 bp, Mus musculus
aaggatccagggctcactgatcacc

SEQ ID NO: 166911 - DNA, 25 bp, Mus musculus
aaggatccagtttatttatatggtg

SEQ ID NO: 166912 - DNA, 25 bp, Mus musculus
aaggatccgctggtgctcctggaat

SEQ ID NO: 166913 - DNA, 25 bp, Mus musculus
aaggatccggatggagcttttaagg

SEQ ID NO: 166914 - DNA, 25 bp, Mus musculus
aaggatccggatgggtatagtgcca

SEQ ID NO: 166915 - DNA, 25 bp, Mus musculus
aaggatcctgaccccgaacttctca

SEQ ID NO: 166916 - DNA, 25 bp, Mus musculus
aaggatctacagaagagagacatct

SEQ ID NO: 166917 - DNA, 25 bp, Mus musculus
aaggatctagatgagaatgaagttg

SEQ ID NO: 166918 - DNA, 25 bp, Mus musculus
aaggatcttcagagggttcccagcc

SEQ ID NO: 166919 - DNA, 25 bp, Mus musculus
aaggatcttctgaaagctctgtaca

SEQ ID NO: 166920 - DNA, 25 bp, Mus musculus
aaggatgaaaagcttattcgtctga

SEQ ID NO: 166921 - DNA, 25 bp, Mus musculus
aaggatgaagagctaaggcgcatgc

SEQ ID NO: 166922 - DNA, 25 bp, Mus musculus
aaggatgaagagggccccgtggggc

SEQ ID NO: 166923 - DNA, 25 bp, Mus musculus
aaggatgaagattcctatcacatat

SEQ ID NO: 166924 - DNA, 25 bp, Mus musculus
aaggatgacaaaaaggtttgcacct

SEQ ID NO: 166925 - DNA, 25 bp, Mus musculus
aaggatgacctgggccttttgctcg

SEQ ID NO: 166926 - DNA, 25 bp, Mus musculus
aaggatgacttggagattttgcatg

SEQ ID NO: 166927 - DNA, 25 bp, Mus musculus
aaggatgagcaagatgaacgagacc

SEQ ID NO: 166928 - DNA, 25 bp, Mus musculus
aaggatgagctgggttcaggaggtg

SEQ ID NO: 166929 - DNA, 25 bp, Mus musculus
aaggatgaggaggagaaagaaaaga

SEQ ID NO: 166930 - DNA, 25 bp, Mus musculus
aaggatgagtgggtggaagagcaga

SEQ ID NO: 166931 - DNA, 25 bp, Mus musculus
aaggatgagttgcttcagaggttca

SEQ ID NO: 166932 - DNA, 25 bp, Mus musculus
aaggatgatgagctgaactttgacc

SEQ ID NO: 166933 - DNA, 25 bp, Mus musculus
aaggatgatgaggagaaagagaaga

SEQ ID NO: 166934 - DNA, 25 bp, Mus musculus
aaggatgatgatggaaaggaagaag

SEQ ID NO: 166935 - DNA, 25 bp, Mus musculus
aaggatgatgatggtacaaaatgct

SEQ ID NO: 166936 - DNA, 25 bp, Mus musculus
aaggatgatgggccagatcatctgt

SEQ ID NO: 166937 - DNA, 25 bp, Mus musculus
aaggatgattgatctgatggaacaa

SEQ ID NO: 166938 - DNA, 25 bp, Mus musculus
aaggatgcagaaaatgtaggccgct

SEQ ID NO: 166939 - DNA, 25 bp, Mus musculus
aaggatgccagcccaaaccaggtgg

SEQ ID NO: 166940 - DNA, 25 bp, Mus musculus
aaggatgccagccctccagggccag

SEQ ID NO: 166941 - DNA, 25 bp, Mus musculus
aaggatgcctggcggaaagcttccc

SEQ ID NO: 166942 - DNA, 25 bp, Mus musculus
aaggatgctgggaagtccgtgggca

SEQ ID NO: 166943 - DNA, 25 bp, Mus musculus
aaggatggaaagaaagatctgatgt

SEQ ID NO: 166944 - DNA, 25 bp, Mus musculus
aaggatggaaagagcttaacaaaag

SEQ ID NO: 166945 - DNA, 25 bp, Mus musculus
aaggatggaaaggtgaagctggaga

SEQ ID NO: 166946 - DNA, 25 bp, Mus musculus
aaggatggaacggtgtggaccgtgt

SEQ ID NO: 166947 - DNA, 25 bp, Mus musculus
aaggatggacaaagctggtcagtac

SEQ ID NO: 166948 - DNA, 25 bp, Mus musculus
aaggatggacacattcattacttcc

SEQ ID NO: 166949 - DNA, 25 bp, Mus musculus
aaggatggagatcccccaggtccaa

SEQ ID NO: 166950 - DNA, 25 bp, Mus musculus
aaggatggagccaaacatttctcgg

SEQ ID NO: 166951 - DNA, 25 bp, Mus musculus
aaggatggagccaaagaatgaataa

SEQ ID NO: 166952 - DNA, 25 bp, Mus musculus
aaggatggcggccgaggtctgactg

SEQ ID NO: 166953 - DNA, 25 bp, Mus musculus
aaggatggcggtgttagaacaacgg

SEQ ID NO: 166954 - DNA, 25 bp, Mus musculus
aaggatggtgagctccctgtggagg

SEQ ID NO: 166955 - DNA, 25 bp, Mus musculus
aaggatgtacaggggagcagcgcgg

SEQ ID NO: 166956 - DNA, 25 bp, Mus musculus
aaggatgtagaaaagaagctcaata

SEQ ID NO: 166957 - DNA, 25 bp, Mus musculus
aaggatgtctgtgagcagtctcgaa

SEQ ID NO: 166958 - DNA, 25 bp, Mus musculus
aaggatgtgatggaggatgtggtgg

SEQ ID NO: 166959 - DNA, 25 bp, Mus musculus
aaggatgtggatgggttgacgagcg

SEQ ID NO: 166960 - DNA, 25 bp, Mus musculus
aaggattaattagaaaaggaggcgc

SEQ ID NO: 166961 - DNA, 25 bp, Mus musculus
aaggattagggatcttggcaaccat

SEQ ID NO: 166962 - DNA, 25 bp, Mus musculus
aaggattatggtaccaagcgccttg

SEQ ID NO: 166963 - DNA, 25 bp, Mus musculus
aaggattcaggctaaaaccgactct

SEQ ID NO: 166964 - DNA, 25 bp, Mus musculus
aaggattcatgaaagtcctgaagtg

SEQ ID NO: 166965 - DNA, 25 bp, Mus musculus
aaggattccaagctaccacagtgaa

SEQ ID NO: 166966 - DNA, 25 bp, Mus musculus
aaggattccaagctcctactactca

SEQ ID NO: 166967 - DNA, 25 bp, Mus musculus
aaggattcccaggtgctcctggctc

SEQ ID NO: 166968 - DNA, 25 bp, Mus musculus
aaggattctaaaaggaatattattg

SEQ ID NO: 166969 - DNA, 25 bp, Mus musculus
aaggattctatgacccctcaccatc

SEQ ID NO: 166970 - DNA, 25 bp, Mus musculus
aaggattctatgctgggcacacagg

SEQ ID NO: 166971 - DNA, 25 bp, Mus musculus
aaggattctgctcttgctgtccatc

SEQ ID NO: 166972 - DNA, 25 bp, Mus musculus
aaggattctgggaggctccccagca

SEQ ID NO: 166973 - DNA, 25 bp, Mus musculus
aaggattcttccttgaaatttgcct

SEQ ID NO: 166974 - DNA, 25 bp, Mus musculus
aaggattgtcccgaaagggtctcct

SEQ ID NO: 166975 - DNA, 25 bp, Mus musculus
aaggattgtcccgatgtgaaacatt

SEQ ID NO: 166976 - DNA, 25 bp, Mus musculus
aaggattgtgatatcgtgtcccgag

SEQ ID NO: 166977 - DNA, 25 bp, Mus musculus
aaggatttcccaggtaagcttcaag

SEQ ID NO: 166978 - DNA, 25 bp, Mus musculus
aaggatttcctgattccacgaggac

SEQ ID NO: 166979 - DNA, 25 bp, Mus musculus
aaggattttgagaacctgggtgtgg

SEQ ID NO: 166980 - DNA, 25 bp, Mus musculus
aaggattttgatcactggaggtgca

SEQ ID NO: 166981 - DNA, 25 bp, Mus musculus
aaggattttggcaggaagagaaatg

SEQ ID NO: 166982 - DNA, 25 bp, Mus musculus
aaggattttgttgaccagatatatc

SEQ ID NO: 166983 - DNA, 25 bp, Mus musculus
aaggatttttctagcaagttgcgaa

SEQ ID NO: 166984 - DNA, 25 bp, Mus musculus
aaggatttttctaggacatgtatgc

SEQ ID NO: 166985 - DNA, 25 bp, Mus musculus
aaggatttttgtcctacttggagga

SEQ ID NO: 166986 - DNA, 25 bp, Mus musculus
aaggcaaaaaaagtggacgctcagg

SEQ ID NO: 166987 - DNA, 25 bp, Mus musculus
aaggcaaaaaggccaaagcctcact

SEQ ID NO: 166988 - DNA, 25 bp, Mus musculus
aaggcaaaagcacgtacctgtttgc

SEQ ID NO: 166989 - DNA, 25 bp, Mus musculus
aaggcaaaagcaggtacctgtttgc

SEQ ID NO: 166990 - DNA, 25 bp, Mus musculus
aaggcaaaattggaaagagaacttg

SEQ ID NO: 166991 - DNA, 25 bp, Mus musculus
aaggcaaaattgtctgtccactctg

SEQ ID NO: 166992 - DNA, 25 bp, Mus musculus
aaggcaaacaacagggcagcagaag

SEQ ID NO: 166993 - DNA, 25 bp, Mus musculus
aaggcaaacaacagggtggcagacg

SEQ ID NO: 166994 - DNA, 25 bp, Mus musculus
aaggcaaacagacagtgattgtatg

SEQ ID NO: 166995 - DNA, 25 bp, Mus musculus
aaggcaaagacaaggaggcagaaga

SEQ ID NO: 166996 - DNA, 25 bp, Mus musculus
aaggcaaagagagacacaccctgag

SEQ ID NO: 166997 - DNA, 25 bp, Mus musculus
aaggcaaagaggaacagagtgtttg

SEQ ID NO: 166998 - DNA, 25 bp, Mus musculus
aaggcaaagatccagacaaggaggg

SEQ ID NO: 166999 - DNA, 25 bp, Mus musculus
aaggcaaagatgcagctgtgtcggc

SEQ ID NO: 167000 - DNA, 25 bp, Mus musculus
aaggcaaagccgacgcagtatgaga

SEQ ID NO: 167001 - DNA, 25 bp, Mus musculus
aaggcaaatgctatgctggatgaag

SEQ ID NO: 167002 - DNA, 25 bp, Mus musculus
aaggcaaatgtccctccacctcctg

SEQ ID NO: 167003 - DNA, 25 bp, Mus musculus
aaggcaacaagatgaagaacaacga

SEQ ID NO: 167004 - DNA, 25 bp, Mus musculus
aaggcaacaaggatgctacagctat

SEQ ID NO: 167005 - DNA, 25 bp, Mus musculus
aaggcaacacagtgctgctcttagc

SEQ ID NO: 167006 - DNA, 25 bp, Mus musculus
aaggcaacagaatgaagggacctga

SEQ ID NO: 167007 - DNA, 25 bp, Mus musculus
aaggcaacagtgaagggacctgcat

SEQ ID NO: 167008 - DNA, 25 bp, Mus musculus
aaggcaacatcgctgtgggcaaatc

SEQ ID NO: 167009 - DNA, 25 bp, Mus musculus
aaggcaacatcggatggcacttcca

SEQ ID NO: 167010 - DNA, 25 bp, Mus musculus
aaggcaaccaagcattatgagatgc

SEQ ID NO: 167011 - DNA, 25 bp, Mus musculus
aaggcaaccagagtaccagtgatgg

SEQ ID NO: 167012 - DNA, 25 bp, Mus musculus
aaggcaaccgcaggactactggtgc

SEQ ID NO: 167013 - DNA, 25 bp, Mus musculus
aaggcaagaagacagtaaccagttt

SEQ ID NO: 167014 - DNA, 25 bp, Mus musculus
aaggcaagaagagacttgaggcttc

SEQ ID NO: 167015 - DNA, 25 bp, Mus musculus
aaggcaagaagtcctgccacactgg

SEQ ID NO: 167016 - DNA, 25 bp, Mus musculus
aaggcaagacagattacaaaagaag

SEQ ID NO: 167017 - DNA, 25 bp, Mus musculus
aaggcaagatcaaagcctcagcgtt

SEQ ID NO: 167018 - DNA, 25 bp, Mus musculus
aaggcaagatctctcccaatccata

SEQ ID NO: 167019 - DNA, 25 bp, Mus musculus
aaggcaagatctctgccaatccata

SEQ ID NO: 167020 - DNA, 25 bp, Mus musculus
aaggcaaggaaccagaggaattctg

SEQ ID NO: 167021 - DNA, 25 bp, Mus musculus
aaggcaaggaggtggatacgacgct

SEQ ID NO: 167022 - DNA, 25 bp, Mus musculus
aaggcaaggatagcatccatgtctt

SEQ ID NO: 167023 - DNA, 25 bp, Mus musculus
aaggcaaggatagggagcgcctcat

SEQ ID NO: 167024 - DNA, 25 bp, Mus musculus
aaggcaaggggatgaaagcttgcgg

SEQ ID NO: 167025 - DNA, 25 bp, Mus musculus
aaggcaatacgtgtcatagaatgtc

SEQ ID NO: 167026 - DNA, 25 bp, Mus musculus
aaggcaatcgtgaagtcctacctat

SEQ ID NO: 167027 - DNA, 25 bp, Mus musculus
aaggcaatgaaggaagaagaaagaa

SEQ ID NO: 167028 - DNA, 25 bp, Mus musculus
aaggcaatgaaggctccatatattt

SEQ ID NO: 167029 - DNA, 25 bp, Mus musculus
aaggcaatgaaggtaaatgatctcc

SEQ ID NO: 167030 - DNA, 25 bp, Mus musculus
aaggcacaaagtaagcgcaaagcac

SEQ ID NO: 167031 - DNA, 25 bp, Mus musculus
aaggcaccaacaggcctgatgggac

SEQ ID NO: 167032 - DNA, 25 bp, Mus musculus
aaggcaccaacaggggagtatgtgc

SEQ ID NO: 167033 - DNA, 25 bp, Mus musculus
aaggcacccgccgaggtatttcaac

SEQ ID NO: 167034 - DNA, 25 bp, Mus musculus
aaggcacctgaaaacagcaatgcag

SEQ ID NO: 167035 - DNA, 25 bp, Mus musculus
aaggcacctggctgagttcactcac

SEQ ID NO: 167036 - DNA, 25 bp, Mus musculus
aaggcaccttgaagatccttcgtac

SEQ ID NO: 167037 - DNA, 25 bp, Mus musculus
aaggcaccttgggtcctgggccttg

SEQ ID NO: 167038 - DNA, 25 bp, Mus musculus
aaggcacgaaagtgagggaagactc

SEQ ID NO: 167039 - DNA, 25 bp, Mus musculus
aaggcactacagatgttcatctaga

SEQ ID NO: 167040 - DNA, 25 bp, Mus musculus
aaggcactagagccccagatcctgt

SEQ ID NO: 167041 - DNA, 25 bp, Mus musculus
aaggcactagggtgccacctacgcg

SEQ ID NO: 167042 - DNA, 25 bp, Mus musculus
aaggcactatgggagaaataccgac

SEQ ID NO: 167043 - DNA, 25 bp, Mus musculus
aaggcactcatgggtggaggtggga

SEQ ID NO: 167044 - DNA, 25 bp, Mus musculus
aaggcactccagatgaaagcttgcg

SEQ ID NO: 167045 - DNA, 25 bp, Mus musculus
aaggcactccagtcaatgggtcaca

SEQ ID NO: 167046 - DNA, 25 bp, Mus musculus
aaggcactgaagggccacacatggt

SEQ ID NO: 167047 - DNA, 25 bp, Mus musculus
aaggcactggcctcgatctactccc

SEQ ID NO: 167048 - DNA, 25 bp, Mus musculus
aaggcagaagatgcatattgaagct

SEQ ID NO: 167049 - DNA, 25 bp, Mus musculus
aaggcagaagcagaaatgctaatca

SEQ ID NO: 167050 - DNA, 25 bp, Mus musculus
aaggcagaaggtgatgtgggtcctc

SEQ ID NO: 167051 - DNA, 25 bp, Mus musculus
aaggcagacgtattgcagactgtgc

SEQ ID NO: 167052 - DNA, 25 bp, Mus musculus
aaggcagagaactgtgccaagtggt

SEQ ID NO: 167053 - DNA, 25 bp, Mus musculus
aaggcagagcaggttatttcgcttg

SEQ ID NO: 167054 - DNA, 25 bp, Mus musculus
aaggcagaggaggcattatgagaga

SEQ ID NO: 167055 - DNA, 25 bp, Mus musculus
aaggcagaggcaggcgtgcccacac

SEQ ID NO: 167056 - DNA, 25 bp, Mus musculus
aaggcagaggtgaagggaagacaaa

SEQ ID NO: 167057 - DNA, 25 bp, Mus musculus
aaggcagaggttgtatggagagact

SEQ ID NO: 167058 - DNA, 25 bp, Mus musculus
aaggcagagtgctcgatccgacttc

SEQ ID NO: 167059 - DNA, 25 bp, Mus musculus
aaggcagcactggattcccggtcgg

SEQ ID NO: 167060 - DNA, 25 bp, Mus musculus
aaggcagcagagaagaaagcccgct

SEQ ID NO: 167061 - DNA, 25 bp, Mus musculus
aaggcagcagagaagggcggtgctg

SEQ ID NO: 167062 - DNA, 25 bp, Mus musculus
aaggcagcagcagaaggtttgatga

SEQ ID NO: 167063 - DNA, 25 bp, Mus musculus
aaggcagccctggccctgtgggctt

SEQ ID NO: 167064 - DNA, 25 bp, Mus musculus
aaggcagccgacgctgaagctgagg

SEQ ID NO: 167065 - DNA, 25 bp, Mus musculus
aaggcagccggcatatcattgctta

SEQ ID NO: 167066 - DNA, 25 bp, Mus musculus
aaggcagccggcatatccctgattg

SEQ ID NO: 167067 - DNA, 25 bp, Mus musculus
aaggcagccttggctggtcgtttga

SEQ ID NO: 167068 - DNA, 25 bp, Mus musculus
aaggcagcgagcgagtggtgatcat

SEQ ID NO: 167069 - DNA, 25 bp, Mus musculus
aaggcagctagaatgcactggggct

SEQ ID NO: 167070 - DNA, 25 bp, Mus musculus
aaggcagctttgcagcatgctcacg

SEQ ID NO: 167071 - DNA, 25 bp, Mus musculus
aaggcaggaagctgggccggcacat

SEQ ID NO: 167072 - DNA, 25 bp, Mus musculus
aaggcaggagatcgggaagctgcat

SEQ ID NO: 167073 - DNA, 25 bp, Mus musculus
aaggcaggaggctggtcagatctca

SEQ ID NO: 167074 - DNA, 25 bp, Mus musculus
aaggcagtgcagcaggttcaccgtc

SEQ ID NO: 167075 - DNA, 25 bp, Mus musculus
aaggcatatttgagggattttatat

SEQ ID NO: 167076 - DNA, 25 bp, Mus musculus
aaggcatcagatttcgtggatattg

SEQ ID NO: 167077 - DNA, 25 bp, Mus musculus
aaggcatcatggctcacctgtgcca

SEQ ID NO: 167078 - DNA, 25 bp, Mus musculus
aaggcatccacggaagaagtgcctt

SEQ ID NO: 167079 - DNA, 25 bp, Mus musculus
aaggcatccacggccatgggttctc

SEQ ID NO: 167080 - DNA, 25 bp, Mus musculus
aaggcatcctcaaggacacccagtt

SEQ ID NO: 167081 - DNA, 25 bp, Mus musculus
aaggcatctgagtgatataaaaaca

SEQ ID NO: 167082 - DNA, 25 bp, Mus musculus
aaggcatctggcacacctctatagt

SEQ ID NO: 167083 - DNA, 25 bp, Mus musculus
aaggcatctgggagggacattgctt

SEQ ID NO: 167084 - DNA, 25 bp, Mus musculus
aaggcatgatatggttccttgttcc

SEQ ID NO: 167085 - DNA, 25 bp, Mus musculus
aaggcatgggcagaggtatatgtgg

SEQ ID NO: 167086 - DNA, 25 bp, Mus musculus
aaggcatgggctacatgccctcagc

SEQ ID NO: 167087 - DNA, 25 bp, Mus musculus
aaggcatgggctacatggcctcttc

SEQ ID NO: 167088 - DNA, 25 bp, Mus musculus
aaggcatgggctacattgcacactt

SEQ ID NO: 167089 - DNA, 25 bp, Mus musculus
aaggcattgcacaagaaaagaaggc

SEQ ID NO: 167090 - DNA, 25 bp, Mus musculus
aaggcattgctaaaagaggcatcca

SEQ ID NO: 167091 - DNA, 25 bp, Mus musculus
aaggccaaaaatgtcagcagctatg

SEQ ID NO: 167092 - DNA, 25 bp, Mus musculus
aaggccaaaactgtacatcattgac

SEQ ID NO: 167093 - DNA, 25 bp, Mus musculus
aaggccaaaagcctgatagaggaag

SEQ ID NO: 167094 - DNA, 25 bp, Mus musculus
aaggccaaaatgatgaagaaaatac

SEQ ID NO: 167095 - DNA, 25 bp, Mus musculus
aaggccaaaatgatggatgcatccc

SEQ ID NO: 167096 - DNA, 25 bp, Mus musculus
aaggccaaaattagatcatagcagt

SEQ ID NO: 167097 - DNA, 25 bp, Mus musculus
aaggccaaacaaaagccgaaataga

SEQ ID NO: 167098 - DNA, 25 bp, Mus musculus
aaggccaaacaaagagcacagtcag

SEQ ID NO: 167099 - DNA, 25 bp, Mus musculus
aaggccaaacaagttgtcaagttgc

SEQ ID NO: 167100 - DNA, 25 bp, Mus musculus
aaggccaacccagatggcaagaaga

SEQ ID NO: 167101 - DNA, 25 bp, Mus musculus
aaggccaagacatagctcattctgg

SEQ ID NO: 167102 - DNA, 25 bp, Mus musculus
aaggccaagacatagtcttgccatg

SEQ ID NO: 167103 - DNA, 25 bp, Mus musculus
aaggccaagattagattgctttatt

SEQ ID NO: 167104 - DNA, 25 bp, Mus musculus
aaggccaagctggccctgcttgtca

SEQ ID NO: 167105 - DNA, 25 bp, Mus musculus
aaggccaagcttgccctgcttgtca

SEQ ID NO: 167106 - DNA, 25 bp, Mus musculus
aaggccaaggaaggcaccagacctg

SEQ ID NO: 167107 - DNA, 25 bp, Mus musculus
aaggccaagttgtgctggtaactca

SEQ ID NO: 167108 - DNA, 25 bp, Mus musculus
aaggccaatgtgggaagcaaagctg

SEQ ID NO: 167109 - DNA, 25 bp, Mus musculus
aaggccacagatgctgaagctgacg

SEQ ID NO: 167110 - DNA, 25 bp, Mus musculus
aaggccacagccaggagaaactgtc

SEQ ID NO: 167111 - DNA, 25 bp, Mus musculus
aaggccaccgccgcggcatggatgg

SEQ ID NO: 167112 - DNA, 25 bp, Mus musculus
aaggccagacagacgggtccacctc

SEQ ID NO: 167113 - DNA, 25 bp, Mus musculus
aaggccagagcagatgaagtgagag

SEQ ID NO: 167114 - DNA, 25 bp, Mus musculus
aaggccagagcaggctccttaggct

SEQ ID NO: 167115 - DNA, 25 bp, Mus musculus
aaggccagatgctgaaattacccca

SEQ ID NO: 167116 - DNA, 25 bp, Mus musculus
aaggccagatggatgctgttcgaat

SEQ ID NO: 167117 - DNA, 25 bp, Mus musculus
aaggccagatgtgatgctgttgtgt

SEQ ID NO: 167118 - DNA, 25 bp, Mus musculus
aaggccagcagattgtgatatcttt

SEQ ID NO: 167119 - DNA, 25 bp, Mus musculus
aaggccagcagctctgcggagtcgg

SEQ ID NO: 167120 - DNA, 25 bp, Mus musculus
aaggccagcaggtctcataacaaca

SEQ ID NO: 167121 - DNA, 25 bp, Mus musculus
aaggccagctgatcgctggtgttcg

SEQ ID NO: 167122 - DNA, 25 bp, Mus musculus
aaggccaggaggaagaaaattatga

SEQ ID NO: 167123 - DNA, 25 bp, Mus musculus
aaggccaggaggaggacccaggtca

SEQ ID NO: 167124 - DNA, 25 bp, Mus musculus
aaggccaggcggaaaaagtggataa

SEQ ID NO: 167125 - DNA, 25 bp, Mus musculus
aaggccaggcggaaggtgatgttcg

SEQ ID NO: 167126 - DNA, 25 bp, Mus musculus
aaggccagggccattgtgacttctt

SEQ ID NO: 167127 - DNA, 25 bp, Mus musculus
aaggccagggctgaggcttgttccc

SEQ ID NO: 167128 - DNA, 25 bp, Mus musculus
aaggccaggtaaagcctgccgggag

SEQ ID NO: 167129 - DNA, 25 bp, Mus musculus
aaggccaggtacctgggagcccgaa

SEQ ID NO: 167130 - DNA, 25 bp, Mus musculus
aaggccaggtccagaacggaggttc

SEQ ID NO: 167131 - DNA, 25 bp, Mus musculus
aaggccaggtccagctggaccccca

SEQ ID NO: 167132 - DNA, 25 bp, Mus musculus
aaggccagtggatgcgcctatgtac

SEQ ID NO: 167133 - DNA, 25 bp, Mus musculus
aaggccataaagactcactccgaag

SEQ ID NO: 167134 - DNA, 25 bp, Mus musculus
aaggccataaaggcttctggggatg

SEQ ID NO: 167135 - DNA, 25 bp, Mus musculus
aaggccataaggagctggtggggag

SEQ ID NO: 167136 - DNA, 25 bp, Mus musculus
aaggccatcacagatgccgcaatga

SEQ ID NO: 167137 - DNA, 25 bp, Mus musculus
aaggccatcaccagggtgtttccac

SEQ ID NO: 167138 - DNA, 25 bp, Mus musculus
aaggccattggcaggttgtccgatt

SEQ ID NO: 167139 - DNA, 25 bp, Mus musculus
aaggcccaacccagtgacaatgccc

SEQ ID NO: 167140 - DNA, 25 bp, Mus musculus
aaggcccagaaggaggtcaagatgg

SEQ ID NO: 167141 - DNA, 25 bp, Mus musculus
aaggcccaggttgaccaaagaaatg

SEQ ID NO: 167142 - DNA, 25 bp, Mus musculus
aaggcccatgtcttccctacaccag

SEQ ID NO: 167143 - DNA, 25 bp, Mus musculus
aaggcccatgtgaccctgctgacat

SEQ ID NO: 167144 - DNA, 25 bp, Mus musculus
aaggccccacaggctctgcaggaac

SEQ ID NO: 167145 - DNA, 25 bp, Mus musculus
aaggccccagccaagccgcaatgaa

SEQ ID NO: 167146 - DNA, 25 bp, Mus musculus
aaggcccccaacacggcgagcctcg

SEQ ID NO: 167147 - DNA, 25 bp, Mus musculus
aaggcccctagccccatctcttctg

SEQ ID NO: 167148 - DNA, 25 bp, Mus musculus
aaggcccgctggtcggtctgggaac

SEQ ID NO: 167149 - DNA, 25 bp, Mus musculus
aaggcccggcttcgtgtatcctcag

SEQ ID NO: 167150 - DNA, 25 bp, Mus musculus
aaggcccgtggagaggaggtggtgt

SEQ ID NO: 167151 - DNA, 25 bp, Mus musculus
aaggcccgtggagaggtctgcaaac

SEQ ID NO: 167152 - DNA, 25 bp, Mus musculus
aaggccctagcagatgaaaaacgac

SEQ ID NO: 167153 - DNA, 25 bp, Mus musculus
aaggccctcagattgacaaggaaca

SEQ ID NO: 167154 - DNA, 25 bp, Mus musculus
aaggccctgagactgccagcaaatt

SEQ ID NO: 167155 - DNA, 25 bp, Mus musculus
aaggccctgaggtatcaccacagct

SEQ ID NO: 167156 - DNA, 25 bp, Mus musculus
aaggccctggcagatgagcgtgaag

SEQ ID NO: 167157 - DNA, 25 bp, Mus musculus
aaggccctggggaatgtatcattga

SEQ ID NO: 167158 - DNA, 25 bp, Mus musculus
aaggccctgttcagagccctgaaga

SEQ ID NO: 167159 - DNA, 25 bp, Mus musculus
aaggccctttatgaacaaaggaaga

SEQ ID NO: 167160 - DNA, 25 bp, Mus musculus
aaggccctttatggaacagacggag

SEQ ID NO: 167161 - DNA, 25 bp, Mus musculus
aaggccgagaaggagtttcgaaact

SEQ ID NO: 167162 - DNA, 25 bp, Mus musculus
aaggccgcgggaaagagtccagcct

SEQ ID NO: 167163 - DNA, 25 bp, Mus musculus
aaggccgcgggaaaggataaagcat

SEQ ID NO: 167164 - DNA, 25 bp, Mus musculus
aaggccgctacggatacaggttcac

SEQ ID NO: 167165 - DNA, 25 bp, Mus musculus
aaggccggaaggtagcgatggtgga

SEQ ID NO: 167166 - DNA, 25 bp, Mus musculus
aaggccggaggatggaaccaaatga

SEQ ID NO: 167167 - DNA, 25 bp, Mus musculus
aaggccggagttccctcacaacagg

SEQ ID NO: 167168 - DNA, 25 bp, Mus musculus
aaggccggcatcgccgcttacaagc

SEQ ID NO: 167169 - DNA, 25 bp, Mus musculus
aaggccgtcagaactcggtatatca

SEQ ID NO: 167170 - DNA, 25 bp, Mus musculus
aaggccgtcagatgggtttcaaggg

SEQ ID NO: 167171 - DNA, 25 bp, Mus musculus
aaggccgtcagtgcctgatgccacc

SEQ ID NO: 167172 - DNA, 25 bp, Mus musculus
aaggccgttatccagcatttccagg

SEQ ID NO: 167173 - DNA, 25 bp, Mus musculus
aaggccgttcggaaggctgtgggaa

SEQ ID NO: 167174 - DNA, 25 bp, Mus musculus
aaggcctactataagaagatggact

SEQ ID NO: 167175 - DNA, 25 bp, Mus musculus
aaggcctactataagccagattccc

SEQ ID NO: 167176 - DNA, 25 bp, Mus musculus
aaggcctatgaaggaggttccgagt

SEQ ID NO: 167177 - DNA, 25 bp, Mus musculus
aaggcctatgtcagcactttaatgg

SEQ ID NO: 167178 - DNA, 25 bp, Mus musculus
aaggcctcaggtggagccagtgatg

SEQ ID NO: 167179 - DNA, 25 bp, Mus musculus
aaggcctcctcaagctaaagaacgc

SEQ ID NO: 167180 - DNA, 25 bp, Mus musculus
aaggcctcgccagaagccccccagc

SEQ ID NO: 167181 - DNA, 25 bp, Mus musculus
aaggcctcgttctctgaaccttcag

SEQ ID NO: 167182 - DNA, 25 bp, Mus musculus
aaggcctctgtctgggcggcaatct

SEQ ID NO: 167183 - DNA, 25 bp, Mus musculus
aaggcctgaagaaggagctgcggga

SEQ ID NO: 167184 - DNA, 25 bp, Mus musculus
aaggcctgaagctgtctccagacac

SEQ ID NO: 167185 - DNA, 25 bp, Mus musculus
aaggcctgaaggtgcgggagtatga

SEQ ID NO: 167186 - DNA, 25 bp, Mus musculus
aaggcctgacactgactctcatggt

SEQ ID NO: 167187 - DNA, 25 bp, Mus musculus
aaggcctgactcaggtctgctggca

SEQ ID NO: 167188 - DNA, 25 bp, Mus musculus
aaggcctgaggagcttttcatgcag

SEQ ID NO: 167189 - DNA, 25 bp, Mus musculus
aaggcctgcgaagatataaatgagt

SEQ ID NO: 167190 - DNA, 25 bp, Mus musculus
aaggcctggacgaaaaccacgagct

SEQ ID NO: 167191 - DNA, 25 bp, Mus musculus
aaggcctggacgacgctgagcaggg

SEQ ID NO: 167192 - DNA, 25 bp, Mus musculus
aaggcctggcagtgtgtctccaggc

SEQ ID NO: 167193 - DNA, 25 bp, Mus musculus
aaggcctgtgagtgctgccgaccta

SEQ ID NO: 167194 - DNA, 25 bp, Mus musculus
aaggcctgtggcatcctgcctgttt

SEQ ID NO: 167195 - DNA, 25 bp, Mus musculus
aaggcctgtggtatcctgcctgttt

SEQ ID NO: 167196 - DNA, 25 bp, Mus musculus
aaggcctgtgttgctacccctctgg

SEQ ID NO: 167197 - DNA, 25 bp, Mus musculus
aaggccttaaagactattaagataa

SEQ ID NO: 167198 - DNA, 25 bp, Mus musculus
aaggccttaaaggaaatgaaagtgc

SEQ ID NO: 167199 - DNA, 25 bp, Mus musculus
aaggccttcacaatctccagaacta

SEQ ID NO: 167200 - DNA, 25 bp, Mus musculus
aaggccttccaggagatggagttgc

SEQ ID NO: 167201 - DNA, 25 bp, Mus musculus
aaggccttccaggaggggctggagg

SEQ ID NO: 167202 - DNA, 25 bp, Mus musculus
aaggccttctttgatgtgaagacaa

SEQ ID NO: 167203 - DNA, 25 bp, Mus musculus
aaggccttgacctgttgaggagact

SEQ ID NO: 167204 - DNA, 25 bp, Mus musculus
aaggccttggcaattatttgtataa

SEQ ID NO: 167205 - DNA, 25 bp, Mus musculus
aaggccttgtggaaaacaacaggtt

SEQ ID NO: 167206 - DNA, 25 bp, Mus musculus
aaggccttgtggaaaagctgacaac

SEQ ID NO: 167207 - DNA, 25 bp, Mus musculus
aaggcgagaaatgagagaaacgcac

SEQ ID NO: 167208 - DNA, 25 bp, Mus musculus
aaggcgagaaatggaaacagctgct

SEQ ID NO: 167209 - DNA, 25 bp, Mus musculus
aaggcgagaagatccttatccttca

SEQ ID NO: 167210 - DNA, 25 bp, Mus musculus
aaggcgagaagatgggctgcatcta

SEQ ID NO: 167211 - DNA, 25 bp, Mus musculus
aaggcgagcagaaacttggaccctt

SEQ ID NO: 167212 - DNA, 25 bp, Mus musculus
aaggcgagcagggtcctcctgggcc

SEQ ID NO: 167213 - DNA, 25 bp, Mus musculus
aaggcgaggaagaaaaaagtcatga

SEQ ID NO: 167214 - DNA, 25 bp, Mus musculus
aaggcgaggaaggcattgggagaga

SEQ ID NO: 167215 - DNA, 25 bp, Mus musculus
aaggcgagggattttaggtgatggg

SEQ ID NO: 167216 - DNA, 25 bp, Mus musculus
aaggcgagttacaggagggaatctt

SEQ ID NO: 167217 - DNA, 25 bp, Mus musculus
aaggcgatcttgagcaaaagagccc

SEQ ID NO: 167218 - DNA, 25 bp, Mus musculus
aaggcgatcttgaggtggctaccgt

SEQ ID NO: 167219 - DNA, 25 bp, Mus musculus
aaggcgcaccgcaaagatgtgaaat

SEQ ID NO: 167220 - DNA, 25 bp, Mus musculus
aaggcgcagaaggatcgccacgact

SEQ ID NO: 167221 - DNA, 25 bp, Mus musculus
aaggcgcagatttggatgacttttt

SEQ ID NO: 167222 - DNA, 25 bp, Mus musculus
aaggcgcagatttgggattttgaac

SEQ ID NO: 167223 - DNA, 25 bp, Mus musculus
aaggcgctcgagtatgcctgtggta

SEQ ID NO: 167224 - DNA, 25 bp, Mus musculus
aaggcggaagtggttctgctgcctt

SEQ ID NO: 167225 - DNA, 25 bp, Mus musculus
aaggcggattccagcccaacatgca

SEQ ID NO: 167226 - DNA, 25 bp, Mus musculus
aaggcggcagactttctgcactggc

SEQ ID NO: 167227 - DNA, 25 bp, Mus musculus
aaggcggcaggaccctgagccgtaa

SEQ ID NO: 167228 - DNA, 25 bp, Mus musculus
aaggcggccgaccagatgtgaggtg

SEQ ID NO: 167229 - DNA, 25 bp, Mus musculus
aaggcggcgcgggaggtgctggaga

SEQ ID NO: 167230 - DNA, 25 bp, Mus musculus
aaggcgggacccgagatccacgtgt

SEQ ID NO: 167231 - DNA, 25 bp, Mus musculus
aaggcgggacccgagctgtgtctct

SEQ ID NO: 167232 - DNA, 25 bp, Mus musculus
aaggcgggcagacgtatgtttcctt

SEQ ID NO: 167233 - DNA, 25 bp, Mus musculus
aaggcgggtttgccacaatctgcct

SEQ ID NO: 167234 - DNA, 25 bp, Mus musculus
aaggcggtaaatgggcttcttggta

SEQ ID NO: 167235 - DNA, 25 bp, Mus musculus
aaggcggtcgcccaggctccgcccc

SEQ ID NO: 167236 - DNA, 25 bp, Mus musculus
aaggcggtggggtaagtgtggacat

SEQ ID NO: 167237 - DNA, 25 bp, Mus musculus
aaggcgtccgcaggtttgatgagat

SEQ ID NO: 167238 - DNA, 25 bp, Mus musculus
aaggcgtctcgagcctatcctctac

SEQ ID NO: 167239 - DNA, 25 bp, Mus musculus
aaggcgtctcgaggaacgcctcgat

SEQ ID NO: 167240 - DNA, 25 bp, Mus musculus
aaggcgtgcgggtgtgaacaacgtg

SEQ ID NO: 167241 - DNA, 25 bp, Mus musculus
aaggcgtgggaacagagccctttgg

SEQ ID NO: 167242 - DNA, 25 bp, Mus musculus
aaggctaaaggtctgtacacatgag

SEQ ID NO: 167243 - DNA, 25 bp, Mus musculus
aaggctaagagcctgaccagggatt

SEQ ID NO: 167244 - DNA, 25 bp, Mus musculus
aaggctaatttatgatcgttgtcca

SEQ ID NO: 167245 - DNA, 25 bp, Mus musculus
aaggctacaagcagtgccggctaca

SEQ ID NO: 167246 - DNA, 25 bp, Mus musculus
aaggctacaaggtgctggtggcaac

SEQ ID NO: 167247 - DNA, 25 bp, Mus musculus
aaggctacaatccctctacttcgga

SEQ ID NO: 167248 - DNA, 25 bp, Mus musculus
aaggctacactggggcttacagggc

SEQ ID NO: 167249 - DNA, 25 bp, Mus musculus
aaggctacctagaaagtcccaagga

SEQ ID NO: 167250 - DNA, 25 bp, Mus musculus
aaggctacctagaacatcagaaacc

SEQ ID NO: 167251 - DNA, 25 bp, Mus musculus
aaggctacggaggctatggggcatg

SEQ ID NO: 167252 - DNA, 25 bp, Mus musculus
aaggctagaaagcagatggaaaggc

SEQ ID NO: 167253 - DNA, 25 bp, Mus musculus
aaggctagactggctgcgaagctgg

SEQ ID NO: 167254 - DNA, 25 bp, Mus musculus
aaggctatagggtcggtgatggagc

SEQ ID NO: 167255 - DNA, 25 bp, Mus musculus
aaggctatgaaggggtcagaataca

SEQ ID NO: 167256 - DNA, 25 bp, Mus musculus
aaggctatggtggaggtagaagatt

SEQ ID NO: 167257 - DNA, 25 bp, Mus musculus
aaggctcaagggctttgctgagcgc

SEQ ID NO: 167258 - DNA, 25 bp, Mus musculus
aaggctcatagacagggtttctctg

SEQ ID NO: 167259 - DNA, 25 bp, Mus musculus
aaggctcataggccaaactcaaggg

SEQ ID NO: 167260 - DNA, 25 bp, Mus musculus
aaggctcatcagatgtaaacagaaa

SEQ ID NO: 167261 - DNA, 25 bp, Mus musculus
aaggctcatgtgcagaaggtctcga

SEQ ID NO: 167262 - DNA, 25 bp, Mus musculus
aaggctccacaggagatggctttca

SEQ ID NO: 167263 - DNA, 25 bp, Mus musculus
aaggctccaccgcggtctgacagcg

SEQ ID NO: 167264 - DNA, 25 bp, Mus musculus
aaggctccaccgcggttggaattcg

SEQ ID NO: 167265 - DNA, 25 bp, Mus musculus
aaggctccaggggtgatggacaacc

SEQ ID NO: 167266 - DNA, 25 bp, Mus musculus
aaggctccgagcaaggccgtgcaga

SEQ ID NO: 167267 - DNA, 25 bp, Mus musculus
aaggctcggggaacctccgcttcac

SEQ ID NO: 167268 - DNA, 25 bp, Mus musculus
aaggctctacattcccaaggtgatg

SEQ ID NO: 167269 - DNA, 25 bp, Mus musculus
aaggctctccaggcagtgcttttac

SEQ ID NO: 167270 - DNA, 25 bp, Mus musculus
aaggctctccaggtagcctttccag

SEQ ID NO: 167271 - DNA, 25 bp, Mus musculus
aaggctctccaggtttgtgtaagtc

SEQ ID NO: 167272 - DNA, 25 bp, Mus musculus
aaggctctccgggttcaataggatt

SEQ ID NO: 167273 - DNA, 25 bp, Mus musculus
aaggctctgaggcaggtacccaccc

SEQ ID NO: 167274 - DNA, 25 bp, Mus musculus
aaggctctggagatggcaggttcag

SEQ ID NO: 167275 - DNA, 25 bp, Mus musculus
aaggctctgtggaggaagcaagggc

SEQ ID NO: 167276 - DNA, 25 bp, Mus musculus
aaggctcttatcaggtatggggcag

SEQ ID NO: 167277 - DNA, 25 bp, Mus musculus
aaggctgaaggcttaactccggccg

SEQ ID NO: 167278 - DNA, 25 bp, Mus musculus
aaggctgacaaggaatttcggcaga

SEQ ID NO: 167279 - DNA, 25 bp, Mus musculus
aaggctgagcagcacgcctccggtc

SEQ ID NO: 167280 - DNA, 25 bp, Mus musculus
aaggctgagcagcaggctgacgagg

SEQ ID NO: 167281 - DNA, 25 bp, Mus musculus
aaggctgagcagcaggtgaaccagc

SEQ ID NO: 167282 - DNA, 25 bp, Mus musculus
aaggctgatggaattgaacttttga

SEQ ID NO: 167283 - DNA, 25 bp, Mus musculus
aaggctgcagaacatgaagttcctt

SEQ ID NO: 167284 - DNA, 25 bp, Mus musculus
aaggctgcagatgcagccggtggag

SEQ ID NO: 167285 - DNA, 25 bp, Mus musculus
aaggctgcagctcttaaccggctct

SEQ ID NO: 167286 - DNA, 25 bp, Mus musculus
aaggctgccccaggttgccactgat

SEQ ID NO: 167287 - DNA, 25 bp, Mus musculus
aaggctgccgctctggcccacaggg

SEQ ID NO: 167288 - DNA, 25 bp, Mus musculus
aaggctgcgaccaggctttggcgtt

SEQ ID NO: 167289 - DNA, 25 bp, Mus musculus
aaggctgctccagagcatctaaaga

SEQ ID NO: 167290 - DNA, 25 bp, Mus musculus
aaggctgctccagagctggagaagc

SEQ ID NO: 167291 - DNA, 25 bp, Mus musculus
aaggctggaatgcagataacaattg

SEQ ID NO: 167292 - DNA, 25 bp, Mus musculus
aaggctggaatgcagcttgaaggtc

SEQ ID NO: 167293 - DNA, 25 bp, Mus musculus
aaggctggacagatctgctcatttt

SEQ ID NO: 167294 - DNA, 25 bp, Mus musculus
aaggctggacagattcagataacaa

SEQ ID NO: 167295 - DNA, 25 bp, Mus musculus
aaggctggagcggaagggtttgttc

SEQ ID NO: 167296 - DNA, 25 bp, Mus musculus
aaggctggccagtgggttgatttct

SEQ ID NO: 167297 - DNA, 25 bp, Mus musculus
aaggctggcgtagatcgactgtgcc

SEQ ID NO: 167298 - DNA, 25 bp, Mus musculus
aaggctggctcagagttctcagtat

SEQ ID NO: 167299 - DNA, 25 bp, Mus musculus
aaggctggctgcctttgcggggcct

SEQ ID NO: 167300 - DNA, 25 bp, Mus musculus
aaggctggctgtcagctgctgactg

SEQ ID NO: 167301 - DNA, 25 bp, Mus musculus
aaggctgggcacagattggtgttgg

SEQ ID NO: 167302 - DNA, 25 bp, Mus musculus
aaggctgggtgcagtgacccttacc

SEQ ID NO: 167303 - DNA, 25 bp, Mus musculus
aaggctggtgatcaaggtgttcctg

SEQ ID NO: 167304 - DNA, 25 bp, Mus musculus
aaggctggtgctatttatattttgg

SEQ ID NO: 167305 - DNA, 25 bp, Mus musculus
aaggctgtccaacaggtgcgccagg

SEQ ID NO: 167306 - DNA, 25 bp, Mus musculus
aaggctgtcccgagttgaggccggc

SEQ ID NO: 167307 - DNA, 25 bp, Mus musculus
aaggctgtctcaggtggcccctgtg

SEQ ID NO: 167308 - DNA, 25 bp, Mus musculus
aaggctgtgtctgatgtcctggaat

SEQ ID NO: 167309 - DNA, 25 bp, Mus musculus
aaggctgtttatggatgaccaggaa

SEQ ID NO: 167310 - DNA, 25 bp, Mus musculus
aaggcttaccaagcccgttctcaaa

SEQ ID NO: 167311 - DNA, 25 bp, Mus musculus
aaggcttacccaggtttggcataga

SEQ ID NO: 167312 - DNA, 25 bp, Mus musculus
aaggcttcaaagattacatgaaaga

SEQ ID NO: 167313 - DNA, 25 bp, Mus musculus
aaggcttcaaagttgcacctgctta

SEQ ID NO: 167314 - DNA, 25 bp, Mus musculus
aaggcttcaggaaatcaggaccttt

SEQ ID NO: 167315 - DNA, 25 bp, Mus musculus
aaggcttcgttccttgcgcgctggg

SEQ ID NO: 167316 - DNA, 25 bp, Mus musculus
aaggcttctgccaaggcgcagcacc

SEQ ID NO: 167317 - DNA, 25 bp, Mus musculus
aaggcttgctcaggtagctaaagca

SEQ ID NO: 167318 - DNA, 25 bp, Mus musculus
aaggcttggcagagcaacttatttt

SEQ ID NO: 167319 - DNA, 25 bp, Mus musculus
aaggcttgggaggaactgagtggta

SEQ ID NO: 167320 - DNA, 25 bp, Mus musculus
aaggcttgggagggtgacacttccc

SEQ ID NO: 167321 - DNA, 25 bp, Mus musculus
aaggctttaagctctggtgcaagtg

SEQ ID NO: 167322 - DNA, 25 bp, Mus musculus
aaggctttccagccatggccatgca

SEQ ID NO: 167323 - DNA, 25 bp, Mus musculus
aaggctttccagctccagcacctgc

SEQ ID NO: 167324 - DNA, 25 bp, Mus musculus
aaggctttcctttgggtattcccat

SEQ ID NO: 167325 - DNA, 25 bp, Mus musculus
aaggctttgcaaggaagccatcact

SEQ ID NO: 167326 - DNA, 25 bp, Mus musculus
aaggctttgtgtactgctctgctgc

SEQ ID NO: 167327 - DNA, 25 bp, Mus musculus
aaggcttttggggcaggggctgact

SEQ ID NO: 167328 - DNA, 25 bp, Mus musculus
aaggcttttggggctgactttgtga

SEQ ID NO: 167329 - DNA, 25 bp, Mus musculus
aaggctttttactatgcagtcacag

SEQ ID NO: 167330 - DNA, 25 bp, Mus musculus
aagggaaaaaggtgatgtctatcct

SEQ ID NO: 167331 - DNA, 25 bp, Mus musculus
aagggaaaagagctggattctaatc

SEQ ID NO: 167332 - DNA, 25 bp, Mus musculus
aagggaaacaagttctgacagtatc

SEQ ID NO: 167333 - DNA, 25 bp, Mus musculus
aagggaaagaaagccgctctgcaca

SEQ ID NO: 167334 - DNA, 25 bp, Mus musculus
aagggaaagaaagtcacagacaagt

SEQ ID NO: 167335 - DNA, 25 bp, Mus musculus
aagggaaagaccagacatcatccca

SEQ ID NO: 167336 - DNA, 25 bp, Mus musculus
aagggaaagaccaggacctcaccat

SEQ ID NO: 167337 - DNA, 25 bp, Mus musculus
aagggaaagccaagatgccagacca

SEQ ID NO: 167338 - DNA, 25 bp, Mus musculus
aagggaaaggggaatgatgaaaggc

SEQ ID NO: 167339 - DNA, 25 bp, Mus musculus
aagggaacacgaggttccgagtccg

SEQ ID NO: 167340 - DNA, 25 bp, Mus musculus
aagggaacccaaggcctggcagaac

SEQ ID NO: 167341 - DNA, 25 bp, Mus musculus
aagggaagaataggtatcgtgtcca

SEQ ID NO: 167342 - DNA, 25 bp, Mus musculus
aagggaagagatggctacatgggaa

SEQ ID NO: 167343 - DNA, 25 bp, Mus musculus
aagggaagagatgggtattgctttc

SEQ ID NO: 167344 - DNA, 25 bp, Mus musculus
aagggaagattcggatccctaccgt

SEQ ID NO: 167345 - DNA, 25 bp, Mus musculus
aagggaagggatgcatgggcatgga

SEQ ID NO: 167346 - DNA, 25 bp, Mus musculus
aagggaagggctcgggtccgcacgg

SEQ ID NO: 167347 - DNA, 25 bp, Mus musculus
aagggaaggtaaagatacacctatg

SEQ ID NO: 167348 - DNA, 25 bp, Mus musculus
aagggaagtctcaggtgtcggtgac

SEQ ID NO: 167349 - DNA, 25 bp, Mus musculus
aagggaagtttgagaaatcagggat

SEQ ID NO: 167350 - DNA, 25 bp, Mus musculus
aagggaatccagagatcattgatag

SEQ ID NO: 167351 - DNA, 25 bp, Mus musculus
aagggaatccagatcaaggttccag

SEQ ID NO: 167352 - DNA, 25 bp, Mus musculus
aagggaatccagatgactgcagtca

SEQ ID NO: 167353 - DNA, 25 bp, Mus musculus
aagggaatcctggcctcccagtaaa

SEQ ID NO: 167354 - DNA, 25 bp, Mus musculus
aagggaatcctggggacacttaaca

SEQ ID NO: 167355 - DNA, 25 bp, Mus musculus
aagggacaaccaggcaaccgagggc

SEQ ID NO: 167356 - DNA, 25 bp, Mus musculus
aagggacaactgcttcggcccacaa

SEQ ID NO: 167357 - DNA, 25 bp, Mus musculus
aagggacacgagggctccttcttct

SEQ ID NO: 167358 - DNA, 25 bp, Mus musculus
aagggacagtgtttggattctccag

SEQ ID NO: 167359 - DNA, 25 bp, Mus musculus
aagggacagtgtttgggcggttcga

SEQ ID NO: 167360 - DNA, 25 bp, Mus musculus
aagggacatgaaggtagcatcgcct

SEQ ID NO: 167361 - DNA, 25 bp, Mus musculus
aagggaccaagcattcacagctctg

SEQ ID NO: 167362 - DNA, 25 bp, Mus musculus
aagggacgctgtgctttcatggatc

SEQ ID NO: 167363 - DNA, 25 bp, Mus musculus
aagggactacatattctgtcccctc

SEQ ID NO: 167364 - DNA, 25 bp, Mus musculus
aagggactacatgacattaagaacg

SEQ ID NO: 167365 - DNA, 25 bp, Mus musculus
aagggactcggagaatcatcattca

SEQ ID NO: 167366 - DNA, 25 bp, Mus musculus
aagggactcttcaagccacttagcc

SEQ ID NO: 167367 - DNA, 25 bp, Mus musculus
aagggactcttcaaggtgctggagg

SEQ ID NO: 167368 - DNA, 25 bp, Mus musculus
aagggacttcaggccttctcccaac

SEQ ID NO: 167369 - DNA, 25 bp, Mus musculus
aagggacttgtcaggtttctaaaca

SEQ ID NO: 167370 - DNA, 25 bp, Mus musculus
aagggagaaaagaacttcgcggctc

SEQ ID NO: 167371 - DNA, 25 bp, Mus musculus
aagggagaaaagggtgcgcctggac

SEQ ID NO: 167372 - DNA, 25 bp, Mus musculus
aagggagaagagaaggaagatccct

SEQ ID NO: 167373 - DNA, 25 bp, Mus musculus
aagggagaagagaagggactcggcc

SEQ ID NO: 167374 - DNA, 25 bp, Mus musculus
aagggagaatacagggattacagca

SEQ ID NO: 167375 - DNA, 25 bp, Mus musculus
aagggagaatacagggtctgttcac

SEQ ID NO: 167376 - DNA, 25 bp, Mus musculus
aagggagacagaggcgatgttggcg

SEQ ID NO: 167377 - DNA, 25 bp, Mus musculus
aagggagagacgggtatcccaggag

SEQ ID NO: 167378 - DNA, 25 bp, Mus musculus
aagggagagactggacctgctgggc

SEQ ID NO: 167379 - DNA, 25 bp, Mus musculus
aagggagatgatgatgaggaatctg

SEQ ID NO: 167380 - DNA, 25 bp, Mus musculus
aagggagcgctgatcatggctcctt

SEQ ID NO: 167381 - DNA, 25 bp, Mus musculus
aagggagctagtgaaactgacgtct

SEQ ID NO: 167382 - DNA, 25 bp, Mus musculus
aagggagctagtggcccacgcttgt

SEQ ID NO: 167383 - DNA, 25 bp, Mus musculus
aagggagctagtggtttaggtaata

SEQ ID NO: 167384 - DNA, 25 bp, Mus musculus
aagggagctctggatgctgaatgct

SEQ ID NO: 167385 - DNA, 25 bp, Mus musculus
aagggagctctgggaattaacaagc

SEQ ID NO: 167386 - DNA, 25 bp, Mus musculus
aagggaggggatcaaactcttcacc

SEQ ID NO: 167387 - DNA, 25 bp, Mus musculus
aagggagggtccgggttgtggatca

SEQ ID NO: 167388 - DNA, 25 bp, Mus musculus
aagggaggtgaggaggaagaagtgc

SEQ ID NO: 167389 - DNA, 25 bp, Mus musculus
aagggagtaaaggaaacagacagct

SEQ ID NO: 167390 - DNA, 25 bp, Mus musculus
aagggagtaaaggcagtctaaagtc

SEQ ID NO: 167391 - DNA, 25 bp, Mus musculus
aagggagtcaaagggctaacagaac

SEQ ID NO: 167392 - DNA, 25 bp, Mus musculus
aagggagtggtgggttcgagtgacg

SEQ ID NO: 167393 - DNA, 25 bp, Mus musculus
aagggatacccggcgtaatctcaaa

SEQ ID NO: 167394 - DNA, 25 bp, Mus musculus
aagggatccaaagaggagatctttt

SEQ ID NO: 167395 - DNA, 25 bp, Mus musculus
aagggatctgcagacctcagtcaga

SEQ ID NO: 167396 - DNA, 25 bp, Mus musculus
aagggatctgcagagctcagtcaga

SEQ ID NO: 167397 - DNA, 25 bp, Mus musculus
aagggatctgccagtgtgcccctgg

SEQ ID NO: 167398 - DNA, 25 bp, Mus musculus
aagggatctttgagagaaatacaag

SEQ ID NO: 167399 - DNA, 25 bp, Mus musculus
aagggatgatgcaatgagttccttc

SEQ ID NO: 167400 - DNA, 25 bp, Mus musculus
aagggatgccagatgaggagtccct

SEQ ID NO: 167401 - DNA, 25 bp, Mus musculus
aagggatgccagatgatcttccccc

SEQ ID NO: 167402 - DNA, 25 bp, Mus musculus
aagggatgcttcagatacgggaagc

SEQ ID NO: 167403 - DNA, 25 bp, Mus musculus
aagggatggggagagttggagtttg

SEQ ID NO: 167404 - DNA, 25 bp, Mus musculus
aagggatgttttgggtcgcagacac

SEQ ID NO: 167405 - DNA, 25 bp, Mus musculus
aagggattccagtactagtacttgg

SEQ ID NO: 167406 - DNA, 25 bp, Mus musculus
aagggattgaccgacgcctcttcgc

SEQ ID NO: 167407 - DNA, 25 bp, Mus musculus
aagggatttctggacttggcagtgt

SEQ ID NO: 167408 - DNA, 25 bp, Mus musculus
aagggcaaaagacatatatccagtg

SEQ ID NO: 167409 - DNA, 25 bp, Mus musculus
aagggcaaaagagatatatccagtg

SEQ ID NO: 167410 - DNA, 25 bp, Mus musculus
aagggcaaagacgatgcggtcccta

SEQ ID NO: 167411 - DNA, 25 bp, Mus musculus
aagggcaaagatgagtggttctcca

SEQ ID NO: 167412 - DNA, 25 bp, Mus musculus
aagggcaaaggctggagcaaaacat

SEQ ID NO: 167413 - DNA, 25 bp, Mus musculus
aagggcaacagtcatcatctgactg

SEQ ID NO: 167414 - DNA, 25 bp, Mus musculus
aagggcaacagtgaactaatgctgg

SEQ ID NO: 167415 - DNA, 25 bp, Mus musculus
aagggcaagaagcctggaattgtgt

SEQ ID NO: 167416 - DNA, 25 bp, Mus musculus
aagggcaagaagtatttaggtcagt

SEQ ID NO: 167417 - DNA, 25 bp, Mus musculus
aagggcaagaccaaaaacctcatca

SEQ ID NO: 167418 - DNA, 25 bp, Mus musculus
aagggcaagacgggcgcagttctga

SEQ ID NO: 167419 - DNA, 25 bp, Mus musculus
aagggcaagatacacggcatcatcg

SEQ ID NO: 167420 - DNA, 25 bp, Mus musculus
aagggcaaggactacctggaccagc

SEQ ID NO: 167421 - DNA, 25 bp, Mus musculus
aagggcaagggactccgagggagcg

SEQ ID NO: 167422 - DNA, 25 bp, Mus musculus
aagggcaagggggagaagattaatc

SEQ ID NO: 167423 - DNA, 25 bp, Mus musculus
aagggcaagggttcttggcccagct

SEQ ID NO: 167424 - DNA, 25 bp, Mus musculus
aagggcacaagctcctgacgagcag

SEQ ID NO: 167425 - DNA, 25 bp, Mus musculus
aagggcacaagctgagcggggccca

SEQ ID NO: 167426 - DNA, 25 bp, Mus musculus
aagggcacaatgcgaccttcttcgg

SEQ ID NO: 167427 - DNA, 25 bp, Mus musculus
aagggcacacctagtcaggtgaggg

SEQ ID NO: 167428 - DNA, 25 bp, Mus musculus
aagggcacaggctcgtcccctgact

SEQ ID NO: 167429 - DNA, 25 bp, Mus musculus
aagggcagagggatacagtacagcc

SEQ ID NO: 167430 - DNA, 25 bp, Mus musculus
aagggcagcgacgaggttcagattc

SEQ ID NO: 167431 - DNA, 25 bp, Mus musculus
aagggcagcgccctcggagccctgt

SEQ ID NO: 167432 - DNA, 25 bp, Mus musculus
aagggcagcgtggccaagcggcgac

SEQ ID NO: 167433 - DNA, 25 bp, Mus musculus
aagggcagtgggtgctggtcttcag

SEQ ID NO: 167434 - DNA, 25 bp, Mus musculus
aagggcataggcagccacctagatc

SEQ ID NO: 167435 - DNA, 25 bp, Mus musculus
aagggcatcagcgagggctgccgga

SEQ ID NO: 167436 - DNA, 25 bp, Mus musculus
aagggcatcaggaggctgcacaggg

SEQ ID NO: 167437 - DNA, 25 bp, Mus musculus
aagggcatcaggcggtatgaatatc

SEQ ID NO: 167438 - DNA, 25 bp, Mus musculus
aagggcatggtgggcagcaaagatt

SEQ ID NO: 167439 - DNA, 25 bp, Mus musculus
aagggccaaagggttccattggatt

SEQ ID NO: 167440 - DNA, 25 bp, Mus musculus
aagggccaagaagtctacatgtggg

SEQ ID NO: 167441 - DNA, 25 bp, Mus musculus
aagggccagaagaagagtcgaaagg

SEQ ID NO: 167442 - DNA, 25 bp, Mus musculus
aagggccagggatctctctctccac

SEQ ID NO: 167443 - DNA, 25 bp, Mus musculus
aagggccagggatctgatgcgggct

SEQ ID NO: 167444 - DNA, 25 bp, Mus musculus
aagggccatgaccggatttaattgg

SEQ ID NO: 167445 - DNA, 25 bp, Mus musculus
aagggccatgaccggcttccttcaa

SEQ ID NO: 167446 - DNA, 25 bp, Mus musculus
aagggcccatgatctccatctttcc

SEQ ID NO: 167447 - DNA, 25 bp, Mus musculus
aagggccgaggcgaagcccgacatc

SEQ ID NO: 167448 - DNA, 25 bp, Mus musculus
aagggccggggtgtgcacatggaag

SEQ ID NO: 167449 - DNA, 25 bp, Mus musculus
aagggcctagcagagctcctcagaa

SEQ ID NO: 167450 - DNA, 25 bp, Mus musculus
aagggcctagcgccagccagagctc

SEQ ID NO: 167451 - DNA, 25 bp, Mus musculus
aagggcctcacaccaagcctgaaga

SEQ ID NO: 167452 - DNA, 25 bp, Mus musculus
aagggccttttggtctggaagctga

SEQ ID NO: 167453 - DNA, 25 bp, Mus musculus
aagggcgagaagggagatcctggta

SEQ ID NO: 167454 - DNA, 25 bp, Mus musculus
aagggcgagatgagcaaccctgggg

SEQ ID NO: 167455 - DNA, 25 bp, Mus musculus
aagggcgccagatgctggaggtaaa

SEQ ID NO: 167456 - DNA, 25 bp, Mus musculus
aagggcgctggcggaatggcttcct

SEQ ID NO: 167457 - DNA, 25 bp, Mus musculus
aagggcggaggtgagtgcaggatcc

SEQ ID NO: 167458 - DNA, 25 bp, Mus musculus
aagggcgggtcagcaagctccgggc

SEQ ID NO: 167459 - DNA, 25 bp, Mus musculus
aagggcgggtcagcggccctgtgag

SEQ ID NO: 167460 - DNA, 25 bp, Mus musculus
aagggcgtcttagatgacgtggtct

SEQ ID NO: 167461 - DNA, 25 bp, Mus musculus
aagggctacagctccggaccaaaat

SEQ ID NO: 167462 - DNA, 25 bp, Mus musculus
aagggctacgtcaaggtcccaaagc

SEQ ID NO: 167463 - DNA, 25 bp, Mus musculus
aagggctactccaggaggcaccatg

SEQ ID NO: 167464 - DNA, 25 bp, Mus musculus
aagggctatttccctgcagtctgac

SEQ ID NO: 167465 - DNA, 25 bp, Mus musculus
aagggctcagccagagtaacagttg

SEQ ID NO: 167466 - DNA, 25 bp, Mus musculus
aagggctccacactgtcccggagag

SEQ ID NO: 167467 - DNA, 25 bp, Mus musculus
aagggctccaccgcggttggtgttc

SEQ ID NO: 167468 - DNA, 25 bp, Mus musculus
aagggctcttgctgttccggggcac

SEQ ID NO: 167469 - DNA, 25 bp, Mus musculus
aagggctcttgggcagcgctcacca

SEQ ID NO: 167470 - DNA, 25 bp, Mus musculus
aagggctgagaggcaggaaatgttg

SEQ ID NO: 167471 - DNA, 25 bp, Mus musculus
aagggctgcagcttcctgcctgttc

SEQ ID NO: 167472 - DNA, 25 bp, Mus musculus
aagggctgccaggagatggacatga

SEQ ID NO: 167473 - DNA, 25 bp, Mus musculus
aagggctgccaggttgaattctctt

SEQ ID NO: 167474 - DNA, 25 bp, Mus musculus
aagggctgccatgcctgtgactgca

SEQ ID NO: 167475 - DNA, 25 bp, Mus musculus
aagggctgccgacatgtggacgagt

SEQ ID NO: 167476 - DNA, 25 bp, Mus musculus
aagggctgccgactgctgatctctt

SEQ ID NO: 167477 - DNA, 25 bp, Mus musculus
aagggctgccgagatgtggacgagt

SEQ ID NO: 167478 - DNA, 25 bp, Mus musculus
aagggcttattctcagctctttgat

SEQ ID NO: 167479 - DNA, 25 bp, Mus musculus
aagggcttcttaggtcgcaagtctg

SEQ ID NO: 167480 - DNA, 25 bp, Mus musculus
aagggcttcttcagacgaacagtca

SEQ ID NO: 167481 - DNA, 25 bp, Mus musculus
aagggcttcttcagtgatactgtca

SEQ ID NO: 167482 - DNA, 25 bp, Mus musculus
aagggctttaccagaagagggcatc

SEQ ID NO: 167483 - DNA, 25 bp, Mus musculus
aagggctttaccagtctattgcatc

SEQ ID NO: 167484 - DNA, 25 bp, Mus musculus
aaggggaagaacaatgacctccggg

SEQ ID NO: 167485 - DNA, 25 bp, Mus musculus
aaggggaagactgccgtgagcatcc

SEQ ID NO: 167486 - DNA, 25 bp, Mus musculus
aaggggaagactggcgcaagcggcg

SEQ ID NO: 167487 - DNA, 25 bp, Mus musculus
aaggggaagactgggagatggaaca

SEQ ID NO: 167488 - DNA, 25 bp, Mus musculus
aaggggaagactggtccctgtggcc

SEQ ID NO: 167489 - DNA, 25 bp, Mus musculus
aaggggaagactggtctctaactgg

SEQ ID NO: 167490 - DNA, 25 bp, Mus musculus
aaggggaagaggaatattgaagaga

SEQ ID NO: 167491 - DNA, 25 bp, Mus musculus
aaggggacacattttagtttctgga

SEQ ID NO: 167492 - DNA, 25 bp, Mus musculus
aaggggagaagaaccatttgacatt

SEQ ID NO: 167493 - DNA, 25 bp, Mus musculus
aaggggagagctcctgctttctgac

SEQ ID NO: 167494 - DNA, 25 bp, Mus musculus
aaggggagaggaagctttgtctcct

SEQ ID NO: 167495 - DNA, 25 bp, Mus musculus
aaggggagcagaaaatgttttcaga

SEQ ID NO: 167496 - DNA, 25 bp, Mus musculus
aaggggataatgcactttgtggaga

SEQ ID NO: 167497 - DNA, 25 bp, Mus musculus
aaggggatccaggtggcacattgga

SEQ ID NO: 167498 - DNA, 25 bp, Mus musculus
aaggggatcgacaaccacagcaaac

SEQ ID NO: 167499 - DNA, 25 bp, Mus musculus
aaggggatcggtatcatgccaaaga

SEQ ID NO: 167500 - DNA, 25 bp, Mus musculus
aaggggcaacctaggtgttgacttt

SEQ ID NO: 167501 - DNA, 25 bp, Mus musculus
aaggggcaggcgggtgattatagag

SEQ ID NO: 167502 - DNA, 25 bp, Mus musculus
aaggggccactcaacccaccctcag

SEQ ID NO: 167503 - DNA, 25 bp, Mus musculus
aaggggcccagcaggtggagagcag

SEQ ID NO: 167504 - DNA, 25 bp, Mus musculus
aaggggctccaggcagaagcgatgc

SEQ ID NO: 167505 - DNA, 25 bp, Mus musculus
aaggggctgaagtatatccatgcgg

SEQ ID NO: 167506 - DNA, 25 bp, Mus musculus
aaggggctgagaaagacaggttgca

SEQ ID NO: 167507 - DNA, 25 bp, Mus musculus
aaggggctggactgtaacagaagac

SEQ ID NO: 167508 - DNA, 25 bp, Mus musculus
aaggggctggggaacagaaggcgga

SEQ ID NO: 167509 - DNA, 25 bp, Mus musculus
aaggggctgttggacttcaagaaaa

SEQ ID NO: 167510 - DNA, 25 bp, Mus musculus
aagggggagaagggccacattgggc

SEQ ID NO: 167511 - DNA, 25 bp, Mus musculus
aagggggagatcttgacatcactga

SEQ ID NO: 167512 - DNA, 25 bp, Mus musculus
aagggggagatcttggtgatccgca

SEQ ID NO: 167513 - DNA, 25 bp, Mus musculus
aagggggagatgacggcagaggaga

SEQ ID NO: 167514 - DNA, 25 bp, Mus musculus
aagggggcaagggtggaccacttgg

SEQ ID NO: 167515 - DNA, 25 bp, Mus musculus
aagggggcagccttgcagcagaata

SEQ ID NO: 167516 - DNA, 25 bp, Mus musculus
aagggggcagctttgtcgaaacacc

SEQ ID NO: 167517 - DNA, 25 bp, Mus musculus
aagggggcctggtccatcccgtgga

SEQ ID NO: 167518 - DNA, 25 bp, Mus musculus
aagggggcgcgcaggtgtccacaga

SEQ ID NO: 167519 - DNA, 25 bp, Mus musculus
aagggggtgtcgagcccagccagtg

SEQ ID NO: 167520 - DNA, 25 bp, Mus musculus
aaggggtcaaaattgacaagactga

SEQ ID NO: 167521 - DNA, 25 bp, Mus musculus
aaggggtctgaagtcaaataccttc

SEQ ID NO: 167522 - DNA, 25 bp, Mus musculus
aaggggtgaagactgaaccaataac

SEQ ID NO: 167523 - DNA, 25 bp, Mus musculus
aaggggtgaagagggtcaacaggac

SEQ ID NO: 167524 - DNA, 25 bp, Mus musculus
aaggggtgccctaagtatccagcat

SEQ ID NO: 167525 - DNA, 25 bp, Mus musculus
aaggggttcaattccagccatattg

SEQ ID NO: 167526 - DNA, 25 bp, Mus musculus
aaggggttccgggtggacaagattg

SEQ ID NO: 167527 - DNA, 25 bp, Mus musculus
aaggggttggatcagaggagtccct

SEQ ID NO: 167528 - DNA, 25 bp, Mus musculus
aaggggtttgactcgcacatccttg

SEQ ID NO: 167529 - DNA, 25 bp, Mus musculus
aagggtagtcactgactgtatccag

SEQ ID NO: 167530 - DNA, 25 bp, Mus musculus
aagggtataggcatcgcctccatgt

SEQ ID NO: 167531 - DNA, 25 bp, Mus musculus
aagggtatcgacaggtacaatcctg

SEQ ID NO: 167532 - DNA, 25 bp, Mus musculus
aagggtatcgacaggtaccagttca

SEQ ID NO: 167533 - DNA, 25 bp, Mus musculus
aagggtcacagaggttacccaggcc

SEQ ID NO: 167534 - DNA, 25 bp, Mus musculus
aagggtcacggacctcttcactgga

SEQ ID NO: 167535 - DNA, 25 bp, Mus musculus
aagggtcacggttgcatctgatgcc

SEQ ID NO: 167536 - DNA, 25 bp, Mus musculus
aagggtcataggcacagaccaagcg

SEQ ID NO: 167537 - DNA, 25 bp, Mus musculus
aagggtcatgggatggctgcactgc

SEQ ID NO: 167538 - DNA, 25 bp, Mus musculus
aagggtccagggtctcaggtcccag

SEQ ID NO: 167539 - DNA, 25 bp, Mus musculus
aagggtgaaaagggtgacataggac

SEQ ID NO: 167540 - DNA, 25 bp, Mus musculus
aagggtgaacaaggtgttccaggaa

SEQ ID NO: 167541 - DNA, 25 bp, Mus musculus
aagggtgaacagggtgcctctggtg

SEQ ID NO: 167542 - DNA, 25 bp, Mus musculus
aagggtgaccgaggtggcataggag

SEQ ID NO: 167543 - DNA, 25 bp, Mus musculus
aagggtgatggtgaggtctagtgac

SEQ ID NO: 167544 - DNA, 25 bp, Mus musculus
aagggtgcaaaaggtaccagcaagg

SEQ ID NO: 167545 - DNA, 25 bp, Mus musculus
aagggtgcagaagttccctcaaccc

SEQ ID NO: 167546 - DNA, 25 bp, Mus musculus
aagggtgccagccagtgtacgatcc

SEQ ID NO: 167547 - DNA, 25 bp, Mus musculus
aagggtgcccgtgacaaatgaagag

SEQ ID NO: 167548 - DNA, 25 bp, Mus musculus
aagggtgcgcacagaactcaggggc

SEQ ID NO: 167549 - DNA, 25 bp, Mus musculus
aagggtgcgcacagatgactggttt

SEQ ID NO: 167550 - DNA, 25 bp, Mus musculus
aagggtggcagggggacacctggaa

SEQ ID NO: 167551 - DNA, 25 bp, Mus musculus
aagggtgttgtagcatcttggttgc

SEQ ID NO: 167552 - DNA, 25 bp, Mus musculus
aagggtgttgtagctgctcctcaca

SEQ ID NO: 167553 - DNA, 25 bp, Mus musculus
aagggttcacaggcacactggcaac

SEQ ID NO: 167554 - DNA, 25 bp, Mus musculus
aagggttgggaaggttctggctgcc

SEQ ID NO: 167555 - DNA, 25 bp, Mus musculus
aagggttgtgatgggaggctcctat

SEQ ID NO: 167556 - DNA, 25 bp, Mus musculus
aagggttgtgatgggcggctcctat

SEQ ID NO: 167557 - DNA, 25 bp, Mus musculus
aagggtttgaatgtatcgcaaacgc

SEQ ID NO: 167558 - DNA, 25 bp, Mus musculus
aagggtttgagagaatcgcacgtcc

SEQ ID NO: 167559 - DNA, 25 bp, Mus musculus
aagggtttgttcagtcgacctgata

SEQ ID NO: 167560 - DNA, 25 bp, Mus musculus
aaggtaaaactgattgactggggaa

SEQ ID NO: 167561 - DNA, 25 bp, Mus musculus
aaggtaaactgcaggttgtcctggt

SEQ ID NO: 167562 - DNA, 25 bp, Mus musculus
aaggtaactacggagatcagcaggc

SEQ ID NO: 167563 - DNA, 25 bp, Mus musculus
aaggtaagaaggcaatggcaagccg

SEQ ID NO: 167564 - DNA, 25 bp, Mus musculus
aaggtaagcagacagatgagcgttc

SEQ ID NO: 167565 - DNA, 25 bp, Mus musculus
aaggtacaagacaacactgcttatc

SEQ ID NO: 167566 - DNA, 25 bp, Mus musculus
aaggtaccagtggctacctccctcc

SEQ ID NO: 167567 - DNA, 25 bp, Mus musculus
aaggtactcaagcgagctgcagcga

SEQ ID NO: 167568 - DNA, 25 bp, Mus musculus
aaggtactcaaggtaggctgctttg

SEQ ID NO: 167569 - DNA, 25 bp, Mus musculus
aaggtagagccaaagaacaaattgg

SEQ ID NO: 167570 - DNA, 25 bp, Mus musculus
aaggtagcaaagggtgtggaatatt

SEQ ID NO: 167571 - DNA, 25 bp, Mus musculus
aaggtagcatcaccaccgcctccgc

SEQ ID NO: 167572 - DNA, 25 bp, Mus musculus
aaggtaggctgtcagccatcttacc

SEQ ID NO: 167573 - DNA, 25 bp, Mus musculus
aaggtataaggcttgctcttcagct

SEQ ID NO: 167574 - DNA, 25 bp, Mus musculus
aaggtatctgtgaagcttcttaacc

SEQ ID NO: 167575 - DNA, 25 bp, Mus musculus
aaggtatggctttttatttagaaga

SEQ ID NO: 167576 - DNA, 25 bp, Mus musculus
aaggtattcatgcaggtccacgcct

SEQ ID NO: 167577 - DNA, 25 bp, Mus musculus
aaggtcaaaagggagaacctggcat

SEQ ID NO: 167578 - DNA, 25 bp, Mus musculus
aaggtcaacaggcgcaacctggtgg

SEQ ID NO: 167579 - DNA, 25 bp, Mus musculus
aaggtcaaggaaatggtggctgcgt

SEQ ID NO: 167580 - DNA, 25 bp, Mus musculus
aaggtcaaggcaccaatgaggaaac

SEQ ID NO: 167581 - DNA, 25 bp, Mus musculus
aaggtcaaggcagcaatgaggaaac

SEQ ID NO: 167582 - DNA, 25 bp, Mus musculus
aaggtcaagtcagtaggacaaagta

SEQ ID NO: 167583 - DNA, 25 bp, Mus musculus
aaggtcacaccgaggatgcgtccga

SEQ ID NO: 167584 - DNA, 25 bp, Mus musculus
aaggtcacagaggacacaaaggtct

SEQ ID NO: 167585 - DNA, 25 bp, Mus musculus
aaggtcacccaggtcctgtccttgg

SEQ ID NO: 167586 - DNA, 25 bp, Mus musculus
aaggtcactgagggcggtgagccgt

SEQ ID NO: 167587 - DNA, 25 bp, Mus musculus
aaggtcagaaagcctctccgaccag

SEQ ID NO: 167588 - DNA, 25 bp, Mus musculus
aaggtcagactgaggcaccaagtat

SEQ ID NO: 167589 - DNA, 25 bp, Mus musculus
aaggtcaggacccagctgtggctag

SEQ ID NO: 167590 - DNA, 25 bp, Mus musculus
aaggtcaggcgggtgaacctggcat

SEQ ID NO: 167591 - DNA, 25 bp, Mus musculus
aaggtcatataagtgacattgaaac

SEQ ID NO: 167592 - DNA, 25 bp, Mus musculus
aaggtcatataatgtcatatttgaa

SEQ ID NO: 167593 - DNA, 25 bp, Mus musculus
aaggtcatcaagcagtgctatcaag

SEQ ID NO: 167594 - DNA, 25 bp, Mus musculus
aaggtccaagaaggtgaatgaatat

SEQ ID NO: 167595 - DNA, 25 bp, Mus musculus
aaggtccagagaggtgtggagagga

SEQ ID NO: 167596 - DNA, 25 bp, Mus musculus
aaggtccaggactgaatctacccaa

SEQ ID NO: 167597 - DNA, 25 bp, Mus musculus
aaggtccaggtccaggtcccgttca

SEQ ID NO: 167598 - DNA, 25 bp, Mus musculus
aaggtcccgggcagcatccagcatg

SEQ ID NO: 167599 - DNA, 25 bp, Mus musculus
aaggtcctacaagggcctgtggacc

SEQ ID NO: 167600 - DNA, 25 bp, Mus musculus
aaggtcctgaagcactcggggataa

SEQ ID NO: 167601 - DNA, 25 bp, Mus musculus
aaggtcctgaagcgcctgtgagaga

SEQ ID NO: 167602 - DNA, 25 bp, Mus musculus
aaggtcctgaaggccgccggtgtta

SEQ ID NO: 167603 - DNA, 25 bp, Mus musculus
aaggtcctttcccagaaaaatatgc

SEQ ID NO: 167604 - DNA, 25 bp, Mus musculus
aaggtcgaacacatgggtcggagcc

SEQ ID NO: 167605 - DNA, 25 bp, Mus musculus
aaggtcgagcaggagcatagaagac

SEQ ID NO: 167606 - DNA, 25 bp, Mus musculus
aaggtcgatgtgggcccagaccctt

SEQ ID NO: 167607 - DNA, 25 bp, Mus musculus
aaggtcggacaagctctactccagg

SEQ ID NO: 167608 - DNA, 25 bp, Mus musculus
aaggtcggacaaggaaacacagaga

SEQ ID NO: 167609 - DNA, 25 bp, Mus musculus
aaggtcgtccaatgccgagacccca

SEQ ID NO: 167610 - DNA, 25 bp, Mus musculus
aaggtcgtccagctgaagaacctgg

SEQ ID NO: 167611 - DNA, 25 bp, Mus musculus
aaggtcgtccatgctggagttacag

SEQ ID NO: 167612 - DNA, 25 bp, Mus musculus
aaggtctcctcagatgaggaaactg

SEQ ID NO: 167613 - DNA, 25 bp, Mus musculus
aaggtctcctggtcttatatccaga

SEQ ID NO: 167614 - DNA, 25 bp, Mus musculus
aaggtctttgcaaagcccaaaatca

SEQ ID NO: 167615 - DNA, 25 bp, Mus musculus
aaggtgaaagacactcgtaatcgcg

SEQ ID NO: 167616 - DNA, 25 bp, Mus musculus
aaggtgaaagagactcggatgacgc

SEQ ID NO: 167617 - DNA, 25 bp, Mus musculus
aaggtgaaagtctcacacaggtccc

SEQ ID NO: 167618 - DNA, 25 bp, Mus musculus
aaggtgaaattggaactcctggccc

SEQ ID NO: 167619 - DNA, 25 bp, Mus musculus
aaggtgaagcttggctgctgtgaag

SEQ ID NO: 167620 - DNA, 25 bp, Mus musculus
aaggtgaccagggtattcctggtga

SEQ ID NO: 167621 - DNA, 25 bp, Mus musculus
aaggtgacctgtgacatccggctcc

SEQ ID NO: 167622 - DNA, 25 bp, Mus musculus
aaggtgacctgtgatggggaaacag

SEQ ID NO: 167623 - DNA, 25 bp, Mus musculus
aaggtgacttccgaggtcctggagg

SEQ ID NO: 167624 - DNA, 25 bp, Mus musculus
aaggtgagaaccgagttcctgttcc

SEQ ID NO: 167625 - DNA, 25 bp, Mus musculus
aaggtgaggagtactgaaccttcca

SEQ ID NO: 167626 - DNA, 25 bp, Mus musculus
aaggtgaggctggtggagttcatga

SEQ ID NO: 167627 - DNA, 25 bp, Mus musculus
aaggtgatacagcaggtggggatgc

SEQ ID NO: 167628 - DNA, 25 bp, Mus musculus
aaggtgatgaaaactacatggaatt

SEQ ID NO: 167629 - DNA, 25 bp, Mus musculus
aaggtgcagttaaagctccctcttg

SEQ ID NO: 167630 - DNA, 25 bp, Mus musculus
aaggtgcagttaaaggatggttcct

SEQ ID NO: 167631 - DNA, 25 bp, Mus musculus
aaggtgccaacatctatttcaaggt

SEQ ID NO: 167632 - DNA, 25 bp, Mus musculus
aaggtgccaacggcgagcctggcaa

SEQ ID NO: 167633 - DNA, 25 bp, Mus musculus
aaggtgccagaggaggatgactcta

SEQ ID NO: 167634 - DNA, 25 bp, Mus musculus
aaggtgccggttttggcacgtgact

SEQ ID NO: 167635 - DNA, 25 bp, Mus musculus
aaggtgcctggacagaaatatcttg

SEQ ID NO: 167636 - DNA, 25 bp, Mus musculus
aaggtgctacaagaaatgtctgaag

SEQ ID NO: 167637 - DNA, 25 bp, Mus musculus
aaggtgctcatgcaggtccatgcct

SEQ ID NO: 167638 - DNA, 25 bp, Mus musculus
aaggtgctgaggcaccatcacaggg

SEQ ID NO: 167639 - DNA, 25 bp, Mus musculus
aaggtgctgagttcatgcaaagagg

SEQ ID NO: 167640 - DNA, 25 bp, Mus musculus
aaggtgcttaaaaaggcaatgatag

SEQ ID NO: 167641 - DNA, 25 bp, Mus musculus
aaggtggaaacaagcgcccaggcgc

SEQ ID NO: 167642 - DNA, 25 bp, Mus musculus
aaggtggagaaacaggtcttgtcca

SEQ ID NO: 167643 - DNA, 25 bp, Mus musculus
aaggtggagaagctcaaggcaagga

SEQ ID NO: 167644 - DNA, 25 bp, Mus musculus
aaggtggcagaggtgctggctggag

SEQ ID NO: 167645 - DNA, 25 bp, Mus musculus
aaggtggcctgtgagacagtgtgca

SEQ ID NO: 167646 - DNA, 25 bp, Mus musculus
aaggtggctctcagccaccaccttg

SEQ ID NO: 167647 - DNA, 25 bp, Mus musculus
aaggtggcttccgaggctccggctt

SEQ ID NO: 167648 - DNA, 25 bp, Mus musculus
aaggtggggccgagcaaccatgaag

SEQ ID NO: 167649 - DNA, 25 bp, Mus musculus
aaggtggtggaaggagctcaaggtt

SEQ ID NO: 167650 - DNA, 25 bp, Mus musculus
aaggtggttcctttggggagataca

SEQ ID NO: 167651 - DNA, 25 bp, Mus musculus
aaggtggttctcgaggctgctgatg

SEQ ID NO: 167652 - DNA, 25 bp, Mus musculus
aaggtggttctgaaacgaagtgaga

SEQ ID NO: 167653 - DNA, 25 bp, Mus musculus
aaggtgtaatgtgagacctctgggt

SEQ ID NO: 167654 - DNA, 25 bp, Mus musculus
aaggtgtaatgtgagagattggtgt

SEQ ID NO: 167655 - DNA, 25 bp, Mus musculus
aaggtgtacaatgaaaatcttgttc

SEQ ID NO: 167656 - DNA, 25 bp, Mus musculus
aaggtgtacaatgagaaacatattc

SEQ ID NO: 167657 - DNA, 25 bp, Mus musculus
aaggtgtattcagacttcaagacca

SEQ ID NO: 167658 - DNA, 25 bp, Mus musculus
aaggtgtattcgggttcctggactg

SEQ ID NO: 167659 - DNA, 25 bp, Mus musculus
aaggtgtcatagacatgaaaaatgc

SEQ ID NO: 167660 - DNA, 25 bp, Mus musculus
aaggtgtctggccctctccaggcca

SEQ ID NO: 167661 - DNA, 25 bp, Mus musculus
aaggtgtgctgaaatttcaaaagga

SEQ ID NO: 167662 - DNA, 25 bp, Mus musculus
aaggtgtgctggtgcgatgcatgct

SEQ ID NO: 167663 - DNA, 25 bp, Mus musculus
aaggtgttccaggagcgcatcaact

SEQ ID NO: 167664 - DNA, 25 bp, Mus musculus
aaggtgttccaggtaggtgcatgag

SEQ ID NO: 167665 - DNA, 25 bp, Mus musculus
aaggttaaaacttcagcatcttctt

SEQ ID NO: 167666 - DNA, 25 bp, Mus musculus
aaggttacaagagtgaaacatcttt

SEQ ID NO: 167667 - DNA, 25 bp, Mus musculus
aaggttacaccaggcttgtgaagat

SEQ ID NO: 167668 - DNA, 25 bp, Mus musculus
aaggttaccagagctgaaattagct

SEQ ID NO: 167669 - DNA, 25 bp, Mus musculus
aaggttaccagtatgcaaccgagga

SEQ ID NO: 167670 - DNA, 25 bp, Mus musculus
aaggttaccagtgtttgaaagacgt

SEQ ID NO: 167671 - DNA, 25 bp, Mus musculus
aaggttaccgcacggataattgtgt

SEQ ID NO: 167672 - DNA, 25 bp, Mus musculus
aaggttacctttcagcctcccagta

SEQ ID NO: 167673 - DNA, 25 bp, Mus musculus
aaggttatagcacacatccagaacc

SEQ ID NO: 167674 - DNA, 25 bp, Mus musculus
aaggttatttgaacacacaggtttg

SEQ ID NO: 167675 - DNA, 25 bp, Mus musculus
aaggttatttggtacaaaatgcagc

SEQ ID NO: 167676 - DNA, 25 bp, Mus musculus
aaggttcaaaccagtaggtgcaaac

SEQ ID NO: 167677 - DNA, 25 bp, Mus musculus
aaggttcaacttctggtctcaccca

SEQ ID NO: 167678 - DNA, 25 bp, Mus musculus
aaggttcagcaaggtttacagtagc

SEQ ID NO: 167679 - DNA, 25 bp, Mus musculus
aaggttcatctctcccttctcagca

SEQ ID NO: 167680 - DNA, 25 bp, Mus musculus
aaggttccaggagagacatgctaca

SEQ ID NO: 167681 - DNA, 25 bp, Mus musculus
aaggttcccaggatcaccgacaacc

SEQ ID NO: 167682 - DNA, 25 bp, Mus musculus
aaggttcctgccgctaacgtcctga

SEQ ID NO: 167683 - DNA, 25 bp, Mus musculus
aaggttctgatatgtcacatgctgc

SEQ ID NO: 167684 - DNA, 25 bp, Mus musculus
aaggttgatgggaatgtaaataaac

SEQ ID NO: 167685 - DNA, 25 bp, Mus musculus
aaggttgatggtccgcagacatctg

SEQ ID NO: 167686 - DNA, 25 bp, Mus musculus
aaggttgcagcacgcagcagaactg

SEQ ID NO: 167687 - DNA, 25 bp, Mus musculus
aaggttgctcaaacatgtgaggaac

SEQ ID NO: 167688 - DNA, 25 bp, Mus musculus
aaggttgctcaatcatgtgaggaac

SEQ ID NO: 167689 - DNA, 25 bp, Mus musculus
aaggttggatgcaagctatgccccc

SEQ ID NO: 167690 - DNA, 25 bp, Mus musculus
aaggttgtccggtccttcagaccag

SEQ ID NO: 167691 - DNA, 25 bp, Mus musculus
aaggtttaatgaaatgatgaaagtt

SEQ ID NO: 167692 - DNA, 25 bp, Mus musculus
aaggtttaatgaaggtgattcagaa

SEQ ID NO: 167693 - DNA, 25 bp, Mus musculus
aaggtttacagcagatacagttggt

SEQ ID NO: 167694 - DNA, 25 bp, Mus musculus
aaggtttataagaacgagctgcacc

SEQ ID NO: 167695 - DNA, 25 bp, Mus musculus
aaggtttcaagaattggaggccact

SEQ ID NO: 167696 - DNA, 25 bp, Mus musculus
aaggtttcagataattggaggatag

SEQ ID NO: 167697 - DNA, 25 bp, Mus musculus
aaggtttcagataattgggccattg

SEQ ID NO: 167698 - DNA, 25 bp, Mus musculus
aaggtttctgacaggtaaccaatgg

SEQ ID NO: 167699 - DNA, 25 bp, Mus musculus
aaggtttctgtttgttttcttctgc

SEQ ID NO: 167700 - DNA, 25 bp, Mus musculus
aaggttttagggcaagtctgatgag

SEQ ID NO: 167701 - DNA, 25 bp, Mus musculus
aagtaaaaactggcattgcttcacg

SEQ ID NO: 167702 - DNA, 25 bp, Mus musculus
aagtaaagagaaagtgtttatggga

SEQ ID NO: 167703 - DNA, 25 bp, Mus musculus
aagtaaagcaagagcaccagaagtg

SEQ ID NO: 167704 - DNA, 25 bp, Mus musculus
aagtaaagcaaggctgtggctctgg

SEQ ID NO: 167705 - DNA, 25 bp, Mus musculus
aagtaaataaaggaatgtgtttctg

SEQ ID NO: 167706 - DNA, 25 bp, Mus musculus
aagtaaatggaaggcatacgatgcg

SEQ ID NO: 167707 - DNA, 25 bp, Mus musculus
aagtaaatgtaagtatgccatttgt

SEQ ID NO: 167708 - DNA, 25 bp, Mus musculus
aagtaacactgagtaccagtgatgg

SEQ ID NO: 167709 - DNA, 25 bp, Mus musculus
aagtaacagacctgaccaaagtcaa

SEQ ID NO: 167710 - DNA, 25 bp, Mus musculus
aagtaacagactttgcatgaagttg

SEQ ID NO: 167711 - DNA, 25 bp, Mus musculus
aagtaaccaaatgagtaagaaagcc

SEQ ID NO: 167712 - DNA, 25 bp, Mus musculus
aagtaaccaacacagatccagtcct

SEQ ID NO: 167713 - DNA, 25 bp, Mus musculus
aagtaaccccaggttctgccttaga

SEQ ID NO: 167714 - DNA, 25 bp, Mus musculus
aagtaaccgctcaggtagtagtctg

SEQ ID NO: 167715 - DNA, 25 bp, Mus musculus
aagtaaccgctcagttcatctcaaa

SEQ ID NO: 167716 - DNA, 25 bp, Mus musculus
aagtaacctaggtctgctgcaggtg

SEQ ID NO: 167717 - DNA, 25 bp, Mus musculus
aagtaactaactggtccagctgctg

SEQ ID NO: 167718 - DNA, 25 bp, Mus musculus
aagtaacttcaaggttatccaggcc

SEQ ID NO: 167719 - DNA, 25 bp, Mus musculus
aagtaacttgataacaaagttgtta

SEQ ID NO: 167720 - DNA, 25 bp, Mus musculus
aagtaagaagctgacatgccatatg

SEQ ID NO: 167721 - DNA, 25 bp, Mus musculus
aagtaagagaaccagcattggattg

SEQ ID NO: 167722 - DNA, 25 bp, Mus musculus
aagtaagcggactggaaacagcaaa

SEQ ID NO: 167723 - DNA, 25 bp, Mus musculus
aagtaaggagagatgcctctggatg

SEQ ID NO: 167724 - DNA, 25 bp, Mus musculus
aagtaaggagagttttagatgcctc

SEQ ID NO: 167725 - DNA, 25 bp, Mus musculus
aagtaagttatggttatcaccattc

SEQ ID NO: 167726 - DNA, 25 bp, Mus musculus
aagtaataaaatagagaatcatcat

SEQ ID NO: 167727 - DNA, 25 bp, Mus musculus
aagtaatacaagctatggtgaaata

SEQ ID NO: 167728 - DNA, 25 bp, Mus musculus
aagtaatgccaatcccatcttcatg

SEQ ID NO: 167729 - DNA, 25 bp, Mus musculus
aagtaatgggggcctgcatccttag

SEQ ID NO: 167730 - DNA, 25 bp, Mus musculus
aagtacaaagatgaacgagaccgtg

SEQ ID NO: 167731 - DNA, 25 bp, Mus musculus
aagtacaaataatctgcaggacagc

SEQ ID NO: 167732 - DNA, 25 bp, Mus musculus
aagtacaagagcgaggaagaggaag

SEQ ID NO: 167733 - DNA, 25 bp, Mus musculus
aagtacaagagcgagggtccagatt

SEQ ID NO: 167734 - DNA, 25 bp, Mus musculus
aagtacaatcaggcctggctgctgc

SEQ ID NO: 167735 - DNA, 25 bp, Mus musculus
aagtacacaaatgatgacttctggt

SEQ ID NO: 167736 - DNA, 25 bp, Mus musculus
aagtacacaagaaactaacactaag

SEQ ID NO: 167737 - DNA, 25 bp, Mus musculus
aagtacacagtgtgtgattcagtga

SEQ ID NO: 167738 - DNA, 25 bp, Mus musculus
aagtacaccaagtcaaaagtgagac

SEQ ID NO: 167739 - DNA, 25 bp, Mus musculus
aagtacaccaagtcggacttacggt

SEQ ID NO: 167740 - DNA, 25 bp, Mus musculus
aagtacacccaaaagatttttgaat

SEQ ID NO: 167741 - DNA, 25 bp, Mus musculus
aagtacacccaaaaggtcactccat

SEQ ID NO: 167742 - DNA, 25 bp, Mus musculus
aagtacacggtccagcagcaaccct

SEQ ID NO: 167743 - DNA, 25 bp, Mus musculus
aagtacacggtccaggatgagagtc

SEQ ID NO: 167744 - DNA, 25 bp, Mus musculus
aagtacactcaggctgaagctctac

SEQ ID NO: 167745 - DNA, 25 bp, Mus musculus
aagtacactcaggctgagggtaaaa

SEQ ID NO: 167746 - DNA, 25 bp, Mus musculus
aagtacagaagatctaaagcgggaa

SEQ ID NO: 167747 - DNA, 25 bp, Mus musculus
aagtacagcaaacagatgcgtgtac

SEQ ID NO: 167748 - DNA, 25 bp, Mus musculus
aagtacagcaaacagccatttcgta

SEQ ID NO: 167749 - DNA, 25 bp, Mus musculus
aagtacagcagggcttcctgaaaga

SEQ ID NO: 167750 - DNA, 25 bp, Mus musculus
aagtacagcatggggcaaggagagg

SEQ ID NO: 167751 - DNA, 25 bp, Mus musculus
aagtacagcatgggtatcaccagcc

SEQ ID NO: 167752 - DNA, 25 bp, Mus musculus
aagtacagcttctggcctccaactt

SEQ ID NO: 167753 - DNA, 25 bp, Mus musculus
aagtacaggtagagatctgcctgcc

SEQ ID NO: 167754 - DNA, 25 bp, Mus musculus
aagtacaggtatgaactcaagcggc

SEQ ID NO: 167755 - DNA, 25 bp, Mus musculus
aagtacatccaccctgaaacgatca

SEQ ID NO: 167756 - DNA, 25 bp, Mus musculus
aagtacatggcgcagcagcagtttt

SEQ ID NO: 167757 - DNA, 25 bp, Mus musculus
aagtaccacagggagtccccccatc

SEQ ID NO: 167758 - DNA, 25 bp, Mus musculus
aagtaccagaagacctcatcgggaa

SEQ ID NO: 167759 - DNA, 25 bp, Mus musculus
aagtaccagaccagtatcacagagc

SEQ ID NO: 167760 - DNA, 25 bp, Mus musculus
aagtaccagaccagtcgtgttgagg

SEQ ID NO: 167761 - DNA, 25 bp, Mus musculus
aagtacccacacacccaaaccaggt

SEQ ID NO: 167762 - DNA, 25 bp, Mus musculus
aagtaccctgaaagagttaaacatc

SEQ ID NO: 167763 - DNA, 25 bp, Mus musculus
aagtacccttgctgcaatgaagctg

SEQ ID NO: 167764 - DNA, 25 bp, Mus musculus
aagtaccgaaagctggacgatggta

SEQ ID NO: 167765 - DNA, 25 bp, Mus musculus
aagtaccgagtgctgcttttgatac

SEQ ID NO: 167766 - DNA, 25 bp, Mus musculus
aagtaccgttgtgagctgctggggc

SEQ ID NO: 167767 - DNA, 25 bp, Mus musculus
aagtacctagaagatcttggtaatg

SEQ ID NO: 167768 - DNA, 25 bp, Mus musculus
aagtacctggtctggtcactcgagc

SEQ ID NO: 167769 - DNA, 25 bp, Mus musculus
aagtaccttgggatcagagggctcc

SEQ ID NO: 167770 - DNA, 25 bp, Mus musculus
aagtaccttgggggccggcacatgg

SEQ ID NO: 167771 - DNA, 25 bp, Mus musculus
aagtacctttccaataccaaatatg

SEQ ID NO: 167772 - DNA, 25 bp, Mus musculus
aagtacctttccagagctgccttac

SEQ ID NO: 167773 - DNA, 25 bp, Mus musculus
aagtacgactgaaggagaaaatttt

SEQ ID NO: 167774 - DNA, 25 bp, Mus musculus
aagtacgcaagatgaacactaccac

SEQ ID NO: 167775 - DNA, 25 bp, Mus musculus
aagtacgcccgaggacttcaggaac

SEQ ID NO: 167776 - DNA, 25 bp, Mus musculus
aagtacggcgtggccttttacaact

SEQ ID NO: 167777 - DNA, 25 bp, Mus musculus
aagtacgggatttgctggacaggac

SEQ ID NO: 167778 - DNA, 25 bp, Mus musculus
aagtacgtttactgtgagttccttc

SEQ ID NO: 167779 - DNA, 25 bp, Mus musculus
aagtactacaaggacatcaatgcaa

SEQ ID NO: 167780 - DNA, 25 bp, Mus musculus
aagtactagaaaagttcctgtggaa

SEQ ID NO: 167781 - DNA, 25 bp, Mus musculus
aagtactatctgacaagcacaaacg

SEQ ID NO: 167782 - DNA, 25 bp, Mus musculus
aagtactatctgacaagcacctata

SEQ ID NO: 167783 - DNA, 25 bp, Mus musculus
aagtactatctgacagaagtggtcc

SEQ ID NO: 167784 - DNA, 25 bp, Mus musculus
aagtactcacccaagattgatgacc

SEQ ID NO: 167785 - DNA, 25 bp, Mus musculus
aagtactcacccaaggagctgctag

SEQ ID NO: 167786 - DNA, 25 bp, Mus musculus
aagtactgacaaggggtgtgatttt

SEQ ID NO: 167787 - DNA, 25 bp, Mus musculus
aagtactgcgaagatgtcaatgaat

SEQ ID NO: 167788 - DNA, 25 bp, Mus musculus
aagtacttaaggctcaggccgtgga

SEQ ID NO: 167789 - DNA, 25 bp, Mus musculus
aagtacttaagtcaggaggaggctc

SEQ ID NO: 167790 - DNA, 25 bp, Mus musculus
aagtacttcctggtgggtgcagggg

SEQ ID NO: 167791 - DNA, 25 bp, Mus musculus
aagtacttcttgcacgatgacagag

SEQ ID NO: 167792 - DNA, 25 bp, Mus musculus
aagtacttgaagcatgcctcatggc

SEQ ID NO: 167793 - DNA, 25 bp, Mus musculus
aagtactttgcccgagggctccggg

SEQ ID NO: 167794 - DNA, 25 bp, Mus musculus
aagtactttggcagcccgggccaac

SEQ ID NO: 167795 - DNA, 25 bp, Mus musculus
aagtagaaaaaacagacagtgatgt

SEQ ID NO: 167796 - DNA, 25 bp, Mus musculus
aagtagaaagatctaaaggggtgat

SEQ ID NO: 167797 - DNA, 25 bp, Mus musculus
aagtagaagaacagaaactacataa

SEQ ID NO: 167798 - DNA, 25 bp, Mus musculus
aagtagacacctacatacagactaa

SEQ ID NO: 167799 - DNA, 25 bp, Mus musculus
aagtagacagcctgatgtgtgaaaa

SEQ ID NO: 167800 - DNA, 25 bp, Mus musculus
aagtagacaggcattggactactca

SEQ ID NO: 167801 - DNA, 25 bp, Mus musculus
aagtagagaggcattttcttgagat

SEQ ID NO: 167802 - DNA, 25 bp, Mus musculus
aagtagagccagcaagtccacatgc

SEQ ID NO: 167803 - DNA, 25 bp, Mus musculus
aagtagagccaggcttgccatctcc

SEQ ID NO: 167804 - DNA, 25 bp, Mus musculus
aagtagaggactgttatgaaagaga

SEQ ID NO: 167805 - DNA, 25 bp, Mus musculus
aagtagaggcaccagactccccctg

SEQ ID NO: 167806 - DNA, 25 bp, Mus musculus
aagtagcaaagactctgttacggca

SEQ ID NO: 167807 - DNA, 25 bp, Mus musculus
aagtagcaaaggtgattggatgtgt

SEQ ID NO: 167808 - DNA, 25 bp, Mus musculus
aagtagcaatgaaggggtagaggag

SEQ ID NO: 167809 - DNA, 25 bp, Mus musculus
aagtagccccagctgagaaaaaacg

SEQ ID NO: 167810 - DNA, 25 bp, Mus musculus
aagtagcctccggctatgcatatgg

SEQ ID NO: 167811 - DNA, 25 bp, Mus musculus
aagtagcgtgaaggttcttcatgag

SEQ ID NO: 167812 - DNA, 25 bp, Mus musculus
aagtagctaaaacattctcatacaa

SEQ ID NO: 167813 - DNA, 25 bp, Mus musculus
aagtagctcagcagacaagaaaaat

SEQ ID NO: 167814 - DNA, 25 bp, Mus musculus
aagtaggctccgaggtggcgaaatg

SEQ ID NO: 167815 - DNA, 25 bp, Mus musculus
aagtagtccaacagagaatgaagca

SEQ ID NO: 167816 - DNA, 25 bp, Mus musculus
aagtagtctggtcagatagttttga

SEQ ID NO: 167817 - DNA, 25 bp, Mus musculus
aagtagtgagtctattgagaacctt

SEQ ID NO: 167818 - DNA, 25 bp, Mus musculus
aagtagttaccgtggtcaagaagaa

SEQ ID NO: 167819 - DNA, 25 bp, Mus musculus
aagtagtttttgacagaaaatctgg

SEQ ID NO: 167820 - DNA, 25 bp, Mus musculus
aagtataaaaaacgcaataccacag

SEQ ID NO: 167821 - DNA, 25 bp, Mus musculus
aagtataaacactggaacttagcag

SEQ ID NO: 167822 - DNA, 25 bp, Mus musculus
aagtataaacactgtaaaggatctc

SEQ ID NO: 167823 - DNA, 25 bp, Mus musculus
aagtataactcaaggctccagaatg

SEQ ID NO: 167824 - DNA, 25 bp, Mus musculus
aagtataactcagggaatgggacag

SEQ ID NO: 167825 - DNA, 25 bp, Mus musculus
aagtatacaaaaggatttactaggt

SEQ ID NO: 167826 - DNA, 25 bp, Mus musculus
aagtatagcagagggctcctgctga

SEQ ID NO: 167827 - DNA, 25 bp, Mus musculus
aagtatatactcaaggtatcgcagg

SEQ ID NO: 167828 - DNA, 25 bp, Mus musculus
aagtatattgcaggattcactagca

SEQ ID NO: 167829 - DNA, 25 bp, Mus musculus
aagtatccatcatcagaagtactcc

SEQ ID NO: 167830 - DNA, 25 bp, Mus musculus
aagtatccatcttctgtatctcaga

SEQ ID NO: 167831 - DNA, 25 bp, Mus musculus
aagtatcctgaaggaaagaccgtag

SEQ ID NO: 167832 - DNA, 25 bp, Mus musculus
aagtatcggaagcttgtgtcggcag

SEQ ID NO: 167833 - DNA, 25 bp, Mus musculus
aagtatctcagaaagacccaaatgg

SEQ ID NO: 167834 - DNA, 25 bp, Mus musculus
aagtatctcagattgaagaccaaat

SEQ ID NO: 167835 - DNA, 25 bp, Mus musculus
aagtatcttgatcccacctaaacca

SEQ ID NO: 167836 - DNA, 25 bp, Mus musculus
aagtatgaacaggcctgtcgtgagt

SEQ ID NO: 167837 - DNA, 25 bp, Mus musculus
aagtatgaagaggtggcccgtaagc

SEQ ID NO: 167838 - DNA, 25 bp, Mus musculus
aagtatgaagaggtggctcgtaagt

SEQ ID NO: 167839 - DNA, 25 bp, Mus musculus
aagtatgacccacagggctctctag

SEQ ID NO: 167840 - DNA, 25 bp, Mus musculus
aagtatgacctcaagggctctctag

SEQ ID NO: 167841 - DNA, 25 bp, Mus musculus
aagtatgacgccagctgtgactcca

SEQ ID NO: 167842 - DNA, 25 bp, Mus musculus
aagtatgagaaggatgttgctgact

SEQ ID NO: 167843 - DNA, 25 bp, Mus musculus
aagtatgagcctgccatacagcgtt

SEQ ID NO: 167844 - DNA, 25 bp, Mus musculus
aagtatgatgatataagcttaccaa

SEQ ID NO: 167845 - DNA, 25 bp, Mus musculus
aagtatgatgcccaggacttagaag

SEQ ID NO: 167846 - DNA, 25 bp, Mus musculus
aagtatgatgcccagtcttaccatg

SEQ ID NO: 167847 - DNA, 25 bp, Mus musculus
aagtatgatttgaggacccagttcc

SEQ ID NO: 167848 - DNA, 25 bp, Mus musculus
aagtatgcaggctgctcgtcagtgc

SEQ ID NO: 167849 - DNA, 25 bp, Mus musculus
aagtatgcagtgctcgatgaagcca

SEQ ID NO: 167850 - DNA, 25 bp, Mus musculus
aagtatgctgagctgacacttatgc

SEQ ID NO: 167851 - DNA, 25 bp, Mus musculus
aagtatgctgagctgctggaagagc

SEQ ID NO: 167852 - DNA, 25 bp, Mus musculus
aagtatggatgggtacctggaatgg

SEQ ID NO: 167853 - DNA, 25 bp, Mus musculus
aagtatgtaccccaactgtgccatc

SEQ ID NO: 167854 - DNA, 25 bp, Mus musculus
aagtatgtggaggaacatgtgtatg

SEQ ID NO: 167855 - DNA, 25 bp, Mus musculus
aagtatgtggaggccatgggaagtg

SEQ ID NO: 167856 - DNA, 25 bp, Mus musculus
aagtattaccgtaataaaagagcag

SEQ ID NO: 167857 - DNA, 25 bp, Mus musculus
aagtattactatgaagtttctctgc

SEQ ID NO: 167858 - DNA, 25 bp, Mus musculus
aagtattactatgaatacctctctg

SEQ ID NO: 167859 - DNA, 25 bp, Mus musculus
aagtattagaaaaagatgttggttt

SEQ ID NO: 167860 - DNA, 25 bp, Mus musculus
aagtattagaataaatgaaggattc

SEQ ID NO: 167861 - DNA, 25 bp, Mus musculus
aagtattcaaacaaggcaagcttct

SEQ ID NO: 167862 - DNA, 25 bp, Mus musculus
aagtattccaggctctgtgcaagga

SEQ ID NO: 167863 - DNA, 25 bp, Mus musculus
aagtattctgtatctgcagtgggtc

SEQ ID NO: 167864 - DNA, 25 bp, Mus musculus
aagtattgggagctccagtggcagt

SEQ ID NO: 167865 - DNA, 25 bp, Mus musculus
aagtattgtttaaactacagaactt

SEQ ID NO: 167866 - DNA, 25 bp, Mus musculus
aagtatttaataaaggcctgtgata

SEQ ID NO: 167867 - DNA, 25 bp, Mus musculus
aagtatttatcagataaccacattt

SEQ ID NO: 167868 - DNA, 25 bp, Mus musculus
aagtatttctggcctcggattacaa

SEQ ID NO: 167869 - DNA, 25 bp, Mus musculus
aagtcaaaaagattgataagtatct

SEQ ID NO: 167870 - DNA, 25 bp, Mus musculus
aagtcaaaaggatcgtcagtggcat

SEQ ID NO: 167871 - DNA, 25 bp, Mus musculus
aagtcaaaaggtctccagatgaggc

SEQ ID NO: 167872 - DNA, 25 bp, Mus musculus
aagtcaaagaggcaaaagcaaaaga

SEQ ID NO: 167873 - DNA, 25 bp, Mus musculus
aagtcaaagctgaggtacggcatcc

SEQ ID NO: 167874 - DNA, 25 bp, Mus musculus
aagtcaacgtccacaagcttgtgac

SEQ ID NO: 167875 - DNA, 25 bp, Mus musculus
aagtcaagaagaagatgtgttacag

SEQ ID NO: 167876 - DNA, 25 bp, Mus musculus
aagtcaagagcaagaagaagcagac

SEQ ID NO: 167877 - DNA, 25 bp, Mus musculus
aagtcaagagcaagtttggcgccga

SEQ ID NO: 167878 - DNA, 25 bp, Mus musculus
aagtcaagcctttcatcacctatca

SEQ ID NO: 167879 - DNA, 25 bp, Mus musculus
aagtcaagtgatcaaccggaaactc

SEQ ID NO: 167880 - DNA, 25 bp, Mus musculus
aagtcaagtttgtgggtgaatccgt

SEQ ID NO: 167881 - DNA, 25 bp, Mus musculus
aagtcaatcaggcgacggtgtggat

SEQ ID NO: 167882 - DNA, 25 bp, Mus musculus
aagtcaatgctcaggtgcagtgtct

SEQ ID NO: 167883 - DNA, 25 bp, Mus musculus
aagtcaatgtgaacaagcttgtgac

SEQ ID NO: 167884 - DNA, 25 bp, Mus musculus
aagtcacaacttagtcttgacttct

SEQ ID NO: 167885 - DNA, 25 bp, Mus musculus
aagtcacaacttagtgtcttcaaga

SEQ ID NO: 167886 - DNA, 25 bp, Mus musculus
aagtcacaagagaatgcaggcatgt

SEQ ID NO: 167887 - DNA, 25 bp, Mus musculus
aagtcacaagaggaactttgtggtg

SEQ ID NO: 167888 - DNA, 25 bp, Mus musculus
aagtcacaagctcctcaggatccca

SEQ ID NO: 167889 - DNA, 25 bp, Mus musculus
aagtcacaaggacaaagtatagaca

SEQ ID NO: 167890 - DNA, 25 bp, Mus musculus
aagtcacaagggaacagcagtgcac

SEQ ID NO: 167891 - DNA, 25 bp, Mus musculus
aagtcacacaaggaggatacatctc

SEQ ID NO: 167892 - DNA, 25 bp, Mus musculus
aagtcacacagcgacatgtgaggga

SEQ ID NO: 167893 - DNA, 25 bp, Mus musculus
aagtcacatggctgctgccacaggt

SEQ ID NO: 167894 - DNA, 25 bp, Mus musculus
aagtcacctttcgggcaggtgatat

SEQ ID NO: 167895 - DNA, 25 bp, Mus musculus
aagtcacctttcgggtcatctagta

SEQ ID NO: 167896 - DNA, 25 bp, Mus musculus
aagtcacgtcaaggtagccatccct

SEQ ID NO: 167897 - DNA, 25 bp, Mus musculus
aagtcactcggtgtgggctttgcca

SEQ ID NO: 167898 - DNA, 25 bp, Mus musculus
aagtcactgccaggtatgtgaaggg

SEQ ID NO: 167899 - DNA, 25 bp, Mus musculus
aagtcactgcggaaactgaaacctt

SEQ ID NO: 167900 - DNA, 25 bp, Mus musculus
aagtcactggaatttcttgatggaa

SEQ ID NO: 167901 - DNA, 25 bp, Mus musculus
aagtcactgggaatctgtccttgaa

SEQ ID NO: 167902 - DNA, 25 bp, Mus musculus
aagtcactggggacccctgtgcagc

SEQ ID NO: 167903 - DNA, 25 bp, Mus musculus
aagtcactgtggacgatgctcagac

SEQ ID NO: 167904 - DNA, 25 bp, Mus musculus
aagtcactttccaaggaatttgaag

SEQ ID NO: 167905 - DNA, 25 bp, Mus musculus
aagtcagaaaagtgttacatgtaga

SEQ ID NO: 167906 - DNA, 25 bp, Mus musculus
aagtcagaaaccccaggtttcccag

SEQ ID NO: 167907 - DNA, 25 bp, Mus musculus
aagtcagaactgagtacacaaacaa

SEQ ID NO: 167908 - DNA, 25 bp, Mus musculus
aagtcagaagatgattcagctaaat

SEQ ID NO: 167909 - DNA, 25 bp, Mus musculus
aagtcagaaggcttcggagttgggc

SEQ ID NO: 167910 - DNA, 25 bp, Mus musculus
aagtcagaagggcatcctggcccag

SEQ ID NO: 167911 - DNA, 25 bp, Mus musculus
aagtcagaagttttggggttacaag

SEQ ID NO: 167912 - DNA, 25 bp, Mus musculus
aagtcagagaggaagattacaacaa

SEQ ID NO: 167913 - DNA, 25 bp, Mus musculus
aagtcagaggccttgctcctaaatg

SEQ ID NO: 167914 - DNA, 25 bp, Mus musculus
aagtcagatgcaggatgccaggcag

SEQ ID NO: 167915 - DNA, 25 bp, Mus musculus
aagtcagccaagaaggtgaaggaag

SEQ ID NO: 167916 - DNA, 25 bp, Mus musculus
aagtcagcctggaaactgcccgtga

SEQ ID NO: 167917 - DNA, 25 bp, Mus musculus
aagtcagcctggcgcaagatgcagg

SEQ ID NO: 167918 - DNA, 25 bp, Mus musculus
aagtcagcctttagttcctctttcc

SEQ ID NO: 167919 - DNA, 25 bp, Mus musculus
aagtcagcgagaaaggagacaccgt

SEQ ID NO: 167920 - DNA, 25 bp, Mus musculus
aagtcaggaggatcgcaagtcctac

SEQ ID NO: 167921 - DNA, 25 bp, Mus musculus
aagtcaggcagatgatgtgtgttaa

SEQ ID NO: 167922 - DNA, 25 bp, Mus musculus
aagtcagggaaggttttggtcgtgt

SEQ ID NO: 167923 - DNA, 25 bp, Mus musculus
aagtcagtcagctttccctgctgct

SEQ ID NO: 167924 - DNA, 25 bp, Mus musculus
aagtcagtcaggtcagctttggcta

SEQ ID NO: 167925 - DNA, 25 bp, Mus musculus
aagtcagtgaaaaaaaattcaagca

SEQ ID NO: 167926 - DNA, 25 bp, Mus musculus
aagtcagtgaaaaaattgtacaatc

SEQ ID NO: 167927 - DNA, 25 bp, Mus musculus
aagtcagtgaaggcaggagctggga

SEQ ID NO: 167928 - DNA, 25 bp, Mus musculus
aagtcagtgaggacttacagaagct

SEQ ID NO: 167929 - DNA, 25 bp, Mus musculus
aagtcagttgtagagggcatctcct

SEQ ID NO: 167930 - DNA, 25 bp, Mus musculus
aagtcatactggtgaacggcctttc

SEQ ID NO: 167931 - DNA, 25 bp, Mus musculus
aagtcatattcagagcctcagctta

SEQ ID NO: 167932 - DNA, 25 bp, Mus musculus
aagtcatattcggtggatttcttta

SEQ ID NO: 167933 - DNA, 25 bp, Mus musculus
aagtcatccttggcatggatgatac

SEQ ID NO: 167934 - DNA, 25 bp, Mus musculus
aagtcatggaacaggtgagaggcta

SEQ ID NO: 167935 - DNA, 25 bp, Mus musculus
aagtcattaagggtgatgtttataa

SEQ ID NO: 167936 - DNA, 25 bp, Mus musculus
aagtcattcaattctggaacaagaa

SEQ ID NO: 167937 - DNA, 25 bp, Mus musculus
aagtcattgggagagtccttatcgg

SEQ ID NO: 167938 - DNA, 25 bp, Mus musculus
aagtcatttcagccgtgtttgaccg

SEQ ID NO: 167939 - DNA, 25 bp, Mus musculus
aagtcatttcctgtagaagaccctg

SEQ ID NO: 167940 - DNA, 25 bp, Mus musculus
aagtcattttgaaagatgtccttca

SEQ ID NO: 167941 - DNA, 25 bp, Mus musculus
aagtccaaacagttcagatttcaac

SEQ ID NO: 167942 - DNA, 25 bp, Mus musculus
aagtccaaatcacaggcatatgcta

SEQ ID NO: 167943 - DNA, 25 bp, Mus musculus
aagtccaacctcgggctcaaaaaat

SEQ ID NO: 167944 - DNA, 25 bp, Mus musculus
aagtccaagaagaggagaaaccaag

SEQ ID NO: 167945 - DNA, 25 bp, Mus musculus
aagtccaagaagatgctgtcgccga

SEQ ID NO: 167946 - DNA, 25 bp, Mus musculus
aagtccaagtccggtcagagcagca

SEQ ID NO: 167947 - DNA, 25 bp, Mus musculus
aagtccaagtgcgatatgatgaatg

SEQ ID NO: 167948 - DNA, 25 bp, Mus musculus
aagtccacaccgggacaaccatcat

SEQ ID NO: 167949 - DNA, 25 bp, Mus musculus
aagtccacatttgagaacggccggt

SEQ ID NO: 167950 - DNA, 25 bp, Mus musculus
aagtccacatttgagtgtgaagtga

SEQ ID NO: 167951 - DNA, 25 bp, Mus musculus
aagtccagaagaaatattatgggct

SEQ ID NO: 167952 - DNA, 25 bp, Mus musculus
aagtccagagcaaggttgctcttct

SEQ ID NO: 167953 - DNA, 25 bp, Mus musculus
aagtccagatctgatgaacacaatg

SEQ ID NO: 167954 - DNA, 25 bp, Mus musculus
aagtccagcaaggagattcttccaa

SEQ ID NO: 167955 - DNA, 25 bp, Mus musculus
aagtccagcactagggctccttctc

SEQ ID NO: 167956 - DNA, 25 bp, Mus musculus
aagtccagcaggaattgtctgggac

SEQ ID NO: 167957 - DNA, 25 bp, Mus musculus
aagtccaggaggaagaggaagtcca

SEQ ID NO: 167958 - DNA, 25 bp, Mus musculus
aagtccaggaggaagatgctgtcgc

SEQ ID NO: 167959 - DNA, 25 bp, Mus musculus
aagtccatcaacatcctaatcctgg

SEQ ID NO: 167960 - DNA, 25 bp, Mus musculus
aagtccatcacgattcaggctcttt

SEQ ID NO: 167961 - DNA, 25 bp, Mus musculus
aagtccatgaaagtgagatgagcat

SEQ ID NO: 167962 - DNA, 25 bp, Mus musculus
aagtccatgttggagtttggattcg

SEQ ID NO: 167963 - DNA, 25 bp, Mus musculus
aagtccattctcacatccatgaaga

SEQ ID NO: 167964 - DNA, 25 bp, Mus musculus
aagtcccaaatcagatcgacatcag

SEQ ID NO: 167965 - DNA, 25 bp, Mus musculus
aagtcccaactcaaggtctgatccg

SEQ ID NO: 167966 - DNA, 25 bp, Mus musculus
aagtcccaactcaaggtgctgtccc

SEQ ID NO: 167967 - DNA, 25 bp, Mus musculus
aagtcccaagccaggctttcttgat

SEQ ID NO: 167968 - DNA, 25 bp, Mus musculus
aagtcccacacctacttcattatag

SEQ ID NO: 167969 - DNA, 25 bp, Mus musculus
aagtcccagacagcagctgcagtat

SEQ ID NO: 167970 - DNA, 25 bp, Mus musculus
aagtcccagacagcttgcttgcctt

SEQ ID NO: 167971 - DNA, 25 bp, Mus musculus
aagtcccagctgagactggctggtg

SEQ ID NO: 167972 - DNA, 25 bp, Mus musculus
aagtcccaggactctcggctctccc

SEQ ID NO: 167973 - DNA, 25 bp, Mus musculus
aagtcccaggttgttcagatgtcac

SEQ ID NO: 167974 - DNA, 25 bp, Mus musculus
aagtcccatgcgtcaggaaatgtgt

SEQ ID NO: 167975 - DNA, 25 bp, Mus musculus
aagtccccaggagaggagacaaggc

SEQ ID NO: 167976 - DNA, 25 bp, Mus musculus
aagtccccaggccggggagcgtcat

SEQ ID NO: 167977 - DNA, 25 bp, Mus musculus
aagtccccatctcagagctctcttc

SEQ ID NO: 167978 - DNA, 25 bp, Mus musculus
aagtccccatctcagccagcagagg

SEQ ID NO: 167979 - DNA, 25 bp, Mus musculus
aagtccccatctcagctccggaaag

SEQ ID NO: 167980 - DNA, 25 bp, Mus musculus
aagtcccccaaactgaagaagtagc

SEQ ID NO: 167981 - DNA, 25 bp, Mus musculus
aagtcccgaggccaaccgcgtagcc

SEQ ID NO: 167982 - DNA, 25 bp, Mus musculus
aagtcccgaggttgagccccacatg

SEQ ID NO: 167983 - DNA, 25 bp, Mus musculus
aagtcccgatcaagatcaacaaccc

SEQ ID NO: 167984 - DNA, 25 bp, Mus musculus
aagtccctataaccgatgagaacca

SEQ ID NO: 167985 - DNA, 25 bp, Mus musculus
aagtccctcacacacctgcacgttc

SEQ ID NO: 167986 - DNA, 25 bp, Mus musculus
aagtccctcagggtgatgtgaacag

SEQ ID NO: 167987 - DNA, 25 bp, Mus musculus
aagtccctcttagagtttcaagaac

SEQ ID NO: 167988 - DNA, 25 bp, Mus musculus
aagtccctggctgagtatgagccca

SEQ ID NO: 167989 - DNA, 25 bp, Mus musculus
aagtccgactggaactggaaaagga

SEQ ID NO: 167990 - DNA, 25 bp, Mus musculus
aagtccgagaaggaaaagtggtcat

SEQ ID NO: 167991 - DNA, 25 bp, Mus musculus
aagtccgagaaggcctgtgtgggca

SEQ ID NO: 167992 - DNA, 25 bp, Mus musculus
aagtccgaggcctacctcccttttg

SEQ ID NO: 167993 - DNA, 25 bp, Mus musculus
aagtccgaggcctatgttgatctaa

SEQ ID NO: 167994 - DNA, 25 bp, Mus musculus
aagtccgaggttctgccgcaggaga

SEQ ID NO: 167995 - DNA, 25 bp, Mus musculus
aagtccgcgagtggggttgcggccg

SEQ ID NO: 167996 - DNA, 25 bp, Mus musculus
aagtccggcagtaggacagtccttc

SEQ ID NO: 167997 - DNA, 25 bp, Mus musculus
aagtccggcggtagccaccaagatc

SEQ ID NO: 167998 - DNA, 25 bp, Mus musculus
aagtccgggaaaggattcagatatt

SEQ ID NO: 167999 - DNA, 25 bp, Mus musculus
aagtccgtgatcagaattgcatttg

SEQ ID NO: 168000 - DNA, 25 bp, Mus musculus
aagtccgtgatcagttccgtatcta

SEQ ID NO: 168001 - DNA, 25 bp, Mus musculus
aagtcctatataggtgacagtggaa

SEQ ID NO: 168002 - DNA, 25 bp, Mus musculus
aagtcctcaactaggagcttcgata

SEQ ID NO: 168003 - DNA, 25 bp, Mus musculus
aagtcctcagccagcaaacaggccc

SEQ ID NO: 168004 - DNA, 25 bp, Mus musculus
aagtcctcagggctgaactgaaaaa

SEQ ID NO: 168005 - DNA, 25 bp, Mus musculus
aagtcctccggaccatgctgcctgt

SEQ ID NO: 168006 - DNA, 25 bp, Mus musculus
aagtcctccggtctgaaactcttct

SEQ ID NO: 168007 - DNA, 25 bp, Mus musculus
aagtcctgacaagccgcccctcggc

SEQ ID NO: 168008 - DNA, 25 bp, Mus musculus
aagtcctgacacaagcgaccgggac

SEQ ID NO: 168009 - DNA, 25 bp, Mus musculus
aagtcctggaatgtcatggccttat

SEQ ID NO: 168010 - DNA, 25 bp, Mus musculus
aagtcctggaggcaggcgacaagca

SEQ ID NO: 168011 - DNA, 25 bp, Mus musculus
aagtcctggaggctggagtcacaga

SEQ ID NO: 168012 - DNA, 25 bp, Mus musculus
aagtcctggcacagagaacctgtgc

SEQ ID NO: 168013 - DNA, 25 bp, Mus musculus
aagtcctggcacaggtacaaagtga

SEQ ID NO: 168014 - DNA, 25 bp, Mus musculus
aagtcctgggaatcaacaagcaaga

SEQ ID NO: 168015 - DNA, 25 bp, Mus musculus
aagtccttaaggtgcagacccacct

SEQ ID NO: 168016 - DNA, 25 bp, Mus musculus
aagtccttacagcaaattgctgttg

SEQ ID NO: 168017 - DNA, 25 bp, Mus musculus
aagtccttacagttttaagtggaag

SEQ ID NO: 168018 - DNA, 25 bp, Mus musculus
aagtccttcagagaaacagcagcac

SEQ ID NO: 168019 - DNA, 25 bp, Mus musculus
aagtccttcagggcaatctctgtgg

SEQ ID NO: 168020 - DNA, 25 bp, Mus musculus
aagtcctttcagtcttttgatggat

SEQ ID NO: 168021 - DNA, 25 bp, Mus musculus
aagtcctttccgggtggcaaggagt

SEQ ID NO: 168022 - DNA, 25 bp, Mus musculus
aagtcctttgctagggaaagagaaa

SEQ ID NO: 168023 - DNA, 25 bp, Mus musculus
aagtcgaaaagatatcccctgtata

SEQ ID NO: 168024 - DNA, 25 bp, Mus musculus
aagtcgaaagagttataccctgact

SEQ ID NO: 168025 - DNA, 25 bp, Mus musculus
aagtcgaagacacagtgaagcatga

SEQ ID NO: 168026 - DNA, 25 bp, Mus musculus
aagtcgaagactaagtggactaaag

SEQ ID NO: 168027 - DNA, 25 bp, Mus musculus
aagtcgcaactcaaggtaggtgtac

SEQ ID NO: 168028 - DNA, 25 bp, Mus musculus
aagtcgcaactcaaggtcctttccc

SEQ ID NO: 168029 - DNA, 25 bp, Mus musculus
aagtcgcagggagagtctcttccgc

SEQ ID NO: 168030 - DNA, 25 bp, Mus musculus
aagtcgcagtggtgcaggcagtgca

SEQ ID NO: 168031 - DNA, 25 bp, Mus musculus
aagtcgccaaataagaacaactagg

SEQ ID NO: 168032 - DNA, 25 bp, Mus musculus
aagtcgccaaataagacagtgaaat

SEQ ID NO: 168033 - DNA, 25 bp, Mus musculus
aagtcgccaaggtgaccccaggctc

SEQ ID NO: 168034 - DNA, 25 bp, Mus musculus
aagtcgccacgcgagcaagctctca

SEQ ID NO: 168035 - DNA, 25 bp, Mus musculus
aagtcgctcaacaagagagaaggct

SEQ ID NO: 168036 - DNA, 25 bp, Mus musculus
aagtcgctgatgaggagactgctca

SEQ ID NO: 168037 - DNA, 25 bp, Mus musculus
aagtcgcttcagcctttaccctccg

SEQ ID NO: 168038 - DNA, 25 bp, Mus musculus
aagtcggaaagtgtggagcaaaaat

SEQ ID NO: 168039 - DNA, 25 bp, Mus musculus
aagtcggaattcctaccctcagaag

SEQ ID NO: 168040 - DNA, 25 bp, Mus musculus
aagtcggagaggtacagattcctcg

SEQ ID NO: 168041 - DNA, 25 bp, Mus musculus
aagtcggagaggttgacgtcgagca

SEQ ID NO: 168042 - DNA, 25 bp, Mus musculus
aagtcggccaaaactgttatggttt

SEQ ID NO: 168043 - DNA, 25 bp, Mus musculus
aagtcggcttaggagccacatatag

SEQ ID NO: 168044 - DNA, 25 bp, Mus musculus
aagtcgggacccttgcacaagcagt

SEQ ID NO: 168045 - DNA, 25 bp, Mus musculus
aagtcggtgtgtatgattccctgtc

SEQ ID NO: 168046 - DNA, 25 bp, Mus musculus
aagtcgtattaggcttaactccggc

SEQ ID NO: 168047 - DNA, 25 bp, Mus musculus
aagtcgttgacaggaaagagtagga

SEQ ID NO: 168048 - DNA, 25 bp, Mus musculus
aagtctaaagggccagtgtccttat

SEQ ID NO: 168049 - DNA, 25 bp, Mus musculus
aagtctaacctggttggtttgggat

SEQ ID NO: 168050 - DNA, 25 bp, Mus musculus
aagtctacaaaagctcttcagagaa

SEQ ID NO: 168051 - DNA, 25 bp, Mus musculus
aagtctacaaaaggtgaagtatttg

SEQ ID NO: 168052 - DNA, 25 bp, Mus musculus
aagtctacaggtggtgtctaccatg

SEQ ID NO: 168053 - DNA, 25 bp, Mus musculus
aagtctacccggcagttgggttctg

SEQ ID NO: 168054 - DNA, 25 bp, Mus musculus
aagtctacccggtttattatataca

SEQ ID NO: 168055 - DNA, 25 bp, Mus musculus
aagtctacctgcagcatcgaatcct

SEQ ID NO: 168056 - DNA, 25 bp, Mus musculus
aagtctacctgcaggagaccccatg

SEQ ID NO: 168057 - DNA, 25 bp, Mus musculus
aagtctattaaaatgaagcattgga

SEQ ID NO: 168058 - DNA, 25 bp, Mus musculus
aagtctattctgactggagcccttt

SEQ ID NO: 168059 - DNA, 25 bp, Mus musculus
aagtctcaaaactggcttggagtca

SEQ ID NO: 168060 - DNA, 25 bp, Mus musculus
aagtctcaaaactgggattattggc

SEQ ID NO: 168061 - DNA, 25 bp, Mus musculus
aagtctccaggtgctgctggggaaa

SEQ ID NO: 168062 - DNA, 25 bp, Mus musculus
aagtctccgggtgagtttgccaggc

SEQ ID NO: 168063 - DNA, 25 bp, Mus musculus
aagtctcctagtgagcttgtccagg

SEQ ID NO: 168064 - DNA, 25 bp, Mus musculus
aagtctcctcccagtgccctggggg

SEQ ID NO: 168065 - DNA, 25 bp, Mus musculus
aagtctcgacaacatgcattcattc

SEQ ID NO: 168066 - DNA, 25 bp, Mus musculus
aagtctctcaagagtcaccatgtag

SEQ ID NO: 168067 - DNA, 25 bp, Mus musculus
aagtctctcaagtatctcagcaata

SEQ ID NO: 168068 - DNA, 25 bp, Mus musculus
aagtctctcataaagccctttctga

SEQ ID NO: 168069 - DNA, 25 bp, Mus musculus
aagtctctgcaggtgcccaaaactg

SEQ ID NO: 168070 - DNA, 25 bp, Mus musculus
aagtctgacccccattgttcccaca

SEQ ID NO: 168071 - DNA, 25 bp, Mus musculus
aagtctgagggagccagaatcactt

SEQ ID NO: 168072 - DNA, 25 bp, Mus musculus
aagtctgcacaggaaatgaaagctt

SEQ ID NO: 168073 - DNA, 25 bp, Mus musculus
aagtctgcagagataaagccactct

SEQ ID NO: 168074 - DNA, 25 bp, Mus musculus
aagtctgctgccctgctgtcctcct

SEQ ID NO: 168075 - DNA, 25 bp, Mus musculus
aagtctgctgggaagatgagccaga

SEQ ID NO: 168076 - DNA, 25 bp, Mus musculus
aagtctggcaaaatgaacactacca

SEQ ID NO: 168077 - DNA, 25 bp, Mus musculus
aagtctgtcgtagagacactctgca

SEQ ID NO: 168078 - DNA, 25 bp, Mus musculus
aagtctgtctagagtttcaagaaca

SEQ ID NO: 168079 - DNA, 25 bp, Mus musculus
aagtctgtgaggctgggacccacga

SEQ ID NO: 168080 - DNA, 25 bp, Mus musculus
aagtcttaagcgtgtagtggagatg

SEQ ID NO: 168081 - DNA, 25 bp, Mus musculus
aagtcttaagggtgtagtggagatg

SEQ ID NO: 168082 - DNA, 25 bp, Mus musculus
aagtcttacagcctttgtttctgtg

SEQ ID NO: 168083 - DNA, 25 bp, Mus musculus
aagtcttacagcttgggcaatagga

SEQ ID NO: 168084 - DNA, 25 bp, Mus musculus
aagtcttacaggagttaggatctgt

SEQ ID NO: 168085 - DNA, 25 bp, Mus musculus
aagtcttacagtattaccaggagtc

SEQ ID NO: 168086 - DNA, 25 bp, Mus musculus
aagtcttacagtccattttgaatca

SEQ ID NO: 168087 - DNA, 25 bp, Mus musculus
aagtcttagtgcaggccaaaagtca

SEQ ID NO: 168088 - DNA, 25 bp, Mus musculus
aagtcttagtgcaggctttggcagc

SEQ ID NO: 168089 - DNA, 25 bp, Mus musculus
aagtcttatcaccagggagctaaga

SEQ ID NO: 168090 - DNA, 25 bp, Mus musculus
aagtcttcacagagctgtgaaatca

SEQ ID NO: 168091 - DNA, 25 bp, Mus musculus
aagtcttcatagagacacaccagag

SEQ ID NO: 168092 - DNA, 25 bp, Mus musculus
aagtcttcatagagatctccttgtc

SEQ ID NO: 168093 - DNA, 25 bp, Mus musculus
aagtcttcattgtcagtcagggatc

SEQ ID NO: 168094 - DNA, 25 bp, Mus musculus
aagtcttcgaataaggactgcatca

SEQ ID NO: 168095 - DNA, 25 bp, Mus musculus
aagtcttcgaataagtaataaaaga

SEQ ID NO: 168096 - DNA, 25 bp, Mus musculus
aagtcttcgtgggacctcgcaagct

SEQ ID NO: 168097 - DNA, 25 bp, Mus musculus
aagtcttgtaatttgaactgtgaaa

SEQ ID NO: 168098 - DNA, 25 bp, Mus musculus
aagtctttaagtgagcccttgaatg

SEQ ID NO: 168099 - DNA, 25 bp, Mus musculus
aagtctttctctggccctgtatccc

SEQ ID NO: 168100 - DNA, 25 bp, Mus musculus
aagtctttctgccagcgggtccgga

SEQ ID NO: 168101 - DNA, 25 bp, Mus musculus
aagtctttggaaagggacatcatcg

SEQ ID NO: 168102 - DNA, 25 bp, Mus musculus
aagtcttttgcagcagtcctatgca

SEQ ID NO: 168103 - DNA, 25 bp, Mus musculus
aagtgaaaaagtactgtctgatgag

SEQ ID NO: 168104 - DNA, 25 bp, Mus musculus
aagtgaaaaagtgccactgaggtct

SEQ ID NO: 168105 - DNA, 25 bp, Mus musculus
aagtgaaaaggttgtccaggaagcg

SEQ ID NO: 168106 - DNA, 25 bp, Mus musculus
aagtgaaactcaaagagcgtcagga

SEQ ID NO: 168107 - DNA, 25 bp, Mus musculus
aagtgaaactcaaattttaatccag

SEQ ID NO: 168108 - DNA, 25 bp, Mus musculus
aagtgaaagaggtcaaccggatgca

SEQ ID NO: 168109 - DNA, 25 bp, Mus musculus
aagtgaaagcgacagctctacaaca

SEQ ID NO: 168110 - DNA, 25 bp, Mus musculus
aagtgaaagttagaaatttcaacgt

SEQ ID NO: 168111 - DNA, 25 bp, Mus musculus
aagtgaacaagaactggaatgcact

SEQ ID NO: 168112 - DNA, 25 bp, Mus musculus
aagtgaacactgacgcttttgtcaa

SEQ ID NO: 168113 - DNA, 25 bp, Mus musculus
aagtgaacaggccatggcgcaggct

SEQ ID NO: 168114 - DNA, 25 bp, Mus musculus
aagtgaacaggtgccttcttcacaa

SEQ ID NO: 168115 - DNA, 25 bp, Mus musculus
aagtgaacagtaggtgagcttagcc

SEQ ID NO: 168116 - DNA, 25 bp, Mus musculus
aagtgaacatccagatcatccacac

SEQ ID NO: 168117 - DNA, 25 bp, Mus musculus
aagtgaagagagaagtttattgata

SEQ ID NO: 168118 - DNA, 25 bp, Mus musculus
aagtgaagatcatgtgagcatcgtg

SEQ ID NO: 168119 - DNA, 25 bp, Mus musculus
aagtgaagcctgctggtcctacagt

SEQ ID NO: 168120 - DNA, 25 bp, Mus musculus
aagtgaagctcaagatggagaaatg

SEQ ID NO: 168121 - DNA, 25 bp, Mus musculus
aagtgaagctcaaggttgattcttt

SEQ ID NO: 168122 - DNA, 25 bp, Mus musculus
aagtgaaggagtttctggtgtgatc

SEQ ID NO: 168123 - DNA, 25 bp, Mus musculus
aagtgaaggtgacaggtctattttc

SEQ ID NO: 168124 - DNA, 25 bp, Mus musculus
aagtgaatacgaagctgttgccgca

SEQ ID NO: 168125 - DNA, 25 bp, Mus musculus
aagtgaatattccaggaacattaga

SEQ ID NO: 168126 - DNA, 25 bp, Mus musculus
aagtgaatccaggtggcacaagact

SEQ ID NO: 168127 - DNA, 25 bp, Mus musculus
aagtgaatgacgagccccacaggat

SEQ ID NO: 168128 - DNA, 25 bp, Mus musculus
aagtgaatgacgagtgtggagagca

SEQ ID NO: 168129 - DNA, 25 bp, Mus musculus
aagtgaatgtactctattcttcatc

SEQ ID NO: 168130 - DNA, 25 bp, Mus musculus
aagtgaatttccagatgcaggtgtc

SEQ ID NO: 168131 - DNA, 25 bp, Mus musculus
aagtgacaagaaaatgacaagatta

SEQ ID NO: 168132 - DNA, 25 bp, Mus musculus
aagtgacaagaatatagaacgatat

SEQ ID NO: 168133 - DNA, 25 bp, Mus musculus
aagtgacagagaaagtgatctttcc

SEQ ID NO: 168134 - DNA, 25 bp, Mus musculus
aagtgacagagagtcagtgggcccc

SEQ ID NO: 168135 - DNA, 25 bp, Mus musculus
aagtgacaggcatgagtaaagacat

SEQ ID NO: 168136 - DNA, 25 bp, Mus musculus
aagtgaccagccgagaacgaggccc

SEQ ID NO: 168137 - DNA, 25 bp, Mus musculus
aagtgaccagcgtgtccaccctgaa

SEQ ID NO: 168138 - DNA, 25 bp, Mus musculus
aagtgaccatccagaaaaaacactg

SEQ ID NO: 168139 - DNA, 25 bp, Mus musculus
aagtgaccatggaagcgtatttgat

SEQ ID NO: 168140 - DNA, 25 bp, Mus musculus
aagtgaccatggtagcgtatttgat

SEQ ID NO: 168141 - DNA, 25 bp, Mus musculus
aagtgaccgaatgagaaaggtttaa

SEQ ID NO: 168142 - DNA, 25 bp, Mus musculus
aagtgaccgaatgagagactctaca

SEQ ID NO: 168143 - DNA, 25 bp, Mus musculus
aagtgaccgaatgagctgccgagtg

SEQ ID NO: 168144 - DNA, 25 bp, Mus musculus
aagtgacctaacaggtgtgaaagat

SEQ ID NO: 168145 - DNA, 25 bp, Mus musculus
aagtgacgtcgggaactgaagagcc

SEQ ID NO: 168146 - DNA, 25 bp, Mus musculus
aagtgacgtcgggaagttccgtgta

SEQ ID NO: 168147 - DNA, 25 bp, Mus musculus
aagtgacgtgaaagccagagacgcc

SEQ ID NO: 168148 - DNA, 25 bp, Mus musculus
aagtgacgtgtgggcttttggcgtg

SEQ ID NO: 168149 - DNA, 25 bp, Mus musculus
aagtgactgagagtggaatgcagtg

SEQ ID NO: 168150 - DNA, 25 bp, Mus musculus
aagtgactttaaggacagttatctg

SEQ ID NO: 168151 - DNA, 25 bp, Mus musculus
aagtgagaaccttacccacaggtcc

SEQ ID NO: 168152 - DNA, 25 bp, Mus musculus
aagtgagaatgattggagcctgccg

SEQ ID NO: 168153 - DNA, 25 bp, Mus musculus
aagtgagaatgggttaactgctctt

SEQ ID NO: 168154 - DNA, 25 bp, Mus musculus
aagtgagatacagattgctaataat

SEQ ID NO: 168155 - DNA, 25 bp, Mus musculus
aagtgagcaagcaggaggaggcctc

SEQ ID NO: 168156 - DNA, 25 bp, Mus musculus
aagtgagcagactcggagtgcgggc

SEQ ID NO: 168157 - DNA, 25 bp, Mus musculus
aagtgagcagggacggcctcaggat

SEQ ID NO: 168158 - DNA, 25 bp, Mus musculus
aagtgaggacaggcttttgattgca

SEQ ID NO: 168159 - DNA, 25 bp, Mus musculus
aagtgagggaagatggagatattct

SEQ ID NO: 168160 - DNA, 25 bp, Mus musculus
aagtgagtcaggtgttaaatgaata

SEQ ID NO: 168161 - DNA, 25 bp, Mus musculus
aagtgagtccgatgccttacggtca

SEQ ID NO: 168162 - DNA, 25 bp, Mus musculus
aagtgagtccgcaccttcagggtcc

SEQ ID NO: 168163 - DNA, 25 bp, Mus musculus
aagtgagtcctccccttcaaagctg

SEQ ID NO: 168164 - DNA, 25 bp, Mus musculus
aagtgagtgacagagcctccaggtg

SEQ ID NO: 168165 - DNA, 25 bp, Mus musculus
aagtgagtgtgtgtgtcagcggtct

SEQ ID NO: 168166 - DNA, 25 bp, Mus musculus
aagtgataaaggagattgaggacgg

SEQ ID NO: 168167 - DNA, 25 bp, Mus musculus
aagtgataaaggaggccttggaaat

SEQ ID NO: 168168 - DNA, 25 bp, Mus musculus
aagtgatagaaaagcttggctttcc

SEQ ID NO: 168169 - DNA, 25 bp, Mus musculus
aagtgatagtggcaatccagatcat

SEQ ID NO: 168170 - DNA, 25 bp, Mus musculus
aagtgatcaagattagacgtggtct

SEQ ID NO: 168171 - DNA, 25 bp, Mus musculus
aagtgatcaagattcaaaataaacc

SEQ ID NO: 168172 - DNA, 25 bp, Mus musculus
aagtgatgaagaagccttcctgttc

SEQ ID NO: 168173 - DNA, 25 bp, Mus musculus
aagtgatgaaggagaggatgatgtc

SEQ ID NO: 168174 - DNA, 25 bp, Mus musculus
aagtgatggagactcagaaagcctt

SEQ ID NO: 168175 - DNA, 25 bp, Mus musculus
aagtgatggagatgagaagaagccg

SEQ ID NO: 168176 - DNA, 25 bp, Mus musculus
aagtgatggagatgcgctccctcct

SEQ ID NO: 168177 - DNA, 25 bp, Mus musculus
aagtgatggagatggggtcctaaag

SEQ ID NO: 168178 - DNA, 25 bp, Mus musculus
aagtgatggcgactgttgccctcta

SEQ ID NO: 168179 - DNA, 25 bp, Mus musculus
aagtgattccaggttcagtacctct

SEQ ID NO: 168180 - DNA, 25 bp, Mus musculus
aagtgattctgcaaaaaatactttg

SEQ ID NO: 168181 - DNA, 25 bp, Mus musculus
aagtgatttggagaggtacaactga

SEQ ID NO: 168182 - DNA, 25 bp, Mus musculus
aagtgcaaaacagatggagaatagg

SEQ ID NO: 168183 - DNA, 25 bp, Mus musculus
aagtgcaaaacaggatatcctgtac

SEQ ID NO: 168184 - DNA, 25 bp, Mus musculus
aagtgcaaagaatggctacatcttt

SEQ ID NO: 168185 - DNA, 25 bp, Mus musculus
aagtgcaaagagagacaggaatcct

SEQ ID NO: 168186 - DNA, 25 bp, Mus musculus
aagtgcaaaggaggtgttttagctc

SEQ ID NO: 168187 - DNA, 25 bp, Mus musculus
aagtgcaacacaagatttccaccca

SEQ ID NO: 168188 - DNA, 25 bp, Mus musculus
aagtgcaacacaaggctgtgtctct

SEQ ID NO: 168189 - DNA, 25 bp, Mus musculus
aagtgcaaccagacatccagaaccc

SEQ ID NO: 168190 - DNA, 25 bp, Mus musculus
aagtgcaagatatgaaattgttgat

SEQ ID NO: 168191 - DNA, 25 bp, Mus musculus
aagtgcaatgaaattgaatcccaca

SEQ ID NO: 168192 - DNA, 25 bp, Mus musculus
aagtgcaccggaagatggacgacat

SEQ ID NO: 168193 - DNA, 25 bp, Mus musculus
aagtgcaccggggtctgctgacaga

SEQ ID NO: 168194 - DNA, 25 bp, Mus musculus
aagtgcacttagcatgatgacttgc

SEQ ID NO: 168195 - DNA, 25 bp, Mus musculus
aagtgcagagactgtgagcaaagaa

SEQ ID NO: 168196 - DNA, 25 bp, Mus musculus
aagtgcagagacttcttccctagga

SEQ ID NO: 168197 - DNA, 25 bp, Mus musculus
aagtgcagagatccgtggacagctg

SEQ ID NO: 168198 - DNA, 25 bp, Mus musculus
aagtgcagaggattcctacgaggcc

SEQ ID NO: 168199 - DNA, 25 bp, Mus musculus
aagtgcagaggttcaaggcaacact

SEQ ID NO: 168200 - DNA, 25 bp, Mus musculus
aagtgcagcagccccaccagtggga

SEQ ID NO: 168201 - DNA, 25 bp, Mus musculus
aagtgcagcagggcaagcttctagc

SEQ ID NO: 168202 - DNA, 25 bp, Mus musculus
aagtgcagcgacggatcgaagcctg

SEQ ID NO: 168203 - DNA, 25 bp, Mus musculus
aagtgcagctgaggagcagctgcct

SEQ ID NO: 168204 - DNA, 25 bp, Mus musculus
aagtgcaggatgcaggtcaactgaa

SEQ ID NO: 168205 - DNA, 25 bp, Mus musculus
aagtgcaggcggaacaagacaacct

SEQ ID NO: 168206 - DNA, 25 bp, Mus musculus
aagtgcataggaggagcttcctggc

SEQ ID NO: 168207 - DNA, 25 bp, Mus musculus
aagtgcataggagtggctgctactc

SEQ ID NO: 168208 - DNA, 25 bp, Mus musculus
aagtgcatccatgcagtattcaaga

SEQ ID NO: 168209 - DNA, 25 bp, Mus musculus
aagtgcatctggagaccaggttctc

SEQ ID NO: 168210 - DNA, 25 bp, Mus musculus
aagtgcatctggcctcgaactcaga

SEQ ID NO: 168211 - DNA, 25 bp, Mus musculus
aagtgcattgagaaagaagtcaaca

SEQ ID NO: 168212 - DNA, 25 bp, Mus musculus
aagtgcattgagagctgtctgtcta

SEQ ID NO: 168213 - DNA, 25 bp, Mus musculus
aagtgcattgccaaggcgttcgtgc

SEQ ID NO: 168214 - DNA, 25 bp, Mus musculus
aagtgccacaaaggaacctacttgg

SEQ ID NO: 168215 - DNA, 25 bp, Mus musculus
aagtgccagcagaagatgatgacta

SEQ ID NO: 168216 - DNA, 25 bp, Mus musculus
aagtgccagcagaagattctactca

SEQ ID NO: 168217 - DNA, 25 bp, Mus musculus
aagtgccaggaatccgaatcttgaa

SEQ ID NO: 168218 - DNA, 25 bp, Mus musculus
aagtgccaggagaaatctgagctgt

SEQ ID NO: 168219 - DNA, 25 bp, Mus musculus
aagtgccaggatcacaacgaatgcc

SEQ ID NO: 168220 - DNA, 25 bp, Mus musculus
aagtgccaggttcacaacgaatgcc

SEQ ID NO: 168221 - DNA, 25 bp, Mus musculus
aagtgccgcatgcaggtggaccctc

SEQ ID NO: 168222 - DNA, 25 bp, Mus musculus
aagtgccgcctacaggattcctgtc

SEQ ID NO: 168223 - DNA, 25 bp, Mus musculus
aagtgccgcctacagtgcagggaga

SEQ ID NO: 168224 - DNA, 25 bp, Mus musculus
aagtgccggttagggactgcatgag

SEQ ID NO: 168225 - DNA, 25 bp, Mus musculus
aagtgccggttaggggcgaatggac

SEQ ID NO: 168226 - DNA, 25 bp, Mus musculus
aagtgcctcagggcaccaccgtggg

SEQ ID NO: 168227 - DNA, 25 bp, Mus musculus
aagtgcctcccacgtcagaaccgtt

SEQ ID NO: 168228 - DNA, 25 bp, Mus musculus
aagtgcgatgcgctgttcctgggcg

SEQ ID NO: 168229 - DNA, 25 bp, Mus musculus
aagtgcgatgcgtcgtcccccagac

SEQ ID NO: 168230 - DNA, 25 bp, Mus musculus
aagtgcgcaaatgaagaagccggca

SEQ ID NO: 168231 - DNA, 25 bp, Mus musculus
aagtgcgcaaatgggagaagaaatg

SEQ ID NO: 168232 - DNA, 25 bp, Mus musculus
aagtgcgcgacaggctgtttggtct

SEQ ID NO: 168233 - DNA, 25 bp, Mus musculus
aagtgcgcgacaggttctggatggt

SEQ ID NO: 168234 - DNA, 25 bp, Mus musculus
aagtgcggaaatgggagaagaaatg

SEQ ID NO: 168235 - DNA, 25 bp, Mus musculus
aagtgcggccggatgagattatgcg

SEQ ID NO: 168236 - DNA, 25 bp, Mus musculus
aagtgcggccggatgccactacgaa

SEQ ID NO: 168237 - DNA, 25 bp, Mus musculus
aagtgcgttatcagagtgaagccat

SEQ ID NO: 168238 - DNA, 25 bp, Mus musculus
aagtgctcaactggctgttggaaag

SEQ ID NO: 168239 - DNA, 25 bp, Mus musculus
aagtgctcaagtatgatgacttcct

SEQ ID NO: 168240 - DNA, 25 bp, Mus musculus
aagtgctcaccaagagctttgtaaa

SEQ ID NO: 168241 - DNA, 25 bp, Mus musculus
aagtgctcaggaagactcttcaatc

SEQ ID NO: 168242 - DNA, 25 bp, Mus musculus
aagtgctcaggaagtctaaagctaa

SEQ ID NO: 168243 - DNA, 25 bp, Mus musculus
aagtgctcaggaggccatgacaccg

SEQ ID NO: 168244 - DNA, 25 bp, Mus musculus
aagtgctcatccagctcagcacatt

SEQ ID NO: 168245 - DNA, 25 bp, Mus musculus
aagtgctcatccaggaacaacttcc

SEQ ID NO: 168246 - DNA, 25 bp, Mus musculus
aagtgctcatccaggtgggatatga

SEQ ID NO: 168247 - DNA, 25 bp, Mus musculus
aagtgctccaaggatcgtggagttg

SEQ ID NO: 168248 - DNA, 25 bp, Mus musculus
aagtgctccagtatgcagattaaga

SEQ ID NO: 168249 - DNA, 25 bp, Mus musculus
aagtgctcccaaagcattagcagag

SEQ ID NO: 168250 - DNA, 25 bp, Mus musculus
aagtgctctggtcctccttgtcctc

SEQ ID NO: 168251 - DNA, 25 bp, Mus musculus
aagtgctgaaggcagggaagcggcc

SEQ ID NO: 168252 - DNA, 25 bp, Mus musculus
aagtgctgagcagtaacttgaatcc

SEQ ID NO: 168253 - DNA, 25 bp, Mus musculus
aagtgctgaggctgcctgctgtctc

SEQ ID NO: 168254 - DNA, 25 bp, Mus musculus
aagtgctgataggatccacgcacat

SEQ ID NO: 168255 - DNA, 25 bp, Mus musculus
aagtgctgatggagtttgtggaaaa

SEQ ID NO: 168256 - DNA, 25 bp, Mus musculus
aagtgctgcacaatgccttaggatt

SEQ ID NO: 168257 - DNA, 25 bp, Mus musculus
aagtgctgcaggaggctactttttg

SEQ ID NO: 168258 - DNA, 25 bp, Mus musculus
aagtgctgtatccacgagaggcacg

SEQ ID NO: 168259 - DNA, 25 bp, Mus musculus
aagtggaaagcgtgactccagaaca

SEQ ID NO: 168260 - DNA, 25 bp, Mus musculus
aagtggaaagctgcggctgctgtat

SEQ ID NO: 168261 - DNA, 25 bp, Mus musculus
aagtggaaaggcaggtgtccacagc

SEQ ID NO: 168262 - DNA, 25 bp, Mus musculus
aagtggaaatagcaaaaccagcaag

SEQ ID NO: 168263 - DNA, 25 bp, Mus musculus
aagtggaaataggaaaaccagcaag

SEQ ID NO: 168264 - DNA, 25 bp, Mus musculus
aagtggaacactgactgtcacagtg

SEQ ID NO: 168265 - DNA, 25 bp, Mus musculus
aagtggaacattcttctgccttggc

SEQ ID NO: 168266 - DNA, 25 bp, Mus musculus
aagtggaacgggcagtgtggtgagc

SEQ ID NO: 168267 - DNA, 25 bp, Mus musculus
aagtggaagcgaaggcaaacttaaa

SEQ ID NO: 168268 - DNA, 25 bp, Mus musculus
aagtggaagctaaaagagcatgaag

SEQ ID NO: 168269 - DNA, 25 bp, Mus musculus
aagtggaataagagctcagtaagtt

SEQ ID NO: 168270 - DNA, 25 bp, Mus musculus
aagtggacaatcatggctgtcatgg

SEQ ID NO: 168271 - DNA, 25 bp, Mus musculus
aagtggacagtcccaccgtcacaac

SEQ ID NO: 168272 - DNA, 25 bp, Mus musculus
aagtggaccagcagcagcagcagcc

SEQ ID NO: 168273 - DNA, 25 bp, Mus musculus
aagtggaccaggactaccttattgc

SEQ ID NO: 168274 - DNA, 25 bp, Mus musculus
aagtggaccccaaaggccatgaaga

SEQ ID NO: 168275 - DNA, 25 bp, Mus musculus
aagtggacttgatccctgctgtctg

SEQ ID NO: 168276 - DNA, 25 bp, Mus musculus
aagtggagaaaagagaatattttcc

SEQ ID NO: 168277 - DNA, 25 bp, Mus musculus
aagtggagaaaagaggaatattagt

SEQ ID NO: 168278 - DNA, 25 bp, Mus musculus
aagtggagaaaggtttccttctctt

SEQ ID NO: 168279 - DNA, 25 bp, Mus musculus
aagtggagaataagcgtgaagtgca

SEQ ID NO: 168280 - DNA, 25 bp, Mus musculus
aagtggagaataagtggtacagggt

SEQ ID NO: 168281 - DNA, 25 bp, Mus musculus
aagtggagaatgaagatgctgggtt

SEQ ID NO: 168282 - DNA, 25 bp, Mus musculus
aagtggagagcgtgaaagagtttct

SEQ ID NO: 168283 - DNA, 25 bp, Mus musculus
aagtggagaggagctctcctatgtg

SEQ ID NO: 168284 - DNA, 25 bp, Mus musculus
aagtggagagggaccttcttcacct

SEQ ID NO: 168285 - DNA, 25 bp, Mus musculus
aagtggagataccaggcacaatcac

SEQ ID NO: 168286 - DNA, 25 bp, Mus musculus
aagtggagctggagggctaaaaccg

SEQ ID NO: 168287 - DNA, 25 bp, Mus musculus
aagtggaggaggacttggtgaaatg

SEQ ID NO: 168288 - DNA, 25 bp, Mus musculus
aagtggaggcaaatatctgaaagat

SEQ ID NO: 168289 - DNA, 25 bp, Mus musculus
aagtggatcgcggggtcccagctcc

SEQ ID NO: 168290 - DNA, 25 bp, Mus musculus
aagtggatgcagctgccatcaaact

SEQ ID NO: 168291 - DNA, 25 bp, Mus musculus
aagtggatgctgatggcaatggcac

SEQ ID NO: 168292 - DNA, 25 bp, Mus musculus
aagtggcaagaaggaaaacaaatta

SEQ ID NO: 168293 - DNA, 25 bp, Mus musculus
aagtggcaagagagatctccagtcc

SEQ ID NO: 168294 - DNA, 25 bp, Mus musculus
aagtggcaagatcttagggttggag

SEQ ID NO: 168295 - DNA, 25 bp, Mus musculus
aagtggcaaggacagtctcatgctt

SEQ ID NO: 168296 - DNA, 25 bp, Mus musculus
aagtggcaagtcagtacaggctacc

SEQ ID NO: 168297 - DNA, 25 bp, Mus musculus
aagtggcagaagactcagaggcctg

SEQ ID NO: 168298 - DNA, 25 bp, Mus musculus
aagtggcatttctgatgggcagccc

SEQ ID NO: 168299 - DNA, 25 bp, Mus musculus
aagtggcatttctgtggctaacttc

SEQ ID NO: 168300 - DNA, 25 bp, Mus musculus
aagtggccaagctgaacatccagag

SEQ ID NO: 168301 - DNA, 25 bp, Mus musculus
aagtggccaggagcttgcaagtgtt

SEQ ID NO: 168302 - DNA, 25 bp, Mus musculus
aagtggccgaggaggtccagattat

SEQ ID NO: 168303 - DNA, 25 bp, Mus musculus
aagtggcctcagataatgatttttc

SEQ ID NO: 168304 - DNA, 25 bp, Mus musculus
aagtggcctcaggtgcgttcattcc

SEQ ID NO: 168305 - DNA, 25 bp, Mus musculus
aagtggcgaaggtcttccatgtttg

SEQ ID NO: 168306 - DNA, 25 bp, Mus musculus
aagtggcgcagatgggatacagatt

SEQ ID NO: 168307 - DNA, 25 bp, Mus musculus
aagtggcgcagatggtcaccctgct

SEQ ID NO: 168308 - DNA, 25 bp, Mus musculus
aagtggctgagtatctccagacagg

SEQ ID NO: 168309 - DNA, 25 bp, Mus musculus
aagtgggacaagatgcagcaccgag

SEQ ID NO: 168310 - DNA, 25 bp, Mus musculus
aagtgggacaggagaacgagaagaa

SEQ ID NO: 168311 - DNA, 25 bp, Mus musculus
aagtgggagaaggtgcagcagctgg

SEQ ID NO: 168312 - DNA, 25 bp, Mus musculus
aagtgggcacaagacagacaaggaa

SEQ ID NO: 168313 - DNA, 25 bp, Mus musculus
aagtgggcacaagagtcagctctgg

SEQ ID NO: 168314 - DNA, 25 bp, Mus musculus
aagtgggcaggcacccagcggaaca

SEQ ID NO: 168315 - DNA, 25 bp, Mus musculus
aagtgggcagggtgaagtgtgtccg

SEQ ID NO: 168316 - DNA, 25 bp, Mus musculus
aagtgggctgcggtatcagcctagc

SEQ ID NO: 168317 - DNA, 25 bp, Mus musculus
aagtggggacaccattaccatgcag

SEQ ID NO: 168318 - DNA, 25 bp, Mus musculus
aagtggggcatgagtgtaatgttca

SEQ ID NO: 168319 - DNA, 25 bp, Mus musculus
aagtggggcctggaggacatcatgt

SEQ ID NO: 168320 - DNA, 25 bp, Mus musculus
aagtgggggatcctgcagaggactt

SEQ ID NO: 168321 - DNA, 25 bp, Mus musculus
aagtggggtgacgaggtggagtaca

SEQ ID NO: 168322 - DNA, 25 bp, Mus musculus
aagtggtataggatcttgaaacagg

SEQ ID NO: 168323 - DNA, 25 bp, Mus musculus
aagtggtcccagaatggaagcccag

SEQ ID NO: 168324 - DNA, 25 bp, Mus musculus
aagtggtcccagggccagaaaaagc

SEQ ID NO: 168325 - DNA, 25 bp, Mus musculus
aagtggtccctgagttcgtcaatgc

SEQ ID NO: 168326 - DNA, 25 bp, Mus musculus
aagtggtcctgtcagcttcagccac

SEQ ID NO: 168327 - DNA, 25 bp, Mus musculus
aagtggtcctgtcagtggatgtgtc

SEQ ID NO: 168328 - DNA, 25 bp, Mus musculus
aagtggtctgcaaaggagaatcaca

SEQ ID NO: 168329 - DNA, 25 bp, Mus musculus
aagtggtggaggggatcctggacac

SEQ ID NO: 168330 - DNA, 25 bp, Mus musculus
aagtggtggccaggacagcaaccat

SEQ ID NO: 168331 - DNA, 25 bp, Mus musculus
aagtggtgggagccctatgctgctg

SEQ ID NO: 168332 - DNA, 25 bp, Mus musculus
aagtggtgtgctcggaggacactaa

SEQ ID NO: 168333 - DNA, 25 bp, Mus musculus
aagtggttctagctttaaggaccat

SEQ ID NO: 168334 - DNA, 25 bp, Mus musculus
aagtggttctaggagctcagactga

SEQ ID NO: 168335 - DNA, 25 bp, Mus musculus
aagtggttctgaacacggtacaacc

SEQ ID NO: 168336 - DNA, 25 bp, Mus musculus
aagtggttgaatgatccagagtcct

SEQ ID NO: 168337 - DNA, 25 bp, Mus musculus
aagtggttgattgagaaggagggag

SEQ ID NO: 168338 - DNA, 25 bp, Mus musculus
aagtggttgcgaacaatttcgaaga

SEQ ID NO: 168339 - DNA, 25 bp, Mus musculus
aagtggttgcggagaggtttgcagc

SEQ ID NO: 168340 - DNA, 25 bp, Mus musculus
aagtggttgcggagcgagcccggcc

SEQ ID NO: 168341 - DNA, 25 bp, Mus musculus
aagtgtaaatctaagatcaactatg

SEQ ID NO: 168342 - DNA, 25 bp, Mus musculus
aagtgtaagcccggccgaattcgag

SEQ ID NO: 168343 - DNA, 25 bp, Mus musculus
aagtgtactggataagaacaagaag

SEQ ID NO: 168344 - DNA, 25 bp, Mus musculus
aagtgtagtgaaaagctgcagcaat

SEQ ID NO: 168345 - DNA, 25 bp, Mus musculus
aagtgtatccaggctttaagcactg

SEQ ID NO: 168346 - DNA, 25 bp, Mus musculus
aagtgtatccagggaccaccacacc

SEQ ID NO: 168347 - DNA, 25 bp, Mus musculus
aagtgtatccagggataatcttggg

SEQ ID NO: 168348 - DNA, 25 bp, Mus musculus
aagtgtatccctgggaagatgccga

SEQ ID NO: 168349 - DNA, 25 bp, Mus musculus
aagtgtatgaggcagccatctccat

SEQ ID NO: 168350 - DNA, 25 bp, Mus musculus
aagtgtatgaggcagggctcatttt

SEQ ID NO: 168351 - DNA, 25 bp, Mus musculus
aagtgtcaaatatggacctgggtcg

SEQ ID NO: 168352 - DNA, 25 bp, Mus musculus
aagtgtcaaatatggccaccaggcc

SEQ ID NO: 168353 - DNA, 25 bp, Mus musculus
aagtgtcacaagatggagcaggaaa

SEQ ID NO: 168354 - DNA, 25 bp, Mus musculus
aagtgtcacagtgtggttgatgaca

SEQ ID NO: 168355 - DNA, 25 bp, Mus musculus
aagtgtcagaattggggaccctctg

SEQ ID NO: 168356 - DNA, 25 bp, Mus musculus
aagtgtcattttcagaatggtcgat

SEQ ID NO: 168357 - DNA, 25 bp, Mus musculus
aagtgtccaggtgtaaccagccatg

SEQ ID NO: 168358 - DNA, 25 bp, Mus musculus
aagtgtccatgaggttttggggcga

SEQ ID NO: 168359 - DNA, 25 bp, Mus musculus
aagtgtcccaagagggtgtattacc

SEQ ID NO: 168360 - DNA, 25 bp, Mus musculus
aagtgtctactaatttcccagcagt

SEQ ID NO: 168361 - DNA, 25 bp, Mus musculus
aagtgtctatggacgaccataaact

SEQ ID NO: 168362 - DNA, 25 bp, Mus musculus
aagtgtctcagaatgcaaagtatgg

SEQ ID NO: 168363 - DNA, 25 bp, Mus musculus
aagtgtctcagccttcgtagtgcac

SEQ ID NO: 168364 - DNA, 25 bp, Mus musculus
aagtgtctgcttttcagaaaggcga

SEQ ID NO: 168365 - DNA, 25 bp, Mus musculus
aagtgtctggaatcccaggccaact

SEQ ID NO: 168366 - DNA, 25 bp, Mus musculus
aagtgtctggagataacaatcgaaa

SEQ ID NO: 168367 - DNA, 25 bp, Mus musculus
aagtgtgacaaggtggtacaggatc

SEQ ID NO: 168368 - DNA, 25 bp, Mus musculus
aagtgtgaggacaagagtgtggaaa

SEQ ID NO: 168369 - DNA, 25 bp, Mus musculus
aagtgtgccaccaggatccaagcct

SEQ ID NO: 168370 - DNA, 25 bp, Mus musculus
aagtgtgccagccaggtgggcatga

SEQ ID NO: 168371 - DNA, 25 bp, Mus musculus
aagtgtgccctgaagctcctgtatg

SEQ ID NO: 168372 - DNA, 25 bp, Mus musculus
aagtgtgccctgaaggtcagaaacc

SEQ ID NO: 168373 - DNA, 25 bp, Mus musculus
aagtgtgccgatcccgtgcatggcc

SEQ ID NO: 168374 - DNA, 25 bp, Mus musculus
aagtgtgccggagccagtgttacca

SEQ ID NO: 168375 - DNA, 25 bp, Mus musculus
aagtgtgctgagaagctgagttcct

SEQ ID NO: 168376 - DNA, 25 bp, Mus musculus
aagtgtggagagcctcaagtcagat

SEQ ID NO: 168377 - DNA, 25 bp, Mus musculus
aagtgtggcttggtacctggaatgg

SEQ ID NO: 168378 - DNA, 25 bp, Mus musculus
aagtgtggtgctgataatactagaa

SEQ ID NO: 168379 - DNA, 25 bp, Mus musculus
aagtgtggtggattgaaccagctgc

SEQ ID NO: 168380 - DNA, 25 bp, Mus musculus
aagtgtggtttgcagcttcatggtt

SEQ ID NO: 168381 - DNA, 25 bp, Mus musculus
aagtgtggtttgcagggatgcggta

SEQ ID NO: 168382 - DNA, 25 bp, Mus musculus
aagtgtgtcacacgtgtggggctgc

SEQ ID NO: 168383 - DNA, 25 bp, Mus musculus
aagtgtgtggacatcaatgagtgtg

SEQ ID NO: 168384 - DNA, 25 bp, Mus musculus
aagtgtgtggtgcaacagaatggga

SEQ ID NO: 168385 - DNA, 25 bp, Mus musculus
aagtgtgtgtgcaacgatactgtat

SEQ ID NO: 168386 - DNA, 25 bp, Mus musculus
aagtgttcaaagggctgaacgacaa

SEQ ID NO: 168387 - DNA, 25 bp, Mus musculus
aagtgttcaagccgccccacgaggc

SEQ ID NO: 168388 - DNA, 25 bp, Mus musculus
aagtgttcaaggtagccattgcggg

SEQ ID NO: 168389 - DNA, 25 bp, Mus musculus
aagtgttcagagccggaaacaactg

SEQ ID NO: 168390 - DNA, 25 bp, Mus musculus
aagtgttcaggcctccttctttttg

SEQ ID NO: 168391 - DNA, 25 bp, Mus musculus
aagtgttcagtgatgtgatggagga

SEQ ID NO: 168392 - DNA, 25 bp, Mus musculus
aagtgttccaggacatgctacccat

SEQ ID NO: 168393 - DNA, 25 bp, Mus musculus
aagtgttgaaagtggagcaaaatgc

SEQ ID NO: 168394 - DNA, 25 bp, Mus musculus
aagtgttgaccctgcagaaaacttc

SEQ ID NO: 168395 - DNA, 25 bp, Mus musculus
aagtgttgcttgctgtgcctcagat

SEQ ID NO: 168396 - DNA, 25 bp, Mus musculus
aagtgttgcttgttttgctggtaac

SEQ ID NO: 168397 - DNA, 25 bp, Mus musculus
aagtgttggacagattgtaggtgaa

SEQ ID NO: 168398 - DNA, 25 bp, Mus musculus
aagtgtttggattcacaacacttct

SEQ ID NO: 168399 - DNA, 25 bp, Mus musculus
aagtgtttggcaggatgctcgggac

SEQ ID NO: 168400 - DNA, 25 bp, Mus musculus
aagtgtttggcagtctccaaaaccc

SEQ ID NO: 168401 - DNA, 25 bp, Mus musculus
aagttaaaaacagcctcaccattga

SEQ ID NO: 168402 - DNA, 25 bp, Mus musculus
aagttaaaaagtggaatgcagtggc

SEQ ID NO: 168403 - DNA, 25 bp, Mus musculus
aagttaaaaatcgcctcaccattga

SEQ ID NO: 168404 - DNA, 25 bp, Mus musculus
aagttaaaaggaacttctgcaggtg

SEQ ID NO: 168405 - DNA, 25 bp, Mus musculus
aagttaacagaaacttcagaaaagt

SEQ ID NO: 168406 - DNA, 25 bp, Mus musculus
aagttaaccagagtttgagtgacag

SEQ ID NO: 168407 - DNA, 25 bp, Mus musculus
aagttaacccacagacaaggaatat

SEQ ID NO: 168408 - DNA, 25 bp, Mus musculus
aagttaactgacacgagtgcgcaaa

SEQ ID NO: 168409 - DNA, 25 bp, Mus musculus
aagttaactgacacgcaacagatag

SEQ ID NO: 168410 - DNA, 25 bp, Mus musculus
aagttaactgacacggtaagtcttc

SEQ ID NO: 168411 - DNA, 25 bp, Mus musculus
aagttaactgctcttcagggcaaag

SEQ ID NO: 168412 - DNA, 25 bp, Mus musculus
aagttaatatcaaggtactgtctga

SEQ ID NO: 168413 - DNA, 25 bp, Mus musculus
aagttacaatccaagtaaacgccac

SEQ ID NO: 168414 - DNA, 25 bp, Mus musculus
aagttacaggcccactgtccgtgtc

SEQ ID NO: 168415 - DNA, 25 bp, Mus musculus
aagttacagtttgccccggctgagg

SEQ ID NO: 168416 - DNA, 25 bp, Mus musculus
aagttaccatgcctgtctcctccct

SEQ ID NO: 168417 - DNA, 25 bp, Mus musculus
aagttacgtaatcattgcaacgatg

SEQ ID NO: 168418 - DNA, 25 bp, Mus musculus
aagttactcaggggtggatgagagg

SEQ ID NO: 168419 - DNA, 25 bp, Mus musculus
aagttactcaggtggctggtggtgg

SEQ ID NO: 168420 - DNA, 25 bp, Mus musculus
aagttacttctgatggcctcgaact

SEQ ID NO: 168421 - DNA, 25 bp, Mus musculus
aagttagaaaagagtatgctgtcaa

SEQ ID NO: 168422 - DNA, 25 bp, Mus musculus
aagttagaaaagcatccgcagacat

SEQ ID NO: 168423 - DNA, 25 bp, Mus musculus
aagttagaaaaggcatctgtggcaa

SEQ ID NO: 168424 - DNA, 25 bp, Mus musculus
aagttagaccatggcacccgatggc

SEQ ID NO: 168425 - DNA, 25 bp, Mus musculus
aagttagaccatgtggtgaccatca

SEQ ID NO: 168426 - DNA, 25 bp, Mus musculus
aagttagatctagtgagcagcacct

SEQ ID NO: 168427 - DNA, 25 bp, Mus musculus
aagttagatctagtttttagagaaa

SEQ ID NO: 168428 - DNA, 25 bp, Mus musculus
aagttagcaccgtggtgagtaatag

SEQ ID NO: 168429 - DNA, 25 bp, Mus musculus
aagttagcttgaacatcacaagtgc

SEQ ID NO: 168430 - DNA, 25 bp, Mus musculus
aagttaggaccacgagtattgttac

SEQ ID NO: 168431 - DNA, 25 bp, Mus musculus
aagttaggtgagaaagcagaagata

SEQ ID NO: 168432 - DNA, 25 bp, Mus musculus
aagttatatgaaagttacgagaagc

SEQ ID NO: 168433 - DNA, 25 bp, Mus musculus
aagttatcaaagaggatgtctcgga

SEQ ID NO: 168434 - DNA, 25 bp, Mus musculus
aagttatggttatcaccattcctcc

SEQ ID NO: 168435 - DNA, 25 bp, Mus musculus
aagttattcagaagagagccaacca

SEQ ID NO: 168436 - DNA, 25 bp, Mus musculus
aagttattcatgctcgatttattcg

SEQ ID NO: 168437 - DNA, 25 bp, Mus musculus
aagttcaaacaggcagctgagacac

SEQ ID NO: 168438 - DNA, 25 bp, Mus musculus
aagttcaaacagtcgagagctatga

SEQ ID NO: 168439 - DNA, 25 bp, Mus musculus
aagttcaaagcgcaacaggtcctgg

SEQ ID NO: 168440 - DNA, 25 bp, Mus musculus
aagttcaaagctctaggactccatc

SEQ ID NO: 168441 - DNA, 25 bp, Mus musculus
aagttcaaaggcaaaattcttccaa

SEQ ID NO: 168442 - DNA, 25 bp, Mus musculus
aagttcaaaggcaaagcttccctgg

SEQ ID NO: 168443 - DNA, 25 bp, Mus musculus
aagttcaaagggcaacaggtcctgg

SEQ ID NO: 168444 - DNA, 25 bp, Mus musculus
aagttcaaaggtctaggactccatc

SEQ ID NO: 168445 - DNA, 25 bp, Mus musculus
aagttcaaatgagacatcctatgag

SEQ ID NO: 168446 - DNA, 25 bp, Mus musculus
aagttcaacttcgctagttgattta

SEQ ID NO: 168447 - DNA, 25 bp, Mus musculus
aagttcaagagagcaggcaaggaga

SEQ ID NO: 168448 - DNA, 25 bp, Mus musculus
aagttcaagcaagactgtacatttg

SEQ ID NO: 168449 - DNA, 25 bp, Mus musculus
aagttcaagcaagtaaaccggcctc

SEQ ID NO: 168450 - DNA, 25 bp, Mus musculus
aagttcaatggccagaagcaccaag

SEQ ID NO: 168451 - DNA, 25 bp, Mus musculus
aagttcaatggccaggtcaggagtt

SEQ ID NO: 168452 - DNA, 25 bp, Mus musculus
aagttcacaagataaccaacaacca

SEQ ID NO: 168453 - DNA, 25 bp, Mus musculus
aagttcacaaggaatgtatcattga

SEQ ID NO: 168454 - DNA, 25 bp, Mus musculus
aagttcacacagcagaaagtgtcac

SEQ ID NO: 168455 - DNA, 25 bp, Mus musculus
aagttcacagatgtgaccttgagcc

SEQ ID NO: 168456 - DNA, 25 bp, Mus musculus
aagttcaccaagatatttatcaaca

SEQ ID NO: 168457 - DNA, 25 bp, Mus musculus
aagttcaccacagtgactccatacc

SEQ ID NO: 168458 - DNA, 25 bp, Mus musculus
aagttcaccaggcaggcagtacagg

SEQ ID NO: 168459 - DNA, 25 bp, Mus musculus
aagttcaccaggcaggtaagcttca

SEQ ID NO: 168460 - DNA, 25 bp, Mus musculus
aagttcactctagagtcttttattc

SEQ ID NO: 168461 - DNA, 25 bp, Mus musculus
aagttcacttgcaggtgttgtttgt

SEQ ID NO: 168462 - DNA, 25 bp, Mus musculus
aagttcacttgcagtcgagcaaaag

SEQ ID NO: 168463 - DNA, 25 bp, Mus musculus
aagttcagagctggcttccatggag

SEQ ID NO: 168464 - DNA, 25 bp, Mus musculus
aagttcagccctgaaaagtcccaac

SEQ ID NO: 168465 - DNA, 25 bp, Mus musculus
aagttcagccctgagaagagcctgg

SEQ ID NO: 168466 - DNA, 25 bp, Mus musculus
aagttcaggaagctgatttcacaat

SEQ ID NO: 168467 - DNA, 25 bp, Mus musculus
aagttcaggaaggtgcagacacaag

SEQ ID NO: 168468 - DNA, 25 bp, Mus musculus
aagttcaggacctctcctattacac

SEQ ID NO: 168469 - DNA, 25 bp, Mus musculus
aagttcaggcagctgtgctcactgc

SEQ ID NO: 168470 - DNA, 25 bp, Mus musculus
aagttcaggcaggtaatgccatcat

SEQ ID NO: 168471 - DNA, 25 bp, Mus musculus
aagttcaggcttcaggtgcaggtcc

SEQ ID NO: 168472 - DNA, 25 bp, Mus musculus
aagttcaggtaacgcacagtggtat

SEQ ID NO: 168473 - DNA, 25 bp, Mus musculus
aagttcatcagcgggcccctctcca

SEQ ID NO: 168474 - DNA, 25 bp, Mus musculus
aagttcatcaggtatttgtactgtg

SEQ ID NO: 168475 - DNA, 25 bp, Mus musculus
aagttcatgaacacccagtattttg

SEQ ID NO: 168476 - DNA, 25 bp, Mus musculus
aagttcatgaggatctaccgttacc

SEQ ID NO: 168477 - DNA, 25 bp, Mus musculus
aagttcatgatggattgggtcgaaa

SEQ ID NO: 168478 - DNA, 25 bp, Mus musculus
aagttccaacagactggattttggg

SEQ ID NO: 168479 - DNA, 25 bp, Mus musculus
aagttccaacagtctgatgatttga

SEQ ID NO: 168480 - DNA, 25 bp, Mus musculus
aagttccattacaagaccgaccagg

SEQ ID NO: 168481 - DNA, 25 bp, Mus musculus
aagttcccagaccttgtgaccgtgt

SEQ ID NO: 168482 - DNA, 25 bp, Mus musculus
aagttcccagcaagccccgcccaac

SEQ ID NO: 168483 - DNA, 25 bp, Mus musculus
aagttcccagcttcttctgtgtggc

SEQ ID NO: 168484 - DNA, 25 bp, Mus musculus
aagttcccgcctggtctctctggga

SEQ ID NO: 168485 - DNA, 25 bp, Mus musculus
aagttccctccggatggttcagccc

SEQ ID NO: 168486 - DNA, 25 bp, Mus musculus
aagttccctggatgagcaagaagga

SEQ ID NO: 168487 - DNA, 25 bp, Mus musculus
aagttccgattaatggaacggcggt

SEQ ID NO: 168488 - DNA, 25 bp, Mus musculus
aagttcctatgtcacctccaagtaa

SEQ ID NO: 168489 - DNA, 25 bp, Mus musculus
aagttcctcatttacgagcacgagt

SEQ ID NO: 168490 - DNA, 25 bp, Mus musculus
aagttcctgccccgtgaggagactg

SEQ ID NO: 168491 - DNA, 25 bp, Mus musculus
aagttcctgggtttgatgaagataa

SEQ ID NO: 168492 - DNA, 25 bp, Mus musculus
aagttccttcgggcctctgaagaac

SEQ ID NO: 168493 - DNA, 25 bp, Mus musculus
aagttccttcggtgtgtcctggtcc

SEQ ID NO: 168494 - DNA, 25 bp, Mus musculus
aagttcgacgccttaaaagatgatg

SEQ ID NO: 168495 - DNA, 25 bp, Mus musculus
aagttcgactccagctatgacaggg

SEQ ID NO: 168496 - DNA, 25 bp, Mus musculus
aagttcgactccagctatgctccta

SEQ ID NO: 168497 - DNA, 25 bp, Mus musculus
aagttcgcagcctggacctggggat

SEQ ID NO: 168498 - DNA, 25 bp, Mus musculus
aagttcgcagcctgttcagaattgg

SEQ ID NO: 168499 - DNA, 25 bp, Mus musculus
aagttcgggcaggtgcagtaagtgc

SEQ ID NO: 168500 - DNA, 25 bp, Mus musculus
aagttcgtggaaggcaagaagaaat

SEQ ID NO: 168501 - DNA, 25 bp, Mus musculus
aagttcgtggaaggggaagacagcg

SEQ ID NO: 168502 - DNA, 25 bp, Mus musculus
aagttctacagcaagttcgatcctt

SEQ ID NO: 168503 - DNA, 25 bp, Mus musculus
aagttctacaggcacatcatctttg

SEQ ID NO: 168504 - DNA, 25 bp, Mus musculus
aagttctacaggcctgagaataccc

SEQ ID NO: 168505 - DNA, 25 bp, Mus musculus
aagttctacaggctgccacaggtgt

SEQ ID NO: 168506 - DNA, 25 bp, Mus musculus
aagttctacctgaaggatctgaaaa

SEQ ID NO: 168507 - DNA, 25 bp, Mus musculus
aagttctcacagcacatgaaggcac

SEQ ID NO: 168508 - DNA, 25 bp, Mus musculus
aagttctcacaggacatgaaggcac

SEQ ID NO: 168509 - DNA, 25 bp, Mus musculus
aagttctcagatgaatatctgacaa

SEQ ID NO: 168510 - DNA, 25 bp, Mus musculus
aagttctcaggaacaatcctcaatg

SEQ ID NO: 168511 - DNA, 25 bp, Mus musculus
aagttctcatgtctgcccaggaccc

SEQ ID NO: 168512 - DNA, 25 bp, Mus musculus
aagttctctgacaggaatgaatttc

SEQ ID NO: 168513 - DNA, 25 bp, Mus musculus
aagttctctgtcgggtaagcagctg

SEQ ID NO: 168514 - DNA, 25 bp, Mus musculus
aagttctgagaaagacaactgagga

SEQ ID NO: 168515 - DNA, 25 bp, Mus musculus
aagttctgcaaggatgaattgtctg

SEQ ID NO: 168516 - DNA, 25 bp, Mus musculus
aagttctgggtgaaggagagtttgg

SEQ ID NO: 168517 - DNA, 25 bp, Mus musculus
aagttcttcagagagatgacataac

SEQ ID NO: 168518 - DNA, 25 bp, Mus musculus
aagttcttcagagggtttcatatgt

SEQ ID NO: 168519 - DNA, 25 bp, Mus musculus
aagttcttcagagggtttcatctgc

SEQ ID NO: 168520 - DNA, 25 bp, Mus musculus
aagttcttcgtgacgataagtgggc

SEQ ID NO: 168521 - DNA, 25 bp, Mus musculus
aagttcttcgtgacgttattagaag

SEQ ID NO: 168522 - DNA, 25 bp, Mus musculus
aagttgaaacaagggggagaagcga

SEQ ID NO: 168523 - DNA, 25 bp, Mus musculus
aagttgaaacactatggatcgcagc

SEQ ID NO: 168524 - DNA, 25 bp, Mus musculus
aagttgaaactgttatctgggagta

SEQ ID NO: 168525 - DNA, 25 bp, Mus musculus
aagttgaagaagagcctggaagtgg

SEQ ID NO: 168526 - DNA, 25 bp, Mus musculus
aagttgaagaagtgggaatccggaa

SEQ ID NO: 168527 - DNA, 25 bp, Mus musculus
aagttgaagagatccacgtctctcg

SEQ ID NO: 168528 - DNA, 25 bp, Mus musculus
aagttgaagaggcacagagaactga

SEQ ID NO: 168529 - DNA, 25 bp, Mus musculus
aagttgacacactggagggagactg

SEQ ID NO: 168530 - DNA, 25 bp, Mus musculus
aagttgacagtcccacagtcaacac

SEQ ID NO: 168531 - DNA, 25 bp, Mus musculus
aagttgagatggagtctctagccaa

SEQ ID NO: 168532 - DNA, 25 bp, Mus musculus
aagttgagcctcaggactcagagag

SEQ ID NO: 168533 - DNA, 25 bp, Mus musculus
aagttgagcggcggctggtaagaac

SEQ ID NO: 168534 - DNA, 25 bp, Mus musculus
aagttgagcttaatgctttaatgac

SEQ ID NO: 168535 - DNA, 25 bp, Mus musculus
aagttgagcttaatgtttgttaacg

SEQ ID NO: 168536 - DNA, 25 bp, Mus musculus
aagttgagttattggtaacttcaat

SEQ ID NO: 168537 - DNA, 25 bp, Mus musculus
aagttgatgcaaggctttcctttga

SEQ ID NO: 168538 - DNA, 25 bp, Mus musculus
aagttgatgcaagggagctggagga

SEQ ID NO: 168539 - DNA, 25 bp, Mus musculus
aagttgcacaaggtcattgaagcca

SEQ ID NO: 168540 - DNA, 25 bp, Mus musculus
aagttgcagatactcagcctcaggg

SEQ ID NO: 168541 - DNA, 25 bp, Mus musculus
aagttgccatcattggaaagatcta

SEQ ID NO: 168542 - DNA, 25 bp, Mus musculus
aagttgctcagtggacaagattgtg

SEQ ID NO: 168543 - DNA, 25 bp, Mus musculus
aagttgctgaggttgccaagaagtt

SEQ ID NO: 168544 - DNA, 25 bp, Mus musculus
aagttgctgtgaaaccgggctccat

SEQ ID NO: 168545 - DNA, 25 bp, Mus musculus
aagttggacaagatgcaagttctgc

SEQ ID NO: 168546 - DNA, 25 bp, Mus musculus
aagttggcaggaacatcattcatgg

SEQ ID NO: 168547 - DNA, 25 bp, Mus musculus
aagttggcatgaaagctgcactgca

SEQ ID NO: 168548 - DNA, 25 bp, Mus musculus
aagttggcttggcttgagattttta

SEQ ID NO: 168549 - DNA, 25 bp, Mus musculus
aagttggtaaagagcatcataaggg

SEQ ID NO: 168550 - DNA, 25 bp, Mus musculus
aagttggtccttctggagcccctgg

SEQ ID NO: 168551 - DNA, 25 bp, Mus musculus
aagttggttgggtgaatttcatgat

SEQ ID NO: 168552 - DNA, 25 bp, Mus musculus
aagttgtcaacaagctcattcagtt

SEQ ID NO: 168553 - DNA, 25 bp, Mus musculus
aagttgtcaatcagcacaatgctcc

SEQ ID NO: 168554 - DNA, 25 bp, Mus musculus
aagttgtccccttcgcggccgtcag

SEQ ID NO: 168555 - DNA, 25 bp, Mus musculus
aagttgtccccttcggatgaattgt

SEQ ID NO: 168556 - DNA, 25 bp, Mus musculus
aagttgtgagagaaggaagaggcaa

SEQ ID NO: 168557 - DNA, 25 bp, Mus musculus
aagttgtgatcttggaggctggtcc

SEQ ID NO: 168558 - DNA, 25 bp, Mus musculus
aagttgtgcattggactcgttactg

SEQ ID NO: 168559 - DNA, 25 bp, Mus musculus
aagttgtggtgactgacctatccgc

SEQ ID NO: 168560 - DNA, 25 bp, Mus musculus
aagttgtgtgccaccatttgaaagg

SEQ ID NO: 168561 - DNA, 25 bp, Mus musculus
aagttgtgtgccattgctgctgatt

SEQ ID NO: 168562 - DNA, 25 bp, Mus musculus
aagttgttggagacaaagctggctg

SEQ ID NO: 168563 - DNA, 25 bp, Mus musculus
aagttgttggcagagaactgataga

SEQ ID NO: 168564 - DNA, 25 bp, Mus musculus
aagttgttggcaggtattcaataca

SEQ ID NO: 168565 - DNA, 25 bp, Mus musculus
aagttgttgttcaagctgcctcagg

SEQ ID NO: 168566 - DNA, 25 bp, Mus musculus
aagttgttgttcaaggaatatagag

SEQ ID NO: 168567 - DNA, 25 bp, Mus musculus
aagttgtttaacggtagcgcctggc

SEQ ID NO: 168568 - DNA, 25 bp, Mus musculus
aagtttataagggtcgtcatgtcaa

SEQ ID NO: 168569 - DNA, 25 bp, Mus musculus
aagtttatacagatctttcatttgt

SEQ ID NO: 168570 - DNA, 25 bp, Mus musculus
aagtttatacagggtgacatttgtg

SEQ ID NO: 168571 - DNA, 25 bp, Mus musculus
aagtttattacagcactcaaatcta

SEQ ID NO: 168572 - DNA, 25 bp, Mus musculus
aagtttattacagtgtgttcaaagc

SEQ ID NO: 168573 - DNA, 25 bp, Mus musculus
aagtttcatccagggtcacaaacct

SEQ ID NO: 168574 - DNA, 25 bp, Mus musculus
aagtttccagactcaaactgtcacc

SEQ ID NO: 168575 - DNA, 25 bp, Mus musculus
aagtttccagcaagttctggatgat

SEQ ID NO: 168576 - DNA, 25 bp, Mus musculus
aagtttccagcctcctctggtaaag

SEQ ID NO: 168577 - DNA, 25 bp, Mus musculus
aagtttcctgcagctatccttcggg

SEQ ID NO: 168578 - DNA, 25 bp, Mus musculus
aagtttctgtgaagatgggaaataa

SEQ ID NO: 168579 - DNA, 25 bp, Mus musculus
aagtttcttgcaaagatcactggag

SEQ ID NO: 168580 - DNA, 25 bp, Mus musculus
aagtttcttgggaggaagtccacat

SEQ ID NO: 168581 - DNA, 25 bp, Mus musculus
aagtttgaccccccagacttctgga

SEQ ID NO: 168582 - DNA, 25 bp, Mus musculus
aagtttgactggagacagcagtatg

SEQ ID NO: 168583 - DNA, 25 bp, Mus musculus
aagtttgactgggccatgccgctga

SEQ ID NO: 168584 - DNA, 25 bp, Mus musculus
aagtttgagagtggatgtaaagcca

SEQ ID NO: 168585 - DNA, 25 bp, Mus musculus
aagtttgatgaattcttcaaagaac

SEQ ID NO: 168586 - DNA, 25 bp, Mus musculus
aagtttgatgcccaggcaacttaag

SEQ ID NO: 168587 - DNA, 25 bp, Mus musculus
aagtttgatggcaagggtcatgtgg

SEQ ID NO: 168588 - DNA, 25 bp, Mus musculus
aagtttgatggcaaggtgctgtctg

SEQ ID NO: 168589 - DNA, 25 bp, Mus musculus
aagtttgatgtattcttcaaagaac

SEQ ID NO: 168590 - DNA, 25 bp, Mus musculus
aagtttgcaaagaagaaacagcatt

SEQ ID NO: 168591 - DNA, 25 bp, Mus musculus
aagtttgcaaaggaaatatatcccg

SEQ ID NO: 168592 - DNA, 25 bp, Mus musculus
aagtttgcagctaggagccctgggg

SEQ ID NO: 168593 - DNA, 25 bp, Mus musculus
aagtttgcagcttggatgctcaaca

SEQ ID NO: 168594 - DNA, 25 bp, Mus musculus
aagtttgcagtgtgtgacatccctc

SEQ ID NO: 168595 - DNA, 25 bp, Mus musculus
aagtttgccttagagcacggcatcc

SEQ ID NO: 168596 - DNA, 25 bp, Mus musculus
aagtttgctattggccaggctggcc

SEQ ID NO: 168597 - DNA, 25 bp, Mus musculus
aagtttgctattggggggctctgca

SEQ ID NO: 168598 - DNA, 25 bp, Mus musculus
aagtttgctattgtctaaatctcag

SEQ ID NO: 168599 - DNA, 25 bp, Mus musculus
aagtttgcttgtaaggtgcaaaaga

SEQ ID NO: 168600 - DNA, 25 bp, Mus musculus
aagtttggaaacgccattatttgca

SEQ ID NO: 168601 - DNA, 25 bp, Mus musculus
aagtttggaaacggattctgctcta

SEQ ID NO: 168602 - DNA, 25 bp, Mus musculus
aagtttggaagaatgacatacggcc

SEQ ID NO: 168603 - DNA, 25 bp, Mus musculus
aagtttggaagataccaacattttt

SEQ ID NO: 168604 - DNA, 25 bp, Mus musculus
aagtttggaagttgccatccagtgt

SEQ ID NO: 168605 - DNA, 25 bp, Mus musculus
aagtttggaggccacctatgaaaat

SEQ ID NO: 168606 - DNA, 25 bp, Mus musculus
aagtttggagtttgttgaaggatca

SEQ ID NO: 168607 - DNA, 25 bp, Mus musculus
aagtttggcaaggaagcagaacaag

SEQ ID NO: 168608 - DNA, 25 bp, Mus musculus
aagtttgtaaagcctcttcggtgat

SEQ ID NO: 168609 - DNA, 25 bp, Mus musculus
aagtttgtaaccatgaaaatcagaa

SEQ ID NO: 168610 - DNA, 25 bp, Mus musculus
aagtttgtattgcagagctgtttga

SEQ ID NO: 168611 - DNA, 25 bp, Mus musculus
aagtttgtattgcagcttctagagc

SEQ ID NO: 168612 - DNA, 25 bp, Mus musculus
aagtttgtccaacagctcctggagc

SEQ ID NO: 168613 - DNA, 25 bp, Mus musculus
aagtttgtccaacagtaatttgtca

SEQ ID NO: 168614 - DNA, 25 bp, Mus musculus
aagtttgtccgcagaaatctgtctt

SEQ ID NO: 168615 - DNA, 25 bp, Mus musculus
aagtttgtccgcaggaacctgaatg

SEQ ID NO: 168616 - DNA, 25 bp, Mus musculus
aagtttgtgaatgattcccatcatg

SEQ ID NO: 168617 - DNA, 25 bp, Mus musculus
aagtttgtgggtgaatccgtggacg

SEQ ID NO: 168618 - DNA, 25 bp, Mus musculus
aagtttgtttgctcgctcgggcaaa

SEQ ID NO: 168619 - DNA, 25 bp, Mus musculus
aagttttacagtggaaagcccatga

SEQ ID NO: 168620 - DNA, 25 bp, Mus musculus
aagttttagtccttgccctgccgaa

SEQ ID NO: 168621 - DNA, 25 bp, Mus musculus
aagttttcaagaaatattatgctga

SEQ ID NO: 168622 - DNA, 25 bp, Mus musculus
aagttttcaagaaatgtatctttcc

SEQ ID NO: 168623 - DNA, 25 bp, Mus musculus
aagttttcagagattgctggcctcc

SEQ ID NO: 168624 - DNA, 25 bp, Mus musculus
aagttttccagtgaagccatggcag

SEQ ID NO: 168625 - DNA, 25 bp, Mus musculus
aagttttcctacagagagaacctgg

SEQ ID NO: 168626 - DNA, 25 bp, Mus musculus
aagttttcttcccagccggttccag

SEQ ID NO: 168627 - DNA, 25 bp, Mus musculus
aagttttgagagaagcagaagataa

SEQ ID NO: 168628 - DNA, 25 bp, Mus musculus
aagtttttataatgtaaagctgtac

SEQ ID NO: 168629 - DNA, 25 bp, Mus musculus
aagtttttcagaatttcttaatgtc

SEQ ID NO: 168630 - DNA, 25 bp, Mus musculus
aagttttttcagagatcccgcccgg

SEQ ID NO: 168631 - DNA, 25 bp, Mus musculus
aagttttttgggcattgttgtgact

SEQ ID NO: 168632 - DNA, 25 bp, Mus musculus
aagttttttggttgcaaggaagctg

SEQ ID NO: 168633 - DNA, 25 bp, Mus musculus
aataaaaaaattcagggaatgcagt

SEQ ID NO: 168634 - DNA, 25 bp, Mus musculus
aataaaaaaattcatctacaggctc

SEQ ID NO: 168635 - DNA, 25 bp, Mus musculus
aataaaaaaggggcctgctgactcg

SEQ ID NO: 168636 - DNA, 25 bp, Mus musculus
aataaaaacagaacagttgaataga

SEQ ID NO: 168637 - DNA, 25 bp, Mus musculus
aataaaaactcaggtcctttgcaaa

SEQ ID NO: 168638 - DNA, 25 bp, Mus musculus
aataaaaagagactgttgtaacagt

SEQ ID NO: 168639 - DNA, 25 bp, Mus musculus
aataaaaagcagatgcatgttcctg

SEQ ID NO: 168640 - DNA, 25 bp, Mus musculus
aataaaaagcagatgtcatatgcct

SEQ ID NO: 168641 - DNA, 25 bp, Mus musculus
aataaaacaacagttaatttagagt

SEQ ID NO: 168642 - DNA, 25 bp, Mus musculus
aataaaacagaaacatggagctcgg

SEQ ID NO: 168643 - DNA, 25 bp, Mus musculus
aataaaacaggtggcttcggtgctg

SEQ ID NO: 168644 - DNA, 25 bp, Mus musculus
aataaaacaggttcgggagcagcgg

SEQ ID NO: 168645 - DNA, 25 bp, Mus musculus
aataaaacgggtaaaatgatccatt

SEQ ID NO: 168646 - DNA, 25 bp, Mus musculus
aataaaacttcagttgttgacctcc

SEQ ID NO: 168647 - DNA, 25 bp, Mus musculus
aataaaagacaaaggggaagacatc

SEQ ID NO: 168648 - DNA, 25 bp, Mus musculus
aataaaagcaaagagtcttatcagc

SEQ ID NO: 168649 - DNA, 25 bp, Mus musculus
aataaaagcggccataaactgtaca

SEQ ID NO: 168650 - DNA, 25 bp, Mus musculus
aataaaagctcaggaagtctttaat

SEQ ID NO: 168651 - DNA, 25 bp, Mus musculus
aataaaaggtgccacaggcaccatg

SEQ ID NO: 168652 - DNA, 25 bp, Mus musculus
aataaaatagagaatcatcattcaa

SEQ ID NO: 168653 - DNA, 25 bp, Mus musculus
aataaaatatgtcagatttcaacta

SEQ ID NO: 168654 - DNA, 25 bp, Mus musculus
aataaaattcatatgggtaactgtg

SEQ ID NO: 168655 - DNA, 25 bp, Mus musculus
aataaacatcttgagatcttcaact

SEQ ID NO: 168656 - DNA, 25 bp, Mus musculus
aataaaccagaactgagcagtgtcg

SEQ ID NO: 168657 - DNA, 25 bp, Mus musculus
aataaactacagactccatgaattt

SEQ ID NO: 168658 - DNA, 25 bp, Mus musculus
aataaactttcttccatgatagagt

SEQ ID NO: 168659 - DNA, 25 bp, Mus musculus
aataaactttcttcgatgatagagt

SEQ ID NO: 168660 - DNA, 25 bp, Mus musculus
aataaagaaaacagagacgaagaca

SEQ ID NO: 168661 - DNA, 25 bp, Mus musculus
aataaagaaaacagttgagtggtac

SEQ ID NO: 168662 - DNA, 25 bp, Mus musculus
aataaagaaaaggctggaagttctg

SEQ ID NO: 168663 - DNA, 25 bp, Mus musculus
aataaagaaactactcactggccta

SEQ ID NO: 168664 - DNA, 25 bp, Mus musculus
aataaagaaaggtgaccagaatgga

SEQ ID NO: 168665 - DNA, 25 bp, Mus musculus
aataaagaagatatgcacctatttg

SEQ ID NO: 168666 - DNA, 25 bp, Mus musculus
aataaagaagattagttgaagaaca

SEQ ID NO: 168667 - DNA, 25 bp, Mus musculus
aataaagaccttgagagctgttctg

SEQ ID NO: 168668 - DNA, 25 bp, Mus musculus
aataaagagaaaaggtctttcgcac

SEQ ID NO: 168669 - DNA, 25 bp, Mus musculus
aataaagagaaaagtgttaatggcc

SEQ ID NO: 168670 - DNA, 25 bp, Mus musculus
aataaagagcaggtgtcacaactgc

SEQ ID NO: 168671 - DNA, 25 bp, Mus musculus
aataaagcaaggaggggctgagaaa

SEQ ID NO: 168672 - DNA, 25 bp, Mus musculus
aataaagcagttttccacatcgatc

SEQ ID NO: 168673 - DNA, 25 bp, Mus musculus
aataaagcgaatgaacttttctatc

SEQ ID NO: 168674 - DNA, 25 bp, Mus musculus
aataaaggaccgaggattgaagtga

SEQ ID NO: 168675 - DNA, 25 bp, Mus musculus
aataaagtatcagaaatccacttct

SEQ ID NO: 168676 - DNA, 25 bp, Mus musculus
aataaagtatcagatgtctttattc

SEQ ID NO: 168677 - DNA, 25 bp, Mus musculus
aataaagtatcagggctggcagtct

SEQ ID NO: 168678 - DNA, 25 bp, Mus musculus
aataaagtcagagatccagaaattc

SEQ ID NO: 168679 - DNA, 25 bp, Mus musculus
aataaagtcaggtatcttttggata

SEQ ID NO: 168680 - DNA, 25 bp, Mus musculus
aataaagtcaggttttgatatttct

SEQ ID NO: 168681 - DNA, 25 bp, Mus musculus
aataaataaggaagcagtatggttc

SEQ ID NO: 168682 - DNA, 25 bp, Mus musculus
aataaataccggttcttcctcggca

SEQ ID NO: 168683 - DNA, 25 bp, Mus musculus
aataaataccggtttggagattctc

SEQ ID NO: 168684 - DNA, 25 bp, Mus musculus
aataaatagataataccaaacgtct

SEQ ID NO: 168685 - DNA, 25 bp, Mus musculus
aataaatattgggaggactcaggag

SEQ ID NO: 168686 - DNA, 25 bp, Mus musculus
aataaatgcagtatctctcctctct

SEQ ID NO: 168687 - DNA, 25 bp, Mus musculus
aataaattaaagcaagcctgtggtt

SEQ ID NO: 168688 - DNA, 25 bp, Mus musculus
aataaattgaagggtatttcaacaa

SEQ ID NO: 168689 - DNA, 25 bp, Mus musculus
aataaattgctacagggtggttatg

SEQ ID NO: 168690 - DNA, 25 bp, Mus musculus
aataacaaaaactgaacgaacacag

SEQ ID NO: 168691 - DNA, 25 bp, Mus musculus
aataacaaagatgctactacacact

SEQ ID NO: 168692 - DNA, 25 bp, Mus musculus
aataacaaagctgcagtgttgaagt

SEQ ID NO: 168693 - DNA, 25 bp, Mus musculus
aataacaaaggctcaccatcatgga

SEQ ID NO: 168694 - DNA, 25 bp, Mus musculus
aataacacataccaggttacaagga

SEQ ID NO: 168695 - DNA, 25 bp, Mus musculus
aataacactgcagaggactagagtg

SEQ ID NO: 168696 - DNA, 25 bp, Mus musculus
aataacactgcagggtctccaactg

SEQ ID NO: 168697 - DNA, 25 bp, Mus musculus
aataacagaagaaattaaagagaca

SEQ ID NO: 168698 - DNA, 25 bp, Mus musculus
aataacagtgactggtcctattttc

SEQ ID NO: 168699 - DNA, 25 bp, Mus musculus
aataacatccatccttcatgattgt

SEQ ID NO: 168700 - DNA, 25 bp, Mus musculus
aataaccacatttaaatgattatag

SEQ ID NO: 168701 - DNA, 25 bp, Mus musculus
aataaccacatttaagtcagattat

SEQ ID NO: 168702 - DNA, 25 bp, Mus musculus
aataaccagcaacagctcctgagga

SEQ ID NO: 168703 - DNA, 25 bp, Mus musculus
aataaccagtctgtgaacctacaca

SEQ ID NO: 168704 - DNA, 25 bp, Mus musculus
aataacccaggtagtataactccaa

SEQ ID NO: 168705 - DNA, 25 bp, Mus musculus
aataacccagtgggtaagctgaagg

SEQ ID NO: 168706 - DNA, 25 bp, Mus musculus
aataaccctaaaggccttgcatcaa

SEQ ID NO: 168707 - DNA, 25 bp, Mus musculus
aataacctcaagtgactgtggtctg

SEQ ID NO: 168708 - DNA, 25 bp, Mus musculus
aataacctccagggaggtatggacc

SEQ ID NO: 168709 - DNA, 25 bp, Mus musculus
aataacgtaacgcccggccacacag

SEQ ID NO: 168710 - DNA, 25 bp, Mus musculus
aataacgttgggaaggaagaacgct

SEQ ID NO: 168711 - DNA, 25 bp, Mus musculus
aataactatgcctgtggttgagccc

SEQ ID NO: 168712 - DNA, 25 bp, Mus musculus
aataactgggctgttttacctctag

SEQ ID NO: 168713 - DNA, 25 bp, Mus musculus
aataacttatggcaggtccaaacat

SEQ ID NO: 168714 - DNA, 25 bp, Mus musculus
aataactttgtcaagtccaagacag

SEQ ID NO: 168715 - DNA, 25 bp, Mus musculus
aataagaagctcaagtccattacaa

SEQ ID NO: 168716 - DNA, 25 bp, Mus musculus
aataagacaagagtttgggaaatgg

SEQ ID NO: 168717 - DNA, 25 bp, Mus musculus
aataagaccagatcatctttagatg

SEQ ID NO: 168718 - DNA, 25 bp, Mus musculus
aataagactgggatgtttctttcat

SEQ ID NO: 168719 - DNA, 25 bp, Mus musculus
aataagactgggtaaatttgatcct

SEQ ID NO: 168720 - DNA, 25 bp, Mus musculus
aataagagaagctggctgtatagga

SEQ ID NO: 168721 - DNA, 25 bp, Mus musculus
aataagagatccagcccactcaaga

SEQ ID NO: 168722 - DNA, 25 bp, Mus musculus
aataagagatgacagctgaggaccg

SEQ ID NO: 168723 - DNA, 25 bp, Mus musculus
aataagagatgacgtcaggggagga

SEQ ID NO: 168724 - DNA, 25 bp, Mus musculus
aataagagctggagcattttctgca

SEQ ID NO: 168725 - DNA, 25 bp, Mus musculus
aataagatgaggtcctccaccttcg

SEQ ID NO: 168726 - DNA, 25 bp, Mus musculus
aataagatgcactccatgaatgggt

SEQ ID NO: 168727 - DNA, 25 bp, Mus musculus
aataagcagctgacagagggtaccc

SEQ ID NO: 168728 - DNA, 25 bp, Mus musculus
aataagcagtccagatttcatcctg

SEQ ID NO: 168729 - DNA, 25 bp, Mus musculus
aataagcagtccagccctattctga

SEQ ID NO: 168730 - DNA, 25 bp, Mus musculus
aataagcagtccagctcgtctgatc

SEQ ID NO: 168731 - DNA, 25 bp, Mus musculus
aataagcagtccaggttcttactct

SEQ ID NO: 168732 - DNA, 25 bp, Mus musculus
aataagcctggtggacccatggatg

SEQ ID NO: 168733 - DNA, 25 bp, Mus musculus
aataagccttgtacactggacacta

SEQ ID NO: 168734 - DNA, 25 bp, Mus musculus
aataagcgccggaggactgcatgag

SEQ ID NO: 168735 - DNA, 25 bp, Mus musculus
aataagctacaggagcttcaagtca

SEQ ID NO: 168736 - DNA, 25 bp, Mus musculus
aataagcttgctgagactctccgct

SEQ ID NO: 168737 - DNA, 25 bp, Mus musculus
aataagcttgctgagggtttcccag

SEQ ID NO: 168738 - DNA, 25 bp, Mus musculus
aataaggaacaggacggacggaatg

SEQ ID NO: 168739 - DNA, 25 bp, Mus musculus
aataaggaacagtcagagctaagac

SEQ ID NO: 168740 - DNA, 25 bp, Mus musculus
aataaggaagcggggagtgaggcag

SEQ ID NO: 168741 - DNA, 25 bp, Mus musculus
aataaggacgggccaaggtggagct

SEQ ID NO: 168742 - DNA, 25 bp, Mus musculus
aataaggcactgaagggccacacat

SEQ ID NO: 168743 - DNA, 25 bp, Mus musculus
aataaggcagagcaggttatttcgc

SEQ ID NO: 168744 - DNA, 25 bp, Mus musculus
aataagggcacacctagtcaggtga

SEQ ID NO: 168745 - DNA, 25 bp, Mus musculus
aataaggtggttcctttggggagat

SEQ ID NO: 168746 - DNA, 25 bp, Mus musculus
aataataaaaagtgctctatgccca

SEQ ID NO: 168747 - DNA, 25 bp, Mus musculus
aataataaagcatattcaaaagaaa

SEQ ID NO: 168748 - DNA, 25 bp, Mus musculus
aataataaagggacagatatggctt

SEQ ID NO: 168749 - DNA, 25 bp, Mus musculus
aataataacaaaaactgaacgaaca

SEQ ID NO: 168750 - DNA, 25 bp, Mus musculus
aataataacccaggtagtataactc

SEQ ID NO: 168751 - DNA, 25 bp, Mus musculus
aataataacccagtgggtaagctga

SEQ ID NO: 168752 - DNA, 25 bp, Mus musculus
aataataccaggtggtgccacagag

SEQ ID NO: 168753 - DNA, 25 bp, Mus musculus
aataatactagaagatacatcacta

SEQ ID NO: 168754 - DNA, 25 bp, Mus musculus
aataatagcagtggcagcaatgttc

SEQ ID NO: 168755 - DNA, 25 bp, Mus musculus
aataatatgatgaggggttgccaca

SEQ ID NO: 168756 - DNA, 25 bp, Mus musculus
aataatatttctaatgcggcattcc

SEQ ID NO: 168757 - DNA, 25 bp, Mus musculus
aataatcaaagatcttgtttttagc

SEQ ID NO: 168758 - DNA, 25 bp, Mus musculus
aataatcaaatgggttgtgtggtga

SEQ ID NO: 168759 - DNA, 25 bp, Mus musculus
aataatcacactgaagtgatcccaa

SEQ ID NO: 168760 - DNA, 25 bp, Mus musculus
aataatcagagctgagggaataaaa

SEQ ID NO: 168761 - DNA, 25 bp, Mus musculus
aataatcagaggtatgccttcatgc

SEQ ID NO: 168762 - DNA, 25 bp, Mus musculus
aataatcagtatgaagctgctctta

SEQ ID NO: 168763 - DNA, 25 bp, Mus musculus
aataatcagtgtaagctgctcttaa

SEQ ID NO: 168764 - DNA, 25 bp, Mus musculus
aataatcatcttcttcagggtgatg

SEQ ID NO: 168765 - DNA, 25 bp, Mus musculus
aataatcctgttttgatggaaggac

SEQ ID NO: 168766 - DNA, 25 bp, Mus musculus
aataatctgaagaccatggagcaag

SEQ ID NO: 168767 - DNA, 25 bp, Mus musculus
aataatctgtgaagatgtccagctc

SEQ ID NO: 168768 - DNA, 25 bp, Mus musculus
aataatcttaacagtgtcttggctg

SEQ ID NO: 168769 - DNA, 25 bp, Mus musculus
aataatgaaatggatataaccaaga

SEQ ID NO: 168770 - DNA, 25 bp, Mus musculus
aataatgaaatggggattggtgtgt

SEQ ID NO: 168771 - DNA, 25 bp, Mus musculus
aataatgacttgggacaaaagaaag

SEQ ID NO: 168772 - DNA, 25 bp, Mus musculus
aataatgatacctcgttcgtgtctt

SEQ ID NO: 168773 - DNA, 25 bp, Mus musculus
aataatgcaaaagactaacctaaca

SEQ ID NO: 168774 - DNA, 25 bp, Mus musculus
aataatgccactgaggagctcctag

SEQ ID NO: 168775 - DNA, 25 bp, Mus musculus
aataatgccactgagtgaagcgtct

SEQ ID NO: 168776 - DNA, 25 bp, Mus musculus
aataatggaagccagaaataggacc

SEQ ID NO: 168777 - DNA, 25 bp, Mus musculus
aataatggaagtgggaagagtgctg

SEQ ID NO: 168778 - DNA, 25 bp, Mus musculus
aataatggacccacatgaaaaatgt

SEQ ID NO: 168779 - DNA, 25 bp, Mus musculus
aataatggactcccttttatttgac

SEQ ID NO: 168780 - DNA, 25 bp, Mus musculus
aataatggcctcggtcactttcacg

SEQ ID NO: 168781 - DNA, 25 bp, Mus musculus
aataatggcgcccagagcataaata

SEQ ID NO: 168782 - DNA, 25 bp, Mus musculus
aataatggcggctattgatacagaa

SEQ ID NO: 168783 - DNA, 25 bp, Mus musculus
aataatggtgatggtcttctccatc

SEQ ID NO: 168784 - DNA, 25 bp, Mus musculus
aataatgttgaaggaagccaaaaac

SEQ ID NO: 168785 - DNA, 25 bp, Mus musculus
aataattaaggaaagggctgtgagg

SEQ ID NO: 168786 - DNA, 25 bp, Mus musculus
aataattatttggctgatgaagaat

SEQ ID NO: 168787 - DNA, 25 bp, Mus musculus
aataattcactgctaaaatacatta

SEQ ID NO: 168788 - DNA, 25 bp, Mus musculus
aataattcatccaggtcaagtggag

SEQ ID NO: 168789 - DNA, 25 bp, Mus musculus
aataattcatccaggttcttaaatt

SEQ ID NO: 168790 - DNA, 25 bp, Mus musculus
aataattcctaccacagaaactgca

SEQ ID NO: 168791 - DNA, 25 bp, Mus musculus
aataattcctcacagacacactgga

SEQ ID NO: 168792 - DNA, 25 bp, Mus musculus
aataattgatgctgtgaaggctgga

SEQ ID NO: 168793 - DNA, 25 bp, Mus musculus
aataattgcaaagataactgggaaa

SEQ ID NO: 168794 - DNA, 25 bp, Mus musculus
aataattgcaaaggaaggaaggtct

SEQ ID NO: 168795 - DNA, 25 bp, Mus musculus
aataattggtttaagtgctgtgaag

SEQ ID NO: 168796 - DNA, 25 bp, Mus musculus
aataattgtgaggatgaagtttctg

SEQ ID NO: 168797 - DNA, 25 bp, Mus musculus
aataatttcagctgccagtgaagga

SEQ ID NO: 168798 - DNA, 25 bp, Mus musculus
aatacaaatacaggaagacatttca

SEQ ID NO: 168799 - DNA, 25 bp, Mus musculus
aatacaaccgggattgacccaccgt

SEQ ID NO: 168800 - DNA, 25 bp, Mus musculus
aatacaaccgggattggcagaatta

SEQ ID NO: 168801 - DNA, 25 bp, Mus musculus
aatacaactcagatcccaagcagta

SEQ ID NO: 168802 - DNA, 25 bp, Mus musculus
aatacaactcagatctccatcagaa

SEQ ID NO: 168803 - DNA, 25 bp, Mus musculus
aatacaacttcaggtgaaaattttg

SEQ ID NO: 168804 - DNA, 25 bp, Mus musculus
aatacaagaagacaggtaaacacaa

SEQ ID NO: 168805 - DNA, 25 bp, Mus musculus
aatacaagaagagttatgaaaagat

SEQ ID NO: 168806 - DNA, 25 bp, Mus musculus
aatacaagagcttctactggtgcag

SEQ ID NO: 168807 - DNA, 25 bp, Mus musculus
aatacaagagcttctgagtctatcc

SEQ ID NO: 168808 - DNA, 25 bp, Mus musculus
aatacaaggataagaatgaagaaga

SEQ ID NO: 168809 - DNA, 25 bp, Mus musculus
aatacaatatggggctgccggtgga

SEQ ID NO: 168810 - DNA, 25 bp, Mus musculus
aatacaatgcctttaacttgtttgt

SEQ ID NO: 168811 - DNA, 25 bp, Mus musculus
aatacaattgctgatactttgtgta

SEQ ID NO: 168812 - DNA, 25 bp, Mus musculus
aatacacgtctgcccgtgtgctgat

SEQ ID NO: 168813 - DNA, 25 bp, Mus musculus
aatacactctgattactacaaggga

SEQ ID NO: 168814 - DNA, 25 bp, Mus musculus
aatacactgagctcatgaccaggtg

SEQ ID NO: 168815 - DNA, 25 bp, Mus musculus
aatacagatcagggagcctttgcct

SEQ ID NO: 168816 - DNA, 25 bp, Mus musculus
aatacagcaaataaggagacagtga

SEQ ID NO: 168817 - DNA, 25 bp, Mus musculus
aatacagccaacagagcttggccag

SEQ ID NO: 168818 - DNA, 25 bp, Mus musculus
aatacagccaggatctgagtgttcg

SEQ ID NO: 168819 - DNA, 25 bp, Mus musculus
aatacagccaggatgaggtagatga

SEQ ID NO: 168820 - DNA, 25 bp, Mus musculus
aatacagcttttatcaaaggtgtgc

SEQ ID NO: 168821 - DNA, 25 bp, Mus musculus
aatacagtaaatggaagatcaagat

SEQ ID NO: 168822 - DNA, 25 bp, Mus musculus
aatacagtagtctggacagaggatc

SEQ ID NO: 168823 - DNA, 25 bp, Mus musculus
aatacataaatatgcaaacagggag

SEQ ID NO: 168824 - DNA, 25 bp, Mus musculus
aatacataaatatgtaaagaacatg

SEQ ID NO: 168825 - DNA, 25 bp, Mus musculus
aatacatagcgacagcgaaggacga

SEQ ID NO: 168826 - DNA, 25 bp, Mus musculus
aatacatctgccagtgtcctggcat

SEQ ID NO: 168827 - DNA, 25 bp, Mus musculus
aatacatgggcaacgctggacgtaa

SEQ ID NO: 168828 - DNA, 25 bp, Mus musculus
aatacatgtcaagatgtgaatgagt

SEQ ID NO: 168829 - DNA, 25 bp, Mus musculus
aatacatgtcaagatgtggatgagt

SEQ ID NO: 168830 - DNA, 25 bp, Mus musculus
aatacatgtcaagcatcagtgaaca

SEQ ID NO: 168831 - DNA, 25 bp, Mus musculus
aatacattaaaggaggcacttgact

SEQ ID NO: 168832 - DNA, 25 bp, Mus musculus
aatacattcagcccacttggtgcct

SEQ ID NO: 168833 - DNA, 25 bp, Mus musculus
aatacattcaggaagccgaaatgtt

SEQ ID NO: 168834 - DNA, 25 bp, Mus musculus
aatacattttcacggacaagccctc

SEQ ID NO: 168835 - DNA, 25 bp, Mus musculus
aataccaagcctagtgctaccaagg

SEQ ID NO: 168836 - DNA, 25 bp, Mus musculus
aataccaatagagggggctactgag

SEQ ID NO: 168837 - DNA, 25 bp, Mus musculus
aataccacaacacaacaatcttggg

SEQ ID NO: 168838 - DNA, 25 bp, Mus musculus
aataccagtgaaatgcctgcccaga

SEQ ID NO: 168839 - DNA, 25 bp, Mus musculus
aataccatatcagtgccttgtatgt

SEQ ID NO: 168840 - DNA, 25 bp, Mus musculus
aataccatccggttatgggatattg

SEQ ID NO: 168841 - DNA, 25 bp, Mus musculus
aataccatgatttctaggcaaggcc

SEQ ID NO: 168842 - DNA, 25 bp, Mus musculus
aataccattaaaaagcctcaagccc

SEQ ID NO: 168843 - DNA, 25 bp, Mus musculus
aataccattaaaaagctcactctgc

SEQ ID NO: 168844 - DNA, 25 bp, Mus musculus
aatacccaaagatctttataagcta

SEQ ID NO: 168845 - DNA, 25 bp, Mus musculus
aatacccagccaaagccctggacta

SEQ ID NO: 168846 - DNA, 25 bp, Mus musculus
aataccccccggtgccacattctgg

SEQ ID NO: 168847 - DNA, 25 bp, Mus musculus
aatacccctctataaaactggtggt

SEQ ID NO: 168848 - DNA, 25 bp, Mus musculus
aatacccctctctggtggtggagct

SEQ ID NO: 168849 - DNA, 25 bp, Mus musculus
aataccctcacaaccccggctacaa

SEQ ID NO: 168850 - DNA, 25 bp, Mus musculus
aataccctgcagcatagcatctccc

SEQ ID NO: 168851 - DNA, 25 bp, Mus musculus
aataccctgcaggtgatctgtctgg

SEQ ID NO: 168852 - DNA, 25 bp, Mus musculus
aatacccttaccacctatgtgccat

SEQ ID NO: 168853 - DNA, 25 bp, Mus musculus
aatacccttttcagactcttgtgta

SEQ ID NO: 168854 - DNA, 25 bp, Mus musculus
aatacccttttcaggtcgtgcatga

SEQ ID NO: 168855 - DNA, 25 bp, Mus musculus
aataccgcaagggcctgctgaaaat

SEQ ID NO: 168856 - DNA, 25 bp, Mus musculus
aataccgtaggtggtcaactattcc

SEQ ID NO: 168857 - DNA, 25 bp, Mus musculus
aatacctaagctttctccagaccag

SEQ ID NO: 168858 - DNA, 25 bp, Mus musculus
aatacctaagtagtgttggagtgca

SEQ ID NO: 168859 - DNA, 25 bp, Mus musculus
aatacctagcaggtcctcatgggta

SEQ ID NO: 168860 - DNA, 25 bp, Mus musculus
aatacctcaagggtgaggatccttt

SEQ ID NO: 168861 - DNA, 25 bp, Mus musculus
aatacctcaggtgcctgaaaaagcc

SEQ ID NO: 168862 - DNA, 25 bp, Mus musculus
aatacctccagttcagaagaagagc

SEQ ID NO: 168863 - DNA, 25 bp, Mus musculus
aatacctggagcacacatccattcc

SEQ ID NO: 168864 - DNA, 25 bp, Mus musculus
aatacctggagtgtctggtcctgga

SEQ ID NO: 168865 - DNA, 25 bp, Mus musculus
aatacctggatcctgagcatgctgc

SEQ ID NO: 168866 - DNA, 25 bp, Mus musculus
aatacctggatgaggagaaacttga

SEQ ID NO: 168867 - DNA, 25 bp, Mus musculus
aataccttcaagatgctgggtgccc

SEQ ID NO: 168868 - DNA, 25 bp, Mus musculus
aataccttcaagccaccttcaagac

SEQ ID NO: 168869 - DNA, 25 bp, Mus musculus
aataccttcgagatgctgggtgccc

SEQ ID NO: 168870 - DNA, 25 bp, Mus musculus
aataccttcgagccttcccagaggc

SEQ ID NO: 168871 - DNA, 25 bp, Mus musculus
aatacgaactgcctgatgtaaagaa

SEQ ID NO: 168872 - DNA, 25 bp, Mus musculus
aatacgaagaggaagaggaggccca

SEQ ID NO: 168873 - DNA, 25 bp, Mus musculus
aatacgatctctttgggtccatttt

SEQ ID NO: 168874 - DNA, 25 bp, Mus musculus
aatacgattcagatggttacggctc

SEQ ID NO: 168875 - DNA, 25 bp, Mus musculus
aatacgctacacgactggcccagat

SEQ ID NO: 168876 - DNA, 25 bp, Mus musculus
aatacgctcagccatgaagatgagg

SEQ ID NO: 168877 - DNA, 25 bp, Mus musculus
aatacgctctgagaagtactctcaa

SEQ ID NO: 168878 - DNA, 25 bp, Mus musculus
aatacgctctgagaatgtatgactc

SEQ ID NO: 168879 - DNA, 25 bp, Mus musculus
aatacgctgctgagataggacggga

SEQ ID NO: 168880 - DNA, 25 bp, Mus musculus
aatacgctgctgagcttcacctggt

SEQ ID NO: 168881 - DNA, 25 bp, Mus musculus
aatacggaagcaaggaaaatccaat

SEQ ID NO: 168882 - DNA, 25 bp, Mus musculus
aatacgtcaaagagcagtgacttat

SEQ ID NO: 168883 - DNA, 25 bp, Mus musculus
aatacgtcagacatctggcaggaga

SEQ ID NO: 168884 - DNA, 25 bp, Mus musculus
aatacgtgaagttctccaaggagag

SEQ ID NO: 168885 - DNA, 25 bp, Mus musculus
aatacgtgtcgtcagcagccttttg

SEQ ID NO: 168886 - DNA, 25 bp, Mus musculus
aatacgttccaggagttacagcttc

SEQ ID NO: 168887 - DNA, 25 bp, Mus musculus
aatacgttcgcaactcacggatgat

SEQ ID NO: 168888 - DNA, 25 bp, Mus musculus
aatactacatttatgatctgcagaa

SEQ ID NO: 168889 - DNA, 25 bp, Mus musculus
aatactacatttttttccagaggcc

SEQ ID NO: 168890 - DNA, 25 bp, Mus musculus
aatactagaagatacatcactaaag

SEQ ID NO: 168891 - DNA, 25 bp, Mus musculus
aatactattacggcatcctgagtga

SEQ ID NO: 168892 - DNA, 25 bp, Mus musculus
aatactattacggcatggaccttga

SEQ ID NO: 168893 - DNA, 25 bp, Mus musculus
aatactcacagaaagaagaatcctc

SEQ ID NO: 168894 - DNA, 25 bp, Mus musculus
aatactcagggaggagactcccata

SEQ ID NO: 168895 - DNA, 25 bp, Mus musculus
aatactcatctcaggacagctccct

SEQ ID NO: 168896 - DNA, 25 bp, Mus musculus
aatactcatctcagggctgtccaag

SEQ ID NO: 168897 - DNA, 25 bp, Mus musculus
aatactccgcaaccgatcacttgtg

SEQ ID NO: 168898 - DNA, 25 bp, Mus musculus
aatactctttaaggaagattacttt

SEQ ID NO: 168899 - DNA, 25 bp, Mus musculus
aatactgaagtgtattccttaccgt

SEQ ID NO: 168900 - DNA, 25 bp, Mus musculus
aatactgagctgactaagccccagt

SEQ ID NO: 168901 - DNA, 25 bp, Mus musculus
aatactgatactggtgaagaaaatc

SEQ ID NO: 168902 - DNA, 25 bp, Mus musculus
aatactgcataccgacaacatctgg

SEQ ID NO: 168903 - DNA, 25 bp, Mus musculus
aatactgccatcaaggcccctaaca

SEQ ID NO: 168904 - DNA, 25 bp, Mus musculus
aatactgcttaagtatttttctgac

SEQ ID NO: 168905 - DNA, 25 bp, Mus musculus
aatactgcttcaacttctcttgcag

SEQ ID NO: 168906 - DNA, 25 bp, Mus musculus
aatactggaattacaggctgacccc

SEQ ID NO: 168907 - DNA, 25 bp, Mus musculus
aatactgtcttctctgcctcccgag

SEQ ID NO: 168908 - DNA, 25 bp, Mus musculus
aatactgtgaaggaagccaaagaga

SEQ ID NO: 168909 - DNA, 25 bp, Mus musculus
aatactgtttggcatggctgccagc

SEQ ID NO: 168910 - DNA, 25 bp, Mus musculus
aatacttaacgtctcattcttgcgc

SEQ ID NO: 168911 - DNA, 25 bp, Mus musculus
aatacttaggaaagccccggcagcc

SEQ ID NO: 168912 - DNA, 25 bp, Mus musculus
aatacttcacagagaaatattactg

SEQ ID NO: 168913 - DNA, 25 bp, Mus musculus
aatacttcacagagagcatgtgacc

SEQ ID NO: 168914 - DNA, 25 bp, Mus musculus
aatacttccaagccaactaagaaga

SEQ ID NO: 168915 - DNA, 25 bp, Mus musculus
aatacttcttcatccacatctacat

SEQ ID NO: 168916 - DNA, 25 bp, Mus musculus
aatacttggagaaactggaggtact

SEQ ID NO: 168917 - DNA, 25 bp, Mus musculus
aatactttccagaacacttcagtta

SEQ ID NO: 168918 - DNA, 25 bp, Mus musculus
aatagaaaataaaatcttggcaatg

SEQ ID NO: 168919 - DNA, 25 bp, Mus musculus
aatagaaattctcacctccctagca

SEQ ID NO: 168920 - DNA, 25 bp, Mus musculus
aatagaagaggactccatataaccc

SEQ ID NO: 168921 - DNA, 25 bp, Mus musculus
aatagaagaggagggactgatttgc

SEQ ID NO: 168922 - DNA, 25 bp, Mus musculus
aatagaagaggccttctttctagag

SEQ ID NO: 168923 - DNA, 25 bp, Mus musculus
aatagaagaggtagtagaagaggag

SEQ ID NO: 168924 - DNA, 25 bp, Mus musculus
aatagaagatattaaacgacacaag

SEQ ID NO: 168925 - DNA, 25 bp, Mus musculus
aatagaagatattttttgagaaatg

SEQ ID NO: 168926 - DNA, 25 bp, Mus musculus
aatagaaggaaacagttcagggcga

SEQ ID NO: 168927 - DNA, 25 bp, Mus musculus
aatagaatacatggcccctgaaatc

SEQ ID NO: 168928 - DNA, 25 bp, Mus musculus
aatagaatcagcaggtctgatcttg

SEQ ID NO: 168929 - DNA, 25 bp, Mus musculus
aatagacaaggctttgatgaggcct

SEQ ID NO: 168930 - DNA, 25 bp, Mus musculus
aatagaccagatctcacaggaaaac

SEQ ID NO: 168931 - DNA, 25 bp, Mus musculus
aatagactaccaggttgggataaac

SEQ ID NO: 168932 - DNA, 25 bp, Mus musculus
aatagagacagaaagctcagaggct

SEQ ID NO: 168933 - DNA, 25 bp, Mus musculus
aatagaggatctcagttcacatatg

SEQ ID NO: 168934 - DNA, 25 bp, Mus musculus
aatagagttgcttcacgtcttaccc

SEQ ID NO: 168935 - DNA, 25 bp, Mus musculus
aatagatctaaaggagctgtgaaat

SEQ ID NO: 168936 - DNA, 25 bp, Mus musculus
aatagcaaaggatgcagtcatgctg

SEQ ID NO: 168937 - DNA, 25 bp, Mus musculus
aatagcacacacaagggctgggtat

SEQ ID NO: 168938 - DNA, 25 bp, Mus musculus
aatagcacaggaatgattggcagca

SEQ ID NO: 168939 - DNA, 25 bp, Mus musculus
aatagcagaaagttccctggctcct

SEQ ID NO: 168940 - DNA, 25 bp, Mus musculus
aatagcatagacatggactagggtt

SEQ ID NO: 168941 - DNA, 25 bp, Mus musculus
aatagcccctatggctgtagcagtg

SEQ ID NO: 168942 - DNA, 25 bp, Mus musculus
aatagctaagagctttgaccctgtc

SEQ ID NO: 168943 - DNA, 25 bp, Mus musculus
aatagctacaacaaccgccgagacc

SEQ ID NO: 168944 - DNA, 25 bp, Mus musculus
aatagctcctaggttgggagtctaa

SEQ ID NO: 168945 - DNA, 25 bp, Mus musculus
aatagctcctatacctgactgtcag

SEQ ID NO: 168946 - DNA, 25 bp, Mus musculus
aatagctcctccagagctcccagac

SEQ ID NO: 168947 - DNA, 25 bp, Mus musculus
aatagctctcaggtcaactcctgga

SEQ ID NO: 168948 - DNA, 25 bp, Mus musculus
aatagctgggccgggattctgaaag

SEQ ID NO: 168949 - DNA, 25 bp, Mus musculus
aataggaaataggttaaatggaatc

SEQ ID NO: 168950 - DNA, 25 bp, Mus musculus
aataggagacaggtggcgacagaca

SEQ ID NO: 168951 - DNA, 25 bp, Mus musculus
aataggagacagtcagtggatacgg

SEQ ID NO: 168952 - DNA, 25 bp, Mus musculus
aataggaggcggtaaccatagagat

SEQ ID NO: 168953 - DNA, 25 bp, Mus musculus
aataggatccctggagtccctggct

SEQ ID NO: 168954 - DNA, 25 bp, Mus musculus
aataggatcgagatcccgctcaagg

SEQ ID NO: 168955 - DNA, 25 bp, Mus musculus
aataggattccaggagtccctggct

SEQ ID NO: 168956 - DNA, 25 bp, Mus musculus
aataggccagagtgggtcatctctg

SEQ ID NO: 168957 - DNA, 25 bp, Mus musculus
aataggccagagtggtggttcccga

SEQ ID NO: 168958 - DNA, 25 bp, Mus musculus
aataggcgaggacgcggacctcagc

SEQ ID NO: 168959 - DNA, 25 bp, Mus musculus
aataggcgaggttcaagtagtatct

SEQ ID NO: 168960 - DNA, 25 bp, Mus musculus
aatagggcacaggtatattgaaata

SEQ ID NO: 168961 - DNA, 25 bp, Mus musculus
aataggggagcagccctggctgtcc

SEQ ID NO: 168962 - DNA, 25 bp, Mus musculus
aataggggagcagggcatgaatctt

SEQ ID NO: 168963 - DNA, 25 bp, Mus musculus
aatagtaaaggctggacccgactat

SEQ ID NO: 168964 - DNA, 25 bp, Mus musculus
aatagtacaggcagtgggaactcac

SEQ ID NO: 168965 - DNA, 25 bp, Mus musculus
aatagtaccatgcaggcgagacttc

SEQ ID NO: 168966 - DNA, 25 bp, Mus musculus
aatagtaggcactgatattcgagac

SEQ ID NO: 168967 - DNA, 25 bp, Mus musculus
aatagtcaaggtgaatatgaagaag

SEQ ID NO: 168968 - DNA, 25 bp, Mus musculus
aatagtccaacagaaagcaaagata

SEQ ID NO: 168969 - DNA, 25 bp, Mus musculus
aatagtccaacaggtgactgttcag

SEQ ID NO: 168970 - DNA, 25 bp, Mus musculus
aatagtccaacatcttcagcaaacg

SEQ ID NO: 168971 - DNA, 25 bp, Mus musculus
aatagtccccaaggactttctgagc

SEQ ID NO: 168972 - DNA, 25 bp, Mus musculus
aatagtcttttacccagtagagatg

SEQ ID NO: 168973 - DNA, 25 bp, Mus musculus
aatagtgaaagtcctcaggactcct

SEQ ID NO: 168974 - DNA, 25 bp, Mus musculus
aatagtgaagcagagccatgaagaa

SEQ ID NO: 168975 - DNA, 25 bp, Mus musculus
aatagtgtccatgtcaatatacagt

SEQ ID NO: 168976 - DNA, 25 bp, Mus musculus
aatagtgttctgttgttattttcct

SEQ ID NO: 168977 - DNA, 25 bp, Mus musculus
aatagttcagacatcctacaggctt

SEQ ID NO: 168978 - DNA, 25 bp, Mus musculus
aatagttctgcagagttctacagcc

SEQ ID NO: 168979 - DNA, 25 bp, Mus musculus
aatagttctgcaggacaatgcctta

SEQ ID NO: 168980 - DNA, 25 bp, Mus musculus
aatagttggtgtttggcacagacta

SEQ ID NO: 168981 - DNA, 25 bp, Mus musculus
aatataaaaagaggaaactgcactg

SEQ ID NO: 168982 - DNA, 25 bp, Mus musculus
aatataaaaaggtaacaactgattg

SEQ ID NO: 168983 - DNA, 25 bp, Mus musculus
aatataaaatggaagctttaaatgc

SEQ ID NO: 168984 - DNA, 25 bp, Mus musculus
aatataaaatgggtcaaatagaaat

SEQ ID NO: 168985 - DNA, 25 bp, Mus musculus
aatataaacaacttccattcgaaca

SEQ ID NO: 168986 - DNA, 25 bp, Mus musculus
aatataacatcagatattcagtgaa

SEQ ID NO: 168987 - DNA, 25 bp, Mus musculus
aatataacatctttaactacaaggg

SEQ ID NO: 168988 - DNA, 25 bp, Mus musculus
aatataacatgcagatattcagtga

SEQ ID NO: 168989 - DNA, 25 bp, Mus musculus
aatataagtgaggtgttacatcctg

SEQ ID NO: 168990 - DNA, 25 bp, Mus musculus
aatataatagatgtggtatctaccc

SEQ ID NO: 168991 - DNA, 25 bp, Mus musculus
aatataatgctagataaatgggaga

SEQ ID NO: 168992 - DNA, 25 bp, Mus musculus
aatataattgaagaagcaacagact

SEQ ID NO: 168993 - DNA, 25 bp, Mus musculus
aatatacaaggctcaaactcagaaa

SEQ ID NO: 168994 - DNA, 25 bp, Mus musculus
aatatacagcgtttgacttttgcca

SEQ ID NO: 168995 - DNA, 25 bp, Mus musculus
aatataccaagtgtcctggttgcct

SEQ ID NO: 168996 - DNA, 25 bp, Mus musculus
aatataccaatgtctcttggacctt

SEQ ID NO: 168997 - DNA, 25 bp, Mus musculus
aatatacggaagcccctctggaacc

SEQ ID NO: 168998 - DNA, 25 bp, Mus musculus
aatatagagctggaggataaataag

SEQ ID NO: 168999 - DNA, 25 bp, Mus musculus
aatatagcaacttggttctcacgag

SEQ ID NO: 169000 - DNA, 25 bp, Mus musculus
aatatagcacagaacctatcaacac

SEQ ID NO: 169001 - DNA, 25 bp, Mus musculus
aatatagccttcaggaaacaaagca

SEQ ID NO: 169002 - DNA, 25 bp, Mus musculus
aatataggacggcagagaatccgtg

SEQ ID NO: 169003 - DNA, 25 bp, Mus musculus
aatatataaagaggcttgcacagca

SEQ ID NO: 169004 - DNA, 25 bp, Mus musculus
aatatatacgggttctccttgctgg

SEQ ID NO: 169005 - DNA, 25 bp, Mus musculus
aatatatatggaagaccaccagact

SEQ ID NO: 169006 - DNA, 25 bp, Mus musculus
aatatatctgcttgtagagctgtcg

SEQ ID NO: 169007 - DNA, 25 bp, Mus musculus
aatatatggagcagaagcaaatcag

SEQ ID NO: 169008 - DNA, 25 bp, Mus musculus
aatatatgtatatactgccccggag

SEQ ID NO: 169009 - DNA, 25 bp, Mus musculus
aatatattaaccgggaatcacctgg

SEQ ID NO: 169010 - DNA, 25 bp, Mus musculus
aatatattacatagacatgcagaag

SEQ ID NO: 169011 - DNA, 25 bp, Mus musculus
aatatattatgaaagaatcccagta

SEQ ID NO: 169012 - DNA, 25 bp, Mus musculus
aatatattatgaaagctatcatgag

SEQ ID NO: 169013 - DNA, 25 bp, Mus musculus
aatatattgtaacagaatccgaatc

SEQ ID NO: 169014 - DNA, 25 bp, Mus musculus
aatatatttgctcaaagccatcttc

SEQ ID NO: 169015 - DNA, 25 bp, Mus musculus
aatatatttgctcaaatggcctcct

SEQ ID NO: 169016 - DNA, 25 bp, Mus musculus
aatatcaacctgaagattacgctcg

SEQ ID NO: 169017 - DNA, 25 bp, Mus musculus
aatatcaagaaacccccatagaatg

SEQ ID NO: 169018 - DNA, 25 bp, Mus musculus
aatatcaagaaactaatactctaca

SEQ ID NO: 169019 - DNA, 25 bp, Mus musculus
aatatcaagccgcctgtttctggac

SEQ ID NO: 169020 - DNA, 25 bp, Mus musculus
aatatcaagccgcgttttacgatgg

SEQ ID NO: 169021 - DNA, 25 bp, Mus musculus
aatatcaatacagggtctgtgatgg

SEQ ID NO: 169022 - DNA, 25 bp, Mus musculus
aatatcacagaacagcacttcttaa

SEQ ID NO: 169023 - DNA, 25 bp, Mus musculus
aatatcacaggctaatgttatctgc

SEQ ID NO: 169024 - DNA, 25 bp, Mus musculus
aatatcaccaaacagacaccaactt

SEQ ID NO: 169025 - DNA, 25 bp, Mus musculus
aatatcaccggattcatggttggca

SEQ ID NO: 169026 - DNA, 25 bp, Mus musculus
aatatcacgaggacaaagataatgg

SEQ ID NO: 169027 - DNA, 25 bp, Mus musculus
aatatcagaagtttcagtctggaag

SEQ ID NO: 169028 - DNA, 25 bp, Mus musculus
aatatcagaggccacctatgaaaat

SEQ ID NO: 169029 - DNA, 25 bp, Mus musculus
aatatcatatctggccatcagacac

SEQ ID NO: 169030 - DNA, 25 bp, Mus musculus
aatatcatatctgtgtgaaaatagg

SEQ ID NO: 169031 - DNA, 25 bp, Mus musculus
aatatcatccagttgctgcttcaag

SEQ ID NO: 169032 - DNA, 25 bp, Mus musculus
aatatcatggtgcagtaccatgcac

SEQ ID NO: 169033 - DNA, 25 bp, Mus musculus
aatatcatgttgaagatggtaaaag

SEQ ID NO: 169034 - DNA, 25 bp, Mus musculus
aatatcatgttgaagctcatctacg

SEQ ID NO: 169035 - DNA, 25 bp, Mus musculus
aatatcattagcaacgctgttcctg

SEQ ID NO: 169036 - DNA, 25 bp, Mus musculus
aatatccacgctttctctgctgccc

SEQ ID NO: 169037 - DNA, 25 bp, Mus musculus
aatatccaggaaggctcagcaacaa

SEQ ID NO: 169038 - DNA, 25 bp, Mus musculus
aatatcccaacggagtcctcctttg

SEQ ID NO: 169039 - DNA, 25 bp, Mus musculus
aatatccccaggtactgtgcaggca

SEQ ID NO: 169040 - DNA, 25 bp, Mus musculus
aatatccgtcgaaaagcggcatctg

SEQ ID NO: 169041 - DNA, 25 bp, Mus musculus
aatatcgaacaaaagacgaggcgaa

SEQ ID NO: 169042 - DNA, 25 bp, Mus musculus
aatatcgaacctcacatgagccccc

SEQ ID NO: 169043 - DNA, 25 bp, Mus musculus
aatatcgacccgaagagtacagtcg

SEQ ID NO: 169044 - DNA, 25 bp, Mus musculus
aatatcgacccgaaggtcgttttga

SEQ ID NO: 169045 - DNA, 25 bp, Mus musculus
aatatcgacttcaggctgatctctt

SEQ ID NO: 169046 - DNA, 25 bp, Mus musculus
aatatctaaccagcagatagtctac

SEQ ID NO: 169047 - DNA, 25 bp, Mus musculus
aatatctatctgcatgtccagatca

SEQ ID NO: 169048 - DNA, 25 bp, Mus musculus
aatatctcaacaaggcacggcagct

SEQ ID NO: 169049 - DNA, 25 bp, Mus musculus
aatatctcaagtatgcgagaccacc

SEQ ID NO: 169050 - DNA, 25 bp, Mus musculus
aatatctcacccagacaggcttcta

SEQ ID NO: 169051 - DNA, 25 bp, Mus musculus
aatatctcggacgtgagggtcacac

SEQ ID NO: 169052 - DNA, 25 bp, Mus musculus
aatatctcggagcggtttcctctga

SEQ ID NO: 169053 - DNA, 25 bp, Mus musculus
aatatctgacctgtgctgagcctac

SEQ ID NO: 169054 - DNA, 25 bp, Mus musculus
aatatcttcagagactggaagtgat

SEQ ID NO: 169055 - DNA, 25 bp, Mus musculus
aatatcttcattaagatggatgtag

SEQ ID NO: 169056 - DNA, 25 bp, Mus musculus
aatatcttgaagcaggtggactccc

SEQ ID NO: 169057 - DNA, 25 bp, Mus musculus
aatatctttatatcttaaaagatgt

SEQ ID NO: 169058 - DNA, 25 bp, Mus musculus
aatatctttgggagacgctctgtct

SEQ ID NO: 169059 - DNA, 25 bp, Mus musculus
aatatctttggtctgtccgaatctc

SEQ ID NO: 169060 - DNA, 25 bp, Mus musculus
aatatgaacaggcatgtaatgaatt

SEQ ID NO: 169061 - DNA, 25 bp, Mus musculus
aatatgaactctcatccttattctt

SEQ ID NO: 169062 - DNA, 25 bp, Mus musculus
aatatgaagaagcacttttagatgg

SEQ ID NO: 169063 - DNA, 25 bp, Mus musculus
aatatgaagaggaggcgggccccgg

SEQ ID NO: 169064 - DNA, 25 bp, Mus musculus
aatatgaagccactctgatatctgc

SEQ ID NO: 169065 - DNA, 25 bp, Mus musculus
aatatgaagctttggttccagtgtc

SEQ ID NO: 169066 - DNA, 25 bp, Mus musculus
aatatgaaggagataacaggacgga

SEQ ID NO: 169067 - DNA, 25 bp, Mus musculus
aatatgaagtatggatggaagaatt

SEQ ID NO: 169068 - DNA, 25 bp, Mus musculus
aatatgaatatgtatgtgtttttca

SEQ ID NO: 169069 - DNA, 25 bp, Mus musculus
aatatgaatattagtgaacttattt

SEQ ID NO: 169070 - DNA, 25 bp, Mus musculus
aatatgaatattgctggcctataaa

SEQ ID NO: 169071 - DNA, 25 bp, Mus musculus
aatatgacaactgttggctggctct

SEQ ID NO: 169072 - DNA, 25 bp, Mus musculus
aatatgacatggagtggaagacatg

SEQ ID NO: 169073 - DNA, 25 bp, Mus musculus
aatatgactgaaacggcatggaccg

SEQ ID NO: 169074 - DNA, 25 bp, Mus musculus
aatatgactgcccgaagcctttccc

SEQ ID NO: 169075 - DNA, 25 bp, Mus musculus
aatatgaggagcaccagctagccac

SEQ ID NO: 169076 - DNA, 25 bp, Mus musculus
aatatgagtggaaggtggcccagat

SEQ ID NO: 169077 - DNA, 25 bp, Mus musculus
aatatgagtggaaggtgggattggt

SEQ ID NO: 169078 - DNA, 25 bp, Mus musculus
aatatgatgaccgagaggaagacat

SEQ ID NO: 169079 - DNA, 25 bp, Mus musculus
aatatgatgaggggttgccacatct

SEQ ID NO: 169080 - DNA, 25 bp, Mus musculus
aatatgcaagtggaggtgaagtatt

SEQ ID NO: 169081 - DNA, 25 bp, Mus musculus
aatatgcacgaaggatggcgagaca

SEQ ID NO: 169082 - DNA, 25 bp, Mus musculus
aatatgcagaaaatacaacctccaa

SEQ ID NO: 169083 - DNA, 25 bp, Mus musculus
aatatgcaggcttatgctttgatcc

SEQ ID NO: 169084 - DNA, 25 bp, Mus musculus
aatatgcccagcgagccagagcccc

SEQ ID NO: 169085 - DNA, 25 bp, Mus musculus
aatatgcccaggtgaagcctgacgg

SEQ ID NO: 169086 - DNA, 25 bp, Mus musculus
aatatgcccttgaaagcagaccgcg

SEQ ID NO: 169087 - DNA, 25 bp, Mus musculus
aatatgcctaaagggtatgtgtatt

SEQ ID NO: 169088 - DNA, 25 bp, Mus musculus
aatatgctgcagagcttcacttggt

SEQ ID NO: 169089 - DNA, 25 bp, Mus musculus
aatatgcttttaaggcagcccaccc

SEQ ID NO: 169090 - DNA, 25 bp, Mus musculus
aatatggattattgggcttgggtga

SEQ ID NO: 169091 - DNA, 25 bp, Mus musculus
aatatggttttgctgtacagagagg

SEQ ID NO: 169092 - DNA, 25 bp, Mus musculus
aatatgtcaacagaattccagaggt

SEQ ID NO: 169093 - DNA, 25 bp, Mus musculus
aatatgtcaacagcccagaaggctc

SEQ ID NO: 169094 - DNA, 25 bp, Mus musculus
aatatgtcaacaggacccacagtta

SEQ ID NO: 169095 - DNA, 25 bp, Mus musculus
aatatgtcagatttcaactattgca

SEQ ID NO: 169096 - DNA, 25 bp, Mus musculus
aatatgtggggatgatccttagtgt

SEQ ID NO: 169097 - DNA, 25 bp, Mus musculus
aatatgtggggtacgatctttgcgg

SEQ ID NO: 169098 - DNA, 25 bp, Mus musculus
aatatgttctcatccagagccttta

SEQ ID NO: 169099 - DNA, 25 bp, Mus musculus
aatattaaagagtccttcactcgtc

SEQ ID NO: 169100 - DNA, 25 bp, Mus musculus
aatattacatgggtcattcacatgt

SEQ ID NO: 169101 - DNA, 25 bp, Mus musculus
aatattaccctgatggaaactccca

SEQ ID NO: 169102 - DNA, 25 bp, Mus musculus
aatattaccctgatggtcataatga

SEQ ID NO: 169103 - DNA, 25 bp, Mus musculus
aatattagaggagtcgctaagattg

SEQ ID NO: 169104 - DNA, 25 bp, Mus musculus
aatattatccccatggagaaaatcc

SEQ ID NO: 169105 - DNA, 25 bp, Mus musculus
aatattatccccatgttagaattgc

SEQ ID NO: 169106 - DNA, 25 bp, Mus musculus
aatattcaaacaagttcaaagaaga

SEQ ID NO: 169107 - DNA, 25 bp, Mus musculus
aatattcaagacgccttgggatgtc

SEQ ID NO: 169108 - DNA, 25 bp, Mus musculus
aatattcacagaagaacactcaagg

SEQ ID NO: 169109 - DNA, 25 bp, Mus musculus
aatattcacagattatttatagcac

SEQ ID NO: 169110 - DNA, 25 bp, Mus musculus
aatattcacaggtattccttttttg

SEQ ID NO: 169111 - DNA, 25 bp, Mus musculus
aatattccaaaggatggaggccagt

SEQ ID NO: 169112 - DNA, 25 bp, Mus musculus
aatattccaagttcagtggtcacct

SEQ ID NO: 169113 - DNA, 25 bp, Mus musculus
aatattccaggaacattagaatgca

SEQ ID NO: 169114 - DNA, 25 bp, Mus musculus
aatattccataagatcatctttaga

SEQ ID NO: 169115 - DNA, 25 bp, Mus musculus
aatattcgaggagactcctgaggct

SEQ ID NO: 169116 - DNA, 25 bp, Mus musculus
aatattctaagatgctcctgccagc

SEQ ID NO: 169117 - DNA, 25 bp, Mus musculus
aatattctatgccagacttggaggt

SEQ ID NO: 169118 - DNA, 25 bp, Mus musculus
aatattctcccagagatcttcaaaa

SEQ ID NO: 169119 - DNA, 25 bp, Mus musculus
aatattctgtaacgtatgatggatc

SEQ ID NO: 169120 - DNA, 25 bp, Mus musculus
aatattctgtaacgtatgatggatt

SEQ ID NO: 169121 - DNA, 25 bp, Mus musculus
aatattgagcagattctcgactatc

SEQ ID NO: 169122 - DNA, 25 bp, Mus musculus
aatattgatgctgctgtccggcggt

SEQ ID NO: 169123 - DNA, 25 bp, Mus musculus
aatattgcatagggtaaatgagaaa

SEQ ID NO: 169124 - DNA, 25 bp, Mus musculus
aatattgccaggagttggcatccat

SEQ ID NO: 169125 - DNA, 25 bp, Mus musculus
aatattggcaacagacctgcctgga

SEQ ID NO: 169126 - DNA, 25 bp, Mus musculus
aatattggcaacagttggaacgcta

SEQ ID NO: 169127 - DNA, 25 bp, Mus musculus
aatattgtcaagatcgtaccgagaa

SEQ ID NO: 169128 - DNA, 25 bp, Mus musculus
aatattgtcgttggcttcctgcctg

SEQ ID NO: 169129 - DNA, 25 bp, Mus musculus
aatatttaaaaacatatgacatctg

SEQ ID NO: 169130 - DNA, 25 bp, Mus musculus
aatatttcagacaggattggtagct

SEQ ID NO: 169131 - DNA, 25 bp, Mus musculus
aatatttcagctaaactctgttcaa

SEQ ID NO: 169132 - DNA, 25 bp, Mus musculus
aatatttcaggtttcacagacattt

SEQ ID NO: 169133 - DNA, 25 bp, Mus musculus
aatatttcgtgcacagcaaaactct

SEQ ID NO: 169134 - DNA, 25 bp, Mus musculus
aatatttcgtgcacatttttgcagc

SEQ ID NO: 169135 - DNA, 25 bp, Mus musculus
aatatttctaatgcggcattccaaa

SEQ ID NO: 169136 - DNA, 25 bp, Mus musculus
aatatttggagccagacacttgtct

SEQ ID NO: 169137 - DNA, 25 bp, Mus musculus
aatatttgggaaaaggactagcgga

SEQ ID NO: 169138 - DNA, 25 bp, Mus musculus
aatatttgggaaaaggtgatgcctg

SEQ ID NO: 169139 - DNA, 25 bp, Mus musculus
aatattttatataattggcctacag

SEQ ID NO: 169140 - DNA, 25 bp, Mus musculus
aatattttcgagcattactgtatgg

SEQ ID NO: 169141 - DNA, 25 bp, Mus musculus
aatattttctcagcaagccccgccc

SEQ ID NO: 169142 - DNA, 25 bp, Mus musculus
aatattttgaggttccatctgtcct

SEQ ID NO: 169143 - DNA, 25 bp, Mus musculus
aatatttttgaaggttaatatcctt

SEQ ID NO: 169144 - DNA, 25 bp, Mus musculus
aatatttttgaagtatgcgagcatt

SEQ ID NO: 169145 - DNA, 25 bp, Mus musculus
aatcaaaaatcagataacaactatt

SEQ ID NO: 169146 - DNA, 25 bp, Mus musculus
aatcaaaaatcagataagaaacctg

SEQ ID NO: 169147 - DNA, 25 bp, Mus musculus
aatcaaaactactaaatggaaatga

SEQ ID NO: 169148 - DNA, 25 bp, Mus musculus
aatcaaaactagttggacacccccg

SEQ ID NO: 169149 - DNA, 25 bp, Mus musculus
aatcaaaagaatgctgtgtctgctt

SEQ ID NO: 169150 - DNA, 25 bp, Mus musculus
aatcaaaagggaagttgtccttgaa

SEQ ID NO: 169151 - DNA, 25 bp, Mus musculus
aatcaaacattatcagcagcgtcgc

SEQ ID NO: 169152 - DNA, 25 bp, Mus musculus
aatcaaaccaaaaggcatcatagct

SEQ ID NO: 169153 - DNA, 25 bp, Mus musculus
aatcaaaccacagctgcactggcgt

SEQ ID NO: 169154 - DNA, 25 bp, Mus musculus
aatcaaaccacagtgagaagtctgt

SEQ ID NO: 169155 - DNA, 25 bp, Mus musculus
aatcaaacctgcatgccatgatcaa

SEQ ID NO: 169156 - DNA, 25 bp, Mus musculus
aatcaaactacgaccccagcagcga

SEQ ID NO: 169157 - DNA, 25 bp, Mus musculus
aatcaaactcacaagagcaaagcca

SEQ ID NO: 169158 - DNA, 25 bp, Mus musculus
aatcaaactcacaaggtatcgaagt

SEQ ID NO: 169159 - DNA, 25 bp, Mus musculus
aatcaaagacagagttgactcctga

SEQ ID NO: 169160 - DNA, 25 bp, Mus musculus
aatcaaagagagaatccatggagct

SEQ ID NO: 169161 - DNA, 25 bp, Mus musculus
aatcaaagagatggatctgtccgtg

SEQ ID NO: 169162 - DNA, 25 bp, Mus musculus
aatcaaagaggatgtatatacaaat

SEQ ID NO: 169163 - DNA, 25 bp, Mus musculus
aatcaaagctctgaccattcccgga

SEQ ID NO: 169164 - DNA, 25 bp, Mus musculus
aatcaaagtgaaagttaatgaaatc

SEQ ID NO: 169165 - DNA, 25 bp, Mus musculus
aatcaaatccaccgccatctccctc

SEQ ID NO: 169166 - DNA, 25 bp, Mus musculus
aatcaaatggcagaggtcacttttg

SEQ ID NO: 169167 - DNA, 25 bp, Mus musculus
aatcaaatggcagtatatatgtttt

SEQ ID NO: 169168 - DNA, 25 bp, Mus musculus
aatcaaatgttacaggcatcaaaaa

SEQ ID NO: 169169 - DNA, 25 bp, Mus musculus
aatcaaatgttacaggtcatggaaa

SEQ ID NO: 169170 - DNA, 25 bp, Mus musculus
aatcaacaagaagttaattataccc

SEQ ID NO: 169171 - DNA, 25 bp, Mus musculus
aatcaacagagtatgtcaataggca

SEQ ID NO: 169172 - DNA, 25 bp, Mus musculus
aatcaaccaacagcctcctggactg

SEQ ID NO: 169173 - DNA, 25 bp, Mus musculus
aatcaaccaagctgctcttctcagc

SEQ ID NO: 169174 - DNA, 25 bp, Mus musculus
aatcaagaagaaggattccaaggaa

SEQ ID NO: 169175 - DNA, 25 bp, Mus musculus
aatcaagagaagcccgagttcgtga

SEQ ID NO: 169176 - DNA, 25 bp, Mus musculus
aatcaagagaagcgagccagagccc

SEQ ID NO: 169177 - DNA, 25 bp, Mus musculus
aatcaagagagcaagctcatcattc

SEQ ID NO: 169178 - DNA, 25 bp, Mus musculus
aatcaagcagaaaatgagtccactc

SEQ ID NO: 169179 - DNA, 25 bp, Mus musculus
aatcaagcaggagccatgcagtggt

SEQ ID NO: 169180 - DNA, 25 bp, Mus musculus
aatcaagccaaatctgaagtggaga

SEQ ID NO: 169181 - DNA, 25 bp, Mus musculus
aatcaagccaatccataggaatcca

SEQ ID NO: 169182 - DNA, 25 bp, Mus musculus
aatcaagcgcaaaggaaaatgactc

SEQ ID NO: 169183 - DNA, 25 bp, Mus musculus
aatcaagcgcaaagggcccacatgg

SEQ ID NO: 169184 - DNA, 25 bp, Mus musculus
aatcaaggagcttgtagtgaagaat

SEQ ID NO: 169185 - DNA, 25 bp, Mus musculus
aatcaaggccctcagattgacaagg

SEQ ID NO: 169186 - DNA, 25 bp, Mus musculus
aatcaaggtctggatattgaagtaa

SEQ ID NO: 169187 - DNA, 25 bp, Mus musculus
aatcaaggtctggtgagaagctgga

SEQ ID NO: 169188 - DNA, 25 bp, Mus musculus
aatcaatacctggagcacacatcca

SEQ ID NO: 169189 - DNA, 25 bp, Mus musculus
aatcaatacctggagtgtctggtcc

SEQ ID NO: 169190 - DNA, 25 bp, Mus musculus
aatcaatggcgtgatccaggaagcc

SEQ ID NO: 169191 - DNA, 25 bp, Mus musculus
aatcaattttcaggaatgggacggc

SEQ ID NO: 169192 - DNA, 25 bp, Mus musculus
aatcaattttcaggtaataccagaa

SEQ ID NO: 169193 - DNA, 25 bp, Mus musculus
aatcacaaaaatataattggccttt

SEQ ID NO: 169194 - DNA, 25 bp, Mus musculus
aatcacactattgggatggaagact

SEQ ID NO: 169195 - DNA, 25 bp, Mus musculus
aatcacactattggtcctgagttca

SEQ ID NO: 169196 - DNA, 25 bp, Mus musculus
aatcacagagaacacccagatcgac

SEQ ID NO: 169197 - DNA, 25 bp, Mus musculus
aatcacagatggaacaatgttgcaa

SEQ ID NO: 169198 - DNA, 25 bp, Mus musculus
aatcacagctctacctaggattcga

SEQ ID NO: 169199 - DNA, 25 bp, Mus musculus
aatcacatcaggtgacagagttagt

SEQ ID NO: 169200 - DNA, 25 bp, Mus musculus
aatcacatccgctgcgagcctgcgg

SEQ ID NO: 169201 - DNA, 25 bp, Mus musculus
aatcacatctcacagactgtggata

SEQ ID NO: 169202 - DNA, 25 bp, Mus musculus
aatcacatgatggagcctcaaggca

SEQ ID NO: 169203 - DNA, 25 bp, Mus musculus
aatcacatggatgaaaaaaaggacc

SEQ ID NO: 169204 - DNA, 25 bp, Mus musculus
aatcacatggatggtgttctcggga

SEQ ID NO: 169205 - DNA, 25 bp, Mus musculus
aatcacatgtatgtctctgcccttc

SEQ ID NO: 169206 - DNA, 25 bp, Mus musculus
aatcaccaaggtcacgtgaaactaa

SEQ ID NO: 169207 - DNA, 25 bp, Mus musculus
aatcaccacagtttcgttatcagca

SEQ ID NO: 169208 - DNA, 25 bp, Mus musculus
aatcaccaccaaaggggagcgagga

SEQ ID NO: 169209 - DNA, 25 bp, Mus musculus
aatcaccatttgcagaggcaggcag

SEQ ID NO: 169210 - DNA, 25 bp, Mus musculus
aatcaccccatcggtgtagcccgga

SEQ ID NO: 169211 - DNA, 25 bp, Mus musculus
aatcaccctcaggaggagaatgaaa

SEQ ID NO: 169212 - DNA, 25 bp, Mus musculus
aatcaccctcagtttgtgcttgtcc

SEQ ID NO: 169213 - DNA, 25 bp, Mus musculus
aatcaccgcactgattttggctctg

SEQ ID NO: 169214 - DNA, 25 bp, Mus musculus
aatcaccgcactgcttcaggacccc

SEQ ID NO: 169215 - DNA, 25 bp, Mus musculus
aatcaccggcgaggagtctgcaggt

SEQ ID NO: 169216 - DNA, 25 bp, Mus musculus
aatcacgacagcctgcctggccccc

SEQ ID NO: 169217 - DNA, 25 bp, Mus musculus
aatcacggaaggtgtctcagacata

SEQ ID NO: 169218 - DNA, 25 bp, Mus musculus
aatcacgtggagtgaactcagtgag

SEQ ID NO: 169219 - DNA, 25 bp, Mus musculus
aatcacgtggatggaatgaaacctt

SEQ ID NO: 169220 - DNA, 25 bp, Mus musculus
aatcactaagagggaccagtcttgg

SEQ ID NO: 169221 - DNA, 25 bp, Mus musculus
aatcactaataaagaagtgtgctgg

SEQ ID NO: 169222 - DNA, 25 bp, Mus musculus
aatcactccccagccgtgggaatgg

SEQ ID NO: 169223 - DNA, 25 bp, Mus musculus
aatcactccgacacctcctgcccct

SEQ ID NO: 169224 - DNA, 25 bp, Mus musculus
aatcactgaaaaatgtagttcctaa

SEQ ID NO: 169225 - DNA, 25 bp, Mus musculus
aatcactgacaagcaaggaaagact

SEQ ID NO: 169226 - DNA, 25 bp, Mus musculus
aatcactgcccatagaactagatca

SEQ ID NO: 169227 - DNA, 25 bp, Mus musculus
aatcactgcttgcccaagtgtgcct

SEQ ID NO: 169228 - DNA, 25 bp, Mus musculus
aatcactggctgagaacccttctgg

SEQ ID NO: 169229 - DNA, 25 bp, Mus musculus
aatcacttagcatgtgtgaactgtg

SEQ ID NO: 169230 - DNA, 25 bp, Mus musculus
aatcacttggggaaaggcgaagcta

SEQ ID NO: 169231 - DNA, 25 bp, Mus musculus
aatcacttttcctactttcactcta

SEQ ID NO: 169232 - DNA, 25 bp, Mus musculus
aatcagaaaaatttgctcaggaaac

SEQ ID NO: 169233 - DNA, 25 bp, Mus musculus
aatcagaaacagaagactctattct

SEQ ID NO: 169234 - DNA, 25 bp, Mus musculus
aatcagaaagggtccccagaagcac

SEQ ID NO: 169235 - DNA, 25 bp, Mus musculus
aatcagaatcacaaccagccagacc

SEQ ID NO: 169236 - DNA, 25 bp, Mus musculus
aatcagacaaaagattcgcctaaaa

SEQ ID NO: 169237 - DNA, 25 bp, Mus musculus
aatcagacaagaaccctaattcccc

SEQ ID NO: 169238 - DNA, 25 bp, Mus musculus
aatcagacaagctatggtatctccc

SEQ ID NO: 169239 - DNA, 25 bp, Mus musculus
aatcagacagatccgagacactaaa

SEQ ID NO: 169240 - DNA, 25 bp, Mus musculus
aatcagacaggaatctgcttgaata

SEQ ID NO: 169241 - DNA, 25 bp, Mus musculus
aatcagacaggtgatttgaactgtg

SEQ ID NO: 169242 - DNA, 25 bp, Mus musculus
aatcagacagtgatttcaatcagat

SEQ ID NO: 169243 - DNA, 25 bp, Mus musculus
aatcagacttcagatctgttgaaca

SEQ ID NO: 169244 - DNA, 25 bp, Mus musculus
aatcagagaaaggttctcaacgcct

SEQ ID NO: 169245 - DNA, 25 bp, Mus musculus
aatcagagaaaggtttaacatctca

SEQ ID NO: 169246 - DNA, 25 bp, Mus musculus
aatcagagagtgtcacgatgtctga

SEQ ID NO: 169247 - DNA, 25 bp, Mus musculus
aatcagagcagtgagcagtgggaga

SEQ ID NO: 169248 - DNA, 25 bp, Mus musculus
aatcagagcagtgaggataccgcta

SEQ ID NO: 169249 - DNA, 25 bp, Mus musculus
aatcagagtacagaggtccctcggt

SEQ ID NO: 169250 - DNA, 25 bp, Mus musculus
aatcagagtggtgtctcctttgaca

SEQ ID NO: 169251 - DNA, 25 bp, Mus musculus
aatcagagttgaaaccgacagagca

SEQ ID NO: 169252 - DNA, 25 bp, Mus musculus
aatcagatagtcttccccgctggca

SEQ ID NO: 169253 - DNA, 25 bp, Mus musculus
aatcagatcaggtggatgtgtgtac

SEQ ID NO: 169254 - DNA, 25 bp, Mus musculus
aatcagattctcagcttttaatata

SEQ ID NO: 169255 - DNA, 25 bp, Mus musculus
aatcagattctcaggtaagctctga

SEQ ID NO: 169256 - DNA, 25 bp, Mus musculus
aatcagcaagactacagatgctgga

SEQ ID NO: 169257 - DNA, 25 bp, Mus musculus
aatcagcaaggagctagctgagcca

SEQ ID NO: 169258 - DNA, 25 bp, Mus musculus
aatcagcaagtctacagatgctgga

SEQ ID NO: 169259 - DNA, 25 bp, Mus musculus
aatcagcacaacctcatattcagtg

SEQ ID NO: 169260 - DNA, 25 bp, Mus musculus
aatcagcacatcctcatattcagtg

SEQ ID NO: 169261 - DNA, 25 bp, Mus musculus
aatcagcagaaggaagagcggtcga

SEQ ID NO: 169262 - DNA, 25 bp, Mus musculus
aatcagcatagggatctgagaattg

SEQ ID NO: 169263 - DNA, 25 bp, Mus musculus
aatcagcatcagattccaaatctat

SEQ ID NO: 169264 - DNA, 25 bp, Mus musculus
aatcagcatcagtctggagcaaaag

SEQ ID NO: 169265 - DNA, 25 bp, Mus musculus
aatcagccaaggttactcctagaac

SEQ ID NO: 169266 - DNA, 25 bp, Mus musculus
aatcagcctgttgttgctcaccaag

SEQ ID NO: 169267 - DNA, 25 bp, Mus musculus
aatcagctacaagatgctgggtgcc

SEQ ID NO: 169268 - DNA, 25 bp, Mus musculus
aatcagctgaaggaactcagagaaa

SEQ ID NO: 169269 - DNA, 25 bp, Mus musculus
aatcagctgaagtgtgggagtatgg

SEQ ID NO: 169270 - DNA, 25 bp, Mus musculus
aatcaggatgatctcaaagccatta

SEQ ID NO: 169271 - DNA, 25 bp, Mus musculus
aatcaggatgtgtctctctccagtc

SEQ ID NO: 169272 - DNA, 25 bp, Mus musculus
aatcaggcgatatccgtaaagaact

SEQ ID NO: 169273 - DNA, 25 bp, Mus musculus
aatcaggtggatttgaaagaaactg

SEQ ID NO: 169274 - DNA, 25 bp, Mus musculus
aatcagtaattatggatgggatcag

SEQ ID NO: 169275 - DNA, 25 bp, Mus musculus
aatcagtctttaagtgccttcagtc

SEQ ID NO: 169276 - DNA, 25 bp, Mus musculus
aatcagtgagaccaagtaccgtaaa

SEQ ID NO: 169277 - DNA, 25 bp, Mus musculus
aatcagtgagcaagtacaaatctga

SEQ ID NO: 169278 - DNA, 25 bp, Mus musculus
aatcagtggggcggcccctgcccgg

SEQ ID NO: 169279 - DNA, 25 bp, Mus musculus
aatcagtgtaagctgctcttaacct

SEQ ID NO: 169280 - DNA, 25 bp, Mus musculus
aatcagttcaagtctgttatctcct

SEQ ID NO: 169281 - DNA, 25 bp, Mus musculus
aatcagttcttttaggaagctcaat

SEQ ID NO: 169282 - DNA, 25 bp, Mus musculus
aatcataacgctaacaggatgagat

SEQ ID NO: 169283 - DNA, 25 bp, Mus musculus
aatcataacgctaagtgtgatgaat

SEQ ID NO: 169284 - DNA, 25 bp, Mus musculus
aatcatagaggacattaaggacgcc

SEQ ID NO: 169285 - DNA, 25 bp, Mus musculus
aatcatatctttcaggtggtatagc

SEQ ID NO: 169286 - DNA, 25 bp, Mus musculus
aatcatcaccagaataagcctgcac

SEQ ID NO: 169287 - DNA, 25 bp, Mus musculus
aatcatcgaagtctttgtccaggag

SEQ ID NO: 169288 - DNA, 25 bp, Mus musculus
aatcatcgagaaacctgaaaaatga

SEQ ID NO: 169289 - DNA, 25 bp, Mus musculus
aatcatcgtttaacaatggaacata

SEQ ID NO: 169290 - DNA, 25 bp, Mus musculus
aatcatcttcttcagggtgatgcac

SEQ ID NO: 169291 - DNA, 25 bp, Mus musculus
aatcatgaaaaaactaaggagtttt

SEQ ID NO: 169292 - DNA, 25 bp, Mus musculus
aatcatgaaaaaacttttgcactcc

SEQ ID NO: 169293 - DNA, 25 bp, Mus musculus
aatcatgacagaacagccttgtctt

SEQ ID NO: 169294 - DNA, 25 bp, Mus musculus
aatcatgacaggcccattcttccgc

SEQ ID NO: 169295 - DNA, 25 bp, Mus musculus
aatcatgcaggaggatctgctggag

SEQ ID NO: 169296 - DNA, 25 bp, Mus musculus
aatcatgcagggtcccacctcctgg

SEQ ID NO: 169297 - DNA, 25 bp, Mus musculus
aatcatgctcggatcaagcaaatcg

SEQ ID NO: 169298 - DNA, 25 bp, Mus musculus
aatcatgctcggctatctgcacctg

SEQ ID NO: 169299 - DNA, 25 bp, Mus musculus
aatcatggggaaaagtgcgcaaact

SEQ ID NO: 169300 - DNA, 25 bp, Mus musculus
aatcatgtaccaaggagacaaaatt

SEQ ID NO: 169301 - DNA, 25 bp, Mus musculus
aatcatgtcacagcgtctgttgaca

SEQ ID NO: 169302 - DNA, 25 bp, Mus musculus
aatcatgtcacagggcagcaagttc

SEQ ID NO: 169303 - DNA, 25 bp, Mus musculus
aatcattacagacacacctgcaaag

SEQ ID NO: 169304 - DNA, 25 bp, Mus musculus
aatcattacaggtcctgagataaaa

SEQ ID NO: 169305 - DNA, 25 bp, Mus musculus
aatcattataaatgctacaataaaa

SEQ ID NO: 169306 - DNA, 25 bp, Mus musculus
aatcattattcgagcccccaagctc

SEQ ID NO: 169307 - DNA, 25 bp, Mus musculus
aatcattattcgagctatcttcaga

SEQ ID NO: 169308 - DNA, 25 bp, Mus musculus
aatcattattttagacacagaatgt

SEQ ID NO: 169309 - DNA, 25 bp, Mus musculus
aatcattcaggtctgtctatccctg

SEQ ID NO: 169310 - DNA, 25 bp, Mus musculus
aatcattcagtcttccgtgtctccc

SEQ ID NO: 169311 - DNA, 25 bp, Mus musculus
aatcattcccaagaatctgggtgtg

SEQ ID NO: 169312 - DNA, 25 bp, Mus musculus
aatcattcccaagacaagcagtaac

SEQ ID NO: 169313 - DNA, 25 bp, Mus musculus
aatcattcccaagcatccagcgtca

SEQ ID NO: 169314 - DNA, 25 bp, Mus musculus
aatcattcttgtgaatctcttggct

SEQ ID NO: 169315 - DNA, 25 bp, Mus musculus
aatcattctttctgagcagaagtga

SEQ ID NO: 169316 - DNA, 25 bp, Mus musculus
aatcattgacagattctttctaaag

SEQ ID NO: 169317 - DNA, 25 bp, Mus musculus
aatcattgacagtcctgatgcttcc

SEQ ID NO: 169318 - DNA, 25 bp, Mus musculus
aatcattgagaatgaaaagaagcag

SEQ ID NO: 169319 - DNA, 25 bp, Mus musculus
aatcattgatatgtcaactcagatg

SEQ ID NO: 169320 - DNA, 25 bp, Mus musculus
aatcatttcaagagtgagaagcgcc

SEQ ID NO: 169321 - DNA, 25 bp, Mus musculus
aatccaaaaggacacatgtatgatc

SEQ ID NO: 169322 - DNA, 25 bp, Mus musculus
aatccaaaaggatctggagactcac

SEQ ID NO: 169323 - DNA, 25 bp, Mus musculus
aatccaaaataccaccaagctcctc

SEQ ID NO: 169324 - DNA, 25 bp, Mus musculus
aatccaaaatcaggcaccccgtggc

SEQ ID NO: 169325 - DNA, 25 bp, Mus musculus
aatccaaaatcaggttgctggctct

SEQ ID NO: 169326 - DNA, 25 bp, Mus musculus
aatccaaacacagatccgagtggtg

SEQ ID NO: 169327 - DNA, 25 bp, Mus musculus
aatccaaacacagatggatgtagtg

SEQ ID NO: 169328 - DNA, 25 bp, Mus musculus
aatccaaactttatgatggttaatg

SEQ ID NO: 169329 - DNA, 25 bp, Mus musculus
aatccaacaccccgctgctgccttc

SEQ ID NO: 169330 - DNA, 25 bp, Mus musculus
aatccaacaccccgcttctcttgcc

SEQ ID NO: 169331 - DNA, 25 bp, Mus musculus
aatccaagacaaaagatttgcaaca

SEQ ID NO: 169332 - DNA, 25 bp, Mus musculus
aatccaagaggcggtggtggtgcat

SEQ ID NO: 169333 - DNA, 25 bp, Mus musculus
aatccaagccaagtgccctccaaga

SEQ ID NO: 169334 - DNA, 25 bp, Mus musculus
aatccaagtgggtattccatgtctg

SEQ ID NO: 169335 - DNA, 25 bp, Mus musculus
aatccaatcggaagggtcctaaaca

SEQ ID NO: 169336 - DNA, 25 bp, Mus musculus
aatccaatgaagccctcttattaca

SEQ ID NO: 169337 - DNA, 25 bp, Mus musculus
aatccaatgaaggaaaaggtgcggc

SEQ ID NO: 169338 - DNA, 25 bp, Mus musculus
aatccaattctataggtcctgaggg

SEQ ID NO: 169339 - DNA, 25 bp, Mus musculus
aatccacaacagtgagaggactttt

SEQ ID NO: 169340 - DNA, 25 bp, Mus musculus
aatccacaggcagtgaggaatggtg

SEQ ID NO: 169341 - DNA, 25 bp, Mus musculus
aatccaccacagataactctcttca

SEQ ID NO: 169342 - DNA, 25 bp, Mus musculus
aatccaccacaggaggaaaaagaaa

SEQ ID NO: 169343 - DNA, 25 bp, Mus musculus
aatccaccccaagaaaaagctccct

SEQ ID NO: 169344 - DNA, 25 bp, Mus musculus
aatccacccgagaagacagcatgaa

SEQ ID NO: 169345 - DNA, 25 bp, Mus musculus
aatccacccgagcactgtctatgga

SEQ ID NO: 169346 - DNA, 25 bp, Mus musculus
aatccaccgcggagatggatggcct

SEQ ID NO: 169347 - DNA, 25 bp, Mus musculus
aatccaccgcgggaccttctgtctc

SEQ ID NO: 169348 - DNA, 25 bp, Mus musculus
aatccacctgtgaggtttcaagtgc

SEQ ID NO: 169349 - DNA, 25 bp, Mus musculus
aatccacgttctagattggccgttt

SEQ ID NO: 169350 - DNA, 25 bp, Mus musculus
aatccacgttctaggctcctgtgct

SEQ ID NO: 169351 - DNA, 25 bp, Mus musculus
aatccactagactctggaactgtag

SEQ ID NO: 169352 - DNA, 25 bp, Mus musculus
aatccactaggagacttaatggagc

SEQ ID NO: 169353 - DNA, 25 bp, Mus musculus
aatccactttgtcaagtggattacc

SEQ ID NO: 169354 - DNA, 25 bp, Mus musculus
aatccagaaaatgtaaagcaattgt

SEQ ID NO: 169355 - DNA, 25 bp, Mus musculus
aatccagaagacattgatcagctca

SEQ ID NO: 169356 - DNA, 25 bp, Mus musculus
aatccagaattgattacaacaaccc

SEQ ID NO: 169357 - DNA, 25 bp, Mus musculus
aatccagacacgcagttacagacca

SEQ ID NO: 169358 - DNA, 25 bp, Mus musculus
aatccagacacgcattcctgggaga

SEQ ID NO: 169359 - DNA, 25 bp, Mus musculus
aatccagaggcagcaagaaaagcag

SEQ ID NO: 169360 - DNA, 25 bp, Mus musculus
aatccagaggcagttagccttacaa

SEQ ID NO: 169361 - DNA, 25 bp, Mus musculus
aatccagcaaacagatactctgtca

SEQ ID NO: 169362 - DNA, 25 bp, Mus musculus
aatccagcaaacagccaaagttgtt

SEQ ID NO: 169363 - DNA, 25 bp, Mus musculus
aatccagcagacccgagaagcccta

SEQ ID NO: 169364 - DNA, 25 bp, Mus musculus
aatccagcaggcatccagggcagaa

SEQ ID NO: 169365 - DNA, 25 bp, Mus musculus
aatccagcctgaaactgttattgga

SEQ ID NO: 169366 - DNA, 25 bp, Mus musculus
aatccagcctggctgacgttggggt

SEQ ID NO: 169367 - DNA, 25 bp, Mus musculus
aatccagcggctcctggaggagaat

SEQ ID NO: 169368 - DNA, 25 bp, Mus musculus
aatccagctcagttctgcgctcggg

SEQ ID NO: 169369 - DNA, 25 bp, Mus musculus
aatccaggttcccagtttagccagg

SEQ ID NO: 169370 - DNA, 25 bp, Mus musculus
aatccagtacaggtgaatatactgt

SEQ ID NO: 169371 - DNA, 25 bp, Mus musculus
aatccagtccacagccattcctgcg

SEQ ID NO: 169372 - DNA, 25 bp, Mus musculus
aatccataaagaggatggagatatt

SEQ ID NO: 169373 - DNA, 25 bp, Mus musculus
aatccatgagatcagggcactgaca

SEQ ID NO: 169374 - DNA, 25 bp, Mus musculus
aatccatggacatgatgttgacggc

SEQ ID NO: 169375 - DNA, 25 bp, Mus musculus
aatccatggacatgcacaatatcgc

SEQ ID NO: 169376 - DNA, 25 bp, Mus musculus
aatccattatgaaattgaagaccaa

SEQ ID NO: 169377 - DNA, 25 bp, Mus musculus
aatccattatgaagaaacagggaag

SEQ ID NO: 169378 - DNA, 25 bp, Mus musculus
aatcccaaaagatctagatccagag

SEQ ID NO: 169379 - DNA, 25 bp, Mus musculus
aatcccaagtagcatgctacaaatg

SEQ ID NO: 169380 - DNA, 25 bp, Mus musculus
aatcccaagttcaagggaatcaaag

SEQ ID NO: 169381 - DNA, 25 bp, Mus musculus
aatcccaatgacagttctgccccag

SEQ ID NO: 169382 - DNA, 25 bp, Mus musculus
aatcccacaggctctgttgtcatga

SEQ ID NO: 169383 - DNA, 25 bp, Mus musculus
aatcccaccaagctctctgctggaa

SEQ ID NO: 169384 - DNA, 25 bp, Mus musculus
aatcccactgatgacactttcatgg

SEQ ID NO: 169385 - DNA, 25 bp, Mus musculus
aatcccactgattttaggtgatggg

SEQ ID NO: 169386 - DNA, 25 bp, Mus musculus
aatcccactgtgcaaactctggcct

SEQ ID NO: 169387 - DNA, 25 bp, Mus musculus
aatcccatctgcttcgagagctgtg

SEQ ID NO: 169388 - DNA, 25 bp, Mus musculus
aatcccatgcagctcggggtctggt

SEQ ID NO: 169389 - DNA, 25 bp, Mus musculus
aatccccaaacccaggtctggaggt

SEQ ID NO: 169390 - DNA, 25 bp, Mus musculus
aatccccaagaccctgaagaagaaa

SEQ ID NO: 169391 - DNA, 25 bp, Mus musculus
aatccccaaggttcattctgtggtg

SEQ ID NO: 169392 - DNA, 25 bp, Mus musculus
aatccccaccaggacctgcaagcac

SEQ ID NO: 169393 - DNA, 25 bp, Mus musculus
aatccccagttcttagaccctgtat

SEQ ID NO: 169394 - DNA, 25 bp, Mus musculus
aatccccatgatgaatcagcagatg

SEQ ID NO: 169395 - DNA, 25 bp, Mus musculus
aatcccccaatgtgccttcaggatg

SEQ ID NO: 169396 - DNA, 25 bp, Mus musculus
aatcccgcaaggtcccgcacaccat

SEQ ID NO: 169397 - DNA, 25 bp, Mus musculus
aatcccggctgcagggtctgtcacc

SEQ ID NO: 169398 - DNA, 25 bp, Mus musculus
aatccctgagatcaaaaccatcctg

SEQ ID NO: 169399 - DNA, 25 bp, Mus musculus
aatccctgcacttgtggatggagac

SEQ ID NO: 169400 - DNA, 25 bp, Mus musculus
aatccctgcatagaggtagttccta

SEQ ID NO: 169401 - DNA, 25 bp, Mus musculus
aatccctgcatagaggtgtgaaatt

SEQ ID NO: 169402 - DNA, 25 bp, Mus musculus
aatccctgcctgaggagctgcagaa

SEQ ID NO: 169403 - DNA, 25 bp, Mus musculus
aatccctgctatgggcatattgtat

SEQ ID NO: 169404 - DNA, 25 bp, Mus musculus
aatcccttaccgcgtcgagcagaac

SEQ ID NO: 169405 - DNA, 25 bp, Mus musculus
aatcccttccagaagtcttgtgtga

SEQ ID NO: 169406 - DNA, 25 bp, Mus musculus
aatcccttccagaatgtcaagtgcc

SEQ ID NO: 169407 - DNA, 25 bp, Mus musculus
aatcccttccgggctgtggaaggat

SEQ ID NO: 169408 - DNA, 25 bp, Mus musculus
aatcccttctcctgagctacatatt

SEQ ID NO: 169409 - DNA, 25 bp, Mus musculus
aatccgagaggtcgaaggatctcat

SEQ ID NO: 169410 - DNA, 25 bp, Mus musculus
aatccgatggggagcctttactttc

SEQ ID NO: 169411 - DNA, 25 bp, Mus musculus
aatccgatggttttcagacaaattt

SEQ ID NO: 169412 - DNA, 25 bp, Mus musculus
aatccgcaatgccctggctttcctg

SEQ ID NO: 169413 - DNA, 25 bp, Mus musculus
aatccgcaatgcttctggaatttct

SEQ ID NO: 169414 - DNA, 25 bp, Mus musculus
aatccggcagagtgaccgtcttcta

SEQ ID NO: 169415 - DNA, 25 bp, Mus musculus
aatccgggagctttctccagaccag

SEQ ID NO: 169416 - DNA, 25 bp, Mus musculus
aatccggtcatgggagttagggaga

SEQ ID NO: 169417 - DNA, 25 bp, Mus musculus
aatccgttcaggctgacggctgagg

SEQ ID NO: 169418 - DNA, 25 bp, Mus musculus
aatcctaaagagactaagccccagt

SEQ ID NO: 169419 - DNA, 25 bp, Mus musculus
aatcctaaatctccacagttgacgg

SEQ ID NO: 169420 - DNA, 25 bp, Mus musculus
aatcctagagagcctttccacgtct

SEQ ID NO: 169421 - DNA, 25 bp, Mus musculus
aatcctagctggggatttgtataca

SEQ ID NO: 169422 - DNA, 25 bp, Mus musculus
aatcctatacccacctgtctctctc

SEQ ID NO: 169423 - DNA, 25 bp, Mus musculus
aatcctatcaagaggcaggaagcga

SEQ ID NO: 169424 - DNA, 25 bp, Mus musculus
aatcctatcaaggctcatcagcagg

SEQ ID NO: 169425 - DNA, 25 bp, Mus musculus
aatcctatcagggtgaaggaggtgt

SEQ ID NO: 169426 - DNA, 25 bp, Mus musculus
aatcctcacagccaacgaggtgaca

SEQ ID NO: 169427 - DNA, 25 bp, Mus musculus
aatcctccagccaggaatggcaaga

SEQ ID NO: 169428 - DNA, 25 bp, Mus musculus
aatcctccagccaggtgatgttctg

SEQ ID NO: 169429 - DNA, 25 bp, Mus musculus
aatcctccatgacgcctgacctgct

SEQ ID NO: 169430 - DNA, 25 bp, Mus musculus
aatcctcctccttgggcccattgac

SEQ ID NO: 169431 - DNA, 25 bp, Mus musculus
aatcctcctcgaatgataatctgga

SEQ ID NO: 169432 - DNA, 25 bp, Mus musculus
aatcctccttcagctgataatacta

SEQ ID NO: 169433 - DNA, 25 bp, Mus musculus
aatcctctacatgggtaaaaagcaa

SEQ ID NO: 169434 - DNA, 25 bp, Mus musculus
aatcctctagactttgagagttttg

SEQ ID NO: 169435 - DNA, 25 bp, Mus musculus
aatcctctagttttgacctgcctga

SEQ ID NO: 169436 - DNA, 25 bp, Mus musculus
aatcctctgtgaaggtcacagtaat

SEQ ID NO: 169437 - DNA, 25 bp, Mus musculus
aatcctcttggttcagacaatgaat

SEQ ID NO: 169438 - DNA, 25 bp, Mus musculus
aatcctgaaacaggtactacttgtc

SEQ ID NO: 169439 - DNA, 25 bp, Mus musculus
aatcctgaacaggatgctgccagcc

SEQ ID NO: 169440 - DNA, 25 bp, Mus musculus
aatcctgaagaagattaacttgagt

SEQ ID NO: 169441 - DNA, 25 bp, Mus musculus
aatcctgactgtctacagtgtctag

SEQ ID NO: 169442 - DNA, 25 bp, Mus musculus
aatcctgagcaggttgtggatgtgg

SEQ ID NO: 169443 - DNA, 25 bp, Mus musculus
aatcctgatggaaagaacagacaag

SEQ ID NO: 169444 - DNA, 25 bp, Mus musculus
aatcctgcaccaggaagagttgggc

SEQ ID NO: 169445 - DNA, 25 bp, Mus musculus
aatcctgcaggactacaaatctctc

SEQ ID NO: 169446 - DNA, 25 bp, Mus musculus
aatcctgcaggagccagcaggggtc

SEQ ID NO: 169447 - DNA, 25 bp, Mus musculus
aatcctggaatgaagggagaagcag

SEQ ID NO: 169448 - DNA, 25 bp, Mus musculus
aatcctggacagaaccagctcctga

SEQ ID NO: 169449 - DNA, 25 bp, Mus musculus
aatcctggagcgttcactgtgagcc

SEQ ID NO: 169450 - DNA, 25 bp, Mus musculus
aatcctggaggtcctagaagaccct

SEQ ID NO: 169451 - DNA, 25 bp, Mus musculus
aatcctggagttagcagcccaagtc

SEQ ID NO: 169452 - DNA, 25 bp, Mus musculus
aatcctggcaagaggagcactcacc

SEQ ID NO: 169453 - DNA, 25 bp, Mus musculus
aatcctgtcaggtgaaaatgctgat

SEQ ID NO: 169454 - DNA, 25 bp, Mus musculus
aatcctgtgaagatattgacgaatg

SEQ ID NO: 169455 - DNA, 25 bp, Mus musculus
aatcctgtgaagatgtggatgagtg

SEQ ID NO: 169456 - DNA, 25 bp, Mus musculus
aatcctgtgtctccaatcgtggatg

SEQ ID NO: 169457 - DNA, 25 bp, Mus musculus
aatcctgttttgatggaaggaccct

SEQ ID NO: 169458 - DNA, 25 bp, Mus musculus
aatccttaccacagaatccagattc

SEQ ID NO: 169459 - DNA, 25 bp, Mus musculus
aatccttaccacaggctccaagatt

SEQ ID NO: 169460 - DNA, 25 bp, Mus musculus
aatccttaccacaggtgctactttt

SEQ ID NO: 169461 - DNA, 25 bp, Mus musculus
aatccttacgatgctgatgacatcc

SEQ ID NO: 169462 - DNA, 25 bp, Mus musculus
aatccttacggcatttttctgtgca

SEQ ID NO: 169463 - DNA, 25 bp, Mus musculus
aatccttacgggaaggtgcacactt

SEQ ID NO: 169464 - DNA, 25 bp, Mus musculus
aatccttacggtgataaaattgcca

SEQ ID NO: 169465 - DNA, 25 bp, Mus musculus
aatccttcaccaatttatcaaaagt

SEQ ID NO: 169466 - DNA, 25 bp, Mus musculus
aatccttccgacccctacttcagca

SEQ ID NO: 169467 - DNA, 25 bp, Mus musculus
aatccttcctgaaacttcatggctc

SEQ ID NO: 169468 - DNA, 25 bp, Mus musculus
aatccttcctggaaggccggatggt

SEQ ID NO: 169469 - DNA, 25 bp, Mus musculus
aatccttctccagattatctgcaat

SEQ ID NO: 169470 - DNA, 25 bp, Mus musculus
aatccttgaaagccctctgggcgtg

SEQ ID NO: 169471 - DNA, 25 bp, Mus musculus
aatccttgagcatgatgttgccatc

SEQ ID NO: 169472 - DNA, 25 bp, Mus musculus
aatccttgagcatgcaccagccaca

SEQ ID NO: 169473 - DNA, 25 bp, Mus musculus
aatccttgcagtcagaaaatgggta

SEQ ID NO: 169474 - DNA, 25 bp, Mus musculus
aatccttgtgcttaggacgggttcc

SEQ ID NO: 169475 - DNA, 25 bp, Mus musculus
aatcctttagcagctactccatccg

SEQ ID NO: 169476 - DNA, 25 bp, Mus musculus
aatcctttttgtgttcttgggagtc

SEQ ID NO: 169477 - DNA, 25 bp, Mus musculus
aatcgaagcagaaaatgaacaggtt

SEQ ID NO: 169478 - DNA, 25 bp, Mus musculus
aatcgaagcccttggtccagaatag

SEQ ID NO: 169479 - DNA, 25 bp, Mus musculus
aatcgaaggcctggacatacgcacg

SEQ ID NO: 169480 - DNA, 25 bp, Mus musculus
aatcgacaccttggggcaacctatc

SEQ ID NO: 169481 - DNA, 25 bp, Mus musculus
aatcgagtacaggagttattcctga

SEQ ID NO: 169482 - DNA, 25 bp, Mus musculus
aatcgataaccagagccaacctttg

SEQ ID NO: 169483 - DNA, 25 bp, Mus musculus
aatcgataaccaggtgagaaaggca

SEQ ID NO: 169484 - DNA, 25 bp, Mus musculus
aatcgatatcaggttgatccccaaa

SEQ ID NO: 169485 - DNA, 25 bp, Mus musculus
aatcgatatctaatttttaagacaa

SEQ ID NO: 169486 - DNA, 25 bp, Mus musculus
aatcgatcgatcgagtcagtccgac

SEQ ID NO: 169487 - DNA, 25 bp, Mus musculus
aatcgattcaaggatcgcattgtat

SEQ ID NO: 169488 - DNA, 25 bp, Mus musculus
aatcgattccagcgtctcaaagggt

SEQ ID NO: 169489 - DNA, 25 bp, Mus musculus
aatcgattccagcgtttcatgaacc

SEQ ID NO: 169490 - DNA, 25 bp, Mus musculus
aatcgcaattggaaggatgcagggc

SEQ ID NO: 169491 - DNA, 25 bp, Mus musculus
aatcgcagaggagaactgcggcaca

SEQ ID NO: 169492 - DNA, 25 bp, Mus musculus
aatcgccacagagcctacagagtga

SEQ ID NO: 169493 - DNA, 25 bp, Mus musculus
aatcgccactgtgttcacacgagag

SEQ ID NO: 169494 - DNA, 25 bp, Mus musculus
aatcgccgagaggaaccaagatgac

SEQ ID NO: 169495 - DNA, 25 bp, Mus musculus
aatcgcgcgcgggggtgttccctca

SEQ ID NO: 169496 - DNA, 25 bp, Mus musculus
aatcgctcagtcctgcatctggcct

SEQ ID NO: 169497 - DNA, 25 bp, Mus musculus
aatcgctcagtgccacatatgtgca

SEQ ID NO: 169498 - DNA, 25 bp, Mus musculus
aatcggaaccagttccctcagccaa

SEQ ID NO: 169499 - DNA, 25 bp, Mus musculus
aatcggaagcctctgagtcgcttca

SEQ ID NO: 169500 - DNA, 25 bp, Mus musculus
aatcggaagcctctggaattggaaa

SEQ ID NO: 169501 - DNA, 25 bp, Mus musculus
aatcggacagggatgagaccggggc

SEQ ID NO: 169502 - DNA, 25 bp, Mus musculus
aatcggctgtcagagactatgaaat

SEQ ID NO: 169503 - DNA, 25 bp, Mus musculus
aatcggggcggtgtgaatgacagag

SEQ ID NO: 169504 - DNA, 25 bp, Mus musculus
aatcggggttgtcaggtatgagcat

SEQ ID NO: 169505 - DNA, 25 bp, Mus musculus
aatcgggttaaggttgaggagccct

SEQ ID NO: 169506 - DNA, 25 bp, Mus musculus
aatcgtcactgacaccaattctagg

SEQ ID NO: 169507 - DNA, 25 bp, Mus musculus
aatcgtcactgatgcccttcccggt

SEQ ID NO: 169508 - DNA, 25 bp, Mus musculus
aatcgtcactgatgtatgacctgcc

SEQ ID NO: 169509 - DNA, 25 bp, Mus musculus
aatcgtccccggacggagctgaaga

SEQ ID NO: 169510 - DNA, 25 bp, Mus musculus
aatcgtccttgaaagccctctgggc

SEQ ID NO: 169511 - DNA, 25 bp, Mus musculus
aatcgtgagtggtcctgtccaagaa

SEQ ID NO: 169512 - DNA, 25 bp, Mus musculus
aatcgtggcaaaaagtcagtccgac

SEQ ID NO: 169513 - DNA, 25 bp, Mus musculus
aatctaaactgacccccgtcagagg

SEQ ID NO: 169514 - DNA, 25 bp, Mus musculus
aatctaaactggatcgaagtaaaca

SEQ ID NO: 169515 - DNA, 25 bp, Mus musculus
aatctaaattctaagatgggatgtg

SEQ ID NO: 169516 - DNA, 25 bp, Mus musculus
aatctaacaattttcagcagtaccc

SEQ ID NO: 169517 - DNA, 25 bp, Mus musculus
aatctaagaaggctacaaggtgggg

SEQ ID NO: 169518 - DNA, 25 bp, Mus musculus
aatctaagccaggttgccatgaagt

SEQ ID NO: 169519 - DNA, 25 bp, Mus musculus
aatctacagggatgaatggatccag

SEQ ID NO: 169520 - DNA, 25 bp, Mus musculus
aatctacaggttatacaatggtcga

SEQ ID NO: 169521 - DNA, 25 bp, Mus musculus
aatctaccagaacaatctggaactt

SEQ ID NO: 169522 - DNA, 25 bp, Mus musculus
aatctaccagttgagaaatgtgatg

SEQ ID NO: 169523 - DNA, 25 bp, Mus musculus
aatctactgacagttgtccgtgtaa

SEQ ID NO: 169524 - DNA, 25 bp, Mus musculus
aatctactggcaaggtggtctactt

SEQ ID NO: 169525 - DNA, 25 bp, Mus musculus
aatctactggcaaggtggtctattt

SEQ ID NO: 169526 - DNA, 25 bp, Mus musculus
aatctagaaggtggtgacattcgtg

SEQ ID NO: 169527 - DNA, 25 bp, Mus musculus
aatctagaggtgaacgagattattg

SEQ ID NO: 169528 - DNA, 25 bp, Mus musculus
aatctaggagcccaccttgggacac

SEQ ID NO: 169529 - DNA, 25 bp, Mus musculus
aatctaggccctcagatcaatgatg

SEQ ID NO: 169530 - DNA, 25 bp, Mus musculus
aatctaggtatggtctgccggaagc

SEQ ID NO: 169531 - DNA, 25 bp, Mus musculus
aatctagttccgagtcccgctcacg

SEQ ID NO: 169532 - DNA, 25 bp, Mus musculus
aatctatataggcaaaggtgattta

SEQ ID NO: 169533 - DNA, 25 bp, Mus musculus
aatctatcaaaggtgatttcaatct

SEQ ID NO: 169534 - DNA, 25 bp, Mus musculus
aatctatcagggcgtctaagaagct

SEQ ID NO: 169535 - DNA, 25 bp, Mus musculus
aatctatcagggtgaaggcgggaag

SEQ ID NO: 169536 - DNA, 25 bp, Mus musculus
aatctatgaaagccctggtttggtc

SEQ ID NO: 169537 - DNA, 25 bp, Mus musculus
aatctatgaaatcagcaaccgctgg

SEQ ID NO: 169538 - DNA, 25 bp, Mus musculus
aatctatggagagagtgctgaggct

SEQ ID NO: 169539 - DNA, 25 bp, Mus musculus
aatctatgggcatgctagcaaaaaa

SEQ ID NO: 169540 - DNA, 25 bp, Mus musculus
aatctatgggcatggcatcgtcttc

SEQ ID NO: 169541 - DNA, 25 bp, Mus musculus
aatctatggggagacaccagaggca

SEQ ID NO: 169542 - DNA, 25 bp, Mus musculus
aatctattacaggtgaatacattgt

SEQ ID NO: 169543 - DNA, 25 bp, Mus musculus
aatctattaggcatcagaccatgat

SEQ ID NO: 169544 - DNA, 25 bp, Mus musculus
aatctattagggaaagagataccac

SEQ ID NO: 169545 - DNA, 25 bp, Mus musculus
aatctattattggtactggcggagg

SEQ ID NO: 169546 - DNA, 25 bp, Mus musculus
aatctattcagtattaatataaaca

SEQ ID NO: 169547 - DNA, 25 bp, Mus musculus
aatctattgcagagttacccctgga

SEQ ID NO: 169548 - DNA, 25 bp, Mus musculus
aatctattgcagcagtgtcagacac

SEQ ID NO: 169549 - DNA, 25 bp, Mus musculus
aatctcaaaaaggttactgcagggg

SEQ ID NO: 169550 - DNA, 25 bp, Mus musculus
aatctcaaacaaagcatcgctgata

SEQ ID NO: 169551 - DNA, 25 bp, Mus musculus
aatctcaaacaaagcatctatccag

SEQ ID NO: 169552 - DNA, 25 bp, Mus musculus
aatctcaacacctcacgaaggggca

SEQ ID NO: 169553 - DNA, 25 bp, Mus musculus
aatctcaacaggacaagaaaagaaa

SEQ ID NO: 169554 - DNA, 25 bp, Mus musculus
aatctcaacaggtttatttatttat

SEQ ID NO: 169555 - DNA, 25 bp, Mus musculus
aatctcaactccatggtcagcaaca

SEQ ID NO: 169556 - DNA, 25 bp, Mus musculus
aatctcaagaaaggatggatgatcc

SEQ ID NO: 169557 - DNA, 25 bp, Mus musculus
aatctcaagcaagttgataatgaag

SEQ ID NO: 169558 - DNA, 25 bp, Mus musculus
aatctcaagtcaaagaaatggcctc

SEQ ID NO: 169559 - DNA, 25 bp, Mus musculus
aatctcagaaaatggctcctcggtg

SEQ ID NO: 169560 - DNA, 25 bp, Mus musculus
aatctcagcaaaaagcctaagaaag

SEQ ID NO: 169561 - DNA, 25 bp, Mus musculus
aatctcagggttttggcaaggagct

SEQ ID NO: 169562 - DNA, 25 bp, Mus musculus
aatctcatggctatactgatcattt

SEQ ID NO: 169563 - DNA, 25 bp, Mus musculus
aatctcatgttgagtgacaaaagaa

SEQ ID NO: 169564 - DNA, 25 bp, Mus musculus
aatctccaacaacaaagaagcctga

SEQ ID NO: 169565 - DNA, 25 bp, Mus musculus
aatctcccaggaaacctcatcgtct

SEQ ID NO: 169566 - DNA, 25 bp, Mus musculus
aatctcccaggtagtcaatacccat

SEQ ID NO: 169567 - DNA, 25 bp, Mus musculus
aatctccctggcgagtgactcagac

SEQ ID NO: 169568 - DNA, 25 bp, Mus musculus
aatctcctggaaaactgggcccatt

SEQ ID NO: 169569 - DNA, 25 bp, Mus musculus
aatctcgcacaggacctaaagattg

SEQ ID NO: 169570 - DNA, 25 bp, Mus musculus
aatctctaaaactgaagcaccttca

SEQ ID NO: 169571 - DNA, 25 bp, Mus musculus
aatctctaaaacttctatcatcctg

SEQ ID NO: 169572 - DNA, 25 bp, Mus musculus
aatctctagctgaagtgagcaaacc

SEQ ID NO: 169573 - DNA, 25 bp, Mus musculus
aatctctcaaaggatcctgctggcc

SEQ ID NO: 169574 - DNA, 25 bp, Mus musculus
aatctctcaaaggatgacatttgca

SEQ ID NO: 169575 - DNA, 25 bp, Mus musculus
aatctctcaagacctcttctagaaa

SEQ ID NO: 169576 - DNA, 25 bp, Mus musculus
aatctctccagccaggctgcttctg

SEQ ID NO: 169577 - DNA, 25 bp, Mus musculus
aatctctccagccagtgaggatccc

SEQ ID NO: 169578 - DNA, 25 bp, Mus musculus
aatctctccagccatatctggcacc

SEQ ID NO: 169579 - DNA, 25 bp, Mus musculus
aatctctgaacctgttccagctacg

SEQ ID NO: 169580 - DNA, 25 bp, Mus musculus
aatctctgagcgtgccttcatcaag

SEQ ID NO: 169581 - DNA, 25 bp, Mus musculus
aatctcttagtgagaagccagtgga

SEQ ID NO: 169582 - DNA, 25 bp, Mus musculus
aatctcttagtgataacaaagatac

SEQ ID NO: 169583 - DNA, 25 bp, Mus musculus
aatctctttccgggtgaacagagag

SEQ ID NO: 169584 - DNA, 25 bp, Mus musculus
aatctgaaaatttggaggcagcacc

SEQ ID NO: 169585 - DNA, 25 bp, Mus musculus
aatctgaaagagttcttgcctctca

SEQ ID NO: 169586 - DNA, 25 bp, Mus musculus
aatctgaaaggtacccagaacttat

SEQ ID NO: 169587 - DNA, 25 bp, Mus musculus
aatctgaaggcctggttctgcataa

SEQ ID NO: 169588 - DNA, 25 bp, Mus musculus
aatctgaaggggagaaaactggtta

SEQ ID NO: 169589 - DNA, 25 bp, Mus musculus
aatctgaattcagaggaggtggctg

SEQ ID NO: 169590 - DNA, 25 bp, Mus musculus
aatctgactccacgtcgtggtcctg

SEQ ID NO: 169591 - DNA, 25 bp, Mus musculus
aatctgagagaggtgaaccaccaaa

SEQ ID NO: 169592 - DNA, 25 bp, Mus musculus
aatctgagctgccgaacaaaaaagg

SEQ ID NO: 169593 - DNA, 25 bp, Mus musculus
aatctgagttggcaggaagaaaatg

SEQ ID NO: 169594 - DNA, 25 bp, Mus musculus
aatctgagttggcagtcacaaactc

SEQ ID NO: 169595 - DNA, 25 bp, Mus musculus
aatctgataactgatttgaatagga

SEQ ID NO: 169596 - DNA, 25 bp, Mus musculus
aatctgataagtcctttgcaaacac

SEQ ID NO: 169597 - DNA, 25 bp, Mus musculus
aatctgatagggaaaacatcagaga

SEQ ID NO: 169598 - DNA, 25 bp, Mus musculus
aatctgatgaggttgtcttgaagga

SEQ ID NO: 169599 - DNA, 25 bp, Mus musculus
aatctgatggaggagtcttctatga

SEQ ID NO: 169600 - DNA, 25 bp, Mus musculus
aatctgattcctcagggcatcgtga

SEQ ID NO: 169601 - DNA, 25 bp, Mus musculus
aatctgcaagaaaaggaaggaactc

SEQ ID NO: 169602 - DNA, 25 bp, Mus musculus
aatctgcaagaaaaggactggacag

SEQ ID NO: 169603 - DNA, 25 bp, Mus musculus
aatctgcaagaaaaggctcatgtgt

SEQ ID NO: 169604 - DNA, 25 bp, Mus musculus
aatctgcaaggcaggtcttccatgt

SEQ ID NO: 169605 - DNA, 25 bp, Mus musculus
aatctgcacttcgtggggagcaggt

SEQ ID NO: 169606 - DNA, 25 bp, Mus musculus
aatctgcagcgagcctatagtttgg

SEQ ID NO: 169607 - DNA, 25 bp, Mus musculus
aatctgcagcgagtgcccttcgcat

SEQ ID NO: 169608 - DNA, 25 bp, Mus musculus
aatctgcagcgagtttggccaagga

SEQ ID NO: 169609 - DNA, 25 bp, Mus musculus
aatctgccaagagacaaacagaagt

SEQ ID NO: 169610 - DNA, 25 bp, Mus musculus
aatctgccaagtggtccagtgtgag

SEQ ID NO: 169611 - DNA, 25 bp, Mus musculus
aatctgctaagaaggattcatggtt

SEQ ID NO: 169612 - DNA, 25 bp, Mus musculus
aatctgctaagaagggtgctcactt

SEQ ID NO: 169613 - DNA, 25 bp, Mus musculus
aatctgctagcatagatattttgag

SEQ ID NO: 169614 - DNA, 25 bp, Mus musculus
aatctgctgacaattgcttctactt

SEQ ID NO: 169615 - DNA, 25 bp, Mus musculus
aatctgctgacgcttcgctgcgggg

SEQ ID NO: 169616 - DNA, 25 bp, Mus musculus
aatctgctgacggatagcggcggct

SEQ ID NO: 169617 - DNA, 25 bp, Mus musculus
aatctggagacactagacctgaact

SEQ ID NO: 169618 - DNA, 25 bp, Mus musculus
aatctggatggctatggtcaaggtc

SEQ ID NO: 169619 - DNA, 25 bp, Mus musculus
aatctggccaaacgaaagctgggct

SEQ ID NO: 169620 - DNA, 25 bp, Mus musculus
aatctggctgtagcagctgcaccac

SEQ ID NO: 169621 - DNA, 25 bp, Mus musculus
aatctggggaactctgataagatac

SEQ ID NO: 169622 - DNA, 25 bp, Mus musculus
aatctgggttagagatgagacctgc

SEQ ID NO: 169623 - DNA, 25 bp, Mus musculus
aatctggtaaagacgagatgctcca

SEQ ID NO: 169624 - DNA, 25 bp, Mus musculus
aatctgtaacggaaggtgcatctgc

SEQ ID NO: 169625 - DNA, 25 bp, Mus musculus
aatctgtcacagaaagaaagactgc

SEQ ID NO: 169626 - DNA, 25 bp, Mus musculus
aatctgtcagggccagagaacagcc

SEQ ID NO: 169627 - DNA, 25 bp, Mus musculus
aatctgtcagggggagatgactgcc

SEQ ID NO: 169628 - DNA, 25 bp, Mus musculus
aatctgtcaggtatacagatatgga

SEQ ID NO: 169629 - DNA, 25 bp, Mus musculus
aatctgtctaagaatctcctgtaaa

SEQ ID NO: 169630 - DNA, 25 bp, Mus musculus
aatctgtctgaaatactgatccaga

SEQ ID NO: 169631 - DNA, 25 bp, Mus musculus
aatctgtctgaaatgagcatctgta

SEQ ID NO: 169632 - DNA, 25 bp, Mus musculus
aatctgtctttcagggtggtaggaa

SEQ ID NO: 169633 - DNA, 25 bp, Mus musculus
aatctgtgaagatgtccagctcgcc

SEQ ID NO: 169634 - DNA, 25 bp, Mus musculus
aatctgtggctgaattacacagtcg

SEQ ID NO: 169635 - DNA, 25 bp, Mus musculus
aatctgttcaacagcactgttgcca

SEQ ID NO: 169636 - DNA, 25 bp, Mus musculus
aatctgttcaacagggaccaaatga

SEQ ID NO: 169637 - DNA, 25 bp, Mus musculus
aatcttaaaagaggtctggaagact

SEQ ID NO: 169638 - DNA, 25 bp, Mus musculus
aatcttaaagatgaggtcctgtaat

SEQ ID NO: 169639 - DNA, 25 bp, Mus musculus
aatcttaaagatggaggcgccgagg

SEQ ID NO: 169640 - DNA, 25 bp, Mus musculus
aatcttaaagatggcttgtccatgc

SEQ ID NO: 169641 - DNA, 25 bp, Mus musculus
aatcttaaagatgggggctgaggcg

SEQ ID NO: 169642 - DNA, 25 bp, Mus musculus
aatcttaaaggggcaagcggatctt

SEQ ID NO: 169643 - DNA, 25 bp, Mus musculus
aatcttaaataaaggtatggcctca

SEQ ID NO: 169644 - DNA, 25 bp, Mus musculus
aatcttaacaagggataactctctg

SEQ ID NO: 169645 - DNA, 25 bp, Mus musculus
aatcttaacaattcaggccaaacag

SEQ ID NO: 169646 - DNA, 25 bp, Mus musculus
aatcttaacagtgtcttggctgaac

SEQ ID NO: 169647 - DNA, 25 bp, Mus musculus
aatcttacaagaagtaaagcttagt

SEQ ID NO: 169648 - DNA, 25 bp, Mus musculus
aatcttacaagaatgcagaaggctg

SEQ ID NO: 169649 - DNA, 25 bp, Mus musculus
aatcttacaggaggccacatggtga

SEQ ID NO: 169650 - DNA, 25 bp, Mus musculus
aatcttatcagacaaagtaaatcag

SEQ ID NO: 169651 - DNA, 25 bp, Mus musculus
aatcttatgtcaaggcaccgagatg

SEQ ID NO: 169652 - DNA, 25 bp, Mus musculus
aatcttcagagccagatagacctct

SEQ ID NO: 169653 - DNA, 25 bp, Mus musculus
aatcttcagccaaagaaccccaaat

SEQ ID NO: 169654 - DNA, 25 bp, Mus musculus
aatcttcagccaaagcctattggtg

SEQ ID NO: 169655 - DNA, 25 bp, Mus musculus
aatcttcagccaaaggagccagtca

SEQ ID NO: 169656 - DNA, 25 bp, Mus musculus
aatcttcagccaaaggattgggaca

SEQ ID NO: 169657 - DNA, 25 bp, Mus musculus
aatcttcatcaagtcacagtaatga

SEQ ID NO: 169658 - DNA, 25 bp, Mus musculus
aatcttccatctggtcctgcatgtc

SEQ ID NO: 169659 - DNA, 25 bp, Mus musculus
aatcttccctggcacagaaacatca

SEQ ID NO: 169660 - DNA, 25 bp, Mus musculus
aatcttccttcctactagacgtgaa

SEQ ID NO: 169661 - DNA, 25 bp, Mus musculus
aatcttcgaggtgctggaaagacaa

SEQ ID NO: 169662 - DNA, 25 bp, Mus musculus
aatcttctaccccacataatatttc

SEQ ID NO: 169663 - DNA, 25 bp, Mus musculus
aatcttctaccccagataatatttc

SEQ ID NO: 169664 - DNA, 25 bp, Mus musculus
aatcttctcagatcatagcagaact

SEQ ID NO: 169665 - DNA, 25 bp, Mus musculus
aatcttctcagggacaggggcagac

SEQ ID NO: 169666 - DNA, 25 bp, Mus musculus
aatcttgacaagtggagagtacagt

SEQ ID NO: 169667 - DNA, 25 bp, Mus musculus
aatcttgcaggcctggagataaagt

SEQ ID NO: 169668 - DNA, 25 bp, Mus musculus
aatcttgcatctgaaagctgggtgt

SEQ ID NO: 169669 - DNA, 25 bp, Mus musculus
aatcttgcatgacaacctggactgt

SEQ ID NO: 169670 - DNA, 25 bp, Mus musculus
aatcttgccggtcctgttagcctga

SEQ ID NO: 169671 - DNA, 25 bp, Mus musculus
aatcttggctataaaaaatgccagg

SEQ ID NO: 169672 - DNA, 25 bp, Mus musculus
aatcttgggaagagacaaagacatc

SEQ ID NO: 169673 - DNA, 25 bp, Mus musculus
aatcttgtcaggaacctcagctgac

SEQ ID NO: 169674 - DNA, 25 bp, Mus musculus
aatcttgtcaggtgtgatgaatgca

SEQ ID NO: 169675 - DNA, 25 bp, Mus musculus
aatctttaaaatcgatcaaatggga

SEQ ID NO: 169676 - DNA, 25 bp, Mus musculus
aatctttaagctgggaggaagagac

SEQ ID NO: 169677 - DNA, 25 bp, Mus musculus
aatctttcaacgccaaccactctga

SEQ ID NO: 169678 - DNA, 25 bp, Mus musculus
aatctttcaaggaccctgattttaa

SEQ ID NO: 169679 - DNA, 25 bp, Mus musculus
aatctttcaaggtttgaccaaaagg

SEQ ID NO: 169680 - DNA, 25 bp, Mus musculus
aatctttctgggtcagaaacgtact

SEQ ID NO: 169681 - DNA, 25 bp, Mus musculus
aatctttgaggcctgcagcatgctg

SEQ ID NO: 169682 - DNA, 25 bp, Mus musculus
aatctttgagggaaccaatgagatt

SEQ ID NO: 169683 - DNA, 25 bp, Mus musculus
aatctttgagtgtgagaaactttac

SEQ ID NO: 169684 - DNA, 25 bp, Mus musculus
aatctttttaaggtacagcaaggga

SEQ ID NO: 169685 - DNA, 25 bp, Mus musculus
aatgaaaaaaggctctggaatggca

SEQ ID NO: 169686 - DNA, 25 bp, Mus musculus
aatgaaaaaggcccaagaggatgct

SEQ ID NO: 169687 - DNA, 25 bp, Mus musculus
aatgaaaaaggttaaggagctgaat

SEQ ID NO: 169688 - DNA, 25 bp, Mus musculus
aatgaaaaatatggaattgccatgt

SEQ ID NO: 169689 - DNA, 25 bp, Mus musculus
aatgaaaaatggaatgactgtacta

SEQ ID NO: 169690 - DNA, 25 bp, Mus musculus
aatgaaaacaggcccagaggaactg

SEQ ID NO: 169691 - DNA, 25 bp, Mus musculus
aatgaaaacagggcacctccgtctg

SEQ ID NO: 169692 - DNA, 25 bp, Mus musculus
aatgaaaacctggatctgatggaac

SEQ ID NO: 169693 - DNA, 25 bp, Mus musculus
aatgaaaacctgtattttgaggaat

SEQ ID NO: 169694 - DNA, 25 bp, Mus musculus
aatgaaaactgagggagatgagaca

SEQ ID NO: 169695 - DNA, 25 bp, Mus musculus
aatgaaaagtgcggggaagcgcttg

SEQ ID NO: 169696 - DNA, 25 bp, Mus musculus
aatgaaaatcaccagatggtctcag

SEQ ID NO: 169697 - DNA, 25 bp, Mus musculus
aatgaaaattattggattgcagtgc

SEQ ID NO: 169698 - DNA, 25 bp, Mus musculus
aatgaaaccacatccgtggtttttt

SEQ ID NO: 169699 - DNA, 25 bp, Mus musculus
aatgaaaccacatccgtttggaaat

SEQ ID NO: 169700 - DNA, 25 bp, Mus musculus
aatgaaagacagaaacaaactgttc

SEQ ID NO: 169701 - DNA, 25 bp, Mus musculus
aatgaaagacagggacatgaaacct

SEQ ID NO: 169702 - DNA, 25 bp, Mus musculus
aatgaaagctcaaaacattcaaggg

SEQ ID NO: 169703 - DNA, 25 bp, Mus musculus
aatgaaagctcaggactctcggctc

SEQ ID NO: 169704 - DNA, 25 bp, Mus musculus
aatgaaagctgacttaaaaacaaga

SEQ ID NO: 169705 - DNA, 25 bp, Mus musculus
aatgaaagtggatcagcatggagac

SEQ ID NO: 169706 - DNA, 25 bp, Mus musculus
aatgaaatagaagaggactccatat

SEQ ID NO: 169707 - DNA, 25 bp, Mus musculus
aatgaaatagaagaggccttctttc

SEQ ID NO: 169708 - DNA, 25 bp, Mus musculus
aatgaaatgaaaaaggcccaagagg

SEQ ID NO: 169709 - DNA, 25 bp, Mus musculus
aatgaaatgaaaaaggttaaggagc

SEQ ID NO: 169710 - DNA, 25 bp, Mus musculus
aatgaaatgatccaggtactgcagg

SEQ ID NO: 169711 - DNA, 25 bp, Mus musculus
aatgaaatggatataaccaagaact

SEQ ID NO: 169712 - DNA, 25 bp, Mus musculus
aatgaaatggcaaagtacccaggca

SEQ ID NO: 169713 - DNA, 25 bp, Mus musculus
aatgaaatggggattggtgtgtgct

SEQ ID NO: 169714 - DNA, 25 bp, Mus musculus
aatgaaatgtctggatgctaatgag

SEQ ID NO: 169715 - DNA, 25 bp, Mus musculus
aatgaaatgtgcagagccagtgttt

SEQ ID NO: 169716 - DNA, 25 bp, Mus musculus
aatgaaattggacaggtccttcatt

SEQ ID NO: 169717 - DNA, 25 bp, Mus musculus
aatgaacaggcaccacgccccactc

SEQ ID NO: 169718 - DNA, 25 bp, Mus musculus
aatgaaccagcggagttcaatgcga

SEQ ID NO: 169719 - DNA, 25 bp, Mus musculus
aatgaaccagcggagtttcagtctg

SEQ ID NO: 169720 - DNA, 25 bp, Mus musculus
aatgaaccgtgaggggaactggtat

SEQ ID NO: 169721 - DNA, 25 bp, Mus musculus
aatgaacggacaagaagtattttat

SEQ ID NO: 169722 - DNA, 25 bp, Mus musculus
aatgaacggacaagttgtgtgcgct

SEQ ID NO: 169723 - DNA, 25 bp, Mus musculus
aatgaactaaagcttgacaaaaaag

SEQ ID NO: 169724 - DNA, 25 bp, Mus musculus
aatgaactcactgtgaatgggaaca

SEQ ID NO: 169725 - DNA, 25 bp, Mus musculus
aatgaacttgggggactgcaggcca

SEQ ID NO: 169726 - DNA, 25 bp, Mus musculus
aatgaactttgaatgctcacactgc

SEQ ID NO: 169727 - DNA, 25 bp, Mus musculus
aatgaagaaagaacatgcataccag

SEQ ID NO: 169728 - DNA, 25 bp, Mus musculus
aatgaagaaagagctgtgcaactca

SEQ ID NO: 169729 - DNA, 25 bp, Mus musculus
aatgaagaagatgggcttaggtcat

SEQ ID NO: 169730 - DNA, 25 bp, Mus musculus
aatgaagaagcttctcttcaggagg

SEQ ID NO: 169731 - DNA, 25 bp, Mus musculus
aatgaagaaggaggtgaagattgac

SEQ ID NO: 169732 - DNA, 25 bp, Mus musculus
aatgaagaagtggaactatggacac

SEQ ID NO: 169733 - DNA, 25 bp, Mus musculus
aatgaagagaaagtacacactgcgc

SEQ ID NO: 169734 - DNA, 25 bp, Mus musculus
aatgaagatgaacagagcctcccaa

SEQ ID NO: 169735 - DNA, 25 bp, Mus musculus
aatgaagcaggtgaagatgacgatg

SEQ ID NO: 169736 - DNA, 25 bp, Mus musculus
aatgaagcaggtttagatgacgatg

SEQ ID NO: 169737 - DNA, 25 bp, Mus musculus
aatgaagccaagccctcccaggacg

SEQ ID NO: 169738 - DNA, 25 bp, Mus musculus
aatgaagccaagggcccagtgtgca

SEQ ID NO: 169739 - DNA, 25 bp, Mus musculus
aatgaagccatgtgcacagccctga

SEQ ID NO: 169740 - DNA, 25 bp, Mus musculus
aatgaagcctttcaggatgaagacc

SEQ ID NO: 169741 - DNA, 25 bp, Mus musculus
aatgaagcctttcaggtgcctctcc

SEQ ID NO: 169742 - DNA, 25 bp, Mus musculus
aatgaagctacgccaatcaaaaccc

SEQ ID NO: 169743 - DNA, 25 bp, Mus musculus
aatgaagctacgtcgacgcataatt

SEQ ID NO: 169744 - DNA, 25 bp, Mus musculus
aatgaagctctgatgcgctctgagg

SEQ ID NO: 169745 - DNA, 25 bp, Mus musculus
aatgaagctgaaggcatcatagaca

SEQ ID NO: 169746 - DNA, 25 bp, Mus musculus
aatgaaggaatggtcacgatctaga

SEQ ID NO: 169747 - DNA, 25 bp, Mus musculus
aatgaaggacatagtttcaggcacc

SEQ ID NO: 169748 - DNA, 25 bp, Mus musculus
aatgaaggagatgacaaatctagtg

SEQ ID NO: 169749 - DNA, 25 bp, Mus musculus
aatgaaggagctgaaaggcctaatg

SEQ ID NO: 169750 - DNA, 25 bp, Mus musculus
aatgaaggaggaatgtcaagtgaaa

SEQ ID NO: 169751 - DNA, 25 bp, Mus musculus
aatgaaggaggaattttattgagct

SEQ ID NO: 169752 - DNA, 25 bp, Mus musculus
aatgaaggaggcaagtcttctggct

SEQ ID NO: 169753 - DNA, 25 bp, Mus musculus
aatgaaggaggtgactccaatgaag

SEQ ID NO: 169754 - DNA, 25 bp, Mus musculus
aatgaaggcgtggcaacatacgcag

SEQ ID NO: 169755 - DNA, 25 bp, Mus musculus
aatgaaggctgaacttccactttgc

SEQ ID NO: 169756 - DNA, 25 bp, Mus musculus
aatgaaggttcatctctcccttctc

SEQ ID NO: 169757 - DNA, 25 bp, Mus musculus
aatgaagtaaaacaagatactcatt

SEQ ID NO: 169758 - DNA, 25 bp, Mus musculus
aatgaatacccctctataaaactgg

SEQ ID NO: 169759 - DNA, 25 bp, Mus musculus
aatgaatacccctctctggtggtgg

SEQ ID NO: 169760 - DNA, 25 bp, Mus musculus
aatgaatactcagcaatgtgggctg

SEQ ID NO: 169761 - DNA, 25 bp, Mus musculus
aatgaatactcaggatactgggaac

SEQ ID NO: 169762 - DNA, 25 bp, Mus musculus
aatgaatccttgcagtcagaaaatg

SEQ ID NO: 169763 - DNA, 25 bp, Mus musculus
aatgaatctgatcctggcctgtgtt

SEQ ID NO: 169764 - DNA, 25 bp, Mus musculus
aatgaatgaacttgggggactgcag

SEQ ID NO: 169765 - DNA, 25 bp, Mus musculus
aatgaatgcgggctttgaagactgc

SEQ ID NO: 169766 - DNA, 25 bp, Mus musculus
aatgaatggattggtatgtgtgcaa

SEQ ID NO: 169767 - DNA, 25 bp, Mus musculus
aatgaatgtcaagggaagttgagaa

SEQ ID NO: 169768 - DNA, 25 bp, Mus musculus
aatgaattcaaaagatagtgttttg

SEQ ID NO: 169769 - DNA, 25 bp, Mus musculus
aatgaattcaaaagctgccgttcgg

SEQ ID NO: 169770 - DNA, 25 bp, Mus musculus
aatgaatttcaaggggctgaggcga

SEQ ID NO: 169771 - DNA, 25 bp, Mus musculus
aatgaattttccaagctgatcatat

SEQ ID NO: 169772 - DNA, 25 bp, Mus musculus
aatgacaaagaattactgactttgg

SEQ ID NO: 169773 - DNA, 25 bp, Mus musculus
aatgacaatgaagaaaggaagtgga

SEQ ID NO: 169774 - DNA, 25 bp, Mus musculus
aatgacacagaggggctggctgtgg

SEQ ID NO: 169775 - DNA, 25 bp, Mus musculus
aatgacacagaggtggaggagagca

SEQ ID NO: 169776 - DNA, 25 bp, Mus musculus
aatgacacagaggtggcggagaaca

SEQ ID NO: 169777 - DNA, 25 bp, Mus musculus
aatgacacatgatgctatcatgaac

SEQ ID NO: 169778 - DNA, 25 bp, Mus musculus
aatgacacatgatggctatttgaaa

SEQ ID NO: 169779 - DNA, 25 bp, Mus musculus
aatgacactcagatcaaattgctta

SEQ ID NO: 169780 - DNA, 25 bp, Mus musculus
aatgacactgaggtcgcatcaaata

SEQ ID NO: 169781 - DNA, 25 bp, Mus musculus
aatgacagcataggtccctcactct

SEQ ID NO: 169782 - DNA, 25 bp, Mus musculus
aatgacagtgagaacacaaacctcc

SEQ ID NO: 169783 - DNA, 25 bp, Mus musculus
aatgacatcaggacccgggtcggtg

SEQ ID NO: 169784 - DNA, 25 bp, Mus musculus
aatgacatccaggacctcatgtggc

SEQ ID NO: 169785 - DNA, 25 bp, Mus musculus
aatgacatgtcaaggtcctgggtga

SEQ ID NO: 169786 - DNA, 25 bp, Mus musculus
aatgacattggtccctatggtgaac

SEQ ID NO: 169787 - DNA, 25 bp, Mus musculus
aatgacatttctgttggaggcctcc

SEQ ID NO: 169788 - DNA, 25 bp, Mus musculus
aatgaccaaacaggccatcgtgtat

SEQ ID NO: 169789 - DNA, 25 bp, Mus musculus
aatgaccaaacaggcgctgctaagt

SEQ ID NO: 169790 - DNA, 25 bp, Mus musculus
aatgaccaacagcaacatggccaat

SEQ ID NO: 169791 - DNA, 25 bp, Mus musculus
aatgaccaacagtttgaaggaagga

SEQ ID NO: 169792 - DNA, 25 bp, Mus musculus
aatgaccaagccttagggtcagcag

SEQ ID NO: 169793 - DNA, 25 bp, Mus musculus
aatgaccaaggaccctctgtcattt

SEQ ID NO: 169794 - DNA, 25 bp, Mus musculus
aatgaccaatatgagaaagtttggt

SEQ ID NO: 169795 - DNA, 25 bp, Mus musculus
aatgacccagacatgctgctcatcg

SEQ ID NO: 169796 - DNA, 25 bp, Mus musculus
aatgacccctatcctctctttgtga

SEQ ID NO: 169797 - DNA, 25 bp, Mus musculus
aatgacccgctgttcattccttgga

SEQ ID NO: 169798 - DNA, 25 bp, Mus musculus
aatgaccgaggtgaaggcagctaca

SEQ ID NO: 169799 - DNA, 25 bp, Mus musculus
aatgaccggcagggtgatgctgagt

SEQ ID NO: 169800 - DNA, 25 bp, Mus musculus
aatgaccgtaaagtgttcgtgggta

SEQ ID NO: 169801 - DNA, 25 bp, Mus musculus
aatgacctagctgagccctacaaag

SEQ ID NO: 169802 - DNA, 25 bp, Mus musculus
aatgacctaggaaggcccagccccc

SEQ ID NO: 169803 - DNA, 25 bp, Mus musculus
aatgacctcattacagtgtgactgc

SEQ ID NO: 169804 - DNA, 25 bp, Mus musculus
aatgacctgtatcagacacctctgc

SEQ ID NO: 169805 - DNA, 25 bp, Mus musculus
aatgacgcctgggtcctaaaggaaa

SEQ ID NO: 169806 - DNA, 25 bp, Mus musculus
aatgacgctgaggttttatataacc

SEQ ID NO: 169807 - DNA, 25 bp, Mus musculus
aatgacgctggtgaaatacaggacg

SEQ ID NO: 169808 - DNA, 25 bp, Mus musculus
aatgacggtgccccctacagccagc

SEQ ID NO: 169809 - DNA, 25 bp, Mus musculus
aatgactaagtacctacagtccaac

SEQ ID NO: 169810 - DNA, 25 bp, Mus musculus
aatgactaagttacagtgctagcaa

SEQ ID NO: 169811 - DNA, 25 bp, Mus musculus
aatgactacctgggaattaccagga

SEQ ID NO: 169812 - DNA, 25 bp, Mus musculus
aatgactacctgggacattcctgga

SEQ ID NO: 169813 - DNA, 25 bp, Mus musculus
aatgactactttaagggactgatgg

SEQ ID NO: 169814 - DNA, 25 bp, Mus musculus
aatgactctctgtggacgcaagcgc

SEQ ID NO: 169815 - DNA, 25 bp, Mus musculus
aatgactgaccgggagagggataaa

SEQ ID NO: 169816 - DNA, 25 bp, Mus musculus
aatgactgcaagattatttatgtgg

SEQ ID NO: 169817 - DNA, 25 bp, Mus musculus
aatgactgcacgcagaaagatgaca

SEQ ID NO: 169818 - DNA, 25 bp, Mus musculus
aatgactgggaaactactatagaaa

SEQ ID NO: 169819 - DNA, 25 bp, Mus musculus
aatgactggttaggaaacctgccat

SEQ ID NO: 169820 - DNA, 25 bp, Mus musculus
aatgacttcagagaatacctgtctc

SEQ ID NO: 169821 - DNA, 25 bp, Mus musculus
aatgacttcagctgctgacctcact

SEQ ID NO: 169822 - DNA, 25 bp, Mus musculus
aatgacttcgcactgaaaatcaaag

SEQ ID NO: 169823 - DNA, 25 bp, Mus musculus
aatgacttcggagatgataggagga

SEQ ID NO: 169824 - DNA, 25 bp, Mus musculus
aatgacttgggacaaaagaaagata

SEQ ID NO: 169825 - DNA, 25 bp, Mus musculus
aatgactttaagcaggtgctgctgg

SEQ ID NO: 169826 - DNA, 25 bp, Mus musculus
aatgactttaaggaggccacgcagt

SEQ ID NO: 169827 - DNA, 25 bp, Mus musculus
aatgactttgtaagaaactggtcaa

SEQ ID NO: 169828 - DNA, 25 bp, Mus musculus
aatgactttgtaaggtatctacttt

SEQ ID NO: 169829 - DNA, 25 bp, Mus musculus
aatgagaaaaaggattcagaatttc

SEQ ID NO: 169830 - DNA, 25 bp, Mus musculus
aatgagaaagaagggagcctagctg

SEQ ID NO: 169831 - DNA, 25 bp, Mus musculus
aatgagaaagaccttgtcctggccc

SEQ ID NO: 169832 - DNA, 25 bp, Mus musculus
aatgagaaagatatagcaggttctg

SEQ ID NO: 169833 - DNA, 25 bp, Mus musculus
aatgagaaagattctgaagcaagta

SEQ ID NO: 169834 - DNA, 25 bp, Mus musculus
aatgagaaataagaggtacccagac

SEQ ID NO: 169835 - DNA, 25 bp, Mus musculus
aatgagaaatacggtgaggccctgg

SEQ ID NO: 169836 - DNA, 25 bp, Mus musculus
aatgagaaatgttgtcagagaattc

SEQ ID NO: 169837 - DNA, 25 bp, Mus musculus
aatgagaagagaagacactaccact

SEQ ID NO: 169838 - DNA, 25 bp, Mus musculus
aatgagaagatgagctcagcagtca

SEQ ID NO: 169839 - DNA, 25 bp, Mus musculus
aatgagaagatgagtcgggatataa

SEQ ID NO: 169840 - DNA, 25 bp, Mus musculus
aatgagaaggagggggagctcaact

SEQ ID NO: 169841 - DNA, 25 bp, Mus musculus
aatgagaaggaggggttccccatca

SEQ ID NO: 169842 - DNA, 25 bp, Mus musculus
aatgagaatgattcccttcaggccc

SEQ ID NO: 169843 - DNA, 25 bp, Mus musculus
aatgagacaagagatgtgcttgtgt

SEQ ID NO: 169844 - DNA, 25 bp, Mus musculus
aatgagacagccaagcagcacgaac

SEQ ID NO: 169845 - DNA, 25 bp, Mus musculus
aatgagacaggacatgggtcagccc

SEQ ID NO: 169846 - DNA, 25 bp, Mus musculus
aatgagagaggacacaatgtaggaa

SEQ ID NO: 169847 - DNA, 25 bp, Mus musculus
aatgagagcaaggatttatatgaat

SEQ ID NO: 169848 - DNA, 25 bp, Mus musculus
aatgagagcaggtcaaggaggccat

SEQ ID NO: 169849 - DNA, 25 bp, Mus musculus
aatgagagcagtgggagccggtgaa

SEQ ID NO: 169850 - DNA, 25 bp, Mus musculus
aatgagagctcagccctagtcgagg

SEQ ID NO: 169851 - DNA, 25 bp, Mus musculus
aatgagatatttgtggtagtgtgaa

SEQ ID NO: 169852 - DNA, 25 bp, Mus musculus
aatgagatcaacctgccactgtcca

SEQ ID NO: 169853 - DNA, 25 bp, Mus musculus
aatgagatcccagcccccgaaactc

SEQ ID NO: 169854 - DNA, 25 bp, Mus musculus
aatgagatcccagctgagaaagcgc

SEQ ID NO: 169855 - DNA, 25 bp, Mus musculus
aatgagatcctcacattagcttttt

SEQ ID NO: 169856 - DNA, 25 bp, Mus musculus
aatgagatggagaggtgaggctgct

SEQ ID NO: 169857 - DNA, 25 bp, Mus musculus
aatgagattcctgagatgaccacag

SEQ ID NO: 169858 - DNA, 25 bp, Mus musculus
aatgagattctgaccaagtgttgta

SEQ ID NO: 169859 - DNA, 25 bp, Mus musculus
aatgagattctgacccatgcttctc

SEQ ID NO: 169860 - DNA, 25 bp, Mus musculus
aatgagatttcctgactgctctttt

SEQ ID NO: 169861 - DNA, 25 bp, Mus musculus
aatgagcaaagccaaacaccatgtc

SEQ ID NO: 169862 - DNA, 25 bp, Mus musculus
aatgagcaagcggcccttgattgtg

SEQ ID NO: 169863 - DNA, 25 bp, Mus musculus
aatgagcaagcggcttgttatgctg

SEQ ID NO: 169864 - DNA, 25 bp, Mus musculus
aatgagcaatctgtaaagaaaacgt

SEQ ID NO: 169865 - DNA, 25 bp, Mus musculus
aatgagcacaagactgacctaggtg

SEQ ID NO: 169866 - DNA, 25 bp, Mus musculus
aatgagcacaagagctgcgaggaga

SEQ ID NO: 169867 - DNA, 25 bp, Mus musculus
aatgagcagcaatggtaaatatgtg

SEQ ID NO: 169868 - DNA, 25 bp, Mus musculus
aatgagcagggttggtttttgctct

SEQ ID NO: 169869 - DNA, 25 bp, Mus musculus
aatgagcaggtttcagcggacgttc

SEQ ID NO: 169870 - DNA, 25 bp, Mus musculus
aatgagccaaggaccagagtgaggg

SEQ ID NO: 169871 - DNA, 25 bp, Mus musculus
aatgagcgactggtctgtgagtttc

SEQ ID NO: 169872 - DNA, 25 bp, Mus musculus
aatgagcgggagaaggctctgtcca

SEQ ID NO: 169873 - DNA, 25 bp, Mus musculus
aatgagctccaaggatgctctggag

SEQ ID NO: 169874 - DNA, 25 bp, Mus musculus
aatgagctgaacattatccacaagt

SEQ ID NO: 169875 - DNA, 25 bp, Mus musculus
aatgaggaagaaaaagagagagaga

SEQ ID NO: 169876 - DNA, 25 bp, Mus musculus
aatgaggaccagtgggcatgggtcc

SEQ ID NO: 169877 - DNA, 25 bp, Mus musculus
aatgaggccatgagagtcctcgttg

SEQ ID NO: 169878 - DNA, 25 bp, Mus musculus
aatgaggccggcgtcctccgccccc

SEQ ID NO: 169879 - DNA, 25 bp, Mus musculus
aatgaggctgctgcagagcctactg

SEQ ID NO: 169880 - DNA, 25 bp, Mus musculus
aatgagggctggagtggcaaaacct

SEQ ID NO: 169881 - DNA, 25 bp, Mus musculus
aatgaggggagccagattatcacaa

SEQ ID NO: 169882 - DNA, 25 bp, Mus musculus
aatgaggggcggccaggtccagcac

SEQ ID NO: 169883 - DNA, 25 bp, Mus musculus
aatgagggtagcaggagctgcaaag

SEQ ID NO: 169884 - DNA, 25 bp, Mus musculus
aatgaggtcaagagtgggccatgaa

SEQ ID NO: 169885 - DNA, 25 bp, Mus musculus
aatgagtaagtggcttgcagcgtgg

SEQ ID NO: 169886 - DNA, 25 bp, Mus musculus
aatgagtatcttgagttgaactaca

SEQ ID NO: 169887 - DNA, 25 bp, Mus musculus
aatgagtattttgatgttgccttca

SEQ ID NO: 169888 - DNA, 25 bp, Mus musculus
aatgagtattttggtataggcagag

SEQ ID NO: 169889 - DNA, 25 bp, Mus musculus
aatgagtccaaaggatcagactgaa

SEQ ID NO: 169890 - DNA, 25 bp, Mus musculus
aatgagtccaaagtttccattggga

SEQ ID NO: 169891 - DNA, 25 bp, Mus musculus
aatgagtcctttggcttcaccgctg

SEQ ID NO: 169892 - DNA, 25 bp, Mus musculus
aatgagttacatgtatgatttctgt

SEQ ID NO: 169893 - DNA, 25 bp, Mus musculus
aatgagtttgagatactaagcaacc

SEQ ID NO: 169894 - DNA, 25 bp, Mus musculus
aatgagtttgaggcgggatccacgg

SEQ ID NO: 169895 - DNA, 25 bp, Mus musculus
aatgataacagagcaacccgatagc

SEQ ID NO: 169896 - DNA, 25 bp, Mus musculus
aatgataacagagcatacaagcaat

SEQ ID NO: 169897 - DNA, 25 bp, Mus musculus
aatgataacagagtcaatccccttc

SEQ ID NO: 169898 - DNA, 25 bp, Mus musculus
aatgataagctgaatgatatggaac

SEQ ID NO: 169899 - DNA, 25 bp, Mus musculus
aatgataagctgggtaaaactccac

SEQ ID NO: 169900 - DNA, 25 bp, Mus musculus
aatgatactgtcggccagtgaagca

SEQ ID NO: 169901 - DNA, 25 bp, Mus musculus
aatgatattgacttagaaggttttg

SEQ ID NO: 169902 - DNA, 25 bp, Mus musculus
aatgatcagcacatgggagtggtca

SEQ ID NO: 169903 - DNA, 25 bp, Mus musculus
aatgatcagcacatgggctttccca

SEQ ID NO: 169904 - DNA, 25 bp, Mus musculus
aatgatccagaaagatcaagagcac

SEQ ID NO: 169905 - DNA, 25 bp, Mus musculus
aatgatccagattatatcagaattc

SEQ ID NO: 169906 - DNA, 25 bp, Mus musculus
aatgatccaggtactgcagggtgct

SEQ ID NO: 169907 - DNA, 25 bp, Mus musculus
aatgatctccaaggactcaggcagc

SEQ ID NO: 169908 - DNA, 25 bp, Mus musculus
aatgatctggagtgccccgagccta

SEQ ID NO: 169909 - DNA, 25 bp, Mus musculus
aatgatcttgaactcacagaaggaa

SEQ ID NO: 169910 - DNA, 25 bp, Mus musculus
aatgatgaaacagtcaaaacaattc

SEQ ID NO: 169911 - DNA, 25 bp, Mus musculus
aatgatgaaacagtgaaaaccataa

SEQ ID NO: 169912 - DNA, 25 bp, Mus musculus
aatgatgaaagcagccatgtactcg

SEQ ID NO: 169913 - DNA, 25 bp, Mus musculus
aatgatgaaagcagtggtccatgcc

SEQ ID NO: 169914 - DNA, 25 bp, Mus musculus
aatgatgaaaggcatccttacttcg

SEQ ID NO: 169915 - DNA, 25 bp, Mus musculus
aatgatgaagactctaaaatagagc

SEQ ID NO: 169916 - DNA, 25 bp, Mus musculus
aatgatgaagatgcagatagactgt

SEQ ID NO: 169917 - DNA, 25 bp, Mus musculus
aatgatgaaggaaagaagaaagaac

SEQ ID NO: 169918 - DNA, 25 bp, Mus musculus
aatgatgaatgacgaataggtgaag

SEQ ID NO: 169919 - DNA, 25 bp, Mus musculus
aatgatgaatggcaagtgactgtct

SEQ ID NO: 169920 - DNA, 25 bp, Mus musculus
aatgatgaatggcagtcactacagc

SEQ ID NO: 169921 - DNA, 25 bp, Mus musculus
aatgatgaccaggatctgacacaca

SEQ ID NO: 169922 - DNA, 25 bp, Mus musculus
aatgatgatagaatgttgctggtga

SEQ ID NO: 169923 - DNA, 25 bp, Mus musculus
aatgatgatgcagggccctggccac

SEQ ID NO: 169924 - DNA, 25 bp, Mus musculus
aatgatgcaattcgggaggctttgg

SEQ ID NO: 169925 - DNA, 25 bp, Mus musculus
aatgatgcagagtcctccccgtcag

SEQ ID NO: 169926 - DNA, 25 bp, Mus musculus
aatgatgcagtgcaggcaatacaga

SEQ ID NO: 169927 - DNA, 25 bp, Mus musculus
aatgatgcctatcctggcccgccca

SEQ ID NO: 169928 - DNA, 25 bp, Mus musculus
aatgatggcagagtgttcaacttct

SEQ ID NO: 169929 - DNA, 25 bp, Mus musculus
aatgatgggaagaaacctgatcagg

SEQ ID NO: 169930 - DNA, 25 bp, Mus musculus
aatgatgggaaggacaaaccagaga

SEQ ID NO: 169931 - DNA, 25 bp, Mus musculus
aatgatgttgatgccctgctggcag

SEQ ID NO: 169932 - DNA, 25 bp, Mus musculus
aatgatgtttacaagtatgagacca

SEQ ID NO: 169933 - DNA, 25 bp, Mus musculus
aatgattaaagtgaggaataagact

SEQ ID NO: 169934 - DNA, 25 bp, Mus musculus
aatgattaatgacaccaattctagg

SEQ ID NO: 169935 - DNA, 25 bp, Mus musculus
aatgattacaacatttcagaaggtt

SEQ ID NO: 169936 - DNA, 25 bp, Mus musculus
aatgattattgggtgtgcattatgt

SEQ ID NO: 169937 - DNA, 25 bp, Mus musculus
aatgattcagagacctgcttctggt

SEQ ID NO: 169938 - DNA, 25 bp, Mus musculus
aatgattcagatatcctgttagatt

SEQ ID NO: 169939 - DNA, 25 bp, Mus musculus
aatgattccactagggctattctcc

SEQ ID NO: 169940 - DNA, 25 bp, Mus musculus
aatgattccgatggagggacggctt

SEQ ID NO: 169941 - DNA, 25 bp, Mus musculus
aatgattggacagcctgccgggcct

SEQ ID NO: 169942 - DNA, 25 bp, Mus musculus
aatgattggacaggcatcaagattc

SEQ ID NO: 169943 - DNA, 25 bp, Mus musculus
aatgattggcaagcagtggtgacgt

SEQ ID NO: 169944 - DNA, 25 bp, Mus musculus
aatgattttaggttacagccaagct

SEQ ID NO: 169945 - DNA, 25 bp, Mus musculus
aatgcaaaacttgcagtaatgtgaa

SEQ ID NO: 169946 - DNA, 25 bp, Mus musculus
aatgcaaaagactaacctaacatgg

SEQ ID NO: 169947 - DNA, 25 bp, Mus musculus
aatgcaaaaggaccctgatagaact

SEQ ID NO: 169948 - DNA, 25 bp, Mus musculus
aatgcaaacaagggcaccctggagg

SEQ ID NO: 169949 - DNA, 25 bp, Mus musculus
aatgcaaataagtgaaaaggaagat

SEQ ID NO: 169950 - DNA, 25 bp, Mus musculus
aatgcaaatgggaacaactgtataa

SEQ ID NO: 169951 - DNA, 25 bp, Mus musculus
aatgcaagagagatgctgaggatgc

SEQ ID NO: 169952 - DNA, 25 bp, Mus musculus
aatgcaagtttgtcaatatacagta

SEQ ID NO: 169953 - DNA, 25 bp, Mus musculus
aatgcaattgtttacatgatagatg

SEQ ID NO: 169954 - DNA, 25 bp, Mus musculus
aatgcacatgtcagatactttggca

SEQ ID NO: 169955 - DNA, 25 bp, Mus musculus
aatgcacgactccgctctcactctt

SEQ ID NO: 169956 - DNA, 25 bp, Mus musculus
aatgcactagcaggtatggcggctc

SEQ ID NO: 169957 - DNA, 25 bp, Mus musculus
aatgcactagcagttgctcaaatgc

SEQ ID NO: 169958 - DNA, 25 bp, Mus musculus
aatgcagaaagcaggattcctctac

SEQ ID NO: 169959 - DNA, 25 bp, Mus musculus
aatgcagaaagcaggtcatccgggt

SEQ ID NO: 169960 - DNA, 25 bp, Mus musculus
aatgcagaatgcagagtacagttgt

SEQ ID NO: 169961 - DNA, 25 bp, Mus musculus
aatgcagaatgcaggtggaccctca

SEQ ID NO: 169962 - DNA, 25 bp, Mus musculus
aatgcagactcatggctgggctcta

SEQ ID NO: 169963 - DNA, 25 bp, Mus musculus
aatgcagagaccgctacatcagaag

SEQ ID NO: 169964 - DNA, 25 bp, Mus musculus
aatgcagagcaggtttgacatggct

SEQ ID NO: 169965 - DNA, 25 bp, Mus musculus
aatgcagagcttaagccaatccatg

SEQ ID NO: 169966 - DNA, 25 bp, Mus musculus
aatgcagatgggtggcaagacattg

SEQ ID NO: 169967 - DNA, 25 bp, Mus musculus
aatgcagcaaccaagctgtgattgg

SEQ ID NO: 169968 - DNA, 25 bp, Mus musculus
aatgcagcaaccaaggagacagtga

SEQ ID NO: 169969 - DNA, 25 bp, Mus musculus
aatgcagcagcttagagaagctgat

SEQ ID NO: 169970 - DNA, 25 bp, Mus musculus
aatgcagcagcttagggatacaagt

SEQ ID NO: 169971 - DNA, 25 bp, Mus musculus
aatgcagccagcgggtattccccta

SEQ ID NO: 169972 - DNA, 25 bp, Mus musculus
aatgcagccagggcctgtgtttgga

SEQ ID NO: 169973 - DNA, 25 bp, Mus musculus
aatgcagcccttttgatctcttggg

SEQ ID NO: 169974 - DNA, 25 bp, Mus musculus
aatgcagctaaagatgaacatgaaa

SEQ ID NO: 169975 - DNA, 25 bp, Mus musculus
aatgcaggactgtctccttagtgca

SEQ ID NO: 169976 - DNA, 25 bp, Mus musculus
aatgcaggagctacggaggaggcaa

SEQ ID NO: 169977 - DNA, 25 bp, Mus musculus
aatgcaggagctacggatagcgagg

SEQ ID NO: 169978 - DNA, 25 bp, Mus musculus
aatgcaggcccaagcctccattgag

SEQ ID NO: 169979 - DNA, 25 bp, Mus musculus
aatgcaggcccaaggtctccatggt

SEQ ID NO: 169980 - DNA, 25 bp, Mus musculus
aatgcaggctacgaatttaaagagg

SEQ ID NO: 169981 - DNA, 25 bp, Mus musculus
aatgcaggtgcaaagagctgaggac

SEQ ID NO: 169982 - DNA, 25 bp, Mus musculus
aatgcagtagaagccatgctggccc

SEQ ID NO: 169983 - DNA, 25 bp, Mus musculus
aatgcagtggctggcatgctacaaa

SEQ ID NO: 169984 - DNA, 25 bp, Mus musculus
aatgcagttatgcagaacttgtcac

SEQ ID NO: 169985 - DNA, 25 bp, Mus musculus
aatgcagttctcgttgtgaaaatgt

SEQ ID NO: 169986 - DNA, 25 bp, Mus musculus
aatgcataagttggttgatcgtgtt

SEQ ID NO: 169987 - DNA, 25 bp, Mus musculus
aatgcatcatttgaacaatgcccag

SEQ ID NO: 169988 - DNA, 25 bp, Mus musculus
aatgcatcatttgactgaggaccat

SEQ ID NO: 169989 - DNA, 25 bp, Mus musculus
aatgcatccacagagcttggctgaa

SEQ ID NO: 169990 - DNA, 25 bp, Mus musculus
aatgcatcccacagggtggtcatga

SEQ ID NO: 169991 - DNA, 25 bp, Mus musculus
aatgcatccgtatcaactcaacaag

SEQ ID NO: 169992 - DNA, 25 bp, Mus musculus
aatgcatccgtatcaagacatgttc

SEQ ID NO: 169993 - DNA, 25 bp, Mus musculus
aatgcatcctggcaggggacccagc

SEQ ID NO: 169994 - DNA, 25 bp, Mus musculus
aatgcatctgagccttctaggaaag

SEQ ID NO: 169995 - DNA, 25 bp, Mus musculus
aatgcattcagaggtggggtaagtg

SEQ ID NO: 169996 - DNA, 25 bp, Mus musculus
aatgcattcttcaagagtttatcca

SEQ ID NO: 169997 - DNA, 25 bp, Mus musculus
aatgcatttctacagaacctgcttt

SEQ ID NO: 169998 - DNA, 25 bp, Mus musculus
aatgccaaactccgtgtcgaccagc

SEQ ID NO: 169999 - DNA, 25 bp, Mus musculus
aatgccaaagccctgaatggcttca

SEQ ID NO: 170000 - DNA, 25 bp, Mus musculus
aatgccaacagcactatagttccct

SEQ ID NO: 170001 - DNA, 25 bp, Mus musculus
aatgccaacgtgagagtcattcaga

SEQ ID NO: 170002 - DNA, 25 bp, Mus musculus
aatgccaacgtgagggagcctgtat

SEQ ID NO: 170003 - DNA, 25 bp, Mus musculus
aatgccaagacgaagaatggataca

SEQ ID NO: 170004 - DNA, 25 bp, Mus musculus
aatgccaagtgccagaacaccaagc

SEQ ID NO: 170005 - DNA, 25 bp, Mus musculus
aatgccaatgcgactgcttttttcc

SEQ ID NO: 170006 - DNA, 25 bp, Mus musculus
aatgccacaactgatgccttaactt

SEQ ID NO: 170007 - DNA, 25 bp, Mus musculus
aatgccacgctgagcaccatcaatc

SEQ ID NO: 170008 - DNA, 25 bp, Mus musculus
aatgccactaaacctggaccctttc

SEQ ID NO: 170009 - DNA, 25 bp, Mus musculus
aatgccactgaggagctcctagtta

SEQ ID NO: 170010 - DNA, 25 bp, Mus musculus
aatgccactgagtgaagcgtctgcc

SEQ ID NO: 170011 - DNA, 25 bp, Mus musculus
aatgccagaggagtctaagtctcta

SEQ ID NO: 170012 - DNA, 25 bp, Mus musculus
aatgccagaggagtctaatgacttt

SEQ ID NO: 170013 - DNA, 25 bp, Mus musculus
aatgccagagtctgttataatgcca

SEQ ID NO: 170014 - DNA, 25 bp, Mus musculus
aatgccagcacccgccgccgctcct

SEQ ID NO: 170015 - DNA, 25 bp, Mus musculus
aatgccagtaacaggcacatccagg

SEQ ID NO: 170016 - DNA, 25 bp, Mus musculus
aatgccatcggccaggtttggccgt

SEQ ID NO: 170017 - DNA, 25 bp, Mus musculus
aatgccatcggccagtgggatctgg

SEQ ID NO: 170018 - DNA, 25 bp, Mus musculus
aatgccattattgctttcgaggacg

SEQ ID NO: 170019 - DNA, 25 bp, Mus musculus
aatgcccaatggcacccaggcccgt

SEQ ID NO: 170020 - DNA, 25 bp, Mus musculus
aatgcccaggaaagagcccaagatg

SEQ ID NO: 170021 - DNA, 25 bp, Mus musculus
aatgcccaggaaagtttctatgttg

SEQ ID NO: 170022 - DNA, 25 bp, Mus musculus
aatgcccaggcccaaatgtaccgtc

SEQ ID NO: 170023 - DNA, 25 bp, Mus musculus
aatgcccatgacaagctccaccgca

SEQ ID NO: 170024 - DNA, 25 bp, Mus musculus
aatgcccccaagagatcccgtttca

SEQ ID NO: 170025 - DNA, 25 bp, Mus musculus
aatgcccccaaggacttaaaagagg

SEQ ID NO: 170026 - DNA, 25 bp, Mus musculus
aatgccccgtaacaggaattatttt

SEQ ID NO: 170027 - DNA, 25 bp, Mus musculus
aatgcccctgttggaattcgacacc

SEQ ID NO: 170028 - DNA, 25 bp, Mus musculus
aatgcccgaaggagccgggtcaaac

SEQ ID NO: 170029 - DNA, 25 bp, Mus musculus
aatgcccgaaggtagagaaacctag

SEQ ID NO: 170030 - DNA, 25 bp, Mus musculus
aatgccctgcagggtttgtccgccc

SEQ ID NO: 170031 - DNA, 25 bp, Mus musculus
aatgcccttcgggagacaaatgtgc

SEQ ID NO: 170032 - DNA, 25 bp, Mus musculus
aatgcccttcgggagccatcaagag

SEQ ID NO: 170033 - DNA, 25 bp, Mus musculus
aatgccgatggagctgtcttgcagg

SEQ ID NO: 170034 - DNA, 25 bp, Mus musculus
aatgccggaagcagtagctaagatg

SEQ ID NO: 170035 - DNA, 25 bp, Mus musculus
aatgccgtggctgctccagtttctc

SEQ ID NO: 170036 - DNA, 25 bp, Mus musculus
aatgccgtggtgtggcttgacctaa

SEQ ID NO: 170037 - DNA, 25 bp, Mus musculus
aatgcctacagctcttaacctttac

SEQ ID NO: 170038 - DNA, 25 bp, Mus musculus
aatgcctacaggttcttcttcacat

SEQ ID NO: 170039 - DNA, 25 bp, Mus musculus
aatgcctagaagagtggttcttcga

SEQ ID NO: 170040 - DNA, 25 bp, Mus musculus
aatgcctagaaggggcaatgtcatc

SEQ ID NO: 170041 - DNA, 25 bp, Mus musculus
aatgcctcagcccagcgtaagcgga

SEQ ID NO: 170042 - DNA, 25 bp, Mus musculus
aatgcctcagcttcggtagccctaa

SEQ ID NO: 170043 - DNA, 25 bp, Mus musculus
aatgcctgcctgcaaatttcaggtg

SEQ ID NO: 170044 - DNA, 25 bp, Mus musculus
aatgccttccaaggaaacctctgcc

SEQ ID NO: 170045 - DNA, 25 bp, Mus musculus
aatgccttccaaggttgagagctgt

SEQ ID NO: 170046 - DNA, 25 bp, Mus musculus
aatgcctttctggagaaaaacaaaa

SEQ ID NO: 170047 - DNA, 25 bp, Mus musculus
aatgcgaacgacttcttcgccaagc

SEQ ID NO: 170048 - DNA, 25 bp, Mus musculus
aatgcgactggaagaactaaagaga

SEQ ID NO: 170049 - DNA, 25 bp, Mus musculus
aatgcgactggtggcaattaacaga

SEQ ID NO: 170050 - DNA, 25 bp, Mus musculus
aatgcgcacggtagcactcagcatg

SEQ ID NO: 170051 - DNA, 25 bp, Mus musculus
aatgcgcagagatggttggcctgct

SEQ ID NO: 170052 - DNA, 25 bp, Mus musculus
aatgcgccagttgatgaaggttgtc

SEQ ID NO: 170053 - DNA, 25 bp, Mus musculus
aatgcgcgctagaagatgttaaaga

SEQ ID NO: 170054 - DNA, 25 bp, Mus musculus
aatgcgcgctagaagctactcaggt

SEQ ID NO: 170055 - DNA, 25 bp, Mus musculus
aatgcggatatgtggccgatctgtc

SEQ ID NO: 170056 - DNA, 25 bp, Mus musculus
aatgcgggagaaggtttttcgttgg

SEQ ID NO: 170057 - DNA, 25 bp, Mus musculus
aatgcggttacgaagaagaggaaag

SEQ ID NO: 170058 - DNA, 25 bp, Mus musculus
aatgcggttagtcgagaactgatag

SEQ ID NO: 170059 - DNA, 25 bp, Mus musculus
aatgcgtacagaaaagcggcatctg

SEQ ID NO: 170060 - DNA, 25 bp, Mus musculus
aatgcgtacagccaggagtaggaac

SEQ ID NO: 170061 - DNA, 25 bp, Mus musculus
aatgcgtacagtagcatccgggcta

SEQ ID NO: 170062 - DNA, 25 bp, Mus musculus
aatgcgtcgagcagagtgtctacat

SEQ ID NO: 170063 - DNA, 25 bp, Mus musculus
aatgcgttcacagagtgcaaattca

SEQ ID NO: 170064 - DNA, 25 bp, Mus musculus
aatgctaacaagagtgaaattccac

SEQ ID NO: 170065 - DNA, 25 bp, Mus musculus
aatgctacaaagacatccttctacg

SEQ ID NO: 170066 - DNA, 25 bp, Mus musculus
aatgctacagagtggccaccctttg

SEQ ID NO: 170067 - DNA, 25 bp, Mus musculus
aatgctacgcaggggaaatcctggc

SEQ ID NO: 170068 - DNA, 25 bp, Mus musculus
aatgctatccagatgtacgtgccct

SEQ ID NO: 170069 - DNA, 25 bp, Mus musculus
aatgctatgatcaacgcctgtaggg

SEQ ID NO: 170070 - DNA, 25 bp, Mus musculus
aatgctatgtcagaaggcttatcag

SEQ ID NO: 170071 - DNA, 25 bp, Mus musculus
aatgctatgtcaggaaaccatccaa

SEQ ID NO: 170072 - DNA, 25 bp, Mus musculus
aatgctattgctcaggccctggcac

SEQ ID NO: 170073 - DNA, 25 bp, Mus musculus
aatgctattggcttctcccatgatg

SEQ ID NO: 170074 - DNA, 25 bp, Mus musculus
aatgctcccgctaagtcgtcagcgc

SEQ ID NO: 170075 - DNA, 25 bp, Mus musculus
aatgctcccgctagtgttgcagagg

SEQ ID NO: 170076 - DNA, 25 bp, Mus musculus
aatgctctccctctagagtgcagag

SEQ ID NO: 170077 - DNA, 25 bp, Mus musculus
aatgctgaaaagaatgatggaaact

SEQ ID NO: 170078 - DNA, 25 bp, Mus musculus
aatgctgaaaagttgccagtagtta

SEQ ID NO: 170079 - DNA, 25 bp, Mus musculus
aatgctgaagaaagcgaaatccgtt

SEQ ID NO: 170080 - DNA, 25 bp, Mus musculus
aatgctgaaggacgcattcagctta

SEQ ID NO: 170081 - DNA, 25 bp, Mus musculus
aatgctgactggaaagcactctcca

SEQ ID NO: 170082 - DNA, 25 bp, Mus musculus
aatgctgagaaacaggtggaagagc

SEQ ID NO: 170083 - DNA, 25 bp, Mus musculus
aatgctgagagttgaaaaacatgtg

SEQ ID NO: 170084 - DNA, 25 bp, Mus musculus
aatgctgatcaaccattgcagacct

SEQ ID NO: 170085 - DNA, 25 bp, Mus musculus
aatgctgatcaagcaccacacagtc

SEQ ID NO: 170086 - DNA, 25 bp, Mus musculus
aatgctgcaagcaccttctagcacc

SEQ ID NO: 170087 - DNA, 25 bp, Mus musculus
aatgctgcaagtatagaacattgca

SEQ ID NO: 170088 - DNA, 25 bp, Mus musculus
aatgctgccctattcctcagggtct

SEQ ID NO: 170089 - DNA, 25 bp, Mus musculus
aatgctgccgtttggtggtgaagca

SEQ ID NO: 170090 - DNA, 25 bp, Mus musculus
aatgctgctgacatgttctactggg

SEQ ID NO: 170091 - DNA, 25 bp, Mus musculus
aatgctggcagaaggagctaactgc

SEQ ID NO: 170092 - DNA, 25 bp, Mus musculus
aatgctgtaggcaccagacctgttg

SEQ ID NO: 170093 - DNA, 25 bp, Mus musculus
aatgctgtgagtgctccgtggcctc

SEQ ID NO: 170094 - DNA, 25 bp, Mus musculus
aatgctgtggtgacgctagagaact

SEQ ID NO: 170095 - DNA, 25 bp, Mus musculus
aatgcttataagggtccgtcgtaac

SEQ ID NO: 170096 - DNA, 25 bp, Mus musculus
aatgcttatctagggtggaagaaag

SEQ ID NO: 170097 - DNA, 25 bp, Mus musculus
aatgcttatgaggaagaattctttc

SEQ ID NO: 170098 - DNA, 25 bp, Mus musculus
aatgcttcagggccgcctttttgcc

SEQ ID NO: 170099 - DNA, 25 bp, Mus musculus
aatgcttccagagtcttgtgatatg

SEQ ID NO: 170100 - DNA, 25 bp, Mus musculus
aatgcttcctatcgacatcccaggc

SEQ ID NO: 170101 - DNA, 25 bp, Mus musculus
aatgcttcctatcggcctttcagac

SEQ ID NO: 170102 - DNA, 25 bp, Mus musculus
aatgcttctgattcttataaacagc

SEQ ID NO: 170103 - DNA, 25 bp, Mus musculus
aatgcttctggtgaccttggggaag

SEQ ID NO: 170104 - DNA, 25 bp, Mus musculus
aatgcttgccccgagtctccatctt

SEQ ID NO: 170105 - DNA, 25 bp, Mus musculus
aatgcttgggtaagcagtggattct

SEQ ID NO: 170106 - DNA, 25 bp, Mus musculus
aatgcttgttaaggctgctgaaaaa

SEQ ID NO: 170107 - DNA, 25 bp, Mus musculus
aatgctttcagccccagccgttcag

SEQ ID NO: 170108 - DNA, 25 bp, Mus musculus
aatgctttcatcggctcggatgtgg

SEQ ID NO: 170109 - DNA, 25 bp, Mus musculus
aatgctttccaggattcacagaaat

SEQ ID NO: 170110 - DNA, 25 bp, Mus musculus
aatgctttccgcaaggccctttatg

SEQ ID NO: 170111 - DNA, 25 bp, Mus musculus
aatggaaaaacagctctcctctcaa

SEQ ID NO: 170112 - DNA, 25 bp, Mus musculus
aatggaaaaagcaggtttctggacg

SEQ ID NO: 170113 - DNA, 25 bp, Mus musculus
aatggaaaaaggtgttcgaatttgc

SEQ ID NO: 170114 - DNA, 25 bp, Mus musculus
aatggaaaacacagtttggcttgtg

SEQ ID NO: 170115 - DNA, 25 bp, Mus musculus
aatggaaacacccagagcctctcgg

SEQ ID NO: 170116 - DNA, 25 bp, Mus musculus
aatggaaactgagcacattaatcca

SEQ ID NO: 170117 - DNA, 25 bp, Mus musculus
aatggaaactgagcaccaaacaaca

SEQ ID NO: 170118 - DNA, 25 bp, Mus musculus
aatggaaactgagcaccaagcttac

SEQ ID NO: 170119 - DNA, 25 bp, Mus musculus
aatggaaactgagcagcagaataaa

SEQ ID NO: 170120 - DNA, 25 bp, Mus musculus
aatggaaactgagcattttgctctg

SEQ ID NO: 170121 - DNA, 25 bp, Mus musculus
aatggaaataatgctcttcatcttg

SEQ ID NO: 170122 - DNA, 25 bp, Mus musculus
aatggaaatgaggaggctgctcagt

SEQ ID NO: 170123 - DNA, 25 bp, Mus musculus
aatggaacaaggacctctgcttgct

SEQ ID NO: 170124 - DNA, 25 bp, Mus musculus
aatggaacaagtacaaccctcagcc

SEQ ID NO: 170125 - DNA, 25 bp, Mus musculus
aatggaacagatggcagtgaaaatg

SEQ ID NO: 170126 - DNA, 25 bp, Mus musculus
aatggaaccatcagcctgctgattt

SEQ ID NO: 170127 - DNA, 25 bp, Mus musculus
aatggaaccatcaggctgctgattt

SEQ ID NO: 170128 - DNA, 25 bp, Mus musculus
aatggaactagtaacaaggacgagg

SEQ ID NO: 170129 - DNA, 25 bp, Mus musculus
aatggaagaaggtatcaactggcag

SEQ ID NO: 170130 - DNA, 25 bp, Mus musculus
aatggaagagctggatgccttattg

SEQ ID NO: 170131 - DNA, 25 bp, Mus musculus
aatggaagcagaaaattgtgcaagc

SEQ ID NO: 170132 - DNA, 25 bp, Mus musculus
aatggaagcagatcctgcctctcag

SEQ ID NO: 170133 - DNA, 25 bp, Mus musculus
aatggaagccagaaataggaccaag

SEQ ID NO: 170134 - DNA, 25 bp, Mus musculus
aatggaagcccagctcacaggaagg

SEQ ID NO: 170135 - DNA, 25 bp, Mus musculus
aatggaagcccttaccagcccagct

SEQ ID NO: 170136 - DNA, 25 bp, Mus musculus
aatggaatcctctggcaagcgcgcc

SEQ ID NO: 170137 - DNA, 25 bp, Mus musculus
aatggaatgggcattatatttagta

SEQ ID NO: 170138 - DNA, 25 bp, Mus musculus
aatggaatgggccttgcatttagta

SEQ ID NO: 170139 - DNA, 25 bp, Mus musculus
aatggacagaaagaatgtcactgct

SEQ ID NO: 170140 - DNA, 25 bp, Mus musculus
aatggacagatgtccactcccgaga

SEQ ID NO: 170141 - DNA, 25 bp, Mus musculus
aatggacagggtaaagaaggaatgg

SEQ ID NO: 170142 - DNA, 25 bp, Mus musculus
aatggacagtgccagctgaggatgg

SEQ ID NO: 170143 - DNA, 25 bp, Mus musculus
aatggaccagctagtggaaccctgg

SEQ ID NO: 170144 - DNA, 25 bp, Mus musculus
aatggacccacatgaaaaatgtgtc

SEQ ID NO: 170145 - DNA, 25 bp, Mus musculus
aatggacgttcagagttactacctg

SEQ ID NO: 170146 - DNA, 25 bp, Mus musculus
aatggactaaacctctgaaactgta

SEQ ID NO: 170147 - DNA, 25 bp, Mus musculus
aatggacttcaggcaatccaaaagt

SEQ ID NO: 170148 - DNA, 25 bp, Mus musculus
aatggactttgaagcatttttcagc

SEQ ID NO: 170149 - DNA, 25 bp, Mus musculus
aatggactttttgatcgatgatgaa

SEQ ID NO: 170150 - DNA, 25 bp, Mus musculus
aatggagaaaaagtaaatataatca

SEQ ID NO: 170151 - DNA, 25 bp, Mus musculus
aatggagaaaacttctaaagatggc

SEQ ID NO: 170152 - DNA, 25 bp, Mus musculus
aatggagaaaatttgccttgaattc

SEQ ID NO: 170153 - DNA, 25 bp, Mus musculus
aatggagacaaggaacatggaatac

SEQ ID NO: 170154 - DNA, 25 bp, Mus musculus
aatggagacccaggtgataactccc

SEQ ID NO: 170155 - DNA, 25 bp, Mus musculus
aatggagagaggaggctgctcccct

SEQ ID NO: 170156 - DNA, 25 bp, Mus musculus
aatggagagagtttggaagaactga

SEQ ID NO: 170157 - DNA, 25 bp, Mus musculus
aatggagagcaaagaaccccagctg

SEQ ID NO: 170158 - DNA, 25 bp, Mus musculus
aatggagaggaaggcgcgggctggg

SEQ ID NO: 170159 - DNA, 25 bp, Mus musculus
aatggagatggttctgccgatcttg

SEQ ID NO: 170160 - DNA, 25 bp, Mus musculus
aatggagcaaagaactgagattgca

SEQ ID NO: 170161 - DNA, 25 bp, Mus musculus
aatggagcaaaggcaccatcggttt

SEQ ID NO: 170162 - DNA, 25 bp, Mus musculus
aatggagcaaggtgtccatgttgga

SEQ ID NO: 170163 - DNA, 25 bp, Mus musculus
aatggagcaggagccctgcctagcc

SEQ ID NO: 170164 - DNA, 25 bp, Mus musculus
aatggagcgaggaaggcacctgatg

SEQ ID NO: 170165 - DNA, 25 bp, Mus musculus
aatggagcgaggaagggatcgctta

SEQ ID NO: 170166 - DNA, 25 bp, Mus musculus
aatggagcggaagagccccagcggg

SEQ ID NO: 170167 - DNA, 25 bp, Mus musculus
aatggaggaaaggttacagcaggcg

SEQ ID NO: 170168 - DNA, 25 bp, Mus musculus
aatggaggaggtgactccaatgaag

SEQ ID NO: 170169 - DNA, 25 bp, Mus musculus
aatggaggccaggaaaacggcaact

SEQ ID NO: 170170 - DNA, 25 bp, Mus musculus
aatggaggccaggctgtaattcaaa

SEQ ID NO: 170171 - DNA, 25 bp, Mus musculus
aatggaggccaggtgacataccgcg

SEQ ID NO: 170172 - DNA, 25 bp, Mus musculus
aatggaggtaatgttgggaggaaag

SEQ ID NO: 170173 - DNA, 25 bp, Mus musculus
aatggagttctggggacaatggtga

SEQ ID NO: 170174 - DNA, 25 bp, Mus musculus
aatggagttgctggaaaatctggat

SEQ ID NO: 170175 - DNA, 25 bp, Mus musculus
aatggagttgctggaacagattttc

SEQ ID NO: 170176 - DNA, 25 bp, Mus musculus
aatggagttggctctgctctgacca

SEQ ID NO: 170177 - DNA, 25 bp, Mus musculus
aatggataaaggagccgggtgtggg

SEQ ID NO: 170178 - DNA, 25 bp, Mus musculus
aatggatacacaactattgtcccag

SEQ ID NO: 170179 - DNA, 25 bp, Mus musculus
aatggatacccagacctgattgtgg

SEQ ID NO: 170180 - DNA, 25 bp, Mus musculus
aatggatacccaggcctgattgtgg

SEQ ID NO: 170181 - DNA, 25 bp, Mus musculus
aatggatagccaggtgccagaactg

SEQ ID NO: 170182 - DNA, 25 bp, Mus musculus
aatggatccaccagcactgcccccc

SEQ ID NO: 170183 - DNA, 25 bp, Mus musculus
aatggatcccactgatgccaagtat

SEQ ID NO: 170184 - DNA, 25 bp, Mus musculus
aatggatcccgggcgtccatgctgg

SEQ ID NO: 170185 - DNA, 25 bp, Mus musculus
aatggatccttgctaatttgaaata

SEQ ID NO: 170186 - DNA, 25 bp, Mus musculus
aatggatctcactgtggtccagatt

SEQ ID NO: 170187 - DNA, 25 bp, Mus musculus
aatggatgaccagttggcaaagctc

SEQ ID NO: 170188 - DNA, 25 bp, Mus musculus
aatggatgcaggggtcccaatttca

SEQ ID NO: 170189 - DNA, 25 bp, Mus musculus
aatggatgcaggtgtagcagtggga

SEQ ID NO: 170190 - DNA, 25 bp, Mus musculus
aatggattaaagctatcccctctgc

SEQ ID NO: 170191 - DNA, 25 bp, Mus musculus
aatggatttagaggaggatatgatg

SEQ ID NO: 170192 - DNA, 25 bp, Mus musculus
aatggatttgctcaaaccagaactt

SEQ ID NO: 170193 - DNA, 25 bp, Mus musculus
aatggcaaaaaggtggtggagaaaa

SEQ ID NO: 170194 - DNA, 25 bp, Mus musculus
aatggcaaacacctccctctcccag

SEQ ID NO: 170195 - DNA, 25 bp, Mus musculus
aatggcaaagggagttttgtgctgc

SEQ ID NO: 170196 - DNA, 25 bp, Mus musculus
aatggcaaagtacccaggcaagact

SEQ ID NO: 170197 - DNA, 25 bp, Mus musculus
aatggcaacctcctctgacctctgg

SEQ ID NO: 170198 - DNA, 25 bp, Mus musculus
aatggcaagggaggaccgggctcat

SEQ ID NO: 170199 - DNA, 25 bp, Mus musculus
aatggcaagggagggcgtggacggg

SEQ ID NO: 170200 - DNA, 25 bp, Mus musculus
aatggcacaagaacaagtaagaagt

SEQ ID NO: 170201 - DNA, 25 bp, Mus musculus
aatggcacagacgcagcctcctttc

SEQ ID NO: 170202 - DNA, 25 bp, Mus musculus
aatggcacattcaaggacatcgagg

SEQ ID NO: 170203 - DNA, 25 bp, Mus musculus
aatggcacattcaaggactgggctg

SEQ ID NO: 170204 - DNA, 25 bp, Mus musculus
aatggcagcacagcttagaaccata

SEQ ID NO: 170205 - DNA, 25 bp, Mus musculus
aatggcaggaaatctcaccacatct

SEQ ID NO: 170206 - DNA, 25 bp, Mus musculus
aatggcagtggtcctacggctctgt

SEQ ID NO: 170207 - DNA, 25 bp, Mus musculus
aatggcatgaccaagatgccaaaga

SEQ ID NO: 170208 - DNA, 25 bp, Mus musculus
aatggcatgaccaaggtacttcctg

SEQ ID NO: 170209 - DNA, 25 bp, Mus musculus
aatggcatgattgaggactgggagt

SEQ ID NO: 170210 - DNA, 25 bp, Mus musculus
aatggccaagaagtctacatgtggg

SEQ ID NO: 170211 - DNA, 25 bp, Mus musculus
aatggccagatctaggcagtgcaca

SEQ ID NO: 170212 - DNA, 25 bp, Mus musculus
aatggccagatctagtgctcacatg

SEQ ID NO: 170213 - DNA, 25 bp, Mus musculus
aatggccagcaggctccagcccact

SEQ ID NO: 170214 - DNA, 25 bp, Mus musculus
aatggccagcaggtgcttgtgtgta

SEQ ID NO: 170215 - DNA, 25 bp, Mus musculus
aatggccagctgcagacgaagcttc

SEQ ID NO: 170216 - DNA, 25 bp, Mus musculus
aatggccagctgcagagcgaagtca

SEQ ID NO: 170217 - DNA, 25 bp, Mus musculus
aatggccagctgcagctgctgataa

SEQ ID NO: 170218 - DNA, 25 bp, Mus musculus
aatggccatgataacagctatcttg

SEQ ID NO: 170219 - DNA, 25 bp, Mus musculus
aatggccatgtacccagaggatcat

SEQ ID NO: 170220 - DNA, 25 bp, Mus musculus
aatggccatgtacccccatgcccgg

SEQ ID NO: 170221 - DNA, 25 bp, Mus musculus
aatggccatgtacccgcacgtgaca

SEQ ID NO: 170222 - DNA, 25 bp, Mus musculus
aatggcccatgattttgttctttag

SEQ ID NO: 170223 - DNA, 25 bp, Mus musculus
aatggcccatgtgctctgtaacaga

SEQ ID NO: 170224 - DNA, 25 bp, Mus musculus
aatggcccattgaaaagagtcatca

SEQ ID NO: 170225 - DNA, 25 bp, Mus musculus
aatggccgtattgagagttgcattg

SEQ ID NO: 170226 - DNA, 25 bp, Mus musculus
aatggccgtattgaggaacaaagga

SEQ ID NO: 170227 - DNA, 25 bp, Mus musculus
aatggcctcggtcactttcacgaaa

SEQ ID NO: 170228 - DNA, 25 bp, Mus musculus
aatggcctgagaattcttttcgtcc

SEQ ID NO: 170229 - DNA, 25 bp, Mus musculus
aatggccttgaaaagatgaatgaga

SEQ ID NO: 170230 - DNA, 25 bp, Mus musculus
aatggccttgaaaagattggccacc

SEQ ID NO: 170231 - DNA, 25 bp, Mus musculus
aatggccttgaaaaggtagacccac

SEQ ID NO: 170232 - DNA, 25 bp, Mus musculus
aatggccttgatgtgagccatgagc

SEQ ID NO: 170233 - DNA, 25 bp, Mus musculus
aatggcgagacaactaaattttcca

SEQ ID NO: 170234 - DNA, 25 bp, Mus musculus
aatggcgccagccaggacggcttca

SEQ ID NO: 170235 - DNA, 25 bp, Mus musculus
aatggcgccgccgggttcaagcgct

SEQ ID NO: 170236 - DNA, 25 bp, Mus musculus
aatggcggaagatataacagacttt

SEQ ID NO: 170237 - DNA, 25 bp, Mus musculus
aatggcggagaggtattagaagata

SEQ ID NO: 170238 - DNA, 25 bp, Mus musculus
aatggcggagaggtgttctctgagg

SEQ ID NO: 170239 - DNA, 25 bp, Mus musculus
aatggcgtgatccaggaagccccga

SEQ ID NO: 170240 - DNA, 25 bp, Mus musculus
aatggcgtggcagtgtacagctgta

SEQ ID NO: 170241 - DNA, 25 bp, Mus musculus
aatggctaaaactgtgcagttgtac

SEQ ID NO: 170242 - DNA, 25 bp, Mus musculus
aatggctacatttgtcctctctaac

SEQ ID NO: 170243 - DNA, 25 bp, Mus musculus
aatggctatgttggaaatataaatg

SEQ ID NO: 170244 - DNA, 25 bp, Mus musculus
aatggctcaagcaggaacctagcaa

SEQ ID NO: 170245 - DNA, 25 bp, Mus musculus
aatggctcaagcagggccacaatgc

SEQ ID NO: 170246 - DNA, 25 bp, Mus musculus
aatggctcaagcaggtaacaaatca

SEQ ID NO: 170247 - DNA, 25 bp, Mus musculus
aatggctcaaggaacagtgagcaga

SEQ ID NO: 170248 - DNA, 25 bp, Mus musculus
aatggctcagctttcaacatttcca

SEQ ID NO: 170249 - DNA, 25 bp, Mus musculus
aatggctcagggccatcgaagacgg

SEQ ID NO: 170250 - DNA, 25 bp, Mus musculus
aatggctccattcagagcataccag

SEQ ID NO: 170251 - DNA, 25 bp, Mus musculus
aatggctccattcagttttcctttt

SEQ ID NO: 170252 - DNA, 25 bp, Mus musculus
aatggctgaagtgaggggggtccag

SEQ ID NO: 170253 - DNA, 25 bp, Mus musculus
aatggctgaagtgagtgggcccagc

SEQ ID NO: 170254 - DNA, 25 bp, Mus musculus
aatggctgacaaagagcttccactt

SEQ ID NO: 170255 - DNA, 25 bp, Mus musculus
aatggctgacaaagggcactggttc

SEQ ID NO: 170256 - DNA, 25 bp, Mus musculus
aatggcttcactgcgctggcattga

SEQ ID NO: 170257 - DNA, 25 bp, Mus musculus
aatggcttccttcatgaagataagc

SEQ ID NO: 170258 - DNA, 25 bp, Mus musculus
aatggcttctgagaaactggtcaaa

SEQ ID NO: 170259 - DNA, 25 bp, Mus musculus
aatggcttgaagatgataattagca

SEQ ID NO: 170260 - DNA, 25 bp, Mus musculus
aatgggaaaacggtatatgcaccat

SEQ ID NO: 170261 - DNA, 25 bp, Mus musculus
aatgggaaactgccgccacagtaca

SEQ ID NO: 170262 - DNA, 25 bp, Mus musculus
aatgggaagactccaattcattgct

SEQ ID NO: 170263 - DNA, 25 bp, Mus musculus
aatgggacaaatgcctggaatgatg

SEQ ID NO: 170264 - DNA, 25 bp, Mus musculus
aatgggacaggagacaagatccctg

SEQ ID NO: 170265 - DNA, 25 bp, Mus musculus
aatgggacaggagacaattacaatg

SEQ ID NO: 170266 - DNA, 25 bp, Mus musculus
aatgggacaggagtgtctcttcttg

SEQ ID NO: 170267 - DNA, 25 bp, Mus musculus
aatgggacctcacctacccaaagct

SEQ ID NO: 170268 - DNA, 25 bp, Mus musculus
aatgggacctcagagtaatataaag

SEQ ID NO: 170269 - DNA, 25 bp, Mus musculus
aatgggagaaaggggcgctcctggc

SEQ ID NO: 170270 - DNA, 25 bp, Mus musculus
aatgggagagatgcagaaagagagt

SEQ ID NO: 170271 - DNA, 25 bp, Mus musculus
aatgggagagcttttgcctaccaaa

SEQ ID NO: 170272 - DNA, 25 bp, Mus musculus
aatgggagctgatgttcaggtaaat

SEQ ID NO: 170273 - DNA, 25 bp, Mus musculus
aatgggagctggtaaatgatgatga

SEQ ID NO: 170274 - DNA, 25 bp, Mus musculus
aatgggaggaggcacttgaatattg

SEQ ID NO: 170275 - DNA, 25 bp, Mus musculus
aatgggaggctatggtcgtggtggt

SEQ ID NO: 170276 - DNA, 25 bp, Mus musculus
aatgggataaaaagaatgctgccaa

SEQ ID NO: 170277 - DNA, 25 bp, Mus musculus
aatgggatgcaactgatgtttccca

SEQ ID NO: 170278 - DNA, 25 bp, Mus musculus
aatgggatgcaactgggaagagagc

SEQ ID NO: 170279 - DNA, 25 bp, Mus musculus
aatgggatgttggcctgatgccctc

SEQ ID NO: 170280 - DNA, 25 bp, Mus musculus
aatgggatgttgggtgtttgaagct

SEQ ID NO: 170281 - DNA, 25 bp, Mus musculus
aatgggcaacctttggtagagacct

SEQ ID NO: 170282 - DNA, 25 bp, Mus musculus
aatgggcaaggtgaaattggtgcac

SEQ ID NO: 170283 - DNA, 25 bp, Mus musculus
aatgggcacaaggcgacccaagctc

SEQ ID NO: 170284 - DNA, 25 bp, Mus musculus
aatgggcacaagggtgtggactgcg

SEQ ID NO: 170285 - DNA, 25 bp, Mus musculus
aatgggcagagagaaatgtcaccag

SEQ ID NO: 170286 - DNA, 25 bp, Mus musculus
aatgggcatcacagtcagtacaggc

SEQ ID NO: 170287 - DNA, 25 bp, Mus musculus
aatgggcatgtctacacctgcatgg

SEQ ID NO: 170288 - DNA, 25 bp, Mus musculus
aatgggccaagcagaaaagaaatgg

SEQ ID NO: 170289 - DNA, 25 bp, Mus musculus
aatgggccaaggaaaatgatgaaga

SEQ ID NO: 170290 - DNA, 25 bp, Mus musculus
aatgggccacgtctaaagagcctgg

SEQ ID NO: 170291 - DNA, 25 bp, Mus musculus
aatgggccagatacaatttgtttat

SEQ ID NO: 170292 - DNA, 25 bp, Mus musculus
aatgggccagtgatgagatgccatc

SEQ ID NO: 170293 - DNA, 25 bp, Mus musculus
aatgggcgcaccaaggccatggtgg

SEQ ID NO: 170294 - DNA, 25 bp, Mus musculus
aatgggcgcagacatgaaagcttgc

SEQ ID NO: 170295 - DNA, 25 bp, Mus musculus
aatgggctacataccatctgccagc

SEQ ID NO: 170296 - DNA, 25 bp, Mus musculus
aatgggctacatcccgtatgtgcag

SEQ ID NO: 170297 - DNA, 25 bp, Mus musculus
aatgggctaggcaaaagatgtgatt

SEQ ID NO: 170298 - DNA, 25 bp, Mus musculus
aatgggctagtcacagttgcagatt

SEQ ID NO: 170299 - DNA, 25 bp, Mus musculus
aatgggctgaagagaatgcaaagct

SEQ ID NO: 170300 - DNA, 25 bp, Mus musculus
aatggggaaggtctaaatgccatcc

SEQ ID NO: 170301 - DNA, 25 bp, Mus musculus
aatggggacagtgtcttacacttag

SEQ ID NO: 170302 - DNA, 25 bp, Mus musculus
aatggggagctggccccacagggct

SEQ ID NO: 170303 - DNA, 25 bp, Mus musculus
aatggggagctggctaagctggtgc

SEQ ID NO: 170304 - DNA, 25 bp, Mus musculus
aatggggctcctcctccaggcatgc

SEQ ID NO: 170305 - DNA, 25 bp, Mus musculus
aatggggctgtgatggaatttcacg

SEQ ID NO: 170306 - DNA, 25 bp, Mus musculus
aatggggctgtgatggtagcatcgc

SEQ ID NO: 170307 - DNA, 25 bp, Mus musculus
aatggggcttaactggttacaaaat

SEQ ID NO: 170308 - DNA, 25 bp, Mus musculus
aatggggcttctagccagagccatg

SEQ ID NO: 170309 - DNA, 25 bp, Mus musculus
aatggggtacagggtgaagtactgg

SEQ ID NO: 170310 - DNA, 25 bp, Mus musculus
aatgggtaggtggagtattggcttc

SEQ ID NO: 170311 - DNA, 25 bp, Mus musculus
aatgggtcagacagcgtcatcatga

SEQ ID NO: 170312 - DNA, 25 bp, Mus musculus
aatgggtcagacaggcaagggctca

SEQ ID NO: 170313 - DNA, 25 bp, Mus musculus
aatgggtctgacaggcacagtagac

SEQ ID NO: 170314 - DNA, 25 bp, Mus musculus
aatgggtctgacagtgttgtcatga

SEQ ID NO: 170315 - DNA, 25 bp, Mus musculus
aatgggtctggttctccacatgaca

SEQ ID NO: 170316 - DNA, 25 bp, Mus musculus
aatgggtgaagaagaagctgactgc

SEQ ID NO: 170317 - DNA, 25 bp, Mus musculus
aatgggttatattatgggcaaagca

SEQ ID NO: 170318 - DNA, 25 bp, Mus musculus
aatggtaaagacagcacagcccccc

SEQ ID NO: 170319 - DNA, 25 bp, Mus musculus
aatggtaaagacagcctaaccatgc

SEQ ID NO: 170320 - DNA, 25 bp, Mus musculus
aatggtactgtaggtggatagtcca

SEQ ID NO: 170321 - DNA, 25 bp, Mus musculus
aatggtcagtgttggtttcaacctc

SEQ ID NO: 170322 - DNA, 25 bp, Mus musculus
aatggtcatcagagctgtactggcg

SEQ ID NO: 170323 - DNA, 25 bp, Mus musculus
aatggtcatcagtgtcctcctatcg

SEQ ID NO: 170324 - DNA, 25 bp, Mus musculus
aatggtcatgatggtaccaggagct

SEQ ID NO: 170325 - DNA, 25 bp, Mus musculus
aatggtccatctctacaacatcttc

SEQ ID NO: 170326 - DNA, 25 bp, Mus musculus
aatggtccattacccaggcaagact

SEQ ID NO: 170327 - DNA, 25 bp, Mus musculus
aatggtcccacccagacaggcttca

SEQ ID NO: 170328 - DNA, 25 bp, Mus musculus
aatggtcctgagctgtttggggcaa

SEQ ID NO: 170329 - DNA, 25 bp, Mus musculus
aatggtcgaattcgccgcatgtctc

SEQ ID NO: 170330 - DNA, 25 bp, Mus musculus
aatggtcgatgaagagtttgatttt

SEQ ID NO: 170331 - DNA, 25 bp, Mus musculus
aatggtcgatggtggatgtacagtt

SEQ ID NO: 170332 - DNA, 25 bp, Mus musculus
aatggtctagcaagccgggtatccc

SEQ ID NO: 170333 - DNA, 25 bp, Mus musculus
aatggtctagcaagggcaatgacat

SEQ ID NO: 170334 - DNA, 25 bp, Mus musculus
aatggtctgggttaaatggtttgtc

SEQ ID NO: 170335 - DNA, 25 bp, Mus musculus
aatggtgatggtcttctccatcgtg

SEQ ID NO: 170336 - DNA, 25 bp, Mus musculus
aatggtggagttggccaaacagtgg

SEQ ID NO: 170337 - DNA, 25 bp, Mus musculus
aatggtggtatcatgatgacacttg

SEQ ID NO: 170338 - DNA, 25 bp, Mus musculus
aatggtggtatcatggtggatacag

SEQ ID NO: 170339 - DNA, 25 bp, Mus musculus
aatggtgtataatgaatttcagaaa

SEQ ID NO: 170340 - DNA, 25 bp, Mus musculus
aatggtgtataatggcatttgagca

SEQ ID NO: 170341 - DNA, 25 bp, Mus musculus
aatggtgtggagtttgcagattcct

SEQ ID NO: 170342 - DNA, 25 bp, Mus musculus
aatggtgtgtttgaggagatttcta

SEQ ID NO: 170343 - DNA, 25 bp, Mus musculus
aatggtgtttgcaggagtgtaccct

SEQ ID NO: 170344 - DNA, 25 bp, Mus musculus
aatggttacacagggctgttcaggt

SEQ ID NO: 170345 - DNA, 25 bp, Mus musculus
aatggttatactaatggaattgcta

SEQ ID NO: 170346 - DNA, 25 bp, Mus musculus
aatggttatactgccttaacatggg

SEQ ID NO: 170347 - DNA, 25 bp, Mus musculus
aatggttatgataattagcaccatg

SEQ ID NO: 170348 - DNA, 25 bp, Mus musculus
aatggttatggttatgcttcaaatg

SEQ ID NO: 170349 - DNA, 25 bp, Mus musculus
aatggttcacagagatcccagaaac

SEQ ID NO: 170350 - DNA, 25 bp, Mus musculus
aatggttcctcagaacctgggaggc

SEQ ID NO: 170351 - DNA, 25 bp, Mus musculus
aatggttgaagacacaggaggcagc

SEQ ID NO: 170352 - DNA, 25 bp, Mus musculus
aatggttgacaggcaataccctttc

SEQ ID NO: 170353 - DNA, 25 bp, Mus musculus
aatggttggctcaacttgatttctt

SEQ ID NO: 170354 - DNA, 25 bp, Mus musculus
aatggttgggaaggaaaagggctat

SEQ ID NO: 170355 - DNA, 25 bp, Mus musculus
aatggtttacagactgttttccaag

SEQ ID NO: 170356 - DNA, 25 bp, Mus musculus
aatggtttacaggtttactgctagg

SEQ ID NO: 170357 - DNA, 25 bp, Mus musculus
aatggtttgcgtttgcagtatgaag

SEQ ID NO: 170358 - DNA, 25 bp, Mus musculus
aatggtttttggtctcagtgtgttg

SEQ ID NO: 170359 - DNA, 25 bp, Mus musculus
aatgtaaacctgaactatgacaatg

SEQ ID NO: 170360 - DNA, 25 bp, Mus musculus
aatgtaaacctgttgccaagaacta

SEQ ID NO: 170361 - DNA, 25 bp, Mus musculus
aatgtaacagagggaaaacagttgg

SEQ ID NO: 170362 - DNA, 25 bp, Mus musculus
aatgtaacagagggttcccatctcc

SEQ ID NO: 170363 - DNA, 25 bp, Mus musculus
aatgtaacagagggtttgaagatca

SEQ ID NO: 170364 - DNA, 25 bp, Mus musculus
aatgtaagaatgtctacaagcagga

SEQ ID NO: 170365 - DNA, 25 bp, Mus musculus
aatgtaagtatgccatttgtcacag

SEQ ID NO: 170366 - DNA, 25 bp, Mus musculus
aatgtaatctgggtgttgacgatgc

SEQ ID NO: 170367 - DNA, 25 bp, Mus musculus
aatgtaccagctcaaacaggccgag

SEQ ID NO: 170368 - DNA, 25 bp, Mus musculus
aatgtaccagtgtatctctatggtg

SEQ ID NO: 170369 - DNA, 25 bp, Mus musculus
aatgtactcaattagcatgacaggg

SEQ ID NO: 170370 - DNA, 25 bp, Mus musculus
aatgtactgaaggatttctggtagg

SEQ ID NO: 170371 - DNA, 25 bp, Mus musculus
aatgtagaaaagattaatggggaat

SEQ ID NO: 170372 - DNA, 25 bp, Mus musculus
aatgtagaacagattagtgggtatt

SEQ ID NO: 170373 - DNA, 25 bp, Mus musculus
aatgtagagatctcagtgcccttat

SEQ ID NO: 170374 - DNA, 25 bp, Mus musculus
aatgtagatgaaactgaaggctcag

SEQ ID NO: 170375 - DNA, 25 bp, Mus musculus
aatgtagatgaggaagcaagggaag

SEQ ID NO: 170376 - DNA, 25 bp, Mus musculus
aatgtagccaacccttcactgaagt

SEQ ID NO: 170377 - DNA, 25 bp, Mus musculus
aatgtagcccggagccttctgatgg

SEQ ID NO: 170378 - DNA, 25 bp, Mus musculus
aatgtagcctacagatgaaaaacga

SEQ ID NO: 170379 - DNA, 25 bp, Mus musculus
aatgtagcctacaggtggcggagga

SEQ ID NO: 170380 - DNA, 25 bp, Mus musculus
aatgtagtgaagctatgccattgtg

SEQ ID NO: 170381 - DNA, 25 bp, Mus musculus
aatgtagtgaagctccttggcgagc

SEQ ID NO: 170382 - DNA, 25 bp, Mus musculus
aatgtagttcagagtgtcaaaaccg

SEQ ID NO: 170383 - DNA, 25 bp, Mus musculus
aatgtataccaggaatttccacagt

SEQ ID NO: 170384 - DNA, 25 bp, Mus musculus
aatgtatatattaggctatgtggtg

SEQ ID NO: 170385 - DNA, 25 bp, Mus musculus
aatgtatccaagggagcccaggaag

SEQ ID NO: 170386 - DNA, 25 bp, Mus musculus
aatgtatcggaggacaccaaagtga

SEQ ID NO: 170387 - DNA, 25 bp, Mus musculus
aatgtatctggtgaccacattagtc

SEQ ID NO: 170388 - DNA, 25 bp, Mus musculus
aatgtatgacgaggagacccgcatc

SEQ ID NO: 170389 - DNA, 25 bp, Mus musculus
aatgtatgatgaggagacccgcatc

SEQ ID NO: 170390 - DNA, 25 bp, Mus musculus
aatgtatgcagggacgcatcgttga

SEQ ID NO: 170391 - DNA, 25 bp, Mus musculus
aatgtatgcgcaaggcttcattctc

SEQ ID NO: 170392 - DNA, 25 bp, Mus musculus
aatgtatgtatacaggtttgttaac

SEQ ID NO: 170393 - DNA, 25 bp, Mus musculus
aatgtattcaagatgctggagactt

SEQ ID NO: 170394 - DNA, 25 bp, Mus musculus
aatgtattcaaggtctgcgacgagc

SEQ ID NO: 170395 - DNA, 25 bp, Mus musculus
aatgtattctgcaaaaccttatgca

SEQ ID NO: 170396 - DNA, 25 bp, Mus musculus
aatgtattctgcaaacttcaagcac

SEQ ID NO: 170397 - DNA, 25 bp, Mus musculus
aatgtattggataagaccaccgctc

SEQ ID NO: 170398 - DNA, 25 bp, Mus musculus
aatgtcaaagattgtaacataaaac

SEQ ID NO: 170399 - DNA, 25 bp, Mus musculus
aatgtcaaagctggcaagatgtcag

SEQ ID NO: 170400 - DNA, 25 bp, Mus musculus
aatgtcaaaggatgaccttgatctg

SEQ ID NO: 170401 - DNA, 25 bp, Mus musculus
aatgtcaacagaccgctccggcctg

SEQ ID NO: 170402 - DNA, 25 bp, Mus musculus
aatgtcacagatgccatctcatctg

SEQ ID NO: 170403 - DNA, 25 bp, Mus musculus
aatgtcaccacacaggtatcagtga

SEQ ID NO: 170404 - DNA, 25 bp, Mus musculus
aatgtcaccacacagtcttaggcaa

SEQ ID NO: 170405 - DNA, 25 bp, Mus musculus
aatgtcacctataattcacagaact

SEQ ID NO: 170406 - DNA, 25 bp, Mus musculus
aatgtcaccttcagctacccctgca

SEQ ID NO: 170407 - DNA, 25 bp, Mus musculus
aatgtcactcaggtgcggacattct

SEQ ID NO: 170408 - DNA, 25 bp, Mus musculus
aatgtcagaaagagtctactgtata

SEQ ID NO: 170409 - DNA, 25 bp, Mus musculus
aatgtcagaaagtgtctactgtata

SEQ ID NO: 170410 - DNA, 25 bp, Mus musculus
aatgtcagcaggatggcacgctcaa

SEQ ID NO: 170411 - DNA, 25 bp, Mus musculus
aatgtcagcccaggtgctgtgagtg

SEQ ID NO: 170412 - DNA, 25 bp, Mus musculus
aatgtcagtgcgattcccaactttc

SEQ ID NO: 170413 - DNA, 25 bp, Mus musculus
aatgtcatattttggtttttgggaa

SEQ ID NO: 170414 - DNA, 25 bp, Mus musculus
aatgtcatcaaagggaatgatgaaa

SEQ ID NO: 170415 - DNA, 25 bp, Mus musculus
aatgtcatcaaagggtctgagtggc

SEQ ID NO: 170416 - DNA, 25 bp, Mus musculus
aatgtccacaccggtgatcctaaga

SEQ ID NO: 170417 - DNA, 25 bp, Mus musculus
aatgtccactgttccccattttctt

SEQ ID NO: 170418 - DNA, 25 bp, Mus musculus
aatgtccaggtcctttcctcttccc

SEQ ID NO: 170419 - DNA, 25 bp, Mus musculus
aatgtcccaacaggccatccgctgc

SEQ ID NO: 170420 - DNA, 25 bp, Mus musculus
aatgtcccaggccgctagtcagaca

SEQ ID NO: 170421 - DNA, 25 bp, Mus musculus
aatgtcccagggcggcaatctgctc

SEQ ID NO: 170422 - DNA, 25 bp, Mus musculus
aatgtcctgatttcagagtgggtgg

SEQ ID NO: 170423 - DNA, 25 bp, Mus musculus
aatgtcctgcagggtttcaaagata

SEQ ID NO: 170424 - DNA, 25 bp, Mus musculus
aatgtcgccaaagcccatgaaatga

SEQ ID NO: 170425 - DNA, 25 bp, Mus musculus
aatgtctaataaaactggatggctt

SEQ ID NO: 170426 - DNA, 25 bp, Mus musculus
aatgtctacgagaagatctcaagaa

SEQ ID NO: 170427 - DNA, 25 bp, Mus musculus
aatgtctacgttaaggtcacctcca

SEQ ID NO: 170428 - DNA, 25 bp, Mus musculus
aatgtctacgttaagttccggcggg

SEQ ID NO: 170429 - DNA, 25 bp, Mus musculus
aatgtctatggcagtcctgacttcc

SEQ ID NO: 170430 - DNA, 25 bp, Mus musculus
aatgtctcagatgcactcccatcct

SEQ ID NO: 170431 - DNA, 25 bp, Mus musculus
aatgtctcctgcttggctcctgtag

SEQ ID NO: 170432 - DNA, 25 bp, Mus musculus
aatgtctgcctttggaaaggagcac

SEQ ID NO: 170433 - DNA, 25 bp, Mus musculus
aatgtcttccaggccaagttccttc

SEQ ID NO: 170434 - DNA, 25 bp, Mus musculus
aatgtctttgcaccctgtgacctgg

SEQ ID NO: 170435 - DNA, 25 bp, Mus musculus
aatgtctttggtttcaacagctccc

SEQ ID NO: 170436 - DNA, 25 bp, Mus musculus
aatgtgaaaaagtattcaaacatag

SEQ ID NO: 170437 - DNA, 25 bp, Mus musculus
aatgtgaaaagagtgtcccagcaga

SEQ ID NO: 170438 - DNA, 25 bp, Mus musculus
aatgtgaaagactaggccaatccct

SEQ ID NO: 170439 - DNA, 25 bp, Mus musculus
aatgtgaaaggctaccttggaccgg

SEQ ID NO: 170440 - DNA, 25 bp, Mus musculus
aatgtgaaaggctggcacagaagtc

SEQ ID NO: 170441 - DNA, 25 bp, Mus musculus
aatgtgaaagtacatttgcaagaat

SEQ ID NO: 170442 - DNA, 25 bp, Mus musculus
aatgtgaacaaagtgaattccaagg

SEQ ID NO: 170443 - DNA, 25 bp, Mus musculus
aatgtgaacaagcttgtgacacagc

SEQ ID NO: 170444 - DNA, 25 bp, Mus musculus
aatgtgaagagctgctggagcaggc

SEQ ID NO: 170445 - DNA, 25 bp, Mus musculus
aatgtgaaggctccagcctggcatg

SEQ ID NO: 170446 - DNA, 25 bp, Mus musculus
aatgtgaatcttctggacatgttga

SEQ ID NO: 170447 - DNA, 25 bp, Mus musculus
aatgtgacaagatcgtgaaccttat

SEQ ID NO: 170448 - DNA, 25 bp, Mus musculus
aatgtgacaaggcatatctagatga

SEQ ID NO: 170449 - DNA, 25 bp, Mus musculus
aatgtgacaggctaaactgtgacaa

SEQ ID NO: 170450 - DNA, 25 bp, Mus musculus
aatgtgacagtccatatgttgtgaa

SEQ ID NO: 170451 - DNA, 25 bp, Mus musculus
aatgtgagcacatccgtctcaggtg

SEQ ID NO: 170452 - DNA, 25 bp, Mus musculus
aatgtgagctggaggcccctggcga

SEQ ID NO: 170453 - DNA, 25 bp, Mus musculus
aatgtgataggtttgccagatctgc

SEQ ID NO: 170454 - DNA, 25 bp, Mus musculus
aatgtgatctgcaggaccagtccat

SEQ ID NO: 170455 - DNA, 25 bp, Mus musculus
aatgtgatgcttgcggaatgcagcc

SEQ ID NO: 170456 - DNA, 25 bp, Mus musculus
aatgtgatgcttgcgtgcaatgctc

SEQ ID NO: 170457 - DNA, 25 bp, Mus musculus
aatgtgatgtacaagaaagggaaga

SEQ ID NO: 170458 - DNA, 25 bp, Mus musculus
aatgtgattgctctaagaagctgat

SEQ ID NO: 170459 - DNA, 25 bp, Mus musculus
aatgtgattgtcgagacgtgcgacc

SEQ ID NO: 170460 - DNA, 25 bp, Mus musculus
aatgtgattgtggtgacactgcaaa

SEQ ID NO: 170461 - DNA, 25 bp, Mus musculus
aatgtgattttcaggaaaagtgcaa

SEQ ID NO: 170462 - DNA, 25 bp, Mus musculus
aatgtgcagcatgagaatggctatg

SEQ ID NO: 170463 - DNA, 25 bp, Mus musculus
aatgtgcagcatgcttttcccagtc

SEQ ID NO: 170464 - DNA, 25 bp, Mus musculus
aatgtgcagccaagaagtccaggaa

SEQ ID NO: 170465 - DNA, 25 bp, Mus musculus
aatgtgcagtcacaggtggataccc

SEQ ID NO: 170466 - DNA, 25 bp, Mus musculus
aatgtgcattagtgggtttgatgac

SEQ ID NO: 170467 - DNA, 25 bp, Mus musculus
aatgtgccaatattcaaggacaaga

SEQ ID NO: 170468 - DNA, 25 bp, Mus musculus
aatgtgccagaaagctgccccacga

SEQ ID NO: 170469 - DNA, 25 bp, Mus musculus
aatgtgctggaattgtctgtaagta

SEQ ID NO: 170470 - DNA, 25 bp, Mus musculus
aatgtgctggccatgcctttttatt

SEQ ID NO: 170471 - DNA, 25 bp, Mus musculus
aatgtgctgggttttctgtctccag

SEQ ID NO: 170472 - DNA, 25 bp, Mus musculus
aatgtgcttacatgcatgtgtaata

SEQ ID NO: 170473 - DNA, 25 bp, Mus musculus
aatgtgcttacgagtctactgtgct

SEQ ID NO: 170474 - DNA, 25 bp, Mus musculus
aatgtgcttatccaggttatcttct

SEQ ID NO: 170475 - DNA, 25 bp, Mus musculus
aatgtgcttgtcaggaacaatccac

SEQ ID NO: 170476 - DNA, 25 bp, Mus musculus
aatgtggaaatctctcaggagaagt

SEQ ID NO: 170477 - DNA, 25 bp, Mus musculus
aatgtggaaatgtgttctgcccagt

SEQ ID NO: 170478 - DNA, 25 bp, Mus musculus
aatgtggaaattttatagaacaagg

SEQ ID NO: 170479 - DNA, 25 bp, Mus musculus
aatgtggaacatcagaggatctgag

SEQ ID NO: 170480 - DNA, 25 bp, Mus musculus
aatgtggaagaggaaccgggcaaat

SEQ ID NO: 170481 - DNA, 25 bp, Mus musculus
aatgtggaagccgtgccccggcagc

SEQ ID NO: 170482 - DNA, 25 bp, Mus musculus
aatgtggaagtcttcagtaacttgt

SEQ ID NO: 170483 - DNA, 25 bp, Mus musculus
aatgtggaataaagtatcaggagtg

SEQ ID NO: 170484 - DNA, 25 bp, Mus musculus
aatgtggacaaggtattctttgatc

SEQ ID NO: 170485 - DNA, 25 bp, Mus musculus
aatgtggacaaggtcattgtgctca

SEQ ID NO: 170486 - DNA, 25 bp, Mus musculus
aatgtggagaaggtgaaatttatga

SEQ ID NO: 170487 - DNA, 25 bp, Mus musculus
aatgtggagaatgcatttttcactc

SEQ ID NO: 170488 - DNA, 25 bp, Mus musculus
aatgtggatcaggaatcctttctgc

SEQ ID NO: 170489 - DNA, 25 bp, Mus musculus
aatgtggcaaccagaatggggaatg

SEQ ID NO: 170490 - DNA, 25 bp, Mus musculus
aatgtggcaaccaggctgacagggg

SEQ ID NO: 170491 - DNA, 25 bp, Mus musculus
aatgtggcagatatcattaatggag

SEQ ID NO: 170492 - DNA, 25 bp, Mus musculus
aatgtggccaggcctgcaccacgga

SEQ ID NO: 170493 - DNA, 25 bp, Mus musculus
aatgtggctaccctggtcatctgac

SEQ ID NO: 170494 - DNA, 25 bp, Mus musculus
aatgtggctagagaggctgccctgg

SEQ ID NO: 170495 - DNA, 25 bp, Mus musculus
aatgtggctagctataaaaccattt

SEQ ID NO: 170496 - DNA, 25 bp, Mus musculus
aatgtgggcgaggaatcttatggca

SEQ ID NO: 170497 - DNA, 25 bp, Mus musculus
aatgtggggctggcatggaaaataa

SEQ ID NO: 170498 - DNA, 25 bp, Mus musculus
aatgtggggctggtgtcaggcatgg

SEQ ID NO: 170499 - DNA, 25 bp, Mus musculus
aatgtggtacccttgtgaatacatc

SEQ ID NO: 170500 - DNA, 25 bp, Mus musculus
aatgtggttgccggacctacaacct

SEQ ID NO: 170501 - DNA, 25 bp, Mus musculus
aatgtgtaagcggccatgtattctc

SEQ ID NO: 170502 - DNA, 25 bp, Mus musculus
aatgtgtaagcggtatttggaggta

SEQ ID NO: 170503 - DNA, 25 bp, Mus musculus
aatgtgtaagctgctggctctacat

SEQ ID NO: 170504 - DNA, 25 bp, Mus musculus
aatgtgtcacccattctaacggcaa

SEQ ID NO: 170505 - DNA, 25 bp, Mus musculus
aatgtgtccccagaaccaaggagag

SEQ ID NO: 170506 - DNA, 25 bp, Mus musculus
aatgtgtccgacttcccggagagga

SEQ ID NO: 170507 - DNA, 25 bp, Mus musculus
aatgtgtcctgattaccgacagcac

SEQ ID NO: 170508 - DNA, 25 bp, Mus musculus
aatgtgtcctgtcccacgctcagga

SEQ ID NO: 170509 - DNA, 25 bp, Mus musculus
aatgtgtgagagaaaccttataagt

SEQ ID NO: 170510 - DNA, 25 bp, Mus musculus
aatgtgtgagcaaagaagatagagg

SEQ ID NO: 170511 - DNA, 25 bp, Mus musculus
aatgtgtgagcaacttggcatcagc

SEQ ID NO: 170512 - DNA, 25 bp, Mus musculus
aatgtgtgcatagagtgttattgta

SEQ ID NO: 170513 - DNA, 25 bp, Mus musculus
aatgtgtgcatagctaatgtctgcg

SEQ ID NO: 170514 - DNA, 25 bp, Mus musculus
aatgtgtgccaagatattgatgagt

SEQ ID NO: 170515 - DNA, 25 bp, Mus musculus
aatgtgtgttggcgctaccctgatt

SEQ ID NO: 170516 - DNA, 25 bp, Mus musculus
aatgtgttcaagaacaaggttggcc

SEQ ID NO: 170517 - DNA, 25 bp, Mus musculus
aatgtgttcagcccgcatgccctac

SEQ ID NO: 170518 - DNA, 25 bp, Mus musculus
aatgtgttccttgcccagtctcgac

SEQ ID NO: 170519 - DNA, 25 bp, Mus musculus
aatgttaaaatgtgtcccctgcact

SEQ ID NO: 170520 - DNA, 25 bp, Mus musculus
aatgttaatgtccaagccatgtaca

SEQ ID NO: 170521 - DNA, 25 bp, Mus musculus
aatgttacaggcatcaaaaagtttg

SEQ ID NO: 170522 - DNA, 25 bp, Mus musculus
aatgttacaggtcatggaaaatgga

SEQ ID NO: 170523 - DNA, 25 bp, Mus musculus
aatgttagagagaatggactgctgt

SEQ ID NO: 170524 - DNA, 25 bp, Mus musculus
aatgttcaacagtgcacagtgtgtt

SEQ ID NO: 170525 - DNA, 25 bp, Mus musculus
aatgttcaccagaaaccaggtggcc

SEQ ID NO: 170526 - DNA, 25 bp, Mus musculus
aatgttcattttactgtgtggagag

SEQ ID NO: 170527 - DNA, 25 bp, Mus musculus
aatgttccaagtaccccagcaagaa

SEQ ID NO: 170528 - DNA, 25 bp, Mus musculus
aatgttccagacgtgaagcccttct

SEQ ID NO: 170529 - DNA, 25 bp, Mus musculus
aatgttccccattgtaacataaaac

SEQ ID NO: 170530 - DNA, 25 bp, Mus musculus
aatgttccccgtaacaaatcacaag

SEQ ID NO: 170531 - DNA, 25 bp, Mus musculus
aatgttccccgtcagaaacgtactt

SEQ ID NO: 170532 - DNA, 25 bp, Mus musculus
aatgttgaaggaagccaaaaacggg

SEQ ID NO: 170533 - DNA, 25 bp, Mus musculus
aatgttgcaattacccacggtctga

SEQ ID NO: 170534 - DNA, 25 bp, Mus musculus
aatgttgcaattacgtttctactgc

SEQ ID NO: 170535 - DNA, 25 bp, Mus musculus
aatgttgcttgatggtgaaattgaa

SEQ ID NO: 170536 - DNA, 25 bp, Mus musculus
aatgttggaggacctggataaggcc

SEQ ID NO: 170537 - DNA, 25 bp, Mus musculus
aatgttggaggatttagacaagagt

SEQ ID NO: 170538 - DNA, 25 bp, Mus musculus
aatgttggatagagatatgtccggc

SEQ ID NO: 170539 - DNA, 25 bp, Mus musculus
aatgttggcctataggaagtttggt

SEQ ID NO: 170540 - DNA, 25 bp, Mus musculus
aatgttgggcagatcctgctcatct

SEQ ID NO: 170541 - DNA, 25 bp, Mus musculus
aatgttgggcaggatgtttggatct

SEQ ID NO: 170542 - DNA, 25 bp, Mus musculus
aatgttgggcgaagatctgcaagta

SEQ ID NO: 170543 - DNA, 25 bp, Mus musculus
aatgttgggcgtgtgcatgtagccg

SEQ ID NO: 170544 - DNA, 25 bp, Mus musculus
aatgttggtgggcttccaccactgc

SEQ ID NO: 170545 - DNA, 25 bp, Mus musculus
aatgttgtacggctgatggatgtct

SEQ ID NO: 170546 - DNA, 25 bp, Mus musculus
aatgttgtacggtggttacgctctg

SEQ ID NO: 170547 - DNA, 25 bp, Mus musculus
aatgttgtgaagaacttcaagttgg

SEQ ID NO: 170548 - DNA, 25 bp, Mus musculus
aatgttgtgaagctcttcaatgatg

SEQ ID NO: 170549 - DNA, 25 bp, Mus musculus
aatgtttaattccatatttgatggt

SEQ ID NO: 170550 - DNA, 25 bp, Mus musculus
aatgtttacaagccaacaactattt

SEQ ID NO: 170551 - DNA, 25 bp, Mus musculus
aatgtttcacagatagaagctttgg

SEQ ID NO: 170552 - DNA, 25 bp, Mus musculus
aatgtttcacagttcttccagaaag

SEQ ID NO: 170553 - DNA, 25 bp, Mus musculus
aatgtttcaggacagtcggcccaat

SEQ ID NO: 170554 - DNA, 25 bp, Mus musculus
aatgtttccaaggatctgttaagat

SEQ ID NO: 170555 - DNA, 25 bp, Mus musculus
aatgtttccaagtgttcatggatgt

SEQ ID NO: 170556 - DNA, 25 bp, Mus musculus
aatgtttctggtggaacaccagtac

SEQ ID NO: 170557 - DNA, 25 bp, Mus musculus
aatgtttctgtgtgagtgcatgcgg

SEQ ID NO: 170558 - DNA, 25 bp, Mus musculus
aatgtttgaagcgacagcagtctcc

SEQ ID NO: 170559 - DNA, 25 bp, Mus musculus
aatgtttgccagaaatgtgcaaact

SEQ ID NO: 170560 - DNA, 25 bp, Mus musculus
aatgtttgccagacacgcgaaaaga

SEQ ID NO: 170561 - DNA, 25 bp, Mus musculus
aatgtttgcctgggaaatgctcata

SEQ ID NO: 170562 - DNA, 25 bp, Mus musculus
aatgtttggtcaatttggtaaaata

SEQ ID NO: 170563 - DNA, 25 bp, Mus musculus
aatgtttgtgtgtggacaggccaaa

SEQ ID NO: 170564 - DNA, 25 bp, Mus musculus
aatgttttaagttcctgaatgccac

SEQ ID NO: 170565 - DNA, 25 bp, Mus musculus
aatgttttctggagtgacactagca

SEQ ID NO: 170566 - DNA, 25 bp, Mus musculus
aatgttttgatacagtcaccaagga

SEQ ID NO: 170567 - DNA, 25 bp, Mus musculus
aattaaaaagacgctgaacccaaag

SEQ ID NO: 170568 - DNA, 25 bp, Mus musculus
aattaaaaatgatgtcttcatttgt

SEQ ID NO: 170569 - DNA, 25 bp, Mus musculus
aattaaaattcagcctttagaaagg

SEQ ID NO: 170570 - DNA, 25 bp, Mus musculus
aattaaaattcaggctgtagctgtt

SEQ ID NO: 170571 - DNA, 25 bp, Mus musculus
aattaaacaggcatgatgcacagct

SEQ ID NO: 170572 - DNA, 25 bp, Mus musculus
aattaaacataaaagaaattgcatg

SEQ ID NO: 170573 - DNA, 25 bp, Mus musculus
aattaaacctaatgcttgcattggg

SEQ ID NO: 170574 - DNA, 25 bp, Mus musculus
aattaaactaggcctgaggagcgat

SEQ ID NO: 170575 - DNA, 25 bp, Mus musculus
aattaaagaagtataataagcccag

SEQ ID NO: 170576 - DNA, 25 bp, Mus musculus
aattaaagtgaagacgctgactggg

SEQ ID NO: 170577 - DNA, 25 bp, Mus musculus
aattaaagtgaagtccaccacagaa

SEQ ID NO: 170578 - DNA, 25 bp, Mus musculus
aattaaagtggcagcttgacttggc

SEQ ID NO: 170579 - DNA, 25 bp, Mus musculus
aattaaatgccttgatgggaaccca

SEQ ID NO: 170580 - DNA, 25 bp, Mus musculus
aattaagacgaagatggccaagctg

SEQ ID NO: 170581 - DNA, 25 bp, Mus musculus
aattaagacgaagggcaaggaggcc

SEQ ID NO: 170582 - DNA, 25 bp, Mus musculus
aattaagcaagatgagaagccagct

SEQ ID NO: 170583 - DNA, 25 bp, Mus musculus
aattaagcaaggctgtggacttaag

SEQ ID NO: 170584 - DNA, 25 bp, Mus musculus
aattaaggaagttacaatgattttg

SEQ ID NO: 170585 - DNA, 25 bp, Mus musculus
aattaatatatgatcctgaaaaagc

SEQ ID NO: 170586 - DNA, 25 bp, Mus musculus
aattaatgtggcagatatcattaat

SEQ ID NO: 170587 - DNA, 25 bp, Mus musculus
aattacaaaggtggctttgacactg

SEQ ID NO: 170588 - DNA, 25 bp, Mus musculus
aattacaaatacgatacactaaaga

SEQ ID NO: 170589 - DNA, 25 bp, Mus musculus
aattacaaatacggtacccatgtga

SEQ ID NO: 170590 - DNA, 25 bp, Mus musculus
aattacaagatagcgggacacggct

SEQ ID NO: 170591 - DNA, 25 bp, Mus musculus
aattacaagtgtaaagtagtcgccg

SEQ ID NO: 170592 - DNA, 25 bp, Mus musculus
aattacaagtgtgaagtagtcgccg

SEQ ID NO: 170593 - DNA, 25 bp, Mus musculus
aattacaattgagaccaggccatgc

SEQ ID NO: 170594 - DNA, 25 bp, Mus musculus
aattacacatttttgttgtgaagtt

SEQ ID NO: 170595 - DNA, 25 bp, Mus musculus
aattacagaaggtcaccagaaagac

SEQ ID NO: 170596 - DNA, 25 bp, Mus musculus
aattacagagcatgaaatgcattga

SEQ ID NO: 170597 - DNA, 25 bp, Mus musculus
aattacagataaggaactgctgaag

SEQ ID NO: 170598 - DNA, 25 bp, Mus musculus
aattacagataaggtgttctcattg

SEQ ID NO: 170599 - DNA, 25 bp, Mus musculus
aattacataaaagaggaactcatta

SEQ ID NO: 170600 - DNA, 25 bp, Mus musculus
aattacataagcccatggatgggat

SEQ ID NO: 170601 - DNA, 25 bp, Mus musculus
aattacatcaagaagtccaaggttg

SEQ ID NO: 170602 - DNA, 25 bp, Mus musculus
aattacatcacgaatccagttcact

SEQ ID NO: 170603 - DNA, 25 bp, Mus musculus
aattaccaacgattgaaaaatgcag

SEQ ID NO: 170604 - DNA, 25 bp, Mus musculus
aattaccagcctcagattcagcgtt

SEQ ID NO: 170605 - DNA, 25 bp, Mus musculus
aattaccagtgatatgctgtggaag

SEQ ID NO: 170606 - DNA, 25 bp, Mus musculus
aattaccccaagcattcttgaagta

SEQ ID NO: 170607 - DNA, 25 bp, Mus musculus
aattaccctaagttatacattgatg

SEQ ID NO: 170608 - DNA, 25 bp, Mus musculus
aattaccgatggatctggtggccct

SEQ ID NO: 170609 - DNA, 25 bp, Mus musculus
aattacctgaaggatgggccttaca

SEQ ID NO: 170610 - DNA, 25 bp, Mus musculus
aattacctgaaggttgggccttaca

SEQ ID NO: 170611 - DNA, 25 bp, Mus musculus
aattacctgagcacccagttgatga

SEQ ID NO: 170612 - DNA, 25 bp, Mus musculus
aattacctgtgatgtctcacaccat

SEQ ID NO: 170613 - DNA, 25 bp, Mus musculus
aattacgccacttatggatgtaggt

SEQ ID NO: 170614 - DNA, 25 bp, Mus musculus
aattacgtgaagagagggcacatct

SEQ ID NO: 170615 - DNA, 25 bp, Mus musculus
aattacgtggagaggtcaacagtct

SEQ ID NO: 170616 - DNA, 25 bp, Mus musculus
aattactaagtggaggttccatgtt

SEQ ID NO: 170617 - DNA, 25 bp, Mus musculus
aattactacaagggccagtatatcc

SEQ ID NO: 170618 - DNA, 25 bp, Mus musculus
aattactatagagaataggtcaaag

SEQ ID NO: 170619 - DNA, 25 bp, Mus musculus
aattactataggctgcagaagagga

SEQ ID NO: 170620 - DNA, 25 bp, Mus musculus
aattactgagacaacactggtagcc

SEQ ID NO: 170621 - DNA, 25 bp, Mus musculus
aattactgagcaaattgctgttact

SEQ ID NO: 170622 - DNA, 25 bp, Mus musculus
aattactgcaacagctttttctaaa

SEQ ID NO: 170623 - DNA, 25 bp, Mus musculus
aattactgctaccgccatcttagaa

SEQ ID NO: 170624 - DNA, 25 bp, Mus musculus
aattactgctaccgctgtggcaatg

SEQ ID NO: 170625 - DNA, 25 bp, Mus musculus
aattactgtcgagagaagggtttct

SEQ ID NO: 170626 - DNA, 25 bp, Mus musculus
aattactttctggatgagcagaagc

SEQ ID NO: 170627 - DNA, 25 bp, Mus musculus
aattagaatggcagggacggtcaag

SEQ ID NO: 170628 - DNA, 25 bp, Mus musculus
aattagcaaaagtgcttggctgtct

SEQ ID NO: 170629 - DNA, 25 bp, Mus musculus
aattagcatctgacattgagattct

SEQ ID NO: 170630 - DNA, 25 bp, Mus musculus
aattagccctctttgaaccctgaaa

SEQ ID NO: 170631 - DNA, 25 bp, Mus musculus
aattagccctgtcttcttcccgtgt

SEQ ID NO: 170632 - DNA, 25 bp, Mus musculus
aattagcttttatggcgcgagcttc

SEQ ID NO: 170633 - DNA, 25 bp, Mus musculus
aattaggagttgaatgcccaaagga

SEQ ID NO: 170634 - DNA, 25 bp, Mus musculus
aattaggcagcaaaacataaagaac

SEQ ID NO: 170635 - DNA, 25 bp, Mus musculus
aattaggttctcaggctattgatac

SEQ ID NO: 170636 - DNA, 25 bp, Mus musculus
aattagtgcaggaaaacccaaccac

SEQ ID NO: 170637 - DNA, 25 bp, Mus musculus
aattagttgttcaagagaaaccatt

SEQ ID NO: 170638 - DNA, 25 bp, Mus musculus
aattagttgttcaagatgggagaat

SEQ ID NO: 170639 - DNA, 25 bp, Mus musculus
aattataaaaaggcacagaagaatg

SEQ ID NO: 170640 - DNA, 25 bp, Mus musculus
aattataagcaaattctacggtgag

SEQ ID NO: 170641 - DNA, 25 bp, Mus musculus
aattataatcaggctggccagctaa

SEQ ID NO: 170642 - DNA, 25 bp, Mus musculus
aattataatgaaaaggtaatgtatg

SEQ ID NO: 170643 - DNA, 25 bp, Mus musculus
aattataatttcaaggttgattctt

SEQ ID NO: 170644 - DNA, 25 bp, Mus musculus
aattatataccaaaggttcaaaaga

SEQ ID NO: 170645 - DNA, 25 bp, Mus musculus
aattatcacaatgaggttgacattg

SEQ ID NO: 170646 - DNA, 25 bp, Mus musculus
aattatcatccaggccattccccag

SEQ ID NO: 170647 - DNA, 25 bp, Mus musculus
aattatcctgcaagggagcccggtg

SEQ ID NO: 170648 - DNA, 25 bp, Mus musculus
aattatccttaagatgactgcttac

SEQ ID NO: 170649 - DNA, 25 bp, Mus musculus
aattatgaacagattgatgacattg

SEQ ID NO: 170650 - DNA, 25 bp, Mus musculus
aattatgaagagtttgtacagatga

SEQ ID NO: 170651 - DNA, 25 bp, Mus musculus
aattatgacactatttttgaagact

SEQ ID NO: 170652 - DNA, 25 bp, Mus musculus
aattatgagcagcatcagtatgaga

SEQ ID NO: 170653 - DNA, 25 bp, Mus musculus
aattatgagcaggatcagtatgaga

SEQ ID NO: 170654 - DNA, 25 bp, Mus musculus
aattatgatgcatccgatgtcgtcc

SEQ ID NO: 170655 - DNA, 25 bp, Mus musculus
aattatgatgcatcggatgtcgtcc

SEQ ID NO: 170656 - DNA, 25 bp, Mus musculus
aattatgggacctaatgacagccca

SEQ ID NO: 170657 - DNA, 25 bp, Mus musculus
aattatgggacctctcaatgaaagt

SEQ ID NO: 170658 - DNA, 25 bp, Mus musculus
aattattacaggtaatgaagaagga

SEQ ID NO: 170659 - DNA, 25 bp, Mus musculus
aattattcaagaacaggacgcgggt

SEQ ID NO: 170660 - DNA, 25 bp, Mus musculus
aattattcaagagatcatcgatgac

SEQ ID NO: 170661 - DNA, 25 bp, Mus musculus
aattattcacgacagtgttgaaggc

SEQ ID NO: 170662 - DNA, 25 bp, Mus musculus
aattattctgctcttcctcccctcc

SEQ ID NO: 170663 - DNA, 25 bp, Mus musculus
aattattgttaaaggaaattcgata

SEQ ID NO: 170664 - DNA, 25 bp, Mus musculus
aattatttcaaaatggagctgaagt

SEQ ID NO: 170665 - DNA, 25 bp, Mus musculus
aattatttcagagtgccagaaggct

SEQ ID NO: 170666 - DNA, 25 bp, Mus musculus
aattatttcaggtggatctaaagac

SEQ ID NO: 170667 - DNA, 25 bp, Mus musculus
aattatttcggcaggaattagctct

SEQ ID NO: 170668 - DNA, 25 bp, Mus musculus
aattatttcggcaggcaatacggaa

SEQ ID NO: 170669 - DNA, 25 bp, Mus musculus
aattattttcagagaagcagaagat

SEQ ID NO: 170670 - DNA, 25 bp, Mus musculus
aattcaaaagaattactcagaaggg

SEQ ID NO: 170671 - DNA, 25 bp, Mus musculus
aattcaaaagatagtgttttgggtg

SEQ ID NO: 170672 - DNA, 25 bp, Mus musculus
aattcaaaagctgccgttcggctct

SEQ ID NO: 170673 - DNA, 25 bp, Mus musculus
aattcaaatgaactaactacttgat

SEQ ID NO: 170674 - DNA, 25 bp, Mus musculus
aattcaaatgaactgggaaactaga

SEQ ID NO: 170675 - DNA, 25 bp, Mus musculus
aattcaaatgttgtggcagaatacc

SEQ ID NO: 170676 - DNA, 25 bp, Mus musculus
aattcaaatgttgtgtcctctgttg

SEQ ID NO: 170677 - DNA, 25 bp, Mus musculus
aattcaaatttcatggctacctctg

SEQ ID NO: 170678 - DNA, 25 bp, Mus musculus
aattcaaattttgctacaaaaggca

SEQ ID NO: 170679 - DNA, 25 bp, Mus musculus
aattcaaattttggcacgcagctac

SEQ ID NO: 170680 - DNA, 25 bp, Mus musculus
aattcaacaagaatttggatgtatc

SEQ ID NO: 170681 - DNA, 25 bp, Mus musculus
aattcaacaaggtgtcggtgctgac

SEQ ID NO: 170682 - DNA, 25 bp, Mus musculus
aattcaacagacaagtcaagagcaa

SEQ ID NO: 170683 - DNA, 25 bp, Mus musculus
aattcaagagtatggggaaaaagag

SEQ ID NO: 170684 - DNA, 25 bp, Mus musculus
aattcaagagtattcggggaaacct

SEQ ID NO: 170685 - DNA, 25 bp, Mus musculus
aattcaagcagagggttcgcaaaga

SEQ ID NO: 170686 - DNA, 25 bp, Mus musculus
aattcaagcagatttacaagggccc

SEQ ID NO: 170687 - DNA, 25 bp, Mus musculus
aattcaagctatgatgaccagacct

SEQ ID NO: 170688 - DNA, 25 bp, Mus musculus
aattcaaggagctgcaacaacattt

SEQ ID NO: 170689 - DNA, 25 bp, Mus musculus
aattcaagtcctgagatgagccgcc

SEQ ID NO: 170690 - DNA, 25 bp, Mus musculus
aattcaagtcctgctctacagaggg

SEQ ID NO: 170691 - DNA, 25 bp, Mus musculus
aattcaagtcctggtgtggaggctg

SEQ ID NO: 170692 - DNA, 25 bp, Mus musculus
aattcaagtgttggactggaacttc

SEQ ID NO: 170693 - DNA, 25 bp, Mus musculus
aattcaagtgttggcagcagtggtg

SEQ ID NO: 170694 - DNA, 25 bp, Mus musculus
aattcaagttagttgatctgcctgc

SEQ ID NO: 170695 - DNA, 25 bp, Mus musculus
aattcaagtttttataatgtaaagc

SEQ ID NO: 170696 - DNA, 25 bp, Mus musculus
aattcaagttttttgatttgtctat

SEQ ID NO: 170697 - DNA, 25 bp, Mus musculus
aattcaatcacgcagtcatgtttac

SEQ ID NO: 170698 - DNA, 25 bp, Mus musculus
aattcaatcacgcagtggatcgtag

SEQ ID NO: 170699 - DNA, 25 bp, Mus musculus
aattcacaaaagggaaggatctgtc

SEQ ID NO: 170700 - DNA, 25 bp, Mus musculus
aattcacacagaagtgctgtcgact

SEQ ID NO: 170701 - DNA, 25 bp, Mus musculus
aattcacaccgaaactatgttccaa

SEQ ID NO: 170702 - DNA, 25 bp, Mus musculus
aattcacatgagctgtttcagaaag

SEQ ID NO: 170703 - DNA, 25 bp, Mus musculus
aattcacattcaggcacaccaagat

SEQ ID NO: 170704 - DNA, 25 bp, Mus musculus
aattcacgacgggatgtttcggaag

SEQ ID NO: 170705 - DNA, 25 bp, Mus musculus
aattcactgttcagcccacagtgag

SEQ ID NO: 170706 - DNA, 25 bp, Mus musculus
aattcactgttcaggcatccgaagg

SEQ ID NO: 170707 - DNA, 25 bp, Mus musculus
aattcacttagacagacttacaaca

SEQ ID NO: 170708 - DNA, 25 bp, Mus musculus
aattcagaaacagtggaagcatcag

SEQ ID NO: 170709 - DNA, 25 bp, Mus musculus
aattcagaaagagagtcctgttgaa

SEQ ID NO: 170710 - DNA, 25 bp, Mus musculus
aattcagaaaggagttcgtgaagtg

SEQ ID NO: 170711 - DNA, 25 bp, Mus musculus
aattcagaatgtctctcatgttacc

SEQ ID NO: 170712 - DNA, 25 bp, Mus musculus
aattcagaatgttgttcagatgtca

SEQ ID NO: 170713 - DNA, 25 bp, Mus musculus
aattcagacacaatggcctgtgagt

SEQ ID NO: 170714 - DNA, 25 bp, Mus musculus
aattcaggaagcacagaccaagcgg

SEQ ID NO: 170715 - DNA, 25 bp, Mus musculus
aattcaggggggaggatgacttgtg

SEQ ID NO: 170716 - DNA, 25 bp, Mus musculus
aattcagtgaggccttggaaactgg

SEQ ID NO: 170717 - DNA, 25 bp, Mus musculus
aattcagtgaggtcaaaggactgga

SEQ ID NO: 170718 - DNA, 25 bp, Mus musculus
aattcatacagattcatctgaaaac

SEQ ID NO: 170719 - DNA, 25 bp, Mus musculus
aattcatacaggtcccatggcctct

SEQ ID NO: 170720 - DNA, 25 bp, Mus musculus
aattcatatgggtaactgtgctgag

SEQ ID NO: 170721 - DNA, 25 bp, Mus musculus
aattcatccaggtcaagtggagaag

SEQ ID NO: 170722 - DNA, 25 bp, Mus musculus
aattcatccaggttcttaaattcct

SEQ ID NO: 170723 - DNA, 25 bp, Mus musculus
aattcatcttaggtcgggatggtgg

SEQ ID NO: 170724 - DNA, 25 bp, Mus musculus
aattcatgaacgagtttttcttaaa

SEQ ID NO: 170725 - DNA, 25 bp, Mus musculus
aattcatgcagatgaatgagaacag

SEQ ID NO: 170726 - DNA, 25 bp, Mus musculus
aattcatgcagcactatgccttcct

SEQ ID NO: 170727 - DNA, 25 bp, Mus musculus
aattcatgcgagggagaactggtgg

SEQ ID NO: 170728 - DNA, 25 bp, Mus musculus
aattcattgtggaggtcaacgtcct

SEQ ID NO: 170729 - DNA, 25 bp, Mus musculus
aattccaaaacactgtaacatggca

SEQ ID NO: 170730 - DNA, 25 bp, Mus musculus
aattccaagcaattttcaacatgga

SEQ ID NO: 170731 - DNA, 25 bp, Mus musculus
aattccaatgatgttgcaaaatcta

SEQ ID NO: 170732 - DNA, 25 bp, Mus musculus
aattccaatgcaaacaagaatgccg

SEQ ID NO: 170733 - DNA, 25 bp, Mus musculus
aattccacaagctgatcaacgtcac

SEQ ID NO: 170734 - DNA, 25 bp, Mus musculus
aattccaccagcagtatgagccccg

SEQ ID NO: 170735 - DNA, 25 bp, Mus musculus
aattccaccccggccccagctggag

SEQ ID NO: 170736 - DNA, 25 bp, Mus musculus
aattccacggacctagactcagcac

SEQ ID NO: 170737 - DNA, 25 bp, Mus musculus
aattccacttgactgggacgtggaa

SEQ ID NO: 170738 - DNA, 25 bp, Mus musculus
aattccagaaagatggaaccgccct

SEQ ID NO: 170739 - DNA, 25 bp, Mus musculus
aattccagaaagtgtctatcgcagc

SEQ ID NO: 170740 - DNA, 25 bp, Mus musculus
aattccagaacaagattcttttcgt

SEQ ID NO: 170741 - DNA, 25 bp, Mus musculus
aattccagaacaagtttccatagaa

SEQ ID NO: 170742 - DNA, 25 bp, Mus musculus
aattccagacacaagtacccaccat

SEQ ID NO: 170743 - DNA, 25 bp, Mus musculus
aattccagacagcttttcaagatct

SEQ ID NO: 170744 - DNA, 25 bp, Mus musculus
aattccagctgatggagacctgaca

SEQ ID NO: 170745 - DNA, 25 bp, Mus musculus
aattccagctgggtgagtctgtaaa

SEQ ID NO: 170746 - DNA, 25 bp, Mus musculus
aattccatattattataaatgagga

SEQ ID NO: 170747 - DNA, 25 bp, Mus musculus
aattccatctgctcccagaattacc

SEQ ID NO: 170748 - DNA, 25 bp, Mus musculus
aattccatgccgggttgcttcctag

SEQ ID NO: 170749 - DNA, 25 bp, Mus musculus
aattccatttaacgttctgatgaac

SEQ ID NO: 170750 - DNA, 25 bp, Mus musculus
aattccatttaattgtaaatgaaga

SEQ ID NO: 170751 - DNA, 25 bp, Mus musculus
aattcccaaatggatgacaagtggg

SEQ ID NO: 170752 - DNA, 25 bp, Mus musculus
aattcccaaatggattttctctata

SEQ ID NO: 170753 - DNA, 25 bp, Mus musculus
aattcccaatgagttgccatataat

SEQ ID NO: 170754 - DNA, 25 bp, Mus musculus
aattcccagcctaggcgaaacctga

SEQ ID NO: 170755 - DNA, 25 bp, Mus musculus
aattcccatctcatttgaaaatgtg

SEQ ID NO: 170756 - DNA, 25 bp, Mus musculus
aattccccagaaattgatgagaaga

SEQ ID NO: 170757 - DNA, 25 bp, Mus musculus
aattccccaggcgttaagcatctga

SEQ ID NO: 170758 - DNA, 25 bp, Mus musculus
aattccctctgacaaaaggcttgat

SEQ ID NO: 170759 - DNA, 25 bp, Mus musculus
aattccctggacaagctgtggccag

SEQ ID NO: 170760 - DNA, 25 bp, Mus musculus
aattcccttaggaacctcctctggg

SEQ ID NO: 170761 - DNA, 25 bp, Mus musculus
aattcccttggatttcagtttttct

SEQ ID NO: 170762 - DNA, 25 bp, Mus musculus
aattccggagctggactgaactttt

SEQ ID NO: 170763 - DNA, 25 bp, Mus musculus
aattcctaaaagcagccaacaagaa

SEQ ID NO: 170764 - DNA, 25 bp, Mus musculus
aattcctaccacagaaactgcactt

SEQ ID NO: 170765 - DNA, 25 bp, Mus musculus
aattcctcaaggagtcacctgggag

SEQ ID NO: 170766 - DNA, 25 bp, Mus musculus
aattcctcaaggcacttaggcagaa

SEQ ID NO: 170767 - DNA, 25 bp, Mus musculus
aattcctcaagggggaggataagaa

SEQ ID NO: 170768 - DNA, 25 bp, Mus musculus
aattcctcacagacacactggatgc

SEQ ID NO: 170769 - DNA, 25 bp, Mus musculus
aattcctccaggagtacatcataaa

SEQ ID NO: 170770 - DNA, 25 bp, Mus musculus
aattcctccaggtcatcgtcacggt

SEQ ID NO: 170771 - DNA, 25 bp, Mus musculus
aattcctcccctggctagagcatgg

SEQ ID NO: 170772 - DNA, 25 bp, Mus musculus
aattcctctacgctgagcggcagcc

SEQ ID NO: 170773 - DNA, 25 bp, Mus musculus
aattcctgaaacagagaagcccgtg

SEQ ID NO: 170774 - DNA, 25 bp, Mus musculus
aattcctgaagaaaggaactgtcgt

SEQ ID NO: 170775 - DNA, 25 bp, Mus musculus
aattcctgaagaaagtggtatcccg

SEQ ID NO: 170776 - DNA, 25 bp, Mus musculus
aattcctgaggtaaaggggaatgct

SEQ ID NO: 170777 - DNA, 25 bp, Mus musculus
aattcctgaggttcttaatatgttc

SEQ ID NO: 170778 - DNA, 25 bp, Mus musculus
aattcctgatctccgcatctcttcg

SEQ ID NO: 170779 - DNA, 25 bp, Mus musculus
aattcctgctgctgaactaaccttt

SEQ ID NO: 170780 - DNA, 25 bp, Mus musculus
aattccttagagcagaacatctggc

SEQ ID NO: 170781 - DNA, 25 bp, Mus musculus
aattccttcaggtgcacgcctcctc

SEQ ID NO: 170782 - DNA, 25 bp, Mus musculus
aattccttggaggactcaaggaaat

SEQ ID NO: 170783 - DNA, 25 bp, Mus musculus
aattccttggaggttcattctgtgg

SEQ ID NO: 170784 - DNA, 25 bp, Mus musculus
aattccttggctcatcagcagttat

SEQ ID NO: 170785 - DNA, 25 bp, Mus musculus
aattccttggggtaatgatgtgggc

SEQ ID NO: 170786 - DNA, 25 bp, Mus musculus
aattcgaactggtgttgatcagtgt

SEQ ID NO: 170787 - DNA, 25 bp, Mus musculus
aattcgagaaagaagcctcaggtac

SEQ ID NO: 170788 - DNA, 25 bp, Mus musculus
aattcgagaagtcaaccatccaaaa

SEQ ID NO: 170789 - DNA, 25 bp, Mus musculus
aattcgatccaggctccccggctgt

SEQ ID NO: 170790 - DNA, 25 bp, Mus musculus
aattcgatccaggtgctaccaagta

SEQ ID NO: 170791 - DNA, 25 bp, Mus musculus
aattcgcacagtggggtcggttacg

SEQ ID NO: 170792 - DNA, 25 bp, Mus musculus
aattcgcacagtgtgtgttttgtgc

SEQ ID NO: 170793 - DNA, 25 bp, Mus musculus
aattcgcgacatgaatggaatgacc

SEQ ID NO: 170794 - DNA, 25 bp, Mus musculus
aattcgcgacatgatctacttctcc

SEQ ID NO: 170795 - DNA, 25 bp, Mus musculus
aattcgcgcctggagtctcactgtt

SEQ ID NO: 170796 - DNA, 25 bp, Mus musculus
aattcgtctgaggaagaatgtttct

SEQ ID NO: 170797 - DNA, 25 bp, Mus musculus
aattcgtgcaccgtaacgtacctga

SEQ ID NO: 170798 - DNA, 25 bp, Mus musculus
aattcgtggaagaggtaaagagaga

SEQ ID NO: 170799 - DNA, 25 bp, Mus musculus
aattctaacagagatataccgcatt

SEQ ID NO: 170800 - DNA, 25 bp, Mus musculus
aattctacccatttctcccaagtgc

SEQ ID NO: 170801 - DNA, 25 bp, Mus musculus
aattctaccgcaacgtggtctccat

SEQ ID NO: 170802 - DNA, 25 bp, Mus musculus
aattctactactgggactcgtactg

SEQ ID NO: 170803 - DNA, 25 bp, Mus musculus
aattctagaaggttttctgtccaca

SEQ ID NO: 170804 - DNA, 25 bp, Mus musculus
aattctagctgtcgggacacagatt

SEQ ID NO: 170805 - DNA, 25 bp, Mus musculus
aattctatacacaggtgattttcga

SEQ ID NO: 170806 - DNA, 25 bp, Mus musculus
aattctataggtcctgagggaggca

SEQ ID NO: 170807 - DNA, 25 bp, Mus musculus
aattctatcacagagctgtttggat

SEQ ID NO: 170808 - DNA, 25 bp, Mus musculus
aattctatgctaataacatgtacct

SEQ ID NO: 170809 - DNA, 25 bp, Mus musculus
aattctcaaaacccaatgatgagtg

SEQ ID NO: 170810 - DNA, 25 bp, Mus musculus
aattctcaaaatgttcaagccatat

SEQ ID NO: 170811 - DNA, 25 bp, Mus musculus
aattctcaagccagtaaaaaagaag

SEQ ID NO: 170812 - DNA, 25 bp, Mus musculus
aattctcaagtcacgaacccctgcc

SEQ ID NO: 170813 - DNA, 25 bp, Mus musculus
aattctcacataaaggctgaaggtg

SEQ ID NO: 170814 - DNA, 25 bp, Mus musculus
aattctcacgcaagaccctgactgc

SEQ ID NO: 170815 - DNA, 25 bp, Mus musculus
aattctcagtcaggagagaattcag

SEQ ID NO: 170816 - DNA, 25 bp, Mus musculus
aattctcatcaaggataacagcaag

SEQ ID NO: 170817 - DNA, 25 bp, Mus musculus
aattctccaagaatgggaaatgcac

SEQ ID NO: 170818 - DNA, 25 bp, Mus musculus
aattctccaaggtggctggacccga

SEQ ID NO: 170819 - DNA, 25 bp, Mus musculus
aattctccagcaaggcatgatcacc

SEQ ID NO: 170820 - DNA, 25 bp, Mus musculus
aattctccagcaagttacagtccct

SEQ ID NO: 170821 - DNA, 25 bp, Mus musculus
aattctccagccaatgctgactacc

SEQ ID NO: 170822 - DNA, 25 bp, Mus musculus
aattctccattgaaatgttgtcctt

SEQ ID NO: 170823 - DNA, 25 bp, Mus musculus
aattctccccaggaaaatacagaag

SEQ ID NO: 170824 - DNA, 25 bp, Mus musculus
aattctcttcagtaccgggaggtgg

SEQ ID NO: 170825 - DNA, 25 bp, Mus musculus
aattctgaaatacgattcagatggt

SEQ ID NO: 170826 - DNA, 25 bp, Mus musculus
aattctgaagaggacagctcttaca

SEQ ID NO: 170827 - DNA, 25 bp, Mus musculus
aattctgagggactaactacgacca

SEQ ID NO: 170828 - DNA, 25 bp, Mus musculus
aattctgatgtactaaaaatcactg

SEQ ID NO: 170829 - DNA, 25 bp, Mus musculus
aattctgcactaggctccgcaggag

SEQ ID NO: 170830 - DNA, 25 bp, Mus musculus
aattctgcagacccatgcagatgca

SEQ ID NO: 170831 - DNA, 25 bp, Mus musculus
aattctgcaggtatccaacggttgt

SEQ ID NO: 170832 - DNA, 25 bp, Mus musculus
aattctgcaggtcacgtacagtgct

SEQ ID NO: 170833 - DNA, 25 bp, Mus musculus
aattctgccagataaaacacggacc

SEQ ID NO: 170834 - DNA, 25 bp, Mus musculus
aattctgccagatactggatttatg

SEQ ID NO: 170835 - DNA, 25 bp, Mus musculus
aattctgcctcaggacctcttcctg

SEQ ID NO: 170836 - DNA, 25 bp, Mus musculus
aattctgcgggctttgcttaaatcc

SEQ ID NO: 170837 - DNA, 25 bp, Mus musculus
aattctggatgaagctgtagcaatg

SEQ ID NO: 170838 - DNA, 25 bp, Mus musculus
aattctggcaggaagcagtgaagca

SEQ ID NO: 170839 - DNA, 25 bp, Mus musculus
aattctggcaggacatgaagctatt

SEQ ID NO: 170840 - DNA, 25 bp, Mus musculus
aattctggcaggtagtgctgcccta

SEQ ID NO: 170841 - DNA, 25 bp, Mus musculus
aattctggtgagtatgcagctgata

SEQ ID NO: 170842 - DNA, 25 bp, Mus musculus
aattctgttagacagaatggcaatc

SEQ ID NO: 170843 - DNA, 25 bp, Mus musculus
aattctgttcaggaggaagcagaaa

SEQ ID NO: 170844 - DNA, 25 bp, Mus musculus
aattctgtttcgatctatgtaagag

SEQ ID NO: 170845 - DNA, 25 bp, Mus musculus
aattctgtttcggacttgccatcaa

SEQ ID NO: 170846 - DNA, 25 bp, Mus musculus
aattcttataaatgtttatgtctgg

SEQ ID NO: 170847 - DNA, 25 bp, Mus musculus
aattcttcaacgagcgggctgagcg

SEQ ID NO: 170848 - DNA, 25 bp, Mus musculus
aattcttcaaggactggggatctcg

SEQ ID NO: 170849 - DNA, 25 bp, Mus musculus
aattcttcaaggtggtacctcatca

SEQ ID NO: 170850 - DNA, 25 bp, Mus musculus
aattcttcacctactacagacaagt

SEQ ID NO: 170851 - DNA, 25 bp, Mus musculus
aattcttcaccttctacagacaagt

SEQ ID NO: 170852 - DNA, 25 bp, Mus musculus
aattcttctatacagaaactgcact

SEQ ID NO: 170853 - DNA, 25 bp, Mus musculus
aattcttctgcaagcactgcagaga

SEQ ID NO: 170854 - DNA, 25 bp, Mus musculus
aattcttctttcctgactgatggcg

SEQ ID NO: 170855 - DNA, 25 bp, Mus musculus
aattcttgatgagacctctttgaca

SEQ ID NO: 170856 - DNA, 25 bp, Mus musculus
aattcttgcaaaaagacacacctgc

SEQ ID NO: 170857 - DNA, 25 bp, Mus musculus
aattcttgcaaaaagaggtctccaa

SEQ ID NO: 170858 - DNA, 25 bp, Mus musculus
aattcttgcagacacctttgtcctg

SEQ ID NO: 170859 - DNA, 25 bp, Mus musculus
aattcttgcagatccgtctaccttg

SEQ ID NO: 170860 - DNA, 25 bp, Mus musculus
aattcttgtcataaaaatatgacag

SEQ ID NO: 170861 - DNA, 25 bp, Mus musculus
aattctttaagttcaagtttggacg

SEQ ID NO: 170862 - DNA, 25 bp, Mus musculus
aattctttcttttgggagcctcaat

SEQ ID NO: 170863 - DNA, 25 bp, Mus musculus
aattctttcttttgggagtgagtgt

SEQ ID NO: 170864 - DNA, 25 bp, Mus musculus
aattctttgtacacaatgccaaaga

SEQ ID NO: 170865 - DNA, 25 bp, Mus musculus
aattctttgtacacagcccactttt

SEQ ID NO: 170866 - DNA, 25 bp, Mus musculus
aattgaaaagtttctagatgttgtg

SEQ ID NO: 170867 - DNA, 25 bp, Mus musculus
aattgaaactggaagcatatattca

SEQ ID NO: 170868 - DNA, 25 bp, Mus musculus
aattgaaatcacagctcccgagggt

SEQ ID NO: 170869 - DNA, 25 bp, Mus musculus
aattgaaatcagggaagctgctcac

SEQ ID NO: 170870 - DNA, 25 bp, Mus musculus
aattgaacctgcaggtactaacacc

SEQ ID NO: 170871 - DNA, 25 bp, Mus musculus
aattgaacctgcaggtcttttcatg

SEQ ID NO: 170872 - DNA, 25 bp, Mus musculus
aattgaactcaggccatattcccaa

SEQ ID NO: 170873 - DNA, 25 bp, Mus musculus
aattgaagaagcaacagactttatc

SEQ ID NO: 170874 - DNA, 25 bp, Mus musculus
aattgaagctggaaagcaaagatat

SEQ ID NO: 170875 - DNA, 25 bp, Mus musculus
aattgaagctgggtgttgaccagat

SEQ ID NO: 170876 - DNA, 25 bp, Mus musculus
aattgacaaccaatatcagtctctg

SEQ ID NO: 170877 - DNA, 25 bp, Mus musculus
aattgacaaccagacacgcataact

SEQ ID NO: 170878 - DNA, 25 bp, Mus musculus
aattgacagttgcttataggctctt

SEQ ID NO: 170879 - DNA, 25 bp, Mus musculus
aattgacccaaagatcttggcatat

SEQ ID NO: 170880 - DNA, 25 bp, Mus musculus
aattgaccctgagacgatccagaac

SEQ ID NO: 170881 - DNA, 25 bp, Mus musculus
aattgactacagaacacaagacttc

SEQ ID NO: 170882 - DNA, 25 bp, Mus musculus
aattgactacagatttcatatataa

SEQ ID NO: 170883 - DNA, 25 bp, Mus musculus
aattgactacaggaaactataagta

SEQ ID NO: 170884 - DNA, 25 bp, Mus musculus
aattgactctgtttcccacagtcag

SEQ ID NO: 170885 - DNA, 25 bp, Mus musculus
aattgagaaggcatacaaatgctct

SEQ ID NO: 170886 - DNA, 25 bp, Mus musculus
aattgagcaggccgcttggacatcg

SEQ ID NO: 170887 - DNA, 25 bp, Mus musculus
aattgagctcccaaggtggatgaag

SEQ ID NO: 170888 - DNA, 25 bp, Mus musculus
aattgagggaaggtccccaccctgc

SEQ ID NO: 170889 - DNA, 25 bp, Mus musculus
aattgagtattgggaatattacagc

SEQ ID NO: 170890 - DNA, 25 bp, Mus musculus
aattgatactaaaaggagacagtgg

SEQ ID NO: 170891 - DNA, 25 bp, Mus musculus
aattgatactaaaagtgaagcctgt

SEQ ID NO: 170892 - DNA, 25 bp, Mus musculus
aattgatcatgggccctggggagag

SEQ ID NO: 170893 - DNA, 25 bp, Mus musculus
aattgatccgatttggaacctggct

SEQ ID NO: 170894 - DNA, 25 bp, Mus musculus
aattgatccgtgtgccattgaaaga

SEQ ID NO: 170895 - DNA, 25 bp, Mus musculus
aattgatgagatggttggtaaaggc

SEQ ID NO: 170896 - DNA, 25 bp, Mus musculus
aattgattcactgagctcctgcaaa

SEQ ID NO: 170897 - DNA, 25 bp, Mus musculus
aattgattgaggactctcaaagaag

SEQ ID NO: 170898 - DNA, 25 bp, Mus musculus
aattgattgaggggtctcactctaa

SEQ ID NO: 170899 - DNA, 25 bp, Mus musculus
aattgcaaagaaaagacccaagtgc

SEQ ID NO: 170900 - DNA, 25 bp, Mus musculus
aattgcaaagataactgggaaaaag

SEQ ID NO: 170901 - DNA, 25 bp, Mus musculus
aattgcaaagatgtgtccaggtgtg

SEQ ID NO: 170902 - DNA, 25 bp, Mus musculus
aattgcaaagcttcagtggttctct

SEQ ID NO: 170903 - DNA, 25 bp, Mus musculus
aattgcaaagcttctgtggttctct

SEQ ID NO: 170904 - DNA, 25 bp, Mus musculus
aattgcaaaggaaggaaggtctgat

SEQ ID NO: 170905 - DNA, 25 bp, Mus musculus
aattgcaaagtgtactgggactaaa

SEQ ID NO: 170906 - DNA, 25 bp, Mus musculus
aattgcaccaggatctttctcaagt

SEQ ID NO: 170907 - DNA, 25 bp, Mus musculus
aattgcaccaggtgatgttattgta

SEQ ID NO: 170908 - DNA, 25 bp, Mus musculus
aattgcagaagggagagagtggcta

SEQ ID NO: 170909 - DNA, 25 bp, Mus musculus
aattgcagaaggtgcacatcaggga

SEQ ID NO: 170910 - DNA, 25 bp, Mus musculus
aattgcagatctgataaaaagagca

SEQ ID NO: 170911 - DNA, 25 bp, Mus musculus
aattgcagtctgtgatgctcccaat

SEQ ID NO: 170912 - DNA, 25 bp, Mus musculus
aattgccaactggtgctctgttgcc

SEQ ID NO: 170913 - DNA, 25 bp, Mus musculus
aattgccaagcctgtctcgctgctt

SEQ ID NO: 170914 - DNA, 25 bp, Mus musculus
aattgccaaggcagaagaggagctc

SEQ ID NO: 170915 - DNA, 25 bp, Mus musculus
aattgccaaggcaggtgcagtgaag

SEQ ID NO: 170916 - DNA, 25 bp, Mus musculus
aattgcccaagaacaaacctgtgat

SEQ ID NO: 170917 - DNA, 25 bp, Mus musculus
aattgcccaagagttaaccagctta

SEQ ID NO: 170918 - DNA, 25 bp, Mus musculus
aattgcccaaggtaataatcttcag

SEQ ID NO: 170919 - DNA, 25 bp, Mus musculus
aattgcccaggactcgttaatgttg

SEQ ID NO: 170920 - DNA, 25 bp, Mus musculus
aattgcccagtatttaacagacctg

SEQ ID NO: 170921 - DNA, 25 bp, Mus musculus
aattgcctggaaggttgagattgag

SEQ ID NO: 170922 - DNA, 25 bp, Mus musculus
aattgcctgtacacagagttctgcc

SEQ ID NO: 170923 - DNA, 25 bp, Mus musculus
aattgctaagaacaccagaaccgtg

SEQ ID NO: 170924 - DNA, 25 bp, Mus musculus
aattgctacaaaagatttaaagatg

SEQ ID NO: 170925 - DNA, 25 bp, Mus musculus
aattgctacaaaagcagcagcaaca

SEQ ID NO: 170926 - DNA, 25 bp, Mus musculus
aattgctacagctgggctgggagga

SEQ ID NO: 170927 - DNA, 25 bp, Mus musculus
aattgctacaggaggatctaagatg

SEQ ID NO: 170928 - DNA, 25 bp, Mus musculus
aattgctacagggtggttatgctgc

SEQ ID NO: 170929 - DNA, 25 bp, Mus musculus
aattgctacctcaggctctgaccat

SEQ ID NO: 170930 - DNA, 25 bp, Mus musculus
aattgctcaagagacattttaagtc

SEQ ID NO: 170931 - DNA, 25 bp, Mus musculus
aattgctcaagagtcctaaacctgg

SEQ ID NO: 170932 - DNA, 25 bp, Mus musculus
aattgctcaggaaaatggacaaagg

SEQ ID NO: 170933 - DNA, 25 bp, Mus musculus
aattgctcaggagcacagcgagctg

SEQ ID NO: 170934 - DNA, 25 bp, Mus musculus
aattgctcaggaggctttagaaagg

SEQ ID NO: 170935 - DNA, 25 bp, Mus musculus
aattgctcaggcgagagcaggcttt

SEQ ID NO: 170936 - DNA, 25 bp, Mus musculus
aattgctcagtgagcaaccctaatt

SEQ ID NO: 170937 - DNA, 25 bp, Mus musculus
aattgctctaaagatgactgcttac

SEQ ID NO: 170938 - DNA, 25 bp, Mus musculus
aattgctctacagagtgagcctagg

SEQ ID NO: 170939 - DNA, 25 bp, Mus musculus
aattgctctgataagtatggaacaa

SEQ ID NO: 170940 - DNA, 25 bp, Mus musculus
aattgctgagcaagagatgcctgcc

SEQ ID NO: 170941 - DNA, 25 bp, Mus musculus
aattgctgataagatctcccttgat

SEQ ID NO: 170942 - DNA, 25 bp, Mus musculus
aattgctgataagatgtctggtgag

SEQ ID NO: 170943 - DNA, 25 bp, Mus musculus
aattgctggccttcgttttcacaat

SEQ ID NO: 170944 - DNA, 25 bp, Mus musculus
aattgctgtggcactcagaaagaag

SEQ ID NO: 170945 - DNA, 25 bp, Mus musculus
aattgctttccagagacttcctgct

SEQ ID NO: 170946 - DNA, 25 bp, Mus musculus
aattggaaaagaggtccttctgtag

SEQ ID NO: 170947 - DNA, 25 bp, Mus musculus
aattggaaaagataaataaagacaa

SEQ ID NO: 170948 - DNA, 25 bp, Mus musculus
aattggaaaagatatgatgaggaat

SEQ ID NO: 170949 - DNA, 25 bp, Mus musculus
aattggaaaaggaatcttctatttg

SEQ ID NO: 170950 - DNA, 25 bp, Mus musculus
aattggaaaatgaaagttgtaagca

SEQ ID NO: 170951 - DNA, 25 bp, Mus musculus
aattggaaagacagtgatgtgactc

SEQ ID NO: 170952 - DNA, 25 bp, Mus musculus
aattggaaaggtatctggccaggaa

SEQ ID NO: 170953 - DNA, 25 bp, Mus musculus
aattggaaatcaggtgattcgtaag

SEQ ID NO: 170954 - DNA, 25 bp, Mus musculus
aattggaagaaaggtggtggtgtca

SEQ ID NO: 170955 - DNA, 25 bp, Mus musculus
aattggaagccaagatttcctggcc

SEQ ID NO: 170956 - DNA, 25 bp, Mus musculus
aattggaagccaagggtgtaaattc

SEQ ID NO: 170957 - DNA, 25 bp, Mus musculus
aattggaatcaggtggacagcagca

SEQ ID NO: 170958 - DNA, 25 bp, Mus musculus
aattggaatgaaggctcagatccga

SEQ ID NO: 170959 - DNA, 25 bp, Mus musculus
aattggacaggattggcccctgcca

SEQ ID NO: 170960 - DNA, 25 bp, Mus musculus
aattggacaggtccttcattttgag

SEQ ID NO: 170961 - DNA, 25 bp, Mus musculus
aattggaccactcaaatgggcatag

SEQ ID NO: 170962 - DNA, 25 bp, Mus musculus
aattggactcaagcggatagccaag

SEQ ID NO: 170963 - DNA, 25 bp, Mus musculus
aattggagctcaaccacttcggata

SEQ ID NO: 170964 - DNA, 25 bp, Mus musculus
aattggaggagagagaatgactctg

SEQ ID NO: 170965 - DNA, 25 bp, Mus musculus
aattggaggagagaggtacaatttc

SEQ ID NO: 170966 - DNA, 25 bp, Mus musculus
aattggagtgacaggtcctttccca

SEQ ID NO: 170967 - DNA, 25 bp, Mus musculus
aattggcacacactggttctggatt

SEQ ID NO: 170968 - DNA, 25 bp, Mus musculus
aattggccaacaaggtcgtatacaa

SEQ ID NO: 170969 - DNA, 25 bp, Mus musculus
aattggccatgctctgcatgcccat

SEQ ID NO: 170970 - DNA, 25 bp, Mus musculus
aattggccttcaaatctgcagaaga

SEQ ID NO: 170971 - DNA, 25 bp, Mus musculus
aattggccttcagaatacccggagg

SEQ ID NO: 170972 - DNA, 25 bp, Mus musculus
aattggcgaggactttgtgttgctc

SEQ ID NO: 170973 - DNA, 25 bp, Mus musculus
aattggctcaatacggttattactc

SEQ ID NO: 170974 - DNA, 25 bp, Mus musculus
aattggctcttaggtaagaagacaa

SEQ ID NO: 170975 - DNA, 25 bp, Mus musculus
aattggctgagctccccttggctag

SEQ ID NO: 170976 - DNA, 25 bp, Mus musculus
aattggcttccctgagatcctgttc

SEQ ID NO: 170977 - DNA, 25 bp, Mus musculus
aattggggaagcgagccctgaagac

SEQ ID NO: 170978 - DNA, 25 bp, Mus musculus
aattggggaagcggtaggtgcacgc

SEQ ID NO: 170979 - DNA, 25 bp, Mus musculus
aattggggactttgcttgtggccaa

SEQ ID NO: 170980 - DNA, 25 bp, Mus musculus
aattggggataaagtgtactggaat

SEQ ID NO: 170981 - DNA, 25 bp, Mus musculus
aattgggtacccagttgcacaacct

SEQ ID NO: 170982 - DNA, 25 bp, Mus musculus
aattggtcctcatctctccaggcgt

SEQ ID NO: 170983 - DNA, 25 bp, Mus musculus
aattggtcctggctctgtctgtaca

SEQ ID NO: 170984 - DNA, 25 bp, Mus musculus
aattggtttaagtgctgtgaagagc

SEQ ID NO: 170985 - DNA, 25 bp, Mus musculus
aattgtacagatatcgatgagtgtg

SEQ ID NO: 170986 - DNA, 25 bp, Mus musculus
aattgtacagatccgctgtactctc

SEQ ID NO: 170987 - DNA, 25 bp, Mus musculus
aattgtagaaaactgtggtgtcatg

SEQ ID NO: 170988 - DNA, 25 bp, Mus musculus
aattgtagagaatttcttgctgctc

SEQ ID NO: 170989 - DNA, 25 bp, Mus musculus
aattgtagagttgctcacagactgt

SEQ ID NO: 170990 - DNA, 25 bp, Mus musculus
aattgtagagttggctcacgtctta

SEQ ID NO: 170991 - DNA, 25 bp, Mus musculus
aattgtattagagggaattctgcct

SEQ ID NO: 170992 - DNA, 25 bp, Mus musculus
aattgtattagaggttcataagcca

SEQ ID NO: 170993 - DNA, 25 bp, Mus musculus
aattgtattagaggttggcaggaag

SEQ ID NO: 170994 - DNA, 25 bp, Mus musculus
aattgtatttacagatttatgacat

SEQ ID NO: 170995 - DNA, 25 bp, Mus musculus
aattgtatttacaggatcttgctgc

SEQ ID NO: 170996 - DNA, 25 bp, Mus musculus
aattgtattttaggtacattttatg

SEQ ID NO: 170997 - DNA, 25 bp, Mus musculus
aattgtcaagcaataccaagacgcc

SEQ ID NO: 170998 - DNA, 25 bp, Mus musculus
aattgtccgatgccatgaacacata

SEQ ID NO: 170999 - DNA, 25 bp, Mus musculus
aattgtctactggtgcattgaagat

SEQ ID NO: 171000 - DNA, 25 bp, Mus musculus
aattgtctcaaagaacttttgagca

SEQ ID NO: 171001 - DNA, 25 bp, Mus musculus
aattgtcttcagagattttcacagc

SEQ ID NO: 171002 - DNA, 25 bp, Mus musculus
aattgtcttgcttcattaaaaaaac

SEQ ID NO: 171003 - DNA, 25 bp, Mus musculus
aattgtcttgcttcattaacaattt

SEQ ID NO: 171004 - DNA, 25 bp, Mus musculus
aattgtgaaagaggtcctgtaataa

SEQ ID NO: 171005 - DNA, 25 bp, Mus musculus
aattgtgaaggccctgtctcaaagg

SEQ ID NO: 171006 - DNA, 25 bp, Mus musculus
aattgtgaaggtttgtctgggcacc

SEQ ID NO: 171007 - DNA, 25 bp, Mus musculus
aattgtgcatggcagaagaggaaag

SEQ ID NO: 171008 - DNA, 25 bp, Mus musculus
aattgtgcatgttccccctacctcc

SEQ ID NO: 171009 - DNA, 25 bp, Mus musculus
aattgtgctaaagaaatgctctact

SEQ ID NO: 171010 - DNA, 25 bp, Mus musculus
aattgtgctaaagaaattgccaaca

SEQ ID NO: 171011 - DNA, 25 bp, Mus musculus
aattgtggaagaataagaatgagcg

SEQ ID NO: 171012 - DNA, 25 bp, Mus musculus
aattgtggagattgaagaagttccg

SEQ ID NO: 171013 - DNA, 25 bp, Mus musculus
aattgtggaggttgacgttgatgca

SEQ ID NO: 171014 - DNA, 25 bp, Mus musculus
aattgtggataagcctgagtggcga

SEQ ID NO: 171015 - DNA, 25 bp, Mus musculus
aattgtgggagtctgcagtgatgag

SEQ ID NO: 171016 - DNA, 25 bp, Mus musculus
aattgtgtggccaaagccaaacttg

SEQ ID NO: 171017 - DNA, 25 bp, Mus musculus
aattgtgtggccaaagggacagtac

SEQ ID NO: 171018 - DNA, 25 bp, Mus musculus
aattgtgtttgtagacccatccctg

SEQ ID NO: 171019 - DNA, 25 bp, Mus musculus
aattgttaccaaagtgtgcaactgc

SEQ ID NO: 171020 - DNA, 25 bp, Mus musculus
aattgttatcccaactgtaaatttg

SEQ ID NO: 171021 - DNA, 25 bp, Mus musculus
aattgttccactgtagtcacagtaa

SEQ ID NO: 171022 - DNA, 25 bp, Mus musculus
aattgttgggatgattgcgaagggg

SEQ ID NO: 171023 - DNA, 25 bp, Mus musculus
aattgtttatagaaatacaatattc

SEQ ID NO: 171024 - DNA, 25 bp, Mus musculus
aattgtttatagagatttgaagttg

SEQ ID NO: 171025 - DNA, 25 bp, Mus musculus
aatttaaaaagggagatgagtacga

SEQ ID NO: 171026 - DNA, 25 bp, Mus musculus
aatttaaaaggttgcagtgtgtgct

SEQ ID NO: 171027 - DNA, 25 bp, Mus musculus
aatttaaatgaagagatggttacgc

SEQ ID NO: 171028 - DNA, 25 bp, Mus musculus
aatttaaatgaagaggtgtttatgg

SEQ ID NO: 171029 - DNA, 25 bp, Mus musculus
aatttaacacagtgttgctggcggt

SEQ ID NO: 171030 - DNA, 25 bp, Mus musculus
aatttaaccgcttggctgaagagga

SEQ ID NO: 171031 - DNA, 25 bp, Mus musculus
aatttaacgccaaggtaaacgatga

SEQ ID NO: 171032 - DNA, 25 bp, Mus musculus
aatttaaggagattaatagagacag

SEQ ID NO: 171033 - DNA, 25 bp, Mus musculus
aatttaaggagttcatcagcctcca

SEQ ID NO: 171034 - DNA, 25 bp, Mus musculus
aatttaatgttggaggacctggata

SEQ ID NO: 171035 - DNA, 25 bp, Mus musculus
aatttaatgttggaggatttagaca

SEQ ID NO: 171036 - DNA, 25 bp, Mus musculus
aatttacacgaccagtgcagcccct

SEQ ID NO: 171037 - DNA, 25 bp, Mus musculus
aatttacccaaaggaagcctcaagg

SEQ ID NO: 171038 - DNA, 25 bp, Mus musculus
aatttagacaagtatgatgatgttc

SEQ ID NO: 171039 - DNA, 25 bp, Mus musculus
aatttagacaattggtggccattta

SEQ ID NO: 171040 - DNA, 25 bp, Mus musculus
aatttaggaaaacaataaatgcacc

SEQ ID NO: 171041 - DNA, 25 bp, Mus musculus
aatttaggaaaacagtccttcacgt

SEQ ID NO: 171042 - DNA, 25 bp, Mus musculus
aatttaggcaagggaaggacatttg

SEQ ID NO: 171043 - DNA, 25 bp, Mus musculus
aatttagtgagccacagtacacgaa

SEQ ID NO: 171044 - DNA, 25 bp, Mus musculus
aatttagttaaaagctgtatcgaca

SEQ ID NO: 171045 - DNA, 25 bp, Mus musculus
aatttataagacaaaaaagaagagg

SEQ ID NO: 171046 - DNA, 25 bp, Mus musculus
aatttataagagagatggttgtcca

SEQ ID NO: 171047 - DNA, 25 bp, Mus musculus
aatttatcaggaaacaaaaggaggg

SEQ ID NO: 171048 - DNA, 25 bp, Mus musculus
aatttatctatgatgaagctgctct

SEQ ID NO: 171049 - DNA, 25 bp, Mus musculus
aatttatctatggtcgaatatttcc

SEQ ID NO: 171050 - DNA, 25 bp, Mus musculus
aatttatctgaggtgagaagtctgg

SEQ ID NO: 171051 - DNA, 25 bp, Mus musculus
aatttcaaagaggtaactcacggtt

SEQ ID NO: 171052 - DNA, 25 bp, Mus musculus
aatttcacaatactacctgtctgct

SEQ ID NO: 171053 - DNA, 25 bp, Mus musculus
aatttcactgaggttaatctataat

SEQ ID NO: 171054 - DNA, 25 bp, Mus musculus
aatttcagagctggaaccctgccac

SEQ ID NO: 171055 - DNA, 25 bp, Mus musculus
aatttcagagctggagagttgaagc

SEQ ID NO: 171056 - DNA, 25 bp, Mus musculus
aatttcagagggccttcagcggctc

SEQ ID NO: 171057 - DNA, 25 bp, Mus musculus
aatttcagcaagaggaatatcctcc

SEQ ID NO: 171058 - DNA, 25 bp, Mus musculus
aatttcagcatcaggggttcggcat

SEQ ID NO: 171059 - DNA, 25 bp, Mus musculus
aatttcaggccagggaccgagaaca

SEQ ID NO: 171060 - DNA, 25 bp, Mus musculus
aatttcagttcagttttgctaactg

SEQ ID NO: 171061 - DNA, 25 bp, Mus musculus
aatttcatacagacgcttgatcctg

SEQ ID NO: 171062 - DNA, 25 bp, Mus musculus
aatttcatacaggattcaatgttgg

SEQ ID NO: 171063 - DNA, 25 bp, Mus musculus
aatttcatagatgctatgctgatgg

SEQ ID NO: 171064 - DNA, 25 bp, Mus musculus
aatttcatagttgctatgctgatgg

SEQ ID NO: 171065 - DNA, 25 bp, Mus musculus
aatttcatgcatttggaggaactgc

SEQ ID NO: 171066 - DNA, 25 bp, Mus musculus
aatttcattaagacctggtcccagg

SEQ ID NO: 171067 - DNA, 25 bp, Mus musculus
aatttcattaagatcgggaagctgc

SEQ ID NO: 171068 - DNA, 25 bp, Mus musculus
aatttccaaaagagaacggacactc

SEQ ID NO: 171069 - DNA, 25 bp, Mus musculus
aatttccaaaagcctgaaacatttg

SEQ ID NO: 171070 - DNA, 25 bp, Mus musculus
aatttccaccggtttgctgaggagc

SEQ ID NO: 171071 - DNA, 25 bp, Mus musculus
aatttccacggaggttaatctataa

SEQ ID NO: 171072 - DNA, 25 bp, Mus musculus
aatttccagaagcaggtgtccccag

SEQ ID NO: 171073 - DNA, 25 bp, Mus musculus
aatttccagatgcaggtgtccccag

SEQ ID NO: 171074 - DNA, 25 bp, Mus musculus
aatttccagcaagcttgagtctact

SEQ ID NO: 171075 - DNA, 25 bp, Mus musculus
aatttccagcaagtaccaggaatgt

SEQ ID NO: 171076 - DNA, 25 bp, Mus musculus
aatttccaggcaggctcatggcaga

SEQ ID NO: 171077 - DNA, 25 bp, Mus musculus
aatttccagttaaacctgctgatct

SEQ ID NO: 171078 - DNA, 25 bp, Mus musculus
aatttcccaagtggatggagaccaa

SEQ ID NO: 171079 - DNA, 25 bp, Mus musculus
aatttcccctcagcaaatccagttt

SEQ ID NO: 171080 - DNA, 25 bp, Mus musculus
aatttcccctgcaaaaatctggaag

SEQ ID NO: 171081 - DNA, 25 bp, Mus musculus
aatttcccctgcaatactgccgaaa

SEQ ID NO: 171082 - DNA, 25 bp, Mus musculus
aatttccctcttggctgatggtgag

SEQ ID NO: 171083 - DNA, 25 bp, Mus musculus
aatttcctaaaggagatataatcag

SEQ ID NO: 171084 - DNA, 25 bp, Mus musculus
aatttcctatcctggtgctactaaa

SEQ ID NO: 171085 - DNA, 25 bp, Mus musculus
aatttcctgaggctgtaagcaatgg

SEQ ID NO: 171086 - DNA, 25 bp, Mus musculus
aatttcgtcttctggctggctggag

SEQ ID NO: 171087 - DNA, 25 bp, Mus musculus
aatttctaaacaggatttggtgagc

SEQ ID NO: 171088 - DNA, 25 bp, Mus musculus
aatttctaaagaagttggcatcaga

SEQ ID NO: 171089 - DNA, 25 bp, Mus musculus
aatttctactgaaggcttccaaagg

SEQ ID NO: 171090 - DNA, 25 bp, Mus musculus
aatttctatgtggaaaggaaaatag

SEQ ID NO: 171091 - DNA, 25 bp, Mus musculus
aatttctgaaacagcctcaaggaga

SEQ ID NO: 171092 - DNA, 25 bp, Mus musculus
aatttctggagcctatcttccagcc

SEQ ID NO: 171093 - DNA, 25 bp, Mus musculus
aatttcttaatcaggtatgtgtaca

SEQ ID NO: 171094 - DNA, 25 bp, Mus musculus
aatttcttaatcaggtcttctcgtc

SEQ ID NO: 171095 - DNA, 25 bp, Mus musculus
aatttcttggatcggatgaagaaga

SEQ ID NO: 171096 - DNA, 25 bp, Mus musculus
aatttcttggggcgctttcatcttc

SEQ ID NO: 171097 - DNA, 25 bp, Mus musculus
aatttcttggtgaatgaactcattc

SEQ ID NO: 171098 - DNA, 25 bp, Mus musculus
aatttcttgtgaaaatgaacaagca

SEQ ID NO: 171099 - DNA, 25 bp, Mus musculus
aatttctttccaagtccttctttga

SEQ ID NO: 171100 - DNA, 25 bp, Mus musculus
aatttcttttcctgggtgaaagaca

SEQ ID NO: 171101 - DNA, 25 bp, Mus musculus
aatttgaaaatttggaggcagcacc

SEQ ID NO: 171102 - DNA, 25 bp, Mus musculus
aatttgaacagggcctgtctgagaa

SEQ ID NO: 171103 - DNA, 25 bp, Mus musculus
aatttgaacaggtcatgcagttgct

SEQ ID NO: 171104 - DNA, 25 bp, Mus musculus
aatttgactctgagatggtagagat

SEQ ID NO: 171105 - DNA, 25 bp, Mus musculus
aatttgactctgaggtgctgtagga

SEQ ID NO: 171106 - DNA, 25 bp, Mus musculus
aatttgataatgcaaacccgtggca

SEQ ID NO: 171107 - DNA, 25 bp, Mus musculus
aatttgatgaggacagtggtgacta

SEQ ID NO: 171108 - DNA, 25 bp, Mus musculus
aatttgcaagtggattgtcttgcct

SEQ ID NO: 171109 - DNA, 25 bp, Mus musculus
aatttgcagccaaggccacagagga

SEQ ID NO: 171110 - DNA, 25 bp, Mus musculus
aatttgcataaagactgaccatcat

SEQ ID NO: 171111 - DNA, 25 bp, Mus musculus
aatttgcatgcaaggcttgttcccc

SEQ ID NO: 171112 - DNA, 25 bp, Mus musculus
aatttgcatgcaaggtacagaagaa

SEQ ID NO: 171113 - DNA, 25 bp, Mus musculus
aatttgccgttaaacctgaagaatc

SEQ ID NO: 171114 - DNA, 25 bp, Mus musculus
aatttgccgttaaatgtgggaactt

SEQ ID NO: 171115 - DNA, 25 bp, Mus musculus
aatttgcctttgcaggtgacagcag

SEQ ID NO: 171116 - DNA, 25 bp, Mus musculus
aatttgctggggagaaggaactcag

SEQ ID NO: 171117 - DNA, 25 bp, Mus musculus
aatttgctgtagacattttaagtct

SEQ ID NO: 171118 - DNA, 25 bp, Mus musculus
aatttgctgtggagatcggcctggc

SEQ ID NO: 171119 - DNA, 25 bp, Mus musculus
aatttgctgtggagctccttcaaaa

SEQ ID NO: 171120 - DNA, 25 bp, Mus musculus
aatttggaagctacgcttacacaac

SEQ ID NO: 171121 - DNA, 25 bp, Mus musculus
aatttggaagggaggtcctggccag

SEQ ID NO: 171122 - DNA, 25 bp, Mus musculus
aatttggaatgaagggtcctgtggc

SEQ ID NO: 171123 - DNA, 25 bp, Mus musculus
aatttggagaaggtacattattttg

SEQ ID NO: 171124 - DNA, 25 bp, Mus musculus
aatttggcttcaatactgggcggtt

SEQ ID NO: 171125 - DNA, 25 bp, Mus musculus
aatttggcttcatactttatcttgt

SEQ ID NO: 171126 - DNA, 25 bp, Mus musculus
aatttgggagcgggggtccaactga

SEQ ID NO: 171127 - DNA, 25 bp, Mus musculus
aatttgggagttatgcatatcccaa

SEQ ID NO: 171128 - DNA, 25 bp, Mus musculus
aatttgggcaccctaagatgagtcc

SEQ ID NO: 171129 - DNA, 25 bp, Mus musculus
aatttgggcactgcagcctgtcaac

SEQ ID NO: 171130 - DNA, 25 bp, Mus musculus
aatttgtcaaagaactactatccag

SEQ ID NO: 171131 - DNA, 25 bp, Mus musculus
aatttgtcagttggttactggctgt

SEQ ID NO: 171132 - DNA, 25 bp, Mus musculus
aatttgtccagccccagcatctcac

SEQ ID NO: 171133 - DNA, 25 bp, Mus musculus
aatttgtcgataatctgtatcgatt

SEQ ID NO: 171134 - DNA, 25 bp, Mus musculus
aatttgtgagcagaacatgttacta

SEQ ID NO: 171135 - DNA, 25 bp, Mus musculus
aatttgtgagcaggtgtccacaaag

SEQ ID NO: 171136 - DNA, 25 bp, Mus musculus
aatttgtgcacaaggtggtccgaga

SEQ ID NO: 171137 - DNA, 25 bp, Mus musculus
aatttgttagaaagcctgcaaggtc

SEQ ID NO: 171138 - DNA, 25 bp, Mus musculus
aatttgttcccaggcaaattccatc

SEQ ID NO: 171139 - DNA, 25 bp, Mus musculus
aattttaagatgaaaatacttggaa

SEQ ID NO: 171140 - DNA, 25 bp, Mus musculus
aattttaatgaatgcagctgccttg

SEQ ID NO: 171141 - DNA, 25 bp, Mus musculus
aattttagaagataggttaagagca

SEQ ID NO: 171142 - DNA, 25 bp, Mus musculus
aattttattacgtttggcaaacatc

SEQ ID NO: 171143 - DNA, 25 bp, Mus musculus
aattttcaagccctggtaacccata

SEQ ID NO: 171144 - DNA, 25 bp, Mus musculus
aattttcaagccctggtgtctcttg

SEQ ID NO: 171145 - DNA, 25 bp, Mus musculus
aattttcattataagaacaacaaaa

SEQ ID NO: 171146 - DNA, 25 bp, Mus musculus
aattttcattataagcatgatcggg

SEQ ID NO: 171147 - DNA, 25 bp, Mus musculus
aattttccaagctgatcatatgatg

SEQ ID NO: 171148 - DNA, 25 bp, Mus musculus
aattttccaggtctctttaaggtca

SEQ ID NO: 171149 - DNA, 25 bp, Mus musculus
aattttccagttcaaaaggacatag

SEQ ID NO: 171150 - DNA, 25 bp, Mus musculus
aattttccagttccagtgcagactc

SEQ ID NO: 171151 - DNA, 25 bp, Mus musculus
aattttctagcacttgtgcttccaa

SEQ ID NO: 171152 - DNA, 25 bp, Mus musculus
aattttctgaagagacttgcctttc

SEQ ID NO: 171153 - DNA, 25 bp, Mus musculus
aattttctgaagaggcttatccatg

SEQ ID NO: 171154 - DNA, 25 bp, Mus musculus
aattttctgggggtcccacagaggc

SEQ ID NO: 171155 - DNA, 25 bp, Mus musculus
aattttgaaatgtgctgctctggtt

SEQ ID NO: 171156 - DNA, 25 bp, Mus musculus
aattttgatataaaggttttaaatg

SEQ ID NO: 171157 - DNA, 25 bp, Mus musculus
aattttgatgactaccatcatcgag

SEQ ID NO: 171158 - DNA, 25 bp, Mus musculus
aattttggaaggaggccatgtcatg

SEQ ID NO: 171159 - DNA, 25 bp, Mus musculus
aattttgggattttagttctcaaat

SEQ ID NO: 171160 - DNA, 25 bp, Mus musculus
aattttgggattttatcgcatcata

SEQ ID NO: 171161 - DNA, 25 bp, Mus musculus
aattttgtaagaggacaatgcgtat

SEQ ID NO: 171162 - DNA, 25 bp, Mus musculus
aattttgtaagtacaaacaggccat

SEQ ID NO: 171163 - DNA, 25 bp, Mus musculus
aattttgtagctgggattgacttct

SEQ ID NO: 171164 - DNA, 25 bp, Mus musculus
aattttgtgctcgattacgctcgat

SEQ ID NO: 171165 - DNA, 25 bp, Mus musculus
aattttgttaaggaaattaagcgag

SEQ ID NO: 171166 - DNA, 25 bp, Mus musculus
aatttttaggccccgtcattgtgga

SEQ ID NO: 171167 - DNA, 25 bp, Mus musculus
aatttttataaaggcagctgctggg

SEQ ID NO: 171168 - DNA, 25 bp, Mus musculus
aatttttatgttgagctaccaatat

SEQ ID NO: 171169 - DNA, 25 bp, Mus musculus
aatttttcaaatttctgctggaccg

SEQ ID NO: 171170 - DNA, 25 bp, Mus musculus
aatttttcaggtgccgacttattaa

SEQ ID NO: 171171 - DNA, 25 bp, Mus musculus
aatttttgtagtgccaggacatatg

SEQ ID NO: 171172 - DNA, 25 bp, Mus musculus
aattttttgaacaaggaagctcgga

SEQ ID NO: 171173 - DNA, 25 bp, Mus musculus
acaaaaaaaagctgctgatcactgg

SEQ ID NO: 171174 - DNA, 25 bp, Mus musculus
acaaaaaaagattttggagtaagcg

SEQ ID NO: 171175 - DNA, 25 bp, Mus musculus
acaaaaaaagctccgactgattgat

SEQ ID NO: 171176 - DNA, 25 bp, Mus musculus
acaaaaaacttgagcccagcgggcc

SEQ ID NO: 171177 - DNA, 25 bp, Mus musculus
acaaaaaagacaggtgttcacaaaa

SEQ ID NO: 171178 - DNA, 25 bp, Mus musculus
acaaaaaagagctctcttacagggc

SEQ ID NO: 171179 - DNA, 25 bp, Mus musculus
acaaaaaatcagtggttagccagcg

SEQ ID NO: 171180 - DNA, 25 bp, Mus musculus
acaaaaaatcagttcccaagagttc

SEQ ID NO: 171181 - DNA, 25 bp, Mus musculus
acaaaaaatctccaggtcccgtcag

SEQ ID NO: 171182 - DNA, 25 bp, Mus musculus
acaaaaacaacatcctgcggtattc

SEQ ID NO: 171183 - DNA, 25 bp, Mus musculus
acaaaaacacagagcttaccatcta

SEQ ID NO: 171184 - DNA, 25 bp, Mus musculus
acaaaaacacagggggaagagggca

SEQ ID NO: 171185 - DNA, 25 bp, Mus musculus
acaaaaacagatggatgagacatca

SEQ ID NO: 171186 - DNA, 25 bp, Mus musculus
acaaaaacagcttatagagcacaaa

SEQ ID NO: 171187 - DNA, 25 bp, Mus musculus
acaaaaaccaaagaatgacttcgct

SEQ ID NO: 171188 - DNA, 25 bp, Mus musculus
acaaaaaccaaaggccagcgtgacg

SEQ ID NO: 171189 - DNA, 25 bp, Mus musculus
acaaaaaccaagaggaaagcataga

SEQ ID NO: 171190 - DNA, 25 bp, Mus musculus
acaaaaaccatctttcaggacctgc

SEQ ID NO: 171191 - DNA, 25 bp, Mus musculus
acaaaaactgccagttggtggcact

SEQ ID NO: 171192 - DNA, 25 bp, Mus musculus
acaaaaacttctggaattattgaag

SEQ ID NO: 171193 - DNA, 25 bp, Mus musculus
acaaaaagaaagactgccctcccgg

SEQ ID NO: 171194 - DNA, 25 bp, Mus musculus
acaaaaagaaatggtgacattccaa

SEQ ID NO: 171195 - DNA, 25 bp, Mus musculus
acaaaaagaaggctaatgcttctgt

SEQ ID NO: 171196 - DNA, 25 bp, Mus musculus
acaaaaagaatgatggtcgaatcga

SEQ ID NO: 171197 - DNA, 25 bp, Mus musculus
acaaaaagccagcaccaagtgatct

SEQ ID NO: 171198 - DNA, 25 bp, Mus musculus
acaaaaagccagggatggctgtgtg

SEQ ID NO: 171199 - DNA, 25 bp, Mus musculus
acaaaaatctaggcatggtctgccg

SEQ ID NO: 171200 - DNA, 25 bp, Mus musculus
acaaaaatgggaggcttactcaatt

SEQ ID NO: 171201 - DNA, 25 bp, Mus musculus
acaaaaatgggagtgggtgaactca

SEQ ID NO: 171202 - DNA, 25 bp, Mus musculus
acaaaaatttcaagtactcagacta

SEQ ID NO: 171203 - DNA, 25 bp, Mus musculus
acaaaacaaaaacaacatggctggg

SEQ ID NO: 171204 - DNA, 25 bp, Mus musculus
acaaaacaaaccaaggctactatga

SEQ ID NO: 171205 - DNA, 25 bp, Mus musculus
acaaaacatttaaggagattacttt

SEQ ID NO: 171206 - DNA, 25 bp, Mus musculus
acaaaaccaaaactgccttaggatt

SEQ ID NO: 171207 - DNA, 25 bp, Mus musculus
acaaaaccaagaaaccaagccgcaa

SEQ ID NO: 171208 - DNA, 25 bp, Mus musculus
acaaaaccaaggatgtggagtacat

SEQ ID NO: 171209 - DNA, 25 bp, Mus musculus
acaaaaccagaagaagctcgagtgc

SEQ ID NO: 171210 - DNA, 25 bp, Mus musculus
acaaaaccagatcaaattgacatcg

SEQ ID NO: 171211 - DNA, 25 bp, Mus musculus
acaaaacctttggtagatgccagcc

SEQ ID NO: 171212 - DNA, 25 bp, Mus musculus
acaaaacgagatctggcagaccttc

SEQ ID NO: 171213 - DNA, 25 bp, Mus musculus
acaaaacgagtgacgagtatctgtc

SEQ ID NO: 171214 - DNA, 25 bp, Mus musculus
acaaaacgctgagagagatgccaaa

SEQ ID NO: 171215 - DNA, 25 bp, Mus musculus
acaaaacgctgtaagccgtgcctca

SEQ ID NO: 171216 - DNA, 25 bp, Mus musculus
acaaaactcaaaagattgctttatt

SEQ ID NO: 171217 - DNA, 25 bp, Mus musculus
acaaaactcagggaccaagagccct

SEQ ID NO: 171218 - DNA, 25 bp, Mus musculus
acaaaagaaaataagtaccatgaaa

SEQ ID NO: 171219 - DNA, 25 bp, Mus musculus
acaaaagaaagaagacccactgcca

SEQ ID NO: 171220 - DNA, 25 bp, Mus musculus
acaaaagaaagatataagcatacaa

SEQ ID NO: 171221 - DNA, 25 bp, Mus musculus
acaaaagaaagctgtattttaaatc

SEQ ID NO: 171222 - DNA, 25 bp, Mus musculus
acaaaagaaagctgtggaaatcagt

SEQ ID NO: 171223 - DNA, 25 bp, Mus musculus
acaaaagaaagctgtggtaattcca

SEQ ID NO: 171224 - DNA, 25 bp, Mus musculus
acaaaagaatttccattcgagcatc

SEQ ID NO: 171225 - DNA, 25 bp, Mus musculus
acaaaagactgacacatgcagccgc

SEQ ID NO: 171226 - DNA, 25 bp, Mus musculus
acaaaagagacgggaaaagaaggct

SEQ ID NO: 171227 - DNA, 25 bp, Mus musculus
acaaaagagacgggatcttatcctg

SEQ ID NO: 171228 - DNA, 25 bp, Mus musculus
acaaaagagatgtcttctcacaggt

SEQ ID NO: 171229 - DNA, 25 bp, Mus musculus
acaaaagcagaatgattgaagatag

SEQ ID NO: 171230 - DNA, 25 bp, Mus musculus
acaaaagcagctatgccccctcaaa

SEQ ID NO: 171231 - DNA, 25 bp, Mus musculus
acaaaaggaatcaagttactggaca

SEQ ID NO: 171232 - DNA, 25 bp, Mus musculus
acaaaaggatgattgatctgatgga

SEQ ID NO: 171233 - DNA, 25 bp, Mus musculus
acaaaaggccggtcatggtatggat

SEQ ID NO: 171234 - DNA, 25 bp, Mus musculus
acaaaagggacaggttttcctagat

SEQ ID NO: 171235 - DNA, 25 bp, Mus musculus
acaaaagggacagtgatggatgtgg

SEQ ID NO: 171236 - DNA, 25 bp, Mus musculus
acaaaagtaggagttaccattgagt

SEQ ID NO: 171237 - DNA, 25 bp, Mus musculus
acaaaagtcaaatgtggatatgcta

SEQ ID NO: 171238 - DNA, 25 bp, Mus musculus
acaaaataaatggtctactgaaagt

SEQ ID NO: 171239 - DNA, 25 bp, Mus musculus
acaaaataacaaagagctactgctt

SEQ ID NO: 171240 - DNA, 25 bp, Mus musculus
acaaaataacaaagcggagtatgtc

SEQ ID NO: 171241 - DNA, 25 bp, Mus musculus
acaaaatatagtgtcatcatgctgg

SEQ ID NO: 171242 - DNA, 25 bp, Mus musculus
acaaaatatgggccaaatgaaaatt

SEQ ID NO: 171243 - DNA, 25 bp, Mus musculus
acaaaatatttggtgacttcacctg

SEQ ID NO: 171244 - DNA, 25 bp, Mus musculus
acaaaatcaaggatcatgggctcta

SEQ ID NO: 171245 - DNA, 25 bp, Mus musculus
acaaaatcatagagcccatccagtc

SEQ ID NO: 171246 - DNA, 25 bp, Mus musculus
acaaaatcatggacgcattcagctt

SEQ ID NO: 171247 - DNA, 25 bp, Mus musculus
acaaaatcattagataacaactatt

SEQ ID NO: 171248 - DNA, 25 bp, Mus musculus
acaaaatccggcagagtgaccgtct

SEQ ID NO: 171249 - DNA, 25 bp, Mus musculus
acaaaatctaacaattctctacatt

SEQ ID NO: 171250 - DNA, 25 bp, Mus musculus
acaaaatgaaagtggatcagcatgg

SEQ ID NO: 171251 - DNA, 25 bp, Mus musculus
acaaaatgagacctgggcggccctc

SEQ ID NO: 171252 - DNA, 25 bp, Mus musculus
acaaaatgcttcagggccgcctttt

SEQ ID NO: 171253 - DNA, 25 bp, Mus musculus
acaaaatgtaggtggatgaagactc

SEQ ID NO: 171254 - DNA, 25 bp, Mus musculus
acaaaatgtttctggtggaacacca

SEQ ID NO: 171255 - DNA, 25 bp, Mus musculus
acaaaattaccccaagcattcttga

SEQ ID NO: 171256 - DNA, 25 bp, Mus musculus
acaaaattagagaggaggaaaaagg

SEQ ID NO: 171257 - DNA, 25 bp, Mus musculus
acaaaattagtccatttcagtcctc

SEQ ID NO: 171258 - DNA, 25 bp, Mus musculus
acaaaattgaatcacgtgaactgga

SEQ ID NO: 171259 - DNA, 25 bp, Mus musculus
acaaaattgaatcaggtgaactgga

SEQ ID NO: 171260 - DNA, 25 bp, Mus musculus
acaaaattggccatgctctgcatgc

SEQ ID NO: 171261 - DNA, 25 bp, Mus musculus
acaaacaaaaagtactacaagaagt

SEQ ID NO: 171262 - DNA, 25 bp, Mus musculus
acaaacaaaagtgtttacaattgaa

SEQ ID NO: 171263 - DNA, 25 bp, Mus musculus
acaaacaaatgacatgtttttcagt

SEQ ID NO: 171264 - DNA, 25 bp, Mus musculus
acaaacaacatgccctgcctgcccc

SEQ ID NO: 171265 - DNA, 25 bp, Mus musculus
acaaacaagattacggccgaagact

SEQ ID NO: 171266 - DNA, 25 bp, Mus musculus
acaaacaagattacggtacagcaag

SEQ ID NO: 171267 - DNA, 25 bp, Mus musculus
acaaacaataatgaagacaactgga

SEQ ID NO: 171268 - DNA, 25 bp, Mus musculus
acaaacaattcctccatctgctaag

SEQ ID NO: 171269 - DNA, 25 bp, Mus musculus
acaaacacaaaaaatcttctctgat

SEQ ID NO: 171270 - DNA, 25 bp, Mus musculus
acaaacacagacattcccagctatt

SEQ ID NO: 171271 - DNA, 25 bp, Mus musculus
acaaacacagaggagcttaatttgc

SEQ ID NO: 171272 - DNA, 25 bp, Mus musculus
acaaacacattgcaggctgcagatg

SEQ ID NO: 171273 - DNA, 25 bp, Mus musculus
acaaacacattgcagttggaacaag

SEQ ID NO: 171274 - DNA, 25 bp, Mus musculus
acaaacaccgtgcctaaattgtata

SEQ ID NO: 171275 - DNA, 25 bp, Mus musculus
acaaacacgacagtccctgacctca

SEQ ID NO: 171276 - DNA, 25 bp, Mus musculus
acaaacacgagagtccctgacctca

SEQ ID NO: 171277 - DNA, 25 bp, Mus musculus
acaaacacttggtgatgaagatgaa

SEQ ID NO: 171278 - DNA, 25 bp, Mus musculus
acaaacacttggtggtgtgaatgag

SEQ ID NO: 171279 - DNA, 25 bp, Mus musculus
acaaacagaacagaaaagaaatggt

SEQ ID NO: 171280 - DNA, 25 bp, Mus musculus
acaaacagaatgcaacaaggatgac

SEQ ID NO: 171281 - DNA, 25 bp, Mus musculus
acaaacagactaaagactatgctga

SEQ ID NO: 171282 - DNA, 25 bp, Mus musculus
acaaacagagacaggcatccgtccc

SEQ ID NO: 171283 - DNA, 25 bp, Mus musculus
acaaacagaggatcaataccagttc

SEQ ID NO: 171284 - DNA, 25 bp, Mus musculus
acaaacagaggcaaatattgtggat

SEQ ID NO: 171285 - DNA, 25 bp, Mus musculus
acaaacagcatgatgcagctgcctt

SEQ ID NO: 171286 - DNA, 25 bp, Mus musculus
acaaacagcatggaactgacccgag

SEQ ID NO: 171287 - DNA, 25 bp, Mus musculus
acaaacatgcagagagtagcagtgc

SEQ ID NO: 171288 - DNA, 25 bp, Mus musculus
acaaacatgcagagtgctgtgtgtt

SEQ ID NO: 171289 - DNA, 25 bp, Mus musculus
acaaacatggggtcccagcaacaga

SEQ ID NO: 171290 - DNA, 25 bp, Mus musculus
acaaacatgggtttaggcaagagta

SEQ ID NO: 171291 - DNA, 25 bp, Mus musculus
acaaacatgtgcagataacaatcga

SEQ ID NO: 171292 - DNA, 25 bp, Mus musculus
acaaaccaaggctcatctgcggtgt

SEQ ID NO: 171293 - DNA, 25 bp, Mus musculus
acaaaccacattgggtgggtgcagg

SEQ ID NO: 171294 - DNA, 25 bp, Mus musculus
acaaaccatctgatggcctgctggt

SEQ ID NO: 171295 - DNA, 25 bp, Mus musculus
acaaaccgaagagatacttggagat

SEQ ID NO: 171296 - DNA, 25 bp, Mus musculus
acaaacgaacaagactctgacacca

SEQ ID NO: 171297 - DNA, 25 bp, Mus musculus
acaaacgaacaagcaggttcaggag

SEQ ID NO: 171298 - DNA, 25 bp, Mus musculus
acaaacgaacaatagtagaaaatga

SEQ ID NO: 171299 - DNA, 25 bp, Mus musculus
acaaacgaagacatcaaaggctctt

SEQ ID NO: 171300 - DNA, 25 bp, Mus musculus
acaaacgccagacgtgaaaaatgaa

SEQ ID NO: 171301 - DNA, 25 bp, Mus musculus
acaaacgtgacaacagcactgtttg

SEQ ID NO: 171302 - DNA, 25 bp, Mus musculus
acaaactaaaggctatggtcatgcg

SEQ ID NO: 171303 - DNA, 25 bp, Mus musculus
acaaactaattatagtcctattgtc

SEQ ID NO: 171304 - DNA, 25 bp, Mus musculus
acaaactacacggaagaaaagcaac

SEQ ID NO: 171305 - DNA, 25 bp, Mus musculus
acaaactagacaagatgtcttggga

SEQ ID NO: 171306 - DNA, 25 bp, Mus musculus
acaaactcaagatgggaagtcattg

SEQ ID NO: 171307 - DNA, 25 bp, Mus musculus
acaaactcaaggccctcatcaaaaa

SEQ ID NO: 171308 - DNA, 25 bp, Mus musculus
acaaactccatgactacctcatgag

SEQ ID NO: 171309 - DNA, 25 bp, Mus musculus
acaaactccgtcaggcccctgattt

SEQ ID NO: 171310 - DNA, 25 bp, Mus musculus
acaaactccgtcagtacctcttgtg

SEQ ID NO: 171311 - DNA, 25 bp, Mus musculus
acaaactgaacagagacactcctga

SEQ ID NO: 171312 - DNA, 25 bp, Mus musculus
acaaactgaacagagatgatgattc

SEQ ID NO: 171313 - DNA, 25 bp, Mus musculus
acaaactgaagcaggaggaggagac

SEQ ID NO: 171314 - DNA, 25 bp, Mus musculus
acaaactgaagcaggtgtccatcct

SEQ ID NO: 171315 - DNA, 25 bp, Mus musculus
acaaactgaaggctcgatgagagaa

SEQ ID NO: 171316 - DNA, 25 bp, Mus musculus
acaaactgactggttctgcagcatt

SEQ ID NO: 171317 - DNA, 25 bp, Mus musculus
acaaactgagtagcactcagcatgg

SEQ ID NO: 171318 - DNA, 25 bp, Mus musculus
acaaactgttcaggtagcaacaatt

SEQ ID NO: 171319 - DNA, 25 bp, Mus musculus
acaaactttagggactccagctacc

SEQ ID NO: 171320 - DNA, 25 bp, Mus musculus
acaaactttagggagtatagtcatg

SEQ ID NO: 171321 - DNA, 25 bp, Mus musculus
acaaacttttaggtagacatttggg

SEQ ID NO: 171322 - DNA, 25 bp, Mus musculus
acaaagaaagagagaccagagggac

SEQ ID NO: 171323 - DNA, 25 bp, Mus musculus
acaaagaaagagagatggcagcagc

SEQ ID NO: 171324 - DNA, 25 bp, Mus musculus
acaaagaaagcaactgggacaaata

SEQ ID NO: 171325 - DNA, 25 bp, Mus musculus
acaaagaaagtcaggtatgctgcaa

SEQ ID NO: 171326 - DNA, 25 bp, Mus musculus
acaaagaaatggcaaccagataaac

SEQ ID NO: 171327 - DNA, 25 bp, Mus musculus
acaaagaagaaaaggactgcattta

SEQ ID NO: 171328 - DNA, 25 bp, Mus musculus
acaaagaagacagccaaggacactg

SEQ ID NO: 171329 - DNA, 25 bp, Mus musculus
acaaagaatcagagacaccagagaa

SEQ ID NO: 171330 - DNA, 25 bp, Mus musculus
acaaagaatcagagagacaactggc

SEQ ID NO: 171331 - DNA, 25 bp, Mus musculus
acaaagaattccagaattcagtagc

SEQ ID NO: 171332 - DNA, 25 bp, Mus musculus
acaaagacaacaaaaatgaaaagaa

SEQ ID NO: 171333 - DNA, 25 bp, Mus musculus
acaaagacagcaggctgcctttgat

SEQ ID NO: 171334 - DNA, 25 bp, Mus musculus
acaaagacaggagcgaatccgtaat

SEQ ID NO: 171335 - DNA, 25 bp, Mus musculus
acaaagacaggatgagagacaatga

SEQ ID NO: 171336 - DNA, 25 bp, Mus musculus
acaaagacaggtgtaacgtggagaa

SEQ ID NO: 171337 - DNA, 25 bp, Mus musculus
acaaagacagttcagggcgacagct

SEQ ID NO: 171338 - DNA, 25 bp, Mus musculus
acaaagacccaggagattagccgtc

SEQ ID NO: 171339 - DNA, 25 bp, Mus musculus
acaaagacctacagctgcaccaaag

SEQ ID NO: 171340 - DNA, 25 bp, Mus musculus
acaaagacctacaggaatcacaggt

SEQ ID NO: 171341 - DNA, 25 bp, Mus musculus
acaaagacgaggaaccttcagctgc

SEQ ID NO: 171342 - DNA, 25 bp, Mus musculus
acaaagactctaggatcaagtgagc

SEQ ID NO: 171343 - DNA, 25 bp, Mus musculus
acaaagactctagtctttcaggttc

SEQ ID NO: 171344 - DNA, 25 bp, Mus musculus
acaaagactgcagcaaatgaagctg

SEQ ID NO: 171345 - DNA, 25 bp, Mus musculus
acaaagagaaagccagtgagaccga

SEQ ID NO: 171346 - DNA, 25 bp, Mus musculus
acaaagagaaggatgcatcttcctg

SEQ ID NO: 171347 - DNA, 25 bp, Mus musculus
acaaagagaaggatggcatccccat

SEQ ID NO: 171348 - DNA, 25 bp, Mus musculus
acaaagagaagtgcagcccccttcc

SEQ ID NO: 171349 - DNA, 25 bp, Mus musculus
acaaagagaatgatggatatatctt

SEQ ID NO: 171350 - DNA, 25 bp, Mus musculus
acaaagagagctggaaagtctttga

SEQ ID NO: 171351 - DNA, 25 bp, Mus musculus
acaaagagcagcaatgttaagtctt

SEQ ID NO: 171352 - DNA, 25 bp, Mus musculus
acaaagagccagttccaagaattac

SEQ ID NO: 171353 - DNA, 25 bp, Mus musculus
acaaagagcgcgcgatttctaacga

SEQ ID NO: 171354 - DNA, 25 bp, Mus musculus
acaaagagcgcgcgtggaaagaaga

SEQ ID NO: 171355 - DNA, 25 bp, Mus musculus
acaaagagtctgaggatcctaaaca

SEQ ID NO: 171356 - DNA, 25 bp, Mus musculus
acaaagatattcaggtccttaaaat

SEQ ID NO: 171357 - DNA, 25 bp, Mus musculus
acaaagatattccagcctcactgca

SEQ ID NO: 171358 - DNA, 25 bp, Mus musculus
acaaagatcctctgagtgccagcag

SEQ ID NO: 171359 - DNA, 25 bp, Mus musculus
acaaagatgacaaccccaagcatcc

SEQ ID NO: 171360 - DNA, 25 bp, Mus musculus
acaaagatgacagcaaaaatgtatt

SEQ ID NO: 171361 - DNA, 25 bp, Mus musculus
acaaagatgacagcaaacataaagg

SEQ ID NO: 171362 - DNA, 25 bp, Mus musculus
acaaagatgagtggataagtggagc

SEQ ID NO: 171363 - DNA, 25 bp, Mus musculus
acaaagatggctgcatgagagcgac

SEQ ID NO: 171364 - DNA, 25 bp, Mus musculus
acaaagcaaagacaaatgagcttgt

SEQ ID NO: 171365 - DNA, 25 bp, Mus musculus
acaaagcaaagatcattgcttgtct

SEQ ID NO: 171366 - DNA, 25 bp, Mus musculus
acaaagcaaagccagggcatagtcc

SEQ ID NO: 171367 - DNA, 25 bp, Mus musculus
acaaagcaaagccagtgaaactgaa

SEQ ID NO: 171368 - DNA, 25 bp, Mus musculus
acaaagcaacaggtggaccgtacgg

SEQ ID NO: 171369 - DNA, 25 bp, Mus musculus
acaaagcaagctaccaagagcaaaa

SEQ ID NO: 171370 - DNA, 25 bp, Mus musculus
acaaagcaaggagtaatataaagat

SEQ ID NO: 171371 - DNA, 25 bp, Mus musculus
acaaagcaattgcctgtaccccagt

SEQ ID NO: 171372 - DNA, 25 bp, Mus musculus
acaaagcacagaaggaacagattct

SEQ ID NO: 171373 - DNA, 25 bp, Mus musculus
acaaagcagaagagaatggaagtga

SEQ ID NO: 171374 - DNA, 25 bp, Mus musculus
acaaagcagatttaaagaacccaat

SEQ ID NO: 171375 - DNA, 25 bp, Mus musculus
acaaagccaaagctgctcagactgc

SEQ ID NO: 171376 - DNA, 25 bp, Mus musculus
acaaagccaccaagatcctgagaca

SEQ ID NO: 171377 - DNA, 25 bp, Mus musculus
acaaagccagaaaaaaaatcagttc

SEQ ID NO: 171378 - DNA, 25 bp, Mus musculus
acaaagccagaaaatcactgtgagc

SEQ ID NO: 171379 - DNA, 25 bp, Mus musculus
acaaagccagctaccgagtctattg

SEQ ID NO: 171380 - DNA, 25 bp, Mus musculus
acaaagcccactcagtgaatggcat

SEQ ID NO: 171381 - DNA, 25 bp, Mus musculus
acaaagccctcaagaaactccggag

SEQ ID NO: 171382 - DNA, 25 bp, Mus musculus
acaaagccttgctgattttcagaaa

SEQ ID NO: 171383 - DNA, 25 bp, Mus musculus
acaaagctaggaggactcacacacg

SEQ ID NO: 171384 - DNA, 25 bp, Mus musculus
acaaagctcatagcgggatcctgcc

SEQ ID NO: 171385 - DNA, 25 bp, Mus musculus
acaaagctgcaggcatcgttctgcc

SEQ ID NO: 171386 - DNA, 25 bp, Mus musculus
acaaaggaaagatttctcgaatgct

SEQ ID NO: 171387 - DNA, 25 bp, Mus musculus
acaaaggaaaggcattagcaaaagc

SEQ ID NO: 171388 - DNA, 25 bp, Mus musculus
acaaaggaaatctgaaaaaagacga

SEQ ID NO: 171389 - DNA, 25 bp, Mus musculus
acaaaggaaatctgccttaagaact

SEQ ID NO: 171390 - DNA, 25 bp, Mus musculus
acaaaggacagaagagatctgctgg

SEQ ID NO: 171391 - DNA, 25 bp, Mus musculus
acaaaggacagaagggctctgcgtt

SEQ ID NO: 171392 - DNA, 25 bp, Mus musculus
acaaaggacagaagtcctccacaga

SEQ ID NO: 171393 - DNA, 25 bp, Mus musculus
acaaaggaccgatgtagcaggcctg

SEQ ID NO: 171394 - DNA, 25 bp, Mus musculus
acaaaggagaaaagggtgctcgggg

SEQ ID NO: 171395 - DNA, 25 bp, Mus musculus
acaaaggagaccctggcttcaaagg

SEQ ID NO: 171396 - DNA, 25 bp, Mus musculus
acaaaggagagaagagaggctctca

SEQ ID NO: 171397 - DNA, 25 bp, Mus musculus
acaaaggatccagatgcagaactct

SEQ ID NO: 171398 - DNA, 25 bp, Mus musculus
acaaaggatccagtttatttatatg

SEQ ID NO: 171399 - DNA, 25 bp, Mus musculus
acaaaggattatggtaccaagcgcc

SEQ ID NO: 171400 - DNA, 25 bp, Mus musculus
acaaaggcacagcgccctcaggcct

SEQ ID NO: 171401 - DNA, 25 bp, Mus musculus
acaaaggcagagtcagttgttcact

SEQ ID NO: 171402 - DNA, 25 bp, Mus musculus
acaaaggccaaacaaaagccgaaat

SEQ ID NO: 171403 - DNA, 25 bp, Mus musculus
acaaaggccaaacaaagagcacagt

SEQ ID NO: 171404 - DNA, 25 bp, Mus musculus
acaaaggccaaacaagttgtcaagt

SEQ ID NO: 171405 - DNA, 25 bp, Mus musculus
acaaaggcgacgacctgctgccgtc

SEQ ID NO: 171406 - DNA, 25 bp, Mus musculus
acaaaggcgacgatagggccagtgt

SEQ ID NO: 171407 - DNA, 25 bp, Mus musculus
acaaaggcgagcagggtcctcctgg

SEQ ID NO: 171408 - DNA, 25 bp, Mus musculus
acaaaggctgcagaacatgaagttc

SEQ ID NO: 171409 - DNA, 25 bp, Mus musculus
acaaaggcttcaaagattacatgaa

SEQ ID NO: 171410 - DNA, 25 bp, Mus musculus
acaaaggcttcaaagttgcacctgc

SEQ ID NO: 171411 - DNA, 25 bp, Mus musculus
acaaaggctttaagctctggtgcaa

SEQ ID NO: 171412 - DNA, 25 bp, Mus musculus
acaaagggcacaggctcgtcccctg

SEQ ID NO: 171413 - DNA, 25 bp, Mus musculus
acaaagggcctagcagagctcctca

SEQ ID NO: 171414 - DNA, 25 bp, Mus musculus
acaaagggcctagcgccagccagag

SEQ ID NO: 171415 - DNA, 25 bp, Mus musculus
acaaaggggaagttccaggatccag

SEQ ID NO: 171416 - DNA, 25 bp, Mus musculus
acaaaggtagctacttggtgagtga

SEQ ID NO: 171417 - DNA, 25 bp, Mus musculus
acaaaggtgccaacatctatttcaa

SEQ ID NO: 171418 - DNA, 25 bp, Mus musculus
acaaaggtggcgggcgagaactttg

SEQ ID NO: 171419 - DNA, 25 bp, Mus musculus
acaaaggttgtccggtccttcagac

SEQ ID NO: 171420 - DNA, 25 bp, Mus musculus
acaaaggtttcaagaattggaggcc

SEQ ID NO: 171421 - DNA, 25 bp, Mus musculus
acaaagtagctcaaccgaagaacct

SEQ ID NO: 171422 - DNA, 25 bp, Mus musculus
acaaagtcaaaggtggcagggctga

SEQ ID NO: 171423 - DNA, 25 bp, Mus musculus
acaaagtcaaggctctacccctggt

SEQ ID NO: 171424 - DNA, 25 bp, Mus musculus
acaaagtcaaggtgtatgagatgga

SEQ ID NO: 171425 - DNA, 25 bp, Mus musculus
acaaagtcagatactccatatcata

SEQ ID NO: 171426 - DNA, 25 bp, Mus musculus
acaaagtccaagaactgatgtctac

SEQ ID NO: 171427 - DNA, 25 bp, Mus musculus
acaaagtccaagattgcgctggctc

SEQ ID NO: 171428 - DNA, 25 bp, Mus musculus
acaaagtgaagtgctcaggagctgt

SEQ ID NO: 171429 - DNA, 25 bp, Mus musculus
acaaagtgaatgtactctattcttc

SEQ ID NO: 171430 - DNA, 25 bp, Mus musculus
acaaagtgcgatgcgctgttcctgg

SEQ ID NO: 171431 - DNA, 25 bp, Mus musculus
acaaagtgcgatgcgtcgtccccca

SEQ ID NO: 171432 - DNA, 25 bp, Mus musculus
acaaagtgctgatggagtttgtgga

SEQ ID NO: 171433 - DNA, 25 bp, Mus musculus
acaaagtggtggaggggatcctgga

SEQ ID NO: 171434 - DNA, 25 bp, Mus musculus
acaaagtgtctcagaatgcaaagta

SEQ ID NO: 171435 - DNA, 25 bp, Mus musculus
acaaagtgtctcagccttcgtagtg

SEQ ID NO: 171436 - DNA, 25 bp, Mus musculus
acaaagtgtctgcttttcagaaagg

SEQ ID NO: 171437 - DNA, 25 bp, Mus musculus
acaaagttagcttgaacatcacaag

SEQ ID NO: 171438 - DNA, 25 bp, Mus musculus
acaaagttcagagtgcagagagcag

SEQ ID NO: 171439 - DNA, 25 bp, Mus musculus
acaaagttcagtactagaagacaca

SEQ ID NO: 171440 - DNA, 25 bp, Mus musculus
acaaagttcatggagtcgctgggga

SEQ ID NO: 171441 - DNA, 25 bp, Mus musculus
acaaagttcatgggtgtttgccagc

SEQ ID NO: 171442 - DNA, 25 bp, Mus musculus
acaaagttgcagatactcagcctca

SEQ ID NO: 171443 - DNA, 25 bp, Mus musculus
acaaagttggcatcctgactttgag

SEQ ID NO: 171444 - DNA, 25 bp, Mus musculus
acaaagtttgagagtggatgtaaag

SEQ ID NO: 171445 - DNA, 25 bp, Mus musculus
acaaagtttggaggccacctatgaa

SEQ ID NO: 171446 - DNA, 25 bp, Mus musculus
acaaagtttggagtttgttgaagga

SEQ ID NO: 171447 - DNA, 25 bp, Mus musculus
acaaagtttgggggagcattctctg

SEQ ID NO: 171448 - DNA, 25 bp, Mus musculus
acaaataaaaaaattcatctacagg

SEQ ID NO: 171449 - DNA, 25 bp, Mus musculus
acaaataactgggctgttttacctc

SEQ ID NO: 171450 - DNA, 25 bp, Mus musculus
acaaataatagtgcttacagacaca

SEQ ID NO: 171451 - DNA, 25 bp, Mus musculus
acaaatacaggaagacatttcagag

SEQ ID NO: 171452 - DNA, 25 bp, Mus musculus
acaaataccggggtgaacctggaga

SEQ ID NO: 171453 - DNA, 25 bp, Mus musculus
acaaatacggtacccatgtgaaagc

SEQ ID NO: 171454 - DNA, 25 bp, Mus musculus
acaaatactttgctgccttctgata

SEQ ID NO: 171455 - DNA, 25 bp, Mus musculus
acaaatactttgttgaaccaagact

SEQ ID NO: 171456 - DNA, 25 bp, Mus musculus
acaaatagcagattttggagtaagc

SEQ ID NO: 171457 - DNA, 25 bp, Mus musculus
acaaatagctcctaggttgggagtc

SEQ ID NO: 171458 - DNA, 25 bp, Mus musculus
acaaatagctcctatacctgactgt

SEQ ID NO: 171459 - DNA, 25 bp, Mus musculus
acaaatatcagaggccacctatgaa

SEQ ID NO: 171460 - DNA, 25 bp, Mus musculus
acaaatatgtggggatgatccttag

SEQ ID NO: 171461 - DNA, 25 bp, Mus musculus
acaaatatgtggggtacgatctttg

SEQ ID NO: 171462 - DNA, 25 bp, Mus musculus
acaaatcaaaaggtgtgatccttgc

SEQ ID NO: 171463 - DNA, 25 bp, Mus musculus
acaaatcaaggcatgctgtgagatg

SEQ ID NO: 171464 - DNA, 25 bp, Mus musculus
acaaatcaaggtgacaaaagaacta

SEQ ID NO: 171465 - DNA, 25 bp, Mus musculus
acaaatcatagaggacattaaggac

SEQ ID NO: 171466 - DNA, 25 bp, Mus musculus
acaaatccaccgcggagatggatgg

SEQ ID NO: 171467 - DNA, 25 bp, Mus musculus
acaaatccaccgcgggaccttctgt

SEQ ID NO: 171468 - DNA, 25 bp, Mus musculus
acaaatcccaggagcaagtgtcgtt

SEQ ID NO: 171469 - DNA, 25 bp, Mus musculus
acaaatcccagttgtaggccatcgt

SEQ ID NO: 171470 - DNA, 25 bp, Mus musculus
acaaatcctcgtggctcctcccacc

SEQ ID NO: 171471 - DNA, 25 bp, Mus musculus
acaaatcgattcaaggatcgcattg

SEQ ID NO: 171472 - DNA, 25 bp, Mus musculus
acaaatctatcaaaggtgatttcaa

SEQ ID NO: 171473 - DNA, 25 bp, Mus musculus
acaaatgaacagctctggagtgcac

SEQ ID NO: 171474 - DNA, 25 bp, Mus musculus
acaaatgaacaggcaccacgcccca

SEQ ID NO: 171475 - DNA, 25 bp, Mus musculus
acaaatgaacaggcctattcctggc

SEQ ID NO: 171476 - DNA, 25 bp, Mus musculus
acaaatgaacaggtgtgcggaccaa

SEQ ID NO: 171477 - DNA, 25 bp, Mus musculus
acaaatgaaggagcccattgaagac

SEQ ID NO: 171478 - DNA, 25 bp, Mus musculus
acaaatgacacccagtcttctggga

SEQ ID NO: 171479 - DNA, 25 bp, Mus musculus
acaaatgcaggaatgtgctaaaagg

SEQ ID NO: 171480 - DNA, 25 bp, Mus musculus
acaaatgcccagctcctaacctcga

SEQ ID NO: 171481 - DNA, 25 bp, Mus musculus
acaaatgggaggaggcacttgaata

SEQ ID NO: 171482 - DNA, 25 bp, Mus musculus
acaaatggtttgcgtttgcagtatg

SEQ ID NO: 171483 - DNA, 25 bp, Mus musculus
acaaatgtaaggcaaatgaccatgg

SEQ ID NO: 171484 - DNA, 25 bp, Mus musculus
acaaatgtacagagaaatttgtatg

SEQ ID NO: 171485 - DNA, 25 bp, Mus musculus
acaaatgtacaggagctgaagttcc

SEQ ID NO: 171486 - DNA, 25 bp, Mus musculus
acaaatgtttggtcaatttggtaaa

SEQ ID NO: 171487 - DNA, 25 bp, Mus musculus
acaaattaaagaagtataataagcc

SEQ ID NO: 171488 - DNA, 25 bp, Mus musculus
acaaattaatcacaatatcgccatg

SEQ ID NO: 171489 - DNA, 25 bp, Mus musculus
acaaattcaagtgctaaactgaaat

SEQ ID NO: 171490 - DNA, 25 bp, Mus musculus
acaaattcccatctcatttgaaaat

SEQ ID NO: 171491 - DNA, 25 bp, Mus musculus
acaaattgaaactggaagcatatat

SEQ ID NO: 171492 - DNA, 25 bp, Mus musculus
acaaattgaagctggaaagcaaaga

SEQ ID NO: 171493 - DNA, 25 bp, Mus musculus
acaaattgaagctgggtgttgacca

SEQ ID NO: 171494 - DNA, 25 bp, Mus musculus
acaaattgagcaggccgcttggaca

SEQ ID NO: 171495 - DNA, 25 bp, Mus musculus
acaaatttgtcaaagaactactatc

SEQ ID NO: 171496 - DNA, 25 bp, Mus musculus
acaacaaaaatggctcaaactcaga

SEQ ID NO: 171497 - DNA, 25 bp, Mus musculus
acaacaaaaggccaactactcaaaa

SEQ ID NO: 171498 - DNA, 25 bp, Mus musculus
acaacaaagaagctcttagcccccc

SEQ ID NO: 171499 - DNA, 25 bp, Mus musculus
acaacaaagaggaagcctgcacttt

SEQ ID NO: 171500 - DNA, 25 bp, Mus musculus
acaacaaagattatcagagactgct

SEQ ID NO: 171501 - DNA, 25 bp, Mus musculus
acaacaaatggaccccttctttctc

SEQ ID NO: 171502 - DNA, 25 bp, Mus musculus
acaacaaatgtcactagtgccaaca

SEQ ID NO: 171503 - DNA, 25 bp, Mus musculus
acaacaacaaaaatggctcaaactc

SEQ ID NO: 171504 - DNA, 25 bp, Mus musculus
acaacaacaagcatcaccctaccag

SEQ ID NO: 171505 - DNA, 25 bp, Mus musculus
acaacaacaaggagcactttagtga

SEQ ID NO: 171506 - DNA, 25 bp, Mus musculus
acaacaacgagcatcgaggagttgt

SEQ ID NO: 171507 - DNA, 25 bp, Mus musculus
acaacaagaacaaggagttgggagc

SEQ ID NO: 171508 - DNA, 25 bp, Mus musculus
acaacaagaacaaggtgctctgttt

SEQ ID NO: 171509 - DNA, 25 bp, Mus musculus
acaacaagaacattctcaagatcgg

SEQ ID NO: 171510 - DNA, 25 bp, Mus musculus
acaacaagaaggtagaggcagtcat

SEQ ID NO: 171511 - DNA, 25 bp, Mus musculus
acaacaagacccctcctcctcgatt

SEQ ID NO: 171512 - DNA, 25 bp, Mus musculus
acaacaagaggaaatacagaagctt

SEQ ID NO: 171513 - DNA, 25 bp, Mus musculus
acaacaagcacaagttctgcctatc

SEQ ID NO: 171514 - DNA, 25 bp, Mus musculus
acaacaagcctccagaaatcgacat

SEQ ID NO: 171515 - DNA, 25 bp, Mus musculus
acaacaagctaacaactgtgccacc

SEQ ID NO: 171516 - DNA, 25 bp, Mus musculus
acaacaataggtgtttcaccaaaac

SEQ ID NO: 171517 - DNA, 25 bp, Mus musculus
acaacaatctagagcccttactccc

SEQ ID NO: 171518 - DNA, 25 bp, Mus musculus
acaacaatgagagtgctgcaaagat

SEQ ID NO: 171519 - DNA, 25 bp, Mus musculus
acaacacaaaaagcttcctagagga

SEQ ID NO: 171520 - DNA, 25 bp, Mus musculus
acaacacaaaacaggttcagacagt

SEQ ID NO: 171521 - DNA, 25 bp, Mus musculus
acaacacaatggaagtcgatggcaa

SEQ ID NO: 171522 - DNA, 25 bp, Mus musculus
acaacacactgacggagcgcttctg

SEQ ID NO: 171523 - DNA, 25 bp, Mus musculus
acaacacagagtttcaaggcaaacg

SEQ ID NO: 171524 - DNA, 25 bp, Mus musculus
acaacacagccatggatgtgcagca

SEQ ID NO: 171525 - DNA, 25 bp, Mus musculus
acaacacagccatggctgtgtgcaa

SEQ ID NO: 171526 - DNA, 25 bp, Mus musculus
acaacacagtgccaggcaggtcgga

SEQ ID NO: 171527 - DNA, 25 bp, Mus musculus
acaacacagtgccagggagcccaga

SEQ ID NO: 171528 - DNA, 25 bp, Mus musculus
acaacacatgtaaggtatcgcaaac

SEQ ID NO: 171529 - DNA, 25 bp, Mus musculus
acaacacatgtaagtccaacccctg

SEQ ID NO: 171530 - DNA, 25 bp, Mus musculus
acaacaccaaaaggccgaggggcaa

SEQ ID NO: 171531 - DNA, 25 bp, Mus musculus
acaacaccaaactttaagaagcttc

SEQ ID NO: 171532 - DNA, 25 bp, Mus musculus
acaacaccaagagaggtattgtggc

SEQ ID NO: 171533 - DNA, 25 bp, Mus musculus
acaacaccaagagcttactggcggt

SEQ ID NO: 171534 - DNA, 25 bp, Mus musculus
acaacacccctgtggatatgactcc

SEQ ID NO: 171535 - DNA, 25 bp, Mus musculus
acaacacccctgtggattccactgt

SEQ ID NO: 171536 - DNA, 25 bp, Mus musculus
acaacaccctattttataggcaatg

SEQ ID NO: 171537 - DNA, 25 bp, Mus musculus
acaacaccgacgagtccatttcggg

SEQ ID NO: 171538 - DNA, 25 bp, Mus musculus
acaacacctaacccggctggccaag

SEQ ID NO: 171539 - DNA, 25 bp, Mus musculus
acaacacctggagagtgagaagatg

SEQ ID NO: 171540 - DNA, 25 bp, Mus musculus
acaacacggctcaagcaaggaccat

SEQ ID NO: 171541 - DNA, 25 bp, Mus musculus
acaacactgaaaggggcatctgatg

SEQ ID NO: 171542 - DNA, 25 bp, Mus musculus
acaacactgaatatctcctgggctt

SEQ ID NO: 171543 - DNA, 25 bp, Mus musculus
acaacactgttttgagagtggagtc

SEQ ID NO: 171544 - DNA, 25 bp, Mus musculus
acaacagaaaaggcagccggagcat

SEQ ID NO: 171545 - DNA, 25 bp, Mus musculus
acaacagaaatgtgaaaaactcaaa

SEQ ID NO: 171546 - DNA, 25 bp, Mus musculus
acaacagaaggagctccatctgtag

SEQ ID NO: 171547 - DNA, 25 bp, Mus musculus
acaacagaatgcacgtagaaaatcc

SEQ ID NO: 171548 - DNA, 25 bp, Mus musculus
acaacagacaaaaattaactgaaac

SEQ ID NO: 171549 - DNA, 25 bp, Mus musculus
acaacagacaaaagccaaccatatt

SEQ ID NO: 171550 - DNA, 25 bp, Mus musculus
acaacagaccgcagaagttatatga

SEQ ID NO: 171551 - DNA, 25 bp, Mus musculus
acaacagacgaccttgttgccgctg

SEQ ID NO: 171552 - DNA, 25 bp, Mus musculus
acaacagagatggatggacagtctg

SEQ ID NO: 171553 - DNA, 25 bp, Mus musculus
acaacagatttcctctgcccctcag

SEQ ID NO: 171554 - DNA, 25 bp, Mus musculus
acaacagcaagcccaccaattcctg

SEQ ID NO: 171555 - DNA, 25 bp, Mus musculus
acaacagcacaggcgtggtgactgt

SEQ ID NO: 171556 - DNA, 25 bp, Mus musculus
acaacagcagccgcccctgccttag

SEQ ID NO: 171557 - DNA, 25 bp, Mus musculus
acaacagcataaacgatatgtgtca

SEQ ID NO: 171558 - DNA, 25 bp, Mus musculus
acaacagcgctacctccttctggcc

SEQ ID NO: 171559 - DNA, 25 bp, Mus musculus
acaacagcgtttatggggcccagac

SEQ ID NO: 171560 - DNA, 25 bp, Mus musculus
acaacagcttgcaaattacaggcct

SEQ ID NO: 171561 - DNA, 25 bp, Mus musculus
acaacagctttacgatcatcactcc

SEQ ID NO: 171562 - DNA, 25 bp, Mus musculus
acaacagctttacgatcatcttgac

SEQ ID NO: 171563 - DNA, 25 bp, Mus musculus
acaacaggaagcgtggaggatgagc

SEQ ID NO: 171564 - DNA, 25 bp, Mus musculus
acaacaggggcagtcccaggacggc

SEQ ID NO: 171565 - DNA, 25 bp, Mus musculus
acaacaggggcagtgtttgccaaga

SEQ ID NO: 171566 - DNA, 25 bp, Mus musculus
acaacaggtcaaaatgtcctgcagg

SEQ ID NO: 171567 - DNA, 25 bp, Mus musculus
acaacagtccagattccttctggaa

SEQ ID NO: 171568 - DNA, 25 bp, Mus musculus
acaacagtcctgattctttaagaaa

SEQ ID NO: 171569 - DNA, 25 bp, Mus musculus
acaacagtggggtgagtttaaggta

SEQ ID NO: 171570 - DNA, 25 bp, Mus musculus
acaacagttaaaaggttttcagcag

SEQ ID NO: 171571 - DNA, 25 bp, Mus musculus
acaacagtttgggggacatcctgca

SEQ ID NO: 171572 - DNA, 25 bp, Mus musculus
acaacatacaggataagaacaagaa

SEQ ID NO: 171573 - DNA, 25 bp, Mus musculus
acaacatcaaggtgtctttggactc

SEQ ID NO: 171574 - DNA, 25 bp, Mus musculus
acaacatcacagagtcccacccagg

SEQ ID NO: 171575 - DNA, 25 bp, Mus musculus
acaacatcatcgctgtgttttctcg

SEQ ID NO: 171576 - DNA, 25 bp, Mus musculus
acaacatcctaggcttcatcgcctc

SEQ ID NO: 171577 - DNA, 25 bp, Mus musculus
acaacatctgatggaacctgtacca

SEQ ID NO: 171578 - DNA, 25 bp, Mus musculus
acaacatctgatggtctatctccac

SEQ ID NO: 171579 - DNA, 25 bp, Mus musculus
acaacatctggagagagacttgcct

SEQ ID NO: 171580 - DNA, 25 bp, Mus musculus
acaacatctgggacaagctggatgg

SEQ ID NO: 171581 - DNA, 25 bp, Mus musculus
acaacatgaacagaagagagagggg

SEQ ID NO: 171582 - DNA, 25 bp, Mus musculus
acaacatgcagatggtgtcagtgga

SEQ ID NO: 171583 - DNA, 25 bp, Mus musculus
acaacatgcagggtgtgttggagag

SEQ ID NO: 171584 - DNA, 25 bp, Mus musculus
acaacatggagcatatccgtgtggg

SEQ ID NO: 171585 - DNA, 25 bp, Mus musculus
acaacatgtgggatcacatgcagtg

SEQ ID NO: 171586 - DNA, 25 bp, Mus musculus
acaacatgttcaaaggagcctttga

SEQ ID NO: 171587 - DNA, 25 bp, Mus musculus
acaacatgttcaaagttagcatatt

SEQ ID NO: 171588 - DNA, 25 bp, Mus musculus
acaacattgagcagagtctgcgaga

SEQ ID NO: 171589 - DNA, 25 bp, Mus musculus
acaaccaaaaatactgaagcagaaa

SEQ ID NO: 171590 - DNA, 25 bp, Mus musculus
acaaccaagaaaggggagatctttg

SEQ ID NO: 171591 - DNA, 25 bp, Mus musculus
acaaccaagaaagtgctctcttccc

SEQ ID NO: 171592 - DNA, 25 bp, Mus musculus
acaaccaaggataaggacaaagcca

SEQ ID NO: 171593 - DNA, 25 bp, Mus musculus
acaaccaagggtacttcgagaatat

SEQ ID NO: 171594 - DNA, 25 bp, Mus musculus
acaaccaatagaccaagacaacaaa

SEQ ID NO: 171595 - DNA, 25 bp, Mus musculus
acaaccaatgaggaatacttggacc

SEQ ID NO: 171596 - DNA, 25 bp, Mus musculus
acaaccaatgaggaatacttggatc

SEQ ID NO: 171597 - DNA, 25 bp, Mus musculus
acaaccacaaggcgctacagcaacg

SEQ ID NO: 171598 - DNA, 25 bp, Mus musculus
acaaccacagactgcagttttcaga

SEQ ID NO: 171599 - DNA, 25 bp, Mus musculus
acaaccacagactggaaccagccag

SEQ ID NO: 171600 - DNA, 25 bp, Mus musculus
acaaccacagcgacccatacgtgaa

SEQ ID NO: 171601 - DNA, 25 bp, Mus musculus
acaaccacagcttcacacagagacc

SEQ ID NO: 171602 - DNA, 25 bp, Mus musculus
acaaccaccctctgggcatggctat

SEQ ID NO: 171603 - DNA, 25 bp, Mus musculus
acaaccacctggcgctggttacccg

SEQ ID NO: 171604 - DNA, 25 bp, Mus musculus
acaaccacgctgcagcaccacaaag

SEQ ID NO: 171605 - DNA, 25 bp, Mus musculus
acaaccactcagggcttcacaccta

SEQ ID NO: 171606 - DNA, 25 bp, Mus musculus
acaaccagagcctggcagaagatga

SEQ ID NO: 171607 - DNA, 25 bp, Mus musculus
acaaccagagcctgggtcatacttc

SEQ ID NO: 171608 - DNA, 25 bp, Mus musculus
acaaccagcacgaagccccccagca

SEQ ID NO: 171609 - DNA, 25 bp, Mus musculus
acaaccagcagaaaacatggtggta

SEQ ID NO: 171610 - DNA, 25 bp, Mus musculus
acaaccagcagaatgtggctgctac

SEQ ID NO: 171611 - DNA, 25 bp, Mus musculus
acaaccaggagccctacacaggtcc

SEQ ID NO: 171612 - DNA, 25 bp, Mus musculus
acaaccagtataaccctttaatggc

SEQ ID NO: 171613 - DNA, 25 bp, Mus musculus
acaaccagtctaagttctttcgagt

SEQ ID NO: 171614 - DNA, 25 bp, Mus musculus
acaaccatatttggtcacctggaga

SEQ ID NO: 171615 - DNA, 25 bp, Mus musculus
acaaccatcaaaaaggcaaacataa

SEQ ID NO: 171616 - DNA, 25 bp, Mus musculus
acaaccatctctaagatgtaaagaa

SEQ ID NO: 171617 - DNA, 25 bp, Mus musculus
acaaccatggaaggctcacccacgg

SEQ ID NO: 171618 - DNA, 25 bp, Mus musculus
acaacccaaaccaggtgtatatcaa

SEQ ID NO: 171619 - DNA, 25 bp, Mus musculus
acaacccaccatgtatgcttgagag

SEQ ID NO: 171620 - DNA, 25 bp, Mus musculus
acaacccacccaggaacaattgtga

SEQ ID NO: 171621 - DNA, 25 bp, Mus musculus
acaacccagaagttctcctgattct

SEQ ID NO: 171622 - DNA, 25 bp, Mus musculus
acaacccatacctgcacctcgcacc

SEQ ID NO: 171623 - DNA, 25 bp, Mus musculus
acaaccccaaggattaaaccagaag

SEQ ID NO: 171624 - DNA, 25 bp, Mus musculus
acaaccccaagttctacagtgagtc

SEQ ID NO: 171625 - DNA, 25 bp, Mus musculus
acaaccccacccaggtggaggatgc

SEQ ID NO: 171626 - DNA, 25 bp, Mus musculus
acaaccccacccagtttctgtgttg

SEQ ID NO: 171627 - DNA, 25 bp, Mus musculus
acaacccccatacggtgcctcctga

SEQ ID NO: 171628 - DNA, 25 bp, Mus musculus
acaaccccgtcaaggtccgatctga

SEQ ID NO: 171629 - DNA, 25 bp, Mus musculus
acaaccccgttcagcagagagtact

SEQ ID NO: 171630 - DNA, 25 bp, Mus musculus
acaacccctgaccataggtcaaagt

SEQ ID NO: 171631 - DNA, 25 bp, Mus musculus
acaacccctgggtggagtttaccag

SEQ ID NO: 171632 - DNA, 25 bp, Mus musculus
acaacccgatagaggagcatagaaa

SEQ ID NO: 171633 - DNA, 25 bp, Mus musculus
acaacccgcggggcgccctgcataa

SEQ ID NO: 171634 - DNA, 25 bp, Mus musculus
acaacccggaggaggttctgctgcc

SEQ ID NO: 171635 - DNA, 25 bp, Mus musculus
acaaccctctgggacaggtattctc

SEQ ID NO: 171636 - DNA, 25 bp, Mus musculus
acaaccctgactttactaggacctg

SEQ ID NO: 171637 - DNA, 25 bp, Mus musculus
acaaccctgactttgtggctgttcc

SEQ ID NO: 171638 - DNA, 25 bp, Mus musculus
acaaccgagaccagatcatcttcat

SEQ ID NO: 171639 - DNA, 25 bp, Mus musculus
acaaccgggattgacccaccgttct

SEQ ID NO: 171640 - DNA, 25 bp, Mus musculus
acaaccgggattggcagaattacta

SEQ ID NO: 171641 - DNA, 25 bp, Mus musculus
acaacctagagaagaagcgagatga

SEQ ID NO: 171642 - DNA, 25 bp, Mus musculus
acaacctagagaagcgagatgagcg

SEQ ID NO: 171643 - DNA, 25 bp, Mus musculus
acaacctagaggccttgtctcacaa

SEQ ID NO: 171644 - DNA, 25 bp, Mus musculus
acaacctagcctcccgttgttctac

SEQ ID NO: 171645 - DNA, 25 bp, Mus musculus
acaacctagctacagaactgtgccg

SEQ ID NO: 171646 - DNA, 25 bp, Mus musculus
acaacctagctcccgatggtcactg

SEQ ID NO: 171647 - DNA, 25 bp, Mus musculus
acaacctatgtcttttgtgctagag

SEQ ID NO: 171648 - DNA, 25 bp, Mus musculus
acaacctcaaataaagaagatacat

SEQ ID NO: 171649 - DNA, 25 bp, Mus musculus
acaacctcaacgtcatcctggccag

SEQ ID NO: 171650 - DNA, 25 bp, Mus musculus
acaacctcccttgtggtgtgaacat

SEQ ID NO: 171651 - DNA, 25 bp, Mus musculus
acaacctccgcaagaatggaatcat

SEQ ID NO: 171652 - DNA, 25 bp, Mus musculus
acaacctctcccagctccctggctg

SEQ ID NO: 171653 - DNA, 25 bp, Mus musculus
acaacctctcccaggtgtgtgacgg

SEQ ID NO: 171654 - DNA, 25 bp, Mus musculus
acaacctgaaagattttgatagact

SEQ ID NO: 171655 - DNA, 25 bp, Mus musculus
acaacctgagcacagtgagcatgtt

SEQ ID NO: 171656 - DNA, 25 bp, Mus musculus
acaacctggcagaggaaaactccag

SEQ ID NO: 171657 - DNA, 25 bp, Mus musculus
acaacctgggctttgctgggaccca

SEQ ID NO: 171658 - DNA, 25 bp, Mus musculus
acaacctgtacctgcaaatgagcag

SEQ ID NO: 171659 - DNA, 25 bp, Mus musculus
acaacctgttcaagaaaattgacct

SEQ ID NO: 171660 - DNA, 25 bp, Mus musculus
acaacctgttggagagaagacacag

SEQ ID NO: 171661 - DNA, 25 bp, Mus musculus
acaaccttcgagtcctcaaatgcca

SEQ ID NO: 171662 - DNA, 25 bp, Mus musculus
acaaccttgcaggccctgtggttct

SEQ ID NO: 171663 - DNA, 25 bp, Mus musculus
acaacgaaggcgagatctgcatcaa

SEQ ID NO: 171664 - DNA, 25 bp, Mus musculus
acaacgaatcctttgtcatctacat

SEQ ID NO: 171665 - DNA, 25 bp, Mus musculus
acaacgacaagttctccaccccctc

SEQ ID NO: 171666 - DNA, 25 bp, Mus musculus
acaacgagaaggatctggtgaaact

SEQ ID NO: 171667 - DNA, 25 bp, Mus musculus
acaacgagagctggggctttgtgca

SEQ ID NO: 171668 - DNA, 25 bp, Mus musculus
acaacgagagttctgcctgctgagc

SEQ ID NO: 171669 - DNA, 25 bp, Mus musculus
acaacgagcgagtggtgacgtatgc

SEQ ID NO: 171670 - DNA, 25 bp, Mus musculus
acaacgagcgagttgggatggctac

SEQ ID NO: 171671 - DNA, 25 bp, Mus musculus
acaacgccggagcagggtccccaga

SEQ ID NO: 171672 - DNA, 25 bp, Mus musculus
acaacgccggcccgtgtggatctgc

SEQ ID NO: 171673 - DNA, 25 bp, Mus musculus
acaacgctgactttgagaagctgaa

SEQ ID NO: 171674 - DNA, 25 bp, Mus musculus
acaacgctgcttctgaaccagctgg

SEQ ID NO: 171675 - DNA, 25 bp, Mus musculus
acaacggcactgcgctcttggaatt

SEQ ID NO: 171676 - DNA, 25 bp, Mus musculus
acaacggtgtaaagctggaccgtgt

SEQ ID NO: 171677 - DNA, 25 bp, Mus musculus
acaacgtcaacaagcttgctcagga

SEQ ID NO: 171678 - DNA, 25 bp, Mus musculus
acaacgtcaaccctccacgccatca

SEQ ID NO: 171679 - DNA, 25 bp, Mus musculus
acaacgtcaacccttcagaaagcca

SEQ ID NO: 171680 - DNA, 25 bp, Mus musculus
acaacgtcaggtatggcatttcaaa

SEQ ID NO: 171681 - DNA, 25 bp, Mus musculus
acaacgtgataagaatttattctct

SEQ ID NO: 171682 - DNA, 25 bp, Mus musculus
acaacgttaaaggatatcacttata

SEQ ID NO: 171683 - DNA, 25 bp, Mus musculus
acaacgttcacccggccacacagcg

SEQ ID NO: 171684 - DNA, 25 bp, Mus musculus
acaactaaacaggaatgcttcgtgg

SEQ ID NO: 171685 - DNA, 25 bp, Mus musculus
acaactaacatgcaatgatcttccc

SEQ ID NO: 171686 - DNA, 25 bp, Mus musculus
acaactaccagaacaatgaaaagga

SEQ ID NO: 171687 - DNA, 25 bp, Mus musculus
acaactaccagattatccagctgat

SEQ ID NO: 171688 - DNA, 25 bp, Mus musculus
acaactaccaggcaggacccgacgc

SEQ ID NO: 171689 - DNA, 25 bp, Mus musculus
acaactacgattcatcccatcagat

SEQ ID NO: 171690 - DNA, 25 bp, Mus musculus
acaactacgattccatgtacacggc

SEQ ID NO: 171691 - DNA, 25 bp, Mus musculus
acaactacggaaagaatgatgaagt

SEQ ID NO: 171692 - DNA, 25 bp, Mus musculus
acaactacggaaagatcagaaacat

SEQ ID NO: 171693 - DNA, 25 bp, Mus musculus
acaactacggaaaggtgactcagaa

SEQ ID NO: 171694 - DNA, 25 bp, Mus musculus
acaactagaatatgacttgggtcag

SEQ ID NO: 171695 - DNA, 25 bp, Mus musculus
acaactagaatatggtggcccatat

SEQ ID NO: 171696 - DNA, 25 bp, Mus musculus
acaactaggccagatttaccttatg

SEQ ID NO: 171697 - DNA, 25 bp, Mus musculus
acaactaggccagctgctcagccat

SEQ ID NO: 171698 - DNA, 25 bp, Mus musculus
acaactatatacaggctacagacaa

SEQ ID NO: 171699 - DNA, 25 bp, Mus musculus
acaactatctcagcatcaagatgac

SEQ ID NO: 171700 - DNA, 25 bp, Mus musculus
acaactatgaaatgggtgggatgct

SEQ ID NO: 171701 - DNA, 25 bp, Mus musculus
acaactatgagtgaactccgggata

SEQ ID NO: 171702 - DNA, 25 bp, Mus musculus
acaactatggaggaggaaattatgg

SEQ ID NO: 171703 - DNA, 25 bp, Mus musculus
acaactcaagcctaccaccactggc

SEQ ID NO: 171704 - DNA, 25 bp, Mus musculus
acaactcaaggtgaaatttgaagct

SEQ ID NO: 171705 - DNA, 25 bp, Mus musculus
acaactcacaactttgctcggaaaa

SEQ ID NO: 171706 - DNA, 25 bp, Mus musculus
acaactcatcagtctgtatatctgt

SEQ ID NO: 171707 - DNA, 25 bp, Mus musculus
acaactccaggaagagctgatcttt

SEQ ID NO: 171708 - DNA, 25 bp, Mus musculus
acaactctagagaagtttattgata

SEQ ID NO: 171709 - DNA, 25 bp, Mus musculus
acaactctatcaagatctgggataa

SEQ ID NO: 171710 - DNA, 25 bp, Mus musculus
acaactctgagtaccaaggcaaaga

SEQ ID NO: 171711 - DNA, 25 bp, Mus musculus
acaactctgatcagagtgccagaag

SEQ ID NO: 171712 - DNA, 25 bp, Mus musculus
acaactgaaaaaggacggctcctct

SEQ ID NO: 171713 - DNA, 25 bp, Mus musculus
acaactgaacgtttggatgaagcaa

SEQ ID NO: 171714 - DNA, 25 bp, Mus musculus
acaactgaaggctgcccgagagatt

SEQ ID NO: 171715 - DNA, 25 bp, Mus musculus
acaactgaccaggacaagagtgaag

SEQ ID NO: 171716 - DNA, 25 bp, Mus musculus
acaactgagtgaagaaactgatctc

SEQ ID NO: 171717 - DNA, 25 bp, Mus musculus
acaactgagtgaagaggagatgcat

SEQ ID NO: 171718 - DNA, 25 bp, Mus musculus
acaactgagtgggagttgtgacaca

SEQ ID NO: 171719 - DNA, 25 bp, Mus musculus
acaactgcaggctgtttggtctcga

SEQ ID NO: 171720 - DNA, 25 bp, Mus musculus
acaactgccagagggtaacatctgc

SEQ ID NO: 171721 - DNA, 25 bp, Mus musculus
acaactgccagagggttgcatctga

SEQ ID NO: 171722 - DNA, 25 bp, Mus musculus
acaactggaggaagagcagtcagtt

SEQ ID NO: 171723 - DNA, 25 bp, Mus musculus
acaactggaggagttggaagaggaa

SEQ ID NO: 171724 - DNA, 25 bp, Mus musculus
acaactggcactggacagagagaga

SEQ ID NO: 171725 - DNA, 25 bp, Mus musculus
acaactggcactggacaggtacctc

SEQ ID NO: 171726 - DNA, 25 bp, Mus musculus
acaactgtgacaactgtgatgatcc

SEQ ID NO: 171727 - DNA, 25 bp, Mus musculus
acaactgtttaaggaatcacgccta

SEQ ID NO: 171728 - DNA, 25 bp, Mus musculus
acaactgtttaaggaatccctcttc

SEQ ID NO: 171729 - DNA, 25 bp, Mus musculus
acaacttagaaactcctatcacgct

SEQ ID NO: 171730 - DNA, 25 bp, Mus musculus
acaacttaggtgctggctacgccga

SEQ ID NO: 171731 - DNA, 25 bp, Mus musculus
acaacttatccagagttgtttcttg

SEQ ID NO: 171732 - DNA, 25 bp, Mus musculus
acaacttatgacatgatgatgcagt

SEQ ID NO: 171733 - DNA, 25 bp, Mus musculus
acaacttcaaggaggtttgcgggga

SEQ ID NO: 171734 - DNA, 25 bp, Mus musculus
acaacttcaatgaattcctgttccg

SEQ ID NO: 171735 - DNA, 25 bp, Mus musculus
acaacttcaggaaaagctcctccca

SEQ ID NO: 171736 - DNA, 25 bp, Mus musculus
acaacttcaggtgaaaattttgatc

SEQ ID NO: 171737 - DNA, 25 bp, Mus musculus
acaacttcgtagaagtgttaaatga

SEQ ID NO: 171738 - DNA, 25 bp, Mus musculus
acaacttctcctcagtgtttacaaa

SEQ ID NO: 171739 - DNA, 25 bp, Mus musculus
acaacttgacaggcttagaatcaga

SEQ ID NO: 171740 - DNA, 25 bp, Mus musculus
acaactttgaactctgcactttgtt

SEQ ID NO: 171741 - DNA, 25 bp, Mus musculus
acaactttgcaggataaggtagcta

SEQ ID NO: 171742 - DNA, 25 bp, Mus musculus
acaactttgtaagagaaataaagaa

SEQ ID NO: 171743 - DNA, 25 bp, Mus musculus
acaagaaaaatatcgctgtagtgcc

SEQ ID NO: 171744 - DNA, 25 bp, Mus musculus
acaagaaaaatatgttccaagtgat

SEQ ID NO: 171745 - DNA, 25 bp, Mus musculus
acaagaaaacaaagaactgcggaca

SEQ ID NO: 171746 - DNA, 25 bp, Mus musculus
acaagaaaactgttcattcgtatct

SEQ ID NO: 171747 - DNA, 25 bp, Mus musculus
acaagaaaagactatctaagctgga

SEQ ID NO: 171748 - DNA, 25 bp, Mus musculus
acaagaaaaggctgcagaagaggaa

SEQ ID NO: 171749 - DNA, 25 bp, Mus musculus
acaagaaaagtgaagaactggtggc

SEQ ID NO: 171750 - DNA, 25 bp, Mus musculus
acaagaaaatactgaattttctcag

SEQ ID NO: 171751 - DNA, 25 bp, Mus musculus
acaagaaaattgagcccagagtgcc

SEQ ID NO: 171752 - DNA, 25 bp, Mus musculus
acaagaaaattgagcccagcgggcc

SEQ ID NO: 171753 - DNA, 25 bp, Mus musculus
acaagaaaattgtgcccagggattg

SEQ ID NO: 171754 - DNA, 25 bp, Mus musculus
acaagaaacatccggcatttgtaga

SEQ ID NO: 171755 - DNA, 25 bp, Mus musculus
acaagaaactcgggtgccctccaat

SEQ ID NO: 171756 - DNA, 25 bp, Mus musculus
acaagaaagaaatggcaaaagatgt

SEQ ID NO: 171757 - DNA, 25 bp, Mus musculus
acaagaaagccaacattctcaccga

SEQ ID NO: 171758 - DNA, 25 bp, Mus musculus
acaagaaagctgttcttcctaccag

SEQ ID NO: 171759 - DNA, 25 bp, Mus musculus
acaagaaagcttgatccggagcatc

SEQ ID NO: 171760 - DNA, 25 bp, Mus musculus
acaagaaagtctcaatcgtcctttt

SEQ ID NO: 171761 - DNA, 25 bp, Mus musculus
acaagaaatacgatgaggatgatgc

SEQ ID NO: 171762 - DNA, 25 bp, Mus musculus
acaagaaatacggtgaagctctggg

SEQ ID NO: 171763 - DNA, 25 bp, Mus musculus
acaagaaatgcaagattttgctgga

SEQ ID NO: 171764 - DNA, 25 bp, Mus musculus
acaagaaatggaaggtggtgtagtg

SEQ ID NO: 171765 - DNA, 25 bp, Mus musculus
acaagaaatggaagtggctaccaag

SEQ ID NO: 171766 - DNA, 25 bp, Mus musculus
acaagaacaaggagttgggagcggt

SEQ ID NO: 171767 - DNA, 25 bp, Mus musculus
acaagaacaaggtgctctgttttgg

SEQ ID NO: 171768 - DNA, 25 bp, Mus musculus
acaagaacaggcaaggccctcacat

SEQ ID NO: 171769 - DNA, 25 bp, Mus musculus
acaagaacatccagaacaactggcg

SEQ ID NO: 171770 - DNA, 25 bp, Mus musculus
acaagaacatccaggtcctgcctgg

SEQ ID NO: 171771 - DNA, 25 bp, Mus musculus
acaagaacccaactgatccccagct

SEQ ID NO: 171772 - DNA, 25 bp, Mus musculus
acaagaacctccaggaggagatctc

SEQ ID NO: 171773 - DNA, 25 bp, Mus musculus
acaagaactgacggcacaggcccga

SEQ ID NO: 171774 - DNA, 25 bp, Mus musculus
acaagaactgacggcactgatggag

SEQ ID NO: 171775 - DNA, 25 bp, Mus musculus
acaagaacttagtgatgtggagaga

SEQ ID NO: 171776 - DNA, 25 bp, Mus musculus
acaagaagaaaaagaacgtttgctg

SEQ ID NO: 171777 - DNA, 25 bp, Mus musculus
acaagaagaaagccggtggctggtc

SEQ ID NO: 171778 - DNA, 25 bp, Mus musculus
acaagaagaagaaggcgtcccatga

SEQ ID NO: 171779 - DNA, 25 bp, Mus musculus
acaagaagaagaaggttttcgcatt

SEQ ID NO: 171780 - DNA, 25 bp, Mus musculus
acaagaagaattaaagcacgcacag

SEQ ID NO: 171781 - DNA, 25 bp, Mus musculus
acaagaagacagagccaagtcagaa

SEQ ID NO: 171782 - DNA, 25 bp, Mus musculus
acaagaagacagatgttaaggaaga

SEQ ID NO: 171783 - DNA, 25 bp, Mus musculus
acaagaagacaggtaaacacaagac

SEQ ID NO: 171784 - DNA, 25 bp, Mus musculus
acaagaagagatacgaggaggaagt

SEQ ID NO: 171785 - DNA, 25 bp, Mus musculus
acaagaagatgaccgcggagggcat

SEQ ID NO: 171786 - DNA, 25 bp, Mus musculus
acaagaagatggccctctctttcag

SEQ ID NO: 171787 - DNA, 25 bp, Mus musculus
acaagaagatggccgtggcaaccct

SEQ ID NO: 171788 - DNA, 25 bp, Mus musculus
acaagaagccacaggaatcctgacc

SEQ ID NO: 171789 - DNA, 25 bp, Mus musculus
acaagaaggaaagattgaagactga

SEQ ID NO: 171790 - DNA, 25 bp, Mus musculus
acaagaaggaaagatttctaagctc

SEQ ID NO: 171791 - DNA, 25 bp, Mus musculus
acaagaaggacctgagggaccggga

SEQ ID NO: 171792 - DNA, 25 bp, Mus musculus
acaagaaggaggtggaactgacaga

SEQ ID NO: 171793 - DNA, 25 bp, Mus musculus
acaagaaggcacctgactttgtgtt

SEQ ID NO: 171794 - DNA, 25 bp, Mus musculus
acaagaagtcttaacggtgtagtgg

SEQ ID NO: 171795 - DNA, 25 bp, Mus musculus
acaagaagtcttaagggtgtagtgg

SEQ ID NO: 171796 - DNA, 25 bp, Mus musculus
acaagaagtttgatcaattcttcaa

SEQ ID NO: 171797 - DNA, 25 bp, Mus musculus
acaagaagtttgatgaattcttcaa

SEQ ID NO: 171798 - DNA, 25 bp, Mus musculus
acaagaatacagggaaaatggagaa

SEQ ID NO: 171799 - DNA, 25 bp, Mus musculus
acaagaatacatggcaaaagaaaaa

SEQ ID NO: 171800 - DNA, 25 bp, Mus musculus
acaagaatcagcttcagaggattat

SEQ ID NO: 171801 - DNA, 25 bp, Mus musculus
acaagaatcaggttgtggagttgac

SEQ ID NO: 171802 - DNA, 25 bp, Mus musculus
acaagaatgacattggctcgtgagc

SEQ ID NO: 171803 - DNA, 25 bp, Mus musculus
acaagaatgacatttttgccattgg

SEQ ID NO: 171804 - DNA, 25 bp, Mus musculus
acaagaatgaggaaggcacttggtc

SEQ ID NO: 171805 - DNA, 25 bp, Mus musculus
acaagaatgcggaaggcacttggtc

SEQ ID NO: 171806 - DNA, 25 bp, Mus musculus
acaagaatgtacgccaggccagcgt

SEQ ID NO: 171807 - DNA, 25 bp, Mus musculus
acaagaattagccctctttgaaccc

SEQ ID NO: 171808 - DNA, 25 bp, Mus musculus
acaagaattagccctgtcttcttcc

SEQ ID NO: 171809 - DNA, 25 bp, Mus musculus
acaagaattaggactcagtggcaat

SEQ ID NO: 171810 - DNA, 25 bp, Mus musculus
acaagaattgccaacagtagtcgga

SEQ ID NO: 171811 - DNA, 25 bp, Mus musculus
acaagacaagatctggagcacccct

SEQ ID NO: 171812 - DNA, 25 bp, Mus musculus
acaagacaagctgaccttcattgac

SEQ ID NO: 171813 - DNA, 25 bp, Mus musculus
acaagacacccacagggataaggaa

SEQ ID NO: 171814 - DNA, 25 bp, Mus musculus
acaagacacccagaatgggctacac

SEQ ID NO: 171815 - DNA, 25 bp, Mus musculus
acaagacactgcagttcatcgtggc

SEQ ID NO: 171816 - DNA, 25 bp, Mus musculus
acaagacagcacagaccggaagaaa

SEQ ID NO: 171817 - DNA, 25 bp, Mus musculus
acaagacagtgacagccctggagat

SEQ ID NO: 171818 - DNA, 25 bp, Mus musculus
acaagaccaagagaccacagcagtt

SEQ ID NO: 171819 - DNA, 25 bp, Mus musculus
acaagaccaagaggttgaaaggaaa

SEQ ID NO: 171820 - DNA, 25 bp, Mus musculus
acaagaccaagccccagctgcgata

SEQ ID NO: 171821 - DNA, 25 bp, Mus musculus
acaagaccaggggttcaaggaaggt

SEQ ID NO: 171822 - DNA, 25 bp, Mus musculus
acaagaccataccactctcctcctt

SEQ ID NO: 171823 - DNA, 25 bp, Mus musculus
acaagaccatgtttatgtctgggaa

SEQ ID NO: 171824 - DNA, 25 bp, Mus musculus
acaagaccattggagaaggagagga

SEQ ID NO: 171825 - DNA, 25 bp, Mus musculus
acaagacccccgctgcaggctttgc

SEQ ID NO: 171826 - DNA, 25 bp, Mus musculus
acaagacccccgctggtctcagcta

SEQ ID NO: 171827 - DNA, 25 bp, Mus musculus
acaagacccccgctgttggagacag

SEQ ID NO: 171828 - DNA, 25 bp, Mus musculus
acaagaccttcaggatcaagattat

SEQ ID NO: 171829 - DNA, 25 bp, Mus musculus
acaagacgcagctcggtgaggacca

SEQ ID NO: 171830 - DNA, 25 bp, Mus musculus
acaagactaccaacagctcttcgcg

SEQ ID NO: 171831 - DNA, 25 bp, Mus musculus
acaagactaccaagctccacttcga

SEQ ID NO: 171832 - DNA, 25 bp, Mus musculus
acaagactaccaagtgaacaccttt

SEQ ID NO: 171833 - DNA, 25 bp, Mus musculus
acaagactcagaataagcctgcacg

SEQ ID NO: 171834 - DNA, 25 bp, Mus musculus
acaagactgctccagggaaaataga

SEQ ID NO: 171835 - DNA, 25 bp, Mus musculus
acaagactgctccaggtcctggagg

SEQ ID NO: 171836 - DNA, 25 bp, Mus musculus
acaagactgtccacagatacttgga

SEQ ID NO: 171837 - DNA, 25 bp, Mus musculus
acaagactgtggagaccacagacag

SEQ ID NO: 171838 - DNA, 25 bp, Mus musculus
acaagactgtggaggtcttctgcga

SEQ ID NO: 171839 - DNA, 25 bp, Mus musculus
acaagagacatcaaggcagaagact

SEQ ID NO: 171840 - DNA, 25 bp, Mus musculus
acaagagaccaggtgaaaaaactgc

SEQ ID NO: 171841 - DNA, 25 bp, Mus musculus
acaagagaggcaatgggtgacaagc

SEQ ID NO: 171842 - DNA, 25 bp, Mus musculus
acaagagatggaatacgaccataag

SEQ ID NO: 171843 - DNA, 25 bp, Mus musculus
acaagagcaagcagaaacacaggaa

SEQ ID NO: 171844 - DNA, 25 bp, Mus musculus
acaagagcaagcaggaaaaggaagt

SEQ ID NO: 171845 - DNA, 25 bp, Mus musculus
acaagagcaggagaacaaaatccag

SEQ ID NO: 171846 - DNA, 25 bp, Mus musculus
acaagagcaggagcgcctttgacct

SEQ ID NO: 171847 - DNA, 25 bp, Mus musculus
acaagagcatcctggtgaccagcca

SEQ ID NO: 171848 - DNA, 25 bp, Mus musculus
acaagagccccagaaccaaggctct

SEQ ID NO: 171849 - DNA, 25 bp, Mus musculus
acaagagccccttcctctgcccctc

SEQ ID NO: 171850 - DNA, 25 bp, Mus musculus
acaagagcgaggaagaggaagtagt

SEQ ID NO: 171851 - DNA, 25 bp, Mus musculus
acaagagcgagggtccagattatag

SEQ ID NO: 171852 - DNA, 25 bp, Mus musculus
acaagagctgaagtgggagaaaaaa

SEQ ID NO: 171853 - DNA, 25 bp, Mus musculus
acaagagcttctactggtgcagtca

SEQ ID NO: 171854 - DNA, 25 bp, Mus musculus
acaagagcttctgagtctatcctga

SEQ ID NO: 171855 - DNA, 25 bp, Mus musculus
acaagaggaaatacagaagcttaac

SEQ ID NO: 171856 - DNA, 25 bp, Mus musculus
acaagaggcagatgggcatatcaag

SEQ ID NO: 171857 - DNA, 25 bp, Mus musculus
acaagaggctttggtcatccagcac

SEQ ID NO: 171858 - DNA, 25 bp, Mus musculus
acaagagggagagaatatgctggct

SEQ ID NO: 171859 - DNA, 25 bp, Mus musculus
acaagagggagatccacttaaatgg

SEQ ID NO: 171860 - DNA, 25 bp, Mus musculus
acaagagtcggacaataataaaaga

SEQ ID NO: 171861 - DNA, 25 bp, Mus musculus
acaagataaagctcacttcaattgc

SEQ ID NO: 171862 - DNA, 25 bp, Mus musculus
acaagataaggggatggtaataacc

SEQ ID NO: 171863 - DNA, 25 bp, Mus musculus
acaagataataaaggtagtggatgg

SEQ ID NO: 171864 - DNA, 25 bp, Mus musculus
acaagataataaagtacaaaatggt

SEQ ID NO: 171865 - DNA, 25 bp, Mus musculus
acaagatagcgggacacggctctta

SEQ ID NO: 171866 - DNA, 25 bp, Mus musculus
acaagatattggttctgaagactat

SEQ ID NO: 171867 - DNA, 25 bp, Mus musculus
acaagatccagtccccgctgctgcc

SEQ ID NO: 171868 - DNA, 25 bp, Mus musculus
acaagatccatctaaatgggtacaa

SEQ ID NO: 171869 - DNA, 25 bp, Mus musculus
acaagatctgacaaggacccacatt

SEQ ID NO: 171870 - DNA, 25 bp, Mus musculus
acaagatgaggatgataatgatgtt

SEQ ID NO: 171871 - DNA, 25 bp, Mus musculus
acaagatgatctctgggacctggaa

SEQ ID NO: 171872 - DNA, 25 bp, Mus musculus
acaagatgcagtatggtggggctcc

SEQ ID NO: 171873 - DNA, 25 bp, Mus musculus
acaagatgggaggcacctccaagtg

SEQ ID NO: 171874 - DNA, 25 bp, Mus musculus
acaagattaatgaaccaccaaagcc

SEQ ID NO: 171875 - DNA, 25 bp, Mus musculus
acaagattacggccgaagactgtac

SEQ ID NO: 171876 - DNA, 25 bp, Mus musculus
acaagattacggtacagcaagggag

SEQ ID NO: 171877 - DNA, 25 bp, Mus musculus
acaagattcaaaaggataaaccaga

SEQ ID NO: 171878 - DNA, 25 bp, Mus musculus
acaagattgcagagaacaatgacct

SEQ ID NO: 171879 - DNA, 25 bp, Mus musculus
acaagattgcagagtgaaccatgag

SEQ ID NO: 171880 - DNA, 25 bp, Mus musculus
acaagattttagtttgggatcaaag

SEQ ID NO: 171881 - DNA, 25 bp, Mus musculus
acaagcaaaaagctattgaccttct

SEQ ID NO: 171882 - DNA, 25 bp, Mus musculus
acaagcaaagaccggtgtgtgataa

SEQ ID NO: 171883 - DNA, 25 bp, Mus musculus
acaagcaaaggaaagaggccgagaa

SEQ ID NO: 171884 - DNA, 25 bp, Mus musculus
acaagcaaagtggtagtgtgaagcc

SEQ ID NO: 171885 - DNA, 25 bp, Mus musculus
acaagcaaatgatcaaacttcaaga

SEQ ID NO: 171886 - DNA, 25 bp, Mus musculus
acaagcaagcagttgtttcttgaga

SEQ ID NO: 171887 - DNA, 25 bp, Mus musculus
acaagcacaactcctaatagtacag

SEQ ID NO: 171888 - DNA, 25 bp, Mus musculus
acaagcacaagttctgcctatcttg

SEQ ID NO: 171889 - DNA, 25 bp, Mus musculus
acaagcacacagggttttggtaaaa

SEQ ID NO: 171890 - DNA, 25 bp, Mus musculus
acaagcacagcacggccctgccctg

SEQ ID NO: 171891 - DNA, 25 bp, Mus musculus
acaagcaccaagagcccgaccgtcc

SEQ ID NO: 171892 - DNA, 25 bp, Mus musculus
acaagcacccaatgtcagaatacaa

SEQ ID NO: 171893 - DNA, 25 bp, Mus musculus
acaagcacctatgagagtcatcaga

SEQ ID NO: 171894 - DNA, 25 bp, Mus musculus
acaagcacctatgagtacttacagc

SEQ ID NO: 171895 - DNA, 25 bp, Mus musculus
acaagcactctcaggctaccggctc

SEQ ID NO: 171896 - DNA, 25 bp, Mus musculus
acaagcagatgggacagcaaagagc

SEQ ID NO: 171897 - DNA, 25 bp, Mus musculus
acaagcagcaacgtcggagtcttct

SEQ ID NO: 171898 - DNA, 25 bp, Mus musculus
acaagcagccaggccccatgaagct

SEQ ID NO: 171899 - DNA, 25 bp, Mus musculus
acaagcagccagtctcaatggaaac

SEQ ID NO: 171900 - DNA, 25 bp, Mus musculus
acaagcaggtttttctccaggagtg

SEQ ID NO: 171901 - DNA, 25 bp, Mus musculus
acaagcagtgctagttgggtgcaaa

SEQ ID NO: 171902 - DNA, 25 bp, Mus musculus
acaagcatagcgggtttggcttgtg

SEQ ID NO: 171903 - DNA, 25 bp, Mus musculus
acaagcatcagggggtccgcctacc

SEQ ID NO: 171904 - DNA, 25 bp, Mus musculus
acaagcatcccaggctgcgagacaa

SEQ ID NO: 171905 - DNA, 25 bp, Mus musculus
acaagcatgagggacaaagccccag

SEQ ID NO: 171906 - DNA, 25 bp, Mus musculus
acaagcatgtgaaagactggaagaa

SEQ ID NO: 171907 - DNA, 25 bp, Mus musculus
acaagcatgtgaaagccctctcacc

SEQ ID NO: 171908 - DNA, 25 bp, Mus musculus
acaagcattgcaggaagaattcttt

SEQ ID NO: 171909 - DNA, 25 bp, Mus musculus
acaagccaaaggcaccatggctggc

SEQ ID NO: 171910 - DNA, 25 bp, Mus musculus
acaagccaagaaagctcgcttatct

SEQ ID NO: 171911 - DNA, 25 bp, Mus musculus
acaagccaagaatgtgctgatcaac

SEQ ID NO: 171912 - DNA, 25 bp, Mus musculus
acaagccaaggacctctaatttctg

SEQ ID NO: 171913 - DNA, 25 bp, Mus musculus
acaagccaaggtcttcttctccggg

SEQ ID NO: 171914 - DNA, 25 bp, Mus musculus
acaagccactgaagactgagatacc

SEQ ID NO: 171915 - DNA, 25 bp, Mus musculus
acaagccactgacgtggacgacaac

SEQ ID NO: 171916 - DNA, 25 bp, Mus musculus
acaagccagggcccatcactctgac

SEQ ID NO: 171917 - DNA, 25 bp, Mus musculus
acaagccatgatgaacagctcatgc

SEQ ID NO: 171918 - DNA, 25 bp, Mus musculus
acaagcccaacgcaaatctggtgca

SEQ ID NO: 171919 - DNA, 25 bp, Mus musculus
acaagcccaaggaggataagctaaa

SEQ ID NO: 171920 - DNA, 25 bp, Mus musculus
acaagcccaaggctgctgacaagga

SEQ ID NO: 171921 - DNA, 25 bp, Mus musculus
acaagcccaagtgcccaccttgtcc

SEQ ID NO: 171922 - DNA, 25 bp, Mus musculus
acaagcccagcagctacattttctt

SEQ ID NO: 171923 - DNA, 25 bp, Mus musculus
acaagcccagcagctctactgacag

SEQ ID NO: 171924 - DNA, 25 bp, Mus musculus
acaagcccaggagacaatcaggctc

SEQ ID NO: 171925 - DNA, 25 bp, Mus musculus
acaagcccataggaacctggctgct

SEQ ID NO: 171926 - DNA, 25 bp, Mus musculus
acaagcccataggcctggtcagaaa

SEQ ID NO: 171927 - DNA, 25 bp, Mus musculus
acaagcccataggttacaaggacag

SEQ ID NO: 171928 - DNA, 25 bp, Mus musculus
acaagcccatctggctcttgctgct

SEQ ID NO: 171929 - DNA, 25 bp, Mus musculus
acaagcccatgaagtgcccccgcct

SEQ ID NO: 171930 - DNA, 25 bp, Mus musculus
acaagccccagcttatcaagtacgg

SEQ ID NO: 171931 - DNA, 25 bp, Mus musculus
acaagccccagggcagtcctttact

SEQ ID NO: 171932 - DNA, 25 bp, Mus musculus
acaagccccagggtgccacctcctc

SEQ ID NO: 171933 - DNA, 25 bp, Mus musculus
acaagccctccgtctggctggttct

SEQ ID NO: 171934 - DNA, 25 bp, Mus musculus
acaagccgattgccgacgtgttctt

SEQ ID NO: 171935 - DNA, 25 bp, Mus musculus
acaagccgtggcaaggagatgagac

SEQ ID NO: 171936 - DNA, 25 bp, Mus musculus
acaagccgtggcattaaaaaaatat

SEQ ID NO: 171937 - DNA, 25 bp, Mus musculus
acaagcctccagaaatcgacatcac

SEQ ID NO: 171938 - DNA, 25 bp, Mus musculus
acaagcctcgaaacagaggcgctcc

SEQ ID NO: 171939 - DNA, 25 bp, Mus musculus
acaagcctcgaaacatgagcatgcc

SEQ ID NO: 171940 - DNA, 25 bp, Mus musculus
acaagcctgaaatcaactccaccac

SEQ ID NO: 171941 - DNA, 25 bp, Mus musculus
acaagcctgagccaggagggccgta

SEQ ID NO: 171942 - DNA, 25 bp, Mus musculus
acaagcctgcaaaaggaggtgttcc

SEQ ID NO: 171943 - DNA, 25 bp, Mus musculus
acaagcctgccaagaccctaccact

SEQ ID NO: 171944 - DNA, 25 bp, Mus musculus
acaagcctggaggttcatgtctcaa

SEQ ID NO: 171945 - DNA, 25 bp, Mus musculus
acaagcctggagttatgcctcttga

SEQ ID NO: 171946 - DNA, 25 bp, Mus musculus
acaagcctggcaagtcacgtgactt

SEQ ID NO: 171947 - DNA, 25 bp, Mus musculus
acaagcctggcagcaaccttagtgt

SEQ ID NO: 171948 - DNA, 25 bp, Mus musculus
acaagcctggcagtgtcagcagcta

SEQ ID NO: 171949 - DNA, 25 bp, Mus musculus
acaagcctgtcgcacgagtctgaga

SEQ ID NO: 171950 - DNA, 25 bp, Mus musculus
acaagcctgtcggggtgaatcggca

SEQ ID NO: 171951 - DNA, 25 bp, Mus musculus
acaagcgcagatattaaactaacca

SEQ ID NO: 171952 - DNA, 25 bp, Mus musculus
acaagcgcgcctttaaagtgaagga

SEQ ID NO: 171953 - DNA, 25 bp, Mus musculus
acaagcgctgagtgaaaatgtgcta

SEQ ID NO: 171954 - DNA, 25 bp, Mus musculus
acaagcggagtttggtgaaagtgag

SEQ ID NO: 171955 - DNA, 25 bp, Mus musculus
acaagcggcagattgtagacctgga

SEQ ID NO: 171956 - DNA, 25 bp, Mus musculus
acaagcgggatctctaccagaagtg

SEQ ID NO: 171957 - DNA, 25 bp, Mus musculus
acaagcgggcaggtccatggagaga

SEQ ID NO: 171958 - DNA, 25 bp, Mus musculus
acaagctaaagacgggccagcaggc

SEQ ID NO: 171959 - DNA, 25 bp, Mus musculus
acaagctaaagatggagaaggagag

SEQ ID NO: 171960 - DNA, 25 bp, Mus musculus
acaagctaacaactgtgccaccaaa

SEQ ID NO: 171961 - DNA, 25 bp, Mus musculus
acaagctaaggatttggagtttcat

SEQ ID NO: 171962 - DNA, 25 bp, Mus musculus
acaagctcctagatcttgatgacaa

SEQ ID NO: 171963 - DNA, 25 bp, Mus musculus
acaagctccttaagaaggcagatga

SEQ ID NO: 171964 - DNA, 25 bp, Mus musculus
acaagctccttccagtgacagcaga

SEQ ID NO: 171965 - DNA, 25 bp, Mus musculus
acaagctctgctgacagggcagttt

SEQ ID NO: 171966 - DNA, 25 bp, Mus musculus
acaagctctgctgactgtgcagaat

SEQ ID NO: 171967 - DNA, 25 bp, Mus musculus
acaagctgaaccctcacctgtgcca

SEQ ID NO: 171968 - DNA, 25 bp, Mus musculus
acaagctgaagagcatggagaagca

SEQ ID NO: 171969 - DNA, 25 bp, Mus musculus
acaagctgaatgccatcaaactaca

SEQ ID NO: 171970 - DNA, 25 bp, Mus musculus
acaagctgacaggaagactcttcaa

SEQ ID NO: 171971 - DNA, 25 bp, Mus musculus
acaagctgacaggttgccatgcctt

SEQ ID NO: 171972 - DNA, 25 bp, Mus musculus
acaagctgaccaaagcggagaagct

SEQ ID NO: 171973 - DNA, 25 bp, Mus musculus
acaagctgaccaagttacagtccat

SEQ ID NO: 171974 - DNA, 25 bp, Mus musculus
acaagctgagtgtaagggttcccga

SEQ ID NO: 171975 - DNA, 25 bp, Mus musculus
acaagctgcagcccacttcttagat

SEQ ID NO: 171976 - DNA, 25 bp, Mus musculus
acaagctgcaggcttctccagtggc

SEQ ID NO: 171977 - DNA, 25 bp, Mus musculus
acaagctgcggaaggatgatccagt

SEQ ID NO: 171978 - DNA, 25 bp, Mus musculus
acaagctgctgagactataagcgga

SEQ ID NO: 171979 - DNA, 25 bp, Mus musculus
acaagctgctgagatggctccgagc

SEQ ID NO: 171980 - DNA, 25 bp, Mus musculus
acaagctgctgagtgaagagagact

SEQ ID NO: 171981 - DNA, 25 bp, Mus musculus
acaagctggatcaggatgcgggctc

SEQ ID NO: 171982 - DNA, 25 bp, Mus musculus
acaagctgggcgagtacatggagaa

SEQ ID NO: 171983 - DNA, 25 bp, Mus musculus
acaagctgttaacagttcaaggcct

SEQ ID NO: 171984 - DNA, 25 bp, Mus musculus
acaagcttaccagtgattttgagga

SEQ ID NO: 171985 - DNA, 25 bp, Mus musculus
acaagcttggagttgactgtgttcc

SEQ ID NO: 171986 - DNA, 25 bp, Mus musculus
acaagcttggagttgggaatgagca

SEQ ID NO: 171987 - DNA, 25 bp, Mus musculus
acaaggaaagctgccttcaccttcc

SEQ ID NO: 171988 - DNA, 25 bp, Mus musculus
acaaggaaagctggtgaagcacaag

SEQ ID NO: 171989 - DNA, 25 bp, Mus musculus
acaaggaaagctgtctgcaatcctg

SEQ ID NO: 171990 - DNA, 25 bp, Mus musculus
acaaggaaagggatcttgctggaca

SEQ ID NO: 171991 - DNA, 25 bp, Mus musculus
acaaggaaaggtacgacatgatggg

SEQ ID NO: 171992 - DNA, 25 bp, Mus musculus
acaaggaaatgacaaatggttatga

SEQ ID NO: 171993 - DNA, 25 bp, Mus musculus
acaaggaacagaacggagtgcaaga

SEQ ID NO: 171994 - DNA, 25 bp, Mus musculus
acaaggaacagaacgggaggaacta

SEQ ID NO: 171995 - DNA, 25 bp, Mus musculus
acaaggaagacagaacctctggttt

SEQ ID NO: 171996 - DNA, 25 bp, Mus musculus
acaaggaagggcaaatgacttggtg

SEQ ID NO: 171997 - DNA, 25 bp, Mus musculus
acaaggaagttgagaatgaaaagtc

SEQ ID NO: 171998 - DNA, 25 bp, Mus musculus
acaaggaagttgagaatttcaggaa

SEQ ID NO: 171999 - DNA, 25 bp, Mus musculus
acaaggaagttgaggtttaatagtc

SEQ ID NO: 172000 - DNA, 25 bp, Mus musculus
acaaggacacaagggtgaagagggt

SEQ ID NO: 172001 - DNA, 25 bp, Mus musculus
acaaggacagcaaggtggtgtggga

SEQ ID NO: 172002 - DNA, 25 bp, Mus musculus
acaaggacccccagagttgatggtg

SEQ ID NO: 172003 - DNA, 25 bp, Mus musculus
acaaggacgagaaaacgcagaggtg

SEQ ID NO: 172004 - DNA, 25 bp, Mus musculus
acaaggacgagaaggaccacttgat

SEQ ID NO: 172005 - DNA, 25 bp, Mus musculus
acaaggacgatttggggctcatcac

SEQ ID NO: 172006 - DNA, 25 bp, Mus musculus
acaaggacgatttgggtgtcctgct

SEQ ID NO: 172007 - DNA, 25 bp, Mus musculus
acaaggactccagaaaacatctcgg

SEQ ID NO: 172008 - DNA, 25 bp, Mus musculus
acaaggagaacgtggacttatggtc

SEQ ID NO: 172009 - DNA, 25 bp, Mus musculus
acaaggagaacgttgacatttggtc

SEQ ID NO: 172010 - DNA, 25 bp, Mus musculus
acaaggagaagacaggagtgcgatt

SEQ ID NO: 172011 - DNA, 25 bp, Mus musculus
acaaggagaatacacctctcattga

SEQ ID NO: 172012 - DNA, 25 bp, Mus musculus
acaaggagaatgtcccttcagagaa

SEQ ID NO: 172013 - DNA, 25 bp, Mus musculus
acaaggagacagcttggtcacatac

SEQ ID NO: 172014 - DNA, 25 bp, Mus musculus
acaaggagagtcgggtgttaggagc

SEQ ID NO: 172015 - DNA, 25 bp, Mus musculus
acaaggagatggacagtacagacct

SEQ ID NO: 172016 - DNA, 25 bp, Mus musculus
acaaggagcaggacatggctgccaa

SEQ ID NO: 172017 - DNA, 25 bp, Mus musculus
acaaggagccagatgagaaaaccaa

SEQ ID NO: 172018 - DNA, 25 bp, Mus musculus
acaaggagccagcttcacttcttcc

SEQ ID NO: 172019 - DNA, 25 bp, Mus musculus
acaaggagccagctttcttggattc

SEQ ID NO: 172020 - DNA, 25 bp, Mus musculus
acaaggaggacagctacaagcccat

SEQ ID NO: 172021 - DNA, 25 bp, Mus musculus
acaaggaggacggtgtgccgatgct

SEQ ID NO: 172022 - DNA, 25 bp, Mus musculus
acaaggaggtccggagtcaccggcc

SEQ ID NO: 172023 - DNA, 25 bp, Mus musculus
acaaggataagaatgaagaagaagt

SEQ ID NO: 172024 - DNA, 25 bp, Mus musculus
acaaggataggtcatgctgtgaaca

SEQ ID NO: 172025 - DNA, 25 bp, Mus musculus
acaaggatctgatttaaattagctc

SEQ ID NO: 172026 - DNA, 25 bp, Mus musculus
acaaggatgaggaggagaaagaaaa

SEQ ID NO: 172027 - DNA, 25 bp, Mus musculus
acaaggatgatgaggagaaagagaa

SEQ ID NO: 172028 - DNA, 25 bp, Mus musculus
acaaggatggaacggtgtggaccgt

SEQ ID NO: 172029 - DNA, 25 bp, Mus musculus
acaaggcaaagccgacgcagtatga

SEQ ID NO: 172030 - DNA, 25 bp, Mus musculus
acaaggcaaagcggtcccaccagct

SEQ ID NO: 172031 - DNA, 25 bp, Mus musculus
acaaggcaggagatcgggaagctgc

SEQ ID NO: 172032 - DNA, 25 bp, Mus musculus
acaaggcaggaggctggtcagatct

SEQ ID NO: 172033 - DNA, 25 bp, Mus musculus
acaaggcatgtgaagccagtgaaat

SEQ ID NO: 172034 - DNA, 25 bp, Mus musculus
acaaggccaagttgtgctggtaact

SEQ ID NO: 172035 - DNA, 25 bp, Mus musculus
acaaggccaggactgtggcggccac

SEQ ID NO: 172036 - DNA, 25 bp, Mus musculus
acaaggccaggtgtggaggcatcat

SEQ ID NO: 172037 - DNA, 25 bp, Mus musculus
acaaggccccgaaatgggaccctga

SEQ ID NO: 172038 - DNA, 25 bp, Mus musculus
acaaggcccctagccccatctcttc

SEQ ID NO: 172039 - DNA, 25 bp, Mus musculus
acaaggcctgtgttgctacccctct

SEQ ID NO: 172040 - DNA, 25 bp, Mus musculus
acaaggcggcagactttctgcactg

SEQ ID NO: 172041 - DNA, 25 bp, Mus musculus
acaaggctcagacagcagtgacagt

SEQ ID NO: 172042 - DNA, 25 bp, Mus musculus
acaaggctgggtgcagtgaccctta

SEQ ID NO: 172043 - DNA, 25 bp, Mus musculus
acaaggctggtgctatttatatttt

SEQ ID NO: 172044 - DNA, 25 bp, Mus musculus
acaagggacaggtgctgaagcatgt

SEQ ID NO: 172045 - DNA, 25 bp, Mus musculus
acaagggaccaagcattcacagctc

SEQ ID NO: 172046 - DNA, 25 bp, Mus musculus
acaagggagaaaagaacttcgcggc

SEQ ID NO: 172047 - DNA, 25 bp, Mus musculus
acaagggagaaaagggtgcgcctgg

SEQ ID NO: 172048 - DNA, 25 bp, Mus musculus
acaagggatctgccagtgtgcccct

SEQ ID NO: 172049 - DNA, 25 bp, Mus musculus
acaagggattccagtactagtactt

SEQ ID NO: 172050 - DNA, 25 bp, Mus musculus
acaagggcaacagtcatcatctgac

SEQ ID NO: 172051 - DNA, 25 bp, Mus musculus
acaagggcaacagtgaactaatgct

SEQ ID NO: 172052 - DNA, 25 bp, Mus musculus
acaagggcaggctgctgtcaccaag

SEQ ID NO: 172053 - DNA, 25 bp, Mus musculus
acaagggccaaagggttccattgga

SEQ ID NO: 172054 - DNA, 25 bp, Mus musculus
acaagggccagatgctgcatattcc

SEQ ID NO: 172055 - DNA, 25 bp, Mus musculus
acaagggctacagctccggaccaaa

SEQ ID NO: 172056 - DNA, 25 bp, Mus musculus
acaaggggcaggtaccacagagaga

SEQ ID NO: 172057 - DNA, 25 bp, Mus musculus
acaagggtaggtccctgtataccag

SEQ ID NO: 172058 - DNA, 25 bp, Mus musculus
acaaggtaaactgcaggttgtcctg

SEQ ID NO: 172059 - DNA, 25 bp, Mus musculus
acaaggtaactacggagatcagcag

SEQ ID NO: 172060 - DNA, 25 bp, Mus musculus
acaaggtagcaaagggtgtggaata

SEQ ID NO: 172061 - DNA, 25 bp, Mus musculus
acaaggtaggctgtcagccatctta

SEQ ID NO: 172062 - DNA, 25 bp, Mus musculus
acaaggtcaagtcagtaggacaaag

SEQ ID NO: 172063 - DNA, 25 bp, Mus musculus
acaaggtgggccgagacatcttgct

SEQ ID NO: 172064 - DNA, 25 bp, Mus musculus
acaaggtggttctgaaacgaagtga

SEQ ID NO: 172065 - DNA, 25 bp, Mus musculus
acaaggtgttccaggagcgcatcaa

SEQ ID NO: 172066 - DNA, 25 bp, Mus musculus
acaaggtgttccaggtaggtgcatg

SEQ ID NO: 172067 - DNA, 25 bp, Mus musculus
acaaggtttctacatgaaggaaggg

SEQ ID NO: 172068 - DNA, 25 bp, Mus musculus
acaagtaaagaatctgctggatgat

SEQ ID NO: 172069 - DNA, 25 bp, Mus musculus
acaagtacaacatcttgattgccac

SEQ ID NO: 172070 - DNA, 25 bp, Mus musculus
acaagtacacgacagacggcaacca

SEQ ID NO: 172071 - DNA, 25 bp, Mus musculus
acaagtacacggaaatgtgtcatgg

SEQ ID NO: 172072 - DNA, 25 bp, Mus musculus
acaagtacagcttctggcctccaac

SEQ ID NO: 172073 - DNA, 25 bp, Mus musculus
acaagtacaggagctttgtcatccc

SEQ ID NO: 172074 - DNA, 25 bp, Mus musculus
acaagtacaggaggccgagtgggtt

SEQ ID NO: 172075 - DNA, 25 bp, Mus musculus
acaagtataaggtgatgttccctgt

SEQ ID NO: 172076 - DNA, 25 bp, Mus musculus
acaagtatgaacacaattttgaaat

SEQ ID NO: 172077 - DNA, 25 bp, Mus musculus
acaagtatgagcctgccatacagcg

SEQ ID NO: 172078 - DNA, 25 bp, Mus musculus
acaagtcaaagaggcaaaagcaaaa

SEQ ID NO: 172079 - DNA, 25 bp, Mus musculus
acaagtcaaaggtttaacagaagaa

SEQ ID NO: 172080 - DNA, 25 bp, Mus musculus
acaagtcacaagagaatgcaggcat

SEQ ID NO: 172081 - DNA, 25 bp, Mus musculus
acaagtcacaagaggaactttgtgg

SEQ ID NO: 172082 - DNA, 25 bp, Mus musculus
acaagtcacgtcaaggtagccatcc

SEQ ID NO: 172083 - DNA, 25 bp, Mus musculus
acaagtccaaacagttcagatttca

SEQ ID NO: 172084 - DNA, 25 bp, Mus musculus
acaagtccagtagaggaagccagcc

SEQ ID NO: 172085 - DNA, 25 bp, Mus musculus
acaagtccatgttggagtttggatt

SEQ ID NO: 172086 - DNA, 25 bp, Mus musculus
acaagtcctttgctagggaaagaga

SEQ ID NO: 172087 - DNA, 25 bp, Mus musculus
acaagtctacaaaagctcttcagag

SEQ ID NO: 172088 - DNA, 25 bp, Mus musculus
acaagtctacaaaaggtgaagtatt

SEQ ID NO: 172089 - DNA, 25 bp, Mus musculus
acaagtgagaatgattggagcctgc

SEQ ID NO: 172090 - DNA, 25 bp, Mus musculus
acaagtgagaatgggttaactgctc

SEQ ID NO: 172091 - DNA, 25 bp, Mus musculus
acaagtgagatacagattgctaata

SEQ ID NO: 172092 - DNA, 25 bp, Mus musculus
acaagtgagcagactcggagtgcgg

SEQ ID NO: 172093 - DNA, 25 bp, Mus musculus
acaagtgagcagggacggcctcagg

SEQ ID NO: 172094 - DNA, 25 bp, Mus musculus
acaagtgcaaccagacatccagaac

SEQ ID NO: 172095 - DNA, 25 bp, Mus musculus
acaagtgcaagatgatttaccttgc

SEQ ID NO: 172096 - DNA, 25 bp, Mus musculus
acaagtgcagatgaaatcatgcacc

SEQ ID NO: 172097 - DNA, 25 bp, Mus musculus
acaagtgcagcgacggatcgaagcc

SEQ ID NO: 172098 - DNA, 25 bp, Mus musculus
acaagtgccagagaggagttttgcc

SEQ ID NO: 172099 - DNA, 25 bp, Mus musculus
acaagtgccaggtacatatttttac

SEQ ID NO: 172100 - DNA, 25 bp, Mus musculus
acaagtgcgagaacatgtttgggat

SEQ ID NO: 172101 - DNA, 25 bp, Mus musculus
acaagtgcgagatcaaagaactgca

SEQ ID NO: 172102 - DNA, 25 bp, Mus musculus
acaagtgcgaggactgcgggaagga

SEQ ID NO: 172103 - DNA, 25 bp, Mus musculus
acaagtgctcaactggctgttggaa

SEQ ID NO: 172104 - DNA, 25 bp, Mus musculus
acaagtgctgagagctaagtgattg

SEQ ID NO: 172105 - DNA, 25 bp, Mus musculus
acaagtggagaaatgattagcagat

SEQ ID NO: 172106 - DNA, 25 bp, Mus musculus
acaagtggagtcattttataagaaa

SEQ ID NO: 172107 - DNA, 25 bp, Mus musculus
acaagtggatgaacagccagtccta

SEQ ID NO: 172108 - DNA, 25 bp, Mus musculus
acaagtggctggcacccgatggcct

SEQ ID NO: 172109 - DNA, 25 bp, Mus musculus
acaagtggggacaccattaccatgc

SEQ ID NO: 172110 - DNA, 25 bp, Mus musculus
acaagtgtaaagtagtcgccgggtc

SEQ ID NO: 172111 - DNA, 25 bp, Mus musculus
acaagtgtcacaagatggagcagga

SEQ ID NO: 172112 - DNA, 25 bp, Mus musculus
acaagtgtcccaagagggtgtatta

SEQ ID NO: 172113 - DNA, 25 bp, Mus musculus
acaagtgtgagaaaaaacaagaagg

SEQ ID NO: 172114 - DNA, 25 bp, Mus musculus
acaagtgtgaggactgtgggaaacc

SEQ ID NO: 172115 - DNA, 25 bp, Mus musculus
acaagtgtgccagccaggtgggcat

SEQ ID NO: 172116 - DNA, 25 bp, Mus musculus
acaagtgtgtgtgcaacgatactgt

SEQ ID NO: 172117 - DNA, 25 bp, Mus musculus
acaagtgttcaagccgccccacgag

SEQ ID NO: 172118 - DNA, 25 bp, Mus musculus
acaagtgttcaaggtagccattgcg

SEQ ID NO: 172119 - DNA, 25 bp, Mus musculus
acaagtgttcagagccggaaacaac

SEQ ID NO: 172120 - DNA, 25 bp, Mus musculus
acaagtgttcaggcctccttctttt

SEQ ID NO: 172121 - DNA, 25 bp, Mus musculus
acaagtgttgatacccataatatct

SEQ ID NO: 172122 - DNA, 25 bp, Mus musculus
acaagtgttgttcccatggtgcacg

SEQ ID NO: 172123 - DNA, 25 bp, Mus musculus
acaagttagaccatggcacccgatg

SEQ ID NO: 172124 - DNA, 25 bp, Mus musculus
acaagttagaccatgtggtgaccat

SEQ ID NO: 172125 - DNA, 25 bp, Mus musculus
acaagttaggtgagaaagcagaaga

SEQ ID NO: 172126 - DNA, 25 bp, Mus musculus
acaagttcaggtaacgcacagtggt

SEQ ID NO: 172127 - DNA, 25 bp, Mus musculus
acaagttcatcagcgggcccctctc

SEQ ID NO: 172128 - DNA, 25 bp, Mus musculus
acaagttcatcaggtatttgtactg

SEQ ID NO: 172129 - DNA, 25 bp, Mus musculus
acaagttcatgaggatctaccgtta

SEQ ID NO: 172130 - DNA, 25 bp, Mus musculus
acaagttcccgcctggtctctctgg

SEQ ID NO: 172131 - DNA, 25 bp, Mus musculus
acaagttcgacgccttaaaagatga

SEQ ID NO: 172132 - DNA, 25 bp, Mus musculus
acaagttctacaggcctgagaatac

SEQ ID NO: 172133 - DNA, 25 bp, Mus musculus
acaagttctacaggctgccacaggt

SEQ ID NO: 172134 - DNA, 25 bp, Mus musculus
acaagttctcaggaacaatcctcaa

SEQ ID NO: 172135 - DNA, 25 bp, Mus musculus
acaagttctcgcacacaagaagcag

SEQ ID NO: 172136 - DNA, 25 bp, Mus musculus
acaagttctcggcctatggctggtg

SEQ ID NO: 172137 - DNA, 25 bp, Mus musculus
acaagttgagatgaagcccgaggca

SEQ ID NO: 172138 - DNA, 25 bp, Mus musculus
acaagttgaggaacaatacgaagag

SEQ ID NO: 172139 - DNA, 25 bp, Mus musculus
acaagttgaggaggaggcccaagag

SEQ ID NO: 172140 - DNA, 25 bp, Mus musculus
acaagttgtcagggctccagtggct

SEQ ID NO: 172141 - DNA, 25 bp, Mus musculus
acaagttgtgagagaaggaagaggc

SEQ ID NO: 172142 - DNA, 25 bp, Mus musculus
acaagtttatacagatctttcattt

SEQ ID NO: 172143 - DNA, 25 bp, Mus musculus
acaagtttatacagggtgacatttg

SEQ ID NO: 172144 - DNA, 25 bp, Mus musculus
acaagtttattacagcactcaaatc

SEQ ID NO: 172145 - DNA, 25 bp, Mus musculus
acaagtttattacagtgtgttcaaa

SEQ ID NO: 172146 - DNA, 25 bp, Mus musculus
acaagtttcttagacctctcacagc

SEQ ID NO: 172147 - DNA, 25 bp, Mus musculus
acaagttttccagtgaagccatggc

SEQ ID NO: 172148 - DNA, 25 bp, Mus musculus
acaataaaacgggtaaaatgatcca

SEQ ID NO: 172149 - DNA, 25 bp, Mus musculus
acaataaaagctcaggaagtcttta

SEQ ID NO: 172150 - DNA, 25 bp, Mus musculus
acaataaaaggaaagacaaagatgt

SEQ ID NO: 172151 - DNA, 25 bp, Mus musculus
acaataacaaagctgcagtgttgaa

SEQ ID NO: 172152 - DNA, 25 bp, Mus musculus
acaataaccagtctgtgaacctaca

SEQ ID NO: 172153 - DNA, 25 bp, Mus musculus
acaataaccctaaaggccttgcatc

SEQ ID NO: 172154 - DNA, 25 bp, Mus musculus
acaataacctccagggaggtatgga

SEQ ID NO: 172155 - DNA, 25 bp, Mus musculus
acaataagactgggatgtttctttc

SEQ ID NO: 172156 - DNA, 25 bp, Mus musculus
acaataagactgggtaaatttgatc

SEQ ID NO: 172157 - DNA, 25 bp, Mus musculus
acaataaggacgggccaaggtggag

SEQ ID NO: 172158 - DNA, 25 bp, Mus musculus
acaataatgaagacaactggattgc

SEQ ID NO: 172159 - DNA, 25 bp, Mus musculus
acaataatggagtgatagaaggaag

SEQ ID NO: 172160 - DNA, 25 bp, Mus musculus
acaataattatttggctgatgaaga

SEQ ID NO: 172161 - DNA, 25 bp, Mus musculus
acaatacaaatacaggaagacattt

SEQ ID NO: 172162 - DNA, 25 bp, Mus musculus
acaatacaagaagagttatgaaaag

SEQ ID NO: 172163 - DNA, 25 bp, Mus musculus
acaatacccagagatgtgaatacgg

SEQ ID NO: 172164 - DNA, 25 bp, Mus musculus
acaatactcagggaggagactccca

SEQ ID NO: 172165 - DNA, 25 bp, Mus musculus
acaatagaatacatggcccctgaaa

SEQ ID NO: 172166 - DNA, 25 bp, Mus musculus
acaatagcacaggaatgattggcag

SEQ ID NO: 172167 - DNA, 25 bp, Mus musculus
acaatagggcgctctgcctcacgtg

SEQ ID NO: 172168 - DNA, 25 bp, Mus musculus
acaatagggcggctatcctacctac

SEQ ID NO: 172169 - DNA, 25 bp, Mus musculus
acaatagggcggttatgggtgctac

SEQ ID NO: 172170 - DNA, 25 bp, Mus musculus
acaatagggcggtttatctgagcag

SEQ ID NO: 172171 - DNA, 25 bp, Mus musculus
acaatagtaaaggctggacccgact

SEQ ID NO: 172172 - DNA, 25 bp, Mus musculus
acaatagtatctttacggacgagtc

SEQ ID NO: 172173 - DNA, 25 bp, Mus musculus
acaatatcaaggaagtgcttctctt

SEQ ID NO: 172174 - DNA, 25 bp, Mus musculus
acaatatctatctgcatgtccagat

SEQ ID NO: 172175 - DNA, 25 bp, Mus musculus
acaatatctcggacgtgagggtcac

SEQ ID NO: 172176 - DNA, 25 bp, Mus musculus
acaatatctcggagcggtttcctct

SEQ ID NO: 172177 - DNA, 25 bp, Mus musculus
acaatatctggcaaaaaggataagt

SEQ ID NO: 172178 - DNA, 25 bp, Mus musculus
acaatattagaaggaacaactgtga

SEQ ID NO: 172179 - DNA, 25 bp, Mus musculus
acaatattccaacggtgccccttat

SEQ ID NO: 172180 - DNA, 25 bp, Mus musculus
acaatcaaaagggaagttgtccttg

SEQ ID NO: 172181 - DNA, 25 bp, Mus musculus
acaatcaaagacagagttgactcct

SEQ ID NO: 172182 - DNA, 25 bp, Mus musculus
acaatcaaatccaccgccatctccc

SEQ ID NO: 172183 - DNA, 25 bp, Mus musculus
acaatcaataggtttccaggcaaca

SEQ ID NO: 172184 - DNA, 25 bp, Mus musculus
acaatcaattgaaatcaagcagaag

SEQ ID NO: 172185 - DNA, 25 bp, Mus musculus
acaatcacagacagcttacctctag

SEQ ID NO: 172186 - DNA, 25 bp, Mus musculus
acaatcacagaggccagaagagaga

SEQ ID NO: 172187 - DNA, 25 bp, Mus musculus
acaatcacaggtgtagatgtcagca

SEQ ID NO: 172188 - DNA, 25 bp, Mus musculus
acaatcacgacagcctgcctggccc

SEQ ID NO: 172189 - DNA, 25 bp, Mus musculus
acaatcacttagcatgtgtgaactg

SEQ ID NO: 172190 - DNA, 25 bp, Mus musculus
acaatcagccaaggttactcctaga

SEQ ID NO: 172191 - DNA, 25 bp, Mus musculus
acaatcagctgaaggaactcagaga

SEQ ID NO: 172192 - DNA, 25 bp, Mus musculus
acaatcagctgaagtgtgggagtat

SEQ ID NO: 172193 - DNA, 25 bp, Mus musculus
acaatcattgatatgtcaactcaga

SEQ ID NO: 172194 - DNA, 25 bp, Mus musculus
acaatccagcggctcctggaggaga

SEQ ID NO: 172195 - DNA, 25 bp, Mus musculus
acaatcctgaaacaggtactacttg

SEQ ID NO: 172196 - DNA, 25 bp, Mus musculus
acaatcctgagaggaagatccaaaa

SEQ ID NO: 172197 - DNA, 25 bp, Mus musculus
acaatcctgagcaggttgtggatgt

SEQ ID NO: 172198 - DNA, 25 bp, Mus musculus
acaatcctgaggtactgtactgatg

SEQ ID NO: 172199 - DNA, 25 bp, Mus musculus
acaatcctgaggtgaagaggaagat

SEQ ID NO: 172200 - DNA, 25 bp, Mus musculus
acaatccttacgggaaggtgcacac

SEQ ID NO: 172201 - DNA, 25 bp, Mus musculus
acaatccttacggtgataaaattgc

SEQ ID NO: 172202 - DNA, 25 bp, Mus musculus
acaatcctttagcagctactccatc

SEQ ID NO: 172203 - DNA, 25 bp, Mus musculus
acaatctcagaatggcttcacacca

SEQ ID NO: 172204 - DNA, 25 bp, Mus musculus
acaatctgcatgttaacaagcctgc

SEQ ID NO: 172205 - DNA, 25 bp, Mus musculus
acaatctgctgacgcttcgctgcgg

SEQ ID NO: 172206 - DNA, 25 bp, Mus musculus
acaatctgctgacggatagcggcgg

SEQ ID NO: 172207 - DNA, 25 bp, Mus musculus
acaatctggctcttctgtcagtttg

SEQ ID NO: 172208 - DNA, 25 bp, Mus musculus
acaatcttaaaggggcaagcggatc

SEQ ID NO: 172209 - DNA, 25 bp, Mus musculus
acaatcttacaagaagtaaagctta

SEQ ID NO: 172210 - DNA, 25 bp, Mus musculus
acaatcttacaagaatgcagaaggc

SEQ ID NO: 172211 - DNA, 25 bp, Mus musculus
acaatcttcaggtggctgtgaagaa

SEQ ID NO: 172212 - DNA, 25 bp, Mus musculus
acaatgaaaacgtatccaacggttg

SEQ ID NO: 172213 - DNA, 25 bp, Mus musculus
acaatgaagcaggtttagatgacga

SEQ ID NO: 172214 - DNA, 25 bp, Mus musculus
acaatgaagtaaaacaagatactca

SEQ ID NO: 172215 - DNA, 25 bp, Mus musculus
acaatgacactcagatcaaattgct

SEQ ID NO: 172216 - DNA, 25 bp, Mus musculus
acaatgacgatagaaagatcctcaa

SEQ ID NO: 172217 - DNA, 25 bp, Mus musculus
acaatgacgattctgactgcccata

SEQ ID NO: 172218 - DNA, 25 bp, Mus musculus
acaatgagaggccttcagtttatgc

SEQ ID NO: 172219 - DNA, 25 bp, Mus musculus
acaatgagattctgatatctgcaca

SEQ ID NO: 172220 - DNA, 25 bp, Mus musculus
acaatgagattctgcacacttccag

SEQ ID NO: 172221 - DNA, 25 bp, Mus musculus
acaatgagcacaagactgacctagg

SEQ ID NO: 172222 - DNA, 25 bp, Mus musculus
acaatgagcacaagagctgcgagga

SEQ ID NO: 172223 - DNA, 25 bp, Mus musculus
acaatgagctccaaggatgctctgg

SEQ ID NO: 172224 - DNA, 25 bp, Mus musculus
acaatgatagaccaaactgcagctg

SEQ ID NO: 172225 - DNA, 25 bp, Mus musculus
acaatgatagattcaaacaccgaaa

SEQ ID NO: 172226 - DNA, 25 bp, Mus musculus
acaatgatgaagactctaaaataga

SEQ ID NO: 172227 - DNA, 25 bp, Mus musculus
acaatgatgaaggaaagaagaaaga

SEQ ID NO: 172228 - DNA, 25 bp, Mus musculus
acaatgattcggcagacgggcctgg

SEQ ID NO: 172229 - DNA, 25 bp, Mus musculus
acaatgcaacgtggccctgaattca

SEQ ID NO: 172230 - DNA, 25 bp, Mus musculus
acaatgcaagaaaacgaagtccatc

SEQ ID NO: 172231 - DNA, 25 bp, Mus musculus
acaatgcaagtgcaccttccagcca

SEQ ID NO: 172232 - DNA, 25 bp, Mus musculus
acaatgcacgactccgctctcactc

SEQ ID NO: 172233 - DNA, 25 bp, Mus musculus
acaatgcagagactgatgaagtatt

SEQ ID NO: 172234 - DNA, 25 bp, Mus musculus
acaatgcagagagtgacctcagttc

SEQ ID NO: 172235 - DNA, 25 bp, Mus musculus
acaatgcagcccttttgatctcttg

SEQ ID NO: 172236 - DNA, 25 bp, Mus musculus
acaatgcaggggttgacaacttcgg

SEQ ID NO: 172237 - DNA, 25 bp, Mus musculus
acaatgccattattgctttcgagga

SEQ ID NO: 172238 - DNA, 25 bp, Mus musculus
acaatgcccccaagagatcccgttt

SEQ ID NO: 172239 - DNA, 25 bp, Mus musculus
acaatgcccccaaggacttaaaaga

SEQ ID NO: 172240 - DNA, 25 bp, Mus musculus
acaatgcctacagctcttaaccttt

SEQ ID NO: 172241 - DNA, 25 bp, Mus musculus
acaatgcctacaggttcttcttcac

SEQ ID NO: 172242 - DNA, 25 bp, Mus musculus
acaatgcctagaagagtggttcttc

SEQ ID NO: 172243 - DNA, 25 bp, Mus musculus
acaatgcctagaaggggcaatgtca

SEQ ID NO: 172244 - DNA, 25 bp, Mus musculus
acaatgcgtacagaaaagcggcatc

SEQ ID NO: 172245 - DNA, 25 bp, Mus musculus
acaatgcgtacagccaggagtagga

SEQ ID NO: 172246 - DNA, 25 bp, Mus musculus
acaatgctcaagagtatagtcatgg

SEQ ID NO: 172247 - DNA, 25 bp, Mus musculus
acaatgctgagagttgaaaaacatg

SEQ ID NO: 172248 - DNA, 25 bp, Mus musculus
acaatggagacaaggaacatggaat

SEQ ID NO: 172249 - DNA, 25 bp, Mus musculus
acaatggagttctggggacaatggt

SEQ ID NO: 172250 - DNA, 25 bp, Mus musculus
acaatggatacccagacctgattgt

SEQ ID NO: 172251 - DNA, 25 bp, Mus musculus
acaatggcaagattgagctccgggc

SEQ ID NO: 172252 - DNA, 25 bp, Mus musculus
acaatggcaagggaggaccgggctc

SEQ ID NO: 172253 - DNA, 25 bp, Mus musculus
acaatggcaagggagggcgtggacg

SEQ ID NO: 172254 - DNA, 25 bp, Mus musculus
acaatggcaatcatgaggcagtgaa

SEQ ID NO: 172255 - DNA, 25 bp, Mus musculus
acaatggccaaagatgagagctgcc

SEQ ID NO: 172256 - DNA, 25 bp, Mus musculus
acaatggccaagaagtctacatgtg

SEQ ID NO: 172257 - DNA, 25 bp, Mus musculus
acaatggccagaaagaagactcaga

SEQ ID NO: 172258 - DNA, 25 bp, Mus musculus
acaatggcctagaggtaatcaagga

SEQ ID NO: 172259 - DNA, 25 bp, Mus musculus
acaatggcctccccttgctctgcca

SEQ ID NO: 172260 - DNA, 25 bp, Mus musculus
acaatggcgccagccaggacggctt

SEQ ID NO: 172261 - DNA, 25 bp, Mus musculus
acaatgggaaaacggtatatgcacc

SEQ ID NO: 172262 - DNA, 25 bp, Mus musculus
acaatgggagatgatggcccttcag

SEQ ID NO: 172263 - DNA, 25 bp, Mus musculus
acaatgggaggtgctggatagttta

SEQ ID NO: 172264 - DNA, 25 bp, Mus musculus
acaatgggagtgaacacggattcgg

SEQ ID NO: 172265 - DNA, 25 bp, Mus musculus
acaatggtactgtaggtggatagtc

SEQ ID NO: 172266 - DNA, 25 bp, Mus musculus
acaatggtatcgggctagccaacca

SEQ ID NO: 172267 - DNA, 25 bp, Mus musculus
acaatggttatggttatgcttcaaa

SEQ ID NO: 172268 - DNA, 25 bp, Mus musculus
acaatgtaaagaaccctgtgtattc

SEQ ID NO: 172269 - DNA, 25 bp, Mus musculus
acaatgtagagatcccctatttcac

SEQ ID NO: 172270 - DNA, 25 bp, Mus musculus
acaatgtcacgaacttgtttcctgc

SEQ ID NO: 172271 - DNA, 25 bp, Mus musculus
acaatgtcactcaggtgcggacatt

SEQ ID NO: 172272 - DNA, 25 bp, Mus musculus
acaatgtctttggtttcaacagctc

SEQ ID NO: 172273 - DNA, 25 bp, Mus musculus
acaatgtgaaagtacatttgcaaga

SEQ ID NO: 172274 - DNA, 25 bp, Mus musculus
acaatgtgacagtccatatgttgtg

SEQ ID NO: 172275 - DNA, 25 bp, Mus musculus
acaatgtgcagcatgagaatggcta

SEQ ID NO: 172276 - DNA, 25 bp, Mus musculus
acaatgtgcagcatgcttttcccag

SEQ ID NO: 172277 - DNA, 25 bp, Mus musculus
acaatgtggaagtcttcagtaactt

SEQ ID NO: 172278 - DNA, 25 bp, Mus musculus
acaatgtggatcaggaatcctttct

SEQ ID NO: 172279 - DNA, 25 bp, Mus musculus
acaatgttgagctctctggcaagac

SEQ ID NO: 172280 - DNA, 25 bp, Mus musculus
acaatgttgggcaggatgtttggat

SEQ ID NO: 172281 - DNA, 25 bp, Mus musculus
acaatgtttgcctgggaaatgctca

SEQ ID NO: 172282 - DNA, 25 bp, Mus musculus
acaatgtttgtgtgtggacaggcca

SEQ ID NO: 172283 - DNA, 25 bp, Mus musculus
acaattaaaaagacgctgaacccaa

SEQ ID NO: 172284 - DNA, 25 bp, Mus musculus
acaattacagataaggaactgctga

SEQ ID NO: 172285 - DNA, 25 bp, Mus musculus
acaattacagataaggtgttctcat

SEQ ID NO: 172286 - DNA, 25 bp, Mus musculus
acaattaccagtgatatgctgtgga

SEQ ID NO: 172287 - DNA, 25 bp, Mus musculus
acaattacctgaaggatgggcctta

SEQ ID NO: 172288 - DNA, 25 bp, Mus musculus
acaattatgagggttcagctcctaa

SEQ ID NO: 172289 - DNA, 25 bp, Mus musculus
acaattatgggacctaatgacagcc

SEQ ID NO: 172290 - DNA, 25 bp, Mus musculus
acaattatgggacctctcaatgaaa

SEQ ID NO: 172291 - DNA, 25 bp, Mus musculus
acaattattacaggtaatgaagaag

SEQ ID NO: 172292 - DNA, 25 bp, Mus musculus
acaattccagcacaaggaattcgct

SEQ ID NO: 172293 - DNA, 25 bp, Mus musculus
acaattccatctgctcccagaatta

SEQ ID NO: 172294 - DNA, 25 bp, Mus musculus
acaattcctgtacactcacgccttc

SEQ ID NO: 172295 - DNA, 25 bp, Mus musculus
acaattctaacagagatataccgca

SEQ ID NO: 172296 - DNA, 25 bp, Mus musculus
acaattctgtttcgatctatgtaag

SEQ ID NO: 172297 - DNA, 25 bp, Mus musculus
acaattctgtttcggacttgccatc

SEQ ID NO: 172298 - DNA, 25 bp, Mus musculus
acaattgagaccaggccatgctcag

SEQ ID NO: 172299 - DNA, 25 bp, Mus musculus
acaattgcaaagaaaagacccaagt

SEQ ID NO: 172300 - DNA, 25 bp, Mus musculus
acaattggaaatcaggtgattcgta

SEQ ID NO: 172301 - DNA, 25 bp, Mus musculus
acaattggaatgaaggctcagatcc

SEQ ID NO: 172302 - DNA, 25 bp, Mus musculus
acaatttaagaccctgctcacacta

SEQ ID NO: 172303 - DNA, 25 bp, Mus musculus
acaatttaagccacaagatccgtat

SEQ ID NO: 172304 - DNA, 25 bp, Mus musculus
acaatttcagcatctctgagttttt

SEQ ID NO: 172305 - DNA, 25 bp, Mus musculus
acaatttcagtcatctcctgaagat

SEQ ID NO: 172306 - DNA, 25 bp, Mus musculus
acaatttcatagatgctatgctgat

SEQ ID NO: 172307 - DNA, 25 bp, Mus musculus
acaatttcatagttgctatgctgat

SEQ ID NO: 172308 - DNA, 25 bp, Mus musculus
acaatttccaggtcatgagcatggt

SEQ ID NO: 172309 - DNA, 25 bp, Mus musculus
acaatttctggaaatgatatattgg

SEQ ID NO: 172310 - DNA, 25 bp, Mus musculus
acaatttgcataaagactgaccatc

SEQ ID NO: 172311 - DNA, 25 bp, Mus musculus
acaatttggcttcaatactgggcgg

SEQ ID NO: 172312 - DNA, 25 bp, Mus musculus
acaatttggcttcatactttatctt

SEQ ID NO: 172313 - DNA, 25 bp, Mus musculus
acaatttgtcgataatctgtatcga

SEQ ID NO: 172314 - DNA, 25 bp, Mus musculus
acaatttgtgagcagaacatgttac

SEQ ID NO: 172315 - DNA, 25 bp, Mus musculus
acaatttgtgagcaggtgtccacaa

SEQ ID NO: 172316 - DNA, 25 bp, Mus musculus
acaattttcaggatgacgatcagga

SEQ ID NO: 172317 - DNA, 25 bp, Mus musculus
acaattttgttaaggaaattaagcg

SEQ ID NO: 172318 - DNA, 25 bp, Mus musculus
acaatttttaggccccgtcattgtg

SEQ ID NO: 172319 - DNA, 25 bp, Mus musculus
acacaaaaaaaaggcagtggacttt

SEQ ID NO: 172320 - DNA, 25 bp, Mus musculus
acacaaaaaatcttctctgatgatg

SEQ ID NO: 172321 - DNA, 25 bp, Mus musculus
acacaaaaacagatggatgagacat

SEQ ID NO: 172322 - DNA, 25 bp, Mus musculus
acacaaaaagcttcctagaggaagt

SEQ ID NO: 172323 - DNA, 25 bp, Mus musculus
acacaaaaatgggttctctgtctgt

SEQ ID NO: 172324 - DNA, 25 bp, Mus musculus
acacaaaacaggctggccttgtggt

SEQ ID NO: 172325 - DNA, 25 bp, Mus musculus
acacaaaacaggttcagacagtaac

SEQ ID NO: 172326 - DNA, 25 bp, Mus musculus
acacaaaagcaaatcactgaaggac

SEQ ID NO: 172327 - DNA, 25 bp, Mus musculus
acacaaaagtcaaatgtggatatgc

SEQ ID NO: 172328 - DNA, 25 bp, Mus musculus
acacaaaataacaaagagctactgc

SEQ ID NO: 172329 - DNA, 25 bp, Mus musculus
acacaaaataacaaagcggagtatg

SEQ ID NO: 172330 - DNA, 25 bp, Mus musculus
acacaaaatcatggacgcattcagc

SEQ ID NO: 172331 - DNA, 25 bp, Mus musculus
acacaaaatcattagataacaacta

SEQ ID NO: 172332 - DNA, 25 bp, Mus musculus
acacaaaatgtaggtggatgaagac

SEQ ID NO: 172333 - DNA, 25 bp, Mus musculus
acacaaacaccgtgcctaaattgta

SEQ ID NO: 172334 - DNA, 25 bp, Mus musculus
acacaaacacgacagtccctgacct

SEQ ID NO: 172335 - DNA, 25 bp, Mus musculus
acacaaacacgagagtccctgacct

SEQ ID NO: 172336 - DNA, 25 bp, Mus musculus
acacaaacagatctttgaggggaga

SEQ ID NO: 172337 - DNA, 25 bp, Mus musculus
acacaaacagtcaaagcagtcctta

SEQ ID NO: 172338 - DNA, 25 bp, Mus musculus
acacaaacgaggtataagtattgtt

SEQ ID NO: 172339 - DNA, 25 bp, Mus musculus
acacaaacttttaggtagacatttg

SEQ ID NO: 172340 - DNA, 25 bp, Mus musculus
acacaaagcagagcaaaaaggggtg

SEQ ID NO: 172341 - DNA, 25 bp, Mus musculus
acacaaagcagggctttgggaatct

SEQ ID NO: 172342 - DNA, 25 bp, Mus musculus
acacaaagctcatagcgggatcctg

SEQ ID NO: 172343 - DNA, 25 bp, Mus musculus
acacaaaggaaagatttctcgaatg

SEQ ID NO: 172344 - DNA, 25 bp, Mus musculus
acacaaaggaaaggcattagcaaaa

SEQ ID NO: 172345 - DNA, 25 bp, Mus musculus
acacaaaggaccgatgtagcaggcc

SEQ ID NO: 172346 - DNA, 25 bp, Mus musculus
acacaaaggcagagtcagttgttca

SEQ ID NO: 172347 - DNA, 25 bp, Mus musculus
acacaaagttcagtactagaagaca

SEQ ID NO: 172348 - DNA, 25 bp, Mus musculus
acacaacaaagattatcagagactg

SEQ ID NO: 172349 - DNA, 25 bp, Mus musculus
acacaacacaaaaagcttcctagag

SEQ ID NO: 172350 - DNA, 25 bp, Mus musculus
acacaacagagatggatggacagtc

SEQ ID NO: 172351 - DNA, 25 bp, Mus musculus
acacaacagagcaggttaggaaatc

SEQ ID NO: 172352 - DNA, 25 bp, Mus musculus
acacaacatgtgggatcacatgcag

SEQ ID NO: 172353 - DNA, 25 bp, Mus musculus
acacaaccatatttggtcacctgga

SEQ ID NO: 172354 - DNA, 25 bp, Mus musculus
acacaacccaggtggatcccactgc

SEQ ID NO: 172355 - DNA, 25 bp, Mus musculus
acacaacctgttcaagaaaattgac

SEQ ID NO: 172356 - DNA, 25 bp, Mus musculus
acacaactatgttcagcaggacttg

SEQ ID NO: 172357 - DNA, 25 bp, Mus musculus
acacaagaaaagtcaggccctgctg

SEQ ID NO: 172358 - DNA, 25 bp, Mus musculus
acacaagaaactaacactaagcagt

SEQ ID NO: 172359 - DNA, 25 bp, Mus musculus
acacaagaacaggcaaggccctcac

SEQ ID NO: 172360 - DNA, 25 bp, Mus musculus
acacaagaactgacggcacaggccc

SEQ ID NO: 172361 - DNA, 25 bp, Mus musculus
acacaagaactgacggcactgatgg

SEQ ID NO: 172362 - DNA, 25 bp, Mus musculus
acacaagaagcagtcgttccccatc

SEQ ID NO: 172363 - DNA, 25 bp, Mus musculus
acacaagaaggaggtggaactgaca

SEQ ID NO: 172364 - DNA, 25 bp, Mus musculus
acacaagaaggctacatggatgcag

SEQ ID NO: 172365 - DNA, 25 bp, Mus musculus
acacaagagaattcatacaggagag

SEQ ID NO: 172366 - DNA, 25 bp, Mus musculus
acacaagaggctttggtcatccagc

SEQ ID NO: 172367 - DNA, 25 bp, Mus musculus
acacaagatggcccgcagaggacgg

SEQ ID NO: 172368 - DNA, 25 bp, Mus musculus
acacaagcaagcagttgtttcttga

SEQ ID NO: 172369 - DNA, 25 bp, Mus musculus
acacaagcacagcacggccctgccc

SEQ ID NO: 172370 - DNA, 25 bp, Mus musculus
acacaagcaggtcagatgtaccagc

SEQ ID NO: 172371 - DNA, 25 bp, Mus musculus
acacaagcccaaggaggataagcta

SEQ ID NO: 172372 - DNA, 25 bp, Mus musculus
acacaagcccaagtgcccaccttgt

SEQ ID NO: 172373 - DNA, 25 bp, Mus musculus
acacaaggaaggagcagctgcaaga

SEQ ID NO: 172374 - DNA, 25 bp, Mus musculus
acacaaggaggatacatctctacta

SEQ ID NO: 172375 - DNA, 25 bp, Mus musculus
acacaaggaggcatggtccaggtac

SEQ ID NO: 172376 - DNA, 25 bp, Mus musculus
acacaaggccaggagcatcatcggc

SEQ ID NO: 172377 - DNA, 25 bp, Mus musculus
acacaagtataaggtgatgttccct

SEQ ID NO: 172378 - DNA, 25 bp, Mus musculus
acacaagtcaatcgaaaatttccag

SEQ ID NO: 172379 - DNA, 25 bp, Mus musculus
acacaagtcaatcgccagctaatgt

SEQ ID NO: 172380 - DNA, 25 bp, Mus musculus
acacaagtcaatggaaaatttccag

SEQ ID NO: 172381 - DNA, 25 bp, Mus musculus
acacaagtcaatggccagctaatgt

SEQ ID NO: 172382 - DNA, 25 bp, Mus musculus
acacaataaggctcatgcacaattg

SEQ ID NO: 172383 - DNA, 25 bp, Mus musculus
acacaataatggagtgatagaagga

SEQ ID NO: 172384 - DNA, 25 bp, Mus musculus
acacaatacaaaagaaagaaaatgt

SEQ ID NO: 172385 - DNA, 25 bp, Mus musculus
acacaatcaagcccccactgtgttc

SEQ ID NO: 172386 - DNA, 25 bp, Mus musculus
acacaatcaaggcacttcggaggag

SEQ ID NO: 172387 - DNA, 25 bp, Mus musculus
acacaatcaaggtccacaggatgat

SEQ ID NO: 172388 - DNA, 25 bp, Mus musculus
acacaatcaattgaaatcaagcaga

SEQ ID NO: 172389 - DNA, 25 bp, Mus musculus
acacaatcagatgtcgtttggtcac

SEQ ID NO: 172390 - DNA, 25 bp, Mus musculus
acacaatcagccgcataactcatca

SEQ ID NO: 172391 - DNA, 25 bp, Mus musculus
acacaatcagccgtcattcagtctg

SEQ ID NO: 172392 - DNA, 25 bp, Mus musculus
acacaatcagtcgaagggggcagag

SEQ ID NO: 172393 - DNA, 25 bp, Mus musculus
acacaatctgccattatttgcattt

SEQ ID NO: 172394 - DNA, 25 bp, Mus musculus
acacaatgagactcaccataagtgc

SEQ ID NO: 172395 - DNA, 25 bp, Mus musculus
acacaatggagcatatccgtgtggg

SEQ ID NO: 172396 - DNA, 25 bp, Mus musculus
acacaatggcctccccttgctctgc

SEQ ID NO: 172397 - DNA, 25 bp, Mus musculus
acacaattattacaggtaatgaaga

SEQ ID NO: 172398 - DNA, 25 bp, Mus musculus
acacaattggcggcggctgccccga

SEQ ID NO: 172399 - DNA, 25 bp, Mus musculus
acacaatttcaataacttacagtcc

SEQ ID NO: 172400 - DNA, 25 bp, Mus musculus
acacaatttcaatgtgttacagcac

SEQ ID NO: 172401 - DNA, 25 bp, Mus musculus
acacaatttcagactacaaaagtct

SEQ ID NO: 172402 - DNA, 25 bp, Mus musculus
acacaatttgggagtgagctacttt

SEQ ID NO: 172403 - DNA, 25 bp, Mus musculus
acacacaaaacaggctggccttgtg

SEQ ID NO: 172404 - DNA, 25 bp, Mus musculus
acacacaaagattcagagctggagt

SEQ ID NO: 172405 - DNA, 25 bp, Mus musculus
acacacaaaggttggttcctgtaca

SEQ ID NO: 172406 - DNA, 25 bp, Mus musculus
acacacaagaatcgcagaatgcatc

SEQ ID NO: 172407 - DNA, 25 bp, Mus musculus
acacacaaggccaggagcatcatcg

SEQ ID NO: 172408 - DNA, 25 bp, Mus musculus
acacacaattggcggcggctgcccc

SEQ ID NO: 172409 - DNA, 25 bp, Mus musculus
acacacaattgggccggcggcggct

SEQ ID NO: 172410 - DNA, 25 bp, Mus musculus
acacacaattggtggacgcagacga

SEQ ID NO: 172411 - DNA, 25 bp, Mus musculus
acacacacacacacacacacacaca

SEQ ID NO: 172412 - DNA, 25 bp, Mus musculus
acacacacactgcaagaacagaagc

SEQ ID NO: 172413 - DNA, 25 bp, Mus musculus
acacacacagcgattgagtcctgga

SEQ ID NO: 172414 - DNA, 25 bp, Mus musculus
acacacacagggattgagtcctgga

SEQ ID NO: 172415 - DNA, 25 bp, Mus musculus
acacacaccaagtttttcaagacaa

SEQ ID NO: 172416 - DNA, 25 bp, Mus musculus
acacacaccaggggtgacagtccaa

SEQ ID NO: 172417 - DNA, 25 bp, Mus musculus
acacacaccattcagctttctccca

SEQ ID NO: 172418 - DNA, 25 bp, Mus musculus
acacacacgaggtatgacgctgtgg

SEQ ID NO: 172419 - DNA, 25 bp, Mus musculus
acacacactgcaagaacagaagcag

SEQ ID NO: 172420 - DNA, 25 bp, Mus musculus
acacacacttgaagatcaagacata

SEQ ID NO: 172421 - DNA, 25 bp, Mus musculus
acacacacttgaagatctttctgca

SEQ ID NO: 172422 - DNA, 25 bp, Mus musculus
acacacacttgatcgattatgaaaa

SEQ ID NO: 172423 - DNA, 25 bp, Mus musculus
acacacagacttgtcccggccacac

SEQ ID NO: 172424 - DNA, 25 bp, Mus musculus
acacacagagaaaacatcccaggca

SEQ ID NO: 172425 - DNA, 25 bp, Mus musculus
acacacagcagatgcattacacgga

SEQ ID NO: 172426 - DNA, 25 bp, Mus musculus
acacacaggtaagggcagatgtcat

SEQ ID NO: 172427 - DNA, 25 bp, Mus musculus
acacacagtaaggaaatgatatatt

SEQ ID NO: 172428 - DNA, 25 bp, Mus musculus
acacacagtaaggctttaccgccag

SEQ ID NO: 172429 - DNA, 25 bp, Mus musculus
acacacagttctatggccaacaggc

SEQ ID NO: 172430 - DNA, 25 bp, Mus musculus
acacaccaagtttttcaagacaaaa

SEQ ID NO: 172431 - DNA, 25 bp, Mus musculus
acacaccacaggctttgctactgga

SEQ ID NO: 172432 - DNA, 25 bp, Mus musculus
acacaccacagggaaaccaggaaca

SEQ ID NO: 172433 - DNA, 25 bp, Mus musculus
acacaccattcagctttctcccaga

SEQ ID NO: 172434 - DNA, 25 bp, Mus musculus
acacacccaaagagggctgtgaccc

SEQ ID NO: 172435 - DNA, 25 bp, Mus musculus
acacaccccaggacaccatcttgct

SEQ ID NO: 172436 - DNA, 25 bp, Mus musculus
acacaccccccggtcacccgctgcc

SEQ ID NO: 172437 - DNA, 25 bp, Mus musculus
acacaccccctacctatggagttca

SEQ ID NO: 172438 - DNA, 25 bp, Mus musculus
acacacccctgtctgcaggcattgc

SEQ ID NO: 172439 - DNA, 25 bp, Mus musculus
acacacccggacgatgacagctata

SEQ ID NO: 172440 - DNA, 25 bp, Mus musculus
acacaccctaaggtaaaagttggca

SEQ ID NO: 172441 - DNA, 25 bp, Mus musculus
acacaccctaagtatttagaaatga

SEQ ID NO: 172442 - DNA, 25 bp, Mus musculus
acacaccgtatgaaggtggaagata

SEQ ID NO: 172443 - DNA, 25 bp, Mus musculus
acacacctcatacagggtggcagtg

SEQ ID NO: 172444 - DNA, 25 bp, Mus musculus
acacacctccacaggttccagatga

SEQ ID NO: 172445 - DNA, 25 bp, Mus musculus
acacacctctcacagacagctcagc

SEQ ID NO: 172446 - DNA, 25 bp, Mus musculus
acacacctcttccagacgctgaatc

SEQ ID NO: 172447 - DNA, 25 bp, Mus musculus
acacacctgaacctgatatctgtca

SEQ ID NO: 172448 - DNA, 25 bp, Mus musculus
acacacctgacttatttattttggt

SEQ ID NO: 172449 - DNA, 25 bp, Mus musculus
acacacgaccttggacgtaccatgc

SEQ ID NO: 172450 - DNA, 25 bp, Mus musculus
acacacgaggtatgacgctgtggta

SEQ ID NO: 172451 - DNA, 25 bp, Mus musculus
acacacgagttgggccattccagct

SEQ ID NO: 172452 - DNA, 25 bp, Mus musculus
acacacgctcaccagctgatggttc

SEQ ID NO: 172453 - DNA, 25 bp, Mus musculus
acacacgcttcttgccagtttatta

SEQ ID NO: 172454 - DNA, 25 bp, Mus musculus
acacacggaagaagaacatcagaaa

SEQ ID NO: 172455 - DNA, 25 bp, Mus musculus
acacacgggggagaggccatttgtt

SEQ ID NO: 172456 - DNA, 25 bp, Mus musculus
acacacgtgacaaataaccctggca

SEQ ID NO: 172457 - DNA, 25 bp, Mus musculus
acacacgtggaagagccggctttcc

SEQ ID NO: 172458 - DNA, 25 bp, Mus musculus
acacactccagaggtacaagcgcca

SEQ ID NO: 172459 - DNA, 25 bp, Mus musculus
acacactccctgtcctgttagcctg

SEQ ID NO: 172460 - DNA, 25 bp, Mus musculus
acacactccgacagctttccaccac

SEQ ID NO: 172461 - DNA, 25 bp, Mus musculus
acacactcttcagtgggcccgggat

SEQ ID NO: 172462 - DNA, 25 bp, Mus musculus
acacactgacggagcgcttctggga

SEQ ID NO: 172463 - DNA, 25 bp, Mus musculus
acacactgcagcaatgcacggctgt

SEQ ID NO: 172464 - DNA, 25 bp, Mus musculus
acacactgcagcgagctcgcgagta

SEQ ID NO: 172465 - DNA, 25 bp, Mus musculus
acacactgcagcgtgctctgctagc

SEQ ID NO: 172466 - DNA, 25 bp, Mus musculus
acacactgcgctaccctgtgaagcc

SEQ ID NO: 172467 - DNA, 25 bp, Mus musculus
acacactggaaggatttgccagtcc

SEQ ID NO: 172468 - DNA, 25 bp, Mus musculus
acacactggaagtatttttgaacaa

SEQ ID NO: 172469 - DNA, 25 bp, Mus musculus
acacactgtccaaactagcctctgc

SEQ ID NO: 172470 - DNA, 25 bp, Mus musculus
acacactgtccaagatctccgaggc

SEQ ID NO: 172471 - DNA, 25 bp, Mus musculus
acacactgtgccgggtgcacacagt

SEQ ID NO: 172472 - DNA, 25 bp, Mus musculus
acacactgtgggcatcctctacaca

SEQ ID NO: 172473 - DNA, 25 bp, Mus musculus
acacactgtgggccatccacgaaaa

SEQ ID NO: 172474 - DNA, 25 bp, Mus musculus
acacactgtggggtgcccaattacc

SEQ ID NO: 172475 - DNA, 25 bp, Mus musculus
acacacttgaagatcaagacataag

SEQ ID NO: 172476 - DNA, 25 bp, Mus musculus
acacacttgaagatctttctgcaag

SEQ ID NO: 172477 - DNA, 25 bp, Mus musculus
acacacttgatcgattatgaaaagg

SEQ ID NO: 172478 - DNA, 25 bp, Mus musculus
acacacttgatcggttatgaaaagt

SEQ ID NO: 172479 - DNA, 25 bp, Mus musculus
acacacttttccagttccccacact

SEQ ID NO: 172480 - DNA, 25 bp, Mus musculus
acacagaaaaagcctgaaaatgaat

SEQ ID NO: 172481 - DNA, 25 bp, Mus musculus
acacagaaaaaggtctgcagaatgt

SEQ ID NO: 172482 - DNA, 25 bp, Mus musculus
acacagaaaagaaggctggtgagga

SEQ ID NO: 172483 - DNA, 25 bp, Mus musculus
acacagaaaccgatcatcccagcag

SEQ ID NO: 172484 - DNA, 25 bp, Mus musculus
acacagaaaccggtgctcccttgca

SEQ ID NO: 172485 - DNA, 25 bp, Mus musculus
acacagaaagggtgcttcgagtgct

SEQ ID NO: 172486 - DNA, 25 bp, Mus musculus
acacagaaatttgaaatttcaacaa

SEQ ID NO: 172487 - DNA, 25 bp, Mus musculus
acacagaacattagctcaggtacct

SEQ ID NO: 172488 - DNA, 25 bp, Mus musculus
acacagaacccgaagagcctcagct

SEQ ID NO: 172489 - DNA, 25 bp, Mus musculus
acacagaacggagattatcagctcc

SEQ ID NO: 172490 - DNA, 25 bp, Mus musculus
acacagaagtccctgagctcagccc

SEQ ID NO: 172491 - DNA, 25 bp, Mus musculus
acacagaatgtcagaaccatcctcc

SEQ ID NO: 172492 - DNA, 25 bp, Mus musculus
acacagaatgtcagtctggagcccc

SEQ ID NO: 172493 - DNA, 25 bp, Mus musculus
acacagacacaaagctcaagttcat

SEQ ID NO: 172494 - DNA, 25 bp, Mus musculus
acacagacacaagatggaatatagg

SEQ ID NO: 172495 - DNA, 25 bp, Mus musculus
acacagacacggacaatttgggtat

SEQ ID NO: 172496 - DNA, 25 bp, Mus musculus
acacagacatggactgtctaacttt

SEQ ID NO: 172497 - DNA, 25 bp, Mus musculus
acacagaccaggtgggagcatgccg

SEQ ID NO: 172498 - DNA, 25 bp, Mus musculus
acacagacgtgaaaagtgacgtgaa

SEQ ID NO: 172499 - DNA, 25 bp, Mus musculus
acacagacgtgaaaatgttctgcct

SEQ ID NO: 172500 - DNA, 25 bp, Mus musculus
acacagactcccctgaatttaagga

SEQ ID NO: 172501 - DNA, 25 bp, Mus musculus
acacagactggaaggaacatgacat

SEQ ID NO: 172502 - DNA, 25 bp, Mus musculus
acacagacttgtcccggccacacag

SEQ ID NO: 172503 - DNA, 25 bp, Mus musculus
acacagagaaaacatcccaggcatc

SEQ ID NO: 172504 - DNA, 25 bp, Mus musculus
acacagagaacaaaggctccttctt

SEQ ID NO: 172505 - DNA, 25 bp, Mus musculus
acacagagaagtatagaagaagaaa

SEQ ID NO: 172506 - DNA, 25 bp, Mus musculus
acacagagcaccgggcaagagtcca

SEQ ID NO: 172507 - DNA, 25 bp, Mus musculus
acacagagcaccggggactcctgag

SEQ ID NO: 172508 - DNA, 25 bp, Mus musculus
acacagagcagaggaatgtctacaa

SEQ ID NO: 172509 - DNA, 25 bp, Mus musculus
acacagagcaggtcatacctcactc

SEQ ID NO: 172510 - DNA, 25 bp, Mus musculus
acacagagcagtacctcaaatcgtt

SEQ ID NO: 172511 - DNA, 25 bp, Mus musculus
acacagagctgtcccacattgggct

SEQ ID NO: 172512 - DNA, 25 bp, Mus musculus
acacagagctgttgccaaaacaaag

SEQ ID NO: 172513 - DNA, 25 bp, Mus musculus
acacagaggtggaggagagcatggc

SEQ ID NO: 172514 - DNA, 25 bp, Mus musculus
acacagagtttcaaggcaaacgaat

SEQ ID NO: 172515 - DNA, 25 bp, Mus musculus
acacagagtttcaaggcagcagtga

SEQ ID NO: 172516 - DNA, 25 bp, Mus musculus
acacagagtttcaaggtgggatgtg

SEQ ID NO: 172517 - DNA, 25 bp, Mus musculus
acacagatagagaaaccaactgagg

SEQ ID NO: 172518 - DNA, 25 bp, Mus musculus
acacagatcatgaagacagtaaaga

SEQ ID NO: 172519 - DNA, 25 bp, Mus musculus
acacagatcatgaaggacatctggg

SEQ ID NO: 172520 - DNA, 25 bp, Mus musculus
acacagatcatgaaggtacatttta

SEQ ID NO: 172521 - DNA, 25 bp, Mus musculus
acacagatctcgctcaagaagtcct

SEQ ID NO: 172522 - DNA, 25 bp, Mus musculus
acacagcaaacggctgtccctcctc

SEQ ID NO: 172523 - DNA, 25 bp, Mus musculus
acacagcaacatcaggtctcggaca

SEQ ID NO: 172524 - DNA, 25 bp, Mus musculus
acacagcacaggtgtaacgagtaat

SEQ ID NO: 172525 - DNA, 25 bp, Mus musculus
acacagcacccttatcttcaaagtg

SEQ ID NO: 172526 - DNA, 25 bp, Mus musculus
acacagcagacacagtccggttctc

SEQ ID NO: 172527 - DNA, 25 bp, Mus musculus
acacagcagagattgtatgtttatc

SEQ ID NO: 172528 - DNA, 25 bp, Mus musculus
acacagcagctggaactcattatac

SEQ ID NO: 172529 - DNA, 25 bp, Mus musculus
acacagcagggcaggatgagtacag

SEQ ID NO: 172530 - DNA, 25 bp, Mus musculus
acacagcaggtggatgcagtgacct

SEQ ID NO: 172531 - DNA, 25 bp, Mus musculus
acacagcatacaagacgagaaggac

SEQ ID NO: 172532 - DNA, 25 bp, Mus musculus
acacagcatacaagtcctcaagggc

SEQ ID NO: 172533 - DNA, 25 bp, Mus musculus
acacagcattaaggctcggctatta

SEQ ID NO: 172534 - DNA, 25 bp, Mus musculus
acacagccaaagatcggaaccgctg

SEQ ID NO: 172535 - DNA, 25 bp, Mus musculus
acacagccagtccagtagctccatc

SEQ ID NO: 172536 - DNA, 25 bp, Mus musculus
acacagccagtccgggaacccagtg

SEQ ID NO: 172537 - DNA, 25 bp, Mus musculus
acacagccagtccgtaaaagctctt

SEQ ID NO: 172538 - DNA, 25 bp, Mus musculus
acacagccatggatgtgcagcagcc

SEQ ID NO: 172539 - DNA, 25 bp, Mus musculus
acacagccatggctgtgtgcaatag

SEQ ID NO: 172540 - DNA, 25 bp, Mus musculus
acacagccatggggaaccagcctga

SEQ ID NO: 172541 - DNA, 25 bp, Mus musculus
acacagccgtccagacggtgcagag

SEQ ID NO: 172542 - DNA, 25 bp, Mus musculus
acacagccgtccagcacttccacgt

SEQ ID NO: 172543 - DNA, 25 bp, Mus musculus
acacagcctctgccaagcagttctt

SEQ ID NO: 172544 - DNA, 25 bp, Mus musculus
acacagcctgcttctacctggcaga

SEQ ID NO: 172545 - DNA, 25 bp, Mus musculus
acacagcggaggaaggagctaactc

SEQ ID NO: 172546 - DNA, 25 bp, Mus musculus
acacagcggaggaagtccttccgag

SEQ ID NO: 172547 - DNA, 25 bp, Mus musculus
acacagcggtcgccggttcccacta

SEQ ID NO: 172548 - DNA, 25 bp, Mus musculus
acacagcgtgcttttacttggctga

SEQ ID NO: 172549 - DNA, 25 bp, Mus musculus
acacagcgtggccttgggtggaccg

SEQ ID NO: 172550 - DNA, 25 bp, Mus musculus
acacagctaagttcacagccatgaa

SEQ ID NO: 172551 - DNA, 25 bp, Mus musculus
acacagctagagctttggatgatgt

SEQ ID NO: 172552 - DNA, 25 bp, Mus musculus
acacagctagaggtttggatgatgt

SEQ ID NO: 172553 - DNA, 25 bp, Mus musculus
acacagctgaaaaagtctggttttt

SEQ ID NO: 172554 - DNA, 25 bp, Mus musculus
acacagctgaaggagagactagaaa

SEQ ID NO: 172555 - DNA, 25 bp, Mus musculus
acacagcttcccagggggatatccg

SEQ ID NO: 172556 - DNA, 25 bp, Mus musculus
acacaggaaatgtttattggaaaag

SEQ ID NO: 172557 - DNA, 25 bp, Mus musculus
acacaggaaatgtttgcatctggcc

SEQ ID NO: 172558 - DNA, 25 bp, Mus musculus
acacaggaaatgtttgtgacccccc

SEQ ID NO: 172559 - DNA, 25 bp, Mus musculus
acacaggaagagctggattttgcca

SEQ ID NO: 172560 - DNA, 25 bp, Mus musculus
acacaggaagagctgggctctcccg

SEQ ID NO: 172561 - DNA, 25 bp, Mus musculus
acacaggacatcaggctctgtgtga

SEQ ID NO: 172562 - DNA, 25 bp, Mus musculus
acacaggacccaagtacattcacct

SEQ ID NO: 172563 - DNA, 25 bp, Mus musculus
acacaggacgggccaaaagatgcag

SEQ ID NO: 172564 - DNA, 25 bp, Mus musculus
acacaggacggtgtctttattgcca

SEQ ID NO: 172565 - DNA, 25 bp, Mus musculus
acacaggattttctgtgcagcagat

SEQ ID NO: 172566 - DNA, 25 bp, Mus musculus
acacaggattttctgtgcctttatt

SEQ ID NO: 172567 - DNA, 25 bp, Mus musculus
acacaggcacaccagggcaccctca

SEQ ID NO: 172568 - DNA, 25 bp, Mus musculus
acacaggcaggcagattgaccttgg

SEQ ID NO: 172569 - DNA, 25 bp, Mus musculus
acacagggagacaggatccttcctt

SEQ ID NO: 172570 - DNA, 25 bp, Mus musculus
acacagggcgaaacaaaggtcccac

SEQ ID NO: 172571 - DNA, 25 bp, Mus musculus
acacaggtaagggcagatgtcatca

SEQ ID NO: 172572 - DNA, 25 bp, Mus musculus
acacagtaaggaaatgatatattgg

SEQ ID NO: 172573 - DNA, 25 bp, Mus musculus
acacagtaaggctttaccgccagca

SEQ ID NO: 172574 - DNA, 25 bp, Mus musculus
acacagtagacactacttcatccgt

SEQ ID NO: 172575 - DNA, 25 bp, Mus musculus
acacagtcaagggatgaactgtgaa

SEQ ID NO: 172576 - DNA, 25 bp, Mus musculus
acacagtcagttcagcttcaattag

SEQ ID NO: 172577 - DNA, 25 bp, Mus musculus
acacagtccaaggtcacacggttat

SEQ ID NO: 172578 - DNA, 25 bp, Mus musculus
acacagtctcagctgccacccgatg

SEQ ID NO: 172579 - DNA, 25 bp, Mus musculus
acacagtctcagctgcctcctggtc

SEQ ID NO: 172580 - DNA, 25 bp, Mus musculus
acacagtgaagtcccctcctggcca

SEQ ID NO: 172581 - DNA, 25 bp, Mus musculus
acacagtgagagttcgatgcccaag

SEQ ID NO: 172582 - DNA, 25 bp, Mus musculus
acacagtgattatagttgattgaat

SEQ ID NO: 172583 - DNA, 25 bp, Mus musculus
acacagtgccaggcaggtcggataa

SEQ ID NO: 172584 - DNA, 25 bp, Mus musculus
acacagtgccagggagcccagagga

SEQ ID NO: 172585 - DNA, 25 bp, Mus musculus
acacagtgcccgtgcgcagttctgt

SEQ ID NO: 172586 - DNA, 25 bp, Mus musculus
acacagtgctgccacgacccttccc

SEQ ID NO: 172587 - DNA, 25 bp, Mus musculus
acacagtggaggattaccaggcaat

SEQ ID NO: 172588 - DNA, 25 bp, Mus musculus
acacagtgtaaaaacagaaagtgtg

SEQ ID NO: 172589 - DNA, 25 bp, Mus musculus
acacagtgttaccagcaccaccaaa

SEQ ID NO: 172590 - DNA, 25 bp, Mus musculus
acacagttatgaacatcagaaagcc

SEQ ID NO: 172591 - DNA, 25 bp, Mus musculus
acacagttatgtatgcaattggcag

SEQ ID NO: 172592 - DNA, 25 bp, Mus musculus
acacagttctatggccaacaggcta

SEQ ID NO: 172593 - DNA, 25 bp, Mus musculus
acacataaaggcaagaaaactggat

SEQ ID NO: 172594 - DNA, 25 bp, Mus musculus
acacatacaagagaggtgactacgg

SEQ ID NO: 172595 - DNA, 25 bp, Mus musculus
acacatacacagggagcatgacttc

SEQ ID NO: 172596 - DNA, 25 bp, Mus musculus
acacatacacgcccgaatggctggt

SEQ ID NO: 172597 - DNA, 25 bp, Mus musculus
acacatacagagttcgttatctagc

SEQ ID NO: 172598 - DNA, 25 bp, Mus musculus
acacatacattaaaagttttcagca

SEQ ID NO: 172599 - DNA, 25 bp, Mus musculus
acacataccaggttacaaggacagc

SEQ ID NO: 172600 - DNA, 25 bp, Mus musculus
acacatacggacctcaaacctgaaa

SEQ ID NO: 172601 - DNA, 25 bp, Mus musculus
acacatagcagataaacttctgcac

SEQ ID NO: 172602 - DNA, 25 bp, Mus musculus
acacatataaggaggaatttggcta

SEQ ID NO: 172603 - DNA, 25 bp, Mus musculus
acacatatgacgttcagaaacttag

SEQ ID NO: 172604 - DNA, 25 bp, Mus musculus
acacatcaccagggaattcgtacca

SEQ ID NO: 172605 - DNA, 25 bp, Mus musculus
acacatcaccaggtctcattattct

SEQ ID NO: 172606 - DNA, 25 bp, Mus musculus
acacatcacttgtcttccccaggga

SEQ ID NO: 172607 - DNA, 25 bp, Mus musculus
acacatcagcaggcccgggagatca

SEQ ID NO: 172608 - DNA, 25 bp, Mus musculus
acacatcagcgacacgcgggcgtcc

SEQ ID NO: 172609 - DNA, 25 bp, Mus musculus
acacatcataaagaggctcacaact

SEQ ID NO: 172610 - DNA, 25 bp, Mus musculus
acacatcctcaggaaagctgtggag

SEQ ID NO: 172611 - DNA, 25 bp, Mus musculus
acacatcctcaggagccagggaagg

SEQ ID NO: 172612 - DNA, 25 bp, Mus musculus
acacatcgataaggctcctgagggt

SEQ ID NO: 172613 - DNA, 25 bp, Mus musculus
acacatcgataaggttgaagaacag

SEQ ID NO: 172614 - DNA, 25 bp, Mus musculus
acacatctgaccccagtacatggag

SEQ ID NO: 172615 - DNA, 25 bp, Mus musculus
acacatctgctctcctctgatgaag

SEQ ID NO: 172616 - DNA, 25 bp, Mus musculus
acacatgaaacagtttgtagtgcat

SEQ ID NO: 172617 - DNA, 25 bp, Mus musculus
acacatgaacaggagtccttgccat

SEQ ID NO: 172618 - DNA, 25 bp, Mus musculus
acacatgaaggttcatgaatctcaa

SEQ ID NO: 172619 - DNA, 25 bp, Mus musculus
acacatgaagtgttgtcctgcttgg

SEQ ID NO: 172620 - DNA, 25 bp, Mus musculus
acacatgagagaaagaatcccaaga

SEQ ID NO: 172621 - DNA, 25 bp, Mus musculus
acacatgagagaaagaatgcccaga

SEQ ID NO: 172622 - DNA, 25 bp, Mus musculus
acacatgagtaaggtagcctccaag

SEQ ID NO: 172623 - DNA, 25 bp, Mus musculus
acacatgatcggaacaccatggacg

SEQ ID NO: 172624 - DNA, 25 bp, Mus musculus
acacatgatgctatcatgaacatag

SEQ ID NO: 172625 - DNA, 25 bp, Mus musculus
acacatgatggctatttgaaactct

SEQ ID NO: 172626 - DNA, 25 bp, Mus musculus
acacatgcaactgtgttattggcta

SEQ ID NO: 172627 - DNA, 25 bp, Mus musculus
acacatgcagaaaagtaaagaacaa

SEQ ID NO: 172628 - DNA, 25 bp, Mus musculus
acacatgcagctggtgaatgagcaa

SEQ ID NO: 172629 - DNA, 25 bp, Mus musculus
acacatgcaggcgcatacctcttgg

SEQ ID NO: 172630 - DNA, 25 bp, Mus musculus
acacatgctattgatctgatggagg

SEQ ID NO: 172631 - DNA, 25 bp, Mus musculus
acacatgctattgatgcttgcttta

SEQ ID NO: 172632 - DNA, 25 bp, Mus musculus
acacatgctcaggacccatagatga

SEQ ID NO: 172633 - DNA, 25 bp, Mus musculus
acacatggaagatctcaggcccatg

SEQ ID NO: 172634 - DNA, 25 bp, Mus musculus
acacatggaagcatggaatcagagc

SEQ ID NO: 172635 - DNA, 25 bp, Mus musculus
acacatggaaggaaaggacttcatc

SEQ ID NO: 172636 - DNA, 25 bp, Mus musculus
acacatggacaggtgacgccatctg

SEQ ID NO: 172637 - DNA, 25 bp, Mus musculus
acacatggatgaaaattcaggacgc

SEQ ID NO: 172638 - DNA, 25 bp, Mus musculus
acacatgggaaggagctgtcagtag

SEQ ID NO: 172639 - DNA, 25 bp, Mus musculus
acacatggggagagagggcaatgcg

SEQ ID NO: 172640 - DNA, 25 bp, Mus musculus
acacatggtgacagtccctctgagg

SEQ ID NO: 172641 - DNA, 25 bp, Mus musculus
acacatgtaaggtatcgcaaacgct

SEQ ID NO: 172642 - DNA, 25 bp, Mus musculus
acacatgtaagtccaacccctgtca

SEQ ID NO: 172643 - DNA, 25 bp, Mus musculus
acacatgtagatctttcatttgtcc

SEQ ID NO: 172644 - DNA, 25 bp, Mus musculus
acacattaaccagtgcacttaagga

SEQ ID NO: 172645 - DNA, 25 bp, Mus musculus
acacattattaaacggatggctccc

SEQ ID NO: 172646 - DNA, 25 bp, Mus musculus
acacattcaacgggggattcatcag

SEQ ID NO: 172647 - DNA, 25 bp, Mus musculus
acacattcactgcagctgctattgg

SEQ ID NO: 172648 - DNA, 25 bp, Mus musculus
acacattcactgcaggtccgagaga

SEQ ID NO: 172649 - DNA, 25 bp, Mus musculus
acacattcactgcagtgcccaggtc

SEQ ID NO: 172650 - DNA, 25 bp, Mus musculus
acacattccaaagtatagcacattt

SEQ ID NO: 172651 - DNA, 25 bp, Mus musculus
acacattccaaagtttatgttttgt

SEQ ID NO: 172652 - DNA, 25 bp, Mus musculus
acacattctcaataacctgtgtgaa

SEQ ID NO: 172653 - DNA, 25 bp, Mus musculus
acacattctggtgctggagacagat

SEQ ID NO: 172654 - DNA, 25 bp, Mus musculus
acacattgaagcaataccttctgac

SEQ ID NO: 172655 - DNA, 25 bp, Mus musculus
acacattgcaggctgcagatgtgtt

SEQ ID NO: 172656 - DNA, 25 bp, Mus musculus
acacattgcagttggaacaagagga

SEQ ID NO: 172657 - DNA, 25 bp, Mus musculus
acacattgcggatagagacatcggc

SEQ ID NO: 172658 - DNA, 25 bp, Mus musculus
acacattggcggctttcttgatcat

SEQ ID NO: 172659 - DNA, 25 bp, Mus musculus
acacatttcagggagactgctgggc

SEQ ID NO: 172660 - DNA, 25 bp, Mus musculus
acacattttgcagagattgagaagc

SEQ ID NO: 172661 - DNA, 25 bp, Mus musculus
acacattttgcagagctttgggacc

SEQ ID NO: 172662 - DNA, 25 bp, Mus musculus
acacattttggaaggtgcctctcct

SEQ ID NO: 172663 - DNA, 25 bp, Mus musculus
acacatttttgttgtgaagttatcc

SEQ ID NO: 172664 - DNA, 25 bp, Mus musculus
acaccaaaaacaagctttacacaga

SEQ ID NO: 172665 - DNA, 25 bp, Mus musculus
acaccaaaaagcacaacccaagagg

SEQ ID NO: 172666 - DNA, 25 bp, Mus musculus
acaccaaaaggccgaggggcaaaga

SEQ ID NO: 172667 - DNA, 25 bp, Mus musculus
acaccaaaagggctcaggatgctac

SEQ ID NO: 172668 - DNA, 25 bp, Mus musculus
acaccaaacagagttattggaagcc

SEQ ID NO: 172669 - DNA, 25 bp, Mus musculus
acaccaaacaggaaggtaccaggtg

SEQ ID NO: 172670 - DNA, 25 bp, Mus musculus
acaccaaacaggaggaggcgaagag

SEQ ID NO: 172671 - DNA, 25 bp, Mus musculus
acaccaaacaggcaccatcacaggg

SEQ ID NO: 172672 - DNA, 25 bp, Mus musculus
acaccaaaccaaaccctgtagctcc

SEQ ID NO: 172673 - DNA, 25 bp, Mus musculus
acaccaaactgcagctgcatggagc

SEQ ID NO: 172674 - DNA, 25 bp, Mus musculus
acaccaaactgcaggaatgggcaaa

SEQ ID NO: 172675 - DNA, 25 bp, Mus musculus
acaccaaaggagcagttcagggaag

SEQ ID NO: 172676 - DNA, 25 bp, Mus musculus
acaccaaaggcgacctggcgagaat

SEQ ID NO: 172677 - DNA, 25 bp, Mus musculus
acaccaacaaagggcgagaactttg

SEQ ID NO: 172678 - DNA, 25 bp, Mus musculus
acaccaacacaggttccttcctcca

SEQ ID NO: 172679 - DNA, 25 bp, Mus musculus
acaccaacagatgttctgatggcaa

SEQ ID NO: 172680 - DNA, 25 bp, Mus musculus
acaccaacaggggtggtggatttca

SEQ ID NO: 172681 - DNA, 25 bp, Mus musculus
acaccaacctatgaaaactctctac

SEQ ID NO: 172682 - DNA, 25 bp, Mus musculus
acaccaaccttcacctgggcctagg

SEQ ID NO: 172683 - DNA, 25 bp, Mus musculus
acaccaagaaaaaaattgacatcct

SEQ ID NO: 172684 - DNA, 25 bp, Mus musculus
acaccaagaaccaggcgctcaactc

SEQ ID NO: 172685 - DNA, 25 bp, Mus musculus
acaccaagaagcagccctcaggcac

SEQ ID NO: 172686 - DNA, 25 bp, Mus musculus
acaccaagaagcagttactgccgcc

SEQ ID NO: 172687 - DNA, 25 bp, Mus musculus
acaccaagagaggtattgtggccag

SEQ ID NO: 172688 - DNA, 25 bp, Mus musculus
acaccaagagcttactggcggtttt

SEQ ID NO: 172689 - DNA, 25 bp, Mus musculus
acaccaagcaagaatgtgaaactcc

SEQ ID NO: 172690 - DNA, 25 bp, Mus musculus
acaccaagcaagatcgacatcagga

SEQ ID NO: 172691 - DNA, 25 bp, Mus musculus
acaccaagtcaaaagtgagaccaac

SEQ ID NO: 172692 - DNA, 25 bp, Mus musculus
acaccaagtcgcagggagagtctct

SEQ ID NO: 172693 - DNA, 25 bp, Mus musculus
acaccaagtcggacttacggttaat

SEQ ID NO: 172694 - DNA, 25 bp, Mus musculus
acaccacaaccagctaaagaacgct

SEQ ID NO: 172695 - DNA, 25 bp, Mus musculus
acaccacaagagcatcgcaacatgc

SEQ ID NO: 172696 - DNA, 25 bp, Mus musculus
acaccacaaggggaggcaaaattcc

SEQ ID NO: 172697 - DNA, 25 bp, Mus musculus
acaccacacagacagaggagttgaa

SEQ ID NO: 172698 - DNA, 25 bp, Mus musculus
acaccacagtcacatttacagactc

SEQ ID NO: 172699 - DNA, 25 bp, Mus musculus
acaccaccaagatcccatggtttcc

SEQ ID NO: 172700 - DNA, 25 bp, Mus musculus
acaccaccaatcaaggctggcttca

SEQ ID NO: 172701 - DNA, 25 bp, Mus musculus
acaccaccaatcaagtcaccggaag

SEQ ID NO: 172702 - DNA, 25 bp, Mus musculus
acaccaccaatgtgagaggagagac

SEQ ID NO: 172703 - DNA, 25 bp, Mus musculus
acaccaccacgggttggatcaggcc

SEQ ID NO: 172704 - DNA, 25 bp, Mus musculus
acaccaccactagtgtgtcacatca

SEQ ID NO: 172705 - DNA, 25 bp, Mus musculus
acaccaccagagccctgcaggccct

SEQ ID NO: 172706 - DNA, 25 bp, Mus musculus
acaccacccagactatgaaatccct

SEQ ID NO: 172707 - DNA, 25 bp, Mus musculus
acaccacctcggcctctccatccgt

SEQ ID NO: 172708 - DNA, 25 bp, Mus musculus
acaccacgactggtggaaaaattcc

SEQ ID NO: 172709 - DNA, 25 bp, Mus musculus
acaccacgcagaatggtggcatcta

SEQ ID NO: 172710 - DNA, 25 bp, Mus musculus
acaccacgcagcccccacatcgaca

SEQ ID NO: 172711 - DNA, 25 bp, Mus musculus
acaccactacatggaaaaaagataa

SEQ ID NO: 172712 - DNA, 25 bp, Mus musculus
acaccactgcagcagatccacagat

SEQ ID NO: 172713 - DNA, 25 bp, Mus musculus
acaccactgcagtgtttgtaagcgg

SEQ ID NO: 172714 - DNA, 25 bp, Mus musculus
acaccactgtgtcaggtgtggccca

SEQ ID NO: 172715 - DNA, 25 bp, Mus musculus
acaccagaagggccggcccaccagt

SEQ ID NO: 172716 - DNA, 25 bp, Mus musculus
acaccagagaccttaaccgaaggtg

SEQ ID NO: 172717 - DNA, 25 bp, Mus musculus
acaccagagagctatcattgaggcg

SEQ ID NO: 172718 - DNA, 25 bp, Mus musculus
acaccagagagctgtcattgaggcg

SEQ ID NO: 172719 - DNA, 25 bp, Mus musculus
acaccagagcagcgtcatctccgaa

SEQ ID NO: 172720 - DNA, 25 bp, Mus musculus
acaccagagcgatgtgtggtctttt

SEQ ID NO: 172721 - DNA, 25 bp, Mus musculus
acaccagcagacatagactgccagt

SEQ ID NO: 172722 - DNA, 25 bp, Mus musculus
acaccagcagtcatagactgccagt

SEQ ID NO: 172723 - DNA, 25 bp, Mus musculus
acaccagcccataaaaacgtcaacg

SEQ ID NO: 172724 - DNA, 25 bp, Mus musculus
acaccagcgtcaagcaggtgtcttc

SEQ ID NO: 172725 - DNA, 25 bp, Mus musculus
acaccagctccaacatagtttgtga

SEQ ID NO: 172726 - DNA, 25 bp, Mus musculus
acaccagctccaatttttcaagaca

SEQ ID NO: 172727 - DNA, 25 bp, Mus musculus
acaccagctgcaaggtgtgaggtta

SEQ ID NO: 172728 - DNA, 25 bp, Mus musculus
acaccaggaaagattaattgcctga

SEQ ID NO: 172729 - DNA, 25 bp, Mus musculus
acaccaggaaagttcaaatagcccg

SEQ ID NO: 172730 - DNA, 25 bp, Mus musculus
acaccaggaaagttctcaatctcac

SEQ ID NO: 172731 - DNA, 25 bp, Mus musculus
acaccaggacttgcttgtgacgaat

SEQ ID NO: 172732 - DNA, 25 bp, Mus musculus
acaccaggacttggactattttgaa

SEQ ID NO: 172733 - DNA, 25 bp, Mus musculus
acaccaggcaccagtacagaaagca

SEQ ID NO: 172734 - DNA, 25 bp, Mus musculus
acaccaggcagagagatcgccttac

SEQ ID NO: 172735 - DNA, 25 bp, Mus musculus
acaccaggcatgcagtaaaggccaa

SEQ ID NO: 172736 - DNA, 25 bp, Mus musculus
acaccaggctgagtgtttatcatgg

SEQ ID NO: 172737 - DNA, 25 bp, Mus musculus
acaccaggctgcaggcctgtgggcc

SEQ ID NO: 172738 - DNA, 25 bp, Mus musculus
acaccagggtagtgggagccctcgt

SEQ ID NO: 172739 - DNA, 25 bp, Mus musculus
acaccagtgataaactcgatgacct

SEQ ID NO: 172740 - DNA, 25 bp, Mus musculus
acaccagtggaaggcaaaggctgcg

SEQ ID NO: 172741 - DNA, 25 bp, Mus musculus
acaccagtttgacaggacacagagc

SEQ ID NO: 172742 - DNA, 25 bp, Mus musculus
acaccatcaagcacccaggaggtac

SEQ ID NO: 172743 - DNA, 25 bp, Mus musculus
acaccatcacagaatacactgtaag

SEQ ID NO: 172744 - DNA, 25 bp, Mus musculus
acaccatcacagtgttccttcctgc

SEQ ID NO: 172745 - DNA, 25 bp, Mus musculus
acaccatcagtgatgatttcctatt

SEQ ID NO: 172746 - DNA, 25 bp, Mus musculus
acaccatcagtgatgctctccttac

SEQ ID NO: 172747 - DNA, 25 bp, Mus musculus
acaccatccaaccgaggagagtcaa

SEQ ID NO: 172748 - DNA, 25 bp, Mus musculus
acaccatccagcacgtgcaggctct

SEQ ID NO: 172749 - DNA, 25 bp, Mus musculus
acaccatccccccgcaggctggcca

SEQ ID NO: 172750 - DNA, 25 bp, Mus musculus
acaccatcgggaaacgtctctggag

SEQ ID NO: 172751 - DNA, 25 bp, Mus musculus
acaccatctttgcacccaggattca

SEQ ID NO: 172752 - DNA, 25 bp, Mus musculus
acaccatctttgcatgaaagcccct

SEQ ID NO: 172753 - DNA, 25 bp, Mus musculus
acaccatctttggattcaatttttt

SEQ ID NO: 172754 - DNA, 25 bp, Mus musculus
acaccatgaaggaagccaaggacat

SEQ ID NO: 172755 - DNA, 25 bp, Mus musculus
acaccatgaggcaaaagcaaaagaa

SEQ ID NO: 172756 - DNA, 25 bp, Mus musculus
acaccatgcataggaagcaccttca

SEQ ID NO: 172757 - DNA, 25 bp, Mus musculus
acaccatgccagtcttcccaccaga

SEQ ID NO: 172758 - DNA, 25 bp, Mus musculus
acaccatgcttctgtggacgcagac

SEQ ID NO: 172759 - DNA, 25 bp, Mus musculus
acaccatggacttggcatctgggtg

SEQ ID NO: 172760 - DNA, 25 bp, Mus musculus
acaccatggacttgggaacacacca

SEQ ID NO: 172761 - DNA, 25 bp, Mus musculus
acaccatggctctggggttggttct

SEQ ID NO: 172762 - DNA, 25 bp, Mus musculus
acaccatggctgatcatcactccgt

SEQ ID NO: 172763 - DNA, 25 bp, Mus musculus
acaccattaaaagggggaggagtgt

SEQ ID NO: 172764 - DNA, 25 bp, Mus musculus
acaccattaccaaggtcccttcaga

SEQ ID NO: 172765 - DNA, 25 bp, Mus musculus
acaccattcagctttctcccagatg

SEQ ID NO: 172766 - DNA, 25 bp, Mus musculus
acaccattgaaatcccagcctgcag

SEQ ID NO: 172767 - DNA, 25 bp, Mus musculus
acaccattgaaggtcctcaactttg

SEQ ID NO: 172768 - DNA, 25 bp, Mus musculus
acaccattggtctgcaggcaccgct

SEQ ID NO: 172769 - DNA, 25 bp, Mus musculus
acaccatttaagttgctttctgatt

SEQ ID NO: 172770 - DNA, 25 bp, Mus musculus
acaccatttcagacctcaagtggaa

SEQ ID NO: 172771 - DNA, 25 bp, Mus musculus
acacccaaaagatttttgaatgtca

SEQ ID NO: 172772 - DNA, 25 bp, Mus musculus
acacccaaaaggtcactccattctc

SEQ ID NO: 172773 - DNA, 25 bp, Mus musculus
acacccaaagagggctgtgacccca

SEQ ID NO: 172774 - DNA, 25 bp, Mus musculus
acacccaaccaatggcttcgagctg

SEQ ID NO: 172775 - DNA, 25 bp, Mus musculus
acacccaaggaggccaaaaaagtgg

SEQ ID NO: 172776 - DNA, 25 bp, Mus musculus
acacccaaggagggtcaaaaggcaa

SEQ ID NO: 172777 - DNA, 25 bp, Mus musculus
acacccaaggatgtgaatgagtgca

SEQ ID NO: 172778 - DNA, 25 bp, Mus musculus
acacccaatgaacttgtttttaatc

SEQ ID NO: 172779 - DNA, 25 bp, Mus musculus
acacccacagagaaatgatctcctg

SEQ ID NO: 172780 - DNA, 25 bp, Mus musculus
acacccacagaggacgacaatgagg

SEQ ID NO: 172781 - DNA, 25 bp, Mus musculus
acacccacagggataaggaaggcgt

SEQ ID NO: 172782 - DNA, 25 bp, Mus musculus
acacccacagggctgtcccccagtg

SEQ ID NO: 172783 - DNA, 25 bp, Mus musculus
acacccacagttccagggtccctgc

SEQ ID NO: 172784 - DNA, 25 bp, Mus musculus
acacccaccaccccagtctacctcg

SEQ ID NO: 172785 - DNA, 25 bp, Mus musculus
acacccacgaaatggcaaatcccaa

SEQ ID NO: 172786 - DNA, 25 bp, Mus musculus
acacccagacaagtaggtatcgcag

SEQ ID NO: 172787 - DNA, 25 bp, Mus musculus
acacccagagaagagtaaactggtg

SEQ ID NO: 172788 - DNA, 25 bp, Mus musculus
acacccagagggaagtgggctaaag

SEQ ID NO: 172789 - DNA, 25 bp, Mus musculus
acacccagatcccagaacactgcgg

SEQ ID NO: 172790 - DNA, 25 bp, Mus musculus
acacccagatcccaggcctctatgg

SEQ ID NO: 172791 - DNA, 25 bp, Mus musculus
acacccagcccaggtccctgtggcc

SEQ ID NO: 172792 - DNA, 25 bp, Mus musculus
acacccagcctggccgcagaagagc

SEQ ID NO: 172793 - DNA, 25 bp, Mus musculus
acacccagcttcagctgtttgttca

SEQ ID NO: 172794 - DNA, 25 bp, Mus musculus
acacccaggagcatgttaatgaaaa

SEQ ID NO: 172795 - DNA, 25 bp, Mus musculus
acacccagggtcctcactgcagtgg

SEQ ID NO: 172796 - DNA, 25 bp, Mus musculus
acacccagggtcctgtttgggcttc

SEQ ID NO: 172797 - DNA, 25 bp, Mus musculus
acacccagtcatcttgatcgactgc

SEQ ID NO: 172798 - DNA, 25 bp, Mus musculus
acacccatcaaggcgacctggcatt

SEQ ID NO: 172799 - DNA, 25 bp, Mus musculus
acacccatcccagaaccaggcagat

SEQ ID NO: 172800 - DNA, 25 bp, Mus musculus
acacccatgagcacttgctggctca

SEQ ID NO: 172801 - DNA, 25 bp, Mus musculus
acacccatggacactccagcacgga

SEQ ID NO: 172802 - DNA, 25 bp, Mus musculus
acacccatggctttgagcacacctt

SEQ ID NO: 172803 - DNA, 25 bp, Mus musculus
acacccattgagaatcctataagga

SEQ ID NO: 172804 - DNA, 25 bp, Mus musculus
acacccattgaggcccaaacacgag

SEQ ID NO: 172805 - DNA, 25 bp, Mus musculus
acaccccaggacaccatcttgctga

SEQ ID NO: 172806 - DNA, 25 bp, Mus musculus
acacccccaagttcaatctcatccc

SEQ ID NO: 172807 - DNA, 25 bp, Mus musculus
acacccccatgtatggctgtaagaa

SEQ ID NO: 172808 - DNA, 25 bp, Mus musculus
acaccccccggtcacccgctgcctc

SEQ ID NO: 172809 - DNA, 25 bp, Mus musculus
acaccccctacctatggagttcagc

SEQ ID NO: 172810 - DNA, 25 bp, Mus musculus
acaccccctcagtggccacagttaa

SEQ ID NO: 172811 - DNA, 25 bp, Mus musculus
acacccctcaccaggaggcaccatg

SEQ ID NO: 172812 - DNA, 25 bp, Mus musculus
acacccctgaaatggcattatccaa

SEQ ID NO: 172813 - DNA, 25 bp, Mus musculus
acacccctgtggatatgactccctg

SEQ ID NO: 172814 - DNA, 25 bp, Mus musculus
acacccctgtggattccactgtatc

SEQ ID NO: 172815 - DNA, 25 bp, Mus musculus
acaccccttcagtgcctgtgctgac

SEQ ID NO: 172816 - DNA, 25 bp, Mus musculus
acacccgcccgccgtgaaagccggc

SEQ ID NO: 172817 - DNA, 25 bp, Mus musculus
acacccggacgatgacagctatatt

SEQ ID NO: 172818 - DNA, 25 bp, Mus musculus
acacccgtcaaatatgaatacccag

SEQ ID NO: 172819 - DNA, 25 bp, Mus musculus
acaccctaaggtaaaagttggcatg

SEQ ID NO: 172820 - DNA, 25 bp, Mus musculus
acaccctaagtatttagaaatgatg

SEQ ID NO: 172821 - DNA, 25 bp, Mus musculus
acaccctacagaggaggaacctgag

SEQ ID NO: 172822 - DNA, 25 bp, Mus musculus
acaccctacaggcaagattgagatc

SEQ ID NO: 172823 - DNA, 25 bp, Mus musculus
acaccctagatgtgctcctggaggt

SEQ ID NO: 172824 - DNA, 25 bp, Mus musculus
acaccctcccccagagtgctgacct

SEQ ID NO: 172825 - DNA, 25 bp, Mus musculus
acaccctctctggactctatagctg

SEQ ID NO: 172826 - DNA, 25 bp, Mus musculus
acaccctctggtcagtcaatcccat

SEQ ID NO: 172827 - DNA, 25 bp, Mus musculus
acaccctgacctaagtcgaatggta

SEQ ID NO: 172828 - DNA, 25 bp, Mus musculus
acaccctgatgcttcctttgcagcc

SEQ ID NO: 172829 - DNA, 25 bp, Mus musculus
acaccctgggaaatgtgtgtctgtc

SEQ ID NO: 172830 - DNA, 25 bp, Mus musculus
acaccctgggcattggggctttcca

SEQ ID NO: 172831 - DNA, 25 bp, Mus musculus
acaccctgggttttagatgcctctg

SEQ ID NO: 172832 - DNA, 25 bp, Mus musculus
acaccctgtgtgtgttttgggaaga

SEQ ID NO: 172833 - DNA, 25 bp, Mus musculus
acacccttttcatgcctagtgacct

SEQ ID NO: 172834 - DNA, 25 bp, Mus musculus
acaccgaaaaccccagatctgtgcc

SEQ ID NO: 172835 - DNA, 25 bp, Mus musculus
acaccgaatgcagaggtgaggcatg

SEQ ID NO: 172836 - DNA, 25 bp, Mus musculus
acaccgacgagtccatttcgggctt

SEQ ID NO: 172837 - DNA, 25 bp, Mus musculus
acaccgacttcctcgctgcacctgg

SEQ ID NO: 172838 - DNA, 25 bp, Mus musculus
acaccgagcggagggcaagaggctg

SEQ ID NO: 172839 - DNA, 25 bp, Mus musculus
acaccgatgaagaacgagccctcgt

SEQ ID NO: 172840 - DNA, 25 bp, Mus musculus
acaccgccaaagcagcttcctgcca

SEQ ID NO: 172841 - DNA, 25 bp, Mus musculus
acaccgccagctctgctgtggctgg

SEQ ID NO: 172842 - DNA, 25 bp, Mus musculus
acaccgccgtcaggatctggaagtt

SEQ ID NO: 172843 - DNA, 25 bp, Mus musculus
acaccgcgcagatctcaagcataca

SEQ ID NO: 172844 - DNA, 25 bp, Mus musculus
acaccgcgcggcgaagtcaatgaaa

SEQ ID NO: 172845 - DNA, 25 bp, Mus musculus
acaccgctcgtgtcttatctagcat

SEQ ID NO: 172846 - DNA, 25 bp, Mus musculus
acaccgctgccaggcacaatggaag

SEQ ID NO: 172847 - DNA, 25 bp, Mus musculus
acaccgctggaagatttatacaaaa

SEQ ID NO: 172848 - DNA, 25 bp, Mus musculus
acaccggacggtgggattgtgctca

SEQ ID NO: 172849 - DNA, 25 bp, Mus musculus
acaccggacgtgggaagctgctgct

SEQ ID NO: 172850 - DNA, 25 bp, Mus musculus
acaccggagtgcaatcaaaaccaat

SEQ ID NO: 172851 - DNA, 25 bp, Mus musculus
acaccggagtggtgacaaatggata

SEQ ID NO: 172852 - DNA, 25 bp, Mus musculus
acaccggattcagtgcaggtttgga

SEQ ID NO: 172853 - DNA, 25 bp, Mus musculus
acaccggattcagtggcattgaatc

SEQ ID NO: 172854 - DNA, 25 bp, Mus musculus
acaccggattcggtgtatcctgctg

SEQ ID NO: 172855 - DNA, 25 bp, Mus musculus
acaccggcaagatagttgaagtatt

SEQ ID NO: 172856 - DNA, 25 bp, Mus musculus
acaccggcagaaaaagttacgtcga

SEQ ID NO: 172857 - DNA, 25 bp, Mus musculus
acaccggcaggtgggtaatgctgtg

SEQ ID NO: 172858 - DNA, 25 bp, Mus musculus
acaccggcagttccagttactatgg

SEQ ID NO: 172859 - DNA, 25 bp, Mus musculus
acaccggccaggggcgcaagaagtt

SEQ ID NO: 172860 - DNA, 25 bp, Mus musculus
acaccggccaggtgctctcaccacc

SEQ ID NO: 172861 - DNA, 25 bp, Mus musculus
acaccgggaaaaagcaagaccacac

SEQ ID NO: 172862 - DNA, 25 bp, Mus musculus
acaccgggtgtggagaagaacgctg

SEQ ID NO: 172863 - DNA, 25 bp, Mus musculus
acaccgtacatcaggtacttcgtga

SEQ ID NO: 172864 - DNA, 25 bp, Mus musculus
acaccgtacgaggcagctgtggccc

SEQ ID NO: 172865 - DNA, 25 bp, Mus musculus
acaccgtatgaaggtggaagatatc

SEQ ID NO: 172866 - DNA, 25 bp, Mus musculus
acaccgtgaaaatcagatgggatca

SEQ ID NO: 172867 - DNA, 25 bp, Mus musculus
acaccgttttcagatagcggccatt

SEQ ID NO: 172868 - DNA, 25 bp, Mus musculus
acaccgttttcaggctttctggctc

SEQ ID NO: 172869 - DNA, 25 bp, Mus musculus
acaccgttttcagttatttgccagg

SEQ ID NO: 172870 - DNA, 25 bp, Mus musculus
acacctaaacacaagatcttctgcc

SEQ ID NO: 172871 - DNA, 25 bp, Mus musculus
acacctaaagagcaatgcaagtggt

SEQ ID NO: 172872 - DNA, 25 bp, Mus musculus
acacctaaagagtctgacacgtact

SEQ ID NO: 172873 - DNA, 25 bp, Mus musculus
acacctaaagccttagggtcagcag

SEQ ID NO: 172874 - DNA, 25 bp, Mus musculus
acacctaaagcggactcctctgata

SEQ ID NO: 172875 - DNA, 25 bp, Mus musculus
acacctaaaggctcccctttgattg

SEQ ID NO: 172876 - DNA, 25 bp, Mus musculus
acacctaacccggctggccaaggtc

SEQ ID NO: 172877 - DNA, 25 bp, Mus musculus
acacctacacaaatgtcccctttgc

SEQ ID NO: 172878 - DNA, 25 bp, Mus musculus
acacctactgaagctcctgcagact

SEQ ID NO: 172879 - DNA, 25 bp, Mus musculus
acacctactgaagctgtggggattg

SEQ ID NO: 172880 - DNA, 25 bp, Mus musculus
acacctagagagttgcttcagatcg

SEQ ID NO: 172881 - DNA, 25 bp, Mus musculus
acacctaggggctacctcacttaca

SEQ ID NO: 172882 - DNA, 25 bp, Mus musculus
acacctagtcagtccccagttgtag

SEQ ID NO: 172883 - DNA, 25 bp, Mus musculus
acacctcaaaggccacgagacccaa

SEQ ID NO: 172884 - DNA, 25 bp, Mus musculus
acacctcaactgatgggaccctgcc

SEQ ID NO: 172885 - DNA, 25 bp, Mus musculus
acacctcaggtaaaccccttgacct

SEQ ID NO: 172886 - DNA, 25 bp, Mus musculus
acacctcagtgtatgccgcttacaa

SEQ ID NO: 172887 - DNA, 25 bp, Mus musculus
acacctcatacagggtggcagtgag

SEQ ID NO: 172888 - DNA, 25 bp, Mus musculus
acacctcatgagctggctgcctgag

SEQ ID NO: 172889 - DNA, 25 bp, Mus musculus
acacctcatgccgagcaactgtggg

SEQ ID NO: 172890 - DNA, 25 bp, Mus musculus
acacctccacaggttccagatgatg

SEQ ID NO: 172891 - DNA, 25 bp, Mus musculus
acacctccatgtatcccaagggtta

SEQ ID NO: 172892 - DNA, 25 bp, Mus musculus
acacctccgactgctctttgtcacc

SEQ ID NO: 172893 - DNA, 25 bp, Mus musculus
acacctccgactgggaggagaagga

SEQ ID NO: 172894 - DNA, 25 bp, Mus musculus
acacctccggttatggtacaaattc

SEQ ID NO: 172895 - DNA, 25 bp, Mus musculus
acacctcgaaggaatggaagaaagc

SEQ ID NO: 172896 - DNA, 25 bp, Mus musculus
acacctcgaaggtacacaactggag

SEQ ID NO: 172897 - DNA, 25 bp, Mus musculus
acacctcgccacggcccagttcaat

SEQ ID NO: 172898 - DNA, 25 bp, Mus musculus
acacctctcacagacagctcagctc

SEQ ID NO: 172899 - DNA, 25 bp, Mus musculus
acacctctcagaaaagttgtatggc

SEQ ID NO: 172900 - DNA, 25 bp, Mus musculus
acacctctcctggagtgtctgtgag

SEQ ID NO: 172901 - DNA, 25 bp, Mus musculus
acacctctcctgggcctctgatacc

SEQ ID NO: 172902 - DNA, 25 bp, Mus musculus
acacctctctctcaggagtgaagat

SEQ ID NO: 172903 - DNA, 25 bp, Mus musculus
acacctctgcagttacggacgagtt

SEQ ID NO: 172904 - DNA, 25 bp, Mus musculus
acacctcttccagacgctgaatcgc

SEQ ID NO: 172905 - DNA, 25 bp, Mus musculus
acacctctttaaggcgtaccttctc

SEQ ID NO: 172906 - DNA, 25 bp, Mus musculus
acacctctttaagtatgcagcagat

SEQ ID NO: 172907 - DNA, 25 bp, Mus musculus
acacctctttgcagatcttgatatg

SEQ ID NO: 172908 - DNA, 25 bp, Mus musculus
acacctgaaagcagaacctggtcca

SEQ ID NO: 172909 - DNA, 25 bp, Mus musculus
acacctgaacctgatatctgtcatg

SEQ ID NO: 172910 - DNA, 25 bp, Mus musculus
acacctgaaccttggcatgaatagg

SEQ ID NO: 172911 - DNA, 25 bp, Mus musculus
acacctgaaccttgggtggcttgtc

SEQ ID NO: 172912 - DNA, 25 bp, Mus musculus
acacctgacatctggcctacacaga

SEQ ID NO: 172913 - DNA, 25 bp, Mus musculus
acacctgcaaggaatattgaagaga

SEQ ID NO: 172914 - DNA, 25 bp, Mus musculus
acacctgcagatgcaagttgttctg

SEQ ID NO: 172915 - DNA, 25 bp, Mus musculus
acacctgcagcccggacaagtgggc

SEQ ID NO: 172916 - DNA, 25 bp, Mus musculus
acacctgcatgctgaccctgttggc

SEQ ID NO: 172917 - DNA, 25 bp, Mus musculus
acacctgcatgctggctcttcatag

SEQ ID NO: 172918 - DNA, 25 bp, Mus musculus
acacctgccgggcagcgagtcatcc

SEQ ID NO: 172919 - DNA, 25 bp, Mus musculus
acacctgccggtcagggatccccca

SEQ ID NO: 172920 - DNA, 25 bp, Mus musculus
acacctgccggtccaaccgtgactg

SEQ ID NO: 172921 - DNA, 25 bp, Mus musculus
acacctgctctatgtgctgatggag

SEQ ID NO: 172922 - DNA, 25 bp, Mus musculus
acacctgcttggagtacaaggttct

SEQ ID NO: 172923 - DNA, 25 bp, Mus musculus
acacctggaagctgaactcccacct

SEQ ID NO: 172924 - DNA, 25 bp, Mus musculus
acacctggaaggcagccagagtaac

SEQ ID NO: 172925 - DNA, 25 bp, Mus musculus
acacctggagagtgagaagatgctg

SEQ ID NO: 172926 - DNA, 25 bp, Mus musculus
acacctggatggatgctgcaagcag

SEQ ID NO: 172927 - DNA, 25 bp, Mus musculus
acacctggatggggttcatgttgtt

SEQ ID NO: 172928 - DNA, 25 bp, Mus musculus
acacctggcagccagatgaggatga

SEQ ID NO: 172929 - DNA, 25 bp, Mus musculus
acacctggcataaggccactcagaa

SEQ ID NO: 172930 - DNA, 25 bp, Mus musculus
acacctggccaaagggtcattatcg

SEQ ID NO: 172931 - DNA, 25 bp, Mus musculus
acacctggccaaaggtcagcctcca

SEQ ID NO: 172932 - DNA, 25 bp, Mus musculus
acacctggccaaaggtcggacatca

SEQ ID NO: 172933 - DNA, 25 bp, Mus musculus
acacctggctattgacaagaaggct

SEQ ID NO: 172934 - DNA, 25 bp, Mus musculus
acacctggctattgactccacggct

SEQ ID NO: 172935 - DNA, 25 bp, Mus musculus
acacctgggcacagcattgatctgg

SEQ ID NO: 172936 - DNA, 25 bp, Mus musculus
acacctgtcaggagaacagccagtc

SEQ ID NO: 172937 - DNA, 25 bp, Mus musculus
acacctgtcaggagatcttcctgtg

SEQ ID NO: 172938 - DNA, 25 bp, Mus musculus
acacctgtcgcccatattttaatat

SEQ ID NO: 172939 - DNA, 25 bp, Mus musculus
acacctgtcgcccctgagtgcaata

SEQ ID NO: 172940 - DNA, 25 bp, Mus musculus
acacctgtgcctcagggtgacagaa

SEQ ID NO: 172941 - DNA, 25 bp, Mus musculus
acacctgtgcctcagggttgcagta

SEQ ID NO: 172942 - DNA, 25 bp, Mus musculus
acacctgtgcctcaggttgccctct

SEQ ID NO: 172943 - DNA, 25 bp, Mus musculus
acacctgttgcaggcatgatgggtg

SEQ ID NO: 172944 - DNA, 25 bp, Mus musculus
acaccttagccagtccaaactgaag

SEQ ID NO: 172945 - DNA, 25 bp, Mus musculus
acaccttatcaagcactggagggca

SEQ ID NO: 172946 - DNA, 25 bp, Mus musculus
acaccttatcaaggctcagaggcac

SEQ ID NO: 172947 - DNA, 25 bp, Mus musculus
acaccttcagcagagcaggaagatc

SEQ ID NO: 172948 - DNA, 25 bp, Mus musculus
acaccttcaggtggaagggagagaa

SEQ ID NO: 172949 - DNA, 25 bp, Mus musculus
acaccttccgccagtttcgtgatcc

SEQ ID NO: 172950 - DNA, 25 bp, Mus musculus
acaccttctgcagcaaatctcccgg

SEQ ID NO: 172951 - DNA, 25 bp, Mus musculus
acaccttcttttgcttctgcagtga

SEQ ID NO: 172952 - DNA, 25 bp, Mus musculus
acaccttcttttggcgtgcccacac

SEQ ID NO: 172953 - DNA, 25 bp, Mus musculus
acaccttgagagggttttatggaca

SEQ ID NO: 172954 - DNA, 25 bp, Mus musculus
acaccttgcagaacattccaggatc

SEQ ID NO: 172955 - DNA, 25 bp, Mus musculus
acaccttgcatcccacgagtcctac

SEQ ID NO: 172956 - DNA, 25 bp, Mus musculus
acaccttgcccgaaacaaccacaac

SEQ ID NO: 172957 - DNA, 25 bp, Mus musculus
acaccttgtgtcaagggaaaagatg

SEQ ID NO: 172958 - DNA, 25 bp, Mus musculus
acacctttccaaaggagttgaagca

SEQ ID NO: 172959 - DNA, 25 bp, Mus musculus
acaccttttttcaagctatcagaga

SEQ ID NO: 172960 - DNA, 25 bp, Mus musculus
acaccttttttcaaggatgttaatt

SEQ ID NO: 172961 - DNA, 25 bp, Mus musculus
acacgaacgcagggcactgcagaag

SEQ ID NO: 172962 - DNA, 25 bp, Mus musculus
acacgaagaggtatatgtggttgct

SEQ ID NO: 172963 - DNA, 25 bp, Mus musculus
acacgaagggagatgatgatgagga

SEQ ID NO: 172964 - DNA, 25 bp, Mus musculus
acacgacaaggtgtccaggcctcag

SEQ ID NO: 172965 - DNA, 25 bp, Mus musculus
acacgaccaggtctcccagtggact

SEQ ID NO: 172966 - DNA, 25 bp, Mus musculus
acacgaccagtgcagcccctggaag

SEQ ID NO: 172967 - DNA, 25 bp, Mus musculus
acacgacccaaggaggcaagtgttt

SEQ ID NO: 172968 - DNA, 25 bp, Mus musculus
acacgacccaagtggcagcaatgtt

SEQ ID NO: 172969 - DNA, 25 bp, Mus musculus
acacgaccttggacgtaccatgcgg

SEQ ID NO: 172970 - DNA, 25 bp, Mus musculus
acacgactgtgaagggaagacatgt

SEQ ID NO: 172971 - DNA, 25 bp, Mus musculus
acacgactgtgaagttagtagaaaa

SEQ ID NO: 172972 - DNA, 25 bp, Mus musculus
acacgagatgatggattatctatta

SEQ ID NO: 172973 - DNA, 25 bp, Mus musculus
acacgagctggagtgagcaaaccaa

SEQ ID NO: 172974 - DNA, 25 bp, Mus musculus
acacgaggtatgacgctgtggtacc

SEQ ID NO: 172975 - DNA, 25 bp, Mus musculus
acacgagttgggccattccagcttc

SEQ ID NO: 172976 - DNA, 25 bp, Mus musculus
acacgatggaagcagaaaccagtga

SEQ ID NO: 172977 - DNA, 25 bp, Mus musculus
acacgatggaagctcagctgccaac

SEQ ID NO: 172978 - DNA, 25 bp, Mus musculus
acacgatgtgctggatttccactta

SEQ ID NO: 172979 - DNA, 25 bp, Mus musculus
acacgattcacgaggtcctgtaata

SEQ ID NO: 172980 - DNA, 25 bp, Mus musculus
acacgcaccagtggtatgtgtgcaa

SEQ ID NO: 172981 - DNA, 25 bp, Mus musculus
acacgcaccatacaggatactggga

SEQ ID NO: 172982 - DNA, 25 bp, Mus musculus
acacgcagacagtggacatttggtc

SEQ ID NO: 172983 - DNA, 25 bp, Mus musculus
acacgcagatgaggattgagctccg

SEQ ID NO: 172984 - DNA, 25 bp, Mus musculus
acacgcagtccgaggtcgccatgga

SEQ ID NO: 172985 - DNA, 25 bp, Mus musculus
acacgcatcgagggggctacccgac

SEQ ID NO: 172986 - DNA, 25 bp, Mus musculus
acacgcatgccaggttggcctgctt

SEQ ID NO: 172987 - DNA, 25 bp, Mus musculus
acacgccagataacacaactggagg

SEQ ID NO: 172988 - DNA, 25 bp, Mus musculus
acacgccagcctctgaaactagaca

SEQ ID NO: 172989 - DNA, 25 bp, Mus musculus
acacgccaggtcgtggggttgtgct

SEQ ID NO: 172990 - DNA, 25 bp, Mus musculus
acacgccagtggctgtttacctgat

SEQ ID NO: 172991 - DNA, 25 bp, Mus musculus
acacgccagtgggttcttctgtgac

SEQ ID NO: 172992 - DNA, 25 bp, Mus musculus
acacgcccaagaaaggtggcaggag

SEQ ID NO: 172993 - DNA, 25 bp, Mus musculus
acacgcccacccaggaaatcctgaa

SEQ ID NO: 172994 - DNA, 25 bp, Mus musculus
acacgcccacccaggaatccatcag

SEQ ID NO: 172995 - DNA, 25 bp, Mus musculus
acacgccccacaaagaattccagag

SEQ ID NO: 172996 - DNA, 25 bp, Mus musculus
acacgccctgaaccgcttgggtgtc

SEQ ID NO: 172997 - DNA, 25 bp, Mus musculus
acacgccgcggggagaccatgagaa

SEQ ID NO: 172998 - DNA, 25 bp, Mus musculus
acacgccgcggggatccacctgatg

SEQ ID NO: 172999 - DNA, 25 bp, Mus musculus
acacgccggccgccgtccccagtga

SEQ ID NO: 173000 - DNA, 25 bp, Mus musculus
acacgcctgaagaggacatggatga

SEQ ID NO: 173001 - DNA, 25 bp, Mus musculus
acacgccttggccggaatgtgtatc

SEQ ID NO: 173002 - DNA, 25 bp, Mus musculus
acacgccttggggttctctgtgtag

SEQ ID NO: 173003 - DNA, 25 bp, Mus musculus
acacgcgcaagccctgaggtgcgca

SEQ ID NO: 173004 - DNA, 25 bp, Mus musculus
acacgcgccctcagatgtcacctgt

SEQ ID NO: 173005 - DNA, 25 bp, Mus musculus
acacgcgccctcagtgggaagatgc

SEQ ID NO: 173006 - DNA, 25 bp, Mus musculus
acacgcggagcctctgacctccagg

SEQ ID NO: 173007 - DNA, 25 bp, Mus musculus
acacgcggcataggccttcagaagt

SEQ ID NO: 173008 - DNA, 25 bp, Mus musculus
acacgctacttagccccaaccatac

SEQ ID NO: 173009 - DNA, 25 bp, Mus musculus
acacgctacttaggtgatgcaagaa

SEQ ID NO: 173010 - DNA, 25 bp, Mus musculus
acacgctatggcaatctttaaattt

SEQ ID NO: 173011 - DNA, 25 bp, Mus musculus
acacgctcaccagctgatggttcct

SEQ ID NO: 173012 - DNA, 25 bp, Mus musculus
acacgctccccaaggaggtattccc

SEQ ID NO: 173013 - DNA, 25 bp, Mus musculus
acacgctgagaaatacgaagaaaaa

SEQ ID NO: 173014 - DNA, 25 bp, Mus musculus
acacgctgagaatatatcagagcct

SEQ ID NO: 173015 - DNA, 25 bp, Mus musculus
acacgctgcccaagcgccggagtac

SEQ ID NO: 173016 - DNA, 25 bp, Mus musculus
acacgctgtgctgaatgagcaacat

SEQ ID NO: 173017 - DNA, 25 bp, Mus musculus
acacgcttcaaatggatagtcacat

SEQ ID NO: 173018 - DNA, 25 bp, Mus musculus
acacgcttcttgccagtttattaac

SEQ ID NO: 173019 - DNA, 25 bp, Mus musculus
acacggaaaaaggttttgacgcatc

SEQ ID NO: 173020 - DNA, 25 bp, Mus musculus
acacggaagaagaacatcagaaagc

SEQ ID NO: 173021 - DNA, 25 bp, Mus musculus
acacggaagtgaatccagcagcttt

SEQ ID NO: 173022 - DNA, 25 bp, Mus musculus
acacggaagtgatcagctctgaatg

SEQ ID NO: 173023 - DNA, 25 bp, Mus musculus
acacggacaccgggattatgtccct

SEQ ID NO: 173024 - DNA, 25 bp, Mus musculus
acacggacagcgcgctttggatccg

SEQ ID NO: 173025 - DNA, 25 bp, Mus musculus
acacggacagcggcacagccgagcc

SEQ ID NO: 173026 - DNA, 25 bp, Mus musculus
acacggacattcagggcttcctgaa

SEQ ID NO: 173027 - DNA, 25 bp, Mus musculus
acacggactggaggcgccagcccct

SEQ ID NO: 173028 - DNA, 25 bp, Mus musculus
acacggagacgaccatgccgtccat

SEQ ID NO: 173029 - DNA, 25 bp, Mus musculus
acacggagacttcagaatcaagatg

SEQ ID NO: 173030 - DNA, 25 bp, Mus musculus
acacggagagaagattaaggacaga

SEQ ID NO: 173031 - DNA, 25 bp, Mus musculus
acacggagcagcccaccttgggaca

SEQ ID NO: 173032 - DNA, 25 bp, Mus musculus
acacggagcaggaaggcaaatacta

SEQ ID NO: 173033 - DNA, 25 bp, Mus musculus
acacggagcatgagccagatatact

SEQ ID NO: 173034 - DNA, 25 bp, Mus musculus
acacggagcggtactgctcacgaat

SEQ ID NO: 173035 - DNA, 25 bp, Mus musculus
acacggatagcagacactacaagaa

SEQ ID NO: 173036 - DNA, 25 bp, Mus musculus
acacggatatggaagagggatttca

SEQ ID NO: 173037 - DNA, 25 bp, Mus musculus
acacggcaagtactgaaccttccag

SEQ ID NO: 173038 - DNA, 25 bp, Mus musculus
acacggcaccaaactactaaaggtg

SEQ ID NO: 173039 - DNA, 25 bp, Mus musculus
acacggcaccaaactccatagattg

SEQ ID NO: 173040 - DNA, 25 bp, Mus musculus
acacggcaccaaactgcttgattta

SEQ ID NO: 173041 - DNA, 25 bp, Mus musculus
acacggcatagatttcaccgagatg

SEQ ID NO: 173042 - DNA, 25 bp, Mus musculus
acacggcataggaccactgcaaagc

SEQ ID NO: 173043 - DNA, 25 bp, Mus musculus
acacggcataggagctggtggccac

SEQ ID NO: 173044 - DNA, 25 bp, Mus musculus
acacggcccttctggcgacccccag

SEQ ID NO: 173045 - DNA, 25 bp, Mus musculus
acacggctaagcaggtgaagtccac

SEQ ID NO: 173046 - DNA, 25 bp, Mus musculus
acacggctcaagcaaggaccatggt

SEQ ID NO: 173047 - DNA, 25 bp, Mus musculus
acacggctgggaagaccctgtttgg

SEQ ID NO: 173048 - DNA, 25 bp, Mus musculus
acacggcttcagaaaagaagttgtg

SEQ ID NO: 173049 - DNA, 25 bp, Mus musculus
acacggcttcagaaggaagaggcaa

SEQ ID NO: 173050 - DNA, 25 bp, Mus musculus
acacggcttcagtctttgcagttta

SEQ ID NO: 173051 - DNA, 25 bp, Mus musculus
acacgggaccacagcctccaggatc

SEQ ID NO: 173052 - DNA, 25 bp, Mus musculus
acacgggctatgagccaacttccat

SEQ ID NO: 173053 - DNA, 25 bp, Mus musculus
acacgggctgctggaaagggataaa

SEQ ID NO: 173054 - DNA, 25 bp, Mus musculus
acacggggctgcaggtcacagcgga

SEQ ID NO: 173055 - DNA, 25 bp, Mus musculus
acacgggggagaggccatttgtttg

SEQ ID NO: 173056 - DNA, 25 bp, Mus musculus
acacgggtgatgctggacaagtggg

SEQ ID NO: 173057 - DNA, 25 bp, Mus musculus
acacggtagatctagccttttctga

SEQ ID NO: 173058 - DNA, 25 bp, Mus musculus
acacggtagatctagttacaacctg

SEQ ID NO: 173059 - DNA, 25 bp, Mus musculus
acacggtccagcagcaaccctatca

SEQ ID NO: 173060 - DNA, 25 bp, Mus musculus
acacggtccagctgcccaccattct

SEQ ID NO: 173061 - DNA, 25 bp, Mus musculus
acacggtccaggatgagagtcattc

SEQ ID NO: 173062 - DNA, 25 bp, Mus musculus
acacggttggataaacctgactcta

SEQ ID NO: 173063 - DNA, 25 bp, Mus musculus
acacgtcaaagaagtcttctaaaca

SEQ ID NO: 173064 - DNA, 25 bp, Mus musculus
acacgtcaaagacctaactaccgta

SEQ ID NO: 173065 - DNA, 25 bp, Mus musculus
acacgtcacaatgatttctatggga

SEQ ID NO: 173066 - DNA, 25 bp, Mus musculus
acacgtctgcccgtgtgctgatgtc

SEQ ID NO: 173067 - DNA, 25 bp, Mus musculus
acacgtgacaaataaccctggcact

SEQ ID NO: 173068 - DNA, 25 bp, Mus musculus
acacgtgaccagtatggcaagaaga

SEQ ID NO: 173069 - DNA, 25 bp, Mus musculus
acacgtgcaggtactgtggcaagat

SEQ ID NO: 173070 - DNA, 25 bp, Mus musculus
acacgtgccaaaatatctactagaa

SEQ ID NO: 173071 - DNA, 25 bp, Mus musculus
acacgtgctcagagcagagcctcta

SEQ ID NO: 173072 - DNA, 25 bp, Mus musculus
acacgtgctcagccctttgttcagg

SEQ ID NO: 173073 - DNA, 25 bp, Mus musculus
acacgtggaagagccggctttcctc

SEQ ID NO: 173074 - DNA, 25 bp, Mus musculus
acacgtgtgcagataccccggtacc

SEQ ID NO: 173075 - DNA, 25 bp, Mus musculus
acacgtgtgcagcctttgcttttct

SEQ ID NO: 173076 - DNA, 25 bp, Mus musculus
acacgtgtgcagttggcagatattc

SEQ ID NO: 173077 - DNA, 25 bp, Mus musculus
acacgtttgccgctcctgagaaatg

SEQ ID NO: 173078 - DNA, 25 bp, Mus musculus
acacgttttttgccattggtgtcag

SEQ ID NO: 173079 - DNA, 25 bp, Mus musculus
acactaaaataaatatccatgggaa

SEQ ID NO: 173080 - DNA, 25 bp, Mus musculus
acactaaaataaatcatacctgcgg

SEQ ID NO: 173081 - DNA, 25 bp, Mus musculus
acactaaagcagaggtgaaagacaa

SEQ ID NO: 173082 - DNA, 25 bp, Mus musculus
acactaaagtagagactcagggtga

SEQ ID NO: 173083 - DNA, 25 bp, Mus musculus
acactaaccctgagctcttggctag

SEQ ID NO: 173084 - DNA, 25 bp, Mus musculus
acactaagaacaagaaaacagataa

SEQ ID NO: 173085 - DNA, 25 bp, Mus musculus
acactaagcaaggtaacccagcatg

SEQ ID NO: 173086 - DNA, 25 bp, Mus musculus
acactaaggaaacaggtctggaacc

SEQ ID NO: 173087 - DNA, 25 bp, Mus musculus
acactaatcttgtaaccaccaaaga

SEQ ID NO: 173088 - DNA, 25 bp, Mus musculus
acactacaaatcccctagtgagctg

SEQ ID NO: 173089 - DNA, 25 bp, Mus musculus
acactacatacgatctcctccacaa

SEQ ID NO: 173090 - DNA, 25 bp, Mus musculus
acactacatgaagtattacaatgac

SEQ ID NO: 173091 - DNA, 25 bp, Mus musculus
acactaccagctggcctataggttg

SEQ ID NO: 173092 - DNA, 25 bp, Mus musculus
acactaccagctgggtaacgacatt

SEQ ID NO: 173093 - DNA, 25 bp, Mus musculus
acactactgaccacgatgatgccag

SEQ ID NO: 173094 - DNA, 25 bp, Mus musculus
acactactgactccatgcctgcaac

SEQ ID NO: 173095 - DNA, 25 bp, Mus musculus
acactactgatttcagctctgatct

SEQ ID NO: 173096 - DNA, 25 bp, Mus musculus
acactagagaagagttggttgatcg

SEQ ID NO: 173097 - DNA, 25 bp, Mus musculus
acactagctagaggcaactcgccat

SEQ ID NO: 173098 - DNA, 25 bp, Mus musculus
acactagctagagggtacaaaggat

SEQ ID NO: 173099 - DNA, 25 bp, Mus musculus
acactaggattgcgattttctacct

SEQ ID NO: 173100 - DNA, 25 bp, Mus musculus
acactagtgccagcttcggtggtgt

SEQ ID NO: 173101 - DNA, 25 bp, Mus musculus
acactagtgcctgataagccaaaga

SEQ ID NO: 173102 - DNA, 25 bp, Mus musculus
acactataaggtttgctatgcgcgt

SEQ ID NO: 173103 - DNA, 25 bp, Mus musculus
acactatacagtggtggaagatacc

SEQ ID NO: 173104 - DNA, 25 bp, Mus musculus
acactatagtgaagcccctggtcat

SEQ ID NO: 173105 - DNA, 25 bp, Mus musculus
acactatagtgaaggtgtttcctac

SEQ ID NO: 173106 - DNA, 25 bp, Mus musculus
acactatcacagacacgtgcgaccg

SEQ ID NO: 173107 - DNA, 25 bp, Mus musculus
acactatcacagacgatctagaagc

SEQ ID NO: 173108 - DNA, 25 bp, Mus musculus
acactatccaggtcaggctgctaca

SEQ ID NO: 173109 - DNA, 25 bp, Mus musculus
acactatccagtgggatctgccgcg

SEQ ID NO: 173110 - DNA, 25 bp, Mus musculus
acactattattcccggtgtggaata

SEQ ID NO: 173111 - DNA, 25 bp, Mus musculus
acactcaaagattgacatggtacat

SEQ ID NO: 173112 - DNA, 25 bp, Mus musculus
acactcaaaggagttgcaagcacat

SEQ ID NO: 173113 - DNA, 25 bp, Mus musculus
acactcacagaaaggtgtccaccca

SEQ ID NO: 173114 - DNA, 25 bp, Mus musculus
acactcacagaaggtggcttaaaaa

SEQ ID NO: 173115 - DNA, 25 bp, Mus musculus
acactcacagaaggtgtaacacggc

SEQ ID NO: 173116 - DNA, 25 bp, Mus musculus
acactcaccaggcacttgtggaatg

SEQ ID NO: 173117 - DNA, 25 bp, Mus musculus
acactcaccctcaggctctgagtca

SEQ ID NO: 173118 - DNA, 25 bp, Mus musculus
acactcacgataaaagctggcaggc

SEQ ID NO: 173119 - DNA, 25 bp, Mus musculus
acactcactgtatgcttccactgac

SEQ ID NO: 173120 - DNA, 25 bp, Mus musculus
acactcactgtttcttctagtatgc

SEQ ID NO: 173121 - DNA, 25 bp, Mus musculus
acactcagagacaggcctcaggata

SEQ ID NO: 173122 - DNA, 25 bp, Mus musculus
acactcagagactgtctctggaggt

SEQ ID NO: 173123 - DNA, 25 bp, Mus musculus
acactcagaggatttccctagagat

SEQ ID NO: 173124 - DNA, 25 bp, Mus musculus
acactcagcagcgaatgagcatgct

SEQ ID NO: 173125 - DNA, 25 bp, Mus musculus
acactcagcccacagaaaccactca

SEQ ID NO: 173126 - DNA, 25 bp, Mus musculus
acactcagcccacagctccccatag

SEQ ID NO: 173127 - DNA, 25 bp, Mus musculus
acactcatctaagggagatgaagga

SEQ ID NO: 173128 - DNA, 25 bp, Mus musculus
acactcattcccagacccagtgatt

SEQ ID NO: 173129 - DNA, 25 bp, Mus musculus
acactccacacgagaggctcacaat

SEQ ID NO: 173130 - DNA, 25 bp, Mus musculus
acactccacacgaggagccagatgt

SEQ ID NO: 173131 - DNA, 25 bp, Mus musculus
acactccacacttggatgctcaaca

SEQ ID NO: 173132 - DNA, 25 bp, Mus musculus
acactccacagaagtgtacagtcca

SEQ ID NO: 173133 - DNA, 25 bp, Mus musculus
acactccagaggtaaaagcgccatt

SEQ ID NO: 173134 - DNA, 25 bp, Mus musculus
acactccagaggtacaagcgccatt

SEQ ID NO: 173135 - DNA, 25 bp, Mus musculus
acactccagcccagaattaaccctg

SEQ ID NO: 173136 - DNA, 25 bp, Mus musculus
acactccagcccagatggaggatga

SEQ ID NO: 173137 - DNA, 25 bp, Mus musculus
acactccagcccagcagacaggagg

SEQ ID NO: 173138 - DNA, 25 bp, Mus musculus
acactccagcccagctggagatgga

SEQ ID NO: 173139 - DNA, 25 bp, Mus musculus
acactccagcccaggccctccttgt

SEQ ID NO: 173140 - DNA, 25 bp, Mus musculus
acactccaggagctgcagccccagg

SEQ ID NO: 173141 - DNA, 25 bp, Mus musculus
acactccagggcaagccccaggact

SEQ ID NO: 173142 - DNA, 25 bp, Mus musculus
acactccagtccagcaatcccagga

SEQ ID NO: 173143 - DNA, 25 bp, Mus musculus
acactcccacagaaggacccagaaa

SEQ ID NO: 173144 - DNA, 25 bp, Mus musculus
acactcccatgcccgtggctgttcg

SEQ ID NO: 173145 - DNA, 25 bp, Mus musculus
acactccgacagctttccaccacca

SEQ ID NO: 173146 - DNA, 25 bp, Mus musculus
acactcctctacacttagcctgtga

SEQ ID NO: 173147 - DNA, 25 bp, Mus musculus
acactcctgggagtccttttgtcct

SEQ ID NO: 173148 - DNA, 25 bp, Mus musculus
acactcctgtacttgcgaaagcagt

SEQ ID NO: 173149 - DNA, 25 bp, Mus musculus
acactcctgtacttggttcgtcaat

SEQ ID NO: 173150 - DNA, 25 bp, Mus musculus
acactccttaacactgtcataggcc

SEQ ID NO: 173151 - DNA, 25 bp, Mus musculus
acactccttttagaagcaattctac

SEQ ID NO: 173152 - DNA, 25 bp, Mus musculus
acactcgaaacattctattcactgg

SEQ ID NO: 173153 - DNA, 25 bp, Mus musculus
acactcgaccacaggaagaagagct

SEQ ID NO: 173154 - DNA, 25 bp, Mus musculus
acactcgcctgagactcgtcctccc

SEQ ID NO: 173155 - DNA, 25 bp, Mus musculus
acactcgctggagctggtggagaag

SEQ ID NO: 173156 - DNA, 25 bp, Mus musculus
acactcgttcaaacaaagtctggtt

SEQ ID NO: 173157 - DNA, 25 bp, Mus musculus
acactctactaagtgccctgcattg

SEQ ID NO: 173158 - DNA, 25 bp, Mus musculus
acactctactggatgactggaaacc

SEQ ID NO: 173159 - DNA, 25 bp, Mus musculus
acactctcatccctagcagaacatc

SEQ ID NO: 173160 - DNA, 25 bp, Mus musculus
acactctccaactggctttaaggga

SEQ ID NO: 173161 - DNA, 25 bp, Mus musculus
acactctcctctcagaggctctgga

SEQ ID NO: 173162 - DNA, 25 bp, Mus musculus
acactctctcaaattgcctatcaga

SEQ ID NO: 173163 - DNA, 25 bp, Mus musculus
acactctgacagattcacctgcaag

SEQ ID NO: 173164 - DNA, 25 bp, Mus musculus
acactctgacagtgagggtgcgggg

SEQ ID NO: 173165 - DNA, 25 bp, Mus musculus
acactcttacccagaccaacagcaa

SEQ ID NO: 173166 - DNA, 25 bp, Mus musculus
acactcttacccagcatatatttgg

SEQ ID NO: 173167 - DNA, 25 bp, Mus musculus
acactcttacccaggtttttgtgcg

SEQ ID NO: 173168 - DNA, 25 bp, Mus musculus
acactcttcaaaggctttggagaca

SEQ ID NO: 173169 - DNA, 25 bp, Mus musculus
acactcttcaaggtaaagtggatct

SEQ ID NO: 173170 - DNA, 25 bp, Mus musculus
acactcttcagtgggcccgggatga

SEQ ID NO: 173171 - DNA, 25 bp, Mus musculus
acactcttccagacccatgaaaata

SEQ ID NO: 173172 - DNA, 25 bp, Mus musculus
acactgaaaaatgggatgggttgga

SEQ ID NO: 173173 - DNA, 25 bp, Mus musculus
acactgaaaagcgccatggctactt

SEQ ID NO: 173174 - DNA, 25 bp, Mus musculus
acactgaaaggggcatctgatgatg

SEQ ID NO: 173175 - DNA, 25 bp, Mus musculus
acactgaacaatggtttgctatctt

SEQ ID NO: 173176 - DNA, 25 bp, Mus musculus
acactgaaggtcgtgccagaaggaa

SEQ ID NO: 173177 - DNA, 25 bp, Mus musculus
acactgaagttatgagagagattca

SEQ ID NO: 173178 - DNA, 25 bp, Mus musculus
acactgaagttatgcagggatggca

SEQ ID NO: 173179 - DNA, 25 bp, Mus musculus
acactgacacaatatggagtctgga

SEQ ID NO: 173180 - DNA, 25 bp, Mus musculus
acactgacagggatcaagtttgtgg

SEQ ID NO: 173181 - DNA, 25 bp, Mus musculus
acactgaccaaagatgagaaagtat

SEQ ID NO: 173182 - DNA, 25 bp, Mus musculus
acactgaccctcagatagtgtttct

SEQ ID NO: 173183 - DNA, 25 bp, Mus musculus
acactgacctggtgttgctgcacct

SEQ ID NO: 173184 - DNA, 25 bp, Mus musculus
acactgacctggtgtttacagtgtt

SEQ ID NO: 173185 - DNA, 25 bp, Mus musculus
acactgactttgccttcaatctcac

SEQ ID NO: 173186 - DNA, 25 bp, Mus musculus
acactgagaagaaggtgtttctcct

SEQ ID NO: 173187 - DNA, 25 bp, Mus musculus
acactgagacccaagggcctgattt

SEQ ID NO: 173188 - DNA, 25 bp, Mus musculus
acactgagagcagacttctttctat

SEQ ID NO: 173189 - DNA, 25 bp, Mus musculus
acactgagaggagacttctttctat

SEQ ID NO: 173190 - DNA, 25 bp, Mus musculus
acactgagcaagagtccaactttat

SEQ ID NO: 173191 - DNA, 25 bp, Mus musculus
acactgagcaagtgtccaactttat

SEQ ID NO: 173192 - DNA, 25 bp, Mus musculus
acactgagggcagggcctacgtcgg

SEQ ID NO: 173193 - DNA, 25 bp, Mus musculus
acactgaggtgccagacgacctgga

SEQ ID NO: 173194 - DNA, 25 bp, Mus musculus
acactgaggtgccaggctggaccca

SEQ ID NO: 173195 - DNA, 25 bp, Mus musculus
acactgagtctctgggcacggaggt

SEQ ID NO: 173196 - DNA, 25 bp, Mus musculus
acactgatcaagaaaatcttgttgg

SEQ ID NO: 173197 - DNA, 25 bp, Mus musculus
acactgatgcaaagttccaggtgtt

SEQ ID NO: 173198 - DNA, 25 bp, Mus musculus
acactgcaaaaacctggagccagaa

SEQ ID NO: 173199 - DNA, 25 bp, Mus musculus
acactgcaacaacgggatcccggag

SEQ ID NO: 173200 - DNA, 25 bp, Mus musculus
acactgcactgggtgggctgaaggc

SEQ ID NO: 173201 - DNA, 25 bp, Mus musculus
acactgcagcgagctcgcgagtaca

SEQ ID NO: 173202 - DNA, 25 bp, Mus musculus
acactgcaggacaggaggattacaa

SEQ ID NO: 173203 - DNA, 25 bp, Mus musculus
acactgcagtggagttgtttaagaa

SEQ ID NO: 173204 - DNA, 25 bp, Mus musculus
acactgccaaccagaactgcgtaga

SEQ ID NO: 173205 - DNA, 25 bp, Mus musculus
acactgccaggtgtggcgctaatgt

SEQ ID NO: 173206 - DNA, 25 bp, Mus musculus
acactgccagtagggggtacagtcc

SEQ ID NO: 173207 - DNA, 25 bp, Mus musculus
acactgcccaagtgggctcacccga

SEQ ID NO: 173208 - DNA, 25 bp, Mus musculus
acactgccccaggaaagggtcacga

SEQ ID NO: 173209 - DNA, 25 bp, Mus musculus
acactgccttacccatatctgtcag

SEQ ID NO: 173210 - DNA, 25 bp, Mus musculus
acactgcgctaccctgtgaagccag

SEQ ID NO: 173211 - DNA, 25 bp, Mus musculus
acactgcgggaccaggatgggctca

SEQ ID NO: 173212 - DNA, 25 bp, Mus musculus
acactgcgtgggcccagtgggcagc

SEQ ID NO: 173213 - DNA, 25 bp, Mus musculus
acactgctccgacaatatgcaccta

SEQ ID NO: 173214 - DNA, 25 bp, Mus musculus
acactgctccgacaatgtagattta

SEQ ID NO: 173215 - DNA, 25 bp, Mus musculus
acactgctctaccagtccttcgtga

SEQ ID NO: 173216 - DNA, 25 bp, Mus musculus
acactgctctcaaaggtcttcctgc

SEQ ID NO: 173217 - DNA, 25 bp, Mus musculus
acactgctgctctggcaaggccaga

SEQ ID NO: 173218 - DNA, 25 bp, Mus musculus
acactgctgctctgggtaaccaagg

SEQ ID NO: 173219 - DNA, 25 bp, Mus musculus
acactgctggtcagctctgcaatct

SEQ ID NO: 173220 - DNA, 25 bp, Mus musculus
acactgctggtcaggcagagttcac

SEQ ID NO: 173221 - DNA, 25 bp, Mus musculus
acactgcttgggaaatcctcaagga

SEQ ID NO: 173222 - DNA, 25 bp, Mus musculus
acactgcttggttcgttccaccagt

SEQ ID NO: 173223 - DNA, 25 bp, Mus musculus
acactgcttggttggtgttaaggga

SEQ ID NO: 173224 - DNA, 25 bp, Mus musculus
acactgcttttctccttccgcaaca

SEQ ID NO: 173225 - DNA, 25 bp, Mus musculus
acactggaaaatggtggtggcttgg

SEQ ID NO: 173226 - DNA, 25 bp, Mus musculus
acactggaaacaaatgagatattct

SEQ ID NO: 173227 - DNA, 25 bp, Mus musculus
acactggaaacaagataaaacaaaa

SEQ ID NO: 173228 - DNA, 25 bp, Mus musculus
acactggaaagggcagcctctttcc

SEQ ID NO: 173229 - DNA, 25 bp, Mus musculus
acactggaaggatttgccagtccac

SEQ ID NO: 173230 - DNA, 25 bp, Mus musculus
acactggaagtatttttgaacaatg

SEQ ID NO: 173231 - DNA, 25 bp, Mus musculus
acactggacccaagggaaagcgtgg

SEQ ID NO: 173232 - DNA, 25 bp, Mus musculus
acactggagaatcgaggaaaacttc

SEQ ID NO: 173233 - DNA, 25 bp, Mus musculus
acactggcagaggtacggagtttga

SEQ ID NO: 173234 - DNA, 25 bp, Mus musculus
acactggcagcagggcagtttcaca

SEQ ID NO: 173235 - DNA, 25 bp, Mus musculus
acactggcagtttccaggcacttgg

SEQ ID NO: 173236 - DNA, 25 bp, Mus musculus
acactggccaaaatttatgagaaga

SEQ ID NO: 173237 - DNA, 25 bp, Mus musculus
acactggccaaaatttcctctgtga

SEQ ID NO: 173238 - DNA, 25 bp, Mus musculus
acactggccaagtactgtgaggtgc

SEQ ID NO: 173239 - DNA, 25 bp, Mus musculus
acactggccaatgactgtgaggtgc

SEQ ID NO: 173240 - DNA, 25 bp, Mus musculus
acactggccagaaggatgtcaatgg

SEQ ID NO: 173241 - DNA, 25 bp, Mus musculus
acactggccatgaacgtcctgtttc

SEQ ID NO: 173242 - DNA, 25 bp, Mus musculus
acactggccgagggatggaattcga

SEQ ID NO: 173243 - DNA, 25 bp, Mus musculus
acactggccgccactgggaagcctg

SEQ ID NO: 173244 - DNA, 25 bp, Mus musculus
acactggccggacccacattgtgga

SEQ ID NO: 173245 - DNA, 25 bp, Mus musculus
acactggccggagaagctggaggga

SEQ ID NO: 173246 - DNA, 25 bp, Mus musculus
acactggccggcacaatatgacgac

SEQ ID NO: 173247 - DNA, 25 bp, Mus musculus
acactggcctctgagagctgtcggc

SEQ ID NO: 173248 - DNA, 25 bp, Mus musculus
acactggcgagaagaccaccatgcg

SEQ ID NO: 173249 - DNA, 25 bp, Mus musculus
acactggctgatctgcatccccaaa

SEQ ID NO: 173250 - DNA, 25 bp, Mus musculus
acactgggcctggttgtggagttga

SEQ ID NO: 173251 - DNA, 25 bp, Mus musculus
acactgggcgcaggtttacctattt

SEQ ID NO: 173252 - DNA, 25 bp, Mus musculus
acactggtaatgatgaccattaatt

SEQ ID NO: 173253 - DNA, 25 bp, Mus musculus
acactggtgagccatcttttctggg

SEQ ID NO: 173254 - DNA, 25 bp, Mus musculus
acactggtgcagaagagaagagcag

SEQ ID NO: 173255 - DNA, 25 bp, Mus musculus
acactggtgtaagaaatgaagctca

SEQ ID NO: 173256 - DNA, 25 bp, Mus musculus
acactgtacttcgcagatatggcca

SEQ ID NO: 173257 - DNA, 25 bp, Mus musculus
acactgtagtggaagaagaatgact

SEQ ID NO: 173258 - DNA, 25 bp, Mus musculus
acactgtagtggaagagaaatcact

SEQ ID NO: 173259 - DNA, 25 bp, Mus musculus
acactgtatcggttccatgtaagtc

SEQ ID NO: 173260 - DNA, 25 bp, Mus musculus
acactgtcaccgactatttgcatca

SEQ ID NO: 173261 - DNA, 25 bp, Mus musculus
acactgtcaccgagtttgtctctgt

SEQ ID NO: 173262 - DNA, 25 bp, Mus musculus
acactgtcaccgatgtggataagtc

SEQ ID NO: 173263 - DNA, 25 bp, Mus musculus
acactgtcagagtatttttctattg

SEQ ID NO: 173264 - DNA, 25 bp, Mus musculus
acactgtccaaactagcctctgcag

SEQ ID NO: 173265 - DNA, 25 bp, Mus musculus
acactgtccaacactggccagtgtt

SEQ ID NO: 173266 - DNA, 25 bp, Mus musculus
acactgtccaagatctccgaggctg

SEQ ID NO: 173267 - DNA, 25 bp, Mus musculus
acactgtctagcaccatcaaaaagg

SEQ ID NO: 173268 - DNA, 25 bp, Mus musculus
acactgtctgaactcacgctcgcct

SEQ ID NO: 173269 - DNA, 25 bp, Mus musculus
acactgtgatgtggtggaggtggat

SEQ ID NO: 173270 - DNA, 25 bp, Mus musculus
acactgtgccgggtgcacacagtga

SEQ ID NO: 173271 - DNA, 25 bp, Mus musculus
acactgtggcaggtgttcttctgga

SEQ ID NO: 173272 - DNA, 25 bp, Mus musculus
acactgtgggaacaggaacagaatg

SEQ ID NO: 173273 - DNA, 25 bp, Mus musculus
acactgtgggaacaggtattgaagc

SEQ ID NO: 173274 - DNA, 25 bp, Mus musculus
acactgtgggaggaccatccttgct

SEQ ID NO: 173275 - DNA, 25 bp, Mus musculus
acactgtgggcatcctctacacatt

SEQ ID NO: 173276 - DNA, 25 bp, Mus musculus
acactgtgggccatccacgaaaatg

SEQ ID NO: 173277 - DNA, 25 bp, Mus musculus
acactgtgggcccagaccattcccc

SEQ ID NO: 173278 - DNA, 25 bp, Mus musculus
acactgtggggtgcccaattacctg

SEQ ID NO: 173279 - DNA, 25 bp, Mus musculus
acactgttgatccacagggatggcc

SEQ ID NO: 173280 - DNA, 25 bp, Mus musculus
acactgttttgagagtggagtcaac

SEQ ID NO: 173281 - DNA, 25 bp, Mus musculus
acacttaaagctgcgcaaaccatgc

SEQ ID NO: 173282 - DNA, 25 bp, Mus musculus
acacttaaagtatcaagagagcctg

SEQ ID NO: 173283 - DNA, 25 bp, Mus musculus
acacttaacaggtccccaggcaaga

SEQ ID NO: 173284 - DNA, 25 bp, Mus musculus
acacttacaagagcctcaggacagc

SEQ ID NO: 173285 - DNA, 25 bp, Mus musculus
acacttacaagagggggaaggactt

SEQ ID NO: 173286 - DNA, 25 bp, Mus musculus
acacttaccaggtctttgacagaat

SEQ ID NO: 173287 - DNA, 25 bp, Mus musculus
acacttacgaagatggctctgactc

SEQ ID NO: 173288 - DNA, 25 bp, Mus musculus
acacttatccaggctgaataaaaat

SEQ ID NO: 173289 - DNA, 25 bp, Mus musculus
acacttatccagggtgtattgagaa

SEQ ID NO: 173290 - DNA, 25 bp, Mus musculus
acacttatgacctgatggccaactt

SEQ ID NO: 173291 - DNA, 25 bp, Mus musculus
acacttatgacctggcagaacagct

SEQ ID NO: 173292 - DNA, 25 bp, Mus musculus
acacttcaaagagcagcctctatta

SEQ ID NO: 173293 - DNA, 25 bp, Mus musculus
acacttcaacagttatcagagactg

SEQ ID NO: 173294 - DNA, 25 bp, Mus musculus
acacttcacaaggatggaatagagt

SEQ ID NO: 173295 - DNA, 25 bp, Mus musculus
acacttcattggccccagagcagca

SEQ ID NO: 173296 - DNA, 25 bp, Mus musculus
acacttccaaaatgataaactttat

SEQ ID NO: 173297 - DNA, 25 bp, Mus musculus
acacttccaacaagaggaaaaagct

SEQ ID NO: 173298 - DNA, 25 bp, Mus musculus
acacttcccaaaaagaagattataa

SEQ ID NO: 173299 - DNA, 25 bp, Mus musculus
acacttcccagggaggtcagcacct

SEQ ID NO: 173300 - DNA, 25 bp, Mus musculus
acacttccgtgttaggcacgggcag

SEQ ID NO: 173301 - DNA, 25 bp, Mus musculus
acacttcctgaagatcaaagacgcc

SEQ ID NO: 173302 - DNA, 25 bp, Mus musculus
acacttcgtcctggatcttcctgcc

SEQ ID NO: 173303 - DNA, 25 bp, Mus musculus
acacttcgtcctgtcagtggtgcag

SEQ ID NO: 173304 - DNA, 25 bp, Mus musculus
acacttctcaggttcctgtcccacc

SEQ ID NO: 173305 - DNA, 25 bp, Mus musculus
acacttctctcaggcaggcaacctt

SEQ ID NO: 173306 - DNA, 25 bp, Mus musculus
acacttctgacgatcttgaccggcc

SEQ ID NO: 173307 - DNA, 25 bp, Mus musculus
acacttctggagaccacatgtgtcg

SEQ ID NO: 173308 - DNA, 25 bp, Mus musculus
acacttctggaggaaaatatgtcgt

SEQ ID NO: 173309 - DNA, 25 bp, Mus musculus
acacttcttcctgccttaaccatgg

SEQ ID NO: 173310 - DNA, 25 bp, Mus musculus
acacttgaaacagttccctggcagc

SEQ ID NO: 173311 - DNA, 25 bp, Mus musculus
acacttgaaaccagcgtgcagggtc

SEQ ID NO: 173312 - DNA, 25 bp, Mus musculus
acacttgaagatcaagacataagtt

SEQ ID NO: 173313 - DNA, 25 bp, Mus musculus
acacttgaagatctttctgcaagag

SEQ ID NO: 173314 - DNA, 25 bp, Mus musculus
acacttgatcgattatgaaaagggc

SEQ ID NO: 173315 - DNA, 25 bp, Mus musculus
acacttgatcggttatgaaaagtct

SEQ ID NO: 173316 - DNA, 25 bp, Mus musculus
acacttgcaaggccataccttctgg

SEQ ID NO: 173317 - DNA, 25 bp, Mus musculus
acacttggacgttcatgagggatcc

SEQ ID NO: 173318 - DNA, 25 bp, Mus musculus
acacttggaggtgaaatcgccctgt

SEQ ID NO: 173319 - DNA, 25 bp, Mus musculus
acacttgggaggccatggaggacct

SEQ ID NO: 173320 - DNA, 25 bp, Mus musculus
acacttggtgatgaagatgaatgtg

SEQ ID NO: 173321 - DNA, 25 bp, Mus musculus
acacttggtggtgtgaatgagtgtc

SEQ ID NO: 173322 - DNA, 25 bp, Mus musculus
acacttggttatgaggaggatgtta

SEQ ID NO: 173323 - DNA, 25 bp, Mus musculus
acacttgtgcggaggcccactgatc

SEQ ID NO: 173324 - DNA, 25 bp, Mus musculus
acacttgtgcgggtgactcaggagg

SEQ ID NO: 173325 - DNA, 25 bp, Mus musculus
acacttgttatcagttgaatctgga

SEQ ID NO: 173326 - DNA, 25 bp, Mus musculus
acacttgttcagggtgacagaaggt

SEQ ID NO: 173327 - DNA, 25 bp, Mus musculus
acacttgtttgatttatgaggaatc

SEQ ID NO: 173328 - DNA, 25 bp, Mus musculus
acacttgtttgcgtttcccaacaga

SEQ ID NO: 173329 - DNA, 25 bp, Mus musculus
acactttaggagaagacataatgtc

SEQ ID NO: 173330 - DNA, 25 bp, Mus musculus
acactttaggagaaggttgtggagt

SEQ ID NO: 173331 - DNA, 25 bp, Mus musculus
acactttcaaacttccaaaggaatt

SEQ ID NO: 173332 - DNA, 25 bp, Mus musculus
acactttcgatgacgattgtggtgg

SEQ ID NO: 173333 - DNA, 25 bp, Mus musculus
acactttctgtccacttcagtccag

SEQ ID NO: 173334 - DNA, 25 bp, Mus musculus
acactttgaagtcttgaagaaccac

SEQ ID NO: 173335 - DNA, 25 bp, Mus musculus
acactttgagaagcaccaggcgttt

SEQ ID NO: 173336 - DNA, 25 bp, Mus musculus
acactttgcaaaggcaaaatcatgg

SEQ ID NO: 173337 - DNA, 25 bp, Mus musculus
acactttggaacagattcaagtcaa

SEQ ID NO: 173338 - DNA, 25 bp, Mus musculus
acactttggagaagtattgaggctc

SEQ ID NO: 173339 - DNA, 25 bp, Mus musculus
acacttttcatgcagatcctgtgtg

SEQ ID NO: 173340 - DNA, 25 bp, Mus musculus
acacttttccagttccccacactgc

SEQ ID NO: 173341 - DNA, 25 bp, Mus musculus
acagaaaaaaattgaggagacttct

SEQ ID NO: 173342 - DNA, 25 bp, Mus musculus
acagaaaaagagaagctgatggtcc

SEQ ID NO: 173343 - DNA, 25 bp, Mus musculus
acagaaaaagaggctcctcaacttt

SEQ ID NO: 173344 - DNA, 25 bp, Mus musculus
acagaaaaagcctgaaaatgaatct

SEQ ID NO: 173345 - DNA, 25 bp, Mus musculus
acagaaaaagctcctgccacccttc

SEQ ID NO: 173346 - DNA, 25 bp, Mus musculus
acagaaaaaggtctgcagaatgtcc

SEQ ID NO: 173347 - DNA, 25 bp, Mus musculus
acagaaaaatctcatcagagttgta

SEQ ID NO: 173348 - DNA, 25 bp, Mus musculus
acagaaaaatgcatacacagactac

SEQ ID NO: 173349 - DNA, 25 bp, Mus musculus
acagaaaacaaagtggagcgaccct

SEQ ID NO: 173350 - DNA, 25 bp, Mus musculus
acagaaaaccacagtgtcctgtgca

SEQ ID NO: 173351 - DNA, 25 bp, Mus musculus
acagaaaacggaggatggacagtca

SEQ ID NO: 173352 - DNA, 25 bp, Mus musculus
acagaaaagaaggctggtgaggact

SEQ ID NO: 173353 - DNA, 25 bp, Mus musculus
acagaaaataatacaatggattctg

SEQ ID NO: 173354 - DNA, 25 bp, Mus musculus
acagaaaatactttccgtccagatc

SEQ ID NO: 173355 - DNA, 25 bp, Mus musculus
acagaaaatgcacgagcctggttac

SEQ ID NO: 173356 - DNA, 25 bp, Mus musculus
acagaaaatggacggacaaaggaga

SEQ ID NO: 173357 - DNA, 25 bp, Mus musculus
acagaaaatggacggaggaagtgtg

SEQ ID NO: 173358 - DNA, 25 bp, Mus musculus
acagaaacaagctccttgctcggat

SEQ ID NO: 173359 - DNA, 25 bp, Mus musculus
acagaaacacacaggcagatgtcat

SEQ ID NO: 173360 - DNA, 25 bp, Mus musculus
acagaaacaggagaatccaaatggg

SEQ ID NO: 173361 - DNA, 25 bp, Mus musculus
acagaaacaggagttattaaaatgt

SEQ ID NO: 173362 - DNA, 25 bp, Mus musculus
acagaaacaggtgattttttcagca

SEQ ID NO: 173363 - DNA, 25 bp, Mus musculus
acagaaaccaagaccaaaaacactg

SEQ ID NO: 173364 - DNA, 25 bp, Mus musculus
acagaaaccaagtgctaaactgaaa

SEQ ID NO: 173365 - DNA, 25 bp, Mus musculus
acagaaaccagattcatccagtgga

SEQ ID NO: 173366 - DNA, 25 bp, Mus musculus
acagaaacccatgtgagcatgccca

SEQ ID NO: 173367 - DNA, 25 bp, Mus musculus
acagaaaccgatcatcccagcagcc

SEQ ID NO: 173368 - DNA, 25 bp, Mus musculus
acagaaaccggtgctcccttgcatt

SEQ ID NO: 173369 - DNA, 25 bp, Mus musculus
acagaaacggtatctgcagagtttc

SEQ ID NO: 173370 - DNA, 25 bp, Mus musculus
acagaaagagtatgaaaagacacag

SEQ ID NO: 173371 - DNA, 25 bp, Mus musculus
acagaaagcaagatttgtcttcggc

SEQ ID NO: 173372 - DNA, 25 bp, Mus musculus
acagaaagcagatttcaacaagaaa

SEQ ID NO: 173373 - DNA, 25 bp, Mus musculus
acagaaagccttgagggtgtttctt

SEQ ID NO: 173374 - DNA, 25 bp, Mus musculus
acagaaaggccaggttctgggagaa

SEQ ID NO: 173375 - DNA, 25 bp, Mus musculus
acagaaaggcggaacagagtgttct

SEQ ID NO: 173376 - DNA, 25 bp, Mus musculus
acagaaaggcgggaaagggctgtga

SEQ ID NO: 173377 - DNA, 25 bp, Mus musculus
acagaaaggtggatatgtccgaccc

SEQ ID NO: 173378 - DNA, 25 bp, Mus musculus
acagaaagtgaaaaggttgtccagg

SEQ ID NO: 173379 - DNA, 25 bp, Mus musculus
acagaaatcgagctgaggaaacgtg

SEQ ID NO: 173380 - DNA, 25 bp, Mus musculus
acagaaatgaaagtatcaagcactg

SEQ ID NO: 173381 - DNA, 25 bp, Mus musculus
acagaaatgaaggctccagccaggc

SEQ ID NO: 173382 - DNA, 25 bp, Mus musculus
acagaaatgctgagatggtgcagtc

SEQ ID NO: 173383 - DNA, 25 bp, Mus musculus
acagaaattgagtgctcctgtgctg

SEQ ID NO: 173384 - DNA, 25 bp, Mus musculus
acagaaattgagtgggacgacttgg

SEQ ID NO: 173385 - DNA, 25 bp, Mus musculus
acagaaatttgaaatttcaacaaga

SEQ ID NO: 173386 - DNA, 25 bp, Mus musculus
acagaacaaataagatgttctcaaa

SEQ ID NO: 173387 - DNA, 25 bp, Mus musculus
acagaacaagcagacttccagcagc

SEQ ID NO: 173388 - DNA, 25 bp, Mus musculus
acagaacagagggggaagaaaccga

SEQ ID NO: 173389 - DNA, 25 bp, Mus musculus
acagaacataattagcttgaagtca

SEQ ID NO: 173390 - DNA, 25 bp, Mus musculus
acagaacattagctcaggtacctga

SEQ ID NO: 173391 - DNA, 25 bp, Mus musculus
acagaacatttccaggttcagctcc

SEQ ID NO: 173392 - DNA, 25 bp, Mus musculus
acagaaccagccaacagccatcatt

SEQ ID NO: 173393 - DNA, 25 bp, Mus musculus
acagaaccagcccatcattcaggtc

SEQ ID NO: 173394 - DNA, 25 bp, Mus musculus
acagaacccgaaaagggccctgtag

SEQ ID NO: 173395 - DNA, 25 bp, Mus musculus
acagaacccgaagagcctcagctta

SEQ ID NO: 173396 - DNA, 25 bp, Mus musculus
acagaacccgagctgcctgccgaca

SEQ ID NO: 173397 - DNA, 25 bp, Mus musculus
acagaaccctttcagatctcgctgc

SEQ ID NO: 173398 - DNA, 25 bp, Mus musculus
acagaaccctttcagccgttaacca

SEQ ID NO: 173399 - DNA, 25 bp, Mus musculus
acagaaccgaggtagtcaagaacaa

SEQ ID NO: 173400 - DNA, 25 bp, Mus musculus
acagaaccgcaagacaggagcccgg

SEQ ID NO: 173401 - DNA, 25 bp, Mus musculus
acagaaccgcaagcttccatacgac

SEQ ID NO: 173402 - DNA, 25 bp, Mus musculus
acagaacctcagcatcatgatccag

SEQ ID NO: 173403 - DNA, 25 bp, Mus musculus
acagaacctgacaggtatgtcattc

SEQ ID NO: 173404 - DNA, 25 bp, Mus musculus
acagaacgagcagcttttgaaatcc

SEQ ID NO: 173405 - DNA, 25 bp, Mus musculus
acagaacgagcaggcgaaggagatg

SEQ ID NO: 173406 - DNA, 25 bp, Mus musculus
acagaacggagattatcagctccgg

SEQ ID NO: 173407 - DNA, 25 bp, Mus musculus
acagaacggttgattacaacggcga

SEQ ID NO: 173408 - DNA, 25 bp, Mus musculus
acagaactagctaaggctcaaactc

SEQ ID NO: 173409 - DNA, 25 bp, Mus musculus
acagaactcaggtttaacagaagaa

SEQ ID NO: 173410 - DNA, 25 bp, Mus musculus
acagaacttctgatgtttcttccag

SEQ ID NO: 173411 - DNA, 25 bp, Mus musculus
acagaagaaaaattcatcgttaaag

SEQ ID NO: 173412 - DNA, 25 bp, Mus musculus
acagaagaaagaggaagtttgtttg

SEQ ID NO: 173413 - DNA, 25 bp, Mus musculus
acagaagaaagaggttatggctttc

SEQ ID NO: 173414 - DNA, 25 bp, Mus musculus
acagaagaaatgttgctgcccaggt

SEQ ID NO: 173415 - DNA, 25 bp, Mus musculus
acagaagaacagatggaggccttta

SEQ ID NO: 173416 - DNA, 25 bp, Mus musculus
acagaagaacagtgtcccagcagat

SEQ ID NO: 173417 - DNA, 25 bp, Mus musculus
acagaagaagaaaagctcaacagag

SEQ ID NO: 173418 - DNA, 25 bp, Mus musculus
acagaagaagagcagagaaactttt

SEQ ID NO: 173419 - DNA, 25 bp, Mus musculus
acagaagacaaaggaaacagaggct

SEQ ID NO: 173420 - DNA, 25 bp, Mus musculus
acagaagacaatagcacccaggcag

SEQ ID NO: 173421 - DNA, 25 bp, Mus musculus
acagaagactacagctcgacatggg

SEQ ID NO: 173422 - DNA, 25 bp, Mus musculus
acagaagactacagttgcagctcga

SEQ ID NO: 173423 - DNA, 25 bp, Mus musculus
acagaagagaaagaaagaccagaga

SEQ ID NO: 173424 - DNA, 25 bp, Mus musculus
acagaagagaagagttgatacaaaa

SEQ ID NO: 173425 - DNA, 25 bp, Mus musculus
acagaagaggccagatatcacagcc

SEQ ID NO: 173426 - DNA, 25 bp, Mus musculus
acagaagaggctcagaacactgggg

SEQ ID NO: 173427 - DNA, 25 bp, Mus musculus
acagaagaggctctccctgaagtca

SEQ ID NO: 173428 - DNA, 25 bp, Mus musculus
acagaagagggtgattaaagtttac

SEQ ID NO: 173429 - DNA, 25 bp, Mus musculus
acagaagatgaagatgtctggtgag

SEQ ID NO: 173430 - DNA, 25 bp, Mus musculus
acagaagatggcagaatagtgattg

SEQ ID NO: 173431 - DNA, 25 bp, Mus musculus
acagaagcaacaggaggctgatcga

SEQ ID NO: 173432 - DNA, 25 bp, Mus musculus
acagaagcaagggaaaatacagaag

SEQ ID NO: 173433 - DNA, 25 bp, Mus musculus
acagaagcaagggaacctgcaactg

SEQ ID NO: 173434 - DNA, 25 bp, Mus musculus
acagaagcagagcagcagaccacag

SEQ ID NO: 173435 - DNA, 25 bp, Mus musculus
acagaagcagattaagcacatgatg

SEQ ID NO: 173436 - DNA, 25 bp, Mus musculus
acagaagcagtgagtacaacacatg

SEQ ID NO: 173437 - DNA, 25 bp, Mus musculus
acagaagcagtggtatttatgagcc

SEQ ID NO: 173438 - DNA, 25 bp, Mus musculus
acagaagcatggaagaaaaagagag

SEQ ID NO: 173439 - DNA, 25 bp, Mus musculus
acagaagcatggaaggatttagaca

SEQ ID NO: 173440 - DNA, 25 bp, Mus musculus
acagaagcatggaaggtggaaaaaa

SEQ ID NO: 173441 - DNA, 25 bp, Mus musculus
acagaagcgagacggtgttctgaat

SEQ ID NO: 173442 - DNA, 25 bp, Mus musculus
acagaagcgcaaggtgtcagacaaa

SEQ ID NO: 173443 - DNA, 25 bp, Mus musculus
acagaagctatgaggtaactgtgga

SEQ ID NO: 173444 - DNA, 25 bp, Mus musculus
acagaagctatgaggtcatggaggg

SEQ ID NO: 173445 - DNA, 25 bp, Mus musculus
acagaagctgaagcctgcaggtctc

SEQ ID NO: 173446 - DNA, 25 bp, Mus musculus
acagaagctgtggctataatgtgca

SEQ ID NO: 173447 - DNA, 25 bp, Mus musculus
acagaagcttccaagtatgaggatg

SEQ ID NO: 173448 - DNA, 25 bp, Mus musculus
acagaaggaagaagaaaagacaccg

SEQ ID NO: 173449 - DNA, 25 bp, Mus musculus
acagaaggaagaagaggaaaggatt

SEQ ID NO: 173450 - DNA, 25 bp, Mus musculus
acagaaggagaagaataccaggaaa

SEQ ID NO: 173451 - DNA, 25 bp, Mus musculus
acagaaggagaaggaaagcggtaca

SEQ ID NO: 173452 - DNA, 25 bp, Mus musculus
acagaaggagctccatctgtagcac

SEQ ID NO: 173453 - DNA, 25 bp, Mus musculus
acagaaggcgacatcccaggcatcc

SEQ ID NO: 173454 - DNA, 25 bp, Mus musculus
acagaagggaaggtgggctacgaac

SEQ ID NO: 173455 - DNA, 25 bp, Mus musculus
acagaagggactggacccatacaat

SEQ ID NO: 173456 - DNA, 25 bp, Mus musculus
acagaagggactgtcaactcttgtc

SEQ ID NO: 173457 - DNA, 25 bp, Mus musculus
acagaaggggatcggtatcatgcca

SEQ ID NO: 173458 - DNA, 25 bp, Mus musculus
acagaagtccctaaatcaaaaagtt

SEQ ID NO: 173459 - DNA, 25 bp, Mus musculus
acagaagtccctactccggaccaaa

SEQ ID NO: 173460 - DNA, 25 bp, Mus musculus
acagaagtccctgagctcagccccc

SEQ ID NO: 173461 - DNA, 25 bp, Mus musculus
acagaagtggaagagacaatgaata

SEQ ID NO: 173462 - DNA, 25 bp, Mus musculus
acagaagttgctgtgaaaccgggct

SEQ ID NO: 173463 - DNA, 25 bp, Mus musculus
acagaagttggcttggcttgagatt

SEQ ID NO: 173464 - DNA, 25 bp, Mus musculus
acagaataaacacactgtgacagag

SEQ ID NO: 173465 - DNA, 25 bp, Mus musculus
acagaataaacagactgtgacagag

SEQ ID NO: 173466 - DNA, 25 bp, Mus musculus
acagaataagcttagatatgccaac

SEQ ID NO: 173467 - DNA, 25 bp, Mus musculus
acagaataattgcctgtcacctact

SEQ ID NO: 173468 - DNA, 25 bp, Mus musculus
acagaatacatgcaagaccctgatg

SEQ ID NO: 173469 - DNA, 25 bp, Mus musculus
acagaatactgtaataccagaagat

SEQ ID NO: 173470 - DNA, 25 bp, Mus musculus
acagaatagttgatctttataagct

SEQ ID NO: 173471 - DNA, 25 bp, Mus musculus
acagaatagttggtcaaaagaagcc

SEQ ID NO: 173472 - DNA, 25 bp, Mus musculus
acagaatatcagatacacaaaattg

SEQ ID NO: 173473 - DNA, 25 bp, Mus musculus
acagaatatcagttacacaaaattg

SEQ ID NO: 173474 - DNA, 25 bp, Mus musculus
acagaatatttaatacgaacagaac

SEQ ID NO: 173475 - DNA, 25 bp, Mus musculus
acagaatcccagtctcctcactact

SEQ ID NO: 173476 - DNA, 25 bp, Mus musculus
acagaatcccagtggggaaacggca

SEQ ID NO: 173477 - DNA, 25 bp, Mus musculus
acagaatcgaggtacaaccagcatc

SEQ ID NO: 173478 - DNA, 25 bp, Mus musculus
acagaatgaggccggggacgaccat

SEQ ID NO: 173479 - DNA, 25 bp, Mus musculus
acagaatgcaagtcacacaaggacc

SEQ ID NO: 173480 - DNA, 25 bp, Mus musculus
acagaatgcaggctggtgagattgg

SEQ ID NO: 173481 - DNA, 25 bp, Mus musculus
acagaatgccaaactccgtgtcgac

SEQ ID NO: 173482 - DNA, 25 bp, Mus musculus
acagaatgcgcacggtagcactcag

SEQ ID NO: 173483 - DNA, 25 bp, Mus musculus
acagaatgggataaagatgacctct

SEQ ID NO: 173484 - DNA, 25 bp, Mus musculus
acagaatgggatctttttaaagcga

SEQ ID NO: 173485 - DNA, 25 bp, Mus musculus
acagaatgggctgaaccaataacgt

SEQ ID NO: 173486 - DNA, 25 bp, Mus musculus
acagaatggggggtcaacaggacaa

SEQ ID NO: 173487 - DNA, 25 bp, Mus musculus
acagaatgtcagaaccatcctcctg

SEQ ID NO: 173488 - DNA, 25 bp, Mus musculus
acagaatgtcagtctggagccccca

SEQ ID NO: 173489 - DNA, 25 bp, Mus musculus
acagaattagggaacctgctggtag

SEQ ID NO: 173490 - DNA, 25 bp, Mus musculus
acagaattccaggacagagatttcc

SEQ ID NO: 173491 - DNA, 25 bp, Mus musculus
acagaattctcaggaacatcatgac

SEQ ID NO: 173492 - DNA, 25 bp, Mus musculus
acagacaaaaattaactgaaacaga

SEQ ID NO: 173493 - DNA, 25 bp, Mus musculus
acagacaaaagccaaccatattctg

SEQ ID NO: 173494 - DNA, 25 bp, Mus musculus
acagacaaacttgggttctatggcc

SEQ ID NO: 173495 - DNA, 25 bp, Mus musculus
acagacaaagcaagctaccaagagc

SEQ ID NO: 173496 - DNA, 25 bp, Mus musculus
acagacaaagcaaggagtaatataa

SEQ ID NO: 173497 - DNA, 25 bp, Mus musculus
acagacaaccccaaggattaaacca

SEQ ID NO: 173498 - DNA, 25 bp, Mus musculus
acagacaaccccaagttctacagtg

SEQ ID NO: 173499 - DNA, 25 bp, Mus musculus
acagacaacctgacagatcgttacg

SEQ ID NO: 173500 - DNA, 25 bp, Mus musculus
acagacaactcaacagcacagtcag

SEQ ID NO: 173501 - DNA, 25 bp, Mus musculus
acagacaactcaattagcaatagcg

SEQ ID NO: 173502 - DNA, 25 bp, Mus musculus
acagacaagacaggaaccctgaccc

SEQ ID NO: 173503 - DNA, 25 bp, Mus musculus
acagacaagagagatgcctcaggaa

SEQ ID NO: 173504 - DNA, 25 bp, Mus musculus
acagacaatacccagagatgtgaat

SEQ ID NO: 173505 - DNA, 25 bp, Mus musculus
acagacaatcctatggtctttgcca

SEQ ID NO: 173506 - DNA, 25 bp, Mus musculus
acagacaatgaagataaaattgcta

SEQ ID NO: 173507 - DNA, 25 bp, Mus musculus
acagacaatgaagtgtttgctggtg

SEQ ID NO: 173508 - DNA, 25 bp, Mus musculus
acagacacaaagctcaagttcatgt

SEQ ID NO: 173509 - DNA, 25 bp, Mus musculus
acagacacaagttttgagaaatggt

SEQ ID NO: 173510 - DNA, 25 bp, Mus musculus
acagacacagaaagggtgcttcgag

SEQ ID NO: 173511 - DNA, 25 bp, Mus musculus
acagacacagctcacagacttcgga

SEQ ID NO: 173512 - DNA, 25 bp, Mus musculus
acagacacaggtaccagagagatgg

SEQ ID NO: 173513 - DNA, 25 bp, Mus musculus
acagacacaggtggggtgaactgaa

SEQ ID NO: 173514 - DNA, 25 bp, Mus musculus
acagacacatgaggtgcacgcctcc

SEQ ID NO: 173515 - DNA, 25 bp, Mus musculus
acagacacatgtagatctttcattt

SEQ ID NO: 173516 - DNA, 25 bp, Mus musculus
acagacaccgctcgtgtcttatcta

SEQ ID NO: 173517 - DNA, 25 bp, Mus musculus
acagacaccggcaggtgggtaatgc

SEQ ID NO: 173518 - DNA, 25 bp, Mus musculus
acagacaccggccaggggcgcaaga

SEQ ID NO: 173519 - DNA, 25 bp, Mus musculus
acagacaccggccaggtgctctcac

SEQ ID NO: 173520 - DNA, 25 bp, Mus musculus
acagacaccttgagagggttttatg

SEQ ID NO: 173521 - DNA, 25 bp, Mus musculus
acagacacggacaatttgggtatcc

SEQ ID NO: 173522 - DNA, 25 bp, Mus musculus
acagacagaacagtctaagagtgtc

SEQ ID NO: 173523 - DNA, 25 bp, Mus musculus
acagacagactgggaaaacatcgat

SEQ ID NO: 173524 - DNA, 25 bp, Mus musculus
acagacagattgagcagctctatgc

SEQ ID NO: 173525 - DNA, 25 bp, Mus musculus
acagacagcaaggcaaagatgcaat

SEQ ID NO: 173526 - DNA, 25 bp, Mus musculus
acagacagctgcagtgcttacagac

SEQ ID NO: 173527 - DNA, 25 bp, Mus musculus
acagacagtgggaagtctgttgttg

SEQ ID NO: 173528 - DNA, 25 bp, Mus musculus
acagacataggaagatcaccagcaa

SEQ ID NO: 173529 - DNA, 25 bp, Mus musculus
acagacatccctgactaaggctgga

SEQ ID NO: 173530 - DNA, 25 bp, Mus musculus
acagacatctcaggaggctgcgggg

SEQ ID NO: 173531 - DNA, 25 bp, Mus musculus
acagacatggggagtcttctgagtc

SEQ ID NO: 173532 - DNA, 25 bp, Mus musculus
acagaccagaaacggatgggctgta

SEQ ID NO: 173533 - DNA, 25 bp, Mus musculus
acagaccagtacatgacaatggatg

SEQ ID NO: 173534 - DNA, 25 bp, Mus musculus
acagaccatccaggtgagcctcatg

SEQ ID NO: 173535 - DNA, 25 bp, Mus musculus
acagaccatgcaagtgaacgaagct

SEQ ID NO: 173536 - DNA, 25 bp, Mus musculus
acagaccatgcaagtggaaagtacg

SEQ ID NO: 173537 - DNA, 25 bp, Mus musculus
acagaccccaaaggagccaagtcag

SEQ ID NO: 173538 - DNA, 25 bp, Mus musculus
acagaccctccccacagagcgcacg

SEQ ID NO: 173539 - DNA, 25 bp, Mus musculus
acagaccctggacatcaacatggct

SEQ ID NO: 173540 - DNA, 25 bp, Mus musculus
acagaccctgggacagcaggtgccc

SEQ ID NO: 173541 - DNA, 25 bp, Mus musculus
acagaccctgggctccaccctcatc

SEQ ID NO: 173542 - DNA, 25 bp, Mus musculus
acagaccctggtcactcatcaggcc

SEQ ID NO: 173543 - DNA, 25 bp, Mus musculus
acagaccgcagaagttatatgagtg

SEQ ID NO: 173544 - DNA, 25 bp, Mus musculus
acagaccgcctacacatccaggtgg

SEQ ID NO: 173545 - DNA, 25 bp, Mus musculus
acagaccgtcacggacaattgttcc

SEQ ID NO: 173546 - DNA, 25 bp, Mus musculus
acagacctactgtgtctctggacca

SEQ ID NO: 173547 - DNA, 25 bp, Mus musculus
acagacctccaagggcaccatgaac

SEQ ID NO: 173548 - DNA, 25 bp, Mus musculus
acagacctcctgatcacttgtacag

SEQ ID NO: 173549 - DNA, 25 bp, Mus musculus
acagacctcgcggaaaactgtcctt

SEQ ID NO: 173550 - DNA, 25 bp, Mus musculus
acagacctcgcgggcccatcctccc

SEQ ID NO: 173551 - DNA, 25 bp, Mus musculus
acagacctgcaaatctcccagccaa

SEQ ID NO: 173552 - DNA, 25 bp, Mus musculus
acagacctgttagggatccttgtgg

SEQ ID NO: 173553 - DNA, 25 bp, Mus musculus
acagacgaccttgttgccgctggtg

SEQ ID NO: 173554 - DNA, 25 bp, Mus musculus
acagacgtgaaaagtgacgtgaaca

SEQ ID NO: 173555 - DNA, 25 bp, Mus musculus
acagacgtgaaaatgttctgcctgc

SEQ ID NO: 173556 - DNA, 25 bp, Mus musculus
acagactaaagaagtttccagaact

SEQ ID NO: 173557 - DNA, 25 bp, Mus musculus
acagactatgggcaggtgttcacct

SEQ ID NO: 173558 - DNA, 25 bp, Mus musculus
acagactcattaaaggaaaaggata

SEQ ID NO: 173559 - DNA, 25 bp, Mus musculus
acagactccccagtttctcaaggga

SEQ ID NO: 173560 - DNA, 25 bp, Mus musculus
acagactcccctgaatttaaggagc

SEQ ID NO: 173561 - DNA, 25 bp, Mus musculus
acagactctgccaaggagttaatca

SEQ ID NO: 173562 - DNA, 25 bp, Mus musculus
acagactgaaggacagggtggcctg

SEQ ID NO: 173563 - DNA, 25 bp, Mus musculus
acagactgagccccttaggtgagga

SEQ ID NO: 173564 - DNA, 25 bp, Mus musculus
acagactgcacttgtggtttgctat

SEQ ID NO: 173565 - DNA, 25 bp, Mus musculus
acagactgccacggcctcctcagca

SEQ ID NO: 173566 - DNA, 25 bp, Mus musculus
acagactgccacggtcatctctcat

SEQ ID NO: 173567 - DNA, 25 bp, Mus musculus
acagactgcgacttggataagaaaa

SEQ ID NO: 173568 - DNA, 25 bp, Mus musculus
acagactgcgacttgggcttcctgt

SEQ ID NO: 173569 - DNA, 25 bp, Mus musculus
acagactgctgacaggcaccacaca

SEQ ID NO: 173570 - DNA, 25 bp, Mus musculus
acagactggaaggaacatgacatcg

SEQ ID NO: 173571 - DNA, 25 bp, Mus musculus
acagactggaggagttgaaagaatt

SEQ ID NO: 173572 - DNA, 25 bp, Mus musculus
acagactggaggcattctggaattt

SEQ ID NO: 173573 - DNA, 25 bp, Mus musculus
acagactgtaacctgtcctggttat

SEQ ID NO: 173574 - DNA, 25 bp, Mus musculus
acagacttaggcgctaactgggatc

SEQ ID NO: 173575 - DNA, 25 bp, Mus musculus
acagacttgtcccggccacacagcg

SEQ ID NO: 173576 - DNA, 25 bp, Mus musculus
acagagaaacgtctgtctgcaggtt

SEQ ID NO: 173577 - DNA, 25 bp, Mus musculus
acagagaaagatgccaagctggggc

SEQ ID NO: 173578 - DNA, 25 bp, Mus musculus
acagagaacaagatttctccttatt

SEQ ID NO: 173579 - DNA, 25 bp, Mus musculus
acagagaacggggagttggctaggc

SEQ ID NO: 173580 - DNA, 25 bp, Mus musculus
acagagaactggccggttctgcggt

SEQ ID NO: 173581 - DNA, 25 bp, Mus musculus
acagagaagccaggttacaaactac

SEQ ID NO: 173582 - DNA, 25 bp, Mus musculus
acagagaagtcagagcagcagcaag

SEQ ID NO: 173583 - DNA, 25 bp, Mus musculus
acagagaagtcagagtgaaagtaga

SEQ ID NO: 173584 - DNA, 25 bp, Mus musculus
acagagaatgaaaagtgaagctgag

SEQ ID NO: 173585 - DNA, 25 bp, Mus musculus
acagagaatggggagctgtcccggc

SEQ ID NO: 173586 - DNA, 25 bp, Mus musculus
acagagacaaaggaacaagttgatc

SEQ ID NO: 173587 - DNA, 25 bp, Mus musculus
acagagacaccagcttgggggcccc

SEQ ID NO: 173588 - DNA, 25 bp, Mus musculus
acagagacaggcatccgtccctgcc

SEQ ID NO: 173589 - DNA, 25 bp, Mus musculus
acagagacaggttgcttttaacttt

SEQ ID NO: 173590 - DNA, 25 bp, Mus musculus
acagagaccaggtctttggccagta

SEQ ID NO: 173591 - DNA, 25 bp, Mus musculus
acagagactaaggcaattccagtaa

SEQ ID NO: 173592 - DNA, 25 bp, Mus musculus
acagagactaaggctgtgaaaacag

SEQ ID NO: 173593 - DNA, 25 bp, Mus musculus
acagagactggggccgtcatcatag

SEQ ID NO: 173594 - DNA, 25 bp, Mus musculus
acagagactggggctgcaggatgac

SEQ ID NO: 173595 - DNA, 25 bp, Mus musculus
acagagagaaataatgaagcattgg

SEQ ID NO: 173596 - DNA, 25 bp, Mus musculus
acagagagaaggcttcgtgagcttc

SEQ ID NO: 173597 - DNA, 25 bp, Mus musculus
acagagagaagggcccgagggctgt

SEQ ID NO: 173598 - DNA, 25 bp, Mus musculus
acagagagaattttgttcaggctgt

SEQ ID NO: 173599 - DNA, 25 bp, Mus musculus
acagagagacaattgggttcatagt

SEQ ID NO: 173600 - DNA, 25 bp, Mus musculus
acagagagagccgaagccgaaagcg

SEQ ID NO: 173601 - DNA, 25 bp, Mus musculus
acagagagagccgaatattaattaa

SEQ ID NO: 173602 - DNA, 25 bp, Mus musculus
acagagagaggtgaaacctttgtcc

SEQ ID NO: 173603 - DNA, 25 bp, Mus musculus
acagagagcaaaacagaggcccaga

SEQ ID NO: 173604 - DNA, 25 bp, Mus musculus
acagagagcaaggtcgccgctgaag

SEQ ID NO: 173605 - DNA, 25 bp, Mus musculus
acagagagcagatcttgagtgcacc

SEQ ID NO: 173606 - DNA, 25 bp, Mus musculus
acagagagcagattctgccctttcc

SEQ ID NO: 173607 - DNA, 25 bp, Mus musculus
acagagaggaagaaacttcaccctt

SEQ ID NO: 173608 - DNA, 25 bp, Mus musculus
acagagaggaagatgtttgagacag

SEQ ID NO: 173609 - DNA, 25 bp, Mus musculus
acagagaggaggagacacggtctct

SEQ ID NO: 173610 - DNA, 25 bp, Mus musculus
acagagaggcgtcccagccaagcgg

SEQ ID NO: 173611 - DNA, 25 bp, Mus musculus
acagagatccaaggacaccacttca

SEQ ID NO: 173612 - DNA, 25 bp, Mus musculus
acagagatccaaggttgaccacaag

SEQ ID NO: 173613 - DNA, 25 bp, Mus musculus
acagagatcggtaccgttgctccag

SEQ ID NO: 173614 - DNA, 25 bp, Mus musculus
acagagatggatggacagtctgagg

SEQ ID NO: 173615 - DNA, 25 bp, Mus musculus
acagagattcaggttctcccctatg

SEQ ID NO: 173616 - DNA, 25 bp, Mus musculus
acagagatttgctggatctcatgga

SEQ ID NO: 173617 - DNA, 25 bp, Mus musculus
acagagatttgtctcaatggaaact

SEQ ID NO: 173618 - DNA, 25 bp, Mus musculus
acagagcaagaaggagagcgtggca

SEQ ID NO: 173619 - DNA, 25 bp, Mus musculus
acagagcaaggtcctgtttattgct

SEQ ID NO: 173620 - DNA, 25 bp, Mus musculus
acagagcaatgcaggggggcttggt

SEQ ID NO: 173621 - DNA, 25 bp, Mus musculus
acagagcacagctgtcccagaagct

SEQ ID NO: 173622 - DNA, 25 bp, Mus musculus
acagagcaccgggcaagagtccatc

SEQ ID NO: 173623 - DNA, 25 bp, Mus musculus
acagagcaccggggactcctgagac

SEQ ID NO: 173624 - DNA, 25 bp, Mus musculus
acagagcagaggaatgtctacaagg

SEQ ID NO: 173625 - DNA, 25 bp, Mus musculus
acagagcagcagaaaattgtccagc

SEQ ID NO: 173626 - DNA, 25 bp, Mus musculus
acagagcagcaggaggatatggctc

SEQ ID NO: 173627 - DNA, 25 bp, Mus musculus
acagagcatcccagaggaattcaag

SEQ ID NO: 173628 - DNA, 25 bp, Mus musculus
acagagcatgaaatgcattgatatt

SEQ ID NO: 173629 - DNA, 25 bp, Mus musculus
acagagccagaagaccagtgaagtc

SEQ ID NO: 173630 - DNA, 25 bp, Mus musculus
acagagccagctgcgcaaaccatgc

SEQ ID NO: 173631 - DNA, 25 bp, Mus musculus
acagagccatcaggtcctaatcaaa

SEQ ID NO: 173632 - DNA, 25 bp, Mus musculus
acagagccatggggaagctctttgt

SEQ ID NO: 173633 - DNA, 25 bp, Mus musculus
acagagcccaggagcacctcaacta

SEQ ID NO: 173634 - DNA, 25 bp, Mus musculus
acagagcccaggtctgctgccttgc

SEQ ID NO: 173635 - DNA, 25 bp, Mus musculus
acagagcccattgatgtcacagcta

SEQ ID NO: 173636 - DNA, 25 bp, Mus musculus
acagagccctgggcccttcctgtcc

SEQ ID NO: 173637 - DNA, 25 bp, Mus musculus
acagagcctccggggaccttcctgg

SEQ ID NO: 173638 - DNA, 25 bp, Mus musculus
acagagcctccgggggtgtctcttt

SEQ ID NO: 173639 - DNA, 25 bp, Mus musculus
acagagcctgtgagaaaactaactg

SEQ ID NO: 173640 - DNA, 25 bp, Mus musculus
acagagcctgtgagcttcaaactgg

SEQ ID NO: 173641 - DNA, 25 bp, Mus musculus
acagagccttcaagaagttgctctg

SEQ ID NO: 173642 - DNA, 25 bp, Mus musculus
acagagcgaagacgggagcgggagc

SEQ ID NO: 173643 - DNA, 25 bp, Mus musculus
acagagcgaggtgtggacagttctg

SEQ ID NO: 173644 - DNA, 25 bp, Mus musculus
acagagctacagaatcatacgatga

SEQ ID NO: 173645 - DNA, 25 bp, Mus musculus
acagagctacagtggcacctgacaa

SEQ ID NO: 173646 - DNA, 25 bp, Mus musculus
acagagctatctaaactctgttcaa

SEQ ID NO: 173647 - DNA, 25 bp, Mus musculus
acagagctcgggaggtacagtggtc

SEQ ID NO: 173648 - DNA, 25 bp, Mus musculus
acagagctcgggaggttcccgtgag

SEQ ID NO: 173649 - DNA, 25 bp, Mus musculus
acagagctgaagagccagatgaagt

SEQ ID NO: 173650 - DNA, 25 bp, Mus musculus
acagagctgacccaagccattttga

SEQ ID NO: 173651 - DNA, 25 bp, Mus musculus
acagagcttcccaggtctctttgag

SEQ ID NO: 173652 - DNA, 25 bp, Mus musculus
acagaggaaaagattgataagtatc

SEQ ID NO: 173653 - DNA, 25 bp, Mus musculus
acagaggaaatccaacagcttcccc

SEQ ID NO: 173654 - DNA, 25 bp, Mus musculus
acagaggaaattacacctgctcctg

SEQ ID NO: 173655 - DNA, 25 bp, Mus musculus
acagaggaatggagaacatcccaac

SEQ ID NO: 173656 - DNA, 25 bp, Mus musculus
acagaggaatggaggtggacattgc

SEQ ID NO: 173657 - DNA, 25 bp, Mus musculus
acagaggacaggctcacaactcagt

SEQ ID NO: 173658 - DNA, 25 bp, Mus musculus
acagaggagaggctggtgcacaagg

SEQ ID NO: 173659 - DNA, 25 bp, Mus musculus
acagaggagcagtgaaatatttcag

SEQ ID NO: 173660 - DNA, 25 bp, Mus musculus
acagaggagcagtgaggtaatgaca

SEQ ID NO: 173661 - DNA, 25 bp, Mus musculus
acagaggagcctcgagcatttagct

SEQ ID NO: 173662 - DNA, 25 bp, Mus musculus
acagaggaggagatacttctgacac

SEQ ID NO: 173663 - DNA, 25 bp, Mus musculus
acagaggaggagggaaaaagagaga

SEQ ID NO: 173664 - DNA, 25 bp, Mus musculus
acagaggatccagcaaccagacctc

SEQ ID NO: 173665 - DNA, 25 bp, Mus musculus
acagaggatccaggagctcgaacag

SEQ ID NO: 173666 - DNA, 25 bp, Mus musculus
acagaggatgaagtgaaacgcttcg

SEQ ID NO: 173667 - DNA, 25 bp, Mus musculus
acagaggatggctccccttccaatg

SEQ ID NO: 173668 - DNA, 25 bp, Mus musculus
acagaggatggctgttttaaaatca

SEQ ID NO: 173669 - DNA, 25 bp, Mus musculus
acagaggcagagcaggtgacggtgt

SEQ ID NO: 173670 - DNA, 25 bp, Mus musculus
acagaggcgtgcagatccaagcaag

SEQ ID NO: 173671 - DNA, 25 bp, Mus musculus
acagaggctctgcagactgcacaga

SEQ ID NO: 173672 - DNA, 25 bp, Mus musculus
acagaggctctgcagcatctcagct

SEQ ID NO: 173673 - DNA, 25 bp, Mus musculus
acagaggctctgcagcctgaagaac

SEQ ID NO: 173674 - DNA, 25 bp, Mus musculus
acagaggctgactgggtttaccagc

SEQ ID NO: 173675 - DNA, 25 bp, Mus musculus
acagaggctgtgggtctgcagctgt

SEQ ID NO: 173676 - DNA, 25 bp, Mus musculus
acagaggcttccagatgggaaccag

SEQ ID NO: 173677 - DNA, 25 bp, Mus musculus
acagaggcttccaggtcagaagcct

SEQ ID NO: 173678 - DNA, 25 bp, Mus musculus
acagaggggccggggcctgtgcagg

SEQ ID NO: 173679 - DNA, 25 bp, Mus musculus
acagagggggaggaagaaattgtca

SEQ ID NO: 173680 - DNA, 25 bp, Mus musculus
acagagggtaaggatcctgtttgaa

SEQ ID NO: 173681 - DNA, 25 bp, Mus musculus
acagagggtcagagagatggcacat

SEQ ID NO: 173682 - DNA, 25 bp, Mus musculus
acagagggtcagttccaggaagaca

SEQ ID NO: 173683 - DNA, 25 bp, Mus musculus
acagaggtttcacagagatgctgat

SEQ ID NO: 173684 - DNA, 25 bp, Mus musculus
acagagtaccactcattcggcgacg

SEQ ID NO: 173685 - DNA, 25 bp, Mus musculus
acagagtactgcagaaatatgccga

SEQ ID NO: 173686 - DNA, 25 bp, Mus musculus
acagagtacttgggaatcatgacca

SEQ ID NO: 173687 - DNA, 25 bp, Mus musculus
acagagtacttgggagctaggagac

SEQ ID NO: 173688 - DNA, 25 bp, Mus musculus
acagagtagctatggacgtggagga

SEQ ID NO: 173689 - DNA, 25 bp, Mus musculus
acagagtcattgattaggttatacc

SEQ ID NO: 173690 - DNA, 25 bp, Mus musculus
acagagtccaccgatttactaaatt

SEQ ID NO: 173691 - DNA, 25 bp, Mus musculus
acagagtccaccgttatatttcaga

SEQ ID NO: 173692 - DNA, 25 bp, Mus musculus
acagagtccatgagtttacaggaac

SEQ ID NO: 173693 - DNA, 25 bp, Mus musculus
acagagtccgggagactcgatctgc

SEQ ID NO: 173694 - DNA, 25 bp, Mus musculus
acagagtctcaggtggtccacaagg

SEQ ID NO: 173695 - DNA, 25 bp, Mus musculus
acagagtgactgtatacgacatttc

SEQ ID NO: 173696 - DNA, 25 bp, Mus musculus
acagagtgagagaatagaaccccca

SEQ ID NO: 173697 - DNA, 25 bp, Mus musculus
acagagtgagttactagagcccgtg

SEQ ID NO: 173698 - DNA, 25 bp, Mus musculus
acagagtgcaagggtagctaagaaa

SEQ ID NO: 173699 - DNA, 25 bp, Mus musculus
acagagtgcaaggtaaatctttatt

SEQ ID NO: 173700 - DNA, 25 bp, Mus musculus
acagagtgcagagtaaatccctgtc

SEQ ID NO: 173701 - DNA, 25 bp, Mus musculus
acagagtgtgtggaggagtgatggg

SEQ ID NO: 173702 - DNA, 25 bp, Mus musculus
acagagtgttttcagaatggcttcc

SEQ ID NO: 173703 - DNA, 25 bp, Mus musculus
acagagttaggaaaggaaagcactg

SEQ ID NO: 173704 - DNA, 25 bp, Mus musculus
acagagtttagggaggagcaaaaac

SEQ ID NO: 173705 - DNA, 25 bp, Mus musculus
acagagtttcaaggcaaacgaatgc

SEQ ID NO: 173706 - DNA, 25 bp, Mus musculus
acagagtttcaaggcagcagtgaat

SEQ ID NO: 173707 - DNA, 25 bp, Mus musculus
acagagtttcaaggtgggatgtgtg

SEQ ID NO: 173708 - DNA, 25 bp, Mus musculus
acagataaagaggactcacggagct

SEQ ID NO: 173709 - DNA, 25 bp, Mus musculus
acagataaagaggtgctaggacctc

SEQ ID NO: 173710 - DNA, 25 bp, Mus musculus
acagataaagagtgtgactggctca

SEQ ID NO: 173711 - DNA, 25 bp, Mus musculus
acagataacccaaggtggctggatc

SEQ ID NO: 173712 - DNA, 25 bp, Mus musculus
acagataacccagaggatcacctta

SEQ ID NO: 173713 - DNA, 25 bp, Mus musculus
acagataacccagtatcagtacttt

SEQ ID NO: 173714 - DNA, 25 bp, Mus musculus
acagataagaaagatggcttgccag

SEQ ID NO: 173715 - DNA, 25 bp, Mus musculus
acagataccagaccttcctgcgagt

SEQ ID NO: 173716 - DNA, 25 bp, Mus musculus
acagatacgaagaggaatcttttgt

SEQ ID NO: 173717 - DNA, 25 bp, Mus musculus
acagatacttctgtgagtgcaaaga

SEQ ID NO: 173718 - DNA, 25 bp, Mus musculus
acagatagaagaagaaaagcagcaa

SEQ ID NO: 173719 - DNA, 25 bp, Mus musculus
acagatagaagatcaacaacccctc

SEQ ID NO: 173720 - DNA, 25 bp, Mus musculus
acagatagagaaaaagtaaagacat

SEQ ID NO: 173721 - DNA, 25 bp, Mus musculus
acagatagagaaaagtacaacagaa

SEQ ID NO: 173722 - DNA, 25 bp, Mus musculus
acagatagagaaaccaactgaggtg

SEQ ID NO: 173723 - DNA, 25 bp, Mus musculus
acagatagcaaggagaaagaaaagt

SEQ ID NO: 173724 - DNA, 25 bp, Mus musculus
acagatagcaaggagggattttgaa

SEQ ID NO: 173725 - DNA, 25 bp, Mus musculus
acagatagcctaggttcaaccaggc

SEQ ID NO: 173726 - DNA, 25 bp, Mus musculus
acagatatagactcttcaagaaatc

SEQ ID NO: 173727 - DNA, 25 bp, Mus musculus
acagatatcctcagtgtttgtgcct

SEQ ID NO: 173728 - DNA, 25 bp, Mus musculus
acagatattcagcaagccccgccca

SEQ ID NO: 173729 - DNA, 25 bp, Mus musculus
acagatcaagaacctgctgggattg

SEQ ID NO: 173730 - DNA, 25 bp, Mus musculus
acagatcaagagattggtgagctcc

SEQ ID NO: 173731 - DNA, 25 bp, Mus musculus
acagatcaagaggcctgggattgat

SEQ ID NO: 173732 - DNA, 25 bp, Mus musculus
acagatcaagcgtctcagaataact

SEQ ID NO: 173733 - DNA, 25 bp, Mus musculus
acagatcacaagggttctcttggaa

SEQ ID NO: 173734 - DNA, 25 bp, Mus musculus
acagatcaccatcaatgagatcagt

SEQ ID NO: 173735 - DNA, 25 bp, Mus musculus
acagatcagaagcacaattatatga

SEQ ID NO: 173736 - DNA, 25 bp, Mus musculus
acagatcagaaggcttatggtagca

SEQ ID NO: 173737 - DNA, 25 bp, Mus musculus
acagatcagtatggtccatattgtg

SEQ ID NO: 173738 - DNA, 25 bp, Mus musculus
acagatcatgaagacagtaaagact

SEQ ID NO: 173739 - DNA, 25 bp, Mus musculus
acagatcatgaaggacatctgggtt

SEQ ID NO: 173740 - DNA, 25 bp, Mus musculus
acagatcatgaaggtacattttata

SEQ ID NO: 173741 - DNA, 25 bp, Mus musculus
acagatccagcaattcttggccaca

SEQ ID NO: 173742 - DNA, 25 bp, Mus musculus
acagatccagggagcatggcactct

SEQ ID NO: 173743 - DNA, 25 bp, Mus musculus
acagatccaggttcaggggcacatg

SEQ ID NO: 173744 - DNA, 25 bp, Mus musculus
acagatcccagccctgtccctagga

SEQ ID NO: 173745 - DNA, 25 bp, Mus musculus
acagatcgaagttaaaattgaagag

SEQ ID NO: 173746 - DNA, 25 bp, Mus musculus
acagatctcgctcaagaagtcctga

SEQ ID NO: 173747 - DNA, 25 bp, Mus musculus
acagatctctgtggcaaggattaat

SEQ ID NO: 173748 - DNA, 25 bp, Mus musculus
acagatctctgtgtggagctggcct

SEQ ID NO: 173749 - DNA, 25 bp, Mus musculus
acagatctgcagggcgacactcccc

SEQ ID NO: 173750 - DNA, 25 bp, Mus musculus
acagatcttcaaggcctgggctgtg

SEQ ID NO: 173751 - DNA, 25 bp, Mus musculus
acagatgaacctgtcctaaaggaaa

SEQ ID NO: 173752 - DNA, 25 bp, Mus musculus
acagatgaagagcaagtacagaact

SEQ ID NO: 173753 - DNA, 25 bp, Mus musculus
acagatgaagatcttcaggatttat

SEQ ID NO: 173754 - DNA, 25 bp, Mus musculus
acagatgacaggtctgaggagggcc

SEQ ID NO: 173755 - DNA, 25 bp, Mus musculus
acagatgagacgggcatagaacaat

SEQ ID NO: 173756 - DNA, 25 bp, Mus musculus
acagatgagacgggtattgaacgcc

SEQ ID NO: 173757 - DNA, 25 bp, Mus musculus
acagatgagagaaaacttttatcca

SEQ ID NO: 173758 - DNA, 25 bp, Mus musculus
acagatgagagaaaaggcctgctgg

SEQ ID NO: 173759 - DNA, 25 bp, Mus musculus
acagatgatatgctggacaaatttg

SEQ ID NO: 173760 - DNA, 25 bp, Mus musculus
acagatgatcaggagttagtgagct

SEQ ID NO: 173761 - DNA, 25 bp, Mus musculus
acagatgatggcgagtcattcgacg

SEQ ID NO: 173762 - DNA, 25 bp, Mus musculus
acagatgcaaagccgccatggatac

SEQ ID NO: 173763 - DNA, 25 bp, Mus musculus
acagatgcagacaggcttcgccggc

SEQ ID NO: 173764 - DNA, 25 bp, Mus musculus
acagatgcagacagtgtggcatcag

SEQ ID NO: 173765 - DNA, 25 bp, Mus musculus
acagatgccccaacaagggagaagc

SEQ ID NO: 173766 - DNA, 25 bp, Mus musculus
acagatgcgaagatgtggatgagtg

SEQ ID NO: 173767 - DNA, 25 bp, Mus musculus
acagatgcgaagttgtggatgagtg

SEQ ID NO: 173768 - DNA, 25 bp, Mus musculus
acagatgctgacatggtcaaccagt

SEQ ID NO: 173769 - DNA, 25 bp, Mus musculus
acagatggaagaaaagttcctagtc

SEQ ID NO: 173770 - DNA, 25 bp, Mus musculus
acagatggaatctgtctctctcctc

SEQ ID NO: 173771 - DNA, 25 bp, Mus musculus
acagatggagcaagtgatgacagac

SEQ ID NO: 173772 - DNA, 25 bp, Mus musculus
acagatggagccagagaacctacaa

SEQ ID NO: 173773 - DNA, 25 bp, Mus musculus
acagatggatacagccttccagaga

SEQ ID NO: 173774 - DNA, 25 bp, Mus musculus
acagatggcaaggagctttggaacc

SEQ ID NO: 173775 - DNA, 25 bp, Mus musculus
acagatggccaagggcactcaacgc

SEQ ID NO: 173776 - DNA, 25 bp, Mus musculus
acagatggccaagtcaagctgtgat

SEQ ID NO: 173777 - DNA, 25 bp, Mus musculus
acagatggctgacagatctcggcaa

SEQ ID NO: 173778 - DNA, 25 bp, Mus musculus
acagatggctgacagcttggatctg

SEQ ID NO: 173779 - DNA, 25 bp, Mus musculus
acagatgggacccaggctgccctgc

SEQ ID NO: 173780 - DNA, 25 bp, Mus musculus
acagatgggagtgaggtgacttctg

SEQ ID NO: 173781 - DNA, 25 bp, Mus musculus
acagatgggattcagaagataattg

SEQ ID NO: 173782 - DNA, 25 bp, Mus musculus
acagatgtcaggagccctgtcctgg

SEQ ID NO: 173783 - DNA, 25 bp, Mus musculus
acagatgtcagggttgtacctgact

SEQ ID NO: 173784 - DNA, 25 bp, Mus musculus
acagatgtcaggtttatgcgcatga

SEQ ID NO: 173785 - DNA, 25 bp, Mus musculus
acagatgtcagtcatcttcctctgt

SEQ ID NO: 173786 - DNA, 25 bp, Mus musculus
acagatgtcatgctgtgtgcaggag

SEQ ID NO: 173787 - DNA, 25 bp, Mus musculus
acagatgtgcacaggacattgccct

SEQ ID NO: 173788 - DNA, 25 bp, Mus musculus
acagatgtgcacaggctacattgct

SEQ ID NO: 173789 - DNA, 25 bp, Mus musculus
acagatgtgcagcttgaaggaggct

SEQ ID NO: 173790 - DNA, 25 bp, Mus musculus
acagatgtggtcgagaaaagacaac

SEQ ID NO: 173791 - DNA, 25 bp, Mus musculus
acagatgtggtcgagttgcagtaat

SEQ ID NO: 173792 - DNA, 25 bp, Mus musculus
acagatgttcatgataggagacaaa

SEQ ID NO: 173793 - DNA, 25 bp, Mus musculus
acagatgttcatgggactttcagtt

SEQ ID NO: 173794 - DNA, 25 bp, Mus musculus
acagatgttctgcgccccactcacc

SEQ ID NO: 173795 - DNA, 25 bp, Mus musculus
acagatgttctggccaacctctccc

SEQ ID NO: 173796 - DNA, 25 bp, Mus musculus
acagatgttttccaggaggtggtgt

SEQ ID NO: 173797 - DNA, 25 bp, Mus musculus
acagattaaacaagccgctgcgcct

SEQ ID NO: 173798 - DNA, 25 bp, Mus musculus
acagattaaacaaggctggagccag

SEQ ID NO: 173799 - DNA, 25 bp, Mus musculus
acagattatccagaggagacagcac

SEQ ID NO: 173800 - DNA, 25 bp, Mus musculus
acagattatctttataggctgaagg

SEQ ID NO: 173801 - DNA, 25 bp, Mus musculus
acagattcagagcctctctcccagc

SEQ ID NO: 173802 - DNA, 25 bp, Mus musculus
acagattcagcagcagcaacagcag

SEQ ID NO: 173803 - DNA, 25 bp, Mus musculus
acagattcaggcttccagttcacgt

SEQ ID NO: 173804 - DNA, 25 bp, Mus musculus
acagattgagcagctctatgccgct

SEQ ID NO: 173805 - DNA, 25 bp, Mus musculus
acagattgctaaaagtactattaat

SEQ ID NO: 173806 - DNA, 25 bp, Mus musculus
acagattgctaaagaccagagtaat

SEQ ID NO: 173807 - DNA, 25 bp, Mus musculus
acagattgctaaagcagtgggaact

SEQ ID NO: 173808 - DNA, 25 bp, Mus musculus
acagattgctctgccatcacctgtt

SEQ ID NO: 173809 - DNA, 25 bp, Mus musculus
acagatttaagagtttgtttctaat

SEQ ID NO: 173810 - DNA, 25 bp, Mus musculus
acagatttaagcttccttccactgt

SEQ ID NO: 173811 - DNA, 25 bp, Mus musculus
acagatttacaaagttgcttcagat

SEQ ID NO: 173812 - DNA, 25 bp, Mus musculus
acagatttcacgtgtcaccatgctg

SEQ ID NO: 173813 - DNA, 25 bp, Mus musculus
acagatttgagccgaggattaacac

SEQ ID NO: 173814 - DNA, 25 bp, Mus musculus
acagatttttctgggattgggtcga

SEQ ID NO: 173815 - DNA, 25 bp, Mus musculus
acagatttttctgggcccctgatga

SEQ ID NO: 173816 - DNA, 25 bp, Mus musculus
acagatttttttctatctgcccgcg

SEQ ID NO: 173817 - DNA, 25 bp, Mus musculus
acagcaaaataggaaacctcgtgtt

SEQ ID NO: 173818 - DNA, 25 bp, Mus musculus
acagcaaaataggacggaaagttat

SEQ ID NO: 173819 - DNA, 25 bp, Mus musculus
acagcaaacagagccctttgccatg

SEQ ID NO: 173820 - DNA, 25 bp, Mus musculus
acagcaaacagatgcgtgtacatcc

SEQ ID NO: 173821 - DNA, 25 bp, Mus musculus
acagcaaacagccatttcgtagagt

SEQ ID NO: 173822 - DNA, 25 bp, Mus musculus
acagcaaacgaggcctaagtcaccc

SEQ ID NO: 173823 - DNA, 25 bp, Mus musculus
acagcaaacggctgtccctcctccc

SEQ ID NO: 173824 - DNA, 25 bp, Mus musculus
acagcaaagaaaggcctcctggaac

SEQ ID NO: 173825 - DNA, 25 bp, Mus musculus
acagcaaagcgcaggctatgaagtt

SEQ ID NO: 173826 - DNA, 25 bp, Mus musculus
acagcaaaggcacccggattctgga

SEQ ID NO: 173827 - DNA, 25 bp, Mus musculus
acagcaaagtacaggtgttgctgga

SEQ ID NO: 173828 - DNA, 25 bp, Mus musculus
acagcaaataaggagacagtgatgg

SEQ ID NO: 173829 - DNA, 25 bp, Mus musculus
acagcaaattcaactacagtgggag

SEQ ID NO: 173830 - DNA, 25 bp, Mus musculus
acagcaacaactgtcccaggtcttt

SEQ ID NO: 173831 - DNA, 25 bp, Mus musculus
acagcaacaagcttgtagaggagtt

SEQ ID NO: 173832 - DNA, 25 bp, Mus musculus
acagcaacagccttctacttctaca

SEQ ID NO: 173833 - DNA, 25 bp, Mus musculus
acagcaacatcaggtctcggacaaa

SEQ ID NO: 173834 - DNA, 25 bp, Mus musculus
acagcaacatgaaatgtgtctaaac

SEQ ID NO: 173835 - DNA, 25 bp, Mus musculus
acagcaacgaccctgaggacggggc

SEQ ID NO: 173836 - DNA, 25 bp, Mus musculus
acagcaacgctaggttcggagcgac

SEQ ID NO: 173837 - DNA, 25 bp, Mus musculus
acagcaacgttttacaaacctgaag

SEQ ID NO: 173838 - DNA, 25 bp, Mus musculus
acagcaactaggcatgaagcactac

SEQ ID NO: 173839 - DNA, 25 bp, Mus musculus
acagcaagatccaccaatgtttccc

SEQ ID NO: 173840 - DNA, 25 bp, Mus musculus
acagcaagcacatcgtatggcgccc

SEQ ID NO: 173841 - DNA, 25 bp, Mus musculus
acagcaagcggaatatctccatgca

SEQ ID NO: 173842 - DNA, 25 bp, Mus musculus
acagcaagcggatttcccttttcta

SEQ ID NO: 173843 - DNA, 25 bp, Mus musculus
acagcaagcggttcagcagaggaca

SEQ ID NO: 173844 - DNA, 25 bp, Mus musculus
acagcaatgtgtgggttgaatttac

SEQ ID NO: 173845 - DNA, 25 bp, Mus musculus
acagcacaaataatagtgcttacag

SEQ ID NO: 173846 - DNA, 25 bp, Mus musculus
acagcacaataaaacccaagcaact

SEQ ID NO: 173847 - DNA, 25 bp, Mus musculus
acagcacacaggcagaggtgttaaa

SEQ ID NO: 173848 - DNA, 25 bp, Mus musculus
acagcacactagaaaccccatttcc

SEQ ID NO: 173849 - DNA, 25 bp, Mus musculus
acagcacaggctaaataaaacggaa

SEQ ID NO: 173850 - DNA, 25 bp, Mus musculus
acagcacaggttaccagtgcagaat

SEQ ID NO: 173851 - DNA, 25 bp, Mus musculus
acagcacaggttgctggttgttgga

SEQ ID NO: 173852 - DNA, 25 bp, Mus musculus
acagcaccaagatatcattaatgga

SEQ ID NO: 173853 - DNA, 25 bp, Mus musculus
acagcaccaaggaggagacagcctg

SEQ ID NO: 173854 - DNA, 25 bp, Mus musculus
acagcaccatcaatggtgcagtgca

SEQ ID NO: 173855 - DNA, 25 bp, Mus musculus
acagcaccatcaatgttgcctaatg

SEQ ID NO: 173856 - DNA, 25 bp, Mus musculus
acagcacccaccatcccctgcccct

SEQ ID NO: 173857 - DNA, 25 bp, Mus musculus
acagcacccagcatgaggagctgaa

SEQ ID NO: 173858 - DNA, 25 bp, Mus musculus
acagcacccctttgagcccgctgtg

SEQ ID NO: 173859 - DNA, 25 bp, Mus musculus
acagcacccctttgtactatgcctg

SEQ ID NO: 173860 - DNA, 25 bp, Mus musculus
acagcacccttatcttcaaagtgca

SEQ ID NO: 173861 - DNA, 25 bp, Mus musculus
acagcaccctttcacaccggaactt

SEQ ID NO: 173862 - DNA, 25 bp, Mus musculus
acagcacgaagtcacgagcttcgtt

SEQ ID NO: 173863 - DNA, 25 bp, Mus musculus
acagcactaacaggaatgcagaaac

SEQ ID NO: 173864 - DNA, 25 bp, Mus musculus
acagcactgtggttggctgggaccc

SEQ ID NO: 173865 - DNA, 25 bp, Mus musculus
acagcactgtggttggtgagcgggg

SEQ ID NO: 173866 - DNA, 25 bp, Mus musculus
acagcagaaacagagatagccagca

SEQ ID NO: 173867 - DNA, 25 bp, Mus musculus
acagcagaaacagagtgctactgtc

SEQ ID NO: 173868 - DNA, 25 bp, Mus musculus
acagcagaaagagcacagagaaccc

SEQ ID NO: 173869 - DNA, 25 bp, Mus musculus
acagcagaaagaggagttcgtgagt

SEQ ID NO: 173870 - DNA, 25 bp, Mus musculus
acagcagaaagctggtttattgcag

SEQ ID NO: 173871 - DNA, 25 bp, Mus musculus
acagcagaagaggaccacgacttct

SEQ ID NO: 173872 - DNA, 25 bp, Mus musculus
acagcagaaggtagagcttgagatg

SEQ ID NO: 173873 - DNA, 25 bp, Mus musculus
acagcagacacagtccggttctcca

SEQ ID NO: 173874 - DNA, 25 bp, Mus musculus
acagcagacactcatcagcctgaag

SEQ ID NO: 173875 - DNA, 25 bp, Mus musculus
acagcagacagaagtgggagcagat

SEQ ID NO: 173876 - DNA, 25 bp, Mus musculus
acagcagagagagggagttgaggat

SEQ ID NO: 173877 - DNA, 25 bp, Mus musculus
acagcagagagagttggatgaaaaa

SEQ ID NO: 173878 - DNA, 25 bp, Mus musculus
acagcagagattgtatgtttatcat

SEQ ID NO: 173879 - DNA, 25 bp, Mus musculus
acagcagagcaagagacgaattatc

SEQ ID NO: 173880 - DNA, 25 bp, Mus musculus
acagcagagcaggtgaagagaagga

SEQ ID NO: 173881 - DNA, 25 bp, Mus musculus
acagcagatattttgcttttagata

SEQ ID NO: 173882 - DNA, 25 bp, Mus musculus
acagcagatctggatccctagcccc

SEQ ID NO: 173883 - DNA, 25 bp, Mus musculus
acagcagatgctggacatccaggca

SEQ ID NO: 173884 - DNA, 25 bp, Mus musculus
acagcagcacctggctgactgcctt

SEQ ID NO: 173885 - DNA, 25 bp, Mus musculus
acagcagcacggatgatgttgcctc

SEQ ID NO: 173886 - DNA, 25 bp, Mus musculus
acagcagcagcagcaacagcaacag

SEQ ID NO: 173887 - DNA, 25 bp, Mus musculus
acagcagcagcgcaacgaagttcag

SEQ ID NO: 173888 - DNA, 25 bp, Mus musculus
acagcagcaggaaaatgggaaggag

SEQ ID NO: 173889 - DNA, 25 bp, Mus musculus
acagcagcagggcacgtcagaggcc

SEQ ID NO: 173890 - DNA, 25 bp, Mus musculus
acagcagcagtgtgaggatgacccg

SEQ ID NO: 173891 - DNA, 25 bp, Mus musculus
acagcagcccagtgtcacgagcaag

SEQ ID NO: 173892 - DNA, 25 bp, Mus musculus
acagcagccgcccctgccttagact

SEQ ID NO: 173893 - DNA, 25 bp, Mus musculus
acagcagcgcccggacgtcctcccc

SEQ ID NO: 173894 - DNA, 25 bp, Mus musculus
acagcagcggcgagagatgctcaga

SEQ ID NO: 173895 - DNA, 25 bp, Mus musculus
acagcagctcccaggaggttcatga

SEQ ID NO: 173896 - DNA, 25 bp, Mus musculus
acagcagctgctgaccacactgggt

SEQ ID NO: 173897 - DNA, 25 bp, Mus musculus
acagcagctgctggcaggctgcatg

SEQ ID NO: 173898 - DNA, 25 bp, Mus musculus
acagcagctggaactcattatacaa

SEQ ID NO: 173899 - DNA, 25 bp, Mus musculus
acagcagctgtaaggagcttcaccc

SEQ ID NO: 173900 - DNA, 25 bp, Mus musculus
acagcaggaacgattcaatcccaag

SEQ ID NO: 173901 - DNA, 25 bp, Mus musculus
acagcaggaacgtatatgactgctg

SEQ ID NO: 173902 - DNA, 25 bp, Mus musculus
acagcaggaagacaggaagatctgt

SEQ ID NO: 173903 - DNA, 25 bp, Mus musculus
acagcaggaaggaaagaaaggagag

SEQ ID NO: 173904 - DNA, 25 bp, Mus musculus
acagcaggaaggaggatgctgtcct

SEQ ID NO: 173905 - DNA, 25 bp, Mus musculus
acagcaggaagggtgagtttttctc

SEQ ID NO: 173906 - DNA, 25 bp, Mus musculus
acagcaggacaaagaccaaggatta

SEQ ID NO: 173907 - DNA, 25 bp, Mus musculus
acagcaggacaaagagactgcatcg

SEQ ID NO: 173908 - DNA, 25 bp, Mus musculus
acagcaggagatagggtttcaagtc

SEQ ID NO: 173909 - DNA, 25 bp, Mus musculus
acagcaggagttcaagaacgccaat

SEQ ID NO: 173910 - DNA, 25 bp, Mus musculus
acagcaggagttgaggacctgttta

SEQ ID NO: 173911 - DNA, 25 bp, Mus musculus
acagcaggatgtcgatcagatgttt

SEQ ID NO: 173912 - DNA, 25 bp, Mus musculus
acagcaggctacagtcagttctaca

SEQ ID NO: 173913 - DNA, 25 bp, Mus musculus
acagcaggctacagtgactttttca

SEQ ID NO: 173914 - DNA, 25 bp, Mus musculus
acagcagggagcaggatatggttac

SEQ ID NO: 173915 - DNA, 25 bp, Mus musculus
acagcagggcaggatgagtacagca

SEQ ID NO: 173916 - DNA, 25 bp, Mus musculus
acagcaggtggatgcagtgaccttt

SEQ ID NO: 173917 - DNA, 25 bp, Mus musculus
acagcagtcactgctggggttcgaa

SEQ ID NO: 173918 - DNA, 25 bp, Mus musculus
acagcagtccaagaaaacatcgctc

SEQ ID NO: 173919 - DNA, 25 bp, Mus musculus
acagcagtccaagatctgatgtttt

SEQ ID NO: 173920 - DNA, 25 bp, Mus musculus
acagcagtccaagcgctctctcaga

SEQ ID NO: 173921 - DNA, 25 bp, Mus musculus
acagcagtcccagcgcttcccgagc

SEQ ID NO: 173922 - DNA, 25 bp, Mus musculus
acagcagtgggaccaggatggaaac

SEQ ID NO: 173923 - DNA, 25 bp, Mus musculus
acagcagtgtaaagatattgatgaa

SEQ ID NO: 173924 - DNA, 25 bp, Mus musculus
acagcagttgaaaggagaggatgct

SEQ ID NO: 173925 - DNA, 25 bp, Mus musculus
acagcagttgcaaggactggaccag

SEQ ID NO: 173926 - DNA, 25 bp, Mus musculus
acagcagttgcaaggtaacctccgt

SEQ ID NO: 173927 - DNA, 25 bp, Mus musculus
acagcataaacgatatgtgtcacaa

SEQ ID NO: 173928 - DNA, 25 bp, Mus musculus
acagcataaggcttgctcttcagct

SEQ ID NO: 173929 - DNA, 25 bp, Mus musculus
acagcatacaagacgagaaggacat

SEQ ID NO: 173930 - DNA, 25 bp, Mus musculus
acagcatacaagtcctcaagggccc

SEQ ID NO: 173931 - DNA, 25 bp, Mus musculus
acagcataggtccctcactctcccc

SEQ ID NO: 173932 - DNA, 25 bp, Mus musculus
acagcatcaaaatgccaggcaggct

SEQ ID NO: 173933 - DNA, 25 bp, Mus musculus
acagcatcaaacaatttgtcgtcct

SEQ ID NO: 173934 - DNA, 25 bp, Mus musculus
acagcatcaaacatggaggaatcgt

SEQ ID NO: 173935 - DNA, 25 bp, Mus musculus
acagcatcaaagcctgctcccagtg

SEQ ID NO: 173936 - DNA, 25 bp, Mus musculus
acagcatcaaggacaattcaagctt

SEQ ID NO: 173937 - DNA, 25 bp, Mus musculus
acagcatcaaggcctgggaggagtt

SEQ ID NO: 173938 - DNA, 25 bp, Mus musculus
acagcatcaaggtggcccggcagat

SEQ ID NO: 173939 - DNA, 25 bp, Mus musculus
acagcatcactcaaggagaagctgt

SEQ ID NO: 173940 - DNA, 25 bp, Mus musculus
acagcatcaggattgctgaaagaca

SEQ ID NO: 173941 - DNA, 25 bp, Mus musculus
acagcatcccctaggacccccactc

SEQ ID NO: 173942 - DNA, 25 bp, Mus musculus
acagcatcccctagggagctccggg

SEQ ID NO: 173943 - DNA, 25 bp, Mus musculus
acagcatccgaacttttgtgagccc

SEQ ID NO: 173944 - DNA, 25 bp, Mus musculus
acagcatcgtgggagggaatagcca

SEQ ID NO: 173945 - DNA, 25 bp, Mus musculus
acagcatgactgtgtgtccattgtc

SEQ ID NO: 173946 - DNA, 25 bp, Mus musculus
acagcatgcgggaggaggacttcat

SEQ ID NO: 173947 - DNA, 25 bp, Mus musculus
acagcatggcagaggctcctcttcc

SEQ ID NO: 173948 - DNA, 25 bp, Mus musculus
acagcattaacaggagaagggaaga

SEQ ID NO: 173949 - DNA, 25 bp, Mus musculus
acagcattaaggctcggctattagc

SEQ ID NO: 173950 - DNA, 25 bp, Mus musculus
acagcattactcagagaaagctgat

SEQ ID NO: 173951 - DNA, 25 bp, Mus musculus
acagcattactcagagagagccgca

SEQ ID NO: 173952 - DNA, 25 bp, Mus musculus
acagcattcagacaagattttcgaa

SEQ ID NO: 173953 - DNA, 25 bp, Mus musculus
acagcattcttaatttaccgagaga

SEQ ID NO: 173954 - DNA, 25 bp, Mus musculus
acagcattgcccaggtgcactggag

SEQ ID NO: 173955 - DNA, 25 bp, Mus musculus
acagcattgctgaggttgaaaatga

SEQ ID NO: 173956 - DNA, 25 bp, Mus musculus
acagcattgtgagagctgtggaacg

SEQ ID NO: 173957 - DNA, 25 bp, Mus musculus
acagcattgtgagagtgaaaagctt

SEQ ID NO: 173958 - DNA, 25 bp, Mus musculus
acagccaaagaaaactaactgctta

SEQ ID NO: 173959 - DNA, 25 bp, Mus musculus
acagccaaagatcggaaccgctggg

SEQ ID NO: 173960 - DNA, 25 bp, Mus musculus
acagccaacaaatgcctcaaggaga

SEQ ID NO: 173961 - DNA, 25 bp, Mus musculus
acagccaacagagcttggccagagt

SEQ ID NO: 173962 - DNA, 25 bp, Mus musculus
acagccaacaggtcagaccaagcca

SEQ ID NO: 173963 - DNA, 25 bp, Mus musculus
acagccaaccagatacccataatat

SEQ ID NO: 173964 - DNA, 25 bp, Mus musculus
acagccaaggaggcaccgagatgga

SEQ ID NO: 173965 - DNA, 25 bp, Mus musculus
acagccaagggatttgaattaatcg

SEQ ID NO: 173966 - DNA, 25 bp, Mus musculus
acagccaatcagataattctgaaat

SEQ ID NO: 173967 - DNA, 25 bp, Mus musculus
acagccacagccgcgaccatagtct

SEQ ID NO: 173968 - DNA, 25 bp, Mus musculus
acagccacagccgcgcctggtgcag

SEQ ID NO: 173969 - DNA, 25 bp, Mus musculus
acagccaccaaggtgacagcttcct

SEQ ID NO: 173970 - DNA, 25 bp, Mus musculus
acagccaccaccacctcctcgccct

SEQ ID NO: 173971 - DNA, 25 bp, Mus musculus
acagccaccgagactccagacctcg

SEQ ID NO: 173972 - DNA, 25 bp, Mus musculus
acagccaccgagccgtcaagctgaa

SEQ ID NO: 173973 - DNA, 25 bp, Mus musculus
acagccactgaaagactcgccagtg

SEQ ID NO: 173974 - DNA, 25 bp, Mus musculus
acagccagaacccagctaacagaga

SEQ ID NO: 173975 - DNA, 25 bp, Mus musculus
acagccagaagaattggctggaccc

SEQ ID NO: 173976 - DNA, 25 bp, Mus musculus
acagccagaagagatcctcagctct

SEQ ID NO: 173977 - DNA, 25 bp, Mus musculus
acagccagaagagccatggcgagtg

SEQ ID NO: 173978 - DNA, 25 bp, Mus musculus
acagccagaaggtagcccctggaac

SEQ ID NO: 173979 - DNA, 25 bp, Mus musculus
acagccagaggaacagatggagtcg

SEQ ID NO: 173980 - DNA, 25 bp, Mus musculus
acagccagaggcagagtgaagaaat

SEQ ID NO: 173981 - DNA, 25 bp, Mus musculus
acagccagatgaatagagaagaaga

SEQ ID NO: 173982 - DNA, 25 bp, Mus musculus
acagccagatttgaccaagctgcac

SEQ ID NO: 173983 - DNA, 25 bp, Mus musculus
acagccagcaagaaaccgaagaaaa

SEQ ID NO: 173984 - DNA, 25 bp, Mus musculus
acagccagcaccagcactgcccccc

SEQ ID NO: 173985 - DNA, 25 bp, Mus musculus
acagccagctggctttttctaaaag

SEQ ID NO: 173986 - DNA, 25 bp, Mus musculus
acagccagctgttgaggaccctgtc

SEQ ID NO: 173987 - DNA, 25 bp, Mus musculus
acagccaggaggctctgcagaagct

SEQ ID NO: 173988 - DNA, 25 bp, Mus musculus
acagccaggatctgagtgttcgaga

SEQ ID NO: 173989 - DNA, 25 bp, Mus musculus
acagccaggatgaggtagatgactt

SEQ ID NO: 173990 - DNA, 25 bp, Mus musculus
acagccaggcgtcccaaaaagcctc

SEQ ID NO: 173991 - DNA, 25 bp, Mus musculus
acagccaggtaccaggatttccaat

SEQ ID NO: 173992 - DNA, 25 bp, Mus musculus
acagccaggtaccaggcatacttct

SEQ ID NO: 173993 - DNA, 25 bp, Mus musculus
acagccagtccagtagctccatcaa

SEQ ID NO: 173994 - DNA, 25 bp, Mus musculus
acagccagtccgggaacccagtgca

SEQ ID NO: 173995 - DNA, 25 bp, Mus musculus
acagccagtccgtaaaagctctttg

SEQ ID NO: 173996 - DNA, 25 bp, Mus musculus
acagccagtgagccatgaggctggc

SEQ ID NO: 173997 - DNA, 25 bp, Mus musculus
acagccagtggaggtccaggttcct

SEQ ID NO: 173998 - DNA, 25 bp, Mus musculus
acagccatcgggtgggaaaatggca

SEQ ID NO: 173999 - DNA, 25 bp, Mus musculus
acagccatcttgcttcctcacaaag

SEQ ID NO: 174000 - DNA, 25 bp, Mus musculus
acagccatgagcctcagggctaatt

SEQ ID NO: 174001 - DNA, 25 bp, Mus musculus
acagccatgatgattgtgggttctg

SEQ ID NO: 174002 - DNA, 25 bp, Mus musculus
acagccatgcggcttctccatgatc

SEQ ID NO: 174003 - DNA, 25 bp, Mus musculus
acagccatgctgagcttcttgatgc

SEQ ID NO: 174004 - DNA, 25 bp, Mus musculus
acagccatgctgtcaatcaactgaa

SEQ ID NO: 174005 - DNA, 25 bp, Mus musculus
acagccatggatgtgcagcagccgc

SEQ ID NO: 174006 - DNA, 25 bp, Mus musculus
acagccatggcgcccaggaggacac

SEQ ID NO: 174007 - DNA, 25 bp, Mus musculus
acagccatggcggccaggaggacac

SEQ ID NO: 174008 - DNA, 25 bp, Mus musculus
acagccatggctgtgtgcaatagca

SEQ ID NO: 174009 - DNA, 25 bp, Mus musculus
acagccatggggaaccagcctgagg

SEQ ID NO: 174010 - DNA, 25 bp, Mus musculus
acagccattgttcaggctccaggcc

SEQ ID NO: 174011 - DNA, 25 bp, Mus musculus
acagcccaaaggatgactcaaagcc

SEQ ID NO: 174012 - DNA, 25 bp, Mus musculus
acagcccaaaggtcctctgacacta

SEQ ID NO: 174013 - DNA, 25 bp, Mus musculus
acagcccaaagtctgacactacaac

SEQ ID NO: 174014 - DNA, 25 bp, Mus musculus
acagcccaagcagccacctagatca

SEQ ID NO: 174015 - DNA, 25 bp, Mus musculus
acagcccaagcgaaccccagctgaa

SEQ ID NO: 174016 - DNA, 25 bp, Mus musculus
acagcccaaggaggctcgaagcacc

SEQ ID NO: 174017 - DNA, 25 bp, Mus musculus
acagcccaatggtgcaggtttcgcc

SEQ ID NO: 174018 - DNA, 25 bp, Mus musculus
acagcccaatggtttcgccacgttt

SEQ ID NO: 174019 - DNA, 25 bp, Mus musculus
acagcccagatgttctccgccatga

SEQ ID NO: 174020 - DNA, 25 bp, Mus musculus
acagcccatgagcagatgaacgaat

SEQ ID NO: 174021 - DNA, 25 bp, Mus musculus
acagccccaccaagctcagtaacaa

SEQ ID NO: 174022 - DNA, 25 bp, Mus musculus
acagccccacgccaggattacatct

SEQ ID NO: 174023 - DNA, 25 bp, Mus musculus
acagccccactagagtgcggccaag

SEQ ID NO: 174024 - DNA, 25 bp, Mus musculus
acagccccagatcacagccatgaac

SEQ ID NO: 174025 - DNA, 25 bp, Mus musculus
acagccccagcgagacagaggctta

SEQ ID NO: 174026 - DNA, 25 bp, Mus musculus
acagccccagcgagagctagctgag

SEQ ID NO: 174027 - DNA, 25 bp, Mus musculus
acagccccagcgagtccttcgggga

SEQ ID NO: 174028 - DNA, 25 bp, Mus musculus
acagccccaggccagcagaggagcc

SEQ ID NO: 174029 - DNA, 25 bp, Mus musculus
acagccccaggtggtgatgaagcat

SEQ ID NO: 174030 - DNA, 25 bp, Mus musculus
acagccccagtgctctctctgtgtt

SEQ ID NO: 174031 - DNA, 25 bp, Mus musculus
acagccccagttcacagccatgaac

SEQ ID NO: 174032 - DNA, 25 bp, Mus musculus
acagcccccactatcttgcctcatc

SEQ ID NO: 174033 - DNA, 25 bp, Mus musculus
acagcccccactcactcgcctcgct

SEQ ID NO: 174034 - DNA, 25 bp, Mus musculus
acagcccccactgtccaggtgctgt

SEQ ID NO: 174035 - DNA, 25 bp, Mus musculus
acagcccccagcccagtgcactaag

SEQ ID NO: 174036 - DNA, 25 bp, Mus musculus
acagcccccagctcgtagtgcatgt

SEQ ID NO: 174037 - DNA, 25 bp, Mus musculus
acagccccctggcaggttcagagca

SEQ ID NO: 174038 - DNA, 25 bp, Mus musculus
acagccccgcagacactgggttccc

SEQ ID NO: 174039 - DNA, 25 bp, Mus musculus
acagcccctttgacactcctcagat

SEQ ID NO: 174040 - DNA, 25 bp, Mus musculus
acagcccgaaagaccacaactcgac

SEQ ID NO: 174041 - DNA, 25 bp, Mus musculus
acagcccgatgccaaaatccaacaa

SEQ ID NO: 174042 - DNA, 25 bp, Mus musculus
acagcccgatgccaaaattccacca

SEQ ID NO: 174043 - DNA, 25 bp, Mus musculus
acagcccgccggtggcagctgacca

SEQ ID NO: 174044 - DNA, 25 bp, Mus musculus
acagccctatgaggtgccattgaca

SEQ ID NO: 174045 - DNA, 25 bp, Mus musculus
acagccctctcaggttgtctcaact

SEQ ID NO: 174046 - DNA, 25 bp, Mus musculus
acagccctgcaccagagaaatcata

SEQ ID NO: 174047 - DNA, 25 bp, Mus musculus
acagccctgcaccaggcctgtattg

SEQ ID NO: 174048 - DNA, 25 bp, Mus musculus
acagccctgcctaccctaacccaga

SEQ ID NO: 174049 - DNA, 25 bp, Mus musculus
acagccctgcgggataagaagtatg

SEQ ID NO: 174050 - DNA, 25 bp, Mus musculus
acagccctggctgggggatgggctc

SEQ ID NO: 174051 - DNA, 25 bp, Mus musculus
acagcccttcagccagtactgtccc

SEQ ID NO: 174052 - DNA, 25 bp, Mus musculus
acagcccttcccttggtatgtctac

SEQ ID NO: 174053 - DNA, 25 bp, Mus musculus
acagccgaggagggatccaagaacc

SEQ ID NO: 174054 - DNA, 25 bp, Mus musculus
acagccgaggagggtatttcctggt

SEQ ID NO: 174055 - DNA, 25 bp, Mus musculus
acagccgagttcagattctccgagt

SEQ ID NO: 174056 - DNA, 25 bp, Mus musculus
acagccgagttcagggaacagattc

SEQ ID NO: 174057 - DNA, 25 bp, Mus musculus
acagccgcagccttaccagccagcc

SEQ ID NO: 174058 - DNA, 25 bp, Mus musculus
acagccgcagcgtcctcagaatggt

SEQ ID NO: 174059 - DNA, 25 bp, Mus musculus
acagccgctgaagatgtgcctcatc

SEQ ID NO: 174060 - DNA, 25 bp, Mus musculus
acagccgcttcggcattctggaatt

SEQ ID NO: 174061 - DNA, 25 bp, Mus musculus
acagccgtccagacggtgcagagac

SEQ ID NO: 174062 - DNA, 25 bp, Mus musculus
acagccgtccagcacttccacgtgc

SEQ ID NO: 174063 - DNA, 25 bp, Mus musculus
acagccgtgtagtttccatttattt

SEQ ID NO: 174064 - DNA, 25 bp, Mus musculus
acagcctaaaaaagcattcaactcg

SEQ ID NO: 174065 - DNA, 25 bp, Mus musculus
acagcctaagatggtcactcggacg

SEQ ID NO: 174066 - DNA, 25 bp, Mus musculus
acagcctacggtggatcatgggctc

SEQ ID NO: 174067 - DNA, 25 bp, Mus musculus
acagcctagaacaggcagcagaaga

SEQ ID NO: 174068 - DNA, 25 bp, Mus musculus
acagcctagcgggtgcaaagaaatg

SEQ ID NO: 174069 - DNA, 25 bp, Mus musculus
acagcctcagatgaaatcatgcacc

SEQ ID NO: 174070 - DNA, 25 bp, Mus musculus
acagcctcccactggttatagcact

SEQ ID NO: 174071 - DNA, 25 bp, Mus musculus
acagcctcccactgtagaagggacc

SEQ ID NO: 174072 - DNA, 25 bp, Mus musculus
acagcctcctcgaggctgtgtgact

SEQ ID NO: 174073 - DNA, 25 bp, Mus musculus
acagcctcgactgaccctgactgca

SEQ ID NO: 174074 - DNA, 25 bp, Mus musculus
acagcctctaccccctgctgaatga

SEQ ID NO: 174075 - DNA, 25 bp, Mus musculus
acagcctctacccccttcctgccca

SEQ ID NO: 174076 - DNA, 25 bp, Mus musculus
acagcctctccaggggaaaataagt

SEQ ID NO: 174077 - DNA, 25 bp, Mus musculus
acagcctctccagttcctttgtccc

SEQ ID NO: 174078 - DNA, 25 bp, Mus musculus
acagcctctctggtacatggcttct

SEQ ID NO: 174079 - DNA, 25 bp, Mus musculus
acagcctctggatttatcacttttt

SEQ ID NO: 174080 - DNA, 25 bp, Mus musculus
acagcctgaggagacgcagaggcag

SEQ ID NO: 174081 - DNA, 25 bp, Mus musculus
acagcctgatgaaaatgcctttgag

SEQ ID NO: 174082 - DNA, 25 bp, Mus musculus
acagcctgatgaaagcatctgtggc

SEQ ID NO: 174083 - DNA, 25 bp, Mus musculus
acagcctgcagccagccaggacccc

SEQ ID NO: 174084 - DNA, 25 bp, Mus musculus
acagcctgcaggatgctttgctgag

SEQ ID NO: 174085 - DNA, 25 bp, Mus musculus
acagcctgccacaggaagagagctc

SEQ ID NO: 174086 - DNA, 25 bp, Mus musculus
acagcctgggcatatggcctccatc

SEQ ID NO: 174087 - DNA, 25 bp, Mus musculus
acagcctgtgaccatctttggagag

SEQ ID NO: 174088 - DNA, 25 bp, Mus musculus
acagcctgtgctcattgcccactgt

SEQ ID NO: 174089 - DNA, 25 bp, Mus musculus
acagcctgtgtggctcaagtggcct

SEQ ID NO: 174090 - DNA, 25 bp, Mus musculus
acagcctgtgtgggcctgggacttt

SEQ ID NO: 174091 - DNA, 25 bp, Mus musculus
acagccttaccctgattaacctggc

SEQ ID NO: 174092 - DNA, 25 bp, Mus musculus
acagccttactggggtttggaaata

SEQ ID NO: 174093 - DNA, 25 bp, Mus musculus
acagccttagctaccgccaccagaa

SEQ ID NO: 174094 - DNA, 25 bp, Mus musculus
acagccttcaaagaatgtctgtaag

SEQ ID NO: 174095 - DNA, 25 bp, Mus musculus
acagccttcaggagcgggcctgtgt

SEQ ID NO: 174096 - DNA, 25 bp, Mus musculus
acagccttcaggaggtatgctgctt

SEQ ID NO: 174097 - DNA, 25 bp, Mus musculus
acagccttcttttatgaggtctccc

SEQ ID NO: 174098 - DNA, 25 bp, Mus musculus
acagccttcttttgacccacataat

SEQ ID NO: 174099 - DNA, 25 bp, Mus musculus
acagccttggcgcggactggtatcc

SEQ ID NO: 174100 - DNA, 25 bp, Mus musculus
acagcgaagccgaagtcttactcct

SEQ ID NO: 174101 - DNA, 25 bp, Mus musculus
acagcgaagccggagactatctggt

SEQ ID NO: 174102 - DNA, 25 bp, Mus musculus
acagcgaagggctcacaactcagtg

SEQ ID NO: 174103 - DNA, 25 bp, Mus musculus
acagcgacagagagcacctaaagga

SEQ ID NO: 174104 - DNA, 25 bp, Mus musculus
acagcgacccagcgtctgatggcta

SEQ ID NO: 174105 - DNA, 25 bp, Mus musculus
acagcgacgcagaaaaccaacagaa

SEQ ID NO: 174106 - DNA, 25 bp, Mus musculus
acagcgacgcagaggagcctttggg

SEQ ID NO: 174107 - DNA, 25 bp, Mus musculus
acagcgagcagccatgatgagtctc

SEQ ID NO: 174108 - DNA, 25 bp, Mus musculus
acagcgatggtgagaaggccactaa

SEQ ID NO: 174109 - DNA, 25 bp, Mus musculus
acagcgcaaccaggcccaggagggt

SEQ ID NO: 174110 - DNA, 25 bp, Mus musculus
acagcgcactgtcagatgtagaaat

SEQ ID NO: 174111 - DNA, 25 bp, Mus musculus
acagcgcactgtcaggtaaatccat

SEQ ID NO: 174112 - DNA, 25 bp, Mus musculus
acagcgcatgaaagggtctggtgag

SEQ ID NO: 174113 - DNA, 25 bp, Mus musculus
acagcgcccgcgatgactgccactc

SEQ ID NO: 174114 - DNA, 25 bp, Mus musculus
acagcgcccgcgcgggtcgcccaat

SEQ ID NO: 174115 - DNA, 25 bp, Mus musculus
acagcgcgggatgggggcacagcag

SEQ ID NO: 174116 - DNA, 25 bp, Mus musculus
acagcgctacctccttctggccggg

SEQ ID NO: 174117 - DNA, 25 bp, Mus musculus
acagcgctcagatccgtatgtaaag

SEQ ID NO: 174118 - DNA, 25 bp, Mus musculus
acagcgctgactttgagaaacggaa

SEQ ID NO: 174119 - DNA, 25 bp, Mus musculus
acagcgctgactttggcctgcatga

SEQ ID NO: 174120 - DNA, 25 bp, Mus musculus
acagcggaaccgacaaaggttacct

SEQ ID NO: 174121 - DNA, 25 bp, Mus musculus
acagcggaaccgcttcttcacttgt

SEQ ID NO: 174122 - DNA, 25 bp, Mus musculus
acagcggaaccggacgccctggcct

SEQ ID NO: 174123 - DNA, 25 bp, Mus musculus
acagcggagaagagaatacagacag

SEQ ID NO: 174124 - DNA, 25 bp, Mus musculus
acagcggagaagaggaattcatgaa

SEQ ID NO: 174125 - DNA, 25 bp, Mus musculus
acagcggagcaactgaagactcagg

SEQ ID NO: 174126 - DNA, 25 bp, Mus musculus
acagcggaggaaggagctaactctc

SEQ ID NO: 174127 - DNA, 25 bp, Mus musculus
acagcggaggaagtccttccgaggt

SEQ ID NO: 174128 - DNA, 25 bp, Mus musculus
acagcggcaaaatagtgtttctaga

SEQ ID NO: 174129 - DNA, 25 bp, Mus musculus
acagcggcaacctggcctctagacg

SEQ ID NO: 174130 - DNA, 25 bp, Mus musculus
acagcggctcagagcaatcaggacc

SEQ ID NO: 174131 - DNA, 25 bp, Mus musculus
acagcggctcagaggaaagaatacc

SEQ ID NO: 174132 - DNA, 25 bp, Mus musculus
acagcgggaagaatggaaaatgttt

SEQ ID NO: 174133 - DNA, 25 bp, Mus musculus
acagcgggcgggattcccgaagccc

SEQ ID NO: 174134 - DNA, 25 bp, Mus musculus
acagcggtcgccggttcccactatg

SEQ ID NO: 174135 - DNA, 25 bp, Mus musculus
acagcgtacagatgaaaaggggttc

SEQ ID NO: 174136 - DNA, 25 bp, Mus musculus
acagcgtacaggctcaggaaacatc

SEQ ID NO: 174137 - DNA, 25 bp, Mus musculus
acagcgtccccaactcttcctcccc

SEQ ID NO: 174138 - DNA, 25 bp, Mus musculus
acagcgtccccggtggaatgcaaga

SEQ ID NO: 174139 - DNA, 25 bp, Mus musculus
acagcgtcctccgggtagctgggag

SEQ ID NO: 174140 - DNA, 25 bp, Mus musculus
acagcgtgaatgggggcaatggcat

SEQ ID NO: 174141 - DNA, 25 bp, Mus musculus
acagcgtgcgcatcacccagaacac

SEQ ID NO: 174142 - DNA, 25 bp, Mus musculus
acagcgtgctctcaatgaaggcaag

SEQ ID NO: 174143 - DNA, 25 bp, Mus musculus
acagcgttcacaagatcatttccat

SEQ ID NO: 174144 - DNA, 25 bp, Mus musculus
acagcgttcacaagtctgagttcac

SEQ ID NO: 174145 - DNA, 25 bp, Mus musculus
acagcgttccaaaagctgccgcagt

SEQ ID NO: 174146 - DNA, 25 bp, Mus musculus
acagcgtttgcttcatgactttata

SEQ ID NO: 174147 - DNA, 25 bp, Mus musculus
acagctaaactcagcccaaggcttg

SEQ ID NO: 174148 - DNA, 25 bp, Mus musculus
acagctaaagagaatggactcgcta

SEQ ID NO: 174149 - DNA, 25 bp, Mus musculus
acagctaaaggcagaccattccaca

SEQ ID NO: 174150 - DNA, 25 bp, Mus musculus
acagctaaagtgtatactcctgatc

SEQ ID NO: 174151 - DNA, 25 bp, Mus musculus
acagctaccgaggagagagtcagaa

SEQ ID NO: 174152 - DNA, 25 bp, Mus musculus
acagctaccgaggtgctgcaggagt

SEQ ID NO: 174153 - DNA, 25 bp, Mus musculus
acagctacctagcatgtccaaaatt

SEQ ID NO: 174154 - DNA, 25 bp, Mus musculus
acagctactatgagaagctccataa

SEQ ID NO: 174155 - DNA, 25 bp, Mus musculus
acagctactgcgggggactccccac

SEQ ID NO: 174156 - DNA, 25 bp, Mus musculus
acagctacttcgtaagaatgtcttc

SEQ ID NO: 174157 - DNA, 25 bp, Mus musculus
acagctagagaccaaaaccaacaaa

SEQ ID NO: 174158 - DNA, 25 bp, Mus musculus
acagctagagctttggatgatgtga

SEQ ID NO: 174159 - DNA, 25 bp, Mus musculus
acagctagaggtttggatgatgtga

SEQ ID NO: 174160 - DNA, 25 bp, Mus musculus
acagctagcaaagcactgctgttct

SEQ ID NO: 174161 - DNA, 25 bp, Mus musculus
acagctagctatgacctatgaggag

SEQ ID NO: 174162 - DNA, 25 bp, Mus musculus
acagctagtgaccagatactgttaa

SEQ ID NO: 174163 - DNA, 25 bp, Mus musculus
acagctagtgaccaggatcgactgc

SEQ ID NO: 174164 - DNA, 25 bp, Mus musculus
acagctagttcatcactatttcatg

SEQ ID NO: 174165 - DNA, 25 bp, Mus musculus
acagctatagctcagctgcctcata

SEQ ID NO: 174166 - DNA, 25 bp, Mus musculus
acagctatcccaggaccgggacttc

SEQ ID NO: 174167 - DNA, 25 bp, Mus musculus
acagctatcccaggcccctctgccc

SEQ ID NO: 174168 - DNA, 25 bp, Mus musculus
acagctattgcgtctgcaccagggt

SEQ ID NO: 174169 - DNA, 25 bp, Mus musculus
acagctcacagaagcctgcagagcc

SEQ ID NO: 174170 - DNA, 25 bp, Mus musculus
acagctcacagaaggacatggcttt

SEQ ID NO: 174171 - DNA, 25 bp, Mus musculus
acagctcagagagaatccaccttga

SEQ ID NO: 174172 - DNA, 25 bp, Mus musculus
acagctcagccctgcccacctcaaa

SEQ ID NO: 174173 - DNA, 25 bp, Mus musculus
acagctccaagatgagcgtgaagct

SEQ ID NO: 174174 - DNA, 25 bp, Mus musculus
acagctccagcagagtcaggggatg

SEQ ID NO: 174175 - DNA, 25 bp, Mus musculus
acagctccagcaggaccttctaccg

SEQ ID NO: 174176 - DNA, 25 bp, Mus musculus
acagctccagcaggctcttgcttga

SEQ ID NO: 174177 - DNA, 25 bp, Mus musculus
acagctccagtttttcagccgtgcc

SEQ ID NO: 174178 - DNA, 25 bp, Mus musculus
acagctccagtttttcaggaatctg

SEQ ID NO: 174179 - DNA, 25 bp, Mus musculus
acagctccgggaggcctttgaagat

SEQ ID NO: 174180 - DNA, 25 bp, Mus musculus
acagctcctaacttatctacactga

SEQ ID NO: 174181 - DNA, 25 bp, Mus musculus
acagctcctggctgttggagacagg

SEQ ID NO: 174182 - DNA, 25 bp, Mus musculus
acagctcctgtccaggagatggcag

SEQ ID NO: 174183 - DNA, 25 bp, Mus musculus
acagctctacctaggattcgagtaa

SEQ ID NO: 174184 - DNA, 25 bp, Mus musculus
acagctctaggcttttcagatgtgg

SEQ ID NO: 174185 - DNA, 25 bp, Mus musculus
acagctctcagacaggaacagaaat

SEQ ID NO: 174186 - DNA, 25 bp, Mus musculus
acagctctcagacaggtttggtcgc

SEQ ID NO: 174187 - DNA, 25 bp, Mus musculus
acagctctctatgatcttaccaata

SEQ ID NO: 174188 - DNA, 25 bp, Mus musculus
acagctctgcaagagaagctgatgg

SEQ ID NO: 174189 - DNA, 25 bp, Mus musculus
acagctctgcaagtacggttagaac

SEQ ID NO: 174190 - DNA, 25 bp, Mus musculus
acagctctgcctatttgatcaagag

SEQ ID NO: 174191 - DNA, 25 bp, Mus musculus
acagctctgggatgtcacagccgca

SEQ ID NO: 174192 - DNA, 25 bp, Mus musculus
acagctctggtcgaggaagatgggc

SEQ ID NO: 174193 - DNA, 25 bp, Mus musculus
acagctctgtggaatcaccctgccc

SEQ ID NO: 174194 - DNA, 25 bp, Mus musculus
acagctcttaagaaggactgcagtg

SEQ ID NO: 174195 - DNA, 25 bp, Mus musculus
acagctctttaggtctgaacggcgt

SEQ ID NO: 174196 - DNA, 25 bp, Mus musculus
acagctgaaggagagactagaaaaa

SEQ ID NO: 174197 - DNA, 25 bp, Mus musculus
acagctgaccccagagcaccagact

SEQ ID NO: 174198 - DNA, 25 bp, Mus musculus
acagctgactcagcccggcaagctg

SEQ ID NO: 174199 - DNA, 25 bp, Mus musculus
acagctgatggttccagcatcttgg

SEQ ID NO: 174200 - DNA, 25 bp, Mus musculus
acagctgcactcaaaagtcagcgtg

SEQ ID NO: 174201 - DNA, 25 bp, Mus musculus
acagctgcagcaggagcaaccaaca

SEQ ID NO: 174202 - DNA, 25 bp, Mus musculus
acagctgcagcctctgtccggatag

SEQ ID NO: 174203 - DNA, 25 bp, Mus musculus
acagctgcaggaatagtgattgacg

SEQ ID NO: 174204 - DNA, 25 bp, Mus musculus
acagctgcaggtaaaaataaatggc

SEQ ID NO: 174205 - DNA, 25 bp, Mus musculus
acagctgccgggcccttcgacaaaa

SEQ ID NO: 174206 - DNA, 25 bp, Mus musculus
acagctgctggaaattagagcgctc

SEQ ID NO: 174207 - DNA, 25 bp, Mus musculus
acagctgctggctgagggtgggatc

SEQ ID NO: 174208 - DNA, 25 bp, Mus musculus
acagctggaacagtggccgcacgag

SEQ ID NO: 174209 - DNA, 25 bp, Mus musculus
acagctggaagaggacaagctgggc

SEQ ID NO: 174210 - DNA, 25 bp, Mus musculus
acagctggaagaggactagtgtctg

SEQ ID NO: 174211 - DNA, 25 bp, Mus musculus
acagctggaagagtaccgttcccca

SEQ ID NO: 174212 - DNA, 25 bp, Mus musculus
acagctggaaggtgatttcaatctc

SEQ ID NO: 174213 - DNA, 25 bp, Mus musculus
acagctggagcaaagattgcgccag

SEQ ID NO: 174214 - DNA, 25 bp, Mus musculus
acagctggagcaaagtgaaaaagat

SEQ ID NO: 174215 - DNA, 25 bp, Mus musculus
acagctggagcagaggatttcagcg

SEQ ID NO: 174216 - DNA, 25 bp, Mus musculus
acagctggcagaactcaacaaaaat

SEQ ID NO: 174217 - DNA, 25 bp, Mus musculus
acagctggcgaggtgttggcagccg

SEQ ID NO: 174218 - DNA, 25 bp, Mus musculus
acagctggggcagaagtggcagtgt

SEQ ID NO: 174219 - DNA, 25 bp, Mus musculus
acagctgggtccagcggctggagga

SEQ ID NO: 174220 - DNA, 25 bp, Mus musculus
acagctggtggagatgattgcagac

SEQ ID NO: 174221 - DNA, 25 bp, Mus musculus
acagctggtggagttgttgggagaa

SEQ ID NO: 174222 - DNA, 25 bp, Mus musculus
acagctgtcaccaacattaccacag

SEQ ID NO: 174223 - DNA, 25 bp, Mus musculus
acagctgtcacctacattaccacag

SEQ ID NO: 174224 - DNA, 25 bp, Mus musculus
acagctgtctagctgtttcctcttg

SEQ ID NO: 174225 - DNA, 25 bp, Mus musculus
acagctgtctagtccccatggacac

SEQ ID NO: 174226 - DNA, 25 bp, Mus musculus
acagctgttctgcccgaggacggtg

SEQ ID NO: 174227 - DNA, 25 bp, Mus musculus
acagcttatggcagctgctgtgtgg

SEQ ID NO: 174228 - DNA, 25 bp, Mus musculus
acagcttcaccacgaccctggtgaa

SEQ ID NO: 174229 - DNA, 25 bp, Mus musculus
acagcttcagaacaaaagtccagac

SEQ ID NO: 174230 - DNA, 25 bp, Mus musculus
acagcttcagaagggtcatgtttcc

SEQ ID NO: 174231 - DNA, 25 bp, Mus musculus
acagcttcagagagatggtgtcttg

SEQ ID NO: 174232 - DNA, 25 bp, Mus musculus
acagcttcagagagctgccaggccg

SEQ ID NO: 174233 - DNA, 25 bp, Mus musculus
acagcttcagagagtgtttaattcc

SEQ ID NO: 174234 - DNA, 25 bp, Mus musculus
acagcttcagattccatcaatctct

SEQ ID NO: 174235 - DNA, 25 bp, Mus musculus
acagcttcagcagctctatgccgct

SEQ ID NO: 174236 - DNA, 25 bp, Mus musculus
acagcttccaggcatgctcagggta

SEQ ID NO: 174237 - DNA, 25 bp, Mus musculus
acagcttcccaggagatgtacgact

SEQ ID NO: 174238 - DNA, 25 bp, Mus musculus
acagcttcccagggggatatccgcc

SEQ ID NO: 174239 - DNA, 25 bp, Mus musculus
acagcttctgggaggttgggaacta

SEQ ID NO: 174240 - DNA, 25 bp, Mus musculus
acagcttgatgcaaggactcgtggg

SEQ ID NO: 174241 - DNA, 25 bp, Mus musculus
acagcttgcaaattacaggcctgag

SEQ ID NO: 174242 - DNA, 25 bp, Mus musculus
acagcttggggaagggaacataatg

SEQ ID NO: 174243 - DNA, 25 bp, Mus musculus
acagcttgtacaagcttcaaaaccg

SEQ ID NO: 174244 - DNA, 25 bp, Mus musculus
acagcttgtacaagtctgcagatgg

SEQ ID NO: 174245 - DNA, 25 bp, Mus musculus
acagctttacgatcatcactccgtt

SEQ ID NO: 174246 - DNA, 25 bp, Mus musculus
acagctttacgatcatcttgactgc

SEQ ID NO: 174247 - DNA, 25 bp, Mus musculus
acagctttacttttggtatatcatg

SEQ ID NO: 174248 - DNA, 25 bp, Mus musculus
acagctttatacagaaagatgttgg

SEQ ID NO: 174249 - DNA, 25 bp, Mus musculus
acagctttccagaattcctcagaga

SEQ ID NO: 174250 - DNA, 25 bp, Mus musculus
acagctttccagacttacaacagct

SEQ ID NO: 174251 - DNA, 25 bp, Mus musculus
acagctttgctcagtatgggtgaga

SEQ ID NO: 174252 - DNA, 25 bp, Mus musculus
acagcttttatcaaaggtgtgccat

SEQ ID NO: 174253 - DNA, 25 bp, Mus musculus
acaggaaaacaggtttcaagtgccc

SEQ ID NO: 174254 - DNA, 25 bp, Mus musculus
acaggaaaaccaggttgctggtgac

SEQ ID NO: 174255 - DNA, 25 bp, Mus musculus
acaggaaaatcagtgtctttacatc

SEQ ID NO: 174256 - DNA, 25 bp, Mus musculus
acaggaaacaggagcagcgttgccc

SEQ ID NO: 174257 - DNA, 25 bp, Mus musculus
acaggaaactggccaaggtggagct

SEQ ID NO: 174258 - DNA, 25 bp, Mus musculus
acaggaaactggccaggtgctctcc

SEQ ID NO: 174259 - DNA, 25 bp, Mus musculus
acaggaaactggttggctgggaaga

SEQ ID NO: 174260 - DNA, 25 bp, Mus musculus
acaggaaagaagaagacctgtctga

SEQ ID NO: 174261 - DNA, 25 bp, Mus musculus
acaggaaagaaggtggtggaagata

SEQ ID NO: 174262 - DNA, 25 bp, Mus musculus
acaggaaaggccgttttggactaca

SEQ ID NO: 174263 - DNA, 25 bp, Mus musculus
acaggaaagggcactgtggagtcac

SEQ ID NO: 174264 - DNA, 25 bp, Mus musculus
acaggaaatgcttgcccctaagcgt

SEQ ID NO: 174265 - DNA, 25 bp, Mus musculus
acaggaaatggctctctgctaccag

SEQ ID NO: 174266 - DNA, 25 bp, Mus musculus
acaggaaatgtttattggaaaagga

SEQ ID NO: 174267 - DNA, 25 bp, Mus musculus
acaggaaatgtttgcatctggccat

SEQ ID NO: 174268 - DNA, 25 bp, Mus musculus
acaggaaatgtttgtgacccccctc

SEQ ID NO: 174269 - DNA, 25 bp, Mus musculus
acaggaaattcagcctcaagtacct

SEQ ID NO: 174270 - DNA, 25 bp, Mus musculus
acaggaaattcaggcgatgctgggc

SEQ ID NO: 174271 - DNA, 25 bp, Mus musculus
acaggaacaaacattcaggccaaac

SEQ ID NO: 174272 - DNA, 25 bp, Mus musculus
acaggaacaaatggggagaaactcc

SEQ ID NO: 174273 - DNA, 25 bp, Mus musculus
acaggaacaagatcctgcacaggga

SEQ ID NO: 174274 - DNA, 25 bp, Mus musculus
acaggaacaaggtgtggccaaacgt

SEQ ID NO: 174275 - DNA, 25 bp, Mus musculus
acaggaacagcgctcatccactgca

SEQ ID NO: 174276 - DNA, 25 bp, Mus musculus
acaggaacagcggaaaatacagaag

SEQ ID NO: 174277 - DNA, 25 bp, Mus musculus
acaggaacatcgtgactttatatgg

SEQ ID NO: 174278 - DNA, 25 bp, Mus musculus
acaggaacattttccctcctgtcct

SEQ ID NO: 174279 - DNA, 25 bp, Mus musculus
acaggaaccagctgatggccaggag

SEQ ID NO: 174280 - DNA, 25 bp, Mus musculus
acaggaacccgtcattgcctttctc

SEQ ID NO: 174281 - DNA, 25 bp, Mus musculus
acaggaacgaccgtgctatgtttca

SEQ ID NO: 174282 - DNA, 25 bp, Mus musculus
acaggaactgaggctccggagggtg

SEQ ID NO: 174283 - DNA, 25 bp, Mus musculus
acaggaactggtggattgtctggaa

SEQ ID NO: 174284 - DNA, 25 bp, Mus musculus
acaggaagactggtgggaacacagg

SEQ ID NO: 174285 - DNA, 25 bp, Mus musculus
acaggaagagctggattttgccatg

SEQ ID NO: 174286 - DNA, 25 bp, Mus musculus
acaggaagagctgggctctcccgca

SEQ ID NO: 174287 - DNA, 25 bp, Mus musculus
acaggaagaggacgccctacctggt

SEQ ID NO: 174288 - DNA, 25 bp, Mus musculus
acaggaagcgagaagagaaaaggaa

SEQ ID NO: 174289 - DNA, 25 bp, Mus musculus
acaggaagcgtggaggatgagcatg

SEQ ID NO: 174290 - DNA, 25 bp, Mus musculus
acaggaagcttcagattataccgaa

SEQ ID NO: 174291 - DNA, 25 bp, Mus musculus
acaggaagcttcaggctatgtcttt

SEQ ID NO: 174292 - DNA, 25 bp, Mus musculus
acaggaagtcagctagcagccacat

SEQ ID NO: 174293 - DNA, 25 bp, Mus musculus
acaggaagtgcataggaggagcttc

SEQ ID NO: 174294 - DNA, 25 bp, Mus musculus
acaggaagtgcataggagtggctgc

SEQ ID NO: 174295 - DNA, 25 bp, Mus musculus
acaggaagtgtactggataagaaca

SEQ ID NO: 174296 - DNA, 25 bp, Mus musculus
acaggaatacagagaccgtctcgac

SEQ ID NO: 174297 - DNA, 25 bp, Mus musculus
acaggaatacaggattttggttcca

SEQ ID NO: 174298 - DNA, 25 bp, Mus musculus
acaggaatacgagaaagccctgcag

SEQ ID NO: 174299 - DNA, 25 bp, Mus musculus
acaggaatactgtttggcatggctg

SEQ ID NO: 174300 - DNA, 25 bp, Mus musculus
acaggaatatgtagatttgggtatc

SEQ ID NO: 174301 - DNA, 25 bp, Mus musculus
acaggacaaaaacagtacaacgtag

SEQ ID NO: 174302 - DNA, 25 bp, Mus musculus
acaggacaagaatgccctggacttg

SEQ ID NO: 174303 - DNA, 25 bp, Mus musculus
acaggacaagctaagcattgaggat

SEQ ID NO: 174304 - DNA, 25 bp, Mus musculus
acaggacacagagatgactcgttgg

SEQ ID NO: 174305 - DNA, 25 bp, Mus musculus
acaggacagagttcctgtagttgct

SEQ ID NO: 174306 - DNA, 25 bp, Mus musculus
acaggacatcaggctctgtgtgagt

SEQ ID NO: 174307 - DNA, 25 bp, Mus musculus
acaggacatcccagacaattttgga

SEQ ID NO: 174308 - DNA, 25 bp, Mus musculus
acaggacatcccagcaaagaaacga

SEQ ID NO: 174309 - DNA, 25 bp, Mus musculus
acaggacatgagctactatagaaaa

SEQ ID NO: 174310 - DNA, 25 bp, Mus musculus
acaggaccagcaatggcaagccggc

SEQ ID NO: 174311 - DNA, 25 bp, Mus musculus
acaggaccattaaagtgtggagcac

SEQ ID NO: 174312 - DNA, 25 bp, Mus musculus
acaggacccaagtacattcacctgc

SEQ ID NO: 174313 - DNA, 25 bp, Mus musculus
acaggacccagaaagcatctgcatc

SEQ ID NO: 174314 - DNA, 25 bp, Mus musculus
acaggacccagagcaagtccacatg

SEQ ID NO: 174315 - DNA, 25 bp, Mus musculus
acaggacccccgaggtgattcatgg

SEQ ID NO: 174316 - DNA, 25 bp, Mus musculus
acaggacccccgagtgtccaggtta

SEQ ID NO: 174317 - DNA, 25 bp, Mus musculus
acaggacctgcagtgctcccaccac

SEQ ID NO: 174318 - DNA, 25 bp, Mus musculus
acaggaccttttcggactgggtgaa

SEQ ID NO: 174319 - DNA, 25 bp, Mus musculus
acaggaccttttcggatcaagatta

SEQ ID NO: 174320 - DNA, 25 bp, Mus musculus
acaggaccttttcgtgggagccaag

SEQ ID NO: 174321 - DNA, 25 bp, Mus musculus
acaggacggaaagcgaatggacccg

SEQ ID NO: 174322 - DNA, 25 bp, Mus musculus
acaggacggatggcgggtttccgct

SEQ ID NO: 174323 - DNA, 25 bp, Mus musculus
acaggactaagagggtgtttcttga

SEQ ID NO: 174324 - DNA, 25 bp, Mus musculus
acaggactaaggggaagactgtcac

SEQ ID NO: 174325 - DNA, 25 bp, Mus musculus
acaggactacacagcatcctgcctc

SEQ ID NO: 174326 - DNA, 25 bp, Mus musculus
acaggactagagaaagtgtgcaatg

SEQ ID NO: 174327 - DNA, 25 bp, Mus musculus
acaggactcaagtcctccacagagc

SEQ ID NO: 174328 - DNA, 25 bp, Mus musculus
acaggactcaggtagatgagaggcc

SEQ ID NO: 174329 - DNA, 25 bp, Mus musculus
acaggactcaggtaggttgatggaa

SEQ ID NO: 174330 - DNA, 25 bp, Mus musculus
acaggactctttgatgtaacccacg

SEQ ID NO: 174331 - DNA, 25 bp, Mus musculus
acaggagaaaggctggagctggaac

SEQ ID NO: 174332 - DNA, 25 bp, Mus musculus
acaggagaaaggctgggtgaagacc

SEQ ID NO: 174333 - DNA, 25 bp, Mus musculus
acaggagaacagataagccaaagag

SEQ ID NO: 174334 - DNA, 25 bp, Mus musculus
acaggagaagggagttggcagtaag

SEQ ID NO: 174335 - DNA, 25 bp, Mus musculus
acaggagaaggtgaaggagggaagg

SEQ ID NO: 174336 - DNA, 25 bp, Mus musculus
acaggagaagtggtgcatggatgtt

SEQ ID NO: 174337 - DNA, 25 bp, Mus musculus
acaggagaagtggtggcctgcttga

SEQ ID NO: 174338 - DNA, 25 bp, Mus musculus
acaggagaataaaggacctttttca

SEQ ID NO: 174339 - DNA, 25 bp, Mus musculus
acaggagacagagggcatggtggca

SEQ ID NO: 174340 - DNA, 25 bp, Mus musculus
acaggagactctaaagttgcagcag

SEQ ID NO: 174341 - DNA, 25 bp, Mus musculus
acaggagactctgtcttcctgtgtt

SEQ ID NO: 174342 - DNA, 25 bp, Mus musculus
acaggagagaagcatcaagatgacc

SEQ ID NO: 174343 - DNA, 25 bp, Mus musculus
acaggagagaagggtcaccgctaga

SEQ ID NO: 174344 - DNA, 25 bp, Mus musculus
acaggagatatgagcaacaaaagcg

SEQ ID NO: 174345 - DNA, 25 bp, Mus musculus
acaggagatatgcgcaacaaaagcg

SEQ ID NO: 174346 - DNA, 25 bp, Mus musculus
acaggagcaaccagagagcaccgta

SEQ ID NO: 174347 - DNA, 25 bp, Mus musculus
acaggagcaagaagcagcaaagctg

SEQ ID NO: 174348 - DNA, 25 bp, Mus musculus
acaggagcagatcaggaatctttct

SEQ ID NO: 174349 - DNA, 25 bp, Mus musculus
acaggagcagatccgctctcacatc

SEQ ID NO: 174350 - DNA, 25 bp, Mus musculus
acaggagccaagagctatgagccag

SEQ ID NO: 174351 - DNA, 25 bp, Mus musculus
acaggagccaagagtgaagaacaat

SEQ ID NO: 174352 - DNA, 25 bp, Mus musculus
acaggagccggaaaggcggaggcca

SEQ ID NO: 174353 - DNA, 25 bp, Mus musculus
acaggagctcgagaacttcaagttg

SEQ ID NO: 174354 - DNA, 25 bp, Mus musculus
acaggaggagctgatccgagcacac

SEQ ID NO: 174355 - DNA, 25 bp, Mus musculus
acaggagtggtcccgtaggcctcac

SEQ ID NO: 174356 - DNA, 25 bp, Mus musculus
acaggagttcgggactctgctgaca

SEQ ID NO: 174357 - DNA, 25 bp, Mus musculus
acaggagttgacacatggtttggga

SEQ ID NO: 174358 - DNA, 25 bp, Mus musculus
acaggataactttaaccagacacac

SEQ ID NO: 174359 - DNA, 25 bp, Mus musculus
acaggataactttgatgtgtatgct

SEQ ID NO: 174360 - DNA, 25 bp, Mus musculus
acaggatacaaggcaaaaacagctc

SEQ ID NO: 174361 - DNA, 25 bp, Mus musculus
acaggatacaggattctcataatga

SEQ ID NO: 174362 - DNA, 25 bp, Mus musculus
acaggatacagggttatacagggga

SEQ ID NO: 174363 - DNA, 25 bp, Mus musculus
acaggatagagactaatgctcatac

SEQ ID NO: 174364 - DNA, 25 bp, Mus musculus
acaggatcagaggtcaccttccgaa

SEQ ID NO: 174365 - DNA, 25 bp, Mus musculus
acaggatcagcagtttgatttcagt

SEQ ID NO: 174366 - DNA, 25 bp, Mus musculus
acaggatcaggagtttgatttcagt

SEQ ID NO: 174367 - DNA, 25 bp, Mus musculus
acaggatctttccagttacaaattt

SEQ ID NO: 174368 - DNA, 25 bp, Mus musculus
acaggatgaaggttaggcacgggca

SEQ ID NO: 174369 - DNA, 25 bp, Mus musculus
acaggatgaccaggtagagaccttt

SEQ ID NO: 174370 - DNA, 25 bp, Mus musculus
acaggatgaccagtttcagaaagct

SEQ ID NO: 174371 - DNA, 25 bp, Mus musculus
acaggatgagtacgccatgaacgac

SEQ ID NO: 174372 - DNA, 25 bp, Mus musculus
acaggatgagtacggtgggaatgct

SEQ ID NO: 174373 - DNA, 25 bp, Mus musculus
acaggatgggtcccagcctgcagtt

SEQ ID NO: 174374 - DNA, 25 bp, Mus musculus
acaggattagtttccttttagacca

SEQ ID NO: 174375 - DNA, 25 bp, Mus musculus
acaggattcagctctgtttcctagg

SEQ ID NO: 174376 - DNA, 25 bp, Mus musculus
acaggattcaggccactaaacctcg

SEQ ID NO: 174377 - DNA, 25 bp, Mus musculus
acaggattgaggtccagaaggatgc

SEQ ID NO: 174378 - DNA, 25 bp, Mus musculus
acaggattgtggcgacaaataacaa

SEQ ID NO: 174379 - DNA, 25 bp, Mus musculus
acaggattgtggtaacaaataacaa

SEQ ID NO: 174380 - DNA, 25 bp, Mus musculus
acaggatttctaagcattccatatt

SEQ ID NO: 174381 - DNA, 25 bp, Mus musculus
acaggatttctaaggcttcagaaga

SEQ ID NO: 174382 - DNA, 25 bp, Mus musculus
acaggatttgtgaagaaacccccag

SEQ ID NO: 174383 - DNA, 25 bp, Mus musculus
acaggatttgtgaaggtatccgccc

SEQ ID NO: 174384 - DNA, 25 bp, Mus musculus
acaggatttgtgaaggtttcagagg

SEQ ID NO: 174385 - DNA, 25 bp, Mus musculus
acaggattttctgtgcagcagattt

SEQ ID NO: 174386 - DNA, 25 bp, Mus musculus
acaggattttctgtgcctttattgc

SEQ ID NO: 174387 - DNA, 25 bp, Mus musculus
acaggcaaaagcagattttatcatg

SEQ ID NO: 174388 - DNA, 25 bp, Mus musculus
acaggcaaacaggggcaattattgc

SEQ ID NO: 174389 - DNA, 25 bp, Mus musculus
acaggcaaacagggtacctttcaca

SEQ ID NO: 174390 - DNA, 25 bp, Mus musculus
acaggcaacgggggtctctttaggt

SEQ ID NO: 174391 - DNA, 25 bp, Mus musculus
acaggcaagaaccggagacaatcag

SEQ ID NO: 174392 - DNA, 25 bp, Mus musculus
acaggcaagaaccgttctcaagaac

SEQ ID NO: 174393 - DNA, 25 bp, Mus musculus
acaggcacaccagggcaccctcaga

SEQ ID NO: 174394 - DNA, 25 bp, Mus musculus
acaggcacagctactatgtgtgtaa

SEQ ID NO: 174395 - DNA, 25 bp, Mus musculus
acaggcacaggtcgaggtggcgcat

SEQ ID NO: 174396 - DNA, 25 bp, Mus musculus
acaggcaccagtcttggaggaggaa

SEQ ID NO: 174397 - DNA, 25 bp, Mus musculus
acaggcacgagctgcaggtcctggt

SEQ ID NO: 174398 - DNA, 25 bp, Mus musculus
acaggcactgaagtggactgcctgc

SEQ ID NO: 174399 - DNA, 25 bp, Mus musculus
acaggcagaacgaggcaaagacaag

SEQ ID NO: 174400 - DNA, 25 bp, Mus musculus
acaggcagaggcacggtagatggac

SEQ ID NO: 174401 - DNA, 25 bp, Mus musculus
acaggcagcagctccggtctgatat

SEQ ID NO: 174402 - DNA, 25 bp, Mus musculus
acaggcagccggggcgagaagggta

SEQ ID NO: 174403 - DNA, 25 bp, Mus musculus
acaggcaggacaagaaggcaaatta

SEQ ID NO: 174404 - DNA, 25 bp, Mus musculus
acaggcaggcagattgaccttggcc

SEQ ID NO: 174405 - DNA, 25 bp, Mus musculus
acaggcaggctaggttcctccggtt

SEQ ID NO: 174406 - DNA, 25 bp, Mus musculus
acaggcagtgtccccaccttcaaac

SEQ ID NO: 174407 - DNA, 25 bp, Mus musculus
acaggcataccaggctccagaaatg

SEQ ID NO: 174408 - DNA, 25 bp, Mus musculus
acaggcatcacatgaccagtggctg

SEQ ID NO: 174409 - DNA, 25 bp, Mus musculus
acaggcatccaagagcaactggtgg

SEQ ID NO: 174410 - DNA, 25 bp, Mus musculus
acaggcatccaagcaagcgaagatg

SEQ ID NO: 174411 - DNA, 25 bp, Mus musculus
acaggcatcctggtcatttgaagac

SEQ ID NO: 174412 - DNA, 25 bp, Mus musculus
acaggccaaagcttcctgaaagagg

SEQ ID NO: 174413 - DNA, 25 bp, Mus musculus
acaggccaattgttcctgtaccagg

SEQ ID NO: 174414 - DNA, 25 bp, Mus musculus
acaggccacaggaaagcacagacaa

SEQ ID NO: 174415 - DNA, 25 bp, Mus musculus
acaggccaggagggctcgctcgaag

SEQ ID NO: 174416 - DNA, 25 bp, Mus musculus
acaggccagtaggagttaaagggaa

SEQ ID NO: 174417 - DNA, 25 bp, Mus musculus
acaggccattggtggctatggccca

SEQ ID NO: 174418 - DNA, 25 bp, Mus musculus
acaggcccattaaggtgaacctcct

SEQ ID NO: 174419 - DNA, 25 bp, Mus musculus
acaggcccctaccaggcgggatgga

SEQ ID NO: 174420 - DNA, 25 bp, Mus musculus
acaggccctggtaaaagcagaagca

SEQ ID NO: 174421 - DNA, 25 bp, Mus musculus
acaggccctgttggtccccctggaa

SEQ ID NO: 174422 - DNA, 25 bp, Mus musculus
acaggccgaggcaagtttcctttta

SEQ ID NO: 174423 - DNA, 25 bp, Mus musculus
acaggcctaaaggctttgatgacag

SEQ ID NO: 174424 - DNA, 25 bp, Mus musculus
acaggcctaagcacaggcagcagag

SEQ ID NO: 174425 - DNA, 25 bp, Mus musculus
acaggcctaagtgtccaccatcaca

SEQ ID NO: 174426 - DNA, 25 bp, Mus musculus
acaggcctagtgccaaaccagagga

SEQ ID NO: 174427 - DNA, 25 bp, Mus musculus
acaggcctccccaggtccccctgac

SEQ ID NO: 174428 - DNA, 25 bp, Mus musculus
acaggcctccgaatcacatgggtgt

SEQ ID NO: 174429 - DNA, 25 bp, Mus musculus
acaggcctgcagacatttttagcca

SEQ ID NO: 174430 - DNA, 25 bp, Mus musculus
acaggcctgcagccaggtgattttg

SEQ ID NO: 174431 - DNA, 25 bp, Mus musculus
acaggccttccagggctgaccagtt

SEQ ID NO: 174432 - DNA, 25 bp, Mus musculus
acaggccttgccagagccatgcaga

SEQ ID NO: 174433 - DNA, 25 bp, Mus musculus
acaggccttgggctggagcacccgg

SEQ ID NO: 174434 - DNA, 25 bp, Mus musculus
acaggcgcaagaaaagagaagcagc

SEQ ID NO: 174435 - DNA, 25 bp, Mus musculus
acaggcggaaagatggcgtaccttc

SEQ ID NO: 174436 - DNA, 25 bp, Mus musculus
acaggcggaggaaacctatgagaat

SEQ ID NO: 174437 - DNA, 25 bp, Mus musculus
acaggcggaggctagacaaatggct

SEQ ID NO: 174438 - DNA, 25 bp, Mus musculus
acaggcgggcggtgtatcctcagag

SEQ ID NO: 174439 - DNA, 25 bp, Mus musculus
acaggcgtccaagctcccagcagca

SEQ ID NO: 174440 - DNA, 25 bp, Mus musculus
acaggcgtccaaggccatcagctcc

SEQ ID NO: 174441 - DNA, 25 bp, Mus musculus
acaggctacgacgtgctgtgtgcag

SEQ ID NO: 174442 - DNA, 25 bp, Mus musculus
acaggctacgacgtggttgcgcaga

SEQ ID NO: 174443 - DNA, 25 bp, Mus musculus
acaggctacttctgcgacagtgaca

SEQ ID NO: 174444 - DNA, 25 bp, Mus musculus
acaggctacttcttctggatctctt

SEQ ID NO: 174445 - DNA, 25 bp, Mus musculus
acaggctataatctggtatgtgtat

SEQ ID NO: 174446 - DNA, 25 bp, Mus musculus
acaggctatgaggtacatccctgag

SEQ ID NO: 174447 - DNA, 25 bp, Mus musculus
acaggctcaggaggcctttcccagg

SEQ ID NO: 174448 - DNA, 25 bp, Mus musculus
acaggctccaggctgttggaaagcc

SEQ ID NO: 174449 - DNA, 25 bp, Mus musculus
acaggctccagtctttcaccccttc

SEQ ID NO: 174450 - DNA, 25 bp, Mus musculus
acaggctcctgagcgcagccttggg

SEQ ID NO: 174451 - DNA, 25 bp, Mus musculus
acaggctcctggccaggagcaagac

SEQ ID NO: 174452 - DNA, 25 bp, Mus musculus
acaggctcttgggtgacaattggtg

SEQ ID NO: 174453 - DNA, 25 bp, Mus musculus
acaggctgatggcagcctctccagg

SEQ ID NO: 174454 - DNA, 25 bp, Mus musculus
acaggctgcgctgaggctccagcct

SEQ ID NO: 174455 - DNA, 25 bp, Mus musculus
acaggctggatacagttaccagtaa

SEQ ID NO: 174456 - DNA, 25 bp, Mus musculus
acaggctggcaaggtcaaacctgcg

SEQ ID NO: 174457 - DNA, 25 bp, Mus musculus
acaggctgtgaaagctgtccagcag

SEQ ID NO: 174458 - DNA, 25 bp, Mus musculus
acaggcttaggtgccacattctggg

SEQ ID NO: 174459 - DNA, 25 bp, Mus musculus
acaggcttcaagagtggtcttgtcc

SEQ ID NO: 174460 - DNA, 25 bp, Mus musculus
acaggcttcaagccagaagcctgcc

SEQ ID NO: 174461 - DNA, 25 bp, Mus musculus
acaggcttcacttcatcttcatggg

SEQ ID NO: 174462 - DNA, 25 bp, Mus musculus
acaggcttcgagaacgaagaaagaa

SEQ ID NO: 174463 - DNA, 25 bp, Mus musculus
acaggcttcgagaacgtgactacga

SEQ ID NO: 174464 - DNA, 25 bp, Mus musculus
acaggcttctagggacagaacaaca

SEQ ID NO: 174465 - DNA, 25 bp, Mus musculus
acaggctttttcttacttctcgctt

SEQ ID NO: 174466 - DNA, 25 bp, Mus musculus
acagggaacccaagcaccccttggg

SEQ ID NO: 174467 - DNA, 25 bp, Mus musculus
acagggaacggcaggccgatctgtc

SEQ ID NO: 174468 - DNA, 25 bp, Mus musculus
acagggaagtaggctgaaccttcgg

SEQ ID NO: 174469 - DNA, 25 bp, Mus musculus
acagggaagttaggcacaatcactt

SEQ ID NO: 174470 - DNA, 25 bp, Mus musculus
acagggacattccttatcataacag

SEQ ID NO: 174471 - DNA, 25 bp, Mus musculus
acagggaccatggagaccatagtct

SEQ ID NO: 174472 - DNA, 25 bp, Mus musculus
acagggaccatggaggtgtgtgtac

SEQ ID NO: 174473 - DNA, 25 bp, Mus musculus
acagggacccagaagatgatttttg

SEQ ID NO: 174474 - DNA, 25 bp, Mus musculus
acagggaccccactgaggcttctca

SEQ ID NO: 174475 - DNA, 25 bp, Mus musculus
acagggaccccactgcactgctgtt

SEQ ID NO: 174476 - DNA, 25 bp, Mus musculus
acagggacctgaagcctgagaattt

SEQ ID NO: 174477 - DNA, 25 bp, Mus musculus
acagggactaagcccacaggagttt

SEQ ID NO: 174478 - DNA, 25 bp, Mus musculus
acagggagaatgtttttcttactta

SEQ ID NO: 174479 - DNA, 25 bp, Mus musculus
acagggagacaggatccttccttgt

SEQ ID NO: 174480 - DNA, 25 bp, Mus musculus
acagggaggcagtttgcagggacat

SEQ ID NO: 174481 - DNA, 25 bp, Mus musculus
acagggatgagactttgaagagaaa

SEQ ID NO: 174482 - DNA, 25 bp, Mus musculus
acagggatgagctagttaaaggcct

SEQ ID NO: 174483 - DNA, 25 bp, Mus musculus
acagggatgagtgggatgtaccatg

SEQ ID NO: 174484 - DNA, 25 bp, Mus musculus
acagggatgttggatggaagaattt

SEQ ID NO: 174485 - DNA, 25 bp, Mus musculus
acagggatttcagatgataaaggca

SEQ ID NO: 174486 - DNA, 25 bp, Mus musculus
acagggatttcaggctgggaatgcg

SEQ ID NO: 174487 - DNA, 25 bp, Mus musculus
acagggatttcagtctggaaatgtc

SEQ ID NO: 174488 - DNA, 25 bp, Mus musculus
acagggcaaaggggtttcctgagat

SEQ ID NO: 174489 - DNA, 25 bp, Mus musculus
acagggcaacaggctgaaccattag

SEQ ID NO: 174490 - DNA, 25 bp, Mus musculus
acagggcagagaagctggcttgctg

SEQ ID NO: 174491 - DNA, 25 bp, Mus musculus
acagggcccagagggtcgttgctcc

SEQ ID NO: 174492 - DNA, 25 bp, Mus musculus
acagggccttcaagaaaattacaac

SEQ ID NO: 174493 - DNA, 25 bp, Mus musculus
acagggccttgaggacctgctctcc

SEQ ID NO: 174494 - DNA, 25 bp, Mus musculus
acagggcgaaacaaaggtcccacct

SEQ ID NO: 174495 - DNA, 25 bp, Mus musculus
acagggcgagcccaggatgggctct

SEQ ID NO: 174496 - DNA, 25 bp, Mus musculus
acagggctcttcaggtctacatgtg

SEQ ID NO: 174497 - DNA, 25 bp, Mus musculus
acagggctcttcaggtgctccaatg

SEQ ID NO: 174498 - DNA, 25 bp, Mus musculus
acaggggatgatgagacagaagact

SEQ ID NO: 174499 - DNA, 25 bp, Mus musculus
acaggggcacaaggcattgccacag

SEQ ID NO: 174500 - DNA, 25 bp, Mus musculus
acaggggcacaatctgcagctcagt

SEQ ID NO: 174501 - DNA, 25 bp, Mus musculus
acaggggcagtcccaggacggccca

SEQ ID NO: 174502 - DNA, 25 bp, Mus musculus
acaggggcagtgtttgccaagaatt

SEQ ID NO: 174503 - DNA, 25 bp, Mus musculus
acaggggctgcctgcctacagacta

SEQ ID NO: 174504 - DNA, 25 bp, Mus musculus
acagggggccaggtgagttggagtg

SEQ ID NO: 174505 - DNA, 25 bp, Mus musculus
acaggggtggcagactctcttctgc

SEQ ID NO: 174506 - DNA, 25 bp, Mus musculus
acaggggtggcaggcgcaccaaccc

SEQ ID NO: 174507 - DNA, 25 bp, Mus musculus
acaggggttgcacaggatttcccta

SEQ ID NO: 174508 - DNA, 25 bp, Mus musculus
acaggggttgcacaggtgaagatca

SEQ ID NO: 174509 - DNA, 25 bp, Mus musculus
acagggtcaaaggataattccttaa

SEQ ID NO: 174510 - DNA, 25 bp, Mus musculus
acagggtcaaaggccacattgaatt

SEQ ID NO: 174511 - DNA, 25 bp, Mus musculus
acagggtcagctggtcacttgctct

SEQ ID NO: 174512 - DNA, 25 bp, Mus musculus
acagggtcagcttcggtttgctgcc

SEQ ID NO: 174513 - DNA, 25 bp, Mus musculus
acagggtcctggcaggaagatttat

SEQ ID NO: 174514 - DNA, 25 bp, Mus musculus
acagggtcctggcaggggcagtaat

SEQ ID NO: 174515 - DNA, 25 bp, Mus musculus
acagggtgcaagatgatgacttctg

SEQ ID NO: 174516 - DNA, 25 bp, Mus musculus
acagggtgcaagccagcccttcagc

SEQ ID NO: 174517 - DNA, 25 bp, Mus musculus
acagggtgcccagtgctaggagacc

SEQ ID NO: 174518 - DNA, 25 bp, Mus musculus
acagggtgctcctggaaaacggggt

SEQ ID NO: 174519 - DNA, 25 bp, Mus musculus
acagggtgctggttggtggcactaa

SEQ ID NO: 174520 - DNA, 25 bp, Mus musculus
acagggtggagcatctgatgacatg

SEQ ID NO: 174521 - DNA, 25 bp, Mus musculus
acagggtggcatacacagagattga

SEQ ID NO: 174522 - DNA, 25 bp, Mus musculus
acagggtggcatctacccagctggg

SEQ ID NO: 174523 - DNA, 25 bp, Mus musculus
acagggtgtggtgggccgagccgcc

SEQ ID NO: 174524 - DNA, 25 bp, Mus musculus
acaggtaaaaatggattagtcgtat

SEQ ID NO: 174525 - DNA, 25 bp, Mus musculus
acaggtaacagtgtcagctgactcc

SEQ ID NO: 174526 - DNA, 25 bp, Mus musculus
acaggtaacagtttcggccgagtcc

SEQ ID NO: 174527 - DNA, 25 bp, Mus musculus
acaggtaagggcagatgtcatcaat

SEQ ID NO: 174528 - DNA, 25 bp, Mus musculus
acaggtacaggcaggcaaaggctcg

SEQ ID NO: 174529 - DNA, 25 bp, Mus musculus
acaggtacctaccaggtgaaacctt

SEQ ID NO: 174530 - DNA, 25 bp, Mus musculus
acaggtagaaaagagaagcccgtgc

SEQ ID NO: 174531 - DNA, 25 bp, Mus musculus
acaggtagattctggtttacaatct

SEQ ID NO: 174532 - DNA, 25 bp, Mus musculus
acaggtaggcaaaggtggaggaaga

SEQ ID NO: 174533 - DNA, 25 bp, Mus musculus
acaggtagggtttcgatgagactgt

SEQ ID NO: 174534 - DNA, 25 bp, Mus musculus
acaggtcaaaatgtcctgcaggtct

SEQ ID NO: 174535 - DNA, 25 bp, Mus musculus
acaggtcaaggagagtgtcactgac

SEQ ID NO: 174536 - DNA, 25 bp, Mus musculus
acaggtcacctgcagatactttatg

SEQ ID NO: 174537 - DNA, 25 bp, Mus musculus
acaggtcagtaagggggtccaaggc

SEQ ID NO: 174538 - DNA, 25 bp, Mus musculus
acaggtcagtcctgggctgggccgt

SEQ ID NO: 174539 - DNA, 25 bp, Mus musculus
acaggtcatcaagatgaacaggatg

SEQ ID NO: 174540 - DNA, 25 bp, Mus musculus
acaggtcatcaaggacttcccatgg

SEQ ID NO: 174541 - DNA, 25 bp, Mus musculus
acaggtccacccaagggtacagcat

SEQ ID NO: 174542 - DNA, 25 bp, Mus musculus
acaggtccagagcatgggggggaaa

SEQ ID NO: 174543 - DNA, 25 bp, Mus musculus
acaggtcccagctggggtcggagct

SEQ ID NO: 174544 - DNA, 25 bp, Mus musculus
acaggtcgagggaagctaaagaagt

SEQ ID NO: 174545 - DNA, 25 bp, Mus musculus
acaggtcggaaggctgcctctcgct

SEQ ID NO: 174546 - DNA, 25 bp, Mus musculus
acaggtcttgtcaaacacgctggac

SEQ ID NO: 174547 - DNA, 25 bp, Mus musculus
acaggtgaagcatgatcagcaagtc

SEQ ID NO: 174548 - DNA, 25 bp, Mus musculus
acaggtgaagcatggggccactgtc

SEQ ID NO: 174549 - DNA, 25 bp, Mus musculus
acaggtgacaggttttactgcaatc

SEQ ID NO: 174550 - DNA, 25 bp, Mus musculus
acaggtgactggttgcaatcaggat

SEQ ID NO: 174551 - DNA, 25 bp, Mus musculus
acaggtgactggttgttaaatgaag

SEQ ID NO: 174552 - DNA, 25 bp, Mus musculus
acaggtgatcacgctcaccatcatg

SEQ ID NO: 174553 - DNA, 25 bp, Mus musculus
acaggtgatccagagaagagtttag

SEQ ID NO: 174554 - DNA, 25 bp, Mus musculus
acaggtgcctcggttccagggtccc

SEQ ID NO: 174555 - DNA, 25 bp, Mus musculus
acaggtgcctgaaaggttgcaggaa

SEQ ID NO: 174556 - DNA, 25 bp, Mus musculus
acaggtgctgaaaggtattcccaag

SEQ ID NO: 174557 - DNA, 25 bp, Mus musculus
acaggtggaagaactatatcagtct

SEQ ID NO: 174558 - DNA, 25 bp, Mus musculus
acaggtggaaggtacagttaaagaa

SEQ ID NO: 174559 - DNA, 25 bp, Mus musculus
acaggtggacccaggtttgccgaag

SEQ ID NO: 174560 - DNA, 25 bp, Mus musculus
acaggtggagcagggctcaaactca

SEQ ID NO: 174561 - DNA, 25 bp, Mus musculus
acaggtggcaaagaaccagcatttt

SEQ ID NO: 174562 - DNA, 25 bp, Mus musculus
acaggtggctctctgatgcaagctg

SEQ ID NO: 174563 - DNA, 25 bp, Mus musculus
acaggtggggtttaggtcacaatca

SEQ ID NO: 174564 - DNA, 25 bp, Mus musculus
acaggtgtagcttactaccagccaa

SEQ ID NO: 174565 - DNA, 25 bp, Mus musculus
acaggtgtagggcagaggagactga

SEQ ID NO: 174566 - DNA, 25 bp, Mus musculus
acaggtgtaggggttgtgctgggcc

SEQ ID NO: 174567 - DNA, 25 bp, Mus musculus
acaggtgtctagtggtaaagcgggc

SEQ ID NO: 174568 - DNA, 25 bp, Mus musculus
acaggtgtgaacaggttccacccga

SEQ ID NO: 174569 - DNA, 25 bp, Mus musculus
acaggttcttgagaggccacagacc

SEQ ID NO: 174570 - DNA, 25 bp, Mus musculus
acaggtttaggaatcactgggccac

SEQ ID NO: 174571 - DNA, 25 bp, Mus musculus
acaggtttgccctgagagtgggcca

SEQ ID NO: 174572 - DNA, 25 bp, Mus musculus
acagtaaaagctgaaaataatgatg

SEQ ID NO: 174573 - DNA, 25 bp, Mus musculus
acagtaaatggaagatcaagatcgc

SEQ ID NO: 174574 - DNA, 25 bp, Mus musculus
acagtaacagaggtgataagatttc

SEQ ID NO: 174575 - DNA, 25 bp, Mus musculus
acagtaacagagttgacagttcctc

SEQ ID NO: 174576 - DNA, 25 bp, Mus musculus
acagtaaccatccttcttgctttgt

SEQ ID NO: 174577 - DNA, 25 bp, Mus musculus
acagtaagaaggtggaggagcctgc

SEQ ID NO: 174578 - DNA, 25 bp, Mus musculus
acagtaagaaggtggagtacctcta

SEQ ID NO: 174579 - DNA, 25 bp, Mus musculus
acagtaagaccgtggtaaatgtttc

SEQ ID NO: 174580 - DNA, 25 bp, Mus musculus
acagtaagaggtaaagttcaagtta

SEQ ID NO: 174581 - DNA, 25 bp, Mus musculus
acagtaagtacagttgatacactaa

SEQ ID NO: 174582 - DNA, 25 bp, Mus musculus
acagtaagtcaggaggatcgcaagt

SEQ ID NO: 174583 - DNA, 25 bp, Mus musculus
acagtaagtctatatggagacacca

SEQ ID NO: 174584 - DNA, 25 bp, Mus musculus
acagtaataagtgcgtgaagactct

SEQ ID NO: 174585 - DNA, 25 bp, Mus musculus
acagtaatataccaagtgtcctggt

SEQ ID NO: 174586 - DNA, 25 bp, Mus musculus
acagtaatataccaatgtctcttgg

SEQ ID NO: 174587 - DNA, 25 bp, Mus musculus
acagtacacagtgagagttcgatgc

SEQ ID NO: 174588 - DNA, 25 bp, Mus musculus
acagtacagaggctttttcagggct

SEQ ID NO: 174589 - DNA, 25 bp, Mus musculus
acagtacagaggtctatggccagcc

SEQ ID NO: 174590 - DNA, 25 bp, Mus musculus
acagtacccatcaactaattgtcaa

SEQ ID NO: 174591 - DNA, 25 bp, Mus musculus
acagtacccatcaagccaccctgta

SEQ ID NO: 174592 - DNA, 25 bp, Mus musculus
acagtaccctcggcgcttgttctct

SEQ ID NO: 174593 - DNA, 25 bp, Mus musculus
acagtacctcccaagccggccgttg

SEQ ID NO: 174594 - DNA, 25 bp, Mus musculus
acagtacctcccagtactgggtaca

SEQ ID NO: 174595 - DNA, 25 bp, Mus musculus
acagtactatggggatgtctgtgtt

SEQ ID NO: 174596 - DNA, 25 bp, Mus musculus
acagtagaagagctgccctctgaag

SEQ ID NO: 174597 - DNA, 25 bp, Mus musculus
acagtagacactacttcatccgttc

SEQ ID NO: 174598 - DNA, 25 bp, Mus musculus
acagtagcttagcatggtttattga

SEQ ID NO: 174599 - DNA, 25 bp, Mus musculus
acagtaggctaccggtgatggtgtg

SEQ ID NO: 174600 - DNA, 25 bp, Mus musculus
acagtaggtttgtagtgagcttagc

SEQ ID NO: 174601 - DNA, 25 bp, Mus musculus
acagtagttctaaagtgtcatattt

SEQ ID NO: 174602 - DNA, 25 bp, Mus musculus
acagtataaaacccatacaatttgt

SEQ ID NO: 174603 - DNA, 25 bp, Mus musculus
acagtataaaacccatccagaatga

SEQ ID NO: 174604 - DNA, 25 bp, Mus musculus
acagtatccaaaggagtgtgcagca

SEQ ID NO: 174605 - DNA, 25 bp, Mus musculus
acagtatccaaagttcaattttgtg

SEQ ID NO: 174606 - DNA, 25 bp, Mus musculus
acagtatcgaggagaaagaaaagaa

SEQ ID NO: 174607 - DNA, 25 bp, Mus musculus
acagtatctatgcagggtgacaagg

SEQ ID NO: 174608 - DNA, 25 bp, Mus musculus
acagtatgaagttttcaggggctct

SEQ ID NO: 174609 - DNA, 25 bp, Mus musculus
acagtatgagggagtggggccggcc

SEQ ID NO: 174610 - DNA, 25 bp, Mus musculus
acagtatgtattggatatgatggtt

SEQ ID NO: 174611 - DNA, 25 bp, Mus musculus
acagtatgtgtgcagttatgagggt

SEQ ID NO: 174612 - DNA, 25 bp, Mus musculus
acagtattaaaccaggtgctgtgga

SEQ ID NO: 174613 - DNA, 25 bp, Mus musculus
acagtattcagaggaaatataagaa

SEQ ID NO: 174614 - DNA, 25 bp, Mus musculus
acagtattcagttacggtctttggt

SEQ ID NO: 174615 - DNA, 25 bp, Mus musculus
acagtattcatgagaacctgcagct

SEQ ID NO: 174616 - DNA, 25 bp, Mus musculus
acagtattctacagcccaggagtgt

SEQ ID NO: 174617 - DNA, 25 bp, Mus musculus
acagtattctacagctcaagactgc

SEQ ID NO: 174618 - DNA, 25 bp, Mus musculus
acagtattctacagctgaggaatgt

SEQ ID NO: 174619 - DNA, 25 bp, Mus musculus
acagtattgaggagaaacgaaaccc

SEQ ID NO: 174620 - DNA, 25 bp, Mus musculus
acagtcaaatcagatgcccccacga

SEQ ID NO: 174621 - DNA, 25 bp, Mus musculus
acagtcaacagcccgaaaagcgact

SEQ ID NO: 174622 - DNA, 25 bp, Mus musculus
acagtcaacagcccgacgtatgttt

SEQ ID NO: 174623 - DNA, 25 bp, Mus musculus
acagtcaatcagaatcagatagtaa

SEQ ID NO: 174624 - DNA, 25 bp, Mus musculus
acagtcaatcaggtacatccaaacg

SEQ ID NO: 174625 - DNA, 25 bp, Mus musculus
acagtcacagactgtatgagagtgc

SEQ ID NO: 174626 - DNA, 25 bp, Mus musculus
acagtcacagagagtggtgaaggca

SEQ ID NO: 174627 - DNA, 25 bp, Mus musculus
acagtcacagatggctttatggatt

SEQ ID NO: 174628 - DNA, 25 bp, Mus musculus
acagtcacagcgtattgtcagggca

SEQ ID NO: 174629 - DNA, 25 bp, Mus musculus
acagtcacaggcagatattgtaaac

SEQ ID NO: 174630 - DNA, 25 bp, Mus musculus
acagtcacatttacagactcctagt

SEQ ID NO: 174631 - DNA, 25 bp, Mus musculus
acagtcaccgagagtggggagtagt

SEQ ID NO: 174632 - DNA, 25 bp, Mus musculus
acagtcactaccaggtgcagaccca

SEQ ID NO: 174633 - DNA, 25 bp, Mus musculus
acagtcactcggaggcttactgctc

SEQ ID NO: 174634 - DNA, 25 bp, Mus musculus
acagtcactggacccaaagtcattc

SEQ ID NO: 174635 - DNA, 25 bp, Mus musculus
acagtcagaagccggagcctggcga

SEQ ID NO: 174636 - DNA, 25 bp, Mus musculus
acagtcagcacaaactacagctgtg

SEQ ID NO: 174637 - DNA, 25 bp, Mus musculus
acagtcagcacaactcctccagtgc

SEQ ID NO: 174638 - DNA, 25 bp, Mus musculus
acagtcagtacctaccgtgctgtgc

SEQ ID NO: 174639 - DNA, 25 bp, Mus musculus
acagtcagtacctagatcgacagct

SEQ ID NO: 174640 - DNA, 25 bp, Mus musculus
acagtcagttaaaagaaggtaccag

SEQ ID NO: 174641 - DNA, 25 bp, Mus musculus
acagtcagttcagcttcaattagtg

SEQ ID NO: 174642 - DNA, 25 bp, Mus musculus
acagtcatacagaaccatgaccatc

SEQ ID NO: 174643 - DNA, 25 bp, Mus musculus
acagtcatacagtccagacaagaca

SEQ ID NO: 174644 - DNA, 25 bp, Mus musculus
acagtccaaggtcacacggttatcc

SEQ ID NO: 174645 - DNA, 25 bp, Mus musculus
acagtccagagcgcctccccatctg

SEQ ID NO: 174646 - DNA, 25 bp, Mus musculus
acagtccagcgagtgtgctagaggc

SEQ ID NO: 174647 - DNA, 25 bp, Mus musculus
acagtccagctccaagttatctcca

SEQ ID NO: 174648 - DNA, 25 bp, Mus musculus
acagtccatggagagattgatcctg

SEQ ID NO: 174649 - DNA, 25 bp, Mus musculus
acagtcccagcagagtgatggttgc

SEQ ID NO: 174650 - DNA, 25 bp, Mus musculus
acagtcccagcaggacatggatttg

SEQ ID NO: 174651 - DNA, 25 bp, Mus musculus
acagtcccccgcaagcctcctggag

SEQ ID NO: 174652 - DNA, 25 bp, Mus musculus
acagtccggggaccgaaagtctcct

SEQ ID NO: 174653 - DNA, 25 bp, Mus musculus
acagtcctagaaaaccaaactgcag

SEQ ID NO: 174654 - DNA, 25 bp, Mus musculus
acagtcctcagaagagcatggcaga

SEQ ID NO: 174655 - DNA, 25 bp, Mus musculus
acagtcctcagaagcatggtgtgct

SEQ ID NO: 174656 - DNA, 25 bp, Mus musculus
acagtcctcggaggagtatatatcc

SEQ ID NO: 174657 - DNA, 25 bp, Mus musculus
acagtcctgactatgccacctgctc

SEQ ID NO: 174658 - DNA, 25 bp, Mus musculus
acagtcctgattctttaagaaatag

SEQ ID NO: 174659 - DNA, 25 bp, Mus musculus
acagtcctgcagatcgtcctgcttc

SEQ ID NO: 174660 - DNA, 25 bp, Mus musculus
acagtcgcttgcaaggttcctgtcc

SEQ ID NO: 174661 - DNA, 25 bp, Mus musculus
acagtcgcttgcaagtgtgacttgg

SEQ ID NO: 174662 - DNA, 25 bp, Mus musculus
acagtcggaccagatggtgacttgc

SEQ ID NO: 174663 - DNA, 25 bp, Mus musculus
acagtcggagccatgcctcttcgac

SEQ ID NO: 174664 - DNA, 25 bp, Mus musculus
acagtcggagccatggagcatttca

SEQ ID NO: 174665 - DNA, 25 bp, Mus musculus
acagtctactcacaggagaaaatgc

SEQ ID NO: 174666 - DNA, 25 bp, Mus musculus
acagtctatcttggaaaagatgacg

SEQ ID NO: 174667 - DNA, 25 bp, Mus musculus
acagtctcagaaaccattgaatcct

SEQ ID NO: 174668 - DNA, 25 bp, Mus musculus
acagtctcagaagtcagcggctgcg

SEQ ID NO: 174669 - DNA, 25 bp, Mus musculus
acagtctcagccacagagaaccagg

SEQ ID NO: 174670 - DNA, 25 bp, Mus musculus
acagtctcagctgccacccgatgca

SEQ ID NO: 174671 - DNA, 25 bp, Mus musculus
acagtctcagctgcctcctggtcac

SEQ ID NO: 174672 - DNA, 25 bp, Mus musculus
acagtctcctcagagagtcagtcct

SEQ ID NO: 174673 - DNA, 25 bp, Mus musculus
acagtctcctcagagtctgcgagaa

SEQ ID NO: 174674 - DNA, 25 bp, Mus musculus
acagtctcctcagccaaaacaacac

SEQ ID NO: 174675 - DNA, 25 bp, Mus musculus
acagtctcctcagccaaaacaacag

SEQ ID NO: 174676 - DNA, 25 bp, Mus musculus
acagtctcctcagccaaaacgacac

SEQ ID NO: 174677 - DNA, 25 bp, Mus musculus
acagtctcctcagctacaacaacag

SEQ ID NO: 174678 - DNA, 25 bp, Mus musculus
acagtctctgcccttcaggatgagc

SEQ ID NO: 174679 - DNA, 25 bp, Mus musculus
acagtctcttcctctgctctgcctt

SEQ ID NO: 174680 - DNA, 25 bp, Mus musculus
acagtctgacacagcaattaccaag

SEQ ID NO: 174681 - DNA, 25 bp, Mus musculus
acagtctgaggaagcctaacctgac

SEQ ID NO: 174682 - DNA, 25 bp, Mus musculus
acagtctgaggtgtcttcagaagcc

SEQ ID NO: 174683 - DNA, 25 bp, Mus musculus
acagtctgcagcatgtgtgaactgt

SEQ ID NO: 174684 - DNA, 25 bp, Mus musculus
acagtcttcggacatagactgactc

SEQ ID NO: 174685 - DNA, 25 bp, Mus musculus
acagtgaagcaggcagggcattttc

SEQ ID NO: 174686 - DNA, 25 bp, Mus musculus
acagtgaatcagcctcaccttcagc

SEQ ID NO: 174687 - DNA, 25 bp, Mus musculus
acagtgacaagggagaattcggtgg

SEQ ID NO: 174688 - DNA, 25 bp, Mus musculus
acagtgacaagggagggaaaattga

SEQ ID NO: 174689 - DNA, 25 bp, Mus musculus
acagtgacagaaatcagttcgtctt

SEQ ID NO: 174690 - DNA, 25 bp, Mus musculus
acagtgacagggcccaatgtaaagg

SEQ ID NO: 174691 - DNA, 25 bp, Mus musculus
acagtgacaggtatatctttgcaaa

SEQ ID NO: 174692 - DNA, 25 bp, Mus musculus
acagtgacagttacggacgagttta

SEQ ID NO: 174693 - DNA, 25 bp, Mus musculus
acagtgaccccctggcaggacacta

SEQ ID NO: 174694 - DNA, 25 bp, Mus musculus
acagtgacccggctaagcatgggga

SEQ ID NO: 174695 - DNA, 25 bp, Mus musculus
acagtgacccggtgaagacttttgg

SEQ ID NO: 174696 - DNA, 25 bp, Mus musculus
acagtgacggccctggagatggaag

SEQ ID NO: 174697 - DNA, 25 bp, Mus musculus
acagtgagaacacaaacctccaatg

SEQ ID NO: 174698 - DNA, 25 bp, Mus musculus
acagtgagagcgagcaaccttcaaa

SEQ ID NO: 174699 - DNA, 25 bp, Mus musculus
acagtgagcaggggtgactactttg

SEQ ID NO: 174700 - DNA, 25 bp, Mus musculus
acagtgagcgggggctgagtgtcag

SEQ ID NO: 174701 - DNA, 25 bp, Mus musculus
acagtgatactagtcgacaattaga

SEQ ID NO: 174702 - DNA, 25 bp, Mus musculus
acagtgatactagtttaaaagccgc

SEQ ID NO: 174703 - DNA, 25 bp, Mus musculus
acagtgatcaggttcagcgtcctct

SEQ ID NO: 174704 - DNA, 25 bp, Mus musculus
acagtgatgctacaggtaaagtcct

SEQ ID NO: 174705 - DNA, 25 bp, Mus musculus
acagtgatgctgatgagtgccttgc

SEQ ID NO: 174706 - DNA, 25 bp, Mus musculus
acagtgatgctggacaccgccttag

SEQ ID NO: 174707 - DNA, 25 bp, Mus musculus
acagtgatggacaggtttttggtgc

SEQ ID NO: 174708 - DNA, 25 bp, Mus musculus
acagtgatgtgtttggactcacaca

SEQ ID NO: 174709 - DNA, 25 bp, Mus musculus
acagtgatgtgtttggggaggcaga

SEQ ID NO: 174710 - DNA, 25 bp, Mus musculus
acagtgattatagttgattgaatca

SEQ ID NO: 174711 - DNA, 25 bp, Mus musculus
acagtgattatagtttcagagccat

SEQ ID NO: 174712 - DNA, 25 bp, Mus musculus
acagtgcaaaggtaatgctgatggc

SEQ ID NO: 174713 - DNA, 25 bp, Mus musculus
acagtgcaagccccatgtcactgcc

SEQ ID NO: 174714 - DNA, 25 bp, Mus musculus
acagtgcacagctggtatgcatgga

SEQ ID NO: 174715 - DNA, 25 bp, Mus musculus
acagtgcagacgtagagggatttaa

SEQ ID NO: 174716 - DNA, 25 bp, Mus musculus
acagtgcagggctggaagccattca

SEQ ID NO: 174717 - DNA, 25 bp, Mus musculus
acagtgcagggtcaccatcatgatg

SEQ ID NO: 174718 - DNA, 25 bp, Mus musculus
acagtgccaacatttaaacgagtgt

SEQ ID NO: 174719 - DNA, 25 bp, Mus musculus
acagtgccaacctggagaaggcgca

SEQ ID NO: 174720 - DNA, 25 bp, Mus musculus
acagtgccaacctgtgtgtcaacca

SEQ ID NO: 174721 - DNA, 25 bp, Mus musculus
acagtgccaacctttctacgtctta

SEQ ID NO: 174722 - DNA, 25 bp, Mus musculus
acagtgccaagaagggttgagattg

SEQ ID NO: 174723 - DNA, 25 bp, Mus musculus
acagtgccaagatttttttcgtatc

SEQ ID NO: 174724 - DNA, 25 bp, Mus musculus
acagtgccaaggtcaaaattgcaga

SEQ ID NO: 174725 - DNA, 25 bp, Mus musculus
acagtgccacggctgagttaagaat

SEQ ID NO: 174726 - DNA, 25 bp, Mus musculus
acagtgccagctgaggatggttccc

SEQ ID NO: 174727 - DNA, 25 bp, Mus musculus
acagtgccaggcaggtcggataact

SEQ ID NO: 174728 - DNA, 25 bp, Mus musculus
acagtgccagggagcccagaggaaa

SEQ ID NO: 174729 - DNA, 25 bp, Mus musculus
acagtgccattaggttttcttaaag

SEQ ID NO: 174730 - DNA, 25 bp, Mus musculus
acagtgcccacccatcactcagcac

SEQ ID NO: 174731 - DNA, 25 bp, Mus musculus
acagtgcccctgcttgttctccagg

SEQ ID NO: 174732 - DNA, 25 bp, Mus musculus
acagtgcccgcccaggttgtcttga

SEQ ID NO: 174733 - DNA, 25 bp, Mus musculus
acagtgcccgtgcgcagttctgtgg

SEQ ID NO: 174734 - DNA, 25 bp, Mus musculus
acagtgccggtgctgtaagaggaaa

SEQ ID NO: 174735 - DNA, 25 bp, Mus musculus
acagtgccggtggtgtaagaggaaa

SEQ ID NO: 174736 - DNA, 25 bp, Mus musculus
acagtgcctggacaggtcctggaag

SEQ ID NO: 174737 - DNA, 25 bp, Mus musculus
acagtgcctggtgtcgaggaggcgg

SEQ ID NO: 174738 - DNA, 25 bp, Mus musculus
acagtgccttcagagtgatccacct

SEQ ID NO: 174739 - DNA, 25 bp, Mus musculus
acagtgccttcaggtgccttggagc

SEQ ID NO: 174740 - DNA, 25 bp, Mus musculus
acagtgcgcctccgccggtgagctc

SEQ ID NO: 174741 - DNA, 25 bp, Mus musculus
acagtgcgcgcgatgaggctgtaga

SEQ ID NO: 174742 - DNA, 25 bp, Mus musculus
acagtgctctgagaacagtacggac

SEQ ID NO: 174743 - DNA, 25 bp, Mus musculus
acagtgctgccacgacccttcccac

SEQ ID NO: 174744 - DNA, 25 bp, Mus musculus
acagtggaaaggttgagttatttga

SEQ ID NO: 174745 - DNA, 25 bp, Mus musculus
acagtggaattatagccacaatcac

SEQ ID NO: 174746 - DNA, 25 bp, Mus musculus
acagtggaggtgaaggccaatacat

SEQ ID NO: 174747 - DNA, 25 bp, Mus musculus
acagtggataaatagatgcccgtgt

SEQ ID NO: 174748 - DNA, 25 bp, Mus musculus
acagtggatccagatctcggacgct

SEQ ID NO: 174749 - DNA, 25 bp, Mus musculus
acagtggatgttcctccatttggaa

SEQ ID NO: 174750 - DNA, 25 bp, Mus musculus
acagtgggaccaagaacacggtaca

SEQ ID NO: 174751 - DNA, 25 bp, Mus musculus
acagtgggatggagctcctggtgaa

SEQ ID NO: 174752 - DNA, 25 bp, Mus musculus
acagtgggcccccaagccttggaaa

SEQ ID NO: 174753 - DNA, 25 bp, Mus musculus
acagtggtgaacattagcaacaaga

SEQ ID NO: 174754 - DNA, 25 bp, Mus musculus
acagtggtgaagggacacgcctgcg

SEQ ID NO: 174755 - DNA, 25 bp, Mus musculus
acagtggtgacaggctccatccaac

SEQ ID NO: 174756 - DNA, 25 bp, Mus musculus
acagtggtgaggtgtatggctgggg

SEQ ID NO: 174757 - DNA, 25 bp, Mus musculus
acagtgtaaaaacagaaagtgtgga

SEQ ID NO: 174758 - DNA, 25 bp, Mus musculus
acagtgtaaagctctatgtcagaaa

SEQ ID NO: 174759 - DNA, 25 bp, Mus musculus
acagtgtatacagtggcccatcatg

SEQ ID NO: 174760 - DNA, 25 bp, Mus musculus
acagtgtattcccaggacccacatt

SEQ ID NO: 174761 - DNA, 25 bp, Mus musculus
acagtgtcaaccagtgctcagagtt

SEQ ID NO: 174762 - DNA, 25 bp, Mus musculus
acagtgtcaaccatcttgctctaca

SEQ ID NO: 174763 - DNA, 25 bp, Mus musculus
acagtgtcaagttctgtggatctac

SEQ ID NO: 174764 - DNA, 25 bp, Mus musculus
acagtgtcccaggtccctgtggccc

SEQ ID NO: 174765 - DNA, 25 bp, Mus musculus
acagtgtcccaggtctctaactggt

SEQ ID NO: 174766 - DNA, 25 bp, Mus musculus
acagtgtcctagcagattgtccttc

SEQ ID NO: 174767 - DNA, 25 bp, Mus musculus
acagtgtctcggttattcccaattg

SEQ ID NO: 174768 - DNA, 25 bp, Mus musculus
acagtgtgaccgtaccgacccttga

SEQ ID NO: 174769 - DNA, 25 bp, Mus musculus
acagtgtgcgaagatgtggatgagt

SEQ ID NO: 174770 - DNA, 25 bp, Mus musculus
acagtgtgtcaggcattcggggcac

SEQ ID NO: 174771 - DNA, 25 bp, Mus musculus
acagtgttaccagcaccaccaaaaa

SEQ ID NO: 174772 - DNA, 25 bp, Mus musculus
acagtgttcaagggtctcttgtggt

SEQ ID NO: 174773 - DNA, 25 bp, Mus musculus
acagtgtttggattctccagtgaca

SEQ ID NO: 174774 - DNA, 25 bp, Mus musculus
acagtgtttgggcggttcgacaaga

SEQ ID NO: 174775 - DNA, 25 bp, Mus musculus
acagtgtttttgcagaatgtgtgct

SEQ ID NO: 174776 - DNA, 25 bp, Mus musculus
acagttaaaaggttttcagcagact

SEQ ID NO: 174777 - DNA, 25 bp, Mus musculus
acagttaagtagtcttttcacagag

SEQ ID NO: 174778 - DNA, 25 bp, Mus musculus
acagttacatgcaggtcataaatga

SEQ ID NO: 174779 - DNA, 25 bp, Mus musculus
acagttaccaggaccgctcctttga

SEQ ID NO: 174780 - DNA, 25 bp, Mus musculus
acagttaccaggggcacgaccagtt

SEQ ID NO: 174781 - DNA, 25 bp, Mus musculus
acagttacctagatattgctgttgg

SEQ ID NO: 174782 - DNA, 25 bp, Mus musculus
acagttacctaggcttttcactgga

SEQ ID NO: 174783 - DNA, 25 bp, Mus musculus
acagttagaggaaagaacaggctgc

SEQ ID NO: 174784 - DNA, 25 bp, Mus musculus
acagttagaggttcgagaaatggct

SEQ ID NO: 174785 - DNA, 25 bp, Mus musculus
acagttatctgcagaatgtgtatgc

SEQ ID NO: 174786 - DNA, 25 bp, Mus musculus
acagttcacagcagatgtaaagaac

SEQ ID NO: 174787 - DNA, 25 bp, Mus musculus
acagttcacagcaggtttaaaaaat

SEQ ID NO: 174788 - DNA, 25 bp, Mus musculus
acagttcacagggaaccccaatata

SEQ ID NO: 174789 - DNA, 25 bp, Mus musculus
acagttcactcaagagttcacaagc

SEQ ID NO: 174790 - DNA, 25 bp, Mus musculus
acagttcactcaaggagctctgtga

SEQ ID NO: 174791 - DNA, 25 bp, Mus musculus
acagttcataaacaagatgaaatta

SEQ ID NO: 174792 - DNA, 25 bp, Mus musculus
acagttcataaacaaggtcgctggt

SEQ ID NO: 174793 - DNA, 25 bp, Mus musculus
acagttcatcagaggagaaatgggt

SEQ ID NO: 174794 - DNA, 25 bp, Mus musculus
acagttcatgaaatcttttgagcat

SEQ ID NO: 174795 - DNA, 25 bp, Mus musculus
acagttcatgaggttacgtccccat

SEQ ID NO: 174796 - DNA, 25 bp, Mus musculus
acagttccagaggcagcagtggtcg

SEQ ID NO: 174797 - DNA, 25 bp, Mus musculus
acagttccagattcagcacttagga

SEQ ID NO: 174798 - DNA, 25 bp, Mus musculus
acagttccaggaagggaacataatg

SEQ ID NO: 174799 - DNA, 25 bp, Mus musculus
acagttccagtcactattaccttgc

SEQ ID NO: 174800 - DNA, 25 bp, Mus musculus
acagttcctgcgaggctgctccact

SEQ ID NO: 174801 - DNA, 25 bp, Mus musculus
acagttcgcagatacacttttggcg

SEQ ID NO: 174802 - DNA, 25 bp, Mus musculus
acagttcgcaggaggcagagtaaga

SEQ ID NO: 174803 - DNA, 25 bp, Mus musculus
acagttctatggccaacaggctatg

SEQ ID NO: 174804 - DNA, 25 bp, Mus musculus
acagttctgcaccagcaggaagtga

SEQ ID NO: 174805 - DNA, 25 bp, Mus musculus
acagttctgcaccaggcatagcagg

SEQ ID NO: 174806 - DNA, 25 bp, Mus musculus
acagttctgccagcgcctgtgagag

SEQ ID NO: 174807 - DNA, 25 bp, Mus musculus
acagttcttccaatcccacatgtaa

SEQ ID NO: 174808 - DNA, 25 bp, Mus musculus
acagttgaagggccttcagtggggc

SEQ ID NO: 174809 - DNA, 25 bp, Mus musculus
acagttgataaagactccattagca

SEQ ID NO: 174810 - DNA, 25 bp, Mus musculus
acagttgatttgagggatggagagt

SEQ ID NO: 174811 - DNA, 25 bp, Mus musculus
acagttgcaggcatcccacaaagag

SEQ ID NO: 174812 - DNA, 25 bp, Mus musculus
acagttgcttagaggctcttgaaat

SEQ ID NO: 174813 - DNA, 25 bp, Mus musculus
acagttgcttataggctcttgaaat

SEQ ID NO: 174814 - DNA, 25 bp, Mus musculus
acagttggaaatcagcaagaagaga

SEQ ID NO: 174815 - DNA, 25 bp, Mus musculus
acagttggaaatcaggggtctgcaa

SEQ ID NO: 174816 - DNA, 25 bp, Mus musculus
acagttggccgatatgaaaatccat

SEQ ID NO: 174817 - DNA, 25 bp, Mus musculus
acagttggtggctacctgaagctga

SEQ ID NO: 174818 - DNA, 25 bp, Mus musculus
acagttggttttgaagaaaggcttt

SEQ ID NO: 174819 - DNA, 25 bp, Mus musculus
acagttgtagaggatctgagaaatg

SEQ ID NO: 174820 - DNA, 25 bp, Mus musculus
acagttgtctacgtcacagagctgc

SEQ ID NO: 174821 - DNA, 25 bp, Mus musculus
acagttgtctacttacagctctgag

SEQ ID NO: 174822 - DNA, 25 bp, Mus musculus
acagttgttcatgtcctgaagggga

SEQ ID NO: 174823 - DNA, 25 bp, Mus musculus
acagtttaaatgcagacttaattca

SEQ ID NO: 174824 - DNA, 25 bp, Mus musculus
acagtttaaatgcaggtctcagcca

SEQ ID NO: 174825 - DNA, 25 bp, Mus musculus
acagtttagtgtagcacttactagt

SEQ ID NO: 174826 - DNA, 25 bp, Mus musculus
acagtttagtgtagcttgaactttc

SEQ ID NO: 174827 - DNA, 25 bp, Mus musculus
acagtttagtgtagttccctccttt

SEQ ID NO: 174828 - DNA, 25 bp, Mus musculus
acagtttcagagtttctaagctgac

SEQ ID NO: 174829 - DNA, 25 bp, Mus musculus
acagtttccatagaaccagtcttca

SEQ ID NO: 174830 - DNA, 25 bp, Mus musculus
acagtttcgtcaagatcaaggtcac

SEQ ID NO: 174831 - DNA, 25 bp, Mus musculus
acagtttcgtcaaggtcaccaaggc

SEQ ID NO: 174832 - DNA, 25 bp, Mus musculus
acagtttctcaagggttgagctcca

SEQ ID NO: 174833 - DNA, 25 bp, Mus musculus
acagtttctcccatccccacctgtc

SEQ ID NO: 174834 - DNA, 25 bp, Mus musculus
acagtttctctagatttcaccaacg

SEQ ID NO: 174835 - DNA, 25 bp, Mus musculus
acagtttctgctctgaaggaaagag

SEQ ID NO: 174836 - DNA, 25 bp, Mus musculus
acagtttctgctctgcatggtgaca

SEQ ID NO: 174837 - DNA, 25 bp, Mus musculus
acagtttctgctctggcccgtggga

SEQ ID NO: 174838 - DNA, 25 bp, Mus musculus
acagtttctgctgcagttctcagac

SEQ ID NO: 174839 - DNA, 25 bp, Mus musculus
acagtttcttggtctggaataaaag

SEQ ID NO: 174840 - DNA, 25 bp, Mus musculus
acagtttgaaatcattgctatgtcc

SEQ ID NO: 174841 - DNA, 25 bp, Mus musculus
acagtttggaggacgtaccatgcgg

SEQ ID NO: 174842 - DNA, 25 bp, Mus musculus
acagtttggaggctcacccgggtgg

SEQ ID NO: 174843 - DNA, 25 bp, Mus musculus
acagttttaagagagattcctttct

SEQ ID NO: 174844 - DNA, 25 bp, Mus musculus
acagttttaagagaggatttaacag

SEQ ID NO: 174845 - DNA, 25 bp, Mus musculus
acagttttaagagaggtggctttgc

SEQ ID NO: 174846 - DNA, 25 bp, Mus musculus
acagtttttggaggcaactgtgccc

SEQ ID NO: 174847 - DNA, 25 bp, Mus musculus
acataaaaaagaggacgaggcggaa

SEQ ID NO: 174848 - DNA, 25 bp, Mus musculus
acataaaaaagcttgcacacacaat

SEQ ID NO: 174849 - DNA, 25 bp, Mus musculus
acataaaaaggagacagagtcagat

SEQ ID NO: 174850 - DNA, 25 bp, Mus musculus
acataaaaaggctgagaaggcagac

SEQ ID NO: 174851 - DNA, 25 bp, Mus musculus
acataaaactacgagctcctgcttc

SEQ ID NO: 174852 - DNA, 25 bp, Mus musculus
acataaaactacgaggtgttctgcc

SEQ ID NO: 174853 - DNA, 25 bp, Mus musculus
acataaaactacgagtcacaccaga

SEQ ID NO: 174854 - DNA, 25 bp, Mus musculus
acataaaactacgagtttatagaac

SEQ ID NO: 174855 - DNA, 25 bp, Mus musculus
acataaaagaggaactcattataca

SEQ ID NO: 174856 - DNA, 25 bp, Mus musculus
acataaacagaaagcttcacggaaa

SEQ ID NO: 174857 - DNA, 25 bp, Mus musculus
acataaagaaaatataaacaccagt

SEQ ID NO: 174858 - DNA, 25 bp, Mus musculus
acataaagaaaatgcagcgttcctg

SEQ ID NO: 174859 - DNA, 25 bp, Mus musculus
acataaagaagccaccccctctttg

SEQ ID NO: 174860 - DNA, 25 bp, Mus musculus
acataaagaagccagcccctctttg

SEQ ID NO: 174861 - DNA, 25 bp, Mus musculus
acataaagacagaggttcttgcagc

SEQ ID NO: 174862 - DNA, 25 bp, Mus musculus
acataaagagcagatcaaattgctt

SEQ ID NO: 174863 - DNA, 25 bp, Mus musculus
acataaagagcagttctcctatttc

SEQ ID NO: 174864 - DNA, 25 bp, Mus musculus
acataaatatgcaaacagggaggaa

SEQ ID NO: 174865 - DNA, 25 bp, Mus musculus
acataaatattgaaatcgcatcata

SEQ ID NO: 174866 - DNA, 25 bp, Mus musculus
acataaatggaaaaacagctctcct

SEQ ID NO: 174867 - DNA, 25 bp, Mus musculus
acataacccttcggtgacccaccct

SEQ ID NO: 174868 - DNA, 25 bp, Mus musculus
acataacctggagacagcctgtgca

SEQ ID NO: 174869 - DNA, 25 bp, Mus musculus
acataactggctgggtggaaccagg

SEQ ID NO: 174870 - DNA, 25 bp, Mus musculus
acataagcactgtgttttcagtaaa

SEQ ID NO: 174871 - DNA, 25 bp, Mus musculus
acataagcgtattatttatgtggca

SEQ ID NO: 174872 - DNA, 25 bp, Mus musculus
acataaggacattagattgatcagg

SEQ ID NO: 174873 - DNA, 25 bp, Mus musculus
acataagtaaccaaatgagtaagaa

SEQ ID NO: 174874 - DNA, 25 bp, Mus musculus
acataagtaaccaacacagatccag

SEQ ID NO: 174875 - DNA, 25 bp, Mus musculus
acataatgaaggtttatggaggtga

SEQ ID NO: 174876 - DNA, 25 bp, Mus musculus
acataatgcatgccaagtggcagca

SEQ ID NO: 174877 - DNA, 25 bp, Mus musculus
acataatggaagggccatgccacct

SEQ ID NO: 174878 - DNA, 25 bp, Mus musculus
acataattagcttgaagtcaatggc

SEQ ID NO: 174879 - DNA, 25 bp, Mus musculus
acataattccccagaaattgatgag

SEQ ID NO: 174880 - DNA, 25 bp, Mus musculus
acataattccccaggcgttaagcat

SEQ ID NO: 174881 - DNA, 25 bp, Mus musculus
acatacaaagacgacgctcacctgg

SEQ ID NO: 174882 - DNA, 25 bp, Mus musculus
acatacaaagctggcttaatggtga

SEQ ID NO: 174883 - DNA, 25 bp, Mus musculus
acatacaacatgctgttgtgaactt

SEQ ID NO: 174884 - DNA, 25 bp, Mus musculus
acatacaagagaggtgactacgggg

SEQ ID NO: 174885 - DNA, 25 bp, Mus musculus
acatacacagggagcatgacttcgg

SEQ ID NO: 174886 - DNA, 25 bp, Mus musculus
acatacagccagagaagtgacaggg

SEQ ID NO: 174887 - DNA, 25 bp, Mus musculus
acatacagccaggaaacaaagctta

SEQ ID NO: 174888 - DNA, 25 bp, Mus musculus
acatacagccaggaaggaatctgct

SEQ ID NO: 174889 - DNA, 25 bp, Mus musculus
acatacagggagcctgctttggtac

SEQ ID NO: 174890 - DNA, 25 bp, Mus musculus
acatacattaaaagttttcagcaga

SEQ ID NO: 174891 - DNA, 25 bp, Mus musculus
acatacattccagggccttattttg

SEQ ID NO: 174892 - DNA, 25 bp, Mus musculus
acataccacacagcaaggggacggg

SEQ ID NO: 174893 - DNA, 25 bp, Mus musculus
acataccacacagcaagggggaagc

SEQ ID NO: 174894 - DNA, 25 bp, Mus musculus
acatacccaggatcaaaaccctatc

SEQ ID NO: 174895 - DNA, 25 bp, Mus musculus
acatacccaggttgctgccttgatc

SEQ ID NO: 174896 - DNA, 25 bp, Mus musculus
acatacccagtgccttgccatctct

SEQ ID NO: 174897 - DNA, 25 bp, Mus musculus
acatacccagtgtgtcatcaataaa

SEQ ID NO: 174898 - DNA, 25 bp, Mus musculus
acatacccatgtctgaccttctgcc

SEQ ID NO: 174899 - DNA, 25 bp, Mus musculus
acatacctagggatgccctggacct

SEQ ID NO: 174900 - DNA, 25 bp, Mus musculus
acatacctgacaggagtggggatac

SEQ ID NO: 174901 - DNA, 25 bp, Mus musculus
acatacgacagctgcctcctagctt

SEQ ID NO: 174902 - DNA, 25 bp, Mus musculus
acatacgacagctgggctacttgat

SEQ ID NO: 174903 - DNA, 25 bp, Mus musculus
acatacggacctcaaacctgaaaat

SEQ ID NO: 174904 - DNA, 25 bp, Mus musculus
acatacggcacctcgacacgtgtgc

SEQ ID NO: 174905 - DNA, 25 bp, Mus musculus
acatacggcacctcggctggaaccc

SEQ ID NO: 174906 - DNA, 25 bp, Mus musculus
acatactaactaaaggatgacagtc

SEQ ID NO: 174907 - DNA, 25 bp, Mus musculus
acatactacgttgatcacctcaacc

SEQ ID NO: 174908 - DNA, 25 bp, Mus musculus
acatactatatatgccgttcctatg

SEQ ID NO: 174909 - DNA, 25 bp, Mus musculus
acatactcaagctaccactacccct

SEQ ID NO: 174910 - DNA, 25 bp, Mus musculus
acatactgatagaccctgttgactg

SEQ ID NO: 174911 - DNA, 25 bp, Mus musculus
acatactgccatttgatcacagccg

SEQ ID NO: 174912 - DNA, 25 bp, Mus musculus
acatactggggtgagcatgccaact

SEQ ID NO: 174913 - DNA, 25 bp, Mus musculus
acatacttccatgaaacaatcccac

SEQ ID NO: 174914 - DNA, 25 bp, Mus musculus
acatacttccatggccgtaattaac

SEQ ID NO: 174915 - DNA, 25 bp, Mus musculus
acatacttctacactccagaagagg

SEQ ID NO: 174916 - DNA, 25 bp, Mus musculus
acatagaaaggccaccttaggggtg

SEQ ID NO: 174917 - DNA, 25 bp, Mus musculus
acatagaaagggagccacccagccc

SEQ ID NO: 174918 - DNA, 25 bp, Mus musculus
acatagaaggagaaggtctcaggag

SEQ ID NO: 174919 - DNA, 25 bp, Mus musculus
acatagacagtagaggctccgcagg

SEQ ID NO: 174920 - DNA, 25 bp, Mus musculus
acatagaccagcgctcctccagaca

SEQ ID NO: 174921 - DNA, 25 bp, Mus musculus
acatagactgtgaagtatttcggcg

SEQ ID NO: 174922 - DNA, 25 bp, Mus musculus
acatagagaaggtgacagatgtcat

SEQ ID NO: 174923 - DNA, 25 bp, Mus musculus
acatagagacctaccttctggagaa

SEQ ID NO: 174924 - DNA, 25 bp, Mus musculus
acatagcaattaaggaactagaggc

SEQ ID NO: 174925 - DNA, 25 bp, Mus musculus
acatagcaattaagggagtggccag

SEQ ID NO: 174926 - DNA, 25 bp, Mus musculus
acatagccagatgaggaagctggaa

SEQ ID NO: 174927 - DNA, 25 bp, Mus musculus
acatagcccagaaggcgggcaggaa

SEQ ID NO: 174928 - DNA, 25 bp, Mus musculus
acatagcctgctgggtccaccataa

SEQ ID NO: 174929 - DNA, 25 bp, Mus musculus
acatagcgacagcgaaggacgaacg

SEQ ID NO: 174930 - DNA, 25 bp, Mus musculus
acatagctccacatgaactcacaga

SEQ ID NO: 174931 - DNA, 25 bp, Mus musculus
acatagctccacatgacattctctg

SEQ ID NO: 174932 - DNA, 25 bp, Mus musculus
acatagctccacatgccatttacca

SEQ ID NO: 174933 - DNA, 25 bp, Mus musculus
acatagctgcttggaagttggcagt

SEQ ID NO: 174934 - DNA, 25 bp, Mus musculus
acataggaagatcaccagcaaaagt

SEQ ID NO: 174935 - DNA, 25 bp, Mus musculus
acataggcaaggatagttcatgcag

SEQ ID NO: 174936 - DNA, 25 bp, Mus musculus
acataggctatgggcacgtgcggca

SEQ ID NO: 174937 - DNA, 25 bp, Mus musculus
acataggtcctacagctataggccg

SEQ ID NO: 174938 - DNA, 25 bp, Mus musculus
acatagtgaacgagccacctcccaa

SEQ ID NO: 174939 - DNA, 25 bp, Mus musculus
acatagtgaccatggtggtgatgac

SEQ ID NO: 174940 - DNA, 25 bp, Mus musculus
acatagtttaggtattgctttcacc

SEQ ID NO: 174941 - DNA, 25 bp, Mus musculus
acatataaactcaagccaggaacca

SEQ ID NO: 174942 - DNA, 25 bp, Mus musculus
acatataaactcaagggctcgggcc

SEQ ID NO: 174943 - DNA, 25 bp, Mus musculus
acatataataagaacctatgggcta

SEQ ID NO: 174944 - DNA, 25 bp, Mus musculus
acatataattcatattacaggcctg

SEQ ID NO: 174945 - DNA, 25 bp, Mus musculus
acatatagaagattttaaacagttt

SEQ ID NO: 174946 - DNA, 25 bp, Mus musculus
acatatagagcagtaccaaatatgc

SEQ ID NO: 174947 - DNA, 25 bp, Mus musculus
acatatcaaaatcagagccagaaac

SEQ ID NO: 174948 - DNA, 25 bp, Mus musculus
acatatcaaaatcaggagatggagt

SEQ ID NO: 174949 - DNA, 25 bp, Mus musculus
acatatcactactggggaaacaggc

SEQ ID NO: 174950 - DNA, 25 bp, Mus musculus
acatatcactactgtggtcgtgcag

SEQ ID NO: 174951 - DNA, 25 bp, Mus musculus
acatatcatccaggtgtgttatcca

SEQ ID NO: 174952 - DNA, 25 bp, Mus musculus
acatatcccagatctctctggcttt

SEQ ID NO: 174953 - DNA, 25 bp, Mus musculus
acatatgaaaaagggggccacatta

SEQ ID NO: 174954 - DNA, 25 bp, Mus musculus
acatatgagaaaatttccaggacct

SEQ ID NO: 174955 - DNA, 25 bp, Mus musculus
acatatgagtcgaacaccaaacagc

SEQ ID NO: 174956 - DNA, 25 bp, Mus musculus
acatatgcagacatcaagccctaca

SEQ ID NO: 174957 - DNA, 25 bp, Mus musculus
acatatgcaggaatctccacacaaa

SEQ ID NO: 174958 - DNA, 25 bp, Mus musculus
acatatggaagtgctccttccgctt

SEQ ID NO: 174959 - DNA, 25 bp, Mus musculus
acatatggaataaatttcaagaatt

SEQ ID NO: 174960 - DNA, 25 bp, Mus musculus
acatatggaatgcaaattgaagaat

SEQ ID NO: 174961 - DNA, 25 bp, Mus musculus
acatatggccagaatgaccatactc

SEQ ID NO: 174962 - DNA, 25 bp, Mus musculus
acatatggtactgagtactctctga

SEQ ID NO: 174963 - DNA, 25 bp, Mus musculus
acatattaaaggaggtcctggccag

SEQ ID NO: 174964 - DNA, 25 bp, Mus musculus
acatattcaaatctggaatgttccg

SEQ ID NO: 174965 - DNA, 25 bp, Mus musculus
acatattcaagcaaccatttaagaa

SEQ ID NO: 174966 - DNA, 25 bp, Mus musculus
acatattcttcatcgtcatttactt

SEQ ID NO: 174967 - DNA, 25 bp, Mus musculus
acatattgaaaagagagccaagcct

SEQ ID NO: 174968 - DNA, 25 bp, Mus musculus
acatattgaaaaggcggcaaagtgc

SEQ ID NO: 174969 - DNA, 25 bp, Mus musculus
acatatttattgcatccgatatcaa

SEQ ID NO: 174970 - DNA, 25 bp, Mus musculus
acatatttattggatgactaggacc

SEQ ID NO: 174971 - DNA, 25 bp, Mus musculus
acatatttattggtgaagccgagct

SEQ ID NO: 174972 - DNA, 25 bp, Mus musculus
acatatttgagaagatagatgaaga

SEQ ID NO: 174973 - DNA, 25 bp, Mus musculus
acatatttgcaggtgtcctccacca

SEQ ID NO: 174974 - DNA, 25 bp, Mus musculus
acatatttttaagtaggaaaatgac

SEQ ID NO: 174975 - DNA, 25 bp, Mus musculus
acatatttttaagtgtgatcccacc

SEQ ID NO: 174976 - DNA, 25 bp, Mus musculus
acatcaaaagaggcttccagtttgg

SEQ ID NO: 174977 - DNA, 25 bp, Mus musculus
acatcaaaagctgcagaatctgtga

SEQ ID NO: 174978 - DNA, 25 bp, Mus musculus
acatcaaaaggtacttcgagtttta

SEQ ID NO: 174979 - DNA, 25 bp, Mus musculus
acatcaaaataaaccaggcgatgcg

SEQ ID NO: 174980 - DNA, 25 bp, Mus musculus
acatcaaaatcttggtggaagatga

SEQ ID NO: 174981 - DNA, 25 bp, Mus musculus
acatcaaactatcaggtactctatc

SEQ ID NO: 174982 - DNA, 25 bp, Mus musculus
acatcaacaaggtgtttgagtttgg

SEQ ID NO: 174983 - DNA, 25 bp, Mus musculus
acatcaacgagaggacggcctgggt

SEQ ID NO: 174984 - DNA, 25 bp, Mus musculus
acatcaactacgggtatttggctcc

SEQ ID NO: 174985 - DNA, 25 bp, Mus musculus
acatcaacttcaagccctccaacca

SEQ ID NO: 174986 - DNA, 25 bp, Mus musculus
acatcaacttcaagggccagctaga

SEQ ID NO: 174987 - DNA, 25 bp, Mus musculus
acatcaagaaggcgtaccgaaagaa

SEQ ID NO: 174988 - DNA, 25 bp, Mus musculus
acatcaagaagggagaagaaatggg

SEQ ID NO: 174989 - DNA, 25 bp, Mus musculus
acatcaagacaaaccaggtgatgag

SEQ ID NO: 174990 - DNA, 25 bp, Mus musculus
acatcaagactgccaaggttacttt

SEQ ID NO: 174991 - DNA, 25 bp, Mus musculus
acatcaagactggagtacctgcaag

SEQ ID NO: 174992 - DNA, 25 bp, Mus musculus
acatcaagagttctaacgtgcttct

SEQ ID NO: 174993 - DNA, 25 bp, Mus musculus
acatcaagcgcgccaacagcctcgc

SEQ ID NO: 174994 - DNA, 25 bp, Mus musculus
acatcaagtttcagccctaccactg

SEQ ID NO: 174995 - DNA, 25 bp, Mus musculus
acatcaagtttctgccctaccactg

SEQ ID NO: 174996 - DNA, 25 bp, Mus musculus
acatcaataatgacaccacctactg

SEQ ID NO: 174997 - DNA, 25 bp, Mus musculus
acatcaatatcacagaaaagtgtgt

SEQ ID NO: 174998 - DNA, 25 bp, Mus musculus
acatcaatgctttgaatttaaaatc

SEQ ID NO: 174999 - DNA, 25 bp, Mus musculus
acatcaatgctttgttcacagaggc

SEQ ID NO: 175000 - DNA, 25 bp, Mus musculus
acatcaattgccagtctgcaagcca

SEQ ID NO: 175001 - DNA, 25 bp, Mus musculus
acatcacaagagccccatgctaaat

SEQ ID NO: 175002 - DNA, 25 bp, Mus musculus
acatcacaaggatgatgagggtgga

SEQ ID NO: 175003 - DNA, 25 bp, Mus musculus
acatcacactcaatgacgaggctgc

SEQ ID NO: 175004 - DNA, 25 bp, Mus musculus
acatcacagagtcccacccaggagt

SEQ ID NO: 175005 - DNA, 25 bp, Mus musculus
acatcacagggcacccatgcatcag

SEQ ID NO: 175006 - DNA, 25 bp, Mus musculus
acatcacagtttaggaactggtatg

SEQ ID NO: 175007 - DNA, 25 bp, Mus musculus
acatcacagtttagtggctgaccta

SEQ ID NO: 175008 - DNA, 25 bp, Mus musculus
acatcacattggcgtcttctgggac

SEQ ID NO: 175009 - DNA, 25 bp, Mus musculus
acatcaccagaagacaagactggca

SEQ ID NO: 175010 - DNA, 25 bp, Mus musculus
acatcaccagccgagaaacctgcaa

SEQ ID NO: 175011 - DNA, 25 bp, Mus musculus
acatcaccaggcgagaaacctgcaa

SEQ ID NO: 175012 - DNA, 25 bp, Mus musculus
acatcaccagggaattcgtaccagc

SEQ ID NO: 175013 - DNA, 25 bp, Mus musculus
acatcaccaggtctcattattctca

SEQ ID NO: 175014 - DNA, 25 bp, Mus musculus
acatcacccaggctgccggaaccag

SEQ ID NO: 175015 - DNA, 25 bp, Mus musculus
acatcacccccgccactggcttggc

SEQ ID NO: 175016 - DNA, 25 bp, Mus musculus
acatcacccccggtggtgaagggca

SEQ ID NO: 175017 - DNA, 25 bp, Mus musculus
acatcacccccgtgctccccctgca

SEQ ID NO: 175018 - DNA, 25 bp, Mus musculus
acatcaccctgacctgcaactcctc

SEQ ID NO: 175019 - DNA, 25 bp, Mus musculus
acatcaccttggatggcaaggtcag

SEQ ID NO: 175020 - DNA, 25 bp, Mus musculus
acatcacgaagaaacttgtggaaac

SEQ ID NO: 175021 - DNA, 25 bp, Mus musculus
acatcacgaaggctttacaatgtgg

SEQ ID NO: 175022 - DNA, 25 bp, Mus musculus
acatcacgaatccagttcactctga

SEQ ID NO: 175023 - DNA, 25 bp, Mus musculus
acatcacgcagtgtggcttgacctc

SEQ ID NO: 175024 - DNA, 25 bp, Mus musculus
acatcactaggaagggtgagtgggg

SEQ ID NO: 175025 - DNA, 25 bp, Mus musculus
acatcactataaagggagttggaaa

SEQ ID NO: 175026 - DNA, 25 bp, Mus musculus
acatcactataaaggggtgctggtg

SEQ ID NO: 175027 - DNA, 25 bp, Mus musculus
acatcactcacgagctctttgacat

SEQ ID NO: 175028 - DNA, 25 bp, Mus musculus
acatcactcagctttccactgccaa

SEQ ID NO: 175029 - DNA, 25 bp, Mus musculus
acatcactgtggataaaaatatgcc

SEQ ID NO: 175030 - DNA, 25 bp, Mus musculus
acatcacttggctgtcggcgagcca

SEQ ID NO: 175031 - DNA, 25 bp, Mus musculus
acatcagaaaattagaccgattcaa

SEQ ID NO: 175032 - DNA, 25 bp, Mus musculus
acatcagaaagggtctgccgtcatc

SEQ ID NO: 175033 - DNA, 25 bp, Mus musculus
acatcagaagactcaaatggtcatt

SEQ ID NO: 175034 - DNA, 25 bp, Mus musculus
acatcagaagatggtgaggattcag

SEQ ID NO: 175035 - DNA, 25 bp, Mus musculus
acatcagaagttttagagcgaaaaa

SEQ ID NO: 175036 - DNA, 25 bp, Mus musculus
acatcagagacttcagtactcgctc

SEQ ID NO: 175037 - DNA, 25 bp, Mus musculus
acatcagagagtgtccaggttatgg

SEQ ID NO: 175038 - DNA, 25 bp, Mus musculus
acatcagaggagagcccagaggctc

SEQ ID NO: 175039 - DNA, 25 bp, Mus musculus
acatcagagtaggtttgattggcag

SEQ ID NO: 175040 - DNA, 25 bp, Mus musculus
acatcagcagcccagtggtactgcc

SEQ ID NO: 175041 - DNA, 25 bp, Mus musculus
acatcagcaggaacgtcatccatgc

SEQ ID NO: 175042 - DNA, 25 bp, Mus musculus
acatcagcaggcccgggagatcaag

SEQ ID NO: 175043 - DNA, 25 bp, Mus musculus
acatcagcagtgcctgcagaagcca

SEQ ID NO: 175044 - DNA, 25 bp, Mus musculus
acatcagcatcgtgtttactccaga

SEQ ID NO: 175045 - DNA, 25 bp, Mus musculus
acatcagccctggttcaggcagctg

SEQ ID NO: 175046 - DNA, 25 bp, Mus musculus
acatcagcgacacgcgggcgtccga

SEQ ID NO: 175047 - DNA, 25 bp, Mus musculus
acatcagctctgagtggtgggacga

SEQ ID NO: 175048 - DNA, 25 bp, Mus musculus
acatcagctctgggcgtcagtgttc

SEQ ID NO: 175049 - DNA, 25 bp, Mus musculus
acatcagctgcacctcagtcccctc

SEQ ID NO: 175050 - DNA, 25 bp, Mus musculus
acatcagctggtcctatgtatggcg

SEQ ID NO: 175051 - DNA, 25 bp, Mus musculus
acatcagctgtcagtgcactgatgt

SEQ ID NO: 175052 - DNA, 25 bp, Mus musculus
acatcagctgtcagttctttgccag

SEQ ID NO: 175053 - DNA, 25 bp, Mus musculus
acatcagggtgtaccagcctccagc

SEQ ID NO: 175054 - DNA, 25 bp, Mus musculus
acatcaggtccaagagtctgaagga

SEQ ID NO: 175055 - DNA, 25 bp, Mus musculus
acatcaggtccaagtccgtaattga

SEQ ID NO: 175056 - DNA, 25 bp, Mus musculus
acatcagtgagaaagtggacaccat

SEQ ID NO: 175057 - DNA, 25 bp, Mus musculus
acatcataaagaggctcacaactca

SEQ ID NO: 175058 - DNA, 25 bp, Mus musculus
acatcatatggagagacgtgtcctg

SEQ ID NO: 175059 - DNA, 25 bp, Mus musculus
acatcatatggagagtatgctatta

SEQ ID NO: 175060 - DNA, 25 bp, Mus musculus
acatcatcacagatcttcggaacca

SEQ ID NO: 175061 - DNA, 25 bp, Mus musculus
acatcatcacagcaatccgccactt

SEQ ID NO: 175062 - DNA, 25 bp, Mus musculus
acatcatcacagcctggcaccctcc

SEQ ID NO: 175063 - DNA, 25 bp, Mus musculus
acatcatcacagcctgtaaaaagaa

SEQ ID NO: 175064 - DNA, 25 bp, Mus musculus
acatcatcacaggagcgaggcacgg

SEQ ID NO: 175065 - DNA, 25 bp, Mus musculus
acatcatcacagtgctgaagacagt

SEQ ID NO: 175066 - DNA, 25 bp, Mus musculus
acatcatcacgaaactgaggctcct

SEQ ID NO: 175067 - DNA, 25 bp, Mus musculus
acatcatcagacttgcgtgcgggac

SEQ ID NO: 175068 - DNA, 25 bp, Mus musculus
acatcatcagatagagactagctgt

SEQ ID NO: 175069 - DNA, 25 bp, Mus musculus
acatcatcatggaaggcgtcacctc

SEQ ID NO: 175070 - DNA, 25 bp, Mus musculus
acatcatccacgcagtgattgacga

SEQ ID NO: 175071 - DNA, 25 bp, Mus musculus
acatcatccggcgcctgtctcacgt

SEQ ID NO: 175072 - DNA, 25 bp, Mus musculus
acatcatcgagaccctgaggaagaa

SEQ ID NO: 175073 - DNA, 25 bp, Mus musculus
acatcatcgaggcgctgcacaagaa

SEQ ID NO: 175074 - DNA, 25 bp, Mus musculus
acatcatcgctgtgttttctcgtga

SEQ ID NO: 175075 - DNA, 25 bp, Mus musculus
acatcatcttggtggagaggcttcg

SEQ ID NO: 175076 - DNA, 25 bp, Mus musculus
acatcatgacttcttgttcagtcac

SEQ ID NO: 175077 - DNA, 25 bp, Mus musculus
acatcatgagccaggactgctagac

SEQ ID NO: 175078 - DNA, 25 bp, Mus musculus
acatcatgagccaggtggctgtggg

SEQ ID NO: 175079 - DNA, 25 bp, Mus musculus
acatcatgcaggatccaaacgaaga

SEQ ID NO: 175080 - DNA, 25 bp, Mus musculus
acatcatgcagttaaaccatatgag

SEQ ID NO: 175081 - DNA, 25 bp, Mus musculus
acatcatgcatgctaagtggcagtg

SEQ ID NO: 175082 - DNA, 25 bp, Mus musculus
acatcatgccaagacaactcctgag

SEQ ID NO: 175083 - DNA, 25 bp, Mus musculus
acatcatgccaagcctgttcattaa

SEQ ID NO: 175084 - DNA, 25 bp, Mus musculus
acatcatgccaaggactctggagga

SEQ ID NO: 175085 - DNA, 25 bp, Mus musculus
acatcatggaattcgtactgcgttt

SEQ ID NO: 175086 - DNA, 25 bp, Mus musculus
acatcatggtcgttggccagagtgg

SEQ ID NO: 175087 - DNA, 25 bp, Mus musculus
acatcatgtttggacctgatatttg

SEQ ID NO: 175088 - DNA, 25 bp, Mus musculus
acatcattcagaaatggcaaaatgc

SEQ ID NO: 175089 - DNA, 25 bp, Mus musculus
acatcattcagaatctgtccgtgtg

SEQ ID NO: 175090 - DNA, 25 bp, Mus musculus
acatcattcagggctgcaaaataaa

SEQ ID NO: 175091 - DNA, 25 bp, Mus musculus
acatcattccattagtaaccgtgtg

SEQ ID NO: 175092 - DNA, 25 bp, Mus musculus
acatcattgatgggaatccggaaac

SEQ ID NO: 175093 - DNA, 25 bp, Mus musculus
acatcattgatggtcctgcttggcg

SEQ ID NO: 175094 - DNA, 25 bp, Mus musculus
acatcattgcatatgatcactctcg

SEQ ID NO: 175095 - DNA, 25 bp, Mus musculus
acatcattgcatccatgccgagctc

SEQ ID NO: 175096 - DNA, 25 bp, Mus musculus
acatcattgctacagagtacctgaa

SEQ ID NO: 175097 - DNA, 25 bp, Mus musculus
acatcatttcagaagcatgtaatga

SEQ ID NO: 175098 - DNA, 25 bp, Mus musculus
acatccaaacattgtgcgtctccat

SEQ ID NO: 175099 - DNA, 25 bp, Mus musculus
acatccaaacattgtgttaccggag

SEQ ID NO: 175100 - DNA, 25 bp, Mus musculus
acatccaaagacacttcctctctct

SEQ ID NO: 175101 - DNA, 25 bp, Mus musculus
acatccaacagagcccagcagcagc

SEQ ID NO: 175102 - DNA, 25 bp, Mus musculus
acatccaatgtctcttcagatggag

SEQ ID NO: 175103 - DNA, 25 bp, Mus musculus
acatccacaacccagccaccaatga

SEQ ID NO: 175104 - DNA, 25 bp, Mus musculus
acatccaccctgaaacgatcagcag

SEQ ID NO: 175105 - DNA, 25 bp, Mus musculus
acatccacggagtcaggacggggct

SEQ ID NO: 175106 - DNA, 25 bp, Mus musculus
acatccactggtggagctgcccgac

SEQ ID NO: 175107 - DNA, 25 bp, Mus musculus
acatccagaatgtggatcggtcatg

SEQ ID NO: 175108 - DNA, 25 bp, Mus musculus
acatccagagccgtctgggtacatg

SEQ ID NO: 175109 - DNA, 25 bp, Mus musculus
acatccagcagcaggaccagtgtgt

SEQ ID NO: 175110 - DNA, 25 bp, Mus musculus
acatccagcagcagtttgtgcagtg

SEQ ID NO: 175111 - DNA, 25 bp, Mus musculus
acatccagctgttgcacaaacagcg

SEQ ID NO: 175112 - DNA, 25 bp, Mus musculus
acatccaggacctcatgtggcaggc

SEQ ID NO: 175113 - DNA, 25 bp, Mus musculus
acatccaggccaggtacatctatgg

SEQ ID NO: 175114 - DNA, 25 bp, Mus musculus
acatccaggcttgccctctgttttc

SEQ ID NO: 175115 - DNA, 25 bp, Mus musculus
acatccatagaacagaactcatggg

SEQ ID NO: 175116 - DNA, 25 bp, Mus musculus
acatccatagaacaggccaaagtag

SEQ ID NO: 175117 - DNA, 25 bp, Mus musculus
acatccatccgcgaggaaatctcag

SEQ ID NO: 175118 - DNA, 25 bp, Mus musculus
acatcccagacagacggtggcgcct

SEQ ID NO: 175119 - DNA, 25 bp, Mus musculus
acatcccagacagagatgctgcctg

SEQ ID NO: 175120 - DNA, 25 bp, Mus musculus
acatccccaatacctgtcctagcct

SEQ ID NO: 175121 - DNA, 25 bp, Mus musculus
acatccccaccgtctttgacaacta

SEQ ID NO: 175122 - DNA, 25 bp, Mus musculus
acatccccaccgtgacgtgttctta

SEQ ID NO: 175123 - DNA, 25 bp, Mus musculus
acatcccccgctgcacaacaccccc

SEQ ID NO: 175124 - DNA, 25 bp, Mus musculus
acatccccctggttggttttatcaa

SEQ ID NO: 175125 - DNA, 25 bp, Mus musculus
acatccccctgtgtgcatcagcatc

SEQ ID NO: 175126 - DNA, 25 bp, Mus musculus
acatccctctggatcggttaagcat

SEQ ID NO: 175127 - DNA, 25 bp, Mus musculus
acatccctctggtgaattccaaggc

SEQ ID NO: 175128 - DNA, 25 bp, Mus musculus
acatccctgccaaatttccaagcaa

SEQ ID NO: 175129 - DNA, 25 bp, Mus musculus
acatccctgccaacaagaacctgaa

SEQ ID NO: 175130 - DNA, 25 bp, Mus musculus
acatccctgctcattattcccccag

SEQ ID NO: 175131 - DNA, 25 bp, Mus musculus
acatccctgttcactcaacagacct

SEQ ID NO: 175132 - DNA, 25 bp, Mus musculus
acatcccttcagaatacacatgcca

SEQ ID NO: 175133 - DNA, 25 bp, Mus musculus
acatccgaaaaagccggagcctcaa

SEQ ID NO: 175134 - DNA, 25 bp, Mus musculus
acatccgagagctagcccaccaggg

SEQ ID NO: 175135 - DNA, 25 bp, Mus musculus
acatccgagaggccatcaaaaacaa

SEQ ID NO: 175136 - DNA, 25 bp, Mus musculus
acatccgagtagtgtgtgacggaat

SEQ ID NO: 175137 - DNA, 25 bp, Mus musculus
acatccggacagccagcgatgggga

SEQ ID NO: 175138 - DNA, 25 bp, Mus musculus
acatccggacaggctgacgatgctc

SEQ ID NO: 175139 - DNA, 25 bp, Mus musculus
acatccggccaggacctagggaagg

SEQ ID NO: 175140 - DNA, 25 bp, Mus musculus
acatccgggacaacgaggagaacat

SEQ ID NO: 175141 - DNA, 25 bp, Mus musculus
acatccgtggctccattgtctacct

SEQ ID NO: 175142 - DNA, 25 bp, Mus musculus
acatccgtgggctagcccatgccat

SEQ ID NO: 175143 - DNA, 25 bp, Mus musculus
acatcctaagatcaaacaaatatgc

SEQ ID NO: 175144 - DNA, 25 bp, Mus musculus
acatcctaagccaacatgccatatg

SEQ ID NO: 175145 - DNA, 25 bp, Mus musculus
acatcctaaggtcctcggcccaggt

SEQ ID NO: 175146 - DNA, 25 bp, Mus musculus
acatcctacaggaacttctgggtca

SEQ ID NO: 175147 - DNA, 25 bp, Mus musculus
acatcctacaggtatttcgaactca

SEQ ID NO: 175148 - DNA, 25 bp, Mus musculus
acatcctagaaatgacttctgaata

SEQ ID NO: 175149 - DNA, 25 bp, Mus musculus
acatcctagaaatgcagaccaggaa

SEQ ID NO: 175150 - DNA, 25 bp, Mus musculus
acatcctagaaatgccttctcccta

SEQ ID NO: 175151 - DNA, 25 bp, Mus musculus
acatcctcaaagcgacccctgaaca

SEQ ID NO: 175152 - DNA, 25 bp, Mus musculus
acatcctcaaaggatacaacttctc

SEQ ID NO: 175153 - DNA, 25 bp, Mus musculus
acatcctcacgcagacagtgtccat

SEQ ID NO: 175154 - DNA, 25 bp, Mus musculus
acatcctcaggaaagctgtggagag

SEQ ID NO: 175155 - DNA, 25 bp, Mus musculus
acatcctcaggagccagggaaggag

SEQ ID NO: 175156 - DNA, 25 bp, Mus musculus
acatcctcatcagatgttttaagga

SEQ ID NO: 175157 - DNA, 25 bp, Mus musculus
acatcctcatgatctcggacctaat

SEQ ID NO: 175158 - DNA, 25 bp, Mus musculus
acatcctcatgtatgtggtcatccc

SEQ ID NO: 175159 - DNA, 25 bp, Mus musculus
acatcctccatgagtgaacccacag

SEQ ID NO: 175160 - DNA, 25 bp, Mus musculus
acatcctcgcccaaggagagctctc

SEQ ID NO: 175161 - DNA, 25 bp, Mus musculus
acatcctctgtgaagctgtttgttc

SEQ ID NO: 175162 - DNA, 25 bp, Mus musculus
acatcctgaagaattacctggcaac

SEQ ID NO: 175163 - DNA, 25 bp, Mus musculus
acatcctgaagtgtcttatctgtcc

SEQ ID NO: 175164 - DNA, 25 bp, Mus musculus
acatcctgatcacaggacagctccc

SEQ ID NO: 175165 - DNA, 25 bp, Mus musculus
acatcctgatcttaggacagctccc

SEQ ID NO: 175166 - DNA, 25 bp, Mus musculus
acatcctgccctatgaccactctag

SEQ ID NO: 175167 - DNA, 25 bp, Mus musculus
acatcctgccctttctctctttagc

SEQ ID NO: 175168 - DNA, 25 bp, Mus musculus
acatcctggagctagcatctagtgc

SEQ ID NO: 175169 - DNA, 25 bp, Mus musculus
acatcctggagctaggtcattttac

SEQ ID NO: 175170 - DNA, 25 bp, Mus musculus
acatcctggctcaaggctttggctc

SEQ ID NO: 175171 - DNA, 25 bp, Mus musculus
acatcctgtccgaggatggatgccc

SEQ ID NO: 175172 - DNA, 25 bp, Mus musculus
acatcctgtgtgaggtccctccagc

SEQ ID NO: 175173 - DNA, 25 bp, Mus musculus
acatcctgtgtggaccagcagagaa

SEQ ID NO: 175174 - DNA, 25 bp, Mus musculus
acatcctgttgtacgtggtgatccc

SEQ ID NO: 175175 - DNA, 25 bp, Mus musculus
acatccttcaagaaaccctgaagct

SEQ ID NO: 175176 - DNA, 25 bp, Mus musculus
acatccttcaagactgcaggcacca

SEQ ID NO: 175177 - DNA, 25 bp, Mus musculus
acatccttcaaggtctgtgattgct

SEQ ID NO: 175178 - DNA, 25 bp, Mus musculus
acatccttcaggctggtggctggtg

SEQ ID NO: 175179 - DNA, 25 bp, Mus musculus
acatcgaaagtcaggaaactgaagc

SEQ ID NO: 175180 - DNA, 25 bp, Mus musculus
acatcgacactgtagccacgcgagt

SEQ ID NO: 175181 - DNA, 25 bp, Mus musculus
acatcgacagacatctgcaactatg

SEQ ID NO: 175182 - DNA, 25 bp, Mus musculus
acatcgacatcaagatcatcgcccc

SEQ ID NO: 175183 - DNA, 25 bp, Mus musculus
acatcgaccctgagactggtatggg

SEQ ID NO: 175184 - DNA, 25 bp, Mus musculus
acatcgaccctgagcttgcaagata

SEQ ID NO: 175185 - DNA, 25 bp, Mus musculus
acatcgagaagcaactgcgctccaa

SEQ ID NO: 175186 - DNA, 25 bp, Mus musculus
acatcgagaagccaggagaaactac

SEQ ID NO: 175187 - DNA, 25 bp, Mus musculus
acatcgagaagccaggtggtgacca

SEQ ID NO: 175188 - DNA, 25 bp, Mus musculus
acatcgagaagtatcagcggtgcag

SEQ ID NO: 175189 - DNA, 25 bp, Mus musculus
acatcgagacctttgccactcaagt

SEQ ID NO: 175190 - DNA, 25 bp, Mus musculus
acatcgagcaggccctttccgatct

SEQ ID NO: 175191 - DNA, 25 bp, Mus musculus
acatcgagtttgaaattcctatcac

SEQ ID NO: 175192 - DNA, 25 bp, Mus musculus
acatcgataaggctcctgagggttc

SEQ ID NO: 175193 - DNA, 25 bp, Mus musculus
acatcgataaggttgaagaacagtc

SEQ ID NO: 175194 - DNA, 25 bp, Mus musculus
acatcgatttcgggacctacccctt

SEQ ID NO: 175195 - DNA, 25 bp, Mus musculus
acatcgcaaggggctccacgggcct

SEQ ID NO: 175196 - DNA, 25 bp, Mus musculus
acatcgcccaggttctcggactccc

SEQ ID NO: 175197 - DNA, 25 bp, Mus musculus
acatcgccccagctccaaggaaacg

SEQ ID NO: 175198 - DNA, 25 bp, Mus musculus
acatcgctcgaggaatcaaaagtca

SEQ ID NO: 175199 - DNA, 25 bp, Mus musculus
acatcgctgcccaggtccgcacgct

SEQ ID NO: 175200 - DNA, 25 bp, Mus musculus
acatcgctgggactaatggcaattc

SEQ ID NO: 175201 - DNA, 25 bp, Mus musculus
acatcgctttcaactgtatggtctt

SEQ ID NO: 175202 - DNA, 25 bp, Mus musculus
acatcggaacctctaccactacagc

SEQ ID NO: 175203 - DNA, 25 bp, Mus musculus
acatcggagagaccaggtaggcgac

SEQ ID NO: 175204 - DNA, 25 bp, Mus musculus
acatcggatgagcagagaccactgc

SEQ ID NO: 175205 - DNA, 25 bp, Mus musculus
acatcggcagaaagctaaaaagatc

SEQ ID NO: 175206 - DNA, 25 bp, Mus musculus
acatcggcatgaaccacaagacctg

SEQ ID NO: 175207 - DNA, 25 bp, Mus musculus
acatcggctcagggtcttggaggag

SEQ ID NO: 175208 - DNA, 25 bp, Mus musculus
acatcgggacagcataagcagtacg

SEQ ID NO: 175209 - DNA, 25 bp, Mus musculus
acatcgggtgacagggccctggatg

SEQ ID NO: 175210 - DNA, 25 bp, Mus musculus
acatcggtacaggacagctttgcaa

SEQ ID NO: 175211 - DNA, 25 bp, Mus musculus
acatcggtacagtggcaggacagct

SEQ ID NO: 175212 - DNA, 25 bp, Mus musculus
acatcggttctggcgctccggcact

SEQ ID NO: 175213 - DNA, 25 bp, Mus musculus
acatcggttctggcgggattcctct

SEQ ID NO: 175214 - DNA, 25 bp, Mus musculus
acatcgtcgggagcattactgtatg

SEQ ID NO: 175215 - DNA, 25 bp, Mus musculus
acatcgtcggggccagtgactatca

SEQ ID NO: 175216 - DNA, 25 bp, Mus musculus
acatcgtggtggacagtgaactttt

SEQ ID NO: 175217 - DNA, 25 bp, Mus musculus
acatcgtggtgtatgttgtatgggc

SEQ ID NO: 175218 - DNA, 25 bp, Mus musculus
acatcgtgtctatcggccgctcacc

SEQ ID NO: 175219 - DNA, 25 bp, Mus musculus
acatcgtttatagagacttaaaacc

SEQ ID NO: 175220 - DNA, 25 bp, Mus musculus
acatctacagctataacccagatct

SEQ ID NO: 175221 - DNA, 25 bp, Mus musculus
acatctaccaaaacaaccctggcct

SEQ ID NO: 175222 - DNA, 25 bp, Mus musculus
acatctaccaggaaataatccttgc

SEQ ID NO: 175223 - DNA, 25 bp, Mus musculus
acatctacctaccagccctgggtcc

SEQ ID NO: 175224 - DNA, 25 bp, Mus musculus
acatctacctaccaggatggtccac

SEQ ID NO: 175225 - DNA, 25 bp, Mus musculus
acatctacgagcagggcacaactgt

SEQ ID NO: 175226 - DNA, 25 bp, Mus musculus
acatctactttaaaggcaaatggaa

SEQ ID NO: 175227 - DNA, 25 bp, Mus musculus
acatctactttgactgcagcagaag

SEQ ID NO: 175228 - DNA, 25 bp, Mus musculus
acatctactttgctcagcagatatc

SEQ ID NO: 175229 - DNA, 25 bp, Mus musculus
acatctagacagttcgaacctcaga

SEQ ID NO: 175230 - DNA, 25 bp, Mus musculus
acatctagtggcagagagttgaagt

SEQ ID NO: 175231 - DNA, 25 bp, Mus musculus
acatctataacttcaaaaagcagcc

SEQ ID NO: 175232 - DNA, 25 bp, Mus musculus
acatctataacttcaatgtctttaa

SEQ ID NO: 175233 - DNA, 25 bp, Mus musculus
acatctatcagccatggcgagtgcc

SEQ ID NO: 175234 - DNA, 25 bp, Mus musculus
acatctatctcggtacggacattgc

SEQ ID NO: 175235 - DNA, 25 bp, Mus musculus
acatctatctcgtttttcaaaacat

SEQ ID NO: 175236 - DNA, 25 bp, Mus musculus
acatctatgaggaccggcacgatgg

SEQ ID NO: 175237 - DNA, 25 bp, Mus musculus
acatctatgcagtgaatgggattgc

SEQ ID NO: 175238 - DNA, 25 bp, Mus musculus
acatctatgtgattggttaccagga

SEQ ID NO: 175239 - DNA, 25 bp, Mus musculus
acatctatgtgccagctgcaacgga

SEQ ID NO: 175240 - DNA, 25 bp, Mus musculus
acatctatgtgccaggctgcccgcc

SEQ ID NO: 175241 - DNA, 25 bp, Mus musculus
acatctcacaaaaaacatcggacca

SEQ ID NO: 175242 - DNA, 25 bp, Mus musculus
acatctcacagactgtggatattca

SEQ ID NO: 175243 - DNA, 25 bp, Mus musculus
acatctcagagcctgggacctggaa

SEQ ID NO: 175244 - DNA, 25 bp, Mus musculus
acatctcatgggtttgtggatgcac

SEQ ID NO: 175245 - DNA, 25 bp, Mus musculus
acatctccaagatgcacatgatcct

SEQ ID NO: 175246 - DNA, 25 bp, Mus musculus
acatctccattccaacctggtcttg

SEQ ID NO: 175247 - DNA, 25 bp, Mus musculus
acatctcccaccagaggctgatccc

SEQ ID NO: 175248 - DNA, 25 bp, Mus musculus
acatctcctaacagatgaacagtgt

SEQ ID NO: 175249 - DNA, 25 bp, Mus musculus
acatctcctaacagctatgaaagga

SEQ ID NO: 175250 - DNA, 25 bp, Mus musculus
acatctcctcagaggcagcatcctg

SEQ ID NO: 175251 - DNA, 25 bp, Mus musculus
acatctctgatgtggaaggggagta

SEQ ID NO: 175252 - DNA, 25 bp, Mus musculus
acatctctgtggaagagacctctgc

SEQ ID NO: 175253 - DNA, 25 bp, Mus musculus
acatctgaaacatggtggtaagaga

SEQ ID NO: 175254 - DNA, 25 bp, Mus musculus
acatctgaaaccagagtccagcttg

SEQ ID NO: 175255 - DNA, 25 bp, Mus musculus
acatctgaaaccaggagattggccg

SEQ ID NO: 175256 - DNA, 25 bp, Mus musculus
acatctgaaactgaactcggagagt

SEQ ID NO: 175257 - DNA, 25 bp, Mus musculus
acatctgaaacttttgttttcctga

SEQ ID NO: 175258 - DNA, 25 bp, Mus musculus
acatctgaccccagtacatggagaa

SEQ ID NO: 175259 - DNA, 25 bp, Mus musculus
acatctgactcaagggaagtaagca

SEQ ID NO: 175260 - DNA, 25 bp, Mus musculus
acatctgatggaacctgtaccatca

SEQ ID NO: 175261 - DNA, 25 bp, Mus musculus
acatctgatggtctatctccacgag

SEQ ID NO: 175262 - DNA, 25 bp, Mus musculus
acatctgcaagtgcacgttggttgc

SEQ ID NO: 175263 - DNA, 25 bp, Mus musculus
acatctgcagctctcccttttcttc

SEQ ID NO: 175264 - DNA, 25 bp, Mus musculus
acatctgcaggatctgccactgtga

SEQ ID NO: 175265 - DNA, 25 bp, Mus musculus
acatctgcagtgggccggatgtacc

SEQ ID NO: 175266 - DNA, 25 bp, Mus musculus
acatctgccagtgtcctggcataac

SEQ ID NO: 175267 - DNA, 25 bp, Mus musculus
acatctgcctcaagaaatttgtcaa

SEQ ID NO: 175268 - DNA, 25 bp, Mus musculus
acatctggaaggtatctcagacgag

SEQ ID NO: 175269 - DNA, 25 bp, Mus musculus
acatctggaagtaacttgaatccca

SEQ ID NO: 175270 - DNA, 25 bp, Mus musculus
acatctggcacagaagctgattggc

SEQ ID NO: 175271 - DNA, 25 bp, Mus musculus
acatctgggattcagtcattaggat

SEQ ID NO: 175272 - DNA, 25 bp, Mus musculus
acatctgggcatgtggccattatgt

SEQ ID NO: 175273 - DNA, 25 bp, Mus musculus
acatctgggcatgtggggtgatcct

SEQ ID NO: 175274 - DNA, 25 bp, Mus musculus
acatctggggtcctgctcctgcaaa

SEQ ID NO: 175275 - DNA, 25 bp, Mus musculus
acatctgtaaccagaatggattgaa

SEQ ID NO: 175276 - DNA, 25 bp, Mus musculus
acatctgtactagggaatattggca

SEQ ID NO: 175277 - DNA, 25 bp, Mus musculus
acatctgtagcatatatccggtcga

SEQ ID NO: 175278 - DNA, 25 bp, Mus musculus
acatctgtatgagtggcctcgaact

SEQ ID NO: 175279 - DNA, 25 bp, Mus musculus
acatctgtcctgaggagtgtgcagc

SEQ ID NO: 175280 - DNA, 25 bp, Mus musculus
acatctgtgcactgctgaagaagga

SEQ ID NO: 175281 - DNA, 25 bp, Mus musculus
acatctgtggggaagctcctgacta

SEQ ID NO: 175282 - DNA, 25 bp, Mus musculus
acatctgttggcctggtacaggacc

SEQ ID NO: 175283 - DNA, 25 bp, Mus musculus
acatctgttttttagcacaatggaa

SEQ ID NO: 175284 - DNA, 25 bp, Mus musculus
acatcttaagactggcctgctgcaa

SEQ ID NO: 175285 - DNA, 25 bp, Mus musculus
acatcttacatgctctgaagatggc

SEQ ID NO: 175286 - DNA, 25 bp, Mus musculus
acatcttattccatagtagtgggca

SEQ ID NO: 175287 - DNA, 25 bp, Mus musculus
acatcttcaaaaactgcacctacta

SEQ ID NO: 175288 - DNA, 25 bp, Mus musculus
acatcttcaacccgatctccctgac

SEQ ID NO: 175289 - DNA, 25 bp, Mus musculus
acatcttcaaccggatctccctgac

SEQ ID NO: 175290 - DNA, 25 bp, Mus musculus
acatcttcaatgtggctcactttag

SEQ ID NO: 175291 - DNA, 25 bp, Mus musculus
acatcttcaccaggtccagctagct

SEQ ID NO: 175292 - DNA, 25 bp, Mus musculus
acatcttcaccagtctaaatccagt

SEQ ID NO: 175293 - DNA, 25 bp, Mus musculus
acatcttcacgctaatgaaccggag

SEQ ID NO: 175294 - DNA, 25 bp, Mus musculus
acatcttcacgtctcgaaaaggtgc

SEQ ID NO: 175295 - DNA, 25 bp, Mus musculus
acatcttcagcctggcagaaaactt

SEQ ID NO: 175296 - DNA, 25 bp, Mus musculus
acatcttcaggactcggaaggtgaa

SEQ ID NO: 175297 - DNA, 25 bp, Mus musculus
acatcttcaggcgctttggccgtga

SEQ ID NO: 175298 - DNA, 25 bp, Mus musculus
acatcttcctgaggaatgtcacagc

SEQ ID NO: 175299 - DNA, 25 bp, Mus musculus
acatcttcctggacacatcttacct

SEQ ID NO: 175300 - DNA, 25 bp, Mus musculus
acatcttcctggcttctgctgtaac

SEQ ID NO: 175301 - DNA, 25 bp, Mus musculus
acatcttctgggtattcggcaccaa

SEQ ID NO: 175302 - DNA, 25 bp, Mus musculus
acatcttgagatcttcaactttctt

SEQ ID NO: 175303 - DNA, 25 bp, Mus musculus
acatcttggaacctaggtcctgtca

SEQ ID NO: 175304 - DNA, 25 bp, Mus musculus
acatcttggacttcagccctagtct

SEQ ID NO: 175305 - DNA, 25 bp, Mus musculus
acatcttggtcaagaactgtactct

SEQ ID NO: 175306 - DNA, 25 bp, Mus musculus
acatcttggtcaaggtacaactgta

SEQ ID NO: 175307 - DNA, 25 bp, Mus musculus
acatctttatctcaaattctggaat

SEQ ID NO: 175308 - DNA, 25 bp, Mus musculus
acatctttatctcacacgccggtgg

SEQ ID NO: 175309 - DNA, 25 bp, Mus musculus
acatctttgaaggtctgggacacct

SEQ ID NO: 175310 - DNA, 25 bp, Mus musculus
acatcttttccaggtgcagagtggt

SEQ ID NO: 175311 - DNA, 25 bp, Mus musculus
acatgaaacagtacctttgaccgga

SEQ ID NO: 175312 - DNA, 25 bp, Mus musculus
acatgaaacagtttgtagtgcatcc

SEQ ID NO: 175313 - DNA, 25 bp, Mus musculus
acatgaaatggtgccacatcccagt

SEQ ID NO: 175314 - DNA, 25 bp, Mus musculus
acatgaacaagcgattatacacaga

SEQ ID NO: 175315 - DNA, 25 bp, Mus musculus
acatgaacaagcgcttgtacacaga

SEQ ID NO: 175316 - DNA, 25 bp, Mus musculus
acatgaacagaagagagagggggag

SEQ ID NO: 175317 - DNA, 25 bp, Mus musculus
acatgaacaggagtccttgccatct

SEQ ID NO: 175318 - DNA, 25 bp, Mus musculus
acatgaacatccagtaataatatct

SEQ ID NO: 175319 - DNA, 25 bp, Mus musculus
acatgaacctcagcattgtgatgac

SEQ ID NO: 175320 - DNA, 25 bp, Mus musculus
acatgaactgttggcccttgattgt

SEQ ID NO: 175321 - DNA, 25 bp, Mus musculus
acatgaagaaatattatcacaaaga

SEQ ID NO: 175322 - DNA, 25 bp, Mus musculus
acatgaagagggtaaatagctgtgt

SEQ ID NO: 175323 - DNA, 25 bp, Mus musculus
acatgaagaggtattgactgaatat

SEQ ID NO: 175324 - DNA, 25 bp, Mus musculus
acatgaagattgagagccagcgggc

SEQ ID NO: 175325 - DNA, 25 bp, Mus musculus
acatgaaggcaccaatttcgttgtg

SEQ ID NO: 175326 - DNA, 25 bp, Mus musculus
acatgaagtcactcggtgtgggctt

SEQ ID NO: 175327 - DNA, 25 bp, Mus musculus
acatgaagttggtgagcccgagttc

SEQ ID NO: 175328 - DNA, 25 bp, Mus musculus
acatgaatcaggatgatctcaaagc

SEQ ID NO: 175329 - DNA, 25 bp, Mus musculus
acatgaatcaggatgtgtctctctc

SEQ ID NO: 175330 - DNA, 25 bp, Mus musculus
acatgaatgtgaccgagataatcat

SEQ ID NO: 175331 - DNA, 25 bp, Mus musculus
acatgacaagagaaagcgccaaggg

SEQ ID NO: 175332 - DNA, 25 bp, Mus musculus
acatgacagaagctgattggccatt

SEQ ID NO: 175333 - DNA, 25 bp, Mus musculus
acatgacagacagtttcgcatttgg

SEQ ID NO: 175334 - DNA, 25 bp, Mus musculus
acatgacatagatcctataaggtgg

SEQ ID NO: 175335 - DNA, 25 bp, Mus musculus
acatgacatagggtacatgtggatg

SEQ ID NO: 175336 - DNA, 25 bp, Mus musculus
acatgaccagtgatcggcgccagtg

SEQ ID NO: 175337 - DNA, 25 bp, Mus musculus
acatgaccagtggaaatgatgtacg

SEQ ID NO: 175338 - DNA, 25 bp, Mus musculus
acatgaccagtgtcgttaggagagg

SEQ ID NO: 175339 - DNA, 25 bp, Mus musculus
acatgacccgtaagaccaagcgccc

SEQ ID NO: 175340 - DNA, 25 bp, Mus musculus
acatgaccctggaggtgagaaagtc

SEQ ID NO: 175341 - DNA, 25 bp, Mus musculus
acatgacctctatagcgtctctaca

SEQ ID NO: 175342 - DNA, 25 bp, Mus musculus
acatgacctctatataaactgaagt

SEQ ID NO: 175343 - DNA, 25 bp, Mus musculus
acatgactgccaagattcatgaata

SEQ ID NO: 175344 - DNA, 25 bp, Mus musculus
acatgagaaagcatgctctctgttg

SEQ ID NO: 175345 - DNA, 25 bp, Mus musculus
acatgagacccagctttccctgctg

SEQ ID NO: 175346 - DNA, 25 bp, Mus musculus
acatgagagaaagaatcccaagagg

SEQ ID NO: 175347 - DNA, 25 bp, Mus musculus
acatgagagaaagaatgcccagatg

SEQ ID NO: 175348 - DNA, 25 bp, Mus musculus
acatgagcaaagggccacaataccc

SEQ ID NO: 175349 - DNA, 25 bp, Mus musculus
acatgagcaaggtctttgaagtaat

SEQ ID NO: 175350 - DNA, 25 bp, Mus musculus
acatgagccaggacgacctggcgag

SEQ ID NO: 175351 - DNA, 25 bp, Mus musculus
acatgagcctcctgatgctgctccg

SEQ ID NO: 175352 - DNA, 25 bp, Mus musculus
acatgagcctgcctttaccccagcc

SEQ ID NO: 175353 - DNA, 25 bp, Mus musculus
acatgagctgggctgtagcagtggc

SEQ ID NO: 175354 - DNA, 25 bp, Mus musculus
acatgaggaacaagattcgagagca

SEQ ID NO: 175355 - DNA, 25 bp, Mus musculus
acatgaggcgtgggcttcgggacac

SEQ ID NO: 175356 - DNA, 25 bp, Mus musculus
acatgaggttggcaggccccctgcg

SEQ ID NO: 175357 - DNA, 25 bp, Mus musculus
acatgagtaaggtagcctccaagaa

SEQ ID NO: 175358 - DNA, 25 bp, Mus musculus
acatgagttgtgcctgccgacataa

SEQ ID NO: 175359 - DNA, 25 bp, Mus musculus
acatgagtttaaggttaaatgagca

SEQ ID NO: 175360 - DNA, 25 bp, Mus musculus
acatgatccagagaggtgctcggtc

SEQ ID NO: 175361 - DNA, 25 bp, Mus musculus
acatgatccaggcgtctcttttctc

SEQ ID NO: 175362 - DNA, 25 bp, Mus musculus
acatgatctccacatcttatccttc

SEQ ID NO: 175363 - DNA, 25 bp, Mus musculus
acatgatgaagaatagaattgctga

SEQ ID NO: 175364 - DNA, 25 bp, Mus musculus
acatgatgatcgtggaccctgccat

SEQ ID NO: 175365 - DNA, 25 bp, Mus musculus
acatgatgatcgtggcgggatccgc

SEQ ID NO: 175366 - DNA, 25 bp, Mus musculus
acatgatgatcgtggtttggcctgg

SEQ ID NO: 175367 - DNA, 25 bp, Mus musculus
acatgatgatgaacttgttcctagc

SEQ ID NO: 175368 - DNA, 25 bp, Mus musculus
acatgatgcaggtgaagacttttgg

SEQ ID NO: 175369 - DNA, 25 bp, Mus musculus
acatgatgtcagcgtcaatactatc

SEQ ID NO: 175370 - DNA, 25 bp, Mus musculus
acatgcacaaggttcacctgctgtg

SEQ ID NO: 175371 - DNA, 25 bp, Mus musculus
acatgcacagcctatttaagagtgg

SEQ ID NO: 175372 - DNA, 25 bp, Mus musculus
acatgcagaagtcgatgcagaacca

SEQ ID NO: 175373 - DNA, 25 bp, Mus musculus
acatgcagagagtagcagtgctgtg

SEQ ID NO: 175374 - DNA, 25 bp, Mus musculus
acatgcagagtgctgtgtgttccta

SEQ ID NO: 175375 - DNA, 25 bp, Mus musculus
acatgcagatgacctagagctcgga

SEQ ID NO: 175376 - DNA, 25 bp, Mus musculus
acatgcagatgagctcggatttcta

SEQ ID NO: 175377 - DNA, 25 bp, Mus musculus
acatgcagatgatcgagtgcttcag

SEQ ID NO: 175378 - DNA, 25 bp, Mus musculus
acatgcagatggtgtcagtggattc

SEQ ID NO: 175379 - DNA, 25 bp, Mus musculus
acatgcagcagattcaagtcaatct

SEQ ID NO: 175380 - DNA, 25 bp, Mus musculus
acatgcagcagggtggaagcccaac

SEQ ID NO: 175381 - DNA, 25 bp, Mus musculus
acatgcaggaggaggagcatatgct

SEQ ID NO: 175382 - DNA, 25 bp, Mus musculus
acatgcaggcactgcacgagtctga

SEQ ID NO: 175383 - DNA, 25 bp, Mus musculus
acatgcatttcaggttaatatcctt

SEQ ID NO: 175384 - DNA, 25 bp, Mus musculus
acatgcattttcacgacatccatgg

SEQ ID NO: 175385 - DNA, 25 bp, Mus musculus
acatgccagcccactggaagccgaa

SEQ ID NO: 175386 - DNA, 25 bp, Mus musculus
acatgcccatgatgggcctggtttg

SEQ ID NO: 175387 - DNA, 25 bp, Mus musculus
acatgccccccaggagagtgtgctg

SEQ ID NO: 175388 - DNA, 25 bp, Mus musculus
acatgcctctaggttccagcagcac

SEQ ID NO: 175389 - DNA, 25 bp, Mus musculus
acatgcctctcttggaattaaagga

SEQ ID NO: 175390 - DNA, 25 bp, Mus musculus
acatgcctgaagacgttattgctcg

SEQ ID NO: 175391 - DNA, 25 bp, Mus musculus
acatgcctgaaggctctggtgtcct

SEQ ID NO: 175392 - DNA, 25 bp, Mus musculus
acatgcctgctgagcaagcgttttg

SEQ ID NO: 175393 - DNA, 25 bp, Mus musculus
acatgcctgtctggaaacaacctga

SEQ ID NO: 175394 - DNA, 25 bp, Mus musculus
acatgccttgtgcctacttgagcat

SEQ ID NO: 175395 - DNA, 25 bp, Mus musculus
acatgcgtacggctggcctcaaaca

SEQ ID NO: 175396 - DNA, 25 bp, Mus musculus
acatgcgtccaagctgtttcctctg

SEQ ID NO: 175397 - DNA, 25 bp, Mus musculus
acatgcgtccaaggcaaatttcagg

SEQ ID NO: 175398 - DNA, 25 bp, Mus musculus
acatgcgtccaagtatctagcattc

SEQ ID NO: 175399 - DNA, 25 bp, Mus musculus
acatgctaacaggggctaccagcca

SEQ ID NO: 175400 - DNA, 25 bp, Mus musculus
acatgctaccagaagccagatgaga

SEQ ID NO: 175401 - DNA, 25 bp, Mus musculus
acatgctaccagcatttgatgacca

SEQ ID NO: 175402 - DNA, 25 bp, Mus musculus
acatgctattgatctgatggaggca

SEQ ID NO: 175403 - DNA, 25 bp, Mus musculus
acatgctattgatgcttgctttaaa

SEQ ID NO: 175404 - DNA, 25 bp, Mus musculus
acatgctcaaattcggggcttcctc

SEQ ID NO: 175405 - DNA, 25 bp, Mus musculus
acatgctcaaattcggtgcagcccg

SEQ ID NO: 175406 - DNA, 25 bp, Mus musculus
acatgctcaagccaaaccaacaact

SEQ ID NO: 175407 - DNA, 25 bp, Mus musculus
acatgctcacaaggtgcagacctga

SEQ ID NO: 175408 - DNA, 25 bp, Mus musculus
acatgctcaggacccatagatgaac

SEQ ID NO: 175409 - DNA, 25 bp, Mus musculus
acatgctcaggtgcgctggtacccc

SEQ ID NO: 175410 - DNA, 25 bp, Mus musculus
acatgctcgcagaaaaagcagcgat

SEQ ID NO: 175411 - DNA, 25 bp, Mus musculus
acatgctctgtgatgaccaagatct

SEQ ID NO: 175412 - DNA, 25 bp, Mus musculus
acatgctcttcgtctgctgggattc

SEQ ID NO: 175413 - DNA, 25 bp, Mus musculus
acatgctcttcgtgttccgctactg

SEQ ID NO: 175414 - DNA, 25 bp, Mus musculus
acatgctgaataggtatctgatcaa

SEQ ID NO: 175415 - DNA, 25 bp, Mus musculus
acatgctgaataggtgaattgagac

SEQ ID NO: 175416 - DNA, 25 bp, Mus musculus
acatgctgacagatcgggagaatca

SEQ ID NO: 175417 - DNA, 25 bp, Mus musculus
acatgctgcagctgctgttgatgct

SEQ ID NO: 175418 - DNA, 25 bp, Mus musculus
acatgctgcagttggtgcttcccga

SEQ ID NO: 175419 - DNA, 25 bp, Mus musculus
acatgctggccatgagtactttgtg

SEQ ID NO: 175420 - DNA, 25 bp, Mus musculus
acatgctggccctggagcctggtta

SEQ ID NO: 175421 - DNA, 25 bp, Mus musculus
acatgctggccctgggtattgactt

SEQ ID NO: 175422 - DNA, 25 bp, Mus musculus
acatgctgggaggaggtggcccaga

SEQ ID NO: 175423 - DNA, 25 bp, Mus musculus
acatgctggttgtcacaggtggtgt

SEQ ID NO: 175424 - DNA, 25 bp, Mus musculus
acatgctgtgaatattctagaggaa

SEQ ID NO: 175425 - DNA, 25 bp, Mus musculus
acatgctgtgatggacatactaaaa

SEQ ID NO: 175426 - DNA, 25 bp, Mus musculus
acatgcttggagtgttcctaacttt

SEQ ID NO: 175427 - DNA, 25 bp, Mus musculus
acatgctttcagaaattccctgcgg

SEQ ID NO: 175428 - DNA, 25 bp, Mus musculus
acatgctttcagaagacctggcggt

SEQ ID NO: 175429 - DNA, 25 bp, Mus musculus
acatgctttgatgtcccgcatggtt

SEQ ID NO: 175430 - DNA, 25 bp, Mus musculus
acatggaaaagaaaatagatatcac

SEQ ID NO: 175431 - DNA, 25 bp, Mus musculus
acatggaaaagatatcaccagtaaa

SEQ ID NO: 175432 - DNA, 25 bp, Mus musculus
acatggaaactaaggcattactcat

SEQ ID NO: 175433 - DNA, 25 bp, Mus musculus
acatggaaactaaggctggccttgt

SEQ ID NO: 175434 - DNA, 25 bp, Mus musculus
acatggaaagatcagtactgagtcc

SEQ ID NO: 175435 - DNA, 25 bp, Mus musculus
acatggaaagcaatcactctgtgga

SEQ ID NO: 175436 - DNA, 25 bp, Mus musculus
acatggaaagggatcagtaatggcg

SEQ ID NO: 175437 - DNA, 25 bp, Mus musculus
acatggaagacagagctgcatgagt

SEQ ID NO: 175438 - DNA, 25 bp, Mus musculus
acatggaagccgaggtctgcattac

SEQ ID NO: 175439 - DNA, 25 bp, Mus musculus
acatggaaggcctgggagggtaccc

SEQ ID NO: 175440 - DNA, 25 bp, Mus musculus
acatggaagggctgggactgctctg

SEQ ID NO: 175441 - DNA, 25 bp, Mus musculus
acatggaagtgaaggatgcgaacgc

SEQ ID NO: 175442 - DNA, 25 bp, Mus musculus
acatggacacaggtatacaaggagc

SEQ ID NO: 175443 - DNA, 25 bp, Mus musculus
acatggacaggtgacgccatctggg

SEQ ID NO: 175444 - DNA, 25 bp, Mus musculus
acatggacatcctgaactactttga

SEQ ID NO: 175445 - DNA, 25 bp, Mus musculus
acatggacatcctgcctccttcctt

SEQ ID NO: 175446 - DNA, 25 bp, Mus musculus
acatggaccagttggaggtgggcaa

SEQ ID NO: 175447 - DNA, 25 bp, Mus musculus
acatggacgacctgcaactttttga

SEQ ID NO: 175448 - DNA, 25 bp, Mus musculus
acatggactttggaggacagaaaaa

SEQ ID NO: 175449 - DNA, 25 bp, Mus musculus
acatggactttggagtctgaatatg

SEQ ID NO: 175450 - DNA, 25 bp, Mus musculus
acatggagaggaaactgtcagcaga

SEQ ID NO: 175451 - DNA, 25 bp, Mus musculus
acatggagagggctcctcgctgtta

SEQ ID NO: 175452 - DNA, 25 bp, Mus musculus
acatggagcagttaacgcgggggga

SEQ ID NO: 175453 - DNA, 25 bp, Mus musculus
acatggagcggagcctctctgcctt

SEQ ID NO: 175454 - DNA, 25 bp, Mus musculus
acatggagcggaggtctcattggga

SEQ ID NO: 175455 - DNA, 25 bp, Mus musculus
acatggaggaatgtctataacaata

SEQ ID NO: 175456 - DNA, 25 bp, Mus musculus
acatggaggaggattgtccggagca

SEQ ID NO: 175457 - DNA, 25 bp, Mus musculus
acatggaggaggtgcggcggcagca

SEQ ID NO: 175458 - DNA, 25 bp, Mus musculus
acatggagtacaggatcaataagcc

SEQ ID NO: 175459 - DNA, 25 bp, Mus musculus
acatggagtttaaagatgtcattgt

SEQ ID NO: 175460 - DNA, 25 bp, Mus musculus
acatggagtttaaagtgtcgtgttc

SEQ ID NO: 175461 - DNA, 25 bp, Mus musculus
acatggatctggtgtgagtgttgag

SEQ ID NO: 175462 - DNA, 25 bp, Mus musculus
acatggatctttgggcttgtgatgc

SEQ ID NO: 175463 - DNA, 25 bp, Mus musculus
acatggatctttgggtctgaacggg

SEQ ID NO: 175464 - DNA, 25 bp, Mus musculus
acatggatgctgtgtccaccacggc

SEQ ID NO: 175465 - DNA, 25 bp, Mus musculus
acatggattcttggcacttgatgca

SEQ ID NO: 175466 - DNA, 25 bp, Mus musculus
acatggcaaaagatgccagtctaat

SEQ ID NO: 175467 - DNA, 25 bp, Mus musculus
acatggcaaaagatgtgtggtatct

SEQ ID NO: 175468 - DNA, 25 bp, Mus musculus
acatggcaacaggtttatggtcggc

SEQ ID NO: 175469 - DNA, 25 bp, Mus musculus
acatggcaatgggctacaggggaag

SEQ ID NO: 175470 - DNA, 25 bp, Mus musculus
acatggcactgggtggtgaaagtga

SEQ ID NO: 175471 - DNA, 25 bp, Mus musculus
acatggccaaggaaaattgtccagc

SEQ ID NO: 175472 - DNA, 25 bp, Mus musculus
acatggccaagggactaaagaagat

SEQ ID NO: 175473 - DNA, 25 bp, Mus musculus
acatggccatccagaagcctcccca

SEQ ID NO: 175474 - DNA, 25 bp, Mus musculus
acatggcctcaggtggcccggcaga

SEQ ID NO: 175475 - DNA, 25 bp, Mus musculus
acatggcctgtgtgcatgtgaacga

SEQ ID NO: 175476 - DNA, 25 bp, Mus musculus
acatggcctgtgtggatgtgaacga

SEQ ID NO: 175477 - DNA, 25 bp, Mus musculus
acatggcgaaggaggatgaggaacc

SEQ ID NO: 175478 - DNA, 25 bp, Mus musculus
acatggcgaaggagggtggccggac

SEQ ID NO: 175479 - DNA, 25 bp, Mus musculus
acatggctaacccaggaactggtgc

SEQ ID NO: 175480 - DNA, 25 bp, Mus musculus
acatggctcctgctgactgggtttg

SEQ ID NO: 175481 - DNA, 25 bp, Mus musculus
acatggctgagcctttcagtgctac

SEQ ID NO: 175482 - DNA, 25 bp, Mus musculus
acatggctgagtgctacggagccca

SEQ ID NO: 175483 - DNA, 25 bp, Mus musculus
acatggctgcaagaaaatgccagaa

SEQ ID NO: 175484 - DNA, 25 bp, Mus musculus
acatggcttcaggttgatatcaaaa

SEQ ID NO: 175485 - DNA, 25 bp, Mus musculus
acatgggaaggagctgtcagtagaa

SEQ ID NO: 175486 - DNA, 25 bp, Mus musculus
acatgggactaggatgatgtctaca

SEQ ID NO: 175487 - DNA, 25 bp, Mus musculus
acatgggagatgagaaattatgctt

SEQ ID NO: 175488 - DNA, 25 bp, Mus musculus
acatgggatacaaagtcctctcagc

SEQ ID NO: 175489 - DNA, 25 bp, Mus musculus
acatgggatacaagaacaattttta

SEQ ID NO: 175490 - DNA, 25 bp, Mus musculus
acatgggatttcaggataacctctt

SEQ ID NO: 175491 - DNA, 25 bp, Mus musculus
acatgggcaacgctggacgtaaaga

SEQ ID NO: 175492 - DNA, 25 bp, Mus musculus
acatgggcgagacacattgcgctgg

SEQ ID NO: 175493 - DNA, 25 bp, Mus musculus
acatgggcgagtgcggtttcgtggt

SEQ ID NO: 175494 - DNA, 25 bp, Mus musculus
acatggggagagagggcaatgcgag

SEQ ID NO: 175495 - DNA, 25 bp, Mus musculus
acatggggagatcctttctctgcta

SEQ ID NO: 175496 - DNA, 25 bp, Mus musculus
acatggggagcccaggtccggtgag

SEQ ID NO: 175497 - DNA, 25 bp, Mus musculus
acatggggaggattcagtccttctc

SEQ ID NO: 175498 - DNA, 25 bp, Mus musculus
acatgggtggccatgggaaatggag

SEQ ID NO: 175499 - DNA, 25 bp, Mus musculus
acatgggtggccatgtgcccagccc

SEQ ID NO: 175500 - DNA, 25 bp, Mus musculus
acatggtaaagggaatgcagtggtg

SEQ ID NO: 175501 - DNA, 25 bp, Mus musculus
acatggtctagagctttatggattt

SEQ ID NO: 175502 - DNA, 25 bp, Mus musculus
acatggtctgtggaatgtgacaaac

SEQ ID NO: 175503 - DNA, 25 bp, Mus musculus
acatggtgacagtccctctgaggct

SEQ ID NO: 175504 - DNA, 25 bp, Mus musculus
acatggtgagcaagttgagctctga

SEQ ID NO: 175505 - DNA, 25 bp, Mus musculus
acatggtgcagtggtggagcaaagc

SEQ ID NO: 175506 - DNA, 25 bp, Mus musculus
acatggtggagcactacaccaagga

SEQ ID NO: 175507 - DNA, 25 bp, Mus musculus
acatggtggagctggctggctactc

SEQ ID NO: 175508 - DNA, 25 bp, Mus musculus
acatggtgtttaaggccaagcatct

SEQ ID NO: 175509 - DNA, 25 bp, Mus musculus
acatgtaaaaagatggatcagtttg

SEQ ID NO: 175510 - DNA, 25 bp, Mus musculus
acatgtaaaggtcaagtagcatcat

SEQ ID NO: 175511 - DNA, 25 bp, Mus musculus
acatgtaataaaaagaagctgaagt

SEQ ID NO: 175512 - DNA, 25 bp, Mus musculus
acatgtaataaaaagatgccagcag

SEQ ID NO: 175513 - DNA, 25 bp, Mus musculus
acatgtacaacagaatgaccagtgc

SEQ ID NO: 175514 - DNA, 25 bp, Mus musculus
acatgtacaaggactcacacacgag

SEQ ID NO: 175515 - DNA, 25 bp, Mus musculus
acatgtacatatgaaacctgccata

SEQ ID NO: 175516 - DNA, 25 bp, Mus musculus
acatgtacatatggtcgaccccatc

SEQ ID NO: 175517 - DNA, 25 bp, Mus musculus
acatgtatagactttgatgaatgtg

SEQ ID NO: 175518 - DNA, 25 bp, Mus musculus
acatgtatagctttagatgagcagt

SEQ ID NO: 175519 - DNA, 25 bp, Mus musculus
acatgtatatcagacactgtcctgt

SEQ ID NO: 175520 - DNA, 25 bp, Mus musculus
acatgtcaagatgtgaatgagtgca

SEQ ID NO: 175521 - DNA, 25 bp, Mus musculus
acatgtcaagatgtggatgagtgca

SEQ ID NO: 175522 - DNA, 25 bp, Mus musculus
acatgtcaagcatcagtgaacactg

SEQ ID NO: 175523 - DNA, 25 bp, Mus musculus
acatgtcaaggtcctgggtgagccc

SEQ ID NO: 175524 - DNA, 25 bp, Mus musculus
acatgtcacagctaaagtccaggaa

SEQ ID NO: 175525 - DNA, 25 bp, Mus musculus
acatgtcccagcttacataattggc

SEQ ID NO: 175526 - DNA, 25 bp, Mus musculus
acatgtcccagtttgacccattgat

SEQ ID NO: 175527 - DNA, 25 bp, Mus musculus
acatgtctgagcaggtgctcctgtg

SEQ ID NO: 175528 - DNA, 25 bp, Mus musculus
acatgtgaagatttctgctcctaat

SEQ ID NO: 175529 - DNA, 25 bp, Mus musculus
acatgtgcaaagaagtttacaattc

SEQ ID NO: 175530 - DNA, 25 bp, Mus musculus
acatgtgcaacctgcaccatgggct

SEQ ID NO: 175531 - DNA, 25 bp, Mus musculus
acatgtgcagataacaatcgaaaga

SEQ ID NO: 175532 - DNA, 25 bp, Mus musculus
acatgtgcgcagacaaacccggagg

SEQ ID NO: 175533 - DNA, 25 bp, Mus musculus
acatgtgcgcagccgcctgggaaac

SEQ ID NO: 175534 - DNA, 25 bp, Mus musculus
acatgtgctgccagtccctccacag

SEQ ID NO: 175535 - DNA, 25 bp, Mus musculus
acatgtggaaatccccagaggagct

SEQ ID NO: 175536 - DNA, 25 bp, Mus musculus
acatgtgtagggtgtgtgaggacga

SEQ ID NO: 175537 - DNA, 25 bp, Mus musculus
acatgtgtattgcaagacagatcgg

SEQ ID NO: 175538 - DNA, 25 bp, Mus musculus
acatgtgtattggtgagaagccaga

SEQ ID NO: 175539 - DNA, 25 bp, Mus musculus
acatgtgtcctcgagagacccagcc

SEQ ID NO: 175540 - DNA, 25 bp, Mus musculus
acatgtgtcctcgagttttactaca

SEQ ID NO: 175541 - DNA, 25 bp, Mus musculus
acatgtgtgaaaaccttgtcactag

SEQ ID NO: 175542 - DNA, 25 bp, Mus musculus
acatgtgtgagggctgccggtcact

SEQ ID NO: 175543 - DNA, 25 bp, Mus musculus
acatgtgtggcaggggagccttctc

SEQ ID NO: 175544 - DNA, 25 bp, Mus musculus
acatgtgtgtgaggaggttccccct

SEQ ID NO: 175545 - DNA, 25 bp, Mus musculus
acatgttcaaaggagcctttgacca

SEQ ID NO: 175546 - DNA, 25 bp, Mus musculus
acatgttcaaagttagcatattatt

SEQ ID NO: 175547 - DNA, 25 bp, Mus musculus
acatgttcaaggtaattcagagatc

SEQ ID NO: 175548 - DNA, 25 bp, Mus musculus
acatgttcagcctggccaaactgaa

SEQ ID NO: 175549 - DNA, 25 bp, Mus musculus
acatgttcaggtttggcaaacatcg

SEQ ID NO: 175550 - DNA, 25 bp, Mus musculus
acatgttcttctcggacctactaaa

SEQ ID NO: 175551 - DNA, 25 bp, Mus musculus
acatgttcttggcattgggagagac

SEQ ID NO: 175552 - DNA, 25 bp, Mus musculus
acatgttgaagagactttcaacagc

SEQ ID NO: 175553 - DNA, 25 bp, Mus musculus
acatgttgaaggtgttggctgccct

SEQ ID NO: 175554 - DNA, 25 bp, Mus musculus
acatgttgtgcaaatgaagaaaagc

SEQ ID NO: 175555 - DNA, 25 bp, Mus musculus
acatgtttaagaaggtgcccactag

SEQ ID NO: 175556 - DNA, 25 bp, Mus musculus
acatgtttcagaaatgaagcagatg

SEQ ID NO: 175557 - DNA, 25 bp, Mus musculus
acatgtttcagccggataccaacat

SEQ ID NO: 175558 - DNA, 25 bp, Mus musculus
acatgtttttacaagagctaagtga

SEQ ID NO: 175559 - DNA, 25 bp, Mus musculus
acattaaaaacctgcaactggatta

SEQ ID NO: 175560 - DNA, 25 bp, Mus musculus
acattaaaaaccttaggttgttctg

SEQ ID NO: 175561 - DNA, 25 bp, Mus musculus
acattaaaaggagtgcaagatcccc

SEQ ID NO: 175562 - DNA, 25 bp, Mus musculus
acattaaaggaggcacttgactcaa

SEQ ID NO: 175563 - DNA, 25 bp, Mus musculus
acattaaagtgacatatgacatcca

SEQ ID NO: 175564 - DNA, 25 bp, Mus musculus
acattaaagtgcccagccacagctg

SEQ ID NO: 175565 - DNA, 25 bp, Mus musculus
acattaaatctgaagtgcagcgtaa

SEQ ID NO: 175566 - DNA, 25 bp, Mus musculus
acattaacaaagtagcagacagtgt

SEQ ID NO: 175567 - DNA, 25 bp, Mus musculus
acattaaccagtgcacttaaggaca

SEQ ID NO: 175568 - DNA, 25 bp, Mus musculus
acattaacgtggttcattatgatgg

SEQ ID NO: 175569 - DNA, 25 bp, Mus musculus
acattaacttgaaggtagaagactt

SEQ ID NO: 175570 - DNA, 25 bp, Mus musculus
acattaatgccaccctgcaggcatt

SEQ ID NO: 175571 - DNA, 25 bp, Mus musculus
acattaatgccatttagttcgctac

SEQ ID NO: 175572 - DNA, 25 bp, Mus musculus
acattacaaagcctcccagactaca

SEQ ID NO: 175573 - DNA, 25 bp, Mus musculus
acattacaaggacatgggcaagttc

SEQ ID NO: 175574 - DNA, 25 bp, Mus musculus
acattacacaagaaaaaagtgaaaa

SEQ ID NO: 175575 - DNA, 25 bp, Mus musculus
acattacagatgaccgtgataaagg

SEQ ID NO: 175576 - DNA, 25 bp, Mus musculus
acattaccaatggacgcatcgttga

SEQ ID NO: 175577 - DNA, 25 bp, Mus musculus
acattaccccggagcgagcccatcc

SEQ ID NO: 175578 - DNA, 25 bp, Mus musculus
acattacctcagagctgtggaacga

SEQ ID NO: 175579 - DNA, 25 bp, Mus musculus
acattagaaaaacataaatgcagtt

SEQ ID NO: 175580 - DNA, 25 bp, Mus musculus
acattagaagatctcaggaaaaatg

SEQ ID NO: 175581 - DNA, 25 bp, Mus musculus
acattagagggcaggacaataagac

SEQ ID NO: 175582 - DNA, 25 bp, Mus musculus
acattagcccaggtatccatgccag

SEQ ID NO: 175583 - DNA, 25 bp, Mus musculus
acattagctcggttatgtacaaaga

SEQ ID NO: 175584 - DNA, 25 bp, Mus musculus
acattagctcggttttgtacaaaga

SEQ ID NO: 175585 - DNA, 25 bp, Mus musculus
acattaggaaattagataggttttc

SEQ ID NO: 175586 - DNA, 25 bp, Mus musculus
acattagtgggaagcagctatactg

SEQ ID NO: 175587 - DNA, 25 bp, Mus musculus
acattagtgggatgcagctatactg

SEQ ID NO: 175588 - DNA, 25 bp, Mus musculus
acattataagattccccccctaggg

SEQ ID NO: 175589 - DNA, 25 bp, Mus musculus
acattatcactgtgggccccctccc

SEQ ID NO: 175590 - DNA, 25 bp, Mus musculus
acattatgcagagatgcacacaagc

SEQ ID NO: 175591 - DNA, 25 bp, Mus musculus
acattatgcagagcttctgaacaag

SEQ ID NO: 175592 - DNA, 25 bp, Mus musculus
acattatgcagaggatgattctgac

SEQ ID NO: 175593 - DNA, 25 bp, Mus musculus
acattatggaggacactatcgaaga

SEQ ID NO: 175594 - DNA, 25 bp, Mus musculus
acattattaaacggatggctcccag

SEQ ID NO: 175595 - DNA, 25 bp, Mus musculus
acattattaaagacacactttttaa

SEQ ID NO: 175596 - DNA, 25 bp, Mus musculus
acattattaaagataattgctgtga

SEQ ID NO: 175597 - DNA, 25 bp, Mus musculus
acattattgagatgacacagagacc

SEQ ID NO: 175598 - DNA, 25 bp, Mus musculus
acattattgaggccactgcagatga

SEQ ID NO: 175599 - DNA, 25 bp, Mus musculus
acattattggagatcgtggccttca

SEQ ID NO: 175600 - DNA, 25 bp, Mus musculus
acattattggaggtgctctgcccgt

SEQ ID NO: 175601 - DNA, 25 bp, Mus musculus
acattcaacagagctgccttccgtc

SEQ ID NO: 175602 - DNA, 25 bp, Mus musculus
acattcaacgggggattcatcagtt

SEQ ID NO: 175603 - DNA, 25 bp, Mus musculus
acattcaaggaatgtatgtgcatga

SEQ ID NO: 175604 - DNA, 25 bp, Mus musculus
acattcaatagaggatatccatgca

SEQ ID NO: 175605 - DNA, 25 bp, Mus musculus
acattcaatgctcagtgctgcctga

SEQ ID NO: 175606 - DNA, 25 bp, Mus musculus
acattcaccaggtgcactgcctgtt

SEQ ID NO: 175607 - DNA, 25 bp, Mus musculus
acattcactgcagctgctattggag

SEQ ID NO: 175608 - DNA, 25 bp, Mus musculus
acattcactgcaggtccgagagaag

SEQ ID NO: 175609 - DNA, 25 bp, Mus musculus
acattcactgcagtgcccaggtccg

SEQ ID NO: 175610 - DNA, 25 bp, Mus musculus
acattcagagcaggagcctttgacc

SEQ ID NO: 175611 - DNA, 25 bp, Mus musculus
acattcagagccacaggcaccatgt

SEQ ID NO: 175612 - DNA, 25 bp, Mus musculus
acattcagcccacttggtgcctcct

SEQ ID NO: 175613 - DNA, 25 bp, Mus musculus
acattcagctctggtgattgttcag

SEQ ID NO: 175614 - DNA, 25 bp, Mus musculus
acattcataaaggtcagaaggctat

SEQ ID NO: 175615 - DNA, 25 bp, Mus musculus
acattcataaaggtctagagggctt

SEQ ID NO: 175616 - DNA, 25 bp, Mus musculus
acattcatgcccagggtgttccatg

SEQ ID NO: 175617 - DNA, 25 bp, Mus musculus
acattcatggtgaaggacacatctt

SEQ ID NO: 175618 - DNA, 25 bp, Mus musculus
acattcatttagaaactccccaact

SEQ ID NO: 175619 - DNA, 25 bp, Mus musculus
acattcatttagtatccgctccatt

SEQ ID NO: 175620 - DNA, 25 bp, Mus musculus
acattccaaaggtgtgcaggatttt

SEQ ID NO: 175621 - DNA, 25 bp, Mus musculus
acattccaaagtatagcacatttgg

SEQ ID NO: 175622 - DNA, 25 bp, Mus musculus
acattccaaagtttatgttttgtgc

SEQ ID NO: 175623 - DNA, 25 bp, Mus musculus
acattccaacacttcaaactcaatc

SEQ ID NO: 175624 - DNA, 25 bp, Mus musculus
acattccaacgtgtccgatccgtac

SEQ ID NO: 175625 - DNA, 25 bp, Mus musculus
acattccacactcccgtatgaaaag

SEQ ID NO: 175626 - DNA, 25 bp, Mus musculus
acattccagaggtgatggtggcccc

SEQ ID NO: 175627 - DNA, 25 bp, Mus musculus
acattccagcagaccgacttgtctc

SEQ ID NO: 175628 - DNA, 25 bp, Mus musculus
acattccaggagaatgccaggaggt

SEQ ID NO: 175629 - DNA, 25 bp, Mus musculus
acattccagggagattccagacttc

SEQ ID NO: 175630 - DNA, 25 bp, Mus musculus
acattccagggagggtcccacctcc

SEQ ID NO: 175631 - DNA, 25 bp, Mus musculus
acattcccaagggcacaagtgtaat

SEQ ID NO: 175632 - DNA, 25 bp, Mus musculus
acattccccagcctctgcagacctc

SEQ ID NO: 175633 - DNA, 25 bp, Mus musculus
acattccccaggattgggtttcctt

SEQ ID NO: 175634 - DNA, 25 bp, Mus musculus
acattccccaggctctgcagacctc

SEQ ID NO: 175635 - DNA, 25 bp, Mus musculus
acattccgttcaaaggtctcaacat

SEQ ID NO: 175636 - DNA, 25 bp, Mus musculus
acattcctatgaagcccacattcag

SEQ ID NO: 175637 - DNA, 25 bp, Mus musculus
acattcctatgaaggaagagcagca

SEQ ID NO: 175638 - DNA, 25 bp, Mus musculus
acattcctcactgacctggcctctg

SEQ ID NO: 175639 - DNA, 25 bp, Mus musculus
acattcctcagggaactgaaaccaa

SEQ ID NO: 175640 - DNA, 25 bp, Mus musculus
acattcctgagccagtcctagaggc

SEQ ID NO: 175641 - DNA, 25 bp, Mus musculus
acattcctgagccgggataactggg

SEQ ID NO: 175642 - DNA, 25 bp, Mus musculus
acattcctggagggatcatgcctgg

SEQ ID NO: 175643 - DNA, 25 bp, Mus musculus
acattcctgggtgtggtcaacagct

SEQ ID NO: 175644 - DNA, 25 bp, Mus musculus
acattccttcattagtgaaaagaat

SEQ ID NO: 175645 - DNA, 25 bp, Mus musculus
acattcgacagggaagaagaaaaag

SEQ ID NO: 175646 - DNA, 25 bp, Mus musculus
acattcgacagggaagggaacaaaa

SEQ ID NO: 175647 - DNA, 25 bp, Mus musculus
acattcgacaggggaatggtttgga

SEQ ID NO: 175648 - DNA, 25 bp, Mus musculus
acattcgcaaagactctcacccagg

SEQ ID NO: 175649 - DNA, 25 bp, Mus musculus
acattcgcataccggatggaaatgc

SEQ ID NO: 175650 - DNA, 25 bp, Mus musculus
acattcgcgcctagtattttgttaa

SEQ ID NO: 175651 - DNA, 25 bp, Mus musculus
acattcggacccagatgacccaggg

SEQ ID NO: 175652 - DNA, 25 bp, Mus musculus
acattctacagggtcacagacagga

SEQ ID NO: 175653 - DNA, 25 bp, Mus musculus
acattctaccgctcctggaggatga

SEQ ID NO: 175654 - DNA, 25 bp, Mus musculus
acattctaccgctgaaaaagcagtt

SEQ ID NO: 175655 - DNA, 25 bp, Mus musculus
acattctaccgctttgatgcagcaa

SEQ ID NO: 175656 - DNA, 25 bp, Mus musculus
acattctcaacaacctgagattcat

SEQ ID NO: 175657 - DNA, 25 bp, Mus musculus
acattctcaaggtttcttttacagc

SEQ ID NO: 175658 - DNA, 25 bp, Mus musculus
acattctcaataacctgtgtgaacg

SEQ ID NO: 175659 - DNA, 25 bp, Mus musculus
acattctcaccgacatcactcagca

SEQ ID NO: 175660 - DNA, 25 bp, Mus musculus
acattctcttaaggttgtgtggagg

SEQ ID NO: 175661 - DNA, 25 bp, Mus musculus
acattctgaagatactaagcaacca

SEQ ID NO: 175662 - DNA, 25 bp, Mus musculus
acattctgaagatgtgggcacatgc

SEQ ID NO: 175663 - DNA, 25 bp, Mus musculus
acattctgaaggatttgacgttggt

SEQ ID NO: 175664 - DNA, 25 bp, Mus musculus
acattctgcagcagatcgtgaacct

SEQ ID NO: 175665 - DNA, 25 bp, Mus musculus
acattctggagcagtgccaataact

SEQ ID NO: 175666 - DNA, 25 bp, Mus musculus
acattctggagccagcagggcctca

SEQ ID NO: 175667 - DNA, 25 bp, Mus musculus
acattctggagggatgagacacctc

SEQ ID NO: 175668 - DNA, 25 bp, Mus musculus
acattctgggccaggagtctccaaa

SEQ ID NO: 175669 - DNA, 25 bp, Mus musculus
acattctggtgttcggtagagctgg

SEQ ID NO: 175670 - DNA, 25 bp, Mus musculus
acattctggtgttcggtgaagatgg

SEQ ID NO: 175671 - DNA, 25 bp, Mus musculus
acattcttgaggtggagtctttcat

SEQ ID NO: 175672 - DNA, 25 bp, Mus musculus
acattgaaagagcccattctgcact

SEQ ID NO: 175673 - DNA, 25 bp, Mus musculus
acattgaactaaaggagtcaaggag

SEQ ID NO: 175674 - DNA, 25 bp, Mus musculus
acattgaagagcatgcctctgcaga

SEQ ID NO: 175675 - DNA, 25 bp, Mus musculus
acattgaagagcatgcctctggagc

SEQ ID NO: 175676 - DNA, 25 bp, Mus musculus
acattgaaggtacaggagttaaaga

SEQ ID NO: 175677 - DNA, 25 bp, Mus musculus
acattgacactgctgacagtgccac

SEQ ID NO: 175678 - DNA, 25 bp, Mus musculus
acattgacactgctgatgccgagtg

SEQ ID NO: 175679 - DNA, 25 bp, Mus musculus
acattgacctggtgatctccttctt

SEQ ID NO: 175680 - DNA, 25 bp, Mus musculus
acattgacttcatggtggcttgcat

SEQ ID NO: 175681 - DNA, 25 bp, Mus musculus
acattgagactttctttggggtagg

SEQ ID NO: 175682 - DNA, 25 bp, Mus musculus
acattgagagggaatgaggtcttgt

SEQ ID NO: 175683 - DNA, 25 bp, Mus musculus
acattgagagggagagtgtggagag

SEQ ID NO: 175684 - DNA, 25 bp, Mus musculus
acattgagcagagtctgcgagaaat

SEQ ID NO: 175685 - DNA, 25 bp, Mus musculus
acattgagcaggcatacaaatgctc

SEQ ID NO: 175686 - DNA, 25 bp, Mus musculus
acattgaggaataggtacctggcag

SEQ ID NO: 175687 - DNA, 25 bp, Mus musculus
acattgaggggtacgtgccatcaca

SEQ ID NO: 175688 - DNA, 25 bp, Mus musculus
acattgaggggtctgtgcacttgtt

SEQ ID NO: 175689 - DNA, 25 bp, Mus musculus
acattgataatccgctggctcgggc

SEQ ID NO: 175690 - DNA, 25 bp, Mus musculus
acattgatgaagcgtcaggaactgt

SEQ ID NO: 175691 - DNA, 25 bp, Mus musculus
acattgatgacctttggcaagaaga

SEQ ID NO: 175692 - DNA, 25 bp, Mus musculus
acattgatgagaaaaagaaatccaa

SEQ ID NO: 175693 - DNA, 25 bp, Mus musculus
acattgatgagtatgcacctgagga

SEQ ID NO: 175694 - DNA, 25 bp, Mus musculus
acattgatgagtgaagaggcgacga

SEQ ID NO: 175695 - DNA, 25 bp, Mus musculus
acattgatgagtgacctgctgccgt

SEQ ID NO: 175696 - DNA, 25 bp, Mus musculus
acattgatgtcacgaagccagcgat

SEQ ID NO: 175697 - DNA, 25 bp, Mus musculus
acattgatgtcacgccgcataactc

SEQ ID NO: 175698 - DNA, 25 bp, Mus musculus
acattgatgtcacggtctattacaa

SEQ ID NO: 175699 - DNA, 25 bp, Mus musculus
acattgattgtagagatcagctcga

SEQ ID NO: 175700 - DNA, 25 bp, Mus musculus
acattgattgtagagttcaggatgg

SEQ ID NO: 175701 - DNA, 25 bp, Mus musculus
acattgcaaagattctgaaaggcct

SEQ ID NO: 175702 - DNA, 25 bp, Mus musculus
acattgcaatggatgagtttcatcc

SEQ ID NO: 175703 - DNA, 25 bp, Mus musculus
acattgcaccagatcacagaactgt

SEQ ID NO: 175704 - DNA, 25 bp, Mus musculus
acattgcacctatagatggcattcg

SEQ ID NO: 175705 - DNA, 25 bp, Mus musculus
acattgcacctatagtgtctataat

SEQ ID NO: 175706 - DNA, 25 bp, Mus musculus
acattgcacggcagattacaaaaga

SEQ ID NO: 175707 - DNA, 25 bp, Mus musculus
acattgcagaggatttttgcagctc

SEQ ID NO: 175708 - DNA, 25 bp, Mus musculus
acattgcagaggggctacatgacac

SEQ ID NO: 175709 - DNA, 25 bp, Mus musculus
acattgcataggtagccaaggagca

SEQ ID NO: 175710 - DNA, 25 bp, Mus musculus
acattgccaaatgcaagctgtgcat

SEQ ID NO: 175711 - DNA, 25 bp, Mus musculus
acattgccaagcaaggaagcctgct

SEQ ID NO: 175712 - DNA, 25 bp, Mus musculus
acattgccaagtataaaggagaaga

SEQ ID NO: 175713 - DNA, 25 bp, Mus musculus
acattgccaagttaaaaggagaaga

SEQ ID NO: 175714 - DNA, 25 bp, Mus musculus
acattgccagaaagagaaatgcttt

SEQ ID NO: 175715 - DNA, 25 bp, Mus musculus
acattgccagccttggggagttctg

SEQ ID NO: 175716 - DNA, 25 bp, Mus musculus
acattgccataaaggtgacaaatgg

SEQ ID NO: 175717 - DNA, 25 bp, Mus musculus
acattgccgagcgtgagagccaagc

SEQ ID NO: 175718 - DNA, 25 bp, Mus musculus
acattgccgcccaggactgctcctg

SEQ ID NO: 175719 - DNA, 25 bp, Mus musculus
acattgctaactgccttgcagtgag

SEQ ID NO: 175720 - DNA, 25 bp, Mus musculus
acattgctacagctgcacagagcat

SEQ ID NO: 175721 - DNA, 25 bp, Mus musculus
acattgctagcatttgaagacatgc

SEQ ID NO: 175722 - DNA, 25 bp, Mus musculus
acattgctggacatttcaatgatga

SEQ ID NO: 175723 - DNA, 25 bp, Mus musculus
acattgctggatcctctcccagtcc

SEQ ID NO: 175724 - DNA, 25 bp, Mus musculus
acattgctttccagagcggaaacgg

SEQ ID NO: 175725 - DNA, 25 bp, Mus musculus
acattggacggaagaagtcccagac

SEQ ID NO: 175726 - DNA, 25 bp, Mus musculus
acattggcacagaggctcagatccg

SEQ ID NO: 175727 - DNA, 25 bp, Mus musculus
acattggcatagctccttattacca

SEQ ID NO: 175728 - DNA, 25 bp, Mus musculus
acattggctggggctccaacggcaa

SEQ ID NO: 175729 - DNA, 25 bp, Mus musculus
acattggctggtgtcccttctggta

SEQ ID NO: 175730 - DNA, 25 bp, Mus musculus
acattgggataacagttcccaaagt

SEQ ID NO: 175731 - DNA, 25 bp, Mus musculus
acattggtgccaagaagatgcacga

SEQ ID NO: 175732 - DNA, 25 bp, Mus musculus
acattgtacagaagctgttgcaata

SEQ ID NO: 175733 - DNA, 25 bp, Mus musculus
acattgtacagaaggacctggtggc

SEQ ID NO: 175734 - DNA, 25 bp, Mus musculus
acattgtagaaaaaatcgatgccca

SEQ ID NO: 175735 - DNA, 25 bp, Mus musculus
acattgtcagatctcagggcagttg

SEQ ID NO: 175736 - DNA, 25 bp, Mus musculus
acattgtcagatgtccattcagcca

SEQ ID NO: 175737 - DNA, 25 bp, Mus musculus
acattgtcattccagggatcttcat

SEQ ID NO: 175738 - DNA, 25 bp, Mus musculus
acattgtcggtgtacttgggagatg

SEQ ID NO: 175739 - DNA, 25 bp, Mus musculus
acattgtctatgagtttctgatgtc

SEQ ID NO: 175740 - DNA, 25 bp, Mus musculus
acattgtcttctgggtgctgggagc

SEQ ID NO: 175741 - DNA, 25 bp, Mus musculus
acattgtcttctggttctctgtgtt

SEQ ID NO: 175742 - DNA, 25 bp, Mus musculus
acattgtgctatagggattgtgcca

SEQ ID NO: 175743 - DNA, 25 bp, Mus musculus
acattgtgctcaagaccttcctgga

SEQ ID NO: 175744 - DNA, 25 bp, Mus musculus
acattgtggagacattgagaaagaa

SEQ ID NO: 175745 - DNA, 25 bp, Mus musculus
acattgtggaggcattgaacaagaa

SEQ ID NO: 175746 - DNA, 25 bp, Mus musculus
acattgtggggacaaaacacagaag

SEQ ID NO: 175747 - DNA, 25 bp, Mus musculus
acattgtgtggggtcaccgacaatg

SEQ ID NO: 175748 - DNA, 25 bp, Mus musculus
acattgttacagaattgaattagaa

SEQ ID NO: 175749 - DNA, 25 bp, Mus musculus
acattgttgtcaaggtttgatctca

SEQ ID NO: 175750 - DNA, 25 bp, Mus musculus
acattgtttactccctgaaggagtc

SEQ ID NO: 175751 - DNA, 25 bp, Mus musculus
acatttaaaacagttgccatccaca

SEQ ID NO: 175752 - DNA, 25 bp, Mus musculus
acatttaaaagctatgacttcacac

SEQ ID NO: 175753 - DNA, 25 bp, Mus musculus
acatttaaaaggccatatcaatatt

SEQ ID NO: 175754 - DNA, 25 bp, Mus musculus
acatttaaacctgagcattttaatc

SEQ ID NO: 175755 - DNA, 25 bp, Mus musculus
acatttaaggagattactttgcaaa

SEQ ID NO: 175756 - DNA, 25 bp, Mus musculus
acatttacagctcccctctccacag

SEQ ID NO: 175757 - DNA, 25 bp, Mus musculus
acatttaccagggaagacagtgatc

SEQ ID NO: 175758 - DNA, 25 bp, Mus musculus
acatttaccatatgacttttccaac

SEQ ID NO: 175759 - DNA, 25 bp, Mus musculus
acatttcaaaagaaaggacctatgc

SEQ ID NO: 175760 - DNA, 25 bp, Mus musculus
acatttcaaaagtttgatttccagg

SEQ ID NO: 175761 - DNA, 25 bp, Mus musculus
acatttcaaaggtaccaaagcagtc

SEQ ID NO: 175762 - DNA, 25 bp, Mus musculus
acatttcaaaggttagcgatgcaac

SEQ ID NO: 175763 - DNA, 25 bp, Mus musculus
acatttcaagaagacagcatcccac

SEQ ID NO: 175764 - DNA, 25 bp, Mus musculus
acatttcaagctcttagccccccaa

SEQ ID NO: 175765 - DNA, 25 bp, Mus musculus
acatttcaaggcacagaagaaaata

SEQ ID NO: 175766 - DNA, 25 bp, Mus musculus
acatttcaagtcttcaggaaagact

SEQ ID NO: 175767 - DNA, 25 bp, Mus musculus
acatttcaagttcatggcatctcat

SEQ ID NO: 175768 - DNA, 25 bp, Mus musculus
acatttcacaaagctcggattggga

SEQ ID NO: 175769 - DNA, 25 bp, Mus musculus
acatttcagggagactgctgggctg

SEQ ID NO: 175770 - DNA, 25 bp, Mus musculus
acatttccagcgttcccaggctcct

SEQ ID NO: 175771 - DNA, 25 bp, Mus musculus
acatttccagcgttcccatgcccct

SEQ ID NO: 175772 - DNA, 25 bp, Mus musculus
acatttccaggttcagctcctaatc

SEQ ID NO: 175773 - DNA, 25 bp, Mus musculus
acatttccctgatagattgctaaca

SEQ ID NO: 175774 - DNA, 25 bp, Mus musculus
acatttcctcctacaacacggtaga

SEQ ID NO: 175775 - DNA, 25 bp, Mus musculus
acatttcctcctacattgagcagac

SEQ ID NO: 175776 - DNA, 25 bp, Mus musculus
acatttcctttcaggcaagtacatt

SEQ ID NO: 175777 - DNA, 25 bp, Mus musculus
acatttctaactgggttatgggtgc

SEQ ID NO: 175778 - DNA, 25 bp, Mus musculus
acatttctaactggtagtgtgagga

SEQ ID NO: 175779 - DNA, 25 bp, Mus musculus
acatttctcctggaggttccaacta

SEQ ID NO: 175780 - DNA, 25 bp, Mus musculus
acatttctggggacacccagaaagc

SEQ ID NO: 175781 - DNA, 25 bp, Mus musculus
acatttgaaagagccccggcagccc

SEQ ID NO: 175782 - DNA, 25 bp, Mus musculus
acatttgaagacatgctccagctca

SEQ ID NO: 175783 - DNA, 25 bp, Mus musculus
acatttgagactctctgtgcaaaga

SEQ ID NO: 175784 - DNA, 25 bp, Mus musculus
acatttgagattaagaaatgtgacc

SEQ ID NO: 175785 - DNA, 25 bp, Mus musculus
acatttgagattaaggaagcctgct

SEQ ID NO: 175786 - DNA, 25 bp, Mus musculus
acatttggagcccttacagaggaac

SEQ ID NO: 175787 - DNA, 25 bp, Mus musculus
acatttgggtcttctaattgtcaac

SEQ ID NO: 175788 - DNA, 25 bp, Mus musculus
acatttggtgcaacgtttgtgcttg

SEQ ID NO: 175789 - DNA, 25 bp, Mus musculus
acatttgtgggagatcaagttcttg

SEQ ID NO: 175790 - DNA, 25 bp, Mus musculus
acatttgtggggaacagacaagtct

SEQ ID NO: 175791 - DNA, 25 bp, Mus musculus
acatttgtttgcaatcaattatact

SEQ ID NO: 175792 - DNA, 25 bp, Mus musculus
acattttaaaaaagtcgagcctgtt

SEQ ID NO: 175793 - DNA, 25 bp, Mus musculus
acattttaaagacatttgagaactt

SEQ ID NO: 175794 - DNA, 25 bp, Mus musculus
acattttaaagctgccatccatcca

SEQ ID NO: 175795 - DNA, 25 bp, Mus musculus
acattttaagccagaacgctttacc

SEQ ID NO: 175796 - DNA, 25 bp, Mus musculus
acattttaagccagagttgtaagct

SEQ ID NO: 175797 - DNA, 25 bp, Mus musculus
acattttactaagagatgtggcttt

SEQ ID NO: 175798 - DNA, 25 bp, Mus musculus
acattttagcaggttttctgattaa

SEQ ID NO: 175799 - DNA, 25 bp, Mus musculus
acattttattcatccaacaactatt

SEQ ID NO: 175800 - DNA, 25 bp, Mus musculus
acattttattcatgcttaggtggag

SEQ ID NO: 175801 - DNA, 25 bp, Mus musculus
acattttattcatttttctggatat

SEQ ID NO: 175802 - DNA, 25 bp, Mus musculus
acattttcacggacaagccctcagt

SEQ ID NO: 175803 - DNA, 25 bp, Mus musculus
acattttgagcgttggtgttgtgag

SEQ ID NO: 175804 - DNA, 25 bp, Mus musculus
acattttgaggactactgttgaaga

SEQ ID NO: 175805 - DNA, 25 bp, Mus musculus
acattttgatggagcctgaaacatt

SEQ ID NO: 175806 - DNA, 25 bp, Mus musculus
acattttgcagagattgagaagcat

SEQ ID NO: 175807 - DNA, 25 bp, Mus musculus
acattttgcagagctttgggaccat

SEQ ID NO: 175808 - DNA, 25 bp, Mus musculus
acattttggaactagagttggtgac

SEQ ID NO: 175809 - DNA, 25 bp, Mus musculus
acattttggaactaggtgcaagaat

SEQ ID NO: 175810 - DNA, 25 bp, Mus musculus
acattttggaaggtgcctctccttt

SEQ ID NO: 175811 - DNA, 25 bp, Mus musculus
acatttttaacagaagcaaacccaa

SEQ ID NO: 175812 - DNA, 25 bp, Mus musculus
acatttttaacagattagttcataa

SEQ ID NO: 175813 - DNA, 25 bp, Mus musculus
acatttttcgacatccgcagacatc

SEQ ID NO: 175814 - DNA, 25 bp, Mus musculus
acatttttctgaattattttgataa

SEQ ID NO: 175815 - DNA, 25 bp, Mus musculus
acattttttatcagccatcgtctag

SEQ ID NO: 175816 - DNA, 25 bp, Mus musculus
accaaaaacaagctttacacagatt

SEQ ID NO: 175817 - DNA, 25 bp, Mus musculus
accaaaaaccgaagcgcagcagcag

SEQ ID NO: 175818 - DNA, 25 bp, Mus musculus
accaaaaagcacaacccaagaggca

SEQ ID NO: 175819 - DNA, 25 bp, Mus musculus
accaaaaagcagatggagacacgga

SEQ ID NO: 175820 - DNA, 25 bp, Mus musculus
accaaaaagcagattgtccatccca

SEQ ID NO: 175821 - DNA, 25 bp, Mus musculus
accaaaaataaggtacaagttcagt

SEQ ID NO: 175822 - DNA, 25 bp, Mus musculus
accaaaacagaagaggaacaagttg

SEQ ID NO: 175823 - DNA, 25 bp, Mus musculus
accaaaacagaagaggatgaaacaa

SEQ ID NO: 175824 - DNA, 25 bp, Mus musculus
accaaaacgaaaatgcaaaattact

SEQ ID NO: 175825 - DNA, 25 bp, Mus musculus
accaaaagctagagacaagcgagac

SEQ ID NO: 175826 - DNA, 25 bp, Mus musculus
accaaaagcttgtgggcgaaacgct

SEQ ID NO: 175827 - DNA, 25 bp, Mus musculus
accaaaaggagcagcagcagcagca

SEQ ID NO: 175828 - DNA, 25 bp, Mus musculus
accaaaagggcaacatccccgatga

SEQ ID NO: 175829 - DNA, 25 bp, Mus musculus
accaaaatcagggccctgtggacaa

SEQ ID NO: 175830 - DNA, 25 bp, Mus musculus
accaaaatctcagaactcaagtgat

SEQ ID NO: 175831 - DNA, 25 bp, Mus musculus
accaaaatctcaggctggcctgtga

SEQ ID NO: 175832 - DNA, 25 bp, Mus musculus
accaaaatgaagaagatgggcttag

SEQ ID NO: 175833 - DNA, 25 bp, Mus musculus
accaaaatgaagaagtggaactatg

SEQ ID NO: 175834 - DNA, 25 bp, Mus musculus
accaaaatgaaggaagctctgagtt

SEQ ID NO: 175835 - DNA, 25 bp, Mus musculus
accaaacaaggttatatctgaagaa

SEQ ID NO: 175836 - DNA, 25 bp, Mus musculus
accaaacaccagtatttctctgagt

SEQ ID NO: 175837 - DNA, 25 bp, Mus musculus
accaaacagaacagatgacacttct

SEQ ID NO: 175838 - DNA, 25 bp, Mus musculus
accaaacagagtctccttaaagaat

SEQ ID NO: 175839 - DNA, 25 bp, Mus musculus
accaaacaggaggaggcgaagagga

SEQ ID NO: 175840 - DNA, 25 bp, Mus musculus
accaaaccaaaccctgtagctccct

SEQ ID NO: 175841 - DNA, 25 bp, Mus musculus
accaaaccaccgctgaagacgatga

SEQ ID NO: 175842 - DNA, 25 bp, Mus musculus
accaaaccaccgctgcagcccacta

SEQ ID NO: 175843 - DNA, 25 bp, Mus musculus
accaaaccctttgcactgagcagcc

SEQ ID NO: 175844 - DNA, 25 bp, Mus musculus
accaaaccgcaggcaatactagcca

SEQ ID NO: 175845 - DNA, 25 bp, Mus musculus
accaaaccgcaggtataatcaaagg

SEQ ID NO: 175846 - DNA, 25 bp, Mus musculus
accaaaccggattgagtttatctca

SEQ ID NO: 175847 - DNA, 25 bp, Mus musculus
accaaaccgggtgaggcacagagtt

SEQ ID NO: 175848 - DNA, 25 bp, Mus musculus
accaaaccgtaggcctgtagctccc

SEQ ID NO: 175849 - DNA, 25 bp, Mus musculus
accaaacctctcagtgaaaactgaa

SEQ ID NO: 175850 - DNA, 25 bp, Mus musculus
accaaacgcagaagcttgcaggaaa

SEQ ID NO: 175851 - DNA, 25 bp, Mus musculus
accaaacggcatgtatcctcctcca

SEQ ID NO: 175852 - DNA, 25 bp, Mus musculus
accaaacggcatgtgacctgaccta

SEQ ID NO: 175853 - DNA, 25 bp, Mus musculus
accaaactgcagctgcatggagcag

SEQ ID NO: 175854 - DNA, 25 bp, Mus musculus
accaaactgcaggaatgggcaaagg

SEQ ID NO: 175855 - DNA, 25 bp, Mus musculus
accaaactgttgattggtgctgatg

SEQ ID NO: 175856 - DNA, 25 bp, Mus musculus
accaaagaagatgccgctccaattg

SEQ ID NO: 175857 - DNA, 25 bp, Mus musculus
accaaagaagtacggcgagctcctc

SEQ ID NO: 175858 - DNA, 25 bp, Mus musculus
accaaagaccacgtggatgaaggct

SEQ ID NO: 175859 - DNA, 25 bp, Mus musculus
accaaagagagacctcctaagccat

SEQ ID NO: 175860 - DNA, 25 bp, Mus musculus
accaaagagcagccccggactcact

SEQ ID NO: 175861 - DNA, 25 bp, Mus musculus
accaaagagctcaaggatgcaggag

SEQ ID NO: 175862 - DNA, 25 bp, Mus musculus
accaaagagctgcctctgttcctct

SEQ ID NO: 175863 - DNA, 25 bp, Mus musculus
accaaagatgggttaatatccttcc

SEQ ID NO: 175864 - DNA, 25 bp, Mus musculus
accaaagattaaggtacacaggttt

SEQ ID NO: 175865 - DNA, 25 bp, Mus musculus
accaaagattaagttgctcaggaaa

SEQ ID NO: 175866 - DNA, 25 bp, Mus musculus
accaaagcacagtgtcctcaacaat

SEQ ID NO: 175867 - DNA, 25 bp, Mus musculus
accaaagcagagttctcgtcatttg

SEQ ID NO: 175868 - DNA, 25 bp, Mus musculus
accaaagcaggcttcttcccttacc

SEQ ID NO: 175869 - DNA, 25 bp, Mus musculus
accaaagcatggagggtgatgagga

SEQ ID NO: 175870 - DNA, 25 bp, Mus musculus
accaaagctcccaaagcaaatccag

SEQ ID NO: 175871 - DNA, 25 bp, Mus musculus
accaaaggaacaaggacagggagat

SEQ ID NO: 175872 - DNA, 25 bp, Mus musculus
accaaaggacagaggacctgaaggc

SEQ ID NO: 175873 - DNA, 25 bp, Mus musculus
accaaaggacagagggtagacaaac

SEQ ID NO: 175874 - DNA, 25 bp, Mus musculus
accaaagggaagggctccacctgtg

SEQ ID NO: 175875 - DNA, 25 bp, Mus musculus
accaaagtcttgtaatttgaactgt

SEQ ID NO: 175876 - DNA, 25 bp, Mus musculus
accaaagtcttgtgatttgaactgt

SEQ ID NO: 175877 - DNA, 25 bp, Mus musculus
accaaagtgatcctatcccatcacc

SEQ ID NO: 175878 - DNA, 25 bp, Mus musculus
accaaagttaaaaacagcctcacca

SEQ ID NO: 175879 - DNA, 25 bp, Mus musculus
accaaatacaatgacccctgacaag

SEQ ID NO: 175880 - DNA, 25 bp, Mus musculus
accaaatacaatgccctcaagaccc

SEQ ID NO: 175881 - DNA, 25 bp, Mus musculus
accaaatagtacaggcagtgggaac

SEQ ID NO: 175882 - DNA, 25 bp, Mus musculus
accaaatcaagggccgatgatgcac

SEQ ID NO: 175883 - DNA, 25 bp, Mus musculus
accaaatcacatgatggagcctcaa

SEQ ID NO: 175884 - DNA, 25 bp, Mus musculus
accaaatcagatgtcatggcacccc

SEQ ID NO: 175885 - DNA, 25 bp, Mus musculus
accaaatcagcagaaatggaggaac

SEQ ID NO: 175886 - DNA, 25 bp, Mus musculus
accaaatggagatataatcatgtgt

SEQ ID NO: 175887 - DNA, 25 bp, Mus musculus
accaaatggccatgataacagctat

SEQ ID NO: 175888 - DNA, 25 bp, Mus musculus
accaaatgggaggtgtgtcagaaat

SEQ ID NO: 175889 - DNA, 25 bp, Mus musculus
accaaatgttgggcgaagatctgca

SEQ ID NO: 175890 - DNA, 25 bp, Mus musculus
accaaatgttgggcgtgtgcatgta

SEQ ID NO: 175891 - DNA, 25 bp, Mus musculus
accaaattaatgacaagaacggaga

SEQ ID NO: 175892 - DNA, 25 bp, Mus musculus
accaaattaatgagtacaaggagtg

SEQ ID NO: 175893 - DNA, 25 bp, Mus musculus
accaaattaatgtggatgatctttt

SEQ ID NO: 175894 - DNA, 25 bp, Mus musculus
accaacaaaaaaagctccgactgat

SEQ ID NO: 175895 - DNA, 25 bp, Mus musculus
accaacaaaaaagacaggtgttcac

SEQ ID NO: 175896 - DNA, 25 bp, Mus musculus
accaacaaagggcgagaactttgga

SEQ ID NO: 175897 - DNA, 25 bp, Mus musculus
accaacaaagttattcatggtggac

SEQ ID NO: 175898 - DNA, 25 bp, Mus musculus
accaacaacactgacaggggcatct

SEQ ID NO: 175899 - DNA, 25 bp, Mus musculus
accaacaagtagcaggattgtctct

SEQ ID NO: 175900 - DNA, 25 bp, Mus musculus
accaacacaccacaggctttgctac

SEQ ID NO: 175901 - DNA, 25 bp, Mus musculus
accaacacaccacagggaaaccagg

SEQ ID NO: 175902 - DNA, 25 bp, Mus musculus
accaacacacgtgggaaggtggcgt

SEQ ID NO: 175903 - DNA, 25 bp, Mus musculus
accaacacacgtggtggtacccggg

SEQ ID NO: 175904 - DNA, 25 bp, Mus musculus
accaacacaggttccttcctccaca

SEQ ID NO: 175905 - DNA, 25 bp, Mus musculus
accaacaccatggacaaaagcttca

SEQ ID NO: 175906 - DNA, 25 bp, Mus musculus
accaacaccatggtgtttcctggct

SEQ ID NO: 175907 - DNA, 25 bp, Mus musculus
accaacacccaggcctgcagtgggg

SEQ ID NO: 175908 - DNA, 25 bp, Mus musculus
accaacaccccttcagtgcctgtgc

SEQ ID NO: 175909 - DNA, 25 bp, Mus musculus
accaacactttgaagtcttgaagaa

SEQ ID NO: 175910 - DNA, 25 bp, Mus musculus
accaacagaggaattcatcagagag

SEQ ID NO: 175911 - DNA, 25 bp, Mus musculus
accaacagcagagaactggggaacc

SEQ ID NO: 175912 - DNA, 25 bp, Mus musculus
accaacagttcttccaatcccacat

SEQ ID NO: 175913 - DNA, 25 bp, Mus musculus
accaacataatgcatgccaagtggc

SEQ ID NO: 175914 - DNA, 25 bp, Mus musculus
accaacatccagagcaagcaccaga

SEQ ID NO: 175915 - DNA, 25 bp, Mus musculus
accaacatccagctttccaagctgt

SEQ ID NO: 175916 - DNA, 25 bp, Mus musculus
accaacatgtggagtgaaaaatctc

SEQ ID NO: 175917 - DNA, 25 bp, Mus musculus
accaacattcagggtctactgaaag

SEQ ID NO: 175918 - DNA, 25 bp, Mus musculus
accaacattgctggacatttcaatg

SEQ ID NO: 175919 - DNA, 25 bp, Mus musculus
accaacattgctggatcctctccca

SEQ ID NO: 175920 - DNA, 25 bp, Mus musculus
accaaccaaagccagacccacactt

SEQ ID NO: 175921 - DNA, 25 bp, Mus musculus
accaaccaccaggggacctatgtgc

SEQ ID NO: 175922 - DNA, 25 bp, Mus musculus
accaaccaccagttcctggccttca

SEQ ID NO: 175923 - DNA, 25 bp, Mus musculus
accaaccaggggccttggccttaca

SEQ ID NO: 175924 - DNA, 25 bp, Mus musculus
accaaccagggtcatgccattgcca

SEQ ID NO: 175925 - DNA, 25 bp, Mus musculus
accaaccattgtaaaacttatggaa

SEQ ID NO: 175926 - DNA, 25 bp, Mus musculus
accaaccgagtcatttaaggctgca

SEQ ID NO: 175927 - DNA, 25 bp, Mus musculus
accaacctatgaaaactctctactt

SEQ ID NO: 175928 - DNA, 25 bp, Mus musculus
accaacctgcagatggcagcagtga

SEQ ID NO: 175929 - DNA, 25 bp, Mus musculus
accaacctgcagatggcagctcaac

SEQ ID NO: 175930 - DNA, 25 bp, Mus musculus
accaaccttcacctgggcctaggct

SEQ ID NO: 175931 - DNA, 25 bp, Mus musculus
accaacgccagaaggaagaggcaaa

SEQ ID NO: 175932 - DNA, 25 bp, Mus musculus
accaacggaggtcctgggtgggatt

SEQ ID NO: 175933 - DNA, 25 bp, Mus musculus
accaacggtaagacaataaaattat

SEQ ID NO: 175934 - DNA, 25 bp, Mus musculus
accaacgtcaatcgctgcctcgagg

SEQ ID NO: 175935 - DNA, 25 bp, Mus musculus
accaactacaggtcaccttgttgga

SEQ ID NO: 175936 - DNA, 25 bp, Mus musculus
accaactcaagaggcccaggagact

SEQ ID NO: 175937 - DNA, 25 bp, Mus musculus
accaactcagcagggcatctgaagt

SEQ ID NO: 175938 - DNA, 25 bp, Mus musculus
accaactcagctctctgctctctgc

SEQ ID NO: 175939 - DNA, 25 bp, Mus musculus
accaactccaacctgaactctctct

SEQ ID NO: 175940 - DNA, 25 bp, Mus musculus
accaactccaacctggaacgagtgg

SEQ ID NO: 175941 - DNA, 25 bp, Mus musculus
accaactccacagaccctgctcaca

SEQ ID NO: 175942 - DNA, 25 bp, Mus musculus
accaactccacaggatctttggaag

SEQ ID NO: 175943 - DNA, 25 bp, Mus musculus
accaactccacctctgcacagaaga

SEQ ID NO: 175944 - DNA, 25 bp, Mus musculus
accaactccgcggatgtggtggagg

SEQ ID NO: 175945 - DNA, 25 bp, Mus musculus
accaactccgcgggctcagggacct

SEQ ID NO: 175946 - DNA, 25 bp, Mus musculus
accaactccgcgtctcttacatctc

SEQ ID NO: 175947 - DNA, 25 bp, Mus musculus
accaactcgaacagctctcgtggcg

SEQ ID NO: 175948 - DNA, 25 bp, Mus musculus
accaactgcaaacgggaggatatga

SEQ ID NO: 175949 - DNA, 25 bp, Mus musculus
accaactgcaaacggtggttggcac

SEQ ID NO: 175950 - DNA, 25 bp, Mus musculus
accaactgcttgtggactaaagagg

SEQ ID NO: 175951 - DNA, 25 bp, Mus musculus
accaactgtatgcagaaatttacac

SEQ ID NO: 175952 - DNA, 25 bp, Mus musculus
accaactgtatgcagcatctgtctg

SEQ ID NO: 175953 - DNA, 25 bp, Mus musculus
accaacttcaccatagaaaacggga

SEQ ID NO: 175954 - DNA, 25 bp, Mus musculus
accaacttcaccatgcttataggag

SEQ ID NO: 175955 - DNA, 25 bp, Mus musculus
accaacttctcagatttactgaaac

SEQ ID NO: 175956 - DNA, 25 bp, Mus musculus
accaacttctcaggggcagatttac

SEQ ID NO: 175957 - DNA, 25 bp, Mus musculus
accaacttctccagaaagcttccct

SEQ ID NO: 175958 - DNA, 25 bp, Mus musculus
accaacttctccagaagcttccctg

SEQ ID NO: 175959 - DNA, 25 bp, Mus musculus
accaacttcttaactgacaggccaa

SEQ ID NO: 175960 - DNA, 25 bp, Mus musculus
accaacttgagaattggacagcgga

SEQ ID NO: 175961 - DNA, 25 bp, Mus musculus
accaacttgagagtgacttctgcga

SEQ ID NO: 175962 - DNA, 25 bp, Mus musculus
accaactttgctagatgtgtcttcc

SEQ ID NO: 175963 - DNA, 25 bp, Mus musculus
accaactttgctgtcatttctcaaa

SEQ ID NO: 175964 - DNA, 25 bp, Mus musculus
accaactttgcttcattacaggacg

SEQ ID NO: 175965 - DNA, 25 bp, Mus musculus
accaacttttccatgatcatcgatg

SEQ ID NO: 175966 - DNA, 25 bp, Mus musculus
accaagaaaaaaattgacatcctgc

SEQ ID NO: 175967 - DNA, 25 bp, Mus musculus
accaagaaaaagacgctgggctgcg

SEQ ID NO: 175968 - DNA, 25 bp, Mus musculus
accaagaaaaagacttcaaggaggc

SEQ ID NO: 175969 - DNA, 25 bp, Mus musculus
accaagaaaaggcagcattctcata

SEQ ID NO: 175970 - DNA, 25 bp, Mus musculus
accaagaaaggggagatctttgagc

SEQ ID NO: 175971 - DNA, 25 bp, Mus musculus
accaagaaagtgctctcttccctga

SEQ ID NO: 175972 - DNA, 25 bp, Mus musculus
accaagaaatgattggtggcttccg

SEQ ID NO: 175973 - DNA, 25 bp, Mus musculus
accaagaacaacctggcttcctgct

SEQ ID NO: 175974 - DNA, 25 bp, Mus musculus
accaagaaccaggcgctcaactcca

SEQ ID NO: 175975 - DNA, 25 bp, Mus musculus
accaagaagaactgagattcctact

SEQ ID NO: 175976 - DNA, 25 bp, Mus musculus
accaagaagcacacagatcgcaagt

SEQ ID NO: 175977 - DNA, 25 bp, Mus musculus
accaagaagcagccctcaggcactg

SEQ ID NO: 175978 - DNA, 25 bp, Mus musculus
accaagaagcagccgatcaaaatcc

SEQ ID NO: 175979 - DNA, 25 bp, Mus musculus
accaagaagcagtcgttccccatca

SEQ ID NO: 175980 - DNA, 25 bp, Mus musculus
accaagaagcagttactgccgcctt

SEQ ID NO: 175981 - DNA, 25 bp, Mus musculus
accaagaaggaaaaggtagagcaga

SEQ ID NO: 175982 - DNA, 25 bp, Mus musculus
accaagaataacctggcttcctgct

SEQ ID NO: 175983 - DNA, 25 bp, Mus musculus
accaagaatcacagacgcagtatga

SEQ ID NO: 175984 - DNA, 25 bp, Mus musculus
accaagaatcacagctcgccaaatc

SEQ ID NO: 175985 - DNA, 25 bp, Mus musculus
accaagacacacccgcagtggtatc

SEQ ID NO: 175986 - DNA, 25 bp, Mus musculus
accaagacacaggggaagtccctga

SEQ ID NO: 175987 - DNA, 25 bp, Mus musculus
accaagacagcagggagtgtgtgcc

SEQ ID NO: 175988 - DNA, 25 bp, Mus musculus
accaagacagcagggtttcaatgcc

SEQ ID NO: 175989 - DNA, 25 bp, Mus musculus
accaagacccaaacttactgctcct

SEQ ID NO: 175990 - DNA, 25 bp, Mus musculus
accaagacccacatctggcaagttc

SEQ ID NO: 175991 - DNA, 25 bp, Mus musculus
accaagaccccaggccagcgctcag

SEQ ID NO: 175992 - DNA, 25 bp, Mus musculus
accaagacccgggcctggttctcag

SEQ ID NO: 175993 - DNA, 25 bp, Mus musculus
accaagacctgcaagccctacctga

SEQ ID NO: 175994 - DNA, 25 bp, Mus musculus
accaagacctgcaaggaatctccgg

SEQ ID NO: 175995 - DNA, 25 bp, Mus musculus
accaagacctgcaaggtccccaacc

SEQ ID NO: 175996 - DNA, 25 bp, Mus musculus
accaagacctggaggaggtgatcac

SEQ ID NO: 175997 - DNA, 25 bp, Mus musculus
accaagagaaccggcatggagagta

SEQ ID NO: 175998 - DNA, 25 bp, Mus musculus
accaagagagcaggtgtaaaagaag

SEQ ID NO: 175999 - DNA, 25 bp, Mus musculus
accaagagcaagaccaggtgctact

SEQ ID NO: 176000 - DNA, 25 bp, Mus musculus
accaagagcaaggcgacggtgtgga

SEQ ID NO: 176001 - DNA, 25 bp, Mus musculus
accaagagctgggagatcatcacag

SEQ ID NO: 176002 - DNA, 25 bp, Mus musculus
accaagaggacggtgtgccgatgct

SEQ ID NO: 176003 - DNA, 25 bp, Mus musculus
accaagagtaaggacgagtcttgca

SEQ ID NO: 176004 - DNA, 25 bp, Mus musculus
accaagatatcgactgatatcttct

SEQ ID NO: 176005 - DNA, 25 bp, Mus musculus
accaagatccagatcttactctagc

SEQ ID NO: 176006 - DNA, 25 bp, Mus musculus
accaagatcccagtgattatagagc

SEQ ID NO: 176007 - DNA, 25 bp, Mus musculus
accaagatcctaaaaatactcttgc

SEQ ID NO: 176008 - DNA, 25 bp, Mus musculus
accaagatctcggtggatatgttct

SEQ ID NO: 176009 - DNA, 25 bp, Mus musculus
accaagatgatagggatgcaaactt

SEQ ID NO: 176010 - DNA, 25 bp, Mus musculus
accaagatgcagacgacctggagga

SEQ ID NO: 176011 - DNA, 25 bp, Mus musculus
accaagatggaggagatcgggcgca

SEQ ID NO: 176012 - DNA, 25 bp, Mus musculus
accaagatggaggagattgggagga

SEQ ID NO: 176013 - DNA, 25 bp, Mus musculus
accaagatgttattgcttcaggagc

SEQ ID NO: 176014 - DNA, 25 bp, Mus musculus
accaagcaagaatgtgaaactccga

SEQ ID NO: 176015 - DNA, 25 bp, Mus musculus
accaagcaagatcgacatcaggatg

SEQ ID NO: 176016 - DNA, 25 bp, Mus musculus
accaagcaatcaaggctttacaaga

SEQ ID NO: 176017 - DNA, 25 bp, Mus musculus
accaagcaccagaatgcaagggtgt

SEQ ID NO: 176018 - DNA, 25 bp, Mus musculus
accaagcaccagctgcgatactatg

SEQ ID NO: 176019 - DNA, 25 bp, Mus musculus
accaagcactggcaggtccaggagg

SEQ ID NO: 176020 - DNA, 25 bp, Mus musculus
accaagcacttgtttctagtttatt

SEQ ID NO: 176021 - DNA, 25 bp, Mus musculus
accaagcagccaggggactctgatg

SEQ ID NO: 176022 - DNA, 25 bp, Mus musculus
accaagcaggagaactactttctcc

SEQ ID NO: 176023 - DNA, 25 bp, Mus musculus
accaagcaggaggttgaggtgagcc

SEQ ID NO: 176024 - DNA, 25 bp, Mus musculus
accaagcattccggagaaaacaacg

SEQ ID NO: 176025 - DNA, 25 bp, Mus musculus
accaagcattccggctactcctgga

SEQ ID NO: 176026 - DNA, 25 bp, Mus musculus
accaagccacagcaatgtggggctg

SEQ ID NO: 176027 - DNA, 25 bp, Mus musculus
accaagccacaggatggtgacatta

SEQ ID NO: 176028 - DNA, 25 bp, Mus musculus
accaagccaggatcctgtccccatc

SEQ ID NO: 176029 - DNA, 25 bp, Mus musculus
accaagccaggtggacttgtttgtc

SEQ ID NO: 176030 - DNA, 25 bp, Mus musculus
accaagccatggtacactgtgggag

SEQ ID NO: 176031 - DNA, 25 bp, Mus musculus
accaagcctagtgctaccaagggaa

SEQ ID NO: 176032 - DNA, 25 bp, Mus musculus
accaagctcagcctcctcttagaca

SEQ ID NO: 176033 - DNA, 25 bp, Mus musculus
accaagctgctgagactttccagtt

SEQ ID NO: 176034 - DNA, 25 bp, Mus musculus
accaagctgtagatcaagtctccag

SEQ ID NO: 176035 - DNA, 25 bp, Mus musculus
accaagctgtagcatagttttggga

SEQ ID NO: 176036 - DNA, 25 bp, Mus musculus
accaagctttccagcacctcctacc

SEQ ID NO: 176037 - DNA, 25 bp, Mus musculus
accaagctttccaggtctttgactc

SEQ ID NO: 176038 - DNA, 25 bp, Mus musculus
accaaggaacagatcctgaagctgc

SEQ ID NO: 176039 - DNA, 25 bp, Mus musculus
accaaggaccagactttgaagaatc

SEQ ID NO: 176040 - DNA, 25 bp, Mus musculus
accaaggaccaggagatccagactt

SEQ ID NO: 176041 - DNA, 25 bp, Mus musculus
accaaggaccttctcttggtcttca

SEQ ID NO: 176042 - DNA, 25 bp, Mus musculus
accaaggactgctacaccttacaac

SEQ ID NO: 176043 - DNA, 25 bp, Mus musculus
accaaggactggccttctcagtatt

SEQ ID NO: 176044 - DNA, 25 bp, Mus musculus
accaaggagcaggtcatgcttctca

SEQ ID NO: 176045 - DNA, 25 bp, Mus musculus
accaaggagttcaggaggacccgct

SEQ ID NO: 176046 - DNA, 25 bp, Mus musculus
accaaggataaggacaaagccaagg

SEQ ID NO: 176047 - DNA, 25 bp, Mus musculus
accaaggattcccaggtgctcctgg

SEQ ID NO: 176048 - DNA, 25 bp, Mus musculus
accaaggccagcttttcctagatga

SEQ ID NO: 176049 - DNA, 25 bp, Mus musculus
accaaggcgggcagacgtatgtttc

SEQ ID NO: 176050 - DNA, 25 bp, Mus musculus
accaaggctacactggggcttacag

SEQ ID NO: 176051 - DNA, 25 bp, Mus musculus
accaaggggcccagcaggtggagag

SEQ ID NO: 176052 - DNA, 25 bp, Mus musculus
accaaggtgagactctgctgctaaa

SEQ ID NO: 176053 - DNA, 25 bp, Mus musculus
accaagtcaaaaagattgataagta

SEQ ID NO: 176054 - DNA, 25 bp, Mus musculus
accaagtcagggaaggttttggtcg

SEQ ID NO: 176055 - DNA, 25 bp, Mus musculus
accaagtccagcaggaattgtctgg

SEQ ID NO: 176056 - DNA, 25 bp, Mus musculus
accaagtccatgaagccatgtatga

SEQ ID NO: 176057 - DNA, 25 bp, Mus musculus
accaagtccatgagtttaagatcca

SEQ ID NO: 176058 - DNA, 25 bp, Mus musculus
accaagtccatgattctgtaaccct

SEQ ID NO: 176059 - DNA, 25 bp, Mus musculus
accaagtccatgcaacagggagctg

SEQ ID NO: 176060 - DNA, 25 bp, Mus musculus
accaagtcgcagggagagtctcttc

SEQ ID NO: 176061 - DNA, 25 bp, Mus musculus
accaagtgagaaccttacccacagg

SEQ ID NO: 176062 - DNA, 25 bp, Mus musculus
accaagtgcaatgaaattgaatccc

SEQ ID NO: 176063 - DNA, 25 bp, Mus musculus
accaagtgcaccggaagatggacga

SEQ ID NO: 176064 - DNA, 25 bp, Mus musculus
accaagtgcaccggggtctgctgac

SEQ ID NO: 176065 - DNA, 25 bp, Mus musculus
accaagtggagaaaggtttccttct

SEQ ID NO: 176066 - DNA, 25 bp, Mus musculus
accaagtgtgacaaggtggtacagg

SEQ ID NO: 176067 - DNA, 25 bp, Mus musculus
accaagtgtgccgatcccgtgcatg

SEQ ID NO: 176068 - DNA, 25 bp, Mus musculus
accaagtgtgccggagccagtgtta

SEQ ID NO: 176069 - DNA, 25 bp, Mus musculus
accaagttacaggaggcagtgacat

SEQ ID NO: 176070 - DNA, 25 bp, Mus musculus
accaagttacaggaggcagtgacgt

SEQ ID NO: 176071 - DNA, 25 bp, Mus musculus
accaagttacaggaggcagtgactt

SEQ ID NO: 176072 - DNA, 25 bp, Mus musculus
accaagttacaggtctcctgtttct

SEQ ID NO: 176073 - DNA, 25 bp, Mus musculus
accaagttctcatgtctgcccagga

SEQ ID NO: 176074 - DNA, 25 bp, Mus musculus
accaataaaatggatcttcattgcc

SEQ ID NO: 176075 - DNA, 25 bp, Mus musculus
accaataaaattggtgttcccccag

SEQ ID NO: 176076 - DNA, 25 bp, Mus musculus
accaataaagcccacagaagctgtt

SEQ ID NO: 176077 - DNA, 25 bp, Mus musculus
accaataaaggcaaatcctcctcca

SEQ ID NO: 176078 - DNA, 25 bp, Mus musculus
accaataagagaagctggctgtata

SEQ ID NO: 176079 - DNA, 25 bp, Mus musculus
accaatagaccaagacaacaaaaca

SEQ ID NO: 176080 - DNA, 25 bp, Mus musculus
accaatagagggggctactgagtgg

SEQ ID NO: 176081 - DNA, 25 bp, Mus musculus
accaatagttcagacatcctacagg

SEQ ID NO: 176082 - DNA, 25 bp, Mus musculus
accaatattccaaaggatggaggcc

SEQ ID NO: 176083 - DNA, 25 bp, Mus musculus
accaatcaaagcaagctcatgttgg

SEQ ID NO: 176084 - DNA, 25 bp, Mus musculus
accaatcaaggctggcttcaaactc

SEQ ID NO: 176085 - DNA, 25 bp, Mus musculus
accaatcaagtcaccggaagaagat

SEQ ID NO: 176086 - DNA, 25 bp, Mus musculus
accaatcagcatagggatctgagaa

SEQ ID NO: 176087 - DNA, 25 bp, Mus musculus
accaatcaggatgtgatcaaggcag

SEQ ID NO: 176088 - DNA, 25 bp, Mus musculus
accaatcccagtgactctggacgtg

SEQ ID NO: 176089 - DNA, 25 bp, Mus musculus
accaatcgccactgtgttcacacga

SEQ ID NO: 176090 - DNA, 25 bp, Mus musculus
accaatctattaggcatcagaccat

SEQ ID NO: 176091 - DNA, 25 bp, Mus musculus
accaatctattagggaaagagatac

SEQ ID NO: 176092 - DNA, 25 bp, Mus musculus
accaatcttgatcgcagtaagagaa

SEQ ID NO: 176093 - DNA, 25 bp, Mus musculus
accaatgaaaacaggcccagaggaa

SEQ ID NO: 176094 - DNA, 25 bp, Mus musculus
accaatgaaaacagggcacctccgt

SEQ ID NO: 176095 - DNA, 25 bp, Mus musculus
accaatgaaaacctggatctgatgg

SEQ ID NO: 176096 - DNA, 25 bp, Mus musculus
accaatgaaaacctgtattttgagg

SEQ ID NO: 176097 - DNA, 25 bp, Mus musculus
accaatgaaaagggtgccttctcag

SEQ ID NO: 176098 - DNA, 25 bp, Mus musculus
accaatgaagacagttgattcagga

SEQ ID NO: 176099 - DNA, 25 bp, Mus musculus
accaatgacacagaggggctggctg

SEQ ID NO: 176100 - DNA, 25 bp, Mus musculus
accaatgacacagaggtggcggaga

SEQ ID NO: 176101 - DNA, 25 bp, Mus musculus
accaatgacccctatcctctctttg

SEQ ID NO: 176102 - DNA, 25 bp, Mus musculus
accaatgacctaggaaggcccagcc

SEQ ID NO: 176103 - DNA, 25 bp, Mus musculus
accaatgagaagatgagctcagcag

SEQ ID NO: 176104 - DNA, 25 bp, Mus musculus
accaatgagaagatgagtcgggata

SEQ ID NO: 176105 - DNA, 25 bp, Mus musculus
accaatggcctgatcacaactggct

SEQ ID NO: 176106 - DNA, 25 bp, Mus musculus
accaatggttgacaggcaataccct

SEQ ID NO: 176107 - DNA, 25 bp, Mus musculus
accaatgtagccaacccttcactga

SEQ ID NO: 176108 - DNA, 25 bp, Mus musculus
accaatgtatgcagggacgcatcgt

SEQ ID NO: 176109 - DNA, 25 bp, Mus musculus
accaatgtcaatcgctgcctcgagg

SEQ ID NO: 176110 - DNA, 25 bp, Mus musculus
accaatgtcaggttgaaaactgtaa

SEQ ID NO: 176111 - DNA, 25 bp, Mus musculus
accaatgtcagtgtgcgggatgaca

SEQ ID NO: 176112 - DNA, 25 bp, Mus musculus
accaatgtcctgatttcagagtggg

SEQ ID NO: 176113 - DNA, 25 bp, Mus musculus
accaatgtgaagatatcaatgaatg

SEQ ID NO: 176114 - DNA, 25 bp, Mus musculus
accaatgtgaagatattgatgaatg

SEQ ID NO: 176115 - DNA, 25 bp, Mus musculus
accaatgtgagatctggcgggagct

SEQ ID NO: 176116 - DNA, 25 bp, Mus musculus
accaatgtgagcacacagcatgtac

SEQ ID NO: 176117 - DNA, 25 bp, Mus musculus
accaatgtgcttacatgcatgtgta

SEQ ID NO: 176118 - DNA, 25 bp, Mus musculus
accaatgtgcttacgagtctactgt

SEQ ID NO: 176119 - DNA, 25 bp, Mus musculus
accaatgttgtgaagaacttcaagt

SEQ ID NO: 176120 - DNA, 25 bp, Mus musculus
accaatgttgtgaagctcttcaatg

SEQ ID NO: 176121 - DNA, 25 bp, Mus musculus
accaattacataagcccatggatgg

SEQ ID NO: 176122 - DNA, 25 bp, Mus musculus
accaattccttggaggactcaagga

SEQ ID NO: 176123 - DNA, 25 bp, Mus musculus
accaattccttggaggttcattctg

SEQ ID NO: 176124 - DNA, 25 bp, Mus musculus
accaatttaagctccagctccagat

SEQ ID NO: 176125 - DNA, 25 bp, Mus musculus
accaatttagtattcgcctgggaat

SEQ ID NO: 176126 - DNA, 25 bp, Mus musculus
accaatttgaaattgcagactgtgc

SEQ ID NO: 176127 - DNA, 25 bp, Mus musculus
accaattttaatgaatgcagctgcc

SEQ ID NO: 176128 - DNA, 25 bp, Mus musculus
accaatttttgtagtgccaggacat

SEQ ID NO: 176129 - DNA, 25 bp, Mus musculus
accacaaacgaagacatcaaaggct

SEQ ID NO: 176130 - DNA, 25 bp, Mus musculus
accacaaagaggaaatgcaggctct

SEQ ID NO: 176131 - DNA, 25 bp, Mus musculus
accacaacacaacaatcttgggata

SEQ ID NO: 176132 - DNA, 25 bp, Mus musculus
accacaaccacagactggaaccagc

SEQ ID NO: 176133 - DNA, 25 bp, Mus musculus
accacaaccagctaaagaacgcttc

SEQ ID NO: 176134 - DNA, 25 bp, Mus musculus
accacaaccagctgctgaaccgaat

SEQ ID NO: 176135 - DNA, 25 bp, Mus musculus
accacaagaagacccactccgagga

SEQ ID NO: 176136 - DNA, 25 bp, Mus musculus
accacaagaaggttgtggatcatta

SEQ ID NO: 176137 - DNA, 25 bp, Mus musculus
accacaagcaacgatgcctacttct

SEQ ID NO: 176138 - DNA, 25 bp, Mus musculus
accacaagcgactcgtcctcccacg

SEQ ID NO: 176139 - DNA, 25 bp, Mus musculus
accacaagcgagcctagaagaggag

SEQ ID NO: 176140 - DNA, 25 bp, Mus musculus
accacaagcgagctaatgtctgcga

SEQ ID NO: 176141 - DNA, 25 bp, Mus musculus
accacaagcgagttcacatgagact

SEQ ID NO: 176142 - DNA, 25 bp, Mus musculus
accacaaggagccagaactacagct

SEQ ID NO: 176143 - DNA, 25 bp, Mus musculus
accacaaggcgctacagcaacgttt

SEQ ID NO: 176144 - DNA, 25 bp, Mus musculus
accacaatctgcatgttaacaagcc

SEQ ID NO: 176145 - DNA, 25 bp, Mus musculus
accacaattatgcctctgatgaaga

SEQ ID NO: 176146 - DNA, 25 bp, Mus musculus
accacaattatggaatccccctacg

SEQ ID NO: 176147 - DNA, 25 bp, Mus musculus
accacaattttcaggatgacgatca

SEQ ID NO: 176148 - DNA, 25 bp, Mus musculus
accacacaagattccgcagggccat

SEQ ID NO: 176149 - DNA, 25 bp, Mus musculus
accacacaagggccatcaaaagtga

SEQ ID NO: 176150 - DNA, 25 bp, Mus musculus
accacacaaggtttgacggatgaaa

SEQ ID NO: 176151 - DNA, 25 bp, Mus musculus
accacacaatggcctccccttgctc

SEQ ID NO: 176152 - DNA, 25 bp, Mus musculus
accacacacccaaagagggctgtga

SEQ ID NO: 176153 - DNA, 25 bp, Mus musculus
accacacactgttcagacggctcca

SEQ ID NO: 176154 - DNA, 25 bp, Mus musculus
accacacagagacttgaaaatcgaa

SEQ ID NO: 176155 - DNA, 25 bp, Mus musculus
accacacagagtttatggttcactt

SEQ ID NO: 176156 - DNA, 25 bp, Mus musculus
accacacagcaatgtttgcagagac

SEQ ID NO: 176157 - DNA, 25 bp, Mus musculus
accacacagcggggagaaggttgct

SEQ ID NO: 176158 - DNA, 25 bp, Mus musculus
accacacagcggtcgctatgcattt

SEQ ID NO: 176159 - DNA, 25 bp, Mus musculus
accacacaggacgggccaaaagatg

SEQ ID NO: 176160 - DNA, 25 bp, Mus musculus
accacacaggacggtgtctttattg

SEQ ID NO: 176161 - DNA, 25 bp, Mus musculus
accacaccagcattcggaggggttt

SEQ ID NO: 176162 - DNA, 25 bp, Mus musculus
accacaccagttcctctaattcttt

SEQ ID NO: 176163 - DNA, 25 bp, Mus musculus
accacacccaatgaacttgttttta

SEQ ID NO: 176164 - DNA, 25 bp, Mus musculus
accacacccgagcagtatataaaga

SEQ ID NO: 176165 - DNA, 25 bp, Mus musculus
accacaccctacagaggaggaacct

SEQ ID NO: 176166 - DNA, 25 bp, Mus musculus
accacaccctacaggcaagattgag

SEQ ID NO: 176167 - DNA, 25 bp, Mus musculus
accacaccctgttcttgcttcagca

SEQ ID NO: 176168 - DNA, 25 bp, Mus musculus
accacacctcagcagggacctcttg

SEQ ID NO: 176169 - DNA, 25 bp, Mus musculus
accacacctgtctcctccttcacat

SEQ ID NO: 176170 - DNA, 25 bp, Mus musculus
accacacggatatggaagagggatt

SEQ ID NO: 176171 - DNA, 25 bp, Mus musculus
accacactctgacagattcacctgc

SEQ ID NO: 176172 - DNA, 25 bp, Mus musculus
accacactctgacagtgagggtgcg

SEQ ID NO: 176173 - DNA, 25 bp, Mus musculus
accacactgacacaatatggagtct

SEQ ID NO: 176174 - DNA, 25 bp, Mus musculus
accacagaagacagttgctcagaca

SEQ ID NO: 176175 - DNA, 25 bp, Mus musculus
accacagaaggccctgacccctccc

SEQ ID NO: 176176 - DNA, 25 bp, Mus musculus
accacagaaggtgcagacctctgac

SEQ ID NO: 176177 - DNA, 25 bp, Mus musculus
accacagaaggttatagaagctgcg

SEQ ID NO: 176178 - DNA, 25 bp, Mus musculus
accacagacaaggccaacatcaaag

SEQ ID NO: 176179 - DNA, 25 bp, Mus musculus
accacagacagatgccctttgaagc

SEQ ID NO: 176180 - DNA, 25 bp, Mus musculus
accacagacagcaaggcaaagatgc

SEQ ID NO: 176181 - DNA, 25 bp, Mus musculus
accacagactgcagttttcagatat

SEQ ID NO: 176182 - DNA, 25 bp, Mus musculus
accacagagactaaggcaattccag

SEQ ID NO: 176183 - DNA, 25 bp, Mus musculus
accacagagactaaggctgtgaaaa

SEQ ID NO: 176184 - DNA, 25 bp, Mus musculus
accacagagagttctccagatttgg

SEQ ID NO: 176185 - DNA, 25 bp, Mus musculus
accacagaggcctcaggatgactac

SEQ ID NO: 176186 - DNA, 25 bp, Mus musculus
accacagagggtggctgtctgccca

SEQ ID NO: 176187 - DNA, 25 bp, Mus musculus
accacagatgaagagcaagtacaga

SEQ ID NO: 176188 - DNA, 25 bp, Mus musculus
accacagatgaagatcttcaggatt

SEQ ID NO: 176189 - DNA, 25 bp, Mus musculus
accacagatgactacagctgtggag

SEQ ID NO: 176190 - DNA, 25 bp, Mus musculus
accacagatttattctgtgatgagg

SEQ ID NO: 176191 - DNA, 25 bp, Mus musculus
accacagatttcacctgggccactg

SEQ ID NO: 176192 - DNA, 25 bp, Mus musculus
accacagcaccaagatatcattaat

SEQ ID NO: 176193 - DNA, 25 bp, Mus musculus
accacagcaggcactacagactcga

SEQ ID NO: 176194 - DNA, 25 bp, Mus musculus
accacagccaactttccagatgtca

SEQ ID NO: 176195 - DNA, 25 bp, Mus musculus
accacagccgcttcggcattctgga

SEQ ID NO: 176196 - DNA, 25 bp, Mus musculus
accacagcgagggggcgctcctggg

SEQ ID NO: 176197 - DNA, 25 bp, Mus musculus
accacagcgtgctctcaatgaaggc

SEQ ID NO: 176198 - DNA, 25 bp, Mus musculus
accacagctgcagcaggagcaacca

SEQ ID NO: 176199 - DNA, 25 bp, Mus musculus
accacagctgcaggtaaaaataaat

SEQ ID NO: 176200 - DNA, 25 bp, Mus musculus
accacagctggcgaggtgttggcag

SEQ ID NO: 176201 - DNA, 25 bp, Mus musculus
accacagcttcacacagagaccctg

SEQ ID NO: 176202 - DNA, 25 bp, Mus musculus
accacaggaaaggggaatgtgactc

SEQ ID NO: 176203 - DNA, 25 bp, Mus musculus
accacaggatacaggattctcataa

SEQ ID NO: 176204 - DNA, 25 bp, Mus musculus
accacaggatacagggttatacagg

SEQ ID NO: 176205 - DNA, 25 bp, Mus musculus
accacaggctcctgagcgcagcctt

SEQ ID NO: 176206 - DNA, 25 bp, Mus musculus
accacaggctcctggccaggagcaa

SEQ ID NO: 176207 - DNA, 25 bp, Mus musculus
accacagggactaagcccacaggag

SEQ ID NO: 176208 - DNA, 25 bp, Mus musculus
accacagggatgttggatggaagaa

SEQ ID NO: 176209 - DNA, 25 bp, Mus musculus
accacagtaaggtcacgaagttggg

SEQ ID NO: 176210 - DNA, 25 bp, Mus musculus
accacagtaaggtgtaacacggcta

SEQ ID NO: 176211 - DNA, 25 bp, Mus musculus
accacagtcacatttacagactcct

SEQ ID NO: 176212 - DNA, 25 bp, Mus musculus
accacagtcaccgagagtgagcagc

SEQ ID NO: 176213 - DNA, 25 bp, Mus musculus
accacagtcactggacccaaagtca

SEQ ID NO: 176214 - DNA, 25 bp, Mus musculus
accacagtgactcatctgcccctcc

SEQ ID NO: 176215 - DNA, 25 bp, Mus musculus
accacagtttctgctgcagttctca

SEQ ID NO: 176216 - DNA, 25 bp, Mus musculus
accacatccactggtggagctgccc

SEQ ID NO: 176217 - DNA, 25 bp, Mus musculus
accacatccctccctccaaagctga

SEQ ID NO: 176218 - DNA, 25 bp, Mus musculus
accacatctgtcaaattatcacaca

SEQ ID NO: 176219 - DNA, 25 bp, Mus musculus
accacatgcagaatcacagcgaggt

SEQ ID NO: 176220 - DNA, 25 bp, Mus musculus
accacatgcaggagagattttgggc

SEQ ID NO: 176221 - DNA, 25 bp, Mus musculus
accacatggcaacaggtttatggtc

SEQ ID NO: 176222 - DNA, 25 bp, Mus musculus
accacatgttcactatgaggagaga

SEQ ID NO: 176223 - DNA, 25 bp, Mus musculus
accacattaggactctgttggtgtg

SEQ ID NO: 176224 - DNA, 25 bp, Mus musculus
accacattaggatctgaagtgaaaa

SEQ ID NO: 176225 - DNA, 25 bp, Mus musculus
accacattcccaagggcacaagtgt

SEQ ID NO: 176226 - DNA, 25 bp, Mus musculus
accacattgggtgggtgcaggagtt

SEQ ID NO: 176227 - DNA, 25 bp, Mus musculus
accacatttaaatgattatagatct

SEQ ID NO: 176228 - DNA, 25 bp, Mus musculus
accacatttaagtcagattatcgcc

SEQ ID NO: 176229 - DNA, 25 bp, Mus musculus
accacattttgctatgagcttggat

SEQ ID NO: 176230 - DNA, 25 bp, Mus musculus
accacattttggtgtgatggagtct

SEQ ID NO: 176231 - DNA, 25 bp, Mus musculus
accaccaaaggggagcgaggacagc

SEQ ID NO: 176232 - DNA, 25 bp, Mus musculus
accaccaaggaaaagttgtatggcg

SEQ ID NO: 176233 - DNA, 25 bp, Mus musculus
accaccaagggaacttaatacagaa

SEQ ID NO: 176234 - DNA, 25 bp, Mus musculus
accaccaatcaaggctggcttcaaa

SEQ ID NO: 176235 - DNA, 25 bp, Mus musculus
accaccaatcaagtcaccggaagaa

SEQ ID NO: 176236 - DNA, 25 bp, Mus musculus
accaccaatgtgagaggagagacgg

SEQ ID NO: 176237 - DNA, 25 bp, Mus musculus
accaccacacactgttcagacggct

SEQ ID NO: 176238 - DNA, 25 bp, Mus musculus
accaccacacaggccagacccatgg

SEQ ID NO: 176239 - DNA, 25 bp, Mus musculus
accaccacacccagtgttgggcaac

SEQ ID NO: 176240 - DNA, 25 bp, Mus musculus
accaccacagcaggcactacagact

SEQ ID NO: 176241 - DNA, 25 bp, Mus musculus
accaccaccaccacggcgacgacag

SEQ ID NO: 176242 - DNA, 25 bp, Mus musculus
accaccacgacgaaggaccccttct

SEQ ID NO: 176243 - DNA, 25 bp, Mus musculus
accaccacgggttggatcaggcctg

SEQ ID NO: 176244 - DNA, 25 bp, Mus musculus
accaccactagtgtgtcacatcaag

SEQ ID NO: 176245 - DNA, 25 bp, Mus musculus
accaccagagccctgcaggccctgg

SEQ ID NO: 176246 - DNA, 25 bp, Mus musculus
accaccagagcctgtactcctggac

SEQ ID NO: 176247 - DNA, 25 bp, Mus musculus
accaccagcagctgaacagaaaatg

SEQ ID NO: 176248 - DNA, 25 bp, Mus musculus
accaccagcagctgaagtccgcaca

SEQ ID NO: 176249 - DNA, 25 bp, Mus musculus
accaccagcagctgaatggttacca

SEQ ID NO: 176250 - DNA, 25 bp, Mus musculus
accaccaggaacagagagaacatta

SEQ ID NO: 176251 - DNA, 25 bp, Mus musculus
accaccaggaagggtgttaggagtg

SEQ ID NO: 176252 - DNA, 25 bp, Mus musculus
accaccaggcaagggttgcccttca

SEQ ID NO: 176253 - DNA, 25 bp, Mus musculus
accaccaggtgccacacggccatgg

SEQ ID NO: 176254 - DNA, 25 bp, Mus musculus
accaccataggatacgacttgatga

SEQ ID NO: 176255 - DNA, 25 bp, Mus musculus
accaccatatttgaaaatgctgtgg

SEQ ID NO: 176256 - DNA, 25 bp, Mus musculus
accaccatatttgaatcatttccac

SEQ ID NO: 176257 - DNA, 25 bp, Mus musculus
accaccatatttgacgcggaaaagg

SEQ ID NO: 176258 - DNA, 25 bp, Mus musculus
accaccatcggctatggtcatgcgg

SEQ ID NO: 176259 - DNA, 25 bp, Mus musculus
accaccatgagagacttccagacag

SEQ ID NO: 176260 - DNA, 25 bp, Mus musculus
accaccatgatattggaccatgtgt

SEQ ID NO: 176261 - DNA, 25 bp, Mus musculus
accaccatggagaacaagcattgat

SEQ ID NO: 176262 - DNA, 25 bp, Mus musculus
accacccaagattcagtttgctgac

SEQ ID NO: 176263 - DNA, 25 bp, Mus musculus
accacccagctgtggctgcgaccct

SEQ ID NO: 176264 - DNA, 25 bp, Mus musculus
accaccccacaaacctgacgagatg

SEQ ID NO: 176265 - DNA, 25 bp, Mus musculus
accaccccaggcccagagtctactc

SEQ ID NO: 176266 - DNA, 25 bp, Mus musculus
accacccccacccgagttctatcca

SEQ ID NO: 176267 - DNA, 25 bp, Mus musculus
accacccccacgacccactgatgtt

SEQ ID NO: 176268 - DNA, 25 bp, Mus musculus
accacccccggaaggtatcatccgg

SEQ ID NO: 176269 - DNA, 25 bp, Mus musculus
accaccccctcccagagctctcttc

SEQ ID NO: 176270 - DNA, 25 bp, Mus musculus
accaccccttcaggcagagagccag

SEQ ID NO: 176271 - DNA, 25 bp, Mus musculus
accaccccttgggggctcgctccca

SEQ ID NO: 176272 - DNA, 25 bp, Mus musculus
accaccctctgggcatggctatctt

SEQ ID NO: 176273 - DNA, 25 bp, Mus musculus
accacccttggtgaaggcagctaca

SEQ ID NO: 176274 - DNA, 25 bp, Mus musculus
accaccgacatggtaaagaacttgt

SEQ ID NO: 176275 - DNA, 25 bp, Mus musculus
accaccgaccaggcagccacctgga

SEQ ID NO: 176276 - DNA, 25 bp, Mus musculus
accaccgaccaggtcgtccgtactg

SEQ ID NO: 176277 - DNA, 25 bp, Mus musculus
accaccgccactggcataaatgcag

SEQ ID NO: 176278 - DNA, 25 bp, Mus musculus
accaccgcggccgtgcagttggaat

SEQ ID NO: 176279 - DNA, 25 bp, Mus musculus
accaccgcgtaggatctttctcaag

SEQ ID NO: 176280 - DNA, 25 bp, Mus musculus
accaccgctcaacgaaacggaaggt

SEQ ID NO: 176281 - DNA, 25 bp, Mus musculus
accaccgctgacgatgcagatcttt

SEQ ID NO: 176282 - DNA, 25 bp, Mus musculus
accaccgctggatgcagatctttgt

SEQ ID NO: 176283 - DNA, 25 bp, Mus musculus
accaccgggtcaaacagaggacagt

SEQ ID NO: 176284 - DNA, 25 bp, Mus musculus
accaccgtggtacagcgccccggga

SEQ ID NO: 176285 - DNA, 25 bp, Mus musculus
accacctacaaccataggtacttcg

SEQ ID NO: 176286 - DNA, 25 bp, Mus musculus
accacctcaggagtgaagcgtgtcc

SEQ ID NO: 176287 - DNA, 25 bp, Mus musculus
accacctccaaacagaagctccctg

SEQ ID NO: 176288 - DNA, 25 bp, Mus musculus
accacctccaaacagtgaaggtgag

SEQ ID NO: 176289 - DNA, 25 bp, Mus musculus
accacctccaagaagccaaatctta

SEQ ID NO: 176290 - DNA, 25 bp, Mus musculus
accacctccattttggattcgtaaa

SEQ ID NO: 176291 - DNA, 25 bp, Mus musculus
accacctcccaagattccactttga

SEQ ID NO: 176292 - DNA, 25 bp, Mus musculus
accacctcctgctggggtagacagc

SEQ ID NO: 176293 - DNA, 25 bp, Mus musculus
accacctccttcctggcattggagg

SEQ ID NO: 176294 - DNA, 25 bp, Mus musculus
accacctcggcctctccatccgttc

SEQ ID NO: 176295 - DNA, 25 bp, Mus musculus
accacctctagaggcctataccatt

SEQ ID NO: 176296 - DNA, 25 bp, Mus musculus
accacctctagagttgaccaagctg

SEQ ID NO: 176297 - DNA, 25 bp, Mus musculus
accacctggacaggtcggaagctgg

SEQ ID NO: 176298 - DNA, 25 bp, Mus musculus
accacctggagagcatcttcctggt

SEQ ID NO: 176299 - DNA, 25 bp, Mus musculus
accacctggcaagagaaatgtctca

SEQ ID NO: 176300 - DNA, 25 bp, Mus musculus
accacctggcgctcgagcacgggtc

SEQ ID NO: 176301 - DNA, 25 bp, Mus musculus
accacctgtagcaccactctcgctc

SEQ ID NO: 176302 - DNA, 25 bp, Mus musculus
accacctgtagcacccctctactca

SEQ ID NO: 176303 - DNA, 25 bp, Mus musculus
accacctgtggtggactggtgatag

SEQ ID NO: 176304 - DNA, 25 bp, Mus musculus
accacctgttccagaagttggcatc

SEQ ID NO: 176305 - DNA, 25 bp, Mus musculus
accacctgttgtgcagagttgtctt

SEQ ID NO: 176306 - DNA, 25 bp, Mus musculus
accaccttcctcctggcaggccaaa

SEQ ID NO: 176307 - DNA, 25 bp, Mus musculus
accaccttctacaattcccagcgac

SEQ ID NO: 176308 - DNA, 25 bp, Mus musculus
accaccttggagaagataaaaatat

SEQ ID NO: 176309 - DNA, 25 bp, Mus musculus
accacctttgatgagatatgtgtca

SEQ ID NO: 176310 - DNA, 25 bp, Mus musculus
accacgaaaatctccttcgggctga

SEQ ID NO: 176311 - DNA, 25 bp, Mus musculus
accacgaagaggaaatgcaggctct

SEQ ID NO: 176312 - DNA, 25 bp, Mus musculus
accacgacgaaggaccccttctcct

SEQ ID NO: 176313 - DNA, 25 bp, Mus musculus
accacgagcagataagaggagtcct

SEQ ID NO: 176314 - DNA, 25 bp, Mus musculus
accacgagcagcccgaggagctcac

SEQ ID NO: 176315 - DNA, 25 bp, Mus musculus
accacgagcagttgttccaagttgc

SEQ ID NO: 176316 - DNA, 25 bp, Mus musculus
accacgaggagctgaaggaccagcc

SEQ ID NO: 176317 - DNA, 25 bp, Mus musculus
accacgaggaggaaatgcaggctct

SEQ ID NO: 176318 - DNA, 25 bp, Mus musculus
accacgaggaggaaatggcctccat

SEQ ID NO: 176319 - DNA, 25 bp, Mus musculus
accacgaggaggtggccaccaacag

SEQ ID NO: 176320 - DNA, 25 bp, Mus musculus
accacgaggccagatacctgactgt

SEQ ID NO: 176321 - DNA, 25 bp, Mus musculus
accacgcagaggaaagatggtccag

SEQ ID NO: 176322 - DNA, 25 bp, Mus musculus
accacgcagagggaaggtgtgaacc

SEQ ID NO: 176323 - DNA, 25 bp, Mus musculus
accacgcccttccaggtgactggtt

SEQ ID NO: 176324 - DNA, 25 bp, Mus musculus
accacgcctgacattatcctggatg

SEQ ID NO: 176325 - DNA, 25 bp, Mus musculus
accacgctccagaggctttgctgac

SEQ ID NO: 176326 - DNA, 25 bp, Mus musculus
accacgctccagagtgtgcactctc

SEQ ID NO: 176327 - DNA, 25 bp, Mus musculus
accacgctctcaaggccgagtacaa

SEQ ID NO: 176328 - DNA, 25 bp, Mus musculus
accacgctctcaaggtatagtccta

SEQ ID NO: 176329 - DNA, 25 bp, Mus musculus
accacgctgcagcaccacaaagatg

SEQ ID NO: 176330 - DNA, 25 bp, Mus musculus
accacgctggccagacagctgcagc

SEQ ID NO: 176331 - DNA, 25 bp, Mus musculus
accacgctggccagataaggctagc

SEQ ID NO: 176332 - DNA, 25 bp, Mus musculus
accacgctggccagctgcctcaccc

SEQ ID NO: 176333 - DNA, 25 bp, Mus musculus
accacgctggccaggtattgttaga

SEQ ID NO: 176334 - DNA, 25 bp, Mus musculus
accacgcttggaaagcaaatgcaat

SEQ ID NO: 176335 - DNA, 25 bp, Mus musculus
accacgcttggaaagttgtccagtc

SEQ ID NO: 176336 - DNA, 25 bp, Mus musculus
accacggaaccaaggtggctatggc

SEQ ID NO: 176337 - DNA, 25 bp, Mus musculus
accacggagattagcggagccaggt

SEQ ID NO: 176338 - DNA, 25 bp, Mus musculus
accacggatacttgtaagcggtaac

SEQ ID NO: 176339 - DNA, 25 bp, Mus musculus
accacggcatgcagaggaatctggg

SEQ ID NO: 176340 - DNA, 25 bp, Mus musculus
accacggcatgcagggtgtgtctgc

SEQ ID NO: 176341 - DNA, 25 bp, Mus musculus
accacggtctggaggtcctgggcct

SEQ ID NO: 176342 - DNA, 25 bp, Mus musculus
accacgtagagagttccctcagtac

SEQ ID NO: 176343 - DNA, 25 bp, Mus musculus
accacgtcacctctcacatctccaa

SEQ ID NO: 176344 - DNA, 25 bp, Mus musculus
accacgtcagtcctcgttgccattc

SEQ ID NO: 176345 - DNA, 25 bp, Mus musculus
accacgtcggctcagctggacagag

SEQ ID NO: 176346 - DNA, 25 bp, Mus musculus
accacgtgaggaacaaagacaaagc

SEQ ID NO: 176347 - DNA, 25 bp, Mus musculus
accacgtgctgggcctggccaggag

SEQ ID NO: 176348 - DNA, 25 bp, Mus musculus
accacgtggttcagacagctgtcat

SEQ ID NO: 176349 - DNA, 25 bp, Mus musculus
accacgtggttcagggtctggagac

SEQ ID NO: 176350 - DNA, 25 bp, Mus musculus
accactaaacgattggtgacccaga

SEQ ID NO: 176351 - DNA, 25 bp, Mus musculus
accactacacccagctgccctcacc

SEQ ID NO: 176352 - DNA, 25 bp, Mus musculus
accactaccagaatgttgaccccaa

SEQ ID NO: 176353 - DNA, 25 bp, Mus musculus
accactacgcaggaggattacaacc

SEQ ID NO: 176354 - DNA, 25 bp, Mus musculus
accactacgcagttaccgtgacggt

SEQ ID NO: 176355 - DNA, 25 bp, Mus musculus
accactactcacctggttcaaccag

SEQ ID NO: 176356 - DNA, 25 bp, Mus musculus
accactagtcgataaggttgaaaga

SEQ ID NO: 176357 - DNA, 25 bp, Mus musculus
accactagtgtgtcacatcaagttg

SEQ ID NO: 176358 - DNA, 25 bp, Mus musculus
accactcaagcccatcgtttctgaa

SEQ ID NO: 176359 - DNA, 25 bp, Mus musculus
accactcaaggcaccacaatgggag

SEQ ID NO: 176360 - DNA, 25 bp, Mus musculus
accactcagctgctgcgctgcccca

SEQ ID NO: 176361 - DNA, 25 bp, Mus musculus
accactcaggaccctggaaccctca

SEQ ID NO: 176362 - DNA, 25 bp, Mus musculus
accactcatatgatacagatttcaa

SEQ ID NO: 176363 - DNA, 25 bp, Mus musculus
accactcatatgatttcaaccagtt

SEQ ID NO: 176364 - DNA, 25 bp, Mus musculus
accactccatggattgccggaactt

SEQ ID NO: 176365 - DNA, 25 bp, Mus musculus
accactccctaggtgttgggagccc

SEQ ID NO: 176366 - DNA, 25 bp, Mus musculus
accactcctctggatcccagagtgc

SEQ ID NO: 176367 - DNA, 25 bp, Mus musculus
accactcgaccaggttctgggctga

SEQ ID NO: 176368 - DNA, 25 bp, Mus musculus
accactcgcagaggaccgccttcaa

SEQ ID NO: 176369 - DNA, 25 bp, Mus musculus
accactctcgggaagttattggaga

SEQ ID NO: 176370 - DNA, 25 bp, Mus musculus
accactcttgtaaagtaccagtgct

SEQ ID NO: 176371 - DNA, 25 bp, Mus musculus
accactcttgtaaagttacaagccc

SEQ ID NO: 176372 - DNA, 25 bp, Mus musculus
accactgatgagagaggtcctccgg

SEQ ID NO: 176373 - DNA, 25 bp, Mus musculus
accactgcaaggtgctgagacgtga

SEQ ID NO: 176374 - DNA, 25 bp, Mus musculus
accactgcagcagatccacagatga

SEQ ID NO: 176375 - DNA, 25 bp, Mus musculus
accactgcaggatttctggcaccag

SEQ ID NO: 176376 - DNA, 25 bp, Mus musculus
accactgcagtctctctctccagcc

SEQ ID NO: 176377 - DNA, 25 bp, Mus musculus
accactgcagtgtttgtaagcggtg

SEQ ID NO: 176378 - DNA, 25 bp, Mus musculus
accactgcccagattttcactgtaa

SEQ ID NO: 176379 - DNA, 25 bp, Mus musculus
accactgcggcaagtttgatggtga

SEQ ID NO: 176380 - DNA, 25 bp, Mus musculus
accactgctaagatttgaattctgt

SEQ ID NO: 176381 - DNA, 25 bp, Mus musculus
accactgctacagctgctcctacac

SEQ ID NO: 176382 - DNA, 25 bp, Mus musculus
accactgctgcgcaaggtatacctg

SEQ ID NO: 176383 - DNA, 25 bp, Mus musculus
accactgctgtgagtgcccgctatg

SEQ ID NO: 176384 - DNA, 25 bp, Mus musculus
accactggactgcatggtctgagac

SEQ ID NO: 176385 - DNA, 25 bp, Mus musculus
accactggcaagatgtgctagttgg

SEQ ID NO: 176386 - DNA, 25 bp, Mus musculus
accactggcaaggctggtacaagga

SEQ ID NO: 176387 - DNA, 25 bp, Mus musculus
accactggcacaggagacactgcag

SEQ ID NO: 176388 - DNA, 25 bp, Mus musculus
accactggctatgaggacgtagcaa

SEQ ID NO: 176389 - DNA, 25 bp, Mus musculus
accactgggacgcggccatccatgg

SEQ ID NO: 176390 - DNA, 25 bp, Mus musculus
accactgggacgcgttctgtggatc

SEQ ID NO: 176391 - DNA, 25 bp, Mus musculus
accactggtgcgaacaaagtctccc

SEQ ID NO: 176392 - DNA, 25 bp, Mus musculus
accactggttgagatcctctttagg

SEQ ID NO: 176393 - DNA, 25 bp, Mus musculus
accactggttgagggcaatggcatc

SEQ ID NO: 176394 - DNA, 25 bp, Mus musculus
accactgtatcaaacgctacctggg

SEQ ID NO: 176395 - DNA, 25 bp, Mus musculus
accactgtatcaaaggctacctggg

SEQ ID NO: 176396 - DNA, 25 bp, Mus musculus
accactgtccgccgggagcagcaac

SEQ ID NO: 176397 - DNA, 25 bp, Mus musculus
accactgtgaggatatcaatgaatg

SEQ ID NO: 176398 - DNA, 25 bp, Mus musculus
accactgtggattacgctcgatttg

SEQ ID NO: 176399 - DNA, 25 bp, Mus musculus
accactgtgtcaggtgtggcccata

SEQ ID NO: 176400 - DNA, 25 bp, Mus musculus
accactgtgtgtctgcctcgtgcct

SEQ ID NO: 176401 - DNA, 25 bp, Mus musculus
accactgttctgcaggcttgcgaga

SEQ ID NO: 176402 - DNA, 25 bp, Mus musculus
accacttaggaggcacatagacatt

SEQ ID NO: 176403 - DNA, 25 bp, Mus musculus
accacttcaacaggactcatttcac

SEQ ID NO: 176404 - DNA, 25 bp, Mus musculus
accacttcgtggaggtcctggtggc

SEQ ID NO: 176405 - DNA, 25 bp, Mus musculus
accacttctcacccggaaaatgact

SEQ ID NO: 176406 - DNA, 25 bp, Mus musculus
accacttgcagacaaatgaattcct

SEQ ID NO: 176407 - DNA, 25 bp, Mus musculus
accacttgccatgcataatcttggt

SEQ ID NO: 176408 - DNA, 25 bp, Mus musculus
accacttgcgaaggggcttcgcctc

SEQ ID NO: 176409 - DNA, 25 bp, Mus musculus
accacttggctatgggagaggagag

SEQ ID NO: 176410 - DNA, 25 bp, Mus musculus
accacttggctatgggggcggggcc

SEQ ID NO: 176411 - DNA, 25 bp, Mus musculus
accacttgtgccggtcccgcctggc

SEQ ID NO: 176412 - DNA, 25 bp, Mus musculus
accactttgaccggaagaagacggg

SEQ ID NO: 176413 - DNA, 25 bp, Mus musculus
accactttgaccgggatcactccgg

SEQ ID NO: 176414 - DNA, 25 bp, Mus musculus
accacttttgatcttgattctgatt

SEQ ID NO: 176415 - DNA, 25 bp, Mus musculus
accagaaacggatgggctgtatggg

SEQ ID NO: 176416 - DNA, 25 bp, Mus musculus
accagaaactatggtggccctgtta

SEQ ID NO: 176417 - DNA, 25 bp, Mus musculus
accagaaagatacctcagaatacat

SEQ ID NO: 176418 - DNA, 25 bp, Mus musculus
accagaaagatatactgcaggcaaa

SEQ ID NO: 176419 - DNA, 25 bp, Mus musculus
accagaaagatctgcatccaaagac

SEQ ID NO: 176420 - DNA, 25 bp, Mus musculus
accagaaataggagcagttgacctt

SEQ ID NO: 176421 - DNA, 25 bp, Mus musculus
accagaacaatcgattggaagaatt

SEQ ID NO: 176422 - DNA, 25 bp, Mus musculus
accagaacaatcgggaacagactgc

SEQ ID NO: 176423 - DNA, 25 bp, Mus musculus
accagaaccaactgataaccaagct

SEQ ID NO: 176424 - DNA, 25 bp, Mus musculus
accagaaccaactggagagacttcc

SEQ ID NO: 176425 - DNA, 25 bp, Mus musculus
accagaaccaccacctggggccagg

SEQ ID NO: 176426 - DNA, 25 bp, Mus musculus
accagaaccaggttatgtagtaaca

SEQ ID NO: 176427 - DNA, 25 bp, Mus musculus
accagaactaaagggcttgttgtca

SEQ ID NO: 176428 - DNA, 25 bp, Mus musculus
accagaacttctcagacaattgaca

SEQ ID NO: 176429 - DNA, 25 bp, Mus musculus
accagaagaaagagtgtgaggagat

SEQ ID NO: 176430 - DNA, 25 bp, Mus musculus
accagaagacagtgatggcgactgg

SEQ ID NO: 176431 - DNA, 25 bp, Mus musculus
accagaagacagttgccctctatac

SEQ ID NO: 176432 - DNA, 25 bp, Mus musculus
accagaagacctcatcgggaaccag

SEQ ID NO: 176433 - DNA, 25 bp, Mus musculus
accagaagagatcctggctaagaat

SEQ ID NO: 176434 - DNA, 25 bp, Mus musculus
accagaagcagccaggcttctcttc

SEQ ID NO: 176435 - DNA, 25 bp, Mus musculus
accagaagcagccatggaccctctc

SEQ ID NO: 176436 - DNA, 25 bp, Mus musculus
accagaagcagctggtgaatgagca

SEQ ID NO: 176437 - DNA, 25 bp, Mus musculus
accagaagcagggaaaaggctctag

SEQ ID NO: 176438 - DNA, 25 bp, Mus musculus
accagaagcagtgcgatgactttgt

SEQ ID NO: 176439 - DNA, 25 bp, Mus musculus
accagaagctaggacctacagacta

SEQ ID NO: 176440 - DNA, 25 bp, Mus musculus
accagaagctggaatcctttctgcc

SEQ ID NO: 176441 - DNA, 25 bp, Mus musculus
accagaaggaccagctaaccctgag

SEQ ID NO: 176442 - DNA, 25 bp, Mus musculus
accagaagtcctcagggctgaactg

SEQ ID NO: 176443 - DNA, 25 bp, Mus musculus
accagaagtgcctgacagaggaggg

SEQ ID NO: 176444 - DNA, 25 bp, Mus musculus
accagaagtgcctgctcttgctccc

SEQ ID NO: 176445 - DNA, 25 bp, Mus musculus
accagaataaccaggtgaggaaaac

SEQ ID NO: 176446 - DNA, 25 bp, Mus musculus
accagaatcaagttccttacagatg

SEQ ID NO: 176447 - DNA, 25 bp, Mus musculus
accagaatcagaacattgtccttag

SEQ ID NO: 176448 - DNA, 25 bp, Mus musculus
accagaatcagagctgatcataagc

SEQ ID NO: 176449 - DNA, 25 bp, Mus musculus
accagaatccagtatctcttgctcc

SEQ ID NO: 176450 - DNA, 25 bp, Mus musculus
accagaatccagtttcagatacacc

SEQ ID NO: 176451 - DNA, 25 bp, Mus musculus
accagaatctggatggctatggtca

SEQ ID NO: 176452 - DNA, 25 bp, Mus musculus
accagaatgaggatcccagaaagct

SEQ ID NO: 176453 - DNA, 25 bp, Mus musculus
accagaattgtggagattgaagaag

SEQ ID NO: 176454 - DNA, 25 bp, Mus musculus
accagaattgtggaggttgacgttg

SEQ ID NO: 176455 - DNA, 25 bp, Mus musculus
accagaattgttgtttattcatggt

SEQ ID NO: 176456 - DNA, 25 bp, Mus musculus
accagacaaagacatggaccctacc

SEQ ID NO: 176457 - DNA, 25 bp, Mus musculus
accagacaaagccgaccctttccgt

SEQ ID NO: 176458 - DNA, 25 bp, Mus musculus
accagacaagatgatagtagctgat

SEQ ID NO: 176459 - DNA, 25 bp, Mus musculus
accagacacagcacctgcagtggct

SEQ ID NO: 176460 - DNA, 25 bp, Mus musculus
accagacactaatctgaccccagtg

SEQ ID NO: 176461 - DNA, 25 bp, Mus musculus
accagacactgcacaagggcaccac

SEQ ID NO: 176462 - DNA, 25 bp, Mus musculus
accagacattgaggcaccacctacc

SEQ ID NO: 176463 - DNA, 25 bp, Mus musculus
accagaccagtatcacagagcagca

SEQ ID NO: 176464 - DNA, 25 bp, Mus musculus
accagaccagtcgtgttgaggagac

SEQ ID NO: 176465 - DNA, 25 bp, Mus musculus
accagaccccaggtatgcgagacca

SEQ ID NO: 176466 - DNA, 25 bp, Mus musculus
accagaccccaggttccagtgcccc

SEQ ID NO: 176467 - DNA, 25 bp, Mus musculus
accagacctacgataaccacttccg

SEQ ID NO: 176468 - DNA, 25 bp, Mus musculus
accagacctgccccaggatccggtt

SEQ ID NO: 176469 - DNA, 25 bp, Mus musculus
accagactgagatggaccacacagc

SEQ ID NO: 176470 - DNA, 25 bp, Mus musculus
accagactgaggaacctgagaagaa

SEQ ID NO: 176471 - DNA, 25 bp, Mus musculus
accagactgaggctgtgtttcaaat

SEQ ID NO: 176472 - DNA, 25 bp, Mus musculus
accagacttcccagagaatgttgct

SEQ ID NO: 176473 - DNA, 25 bp, Mus musculus
accagagaaaaatggaatctctacg

SEQ ID NO: 176474 - DNA, 25 bp, Mus musculus
accagagaacatggatgtcagcaat

SEQ ID NO: 176475 - DNA, 25 bp, Mus musculus
accagagaatagccatgatgctggc

SEQ ID NO: 176476 - DNA, 25 bp, Mus musculus
accagagaatgtgcccacagaccat

SEQ ID NO: 176477 - DNA, 25 bp, Mus musculus
accagagacaaggtccactgggcag

SEQ ID NO: 176478 - DNA, 25 bp, Mus musculus
accagagagctatcattgaggcgga

SEQ ID NO: 176479 - DNA, 25 bp, Mus musculus
accagagagctgtcattgaggcgga

SEQ ID NO: 176480 - DNA, 25 bp, Mus musculus
accagagaggacctgagctgtccca

SEQ ID NO: 176481 - DNA, 25 bp, Mus musculus
accagagagggtccgggccatcagg

SEQ ID NO: 176482 - DNA, 25 bp, Mus musculus
accagagatagagacaaaagactgt

SEQ ID NO: 176483 - DNA, 25 bp, Mus musculus
accagagcaaattcagaaatggatt

SEQ ID NO: 176484 - DNA, 25 bp, Mus musculus
accagagcaaccggtgaaaaaagcc

SEQ ID NO: 176485 - DNA, 25 bp, Mus musculus
accagagcaaccgtcaagtaaacaa

SEQ ID NO: 176486 - DNA, 25 bp, Mus musculus
accagagcaaccgtttctatggcgt

SEQ ID NO: 176487 - DNA, 25 bp, Mus musculus
accagagcaagaaaattgtgcaagc

SEQ ID NO: 176488 - DNA, 25 bp, Mus musculus
accagagcaagatatggcgtgatca

SEQ ID NO: 176489 - DNA, 25 bp, Mus musculus
accagagcaagggcgattccccaaa

SEQ ID NO: 176490 - DNA, 25 bp, Mus musculus
accagagcaaggtatggcgtgatca

SEQ ID NO: 176491 - DNA, 25 bp, Mus musculus
accagagcagcgtcatctccgaacc

SEQ ID NO: 176492 - DNA, 25 bp, Mus musculus
accagagcagttaagctaccttaag

SEQ ID NO: 176493 - DNA, 25 bp, Mus musculus
accagagccatgagggatcttaaag

SEQ ID NO: 176494 - DNA, 25 bp, Mus musculus
accagagccatgcggtgctcttagc

SEQ ID NO: 176495 - DNA, 25 bp, Mus musculus
accagagccatgtagaaccaggccc

SEQ ID NO: 176496 - DNA, 25 bp, Mus musculus
accagagccatgtggaaccaggccc

SEQ ID NO: 176497 - DNA, 25 bp, Mus musculus
accagagcctggcagaagatgagtt

SEQ ID NO: 176498 - DNA, 25 bp, Mus musculus
accagagcctgggtcatacttccat

SEQ ID NO: 176499 - DNA, 25 bp, Mus musculus
accagagcgatgtgtggtcttttgg

SEQ ID NO: 176500 - DNA, 25 bp, Mus musculus
accagagctgccccggttcagaaac

SEQ ID NO: 176501 - DNA, 25 bp, Mus musculus
accagaggaagtgggtagaggaact

SEQ ID NO: 176502 - DNA, 25 bp, Mus musculus
accagaggactaacactgtgtccgt

SEQ ID NO: 176503 - DNA, 25 bp, Mus musculus
accagaggagattggattccagatt

SEQ ID NO: 176504 - DNA, 25 bp, Mus musculus
accagaggcagagtgaagaaatcga

SEQ ID NO: 176505 - DNA, 25 bp, Mus musculus
accagagggaactggtggaaactga

SEQ ID NO: 176506 - DNA, 25 bp, Mus musculus
accagaggtggtggaatgatgcgtg

SEQ ID NO: 176507 - DNA, 25 bp, Mus musculus
accagagtcagaaaaatataactgt

SEQ ID NO: 176508 - DNA, 25 bp, Mus musculus
accagatagagctggagctggccac

SEQ ID NO: 176509 - DNA, 25 bp, Mus musculus
accagatagaggctgatcttaaatt

SEQ ID NO: 176510 - DNA, 25 bp, Mus musculus
accagatagaggtctccctgtgtat

SEQ ID NO: 176511 - DNA, 25 bp, Mus musculus
accagatatcagaatggtcatttat

SEQ ID NO: 176512 - DNA, 25 bp, Mus musculus
accagatcaaggtggttgaagatgg

SEQ ID NO: 176513 - DNA, 25 bp, Mus musculus
accagatcagaaaccagtaaagtgg

SEQ ID NO: 176514 - DNA, 25 bp, Mus musculus
accagatcagaagaacagtctatcc

SEQ ID NO: 176515 - DNA, 25 bp, Mus musculus
accagatcagaagaccaggaaccca

SEQ ID NO: 176516 - DNA, 25 bp, Mus musculus
accagatcagaagagctctgcaggt

SEQ ID NO: 176517 - DNA, 25 bp, Mus musculus
accagatcagaatttcagcatatgt

SEQ ID NO: 176518 - DNA, 25 bp, Mus musculus
accagatcagctcaaggcaaggatg

SEQ ID NO: 176519 - DNA, 25 bp, Mus musculus
accagatctcaaaggaaaaccagtg

SEQ ID NO: 176520 - DNA, 25 bp, Mus musculus
accagatgacagcaacttcaaagct

SEQ ID NO: 176521 - DNA, 25 bp, Mus musculus
accagatgagcacgctaacatccac

SEQ ID NO: 176522 - DNA, 25 bp, Mus musculus
accagatgagcaggctaacatccac

SEQ ID NO: 176523 - DNA, 25 bp, Mus musculus
accagatgcaaagttctgctttcac

SEQ ID NO: 176524 - DNA, 25 bp, Mus musculus
accagatgcagcatccctggagctg

SEQ ID NO: 176525 - DNA, 25 bp, Mus musculus
accagatgcaggagagaagatgggg

SEQ ID NO: 176526 - DNA, 25 bp, Mus musculus
accagatgcagtgttgtggtcctca

SEQ ID NO: 176527 - DNA, 25 bp, Mus musculus
accagatgccagcatgttgatgaat

SEQ ID NO: 176528 - DNA, 25 bp, Mus musculus
accagatgccaggatgttgatgaat

SEQ ID NO: 176529 - DNA, 25 bp, Mus musculus
accagatgcggtggtagcaaaggaa

SEQ ID NO: 176530 - DNA, 25 bp, Mus musculus
accagatggcccaggtacttcaatt

SEQ ID NO: 176531 - DNA, 25 bp, Mus musculus
accagatgggcaagggtgaggaggg

SEQ ID NO: 176532 - DNA, 25 bp, Mus musculus
accagatgggcaaggtatcaatcta

SEQ ID NO: 176533 - DNA, 25 bp, Mus musculus
accagatgtgtcggtgtcccgatgc

SEQ ID NO: 176534 - DNA, 25 bp, Mus musculus
accagatgtgtcgtaacatatcgca

SEQ ID NO: 176535 - DNA, 25 bp, Mus musculus
accagatgttcagccagtatccgcc

SEQ ID NO: 176536 - DNA, 25 bp, Mus musculus
accagattgccgacttcaaggaggc

SEQ ID NO: 176537 - DNA, 25 bp, Mus musculus
accagattgccgatcgagttctcta

SEQ ID NO: 176538 - DNA, 25 bp, Mus musculus
accagcaaaaaatgctatcagaagg

SEQ ID NO: 176539 - DNA, 25 bp, Mus musculus
accagcaaactgcctactcgcccag

SEQ ID NO: 176540 - DNA, 25 bp, Mus musculus
accagcaaactgcggggactgaagc

SEQ ID NO: 176541 - DNA, 25 bp, Mus musculus
accagcaaactggcaccgacagccc

SEQ ID NO: 176542 - DNA, 25 bp, Mus musculus
accagcaaagaaaaaatggcgtcat

SEQ ID NO: 176543 - DNA, 25 bp, Mus musculus
accagcaaagccaaacccatgcgta

SEQ ID NO: 176544 - DNA, 25 bp, Mus musculus
accagcaaaggaagtggggataaat

SEQ ID NO: 176545 - DNA, 25 bp, Mus musculus
accagcaaaggtcctttccagtctc

SEQ ID NO: 176546 - DNA, 25 bp, Mus musculus
accagcaaatctcactggaagctcc

SEQ ID NO: 176547 - DNA, 25 bp, Mus musculus
accagcaaatgagggcgaacagcta

SEQ ID NO: 176548 - DNA, 25 bp, Mus musculus
accagcaacaacaggtgactgtggt

SEQ ID NO: 176549 - DNA, 25 bp, Mus musculus
accagcaacagctcctgaggaagcg

SEQ ID NO: 176550 - DNA, 25 bp, Mus musculus
accagcacagcaaagcgccaggctc

SEQ ID NO: 176551 - DNA, 25 bp, Mus musculus
accagcaccggcgcgtaagcaatgg

SEQ ID NO: 176552 - DNA, 25 bp, Mus musculus
accagcacgacttggctctgctgcg

SEQ ID NO: 176553 - DNA, 25 bp, Mus musculus
accagcagaaaaccggttgctgtgg

SEQ ID NO: 176554 - DNA, 25 bp, Mus musculus
accagcagacggtgcaaccaggtac

SEQ ID NO: 176555 - DNA, 25 bp, Mus musculus
accagcagacggtggaaattgacaa

SEQ ID NO: 176556 - DNA, 25 bp, Mus musculus
accagcagactgtaaaacagactag

SEQ ID NO: 176557 - DNA, 25 bp, Mus musculus
accagcagactttctcctgtctatc

SEQ ID NO: 176558 - DNA, 25 bp, Mus musculus
accagcagacttttgatttcaaaat

SEQ ID NO: 176559 - DNA, 25 bp, Mus musculus
accagcagagaaattcaaagggcaa

SEQ ID NO: 176560 - DNA, 25 bp, Mus musculus
accagcagagacgttcacagcctgg

SEQ ID NO: 176561 - DNA, 25 bp, Mus musculus
accagcagagccatggacaaggaat

SEQ ID NO: 176562 - DNA, 25 bp, Mus musculus
accagcagatcaagaattttctgaa

SEQ ID NO: 176563 - DNA, 25 bp, Mus musculus
accagcagcacgcaggacttccctg

SEQ ID NO: 176564 - DNA, 25 bp, Mus musculus
accagcagcacggaggacttccctg

SEQ ID NO: 176565 - DNA, 25 bp, Mus musculus
accagcagcccagggtcaggtacct

SEQ ID NO: 176566 - DNA, 25 bp, Mus musculus
accagcagctgaacagaaaatgtat

SEQ ID NO: 176567 - DNA, 25 bp, Mus musculus
accagcagctgaagtccgcacagag

SEQ ID NO: 176568 - DNA, 25 bp, Mus musculus
accagcagctgaatggttaccacaa

SEQ ID NO: 176569 - DNA, 25 bp, Mus musculus
accagcaggcatgggtaggatttgc

SEQ ID NO: 176570 - DNA, 25 bp, Mus musculus
accagcagggtcagggactcatgca

SEQ ID NO: 176571 - DNA, 25 bp, Mus musculus
accagcaggtaattaacgagatggt

SEQ ID NO: 176572 - DNA, 25 bp, Mus musculus
accagcagttcacgattctcgagca

SEQ ID NO: 176573 - DNA, 25 bp, Mus musculus
accagcataaagatagatgtgctaa

SEQ ID NO: 176574 - DNA, 25 bp, Mus musculus
accagcatcctcagctctgggcccc

SEQ ID NO: 176575 - DNA, 25 bp, Mus musculus
accagcatctgagagcaaccaggac

SEQ ID NO: 176576 - DNA, 25 bp, Mus musculus
accagcatctgagaggtggactctg

SEQ ID NO: 176577 - DNA, 25 bp, Mus musculus
accagcatgggagagttgcagcttc

SEQ ID NO: 176578 - DNA, 25 bp, Mus musculus
accagcatttgattaaagcaccgtg

SEQ ID NO: 176579 - DNA, 25 bp, Mus musculus
accagcatttggtataggagggatt

SEQ ID NO: 176580 - DNA, 25 bp, Mus musculus
accagccaacagaacctgagccagt

SEQ ID NO: 176581 - DNA, 25 bp, Mus musculus
accagccaacagtgcaacatagatt

SEQ ID NO: 176582 - DNA, 25 bp, Mus musculus
accagccaacccagatcaggcgtca

SEQ ID NO: 176583 - DNA, 25 bp, Mus musculus
accagccaaggactaactacgacca

SEQ ID NO: 176584 - DNA, 25 bp, Mus musculus
accagccaaggcaggatggaaccgc

SEQ ID NO: 176585 - DNA, 25 bp, Mus musculus
accagccacaggagctcttagggaa

SEQ ID NO: 176586 - DNA, 25 bp, Mus musculus
accagccagaagcaaacgatggagg

SEQ ID NO: 176587 - DNA, 25 bp, Mus musculus
accagccagaagcaaagggtgtgag

SEQ ID NO: 176588 - DNA, 25 bp, Mus musculus
accagccagccagagaaagaagtgg

SEQ ID NO: 176589 - DNA, 25 bp, Mus musculus
accagccagccagctttcagctggc

SEQ ID NO: 176590 - DNA, 25 bp, Mus musculus
accagccagtaattgggtgctgtac

SEQ ID NO: 176591 - DNA, 25 bp, Mus musculus
accagcccagagagaggtcttttgg

SEQ ID NO: 176592 - DNA, 25 bp, Mus musculus
accagcccaggtcaaccattcgagt

SEQ ID NO: 176593 - DNA, 25 bp, Mus musculus
accagcccataaaaacgtcaacgtc

SEQ ID NO: 176594 - DNA, 25 bp, Mus musculus
accagccccaatcaggaaattaccg

SEQ ID NO: 176595 - DNA, 25 bp, Mus musculus
accagcccgaggacaagaaaagaaa

SEQ ID NO: 176596 - DNA, 25 bp, Mus musculus
accagcccgtaagtttggtgagcgg

SEQ ID NO: 176597 - DNA, 25 bp, Mus musculus
accagccctgccccagcaccaccta

SEQ ID NO: 176598 - DNA, 25 bp, Mus musculus
accagccctggggtacttgttgact

SEQ ID NO: 176599 - DNA, 25 bp, Mus musculus
accagccctttgcttatgggacact

SEQ ID NO: 176600 - DNA, 25 bp, Mus musculus
accagccgcaagggaaggtgtgatc

SEQ ID NO: 176601 - DNA, 25 bp, Mus musculus
accagccgcagagccccaaggacga

SEQ ID NO: 176602 - DNA, 25 bp, Mus musculus
accagccgccccacggcggagcctg

SEQ ID NO: 176603 - DNA, 25 bp, Mus musculus
accagccgccccacgggccatggag

SEQ ID NO: 176604 - DNA, 25 bp, Mus musculus
accagcctcagattcagcgtttaaa

SEQ ID NO: 176605 - DNA, 25 bp, Mus musculus
accagcctcaggaagcaggccagca

SEQ ID NO: 176606 - DNA, 25 bp, Mus musculus
accagcctctggggccctggcccag

SEQ ID NO: 176607 - DNA, 25 bp, Mus musculus
accagcctgactggttgtgtcacca

SEQ ID NO: 176608 - DNA, 25 bp, Mus musculus
accagcctgtggaatagtcactgct

SEQ ID NO: 176609 - DNA, 25 bp, Mus musculus
accagcctgtgggtccgaagcagta

SEQ ID NO: 176610 - DNA, 25 bp, Mus musculus
accagccttaactaactccacggac

SEQ ID NO: 176611 - DNA, 25 bp, Mus musculus
accagccttaactggctccatagga

SEQ ID NO: 176612 - DNA, 25 bp, Mus musculus
accagcctttacaggacgcctttga

SEQ ID NO: 176613 - DNA, 25 bp, Mus musculus
accagcgaaggatgggacaaggcct

SEQ ID NO: 176614 - DNA, 25 bp, Mus musculus
accagcgaaggatggtggaagaaaa

SEQ ID NO: 176615 - DNA, 25 bp, Mus musculus
accagcgaccagatgaccaatgcaa

SEQ ID NO: 176616 - DNA, 25 bp, Mus musculus
accagcgaccagtcttgtgccattg

SEQ ID NO: 176617 - DNA, 25 bp, Mus musculus
accagcgcagggaatggatacggca

SEQ ID NO: 176618 - DNA, 25 bp, Mus musculus
accagcgccaccccctgctcctgct

SEQ ID NO: 176619 - DNA, 25 bp, Mus musculus
accagcgcgaaggtgatgctagaag

SEQ ID NO: 176620 - DNA, 25 bp, Mus musculus
accagcgctaagaggatccagaagg

SEQ ID NO: 176621 - DNA, 25 bp, Mus musculus
accagcgctcttctgttatgttctt

SEQ ID NO: 176622 - DNA, 25 bp, Mus musculus
accagcggagcatgcacgcctacca

SEQ ID NO: 176623 - DNA, 25 bp, Mus musculus
accagcggagggtttctctgtgtag

SEQ ID NO: 176624 - DNA, 25 bp, Mus musculus
accagcggagttcaatgcgagctct

SEQ ID NO: 176625 - DNA, 25 bp, Mus musculus
accagcggagtttcagtctggaagg

SEQ ID NO: 176626 - DNA, 25 bp, Mus musculus
accagcggcaagcctgagactggtg

SEQ ID NO: 176627 - DNA, 25 bp, Mus musculus
accagcggccacagccccactccac

SEQ ID NO: 176628 - DNA, 25 bp, Mus musculus
accagcgggagaagatggttggtaa

SEQ ID NO: 176629 - DNA, 25 bp, Mus musculus
accagcgggagaaggctctgcaccc

SEQ ID NO: 176630 - DNA, 25 bp, Mus musculus
accagcgggagaaggttgatccaaa

SEQ ID NO: 176631 - DNA, 25 bp, Mus musculus
accagcgtacagattgcatctgggt

SEQ ID NO: 176632 - DNA, 25 bp, Mus musculus
accagcgtcaagcaggtgtcttctg

SEQ ID NO: 176633 - DNA, 25 bp, Mus musculus
accagctaaaggaggctgtgagggg

SEQ ID NO: 176634 - DNA, 25 bp, Mus musculus
accagctaagggtgtcagggtcact

SEQ ID NO: 176635 - DNA, 25 bp, Mus musculus
accagctacaaagtgtctttgccat

SEQ ID NO: 176636 - DNA, 25 bp, Mus musculus
accagctagaaacgagatgtccctg

SEQ ID NO: 176637 - DNA, 25 bp, Mus musculus
accagctagaaacttctcctctgtt

SEQ ID NO: 176638 - DNA, 25 bp, Mus musculus
accagctatagacccatgcttgtac

SEQ ID NO: 176639 - DNA, 25 bp, Mus musculus
accagctcagttaatggaacccctg

SEQ ID NO: 176640 - DNA, 25 bp, Mus musculus
accagctcattgtgggaaactccaa

SEQ ID NO: 176641 - DNA, 25 bp, Mus musculus
accagctcattgtggggaccagcgg

SEQ ID NO: 176642 - DNA, 25 bp, Mus musculus
accagctccaacatagtttgtgatt

SEQ ID NO: 176643 - DNA, 25 bp, Mus musculus
accagctccaaccctttgcggaagt

SEQ ID NO: 176644 - DNA, 25 bp, Mus musculus
accagctccaatttttcaagacaaa

SEQ ID NO: 176645 - DNA, 25 bp, Mus musculus
accagctccacctggaaatgttctg

SEQ ID NO: 176646 - DNA, 25 bp, Mus musculus
accagctccacctgttatttggccg

SEQ ID NO: 176647 - DNA, 25 bp, Mus musculus
accagctccaggaagcagtcatgac

SEQ ID NO: 176648 - DNA, 25 bp, Mus musculus
accagctcgaaaaaacaatggcaag

SEQ ID NO: 176649 - DNA, 25 bp, Mus musculus
accagctctcggggatcttgaaaca

SEQ ID NO: 176650 - DNA, 25 bp, Mus musculus
accagctgaagacttgattgcaatt

SEQ ID NO: 176651 - DNA, 25 bp, Mus musculus
accagctgacagaaccagcagatag

SEQ ID NO: 176652 - DNA, 25 bp, Mus musculus
accagctgacccactgaagctgggg

SEQ ID NO: 176653 - DNA, 25 bp, Mus musculus
accagctgatcctgataccgctatt

SEQ ID NO: 176654 - DNA, 25 bp, Mus musculus
accagctgcaaggtgtgaggttaat

SEQ ID NO: 176655 - DNA, 25 bp, Mus musculus
accagctgcactatgtgacggagct

SEQ ID NO: 176656 - DNA, 25 bp, Mus musculus
accagctgcactcaggaagaggaga

SEQ ID NO: 176657 - DNA, 25 bp, Mus musculus
accagctggacaaaatggggtggat

SEQ ID NO: 176658 - DNA, 25 bp, Mus musculus
accagctggagaagttgtgtgactc

SEQ ID NO: 176659 - DNA, 25 bp, Mus musculus
accagctggcaaggttatgaaaact

SEQ ID NO: 176660 - DNA, 25 bp, Mus musculus
accagctgggagagcgaggggttgt

SEQ ID NO: 176661 - DNA, 25 bp, Mus musculus
accagctgggccaatgaaaaccaac

SEQ ID NO: 176662 - DNA, 25 bp, Mus musculus
accagctgtggttcggggccaggaa

SEQ ID NO: 176663 - DNA, 25 bp, Mus musculus
accagcttcagatctacccaaacga

SEQ ID NO: 176664 - DNA, 25 bp, Mus musculus
accagcttcaggttgcatcagtgac

SEQ ID NO: 176665 - DNA, 25 bp, Mus musculus
accagcttcagtaaagagggctggc

SEQ ID NO: 176666 - DNA, 25 bp, Mus musculus
accagcttcagtgaatggaactccc

SEQ ID NO: 176667 - DNA, 25 bp, Mus musculus
accagcttcccagccggaacccaga

SEQ ID NO: 176668 - DNA, 25 bp, Mus musculus
accagcttcctgatgaggagtctct

SEQ ID NO: 176669 - DNA, 25 bp, Mus musculus
accagctttagaaggcatggatgat

SEQ ID NO: 176670 - DNA, 25 bp, Mus musculus
accagctttagtcctcaaaggccag

SEQ ID NO: 176671 - DNA, 25 bp, Mus musculus
accagctttgtttctcccaggactc

SEQ ID NO: 176672 - DNA, 25 bp, Mus musculus
accagctttttgctgccccttaccg

SEQ ID NO: 176673 - DNA, 25 bp, Mus musculus
accaggaaaatatgggctggcgctg

SEQ ID NO: 176674 - DNA, 25 bp, Mus musculus
accaggaaagattaattgcctgagg

SEQ ID NO: 176675 - DNA, 25 bp, Mus musculus
accaggaaagttcaaatagcccgtc

SEQ ID NO: 176676 - DNA, 25 bp, Mus musculus
accaggaaagttctcaatctcacag

SEQ ID NO: 176677 - DNA, 25 bp, Mus musculus
accaggaacacctgctgacctctgt

SEQ ID NO: 176678 - DNA, 25 bp, Mus musculus
accaggaacacctttatctgaatta

SEQ ID NO: 176679 - DNA, 25 bp, Mus musculus
accaggaacacgggggcttcttcac

SEQ ID NO: 176680 - DNA, 25 bp, Mus musculus
accaggaacagagagaacattataa

SEQ ID NO: 176681 - DNA, 25 bp, Mus musculus
accaggaactcgaggctcctggagg

SEQ ID NO: 176682 - DNA, 25 bp, Mus musculus
accaggaagaacgcggagggagcta

SEQ ID NO: 176683 - DNA, 25 bp, Mus musculus
accaggaagagaaggcttcagatgc

SEQ ID NO: 176684 - DNA, 25 bp, Mus musculus
accaggaagcacctgccattgtggc

SEQ ID NO: 176685 - DNA, 25 bp, Mus musculus
accaggaagcaggtgtctagtcaca

SEQ ID NO: 176686 - DNA, 25 bp, Mus musculus
accaggaagcaggtgtctagtcata

SEQ ID NO: 176687 - DNA, 25 bp, Mus musculus
accaggaaggcaaattcgtgattac

SEQ ID NO: 176688 - DNA, 25 bp, Mus musculus
accaggaagggtgttaggagtggat

SEQ ID NO: 176689 - DNA, 25 bp, Mus musculus
accaggaattcagcaccccatgaac

SEQ ID NO: 176690 - DNA, 25 bp, Mus musculus
accaggaattcaggaaatattttca

SEQ ID NO: 176691 - DNA, 25 bp, Mus musculus
accaggacaagcaggtcccatgcat

SEQ ID NO: 176692 - DNA, 25 bp, Mus musculus
accaggacagcagggtgtgcagggg

SEQ ID NO: 176693 - DNA, 25 bp, Mus musculus
accaggacaggattccccctctgtg

SEQ ID NO: 176694 - DNA, 25 bp, Mus musculus
accaggacccccaggtgatgctggc

SEQ ID NO: 176695 - DNA, 25 bp, Mus musculus
accaggacctaggctggcacgcttc

SEQ ID NO: 176696 - DNA, 25 bp, Mus musculus
accaggactcaaatattctccttct

SEQ ID NO: 176697 - DNA, 25 bp, Mus musculus
accaggacttgcttgtgacgaatgg

SEQ ID NO: 176698 - DNA, 25 bp, Mus musculus
accaggacttggactattttgaaag

SEQ ID NO: 176699 - DNA, 25 bp, Mus musculus
accaggacttggagagctgtcacct

SEQ ID NO: 176700 - DNA, 25 bp, Mus musculus
accaggagaaggtgaggtacaccag

SEQ ID NO: 176701 - DNA, 25 bp, Mus musculus
accaggagactaagccttctgatga

SEQ ID NO: 176702 - DNA, 25 bp, Mus musculus
accaggagagcaagctgatcatcct

SEQ ID NO: 176703 - DNA, 25 bp, Mus musculus
accaggaggacagatcttctatcgg

SEQ ID NO: 176704 - DNA, 25 bp, Mus musculus
accaggaggtgacgggtctcactct

SEQ ID NO: 176705 - DNA, 25 bp, Mus musculus
accaggaggtgacggtgcagcggaa

SEQ ID NO: 176706 - DNA, 25 bp, Mus musculus
accaggaggtgacgttgctgtccca

SEQ ID NO: 176707 - DNA, 25 bp, Mus musculus
accaggagtttgttcaggaagtgga

SEQ ID NO: 176708 - DNA, 25 bp, Mus musculus
accaggataacacctgacactgaag

SEQ ID NO: 176709 - DNA, 25 bp, Mus musculus
accaggataacacgtccctagctgt

SEQ ID NO: 176710 - DNA, 25 bp, Mus musculus
accaggatactggagcttgcctctc

SEQ ID NO: 176711 - DNA, 25 bp, Mus musculus
accaggatatgagtgttttatggct

SEQ ID NO: 176712 - DNA, 25 bp, Mus musculus
accaggatcccctcctgtgcccctg

SEQ ID NO: 176713 - DNA, 25 bp, Mus musculus
accaggatcccctggcctcgctgga

SEQ ID NO: 176714 - DNA, 25 bp, Mus musculus
accaggatggctgatatagacagaa

SEQ ID NO: 176715 - DNA, 25 bp, Mus musculus
accaggatgttgacctaaagattgt

SEQ ID NO: 176716 - DNA, 25 bp, Mus musculus
accaggatgttgagaaagcaactag

SEQ ID NO: 176717 - DNA, 25 bp, Mus musculus
accaggcaagggttgcccttcacca

SEQ ID NO: 176718 - DNA, 25 bp, Mus musculus
accaggcaaggtactggtgaggttt

SEQ ID NO: 176719 - DNA, 25 bp, Mus musculus
accaggcaattctagtggctgcggc

SEQ ID NO: 176720 - DNA, 25 bp, Mus musculus
accaggcaccaggcaccaacagaga

SEQ ID NO: 176721 - DNA, 25 bp, Mus musculus
accaggcaccaggtcctgtttattg

SEQ ID NO: 176722 - DNA, 25 bp, Mus musculus
accaggcaccagtacagaaagcaag

SEQ ID NO: 176723 - DNA, 25 bp, Mus musculus
accaggcacccagagttttgctctg

SEQ ID NO: 176724 - DNA, 25 bp, Mus musculus
accaggcacccatggctcaaactac

SEQ ID NO: 176725 - DNA, 25 bp, Mus musculus
accaggcacttaaggaaattgggga

SEQ ID NO: 176726 - DNA, 25 bp, Mus musculus
accaggcagaagctgggaagtcatc

SEQ ID NO: 176727 - DNA, 25 bp, Mus musculus
accaggcagaaggcgacagacttat

SEQ ID NO: 176728 - DNA, 25 bp, Mus musculus
accaggcagacgatgttgaatgaca

SEQ ID NO: 176729 - DNA, 25 bp, Mus musculus
accaggcagagagatcgccttacag

SEQ ID NO: 176730 - DNA, 25 bp, Mus musculus
accaggcagtgagatgtccctagac

SEQ ID NO: 176731 - DNA, 25 bp, Mus musculus
accaggcagttgcccatggaggcca

SEQ ID NO: 176732 - DNA, 25 bp, Mus musculus
accaggcatgaggggccataaaggg

SEQ ID NO: 176733 - DNA, 25 bp, Mus musculus
accaggcatgcagtaaaggccaaaa

SEQ ID NO: 176734 - DNA, 25 bp, Mus musculus
accaggcatgctccctgacctcagc

SEQ ID NO: 176735 - DNA, 25 bp, Mus musculus
accaggccaaagattatttgtataa

SEQ ID NO: 176736 - DNA, 25 bp, Mus musculus
accaggccaagaagggggatggaaa

SEQ ID NO: 176737 - DNA, 25 bp, Mus musculus
accaggcccggaagttcctgttcct

SEQ ID NO: 176738 - DNA, 25 bp, Mus musculus
accaggcccgtgaccacctctctgg

SEQ ID NO: 176739 - DNA, 25 bp, Mus musculus
accaggcctagctcaagtcttttat

SEQ ID NO: 176740 - DNA, 25 bp, Mus musculus
accaggcctggaagcaccagcctag

SEQ ID NO: 176741 - DNA, 25 bp, Mus musculus
accaggcctggggtccccttcctct

SEQ ID NO: 176742 - DNA, 25 bp, Mus musculus
accaggcctgtcttcagtcccctaa

SEQ ID NO: 176743 - DNA, 25 bp, Mus musculus
accaggctacaaagaacccaagaga

SEQ ID NO: 176744 - DNA, 25 bp, Mus musculus
accaggctcccgagggatcatgcct

SEQ ID NO: 176745 - DNA, 25 bp, Mus musculus
accaggctgacgggtatcaccacag

SEQ ID NO: 176746 - DNA, 25 bp, Mus musculus
accaggctgagtgtttatcatggct

SEQ ID NO: 176747 - DNA, 25 bp, Mus musculus
accaggctgcaggcctgtgggccga

SEQ ID NO: 176748 - DNA, 25 bp, Mus musculus
accagggaaactgggatctgttggc

SEQ ID NO: 176749 - DNA, 25 bp, Mus musculus
accagggaagccagggtctttgtga

SEQ ID NO: 176750 - DNA, 25 bp, Mus musculus
accagggacagactcactctgtgga

SEQ ID NO: 176751 - DNA, 25 bp, Mus musculus
accagggacatcagttccagacacg

SEQ ID NO: 176752 - DNA, 25 bp, Mus musculus
accagggaggtgactgacttacagg

SEQ ID NO: 176753 - DNA, 25 bp, Mus musculus
accagggagtaaagggacatctcta

SEQ ID NO: 176754 - DNA, 25 bp, Mus musculus
accagggattcccgtcttctccctc

SEQ ID NO: 176755 - DNA, 25 bp, Mus musculus
accagggcaagaagcatcctcctcc

SEQ ID NO: 176756 - DNA, 25 bp, Mus musculus
accagggcaagaaggtgggaatcct

SEQ ID NO: 176757 - DNA, 25 bp, Mus musculus
accagggcaccaaggctgctttggc

SEQ ID NO: 176758 - DNA, 25 bp, Mus musculus
accagggcaccaagttctccagcca

SEQ ID NO: 176759 - DNA, 25 bp, Mus musculus
accagggcagtgccctgcagacaca

SEQ ID NO: 176760 - DNA, 25 bp, Mus musculus
accagggcataggagaacattctgg

SEQ ID NO: 176761 - DNA, 25 bp, Mus musculus
accagggcataggaggtaacaacaa

SEQ ID NO: 176762 - DNA, 25 bp, Mus musculus
accagggcgacttcgagaagccccg

SEQ ID NO: 176763 - DNA, 25 bp, Mus musculus
accagggctaccgtcatacctcact

SEQ ID NO: 176764 - DNA, 25 bp, Mus musculus
accaggggcaaggtttcagccacaa

SEQ ID NO: 176765 - DNA, 25 bp, Mus musculus
accagggtagtgggagccctcgtag

SEQ ID NO: 176766 - DNA, 25 bp, Mus musculus
accagggtcggacaaatgacaaaga

SEQ ID NO: 176767 - DNA, 25 bp, Mus musculus
accaggtaagacccctgggcctcct

SEQ ID NO: 176768 - DNA, 25 bp, Mus musculus
accaggtacagcaatgacatttctt

SEQ ID NO: 176769 - DNA, 25 bp, Mus musculus
accaggtagatgctgagaggaaaac

SEQ ID NO: 176770 - DNA, 25 bp, Mus musculus
accaggtcaaggctctggataagca

SEQ ID NO: 176771 - DNA, 25 bp, Mus musculus
accaggtcaagggcaagcctgacct

SEQ ID NO: 176772 - DNA, 25 bp, Mus musculus
accaggtccatgaccgaaatgcgac

SEQ ID NO: 176773 - DNA, 25 bp, Mus musculus
accaggtccgaagtgctgactggtc

SEQ ID NO: 176774 - DNA, 25 bp, Mus musculus
accaggtcctgcgggttctccaggg

SEQ ID NO: 176775 - DNA, 25 bp, Mus musculus
accaggtgcaaagaggaaaacacca

SEQ ID NO: 176776 - DNA, 25 bp, Mus musculus
accaggtgccacacggccatggcta

SEQ ID NO: 176777 - DNA, 25 bp, Mus musculus
accaggtgccccaggtgttccatga

SEQ ID NO: 176778 - DNA, 25 bp, Mus musculus
accaggtgccccaggtttcttgaac

SEQ ID NO: 176779 - DNA, 25 bp, Mus musculus
accaggtggacatgacagtggccga

SEQ ID NO: 176780 - DNA, 25 bp, Mus musculus
accaggtggagagcatatccgaggg

SEQ ID NO: 176781 - DNA, 25 bp, Mus musculus
accaggtggagataagtcattgtga

SEQ ID NO: 176782 - DNA, 25 bp, Mus musculus
accaggtggcagaggacctggtggc

SEQ ID NO: 176783 - DNA, 25 bp, Mus musculus
accaggtggttcgccctagtcgagg

SEQ ID NO: 176784 - DNA, 25 bp, Mus musculus
accaggtgtttcagggctaccagtg

SEQ ID NO: 176785 - DNA, 25 bp, Mus musculus
accaggttcccagtcttctcaccag

SEQ ID NO: 176786 - DNA, 25 bp, Mus musculus
accaggtttgagaatttgacttcgg

SEQ ID NO: 176787 - DNA, 25 bp, Mus musculus
accaggtttgggttccccaggatga

SEQ ID NO: 176788 - DNA, 25 bp, Mus musculus
accagtacaaggagcttcctccaat

SEQ ID NO: 176789 - DNA, 25 bp, Mus musculus
accagtaccaggaatgggcacccct

SEQ ID NO: 176790 - DNA, 25 bp, Mus musculus
accagtaccagtcctcttctccaaa

SEQ ID NO: 176791 - DNA, 25 bp, Mus musculus
accagtacctggagcaatcaaagta

SEQ ID NO: 176792 - DNA, 25 bp, Mus musculus
accagtacctggagggcctgttctt

SEQ ID NO: 176793 - DNA, 25 bp, Mus musculus
accagtacttgacaggttcttgtct

SEQ ID NO: 176794 - DNA, 25 bp, Mus musculus
accagtacttggggccttttgctcg

SEQ ID NO: 176795 - DNA, 25 bp, Mus musculus
accagtacttgggtctgacaagatg

SEQ ID NO: 176796 - DNA, 25 bp, Mus musculus
accagtagaacaagagactaagtct

SEQ ID NO: 176797 - DNA, 25 bp, Mus musculus
accagtagaacaagtatcatctcag

SEQ ID NO: 176798 - DNA, 25 bp, Mus musculus
accagtagcagtgtcagtgtgcact

SEQ ID NO: 176799 - DNA, 25 bp, Mus musculus
accagtataaccctttaatggctac

SEQ ID NO: 176800 - DNA, 25 bp, Mus musculus
accagtatcagagagacaagattga

SEQ ID NO: 176801 - DNA, 25 bp, Mus musculus
accagtatctcctcgctcttcgaac

SEQ ID NO: 176802 - DNA, 25 bp, Mus musculus
accagtatggaccgatgggtcccac

SEQ ID NO: 176803 - DNA, 25 bp, Mus musculus
accagtatggaccggtgtgttcctc

SEQ ID NO: 176804 - DNA, 25 bp, Mus musculus
accagtatgggagtcaagctgtgca

SEQ ID NO: 176805 - DNA, 25 bp, Mus musculus
accagtatgtctcaggctgaatttg

SEQ ID NO: 176806 - DNA, 25 bp, Mus musculus
accagtattgtacccatgatgcaca

SEQ ID NO: 176807 - DNA, 25 bp, Mus musculus
accagtcaaacagtggcttgcattg

SEQ ID NO: 176808 - DNA, 25 bp, Mus musculus
accagtcaaacagtggtattttaac

SEQ ID NO: 176809 - DNA, 25 bp, Mus musculus
accagtcacagtttgtggggacatc

SEQ ID NO: 176810 - DNA, 25 bp, Mus musculus
accagtcactatgtgctgtgagtgg

SEQ ID NO: 176811 - DNA, 25 bp, Mus musculus
accagtcagctcagaccctgctgga

SEQ ID NO: 176812 - DNA, 25 bp, Mus musculus
accagtcagctcagctttgcggagc

SEQ ID NO: 176813 - DNA, 25 bp, Mus musculus
accagtcagtacagcaaacaattgg

SEQ ID NO: 176814 - DNA, 25 bp, Mus musculus
accagtcagtacaggttcatcgttt

SEQ ID NO: 176815 - DNA, 25 bp, Mus musculus
accagtccactgactttaactggta

SEQ ID NO: 176816 - DNA, 25 bp, Mus musculus
accagtcctaacacttccagaaact

SEQ ID NO: 176817 - DNA, 25 bp, Mus musculus
accagtcctgcccagctcaatggtg

SEQ ID NO: 176818 - DNA, 25 bp, Mus musculus
accagtcctgcccaggatggcagta

SEQ ID NO: 176819 - DNA, 25 bp, Mus musculus
accagtcgcggacagtggcaaccct

SEQ ID NO: 176820 - DNA, 25 bp, Mus musculus
accagtctaagttctttcgagtttt

SEQ ID NO: 176821 - DNA, 25 bp, Mus musculus
accagtctaggaaggtccttttgat

SEQ ID NO: 176822 - DNA, 25 bp, Mus musculus
accagtctcacagccgagggttgat

SEQ ID NO: 176823 - DNA, 25 bp, Mus musculus
accagtctccaagatggcggtaaat

SEQ ID NO: 176824 - DNA, 25 bp, Mus musculus
accagtctgcataaggctgcggaga

SEQ ID NO: 176825 - DNA, 25 bp, Mus musculus
accagtctgcctaactctgtggcct

SEQ ID NO: 176826 - DNA, 25 bp, Mus musculus
accagtctggcaggatcttgtgctg

SEQ ID NO: 176827 - DNA, 25 bp, Mus musculus
accagtgaaatgcctgcccagaaaa

SEQ ID NO: 176828 - DNA, 25 bp, Mus musculus
accagtgaaatgtctgcccagaaaa

SEQ ID NO: 176829 - DNA, 25 bp, Mus musculus
accagtgacagtgacctggctgaag

SEQ ID NO: 176830 - DNA, 25 bp, Mus musculus
accagtgactaaaagtagtagaagg

SEQ ID NO: 176831 - DNA, 25 bp, Mus musculus
accagtgactccaatatgcctgaag

SEQ ID NO: 176832 - DNA, 25 bp, Mus musculus
accagtgaggactgggttgactgtg

SEQ ID NO: 176833 - DNA, 25 bp, Mus musculus
accagtgaggagattccccccctag

SEQ ID NO: 176834 - DNA, 25 bp, Mus musculus
accagtgataaactcgatgacctca

SEQ ID NO: 176835 - DNA, 25 bp, Mus musculus
accagtgatgaaaagcttgttcggc

SEQ ID NO: 176836 - DNA, 25 bp, Mus musculus
accagtgatgaaaaggaagtaccat

SEQ ID NO: 176837 - DNA, 25 bp, Mus musculus
accagtgcaagacagggtctcatgg

SEQ ID NO: 176838 - DNA, 25 bp, Mus musculus
accagtgcaccctggaacagcttca

SEQ ID NO: 176839 - DNA, 25 bp, Mus musculus
accagtgcacggtgatatttttgaa

SEQ ID NO: 176840 - DNA, 25 bp, Mus musculus
accagtgccaaaagaattcagaagg

SEQ ID NO: 176841 - DNA, 25 bp, Mus musculus
accagtgccaaaagtgctggaccca

SEQ ID NO: 176842 - DNA, 25 bp, Mus musculus
accagtgccacggaggatctagata

SEQ ID NO: 176843 - DNA, 25 bp, Mus musculus
accagtgccacggagtcggaccagg

SEQ ID NO: 176844 - DNA, 25 bp, Mus musculus
accagtgccgcacagtctggaataa

SEQ ID NO: 176845 - DNA, 25 bp, Mus musculus
accagtgcctctgactaggtctgcg

SEQ ID NO: 176846 - DNA, 25 bp, Mus musculus
accagtggaaggcaaaggctgcgaa

SEQ ID NO: 176847 - DNA, 25 bp, Mus musculus
accagtggggagtggagctggggaa

SEQ ID NO: 176848 - DNA, 25 bp, Mus musculus
accagtggggctggggaagcagctg

SEQ ID NO: 176849 - DNA, 25 bp, Mus musculus
accagtggtatgaggttgaacggac

SEQ ID NO: 176850 - DNA, 25 bp, Mus musculus
accagtggtatgagtggttcagaaa

SEQ ID NO: 176851 - DNA, 25 bp, Mus musculus
accagtgtaagattaatgtggctgc

SEQ ID NO: 176852 - DNA, 25 bp, Mus musculus
accagtgtagcctatgcccatccta

SEQ ID NO: 176853 - DNA, 25 bp, Mus musculus
accagtgtcctcttctagttctttg

SEQ ID NO: 176854 - DNA, 25 bp, Mus musculus
accagtgtgtggatgtggacgagtg

SEQ ID NO: 176855 - DNA, 25 bp, Mus musculus
accagtgtgtggcccgccacctcta

SEQ ID NO: 176856 - DNA, 25 bp, Mus musculus
accagtgtttatggcttgaagatgc

SEQ ID NO: 176857 - DNA, 25 bp, Mus musculus
accagttaagagagaacagagtttc

SEQ ID NO: 176858 - DNA, 25 bp, Mus musculus
accagttccatagtgatgttaatta

SEQ ID NO: 176859 - DNA, 25 bp, Mus musculus
accagttccccgaattccgtgtaga

SEQ ID NO: 176860 - DNA, 25 bp, Mus musculus
accagttccccggtatccctctcac

SEQ ID NO: 176861 - DNA, 25 bp, Mus musculus
accagttccgttggcgtctccaagg

SEQ ID NO: 176862 - DNA, 25 bp, Mus musculus
accagttccgttgggatccgcgcgg

SEQ ID NO: 176863 - DNA, 25 bp, Mus musculus
accagttcgagggggctgaagaata

SEQ ID NO: 176864 - DNA, 25 bp, Mus musculus
accagttgcggatgagtacagcatt

SEQ ID NO: 176865 - DNA, 25 bp, Mus musculus
accagttgctcaggcagtgctttta

SEQ ID NO: 176866 - DNA, 25 bp, Mus musculus
accagttgtcgccctttaaccatgc

SEQ ID NO: 176867 - DNA, 25 bp, Mus musculus
accagtttcagcgtgcgggaggtgc

SEQ ID NO: 176868 - DNA, 25 bp, Mus musculus
accagtttgacaggacacagagctg

SEQ ID NO: 176869 - DNA, 25 bp, Mus musculus
accagtttgggctcaagagtgtcat

SEQ ID NO: 176870 - DNA, 25 bp, Mus musculus
accataaaaaaaccgacaagctggg

SEQ ID NO: 176871 - DNA, 25 bp, Mus musculus
accataaaaacattgcaaagaactg

SEQ ID NO: 176872 - DNA, 25 bp, Mus musculus
accataaacagtatggcggctctga

SEQ ID NO: 176873 - DNA, 25 bp, Mus musculus
accataatcgaaggttggctgctga

SEQ ID NO: 176874 - DNA, 25 bp, Mus musculus
accatacacaaggccagctgttgcc

SEQ ID NO: 176875 - DNA, 25 bp, Mus musculus
accatacagaaatatgatcctccag

SEQ ID NO: 176876 - DNA, 25 bp, Mus musculus
accatacaggtatgtcatcaggcag

SEQ ID NO: 176877 - DNA, 25 bp, Mus musculus
accatacggacatatagattcttgt

SEQ ID NO: 176878 - DNA, 25 bp, Mus musculus
accatactatgcattatccaattgg

SEQ ID NO: 176879 - DNA, 25 bp, Mus musculus
accatactatttgcttttgccaaga

SEQ ID NO: 176880 - DNA, 25 bp, Mus musculus
accatactcccgagatgttagatgt

SEQ ID NO: 176881 - DNA, 25 bp, Mus musculus
accatactgtctactggtgccctcc

SEQ ID NO: 176882 - DNA, 25 bp, Mus musculus
accatactgtctactgttccaccaa

SEQ ID NO: 176883 - DNA, 25 bp, Mus musculus
accatacttcagactagcttccttt

SEQ ID NO: 176884 - DNA, 25 bp, Mus musculus
accatacttcaggtcttcagcaata

SEQ ID NO: 176885 - DNA, 25 bp, Mus musculus
accatagaagtacctcaaatcgttt

SEQ ID NO: 176886 - DNA, 25 bp, Mus musculus
accatagaagttgctcctttggtag

SEQ ID NO: 176887 - DNA, 25 bp, Mus musculus
accatagacgagttggagtggaaac

SEQ ID NO: 176888 - DNA, 25 bp, Mus musculus
accatagacgtggaaactgtctgag

SEQ ID NO: 176889 - DNA, 25 bp, Mus musculus
accatagcagaccggatcctcttca

SEQ ID NO: 176890 - DNA, 25 bp, Mus musculus
accatagccatgctttctggcatat

SEQ ID NO: 176891 - DNA, 25 bp, Mus musculus
accatagcccagcaggaagcaactt

SEQ ID NO: 176892 - DNA, 25 bp, Mus musculus
accatagcccagcaggtgaccaacc

SEQ ID NO: 176893 - DNA, 25 bp, Mus musculus
accatatcaagtctatgcatggaac

SEQ ID NO: 176894 - DNA, 25 bp, Mus musculus
accatatcaagtttagagacgtgga

SEQ ID NO: 176895 - DNA, 25 bp, Mus musculus
accatatcagccattgaagccatga

SEQ ID NO: 176896 - DNA, 25 bp, Mus musculus
accatatcagtgccttgtatgtggt

SEQ ID NO: 176897 - DNA, 25 bp, Mus musculus
accatatcccaagtgtctgataaca

SEQ ID NO: 176898 - DNA, 25 bp, Mus musculus
accatatgaacttggcatggaacat

SEQ ID NO: 176899 - DNA, 25 bp, Mus musculus
accatatgctgaaggagttattcct

SEQ ID NO: 176900 - DNA, 25 bp, Mus musculus
accatatgctgaagtatttcatggt

SEQ ID NO: 176901 - DNA, 25 bp, Mus musculus
accatatggaagactcggagatcaa

SEQ ID NO: 176902 - DNA, 25 bp, Mus musculus
accatattcttttgaatatgtagac

SEQ ID NO: 176903 - DNA, 25 bp, Mus musculus
accatattgcccaaggacctgagcc

SEQ ID NO: 176904 - DNA, 25 bp, Mus musculus
accatattgcccaagtcaaagtaaa

SEQ ID NO: 176905 - DNA, 25 bp, Mus musculus
accatattggcgcaccactctcaag

SEQ ID NO: 176906 - DNA, 25 bp, Mus musculus
accatatttgaaaatgctgtggatg

SEQ ID NO: 176907 - DNA, 25 bp, Mus musculus
accatatttgaatcatttccaccct

SEQ ID NO: 176908 - DNA, 25 bp, Mus musculus
accatatttgacgcggaaaaggata

SEQ ID NO: 176909 - DNA, 25 bp, Mus musculus
accatatttgcagaagtcgagtccc

SEQ ID NO: 176910 - DNA, 25 bp, Mus musculus
accatatttggtcacctggagagaa

SEQ ID NO: 176911 - DNA, 25 bp, Mus musculus
accatcaaaaaggcaaacataaatg

SEQ ID NO: 176912 - DNA, 25 bp, Mus musculus
accatcaaaaggagaagaaatgctt

SEQ ID NO: 176913 - DNA, 25 bp, Mus musculus
accatcaaaaggaggaagctggcta

SEQ ID NO: 176914 - DNA, 25 bp, Mus musculus
accatcaacaagcaaatccgcgaca

SEQ ID NO: 176915 - DNA, 25 bp, Mus musculus
accatcaacacaccctttggggcga

SEQ ID NO: 176916 - DNA, 25 bp, Mus musculus
accatcaatggtgcagtgcagttgc

SEQ ID NO: 176917 - DNA, 25 bp, Mus musculus
accatcaatgttgcctaatgggaac

SEQ ID NO: 176918 - DNA, 25 bp, Mus musculus
accatcacaagatctgatactcttg

SEQ ID NO: 176919 - DNA, 25 bp, Mus musculus
accatcacaaggtctgatactcttg

SEQ ID NO: 176920 - DNA, 25 bp, Mus musculus
accatcacacagcctcggcccacac

SEQ ID NO: 176921 - DNA, 25 bp, Mus musculus
accatcacaccaccagtcccgctcg

SEQ ID NO: 176922 - DNA, 25 bp, Mus musculus
accatcacagaatacactgtaagtt

SEQ ID NO: 176923 - DNA, 25 bp, Mus musculus
accatcacagagtcaaatccacgga

SEQ ID NO: 176924 - DNA, 25 bp, Mus musculus
accatcacagggtttgtggatgcac

SEQ ID NO: 176925 - DNA, 25 bp, Mus musculus
accatcacaggtctattctggatag

SEQ ID NO: 176926 - DNA, 25 bp, Mus musculus
accatcacagtgttccttcctgccg

SEQ ID NO: 176927 - DNA, 25 bp, Mus musculus
accatcacatacacgatattgatga

SEQ ID NO: 176928 - DNA, 25 bp, Mus musculus
accatcacatacacgcaatgcaccg

SEQ ID NO: 176929 - DNA, 25 bp, Mus musculus
accatcaccaaaaatgggtacaagt

SEQ ID NO: 176930 - DNA, 25 bp, Mus musculus
accatcaccaaagccccccatcaac

SEQ ID NO: 176931 - DNA, 25 bp, Mus musculus
accatcaccaagctcctccagacaa

SEQ ID NO: 176932 - DNA, 25 bp, Mus musculus
accatcaccaagtcggatgctctgg

SEQ ID NO: 176933 - DNA, 25 bp, Mus musculus
accatcactcgagcttctagggacc

SEQ ID NO: 176934 - DNA, 25 bp, Mus musculus
accatcagctgactacccaggcggc

SEQ ID NO: 176935 - DNA, 25 bp, Mus musculus
accatcagctgagtgactgtggaga

SEQ ID NO: 176936 - DNA, 25 bp, Mus musculus
accatcagtcctcagatgcggtgag

SEQ ID NO: 176937 - DNA, 25 bp, Mus musculus
accatcagtgatgatttcctattat

SEQ ID NO: 176938 - DNA, 25 bp, Mus musculus
accatcagtgatgctctccttacag

SEQ ID NO: 176939 - DNA, 25 bp, Mus musculus
accatcatcaatggcattgtggagg

SEQ ID NO: 176940 - DNA, 25 bp, Mus musculus
accatcatcacagacaccacggcga

SEQ ID NO: 176941 - DNA, 25 bp, Mus musculus
accatcatcacagattctcgagcag

SEQ ID NO: 176942 - DNA, 25 bp, Mus musculus
accatcatcagagagcttcatggag

SEQ ID NO: 176943 - DNA, 25 bp, Mus musculus
accatcatcaggcaaacaggcatgg

SEQ ID NO: 176944 - DNA, 25 bp, Mus musculus
accatcatcagtgtcccttgggaag

SEQ ID NO: 176945 - DNA, 25 bp, Mus musculus
accatcatccgggccatccgaacca

SEQ ID NO: 176946 - DNA, 25 bp, Mus musculus
accatcatgaatcccagcccggagg

SEQ ID NO: 176947 - DNA, 25 bp, Mus musculus
accatcatgagatatctgccaagag

SEQ ID NO: 176948 - DNA, 25 bp, Mus musculus
accatcattggcgattccggggtgc

SEQ ID NO: 176949 - DNA, 25 bp, Mus musculus
accatcattggcggtgcccagatca

SEQ ID NO: 176950 - DNA, 25 bp, Mus musculus
accatccaaccgaggagagtcaaca

SEQ ID NO: 176951 - DNA, 25 bp, Mus musculus
accatccatagtgaccatgagggtg

SEQ ID NO: 176952 - DNA, 25 bp, Mus musculus
accatcccaggtgacaccgcttggc

SEQ ID NO: 176953 - DNA, 25 bp, Mus musculus
accatcccatgcccctgtttcactg

SEQ ID NO: 176954 - DNA, 25 bp, Mus musculus
accatccccaaagatggacaaaaga

SEQ ID NO: 176955 - DNA, 25 bp, Mus musculus
accatccccaaggaacctgatggaa

SEQ ID NO: 176956 - DNA, 25 bp, Mus musculus
accatcccccatgcggctgggtatc

SEQ ID NO: 176957 - DNA, 25 bp, Mus musculus
accatccccttaaaggatcctctga

SEQ ID NO: 176958 - DNA, 25 bp, Mus musculus
accatccggaagaaagcaaaagaga

SEQ ID NO: 176959 - DNA, 25 bp, Mus musculus
accatccgtgtagaggagcaggcga

SEQ ID NO: 176960 - DNA, 25 bp, Mus musculus
accatcctagtcatgggagacttca

SEQ ID NO: 176961 - DNA, 25 bp, Mus musculus
accatcctcagtggtacacttagct

SEQ ID NO: 176962 - DNA, 25 bp, Mus musculus
accatcctctggagacaggttttct

SEQ ID NO: 176963 - DNA, 25 bp, Mus musculus
accatcctctggagggtctggaatc

SEQ ID NO: 176964 - DNA, 25 bp, Mus musculus
accatcctgaggcctgactaccaga

SEQ ID NO: 176965 - DNA, 25 bp, Mus musculus
accatccttaagtggccaaatgtaa

SEQ ID NO: 176966 - DNA, 25 bp, Mus musculus
accatcgagctcatgaacacttcag

SEQ ID NO: 176967 - DNA, 25 bp, Mus musculus
accatcgagctcatgatcagtaatg

SEQ ID NO: 176968 - DNA, 25 bp, Mus musculus
accatcgagctcatgtgttctgtgc

SEQ ID NO: 176969 - DNA, 25 bp, Mus musculus
accatcgagctcatgttaccgaagt

SEQ ID NO: 176970 - DNA, 25 bp, Mus musculus
accatcgatagtgtccggatgcgat

SEQ ID NO: 176971 - DNA, 25 bp, Mus musculus
accatcgcagaccattgcccagact

SEQ ID NO: 176972 - DNA, 25 bp, Mus musculus
accatcggcaaggttcagaagaaga

SEQ ID NO: 176973 - DNA, 25 bp, Mus musculus
accatcgggaaacgtctctggagct

SEQ ID NO: 176974 - DNA, 25 bp, Mus musculus
accatcgtaggttctgtacctcact

SEQ ID NO: 176975 - DNA, 25 bp, Mus musculus
accatcgtgacagagatggtcaaga

SEQ ID NO: 176976 - DNA, 25 bp, Mus musculus
accatcgtgacagaggaacagaaat

SEQ ID NO: 176977 - DNA, 25 bp, Mus musculus
accatcgtgacagaggcgttctctg

SEQ ID NO: 176978 - DNA, 25 bp, Mus musculus
accatcgtgacagagtggaatctgg

SEQ ID NO: 176979 - DNA, 25 bp, Mus musculus
accatcgtgacagagtgggacctgg

SEQ ID NO: 176980 - DNA, 25 bp, Mus musculus
accatcgtgactgagtggaaccttg

SEQ ID NO: 176981 - DNA, 25 bp, Mus musculus
accatcgtgtctagaccttaaacta

SEQ ID NO: 176982 - DNA, 25 bp, Mus musculus
accatcgtgtctagagccttgcaca

SEQ ID NO: 176983 - DNA, 25 bp, Mus musculus
accatctagtgaatagtggaggagt

SEQ ID NO: 176984 - DNA, 25 bp, Mus musculus
accatctatgagagaatatcaaaga

SEQ ID NO: 176985 - DNA, 25 bp, Mus musculus
accatctcaaaacctgacaagacat

SEQ ID NO: 176986 - DNA, 25 bp, Mus musculus
accatctcaaccaggatgcgtacac

SEQ ID NO: 176987 - DNA, 25 bp, Mus musculus
accatctccggtcctggcttaacag

SEQ ID NO: 176988 - DNA, 25 bp, Mus musculus
accatctctaagatgtaaagaagga

SEQ ID NO: 176989 - DNA, 25 bp, Mus musculus
accatctctacagattcctgcggaa

SEQ ID NO: 176990 - DNA, 25 bp, Mus musculus
accatctctagatctccattcggac

SEQ ID NO: 176991 - DNA, 25 bp, Mus musculus
accatctgaaagctgggttgcaggc

SEQ ID NO: 176992 - DNA, 25 bp, Mus musculus
accatctgaagagtctactcggatg

SEQ ID NO: 176993 - DNA, 25 bp, Mus musculus
accatctgaaggacaaggagctcca

SEQ ID NO: 176994 - DNA, 25 bp, Mus musculus
accatctgatggcctgctggtgacc

SEQ ID NO: 176995 - DNA, 25 bp, Mus musculus
accatctggagaatgtgaggtggac

SEQ ID NO: 176996 - DNA, 25 bp, Mus musculus
accatcttcaaggacctgccgctgc

SEQ ID NO: 176997 - DNA, 25 bp, Mus musculus
accatcttcaccatggaaaagaaca

SEQ ID NO: 176998 - DNA, 25 bp, Mus musculus
accatcttgcttagcctcaaagagt

SEQ ID NO: 176999 - DNA, 25 bp, Mus musculus
accatctttgcacccaggattcaat

SEQ ID NO: 177000 - DNA, 25 bp, Mus musculus
accatctttgcatgaaagccccttc

SEQ ID NO: 177001 - DNA, 25 bp, Mus musculus
accatctttggattcaattttttgc

SEQ ID NO: 177002 - DNA, 25 bp, Mus musculus
accatcttttccaaacatcaacatg

SEQ ID NO: 177003 - DNA, 25 bp, Mus musculus
accatgaaaagaagagatgagacca

SEQ ID NO: 177004 - DNA, 25 bp, Mus musculus
accatgaaccgaggcatcaaggcct

SEQ ID NO: 177005 - DNA, 25 bp, Mus musculus
accatgaagaggaagttggtgtcct

SEQ ID NO: 177006 - DNA, 25 bp, Mus musculus
accatgaagatcaagatcattgctc

SEQ ID NO: 177007 - DNA, 25 bp, Mus musculus
accatgaagatcaagcagatgtgga

SEQ ID NO: 177008 - DNA, 25 bp, Mus musculus
accatgaaggaaagactcaggcagc

SEQ ID NO: 177009 - DNA, 25 bp, Mus musculus
accatgaaggaaagttacccagcat

SEQ ID NO: 177010 - DNA, 25 bp, Mus musculus
accatgaaggaagccaaggacatga

SEQ ID NO: 177011 - DNA, 25 bp, Mus musculus
accatgaaggatcaggatgacgatg

SEQ ID NO: 177012 - DNA, 25 bp, Mus musculus
accatgaaggatcaggcccttaagg

SEQ ID NO: 177013 - DNA, 25 bp, Mus musculus
accatgaagtacaggctggacattg

SEQ ID NO: 177014 - DNA, 25 bp, Mus musculus
accatgaagtacctgaacgtgctgg

SEQ ID NO: 177015 - DNA, 25 bp, Mus musculus
accatgaagttggacaacttttctc

SEQ ID NO: 177016 - DNA, 25 bp, Mus musculus
accatgacatccttggcagcactgc

SEQ ID NO: 177017 - DNA, 25 bp, Mus musculus
accatgaccaagaggtcgctcgcat

SEQ ID NO: 177018 - DNA, 25 bp, Mus musculus
accatgaccaaggatgaacagcaac

SEQ ID NO: 177019 - DNA, 25 bp, Mus musculus
accatgaccaggaataactcaacct

SEQ ID NO: 177020 - DNA, 25 bp, Mus musculus
accatgaccaggcgctggctcaggc

SEQ ID NO: 177021 - DNA, 25 bp, Mus musculus
accatgactctcaggcaaggccagc

SEQ ID NO: 177022 - DNA, 25 bp, Mus musculus
accatgagaaagagccactggcaag

SEQ ID NO: 177023 - DNA, 25 bp, Mus musculus
accatgagagacttccagacagaac

SEQ ID NO: 177024 - DNA, 25 bp, Mus musculus
accatgagagggtgtggaccgtgtc

SEQ ID NO: 177025 - DNA, 25 bp, Mus musculus
accatgagccactgccagcgttcca

SEQ ID NO: 177026 - DNA, 25 bp, Mus musculus
accatgaggaggaagtcaacaccct

SEQ ID NO: 177027 - DNA, 25 bp, Mus musculus
accatgagttcaaagaaaatccctg

SEQ ID NO: 177028 - DNA, 25 bp, Mus musculus
accatgatattggaccatgtgtttc

SEQ ID NO: 177029 - DNA, 25 bp, Mus musculus
accatgatcttcctggacaaaccaa

SEQ ID NO: 177030 - DNA, 25 bp, Mus musculus
accatgatgaacatggaagggttat

SEQ ID NO: 177031 - DNA, 25 bp, Mus musculus
accatgatgaacatggtgaagattc

SEQ ID NO: 177032 - DNA, 25 bp, Mus musculus
accatgatgcatatcttcctcctgg

SEQ ID NO: 177033 - DNA, 25 bp, Mus musculus
accatgcaatcaatgtttgcaaaaa

SEQ ID NO: 177034 - DNA, 25 bp, Mus musculus
accatgcagagcgagatcaagaaat

SEQ ID NO: 177035 - DNA, 25 bp, Mus musculus
accatgcagggttctgaggaggact

SEQ ID NO: 177036 - DNA, 25 bp, Mus musculus
accatgcataggaagcaccttcagg

SEQ ID NO: 177037 - DNA, 25 bp, Mus musculus
accatgccaaacagagcatgctgga

SEQ ID NO: 177038 - DNA, 25 bp, Mus musculus
accatgccaaacagctgcagagaaa

SEQ ID NO: 177039 - DNA, 25 bp, Mus musculus
accatgccagtcttcccaccagatg

SEQ ID NO: 177040 - DNA, 25 bp, Mus musculus
accatgccatcaagaatgaggagat

SEQ ID NO: 177041 - DNA, 25 bp, Mus musculus
accatgccggcccgcaggcccaagc

SEQ ID NO: 177042 - DNA, 25 bp, Mus musculus
accatgccgggtggataccttggct

SEQ ID NO: 177043 - DNA, 25 bp, Mus musculus
accatgccttagtgggctgggtggg

SEQ ID NO: 177044 - DNA, 25 bp, Mus musculus
accatgcgaatgttcggagcgaccg

SEQ ID NO: 177045 - DNA, 25 bp, Mus musculus
accatgctccccacccccgatcttt

SEQ ID NO: 177046 - DNA, 25 bp, Mus musculus
accatgctccgagccgctggtttgt

SEQ ID NO: 177047 - DNA, 25 bp, Mus musculus
accatgctccgagggtctgactaca

SEQ ID NO: 177048 - DNA, 25 bp, Mus musculus
accatgctgaaaagagcaaggaacc

SEQ ID NO: 177049 - DNA, 25 bp, Mus musculus
accatgctgactcggctgaaagcaa

SEQ ID NO: 177050 - DNA, 25 bp, Mus musculus
accatgctgactcgggttatcttct

SEQ ID NO: 177051 - DNA, 25 bp, Mus musculus
accatgctggcaaagagtgatggcg

SEQ ID NO: 177052 - DNA, 25 bp, Mus musculus
accatgctgttcttttcaggggagt

SEQ ID NO: 177053 - DNA, 25 bp, Mus musculus
accatgcttcactagaaagaaaaat

SEQ ID NO: 177054 - DNA, 25 bp, Mus musculus
accatgcttctgtggacgcagacga

SEQ ID NO: 177055 - DNA, 25 bp, Mus musculus
accatggaaaccagaagcgaatgga

SEQ ID NO: 177056 - DNA, 25 bp, Mus musculus
accatggaaaccagtattgcagcac

SEQ ID NO: 177057 - DNA, 25 bp, Mus musculus
accatggaagagatctgtgaaggtt

SEQ ID NO: 177058 - DNA, 25 bp, Mus musculus
accatggaaggctcacccacgggca

SEQ ID NO: 177059 - DNA, 25 bp, Mus musculus
accatggacctagtccaaggcggtt

SEQ ID NO: 177060 - DNA, 25 bp, Mus musculus
accatggacgatctgtttcccctca

SEQ ID NO: 177061 - DNA, 25 bp, Mus musculus
accatggacttggcatctgggtgtt

SEQ ID NO: 177062 - DNA, 25 bp, Mus musculus
accatggacttgggaacacaccagt

SEQ ID NO: 177063 - DNA, 25 bp, Mus musculus
accatggagaacaagcattgatgat

SEQ ID NO: 177064 - DNA, 25 bp, Mus musculus
accatggagcgatggttgtcggtgc

SEQ ID NO: 177065 - DNA, 25 bp, Mus musculus
accatggagcgatgtacctgacctc

SEQ ID NO: 177066 - DNA, 25 bp, Mus musculus
accatggagcgatgtggacagaagt

SEQ ID NO: 177067 - DNA, 25 bp, Mus musculus
accatggcagaacaaaaatcagatg

SEQ ID NO: 177068 - DNA, 25 bp, Mus musculus
accatggcagaattttctcagcgtg

SEQ ID NO: 177069 - DNA, 25 bp, Mus musculus
accatggcagagcacctgacccagc

SEQ ID NO: 177070 - DNA, 25 bp, Mus musculus
accatggcagagcgatggcagcacc

SEQ ID NO: 177071 - DNA, 25 bp, Mus musculus
accatggcagcagcttctaggtgcg

SEQ ID NO: 177072 - DNA, 25 bp, Mus musculus
accatggcaggcagtgtggattgtc

SEQ ID NO: 177073 - DNA, 25 bp, Mus musculus
accatggcaggggagtcctcatgga

SEQ ID NO: 177074 - DNA, 25 bp, Mus musculus
accatggcaggtacagagctatcgt

SEQ ID NO: 177075 - DNA, 25 bp, Mus musculus
accatggccaagatggagttccaga

SEQ ID NO: 177076 - DNA, 25 bp, Mus musculus
accatggccagggctctgacagctt

SEQ ID NO: 177077 - DNA, 25 bp, Mus musculus
accatggccagtgaggtgttcggaa

SEQ ID NO: 177078 - DNA, 25 bp, Mus musculus
accatggcccgtattcggaaactaa

SEQ ID NO: 177079 - DNA, 25 bp, Mus musculus
accatggcccgtgatgcttcatttc

SEQ ID NO: 177080 - DNA, 25 bp, Mus musculus
accatggcccgtgtgtcagtggtgt

SEQ ID NO: 177081 - DNA, 25 bp, Mus musculus
accatggccttatgttgacttactt

SEQ ID NO: 177082 - DNA, 25 bp, Mus musculus
accatggcggctgggaccctgtaca

SEQ ID NO: 177083 - DNA, 25 bp, Mus musculus
accatggctcactggtcctgcgact

SEQ ID NO: 177084 - DNA, 25 bp, Mus musculus
accatggctctggggttggttctgg

SEQ ID NO: 177085 - DNA, 25 bp, Mus musculus
accatggctgatcatcactccgttc

SEQ ID NO: 177086 - DNA, 25 bp, Mus musculus
accatggcttaaaagagtctccccc

SEQ ID NO: 177087 - DNA, 25 bp, Mus musculus
accatggcttaaaagccgaagaagc

SEQ ID NO: 177088 - DNA, 25 bp, Mus musculus
accatggcttaaaagctcgtgtggc

SEQ ID NO: 177089 - DNA, 25 bp, Mus musculus
accatgggaagatcccaacgctggt

SEQ ID NO: 177090 - DNA, 25 bp, Mus musculus
accatgggaaggatcatgcgtccag

SEQ ID NO: 177091 - DNA, 25 bp, Mus musculus
accatgggaccggtccaacgggcgc

SEQ ID NO: 177092 - DNA, 25 bp, Mus musculus
accatgggcaatgacacgtccccat

SEQ ID NO: 177093 - DNA, 25 bp, Mus musculus
accatggggcctttagatgggaaag

SEQ ID NO: 177094 - DNA, 25 bp, Mus musculus
accatggtcatcggaaattaccgga

SEQ ID NO: 177095 - DNA, 25 bp, Mus musculus
accatggtcatcggcaactatcgaa

SEQ ID NO: 177096 - DNA, 25 bp, Mus musculus
accatggtgaagatttacccaataa

SEQ ID NO: 177097 - DNA, 25 bp, Mus musculus
accatggtgaagctaatctggaaat

SEQ ID NO: 177098 - DNA, 25 bp, Mus musculus
accatggtgaagggaatgtacggca

SEQ ID NO: 177099 - DNA, 25 bp, Mus musculus
accatggtgagcccattggccgggg

SEQ ID NO: 177100 - DNA, 25 bp, Mus musculus
accatggtgggacagggcaagaccg

SEQ ID NO: 177101 - DNA, 25 bp, Mus musculus
accatgtatacacatgccgatgaat

SEQ ID NO: 177102 - DNA, 25 bp, Mus musculus
accatgtatacagatgccgatgaat

SEQ ID NO: 177103 - DNA, 25 bp, Mus musculus
accatgtatggcaaggatttaatta

SEQ ID NO: 177104 - DNA, 25 bp, Mus musculus
accatgtatggcaaggctggccttc

SEQ ID NO: 177105 - DNA, 25 bp, Mus musculus
accatgtccagattcggaaactaag

SEQ ID NO: 177106 - DNA, 25 bp, Mus musculus
accatgtgaagttccgctcgctgtc

SEQ ID NO: 177107 - DNA, 25 bp, Mus musculus
accatgtgattctggaggagcaaaa

SEQ ID NO: 177108 - DNA, 25 bp, Mus musculus
accatgtgcaggacccaaggctgga

SEQ ID NO: 177109 - DNA, 25 bp, Mus musculus
accatgtgctgcacaatcctggagg

SEQ ID NO: 177110 - DNA, 25 bp, Mus musculus
accatgtgtgagcacgtgaatgagt

SEQ ID NO: 177111 - DNA, 25 bp, Mus musculus
accatgtgtgaggacgtgaatgagt

SEQ ID NO: 177112 - DNA, 25 bp, Mus musculus
accatgttccggcttttccccagtc

SEQ ID NO: 177113 - DNA, 25 bp, Mus musculus
accatgtttgcagccagcagcaagt

SEQ ID NO: 177114 - DNA, 25 bp, Mus musculus
accattaaaaagcctcaagcccaag

SEQ ID NO: 177115 - DNA, 25 bp, Mus musculus
accattaaaaagctcactctgcaga

SEQ ID NO: 177116 - DNA, 25 bp, Mus musculus
accattaaaagggggaggagtgtct

SEQ ID NO: 177117 - DNA, 25 bp, Mus musculus
accattaactttagcccagaaacta

SEQ ID NO: 177118 - DNA, 25 bp, Mus musculus
accattaactttaggtgctgctttc

SEQ ID NO: 177119 - DNA, 25 bp, Mus musculus
accattaataaggaccaaaatgtct

SEQ ID NO: 177120 - DNA, 25 bp, Mus musculus
accattaatctgtacccgcttacca

SEQ ID NO: 177121 - DNA, 25 bp, Mus musculus
accattacagaagctgaaccggaag

SEQ ID NO: 177122 - DNA, 25 bp, Mus musculus
accattacagccatccccaggcagt

SEQ ID NO: 177123 - DNA, 25 bp, Mus musculus
accattaccaaggtcccttcagaga

SEQ ID NO: 177124 - DNA, 25 bp, Mus musculus
accattactctacggctggcccgct

SEQ ID NO: 177125 - DNA, 25 bp, Mus musculus
accattactgggggatgcagagagc

SEQ ID NO: 177126 - DNA, 25 bp, Mus musculus
accattagacaagccctgacgtcaa

SEQ ID NO: 177127 - DNA, 25 bp, Mus musculus
accattagtatagcaagaagccagt

SEQ ID NO: 177128 - DNA, 25 bp, Mus musculus
accattagtcagagaattgtaagtg

SEQ ID NO: 177129 - DNA, 25 bp, Mus musculus
accattatcaagttctcagatgaat

SEQ ID NO: 177130 - DNA, 25 bp, Mus musculus
accattcaaaatacaagtcctggtt

SEQ ID NO: 177131 - DNA, 25 bp, Mus musculus
accattcaaatcctggttgaagctg

SEQ ID NO: 177132 - DNA, 25 bp, Mus musculus
accattcacacgggaagagtcaccg

SEQ ID NO: 177133 - DNA, 25 bp, Mus musculus
accattcacacgggatgaaattgtt

SEQ ID NO: 177134 - DNA, 25 bp, Mus musculus
accattcatctgggaatgattttgc

SEQ ID NO: 177135 - DNA, 25 bp, Mus musculus
accattccggagtgagaacaatctc

SEQ ID NO: 177136 - DNA, 25 bp, Mus musculus
accattcctatgatcgtcatcttct

SEQ ID NO: 177137 - DNA, 25 bp, Mus musculus
accattcctccaggaacaacaggca

SEQ ID NO: 177138 - DNA, 25 bp, Mus musculus
accattcctccaggtacatttgatt

SEQ ID NO: 177139 - DNA, 25 bp, Mus musculus
accattcctccaggtcttgccgtca

SEQ ID NO: 177140 - DNA, 25 bp, Mus musculus
accattctcaagaggtctgaatttc

SEQ ID NO: 177141 - DNA, 25 bp, Mus musculus
accattctcacagagatgaggcttg

SEQ ID NO: 177142 - DNA, 25 bp, Mus musculus
accattctcacagagtgttctccat

SEQ ID NO: 177143 - DNA, 25 bp, Mus musculus
accattgaaatcccagcctgcagtt

SEQ ID NO: 177144 - DNA, 25 bp, Mus musculus
accattgaagatgatgactattctc

SEQ ID NO: 177145 - DNA, 25 bp, Mus musculus
accattgaaggtcctcaactttgac

SEQ ID NO: 177146 - DNA, 25 bp, Mus musculus
accattgaatatactgttgaatcaa

SEQ ID NO: 177147 - DNA, 25 bp, Mus musculus
accattgagactgacaatttatttc

SEQ ID NO: 177148 - DNA, 25 bp, Mus musculus
accattgagactgccaaacaagaag

SEQ ID NO: 177149 - DNA, 25 bp, Mus musculus
accattgaggttgagcaacattttg

SEQ ID NO: 177150 - DNA, 25 bp, Mus musculus
accattgaggttgagggaatagcca

SEQ ID NO: 177151 - DNA, 25 bp, Mus musculus
accattgaggttgaggtgtcctcaa

SEQ ID NO: 177152 - DNA, 25 bp, Mus musculus
accattgagtacatggccccagaga

SEQ ID NO: 177153 - DNA, 25 bp, Mus musculus
accattgcaaatgctgaaaaaggag

SEQ ID NO: 177154 - DNA, 25 bp, Mus musculus
accattgcaaatgctgagtgaatta

SEQ ID NO: 177155 - DNA, 25 bp, Mus musculus
accattgccagaatggaccatctgc

SEQ ID NO: 177156 - DNA, 25 bp, Mus musculus
accattgcccgcaattgggcagatg

SEQ ID NO: 177157 - DNA, 25 bp, Mus musculus
accattgccgcaggaacaccccaat

SEQ ID NO: 177158 - DNA, 25 bp, Mus musculus
accattgccgcaggggtgatgttta

SEQ ID NO: 177159 - DNA, 25 bp, Mus musculus
accattgctggggtggagaccatca

SEQ ID NO: 177160 - DNA, 25 bp, Mus musculus
accattgctggtcaacgtcctgcat

SEQ ID NO: 177161 - DNA, 25 bp, Mus musculus
accattggaggaataaacattgctg

SEQ ID NO: 177162 - DNA, 25 bp, Mus musculus
accattggagggttcccagtgggaa

SEQ ID NO: 177163 - DNA, 25 bp, Mus musculus
accattggcaagggcacagtcagtg

SEQ ID NO: 177164 - DNA, 25 bp, Mus musculus
accattggctggattgctgctggac

SEQ ID NO: 177165 - DNA, 25 bp, Mus musculus
accattggtctgcaggcaccgctcc

SEQ ID NO: 177166 - DNA, 25 bp, Mus musculus
accattgtgacagagtgggacttgg

SEQ ID NO: 177167 - DNA, 25 bp, Mus musculus
accatttagatctgaacaatgccca

SEQ ID NO: 177168 - DNA, 25 bp, Mus musculus
accatttatggaagccctgcagagg

SEQ ID NO: 177169 - DNA, 25 bp, Mus musculus
accatttcagacctcaagtggaacc

SEQ ID NO: 177170 - DNA, 25 bp, Mus musculus
accatttcagagtcagcttgcgaag

SEQ ID NO: 177171 - DNA, 25 bp, Mus musculus
accatttcagtcaggaagtcctacc

SEQ ID NO: 177172 - DNA, 25 bp, Mus musculus
accatttctaagcaggctgaggtct

SEQ ID NO: 177173 - DNA, 25 bp, Mus musculus
accatttgaacagccctgctttaag

SEQ ID NO: 177174 - DNA, 25 bp, Mus musculus
accatttgaacaggtcttatgcaag

SEQ ID NO: 177175 - DNA, 25 bp, Mus musculus
accatttgcagaggcaggcaggttt

SEQ ID NO: 177176 - DNA, 25 bp, Mus musculus
accatttgtggggcggatgtctgct

SEQ ID NO: 177177 - DNA, 25 bp, Mus musculus
accatttgtggggtctcaaagcaag

SEQ ID NO: 177178 - DNA, 25 bp, Mus musculus
accattttgacaagaagcagacagg

SEQ ID NO: 177179 - DNA, 25 bp, Mus musculus
accattttgacaaggaccatggcgg

SEQ ID NO: 177180 - DNA, 25 bp, Mus musculus
acccaaaacaagctaatgtctgcga

SEQ ID NO: 177181 - DNA, 25 bp, Mus musculus
acccaaaacaagttgctcccaaatt

SEQ ID NO: 177182 - DNA, 25 bp, Mus musculus
acccaaaagagaaaaggaagcagta

SEQ ID NO: 177183 - DNA, 25 bp, Mus musculus
acccaaaagcaaggatgaagtggcc

SEQ ID NO: 177184 - DNA, 25 bp, Mus musculus
acccaaacatagtgaagttgttcga

SEQ ID NO: 177185 - DNA, 25 bp, Mus musculus
acccaaacattatagccagtgatgg

SEQ ID NO: 177186 - DNA, 25 bp, Mus musculus
acccaaacattataggatatcgtgc

SEQ ID NO: 177187 - DNA, 25 bp, Mus musculus
acccaaaccagggtgtggacattgt

SEQ ID NO: 177188 - DNA, 25 bp, Mus musculus
acccaaaccaggtgtatatcaacat

SEQ ID NO: 177189 - DNA, 25 bp, Mus musculus
acccaaacggatgaaaaccgtcaag

SEQ ID NO: 177190 - DNA, 25 bp, Mus musculus
acccaaagagcccagcaaaggaagc

SEQ ID NO: 177191 - DNA, 25 bp, Mus musculus
acccaaagtcagagaagtcctgcat

SEQ ID NO: 177192 - DNA, 25 bp, Mus musculus
acccaaagtccaggatgttgtacca

SEQ ID NO: 177193 - DNA, 25 bp, Mus musculus
acccaaatagcgctggcgtggatgc

SEQ ID NO: 177194 - DNA, 25 bp, Mus musculus
acccaaattgacaggtagctacatc

SEQ ID NO: 177195 - DNA, 25 bp, Mus musculus
acccaaccaatggcttcgagctgta

SEQ ID NO: 177196 - DNA, 25 bp, Mus musculus
acccaaccaggtgatgagactatcc

SEQ ID NO: 177197 - DNA, 25 bp, Mus musculus
acccaaccatatgagagtctgtgga

SEQ ID NO: 177198 - DNA, 25 bp, Mus musculus
acccaacccggaggaccaggactga

SEQ ID NO: 177199 - DNA, 25 bp, Mus musculus
acccaacgacattgtgtacctcatc

SEQ ID NO: 177200 - DNA, 25 bp, Mus musculus
acccaacgttcagaaccccaaatct

SEQ ID NO: 177201 - DNA, 25 bp, Mus musculus
acccaactatactgtcactgccctg

SEQ ID NO: 177202 - DNA, 25 bp, Mus musculus
acccaacttcaggtaccaatgggga

SEQ ID NO: 177203 - DNA, 25 bp, Mus musculus
acccaagaaaatgatctgaatttct

SEQ ID NO: 177204 - DNA, 25 bp, Mus musculus
acccaagaaaatggatgagtatgtg

SEQ ID NO: 177205 - DNA, 25 bp, Mus musculus
acccaagaagtctagaaattctgtg

SEQ ID NO: 177206 - DNA, 25 bp, Mus musculus
acccaagaagtctagggcacttgat

SEQ ID NO: 177207 - DNA, 25 bp, Mus musculus
acccaagaagtgagaacggagcacc

SEQ ID NO: 177208 - DNA, 25 bp, Mus musculus
acccaagaagtgaggccgggagcag

SEQ ID NO: 177209 - DNA, 25 bp, Mus musculus
acccaagacaagttcgagaaatggt

SEQ ID NO: 177210 - DNA, 25 bp, Mus musculus
acccaagagcagagagatcatctcc

SEQ ID NO: 177211 - DNA, 25 bp, Mus musculus
acccaagaggctggggtctcagaat

SEQ ID NO: 177212 - DNA, 25 bp, Mus musculus
acccaagagtgatggaaagaactca

SEQ ID NO: 177213 - DNA, 25 bp, Mus musculus
acccaagcccaggacaccgtgcatt

SEQ ID NO: 177214 - DNA, 25 bp, Mus musculus
acccaagcccagttccacaagagga

SEQ ID NO: 177215 - DNA, 25 bp, Mus musculus
acccaagcggaaggagcatagtgaa

SEQ ID NO: 177216 - DNA, 25 bp, Mus musculus
acccaagctgctttctggcttgctg

SEQ ID NO: 177217 - DNA, 25 bp, Mus musculus
acccaaggaatgattcccgttgcgc

SEQ ID NO: 177218 - DNA, 25 bp, Mus musculus
acccaaggaggccaaaaaagtggat

SEQ ID NO: 177219 - DNA, 25 bp, Mus musculus
acccaaggagggtcaaaaggcaagc

SEQ ID NO: 177220 - DNA, 25 bp, Mus musculus
acccaaggtgctacaagaaatgtct

SEQ ID NO: 177221 - DNA, 25 bp, Mus musculus
acccaaggtgctacagtggggataa

SEQ ID NO: 177222 - DNA, 25 bp, Mus musculus
acccaagtcatcttggctgaagagg

SEQ ID NO: 177223 - DNA, 25 bp, Mus musculus
acccaagtgcgagatgttgcatgtg

SEQ ID NO: 177224 - DNA, 25 bp, Mus musculus
acccaagtgcgaggaaaaatccgct

SEQ ID NO: 177225 - DNA, 25 bp, Mus musculus
acccaagttacgtaatcattgcaac

SEQ ID NO: 177226 - DNA, 25 bp, Mus musculus
acccaagttgcatttaaatattaga

SEQ ID NO: 177227 - DNA, 25 bp, Mus musculus
acccaagttgctggacaaatttgcc

SEQ ID NO: 177228 - DNA, 25 bp, Mus musculus
acccaatacagtgttatttctgctc

SEQ ID NO: 177229 - DNA, 25 bp, Mus musculus
acccaatatttcagctaaactctgt

SEQ ID NO: 177230 - DNA, 25 bp, Mus musculus
acccaatatttcaggtttcacagac

SEQ ID NO: 177231 - DNA, 25 bp, Mus musculus
acccaatcagggggagatcttggta

SEQ ID NO: 177232 - DNA, 25 bp, Mus musculus
acccaatcaggtgatccgcaggggc

SEQ ID NO: 177233 - DNA, 25 bp, Mus musculus
acccaatccagagctaagctaggaa

SEQ ID NO: 177234 - DNA, 25 bp, Mus musculus
acccaatccagcatacagagctaag

SEQ ID NO: 177235 - DNA, 25 bp, Mus musculus
acccaatgaaaaaaggctctggaat

SEQ ID NO: 177236 - DNA, 25 bp, Mus musculus
acccaatgaacttgtttttaatctg

SEQ ID NO: 177237 - DNA, 25 bp, Mus musculus
acccaatggaggttctgaagacccg

SEQ ID NO: 177238 - DNA, 25 bp, Mus musculus
acccaattgatcatgggccctgggg

SEQ ID NO: 177239 - DNA, 25 bp, Mus musculus
acccacaaaagcagctatgccccct

SEQ ID NO: 177240 - DNA, 25 bp, Mus musculus
acccacaaacaggtcagcccttctt

SEQ ID NO: 177241 - DNA, 25 bp, Mus musculus
acccacacacaagtctggccacaga

SEQ ID NO: 177242 - DNA, 25 bp, Mus musculus
acccacacatagagagactgagaac

SEQ ID NO: 177243 - DNA, 25 bp, Mus musculus
acccacaccacgactactgtgaaga

SEQ ID NO: 177244 - DNA, 25 bp, Mus musculus
acccacacctcacaaattgaagtga

SEQ ID NO: 177245 - DNA, 25 bp, Mus musculus
acccacactgcactgcagaagggac

SEQ ID NO: 177246 - DNA, 25 bp, Mus musculus
acccacactgctgagaagccattct

SEQ ID NO: 177247 - DNA, 25 bp, Mus musculus
acccacactggactgcagaagggac

SEQ ID NO: 177248 - DNA, 25 bp, Mus musculus
acccacactggtgagaagccattct

SEQ ID NO: 177249 - DNA, 25 bp, Mus musculus
acccacagaacgagagcgccatctg

SEQ ID NO: 177250 - DNA, 25 bp, Mus musculus
acccacagagaaatgatctcctgtc

SEQ ID NO: 177251 - DNA, 25 bp, Mus musculus
acccacagagaggccgtgagaccag

SEQ ID NO: 177252 - DNA, 25 bp, Mus musculus
acccacagagatataaactacactc

SEQ ID NO: 177253 - DNA, 25 bp, Mus musculus
acccacagaggacgacaatgaggat

SEQ ID NO: 177254 - DNA, 25 bp, Mus musculus
acccacagagggagcatgacttcgg

SEQ ID NO: 177255 - DNA, 25 bp, Mus musculus
acccacagccccgcagacactgggt

SEQ ID NO: 177256 - DNA, 25 bp, Mus musculus
acccacagccgcagccttaccagcc

SEQ ID NO: 177257 - DNA, 25 bp, Mus musculus
acccacagccgcagcgtcctcagaa

SEQ ID NO: 177258 - DNA, 25 bp, Mus musculus
acccacaggaaccagctgatggcca

SEQ ID NO: 177259 - DNA, 25 bp, Mus musculus
acccacaggacagagttcctgtagt

SEQ ID NO: 177260 - DNA, 25 bp, Mus musculus
acccacaggccagccttcttgctaa

SEQ ID NO: 177261 - DNA, 25 bp, Mus musculus
acccacagttcagaaactgtgaagt

SEQ ID NO: 177262 - DNA, 25 bp, Mus musculus
acccacatgtcacagctaaagtcca

SEQ ID NO: 177263 - DNA, 25 bp, Mus musculus
acccaccaaagcacagtgtcctcaa

SEQ ID NO: 177264 - DNA, 25 bp, Mus musculus
acccaccaagaataaagcgctaact

SEQ ID NO: 177265 - DNA, 25 bp, Mus musculus
acccaccaccccaggcccagagtct

SEQ ID NO: 177266 - DNA, 25 bp, Mus musculus
acccaccacgggagccaggtatgcc

SEQ ID NO: 177267 - DNA, 25 bp, Mus musculus
acccaccagagagtgctgatcccag

SEQ ID NO: 177268 - DNA, 25 bp, Mus musculus
acccaccagagcccgagacagtgat

SEQ ID NO: 177269 - DNA, 25 bp, Mus musculus
acccaccaggaagtacccagcgagc

SEQ ID NO: 177270 - DNA, 25 bp, Mus musculus
acccaccaggcaaggtactggtgag

SEQ ID NO: 177271 - DNA, 25 bp, Mus musculus
acccaccatcatcagagagcttcat

SEQ ID NO: 177272 - DNA, 25 bp, Mus musculus
acccaccatcatcagtgtcccttgg

SEQ ID NO: 177273 - DNA, 25 bp, Mus musculus
acccaccatgtatgcttgagagttc

SEQ ID NO: 177274 - DNA, 25 bp, Mus musculus
acccacccaggaacaattgtgagaa

SEQ ID NO: 177275 - DNA, 25 bp, Mus musculus
acccaccctgaaaagtgcaggtgtg

SEQ ID NO: 177276 - DNA, 25 bp, Mus musculus
acccaccgccaagagaataaagact

SEQ ID NO: 177277 - DNA, 25 bp, Mus musculus
acccaccgccaagatggattcatgg

SEQ ID NO: 177278 - DNA, 25 bp, Mus musculus
acccacctaagacagcgaaggtgtc

SEQ ID NO: 177279 - DNA, 25 bp, Mus musculus
acccacctatgtgctcccaagatgc

SEQ ID NO: 177280 - DNA, 25 bp, Mus musculus
acccacctgcaagattctggtgcta

SEQ ID NO: 177281 - DNA, 25 bp, Mus musculus
acccacctgcaagtctacagagagc

SEQ ID NO: 177282 - DNA, 25 bp, Mus musculus
acccacctttggaatgactattcca

SEQ ID NO: 177283 - DNA, 25 bp, Mus musculus
acccacgaaatggcaaatcccaaat

SEQ ID NO: 177284 - DNA, 25 bp, Mus musculus
acccacgaagggcgaatcgccagga

SEQ ID NO: 177285 - DNA, 25 bp, Mus musculus
acccacgcaagatggctgccagcaa

SEQ ID NO: 177286 - DNA, 25 bp, Mus musculus
acccacgcacgaaaaacactctgtt

SEQ ID NO: 177287 - DNA, 25 bp, Mus musculus
acccacggcctctggactgccatca

SEQ ID NO: 177288 - DNA, 25 bp, Mus musculus
acccacggcctctggtgtttgcaga

SEQ ID NO: 177289 - DNA, 25 bp, Mus musculus
acccacgtctcttcaacagactccc

SEQ ID NO: 177290 - DNA, 25 bp, Mus musculus
acccactcagaaaagcggccttata

SEQ ID NO: 177291 - DNA, 25 bp, Mus musculus
acccactccaggcagcttcttcggc

SEQ ID NO: 177292 - DNA, 25 bp, Mus musculus
acccactgaagatgatgcttctgtg

SEQ ID NO: 177293 - DNA, 25 bp, Mus musculus
acccactgaagatggactggaaaca

SEQ ID NO: 177294 - DNA, 25 bp, Mus musculus
acccacttacacaggccgccccggg

SEQ ID NO: 177295 - DNA, 25 bp, Mus musculus
acccacttactggtgcccggcgccc

SEQ ID NO: 177296 - DNA, 25 bp, Mus musculus
acccacttctcttagagtgtggggc

SEQ ID NO: 177297 - DNA, 25 bp, Mus musculus
acccagaaaagaaggtctctggtaa

SEQ ID NO: 177298 - DNA, 25 bp, Mus musculus
acccagaaagcatctgcatctctaa

SEQ ID NO: 177299 - DNA, 25 bp, Mus musculus
acccagaaattgaagagaaacttca

SEQ ID NO: 177300 - DNA, 25 bp, Mus musculus
acccagaagacacgaaggcaaccaa

SEQ ID NO: 177301 - DNA, 25 bp, Mus musculus
acccagaagacacggatactgagaa

SEQ ID NO: 177302 - DNA, 25 bp, Mus musculus
acccagaagactgcgctgagtggac

SEQ ID NO: 177303 - DNA, 25 bp, Mus musculus
acccagaagcaagacgcgggcgatc

SEQ ID NO: 177304 - DNA, 25 bp, Mus musculus
acccagaagcaaggggtggatgaga

SEQ ID NO: 177305 - DNA, 25 bp, Mus musculus
acccagaagtacgtgggacctctta

SEQ ID NO: 177306 - DNA, 25 bp, Mus musculus
acccagaattaggtatcgaagtgag

SEQ ID NO: 177307 - DNA, 25 bp, Mus musculus
acccagacaagggaggatctcctta

SEQ ID NO: 177308 - DNA, 25 bp, Mus musculus
acccagacaagggccctctggtgga

SEQ ID NO: 177309 - DNA, 25 bp, Mus musculus
acccagacaagtaggtatcgcaggg

SEQ ID NO: 177310 - DNA, 25 bp, Mus musculus
acccagacacaagcattcccactat

SEQ ID NO: 177311 - DNA, 25 bp, Mus musculus
acccagacaggtgcgtggtccaacg

SEQ ID NO: 177312 - DNA, 25 bp, Mus musculus
acccagacagtcaggatggtgtcac

SEQ ID NO: 177313 - DNA, 25 bp, Mus musculus
acccagacatgctgctcatcgggaa

SEQ ID NO: 177314 - DNA, 25 bp, Mus musculus
acccagagaacaggctgtgaaaaca

SEQ ID NO: 177315 - DNA, 25 bp, Mus musculus
acccagagaagagtaaactggtgca

SEQ ID NO: 177316 - DNA, 25 bp, Mus musculus
acccagagaagagtgacagcagcta

SEQ ID NO: 177317 - DNA, 25 bp, Mus musculus
acccagagaagatgtgagcccacct

SEQ ID NO: 177318 - DNA, 25 bp, Mus musculus
acccagagaaggcccagcttgggac

SEQ ID NO: 177319 - DNA, 25 bp, Mus musculus
acccagagatcagaggatgcagcac

SEQ ID NO: 177320 - DNA, 25 bp, Mus musculus
acccagagccctttggatccagcca

SEQ ID NO: 177321 - DNA, 25 bp, Mus musculus
acccagagctaaggttcccgaggag

SEQ ID NO: 177322 - DNA, 25 bp, Mus musculus
acccagagcttagttcacaagccag

SEQ ID NO: 177323 - DNA, 25 bp, Mus musculus
acccagaggagaaggaggagcaggc

SEQ ID NO: 177324 - DNA, 25 bp, Mus musculus
acccagaggagatgctgtctatgta

SEQ ID NO: 177325 - DNA, 25 bp, Mus musculus
acccagaggagattgagaaggagga

SEQ ID NO: 177326 - DNA, 25 bp, Mus musculus
acccagaggagggagtgagctactt

SEQ ID NO: 177327 - DNA, 25 bp, Mus musculus
acccagaggcggacccaccctcagc

SEQ ID NO: 177328 - DNA, 25 bp, Mus musculus
acccagagggaagtgggctaaagcc

SEQ ID NO: 177329 - DNA, 25 bp, Mus musculus
acccagagtgattgacagggagggt

SEQ ID NO: 177330 - DNA, 25 bp, Mus musculus
acccagataaccaggtgattgttca

SEQ ID NO: 177331 - DNA, 25 bp, Mus musculus
acccagataccagattaagcttgca

SEQ ID NO: 177332 - DNA, 25 bp, Mus musculus
acccagataccattaaaaagagaaa

SEQ ID NO: 177333 - DNA, 25 bp, Mus musculus
acccagatatttgcgaacaaggagc

SEQ ID NO: 177334 - DNA, 25 bp, Mus musculus
acccagatcccaaacctagagactg

SEQ ID NO: 177335 - DNA, 25 bp, Mus musculus
acccagatcccagaacactgcggcc

SEQ ID NO: 177336 - DNA, 25 bp, Mus musculus
acccagatcccaggcctctatggcc

SEQ ID NO: 177337 - DNA, 25 bp, Mus musculus
acccagattcaaactgccgtggtga

SEQ ID NO: 177338 - DNA, 25 bp, Mus musculus
acccagattccaggataacataaat

SEQ ID NO: 177339 - DNA, 25 bp, Mus musculus
acccagcaaccaggagctggagccc

SEQ ID NO: 177340 - DNA, 25 bp, Mus musculus
acccagcaagaaaaagccacaaatg

SEQ ID NO: 177341 - DNA, 25 bp, Mus musculus
acccagcaagccaagctgatctata

SEQ ID NO: 177342 - DNA, 25 bp, Mus musculus
acccagcacctgcgcttagatccgg

SEQ ID NO: 177343 - DNA, 25 bp, Mus musculus
acccagcacctgcggaaaatttccc

SEQ ID NO: 177344 - DNA, 25 bp, Mus musculus
acccagcatacgggcaccttgttgt

SEQ ID NO: 177345 - DNA, 25 bp, Mus musculus
acccagcatagccccttcacagaat

SEQ ID NO: 177346 - DNA, 25 bp, Mus musculus
acccagcatgagtccgcagagtcct

SEQ ID NO: 177347 - DNA, 25 bp, Mus musculus
acccagccaaagccctggactattt

SEQ ID NO: 177348 - DNA, 25 bp, Mus musculus
acccagccactccagctcccggcaa

SEQ ID NO: 177349 - DNA, 25 bp, Mus musculus
acccagccagccccggaaagccagt

SEQ ID NO: 177350 - DNA, 25 bp, Mus musculus
acccagccagggttgtcgccctgga

SEQ ID NO: 177351 - DNA, 25 bp, Mus musculus
acccagccatgcctatggaggccat

SEQ ID NO: 177352 - DNA, 25 bp, Mus musculus
acccagccatgctatcccaatagaa

SEQ ID NO: 177353 - DNA, 25 bp, Mus musculus
acccagcccagaacaagcctgccat

SEQ ID NO: 177354 - DNA, 25 bp, Mus musculus
acccagcccagaagtaccattcccg

SEQ ID NO: 177355 - DNA, 25 bp, Mus musculus
acccagcccagagatacattgttgc

SEQ ID NO: 177356 - DNA, 25 bp, Mus musculus
acccagcccaggtccctgtggcccc

SEQ ID NO: 177357 - DNA, 25 bp, Mus musculus
acccagcccaggtgaggaattttaa

SEQ ID NO: 177358 - DNA, 25 bp, Mus musculus
acccagcccaggttccgagtccgag

SEQ ID NO: 177359 - DNA, 25 bp, Mus musculus
acccagcctggccgcagaagagcgt

SEQ ID NO: 177360 - DNA, 25 bp, Mus musculus
acccagcctggtctatacagaggaa

SEQ ID NO: 177361 - DNA, 25 bp, Mus musculus
acccagctacaagaggaatcattga

SEQ ID NO: 177362 - DNA, 25 bp, Mus musculus
acccagctcagtggatctggcgagt

SEQ ID NO: 177363 - DNA, 25 bp, Mus musculus
acccagctccaggactcccctgagg

SEQ ID NO: 177364 - DNA, 25 bp, Mus musculus
acccagctccagttaacctgtggaa

SEQ ID NO: 177365 - DNA, 25 bp, Mus musculus
acccagctcccagctaaatgtggtc

SEQ ID NO: 177366 - DNA, 25 bp, Mus musculus
acccagctggagaaagattccagtt

SEQ ID NO: 177367 - DNA, 25 bp, Mus musculus
acccagctggaggtcacctcagcac

SEQ ID NO: 177368 - DNA, 25 bp, Mus musculus
acccagcttcagctgtttgttcagg

SEQ ID NO: 177369 - DNA, 25 bp, Mus musculus
acccaggaaagagacatggcaagtg

SEQ ID NO: 177370 - DNA, 25 bp, Mus musculus
acccaggaaagaggtgcccactcat

SEQ ID NO: 177371 - DNA, 25 bp, Mus musculus
acccaggaatatattccaatgcaag

SEQ ID NO: 177372 - DNA, 25 bp, Mus musculus
acccaggaatattggcagtgctgtg

SEQ ID NO: 177373 - DNA, 25 bp, Mus musculus
acccaggacagacagctgcagcacg

SEQ ID NO: 177374 - DNA, 25 bp, Mus musculus
acccaggacgagggcttcatcactg

SEQ ID NO: 177375 - DNA, 25 bp, Mus musculus
acccaggagagaaggatgtgcgggc

SEQ ID NO: 177376 - DNA, 25 bp, Mus musculus
acccaggagatgaagtgataattat

SEQ ID NO: 177377 - DNA, 25 bp, Mus musculus
acccaggagggtgtctccaaacaaa

SEQ ID NO: 177378 - DNA, 25 bp, Mus musculus
acccaggcaagttctgcctgctgag

SEQ ID NO: 177379 - DNA, 25 bp, Mus musculus
acccaggcaccagaaacctcatcca

SEQ ID NO: 177380 - DNA, 25 bp, Mus musculus
acccaggcaccagccagtaagtgct

SEQ ID NO: 177381 - DNA, 25 bp, Mus musculus
acccaggcaccaggttgctccagga

SEQ ID NO: 177382 - DNA, 25 bp, Mus musculus
acccaggcaccagtgtgtccattgt

SEQ ID NO: 177383 - DNA, 25 bp, Mus musculus
acccaggcactcggggtcctgagaa

SEQ ID NO: 177384 - DNA, 25 bp, Mus musculus
acccaggcataggtcacctccaagg

SEQ ID NO: 177385 - DNA, 25 bp, Mus musculus
acccaggcatcacagagctctgcag

SEQ ID NO: 177386 - DNA, 25 bp, Mus musculus
acccaggcatctctcccttctgcat

SEQ ID NO: 177387 - DNA, 25 bp, Mus musculus
acccaggccaaggaggagtcagaaa

SEQ ID NO: 177388 - DNA, 25 bp, Mus musculus
acccaggccactgagtcttctggcc

SEQ ID NO: 177389 - DNA, 25 bp, Mus musculus
acccaggccagatgaacgatggacc

SEQ ID NO: 177390 - DNA, 25 bp, Mus musculus
acccaggcccaggtgttatctgcag

SEQ ID NO: 177391 - DNA, 25 bp, Mus musculus
acccaggcgggtatggtggggctcc

SEQ ID NO: 177392 - DNA, 25 bp, Mus musculus
acccaggcgtggcggacccaggcac

SEQ ID NO: 177393 - DNA, 25 bp, Mus musculus
acccaggctccaccaaacgtggtcc

SEQ ID NO: 177394 - DNA, 25 bp, Mus musculus
acccaggctcccactggcctcatgt

SEQ ID NO: 177395 - DNA, 25 bp, Mus musculus
acccaggctcgggggctgcccctgg

SEQ ID NO: 177396 - DNA, 25 bp, Mus musculus
acccaggctcggggggaaagaggag

SEQ ID NO: 177397 - DNA, 25 bp, Mus musculus
acccaggctctgtgatcgtggcctt

SEQ ID NO: 177398 - DNA, 25 bp, Mus musculus
acccaggctgccggaaccagctgtc

SEQ ID NO: 177399 - DNA, 25 bp, Mus musculus
acccaggctgttcagaaggctgtgg

SEQ ID NO: 177400 - DNA, 25 bp, Mus musculus
acccaggctgttcaggtcctgctct

SEQ ID NO: 177401 - DNA, 25 bp, Mus musculus
acccagggaaaagttattaaatgca

SEQ ID NO: 177402 - DNA, 25 bp, Mus musculus
acccagggaaggtgctgtgggacgg

SEQ ID NO: 177403 - DNA, 25 bp, Mus musculus
acccagggccggagataatagaatc

SEQ ID NO: 177404 - DNA, 25 bp, Mus musculus
acccagggtccacctggtgctacag

SEQ ID NO: 177405 - DNA, 25 bp, Mus musculus
acccagggtcctcactgcagtgggc

SEQ ID NO: 177406 - DNA, 25 bp, Mus musculus
acccagggtcctgtttgggcttcct

SEQ ID NO: 177407 - DNA, 25 bp, Mus musculus
acccaggtggatggaacatgaagct

SEQ ID NO: 177408 - DNA, 25 bp, Mus musculus
acccaggttcaggaataagactgtc

SEQ ID NO: 177409 - DNA, 25 bp, Mus musculus
acccagtaatttgtactataccaac

SEQ ID NO: 177410 - DNA, 25 bp, Mus musculus
acccagtaccaaggacctgtgttac

SEQ ID NO: 177411 - DNA, 25 bp, Mus musculus
acccagtcatcttgatcgactgcgg

SEQ ID NO: 177412 - DNA, 25 bp, Mus musculus
acccagtctaaaatcgatgtccatc

SEQ ID NO: 177413 - DNA, 25 bp, Mus musculus
acccagtctaacacagaggagattc

SEQ ID NO: 177414 - DNA, 25 bp, Mus musculus
acccagtcttcctaaatctgcagaa

SEQ ID NO: 177415 - DNA, 25 bp, Mus musculus
acccagtgacgggtgagcctgcaac

SEQ ID NO: 177416 - DNA, 25 bp, Mus musculus
acccagtgaggaaaggagggcggaa

SEQ ID NO: 177417 - DNA, 25 bp, Mus musculus
acccagtggtggaagaggagaactt

SEQ ID NO: 177418 - DNA, 25 bp, Mus musculus
acccagtggtggaagtcgtgttcaa

SEQ ID NO: 177419 - DNA, 25 bp, Mus musculus
acccagttaaatcatcgggttatag

SEQ ID NO: 177420 - DNA, 25 bp, Mus musculus
acccagttgatggtcacccttcctt

SEQ ID NO: 177421 - DNA, 25 bp, Mus musculus
acccagttgatggttggcagaacga

SEQ ID NO: 177422 - DNA, 25 bp, Mus musculus
acccagttttcggagtctattgcat

SEQ ID NO: 177423 - DNA, 25 bp, Mus musculus
acccatacaggtagtgctgccctaa

SEQ ID NO: 177424 - DNA, 25 bp, Mus musculus
acccatagtgggccaaagagatgtc

SEQ ID NO: 177425 - DNA, 25 bp, Mus musculus
acccatatgccaatggctggaagct

SEQ ID NO: 177426 - DNA, 25 bp, Mus musculus
acccatcaaggcgacctggcattca

SEQ ID NO: 177427 - DNA, 25 bp, Mus musculus
acccatcaatcaggtgaatcccccg

SEQ ID NO: 177428 - DNA, 25 bp, Mus musculus
acccatcaatcaggtgactgtgacg

SEQ ID NO: 177429 - DNA, 25 bp, Mus musculus
acccatcagaagtcctaggtactgg

SEQ ID NO: 177430 - DNA, 25 bp, Mus musculus
acccatcagccagaccacagatgac

SEQ ID NO: 177431 - DNA, 25 bp, Mus musculus
acccatcccagaaccaggcagataa

SEQ ID NO: 177432 - DNA, 25 bp, Mus musculus
acccatcctggacaggccaaccagg

SEQ ID NO: 177433 - DNA, 25 bp, Mus musculus
acccatcctggacagtctgcacctg

SEQ ID NO: 177434 - DNA, 25 bp, Mus musculus
acccatcctggagggctcctgtgat

SEQ ID NO: 177435 - DNA, 25 bp, Mus musculus
acccatcctggagtgtacaactcta

SEQ ID NO: 177436 - DNA, 25 bp, Mus musculus
acccatcgcaggtgcagaccataat

SEQ ID NO: 177437 - DNA, 25 bp, Mus musculus
acccatctacagaggctgatccccg

SEQ ID NO: 177438 - DNA, 25 bp, Mus musculus
acccatctcagatcttctgcccaat

SEQ ID NO: 177439 - DNA, 25 bp, Mus musculus
acccatctgcagaaaaatatcgttt

SEQ ID NO: 177440 - DNA, 25 bp, Mus musculus
acccatctgcagaaagtggaagaaa

SEQ ID NO: 177441 - DNA, 25 bp, Mus musculus
acccatcttagttcgttgtgatgac

SEQ ID NO: 177442 - DNA, 25 bp, Mus musculus
acccatctttcgactaagatgctta

SEQ ID NO: 177443 - DNA, 25 bp, Mus musculus
acccatgaaactgcatttctaggtc

SEQ ID NO: 177444 - DNA, 25 bp, Mus musculus
acccatgaagactcttgggaggatt

SEQ ID NO: 177445 - DNA, 25 bp, Mus musculus
acccatgaagatcccaattatctca

SEQ ID NO: 177446 - DNA, 25 bp, Mus musculus
acccatgagaagctgcccatggtgc

SEQ ID NO: 177447 - DNA, 25 bp, Mus musculus
acccatgcaaacagaacatgttgga

SEQ ID NO: 177448 - DNA, 25 bp, Mus musculus
acccatgctaagaggggatgtgaag

SEQ ID NO: 177449 - DNA, 25 bp, Mus musculus
acccatgctggtaacgattcactaa

SEQ ID NO: 177450 - DNA, 25 bp, Mus musculus
acccatgctggtaaggattcactaa

SEQ ID NO: 177451 - DNA, 25 bp, Mus musculus
acccatggaagacaaagtctggagc

SEQ ID NO: 177452 - DNA, 25 bp, Mus musculus
acccatggaagcaccccccattgga

SEQ ID NO: 177453 - DNA, 25 bp, Mus musculus
acccatggacactccagcacggaag

SEQ ID NO: 177454 - DNA, 25 bp, Mus musculus
acccatggatggagggatcgcttac

SEQ ID NO: 177455 - DNA, 25 bp, Mus musculus
acccatggccagtaactctgaatgt

SEQ ID NO: 177456 - DNA, 25 bp, Mus musculus
acccatggctcagactccgtggttt

SEQ ID NO: 177457 - DNA, 25 bp, Mus musculus
acccatggtcctagtcaagagaatc

SEQ ID NO: 177458 - DNA, 25 bp, Mus musculus
acccatggtctcttcccatacatgg

SEQ ID NO: 177459 - DNA, 25 bp, Mus musculus
acccatgtactaagacctgttcccg

SEQ ID NO: 177460 - DNA, 25 bp, Mus musculus
acccatgtactaagggatacagtgg

SEQ ID NO: 177461 - DNA, 25 bp, Mus musculus
acccatgtactaaggtatacagttt

SEQ ID NO: 177462 - DNA, 25 bp, Mus musculus
acccatgtactaagtttccccctgc

SEQ ID NO: 177463 - DNA, 25 bp, Mus musculus
acccatgtctgaccttctgccccct

SEQ ID NO: 177464 - DNA, 25 bp, Mus musculus
acccatgtggcagtggtccccagtg

SEQ ID NO: 177465 - DNA, 25 bp, Mus musculus
acccattcaggctgcaacaggtgac

SEQ ID NO: 177466 - DNA, 25 bp, Mus musculus
acccattccccaaagtaatggactc

SEQ ID NO: 177467 - DNA, 25 bp, Mus musculus
acccattcctgcctaaattttaagc

SEQ ID NO: 177468 - DNA, 25 bp, Mus musculus
acccattctcaaaaatttcaaaggc

SEQ ID NO: 177469 - DNA, 25 bp, Mus musculus
acccattctgtgctgcctgccagcc

SEQ ID NO: 177470 - DNA, 25 bp, Mus musculus
acccattctgtggctttcacttttt

SEQ ID NO: 177471 - DNA, 25 bp, Mus musculus
acccattgaccagcaggaatccagc

SEQ ID NO: 177472 - DNA, 25 bp, Mus musculus
acccattgagaagagatgaggctgt

SEQ ID NO: 177473 - DNA, 25 bp, Mus musculus
acccattgagaatcctataaggaga

SEQ ID NO: 177474 - DNA, 25 bp, Mus musculus
acccattgaggcccaaacacgagtt

SEQ ID NO: 177475 - DNA, 25 bp, Mus musculus
acccattggctggcaaggtcagcct

SEQ ID NO: 177476 - DNA, 25 bp, Mus musculus
acccattggctggttttcccatcat

SEQ ID NO: 177477 - DNA, 25 bp, Mus musculus
acccatttcacagggagcccgaacc

SEQ ID NO: 177478 - DNA, 25 bp, Mus musculus
acccatttcggatgttcctgccttc

SEQ ID NO: 177479 - DNA, 25 bp, Mus musculus
acccattttctctatgagtattgga

SEQ ID NO: 177480 - DNA, 25 bp, Mus musculus
accccaaaacaggccccagggctgg

SEQ ID NO: 177481 - DNA, 25 bp, Mus musculus
accccaaaacagtgggaaatgcctg

SEQ ID NO: 177482 - DNA, 25 bp, Mus musculus
accccaaaacggacctacgagcaga

SEQ ID NO: 177483 - DNA, 25 bp, Mus musculus
accccaaaagagaatcgcacgtcca

SEQ ID NO: 177484 - DNA, 25 bp, Mus musculus
accccaaacagtgtcaccccgccct

SEQ ID NO: 177485 - DNA, 25 bp, Mus musculus
accccaaaccaccctgctgagacag

SEQ ID NO: 177486 - DNA, 25 bp, Mus musculus
accccaaacttccagacctgaggtc

SEQ ID NO: 177487 - DNA, 25 bp, Mus musculus
accccaaacttccaggcacatctca

SEQ ID NO: 177488 - DNA, 25 bp, Mus musculus
accccaaaggagccaagtcagaaca

SEQ ID NO: 177489 - DNA, 25 bp, Mus musculus
accccaaatacctctcaaaaatagt

SEQ ID NO: 177490 - DNA, 25 bp, Mus musculus
accccaaatctgtgctgaagagacc

SEQ ID NO: 177491 - DNA, 25 bp, Mus musculus
accccaaatgaccactgagattcca

SEQ ID NO: 177492 - DNA, 25 bp, Mus musculus
accccaaatgaccagagaacttcac

SEQ ID NO: 177493 - DNA, 25 bp, Mus musculus
accccaaatgattataagcacaccg

SEQ ID NO: 177494 - DNA, 25 bp, Mus musculus
accccaacaagaatcagcacacaac

SEQ ID NO: 177495 - DNA, 25 bp, Mus musculus
accccaacaagacccgtctaaatga

SEQ ID NO: 177496 - DNA, 25 bp, Mus musculus
accccaacatgcggacctcatgcct

SEQ ID NO: 177497 - DNA, 25 bp, Mus musculus
accccaacatgcgggaattcatcct

SEQ ID NO: 177498 - DNA, 25 bp, Mus musculus
accccaactctcgtggaagcacaag

SEQ ID NO: 177499 - DNA, 25 bp, Mus musculus
accccaacttctcggtctactatac

SEQ ID NO: 177500 - DNA, 25 bp, Mus musculus
accccaagagaagggagtggatcac

SEQ ID NO: 177501 - DNA, 25 bp, Mus musculus
accccaagagagacaacaatcctct

SEQ ID NO: 177502 - DNA, 25 bp, Mus musculus
accccaagatgctttgtgacgacaa

SEQ ID NO: 177503 - DNA, 25 bp, Mus musculus
accccaaggacagtttagagacgtg

SEQ ID NO: 177504 - DNA, 25 bp, Mus musculus
accccaaggtgccagaggaggatga

SEQ ID NO: 177505 - DNA, 25 bp, Mus musculus
accccaagtaagaagactagcagtg

SEQ ID NO: 177506 - DNA, 25 bp, Mus musculus
accccaagtaagataccaaggtata

SEQ ID NO: 177507 - DNA, 25 bp, Mus musculus
accccaagttcccagaccttgtgac

SEQ ID NO: 177508 - DNA, 25 bp, Mus musculus
accccaatagagataatgcagggga

SEQ ID NO: 177509 - DNA, 25 bp, Mus musculus
accccaatagagatggcttgccagt

SEQ ID NO: 177510 - DNA, 25 bp, Mus musculus
accccaatcggatctgtgtaagaac

SEQ ID NO: 177511 - DNA, 25 bp, Mus musculus
accccaatcggggcaccacctgtct

SEQ ID NO: 177512 - DNA, 25 bp, Mus musculus
accccaatggggaaggtctaaatgc

SEQ ID NO: 177513 - DNA, 25 bp, Mus musculus
accccacaaaatcatgcaaatcaag

SEQ ID NO: 177514 - DNA, 25 bp, Mus musculus
accccacaaacctgacgagatgaca

SEQ ID NO: 177515 - DNA, 25 bp, Mus musculus
accccacaatcgaagatgcttataa

SEQ ID NO: 177516 - DNA, 25 bp, Mus musculus
accccacaatcggcagagttcacgg

SEQ ID NO: 177517 - DNA, 25 bp, Mus musculus
accccacacaagtcaaaggagccct

SEQ ID NO: 177518 - DNA, 25 bp, Mus musculus
accccacacaatgtttagttctgtg

SEQ ID NO: 177519 - DNA, 25 bp, Mus musculus
accccacacagcaggaggtcccagg

SEQ ID NO: 177520 - DNA, 25 bp, Mus musculus
accccacagcagaaactgcagttgg

SEQ ID NO: 177521 - DNA, 25 bp, Mus musculus
accccacagcaggagtggacagcat

SEQ ID NO: 177522 - DNA, 25 bp, Mus musculus
accccacagctgaacaatgtgggtc

SEQ ID NO: 177523 - DNA, 25 bp, Mus musculus
accccacagtaaactacattttgtc

SEQ ID NO: 177524 - DNA, 25 bp, Mus musculus
accccacagtcagccttttatgtca

SEQ ID NO: 177525 - DNA, 25 bp, Mus musculus
accccaccacagaggcctcaggatg

SEQ ID NO: 177526 - DNA, 25 bp, Mus musculus
accccaccatcatgatttaagcagc

SEQ ID NO: 177527 - DNA, 25 bp, Mus musculus
accccacccaggtggaggatgcggt

SEQ ID NO: 177528 - DNA, 25 bp, Mus musculus
accccacccagtttctgtgttgtgg

SEQ ID NO: 177529 - DNA, 25 bp, Mus musculus
accccaccccgctggcaaatctcat

SEQ ID NO: 177530 - DNA, 25 bp, Mus musculus
accccaccccgctggctgccttcaa

SEQ ID NO: 177531 - DNA, 25 bp, Mus musculus
accccacgtgatggagtatcccggc

SEQ ID NO: 177532 - DNA, 25 bp, Mus musculus
accccacgtgctcctggcccagaat

SEQ ID NO: 177533 - DNA, 25 bp, Mus musculus
accccacgttttctcctcagagctg

SEQ ID NO: 177534 - DNA, 25 bp, Mus musculus
accccagaacaagagctgaggctgc

SEQ ID NO: 177535 - DNA, 25 bp, Mus musculus
accccagaagagggctacaggggaa

SEQ ID NO: 177536 - DNA, 25 bp, Mus musculus
accccagaagagtttgtggcagctg

SEQ ID NO: 177537 - DNA, 25 bp, Mus musculus
accccagaagtaagattggcctgtt

SEQ ID NO: 177538 - DNA, 25 bp, Mus musculus
accccagacctgcagctaaagcacc

SEQ ID NO: 177539 - DNA, 25 bp, Mus musculus
accccagagcgaagaggagcataga

SEQ ID NO: 177540 - DNA, 25 bp, Mus musculus
accccagagcgaatggcggaggctg

SEQ ID NO: 177541 - DNA, 25 bp, Mus musculus
accccagagcggctccggagttgag

SEQ ID NO: 177542 - DNA, 25 bp, Mus musculus
accccagagcgggagctcttggcta

SEQ ID NO: 177543 - DNA, 25 bp, Mus musculus
accccagagcggttttgctgtattg

SEQ ID NO: 177544 - DNA, 25 bp, Mus musculus
accccagatgcaccatgggcttggc

SEQ ID NO: 177545 - DNA, 25 bp, Mus musculus
accccagatgcagggctgtagcagt

SEQ ID NO: 177546 - DNA, 25 bp, Mus musculus
accccagatgcaggttctgcatttc

SEQ ID NO: 177547 - DNA, 25 bp, Mus musculus
accccagcaaaggctaattctggct

SEQ ID NO: 177548 - DNA, 25 bp, Mus musculus
accccagcaacaaacatctctccaa

SEQ ID NO: 177549 - DNA, 25 bp, Mus musculus
accccagcaacaaagtcacttagaa

SEQ ID NO: 177550 - DNA, 25 bp, Mus musculus
accccagcaagacattcacccccaa

SEQ ID NO: 177551 - DNA, 25 bp, Mus musculus
accccagccaggcccccagcaaaga

SEQ ID NO: 177552 - DNA, 25 bp, Mus musculus
accccagccaggtcagtggctatct

SEQ ID NO: 177553 - DNA, 25 bp, Mus musculus
accccagcctccgcatgagcatcaa

SEQ ID NO: 177554 - DNA, 25 bp, Mus musculus
accccagcgtggctggtcttgagac

SEQ ID NO: 177555 - DNA, 25 bp, Mus musculus
accccagcttcacgctgtccctgaa

SEQ ID NO: 177556 - DNA, 25 bp, Mus musculus
accccaggaagagcctccacctctc

SEQ ID NO: 177557 - DNA, 25 bp, Mus musculus
accccaggaagaggacatgacagat

SEQ ID NO: 177558 - DNA, 25 bp, Mus musculus
accccaggaattagtgtcggagctc

SEQ ID NO: 177559 - DNA, 25 bp, Mus musculus
accccaggaggacctggggtcagac

SEQ ID NO: 177560 - DNA, 25 bp, Mus musculus
accccaggcagaaagtaaatccgtg

SEQ ID NO: 177561 - DNA, 25 bp, Mus musculus
accccagggacagctgactttaaga

SEQ ID NO: 177562 - DNA, 25 bp, Mus musculus
accccagtcactgcttgtctcttac

SEQ ID NO: 177563 - DNA, 25 bp, Mus musculus
accccagtcagggtctggaggtgac

SEQ ID NO: 177564 - DNA, 25 bp, Mus musculus
accccagtggaaatcacggttatct

SEQ ID NO: 177565 - DNA, 25 bp, Mus musculus
accccataccagatgtgagatccag

SEQ ID NO: 177566 - DNA, 25 bp, Mus musculus
accccataccagttgtgagatccag

SEQ ID NO: 177567 - DNA, 25 bp, Mus musculus
accccatatcaagtttcttacttat

SEQ ID NO: 177568 - DNA, 25 bp, Mus musculus
accccatcactgggaaaaggactgt

SEQ ID NO: 177569 - DNA, 25 bp, Mus musculus
accccatcactgggtttggtaaagg

SEQ ID NO: 177570 - DNA, 25 bp, Mus musculus
accccatcagacggaactggtgtcc

SEQ ID NO: 177571 - DNA, 25 bp, Mus musculus
accccatcagacggtatcgagtggc

SEQ ID NO: 177572 - DNA, 25 bp, Mus musculus
accccatcatctgcactgctctgag

SEQ ID NO: 177573 - DNA, 25 bp, Mus musculus
accccatccagaaaatgaggaagac

SEQ ID NO: 177574 - DNA, 25 bp, Mus musculus
accccatcttcaaggtgttcgacgc

SEQ ID NO: 177575 - DNA, 25 bp, Mus musculus
accccatgaaggtacgggtggttct

SEQ ID NO: 177576 - DNA, 25 bp, Mus musculus
accccatgaagtgtttggtgtacag

SEQ ID NO: 177577 - DNA, 25 bp, Mus musculus
accccatgcagaccagactctgaga

SEQ ID NO: 177578 - DNA, 25 bp, Mus musculus
accccatgcagctatctaacttcac

SEQ ID NO: 177579 - DNA, 25 bp, Mus musculus
accccatgcaggaatctgatgcttc

SEQ ID NO: 177580 - DNA, 25 bp, Mus musculus
accccatgcaggtttatggtgtgct

SEQ ID NO: 177581 - DNA, 25 bp, Mus musculus
accccatggagacatatgaggacca

SEQ ID NO: 177582 - DNA, 25 bp, Mus musculus
accccatggagactcggctgactct

SEQ ID NO: 177583 - DNA, 25 bp, Mus musculus
accccatggaggttatttttgaagt

SEQ ID NO: 177584 - DNA, 25 bp, Mus musculus
accccatgtcagggagacagctgtt

SEQ ID NO: 177585 - DNA, 25 bp, Mus musculus
accccatgtggccacagtacacgaa

SEQ ID NO: 177586 - DNA, 25 bp, Mus musculus
accccattcaagaaattggcaccac

SEQ ID NO: 177587 - DNA, 25 bp, Mus musculus
accccattgagctcatgtttgcttc

SEQ ID NO: 177588 - DNA, 25 bp, Mus musculus
accccattgagctggtggttttcct

SEQ ID NO: 177589 - DNA, 25 bp, Mus musculus
accccattgattaagagtgtcaaca

SEQ ID NO: 177590 - DNA, 25 bp, Mus musculus
accccattgattaaggcagtagagt

SEQ ID NO: 177591 - DNA, 25 bp, Mus musculus
accccatttggtgacttcatggtca

SEQ ID NO: 177592 - DNA, 25 bp, Mus musculus
accccatttggtgatctgaatgagg

SEQ ID NO: 177593 - DNA, 25 bp, Mus musculus
acccccaaagatcagagatggagtc

SEQ ID NO: 177594 - DNA, 25 bp, Mus musculus
acccccaaagatcaggagatttgta

SEQ ID NO: 177595 - DNA, 25 bp, Mus musculus
acccccaagaccagtgacagtggga

SEQ ID NO: 177596 - DNA, 25 bp, Mus musculus
acccccaagaccatgtgtgccgaca

SEQ ID NO: 177597 - DNA, 25 bp, Mus musculus
acccccaatatgaacattttccctc

SEQ ID NO: 177598 - DNA, 25 bp, Mus musculus
acccccaatcgcaagacggtgcctc

SEQ ID NO: 177599 - DNA, 25 bp, Mus musculus
acccccaatcgcaaggattcttctt

SEQ ID NO: 177600 - DNA, 25 bp, Mus musculus
acccccaatgacaggttcattttgc

SEQ ID NO: 177601 - DNA, 25 bp, Mus musculus
acccccaccaggagagaaaggacag

SEQ ID NO: 177602 - DNA, 25 bp, Mus musculus
acccccaccccccagcaagagccag

SEQ ID NO: 177603 - DNA, 25 bp, Mus musculus
acccccacccgagttctatccagga

SEQ ID NO: 177604 - DNA, 25 bp, Mus musculus
acccccaccctctgtggatttcctg

SEQ ID NO: 177605 - DNA, 25 bp, Mus musculus
acccccacgcctggcctctgccttc

SEQ ID NO: 177606 - DNA, 25 bp, Mus musculus
acccccacgtgattccttagaaact

SEQ ID NO: 177607 - DNA, 25 bp, Mus musculus
acccccacgtggaagaaaggtcagg

SEQ ID NO: 177608 - DNA, 25 bp, Mus musculus
acccccagaccgatatgacagcctg

SEQ ID NO: 177609 - DNA, 25 bp, Mus musculus
acccccagcactgtgtcgaccccct

SEQ ID NO: 177610 - DNA, 25 bp, Mus musculus
acccccagcagtctaaggtggtaaa

SEQ ID NO: 177611 - DNA, 25 bp, Mus musculus
acccccagcccctgatacgacccgg

SEQ ID NO: 177612 - DNA, 25 bp, Mus musculus
acccccagcccctgtcctgcacttc

SEQ ID NO: 177613 - DNA, 25 bp, Mus musculus
acccccaggcagcttattgatgtcc

SEQ ID NO: 177614 - DNA, 25 bp, Mus musculus
acccccaggcccaggcgtgctggtc

SEQ ID NO: 177615 - DNA, 25 bp, Mus musculus
acccccatacggtgcctcctgagaa

SEQ ID NO: 177616 - DNA, 25 bp, Mus musculus
acccccatagtactttttgcatagt

SEQ ID NO: 177617 - DNA, 25 bp, Mus musculus
acccccatctcagagatgggctttg

SEQ ID NO: 177618 - DNA, 25 bp, Mus musculus
acccccatctcagaggctggtgttt

SEQ ID NO: 177619 - DNA, 25 bp, Mus musculus
acccccattttacagaactgtatga

SEQ ID NO: 177620 - DNA, 25 bp, Mus musculus
accccccaaggatcgtgaactgggc

SEQ ID NO: 177621 - DNA, 25 bp, Mus musculus
accccccatggcttttcaagatctc

SEQ ID NO: 177622 - DNA, 25 bp, Mus musculus
accccccattccaaggcaacccgca

SEQ ID NO: 177623 - DNA, 25 bp, Mus musculus
acccccccacaggtcatcctgttca

SEQ ID NO: 177624 - DNA, 25 bp, Mus musculus
acccccccctccaactggcttaatg

SEQ ID NO: 177625 - DNA, 25 bp, Mus musculus
acccccctaagggcagcagcaatga

SEQ ID NO: 177626 - DNA, 25 bp, Mus musculus
acccccctccttccaccctcatgct

SEQ ID NO: 177627 - DNA, 25 bp, Mus musculus
acccccgagctgctcttgtgaagtc

SEQ ID NO: 177628 - DNA, 25 bp, Mus musculus
acccccgagtacagaaatgctgagc

SEQ ID NO: 177629 - DNA, 25 bp, Mus musculus
acccccgccacattgacagttctcc

SEQ ID NO: 177630 - DNA, 25 bp, Mus musculus
acccccgctgcaggctttgctttca

SEQ ID NO: 177631 - DNA, 25 bp, Mus musculus
acccccgctggtaagattgagaaag

SEQ ID NO: 177632 - DNA, 25 bp, Mus musculus
acccccgctggtctcagctatccaa

SEQ ID NO: 177633 - DNA, 25 bp, Mus musculus
acccccgctgttggagacaggagca

SEQ ID NO: 177634 - DNA, 25 bp, Mus musculus
acccccgcttcggtactctaacaag

SEQ ID NO: 177635 - DNA, 25 bp, Mus musculus
acccccgcttcggtatgactcaata

SEQ ID NO: 177636 - DNA, 25 bp, Mus musculus
acccccggaagccgaactgctttga

SEQ ID NO: 177637 - DNA, 25 bp, Mus musculus
acccccggaaggtatcatccggata

SEQ ID NO: 177638 - DNA, 25 bp, Mus musculus
acccccggagtttcaagccacagag

SEQ ID NO: 177639 - DNA, 25 bp, Mus musculus
acccccggcggacagagttgatggt

SEQ ID NO: 177640 - DNA, 25 bp, Mus musculus
accccctaacaaggtcccaggcagt

SEQ ID NO: 177641 - DNA, 25 bp, Mus musculus
accccctaacatgcagtacactgcc

SEQ ID NO: 177642 - DNA, 25 bp, Mus musculus
accccctagactggcttaagatact

SEQ ID NO: 177643 - DNA, 25 bp, Mus musculus
accccctcagtggccacagttaagc

SEQ ID NO: 177644 - DNA, 25 bp, Mus musculus
accccctcccagagctctcttccgg

SEQ ID NO: 177645 - DNA, 25 bp, Mus musculus
accccctcttcaactctggctccag

SEQ ID NO: 177646 - DNA, 25 bp, Mus musculus
accccctgctccaccttctcgagaa

SEQ ID NO: 177647 - DNA, 25 bp, Mus musculus
acccccttgtgaacgaggctgctgc

SEQ ID NO: 177648 - DNA, 25 bp, Mus musculus
accccctttcgccacagcccaactg

SEQ ID NO: 177649 - DNA, 25 bp, Mus musculus
accccctttggagacctccacacag

SEQ ID NO: 177650 - DNA, 25 bp, Mus musculus
accccgaaacagcagagaactgggg

SEQ ID NO: 177651 - DNA, 25 bp, Mus musculus
accccgaaagagctcctgggctcca

SEQ ID NO: 177652 - DNA, 25 bp, Mus musculus
accccgaagcagaggatgaaggacg

SEQ ID NO: 177653 - DNA, 25 bp, Mus musculus
accccgaatccagaatcggaagact

SEQ ID NO: 177654 - DNA, 25 bp, Mus musculus
accccgaattcctcctccaccgtcg

SEQ ID NO: 177655 - DNA, 25 bp, Mus musculus
accccgacccagactcattacaggc

SEQ ID NO: 177656 - DNA, 25 bp, Mus musculus
accccgagaaagggtatatgtattt

SEQ ID NO: 177657 - DNA, 25 bp, Mus musculus
accccgagcaggatggtgaggattc

SEQ ID NO: 177658 - DNA, 25 bp, Mus musculus
accccgagcgcccgcgtccagagga

SEQ ID NO: 177659 - DNA, 25 bp, Mus musculus
accccgattacgtgggacgagtccg

SEQ ID NO: 177660 - DNA, 25 bp, Mus musculus
accccgcacagcaggttctccacat

SEQ ID NO: 177661 - DNA, 25 bp, Mus musculus
accccgccaagctctcggggataaa

SEQ ID NO: 177662 - DNA, 25 bp, Mus musculus
accccgcggacaggtttggccgtcg

SEQ ID NO: 177663 - DNA, 25 bp, Mus musculus
accccgcggggacagtaagaagaca

SEQ ID NO: 177664 - DNA, 25 bp, Mus musculus
accccgcggggacagtgcctttgac

SEQ ID NO: 177665 - DNA, 25 bp, Mus musculus
accccgcgtctcggaagactcttca

SEQ ID NO: 177666 - DNA, 25 bp, Mus musculus
accccgctcaggccccgcgatcagc

SEQ ID NO: 177667 - DNA, 25 bp, Mus musculus
accccgctcaggtttccaggcttct

SEQ ID NO: 177668 - DNA, 25 bp, Mus musculus
accccgcttccgagcctcgattgaa

SEQ ID NO: 177669 - DNA, 25 bp, Mus musculus
accccgcttttcagatcctggatgg

SEQ ID NO: 177670 - DNA, 25 bp, Mus musculus
accccggcaggtcagaagacatgtc

SEQ ID NO: 177671 - DNA, 25 bp, Mus musculus
accccggccccagctgagtgatcgc

SEQ ID NO: 177672 - DNA, 25 bp, Mus musculus
accccggccccagggctggctgtgg

SEQ ID NO: 177673 - DNA, 25 bp, Mus musculus
accccggcctagatgcagcttcaga

SEQ ID NO: 177674 - DNA, 25 bp, Mus musculus
accccggcgccaatgagaaagataa

SEQ ID NO: 177675 - DNA, 25 bp, Mus musculus
accccggcgctggagccccaaacta

SEQ ID NO: 177676 - DNA, 25 bp, Mus musculus
accccgggaggaagctatgctctac

SEQ ID NO: 177677 - DNA, 25 bp, Mus musculus
accccgggaggcaccaggatcatct

SEQ ID NO: 177678 - DNA, 25 bp, Mus musculus
accccgggcaggtttagacacgtgt

SEQ ID NO: 177679 - DNA, 25 bp, Mus musculus
accccggtgcatagagaaatccaag

SEQ ID NO: 177680 - DNA, 25 bp, Mus musculus
accccggtggcaagagactgcttat

SEQ ID NO: 177681 - DNA, 25 bp, Mus musculus
accccgtcaaggtccgatctgaccg

SEQ ID NO: 177682 - DNA, 25 bp, Mus musculus
accccgtcctgtgtgtcaccccgcc

SEQ ID NO: 177683 - DNA, 25 bp, Mus musculus
accccgtgacgctgcggatttattc

SEQ ID NO: 177684 - DNA, 25 bp, Mus musculus
accccgttcagcagagagtacttca

SEQ ID NO: 177685 - DNA, 25 bp, Mus musculus
accccgttctggagctgagaagggt

SEQ ID NO: 177686 - DNA, 25 bp, Mus musculus
accccgtttattagtgcttacagac

SEQ ID NO: 177687 - DNA, 25 bp, Mus musculus
accccgtttgctcagaatttcatgc

SEQ ID NO: 177688 - DNA, 25 bp, Mus musculus
accccgtttgctcaggtcttggcta

SEQ ID NO: 177689 - DNA, 25 bp, Mus musculus
acccctacaccaatggctggaaatt

SEQ ID NO: 177690 - DNA, 25 bp, Mus musculus
acccctacacgcatgctgtggatac

SEQ ID NO: 177691 - DNA, 25 bp, Mus musculus
acccctacacgcatggagtcgccct

SEQ ID NO: 177692 - DNA, 25 bp, Mus musculus
acccctacagccagggctgatgaac

SEQ ID NO: 177693 - DNA, 25 bp, Mus musculus
acccctacagccaggtctgtgctgc

SEQ ID NO: 177694 - DNA, 25 bp, Mus musculus
acccctacagccccagctaaccaga

SEQ ID NO: 177695 - DNA, 25 bp, Mus musculus
acccctacaggaaggcccaggacct

SEQ ID NO: 177696 - DNA, 25 bp, Mus musculus
acccctacaggatggtcagaacacc

SEQ ID NO: 177697 - DNA, 25 bp, Mus musculus
acccctacaggtctgtctgacctga

SEQ ID NO: 177698 - DNA, 25 bp, Mus musculus
acccctacagtcagggtttctattc

SEQ ID NO: 177699 - DNA, 25 bp, Mus musculus
acccctacagtgttctcaacattat

SEQ ID NO: 177700 - DNA, 25 bp, Mus musculus
acccctacccttgcagggagactcc

SEQ ID NO: 177701 - DNA, 25 bp, Mus musculus
acccctaggcaagactggacgagta

SEQ ID NO: 177702 - DNA, 25 bp, Mus musculus
acccctagggcctgcaggtctacag

SEQ ID NO: 177703 - DNA, 25 bp, Mus musculus
acccctatatttcgcacatcttcat

SEQ ID NO: 177704 - DNA, 25 bp, Mus musculus
acccctatctgagctgctgttgcac

SEQ ID NO: 177705 - DNA, 25 bp, Mus musculus
acccctatgaggagctcctagttaa

SEQ ID NO: 177706 - DNA, 25 bp, Mus musculus
acccctatggctggccacagattgt

SEQ ID NO: 177707 - DNA, 25 bp, Mus musculus
acccctcaacagccggagcagctgg

SEQ ID NO: 177708 - DNA, 25 bp, Mus musculus
acccctcaagacggaggaggactac

SEQ ID NO: 177709 - DNA, 25 bp, Mus musculus
acccctcaagcatgaccagtgtcct

SEQ ID NO: 177710 - DNA, 25 bp, Mus musculus
acccctcaaggagcacttcaattac

SEQ ID NO: 177711 - DNA, 25 bp, Mus musculus
acccctcaagttcacagctcccagc

SEQ ID NO: 177712 - DNA, 25 bp, Mus musculus
acccctcaccaggaggcaccatgtg

SEQ ID NO: 177713 - DNA, 25 bp, Mus musculus
acccctccacatggcttcttctcca

SEQ ID NO: 177714 - DNA, 25 bp, Mus musculus
acccctccacatgtctctggatttg

SEQ ID NO: 177715 - DNA, 25 bp, Mus musculus
acccctcctccgggaaggtagactg

SEQ ID NO: 177716 - DNA, 25 bp, Mus musculus
acccctcggggcagggatgccctgg

SEQ ID NO: 177717 - DNA, 25 bp, Mus musculus
acccctctataaagcattgaggcca

SEQ ID NO: 177718 - DNA, 25 bp, Mus musculus
acccctctataaagtctttcctgta

SEQ ID NO: 177719 - DNA, 25 bp, Mus musculus
acccctctccatatcgctgtattgt

SEQ ID NO: 177720 - DNA, 25 bp, Mus musculus
acccctcttcagacagagagcctgg

SEQ ID NO: 177721 - DNA, 25 bp, Mus musculus
acccctcttcaggttatccgtgttc

SEQ ID NO: 177722 - DNA, 25 bp, Mus musculus
acccctcttgacccagccctgcaga

SEQ ID NO: 177723 - DNA, 25 bp, Mus musculus
acccctgaaatggcattatccaatt

SEQ ID NO: 177724 - DNA, 25 bp, Mus musculus
acccctgaaggacatagcattgttg

SEQ ID NO: 177725 - DNA, 25 bp, Mus musculus
acccctgaaggttacagtctctagc

SEQ ID NO: 177726 - DNA, 25 bp, Mus musculus
acccctgactttgagcggaggctgc

SEQ ID NO: 177727 - DNA, 25 bp, Mus musculus
acccctgagggaggtgaccattgtt

SEQ ID NO: 177728 - DNA, 25 bp, Mus musculus
acccctgcaggaagtggccagatgt

SEQ ID NO: 177729 - DNA, 25 bp, Mus musculus
acccctgccacagccccggccaccc

SEQ ID NO: 177730 - DNA, 25 bp, Mus musculus
acccctgccagataatcagccttta

SEQ ID NO: 177731 - DNA, 25 bp, Mus musculus
acccctgccagtctcctggctgctt

SEQ ID NO: 177732 - DNA, 25 bp, Mus musculus
acccctgcgaggcggtgctggtgga

SEQ ID NO: 177733 - DNA, 25 bp, Mus musculus
acccctgcgaggggacatgcttcgg

SEQ ID NO: 177734 - DNA, 25 bp, Mus musculus
acccctggaggaaactctgatgcct

SEQ ID NO: 177735 - DNA, 25 bp, Mus musculus
acccctggaggtggagacagaaaat

SEQ ID NO: 177736 - DNA, 25 bp, Mus musculus
acccctggatcaaaggcctacagtt

SEQ ID NO: 177737 - DNA, 25 bp, Mus musculus
acccctggccctgaaggcagcccag

SEQ ID NO: 177738 - DNA, 25 bp, Mus musculus
acccctggcgaccaggcttcagatg

SEQ ID NO: 177739 - DNA, 25 bp, Mus musculus
acccctgggactagctcaggccctg

SEQ ID NO: 177740 - DNA, 25 bp, Mus musculus
acccctgggcaggtgttttagctca

SEQ ID NO: 177741 - DNA, 25 bp, Mus musculus
acccctggggagagatctccatagt

SEQ ID NO: 177742 - DNA, 25 bp, Mus musculus
acccctgggtgtcagatgatgcatc

SEQ ID NO: 177743 - DNA, 25 bp, Mus musculus
acccctgtgacacctgttgagggcg

SEQ ID NO: 177744 - DNA, 25 bp, Mus musculus
acccctgtgcgctgctcccgccagt

SEQ ID NO: 177745 - DNA, 25 bp, Mus musculus
acccctgtggatatgactccctgca

SEQ ID NO: 177746 - DNA, 25 bp, Mus musculus
acccctgtggattccactgtatcag

SEQ ID NO: 177747 - DNA, 25 bp, Mus musculus
accccttcaaaggtgatcctttcca

SEQ ID NO: 177748 - DNA, 25 bp, Mus musculus
accccttcaggcagagagccagctg

SEQ ID NO: 177749 - DNA, 25 bp, Mus musculus
accccttccaaggtgatcctttcca

SEQ ID NO: 177750 - DNA, 25 bp, Mus musculus
accccttccttacagccctcaagta

SEQ ID NO: 177751 - DNA, 25 bp, Mus musculus
accccttcttcgcagaatacaaaca

SEQ ID NO: 177752 - DNA, 25 bp, Mus musculus
accccttcttcgctgattcttttct

SEQ ID NO: 177753 - DNA, 25 bp, Mus musculus
accccttggaagaacttgcaaaagc

SEQ ID NO: 177754 - DNA, 25 bp, Mus musculus
accccttggaggagaggatgcttaa

SEQ ID NO: 177755 - DNA, 25 bp, Mus musculus
accccttggttgcaggtttgcaata

SEQ ID NO: 177756 - DNA, 25 bp, Mus musculus
accccttgtatccagacttcagtac

SEQ ID NO: 177757 - DNA, 25 bp, Mus musculus
acccctttaggtgttccgaatgcca

SEQ ID NO: 177758 - DNA, 25 bp, Mus musculus
acccctttatcacggtatcagagca

SEQ ID NO: 177759 - DNA, 25 bp, Mus musculus
acccctttatcagggtatcagagca

SEQ ID NO: 177760 - DNA, 25 bp, Mus musculus
acccctttcagattgtaagctcctt

SEQ ID NO: 177761 - DNA, 25 bp, Mus musculus
acccctttcaggactccttctaatg

SEQ ID NO: 177762 - DNA, 25 bp, Mus musculus
acccctttgaccaggatgacctcac

SEQ ID NO: 177763 - DNA, 25 bp, Mus musculus
acccgaaacgcgcacgcggctggag

SEQ ID NO: 177764 - DNA, 25 bp, Mus musculus
acccgacaatgcttttgtcaatctt

SEQ ID NO: 177765 - DNA, 25 bp, Mus musculus
acccgacaggcacagctactatgtg

SEQ ID NO: 177766 - DNA, 25 bp, Mus musculus
acccgacaggcacaggtcgaggtgg

SEQ ID NO: 177767 - DNA, 25 bp, Mus musculus
acccgacagggccgcagcctcgtgt

SEQ ID NO: 177768 - DNA, 25 bp, Mus musculus
acccgacccaaggcatgcgccaagg

SEQ ID NO: 177769 - DNA, 25 bp, Mus musculus
acccgacccagttaatctctcagta

SEQ ID NO: 177770 - DNA, 25 bp, Mus musculus
acccgactgaatgctcggattggga

SEQ ID NO: 177771 - DNA, 25 bp, Mus musculus
acccgagacgtgatcgtccgcgctg

SEQ ID NO: 177772 - DNA, 25 bp, Mus musculus
acccgagcaagatcaacgaggatca

SEQ ID NO: 177773 - DNA, 25 bp, Mus musculus
acccgagctaggggaagacacccag

SEQ ID NO: 177774 - DNA, 25 bp, Mus musculus
acccgaggagaaactggaaacaaag

SEQ ID NO: 177775 - DNA, 25 bp, Mus musculus
acccgaggagaccaaacagtcttct

SEQ ID NO: 177776 - DNA, 25 bp, Mus musculus
acccgaggagaccaaagaagagaga

SEQ ID NO: 177777 - DNA, 25 bp, Mus musculus
acccgaggatatcagaaggactcag

SEQ ID NO: 177778 - DNA, 25 bp, Mus musculus
acccgagtatccgaggctggttatg

SEQ ID NO: 177779 - DNA, 25 bp, Mus musculus
acccgagtcccctgagggatctgag

SEQ ID NO: 177780 - DNA, 25 bp, Mus musculus
acccgatagaggtccaggtctgttc

SEQ ID NO: 177781 - DNA, 25 bp, Mus musculus
acccgatccgcgtgggatccaagga

SEQ ID NO: 177782 - DNA, 25 bp, Mus musculus
acccgatggagggaccttgccaggg

SEQ ID NO: 177783 - DNA, 25 bp, Mus musculus
acccgatgtgcgcattaaagaggaa

SEQ ID NO: 177784 - DNA, 25 bp, Mus musculus
acccgatgtggctcttaaggactct

SEQ ID NO: 177785 - DNA, 25 bp, Mus musculus
acccgcaagcccattacttcacaga

SEQ ID NO: 177786 - DNA, 25 bp, Mus musculus
acccgcactcagctgtttgaaataa

SEQ ID NO: 177787 - DNA, 25 bp, Mus musculus
acccgcactcaggggaaggagccac

SEQ ID NO: 177788 - DNA, 25 bp, Mus musculus
acccgcagacagacgtgttcttaat

SEQ ID NO: 177789 - DNA, 25 bp, Mus musculus
acccgcagacagttggagacacatg

SEQ ID NO: 177790 - DNA, 25 bp, Mus musculus
acccgccattcagggtgtcctggac

SEQ ID NO: 177791 - DNA, 25 bp, Mus musculus
acccgcccccaggccttctgggttg

SEQ ID NO: 177792 - DNA, 25 bp, Mus musculus
acccgcccgccgtgaaagccggcgg

SEQ ID NO: 177793 - DNA, 25 bp, Mus musculus
acccgccgacagccaccatgcggcg

SEQ ID NO: 177794 - DNA, 25 bp, Mus musculus
acccgccgaggtatttcaacaatcc

SEQ ID NO: 177795 - DNA, 25 bp, Mus musculus
acccgccgctcgccggccctgctga

SEQ ID NO: 177796 - DNA, 25 bp, Mus musculus
acccgccgctcggttacctgccttg

SEQ ID NO: 177797 - DNA, 25 bp, Mus musculus
acccgcctctggaggaaagagccag

SEQ ID NO: 177798 - DNA, 25 bp, Mus musculus
acccgcctctggaggctccatctcc

SEQ ID NO: 177799 - DNA, 25 bp, Mus musculus
acccgcctgctggagctgctattgt

SEQ ID NO: 177800 - DNA, 25 bp, Mus musculus
acccgcctggaaaagctgctaaagc

SEQ ID NO: 177801 - DNA, 25 bp, Mus musculus
acccgcgagggtggcccgaggcagc

SEQ ID NO: 177802 - DNA, 25 bp, Mus musculus
acccgcgcggcccgcgcagccgccc

SEQ ID NO: 177803 - DNA, 25 bp, Mus musculus
acccgcgcgggcccacactcgctga

SEQ ID NO: 177804 - DNA, 25 bp, Mus musculus
acccgctactgtatcccttttggct

SEQ ID NO: 177805 - DNA, 25 bp, Mus musculus
acccgctcagatcttgacagttgct

SEQ ID NO: 177806 - DNA, 25 bp, Mus musculus
acccgctcagcagcacaaaggcatt

SEQ ID NO: 177807 - DNA, 25 bp, Mus musculus
acccgctcagggaaacagatcttga

SEQ ID NO: 177808 - DNA, 25 bp, Mus musculus
acccgctctggatctagtgacagca

SEQ ID NO: 177809 - DNA, 25 bp, Mus musculus
acccgctggtggagggtgtcaccga

SEQ ID NO: 177810 - DNA, 25 bp, Mus musculus
acccgctgtctgggaagagcatgga

SEQ ID NO: 177811 - DNA, 25 bp, Mus musculus
acccggaaaagcatgccttggactc

SEQ ID NO: 177812 - DNA, 25 bp, Mus musculus
acccggaacaaggatgtatttatac

SEQ ID NO: 177813 - DNA, 25 bp, Mus musculus
acccggaacaaggtcctacatctcc

SEQ ID NO: 177814 - DNA, 25 bp, Mus musculus
acccggacaaggactggttccacct

SEQ ID NO: 177815 - DNA, 25 bp, Mus musculus
acccggacgatgacagctatattgt

SEQ ID NO: 177816 - DNA, 25 bp, Mus musculus
acccggactcagatcatctttagat

SEQ ID NO: 177817 - DNA, 25 bp, Mus musculus
acccggagaactggtgcctcgtctc

SEQ ID NO: 177818 - DNA, 25 bp, Mus musculus
acccggagccgttatcctaggcgtc

SEQ ID NO: 177819 - DNA, 25 bp, Mus musculus
acccggagctgagggttccagacca

SEQ ID NO: 177820 - DNA, 25 bp, Mus musculus
acccggagctgatcgatttgatcta

SEQ ID NO: 177821 - DNA, 25 bp, Mus musculus
acccggaggacaaaggctatgtgct

SEQ ID NO: 177822 - DNA, 25 bp, Mus musculus
acccggaggagagtccaccactgcc

SEQ ID NO: 177823 - DNA, 25 bp, Mus musculus
acccggaggaggttctgctgcctta

SEQ ID NO: 177824 - DNA, 25 bp, Mus musculus
acccggaggagtgccggcattggca

SEQ ID NO: 177825 - DNA, 25 bp, Mus musculus
acccggagtctggcacatccaggac

SEQ ID NO: 177826 - DNA, 25 bp, Mus musculus
acccggatatggcaggatgttcaac

SEQ ID NO: 177827 - DNA, 25 bp, Mus musculus
acccggatgtgaaagcacaggtgga

SEQ ID NO: 177828 - DNA, 25 bp, Mus musculus
acccggattacatagccaacaagga

SEQ ID NO: 177829 - DNA, 25 bp, Mus musculus
acccggattacataggttttactat

SEQ ID NO: 177830 - DNA, 25 bp, Mus musculus
acccggattacatagtgtatcccct

SEQ ID NO: 177831 - DNA, 25 bp, Mus musculus
acccggcatgaccaaactccgatga

SEQ ID NO: 177832 - DNA, 25 bp, Mus musculus
acccggcatgaccagtgtcagcgca

SEQ ID NO: 177833 - DNA, 25 bp, Mus musculus
acccggcatggggcggcgtcgcggc

SEQ ID NO: 177834 - DNA, 25 bp, Mus musculus
acccggccatcctacctgcctattg

SEQ ID NO: 177835 - DNA, 25 bp, Mus musculus
acccggccatcgttgtggagctgaa

SEQ ID NO: 177836 - DNA, 25 bp, Mus musculus
acccggccccagcatctgggtggtc

SEQ ID NO: 177837 - DNA, 25 bp, Mus musculus
acccggccccatgggtcctccagga

SEQ ID NO: 177838 - DNA, 25 bp, Mus musculus
acccggcgtcaggagcctgatggga

SEQ ID NO: 177839 - DNA, 25 bp, Mus musculus
acccggctagagcgccacttagccc

SEQ ID NO: 177840 - DNA, 25 bp, Mus musculus
acccgggaccgggagctgctgcagt

SEQ ID NO: 177841 - DNA, 25 bp, Mus musculus
acccggggaaacaatggagaagtgt

SEQ ID NO: 177842 - DNA, 25 bp, Mus musculus
acccggggatacagaacatctcccg

SEQ ID NO: 177843 - DNA, 25 bp, Mus musculus
acccggggatacagctttggggcga

SEQ ID NO: 177844 - DNA, 25 bp, Mus musculus
acccggtgcatcaggtttgcaagtg

SEQ ID NO: 177845 - DNA, 25 bp, Mus musculus
acccggttcccgggctttgatgaca

SEQ ID NO: 177846 - DNA, 25 bp, Mus musculus
acccgtaagaccaagcgcccagccc

SEQ ID NO: 177847 - DNA, 25 bp, Mus musculus
acccgtaagagccagctggctcgca

SEQ ID NO: 177848 - DNA, 25 bp, Mus musculus
acccgtaagagccagttgctatgtc

SEQ ID NO: 177849 - DNA, 25 bp, Mus musculus
acccgtaggacagattgcatctggg

SEQ ID NO: 177850 - DNA, 25 bp, Mus musculus
acccgtatatgatggagagggataa

SEQ ID NO: 177851 - DNA, 25 bp, Mus musculus
acccgtatatgatgggcaggatagc

SEQ ID NO: 177852 - DNA, 25 bp, Mus musculus
acccgtatatgatgggttttaaaga

SEQ ID NO: 177853 - DNA, 25 bp, Mus musculus
acccgtcaaatatgaatacccagat

SEQ ID NO: 177854 - DNA, 25 bp, Mus musculus
acccgtcaccctccgcaagtgtcca

SEQ ID NO: 177855 - DNA, 25 bp, Mus musculus
acccgtcagaacagaaatgctgcca

SEQ ID NO: 177856 - DNA, 25 bp, Mus musculus
acccgtcagaacagatcattgtgac

SEQ ID NO: 177857 - DNA, 25 bp, Mus musculus
acccgtcagaagccactccgtgtat

SEQ ID NO: 177858 - DNA, 25 bp, Mus musculus
acccgtcctgaggagatcatctttc

SEQ ID NO: 177859 - DNA, 25 bp, Mus musculus
acccgtctccgccggcgctggagaa

SEQ ID NO: 177860 - DNA, 25 bp, Mus musculus
acccgtgagtgccaggtgatactta

SEQ ID NO: 177861 - DNA, 25 bp, Mus musculus
acccgtgtgagaaagtcagctctcc

SEQ ID NO: 177862 - DNA, 25 bp, Mus musculus
acccgtgtgaggctgaaaagacccc

SEQ ID NO: 177863 - DNA, 25 bp, Mus musculus
acccgttgatgtgacccggtttgga

SEQ ID NO: 177864 - DNA, 25 bp, Mus musculus
accctaaaaggaagtgctgcatggc

SEQ ID NO: 177865 - DNA, 25 bp, Mus musculus
accctaaaggagcggttccagtttg

SEQ ID NO: 177866 - DNA, 25 bp, Mus musculus
accctaacagagtacacacgaagga

SEQ ID NO: 177867 - DNA, 25 bp, Mus musculus
accctaacagtggggagccagctcc

SEQ ID NO: 177868 - DNA, 25 bp, Mus musculus
accctaagaagctatatccaggacc

SEQ ID NO: 177869 - DNA, 25 bp, Mus musculus
accctaagaagctggggacagcact

SEQ ID NO: 177870 - DNA, 25 bp, Mus musculus
accctaagactctagatattagctc

SEQ ID NO: 177871 - DNA, 25 bp, Mus musculus
accctaagtctccccatgccctacc

SEQ ID NO: 177872 - DNA, 25 bp, Mus musculus
accctaatatgaggaactgtactga

SEQ ID NO: 177873 - DNA, 25 bp, Mus musculus
accctacagaaacactcaaggctgc

SEQ ID NO: 177874 - DNA, 25 bp, Mus musculus
accctacagtaggcttcgagctgta

SEQ ID NO: 177875 - DNA, 25 bp, Mus musculus
accctacagtagggtctcactgtgc

SEQ ID NO: 177876 - DNA, 25 bp, Mus musculus
accctacatgctcaggtgcgctggt

SEQ ID NO: 177877 - DNA, 25 bp, Mus musculus
accctacatggctcctgctgactgg

SEQ ID NO: 177878 - DNA, 25 bp, Mus musculus
accctacatggcttccttcccagtg

SEQ ID NO: 177879 - DNA, 25 bp, Mus musculus
accctaccagaggaagtgggtagag

SEQ ID NO: 177880 - DNA, 25 bp, Mus musculus
accctaccctaagaacacagatctg

SEQ ID NO: 177881 - DNA, 25 bp, Mus musculus
accctacccttcgatgtcgctcacc

SEQ ID NO: 177882 - DNA, 25 bp, Mus musculus
accctacctcctcaggacttctagc

SEQ ID NO: 177883 - DNA, 25 bp, Mus musculus
accctacctcctcaggagccgtctc

SEQ ID NO: 177884 - DNA, 25 bp, Mus musculus
accctacgatagaggactcctacag

SEQ ID NO: 177885 - DNA, 25 bp, Mus musculus
accctacgatagagttgttggagtt

SEQ ID NO: 177886 - DNA, 25 bp, Mus musculus
accctacgcacagagtatgataggc

SEQ ID NO: 177887 - DNA, 25 bp, Mus musculus
accctagaacccgataatgctgagg

SEQ ID NO: 177888 - DNA, 25 bp, Mus musculus
accctagagtcccagacaggcctca

SEQ ID NO: 177889 - DNA, 25 bp, Mus musculus
accctagagtcccagctgcctgctg

SEQ ID NO: 177890 - DNA, 25 bp, Mus musculus
accctagccagatcaatacagaatc

SEQ ID NO: 177891 - DNA, 25 bp, Mus musculus
accctagccagcataattaaatcca

SEQ ID NO: 177892 - DNA, 25 bp, Mus musculus
accctagccagcccgcttcgatgac

SEQ ID NO: 177893 - DNA, 25 bp, Mus musculus
accctagccagggttgatttcttca

SEQ ID NO: 177894 - DNA, 25 bp, Mus musculus
accctagccggaaagccagtgtaac

SEQ ID NO: 177895 - DNA, 25 bp, Mus musculus
accctagccgtgtacaagtctccag

SEQ ID NO: 177896 - DNA, 25 bp, Mus musculus
accctagcttaagtatacctggcct

SEQ ID NO: 177897 - DNA, 25 bp, Mus musculus
accctaggccagataaggaattgga

SEQ ID NO: 177898 - DNA, 25 bp, Mus musculus
accctaggtcagagtcttgtccagg

SEQ ID NO: 177899 - DNA, 25 bp, Mus musculus
accctatcgaagaagaaccgatcgc

SEQ ID NO: 177900 - DNA, 25 bp, Mus musculus
accctatgaagttgaaaacacagct

SEQ ID NO: 177901 - DNA, 25 bp, Mus musculus
accctatgacaagaaaaagcggatg

SEQ ID NO: 177902 - DNA, 25 bp, Mus musculus
accctatggtgcagtgcatcattga

SEQ ID NO: 177903 - DNA, 25 bp, Mus musculus
accctatgtcagggttcggagcgac

SEQ ID NO: 177904 - DNA, 25 bp, Mus musculus
accctattaatgcctcctcctctat

SEQ ID NO: 177905 - DNA, 25 bp, Mus musculus
accctattaatggcttccaggctct

SEQ ID NO: 177906 - DNA, 25 bp, Mus musculus
accctcaaaccaggtgatcatgcta

SEQ ID NO: 177907 - DNA, 25 bp, Mus musculus
accctcaaccgtgttaggagtggat

SEQ ID NO: 177908 - DNA, 25 bp, Mus musculus
accctcagaacatctctgatgtgga

SEQ ID NO: 177909 - DNA, 25 bp, Mus musculus
accctcagaagacccccgtcagagg

SEQ ID NO: 177910 - DNA, 25 bp, Mus musculus
accctcagagctttaataagattca

SEQ ID NO: 177911 - DNA, 25 bp, Mus musculus
accctcagaggagctggactacaga

SEQ ID NO: 177912 - DNA, 25 bp, Mus musculus
accctcagaggtttaataagattca

SEQ ID NO: 177913 - DNA, 25 bp, Mus musculus
accctcagatgcaggaacccagagt

SEQ ID NO: 177914 - DNA, 25 bp, Mus musculus
accctcagcaaagacaagattgagg

SEQ ID NO: 177915 - DNA, 25 bp, Mus musculus
accctcaggatatcaaggcctctgt

SEQ ID NO: 177916 - DNA, 25 bp, Mus musculus
accctcaggatatcagctcttgcac

SEQ ID NO: 177917 - DNA, 25 bp, Mus musculus
accctcaggtatccaacgcttgtat

SEQ ID NO: 177918 - DNA, 25 bp, Mus musculus
accctcatatagaaaaatactgaat

SEQ ID NO: 177919 - DNA, 25 bp, Mus musculus
accctcatccagcatttccaagcta

SEQ ID NO: 177920 - DNA, 25 bp, Mus musculus
accctcatgcattaagtcttgtgaa

SEQ ID NO: 177921 - DNA, 25 bp, Mus musculus
accctcatgcattaagtcttgtgat

SEQ ID NO: 177922 - DNA, 25 bp, Mus musculus
accctcatgcattatgaagaagtct

SEQ ID NO: 177923 - DNA, 25 bp, Mus musculus
accctcatgcctggtggggcagtgg

SEQ ID NO: 177924 - DNA, 25 bp, Mus musculus
accctcatgttatgaaagagaatgc

SEQ ID NO: 177925 - DNA, 25 bp, Mus musculus
accctcatgttatgactcaacaagg

SEQ ID NO: 177926 - DNA, 25 bp, Mus musculus
accctcatgttatggttcctccatc

SEQ ID NO: 177927 - DNA, 25 bp, Mus musculus
accctccaaagaatcataacggttt

SEQ ID NO: 177928 - DNA, 25 bp, Mus musculus
accctccaaaggtcctgcttaggat

SEQ ID NO: 177929 - DNA, 25 bp, Mus musculus
accctccaaatccggccaaagataa

SEQ ID NO: 177930 - DNA, 25 bp, Mus musculus
accctccaacatattcgattcttga

SEQ ID NO: 177931 - DNA, 25 bp, Mus musculus
accctccaatgaaagtgctaatgct

SEQ ID NO: 177932 - DNA, 25 bp, Mus musculus
accctccactagctggcattcctac

SEQ ID NO: 177933 - DNA, 25 bp, Mus musculus
accctccagagaagatacggactct

SEQ ID NO: 177934 - DNA, 25 bp, Mus musculus
accctccagctggaccctggaggag

SEQ ID NO: 177935 - DNA, 25 bp, Mus musculus
accctccaggtagtccaggggcagc

SEQ ID NO: 177936 - DNA, 25 bp, Mus musculus
accctcccagagcctccagagcttc

SEQ ID NO: 177937 - DNA, 25 bp, Mus musculus
accctccccacagagcgcacgcgat

SEQ ID NO: 177938 - DNA, 25 bp, Mus musculus
accctcccccagagtgctgacctag

SEQ ID NO: 177939 - DNA, 25 bp, Mus musculus
accctccctccaactctacaccctc

SEQ ID NO: 177940 - DNA, 25 bp, Mus musculus
accctccctccgcggaaatctacca

SEQ ID NO: 177941 - DNA, 25 bp, Mus musculus
accctccgaagctctggatgggtcc

SEQ ID NO: 177942 - DNA, 25 bp, Mus musculus
accctccgaccaggagtcaaactga

SEQ ID NO: 177943 - DNA, 25 bp, Mus musculus
accctccggcctcagggggctactc

SEQ ID NO: 177944 - DNA, 25 bp, Mus musculus
accctcctatgtgctcccaagatgc

SEQ ID NO: 177945 - DNA, 25 bp, Mus musculus
accctcctctgcagttgttgacctc

SEQ ID NO: 177946 - DNA, 25 bp, Mus musculus
accctcggctcacagatggctgcca

SEQ ID NO: 177947 - DNA, 25 bp, Mus musculus
accctcggctcacaggcagaagact

SEQ ID NO: 177948 - DNA, 25 bp, Mus musculus
accctcggctcacgcgccctcccgc

SEQ ID NO: 177949 - DNA, 25 bp, Mus musculus
accctcgtgagagctgcttcagctg

SEQ ID NO: 177950 - DNA, 25 bp, Mus musculus
accctcgtgagagggtttctctgtg

SEQ ID NO: 177951 - DNA, 25 bp, Mus musculus
accctctaaagacaagattgaggat

SEQ ID NO: 177952 - DNA, 25 bp, Mus musculus
accctctaaagacatcgcctggtgg

SEQ ID NO: 177953 - DNA, 25 bp, Mus musculus
accctctaaggatatgctgtcattc

SEQ ID NO: 177954 - DNA, 25 bp, Mus musculus
accctctataccagactttgtacct

SEQ ID NO: 177955 - DNA, 25 bp, Mus musculus
accctctatcagcaggaatccagcc

SEQ ID NO: 177956 - DNA, 25 bp, Mus musculus
accctctatccctcttggaggaacc

SEQ ID NO: 177957 - DNA, 25 bp, Mus musculus
accctctcagtgtgtgactttcttg

SEQ ID NO: 177958 - DNA, 25 bp, Mus musculus
accctctccagcaggcacctccagt

SEQ ID NO: 177959 - DNA, 25 bp, Mus musculus
accctctctctaccctcctgctgac

SEQ ID NO: 177960 - DNA, 25 bp, Mus musculus
accctctctggactctatagctgca

SEQ ID NO: 177961 - DNA, 25 bp, Mus musculus
accctctctggcagaatccatgcga

SEQ ID NO: 177962 - DNA, 25 bp, Mus musculus
accctctctggcagcgaaattggaa

SEQ ID NO: 177963 - DNA, 25 bp, Mus musculus
accctctgaaactgtgccgatcccc

SEQ ID NO: 177964 - DNA, 25 bp, Mus musculus
accctctgagaagagatggcgtcag

SEQ ID NO: 177965 - DNA, 25 bp, Mus musculus
accctctgagagaagacccatgctt

SEQ ID NO: 177966 - DNA, 25 bp, Mus musculus
accctctgaggggcaccatgtactg

SEQ ID NO: 177967 - DNA, 25 bp, Mus musculus
accctctgatactccagatccaact

SEQ ID NO: 177968 - DNA, 25 bp, Mus musculus
accctctgattgctaaagaagaaga

SEQ ID NO: 177969 - DNA, 25 bp, Mus musculus
accctctgccctgctataacggagg

SEQ ID NO: 177970 - DNA, 25 bp, Mus musculus
accctctgcgaagatggaatgaaac

SEQ ID NO: 177971 - DNA, 25 bp, Mus musculus
accctctgctgaaggtgtccatcat

SEQ ID NO: 177972 - DNA, 25 bp, Mus musculus
accctctggatcagaattaaaatgc

SEQ ID NO: 177973 - DNA, 25 bp, Mus musculus
accctctggatcagatctccatgat

SEQ ID NO: 177974 - DNA, 25 bp, Mus musculus
accctctggatcagattgattatgt

SEQ ID NO: 177975 - DNA, 25 bp, Mus musculus
accctctggctcatacatgtctcag

SEQ ID NO: 177976 - DNA, 25 bp, Mus musculus
accctctgggaaaggtattctctaa

SEQ ID NO: 177977 - DNA, 25 bp, Mus musculus
accctctgggacaggtattctctaa

SEQ ID NO: 177978 - DNA, 25 bp, Mus musculus
accctctggtcagtcaatcccatgg

SEQ ID NO: 177979 - DNA, 25 bp, Mus musculus
accctctgtgggtgaacgtgggtct

SEQ ID NO: 177980 - DNA, 25 bp, Mus musculus
accctctgtggtgagcatcagatgg

SEQ ID NO: 177981 - DNA, 25 bp, Mus musculus
accctctgtgtgacagctcaacttc

SEQ ID NO: 177982 - DNA, 25 bp, Mus musculus
accctcttagcagaaatctagatct

SEQ ID NO: 177983 - DNA, 25 bp, Mus musculus
accctcttcggctacagcaagtggg

SEQ ID NO: 177984 - DNA, 25 bp, Mus musculus
accctcttcggtgtttatggagatg

SEQ ID NO: 177985 - DNA, 25 bp, Mus musculus
accctcttcgtcaaggctggttatg

SEQ ID NO: 177986 - DNA, 25 bp, Mus musculus
accctcttctaccactgaggggttt

SEQ ID NO: 177987 - DNA, 25 bp, Mus musculus
accctcttcttcagatacatgtctc

SEQ ID NO: 177988 - DNA, 25 bp, Mus musculus
accctctttcaagccgtaattgctg

SEQ ID NO: 177989 - DNA, 25 bp, Mus musculus
accctgaaaaatcgggttctgcctg

SEQ ID NO: 177990 - DNA, 25 bp, Mus musculus
accctgaaaagtgcaggtgtgcatt

SEQ ID NO: 177991 - DNA, 25 bp, Mus musculus
accctgaaactcaggtggtgctgat

SEQ ID NO: 177992 - DNA, 25 bp, Mus musculus
accctgaaagagttaaacatcttat

SEQ ID NO: 177993 - DNA, 25 bp, Mus musculus
accctgaaattatatcattggatac

SEQ ID NO: 177994 - DNA, 25 bp, Mus musculus
accctgaactcaacatggcaaggca

SEQ ID NO: 177995 - DNA, 25 bp, Mus musculus
accctgaactcaagttcacgcaaag

SEQ ID NO: 177996 - DNA, 25 bp, Mus musculus
accctgaagagagcagataagattc

SEQ ID NO: 177997 - DNA, 25 bp, Mus musculus
accctgaagagatgccacctcggct

SEQ ID NO: 177998 - DNA, 25 bp, Mus musculus
accctgacaggatgcaagctgttgc

SEQ ID NO: 177999 - DNA, 25 bp, Mus musculus
accctgacaggcaggtaccaccatg

SEQ ID NO: 178000 - DNA, 25 bp, Mus musculus
accctgacaggggcataaggacagc

SEQ ID NO: 178001 - DNA, 25 bp, Mus musculus
accctgacccagccccaccattctc

SEQ ID NO: 178002 - DNA, 25 bp, Mus musculus
accctgacccagcttctcgtgtaga

SEQ ID NO: 178003 - DNA, 25 bp, Mus musculus
accctgacccaggaacacagtgtgt

SEQ ID NO: 178004 - DNA, 25 bp, Mus musculus
accctgacccaggtcaacagctgag

SEQ ID NO: 178005 - DNA, 25 bp, Mus musculus
accctgacctaagtcgaatggtatg

SEQ ID NO: 178006 - DNA, 25 bp, Mus musculus
accctgacctgtgctgctccgcaga

SEQ ID NO: 178007 - DNA, 25 bp, Mus musculus
accctgacctgtggttcctgcacga

SEQ ID NO: 178008 - DNA, 25 bp, Mus musculus
accctgactttactaggacctggcc

SEQ ID NO: 178009 - DNA, 25 bp, Mus musculus
accctgactttcatgatgcccccac

SEQ ID NO: 178010 - DNA, 25 bp, Mus musculus
accctgactttgtggctgttccatt

SEQ ID NO: 178011 - DNA, 25 bp, Mus musculus
accctgagaaggagcttcctgtcac

SEQ ID NO: 178012 - DNA, 25 bp, Mus musculus
accctgagaaggaggtcactcttat

SEQ ID NO: 178013 - DNA, 25 bp, Mus musculus
accctgagacccaggtggtactgat

SEQ ID NO: 178014 - DNA, 25 bp, Mus musculus
accctgagcaggctcctgctgaagg

SEQ ID NO: 178015 - DNA, 25 bp, Mus musculus
accctgagcctgaagaaaaagttaa

SEQ ID NO: 178016 - DNA, 25 bp, Mus musculus
accctgagcctgaagtggtgttcaa

SEQ ID NO: 178017 - DNA, 25 bp, Mus musculus
accctgagcgcccccgtggaatggc

SEQ ID NO: 178018 - DNA, 25 bp, Mus musculus
accctgagctggccaaaaggccaga

SEQ ID NO: 178019 - DNA, 25 bp, Mus musculus
accctgagctggctctctgacaaat

SEQ ID NO: 178020 - DNA, 25 bp, Mus musculus
accctgaggcagaagctccaagatg

SEQ ID NO: 178021 - DNA, 25 bp, Mus musculus
accctgaggctgcttctttttaaag

SEQ ID NO: 178022 - DNA, 25 bp, Mus musculus
accctgaggctgcttgggaaccaac

SEQ ID NO: 178023 - DNA, 25 bp, Mus musculus
accctgataatggcagcccagccat

SEQ ID NO: 178024 - DNA, 25 bp, Mus musculus
accctgatccagatctggccgcccc

SEQ ID NO: 178025 - DNA, 25 bp, Mus musculus
accctgatctgcggcggtcagggaa

SEQ ID NO: 178026 - DNA, 25 bp, Mus musculus
accctgatgaaaacgttgtatcaga

SEQ ID NO: 178027 - DNA, 25 bp, Mus musculus
accctgatgctgaggcctgacctgg

SEQ ID NO: 178028 - DNA, 25 bp, Mus musculus
accctgcaagagttctttttgcaga

SEQ ID NO: 178029 - DNA, 25 bp, Mus musculus
accctgcaagatggagggggcagaa

SEQ ID NO: 178030 - DNA, 25 bp, Mus musculus
accctgcacggctgtggacttaagt

SEQ ID NO: 178031 - DNA, 25 bp, Mus musculus
accctgcactctatgttttctcagt

SEQ ID NO: 178032 - DNA, 25 bp, Mus musculus
accctgcagggagagagaatcaatg

SEQ ID NO: 178033 - DNA, 25 bp, Mus musculus
accctgcatctgagtgccgtactgt

SEQ ID NO: 178034 - DNA, 25 bp, Mus musculus
accctgccacccaggttctgattgg

SEQ ID NO: 178035 - DNA, 25 bp, Mus musculus
accctgccagggatggcgcggccga

SEQ ID NO: 178036 - DNA, 25 bp, Mus musculus
accctgccatcagatacaagcggaa

SEQ ID NO: 178037 - DNA, 25 bp, Mus musculus
accctgccattctagatgtgaaggc

SEQ ID NO: 178038 - DNA, 25 bp, Mus musculus
accctgccattctgatgaagttcct

SEQ ID NO: 178039 - DNA, 25 bp, Mus musculus
accctgccattcttattctgaggaa

SEQ ID NO: 178040 - DNA, 25 bp, Mus musculus
accctgcctcagcccatacccagcc

SEQ ID NO: 178041 - DNA, 25 bp, Mus musculus
accctgcctccagcactgggaagca

SEQ ID NO: 178042 - DNA, 25 bp, Mus musculus
accctgcctgatgagctgggagacc

SEQ ID NO: 178043 - DNA, 25 bp, Mus musculus
accctgccttcaaacgtgtttggac

SEQ ID NO: 178044 - DNA, 25 bp, Mus musculus
accctgcgcctggagcaggaagggc

SEQ ID NO: 178045 - DNA, 25 bp, Mus musculus
accctgcggccacgaaacgatcagc

SEQ ID NO: 178046 - DNA, 25 bp, Mus musculus
accctgctaaatgttaggccggggc

SEQ ID NO: 178047 - DNA, 25 bp, Mus musculus
accctgctcctgggcttgtggagaa

SEQ ID NO: 178048 - DNA, 25 bp, Mus musculus
accctgctcctggtggcatctttag

SEQ ID NO: 178049 - DNA, 25 bp, Mus musculus
accctgctcctggtttctgaacttg

SEQ ID NO: 178050 - DNA, 25 bp, Mus musculus
accctgcttactggtttctctcgaa

SEQ ID NO: 178051 - DNA, 25 bp, Mus musculus
accctgcttactggtttctgtctga

SEQ ID NO: 178052 - DNA, 25 bp, Mus musculus
accctgcttatgaaagccatcacca

SEQ ID NO: 178053 - DNA, 25 bp, Mus musculus
accctgcttatgagtcagcagtgta

SEQ ID NO: 178054 - DNA, 25 bp, Mus musculus
accctgcttcagcaacttgatttct

SEQ ID NO: 178055 - DNA, 25 bp, Mus musculus
accctgcttgcgaggcaggaaacag

SEQ ID NO: 178056 - DNA, 25 bp, Mus musculus
accctgcttgcgagggtgacacttc

SEQ ID NO: 178057 - DNA, 25 bp, Mus musculus
accctggaaggaactatgctgttgg

SEQ ID NO: 178058 - DNA, 25 bp, Mus musculus
accctggacaaatgtcccttcactg

SEQ ID NO: 178059 - DNA, 25 bp, Mus musculus
accctggacaacaagaaggggcgaa

SEQ ID NO: 178060 - DNA, 25 bp, Mus musculus
accctggacaagttaatcgatggca

SEQ ID NO: 178061 - DNA, 25 bp, Mus musculus
accctggacaatggtgaacaaccca

SEQ ID NO: 178062 - DNA, 25 bp, Mus musculus
accctggacagccccggcagcccaa

SEQ ID NO: 178063 - DNA, 25 bp, Mus musculus
accctggacgaccggcgtgtgcagc

SEQ ID NO: 178064 - DNA, 25 bp, Mus musculus
accctggacgaccgtatctggacta

SEQ ID NO: 178065 - DNA, 25 bp, Mus musculus
accctggacggcaggtgaagtggaa

SEQ ID NO: 178066 - DNA, 25 bp, Mus musculus
accctggactaaggatcaccactac

SEQ ID NO: 178067 - DNA, 25 bp, Mus musculus
accctggactgctgtaagtgtggac

SEQ ID NO: 178068 - DNA, 25 bp, Mus musculus
accctggagctagcatctcgctctc

SEQ ID NO: 178069 - DNA, 25 bp, Mus musculus
accctggagctagcatgctcacgca

SEQ ID NO: 178070 - DNA, 25 bp, Mus musculus
accctggatctggtcttctagggga

SEQ ID NO: 178071 - DNA, 25 bp, Mus musculus
accctggatgatgggctaggccatg

SEQ ID NO: 178072 - DNA, 25 bp, Mus musculus
accctggatgatggtgtgattgcca

SEQ ID NO: 178073 - DNA, 25 bp, Mus musculus
accctggcaagaggtccgtcttcca

SEQ ID NO: 178074 - DNA, 25 bp, Mus musculus
accctggcacaaggcaggcgacaag

SEQ ID NO: 178075 - DNA, 25 bp, Mus musculus
accctggcacaaggtaacacggaag

SEQ ID NO: 178076 - DNA, 25 bp, Mus musculus
accctggcactgtgaaaattccacc

SEQ ID NO: 178077 - DNA, 25 bp, Mus musculus
accctggcaggtgcacaggctgctg

SEQ ID NO: 178078 - DNA, 25 bp, Mus musculus
accctggcccgccaggactgcagta

SEQ ID NO: 178079 - DNA, 25 bp, Mus musculus
accctggcccttagagtaatccata

SEQ ID NO: 178080 - DNA, 25 bp, Mus musculus
accctggcctgcctgagggatctga

SEQ ID NO: 178081 - DNA, 25 bp, Mus musculus
accctggcgggaggcgcaacagcgt

SEQ ID NO: 178082 - DNA, 25 bp, Mus musculus
accctggcgggagggctcaggatcc

SEQ ID NO: 178083 - DNA, 25 bp, Mus musculus
accctgggaaaggtgctgggtgtgt

SEQ ID NO: 178084 - DNA, 25 bp, Mus musculus
accctgggaagactaaaatgtcaaa

SEQ ID NO: 178085 - DNA, 25 bp, Mus musculus
accctgggtcagaagcatactgagg

SEQ ID NO: 178086 - DNA, 25 bp, Mus musculus
accctgggtcagaagcatacttaga

SEQ ID NO: 178087 - DNA, 25 bp, Mus musculus
accctgggttcctagctggaggaaa

SEQ ID NO: 178088 - DNA, 25 bp, Mus musculus
accctgggttcctaggtccagctgg

SEQ ID NO: 178089 - DNA, 25 bp, Mus musculus
accctggtaactgctgggggctctc

SEQ ID NO: 178090 - DNA, 25 bp, Mus musculus
accctggtactgtccgcatgagaca

SEQ ID NO: 178091 - DNA, 25 bp, Mus musculus
accctggtcaggcagttccagggcc

SEQ ID NO: 178092 - DNA, 25 bp, Mus musculus
accctggtggcaggatcaagttctc

SEQ ID NO: 178093 - DNA, 25 bp, Mus musculus
accctggttcctgtctgcagctgtg

SEQ ID NO: 178094 - DNA, 25 bp, Mus musculus
accctgtaaaagatttctaacgagc

SEQ ID NO: 178095 - DNA, 25 bp, Mus musculus
accctgtacagagagctccaagtcc

SEQ ID NO: 178096 - DNA, 25 bp, Mus musculus
accctgtacagagccaccttgtctc

SEQ ID NO: 178097 - DNA, 25 bp, Mus musculus
accctgtactgcattaacttcagcc

SEQ ID NO: 178098 - DNA, 25 bp, Mus musculus
accctgtactgtgacaagggcactg

SEQ ID NO: 178099 - DNA, 25 bp, Mus musculus
accctgtcagaagcccagaggacag

SEQ ID NO: 178100 - DNA, 25 bp, Mus musculus
accctgtcaggccttgccagcacag

SEQ ID NO: 178101 - DNA, 25 bp, Mus musculus
accctgtccaagcccacaggactgc

SEQ ID NO: 178102 - DNA, 25 bp, Mus musculus
accctgtccaggtagctctggctgg

SEQ ID NO: 178103 - DNA, 25 bp, Mus musculus
accctgtccttcgggtactatgggt

SEQ ID NO: 178104 - DNA, 25 bp, Mus musculus
accctgtctcggtgctcttcaaatg

SEQ ID NO: 178105 - DNA, 25 bp, Mus musculus
accctgtctcggtgtccttcccgtc

SEQ ID NO: 178106 - DNA, 25 bp, Mus musculus
accctgtctctccggatggacctga

SEQ ID NO: 178107 - DNA, 25 bp, Mus musculus
accctgtctctccggcccccgcgcg

SEQ ID NO: 178108 - DNA, 25 bp, Mus musculus
accctgtctgttgcggtggcactgc

SEQ ID NO: 178109 - DNA, 25 bp, Mus musculus
accctgtctttggagatctctgaca

SEQ ID NO: 178110 - DNA, 25 bp, Mus musculus
accctgtgaacctgaaaaatcatgt

SEQ ID NO: 178111 - DNA, 25 bp, Mus musculus
accctgtgaacctgacgtggccatt

SEQ ID NO: 178112 - DNA, 25 bp, Mus musculus
accctgtgacgaaagaagaaattaa

SEQ ID NO: 178113 - DNA, 25 bp, Mus musculus
accctgtgagctcggtcgaggagtg

SEQ ID NO: 178114 - DNA, 25 bp, Mus musculus
accctgtgataaagaccagaatatg

SEQ ID NO: 178115 - DNA, 25 bp, Mus musculus
accctgtgataaaggtgtccccaag

SEQ ID NO: 178116 - DNA, 25 bp, Mus musculus
accctgtgcaccaggtacaagcagt

SEQ ID NO: 178117 - DNA, 25 bp, Mus musculus
accctgtgcacctctcctcttgtgt

SEQ ID NO: 178118 - DNA, 25 bp, Mus musculus
accctgtggacttagggctgaccag

SEQ ID NO: 178119 - DNA, 25 bp, Mus musculus
accctgtggacttaggtgacaagtt

SEQ ID NO: 178120 - DNA, 25 bp, Mus musculus
accctgtgtgagagtgtggctatct

SEQ ID NO: 178121 - DNA, 25 bp, Mus musculus
accctgtgtttgtggtcctccactc

SEQ ID NO: 178122 - DNA, 25 bp, Mus musculus
accctgtgtttgtggtctttgctga

SEQ ID NO: 178123 - DNA, 25 bp, Mus musculus
accctgttgaggtttttcatcttga

SEQ ID NO: 178124 - DNA, 25 bp, Mus musculus
accctgttgggaactgttgacaagc

SEQ ID NO: 178125 - DNA, 25 bp, Mus musculus
acccttaaagatgaccttgcttcca

SEQ ID NO: 178126 - DNA, 25 bp, Mus musculus
acccttaaccaaggacattcactga

SEQ ID NO: 178127 - DNA, 25 bp, Mus musculus
acccttaaccaagggatgactggca

SEQ ID NO: 178128 - DNA, 25 bp, Mus musculus
acccttaagggccacaccaaggatg

SEQ ID NO: 178129 - DNA, 25 bp, Mus musculus
acccttacaaaggtgaccgggctgc

SEQ ID NO: 178130 - DNA, 25 bp, Mus musculus
acccttaccacctatgtgccatgga

SEQ ID NO: 178131 - DNA, 25 bp, Mus musculus
acccttacccagatgaggctctgtc

SEQ ID NO: 178132 - DNA, 25 bp, Mus musculus
acccttacccagcccagagcccggc

SEQ ID NO: 178133 - DNA, 25 bp, Mus musculus
acccttcaaccaggtcaggctgttc

SEQ ID NO: 178134 - DNA, 25 bp, Mus musculus
acccttcaagatcccgattcgctcc

SEQ ID NO: 178135 - DNA, 25 bp, Mus musculus
acccttcagcaccaggagggagcta

SEQ ID NO: 178136 - DNA, 25 bp, Mus musculus
acccttcagcagatgaatggaaact

SEQ ID NO: 178137 - DNA, 25 bp, Mus musculus
acccttcatctgccgactccctgtc

SEQ ID NO: 178138 - DNA, 25 bp, Mus musculus
acccttcatctgccggaagccgact

SEQ ID NO: 178139 - DNA, 25 bp, Mus musculus
acccttcccgccgcggaggagaatg

SEQ ID NO: 178140 - DNA, 25 bp, Mus musculus
acccttcccgctggctgtaattcaa

SEQ ID NO: 178141 - DNA, 25 bp, Mus musculus
acccttccctgaaacccaaatatgc

SEQ ID NO: 178142 - DNA, 25 bp, Mus musculus
acccttccctgagacaatgtctatg

SEQ ID NO: 178143 - DNA, 25 bp, Mus musculus
acccttccctggaaaatctggatgt

SEQ ID NO: 178144 - DNA, 25 bp, Mus musculus
acccttcctgaaggagcagagagtg

SEQ ID NO: 178145 - DNA, 25 bp, Mus musculus
acccttcgagaagcctggaaaggaa

SEQ ID NO: 178146 - DNA, 25 bp, Mus musculus
acccttcgatgtcgctcaccaggca

SEQ ID NO: 178147 - DNA, 25 bp, Mus musculus
acccttcgcggcgggataaataagg

SEQ ID NO: 178148 - DNA, 25 bp, Mus musculus
acccttcgcggcgggcaaatgacca

SEQ ID NO: 178149 - DNA, 25 bp, Mus musculus
acccttctaagttggatcagtgatg

SEQ ID NO: 178150 - DNA, 25 bp, Mus musculus
acccttcttagtatcctttagccca

SEQ ID NO: 178151 - DNA, 25 bp, Mus musculus
acccttcttagtgggtcctgtgtca

SEQ ID NO: 178152 - DNA, 25 bp, Mus musculus
acccttgaactgaggaacgggcatg

SEQ ID NO: 178153 - DNA, 25 bp, Mus musculus
acccttgaaggtgaacaaggcaagc

SEQ ID NO: 178154 - DNA, 25 bp, Mus musculus
acccttgcagcatacgaaggacaac

SEQ ID NO: 178155 - DNA, 25 bp, Mus musculus
acccttgcatcctctaccccctcac

SEQ ID NO: 178156 - DNA, 25 bp, Mus musculus
acccttgccaaaagcggggagccca

SEQ ID NO: 178157 - DNA, 25 bp, Mus musculus
acccttgccaaggttcccagaagcg

SEQ ID NO: 178158 - DNA, 25 bp, Mus musculus
acccttgccgtatggtgacagctgg

SEQ ID NO: 178159 - DNA, 25 bp, Mus musculus
acccttgcgagagcaatctgatgat

SEQ ID NO: 178160 - DNA, 25 bp, Mus musculus
acccttgctaaggggcacctggcca

SEQ ID NO: 178161 - DNA, 25 bp, Mus musculus
acccttgctgcaatgaagctgatga

SEQ ID NO: 178162 - DNA, 25 bp, Mus musculus
acccttgcttgtcggaatctgatgc

SEQ ID NO: 178163 - DNA, 25 bp, Mus musculus
acccttggcagacagggtcccttgc

SEQ ID NO: 178164 - DNA, 25 bp, Mus musculus
acccttggcaggagctgtgaaatca

SEQ ID NO: 178165 - DNA, 25 bp, Mus musculus
acccttggcgttcaacaggtggtgt

SEQ ID NO: 178166 - DNA, 25 bp, Mus musculus
acccttgggtcaaggtcgagtatgc

SEQ ID NO: 178167 - DNA, 25 bp, Mus musculus
acccttgtgatgtggtgaagactcg

SEQ ID NO: 178168 - DNA, 25 bp, Mus musculus
acccttgttcactgtacctcatcaa

SEQ ID NO: 178169 - DNA, 25 bp, Mus musculus
accctttactgaaattaccatggtt

SEQ ID NO: 178170 - DNA, 25 bp, Mus musculus
accctttagatgctagtggaggttc

SEQ ID NO: 178171 - DNA, 25 bp, Mus musculus
accctttagatggtgtggatccaga

SEQ ID NO: 178172 - DNA, 25 bp, Mus musculus
accctttatgctatgaaaccactag

SEQ ID NO: 178173 - DNA, 25 bp, Mus musculus
accctttatgctcaatatgaagata

SEQ ID NO: 178174 - DNA, 25 bp, Mus musculus
accctttatgctgattctctgacct

SEQ ID NO: 178175 - DNA, 25 bp, Mus musculus
accctttattcaggagatgatttgg

SEQ ID NO: 178176 - DNA, 25 bp, Mus musculus
accctttcactggggatcacaagca

SEQ ID NO: 178177 - DNA, 25 bp, Mus musculus
accctttcagatctcgctgcctacc

SEQ ID NO: 178178 - DNA, 25 bp, Mus musculus
accctttcagccgttaaccacatct

SEQ ID NO: 178179 - DNA, 25 bp, Mus musculus
accctttcatagattaccaaggaaa

SEQ ID NO: 178180 - DNA, 25 bp, Mus musculus
accctttcatagctatgataagtta

SEQ ID NO: 178181 - DNA, 25 bp, Mus musculus
accctttgcctggctccaagatgaa

SEQ ID NO: 178182 - DNA, 25 bp, Mus musculus
accctttggagaatgcagttccttt

SEQ ID NO: 178183 - DNA, 25 bp, Mus musculus
accctttgggaagcgcctgctgaac

SEQ ID NO: 178184 - DNA, 25 bp, Mus musculus
accctttggtgacaggcttccccac

SEQ ID NO: 178185 - DNA, 25 bp, Mus musculus
acccttttcagactcttgtgtactt

SEQ ID NO: 178186 - DNA, 25 bp, Mus musculus
acccttttcaggtcgtgcatgacaa

SEQ ID NO: 178187 - DNA, 25 bp, Mus musculus
acccttttcatgcctagtgacctga

SEQ ID NO: 178188 - DNA, 25 bp, Mus musculus
accgaaaaccccagatctgtgccgc

SEQ ID NO: 178189 - DNA, 25 bp, Mus musculus
accgaaaactggaagtgacccagac

SEQ ID NO: 178190 - DNA, 25 bp, Mus musculus
accgaaaagaggactaggaaaagag

SEQ ID NO: 178191 - DNA, 25 bp, Mus musculus
accgaaaatgaaggttctgggctga

SEQ ID NO: 178192 - DNA, 25 bp, Mus musculus
accgaaaatgaagtcgagcctgttg

SEQ ID NO: 178193 - DNA, 25 bp, Mus musculus
accgaaaccgcaggcttatgatgga

SEQ ID NO: 178194 - DNA, 25 bp, Mus musculus
accgaaagcagaggagcaccggggg

SEQ ID NO: 178195 - DNA, 25 bp, Mus musculus
accgaacaagcccaggagacaatca

SEQ ID NO: 178196 - DNA, 25 bp, Mus musculus
accgaacacagtgaggatgccatga

SEQ ID NO: 178197 - DNA, 25 bp, Mus musculus
accgaactcacccaagtgcaaaaca

SEQ ID NO: 178198 - DNA, 25 bp, Mus musculus
accgaactcacccaagtgttgccca

SEQ ID NO: 178199 - DNA, 25 bp, Mus musculus
accgaagaagaatgggctctacttg

SEQ ID NO: 178200 - DNA, 25 bp, Mus musculus
accgaagaagaatgggtctttcctt

SEQ ID NO: 178201 - DNA, 25 bp, Mus musculus
accgaagacacaagtagaaggcagt

SEQ ID NO: 178202 - DNA, 25 bp, Mus musculus
accgaagactggcaggacagtttct

SEQ ID NO: 178203 - DNA, 25 bp, Mus musculus
accgaataaatgcagtatctctcct

SEQ ID NO: 178204 - DNA, 25 bp, Mus musculus
accgaatatatatggaagaccacca

SEQ ID NO: 178205 - DNA, 25 bp, Mus musculus
accgaatcacagctgccttcaccat

SEQ ID NO: 178206 - DNA, 25 bp, Mus musculus
accgaatgagaaaggtttaactgag

SEQ ID NO: 178207 - DNA, 25 bp, Mus musculus
accgaatgagagactctacaggagc

SEQ ID NO: 178208 - DNA, 25 bp, Mus musculus
accgaatgagctgccgagtgtttca

SEQ ID NO: 178209 - DNA, 25 bp, Mus musculus
accgaatgcagaggtgaggcatgaa

SEQ ID NO: 178210 - DNA, 25 bp, Mus musculus
accgaatgcagccagcgggtattcc

SEQ ID NO: 178211 - DNA, 25 bp, Mus musculus
accgaatgcagccagggcctgtgtt

SEQ ID NO: 178212 - DNA, 25 bp, Mus musculus
accgaatggacagggtaaagaagga

SEQ ID NO: 178213 - DNA, 25 bp, Mus musculus
accgacaacatgcagggtgtgttgg

SEQ ID NO: 178214 - DNA, 25 bp, Mus musculus
accgacagcatcaaaatgccaggca

SEQ ID NO: 178215 - DNA, 25 bp, Mus musculus
accgacagcatcaaggacaattcaa

SEQ ID NO: 178216 - DNA, 25 bp, Mus musculus
accgacagcatcaaggcctgggagg

SEQ ID NO: 178217 - DNA, 25 bp, Mus musculus
accgacaggcttcaagagtggtctt

SEQ ID NO: 178218 - DNA, 25 bp, Mus musculus
accgacaggcttcacttcatcttca

SEQ ID NO: 178219 - DNA, 25 bp, Mus musculus
accgacccacagagaggccgtgaga

SEQ ID NO: 178220 - DNA, 25 bp, Mus musculus
accgacccacagagggagcatgact

SEQ ID NO: 178221 - DNA, 25 bp, Mus musculus
accgacccccaggctcaacagtgta

SEQ ID NO: 178222 - DNA, 25 bp, Mus musculus
accgaccgctccaagtttgttgaaa

SEQ ID NO: 178223 - DNA, 25 bp, Mus musculus
accgacctcatctaggtacgtaggt

SEQ ID NO: 178224 - DNA, 25 bp, Mus musculus
accgacctgaaagctttacaactcc

SEQ ID NO: 178225 - DNA, 25 bp, Mus musculus
accgacctgagacttcattgaacca

SEQ ID NO: 178226 - DNA, 25 bp, Mus musculus
accgacctgagcaagaaattatcag

SEQ ID NO: 178227 - DNA, 25 bp, Mus musculus
accgacctggtcagtcttacttctc

SEQ ID NO: 178228 - DNA, 25 bp, Mus musculus
accgacgagaaaaagctggagagat

SEQ ID NO: 178229 - DNA, 25 bp, Mus musculus
accgacgagcccttgctgctcttgg

SEQ ID NO: 178230 - DNA, 25 bp, Mus musculus
accgacggcacactgaaaagatccg

SEQ ID NO: 178231 - DNA, 25 bp, Mus musculus
accgacggcacactgatgagcgccc

SEQ ID NO: 178232 - DNA, 25 bp, Mus musculus
accgacgttaatgagtgcaatgctc

SEQ ID NO: 178233 - DNA, 25 bp, Mus musculus
accgactcaataaggtcactcttca

SEQ ID NO: 178234 - DNA, 25 bp, Mus musculus
accgactcagacagagtctttctat

SEQ ID NO: 178235 - DNA, 25 bp, Mus musculus
accgactcagctgactcaagagact

SEQ ID NO: 178236 - DNA, 25 bp, Mus musculus
accgactcctcagacagcactcaaa

SEQ ID NO: 178237 - DNA, 25 bp, Mus musculus
accgactgaagcacggtgcaacaga

SEQ ID NO: 178238 - DNA, 25 bp, Mus musculus
accgactggaggatgctttgctgag

SEQ ID NO: 178239 - DNA, 25 bp, Mus musculus
accgacttaaaacttcaggttgtgt

SEQ ID NO: 178240 - DNA, 25 bp, Mus musculus
accgacttcacccgaggcaaaggtc

SEQ ID NO: 178241 - DNA, 25 bp, Mus musculus
accgacttcctcgctgcacctggtg

SEQ ID NO: 178242 - DNA, 25 bp, Mus musculus
accgactttcacgatatgtgaccaa

SEQ ID NO: 178243 - DNA, 25 bp, Mus musculus
accgacttttcagagccactcagca

SEQ ID NO: 178244 - DNA, 25 bp, Mus musculus
accgacttttcagggttcagactgg

SEQ ID NO: 178245 - DNA, 25 bp, Mus musculus
accgagaagaggatggctgctccca

SEQ ID NO: 178246 - DNA, 25 bp, Mus musculus
accgagaataagtccaagtttgggg

SEQ ID NO: 178247 - DNA, 25 bp, Mus musculus
accgagacagctccttccgcttcca

SEQ ID NO: 178248 - DNA, 25 bp, Mus musculus
accgagaccagatcatcttcatggt

SEQ ID NO: 178249 - DNA, 25 bp, Mus musculus
accgagacctgtggggtttggtggt

SEQ ID NO: 178250 - DNA, 25 bp, Mus musculus
accgagagcatgaagactccgtggt

SEQ ID NO: 178251 - DNA, 25 bp, Mus musculus
accgagagcatgaagggcgtttttt

SEQ ID NO: 178252 - DNA, 25 bp, Mus musculus
accgagagcatgaagtgggccaatc

SEQ ID NO: 178253 - DNA, 25 bp, Mus musculus
accgagatatcaaagctgccaacgt

SEQ ID NO: 178254 - DNA, 25 bp, Mus musculus
accgagatgcagctgttgccgcaca

SEQ ID NO: 178255 - DNA, 25 bp, Mus musculus
accgagatgctaccggtactaaaca

SEQ ID NO: 178256 - DNA, 25 bp, Mus musculus
accgagatggaatgaagaaaagcaa

SEQ ID NO: 178257 - DNA, 25 bp, Mus musculus
accgagattgatgtggccagcctgc

SEQ ID NO: 178258 - DNA, 25 bp, Mus musculus
accgagcagagcccacagcaacctc

SEQ ID NO: 178259 - DNA, 25 bp, Mus musculus
accgagcagcgaacagttgaataga

SEQ ID NO: 178260 - DNA, 25 bp, Mus musculus
accgagcctggggcgaggaaccacc

SEQ ID NO: 178261 - DNA, 25 bp, Mus musculus
accgagcctggggcggtcagtttag

SEQ ID NO: 178262 - DNA, 25 bp, Mus musculus
accgaggaaggtccatgcgaagtgg

SEQ ID NO: 178263 - DNA, 25 bp, Mus musculus
accgaggaccagcgcaacaaaaaga

SEQ ID NO: 178264 - DNA, 25 bp, Mus musculus
accgaggacgaagtgtttgactttg

SEQ ID NO: 178265 - DNA, 25 bp, Mus musculus
accgaggagagcactgcctgcacat

SEQ ID NO: 178266 - DNA, 25 bp, Mus musculus
accgaggagagccggatggcgcaga

SEQ ID NO: 178267 - DNA, 25 bp, Mus musculus
accgaggagcgcaggggccccacct

SEQ ID NO: 178268 - DNA, 25 bp, Mus musculus
accgaggagcgcaggttgtgtcacc

SEQ ID NO: 178269 - DNA, 25 bp, Mus musculus
accgaggaggtgaggggacttcaaa

SEQ ID NO: 178270 - DNA, 25 bp, Mus musculus
accgaggcaaatacctcgctattgt

SEQ ID NO: 178271 - DNA, 25 bp, Mus musculus
accgaggcaaatcctggatggtatc

SEQ ID NO: 178272 - DNA, 25 bp, Mus musculus
accgaggcaatctacgggctggtga

SEQ ID NO: 178273 - DNA, 25 bp, Mus musculus
accgaggccaaaactgggtttcact

SEQ ID NO: 178274 - DNA, 25 bp, Mus musculus
accgaggccaaagttcaggacatct

SEQ ID NO: 178275 - DNA, 25 bp, Mus musculus
accgaggccagggactcagcgatgt

SEQ ID NO: 178276 - DNA, 25 bp, Mus musculus
accgaggcctaggatcagttcttaa

SEQ ID NO: 178277 - DNA, 25 bp, Mus musculus
accgaggcgcgtgagacgcagaggc

SEQ ID NO: 178278 - DNA, 25 bp, Mus musculus
accgaggcgcgtgagatgcccggaa

SEQ ID NO: 178279 - DNA, 25 bp, Mus musculus
accgaggtaagaaatggcgctcaaa

SEQ ID NO: 178280 - DNA, 25 bp, Mus musculus
accgagtcaagcaggtctgcggaga

SEQ ID NO: 178281 - DNA, 25 bp, Mus musculus
accgagtcacacgataagcccctgg

SEQ ID NO: 178282 - DNA, 25 bp, Mus musculus
accgagtccgagagttcaaaggtga

SEQ ID NO: 178283 - DNA, 25 bp, Mus musculus
accgagtcctcaggccaatgtgctt

SEQ ID NO: 178284 - DNA, 25 bp, Mus musculus
accgagtgatagggtaaaatttatg

SEQ ID NO: 178285 - DNA, 25 bp, Mus musculus
accgagtggcagtgatcatgggcag

SEQ ID NO: 178286 - DNA, 25 bp, Mus musculus
accgagttccgggtcatgcatccat

SEQ ID NO: 178287 - DNA, 25 bp, Mus musculus
accgagttccgggtgctgggtgtgt

SEQ ID NO: 178288 - DNA, 25 bp, Mus musculus
accgagtttccagagccctgaagac

SEQ ID NO: 178289 - DNA, 25 bp, Mus musculus
accgatagctctccagacacaagca

SEQ ID NO: 178290 - DNA, 25 bp, Mus musculus
accgatcacaggtcacttggcatga

SEQ ID NO: 178291 - DNA, 25 bp, Mus musculus
accgatcaccgcaacggccattccc

SEQ ID NO: 178292 - DNA, 25 bp, Mus musculus
accgatcaccggggctaccgtgtga

SEQ ID NO: 178293 - DNA, 25 bp, Mus musculus
accgatcagtatatacacttctgat

SEQ ID NO: 178294 - DNA, 25 bp, Mus musculus
accgatccagagaaggcctactcac

SEQ ID NO: 178295 - DNA, 25 bp, Mus musculus
accgatccagtggaagaggcagagg

SEQ ID NO: 178296 - DNA, 25 bp, Mus musculus
accgatctaatccagggtctgccgt

SEQ ID NO: 178297 - DNA, 25 bp, Mus musculus
accgatctagaatacctgaagaaaa

SEQ ID NO: 178298 - DNA, 25 bp, Mus musculus
accgatgaagaacgagccctcgtgg

SEQ ID NO: 178299 - DNA, 25 bp, Mus musculus
accgatgagtcggatgcagaggcct

SEQ ID NO: 178300 - DNA, 25 bp, Mus musculus
accgattcccagcttccaccatcct

SEQ ID NO: 178301 - DNA, 25 bp, Mus musculus
accgcaaatgagagtcagtccttcc

SEQ ID NO: 178302 - DNA, 25 bp, Mus musculus
accgcaacaacgccatctatgagaa

SEQ ID NO: 178303 - DNA, 25 bp, Mus musculus
accgcaacagaggcctttcagtcag

SEQ ID NO: 178304 - DNA, 25 bp, Mus musculus
accgcaacagagggccttaacaatg

SEQ ID NO: 178305 - DNA, 25 bp, Mus musculus
accgcaacagccatggcttctccat

SEQ ID NO: 178306 - DNA, 25 bp, Mus musculus
accgcaagaaaagtatcaaggaggt

SEQ ID NO: 178307 - DNA, 25 bp, Mus musculus
accgcaagaaggaggaacaagaatt

SEQ ID NO: 178308 - DNA, 25 bp, Mus musculus
accgcaagaaggaggttatgaatga

SEQ ID NO: 178309 - DNA, 25 bp, Mus musculus
accgcaagcagcagtctctggtccc

SEQ ID NO: 178310 - DNA, 25 bp, Mus musculus
accgcacagctgcggatcaccagac

SEQ ID NO: 178311 - DNA, 25 bp, Mus musculus
accgcaccaaagtggagcccctgct

SEQ ID NO: 178312 - DNA, 25 bp, Mus musculus
accgcaccaagtgtgaggagataaa

SEQ ID NO: 178313 - DNA, 25 bp, Mus musculus
accgcaccaagtgtgaggagatgaa

SEQ ID NO: 178314 - DNA, 25 bp, Mus musculus
accgcagaagttgcagaagctggag

SEQ ID NO: 178315 - DNA, 25 bp, Mus musculus
accgcagacaagggttctccagacc

SEQ ID NO: 178316 - DNA, 25 bp, Mus musculus
accgcagacagacctcaagtactac

SEQ ID NO: 178317 - DNA, 25 bp, Mus musculus
accgcagacgggaccttcttttgga

SEQ ID NO: 178318 - DNA, 25 bp, Mus musculus
accgcagacgggagctgcaaagttg

SEQ ID NO: 178319 - DNA, 25 bp, Mus musculus
accgcagagaggaactggcccaaat

SEQ ID NO: 178320 - DNA, 25 bp, Mus musculus
accgcagcaccggcgtgttgcccac

SEQ ID NO: 178321 - DNA, 25 bp, Mus musculus
accgcagcactacacgtacctgaag

SEQ ID NO: 178322 - DNA, 25 bp, Mus musculus
accgcagcacttcatccaccagatg

SEQ ID NO: 178323 - DNA, 25 bp, Mus musculus
accgcagcagccagggccggccctc

SEQ ID NO: 178324 - DNA, 25 bp, Mus musculus
accgcagcggcgctggtacaaagta

SEQ ID NO: 178325 - DNA, 25 bp, Mus musculus
accgcagctgagatcgattatattt

SEQ ID NO: 178326 - DNA, 25 bp, Mus musculus
accgcaggacgcggaaccatgtgcc

SEQ ID NO: 178327 - DNA, 25 bp, Mus musculus
accgcaggaggaagcaactgatggt

SEQ ID NO: 178328 - DNA, 25 bp, Mus musculus
accgcagggacactttacagggaga

SEQ ID NO: 178329 - DNA, 25 bp, Mus musculus
accgcagtggacagaagatttcctc

SEQ ID NO: 178330 - DNA, 25 bp, Mus musculus
accgcagtgtcctggccaagggccg

SEQ ID NO: 178331 - DNA, 25 bp, Mus musculus
accgcagttgtccagagccaccagc

SEQ ID NO: 178332 - DNA, 25 bp, Mus musculus
accgcatccaggtcttggataaata

SEQ ID NO: 178333 - DNA, 25 bp, Mus musculus
accgcatccaggttaaacgctcccg

SEQ ID NO: 178334 - DNA, 25 bp, Mus musculus
accgcatcttcaggcttctcggctg

SEQ ID NO: 178335 - DNA, 25 bp, Mus musculus
accgcatgaggttctactttaccaa

SEQ ID NO: 178336 - DNA, 25 bp, Mus musculus
accgcatggaccagctccatttctg

SEQ ID NO: 178337 - DNA, 25 bp, Mus musculus
accgcatggttcctgctctgcacct

SEQ ID NO: 178338 - DNA, 25 bp, Mus musculus
accgccaaagcagcttcctgccaga

SEQ ID NO: 178339 - DNA, 25 bp, Mus musculus
accgccaaagccgagggttgatgct

SEQ ID NO: 178340 - DNA, 25 bp, Mus musculus
accgccaaaggctttctcctgggct

SEQ ID NO: 178341 - DNA, 25 bp, Mus musculus
accgccaactatgacttttgccaag

SEQ ID NO: 178342 - DNA, 25 bp, Mus musculus
accgccacgggaagaagcgcacgtt

SEQ ID NO: 178343 - DNA, 25 bp, Mus musculus
accgccactggcataaatgcagttc

SEQ ID NO: 178344 - DNA, 25 bp, Mus musculus
accgccagaaagacagggtttcatg

SEQ ID NO: 178345 - DNA, 25 bp, Mus musculus
accgccagaaaggaacacccctggc

SEQ ID NO: 178346 - DNA, 25 bp, Mus musculus
accgccagattgggcctgtcccagg

SEQ ID NO: 178347 - DNA, 25 bp, Mus musculus
accgccagctctgctgtggctggaa

SEQ ID NO: 178348 - DNA, 25 bp, Mus musculus
accgcccagcggtcagagtacacct

SEQ ID NO: 178349 - DNA, 25 bp, Mus musculus
accgcccggtagtgtctctattgca

SEQ ID NO: 178350 - DNA, 25 bp, Mus musculus
accgcccggtgttgcttctgctgtg

SEQ ID NO: 178351 - DNA, 25 bp, Mus musculus
accgccgatcggagaatgtcgtgtt

SEQ ID NO: 178352 - DNA, 25 bp, Mus musculus
accgccgccaaggctgaagctgacg

SEQ ID NO: 178353 - DNA, 25 bp, Mus musculus
accgccggagctgttttatgaccag

SEQ ID NO: 178354 - DNA, 25 bp, Mus musculus
accgccgtcaggatctggaagttgg

SEQ ID NO: 178355 - DNA, 25 bp, Mus musculus
accgccgtcatctgcaaagcagaag

SEQ ID NO: 178356 - DNA, 25 bp, Mus musculus
accgccgtcatctgctatagacata

SEQ ID NO: 178357 - DNA, 25 bp, Mus musculus
accgccgtctacagaaaacaagcac

SEQ ID NO: 178358 - DNA, 25 bp, Mus musculus
accgcctacacatccaggtggccct

SEQ ID NO: 178359 - DNA, 25 bp, Mus musculus
accgcctacctctggatcgctcctt

SEQ ID NO: 178360 - DNA, 25 bp, Mus musculus
accgcctcactggaatcccagctgg

SEQ ID NO: 178361 - DNA, 25 bp, Mus musculus
accgcctgagattgtcgcagcaata

SEQ ID NO: 178362 - DNA, 25 bp, Mus musculus
accgcctgaggcacagaccccacag

SEQ ID NO: 178363 - DNA, 25 bp, Mus musculus
accgcctgagtcaaatcagaaaatt

SEQ ID NO: 178364 - DNA, 25 bp, Mus musculus
accgcctgcaggtgatttccgattt

SEQ ID NO: 178365 - DNA, 25 bp, Mus musculus
accgcctggctgaagagagggcccg

SEQ ID NO: 178366 - DNA, 25 bp, Mus musculus
accgcctgtcgcaggctgttgattc

SEQ ID NO: 178367 - DNA, 25 bp, Mus musculus
accgcctgtcgcagggagcttatgg

SEQ ID NO: 178368 - DNA, 25 bp, Mus musculus
accgccttggtgacaccttcaggtg

SEQ ID NO: 178369 - DNA, 25 bp, Mus musculus
accgcgagatctcaggtctcctgtg

SEQ ID NO: 178370 - DNA, 25 bp, Mus musculus
accgcgagtctactcggaaaaagag

SEQ ID NO: 178371 - DNA, 25 bp, Mus musculus
accgcgagtctactgtctgccaaaa

SEQ ID NO: 178372 - DNA, 25 bp, Mus musculus
accgcgcagcccgagctacttcccc

SEQ ID NO: 178373 - DNA, 25 bp, Mus musculus
accgcgcagtatggacagcattggg

SEQ ID NO: 178374 - DNA, 25 bp, Mus musculus
accgcgcagtggttgggaactgtga

SEQ ID NO: 178375 - DNA, 25 bp, Mus musculus
accgcgccatggtctgccaggaact

SEQ ID NO: 178376 - DNA, 25 bp, Mus musculus
accgcgccatgtgatctcagcgccc

SEQ ID NO: 178377 - DNA, 25 bp, Mus musculus
accgcgccgcagtcgggccgcccca

SEQ ID NO: 178378 - DNA, 25 bp, Mus musculus
accgcgcggcgaagtcaatgaaagg

SEQ ID NO: 178379 - DNA, 25 bp, Mus musculus
accgcgcgggaccagatgccggcaa

SEQ ID NO: 178380 - DNA, 25 bp, Mus musculus
accgcgcgggaccaggtactttgtg

SEQ ID NO: 178381 - DNA, 25 bp, Mus musculus
accgcgctattcaggcctttggagc

SEQ ID NO: 178382 - DNA, 25 bp, Mus musculus
accgcgctcaaagatccaggtgctg

SEQ ID NO: 178383 - DNA, 25 bp, Mus musculus
accgcgctcaaaggactgtgtattc

SEQ ID NO: 178384 - DNA, 25 bp, Mus musculus
accgcgctcaaaggcaaaggaggat

SEQ ID NO: 178385 - DNA, 25 bp, Mus musculus
accgcgcttggcagagccagacatc

SEQ ID NO: 178386 - DNA, 25 bp, Mus musculus
accgcggagacccttccaatctgaa

SEQ ID NO: 178387 - DNA, 25 bp, Mus musculus
accgcggattttgcccaggaccagc

SEQ ID NO: 178388 - DNA, 25 bp, Mus musculus
accgcggccgtgcagttggaattga

SEQ ID NO: 178389 - DNA, 25 bp, Mus musculus
accgcggcgacgcaggttgatatca

SEQ ID NO: 178390 - DNA, 25 bp, Mus musculus
accgcggcgagcaaggtctgctgaa

SEQ ID NO: 178391 - DNA, 25 bp, Mus musculus
accgcggcggcaggattgtcttgag

SEQ ID NO: 178392 - DNA, 25 bp, Mus musculus
accgcggcggcaggctcctcctacg

SEQ ID NO: 178393 - DNA, 25 bp, Mus musculus
accgcggtcactgagcctctgcagg

SEQ ID NO: 178394 - DNA, 25 bp, Mus musculus
accgcggtcactgaggtactggcgg

SEQ ID NO: 178395 - DNA, 25 bp, Mus musculus
accgcggtgggtgatgtcttcccag

SEQ ID NO: 178396 - DNA, 25 bp, Mus musculus
accgcggttacagggcatctgactg

SEQ ID NO: 178397 - DNA, 25 bp, Mus musculus
accgctaacttacagagttgagtgg

SEQ ID NO: 178398 - DNA, 25 bp, Mus musculus
accgctaacttacaggttctgacgg

SEQ ID NO: 178399 - DNA, 25 bp, Mus musculus
accgctacagctcccaagtgccaag

SEQ ID NO: 178400 - DNA, 25 bp, Mus musculus
accgctagtctgaaagaaagactgc

SEQ ID NO: 178401 - DNA, 25 bp, Mus musculus
accgctatggcaacgtgatcgcctc

SEQ ID NO: 178402 - DNA, 25 bp, Mus musculus
accgctcaacaggtttgatggctat

SEQ ID NO: 178403 - DNA, 25 bp, Mus musculus
accgctcaacagttcccttcttcgg

SEQ ID NO: 178404 - DNA, 25 bp, Mus musculus
accgctcaacgaaacggaaggtgga

SEQ ID NO: 178405 - DNA, 25 bp, Mus musculus
accgctcagaacagcatcccctacc

SEQ ID NO: 178406 - DNA, 25 bp, Mus musculus
accgctcagaacaggtcttcacatg

SEQ ID NO: 178407 - DNA, 25 bp, Mus musculus
accgctccaagtttgttgaaagtga

SEQ ID NO: 178408 - DNA, 25 bp, Mus musculus
accgctcccacacagccttggacaa

SEQ ID NO: 178409 - DNA, 25 bp, Mus musculus
accgctcccacacaggtgagaagcc

SEQ ID NO: 178410 - DNA, 25 bp, Mus musculus
accgctccgcccgtgttggtggaat

SEQ ID NO: 178411 - DNA, 25 bp, Mus musculus
accgctccgcgtgagaatcaaatac

SEQ ID NO: 178412 - DNA, 25 bp, Mus musculus
accgctccgtagggaagacatcttt

SEQ ID NO: 178413 - DNA, 25 bp, Mus musculus
accgctcgaggtggccaggcagaca

SEQ ID NO: 178414 - DNA, 25 bp, Mus musculus
accgctcgtttctggtccatacatt

SEQ ID NO: 178415 - DNA, 25 bp, Mus musculus
accgctctccctacagccttgcaaa

SEQ ID NO: 178416 - DNA, 25 bp, Mus musculus
accgctgaccaaggcgccatggaaa

SEQ ID NO: 178417 - DNA, 25 bp, Mus musculus
accgctgactcggatcgagccctaa

SEQ ID NO: 178418 - DNA, 25 bp, Mus musculus
accgctgactcggccaaccaatgga

SEQ ID NO: 178419 - DNA, 25 bp, Mus musculus
accgctgactcgggtcattacaaag

SEQ ID NO: 178420 - DNA, 25 bp, Mus musculus
accgctgataagaaaaccactgagc

SEQ ID NO: 178421 - DNA, 25 bp, Mus musculus
accgctgatttaggaggacaggtgt

SEQ ID NO: 178422 - DNA, 25 bp, Mus musculus
accgctgcaccccgtcagtcatatc

SEQ ID NO: 178423 - DNA, 25 bp, Mus musculus
accgctgcacgccggcatgtgtttc

SEQ ID NO: 178424 - DNA, 25 bp, Mus musculus
accgctgcacgccgtaatttctaat

SEQ ID NO: 178425 - DNA, 25 bp, Mus musculus
accgctgccaggcacaatggaaggt

SEQ ID NO: 178426 - DNA, 25 bp, Mus musculus
accgctgccgaggaggctagacaaa

SEQ ID NO: 178427 - DNA, 25 bp, Mus musculus
accgctgcctcttccaccttccagc

SEQ ID NO: 178428 - DNA, 25 bp, Mus musculus
accgctgctgctcggcaatgatggc

SEQ ID NO: 178429 - DNA, 25 bp, Mus musculus
accgctggaagatttatacaaaagg

SEQ ID NO: 178430 - DNA, 25 bp, Mus musculus
accgctgtccccaggaggccccact

SEQ ID NO: 178431 - DNA, 25 bp, Mus musculus
accgctgtgacaactgccccctgga

SEQ ID NO: 178432 - DNA, 25 bp, Mus musculus
accgcttatagcccaaggaacagag

SEQ ID NO: 178433 - DNA, 25 bp, Mus musculus
accgcttataggcttggggcatatc

SEQ ID NO: 178434 - DNA, 25 bp, Mus musculus
accgcttcatgtttctctgccgatt

SEQ ID NO: 178435 - DNA, 25 bp, Mus musculus
accgcttcgagaagaatttccgtgt

SEQ ID NO: 178436 - DNA, 25 bp, Mus musculus
accgcttcgagaaggtgccgacaat

SEQ ID NO: 178437 - DNA, 25 bp, Mus musculus
accgcttctccaggagagggaagaa

SEQ ID NO: 178438 - DNA, 25 bp, Mus musculus
accgcttggccagggttaactttga

SEQ ID NO: 178439 - DNA, 25 bp, Mus musculus
accgctttaacttggggtgagtcag

SEQ ID NO: 178440 - DNA, 25 bp, Mus musculus
accgctttttgagcagacctgggcc

SEQ ID NO: 178441 - DNA, 25 bp, Mus musculus
accgctttttgagcaggtcacaaac

SEQ ID NO: 178442 - DNA, 25 bp, Mus musculus
accggaacaggttcaagttctttct

SEQ ID NO: 178443 - DNA, 25 bp, Mus musculus
accggaacggatgtatacatctcaa

SEQ ID NO: 178444 - DNA, 25 bp, Mus musculus
accggaactccatggtccccagtgc

SEQ ID NO: 178445 - DNA, 25 bp, Mus musculus
accggaagaagaatatgccccagag

SEQ ID NO: 178446 - DNA, 25 bp, Mus musculus
accggaagcagggaggtaaagcgtt

SEQ ID NO: 178447 - DNA, 25 bp, Mus musculus
accggaagccaggactccccgcggc

SEQ ID NO: 178448 - DNA, 25 bp, Mus musculus
accggaagccaggctgggtcctaga

SEQ ID NO: 178449 - DNA, 25 bp, Mus musculus
accggaaggtcaagtcactggtgac

SEQ ID NO: 178450 - DNA, 25 bp, Mus musculus
accggaagtgacgagagctgtcggc

SEQ ID NO: 178451 - DNA, 25 bp, Mus musculus
accggaagtggcagcatgctaattc

SEQ ID NO: 178452 - DNA, 25 bp, Mus musculus
accggaagttaaagcacggtttgct

SEQ ID NO: 178453 - DNA, 25 bp, Mus musculus
accggaatacacagcctgcatacca

SEQ ID NO: 178454 - DNA, 25 bp, Mus musculus
accggaatacacaggtgaactgtgt

SEQ ID NO: 178455 - DNA, 25 bp, Mus musculus
accggacactcagacaggaccccgt

SEQ ID NO: 178456 - DNA, 25 bp, Mus musculus
accggacactcagcctgcagcctga

SEQ ID NO: 178457 - DNA, 25 bp, Mus musculus
accggacctcttgtctacccagctg

SEQ ID NO: 178458 - DNA, 25 bp, Mus musculus
accggacgccgagatgctccagacc

SEQ ID NO: 178459 - DNA, 25 bp, Mus musculus
accggacttagcacactcctgggca

SEQ ID NO: 178460 - DNA, 25 bp, Mus musculus
accggagagaaggtctaatgcgctc

SEQ ID NO: 178461 - DNA, 25 bp, Mus musculus
accggagcaagcagctcgaggagga

SEQ ID NO: 178462 - DNA, 25 bp, Mus musculus
accggagcaagcagctggaagatga

SEQ ID NO: 178463 - DNA, 25 bp, Mus musculus
accggagcacgggattcgagttctg

SEQ ID NO: 178464 - DNA, 25 bp, Mus musculus
accggagcatgaaagatcagacctg

SEQ ID NO: 178465 - DNA, 25 bp, Mus musculus
accggagcatgaaaggacgtccacg

SEQ ID NO: 178466 - DNA, 25 bp, Mus musculus
accggagctgagcatttcagatctg

SEQ ID NO: 178467 - DNA, 25 bp, Mus musculus
accggagctgcgagaatgtctgaag

SEQ ID NO: 178468 - DNA, 25 bp, Mus musculus
accggagctgcgagcagagggacct

SEQ ID NO: 178469 - DNA, 25 bp, Mus musculus
accggagctgcgaggactgatgaca

SEQ ID NO: 178470 - DNA, 25 bp, Mus musculus
accggagctgcgagttacagaatgt

SEQ ID NO: 178471 - DNA, 25 bp, Mus musculus
accggagctgcgagttacagattta

SEQ ID NO: 178472 - DNA, 25 bp, Mus musculus
accggagctttgagttgctggttgt

SEQ ID NO: 178473 - DNA, 25 bp, Mus musculus
accggagtcatgggggtctgctgca

SEQ ID NO: 178474 - DNA, 25 bp, Mus musculus
accggagttggatcggtcatgggac

SEQ ID NO: 178475 - DNA, 25 bp, Mus musculus
accggatatcatgagctttcccgaa

SEQ ID NO: 178476 - DNA, 25 bp, Mus musculus
accggatcagctccccatatatact

SEQ ID NO: 178477 - DNA, 25 bp, Mus musculus
accggatgctcagcgaggacccgtg

SEQ ID NO: 178478 - DNA, 25 bp, Mus musculus
accggattcagtgcaggtttggatg

SEQ ID NO: 178479 - DNA, 25 bp, Mus musculus
accggattcagtggcattgaatcca

SEQ ID NO: 178480 - DNA, 25 bp, Mus musculus
accggattcggtgtatcctgctgtc

SEQ ID NO: 178481 - DNA, 25 bp, Mus musculus
accggcaaatggttgaaactgagct

SEQ ID NO: 178482 - DNA, 25 bp, Mus musculus
accggcacactcgatctgatttgta

SEQ ID NO: 178483 - DNA, 25 bp, Mus musculus
accggcactgggcactgaaagaaag

SEQ ID NO: 178484 - DNA, 25 bp, Mus musculus
accggcagaaagagtaaataacaga

SEQ ID NO: 178485 - DNA, 25 bp, Mus musculus
accggcagaagagcctagattcaga

SEQ ID NO: 178486 - DNA, 25 bp, Mus musculus
accggcagaagcttcaaactctcca

SEQ ID NO: 178487 - DNA, 25 bp, Mus musculus
accggcagactgcagcctaggatgt

SEQ ID NO: 178488 - DNA, 25 bp, Mus musculus
accggcagactgcagtttcaggtca

SEQ ID NO: 178489 - DNA, 25 bp, Mus musculus
accggcagcaggagaatcctcattg

SEQ ID NO: 178490 - DNA, 25 bp, Mus musculus
accggcagcaggagaatgccatctt

SEQ ID NO: 178491 - DNA, 25 bp, Mus musculus
accggcagtggcgccgtccagagga

SEQ ID NO: 178492 - DNA, 25 bp, Mus musculus
accggcatcggaagcctggacaaac

SEQ ID NO: 178493 - DNA, 25 bp, Mus musculus
accggcattgatgtccagctcgccg

SEQ ID NO: 178494 - DNA, 25 bp, Mus musculus
accggccaccagccccttcacagaa

SEQ ID NO: 178495 - DNA, 25 bp, Mus musculus
accggccaccaggttatcctacaca

SEQ ID NO: 178496 - DNA, 25 bp, Mus musculus
accggccagctgcttgacatctagg

SEQ ID NO: 178497 - DNA, 25 bp, Mus musculus
accggccagctgtctcctgaaggaa

SEQ ID NO: 178498 - DNA, 25 bp, Mus musculus
accggccatgaaaggcgttaagcat

SEQ ID NO: 178499 - DNA, 25 bp, Mus musculus
accggcccagcaatggcaattggca

SEQ ID NO: 178500 - DNA, 25 bp, Mus musculus
accggccgcatgtttgtcattgcct

SEQ ID NO: 178501 - DNA, 25 bp, Mus musculus
accggccgctatcagatccatttgg

SEQ ID NO: 178502 - DNA, 25 bp, Mus musculus
accggccggacgcagatcgcccacg

SEQ ID NO: 178503 - DNA, 25 bp, Mus musculus
accggcctctctggaggaaatccac

SEQ ID NO: 178504 - DNA, 25 bp, Mus musculus
accggcctgacggaatgtatcctgt

SEQ ID NO: 178505 - DNA, 25 bp, Mus musculus
accggcctgacgttatacaaaaggt

SEQ ID NO: 178506 - DNA, 25 bp, Mus musculus
accggcgcggcaggtaccagctgga

SEQ ID NO: 178507 - DNA, 25 bp, Mus musculus
accggcgcggcagtctgcgagtaaa

SEQ ID NO: 178508 - DNA, 25 bp, Mus musculus
accggcgttgttaggaagatgatcc

SEQ ID NO: 178509 - DNA, 25 bp, Mus musculus
accggcgttgttaggattatgtact

SEQ ID NO: 178510 - DNA, 25 bp, Mus musculus
accggctattctaggaaggctgcct

SEQ ID NO: 178511 - DNA, 25 bp, Mus musculus
accggctattctagtgacgccaaga

SEQ ID NO: 178512 - DNA, 25 bp, Mus musculus
accggctctgtggggctgctgccgg

SEQ ID NO: 178513 - DNA, 25 bp, Mus musculus
accggctgaaggcagacacatctga

SEQ ID NO: 178514 - DNA, 25 bp, Mus musculus
accggctgaaggcttgtgaaaaagc

SEQ ID NO: 178515 - DNA, 25 bp, Mus musculus
accggctgaagggcctctggaaatg

SEQ ID NO: 178516 - DNA, 25 bp, Mus musculus
accggctgacctgcaaatctggttc

SEQ ID NO: 178517 - DNA, 25 bp, Mus musculus
accggctgacctggccctctgtcct

SEQ ID NO: 178518 - DNA, 25 bp, Mus musculus
accggctgacctgttgaacactctg

SEQ ID NO: 178519 - DNA, 25 bp, Mus musculus
accggctgagcatggtggctgtatg

SEQ ID NO: 178520 - DNA, 25 bp, Mus musculus
accggctgcacagcccatctctgag

SEQ ID NO: 178521 - DNA, 25 bp, Mus musculus
accggctgcacaggagcaacacgtc

SEQ ID NO: 178522 - DNA, 25 bp, Mus musculus
accggctgcacagtgacatgaaatt

SEQ ID NO: 178523 - DNA, 25 bp, Mus musculus
accggctggaggcatcatgacaccg

SEQ ID NO: 178524 - DNA, 25 bp, Mus musculus
accggcttaatgctgattttgctca

SEQ ID NO: 178525 - DNA, 25 bp, Mus musculus
accggcttaatggtgattttgctca

SEQ ID NO: 178526 - DNA, 25 bp, Mus musculus
accggcttctgccccccactgcctc

SEQ ID NO: 178527 - DNA, 25 bp, Mus musculus
accggcttctggaagtcacctgggc

SEQ ID NO: 178528 - DNA, 25 bp, Mus musculus
accggcttctttagctctcctcaca

SEQ ID NO: 178529 - DNA, 25 bp, Mus musculus
accggcttctttaggacgacagcca

SEQ ID NO: 178530 - DNA, 25 bp, Mus musculus
accggcttctttaggtctcctcaca

SEQ ID NO: 178531 - DNA, 25 bp, Mus musculus
accgggaaaaagcaagaccacacca

SEQ ID NO: 178532 - DNA, 25 bp, Mus musculus
accgggaagttcaggcctggtgatg

SEQ ID NO: 178533 - DNA, 25 bp, Mus musculus
accgggaatgggcagcacatttaaa

SEQ ID NO: 178534 - DNA, 25 bp, Mus musculus
accgggacagagcgcctcctcaagc

SEQ ID NO: 178535 - DNA, 25 bp, Mus musculus
accgggacaggcaagcacaagctgc

SEQ ID NO: 178536 - DNA, 25 bp, Mus musculus
accgggacaggcaccttctgtattt

SEQ ID NO: 178537 - DNA, 25 bp, Mus musculus
accgggacctgacgtgtgctgtgat

SEQ ID NO: 178538 - DNA, 25 bp, Mus musculus
accgggattcagaggaagccaaggg

SEQ ID NO: 178539 - DNA, 25 bp, Mus musculus
accgggcagaggcggaacgtgatgt

SEQ ID NO: 178540 - DNA, 25 bp, Mus musculus
accgggcagatcctgccccgtccca

SEQ ID NO: 178541 - DNA, 25 bp, Mus musculus
accgggcagctgcccacggagcagc

SEQ ID NO: 178542 - DNA, 25 bp, Mus musculus
accgggcatcggccctgggcagtga

SEQ ID NO: 178543 - DNA, 25 bp, Mus musculus
accgggccttccgctctgtgcctca

SEQ ID NO: 178544 - DNA, 25 bp, Mus musculus
accgggcggcagtgccatggcagaa

SEQ ID NO: 178545 - DNA, 25 bp, Mus musculus
accgggctcaccttgaaaatgaagt

SEQ ID NO: 178546 - DNA, 25 bp, Mus musculus
accgggctcaccttgtgttcgactt

SEQ ID NO: 178547 - DNA, 25 bp, Mus musculus
accggggaaaggaatggatggctgt

SEQ ID NO: 178548 - DNA, 25 bp, Mus musculus
accggggaaagggatgattctgagg

SEQ ID NO: 178549 - DNA, 25 bp, Mus musculus
accggggaattcactccagatctct

SEQ ID NO: 178550 - DNA, 25 bp, Mus musculus
accggggaattcactggaattcctg

SEQ ID NO: 178551 - DNA, 25 bp, Mus musculus
accggggactggagggcttcgtggc

SEQ ID NO: 178552 - DNA, 25 bp, Mus musculus
accggggactggagggcttctcatt

SEQ ID NO: 178553 - DNA, 25 bp, Mus musculus
accggggagaagaactggagaattt

SEQ ID NO: 178554 - DNA, 25 bp, Mus musculus
accggggagaagacctgtgtagatc

SEQ ID NO: 178555 - DNA, 25 bp, Mus musculus
accggggatcaggaggttgagaaca

SEQ ID NO: 178556 - DNA, 25 bp, Mus musculus
accggggcaggaagtggtccttctc

SEQ ID NO: 178557 - DNA, 25 bp, Mus musculus
accgggggtctaaggaacgctggca

SEQ ID NO: 178558 - DNA, 25 bp, Mus musculus
accgggggtctaaggatcgagagct

SEQ ID NO: 178559 - DNA, 25 bp, Mus musculus
accgggtacttaggtgctggaaaga

SEQ ID NO: 178560 - DNA, 25 bp, Mus musculus
accgggtcaaacagaggacagtgtg

SEQ ID NO: 178561 - DNA, 25 bp, Mus musculus
accgggtcggagactgcaagtggca

SEQ ID NO: 178562 - DNA, 25 bp, Mus musculus
accgggtgcagagagacatcccaat

SEQ ID NO: 178563 - DNA, 25 bp, Mus musculus
accgggtgccggtcatcgtggagaa

SEQ ID NO: 178564 - DNA, 25 bp, Mus musculus
accgggtgtggagaagaacgctgtg

SEQ ID NO: 178565 - DNA, 25 bp, Mus musculus
accggtaaaggtagctggagttagg

SEQ ID NO: 178566 - DNA, 25 bp, Mus musculus
accggtcaacaatgcatattcctgg

SEQ ID NO: 178567 - DNA, 25 bp, Mus musculus
accggtcagatctggcactcgctcc

SEQ ID NO: 178568 - DNA, 25 bp, Mus musculus
accggtcagatctgtcagtggtgca

SEQ ID NO: 178569 - DNA, 25 bp, Mus musculus
accggtccctcagggtctggagtat

SEQ ID NO: 178570 - DNA, 25 bp, Mus musculus
accggttagccagggattacgcagc

SEQ ID NO: 178571 - DNA, 25 bp, Mus musculus
accggttcactgctcttccgaatcc

SEQ ID NO: 178572 - DNA, 25 bp, Mus musculus
accggttccaggatccagccgcagc

SEQ ID NO: 178573 - DNA, 25 bp, Mus musculus
accggttgtggcggttcccgaggag

SEQ ID NO: 178574 - DNA, 25 bp, Mus musculus
accggtttgccaagggtatgtcgga

SEQ ID NO: 178575 - DNA, 25 bp, Mus musculus
accggtttgtatgaactccagttct

SEQ ID NO: 178576 - DNA, 25 bp, Mus musculus
accgtaaacccaaggcagtgggctc

SEQ ID NO: 178577 - DNA, 25 bp, Mus musculus
accgtaaagtgttcgtgggtagatt

SEQ ID NO: 178578 - DNA, 25 bp, Mus musculus
accgtacatcaggtacttcgtgagc

SEQ ID NO: 178579 - DNA, 25 bp, Mus musculus
accgtaccaagggatagcccacctc

SEQ ID NO: 178580 - DNA, 25 bp, Mus musculus
accgtacctggtctgacagagacag

SEQ ID NO: 178581 - DNA, 25 bp, Mus musculus
accgtacgaggcagctgtggccctg

SEQ ID NO: 178582 - DNA, 25 bp, Mus musculus
accgtagagaccaagaaaatccagc

SEQ ID NO: 178583 - DNA, 25 bp, Mus musculus
accgtagagaccaagatgaagaacc

SEQ ID NO: 178584 - DNA, 25 bp, Mus musculus
accgtagcccagaaaaatatgaaga

SEQ ID NO: 178585 - DNA, 25 bp, Mus musculus
accgtagcccagagcaagtccctcc

SEQ ID NO: 178586 - DNA, 25 bp, Mus musculus
accgtaggcgctgaggcatgtgttc

SEQ ID NO: 178587 - DNA, 25 bp, Mus musculus
accgtaggtgtggctatttcaatgg

SEQ ID NO: 178588 - DNA, 25 bp, Mus musculus
accgtatcaccattgaaatacctga

SEQ ID NO: 178589 - DNA, 25 bp, Mus musculus
accgtatgaaggtggaagatatcaa

SEQ ID NO: 178590 - DNA, 25 bp, Mus musculus
accgtcaaagacctgatctccaagc

SEQ ID NO: 178591 - DNA, 25 bp, Mus musculus
accgtcaaagacctgtttctctaga

SEQ ID NO: 178592 - DNA, 25 bp, Mus musculus
accgtcacaaaccacttccattgaa

SEQ ID NO: 178593 - DNA, 25 bp, Mus musculus
accgtcacagagccccctgtgcgga

SEQ ID NO: 178594 - DNA, 25 bp, Mus musculus
accgtcacagagtcataccaaagtc

SEQ ID NO: 178595 - DNA, 25 bp, Mus musculus
accgtcaccaccaccagagagtcgg

SEQ ID NO: 178596 - DNA, 25 bp, Mus musculus
accgtcacggacaattgttccagtg

SEQ ID NO: 178597 - DNA, 25 bp, Mus musculus
accgtcagggcccagtgggaggagt

SEQ ID NO: 178598 - DNA, 25 bp, Mus musculus
accgtcagtcagatcccattgttaa

SEQ ID NO: 178599 - DNA, 25 bp, Mus musculus
accgtcattgtcagctggattgtca

SEQ ID NO: 178600 - DNA, 25 bp, Mus musculus
accgtccagttggttctgaccagaa

SEQ ID NO: 178601 - DNA, 25 bp, Mus musculus
accgtccggcaggggttcatggcat

SEQ ID NO: 178602 - DNA, 25 bp, Mus musculus
accgtccggcagtgttctcccgcct

SEQ ID NO: 178603 - DNA, 25 bp, Mus musculus
accgtcctcagctggcagctgtcct

SEQ ID NO: 178604 - DNA, 25 bp, Mus musculus
accgtcctgctgcaggctgccaaca

SEQ ID NO: 178605 - DNA, 25 bp, Mus musculus
accgtcctgtttggagtgcttaatg

SEQ ID NO: 178606 - DNA, 25 bp, Mus musculus
accgtcgctttctccagctgagtcc

SEQ ID NO: 178607 - DNA, 25 bp, Mus musculus
accgtcggcgagctgaagcgctgca

SEQ ID NO: 178608 - DNA, 25 bp, Mus musculus
accgtcggtgctgcgatccggagga

SEQ ID NO: 178609 - DNA, 25 bp, Mus musculus
accgtcggtgctggccttcccagaa

SEQ ID NO: 178610 - DNA, 25 bp, Mus musculus
accgtctcctcagagagtcagtcct

SEQ ID NO: 178611 - DNA, 25 bp, Mus musculus
accgtctcctcagagtctgcgagaa

SEQ ID NO: 178612 - DNA, 25 bp, Mus musculus
accgtctcctcagccaaaacaacac

SEQ ID NO: 178613 - DNA, 25 bp, Mus musculus
accgtctcctcagccaaaacaacag

SEQ ID NO: 178614 - DNA, 25 bp, Mus musculus
accgtctcctcagccaaaacgacac

SEQ ID NO: 178615 - DNA, 25 bp, Mus musculus
accgtctcctcagcctctatcagga

SEQ ID NO: 178616 - DNA, 25 bp, Mus musculus
accgtctgcagcaagatcttggcca

SEQ ID NO: 178617 - DNA, 25 bp, Mus musculus
accgtctgcagcaagcacatgcatc

SEQ ID NO: 178618 - DNA, 25 bp, Mus musculus
accgtcttcctctggaatcaacata

SEQ ID NO: 178619 - DNA, 25 bp, Mus musculus
accgtgaaaatcagatgggatcagt

SEQ ID NO: 178620 - DNA, 25 bp, Mus musculus
accgtgaaaggagcaatagagctga

SEQ ID NO: 178621 - DNA, 25 bp, Mus musculus
accgtgaaaggagtcgctttccttg

SEQ ID NO: 178622 - DNA, 25 bp, Mus musculus
accgtgacaagggtgaagatgggct

SEQ ID NO: 178623 - DNA, 25 bp, Mus musculus
accgtgacagtcaaagaacactggt

SEQ ID NO: 178624 - DNA, 25 bp, Mus musculus
accgtgacatcaagctggaaaacct

SEQ ID NO: 178625 - DNA, 25 bp, Mus musculus
accgtgacatggggggatggacagc

SEQ ID NO: 178626 - DNA, 25 bp, Mus musculus
accgtgacattgccctccccttttt

SEQ ID NO: 178627 - DNA, 25 bp, Mus musculus
accgtgacccagcccgtccgcctca

SEQ ID NO: 178628 - DNA, 25 bp, Mus musculus
accgtgactctcaactccgaagtca

SEQ ID NO: 178629 - DNA, 25 bp, Mus musculus
accgtgagcaagtgtgggacccaag

SEQ ID NO: 178630 - DNA, 25 bp, Mus musculus
accgtgagcaggtacctggagtctg

SEQ ID NO: 178631 - DNA, 25 bp, Mus musculus
accgtgagcgcctatgacttggtgc

SEQ ID NO: 178632 - DNA, 25 bp, Mus musculus
accgtgagcttcaggaaaaacataa

SEQ ID NO: 178633 - DNA, 25 bp, Mus musculus
accgtgagcttcaggttcatggaca

SEQ ID NO: 178634 - DNA, 25 bp, Mus musculus
accgtgatctcaagttggagaattt

SEQ ID NO: 178635 - DNA, 25 bp, Mus musculus
accgtgcacccagaaatgtatgagc

SEQ ID NO: 178636 - DNA, 25 bp, Mus musculus
accgtgcacccaggggggaagccct

SEQ ID NO: 178637 - DNA, 25 bp, Mus musculus
accgtgcaggactagcctgagaggg

SEQ ID NO: 178638 - DNA, 25 bp, Mus musculus
accgtgcaggagcagcctgagaggg

SEQ ID NO: 178639 - DNA, 25 bp, Mus musculus
accgtgcctccaggaataacaggca

SEQ ID NO: 178640 - DNA, 25 bp, Mus musculus
accgtgcctccaggagacacaaagc

SEQ ID NO: 178641 - DNA, 25 bp, Mus musculus
accgtgcgaaagaagactttaagaa

SEQ ID NO: 178642 - DNA, 25 bp, Mus musculus
accgtgcgcgcagggtttcacttag

SEQ ID NO: 178643 - DNA, 25 bp, Mus musculus
accgtgcgcgcaggtacagcgcagc

SEQ ID NO: 178644 - DNA, 25 bp, Mus musculus
accgtgcgcgctccccaggctagag

SEQ ID NO: 178645 - DNA, 25 bp, Mus musculus
accgtgcgtaatgacttccctgctg

SEQ ID NO: 178646 - DNA, 25 bp, Mus musculus
accgtgctcaacctgctggttggtg

SEQ ID NO: 178647 - DNA, 25 bp, Mus musculus
accgtgctccaaggggagcctcctt

SEQ ID NO: 178648 - DNA, 25 bp, Mus musculus
accgtgctgaaaggaagcaggtccc

SEQ ID NO: 178649 - DNA, 25 bp, Mus musculus
accgtgctgctgcaggtactagaag

SEQ ID NO: 178650 - DNA, 25 bp, Mus musculus
accgtgctgggcaggtacctggaca

SEQ ID NO: 178651 - DNA, 25 bp, Mus musculus
accgtggaagaagggagcagcatcc

SEQ ID NO: 178652 - DNA, 25 bp, Mus musculus
accgtggaagaaggtgctccttcag

SEQ ID NO: 178653 - DNA, 25 bp, Mus musculus
accgtggacatcgttaaccagaatg

SEQ ID NO: 178654 - DNA, 25 bp, Mus musculus
accgtggagacaggacctcacgcat

SEQ ID NO: 178655 - DNA, 25 bp, Mus musculus
accgtggagacagtttgaagaggac

SEQ ID NO: 178656 - DNA, 25 bp, Mus musculus
accgtggaggatgacttgattatct

SEQ ID NO: 178657 - DNA, 25 bp, Mus musculus
accgtggaggcccccgtcctgcggc

SEQ ID NO: 178658 - DNA, 25 bp, Mus musculus
accgtggccagaggcggaggcagcg

SEQ ID NO: 178659 - DNA, 25 bp, Mus musculus
accgtgggaggttctccagtggtct

SEQ ID NO: 178660 - DNA, 25 bp, Mus musculus
accgtgggagtggattttgctctca

SEQ ID NO: 178661 - DNA, 25 bp, Mus musculus
accgtgggccacaagccctagcatc

SEQ ID NO: 178662 - DNA, 25 bp, Mus musculus
accgtgggggagattttctaccttg

SEQ ID NO: 178663 - DNA, 25 bp, Mus musculus
accgtgggggaggatcccatagcct

SEQ ID NO: 178664 - DNA, 25 bp, Mus musculus
accgtgggggaggtgacagattatg

SEQ ID NO: 178665 - DNA, 25 bp, Mus musculus
accgtggtacagcgccccgggatgc

SEQ ID NO: 178666 - DNA, 25 bp, Mus musculus
accgtggtggagggaaaaatggtga

SEQ ID NO: 178667 - DNA, 25 bp, Mus musculus
accgtggtggaggttgaagaaattg

SEQ ID NO: 178668 - DNA, 25 bp, Mus musculus
accgtgtcgcgtcaagatggggttt

SEQ ID NO: 178669 - DNA, 25 bp, Mus musculus
accgtgtcgcgtgagatctccagag

SEQ ID NO: 178670 - DNA, 25 bp, Mus musculus
accgtgtgacttctcagacttttcg

SEQ ID NO: 178671 - DNA, 25 bp, Mus musculus
accgtgtgtgtctgctgctgacaag

SEQ ID NO: 178672 - DNA, 25 bp, Mus musculus
accgtgttcggggcgggccaatgat

SEQ ID NO: 178673 - DNA, 25 bp, Mus musculus
accgtgtttgaggccttattcagga

SEQ ID NO: 178674 - DNA, 25 bp, Mus musculus
accgttaagacagtgggttgtatcc

SEQ ID NO: 178675 - DNA, 25 bp, Mus musculus
accgttatatatatggacatacatg

SEQ ID NO: 178676 - DNA, 25 bp, Mus musculus
accgttatatatatggatttgttgc

SEQ ID NO: 178677 - DNA, 25 bp, Mus musculus
accgttattctcgatgaaacggaca

SEQ ID NO: 178678 - DNA, 25 bp, Mus musculus
accgttcgttcaaggggcagaatcc

SEQ ID NO: 178679 - DNA, 25 bp, Mus musculus
accgttctggaagccctggaagaga

SEQ ID NO: 178680 - DNA, 25 bp, Mus musculus
accgttggcttcattttaggtttag

SEQ ID NO: 178681 - DNA, 25 bp, Mus musculus
accgttggtggcatagctctaattc

SEQ ID NO: 178682 - DNA, 25 bp, Mus musculus
accgttgtagagtgtgtaatgctgt

SEQ ID NO: 178683 - DNA, 25 bp, Mus musculus
accgttgtcccagaggtgccccagc

SEQ ID NO: 178684 - DNA, 25 bp, Mus musculus
accgttgtcccagctgtccctcctc

SEQ ID NO: 178685 - DNA, 25 bp, Mus musculus
accgttgtgagctgctggggccacc

SEQ ID NO: 178686 - DNA, 25 bp, Mus musculus
accgtttgtagtggtgacactcgag

SEQ ID NO: 178687 - DNA, 25 bp, Mus musculus
accgttttagataagagttgtagtg

SEQ ID NO: 178688 - DNA, 25 bp, Mus musculus
accgttttagataagtatgaattac

SEQ ID NO: 178689 - DNA, 25 bp, Mus musculus
accgttttcagatagcggccattgg

SEQ ID NO: 178690 - DNA, 25 bp, Mus musculus
accgttttcaggctttctggctcac

SEQ ID NO: 178691 - DNA, 25 bp, Mus musculus
accgttttcagttatttgccaggaa

SEQ ID NO: 178692 - DNA, 25 bp, Mus musculus
acctaaacacaagatcttctgccca

SEQ ID NO: 178693 - DNA, 25 bp, Mus musculus
acctaaaccagcagaaaaaattcaa

SEQ ID NO: 178694 - DNA, 25 bp, Mus musculus
acctaaaccagcaggaatccatcag

SEQ ID NO: 178695 - DNA, 25 bp, Mus musculus
acctaaacctctgggaggatgttgg

SEQ ID NO: 178696 - DNA, 25 bp, Mus musculus
acctaaacctctgggtgaagggagc

SEQ ID NO: 178697 - DNA, 25 bp, Mus musculus
acctaaagaagcatgtcatttgctg

SEQ ID NO: 178698 - DNA, 25 bp, Mus musculus
acctaaagagcaatgcaagtggtgc

SEQ ID NO: 178699 - DNA, 25 bp, Mus musculus
acctaaagagtctgacacgtacttc

SEQ ID NO: 178700 - DNA, 25 bp, Mus musculus
acctaaagcatgcgaggtccttcca

SEQ ID NO: 178701 - DNA, 25 bp, Mus musculus
acctaaagcatgtttctctagagga

SEQ ID NO: 178702 - DNA, 25 bp, Mus musculus
acctaaagctacaggtggtaaagcg

SEQ ID NO: 178703 - DNA, 25 bp, Mus musculus
acctaaataagggccacacctagtc

SEQ ID NO: 178704 - DNA, 25 bp, Mus musculus
acctaacaaatgtcgagtggctggt

SEQ ID NO: 178705 - DNA, 25 bp, Mus musculus
acctaacactaaggatcatggatat

SEQ ID NO: 178706 - DNA, 25 bp, Mus musculus
acctaaccaacgtcaatcgctgcct

SEQ ID NO: 178707 - DNA, 25 bp, Mus musculus
acctaaccaatgtcaatcgctgcct

SEQ ID NO: 178708 - DNA, 25 bp, Mus musculus
acctaacccggctggccaaggtcgt

SEQ ID NO: 178709 - DNA, 25 bp, Mus musculus
acctaacggcctatggtgatgaagc

SEQ ID NO: 178710 - DNA, 25 bp, Mus musculus
acctaacggcctgatgggagccagg

SEQ ID NO: 178711 - DNA, 25 bp, Mus musculus
acctaagaagagatccagagttttt

SEQ ID NO: 178712 - DNA, 25 bp, Mus musculus
acctaagacagcgaaggtgtccgag

SEQ ID NO: 178713 - DNA, 25 bp, Mus musculus
acctaagccagcaggcctcagggct

SEQ ID NO: 178714 - DNA, 25 bp, Mus musculus
acctaagccagcagggcctgggctg

SEQ ID NO: 178715 - DNA, 25 bp, Mus musculus
acctaagcttccagagcagaacatc

SEQ ID NO: 178716 - DNA, 25 bp, Mus musculus
acctaaggaagatcctgtctctaca

SEQ ID NO: 178717 - DNA, 25 bp, Mus musculus
acctaaggagacaagaccccagcgc

SEQ ID NO: 178718 - DNA, 25 bp, Mus musculus
acctaaggccggaaggtagcgatgg

SEQ ID NO: 178719 - DNA, 25 bp, Mus musculus
acctaagtaacttgataacaaagtt

SEQ ID NO: 178720 - DNA, 25 bp, Mus musculus
acctaatcagtgagaccaagtaccg

SEQ ID NO: 178721 - DNA, 25 bp, Mus musculus
acctaatcagtgagcaagtacaaat

SEQ ID NO: 178722 - DNA, 25 bp, Mus musculus
acctaatcgattgaggcccaagggg

SEQ ID NO: 178723 - DNA, 25 bp, Mus musculus
acctaatcgattggattttcacctt

SEQ ID NO: 178724 - DNA, 25 bp, Mus musculus
acctaatgaaaagatctccaagagg

SEQ ID NO: 178725 - DNA, 25 bp, Mus musculus
acctaatgcagtcatccttcctaga

SEQ ID NO: 178726 - DNA, 25 bp, Mus musculus
acctacaaaaaagtctgttgcaaga

SEQ ID NO: 178727 - DNA, 25 bp, Mus musculus
acctacaaagagaaaaaactggcca

SEQ ID NO: 178728 - DNA, 25 bp, Mus musculus
acctacaaagaggtcttctgggaga

SEQ ID NO: 178729 - DNA, 25 bp, Mus musculus
acctacaacaagaacattctcaaga

SEQ ID NO: 178730 - DNA, 25 bp, Mus musculus
acctacaaccaagggtacttcgaga

SEQ ID NO: 178731 - DNA, 25 bp, Mus musculus
acctacaaccataggtacttcgaga

SEQ ID NO: 178732 - DNA, 25 bp, Mus musculus
acctacaagagaactctgaaggcat

SEQ ID NO: 178733 - DNA, 25 bp, Mus musculus
acctacaagaggagagtcaaacaca

SEQ ID NO: 178734 - DNA, 25 bp, Mus musculus
acctacaagaggtagaaagtccctc

SEQ ID NO: 178735 - DNA, 25 bp, Mus musculus
acctacaagatgtgaagtgggagct

SEQ ID NO: 178736 - DNA, 25 bp, Mus musculus
acctacaagtggccatggatcggtt

SEQ ID NO: 178737 - DNA, 25 bp, Mus musculus
acctacaagtgggcccgtgatttga

SEQ ID NO: 178738 - DNA, 25 bp, Mus musculus
acctacaatacccttcgagcacatg

SEQ ID NO: 178739 - DNA, 25 bp, Mus musculus
acctacaatttccccgccgactggc

SEQ ID NO: 178740 - DNA, 25 bp, Mus musculus
acctacaccaaacagagttattgga

SEQ ID NO: 178741 - DNA, 25 bp, Mus musculus
acctacaccaaacaggaaggtacca

SEQ ID NO: 178742 - DNA, 25 bp, Mus musculus
acctacaccaaacaggcaccatcac

SEQ ID NO: 178743 - DNA, 25 bp, Mus musculus
acctacacccaaaaacacagataca

SEQ ID NO: 178744 - DNA, 25 bp, Mus musculus
acctacacccaatacaagcagctca

SEQ ID NO: 178745 - DNA, 25 bp, Mus musculus
acctacacccacagttccagggtcc

SEQ ID NO: 178746 - DNA, 25 bp, Mus musculus
acctacacttcagatttccaaaagg

SEQ ID NO: 178747 - DNA, 25 bp, Mus musculus
acctacagagaggaggcttctcaga

SEQ ID NO: 178748 - DNA, 25 bp, Mus musculus
acctacagcaccctttcacaccgga

SEQ ID NO: 178749 - DNA, 25 bp, Mus musculus
acctacaggattgagacaccggtac

SEQ ID NO: 178750 - DNA, 25 bp, Mus musculus
acctacatcctcctgagcggagcgt

SEQ ID NO: 178751 - DNA, 25 bp, Mus musculus
acctacatctgataaggaaggaaag

SEQ ID NO: 178752 - DNA, 25 bp, Mus musculus
acctacattaacgtggttcattatg

SEQ ID NO: 178753 - DNA, 25 bp, Mus musculus
acctacatttcaaaggtaccaaagc

SEQ ID NO: 178754 - DNA, 25 bp, Mus musculus
acctacatttcaaaggttagcgatg

SEQ ID NO: 178755 - DNA, 25 bp, Mus musculus
acctaccaggagcctgccaccacca

SEQ ID NO: 178756 - DNA, 25 bp, Mus musculus
acctaccatggggcgcagttctgaa

SEQ ID NO: 178757 - DNA, 25 bp, Mus musculus
acctacccacctatgtgctcccaag

SEQ ID NO: 178758 - DNA, 25 bp, Mus musculus
acctacccagaaggacggcactaga

SEQ ID NO: 178759 - DNA, 25 bp, Mus musculus
acctacccagaaggacggcattaga

SEQ ID NO: 178760 - DNA, 25 bp, Mus musculus
acctacccctcaagaaaagctactg

SEQ ID NO: 178761 - DNA, 25 bp, Mus musculus
acctacccctcaagccttcctgcct

SEQ ID NO: 178762 - DNA, 25 bp, Mus musculus
acctaccgagtgaccctgagcaaga

SEQ ID NO: 178763 - DNA, 25 bp, Mus musculus
acctaccggctgagcatggtggctg

SEQ ID NO: 178764 - DNA, 25 bp, Mus musculus
acctacctcagggaagagtcccacg

SEQ ID NO: 178765 - DNA, 25 bp, Mus musculus
acctacctcagggagcagaaggcca

SEQ ID NO: 178766 - DNA, 25 bp, Mus musculus
acctacgaccaggttcagaacagcc

SEQ ID NO: 178767 - DNA, 25 bp, Mus musculus
acctacgagctgcagaaccagctag

SEQ ID NO: 178768 - DNA, 25 bp, Mus musculus
acctacgtgctgaagtatgccgcct

SEQ ID NO: 178769 - DNA, 25 bp, Mus musculus
acctactagagccggagaacagtgg

SEQ ID NO: 178770 - DNA, 25 bp, Mus musculus
acctactcccagtgaccttcagaat

SEQ ID NO: 178771 - DNA, 25 bp, Mus musculus
acctactctgacaacctgcttggaa

SEQ ID NO: 178772 - DNA, 25 bp, Mus musculus
acctactctgtccctggcgtgggga

SEQ ID NO: 178773 - DNA, 25 bp, Mus musculus
acctactgaagctcctgcagactgc

SEQ ID NO: 178774 - DNA, 25 bp, Mus musculus
acctactgaagctgtggggattgcc

SEQ ID NO: 178775 - DNA, 25 bp, Mus musculus
acctactgtgccatggaagggtctg

SEQ ID NO: 178776 - DNA, 25 bp, Mus musculus
acctactgtgtctctggaccaaatc

SEQ ID NO: 178777 - DNA, 25 bp, Mus musculus
acctacttggagccctataataaag

SEQ ID NO: 178778 - DNA, 25 bp, Mus musculus
acctactttacatgctcttcctcat

SEQ ID NO: 178779 - DNA, 25 bp, Mus musculus
acctagaaaagatttcacacaccga

SEQ ID NO: 178780 - DNA, 25 bp, Mus musculus
acctagaacaatagaaagcagtctt

SEQ ID NO: 178781 - DNA, 25 bp, Mus musculus
acctagaaccacaacccaccaagca

SEQ ID NO: 178782 - DNA, 25 bp, Mus musculus
acctagaagaaaagaaaaatcaaga

SEQ ID NO: 178783 - DNA, 25 bp, Mus musculus
acctagaagaaaagtttctgtttct

SEQ ID NO: 178784 - DNA, 25 bp, Mus musculus
acctagaagaagaggaatgggtacg

SEQ ID NO: 178785 - DNA, 25 bp, Mus musculus
acctagaaggaaggtatcatgccaa

SEQ ID NO: 178786 - DNA, 25 bp, Mus musculus
acctagaatggtgtgccaggacagg

SEQ ID NO: 178787 - DNA, 25 bp, Mus musculus
acctagaatggtttgcaatagcaat

SEQ ID NO: 178788 - DNA, 25 bp, Mus musculus
acctagaatgtgggcacaatgccca

SEQ ID NO: 178789 - DNA, 25 bp, Mus musculus
acctagacactgagggccgatatct

SEQ ID NO: 178790 - DNA, 25 bp, Mus musculus
acctagagaagaagcgagatgagcg

SEQ ID NO: 178791 - DNA, 25 bp, Mus musculus
acctagagaagacggaatggttcca

SEQ ID NO: 178792 - DNA, 25 bp, Mus musculus
acctagagaagcgagatgagcgcag

SEQ ID NO: 178793 - DNA, 25 bp, Mus musculus
acctagagcgggtgactgagatact

SEQ ID NO: 178794 - DNA, 25 bp, Mus musculus
acctagaggaggatgccctctgaag

SEQ ID NO: 178795 - DNA, 25 bp, Mus musculus
acctagataagaaggacttcctagg

SEQ ID NO: 178796 - DNA, 25 bp, Mus musculus
acctagccaagtgcattgttggtgt

SEQ ID NO: 178797 - DNA, 25 bp, Mus musculus
acctagccgctgtggtgactgggct

SEQ ID NO: 178798 - DNA, 25 bp, Mus musculus
acctagcctcccgttgttctacaca

SEQ ID NO: 178799 - DNA, 25 bp, Mus musculus
acctagctacagaactgtgccggat

SEQ ID NO: 178800 - DNA, 25 bp, Mus musculus
acctagctgagccctacaaaggctg

SEQ ID NO: 178801 - DNA, 25 bp, Mus musculus
acctaggaggccctggaccttggtg

SEQ ID NO: 178802 - DNA, 25 bp, Mus musculus
acctaggaggccctgttcacctctg

SEQ ID NO: 178803 - DNA, 25 bp, Mus musculus
acctaggatagagattgttgtggtg

SEQ ID NO: 178804 - DNA, 25 bp, Mus musculus
acctaggcgtgcagataaagggaga

SEQ ID NO: 178805 - DNA, 25 bp, Mus musculus
acctaggcgtgcagtgggagatttt

SEQ ID NO: 178806 - DNA, 25 bp, Mus musculus
acctaggggctacctcacttacatc

SEQ ID NO: 178807 - DNA, 25 bp, Mus musculus
acctagtcacagagggctttaagga

SEQ ID NO: 178808 - DNA, 25 bp, Mus musculus
acctagtcacagcaacaacacttga

SEQ ID NO: 178809 - DNA, 25 bp, Mus musculus
acctagtcagtccccagttgtaggt

SEQ ID NO: 178810 - DNA, 25 bp, Mus musculus
acctagttcagagcaagaacagaag

SEQ ID NO: 178811 - DNA, 25 bp, Mus musculus
acctagttgctgccttgcgctggcg

SEQ ID NO: 178812 - DNA, 25 bp, Mus musculus
acctataaccagacacgcagtgctg

SEQ ID NO: 178813 - DNA, 25 bp, Mus musculus
acctataaccaggtgcagacacgca

SEQ ID NO: 178814 - DNA, 25 bp, Mus musculus
acctataaggtcaagcctgtgggcc

SEQ ID NO: 178815 - DNA, 25 bp, Mus musculus
acctatacaaactatatatttgtcc

SEQ ID NO: 178816 - DNA, 25 bp, Mus musculus
acctatatcgagcttcttcctccag

SEQ ID NO: 178817 - DNA, 25 bp, Mus musculus
acctatcaccagtatcatagttaat

SEQ ID NO: 178818 - DNA, 25 bp, Mus musculus
acctatccaaaagataggaagtgca

SEQ ID NO: 178819 - DNA, 25 bp, Mus musculus
acctatccaatgccaatcgctgcct

SEQ ID NO: 178820 - DNA, 25 bp, Mus musculus
acctatccagcccaccagaaccgcg

SEQ ID NO: 178821 - DNA, 25 bp, Mus musculus
acctatccctgagagctgctccttt

SEQ ID NO: 178822 - DNA, 25 bp, Mus musculus
acctatctcgacgtcggatgcgcca

SEQ ID NO: 178823 - DNA, 25 bp, Mus musculus
acctatctgaaagaccccgcttggc

SEQ ID NO: 178824 - DNA, 25 bp, Mus musculus
acctatctgaaagattgctgaagct

SEQ ID NO: 178825 - DNA, 25 bp, Mus musculus
acctatctggaacagggaacaagct

SEQ ID NO: 178826 - DNA, 25 bp, Mus musculus
acctatgaagggctgcaattttgag

SEQ ID NO: 178827 - DNA, 25 bp, Mus musculus
acctatgaccatctgtgtaagaact

SEQ ID NO: 178828 - DNA, 25 bp, Mus musculus
acctatgaccgaatataccatgctg

SEQ ID NO: 178829 - DNA, 25 bp, Mus musculus
acctatgacgagtccatgctggaca

SEQ ID NO: 178830 - DNA, 25 bp, Mus musculus
acctatgacttagcaggttcttgtc

SEQ ID NO: 178831 - DNA, 25 bp, Mus musculus
acctatgagatggtagacaaacaca

SEQ ID NO: 178832 - DNA, 25 bp, Mus musculus
acctatgatgaggactaccagcagc

SEQ ID NO: 178833 - DNA, 25 bp, Mus musculus
acctatgatggacaagaagctgatc

SEQ ID NO: 178834 - DNA, 25 bp, Mus musculus
acctatggacttaagaacttttcct

SEQ ID NO: 178835 - DNA, 25 bp, Mus musculus
acctatggacttaagaccatgctcg

SEQ ID NO: 178836 - DNA, 25 bp, Mus musculus
acctatggcagggccaccaaagcac

SEQ ID NO: 178837 - DNA, 25 bp, Mus musculus
acctatggggcctcagactcatccc

SEQ ID NO: 178838 - DNA, 25 bp, Mus musculus
acctatgtcatgatggtgtttggcc

SEQ ID NO: 178839 - DNA, 25 bp, Mus musculus
acctatgtgcacaggaaaggaagtt

SEQ ID NO: 178840 - DNA, 25 bp, Mus musculus
acctatgtgcacagggtcgggagaa

SEQ ID NO: 178841 - DNA, 25 bp, Mus musculus
acctattatggtaactttcggcctg

SEQ ID NO: 178842 - DNA, 25 bp, Mus musculus
acctattcatccatggaccggcacg

SEQ ID NO: 178843 - DNA, 25 bp, Mus musculus
acctattcccgacataggaggcggt

SEQ ID NO: 178844 - DNA, 25 bp, Mus musculus
acctattttggaagagcagtcagtt

SEQ ID NO: 178845 - DNA, 25 bp, Mus musculus
acctattttggttgataatccctct

SEQ ID NO: 178846 - DNA, 25 bp, Mus musculus
acctcaaacccagaaccaaggagag

SEQ ID NO: 178847 - DNA, 25 bp, Mus musculus
acctcaaagacagaaataaaaataa

SEQ ID NO: 178848 - DNA, 25 bp, Mus musculus
acctcaaagacaggccagttaaatt

SEQ ID NO: 178849 - DNA, 25 bp, Mus musculus
acctcaaaggccacgagacccaaac

SEQ ID NO: 178850 - DNA, 25 bp, Mus musculus
acctcaaagtaaacaaacatggaag

SEQ ID NO: 178851 - DNA, 25 bp, Mus musculus
acctcaaagtaaacattttctattt

SEQ ID NO: 178852 - DNA, 25 bp, Mus musculus
acctcaaataaagaagatacattat

SEQ ID NO: 178853 - DNA, 25 bp, Mus musculus
acctcaaatacacgccttccttcag

SEQ ID NO: 178854 - DNA, 25 bp, Mus musculus
acctcaaatacacgctgatgttcct

SEQ ID NO: 178855 - DNA, 25 bp, Mus musculus
acctcaacaccaagatgataccctg

SEQ ID NO: 178856 - DNA, 25 bp, Mus musculus
acctcaacagacatttgctccaagt

SEQ ID NO: 178857 - DNA, 25 bp, Mus musculus
acctcaacagagaataggtgaggct

SEQ ID NO: 178858 - DNA, 25 bp, Mus musculus
acctcaacagggattctgaagggtc

SEQ ID NO: 178859 - DNA, 25 bp, Mus musculus
acctcaacagggtgagccaggtcca

SEQ ID NO: 178860 - DNA, 25 bp, Mus musculus
acctcaacagtgggcagctgatcac

SEQ ID NO: 178861 - DNA, 25 bp, Mus musculus
acctcaacctcagggaaccagctca

SEQ ID NO: 178862 - DNA, 25 bp, Mus musculus
acctcaactaatttgtgatcctgtg

SEQ ID NO: 178863 - DNA, 25 bp, Mus musculus
acctcaactactgcgaggaggcggt

SEQ ID NO: 178864 - DNA, 25 bp, Mus musculus
acctcaactgatgggaccctgccac

SEQ ID NO: 178865 - DNA, 25 bp, Mus musculus
acctcaactgtgtgtgcaacagaag

SEQ ID NO: 178866 - DNA, 25 bp, Mus musculus
acctcaagaacaacggctcggaagt

SEQ ID NO: 178867 - DNA, 25 bp, Mus musculus
acctcaagaacaagctcggaagtgg

SEQ ID NO: 178868 - DNA, 25 bp, Mus musculus
acctcaagaacaatggctcggaagt

SEQ ID NO: 178869 - DNA, 25 bp, Mus musculus
acctcaagaagcaggttgcctagca

SEQ ID NO: 178870 - DNA, 25 bp, Mus musculus
acctcaagaagcagtgtgacgtgct

SEQ ID NO: 178871 - DNA, 25 bp, Mus musculus
acctcaagagggagagaaaatgaaa

SEQ ID NO: 178872 - DNA, 25 bp, Mus musculus
acctcaagaggtacctaagagtaag

SEQ ID NO: 178873 - DNA, 25 bp, Mus musculus
acctcaaggagctgtaggtggcgat

SEQ ID NO: 178874 - DNA, 25 bp, Mus musculus
acctcaagggtggttttgactggaa

SEQ ID NO: 178875 - DNA, 25 bp, Mus musculus
acctcaaggtctttgcaaagcccaa

SEQ ID NO: 178876 - DNA, 25 bp, Mus musculus
acctcaaggttaaggctagatatgg

SEQ ID NO: 178877 - DNA, 25 bp, Mus musculus
acctcaatcaaggacagtcttatga

SEQ ID NO: 178878 - DNA, 25 bp, Mus musculus
acctcaatcaaggtcagtcgtatga

SEQ ID NO: 178879 - DNA, 25 bp, Mus musculus
acctcaatcaaggtgtggtcccaag

SEQ ID NO: 178880 - DNA, 25 bp, Mus musculus
acctcaatcaccatgcccaccgcct

SEQ ID NO: 178881 - DNA, 25 bp, Mus musculus
acctcacaaggtgactggacagaag

SEQ ID NO: 178882 - DNA, 25 bp, Mus musculus
acctcacaagtgcacgatctgattt

SEQ ID NO: 178883 - DNA, 25 bp, Mus musculus
acctcacacaggtggctgtgggcac

SEQ ID NO: 178884 - DNA, 25 bp, Mus musculus
acctcacacagtacagatctcaagt

SEQ ID NO: 178885 - DNA, 25 bp, Mus musculus
acctcacactcactgtatgcttcca

SEQ ID NO: 178886 - DNA, 25 bp, Mus musculus
acctcacactcactgtttcttctag

SEQ ID NO: 178887 - DNA, 25 bp, Mus musculus
acctcacactgtgatgtggtggagg

SEQ ID NO: 178888 - DNA, 25 bp, Mus musculus
acctcacagcagagtgccatcttgc

SEQ ID NO: 178889 - DNA, 25 bp, Mus musculus
acctcacaggtccagttgtactgca

SEQ ID NO: 178890 - DNA, 25 bp, Mus musculus
acctcacagtggaagggttccaatc

SEQ ID NO: 178891 - DNA, 25 bp, Mus musculus
acctcaccaaaggctattcggaaac

SEQ ID NO: 178892 - DNA, 25 bp, Mus musculus
acctcaccaagctgctgtccagagt

SEQ ID NO: 178893 - DNA, 25 bp, Mus musculus
acctcaccaagtaccgggaagctag

SEQ ID NO: 178894 - DNA, 25 bp, Mus musculus
acctcaccagcatgtccaaaattct

SEQ ID NO: 178895 - DNA, 25 bp, Mus musculus
acctcaccattgctggggtggagac

SEQ ID NO: 178896 - DNA, 25 bp, Mus musculus
acctcaccattgctggtcaacgtcc

SEQ ID NO: 178897 - DNA, 25 bp, Mus musculus
acctcaccttctacgacggggtgga

SEQ ID NO: 178898 - DNA, 25 bp, Mus musculus
acctcaccttctacgctgtggaggt

SEQ ID NO: 178899 - DNA, 25 bp, Mus musculus
acctcacgaggttcctggacatcag

SEQ ID NO: 178900 - DNA, 25 bp, Mus musculus
acctcacgtgcagatggtggaccca

SEQ ID NO: 178901 - DNA, 25 bp, Mus musculus
acctcactcacgctgcccaacatgt

SEQ ID NO: 178902 - DNA, 25 bp, Mus musculus
acctcactcagagccatgatgctgg

SEQ ID NO: 178903 - DNA, 25 bp, Mus musculus
acctcactcaggctgccatccagac

SEQ ID NO: 178904 - DNA, 25 bp, Mus musculus
acctcactccaaagacaaatatgaa

SEQ ID NO: 178905 - DNA, 25 bp, Mus musculus
acctcactccaaagtccccagtctt

SEQ ID NO: 178906 - DNA, 25 bp, Mus musculus
acctcactgcattgaaaaaatccca

SEQ ID NO: 178907 - DNA, 25 bp, Mus musculus
acctcactgcattggacttccttgt

SEQ ID NO: 178908 - DNA, 25 bp, Mus musculus
acctcactgctataggatacaaatt

SEQ ID NO: 178909 - DNA, 25 bp, Mus musculus
acctcactgctataggttgatcaga

SEQ ID NO: 178910 - DNA, 25 bp, Mus musculus
acctcagaaacagaacttacacatt

SEQ ID NO: 178911 - DNA, 25 bp, Mus musculus
acctcagaaacatcattcaagactg

SEQ ID NO: 178912 - DNA, 25 bp, Mus musculus
acctcagaaactgtggcccgaggca

SEQ ID NO: 178913 - DNA, 25 bp, Mus musculus
acctcagaaaggagattaacaagtg

SEQ ID NO: 178914 - DNA, 25 bp, Mus musculus
acctcagaaaggaggcatcatagct

SEQ ID NO: 178915 - DNA, 25 bp, Mus musculus
acctcagaattccaggtctatggaa

SEQ ID NO: 178916 - DNA, 25 bp, Mus musculus
acctcagactcagggttgagctcca

SEQ ID NO: 178917 - DNA, 25 bp, Mus musculus
acctcagagcaggtcactttgaatg

SEQ ID NO: 178918 - DNA, 25 bp, Mus musculus
acctcagagccaggttggttcctgt

SEQ ID NO: 178919 - DNA, 25 bp, Mus musculus
acctcagatcagaaccagtcttcag

SEQ ID NO: 178920 - DNA, 25 bp, Mus musculus
acctcagcaaatgtggtaaacagct

SEQ ID NO: 178921 - DNA, 25 bp, Mus musculus
acctcagcactgtcagacatagata

SEQ ID NO: 178922 - DNA, 25 bp, Mus musculus
acctcagcagcggggttctctggaa

SEQ ID NO: 178923 - DNA, 25 bp, Mus musculus
acctcagcatcatgatccaggacct

SEQ ID NO: 178924 - DNA, 25 bp, Mus musculus
acctcagccaacactgatagggctc

SEQ ID NO: 178925 - DNA, 25 bp, Mus musculus
acctcagccaagtaccaaaggctta

SEQ ID NO: 178926 - DNA, 25 bp, Mus musculus
acctcagccccagagcacagaggac

SEQ ID NO: 178927 - DNA, 25 bp, Mus musculus
acctcagccccagaggtctcagcaa

SEQ ID NO: 178928 - DNA, 25 bp, Mus musculus
acctcagccggcaggctcatagtgg

SEQ ID NO: 178929 - DNA, 25 bp, Mus musculus
acctcagctacaaaggcaacatctg

SEQ ID NO: 178930 - DNA, 25 bp, Mus musculus
acctcagctggttgtgcagacaaaa

SEQ ID NO: 178931 - DNA, 25 bp, Mus musculus
acctcagctggttgtgcagtcaaaa

SEQ ID NO: 178932 - DNA, 25 bp, Mus musculus
acctcaggagagatgacttgtacca

SEQ ID NO: 178933 - DNA, 25 bp, Mus musculus
acctcaggagagatgagagcaatca

SEQ ID NO: 178934 - DNA, 25 bp, Mus musculus
acctcagggaaaaggtcattaaagg

SEQ ID NO: 178935 - DNA, 25 bp, Mus musculus
acctcaggtaaaccccttgacctca

SEQ ID NO: 178936 - DNA, 25 bp, Mus musculus
acctcagtggtgtcggcattgctag

SEQ ID NO: 178937 - DNA, 25 bp, Mus musculus
acctcagtggtgtcggtgttgccag

SEQ ID NO: 178938 - DNA, 25 bp, Mus musculus
acctcagtgtatgccgcttacaagc

SEQ ID NO: 178939 - DNA, 25 bp, Mus musculus
acctcagttctgtgactgatgaagt

SEQ ID NO: 178940 - DNA, 25 bp, Mus musculus
acctcagttttcccaagcaacccta

SEQ ID NO: 178941 - DNA, 25 bp, Mus musculus
acctcataaaggttgacctatcaaa

SEQ ID NO: 178942 - DNA, 25 bp, Mus musculus
acctcatacagggtggcagtgagcc

SEQ ID NO: 178943 - DNA, 25 bp, Mus musculus
acctcatcaacagtgagggggactc

SEQ ID NO: 178944 - DNA, 25 bp, Mus musculus
acctcatcaacagtttgcaggacat

SEQ ID NO: 178945 - DNA, 25 bp, Mus musculus
acctcatcatccagctggatagcag

SEQ ID NO: 178946 - DNA, 25 bp, Mus musculus
acctcatccagaccagagggcctgc

SEQ ID NO: 178947 - DNA, 25 bp, Mus musculus
acctcatccagcttactggcggttt

SEQ ID NO: 178948 - DNA, 25 bp, Mus musculus
acctcatcgagaagcccatgggcat

SEQ ID NO: 178949 - DNA, 25 bp, Mus musculus
acctcatcgccatcgacctggaact

SEQ ID NO: 178950 - DNA, 25 bp, Mus musculus
acctcatctaggtacgtaggtgcca

SEQ ID NO: 178951 - DNA, 25 bp, Mus musculus
acctcatctccaagagtgaatgtgg

SEQ ID NO: 178952 - DNA, 25 bp, Mus musculus
acctcatctccaagtccttccaggg

SEQ ID NO: 178953 - DNA, 25 bp, Mus musculus
acctcatctctgatcgctggggtgc

SEQ ID NO: 178954 - DNA, 25 bp, Mus musculus
acctcatctctgtgatgggtcactg

SEQ ID NO: 178955 - DNA, 25 bp, Mus musculus
acctcatctgtggtcaaaatccagt

SEQ ID NO: 178956 - DNA, 25 bp, Mus musculus
acctcatcttctggggggcagctgg

SEQ ID NO: 178957 - DNA, 25 bp, Mus musculus
acctcatcttgtacttgttgactga

SEQ ID NO: 178958 - DNA, 25 bp, Mus musculus
acctcatgagctggctgcctgagta

SEQ ID NO: 178959 - DNA, 25 bp, Mus musculus
acctcatgcagaaggtgattaccac

SEQ ID NO: 178960 - DNA, 25 bp, Mus musculus
acctcatgcaggagtatgcaaacca

SEQ ID NO: 178961 - DNA, 25 bp, Mus musculus
acctcatgccgagcaactgtgggtt

SEQ ID NO: 178962 - DNA, 25 bp, Mus musculus
acctcatgctttcgaaatgaataac

SEQ ID NO: 178963 - DNA, 25 bp, Mus musculus
acctcatggatacaatgagcagcac

SEQ ID NO: 178964 - DNA, 25 bp, Mus musculus
acctcatggcacagagaagccatcc

SEQ ID NO: 178965 - DNA, 25 bp, Mus musculus
acctcattaaatgaatctcctgtaa

SEQ ID NO: 178966 - DNA, 25 bp, Mus musculus
acctcattaagaagaacaatcacca

SEQ ID NO: 178967 - DNA, 25 bp, Mus musculus
acctcattacagtgtgactgcacag

SEQ ID NO: 178968 - DNA, 25 bp, Mus musculus
acctcattatccagatacacagaca

SEQ ID NO: 178969 - DNA, 25 bp, Mus musculus
acctcattggctttatctcggacct

SEQ ID NO: 178970 - DNA, 25 bp, Mus musculus
acctcattggtctaatctctgaccg

SEQ ID NO: 178971 - DNA, 25 bp, Mus musculus
acctccaaacagaagctccctgagt

SEQ ID NO: 178972 - DNA, 25 bp, Mus musculus
acctccaaacagtgaaggtgagcag

SEQ ID NO: 178973 - DNA, 25 bp, Mus musculus
acctccaaaccaagcagtcctatgc

SEQ ID NO: 178974 - DNA, 25 bp, Mus musculus
acctccaaagatggaaaagccgaag

SEQ ID NO: 178975 - DNA, 25 bp, Mus musculus
acctccaaagctcatttttccaaac

SEQ ID NO: 178976 - DNA, 25 bp, Mus musculus
acctccaaaggacacaccagccatt

SEQ ID NO: 178977 - DNA, 25 bp, Mus musculus
acctccaaatggttctgaatcagac

SEQ ID NO: 178978 - DNA, 25 bp, Mus musculus
acctccaagatctcctacctctgcc

SEQ ID NO: 178979 - DNA, 25 bp, Mus musculus
acctccaagggcaccatgaacacag

SEQ ID NO: 178980 - DNA, 25 bp, Mus musculus
acctccacagcacaagagcaagatg

SEQ ID NO: 178981 - DNA, 25 bp, Mus musculus
acctccacagggacaactcccaatc

SEQ ID NO: 178982 - DNA, 25 bp, Mus musculus
acctccacaggttccagatgatgac

SEQ ID NO: 178983 - DNA, 25 bp, Mus musculus
acctccaccatcaagaaccatgagt

SEQ ID NO: 178984 - DNA, 25 bp, Mus musculus
acctccacccccgcctcccagacag

SEQ ID NO: 178985 - DNA, 25 bp, Mus musculus
acctccacctcctgagaaattagaa

SEQ ID NO: 178986 - DNA, 25 bp, Mus musculus
acctccacctcctgagaccatggta

SEQ ID NO: 178987 - DNA, 25 bp, Mus musculus
acctccacctcctgagtctagccgc

SEQ ID NO: 178988 - DNA, 25 bp, Mus musculus
acctccaccttctctctcttcctcc

SEQ ID NO: 178989 - DNA, 25 bp, Mus musculus
acctccacgaggcgagcctgtcaca

SEQ ID NO: 178990 - DNA, 25 bp, Mus musculus
acctccacgctgaatgaaaagtccc

SEQ ID NO: 178991 - DNA, 25 bp, Mus musculus
acctccagactcagctggcggtgca

SEQ ID NO: 178992 - DNA, 25 bp, Mus musculus
acctccagagtggtggattgtccag

SEQ ID NO: 178993 - DNA, 25 bp, Mus musculus
acctccagctcttggcagaagactt

SEQ ID NO: 178994 - DNA, 25 bp, Mus musculus
acctccagctgcaatggggactctg

SEQ ID NO: 178995 - DNA, 25 bp, Mus musculus
acctccaggacgtgtctcccactcc

SEQ ID NO: 178996 - DNA, 25 bp, Mus musculus
acctccaggacgtttctaagctgac

SEQ ID NO: 178997 - DNA, 25 bp, Mus musculus
acctccaggccacaatcggctatcc

SEQ ID NO: 178998 - DNA, 25 bp, Mus musculus
acctccaggccctccggaggacctg

SEQ ID NO: 178999 - DNA, 25 bp, Mus musculus
acctccagtgctgcgccattttggc

SEQ ID NO: 179000 - DNA, 25 bp, Mus musculus
acctccagtgctgtaaccctccact

SEQ ID NO: 179001 - DNA, 25 bp, Mus musculus
acctccatcccaagcgcctgtgtct

SEQ ID NO: 179002 - DNA, 25 bp, Mus musculus
acctccatcctgcagaccttatgtg

SEQ ID NO: 179003 - DNA, 25 bp, Mus musculus
acctccatcctgcaggggctggcga

SEQ ID NO: 179004 - DNA, 25 bp, Mus musculus
acctccattgggcacatgaccgatc

SEQ ID NO: 179005 - DNA, 25 bp, Mus musculus
acctccattttggattcgtaaactt

SEQ ID NO: 179006 - DNA, 25 bp, Mus musculus
acctcccaagattccactttgaaga

SEQ ID NO: 179007 - DNA, 25 bp, Mus musculus
acctcccacacaggcgctctgaaat

SEQ ID NO: 179008 - DNA, 25 bp, Mus musculus
acctcccacagtgttatctttgttg

SEQ ID NO: 179009 - DNA, 25 bp, Mus musculus
acctcccagaactccgaggtgactc

SEQ ID NO: 179010 - DNA, 25 bp, Mus musculus
acctcccagcacctgtccctcactc

SEQ ID NO: 179011 - DNA, 25 bp, Mus musculus
acctcccagtactgggtacagagcc

SEQ ID NO: 179012 - DNA, 25 bp, Mus musculus
acctcccatactcggtccctgaatg

SEQ ID NO: 179013 - DNA, 25 bp, Mus musculus
acctcccatcagcaagccccgccca

SEQ ID NO: 179014 - DNA, 25 bp, Mus musculus
acctcccatcatttgaggctctttc

SEQ ID NO: 179015 - DNA, 25 bp, Mus musculus
acctcccatgatgaccctatcaagg

SEQ ID NO: 179016 - DNA, 25 bp, Mus musculus
acctccccgtaatgctggtgagatt

SEQ ID NO: 179017 - DNA, 25 bp, Mus musculus
acctccccgtaattacgctggggag

SEQ ID NO: 179018 - DNA, 25 bp, Mus musculus
acctcccctccgaaaatgccatccc

SEQ ID NO: 179019 - DNA, 25 bp, Mus musculus
acctcccctccgaaactgtctgccc

SEQ ID NO: 179020 - DNA, 25 bp, Mus musculus
acctccccttcaggccagaaggttt

SEQ ID NO: 179021 - DNA, 25 bp, Mus musculus
acctcccgagcaggcagcaaacaga

SEQ ID NO: 179022 - DNA, 25 bp, Mus musculus
acctcccggatttctgcaccccctg

SEQ ID NO: 179023 - DNA, 25 bp, Mus musculus
acctccctaggattctcaaagctgg

SEQ ID NO: 179024 - DNA, 25 bp, Mus musculus
acctccctaggtgaggattatgaag

SEQ ID NO: 179025 - DNA, 25 bp, Mus musculus
acctccctatgtcccatcttgtcaa

SEQ ID NO: 179026 - DNA, 25 bp, Mus musculus
acctccctcaccaagcttagcaagg

SEQ ID NO: 179027 - DNA, 25 bp, Mus musculus
acctccctcagcagcaggtcctggg

SEQ ID NO: 179028 - DNA, 25 bp, Mus musculus
acctccctcttcatgacacccctgg

SEQ ID NO: 179029 - DNA, 25 bp, Mus musculus
acctccctgccttcagccatctgca

SEQ ID NO: 179030 - DNA, 25 bp, Mus musculus
acctccctggaggtggagccttttg

SEQ ID NO: 179031 - DNA, 25 bp, Mus musculus
acctcccttgtggtgtgaacattgg

SEQ ID NO: 179032 - DNA, 25 bp, Mus musculus
acctccgaaaggcccgacgactctt

SEQ ID NO: 179033 - DNA, 25 bp, Mus musculus
acctccgaacctgattcacagatgg

SEQ ID NO: 179034 - DNA, 25 bp, Mus musculus
acctccgaatagcagcttcttcggc

SEQ ID NO: 179035 - DNA, 25 bp, Mus musculus
acctccgactgctctttgtcaccac

SEQ ID NO: 179036 - DNA, 25 bp, Mus musculus
acctccgactgggaggagaaggagc

SEQ ID NO: 179037 - DNA, 25 bp, Mus musculus
acctccgggacactggacatcatca

SEQ ID NO: 179038 - DNA, 25 bp, Mus musculus
acctccgggacactgggatcttcct

SEQ ID NO: 179039 - DNA, 25 bp, Mus musculus
acctccggtaaagtgacaaaacata

SEQ ID NO: 179040 - DNA, 25 bp, Mus musculus
acctccggttatggtacaaattctg

SEQ ID NO: 179041 - DNA, 25 bp, Mus musculus
acctccgtgaaaaccaggcgactat

SEQ ID NO: 179042 - DNA, 25 bp, Mus musculus
acctcctaacccagttccgcagagg

SEQ ID NO: 179043 - DNA, 25 bp, Mus musculus
acctcctaatggtttctgtagctgg

SEQ ID NO: 179044 - DNA, 25 bp, Mus musculus
acctcctaggaaagctgtagaggaa

SEQ ID NO: 179045 - DNA, 25 bp, Mus musculus
acctcctaggaataggtgaagggaa

SEQ ID NO: 179046 - DNA, 25 bp, Mus musculus
acctcctcaggacttctagcagcag

SEQ ID NO: 179047 - DNA, 25 bp, Mus musculus
acctcctcaggagccgtctctcagg

SEQ ID NO: 179048 - DNA, 25 bp, Mus musculus
acctcctccaacccgggaagcacag

SEQ ID NO: 179049 - DNA, 25 bp, Mus musculus
acctcctccacggagcaggagcgag

SEQ ID NO: 179050 - DNA, 25 bp, Mus musculus
acctcctccacggagcgagaggggg

SEQ ID NO: 179051 - DNA, 25 bp, Mus musculus
acctcctccagggagtgagtgctgc

SEQ ID NO: 179052 - DNA, 25 bp, Mus musculus
acctcctgaacaaggtccaggacat

SEQ ID NO: 179053 - DNA, 25 bp, Mus musculus
acctcctgagaaaagggcagtcatg

SEQ ID NO: 179054 - DNA, 25 bp, Mus musculus
acctcctgagaaacagtcatggaag

SEQ ID NO: 179055 - DNA, 25 bp, Mus musculus
acctcctgataggcaacatgtcggc

SEQ ID NO: 179056 - DNA, 25 bp, Mus musculus
acctcctgctctggtggctccttgt

SEQ ID NO: 179057 - DNA, 25 bp, Mus musculus
acctcctgctggggtagacagcaag

SEQ ID NO: 179058 - DNA, 25 bp, Mus musculus
acctcctgtagagagccatatacag

SEQ ID NO: 179059 - DNA, 25 bp, Mus musculus
acctcctgtagaggtgaggcatgaa

SEQ ID NO: 179060 - DNA, 25 bp, Mus musculus
acctcctgtctgagcgggaggaagc

SEQ ID NO: 179061 - DNA, 25 bp, Mus musculus
acctcctgtctgagctctttcctgt

SEQ ID NO: 179062 - DNA, 25 bp, Mus musculus
acctcctgtctgagtggacgagcga

SEQ ID NO: 179063 - DNA, 25 bp, Mus musculus
acctcctgtggcaagggagtcatcc

SEQ ID NO: 179064 - DNA, 25 bp, Mus musculus
acctccttcctggcattggaggcgg

SEQ ID NO: 179065 - DNA, 25 bp, Mus musculus
acctccttgcatgagacacacaacc

SEQ ID NO: 179066 - DNA, 25 bp, Mus musculus
acctccttggatttccataagacgg

SEQ ID NO: 179067 - DNA, 25 bp, Mus musculus
acctccttgggcatccccaaagctc

SEQ ID NO: 179068 - DNA, 25 bp, Mus musculus
acctcctttcgcttcaagcacaaat

SEQ ID NO: 179069 - DNA, 25 bp, Mus musculus
acctcgaagttcaatatgctcccaa

SEQ ID NO: 179070 - DNA, 25 bp, Mus musculus
acctcgatgtcgttgaacggtcacc

SEQ ID NO: 179071 - DNA, 25 bp, Mus musculus
acctcgcaaattacgtccacagcaa

SEQ ID NO: 179072 - DNA, 25 bp, Mus musculus
acctcgcaagttcttccatcagtgt

SEQ ID NO: 179073 - DNA, 25 bp, Mus musculus
acctcgcaggaaattctacagaagt

SEQ ID NO: 179074 - DNA, 25 bp, Mus musculus
acctcgcaggaagacagatcttcct

SEQ ID NO: 179075 - DNA, 25 bp, Mus musculus
acctcgccacggcccagttcaattt

SEQ ID NO: 179076 - DNA, 25 bp, Mus musculus
acctcgccaggctgcctaaaccacg

SEQ ID NO: 179077 - DNA, 25 bp, Mus musculus
acctcgccagggtgcactcgtgaaa

SEQ ID NO: 179078 - DNA, 25 bp, Mus musculus
acctcgccaggtggaggtgggaaag

SEQ ID NO: 179079 - DNA, 25 bp, Mus musculus
acctcgcgagtttcctgacaggcaa

SEQ ID NO: 179080 - DNA, 25 bp, Mus musculus
acctcgctcaaaggagaaaggatcc

SEQ ID NO: 179081 - DNA, 25 bp, Mus musculus
acctcgctcaaaggtcgatccttcg

SEQ ID NO: 179082 - DNA, 25 bp, Mus musculus
acctcgctgacccagcggcgaggac

SEQ ID NO: 179083 - DNA, 25 bp, Mus musculus
acctcgctggccagtatgtggcctt

SEQ ID NO: 179084 - DNA, 25 bp, Mus musculus
acctcgctgtgttggacttccttgt

SEQ ID NO: 179085 - DNA, 25 bp, Mus musculus
acctcgcttctaaggtggtggccta

SEQ ID NO: 179086 - DNA, 25 bp, Mus musculus
acctcggaccatcagccttggggag

SEQ ID NO: 179087 - DNA, 25 bp, Mus musculus
acctcggcctcaggaaattccttca

SEQ ID NO: 179088 - DNA, 25 bp, Mus musculus
acctcggcctcagtagagtgatgcc

SEQ ID NO: 179089 - DNA, 25 bp, Mus musculus
acctcggcctctccatccgttccgt

SEQ ID NO: 179090 - DNA, 25 bp, Mus musculus
acctcggcgcgggaactggcatcaa

SEQ ID NO: 179091 - DNA, 25 bp, Mus musculus
acctcggcgcgggtgaacaccatgt

SEQ ID NO: 179092 - DNA, 25 bp, Mus musculus
acctcggcgcgggtgagccctattt

SEQ ID NO: 179093 - DNA, 25 bp, Mus musculus
acctcgggaaacatacccagagaaa

SEQ ID NO: 179094 - DNA, 25 bp, Mus musculus
acctcgggaaacatcacagaagtac

SEQ ID NO: 179095 - DNA, 25 bp, Mus musculus
acctcgggagagaaattttaagcgg

SEQ ID NO: 179096 - DNA, 25 bp, Mus musculus
acctcggtctctcagaaaacatctc

SEQ ID NO: 179097 - DNA, 25 bp, Mus musculus
acctcggtgacagaacaaatcagtt

SEQ ID NO: 179098 - DNA, 25 bp, Mus musculus
acctcggtgacaggtttggggcctt

SEQ ID NO: 179099 - DNA, 25 bp, Mus musculus
acctcggtgcaggctatctatgtgc

SEQ ID NO: 179100 - DNA, 25 bp, Mus musculus
acctcgtgaggactctcattagacc

SEQ ID NO: 179101 - DNA, 25 bp, Mus musculus
acctcgtgagttacaggactctcat

SEQ ID NO: 179102 - DNA, 25 bp, Mus musculus
acctcgttaggatcgcaccagagta

SEQ ID NO: 179103 - DNA, 25 bp, Mus musculus
acctcgttcctcaagatggccgact

SEQ ID NO: 179104 - DNA, 25 bp, Mus musculus
acctctaaaaagaggttgtggatgt

SEQ ID NO: 179105 - DNA, 25 bp, Mus musculus
acctctaaaatggtgcacctccgct

SEQ ID NO: 179106 - DNA, 25 bp, Mus musculus
acctctaaaggaggaagatgaggtg

SEQ ID NO: 179107 - DNA, 25 bp, Mus musculus
acctctaacaccgcaagccccgccc

SEQ ID NO: 179108 - DNA, 25 bp, Mus musculus
acctctacaagtgacatcttgaaag

SEQ ID NO: 179109 - DNA, 25 bp, Mus musculus
acctctacagatttcctccctcctc

SEQ ID NO: 179110 - DNA, 25 bp, Mus musculus
acctctaccagcaggcttccccacc

SEQ ID NO: 179111 - DNA, 25 bp, Mus musculus
acctctagaagcgaaggaatacaca

SEQ ID NO: 179112 - DNA, 25 bp, Mus musculus
acctctagacgccagccttctctga

SEQ ID NO: 179113 - DNA, 25 bp, Mus musculus
acctctagaggcctataccattcaa

SEQ ID NO: 179114 - DNA, 25 bp, Mus musculus
acctctagagttgaccaagctgcac

SEQ ID NO: 179115 - DNA, 25 bp, Mus musculus
acctctatccaagggaaggaaaata

SEQ ID NO: 179116 - DNA, 25 bp, Mus musculus
acctctatgtaactgtcaccgtttc

SEQ ID NO: 179117 - DNA, 25 bp, Mus musculus
acctctatttcgccatgagctacaa

SEQ ID NO: 179118 - DNA, 25 bp, Mus musculus
acctctcaacctgtctgcaaacagc

SEQ ID NO: 179119 - DNA, 25 bp, Mus musculus
acctctcaagaaagatgcgccagga

SEQ ID NO: 179120 - DNA, 25 bp, Mus musculus
acctctcaagaaaggacagatcgtt

SEQ ID NO: 179121 - DNA, 25 bp, Mus musculus
acctctcacagacagctcagctctt

SEQ ID NO: 179122 - DNA, 25 bp, Mus musculus
acctctcacagatgaatcagcagat

SEQ ID NO: 179123 - DNA, 25 bp, Mus musculus
acctctcacagtgatagaatgcctg

SEQ ID NO: 179124 - DNA, 25 bp, Mus musculus
acctctcacagtgatgagaatttta

SEQ ID NO: 179125 - DNA, 25 bp, Mus musculus
acctctccacgtgctttagctctgg

SEQ ID NO: 179126 - DNA, 25 bp, Mus musculus
acctctccagattcactaaaaactt

SEQ ID NO: 179127 - DNA, 25 bp, Mus musculus
acctctccagcgttccctgctggct

SEQ ID NO: 179128 - DNA, 25 bp, Mus musculus
acctctccagtctctagataaggtg

SEQ ID NO: 179129 - DNA, 25 bp, Mus musculus
acctctcccaatcctgtgatagtcc

SEQ ID NO: 179130 - DNA, 25 bp, Mus musculus
acctctcccaccatcccaaatttat

SEQ ID NO: 179131 - DNA, 25 bp, Mus musculus
acctctcccaccatgaaacaaaagg

SEQ ID NO: 179132 - DNA, 25 bp, Mus musculus
acctctcccagctccctggctgagc

SEQ ID NO: 179133 - DNA, 25 bp, Mus musculus
acctctcccaggtgtgtgacgggaa

SEQ ID NO: 179134 - DNA, 25 bp, Mus musculus
acctctccggctggatgagcctgcc

SEQ ID NO: 179135 - DNA, 25 bp, Mus musculus
acctctcctggagtgtctgtgagga

SEQ ID NO: 179136 - DNA, 25 bp, Mus musculus
acctctcctgggcctctgatacctc

SEQ ID NO: 179137 - DNA, 25 bp, Mus musculus
acctctcctgtcgcagcctcggcct

SEQ ID NO: 179138 - DNA, 25 bp, Mus musculus
acctctcgggacggagatactactc

SEQ ID NO: 179139 - DNA, 25 bp, Mus musculus
acctctcgggacgggccctggtggt

SEQ ID NO: 179140 - DNA, 25 bp, Mus musculus
acctctcgggacggttcaatgtatc

SEQ ID NO: 179141 - DNA, 25 bp, Mus musculus
acctctcgtcagatgtcgtcaccgt

SEQ ID NO: 179142 - DNA, 25 bp, Mus musculus
acctctcgtcaggactgcaagaggc

SEQ ID NO: 179143 - DNA, 25 bp, Mus musculus
acctctctgaagaagtcttagggaa

SEQ ID NO: 179144 - DNA, 25 bp, Mus musculus
acctctctgactcagattccaccat

SEQ ID NO: 179145 - DNA, 25 bp, Mus musculus
acctctctgcccactcagccagttg

SEQ ID NO: 179146 - DNA, 25 bp, Mus musculus
acctctcttaccagtctccactcag

SEQ ID NO: 179147 - DNA, 25 bp, Mus musculus
acctctgaaactataattttattcc

SEQ ID NO: 179148 - DNA, 25 bp, Mus musculus
acctctgaaactgaactttctaagc

SEQ ID NO: 179149 - DNA, 25 bp, Mus musculus
acctctgaacctaacacagaagaat

SEQ ID NO: 179150 - DNA, 25 bp, Mus musculus
acctctgaacctacactttcctgag

SEQ ID NO: 179151 - DNA, 25 bp, Mus musculus
acctctgaacctagtgctacaataa

SEQ ID NO: 179152 - DNA, 25 bp, Mus musculus
acctctgaacctataattttattcc

SEQ ID NO: 179153 - DNA, 25 bp, Mus musculus
acctctgaacctatactttggcaaa

SEQ ID NO: 179154 - DNA, 25 bp, Mus musculus
acctctgaacctcatagttttggga

SEQ ID NO: 179155 - DNA, 25 bp, Mus musculus
acctctgaacctccaccactggtcc

SEQ ID NO: 179156 - DNA, 25 bp, Mus musculus
acctctgaacctctccttcttctac

SEQ ID NO: 179157 - DNA, 25 bp, Mus musculus
acctctgaacctgacagagatttcc

SEQ ID NO: 179158 - DNA, 25 bp, Mus musculus
acctctgaacctgacccagaagctg

SEQ ID NO: 179159 - DNA, 25 bp, Mus musculus
acctctgaacctgctccgcccccac

SEQ ID NO: 179160 - DNA, 25 bp, Mus musculus
acctctgaacctgtggatattgtcc

SEQ ID NO: 179161 - DNA, 25 bp, Mus musculus
acctctgaactatgcctgtgtcttg

SEQ ID NO: 179162 - DNA, 25 bp, Mus musculus
acctctgaacttgtggcagggctga

SEQ ID NO: 179163 - DNA, 25 bp, Mus musculus
acctctgaagagttacatgctgcag

SEQ ID NO: 179164 - DNA, 25 bp, Mus musculus
acctctgacaaacagttgctcagac

SEQ ID NO: 179165 - DNA, 25 bp, Mus musculus
acctctgacctccagaaaggtgctg

SEQ ID NO: 179166 - DNA, 25 bp, Mus musculus
acctctgagagatggatttataact

SEQ ID NO: 179167 - DNA, 25 bp, Mus musculus
acctctgagagctcccaggaggcaa

SEQ ID NO: 179168 - DNA, 25 bp, Mus musculus
acctctgaggacagaacttatttgt

SEQ ID NO: 179169 - DNA, 25 bp, Mus musculus
acctctgatgaactgaatccaaatc

SEQ ID NO: 179170 - DNA, 25 bp, Mus musculus
acctctgattgcagttccaactacc

SEQ ID NO: 179171 - DNA, 25 bp, Mus musculus
acctctgcaaaagattcacagtctc

SEQ ID NO: 179172 - DNA, 25 bp, Mus musculus
acctctgcaaaagcaatgtcttcaa

SEQ ID NO: 179173 - DNA, 25 bp, Mus musculus
acctctgcaaggtttgtctgggcac

SEQ ID NO: 179174 - DNA, 25 bp, Mus musculus
acctctgcaatcgaggtcatgcttc

SEQ ID NO: 179175 - DNA, 25 bp, Mus musculus
acctctgcacgaagatctgttagca

SEQ ID NO: 179176 - DNA, 25 bp, Mus musculus
acctctgcagcttgcactgaggcca

SEQ ID NO: 179177 - DNA, 25 bp, Mus musculus
acctctgcagttacggacgagttta

SEQ ID NO: 179178 - DNA, 25 bp, Mus musculus
acctctgcgaaccaaacacactggg

SEQ ID NO: 179179 - DNA, 25 bp, Mus musculus
acctctgcgaaccaactgccagggg

SEQ ID NO: 179180 - DNA, 25 bp, Mus musculus
acctctgcggcccggctagttcatt

SEQ ID NO: 179181 - DNA, 25 bp, Mus musculus
acctctgcggcggtatctgacctca

SEQ ID NO: 179182 - DNA, 25 bp, Mus musculus
acctctgcgtacagatgtggagatt

SEQ ID NO: 179183 - DNA, 25 bp, Mus musculus
acctctgctccgaggtctccaaaaa

SEQ ID NO: 179184 - DNA, 25 bp, Mus musculus
acctctggaaacagaaaggacttca

SEQ ID NO: 179185 - DNA, 25 bp, Mus musculus
acctctggaagagaacctgtggaca

SEQ ID NO: 179186 - DNA, 25 bp, Mus musculus
acctctggaaggggcgtatgatcct

SEQ ID NO: 179187 - DNA, 25 bp, Mus musculus
acctctggaggctcctgctcctcaa

SEQ ID NO: 179188 - DNA, 25 bp, Mus musculus
acctctggatgaacaacactttcat

SEQ ID NO: 179189 - DNA, 25 bp, Mus musculus
acctctggatgtcgtcacgctggcc

SEQ ID NO: 179190 - DNA, 25 bp, Mus musculus
acctctggatgtgtcttcggagcct

SEQ ID NO: 179191 - DNA, 25 bp, Mus musculus
acctctggatgttgaacagcgtcac

SEQ ID NO: 179192 - DNA, 25 bp, Mus musculus
acctctggcaaaatgcgtgcccaca

SEQ ID NO: 179193 - DNA, 25 bp, Mus musculus
acctctggcatccaggtgcgctacc

SEQ ID NO: 179194 - DNA, 25 bp, Mus musculus
acctctgggagccagcagaggcctc

SEQ ID NO: 179195 - DNA, 25 bp, Mus musculus
acctctgggagcccacagagagtca

SEQ ID NO: 179196 - DNA, 25 bp, Mus musculus
acctctgggaggacactgtgtgggt

SEQ ID NO: 179197 - DNA, 25 bp, Mus musculus
acctctgggagtttgtcctgggcac

SEQ ID NO: 179198 - DNA, 25 bp, Mus musculus
acctctgtcacatgggaccatctgg

SEQ ID NO: 179199 - DNA, 25 bp, Mus musculus
acctctgtccaccattccaaggaac

SEQ ID NO: 179200 - DNA, 25 bp, Mus musculus
acctctgtctacccttatgagctac

SEQ ID NO: 179201 - DNA, 25 bp, Mus musculus
acctctgtgaaggcaatggtgctcc

SEQ ID NO: 179202 - DNA, 25 bp, Mus musculus
acctctgtgaggtttttcaagacag

SEQ ID NO: 179203 - DNA, 25 bp, Mus musculus
acctctgtgcaatgaaggtaaccga

SEQ ID NO: 179204 - DNA, 25 bp, Mus musculus
acctctgtggaggaaatcctgaaga

SEQ ID NO: 179205 - DNA, 25 bp, Mus musculus
acctctgtggtaacatggccaacct

SEQ ID NO: 179206 - DNA, 25 bp, Mus musculus
acctcttcaatgaggggaagcgctt

SEQ ID NO: 179207 - DNA, 25 bp, Mus musculus
acctcttcaggcccgcactttgcgc

SEQ ID NO: 179208 - DNA, 25 bp, Mus musculus
acctcttcaggctctgtgttccgag

SEQ ID NO: 179209 - DNA, 25 bp, Mus musculus
acctcttcatgcgcatggacttgga

SEQ ID NO: 179210 - DNA, 25 bp, Mus musculus
acctcttccagacgctgaatcgcac

SEQ ID NO: 179211 - DNA, 25 bp, Mus musculus
acctcttccgaggacccacactcag

SEQ ID NO: 179212 - DNA, 25 bp, Mus musculus
acctcttctgtggttggagactagg

SEQ ID NO: 179213 - DNA, 25 bp, Mus musculus
acctcttctgttggccgtgtttaca

SEQ ID NO: 179214 - DNA, 25 bp, Mus musculus
acctcttcttctttgtactaggcgg

SEQ ID NO: 179215 - DNA, 25 bp, Mus musculus
acctcttgaaaatgtggagtgtgac

SEQ ID NO: 179216 - DNA, 25 bp, Mus musculus
acctcttgacctggaagggaacatg

SEQ ID NO: 179217 - DNA, 25 bp, Mus musculus
acctcttgcaaaggtgacccttacc

SEQ ID NO: 179218 - DNA, 25 bp, Mus musculus
acctctttaaagatactatcgtgga

SEQ ID NO: 179219 - DNA, 25 bp, Mus musculus
acctctttaaggcgtaccttctcat

SEQ ID NO: 179220 - DNA, 25 bp, Mus musculus
acctctttaagtatgcagcagatcc

SEQ ID NO: 179221 - DNA, 25 bp, Mus musculus
acctctttactctcagatagccttt

SEQ ID NO: 179222 - DNA, 25 bp, Mus musculus
acctctttcttctggaaccagctat

SEQ ID NO: 179223 - DNA, 25 bp, Mus musculus
acctctttgaggaactttgatgttt

SEQ ID NO: 179224 - DNA, 25 bp, Mus musculus
acctctttgagggaagaagccagct

SEQ ID NO: 179225 - DNA, 25 bp, Mus musculus
acctctttgcagatcttgatatgga

SEQ ID NO: 179226 - DNA, 25 bp, Mus musculus
acctgaaaacattattatgttagtt

SEQ ID NO: 179227 - DNA, 25 bp, Mus musculus
acctgaaaaggaaacctgcagatct

SEQ ID NO: 179228 - DNA, 25 bp, Mus musculus
acctgaaaaggacaagaagatgcca

SEQ ID NO: 179229 - DNA, 25 bp, Mus musculus
acctgaaagcagaacctggtccacg

SEQ ID NO: 179230 - DNA, 25 bp, Mus musculus
acctgaaatctgcctccaacattga

SEQ ID NO: 179231 - DNA, 25 bp, Mus musculus
acctgaaatgtgagctcactctgca

SEQ ID NO: 179232 - DNA, 25 bp, Mus musculus
acctgaacagggacccagaagggca

SEQ ID NO: 179233 - DNA, 25 bp, Mus musculus
acctgaacagtgagacggtttaagc

SEQ ID NO: 179234 - DNA, 25 bp, Mus musculus
acctgaaccttggcatgaataggtt

SEQ ID NO: 179235 - DNA, 25 bp, Mus musculus
acctgaaccttgggtggcttgtccc

SEQ ID NO: 179236 - DNA, 25 bp, Mus musculus
acctgaagaacaaggcagctgcagg

SEQ ID NO: 179237 - DNA, 25 bp, Mus musculus
acctgaagagcaagatcctggcagc

SEQ ID NO: 179238 - DNA, 25 bp, Mus musculus
acctgaagcggtgctcactcctggc

SEQ ID NO: 179239 - DNA, 25 bp, Mus musculus
acctgaaggaggaggttggaagtcg

SEQ ID NO: 179240 - DNA, 25 bp, Mus musculus
acctgaaggagtaggccctgtattg

SEQ ID NO: 179241 - DNA, 25 bp, Mus musculus
acctgaagggcagacaagatgaacc

SEQ ID NO: 179242 - DNA, 25 bp, Mus musculus
acctgaagggcagggacattagtca

SEQ ID NO: 179243 - DNA, 25 bp, Mus musculus
acctgaagggcaggtttggcataga

SEQ ID NO: 179244 - DNA, 25 bp, Mus musculus
acctgaaggttgggccttacatcac

SEQ ID NO: 179245 - DNA, 25 bp, Mus musculus
acctgaatagcgtgcctcaggagcc

SEQ ID NO: 179246 - DNA, 25 bp, Mus musculus
acctgaatcagggcagcgctgtatt

SEQ ID NO: 179247 - DNA, 25 bp, Mus musculus
acctgaatgaacagcttctacctaa

SEQ ID NO: 179248 - DNA, 25 bp, Mus musculus
acctgaatgcagattgaggatgggt

SEQ ID NO: 179249 - DNA, 25 bp, Mus musculus
acctgaatgcagtgacaagcatcag

SEQ ID NO: 179250 - DNA, 25 bp, Mus musculus
acctgacaaaggttctgggagaggt

SEQ ID NO: 179251 - DNA, 25 bp, Mus musculus
acctgacacttccgtgttaggcacg

SEQ ID NO: 179252 - DNA, 25 bp, Mus musculus
acctgacaggagtggggatactgta

SEQ ID NO: 179253 - DNA, 25 bp, Mus musculus
acctgacaggcaggccaggagtgtg

SEQ ID NO: 179254 - DNA, 25 bp, Mus musculus
acctgacagtgaggatccaaaggag

SEQ ID NO: 179255 - DNA, 25 bp, Mus musculus
acctgacatctggcctacacagaga

SEQ ID NO: 179256 - DNA, 25 bp, Mus musculus
acctgaccacggtgattgggatact

SEQ ID NO: 179257 - DNA, 25 bp, Mus musculus
acctgaccacggtttggctccttcc

SEQ ID NO: 179258 - DNA, 25 bp, Mus musculus
acctgaccagtctatatatattggg

SEQ ID NO: 179259 - DNA, 25 bp, Mus musculus
acctgaccatagacgagttggagtg

SEQ ID NO: 179260 - DNA, 25 bp, Mus musculus
acctgaccatagacgtggaaactgt

SEQ ID NO: 179261 - DNA, 25 bp, Mus musculus
acctgacctcaatgtctttacatcc

SEQ ID NO: 179262 - DNA, 25 bp, Mus musculus
acctgacctgagataccatggccaa

SEQ ID NO: 179263 - DNA, 25 bp, Mus musculus
acctgacgcaggcaaaacccattta

SEQ ID NO: 179264 - DNA, 25 bp, Mus musculus
acctgactacgagctaaggaggctc

SEQ ID NO: 179265 - DNA, 25 bp, Mus musculus
acctgactacgagcttaagtaccca

SEQ ID NO: 179266 - DNA, 25 bp, Mus musculus
acctgactcagagaggaagaacctg

SEQ ID NO: 179267 - DNA, 25 bp, Mus musculus
acctgactgacccattgaagaagcc

SEQ ID NO: 179268 - DNA, 25 bp, Mus musculus
acctgacttctggatggacagtctg

SEQ ID NO: 179269 - DNA, 25 bp, Mus musculus
acctgagaagcaggctgtgcagcta

SEQ ID NO: 179270 - DNA, 25 bp, Mus musculus
acctgagaagcaggtctgttctcct

SEQ ID NO: 179271 - DNA, 25 bp, Mus musculus
acctgagaattgattcatctgtttg

SEQ ID NO: 179272 - DNA, 25 bp, Mus musculus
acctgagagccagagctgttctgcc

SEQ ID NO: 179273 - DNA, 25 bp, Mus musculus
acctgagagccagatatccattgaa

SEQ ID NO: 179274 - DNA, 25 bp, Mus musculus
acctgagcaataagagcggtctcac

SEQ ID NO: 179275 - DNA, 25 bp, Mus musculus
acctgagcacagtgagcatgttttt

SEQ ID NO: 179276 - DNA, 25 bp, Mus musculus
acctgagccccgagcctttgacatg

SEQ ID NO: 179277 - DNA, 25 bp, Mus musculus
acctgagcctgctgctccagcctcg

SEQ ID NO: 179278 - DNA, 25 bp, Mus musculus
acctgagctcgatgtcggttggacc

SEQ ID NO: 179279 - DNA, 25 bp, Mus musculus
acctgagctcgctggcttctccccc

SEQ ID NO: 179280 - DNA, 25 bp, Mus musculus
acctgagctggatgtaccctctggg

SEQ ID NO: 179281 - DNA, 25 bp, Mus musculus
acctgaggaagcagatataaagact

SEQ ID NO: 179282 - DNA, 25 bp, Mus musculus
acctgaggactttgcaactgctgct

SEQ ID NO: 179283 - DNA, 25 bp, Mus musculus
acctgaggagagagaacctggtcca

SEQ ID NO: 179284 - DNA, 25 bp, Mus musculus
acctgaggagagagtgttccagaag

SEQ ID NO: 179285 - DNA, 25 bp, Mus musculus
acctgagtccctagaagcaagacga

SEQ ID NO: 179286 - DNA, 25 bp, Mus musculus
acctgagtgaggtagataaagattt

SEQ ID NO: 179287 - DNA, 25 bp, Mus musculus
acctgagtgatgatggaatcagcgt

SEQ ID NO: 179288 - DNA, 25 bp, Mus musculus
acctgagtgtctctgatcaagagca

SEQ ID NO: 179289 - DNA, 25 bp, Mus musculus
acctgataaaaagtatgtctacgtt

SEQ ID NO: 179290 - DNA, 25 bp, Mus musculus
acctgataagaagattatttccaag

SEQ ID NO: 179291 - DNA, 25 bp, Mus musculus
acctgatagaagagcttcggaaatg

SEQ ID NO: 179292 - DNA, 25 bp, Mus musculus
acctgatagaagagtggtagatgac

SEQ ID NO: 179293 - DNA, 25 bp, Mus musculus
acctgatagcagctgtgagtaccag

SEQ ID NO: 179294 - DNA, 25 bp, Mus musculus
acctgatctaaggagattacctgga

SEQ ID NO: 179295 - DNA, 25 bp, Mus musculus
acctgatgaatcccaaaggccctgc

SEQ ID NO: 179296 - DNA, 25 bp, Mus musculus
acctgatgagagtgttcgaggaata

SEQ ID NO: 179297 - DNA, 25 bp, Mus musculus
acctgatgaggagatactggagtgt

SEQ ID NO: 179298 - DNA, 25 bp, Mus musculus
acctgatgtccgggcactagagcag

SEQ ID NO: 179299 - DNA, 25 bp, Mus musculus
acctgattgaaagtaatcacccaat

SEQ ID NO: 179300 - DNA, 25 bp, Mus musculus
acctgattgaaagtataattgcaga

SEQ ID NO: 179301 - DNA, 25 bp, Mus musculus
acctgattgtggcaggacgaagaat

SEQ ID NO: 179302 - DNA, 25 bp, Mus musculus
acctgattgtggcaggtatcacgag

SEQ ID NO: 179303 - DNA, 25 bp, Mus musculus
acctgcaaaatgtaactgcggatcc

SEQ ID NO: 179304 - DNA, 25 bp, Mus musculus
acctgcaaagtaacagcctccaccg

SEQ ID NO: 179305 - DNA, 25 bp, Mus musculus
acctgcaaccaagatgagtccttcc

SEQ ID NO: 179306 - DNA, 25 bp, Mus musculus
acctgcaaccaagatttaaacgagt

SEQ ID NO: 179307 - DNA, 25 bp, Mus musculus
acctgcaacccagagaccttcccct

SEQ ID NO: 179308 - DNA, 25 bp, Mus musculus
acctgcaactcaaggatggatgccc

SEQ ID NO: 179309 - DNA, 25 bp, Mus musculus
acctgcaactcaaggtctaaggtac

SEQ ID NO: 179310 - DNA, 25 bp, Mus musculus
acctgcaagctcagatgtatagact

SEQ ID NO: 179311 - DNA, 25 bp, Mus musculus
acctgcaaggcatggcccagttcaa

SEQ ID NO: 179312 - DNA, 25 bp, Mus musculus
acctgcaaggttcactttaattgag

SEQ ID NO: 179313 - DNA, 25 bp, Mus musculus
acctgcacaagcaaaacctggaaat

SEQ ID NO: 179314 - DNA, 25 bp, Mus musculus
acctgcacaagctgactcatcatgt

SEQ ID NO: 179315 - DNA, 25 bp, Mus musculus
acctgcacacataacaccaatgact

SEQ ID NO: 179316 - DNA, 25 bp, Mus musculus
acctgcaccagagacggaaaaccct

SEQ ID NO: 179317 - DNA, 25 bp, Mus musculus
acctgcaccaggattctaatccctt

SEQ ID NO: 179318 - DNA, 25 bp, Mus musculus
acctgcaccatcgccaagaacagca

SEQ ID NO: 179319 - DNA, 25 bp, Mus musculus
acctgcaccccggagtatgatccca

SEQ ID NO: 179320 - DNA, 25 bp, Mus musculus
acctgcacctcctgtgctttcgttg

SEQ ID NO: 179321 - DNA, 25 bp, Mus musculus
acctgcacctggatgcaccctgctc

SEQ ID NO: 179322 - DNA, 25 bp, Mus musculus
acctgcacctggatgcattttgttc

SEQ ID NO: 179323 - DNA, 25 bp, Mus musculus
acctgcactgggaaatatggctttg

SEQ ID NO: 179324 - DNA, 25 bp, Mus musculus
acctgcactgggaaggcttgtcgct

SEQ ID NO: 179325 - DNA, 25 bp, Mus musculus
acctgcagaccagaggctgcctgga

SEQ ID NO: 179326 - DNA, 25 bp, Mus musculus
acctgcagaccccggaaagccagaa

SEQ ID NO: 179327 - DNA, 25 bp, Mus musculus
acctgcagatgtccctgtccattgc

SEQ ID NO: 179328 - DNA, 25 bp, Mus musculus
acctgcagcaggtgatagagggaaa

SEQ ID NO: 179329 - DNA, 25 bp, Mus musculus
acctgcagccgcccggccatctgct

SEQ ID NO: 179330 - DNA, 25 bp, Mus musculus
acctgcagccgcccgggacaggcca

SEQ ID NO: 179331 - DNA, 25 bp, Mus musculus
acctgcagcggcatgaagatgagct

SEQ ID NO: 179332 - DNA, 25 bp, Mus musculus
acctgcagcggcatggtgatgaatc

SEQ ID NO: 179333 - DNA, 25 bp, Mus musculus
acctgcagctgcacgggcaggtggt

SEQ ID NO: 179334 - DNA, 25 bp, Mus musculus
acctgcagtgctcccaccaccttcc

SEQ ID NO: 179335 - DNA, 25 bp, Mus musculus
acctgcataaagacagacccctgtg

SEQ ID NO: 179336 - DNA, 25 bp, Mus musculus
acctgcataagaattgaattagaaa

SEQ ID NO: 179337 - DNA, 25 bp, Mus musculus
acctgcatagaccaggtgagacgga

SEQ ID NO: 179338 - DNA, 25 bp, Mus musculus
acctgcatctttggaatgcacaagc

SEQ ID NO: 179339 - DNA, 25 bp, Mus musculus
acctgcatgatatagataccaagtg

SEQ ID NO: 179340 - DNA, 25 bp, Mus musculus
acctgcatgatataggacagaaatt

SEQ ID NO: 179341 - DNA, 25 bp, Mus musculus
acctgcatgctgaccctgttggcct

SEQ ID NO: 179342 - DNA, 25 bp, Mus musculus
acctgcatgctggctcttcatagcc

SEQ ID NO: 179343 - DNA, 25 bp, Mus musculus
acctgccaaaagttgtggagctcct

SEQ ID NO: 179344 - DNA, 25 bp, Mus musculus
acctgccaagactgtggccgcagga

SEQ ID NO: 179345 - DNA, 25 bp, Mus musculus
acctgccaagcatgatgtcaaagtc

SEQ ID NO: 179346 - DNA, 25 bp, Mus musculus
acctgccaagcattgtggcagatgt

SEQ ID NO: 179347 - DNA, 25 bp, Mus musculus
acctgccaagcatttccctccaggc

SEQ ID NO: 179348 - DNA, 25 bp, Mus musculus
acctgccaatcccatctctcccgca

SEQ ID NO: 179349 - DNA, 25 bp, Mus musculus
acctgccacctgcgagcccactcgg

SEQ ID NO: 179350 - DNA, 25 bp, Mus musculus
acctgccacgctccagtggcttctg

SEQ ID NO: 179351 - DNA, 25 bp, Mus musculus
acctgccactcacgcgagttccagt

SEQ ID NO: 179352 - DNA, 25 bp, Mus musculus
acctgccactggtgcggaagattgc

SEQ ID NO: 179353 - DNA, 25 bp, Mus musculus
acctgccactggtgtagatacaggc

SEQ ID NO: 179354 - DNA, 25 bp, Mus musculus
acctgccagacgcacagccgagcct

SEQ ID NO: 179355 - DNA, 25 bp, Mus musculus
acctgccatgggaaggagatgcgtg

SEQ ID NO: 179356 - DNA, 25 bp, Mus musculus
acctgccatgggagctggactgtgc

SEQ ID NO: 179357 - DNA, 25 bp, Mus musculus
acctgcccaaacgtgtgcccaatta

SEQ ID NO: 179358 - DNA, 25 bp, Mus musculus
acctgcccaaggagctggagggtgg

SEQ ID NO: 179359 - DNA, 25 bp, Mus musculus
acctgccccaaagacattctgccca

SEQ ID NO: 179360 - DNA, 25 bp, Mus musculus
acctgcccccaagaggacgagtctt

SEQ ID NO: 179361 - DNA, 25 bp, Mus musculus
acctgcccccaaggtggtgttcgta

SEQ ID NO: 179362 - DNA, 25 bp, Mus musculus
acctgcccccagaggctgaagatgg

SEQ ID NO: 179363 - DNA, 25 bp, Mus musculus
acctgcccccagagggagaagggga

SEQ ID NO: 179364 - DNA, 25 bp, Mus musculus
acctgcccgcaggagcgcagcaatc

SEQ ID NO: 179365 - DNA, 25 bp, Mus musculus
acctgccggcggggtctcctgtgag

SEQ ID NO: 179366 - DNA, 25 bp, Mus musculus
acctgccgggcagcgagtcatcctc

SEQ ID NO: 179367 - DNA, 25 bp, Mus musculus
acctgcctaagaatggctcttaccg

SEQ ID NO: 179368 - DNA, 25 bp, Mus musculus
acctgcctaagaatgggatgcctgg

SEQ ID NO: 179369 - DNA, 25 bp, Mus musculus
acctgcctatgcaacccccagtccc

SEQ ID NO: 179370 - DNA, 25 bp, Mus musculus
acctgcctatgcaagactcatttca

SEQ ID NO: 179371 - DNA, 25 bp, Mus musculus
acctgcctcctcagaagactcagaa

SEQ ID NO: 179372 - DNA, 25 bp, Mus musculus
acctgcctccttcagatgacggatt

SEQ ID NO: 179373 - DNA, 25 bp, Mus musculus
acctgcctcgggtgagccctagatt

SEQ ID NO: 179374 - DNA, 25 bp, Mus musculus
acctgcctctgagtgctgcacccac

SEQ ID NO: 179375 - DNA, 25 bp, Mus musculus
acctgcctgccgagcaatgccaagt

SEQ ID NO: 179376 - DNA, 25 bp, Mus musculus
acctgcctggaaagccaacaggtgt

SEQ ID NO: 179377 - DNA, 25 bp, Mus musculus
acctgcctggagaatagctcctgta

SEQ ID NO: 179378 - DNA, 25 bp, Mus musculus
acctgcctgggtctgggatctggag

SEQ ID NO: 179379 - DNA, 25 bp, Mus musculus
acctgcctgttacaggtctgcagca

SEQ ID NO: 179380 - DNA, 25 bp, Mus musculus
acctgccttccagtgtgtggacagc

SEQ ID NO: 179381 - DNA, 25 bp, Mus musculus
acctgccttccagtgtgtggtgtcc

SEQ ID NO: 179382 - DNA, 25 bp, Mus musculus
acctgcgacccagccattcattgag

SEQ ID NO: 179383 - DNA, 25 bp, Mus musculus
acctgcgacccaggtgcctggctgc

SEQ ID NO: 179384 - DNA, 25 bp, Mus musculus
acctgcgaccgtggctcctaatgta

SEQ ID NO: 179385 - DNA, 25 bp, Mus musculus
acctgcgagcaagggtctctgatat

SEQ ID NO: 179386 - DNA, 25 bp, Mus musculus
acctgcgagcaaggtccttccatag

SEQ ID NO: 179387 - DNA, 25 bp, Mus musculus
acctgcgagctccagcaagaaaaat

SEQ ID NO: 179388 - DNA, 25 bp, Mus musculus
acctgcgccagcacgcagggattgg

SEQ ID NO: 179389 - DNA, 25 bp, Mus musculus
acctgcgccaggtgaccatctcggt

SEQ ID NO: 179390 - DNA, 25 bp, Mus musculus
acctgcgccgagagatcccgatgtg

SEQ ID NO: 179391 - DNA, 25 bp, Mus musculus
acctgcgcgacaggttttggctcgt

SEQ ID NO: 179392 - DNA, 25 bp, Mus musculus
acctgcggacagacaactgaggata

SEQ ID NO: 179393 - DNA, 25 bp, Mus musculus
acctgcggacagtctcctgccctga

SEQ ID NO: 179394 - DNA, 25 bp, Mus musculus
acctgcgtgcatcagagtcttcaag

SEQ ID NO: 179395 - DNA, 25 bp, Mus musculus
acctgcgtggagctcaggcctgcat

SEQ ID NO: 179396 - DNA, 25 bp, Mus musculus
acctgcgtggagtgttcagccaagc

SEQ ID NO: 179397 - DNA, 25 bp, Mus musculus
acctgctaccccggcaaagctgttg

SEQ ID NO: 179398 - DNA, 25 bp, Mus musculus
acctgctcagcagaatcgggttgag

SEQ ID NO: 179399 - DNA, 25 bp, Mus musculus
acctgctccagcggggactctggcg

SEQ ID NO: 179400 - DNA, 25 bp, Mus musculus
acctgctctatgtgctgatggagct

SEQ ID NO: 179401 - DNA, 25 bp, Mus musculus
acctgctgaagattcagatattaaa

SEQ ID NO: 179402 - DNA, 25 bp, Mus musculus
acctgctgaagggagcatttccagc

SEQ ID NO: 179403 - DNA, 25 bp, Mus musculus
acctgctgcagaatcaagctataga

SEQ ID NO: 179404 - DNA, 25 bp, Mus musculus
acctgctgcagcttcgctcttgtgg

SEQ ID NO: 179405 - DNA, 25 bp, Mus musculus
acctgctgcccctctcctgggaagg

SEQ ID NO: 179406 - DNA, 25 bp, Mus musculus
acctgctgcggaagaacgcagaggt

SEQ ID NO: 179407 - DNA, 25 bp, Mus musculus
acctgctgctagcccgggccccata

SEQ ID NO: 179408 - DNA, 25 bp, Mus musculus
acctgctgctagccctgctcttgga

SEQ ID NO: 179409 - DNA, 25 bp, Mus musculus
acctgctgctccaggaaattgccaa

SEQ ID NO: 179410 - DNA, 25 bp, Mus musculus
acctgctggaaggagcagcggtcag

SEQ ID NO: 179411 - DNA, 25 bp, Mus musculus
acctgctggaaggtgtgaccccaca

SEQ ID NO: 179412 - DNA, 25 bp, Mus musculus
acctgctggcaggtcgcttctccga

SEQ ID NO: 179413 - DNA, 25 bp, Mus musculus
acctgctgggcttgtgtcttccaaa

SEQ ID NO: 179414 - DNA, 25 bp, Mus musculus
acctgctgtataccctggtcagcct

SEQ ID NO: 179415 - DNA, 25 bp, Mus musculus
acctgctgtataccggtcagctgct

SEQ ID NO: 179416 - DNA, 25 bp, Mus musculus
acctgctgtcctgaggattcggccc

SEQ ID NO: 179417 - DNA, 25 bp, Mus musculus
acctgctgttctggctagccggatc

SEQ ID NO: 179418 - DNA, 25 bp, Mus musculus
acctgcttaccggtatgacccatat

SEQ ID NO: 179419 - DNA, 25 bp, Mus musculus
acctgcttgcagacctgatgcaaca

SEQ ID NO: 179420 - DNA, 25 bp, Mus musculus
acctgcttgcaggcgatcctaaaga

SEQ ID NO: 179421 - DNA, 25 bp, Mus musculus
acctgcttgcaggtggctttgctga

SEQ ID NO: 179422 - DNA, 25 bp, Mus musculus
acctgcttggagtacaaggttctgc

SEQ ID NO: 179423 - DNA, 25 bp, Mus musculus
acctgcttgtgatatatgttgggta

SEQ ID NO: 179424 - DNA, 25 bp, Mus musculus
acctgcttttgaggagttccactcc

SEQ ID NO: 179425 - DNA, 25 bp, Mus musculus
acctggaaaaattaaccacatgaga

SEQ ID NO: 179426 - DNA, 25 bp, Mus musculus
acctggaaaccaacctgaccttcct

SEQ ID NO: 179427 - DNA, 25 bp, Mus musculus
acctggaaaccactaagaaacttca

SEQ ID NO: 179428 - DNA, 25 bp, Mus musculus
acctggaaagagctgttattagacg

SEQ ID NO: 179429 - DNA, 25 bp, Mus musculus
acctggaaaggtggtggtggcaggc

SEQ ID NO: 179430 - DNA, 25 bp, Mus musculus
acctggaaagtgtctttgccatgaa

SEQ ID NO: 179431 - DNA, 25 bp, Mus musculus
acctggaaagttaggaagaagagct

SEQ ID NO: 179432 - DNA, 25 bp, Mus musculus
acctggaacaacccgcaatactgga

SEQ ID NO: 179433 - DNA, 25 bp, Mus musculus
acctggaaccaggcacggctggagc

SEQ ID NO: 179434 - DNA, 25 bp, Mus musculus
acctggaacctgatgaagagctgga

SEQ ID NO: 179435 - DNA, 25 bp, Mus musculus
acctggaactgctggcctctggagt

SEQ ID NO: 179436 - DNA, 25 bp, Mus musculus
acctggaagaaggtcaagcactctc

SEQ ID NO: 179437 - DNA, 25 bp, Mus musculus
acctggaagaagtgcatgctttctc

SEQ ID NO: 179438 - DNA, 25 bp, Mus musculus
acctggaagacaaggggctgcactg

SEQ ID NO: 179439 - DNA, 25 bp, Mus musculus
acctggaagacaagtgcctggagct

SEQ ID NO: 179440 - DNA, 25 bp, Mus musculus
acctggaagacaagttgctgtctca

SEQ ID NO: 179441 - DNA, 25 bp, Mus musculus
acctggaagacctggataactggac

SEQ ID NO: 179442 - DNA, 25 bp, Mus musculus
acctggaagcccagaagaaactgtg

SEQ ID NO: 179443 - DNA, 25 bp, Mus musculus
acctggaagctatttaacattgagg

SEQ ID NO: 179444 - DNA, 25 bp, Mus musculus
acctggaaggcagccagagtaacag

SEQ ID NO: 179445 - DNA, 25 bp, Mus musculus
acctggacaagatcatagaactcaa

SEQ ID NO: 179446 - DNA, 25 bp, Mus musculus
acctggacaagcctccattaacctg

SEQ ID NO: 179447 - DNA, 25 bp, Mus musculus
acctggacaagcctggacaaactac

SEQ ID NO: 179448 - DNA, 25 bp, Mus musculus
acctggacaagctgatgccttcaca

SEQ ID NO: 179449 - DNA, 25 bp, Mus musculus
acctggacaggacaatgtatcttct

SEQ ID NO: 179450 - DNA, 25 bp, Mus musculus
acctggacaggtcggaagctggtct

SEQ ID NO: 179451 - DNA, 25 bp, Mus musculus
acctggacatcacgggttatatatt

SEQ ID NO: 179452 - DNA, 25 bp, Mus musculus
acctggacattcggatttccatttc

SEQ ID NO: 179453 - DNA, 25 bp, Mus musculus
acctggacattcggtcacagtctct

SEQ ID NO: 179454 - DNA, 25 bp, Mus musculus
acctggaccaaagggtgctcaggga

SEQ ID NO: 179455 - DNA, 25 bp, Mus musculus
acctggaccaatgggtcctcttggg

SEQ ID NO: 179456 - DNA, 25 bp, Mus musculus
acctggaccagaggagccccaggat

SEQ ID NO: 179457 - DNA, 25 bp, Mus musculus
acctggaccagatggcttcctgttt

SEQ ID NO: 179458 - DNA, 25 bp, Mus musculus
acctggaccagcaacagtatcaaag

SEQ ID NO: 179459 - DNA, 25 bp, Mus musculus
acctggacctaaagcctgagaatat

SEQ ID NO: 179460 - DNA, 25 bp, Mus musculus
acctggacctagaggcctttatcca

SEQ ID NO: 179461 - DNA, 25 bp, Mus musculus
acctggacgagagggcagccctggt

SEQ ID NO: 179462 - DNA, 25 bp, Mus musculus
acctggacgcacaggcctcctgtgc

SEQ ID NO: 179463 - DNA, 25 bp, Mus musculus
acctggacgctcagccttcaaacag

SEQ ID NO: 179464 - DNA, 25 bp, Mus musculus
acctggacgctcaggacccaccaga

SEQ ID NO: 179465 - DNA, 25 bp, Mus musculus
acctggactgggaggtaggggtcca

SEQ ID NO: 179466 - DNA, 25 bp, Mus musculus
acctggacttaactgtgccaccacc

SEQ ID NO: 179467 - DNA, 25 bp, Mus musculus
acctggagaaaaacagtaccaagga

SEQ ID NO: 179468 - DNA, 25 bp, Mus musculus
acctggagaaaaaggggaccatggc

SEQ ID NO: 179469 - DNA, 25 bp, Mus musculus
acctggagaagacctgtgccgtgtg

SEQ ID NO: 179470 - DNA, 25 bp, Mus musculus
acctggagaagctgacctctctctc

SEQ ID NO: 179471 - DNA, 25 bp, Mus musculus
acctggagacaagctacgcatggag

SEQ ID NO: 179472 - DNA, 25 bp, Mus musculus
acctggagacaatacgcatggagta

SEQ ID NO: 179473 - DNA, 25 bp, Mus musculus
acctggagacgagagctggcattcc

SEQ ID NO: 179474 - DNA, 25 bp, Mus musculus
acctggagagagttcaccttttcca

SEQ ID NO: 179475 - DNA, 25 bp, Mus musculus
acctggagagcatcttcctggtcat

SEQ ID NO: 179476 - DNA, 25 bp, Mus musculus
acctggagatctgcctgtcaatgag

SEQ ID NO: 179477 - DNA, 25 bp, Mus musculus
acctggagatgttccgagaacaagt

SEQ ID NO: 179478 - DNA, 25 bp, Mus musculus
acctggagcatcagctgctgacctg

SEQ ID NO: 179479 - DNA, 25 bp, Mus musculus
acctggagcatcagctgtggtcctc

SEQ ID NO: 179480 - DNA, 25 bp, Mus musculus
acctggagcgtgtatcgacagtgag

SEQ ID NO: 179481 - DNA, 25 bp, Mus musculus
acctggagctgatggaacacccatt

SEQ ID NO: 179482 - DNA, 25 bp, Mus musculus
acctggagtcatcaggggtttcctg

SEQ ID NO: 179483 - DNA, 25 bp, Mus musculus
acctggagttgcagtcctatcttca

SEQ ID NO: 179484 - DNA, 25 bp, Mus musculus
acctggagtttctagcctcaaagcg

SEQ ID NO: 179485 - DNA, 25 bp, Mus musculus
acctggataaagccgatcacgcgtc

SEQ ID NO: 179486 - DNA, 25 bp, Mus musculus
acctggatagcatgtacatcatgtt

SEQ ID NO: 179487 - DNA, 25 bp, Mus musculus
acctggatcccaagacagaccctgt

SEQ ID NO: 179488 - DNA, 25 bp, Mus musculus
acctggatgaaagtgaggcagcagc

SEQ ID NO: 179489 - DNA, 25 bp, Mus musculus
acctggatgacgagttgatagacac

SEQ ID NO: 179490 - DNA, 25 bp, Mus musculus
acctggatgacgttaatgaaatcat

SEQ ID NO: 179491 - DNA, 25 bp, Mus musculus
acctggatgaggagaaacttgaaca

SEQ ID NO: 179492 - DNA, 25 bp, Mus musculus
acctggatgaggagaactttgtgaa

SEQ ID NO: 179493 - DNA, 25 bp, Mus musculus
acctggatgcctatgctgaacaccc

SEQ ID NO: 179494 - DNA, 25 bp, Mus musculus
acctggatgctagaggtctgtgagg

SEQ ID NO: 179495 - DNA, 25 bp, Mus musculus
acctggatggatgctgcaagcagac

SEQ ID NO: 179496 - DNA, 25 bp, Mus musculus
acctggatggggttcatgttgtttt

SEQ ID NO: 179497 - DNA, 25 bp, Mus musculus
acctggattcagaagaataccacaa

SEQ ID NO: 179498 - DNA, 25 bp, Mus musculus
acctggattcagtggcgccgacatc

SEQ ID NO: 179499 - DNA, 25 bp, Mus musculus
acctggattcagtgggcagagccag

SEQ ID NO: 179500 - DNA, 25 bp, Mus musculus
acctggatttaagattgagattttt

SEQ ID NO: 179501 - DNA, 25 bp, Mus musculus
acctggcaagagaaatgtctcaggc

SEQ ID NO: 179502 - DNA, 25 bp, Mus musculus
acctggcaagcttcacatggagtga

SEQ ID NO: 179503 - DNA, 25 bp, Mus musculus
acctggcacagtcaggttttcagct

SEQ ID NO: 179504 - DNA, 25 bp, Mus musculus
acctggcacattcctcttcagatgc

SEQ ID NO: 179505 - DNA, 25 bp, Mus musculus
acctggcaccagaggtattagaaga

SEQ ID NO: 179506 - DNA, 25 bp, Mus musculus
acctggcagaaagggctgaggccac

SEQ ID NO: 179507 - DNA, 25 bp, Mus musculus
acctggcagagatggacatgctagt

SEQ ID NO: 179508 - DNA, 25 bp, Mus musculus
acctggcagagccgctgatggactc

SEQ ID NO: 179509 - DNA, 25 bp, Mus musculus
acctggcagaggaaaactccaggga

SEQ ID NO: 179510 - DNA, 25 bp, Mus musculus
acctggcagaggtgatatgtaaagt

SEQ ID NO: 179511 - DNA, 25 bp, Mus musculus
acctggcagccagatgaggatgatg

SEQ ID NO: 179512 - DNA, 25 bp, Mus musculus
acctggcaggatgggagcctcctgc

SEQ ID NO: 179513 - DNA, 25 bp, Mus musculus
acctggcaggatgggccaccgctga

SEQ ID NO: 179514 - DNA, 25 bp, Mus musculus
acctggcataaggccactcagaagg

SEQ ID NO: 179515 - DNA, 25 bp, Mus musculus
acctggccaaagggtcattatcgtt

SEQ ID NO: 179516 - DNA, 25 bp, Mus musculus
acctggccaaaggtcagcctccaag

SEQ ID NO: 179517 - DNA, 25 bp, Mus musculus
acctggccaaaggtcggacatcaaa

SEQ ID NO: 179518 - DNA, 25 bp, Mus musculus
acctggccaagcctaccaggtacca

SEQ ID NO: 179519 - DNA, 25 bp, Mus musculus
acctggccaaggtaccacggttcgt

SEQ ID NO: 179520 - DNA, 25 bp, Mus musculus
acctggccaggagtgaattggagga

SEQ ID NO: 179521 - DNA, 25 bp, Mus musculus
acctggccagtaaaagctggcaggc

SEQ ID NO: 179522 - DNA, 25 bp, Mus musculus
acctggccagtatattattctccat

SEQ ID NO: 179523 - DNA, 25 bp, Mus musculus
acctggccccgtgggagcccttgga

SEQ ID NO: 179524 - DNA, 25 bp, Mus musculus
acctggccctggcaggtctccctgc

SEQ ID NO: 179525 - DNA, 25 bp, Mus musculus
acctggccgaagcatgacccgccgg

SEQ ID NO: 179526 - DNA, 25 bp, Mus musculus
acctggcgctcgagcacgggtcgtg

SEQ ID NO: 179527 - DNA, 25 bp, Mus musculus
acctggcggacaggctgggccgtcg

SEQ ID NO: 179528 - DNA, 25 bp, Mus musculus
acctggcgggcgaaggggaactgat

SEQ ID NO: 179529 - DNA, 25 bp, Mus musculus
acctggctacaaggctgagggaaaa

SEQ ID NO: 179530 - DNA, 25 bp, Mus musculus
acctggctacaagggatgggcataa

SEQ ID NO: 179531 - DNA, 25 bp, Mus musculus
acctggctattgacaagaaggcttg

SEQ ID NO: 179532 - DNA, 25 bp, Mus musculus
acctggctattgactccacggctga

SEQ ID NO: 179533 - DNA, 25 bp, Mus musculus
acctggctccagtctgttctcctgg

SEQ ID NO: 179534 - DNA, 25 bp, Mus musculus
acctggctccattccatgaggcgcc

SEQ ID NO: 179535 - DNA, 25 bp, Mus musculus
acctggctgagcagcaaaggtgaat

SEQ ID NO: 179536 - DNA, 25 bp, Mus musculus
acctggctgaggacctcctttctta

SEQ ID NO: 179537 - DNA, 25 bp, Mus musculus
acctggctgaggacctcggatgggt

SEQ ID NO: 179538 - DNA, 25 bp, Mus musculus
acctggctgagttcactcacgtgga

SEQ ID NO: 179539 - DNA, 25 bp, Mus musculus
acctggctgtgggtggtgagaagct

SEQ ID NO: 179540 - DNA, 25 bp, Mus musculus
acctggctgttgctcgtcttgggga

SEQ ID NO: 179541 - DNA, 25 bp, Mus musculus
acctggctttgtctgttgctgtgga

SEQ ID NO: 179542 - DNA, 25 bp, Mus musculus
acctgggactgaagactcggatgac

SEQ ID NO: 179543 - DNA, 25 bp, Mus musculus
acctgggagaacagatacaaaggat

SEQ ID NO: 179544 - DNA, 25 bp, Mus musculus
acctgggagccatcgagggaatggg

SEQ ID NO: 179545 - DNA, 25 bp, Mus musculus
acctgggatagaagggcttcttggt

SEQ ID NO: 179546 - DNA, 25 bp, Mus musculus
acctgggatttgtcgccagagagac

SEQ ID NO: 179547 - DNA, 25 bp, Mus musculus
acctgggcaaggagatccacgattt

SEQ ID NO: 179548 - DNA, 25 bp, Mus musculus
acctgggcacagcattgatctggtg

SEQ ID NO: 179549 - DNA, 25 bp, Mus musculus
acctgggcaggagctcggggagaca

SEQ ID NO: 179550 - DNA, 25 bp, Mus musculus
acctgggccagaaggtccggctggt

SEQ ID NO: 179551 - DNA, 25 bp, Mus musculus
acctgggcccccgtcacagtttgca

SEQ ID NO: 179552 - DNA, 25 bp, Mus musculus
acctgggctctgtgggggcagctgg

SEQ ID NO: 179553 - DNA, 25 bp, Mus musculus
acctgggctgaagctaggcggccgt

SEQ ID NO: 179554 - DNA, 25 bp, Mus musculus
acctgggctgaaggagacagaggaa

SEQ ID NO: 179555 - DNA, 25 bp, Mus musculus
acctgggctgaaggggagcttctgg

SEQ ID NO: 179556 - DNA, 25 bp, Mus musculus
acctgggctttgctgggacccatgt

SEQ ID NO: 179557 - DNA, 25 bp, Mus musculus
acctggggacagaattgccctagaa

SEQ ID NO: 179558 - DNA, 25 bp, Mus musculus
acctggggcagggaagaggtgccag

SEQ ID NO: 179559 - DNA, 25 bp, Mus musculus
acctgggggacctcagaaggtctat

SEQ ID NO: 179560 - DNA, 25 bp, Mus musculus
acctgggggacgctgcaagtgtgga

SEQ ID NO: 179561 - DNA, 25 bp, Mus musculus
acctgggggacgctgggatttgaac

SEQ ID NO: 179562 - DNA, 25 bp, Mus musculus
acctgggggcagccgaggaagtgga

SEQ ID NO: 179563 - DNA, 25 bp, Mus musculus
acctgggtcagaacatctttgcctg

SEQ ID NO: 179564 - DNA, 25 bp, Mus musculus
acctggtaaagtggttcatcggaac

SEQ ID NO: 179565 - DNA, 25 bp, Mus musculus
acctggtacatggtggtcaacctgt

SEQ ID NO: 179566 - DNA, 25 bp, Mus musculus
acctggtaggaaagagaaaatccct

SEQ ID NO: 179567 - DNA, 25 bp, Mus musculus
acctggtaggaaaggtccagcaaga

SEQ ID NO: 179568 - DNA, 25 bp, Mus musculus
acctggtatctggttggcagatatt

SEQ ID NO: 179569 - DNA, 25 bp, Mus musculus
acctggtcagtcttacttctcgctt

SEQ ID NO: 179570 - DNA, 25 bp, Mus musculus
acctggtcagtgagcctggaggcct

SEQ ID NO: 179571 - DNA, 25 bp, Mus musculus
acctggtccaggataaataggattt

SEQ ID NO: 179572 - DNA, 25 bp, Mus musculus
acctggtcgaagctgggttgaaaac

SEQ ID NO: 179573 - DNA, 25 bp, Mus musculus
acctggtctacaaagtggatcccac

SEQ ID NO: 179574 - DNA, 25 bp, Mus musculus
acctggtctcgctctggcttcccat

SEQ ID NO: 179575 - DNA, 25 bp, Mus musculus
acctggtctctgtggagaactactg

SEQ ID NO: 179576 - DNA, 25 bp, Mus musculus
acctggtgacccacaaccgcactta

SEQ ID NO: 179577 - DNA, 25 bp, Mus musculus
acctggtgacgacggtgaagctggg

SEQ ID NO: 179578 - DNA, 25 bp, Mus musculus
acctggtgctaagggtgaagctggc

SEQ ID NO: 179579 - DNA, 25 bp, Mus musculus
acctggtgctagcaggttttatgac

SEQ ID NO: 179580 - DNA, 25 bp, Mus musculus
acctggtggccaattggagcatctc

SEQ ID NO: 179581 - DNA, 25 bp, Mus musculus
acctggtggccacaggctcccataa

SEQ ID NO: 179582 - DNA, 25 bp, Mus musculus
acctggtggccacaggttggtttta

SEQ ID NO: 179583 - DNA, 25 bp, Mus musculus
acctggtggccagcaaccttcctgc

SEQ ID NO: 179584 - DNA, 25 bp, Mus musculus
acctggtgggcaccccaggtgaaag

SEQ ID NO: 179585 - DNA, 25 bp, Mus musculus
acctggtgtcgctcgagttcctgag

SEQ ID NO: 179586 - DNA, 25 bp, Mus musculus
acctggtgtcgctcgggtatcaagt

SEQ ID NO: 179587 - DNA, 25 bp, Mus musculus
acctggtttagattctcaaaccatg

SEQ ID NO: 179588 - DNA, 25 bp, Mus musculus
acctggtttcaggccttcccctgaa

SEQ ID NO: 179589 - DNA, 25 bp, Mus musculus
acctggtttcagggcagcccctgga

SEQ ID NO: 179590 - DNA, 25 bp, Mus musculus
acctgtaaagctcggatgcccaact

SEQ ID NO: 179591 - DNA, 25 bp, Mus musculus
acctgtaaagttgcttttagacacg

SEQ ID NO: 179592 - DNA, 25 bp, Mus musculus
acctgtaagtgctgtgacccaatta

SEQ ID NO: 179593 - DNA, 25 bp, Mus musculus
acctgtaagttcacttgttcaaagc

SEQ ID NO: 179594 - DNA, 25 bp, Mus musculus
acctgtacagggctggtacttctac

SEQ ID NO: 179595 - DNA, 25 bp, Mus musculus
acctgtacagttttgtggcggctgg

SEQ ID NO: 179596 - DNA, 25 bp, Mus musculus
acctgtactgccaaggtcaaggctg

SEQ ID NO: 179597 - DNA, 25 bp, Mus musculus
acctgtacttggagaggctccggct

SEQ ID NO: 179598 - DNA, 25 bp, Mus musculus
acctgtagagaacctccatgtactc

SEQ ID NO: 179599 - DNA, 25 bp, Mus musculus
acctgtagcaccactctcgctcaca

SEQ ID NO: 179600 - DNA, 25 bp, Mus musculus
acctgtagcacccctctactcaata

SEQ ID NO: 179601 - DNA, 25 bp, Mus musculus
acctgtatacaggccgcttggacat

SEQ ID NO: 179602 - DNA, 25 bp, Mus musculus
acctgtatagaagtgggaagatgcc

SEQ ID NO: 179603 - DNA, 25 bp, Mus musculus
acctgtatcagacacctctgcactt

SEQ ID NO: 179604 - DNA, 25 bp, Mus musculus
acctgtcaaaccagggttctctaaa

SEQ ID NO: 179605 - DNA, 25 bp, Mus musculus
acctgtcaaaccaggttaaggagct

SEQ ID NO: 179606 - DNA, 25 bp, Mus musculus
acctgtcaatggactatctcatcgg

SEQ ID NO: 179607 - DNA, 25 bp, Mus musculus
acctgtcaatggtacggatgaaatc

SEQ ID NO: 179608 - DNA, 25 bp, Mus musculus
acctgtcacccagactaagaaactt

SEQ ID NO: 179609 - DNA, 25 bp, Mus musculus
acctgtcagaggaggatacgggaag

SEQ ID NO: 179610 - DNA, 25 bp, Mus musculus
acctgtcaggaccaccaatgaatgc

SEQ ID NO: 179611 - DNA, 25 bp, Mus musculus
acctgtcaggagaacagccagtcct

SEQ ID NO: 179612 - DNA, 25 bp, Mus musculus
acctgtcaggagatcttcctgtggc

SEQ ID NO: 179613 - DNA, 25 bp, Mus musculus
acctgtcaggatataaatgaatgtg

SEQ ID NO: 179614 - DNA, 25 bp, Mus musculus
acctgtcatcagatgacctcatccc

SEQ ID NO: 179615 - DNA, 25 bp, Mus musculus
acctgtccaggcgtttcttttgaag

SEQ ID NO: 179616 - DNA, 25 bp, Mus musculus
acctgtccatcaaagccctgtgccc

SEQ ID NO: 179617 - DNA, 25 bp, Mus musculus
acctgtccatcaaagggtcgtcttc

SEQ ID NO: 179618 - DNA, 25 bp, Mus musculus
acctgtcccacaggcggaatgtgcc

SEQ ID NO: 179619 - DNA, 25 bp, Mus musculus
acctgtccgggcagccaaggagatc

SEQ ID NO: 179620 - DNA, 25 bp, Mus musculus
acctgtcctgaggttgctacaggca

SEQ ID NO: 179621 - DNA, 25 bp, Mus musculus
acctgtcgcccatattttaatatcc

SEQ ID NO: 179622 - DNA, 25 bp, Mus musculus
acctgtcgcccctgagtgcaatatc

SEQ ID NO: 179623 - DNA, 25 bp, Mus musculus
acctgtctgcttggagccctgcact

SEQ ID NO: 179624 - DNA, 25 bp, Mus musculus
acctgtcttaagaccttcacagcct

SEQ ID NO: 179625 - DNA, 25 bp, Mus musculus
acctgtcttcaaggtgccgccatgc

SEQ ID NO: 179626 - DNA, 25 bp, Mus musculus
acctgtcttgtaaccctgagataac

SEQ ID NO: 179627 - DNA, 25 bp, Mus musculus
acctgtgaaaagagtggacaagatt

SEQ ID NO: 179628 - DNA, 25 bp, Mus musculus
acctgtgaaaagatcatctgttctc

SEQ ID NO: 179629 - DNA, 25 bp, Mus musculus
acctgtgaaaatggctctggagatc

SEQ ID NO: 179630 - DNA, 25 bp, Mus musculus
acctgtgagcaggagccagaggaag

SEQ ID NO: 179631 - DNA, 25 bp, Mus musculus
acctgtgatgataagaacaaattgg

SEQ ID NO: 179632 - DNA, 25 bp, Mus musculus
acctgtgatgtctcacaccattttg

SEQ ID NO: 179633 - DNA, 25 bp, Mus musculus
acctgtgccactaccccacagcggc

SEQ ID NO: 179634 - DNA, 25 bp, Mus musculus
acctgtgcctcagggtgacagaact

SEQ ID NO: 179635 - DNA, 25 bp, Mus musculus
acctgtgcctcagggttgcagtaat

SEQ ID NO: 179636 - DNA, 25 bp, Mus musculus
acctgtgcctcaggttgccctctgt

SEQ ID NO: 179637 - DNA, 25 bp, Mus musculus
acctgtgcctggaggaccagctctc

SEQ ID NO: 179638 - DNA, 25 bp, Mus musculus
acctgtgctcaagttactgggcctg

SEQ ID NO: 179639 - DNA, 25 bp, Mus musculus
acctgtgctcaggtcgcaggcatcc

SEQ ID NO: 179640 - DNA, 25 bp, Mus musculus
acctgtggcaaaagactgctggagt

SEQ ID NO: 179641 - DNA, 25 bp, Mus musculus
acctgtggcaaaagccctggaagag

SEQ ID NO: 179642 - DNA, 25 bp, Mus musculus
acctgtggctaagactctagccttg

SEQ ID NO: 179643 - DNA, 25 bp, Mus musculus
acctgtggctaagctaccgatttat

SEQ ID NO: 179644 - DNA, 25 bp, Mus musculus
acctgtggctggaggggagtggggc

SEQ ID NO: 179645 - DNA, 25 bp, Mus musculus
acctgtgggggcctgcatggcctga

SEQ ID NO: 179646 - DNA, 25 bp, Mus musculus
acctgtgtctaaggaaacagcaaga

SEQ ID NO: 179647 - DNA, 25 bp, Mus musculus
acctgtgtctaagtgtctgtgcttg

SEQ ID NO: 179648 - DNA, 25 bp, Mus musculus
acctgtgtctgccagaatggggagg

SEQ ID NO: 179649 - DNA, 25 bp, Mus musculus
acctgtgtggacgagagagactcgg

SEQ ID NO: 179650 - DNA, 25 bp, Mus musculus
acctgtgtggagtgttcagcaaaaa

SEQ ID NO: 179651 - DNA, 25 bp, Mus musculus
acctgtgtgtagccccatgtggaac

SEQ ID NO: 179652 - DNA, 25 bp, Mus musculus
acctgtgttctgatatagatgagtg

SEQ ID NO: 179653 - DNA, 25 bp, Mus musculus
acctgttacctgggcccccagattg

SEQ ID NO: 179654 - DNA, 25 bp, Mus musculus
acctgttacgcttgtacttcatcct

SEQ ID NO: 179655 - DNA, 25 bp, Mus musculus
acctgttaggaaagaatcttcaaga

SEQ ID NO: 179656 - DNA, 25 bp, Mus musculus
acctgttattgaaggacctctcttg

SEQ ID NO: 179657 - DNA, 25 bp, Mus musculus
acctgttcagtagacagtataacaa

SEQ ID NO: 179658 - DNA, 25 bp, Mus musculus
acctgttcttcagaaacaacatgcc

SEQ ID NO: 179659 - DNA, 25 bp, Mus musculus
acctgttcttcagaaacagacatct

SEQ ID NO: 179660 - DNA, 25 bp, Mus musculus
acctgttgagcgaagaacaaattac

SEQ ID NO: 179661 - DNA, 25 bp, Mus musculus
acctgttgagcgaagacccttacca

SEQ ID NO: 179662 - DNA, 25 bp, Mus musculus
acctgttgcaagagggtgaagaagc

SEQ ID NO: 179663 - DNA, 25 bp, Mus musculus
acctgttgcaggcatgatgggtggc

SEQ ID NO: 179664 - DNA, 25 bp, Mus musculus
acctgttggctaatggagcccgctg

SEQ ID NO: 179665 - DNA, 25 bp, Mus musculus
acctgttgtgcagagttgtcttgga

SEQ ID NO: 179666 - DNA, 25 bp, Mus musculus
acctgttgttctgaggactctcatt

SEQ ID NO: 179667 - DNA, 25 bp, Mus musculus
acctgttgttctggattccacccag

SEQ ID NO: 179668 - DNA, 25 bp, Mus musculus
acctgtttgtaaaagtaaaggagtg

SEQ ID NO: 179669 - DNA, 25 bp, Mus musculus
acctgtttgtaaaattccttctgat

SEQ ID NO: 179670 - DNA, 25 bp, Mus musculus
accttaaaactctgcgaggcagagg

SEQ ID NO: 179671 - DNA, 25 bp, Mus musculus
accttaaaagaatgctgatgctgtt

SEQ ID NO: 179672 - DNA, 25 bp, Mus musculus
accttaaagacgatgaacgtgtcgt

SEQ ID NO: 179673 - DNA, 25 bp, Mus musculus
accttaaagagcatgaaagccaaag

SEQ ID NO: 179674 - DNA, 25 bp, Mus musculus
accttaaagagcatggacggagatt

SEQ ID NO: 179675 - DNA, 25 bp, Mus musculus
accttaacaggtgaagatggttctg

SEQ ID NO: 179676 - DNA, 25 bp, Mus musculus
accttaacctagcttaccatctagc

SEQ ID NO: 179677 - DNA, 25 bp, Mus musculus
accttaacgctgttggtcagaaaac

SEQ ID NO: 179678 - DNA, 25 bp, Mus musculus
accttaagaccagagtagcttatct

SEQ ID NO: 179679 - DNA, 25 bp, Mus musculus
accttaaggatgtggtccttctggc

SEQ ID NO: 179680 - DNA, 25 bp, Mus musculus
accttacacaggtcaccactcaaga

SEQ ID NO: 179681 - DNA, 25 bp, Mus musculus
accttacagatccagggagcatggc

SEQ ID NO: 179682 - DNA, 25 bp, Mus musculus
accttacagttaaggaagctgtgct

SEQ ID NO: 179683 - DNA, 25 bp, Mus musculus
accttacataaactatactatgcag

SEQ ID NO: 179684 - DNA, 25 bp, Mus musculus
accttaccaaggaccgtagcctggc

SEQ ID NO: 179685 - DNA, 25 bp, Mus musculus
accttaccagttttacaggaatcac

SEQ ID NO: 179686 - DNA, 25 bp, Mus musculus
accttactatgaggtctacaccatc

SEQ ID NO: 179687 - DNA, 25 bp, Mus musculus
accttactatggagaaggaagcatt

SEQ ID NO: 179688 - DNA, 25 bp, Mus musculus
accttagaagaaagttggggctgtg

SEQ ID NO: 179689 - DNA, 25 bp, Mus musculus
accttagagcagcaggtatggacaa

SEQ ID NO: 179690 - DNA, 25 bp, Mus musculus
accttagagctggtgtgtctccagg

SEQ ID NO: 179691 - DNA, 25 bp, Mus musculus
accttagatgatgtgaacgagatta

SEQ ID NO: 179692 - DNA, 25 bp, Mus musculus
accttagccagtccaaactgaagat

SEQ ID NO: 179693 - DNA, 25 bp, Mus musculus
accttaggagtgtaaagagctggcc

SEQ ID NO: 179694 - DNA, 25 bp, Mus musculus
accttagtataggtgattgaagcct

SEQ ID NO: 179695 - DNA, 25 bp, Mus musculus
accttagtataggtgtcctcagata

SEQ ID NO: 179696 - DNA, 25 bp, Mus musculus
accttagttcagaatgtgattctgc

SEQ ID NO: 179697 - DNA, 25 bp, Mus musculus
accttagttcagatcctagcccgat

SEQ ID NO: 179698 - DNA, 25 bp, Mus musculus
accttataggagtaaagatgggaaa

SEQ ID NO: 179699 - DNA, 25 bp, Mus musculus
accttatcaagcactggagggcaga

SEQ ID NO: 179700 - DNA, 25 bp, Mus musculus
accttatcaaggctcagaggcacat

SEQ ID NO: 179701 - DNA, 25 bp, Mus musculus
accttatcacgaagaaaaacgtgaa

SEQ ID NO: 179702 - DNA, 25 bp, Mus musculus
accttatcaggtttgcacagacgct

SEQ ID NO: 179703 - DNA, 25 bp, Mus musculus
accttatgaacatggtgaagtattt

SEQ ID NO: 179704 - DNA, 25 bp, Mus musculus
accttattgaaaggatgaagaaaca

SEQ ID NO: 179705 - DNA, 25 bp, Mus musculus
accttattttacagtgaaaatgtgc

SEQ ID NO: 179706 - DNA, 25 bp, Mus musculus
accttcaaaaagtcaaggtgattct

SEQ ID NO: 179707 - DNA, 25 bp, Mus musculus
accttcaaacctggtgcgttcattc

SEQ ID NO: 179708 - DNA, 25 bp, Mus musculus
accttcaactacagccttacctgcc

SEQ ID NO: 179709 - DNA, 25 bp, Mus musculus
accttcaagctggatcttctatcgg

SEQ ID NO: 179710 - DNA, 25 bp, Mus musculus
accttcaagctgggtgcgcatggtg

SEQ ID NO: 179711 - DNA, 25 bp, Mus musculus
accttcaagggatttaaacgagtgt

SEQ ID NO: 179712 - DNA, 25 bp, Mus musculus
accttcaagtacagagatgaactca

SEQ ID NO: 179713 - DNA, 25 bp, Mus musculus
accttcaatcttcctagtgacggct

SEQ ID NO: 179714 - DNA, 25 bp, Mus musculus
accttcaatcttcctagtgagcccc

SEQ ID NO: 179715 - DNA, 25 bp, Mus musculus
accttcacaccctcagaacagcaac

SEQ ID NO: 179716 - DNA, 25 bp, Mus musculus
accttcacagcctcatcattacaga

SEQ ID NO: 179717 - DNA, 25 bp, Mus musculus
accttcaccactaacgactctgaca

SEQ ID NO: 179718 - DNA, 25 bp, Mus musculus
accttcaccactaacgggactcaga

SEQ ID NO: 179719 - DNA, 25 bp, Mus musculus
accttcaccaggactgggaggtaca

SEQ ID NO: 179720 - DNA, 25 bp, Mus musculus
accttcacggtccaagtgtgggact

SEQ ID NO: 179721 - DNA, 25 bp, Mus musculus
accttcacttttggttccacaccct

SEQ ID NO: 179722 - DNA, 25 bp, Mus musculus
accttcagaaggaagacaacatggc

SEQ ID NO: 179723 - DNA, 25 bp, Mus musculus
accttcagagcgagggagcccgaac

SEQ ID NO: 179724 - DNA, 25 bp, Mus musculus
accttcagcactgaggttcaagaat

SEQ ID NO: 179725 - DNA, 25 bp, Mus musculus
accttcagcagagcaggaagatcct

SEQ ID NO: 179726 - DNA, 25 bp, Mus musculus
accttcagctcacgaggcgcatacc

SEQ ID NO: 179727 - DNA, 25 bp, Mus musculus
accttcaggagtacagacagcaccc

SEQ ID NO: 179728 - DNA, 25 bp, Mus musculus
accttcaggtggacacctccctttc

SEQ ID NO: 179729 - DNA, 25 bp, Mus musculus
accttcagtatcctgatcacatttg

SEQ ID NO: 179730 - DNA, 25 bp, Mus musculus
accttcatatctaccgtcgacttaa

SEQ ID NO: 179731 - DNA, 25 bp, Mus musculus
accttcatcgtgaagagcctcccca

SEQ ID NO: 179732 - DNA, 25 bp, Mus musculus
accttcatgaaaggaatacagatgt

SEQ ID NO: 179733 - DNA, 25 bp, Mus musculus
accttcatgaaagttccgacgagat

SEQ ID NO: 179734 - DNA, 25 bp, Mus musculus
accttcatggagaaggtgcaccgtg

SEQ ID NO: 179735 - DNA, 25 bp, Mus musculus
accttcatggagcaggtgcaccgtg

SEQ ID NO: 179736 - DNA, 25 bp, Mus musculus
accttcattgatctggttatccagg

SEQ ID NO: 179737 - DNA, 25 bp, Mus musculus
accttccaacaagacgatccacgca

SEQ ID NO: 179738 - DNA, 25 bp, Mus musculus
accttccacaaagagcgcctggcca

SEQ ID NO: 179739 - DNA, 25 bp, Mus musculus
accttccaggaatcctgctgcatca

SEQ ID NO: 179740 - DNA, 25 bp, Mus musculus
accttccagtacaggaaattaaaat

SEQ ID NO: 179741 - DNA, 25 bp, Mus musculus
accttccagtacaggtcagaggaac

SEQ ID NO: 179742 - DNA, 25 bp, Mus musculus
accttccatcaccagcatccatgtc

SEQ ID NO: 179743 - DNA, 25 bp, Mus musculus
accttccatcaccaggtgcgtgatg

SEQ ID NO: 179744 - DNA, 25 bp, Mus musculus
accttccatcctatatagtctacat

SEQ ID NO: 179745 - DNA, 25 bp, Mus musculus
accttcccaactctgctcctgacat

SEQ ID NO: 179746 - DNA, 25 bp, Mus musculus
accttcccacagcatcgccaaatgc

SEQ ID NO: 179747 - DNA, 25 bp, Mus musculus
accttcccacaggtctgcctctctt

SEQ ID NO: 179748 - DNA, 25 bp, Mus musculus
accttcccaggaaactccatggaat

SEQ ID NO: 179749 - DNA, 25 bp, Mus musculus
accttcccaggcacatctccctaac

SEQ ID NO: 179750 - DNA, 25 bp, Mus musculus
accttccccttgtgctttgatgacc

SEQ ID NO: 179751 - DNA, 25 bp, Mus musculus
accttccccttgtgctttggtctcc

SEQ ID NO: 179752 - DNA, 25 bp, Mus musculus
accttccctgatgcgagagaacaag

SEQ ID NO: 179753 - DNA, 25 bp, Mus musculus
accttccctggcacagcaagcttcc

SEQ ID NO: 179754 - DNA, 25 bp, Mus musculus
accttcccttacatgaagtcgatgg

SEQ ID NO: 179755 - DNA, 25 bp, Mus musculus
accttccgagaactccgtgcaagaa

SEQ ID NO: 179756 - DNA, 25 bp, Mus musculus
accttccgccaaatggactggaact

SEQ ID NO: 179757 - DNA, 25 bp, Mus musculus
accttccgccagtttcgtgatcctg

SEQ ID NO: 179758 - DNA, 25 bp, Mus musculus
accttccggcaggcagttcctccat

SEQ ID NO: 179759 - DNA, 25 bp, Mus musculus
accttccgtgagaagtttatgcagc

SEQ ID NO: 179760 - DNA, 25 bp, Mus musculus
accttcctcagtaatgaccaattct

SEQ ID NO: 179761 - DNA, 25 bp, Mus musculus
accttcctcccctgctacaaaaaat

SEQ ID NO: 179762 - DNA, 25 bp, Mus musculus
accttcctccggcatgagatcgcca

SEQ ID NO: 179763 - DNA, 25 bp, Mus musculus
accttcctcctaaggcgcctgtgtc

SEQ ID NO: 179764 - DNA, 25 bp, Mus musculus
accttcctcctgcaacagaatggga

SEQ ID NO: 179765 - DNA, 25 bp, Mus musculus
accttcctcctggcaggccaaaagc

SEQ ID NO: 179766 - DNA, 25 bp, Mus musculus
accttcctgagtgagctcattgccc

SEQ ID NO: 179767 - DNA, 25 bp, Mus musculus
accttccttggcggcagaacccggg

SEQ ID NO: 179768 - DNA, 25 bp, Mus musculus
accttccttgttcatagggcggcgg

SEQ ID NO: 179769 - DNA, 25 bp, Mus musculus
accttccttgttcatccgaacaaaa

SEQ ID NO: 179770 - DNA, 25 bp, Mus musculus
accttcgaggcgtggtgcaagattt

SEQ ID NO: 179771 - DNA, 25 bp, Mus musculus
accttcgctaggtatatatggtctg

SEQ ID NO: 179772 - DNA, 25 bp, Mus musculus
accttcggccttgtggtaccaatgg

SEQ ID NO: 179773 - DNA, 25 bp, Mus musculus
accttcggctccagaccaaagattc

SEQ ID NO: 179774 - DNA, 25 bp, Mus musculus
accttcggctccaggccaactggaa

SEQ ID NO: 179775 - DNA, 25 bp, Mus musculus
accttcgggaatctgggtggtactg

SEQ ID NO: 179776 - DNA, 25 bp, Mus musculus
accttcgtgttcactttagaacacc

SEQ ID NO: 179777 - DNA, 25 bp, Mus musculus
accttctaacagtgctgctgaagct

SEQ ID NO: 179778 - DNA, 25 bp, Mus musculus
accttctacaattcccagcgacacc

SEQ ID NO: 179779 - DNA, 25 bp, Mus musculus
accttctacagaaaaccgtcaagga

SEQ ID NO: 179780 - DNA, 25 bp, Mus musculus
accttctacatcctggtgtttgtgg

SEQ ID NO: 179781 - DNA, 25 bp, Mus musculus
accttctacgacggggtggagtcgg

SEQ ID NO: 179782 - DNA, 25 bp, Mus musculus
accttctacgctgtggaggtgagtc

SEQ ID NO: 179783 - DNA, 25 bp, Mus musculus
accttctagaagctcttctgtgcca

SEQ ID NO: 179784 - DNA, 25 bp, Mus musculus
accttctagacaaggcaggttcacc

SEQ ID NO: 179785 - DNA, 25 bp, Mus musculus
accttctatgagaaagtccctccag

SEQ ID NO: 179786 - DNA, 25 bp, Mus musculus
accttctcaaggcaggttgtaaaag

SEQ ID NO: 179787 - DNA, 25 bp, Mus musculus
accttctcagagagacctgcttctg

SEQ ID NO: 179788 - DNA, 25 bp, Mus musculus
accttctctctccagtacccccact

SEQ ID NO: 179789 - DNA, 25 bp, Mus musculus
accttctgaagattccgagaggcaa

SEQ ID NO: 179790 - DNA, 25 bp, Mus musculus
accttctgaggaagcactggattgc

SEQ ID NO: 179791 - DNA, 25 bp, Mus musculus
accttctgaggaaggtattcggcac

SEQ ID NO: 179792 - DNA, 25 bp, Mus musculus
accttctgagtaaaggtgaacgacg

SEQ ID NO: 179793 - DNA, 25 bp, Mus musculus
accttctgagtggagagggcgaggc

SEQ ID NO: 179794 - DNA, 25 bp, Mus musculus
accttctgcaagaaggagatctgga

SEQ ID NO: 179795 - DNA, 25 bp, Mus musculus
accttctgcagcaaatctcccggaa

SEQ ID NO: 179796 - DNA, 25 bp, Mus musculus
accttctggattcttggcgcccgtg

SEQ ID NO: 179797 - DNA, 25 bp, Mus musculus
accttctgtcagacatgtgtaatta

SEQ ID NO: 179798 - DNA, 25 bp, Mus musculus
accttctgtcagctggcatgtggcc

SEQ ID NO: 179799 - DNA, 25 bp, Mus musculus
accttctgtcaggtccccctggccg

SEQ ID NO: 179800 - DNA, 25 bp, Mus musculus
accttctgttgccttgaagtttgca

SEQ ID NO: 179801 - DNA, 25 bp, Mus musculus
accttcttaacaaggcacctaatta

SEQ ID NO: 179802 - DNA, 25 bp, Mus musculus
accttcttaacaaggtgcagatcac

SEQ ID NO: 179803 - DNA, 25 bp, Mus musculus
accttcttattgtcgctctattctc

SEQ ID NO: 179804 - DNA, 25 bp, Mus musculus
accttcttattgtcggttggtgatg

SEQ ID NO: 179805 - DNA, 25 bp, Mus musculus
accttcttcacctgggtgctacaga

SEQ ID NO: 179806 - DNA, 25 bp, Mus musculus
accttcttctgtatatgcaccatcc

SEQ ID NO: 179807 - DNA, 25 bp, Mus musculus
accttcttcttatagcaggttcttg

SEQ ID NO: 179808 - DNA, 25 bp, Mus musculus
accttcttgaaccaccaggcctcag

SEQ ID NO: 179809 - DNA, 25 bp, Mus musculus
accttctttaagagaagaatgtggc

SEQ ID NO: 179810 - DNA, 25 bp, Mus musculus
accttctttctgcccttgcagaact

SEQ ID NO: 179811 - DNA, 25 bp, Mus musculus
accttctttggggttccttgtggag

SEQ ID NO: 179812 - DNA, 25 bp, Mus musculus
accttcttttgcttctgcagtgaga

SEQ ID NO: 179813 - DNA, 25 bp, Mus musculus
accttcttttggcgtgcccacactt

SEQ ID NO: 179814 - DNA, 25 bp, Mus musculus
accttgaaccagaatgtctgtaagg

SEQ ID NO: 179815 - DNA, 25 bp, Mus musculus
accttgaactgagctggtggggagt

SEQ ID NO: 179816 - DNA, 25 bp, Mus musculus
accttgaagaggatcccagtcctcc

SEQ ID NO: 179817 - DNA, 25 bp, Mus musculus
accttgaagcactgagccctccaga

SEQ ID NO: 179818 - DNA, 25 bp, Mus musculus
accttgaagcactgagccctcccca

SEQ ID NO: 179819 - DNA, 25 bp, Mus musculus
accttgaccagctcttcattgggac

SEQ ID NO: 179820 - DNA, 25 bp, Mus musculus
accttgaccatcaggactcttcccc

SEQ ID NO: 179821 - DNA, 25 bp, Mus musculus
accttgacgtcccacacttgcatgg

SEQ ID NO: 179822 - DNA, 25 bp, Mus musculus
accttgactcagtacgtcaagtgga

SEQ ID NO: 179823 - DNA, 25 bp, Mus musculus
accttgagagcaggtttaaacgcat

SEQ ID NO: 179824 - DNA, 25 bp, Mus musculus
accttgagcagcccaaagaagtgca

SEQ ID NO: 179825 - DNA, 25 bp, Mus musculus
accttgagcaggaggcttctcagac

SEQ ID NO: 179826 - DNA, 25 bp, Mus musculus
accttgagccaaagccctgttttct

SEQ ID NO: 179827 - DNA, 25 bp, Mus musculus
accttgatcagagtattgttacagt

SEQ ID NO: 179828 - DNA, 25 bp, Mus musculus
accttgatcaggatcttcccaacaa

SEQ ID NO: 179829 - DNA, 25 bp, Mus musculus
accttgcaaagaatccaaaacctgt

SEQ ID NO: 179830 - DNA, 25 bp, Mus musculus
accttgcaaaggagtggccgtccac

SEQ ID NO: 179831 - DNA, 25 bp, Mus musculus
accttgcaaagtgcaatacgaggat

SEQ ID NO: 179832 - DNA, 25 bp, Mus musculus
accttgcaaagtgccacagttgagg

SEQ ID NO: 179833 - DNA, 25 bp, Mus musculus
accttgcaagatgaggagcctcaga

SEQ ID NO: 179834 - DNA, 25 bp, Mus musculus
accttgcaagatgaggcagagaagg

SEQ ID NO: 179835 - DNA, 25 bp, Mus musculus
accttgcaccaagaagttaagtgtt

SEQ ID NO: 179836 - DNA, 25 bp, Mus musculus
accttgcacgacctagtggtttatt

SEQ ID NO: 179837 - DNA, 25 bp, Mus musculus
accttgcacgggctgcaggatgacc

SEQ ID NO: 179838 - DNA, 25 bp, Mus musculus
accttgcatccagtgatgtggccgt

SEQ ID NO: 179839 - DNA, 25 bp, Mus musculus
accttgcatgagtggtgtgacggct

SEQ ID NO: 179840 - DNA, 25 bp, Mus musculus
accttgccaggttctgccttagatc

SEQ ID NO: 179841 - DNA, 25 bp, Mus musculus
accttgcccgaaacaaccacaacat

SEQ ID NO: 179842 - DNA, 25 bp, Mus musculus
accttgctgcgcagatgatgctgaa

SEQ ID NO: 179843 - DNA, 25 bp, Mus musculus
accttgctgcgcagatgcagaaccc

SEQ ID NO: 179844 - DNA, 25 bp, Mus musculus
accttgctggactcgccagtgatgg

SEQ ID NO: 179845 - DNA, 25 bp, Mus musculus
accttgctgtgatggagtcctcatg

SEQ ID NO: 179846 - DNA, 25 bp, Mus musculus
accttgctgtttatggaccttgaga

SEQ ID NO: 179847 - DNA, 25 bp, Mus musculus
accttgcttgtgggattcacagcct

SEQ ID NO: 179848 - DNA, 25 bp, Mus musculus
accttgctttcaaagaacagcatgt

SEQ ID NO: 179849 - DNA, 25 bp, Mus musculus
accttggaactggtcaaggcctggc

SEQ ID NO: 179850 - DNA, 25 bp, Mus musculus
accttggaagggcctggttctcaga

SEQ ID NO: 179851 - DNA, 25 bp, Mus musculus
accttggacaagatagccaaggact

SEQ ID NO: 179852 - DNA, 25 bp, Mus musculus
accttggacaaggagcagatagcca

SEQ ID NO: 179853 - DNA, 25 bp, Mus musculus
accttggaccaagaagttggtgtcc

SEQ ID NO: 179854 - DNA, 25 bp, Mus musculus
accttggagaagataaaaatatata

SEQ ID NO: 179855 - DNA, 25 bp, Mus musculus
accttggagaagattgctggcctcc

SEQ ID NO: 179856 - DNA, 25 bp, Mus musculus
accttggagagaatatgtttgacaa

SEQ ID NO: 179857 - DNA, 25 bp, Mus musculus
accttggagccgggagttgatacaa

SEQ ID NO: 179858 - DNA, 25 bp, Mus musculus
accttggattgacaggtcccaggtc

SEQ ID NO: 179859 - DNA, 25 bp, Mus musculus
accttggattgacaggtctgaacgg

SEQ ID NO: 179860 - DNA, 25 bp, Mus musculus
accttggcaggagccaacagagaaa

SEQ ID NO: 179861 - DNA, 25 bp, Mus musculus
accttggcaggggaatcaaagactc

SEQ ID NO: 179862 - DNA, 25 bp, Mus musculus
accttggccaccacacagagtcatt

SEQ ID NO: 179863 - DNA, 25 bp, Mus musculus
accttggccaccactcctaatagta

SEQ ID NO: 179864 - DNA, 25 bp, Mus musculus
accttggccaccagagatcgagact

SEQ ID NO: 179865 - DNA, 25 bp, Mus musculus
accttggccaccattgcaagtactc

SEQ ID NO: 179866 - DNA, 25 bp, Mus musculus
accttggccaccattgcctcaactg

SEQ ID NO: 179867 - DNA, 25 bp, Mus musculus
accttggctgggggatgggctcttg

SEQ ID NO: 179868 - DNA, 25 bp, Mus musculus
accttgggccagattgtgtcacaaa

SEQ ID NO: 179869 - DNA, 25 bp, Mus musculus
accttgggccaggctgctgtagaaa

SEQ ID NO: 179870 - DNA, 25 bp, Mus musculus
accttggtctgctggacgcctttag

SEQ ID NO: 179871 - DNA, 25 bp, Mus musculus
accttggtctgctgggaagcggaac

SEQ ID NO: 179872 - DNA, 25 bp, Mus musculus
accttggtgagaccatagcccagtg

SEQ ID NO: 179873 - DNA, 25 bp, Mus musculus
accttggtgcagacaacatcgctgt

SEQ ID NO: 179874 - DNA, 25 bp, Mus musculus
accttgtaacaaggctgtgtctgct

SEQ ID NO: 179875 - DNA, 25 bp, Mus musculus
accttgtaacaaggtacactttttg

SEQ ID NO: 179876 - DNA, 25 bp, Mus musculus
accttgtcgttcgaggtaaaaagag

SEQ ID NO: 179877 - DNA, 25 bp, Mus musculus
accttgtgaagaagggaagtgtgtt

SEQ ID NO: 179878 - DNA, 25 bp, Mus musculus
accttgtgatctagccagatcttct

SEQ ID NO: 179879 - DNA, 25 bp, Mus musculus
accttgtgcaggcaccttttgtgtc

SEQ ID NO: 179880 - DNA, 25 bp, Mus musculus
accttgtggaactgtaccttcactc

SEQ ID NO: 179881 - DNA, 25 bp, Mus musculus
accttgtgtcaagggaaaagatgcc

SEQ ID NO: 179882 - DNA, 25 bp, Mus musculus
accttgtgttcctgggtcttgctgt

SEQ ID NO: 179883 - DNA, 25 bp, Mus musculus
accttgttagtaagcacagtacaga

SEQ ID NO: 179884 - DNA, 25 bp, Mus musculus
accttgttcgtgctgggtgatagca

SEQ ID NO: 179885 - DNA, 25 bp, Mus musculus
acctttaacagcccttagggccatc

SEQ ID NO: 179886 - DNA, 25 bp, Mus musculus
acctttaacagcctctttccaggcc

SEQ ID NO: 179887 - DNA, 25 bp, Mus musculus
acctttaacaggattccagtcttag

SEQ ID NO: 179888 - DNA, 25 bp, Mus musculus
acctttaacagggccatcatggaga

SEQ ID NO: 179889 - DNA, 25 bp, Mus musculus
acctttaaccagcaagccccgccca

SEQ ID NO: 179890 - DNA, 25 bp, Mus musculus
acctttaagaggtgtgctgatgtca

SEQ ID NO: 179891 - DNA, 25 bp, Mus musculus
acctttaatttccgagtggacaaga

SEQ ID NO: 179892 - DNA, 25 bp, Mus musculus
acctttaccaagagctgggtcgacg

SEQ ID NO: 179893 - DNA, 25 bp, Mus musculus
acctttaccagcggcactcagtccc

SEQ ID NO: 179894 - DNA, 25 bp, Mus musculus
acctttacgacagtgtgaactggac

SEQ ID NO: 179895 - DNA, 25 bp, Mus musculus
acctttagagggtctgatatgccga

SEQ ID NO: 179896 - DNA, 25 bp, Mus musculus
acctttagcaagcagtccatctcag

SEQ ID NO: 179897 - DNA, 25 bp, Mus musculus
acctttatacctggggttttgtatg

SEQ ID NO: 179898 - DNA, 25 bp, Mus musculus
acctttatctcaggcttcctgcttt

SEQ ID NO: 179899 - DNA, 25 bp, Mus musculus
acctttccaaaggagttgaagcaga

SEQ ID NO: 179900 - DNA, 25 bp, Mus musculus
acctttccagtatactcctgatcat

SEQ ID NO: 179901 - DNA, 25 bp, Mus musculus
acctttccccagagcccgactctga

SEQ ID NO: 179902 - DNA, 25 bp, Mus musculus
acctttccccaggcccggagcattc

SEQ ID NO: 179903 - DNA, 25 bp, Mus musculus
acctttcctcagatttcctccctcc

SEQ ID NO: 179904 - DNA, 25 bp, Mus musculus
acctttcctgcagtatcaggagtgc

SEQ ID NO: 179905 - DNA, 25 bp, Mus musculus
acctttctaaacagggaacagcagt

SEQ ID NO: 179906 - DNA, 25 bp, Mus musculus
acctttctactcaggaactgctgaa

SEQ ID NO: 179907 - DNA, 25 bp, Mus musculus
acctttctagatgatttaagccaga

SEQ ID NO: 179908 - DNA, 25 bp, Mus musculus
acctttctaggtgactactttggga

SEQ ID NO: 179909 - DNA, 25 bp, Mus musculus
acctttctcagtacattcgctcaga

SEQ ID NO: 179910 - DNA, 25 bp, Mus musculus
acctttctcataggtggaattgggc

SEQ ID NO: 179911 - DNA, 25 bp, Mus musculus
acctttctgagggagacttcctgag

SEQ ID NO: 179912 - DNA, 25 bp, Mus musculus
acctttctgctttcaggttctcaga

SEQ ID NO: 179913 - DNA, 25 bp, Mus musculus
acctttctgctttcaggttctgcag

SEQ ID NO: 179914 - DNA, 25 bp, Mus musculus
acctttctgctttcaggttgggaga

SEQ ID NO: 179915 - DNA, 25 bp, Mus musculus
acctttctgtccttggggatgggcc

SEQ ID NO: 179916 - DNA, 25 bp, Mus musculus
acctttgaacgaatcccgctcaaga

SEQ ID NO: 179917 - DNA, 25 bp, Mus musculus
acctttgaatggtaaccaatggagt

SEQ ID NO: 179918 - DNA, 25 bp, Mus musculus
acctttgacctgggaattcctcaag

SEQ ID NO: 179919 - DNA, 25 bp, Mus musculus
acctttgaggaaaccaggaaaatgg

SEQ ID NO: 179920 - DNA, 25 bp, Mus musculus
acctttgagtacaggtgatttgaac

SEQ ID NO: 179921 - DNA, 25 bp, Mus musculus
acctttgatgagatatgtgtcacaa

SEQ ID NO: 179922 - DNA, 25 bp, Mus musculus
acctttgcaatcgatggcagctcaa

SEQ ID NO: 179923 - DNA, 25 bp, Mus musculus
acctttgcagaaagaagaatcctca

SEQ ID NO: 179924 - DNA, 25 bp, Mus musculus
acctttgctttagggatcagtctgc

SEQ ID NO: 179925 - DNA, 25 bp, Mus musculus
acctttgctttccagaatgggcaaa

SEQ ID NO: 179926 - DNA, 25 bp, Mus musculus
acctttgctttccatgggtcccaca

SEQ ID NO: 179927 - DNA, 25 bp, Mus musculus
acctttgctttgattctttcagccc

SEQ ID NO: 179928 - DNA, 25 bp, Mus musculus
acctttgctttgtattacgtgcact

SEQ ID NO: 179929 - DNA, 25 bp, Mus musculus
acctttggaaggttattatgttgtg

SEQ ID NO: 179930 - DNA, 25 bp, Mus musculus
acctttggccagccttacagttcct

SEQ ID NO: 179931 - DNA, 25 bp, Mus musculus
acctttggccaggcttacagttcct

SEQ ID NO: 179932 - DNA, 25 bp, Mus musculus
acctttggtgctttacatggtgaga

SEQ ID NO: 179933 - DNA, 25 bp, Mus musculus
acctttgtaaaagaatgatagagac

SEQ ID NO: 179934 - DNA, 25 bp, Mus musculus
acctttgtaatcagcttggcttacc

SEQ ID NO: 179935 - DNA, 25 bp, Mus musculus
acctttgtccagcggctcgaggact

SEQ ID NO: 179936 - DNA, 25 bp, Mus musculus
acctttgtgaacaagggttcccgag

SEQ ID NO: 179937 - DNA, 25 bp, Mus musculus
acctttgtggcagtcttcccaggcc

SEQ ID NO: 179938 - DNA, 25 bp, Mus musculus
acctttgtggcagtctttcagccaa

SEQ ID NO: 179939 - DNA, 25 bp, Mus musculus
acctttgtgttgaaggtgcaggacc

SEQ ID NO: 179940 - DNA, 25 bp, Mus musculus
accttttaaaggctgctggcaccct

SEQ ID NO: 179941 - DNA, 25 bp, Mus musculus
accttttattctctcttgcctagaa

SEQ ID NO: 179942 - DNA, 25 bp, Mus musculus
accttttcataggttggatgataca

SEQ ID NO: 179943 - DNA, 25 bp, Mus musculus
accttttctctaggcaagaatcaaa

SEQ ID NO: 179944 - DNA, 25 bp, Mus musculus
accttttctctgagcaaagaacgtt

SEQ ID NO: 179945 - DNA, 25 bp, Mus musculus
accttttgacaaggtcagggcccgg

SEQ ID NO: 179946 - DNA, 25 bp, Mus musculus
accttttgagcaggtagaagagaac

SEQ ID NO: 179947 - DNA, 25 bp, Mus musculus
accttttgctagaggtagaagagcc

SEQ ID NO: 179948 - DNA, 25 bp, Mus musculus
accttttggacatggactgaagccc

SEQ ID NO: 179949 - DNA, 25 bp, Mus musculus
accttttggacatggcccttagatg

SEQ ID NO: 179950 - DNA, 25 bp, Mus musculus
accttttgggaaagcttcaccacga

SEQ ID NO: 179951 - DNA, 25 bp, Mus musculus
accttttgggaccagctggaagatg

SEQ ID NO: 179952 - DNA, 25 bp, Mus musculus
acctttttgttggaggtccagatgg

SEQ ID NO: 179953 - DNA, 25 bp, Mus musculus
accttttttcaagctatcagagatg

SEQ ID NO: 179954 - DNA, 25 bp, Mus musculus
accttttttcaaggatgttaattat

SEQ ID NO: 179955 - DNA, 25 bp, Mus musculus
acgaaaaaagatgattcttttatta

SEQ ID NO: 179956 - DNA, 25 bp, Mus musculus
acgaaaaaaggaatgtcctccaagg

SEQ ID NO: 179957 - DNA, 25 bp, Mus musculus
acgaaaactacaagaaatatgtgga

SEQ ID NO: 179958 - DNA, 25 bp, Mus musculus
acgaaacaaaagtggtccatgccgt

SEQ ID NO: 179959 - DNA, 25 bp, Mus musculus
acgaaacaagtgcctgctttttctc

SEQ ID NO: 179960 - DNA, 25 bp, Mus musculus
acgaaacaccagctgcgatactatg

SEQ ID NO: 179961 - DNA, 25 bp, Mus musculus
acgaaacagccaaggcttccaagca

SEQ ID NO: 179962 - DNA, 25 bp, Mus musculus
acgaaaccacgaaccgcatgcacga

SEQ ID NO: 179963 - DNA, 25 bp, Mus musculus
acgaaagaaaggccagagggaggag

SEQ ID NO: 179964 - DNA, 25 bp, Mus musculus
acgaaagcaaagtggccaaagtgag

SEQ ID NO: 179965 - DNA, 25 bp, Mus musculus
acgaaagcagcttttaatatatttt

SEQ ID NO: 179966 - DNA, 25 bp, Mus musculus
acgaaagtcccagcactccgtcctc

SEQ ID NO: 179967 - DNA, 25 bp, Mus musculus
acgaaagttgcaggatgtgtttgag

SEQ ID NO: 179968 - DNA, 25 bp, Mus musculus
acgaaatcgggaagctctttgtggg

SEQ ID NO: 179969 - DNA, 25 bp, Mus musculus
acgaaatgaggacaagctactgcag

SEQ ID NO: 179970 - DNA, 25 bp, Mus musculus
acgaaattcacgacgggatgtttcg

SEQ ID NO: 179971 - DNA, 25 bp, Mus musculus
acgaacacgcgcaagccctgaggtg

SEQ ID NO: 179972 - DNA, 25 bp, Mus musculus
acgaacagaaacaagctccttgctc

SEQ ID NO: 179973 - DNA, 25 bp, Mus musculus
acgaaccaaggagaaagaactgaga

SEQ ID NO: 179974 - DNA, 25 bp, Mus musculus
acgaaccacactgtaccagcaaggt

SEQ ID NO: 179975 - DNA, 25 bp, Mus musculus
acgaacccaggagttccgactctga

SEQ ID NO: 179976 - DNA, 25 bp, Mus musculus
acgaaccccaagctttgtgacgaca

SEQ ID NO: 179977 - DNA, 25 bp, Mus musculus
acgaaccccaagggaaccatcagcg

SEQ ID NO: 179978 - DNA, 25 bp, Mus musculus
acgaacctaacagcaaatgggaagt

SEQ ID NO: 179979 - DNA, 25 bp, Mus musculus
acgaacgcagggcactgcagaagta

SEQ ID NO: 179980 - DNA, 25 bp, Mus musculus
acgaacggaaaaatggaagtatagt

SEQ ID NO: 179981 - DNA, 25 bp, Mus musculus
acgaacggaaaaatgtgctccagct

SEQ ID NO: 179982 - DNA, 25 bp, Mus musculus
acgaacggacaaggagatcagcagg

SEQ ID NO: 179983 - DNA, 25 bp, Mus musculus
acgaacggtcagaagctccccgcag

SEQ ID NO: 179984 - DNA, 25 bp, Mus musculus
acgaactacaggaagagagagtcat

SEQ ID NO: 179985 - DNA, 25 bp, Mus musculus
acgaactcggctaccaagagcaaaa

SEQ ID NO: 179986 - DNA, 25 bp, Mus musculus
acgaactgagaaaagttttgctcat

SEQ ID NO: 179987 - DNA, 25 bp, Mus musculus
acgaactgcctgatgtaaagaatgt

SEQ ID NO: 179988 - DNA, 25 bp, Mus musculus
acgaagaaaacagtgctctgcagtt

SEQ ID NO: 179989 - DNA, 25 bp, Mus musculus
acgaagaaaggccacggaacacagg

SEQ ID NO: 179990 - DNA, 25 bp, Mus musculus
acgaagaagaagcaggtcacgatct

SEQ ID NO: 179991 - DNA, 25 bp, Mus musculus
acgaagaagaagcaggtttcttcgt

SEQ ID NO: 179992 - DNA, 25 bp, Mus musculus
acgaagaaggcaaatagcacccagg

SEQ ID NO: 179993 - DNA, 25 bp, Mus musculus
acgaagacgacaaaggtcccccctg

SEQ ID NO: 179994 - DNA, 25 bp, Mus musculus
acgaagactgcgagcacgtagaaga

SEQ ID NO: 179995 - DNA, 25 bp, Mus musculus
acgaagactgcgaggaccgtcacga

SEQ ID NO: 179996 - DNA, 25 bp, Mus musculus
acgaagagataggtgatttcagact

SEQ ID NO: 179997 - DNA, 25 bp, Mus musculus
acgaagaggaagaggaggcccaaga

SEQ ID NO: 179998 - DNA, 25 bp, Mus musculus
acgaagaggcccaggtgcgggcgag

SEQ ID NO: 179999 - DNA, 25 bp, Mus musculus
acgaagaggctgggctggagaaaga

SEQ ID NO: 180000 - DNA, 25 bp, Mus musculus
acgaagatctcaaagtgagaaaaca

SEQ ID NO: 180001 - DNA, 25 bp, Mus musculus
acgaagatgaaggtcaaactgggct

SEQ ID NO: 180002 - DNA, 25 bp, Mus musculus
acgaagatgcaggagaagattcgat

SEQ ID NO: 180003 - DNA, 25 bp, Mus musculus
acgaagatgcctggtacggagtcaa

SEQ ID NO: 180004 - DNA, 25 bp, Mus musculus
acgaagatgtgcagaaagacgctcc

SEQ ID NO: 180005 - DNA, 25 bp, Mus musculus
acgaagatgtgcaggtcttgcctca

SEQ ID NO: 180006 - DNA, 25 bp, Mus musculus
acgaagcaataagtcctatgaatcg

SEQ ID NO: 180007 - DNA, 25 bp, Mus musculus
acgaagcagaggagttttttgagct

SEQ ID NO: 180008 - DNA, 25 bp, Mus musculus
acgaagcaggagtgcactgcccccc

SEQ ID NO: 180009 - DNA, 25 bp, Mus musculus
acgaagcaggctgcaccctggagga

SEQ ID NO: 180010 - DNA, 25 bp, Mus musculus
acgaagccagaaggaggctcgcatg

SEQ ID NO: 180011 - DNA, 25 bp, Mus musculus
acgaagcgccctttccgtcagaata

SEQ ID NO: 180012 - DNA, 25 bp, Mus musculus
acgaagcgggcagtcagaaaatggg

SEQ ID NO: 180013 - DNA, 25 bp, Mus musculus
acgaagctgctgagggccttgcggg

SEQ ID NO: 180014 - DNA, 25 bp, Mus musculus
acgaaggaagagctgggagagttca

SEQ ID NO: 180015 - DNA, 25 bp, Mus musculus
acgaaggaagaggtgggagagttca

SEQ ID NO: 180016 - DNA, 25 bp, Mus musculus
acgaaggatcttaccaatcctggga

SEQ ID NO: 180017 - DNA, 25 bp, Mus musculus
acgaaggatcttttttgctccagac

SEQ ID NO: 180018 - DNA, 25 bp, Mus musculus
acgaaggcaaggcgacccctctgag

SEQ ID NO: 180019 - DNA, 25 bp, Mus musculus
acgaaggccagcagctctgcggagt

SEQ ID NO: 180020 - DNA, 25 bp, Mus musculus
acgaaggcgagatctgcatcaaagg

SEQ ID NO: 180021 - DNA, 25 bp, Mus musculus
acgaagggagatgatgatgaggaat

SEQ ID NO: 180022 - DNA, 25 bp, Mus musculus
acgaaggggatgcatgtggatggca

SEQ ID NO: 180023 - DNA, 25 bp, Mus musculus
acgaaggggatgttgtggaagtgac

SEQ ID NO: 180024 - DNA, 25 bp, Mus musculus
acgaaggtaagaaggcaatggcaag

SEQ ID NO: 180025 - DNA, 25 bp, Mus musculus
acgaagtagtttttgacagaaaatc

SEQ ID NO: 180026 - DNA, 25 bp, Mus musculus
acgaagtcacgagcttcgttaccca

SEQ ID NO: 180027 - DNA, 25 bp, Mus musculus
acgaagtggtcggaattctgccttt

SEQ ID NO: 180028 - DNA, 25 bp, Mus musculus
acgaagttccgacagcagcccaaca

SEQ ID NO: 180029 - DNA, 25 bp, Mus musculus
acgaatcacaggattagtcgtatct

SEQ ID NO: 180030 - DNA, 25 bp, Mus musculus
acgaatcattacagacacacctgca

SEQ ID NO: 180031 - DNA, 25 bp, Mus musculus
acgaatcattacaggtcctgagata

SEQ ID NO: 180032 - DNA, 25 bp, Mus musculus
acgaatcctgtgaagatgtggatga

SEQ ID NO: 180033 - DNA, 25 bp, Mus musculus
acgaatccttagtggccaataggtt

SEQ ID NO: 180034 - DNA, 25 bp, Mus musculus
acgaatcctttgtcatctacatcat

SEQ ID NO: 180035 - DNA, 25 bp, Mus musculus
acgaatcgaaggcctggacatacgc

SEQ ID NO: 180036 - DNA, 25 bp, Mus musculus
acgaatctgatgaggttgtcttgaa

SEQ ID NO: 180037 - DNA, 25 bp, Mus musculus
acgaatcttcgaggtgctggaaaga

SEQ ID NO: 180038 - DNA, 25 bp, Mus musculus
acgaatgcaaggcaccaacagagag

SEQ ID NO: 180039 - DNA, 25 bp, Mus musculus
acgaatgcaaggtgagagcacagag

SEQ ID NO: 180040 - DNA, 25 bp, Mus musculus
acgaatgtttcctgcaatcctgaac

SEQ ID NO: 180041 - DNA, 25 bp, Mus musculus
acgaattacctattgaagtggacct

SEQ ID NO: 180042 - DNA, 25 bp, Mus musculus
acgaattgcagcatttgctgatgct

SEQ ID NO: 180043 - DNA, 25 bp, Mus musculus
acgaattggggactttgcttgtggc

SEQ ID NO: 180044 - DNA, 25 bp, Mus musculus
acgaattgtcaagcaataccaagac

SEQ ID NO: 180045 - DNA, 25 bp, Mus musculus
acgacaaaactaatatccaggggat

SEQ ID NO: 180046 - DNA, 25 bp, Mus musculus
acgacaaaactgctaacccagtaga

SEQ ID NO: 180047 - DNA, 25 bp, Mus musculus
acgacaaacaaaaagtactacaaga

SEQ ID NO: 180048 - DNA, 25 bp, Mus musculus
acgacaaataagatgcacgccatcc

SEQ ID NO: 180049 - DNA, 25 bp, Mus musculus
acgacaacagcccaaggagctcgga

SEQ ID NO: 180050 - DNA, 25 bp, Mus musculus
acgacaacatcctaggcttcatcgc

SEQ ID NO: 180051 - DNA, 25 bp, Mus musculus
acgacaagaactgctgagaagaagc

SEQ ID NO: 180052 - DNA, 25 bp, Mus musculus
acgacaagcagccagtctcaatgga

SEQ ID NO: 180053 - DNA, 25 bp, Mus musculus
acgacaagttctccaccccctccac

SEQ ID NO: 180054 - DNA, 25 bp, Mus musculus
acgacaatgcagctataaaaccatt

SEQ ID NO: 180055 - DNA, 25 bp, Mus musculus
acgacaccaaaagggctcaggatgc

SEQ ID NO: 180056 - DNA, 25 bp, Mus musculus
acgacaccaaggagtcagtccgacc

SEQ ID NO: 180057 - DNA, 25 bp, Mus musculus
acgacactcattcccagacccagtg

SEQ ID NO: 180058 - DNA, 25 bp, Mus musculus
acgacactgtacttcgcagatatgg

SEQ ID NO: 180059 - DNA, 25 bp, Mus musculus
acgacacttacgagcatacatcttt

SEQ ID NO: 180060 - DNA, 25 bp, Mus musculus
acgacacttacgataaactttataa

SEQ ID NO: 180061 - DNA, 25 bp, Mus musculus
acgacacttggacgttcatgaggga

SEQ ID NO: 180062 - DNA, 25 bp, Mus musculus
acgacagacagctattatctggaaa

SEQ ID NO: 180063 - DNA, 25 bp, Mus musculus
acgacagcaaattcaactacagtgg

SEQ ID NO: 180064 - DNA, 25 bp, Mus musculus
acgacagcagacagaagtgggagca

SEQ ID NO: 180065 - DNA, 25 bp, Mus musculus
acgacagcagagaaacatggcttag

SEQ ID NO: 180066 - DNA, 25 bp, Mus musculus
acgacagccaggtccccctggagcc

SEQ ID NO: 180067 - DNA, 25 bp, Mus musculus
acgacagcccatctgctgctcctgc

SEQ ID NO: 180068 - DNA, 25 bp, Mus musculus
acgacagctgatggttccagcatct

SEQ ID NO: 180069 - DNA, 25 bp, Mus musculus
acgacagctgcctcctagctttccc

SEQ ID NO: 180070 - DNA, 25 bp, Mus musculus
acgacagctgggctacttgattagc

SEQ ID NO: 180071 - DNA, 25 bp, Mus musculus
acgacaggaaatgcttgcccctaag

SEQ ID NO: 180072 - DNA, 25 bp, Mus musculus
acgacaggaaatggctctctgctac

SEQ ID NO: 180073 - DNA, 25 bp, Mus musculus
acgacatccttcaggctggtggctg

SEQ ID NO: 180074 - DNA, 25 bp, Mus musculus
acgacatcgaagacatgctccagct

SEQ ID NO: 180075 - DNA, 25 bp, Mus musculus
acgacattgtgtacctcatccgttc

SEQ ID NO: 180076 - DNA, 25 bp, Mus musculus
acgaccaagaagcagccgatcaaaa

SEQ ID NO: 180077 - DNA, 25 bp, Mus musculus
acgaccaagaagcagtcgttcccca

SEQ ID NO: 180078 - DNA, 25 bp, Mus musculus
acgaccaagaagcttcgttacacta

SEQ ID NO: 180079 - DNA, 25 bp, Mus musculus
acgaccaagacgcaaatggaacttc

SEQ ID NO: 180080 - DNA, 25 bp, Mus musculus
acgaccagaagagagccaagcctcc

SEQ ID NO: 180081 - DNA, 25 bp, Mus musculus
acgacccaaggaggcaagtgtttaa

SEQ ID NO: 180082 - DNA, 25 bp, Mus musculus
acgacccaagtggcagcaatgttcc

SEQ ID NO: 180083 - DNA, 25 bp, Mus musculus
acgacccaggccagatgaacgatgg

SEQ ID NO: 180084 - DNA, 25 bp, Mus musculus
acgaccccacaatcgaagatgctta

SEQ ID NO: 180085 - DNA, 25 bp, Mus musculus
acgaccccacaatcggcagagttca

SEQ ID NO: 180086 - DNA, 25 bp, Mus musculus
acgacccccagggagaggcagagtt

SEQ ID NO: 180087 - DNA, 25 bp, Mus musculus
acgaccccttggaagaacttgcaaa

SEQ ID NO: 180088 - DNA, 25 bp, Mus musculus
acgacccgacccaaggcatgcgcca

SEQ ID NO: 180089 - DNA, 25 bp, Mus musculus
acgaccctaggccagataaggaatt

SEQ ID NO: 180090 - DNA, 25 bp, Mus musculus
acgaccctcaagtgccctgtgatgc

SEQ ID NO: 180091 - DNA, 25 bp, Mus musculus
acgaccctctaaggatatgctgtca

SEQ ID NO: 180092 - DNA, 25 bp, Mus musculus
acgaccgactggaggatgctttgct

SEQ ID NO: 180093 - DNA, 25 bp, Mus musculus
acgaccgtccggtgcgtataactgt

SEQ ID NO: 180094 - DNA, 25 bp, Mus musculus
acgaccgtccggtgttctggctgat

SEQ ID NO: 180095 - DNA, 25 bp, Mus musculus
acgacctccaaatggttctgaatca

SEQ ID NO: 180096 - DNA, 25 bp, Mus musculus
acgacctccctaggattctcaaagc

SEQ ID NO: 180097 - DNA, 25 bp, Mus musculus
acgacctccctaggtgaggattatg

SEQ ID NO: 180098 - DNA, 25 bp, Mus musculus
acgacctggccagtaaaagctggca

SEQ ID NO: 180099 - DNA, 25 bp, Mus musculus
acgacctgtcatcagatgacctcat

SEQ ID NO: 180100 - DNA, 25 bp, Mus musculus
acgacgaagtggtcggaattctgcc

SEQ ID NO: 180101 - DNA, 25 bp, Mus musculus
acgacgacagtttcagccctcttgt

SEQ ID NO: 180102 - DNA, 25 bp, Mus musculus
acgacgacgacagtttcagccctct

SEQ ID NO: 180103 - DNA, 25 bp, Mus musculus
acgacgacgacgagattttccaggg

SEQ ID NO: 180104 - DNA, 25 bp, Mus musculus
acgacgacgacgagctagacgagac

SEQ ID NO: 180105 - DNA, 25 bp, Mus musculus
acgacgacgagattttccagggcag

SEQ ID NO: 180106 - DNA, 25 bp, Mus musculus
acgacgacgagctagacgagaccct

SEQ ID NO: 180107 - DNA, 25 bp, Mus musculus
acgacgatagggtccaggtggagtt

SEQ ID NO: 180108 - DNA, 25 bp, Mus musculus
acgacgatgactcccctgcaactgt

SEQ ID NO: 180109 - DNA, 25 bp, Mus musculus
acgacgctttggatgagtgtgaact

SEQ ID NO: 180110 - DNA, 25 bp, Mus musculus
acgacgctttggatggctcccggac

SEQ ID NO: 180111 - DNA, 25 bp, Mus musculus
acgacgctttggatggtgatgatga

SEQ ID NO: 180112 - DNA, 25 bp, Mus musculus
acgacgctttggatgtgccttcgga

SEQ ID NO: 180113 - DNA, 25 bp, Mus musculus
acgacggcacagagctcctggccag

SEQ ID NO: 180114 - DNA, 25 bp, Mus musculus
acgacggcgaagagttcatatggga

SEQ ID NO: 180115 - DNA, 25 bp, Mus musculus
acgacgtgaaagactggaggccagc

SEQ ID NO: 180116 - DNA, 25 bp, Mus musculus
acgacgtggactacaagatgtccca

SEQ ID NO: 180117 - DNA, 25 bp, Mus musculus
acgacgtggtcaagacccagagaac

SEQ ID NO: 180118 - DNA, 25 bp, Mus musculus
acgacgtggtcaagattgactttga

SEQ ID NO: 180119 - DNA, 25 bp, Mus musculus
acgacgttaagcagattttgaagca

SEQ ID NO: 180120 - DNA, 25 bp, Mus musculus
acgacgttaagcagatttttcatta

SEQ ID NO: 180121 - DNA, 25 bp, Mus musculus
acgactacagaagtgacctctaggg

SEQ ID NO: 180122 - DNA, 25 bp, Mus musculus
acgactacagaagtgacctctggtc

SEQ ID NO: 180123 - DNA, 25 bp, Mus musculus
acgactactgagggtgtgacttctt

SEQ ID NO: 180124 - DNA, 25 bp, Mus musculus
acgactacttcaaagccaaggacta

SEQ ID NO: 180125 - DNA, 25 bp, Mus musculus
acgactacttcaaaggtggtgaaag

SEQ ID NO: 180126 - DNA, 25 bp, Mus musculus
acgactacttggggctcgtgagctg

SEQ ID NO: 180127 - DNA, 25 bp, Mus musculus
acgactccaacgacccgtgcccagg

SEQ ID NO: 180128 - DNA, 25 bp, Mus musculus
acgactccgtgaacgctctcactct

SEQ ID NO: 180129 - DNA, 25 bp, Mus musculus
acgactgaaggagaaaattttgagc

SEQ ID NO: 180130 - DNA, 25 bp, Mus musculus
acgactgactggggatggaggtaaa

SEQ ID NO: 180131 - DNA, 25 bp, Mus musculus
acgactgactgggtgatgcccacgc

SEQ ID NO: 180132 - DNA, 25 bp, Mus musculus
acgactgccagtctccctatgagcg

SEQ ID NO: 180133 - DNA, 25 bp, Mus musculus
acgactgctgatgaagtgactgaga

SEQ ID NO: 180134 - DNA, 25 bp, Mus musculus
acgactggcgaagcagtgccccctc

SEQ ID NO: 180135 - DNA, 25 bp, Mus musculus
acgactgtgaagggaagacatgtga

SEQ ID NO: 180136 - DNA, 25 bp, Mus musculus
acgactgtgaagttagtagaaaaag

SEQ ID NO: 180137 - DNA, 25 bp, Mus musculus
acgactgttccattgagatctgtgc

SEQ ID NO: 180138 - DNA, 25 bp, Mus musculus
acgacttagacagagctgaggaccg

SEQ ID NO: 180139 - DNA, 25 bp, Mus musculus
acgacttagacaggtgctgccagac

SEQ ID NO: 180140 - DNA, 25 bp, Mus musculus
acgacttcgagcaggacaatcccag

SEQ ID NO: 180141 - DNA, 25 bp, Mus musculus
acgacttgaaacaaggggttataat

SEQ ID NO: 180142 - DNA, 25 bp, Mus musculus
acgacttggagccccacgcaatcat

SEQ ID NO: 180143 - DNA, 25 bp, Mus musculus
acgacttggaggaagtccgccagtt

SEQ ID NO: 180144 - DNA, 25 bp, Mus musculus
acgagaaaaagctggagagatgtct

SEQ ID NO: 180145 - DNA, 25 bp, Mus musculus
acgagaaatgaaggactgcagtaat

SEQ ID NO: 180146 - DNA, 25 bp, Mus musculus
acgagaacagaaaatactcttgcga

SEQ ID NO: 180147 - DNA, 25 bp, Mus musculus
acgagaacagcgactactgtgaaga

SEQ ID NO: 180148 - DNA, 25 bp, Mus musculus
acgagaagaagagctgaagggtctg

SEQ ID NO: 180149 - DNA, 25 bp, Mus musculus
acgagaagaaggtgatggatgggga

SEQ ID NO: 180150 - DNA, 25 bp, Mus musculus
acgagaagcacatcaaggtgaacct

SEQ ID NO: 180151 - DNA, 25 bp, Mus musculus
acgagaagccagaaagaaagatcac

SEQ ID NO: 180152 - DNA, 25 bp, Mus musculus
acgagaaggaatgccaaccaggcag

SEQ ID NO: 180153 - DNA, 25 bp, Mus musculus
acgagaaggaatgccccaaagcaaa

SEQ ID NO: 180154 - DNA, 25 bp, Mus musculus
acgagaaggagctgatcgaagcgtt

SEQ ID NO: 180155 - DNA, 25 bp, Mus musculus
acgagaaggagctgccaaggcggca

SEQ ID NO: 180156 - DNA, 25 bp, Mus musculus
acgagaaggatctggtgaaactagc

SEQ ID NO: 180157 - DNA, 25 bp, Mus musculus
acgagaatggaaacttgagttcggc

SEQ ID NO: 180158 - DNA, 25 bp, Mus musculus
acgagaatgggcaattgcttcccat

SEQ ID NO: 180159 - DNA, 25 bp, Mus musculus
acgagaattctcaggtcctctttca

SEQ ID NO: 180160 - DNA, 25 bp, Mus musculus
acgagacaaactgccagaaagtatt

SEQ ID NO: 180161 - DNA, 25 bp, Mus musculus
acgagacaaagtgctgctgtttttt

SEQ ID NO: 180162 - DNA, 25 bp, Mus musculus
acgagacaagccaaggtcttcttct

SEQ ID NO: 180163 - DNA, 25 bp, Mus musculus
acgagacagaagcaccattgcaaga

SEQ ID NO: 180164 - DNA, 25 bp, Mus musculus
acgagacatgcactccaccacgcag

SEQ ID NO: 180165 - DNA, 25 bp, Mus musculus
acgagacatgcactccgcttacaag

SEQ ID NO: 180166 - DNA, 25 bp, Mus musculus
acgagaccgaggcttacttctttga

SEQ ID NO: 180167 - DNA, 25 bp, Mus musculus
acgagaccgaggtctttgacagaat

SEQ ID NO: 180168 - DNA, 25 bp, Mus musculus
acgagaccgagttacttgccggtca

SEQ ID NO: 180169 - DNA, 25 bp, Mus musculus
acgagaccggcggcaagtacattgc

SEQ ID NO: 180170 - DNA, 25 bp, Mus musculus
acgagacgagagtgatctcagcgcc

SEQ ID NO: 180171 - DNA, 25 bp, Mus musculus
acgagacgctcaaggatgaagaaac

SEQ ID NO: 180172 - DNA, 25 bp, Mus musculus
acgagacgctcaagtcctcctgcat

SEQ ID NO: 180173 - DNA, 25 bp, Mus musculus
acgagactctgcggcactctgtcca

SEQ ID NO: 180174 - DNA, 25 bp, Mus musculus
acgagagattaggttccaaggagca

SEQ ID NO: 180175 - DNA, 25 bp, Mus musculus
acgagagctttaattttgccaaaaa

SEQ ID NO: 180176 - DNA, 25 bp, Mus musculus
acgagagctttggtctctttgctgt

SEQ ID NO: 180177 - DNA, 25 bp, Mus musculus
acgagaggacaatagccttaaagaa

SEQ ID NO: 180178 - DNA, 25 bp, Mus musculus
acgagaggctgcaggctacagaacc

SEQ ID NO: 180179 - DNA, 25 bp, Mus musculus
acgagagtgagttccaggacagcca

SEQ ID NO: 180180 - DNA, 25 bp, Mus musculus
acgagagtgtcaaaggatcaatgtg

SEQ ID NO: 180181 - DNA, 25 bp, Mus musculus
acgagagtgtcaaagtacttcaact

SEQ ID NO: 180182 - DNA, 25 bp, Mus musculus
acgagatccgcagtatgttccggaa

SEQ ID NO: 180183 - DNA, 25 bp, Mus musculus
acgagatccgcagtggtttctctgt

SEQ ID NO: 180184 - DNA, 25 bp, Mus musculus
acgagatcttaaggacctggggatt

SEQ ID NO: 180185 - DNA, 25 bp, Mus musculus
acgagatgatggattatctattatc

SEQ ID NO: 180186 - DNA, 25 bp, Mus musculus
acgagattgcaaaggtcatttggtg

SEQ ID NO: 180187 - DNA, 25 bp, Mus musculus
acgagcacacagatggagtgatcaa

SEQ ID NO: 180188 - DNA, 25 bp, Mus musculus
acgagcacacaggagagaccttctg

SEQ ID NO: 180189 - DNA, 25 bp, Mus musculus
acgagcagatccaatactgcagcaa

SEQ ID NO: 180190 - DNA, 25 bp, Mus musculus
acgagcagatccaatcacgagacca

SEQ ID NO: 180191 - DNA, 25 bp, Mus musculus
acgagcagcaagtggtggaatctgg

SEQ ID NO: 180192 - DNA, 25 bp, Mus musculus
acgagcagtagcgagccacaggttg

SEQ ID NO: 180193 - DNA, 25 bp, Mus musculus
acgagcatgagaggaggagcttggt

SEQ ID NO: 180194 - DNA, 25 bp, Mus musculus
acgagcatgagcttagcagcctggg

SEQ ID NO: 180195 - DNA, 25 bp, Mus musculus
acgagcatgagtggggtccggccag

SEQ ID NO: 180196 - DNA, 25 bp, Mus musculus
acgagccagaatacaatattggcca

SEQ ID NO: 180197 - DNA, 25 bp, Mus musculus
acgagcctggcttctaataacatgc

SEQ ID NO: 180198 - DNA, 25 bp, Mus musculus
acgagcgagatgaagcacacaggca

SEQ ID NO: 180199 - DNA, 25 bp, Mus musculus
acgagcgctcaggagaaatatgaac

SEQ ID NO: 180200 - DNA, 25 bp, Mus musculus
acgagcggaggaggtcccaggtaat

SEQ ID NO: 180201 - DNA, 25 bp, Mus musculus
acgagctcagaaacaaatacattct

SEQ ID NO: 180202 - DNA, 25 bp, Mus musculus
acgagctcagaatattattggcgtg

SEQ ID NO: 180203 - DNA, 25 bp, Mus musculus
acgagctcaggtcctgaactttgtc

SEQ ID NO: 180204 - DNA, 25 bp, Mus musculus
acgagctcatcgagaaacatggctt

SEQ ID NO: 180205 - DNA, 25 bp, Mus musculus
acgagctcatcgaggagaatcagcg

SEQ ID NO: 180206 - DNA, 25 bp, Mus musculus
acgagctccagatgctctccaagtt

SEQ ID NO: 180207 - DNA, 25 bp, Mus musculus
acgagctccagggtttctcagtgtg

SEQ ID NO: 180208 - DNA, 25 bp, Mus musculus
acgagctcttgaaggatctgcagca

SEQ ID NO: 180209 - DNA, 25 bp, Mus musculus
acgagctgcagaaccagctagctgc

SEQ ID NO: 180210 - DNA, 25 bp, Mus musculus
acgagctgcagcaggagttaaaaat

SEQ ID NO: 180211 - DNA, 25 bp, Mus musculus
acgagctgccgtgggttgaaaaata

SEQ ID NO: 180212 - DNA, 25 bp, Mus musculus
acgagctgctggatgagattctgga

SEQ ID NO: 180213 - DNA, 25 bp, Mus musculus
acgagctggactgttatccaactga

SEQ ID NO: 180214 - DNA, 25 bp, Mus musculus
acgagctggagtgagcaaaccaaca

SEQ ID NO: 180215 - DNA, 25 bp, Mus musculus
acgagctggcgggtgaaaattttga

SEQ ID NO: 180216 - DNA, 25 bp, Mus musculus
acgagctggcggttttgtaccaatg

SEQ ID NO: 180217 - DNA, 25 bp, Mus musculus
acgagctgtaaggtgacagaagacc

SEQ ID NO: 180218 - DNA, 25 bp, Mus musculus
acgagctgtaagtgagcttcactag

SEQ ID NO: 180219 - DNA, 25 bp, Mus musculus
acgagctgtcggcattatgccagta

SEQ ID NO: 180220 - DNA, 25 bp, Mus musculus
acgagctgtcgggagaaaattttga

SEQ ID NO: 180221 - DNA, 25 bp, Mus musculus
acgagcttacaaagaatggaattgc

SEQ ID NO: 180222 - DNA, 25 bp, Mus musculus
acgaggaacctttcacgatgacaga

SEQ ID NO: 180223 - DNA, 25 bp, Mus musculus
acgaggaagagaaagggcggtctgg

SEQ ID NO: 180224 - DNA, 25 bp, Mus musculus
acgaggaagagaaggctgaggcaga

SEQ ID NO: 180225 - DNA, 25 bp, Mus musculus
acgaggacaaggaaccttacagcac

SEQ ID NO: 180226 - DNA, 25 bp, Mus musculus
acgaggacaagtgccaatgcaagac

SEQ ID NO: 180227 - DNA, 25 bp, Mus musculus
acgaggaccctcaggtttgatgaag

SEQ ID NO: 180228 - DNA, 25 bp, Mus musculus
acgaggacgactgccccaagaggac

SEQ ID NO: 180229 - DNA, 25 bp, Mus musculus
acgaggacgagctaaagcggctgct

SEQ ID NO: 180230 - DNA, 25 bp, Mus musculus
acgaggacgagctacagccctacac

SEQ ID NO: 180231 - DNA, 25 bp, Mus musculus
acgaggagaactgcacagcgaaccc

SEQ ID NO: 180232 - DNA, 25 bp, Mus musculus
acgaggagcaggttgctatcggctg

SEQ ID NO: 180233 - DNA, 25 bp, Mus musculus
acgaggagctgggccaggagctgaa

SEQ ID NO: 180234 - DNA, 25 bp, Mus musculus
acgaggaggcaaagatttttatcac

SEQ ID NO: 180235 - DNA, 25 bp, Mus musculus
acgaggagtctggctcgggtcttta

SEQ ID NO: 180236 - DNA, 25 bp, Mus musculus
acgaggagtctggtggaggctccaa

SEQ ID NO: 180237 - DNA, 25 bp, Mus musculus
acgaggagtcttcctgtagaaatgc

SEQ ID NO: 180238 - DNA, 25 bp, Mus musculus
acgaggagtggttccgatctaagta

SEQ ID NO: 180239 - DNA, 25 bp, Mus musculus
acgaggatcccaggaaagaaaagtt

SEQ ID NO: 180240 - DNA, 25 bp, Mus musculus
acgaggatcccagtcaggaaccagc

SEQ ID NO: 180241 - DNA, 25 bp, Mus musculus
acgaggatgaggactcgtccagtgg

SEQ ID NO: 180242 - DNA, 25 bp, Mus musculus
acgaggcaaaggtgtacagtgccac

SEQ ID NO: 180243 - DNA, 25 bp, Mus musculus
acgaggcaatcaagtattctgagag

SEQ ID NO: 180244 - DNA, 25 bp, Mus musculus
acgaggccagatacctgactgtcag

SEQ ID NO: 180245 - DNA, 25 bp, Mus musculus
acgaggccgactgctcaccaggacc

SEQ ID NO: 180246 - DNA, 25 bp, Mus musculus
acgaggccgagcccctcggagccct

SEQ ID NO: 180247 - DNA, 25 bp, Mus musculus
acgaggcctaccaggtcagcttgca

SEQ ID NO: 180248 - DNA, 25 bp, Mus musculus
acgaggccttggtcgatccactctc

SEQ ID NO: 180249 - DNA, 25 bp, Mus musculus
acgaggcgtgagcacctccgcacct

SEQ ID NO: 180250 - DNA, 25 bp, Mus musculus
acgaggctcgtcaggcacagaagga

SEQ ID NO: 180251 - DNA, 25 bp, Mus musculus
acgaggctcttcaggtgctccaatg

SEQ ID NO: 180252 - DNA, 25 bp, Mus musculus
acgaggcttccagctccagaaatct

SEQ ID NO: 180253 - DNA, 25 bp, Mus musculus
acgaggcttgaagaaagaacaagtt

SEQ ID NO: 180254 - DNA, 25 bp, Mus musculus
acgagggactgcaggtgtgagagtg

SEQ ID NO: 180255 - DNA, 25 bp, Mus musculus
acgagggagctagcaaaatcggaaa

SEQ ID NO: 180256 - DNA, 25 bp, Mus musculus
acgagggagctaggaggccacgcag

SEQ ID NO: 180257 - DNA, 25 bp, Mus musculus
acgagggcaaaatctgtctccagta

SEQ ID NO: 180258 - DNA, 25 bp, Mus musculus
acgagggcaaaatctgtgagaagga

SEQ ID NO: 180259 - DNA, 25 bp, Mus musculus
acgagggcgaggctcggctattagc

SEQ ID NO: 180260 - DNA, 25 bp, Mus musculus
acgagggcgcggtgtggacaaatgt

SEQ ID NO: 180261 - DNA, 25 bp, Mus musculus
acgaggtcattctgtcagacccgcc

SEQ ID NO: 180262 - DNA, 25 bp, Mus musculus
acgaggtgcactgccaacctaggcg

SEQ ID NO: 180263 - DNA, 25 bp, Mus musculus
acgagtaacctggagtttctgacat

SEQ ID NO: 180264 - DNA, 25 bp, Mus musculus
acgagtaagaggaattctggctgaa

SEQ ID NO: 180265 - DNA, 25 bp, Mus musculus
acgagtaccggcatgtcatgttacc

SEQ ID NO: 180266 - DNA, 25 bp, Mus musculus
acgagtagaagatgaaagtctggat

SEQ ID NO: 180267 - DNA, 25 bp, Mus musculus
acgagtatctggaagtacaaaggag

SEQ ID NO: 180268 - DNA, 25 bp, Mus musculus
acgagtatctggacatgtcctcacg

SEQ ID NO: 180269 - DNA, 25 bp, Mus musculus
acgagtatctggctcagagacatgt

SEQ ID NO: 180270 - DNA, 25 bp, Mus musculus
acgagtatctggttttaacagcgta

SEQ ID NO: 180271 - DNA, 25 bp, Mus musculus
acgagtatgaattggagctactgct

SEQ ID NO: 180272 - DNA, 25 bp, Mus musculus
acgagtccagattgctgaagctaaa

SEQ ID NO: 180273 - DNA, 25 bp, Mus musculus
acgagtccggggaagtgtgtttaat

SEQ ID NO: 180274 - DNA, 25 bp, Mus musculus
acgagtcctatggtgaaggctgcat

SEQ ID NO: 180275 - DNA, 25 bp, Mus musculus
acgagtctgaggctgcttatgatcc

SEQ ID NO: 180276 - DNA, 25 bp, Mus musculus
acgagtctgatagctgctgcttcca

SEQ ID NO: 180277 - DNA, 25 bp, Mus musculus
acgagtctgatatctgctgcttcca

SEQ ID NO: 180278 - DNA, 25 bp, Mus musculus
acgagtgcaaggctgatatagaatt

SEQ ID NO: 180279 - DNA, 25 bp, Mus musculus
acgagtgcaaggtttgacttttgcc

SEQ ID NO: 180280 - DNA, 25 bp, Mus musculus
acgagtgccaaaggtgtgactgcaa

SEQ ID NO: 180281 - DNA, 25 bp, Mus musculus
acgagtgcctgcaggatcggaacgt

SEQ ID NO: 180282 - DNA, 25 bp, Mus musculus
acgagtgcgtccagtatcagcatgt

SEQ ID NO: 180283 - DNA, 25 bp, Mus musculus
acgagtgtagtaggtctgttcctgc

SEQ ID NO: 180284 - DNA, 25 bp, Mus musculus
acgagttagaaaagccatagattgt

SEQ ID NO: 180285 - DNA, 25 bp, Mus musculus
acgagttagaaaagctatagagaag

SEQ ID NO: 180286 - DNA, 25 bp, Mus musculus
acgagttcatgaaggaagcgggtgc

SEQ ID NO: 180287 - DNA, 25 bp, Mus musculus
acgagttcatgaaggaggatttcga

SEQ ID NO: 180288 - DNA, 25 bp, Mus musculus
acgagttggtcaagtgcatcgagga

SEQ ID NO: 180289 - DNA, 25 bp, Mus musculus
acgagtttcaggctccatttggaat

SEQ ID NO: 180290 - DNA, 25 bp, Mus musculus
acgagtttgacaagatgaatgacca

SEQ ID NO: 180291 - DNA, 25 bp, Mus musculus
acgagtttgttgtcacaatgcttat

SEQ ID NO: 180292 - DNA, 25 bp, Mus musculus
acgataatgaagaaaacgggagtga

SEQ ID NO: 180293 - DNA, 25 bp, Mus musculus
acgatacaagtgaccttattcaatc

SEQ ID NO: 180294 - DNA, 25 bp, Mus musculus
acgatacagaaagagtctttctcct

SEQ ID NO: 180295 - DNA, 25 bp, Mus musculus
acgatacagacaggttaactgaggg

SEQ ID NO: 180296 - DNA, 25 bp, Mus musculus
acgataccaacgtggtccactgaca

SEQ ID NO: 180297 - DNA, 25 bp, Mus musculus
acgatagcatacctgtatgaccggt

SEQ ID NO: 180298 - DNA, 25 bp, Mus musculus
acgatagctgagagtcgacaattag

SEQ ID NO: 180299 - DNA, 25 bp, Mus musculus
acgataggaatacaacttctcgccg

SEQ ID NO: 180300 - DNA, 25 bp, Mus musculus
acgatatcacaaatgttaactcatt

SEQ ID NO: 180301 - DNA, 25 bp, Mus musculus
acgatatcatgcctctgacagctgg

SEQ ID NO: 180302 - DNA, 25 bp, Mus musculus
acgatatgacgaatgggtgaagacc

SEQ ID NO: 180303 - DNA, 25 bp, Mus musculus
acgatatgacgtgggcgacccagcc

SEQ ID NO: 180304 - DNA, 25 bp, Mus musculus
acgatcacaagatgtctggtcagcc

SEQ ID NO: 180305 - DNA, 25 bp, Mus musculus
acgatcacaagattggcgaaagaca

SEQ ID NO: 180306 - DNA, 25 bp, Mus musculus
acgatcacagataactatgctaaaa

SEQ ID NO: 180307 - DNA, 25 bp, Mus musculus
acgatcacagggatctcgattgtct

SEQ ID NO: 180308 - DNA, 25 bp, Mus musculus
acgatcagaagactcacagtggtga

SEQ ID NO: 180309 - DNA, 25 bp, Mus musculus
acgatcagaagatgcgctgatcctg

SEQ ID NO: 180310 - DNA, 25 bp, Mus musculus
acgatccaaccctcgaatcaaccta

SEQ ID NO: 180311 - DNA, 25 bp, Mus musculus
acgatccaccaggtttgaggagttc

SEQ ID NO: 180312 - DNA, 25 bp, Mus musculus
acgatccagcttacattgcagtttt

SEQ ID NO: 180313 - DNA, 25 bp, Mus musculus
acgatccagcttgtattgcagtttt

SEQ ID NO: 180314 - DNA, 25 bp, Mus musculus
acgatccgtgacagactcaaactag

SEQ ID NO: 180315 - DNA, 25 bp, Mus musculus
acgatccgtgacaggccctttgaac

SEQ ID NO: 180316 - DNA, 25 bp, Mus musculus
acgatcctgacatgactgacttaca

SEQ ID NO: 180317 - DNA, 25 bp, Mus musculus
acgatcctgccttgacactagttgc

SEQ ID NO: 180318 - DNA, 25 bp, Mus musculus
acgatccttgtggacttctgggata

SEQ ID NO: 180319 - DNA, 25 bp, Mus musculus
acgatccttgtgggtatttgatgtc

SEQ ID NO: 180320 - DNA, 25 bp, Mus musculus
acgatctcatcaagaccctgaagac

SEQ ID NO: 180321 - DNA, 25 bp, Mus musculus
acgatctcatcaaggcacataccat

SEQ ID NO: 180322 - DNA, 25 bp, Mus musculus
acgatctctttgggtccattttcta

SEQ ID NO: 180323 - DNA, 25 bp, Mus musculus
acgatgaaatcaaggaacaagcaat

SEQ ID NO: 180324 - DNA, 25 bp, Mus musculus
acgatgaaatcaaggaagactcttc

SEQ ID NO: 180325 - DNA, 25 bp, Mus musculus
acgatgaaatcaaggtaactatgga

SEQ ID NO: 180326 - DNA, 25 bp, Mus musculus
acgatgaacttggtaagttctcgtc

SEQ ID NO: 180327 - DNA, 25 bp, Mus musculus
acgatgacactgcaccatctgtggc

SEQ ID NO: 180328 - DNA, 25 bp, Mus musculus
acgatgacagctatgtccccagtga

SEQ ID NO: 180329 - DNA, 25 bp, Mus musculus
acgatgaccccagtgtcctttattt

SEQ ID NO: 180330 - DNA, 25 bp, Mus musculus
acgatgactcccctgcaactgtgca

SEQ ID NO: 180331 - DNA, 25 bp, Mus musculus
acgatgactgaggtgcttcaccttt

SEQ ID NO: 180332 - DNA, 25 bp, Mus musculus
acgatgagaaccggaagaaagccga

SEQ ID NO: 180333 - DNA, 25 bp, Mus musculus
acgatgagcactctagttctgacag

SEQ ID NO: 180334 - DNA, 25 bp, Mus musculus
acgatgagcactcttgtccctttaa

SEQ ID NO: 180335 - DNA, 25 bp, Mus musculus
acgatgaggacaatctcctcaactg

SEQ ID NO: 180336 - DNA, 25 bp, Mus musculus
acgatgaggaccaggtggtagttaa

SEQ ID NO: 180337 - DNA, 25 bp, Mus musculus
acgatgagtccaaattttatattgg

SEQ ID NO: 180338 - DNA, 25 bp, Mus musculus
acgatgagtccaagttctatattgg

SEQ ID NO: 180339 - DNA, 25 bp, Mus musculus
acgatgataaagagaaacttttagc

SEQ ID NO: 180340 - DNA, 25 bp, Mus musculus
acgatgataaagagatgagacctgc

SEQ ID NO: 180341 - DNA, 25 bp, Mus musculus
acgatgatattcaagcgtctgttgc

SEQ ID NO: 180342 - DNA, 25 bp, Mus musculus
acgatgatattcaaggaacagcgtc

SEQ ID NO: 180343 - DNA, 25 bp, Mus musculus
acgatgcacaggccatagaagccaa

SEQ ID NO: 180344 - DNA, 25 bp, Mus musculus
acgatgccatcagtgaatcaaagga

SEQ ID NO: 180345 - DNA, 25 bp, Mus musculus
acgatgcctctaaaaagccacaact

SEQ ID NO: 180346 - DNA, 25 bp, Mus musculus
acgatgcggagtacatgaagcacac

SEQ ID NO: 180347 - DNA, 25 bp, Mus musculus
acgatgctccagattctgtcccctc

SEQ ID NO: 180348 - DNA, 25 bp, Mus musculus
acgatgctccaggaggagcctgatc

SEQ ID NO: 180349 - DNA, 25 bp, Mus musculus
acgatgctgctacgaaatccatact

SEQ ID NO: 180350 - DNA, 25 bp, Mus musculus
acgatgctgctacgaggaggaagat

SEQ ID NO: 180351 - DNA, 25 bp, Mus musculus
acgatgcttgccagggtgacagtgg

SEQ ID NO: 180352 - DNA, 25 bp, Mus musculus
acgatgcttgccagtgggggaccgc

SEQ ID NO: 180353 - DNA, 25 bp, Mus musculus
acgatggaagcagaaaccagtgaca

SEQ ID NO: 180354 - DNA, 25 bp, Mus musculus
acgatggaagcagggaggctgcaaa

SEQ ID NO: 180355 - DNA, 25 bp, Mus musculus
acgatggaagctcagctgccaactc

SEQ ID NO: 180356 - DNA, 25 bp, Mus musculus
acgatggacccaggtaaacagttgc

SEQ ID NO: 180357 - DNA, 25 bp, Mus musculus
acgatggacccaggttactccagtg

SEQ ID NO: 180358 - DNA, 25 bp, Mus musculus
acgatggtgtgaagaaaagaaagtc

SEQ ID NO: 180359 - DNA, 25 bp, Mus musculus
acgatggtgtgaaggaatcttctga

SEQ ID NO: 180360 - DNA, 25 bp, Mus musculus
acgatgtaaccagcctcaggagtta

SEQ ID NO: 180361 - DNA, 25 bp, Mus musculus
acgatgtgctggatttccacttaaa

SEQ ID NO: 180362 - DNA, 25 bp, Mus musculus
acgatgtgtggaaattctctgcaca

SEQ ID NO: 180363 - DNA, 25 bp, Mus musculus
acgatgttaaagctgtctgctccca

SEQ ID NO: 180364 - DNA, 25 bp, Mus musculus
acgattacttaaaaagagtgtgtaa

SEQ ID NO: 180365 - DNA, 25 bp, Mus musculus
acgattactttgaataccctggagc

SEQ ID NO: 180366 - DNA, 25 bp, Mus musculus
acgattactttggccgttgtgcccg

SEQ ID NO: 180367 - DNA, 25 bp, Mus musculus
acgattcaagctcttgcttctagtg

SEQ ID NO: 180368 - DNA, 25 bp, Mus musculus
acgattcaaggaggagccccgaaca

SEQ ID NO: 180369 - DNA, 25 bp, Mus musculus
acgattcacgaggtcctgtaataaa

SEQ ID NO: 180370 - DNA, 25 bp, Mus musculus
acgattcagaggatcgacgagaatg

SEQ ID NO: 180371 - DNA, 25 bp, Mus musculus
acgattccatacctgtgttgcgtgg

SEQ ID NO: 180372 - DNA, 25 bp, Mus musculus
acgattccatgtatggcatttcaaa

SEQ ID NO: 180373 - DNA, 25 bp, Mus musculus
acgattccattgtgacaccatcacc

SEQ ID NO: 180374 - DNA, 25 bp, Mus musculus
acgattgatcacagttttcattgaa

SEQ ID NO: 180375 - DNA, 25 bp, Mus musculus
acgatttcagaatgctccccgggag

SEQ ID NO: 180376 - DNA, 25 bp, Mus musculus
acgatttctgatcgtctgccgtagt

SEQ ID NO: 180377 - DNA, 25 bp, Mus musculus
acgatttgtgaagatatagatgagt

SEQ ID NO: 180378 - DNA, 25 bp, Mus musculus
acgcaaaaagcaggcctgttgctgg

SEQ ID NO: 180379 - DNA, 25 bp, Mus musculus
acgcaaaagagtgtgaagattgctc

SEQ ID NO: 180380 - DNA, 25 bp, Mus musculus
acgcaaaaggagcaggtgcttttgg

SEQ ID NO: 180381 - DNA, 25 bp, Mus musculus
acgcaaaataataggaagaaggggc

SEQ ID NO: 180382 - DNA, 25 bp, Mus musculus
acgcaaaatagaacaggtagtagaa

SEQ ID NO: 180383 - DNA, 25 bp, Mus musculus
acgcaaaatagttgaaaaacatttt

SEQ ID NO: 180384 - DNA, 25 bp, Mus musculus
acgcaaacacaggtgaaaatctggt

SEQ ID NO: 180385 - DNA, 25 bp, Mus musculus
acgcaaagaggtaaatgatctgaaa

SEQ ID NO: 180386 - DNA, 25 bp, Mus musculus
acgcaaagagtaacttgtttgaatg

SEQ ID NO: 180387 - DNA, 25 bp, Mus musculus
acgcaaagtggccaggagcttgcaa

SEQ ID NO: 180388 - DNA, 25 bp, Mus musculus
acgcaacgtcatccccgctggcatt

SEQ ID NO: 180389 - DNA, 25 bp, Mus musculus
acgcaagaaatgtatatgcccccaa

SEQ ID NO: 180390 - DNA, 25 bp, Mus musculus
acgcaagaagaagaaggtgccatca

SEQ ID NO: 180391 - DNA, 25 bp, Mus musculus
acgcaagaagaagcaccccactggc

SEQ ID NO: 180392 - DNA, 25 bp, Mus musculus
acgcaaggaaatgcccggaaccgcg

SEQ ID NO: 180393 - DNA, 25 bp, Mus musculus
acgcaaggagctagactctgaggac

SEQ ID NO: 180394 - DNA, 25 bp, Mus musculus
acgcaaggagctagactctgagtac

SEQ ID NO: 180395 - DNA, 25 bp, Mus musculus
acgcaagtcgaaaagatatcccctg

SEQ ID NO: 180396 - DNA, 25 bp, Mus musculus
acgcaatctgagctgccgaacaaaa

SEQ ID NO: 180397 - DNA, 25 bp, Mus musculus
acgcaattcagtcaggatggctaaa

SEQ ID NO: 180398 - DNA, 25 bp, Mus musculus
acgcacaagacaagatctggagcac

SEQ ID NO: 180399 - DNA, 25 bp, Mus musculus
acgcacaatctcagaatggcttcac

SEQ ID NO: 180400 - DNA, 25 bp, Mus musculus
acgcacatggagagggctcctcgct

SEQ ID NO: 180401 - DNA, 25 bp, Mus musculus
acgcaccaaaggtgtgactttgagg

SEQ ID NO: 180402 - DNA, 25 bp, Mus musculus
acgcaccagctatagacccatgctt

SEQ ID NO: 180403 - DNA, 25 bp, Mus musculus
acgcaccagtcacagtttgtgggga

SEQ ID NO: 180404 - DNA, 25 bp, Mus musculus
acgcaccatacaggatactgggaac

SEQ ID NO: 180405 - DNA, 25 bp, Mus musculus
acgcacccttcagtacaagcccacc

SEQ ID NO: 180406 - DNA, 25 bp, Mus musculus
acgcaccgatggagggtccgaagta

SEQ ID NO: 180407 - DNA, 25 bp, Mus musculus
acgcaccggtaaaggtagctggagt

SEQ ID NO: 180408 - DNA, 25 bp, Mus musculus
acgcacctttggaaggttattatgt

SEQ ID NO: 180409 - DNA, 25 bp, Mus musculus
acgcacgaaaaacactctgtttcca

SEQ ID NO: 180410 - DNA, 25 bp, Mus musculus
acgcacgtctcagaaggtggacact

SEQ ID NO: 180411 - DNA, 25 bp, Mus musculus
acgcactcactgtcctgagagggtt

SEQ ID NO: 180412 - DNA, 25 bp, Mus musculus
acgcactgcaagaaaacgaggagga

SEQ ID NO: 180413 - DNA, 25 bp, Mus musculus
acgcactgcaagatctagatggcgc

SEQ ID NO: 180414 - DNA, 25 bp, Mus musculus
acgcagaagagactgagaggaatca

SEQ ID NO: 180415 - DNA, 25 bp, Mus musculus
acgcagaagagcctaccgaggacga

SEQ ID NO: 180416 - DNA, 25 bp, Mus musculus
acgcagaagagtttgactttggcga

SEQ ID NO: 180417 - DNA, 25 bp, Mus musculus
acgcagacagtggacatttggtccg

SEQ ID NO: 180418 - DNA, 25 bp, Mus musculus
acgcagactagcatttcagatctgc

SEQ ID NO: 180419 - DNA, 25 bp, Mus musculus
acgcagactcagcccgtcacaatca

SEQ ID NO: 180420 - DNA, 25 bp, Mus musculus
acgcagagaagggcccagtgtgcat

SEQ ID NO: 180421 - DNA, 25 bp, Mus musculus
acgcagagctgctcagggtgccgcc

SEQ ID NO: 180422 - DNA, 25 bp, Mus musculus
acgcagagctggctcccgcgtatgc

SEQ ID NO: 180423 - DNA, 25 bp, Mus musculus
acgcagagtctgtactcccacaatc

SEQ ID NO: 180424 - DNA, 25 bp, Mus musculus
acgcagatgaggattgagctccggg

SEQ ID NO: 180425 - DNA, 25 bp, Mus musculus
acgcagcacgccatcaatgatgatg

SEQ ID NO: 180426 - DNA, 25 bp, Mus musculus
acgcagcacgccgtatgtgcaggag

SEQ ID NO: 180427 - DNA, 25 bp, Mus musculus
acgcagcactggcaggtgcaggacg

SEQ ID NO: 180428 - DNA, 25 bp, Mus musculus
acgcagcactggcaggtgtcagcgg

SEQ ID NO: 180429 - DNA, 25 bp, Mus musculus
acgcagcatgcttccctagcgttta

SEQ ID NO: 180430 - DNA, 25 bp, Mus musculus
acgcagcatgggctccggctggaag

SEQ ID NO: 180431 - DNA, 25 bp, Mus musculus
acgcagccagagagggaaactgagg

SEQ ID NO: 180432 - DNA, 25 bp, Mus musculus
acgcagccagagcttgtccaggtga

SEQ ID NO: 180433 - DNA, 25 bp, Mus musculus
acgcagcccacacaggtgatccagc

SEQ ID NO: 180434 - DNA, 25 bp, Mus musculus
acgcagccgcaaagaatggctatac

SEQ ID NO: 180435 - DNA, 25 bp, Mus musculus
acgcagcctccaggaggcaaggatc

SEQ ID NO: 180436 - DNA, 25 bp, Mus musculus
acgcagccttcaggctcagttctga

SEQ ID NO: 180437 - DNA, 25 bp, Mus musculus
acgcagcgacacttgtccttcacac

SEQ ID NO: 180438 - DNA, 25 bp, Mus musculus
acgcagcgcgggccggtgtacattg

SEQ ID NO: 180439 - DNA, 25 bp, Mus musculus
acgcagcgctagcctaaattgtata

SEQ ID NO: 180440 - DNA, 25 bp, Mus musculus
acgcagcgctcgaaagaatagactt

SEQ ID NO: 180441 - DNA, 25 bp, Mus musculus
acgcagctgaaggtgatcaactggg

SEQ ID NO: 180442 - DNA, 25 bp, Mus musculus
acgcaggacatagaaattgcttttc

SEQ ID NO: 180443 - DNA, 25 bp, Mus musculus
acgcaggacataggttgaatgctat

SEQ ID NO: 180444 - DNA, 25 bp, Mus musculus
acgcaggagaagaaccaccaccaac

SEQ ID NO: 180445 - DNA, 25 bp, Mus musculus
acgcaggagaagcacatcatgcaac

SEQ ID NO: 180446 - DNA, 25 bp, Mus musculus
acgcaggagatggacttccagctgc

SEQ ID NO: 180447 - DNA, 25 bp, Mus musculus
acgcaggatgatgtctggcaggact

SEQ ID NO: 180448 - DNA, 25 bp, Mus musculus
acgcaggatggacctctctacgtca

SEQ ID NO: 180449 - DNA, 25 bp, Mus musculus
acgcaggatgtgtatccatcgagat

SEQ ID NO: 180450 - DNA, 25 bp, Mus musculus
acgcaggccaagttggtggaaggcc

SEQ ID NO: 180451 - DNA, 25 bp, Mus musculus
acgcaggctggctcaccatcatgga

SEQ ID NO: 180452 - DNA, 25 bp, Mus musculus
acgcagggagatcggctttgaattc

SEQ ID NO: 180453 - DNA, 25 bp, Mus musculus
acgcagtaggtcccttcccactgac

SEQ ID NO: 180454 - DNA, 25 bp, Mus musculus
acgcagtccgaggtcgccatggatc

SEQ ID NO: 180455 - DNA, 25 bp, Mus musculus
acgcagtctatgggacgcctcagaa

SEQ ID NO: 180456 - DNA, 25 bp, Mus musculus
acgcagtctgacctctacaagaaga

SEQ ID NO: 180457 - DNA, 25 bp, Mus musculus
acgcagtgtggcttgacctcagagg

SEQ ID NO: 180458 - DNA, 25 bp, Mus musculus
acgcataccggccaggtgtatgatg

SEQ ID NO: 180459 - DNA, 25 bp, Mus musculus
acgcatacctgtggcagcaccggga

SEQ ID NO: 180460 - DNA, 25 bp, Mus musculus
acgcatacctgtggtctcaccagct

SEQ ID NO: 180461 - DNA, 25 bp, Mus musculus
acgcatatctaccaggtaagattaa

SEQ ID NO: 180462 - DNA, 25 bp, Mus musculus
acgcatccctgcaggggcctgtgta

SEQ ID NO: 180463 - DNA, 25 bp, Mus musculus
acgcatcgagggggctacccgactc

SEQ ID NO: 180464 - DNA, 25 bp, Mus musculus
acgcatcttgcagaccatgctcaag

SEQ ID NO: 180465 - DNA, 25 bp, Mus musculus
acgcatgaaacggccttcctgggac

SEQ ID NO: 180466 - DNA, 25 bp, Mus musculus
acgcatgccaggttggcctgcttgg

SEQ ID NO: 180467 - DNA, 25 bp, Mus musculus
acgcatgcccagctcaagaagggga

SEQ ID NO: 180468 - DNA, 25 bp, Mus musculus
acgcatgcccaggctcctgctcctc

SEQ ID NO: 180469 - DNA, 25 bp, Mus musculus
acgcatgctggcgatgcccctagac

SEQ ID NO: 180470 - DNA, 25 bp, Mus musculus
acgcatggtgacatggtcccggaag

SEQ ID NO: 180471 - DNA, 25 bp, Mus musculus
acgcattcagccagaagacatgttt

SEQ ID NO: 180472 - DNA, 25 bp, Mus musculus
acgcattgaagtggtggaagaactg

SEQ ID NO: 180473 - DNA, 25 bp, Mus musculus
acgcatttctatcgcaggcacatca

SEQ ID NO: 180474 - DNA, 25 bp, Mus musculus
acgcatttctatcgcatgaagataa

SEQ ID NO: 180475 - DNA, 25 bp, Mus musculus
acgcatttctatcgggttcatagtg

SEQ ID NO: 180476 - DNA, 25 bp, Mus musculus
acgcatttctatcggtatccgcccc

SEQ ID NO: 180477 - DNA, 25 bp, Mus musculus
acgcatttggatgaggatggaagac

SEQ ID NO: 180478 - DNA, 25 bp, Mus musculus
acgcattttgccggaacccagataa

SEQ ID NO: 180479 - DNA, 25 bp, Mus musculus
acgcatttttgacagagctgtcgca

SEQ ID NO: 180480 - DNA, 25 bp, Mus musculus
acgccaaactctggtggataccctc

SEQ ID NO: 180481 - DNA, 25 bp, Mus musculus
acgccaaactctggttcttctggtt

SEQ ID NO: 180482 - DNA, 25 bp, Mus musculus
acgccaaagaaaaaggaagactcca

SEQ ID NO: 180483 - DNA, 25 bp, Mus musculus
acgccaaagagtggagttggagaaa

SEQ ID NO: 180484 - DNA, 25 bp, Mus musculus
acgccaaagagtggtgggcttatgc

SEQ ID NO: 180485 - DNA, 25 bp, Mus musculus
acgccaagaaatcattcatcgaccc

SEQ ID NO: 180486 - DNA, 25 bp, Mus musculus
acgccaagaaatccaggaagtaaga

SEQ ID NO: 180487 - DNA, 25 bp, Mus musculus
acgccaagactatgcgcaagaaagg

SEQ ID NO: 180488 - DNA, 25 bp, Mus musculus
acgccaaggagtgggtatggaggag

SEQ ID NO: 180489 - DNA, 25 bp, Mus musculus
acgccaatgaaacttccatagagac

SEQ ID NO: 180490 - DNA, 25 bp, Mus musculus
acgccaatgaaagctcaaaacattc

SEQ ID NO: 180491 - DNA, 25 bp, Mus musculus
acgccaatgaaagctgacttaaaaa

SEQ ID NO: 180492 - DNA, 25 bp, Mus musculus
acgccaatgtgtccgacttcccgga

SEQ ID NO: 180493 - DNA, 25 bp, Mus musculus
acgccacaggactacagtgggagtg

SEQ ID NO: 180494 - DNA, 25 bp, Mus musculus
acgccactaaatagtgaggatgacc

SEQ ID NO: 180495 - DNA, 25 bp, Mus musculus
acgccacttgaccaaatgtgatctt

SEQ ID NO: 180496 - DNA, 25 bp, Mus musculus
acgccagaagaagcgagtacttact

SEQ ID NO: 180497 - DNA, 25 bp, Mus musculus
acgccagcaccttctgcttcccgga

SEQ ID NO: 180498 - DNA, 25 bp, Mus musculus
acgccagcctctgaaactagacacc

SEQ ID NO: 180499 - DNA, 25 bp, Mus musculus
acgccagcttagagtgcgatgcggt

SEQ ID NO: 180500 - DNA, 25 bp, Mus musculus
acgccagggccaggtcctgtgcgca

SEQ ID NO: 180501 - DNA, 25 bp, Mus musculus
acgccaggtcgtggggttgtgctgg

SEQ ID NO: 180502 - DNA, 25 bp, Mus musculus
acgccagtggagaagatctcttcac

SEQ ID NO: 180503 - DNA, 25 bp, Mus musculus
acgccagtggctgtttacctgatgt

SEQ ID NO: 180504 - DNA, 25 bp, Mus musculus
acgccagtgggttcttctgtgaccc

SEQ ID NO: 180505 - DNA, 25 bp, Mus musculus
acgccagtttagaggtctttcagca

SEQ ID NO: 180506 - DNA, 25 bp, Mus musculus
acgccagtttagaggttatctggaa

SEQ ID NO: 180507 - DNA, 25 bp, Mus musculus
acgccatcaaacaggttactatgaa

SEQ ID NO: 180508 - DNA, 25 bp, Mus musculus
acgccatcaaacagtcaaaatatct

SEQ ID NO: 180509 - DNA, 25 bp, Mus musculus
acgccatcatcggagaagcttctga

SEQ ID NO: 180510 - DNA, 25 bp, Mus musculus
acgccatcatcggcgctggcgagaa

SEQ ID NO: 180511 - DNA, 25 bp, Mus musculus
acgccatccagggtggagcttttga

SEQ ID NO: 180512 - DNA, 25 bp, Mus musculus
acgccatccaggtccctaagccttt

SEQ ID NO: 180513 - DNA, 25 bp, Mus musculus
acgccatgactttggcaccaggaag

SEQ ID NO: 180514 - DNA, 25 bp, Mus musculus
acgccatgcacggagttgtgggacc

SEQ ID NO: 180515 - DNA, 25 bp, Mus musculus
acgccatgccaggtatgcaggacat

SEQ ID NO: 180516 - DNA, 25 bp, Mus musculus
acgccatgccaggtgtgtttgatca

SEQ ID NO: 180517 - DNA, 25 bp, Mus musculus
acgccatggctgacaagatcctgag

SEQ ID NO: 180518 - DNA, 25 bp, Mus musculus
acgccatgggctggcgccaccctca

SEQ ID NO: 180519 - DNA, 25 bp, Mus musculus
acgccatgtatgtttccaccggctc

SEQ ID NO: 180520 - DNA, 25 bp, Mus musculus
acgcccaagaaaggtggcaggagat

SEQ ID NO: 180521 - DNA, 25 bp, Mus musculus
acgcccaaggaccacctaccctggt

SEQ ID NO: 180522 - DNA, 25 bp, Mus musculus
acgcccacccaggaaatcctgaaga

SEQ ID NO: 180523 - DNA, 25 bp, Mus musculus
acgcccacccaggaatccatcagca

SEQ ID NO: 180524 - DNA, 25 bp, Mus musculus
acgcccagaagcaggtactctatct

SEQ ID NO: 180525 - DNA, 25 bp, Mus musculus
acgcccagccctgagggccatggcg

SEQ ID NO: 180526 - DNA, 25 bp, Mus musculus
acgcccaggccggtcccggatgttg

SEQ ID NO: 180527 - DNA, 25 bp, Mus musculus
acgcccaggcgtagaccccgactgc

SEQ ID NO: 180528 - DNA, 25 bp, Mus musculus
acgcccaggtcaaggactatgagaa

SEQ ID NO: 180529 - DNA, 25 bp, Mus musculus
acgcccaggtcaaggagtccatgaa

SEQ ID NO: 180530 - DNA, 25 bp, Mus musculus
acgcccaggtcaaggatgataatgg

SEQ ID NO: 180531 - DNA, 25 bp, Mus musculus
acgcccattcaggtgcgctgctcag

SEQ ID NO: 180532 - DNA, 25 bp, Mus musculus
acgccccaaagagggtcttgagagc

SEQ ID NO: 180533 - DNA, 25 bp, Mus musculus
acgccccacaaagaattccagaggc

SEQ ID NO: 180534 - DNA, 25 bp, Mus musculus
acgccccatacacaggggtctgtat

SEQ ID NO: 180535 - DNA, 25 bp, Mus musculus
acgcccccggatgatggtcactttg

SEQ ID NO: 180536 - DNA, 25 bp, Mus musculus
acgccccgcaagactttcctttgcc

SEQ ID NO: 180537 - DNA, 25 bp, Mus musculus
acgccccggctgccctcaaagcgga

SEQ ID NO: 180538 - DNA, 25 bp, Mus musculus
acgcccgccagccaggttgcaagtg

SEQ ID NO: 180539 - DNA, 25 bp, Mus musculus
acgcccgccgagcagagaacggcag

SEQ ID NO: 180540 - DNA, 25 bp, Mus musculus
acgcccgccgagcaggaagttctga

SEQ ID NO: 180541 - DNA, 25 bp, Mus musculus
acgcccggacctcagcagaaatctc

SEQ ID NO: 180542 - DNA, 25 bp, Mus musculus
acgcccggacctcaggtctctgcct

SEQ ID NO: 180543 - DNA, 25 bp, Mus musculus
acgcccggttagcagcccttggcga

SEQ ID NO: 180544 - DNA, 25 bp, Mus musculus
acgcccggttagcagctgccgccct

SEQ ID NO: 180545 - DNA, 25 bp, Mus musculus
acgcccgttcacgatcctcagcgta

SEQ ID NO: 180546 - DNA, 25 bp, Mus musculus
acgccctcaccaatgagctgagcaa

SEQ ID NO: 180547 - DNA, 25 bp, Mus musculus
acgccctcaccaatgcctctgcagg

SEQ ID NO: 180548 - DNA, 25 bp, Mus musculus
acgccctctgatgtgaaagagctgg

SEQ ID NO: 180549 - DNA, 25 bp, Mus musculus
acgcccttccaggtgactggttatc

SEQ ID NO: 180550 - DNA, 25 bp, Mus musculus
acgcccttgctcctgcttgcttccc

SEQ ID NO: 180551 - DNA, 25 bp, Mus musculus
acgcccttgctcctggaggcagtga

SEQ ID NO: 180552 - DNA, 25 bp, Mus musculus
acgccgagaagaaggaactcggaga

SEQ ID NO: 180553 - DNA, 25 bp, Mus musculus
acgccgatccggtaatatccttgtt

SEQ ID NO: 180554 - DNA, 25 bp, Mus musculus
acgccgcacagccgggttccatgat

SEQ ID NO: 180555 - DNA, 25 bp, Mus musculus
acgccgcacagccggtgctggagac

SEQ ID NO: 180556 - DNA, 25 bp, Mus musculus
acgccgccagagacggcaaagagga

SEQ ID NO: 180557 - DNA, 25 bp, Mus musculus
acgccgccttggggcatcatgacac

SEQ ID NO: 180558 - DNA, 25 bp, Mus musculus
acgccgcgaggatctaagatgtcca

SEQ ID NO: 180559 - DNA, 25 bp, Mus musculus
acgccgcggcagccagtcccgctcg

SEQ ID NO: 180560 - DNA, 25 bp, Mus musculus
acgccgcggggagaccatgagaagg

SEQ ID NO: 180561 - DNA, 25 bp, Mus musculus
acgccgcggggatccacctgatggc

SEQ ID NO: 180562 - DNA, 25 bp, Mus musculus
acgccgctccgatccctacgtgaaa

SEQ ID NO: 180563 - DNA, 25 bp, Mus musculus
acgccgctctcagaacccaggaagc

SEQ ID NO: 180564 - DNA, 25 bp, Mus musculus
acgccgctctcaggtcaaatctaag

SEQ ID NO: 180565 - DNA, 25 bp, Mus musculus
acgccggaagatgatgccagaccag

SEQ ID NO: 180566 - DNA, 25 bp, Mus musculus
acgccggagcagggtccccagaagc

SEQ ID NO: 180567 - DNA, 25 bp, Mus musculus
acgccggcccgtgtggatctgcagc

SEQ ID NO: 180568 - DNA, 25 bp, Mus musculus
acgccggccgccgtccccagtgacc

SEQ ID NO: 180569 - DNA, 25 bp, Mus musculus
acgccggcttggtgcctgttccgga

SEQ ID NO: 180570 - DNA, 25 bp, Mus musculus
acgccgggaaaggtaatgatgtggg

SEQ ID NO: 180571 - DNA, 25 bp, Mus musculus
acgccgggactcggggctgagcagc

SEQ ID NO: 180572 - DNA, 25 bp, Mus musculus
acgccgggactcgggggacaggcac

SEQ ID NO: 180573 - DNA, 25 bp, Mus musculus
acgccgggcctcaggcctcagcatt

SEQ ID NO: 180574 - DNA, 25 bp, Mus musculus
acgccgggcctcagtcttatgacct

SEQ ID NO: 180575 - DNA, 25 bp, Mus musculus
acgccggggtgacggtggtcaacat

SEQ ID NO: 180576 - DNA, 25 bp, Mus musculus
acgccggtggagggtcaggatggct

SEQ ID NO: 180577 - DNA, 25 bp, Mus musculus
acgccggtggagggtgtcccctgca

SEQ ID NO: 180578 - DNA, 25 bp, Mus musculus
acgccggtggaggtcgactggccag

SEQ ID NO: 180579 - DNA, 25 bp, Mus musculus
acgccgtccaagaggccattgtgag

SEQ ID NO: 180580 - DNA, 25 bp, Mus musculus
acgccgttccctttgcatcactggc

SEQ ID NO: 180581 - DNA, 25 bp, Mus musculus
acgcctaaaaaaggtctgtgcacca

SEQ ID NO: 180582 - DNA, 25 bp, Mus musculus
acgcctacagcttcctggtggctga

SEQ ID NO: 180583 - DNA, 25 bp, Mus musculus
acgcctacgaagccgatttttggga

SEQ ID NO: 180584 - DNA, 25 bp, Mus musculus
acgcctacgaagccgtgacactgat

SEQ ID NO: 180585 - DNA, 25 bp, Mus musculus
acgcctatcaccagctcctcaggtt

SEQ ID NO: 180586 - DNA, 25 bp, Mus musculus
acgcctatcaccagttatcctacct

SEQ ID NO: 180587 - DNA, 25 bp, Mus musculus
acgcctcaagcacttgtctctgcat

SEQ ID NO: 180588 - DNA, 25 bp, Mus musculus
acgcctcaagggttgagacatccct

SEQ ID NO: 180589 - DNA, 25 bp, Mus musculus
acgcctcagcagaacaaaccaaaga

SEQ ID NO: 180590 - DNA, 25 bp, Mus musculus
acgcctcagctgcacactgccccat

SEQ ID NO: 180591 - DNA, 25 bp, Mus musculus
acgcctccacggggtttgacttcat

SEQ ID NO: 180592 - DNA, 25 bp, Mus musculus
acgcctcccccggcccacaatgtcc

SEQ ID NO: 180593 - DNA, 25 bp, Mus musculus
acgcctctagtaaccctgacctcag

SEQ ID NO: 180594 - DNA, 25 bp, Mus musculus
acgcctctcatggtcgctgtcttaa

SEQ ID NO: 180595 - DNA, 25 bp, Mus musculus
acgcctctgctcagcctgaaggact

SEQ ID NO: 180596 - DNA, 25 bp, Mus musculus
acgcctctgggaaacctaaatgttt

SEQ ID NO: 180597 - DNA, 25 bp, Mus musculus
acgcctgaacggctccaggactggg

SEQ ID NO: 180598 - DNA, 25 bp, Mus musculus
acgcctgaagaggacatggatgaca

SEQ ID NO: 180599 - DNA, 25 bp, Mus musculus
acgcctgacattatcctggatgact

SEQ ID NO: 180600 - DNA, 25 bp, Mus musculus
acgcctgcagagcccacatggtgga

SEQ ID NO: 180601 - DNA, 25 bp, Mus musculus
acgcctgcagtgctgtgaagagctt

SEQ ID NO: 180602 - DNA, 25 bp, Mus musculus
acgcctgcatcatggtatttgatgt

SEQ ID NO: 180603 - DNA, 25 bp, Mus musculus
acgcctgcctggggaatgaattcca

SEQ ID NO: 180604 - DNA, 25 bp, Mus musculus
acgcctgctcggtcagtcagcagtg

SEQ ID NO: 180605 - DNA, 25 bp, Mus musculus
acgcctgctcgtgtgtataagctgc

SEQ ID NO: 180606 - DNA, 25 bp, Mus musculus
acgcctgctgcagctggacccaaca

SEQ ID NO: 180607 - DNA, 25 bp, Mus musculus
acgcctggagagaggagcaccgtga

SEQ ID NO: 180608 - DNA, 25 bp, Mus musculus
acgcctgtgaggtctgtgcattttc

SEQ ID NO: 180609 - DNA, 25 bp, Mus musculus
acgccttcaggaaggcagcctccta

SEQ ID NO: 180610 - DNA, 25 bp, Mus musculus
acgccttccccagctgggccgcgag

SEQ ID NO: 180611 - DNA, 25 bp, Mus musculus
acgccttcccgaactacgctgccat

SEQ ID NO: 180612 - DNA, 25 bp, Mus musculus
acgccttcttctgggagaagtttga

SEQ ID NO: 180613 - DNA, 25 bp, Mus musculus
acgcctttgagatggctgtctcaaa

SEQ ID NO: 180614 - DNA, 25 bp, Mus musculus
acgcctttgaggtcttgctgatcct

SEQ ID NO: 180615 - DNA, 25 bp, Mus musculus
acgccttttatgcatcttggcatgg

SEQ ID NO: 180616 - DNA, 25 bp, Mus musculus
acgcgaaagcaggtccccagcctgg

SEQ ID NO: 180617 - DNA, 25 bp, Mus musculus
acgcgaagtctgtgattcgtaagac

SEQ ID NO: 180618 - DNA, 25 bp, Mus musculus
acgcgacgcgcggaggaaaacttgg

SEQ ID NO: 180619 - DNA, 25 bp, Mus musculus
acgcgactcagtaattggcaactgg

SEQ ID NO: 180620 - DNA, 25 bp, Mus musculus
acgcgaggaggaggccctgcgggcg

SEQ ID NO: 180621 - DNA, 25 bp, Mus musculus
acgcgaggtcttcgaaagaaccaag

SEQ ID NO: 180622 - DNA, 25 bp, Mus musculus
acgcgaggtcttcggccttcccagg

SEQ ID NO: 180623 - DNA, 25 bp, Mus musculus
acgcgataggtacagttctgacaca

SEQ ID NO: 180624 - DNA, 25 bp, Mus musculus
acgcgatttacgaaatctaccagag

SEQ ID NO: 180625 - DNA, 25 bp, Mus musculus
acgcgcacaagaaatatggggtgtg

SEQ ID NO: 180626 - DNA, 25 bp, Mus musculus
acgcgcacctgccggctgcgaccga

SEQ ID NO: 180627 - DNA, 25 bp, Mus musculus
acgcgcagaactgggattgtctttc

SEQ ID NO: 180628 - DNA, 25 bp, Mus musculus
acgcgcagaactgggggatgcagag

SEQ ID NO: 180629 - DNA, 25 bp, Mus musculus
acgcgcagaactggttcttccccag

SEQ ID NO: 180630 - DNA, 25 bp, Mus musculus
acgcgcagctctacccactccgagc

SEQ ID NO: 180631 - DNA, 25 bp, Mus musculus
acgcgcatggagtacgtgtttgact

SEQ ID NO: 180632 - DNA, 25 bp, Mus musculus
acgcgccacacctggccgccgccgc

SEQ ID NO: 180633 - DNA, 25 bp, Mus musculus
acgcgccagggaatggacctgtcag

SEQ ID NO: 180634 - DNA, 25 bp, Mus musculus
acgcgcccacgccggtgtctgcagc

SEQ ID NO: 180635 - DNA, 25 bp, Mus musculus
acgcgcccacgccgtatatcaaggc

SEQ ID NO: 180636 - DNA, 25 bp, Mus musculus
acgcgcccaggcgaggcactgggct

SEQ ID NO: 180637 - DNA, 25 bp, Mus musculus
acgcgccctcagatgtcacctgtac

SEQ ID NO: 180638 - DNA, 25 bp, Mus musculus
acgcgccctcagtgggaagatgccc

SEQ ID NO: 180639 - DNA, 25 bp, Mus musculus
acgcgccgcggccttagaagaaatc

SEQ ID NO: 180640 - DNA, 25 bp, Mus musculus
acgcgccgcggctccatgttctacg

SEQ ID NO: 180641 - DNA, 25 bp, Mus musculus
acgcgcctcagagtttgctattgcg

SEQ ID NO: 180642 - DNA, 25 bp, Mus musculus
acgcgcctcaggtagcactttgtat

SEQ ID NO: 180643 - DNA, 25 bp, Mus musculus
acgcgcctcgataaggaaaagggga

SEQ ID NO: 180644 - DNA, 25 bp, Mus musculus
acgcgcctctgtaaaacccagaacc

SEQ ID NO: 180645 - DNA, 25 bp, Mus musculus
acgcgcctttccctctggagccccc

SEQ ID NO: 180646 - DNA, 25 bp, Mus musculus
acgcgcctttcctctctggagagca

SEQ ID NO: 180647 - DNA, 25 bp, Mus musculus
acgcgcctttctccaccccaggcct

SEQ ID NO: 180648 - DNA, 25 bp, Mus musculus
acgcgcggaggaaaacttggttatg

SEQ ID NO: 180649 - DNA, 25 bp, Mus musculus
acgcgcggcgcggagcttagcagat

SEQ ID NO: 180650 - DNA, 25 bp, Mus musculus
acgcgcggcgcggagtcacattagc

SEQ ID NO: 180651 - DNA, 25 bp, Mus musculus
acgcgcggggaagagtcttgcgctc

SEQ ID NO: 180652 - DNA, 25 bp, Mus musculus
acgcgcgtagtgattgaggatggtg

SEQ ID NO: 180653 - DNA, 25 bp, Mus musculus
acgcgctccgtcaagaatccggaga

SEQ ID NO: 180654 - DNA, 25 bp, Mus musculus
acgcgctccgtcaaggtgtcggacg

SEQ ID NO: 180655 - DNA, 25 bp, Mus musculus
acgcgcttgccgacccttcccggct

SEQ ID NO: 180656 - DNA, 25 bp, Mus musculus
acgcgctttggaggtgacaaacttg

SEQ ID NO: 180657 - DNA, 25 bp, Mus musculus
acgcggaaagagaactagatcagtt

SEQ ID NO: 180658 - DNA, 25 bp, Mus musculus
acgcggaaccggagctggactggcc

SEQ ID NO: 180659 - DNA, 25 bp, Mus musculus
acgcggacggacccctggacttcgt

SEQ ID NO: 180660 - DNA, 25 bp, Mus musculus
acgcggacggacttgatgtggatga

SEQ ID NO: 180661 - DNA, 25 bp, Mus musculus
acgcggagagtagattggatccagt

SEQ ID NO: 180662 - DNA, 25 bp, Mus musculus
acgcggagcccgagggctactcttc

SEQ ID NO: 180663 - DNA, 25 bp, Mus musculus
acgcggagggccgcaacaccaagaa

SEQ ID NO: 180664 - DNA, 25 bp, Mus musculus
acgcggatgagcatcaccctggaat

SEQ ID NO: 180665 - DNA, 25 bp, Mus musculus
acgcggcaaagcagctcctggagga

SEQ ID NO: 180666 - DNA, 25 bp, Mus musculus
acgcggcacagcccatgcagcctgc

SEQ ID NO: 180667 - DNA, 25 bp, Mus musculus
acgcggcacagccccctgcgggtgt

SEQ ID NO: 180668 - DNA, 25 bp, Mus musculus
acgcggcataggccttcagaagtat

SEQ ID NO: 180669 - DNA, 25 bp, Mus musculus
acgcggccagcggggacaatcccag

SEQ ID NO: 180670 - DNA, 25 bp, Mus musculus
acgcggccagcgggttcccgaggag

SEQ ID NO: 180671 - DNA, 25 bp, Mus musculus
acgcggccctgcagatcaccagcaa

SEQ ID NO: 180672 - DNA, 25 bp, Mus musculus
acgcggccctgcaggagtgactagc

SEQ ID NO: 180673 - DNA, 25 bp, Mus musculus
acgcggcgacaggtcttctacttac

SEQ ID NO: 180674 - DNA, 25 bp, Mus musculus
acgcggcgcggggagagttaagaat

SEQ ID NO: 180675 - DNA, 25 bp, Mus musculus
acgcggcgctgcggagagctcagag

SEQ ID NO: 180676 - DNA, 25 bp, Mus musculus
acgcggcgctgcggcaatgccaagt

SEQ ID NO: 180677 - DNA, 25 bp, Mus musculus
acgcggcggcccgacgctgcggcca

SEQ ID NO: 180678 - DNA, 25 bp, Mus musculus
acgcggcgttctgatgagtgaccca

SEQ ID NO: 180679 - DNA, 25 bp, Mus musculus
acgcggcgttctggttttttgcatt

SEQ ID NO: 180680 - DNA, 25 bp, Mus musculus
acgcggctcggcctggtgtctccaa

SEQ ID NO: 180681 - DNA, 25 bp, Mus musculus
acgcggctgccaaaagcggaggcca

SEQ ID NO: 180682 - DNA, 25 bp, Mus musculus
acgcggctggttggcgagaatctgc

SEQ ID NO: 180683 - DNA, 25 bp, Mus musculus
acgcggctggttgggaatgtgacta

SEQ ID NO: 180684 - DNA, 25 bp, Mus musculus
acgcgggaccccgagatcgccgggg

SEQ ID NO: 180685 - DNA, 25 bp, Mus musculus
acgcgggacgggcccagttctgcgc

SEQ ID NO: 180686 - DNA, 25 bp, Mus musculus
acgcgggacggggcttctgacccca

SEQ ID NO: 180687 - DNA, 25 bp, Mus musculus
acgcgggagaggtaaggctgacctc

SEQ ID NO: 180688 - DNA, 25 bp, Mus musculus
acgcgggagagttttctctgtcatc

SEQ ID NO: 180689 - DNA, 25 bp, Mus musculus
acgcgggattccggtcacagtttgc

SEQ ID NO: 180690 - DNA, 25 bp, Mus musculus
acgcgggcactcaggttcgagtgac

SEQ ID NO: 180691 - DNA, 25 bp, Mus musculus
acgcgggcagcagcttggcaaatgg

SEQ ID NO: 180692 - DNA, 25 bp, Mus musculus
acgcgggcagcaggtcactacgttc

SEQ ID NO: 180693 - DNA, 25 bp, Mus musculus
acgcgggcagcagtgacagccctgc

SEQ ID NO: 180694 - DNA, 25 bp, Mus musculus
acgcgggccatcctggccctcatct

SEQ ID NO: 180695 - DNA, 25 bp, Mus musculus
acgcggggaaatggactcagtggct

SEQ ID NO: 180696 - DNA, 25 bp, Mus musculus
acgcggggatcagggcagagatggc

SEQ ID NO: 180697 - DNA, 25 bp, Mus musculus
acgcggtcagaactgtgccggatca

SEQ ID NO: 180698 - DNA, 25 bp, Mus musculus
acgcggtggactgggcgctggagag

SEQ ID NO: 180699 - DNA, 25 bp, Mus musculus
acgcggttgcaggaattggccaacg

SEQ ID NO: 180700 - DNA, 25 bp, Mus musculus
acgcgtcagaggtccctctgtcacc

SEQ ID NO: 180701 - DNA, 25 bp, Mus musculus
acgcgtctggagcaggtgtgccaca

SEQ ID NO: 180702 - DNA, 25 bp, Mus musculus
acgcgtgcgcagactttcctcttca

SEQ ID NO: 180703 - DNA, 25 bp, Mus musculus
acgcgtgtgtggagttcaccttcca

SEQ ID NO: 180704 - DNA, 25 bp, Mus musculus
acgcgtgtgtggtgttcaccttcca

SEQ ID NO: 180705 - DNA, 25 bp, Mus musculus
acgcgttcattccggctagccctgc

SEQ ID NO: 180706 - DNA, 25 bp, Mus musculus
acgcgttgctggtacaattaccaga

SEQ ID NO: 180707 - DNA, 25 bp, Mus musculus
acgcgttttcctcaggcgcagacac

SEQ ID NO: 180708 - DNA, 25 bp, Mus musculus
acgctaacccaggagaacgtcagct

SEQ ID NO: 180709 - DNA, 25 bp, Mus musculus
acgctaacccctctcctccataagc

SEQ ID NO: 180710 - DNA, 25 bp, Mus musculus
acgctaagaaaggaccctcaacacc

SEQ ID NO: 180711 - DNA, 25 bp, Mus musculus
acgctacacgactggcccagatgga

SEQ ID NO: 180712 - DNA, 25 bp, Mus musculus
acgctaccaggttcccagtcttctc

SEQ ID NO: 180713 - DNA, 25 bp, Mus musculus
acgctacggaatgaagctacccagc

SEQ ID NO: 180714 - DNA, 25 bp, Mus musculus
acgctactcagggatgttcccttct

SEQ ID NO: 180715 - DNA, 25 bp, Mus musculus
acgctactctgggcctcaggagttc

SEQ ID NO: 180716 - DNA, 25 bp, Mus musculus
acgctacttagccccaaccatactt

SEQ ID NO: 180717 - DNA, 25 bp, Mus musculus
acgctacttaggtgatgcaagaaga

SEQ ID NO: 180718 - DNA, 25 bp, Mus musculus
acgctagcactaacgtgaccctggc

SEQ ID NO: 180719 - DNA, 25 bp, Mus musculus
acgctagcactaactgacctgggcc

SEQ ID NO: 180720 - DNA, 25 bp, Mus musculus
acgctagtcagggacaagaagacct

SEQ ID NO: 180721 - DNA, 25 bp, Mus musculus
acgctattgtgaggatgaagtttct

SEQ ID NO: 180722 - DNA, 25 bp, Mus musculus
acgctcaaacacagctcaaagatta

SEQ ID NO: 180723 - DNA, 25 bp, Mus musculus
acgctcaccagctgatggttcctgg

SEQ ID NO: 180724 - DNA, 25 bp, Mus musculus
acgctcagagagggggaggcatgag

SEQ ID NO: 180725 - DNA, 25 bp, Mus musculus
acgctcagaggttttctctttttac

SEQ ID NO: 180726 - DNA, 25 bp, Mus musculus
acgctcagccatgaagatgagggtg

SEQ ID NO: 180727 - DNA, 25 bp, Mus musculus
acgctcagtggcagcactccgccag

SEQ ID NO: 180728 - DNA, 25 bp, Mus musculus
acgctcatcctccccctcaagttca

SEQ ID NO: 180729 - DNA, 25 bp, Mus musculus
acgctccaaaaaaggcaaattgaag

SEQ ID NO: 180730 - DNA, 25 bp, Mus musculus
acgctccagaggctttgctgacgga

SEQ ID NO: 180731 - DNA, 25 bp, Mus musculus
acgctccagagtgtgcactctcctc

SEQ ID NO: 180732 - DNA, 25 bp, Mus musculus
acgctccagcatagccccacggcct

SEQ ID NO: 180733 - DNA, 25 bp, Mus musculus
acgctccccaaggaggtattcccca

SEQ ID NO: 180734 - DNA, 25 bp, Mus musculus
acgctcccccttagacactactttg

SEQ ID NO: 180735 - DNA, 25 bp, Mus musculus
acgctcctgcgcgcgcccggcctgg

SEQ ID NO: 180736 - DNA, 25 bp, Mus musculus
acgctcgatgcggccaaagagatgt

SEQ ID NO: 180737 - DNA, 25 bp, Mus musculus
acgctcgatgcgggtggtaggaatg

SEQ ID NO: 180738 - DNA, 25 bp, Mus musculus
acgctcgatgcgttcacaatcttct

SEQ ID NO: 180739 - DNA, 25 bp, Mus musculus
acgctcggcccaggataagtacggt

SEQ ID NO: 180740 - DNA, 25 bp, Mus musculus
acgctctaatacagactcagccatg

SEQ ID NO: 180741 - DNA, 25 bp, Mus musculus
acgctctaatacagtggcttctttc

SEQ ID NO: 180742 - DNA, 25 bp, Mus musculus
acgctctacacgatgcggccgaaag

SEQ ID NO: 180743 - DNA, 25 bp, Mus musculus
acgctctacacgtatgaagtacaca

SEQ ID NO: 180744 - DNA, 25 bp, Mus musculus
acgctctcaaggccgagtacaacag

SEQ ID NO: 180745 - DNA, 25 bp, Mus musculus
acgctctcaaggtatagtcctagca

SEQ ID NO: 180746 - DNA, 25 bp, Mus musculus
acgctctgagaagtactctcaagtt

SEQ ID NO: 180747 - DNA, 25 bp, Mus musculus
acgctctgagaatgtatgactcggt

SEQ ID NO: 180748 - DNA, 25 bp, Mus musculus
acgctctgccctgattccttctgga

SEQ ID NO: 180749 - DNA, 25 bp, Mus musculus
acgctctgggaccggattcccgaag

SEQ ID NO: 180750 - DNA, 25 bp, Mus musculus
acgctctgtcatccgaaaactccag

SEQ ID NO: 180751 - DNA, 25 bp, Mus musculus
acgctctgtcatccgccctagcaca

SEQ ID NO: 180752 - DNA, 25 bp, Mus musculus
acgctgaagaagatcggtcagcacc

SEQ ID NO: 180753 - DNA, 25 bp, Mus musculus
acgctgaagaagattcgccggtaca

SEQ ID NO: 180754 - DNA, 25 bp, Mus musculus
acgctgaagcaggcttccagccagc

SEQ ID NO: 180755 - DNA, 25 bp, Mus musculus
acgctgaagcaggtcataaagcccc

SEQ ID NO: 180756 - DNA, 25 bp, Mus musculus
acgctgaatgtcatgtatttcaaca

SEQ ID NO: 180757 - DNA, 25 bp, Mus musculus
acgctgacagacgaggtaaacagcc

SEQ ID NO: 180758 - DNA, 25 bp, Mus musculus
acgctgacattcagagttgaaactg

SEQ ID NO: 180759 - DNA, 25 bp, Mus musculus
acgctgacattcaggtgcagtcttt

SEQ ID NO: 180760 - DNA, 25 bp, Mus musculus
acgctgacgggctgacaggcgagct

SEQ ID NO: 180761 - DNA, 25 bp, Mus musculus
acgctgacggggtggaggagctacg

SEQ ID NO: 180762 - DNA, 25 bp, Mus musculus
acgctgactgctgcggacaagtttt

SEQ ID NO: 180763 - DNA, 25 bp, Mus musculus
acgctgactttgagaagctgaagcc

SEQ ID NO: 180764 - DNA, 25 bp, Mus musculus
acgctgagaatccagatccagggtt

SEQ ID NO: 180765 - DNA, 25 bp, Mus musculus
acgctgagaatccaggtctcccgga

SEQ ID NO: 180766 - DNA, 25 bp, Mus musculus
acgctgagattaaaggcctctgggg

SEQ ID NO: 180767 - DNA, 25 bp, Mus musculus
acgctgaggaagccgccactggaga

SEQ ID NO: 180768 - DNA, 25 bp, Mus musculus
acgctgaggtggtatataaccgttc

SEQ ID NO: 180769 - DNA, 25 bp, Mus musculus
acgctgatgaccctgactatatagt

SEQ ID NO: 180770 - DNA, 25 bp, Mus musculus
acgctgatgaccgacccttgggtag

SEQ ID NO: 180771 - DNA, 25 bp, Mus musculus
acgctgatgcagacggagaagcagt

SEQ ID NO: 180772 - DNA, 25 bp, Mus musculus
acgctgatggcagtgaagacaaagt

SEQ ID NO: 180773 - DNA, 25 bp, Mus musculus
acgctgatggcggtgaagacaaagt

SEQ ID NO: 180774 - DNA, 25 bp, Mus musculus
acgctgatggtgaagatcccataca

SEQ ID NO: 180775 - DNA, 25 bp, Mus musculus
acgctgatgtgggtgtagcactcct

SEQ ID NO: 180776 - DNA, 25 bp, Mus musculus
acgctgcacgatagtatgaccggtt

SEQ ID NO: 180777 - DNA, 25 bp, Mus musculus
acgctgcatgaactggagaatttga

SEQ ID NO: 180778 - DNA, 25 bp, Mus musculus
acgctgccataatgaagaagaagta

SEQ ID NO: 180779 - DNA, 25 bp, Mus musculus
acgctgcccaagcgccggagtactg

SEQ ID NO: 180780 - DNA, 25 bp, Mus musculus
acgctgccggccatcgtcgttcttg

SEQ ID NO: 180781 - DNA, 25 bp, Mus musculus
acgctgccgggtctcttccactgta

SEQ ID NO: 180782 - DNA, 25 bp, Mus musculus
acgctgccgtgtacccctccacaca

SEQ ID NO: 180783 - DNA, 25 bp, Mus musculus
acgctgcctcagcaagccccgccca

SEQ ID NO: 180784 - DNA, 25 bp, Mus musculus
acgctgcctggacagcattgccgcc

SEQ ID NO: 180785 - DNA, 25 bp, Mus musculus
acgctgcctggacaggggctcttta

SEQ ID NO: 180786 - DNA, 25 bp, Mus musculus
acgctgcgaggaagagccctgggga

SEQ ID NO: 180787 - DNA, 25 bp, Mus musculus
acgctgcgccaaattttcacctgac

SEQ ID NO: 180788 - DNA, 25 bp, Mus musculus
acgctgcgcgagaggaatgcgctca

SEQ ID NO: 180789 - DNA, 25 bp, Mus musculus
acgctgcgcgagagtatgtcttggc

SEQ ID NO: 180790 - DNA, 25 bp, Mus musculus
acgctgctgagataggacgggagaa

SEQ ID NO: 180791 - DNA, 25 bp, Mus musculus
acgctgctgagcttcacctggttca

SEQ ID NO: 180792 - DNA, 25 bp, Mus musculus
acgctgctgcctctgattggccttg

SEQ ID NO: 180793 - DNA, 25 bp, Mus musculus
acgctgctgcctgtattgaccaaga

SEQ ID NO: 180794 - DNA, 25 bp, Mus musculus
acgctgctgcgagaggccaaggtga

SEQ ID NO: 180795 - DNA, 25 bp, Mus musculus
acgctgctgtgcagctttttagaac

SEQ ID NO: 180796 - DNA, 25 bp, Mus musculus
acgctgcttcggtggtgtagtggag

SEQ ID NO: 180797 - DNA, 25 bp, Mus musculus
acgctggaatctggccctggttctg

SEQ ID NO: 180798 - DNA, 25 bp, Mus musculus
acgctggaatctgtgggcgggcagc

SEQ ID NO: 180799 - DNA, 25 bp, Mus musculus
acgctggagcagaagaataaagaga

SEQ ID NO: 180800 - DNA, 25 bp, Mus musculus
acgctggagcagaaggataaacaaa

SEQ ID NO: 180801 - DNA, 25 bp, Mus musculus
acgctggcactgaggtttgggaacc

SEQ ID NO: 180802 - DNA, 25 bp, Mus musculus
acgctggcagacaccactaactgta

SEQ ID NO: 180803 - DNA, 25 bp, Mus musculus
acgctggccactggtttatatccag

SEQ ID NO: 180804 - DNA, 25 bp, Mus musculus
acgctggccagacagctgcagcacg

SEQ ID NO: 180805 - DNA, 25 bp, Mus musculus
acgctggccagataaggctagccct

SEQ ID NO: 180806 - DNA, 25 bp, Mus musculus
acgctggccagctgcctcaccctgc

SEQ ID NO: 180807 - DNA, 25 bp, Mus musculus
acgctggccaggtattgttagaact

SEQ ID NO: 180808 - DNA, 25 bp, Mus musculus
acgctggctctctcttggcctgttg

SEQ ID NO: 180809 - DNA, 25 bp, Mus musculus
acgctgggagagcagcgggaacttc

SEQ ID NO: 180810 - DNA, 25 bp, Mus musculus
acgctgggagagcaggaggtgtaaa

SEQ ID NO: 180811 - DNA, 25 bp, Mus musculus
acgctggtgctgccccacacctctg

SEQ ID NO: 180812 - DNA, 25 bp, Mus musculus
acgctggtgctgcccccggccagcc

SEQ ID NO: 180813 - DNA, 25 bp, Mus musculus
acgctggtgctggggtcctttatgg

SEQ ID NO: 180814 - DNA, 25 bp, Mus musculus
acgctgtaaacagagactcacttct

SEQ ID NO: 180815 - DNA, 25 bp, Mus musculus
acgctgtcctgtggaggtgtaaaga

SEQ ID NO: 180816 - DNA, 25 bp, Mus musculus
acgctgtgacagatctgagcactga

SEQ ID NO: 180817 - DNA, 25 bp, Mus musculus
acgctgtgacagcacctccgtccga

SEQ ID NO: 180818 - DNA, 25 bp, Mus musculus
acgctgtgctgaatgagcaacataa

SEQ ID NO: 180819 - DNA, 25 bp, Mus musculus
acgctgtggaactgtttgaaggctt

SEQ ID NO: 180820 - DNA, 25 bp, Mus musculus
acgctgtggtgcggctgtgtggcac

SEQ ID NO: 180821 - DNA, 25 bp, Mus musculus
acgctgtgtcctgaggatctttcca

SEQ ID NO: 180822 - DNA, 25 bp, Mus musculus
acgctgtgtcctgagtatcccaggc

SEQ ID NO: 180823 - DNA, 25 bp, Mus musculus
acgctgttaagagttcacatgagac

SEQ ID NO: 180824 - DNA, 25 bp, Mus musculus
acgctgttgccgtgacctttgcaga

SEQ ID NO: 180825 - DNA, 25 bp, Mus musculus
acgcttacggactaggccagcaggt

SEQ ID NO: 180826 - DNA, 25 bp, Mus musculus
acgcttacggactagggccctgcac

SEQ ID NO: 180827 - DNA, 25 bp, Mus musculus
acgcttacggactaggtggccatca

SEQ ID NO: 180828 - DNA, 25 bp, Mus musculus
acgcttcaaatggatagtcacatgc

SEQ ID NO: 180829 - DNA, 25 bp, Mus musculus
acgcttcaaggcgcaacctggtgga

SEQ ID NO: 180830 - DNA, 25 bp, Mus musculus
acgcttcccggagagccttacgaga

SEQ ID NO: 180831 - DNA, 25 bp, Mus musculus
acgcttcccggagcacttggaatct

SEQ ID NO: 180832 - DNA, 25 bp, Mus musculus
acgcttccgatccttacctcgtgag

SEQ ID NO: 180833 - DNA, 25 bp, Mus musculus
acgcttcctagcagaggaaaagaag

SEQ ID NO: 180834 - DNA, 25 bp, Mus musculus
acgcttcctagcaggagtgatgatg

SEQ ID NO: 180835 - DNA, 25 bp, Mus musculus
acgcttcctcataaggtcacgttca

SEQ ID NO: 180836 - DNA, 25 bp, Mus musculus
acgcttcctgaagggatgggctctt

SEQ ID NO: 180837 - DNA, 25 bp, Mus musculus
acgcttctataaacctgactctaga

SEQ ID NO: 180838 - DNA, 25 bp, Mus musculus
acgcttctattaaaccgggaggcct

SEQ ID NO: 180839 - DNA, 25 bp, Mus musculus
acgcttctgaaggagacccagcatg

SEQ ID NO: 180840 - DNA, 25 bp, Mus musculus
acgcttctgaaggagccggcatgac

SEQ ID NO: 180841 - DNA, 25 bp, Mus musculus
acgcttcttgccagtttattaacag

SEQ ID NO: 180842 - DNA, 25 bp, Mus musculus
acgcttgccacactgtgaccctaaa

SEQ ID NO: 180843 - DNA, 25 bp, Mus musculus
acgcttgcgttcgggaagatgctgg

SEQ ID NO: 180844 - DNA, 25 bp, Mus musculus
acgcttggaaagcaaatgcaatagg

SEQ ID NO: 180845 - DNA, 25 bp, Mus musculus
acgcttggaaagttgtccagtctgg

SEQ ID NO: 180846 - DNA, 25 bp, Mus musculus
acgcttgtccggcctctgtagagct

SEQ ID NO: 180847 - DNA, 25 bp, Mus musculus
acgcttgtccgggcgggttgaggcg

SEQ ID NO: 180848 - DNA, 25 bp, Mus musculus
acgctttgaagaagatgaagaggtg

SEQ ID NO: 180849 - DNA, 25 bp, Mus musculus
acgctttggatgagtgtgaactgga

SEQ ID NO: 180850 - DNA, 25 bp, Mus musculus
acgctttggatggctcccggacctc

SEQ ID NO: 180851 - DNA, 25 bp, Mus musculus
acgctttggatggtgatgatgaaga

SEQ ID NO: 180852 - DNA, 25 bp, Mus musculus
acgctttggatgtgccttcggaggc

SEQ ID NO: 180853 - DNA, 25 bp, Mus musculus
acgctttggccccaaacccatgcgt

SEQ ID NO: 180854 - DNA, 25 bp, Mus musculus
acgcttttgccagacaagcagtgaa

SEQ ID NO: 180855 - DNA, 25 bp, Mus musculus
acgcttttgccaggtgatggaaaac

SEQ ID NO: 180856 - DNA, 25 bp, Mus musculus
acggaaaaacaagagttactcacaa

SEQ ID NO: 180857 - DNA, 25 bp, Mus musculus
acggaaaaaggttttgacgcatctg

SEQ ID NO: 180858 - DNA, 25 bp, Mus musculus
acggaaaaatggaagtatagtcttt

SEQ ID NO: 180859 - DNA, 25 bp, Mus musculus
acggaaaaatgtgctccagctgagg

SEQ ID NO: 180860 - DNA, 25 bp, Mus musculus
acggaaaaccagagtccagcctctg

SEQ ID NO: 180861 - DNA, 25 bp, Mus musculus
acggaaatatcagttactactcaac

SEQ ID NO: 180862 - DNA, 25 bp, Mus musculus
acggaaatcaaggattcttaatcac

SEQ ID NO: 180863 - DNA, 25 bp, Mus musculus
acggaaatctagtgttctccagttt

SEQ ID NO: 180864 - DNA, 25 bp, Mus musculus
acggaaatgatcagcctcagtccga

SEQ ID NO: 180865 - DNA, 25 bp, Mus musculus
acggaaccaaggtggctatggcggt

SEQ ID NO: 180866 - DNA, 25 bp, Mus musculus
acggaactacagggtccaactgagc

SEQ ID NO: 180867 - DNA, 25 bp, Mus musculus
acggaactcgatgagcctgtttgag

SEQ ID NO: 180868 - DNA, 25 bp, Mus musculus
acggaactcgctaagccgggcaagt

SEQ ID NO: 180869 - DNA, 25 bp, Mus musculus
acggaactcgtgaatgataccaatg

SEQ ID NO: 180870 - DNA, 25 bp, Mus musculus
acggaacttggaccgcagccctctg

SEQ ID NO: 180871 - DNA, 25 bp, Mus musculus
acggaacttggaccggaactgtccg

SEQ ID NO: 180872 - DNA, 25 bp, Mus musculus
acggaagaagaacatcagaaagcct

SEQ ID NO: 180873 - DNA, 25 bp, Mus musculus
acggaagaatcgggcagctcagtgg

SEQ ID NO: 180874 - DNA, 25 bp, Mus musculus
acggaagacacggagtatatatcct

SEQ ID NO: 180875 - DNA, 25 bp, Mus musculus
acggaagatgcaagatgcagagaga

SEQ ID NO: 180876 - DNA, 25 bp, Mus musculus
acggaagatgtcagttcatatggag

SEQ ID NO: 180877 - DNA, 25 bp, Mus musculus
acggaagcaaggaaaatccaattgt

SEQ ID NO: 180878 - DNA, 25 bp, Mus musculus
acggaagccatggcaggacaaagag

SEQ ID NO: 180879 - DNA, 25 bp, Mus musculus
acggaagccgcagtggtggaggtgg

SEQ ID NO: 180880 - DNA, 25 bp, Mus musculus
acggaagctgagccagacccagggg

SEQ ID NO: 180881 - DNA, 25 bp, Mus musculus
acggaagctgatcctcttcccagct

SEQ ID NO: 180882 - DNA, 25 bp, Mus musculus
acggaagcttggtaatgcaggtggt

SEQ ID NO: 180883 - DNA, 25 bp, Mus musculus
acggaaggaaaagaatgtggagaag

SEQ ID NO: 180884 - DNA, 25 bp, Mus musculus
acggaagtacccggacagagagaga

SEQ ID NO: 180885 - DNA, 25 bp, Mus musculus
acggaagtgacacaatgaatcgcac

SEQ ID NO: 180886 - DNA, 25 bp, Mus musculus
acggaagtgacagaatgaatcgcac

SEQ ID NO: 180887 - DNA, 25 bp, Mus musculus
acggaagttggttgctgcatcccag

SEQ ID NO: 180888 - DNA, 25 bp, Mus musculus
acggaataggggtcgaggatgtcag

SEQ ID NO: 180889 - DNA, 25 bp, Mus musculus
acggaatccagatggtgaactgaag

SEQ ID NO: 180890 - DNA, 25 bp, Mus musculus
acggaatccaggagtacaagaactg

SEQ ID NO: 180891 - DNA, 25 bp, Mus musculus
acggaatccaggcacatggatacac

SEQ ID NO: 180892 - DNA, 25 bp, Mus musculus
acggaatcgcaacaaactgacaaga

SEQ ID NO: 180893 - DNA, 25 bp, Mus musculus
acggaatcgcaaggacagatccaga

SEQ ID NO: 180894 - DNA, 25 bp, Mus musculus
acggaatgacaaagaattactgact

SEQ ID NO: 180895 - DNA, 25 bp, Mus musculus
acggaatgacttgtgtgcaaacaag

SEQ ID NO: 180896 - DNA, 25 bp, Mus musculus
acggaatggcggaagatataacaga

SEQ ID NO: 180897 - DNA, 25 bp, Mus musculus
acggaattaaactaggcctgaggag

SEQ ID NO: 180898 - DNA, 25 bp, Mus musculus
acggacacataactggctctgtcca

SEQ ID NO: 180899 - DNA, 25 bp, Mus musculus
acggacaccgggattatgtccctgt

SEQ ID NO: 180900 - DNA, 25 bp, Mus musculus
acggacagccagatgccaaagctgg

SEQ ID NO: 180901 - DNA, 25 bp, Mus musculus
acggacagccagcaggcgtctgtat

SEQ ID NO: 180902 - DNA, 25 bp, Mus musculus
acggacagcgcgctttggatccgcc

SEQ ID NO: 180903 - DNA, 25 bp, Mus musculus
acggacagcggcacagccgagcctt

SEQ ID NO: 180904 - DNA, 25 bp, Mus musculus
acggacaggaggcgttgtctgtctt

SEQ ID NO: 180905 - DNA, 25 bp, Mus musculus
acggacaggaggggagaagagacgt

SEQ ID NO: 180906 - DNA, 25 bp, Mus musculus
acggacataaatattcttgtagaca

SEQ ID NO: 180907 - DNA, 25 bp, Mus musculus
acggacattcagggcttcctgaaga

SEQ ID NO: 180908 - DNA, 25 bp, Mus musculus
acggaccaaatggaatgaataaaat

SEQ ID NO: 180909 - DNA, 25 bp, Mus musculus
acggaccaccagagcctgtactcct

SEQ ID NO: 180910 - DNA, 25 bp, Mus musculus
acggaccatgcgaatgttcggagcg

SEQ ID NO: 180911 - DNA, 25 bp, Mus musculus
acggacccaaagaggtctctcacct

SEQ ID NO: 180912 - DNA, 25 bp, Mus musculus
acggacccaaagaggtgtgaggtta

SEQ ID NO: 180913 - DNA, 25 bp, Mus musculus
acggacccgatgtgcgcattaaaga

SEQ ID NO: 180914 - DNA, 25 bp, Mus musculus
acggacccgatgtggctcttaagga

SEQ ID NO: 180915 - DNA, 25 bp, Mus musculus
acggaccctggacaaatgtcccttc

SEQ ID NO: 180916 - DNA, 25 bp, Mus musculus
acggaccctggacaagttaatcgat

SEQ ID NO: 180917 - DNA, 25 bp, Mus musculus
acggaccctgggagcctacttccag

SEQ ID NO: 180918 - DNA, 25 bp, Mus musculus
acggacggttcagaccatgacaccc

SEQ ID NO: 180919 - DNA, 25 bp, Mus musculus
acggactgaaggcagatcatgcctg

SEQ ID NO: 180920 - DNA, 25 bp, Mus musculus
acggactgacgctgcacctggtgga

SEQ ID NO: 180921 - DNA, 25 bp, Mus musculus
acggactgaggaaaacaaaaatcat

SEQ ID NO: 180922 - DNA, 25 bp, Mus musculus
acggactggaggcgccagcccctcc

SEQ ID NO: 180923 - DNA, 25 bp, Mus musculus
acggagacagggagttctcagatgc

SEQ ID NO: 180924 - DNA, 25 bp, Mus musculus
acggagacatgaggatgcagagaga

SEQ ID NO: 180925 - DNA, 25 bp, Mus musculus
acggagaccgaggaggcccagccag

SEQ ID NO: 180926 - DNA, 25 bp, Mus musculus
acggagactccagatgaggacgatg

SEQ ID NO: 180927 - DNA, 25 bp, Mus musculus
acggagactccaggccacaatggag

SEQ ID NO: 180928 - DNA, 25 bp, Mus musculus
acggagactgaggatgaggctgtag

SEQ ID NO: 180929 - DNA, 25 bp, Mus musculus
acggagacttcagaatcaagatgtg

SEQ ID NO: 180930 - DNA, 25 bp, Mus musculus
acggagagaactcagaacatacaac

SEQ ID NO: 180931 - DNA, 25 bp, Mus musculus
acggagagaactcagcagagcaccc

SEQ ID NO: 180932 - DNA, 25 bp, Mus musculus
acggagagaactcagctcatggcag

SEQ ID NO: 180933 - DNA, 25 bp, Mus musculus
acggagagaactcaggccaggaaca

SEQ ID NO: 180934 - DNA, 25 bp, Mus musculus
acggagagagcgtcgtatacaacgt

SEQ ID NO: 180935 - DNA, 25 bp, Mus musculus
acggagagaggaggacagttactac

SEQ ID NO: 180936 - DNA, 25 bp, Mus musculus
acggagagaggagggagatggtgtt

SEQ ID NO: 180937 - DNA, 25 bp, Mus musculus
acggagagatagatctagctagtga

SEQ ID NO: 180938 - DNA, 25 bp, Mus musculus
acggagagattttatacaagctgta

SEQ ID NO: 180939 - DNA, 25 bp, Mus musculus
acggagagattttatgagaggctgt

SEQ ID NO: 180940 - DNA, 25 bp, Mus musculus
acggagaggagggagggagccatca

SEQ ID NO: 180941 - DNA, 25 bp, Mus musculus
acggagatgctgagagctctggtgt

SEQ ID NO: 180942 - DNA, 25 bp, Mus musculus
acggagatgctgagctgtcgatgcc

SEQ ID NO: 180943 - DNA, 25 bp, Mus musculus
acggagattagcggagccaggtatg

SEQ ID NO: 180944 - DNA, 25 bp, Mus musculus
acggagcagatcaatgaaattggag

SEQ ID NO: 180945 - DNA, 25 bp, Mus musculus
acggagcagtctggcatgctcccaa

SEQ ID NO: 180946 - DNA, 25 bp, Mus musculus
acggagcatgagccagatatactgc

SEQ ID NO: 180947 - DNA, 25 bp, Mus musculus
acggagcatggttggagcctctctg

SEQ ID NO: 180948 - DNA, 25 bp, Mus musculus
acggagccaccccagacccaagaat

SEQ ID NO: 180949 - DNA, 25 bp, Mus musculus
acggagccagcatgaatcagctgcc

SEQ ID NO: 180950 - DNA, 25 bp, Mus musculus
acggagccagcatgccttcctgggc

SEQ ID NO: 180951 - DNA, 25 bp, Mus musculus
acggagccagcatgctcgtcaaggt

SEQ ID NO: 180952 - DNA, 25 bp, Mus musculus
acggagccagccatgagaagttgct

SEQ ID NO: 180953 - DNA, 25 bp, Mus musculus
acggagccagcggatgaagctaccc

SEQ ID NO: 180954 - DNA, 25 bp, Mus musculus
acggagccagttttataggtagaat

SEQ ID NO: 180955 - DNA, 25 bp, Mus musculus
acggagccgcgcgtgtctccacaga

SEQ ID NO: 180956 - DNA, 25 bp, Mus musculus
acggagcgactcgatcccctgaact

SEQ ID NO: 180957 - DNA, 25 bp, Mus musculus
acggagcgactcgttctgcctcccc

SEQ ID NO: 180958 - DNA, 25 bp, Mus musculus
acggagctcgtaccctacgggctgt

SEQ ID NO: 180959 - DNA, 25 bp, Mus musculus
acggagctgggctgcctgcctgcct

SEQ ID NO: 180960 - DNA, 25 bp, Mus musculus
acggagctggtgggaggagtgaagg

SEQ ID NO: 180961 - DNA, 25 bp, Mus musculus
acggagctgtccaatgacgaagctg

SEQ ID NO: 180962 - DNA, 25 bp, Mus musculus
acggagctgtccaatttttggcctt

SEQ ID NO: 180963 - DNA, 25 bp, Mus musculus
acggaggagaaggaactatcccctc

SEQ ID NO: 180964 - DNA, 25 bp, Mus musculus
acggaggagaagtctggacagagga

SEQ ID NO: 180965 - DNA, 25 bp, Mus musculus
acggaggagtaagacgtcgcctcat

SEQ ID NO: 180966 - DNA, 25 bp, Mus musculus
acggaggatgaggatgaggaagaga

SEQ ID NO: 180967 - DNA, 25 bp, Mus musculus
acggaggatgtcccgcatggttcga

SEQ ID NO: 180968 - DNA, 25 bp, Mus musculus
acggaggcagcatctgcatctctaa

SEQ ID NO: 180969 - DNA, 25 bp, Mus musculus
acggaggcgagcgggcttggctgag

SEQ ID NO: 180970 - DNA, 25 bp, Mus musculus
acggaggctgagatcactggagatt

SEQ ID NO: 180971 - DNA, 25 bp, Mus musculus
acggagggcactaaatcgtcctggg

SEQ ID NO: 180972 - DNA, 25 bp, Mus musculus
acggagggcagtaaatcgtcctggg

SEQ ID NO: 180973 - DNA, 25 bp, Mus musculus
acggagggcatgagcctcaagatgg

SEQ ID NO: 180974 - DNA, 25 bp, Mus musculus
acggagggcatgagcgggactcgcc

SEQ ID NO: 180975 - DNA, 25 bp, Mus musculus
acggaggggaggaaatgagaaagat

SEQ ID NO: 180976 - DNA, 25 bp, Mus musculus
acggaggggaggaagatggcactgg

SEQ ID NO: 180977 - DNA, 25 bp, Mus musculus
acggaggggaggaagcctagccgcc

SEQ ID NO: 180978 - DNA, 25 bp, Mus musculus
acggaggggaggaaggcatcccccg

SEQ ID NO: 180979 - DNA, 25 bp, Mus musculus
acggaggggccccgcggcagactcc

SEQ ID NO: 180980 - DNA, 25 bp, Mus musculus
acggaggtagtcttgtcctgggtgg

SEQ ID NO: 180981 - DNA, 25 bp, Mus musculus
acggagtaagtgaggtccagggagg

SEQ ID NO: 180982 - DNA, 25 bp, Mus musculus
acggagtaagtgagtcctttcaggt

SEQ ID NO: 180983 - DNA, 25 bp, Mus musculus
acggagtagcaaaggaatgggacag

SEQ ID NO: 180984 - DNA, 25 bp, Mus musculus
acggagtagcaaaggttcagcctat

SEQ ID NO: 180985 - DNA, 25 bp, Mus musculus
acggagtcaagagccttcgtgagcc

SEQ ID NO: 180986 - DNA, 25 bp, Mus musculus
acggagtcaagaggttctccccaat

SEQ ID NO: 180987 - DNA, 25 bp, Mus musculus
acggagtcaagagtcccctgtcgct

SEQ ID NO: 180988 - DNA, 25 bp, Mus musculus
acggagtcagaactgggctcttcac

SEQ ID NO: 180989 - DNA, 25 bp, Mus musculus
acggagtccccagtgaaagcagaag

SEQ ID NO: 180990 - DNA, 25 bp, Mus musculus
acggagtctccgggaacgtgccaat

SEQ ID NO: 180991 - DNA, 25 bp, Mus musculus
acggagtctccggggatgaattgtc

SEQ ID NO: 180992 - DNA, 25 bp, Mus musculus
acggagtctggcaggagtgctcacc

SEQ ID NO: 180993 - DNA, 25 bp, Mus musculus
acggagtggactgctggatccctct

SEQ ID NO: 180994 - DNA, 25 bp, Mus musculus
acggagtgtctcgctgtcactgagc

SEQ ID NO: 180995 - DNA, 25 bp, Mus musculus
acggagtgtgatcgtttggaaaacg

SEQ ID NO: 180996 - DNA, 25 bp, Mus musculus
acggagttctggaagaccgctgccg

SEQ ID NO: 180997 - DNA, 25 bp, Mus musculus
acggagttggtgaatgataccaatg

SEQ ID NO: 180998 - DNA, 25 bp, Mus musculus
acggatacgcggcgagccggtgtga

SEQ ID NO: 180999 - DNA, 25 bp, Mus musculus
acggatacgcggcggcgcctgtgtc

SEQ ID NO: 181000 - DNA, 25 bp, Mus musculus
acggatagacgtcaggtggccatca

SEQ ID NO: 181001 - DNA, 25 bp, Mus musculus
acggatagcagacactacaagaagc

SEQ ID NO: 181002 - DNA, 25 bp, Mus musculus
acggatagggagttcttccccagag

SEQ ID NO: 181003 - DNA, 25 bp, Mus musculus
acggatatgagaagtcaaactacaa

SEQ ID NO: 181004 - DNA, 25 bp, Mus musculus
acggatccagaaggaactgactgat

SEQ ID NO: 181005 - DNA, 25 bp, Mus musculus
acggatccagaaggttgctttcact

SEQ ID NO: 181006 - DNA, 25 bp, Mus musculus
acggatctcagataataaccaaaga

SEQ ID NO: 181007 - DNA, 25 bp, Mus musculus
acggatctgtgattataaaagcttt

SEQ ID NO: 181008 - DNA, 25 bp, Mus musculus
acggatgatctagtttgtttggtgt

SEQ ID NO: 181009 - DNA, 25 bp, Mus musculus
acggatgattcagagccccagggct

SEQ ID NO: 181010 - DNA, 25 bp, Mus musculus
acggatgcggatgccatgaagtaca

SEQ ID NO: 181011 - DNA, 25 bp, Mus musculus
acggatgctggagctctcttgagtc

SEQ ID NO: 181012 - DNA, 25 bp, Mus musculus
acggatggaagtgtcatctgccagg

SEQ ID NO: 181013 - DNA, 25 bp, Mus musculus
acggatggaggaatcacttggacct

SEQ ID NO: 181014 - DNA, 25 bp, Mus musculus
acggatggaggaggagacaacaagg

SEQ ID NO: 181015 - DNA, 25 bp, Mus musculus
acggatggcacaggagctgatacaa

SEQ ID NO: 181016 - DNA, 25 bp, Mus musculus
acggatgtcagggaggtataagtgc

SEQ ID NO: 181017 - DNA, 25 bp, Mus musculus
acggatgttaaggagagggcgcgag

SEQ ID NO: 181018 - DNA, 25 bp, Mus musculus
acggatgttaaggtgccaagtcggg

SEQ ID NO: 181019 - DNA, 25 bp, Mus musculus
acggatgttcaagacgcaagtggga

SEQ ID NO: 181020 - DNA, 25 bp, Mus musculus
acggattcctcctcaagtactacag

SEQ ID NO: 181021 - DNA, 25 bp, Mus musculus
acggattcctggtgggtattgtgca

SEQ ID NO: 181022 - DNA, 25 bp, Mus musculus
acggattccttatggatcgcagctc

SEQ ID NO: 181023 - DNA, 25 bp, Mus musculus
acggattttaaagagttgattccag

SEQ ID NO: 181024 - DNA, 25 bp, Mus musculus
acggcaaaaaatgtaacatttcact

SEQ ID NO: 181025 - DNA, 25 bp, Mus musculus
acggcaaaaaatgttggtttgccat

SEQ ID NO: 181026 - DNA, 25 bp, Mus musculus
acggcaaaatgagccgcacggaagg

SEQ ID NO: 181027 - DNA, 25 bp, Mus musculus
acggcaacactgggtaacctccgtg

SEQ ID NO: 181028 - DNA, 25 bp, Mus musculus
acggcaacagatttctttctttctt

SEQ ID NO: 181029 - DNA, 25 bp, Mus musculus
acggcaacaggcctgatgggattgg

SEQ ID NO: 181030 - DNA, 25 bp, Mus musculus
acggcaagtacctggcttcctgtgt

SEQ ID NO: 181031 - DNA, 25 bp, Mus musculus
acggcaagtacctggtctggtcact

SEQ ID NO: 181032 - DNA, 25 bp, Mus musculus
acggcaagtgctggaacacctgctg

SEQ ID NO: 181033 - DNA, 25 bp, Mus musculus
acggcacactgaaaagatccgcttc

SEQ ID NO: 181034 - DNA, 25 bp, Mus musculus
acggcacactgatgagcgcccctac

SEQ ID NO: 181035 - DNA, 25 bp, Mus musculus
acggcacagtgcttgctgaatttca

SEQ ID NO: 181036 - DNA, 25 bp, Mus musculus
acggcaccaaactactaaaggtgtt

SEQ ID NO: 181037 - DNA, 25 bp, Mus musculus
acggcaccaaactccatagattgta

SEQ ID NO: 181038 - DNA, 25 bp, Mus musculus
acggcaccaaactgcttgatttaaa

SEQ ID NO: 181039 - DNA, 25 bp, Mus musculus
acggcaccatggcgtttatgtttga

SEQ ID NO: 181040 - DNA, 25 bp, Mus musculus
acggcacccagtaatctttggaaac

SEQ ID NO: 181041 - DNA, 25 bp, Mus musculus
acggcacctcgacacgtgtgcaaaa

SEQ ID NO: 181042 - DNA, 25 bp, Mus musculus
acggcacctcggctggaaccctgat

SEQ ID NO: 181043 - DNA, 25 bp, Mus musculus
acggcacgccacaggactacagtgg

SEQ ID NO: 181044 - DNA, 25 bp, Mus musculus
acggcactacggatgatctgagaat

SEQ ID NO: 181045 - DNA, 25 bp, Mus musculus
acggcactacgggttccaatattga

SEQ ID NO: 181046 - DNA, 25 bp, Mus musculus
acggcactgcgctcttggaatttga

SEQ ID NO: 181047 - DNA, 25 bp, Mus musculus
acggcagagcaggatgcccggggca

SEQ ID NO: 181048 - DNA, 25 bp, Mus musculus
acggcagatgataatgttcactttc

SEQ ID NO: 181049 - DNA, 25 bp, Mus musculus
acggcagatgtggtacacggatgaa

SEQ ID NO: 181050 - DNA, 25 bp, Mus musculus
acggcagctggaaccaccatctggg

SEQ ID NO: 181051 - DNA, 25 bp, Mus musculus
acggcagctggcctcctatgctgct

SEQ ID NO: 181052 - DNA, 25 bp, Mus musculus
acggcaggaactaaatcttccatcc

SEQ ID NO: 181053 - DNA, 25 bp, Mus musculus
acggcaggagagcctgtgtcctgac

SEQ ID NO: 181054 - DNA, 25 bp, Mus musculus
acggcaggagagggctgtagcagtg

SEQ ID NO: 181055 - DNA, 25 bp, Mus musculus
acggcaggattcacgttggtgacca

SEQ ID NO: 181056 - DNA, 25 bp, Mus musculus
acggcaggcatccgggtgatcatgg

SEQ ID NO: 181057 - DNA, 25 bp, Mus musculus
acggcagtactggcaccttctccac

SEQ ID NO: 181058 - DNA, 25 bp, Mus musculus
acggcagtactggtcctaaccgtag

SEQ ID NO: 181059 - DNA, 25 bp, Mus musculus
acggcatcacaaggccatcgccacg

SEQ ID NO: 181060 - DNA, 25 bp, Mus musculus
acggcatcacactatggagtgttcc

SEQ ID NO: 181061 - DNA, 25 bp, Mus musculus
acggcatcaggcgcagatagatcat

SEQ ID NO: 181062 - DNA, 25 bp, Mus musculus
acggcatctataatgtcacccagag

SEQ ID NO: 181063 - DNA, 25 bp, Mus musculus
acggcatctatgcggagctgacccg

SEQ ID NO: 181064 - DNA, 25 bp, Mus musculus
acggcatctatgtacgtgccctgga

SEQ ID NO: 181065 - DNA, 25 bp, Mus musculus
acggcatgcagaggaatctggggtc

SEQ ID NO: 181066 - DNA, 25 bp, Mus musculus
acggcatgcagggtgtgtctgcagc

SEQ ID NO: 181067 - DNA, 25 bp, Mus musculus
acggcatgtacgctaacttgggtat

SEQ ID NO: 181068 - DNA, 25 bp, Mus musculus
acggccaaagcacatgctccatttg

SEQ ID NO: 181069 - DNA, 25 bp, Mus musculus
acggccaagaagaacaaagctgtat

SEQ ID NO: 181070 - DNA, 25 bp, Mus musculus
acggccaagaagaactttcattttc

SEQ ID NO: 181071 - DNA, 25 bp, Mus musculus
acggccaagcatcaggtgtggaggg

SEQ ID NO: 181072 - DNA, 25 bp, Mus musculus
acggccacattgattttcctcgcat

SEQ ID NO: 181073 - DNA, 25 bp, Mus musculus
acggccacattgccctgtcagcctc

SEQ ID NO: 181074 - DNA, 25 bp, Mus musculus
acggccacgggcgaggacctatatc

SEQ ID NO: 181075 - DNA, 25 bp, Mus musculus
acggccacgtgagagggtcgttgct

SEQ ID NO: 181076 - DNA, 25 bp, Mus musculus
acggccacgtgagaggttggtacta

SEQ ID NO: 181077 - DNA, 25 bp, Mus musculus
acggccagatgcctgggccgatgat

SEQ ID NO: 181078 - DNA, 25 bp, Mus musculus
acggccagatgcctgggcctaacca

SEQ ID NO: 181079 - DNA, 25 bp, Mus musculus
acggccagcgggagaccgggtccca

SEQ ID NO: 181080 - DNA, 25 bp, Mus musculus
acggccaggaatggacatttggtca

SEQ ID NO: 181081 - DNA, 25 bp, Mus musculus
acggccaggacgacggcccttcaaa

SEQ ID NO: 181082 - DNA, 25 bp, Mus musculus
acggccatcccagccaatggcagcc

SEQ ID NO: 181083 - DNA, 25 bp, Mus musculus
acggccatcccagccaccctgggcg

SEQ ID NO: 181084 - DNA, 25 bp, Mus musculus
acggccatcctcaggtgagactttc

SEQ ID NO: 181085 - DNA, 25 bp, Mus musculus
acggccatcctcaggtgtgtggtag

SEQ ID NO: 181086 - DNA, 25 bp, Mus musculus
acggccatggggtctgtgacagcag

SEQ ID NO: 181087 - DNA, 25 bp, Mus musculus
acggcccaagcctactcgcccagcc

SEQ ID NO: 181088 - DNA, 25 bp, Mus musculus
acggcccaaggggtttcctgagatg

SEQ ID NO: 181089 - DNA, 25 bp, Mus musculus
acggcccagcaggaccaaactctta

SEQ ID NO: 181090 - DNA, 25 bp, Mus musculus
acggcccaggccgcccaaacccaag

SEQ ID NO: 181091 - DNA, 25 bp, Mus musculus
acggccccagaaattactgtgcttt

SEQ ID NO: 181092 - DNA, 25 bp, Mus musculus
acggccccagaagctgactgcggag

SEQ ID NO: 181093 - DNA, 25 bp, Mus musculus
acggccccctcacagctctcagggc

SEQ ID NO: 181094 - DNA, 25 bp, Mus musculus
acggccctaagggtggaactactct

SEQ ID NO: 181095 - DNA, 25 bp, Mus musculus
acggccctaaggtttgaggattgcg

SEQ ID NO: 181096 - DNA, 25 bp, Mus musculus
acggccctaagtgggagccggtgaa

SEQ ID NO: 181097 - DNA, 25 bp, Mus musculus
acggccctcccagagccgtactgga

SEQ ID NO: 181098 - DNA, 25 bp, Mus musculus
acggccctcgatggggcatcctggc

SEQ ID NO: 181099 - DNA, 25 bp, Mus musculus
acggccctgcaacattggttctttg

SEQ ID NO: 181100 - DNA, 25 bp, Mus musculus
acggccctgcagtggaagacttcgt

SEQ ID NO: 181101 - DNA, 25 bp, Mus musculus
acggcccttctggcgacccccagga

SEQ ID NO: 181102 - DNA, 25 bp, Mus musculus
acggcccttggtgtggacagttctg

SEQ ID NO: 181103 - DNA, 25 bp, Mus musculus
acggccgaggcggcccagggccttg

SEQ ID NO: 181104 - DNA, 25 bp, Mus musculus
acggccgccgcagatataaagactt

SEQ ID NO: 181105 - DNA, 25 bp, Mus musculus
acggccgcctgcagcagagatgctg

SEQ ID NO: 181106 - DNA, 25 bp, Mus musculus
acggccgcctgcagcatgtttgtac

SEQ ID NO: 181107 - DNA, 25 bp, Mus musculus
acggccgcgaacaagaccccctcta

SEQ ID NO: 181108 - DNA, 25 bp, Mus musculus
acggccgcgccatcactcggaaccc

SEQ ID NO: 181109 - DNA, 25 bp, Mus musculus
acggcctccagtgacctgacagtga

SEQ ID NO: 181110 - DNA, 25 bp, Mus musculus
acggcctccagtgactgccgggtaa

SEQ ID NO: 181111 - DNA, 25 bp, Mus musculus
acggcctcgctggtggctggagggg

SEQ ID NO: 181112 - DNA, 25 bp, Mus musculus
acggcctctaccggacacacctgct

SEQ ID NO: 181113 - DNA, 25 bp, Mus musculus
acggcctctggactgccatcagtct

SEQ ID NO: 181114 - DNA, 25 bp, Mus musculus
acggcctctggtgtttgcagagaca

SEQ ID NO: 181115 - DNA, 25 bp, Mus musculus
acggcctggaggaggacagtggtca

SEQ ID NO: 181116 - DNA, 25 bp, Mus musculus
acggcctggaggttgcagaggacag

SEQ ID NO: 181117 - DNA, 25 bp, Mus musculus
acggcctggtagtattaaaggaaca

SEQ ID NO: 181118 - DNA, 25 bp, Mus musculus
acggcctgtgagctggatctcatgg

SEQ ID NO: 181119 - DNA, 25 bp, Mus musculus
acggcctttattaagtacagtccac

SEQ ID NO: 181120 - DNA, 25 bp, Mus musculus
acggcgaagagttcatatgggaagg

SEQ ID NO: 181121 - DNA, 25 bp, Mus musculus
acggcgagaagggagaagtcggacc

SEQ ID NO: 181122 - DNA, 25 bp, Mus musculus
acggcgagccaggatgtccacctcg

SEQ ID NO: 181123 - DNA, 25 bp, Mus musculus
acggcgagccagggcaaaggagcat

SEQ ID NO: 181124 - DNA, 25 bp, Mus musculus
acggcgaggacagcgactttgaaga

SEQ ID NO: 181125 - DNA, 25 bp, Mus musculus
acggcgaggacagcggctggaatgg

SEQ ID NO: 181126 - DNA, 25 bp, Mus musculus
acggcgcctcggctggacattgtgc

SEQ ID NO: 181127 - DNA, 25 bp, Mus musculus
acggcgcctcggtggagtcttacca

SEQ ID NO: 181128 - DNA, 25 bp, Mus musculus
acggcgctccgccgattcctttgtg

SEQ ID NO: 181129 - DNA, 25 bp, Mus musculus
acggcgctccgccggtgagcacgag

SEQ ID NO: 181130 - DNA, 25 bp, Mus musculus
acggcggaaggcaagattgagatca

SEQ ID NO: 181131 - DNA, 25 bp, Mus musculus
acggcggcagtgattcatcagaaaa

SEQ ID NO: 181132 - DNA, 25 bp, Mus musculus
acggcggccagcatcaggaagatga

SEQ ID NO: 181133 - DNA, 25 bp, Mus musculus
acggcggccgaggtctgtctgcagg

SEQ ID NO: 181134 - DNA, 25 bp, Mus musculus
acggcgggagggagcccagaggagg

SEQ ID NO: 181135 - DNA, 25 bp, Mus musculus
acggcgtgacctccaactacattga

SEQ ID NO: 181136 - DNA, 25 bp, Mus musculus
acggctaagcaggtgaagtccacgg

SEQ ID NO: 181137 - DNA, 25 bp, Mus musculus
acggctaatgccttgctgtgcttct

SEQ ID NO: 181138 - DNA, 25 bp, Mus musculus
acggctaatgccttgggcgctgggc

SEQ ID NO: 181139 - DNA, 25 bp, Mus musculus
acggctacattgagagtcaggtaca

SEQ ID NO: 181140 - DNA, 25 bp, Mus musculus
acggctacattgagagtcatccttt

SEQ ID NO: 181141 - DNA, 25 bp, Mus musculus
acggctaccacagaagctgaaccgg

SEQ ID NO: 181142 - DNA, 25 bp, Mus musculus
acggctaccacagaggccttgcccc

SEQ ID NO: 181143 - DNA, 25 bp, Mus musculus
acggctacttctgggaacatcatga

SEQ ID NO: 181144 - DNA, 25 bp, Mus musculus
acggctatgaatcatccaggtttga

SEQ ID NO: 181145 - DNA, 25 bp, Mus musculus
acggctcaagcaaggaccatggtgg

SEQ ID NO: 181146 - DNA, 25 bp, Mus musculus
acggctccaaggatgccaacaagga

SEQ ID NO: 181147 - DNA, 25 bp, Mus musculus
acggctccagaaagatgacaggaaa

SEQ ID NO: 181148 - DNA, 25 bp, Mus musculus
acggctccagattactacaagggaa

SEQ ID NO: 181149 - DNA, 25 bp, Mus musculus
acggctccaggctgctggcaatgca

SEQ ID NO: 181150 - DNA, 25 bp, Mus musculus
acggctcgcggcgagggtggtcctg

SEQ ID NO: 181151 - DNA, 25 bp, Mus musculus
acggctcgcggcgaggtaattgaag

SEQ ID NO: 181152 - DNA, 25 bp, Mus musculus
acggctcgggacggagatgaaacca

SEQ ID NO: 181153 - DNA, 25 bp, Mus musculus
acggctcgggacggttcagtgtatc

SEQ ID NO: 181154 - DNA, 25 bp, Mus musculus
acggctctccttcagtaaattcaag

SEQ ID NO: 181155 - DNA, 25 bp, Mus musculus
acggctgatggagtatggtgatgaa

SEQ ID NO: 181156 - DNA, 25 bp, Mus musculus
acggctgatggagtgatgggagcca

SEQ ID NO: 181157 - DNA, 25 bp, Mus musculus
acggctgcacgagtcacaccggaac

SEQ ID NO: 181158 - DNA, 25 bp, Mus musculus
acggctgccgggttgtgagccccgg

SEQ ID NO: 181159 - DNA, 25 bp, Mus musculus
acggctgcgaggaagaagaaatgcc

SEQ ID NO: 181160 - DNA, 25 bp, Mus musculus
acggctgcgaggaattcatcagaga

SEQ ID NO: 181161 - DNA, 25 bp, Mus musculus
acggctgcgattacatcaccctgac

SEQ ID NO: 181162 - DNA, 25 bp, Mus musculus
acggctgctggaagtgagagggtcc

SEQ ID NO: 181163 - DNA, 25 bp, Mus musculus
acggctgggaagaccctgtttggga

SEQ ID NO: 181164 - DNA, 25 bp, Mus musculus
acggctgtcaacctaatgtctgcga

SEQ ID NO: 181165 - DNA, 25 bp, Mus musculus
acggcttcagaaaagaagttgtgaa

SEQ ID NO: 181166 - DNA, 25 bp, Mus musculus
acggcttcagaaggaagaggcaaat

SEQ ID NO: 181167 - DNA, 25 bp, Mus musculus
acggcttcagtctttgcagtttaat

SEQ ID NO: 181168 - DNA, 25 bp, Mus musculus
acggcttgtcacattcccacgaggt

SEQ ID NO: 181169 - DNA, 25 bp, Mus musculus
acgggaaagaagtgagaagataaag

SEQ ID NO: 181170 - DNA, 25 bp, Mus musculus
acgggaaaggccggatggaccaaga

SEQ ID NO: 181171 - DNA, 25 bp, Mus musculus
acgggaacggagtgtgcaattctca

SEQ ID NO: 181172 - DNA, 25 bp, Mus musculus
acgggaagcaaacattcgagatcta

SEQ ID NO: 181173 - DNA, 25 bp, Mus musculus
acgggaagcacgggacgcctcagaa

SEQ ID NO: 181174 - DNA, 25 bp, Mus musculus
acgggaaggacaggacagcaaggta

SEQ ID NO: 181175 - DNA, 25 bp, Mus musculus
acgggaaggacaggttcaactggag

SEQ ID NO: 181176 - DNA, 25 bp, Mus musculus
acgggaaggagtggaaaagagagac

SEQ ID NO: 181177 - DNA, 25 bp, Mus musculus
acgggaaggagttatccagcttgtc

SEQ ID NO: 181178 - DNA, 25 bp, Mus musculus
acgggaattccaggtctcaagggat

SEQ ID NO: 181179 - DNA, 25 bp, Mus musculus
acgggaattctcgcccgaacctctt

SEQ ID NO: 181180 - DNA, 25 bp, Mus musculus
acgggacaaggtcccatctgcaggt

SEQ ID NO: 181181 - DNA, 25 bp, Mus musculus
acgggacaagttaattcaggacaac

SEQ ID NO: 181182 - DNA, 25 bp, Mus musculus
acgggacagcaaaggccgggtagga

SEQ ID NO: 181183 - DNA, 25 bp, Mus musculus
acgggacagcaaaggttctggccga

SEQ ID NO: 181184 - DNA, 25 bp, Mus musculus
acgggaccaaagagcagccccggac

SEQ ID NO: 181185 - DNA, 25 bp, Mus musculus
acgggaccaaagagctgcctctgtt

SEQ ID NO: 181186 - DNA, 25 bp, Mus musculus
acgggaccacagcctccaggatcac

SEQ ID NO: 181187 - DNA, 25 bp, Mus musculus
acgggaccatagtggagggacggct

SEQ ID NO: 181188 - DNA, 25 bp, Mus musculus
acgggacccagggtgaaatggtcaa

SEQ ID NO: 181189 - DNA, 25 bp, Mus musculus
acgggacctcgagactgccactctc

SEQ ID NO: 181190 - DNA, 25 bp, Mus musculus
acgggacgctgcgaggaagagccct

SEQ ID NO: 181191 - DNA, 25 bp, Mus musculus
acgggagacaggtacttgtggaagg

SEQ ID NO: 181192 - DNA, 25 bp, Mus musculus
acgggagacgaaggcctggagccca

SEQ ID NO: 181193 - DNA, 25 bp, Mus musculus
acgggagacgaagggcagaggtgac

SEQ ID NO: 181194 - DNA, 25 bp, Mus musculus
acgggagcatcaaaaccctactgaa

SEQ ID NO: 181195 - DNA, 25 bp, Mus musculus
acgggagcatcaagaagtcatgctc

SEQ ID NO: 181196 - DNA, 25 bp, Mus musculus
acgggagctgcaggagatgcgggct

SEQ ID NO: 181197 - DNA, 25 bp, Mus musculus
acgggagggacggtattcaggctgt

SEQ ID NO: 181198 - DNA, 25 bp, Mus musculus
acgggagggaggaagatttgctccc

SEQ ID NO: 181199 - DNA, 25 bp, Mus musculus
acgggagtctcagatgaaagaaaca

SEQ ID NO: 181200 - DNA, 25 bp, Mus musculus
acgggatatatttgttaatggagtg

SEQ ID NO: 181201 - DNA, 25 bp, Mus musculus
acgggattaaggaatcttccgacag

SEQ ID NO: 181202 - DNA, 25 bp, Mus musculus
acgggattcctgcctgctccaggac

SEQ ID NO: 181203 - DNA, 25 bp, Mus musculus
acgggattggcctagaaggaggggg

SEQ ID NO: 181204 - DNA, 25 bp, Mus musculus
acgggatttgctggacaggacgccc

SEQ ID NO: 181205 - DNA, 25 bp, Mus musculus
acgggcaacaaaatggcagtgaaaa

SEQ ID NO: 181206 - DNA, 25 bp, Mus musculus
acgggcaacaaagatttctgaaaag

SEQ ID NO: 181207 - DNA, 25 bp, Mus musculus
acgggcaacaaagtgcactaggcct

SEQ ID NO: 181208 - DNA, 25 bp, Mus musculus
acgggcaacaaatatgtctggattt

SEQ ID NO: 181209 - DNA, 25 bp, Mus musculus
acgggcacagaaatggaagcccaga

SEQ ID NO: 181210 - DNA, 25 bp, Mus musculus
acgggcaccccagctggagtccttg

SEQ ID NO: 181211 - DNA, 25 bp, Mus musculus
acgggcaccccaggaatgcaccatg

SEQ ID NO: 181212 - DNA, 25 bp, Mus musculus
acgggcactggcaggcctgtacgga

SEQ ID NO: 181213 - DNA, 25 bp, Mus musculus
acgggcactggcagggctggtctac

SEQ ID NO: 181214 - DNA, 25 bp, Mus musculus
acgggcagagggaatccggagatcg

SEQ ID NO: 181215 - DNA, 25 bp, Mus musculus
acgggcagatcagctgtcctggaag

SEQ ID NO: 181216 - DNA, 25 bp, Mus musculus
acgggcagatcagtccgcactggag

SEQ ID NO: 181217 - DNA, 25 bp, Mus musculus
acgggcagcagagttcattccgaca

SEQ ID NO: 181218 - DNA, 25 bp, Mus musculus
acgggcaggcctgtgataagacgct

SEQ ID NO: 181219 - DNA, 25 bp, Mus musculus
acgggcaggcctgtgctcatatgaa

SEQ ID NO: 181220 - DNA, 25 bp, Mus musculus
acgggcaggctcgatggctcccgca

SEQ ID NO: 181221 - DNA, 25 bp, Mus musculus
acgggcatggcagccaaagcttaat

SEQ ID NO: 181222 - DNA, 25 bp, Mus musculus
acgggcattgcccaggtgaaaatcc

SEQ ID NO: 181223 - DNA, 25 bp, Mus musculus
acgggccaaagaagattgcagagtt

SEQ ID NO: 181224 - DNA, 25 bp, Mus musculus
acgggccagctggctctggaatcat

SEQ ID NO: 181225 - DNA, 25 bp, Mus musculus
acgggccggaaaagacaaggaccag

SEQ ID NO: 181226 - DNA, 25 bp, Mus musculus
acgggccgtgtgagagattggtgtc

SEQ ID NO: 181227 - DNA, 25 bp, Mus musculus
acgggcgaccagccaggtcccagtg

SEQ ID NO: 181228 - DNA, 25 bp, Mus musculus
acgggcgaccaggacctataagaac

SEQ ID NO: 181229 - DNA, 25 bp, Mus musculus
acgggcggcgccaggtctgaccacc

SEQ ID NO: 181230 - DNA, 25 bp, Mus musculus
acgggcgggactggtctccaaaaat

SEQ ID NO: 181231 - DNA, 25 bp, Mus musculus
acgggcgtaacaagccgcattttct

SEQ ID NO: 181232 - DNA, 25 bp, Mus musculus
acgggctacaggttgcgttacagta

SEQ ID NO: 181233 - DNA, 25 bp, Mus musculus
acgggctatgagccaacttccatga

SEQ ID NO: 181234 - DNA, 25 bp, Mus musculus
acgggctgagatctcttgatgctat

SEQ ID NO: 181235 - DNA, 25 bp, Mus musculus
acgggctgaggtctgtgcagacgtt

SEQ ID NO: 181236 - DNA, 25 bp, Mus musculus
acgggctgattccagttacttcctg

SEQ ID NO: 181237 - DNA, 25 bp, Mus musculus
acgggctgcagccgatacgacaaat

SEQ ID NO: 181238 - DNA, 25 bp, Mus musculus
acgggctgcagccggaaggatccct

SEQ ID NO: 181239 - DNA, 25 bp, Mus musculus
acgggctgctggaaagggataaaca

SEQ ID NO: 181240 - DNA, 25 bp, Mus musculus
acgggctgcttagttcaaaccggag

SEQ ID NO: 181241 - DNA, 25 bp, Mus musculus
acgggctggcctacattctaaggtg

SEQ ID NO: 181242 - DNA, 25 bp, Mus musculus
acgggctgggacaggaaatgctgtc

SEQ ID NO: 181243 - DNA, 25 bp, Mus musculus
acggggaatgacagccgccgccatg

SEQ ID NO: 181244 - DNA, 25 bp, Mus musculus
acggggacaggcaagtacattgcct

SEQ ID NO: 181245 - DNA, 25 bp, Mus musculus
acggggaccccggattgcacaggca

SEQ ID NO: 181246 - DNA, 25 bp, Mus musculus
acggggacgcaatgtgtctggaatt

SEQ ID NO: 181247 - DNA, 25 bp, Mus musculus
acggggactgagcggtcttgacgaa

SEQ ID NO: 181248 - DNA, 25 bp, Mus musculus
acggggagaaaagctggcactcgac

SEQ ID NO: 181249 - DNA, 25 bp, Mus musculus
acggggagaagtactgcggtgagag

SEQ ID NO: 181250 - DNA, 25 bp, Mus musculus
acggggagcggccagagtatggctt

SEQ ID NO: 181251 - DNA, 25 bp, Mus musculus
acggggagcggccaggtgtaagagt

SEQ ID NO: 181252 - DNA, 25 bp, Mus musculus
acggggaggtgctgacggagaaaca

SEQ ID NO: 181253 - DNA, 25 bp, Mus musculus
acggggagtccctgtgcgatgactg

SEQ ID NO: 181254 - DNA, 25 bp, Mus musculus
acggggagtccctgtgtgacctctt

SEQ ID NO: 181255 - DNA, 25 bp, Mus musculus
acggggatgacttcagggactcacc

SEQ ID NO: 181256 - DNA, 25 bp, Mus musculus
acggggcaagtgcatttggcacaat

SEQ ID NO: 181257 - DNA, 25 bp, Mus musculus
acggggcaatacaatgaggagactg

SEQ ID NO: 181258 - DNA, 25 bp, Mus musculus
acggggcaatacattgctatagctc

SEQ ID NO: 181259 - DNA, 25 bp, Mus musculus
acggggccatcgatgtgcagaagac

SEQ ID NO: 181260 - DNA, 25 bp, Mus musculus
acggggccatcgtgattcgagtcat

SEQ ID NO: 181261 - DNA, 25 bp, Mus musculus
acggggcgcgaggtgcagggaaggg

SEQ ID NO: 181262 - DNA, 25 bp, Mus musculus
acggggctcctgatgtcactggtct

SEQ ID NO: 181263 - DNA, 25 bp, Mus musculus
acggggctgcaggtcacagcggagt

SEQ ID NO: 181264 - DNA, 25 bp, Mus musculus
acggggcttggcagagatggagttg

SEQ ID NO: 181265 - DNA, 25 bp, Mus musculus
acggggcttgggagcatttagctcc

SEQ ID NO: 181266 - DNA, 25 bp, Mus musculus
acggggcttgtgtgttgcatacttt

SEQ ID NO: 181267 - DNA, 25 bp, Mus musculus
acgggggctggcacaggtgatgaag

SEQ ID NO: 181268 - DNA, 25 bp, Mus musculus
acgggggcttcccagaaaagatcag

SEQ ID NO: 181269 - DNA, 25 bp, Mus musculus
acgggggtgaggatttctcccagga

SEQ ID NO: 181270 - DNA, 25 bp, Mus musculus
acggggtagtgcaaggtggagtgtc

SEQ ID NO: 181271 - DNA, 25 bp, Mus musculus
acgggtactggggcctggatattcc

SEQ ID NO: 181272 - DNA, 25 bp, Mus musculus
acgggtatccaaagcggctggagaa

SEQ ID NO: 181273 - DNA, 25 bp, Mus musculus
acgggtatgagtggcccaggatggg

SEQ ID NO: 181274 - DNA, 25 bp, Mus musculus
acgggtcttaagaagattgaaaagc

SEQ ID NO: 181275 - DNA, 25 bp, Mus musculus
acgggtcttaagaaggtcttgctgt

SEQ ID NO: 181276 - DNA, 25 bp, Mus musculus
acgggtgagtttcacggagaaatcc

SEQ ID NO: 181277 - DNA, 25 bp, Mus musculus
acgggtgatgctggacaagtgggag

SEQ ID NO: 181278 - DNA, 25 bp, Mus musculus
acgggttgttgccgtaatctagctg

SEQ ID NO: 181279 - DNA, 25 bp, Mus musculus
acgggtttcttccagggcttggctg

SEQ ID NO: 181280 - DNA, 25 bp, Mus musculus
acggtacctgcattgtgcttcttct

SEQ ID NO: 181281 - DNA, 25 bp, Mus musculus
acggtagatctagccttttctgatt

SEQ ID NO: 181282 - DNA, 25 bp, Mus musculus
acggtagatctagttacaacctgcc

SEQ ID NO: 181283 - DNA, 25 bp, Mus musculus
acggtagtagctcctggtttgctta

SEQ ID NO: 181284 - DNA, 25 bp, Mus musculus
acggtattgagttggtcacaatggc

SEQ ID NO: 181285 - DNA, 25 bp, Mus musculus
acggtcaagcaagtgcaaagaaacg

SEQ ID NO: 181286 - DNA, 25 bp, Mus musculus
acggtcaataaggctgtggctctgg

SEQ ID NO: 181287 - DNA, 25 bp, Mus musculus
acggtcaatgacaaatcaggacctt

SEQ ID NO: 181288 - DNA, 25 bp, Mus musculus
acggtcacaaacttaatctagagaa

SEQ ID NO: 181289 - DNA, 25 bp, Mus musculus
acggtcaccaggccattccaaggac

SEQ ID NO: 181290 - DNA, 25 bp, Mus musculus
acggtcagaagctccccgcaggccc

SEQ ID NO: 181291 - DNA, 25 bp, Mus musculus
acggtccagaaaaacctccagcgtc

SEQ ID NO: 181292 - DNA, 25 bp, Mus musculus
acggtcctagcctcagcgttctcac

SEQ ID NO: 181293 - DNA, 25 bp, Mus musculus
acggtcctgaggtccacctccacct

SEQ ID NO: 181294 - DNA, 25 bp, Mus musculus
acggtctcatacaggtgagaaacct

SEQ ID NO: 181295 - DNA, 25 bp, Mus musculus
acggtctgattaaacaaattggaga

SEQ ID NO: 181296 - DNA, 25 bp, Mus musculus
acggtctggaggtcctgggccttgt

SEQ ID NO: 181297 - DNA, 25 bp, Mus musculus
acggtctggtcaaagctgttcctga

SEQ ID NO: 181298 - DNA, 25 bp, Mus musculus
acggtctgtgagcagcgcggatgtc

SEQ ID NO: 181299 - DNA, 25 bp, Mus musculus
acggtctgtgagcaggaatcccttc

SEQ ID NO: 181300 - DNA, 25 bp, Mus musculus
acggtctgtgagcagtggcagtggc

SEQ ID NO: 181301 - DNA, 25 bp, Mus musculus
acggtcttccgacatagactgactc

SEQ ID NO: 181302 - DNA, 25 bp, Mus musculus
acggtgaagaaggtgataaatgcac

SEQ ID NO: 181303 - DNA, 25 bp, Mus musculus
acggtgaatccaggtttgatctgtg

SEQ ID NO: 181304 - DNA, 25 bp, Mus musculus
acggtgagcagggatatcgctcgag

SEQ ID NO: 181305 - DNA, 25 bp, Mus musculus
acggtgaggatcaggttggtacacg

SEQ ID NO: 181306 - DNA, 25 bp, Mus musculus
acggtgccaggctgtactgcctgaa

SEQ ID NO: 181307 - DNA, 25 bp, Mus musculus
acggtgcccatcagattatctgcaa

SEQ ID NO: 181308 - DNA, 25 bp, Mus musculus
acggtggattgattcgttctccccg

SEQ ID NO: 181309 - DNA, 25 bp, Mus musculus
acggtggatttggtggagctagagc

SEQ ID NO: 181310 - DNA, 25 bp, Mus musculus
acggtggtcagtgtcctcaagagga

SEQ ID NO: 181311 - DNA, 25 bp, Mus musculus
acggtggtgcaatctgccagcttgg

SEQ ID NO: 181312 - DNA, 25 bp, Mus musculus
acggtggtgcacctcgcctgcatgt

SEQ ID NO: 181313 - DNA, 25 bp, Mus musculus
acggtggtgcaggctctccttcctg

SEQ ID NO: 181314 - DNA, 25 bp, Mus musculus
acggtggtggagtgcacctgtcaag

SEQ ID NO: 181315 - DNA, 25 bp, Mus musculus
acggtggtttgaggtcctccagagg

SEQ ID NO: 181316 - DNA, 25 bp, Mus musculus
acggtgtaaagctggaccgtgtatc

SEQ ID NO: 181317 - DNA, 25 bp, Mus musculus
acggtgtcagctgcccagcctggtg

SEQ ID NO: 181318 - DNA, 25 bp, Mus musculus
acggtgtctttacagttgctagacc

SEQ ID NO: 181319 - DNA, 25 bp, Mus musculus
acggtgtgcagttcatggaccgtct

SEQ ID NO: 181320 - DNA, 25 bp, Mus musculus
acggtgtgctggaggacttcatcaa

SEQ ID NO: 181321 - DNA, 25 bp, Mus musculus
acggtgtgtacaggccccgactctg

SEQ ID NO: 181322 - DNA, 25 bp, Mus musculus
acggtgttcagggactgctgacctt

SEQ ID NO: 181323 - DNA, 25 bp, Mus musculus
acggtgttcaggtcactgcaagaca

SEQ ID NO: 181324 - DNA, 25 bp, Mus musculus
acggtgttcgtgcggtcttttgatg

SEQ ID NO: 181325 - DNA, 25 bp, Mus musculus
acggttactatctgggtgacaatag

SEQ ID NO: 181326 - DNA, 25 bp, Mus musculus
acggttagtgctggattcgagttct

SEQ ID NO: 181327 - DNA, 25 bp, Mus musculus
acggttccgagctgtagccctcatg

SEQ ID NO: 181328 - DNA, 25 bp, Mus musculus
acggttctagatccctttcagctcc

SEQ ID NO: 181329 - DNA, 25 bp, Mus musculus
acggttctagttccctttcagctcc

SEQ ID NO: 181330 - DNA, 25 bp, Mus musculus
acggttgcccaggtgacagattatg

SEQ ID NO: 181331 - DNA, 25 bp, Mus musculus
acggttgcttaatagattgtgccca

SEQ ID NO: 181332 - DNA, 25 bp, Mus musculus
acggttggataaacctgactctaga

SEQ ID NO: 181333 - DNA, 25 bp, Mus musculus
acggttgtcagaaacttatggaacg

SEQ ID NO: 181334 - DNA, 25 bp, Mus musculus
acggttgtcagtccgcagatgcact

SEQ ID NO: 181335 - DNA, 25 bp, Mus musculus
acggttgtgaggtagatgttgtaga

SEQ ID NO: 181336 - DNA, 25 bp, Mus musculus
acggtttagcaactccagctatcac

SEQ ID NO: 181337 - DNA, 25 bp, Mus musculus
acgtaaagagctacaagaaaatcaa

SEQ ID NO: 181338 - DNA, 25 bp, Mus musculus
acgtaactctgagataaagtgcagg

SEQ ID NO: 181339 - DNA, 25 bp, Mus musculus
acgtaactctgagtcacaggaatgt

SEQ ID NO: 181340 - DNA, 25 bp, Mus musculus
acgtaagaccaatcgcagcctgcag

SEQ ID NO: 181341 - DNA, 25 bp, Mus musculus
acgtaagaccagtgggagcaggtgc

SEQ ID NO: 181342 - DNA, 25 bp, Mus musculus
acgtaagcagagagtggctgaagtg

SEQ ID NO: 181343 - DNA, 25 bp, Mus musculus
acgtaagcagggtcttgacaatgtt

SEQ ID NO: 181344 - DNA, 25 bp, Mus musculus
acgtaagcagggtcttggagagcca

SEQ ID NO: 181345 - DNA, 25 bp, Mus musculus
acgtacacagatatgaggaattaaa

SEQ ID NO: 181346 - DNA, 25 bp, Mus musculus
acgtacacaggtttgcagctagaac

SEQ ID NO: 181347 - DNA, 25 bp, Mus musculus
acgtacacaggttttcctttggaat

SEQ ID NO: 181348 - DNA, 25 bp, Mus musculus
acgtaccagatcagctcaaggcaag

SEQ ID NO: 181349 - DNA, 25 bp, Mus musculus
acgtacctagaacaccacgctgcag

SEQ ID NO: 181350 - DNA, 25 bp, Mus musculus
acgtacctcaggctcatgtacagtc

SEQ ID NO: 181351 - DNA, 25 bp, Mus musculus
acgtacctcagtacaagcccaccac

SEQ ID NO: 181352 - DNA, 25 bp, Mus musculus
acgtacctcagttctggctcaaggt

SEQ ID NO: 181353 - DNA, 25 bp, Mus musculus
acgtacctgcataaagacagacccc

SEQ ID NO: 181354 - DNA, 25 bp, Mus musculus
acgtacctgcataagaattgaatta

SEQ ID NO: 181355 - DNA, 25 bp, Mus musculus
acgtactaaaactgtgcagggctat

SEQ ID NO: 181356 - DNA, 25 bp, Mus musculus
acgtagactccgagggacatctcta

SEQ ID NO: 181357 - DNA, 25 bp, Mus musculus
acgtagagagttccctcagtaccgt

SEQ ID NO: 181358 - DNA, 25 bp, Mus musculus
acgtagagcctagccccgtgtctga

SEQ ID NO: 181359 - DNA, 25 bp, Mus musculus
acgtagcagaagcagatataatttc

SEQ ID NO: 181360 - DNA, 25 bp, Mus musculus
acgtagcagaagggttcactgcagt

SEQ ID NO: 181361 - DNA, 25 bp, Mus musculus
acgtagcttcaggtgacctcactga

SEQ ID NO: 181362 - DNA, 25 bp, Mus musculus
acgtatacgacacgggccggactgg

SEQ ID NO: 181363 - DNA, 25 bp, Mus musculus
acgtatagccaggtggtgaccgtta

SEQ ID NO: 181364 - DNA, 25 bp, Mus musculus
acgtatgatgacatcgactatggca

SEQ ID NO: 181365 - DNA, 25 bp, Mus musculus
acgtatgatggaaatttctatggca

SEQ ID NO: 181366 - DNA, 25 bp, Mus musculus
acgtatgcaggctctgcctggtacc

SEQ ID NO: 181367 - DNA, 25 bp, Mus musculus
acgtatggcacacagaaaggggagt

SEQ ID NO: 181368 - DNA, 25 bp, Mus musculus
acgtatgtcagcagatcaacttctg

SEQ ID NO: 181369 - DNA, 25 bp, Mus musculus
acgtatttaacagacaaatggtggc

SEQ ID NO: 181370 - DNA, 25 bp, Mus musculus
acgtatttaacagacaatcatggcc

SEQ ID NO: 181371 - DNA, 25 bp, Mus musculus
acgtatttaccgcagaaacagtatt

SEQ ID NO: 181372 - DNA, 25 bp, Mus musculus
acgtcaaactggagcaggcagactg

SEQ ID NO: 181373 - DNA, 25 bp, Mus musculus
acgtcaaactggaggaaagcacaga

SEQ ID NO: 181374 - DNA, 25 bp, Mus musculus
acgtcaacaagcttgctcaggacct

SEQ ID NO: 181375 - DNA, 25 bp, Mus musculus
acgtcaaccaggaaaccaaaaagag

SEQ ID NO: 181376 - DNA, 25 bp, Mus musculus
acgtcaaccctccagaaagccatcg

SEQ ID NO: 181377 - DNA, 25 bp, Mus musculus
acgtcaacccttcagaaagccatcg

SEQ ID NO: 181378 - DNA, 25 bp, Mus musculus
acgtcaagaagagtggtcttaggtc

SEQ ID NO: 181379 - DNA, 25 bp, Mus musculus
acgtcaagaaggagatccagctgct

SEQ ID NO: 181380 - DNA, 25 bp, Mus musculus
acgtcaagcagtggcatcagaaatt

SEQ ID NO: 181381 - DNA, 25 bp, Mus musculus
acgtcaagcagtgggtatatgcttg

SEQ ID NO: 181382 - DNA, 25 bp, Mus musculus
acgtcaatgcacaggatgcagaagg

SEQ ID NO: 181383 - DNA, 25 bp, Mus musculus
acgtcacaaactcttacgacatgat

SEQ ID NO: 181384 - DNA, 25 bp, Mus musculus
acgtcacaataaagatctgggacat

SEQ ID NO: 181385 - DNA, 25 bp, Mus musculus
acgtcacaataaaggtactagtact

SEQ ID NO: 181386 - DNA, 25 bp, Mus musculus
acgtcacaatgatttctatgggaag

SEQ ID NO: 181387 - DNA, 25 bp, Mus musculus
acgtcacattagcctttggagctga

SEQ ID NO: 181388 - DNA, 25 bp, Mus musculus
acgtcacattagggtccgcaagcag

SEQ ID NO: 181389 - DNA, 25 bp, Mus musculus
acgtcacccaataggcaactccgaa

SEQ ID NO: 181390 - DNA, 25 bp, Mus musculus
acgtcagagcccagtctcagatctc

SEQ ID NO: 181391 - DNA, 25 bp, Mus musculus
acgtcaggtaatcaaattaaataga

SEQ ID NO: 181392 - DNA, 25 bp, Mus musculus
acgtcagtccaggaccacttggtca

SEQ ID NO: 181393 - DNA, 25 bp, Mus musculus
acgtcatagtacaggattcatccca

SEQ ID NO: 181394 - DNA, 25 bp, Mus musculus
acgtcatagtactagattcatccca

SEQ ID NO: 181395 - DNA, 25 bp, Mus musculus
acgtcatccacggtgtggcctcttc

SEQ ID NO: 181396 - DNA, 25 bp, Mus musculus
acgtcatcttaccgatcaagaagct

SEQ ID NO: 181397 - DNA, 25 bp, Mus musculus
acgtcatgagtgagattgataacaa

SEQ ID NO: 181398 - DNA, 25 bp, Mus musculus
acgtcatgagtgagggtacaagaag

SEQ ID NO: 181399 - DNA, 25 bp, Mus musculus
acgtcatgccagatgtctctccgag

SEQ ID NO: 181400 - DNA, 25 bp, Mus musculus
acgtcattgggaggaaaactccctc

SEQ ID NO: 181401 - DNA, 25 bp, Mus musculus
acgtcattgggtgggtgttcgtgtg

SEQ ID NO: 181402 - DNA, 25 bp, Mus musculus
acgtccaaaaaacagatcaaaaggt

SEQ ID NO: 181403 - DNA, 25 bp, Mus musculus
acgtccaccagtgaaaatgtgctat

SEQ ID NO: 181404 - DNA, 25 bp, Mus musculus
acgtccagcaggcgggcttggagga

SEQ ID NO: 181405 - DNA, 25 bp, Mus musculus
acgtccagctccaagaaaagcacct

SEQ ID NO: 181406 - DNA, 25 bp, Mus musculus
acgtccaggagataattgtgtggag

SEQ ID NO: 181407 - DNA, 25 bp, Mus musculus
acgtccagtgcggctgctcctggca

SEQ ID NO: 181408 - DNA, 25 bp, Mus musculus
acgtccagtgcgggctgatgcatgg

SEQ ID NO: 181409 - DNA, 25 bp, Mus musculus
acgtcccaggctgatagagacatcg

SEQ ID NO: 181410 - DNA, 25 bp, Mus musculus
acgtcccaggctggacagagatttc

SEQ ID NO: 181411 - DNA, 25 bp, Mus musculus
acgtcccaggctggagaaagctgtg

SEQ ID NO: 181412 - DNA, 25 bp, Mus musculus
acgtccccagacgcttgtcggagct

SEQ ID NO: 181413 - DNA, 25 bp, Mus musculus
acgtcccctccaagagcaaagctgc

SEQ ID NO: 181414 - DNA, 25 bp, Mus musculus
acgtccccttcacggcatatggatc

SEQ ID NO: 181415 - DNA, 25 bp, Mus musculus
acgtccccttcacggttgcagcttc

SEQ ID NO: 181416 - DNA, 25 bp, Mus musculus
acgtcccgtggccaggaaggacagg

SEQ ID NO: 181417 - DNA, 25 bp, Mus musculus
acgtccctcaagagtttacaaacct

SEQ ID NO: 181418 - DNA, 25 bp, Mus musculus
acgtccctccgggctgtgagcacct

SEQ ID NO: 181419 - DNA, 25 bp, Mus musculus
acgtccgagacatgatagaagcgat

SEQ ID NO: 181420 - DNA, 25 bp, Mus musculus
acgtccgagacatggagatcgaggg

SEQ ID NO: 181421 - DNA, 25 bp, Mus musculus
acgtccggaaggtgaatcggtttag

SEQ ID NO: 181422 - DNA, 25 bp, Mus musculus
acgtccgtcaggtatttgtcaagtg

SEQ ID NO: 181423 - DNA, 25 bp, Mus musculus
acgtcctaatggagccatctttaaa

SEQ ID NO: 181424 - DNA, 25 bp, Mus musculus
acgtcctaatggaggtaattttggg

SEQ ID NO: 181425 - DNA, 25 bp, Mus musculus
acgtcctcaacgtgtattttgttaa

SEQ ID NO: 181426 - DNA, 25 bp, Mus musculus
acgtcctcccgaccatgctcgcatt

SEQ ID NO: 181427 - DNA, 25 bp, Mus musculus
acgtcctcgctttgtactggttccg

SEQ ID NO: 181428 - DNA, 25 bp, Mus musculus
acgtcctgaacacgacccgagcaac

SEQ ID NO: 181429 - DNA, 25 bp, Mus musculus
acgtcctgcagagcgacgtttttct

SEQ ID NO: 181430 - DNA, 25 bp, Mus musculus
acgtcctgccccacgggcttcagca

SEQ ID NO: 181431 - DNA, 25 bp, Mus musculus
acgtcctggggagtgaggacagaac

SEQ ID NO: 181432 - DNA, 25 bp, Mus musculus
acgtcctgttccaccatagccatca

SEQ ID NO: 181433 - DNA, 25 bp, Mus musculus
acgtccttgcggggcctgtgctctc

SEQ ID NO: 181434 - DNA, 25 bp, Mus musculus
acgtccttgtcctctgcgagtggca

SEQ ID NO: 181435 - DNA, 25 bp, Mus musculus
acgtcgaagtcgctgacatcaatgc

SEQ ID NO: 181436 - DNA, 25 bp, Mus musculus
acgtcgacgacagggaacgaatgga

SEQ ID NO: 181437 - DNA, 25 bp, Mus musculus
acgtcgcccctgagaaaaatgtttt

SEQ ID NO: 181438 - DNA, 25 bp, Mus musculus
acgtcgcggccgcatggcggacaag

SEQ ID NO: 181439 - DNA, 25 bp, Mus musculus
acgtcggcaatggctatgacattgc

SEQ ID NO: 181440 - DNA, 25 bp, Mus musculus
acgtcggctcagctggacagagggg

SEQ ID NO: 181441 - DNA, 25 bp, Mus musculus
acgtcgggaactgaagagccgagtg

SEQ ID NO: 181442 - DNA, 25 bp, Mus musculus
acgtcgggaagttccgtgtaccact

SEQ ID NO: 181443 - DNA, 25 bp, Mus musculus
acgtcgtccgagtctccaggaacac

SEQ ID NO: 181444 - DNA, 25 bp, Mus musculus
acgtcgtgaagttaagcaaaactgg

SEQ ID NO: 181445 - DNA, 25 bp, Mus musculus
acgtcgtggtgccgatctctgagaa

SEQ ID NO: 181446 - DNA, 25 bp, Mus musculus
acgtcgtgtggcatgtgggcacatt

SEQ ID NO: 181447 - DNA, 25 bp, Mus musculus
acgtctacaagacgctgaaggactt

SEQ ID NO: 181448 - DNA, 25 bp, Mus musculus
acgtctacaaggccatgacgttgat

SEQ ID NO: 181449 - DNA, 25 bp, Mus musculus
acgtctagccccaggctcaatttga

SEQ ID NO: 181450 - DNA, 25 bp, Mus musculus
acgtctatgcaaaacgtataaatcc

SEQ ID NO: 181451 - DNA, 25 bp, Mus musculus
acgtctatgcaaaactgcttcaccg

SEQ ID NO: 181452 - DNA, 25 bp, Mus musculus
acgtctcagaaggtggacactgcac

SEQ ID NO: 181453 - DNA, 25 bp, Mus musculus
acgtctccacagccagagaacctga

SEQ ID NO: 181454 - DNA, 25 bp, Mus musculus
acgtctctaagtaacatacaagaga

SEQ ID NO: 181455 - DNA, 25 bp, Mus musculus
acgtctctgtggacacagaagccat

SEQ ID NO: 181456 - DNA, 25 bp, Mus musculus
acgtctgaggacacagactcagaag

SEQ ID NO: 181457 - DNA, 25 bp, Mus musculus
acgtctgaggcagcgggagcccatg

SEQ ID NO: 181458 - DNA, 25 bp, Mus musculus
acgtctgaggtggcttggtttgctt

SEQ ID NO: 181459 - DNA, 25 bp, Mus musculus
acgtctgcagaagcaacctcttacc

SEQ ID NO: 181460 - DNA, 25 bp, Mus musculus
acgtctgcagaaggccaagatggac

SEQ ID NO: 181461 - DNA, 25 bp, Mus musculus
acgtctgcagctggtgagccgcggg

SEQ ID NO: 181462 - DNA, 25 bp, Mus musculus
acgtctgcatcgaggtggacaacat

SEQ ID NO: 181463 - DNA, 25 bp, Mus musculus
acgtctgccagtgcgaccagtaccg

SEQ ID NO: 181464 - DNA, 25 bp, Mus musculus
acgtctgcccgtgtgctgatgtcaa

SEQ ID NO: 181465 - DNA, 25 bp, Mus musculus
acgtctggagaatgctgggacccag

SEQ ID NO: 181466 - DNA, 25 bp, Mus musculus
acgtctggagcttcggggttcttct

SEQ ID NO: 181467 - DNA, 25 bp, Mus musculus
acgtctgtcagccatcgtctagaga

SEQ ID NO: 181468 - DNA, 25 bp, Mus musculus
acgtctgtgaagatcactgttaaga

SEQ ID NO: 181469 - DNA, 25 bp, Mus musculus
acgtctgtgacaggtgacacggctc

SEQ ID NO: 181470 - DNA, 25 bp, Mus musculus
acgtctgtgacagtggagatctcag

SEQ ID NO: 181471 - DNA, 25 bp, Mus musculus
acgtcttctatctttggtatagttg

SEQ ID NO: 181472 - DNA, 25 bp, Mus musculus
acgtcttgttcaaaggaaatgccac

SEQ ID NO: 181473 - DNA, 25 bp, Mus musculus
acgtcttgttcaaagggaagtggct

SEQ ID NO: 181474 - DNA, 25 bp, Mus musculus
acgtctttcagaagttctatgcaag

SEQ ID NO: 181475 - DNA, 25 bp, Mus musculus
acgtctttcagacagacatgagtgt

SEQ ID NO: 181476 - DNA, 25 bp, Mus musculus
acgtctttgaccatccatgggaaac

SEQ ID NO: 181477 - DNA, 25 bp, Mus musculus
acgtctttgacttattggtgcagca

SEQ ID NO: 181478 - DNA, 25 bp, Mus musculus
acgtgaaagaaacagaggtcaacag

SEQ ID NO: 181479 - DNA, 25 bp, Mus musculus
acgtgaaagaaacagcttttaaaga

SEQ ID NO: 181480 - DNA, 25 bp, Mus musculus
acgtgaaagataaagcttttaaaga

SEQ ID NO: 181481 - DNA, 25 bp, Mus musculus
acgtgaaaggcaaagccatgtcata

SEQ ID NO: 181482 - DNA, 25 bp, Mus musculus
acgtgaagactgacaagcactgccc

SEQ ID NO: 181483 - DNA, 25 bp, Mus musculus
acgtgaagagagggcacatctgctg

SEQ ID NO: 181484 - DNA, 25 bp, Mus musculus
acgtgaagatgcgcatgggaggctt

SEQ ID NO: 181485 - DNA, 25 bp, Mus musculus
acgtgaagggaggggatcaaactct

SEQ ID NO: 181486 - DNA, 25 bp, Mus musculus
acgtgacaaataaccctggcactgt

SEQ ID NO: 181487 - DNA, 25 bp, Mus musculus
acgtgaccagtatggcaagaagaag

SEQ ID NO: 181488 - DNA, 25 bp, Mus musculus
acgtgagagatctgaagcagataaa

SEQ ID NO: 181489 - DNA, 25 bp, Mus musculus
acgtgagcaggaggagctgagcaag

SEQ ID NO: 181490 - DNA, 25 bp, Mus musculus
acgtgaggaacaaagacaaagccag

SEQ ID NO: 181491 - DNA, 25 bp, Mus musculus
acgtgagtacgccaggagtgagaga

SEQ ID NO: 181492 - DNA, 25 bp, Mus musculus
acgtgataagaatttattctctccg

SEQ ID NO: 181493 - DNA, 25 bp, Mus musculus
acgtgatacgatgagcagctctcaa

SEQ ID NO: 181494 - DNA, 25 bp, Mus musculus
acgtgatcaaaggtatgagggtgct

SEQ ID NO: 181495 - DNA, 25 bp, Mus musculus
acgtgatgacagggtccaaggctgc

SEQ ID NO: 181496 - DNA, 25 bp, Mus musculus
acgtgcaaaaggtaactttcggcct

SEQ ID NO: 181497 - DNA, 25 bp, Mus musculus
acgtgcaatcacaggtggataccct

SEQ ID NO: 181498 - DNA, 25 bp, Mus musculus
acgtgcacatccgagatgatgggcg

SEQ ID NO: 181499 - DNA, 25 bp, Mus musculus
acgtgcactatgagtctacctgaag

SEQ ID NO: 181500 - DNA, 25 bp, Mus musculus
acgtgcagaacagagcctacttcca

SEQ ID NO: 181501 - DNA, 25 bp, Mus musculus
acgtgcagaggggtaccccaagatg

SEQ ID NO: 181502 - DNA, 25 bp, Mus musculus
acgtgcagatggtggacccagtgcc

SEQ ID NO: 181503 - DNA, 25 bp, Mus musculus
acgtgcatgaagacataccgacgct

SEQ ID NO: 181504 - DNA, 25 bp, Mus musculus
acgtgccaaaatatctactagaaat

SEQ ID NO: 181505 - DNA, 25 bp, Mus musculus
acgtgccaagcccagcactatggtg

SEQ ID NO: 181506 - DNA, 25 bp, Mus musculus
acgtgcccggaaagccccggcagcc

SEQ ID NO: 181507 - DNA, 25 bp, Mus musculus
acgtgccggcagaggtggtttgtgc

SEQ ID NO: 181508 - DNA, 25 bp, Mus musculus
acgtgccggcagcagagacttgctg

SEQ ID NO: 181509 - DNA, 25 bp, Mus musculus
acgtgccgtagcggggatgatgagc

SEQ ID NO: 181510 - DNA, 25 bp, Mus musculus
acgtgcctatactagtgagcatcag

SEQ ID NO: 181511 - DNA, 25 bp, Mus musculus
acgtgcgcctgcaggtctctgcaag

SEQ ID NO: 181512 - DNA, 25 bp, Mus musculus
acgtgcgcctgcaggtggtggtgga

SEQ ID NO: 181513 - DNA, 25 bp, Mus musculus
acgtgcgcctgcaggttcacattga

SEQ ID NO: 181514 - DNA, 25 bp, Mus musculus
acgtgctaataagattgagtctgtt

SEQ ID NO: 181515 - DNA, 25 bp, Mus musculus
acgtgctaataaggggttgatagtc

SEQ ID NO: 181516 - DNA, 25 bp, Mus musculus
acgtgctcaccagtttgacttcgga

SEQ ID NO: 181517 - DNA, 25 bp, Mus musculus
acgtgctcagagcagagcctctaaa

SEQ ID NO: 181518 - DNA, 25 bp, Mus musculus
acgtgctcagccctttgttcaggcc

SEQ ID NO: 181519 - DNA, 25 bp, Mus musculus
acgtgctccccttctgctgcagaag

SEQ ID NO: 181520 - DNA, 25 bp, Mus musculus
acgtgctgcaaggtgatgaagtctc

SEQ ID NO: 181521 - DNA, 25 bp, Mus musculus
acgtgctgccgtttagctcgatgag

SEQ ID NO: 181522 - DNA, 25 bp, Mus musculus
acgtgctgggcctggccaggagtga

SEQ ID NO: 181523 - DNA, 25 bp, Mus musculus
acgtgctggtaggcccacagaacat

SEQ ID NO: 181524 - DNA, 25 bp, Mus musculus
acgtgctgtactggatgcaagacgc

SEQ ID NO: 181525 - DNA, 25 bp, Mus musculus
acgtgctgtactgggtcaatgatgc

SEQ ID NO: 181526 - DNA, 25 bp, Mus musculus
acgtgcttggcggcgcctgtgagag

SEQ ID NO: 181527 - DNA, 25 bp, Mus musculus
acgtggaaatacttcggatatcatt

SEQ ID NO: 181528 - DNA, 25 bp, Mus musculus
acgtggaacaagtgctagccattga

SEQ ID NO: 181529 - DNA, 25 bp, Mus musculus
acgtggaagagccggctttcctccc

SEQ ID NO: 181530 - DNA, 25 bp, Mus musculus
acgtggaaggcattttgtgactttt

SEQ ID NO: 181531 - DNA, 25 bp, Mus musculus
acgtggaaggccttgatcctgctcc

SEQ ID NO: 181532 - DNA, 25 bp, Mus musculus
acgtggaagttcaaggactccctta

SEQ ID NO: 181533 - DNA, 25 bp, Mus musculus
acgtggaatatcagaagtgacagac

SEQ ID NO: 181534 - DNA, 25 bp, Mus musculus
acgtggacacttgagaggctacaga

SEQ ID NO: 181535 - DNA, 25 bp, Mus musculus
acgtggaccccagacatcacgagca

SEQ ID NO: 181536 - DNA, 25 bp, Mus musculus
acgtggaccccagcggcagctccgg

SEQ ID NO: 181537 - DNA, 25 bp, Mus musculus
acgtggactacaagatgtcccactt

SEQ ID NO: 181538 - DNA, 25 bp, Mus musculus
acgtggactctacaggagagtattg

SEQ ID NO: 181539 - DNA, 25 bp, Mus musculus
acgtggactgaggtgctgcactgtg

SEQ ID NO: 181540 - DNA, 25 bp, Mus musculus
acgtggagcacctgggagatactgt

SEQ ID NO: 181541 - DNA, 25 bp, Mus musculus
acgtggagcccttgacgcctccttg

SEQ ID NO: 181542 - DNA, 25 bp, Mus musculus
acgtggagtcaaagagtggcttcac

SEQ ID NO: 181543 - DNA, 25 bp, Mus musculus
acgtggagttcagcagcacttggaa

SEQ ID NO: 181544 - DNA, 25 bp, Mus musculus
acgtggatctgcagccatgtcatat

SEQ ID NO: 181545 - DNA, 25 bp, Mus musculus
acgtggatgagtacgctccagaagg

SEQ ID NO: 181546 - DNA, 25 bp, Mus musculus
acgtggatgcaggccctgcttctct

SEQ ID NO: 181547 - DNA, 25 bp, Mus musculus
acgtggatgcagggagcccccgggc

SEQ ID NO: 181548 - DNA, 25 bp, Mus musculus
acgtggattccctccatccatatct

SEQ ID NO: 181549 - DNA, 25 bp, Mus musculus
acgtggccagcttcatcttccgtgg

SEQ ID NO: 181550 - DNA, 25 bp, Mus musculus
acgtggccagtgcttttacagtgag

SEQ ID NO: 181551 - DNA, 25 bp, Mus musculus
acgtggcctccagaagccaccatgg

SEQ ID NO: 181552 - DNA, 25 bp, Mus musculus
acgtggcctgtggagggttgtctac

SEQ ID NO: 181553 - DNA, 25 bp, Mus musculus
acgtggcgaggggatcgtgggattg

SEQ ID NO: 181554 - DNA, 25 bp, Mus musculus
acgtggcgctgtatactccatgttt

SEQ ID NO: 181555 - DNA, 25 bp, Mus musculus
acgtggctgttttgcccattggacg

SEQ ID NO: 181556 - DNA, 25 bp, Mus musculus
acgtggcttaggattgtctaaagcc

SEQ ID NO: 181557 - DNA, 25 bp, Mus musculus
acgtgggaaggcactttccggatga

SEQ ID NO: 181558 - DNA, 25 bp, Mus musculus
acgtgggaccggcccttggtgctga

SEQ ID NO: 181559 - DNA, 25 bp, Mus musculus
acgtgggaccggggtgttgtgctac

SEQ ID NO: 181560 - DNA, 25 bp, Mus musculus
acgtgggccagaggcttcatgtgga

SEQ ID NO: 181561 - DNA, 25 bp, Mus musculus
acgtgggccagagggtccaggtgga

SEQ ID NO: 181562 - DNA, 25 bp, Mus musculus
acgtgggccagatgggccctcctgg

SEQ ID NO: 181563 - DNA, 25 bp, Mus musculus
acgtggggaatgggagaagagttag

SEQ ID NO: 181564 - DNA, 25 bp, Mus musculus
acgtggggaatgggagaagatgctg

SEQ ID NO: 181565 - DNA, 25 bp, Mus musculus
acgtggggttgagactcacacatgt

SEQ ID NO: 181566 - DNA, 25 bp, Mus musculus
acgtgggtgcaggtctcaggagcta

SEQ ID NO: 181567 - DNA, 25 bp, Mus musculus
acgtggtaaaagactacgcgtttgt

SEQ ID NO: 181568 - DNA, 25 bp, Mus musculus
acgtggtacaaccacttccagctgc

SEQ ID NO: 181569 - DNA, 25 bp, Mus musculus
acgtggtacaacccaagtaatgaaa

SEQ ID NO: 181570 - DNA, 25 bp, Mus musculus
acgtggtcaagacccagagaacatg

SEQ ID NO: 181571 - DNA, 25 bp, Mus musculus
acgtggtcaagattgactttgaaga

SEQ ID NO: 181572 - DNA, 25 bp, Mus musculus
acgtggtcaccaacagtcagcgtgg

SEQ ID NO: 181573 - DNA, 25 bp, Mus musculus
acgtggtcgcagacgaagaaatgga

SEQ ID NO: 181574 - DNA, 25 bp, Mus musculus
acgtggtctcactgggcatacttct

SEQ ID NO: 181575 - DNA, 25 bp, Mus musculus
acgtggtgaagaaggttcattatga

SEQ ID NO: 181576 - DNA, 25 bp, Mus musculus
acgtggtgagttcaggtactcagtt

SEQ ID NO: 181577 - DNA, 25 bp, Mus musculus
acgtggtggaaagataaggaattgg

SEQ ID NO: 181578 - DNA, 25 bp, Mus musculus
acgtggtggaaatagacaacctgtt

SEQ ID NO: 181579 - DNA, 25 bp, Mus musculus
acgtggtggaaatagctgcagtacc

SEQ ID NO: 181580 - DNA, 25 bp, Mus musculus
acgtggttcagacagctgtcatcag

SEQ ID NO: 181581 - DNA, 25 bp, Mus musculus
acgtggttcagggtctggagacatg

SEQ ID NO: 181582 - DNA, 25 bp, Mus musculus
acgtggtttatatgcattcacatca

SEQ ID NO: 181583 - DNA, 25 bp, Mus musculus
acgtggtttatatgcttgtgggctt

SEQ ID NO: 181584 - DNA, 25 bp, Mus musculus
acgtggtttgaaagtatccctggaa

SEQ ID NO: 181585 - DNA, 25 bp, Mus musculus
acgtgtactcctggaccatgatgtg

SEQ ID NO: 181586 - DNA, 25 bp, Mus musculus
acgtgtcctatgctgtcttccttgt

SEQ ID NO: 181587 - DNA, 25 bp, Mus musculus
acgtgtcgccaggtcagccatgtca

SEQ ID NO: 181588 - DNA, 25 bp, Mus musculus
acgtgtcgccagtgtggaaggggag

SEQ ID NO: 181589 - DNA, 25 bp, Mus musculus
acgtgtcggaagtgatgggaccagt

SEQ ID NO: 181590 - DNA, 25 bp, Mus musculus
acgtgtctgaagaggaggtgctggg

SEQ ID NO: 181591 - DNA, 25 bp, Mus musculus
acgtgtgagattccctgctccagta

SEQ ID NO: 181592 - DNA, 25 bp, Mus musculus
acgtgtgcaccaggagcacctgagc

SEQ ID NO: 181593 - DNA, 25 bp, Mus musculus
acgtgtgcagataccccggtaccca

SEQ ID NO: 181594 - DNA, 25 bp, Mus musculus
acgtgtgcagcctttgcttttctcc

SEQ ID NO: 181595 - DNA, 25 bp, Mus musculus
acgtgtgcagggtcctgtgggcact

SEQ ID NO: 181596 - DNA, 25 bp, Mus musculus
acgtgtgcagttggcagatattccg

SEQ ID NO: 181597 - DNA, 25 bp, Mus musculus
acgtgtgccggcttgatgcccccaa

SEQ ID NO: 181598 - DNA, 25 bp, Mus musculus
acgtgtgctaggtctcctcctgcct

SEQ ID NO: 181599 - DNA, 25 bp, Mus musculus
acgtgtgctaggtttctgccacctc

SEQ ID NO: 181600 - DNA, 25 bp, Mus musculus
acgtgtgtgcccgtggtatcgatgt

SEQ ID NO: 181601 - DNA, 25 bp, Mus musculus
acgtgtgttgaggagcccaccgcaa

SEQ ID NO: 181602 - DNA, 25 bp, Mus musculus
acgtgttcaatgggcatgttcatca

SEQ ID NO: 181603 - DNA, 25 bp, Mus musculus
acgtgttcatttgtgattcatggca

SEQ ID NO: 181604 - DNA, 25 bp, Mus musculus
acgtgttctatgatgattcggctcc

SEQ ID NO: 181605 - DNA, 25 bp, Mus musculus
acgtgttcttgacagctaccaggga

SEQ ID NO: 181606 - DNA, 25 bp, Mus musculus
acgtgttcttggtttctgccagctc

SEQ ID NO: 181607 - DNA, 25 bp, Mus musculus
acgtgttgttcggagatgggtatcg

SEQ ID NO: 181608 - DNA, 25 bp, Mus musculus
acgtgtttcggaggccgatggcacc

SEQ ID NO: 181609 - DNA, 25 bp, Mus musculus
acgttaagcagattttgaagcatga

SEQ ID NO: 181610 - DNA, 25 bp, Mus musculus
acgttaagcagatttttcattactc

SEQ ID NO: 181611 - DNA, 25 bp, Mus musculus
acgttaatgagtgcaatgctcaccc

SEQ ID NO: 181612 - DNA, 25 bp, Mus musculus
acgttaatgtggttcgtctccaaca

SEQ ID NO: 181613 - DNA, 25 bp, Mus musculus
acgttacaagtgggatgcctggaac

SEQ ID NO: 181614 - DNA, 25 bp, Mus musculus
acgttacccaaaggtggctctgcgg

SEQ ID NO: 181615 - DNA, 25 bp, Mus musculus
acgttagaaggaggattgcttcctg

SEQ ID NO: 181616 - DNA, 25 bp, Mus musculus
acgttagaaggaggccattaggaaa

SEQ ID NO: 181617 - DNA, 25 bp, Mus musculus
acgttagaaggaggggctaaggaga

SEQ ID NO: 181618 - DNA, 25 bp, Mus musculus
acgttaggattgcagcacctaccct

SEQ ID NO: 181619 - DNA, 25 bp, Mus musculus
acgttatgaaagacctgtgttgcgt

SEQ ID NO: 181620 - DNA, 25 bp, Mus musculus
acgttcaacaggcaaagcgagtgga

SEQ ID NO: 181621 - DNA, 25 bp, Mus musculus
acgttcccaagtcggatgtggaaat

SEQ ID NO: 181622 - DNA, 25 bp, Mus musculus
acgttcccaagtcggttaacagtga

SEQ ID NO: 181623 - DNA, 25 bp, Mus musculus
acgttccctgacctcctgtaccctg

SEQ ID NO: 181624 - DNA, 25 bp, Mus musculus
acgttccggaagctgcagcttcaac

SEQ ID NO: 181625 - DNA, 25 bp, Mus musculus
acgttcctttaaaagatcagcatgg

SEQ ID NO: 181626 - DNA, 25 bp, Mus musculus
acgttcgcaactcacggatgattga

SEQ ID NO: 181627 - DNA, 25 bp, Mus musculus
acgttctaaagaccaaggacaagta

SEQ ID NO: 181628 - DNA, 25 bp, Mus musculus
acgttctacttttctggaggcattg

SEQ ID NO: 181629 - DNA, 25 bp, Mus musculus
acgttctatgtgagcaactgggaca

SEQ ID NO: 181630 - DNA, 25 bp, Mus musculus
acgttctatgtgaggaaaaacggga

SEQ ID NO: 181631 - DNA, 25 bp, Mus musculus
acgttctggaagcctttgcttcctt

SEQ ID NO: 181632 - DNA, 25 bp, Mus musculus
acgttgccgacttcctggtggctga

SEQ ID NO: 181633 - DNA, 25 bp, Mus musculus
acgttgccgagaacctgccagatgt

SEQ ID NO: 181634 - DNA, 25 bp, Mus musculus
acgttgccgattttgtcctggatga

SEQ ID NO: 181635 - DNA, 25 bp, Mus musculus
acgttgctctggtcgaatggtatgt

SEQ ID NO: 181636 - DNA, 25 bp, Mus musculus
acgttgctgaggtattatgatcaga

SEQ ID NO: 181637 - DNA, 25 bp, Mus musculus
acgttggatgtaaagacctctcggg

SEQ ID NO: 181638 - DNA, 25 bp, Mus musculus
acgttggccagacagctgagaaggt

SEQ ID NO: 181639 - DNA, 25 bp, Mus musculus
acgttgggaaggaagaacgctgtgg

SEQ ID NO: 181640 - DNA, 25 bp, Mus musculus
acgttggggttcagttctgataccc

SEQ ID NO: 181641 - DNA, 25 bp, Mus musculus
acgttggttggcttttgtttgtcat

SEQ ID NO: 181642 - DNA, 25 bp, Mus musculus
acgttgtatggaagagttactttgg

SEQ ID NO: 181643 - DNA, 25 bp, Mus musculus
acgttgtatggaagatctctgcgat

SEQ ID NO: 181644 - DNA, 25 bp, Mus musculus
acgttgtcatcacagcttagcgctc

SEQ ID NO: 181645 - DNA, 25 bp, Mus musculus
acgttgtcattgagcaagaagagag

SEQ ID NO: 181646 - DNA, 25 bp, Mus musculus
acgttgtggaaggctcaaagcagtg

SEQ ID NO: 181647 - DNA, 25 bp, Mus musculus
acgttgttcatggggcagtaaatgg

SEQ ID NO: 181648 - DNA, 25 bp, Mus musculus
acgttgttgctaagacattcgacat

SEQ ID NO: 181649 - DNA, 25 bp, Mus musculus
acgtttactgtgagttccttcgggg

SEQ ID NO: 181650 - DNA, 25 bp, Mus musculus
acgtttcaacgattgtactgcatct

SEQ ID NO: 181651 - DNA, 25 bp, Mus musculus
acgtttcagccagattctggctggc

SEQ ID NO: 181652 - DNA, 25 bp, Mus musculus
acgtttccaggtatgagatgtacga

SEQ ID NO: 181653 - DNA, 25 bp, Mus musculus
acgtttccagtgcaaacatactctt

SEQ ID NO: 181654 - DNA, 25 bp, Mus musculus
acgtttcccagatctgtctcgagag

SEQ ID NO: 181655 - DNA, 25 bp, Mus musculus
acgtttctaaactacatgagcgatg

SEQ ID NO: 181656 - DNA, 25 bp, Mus musculus
acgtttctcaggttattactctggg

SEQ ID NO: 181657 - DNA, 25 bp, Mus musculus
acgtttcttaactatatgagcgatg

SEQ ID NO: 181658 - DNA, 25 bp, Mus musculus
acgtttgaaggaactctcaagggga

SEQ ID NO: 181659 - DNA, 25 bp, Mus musculus
acgtttgccgctcctgagaaatgct

SEQ ID NO: 181660 - DNA, 25 bp, Mus musculus
acgtttgtcctgctgtgtttcaaat

SEQ ID NO: 181661 - DNA, 25 bp, Mus musculus
acgttttaatcaagtacggcgagct

SEQ ID NO: 181662 - DNA, 25 bp, Mus musculus
acgttttaatcaagtgctaccggac

SEQ ID NO: 181663 - DNA, 25 bp, Mus musculus
acgttttcacactgacttgaatttt

SEQ ID NO: 181664 - DNA, 25 bp, Mus musculus
acgttttcattgtgatctctgggct

SEQ ID NO: 181665 - DNA, 25 bp, Mus musculus
acgttttctcctcagagctgcgcag

SEQ ID NO: 181666 - DNA, 25 bp, Mus musculus
acgttttgctggccttcagtggggc

SEQ ID NO: 181667 - DNA, 25 bp, Mus musculus
acgttttggcaaggagaggccagct

SEQ ID NO: 181668 - DNA, 25 bp, Mus musculus
acgtttttcagaatgccggacacag

SEQ ID NO: 181669 - DNA, 25 bp, Mus musculus
acgttttttgccattggtgtcagca

SEQ ID NO: 181670 - DNA, 25 bp, Mus musculus
actaaaactccaatgtcacagaaaa

SEQ ID NO: 181671 - DNA, 25 bp, Mus musculus
actaaaactccagttccttctgatg

SEQ ID NO: 181672 - DNA, 25 bp, Mus musculus
actaaaagaagtgctcagagttctg

SEQ ID NO: 181673 - DNA, 25 bp, Mus musculus
actaaaagccatgaaagtatatctc

SEQ ID NO: 181674 - DNA, 25 bp, Mus musculus
actaaaagccatgcagcaccagcga

SEQ ID NO: 181675 - DNA, 25 bp, Mus musculus
actaaaaggcagagatgctgattct

SEQ ID NO: 181676 - DNA, 25 bp, Mus musculus
actaaaaggcagagtatgtttgatg

SEQ ID NO: 181677 - DNA, 25 bp, Mus musculus
actaaaataaatatccatgggaaac

SEQ ID NO: 181678 - DNA, 25 bp, Mus musculus
actaaaataaatcatacctgcggtg

SEQ ID NO: 181679 - DNA, 25 bp, Mus musculus
actaaaatactctcctgggttgtgt

SEQ ID NO: 181680 - DNA, 25 bp, Mus musculus
actaaaatcagcaccgtgcgagtcc

SEQ ID NO: 181681 - DNA, 25 bp, Mus musculus
actaaacaagacctcctaagccatg

SEQ ID NO: 181682 - DNA, 25 bp, Mus musculus
actaaacactctactggatgactgg

SEQ ID NO: 181683 - DNA, 25 bp, Mus musculus
actaaagaagaaaaatgatacctta

SEQ ID NO: 181684 - DNA, 25 bp, Mus musculus
actaaagacgtaagttgaagatgtg

SEQ ID NO: 181685 - DNA, 25 bp, Mus musculus
actaaagatgcagctttgcagaaac

SEQ ID NO: 181686 - DNA, 25 bp, Mus musculus
actaaagatgcaggaacctccttct

SEQ ID NO: 181687 - DNA, 25 bp, Mus musculus
actaaagcagaggtgaaagacaagg

SEQ ID NO: 181688 - DNA, 25 bp, Mus musculus
actaaagccaaaaccaacagcagct

SEQ ID NO: 181689 - DNA, 25 bp, Mus musculus
actaaagccggagactcttcctgat

SEQ ID NO: 181690 - DNA, 25 bp, Mus musculus
actaaagccggagcgtgtttggtgc

SEQ ID NO: 181691 - DNA, 25 bp, Mus musculus
actaaagctcagcagaaaatgaaaa

SEQ ID NO: 181692 - DNA, 25 bp, Mus musculus
actaaagctcagcaggaaataacag

SEQ ID NO: 181693 - DNA, 25 bp, Mus musculus
actaaagtagagactcagggtgacc

SEQ ID NO: 181694 - DNA, 25 bp, Mus musculus
actaaagtcattaagggtgatgttt

SEQ ID NO: 181695 - DNA, 25 bp, Mus musculus
actaaagttgaagagatccacgtct

SEQ ID NO: 181696 - DNA, 25 bp, Mus musculus
actaaagttgaagaggcacagagaa

SEQ ID NO: 181697 - DNA, 25 bp, Mus musculus
actaaagttgttcaaggcctggcag

SEQ ID NO: 181698 - DNA, 25 bp, Mus musculus
actaaataatcagtatgaagctgct

SEQ ID NO: 181699 - DNA, 25 bp, Mus musculus
actaaatcatccatgcatcatcaag

SEQ ID NO: 181700 - DNA, 25 bp, Mus musculus
actaaatccgagaggtcgaaggatc

SEQ ID NO: 181701 - DNA, 25 bp, Mus musculus
actaacaaggataagaagcatttgg

SEQ ID NO: 181702 - DNA, 25 bp, Mus musculus
actaacacacaagaatcgcagaatg

SEQ ID NO: 181703 - DNA, 25 bp, Mus musculus
actaacaccaaggtcacaaagcact

SEQ ID NO: 181704 - DNA, 25 bp, Mus musculus
actaacacctagagagttgcttcag

SEQ ID NO: 181705 - DNA, 25 bp, Mus musculus
actaacagagatgattctgacaatg

SEQ ID NO: 181706 - DNA, 25 bp, Mus musculus
actaacagctctgggatgtcacagc

SEQ ID NO: 181707 - DNA, 25 bp, Mus musculus
actaacatattttaatttcaggaat

SEQ ID NO: 181708 - DNA, 25 bp, Mus musculus
actaacatattttatccaagtttgg

SEQ ID NO: 181709 - DNA, 25 bp, Mus musculus
actaacatctaaggtgccaagtgct

SEQ ID NO: 181710 - DNA, 25 bp, Mus musculus
actaacatgcaatgatcttcccaaa

SEQ ID NO: 181711 - DNA, 25 bp, Mus musculus
actaacattagaaatccacaggtag

SEQ ID NO: 181712 - DNA, 25 bp, Mus musculus
actaaccagactgagatggaccaca

SEQ ID NO: 181713 - DNA, 25 bp, Mus musculus
actaaccatcatgagatatctgcca

SEQ ID NO: 181714 - DNA, 25 bp, Mus musculus
actaaccccgaaggcaaataagatt

SEQ ID NO: 181715 - DNA, 25 bp, Mus musculus
actaaccctacagggtgactacaac

SEQ ID NO: 181716 - DNA, 25 bp, Mus musculus
actaactaaaggatgacagtccccg

SEQ ID NO: 181717 - DNA, 25 bp, Mus musculus
actaactctgagaaggtctattaca

SEQ ID NO: 181718 - DNA, 25 bp, Mus musculus
actaactgagaaatgcaaacagatt

SEQ ID NO: 181719 - DNA, 25 bp, Mus musculus
actaactgagttttagaagccaaac

SEQ ID NO: 181720 - DNA, 25 bp, Mus musculus
actaactgctcaatagtgaaattcc

SEQ ID NO: 181721 - DNA, 25 bp, Mus musculus
actaacttacacctcgttttactgc

SEQ ID NO: 181722 - DNA, 25 bp, Mus musculus
actaacttctgggccaacaaattac

SEQ ID NO: 181723 - DNA, 25 bp, Mus musculus
actaacttttacaagacagtccagc

SEQ ID NO: 181724 - DNA, 25 bp, Mus musculus
actaacttttacaaggtggtacagc

SEQ ID NO: 181725 - DNA, 25 bp, Mus musculus
actaagaaaaacaagggaagcttag

SEQ ID NO: 181726 - DNA, 25 bp, Mus musculus
actaagaaaacagagaaacctgatc

SEQ ID NO: 181727 - DNA, 25 bp, Mus musculus
actaagaaagagaccagtgctgttg

SEQ ID NO: 181728 - DNA, 25 bp, Mus musculus
actaagaacaagaaaacagataaat

SEQ ID NO: 181729 - DNA, 25 bp, Mus musculus
actaagaagacccagagtgatatcc

SEQ ID NO: 181730 - DNA, 25 bp, Mus musculus
actaagaaggagaagaccaccagac

SEQ ID NO: 181731 - DNA, 25 bp, Mus musculus
actaagactaaatgggtgaccgagg

SEQ ID NO: 181732 - DNA, 25 bp, Mus musculus
actaagagcccaggttgtctgttct

SEQ ID NO: 181733 - DNA, 25 bp, Mus musculus
actaagagcccagtgccatgtcgga

SEQ ID NO: 181734 - DNA, 25 bp, Mus musculus
actaagataggctgagcatcccagc

SEQ ID NO: 181735 - DNA, 25 bp, Mus musculus
actaagataggctggagtcccctcc

SEQ ID NO: 181736 - DNA, 25 bp, Mus musculus
actaagcaagaacaatactacaaga

SEQ ID NO: 181737 - DNA, 25 bp, Mus musculus
actaagcaagaagactaagaacatt

SEQ ID NO: 181738 - DNA, 25 bp, Mus musculus
actaagcaagaagtggtggtaatca

SEQ ID NO: 181739 - DNA, 25 bp, Mus musculus
actaagcaagaatgagctgaagagg

SEQ ID NO: 181740 - DNA, 25 bp, Mus musculus
actaagcaaggtaacccagcatgta

SEQ ID NO: 181741 - DNA, 25 bp, Mus musculus
actaagcacaagagtcacctgtacc

SEQ ID NO: 181742 - DNA, 25 bp, Mus musculus
actaagcacctagagacaagtaagc

SEQ ID NO: 181743 - DNA, 25 bp, Mus musculus
actaagcatttagaatgcacaaaac

SEQ ID NO: 181744 - DNA, 25 bp, Mus musculus
actaagcctaaggtgctgtgctcca

SEQ ID NO: 181745 - DNA, 25 bp, Mus musculus
actaaggaaacaggtctggaaccaa

SEQ ID NO: 181746 - DNA, 25 bp, Mus musculus
actaaggaacaggtgtggtatcagt

SEQ ID NO: 181747 - DNA, 25 bp, Mus musculus
actaaggagggcctggtttctcact

SEQ ID NO: 181748 - DNA, 25 bp, Mus musculus
actaaggagggcgcagatgtccaaa

SEQ ID NO: 181749 - DNA, 25 bp, Mus musculus
actaaggcaaagattattggatttg

SEQ ID NO: 181750 - DNA, 25 bp, Mus musculus
actaaggcaatcgtgaagtcctacc

SEQ ID NO: 181751 - DNA, 25 bp, Mus musculus
actaaggcagggcctagtaactatc

SEQ ID NO: 181752 - DNA, 25 bp, Mus musculus
actaaggccaagcttctggggtttg

SEQ ID NO: 181753 - DNA, 25 bp, Mus musculus
actaaggcccagggctgtaccatgg

SEQ ID NO: 181754 - DNA, 25 bp, Mus musculus
actaaggcccaggtccctatttgtt

SEQ ID NO: 181755 - DNA, 25 bp, Mus musculus
actaaggcggcaggaccctgagccg

SEQ ID NO: 181756 - DNA, 25 bp, Mus musculus
actaagggggcagccttgcagcaga

SEQ ID NO: 181757 - DNA, 25 bp, Mus musculus
actaagggggcagctttgtcgaaac

SEQ ID NO: 181758 - DNA, 25 bp, Mus musculus
actaagtactttggcagcccgggcc

SEQ ID NO: 181759 - DNA, 25 bp, Mus musculus
actaagtgcaagatatgaaattgtt

SEQ ID NO: 181760 - DNA, 25 bp, Mus musculus
actaagtggaggttccatgttggat

SEQ ID NO: 181761 - DNA, 25 bp, Mus musculus
actaagttcaaacaggcagctgaga

SEQ ID NO: 181762 - DNA, 25 bp, Mus musculus
actaagttcaaacagtcgagagcta

SEQ ID NO: 181763 - DNA, 25 bp, Mus musculus
actaataaaaacagaacagttgaat

SEQ ID NO: 181764 - DNA, 25 bp, Mus musculus
actaataaagaagtgtgctggtgtc

SEQ ID NO: 181765 - DNA, 25 bp, Mus musculus
actaatatctttgggagacgctctg

SEQ ID NO: 181766 - DNA, 25 bp, Mus musculus
actaatatctttggtctgtccgaat

SEQ ID NO: 181767 - DNA, 25 bp, Mus musculus
actaatattcaagacgccttgggat

SEQ ID NO: 181768 - DNA, 25 bp, Mus musculus
actaatcaaaatacgcctactatta

SEQ ID NO: 181769 - DNA, 25 bp, Mus musculus
actaatcaaagtggacccaacagta

SEQ ID NO: 181770 - DNA, 25 bp, Mus musculus
actaatcaaggacactgacatcaat

SEQ ID NO: 181771 - DNA, 25 bp, Mus musculus
actaatcacatccgctgcgagcctg

SEQ ID NO: 181772 - DNA, 25 bp, Mus musculus
actaatctgaaggtgccctgggaca

SEQ ID NO: 181773 - DNA, 25 bp, Mus musculus
actaatgaaagaggttaggaatttg

SEQ ID NO: 181774 - DNA, 25 bp, Mus musculus
actaatgagatggatcccccggatg

SEQ ID NO: 181775 - DNA, 25 bp, Mus musculus
actaatgccactaaacctggaccct

SEQ ID NO: 181776 - DNA, 25 bp, Mus musculus
actaatggaatgggcattatattta

SEQ ID NO: 181777 - DNA, 25 bp, Mus musculus
actaatggaatgggccttgcattta

SEQ ID NO: 181778 - DNA, 25 bp, Mus musculus
actaatggcagttggatcctccaga

SEQ ID NO: 181779 - DNA, 25 bp, Mus musculus
actaatgggttatattatgggcaaa

SEQ ID NO: 181780 - DNA, 25 bp, Mus musculus
actaatgtcgaaagagatgacatca

SEQ ID NO: 181781 - DNA, 25 bp, Mus musculus
actaatgtcggcacaccattcccca

SEQ ID NO: 181782 - DNA, 25 bp, Mus musculus
actaattactgaaaaagaagttatt

SEQ ID NO: 181783 - DNA, 25 bp, Mus musculus
actaattactggattctgctctaat

SEQ ID NO: 181784 - DNA, 25 bp, Mus musculus
actaattgatgagatggttggtaaa

SEQ ID NO: 181785 - DNA, 25 bp, Mus musculus
actaatttagagatgaaatccttca

SEQ ID NO: 181786 - DNA, 25 bp, Mus musculus
actaatttagaggggctccatagac

SEQ ID NO: 181787 - DNA, 25 bp, Mus musculus
actacaaaagcagaatgattgaaga

SEQ ID NO: 181788 - DNA, 25 bp, Mus musculus
actacaaacagtactttgtgttctg

SEQ ID NO: 181789 - DNA, 25 bp, Mus musculus
actacaaactgactggttctgcagc

SEQ ID NO: 181790 - DNA, 25 bp, Mus musculus
actacaaagacaggagcgaatccgt

SEQ ID NO: 181791 - DNA, 25 bp, Mus musculus
actacaaagacaggtgtaacgtgga

SEQ ID NO: 181792 - DNA, 25 bp, Mus musculus
actacaaagacagttcagggcgaca

SEQ ID NO: 181793 - DNA, 25 bp, Mus musculus
actacaacaacgagcatcgaggagt

SEQ ID NO: 181794 - DNA, 25 bp, Mus musculus
actacaacagcgtccatgccattga

SEQ ID NO: 181795 - DNA, 25 bp, Mus musculus
actacaacatggagcatatccgtgt

SEQ ID NO: 181796 - DNA, 25 bp, Mus musculus
actacaaccactcagggcttcacac

SEQ ID NO: 181797 - DNA, 25 bp, Mus musculus
actacaacctggactgcagtgaggt

SEQ ID NO: 181798 - DNA, 25 bp, Mus musculus
actacaacctggcgtgacgggactg

SEQ ID NO: 181799 - DNA, 25 bp, Mus musculus
actacaaccttgcggagtgtgcaga

SEQ ID NO: 181800 - DNA, 25 bp, Mus musculus
actacaagatgaggatgataatgat

SEQ ID NO: 181801 - DNA, 25 bp, Mus musculus
actacaagatgcagtatggtggggc

SEQ ID NO: 181802 - DNA, 25 bp, Mus musculus
actacaaggacccccagagttgatg

SEQ ID NO: 181803 - DNA, 25 bp, Mus musculus
actacaagggacaggtgctgaagca

SEQ ID NO: 181804 - DNA, 25 bp, Mus musculus
actacaagttgtcagggctccagtg

SEQ ID NO: 181805 - DNA, 25 bp, Mus musculus
actacaataagtgtttcctcaatgt

SEQ ID NO: 181806 - DNA, 25 bp, Mus musculus
actacaatccagaggagtctctgtt

SEQ ID NO: 181807 - DNA, 25 bp, Mus musculus
actacacaagcacagcacggccctg

SEQ ID NO: 181808 - DNA, 25 bp, Mus musculus
actacacaatggagcatatccgtgt

SEQ ID NO: 181809 - DNA, 25 bp, Mus musculus
actacacagccattaggaaccagcc

SEQ ID NO: 181810 - DNA, 25 bp, Mus musculus
actacaccacagattatcagctgta

SEQ ID NO: 181811 - DNA, 25 bp, Mus musculus
actacaccactacatggaaaaaaga

SEQ ID NO: 181812 - DNA, 25 bp, Mus musculus
actacaccatgccagtcttcccacc

SEQ ID NO: 181813 - DNA, 25 bp, Mus musculus
actacacccccatgtatggctgtaa

SEQ ID NO: 181814 - DNA, 25 bp, Mus musculus
actacaccctgacaactggagtgga

SEQ ID NO: 181815 - DNA, 25 bp, Mus musculus
actacaccctgtccccagaattcca

SEQ ID NO: 181816 - DNA, 25 bp, Mus musculus
actacaccttagccagtccaaactg

SEQ ID NO: 181817 - DNA, 25 bp, Mus musculus
actacacgagacctgtgttcctgtg

SEQ ID NO: 181818 - DNA, 25 bp, Mus musculus
actacacgtacgtgaaggaattccg

SEQ ID NO: 181819 - DNA, 25 bp, Mus musculus
actacactactgactccatgcctgc

SEQ ID NO: 181820 - DNA, 25 bp, Mus musculus
actacacttctcaggttcctgtccc

SEQ ID NO: 181821 - DNA, 25 bp, Mus musculus
actacacttctggagaccacatgtg

SEQ ID NO: 181822 - DNA, 25 bp, Mus musculus
actacacttctggaggaaaatatgt

SEQ ID NO: 181823 - DNA, 25 bp, Mus musculus
actacagagcagaaaaggaaggccg

SEQ ID NO: 181824 - DNA, 25 bp, Mus musculus
actacagcaacgaccctgaggacgg

SEQ ID NO: 181825 - DNA, 25 bp, Mus musculus
actacagccctgatcacaagtgctc

SEQ ID NO: 181826 - DNA, 25 bp, Mus musculus
actacagcgacagagagcacctaaa

SEQ ID NO: 181827 - DNA, 25 bp, Mus musculus
actacagcgagagtctatataaact

SEQ ID NO: 181828 - DNA, 25 bp, Mus musculus
actacaggctttttcttacttctcg

SEQ ID NO: 181829 - DNA, 25 bp, Mus musculus
actacagtacagctaggtagaagcc

SEQ ID NO: 181830 - DNA, 25 bp, Mus musculus
actacagtgaagatcgttaccagaa

SEQ ID NO: 181831 - DNA, 25 bp, Mus musculus
actacataagcgaagctctggggtc

SEQ ID NO: 181832 - DNA, 25 bp, Mus musculus
actacatacgatctcctccacaact

SEQ ID NO: 181833 - DNA, 25 bp, Mus musculus
actacatcaggaactggtttgaggg

SEQ ID NO: 181834 - DNA, 25 bp, Mus musculus
actacatcatgtttggacctgatat

SEQ ID NO: 181835 - DNA, 25 bp, Mus musculus
actacatcgacatttggctgtacag

SEQ ID NO: 181836 - DNA, 25 bp, Mus musculus
actacatcgacggctaccagagacc

SEQ ID NO: 181837 - DNA, 25 bp, Mus musculus
actacatcgactccctgggctgtga

SEQ ID NO: 181838 - DNA, 25 bp, Mus musculus
actacatgaagtattacaatgacta

SEQ ID NO: 181839 - DNA, 25 bp, Mus musculus
actacatgaagtgccctccgtttta

SEQ ID NO: 181840 - DNA, 25 bp, Mus musculus
actacatgctgcagctgctgttgat

SEQ ID NO: 181841 - DNA, 25 bp, Mus musculus
actacatgctgcagttggtgcttcc

SEQ ID NO: 181842 - DNA, 25 bp, Mus musculus
actacatggagcagttaacgcgggg

SEQ ID NO: 181843 - DNA, 25 bp, Mus musculus
actacatggccatccacaaggaggc

SEQ ID NO: 181844 - DNA, 25 bp, Mus musculus
actacatgtccttctgcgcgtgcgc

SEQ ID NO: 181845 - DNA, 25 bp, Mus musculus
actacattaaagttctttcagatta

SEQ ID NO: 181846 - DNA, 25 bp, Mus musculus
actacattatatatgcaagttctgc

SEQ ID NO: 181847 - DNA, 25 bp, Mus musculus
actacattatatctacatcaaatgg

SEQ ID NO: 181848 - DNA, 25 bp, Mus musculus
actaccaaaacgaaaatgcaaaatt

SEQ ID NO: 181849 - DNA, 25 bp, Mus musculus
actaccaacagctcttcgcggcaaa

SEQ ID NO: 181850 - DNA, 25 bp, Mus musculus
actaccacaaggggacatgaagcag

SEQ ID NO: 181851 - DNA, 25 bp, Mus musculus
actaccaccaccaccacggcgacga

SEQ ID NO: 181852 - DNA, 25 bp, Mus musculus
actaccacccaggaactaaggcaag

SEQ ID NO: 181853 - DNA, 25 bp, Mus musculus
actaccacccaggctgacccttcca

SEQ ID NO: 181854 - DNA, 25 bp, Mus musculus
actaccagaatgttgaccccaacaa

SEQ ID NO: 181855 - DNA, 25 bp, Mus musculus
actaccagaccccaggtatgcgaga

SEQ ID NO: 181856 - DNA, 25 bp, Mus musculus
actaccagaccccaggttccagtgc

SEQ ID NO: 181857 - DNA, 25 bp, Mus musculus
actaccagcagacttttgatttcaa

SEQ ID NO: 181858 - DNA, 25 bp, Mus musculus
actaccagcaggagtcgcctcccgt

SEQ ID NO: 181859 - DNA, 25 bp, Mus musculus
actaccagcaggcgttgctgctgct

SEQ ID NO: 181860 - DNA, 25 bp, Mus musculus
actaccagcccaggtcaaccattcg

SEQ ID NO: 181861 - DNA, 25 bp, Mus musculus
actaccagctgaagacttgattgca

SEQ ID NO: 181862 - DNA, 25 bp, Mus musculus
actaccagctggcctataggttgca

SEQ ID NO: 181863 - DNA, 25 bp, Mus musculus
actaccagctgggtaacgacattgc

SEQ ID NO: 181864 - DNA, 25 bp, Mus musculus
actaccatcacagagtcaaatccac

SEQ ID NO: 181865 - DNA, 25 bp, Mus musculus
actaccatcggctatggcaatatag

SEQ ID NO: 181866 - DNA, 25 bp, Mus musculus
actacccacctttggaatgactatt

SEQ ID NO: 181867 - DNA, 25 bp, Mus musculus
actacccaggcgggtatggtggggc

SEQ ID NO: 181868 - DNA, 25 bp, Mus musculus
actaccccatgagcatgtaccagag

SEQ ID NO: 181869 - DNA, 25 bp, Mus musculus
actaccccatgcctccagtccctgg

SEQ ID NO: 181870 - DNA, 25 bp, Mus musculus
actaccccgggaggcaccaggatca

SEQ ID NO: 181871 - DNA, 25 bp, Mus musculus
actaccctttactgaaattaccatg

SEQ ID NO: 181872 - DNA, 25 bp, Mus musculus
actaccgcatgaggttctactttac

SEQ ID NO: 181873 - DNA, 25 bp, Mus musculus
actaccgtggtggagggaaaaatgg

SEQ ID NO: 181874 - DNA, 25 bp, Mus musculus
actaccgtggtggaggttgaagaaa

SEQ ID NO: 181875 - DNA, 25 bp, Mus musculus
actacctacaatacccttcgagcac

SEQ ID NO: 181876 - DNA, 25 bp, Mus musculus
actacctacagcggcagaacccggg

SEQ ID NO: 181877 - DNA, 25 bp, Mus musculus
actacctagtcacagagggctttaa

SEQ ID NO: 181878 - DNA, 25 bp, Mus musculus
actacctagtcacagcaacaacact

SEQ ID NO: 181879 - DNA, 25 bp, Mus musculus
actacctcaacagacatttgctcca

SEQ ID NO: 181880 - DNA, 25 bp, Mus musculus
actacctcaactaatttgtgatcct

SEQ ID NO: 181881 - DNA, 25 bp, Mus musculus
actacctccaggtcggagtgacctc

SEQ ID NO: 181882 - DNA, 25 bp, Mus musculus
actacctccaggtggttgttggaga

SEQ ID NO: 181883 - DNA, 25 bp, Mus musculus
actacctcctaatggtttctgtagc

SEQ ID NO: 181884 - DNA, 25 bp, Mus musculus
actacctcctttcgcttcaagcaca

SEQ ID NO: 181885 - DNA, 25 bp, Mus musculus
actacctctagacgccagccttctc

SEQ ID NO: 181886 - DNA, 25 bp, Mus musculus
actacctctatttcgccatgagcta

SEQ ID NO: 181887 - DNA, 25 bp, Mus musculus
actacctctggatgtcgtcacgctg

SEQ ID NO: 181888 - DNA, 25 bp, Mus musculus
actacctctggatgtgtcttcggag

SEQ ID NO: 181889 - DNA, 25 bp, Mus musculus
actacctctggatgttgaacagcgt

SEQ ID NO: 181890 - DNA, 25 bp, Mus musculus
actacctctgtgaggtttttcaaga

SEQ ID NO: 181891 - DNA, 25 bp, Mus musculus
actacctcttaggtctctttgagcc

SEQ ID NO: 181892 - DNA, 25 bp, Mus musculus
actacctctttaaagatactatcgt

SEQ ID NO: 181893 - DNA, 25 bp, Mus musculus
actacctgaggctggcccagcctga

SEQ ID NO: 181894 - DNA, 25 bp, Mus musculus
actacctgagggtgaacaacatgcc

SEQ ID NO: 181895 - DNA, 25 bp, Mus musculus
actacctgccactggtgcggaagat

SEQ ID NO: 181896 - DNA, 25 bp, Mus musculus
actacctgccactggtgtagataca

SEQ ID NO: 181897 - DNA, 25 bp, Mus musculus
actacctgcggacagacaactgagg

SEQ ID NO: 181898 - DNA, 25 bp, Mus musculus
actacctgcggacagtctcctgccc

SEQ ID NO: 181899 - DNA, 25 bp, Mus musculus
actacctggatagcatgtacatcat

SEQ ID NO: 181900 - DNA, 25 bp, Mus musculus
actacctggatgcccagtactatgg

SEQ ID NO: 181901 - DNA, 25 bp, Mus musculus
actacctgtgggctctggggtgtgg

SEQ ID NO: 181902 - DNA, 25 bp, Mus musculus
actacgaaggaggaaactcccagta

SEQ ID NO: 181903 - DNA, 25 bp, Mus musculus
actacgagacggtggtgaaagtgaa

SEQ ID NO: 181904 - DNA, 25 bp, Mus musculus
actacgagctaaggaggctcgcatg

SEQ ID NO: 181905 - DNA, 25 bp, Mus musculus
actacgagctcagaaacaaatacat

SEQ ID NO: 181906 - DNA, 25 bp, Mus musculus
actacgagctcagaatattattggc

SEQ ID NO: 181907 - DNA, 25 bp, Mus musculus
actacgagctcaggtcctgaacttt

SEQ ID NO: 181908 - DNA, 25 bp, Mus musculus
actacgagcttaagtacccaccagt

SEQ ID NO: 181909 - DNA, 25 bp, Mus musculus
actacgagtaccggcatgtcatgtt

SEQ ID NO: 181910 - DNA, 25 bp, Mus musculus
actacgagtatctggaagtacaaag

SEQ ID NO: 181911 - DNA, 25 bp, Mus musculus
actacgagtatctggacatgtcctc

SEQ ID NO: 181912 - DNA, 25 bp, Mus musculus
actacgagtatctggctcagagaca

SEQ ID NO: 181913 - DNA, 25 bp, Mus musculus
actacgagtatctggttttaacagc

SEQ ID NO: 181914 - DNA, 25 bp, Mus musculus
actacgagtctgaggctgcttatga

SEQ ID NO: 181915 - DNA, 25 bp, Mus musculus
actacgattatccagataagtagca

SEQ ID NO: 181916 - DNA, 25 bp, Mus musculus
actacgattcatcccatcagattgt

SEQ ID NO: 181917 - DNA, 25 bp, Mus musculus
actacgattccatgtacacggcttc

SEQ ID NO: 181918 - DNA, 25 bp, Mus musculus
actacgcatgcccagctcaagaagg

SEQ ID NO: 181919 - DNA, 25 bp, Mus musculus
actacgcatgcccaggctcctgctc

SEQ ID NO: 181920 - DNA, 25 bp, Mus musculus
actacgccatggagatgctctacat

SEQ ID NO: 181921 - DNA, 25 bp, Mus musculus
actacgcctcccccggcccacaatg

SEQ ID NO: 181922 - DNA, 25 bp, Mus musculus
actacgctgatggcagtgaagacaa

SEQ ID NO: 181923 - DNA, 25 bp, Mus musculus
actacgctgtggaactgtttgaagg

SEQ ID NO: 181924 - DNA, 25 bp, Mus musculus
actacggaaagaatgatgaagtgga

SEQ ID NO: 181925 - DNA, 25 bp, Mus musculus
actacggaaagatcagaaacatcga

SEQ ID NO: 181926 - DNA, 25 bp, Mus musculus
actacggaaaggtgactcagaactg

SEQ ID NO: 181927 - DNA, 25 bp, Mus musculus
actacggactgacgctgcacctggt

SEQ ID NO: 181928 - DNA, 25 bp, Mus musculus
actacggcccagcaggaccaaactc

SEQ ID NO: 181929 - DNA, 25 bp, Mus musculus
actacggctgtcaacctaatgtctg

SEQ ID NO: 181930 - DNA, 25 bp, Mus musculus
actacgggaagcacgggacgcctca

SEQ ID NO: 181931 - DNA, 25 bp, Mus musculus
actacgggcagtgatgatgactgtg

SEQ ID NO: 181932 - DNA, 25 bp, Mus musculus
actacggtagtagctcctggtttgc

SEQ ID NO: 181933 - DNA, 25 bp, Mus musculus
actacggttgtcagaaacttatgga

SEQ ID NO: 181934 - DNA, 25 bp, Mus musculus
actacggttgtcagtccgcagatgc

SEQ ID NO: 181935 - DNA, 25 bp, Mus musculus
actacgtacaagatgaacatctgca

SEQ ID NO: 181936 - DNA, 25 bp, Mus musculus
actacgtacaaggaatcaaagaaga

SEQ ID NO: 181937 - DNA, 25 bp, Mus musculus
actacgtcatgcagtgcccttccag

SEQ ID NO: 181938 - DNA, 25 bp, Mus musculus
actacgtcatggtcatctgctatat

SEQ ID NO: 181939 - DNA, 25 bp, Mus musculus
actacgtgaagcaacatcctttgta

SEQ ID NO: 181940 - DNA, 25 bp, Mus musculus
actacgtgcaaaaggtaactttcgg

SEQ ID NO: 181941 - DNA, 25 bp, Mus musculus
actacgtggcagctggatcagacat

SEQ ID NO: 181942 - DNA, 25 bp, Mus musculus
actacgtggcaggtggatcagacat

SEQ ID NO: 181943 - DNA, 25 bp, Mus musculus
actacgtgtcctatgctgtcttcct

SEQ ID NO: 181944 - DNA, 25 bp, Mus musculus
actacgttcaacaggcaaagcgagt

SEQ ID NO: 181945 - DNA, 25 bp, Mus musculus
actacgttgatcacctcaaccagaa

SEQ ID NO: 181946 - DNA, 25 bp, Mus musculus
actactacagccctgatcacaagtg

SEQ ID NO: 181947 - DNA, 25 bp, Mus musculus
actactacaggtattaagttcctgt

SEQ ID NO: 181948 - DNA, 25 bp, Mus musculus
actactacagtcacctgaagaagga

SEQ ID NO: 181949 - DNA, 25 bp, Mus musculus
actactacatgatcatctccagagg

SEQ ID NO: 181950 - DNA, 25 bp, Mus musculus
actactaccccatgagcatgtacca

SEQ ID NO: 181951 - DNA, 25 bp, Mus musculus
actactaccccatgcctccagtccc

SEQ ID NO: 181952 - DNA, 25 bp, Mus musculus
actactacgccatggagatgctcta

SEQ ID NO: 181953 - DNA, 25 bp, Mus musculus
actactatcggcgacgcctgggctc

SEQ ID NO: 181954 - DNA, 25 bp, Mus musculus
actactatcggcgtcttcccaaagc

SEQ ID NO: 181955 - DNA, 25 bp, Mus musculus
actactatgaagacatccgttctca

SEQ ID NO: 181956 - DNA, 25 bp, Mus musculus
actactatggagacatttcgacttt

SEQ ID NO: 181957 - DNA, 25 bp, Mus musculus
actactatggaggacagtggttctt

SEQ ID NO: 181958 - DNA, 25 bp, Mus musculus
actactcacaggatgagcagaagct

SEQ ID NO: 181959 - DNA, 25 bp, Mus musculus
actactcacctggttcaaccagatg

SEQ ID NO: 181960 - DNA, 25 bp, Mus musculus
actactcactcagggatgactatga

SEQ ID NO: 181961 - DNA, 25 bp, Mus musculus
actactccacggattacctcacgga

SEQ ID NO: 181962 - DNA, 25 bp, Mus musculus
actactccgagcaggacacttggca

SEQ ID NO: 181963 - DNA, 25 bp, Mus musculus
actactccgagcaggatgacagcac

SEQ ID NO: 181964 - DNA, 25 bp, Mus musculus
actactccgagcagtcatcctttgc

SEQ ID NO: 181965 - DNA, 25 bp, Mus musculus
actactcgtccagctcaagtctctg

SEQ ID NO: 181966 - DNA, 25 bp, Mus musculus
actactctctctcaggcacttgtgg

SEQ ID NO: 181967 - DNA, 25 bp, Mus musculus
actactctctctcaggtctgaacat

SEQ ID NO: 181968 - DNA, 25 bp, Mus musculus
actactgacttgttggcccgtggga

SEQ ID NO: 181969 - DNA, 25 bp, Mus musculus
actactgagacaggatttacatgga

SEQ ID NO: 181970 - DNA, 25 bp, Mus musculus
actactgagggtgtgacttctttaa

SEQ ID NO: 181971 - DNA, 25 bp, Mus musculus
actactgattttagctctgatctca

SEQ ID NO: 181972 - DNA, 25 bp, Mus musculus
actactggactcaagctctcttgag

SEQ ID NO: 181973 - DNA, 25 bp, Mus musculus
actactggcacgatcctcaccacga

SEQ ID NO: 181974 - DNA, 25 bp, Mus musculus
actactggccacaggaccagctgcc

SEQ ID NO: 181975 - DNA, 25 bp, Mus musculus
actactggccctgctctctgctctc

SEQ ID NO: 181976 - DNA, 25 bp, Mus musculus
actactgtaggaacccagcccaacc

SEQ ID NO: 181977 - DNA, 25 bp, Mus musculus
actactgtctgccagccaggtgccc

SEQ ID NO: 181978 - DNA, 25 bp, Mus musculus
actactgtggggtatccgagtggtg

SEQ ID NO: 181979 - DNA, 25 bp, Mus musculus
actactgttcaaaatcgaacaccaa

SEQ ID NO: 181980 - DNA, 25 bp, Mus musculus
actactgtttcaacttctactacta

SEQ ID NO: 181981 - DNA, 25 bp, Mus musculus
actactgtttcctgaactcggaagg

SEQ ID NO: 181982 - DNA, 25 bp, Mus musculus
actactgtttcctgatgcttttggg

SEQ ID NO: 181983 - DNA, 25 bp, Mus musculus
actacttaaactccgactgattgat

SEQ ID NO: 181984 - DNA, 25 bp, Mus musculus
actacttaaagctctggattactgc

SEQ ID NO: 181985 - DNA, 25 bp, Mus musculus
actacttcaaagccaaggactacga

SEQ ID NO: 181986 - DNA, 25 bp, Mus musculus
actacttcaaaggtggtgaaagtga

SEQ ID NO: 181987 - DNA, 25 bp, Mus musculus
actacttctaccaggcggaagatgg

SEQ ID NO: 181988 - DNA, 25 bp, Mus musculus
actacttgcagattctcttctggct

SEQ ID NO: 181989 - DNA, 25 bp, Mus musculus
actacttgcaggccacagacaagcg

SEQ ID NO: 181990 - DNA, 25 bp, Mus musculus
actacttgccgtccggtggagagta

SEQ ID NO: 181991 - DNA, 25 bp, Mus musculus
actacttggcaccggtgcagccttg

SEQ ID NO: 181992 - DNA, 25 bp, Mus musculus
actactttaagggactgatggacgg

SEQ ID NO: 181993 - DNA, 25 bp, Mus musculus
actactttagggccatgttcactgg

SEQ ID NO: 181994 - DNA, 25 bp, Mus musculus
actactttagtgctgaggtgacact

SEQ ID NO: 181995 - DNA, 25 bp, Mus musculus
actactttatcaaagtgatctcagc

SEQ ID NO: 181996 - DNA, 25 bp, Mus musculus
actagaaaagcacagacgagctaaa

SEQ ID NO: 181997 - DNA, 25 bp, Mus musculus
actagaaaagttcctgtggaagacc

SEQ ID NO: 181998 - DNA, 25 bp, Mus musculus
actagaaacagaaaattcatttgca

SEQ ID NO: 181999 - DNA, 25 bp, Mus musculus
actagaaacccacaactggagcaag

SEQ ID NO: 182000 - DNA, 25 bp, Mus musculus
actagaaacccagaactggagcaag

SEQ ID NO: 182001 - DNA, 25 bp, Mus musculus
actagaaagagaaatggattccctg

SEQ ID NO: 182002 - DNA, 25 bp, Mus musculus
actagaaatatgcggctatggatgt

SEQ ID NO: 182003 - DNA, 25 bp, Mus musculus
actagaacaaaaggaagccagatgc

SEQ ID NO: 182004 - DNA, 25 bp, Mus musculus
actagaatatgacttgggtcagcaa

SEQ ID NO: 182005 - DNA, 25 bp, Mus musculus
actagaatatggtggcccatatttg

SEQ ID NO: 182006 - DNA, 25 bp, Mus musculus
actagaatcagcaacactacagatg

SEQ ID NO: 182007 - DNA, 25 bp, Mus musculus
actagaatcagcaagactacagatg

SEQ ID NO: 182008 - DNA, 25 bp, Mus musculus
actagaattaaaggtttgggatcaa

SEQ ID NO: 182009 - DNA, 25 bp, Mus musculus
actagacaagatgtcttgggaaggc

SEQ ID NO: 182010 - DNA, 25 bp, Mus musculus
actagacatacagtatgctcctgaa

SEQ ID NO: 182011 - DNA, 25 bp, Mus musculus
actagaccctgataatgcactgctc

SEQ ID NO: 182012 - DNA, 25 bp, Mus musculus
actagacgaaggaaacagcaagaca

SEQ ID NO: 182013 - DNA, 25 bp, Mus musculus
actagactttcccaataaagactga

SEQ ID NO: 182014 - DNA, 25 bp, Mus musculus
actagagaacagcagaggttcagaa

SEQ ID NO: 182015 - DNA, 25 bp, Mus musculus
actagagaacagcagctccatttta

SEQ ID NO: 182016 - DNA, 25 bp, Mus musculus
actagagaagagttggttgatcgtg

SEQ ID NO: 182017 - DNA, 25 bp, Mus musculus
actagaggaggcctcattgcataca

SEQ ID NO: 182018 - DNA, 25 bp, Mus musculus
actagaggaggcctcctcctggact

SEQ ID NO: 182019 - DNA, 25 bp, Mus musculus
actagagggatggatgtgatttttt

SEQ ID NO: 182020 - DNA, 25 bp, Mus musculus
actagaggtaaaggtcgatcgcgat

SEQ ID NO: 182021 - DNA, 25 bp, Mus musculus
actagaggtgggccaaggattctcc

SEQ ID NO: 182022 - DNA, 25 bp, Mus musculus
actagagttagaatcccttcgccaa

SEQ ID NO: 182023 - DNA, 25 bp, Mus musculus
actagatatcaaaatcgggtcatgc

SEQ ID NO: 182024 - DNA, 25 bp, Mus musculus
actagatatcaatctgtggttctct

SEQ ID NO: 182025 - DNA, 25 bp, Mus musculus
actagatatggaacgggagcgaagg

SEQ ID NO: 182026 - DNA, 25 bp, Mus musculus
actagattttagcaggtcaatggcc

SEQ ID NO: 182027 - DNA, 25 bp, Mus musculus
actagcaaatcagaagttacgagac

SEQ ID NO: 182028 - DNA, 25 bp, Mus musculus
actagcaaatcaggaggtgcttgtc

SEQ ID NO: 182029 - DNA, 25 bp, Mus musculus
actagcaatcagaacccaagagatg

SEQ ID NO: 182030 - DNA, 25 bp, Mus musculus
actagcacaaggtgactacgagaag

SEQ ID NO: 182031 - DNA, 25 bp, Mus musculus
actagcacgaaagagaccagctatg

SEQ ID NO: 182032 - DNA, 25 bp, Mus musculus
actagccagaaaggtccacaccagt

SEQ ID NO: 182033 - DNA, 25 bp, Mus musculus
actagccagaaagtttcaggccatc

SEQ ID NO: 182034 - DNA, 25 bp, Mus musculus
actagccagtgagcgcatgagctac

SEQ ID NO: 182035 - DNA, 25 bp, Mus musculus
actagccagtgcctaaggaagaacc

SEQ ID NO: 182036 - DNA, 25 bp, Mus musculus
actagccccagactggtgaatgaga

SEQ ID NO: 182037 - DNA, 25 bp, Mus musculus
actagcctggcatcccagcctttac

SEQ ID NO: 182038 - DNA, 25 bp, Mus musculus
actagcggtccttggacttcaggaa

SEQ ID NO: 182039 - DNA, 25 bp, Mus musculus
actagctaaggctcaaactcagaaa

SEQ ID NO: 182040 - DNA, 25 bp, Mus musculus
actagctagaggcaactcgccatga

SEQ ID NO: 182041 - DNA, 25 bp, Mus musculus
actagctagagggtacaaaggattt

SEQ ID NO: 182042 - DNA, 25 bp, Mus musculus
actagctagtccgtgtactttgtgg

SEQ ID NO: 182043 - DNA, 25 bp, Mus musculus
actagctcttcagctctggggacac

SEQ ID NO: 182044 - DNA, 25 bp, Mus musculus
actagctcttcaggactgggcagct

SEQ ID NO: 182045 - DNA, 25 bp, Mus musculus
actagctgggatactaacaaaacca

SEQ ID NO: 182046 - DNA, 25 bp, Mus musculus
actagctgggtacctcttgtgtcca

SEQ ID NO: 182047 - DNA, 25 bp, Mus musculus
actagcttcctagagaccaagatca

SEQ ID NO: 182048 - DNA, 25 bp, Mus musculus
actaggaaaaaaagtggtcatgctg

SEQ ID NO: 182049 - DNA, 25 bp, Mus musculus
actaggaacatgatgaactttcaac

SEQ ID NO: 182050 - DNA, 25 bp, Mus musculus
actaggaacatggtgtccatcctgt

SEQ ID NO: 182051 - DNA, 25 bp, Mus musculus
actaggaagaagagaatggaccggg

SEQ ID NO: 182052 - DNA, 25 bp, Mus musculus
actaggaagaggaacacgcagcact

SEQ ID NO: 182053 - DNA, 25 bp, Mus musculus
actaggaagtatattacaggattca

SEQ ID NO: 182054 - DNA, 25 bp, Mus musculus
actaggataacaggtccagttgtcc

SEQ ID NO: 182055 - DNA, 25 bp, Mus musculus
actaggattgcgattttctaccttg

SEQ ID NO: 182056 - DNA, 25 bp, Mus musculus
actaggccagatttaccttatgagc

SEQ ID NO: 182057 - DNA, 25 bp, Mus musculus
actaggccagctgctcagccatctc

SEQ ID NO: 182058 - DNA, 25 bp, Mus musculus
actaggcctcgtctaggtgccgccc

SEQ ID NO: 182059 - DNA, 25 bp, Mus musculus
actagggaaggtcccggatgttgcg

SEQ ID NO: 182060 - DNA, 25 bp, Mus musculus
actaggttgcagacagtaaccagtt

SEQ ID NO: 182061 - DNA, 25 bp, Mus musculus
actagtagagaaccccaggcacggc

SEQ ID NO: 182062 - DNA, 25 bp, Mus musculus
actagtattaagtgcgtaatagctt

SEQ ID NO: 182063 - DNA, 25 bp, Mus musculus
actagtatttccaactttcactcag

SEQ ID NO: 182064 - DNA, 25 bp, Mus musculus
actagtatttccaagtttcactcag

SEQ ID NO: 182065 - DNA, 25 bp, Mus musculus
actagtccccagcaagcaagaggag

SEQ ID NO: 182066 - DNA, 25 bp, Mus musculus
actagtcgataaggttgaaagacac

SEQ ID NO: 182067 - DNA, 25 bp, Mus musculus
actagtcggaggtgtatcgttactc

SEQ ID NO: 182068 - DNA, 25 bp, Mus musculus
actagtcggagttacagccgctgtc

SEQ ID NO: 182069 - DNA, 25 bp, Mus musculus
actagtgccagcttcggtggtgtac

SEQ ID NO: 182070 - DNA, 25 bp, Mus musculus
actagtgcccctcaggcggtgctat

SEQ ID NO: 182071 - DNA, 25 bp, Mus musculus
actagtgcctgataagccaaagagc

SEQ ID NO: 182072 - DNA, 25 bp, Mus musculus
actagtggcaccggtttacatctcg

SEQ ID NO: 182073 - DNA, 25 bp, Mus musculus
actagtggcgagaatttgctgagag

SEQ ID NO: 182074 - DNA, 25 bp, Mus musculus
actagtggcgagactttatgatgca

SEQ ID NO: 182075 - DNA, 25 bp, Mus musculus
actagtggcgagcacatgccaacga

SEQ ID NO: 182076 - DNA, 25 bp, Mus musculus
actagtggctcctggcactttgaat

SEQ ID NO: 182077 - DNA, 25 bp, Mus musculus
actagttaagtgcctgaagacctgt

SEQ ID NO: 182078 - DNA, 25 bp, Mus musculus
actagttttccaggtcgtggttcaa

SEQ ID NO: 182079 - DNA, 25 bp, Mus musculus
actataaagccagagccatcgtgac

SEQ ID NO: 182080 - DNA, 25 bp, Mus musculus
actataaagggagttggaaagagag

SEQ ID NO: 182081 - DNA, 25 bp, Mus musculus
actataaaggggtgctggtgttgaa

SEQ ID NO: 182082 - DNA, 25 bp, Mus musculus
actataaagtcgtaaaatatgaaag

SEQ ID NO: 182083 - DNA, 25 bp, Mus musculus
actataacggactgctgaccttggg

SEQ ID NO: 182084 - DNA, 25 bp, Mus musculus
actatacaaggtggggatgcgtcac

SEQ ID NO: 182085 - DNA, 25 bp, Mus musculus
actatacatgtgaatgaactcattc

SEQ ID NO: 182086 - DNA, 25 bp, Mus musculus
actatacctctaggcctgctctgtt

SEQ ID NO: 182087 - DNA, 25 bp, Mus musculus
actatacctctaggccttatattgt

SEQ ID NO: 182088 - DNA, 25 bp, Mus musculus
actataccttgaactgagctggtgg

SEQ ID NO: 182089 - DNA, 25 bp, Mus musculus
actatacgaaaaggaacttacacat

SEQ ID NO: 182090 - DNA, 25 bp, Mus musculus
actatacgaaaaggctctacctctg

SEQ ID NO: 182091 - DNA, 25 bp, Mus musculus
actatagcacatgggagggactggg

SEQ ID NO: 182092 - DNA, 25 bp, Mus musculus
actatagctctccaggtcaatggcc

SEQ ID NO: 182093 - DNA, 25 bp, Mus musculus
actatagctctctgctcagtacaag

SEQ ID NO: 182094 - DNA, 25 bp, Mus musculus
actatagtgaagcccctggtcataa

SEQ ID NO: 182095 - DNA, 25 bp, Mus musculus
actatagtgaaggtgtttcctactt

SEQ ID NO: 182096 - DNA, 25 bp, Mus musculus
actatataagatatccagaaagtgg

SEQ ID NO: 182097 - DNA, 25 bp, Mus musculus
actatataaggtaaatgaattggtg

SEQ ID NO: 182098 - DNA, 25 bp, Mus musculus
actatatacacaggccatcctggac

SEQ ID NO: 182099 - DNA, 25 bp, Mus musculus
actatatacaggctacagacaagag

SEQ ID NO: 182100 - DNA, 25 bp, Mus musculus
actatatcaaccacgagacccaaac

SEQ ID NO: 182101 - DNA, 25 bp, Mus musculus
actatatcttgtaagctaaacagaa

SEQ ID NO: 182102 - DNA, 25 bp, Mus musculus
actatattcacagaattggcagagg

SEQ ID NO: 182103 - DNA, 25 bp, Mus musculus
actatattcacaggagtcgatagcg

SEQ ID NO: 182104 - DNA, 25 bp, Mus musculus
actatcaaagtattctgcagatgct

SEQ ID NO: 182105 - DNA, 25 bp, Mus musculus
actatcacagacacgtgcgaccgca

SEQ ID NO: 182106 - DNA, 25 bp, Mus musculus
actatcacagacgatctagaagcaa

SEQ ID NO: 182107 - DNA, 25 bp, Mus musculus
actatcacctccagaacaatgagct

SEQ ID NO: 182108 - DNA, 25 bp, Mus musculus
actatcacctccagctaattgcctt

SEQ ID NO: 182109 - DNA, 25 bp, Mus musculus
actatcactgttgagggatgacctg

SEQ ID NO: 182110 - DNA, 25 bp, Mus musculus
actatcagaaaggagatgaatatga

SEQ ID NO: 182111 - DNA, 25 bp, Mus musculus
actatcagaaagggatgaatatgag

SEQ ID NO: 182112 - DNA, 25 bp, Mus musculus
actatcagttggtttacctgctgcc

SEQ ID NO: 182113 - DNA, 25 bp, Mus musculus
actatcagtttaggattcagctggc

SEQ ID NO: 182114 - DNA, 25 bp, Mus musculus
actatccatggagggctgagccgga

SEQ ID NO: 182115 - DNA, 25 bp, Mus musculus
actatcccagccccccaggttcgcc

SEQ ID NO: 182116 - DNA, 25 bp, Mus musculus
actatcccagtatgcaaccgaggat

SEQ ID NO: 182117 - DNA, 25 bp, Mus musculus
actatcccagtgtttgaaagacgta

SEQ ID NO: 182118 - DNA, 25 bp, Mus musculus
actatcccgagaaagcctacatctt

SEQ ID NO: 182119 - DNA, 25 bp, Mus musculus
actatcccgaggcccgagtccggaa

SEQ ID NO: 182120 - DNA, 25 bp, Mus musculus
actatccctgctatgacactggctg

SEQ ID NO: 182121 - DNA, 25 bp, Mus musculus
actatcctaaaggggtctttgtgaa

SEQ ID NO: 182122 - DNA, 25 bp, Mus musculus
actatcctaaagggtgacaaagggg

SEQ ID NO: 182123 - DNA, 25 bp, Mus musculus
actatcctacctacggtgactctgg

SEQ ID NO: 182124 - DNA, 25 bp, Mus musculus
actatcctgacagctacgacacgtg

SEQ ID NO: 182125 - DNA, 25 bp, Mus musculus
actatcctttttcaacttggagaag

SEQ ID NO: 182126 - DNA, 25 bp, Mus musculus
actatcgaagttgagaataccactc

SEQ ID NO: 182127 - DNA, 25 bp, Mus musculus
actatcgacagagtcccagatccta

SEQ ID NO: 182128 - DNA, 25 bp, Mus musculus
actatcgacagtttttgtggttctt

SEQ ID NO: 182129 - DNA, 25 bp, Mus musculus
actatcgataattccggcgggagga

SEQ ID NO: 182130 - DNA, 25 bp, Mus musculus
actatcgcaggattgggtttccttc

SEQ ID NO: 182131 - DNA, 25 bp, Mus musculus
actatcgcagggatcccaggctggc

SEQ ID NO: 182132 - DNA, 25 bp, Mus musculus
actatctcagcatcaagatgacctg

SEQ ID NO: 182133 - DNA, 25 bp, Mus musculus
actatctccaagcatgctggactat

SEQ ID NO: 182134 - DNA, 25 bp, Mus musculus
actatctccaagtcggttgtggggt

SEQ ID NO: 182135 - DNA, 25 bp, Mus musculus
actatctgacaagcacaaacgggag

SEQ ID NO: 182136 - DNA, 25 bp, Mus musculus
actatctgacaagcacctatagtct

SEQ ID NO: 182137 - DNA, 25 bp, Mus musculus
actatctgacagaagtggtccttct

SEQ ID NO: 182138 - DNA, 25 bp, Mus musculus
actatctgacaggatggcttgcctt

SEQ ID NO: 182139 - DNA, 25 bp, Mus musculus
actatcttgcttcgaagccagacac

SEQ ID NO: 182140 - DNA, 25 bp, Mus musculus
actatcttgtaaccgtggggatgtc

SEQ ID NO: 182141 - DNA, 25 bp, Mus musculus
actatcttgtaagcgtggggatgtc

SEQ ID NO: 182142 - DNA, 25 bp, Mus musculus
actatgaaaagggatggatctttac

SEQ ID NO: 182143 - DNA, 25 bp, Mus musculus
actatgaaaaggtgacgtgcacaga

SEQ ID NO: 182144 - DNA, 25 bp, Mus musculus
actatgaaacaaagagttcaactag

SEQ ID NO: 182145 - DNA, 25 bp, Mus musculus
actatgaaacagaaaaacaccgagg

SEQ ID NO: 182146 - DNA, 25 bp, Mus musculus
actatgaaatgggtgggatgctatg

SEQ ID NO: 182147 - DNA, 25 bp, Mus musculus
actatgaaatggtccaccaggctgg

SEQ ID NO: 182148 - DNA, 25 bp, Mus musculus
actatgaaatggttttactgggcag

SEQ ID NO: 182149 - DNA, 25 bp, Mus musculus
actatgaacaaataggagacagctt

SEQ ID NO: 182150 - DNA, 25 bp, Mus musculus
actatgaacagacagctgaaattac

SEQ ID NO: 182151 - DNA, 25 bp, Mus musculus
actatgaactctggtggttcaccac

SEQ ID NO: 182152 - DNA, 25 bp, Mus musculus
actatgaagacaggagtcttttatt

SEQ ID NO: 182153 - DNA, 25 bp, Mus musculus
actatgaaggcgtgaatatgacatc

SEQ ID NO: 182154 - DNA, 25 bp, Mus musculus
actatgaaggcgtgggtatgcaata

SEQ ID NO: 182155 - DNA, 25 bp, Mus musculus
actatgactcagacaagctatttcc

SEQ ID NO: 182156 - DNA, 25 bp, Mus musculus
actatgatatcctcttgtttgccag

SEQ ID NO: 182157 - DNA, 25 bp, Mus musculus
actatgatgcctgttcctgccaaca

SEQ ID NO: 182158 - DNA, 25 bp, Mus musculus
actatgatgtacaggtcatagatga

SEQ ID NO: 182159 - DNA, 25 bp, Mus musculus
actatgcagcaaagagttccaacac

SEQ ID NO: 182160 - DNA, 25 bp, Mus musculus
actatgcagcaaaggaaggacagac

SEQ ID NO: 182161 - DNA, 25 bp, Mus musculus
actatgcagtaaagacgctccttgg

SEQ ID NO: 182162 - DNA, 25 bp, Mus musculus
actatgctgactcgagcattgcaga

SEQ ID NO: 182163 - DNA, 25 bp, Mus musculus
actatgctgagcagattaagaaaca

SEQ ID NO: 182164 - DNA, 25 bp, Mus musculus
actatgctgagctggtgaagcacaa

SEQ ID NO: 182165 - DNA, 25 bp, Mus musculus
actatgctgagggccaaggatgtct

SEQ ID NO: 182166 - DNA, 25 bp, Mus musculus
actatgctgctgtgtgctgctctgg

SEQ ID NO: 182167 - DNA, 25 bp, Mus musculus
actatggaggaggaaattatggaag

SEQ ID NO: 182168 - DNA, 25 bp, Mus musculus
actatggattcagtggggtgatgct

SEQ ID NO: 182169 - DNA, 25 bp, Mus musculus
actatggcagcagttttttatggtg

SEQ ID NO: 182170 - DNA, 25 bp, Mus musculus
actatggcatggttacagtaccttt

SEQ ID NO: 182171 - DNA, 25 bp, Mus musculus
actatggcggagtgacaaagaatta

SEQ ID NO: 182172 - DNA, 25 bp, Mus musculus
actatggcggagtttcaacaccgtg

SEQ ID NO: 182173 - DNA, 25 bp, Mus musculus
actatggctagatccagactacatt

SEQ ID NO: 182174 - DNA, 25 bp, Mus musculus
actatggctagcattcaacatcctg

SEQ ID NO: 182175 - DNA, 25 bp, Mus musculus
actatggctgacaagcctatcctct

SEQ ID NO: 182176 - DNA, 25 bp, Mus musculus
actatggcttctttctccttgtgga

SEQ ID NO: 182177 - DNA, 25 bp, Mus musculus
actatgggaaagagattctgaaaag

SEQ ID NO: 182178 - DNA, 25 bp, Mus musculus
actatgggagaaataccgacagtat

SEQ ID NO: 182179 - DNA, 25 bp, Mus musculus
actatgggcaggtattcacctacaa

SEQ ID NO: 182180 - DNA, 25 bp, Mus musculus
actatgggcaggtgttcacctacaa

SEQ ID NO: 182181 - DNA, 25 bp, Mus musculus
actatggtaaagatccctcaagaac

SEQ ID NO: 182182 - DNA, 25 bp, Mus musculus
actatggtgaaccgtgtgtgtctgc

SEQ ID NO: 182183 - DNA, 25 bp, Mus musculus
actatggtgaactctgtctgcaatc

SEQ ID NO: 182184 - DNA, 25 bp, Mus musculus
actatggtgaactggctgacagttg

SEQ ID NO: 182185 - DNA, 25 bp, Mus musculus
actatggtgaactggctgagacttg

SEQ ID NO: 182186 - DNA, 25 bp, Mus musculus
actatggtgaaggctcttgctgagc

SEQ ID NO: 182187 - DNA, 25 bp, Mus musculus
actatggtgtcagaaaaaatgtggg

SEQ ID NO: 182188 - DNA, 25 bp, Mus musculus
actatgtgcaagacggcccccttga

SEQ ID NO: 182189 - DNA, 25 bp, Mus musculus
actattaaaagagggtgcctcagaa

SEQ ID NO: 182190 - DNA, 25 bp, Mus musculus
actattacgacaagaacatcatcaa

SEQ ID NO: 182191 - DNA, 25 bp, Mus musculus
actattacgacaagacaccaagtgg

SEQ ID NO: 182192 - DNA, 25 bp, Mus musculus
actattacggcatcctgagtgatgt

SEQ ID NO: 182193 - DNA, 25 bp, Mus musculus
actattacggcatggaccttgactt

SEQ ID NO: 182194 - DNA, 25 bp, Mus musculus
actattattcccggtgtggaatatt

SEQ ID NO: 182195 - DNA, 25 bp, Mus musculus
actattcaagagcccccaattttat

SEQ ID NO: 182196 - DNA, 25 bp, Mus musculus
actattcacacctcctggaggacca

SEQ ID NO: 182197 - DNA, 25 bp, Mus musculus
actattcacaggctcagcagcagct

SEQ ID NO: 182198 - DNA, 25 bp, Mus musculus
actattcagtacaggaaggctgtga

SEQ ID NO: 182199 - DNA, 25 bp, Mus musculus
actattcagtacagggcttcttcgt

SEQ ID NO: 182200 - DNA, 25 bp, Mus musculus
actattcgagcaggtggggcgagct

SEQ ID NO: 182201 - DNA, 25 bp, Mus musculus
actattctgaggttggtgtcattgg

SEQ ID NO: 182202 - DNA, 25 bp, Mus musculus
actattgagacccgatcctggcagg

SEQ ID NO: 182203 - DNA, 25 bp, Mus musculus
actattgagaggccctggcccagct

SEQ ID NO: 182204 - DNA, 25 bp, Mus musculus
actattgagagtgtatgggcaaggt

SEQ ID NO: 182205 - DNA, 25 bp, Mus musculus
actattgagcctcgaagtctttacc

SEQ ID NO: 182206 - DNA, 25 bp, Mus musculus
actattggctgggcaatgaatgcag

SEQ ID NO: 182207 - DNA, 25 bp, Mus musculus
actattggggagagagaaaaaacca

SEQ ID NO: 182208 - DNA, 25 bp, Mus musculus
actattgtggaaggatacgccaatg

SEQ ID NO: 182209 - DNA, 25 bp, Mus musculus
actatttatgaattcacagacacag

SEQ ID NO: 182210 - DNA, 25 bp, Mus musculus
actatttatgatactgcatttttca

SEQ ID NO: 182211 - DNA, 25 bp, Mus musculus
actatttattccagctacctggaga

SEQ ID NO: 182212 - DNA, 25 bp, Mus musculus
actatttccagcactggccagtgtt

SEQ ID NO: 182213 - DNA, 25 bp, Mus musculus
actatttgacatggcctctgaagaa

SEQ ID NO: 182214 - DNA, 25 bp, Mus musculus
actcaaaaaggtctatcctaaagta

SEQ ID NO: 182215 - DNA, 25 bp, Mus musculus
actcaaacagaaatggtgaggacac

SEQ ID NO: 182216 - DNA, 25 bp, Mus musculus
actcaaacccgcaacttgaattggt

SEQ ID NO: 182217 - DNA, 25 bp, Mus musculus
actcaaagagcaacttgatttctta

SEQ ID NO: 182218 - DNA, 25 bp, Mus musculus
actcaaagatgcagtgccagttttg

SEQ ID NO: 182219 - DNA, 25 bp, Mus musculus
actcaaagatttctgttttggtcgt

SEQ ID NO: 182220 - DNA, 25 bp, Mus musculus
actcaaagtgctgaggctgcctgct

SEQ ID NO: 182221 - DNA, 25 bp, Mus musculus
actcaaatctgatagggaaaacatc

SEQ ID NO: 182222 - DNA, 25 bp, Mus musculus
actcaaatgtcaaagctggcaagat

SEQ ID NO: 182223 - DNA, 25 bp, Mus musculus
actcaaatgtcaaaggatgaccttg

SEQ ID NO: 182224 - DNA, 25 bp, Mus musculus
actcaaatgtgatgcatgtggcatg

SEQ ID NO: 182225 - DNA, 25 bp, Mus musculus
actcaacaaggagatggcttcagag

SEQ ID NO: 182226 - DNA, 25 bp, Mus musculus
actcaacagaagcgagacggtgttc

SEQ ID NO: 182227 - DNA, 25 bp, Mus musculus
actcaacatcgacagcatcaatagg

SEQ ID NO: 182228 - DNA, 25 bp, Mus musculus
actcaacatgtatggttttcggaag

SEQ ID NO: 182229 - DNA, 25 bp, Mus musculus
actcaacgggggggcagtgcccaaa

SEQ ID NO: 182230 - DNA, 25 bp, Mus musculus
actcaacgtgctccccttctgctgc

SEQ ID NO: 182231 - DNA, 25 bp, Mus musculus
actcaactcaaatattatgagaaga

SEQ ID NO: 182232 - DNA, 25 bp, Mus musculus
actcaactcaaatattttgaaaaac

SEQ ID NO: 182233 - DNA, 25 bp, Mus musculus
actcaactcaactctctgaaaactg

SEQ ID NO: 182234 - DNA, 25 bp, Mus musculus
actcaactggctcgggagccttttt

SEQ ID NO: 182235 - DNA, 25 bp, Mus musculus
actcaacttcagccactggaactct

SEQ ID NO: 182236 - DNA, 25 bp, Mus musculus
actcaacttcaggagggcctggggg

SEQ ID NO: 182237 - DNA, 25 bp, Mus musculus
actcaagacagcagcaaaggccgtt

SEQ ID NO: 182238 - DNA, 25 bp, Mus musculus
actcaagaggcagggtgctgagggg

SEQ ID NO: 182239 - DNA, 25 bp, Mus musculus
actcaagatatgtggtgacatccac

SEQ ID NO: 182240 - DNA, 25 bp, Mus musculus
actcaagatgctgatcatatgatgt

SEQ ID NO: 182241 - DNA, 25 bp, Mus musculus
actcaagcaacagcaaatgaagctg

SEQ ID NO: 182242 - DNA, 25 bp, Mus musculus
actcaagcagctggtggcccggcct

SEQ ID NO: 182243 - DNA, 25 bp, Mus musculus
actcaagcagctgttctttggcttt

SEQ ID NO: 182244 - DNA, 25 bp, Mus musculus
actcaagcaggcaaggagacggaag

SEQ ID NO: 182245 - DNA, 25 bp, Mus musculus
actcaagcaggcaaggtgaccacat

SEQ ID NO: 182246 - DNA, 25 bp, Mus musculus
actcaagcaggtgttctttggcttt

SEQ ID NO: 182247 - DNA, 25 bp, Mus musculus
actcaagctccgccctcagtcatct

SEQ ID NO: 182248 - DNA, 25 bp, Mus musculus
actcaagctcctgtcttctaattgt

SEQ ID NO: 182249 - DNA, 25 bp, Mus musculus
actcaaggaggcagagacccgtgct

SEQ ID NO: 182250 - DNA, 25 bp, Mus musculus
actcaaggcagcccctgttacagtg

SEQ ID NO: 182251 - DNA, 25 bp, Mus musculus
actcaagtcttcacagagctgtgaa

SEQ ID NO: 182252 - DNA, 25 bp, Mus musculus
actcaataagctgagagtgctagct

SEQ ID NO: 182253 - DNA, 25 bp, Mus musculus
actcaataaggtcactcttcagcca

SEQ ID NO: 182254 - DNA, 25 bp, Mus musculus
actcaatacaattgctgatactttg

SEQ ID NO: 182255 - DNA, 25 bp, Mus musculus
actcaatagcagaaagttccctggc

SEQ ID NO: 182256 - DNA, 25 bp, Mus musculus
actcaatagcatagacatggactag

SEQ ID NO: 182257 - DNA, 25 bp, Mus musculus
actcaatagcatagacatggacttt

SEQ ID NO: 182258 - DNA, 25 bp, Mus musculus
actcaatcagaggtgcttcttaaaa

SEQ ID NO: 182259 - DNA, 25 bp, Mus musculus
actcaatgaaaatgtcatggttttt

SEQ ID NO: 182260 - DNA, 25 bp, Mus musculus
actcaatgaggccctgctggaggcc

SEQ ID NO: 182261 - DNA, 25 bp, Mus musculus
actcaatgatgttgatgccctgctg

SEQ ID NO: 182262 - DNA, 25 bp, Mus musculus
actcaatgcgatctggttctacacc

SEQ ID NO: 182263 - DNA, 25 bp, Mus musculus
actcaatttagacaagtatgatgat

SEQ ID NO: 182264 - DNA, 25 bp, Mus musculus
actcaatttagacaattggtggcca

SEQ ID NO: 182265 - DNA, 25 bp, Mus musculus
actcaatttagtgagccacagtaca

SEQ ID NO: 182266 - DNA, 25 bp, Mus musculus
actcacaaagaagcacagaccctgg

SEQ ID NO: 182267 - DNA, 25 bp, Mus musculus
actcacaaagaaggatggaaggttt

SEQ ID NO: 182268 - DNA, 25 bp, Mus musculus
actcacaacggacgcctccttggca

SEQ ID NO: 182269 - DNA, 25 bp, Mus musculus
actcacaacgggattgtcttgggga

SEQ ID NO: 182270 - DNA, 25 bp, Mus musculus
actcacaactcacatccttgtctgt

SEQ ID NO: 182271 - DNA, 25 bp, Mus musculus
actcacaactttgctcggaaaacgt

SEQ ID NO: 182272 - DNA, 25 bp, Mus musculus
actcacaagaagaaacatgtcattc

SEQ ID NO: 182273 - DNA, 25 bp, Mus musculus
actcacaagaagacttccaactgaa

SEQ ID NO: 182274 - DNA, 25 bp, Mus musculus
actcacaagaagtcgcaatgtgtct

SEQ ID NO: 182275 - DNA, 25 bp, Mus musculus
actcacaaggaagtaatgtgattta

SEQ ID NO: 182276 - DNA, 25 bp, Mus musculus
actcacaaggaagtggatgatcttt

SEQ ID NO: 182277 - DNA, 25 bp, Mus musculus
actcacacaaagtttgctaggtatt

SEQ ID NO: 182278 - DNA, 25 bp, Mus musculus
actcacacagagcactggcctgagg

SEQ ID NO: 182279 - DNA, 25 bp, Mus musculus
actcacaccaaaggagcagttcagg

SEQ ID NO: 182280 - DNA, 25 bp, Mus musculus
actcacaccaaaggagtgccaggag

SEQ ID NO: 182281 - DNA, 25 bp, Mus musculus
actcacacctgcagcccggacaagt

SEQ ID NO: 182282 - DNA, 25 bp, Mus musculus
actcacactcaagaataaatttgtg

SEQ ID NO: 182283 - DNA, 25 bp, Mus musculus
actcacactcaaggataagtttgtt

SEQ ID NO: 182284 - DNA, 25 bp, Mus musculus
actcacagaaaagcctcatatagat

SEQ ID NO: 182285 - DNA, 25 bp, Mus musculus
actcacagaaagcctcatatagatc

SEQ ID NO: 182286 - DNA, 25 bp, Mus musculus
actcacagaaaggtgtccacccagc

SEQ ID NO: 182287 - DNA, 25 bp, Mus musculus
actcacagaaggtggcttaaaaacc

SEQ ID NO: 182288 - DNA, 25 bp, Mus musculus
actcacagaaggtgtaacacggcta

SEQ ID NO: 182289 - DNA, 25 bp, Mus musculus
actcacagttgtagaggatctgaga

SEQ ID NO: 182290 - DNA, 25 bp, Mus musculus
actcacatctgtgtctgataacaag

SEQ ID NO: 182291 - DNA, 25 bp, Mus musculus
actcacatcttcttccctttcaagc

SEQ ID NO: 182292 - DNA, 25 bp, Mus musculus
actcaccactttgccctgttcttca

SEQ ID NO: 182293 - DNA, 25 bp, Mus musculus
actcacccaagattgatgaccagcg

SEQ ID NO: 182294 - DNA, 25 bp, Mus musculus
actcacccaagctatgagcttggat

SEQ ID NO: 182295 - DNA, 25 bp, Mus musculus
actcacccaaggagctgctagcact

SEQ ID NO: 182296 - DNA, 25 bp, Mus musculus
actcacccaagtgcaaaacatgtct

SEQ ID NO: 182297 - DNA, 25 bp, Mus musculus
actcacccaagtgttgcccaccaac

SEQ ID NO: 182298 - DNA, 25 bp, Mus musculus
actcaccctcaggctctgagtcaga

SEQ ID NO: 182299 - DNA, 25 bp, Mus musculus
actcaccgaaaagaggactaggaaa

SEQ ID NO: 182300 - DNA, 25 bp, Mus musculus
actcaccgccataaaaagatgcagg

SEQ ID NO: 182301 - DNA, 25 bp, Mus musculus
actcacctagagtggaccagattgt

SEQ ID NO: 182302 - DNA, 25 bp, Mus musculus
actcacctcgccaggtggaggtggg

SEQ ID NO: 182303 - DNA, 25 bp, Mus musculus
actcacgacggctccagggaactgt

SEQ ID NO: 182304 - DNA, 25 bp, Mus musculus
actcacgactagggaatgtgtgacc

SEQ ID NO: 182305 - DNA, 25 bp, Mus musculus
actcacgactagggagaaagagaga

SEQ ID NO: 182306 - DNA, 25 bp, Mus musculus
actcacggcacaggtcagacgggaa

SEQ ID NO: 182307 - DNA, 25 bp, Mus musculus
actcacgggcacagaaatggaagcc

SEQ ID NO: 182308 - DNA, 25 bp, Mus musculus
actcactaacagcatcaaggtgtaa

SEQ ID NO: 182309 - DNA, 25 bp, Mus musculus
actcactatcgacagagtcccagat

SEQ ID NO: 182310 - DNA, 25 bp, Mus musculus
actcactatcgacagtttttgtggt

SEQ ID NO: 182311 - DNA, 25 bp, Mus musculus
actcactcagaagagaagagcagcg

SEQ ID NO: 182312 - DNA, 25 bp, Mus musculus
actcactcagggatgactatgaggt

SEQ ID NO: 182313 - DNA, 25 bp, Mus musculus
actcactcagtgtcaacagggaggc

SEQ ID NO: 182314 - DNA, 25 bp, Mus musculus
actcactccactggttcgtcgcctg

SEQ ID NO: 182315 - DNA, 25 bp, Mus musculus
actcactcttctaaaacgttaccac

SEQ ID NO: 182316 - DNA, 25 bp, Mus musculus
actcactcttctaaagatccactat

SEQ ID NO: 182317 - DNA, 25 bp, Mus musculus
actcactgaacccaaccagaatcga

SEQ ID NO: 182318 - DNA, 25 bp, Mus musculus
actcactgcccaggtggaagaacta

SEQ ID NO: 182319 - DNA, 25 bp, Mus musculus
actcactgcccaggtggagcaacta

SEQ ID NO: 182320 - DNA, 25 bp, Mus musculus
actcactgcctgataaatacaacac

SEQ ID NO: 182321 - DNA, 25 bp, Mus musculus
actcactgcctgatgttgtccagga

SEQ ID NO: 182322 - DNA, 25 bp, Mus musculus
actcactgcttaagagggttcagta

SEQ ID NO: 182323 - DNA, 25 bp, Mus musculus
actcactggagggaggttgtgtagc

SEQ ID NO: 182324 - DNA, 25 bp, Mus musculus
actcactgtccagtgcttctacttc

SEQ ID NO: 182325 - DNA, 25 bp, Mus musculus
actcactgtccagttaatgtgttaa

SEQ ID NO: 182326 - DNA, 25 bp, Mus musculus
actcactgtcctgagagggttgtag

SEQ ID NO: 182327 - DNA, 25 bp, Mus musculus
actcactgtgaatgggaacacagct

SEQ ID NO: 182328 - DNA, 25 bp, Mus musculus
actcactgtgacgagggtggctcac

SEQ ID NO: 182329 - DNA, 25 bp, Mus musculus
actcactgtgagcacagcggctaca

SEQ ID NO: 182330 - DNA, 25 bp, Mus musculus
actcacttccccaaattcctgtcca

SEQ ID NO: 182331 - DNA, 25 bp, Mus musculus
actcacttgaagcccatctctgagc

SEQ ID NO: 182332 - DNA, 25 bp, Mus musculus
actcactttcagacatccggctccg

SEQ ID NO: 182333 - DNA, 25 bp, Mus musculus
actcagaaaacattccgtgcagtaa

SEQ ID NO: 182334 - DNA, 25 bp, Mus musculus
actcagaaagaagctagacgaaagg

SEQ ID NO: 182335 - DNA, 25 bp, Mus musculus
actcagaaagagatcccattcctgg

SEQ ID NO: 182336 - DNA, 25 bp, Mus musculus
actcagaaatgattcccgttgcgca

SEQ ID NO: 182337 - DNA, 25 bp, Mus musculus
actcagaacagaagcccacaaggag

SEQ ID NO: 182338 - DNA, 25 bp, Mus musculus
actcagaacagaaggagtgtgtaag

SEQ ID NO: 182339 - DNA, 25 bp, Mus musculus
actcagaacttgggagacgactgca

SEQ ID NO: 182340 - DNA, 25 bp, Mus musculus
actcagaagatctagatcccgctca

SEQ ID NO: 182341 - DNA, 25 bp, Mus musculus
actcagaattccccctcctcaggta

SEQ ID NO: 182342 - DNA, 25 bp, Mus musculus
actcagaattccgggagtgatcgag

SEQ ID NO: 182343 - DNA, 25 bp, Mus musculus
actcagacaaagctaaaaatatctt

SEQ ID NO: 182344 - DNA, 25 bp, Mus musculus
actcagacacctgctcaacatggcg

SEQ ID NO: 182345 - DNA, 25 bp, Mus musculus
actcagacacctggcagtgcttaat

SEQ ID NO: 182346 - DNA, 25 bp, Mus musculus
actcagacagatggtgcagaggagg

SEQ ID NO: 182347 - DNA, 25 bp, Mus musculus
actcagacaggagcagagcccgggt

SEQ ID NO: 182348 - DNA, 25 bp, Mus musculus
actcagactggagaggctcccccac

SEQ ID NO: 182349 - DNA, 25 bp, Mus musculus
actcagactgggcccagtcttctgg

SEQ ID NO: 182350 - DNA, 25 bp, Mus musculus
actcagactggttgatccccaaaga

SEQ ID NO: 182351 - DNA, 25 bp, Mus musculus
actcagagacaggcctcaggatatc

SEQ ID NO: 182352 - DNA, 25 bp, Mus musculus
actcagagacatggagttcttttca

SEQ ID NO: 182353 - DNA, 25 bp, Mus musculus
actcagagacatgtatgcactgaag

SEQ ID NO: 182354 - DNA, 25 bp, Mus musculus
actcagagagctgcatgcctcatgg

SEQ ID NO: 182355 - DNA, 25 bp, Mus musculus
actcagatcagaagagcagcagaag

SEQ ID NO: 182356 - DNA, 25 bp, Mus musculus
actcagatcagccttgcagcagaat

SEQ ID NO: 182357 - DNA, 25 bp, Mus musculus
actcagatcagctgggaagggctac

SEQ ID NO: 182358 - DNA, 25 bp, Mus musculus
actcagattaagggtttcaaaaaca

SEQ ID NO: 182359 - DNA, 25 bp, Mus musculus
actcagatttggggccaggaccctg

SEQ ID NO: 182360 - DNA, 25 bp, Mus musculus
actcagcacacatggaaccatgaat

SEQ ID NO: 182361 - DNA, 25 bp, Mus musculus
actcagcagcgaatgagcatgctgg

SEQ ID NO: 182362 - DNA, 25 bp, Mus musculus
actcagcagggcatctgaagttgag

SEQ ID NO: 182363 - DNA, 25 bp, Mus musculus
actcagcaggtgatgaggaatttaa

SEQ ID NO: 182364 - DNA, 25 bp, Mus musculus
actcagcccacagaaaccactcact

SEQ ID NO: 182365 - DNA, 25 bp, Mus musculus
actcagcccacagctccccataggt

SEQ ID NO: 182366 - DNA, 25 bp, Mus musculus
actcagcccactggatcaaacaaca

SEQ ID NO: 182367 - DNA, 25 bp, Mus musculus
actcagccccagagcagctcttatg

SEQ ID NO: 182368 - DNA, 25 bp, Mus musculus
actcagcctggaggacacagagctg

SEQ ID NO: 182369 - DNA, 25 bp, Mus musculus
actcagccttatgccctggttccac

SEQ ID NO: 182370 - DNA, 25 bp, Mus musculus
actcagcgtcagggccgcgttggcc

SEQ ID NO: 182371 - DNA, 25 bp, Mus musculus
actcagcgtgatcgcaatgagaggt

SEQ ID NO: 182372 - DNA, 25 bp, Mus musculus
actcagctaacagtggtaccagtgg

SEQ ID NO: 182373 - DNA, 25 bp, Mus musculus
actcagctacccaggttgaggctga

SEQ ID NO: 182374 - DNA, 25 bp, Mus musculus
actcagctgctgcgcagaagaagag

SEQ ID NO: 182375 - DNA, 25 bp, Mus musculus
actcaggaaacaacagatcccccac

SEQ ID NO: 182376 - DNA, 25 bp, Mus musculus
actcaggaccccagctctgtcagca

SEQ ID NO: 182377 - DNA, 25 bp, Mus musculus
actcaggaccccaggaccttgccac

SEQ ID NO: 182378 - DNA, 25 bp, Mus musculus
actcaggaccctggaaccctcacaa

SEQ ID NO: 182379 - DNA, 25 bp, Mus musculus
actcaggagacagggaagaagccag

SEQ ID NO: 182380 - DNA, 25 bp, Mus musculus
actcaggagaggagccatttattga

SEQ ID NO: 182381 - DNA, 25 bp, Mus musculus
actcaggagaggctgctcccaggta

SEQ ID NO: 182382 - DNA, 25 bp, Mus musculus
actcaggagaggtacttggaaggct

SEQ ID NO: 182383 - DNA, 25 bp, Mus musculus
actcaggagcagagagtgacaacag

SEQ ID NO: 182384 - DNA, 25 bp, Mus musculus
actcaggagcagagatcatagcagt

SEQ ID NO: 182385 - DNA, 25 bp, Mus musculus
actcaggagccgttgcccacggacc

SEQ ID NO: 182386 - DNA, 25 bp, Mus musculus
actcaggcagcttgatcagtggacc

SEQ ID NO: 182387 - DNA, 25 bp, Mus musculus
actcaggcagcttggaggaagagtc

SEQ ID NO: 182388 - DNA, 25 bp, Mus musculus
actcaggccagatattcagaaaccc

SEQ ID NO: 182389 - DNA, 25 bp, Mus musculus
actcaggccagatcaaaaaagggaa

SEQ ID NO: 182390 - DNA, 25 bp, Mus musculus
actcaggccgggaaccgatgatgtg

SEQ ID NO: 182391 - DNA, 25 bp, Mus musculus
actcaggctaagaatggttttagct

SEQ ID NO: 182392 - DNA, 25 bp, Mus musculus
actcagggaacaagcccaggactgt

SEQ ID NO: 182393 - DNA, 25 bp, Mus musculus
actcagggagaaagagcctggccca

SEQ ID NO: 182394 - DNA, 25 bp, Mus musculus
actcagggatggaggcaaattccac

SEQ ID NO: 182395 - DNA, 25 bp, Mus musculus
actcaggttcatgatggatgacatt

SEQ ID NO: 182396 - DNA, 25 bp, Mus musculus
actcagtaagcggtgggtacagtcc

SEQ ID NO: 182397 - DNA, 25 bp, Mus musculus
actcagtcacgctcaatgagaagcc

SEQ ID NO: 182398 - DNA, 25 bp, Mus musculus
actcagtccattgtaatctcagatg

SEQ ID NO: 182399 - DNA, 25 bp, Mus musculus
actcagtctcacctggcaagatgaa

SEQ ID NO: 182400 - DNA, 25 bp, Mus musculus
actcagtgactgcagaaccaagggc

SEQ ID NO: 182401 - DNA, 25 bp, Mus musculus
actcagtgactgcaggctcatgagc

SEQ ID NO: 182402 - DNA, 25 bp, Mus musculus
actcagtgagagttgtagtgcaagt

SEQ ID NO: 182403 - DNA, 25 bp, Mus musculus
actcagtgatggctgtcacgaccgg

SEQ ID NO: 182404 - DNA, 25 bp, Mus musculus
actcagtgcaagtacagagactcag

SEQ ID NO: 182405 - DNA, 25 bp, Mus musculus
actcagtggaagttctggatgattt

SEQ ID NO: 182406 - DNA, 25 bp, Mus musculus
actcagtggagagatgaataagttg

SEQ ID NO: 182407 - DNA, 25 bp, Mus musculus
actcagtgtctgaaaccaaggaaga

SEQ ID NO: 182408 - DNA, 25 bp, Mus musculus
actcagtgtctggacatttattcag

SEQ ID NO: 182409 - DNA, 25 bp, Mus musculus
actcagtgtctggtgcagagtggtg

SEQ ID NO: 182410 - DNA, 25 bp, Mus musculus
actcagttaggatgaccattgatgc

SEQ ID NO: 182411 - DNA, 25 bp, Mus musculus
actcagttagtttcctatgatgaca

SEQ ID NO: 182412 - DNA, 25 bp, Mus musculus
actcagttgcagcgacaagttctac

SEQ ID NO: 182413 - DNA, 25 bp, Mus musculus
actcagttttagcctgcggagccca

SEQ ID NO: 182414 - DNA, 25 bp, Mus musculus
actcagttttagtgcattgcagaag

SEQ ID NO: 182415 - DNA, 25 bp, Mus musculus
actcagttttagtggcatcccctgt

SEQ ID NO: 182416 - DNA, 25 bp, Mus musculus
actcagtttttgttggaaatacagt

SEQ ID NO: 182417 - DNA, 25 bp, Mus musculus
actcataaattatatgcaggacagg

SEQ ID NO: 182418 - DNA, 25 bp, Mus musculus
actcataaattgttggggtttcttg

SEQ ID NO: 182419 - DNA, 25 bp, Mus musculus
actcatacaccagcaactctgatga

SEQ ID NO: 182420 - DNA, 25 bp, Mus musculus
actcatatggaccacagccacctgg

SEQ ID NO: 182421 - DNA, 25 bp, Mus musculus
actcatattaaatcctgaagtccac

SEQ ID NO: 182422 - DNA, 25 bp, Mus musculus
actcatattactgaagatgagctaa

SEQ ID NO: 182423 - DNA, 25 bp, Mus musculus
actcatattactggtgatgaatctt

SEQ ID NO: 182424 - DNA, 25 bp, Mus musculus
actcatattactgtatcatccagat

SEQ ID NO: 182425 - DNA, 25 bp, Mus musculus
actcatcacactgttgaagagaagg

SEQ ID NO: 182426 - DNA, 25 bp, Mus musculus
actcatcaccaaggaggatataaat

SEQ ID NO: 182427 - DNA, 25 bp, Mus musculus
actcatcagactgtgtcagaagttt

SEQ ID NO: 182428 - DNA, 25 bp, Mus musculus
actcatcagtctgtatatctgtgac

SEQ ID NO: 182429 - DNA, 25 bp, Mus musculus
actcatcatggtggacaatgccaag

SEQ ID NO: 182430 - DNA, 25 bp, Mus musculus
actcatccagctcttcttacatctg

SEQ ID NO: 182431 - DNA, 25 bp, Mus musculus
actcatcctgactctcactcatggc

SEQ ID NO: 182432 - DNA, 25 bp, Mus musculus
actcatcctgggtcactgacaatat

SEQ ID NO: 182433 - DNA, 25 bp, Mus musculus
actcatctaaggaattagctgaaca

SEQ ID NO: 182434 - DNA, 25 bp, Mus musculus
actcatctaagggagatgaaggaga

SEQ ID NO: 182435 - DNA, 25 bp, Mus musculus
actcatctcaggacagctccctctc

SEQ ID NO: 182436 - DNA, 25 bp, Mus musculus
actcatctcagggctgtccaagaag

SEQ ID NO: 182437 - DNA, 25 bp, Mus musculus
actcatctgctagagaagggcaagt

SEQ ID NO: 182438 - DNA, 25 bp, Mus musculus
actcatctgctagagactggctctc

SEQ ID NO: 182439 - DNA, 25 bp, Mus musculus
actcatctgctagagctctggtgtt

SEQ ID NO: 182440 - DNA, 25 bp, Mus musculus
actcatctgctagaggttcacaaca

SEQ ID NO: 182441 - DNA, 25 bp, Mus musculus
actcatctgctagagtaggtgcttc

SEQ ID NO: 182442 - DNA, 25 bp, Mus musculus
actcatctttgtgggcggggcctgc

SEQ ID NO: 182443 - DNA, 25 bp, Mus musculus
actcatgaaaacttgctagaaatga

SEQ ID NO: 182444 - DNA, 25 bp, Mus musculus
actcatgaggcaagtcagaggccaa

SEQ ID NO: 182445 - DNA, 25 bp, Mus musculus
actcatgatgcaagttactgtaaca

SEQ ID NO: 182446 - DNA, 25 bp, Mus musculus
actcatgcaatagaaatgatcaaaa

SEQ ID NO: 182447 - DNA, 25 bp, Mus musculus
actcatgcaatagttccagttcaga

SEQ ID NO: 182448 - DNA, 25 bp, Mus musculus
actcatgcaggttgctgatgccccc

SEQ ID NO: 182449 - DNA, 25 bp, Mus musculus
actcatgcatgccaggttcccacta

SEQ ID NO: 182450 - DNA, 25 bp, Mus musculus
actcatgccagggttgtcgccctgg

SEQ ID NO: 182451 - DNA, 25 bp, Mus musculus
actcatggacaagattaatgccgct

SEQ ID NO: 182452 - DNA, 25 bp, Mus musculus
actcatggactagcggcctggtctc

SEQ ID NO: 182453 - DNA, 25 bp, Mus musculus
actcatggactagcgtttcaggcct

SEQ ID NO: 182454 - DNA, 25 bp, Mus musculus
actcatgggatagacaagaacggag

SEQ ID NO: 182455 - DNA, 25 bp, Mus musculus
actcatggtttaacttattagtact

SEQ ID NO: 182456 - DNA, 25 bp, Mus musculus
actcattaaagagtggccgagcgga

SEQ ID NO: 182457 - DNA, 25 bp, Mus musculus
actcattaaaggaaaaggatataac

SEQ ID NO: 182458 - DNA, 25 bp, Mus musculus
actcattacagagggagtttattca

SEQ ID NO: 182459 - DNA, 25 bp, Mus musculus
actcattcagggagtgttgtgaaga

SEQ ID NO: 182460 - DNA, 25 bp, Mus musculus
actcattcattcgatattacacaag

SEQ ID NO: 182461 - DNA, 25 bp, Mus musculus
actcattgactgcaggtccctggaa

SEQ ID NO: 182462 - DNA, 25 bp, Mus musculus
actcatttccaaggctggtcttgaa

SEQ ID NO: 182463 - DNA, 25 bp, Mus musculus
actcatttccaagtccttccaggga

SEQ ID NO: 182464 - DNA, 25 bp, Mus musculus
actccaaaaagagagggagccccgc

SEQ ID NO: 182465 - DNA, 25 bp, Mus musculus
actccaaaaccagcaccgtcttcta

SEQ ID NO: 182466 - DNA, 25 bp, Mus musculus
actccaaaaccagtgtcgtcaccag

SEQ ID NO: 182467 - DNA, 25 bp, Mus musculus
actccaaagtctttggaagcatatt

SEQ ID NO: 182468 - DNA, 25 bp, Mus musculus
actccaacatcacagatgtctccca

SEQ ID NO: 182469 - DNA, 25 bp, Mus musculus
actccaacctgaactctctctcttc

SEQ ID NO: 182470 - DNA, 25 bp, Mus musculus
actccaacctggaacgagtggagta

SEQ ID NO: 182471 - DNA, 25 bp, Mus musculus
actccaacgacccgtgcccagggat

SEQ ID NO: 182472 - DNA, 25 bp, Mus musculus
actccaagagacaggaggctgtcct

SEQ ID NO: 182473 - DNA, 25 bp, Mus musculus
actccaagaggctcgggtctttaac

SEQ ID NO: 182474 - DNA, 25 bp, Mus musculus
actccaagcacaatggcatctgtaa

SEQ ID NO: 182475 - DNA, 25 bp, Mus musculus
actccaagcccatccaaggttactt

SEQ ID NO: 182476 - DNA, 25 bp, Mus musculus
actccaaggagaggtcaatactatc

SEQ ID NO: 182477 - DNA, 25 bp, Mus musculus
actccaaggagaggttttccttact

SEQ ID NO: 182478 - DNA, 25 bp, Mus musculus
actccaaggcaaaggtgttgaacga

SEQ ID NO: 182479 - DNA, 25 bp, Mus musculus
actccaagttcggggaatgcagcaa

SEQ ID NO: 182480 - DNA, 25 bp, Mus musculus
actccaagttcggtcccctgtgtag

SEQ ID NO: 182481 - DNA, 25 bp, Mus musculus
actccaatcagcaggcccgtcaagt

SEQ ID NO: 182482 - DNA, 25 bp, Mus musculus
actccaatcagcaggggctgctggg

SEQ ID NO: 182483 - DNA, 25 bp, Mus musculus
actccaatcagcaggggtccttgga

SEQ ID NO: 182484 - DNA, 25 bp, Mus musculus
actccaattaatccccccttctaga

SEQ ID NO: 182485 - DNA, 25 bp, Mus musculus
actccaattctaggatgtggttaga

SEQ ID NO: 182486 - DNA, 25 bp, Mus musculus
actccacacgagaggctcacaatat

SEQ ID NO: 182487 - DNA, 25 bp, Mus musculus
actccacacgaggagccagatgtta

SEQ ID NO: 182488 - DNA, 25 bp, Mus musculus
actccacactctggtacatccaaac

SEQ ID NO: 182489 - DNA, 25 bp, Mus musculus
actccacagagcaggagcttgaacc

SEQ ID NO: 182490 - DNA, 25 bp, Mus musculus
actccacagtcaggtgacactgctg

SEQ ID NO: 182491 - DNA, 25 bp, Mus musculus
actccaccacagatgaagaagaaga

SEQ ID NO: 182492 - DNA, 25 bp, Mus musculus
actccaccatctggtgagtgaaccc

SEQ ID NO: 182493 - DNA, 25 bp, Mus musculus
actccaccgaacagtggccacagtt

SEQ ID NO: 182494 - DNA, 25 bp, Mus musculus
actccaccgaccagtggccacagtt

SEQ ID NO: 182495 - DNA, 25 bp, Mus musculus
actccacctctgcacagaagaatga

SEQ ID NO: 182496 - DNA, 25 bp, Mus musculus
actccacgggaggatgctccagtgc

SEQ ID NO: 182497 - DNA, 25 bp, Mus musculus
actccacggtgagagtctgggatgt

SEQ ID NO: 182498 - DNA, 25 bp, Mus musculus
actccactaaagactgacacgttta

SEQ ID NO: 182499 - DNA, 25 bp, Mus musculus
actccactccagggtctagagattg

SEQ ID NO: 182500 - DNA, 25 bp, Mus musculus
actccactcttggatatcacgtatg

SEQ ID NO: 182501 - DNA, 25 bp, Mus musculus
actccactcttggcaagtcggctcc

SEQ ID NO: 182502 - DNA, 25 bp, Mus musculus
actccactgagagcaggagatctgg

SEQ ID NO: 182503 - DNA, 25 bp, Mus musculus
actccactgagagcattccagtgtc

SEQ ID NO: 182504 - DNA, 25 bp, Mus musculus
actccactggttcgtcgcctgcagg

SEQ ID NO: 182505 - DNA, 25 bp, Mus musculus
actccagaaaacggtttcaggcacc

SEQ ID NO: 182506 - DNA, 25 bp, Mus musculus
actccagaagaccgaatttatctct

SEQ ID NO: 182507 - DNA, 25 bp, Mus musculus
actccagaataagctgaactcccac

SEQ ID NO: 182508 - DNA, 25 bp, Mus musculus
actccagagaacaaggtccttccat

SEQ ID NO: 182509 - DNA, 25 bp, Mus musculus
actccagagatctacctggcgtatc

SEQ ID NO: 182510 - DNA, 25 bp, Mus musculus
actccagaggtaaaagcgccattcc

SEQ ID NO: 182511 - DNA, 25 bp, Mus musculus
actccagcacagatggatacagtga

SEQ ID NO: 182512 - DNA, 25 bp, Mus musculus
actccagcagcatccacaggattta

SEQ ID NO: 182513 - DNA, 25 bp, Mus musculus
actccagcaggtctcggacaaaatg

SEQ ID NO: 182514 - DNA, 25 bp, Mus musculus
actccagccaaaggactgcaggcta

SEQ ID NO: 182515 - DNA, 25 bp, Mus musculus
actccagcccagaattaaccctgaa

SEQ ID NO: 182516 - DNA, 25 bp, Mus musculus
actccagcccagatggaggatgagg

SEQ ID NO: 182517 - DNA, 25 bp, Mus musculus
actccagcccagcagacaggaggat

SEQ ID NO: 182518 - DNA, 25 bp, Mus musculus
actccagcccagctggagatggagg

SEQ ID NO: 182519 - DNA, 25 bp, Mus musculus
actccagcccaggccctccttgtca

SEQ ID NO: 182520 - DNA, 25 bp, Mus musculus
actccagcccagtccaaggcgacct

SEQ ID NO: 182521 - DNA, 25 bp, Mus musculus
actccagcccccggcctccacctcc

SEQ ID NO: 182522 - DNA, 25 bp, Mus musculus
actccagctgcagcagttctatgct

SEQ ID NO: 182523 - DNA, 25 bp, Mus musculus
actccagctgcaggatgaagtggcc

SEQ ID NO: 182524 - DNA, 25 bp, Mus musculus
actccagctgccaaacgtcaaactc

SEQ ID NO: 182525 - DNA, 25 bp, Mus musculus
actccagctgcctttttcaacatgg

SEQ ID NO: 182526 - DNA, 25 bp, Mus musculus
actccagcttccagatacctcagtc

SEQ ID NO: 182527 - DNA, 25 bp, Mus musculus
actccagcttccagccctacgttct

SEQ ID NO: 182528 - DNA, 25 bp, Mus musculus
actccaggaacagctcaaggccgtg

SEQ ID NO: 182529 - DNA, 25 bp, Mus musculus
actccaggaagaaaggtcaggatcg

SEQ ID NO: 182530 - DNA, 25 bp, Mus musculus
actccaggaagagctgatcttttca

SEQ ID NO: 182531 - DNA, 25 bp, Mus musculus
actccaggagccggaaagaagagac

SEQ ID NO: 182532 - DNA, 25 bp, Mus musculus
actccaggagccgggcattcaactc

SEQ ID NO: 182533 - DNA, 25 bp, Mus musculus
actccaggaggagcgacagttttga

SEQ ID NO: 182534 - DNA, 25 bp, Mus musculus
actccaggaggcttccagcttgtct

SEQ ID NO: 182535 - DNA, 25 bp, Mus musculus
actccaggagggaagatatgaatct

SEQ ID NO: 182536 - DNA, 25 bp, Mus musculus
actccaggatccaggcgccaggcag

SEQ ID NO: 182537 - DNA, 25 bp, Mus musculus
actccaggatccaggttttatccag

SEQ ID NO: 182538 - DNA, 25 bp, Mus musculus
actccaggatgcaggagcctccaga

SEQ ID NO: 182539 - DNA, 25 bp, Mus musculus
actccaggcagcttcttcggcttcg

SEQ ID NO: 182540 - DNA, 25 bp, Mus musculus
actccagggcaagccccaggactgg

SEQ ID NO: 182541 - DNA, 25 bp, Mus musculus
actccagggtttgctgagagtggac

SEQ ID NO: 182542 - DNA, 25 bp, Mus musculus
actccaggtcaaagtgattgtgtgt

SEQ ID NO: 182543 - DNA, 25 bp, Mus musculus
actccagtaaagactccttgttgca

SEQ ID NO: 182544 - DNA, 25 bp, Mus musculus
actccagtaagtatgataggctggg

SEQ ID NO: 182545 - DNA, 25 bp, Mus musculus
actccagtccagcaatcccaggatc

SEQ ID NO: 182546 - DNA, 25 bp, Mus musculus
actccagtctgcagcaagccccgcc

SEQ ID NO: 182547 - DNA, 25 bp, Mus musculus
actccagtgagagttgctggaactg

SEQ ID NO: 182548 - DNA, 25 bp, Mus musculus
actccagttctaattgtaatcgtgt

SEQ ID NO: 182549 - DNA, 25 bp, Mus musculus
actccatcaaggagctgaatgagcg

SEQ ID NO: 182550 - DNA, 25 bp, Mus musculus
actccatcagacggctggaagaggc

SEQ ID NO: 182551 - DNA, 25 bp, Mus musculus
actccatcatgtccttcagtgctga

SEQ ID NO: 182552 - DNA, 25 bp, Mus musculus
actccatctgcagggttatcaagat

SEQ ID NO: 182553 - DNA, 25 bp, Mus musculus
actccatcttagaacatcctttact

SEQ ID NO: 182554 - DNA, 25 bp, Mus musculus
actccatctttggtctggctcccat

SEQ ID NO: 182555 - DNA, 25 bp, Mus musculus
actccatgactacctcatgagcaca

SEQ ID NO: 182556 - DNA, 25 bp, Mus musculus
actccatgcaagtgccaaatttacg

SEQ ID NO: 182557 - DNA, 25 bp, Mus musculus
actccatgcagcacatttaaaatcc

SEQ ID NO: 182558 - DNA, 25 bp, Mus musculus
actccatgcaggtattgaggctctg

SEQ ID NO: 182559 - DNA, 25 bp, Mus musculus
actccatgcaggtctatgaagggct

SEQ ID NO: 182560 - DNA, 25 bp, Mus musculus
actccatggagacgatctatgacat

SEQ ID NO: 182561 - DNA, 25 bp, Mus musculus
actcccaactacagaaaagcagtca

SEQ ID NO: 182562 - DNA, 25 bp, Mus musculus
actcccaagacaagtgtcagcggaa

SEQ ID NO: 182563 - DNA, 25 bp, Mus musculus
actcccaatgacggtcaagatgctg

SEQ ID NO: 182564 - DNA, 25 bp, Mus musculus
actcccacagaaggacccagaaatc

SEQ ID NO: 182565 - DNA, 25 bp, Mus musculus
actcccacagccagcgtttcccccg

SEQ ID NO: 182566 - DNA, 25 bp, Mus musculus
actcccaccccagggttcctgctgg

SEQ ID NO: 182567 - DNA, 25 bp, Mus musculus
actcccaccccagtacggcctctac

SEQ ID NO: 182568 - DNA, 25 bp, Mus musculus
actcccaccccgggatcgctcaatg

SEQ ID NO: 182569 - DNA, 25 bp, Mus musculus
actcccactgggtgtggagtgtgcg

SEQ ID NO: 182570 - DNA, 25 bp, Mus musculus
actcccagaagatagtcacatgctg

SEQ ID NO: 182571 - DNA, 25 bp, Mus musculus
actcccagaatactgaacttcgtgt

SEQ ID NO: 182572 - DNA, 25 bp, Mus musculus
actcccagaatactgacaaaaaaag

SEQ ID NO: 182573 - DNA, 25 bp, Mus musculus
actcccaggagaggaatgctgtggc

SEQ ID NO: 182574 - DNA, 25 bp, Mus musculus
actcccaggagagtcccggagagtg

SEQ ID NO: 182575 - DNA, 25 bp, Mus musculus
actcccaggagattaccaaggaaat

SEQ ID NO: 182576 - DNA, 25 bp, Mus musculus
actcccaggagttgaccctggaggt

SEQ ID NO: 182577 - DNA, 25 bp, Mus musculus
actcccaggtgcaaccagagctgcc

SEQ ID NO: 182578 - DNA, 25 bp, Mus musculus
actcccatcactcagggaaacctta

SEQ ID NO: 182579 - DNA, 25 bp, Mus musculus
actcccatcactcaggtcgctgtta

SEQ ID NO: 182580 - DNA, 25 bp, Mus musculus
actcccatgcccgtggctgttcgac

SEQ ID NO: 182581 - DNA, 25 bp, Mus musculus
actcccattgagtagatttgaaaga

SEQ ID NO: 182582 - DNA, 25 bp, Mus musculus
actccccagaagtctggagagctgt

SEQ ID NO: 182583 - DNA, 25 bp, Mus musculus
actccccatcagctgtttctccaaa

SEQ ID NO: 182584 - DNA, 25 bp, Mus musculus
actccccatcaggtttggacatatg

SEQ ID NO: 182585 - DNA, 25 bp, Mus musculus
actcccccaagcaggcggacgctca

SEQ ID NO: 182586 - DNA, 25 bp, Mus musculus
actcccccaaggaggcggacgctca

SEQ ID NO: 182587 - DNA, 25 bp, Mus musculus
actcccccaaggaggtctctgagtg

SEQ ID NO: 182588 - DNA, 25 bp, Mus musculus
actcccccaggaggcatcacagcag

SEQ ID NO: 182589 - DNA, 25 bp, Mus musculus
actcccccagtagaaatcgcagcct

SEQ ID NO: 182590 - DNA, 25 bp, Mus musculus
actcccccgcacttctagacagctg

SEQ ID NO: 182591 - DNA, 25 bp, Mus musculus
actcccctacagttggagtaaaaat

SEQ ID NO: 182592 - DNA, 25 bp, Mus musculus
actcccctacagttggcgtaggagt

SEQ ID NO: 182593 - DNA, 25 bp, Mus musculus
actcccctggcgacggttaccacag

SEQ ID NO: 182594 - DNA, 25 bp, Mus musculus
actcccctgtgagggctgaactgaa

SEQ ID NO: 182595 - DNA, 25 bp, Mus musculus
actccccttagcagctcaagcccac

SEQ ID NO: 182596 - DNA, 25 bp, Mus musculus
actccccttccccaggatgacagag

SEQ ID NO: 182597 - DNA, 25 bp, Mus musculus
actcccgcaaagacaggtggtgtcc

SEQ ID NO: 182598 - DNA, 25 bp, Mus musculus
actcccgcaagacgcttaaaggatg

SEQ ID NO: 182599 - DNA, 25 bp, Mus musculus
actcccggagaagcctccccagctt

SEQ ID NO: 182600 - DNA, 25 bp, Mus musculus
actcccggctagagaacatgaatgg

SEQ ID NO: 182601 - DNA, 25 bp, Mus musculus
actcccggctagagatcggaatgtg

SEQ ID NO: 182602 - DNA, 25 bp, Mus musculus
actcccgggagatgcagcttcagaa

SEQ ID NO: 182603 - DNA, 25 bp, Mus musculus
actcccgggaggctcaccatcatgg

SEQ ID NO: 182604 - DNA, 25 bp, Mus musculus
actcccgtgagcacttcattcaagg

SEQ ID NO: 182605 - DNA, 25 bp, Mus musculus
actcccgtgaggttcttgtagtgct

SEQ ID NO: 182606 - DNA, 25 bp, Mus musculus
actcccgtttggtgaactgactcta

SEQ ID NO: 182607 - DNA, 25 bp, Mus musculus
actccctacaagtccctgagttgga

SEQ ID NO: 182608 - DNA, 25 bp, Mus musculus
actccctcaagaacaaagtcacaat

SEQ ID NO: 182609 - DNA, 25 bp, Mus musculus
actccctcaagattcaaacagacaa

SEQ ID NO: 182610 - DNA, 25 bp, Mus musculus
actccctccagacatggaccctacc

SEQ ID NO: 182611 - DNA, 25 bp, Mus musculus
actccctctggctctctcaaaagaa

SEQ ID NO: 182612 - DNA, 25 bp, Mus musculus
actccctgagtggctatggagttac

SEQ ID NO: 182613 - DNA, 25 bp, Mus musculus
actccctgcagcttgacgtggccgg

SEQ ID NO: 182614 - DNA, 25 bp, Mus musculus
actccctggaccaaggtgcttcacc

SEQ ID NO: 182615 - DNA, 25 bp, Mus musculus
actccctggaggtttgcctcaaata

SEQ ID NO: 182616 - DNA, 25 bp, Mus musculus
actccctggatccaggcttacaatt

SEQ ID NO: 182617 - DNA, 25 bp, Mus musculus
actccctgttaagcatcaacatttc

SEQ ID NO: 182618 - DNA, 25 bp, Mus musculus
actcccttcagagggaggggcgaca

SEQ ID NO: 182619 - DNA, 25 bp, Mus musculus
actccgacaagatgaaagaaacaat

SEQ ID NO: 182620 - DNA, 25 bp, Mus musculus
actccgacagctttccaccaccagg

SEQ ID NO: 182621 - DNA, 25 bp, Mus musculus
actccgacatcgatcctgcagtagt

SEQ ID NO: 182622 - DNA, 25 bp, Mus musculus
actccgacatcggcagacagacaca

SEQ ID NO: 182623 - DNA, 25 bp, Mus musculus
actccgacatcgtgatccgggccaa

SEQ ID NO: 182624 - DNA, 25 bp, Mus musculus
actccgacccacagatccctctagc

SEQ ID NO: 182625 - DNA, 25 bp, Mus musculus
actccgactaaatagctggaccacg

SEQ ID NO: 182626 - DNA, 25 bp, Mus musculus
actccgagcaggacacttggcaagc

SEQ ID NO: 182627 - DNA, 25 bp, Mus musculus
actccgagcaggatgacagcaccag

SEQ ID NO: 182628 - DNA, 25 bp, Mus musculus
actccgagcagtcatcctttgcagg

SEQ ID NO: 182629 - DNA, 25 bp, Mus musculus
actccgagcctcatggttcggagcg

SEQ ID NO: 182630 - DNA, 25 bp, Mus musculus
actccgcaaccgatcacttgtggaa

SEQ ID NO: 182631 - DNA, 25 bp, Mus musculus
actccgccaagtggtttgctggtgc

SEQ ID NO: 182632 - DNA, 25 bp, Mus musculus
actccgccacctccgccttactctg

SEQ ID NO: 182633 - DNA, 25 bp, Mus musculus
actccgcgtgcggtttctagagcat

SEQ ID NO: 182634 - DNA, 25 bp, Mus musculus
actccgctctccgaatcaagctata

SEQ ID NO: 182635 - DNA, 25 bp, Mus musculus
actccggaagaacctcagctatgag

SEQ ID NO: 182636 - DNA, 25 bp, Mus musculus
actccggaagtaaggacaagaccag

SEQ ID NO: 182637 - DNA, 25 bp, Mus musculus
actccggacacagaatatccagtta

SEQ ID NO: 182638 - DNA, 25 bp, Mus musculus
actccggacttggacaaacacagcc

SEQ ID NO: 182639 - DNA, 25 bp, Mus musculus
actccggacttggactgacctgaaa

SEQ ID NO: 182640 - DNA, 25 bp, Mus musculus
actccggcatccagtcctctctctg

SEQ ID NO: 182641 - DNA, 25 bp, Mus musculus
actccggcggcagatgtgatggcac

SEQ ID NO: 182642 - DNA, 25 bp, Mus musculus
actccggcggccccgcaatctgtgt

SEQ ID NO: 182643 - DNA, 25 bp, Mus musculus
actccggtgaagaatgctatcagaa

SEQ ID NO: 182644 - DNA, 25 bp, Mus musculus
actccgtagtggtgctgacctggac

SEQ ID NO: 182645 - DNA, 25 bp, Mus musculus
actccgtagtggtggtcttatgctg

SEQ ID NO: 182646 - DNA, 25 bp, Mus musculus
actccgtcaggcccctgatttctac

SEQ ID NO: 182647 - DNA, 25 bp, Mus musculus
actccgtcagtacctcttgtgtcca

SEQ ID NO: 182648 - DNA, 25 bp, Mus musculus
actccgtctgtaagaatgacatacg

SEQ ID NO: 182649 - DNA, 25 bp, Mus musculus
actccgtgaacgctctcactcttga

SEQ ID NO: 182650 - DNA, 25 bp, Mus musculus
actccgtgtgtcacattagcttttt

SEQ ID NO: 182651 - DNA, 25 bp, Mus musculus
actccgttctctgggttaccacagt

SEQ ID NO: 182652 - DNA, 25 bp, Mus musculus
actccgttgttcaagtcagaaacca

SEQ ID NO: 182653 - DNA, 25 bp, Mus musculus
actcctaaaattatttcagctgcca

SEQ ID NO: 182654 - DNA, 25 bp, Mus musculus
actcctaagcaccaaggaacccgga

SEQ ID NO: 182655 - DNA, 25 bp, Mus musculus
actcctaagcggttaatttctaatg

SEQ ID NO: 182656 - DNA, 25 bp, Mus musculus
actcctaggagggagcctccctgtg

SEQ ID NO: 182657 - DNA, 25 bp, Mus musculus
actcctatagtggactcgggagggc

SEQ ID NO: 182658 - DNA, 25 bp, Mus musculus
actcctatataagtaactttgaaac

SEQ ID NO: 182659 - DNA, 25 bp, Mus musculus
actcctatataagtggtaagccaaa

SEQ ID NO: 182660 - DNA, 25 bp, Mus musculus
actcctattacttgaagctggctaa

SEQ ID NO: 182661 - DNA, 25 bp, Mus musculus
actcctattacttgtcccaaaggaa

SEQ ID NO: 182662 - DNA, 25 bp, Mus musculus
actcctattcagaccctcagtgctc

SEQ ID NO: 182663 - DNA, 25 bp, Mus musculus
actcctcaagatggagagacgttag

SEQ ID NO: 182664 - DNA, 25 bp, Mus musculus
actcctcaagggttggtggtcggat

SEQ ID NO: 182665 - DNA, 25 bp, Mus musculus
actcctcacctttacagattggagc

SEQ ID NO: 182666 - DNA, 25 bp, Mus musculus
actcctcagacagcactcaaagaag

SEQ ID NO: 182667 - DNA, 25 bp, Mus musculus
actcctcagcagagttacgtcaata

SEQ ID NO: 182668 - DNA, 25 bp, Mus musculus
actcctcagcaggtatttgtcaagt

SEQ ID NO: 182669 - DNA, 25 bp, Mus musculus
actcctccacccaggtgtcaacaca

SEQ ID NO: 182670 - DNA, 25 bp, Mus musculus
actcctccatgctggacagtgctac

SEQ ID NO: 182671 - DNA, 25 bp, Mus musculus
actcctcccgctttgggaaattcat

SEQ ID NO: 182672 - DNA, 25 bp, Mus musculus
actcctccgagaagccccggcagcc

SEQ ID NO: 182673 - DNA, 25 bp, Mus musculus
actcctcgaaagatgttccggcaca

SEQ ID NO: 182674 - DNA, 25 bp, Mus musculus
actcctcggagagacctccattgct

SEQ ID NO: 182675 - DNA, 25 bp, Mus musculus
actcctctaattaagctgtctccta

SEQ ID NO: 182676 - DNA, 25 bp, Mus musculus
actcctctacaatgggcacctgggt

SEQ ID NO: 182677 - DNA, 25 bp, Mus musculus
actcctctcaaagggacagccagcc

SEQ ID NO: 182678 - DNA, 25 bp, Mus musculus
actcctctcaaaggtttattttatt

SEQ ID NO: 182679 - DNA, 25 bp, Mus musculus
actcctctgacagtgaagaaaatgc

SEQ ID NO: 182680 - DNA, 25 bp, Mus musculus
actcctctgacagtggtgggtgtgt

SEQ ID NO: 182681 - DNA, 25 bp, Mus musculus
actcctctggatcaggctgctccac

SEQ ID NO: 182682 - DNA, 25 bp, Mus musculus
actcctctggatcagggtttgagga

SEQ ID NO: 182683 - DNA, 25 bp, Mus musculus
actcctcttgcagatactggagtgt

SEQ ID NO: 182684 - DNA, 25 bp, Mus musculus
actcctctttgaagacctttgcaca

SEQ ID NO: 182685 - DNA, 25 bp, Mus musculus
actcctgaagatctagtgcgccgtc

SEQ ID NO: 182686 - DNA, 25 bp, Mus musculus
actcctgacggtgaccctaaaacct

SEQ ID NO: 182687 - DNA, 25 bp, Mus musculus
actcctgactacagaggatgcgtcc

SEQ ID NO: 182688 - DNA, 25 bp, Mus musculus
actcctgactacaggtacaatagag

SEQ ID NO: 182689 - DNA, 25 bp, Mus musculus
actcctgactccgttcaacacacag

SEQ ID NO: 182690 - DNA, 25 bp, Mus musculus
actcctgagaggttgatcgtgtcct

SEQ ID NO: 182691 - DNA, 25 bp, Mus musculus
actcctgatgaacaaaacagggatt

SEQ ID NO: 182692 - DNA, 25 bp, Mus musculus
actcctgccagccattctgtattgg

SEQ ID NO: 182693 - DNA, 25 bp, Mus musculus
actcctgccagggcgattcaggggg

SEQ ID NO: 182694 - DNA, 25 bp, Mus musculus
actcctgctccaaggctacagctcc

SEQ ID NO: 182695 - DNA, 25 bp, Mus musculus
actcctgctccaaggctacagctct

SEQ ID NO: 182696 - DNA, 25 bp, Mus musculus
actcctggagcaggcagcacccgag

SEQ ID NO: 182697 - DNA, 25 bp, Mus musculus
actcctggagggcatatccttttta

SEQ ID NO: 182698 - DNA, 25 bp, Mus musculus
actcctggagtagaaaaagacattc

SEQ ID NO: 182699 - DNA, 25 bp, Mus musculus
actcctggcataaggatgctttcat

SEQ ID NO: 182700 - DNA, 25 bp, Mus musculus
actcctggcataagggagctggtaa

SEQ ID NO: 182701 - DNA, 25 bp, Mus musculus
actcctgggagtccttttgtcctct

SEQ ID NO: 182702 - DNA, 25 bp, Mus musculus
actcctggtggtgaccgcagggagg

SEQ ID NO: 182703 - DNA, 25 bp, Mus musculus
actcctggtggtgcgtcttctggga

SEQ ID NO: 182704 - DNA, 25 bp, Mus musculus
actcctgtacttgcgaaagcagttg

SEQ ID NO: 182705 - DNA, 25 bp, Mus musculus
actcctgtacttggttcgtcaatgc

SEQ ID NO: 182706 - DNA, 25 bp, Mus musculus
actcctgtccacgcggttctatggt

SEQ ID NO: 182707 - DNA, 25 bp, Mus musculus
actcctgtccacgcgtgcagtctgc

SEQ ID NO: 182708 - DNA, 25 bp, Mus musculus
actcctgtgaagacagggccagtgc

SEQ ID NO: 182709 - DNA, 25 bp, Mus musculus
actcctgttgaggatattttctttc

SEQ ID NO: 182710 - DNA, 25 bp, Mus musculus
actcctgttgaggcctggaatgtcc

SEQ ID NO: 182711 - DNA, 25 bp, Mus musculus
actccttaaattgggaagatgctgg

SEQ ID NO: 182712 - DNA, 25 bp, Mus musculus
actccttaacactgtcataggcctc

SEQ ID NO: 182713 - DNA, 25 bp, Mus musculus
actccttatgacaggttctgtccat

SEQ ID NO: 182714 - DNA, 25 bp, Mus musculus
actccttcagcgcatcatgactgat

SEQ ID NO: 182715 - DNA, 25 bp, Mus musculus
actccttcaggtccatctctgtaat

SEQ ID NO: 182716 - DNA, 25 bp, Mus musculus
actccttccaaagggtgatgtcttc

SEQ ID NO: 182717 - DNA, 25 bp, Mus musculus
actccttccaggatcccctgccgtg

SEQ ID NO: 182718 - DNA, 25 bp, Mus musculus
actccttccagtgggatgatctggc

SEQ ID NO: 182719 - DNA, 25 bp, Mus musculus
actccttccctgcacctccgcacct

SEQ ID NO: 182720 - DNA, 25 bp, Mus musculus
actccttcggaggagccagttcttg

SEQ ID NO: 182721 - DNA, 25 bp, Mus musculus
actccttctcccaggaagtgatccc

SEQ ID NO: 182722 - DNA, 25 bp, Mus musculus
actccttgcaacactctgggttatg

SEQ ID NO: 182723 - DNA, 25 bp, Mus musculus
actccttggcgcttagtgctgctct

SEQ ID NO: 182724 - DNA, 25 bp, Mus musculus
actccttgtgggaccgacgtctgct

SEQ ID NO: 182725 - DNA, 25 bp, Mus musculus
actcctttacgcagaagatgttgga

SEQ ID NO: 182726 - DNA, 25 bp, Mus musculus
actcctttacgcaggcccagatgac

SEQ ID NO: 182727 - DNA, 25 bp, Mus musculus
actcctttacgcagttcacacagaa

SEQ ID NO: 182728 - DNA, 25 bp, Mus musculus
actcctttcccaacactatgacttg

SEQ ID NO: 182729 - DNA, 25 bp, Mus musculus
actcctttggactggtgcagtcaga

SEQ ID NO: 182730 - DNA, 25 bp, Mus musculus
actcctttggttcctcaagccccgc

SEQ ID NO: 182731 - DNA, 25 bp, Mus musculus
actccttttagaagcaattctacag

SEQ ID NO: 182732 - DNA, 25 bp, Mus musculus
actcgaaacattctattcactggca

SEQ ID NO: 182733 - DNA, 25 bp, Mus musculus
actcgaaacttatagctctcatatg

SEQ ID NO: 182734 - DNA, 25 bp, Mus musculus
actcgaacagctctcgtggcgctct

SEQ ID NO: 182735 - DNA, 25 bp, Mus musculus
actcgaagtgagattgaccttgttc

SEQ ID NO: 182736 - DNA, 25 bp, Mus musculus
actcgacaagtaaagaatctgctgg

SEQ ID NO: 182737 - DNA, 25 bp, Mus musculus
actcgacagtgttagcaacaagacg

SEQ ID NO: 182738 - DNA, 25 bp, Mus musculus
actcgaccacaggaagaagagctgg

SEQ ID NO: 182739 - DNA, 25 bp, Mus musculus
actcgaccaggttctgggctgacaa

SEQ ID NO: 182740 - DNA, 25 bp, Mus musculus
actcgacgagtccagattgctgaag

SEQ ID NO: 182741 - DNA, 25 bp, Mus musculus
actcgacggcccaagcctactcgcc

SEQ ID NO: 182742 - DNA, 25 bp, Mus musculus
actcgactgaccttggcatgcttgc

SEQ ID NO: 182743 - DNA, 25 bp, Mus musculus
actcgagaagcagagattttattcc

SEQ ID NO: 182744 - DNA, 25 bp, Mus musculus
actcgagacgggccattgctcctgt

SEQ ID NO: 182745 - DNA, 25 bp, Mus musculus
actcgagccaggttctctccactat

SEQ ID NO: 182746 - DNA, 25 bp, Mus musculus
actcgatgagcctgtttgagctgag

SEQ ID NO: 182747 - DNA, 25 bp, Mus musculus
actcgatggcggagaggtgtctgtg

SEQ ID NO: 182748 - DNA, 25 bp, Mus musculus
actcgatggcggagagtgaggggtc

SEQ ID NO: 182749 - DNA, 25 bp, Mus musculus
actcgatgtgtttacagtggataat

SEQ ID NO: 182750 - DNA, 25 bp, Mus musculus
actcgcaaaccagctccttaattga

SEQ ID NO: 182751 - DNA, 25 bp, Mus musculus
actcgcaacgagtctgtagctcgtt

SEQ ID NO: 182752 - DNA, 25 bp, Mus musculus
actcgcaaggccaagagcacggacg

SEQ ID NO: 182753 - DNA, 25 bp, Mus musculus
actcgcaaggccaagctattacaag

SEQ ID NO: 182754 - DNA, 25 bp, Mus musculus
actcgcacaccgagagaacaaccag

SEQ ID NO: 182755 - DNA, 25 bp, Mus musculus
actcgcactatggtccacgcttcat

SEQ ID NO: 182756 - DNA, 25 bp, Mus musculus
actcgcagaaagaagctctacaaag

SEQ ID NO: 182757 - DNA, 25 bp, Mus musculus
actcgcagaggaccgccttcaacaa

SEQ ID NO: 182758 - DNA, 25 bp, Mus musculus
actcgcatttgctgtccgctacaga

SEQ ID NO: 182759 - DNA, 25 bp, Mus musculus
actcgccacagagctcagcagtcag

SEQ ID NO: 182760 - DNA, 25 bp, Mus musculus
actcgcccatcaagggaaaactcga

SEQ ID NO: 182761 - DNA, 25 bp, Mus musculus
actcgcccatgtcagtatttcctaa

SEQ ID NO: 182762 - DNA, 25 bp, Mus musculus
actcgcctgagactcgtcctcccac

SEQ ID NO: 182763 - DNA, 25 bp, Mus musculus
actcgcgcatccaggtcatccttcg

SEQ ID NO: 182764 - DNA, 25 bp, Mus musculus
actcgcgcctccagtgaccaaagac

SEQ ID NO: 182765 - DNA, 25 bp, Mus musculus
actcgcgcctccagtttttggcttt

SEQ ID NO: 182766 - DNA, 25 bp, Mus musculus
actcgcggagagcggtcccgtaggc

SEQ ID NO: 182767 - DNA, 25 bp, Mus musculus
actcgcggagatcgtaccgagaagc

SEQ ID NO: 182768 - DNA, 25 bp, Mus musculus
actcgcggagccgagtaaagacatt

SEQ ID NO: 182769 - DNA, 25 bp, Mus musculus
actcgcggagtcagaaggtagcagg

SEQ ID NO: 182770 - DNA, 25 bp, Mus musculus
actcgcggagtcaggctcttgtctg

SEQ ID NO: 182771 - DNA, 25 bp, Mus musculus
actcgcggcctaaactccagtcttt

SEQ ID NO: 182772 - DNA, 25 bp, Mus musculus
actcgcggcggaagactgctagcta

SEQ ID NO: 182773 - DNA, 25 bp, Mus musculus
actcgcggtgctcagggaggttaca

SEQ ID NO: 182774 - DNA, 25 bp, Mus musculus
actcgcggtgctcagtgtctggaga

SEQ ID NO: 182775 - DNA, 25 bp, Mus musculus
actcgctccaaagaacctaaggaag

SEQ ID NO: 182776 - DNA, 25 bp, Mus musculus
actcgctccaaagagaaaacggccc

SEQ ID NO: 182777 - DNA, 25 bp, Mus musculus
actcgctccaaagatcctgtctcta

SEQ ID NO: 182778 - DNA, 25 bp, Mus musculus
actcgctccaaaggctgcctgcttc

SEQ ID NO: 182779 - DNA, 25 bp, Mus musculus
actcgctgagctccagttataaacc

SEQ ID NO: 182780 - DNA, 25 bp, Mus musculus
actcgctggtgtctggtggcactga

SEQ ID NO: 182781 - DNA, 25 bp, Mus musculus
actcggacacagagaagcagggtcc

SEQ ID NO: 182782 - DNA, 25 bp, Mus musculus
actcggacacagatgcctccagctc

SEQ ID NO: 182783 - DNA, 25 bp, Mus musculus
actcggacctggagcagaagtattg

SEQ ID NO: 182784 - DNA, 25 bp, Mus musculus
actcggacctggagtgggaccctga

SEQ ID NO: 182785 - DNA, 25 bp, Mus musculus
actcggacctggatgctaaaaggat

SEQ ID NO: 182786 - DNA, 25 bp, Mus musculus
actcggacctggtcataagggctaa

SEQ ID NO: 182787 - DNA, 25 bp, Mus musculus
actcggagcagaaatgcatcgccat

SEQ ID NO: 182788 - DNA, 25 bp, Mus musculus
actcggagcagatcggtgcagcctt

SEQ ID NO: 182789 - DNA, 25 bp, Mus musculus
actcggagcaggcagctggccgtgt

SEQ ID NO: 182790 - DNA, 25 bp, Mus musculus
actcggagcagtgggaccctgaaga

SEQ ID NO: 182791 - DNA, 25 bp, Mus musculus
actcggaggacagcataagcagtac

SEQ ID NO: 182792 - DNA, 25 bp, Mus musculus
actcggaggatcagacatggtctca

SEQ ID NO: 182793 - DNA, 25 bp, Mus musculus
actcggaggcgggttcagccgactc

SEQ ID NO: 182794 - DNA, 25 bp, Mus musculus
actcggatcaaacagggttcctctg

SEQ ID NO: 182795 - DNA, 25 bp, Mus musculus
actcggatcaatgcacaaagaagac

SEQ ID NO: 182796 - DNA, 25 bp, Mus musculus
actcggcaaggggagactggccaat

SEQ ID NO: 182797 - DNA, 25 bp, Mus musculus
actcggcaggcagaatgggaaacag

SEQ ID NO: 182798 - DNA, 25 bp, Mus musculus
actcggcatcttactacctgaacca

SEQ ID NO: 182799 - DNA, 25 bp, Mus musculus
actcggccctacagtgcctgagcaa

SEQ ID NO: 182800 - DNA, 25 bp, Mus musculus
actcggctgaggaggccaccatggc

SEQ ID NO: 182801 - DNA, 25 bp, Mus musculus
actcggctgcagatcgcaacgagcg

SEQ ID NO: 182802 - DNA, 25 bp, Mus musculus
actcggctgcagttcgcaacgagcg

SEQ ID NO: 182803 - DNA, 25 bp, Mus musculus
actcggctggggtcattctcagagc

SEQ ID NO: 182804 - DNA, 25 bp, Mus musculus
actcggctttgacagctgcaggtcc

SEQ ID NO: 182805 - DNA, 25 bp, Mus musculus
actcgggaaacaggacccagccacc

SEQ ID NO: 182806 - DNA, 25 bp, Mus musculus
actcgggcagagatgggtggcctaa

SEQ ID NO: 182807 - DNA, 25 bp, Mus musculus
actcggggactggacagatggagcc

SEQ ID NO: 182808 - DNA, 25 bp, Mus musculus
actcggggtttgcctgaagagaagg

SEQ ID NO: 182809 - DNA, 25 bp, Mus musculus
actcgggtggtggaggacaaccata

SEQ ID NO: 182810 - DNA, 25 bp, Mus musculus
actcgggtggtggctctgtctctgt

SEQ ID NO: 182811 - DNA, 25 bp, Mus musculus
actcggtgaacatcgaagacgccat

SEQ ID NO: 182812 - DNA, 25 bp, Mus musculus
actcggtgaacatcggaaggaagag

SEQ ID NO: 182813 - DNA, 25 bp, Mus musculus
actcggttcccttctctgggtcctt

SEQ ID NO: 182814 - DNA, 25 bp, Mus musculus
actcgtcagctttgacgttaccacc

SEQ ID NO: 182815 - DNA, 25 bp, Mus musculus
actcgtcagctttgagtcggtctat

SEQ ID NO: 182816 - DNA, 25 bp, Mus musculus
actcgtccagctcaagtctctgcga

SEQ ID NO: 182817 - DNA, 25 bp, Mus musculus
actcgtcctgtgcctatgcttatac

SEQ ID NO: 182818 - DNA, 25 bp, Mus musculus
actcgtcggcatcagaacggccggt

SEQ ID NO: 182819 - DNA, 25 bp, Mus musculus
actcgtctggagatgaagctataaa

SEQ ID NO: 182820 - DNA, 25 bp, Mus musculus
actcgtcttttcaaggtatttcctg

SEQ ID NO: 182821 - DNA, 25 bp, Mus musculus
actcgtgcagcgactgcaggacctg

SEQ ID NO: 182822 - DNA, 25 bp, Mus musculus
actcgtgcagctcagagagccgatg

SEQ ID NO: 182823 - DNA, 25 bp, Mus musculus
actcgtgcagtgccaccgtgccacc

SEQ ID NO: 182824 - DNA, 25 bp, Mus musculus
actcgtggcaggggtactacaagaa

SEQ ID NO: 182825 - DNA, 25 bp, Mus musculus
actcgtgtattcagggggagatgac

SEQ ID NO: 182826 - DNA, 25 bp, Mus musculus
actcgtgtccctcgtttagcttttt

SEQ ID NO: 182827 - DNA, 25 bp, Mus musculus
actcgtgtccgacttcagaggatga

SEQ ID NO: 182828 - DNA, 25 bp, Mus musculus
actcgtgtccgatttattaaccttg

SEQ ID NO: 182829 - DNA, 25 bp, Mus musculus
actcgttcaaacaaagtctggtttt

SEQ ID NO: 182830 - DNA, 25 bp, Mus musculus
actcgttggatcctcctctgtagag

SEQ ID NO: 182831 - DNA, 25 bp, Mus musculus
actcgttggatcctgcgggttgagg

SEQ ID NO: 182832 - DNA, 25 bp, Mus musculus
actcgtttgtagggacagtgatgct

SEQ ID NO: 182833 - DNA, 25 bp, Mus musculus
actctaaaatagagctggagtaact

SEQ ID NO: 182834 - DNA, 25 bp, Mus musculus
actctaaattcaagtgacaatgcct

SEQ ID NO: 182835 - DNA, 25 bp, Mus musculus
actctaacaccgcaagccccgccca

SEQ ID NO: 182836 - DNA, 25 bp, Mus musculus
actctaacataagctgcttcctgct

SEQ ID NO: 182837 - DNA, 25 bp, Mus musculus
actctaacataagtcttcttttttg

SEQ ID NO: 182838 - DNA, 25 bp, Mus musculus
actctaagaaacattccctgtgtgg

SEQ ID NO: 182839 - DNA, 25 bp, Mus musculus
actctacaagcacttgcagaagcaa

SEQ ID NO: 182840 - DNA, 25 bp, Mus musculus
actctacaccctagaggagagctgg

SEQ ID NO: 182841 - DNA, 25 bp, Mus musculus
actctacaccctggtggtgtctgtg

SEQ ID NO: 182842 - DNA, 25 bp, Mus musculus
actctaccaaatactatctgaatga

SEQ ID NO: 182843 - DNA, 25 bp, Mus musculus
actctaccaaatattgcatttagcc

SEQ ID NO: 182844 - DNA, 25 bp, Mus musculus
actctaccacaagatgctggtggtt

SEQ ID NO: 182845 - DNA, 25 bp, Mus musculus
actctaccacagtgactcatgttca

SEQ ID NO: 182846 - DNA, 25 bp, Mus musculus
actctacgacacgaacctgccagat

SEQ ID NO: 182847 - DNA, 25 bp, Mus musculus
actctactaagtgccctgcattgaa

SEQ ID NO: 182848 - DNA, 25 bp, Mus musculus
actctactactgaataccccaagta

SEQ ID NO: 182849 - DNA, 25 bp, Mus musculus
actctactatggagatgtcatctgg

SEQ ID NO: 182850 - DNA, 25 bp, Mus musculus
actctactatggaggggctccacgg

SEQ ID NO: 182851 - DNA, 25 bp, Mus musculus
actctactggaatagctacctcagg

SEQ ID NO: 182852 - DNA, 25 bp, Mus musculus
actctactgtgaaggtgtggtccgg

SEQ ID NO: 182853 - DNA, 25 bp, Mus musculus
actctactgtgaggtctacatcacc

SEQ ID NO: 182854 - DNA, 25 bp, Mus musculus
actctactttcattctctttacagg

SEQ ID NO: 182855 - DNA, 25 bp, Mus musculus
actctactttcattctttagtaaca

SEQ ID NO: 182856 - DNA, 25 bp, Mus musculus
actctagaggaggcctctaggtcgc

SEQ ID NO: 182857 - DNA, 25 bp, Mus musculus
actctagcattgaggcctttgctgt

SEQ ID NO: 182858 - DNA, 25 bp, Mus musculus
actctagctcaggatgatatcctcc

SEQ ID NO: 182859 - DNA, 25 bp, Mus musculus
actctagctcaggtagcaacaattg

SEQ ID NO: 182860 - DNA, 25 bp, Mus musculus
actctagctcaggtttctgtagctg

SEQ ID NO: 182861 - DNA, 25 bp, Mus musculus
actctagctgggcgaggacccgtgg

SEQ ID NO: 182862 - DNA, 25 bp, Mus musculus
actctagtcctcagaactgtggacc

SEQ ID NO: 182863 - DNA, 25 bp, Mus musculus
actctagtgctacaggcactcttca

SEQ ID NO: 182864 - DNA, 25 bp, Mus musculus
actctagtgctacaggttctcacgc

SEQ ID NO: 182865 - DNA, 25 bp, Mus musculus
actctagtgctacaggttctgctga

SEQ ID NO: 182866 - DNA, 25 bp, Mus musculus
actctataaattggagctggcctga

SEQ ID NO: 182867 - DNA, 25 bp, Mus musculus
actctatcaagatctgggataaaag

SEQ ID NO: 182868 - DNA, 25 bp, Mus musculus
actctatcacatagatgagaattct

SEQ ID NO: 182869 - DNA, 25 bp, Mus musculus
actctattcagctcccattttcgcc

SEQ ID NO: 182870 - DNA, 25 bp, Mus musculus
actctatttcaggactcagtggctt

SEQ ID NO: 182871 - DNA, 25 bp, Mus musculus
actctcaaaccacgcggagtgtcct

SEQ ID NO: 182872 - DNA, 25 bp, Mus musculus
actctcaaaccacgtgacctcttgg

SEQ ID NO: 182873 - DNA, 25 bp, Mus musculus
actctcaaactagatttcctctgag

SEQ ID NO: 182874 - DNA, 25 bp, Mus musculus
actctcaacatggaaaagtataact

SEQ ID NO: 182875 - DNA, 25 bp, Mus musculus
actctcaattagttgacattaaaaa

SEQ ID NO: 182876 - DNA, 25 bp, Mus musculus
actctcacaatgctctgtcagaaac

SEQ ID NO: 182877 - DNA, 25 bp, Mus musculus
actctcacaatgtgtcctactgaaa

SEQ ID NO: 182878 - DNA, 25 bp, Mus musculus
actctcacacacagctttcttctgc

SEQ ID NO: 182879 - DNA, 25 bp, Mus musculus
actctcacacacaggacacagaaga

SEQ ID NO: 182880 - DNA, 25 bp, Mus musculus
actctcaccaaaatgtgagcgtgtt

SEQ ID NO: 182881 - DNA, 25 bp, Mus musculus
actctcaccaagcggacagagaagt

SEQ ID NO: 182882 - DNA, 25 bp, Mus musculus
actctcaccaaggctctggcctatg

SEQ ID NO: 182883 - DNA, 25 bp, Mus musculus
actctcagagaaccgagcccgaaaa

SEQ ID NO: 182884 - DNA, 25 bp, Mus musculus
actctcagagctgtggcagctcagc

SEQ ID NO: 182885 - DNA, 25 bp, Mus musculus
actctcagcatgcaaaattctaaag

SEQ ID NO: 182886 - DNA, 25 bp, Mus musculus
actctcagcatgcaagagactctgc

SEQ ID NO: 182887 - DNA, 25 bp, Mus musculus
actctcagctgagcagcaagaacag

SEQ ID NO: 182888 - DNA, 25 bp, Mus musculus
actctcagctgctttgctgctgctc

SEQ ID NO: 182889 - DNA, 25 bp, Mus musculus
actctcaggttttggctaccggctc

SEQ ID NO: 182890 - DNA, 25 bp, Mus musculus
actctcagtcaggtttggacgtcat

SEQ ID NO: 182891 - DNA, 25 bp, Mus musculus
actctcagtgctgggttttcagagc

SEQ ID NO: 182892 - DNA, 25 bp, Mus musculus
actctcatcaataaggactgcatcg

SEQ ID NO: 182893 - DNA, 25 bp, Mus musculus
actctcatcaggtgaaaacatgatt

SEQ ID NO: 182894 - DNA, 25 bp, Mus musculus
actctcatcagttcttacccaagac

SEQ ID NO: 182895 - DNA, 25 bp, Mus musculus
actctcatccctagcagaacatcat

SEQ ID NO: 182896 - DNA, 25 bp, Mus musculus
actctcatgcagatcccagtcaagt

SEQ ID NO: 182897 - DNA, 25 bp, Mus musculus
actctcatgcagttcccagtcaagt

SEQ ID NO: 182898 - DNA, 25 bp, Mus musculus
actctccaaacagacgatccagaac

SEQ ID NO: 182899 - DNA, 25 bp, Mus musculus
actctccaaccagccaatagttaca

SEQ ID NO: 182900 - DNA, 25 bp, Mus musculus
actctccaaccagttacagttagtg

SEQ ID NO: 182901 - DNA, 25 bp, Mus musculus
actctccaactggctttaagggaat

SEQ ID NO: 182902 - DNA, 25 bp, Mus musculus
actctccaaggccgacgtggaaaga

SEQ ID NO: 182903 - DNA, 25 bp, Mus musculus
actctccactacaagatgaggtctc

SEQ ID NO: 182904 - DNA, 25 bp, Mus musculus
actctccagatagagctcgccgcct

SEQ ID NO: 182905 - DNA, 25 bp, Mus musculus
actctccagatagagtcccaggtaa

SEQ ID NO: 182906 - DNA, 25 bp, Mus musculus
actctcccagcatgctggactatga

SEQ ID NO: 182907 - DNA, 25 bp, Mus musculus
actctcccagggatgaacaggccga

SEQ ID NO: 182908 - DNA, 25 bp, Mus musculus
actctcccagggctttctgagggtc

SEQ ID NO: 182909 - DNA, 25 bp, Mus musculus
actctcccctcgtaccagtaatgtt

SEQ ID NO: 182910 - DNA, 25 bp, Mus musculus
actctcccctgtcctggagtgggct

SEQ ID NO: 182911 - DNA, 25 bp, Mus musculus
actctccctacggcatagtgccgtc

SEQ ID NO: 182912 - DNA, 25 bp, Mus musculus
actctccctacggcatgaaacagaa

SEQ ID NO: 182913 - DNA, 25 bp, Mus musculus
actctccgagacagagacaaaatca

SEQ ID NO: 182914 - DNA, 25 bp, Mus musculus
actctcctcagaagactggtccccg

SEQ ID NO: 182915 - DNA, 25 bp, Mus musculus
actctcctcaggtcatgtttactgg

SEQ ID NO: 182916 - DNA, 25 bp, Mus musculus
actctcctccaggcacaactgtgcg

SEQ ID NO: 182917 - DNA, 25 bp, Mus musculus
actctcctctcaactccacgtcagc

SEQ ID NO: 182918 - DNA, 25 bp, Mus musculus
actctcctctcaagcaagctatagt

SEQ ID NO: 182919 - DNA, 25 bp, Mus musculus
actctcctctcagaggctctggaga

SEQ ID NO: 182920 - DNA, 25 bp, Mus musculus
actctcctgctgggacacccctcac

SEQ ID NO: 182921 - DNA, 25 bp, Mus musculus
actctcctgctgggtctgtgatggt

SEQ ID NO: 182922 - DNA, 25 bp, Mus musculus
actctcctttttgctgttcactttg

SEQ ID NO: 182923 - DNA, 25 bp, Mus musculus
actctcggacgcaggctcagcttct

SEQ ID NO: 182924 - DNA, 25 bp, Mus musculus
actctcggacgcagggaaggtagtg

SEQ ID NO: 182925 - DNA, 25 bp, Mus musculus
actctcgggaagttattggagactg

SEQ ID NO: 182926 - DNA, 25 bp, Mus musculus
actctcgtggaggctgctctgacag

SEQ ID NO: 182927 - DNA, 25 bp, Mus musculus
actctctacaaatgataaaactatt

SEQ ID NO: 182928 - DNA, 25 bp, Mus musculus
actctctatataaagacactccgtg

SEQ ID NO: 182929 - DNA, 25 bp, Mus musculus
actctctcaaaccccttatccctct

SEQ ID NO: 182930 - DNA, 25 bp, Mus musculus
actctctcatgaggagccccaggat

SEQ ID NO: 182931 - DNA, 25 bp, Mus musculus
actctctcccagatgacagtcatgc

SEQ ID NO: 182932 - DNA, 25 bp, Mus musculus
actctctctcaggcacttgtggaat

SEQ ID NO: 182933 - DNA, 25 bp, Mus musculus
actctctctcaggtctgaacataag

SEQ ID NO: 182934 - DNA, 25 bp, Mus musculus
actctctctggctgagtgactgggt

SEQ ID NO: 182935 - DNA, 25 bp, Mus musculus
actctctgaagagcactctggccac

SEQ ID NO: 182936 - DNA, 25 bp, Mus musculus
actctctgcctggcccgatttcccg

SEQ ID NO: 182937 - DNA, 25 bp, Mus musculus
actctctgctgcaggatgctgccaa

SEQ ID NO: 182938 - DNA, 25 bp, Mus musculus
actctctgtggaccccgttcatgtc

SEQ ID NO: 182939 - DNA, 25 bp, Mus musculus
actctcttaggaaaagaagaccaga

SEQ ID NO: 182940 - DNA, 25 bp, Mus musculus
actctcttgatcagcaagccccgcc

SEQ ID NO: 182941 - DNA, 25 bp, Mus musculus
actctctttttagtctctggaagac

SEQ ID NO: 182942 - DNA, 25 bp, Mus musculus
actctcttttttgagattgagctcc

SEQ ID NO: 182943 - DNA, 25 bp, Mus musculus
actctgaaaaagtcctaatcaaagt

SEQ ID NO: 182944 - DNA, 25 bp, Mus musculus
actctgaaacagagatggctcccaa

SEQ ID NO: 182945 - DNA, 25 bp, Mus musculus
actctgaaacaggtcctgcctaatc

SEQ ID NO: 182946 - DNA, 25 bp, Mus musculus
actctgaaactagactctacaggag

SEQ ID NO: 182947 - DNA, 25 bp, Mus musculus
actctgaaactctgccgagtgtttc

SEQ ID NO: 182948 - DNA, 25 bp, Mus musculus
actctgaaagatattaccaggagac

SEQ ID NO: 182949 - DNA, 25 bp, Mus musculus
actctgaacaaatcctgctgcatca

SEQ ID NO: 182950 - DNA, 25 bp, Mus musculus
actctgaacactgaggggttcctgg

SEQ ID NO: 182951 - DNA, 25 bp, Mus musculus
actctgaaccagcctccagtccctg

SEQ ID NO: 182952 - DNA, 25 bp, Mus musculus
actctgaacctctatgaagtcttac

SEQ ID NO: 182953 - DNA, 25 bp, Mus musculus
actctgaacctggctctggtagccg

SEQ ID NO: 182954 - DNA, 25 bp, Mus musculus
actctgaacttaacatctctgaaag

SEQ ID NO: 182955 - DNA, 25 bp, Mus musculus
actctgaagaaggctccttcccctg

SEQ ID NO: 182956 - DNA, 25 bp, Mus musculus
actctgaagcagattcgctgcctga

SEQ ID NO: 182957 - DNA, 25 bp, Mus musculus
actctgaagcgagaccaccgtggga

SEQ ID NO: 182958 - DNA, 25 bp, Mus musculus
actctgacaacctgcttggaaagtt

SEQ ID NO: 182959 - DNA, 25 bp, Mus musculus
actctgacagattcacctgcaagag

SEQ ID NO: 182960 - DNA, 25 bp, Mus musculus
actctgacagtgagggtgcggggtc

SEQ ID NO: 182961 - DNA, 25 bp, Mus musculus
actctgacatagcctaggaagtaga

SEQ ID NO: 182962 - DNA, 25 bp, Mus musculus
actctgacatatggggcatcatgga

SEQ ID NO: 182963 - DNA, 25 bp, Mus musculus
actctgacgtccattacagaagact

SEQ ID NO: 182964 - DNA, 25 bp, Mus musculus
actctgagaaggtctattacaatgg

SEQ ID NO: 182965 - DNA, 25 bp, Mus musculus
actctgagacagactgcatgtatgg

SEQ ID NO: 182966 - DNA, 25 bp, Mus musculus
actctgagcaggaggatgagtctga

SEQ ID NO: 182967 - DNA, 25 bp, Mus musculus
actctgagtacaaagtgaaggagga

SEQ ID NO: 182968 - DNA, 25 bp, Mus musculus
actctgagtaccaaggcaaagaccc

SEQ ID NO: 182969 - DNA, 25 bp, Mus musculus
actctgatcagagtgccagaaggct

SEQ ID NO: 182970 - DNA, 25 bp, Mus musculus
actctgatccttcatggcagtgaag

SEQ ID NO: 182971 - DNA, 25 bp, Mus musculus
actctgatgtgtaagcttatcacag

SEQ ID NO: 182972 - DNA, 25 bp, Mus musculus
actctgattttgagaattcagagcc

SEQ ID NO: 182973 - DNA, 25 bp, Mus musculus
actctgattttgagtttgaaaatga

SEQ ID NO: 182974 - DNA, 25 bp, Mus musculus
actctgcaaacagtgccaccaaaag

SEQ ID NO: 182975 - DNA, 25 bp, Mus musculus
actctgcaaagcgccatcaaaggat

SEQ ID NO: 182976 - DNA, 25 bp, Mus musculus
actctgcaaagcgctactgttgagg

SEQ ID NO: 182977 - DNA, 25 bp, Mus musculus
actctgcaaagtgacccagactaca

SEQ ID NO: 182978 - DNA, 25 bp, Mus musculus
actctgcaaagtggcctatgaggag

SEQ ID NO: 182979 - DNA, 25 bp, Mus musculus
actctgcaaattagatgttctttgt

SEQ ID NO: 182980 - DNA, 25 bp, Mus musculus
actctgcaaccaaggcctttgtaga

SEQ ID NO: 182981 - DNA, 25 bp, Mus musculus
actctgcaatacctggcgccagagc

SEQ ID NO: 182982 - DNA, 25 bp, Mus musculus
actctgcacccagccaaggtagcca

SEQ ID NO: 182983 - DNA, 25 bp, Mus musculus
actctgcagcctcagcaaagaagag

SEQ ID NO: 182984 - DNA, 25 bp, Mus musculus
actctgccaaggagttaatcagtca

SEQ ID NO: 182985 - DNA, 25 bp, Mus musculus
actctgccagcaaggtgtagctact

SEQ ID NO: 182986 - DNA, 25 bp, Mus musculus
actctgcccaataaggcacctccca

SEQ ID NO: 182987 - DNA, 25 bp, Mus musculus
actctgccctttttggctgcagaga

SEQ ID NO: 182988 - DNA, 25 bp, Mus musculus
actctgccctttttgtgccgtggtg

SEQ ID NO: 182989 - DNA, 25 bp, Mus musculus
actctgcctttggggatgtcgtcac

SEQ ID NO: 182990 - DNA, 25 bp, Mus musculus
actctgcgaagggaaatgctcataa

SEQ ID NO: 182991 - DNA, 25 bp, Mus musculus
actctgcgagcagccaccactggtc

SEQ ID NO: 182992 - DNA, 25 bp, Mus musculus
actctgctaaaggactggaaaggag

SEQ ID NO: 182993 - DNA, 25 bp, Mus musculus
actctgctagccaagatatcaacct

SEQ ID NO: 182994 - DNA, 25 bp, Mus musculus
actctgctagccaaggtgctggatt

SEQ ID NO: 182995 - DNA, 25 bp, Mus musculus
actctgctctgcagtgcctgagcaa

SEQ ID NO: 182996 - DNA, 25 bp, Mus musculus
actctgctgacagacactgtcctgt

SEQ ID NO: 182997 - DNA, 25 bp, Mus musculus
actctgctgccggcttttctcctga

SEQ ID NO: 182998 - DNA, 25 bp, Mus musculus
actctgctgccgggtcagcacctcg

SEQ ID NO: 182999 - DNA, 25 bp, Mus musculus
actctgctggatggctctgccttat

SEQ ID NO: 183000 - DNA, 25 bp, Mus musculus
actctgctggcaagaacttgacctc

SEQ ID NO: 183001 - DNA, 25 bp, Mus musculus
actctgctgtcaggtacaggtcaag

SEQ ID NO: 183002 - DNA, 25 bp, Mus musculus
actctgctttccagcaagccccgcc

SEQ ID NO: 183003 - DNA, 25 bp, Mus musculus
actctgcttttggcaactcgttggt

SEQ ID NO: 183004 - DNA, 25 bp, Mus musculus
actctggaaataaggccgttgacta

SEQ ID NO: 183005 - DNA, 25 bp, Mus musculus
actctggaagatgggtgtgttttac

SEQ ID NO: 183006 - DNA, 25 bp, Mus musculus
actctggaaggaaaaaaatctggat

SEQ ID NO: 183007 - DNA, 25 bp, Mus musculus
actctggaaggctgtcaagaaacat

SEQ ID NO: 183008 - DNA, 25 bp, Mus musculus
actctggacaaactgtcctgtgtgg

SEQ ID NO: 183009 - DNA, 25 bp, Mus musculus
actctggacaatgccaacagtatac

SEQ ID NO: 183010 - DNA, 25 bp, Mus musculus
actctggacaccgatgactttgtga

SEQ ID NO: 183011 - DNA, 25 bp, Mus musculus
actctggacaccgccacagtacatg

SEQ ID NO: 183012 - DNA, 25 bp, Mus musculus
actctggacccaaatcaatactaca

SEQ ID NO: 183013 - DNA, 25 bp, Mus musculus
actctggagaaggccaacagcaggc

SEQ ID NO: 183014 - DNA, 25 bp, Mus musculus
actctggagcagaagacaaaagaaa

SEQ ID NO: 183015 - DNA, 25 bp, Mus musculus
actctggagcagaaggttatgttct

SEQ ID NO: 183016 - DNA, 25 bp, Mus musculus
actctggatccaggtggtacccggg

SEQ ID NO: 183017 - DNA, 25 bp, Mus musculus
actctggccgtcgcggctggactgt

SEQ ID NO: 183018 - DNA, 25 bp, Mus musculus
actctggctgggcgctcaccctcca

SEQ ID NO: 183019 - DNA, 25 bp, Mus musculus
actctggcttctcagatgggagctc

SEQ ID NO: 183020 - DNA, 25 bp, Mus musculus
actctggcttctcagttccagagcc

SEQ ID NO: 183021 - DNA, 25 bp, Mus musculus
actctgggaatagattccaagagca

SEQ ID NO: 183022 - DNA, 25 bp, Mus musculus
actctgggacccgaacaatttcgaa

SEQ ID NO: 183023 - DNA, 25 bp, Mus musculus
actctgggaggagcctgagttttct

SEQ ID NO: 183024 - DNA, 25 bp, Mus musculus
actctgggcacgctaataattttca

SEQ ID NO: 183025 - DNA, 25 bp, Mus musculus
actctgggctatgtgggtgagcctg

SEQ ID NO: 183026 - DNA, 25 bp, Mus musculus
actctggttcaggctggcctgcctt

SEQ ID NO: 183027 - DNA, 25 bp, Mus musculus
actctgtaatggcagtttgagatgg

SEQ ID NO: 183028 - DNA, 25 bp, Mus musculus
actctgtacggcttgtgaaatggag

SEQ ID NO: 183029 - DNA, 25 bp, Mus musculus
actctgtatccctgttgctgagctg

SEQ ID NO: 183030 - DNA, 25 bp, Mus musculus
actctgtcaaggcccgagaccagaa

SEQ ID NO: 183031 - DNA, 25 bp, Mus musculus
actctgtccctggcgtggggacagt

SEQ ID NO: 183032 - DNA, 25 bp, Mus musculus
actctgtcgcagattggaagaattg

SEQ ID NO: 183033 - DNA, 25 bp, Mus musculus
actctgtgaaggcccgagaccagaa

SEQ ID NO: 183034 - DNA, 25 bp, Mus musculus
actctgtgccagacatcctgcagtt

SEQ ID NO: 183035 - DNA, 25 bp, Mus musculus
actctgtgccagccatgaatgtcct

SEQ ID NO: 183036 - DNA, 25 bp, Mus musculus
actctgtgcccaagattgggtgtga

SEQ ID NO: 183037 - DNA, 25 bp, Mus musculus
actctgtgctgagctgggtgaagat

SEQ ID NO: 183038 - DNA, 25 bp, Mus musculus
actctgtggggctccacagaattgt

SEQ ID NO: 183039 - DNA, 25 bp, Mus musculus
actctgtggggctccctccatgtgc

SEQ ID NO: 183040 - DNA, 25 bp, Mus musculus
actctgttaagaaagaaacgctgca

SEQ ID NO: 183041 - DNA, 25 bp, Mus musculus
actctgttaagaaagattaaagatg

SEQ ID NO: 183042 - DNA, 25 bp, Mus musculus
actctgttaagaaaggacaaagatg

SEQ ID NO: 183043 - DNA, 25 bp, Mus musculus
actctgttcagtgaacctaacactg

SEQ ID NO: 183044 - DNA, 25 bp, Mus musculus
actctgttggttcactttaattgag

SEQ ID NO: 183045 - DNA, 25 bp, Mus musculus
actctgttgtgtagatgaacgagac

SEQ ID NO: 183046 - DNA, 25 bp, Mus musculus
actctgtttcagtggaaacaagttg

SEQ ID NO: 183047 - DNA, 25 bp, Mus musculus
actcttaaagatgagaattctccag

SEQ ID NO: 183048 - DNA, 25 bp, Mus musculus
actcttacccagaccaacagcaacc

SEQ ID NO: 183049 - DNA, 25 bp, Mus musculus
actcttacccagcatatatttggtt

SEQ ID NO: 183050 - DNA, 25 bp, Mus musculus
actcttacccaggtttttgtgcgtc

SEQ ID NO: 183051 - DNA, 25 bp, Mus musculus
actcttaccgatcagcaccagtgat

SEQ ID NO: 183052 - DNA, 25 bp, Mus musculus
actcttacctgcctgtgccgtgtga

SEQ ID NO: 183053 - DNA, 25 bp, Mus musculus
actcttactccgtggcgaatctcat

SEQ ID NO: 183054 - DNA, 25 bp, Mus musculus
actcttagagaacatgctggatagt

SEQ ID NO: 183055 - DNA, 25 bp, Mus musculus
actcttagagaagatccatctgaca

SEQ ID NO: 183056 - DNA, 25 bp, Mus musculus
actcttagagtaccagcgcgggatg

SEQ ID NO: 183057 - DNA, 25 bp, Mus musculus
actcttattgggctgtgcctaagag

SEQ ID NO: 183058 - DNA, 25 bp, Mus musculus
actcttattgttggaaatctacatt

SEQ ID NO: 183059 - DNA, 25 bp, Mus musculus
actcttcaaaggctttggagacagg

SEQ ID NO: 183060 - DNA, 25 bp, Mus musculus
actcttcaagaatgccatgagggcc

SEQ ID NO: 183061 - DNA, 25 bp, Mus musculus
actcttcaagagagatcctggcttc

SEQ ID NO: 183062 - DNA, 25 bp, Mus musculus
actcttcaagatcctaaatttgacc

SEQ ID NO: 183063 - DNA, 25 bp, Mus musculus
actcttcaagccacttagccaagat

SEQ ID NO: 183064 - DNA, 25 bp, Mus musculus
actcttcaaggtaaagtggatcttc

SEQ ID NO: 183065 - DNA, 25 bp, Mus musculus
actcttcaaggtgctggaggactcc

SEQ ID NO: 183066 - DNA, 25 bp, Mus musculus
actcttcaagtatgccatgagggcc

SEQ ID NO: 183067 - DNA, 25 bp, Mus musculus
actcttcacgataggcaaggggaag

SEQ ID NO: 183068 - DNA, 25 bp, Mus musculus
actcttcagacagacccttagaggg

SEQ ID NO: 183069 - DNA, 25 bp, Mus musculus
actcttcagacagagggccacagct

SEQ ID NO: 183070 - DNA, 25 bp, Mus musculus
actcttcagcttcaaatcagtacca

SEQ ID NO: 183071 - DNA, 25 bp, Mus musculus
actcttcagcttcaaggtttggatt

SEQ ID NO: 183072 - DNA, 25 bp, Mus musculus
actcttcagtattcctgtcttgact

SEQ ID NO: 183073 - DNA, 25 bp, Mus musculus
actcttcatggcgaagaagaagaca

SEQ ID NO: 183074 - DNA, 25 bp, Mus musculus
actcttccagacccatgaaaataga

SEQ ID NO: 183075 - DNA, 25 bp, Mus musculus
actcttccatgtgctccccacactc

SEQ ID NO: 183076 - DNA, 25 bp, Mus musculus
actcttcccaagctaaagcccatta

SEQ ID NO: 183077 - DNA, 25 bp, Mus musculus
actcttcccagagaccgtgaagaac

SEQ ID NO: 183078 - DNA, 25 bp, Mus musculus
actcttcccaggctttgacctagag

SEQ ID NO: 183079 - DNA, 25 bp, Mus musculus
actcttccctcctatcccctgcttt

SEQ ID NO: 183080 - DNA, 25 bp, Mus musculus
actcttccttggtactctcaagttc

SEQ ID NO: 183081 - DNA, 25 bp, Mus musculus
actcttctaaaacgttaccacctgc

SEQ ID NO: 183082 - DNA, 25 bp, Mus musculus
actcttctaaagatccactatgggc

SEQ ID NO: 183083 - DNA, 25 bp, Mus musculus
actcttctagtagcttgtcttctca

SEQ ID NO: 183084 - DNA, 25 bp, Mus musculus
actcttctctaaaaaagattgatag

SEQ ID NO: 183085 - DNA, 25 bp, Mus musculus
actcttctggaagccgctctctctc

SEQ ID NO: 183086 - DNA, 25 bp, Mus musculus
actcttctggaaggatccgccgcga

SEQ ID NO: 183087 - DNA, 25 bp, Mus musculus
actcttcttcacggtgccttggagc

SEQ ID NO: 183088 - DNA, 25 bp, Mus musculus
actcttgaagaacatatccccaagt

SEQ ID NO: 183089 - DNA, 25 bp, Mus musculus
actcttgaagatgccgagatgtttc

SEQ ID NO: 183090 - DNA, 25 bp, Mus musculus
actcttgaaggacatagatgctgca

SEQ ID NO: 183091 - DNA, 25 bp, Mus musculus
actcttgaaggatgcccaccaccga

SEQ ID NO: 183092 - DNA, 25 bp, Mus musculus
actcttgacaggaaggagggggaga

SEQ ID NO: 183093 - DNA, 25 bp, Mus musculus
actcttgagggaggccttaaccatg

SEQ ID NO: 183094 - DNA, 25 bp, Mus musculus
actcttgatagtgatctttccagaa

SEQ ID NO: 183095 - DNA, 25 bp, Mus musculus
actcttgatgagggtccaccaaaat

SEQ ID NO: 183096 - DNA, 25 bp, Mus musculus
actcttgcaaggtctggttttgcag

SEQ ID NO: 183097 - DNA, 25 bp, Mus musculus
actcttggagaaaatccaagttctt

SEQ ID NO: 183098 - DNA, 25 bp, Mus musculus
actcttggagctggaagagaaaaca

SEQ ID NO: 183099 - DNA, 25 bp, Mus musculus
actcttgggccagagagctgggttt

SEQ ID NO: 183100 - DNA, 25 bp, Mus musculus
actcttgggttcaagatcttggcaa

SEQ ID NO: 183101 - DNA, 25 bp, Mus musculus
actcttgtaaagtaccagtgctgtg

SEQ ID NO: 183102 - DNA, 25 bp, Mus musculus
actcttgtaaagttacaagcccaaa

SEQ ID NO: 183103 - DNA, 25 bp, Mus musculus
actcttgtcccccacgtgccccgag

SEQ ID NO: 183104 - DNA, 25 bp, Mus musculus
actcttgtgtatatgctgtagaaaa

SEQ ID NO: 183105 - DNA, 25 bp, Mus musculus
actcttgttgcccagctggcatttt

SEQ ID NO: 183106 - DNA, 25 bp, Mus musculus
actctttataaaaatctgctgtatc

SEQ ID NO: 183107 - DNA, 25 bp, Mus musculus
actctttcctcccttggagttccac

SEQ ID NO: 183108 - DNA, 25 bp, Mus musculus
actctttcctctctgacttcctctt

SEQ ID NO: 183109 - DNA, 25 bp, Mus musculus
actctttgaaagaagcagttccgag

SEQ ID NO: 183110 - DNA, 25 bp, Mus musculus
actctttgatgtaacccacggctgc

SEQ ID NO: 183111 - DNA, 25 bp, Mus musculus
actctttgcaggcttcctccccagg

SEQ ID NO: 183112 - DNA, 25 bp, Mus musculus
actctttgtcttcttgtctggggag

SEQ ID NO: 183113 - DNA, 25 bp, Mus musculus
actcttttatgagtttgaaggaagg

SEQ ID NO: 183114 - DNA, 25 bp, Mus musculus
actgaaaaaaggctgtgacctctct

SEQ ID NO: 183115 - DNA, 25 bp, Mus musculus
actgaaaaagacaagatctccctag

SEQ ID NO: 183116 - DNA, 25 bp, Mus musculus
actgaaaaaggacggctcctctaac

SEQ ID NO: 183117 - DNA, 25 bp, Mus musculus
actgaaaaagttccaccaggtgaga

SEQ ID NO: 183118 - DNA, 25 bp, Mus musculus
actgaaaaatgagttcattgagaag

SEQ ID NO: 183119 - DNA, 25 bp, Mus musculus
actgaaaaatgggatgggttggagc

SEQ ID NO: 183120 - DNA, 25 bp, Mus musculus
actgaaaaatgtagttcctaatatt

SEQ ID NO: 183121 - DNA, 25 bp, Mus musculus
actgaaaatgatacagtgtgacaga

SEQ ID NO: 183122 - DNA, 25 bp, Mus musculus
actgaaaatggtgttttcgatgtgg

SEQ ID NO: 183123 - DNA, 25 bp, Mus musculus
actgaaacatgaccaggccatgtga

SEQ ID NO: 183124 - DNA, 25 bp, Mus musculus
actgaaacatgactttctgggacaa

SEQ ID NO: 183125 - DNA, 25 bp, Mus musculus
actgaaacattttaacagtgatgtc

SEQ ID NO: 183126 - DNA, 25 bp, Mus musculus
actgaaaccaaggctggtctgctca

SEQ ID NO: 183127 - DNA, 25 bp, Mus musculus
actgaaactattaggcaggaacagg

SEQ ID NO: 183128 - DNA, 25 bp, Mus musculus
actgaaactgcaggtcacggaagcg

SEQ ID NO: 183129 - DNA, 25 bp, Mus musculus
actgaaactgcagtggactgagttt

SEQ ID NO: 183130 - DNA, 25 bp, Mus musculus
actgaaagctgtcctctattgtatg

SEQ ID NO: 183131 - DNA, 25 bp, Mus musculus
actgaaagctgttttaaaggacacc

SEQ ID NO: 183132 - DNA, 25 bp, Mus musculus
actgaaagtacttgaaaactggtgg

SEQ ID NO: 183133 - DNA, 25 bp, Mus musculus
actgaaagtgacaactggaaccttg

SEQ ID NO: 183134 - DNA, 25 bp, Mus musculus
actgaaagtgggtccctgaagtcag

SEQ ID NO: 183135 - DNA, 25 bp, Mus musculus
actgaaatctcgagatctttgcaag

SEQ ID NO: 183136 - DNA, 25 bp, Mus musculus
actgaaattccacaagctgatcaac

SEQ ID NO: 183137 - DNA, 25 bp, Mus musculus
actgaacagagacactcctgaggaa

SEQ ID NO: 183138 - DNA, 25 bp, Mus musculus
actgaacagagatgatgattctgat

SEQ ID NO: 183139 - DNA, 25 bp, Mus musculus
actgaacattccaccatgccagcag

SEQ ID NO: 183140 - DNA, 25 bp, Mus musculus
actgaacccaaccagaatcgagctc

SEQ ID NO: 183141 - DNA, 25 bp, Mus musculus
actgaaccgctggttgggtgaacag

SEQ ID NO: 183142 - DNA, 25 bp, Mus musculus
actgaactaagacagaaagacatgg

SEQ ID NO: 183143 - DNA, 25 bp, Mus musculus
actgaactctcagacacatgcctgg

SEQ ID NO: 183144 - DNA, 25 bp, Mus musculus
actgaactctcaggaaacccaagga

SEQ ID NO: 183145 - DNA, 25 bp, Mus musculus
actgaactggacaggtacctctaag

SEQ ID NO: 183146 - DNA, 25 bp, Mus musculus
actgaagaagaggttaggaatttgg

SEQ ID NO: 183147 - DNA, 25 bp, Mus musculus
actgaagaagatggatgcagattcc

SEQ ID NO: 183148 - DNA, 25 bp, Mus musculus
actgaagaagatgggcctgacggag

SEQ ID NO: 183149 - DNA, 25 bp, Mus musculus
actgaagaaggacagctcctctgtc

SEQ ID NO: 183150 - DNA, 25 bp, Mus musculus
actgaagaagtggactctcgaaaaa

SEQ ID NO: 183151 - DNA, 25 bp, Mus musculus
actgaagacatagggaatctgtcct

SEQ ID NO: 183152 - DNA, 25 bp, Mus musculus
actgaagacccctatacaaccagtg

SEQ ID NO: 183153 - DNA, 25 bp, Mus musculus
actgaagacgagttggtgtcagaat

SEQ ID NO: 183154 - DNA, 25 bp, Mus musculus
actgaagacgagttttcgtttctct

SEQ ID NO: 183155 - DNA, 25 bp, Mus musculus
actgaagactatcaccttaaccaac

SEQ ID NO: 183156 - DNA, 25 bp, Mus musculus
actgaagactgtcactagatgcaaa

SEQ ID NO: 183157 - DNA, 25 bp, Mus musculus
actgaagagctagagatatgtgtca

SEQ ID NO: 183158 - DNA, 25 bp, Mus musculus
actgaagatgaaaaaggtcatttac

SEQ ID NO: 183159 - DNA, 25 bp, Mus musculus
actgaagatgaaccggaagtatgaa

SEQ ID NO: 183160 - DNA, 25 bp, Mus musculus
actgaagatgatgcttctgtgaaga

SEQ ID NO: 183161 - DNA, 25 bp, Mus musculus
actgaagatggactggaaacatacc

SEQ ID NO: 183162 - DNA, 25 bp, Mus musculus
actgaagcagaaggagctaggtggc

SEQ ID NO: 183163 - DNA, 25 bp, Mus musculus
actgaagcaggaggaggagacgctg

SEQ ID NO: 183164 - DNA, 25 bp, Mus musculus
actgaagcagggaacccagggggca

SEQ ID NO: 183165 - DNA, 25 bp, Mus musculus
actgaagcagggagggcaagctccc

SEQ ID NO: 183166 - DNA, 25 bp, Mus musculus
actgaagcagggagtaatgcatgaa

SEQ ID NO: 183167 - DNA, 25 bp, Mus musculus
actgaagcaggtgtccatcctgtcg

SEQ ID NO: 183168 - DNA, 25 bp, Mus musculus
actgaagcccagcagatttggcctg

SEQ ID NO: 183169 - DNA, 25 bp, Mus musculus
actgaagcccagcaggccagtgtgc

SEQ ID NO: 183170 - DNA, 25 bp, Mus musculus
actgaagctgggatcaagcacttcc

SEQ ID NO: 183171 - DNA, 25 bp, Mus musculus
actgaaggagctggtacagacttac

SEQ ID NO: 183172 - DNA, 25 bp, Mus musculus
actgaaggaggaagctgacctagag

SEQ ID NO: 183173 - DNA, 25 bp, Mus musculus
actgaaggagtctccagcctcccca

SEQ ID NO: 183174 - DNA, 25 bp, Mus musculus
actgaaggcagatcatgcctggggg

SEQ ID NO: 183175 - DNA, 25 bp, Mus musculus
actgaaggccctgaggtatcaccac

SEQ ID NO: 183176 - DNA, 25 bp, Mus musculus
actgaaggcttcaggaaatcaggac

SEQ ID NO: 183177 - DNA, 25 bp, Mus musculus
actgaagggaaaaaggtgatgtcta

SEQ ID NO: 183178 - DNA, 25 bp, Mus musculus
actgaaggtcactgagggcggtgag

SEQ ID NO: 183179 - DNA, 25 bp, Mus musculus
actgaaggtcgtgccagaaggaatg

SEQ ID NO: 183180 - DNA, 25 bp, Mus musculus
actgaagtgttccaggacatgctac

SEQ ID NO: 183181 - DNA, 25 bp, Mus musculus
actgaagttatgagagagattcaga

SEQ ID NO: 183182 - DNA, 25 bp, Mus musculus
actgaagttatgcagggatggcaag

SEQ ID NO: 183183 - DNA, 25 bp, Mus musculus
actgaatatagtatgtgcagcacta

SEQ ID NO: 183184 - DNA, 25 bp, Mus musculus
actgaatcctgagcaatggaagagt

SEQ ID NO: 183185 - DNA, 25 bp, Mus musculus
actgaatcctgaggtgcagcgtggc

SEQ ID NO: 183186 - DNA, 25 bp, Mus musculus
actgaatctgtcagacgtgttgatg

SEQ ID NO: 183187 - DNA, 25 bp, Mus musculus
actgaatcttcagtgagcatgtttt

SEQ ID NO: 183188 - DNA, 25 bp, Mus musculus
actgaatcttcattgagcatgtttt

SEQ ID NO: 183189 - DNA, 25 bp, Mus musculus
actgaatgggctgaagagaatgcaa

SEQ ID NO: 183190 - DNA, 25 bp, Mus musculus
actgaattcaaaggaggttcatgag

SEQ ID NO: 183191 - DNA, 25 bp, Mus musculus
actgaattgtacagatccgctgtac

SEQ ID NO: 183192 - DNA, 25 bp, Mus musculus
actgaatttatcgtcagatacagag

SEQ ID NO: 183193 - DNA, 25 bp, Mus musculus
actgaatttttcaaatttctgctgg

SEQ ID NO: 183194 - DNA, 25 bp, Mus musculus
actgacaaagaaggctggattctca

SEQ ID NO: 183195 - DNA, 25 bp, Mus musculus
actgacacacaccaggggtgacagt

SEQ ID NO: 183196 - DNA, 25 bp, Mus musculus
actgacacctccatgtatcccaagg

SEQ ID NO: 183197 - DNA, 25 bp, Mus musculus
actgacagaaacaaataaaacctca

SEQ ID NO: 183198 - DNA, 25 bp, Mus musculus
actgacagaaaccgtaatcctccac

SEQ ID NO: 183199 - DNA, 25 bp, Mus musculus
actgacagaaaggaaacatggagct

SEQ ID NO: 183200 - DNA, 25 bp, Mus musculus
actgacagaagttaccaaatgggaa

SEQ ID NO: 183201 - DNA, 25 bp, Mus musculus
actgacagagaggaggagacacggt

SEQ ID NO: 183202 - DNA, 25 bp, Mus musculus
actgacagttgaacaccagtgtact

SEQ ID NO: 183203 - DNA, 25 bp, Mus musculus
actgacattgagagggaatgaggtc

SEQ ID NO: 183204 - DNA, 25 bp, Mus musculus
actgacattgagagggagagtgtgg

SEQ ID NO: 183205 - DNA, 25 bp, Mus musculus
actgacattgggagaatcccgggca

SEQ ID NO: 183206 - DNA, 25 bp, Mus musculus
actgaccaaagatgagaaagtattc

SEQ ID NO: 183207 - DNA, 25 bp, Mus musculus
actgaccaaggctccagaaatgttt

SEQ ID NO: 183208 - DNA, 25 bp, Mus musculus
actgaccaaggggctgacgggacca

SEQ ID NO: 183209 - DNA, 25 bp, Mus musculus
actgaccaggtttgggttccccagg

SEQ ID NO: 183210 - DNA, 25 bp, Mus musculus
actgacccaccaggtgccagcctca

SEQ ID NO: 183211 - DNA, 25 bp, Mus musculus
actgacccaccaggtgtgccagggg

SEQ ID NO: 183212 - DNA, 25 bp, Mus musculus
actgacccagactctcaggtggacg

SEQ ID NO: 183213 - DNA, 25 bp, Mus musculus
actgacccgaagggtcacagacgaa

SEQ ID NO: 183214 - DNA, 25 bp, Mus musculus
actgaccctcagatagtgtttctag

SEQ ID NO: 183215 - DNA, 25 bp, Mus musculus
actgaccgagaagtgcccccgcctg

SEQ ID NO: 183216 - DNA, 25 bp, Mus musculus
actgacctggtgttgctgcacctaa

SEQ ID NO: 183217 - DNA, 25 bp, Mus musculus
actgacctggtgtttacagtgttgc

SEQ ID NO: 183218 - DNA, 25 bp, Mus musculus
actgaccttctagctcaccctagca

SEQ ID NO: 183219 - DNA, 25 bp, Mus musculus
actgaccttgaaggggactcagaag

SEQ ID NO: 183220 - DNA, 25 bp, Mus musculus
actgaccttggcatgcttgctcggg

SEQ ID NO: 183221 - DNA, 25 bp, Mus musculus
actgacgcagatgaagagctagagg

SEQ ID NO: 183222 - DNA, 25 bp, Mus musculus
actgacgcagtctggcttgccacgc

SEQ ID NO: 183223 - DNA, 25 bp, Mus musculus
actgacggacagatcttcttggaaa

SEQ ID NO: 183224 - DNA, 25 bp, Mus musculus
actgacggatgcggatgccatgaag

SEQ ID NO: 183225 - DNA, 25 bp, Mus musculus
actgactacaggcactggcagatcc

SEQ ID NO: 183226 - DNA, 25 bp, Mus musculus
actgactatgaacaaataggagaca

SEQ ID NO: 183227 - DNA, 25 bp, Mus musculus
actgactcaggctctgggggacctt

SEQ ID NO: 183228 - DNA, 25 bp, Mus musculus
actgactcagtatgaagagcgcatg

SEQ ID NO: 183229 - DNA, 25 bp, Mus musculus
actgactccgtatgaggttgatgag

SEQ ID NO: 183230 - DNA, 25 bp, Mus musculus
actgactcctgagatcatgaaggaa

SEQ ID NO: 183231 - DNA, 25 bp, Mus musculus
actgactctacagccactacgaagg

SEQ ID NO: 183232 - DNA, 25 bp, Mus musculus
actgactctacaggcattgggcatg

SEQ ID NO: 183233 - DNA, 25 bp, Mus musculus
actgactgagactaaaatacaaatg

SEQ ID NO: 183234 - DNA, 25 bp, Mus musculus
actgactgggagacttgtggcaata

SEQ ID NO: 183235 - DNA, 25 bp, Mus musculus
actgactggggatggaggtaaaggt

SEQ ID NO: 183236 - DNA, 25 bp, Mus musculus
actgactgggtgatgcccacgctgt

SEQ ID NO: 183237 - DNA, 25 bp, Mus musculus
actgactgtgtgtcccatgggtgct

SEQ ID NO: 183238 - DNA, 25 bp, Mus musculus
actgacttcaatggggttgcggccg

SEQ ID NO: 183239 - DNA, 25 bp, Mus musculus
actgacttcactaaagcaaaaatcg

SEQ ID NO: 183240 - DNA, 25 bp, Mus musculus
actgacttcactaaggcaaaaatcg

SEQ ID NO: 183241 - DNA, 25 bp, Mus musculus
actgacttgttggcccgtgggattg

SEQ ID NO: 183242 - DNA, 25 bp, Mus musculus
actgactttgccttcaatctcacag

SEQ ID NO: 183243 - DNA, 25 bp, Mus musculus
actgagaaaacagaagattctagtg

SEQ ID NO: 183244 - DNA, 25 bp, Mus musculus
actgagaaaacaggatctgactttg

SEQ ID NO: 183245 - DNA, 25 bp, Mus musculus
actgagaaaagttttgctcatggaa

SEQ ID NO: 183246 - DNA, 25 bp, Mus musculus
actgagaacaaagcaacaagcaact

SEQ ID NO: 183247 - DNA, 25 bp, Mus musculus
actgagaacaaagcaacaataaatg

SEQ ID NO: 183248 - DNA, 25 bp, Mus musculus
actgagaacaggtccaaagagaaag

SEQ ID NO: 183249 - DNA, 25 bp, Mus musculus
actgagaacaggtctaggtccaaag

SEQ ID NO: 183250 - DNA, 25 bp, Mus musculus
actgagaacctgccctgcagttaaa

SEQ ID NO: 183251 - DNA, 25 bp, Mus musculus
actgagaagaaggtgtttctcctgg

SEQ ID NO: 183252 - DNA, 25 bp, Mus musculus
actgagaagatgggtaatgccatcg

SEQ ID NO: 183253 - DNA, 25 bp, Mus musculus
actgagaaggaaggtctgtctgcag

SEQ ID NO: 183254 - DNA, 25 bp, Mus musculus
actgagaaggacaaattggagcctg

SEQ ID NO: 183255 - DNA, 25 bp, Mus musculus
actgagaaggacaaggttaactgct

SEQ ID NO: 183256 - DNA, 25 bp, Mus musculus
actgagaagtcgggtacaaagtaag

SEQ ID NO: 183257 - DNA, 25 bp, Mus musculus
actgagaataaatccaagtttgggg

SEQ ID NO: 183258 - DNA, 25 bp, Mus musculus
actgagaataaatccttggagctgg

SEQ ID NO: 183259 - DNA, 25 bp, Mus musculus
actgagaataaatgcctttaatgtg

SEQ ID NO: 183260 - DNA, 25 bp, Mus musculus
actgagaattcaagtctgtcaccta

SEQ ID NO: 183261 - DNA, 25 bp, Mus musculus
actgagacaggatttacatggatat

SEQ ID NO: 183262 - DNA, 25 bp, Mus musculus
actgagacagggctttctgagggtc

SEQ ID NO: 183263 - DNA, 25 bp, Mus musculus
actgagacccaagggcctgatttgt

SEQ ID NO: 183264 - DNA, 25 bp, Mus musculus
actgagaccccgagtggaaagctga

SEQ ID NO: 183265 - DNA, 25 bp, Mus musculus
actgagagaggaccatgctccccaa

SEQ ID NO: 183266 - DNA, 25 bp, Mus musculus
actgagagatgcaagctgataggag

SEQ ID NO: 183267 - DNA, 25 bp, Mus musculus
actgagagcaggagatctggaacac

SEQ ID NO: 183268 - DNA, 25 bp, Mus musculus
actgagagcattccagtgtcagatg

SEQ ID NO: 183269 - DNA, 25 bp, Mus musculus
actgagagtgagaagcatttcttca

SEQ ID NO: 183270 - DNA, 25 bp, Mus musculus
actgagatagaaagaaaggcccagg

SEQ ID NO: 183271 - DNA, 25 bp, Mus musculus
actgagatagacaccatcttgctga

SEQ ID NO: 183272 - DNA, 25 bp, Mus musculus
actgagatagatttcaaatatgcca

SEQ ID NO: 183273 - DNA, 25 bp, Mus musculus
actgagattacaggaatggaagaaa

SEQ ID NO: 183274 - DNA, 25 bp, Mus musculus
actgagcaagagtccaactttatcc

SEQ ID NO: 183275 - DNA, 25 bp, Mus musculus
actgagcaagtgtccaactttatcc

SEQ ID NO: 183276 - DNA, 25 bp, Mus musculus
actgagcacaatcagagctattctc

SEQ ID NO: 183277 - DNA, 25 bp, Mus musculus
actgagcacaatcaggtggaaactt

SEQ ID NO: 183278 - DNA, 25 bp, Mus musculus
actgagcacaatcaggtggccaata

SEQ ID NO: 183279 - DNA, 25 bp, Mus musculus
actgagcacaatcaggtgggagaaa

SEQ ID NO: 183280 - DNA, 25 bp, Mus musculus
actgagcacacctgaggagaggtgc

SEQ ID NO: 183281 - DNA, 25 bp, Mus musculus
actgagcacggtgcctgtggcctaa

SEQ ID NO: 183282 - DNA, 25 bp, Mus musculus
actgagcacggtgttcctgtagttg

SEQ ID NO: 183283 - DNA, 25 bp, Mus musculus
actgagcactggaggagttgtaatg

SEQ ID NO: 183284 - DNA, 25 bp, Mus musculus
actgagcagcacagattctaactca

SEQ ID NO: 183285 - DNA, 25 bp, Mus musculus
actgagcatgagcttttatgggagc

SEQ ID NO: 183286 - DNA, 25 bp, Mus musculus
actgagcatgaggtctcagacagcc

SEQ ID NO: 183287 - DNA, 25 bp, Mus musculus
actgagcatgtaagctctggcttct

SEQ ID NO: 183288 - DNA, 25 bp, Mus musculus
actgagccaacatggtcgtgaaaat

SEQ ID NO: 183289 - DNA, 25 bp, Mus musculus
actgagccaagtggtggcgggaatc

SEQ ID NO: 183290 - DNA, 25 bp, Mus musculus
actgagcccaggaaactacaacctt

SEQ ID NO: 183291 - DNA, 25 bp, Mus musculus
actgagcccatggttccaggatggc

SEQ ID NO: 183292 - DNA, 25 bp, Mus musculus
actgagcgaccagagatgtggcttt

SEQ ID NO: 183293 - DNA, 25 bp, Mus musculus
actgagcgaccaggacaggattcca

SEQ ID NO: 183294 - DNA, 25 bp, Mus musculus
actgagcgaggcgagcgtgcacagt

SEQ ID NO: 183295 - DNA, 25 bp, Mus musculus
actgagcgaggcgaggcaccatgac

SEQ ID NO: 183296 - DNA, 25 bp, Mus musculus
actgagcgccagagtacagtcgctt

SEQ ID NO: 183297 - DNA, 25 bp, Mus musculus
actgagcggtaggagggaactgagc

SEQ ID NO: 183298 - DNA, 25 bp, Mus musculus
actgagctcaagcccccggaagcct

SEQ ID NO: 183299 - DNA, 25 bp, Mus musculus
actgagctctgggatcagtttgaca

SEQ ID NO: 183300 - DNA, 25 bp, Mus musculus
actgagctgagctggcaactattga

SEQ ID NO: 183301 - DNA, 25 bp, Mus musculus
actgaggaacatgtaacaggtccac

SEQ ID NO: 183302 - DNA, 25 bp, Mus musculus
actgaggaacctgagaagaaggatc

SEQ ID NO: 183303 - DNA, 25 bp, Mus musculus
actgaggaatcagcttaccaacaaa

SEQ ID NO: 183304 - DNA, 25 bp, Mus musculus
actgaggaatcagtattcgcctggg

SEQ ID NO: 183305 - DNA, 25 bp, Mus musculus
actgaggaccacatgggtggcatcc

SEQ ID NO: 183306 - DNA, 25 bp, Mus musculus
actgaggagaagtgtgagaaacttt

SEQ ID NO: 183307 - DNA, 25 bp, Mus musculus
actgaggagagatcaggaatctttc

SEQ ID NO: 183308 - DNA, 25 bp, Mus musculus
actgaggagctgagtgataacattc

SEQ ID NO: 183309 - DNA, 25 bp, Mus musculus
actgaggagctgagtgattttgagg

SEQ ID NO: 183310 - DNA, 25 bp, Mus musculus
actgaggatgacatccgtggacagc

SEQ ID NO: 183311 - DNA, 25 bp, Mus musculus
actgaggatggcagggtatttatga

SEQ ID NO: 183312 - DNA, 25 bp, Mus musculus
actgaggcaggcagaagaagctttt

SEQ ID NO: 183313 - DNA, 25 bp, Mus musculus
actgaggcgccgcccggttaaccta

SEQ ID NO: 183314 - DNA, 25 bp, Mus musculus
actgagggactacagtggacaaggc

SEQ ID NO: 183315 - DNA, 25 bp, Mus musculus
actgagggtggaagggccagggacc

SEQ ID NO: 183316 - DNA, 25 bp, Mus musculus
actgaggtgagggaaccagacctta

SEQ ID NO: 183317 - DNA, 25 bp, Mus musculus
actgaggtgccagacgacctggagg

SEQ ID NO: 183318 - DNA, 25 bp, Mus musculus
actgaggtgccaggctggacccatg

SEQ ID NO: 183319 - DNA, 25 bp, Mus musculus
actgaggtgtggtctcggattggga

SEQ ID NO: 183320 - DNA, 25 bp, Mus musculus
actgagtacaaggttggaagtcgga

SEQ ID NO: 183321 - DNA, 25 bp, Mus musculus
actgagtcactcaagagcctcatcc

SEQ ID NO: 183322 - DNA, 25 bp, Mus musculus
actgagtcactcaaggaggctgttg

SEQ ID NO: 183323 - DNA, 25 bp, Mus musculus
actgagtcagaggaggggtgagggg

SEQ ID NO: 183324 - DNA, 25 bp, Mus musculus
actgagtcagaggatccacactggc

SEQ ID NO: 183325 - DNA, 25 bp, Mus musculus
actgagtcagccaaggtagccacgg

SEQ ID NO: 183326 - DNA, 25 bp, Mus musculus
actgagtccaagaaatggcctccac

SEQ ID NO: 183327 - DNA, 25 bp, Mus musculus
actgagtctctgggcacggaggtgc

SEQ ID NO: 183328 - DNA, 25 bp, Mus musculus
actgagtcttatctatgttcaaagg

SEQ ID NO: 183329 - DNA, 25 bp, Mus musculus
actgagtcttatgtatgttcaaagg

SEQ ID NO: 183330 - DNA, 25 bp, Mus musculus
actgagtgaagaaactgatctccga

SEQ ID NO: 183331 - DNA, 25 bp, Mus musculus
actgagtgaagaggagatgcatgct

SEQ ID NO: 183332 - DNA, 25 bp, Mus musculus
actgagtgagcacggatgaaaattt

SEQ ID NO: 183333 - DNA, 25 bp, Mus musculus
actgagtgagcaggctcctgcaaaa

SEQ ID NO: 183334 - DNA, 25 bp, Mus musculus
actgagtgggagttgtgacacagga

SEQ ID NO: 183335 - DNA, 25 bp, Mus musculus
actgagttgccctgactctaccgca

SEQ ID NO: 183336 - DNA, 25 bp, Mus musculus
actgagtttttagatattatgagaa

SEQ ID NO: 183337 - DNA, 25 bp, Mus musculus
actgataccatcctcatcccttttt

SEQ ID NO: 183338 - DNA, 25 bp, Mus musculus
actgatagaaaggtttacgaaagat

SEQ ID NO: 183339 - DNA, 25 bp, Mus musculus
actgatagaaagttgatcttcttag

SEQ ID NO: 183340 - DNA, 25 bp, Mus musculus
actgatagacagcccctgttgcatg

SEQ ID NO: 183341 - DNA, 25 bp, Mus musculus
actgatagacagctgctgctccagc

SEQ ID NO: 183342 - DNA, 25 bp, Mus musculus
actgatagcaaaactccaccagaga

SEQ ID NO: 183343 - DNA, 25 bp, Mus musculus
actgatagttgccttatcttccgta

SEQ ID NO: 183344 - DNA, 25 bp, Mus musculus
actgatagttgcggatgacggaggc

SEQ ID NO: 183345 - DNA, 25 bp, Mus musculus
actgatatcaggaggagccatggga

SEQ ID NO: 183346 - DNA, 25 bp, Mus musculus
actgatatccagtatggaagggtgg

SEQ ID NO: 183347 - DNA, 25 bp, Mus musculus
actgatcaagaaaatcttgttggaa

SEQ ID NO: 183348 - DNA, 25 bp, Mus musculus
actgatcacagaaggccagcaacat

SEQ ID NO: 183349 - DNA, 25 bp, Mus musculus
actgatccccacaggagaaatgctc

SEQ ID NO: 183350 - DNA, 25 bp, Mus musculus
actgatccccacaggtgatggacag

SEQ ID NO: 183351 - DNA, 25 bp, Mus musculus
actgatccggaacggtctgaaggtc

SEQ ID NO: 183352 - DNA, 25 bp, Mus musculus
actgatccggaacggtggttgtgga

SEQ ID NO: 183353 - DNA, 25 bp, Mus musculus
actgatcctgagacttgttcaaggg

SEQ ID NO: 183354 - DNA, 25 bp, Mus musculus
actgatcctggaggctgttcatcag

SEQ ID NO: 183355 - DNA, 25 bp, Mus musculus
actgatcgaaaggtggcctcctcag

SEQ ID NO: 183356 - DNA, 25 bp, Mus musculus
actgatctgtgctctaccgtgtgaa

SEQ ID NO: 183357 - DNA, 25 bp, Mus musculus
actgatctgtggtgctgcacagttt

SEQ ID NO: 183358 - DNA, 25 bp, Mus musculus
actgatgacagtatggaagggccta

SEQ ID NO: 183359 - DNA, 25 bp, Mus musculus
actgatgaccaaacgggctgtaaaa

SEQ ID NO: 183360 - DNA, 25 bp, Mus musculus
actgatgaccgcccagctctcaaac

SEQ ID NO: 183361 - DNA, 25 bp, Mus musculus
actgatgagaaaaaggtcctggagt

SEQ ID NO: 183362 - DNA, 25 bp, Mus musculus
actgatgagacaaagggagctgaag

SEQ ID NO: 183363 - DNA, 25 bp, Mus musculus
actgatgaggcgaaggaaagctcac

SEQ ID NO: 183364 - DNA, 25 bp, Mus musculus
actgatgcaaaaaggtctgctgaag

SEQ ID NO: 183365 - DNA, 25 bp, Mus musculus
actgatgcaaagttccaggtgttcc

SEQ ID NO: 183366 - DNA, 25 bp, Mus musculus
actgatgcagggtaatcaggaagca

SEQ ID NO: 183367 - DNA, 25 bp, Mus musculus
actgatgcctcaggttcaaccaggc

SEQ ID NO: 183368 - DNA, 25 bp, Mus musculus
actgatgctggggagaatcccgtat

SEQ ID NO: 183369 - DNA, 25 bp, Mus musculus
actgatggaggagacacgggccagg

SEQ ID NO: 183370 - DNA, 25 bp, Mus musculus
actgatggcaaaagtttcttctggg

SEQ ID NO: 183371 - DNA, 25 bp, Mus musculus
actgatggccggggacctgaagacg

SEQ ID NO: 183372 - DNA, 25 bp, Mus musculus
actgatgggaaggtggcagtgaacc

SEQ ID NO: 183373 - DNA, 25 bp, Mus musculus
actgatggtcaggtgtgacagacat

SEQ ID NO: 183374 - DNA, 25 bp, Mus musculus
actgatggtcccaaaggtgcagctg

SEQ ID NO: 183375 - DNA, 25 bp, Mus musculus
actgatgtcgcagggacactgggtt

SEQ ID NO: 183376 - DNA, 25 bp, Mus musculus
actgatgtgggaggtacgtgggagc

SEQ ID NO: 183377 - DNA, 25 bp, Mus musculus
actgattcaaggaggcttggcaaat

SEQ ID NO: 183378 - DNA, 25 bp, Mus musculus
actgattcagacattgcagatggtg

SEQ ID NO: 183379 - DNA, 25 bp, Mus musculus
actgattctgtggaactagtcttgc

SEQ ID NO: 183380 - DNA, 25 bp, Mus musculus
actgatttaaggcttttgcctacca

SEQ ID NO: 183381 - DNA, 25 bp, Mus musculus
actgatttaagggcagcagggaacc

SEQ ID NO: 183382 - DNA, 25 bp, Mus musculus
actgattttagctctgatctcactc

SEQ ID NO: 183383 - DNA, 25 bp, Mus musculus
actgattttttgcaggcatcacaga

SEQ ID NO: 183384 - DNA, 25 bp, Mus musculus
actgcaaaaacagctcaatgacagt

SEQ ID NO: 183385 - DNA, 25 bp, Mus musculus
actgcaaaaacagctctgtccaaag

SEQ ID NO: 183386 - DNA, 25 bp, Mus musculus
actgcaaaaacctggagccagaatg

SEQ ID NO: 183387 - DNA, 25 bp, Mus musculus
actgcaaaatgggagccaggagtcc

SEQ ID NO: 183388 - DNA, 25 bp, Mus musculus
actgcaaacgggaggatatgatggt

SEQ ID NO: 183389 - DNA, 25 bp, Mus musculus
actgcaaacggtggttggcacttac

SEQ ID NO: 183390 - DNA, 25 bp, Mus musculus
actgcaaagaggctgatttatcgct

SEQ ID NO: 183391 - DNA, 25 bp, Mus musculus
actgcaaaggaagctcaatgacagt

SEQ ID NO: 183392 - DNA, 25 bp, Mus musculus
actgcaaaggtaaccagagcgagca

SEQ ID NO: 183393 - DNA, 25 bp, Mus musculus
actgcaaagtaatatctccatctct

SEQ ID NO: 183394 - DNA, 25 bp, Mus musculus
actgcaacaacgggatcccggagaa

SEQ ID NO: 183395 - DNA, 25 bp, Mus musculus
actgcaacaaggtgtcagctgatgg

SEQ ID NO: 183396 - DNA, 25 bp, Mus musculus
actgcaacagctttttctaaaagcc

SEQ ID NO: 183397 - DNA, 25 bp, Mus musculus
actgcaacatacaggttaccaaagt

SEQ ID NO: 183398 - DNA, 25 bp, Mus musculus
actgcaacccatgagcatccaggtg

SEQ ID NO: 183399 - DNA, 25 bp, Mus musculus
actgcaactgacaagatttagcctt

SEQ ID NO: 183400 - DNA, 25 bp, Mus musculus
actgcaactgacaaggtattcatgc

SEQ ID NO: 183401 - DNA, 25 bp, Mus musculus
actgcaagagcagtttgacaactta

SEQ ID NO: 183402 - DNA, 25 bp, Mus musculus
actgcaagagctttctatccaagga

SEQ ID NO: 183403 - DNA, 25 bp, Mus musculus
actgcaaggattccagccccagtct

SEQ ID NO: 183404 - DNA, 25 bp, Mus musculus
actgcaaggttcctgccgctaacgt

SEQ ID NO: 183405 - DNA, 25 bp, Mus musculus
actgcaagtataggacaacctcaag

SEQ ID NO: 183406 - DNA, 25 bp, Mus musculus
actgcaatatgactgaaacggcatg

SEQ ID NO: 183407 - DNA, 25 bp, Mus musculus
actgcaatatgactgcccgaagcct

SEQ ID NO: 183408 - DNA, 25 bp, Mus musculus
actgcaatcttaacaattcaggcca

SEQ ID NO: 183409 - DNA, 25 bp, Mus musculus
actgcaattgccaaggcaggtgcag

SEQ ID NO: 183410 - DNA, 25 bp, Mus musculus
actgcacaaacagagcagctctggc

SEQ ID NO: 183411 - DNA, 25 bp, Mus musculus
actgcacaagcaagagtaaaaagaa

SEQ ID NO: 183412 - DNA, 25 bp, Mus musculus
actgcacaattgagggttgccccgg

SEQ ID NO: 183413 - DNA, 25 bp, Mus musculus
actgcacaattgctcactatttgga

SEQ ID NO: 183414 - DNA, 25 bp, Mus musculus
actgcacacacacacggattgagtc

SEQ ID NO: 183415 - DNA, 25 bp, Mus musculus
actgcacacacacagggattgagtc

SEQ ID NO: 183416 - DNA, 25 bp, Mus musculus
actgcacagacgagctgttcaagga

SEQ ID NO: 183417 - DNA, 25 bp, Mus musculus
actgcacagagatcccaagtgtcct

SEQ ID NO: 183418 - DNA, 25 bp, Mus musculus
actgcacagaggggctctttagagc

SEQ ID NO: 183419 - DNA, 25 bp, Mus musculus
actgcacagcgaccagcagccagtt

SEQ ID NO: 183420 - DNA, 25 bp, Mus musculus
actgcacagttatggtgtgggagat

SEQ ID NO: 183421 - DNA, 25 bp, Mus musculus
actgcaccatcgagggctgtcctgg

SEQ ID NO: 183422 - DNA, 25 bp, Mus musculus
actgcaccatcgctcactatctgga

SEQ ID NO: 183423 - DNA, 25 bp, Mus musculus
actgcaccttcagcagagcacacaa

SEQ ID NO: 183424 - DNA, 25 bp, Mus musculus
actgcaccttcaggacgccgaggca

SEQ ID NO: 183425 - DNA, 25 bp, Mus musculus
actgcacgcagaaagatgacaggaa

SEQ ID NO: 183426 - DNA, 25 bp, Mus musculus
actgcacggtgaagatctggaacaa

SEQ ID NO: 183427 - DNA, 25 bp, Mus musculus
actgcactgccagcacggggtctgg

SEQ ID NO: 183428 - DNA, 25 bp, Mus musculus
actgcactgctccatgctggcagaa

SEQ ID NO: 183429 - DNA, 25 bp, Mus musculus
actgcactgtcagagagtggggaca

SEQ ID NO: 183430 - DNA, 25 bp, Mus musculus
actgcactgtcagcagcattccttg

SEQ ID NO: 183431 - DNA, 25 bp, Mus musculus
actgcacttgtggtttgctatcttc

SEQ ID NO: 183432 - DNA, 25 bp, Mus musculus
actgcagaacggatcgagcgtttgg

SEQ ID NO: 183433 - DNA, 25 bp, Mus musculus
actgcagaacttgcggtcttagagc

SEQ ID NO: 183434 - DNA, 25 bp, Mus musculus
actgcagaaggctctgaaggacctg

SEQ ID NO: 183435 - DNA, 25 bp, Mus musculus
actgcagaagggagaactttctgga

SEQ ID NO: 183436 - DNA, 25 bp, Mus musculus
actgcagaaggtgctgatggaatgg

SEQ ID NO: 183437 - DNA, 25 bp, Mus musculus
actgcagaatgacagatttgaccag

SEQ ID NO: 183438 - DNA, 25 bp, Mus musculus
actgcagaatgtttaccgagagaaa

SEQ ID NO: 183439 - DNA, 25 bp, Mus musculus
actgcagactcacgcccactggaag

SEQ ID NO: 183440 - DNA, 25 bp, Mus musculus
actgcagactgccgaatacaccaag

SEQ ID NO: 183441 - DNA, 25 bp, Mus musculus
actgcagactggcatccgtctcttg

SEQ ID NO: 183442 - DNA, 25 bp, Mus musculus
actgcagagaaagagggggcccgcc

SEQ ID NO: 183443 - DNA, 25 bp, Mus musculus
actgcagagaaatgtgatttgttca

SEQ ID NO: 183444 - DNA, 25 bp, Mus musculus
actgcagagagatgactggtctggt

SEQ ID NO: 183445 - DNA, 25 bp, Mus musculus
actgcagagagatgagcatccagct

SEQ ID NO: 183446 - DNA, 25 bp, Mus musculus
actgcagagaggctggcctccacat

SEQ ID NO: 183447 - DNA, 25 bp, Mus musculus
actgcagaggaggagggtggacgga

SEQ ID NO: 183448 - DNA, 25 bp, Mus musculus
actgcagaggaggtgttactagtac

SEQ ID NO: 183449 - DNA, 25 bp, Mus musculus
actgcagagtaatgctccaagtatg

SEQ ID NO: 183450 - DNA, 25 bp, Mus musculus
actgcagatgacctcctcctgggga

SEQ ID NO: 183451 - DNA, 25 bp, Mus musculus
actgcagcacaggttctgattcggt

SEQ ID NO: 183452 - DNA, 25 bp, Mus musculus
actgcagcactgcaggagcctgtga

SEQ ID NO: 183453 - DNA, 25 bp, Mus musculus
actgcagcagcttcaaactgttcca

SEQ ID NO: 183454 - DNA, 25 bp, Mus musculus
actgcagcaggagtgtgataattac

SEQ ID NO: 183455 - DNA, 25 bp, Mus musculus
actgcagcaggcaccagagtttttc

SEQ ID NO: 183456 - DNA, 25 bp, Mus musculus
actgcagcaggggccctccctgacc

SEQ ID NO: 183457 - DNA, 25 bp, Mus musculus
actgcagcattcaggtcaaggaagc

SEQ ID NO: 183458 - DNA, 25 bp, Mus musculus
actgcagccaaagggtggataccct

SEQ ID NO: 183459 - DNA, 25 bp, Mus musculus
actgcagcctaaatggcaaaatgtc

SEQ ID NO: 183460 - DNA, 25 bp, Mus musculus
actgcagcctcttttatgaaacaga

SEQ ID NO: 183461 - DNA, 25 bp, Mus musculus
actgcagcgagctcgcgagtacaac

SEQ ID NO: 183462 - DNA, 25 bp, Mus musculus
actgcagcgctccggaccctggctg

SEQ ID NO: 183463 - DNA, 25 bp, Mus musculus
actgcagctgccatgactcagtcgg

SEQ ID NO: 183464 - DNA, 25 bp, Mus musculus
actgcagctgccatgggaattcctc

SEQ ID NO: 183465 - DNA, 25 bp, Mus musculus
actgcagcttcaggatttctaccac

SEQ ID NO: 183466 - DNA, 25 bp, Mus musculus
actgcaggaagaaagtctgcaccaa

SEQ ID NO: 183467 - DNA, 25 bp, Mus musculus
actgcaggaagcttgggatccgctg

SEQ ID NO: 183468 - DNA, 25 bp, Mus musculus
actgcaggacaggaggattacaacc

SEQ ID NO: 183469 - DNA, 25 bp, Mus musculus
actgcaggaggtctccaggtggtcc

SEQ ID NO: 183470 - DNA, 25 bp, Mus musculus
actgcaggcagggaggtgtgagcat

SEQ ID NO: 183471 - DNA, 25 bp, Mus musculus
actgcaggcatccagggccttttgc

SEQ ID NO: 183472 - DNA, 25 bp, Mus musculus
actgcaggctcaagaaatagccaga

SEQ ID NO: 183473 - DNA, 25 bp, Mus musculus
actgcagtgaccaacattgatcgcc

SEQ ID NO: 183474 - DNA, 25 bp, Mus musculus
actgcagtgaccaccattcctgcgc

SEQ ID NO: 183475 - DNA, 25 bp, Mus musculus
actgcagtggagttgtttaagaatg

SEQ ID NO: 183476 - DNA, 25 bp, Mus musculus
actgcagttgcagctctaagaacag

SEQ ID NO: 183477 - DNA, 25 bp, Mus musculus
actgcagttgcaggtttcttcgggt

SEQ ID NO: 183478 - DNA, 25 bp, Mus musculus
actgcatacacaggaaagggctgtg

SEQ ID NO: 183479 - DNA, 25 bp, Mus musculus
actgcataccgacaacatctgggga

SEQ ID NO: 183480 - DNA, 25 bp, Mus musculus
actgcatagctctgtggagcgaccc

SEQ ID NO: 183481 - DNA, 25 bp, Mus musculus
actgcatcaacacaaacttgaccta

SEQ ID NO: 183482 - DNA, 25 bp, Mus musculus
actgcatcagcagtgatgatctttt

SEQ ID NO: 183483 - DNA, 25 bp, Mus musculus
actgcatcaggctcactctttgggt

SEQ ID NO: 183484 - DNA, 25 bp, Mus musculus
actgcatcagtgaacggctctttat

SEQ ID NO: 183485 - DNA, 25 bp, Mus musculus
actgcatcgcccttgactacaagtc

SEQ ID NO: 183486 - DNA, 25 bp, Mus musculus
actgcatgacactaaacatggagtg

SEQ ID NO: 183487 - DNA, 25 bp, Mus musculus
actgcatgtgacctctctatcacgg

SEQ ID NO: 183488 - DNA, 25 bp, Mus musculus
actgcattacaagcccacagagcag

SEQ ID NO: 183489 - DNA, 25 bp, Mus musculus
actgcattacaagccttcccgctcc

SEQ ID NO: 183490 - DNA, 25 bp, Mus musculus
actgcattatctggtgaccatctcg

SEQ ID NO: 183491 - DNA, 25 bp, Mus musculus
actgcattcaggacaggggtccgaa

SEQ ID NO: 183492 - DNA, 25 bp, Mus musculus
actgcatttggtggagtgtgacaat

SEQ ID NO: 183493 - DNA, 25 bp, Mus musculus
actgcattttaggagtgcatgcggg

SEQ ID NO: 183494 - DNA, 25 bp, Mus musculus
actgccaaaacgaaaacagatacaa

SEQ ID NO: 183495 - DNA, 25 bp, Mus musculus
actgccaaaggtcttttccgggctg

SEQ ID NO: 183496 - DNA, 25 bp, Mus musculus
actgccaaagtgaagccgaagaagc

SEQ ID NO: 183497 - DNA, 25 bp, Mus musculus
actgccaaatcaacatcaacgattg

SEQ ID NO: 183498 - DNA, 25 bp, Mus musculus
actgccaacagatctacacacaatg

SEQ ID NO: 183499 - DNA, 25 bp, Mus musculus
actgccaacagggtgcatcgctttc

SEQ ID NO: 183500 - DNA, 25 bp, Mus musculus
actgccaagaccaggaacagcctca

SEQ ID NO: 183501 - DNA, 25 bp, Mus musculus
actgccaagaccagtgaggtctggt

SEQ ID NO: 183502 - DNA, 25 bp, Mus musculus
actgccaagagtctgacagcaaata

SEQ ID NO: 183503 - DNA, 25 bp, Mus musculus
actgccaagcaataaaattcatata

SEQ ID NO: 183504 - DNA, 25 bp, Mus musculus
actgccaaggaggagaagtataaag

SEQ ID NO: 183505 - DNA, 25 bp, Mus musculus
actgccaattatacaactgctgaca

SEQ ID NO: 183506 - DNA, 25 bp, Mus musculus
actgccacagtggttccggaagcct

SEQ ID NO: 183507 - DNA, 25 bp, Mus musculus
actgccacatgctgctggggccacc

SEQ ID NO: 183508 - DNA, 25 bp, Mus musculus
actgccaccaccaggaacttcctgt

SEQ ID NO: 183509 - DNA, 25 bp, Mus musculus
actgccaccgcgttcacattctcta

SEQ ID NO: 183510 - DNA, 25 bp, Mus musculus
actgccaccgctcacgaagttggga

SEQ ID NO: 183511 - DNA, 25 bp, Mus musculus
actgccacggcctcctcagcagccg

SEQ ID NO: 183512 - DNA, 25 bp, Mus musculus
actgccacggtcatctctcatggat

SEQ ID NO: 183513 - DNA, 25 bp, Mus musculus
actgccactcagcttgatactcatg

SEQ ID NO: 183514 - DNA, 25 bp, Mus musculus
actgccagaaacagcatgccagaat

SEQ ID NO: 183515 - DNA, 25 bp, Mus musculus
actgccagagggtaacatctgccgg

SEQ ID NO: 183516 - DNA, 25 bp, Mus musculus
actgccagagggttgcatctgatgc

SEQ ID NO: 183517 - DNA, 25 bp, Mus musculus
actgccagcaatgaggtaccatggt

SEQ ID NO: 183518 - DNA, 25 bp, Mus musculus
actgccagcaatgaggtggctcaca

SEQ ID NO: 183519 - DNA, 25 bp, Mus musculus
actgccaggagaatcccagtgagta

SEQ ID NO: 183520 - DNA, 25 bp, Mus musculus
actgccaggtgtggcgctaatgtgc

SEQ ID NO: 183521 - DNA, 25 bp, Mus musculus
actgccagtagggggtacagtcctc

SEQ ID NO: 183522 - DNA, 25 bp, Mus musculus
actgccagtgggatcccactaaatt

SEQ ID NO: 183523 - DNA, 25 bp, Mus musculus
actgccagtgggatcgctgttgtgg

SEQ ID NO: 183524 - DNA, 25 bp, Mus musculus
actgccataatgacaagtaccaggt

SEQ ID NO: 183525 - DNA, 25 bp, Mus musculus
actgccatatttagattataaaaaa

SEQ ID NO: 183526 - DNA, 25 bp, Mus musculus
actgccatatttagcattcccgtca

SEQ ID NO: 183527 - DNA, 25 bp, Mus musculus
actgccatcaaggcccctaacagct

SEQ ID NO: 183528 - DNA, 25 bp, Mus musculus
actgccatctacaggctgtttgatt

SEQ ID NO: 183529 - DNA, 25 bp, Mus musculus
actgccatctacagtggctacagct

SEQ ID NO: 183530 - DNA, 25 bp, Mus musculus
actgccatgactatctacggagaag

SEQ ID NO: 183531 - DNA, 25 bp, Mus musculus
actgccatgactttctacggagaag

SEQ ID NO: 183532 - DNA, 25 bp, Mus musculus
actgccatgagagctgtttgacaac

SEQ ID NO: 183533 - DNA, 25 bp, Mus musculus
actgccatgcagtgagctgctggtg

SEQ ID NO: 183534 - DNA, 25 bp, Mus musculus
actgccatgcgcagtacaacccgga

SEQ ID NO: 183535 - DNA, 25 bp, Mus musculus
actgccatgcttcctctaacagcag

SEQ ID NO: 183536 - DNA, 25 bp, Mus musculus
actgccatgtcagccagtataatgt

SEQ ID NO: 183537 - DNA, 25 bp, Mus musculus
actgccatgtcccagtatgaggttt

SEQ ID NO: 183538 - DNA, 25 bp, Mus musculus
actgccattgaagctgaagaagatg

SEQ ID NO: 183539 - DNA, 25 bp, Mus musculus
actgcccaagaagcgtgggaccttc

SEQ ID NO: 183540 - DNA, 25 bp, Mus musculus
actgcccaagtgggctcacccgaga

SEQ ID NO: 183541 - DNA, 25 bp, Mus musculus
actgcccaccaggattctcagtcct

SEQ ID NO: 183542 - DNA, 25 bp, Mus musculus
actgcccacctacaggatgtcaatc

SEQ ID NO: 183543 - DNA, 25 bp, Mus musculus
actgcccagattttcactgtaactt

SEQ ID NO: 183544 - DNA, 25 bp, Mus musculus
actgccccaaggctgacttccccac

SEQ ID NO: 183545 - DNA, 25 bp, Mus musculus
actgccccaaggtgaagaactgatt

SEQ ID NO: 183546 - DNA, 25 bp, Mus musculus
actgccccaggaaagggtcacgaag

SEQ ID NO: 183547 - DNA, 25 bp, Mus musculus
actgccccatccagaggccatggac

SEQ ID NO: 183548 - DNA, 25 bp, Mus musculus
actgccccggccagctgactgctgt

SEQ ID NO: 183549 - DNA, 25 bp, Mus musculus
actgcccgacttgggcaggtaaacc

SEQ ID NO: 183550 - DNA, 25 bp, Mus musculus
actgcccggagcgagacactttcct

SEQ ID NO: 183551 - DNA, 25 bp, Mus musculus
actgcccggagcgaggtagcaaaca

SEQ ID NO: 183552 - DNA, 25 bp, Mus musculus
actgcccgttttagcttggctgaag

SEQ ID NO: 183553 - DNA, 25 bp, Mus musculus
actgccctaagaggttatcaagaaa

SEQ ID NO: 183554 - DNA, 25 bp, Mus musculus
actgccctccacagagttccccaca

SEQ ID NO: 183555 - DNA, 25 bp, Mus musculus
actgccctccacagcccctacttcc

SEQ ID NO: 183556 - DNA, 25 bp, Mus musculus
actgccctccacaggagcaggcgag

SEQ ID NO: 183557 - DNA, 25 bp, Mus musculus
actgcccttccgagctatccgggtg

SEQ ID NO: 183558 - DNA, 25 bp, Mus musculus
actgcccttccgaggaagtctgccg

SEQ ID NO: 183559 - DNA, 25 bp, Mus musculus
actgcccttggctctggtcagggtg

SEQ ID NO: 183560 - DNA, 25 bp, Mus musculus
actgccgaaacccagatgaggaata

SEQ ID NO: 183561 - DNA, 25 bp, Mus musculus
actgccgcagacagagtgccctggg

SEQ ID NO: 183562 - DNA, 25 bp, Mus musculus
actgccgccccaacccgtgtcacaa

SEQ ID NO: 183563 - DNA, 25 bp, Mus musculus
actgccggctgggctgctgattcac

SEQ ID NO: 183564 - DNA, 25 bp, Mus musculus
actgccgtaccagagccattcatca

SEQ ID NO: 183565 - DNA, 25 bp, Mus musculus
actgccgtaccagggacattcttct

SEQ ID NO: 183566 - DNA, 25 bp, Mus musculus
actgccgtatcaacattgatgagtg

SEQ ID NO: 183567 - DNA, 25 bp, Mus musculus
actgccgtgttagatgagaaccaca

SEQ ID NO: 183568 - DNA, 25 bp, Mus musculus
actgccgtgttagtccctataaccg

SEQ ID NO: 183569 - DNA, 25 bp, Mus musculus
actgcctaacaagtggtggaccaag

SEQ ID NO: 183570 - DNA, 25 bp, Mus musculus
actgcctagtgagtttacaggctgg

SEQ ID NO: 183571 - DNA, 25 bp, Mus musculus
actgcctcagaggtggaagaagaga

SEQ ID NO: 183572 - DNA, 25 bp, Mus musculus
actgcctccaggtctggagagctgt

SEQ ID NO: 183573 - DNA, 25 bp, Mus musculus
actgcctcctttcaggatgctgtgc

SEQ ID NO: 183574 - DNA, 25 bp, Mus musculus
actgcctcgcaaagagttataccct

SEQ ID NO: 183575 - DNA, 25 bp, Mus musculus
actgcctcgtcatctgggagggcat

SEQ ID NO: 183576 - DNA, 25 bp, Mus musculus
actgcctcgtcatgcacaccaagat

SEQ ID NO: 183577 - DNA, 25 bp, Mus musculus
actgcctgacagctggctgaaggga

SEQ ID NO: 183578 - DNA, 25 bp, Mus musculus
actgcctgataaatacaacaccaga

SEQ ID NO: 183579 - DNA, 25 bp, Mus musculus
actgcctgatgttgtccaggaagcg

SEQ ID NO: 183580 - DNA, 25 bp, Mus musculus
actgcctgcagtggatacattgttg

SEQ ID NO: 183581 - DNA, 25 bp, Mus musculus
actgcctgccaggattttaccggaa

SEQ ID NO: 183582 - DNA, 25 bp, Mus musculus
actgcctggccacttcagcatatag

SEQ ID NO: 183583 - DNA, 25 bp, Mus musculus
actgcctggccagttcagcatatag

SEQ ID NO: 183584 - DNA, 25 bp, Mus musculus
actgcctggcccggaagatgcaagc

SEQ ID NO: 183585 - DNA, 25 bp, Mus musculus
actgcctggcccggtcacagcaaac

SEQ ID NO: 183586 - DNA, 25 bp, Mus musculus
actgcctggctaagagggaaggctc

SEQ ID NO: 183587 - DNA, 25 bp, Mus musculus
actgcctgtgaacacttggatgaat

SEQ ID NO: 183588 - DNA, 25 bp, Mus musculus
actgcctgtgaagacttggatgaat

SEQ ID NO: 183589 - DNA, 25 bp, Mus musculus
actgccttaagaaagaatgggaaac

SEQ ID NO: 183590 - DNA, 25 bp, Mus musculus
actgccttacagacgtggctctttg

SEQ ID NO: 183591 - DNA, 25 bp, Mus musculus
actgccttacccatatctgtcagga

SEQ ID NO: 183592 - DNA, 25 bp, Mus musculus
actgccttcaggacgaatgctacaa

SEQ ID NO: 183593 - DNA, 25 bp, Mus musculus
actgcgacccccagcccagtaggca

SEQ ID NO: 183594 - DNA, 25 bp, Mus musculus
actgcgacttggataagaaaacttc

SEQ ID NO: 183595 - DNA, 25 bp, Mus musculus
actgcgacttgggcttcctgtatcc

SEQ ID NO: 183596 - DNA, 25 bp, Mus musculus
actgcgagcccgcatggattccagg

SEQ ID NO: 183597 - DNA, 25 bp, Mus musculus
actgcgagcgagaagatgtttggca

SEQ ID NO: 183598 - DNA, 25 bp, Mus musculus
actgcgagcgagactatgagaagat

SEQ ID NO: 183599 - DNA, 25 bp, Mus musculus
actgcgaggggaagattgcatctgg

SEQ ID NO: 183600 - DNA, 25 bp, Mus musculus
actgcgaggggaaggtgaagtattt

SEQ ID NO: 183601 - DNA, 25 bp, Mus musculus
actgcgccacaggaaagcactgcca

SEQ ID NO: 183602 - DNA, 25 bp, Mus musculus
actgcgccatctctgtctgccccac

SEQ ID NO: 183603 - DNA, 25 bp, Mus musculus
actgcgctccaggtgccacatcatc

SEQ ID NO: 183604 - DNA, 25 bp, Mus musculus
actgcggaaactgaaacctttgtca

SEQ ID NO: 183605 - DNA, 25 bp, Mus musculus
actgcggagctcggaattagctgaa

SEQ ID NO: 183606 - DNA, 25 bp, Mus musculus
actgcggaggggtgggaggctgccg

SEQ ID NO: 183607 - DNA, 25 bp, Mus musculus
actgcggatggagaatatattcctc

SEQ ID NO: 183608 - DNA, 25 bp, Mus musculus
actgcggattcggagcattcttgaa

SEQ ID NO: 183609 - DNA, 25 bp, Mus musculus
actgcggattcggatggattccaaa

SEQ ID NO: 183610 - DNA, 25 bp, Mus musculus
actgcggcaaagaggcattctggaa

SEQ ID NO: 183611 - DNA, 25 bp, Mus musculus
actgcggcaagtttgatggtgacag

SEQ ID NO: 183612 - DNA, 25 bp, Mus musculus
actgcggcaccatggcaaccgaaga

SEQ ID NO: 183613 - DNA, 25 bp, Mus musculus
actgcgggaccaggatgggctcagg

SEQ ID NO: 183614 - DNA, 25 bp, Mus musculus
actgcgggcccagttgctgatagcc

SEQ ID NO: 183615 - DNA, 25 bp, Mus musculus
actgcgtcaagacccggatgcagag

SEQ ID NO: 183616 - DNA, 25 bp, Mus musculus
actgcgtcaaggtgcagccggatgt

SEQ ID NO: 183617 - DNA, 25 bp, Mus musculus
actgcgtcccgagggaaatggagca

SEQ ID NO: 183618 - DNA, 25 bp, Mus musculus
actgcgtgctcatggaaacttcggg

SEQ ID NO: 183619 - DNA, 25 bp, Mus musculus
actgcgtgctcatggggtacgtgtg

SEQ ID NO: 183620 - DNA, 25 bp, Mus musculus
actgctaaagggagaaaagacatgc

SEQ ID NO: 183621 - DNA, 25 bp, Mus musculus
actgctaactctaaactgcgaggcc

SEQ ID NO: 183622 - DNA, 25 bp, Mus musculus
actgctaactctagcatatgaaact

SEQ ID NO: 183623 - DNA, 25 bp, Mus musculus
actgctaatgagactcagtccgcta

SEQ ID NO: 183624 - DNA, 25 bp, Mus musculus
actgctacaggaggaaccccctcca

SEQ ID NO: 183625 - DNA, 25 bp, Mus musculus
actgctaccactcaggctctcgcct

SEQ ID NO: 183626 - DNA, 25 bp, Mus musculus
actgctacccaagcagggtggccac

SEQ ID NO: 183627 - DNA, 25 bp, Mus musculus
actgctaccgccatcttagaactgg

SEQ ID NO: 183628 - DNA, 25 bp, Mus musculus
actgctaccgctgtggcaatgtggc

SEQ ID NO: 183629 - DNA, 25 bp, Mus musculus
actgctacgacaggtacctgtgtcg

SEQ ID NO: 183630 - DNA, 25 bp, Mus musculus
actgctacgataggtacctgtgtcg

SEQ ID NO: 183631 - DNA, 25 bp, Mus musculus
actgctagataaggtcctggagacc

SEQ ID NO: 183632 - DNA, 25 bp, Mus musculus
actgctagataaggtcctggaggag

SEQ ID NO: 183633 - DNA, 25 bp, Mus musculus
actgctataggatacaaattggaag

SEQ ID NO: 183634 - DNA, 25 bp, Mus musculus
actgctataggttgatcagatccac

SEQ ID NO: 183635 - DNA, 25 bp, Mus musculus
actgctatgcaaaagttatgatggt

SEQ ID NO: 183636 - DNA, 25 bp, Mus musculus
actgctatggagcggaattcctaag

SEQ ID NO: 183637 - DNA, 25 bp, Mus musculus
actgctatggcaaccagtataatgt

SEQ ID NO: 183638 - DNA, 25 bp, Mus musculus
actgctatggcaatgacaccagcca

SEQ ID NO: 183639 - DNA, 25 bp, Mus musculus
actgctatgggtttcagtccccaag

SEQ ID NO: 183640 - DNA, 25 bp, Mus musculus
actgctatgtcgaccagtatgaggt

SEQ ID NO: 183641 - DNA, 25 bp, Mus musculus
actgctattatcatagaccttcagg

SEQ ID NO: 183642 - DNA, 25 bp, Mus musculus
actgctattatcatgatactaccac

SEQ ID NO: 183643 - DNA, 25 bp, Mus musculus
actgctcaaacaagtgtgatgctct

SEQ ID NO: 183644 - DNA, 25 bp, Mus musculus
actgctcaatagtgaaattccacaa

SEQ ID NO: 183645 - DNA, 25 bp, Mus musculus
actgctcaatccatcgagacacaga

SEQ ID NO: 183646 - DNA, 25 bp, Mus musculus
actgctcacagagtcagtccgaccg

SEQ ID NO: 183647 - DNA, 25 bp, Mus musculus
actgctcagacagccgtgcttatgg

SEQ ID NO: 183648 - DNA, 25 bp, Mus musculus
actgctcaggaacagccccacagca

SEQ ID NO: 183649 - DNA, 25 bp, Mus musculus
actgctcaggaacagtatcatcaac

SEQ ID NO: 183650 - DNA, 25 bp, Mus musculus
actgctcatgggggcacctatgagg

SEQ ID NO: 183651 - DNA, 25 bp, Mus musculus
actgctcatttatgataattagcac

SEQ ID NO: 183652 - DNA, 25 bp, Mus musculus
actgctccacttctatcagcaatcc

SEQ ID NO: 183653 - DNA, 25 bp, Mus musculus
actgctccagcggctgtgacagcga

SEQ ID NO: 183654 - DNA, 25 bp, Mus musculus
actgctccagggaaaatagagaaag

SEQ ID NO: 183655 - DNA, 25 bp, Mus musculus
actgctccagggatccagaaggagc

SEQ ID NO: 183656 - DNA, 25 bp, Mus musculus
actgctccaggtcctggaggccaca

SEQ ID NO: 183657 - DNA, 25 bp, Mus musculus
actgctcccgtttgagcccggttcc

SEQ ID NO: 183658 - DNA, 25 bp, Mus musculus
actgctccgacaatatgcacctatt

SEQ ID NO: 183659 - DNA, 25 bp, Mus musculus
actgctccgacaatgtagatttaga

SEQ ID NO: 183660 - DNA, 25 bp, Mus musculus
actgctccgagctcacaggaaggag

SEQ ID NO: 183661 - DNA, 25 bp, Mus musculus
actgctccgaggcatgtcccccagg

SEQ ID NO: 183662 - DNA, 25 bp, Mus musculus
actgctcctggtgcatggaggactg

SEQ ID NO: 183663 - DNA, 25 bp, Mus musculus
actgctcgtaccaggcacagaagaa

SEQ ID NO: 183664 - DNA, 25 bp, Mus musculus
actgctctaccagtccttcgtgaag

SEQ ID NO: 183665 - DNA, 25 bp, Mus musculus
actgctctatcgaggctacatgaag

SEQ ID NO: 183666 - DNA, 25 bp, Mus musculus
actgctctcaaaggtcttcctgcag

SEQ ID NO: 183667 - DNA, 25 bp, Mus musculus
actgctctcaatgcaggtcaatggc

SEQ ID NO: 183668 - DNA, 25 bp, Mus musculus
actgctgaagacgtgactgcgcccc

SEQ ID NO: 183669 - DNA, 25 bp, Mus musculus
actgctgaagttagacacaccagaa

SEQ ID NO: 183670 - DNA, 25 bp, Mus musculus
actgctgacagaaatcttaaaaagg

SEQ ID NO: 183671 - DNA, 25 bp, Mus musculus
actgctgacaggcaccacacagtca

SEQ ID NO: 183672 - DNA, 25 bp, Mus musculus
actgctgactggttgcccattggac

SEQ ID NO: 183673 - DNA, 25 bp, Mus musculus
actgctgaggcggacaaatcagcag

SEQ ID NO: 183674 - DNA, 25 bp, Mus musculus
actgctgatggagcatctgggtggt

SEQ ID NO: 183675 - DNA, 25 bp, Mus musculus
actgctgatggagctatatacgcca

SEQ ID NO: 183676 - DNA, 25 bp, Mus musculus
actgctgcaacaccagcacagtggc

SEQ ID NO: 183677 - DNA, 25 bp, Mus musculus
actgctgcagcagagagccagccat

SEQ ID NO: 183678 - DNA, 25 bp, Mus musculus
actgctgcatgcagaacccttacca

SEQ ID NO: 183679 - DNA, 25 bp, Mus musculus
actgctgcatgcagctggtgcagaa

SEQ ID NO: 183680 - DNA, 25 bp, Mus musculus
actgctgccaggtggagagagccag

SEQ ID NO: 183681 - DNA, 25 bp, Mus musculus
actgctgcccacagagaggtgacag

SEQ ID NO: 183682 - DNA, 25 bp, Mus musculus
actgctgcccacaggaaataacagt

SEQ ID NO: 183683 - DNA, 25 bp, Mus musculus
actgctgccgttaggctactacatg

SEQ ID NO: 183684 - DNA, 25 bp, Mus musculus
actgctgcctcaggtacaactgatg

SEQ ID NO: 183685 - DNA, 25 bp, Mus musculus
actgctgctcagaaggctcaggagg

SEQ ID NO: 183686 - DNA, 25 bp, Mus musculus
actgctgctcctccgttccctgcct

SEQ ID NO: 183687 - DNA, 25 bp, Mus musculus
actgctgctctggcaaggccagacc

SEQ ID NO: 183688 - DNA, 25 bp, Mus musculus
actgctgctctgggtaaccaaggct

SEQ ID NO: 183689 - DNA, 25 bp, Mus musculus
actgctgctgaaagaaattagccga

SEQ ID NO: 183690 - DNA, 25 bp, Mus musculus
actgctgctgaatttgaagtcctga

SEQ ID NO: 183691 - DNA, 25 bp, Mus musculus
actgctgcttctggatttatttatt

SEQ ID NO: 183692 - DNA, 25 bp, Mus musculus
actgctgcttctggctggccggcct

SEQ ID NO: 183693 - DNA, 25 bp, Mus musculus
actgctgcttctgggtgccggtgaa

SEQ ID NO: 183694 - DNA, 25 bp, Mus musculus
actgctgctttggctaccgctgctt

SEQ ID NO: 183695 - DNA, 25 bp, Mus musculus
actgctggagggctgcagtatggcg

SEQ ID NO: 183696 - DNA, 25 bp, Mus musculus
actgctggagtccatcctgatggag

SEQ ID NO: 183697 - DNA, 25 bp, Mus musculus
actgctggagtccatgtttactgtc

SEQ ID NO: 183698 - DNA, 25 bp, Mus musculus
actgctggatgatcctagcaaacag

SEQ ID NO: 183699 - DNA, 25 bp, Mus musculus
actgctggatgatgaagttctcatc

SEQ ID NO: 183700 - DNA, 25 bp, Mus musculus
actgctgggcagctccagatgaaaa

SEQ ID NO: 183701 - DNA, 25 bp, Mus musculus
actgctggtcagagaattgaccttg

SEQ ID NO: 183702 - DNA, 25 bp, Mus musculus
actgctggtcagctctgcaatctga

SEQ ID NO: 183703 - DNA, 25 bp, Mus musculus
actgctggtcaggcagagttcacgg

SEQ ID NO: 183704 - DNA, 25 bp, Mus musculus
actgctgtacggtagcagatatcaa

SEQ ID NO: 183705 - DNA, 25 bp, Mus musculus
actgctgtacgtgagtcagccggca

SEQ ID NO: 183706 - DNA, 25 bp, Mus musculus
actgctgtaggtctgaccacccgga

SEQ ID NO: 183707 - DNA, 25 bp, Mus musculus
actgctgtcaatgggagccggtgaa

SEQ ID NO: 183708 - DNA, 25 bp, Mus musculus
actgctgtcctagggacaaagtata

SEQ ID NO: 183709 - DNA, 25 bp, Mus musculus
actgctgtcctaggggctcaaggaa

SEQ ID NO: 183710 - DNA, 25 bp, Mus musculus
actgctgtctccaggtgacattcca

SEQ ID NO: 183711 - DNA, 25 bp, Mus musculus
actgctgtgagtgcccgctatggac

SEQ ID NO: 183712 - DNA, 25 bp, Mus musculus
actgcttaaacaaggtgattctgct

SEQ ID NO: 183713 - DNA, 25 bp, Mus musculus
actgcttaagagaaggtgttaggag

SEQ ID NO: 183714 - DNA, 25 bp, Mus musculus
actgcttaagagggttcagtaacac

SEQ ID NO: 183715 - DNA, 25 bp, Mus musculus
actgcttcaacttctcttgcaggta

SEQ ID NO: 183716 - DNA, 25 bp, Mus musculus
actgcttcaccaccacctccaaaga

SEQ ID NO: 183717 - DNA, 25 bp, Mus musculus
actgcttcagggagacacacctgca

SEQ ID NO: 183718 - DNA, 25 bp, Mus musculus
actgcttccccagagaacacagcag

SEQ ID NO: 183719 - DNA, 25 bp, Mus musculus
actgcttccctgtgctggtccacag

SEQ ID NO: 183720 - DNA, 25 bp, Mus musculus
actgcttccctgtggtattattcag

SEQ ID NO: 183721 - DNA, 25 bp, Mus musculus
actgcttccggtgtggagaagacag

SEQ ID NO: 183722 - DNA, 25 bp, Mus musculus
actgcttcctcaagctggcagcagt

SEQ ID NO: 183723 - DNA, 25 bp, Mus musculus
actgcttctaagactctgaattcgg

SEQ ID NO: 183724 - DNA, 25 bp, Mus musculus
actgcttctctgggtctgtgaactc

SEQ ID NO: 183725 - DNA, 25 bp, Mus musculus
actgcttctgtatcaagatattatc

SEQ ID NO: 183726 - DNA, 25 bp, Mus musculus
actgcttgagtccaggttcacattg

SEQ ID NO: 183727 - DNA, 25 bp, Mus musculus
actgcttggaaggctgcccaccaag

SEQ ID NO: 183728 - DNA, 25 bp, Mus musculus
actgcttgtataagctggaaaacag

SEQ ID NO: 183729 - DNA, 25 bp, Mus musculus
actgctttaaacctaaacagaatat

SEQ ID NO: 183730 - DNA, 25 bp, Mus musculus
actgctttaaacgacctgatctctg

SEQ ID NO: 183731 - DNA, 25 bp, Mus musculus
actgctttaaacgtcgattgagtga

SEQ ID NO: 183732 - DNA, 25 bp, Mus musculus
actgctttaccagaccatagaatcc

SEQ ID NO: 183733 - DNA, 25 bp, Mus musculus
actgctttaccagagcaaggcttag

SEQ ID NO: 183734 - DNA, 25 bp, Mus musculus
actgctttctatccctgtgcacatg

SEQ ID NO: 183735 - DNA, 25 bp, Mus musculus
actgctttttaggaccttgttcctt

SEQ ID NO: 183736 - DNA, 25 bp, Mus musculus
actgctttttagtggtgatcatgtg

SEQ ID NO: 183737 - DNA, 25 bp, Mus musculus
actggaaaaaggacaggtgcagtca

SEQ ID NO: 183738 - DNA, 25 bp, Mus musculus
actggaaaaaggataggtgcggtca

SEQ ID NO: 183739 - DNA, 25 bp, Mus musculus
actggaaaacagtgaaggcccacgg

SEQ ID NO: 183740 - DNA, 25 bp, Mus musculus
actggaaaacgaagaaatgattctg

SEQ ID NO: 183741 - DNA, 25 bp, Mus musculus
actggaaaaggtgtactttgtgggt

SEQ ID NO: 183742 - DNA, 25 bp, Mus musculus
actggaaaagtcaggctattgacct

SEQ ID NO: 183743 - DNA, 25 bp, Mus musculus
actggaaaatggtggtggcttggtg

SEQ ID NO: 183744 - DNA, 25 bp, Mus musculus
actggaaacaaatgagatattctcc

SEQ ID NO: 183745 - DNA, 25 bp, Mus musculus
actggaaacaagataaaacaaaatt

SEQ ID NO: 183746 - DNA, 25 bp, Mus musculus
actggaaaggtcgaggaccaaactc

SEQ ID NO: 183747 - DNA, 25 bp, Mus musculus
actggaaagttggggttcacggctg

SEQ ID NO: 183748 - DNA, 25 bp, Mus musculus
actggaaatgtagggtaagggtcgt

SEQ ID NO: 183749 - DNA, 25 bp, Mus musculus
actggaacaacgcgggggaccttat

SEQ ID NO: 183750 - DNA, 25 bp, Mus musculus
actggaacaggaaggttcatatggg

SEQ ID NO: 183751 - DNA, 25 bp, Mus musculus
actggaacatggtgcagcccggaat

SEQ ID NO: 183752 - DNA, 25 bp, Mus musculus
actggaaccacagggagttaatgag

SEQ ID NO: 183753 - DNA, 25 bp, Mus musculus
actggaagacaccagcaccaatgga

SEQ ID NO: 183754 - DNA, 25 bp, Mus musculus
actggaagagccgcccgcacccggg

SEQ ID NO: 183755 - DNA, 25 bp, Mus musculus
actggaagagcctcagaaacacttg

SEQ ID NO: 183756 - DNA, 25 bp, Mus musculus
actggaagattcattattgaagaag

SEQ ID NO: 183757 - DNA, 25 bp, Mus musculus
actggaagcaggacaacaatcctct

SEQ ID NO: 183758 - DNA, 25 bp, Mus musculus
actggaaggcatctggcacacctct

SEQ ID NO: 183759 - DNA, 25 bp, Mus musculus
actggaaggcatctgggagggacat

SEQ ID NO: 183760 - DNA, 25 bp, Mus musculus
actggaaggtccagagaaggcaagc

SEQ ID NO: 183761 - DNA, 25 bp, Mus musculus
actggaaggtccaggacctcagaca

SEQ ID NO: 183762 - DNA, 25 bp, Mus musculus
actggaagtaaagcttgttttcagg

SEQ ID NO: 183763 - DNA, 25 bp, Mus musculus
actggaatagctacctcaggctctg

SEQ ID NO: 183764 - DNA, 25 bp, Mus musculus
actggaatcctcacagccaacgagg

SEQ ID NO: 183765 - DNA, 25 bp, Mus musculus
actggaatgaagatctttctgagac

SEQ ID NO: 183766 - DNA, 25 bp, Mus musculus
actggaatgaggccctgctccctgg

SEQ ID NO: 183767 - DNA, 25 bp, Mus musculus
actggaattacaggctgacccctgc

SEQ ID NO: 183768 - DNA, 25 bp, Mus musculus
actggacaaagaaacaacttcctgc

SEQ ID NO: 183769 - DNA, 25 bp, Mus musculus
actggacaaaggactgaggtctggc

SEQ ID NO: 183770 - DNA, 25 bp, Mus musculus
actggacaaaggatgttgggaagtc

SEQ ID NO: 183771 - DNA, 25 bp, Mus musculus
actggacaagaaggagaagatccgg

SEQ ID NO: 183772 - DNA, 25 bp, Mus musculus
actggacaaggccctgtgtgctgca

SEQ ID NO: 183773 - DNA, 25 bp, Mus musculus
actggacaagtgtcttcttggtgtg

SEQ ID NO: 183774 - DNA, 25 bp, Mus musculus
actggacacacaatgggtgatccat

SEQ ID NO: 183775 - DNA, 25 bp, Mus musculus
actggacacttaaagctgcgcaaac

SEQ ID NO: 183776 - DNA, 25 bp, Mus musculus
actggacagcaggtcatgttgggac

SEQ ID NO: 183777 - DNA, 25 bp, Mus musculus
actggacagtgctctgagaacagta

SEQ ID NO: 183778 - DNA, 25 bp, Mus musculus
actggacatcacagcatggtttatt

SEQ ID NO: 183779 - DNA, 25 bp, Mus musculus
actggacatcatccggcgcctgtct

SEQ ID NO: 183780 - DNA, 25 bp, Mus musculus
actggacatctcccaaacccaagca

SEQ ID NO: 183781 - DNA, 25 bp, Mus musculus
actggacatgattttgggcatcacc

SEQ ID NO: 183782 - DNA, 25 bp, Mus musculus
actggacatggggatcctgtgggcc

SEQ ID NO: 183783 - DNA, 25 bp, Mus musculus
actggacatgggtgaagaaggggac

SEQ ID NO: 183784 - DNA, 25 bp, Mus musculus
actggacattgatgaaactgttatt

SEQ ID NO: 183785 - DNA, 25 bp, Mus musculus
actggaccattggagggttcccagt

SEQ ID NO: 183786 - DNA, 25 bp, Mus musculus
actggacccaagggaaagcgtggag

SEQ ID NO: 183787 - DNA, 25 bp, Mus musculus
actggacccatgtccttcaggaccc

SEQ ID NO: 183788 - DNA, 25 bp, Mus musculus
actggacccctgaaggacatagcat

SEQ ID NO: 183789 - DNA, 25 bp, Mus musculus
actggacccctgaaggttacagtct

SEQ ID NO: 183790 - DNA, 25 bp, Mus musculus
actggacctccggggatataaaatt

SEQ ID NO: 183791 - DNA, 25 bp, Mus musculus
actggacctgacaggtgatctggag

SEQ ID NO: 183792 - DNA, 25 bp, Mus musculus
actggacgagaggatggctgtgctt

SEQ ID NO: 183793 - DNA, 25 bp, Mus musculus
actggacgagtccgttagatcgggg

SEQ ID NO: 183794 - DNA, 25 bp, Mus musculus
actggactatccgatacacctcctt

SEQ ID NO: 183795 - DNA, 25 bp, Mus musculus
actggactcaagcggatagccaagg

SEQ ID NO: 183796 - DNA, 25 bp, Mus musculus
actggactcaagctctcttgagtca

SEQ ID NO: 183797 - DNA, 25 bp, Mus musculus
actggactctaaactggtcagcctg

SEQ ID NO: 183798 - DNA, 25 bp, Mus musculus
actggactgaagatctctctgaaac

SEQ ID NO: 183799 - DNA, 25 bp, Mus musculus
actggactgcgccatctctgtctgc

SEQ ID NO: 183800 - DNA, 25 bp, Mus musculus
actggacttgctgaaacctggtccc

SEQ ID NO: 183801 - DNA, 25 bp, Mus musculus
actggagaaaagggtgaacctggtc

SEQ ID NO: 183802 - DNA, 25 bp, Mus musculus
actggagaaacagggtcatgatggt

SEQ ID NO: 183803 - DNA, 25 bp, Mus musculus
actggagaagaagcacaagcttctg

SEQ ID NO: 183804 - DNA, 25 bp, Mus musculus
actggagaagaagcaggaattctta

SEQ ID NO: 183805 - DNA, 25 bp, Mus musculus
actggagaagaagtcttggacaggc

SEQ ID NO: 183806 - DNA, 25 bp, Mus musculus
actggagaaggtcttcgcttatgtc

SEQ ID NO: 183807 - DNA, 25 bp, Mus musculus
actggagaaggtgcaaaacatgtct

SEQ ID NO: 183808 - DNA, 25 bp, Mus musculus
actggagaagtatgtgggtgccctg

SEQ ID NO: 183809 - DNA, 25 bp, Mus musculus
actggagaagttatttccgagagac

SEQ ID NO: 183810 - DNA, 25 bp, Mus musculus
actggagaatcgaggaaaacttccc

SEQ ID NO: 183811 - DNA, 25 bp, Mus musculus
actggagacaaaattgcaatgcatg

SEQ ID NO: 183812 - DNA, 25 bp, Mus musculus
actggagacaaaattgtagaagaac

SEQ ID NO: 183813 - DNA, 25 bp, Mus musculus
actggagacaatggtctgtgggagc

SEQ ID NO: 183814 - DNA, 25 bp, Mus musculus
actggagacaccaacaggtggaagg

SEQ ID NO: 183815 - DNA, 25 bp, Mus musculus
actggagacagcaggcacaccaaga

SEQ ID NO: 183816 - DNA, 25 bp, Mus musculus
actggagacaggccgggtgaccaag

SEQ ID NO: 183817 - DNA, 25 bp, Mus musculus
actggagagatcttgtggcgccatg

SEQ ID NO: 183818 - DNA, 25 bp, Mus musculus
actggagagcacaggattcagtaac

SEQ ID NO: 183819 - DNA, 25 bp, Mus musculus
actggagagccagaagtacctgcac

SEQ ID NO: 183820 - DNA, 25 bp, Mus musculus
actggagatggaagtgtaaatggca

SEQ ID NO: 183821 - DNA, 25 bp, Mus musculus
actggagatggacctcctctggtaa

SEQ ID NO: 183822 - DNA, 25 bp, Mus musculus
actggagatgtggctcaccatgcct

SEQ ID NO: 183823 - DNA, 25 bp, Mus musculus
actggagcaaggtggccctgacaag

SEQ ID NO: 183824 - DNA, 25 bp, Mus musculus
actggagcagctaaatgagatgctg

SEQ ID NO: 183825 - DNA, 25 bp, Mus musculus
actggagcaggccttatgacctgta

SEQ ID NO: 183826 - DNA, 25 bp, Mus musculus
actggagcagggtcggtgatggagc

SEQ ID NO: 183827 - DNA, 25 bp, Mus musculus
actggagccaagagagctgaagcgc

SEQ ID NO: 183828 - DNA, 25 bp, Mus musculus
actggagccaagatgataaatcatc

SEQ ID NO: 183829 - DNA, 25 bp, Mus musculus
actggagccaccccaaatctgccat

SEQ ID NO: 183830 - DNA, 25 bp, Mus musculus
actggagccagaattcacactggag

SEQ ID NO: 183831 - DNA, 25 bp, Mus musculus
actggagcctggaatagagcaatca

SEQ ID NO: 183832 - DNA, 25 bp, Mus musculus
actggagcgtctggtgctacaagtg

SEQ ID NO: 183833 - DNA, 25 bp, Mus musculus
actggagctacaggctggtaagaac

SEQ ID NO: 183834 - DNA, 25 bp, Mus musculus
actggagctgatagaaacatctttc

SEQ ID NO: 183835 - DNA, 25 bp, Mus musculus
actggagctgccagcatttgacatt

SEQ ID NO: 183836 - DNA, 25 bp, Mus musculus
actggagctggccaggactgccgct

SEQ ID NO: 183837 - DNA, 25 bp, Mus musculus
actggagcttgcaggaataacagaa

SEQ ID NO: 183838 - DNA, 25 bp, Mus musculus
actggagcttggtgtctgtctctct

SEQ ID NO: 183839 - DNA, 25 bp, Mus musculus
actggaggacaagggcaggattctg

SEQ ID NO: 183840 - DNA, 25 bp, Mus musculus
actggaggacaaggtgactgcaaag

SEQ ID NO: 183841 - DNA, 25 bp, Mus musculus
actggaggacggaaaccactgagaa

SEQ ID NO: 183842 - DNA, 25 bp, Mus musculus
actggaggagttgaaagaatttgcc

SEQ ID NO: 183843 - DNA, 25 bp, Mus musculus
actggaggatacgtcctctgccaga

SEQ ID NO: 183844 - DNA, 25 bp, Mus musculus
actggagggaggttgtgtagcctga

SEQ ID NO: 183845 - DNA, 25 bp, Mus musculus
actggagggcagaggctcagaggca

SEQ ID NO: 183846 - DNA, 25 bp, Mus musculus
actggagggctagatgggatgtgac

SEQ ID NO: 183847 - DNA, 25 bp, Mus musculus
actggagggctaggcttcaacttgc

SEQ ID NO: 183848 - DNA, 25 bp, Mus musculus
actggagggtgaggctctgggtgct

SEQ ID NO: 183849 - DNA, 25 bp, Mus musculus
actggaggtggcagagtataaagga

SEQ ID NO: 183850 - DNA, 25 bp, Mus musculus
actggaggtggccgatgtgacagca

SEQ ID NO: 183851 - DNA, 25 bp, Mus musculus
actggagtatgccagacagctgagg

SEQ ID NO: 183852 - DNA, 25 bp, Mus musculus
actggagtatgccaggtactacatg

SEQ ID NO: 183853 - DNA, 25 bp, Mus musculus
actggagtccagcaatccaaacttc

SEQ ID NO: 183854 - DNA, 25 bp, Mus musculus
actggagtccataggctgtaccaac

SEQ ID NO: 183855 - DNA, 25 bp, Mus musculus
actggagtgaggaaaatggcacacc

SEQ ID NO: 183856 - DNA, 25 bp, Mus musculus
actggagtgaggagaagaaacactg

SEQ ID NO: 183857 - DNA, 25 bp, Mus musculus
actggagtgaggtcaagggtcttct

SEQ ID NO: 183858 - DNA, 25 bp, Mus musculus
actggagttacagcttcgttacgac

SEQ ID NO: 183859 - DNA, 25 bp, Mus musculus
actggagttagacgtgaccatttga

SEQ ID NO: 183860 - DNA, 25 bp, Mus musculus
actggagttagaggtgaccatttga

SEQ ID NO: 183861 - DNA, 25 bp, Mus musculus
actggagttgcagagaaccccaaag

SEQ ID NO: 183862 - DNA, 25 bp, Mus musculus
actggagttgcagagacctcagaca

SEQ ID NO: 183863 - DNA, 25 bp, Mus musculus
actggataacagtgcctccggagcc

SEQ ID NO: 183864 - DNA, 25 bp, Mus musculus
actggatacaggggtctgtgatgtg

SEQ ID NO: 183865 - DNA, 25 bp, Mus musculus
actggatactgcctgtgcctcacaa

SEQ ID NO: 183866 - DNA, 25 bp, Mus musculus
actggatactggtaacagcatgacc

SEQ ID NO: 183867 - DNA, 25 bp, Mus musculus
actggatagcctgcttggcagtgac

SEQ ID NO: 183868 - DNA, 25 bp, Mus musculus
actggatagcctggtaggacagtcc

SEQ ID NO: 183869 - DNA, 25 bp, Mus musculus
actggatcaaggagaaaatacaact

SEQ ID NO: 183870 - DNA, 25 bp, Mus musculus
actggatctgggagcatcaaggtcc

SEQ ID NO: 183871 - DNA, 25 bp, Mus musculus
actggatctttaaagcgcagtgcta

SEQ ID NO: 183872 - DNA, 25 bp, Mus musculus
actggatgatacctggaaaaatggt

SEQ ID NO: 183873 - DNA, 25 bp, Mus musculus
actggatgcagaccttcaatttggt

SEQ ID NO: 183874 - DNA, 25 bp, Mus musculus
actggatgccactggtaagaccaca

SEQ ID NO: 183875 - DNA, 25 bp, Mus musculus
actggatgccactggtactggcata

SEQ ID NO: 183876 - DNA, 25 bp, Mus musculus
actggatgctatgagctgatacaag

SEQ ID NO: 183877 - DNA, 25 bp, Mus musculus
actggatggggggtgtgccagcctt

SEQ ID NO: 183878 - DNA, 25 bp, Mus musculus
actggattctcggagagtccttctt

SEQ ID NO: 183879 - DNA, 25 bp, Mus musculus
actggattctcggtgggagccagcg

SEQ ID NO: 183880 - DNA, 25 bp, Mus musculus
actggattttcgcaactgcgcaaac

SEQ ID NO: 183881 - DNA, 25 bp, Mus musculus
actggcaaatcaccccttttccagt

SEQ ID NO: 183882 - DNA, 25 bp, Mus musculus
actggcaaccagcatctgatgacat

SEQ ID NO: 183883 - DNA, 25 bp, Mus musculus
actggcaaccaggaagctgccctca

SEQ ID NO: 183884 - DNA, 25 bp, Mus musculus
actggcaacccagaactgatagtgc

SEQ ID NO: 183885 - DNA, 25 bp, Mus musculus
actggcaacccagattgacttgatg

SEQ ID NO: 183886 - DNA, 25 bp, Mus musculus
actggcaagacggcttccttgtggg

SEQ ID NO: 183887 - DNA, 25 bp, Mus musculus
actggcaagagagtgctaacagcca

SEQ ID NO: 183888 - DNA, 25 bp, Mus musculus
actggcacaggagacactgcaggag

SEQ ID NO: 183889 - DNA, 25 bp, Mus musculus
actggcacatgaggtcgggtggaag

SEQ ID NO: 183890 - DNA, 25 bp, Mus musculus
actggcaccagctggagaacatagg

SEQ ID NO: 183891 - DNA, 25 bp, Mus musculus
actggcacgaaatcctagtttcgtc

SEQ ID NO: 183892 - DNA, 25 bp, Mus musculus
actggcactacagatgctcatgaca

SEQ ID NO: 183893 - DNA, 25 bp, Mus musculus
actggcactggacagagagagatgc

SEQ ID NO: 183894 - DNA, 25 bp, Mus musculus
actggcactggacaggtacctctaa

SEQ ID NO: 183895 - DNA, 25 bp, Mus musculus
actggcagaagctcttggcatttgt

SEQ ID NO: 183896 - DNA, 25 bp, Mus musculus
actggcagaggtacggagtttgaag

SEQ ID NO: 183897 - DNA, 25 bp, Mus musculus
actggcagccagcgctcctgttgta

SEQ ID NO: 183898 - DNA, 25 bp, Mus musculus
actggcagggagatctgctggcagc

SEQ ID NO: 183899 - DNA, 25 bp, Mus musculus
actggcagtgagatccgccatcgcg

SEQ ID NO: 183900 - DNA, 25 bp, Mus musculus
actggcatagttggagcgataggtc

SEQ ID NO: 183901 - DNA, 25 bp, Mus musculus
actggcatcatgggagcaggctgca

SEQ ID NO: 183902 - DNA, 25 bp, Mus musculus
actggcatcatggtcaaaaatgctg

SEQ ID NO: 183903 - DNA, 25 bp, Mus musculus
actggcattgcagatttatttcctg

SEQ ID NO: 183904 - DNA, 25 bp, Mus musculus
actggcattgcaggccgaggagaat

SEQ ID NO: 183905 - DNA, 25 bp, Mus musculus
actggcattggaccatctgctgcaa

SEQ ID NO: 183906 - DNA, 25 bp, Mus musculus
actggcattggatctcaggaaaaat

SEQ ID NO: 183907 - DNA, 25 bp, Mus musculus
actggccaaaatttatgagaagatc

SEQ ID NO: 183908 - DNA, 25 bp, Mus musculus
actggccaaaatttcctctgtgaag

SEQ ID NO: 183909 - DNA, 25 bp, Mus musculus
actggccaagtactgtgaggtgctg

SEQ ID NO: 183910 - DNA, 25 bp, Mus musculus
actggccacaatttactggtttact

SEQ ID NO: 183911 - DNA, 25 bp, Mus musculus
actggccacaggaccagctgccaat

SEQ ID NO: 183912 - DNA, 25 bp, Mus musculus
actggccaccccgtgtcctatgcac

SEQ ID NO: 183913 - DNA, 25 bp, Mus musculus
actggccactgcttggcctgtccac

SEQ ID NO: 183914 - DNA, 25 bp, Mus musculus
actggccagaaacagatctggagaa

SEQ ID NO: 183915 - DNA, 25 bp, Mus musculus
actggccagaaggatgtcaatgggc

SEQ ID NO: 183916 - DNA, 25 bp, Mus musculus
actggccagagagcaatggaagtac

SEQ ID NO: 183917 - DNA, 25 bp, Mus musculus
actggccagaggacacggatgctct

SEQ ID NO: 183918 - DNA, 25 bp, Mus musculus
actggccagtaaggcccgaatggct

SEQ ID NO: 183919 - DNA, 25 bp, Mus musculus
actggccagttcagcttccaaaggc

SEQ ID NO: 183920 - DNA, 25 bp, Mus musculus
actggccagttcaggatttccactt

SEQ ID NO: 183921 - DNA, 25 bp, Mus musculus
actggccccgggccctcagcatcct

SEQ ID NO: 183922 - DNA, 25 bp, Mus musculus
actggcccgcccggattgatgaact

SEQ ID NO: 183923 - DNA, 25 bp, Mus musculus
actggcccgcccggtgcatttctag

SEQ ID NO: 183924 - DNA, 25 bp, Mus musculus
actggccctgctctctgctctctgc

SEQ ID NO: 183925 - DNA, 25 bp, Mus musculus
actggccgagggatggaattcgaag

SEQ ID NO: 183926 - DNA, 25 bp, Mus musculus
actggccgcaggaagctaagcaacc

SEQ ID NO: 183927 - DNA, 25 bp, Mus musculus
actggccgcagggtacattcgcctc

SEQ ID NO: 183928 - DNA, 25 bp, Mus musculus
actggccggcccggattgatgacat

SEQ ID NO: 183929 - DNA, 25 bp, Mus musculus
actggccgtaaatggttcagactgg

SEQ ID NO: 183930 - DNA, 25 bp, Mus musculus
actggcctagcctatgctgctgggg

SEQ ID NO: 183931 - DNA, 25 bp, Mus musculus
actggcctcaaaaatactgggcggt

SEQ ID NO: 183932 - DNA, 25 bp, Mus musculus
actggcctcgatctactccccggat

SEQ ID NO: 183933 - DNA, 25 bp, Mus musculus
actggcctctgagagctgtcggcca

SEQ ID NO: 183934 - DNA, 25 bp, Mus musculus
actggcctgaagacattgtctttcc

SEQ ID NO: 183935 - DNA, 25 bp, Mus musculus
actggcctggggtctacatcaccgt

SEQ ID NO: 183936 - DNA, 25 bp, Mus musculus
actggccttccacgagttcgaggaa

SEQ ID NO: 183937 - DNA, 25 bp, Mus musculus
actggccttcgagtttgatcctgag

SEQ ID NO: 183938 - DNA, 25 bp, Mus musculus
actggcgacaggcccacatgcaggc

SEQ ID NO: 183939 - DNA, 25 bp, Mus musculus
actggcgacaggctctgatgggcgc

SEQ ID NO: 183940 - DNA, 25 bp, Mus musculus
actggcgagaagaccaccatgcggg

SEQ ID NO: 183941 - DNA, 25 bp, Mus musculus
actggcgagtagcaggaataaacac

SEQ ID NO: 183942 - DNA, 25 bp, Mus musculus
actggcgattggggtggtcctgccg

SEQ ID NO: 183943 - DNA, 25 bp, Mus musculus
actggcgcaaggttcccaatcaagg

SEQ ID NO: 183944 - DNA, 25 bp, Mus musculus
actggcgcatcccagggttctgcct

SEQ ID NO: 183945 - DNA, 25 bp, Mus musculus
actggcgcctagagaagcctcccca

SEQ ID NO: 183946 - DNA, 25 bp, Mus musculus
actggcgcggccgaggctgcttccg

SEQ ID NO: 183947 - DNA, 25 bp, Mus musculus
actggcggaagctcaagatgacagc

SEQ ID NO: 183948 - DNA, 25 bp, Mus musculus
actggctaagaactgccagtgtatg

SEQ ID NO: 183949 - DNA, 25 bp, Mus musculus
actggctaagagctgcttttagaag

SEQ ID NO: 183950 - DNA, 25 bp, Mus musculus
actggctacctttctgaaggacggg

SEQ ID NO: 183951 - DNA, 25 bp, Mus musculus
actggctatcccagatggatgactg

SEQ ID NO: 183952 - DNA, 25 bp, Mus musculus
actggctatgaggacgtagcaaatt

SEQ ID NO: 183953 - DNA, 25 bp, Mus musculus
actggctatgttgagattcatttta

SEQ ID NO: 183954 - DNA, 25 bp, Mus musculus
actggctatgttgagcttcgttacg

SEQ ID NO: 183955 - DNA, 25 bp, Mus musculus
actggctattgagctcttcctcatg

SEQ ID NO: 183956 - DNA, 25 bp, Mus musculus
actggctcaacagatccaaaaggta

SEQ ID NO: 183957 - DNA, 25 bp, Mus musculus
actggctcatcagccacggcaagct

SEQ ID NO: 183958 - DNA, 25 bp, Mus musculus
actggctcatggggaagtctaaagc

SEQ ID NO: 183959 - DNA, 25 bp, Mus musculus
actggctcatgggttctgcaatctt

SEQ ID NO: 183960 - DNA, 25 bp, Mus musculus
actggctcttggcgacaactggcca

SEQ ID NO: 183961 - DNA, 25 bp, Mus musculus
actggctgaaagataagcccctggt

SEQ ID NO: 183962 - DNA, 25 bp, Mus musculus
actggctgaaggtaccttaacatgg

SEQ ID NO: 183963 - DNA, 25 bp, Mus musculus
actggctgacaaggcacccacatct

SEQ ID NO: 183964 - DNA, 25 bp, Mus musculus
actggctgactgcagatctgatttg

SEQ ID NO: 183965 - DNA, 25 bp, Mus musculus
actggctgactgctgtacacttcct

SEQ ID NO: 183966 - DNA, 25 bp, Mus musculus
actggctgactgctgtagtggatcc

SEQ ID NO: 183967 - DNA, 25 bp, Mus musculus
actggctgagtatagacaactgtca

SEQ ID NO: 183968 - DNA, 25 bp, Mus musculus
actggctgagtataggaaggggcca

SEQ ID NO: 183969 - DNA, 25 bp, Mus musculus
actggctgatctgcatccccaaaag

SEQ ID NO: 183970 - DNA, 25 bp, Mus musculus
actggctgccacgcagactgtatcg

SEQ ID NO: 183971 - DNA, 25 bp, Mus musculus
actggctgtctgaccaagtaactta

SEQ ID NO: 183972 - DNA, 25 bp, Mus musculus
actggctgtctggtttaacttgcac

SEQ ID NO: 183973 - DNA, 25 bp, Mus musculus
actggcttccatttctgcaaggagt

SEQ ID NO: 183974 - DNA, 25 bp, Mus musculus
actggctttcagggacttcctggac

SEQ ID NO: 183975 - DNA, 25 bp, Mus musculus
actgggaaaaggtaaatgttggaga

SEQ ID NO: 183976 - DNA, 25 bp, Mus musculus
actgggaaaaggtggcagtggggga

SEQ ID NO: 183977 - DNA, 25 bp, Mus musculus
actgggaaaagtgagccccaggcca

SEQ ID NO: 183978 - DNA, 25 bp, Mus musculus
actgggaaaccatgtggtgctctaa

SEQ ID NO: 183979 - DNA, 25 bp, Mus musculus
actgggaaaggacccagctgttgtc

SEQ ID NO: 183980 - DNA, 25 bp, Mus musculus
actgggaaaggagtgtgctcgggtg

SEQ ID NO: 183981 - DNA, 25 bp, Mus musculus
actgggaaaggatcatcgggttata

SEQ ID NO: 183982 - DNA, 25 bp, Mus musculus
actgggaaagggtgactgtggccct

SEQ ID NO: 183983 - DNA, 25 bp, Mus musculus
actgggaaatgatgagaatggcttg

SEQ ID NO: 183984 - DNA, 25 bp, Mus musculus
actgggaaatgatgtggttgagaaa

SEQ ID NO: 183985 - DNA, 25 bp, Mus musculus
actgggaagaagacggatctccatc

SEQ ID NO: 183986 - DNA, 25 bp, Mus musculus
actgggaattgagaatatgaacgag

SEQ ID NO: 183987 - DNA, 25 bp, Mus musculus
actgggacaattcaggacccttttg

SEQ ID NO: 183988 - DNA, 25 bp, Mus musculus
actgggacaggacctctggaagcaa

SEQ ID NO: 183989 - DNA, 25 bp, Mus musculus
actgggacagggatcatagacgata

SEQ ID NO: 183990 - DNA, 25 bp, Mus musculus
actgggacagtagggaagttgccac

SEQ ID NO: 183991 - DNA, 25 bp, Mus musculus
actgggacagtagggcagcaccagc

SEQ ID NO: 183992 - DNA, 25 bp, Mus musculus
actgggaccgtgcctgcaggtgtat

SEQ ID NO: 183993 - DNA, 25 bp, Mus musculus
actgggacctcatcattctctggca

SEQ ID NO: 183994 - DNA, 25 bp, Mus musculus
actgggacctcatctacgtgggccg

SEQ ID NO: 183995 - DNA, 25 bp, Mus musculus
actgggacgcggccatccatggctt

SEQ ID NO: 183996 - DNA, 25 bp, Mus musculus
actgggacgcgttctgtggatctac

SEQ ID NO: 183997 - DNA, 25 bp, Mus musculus
actgggactacagggatccgtgaac

SEQ ID NO: 183998 - DNA, 25 bp, Mus musculus
actgggagagaaatatccaccccca

SEQ ID NO: 183999 - DNA, 25 bp, Mus musculus
actgggagaggatttgaattaatcg

SEQ ID NO: 184000 - DNA, 25 bp, Mus musculus
actgggagagggtgttacgtttcca

SEQ ID NO: 184001 - DNA, 25 bp, Mus musculus
actgggaggagaaggtcctgttgag

SEQ ID NO: 184002 - DNA, 25 bp, Mus musculus
actgggaggagcagatattcagtga

SEQ ID NO: 184003 - DNA, 25 bp, Mus musculus
actgggagtacagctgactcaagag

SEQ ID NO: 184004 - DNA, 25 bp, Mus musculus
actgggagtgaggcccagcctgcag

SEQ ID NO: 184005 - DNA, 25 bp, Mus musculus
actgggataaaggattccagcagat

SEQ ID NO: 184006 - DNA, 25 bp, Mus musculus
actgggatcctaaagtggccgtgcc

SEQ ID NO: 184007 - DNA, 25 bp, Mus musculus
actgggattaaaaagaatggaatca

SEQ ID NO: 184008 - DNA, 25 bp, Mus musculus
actgggattaaagatggcagacttt

SEQ ID NO: 184009 - DNA, 25 bp, Mus musculus
actgggattaaaggatgaaaatgag

SEQ ID NO: 184010 - DNA, 25 bp, Mus musculus
actgggattaaagggcatgaatctt

SEQ ID NO: 184011 - DNA, 25 bp, Mus musculus
actgggattaaaggtatagtccaga

SEQ ID NO: 184012 - DNA, 25 bp, Mus musculus
actgggattacaggggctgagattt

SEQ ID NO: 184013 - DNA, 25 bp, Mus musculus
actgggattgggctagtgaaccgga

SEQ ID NO: 184014 - DNA, 25 bp, Mus musculus
actgggcacgaggctggaaggctgc

SEQ ID NO: 184015 - DNA, 25 bp, Mus musculus
actgggcacgccggagctccctgtg

SEQ ID NO: 184016 - DNA, 25 bp, Mus musculus
actgggcctggttgtggagttgaca

SEQ ID NO: 184017 - DNA, 25 bp, Mus musculus
actgggcgcaggtttacctatttcc

SEQ ID NO: 184018 - DNA, 25 bp, Mus musculus
actgggcgtctgggcaagacctgca

SEQ ID NO: 184019 - DNA, 25 bp, Mus musculus
actgggctataagacccagttgtag

SEQ ID NO: 184020 - DNA, 25 bp, Mus musculus
actgggctataaggatgtctcccgt

SEQ ID NO: 184021 - DNA, 25 bp, Mus musculus
actgggctataggtcggatatgaag

SEQ ID NO: 184022 - DNA, 25 bp, Mus musculus
actgggctcctctgggatttgtttt

SEQ ID NO: 184023 - DNA, 25 bp, Mus musculus
actgggctctacgggtgacaccagg

SEQ ID NO: 184024 - DNA, 25 bp, Mus musculus
actgggctgttttggtgtgcacatc

SEQ ID NO: 184025 - DNA, 25 bp, Mus musculus
actgggcttcttggtgtctgaccga

SEQ ID NO: 184026 - DNA, 25 bp, Mus musculus
actgggcttgcagattttcttctaa

SEQ ID NO: 184027 - DNA, 25 bp, Mus musculus
actggggaaaagggaaagcttggcg

SEQ ID NO: 184028 - DNA, 25 bp, Mus musculus
actggggaagaagagcccttctccc

SEQ ID NO: 184029 - DNA, 25 bp, Mus musculus
actggggcgatccggaacctggtgg

SEQ ID NO: 184030 - DNA, 25 bp, Mus musculus
actggggcgatccgggaaggccata

SEQ ID NO: 184031 - DNA, 25 bp, Mus musculus
actggggtactgctgcaggtcctgg

SEQ ID NO: 184032 - DNA, 25 bp, Mus musculus
actggggttttaaggtgtctggctg

SEQ ID NO: 184033 - DNA, 25 bp, Mus musculus
actgggtcaaggacacggcaaatga

SEQ ID NO: 184034 - DNA, 25 bp, Mus musculus
actgggtcaagtcaccctgtgaaga

SEQ ID NO: 184035 - DNA, 25 bp, Mus musculus
actgggtgatgaaagggctgtgcct

SEQ ID NO: 184036 - DNA, 25 bp, Mus musculus
actgggtggaggctaatctcgacga

SEQ ID NO: 184037 - DNA, 25 bp, Mus musculus
actgggttaaatattgatgagaagg

SEQ ID NO: 184038 - DNA, 25 bp, Mus musculus
actggtaatgatgaccattaattaa

SEQ ID NO: 184039 - DNA, 25 bp, Mus musculus
actggtacagtacaatatctccctg

SEQ ID NO: 184040 - DNA, 25 bp, Mus musculus
actggtaccaactgtgtaaggagaa

SEQ ID NO: 184041 - DNA, 25 bp, Mus musculus
actggtacctgcggctgaaggtgaa

SEQ ID NO: 184042 - DNA, 25 bp, Mus musculus
actggtagagctgcgcttgtgcact

SEQ ID NO: 184043 - DNA, 25 bp, Mus musculus
actggtatcaactgtgtaaggagaa

SEQ ID NO: 184044 - DNA, 25 bp, Mus musculus
actggtcaacacaaaacacagatac

SEQ ID NO: 184045 - DNA, 25 bp, Mus musculus
actggtcaacacaggtcttctgacg

SEQ ID NO: 184046 - DNA, 25 bp, Mus musculus
actggtcaacactaaacacagatac

SEQ ID NO: 184047 - DNA, 25 bp, Mus musculus
actggtcaagaggaaattgatgagg

SEQ ID NO: 184048 - DNA, 25 bp, Mus musculus
actggtcaagattcatgaaaaactt

SEQ ID NO: 184049 - DNA, 25 bp, Mus musculus
actggtcaaggcaactattggcctg

SEQ ID NO: 184050 - DNA, 25 bp, Mus musculus
actggtcaatagggtacacctggtg

SEQ ID NO: 184051 - DNA, 25 bp, Mus musculus
actggtcagatgagggtacgggcgc

SEQ ID NO: 184052 - DNA, 25 bp, Mus musculus
actggtcataaaggttccagatgat

SEQ ID NO: 184053 - DNA, 25 bp, Mus musculus
actggtcatcaacaggctctccttt

SEQ ID NO: 184054 - DNA, 25 bp, Mus musculus
actggtccccaggcctggctgctgc

SEQ ID NO: 184055 - DNA, 25 bp, Mus musculus
actggtcctcaggcattaacaagtg

SEQ ID NO: 184056 - DNA, 25 bp, Mus musculus
actggtgaagcttatgtgcgagctg

SEQ ID NO: 184057 - DNA, 25 bp, Mus musculus
actggtgactactggaataccagtt

SEQ ID NO: 184058 - DNA, 25 bp, Mus musculus
actggtgagccatcttttctgggga

SEQ ID NO: 184059 - DNA, 25 bp, Mus musculus
actggtgcagaagagaagagcagcg

SEQ ID NO: 184060 - DNA, 25 bp, Mus musculus
actggtgcagcggaagggcgtgtgg

SEQ ID NO: 184061 - DNA, 25 bp, Mus musculus
actggtgcagtatgatctgaagagt

SEQ ID NO: 184062 - DNA, 25 bp, Mus musculus
actggtgcccagggtgctggtgttg

SEQ ID NO: 184063 - DNA, 25 bp, Mus musculus
actggtgcgaacaaagtctcccctt

SEQ ID NO: 184064 - DNA, 25 bp, Mus musculus
actggtggaggagaagatggagcga

SEQ ID NO: 184065 - DNA, 25 bp, Mus musculus
actggtggcctcaagggttacaggg

SEQ ID NO: 184066 - DNA, 25 bp, Mus musculus
actggtgggcagcttcatgttgtgt

SEQ ID NO: 184067 - DNA, 25 bp, Mus musculus
actggtgggcagggccttcgtatac

SEQ ID NO: 184068 - DNA, 25 bp, Mus musculus
actggtgtaagaaatgaagctcaag

SEQ ID NO: 184069 - DNA, 25 bp, Mus musculus
actggtgtaggcagtctcatcaagc

SEQ ID NO: 184070 - DNA, 25 bp, Mus musculus
actggtgtcaagcctgagggatctg

SEQ ID NO: 184071 - DNA, 25 bp, Mus musculus
actggtgtcaagctcccagactcca

SEQ ID NO: 184072 - DNA, 25 bp, Mus musculus
actggtgtgagccttctctgaggat

SEQ ID NO: 184073 - DNA, 25 bp, Mus musculus
actggtgtgtctagggtgtgcttat

SEQ ID NO: 184074 - DNA, 25 bp, Mus musculus
actggttaacgcttatttcctcaag

SEQ ID NO: 184075 - DNA, 25 bp, Mus musculus
actggttatgctttccatgaagtgg

SEQ ID NO: 184076 - DNA, 25 bp, Mus musculus
actggttatggatccatctgttggc

SEQ ID NO: 184077 - DNA, 25 bp, Mus musculus
actggttccataggtgcggctctgg

SEQ ID NO: 184078 - DNA, 25 bp, Mus musculus
actggttcctggagggatcaatgtg

SEQ ID NO: 184079 - DNA, 25 bp, Mus musculus
actggttgagatcctctttaggagg

SEQ ID NO: 184080 - DNA, 25 bp, Mus musculus
actggttgagggcaatggcatctcc

SEQ ID NO: 184081 - DNA, 25 bp, Mus musculus
actggttgccaagaaggggtagagg

SEQ ID NO: 184082 - DNA, 25 bp, Mus musculus
actggttgccaggctccacccgcgg

SEQ ID NO: 184083 - DNA, 25 bp, Mus musculus
actggtttatcagagatttgaagtt

SEQ ID NO: 184084 - DNA, 25 bp, Mus musculus
actggtttatcaggacccagcatga

SEQ ID NO: 184085 - DNA, 25 bp, Mus musculus
actggtttatcgggaccagaataag

SEQ ID NO: 184086 - DNA, 25 bp, Mus musculus
actggtttcagaaggtttgaagact

SEQ ID NO: 184087 - DNA, 25 bp, Mus musculus
actggttttgccctgcactcctggg

SEQ ID NO: 184088 - DNA, 25 bp, Mus musculus
actggttttgccctgggctacggcg

SEQ ID NO: 184089 - DNA, 25 bp, Mus musculus
actggttttggaggctgataagctg

SEQ ID NO: 184090 - DNA, 25 bp, Mus musculus
actgtaaaccaggtcactcctgtcc

SEQ ID NO: 184091 - DNA, 25 bp, Mus musculus
actgtaaagaagctggctgtgaaca

SEQ ID NO: 184092 - DNA, 25 bp, Mus musculus
actgtaaataggtttgagtacagtg

SEQ ID NO: 184093 - DNA, 25 bp, Mus musculus
actgtaaatggagatcgctctggac

SEQ ID NO: 184094 - DNA, 25 bp, Mus musculus
actgtaaccgtgggactcgatctgc

SEQ ID NO: 184095 - DNA, 25 bp, Mus musculus
actgtaacctgtcctggttatggct

SEQ ID NO: 184096 - DNA, 25 bp, Mus musculus
actgtaacgagcgcttgtacaggtt

SEQ ID NO: 184097 - DNA, 25 bp, Mus musculus
actgtaactccaggggcactatgaa

SEQ ID NO: 184098 - DNA, 25 bp, Mus musculus
actgtaagaggcttctcaggatgga

SEQ ID NO: 184099 - DNA, 25 bp, Mus musculus
actgtaaggcccatcctttgtgaga

SEQ ID NO: 184100 - DNA, 25 bp, Mus musculus
actgtaataaggatgaggctgtgga

SEQ ID NO: 184101 - DNA, 25 bp, Mus musculus
actgtacaacatcagccatgcacac

SEQ ID NO: 184102 - DNA, 25 bp, Mus musculus
actgtacaacttgactggtctgagt

SEQ ID NO: 184103 - DNA, 25 bp, Mus musculus
actgtacaccaggtcctgataagcc

SEQ ID NO: 184104 - DNA, 25 bp, Mus musculus
actgtacactgacgaggatagtgcc

SEQ ID NO: 184105 - DNA, 25 bp, Mus musculus
actgtacactgacgtccagaaacgc

SEQ ID NO: 184106 - DNA, 25 bp, Mus musculus
actgtacagtatgtgcagagcattg

SEQ ID NO: 184107 - DNA, 25 bp, Mus musculus
actgtacagtgaaacagatgtgcag

SEQ ID NO: 184108 - DNA, 25 bp, Mus musculus
actgtacagttccagaggcagcagt

SEQ ID NO: 184109 - DNA, 25 bp, Mus musculus
actgtacagttccagattcagcact

SEQ ID NO: 184110 - DNA, 25 bp, Mus musculus
actgtaccaaggcagctcaggctgg

SEQ ID NO: 184111 - DNA, 25 bp, Mus musculus
actgtaccaagtgcagctcagtcca

SEQ ID NO: 184112 - DNA, 25 bp, Mus musculus
actgtaccaggcccagtctgtgcga

SEQ ID NO: 184113 - DNA, 25 bp, Mus musculus
actgtaccagggccacaccctacgc

SEQ ID NO: 184114 - DNA, 25 bp, Mus musculus
actgtaccagtgacttcaatgcaga

SEQ ID NO: 184115 - DNA, 25 bp, Mus musculus
actgtaccatccctgagatctggac

SEQ ID NO: 184116 - DNA, 25 bp, Mus musculus
actgtaccatccgtgagatctggac

SEQ ID NO: 184117 - DNA, 25 bp, Mus musculus
actgtaccccagctatcatgaacat

SEQ ID NO: 184118 - DNA, 25 bp, Mus musculus
actgtaccgaggtctgatcccacag

SEQ ID NO: 184119 - DNA, 25 bp, Mus musculus
actgtacctatggagtaatggttcc

SEQ ID NO: 184120 - DNA, 25 bp, Mus musculus
actgtacctatggatgtgctgggcc

SEQ ID NO: 184121 - DNA, 25 bp, Mus musculus
actgtacgcggagactgcggcccac

SEQ ID NO: 184122 - DNA, 25 bp, Mus musculus
actgtacgtacacaggttttccttt

SEQ ID NO: 184123 - DNA, 25 bp, Mus musculus
actgtactacacagttcaacgggaa

SEQ ID NO: 184124 - DNA, 25 bp, Mus musculus
actgtactcaagactgcaggcgcta

SEQ ID NO: 184125 - DNA, 25 bp, Mus musculus
actgtactcaagtcctggatcagtg

SEQ ID NO: 184126 - DNA, 25 bp, Mus musculus
actgtagacctggccttccctccgg

SEQ ID NO: 184127 - DNA, 25 bp, Mus musculus
actgtagagccaaacatccagaacc

SEQ ID NO: 184128 - DNA, 25 bp, Mus musculus
actgtagaggaatgcctccaattcc

SEQ ID NO: 184129 - DNA, 25 bp, Mus musculus
actgtagaggagaatccttccttgt

SEQ ID NO: 184130 - DNA, 25 bp, Mus musculus
actgtagcaaagacggtttacagca

SEQ ID NO: 184131 - DNA, 25 bp, Mus musculus
actgtagcaaggacaaatctgttgc

SEQ ID NO: 184132 - DNA, 25 bp, Mus musculus
actgtagcaaggtgtctgatgccat

SEQ ID NO: 184133 - DNA, 25 bp, Mus musculus
actgtagcaattccttcttggaggg

SEQ ID NO: 184134 - DNA, 25 bp, Mus musculus
actgtagcccggacatcaccttgaa

SEQ ID NO: 184135 - DNA, 25 bp, Mus musculus
actgtaggaacccagcccaacctac

SEQ ID NO: 184136 - DNA, 25 bp, Mus musculus
actgtagtggaagaagaatgactgt

SEQ ID NO: 184137 - DNA, 25 bp, Mus musculus
actgtagtggaagagaaatcactgt

SEQ ID NO: 184138 - DNA, 25 bp, Mus musculus
actgtatcaaaccctacctggggga

SEQ ID NO: 184139 - DNA, 25 bp, Mus musculus
actgtatcaaacgctacctggggga

SEQ ID NO: 184140 - DNA, 25 bp, Mus musculus
actgtatcaagcaatgtgacccaga

SEQ ID NO: 184141 - DNA, 25 bp, Mus musculus
actgtatcacttgatattaaactaa

SEQ ID NO: 184142 - DNA, 25 bp, Mus musculus
actgtatcagctgcgaatccctcgt

SEQ ID NO: 184143 - DNA, 25 bp, Mus musculus
actgtatcctgagagacaggcaata

SEQ ID NO: 184144 - DNA, 25 bp, Mus musculus
actgtatgaccagaattatcccatc

SEQ ID NO: 184145 - DNA, 25 bp, Mus musculus
actgtatgcagaaatttacacagag

SEQ ID NO: 184146 - DNA, 25 bp, Mus musculus
actgtatgcagcatctgtctgagca

SEQ ID NO: 184147 - DNA, 25 bp, Mus musculus
actgtatggcacgaatgaggaagag

SEQ ID NO: 184148 - DNA, 25 bp, Mus musculus
actgtatgggggcaggtggctttgt

SEQ ID NO: 184149 - DNA, 25 bp, Mus musculus
actgtattccagaatgcccatatca

SEQ ID NO: 184150 - DNA, 25 bp, Mus musculus
actgtattctcagttcctgtagttg

SEQ ID NO: 184151 - DNA, 25 bp, Mus musculus
actgtatttggaataaccacagtcc

SEQ ID NO: 184152 - DNA, 25 bp, Mus musculus
actgtcaagcacggggcgggggcag

SEQ ID NO: 184153 - DNA, 25 bp, Mus musculus
actgtcaagcagatgagacaaggag

SEQ ID NO: 184154 - DNA, 25 bp, Mus musculus
actgtcaagctgagactgttggtga

SEQ ID NO: 184155 - DNA, 25 bp, Mus musculus
actgtcaaggttcaggtcttatatc

SEQ ID NO: 184156 - DNA, 25 bp, Mus musculus
actgtcaatatgagaagaacaaaca

SEQ ID NO: 184157 - DNA, 25 bp, Mus musculus
actgtcaatatgatataaatgaatg

SEQ ID NO: 184158 - DNA, 25 bp, Mus musculus
actgtcaatcataaggatgagaaca

SEQ ID NO: 184159 - DNA, 25 bp, Mus musculus
actgtcaatcataagggcgagatgt

SEQ ID NO: 184160 - DNA, 25 bp, Mus musculus
actgtcacaacagctcgcaatgccc

SEQ ID NO: 184161 - DNA, 25 bp, Mus musculus
actgtcacaaggcagccatggaatt

SEQ ID NO: 184162 - DNA, 25 bp, Mus musculus
actgtcacaaggcaggggcaagcgg

SEQ ID NO: 184163 - DNA, 25 bp, Mus musculus
actgtcacactgaagctcgcactgg

SEQ ID NO: 184164 - DNA, 25 bp, Mus musculus
actgtcacactgaaggccgttcctc

SEQ ID NO: 184165 - DNA, 25 bp, Mus musculus
actgtcacagatgcaggagacaaga

SEQ ID NO: 184166 - DNA, 25 bp, Mus musculus
actgtcacaggggcaggtggcagtg

SEQ ID NO: 184167 - DNA, 25 bp, Mus musculus
actgtcacaggtctggggctttcct

SEQ ID NO: 184168 - DNA, 25 bp, Mus musculus
actgtcaccctgtctggaaagaaat

SEQ ID NO: 184169 - DNA, 25 bp, Mus musculus
actgtcaccgactatttgcatcagt

SEQ ID NO: 184170 - DNA, 25 bp, Mus musculus
actgtcaccgagtttgtctctgtct

SEQ ID NO: 184171 - DNA, 25 bp, Mus musculus
actgtcaccgatgtggataagtcct

SEQ ID NO: 184172 - DNA, 25 bp, Mus musculus
actgtcactttgcagtgccctgctc

SEQ ID NO: 184173 - DNA, 25 bp, Mus musculus
actgtcagagctaaacagaaagaat

SEQ ID NO: 184174 - DNA, 25 bp, Mus musculus
actgtcagaggtaaacagaaagaat

SEQ ID NO: 184175 - DNA, 25 bp, Mus musculus
actgtcagatcccagacttggagag

SEQ ID NO: 184176 - DNA, 25 bp, Mus musculus
actgtcagatcccaggaagccatga

SEQ ID NO: 184177 - DNA, 25 bp, Mus musculus
actgtcagatcccagtatatttgtg

SEQ ID NO: 184178 - DNA, 25 bp, Mus musculus
actgtcaggaattccttaactccat

SEQ ID NO: 184179 - DNA, 25 bp, Mus musculus
actgtcatcacaccggtgttttggc

SEQ ID NO: 184180 - DNA, 25 bp, Mus musculus
actgtcatccaggaccccatgcctg

SEQ ID NO: 184181 - DNA, 25 bp, Mus musculus
actgtcatccttgtctcattgggag

SEQ ID NO: 184182 - DNA, 25 bp, Mus musculus
actgtcatcgccacctgcggccccg

SEQ ID NO: 184183 - DNA, 25 bp, Mus musculus
actgtcatgttcttcttcagaaaca

SEQ ID NO: 184184 - DNA, 25 bp, Mus musculus
actgtcattagaccatttccaggac

SEQ ID NO: 184185 - DNA, 25 bp, Mus musculus
actgtcattgagaagtgccccaagc

SEQ ID NO: 184186 - DNA, 25 bp, Mus musculus
actgtcattgagaagtgcctgtgac

SEQ ID NO: 184187 - DNA, 25 bp, Mus musculus
actgtccaagacccagcaactacat

SEQ ID NO: 184188 - DNA, 25 bp, Mus musculus
actgtccaagagttgtttgcagccc

SEQ ID NO: 184189 - DNA, 25 bp, Mus musculus
actgtccaaggatggaaggtcactg

SEQ ID NO: 184190 - DNA, 25 bp, Mus musculus
actgtccaagtggacacgggccttt

SEQ ID NO: 184191 - DNA, 25 bp, Mus musculus
actgtccacaaccagaaaagccagc

SEQ ID NO: 184192 - DNA, 25 bp, Mus musculus
actgtccacaaccagccctcagcgg

SEQ ID NO: 184193 - DNA, 25 bp, Mus musculus
actgtccacaaccaggctcccacca

SEQ ID NO: 184194 - DNA, 25 bp, Mus musculus
actgtccacacaagctttgaaccac

SEQ ID NO: 184195 - DNA, 25 bp, Mus musculus
actgtccacacaaggtttcacgact

SEQ ID NO: 184196 - DNA, 25 bp, Mus musculus
actgtccagaaagcgaccataacct

SEQ ID NO: 184197 - DNA, 25 bp, Mus musculus
actgtccagggccaaggaatatgta

SEQ ID NO: 184198 - DNA, 25 bp, Mus musculus
actgtccagggtgaccaacgccagt

SEQ ID NO: 184199 - DNA, 25 bp, Mus musculus
actgtccatgaccggaatccatgcc

SEQ ID NO: 184200 - DNA, 25 bp, Mus musculus
actgtcccacaaggcatgctagtcc

SEQ ID NO: 184201 - DNA, 25 bp, Mus musculus
actgtccccatatgagcataaatca

SEQ ID NO: 184202 - DNA, 25 bp, Mus musculus
actgtccccatatgatgggaaataa

SEQ ID NO: 184203 - DNA, 25 bp, Mus musculus
actgtccctcaagttgcctgcagga

SEQ ID NO: 184204 - DNA, 25 bp, Mus musculus
actgtccctcaatgcaaaaaggcca

SEQ ID NO: 184205 - DNA, 25 bp, Mus musculus
actgtccctcaatggcacgctcctg

SEQ ID NO: 184206 - DNA, 25 bp, Mus musculus
actgtccctcaatttcgaggactcc

SEQ ID NO: 184207 - DNA, 25 bp, Mus musculus
actgtccctctatgccaaaaggcca

SEQ ID NO: 184208 - DNA, 25 bp, Mus musculus
actgtccgggggcctcgcctgctcc

SEQ ID NO: 184209 - DNA, 25 bp, Mus musculus
actgtcctcactatgcccgaccctc

SEQ ID NO: 184210 - DNA, 25 bp, Mus musculus
actgtcctcccgggtaaatagctgt

SEQ ID NO: 184211 - DNA, 25 bp, Mus musculus
actgtcctgactatatgatggggct

SEQ ID NO: 184212 - DNA, 25 bp, Mus musculus
actgtcctgatgaggtttatcagct

SEQ ID NO: 184213 - DNA, 25 bp, Mus musculus
actgtcctggaggagagggaagaat

SEQ ID NO: 184214 - DNA, 25 bp, Mus musculus
actgtccttcgggacctgctagaag

SEQ ID NO: 184215 - DNA, 25 bp, Mus musculus
actgtcgaacccctggaattgtgga

SEQ ID NO: 184216 - DNA, 25 bp, Mus musculus
actgtcgacccgacaaaacttacct

SEQ ID NO: 184217 - DNA, 25 bp, Mus musculus
actgtcgacccggaggaggaggagg

SEQ ID NO: 184218 - DNA, 25 bp, Mus musculus
actgtcgagagaagggtttctcatc

SEQ ID NO: 184219 - DNA, 25 bp, Mus musculus
actgtctaccccaggtggcagcctt

SEQ ID NO: 184220 - DNA, 25 bp, Mus musculus
actgtctactggtgccctcccatgt

SEQ ID NO: 184221 - DNA, 25 bp, Mus musculus
actgtctactgttccaccaagggtg

SEQ ID NO: 184222 - DNA, 25 bp, Mus musculus
actgtctatacaactaaaattataa

SEQ ID NO: 184223 - DNA, 25 bp, Mus musculus
actgtctatagacctgcaatgacga

SEQ ID NO: 184224 - DNA, 25 bp, Mus musculus
actgtctcagatcttgtaggactcc

SEQ ID NO: 184225 - DNA, 25 bp, Mus musculus
actgtctccgattttactcctaaaa

SEQ ID NO: 184226 - DNA, 25 bp, Mus musculus
actgtctctgcagaacaacactgaa

SEQ ID NO: 184227 - DNA, 25 bp, Mus musculus
actgtctctgcagagagtcagtcct

SEQ ID NO: 184228 - DNA, 25 bp, Mus musculus
actgtctctgcagagtctgcgagaa

SEQ ID NO: 184229 - DNA, 25 bp, Mus musculus
actgtctctgcagccaaaacaacac

SEQ ID NO: 184230 - DNA, 25 bp, Mus musculus
actgtctctgcagccaaaacaacag

SEQ ID NO: 184231 - DNA, 25 bp, Mus musculus
actgtctctgcaggtaatgaaaagg

SEQ ID NO: 184232 - DNA, 25 bp, Mus musculus
actgtctgaactcacgctcgcctga

SEQ ID NO: 184233 - DNA, 25 bp, Mus musculus
actgtctgccagccaggtgcccagg

SEQ ID NO: 184234 - DNA, 25 bp, Mus musculus
actgtctggaaggtcgctgtgctat

SEQ ID NO: 184235 - DNA, 25 bp, Mus musculus
actgtctgggaggagccacccgcgg

SEQ ID NO: 184236 - DNA, 25 bp, Mus musculus
actgtctggtagcagttggaacaag

SEQ ID NO: 184237 - DNA, 25 bp, Mus musculus
actgtcttcatttagggacaagaag

SEQ ID NO: 184238 - DNA, 25 bp, Mus musculus
actgtcttgagtgtctagctgccag

SEQ ID NO: 184239 - DNA, 25 bp, Mus musculus
actgtctttgcccggaacacacgcc

SEQ ID NO: 184240 - DNA, 25 bp, Mus musculus
actgtcttttctgcccccagctatt

SEQ ID NO: 184241 - DNA, 25 bp, Mus musculus
actgtgaaaaatgagtttggcaaag

SEQ ID NO: 184242 - DNA, 25 bp, Mus musculus
actgtgaaacagacaagcagatggg

SEQ ID NO: 184243 - DNA, 25 bp, Mus musculus
actgtgaaacagggaagcagctggc

SEQ ID NO: 184244 - DNA, 25 bp, Mus musculus
actgtgaaaccgagaccaactacta

SEQ ID NO: 184245 - DNA, 25 bp, Mus musculus
actgtgaaaccggttgttctacaca

SEQ ID NO: 184246 - DNA, 25 bp, Mus musculus
actgtgaaagagttgttatttctag

SEQ ID NO: 184247 - DNA, 25 bp, Mus musculus
actgtgaaagatatgaatttggaca

SEQ ID NO: 184248 - DNA, 25 bp, Mus musculus
actgtgaaagtgtatgagaagttga

SEQ ID NO: 184249 - DNA, 25 bp, Mus musculus
actgtgaacagtatgtctggatttg

SEQ ID NO: 184250 - DNA, 25 bp, Mus musculus
actgtgaacagttcaaattccatca

SEQ ID NO: 184251 - DNA, 25 bp, Mus musculus
actgtgaacagtttaaagcatgcta

SEQ ID NO: 184252 - DNA, 25 bp, Mus musculus
actgtgaacgaagggaacaagtcat

SEQ ID NO: 184253 - DNA, 25 bp, Mus musculus
actgtgaagaaccgacgcagaccct

SEQ ID NO: 184254 - DNA, 25 bp, Mus musculus
actgtgaagatggagagcttcccta

SEQ ID NO: 184255 - DNA, 25 bp, Mus musculus
actgtgaagcgaggtctaagccgac

SEQ ID NO: 184256 - DNA, 25 bp, Mus musculus
actgtgaagcgagtttcagggacac

SEQ ID NO: 184257 - DNA, 25 bp, Mus musculus
actgtgaaggaagccaaagagaaaa

SEQ ID NO: 184258 - DNA, 25 bp, Mus musculus
actgtgaagtgtgccttacatccat

SEQ ID NO: 184259 - DNA, 25 bp, Mus musculus
actgtgaatctaggtgtagaagcca

SEQ ID NO: 184260 - DNA, 25 bp, Mus musculus
actgtgaatgggtgaatttggaagg

SEQ ID NO: 184261 - DNA, 25 bp, Mus musculus
actgtgaatgggttctaacgttcct

SEQ ID NO: 184262 - DNA, 25 bp, Mus musculus
actgtgaatggttaccataccacag

SEQ ID NO: 184263 - DNA, 25 bp, Mus musculus
actgtgaattagatgcaacgtgtaa

SEQ ID NO: 184264 - DNA, 25 bp, Mus musculus
actgtgaattgtagcaccatcccga

SEQ ID NO: 184265 - DNA, 25 bp, Mus musculus
actgtgacaactgtgatgatccggg

SEQ ID NO: 184266 - DNA, 25 bp, Mus musculus
actgtgacaggagggctggcggcac

SEQ ID NO: 184267 - DNA, 25 bp, Mus musculus
actgtgacaggcatcatagctgcga

SEQ ID NO: 184268 - DNA, 25 bp, Mus musculus
actgtgacatcacagctggtgaatg

SEQ ID NO: 184269 - DNA, 25 bp, Mus musculus
actgtgaccactcgtcctgaggtta

SEQ ID NO: 184270 - DNA, 25 bp, Mus musculus
actgtgaccatggtttgggatcaaa

SEQ ID NO: 184271 - DNA, 25 bp, Mus musculus
actgtgacctgcttggttcaactgg

SEQ ID NO: 184272 - DNA, 25 bp, Mus musculus
actgtgactccaaacatccagaacc

SEQ ID NO: 184273 - DNA, 25 bp, Mus musculus
actgtgagaggcagggcttgtcaat

SEQ ID NO: 184274 - DNA, 25 bp, Mus musculus
actgtgagcccacagcaacctcaag

SEQ ID NO: 184275 - DNA, 25 bp, Mus musculus
actgtgagcccacagccttctcatc

SEQ ID NO: 184276 - DNA, 25 bp, Mus musculus
actgtgagctgaagatcctagactt

SEQ ID NO: 184277 - DNA, 25 bp, Mus musculus
actgtgagctggcccagtcctcctc

SEQ ID NO: 184278 - DNA, 25 bp, Mus musculus
actgtgagctggttcacccacccat

SEQ ID NO: 184279 - DNA, 25 bp, Mus musculus
actgtgagtggacatcatcgaaggg

SEQ ID NO: 184280 - DNA, 25 bp, Mus musculus
actgtgatctactgctgagaagagg

SEQ ID NO: 184281 - DNA, 25 bp, Mus musculus
actgtgatctactgtacagagctat

SEQ ID NO: 184282 - DNA, 25 bp, Mus musculus
actgtgatgggtgtacaatagactg

SEQ ID NO: 184283 - DNA, 25 bp, Mus musculus
actgtgattaaagccatcatgttaa

SEQ ID NO: 184284 - DNA, 25 bp, Mus musculus
actgtgcaagaattactacggtagt

SEQ ID NO: 184285 - DNA, 25 bp, Mus musculus
actgtgcaaggaagatctggagaca

SEQ ID NO: 184286 - DNA, 25 bp, Mus musculus
actgtgcactcagccatagattgta

SEQ ID NO: 184287 - DNA, 25 bp, Mus musculus
actgtgcagagccaatatgaagaga

SEQ ID NO: 184288 - DNA, 25 bp, Mus musculus
actgtgcagaggttcacctggtcat

SEQ ID NO: 184289 - DNA, 25 bp, Mus musculus
actgtgcaggttgaaaacgaggctc

SEQ ID NO: 184290 - DNA, 25 bp, Mus musculus
actgtgcatgctgggatagctcagg

SEQ ID NO: 184291 - DNA, 25 bp, Mus musculus
actgtgccatggaagggtctgttcc

SEQ ID NO: 184292 - DNA, 25 bp, Mus musculus
actgtgcccccaagtctgtcttctc

SEQ ID NO: 184293 - DNA, 25 bp, Mus musculus
actgtgcccggaatcccagtcagaa

SEQ ID NO: 184294 - DNA, 25 bp, Mus musculus
actgtgccttcaggctcacccagga

SEQ ID NO: 184295 - DNA, 25 bp, Mus musculus
actgtgcgagaaaaagcggatggtg

SEQ ID NO: 184296 - DNA, 25 bp, Mus musculus
actgtgcgaggcatgctgccccaca

SEQ ID NO: 184297 - DNA, 25 bp, Mus musculus
actgtgcgcaatggatctgtccgtg

SEQ ID NO: 184298 - DNA, 25 bp, Mus musculus
actgtgcggcgagaaggactccatg

SEQ ID NO: 184299 - DNA, 25 bp, Mus musculus
actgtgcggcgagacacaccagaag

SEQ ID NO: 184300 - DNA, 25 bp, Mus musculus
actgtgcggcgagatcccacgggtt

SEQ ID NO: 184301 - DNA, 25 bp, Mus musculus
actgtgctaaaggcccacgttgtgt

SEQ ID NO: 184302 - DNA, 25 bp, Mus musculus
actgtgctaagaggtccagcatgct

SEQ ID NO: 184303 - DNA, 25 bp, Mus musculus
actgtgctaagtgacattgaccagc

SEQ ID NO: 184304 - DNA, 25 bp, Mus musculus
actgtgctaatggcccacgttgtgt

SEQ ID NO: 184305 - DNA, 25 bp, Mus musculus
actgtgcttttcctggaagagtatc

SEQ ID NO: 184306 - DNA, 25 bp, Mus musculus
actgtggaacaggtcccctgttcca

SEQ ID NO: 184307 - DNA, 25 bp, Mus musculus
actgtggaagaaggtggtgatcttc

SEQ ID NO: 184308 - DNA, 25 bp, Mus musculus
actgtggaagattcttgacaagtgc

SEQ ID NO: 184309 - DNA, 25 bp, Mus musculus
actgtggaaggaagtttggcacctg

SEQ ID NO: 184310 - DNA, 25 bp, Mus musculus
actgtggaagtggtcccaaccgagg

SEQ ID NO: 184311 - DNA, 25 bp, Mus musculus
actgtggaagtgtggattctttaag

SEQ ID NO: 184312 - DNA, 25 bp, Mus musculus
actgtggaagtgtggcttcttcaag

SEQ ID NO: 184313 - DNA, 25 bp, Mus musculus
actgtggacctagattcatcagcca

SEQ ID NO: 184314 - DNA, 25 bp, Mus musculus
actgtggacctagggtttctctgta

SEQ ID NO: 184315 - DNA, 25 bp, Mus musculus
actgtggacgaagcaatggcaagcc

SEQ ID NO: 184316 - DNA, 25 bp, Mus musculus
actgtggacgatgctcagaccagtg

SEQ ID NO: 184317 - DNA, 25 bp, Mus musculus
actgtggacgatgtcataaaggaac

SEQ ID NO: 184318 - DNA, 25 bp, Mus musculus
actgtggacgctctgctcatttggg

SEQ ID NO: 184319 - DNA, 25 bp, Mus musculus
actgtggacgctctggtcatccaac

SEQ ID NO: 184320 - DNA, 25 bp, Mus musculus
actgtggacgggattctctgctctt

SEQ ID NO: 184321 - DNA, 25 bp, Mus musculus
actgtggactggagtgagtcagcag

SEQ ID NO: 184322 - DNA, 25 bp, Mus musculus
actgtggagaagggtcaactgctgc

SEQ ID NO: 184323 - DNA, 25 bp, Mus musculus
actgtggagaagggtttcaaagctg

SEQ ID NO: 184324 - DNA, 25 bp, Mus musculus
actgtggagagagatggtatggtgt

SEQ ID NO: 184325 - DNA, 25 bp, Mus musculus
actgtggatggaccagggaaagagt

SEQ ID NO: 184326 - DNA, 25 bp, Mus musculus
actgtggatgggtcagggaaagagt

SEQ ID NO: 184327 - DNA, 25 bp, Mus musculus
actgtggattcaatcgaagatgctg

SEQ ID NO: 184328 - DNA, 25 bp, Mus musculus
actgtggcaccacacgctacaggta

SEQ ID NO: 184329 - DNA, 25 bp, Mus musculus
actgtggcactaaggctggtgttcc

SEQ ID NO: 184330 - DNA, 25 bp, Mus musculus
actgtggcaggtgttcttctggaca

SEQ ID NO: 184331 - DNA, 25 bp, Mus musculus
actgtggcatcagagccaaggctaa

SEQ ID NO: 184332 - DNA, 25 bp, Mus musculus
actgtggccaggtccttcattccag

SEQ ID NO: 184333 - DNA, 25 bp, Mus musculus
actgtggctgggaccaggagctgac

SEQ ID NO: 184334 - DNA, 25 bp, Mus musculus
actgtggcttgccaggtgaatattg

SEQ ID NO: 184335 - DNA, 25 bp, Mus musculus
actgtgggaaagaaggttaacctct

SEQ ID NO: 184336 - DNA, 25 bp, Mus musculus
actgtgggaacaggaacagaatgga

SEQ ID NO: 184337 - DNA, 25 bp, Mus musculus
actgtgggaacaggtattgaagccc

SEQ ID NO: 184338 - DNA, 25 bp, Mus musculus
actgtgggaggaccatccttgctgc

SEQ ID NO: 184339 - DNA, 25 bp, Mus musculus
actgtgggcagaaatccctagccta

SEQ ID NO: 184340 - DNA, 25 bp, Mus musculus
actgtgggccagatctgccacctcc

SEQ ID NO: 184341 - DNA, 25 bp, Mus musculus
actgtgggcccagaccattcccctt

SEQ ID NO: 184342 - DNA, 25 bp, Mus musculus
actgtggggctgcagaccccacgtg

SEQ ID NO: 184343 - DNA, 25 bp, Mus musculus
actgtggggtatccgagtggtgaat

SEQ ID NO: 184344 - DNA, 25 bp, Mus musculus
actgtggggtgtgccttcttcacaa

SEQ ID NO: 184345 - DNA, 25 bp, Mus musculus
actgtggtccgagggctgctggacc

SEQ ID NO: 184346 - DNA, 25 bp, Mus musculus
actgtggtgacaggcattgagatgt

SEQ ID NO: 184347 - DNA, 25 bp, Mus musculus
actgtggtgctaagaggcttcctgg

SEQ ID NO: 184348 - DNA, 25 bp, Mus musculus
actgtggtgctaaggcaacatctgc

SEQ ID NO: 184349 - DNA, 25 bp, Mus musculus
actgtggtgctaaggtggtggagaa

SEQ ID NO: 184350 - DNA, 25 bp, Mus musculus
actgtggttcctgatatgctctctg

SEQ ID NO: 184351 - DNA, 25 bp, Mus musculus
actgtggttggctgggacccacgaa

SEQ ID NO: 184352 - DNA, 25 bp, Mus musculus
actgtggttggtgagcggggcacaa

SEQ ID NO: 184353 - DNA, 25 bp, Mus musculus
actgtgtaaaaggccttaaccatgg

SEQ ID NO: 184354 - DNA, 25 bp, Mus musculus
actgtgtaacccagagatttatttt

SEQ ID NO: 184355 - DNA, 25 bp, Mus musculus
actgtgtacccaggaataaaaccca

SEQ ID NO: 184356 - DNA, 25 bp, Mus musculus
actgtgtacccaggttgtgactaca

SEQ ID NO: 184357 - DNA, 25 bp, Mus musculus
actgtgtatatggacatctggatta

SEQ ID NO: 184358 - DNA, 25 bp, Mus musculus
actgtgtcaggtgtggcccatagag

SEQ ID NO: 184359 - DNA, 25 bp, Mus musculus
actgtgtcgctcctgggaccattta

SEQ ID NO: 184360 - DNA, 25 bp, Mus musculus
actgtgtctaaagggcttctctgcc

SEQ ID NO: 184361 - DNA, 25 bp, Mus musculus
actgtgtctaaaggtaaaacagact

SEQ ID NO: 184362 - DNA, 25 bp, Mus musculus
actgtgtctgaaaaggctcccccac

SEQ ID NO: 184363 - DNA, 25 bp, Mus musculus
actgtgtctgccgtgcgtctcttcc

SEQ ID NO: 184364 - DNA, 25 bp, Mus musculus
actgtgtcttcagtaaatgaagcat

SEQ ID NO: 184365 - DNA, 25 bp, Mus musculus
actgtgtgataaagttggagtcatt

SEQ ID NO: 184366 - DNA, 25 bp, Mus musculus
actgtgtgatgcgggtgcctggcta

SEQ ID NO: 184367 - DNA, 25 bp, Mus musculus
actgtgtgccaaggcgaaagcccat

SEQ ID NO: 184368 - DNA, 25 bp, Mus musculus
actgtgtgccaaggtttgacctgcc

SEQ ID NO: 184369 - DNA, 25 bp, Mus musculus
actgtgtgcggagactgcggcccac

SEQ ID NO: 184370 - DNA, 25 bp, Mus musculus
actgtgtggaagaacccctcagcag

SEQ ID NO: 184371 - DNA, 25 bp, Mus musculus
actgtgtgggtgaaagccggcggga

SEQ ID NO: 184372 - DNA, 25 bp, Mus musculus
actgtgtgtctgcctcgtgcctcaa

SEQ ID NO: 184373 - DNA, 25 bp, Mus musculus
actgtgtgtctggcgtgtgtgtgca

SEQ ID NO: 184374 - DNA, 25 bp, Mus musculus
actgtgtgtcttcagcctcagcttt

SEQ ID NO: 184375 - DNA, 25 bp, Mus musculus
actgtgtgtgccaagtctatatttg

SEQ ID NO: 184376 - DNA, 25 bp, Mus musculus
actgtgtgtgccaagttccatatct

SEQ ID NO: 184377 - DNA, 25 bp, Mus musculus
actgtgtgtggagtgctgacagagg

SEQ ID NO: 184378 - DNA, 25 bp, Mus musculus
actgtgtgtggcatattctcatctg

SEQ ID NO: 184379 - DNA, 25 bp, Mus musculus
actgtgttagatgctcctgaagttt

SEQ ID NO: 184380 - DNA, 25 bp, Mus musculus
actgtgttagttgaacccacagtga

SEQ ID NO: 184381 - DNA, 25 bp, Mus musculus
actgtgttctagactcaagaatgaa

SEQ ID NO: 184382 - DNA, 25 bp, Mus musculus
actgtgttgagcacatcgagtcacg

SEQ ID NO: 184383 - DNA, 25 bp, Mus musculus
actgtgttgaggtcctgagttcaat

SEQ ID NO: 184384 - DNA, 25 bp, Mus musculus
actgtgttgccagaaaaagatcttc

SEQ ID NO: 184385 - DNA, 25 bp, Mus musculus
actgtgttggctcaggagggtgtga

SEQ ID NO: 184386 - DNA, 25 bp, Mus musculus
actgtgtttatggactacaaagaag

SEQ ID NO: 184387 - DNA, 25 bp, Mus musculus
actgtgtttgaggaattattttata

SEQ ID NO: 184388 - DNA, 25 bp, Mus musculus
actgtgtttggagtaacaactgttc

SEQ ID NO: 184389 - DNA, 25 bp, Mus musculus
actgttaacaggacattcgacatga

SEQ ID NO: 184390 - DNA, 25 bp, Mus musculus
actgttaacaggcagcaaacagaaa

SEQ ID NO: 184391 - DNA, 25 bp, Mus musculus
actgttaatagcccacaggtcctgc

SEQ ID NO: 184392 - DNA, 25 bp, Mus musculus
actgttaataggtcctgcctcccaa

SEQ ID NO: 184393 - DNA, 25 bp, Mus musculus
actgttaccaatgcaccttccagcc

SEQ ID NO: 184394 - DNA, 25 bp, Mus musculus
actgttaccggaacagaaatcatcg

SEQ ID NO: 184395 - DNA, 25 bp, Mus musculus
actgttaccggaacggcacgacgcg

SEQ ID NO: 184396 - DNA, 25 bp, Mus musculus
actgttaggaaacagctatataaaa

SEQ ID NO: 184397 - DNA, 25 bp, Mus musculus
actgttaggaaacagggtggactct

SEQ ID NO: 184398 - DNA, 25 bp, Mus musculus
actgttaggaacagcctcaggccct

SEQ ID NO: 184399 - DNA, 25 bp, Mus musculus
actgttaggcaccgtgggcctaacc

SEQ ID NO: 184400 - DNA, 25 bp, Mus musculus
actgttagtgacctgacgttgatgt

SEQ ID NO: 184401 - DNA, 25 bp, Mus musculus
actgttagtgacctgactcctgggt

SEQ ID NO: 184402 - DNA, 25 bp, Mus musculus
actgttatatgcagcagaagatgtc

SEQ ID NO: 184403 - DNA, 25 bp, Mus musculus
actgttattccagcccaggaggaag

SEQ ID NO: 184404 - DNA, 25 bp, Mus musculus
actgttcaaaatcgaacaccaaaca

SEQ ID NO: 184405 - DNA, 25 bp, Mus musculus
actgttcaagaatgccatgagagcg

SEQ ID NO: 184406 - DNA, 25 bp, Mus musculus
actgttcaagctgggaggcaccatt

SEQ ID NO: 184407 - DNA, 25 bp, Mus musculus
actgttcaagttgtcccccatatta

SEQ ID NO: 184408 - DNA, 25 bp, Mus musculus
actgttcaggagatggtaaccaagt

SEQ ID NO: 184409 - DNA, 25 bp, Mus musculus
actgttcagtctcaccggctgggga

SEQ ID NO: 184410 - DNA, 25 bp, Mus musculus
actgttcatgggagaagggcaggtt

SEQ ID NO: 184411 - DNA, 25 bp, Mus musculus
actgttcatgggagaggggtaacta

SEQ ID NO: 184412 - DNA, 25 bp, Mus musculus
actgttccatgtctccaggaaacct

SEQ ID NO: 184413 - DNA, 25 bp, Mus musculus
actgttccattgagatctgtgccgc

SEQ ID NO: 184414 - DNA, 25 bp, Mus musculus
actgttccgcaaggaggtgctggct

SEQ ID NO: 184415 - DNA, 25 bp, Mus musculus
actgttcctacggtttcacaaggta

SEQ ID NO: 184416 - DNA, 25 bp, Mus musculus
actgttcgagaggcctccaacatgg

SEQ ID NO: 184417 - DNA, 25 bp, Mus musculus
actgttctaaaggtgctttccagct

SEQ ID NO: 184418 - DNA, 25 bp, Mus musculus
actgttctacaggctgcggctgtgt

SEQ ID NO: 184419 - DNA, 25 bp, Mus musculus
actgttctctaattttccaggtgcc

SEQ ID NO: 184420 - DNA, 25 bp, Mus musculus
actgttctcttggagttctgacggg

SEQ ID NO: 184421 - DNA, 25 bp, Mus musculus
actgttctgcaggcttgcgagaagg

SEQ ID NO: 184422 - DNA, 25 bp, Mus musculus
actgttcttgatatacatgataatc

SEQ ID NO: 184423 - DNA, 25 bp, Mus musculus
actgttcttgatccataacaaactg

SEQ ID NO: 184424 - DNA, 25 bp, Mus musculus
actgttgaataagttcgtgtgtaag

SEQ ID NO: 184425 - DNA, 25 bp, Mus musculus
actgttgatccacagggatggccac

SEQ ID NO: 184426 - DNA, 25 bp, Mus musculus
actgttgcttcccagaggaagtcac

SEQ ID NO: 184427 - DNA, 25 bp, Mus musculus
actgttgggcttcagcgagaacttt

SEQ ID NO: 184428 - DNA, 25 bp, Mus musculus
actgtttaaggaatcacgcctacgc

SEQ ID NO: 184429 - DNA, 25 bp, Mus musculus
actgtttaaggaatccctcttcggg

SEQ ID NO: 184430 - DNA, 25 bp, Mus musculus
actgtttcaacttctactactaaag

SEQ ID NO: 184431 - DNA, 25 bp, Mus musculus
actgtttccgagaagagtagcagct

SEQ ID NO: 184432 - DNA, 25 bp, Mus musculus
actgtttccgagggtcagataacac

SEQ ID NO: 184433 - DNA, 25 bp, Mus musculus
actgtttcctgaactcggaaggtga

SEQ ID NO: 184434 - DNA, 25 bp, Mus musculus
actgtttcctgatgcttttgggtcg

SEQ ID NO: 184435 - DNA, 25 bp, Mus musculus
actgtttgattccagccataatcgc

SEQ ID NO: 184436 - DNA, 25 bp, Mus musculus
actgtttggagaaatcttcaagacc

SEQ ID NO: 184437 - DNA, 25 bp, Mus musculus
actgtttggaggccaatgaggcgag

SEQ ID NO: 184438 - DNA, 25 bp, Mus musculus
actgttttcacaggaactggtgact

SEQ ID NO: 184439 - DNA, 25 bp, Mus musculus
actgttttctccaggaaggaactca

SEQ ID NO: 184440 - DNA, 25 bp, Mus musculus
actgttttgagagtggagtcaacat

SEQ ID NO: 184441 - DNA, 25 bp, Mus musculus
actgtttttacttcgcggagtgctc

SEQ ID NO: 184442 - DNA, 25 bp, Mus musculus
acttaaaaaggagcttcgacgcacc

SEQ ID NO: 184443 - DNA, 25 bp, Mus musculus
acttaaaaaggtgattgaagcctca

SEQ ID NO: 184444 - DNA, 25 bp, Mus musculus
acttaaaaaggtgtcctcagataga

SEQ ID NO: 184445 - DNA, 25 bp, Mus musculus
acttaaaagatactgagagaagtgt

SEQ ID NO: 184446 - DNA, 25 bp, Mus musculus
acttaaaagatgattcataataccc

SEQ ID NO: 184447 - DNA, 25 bp, Mus musculus
acttaaacataaaggtgactgattt

SEQ ID NO: 184448 - DNA, 25 bp, Mus musculus
acttaaaccagaatgcatacacagc

SEQ ID NO: 184449 - DNA, 25 bp, Mus musculus
acttaaaccaggtttgcatgcagcc

SEQ ID NO: 184450 - DNA, 25 bp, Mus musculus
acttaaatcgggagagtgtgctggg

SEQ ID NO: 184451 - DNA, 25 bp, Mus musculus
acttaaattgagtaggaagagtggt

SEQ ID NO: 184452 - DNA, 25 bp, Mus musculus
acttaacacgaccaggtctcccagt

SEQ ID NO: 184453 - DNA, 25 bp, Mus musculus
acttaacagcaggctctctggagtc

SEQ ID NO: 184454 - DNA, 25 bp, Mus musculus
acttaacagcgttggcctggaacag

SEQ ID NO: 184455 - DNA, 25 bp, Mus musculus
acttaacagtgaaagatttccgagt

SEQ ID NO: 184456 - DNA, 25 bp, Mus musculus
acttaacagtgaggaatgatattgc

SEQ ID NO: 184457 - DNA, 25 bp, Mus musculus
acttaaccaaagaggatatagatct

SEQ ID NO: 184458 - DNA, 25 bp, Mus musculus
acttaactggtatgatcctcatggg

SEQ ID NO: 184459 - DNA, 25 bp, Mus musculus
acttaagcacagaaggtgggactgg

SEQ ID NO: 184460 - DNA, 25 bp, Mus musculus
acttaaggagagctaacatttagag

SEQ ID NO: 184461 - DNA, 25 bp, Mus musculus
acttaaggagagctcacattcaggg

SEQ ID NO: 184462 - DNA, 25 bp, Mus musculus
acttaagtaccacgtgctggacgga

SEQ ID NO: 184463 - DNA, 25 bp, Mus musculus
acttaagtaccaggtgctggacgga

SEQ ID NO: 184464 - DNA, 25 bp, Mus musculus
acttaagttccagtggtaactcata

SEQ ID NO: 184465 - DNA, 25 bp, Mus musculus
acttaatcaccgtcattacccaaac

SEQ ID NO: 184466 - DNA, 25 bp, Mus musculus
acttaatgagtaagtggcttgcagc

SEQ ID NO: 184467 - DNA, 25 bp, Mus musculus
acttaatgcggttacgaagaagagg

SEQ ID NO: 184468 - DNA, 25 bp, Mus musculus
acttaatgtaccagctcaaacaggc

SEQ ID NO: 184469 - DNA, 25 bp, Mus musculus
acttaatgtaccagtgtatctctat

SEQ ID NO: 184470 - DNA, 25 bp, Mus musculus
acttaatgtcagccataacaaactg

SEQ ID NO: 184471 - DNA, 25 bp, Mus musculus
acttaatgtttgtgtgtctaaacag

SEQ ID NO: 184472 - DNA, 25 bp, Mus musculus
acttacaaatcaggagtatacaagc

SEQ ID NO: 184473 - DNA, 25 bp, Mus musculus
acttacaacaacctgaaggagctcc

SEQ ID NO: 184474 - DNA, 25 bp, Mus musculus
acttacaagagcctcaggacagcat

SEQ ID NO: 184475 - DNA, 25 bp, Mus musculus
acttacaagagggggaaggacttga

SEQ ID NO: 184476 - DNA, 25 bp, Mus musculus
acttacaatgggagatgatggccct

SEQ ID NO: 184477 - DNA, 25 bp, Mus musculus
acttacaatgggaggtgctggatag

SEQ ID NO: 184478 - DNA, 25 bp, Mus musculus
acttacaatgggagtgaacacggat

SEQ ID NO: 184479 - DNA, 25 bp, Mus musculus
acttacacaaacagatctttgaggg

SEQ ID NO: 184480 - DNA, 25 bp, Mus musculus
acttacacaaacagtcaaagcagtc

SEQ ID NO: 184481 - DNA, 25 bp, Mus musculus
acttacacacaggctgagggtatcg

SEQ ID NO: 184482 - DNA, 25 bp, Mus musculus
acttacacctcgttttactgcaatc

SEQ ID NO: 184483 - DNA, 25 bp, Mus musculus
acttacacttcaacggtctgagcgc

SEQ ID NO: 184484 - DNA, 25 bp, Mus musculus
acttacacttcaagatgtttgatgt

SEQ ID NO: 184485 - DNA, 25 bp, Mus musculus
acttacagagctatctaaactctgt

SEQ ID NO: 184486 - DNA, 25 bp, Mus musculus
acttacagcacacaggcagaggtgt

SEQ ID NO: 184487 - DNA, 25 bp, Mus musculus
acttacagctattgcgtctgcacca

SEQ ID NO: 184488 - DNA, 25 bp, Mus musculus
acttacaggaagttgtgccagccat

SEQ ID NO: 184489 - DNA, 25 bp, Mus musculus
acttacaggaggttgtgccagccat

SEQ ID NO: 184490 - DNA, 25 bp, Mus musculus
acttacagtaaggggctccacgggc

SEQ ID NO: 184491 - DNA, 25 bp, Mus musculus
acttacatataataagaacctatgg

SEQ ID NO: 184492 - DNA, 25 bp, Mus musculus
acttacatatataaataaataaatc

SEQ ID NO: 184493 - DNA, 25 bp, Mus musculus
acttacatcacggagaatgtactgg

SEQ ID NO: 184494 - DNA, 25 bp, Mus musculus
acttacattcaatgctcagtgctgc

SEQ ID NO: 184495 - DNA, 25 bp, Mus musculus
acttaccaaagaggaattcaagggc

SEQ ID NO: 184496 - DNA, 25 bp, Mus musculus
acttaccagacactaatctgacccc

SEQ ID NO: 184497 - DNA, 25 bp, Mus musculus
acttaccagacactgcacaagggca

SEQ ID NO: 184498 - DNA, 25 bp, Mus musculus
acttaccatagaagtacctcaaatc

SEQ ID NO: 184499 - DNA, 25 bp, Mus musculus
acttaccatagaagttgctcctttg

SEQ ID NO: 184500 - DNA, 25 bp, Mus musculus
acttaccatcataacagcactacca

SEQ ID NO: 184501 - DNA, 25 bp, Mus musculus
acttaccatcataggccagttcaca

SEQ ID NO: 184502 - DNA, 25 bp, Mus musculus
acttaccatgaggatccagcaatgc

SEQ ID NO: 184503 - DNA, 25 bp, Mus musculus
acttaccatggcattgatatgaacc

SEQ ID NO: 184504 - DNA, 25 bp, Mus musculus
acttaccatgggaaggtgtcttgct

SEQ ID NO: 184505 - DNA, 25 bp, Mus musculus
acttaccatgggcttcactgtataa

SEQ ID NO: 184506 - DNA, 25 bp, Mus musculus
acttaccgattctgttcccagttct

SEQ ID NO: 184507 - DNA, 25 bp, Mus musculus
acttacctgagagcactgtggacaa

SEQ ID NO: 184508 - DNA, 25 bp, Mus musculus
acttacctgagcacagttcccagag

SEQ ID NO: 184509 - DNA, 25 bp, Mus musculus
acttacgaagatggctctgactcca

SEQ ID NO: 184510 - DNA, 25 bp, Mus musculus
acttacgaaggaagtggttccagca

SEQ ID NO: 184511 - DNA, 25 bp, Mus musculus
acttacgactacagaagtgacctct

SEQ ID NO: 184512 - DNA, 25 bp, Mus musculus
acttacgagagtatttggaggtaga

SEQ ID NO: 184513 - DNA, 25 bp, Mus musculus
acttacggaagcttggtaatgcagg

SEQ ID NO: 184514 - DNA, 25 bp, Mus musculus
acttactacagctgggcatggcaga

SEQ ID NO: 184515 - DNA, 25 bp, Mus musculus
acttactacaggtggctgcggcttc

SEQ ID NO: 184516 - DNA, 25 bp, Mus musculus
acttactcccaagactctgaggtcc

SEQ ID NO: 184517 - DNA, 25 bp, Mus musculus
acttactcccaagatggctgtctca

SEQ ID NO: 184518 - DNA, 25 bp, Mus musculus
acttactcccaagcccctggacctt

SEQ ID NO: 184519 - DNA, 25 bp, Mus musculus
acttactctggatccaagacacttt

SEQ ID NO: 184520 - DNA, 25 bp, Mus musculus
acttactgaactgatggctgcccaa

SEQ ID NO: 184521 - DNA, 25 bp, Mus musculus
acttacttccctgcaattttgaacc

SEQ ID NO: 184522 - DNA, 25 bp, Mus musculus
acttagaaactcctatcacgctcat

SEQ ID NO: 184523 - DNA, 25 bp, Mus musculus
acttagaaccaccataacacaaaga

SEQ ID NO: 184524 - DNA, 25 bp, Mus musculus
acttagacagacttacaacagctgt

SEQ ID NO: 184525 - DNA, 25 bp, Mus musculus
acttagacagagctgaggaccgaac

SEQ ID NO: 184526 - DNA, 25 bp, Mus musculus
acttagacaggtatccattatgatg

SEQ ID NO: 184527 - DNA, 25 bp, Mus musculus
acttagacaggtgctgccagactca

SEQ ID NO: 184528 - DNA, 25 bp, Mus musculus
acttagagaaggaagggaacatgcc

SEQ ID NO: 184529 - DNA, 25 bp, Mus musculus
acttagaggactagcccactgtgcc

SEQ ID NO: 184530 - DNA, 25 bp, Mus musculus
acttagaggactgtcagaaaaccca

SEQ ID NO: 184531 - DNA, 25 bp, Mus musculus
acttagaggagagccaagttgaagt

SEQ ID NO: 184532 - DNA, 25 bp, Mus musculus
acttagaggaggcacagaccccaca

SEQ ID NO: 184533 - DNA, 25 bp, Mus musculus
acttagcaaaaaagggtctcgtagc

SEQ ID NO: 184534 - DNA, 25 bp, Mus musculus
acttagcaaaaaaggtgttcctcag

SEQ ID NO: 184535 - DNA, 25 bp, Mus musculus
acttagcacgaatgtgtgagaaaac

SEQ ID NO: 184536 - DNA, 25 bp, Mus musculus
acttagcatggcagatgaaccggac

SEQ ID NO: 184537 - DNA, 25 bp, Mus musculus
acttagccgagttcaatctcatccc

SEQ ID NO: 184538 - DNA, 25 bp, Mus musculus
acttaggaaagccccggcagcccaa

SEQ ID NO: 184539 - DNA, 25 bp, Mus musculus
acttaggaggcacatagacatttta

SEQ ID NO: 184540 - DNA, 25 bp, Mus musculus
acttaggcccaaagctctacagact

SEQ ID NO: 184541 - DNA, 25 bp, Mus musculus
acttaggcccaaaggtacagagatg

SEQ ID NO: 184542 - DNA, 25 bp, Mus musculus
acttaggcccaaaggtgttctacac

SEQ ID NO: 184543 - DNA, 25 bp, Mus musculus
acttagggatggagcctcccaagct

SEQ ID NO: 184544 - DNA, 25 bp, Mus musculus
acttagtagacaagggagcatatgc

SEQ ID NO: 184545 - DNA, 25 bp, Mus musculus
acttagtattccaggaaaagatggc

SEQ ID NO: 184546 - DNA, 25 bp, Mus musculus
acttagtgagtgtgtcccttcttta

SEQ ID NO: 184547 - DNA, 25 bp, Mus musculus
acttagtgcggctgtgtggagatgg

SEQ ID NO: 184548 - DNA, 25 bp, Mus musculus
acttagttggacagagctggcaagg

SEQ ID NO: 184549 - DNA, 25 bp, Mus musculus
acttagttggtcgaccgcccctgct

SEQ ID NO: 184550 - DNA, 25 bp, Mus musculus
acttataaaagacggcatccagctc

SEQ ID NO: 184551 - DNA, 25 bp, Mus musculus
acttataaagatgattatagatctt

SEQ ID NO: 184552 - DNA, 25 bp, Mus musculus
acttataagagagatgctaacattt

SEQ ID NO: 184553 - DNA, 25 bp, Mus musculus
acttataagagaggtagaaatgggt

SEQ ID NO: 184554 - DNA, 25 bp, Mus musculus
acttatatatgacattatgcagaat

SEQ ID NO: 184555 - DNA, 25 bp, Mus musculus
acttatcaaaggtgtggcccaccag

SEQ ID NO: 184556 - DNA, 25 bp, Mus musculus
acttatccagagttgtttcttgaga

SEQ ID NO: 184557 - DNA, 25 bp, Mus musculus
acttatccagatcacctcagcatct

SEQ ID NO: 184558 - DNA, 25 bp, Mus musculus
acttatccaggctgaataaaaatca

SEQ ID NO: 184559 - DNA, 25 bp, Mus musculus
acttatccagggtgtattgagaatc

SEQ ID NO: 184560 - DNA, 25 bp, Mus musculus
acttatccccaacagcgggaacttc

SEQ ID NO: 184561 - DNA, 25 bp, Mus musculus
acttatccccaacaggtggtgaagc

SEQ ID NO: 184562 - DNA, 25 bp, Mus musculus
acttatccctgtcctctacagcctg

SEQ ID NO: 184563 - DNA, 25 bp, Mus musculus
acttatcggaaatggtgaagcaaat

SEQ ID NO: 184564 - DNA, 25 bp, Mus musculus
acttatgaagatcccacataccatt

SEQ ID NO: 184565 - DNA, 25 bp, Mus musculus
acttatgaaggtccttcagtagcct

SEQ ID NO: 184566 - DNA, 25 bp, Mus musculus
acttatgacatgatgatgcagtccc

SEQ ID NO: 184567 - DNA, 25 bp, Mus musculus
acttatgacctgatggccaacttag

SEQ ID NO: 184568 - DNA, 25 bp, Mus musculus
acttatgacctggcagaacagcttt

SEQ ID NO: 184569 - DNA, 25 bp, Mus musculus
acttatgagactggagagacgagag

SEQ ID NO: 184570 - DNA, 25 bp, Mus musculus
acttatgagactggatctctttcct

SEQ ID NO: 184571 - DNA, 25 bp, Mus musculus
acttatggagcggcactggagcaaa

SEQ ID NO: 184572 - DNA, 25 bp, Mus musculus
acttatggagcggtcgtgtatcagg

SEQ ID NO: 184573 - DNA, 25 bp, Mus musculus
acttatggcaggtccaaacatcaca

SEQ ID NO: 184574 - DNA, 25 bp, Mus musculus
acttatgggatatcttcagaaaaaa

SEQ ID NO: 184575 - DNA, 25 bp, Mus musculus
acttattaaggtcacagtaatgaaa

SEQ ID NO: 184576 - DNA, 25 bp, Mus musculus
acttattattcaagattaaaccaga

SEQ ID NO: 184577 - DNA, 25 bp, Mus musculus
acttattcaaagactcctggaagta

SEQ ID NO: 184578 - DNA, 25 bp, Mus musculus
acttattcaaagttgtccgtgtaat

SEQ ID NO: 184579 - DNA, 25 bp, Mus musculus
acttattcagagatttcctctgaga

SEQ ID NO: 184580 - DNA, 25 bp, Mus musculus
acttcaaaaaagatggtttttgatc

SEQ ID NO: 184581 - DNA, 25 bp, Mus musculus
acttcaaaaattaagtgtctctgcc

SEQ ID NO: 184582 - DNA, 25 bp, Mus musculus
acttcaaaaattaagttagctgaca

SEQ ID NO: 184583 - DNA, 25 bp, Mus musculus
acttcaaacagcggatcactgcaga

SEQ ID NO: 184584 - DNA, 25 bp, Mus musculus
acttcaaacccagctctgcatgccc

SEQ ID NO: 184585 - DNA, 25 bp, Mus musculus
acttcaaacccagggcaagacagac

SEQ ID NO: 184586 - DNA, 25 bp, Mus musculus
acttcaaagagcagcctctattaag

SEQ ID NO: 184587 - DNA, 25 bp, Mus musculus
acttcaaagatctgtgaagttcatt

SEQ ID NO: 184588 - DNA, 25 bp, Mus musculus
acttcaaaggagtgtcactactcca

SEQ ID NO: 184589 - DNA, 25 bp, Mus musculus
acttcaaatggacccataactggtg

SEQ ID NO: 184590 - DNA, 25 bp, Mus musculus
acttcaaatgggaagaagatggaca

SEQ ID NO: 184591 - DNA, 25 bp, Mus musculus
acttcaaatggggagggtagacctg

SEQ ID NO: 184592 - DNA, 25 bp, Mus musculus
acttcaacaaggtaatgcaggtggt

SEQ ID NO: 184593 - DNA, 25 bp, Mus musculus
acttcaacaggactcatttcacctg

SEQ ID NO: 184594 - DNA, 25 bp, Mus musculus
acttcaacagttatcagagactgct

SEQ ID NO: 184595 - DNA, 25 bp, Mus musculus
acttcaaccagcgaattcagcttgc

SEQ ID NO: 184596 - DNA, 25 bp, Mus musculus
acttcaaccagtgtttgtcagcaga

SEQ ID NO: 184597 - DNA, 25 bp, Mus musculus
acttcaaccgaagtgagtccattcg

SEQ ID NO: 184598 - DNA, 25 bp, Mus musculus
acttcaaccgagttgagtccattcg

SEQ ID NO: 184599 - DNA, 25 bp, Mus musculus
acttcaacctctaaaagcccgattt

SEQ ID NO: 184600 - DNA, 25 bp, Mus musculus
acttcaacctctatgtgacggacgc

SEQ ID NO: 184601 - DNA, 25 bp, Mus musculus
acttcaactccaggcctctagactg

SEQ ID NO: 184602 - DNA, 25 bp, Mus musculus
acttcaactccaggtatctccacag

SEQ ID NO: 184603 - DNA, 25 bp, Mus musculus
acttcaagaaaggtttcagactgaa

SEQ ID NO: 184604 - DNA, 25 bp, Mus musculus
acttcaagaacaagtatgaggatga

SEQ ID NO: 184605 - DNA, 25 bp, Mus musculus
acttcaagaagcatacagtttcttg

SEQ ID NO: 184606 - DNA, 25 bp, Mus musculus
acttcaagaagtaccagtacatatc

SEQ ID NO: 184607 - DNA, 25 bp, Mus musculus
acttcaagccaaaaggtgaaacctc

SEQ ID NO: 184608 - DNA, 25 bp, Mus musculus
acttcaagcccagctatgggacccc

SEQ ID NO: 184609 - DNA, 25 bp, Mus musculus
acttcaagcccagtcttgcctccag

SEQ ID NO: 184610 - DNA, 25 bp, Mus musculus
acttcaaggaaggaatcttttgtgt

SEQ ID NO: 184611 - DNA, 25 bp, Mus musculus
acttcaaggaggtttgcggggagca

SEQ ID NO: 184612 - DNA, 25 bp, Mus musculus
acttcaagggcggaggtgagtgcag

SEQ ID NO: 184613 - DNA, 25 bp, Mus musculus
acttcaataatgatttccagggtag

SEQ ID NO: 184614 - DNA, 25 bp, Mus musculus
acttcaataatgtggtgaaaacaac

SEQ ID NO: 184615 - DNA, 25 bp, Mus musculus
acttcaatcaagtttttgcagcctg

SEQ ID NO: 184616 - DNA, 25 bp, Mus musculus
acttcaatgaattcctgttccgcca

SEQ ID NO: 184617 - DNA, 25 bp, Mus musculus
acttcacaacaaaccgagaaaggaa

SEQ ID NO: 184618 - DNA, 25 bp, Mus musculus
acttcacaagaaattaccatggttg

SEQ ID NO: 184619 - DNA, 25 bp, Mus musculus
acttcacaatggccaaagatgagag

SEQ ID NO: 184620 - DNA, 25 bp, Mus musculus
acttcacaatggccagaaagaagac

SEQ ID NO: 184621 - DNA, 25 bp, Mus musculus
acttcacacacatttaccttcagtg

SEQ ID NO: 184622 - DNA, 25 bp, Mus musculus
acttcacaccaggagagcactgtga

SEQ ID NO: 184623 - DNA, 25 bp, Mus musculus
acttcacaccagtcttcgctgatag

SEQ ID NO: 184624 - DNA, 25 bp, Mus musculus
acttcacactgttccaggctttacc

SEQ ID NO: 184625 - DNA, 25 bp, Mus musculus
acttcacagacttctacctggtgat

SEQ ID NO: 184626 - DNA, 25 bp, Mus musculus
acttcacagagaaatattactggaa

SEQ ID NO: 184627 - DNA, 25 bp, Mus musculus
acttcacagagagcatgtgaccgac

SEQ ID NO: 184628 - DNA, 25 bp, Mus musculus
acttcacagtgcctggacaggtcct

SEQ ID NO: 184629 - DNA, 25 bp, Mus musculus
acttcacagtgcctggtgtcgagga

SEQ ID NO: 184630 - DNA, 25 bp, Mus musculus
acttcacagtggaaggacattccca

SEQ ID NO: 184631 - DNA, 25 bp, Mus musculus
acttcaccacagtgtttacaaaata

SEQ ID NO: 184632 - DNA, 25 bp, Mus musculus
acttcaccatagaaaacgggagtga

SEQ ID NO: 184633 - DNA, 25 bp, Mus musculus
acttcaccatgcttataggagacag

SEQ ID NO: 184634 - DNA, 25 bp, Mus musculus
acttcacccgaggcaaaggtccact

SEQ ID NO: 184635 - DNA, 25 bp, Mus musculus
acttcaccgcacggaatgacatcac

SEQ ID NO: 184636 - DNA, 25 bp, Mus musculus
acttcacctaccaggaccctgtcct

SEQ ID NO: 184637 - DNA, 25 bp, Mus musculus
acttcacctcgccaggctgcctaaa

SEQ ID NO: 184638 - DNA, 25 bp, Mus musculus
acttcacctcgccagggtgcactcg

SEQ ID NO: 184639 - DNA, 25 bp, Mus musculus
acttcacctcttttggcaatgagga

SEQ ID NO: 184640 - DNA, 25 bp, Mus musculus
acttcactaaagcaaaaatcgtgct

SEQ ID NO: 184641 - DNA, 25 bp, Mus musculus
acttcactacacaacatgcctaacc

SEQ ID NO: 184642 - DNA, 25 bp, Mus musculus
acttcactccctgaaaaatcgagtt

SEQ ID NO: 184643 - DNA, 25 bp, Mus musculus
acttcactccctgcagtctcgaatg

SEQ ID NO: 184644 - DNA, 25 bp, Mus musculus
acttcagaaacagacctcgatgcag

SEQ ID NO: 184645 - DNA, 25 bp, Mus musculus
acttcagaaacatctcctttcagcc

SEQ ID NO: 184646 - DNA, 25 bp, Mus musculus
acttcagaaatgggacactacacag

SEQ ID NO: 184647 - DNA, 25 bp, Mus musculus
acttcagaaattgtgaaggttcccc

SEQ ID NO: 184648 - DNA, 25 bp, Mus musculus
acttcagaaccaggtgaccaacgcc

SEQ ID NO: 184649 - DNA, 25 bp, Mus musculus
acttcagaagataccatctatgtct

SEQ ID NO: 184650 - DNA, 25 bp, Mus musculus
acttcagaaggaataaaagctgtgg

SEQ ID NO: 184651 - DNA, 25 bp, Mus musculus
acttcagaatgaagtatgagaatga

SEQ ID NO: 184652 - DNA, 25 bp, Mus musculus
acttcagacaccaggaagcccctga

SEQ ID NO: 184653 - DNA, 25 bp, Mus musculus
acttcagactcaagtacgaaaacga

SEQ ID NO: 184654 - DNA, 25 bp, Mus musculus
acttcagagcaaagatttctgctgg

SEQ ID NO: 184655 - DNA, 25 bp, Mus musculus
acttcagagctgaagccagcaagcc

SEQ ID NO: 184656 - DNA, 25 bp, Mus musculus
acttcagagctgaaggctattctag

SEQ ID NO: 184657 - DNA, 25 bp, Mus musculus
acttcagaggctgggcaaagtcctt

SEQ ID NO: 184658 - DNA, 25 bp, Mus musculus
acttcagcaaaggcacacaccgagg

SEQ ID NO: 184659 - DNA, 25 bp, Mus musculus
acttcagcaagatgaagacatcccg

SEQ ID NO: 184660 - DNA, 25 bp, Mus musculus
acttcagcaagatgagtcgaaagga

SEQ ID NO: 184661 - DNA, 25 bp, Mus musculus
acttcagcaaggaccataattttga

SEQ ID NO: 184662 - DNA, 25 bp, Mus musculus
acttcagcaccagatccctgctgtc

SEQ ID NO: 184663 - DNA, 25 bp, Mus musculus
acttcagcagagactccaagaagca

SEQ ID NO: 184664 - DNA, 25 bp, Mus musculus
acttcagcaggtccctgcatcccta

SEQ ID NO: 184665 - DNA, 25 bp, Mus musculus
acttcagcctaccaggtacaaccac

SEQ ID NO: 184666 - DNA, 25 bp, Mus musculus
acttcagctgaaaaacattggattg

SEQ ID NO: 184667 - DNA, 25 bp, Mus musculus
acttcagcttatcaggtgcccagat

SEQ ID NO: 184668 - DNA, 25 bp, Mus musculus
acttcaggaaattcactgagggcca

SEQ ID NO: 184669 - DNA, 25 bp, Mus musculus
acttcaggaagctgatgaagagttt

SEQ ID NO: 184670 - DNA, 25 bp, Mus musculus
acttcaggaccaagtatgagtcaga

SEQ ID NO: 184671 - DNA, 25 bp, Mus musculus
acttcagggaaccaggatgagattc

SEQ ID NO: 184672 - DNA, 25 bp, Mus musculus
acttcagggaaggacctctccgagc

SEQ ID NO: 184673 - DNA, 25 bp, Mus musculus
acttcagggaagttttgctccagac

SEQ ID NO: 184674 - DNA, 25 bp, Mus musculus
acttcagtccaagatatgagaacca

SEQ ID NO: 184675 - DNA, 25 bp, Mus musculus
acttcagtccaagattgcccaatga

SEQ ID NO: 184676 - DNA, 25 bp, Mus musculus
acttcagtcccagaagccaaacacc

SEQ ID NO: 184677 - DNA, 25 bp, Mus musculus
acttcagtcctggtgaactgtccat

SEQ ID NO: 184678 - DNA, 25 bp, Mus musculus
acttcagtcctggtggtccccagca

SEQ ID NO: 184679 - DNA, 25 bp, Mus musculus
acttcagtgaaggtaatggaaaagg

SEQ ID NO: 184680 - DNA, 25 bp, Mus musculus
acttcagtgaggatggattcctgaa

SEQ ID NO: 184681 - DNA, 25 bp, Mus musculus
acttcagtgcttatccctctgaaga

SEQ ID NO: 184682 - DNA, 25 bp, Mus musculus
acttcagtggggcgtctccgctggc

SEQ ID NO: 184683 - DNA, 25 bp, Mus musculus
acttcataaatatccttttatcttg

SEQ ID NO: 184684 - DNA, 25 bp, Mus musculus
acttcatagggcggtcagctcacta

SEQ ID NO: 184685 - DNA, 25 bp, Mus musculus
acttcatcaaagagtgtggcctgct

SEQ ID NO: 184686 - DNA, 25 bp, Mus musculus
acttcatcaacagagctggcatgtt

SEQ ID NO: 184687 - DNA, 25 bp, Mus musculus
acttcatcaataggaagaagagaga

SEQ ID NO: 184688 - DNA, 25 bp, Mus musculus
acttcatcaatatgaagagtgtcag

SEQ ID NO: 184689 - DNA, 25 bp, Mus musculus
acttcatccccaaggggacaaatgt

SEQ ID NO: 184690 - DNA, 25 bp, Mus musculus
acttcatccgaaaggcacagtgttc

SEQ ID NO: 184691 - DNA, 25 bp, Mus musculus
acttcatccgaaagggactcctcta

SEQ ID NO: 184692 - DNA, 25 bp, Mus musculus
acttcatcgccaatgctgacttgga

SEQ ID NO: 184693 - DNA, 25 bp, Mus musculus
acttcatctgtgtgggaacgtgttc

SEQ ID NO: 184694 - DNA, 25 bp, Mus musculus
acttcatgataagaaccaacttctt

SEQ ID NO: 184695 - DNA, 25 bp, Mus musculus
acttcatgataagggaagaagacat

SEQ ID NO: 184696 - DNA, 25 bp, Mus musculus
acttcatgtcaacaaagtccaaggt

SEQ ID NO: 184697 - DNA, 25 bp, Mus musculus
acttcattaagcagaggtgacagct

SEQ ID NO: 184698 - DNA, 25 bp, Mus musculus
acttcattccccagactaggctgtc

SEQ ID NO: 184699 - DNA, 25 bp, Mus musculus
acttcattgaccaggagctgtccag

SEQ ID NO: 184700 - DNA, 25 bp, Mus musculus
acttcattgaccataacacaaagac

SEQ ID NO: 184701 - DNA, 25 bp, Mus musculus
acttcattgatcataatacgaagac

SEQ ID NO: 184702 - DNA, 25 bp, Mus musculus
acttcattggccccagagcagcaga

SEQ ID NO: 184703 - DNA, 25 bp, Mus musculus
acttccaaaaggagactttctgcac

SEQ ID NO: 184704 - DNA, 25 bp, Mus musculus
acttccaaaatgataaactttataa

SEQ ID NO: 184705 - DNA, 25 bp, Mus musculus
acttccaaagtgggatccggcactg

SEQ ID NO: 184706 - DNA, 25 bp, Mus musculus
acttccaacaagaggaaaaagctat

SEQ ID NO: 184707 - DNA, 25 bp, Mus musculus
acttccaacaggttgactacagtca

SEQ ID NO: 184708 - DNA, 25 bp, Mus musculus
acttccaagccaactaagaagatcg

SEQ ID NO: 184709 - DNA, 25 bp, Mus musculus
acttccaagtctgagtgtggataag

SEQ ID NO: 184710 - DNA, 25 bp, Mus musculus
acttccaatgcagcctgtggcatct

SEQ ID NO: 184711 - DNA, 25 bp, Mus musculus
acttccacaagaaatttgccccgcg

SEQ ID NO: 184712 - DNA, 25 bp, Mus musculus
acttccacagatctgcagactctca

SEQ ID NO: 184713 - DNA, 25 bp, Mus musculus
acttccacagccagaaaagaaaaag

SEQ ID NO: 184714 - DNA, 25 bp, Mus musculus
acttccacagcccagaaaagaaaaa

SEQ ID NO: 184715 - DNA, 25 bp, Mus musculus
acttccacaggacctataagaacag

SEQ ID NO: 184716 - DNA, 25 bp, Mus musculus
acttccacatcctgactccgttcaa

SEQ ID NO: 184717 - DNA, 25 bp, Mus musculus
acttccaccaaggcctcctatcttt

SEQ ID NO: 184718 - DNA, 25 bp, Mus musculus
acttccaccaaggtatggtgtggaa

SEQ ID NO: 184719 - DNA, 25 bp, Mus musculus
acttccaccgacctgatcaagggat

SEQ ID NO: 184720 - DNA, 25 bp, Mus musculus
acttccaccttcagcaacaacactt

SEQ ID NO: 184721 - DNA, 25 bp, Mus musculus
acttccagaaggatctgaaagccaa

SEQ ID NO: 184722 - DNA, 25 bp, Mus musculus
acttccagagcaatggcacggaatg

SEQ ID NO: 184723 - DNA, 25 bp, Mus musculus
acttccagatgatgttgatcctgtc

SEQ ID NO: 184724 - DNA, 25 bp, Mus musculus
acttccagcaaccagcacccggcag

SEQ ID NO: 184725 - DNA, 25 bp, Mus musculus
acttccagcccaggtgctggggccc

SEQ ID NO: 184726 - DNA, 25 bp, Mus musculus
acttccataattgtgtggattcttt

SEQ ID NO: 184727 - DNA, 25 bp, Mus musculus
acttccatatcagctggaaggacgg

SEQ ID NO: 184728 - DNA, 25 bp, Mus musculus
acttccatgaaggcattgtcgccag

SEQ ID NO: 184729 - DNA, 25 bp, Mus musculus
acttccatgaaggcctgcgggccct

SEQ ID NO: 184730 - DNA, 25 bp, Mus musculus
acttccatgaaggcgagcctgtcag

SEQ ID NO: 184731 - DNA, 25 bp, Mus musculus
acttccatgtccaggttttcccatc

SEQ ID NO: 184732 - DNA, 25 bp, Mus musculus
acttcccaaacaggtgcagttaaaa

SEQ ID NO: 184733 - DNA, 25 bp, Mus musculus
acttcccaagacagcattttccccg

SEQ ID NO: 184734 - DNA, 25 bp, Mus musculus
acttcccaaggcactgtgcttgcac

SEQ ID NO: 184735 - DNA, 25 bp, Mus musculus
acttcccacagaggttgaaatgggc

SEQ ID NO: 184736 - DNA, 25 bp, Mus musculus
acttcccagatgctggcttggagat

SEQ ID NO: 184737 - DNA, 25 bp, Mus musculus
acttcccagatggcgaatactgggt

SEQ ID NO: 184738 - DNA, 25 bp, Mus musculus
acttcccagggaggtcagcacctcg

SEQ ID NO: 184739 - DNA, 25 bp, Mus musculus
acttcccaggtgcagcctctaggtc

SEQ ID NO: 184740 - DNA, 25 bp, Mus musculus
acttccccaaattcctgtccatgct

SEQ ID NO: 184741 - DNA, 25 bp, Mus musculus
acttccccacctgggaaaagatgcc

SEQ ID NO: 184742 - DNA, 25 bp, Mus musculus
acttccccacgatctccctggagtt

SEQ ID NO: 184743 - DNA, 25 bp, Mus musculus
acttccccacggaagacggcgctgg

SEQ ID NO: 184744 - DNA, 25 bp, Mus musculus
acttccccctagaagtggccctgcc

SEQ ID NO: 184745 - DNA, 25 bp, Mus musculus
acttcccctcctgaagctgattggc

SEQ ID NO: 184746 - DNA, 25 bp, Mus musculus
acttcccctcggatgcagatgggaa

SEQ ID NO: 184747 - DNA, 25 bp, Mus musculus
acttccccttcagctcttggggtga

SEQ ID NO: 184748 - DNA, 25 bp, Mus musculus
acttccccttcaggagtcgctttcc

SEQ ID NO: 184749 - DNA, 25 bp, Mus musculus
acttccccttcaggcctgccttttt

SEQ ID NO: 184750 - DNA, 25 bp, Mus musculus
acttccctctagatttgatcaaaaa

SEQ ID NO: 184751 - DNA, 25 bp, Mus musculus
acttccctgagctcaccatggaggt

SEQ ID NO: 184752 - DNA, 25 bp, Mus musculus
acttccctgcaattttgaacccacc

SEQ ID NO: 184753 - DNA, 25 bp, Mus musculus
acttccctggatcaataagtcggag

SEQ ID NO: 184754 - DNA, 25 bp, Mus musculus
acttcccttagaatgtgattttttc

SEQ ID NO: 184755 - DNA, 25 bp, Mus musculus
acttccgagcgggggaacctgattt

SEQ ID NO: 184756 - DNA, 25 bp, Mus musculus
acttccgccaggtctcagttgtggc

SEQ ID NO: 184757 - DNA, 25 bp, Mus musculus
acttccggcagaggtatcgcatcct

SEQ ID NO: 184758 - DNA, 25 bp, Mus musculus
acttccggcagctccgtaaccgcct

SEQ ID NO: 184759 - DNA, 25 bp, Mus musculus
acttccggctgacgggctcctcccc

SEQ ID NO: 184760 - DNA, 25 bp, Mus musculus
acttccgtggtgggattttcctgtg

SEQ ID NO: 184761 - DNA, 25 bp, Mus musculus
acttcctaaaaggtaaagcaccgtg

SEQ ID NO: 184762 - DNA, 25 bp, Mus musculus
acttcctaccacagggtctgtacca

SEQ ID NO: 184763 - DNA, 25 bp, Mus musculus
acttcctccagaagaagactcctac

SEQ ID NO: 184764 - DNA, 25 bp, Mus musculus
acttcctccagacagcctggcaggc

SEQ ID NO: 184765 - DNA, 25 bp, Mus musculus
acttcctccagctgcagaatctgtg

SEQ ID NO: 184766 - DNA, 25 bp, Mus musculus
acttcctccaggactggacagtaag

SEQ ID NO: 184767 - DNA, 25 bp, Mus musculus
acttcctcgaggcctacaattcaaa

SEQ ID NO: 184768 - DNA, 25 bp, Mus musculus
acttcctctggactctgtgaaggga

SEQ ID NO: 184769 - DNA, 25 bp, Mus musculus
acttcctctgtggaaggactctgtg

SEQ ID NO: 184770 - DNA, 25 bp, Mus musculus
acttcctctttagaacctgggtgtg

SEQ ID NO: 184771 - DNA, 25 bp, Mus musculus
acttcctgaaagatgatggcgtgag

SEQ ID NO: 184772 - DNA, 25 bp, Mus musculus
acttcctgaagatcaaagacgcctt

SEQ ID NO: 184773 - DNA, 25 bp, Mus musculus
acttcctgagctttctatcggaagg

SEQ ID NO: 184774 - DNA, 25 bp, Mus musculus
acttcctgaggatgttgatccaggt

SEQ ID NO: 184775 - DNA, 25 bp, Mus musculus
acttcctgccacctggagatggtgt

SEQ ID NO: 184776 - DNA, 25 bp, Mus musculus
acttcctgctgcaggctctggtcca

SEQ ID NO: 184777 - DNA, 25 bp, Mus musculus
acttcctggatgcgttaagatctcc

SEQ ID NO: 184778 - DNA, 25 bp, Mus musculus
acttcctgtccagagagaacattat

SEQ ID NO: 184779 - DNA, 25 bp, Mus musculus
acttcctgtccaggagagaacacaa

SEQ ID NO: 184780 - DNA, 25 bp, Mus musculus
acttccttatctaacagtgtcattc

SEQ ID NO: 184781 - DNA, 25 bp, Mus musculus
acttccttatctatttttcatcatc

SEQ ID NO: 184782 - DNA, 25 bp, Mus musculus
acttccttcagggccactgatgacc

SEQ ID NO: 184783 - DNA, 25 bp, Mus musculus
acttccttcaggtgttagagataga

SEQ ID NO: 184784 - DNA, 25 bp, Mus musculus
acttcgaaactggagggctctctgg

SEQ ID NO: 184785 - DNA, 25 bp, Mus musculus
acttcgaaactggaggtgacccctg

SEQ ID NO: 184786 - DNA, 25 bp, Mus musculus
acttcgaaactggagttacctcgct

SEQ ID NO: 184787 - DNA, 25 bp, Mus musculus
acttcgacaggggaatctggtcggc

SEQ ID NO: 184788 - DNA, 25 bp, Mus musculus
acttcgacagtattccggaacctgt

SEQ ID NO: 184789 - DNA, 25 bp, Mus musculus
acttcgacgaactccaggatgtgtt

SEQ ID NO: 184790 - DNA, 25 bp, Mus musculus
acttcgagcaggacaatcccagaac

SEQ ID NO: 184791 - DNA, 25 bp, Mus musculus
acttcgaggaatgtttaaatgggtg

SEQ ID NO: 184792 - DNA, 25 bp, Mus musculus
acttcgaggacgattacgtgcactc

SEQ ID NO: 184793 - DNA, 25 bp, Mus musculus
acttcgagggcagagagtctcgctc

SEQ ID NO: 184794 - DNA, 25 bp, Mus musculus
acttcgagggcagagttaatgttcg

SEQ ID NO: 184795 - DNA, 25 bp, Mus musculus
acttcgcacaggtgcaggtgtccgg

SEQ ID NO: 184796 - DNA, 25 bp, Mus musculus
acttcgcataggagagcgggctgag

SEQ ID NO: 184797 - DNA, 25 bp, Mus musculus
acttcgcattgcctgctccccacac

SEQ ID NO: 184798 - DNA, 25 bp, Mus musculus
acttcgccaggtcctagagtcgcgg

SEQ ID NO: 184799 - DNA, 25 bp, Mus musculus
acttcgctgctgaggtcgtacaccc

SEQ ID NO: 184800 - DNA, 25 bp, Mus musculus
acttcggactaggggctctgagaca

SEQ ID NO: 184801 - DNA, 25 bp, Mus musculus
acttcggcaagttggagtgcttaat

SEQ ID NO: 184802 - DNA, 25 bp, Mus musculus
acttcgggaccaggtctcctgttct

SEQ ID NO: 184803 - DNA, 25 bp, Mus musculus
acttcgggaggaattatgcttcagc

SEQ ID NO: 184804 - DNA, 25 bp, Mus musculus
acttcgggagggatgtactgagctg

SEQ ID NO: 184805 - DNA, 25 bp, Mus musculus
acttcgggcactgagcaccagtttt

SEQ ID NO: 184806 - DNA, 25 bp, Mus musculus
acttcggggaggacagggtaacagt

SEQ ID NO: 184807 - DNA, 25 bp, Mus musculus
acttcggggaggtggccaagcagga

SEQ ID NO: 184808 - DNA, 25 bp, Mus musculus
acttcgtagaagtgttaaatgaata

SEQ ID NO: 184809 - DNA, 25 bp, Mus musculus
acttcgtcctggatcttcctgccca

SEQ ID NO: 184810 - DNA, 25 bp, Mus musculus
acttcgtcctgtcagtggtgcagtc

SEQ ID NO: 184811 - DNA, 25 bp, Mus musculus
acttcgtcgttccgccgccaccatg

SEQ ID NO: 184812 - DNA, 25 bp, Mus musculus
acttcgtctaccaagctgttccacg

SEQ ID NO: 184813 - DNA, 25 bp, Mus musculus
acttcgtctaccaaggagaggaacg

SEQ ID NO: 184814 - DNA, 25 bp, Mus musculus
acttcgtgcaggtgacccggtttgg

SEQ ID NO: 184815 - DNA, 25 bp, Mus musculus
acttcgtgcagtgactccactggct

SEQ ID NO: 184816 - DNA, 25 bp, Mus musculus
acttcgtggaggtcctggaccttta

SEQ ID NO: 184817 - DNA, 25 bp, Mus musculus
acttcgtggaggtcctggtggccca

SEQ ID NO: 184818 - DNA, 25 bp, Mus musculus
acttctaaacagaattctgattttt

SEQ ID NO: 184819 - DNA, 25 bp, Mus musculus
acttctaaacagatggatttactgc

SEQ ID NO: 184820 - DNA, 25 bp, Mus musculus
acttctacaaaggaagtaaccagga

SEQ ID NO: 184821 - DNA, 25 bp, Mus musculus
acttctacaagccaggagccatgcg

SEQ ID NO: 184822 - DNA, 25 bp, Mus musculus
acttctacaggtttccgtggacgat

SEQ ID NO: 184823 - DNA, 25 bp, Mus musculus
acttctacagttacccagctgtgtg

SEQ ID NO: 184824 - DNA, 25 bp, Mus musculus
acttctacattaggcaaatcaacaa

SEQ ID NO: 184825 - DNA, 25 bp, Mus musculus
acttctaccaggcggaagatggaca

SEQ ID NO: 184826 - DNA, 25 bp, Mus musculus
acttctacccgacagacatacttcc

SEQ ID NO: 184827 - DNA, 25 bp, Mus musculus
acttctacccgacagggtgtgaaca

SEQ ID NO: 184828 - DNA, 25 bp, Mus musculus
acttctactcctcgctgagcacctc

SEQ ID NO: 184829 - DNA, 25 bp, Mus musculus
acttctagtaaaagtgtcctagatg

SEQ ID NO: 184830 - DNA, 25 bp, Mus musculus
acttctatatgacagactccattag

SEQ ID NO: 184831 - DNA, 25 bp, Mus musculus
acttctatatgacagggcttctggt

SEQ ID NO: 184832 - DNA, 25 bp, Mus musculus
acttctatgcaggcacggtgctgtt

SEQ ID NO: 184833 - DNA, 25 bp, Mus musculus
acttctatgcttcagatggagtgga

SEQ ID NO: 184834 - DNA, 25 bp, Mus musculus
acttctatgcttcagcccctggtca

SEQ ID NO: 184835 - DNA, 25 bp, Mus musculus
acttctatgtggtgctgggtaggcc

SEQ ID NO: 184836 - DNA, 25 bp, Mus musculus
acttctcaactcagtttgacccatt

SEQ ID NO: 184837 - DNA, 25 bp, Mus musculus
acttctcaagatgaggttccaggtt

SEQ ID NO: 184838 - DNA, 25 bp, Mus musculus
acttctcaaggaaacttcattctcc

SEQ ID NO: 184839 - DNA, 25 bp, Mus musculus
acttctcaaggaatctgaatttttg

SEQ ID NO: 184840 - DNA, 25 bp, Mus musculus
acttctcaaggagcgatgagcaaga

SEQ ID NO: 184841 - DNA, 25 bp, Mus musculus
acttctcaaggaggcgcttccatga

SEQ ID NO: 184842 - DNA, 25 bp, Mus musculus
acttctcaaggcgaccctttgacag

SEQ ID NO: 184843 - DNA, 25 bp, Mus musculus
acttctcaaggctcagaaatcctgg

SEQ ID NO: 184844 - DNA, 25 bp, Mus musculus
acttctcaagtctattgcatctgca

SEQ ID NO: 184845 - DNA, 25 bp, Mus musculus
acttctcacccggaaaatgactccc

SEQ ID NO: 184846 - DNA, 25 bp, Mus musculus
acttctcagaggctccatctccatt

SEQ ID NO: 184847 - DNA, 25 bp, Mus musculus
acttctcataaaaatggatgagaca

SEQ ID NO: 184848 - DNA, 25 bp, Mus musculus
acttctcataaaattcccatggctc

SEQ ID NO: 184849 - DNA, 25 bp, Mus musculus
acttctccaaagccaagcccgatac

SEQ ID NO: 184850 - DNA, 25 bp, Mus musculus
acttctccaaaggtctgtcaaatat

SEQ ID NO: 184851 - DNA, 25 bp, Mus musculus
acttctccaaggaaaaggaatccac

SEQ ID NO: 184852 - DNA, 25 bp, Mus musculus
acttctccacgcctctcgtcagaag

SEQ ID NO: 184853 - DNA, 25 bp, Mus musculus
acttctccagaaagcttccctggct

SEQ ID NO: 184854 - DNA, 25 bp, Mus musculus
acttctccagaagcttccctgtttc

SEQ ID NO: 184855 - DNA, 25 bp, Mus musculus
acttctccagaggcaagttcaaggt

SEQ ID NO: 184856 - DNA, 25 bp, Mus musculus
acttctccaggctagaaaatgccca

SEQ ID NO: 184857 - DNA, 25 bp, Mus musculus
acttctccaggtttggaggagacca

SEQ ID NO: 184858 - DNA, 25 bp, Mus musculus
acttctcctcagtgtttacaaaata

SEQ ID NO: 184859 - DNA, 25 bp, Mus musculus
acttctcctggacgtgcgaccgcat

SEQ ID NO: 184860 - DNA, 25 bp, Mus musculus
acttctcctggcaacgatatccctg

SEQ ID NO: 184861 - DNA, 25 bp, Mus musculus
acttctctaaggcttgccctctgaa

SEQ ID NO: 184862 - DNA, 25 bp, Mus musculus
acttctctaataaagcaaggagtaa

SEQ ID NO: 184863 - DNA, 25 bp, Mus musculus
acttctctaataaaggatatggtgg

SEQ ID NO: 184864 - DNA, 25 bp, Mus musculus
acttctctatctgccaaagtaaaca

SEQ ID NO: 184865 - DNA, 25 bp, Mus musculus
acttctctcagctacagcggaacat

SEQ ID NO: 184866 - DNA, 25 bp, Mus musculus
acttctctcaggcaggcaaccttca

SEQ ID NO: 184867 - DNA, 25 bp, Mus musculus
acttctctgtcagcacagggtatgg

SEQ ID NO: 184868 - DNA, 25 bp, Mus musculus
acttctcttagagtgtggggccgac

SEQ ID NO: 184869 - DNA, 25 bp, Mus musculus
acttctcttctcagggtctcagaat

SEQ ID NO: 184870 - DNA, 25 bp, Mus musculus
acttctgaaacttacttacagctac

SEQ ID NO: 184871 - DNA, 25 bp, Mus musculus
acttctgaccgccctgctgctcatg

SEQ ID NO: 184872 - DNA, 25 bp, Mus musculus
acttctgacgatcttgaccggccca

SEQ ID NO: 184873 - DNA, 25 bp, Mus musculus
acttctgagaccaccctcccttgga

SEQ ID NO: 184874 - DNA, 25 bp, Mus musculus
acttctgagtcaagagcttggattc

SEQ ID NO: 184875 - DNA, 25 bp, Mus musculus
acttctgatggaggaatcaaaaatg

SEQ ID NO: 184876 - DNA, 25 bp, Mus musculus
acttctgatgtttcttccagcaagt

SEQ ID NO: 184877 - DNA, 25 bp, Mus musculus
acttctgcaaaaaggggatggaatt

SEQ ID NO: 184878 - DNA, 25 bp, Mus musculus
acttctgcaagagcaataaaattgc

SEQ ID NO: 184879 - DNA, 25 bp, Mus musculus
acttctgcaatgcctggcttcccat

SEQ ID NO: 184880 - DNA, 25 bp, Mus musculus
acttctgcacggcgggtaacttcat

SEQ ID NO: 184881 - DNA, 25 bp, Mus musculus
acttctgcagctaatgggaatgaca

SEQ ID NO: 184882 - DNA, 25 bp, Mus musculus
acttctgcattcctctgtgtaccga

SEQ ID NO: 184883 - DNA, 25 bp, Mus musculus
acttctgcattcgctgtgacagcga

SEQ ID NO: 184884 - DNA, 25 bp, Mus musculus
acttctgcccgggctgagcgccctg

SEQ ID NO: 184885 - DNA, 25 bp, Mus musculus
acttctgcccggtgctggccacagg

SEQ ID NO: 184886 - DNA, 25 bp, Mus musculus
acttctgcctagcatcaacgatata

SEQ ID NO: 184887 - DNA, 25 bp, Mus musculus
acttctgcctaggtatgtctatata

SEQ ID NO: 184888 - DNA, 25 bp, Mus musculus
acttctgcctaggtcctcaactttg

SEQ ID NO: 184889 - DNA, 25 bp, Mus musculus
acttctgcctgggatgcgccgcagc

SEQ ID NO: 184890 - DNA, 25 bp, Mus musculus
acttctgcctgggattttcctggtc

SEQ ID NO: 184891 - DNA, 25 bp, Mus musculus
acttctgctacaagcttcctgacag

SEQ ID NO: 184892 - DNA, 25 bp, Mus musculus
acttctggagaccacatgtgtcgct

SEQ ID NO: 184893 - DNA, 25 bp, Mus musculus
acttctggaggaaaatatgtcgtaa

SEQ ID NO: 184894 - DNA, 25 bp, Mus musculus
acttctggcagagacttggcagtgt

SEQ ID NO: 184895 - DNA, 25 bp, Mus musculus
acttctggcagaggcattgaagaca

SEQ ID NO: 184896 - DNA, 25 bp, Mus musculus
acttctggctcacagagaaggactt

SEQ ID NO: 184897 - DNA, 25 bp, Mus musculus
acttctggctggcagcactgaaaac

SEQ ID NO: 184898 - DNA, 25 bp, Mus musculus
acttctggctggcaggaggcacagt

SEQ ID NO: 184899 - DNA, 25 bp, Mus musculus
acttctgggaggcctggccttgatg

SEQ ID NO: 184900 - DNA, 25 bp, Mus musculus
acttctgggccatttcaagtccgag

SEQ ID NO: 184901 - DNA, 25 bp, Mus musculus
acttctgtaacattgccattatcct

SEQ ID NO: 184902 - DNA, 25 bp, Mus musculus
acttctgtagagatttggcccagta

SEQ ID NO: 184903 - DNA, 25 bp, Mus musculus
acttctgtagagtccaattggtaaa

SEQ ID NO: 184904 - DNA, 25 bp, Mus musculus
acttctgtaggcataaactgggaat

SEQ ID NO: 184905 - DNA, 25 bp, Mus musculus
acttctgtcaaaacttggctcttga

SEQ ID NO: 184906 - DNA, 25 bp, Mus musculus
acttctgtctgagatcgtcagtggc

SEQ ID NO: 184907 - DNA, 25 bp, Mus musculus
acttctgtgccaggctgtttgatta

SEQ ID NO: 184908 - DNA, 25 bp, Mus musculus
acttctgtgtacctcagctggattc

SEQ ID NO: 184909 - DNA, 25 bp, Mus musculus
acttctgtgtactgccttctgaaat

SEQ ID NO: 184910 - DNA, 25 bp, Mus musculus
acttctgtgtagtagtttacaaatg

SEQ ID NO: 184911 - DNA, 25 bp, Mus musculus
acttctgttcaggaaactggagacc

SEQ ID NO: 184912 - DNA, 25 bp, Mus musculus
acttcttcaaaggatcccagagagc

SEQ ID NO: 184913 - DNA, 25 bp, Mus musculus
acttcttcaagggtggggtaattag

SEQ ID NO: 184914 - DNA, 25 bp, Mus musculus
acttcttcacggcatggatgatgat

SEQ ID NO: 184915 - DNA, 25 bp, Mus musculus
acttcttcactgcaggtcccaaatt

SEQ ID NO: 184916 - DNA, 25 bp, Mus musculus
acttcttcactgcaggttcacctgg

SEQ ID NO: 184917 - DNA, 25 bp, Mus musculus
acttcttcagaaggtcgtgaaaata

SEQ ID NO: 184918 - DNA, 25 bp, Mus musculus
acttcttcagctgcagtgttgaagt

SEQ ID NO: 184919 - DNA, 25 bp, Mus musculus
acttcttcaggttccggaagcagag

SEQ ID NO: 184920 - DNA, 25 bp, Mus musculus
acttcttcagttaccctgcagtttg

SEQ ID NO: 184921 - DNA, 25 bp, Mus musculus
acttcttcatccacatctacatcca

SEQ ID NO: 184922 - DNA, 25 bp, Mus musculus
acttcttccagagaatttgtttcaa

SEQ ID NO: 184923 - DNA, 25 bp, Mus musculus
acttcttccagcttcacccctcatc

SEQ ID NO: 184924 - DNA, 25 bp, Mus musculus
acttcttccaggctgaaggaaggaa

SEQ ID NO: 184925 - DNA, 25 bp, Mus musculus
acttcttccctaagacctaggacct

SEQ ID NO: 184926 - DNA, 25 bp, Mus musculus
acttcttccctaaggtgaaaggact

SEQ ID NO: 184927 - DNA, 25 bp, Mus musculus
acttcttcctcatcggacccccagc

SEQ ID NO: 184928 - DNA, 25 bp, Mus musculus
acttcttcctgccttaaccatggca

SEQ ID NO: 184929 - DNA, 25 bp, Mus musculus
acttcttcgcggaagatatatgttg

SEQ ID NO: 184930 - DNA, 25 bp, Mus musculus
acttcttctcagaaaagaggccagc

SEQ ID NO: 184931 - DNA, 25 bp, Mus musculus
acttcttctcagataaggatgaatg

SEQ ID NO: 184932 - DNA, 25 bp, Mus musculus
acttcttgacagggtcctgcaggca

SEQ ID NO: 184933 - DNA, 25 bp, Mus musculus
acttcttgagtgagccctgaatctg

SEQ ID NO: 184934 - DNA, 25 bp, Mus musculus
acttcttgagtgagggtatcctgtc

SEQ ID NO: 184935 - DNA, 25 bp, Mus musculus
acttctttacaaggattttcacctt

SEQ ID NO: 184936 - DNA, 25 bp, Mus musculus
acttctttaccaggtatgactacga

SEQ ID NO: 184937 - DNA, 25 bp, Mus musculus
acttctttactatgcggagcaactg

SEQ ID NO: 184938 - DNA, 25 bp, Mus musculus
acttctttcaggtactcatgtgatg

SEQ ID NO: 184939 - DNA, 25 bp, Mus musculus
acttctttcaggtattcatgtgatg

SEQ ID NO: 184940 - DNA, 25 bp, Mus musculus
acttctttcctggagtaggtgacat

SEQ ID NO: 184941 - DNA, 25 bp, Mus musculus
acttctttcgggaggcagcccgcgc

SEQ ID NO: 184942 - DNA, 25 bp, Mus musculus
acttctttcggtgaagaatgctcgt

SEQ ID NO: 184943 - DNA, 25 bp, Mus musculus
acttctttgacatcagtgatgagag

SEQ ID NO: 184944 - DNA, 25 bp, Mus musculus
acttctttgacatctgtgatgagag

SEQ ID NO: 184945 - DNA, 25 bp, Mus musculus
acttctttgaggaggtattcacaga

SEQ ID NO: 184946 - DNA, 25 bp, Mus musculus
acttctttgcacaagacccacacca

SEQ ID NO: 184947 - DNA, 25 bp, Mus musculus
acttctttgcacaagggtttctctg

SEQ ID NO: 184948 - DNA, 25 bp, Mus musculus
acttcttttcacaatgctcatgatc

SEQ ID NO: 184949 - DNA, 25 bp, Mus musculus
acttgaaaactatgctgaacttggt

SEQ ID NO: 184950 - DNA, 25 bp, Mus musculus
acttgaaaactatgtgcttgacaga

SEQ ID NO: 184951 - DNA, 25 bp, Mus musculus
acttgaaaagcaagaacgggagaac

SEQ ID NO: 184952 - DNA, 25 bp, Mus musculus
acttgaaaagtttgataacttacag

SEQ ID NO: 184953 - DNA, 25 bp, Mus musculus
acttgaaacaaggggttataatgag

SEQ ID NO: 184954 - DNA, 25 bp, Mus musculus
acttgaaactgaagaagctattgcc

SEQ ID NO: 184955 - DNA, 25 bp, Mus musculus
acttgaaactgaagaagctcataat

SEQ ID NO: 184956 - DNA, 25 bp, Mus musculus
acttgaaagagtcacatcagtttca

SEQ ID NO: 184957 - DNA, 25 bp, Mus musculus
acttgaaagctatccttcaccagcg

SEQ ID NO: 184958 - DNA, 25 bp, Mus musculus
acttgaaagcttatctgagtccatg

SEQ ID NO: 184959 - DNA, 25 bp, Mus musculus
acttgaacaatgattttgtggtgga

SEQ ID NO: 184960 - DNA, 25 bp, Mus musculus
acttgaacaatgttatgatggttaa

SEQ ID NO: 184961 - DNA, 25 bp, Mus musculus
acttgaacagatggggtgtttgttg

SEQ ID NO: 184962 - DNA, 25 bp, Mus musculus
acttgaacagattcattatgtctta

SEQ ID NO: 184963 - DNA, 25 bp, Mus musculus
acttgaacagcattgaggatcctga

SEQ ID NO: 184964 - DNA, 25 bp, Mus musculus
acttgaacatggatgtggacgccac

SEQ ID NO: 184965 - DNA, 25 bp, Mus musculus
acttgaagaaaaggaaatgttattc

SEQ ID NO: 184966 - DNA, 25 bp, Mus musculus
acttgaagaaaaggaagatgaggag

SEQ ID NO: 184967 - DNA, 25 bp, Mus musculus
acttgaagacatgaggactttcagt

SEQ ID NO: 184968 - DNA, 25 bp, Mus musculus
acttgaaggagaacgggaggctgcc

SEQ ID NO: 184969 - DNA, 25 bp, Mus musculus
acttgaagtctggctgtacatcatt

SEQ ID NO: 184970 - DNA, 25 bp, Mus musculus
acttgaatccagaagacattgatca

SEQ ID NO: 184971 - DNA, 25 bp, Mus musculus
acttgacaaggtggtgacagtggca

SEQ ID NO: 184972 - DNA, 25 bp, Mus musculus
acttgacaatagctctggtgcaagt

SEQ ID NO: 184973 - DNA, 25 bp, Mus musculus
acttgacaattcagcctggagatgc

SEQ ID NO: 184974 - DNA, 25 bp, Mus musculus
acttgacatagcctgcaggggtcca

SEQ ID NO: 184975 - DNA, 25 bp, Mus musculus
acttgacctcagatcttggtaatgt

SEQ ID NO: 184976 - DNA, 25 bp, Mus musculus
acttgagagctttggatatacaacc

SEQ ID NO: 184977 - DNA, 25 bp, Mus musculus
acttgaggctgacagacaagattgt

SEQ ID NO: 184978 - DNA, 25 bp, Mus musculus
acttgagtggtccatgtctctttct

SEQ ID NO: 184979 - DNA, 25 bp, Mus musculus
acttgataaaacatgctggaggcat

SEQ ID NO: 184980 - DNA, 25 bp, Mus musculus
acttgataaaacatggcattctgca

SEQ ID NO: 184981 - DNA, 25 bp, Mus musculus
acttgataccctgggcaggattcct

SEQ ID NO: 184982 - DNA, 25 bp, Mus musculus
acttgatagcatagaaaattggaga

SEQ ID NO: 184983 - DNA, 25 bp, Mus musculus
acttgatagcggagaaaattggaga

SEQ ID NO: 184984 - DNA, 25 bp, Mus musculus
acttgatatcatccgagttagaaca

SEQ ID NO: 184985 - DNA, 25 bp, Mus musculus
acttgatcctggaggtggccttaga

SEQ ID NO: 184986 - DNA, 25 bp, Mus musculus
acttgatcggttatgaaaagtctgt

SEQ ID NO: 184987 - DNA, 25 bp, Mus musculus
acttgatgaaattacttctgaaaag

SEQ ID NO: 184988 - DNA, 25 bp, Mus musculus
acttgatgaaattatacgacctcct

SEQ ID NO: 184989 - DNA, 25 bp, Mus musculus
acttgatgaaattgagcaactgaag

SEQ ID NO: 184990 - DNA, 25 bp, Mus musculus
acttgatgaagaagatgaagtggaa

SEQ ID NO: 184991 - DNA, 25 bp, Mus musculus
acttgatgaagagtcagaagatgaa

SEQ ID NO: 184992 - DNA, 25 bp, Mus musculus
acttgatggtgagaagggagaggct

SEQ ID NO: 184993 - DNA, 25 bp, Mus musculus
acttgatgtgccaagtaatgtatat

SEQ ID NO: 184994 - DNA, 25 bp, Mus musculus
acttgcaaaagaggccatgacgatg

SEQ ID NO: 184995 - DNA, 25 bp, Mus musculus
acttgcaattccatggctgcagaag

SEQ ID NO: 184996 - DNA, 25 bp, Mus musculus
acttgcaattccatggtactctttg

SEQ ID NO: 184997 - DNA, 25 bp, Mus musculus
acttgcacagggaacaagaatgtgg

SEQ ID NO: 184998 - DNA, 25 bp, Mus musculus
acttgcacatgataggctatgatag

SEQ ID NO: 184999 - DNA, 25 bp, Mus musculus
acttgcaccatccagagagatgcca

SEQ ID NO: 185000 - DNA, 25 bp, Mus musculus
acttgcactggttgttcatcgcctg

SEQ ID NO: 185001 - DNA, 25 bp, Mus musculus
acttgcagatcagacccagcatgtg

SEQ ID NO: 185002 - DNA, 25 bp, Mus musculus
acttgcaggctcacgctctcaccac

SEQ ID NO: 185003 - DNA, 25 bp, Mus musculus
acttgccaaaggaaagcgagcttgc

SEQ ID NO: 185004 - DNA, 25 bp, Mus musculus
acttgccaaaggcagtttgatgttt

SEQ ID NO: 185005 - DNA, 25 bp, Mus musculus
acttgccaagaacatactaaaagca

SEQ ID NO: 185006 - DNA, 25 bp, Mus musculus
acttgccactgtgagcttcaacctg

SEQ ID NO: 185007 - DNA, 25 bp, Mus musculus
acttgccagctggacatcaacgatt

SEQ ID NO: 185008 - DNA, 25 bp, Mus musculus
acttgccagctggacgccaatgagt

SEQ ID NO: 185009 - DNA, 25 bp, Mus musculus
acttgcccaaggagaatgaccccag

SEQ ID NO: 185010 - DNA, 25 bp, Mus musculus
acttgcccaaggagttctggcaggt

SEQ ID NO: 185011 - DNA, 25 bp, Mus musculus
acttgccgccgtaggaactgacccg

SEQ ID NO: 185012 - DNA, 25 bp, Mus musculus
acttgccgtccggtggagagtacag

SEQ ID NO: 185013 - DNA, 25 bp, Mus musculus
acttgcctaagttggaaaagcgtct

SEQ ID NO: 185014 - DNA, 25 bp, Mus musculus
acttgcctgagagtgaaataaagaa

SEQ ID NO: 185015 - DNA, 25 bp, Mus musculus
acttgcgaaggggcttcgcctctat

SEQ ID NO: 185016 - DNA, 25 bp, Mus musculus
acttgcggatggggaagccagcttt

SEQ ID NO: 185017 - DNA, 25 bp, Mus musculus
acttgctacaagtgtggtgagaaag

SEQ ID NO: 185018 - DNA, 25 bp, Mus musculus
acttgctacaagtgtggtgggctag

SEQ ID NO: 185019 - DNA, 25 bp, Mus musculus
acttgctcaaccagatccttgcatg

SEQ ID NO: 185020 - DNA, 25 bp, Mus musculus
acttgctcaaccagggcatcgttct

SEQ ID NO: 185021 - DNA, 25 bp, Mus musculus
acttgctcagccttcctgatcaccc

SEQ ID NO: 185022 - DNA, 25 bp, Mus musculus
acttgctccaagggccccgccgtca

SEQ ID NO: 185023 - DNA, 25 bp, Mus musculus
acttgctccctcgcttagcgctctg

SEQ ID NO: 185024 - DNA, 25 bp, Mus musculus
acttgctgctcatggatgaagttgc

SEQ ID NO: 185025 - DNA, 25 bp, Mus musculus
acttgctgtaggttatgatgagttt

SEQ ID NO: 185026 - DNA, 25 bp, Mus musculus
acttgctgtcaaactacagagtgaa

SEQ ID NO: 185027 - DNA, 25 bp, Mus musculus
acttgctgttctttatcctgggtgc

SEQ ID NO: 185028 - DNA, 25 bp, Mus musculus
acttgcttagcaaggcacaacacgt

SEQ ID NO: 185029 - DNA, 25 bp, Mus musculus
acttgcttcagccagagtaacagtt

SEQ ID NO: 185030 - DNA, 25 bp, Mus musculus
acttggaatctccctgagcaagagt

SEQ ID NO: 185031 - DNA, 25 bp, Mus musculus
acttggacaacaccatcaagaaact

SEQ ID NO: 185032 - DNA, 25 bp, Mus musculus
acttggacatgtcatctcctgaaga

SEQ ID NO: 185033 - DNA, 25 bp, Mus musculus
acttggaccgcagccctctgccaga

SEQ ID NO: 185034 - DNA, 25 bp, Mus musculus
acttggaccggaactgtccgactgg

SEQ ID NO: 185035 - DNA, 25 bp, Mus musculus
acttggacttgagcagcgaccactg

SEQ ID NO: 185036 - DNA, 25 bp, Mus musculus
acttggagagtggacagaaaacatc

SEQ ID NO: 185037 - DNA, 25 bp, Mus musculus
acttggaggaagtccgccagttcct

SEQ ID NO: 185038 - DNA, 25 bp, Mus musculus
acttggaggagaatttaaaagaaga

SEQ ID NO: 185039 - DNA, 25 bp, Mus musculus
acttggagttaaaggtccttcacgt

SEQ ID NO: 185040 - DNA, 25 bp, Mus musculus
acttggatgttgaggttctctgctg

SEQ ID NO: 185041 - DNA, 25 bp, Mus musculus
acttggcaacagggtctctgtgatg

SEQ ID NO: 185042 - DNA, 25 bp, Mus musculus
acttggcaccggtgcagccttgctg

SEQ ID NO: 185043 - DNA, 25 bp, Mus musculus
acttggcagaagaggagaaagagaa

SEQ ID NO: 185044 - DNA, 25 bp, Mus musculus
acttggcagaggaggctccgtgccc

SEQ ID NO: 185045 - DNA, 25 bp, Mus musculus
acttggcagaggagtgacatcactg

SEQ ID NO: 185046 - DNA, 25 bp, Mus musculus
acttggcagcccaaggattccagct

SEQ ID NO: 185047 - DNA, 25 bp, Mus musculus
acttggcagcccaagtctttgcaga

SEQ ID NO: 185048 - DNA, 25 bp, Mus musculus
acttggccagggagccacagctaac

SEQ ID NO: 185049 - DNA, 25 bp, Mus musculus
acttggccatgagatgagatggacc

SEQ ID NO: 185050 - DNA, 25 bp, Mus musculus
acttggccgagcagcctgcgccagc

SEQ ID NO: 185051 - DNA, 25 bp, Mus musculus
acttggcctattttggatttcagtg

SEQ ID NO: 185052 - DNA, 25 bp, Mus musculus
acttggcctattttggcaactccga

SEQ ID NO: 185053 - DNA, 25 bp, Mus musculus
acttggccttgatgaagaacaacga

SEQ ID NO: 185054 - DNA, 25 bp, Mus musculus
acttggccttgatgaggagtgggaa

SEQ ID NO: 185055 - DNA, 25 bp, Mus musculus
acttggcgattaaaggcctgaagct

SEQ ID NO: 185056 - DNA, 25 bp, Mus musculus
acttggcgcctgaggtgctagagga

SEQ ID NO: 185057 - DNA, 25 bp, Mus musculus
acttggcggccatcgagtaaaatcg

SEQ ID NO: 185058 - DNA, 25 bp, Mus musculus
acttggctagcaggtattcatgcta

SEQ ID NO: 185059 - DNA, 25 bp, Mus musculus
acttggctagctgcacatccctaca

SEQ ID NO: 185060 - DNA, 25 bp, Mus musculus
acttggctatgggagaggagagaac

SEQ ID NO: 185061 - DNA, 25 bp, Mus musculus
acttggctatgggggcggggcccga

SEQ ID NO: 185062 - DNA, 25 bp, Mus musculus
acttggctcctactttctgcactgg

SEQ ID NO: 185063 - DNA, 25 bp, Mus musculus
acttggctcctgcctgaggagcgat

SEQ ID NO: 185064 - DNA, 25 bp, Mus musculus
acttggctgcagaggtagaccctga

SEQ ID NO: 185065 - DNA, 25 bp, Mus musculus
acttggctgcagaggtggaccctga

SEQ ID NO: 185066 - DNA, 25 bp, Mus musculus
acttggctgctcagctgcactgagc

SEQ ID NO: 185067 - DNA, 25 bp, Mus musculus
acttggctgctcagtgtttcctttc

SEQ ID NO: 185068 - DNA, 25 bp, Mus musculus
acttgggaaaaaattatgcttcagc

SEQ ID NO: 185069 - DNA, 25 bp, Mus musculus
acttgggacagcagatccatgcccg

SEQ ID NO: 185070 - DNA, 25 bp, Mus musculus
acttgggacagcagggccgcctcag

SEQ ID NO: 185071 - DNA, 25 bp, Mus musculus
acttgggaggagactgacaaaacca

SEQ ID NO: 185072 - DNA, 25 bp, Mus musculus
acttgggagggggggcctgctgtag

SEQ ID NO: 185073 - DNA, 25 bp, Mus musculus
acttgggcatgatccagagcaatga

SEQ ID NO: 185074 - DNA, 25 bp, Mus musculus
acttgggcatgctttggtggcccca

SEQ ID NO: 185075 - DNA, 25 bp, Mus musculus
acttggggaagcctgagatgggggt

SEQ ID NO: 185076 - DNA, 25 bp, Mus musculus
acttggggacaggacctttgagcag

SEQ ID NO: 185077 - DNA, 25 bp, Mus musculus
acttggggtccaggtcgggatggtg

SEQ ID NO: 185078 - DNA, 25 bp, Mus musculus
acttgggtatatagcttgaagtcaa

SEQ ID NO: 185079 - DNA, 25 bp, Mus musculus
acttgggttgtaggcttctccagtg

SEQ ID NO: 185080 - DNA, 25 bp, Mus musculus
acttggtatttttaggctgttcatt

SEQ ID NO: 185081 - DNA, 25 bp, Mus musculus
acttggtccaggcaaacagggagga

SEQ ID NO: 185082 - DNA, 25 bp, Mus musculus
acttggtctctgtgggagcttgcat

SEQ ID NO: 185083 - DNA, 25 bp, Mus musculus
acttggtctctgtgggtggtaaatc

SEQ ID NO: 185084 - DNA, 25 bp, Mus musculus
acttggtgaaaaattgcatgtgtgt

SEQ ID NO: 185085 - DNA, 25 bp, Mus musculus
acttggtgaagactccattagagga

SEQ ID NO: 185086 - DNA, 25 bp, Mus musculus
acttggtgacagacagtcttcacac

SEQ ID NO: 185087 - DNA, 25 bp, Mus musculus
acttggtgagagccctgaagacaag

SEQ ID NO: 185088 - DNA, 25 bp, Mus musculus
acttggtgataaggtacagttttgc

SEQ ID NO: 185089 - DNA, 25 bp, Mus musculus
acttggtgatgaaaccattagagga

SEQ ID NO: 185090 - DNA, 25 bp, Mus musculus
acttggtgcatcgggagcaatcatg

SEQ ID NO: 185091 - DNA, 25 bp, Mus musculus
acttggtggatggatgagtttcatc

SEQ ID NO: 185092 - DNA, 25 bp, Mus musculus
acttggtggtggagggggacgattt

SEQ ID NO: 185093 - DNA, 25 bp, Mus musculus
acttggtggttctccgttctgagct

SEQ ID NO: 185094 - DNA, 25 bp, Mus musculus
acttggttatgaggaggatgttaga

SEQ ID NO: 185095 - DNA, 25 bp, Mus musculus
acttggttcggtacatgggctgtgt

SEQ ID NO: 185096 - DNA, 25 bp, Mus musculus
acttgtaaagcttgtagaccctgga

SEQ ID NO: 185097 - DNA, 25 bp, Mus musculus
acttgtaaagtcccacgagtcctac

SEQ ID NO: 185098 - DNA, 25 bp, Mus musculus
acttgtaacgtaaggacaagatggc

SEQ ID NO: 185099 - DNA, 25 bp, Mus musculus
acttgtaataaagctgcgaagctgg

SEQ ID NO: 185100 - DNA, 25 bp, Mus musculus
acttgtacatggaggctttgctgag

SEQ ID NO: 185101 - DNA, 25 bp, Mus musculus
acttgtacatggtgctctagactac

SEQ ID NO: 185102 - DNA, 25 bp, Mus musculus
acttgtagctgttctagtaagcaga

SEQ ID NO: 185103 - DNA, 25 bp, Mus musculus
acttgtaggtcagagtttttgtgcc

SEQ ID NO: 185104 - DNA, 25 bp, Mus musculus
acttgtagtagacccttaagccctc

SEQ ID NO: 185105 - DNA, 25 bp, Mus musculus
acttgtattaagatgggcgtatgtc

SEQ ID NO: 185106 - DNA, 25 bp, Mus musculus
acttgtattccctgtgagtgtgatc

SEQ ID NO: 185107 - DNA, 25 bp, Mus musculus
acttgtcaaaggatggctccggtga

SEQ ID NO: 185108 - DNA, 25 bp, Mus musculus
acttgtcaaaggatggtggtgtgcg

SEQ ID NO: 185109 - DNA, 25 bp, Mus musculus
acttgtccaaacataggaattccag

SEQ ID NO: 185110 - DNA, 25 bp, Mus musculus
acttgtccaaacatgactttctggg

SEQ ID NO: 185111 - DNA, 25 bp, Mus musculus
acttgtccaatttcgaggactccac

SEQ ID NO: 185112 - DNA, 25 bp, Mus musculus
acttgtccatggaggtcttcacttc

SEQ ID NO: 185113 - DNA, 25 bp, Mus musculus
acttgtccattttgttgcatattct

SEQ ID NO: 185114 - DNA, 25 bp, Mus musculus
acttgtcctacctgctgattttctc

SEQ ID NO: 185115 - DNA, 25 bp, Mus musculus
acttgtcgaaccacactaaacaaga

SEQ ID NO: 185116 - DNA, 25 bp, Mus musculus
acttgtctctggcgtgggtgactga

SEQ ID NO: 185117 - DNA, 25 bp, Mus musculus
acttgtctgacttcggtcagccatg

SEQ ID NO: 185118 - DNA, 25 bp, Mus musculus
acttgtgaaactataagcagcaaag

SEQ ID NO: 185119 - DNA, 25 bp, Mus musculus
acttgtgaagaattccatcaatgga

SEQ ID NO: 185120 - DNA, 25 bp, Mus musculus
acttgtgaatggaggttggagacct

SEQ ID NO: 185121 - DNA, 25 bp, Mus musculus
acttgtgacagagccctgcttcaag

SEQ ID NO: 185122 - DNA, 25 bp, Mus musculus
acttgtgagttcgactgtgatttac

SEQ ID NO: 185123 - DNA, 25 bp, Mus musculus
acttgtgccagtctaatgcactacc

SEQ ID NO: 185124 - DNA, 25 bp, Mus musculus
acttgtgccggtcccgcctggcaga

SEQ ID NO: 185125 - DNA, 25 bp, Mus musculus
acttgtgccggtcctgcccccttcc

SEQ ID NO: 185126 - DNA, 25 bp, Mus musculus
acttgtgctggaggtgtccaaagac

SEQ ID NO: 185127 - DNA, 25 bp, Mus musculus
acttgtggaaaagatattctcatgt

SEQ ID NO: 185128 - DNA, 25 bp, Mus musculus
acttgtgggaagctcccctattttc

SEQ ID NO: 185129 - DNA, 25 bp, Mus musculus
acttgtgggaagggcatttgtgtac

SEQ ID NO: 185130 - DNA, 25 bp, Mus musculus
acttgtgttccagaatggggaggta

SEQ ID NO: 185131 - DNA, 25 bp, Mus musculus
acttgtgttccagggagatgctatt

SEQ ID NO: 185132 - DNA, 25 bp, Mus musculus
acttgtgttggcaagagagatgaag

SEQ ID NO: 185133 - DNA, 25 bp, Mus musculus
acttgtgttggcaagaggccacagc

SEQ ID NO: 185134 - DNA, 25 bp, Mus musculus
acttgttaaggctcaggccatccag

SEQ ID NO: 185135 - DNA, 25 bp, Mus musculus
acttgttaagtttctagtgggaatg

SEQ ID NO: 185136 - DNA, 25 bp, Mus musculus
acttgttatcagttgaatctggagg

SEQ ID NO: 185137 - DNA, 25 bp, Mus musculus
acttgttcagggtgacagaaggtga

SEQ ID NO: 185138 - DNA, 25 bp, Mus musculus
acttgttgccagaaagcagcagctg

SEQ ID NO: 185139 - DNA, 25 bp, Mus musculus
acttgttgccaggtgaacagctgct

SEQ ID NO: 185140 - DNA, 25 bp, Mus musculus
acttgttggcatcagaccacagcag

SEQ ID NO: 185141 - DNA, 25 bp, Mus musculus
acttgttgttgagccaccttctcct

SEQ ID NO: 185142 - DNA, 25 bp, Mus musculus
acttgttgttgaggcagcatattat

SEQ ID NO: 185143 - DNA, 25 bp, Mus musculus
acttgtttgaatggtaaatgatctg

SEQ ID NO: 185144 - DNA, 25 bp, Mus musculus
acttgtttgtgcagggatcgcttac

SEQ ID NO: 185145 - DNA, 25 bp, Mus musculus
actttaaaacggctaggacttctct

SEQ ID NO: 185146 - DNA, 25 bp, Mus musculus
actttaaaagaagatccagtcctgc

SEQ ID NO: 185147 - DNA, 25 bp, Mus musculus
actttaaactagcagggggaggagc

SEQ ID NO: 185148 - DNA, 25 bp, Mus musculus
actttaactggaaagaatgtcttga

SEQ ID NO: 185149 - DNA, 25 bp, Mus musculus
actttaactggaaaggatataattg

SEQ ID NO: 185150 - DNA, 25 bp, Mus musculus
actttaactttgagaagaaccaaag

SEQ ID NO: 185151 - DNA, 25 bp, Mus musculus
actttaagcaggtgctgctggtgag

SEQ ID NO: 185152 - DNA, 25 bp, Mus musculus
actttaaggacagttatctgctgat

SEQ ID NO: 185153 - DNA, 25 bp, Mus musculus
actttaaggggagagctcctgcttt

SEQ ID NO: 185154 - DNA, 25 bp, Mus musculus
actttaaggggagaggaagctttgt

SEQ ID NO: 185155 - DNA, 25 bp, Mus musculus
actttaatagtgaggtagaggaggc

SEQ ID NO: 185156 - DNA, 25 bp, Mus musculus
actttaatcaaagcaatggaagtac

SEQ ID NO: 185157 - DNA, 25 bp, Mus musculus
actttaatgctgaggccgggataac

SEQ ID NO: 185158 - DNA, 25 bp, Mus musculus
actttaatgtagaaagattaatggg

SEQ ID NO: 185159 - DNA, 25 bp, Mus musculus
actttacaagattaatgccgctgct

SEQ ID NO: 185160 - DNA, 25 bp, Mus musculus
actttacaagccccaagcattctgc

SEQ ID NO: 185161 - DNA, 25 bp, Mus musculus
actttacaagcttcaacaaatccag

SEQ ID NO: 185162 - DNA, 25 bp, Mus musculus
actttacagaccagtgtgtgccatc

SEQ ID NO: 185163 - DNA, 25 bp, Mus musculus
actttacagtctattaaaggttgca

SEQ ID NO: 185164 - DNA, 25 bp, Mus musculus
actttacagtctgttatcaagaaat

SEQ ID NO: 185165 - DNA, 25 bp, Mus musculus
actttacatatgcagacatcaagcc

SEQ ID NO: 185166 - DNA, 25 bp, Mus musculus
actttacatatgcaggaatctccac

SEQ ID NO: 185167 - DNA, 25 bp, Mus musculus
actttacatgctcttcctcatggtc

SEQ ID NO: 185168 - DNA, 25 bp, Mus musculus
actttacctctctgcagaaagcctg

SEQ ID NO: 185169 - DNA, 25 bp, Mus musculus
actttacttctgtggagtcaattga

SEQ ID NO: 185170 - DNA, 25 bp, Mus musculus
actttactttacaagattaatgccg

SEQ ID NO: 185171 - DNA, 25 bp, Mus musculus
actttactttacaagccccaagcat

SEQ ID NO: 185172 - DNA, 25 bp, Mus musculus
actttactttacaagcttcaacaaa

SEQ ID NO: 185173 - DNA, 25 bp, Mus musculus
actttagatcttgggaacctggtgg

SEQ ID NO: 185174 - DNA, 25 bp, Mus musculus
actttagctcggttttgtacaaaga

SEQ ID NO: 185175 - DNA, 25 bp, Mus musculus
actttaggagaagacataatgtcaa

SEQ ID NO: 185176 - DNA, 25 bp, Mus musculus
actttaggagaaggttgtggagttc

SEQ ID NO: 185177 - DNA, 25 bp, Mus musculus
actttataatgtgtctgacttcttc

SEQ ID NO: 185178 - DNA, 25 bp, Mus musculus
actttatatatgaggtaccagctct

SEQ ID NO: 185179 - DNA, 25 bp, Mus musculus
actttatcaaagtgatctcagcgcc

SEQ ID NO: 185180 - DNA, 25 bp, Mus musculus
actttatccagtcgcccctcccaga

SEQ ID NO: 185181 - DNA, 25 bp, Mus musculus
actttatccagtcgccttctccttg

SEQ ID NO: 185182 - DNA, 25 bp, Mus musculus
actttatgcatcaacgctgtaagat

SEQ ID NO: 185183 - DNA, 25 bp, Mus musculus
actttatttgtctgtctcttctcac

SEQ ID NO: 185184 - DNA, 25 bp, Mus musculus
actttcaaaggcatctagtcttgct

SEQ ID NO: 185185 - DNA, 25 bp, Mus musculus
actttcaatggagagccgtgcagcg

SEQ ID NO: 185186 - DNA, 25 bp, Mus musculus
actttcaccagggaagacagtgacc

SEQ ID NO: 185187 - DNA, 25 bp, Mus musculus
actttcagagcaccccccggcccct

SEQ ID NO: 185188 - DNA, 25 bp, Mus musculus
actttcagagccctccaactccctt

SEQ ID NO: 185189 - DNA, 25 bp, Mus musculus
actttcagcagtcagcatcaggggc

SEQ ID NO: 185190 - DNA, 25 bp, Mus musculus
actttcagccagaccatagtcctgc

SEQ ID NO: 185191 - DNA, 25 bp, Mus musculus
actttcagccagtgctccacctggt

SEQ ID NO: 185192 - DNA, 25 bp, Mus musculus
actttcagccgatcaacttctgaga

SEQ ID NO: 185193 - DNA, 25 bp, Mus musculus
actttcagtgggtggtgatagtgac

SEQ ID NO: 185194 - DNA, 25 bp, Mus musculus
actttcataagattcggctcctttg

SEQ ID NO: 185195 - DNA, 25 bp, Mus musculus
actttcatacagcacgcatttgatg

SEQ ID NO: 185196 - DNA, 25 bp, Mus musculus
actttcatcttttggatcactggtg

SEQ ID NO: 185197 - DNA, 25 bp, Mus musculus
actttcattggtgctgtccccggca

SEQ ID NO: 185198 - DNA, 25 bp, Mus musculus
actttccaagaaagtcactgtaaca

SEQ ID NO: 185199 - DNA, 25 bp, Mus musculus
actttccaaggaatttgaagcctat

SEQ ID NO: 185200 - DNA, 25 bp, Mus musculus
actttccaaggtggaacttgcagaa

SEQ ID NO: 185201 - DNA, 25 bp, Mus musculus
actttccacagagcctttgatatgg

SEQ ID NO: 185202 - DNA, 25 bp, Mus musculus
actttccacagagctctggagaccc

SEQ ID NO: 185203 - DNA, 25 bp, Mus musculus
actttccactgcttaggctcgactt

SEQ ID NO: 185204 - DNA, 25 bp, Mus musculus
actttccagacccagcatgtagtca

SEQ ID NO: 185205 - DNA, 25 bp, Mus musculus
actttcccatccagctggtgaagac

SEQ ID NO: 185206 - DNA, 25 bp, Mus musculus
actttcctaggacagggcttcgcct

SEQ ID NO: 185207 - DNA, 25 bp, Mus musculus
actttcctcaggacccctcatgcct

SEQ ID NO: 185208 - DNA, 25 bp, Mus musculus
actttcctccaacaaatgcagaacc

SEQ ID NO: 185209 - DNA, 25 bp, Mus musculus
actttcctcctaaagaacagagcct

SEQ ID NO: 185210 - DNA, 25 bp, Mus musculus
actttcctcctaaagccgagcgcca

SEQ ID NO: 185211 - DNA, 25 bp, Mus musculus
actttcctttgactgtggcagccac

SEQ ID NO: 185212 - DNA, 25 bp, Mus musculus
actttcgatgacgattgtggtgggt

SEQ ID NO: 185213 - DNA, 25 bp, Mus musculus
actttcgtatacaaggaattttctc

SEQ ID NO: 185214 - DNA, 25 bp, Mus musculus
actttcgtatacaagttccctctag

SEQ ID NO: 185215 - DNA, 25 bp, Mus musculus
actttcgtgggagccacatatagac

SEQ ID NO: 185216 - DNA, 25 bp, Mus musculus
actttctacaagactatggcgacaa

SEQ ID NO: 185217 - DNA, 25 bp, Mus musculus
actttctacaaggtcatggaggcct

SEQ ID NO: 185218 - DNA, 25 bp, Mus musculus
actttctacaaggtcattcccaaaa

SEQ ID NO: 185219 - DNA, 25 bp, Mus musculus
actttctacaagtctcgcctgctgc

SEQ ID NO: 185220 - DNA, 25 bp, Mus musculus
actttctcagatcgtttaggaaagg

SEQ ID NO: 185221 - DNA, 25 bp, Mus musculus
actttctcaggagtctcatgaacag

SEQ ID NO: 185222 - DNA, 25 bp, Mus musculus
actttctcattaaggtaaatgaccg

SEQ ID NO: 185223 - DNA, 25 bp, Mus musculus
actttctccaagatggcctagactg

SEQ ID NO: 185224 - DNA, 25 bp, Mus musculus
actttctccaaggtggcctagactg

SEQ ID NO: 185225 - DNA, 25 bp, Mus musculus
actttctctcagcagattccaaagg

SEQ ID NO: 185226 - DNA, 25 bp, Mus musculus
actttctctcagcaggccttgagcc

SEQ ID NO: 185227 - DNA, 25 bp, Mus musculus
actttctctgtaccgtcagaagggg

SEQ ID NO: 185228 - DNA, 25 bp, Mus musculus
actttctgaagcttcttcacattga

SEQ ID NO: 185229 - DNA, 25 bp, Mus musculus
actttctgcagcctccatctcacca

SEQ ID NO: 185230 - DNA, 25 bp, Mus musculus
actttctgctccagcaaggtgcaga

SEQ ID NO: 185231 - DNA, 25 bp, Mus musculus
actttctggacaaggtcagtcctcc

SEQ ID NO: 185232 - DNA, 25 bp, Mus musculus
actttctgggcaaggagcacttcaa

SEQ ID NO: 185233 - DNA, 25 bp, Mus musculus
actttctgtccacttcagtccagct

SEQ ID NO: 185234 - DNA, 25 bp, Mus musculus
actttcttacctctggaaggcatca

SEQ ID NO: 185235 - DNA, 25 bp, Mus musculus
actttcttacctctgtcccaattca

SEQ ID NO: 185236 - DNA, 25 bp, Mus musculus
actttcttcagttgtttcctctcgc

SEQ ID NO: 185237 - DNA, 25 bp, Mus musculus
actttcttccatgatagagtctaga

SEQ ID NO: 185238 - DNA, 25 bp, Mus musculus
actttcttccttgatagagtctaga

SEQ ID NO: 185239 - DNA, 25 bp, Mus musculus
actttgaaaaccaaatcactgagct

SEQ ID NO: 185240 - DNA, 25 bp, Mus musculus
actttgaaaacttgtctttgcagaa

SEQ ID NO: 185241 - DNA, 25 bp, Mus musculus
actttgaaaaggctgtcacccttga

SEQ ID NO: 185242 - DNA, 25 bp, Mus musculus
actttgaaagggagaagacacccat

SEQ ID NO: 185243 - DNA, 25 bp, Mus musculus
actttgaaagtattgagcaagtgaa

SEQ ID NO: 185244 - DNA, 25 bp, Mus musculus
actttgaagactgtggaaacaccag

SEQ ID NO: 185245 - DNA, 25 bp, Mus musculus
actttgaagactgtggtcttgccgt

SEQ ID NO: 185246 - DNA, 25 bp, Mus musculus
actttgaagagaattgttgtgtgat

SEQ ID NO: 185247 - DNA, 25 bp, Mus musculus
actttgaagaggtgtgagtgttgag

SEQ ID NO: 185248 - DNA, 25 bp, Mus musculus
actttgaagagtatcacagacattt

SEQ ID NO: 185249 - DNA, 25 bp, Mus musculus
actttgaagatgaccgcaacccgca

SEQ ID NO: 185250 - DNA, 25 bp, Mus musculus
actttgaagatgaggatttcttatc

SEQ ID NO: 185251 - DNA, 25 bp, Mus musculus
actttgaatgctcacactgcctcca

SEQ ID NO: 185252 - DNA, 25 bp, Mus musculus
actttgacaagatcctggctgagtg

SEQ ID NO: 185253 - DNA, 25 bp, Mus musculus
actttgaccggaagaagacgggcat

SEQ ID NO: 185254 - DNA, 25 bp, Mus musculus
actttgaccgggatcactccggcac

SEQ ID NO: 185255 - DNA, 25 bp, Mus musculus
actttgacctcaaggtcctaaatgc

SEQ ID NO: 185256 - DNA, 25 bp, Mus musculus
actttgacgagatcatcagtgagga

SEQ ID NO: 185257 - DNA, 25 bp, Mus musculus
actttgacgagtgaggagagattcc

SEQ ID NO: 185258 - DNA, 25 bp, Mus musculus
actttgactcggtccctaccacccg

SEQ ID NO: 185259 - DNA, 25 bp, Mus musculus
actttgactcgtgaagtcatcagag

SEQ ID NO: 185260 - DNA, 25 bp, Mus musculus
actttgactgtcaggaacatgacat

SEQ ID NO: 185261 - DNA, 25 bp, Mus musculus
actttgagaaaggtttgcagctaga

SEQ ID NO: 185262 - DNA, 25 bp, Mus musculus
actttgagaaccctgactgaaataa

SEQ ID NO: 185263 - DNA, 25 bp, Mus musculus
actttgagaatctcctgtccaagaa

SEQ ID NO: 185264 - DNA, 25 bp, Mus musculus
actttgagacctataatggtcagca

SEQ ID NO: 185265 - DNA, 25 bp, Mus musculus
actttgagattgtaaaagctggcag

SEQ ID NO: 185266 - DNA, 25 bp, Mus musculus
actttgagtctaacaaatgcttccc

SEQ ID NO: 185267 - DNA, 25 bp, Mus musculus
actttgataagaatggcaatcccaa

SEQ ID NO: 185268 - DNA, 25 bp, Mus musculus
actttgataaggatggcattgtagc

SEQ ID NO: 185269 - DNA, 25 bp, Mus musculus
actttgatcacaaggtcacacttgg

SEQ ID NO: 185270 - DNA, 25 bp, Mus musculus
actttgatgaggtacagtatcagat

SEQ ID NO: 185271 - DNA, 25 bp, Mus musculus
actttgcaaagacgtgtgcaagaac

SEQ ID NO: 185272 - DNA, 25 bp, Mus musculus
actttgcaaagacgtgtgtgtctgc

SEQ ID NO: 185273 - DNA, 25 bp, Mus musculus
actttgcaaaggcaaaatcatgggg

SEQ ID NO: 185274 - DNA, 25 bp, Mus musculus
actttgcaaggcagtactacgagat

SEQ ID NO: 185275 - DNA, 25 bp, Mus musculus
actttgcacagcactgccaggggga

SEQ ID NO: 185276 - DNA, 25 bp, Mus musculus
actttgcagccaagtccctgccgcc

SEQ ID NO: 185277 - DNA, 25 bp, Mus musculus
actttgcagtctatgctggaaacag

SEQ ID NO: 185278 - DNA, 25 bp, Mus musculus
actttgcagtctatggactggaaac

SEQ ID NO: 185279 - DNA, 25 bp, Mus musculus
actttgccaaagcagggctgcaggt

SEQ ID NO: 185280 - DNA, 25 bp, Mus musculus
actttgccaagacatactccagtga

SEQ ID NO: 185281 - DNA, 25 bp, Mus musculus
actttgccagaaagtgagccacgcc

SEQ ID NO: 185282 - DNA, 25 bp, Mus musculus
actttgccaggacctgtgtcatgtc

SEQ ID NO: 185283 - DNA, 25 bp, Mus musculus
actttgccaggcgctgtgctttggc

SEQ ID NO: 185284 - DNA, 25 bp, Mus musculus
actttgctggatgcttttgttaatg

SEQ ID NO: 185285 - DNA, 25 bp, Mus musculus
actttggaacagattcaagtcaatc

SEQ ID NO: 185286 - DNA, 25 bp, Mus musculus
actttggaagagctcattgcccacc

SEQ ID NO: 185287 - DNA, 25 bp, Mus musculus
actttggacagtcttgcaatgtttc

SEQ ID NO: 185288 - DNA, 25 bp, Mus musculus
actttggacagtgttgcaatgtttc

SEQ ID NO: 185289 - DNA, 25 bp, Mus musculus
actttggaccaaagacccagccatt

SEQ ID NO: 185290 - DNA, 25 bp, Mus musculus
actttggaccaactgttctcagttt

SEQ ID NO: 185291 - DNA, 25 bp, Mus musculus
actttggagaagtattgaggctccc

SEQ ID NO: 185292 - DNA, 25 bp, Mus musculus
actttggatggaagacttcgagttg

SEQ ID NO: 185293 - DNA, 25 bp, Mus musculus
actttggcaaatggagtattggctt

SEQ ID NO: 185294 - DNA, 25 bp, Mus musculus
actttggcggcgaagaggtcctgag

SEQ ID NO: 185295 - DNA, 25 bp, Mus musculus
actttggcggcgaagtctcccctca

SEQ ID NO: 185296 - DNA, 25 bp, Mus musculus
actttggctttaagacactggaacg

SEQ ID NO: 185297 - DNA, 25 bp, Mus musculus
actttgggaggggggatcgcagccg

SEQ ID NO: 185298 - DNA, 25 bp, Mus musculus
actttgggatgaaggtgactgtcct

SEQ ID NO: 185299 - DNA, 25 bp, Mus musculus
actttgggcaggaaacaagttacat

SEQ ID NO: 185300 - DNA, 25 bp, Mus musculus
actttgggggagacgttcatgggcg

SEQ ID NO: 185301 - DNA, 25 bp, Mus musculus
actttgggggagactatggtggaac

SEQ ID NO: 185302 - DNA, 25 bp, Mus musculus
actttggtaaacttcctacagcgtg

SEQ ID NO: 185303 - DNA, 25 bp, Mus musculus
actttgtaaagcaatccgaaggtcc

SEQ ID NO: 185304 - DNA, 25 bp, Mus musculus
actttgtaagaaactggtcaaaatc

SEQ ID NO: 185305 - DNA, 25 bp, Mus musculus
actttgtaagagaaataaagaaaga

SEQ ID NO: 185306 - DNA, 25 bp, Mus musculus
actttgtaaggtatctactttatcc

SEQ ID NO: 185307 - DNA, 25 bp, Mus musculus
actttgtacaaggagggtgacaata

SEQ ID NO: 185308 - DNA, 25 bp, Mus musculus
actttgtaccctatgataaaaacta

SEQ ID NO: 185309 - DNA, 25 bp, Mus musculus
actttgtaccctatgcatctgcctc

SEQ ID NO: 185310 - DNA, 25 bp, Mus musculus
actttgtagccatcctcccgccaca

SEQ ID NO: 185311 - DNA, 25 bp, Mus musculus
actttgtcaagtccaagacaggcct

SEQ ID NO: 185312 - DNA, 25 bp, Mus musculus
actttgtcatccaggtcttggataa

SEQ ID NO: 185313 - DNA, 25 bp, Mus musculus
actttgtctttaaggtctctaatag

SEQ ID NO: 185314 - DNA, 25 bp, Mus musculus
actttgtctttaaggtggtgctgat

SEQ ID NO: 185315 - DNA, 25 bp, Mus musculus
actttgtgaagctccgttttgttca

SEQ ID NO: 185316 - DNA, 25 bp, Mus musculus
actttgtgaagctctgaaaacctgg

SEQ ID NO: 185317 - DNA, 25 bp, Mus musculus
actttgtgaaggacatctttggctg

SEQ ID NO: 185318 - DNA, 25 bp, Mus musculus
actttgtgaaggggcagcattttga

SEQ ID NO: 185319 - DNA, 25 bp, Mus musculus
actttgtgcaggtcccagccagctc

SEQ ID NO: 185320 - DNA, 25 bp, Mus musculus
actttgtgcagtggctcgtgggttt

SEQ ID NO: 185321 - DNA, 25 bp, Mus musculus
actttgtgctggaaggcgcttttgt

SEQ ID NO: 185322 - DNA, 25 bp, Mus musculus
actttgtgctgggaaagagtatggc

SEQ ID NO: 185323 - DNA, 25 bp, Mus musculus
actttgtggacctctgcagggcccc

SEQ ID NO: 185324 - DNA, 25 bp, Mus musculus
actttgttatggctgaatcagagat

SEQ ID NO: 185325 - DNA, 25 bp, Mus musculus
actttgttctcgagcaggttagcca

SEQ ID NO: 185326 - DNA, 25 bp, Mus musculus
actttgtttacctaggtgcctatga

SEQ ID NO: 185327 - DNA, 25 bp, Mus musculus
actttgtttatctagactaaaacaa

SEQ ID NO: 185328 - DNA, 25 bp, Mus musculus
actttgtttatctaggtgcctatga

SEQ ID NO: 185329 - DNA, 25 bp, Mus musculus
actttgttttccagccaaatagagg

SEQ ID NO: 185330 - DNA, 25 bp, Mus musculus
actttgtttttctggatcttgtttc

SEQ ID NO: 185331 - DNA, 25 bp, Mus musculus
acttttacaagacagtccagcagca

SEQ ID NO: 185332 - DNA, 25 bp, Mus musculus
acttttacaaggtggtacagcaaca

SEQ ID NO: 185333 - DNA, 25 bp, Mus musculus
acttttactgtataagtcttgcttc

SEQ ID NO: 185334 - DNA, 25 bp, Mus musculus
acttttatacaggactgacagacga

SEQ ID NO: 185335 - DNA, 25 bp, Mus musculus
acttttatcctgtggtgtgagtgtt

SEQ ID NO: 185336 - DNA, 25 bp, Mus musculus
acttttatggccttgaactcagaaa

SEQ ID NO: 185337 - DNA, 25 bp, Mus musculus
acttttcaaagcagttgaaaactga

SEQ ID NO: 185338 - DNA, 25 bp, Mus musculus
acttttcaacagattttgttcctgg

SEQ ID NO: 185339 - DNA, 25 bp, Mus musculus
acttttcatcgtccaactttaaccg

SEQ ID NO: 185340 - DNA, 25 bp, Mus musculus
acttttccagaagaccagtttccca

SEQ ID NO: 185341 - DNA, 25 bp, Mus musculus
acttttccagtgtgtccattgtcca

SEQ ID NO: 185342 - DNA, 25 bp, Mus musculus
acttttccagttccccacactgctc

SEQ ID NO: 185343 - DNA, 25 bp, Mus musculus
acttttccatgatcatcgatggcgt

SEQ ID NO: 185344 - DNA, 25 bp, Mus musculus
acttttcctactttcactctactca

SEQ ID NO: 185345 - DNA, 25 bp, Mus musculus
acttttcctttgatcgctgccagac

SEQ ID NO: 185346 - DNA, 25 bp, Mus musculus
acttttcctttgatctctgaccagc

SEQ ID NO: 185347 - DNA, 25 bp, Mus musculus
acttttcgcggattctttgggagcc

SEQ ID NO: 185348 - DNA, 25 bp, Mus musculus
acttttcttcagcagatgatgcccg

SEQ ID NO: 185349 - DNA, 25 bp, Mus musculus
acttttcttccacagtgcctccgga

SEQ ID NO: 185350 - DNA, 25 bp, Mus musculus
acttttcttgagcgttggtgatgac

SEQ ID NO: 185351 - DNA, 25 bp, Mus musculus
acttttcttgagtgattccacacaa

SEQ ID NO: 185352 - DNA, 25 bp, Mus musculus
acttttgaattaggacgagtcttgc

SEQ ID NO: 185353 - DNA, 25 bp, Mus musculus
acttttgaattgttcctgtgaaggc

SEQ ID NO: 185354 - DNA, 25 bp, Mus musculus
acttttgagaatgctctggcttctc

SEQ ID NO: 185355 - DNA, 25 bp, Mus musculus
acttttgcagagttctctgtcattg

SEQ ID NO: 185356 - DNA, 25 bp, Mus musculus
acttttgcgcaacgaaaaattcatt

SEQ ID NO: 185357 - DNA, 25 bp, Mus musculus
acttttgcgcaacgaatcctgactg

SEQ ID NO: 185358 - DNA, 25 bp, Mus musculus
acttttggagattggggcctgtgtt

SEQ ID NO: 185359 - DNA, 25 bp, Mus musculus
acttttggatatggggtgcttcgag

SEQ ID NO: 185360 - DNA, 25 bp, Mus musculus
acttttgggctctatacaaccatat

SEQ ID NO: 185361 - DNA, 25 bp, Mus musculus
acttttgggggagctgaagaagaag

SEQ ID NO: 185362 - DNA, 25 bp, Mus musculus
acttttggtcacttgctgagatatg

SEQ ID NO: 185363 - DNA, 25 bp, Mus musculus
acttttgtagccgaagcagatccac

SEQ ID NO: 185364 - DNA, 25 bp, Mus musculus
acttttgttacagactagcttcctt

SEQ ID NO: 185365 - DNA, 25 bp, Mus musculus
actttttacaaagtgattggagttg

SEQ ID NO: 185366 - DNA, 25 bp, Mus musculus
actttttacataatccccagatgca

SEQ ID NO: 185367 - DNA, 25 bp, Mus musculus
actttttacataatcggggtctaat

SEQ ID NO: 185368 - DNA, 25 bp, Mus musculus
actttttattcaggccacgcaacgg

SEQ ID NO: 185369 - DNA, 25 bp, Mus musculus
actttttattcagggatgtgaaatg

SEQ ID NO: 185370 - DNA, 25 bp, Mus musculus
actttttcaccccaggcttacagtt

SEQ ID NO: 185371 - DNA, 25 bp, Mus musculus
actttttcagaatatagagtcatgg

SEQ ID NO: 185372 - DNA, 25 bp, Mus musculus
actttttcattccaatgtgagttct

SEQ ID NO: 185373 - DNA, 25 bp, Mus musculus
actttttcattccattgtgagttct

SEQ ID NO: 185374 - DNA, 25 bp, Mus musculus
actttttgaaccgctcccattttcg

SEQ ID NO: 185375 - DNA, 25 bp, Mus musculus
acttttttgagacagaaaccaactt

SEQ ID NO: 185376 - DNA, 25 bp, Mus musculus
acttttttgctctctggagccaatt

SEQ ID NO: 185377 - DNA, 25 bp, Mus musculus
acttttttggttatgggcaaagcag

SEQ ID NO: 185378 - DNA, 25 bp, Mus musculus
agaaaaaaacacctggacttctctg

SEQ ID NO: 185379 - DNA, 25 bp, Mus musculus
agaaaaaaagaccccagcgcatctc

SEQ ID NO: 185380 - DNA, 25 bp, Mus musculus
agaaaaaaaggtttatgaagctgat

SEQ ID NO: 185381 - DNA, 25 bp, Mus musculus
agaaaaaacagacagtgatgtgact

SEQ ID NO: 185382 - DNA, 25 bp, Mus musculus
agaaaaaagcagtggtttgtattga

SEQ ID NO: 185383 - DNA, 25 bp, Mus musculus
agaaaaaatggtgacgccatcttct

SEQ ID NO: 185384 - DNA, 25 bp, Mus musculus
agaaaaaatggtgaggccatcttct

SEQ ID NO: 185385 - DNA, 25 bp, Mus musculus
agaaaaaattacacaaacattactt

SEQ ID NO: 185386 - DNA, 25 bp, Mus musculus
agaaaaacaaagggaatgtgactat

SEQ ID NO: 185387 - DNA, 25 bp, Mus musculus
agaaaaacaaatgcaatttcaagtt

SEQ ID NO: 185388 - DNA, 25 bp, Mus musculus
agaaaaacaagagacagaaccctgt

SEQ ID NO: 185389 - DNA, 25 bp, Mus musculus
agaaaaacaagagagtctcactatg

SEQ ID NO: 185390 - DNA, 25 bp, Mus musculus
agaaaaacaagagcagtcagcacgg

SEQ ID NO: 185391 - DNA, 25 bp, Mus musculus
agaaaaacaagagggtggagatggc

SEQ ID NO: 185392 - DNA, 25 bp, Mus musculus
agaaaaacaagggaagcttagatat

SEQ ID NO: 185393 - DNA, 25 bp, Mus musculus
agaaaaacagctagctgcacgagaa

SEQ ID NO: 185394 - DNA, 25 bp, Mus musculus
agaaaaaccaatggctccccctgtg

SEQ ID NO: 185395 - DNA, 25 bp, Mus musculus
agaaaaaccagaaccagatggaagt

SEQ ID NO: 185396 - DNA, 25 bp, Mus musculus
agaaaaaccagaagaacaggagaat

SEQ ID NO: 185397 - DNA, 25 bp, Mus musculus
agaaaaaccagaagcctgtgccatc

SEQ ID NO: 185398 - DNA, 25 bp, Mus musculus
agaaaaacccaaagatgcagacagc

SEQ ID NO: 185399 - DNA, 25 bp, Mus musculus
agaaaaagaatgcggctggcgcatt

SEQ ID NO: 185400 - DNA, 25 bp, Mus musculus
agaaaaagaggctcctcaactttca

SEQ ID NO: 185401 - DNA, 25 bp, Mus musculus
agaaaaagatcaatggacagctcgg

SEQ ID NO: 185402 - DNA, 25 bp, Mus musculus
agaaaaaggcagagggagcattcct

SEQ ID NO: 185403 - DNA, 25 bp, Mus musculus
agaaaaaggccaaaactgtacatca

SEQ ID NO: 185404 - DNA, 25 bp, Mus musculus
agaaaaagggcttttcctagatgac

SEQ ID NO: 185405 - DNA, 25 bp, Mus musculus
agaaaaagtaagtgcttccttggca

SEQ ID NO: 185406 - DNA, 25 bp, Mus musculus
agaaaaataaattcggagctgtctt

SEQ ID NO: 185407 - DNA, 25 bp, Mus musculus
agaaaaatacccaaagcacctcatt

SEQ ID NO: 185408 - DNA, 25 bp, Mus musculus
agaaaaatgagaagaattcagggat

SEQ ID NO: 185409 - DNA, 25 bp, Mus musculus
agaaaaatgcatcaaagagatgtct

SEQ ID NO: 185410 - DNA, 25 bp, Mus musculus
agaaaaatggaatctctacgaaggt

SEQ ID NO: 185411 - DNA, 25 bp, Mus musculus
agaaaaatgtctacgaagagatctc

SEQ ID NO: 185412 - DNA, 25 bp, Mus musculus
agaaaaattgaacgagaagtaaaca

SEQ ID NO: 185413 - DNA, 25 bp, Mus musculus
agaaaaattgaacgagaagtaaagt

SEQ ID NO: 185414 - DNA, 25 bp, Mus musculus
agaaaaatttagaatatgacatctg

SEQ ID NO: 185415 - DNA, 25 bp, Mus musculus
agaaaacaaaaagtgtgaacatggc

SEQ ID NO: 185416 - DNA, 25 bp, Mus musculus
agaaaacaaagaactgcggacatcc

SEQ ID NO: 185417 - DNA, 25 bp, Mus musculus
agaaaacaaagtggagcgaccctgt

SEQ ID NO: 185418 - DNA, 25 bp, Mus musculus
agaaaacaaatggctccagcccact

SEQ ID NO: 185419 - DNA, 25 bp, Mus musculus
agaaaacaagacaggtcgattgagt

SEQ ID NO: 185420 - DNA, 25 bp, Mus musculus
agaaaacagagaaacctgatcagga

SEQ ID NO: 185421 - DNA, 25 bp, Mus musculus
agaaaacagatgatccagaggagta

SEQ ID NO: 185422 - DNA, 25 bp, Mus musculus
agaaaacagatggtacaaagaagcg

SEQ ID NO: 185423 - DNA, 25 bp, Mus musculus
agaaaacagtgctctgcagttttga

SEQ ID NO: 185424 - DNA, 25 bp, Mus musculus
agaaaacataacaacattcccgtca

SEQ ID NO: 185425 - DNA, 25 bp, Mus musculus
agaaaacatcaaggaacaataaaaa

SEQ ID NO: 185426 - DNA, 25 bp, Mus musculus
agaaaaccaacagggcatgaaagaa

SEQ ID NO: 185427 - DNA, 25 bp, Mus musculus
agaaaaccacagtgtcctgtgcatg

SEQ ID NO: 185428 - DNA, 25 bp, Mus musculus
agaaaaccagacagaataagaatga

SEQ ID NO: 185429 - DNA, 25 bp, Mus musculus
agaaaacccaacagcccactgagtg

SEQ ID NO: 185430 - DNA, 25 bp, Mus musculus
agaaaacccaaggaatatggttgag

SEQ ID NO: 185431 - DNA, 25 bp, Mus musculus
agaaaaccctggcgtttagagaaga

SEQ ID NO: 185432 - DNA, 25 bp, Mus musculus
agaaaacctgcagtgtcttaaaaca

SEQ ID NO: 185433 - DNA, 25 bp, Mus musculus
agaaaaccttcagttggatcctcca

SEQ ID NO: 185434 - DNA, 25 bp, Mus musculus
agaaaacggaggatggacagtcata

SEQ ID NO: 185435 - DNA, 25 bp, Mus musculus
agaaaactaagatgtcaacttgtgg

SEQ ID NO: 185436 - DNA, 25 bp, Mus musculus
agaaaactatgcaggtgtgcattgg

SEQ ID NO: 185437 - DNA, 25 bp, Mus musculus
agaaaactgaaaatgatacagtgtg

SEQ ID NO: 185438 - DNA, 25 bp, Mus musculus
agaaaactgaaaatggtgttttcga

SEQ ID NO: 185439 - DNA, 25 bp, Mus musculus
agaaaactgactgagactaaaatac

SEQ ID NO: 185440 - DNA, 25 bp, Mus musculus
agaaaactgagatgtgtctacattg

SEQ ID NO: 185441 - DNA, 25 bp, Mus musculus
agaaaactgcaaagaaccgggtggt

SEQ ID NO: 185442 - DNA, 25 bp, Mus musculus
agaaaactggggtaattgaacatga

SEQ ID NO: 185443 - DNA, 25 bp, Mus musculus
agaaaactgtggcaacataacatgt

SEQ ID NO: 185444 - DNA, 25 bp, Mus musculus
agaaaactgttcattcgtatcttga

SEQ ID NO: 185445 - DNA, 25 bp, Mus musculus
agaaaagaaagaatgcgtccaccat

SEQ ID NO: 185446 - DNA, 25 bp, Mus musculus
agaaaagaaatagaggtacaacata

SEQ ID NO: 185447 - DNA, 25 bp, Mus musculus
agaaaagaaggctggtgaggacttc

SEQ ID NO: 185448 - DNA, 25 bp, Mus musculus
agaaaagaccactaaccatgagttt

SEQ ID NO: 185449 - DNA, 25 bp, Mus musculus
agaaaagaccactgggttatcctat

SEQ ID NO: 185450 - DNA, 25 bp, Mus musculus
agaaaagactatctaagctggaacc

SEQ ID NO: 185451 - DNA, 25 bp, Mus musculus
agaaaagagaagctgttgcaggaag

SEQ ID NO: 185452 - DNA, 25 bp, Mus musculus
agaaaagagagagaggtacctgtgt

SEQ ID NO: 185453 - DNA, 25 bp, Mus musculus
agaaaagatggcagcctttacttgt

SEQ ID NO: 185454 - DNA, 25 bp, Mus musculus
agaaaagcaaaacagggagccaccc

SEQ ID NO: 185455 - DNA, 25 bp, Mus musculus
agaaaagcaagtgctgtcttcctgc

SEQ ID NO: 185456 - DNA, 25 bp, Mus musculus
agaaaagcacagacgagctaaactc

SEQ ID NO: 185457 - DNA, 25 bp, Mus musculus
agaaaagcacagccttcacaggctg

SEQ ID NO: 185458 - DNA, 25 bp, Mus musculus
agaaaagcacaggctgctgaggaac

SEQ ID NO: 185459 - DNA, 25 bp, Mus musculus
agaaaagccaggcctgtgatcctgg

SEQ ID NO: 185460 - DNA, 25 bp, Mus musculus
agaaaagcccaacaccagctacatc

SEQ ID NO: 185461 - DNA, 25 bp, Mus musculus
agaaaagcccaggtttaattcagaa

SEQ ID NO: 185462 - DNA, 25 bp, Mus musculus
agaaaagcccagtggctttgggtgg

SEQ ID NO: 185463 - DNA, 25 bp, Mus musculus
agaaaagcccagttctaattcagaa

SEQ ID NO: 185464 - DNA, 25 bp, Mus musculus
agaaaagcctcctgctcctgagtca

SEQ ID NO: 185465 - DNA, 25 bp, Mus musculus
agaaaagctcaagaagaaagagttc

SEQ ID NO: 185466 - DNA, 25 bp, Mus musculus
agaaaagctcaggctgcaagcctga

SEQ ID NO: 185467 - DNA, 25 bp, Mus musculus
agaaaagctcaggctggcaaatgag

SEQ ID NO: 185468 - DNA, 25 bp, Mus musculus
agaaaagctgagagaaacgaagtga

SEQ ID NO: 185469 - DNA, 25 bp, Mus musculus
agaaaagctgcaagctttcagaaag

SEQ ID NO: 185470 - DNA, 25 bp, Mus musculus
agaaaagctgcaagttgcagaatta

SEQ ID NO: 185471 - DNA, 25 bp, Mus musculus
agaaaaggagaagcccaacaggagg

SEQ ID NO: 185472 - DNA, 25 bp, Mus musculus
agaaaaggagcgagagtaccccagg

SEQ ID NO: 185473 - DNA, 25 bp, Mus musculus
agaaaaggagcgagagtttccactg

SEQ ID NO: 185474 - DNA, 25 bp, Mus musculus
agaaaaggcagcattctcatacaag

SEQ ID NO: 185475 - DNA, 25 bp, Mus musculus
agaaaaggccaaaagcctgatagag

SEQ ID NO: 185476 - DNA, 25 bp, Mus musculus
agaaaaggccagcctgccgggagtg

SEQ ID NO: 185477 - DNA, 25 bp, Mus musculus
agaaaaggcggcggtcctttctaca

SEQ ID NO: 185478 - DNA, 25 bp, Mus musculus
agaaaaggtcaaaactctaacacgt

SEQ ID NO: 185479 - DNA, 25 bp, Mus musculus
agaaaaggtgcagatcctggggcag

SEQ ID NO: 185480 - DNA, 25 bp, Mus musculus
agaaaaggtgcagcaactgctttgc

SEQ ID NO: 185481 - DNA, 25 bp, Mus musculus
agaaaaggttgatgggaatgtaaat

SEQ ID NO: 185482 - DNA, 25 bp, Mus musculus
agaaaaggttgatggtccgcagaca

SEQ ID NO: 185483 - DNA, 25 bp, Mus musculus
agaaaagtaccaggtgttttcagct

SEQ ID NO: 185484 - DNA, 25 bp, Mus musculus
agaaaagtcaagaagaacaaacaac

SEQ ID NO: 185485 - DNA, 25 bp, Mus musculus
agaaaagtcaaggtgtactttgtgg

SEQ ID NO: 185486 - DNA, 25 bp, Mus musculus
agaaaagtgatgggattcgaagagt

SEQ ID NO: 185487 - DNA, 25 bp, Mus musculus
agaaaagttttggcatacaaatgct

SEQ ID NO: 185488 - DNA, 25 bp, Mus musculus
agaaaataaagaataaactagacaa

SEQ ID NO: 185489 - DNA, 25 bp, Mus musculus
agaaaataaataaggaagcagtatg

SEQ ID NO: 185490 - DNA, 25 bp, Mus musculus
agaaaataagccttgtacactggac

SEQ ID NO: 185491 - DNA, 25 bp, Mus musculus
agaaaataatacaatggattctgaa

SEQ ID NO: 185492 - DNA, 25 bp, Mus musculus
agaaaatactgaattttctcagcgt

SEQ ID NO: 185493 - DNA, 25 bp, Mus musculus
agaaaatactttccgtccagatcgc

SEQ ID NO: 185494 - DNA, 25 bp, Mus musculus
agaaaatatggccaacagcaggctg

SEQ ID NO: 185495 - DNA, 25 bp, Mus musculus
agaaaatatggctttacaagatgaa

SEQ ID NO: 185496 - DNA, 25 bp, Mus musculus
agaaaatattgaagtttaccatagt

SEQ ID NO: 185497 - DNA, 25 bp, Mus musculus
agaaaatattggattggaagcctgc

SEQ ID NO: 185498 - DNA, 25 bp, Mus musculus
agaaaatatttagattgaggatggg

SEQ ID NO: 185499 - DNA, 25 bp, Mus musculus
agaaaatcaaactgcagcttgctgc

SEQ ID NO: 185500 - DNA, 25 bp, Mus musculus
agaaaatcaaggagcttgtagtgaa

SEQ ID NO: 185501 - DNA, 25 bp, Mus musculus
agaaaatcagacaagaaccctaatt

SEQ ID NO: 185502 - DNA, 25 bp, Mus musculus
agaaaatcagacaagctatggtatc

SEQ ID NO: 185503 - DNA, 25 bp, Mus musculus
agaaaatcatatgtgacaaatacaa

SEQ ID NO: 185504 - DNA, 25 bp, Mus musculus
agaaaatccagcagacccgagaagc

SEQ ID NO: 185505 - DNA, 25 bp, Mus musculus
agaaaatcctgcaggactacaaatc

SEQ ID NO: 185506 - DNA, 25 bp, Mus musculus
agaaaatccttgccagagatcctca

SEQ ID NO: 185507 - DNA, 25 bp, Mus musculus
agaaaatccttgctagagaaaatga

SEQ ID NO: 185508 - DNA, 25 bp, Mus musculus
agaaaatctcagcctccttccctgg

SEQ ID NO: 185509 - DNA, 25 bp, Mus musculus
agaaaatgaacaatcactttttaat

SEQ ID NO: 185510 - DNA, 25 bp, Mus musculus
agaaaatgaagtttctacactaaag

SEQ ID NO: 185511 - DNA, 25 bp, Mus musculus
agaaaatgagaaagaagggagccta

SEQ ID NO: 185512 - DNA, 25 bp, Mus musculus
agaaaatgagaaagatatagcaggt

SEQ ID NO: 185513 - DNA, 25 bp, Mus musculus
agaaaatgagaaagattctgaagca

SEQ ID NO: 185514 - DNA, 25 bp, Mus musculus
agaaaatgagctctgttaaggaaga

SEQ ID NO: 185515 - DNA, 25 bp, Mus musculus
agaaaatgagctgaacattatccac

SEQ ID NO: 185516 - DNA, 25 bp, Mus musculus
agaaaatgagtaagagatttgaaaa

SEQ ID NO: 185517 - DNA, 25 bp, Mus musculus
agaaaatgcacgagcctggttacct

SEQ ID NO: 185518 - DNA, 25 bp, Mus musculus
agaaaatgctaaggtttatgggacc

SEQ ID NO: 185519 - DNA, 25 bp, Mus musculus
agaaaatgctgaaggacgcattcag

SEQ ID NO: 185520 - DNA, 25 bp, Mus musculus
agaaaatggaagagacctgtgggtc

SEQ ID NO: 185521 - DNA, 25 bp, Mus musculus
agaaaatggaagcttggctgaagag

SEQ ID NO: 185522 - DNA, 25 bp, Mus musculus
agaaaatggaaggtcactacgttca

SEQ ID NO: 185523 - DNA, 25 bp, Mus musculus
agaaaatggacggacaaaggagaca

SEQ ID NO: 185524 - DNA, 25 bp, Mus musculus
agaaaatggacggaggaagtgtgaa

SEQ ID NO: 185525 - DNA, 25 bp, Mus musculus
agaaaatggatgtcattgctagaat

SEQ ID NO: 185526 - DNA, 25 bp, Mus musculus
agaaaatggatgttaccattgagcc

SEQ ID NO: 185527 - DNA, 25 bp, Mus musculus
agaaaatggccaccaccggccacac

SEQ ID NO: 185528 - DNA, 25 bp, Mus musculus
agaaaatgtcaaggtatacatctat

SEQ ID NO: 185529 - DNA, 25 bp, Mus musculus
agaaaatgttaaaatgtgtcccctg

SEQ ID NO: 185530 - DNA, 25 bp, Mus musculus
agaaaattaaagatgaactaatgac

SEQ ID NO: 185531 - DNA, 25 bp, Mus musculus
agaaaattaaaggaaattgatcgtg

SEQ ID NO: 185532 - DNA, 25 bp, Mus musculus
agaaaattagagccccttccaatgt

SEQ ID NO: 185533 - DNA, 25 bp, Mus musculus
agaaaattattcaagaacaggacgc

SEQ ID NO: 185534 - DNA, 25 bp, Mus musculus
agaaaattattcaagagatcatcga

SEQ ID NO: 185535 - DNA, 25 bp, Mus musculus
agaaaattattgatattttcatttc

SEQ ID NO: 185536 - DNA, 25 bp, Mus musculus
agaaaattcatgcagatgaatgaga

SEQ ID NO: 185537 - DNA, 25 bp, Mus musculus
agaaaattcatgcgagggagaactg

SEQ ID NO: 185538 - DNA, 25 bp, Mus musculus
agaaaattgcagaagggagagagtg

SEQ ID NO: 185539 - DNA, 25 bp, Mus musculus
agaaaattgcagaaggtgcacatca

SEQ ID NO: 185540 - DNA, 25 bp, Mus musculus
agaaaatttcaggccctcagtaccg

SEQ ID NO: 185541 - DNA, 25 bp, Mus musculus
agaaacaaacggctcttgctgagct

SEQ ID NO: 185542 - DNA, 25 bp, Mus musculus
agaaacaaaggctagtctacccaag

SEQ ID NO: 185543 - DNA, 25 bp, Mus musculus
agaaacaaatgggatggaagactgt

SEQ ID NO: 185544 - DNA, 25 bp, Mus musculus
agaaacaaatggtgaagaagatggc

SEQ ID NO: 185545 - DNA, 25 bp, Mus musculus
agaaacaagaagctcaggcgaaagg

SEQ ID NO: 185546 - DNA, 25 bp, Mus musculus
agaaacaaggtgctctgttgccgtt

SEQ ID NO: 185547 - DNA, 25 bp, Mus musculus
agaaacaatggagtccaacacaatc

SEQ ID NO: 185548 - DNA, 25 bp, Mus musculus
agaaacacacaggcagatgtcatca

SEQ ID NO: 185549 - DNA, 25 bp, Mus musculus
agaaacacagagagcttctcaggat

SEQ ID NO: 185550 - DNA, 25 bp, Mus musculus
agaaacacagatttaccttatgagc

SEQ ID NO: 185551 - DNA, 25 bp, Mus musculus
agaaacacagcttttcttctcacag

SEQ ID NO: 185552 - DNA, 25 bp, Mus musculus
agaaacacagggggtgcagctttta

SEQ ID NO: 185553 - DNA, 25 bp, Mus musculus
agaaacacaggtggaaaaggagggg

SEQ ID NO: 185554 - DNA, 25 bp, Mus musculus
agaaacacgtcggcttctgacgaag

SEQ ID NO: 185555 - DNA, 25 bp, Mus musculus
agaaacacttaaagtatcaagagag

SEQ ID NO: 185556 - DNA, 25 bp, Mus musculus
agaaacagaagactctattcttcat

SEQ ID NO: 185557 - DNA, 25 bp, Mus musculus
agaaacagacacaagttttgagaaa

SEQ ID NO: 185558 - DNA, 25 bp, Mus musculus
agaaacagacagctctgtcttcccc

SEQ ID NO: 185559 - DNA, 25 bp, Mus musculus
agaaacagagatagccagcaggaaa

SEQ ID NO: 185560 - DNA, 25 bp, Mus musculus
agaaacagaggtaatctacaaaatg

SEQ ID NO: 185561 - DNA, 25 bp, Mus musculus
agaaacagagtgctactgtctaaga

SEQ ID NO: 185562 - DNA, 25 bp, Mus musculus
agaaacagcaggtgattcaggatta

SEQ ID NO: 185563 - DNA, 25 bp, Mus musculus
agaaacagccaaagaaaactaactg

SEQ ID NO: 185564 - DNA, 25 bp, Mus musculus
agaaacagcttgagcccgcacagcc

SEQ ID NO: 185565 - DNA, 25 bp, Mus musculus
agaaacaggagaatccaaatgggaa

SEQ ID NO: 185566 - DNA, 25 bp, Mus musculus
agaaacaggagttattaaaatgtgt

SEQ ID NO: 185567 - DNA, 25 bp, Mus musculus
agaaacataaaaaagaggacgaggc

SEQ ID NO: 185568 - DNA, 25 bp, Mus musculus
agaaacataaaaaagcttgcacaca

SEQ ID NO: 185569 - DNA, 25 bp, Mus musculus
agaaacatccggcatttgtagaaac

SEQ ID NO: 185570 - DNA, 25 bp, Mus musculus
agaaacatcgagacctttgccactc

SEQ ID NO: 185571 - DNA, 25 bp, Mus musculus
agaaacatcgagagatccggggttc

SEQ ID NO: 185572 - DNA, 25 bp, Mus musculus
agaaacatgcgtacggctggcctca

SEQ ID NO: 185573 - DNA, 25 bp, Mus musculus
agaaacatgctggtggctgggacaa

SEQ ID NO: 185574 - DNA, 25 bp, Mus musculus
agaaacatgctggtggtgtcacagg

SEQ ID NO: 185575 - DNA, 25 bp, Mus musculus
agaaacatgctggttgtcacaggtg

SEQ ID NO: 185576 - DNA, 25 bp, Mus musculus
agaaacatggatgtaaacagaaagt

SEQ ID NO: 185577 - DNA, 25 bp, Mus musculus
agaaacatgtaggcctcattcacat

SEQ ID NO: 185578 - DNA, 25 bp, Mus musculus
agaaacattcaagggtatccagaag

SEQ ID NO: 185579 - DNA, 25 bp, Mus musculus
agaaacatttgtgggagatcaagtt

SEQ ID NO: 185580 - DNA, 25 bp, Mus musculus
agaaacatttgtggggaacagacaa

SEQ ID NO: 185581 - DNA, 25 bp, Mus musculus
agaaaccaaaccatatggagaaggg

SEQ ID NO: 185582 - DNA, 25 bp, Mus musculus
agaaaccaaaccggataagctggag

SEQ ID NO: 185583 - DNA, 25 bp, Mus musculus
agaaaccaagaccaaaaacactggt

SEQ ID NO: 185584 - DNA, 25 bp, Mus musculus
agaaaccaagacccagacttactgc

SEQ ID NO: 185585 - DNA, 25 bp, Mus musculus
agaaaccaagtgctaaactgaaata

SEQ ID NO: 185586 - DNA, 25 bp, Mus musculus
agaaaccacctcaggagtgaagcgt

SEQ ID NO: 185587 - DNA, 25 bp, Mus musculus
agaaaccagaggtggtggaatgatg

SEQ ID NO: 185588 - DNA, 25 bp, Mus musculus
agaaaccaggacaggattccccctc

SEQ ID NO: 185589 - DNA, 25 bp, Mus musculus
agaaaccagtaccaggaatgggcac

SEQ ID NO: 185590 - DNA, 25 bp, Mus musculus
agaaaccagtaccagtcctcttctc

SEQ ID NO: 185591 - DNA, 25 bp, Mus musculus
agaaaccatggtcgcttataccaag

SEQ ID NO: 185592 - DNA, 25 bp, Mus musculus
agaaaccatgtctcgaagatatgac

SEQ ID NO: 185593 - DNA, 25 bp, Mus musculus
agaaacccatgtgagcatgcccaca

SEQ ID NO: 185594 - DNA, 25 bp, Mus musculus
agaaacccccagcctccagtgatgc

SEQ ID NO: 185595 - DNA, 25 bp, Mus musculus
agaaacccctcagcaagccccgccc

SEQ ID NO: 185596 - DNA, 25 bp, Mus musculus
agaaaccgaggaaggtccatgcgaa

SEQ ID NO: 185597 - DNA, 25 bp, Mus musculus
agaaaccgtggatgatgaaaacaat

SEQ ID NO: 185598 - DNA, 25 bp, Mus musculus
agaaacctcgagatcccaaacggcg

SEQ ID NO: 185599 - DNA, 25 bp, Mus musculus
agaaacctgagatttctgtttttgc

SEQ ID NO: 185600 - DNA, 25 bp, Mus musculus
agaaacctgaggagttaggatctgt

SEQ ID NO: 185601 - DNA, 25 bp, Mus musculus
agaaaccttacataaactatactat

SEQ ID NO: 185602 - DNA, 25 bp, Mus musculus
agaaacctttgaatggtaaccaatg

SEQ ID NO: 185603 - DNA, 25 bp, Mus musculus
agaaacgaaccaaggagaaagaact

SEQ ID NO: 185604 - DNA, 25 bp, Mus musculus
agaaacgaagaaagacccaggagag

SEQ ID NO: 185605 - DNA, 25 bp, Mus musculus
agaaacgaatgtttcctgcaatcct

SEQ ID NO: 185606 - DNA, 25 bp, Mus musculus
agaaacgattccatacctgtgttgc

SEQ ID NO: 185607 - DNA, 25 bp, Mus musculus
agaaacgattccatgtatggcattt

SEQ ID NO: 185608 - DNA, 25 bp, Mus musculus
agaaacgattccattgtgacaccat

SEQ ID NO: 185609 - DNA, 25 bp, Mus musculus
agaaacgcattgaagtggtggaaga

SEQ ID NO: 185610 - DNA, 25 bp, Mus musculus
agaaacgctgccgccaagttgaagt

SEQ ID NO: 185611 - DNA, 25 bp, Mus musculus
agaaacgcttcctcagactgctgtc

SEQ ID NO: 185612 - DNA, 25 bp, Mus musculus
agaaacggaaggcatgaaagaagtg

SEQ ID NO: 185613 - DNA, 25 bp, Mus musculus
agaaacggtatctgcagagtttcca

SEQ ID NO: 185614 - DNA, 25 bp, Mus musculus
agaaacgtaaagagctacaagaaaa

SEQ ID NO: 185615 - DNA, 25 bp, Mus musculus
agaaactaaaaatgtcccatctgca

SEQ ID NO: 185616 - DNA, 25 bp, Mus musculus
agaaactaaatcatccatgcatcat

SEQ ID NO: 185617 - DNA, 25 bp, Mus musculus
agaaactaccagagcagaagaatcc

SEQ ID NO: 185618 - DNA, 25 bp, Mus musculus
agaaactaccagatgctggcatcgc

SEQ ID NO: 185619 - DNA, 25 bp, Mus musculus
agaaactaccaggtgacaaacagca

SEQ ID NO: 185620 - DNA, 25 bp, Mus musculus
agaaactaccaggtgcactaggcct

SEQ ID NO: 185621 - DNA, 25 bp, Mus musculus
agaaactactgcggctcaggatact

SEQ ID NO: 185622 - DNA, 25 bp, Mus musculus
agaaactagaagatgaaatgaagac

SEQ ID NO: 185623 - DNA, 25 bp, Mus musculus
agaaactatgtctgctggttgtgga

SEQ ID NO: 185624 - DNA, 25 bp, Mus musculus
agaaactcaaggctcctgactatga

SEQ ID NO: 185625 - DNA, 25 bp, Mus musculus
agaaactccagatcaccatccggag

SEQ ID NO: 185626 - DNA, 25 bp, Mus musculus
agaaactccaggctgcgctggctga

SEQ ID NO: 185627 - DNA, 25 bp, Mus musculus
agaaactctcccctcgtaccagtaa

SEQ ID NO: 185628 - DNA, 25 bp, Mus musculus
agaaactctcccctgtcctggagtg

SEQ ID NO: 185629 - DNA, 25 bp, Mus musculus
agaaactcttcccagagaccgtgaa

SEQ ID NO: 185630 - DNA, 25 bp, Mus musculus
agaaactcttcccaggctttgacct

SEQ ID NO: 185631 - DNA, 25 bp, Mus musculus
agaaactcttttttctcctcttgcc

SEQ ID NO: 185632 - DNA, 25 bp, Mus musculus
agaaactgaacagagtaccatttag

SEQ ID NO: 185633 - DNA, 25 bp, Mus musculus
agaaactgaacagtaaccgatttcg

SEQ ID NO: 185634 - DNA, 25 bp, Mus musculus
agaaactgaacagtgtaccatctat

SEQ ID NO: 185635 - DNA, 25 bp, Mus musculus
agaaactgaagaagaggttaggaat

SEQ ID NO: 185636 - DNA, 25 bp, Mus musculus
agaaactgaggagatctagatccag

SEQ ID NO: 185637 - DNA, 25 bp, Mus musculus
agaaactgaggaggtcccgatcaca

SEQ ID NO: 185638 - DNA, 25 bp, Mus musculus
agaaactgctctggatttctttgac

SEQ ID NO: 185639 - DNA, 25 bp, Mus musculus
agaaactggacagagccaatgcaga

SEQ ID NO: 185640 - DNA, 25 bp, Mus musculus
agaaactggagaccttcttcgggaa

SEQ ID NO: 185641 - DNA, 25 bp, Mus musculus
agaaactggccacaatttactggtt

SEQ ID NO: 185642 - DNA, 25 bp, Mus musculus
agaaactgggaccgtgcctgcaggt

SEQ ID NO: 185643 - DNA, 25 bp, Mus musculus
agaaactgtctccgattttactcct

SEQ ID NO: 185644 - DNA, 25 bp, Mus musculus
agaaacttaaagcacatacgtgtaa

SEQ ID NO: 185645 - DNA, 25 bp, Mus musculus
agaaacttaaaggggctgatcctga

SEQ ID NO: 185646 - DNA, 25 bp, Mus musculus
agaaacttcaggaggagttagagtt

SEQ ID NO: 185647 - DNA, 25 bp, Mus musculus
agaaacttctttcgggaggcagccc

SEQ ID NO: 185648 - DNA, 25 bp, Mus musculus
agaaacttctttcggtgaagaatgc

SEQ ID NO: 185649 - DNA, 25 bp, Mus musculus
agaaacttgaggccagaagtcaatg

SEQ ID NO: 185650 - DNA, 25 bp, Mus musculus
agaaacttgagtatgaaagcaaggt

SEQ ID NO: 185651 - DNA, 25 bp, Mus musculus
agaaagaaaaagtggagtacatgga

SEQ ID NO: 185652 - DNA, 25 bp, Mus musculus
agaaagaaaacaaaaagtgtgaaca

SEQ ID NO: 185653 - DNA, 25 bp, Mus musculus
agaaagaaaagcccttatgttagct

SEQ ID NO: 185654 - DNA, 25 bp, Mus musculus
agaaagaaagatggttgtccctgcc

SEQ ID NO: 185655 - DNA, 25 bp, Mus musculus
agaaagaaatggcaaaagatgtgat

SEQ ID NO: 185656 - DNA, 25 bp, Mus musculus
agaaagaagagaaataataactgcc

SEQ ID NO: 185657 - DNA, 25 bp, Mus musculus
agaaagaagagaaatattacagcga

SEQ ID NO: 185658 - DNA, 25 bp, Mus musculus
agaaagaagagaggagaaggggacc

SEQ ID NO: 185659 - DNA, 25 bp, Mus musculus
agaaagaagagctgctgaatgccat

SEQ ID NO: 185660 - DNA, 25 bp, Mus musculus
agaaagaagaggctgggatcagtac

SEQ ID NO: 185661 - DNA, 25 bp, Mus musculus
agaaagaatccagagaggaagacga

SEQ ID NO: 185662 - DNA, 25 bp, Mus musculus
agaaagaatgctcaaaggtgacaca

SEQ ID NO: 185663 - DNA, 25 bp, Mus musculus
agaaagaatgtcgaagcggaggcca

SEQ ID NO: 185664 - DNA, 25 bp, Mus musculus
agaaagaattgaaggtgcctgaaaa

SEQ ID NO: 185665 - DNA, 25 bp, Mus musculus
agaaagacaattgcgccgcagagct

SEQ ID NO: 185666 - DNA, 25 bp, Mus musculus
agaaagacaattttgggtgtttgat

SEQ ID NO: 185667 - DNA, 25 bp, Mus musculus
agaaagacctaatgaaagctgcacc

SEQ ID NO: 185668 - DNA, 25 bp, Mus musculus
agaaagacctaatgcgcctagaaaa

SEQ ID NO: 185669 - DNA, 25 bp, Mus musculus
agaaagaccttgattcagatggtcc

SEQ ID NO: 185670 - DNA, 25 bp, Mus musculus
agaaagacgaaagaatcctgtggaa

SEQ ID NO: 185671 - DNA, 25 bp, Mus musculus
agaaagacgaaaggtacctgttgtt

SEQ ID NO: 185672 - DNA, 25 bp, Mus musculus
agaaagactatcatgttccaagatg

SEQ ID NO: 185673 - DNA, 25 bp, Mus musculus
agaaagactatcatttatttccgag

SEQ ID NO: 185674 - DNA, 25 bp, Mus musculus
agaaagactggagagaagctgaaga

SEQ ID NO: 185675 - DNA, 25 bp, Mus musculus
agaaagagaaatggattccctgcta

SEQ ID NO: 185676 - DNA, 25 bp, Mus musculus
agaaagagaacgcctcaaagagttg

SEQ ID NO: 185677 - DNA, 25 bp, Mus musculus
agaaagagaacggccctacccacag

SEQ ID NO: 185678 - DNA, 25 bp, Mus musculus
agaaagagacagtgcattctgtgag

SEQ ID NO: 185679 - DNA, 25 bp, Mus musculus
agaaagagacagtgtgggacttctg

SEQ ID NO: 185680 - DNA, 25 bp, Mus musculus
agaaagagactgctggtgacaaggg

SEQ ID NO: 185681 - DNA, 25 bp, Mus musculus
agaaagagagaccagagggacaagg

SEQ ID NO: 185682 - DNA, 25 bp, Mus musculus
agaaagagagatggcagcagcagca

SEQ ID NO: 185683 - DNA, 25 bp, Mus musculus
agaaagagagccaaatctgccaagg

SEQ ID NO: 185684 - DNA, 25 bp, Mus musculus
agaaagagagtgtaatccacctaac

SEQ ID NO: 185685 - DNA, 25 bp, Mus musculus
agaaagagcgagatggacagagacg

SEQ ID NO: 185686 - DNA, 25 bp, Mus musculus
agaaagagcgatacttggtaacgtt

SEQ ID NO: 185687 - DNA, 25 bp, Mus musculus
agaaagagctgaggatcatctgtcc

SEQ ID NO: 185688 - DNA, 25 bp, Mus musculus
agaaagagctgtcagggacggtcaa

SEQ ID NO: 185689 - DNA, 25 bp, Mus musculus
agaaagaggccctggaagaagaaag

SEQ ID NO: 185690 - DNA, 25 bp, Mus musculus
agaaagagggacgatgggtgatcta

SEQ ID NO: 185691 - DNA, 25 bp, Mus musculus
agaaagagggacggataccaagcta

SEQ ID NO: 185692 - DNA, 25 bp, Mus musculus
agaaagataaggtgaccatagctga

SEQ ID NO: 185693 - DNA, 25 bp, Mus musculus
agaaagataatcagattataccgaa

SEQ ID NO: 185694 - DNA, 25 bp, Mus musculus
agaaagataatcagccgtggggcca

SEQ ID NO: 185695 - DNA, 25 bp, Mus musculus
agaaagataccaagctaatgagcga

SEQ ID NO: 185696 - DNA, 25 bp, Mus musculus
agaaagataggttgcagctgtctaa

SEQ ID NO: 185697 - DNA, 25 bp, Mus musculus
agaaagatcaggaaaagactgatac

SEQ ID NO: 185698 - DNA, 25 bp, Mus musculus
agaaagatcaggcgagtactaacag

SEQ ID NO: 185699 - DNA, 25 bp, Mus musculus
agaaagatcaggggctggaaaacga

SEQ ID NO: 185700 - DNA, 25 bp, Mus musculus
agaaagatctgcatccaaagacaag

SEQ ID NO: 185701 - DNA, 25 bp, Mus musculus
agaaagatctggccaacatagctga

SEQ ID NO: 185702 - DNA, 25 bp, Mus musculus
agaaagatgacaagttgaccccaaa

SEQ ID NO: 185703 - DNA, 25 bp, Mus musculus
agaaagatgacagtgaacgtcctgt

SEQ ID NO: 185704 - DNA, 25 bp, Mus musculus
agaaagatgacccaggagttgcaag

SEQ ID NO: 185705 - DNA, 25 bp, Mus musculus
agaaagatgagctggatccagccat

SEQ ID NO: 185706 - DNA, 25 bp, Mus musculus
agaaagatgtgccagaaacagaagg

SEQ ID NO: 185707 - DNA, 25 bp, Mus musculus
agaaagattaaggagctatcgaaga

SEQ ID NO: 185708 - DNA, 25 bp, Mus musculus
agaaagcaaaaaattgcaaattcaa

SEQ ID NO: 185709 - DNA, 25 bp, Mus musculus
agaaagcaaaagaggagtggttcca

SEQ ID NO: 185710 - DNA, 25 bp, Mus musculus
agaaagcaaaagggaagaaggatgc

SEQ ID NO: 185711 - DNA, 25 bp, Mus musculus
agaaagcaacagggatgaagtacaa

SEQ ID NO: 185712 - DNA, 25 bp, Mus musculus
agaaagcaagatttgtcttcggcaa

SEQ ID NO: 185713 - DNA, 25 bp, Mus musculus
agaaagcaaggaaggaaggtctgat

SEQ ID NO: 185714 - DNA, 25 bp, Mus musculus
agaaagcaccagcaccaggtcttcg

SEQ ID NO: 185715 - DNA, 25 bp, Mus musculus
agaaagcaccaggtccccggcgcta

SEQ ID NO: 185716 - DNA, 25 bp, Mus musculus
agaaagcagaatgctggcagaagac

SEQ ID NO: 185717 - DNA, 25 bp, Mus musculus
agaaagcagagaagagtgtagctgc

SEQ ID NO: 185718 - DNA, 25 bp, Mus musculus
agaaagcagccgtgaagccgctcag

SEQ ID NO: 185719 - DNA, 25 bp, Mus musculus
agaaagcagggctttctgtgagact

SEQ ID NO: 185720 - DNA, 25 bp, Mus musculus
agaaagcagggtgaaggaggagggc

SEQ ID NO: 185721 - DNA, 25 bp, Mus musculus
agaaagcataaagaccagtttccca

SEQ ID NO: 185722 - DNA, 25 bp, Mus musculus
agaaagcataaagatctgggcagtg

SEQ ID NO: 185723 - DNA, 25 bp, Mus musculus
agaaagcataaaggaacatgcctct

SEQ ID NO: 185724 - DNA, 25 bp, Mus musculus
agaaagcataagaatgttttgagtt

SEQ ID NO: 185725 - DNA, 25 bp, Mus musculus
agaaagcataaggtgactcatattc

SEQ ID NO: 185726 - DNA, 25 bp, Mus musculus
agaaagccaaagaaggctcggcgca

SEQ ID NO: 185727 - DNA, 25 bp, Mus musculus
agaaagccaaagaagtatccgagtt

SEQ ID NO: 185728 - DNA, 25 bp, Mus musculus
agaaagccaaagcggaggaagaagg

SEQ ID NO: 185729 - DNA, 25 bp, Mus musculus
agaaagccaacattctcaccgacat

SEQ ID NO: 185730 - DNA, 25 bp, Mus musculus
agaaagccaagaacagagagtacct

SEQ ID NO: 185731 - DNA, 25 bp, Mus musculus
agaaagccaagctggagaaattttc

SEQ ID NO: 185732 - DNA, 25 bp, Mus musculus
agaaagccaatgcaccatgaacaca

SEQ ID NO: 185733 - DNA, 25 bp, Mus musculus
agaaagccagagaaggtgtgatgga

SEQ ID NO: 185734 - DNA, 25 bp, Mus musculus
agaaagccagcagcattagattgac

SEQ ID NO: 185735 - DNA, 25 bp, Mus musculus
agaaagccagtgtgaataaatttgt

SEQ ID NO: 185736 - DNA, 25 bp, Mus musculus
agaaagccatcaacgacctagacag

SEQ ID NO: 185737 - DNA, 25 bp, Mus musculus
agaaagccatcaagttgcctgcagg

SEQ ID NO: 185738 - DNA, 25 bp, Mus musculus
agaaagcccctggggtgtccgatcc

SEQ ID NO: 185739 - DNA, 25 bp, Mus musculus
agaaagccttgagggtgtttcttga

SEQ ID NO: 185740 - DNA, 25 bp, Mus musculus
agaaagcgaggatggtcatgaaagt

SEQ ID NO: 185741 - DNA, 25 bp, Mus musculus
agaaagcgcctgctggagttcaaca

SEQ ID NO: 185742 - DNA, 25 bp, Mus musculus
agaaagctcaggaagtggaggtact

SEQ ID NO: 185743 - DNA, 25 bp, Mus musculus
agaaagctccaaaggaccagtccat

SEQ ID NO: 185744 - DNA, 25 bp, Mus musculus
agaaagctccaaaggttgtcgctgc

SEQ ID NO: 185745 - DNA, 25 bp, Mus musculus
agaaagctgccaggctctgggtgct

SEQ ID NO: 185746 - DNA, 25 bp, Mus musculus
agaaagctggcgggtagaatcattt

SEQ ID NO: 185747 - DNA, 25 bp, Mus musculus
agaaagctgtattttaaatcttcta

SEQ ID NO: 185748 - DNA, 25 bp, Mus musculus
agaaagctgtggaaatcagtcagcc

SEQ ID NO: 185749 - DNA, 25 bp, Mus musculus
agaaagctgtggtaattccaccaat

SEQ ID NO: 185750 - DNA, 25 bp, Mus musculus
agaaagctgttcccatttatgtaca

SEQ ID NO: 185751 - DNA, 25 bp, Mus musculus
agaaagcttccctggcacagaaaca

SEQ ID NO: 185752 - DNA, 25 bp, Mus musculus
agaaagcttcgaagaaaagcaatgg

SEQ ID NO: 185753 - DNA, 25 bp, Mus musculus
agaaagcttttgaaataggaccaag

SEQ ID NO: 185754 - DNA, 25 bp, Mus musculus
agaaaggaaaaggatgtgaggaaga

SEQ ID NO: 185755 - DNA, 25 bp, Mus musculus
agaaaggaaaggccttcgatatgaa

SEQ ID NO: 185756 - DNA, 25 bp, Mus musculus
agaaaggaaataatccctccatatt

SEQ ID NO: 185757 - DNA, 25 bp, Mus musculus
agaaaggaacgcagcaactgctgct

SEQ ID NO: 185758 - DNA, 25 bp, Mus musculus
agaaaggaagagatcaaagatgaga

SEQ ID NO: 185759 - DNA, 25 bp, Mus musculus
agaaaggaagatcctggccctgagg

SEQ ID NO: 185760 - DNA, 25 bp, Mus musculus
agaaaggacagccctcccacagaat

SEQ ID NO: 185761 - DNA, 25 bp, Mus musculus
agaaaggacttcctggcgagaaagg

SEQ ID NO: 185762 - DNA, 25 bp, Mus musculus
agaaaggagagaagggccaatcagg

SEQ ID NO: 185763 - DNA, 25 bp, Mus musculus
agaaaggagcaaggggtcagccagg

SEQ ID NO: 185764 - DNA, 25 bp, Mus musculus
agaaaggagggaagataattatgcc

SEQ ID NO: 185765 - DNA, 25 bp, Mus musculus
agaaaggatggaaaggtgaagctgg

SEQ ID NO: 185766 - DNA, 25 bp, Mus musculus
agaaaggattagggatcttggcaac

SEQ ID NO: 185767 - DNA, 25 bp, Mus musculus
agaaaggattctatgacccctcacc

SEQ ID NO: 185768 - DNA, 25 bp, Mus musculus
agaaaggattctatgctgggcacac

SEQ ID NO: 185769 - DNA, 25 bp, Mus musculus
agaaaggccaagctggccctgcttg

SEQ ID NO: 185770 - DNA, 25 bp, Mus musculus
agaaaggccaagcttgccctgcttg

SEQ ID NO: 185771 - DNA, 25 bp, Mus musculus
agaaaggccaggttctgggagaagt

SEQ ID NO: 185772 - DNA, 25 bp, Mus musculus
agaaaggcctgaagctgtctccaga

SEQ ID NO: 185773 - DNA, 25 bp, Mus musculus
agaaaggcctgaaggtgcgggagta

SEQ ID NO: 185774 - DNA, 25 bp, Mus musculus
agaaaggcgagtctacgtgacactg

SEQ ID NO: 185775 - DNA, 25 bp, Mus musculus
agaaaggcggaacagagtgttctga

SEQ ID NO: 185776 - DNA, 25 bp, Mus musculus
agaaaggcgggaaagggctgtgagg

SEQ ID NO: 185777 - DNA, 25 bp, Mus musculus
agaaaggctggagctggaaccttga

SEQ ID NO: 185778 - DNA, 25 bp, Mus musculus
agaaaggctgggtgaagacccttat

SEQ ID NO: 185779 - DNA, 25 bp, Mus musculus
agaaagggactcggagaatcatcat

SEQ ID NO: 185780 - DNA, 25 bp, Mus musculus
agaaaggggtgaagactgaaccaat

SEQ ID NO: 185781 - DNA, 25 bp, Mus musculus
agaaaggggtgaagagggtcaacag

SEQ ID NO: 185782 - DNA, 25 bp, Mus musculus
agaaagggtcataggcacagaccaa

SEQ ID NO: 185783 - DNA, 25 bp, Mus musculus
agaaagggtgcagaagttccctcaa

SEQ ID NO: 185784 - DNA, 25 bp, Mus musculus
agaaaggtggatatgtccgaccccg

SEQ ID NO: 185785 - DNA, 25 bp, Mus musculus
agaaaggttacaagagtgaaacatc

SEQ ID NO: 185786 - DNA, 25 bp, Mus musculus
agaaagtactggatccactggactc

SEQ ID NO: 185787 - DNA, 25 bp, Mus musculus
agaaagtcactggggacccctgtgc

SEQ ID NO: 185788 - DNA, 25 bp, Mus musculus
agaaagtcaggtatgctgcaagacc

SEQ ID NO: 185789 - DNA, 25 bp, Mus musculus
agaaagtccgactggaactggaaaa

SEQ ID NO: 185790 - DNA, 25 bp, Mus musculus
agaaagtctcaatcgtcctttttct

SEQ ID NO: 185791 - DNA, 25 bp, Mus musculus
agaaagtcttacagcttgggcaata

SEQ ID NO: 185792 - DNA, 25 bp, Mus musculus
agaaagtcttacagtccattttgaa

SEQ ID NO: 185793 - DNA, 25 bp, Mus musculus
agaaagtgaaaaggttgtccaggaa

SEQ ID NO: 185794 - DNA, 25 bp, Mus musculus
agaaagtgaaagaccattgcagcaa

SEQ ID NO: 185795 - DNA, 25 bp, Mus musculus
agaaagtgaggacttttgctgccac

SEQ ID NO: 185796 - DNA, 25 bp, Mus musculus
agaaagtggcaagaaggaaaacaaa

SEQ ID NO: 185797 - DNA, 25 bp, Mus musculus
agaaagtggcaagatcttagggttg

SEQ ID NO: 185798 - DNA, 25 bp, Mus musculus
agaaagtggcaagtcagtacaggct

SEQ ID NO: 185799 - DNA, 25 bp, Mus musculus
agaaagtggcgaaggtcttccatgt

SEQ ID NO: 185800 - DNA, 25 bp, Mus musculus
agaaagtgttcagtgatgtgatgga

SEQ ID NO: 185801 - DNA, 25 bp, Mus musculus
agaaagttactcaggtggctggtgg

SEQ ID NO: 185802 - DNA, 25 bp, Mus musculus
agaaagttgcaaaaatcttggcaat

SEQ ID NO: 185803 - DNA, 25 bp, Mus musculus
agaaagttgcaaatgattcattcct

SEQ ID NO: 185804 - DNA, 25 bp, Mus musculus
agaaagtttggaagaatgacatacg

SEQ ID NO: 185805 - DNA, 25 bp, Mus musculus
agaaagtttggaagttgccatccag

SEQ ID NO: 185806 - DNA, 25 bp, Mus musculus
agaaagtttgtaaagcctcttcggt

SEQ ID NO: 185807 - DNA, 25 bp, Mus musculus
agaaataaagacaaaaggcttgatg

SEQ ID NO: 185808 - DNA, 25 bp, Mus musculus
agaaataaagatgatcagtcagttt

SEQ ID NO: 185809 - DNA, 25 bp, Mus musculus
agaaataaccagatatcagtttttc

SEQ ID NO: 185810 - DNA, 25 bp, Mus musculus
agaaataaccaggtgaagcaagatg

SEQ ID NO: 185811 - DNA, 25 bp, Mus musculus
agaaataagaggtacccagactcat

SEQ ID NO: 185812 - DNA, 25 bp, Mus musculus
agaaataatcaaatgggttgtgtgg

SEQ ID NO: 185813 - DNA, 25 bp, Mus musculus
agaaatacaatatggggctgccggt

SEQ ID NO: 185814 - DNA, 25 bp, Mus musculus
agaaatacagatgtctctttaagga

SEQ ID NO: 185815 - DNA, 25 bp, Mus musculus
agaaataccagtccctggcctacag

SEQ ID NO: 185816 - DNA, 25 bp, Mus musculus
agaaatacctccagttcagaagaag

SEQ ID NO: 185817 - DNA, 25 bp, Mus musculus
agaaatagaagaggagcctgcaggt

SEQ ID NO: 185818 - DNA, 25 bp, Mus musculus
agaaatagaagggaacaagtcatac

SEQ ID NO: 185819 - DNA, 25 bp, Mus musculus
agaaatagaagtggacgacaacctg

SEQ ID NO: 185820 - DNA, 25 bp, Mus musculus
agaaatagaggtacaacataagaga

SEQ ID NO: 185821 - DNA, 25 bp, Mus musculus
agaaatagcatgattcagctactag

SEQ ID NO: 185822 - DNA, 25 bp, Mus musculus
agaaataggaaataggttaaatgga

SEQ ID NO: 185823 - DNA, 25 bp, Mus musculus
agaaatataaggactgaggatctcg

SEQ ID NO: 185824 - DNA, 25 bp, Mus musculus
agaaatataatagatgtggtatcta

SEQ ID NO: 185825 - DNA, 25 bp, Mus musculus
agaaatatagctcccgttacttcca

SEQ ID NO: 185826 - DNA, 25 bp, Mus musculus
agaaatatcacaggctaatgttatc

SEQ ID NO: 185827 - DNA, 25 bp, Mus musculus
agaaatatcttcagagactggaagt

SEQ ID NO: 185828 - DNA, 25 bp, Mus musculus
agaaatatgaacaggcatgtaatga

SEQ ID NO: 185829 - DNA, 25 bp, Mus musculus
agaaatatgaagacactccagcaac

SEQ ID NO: 185830 - DNA, 25 bp, Mus musculus
agaaatatgaagcacaagcccaagg

SEQ ID NO: 185831 - DNA, 25 bp, Mus musculus
agaaatatgaagccactctgatatc

SEQ ID NO: 185832 - DNA, 25 bp, Mus musculus
agaaatatgaggaacacatcaagag

SEQ ID NO: 185833 - DNA, 25 bp, Mus musculus
agaaatatgagtggttccatgtcag

SEQ ID NO: 185834 - DNA, 25 bp, Mus musculus
agaaatatgatatcaccaccctcag

SEQ ID NO: 185835 - DNA, 25 bp, Mus musculus
agaaatatgatatcatgactgtccg

SEQ ID NO: 185836 - DNA, 25 bp, Mus musculus
agaaatatgatcagcaagaaggccg

SEQ ID NO: 185837 - DNA, 25 bp, Mus musculus
agaaatatgatgaccgagaggaaga

SEQ ID NO: 185838 - DNA, 25 bp, Mus musculus
agaaatattttatataattggccta

SEQ ID NO: 185839 - DNA, 25 bp, Mus musculus
agaaatcaaagagaaaatggatcaa

SEQ ID NO: 185840 - DNA, 25 bp, Mus musculus
agaaatcaaagatatagatgtcagt

SEQ ID NO: 185841 - DNA, 25 bp, Mus musculus
agaaatcaaggaaacactcatagac

SEQ ID NO: 185842 - DNA, 25 bp, Mus musculus
agaaatcaagggcttaaggaataaa

SEQ ID NO: 185843 - DNA, 25 bp, Mus musculus
agaaatcaagtttgcttttcctctc

SEQ ID NO: 185844 - DNA, 25 bp, Mus musculus
agaaatcagacagatccgagacact

SEQ ID NO: 185845 - DNA, 25 bp, Mus musculus
agaaatcagacagtgatttcaatca

SEQ ID NO: 185846 - DNA, 25 bp, Mus musculus
agaaatcattcagtctgtgtatgaa

SEQ ID NO: 185847 - DNA, 25 bp, Mus musculus
agaaatccaagaaaatgtacaggcg

SEQ ID NO: 185848 - DNA, 25 bp, Mus musculus
agaaatccaagcttttagccaggct

SEQ ID NO: 185849 - DNA, 25 bp, Mus musculus
agaaatccactagactctggaactg

SEQ ID NO: 185850 - DNA, 25 bp, Mus musculus
agaaatccactaggagacttaatgg

SEQ ID NO: 185851 - DNA, 25 bp, Mus musculus
agaaatccagcgtgcgagaagatgt

SEQ ID NO: 185852 - DNA, 25 bp, Mus musculus
agaaatcccgcaaggtcccgcacac

SEQ ID NO: 185853 - DNA, 25 bp, Mus musculus
agaaatccgatggggagcctttact

SEQ ID NO: 185854 - DNA, 25 bp, Mus musculus
agaaatccgatggttttcagacaaa

SEQ ID NO: 185855 - DNA, 25 bp, Mus musculus
agaaatccggcaacttgaattggtg

SEQ ID NO: 185856 - DNA, 25 bp, Mus musculus
agaaatccgggcagtttaggacact

SEQ ID NO: 185857 - DNA, 25 bp, Mus musculus
agaaatcctgcaggagccagcaggg

SEQ ID NO: 185858 - DNA, 25 bp, Mus musculus
agaaatcgaagcagaaaatgaacag

SEQ ID NO: 185859 - DNA, 25 bp, Mus musculus
agaaatcgagcgccaggctccgatg

SEQ ID NO: 185860 - DNA, 25 bp, Mus musculus
agaaatcgagctgaggaaacgtgtg

SEQ ID NO: 185861 - DNA, 25 bp, Mus musculus
agaaatcgctcagtcctgcatctgg

SEQ ID NO: 185862 - DNA, 25 bp, Mus musculus
agaaatcgctcagtgccacatatgt

SEQ ID NO: 185863 - DNA, 25 bp, Mus musculus
agaaatcggaagatcttagatgagt

SEQ ID NO: 185864 - DNA, 25 bp, Mus musculus
agaaatctattcagtattaatataa

SEQ ID NO: 185865 - DNA, 25 bp, Mus musculus
agaaatctgcccttagtggggagca

SEQ ID NO: 185866 - DNA, 25 bp, Mus musculus
agaaatctgttggtgttctggctga

SEQ ID NO: 185867 - DNA, 25 bp, Mus musculus
agaaatcttatcagacaaagtaaat

SEQ ID NO: 185868 - DNA, 25 bp, Mus musculus
agaaatcttggccaggaccctgcct

SEQ ID NO: 185869 - DNA, 25 bp, Mus musculus
agaaatgaaaactgagggagatgag

SEQ ID NO: 185870 - DNA, 25 bp, Mus musculus
agaaatgaaagtatcaagcactgaa

SEQ ID NO: 185871 - DNA, 25 bp, Mus musculus
agaaatgaaatgtctggatgctaat

SEQ ID NO: 185872 - DNA, 25 bp, Mus musculus
agaaatgaaatgtgcagagccagtg

SEQ ID NO: 185873 - DNA, 25 bp, Mus musculus
agaaatgaaggactgcagtaatgga

SEQ ID NO: 185874 - DNA, 25 bp, Mus musculus
agaaatgaaggctccagccaggctg

SEQ ID NO: 185875 - DNA, 25 bp, Mus musculus
agaaatgaatgcagcagcagcagtg

SEQ ID NO: 185876 - DNA, 25 bp, Mus musculus
agaaatgacacacttttgtgtaatg

SEQ ID NO: 185877 - DNA, 25 bp, Mus musculus
agaaatgaccaaggaccctctgtca

SEQ ID NO: 185878 - DNA, 25 bp, Mus musculus
agaaatgatgaaaggcatccttact

SEQ ID NO: 185879 - DNA, 25 bp, Mus musculus
agaaatgatggttcaacttctgtag

SEQ ID NO: 185880 - DNA, 25 bp, Mus musculus
agaaatgattggtggcttccggaac

SEQ ID NO: 185881 - DNA, 25 bp, Mus musculus
agaaatgcaaaaggaccctgataga

SEQ ID NO: 185882 - DNA, 25 bp, Mus musculus
agaaatgcaaaatccgggaggagat

SEQ ID NO: 185883 - DNA, 25 bp, Mus musculus
agaaatgcaaacccagccatacatt

SEQ ID NO: 185884 - DNA, 25 bp, Mus musculus
agaaatgcaagattttgctggaaga

SEQ ID NO: 185885 - DNA, 25 bp, Mus musculus
agaaatgcaagtttgtcaatataca

SEQ ID NO: 185886 - DNA, 25 bp, Mus musculus
agaaatgcagacgtcttgtagaaat

SEQ ID NO: 185887 - DNA, 25 bp, Mus musculus
agaaatgcaggaatctccggttcca

SEQ ID NO: 185888 - DNA, 25 bp, Mus musculus
agaaatgcataagttggttgatcgt

SEQ ID NO: 185889 - DNA, 25 bp, Mus musculus
agaaatgctgagatggtgcagtcac

SEQ ID NO: 185890 - DNA, 25 bp, Mus musculus
agaaatgcttccagagtcttgtgat

SEQ ID NO: 185891 - DNA, 25 bp, Mus musculus
agaaatggaaggtggtgtagtggag

SEQ ID NO: 185892 - DNA, 25 bp, Mus musculus
agaaatggaagtggctaccaaggac

SEQ ID NO: 185893 - DNA, 25 bp, Mus musculus
agaaatggagagaagcccgggacgg

SEQ ID NO: 185894 - DNA, 25 bp, Mus musculus
agaaatggaggtgacagctactaat

SEQ ID NO: 185895 - DNA, 25 bp, Mus musculus
agaaatggatacacaactattgtcc

SEQ ID NO: 185896 - DNA, 25 bp, Mus musculus
agaaatggcatttatctgggagtat

SEQ ID NO: 185897 - DNA, 25 bp, Mus musculus
agaaatggcccatgattttgttctt

SEQ ID NO: 185898 - DNA, 25 bp, Mus musculus
agaaatggcccatgtgctctgtaac

SEQ ID NO: 185899 - DNA, 25 bp, Mus musculus
agaaatggcccattgaaaagagtca

SEQ ID NO: 185900 - DNA, 25 bp, Mus musculus
agaaatggctcaaggaacagtgagc

SEQ ID NO: 185901 - DNA, 25 bp, Mus musculus
agaaatgggcagagagaaatgtcac

SEQ ID NO: 185902 - DNA, 25 bp, Mus musculus
agaaatggtcatcagagctgtactg

SEQ ID NO: 185903 - DNA, 25 bp, Mus musculus
agaaatggtcatcagtgtcctccta

SEQ ID NO: 185904 - DNA, 25 bp, Mus musculus
agaaatgtatatgcccccaagcctc

SEQ ID NO: 185905 - DNA, 25 bp, Mus musculus
agaaatgtcagtgcgattcccaact

SEQ ID NO: 185906 - DNA, 25 bp, Mus musculus
agaaatgtgacaggctaaactgtga

SEQ ID NO: 185907 - DNA, 25 bp, Mus musculus
agaaatgtgcaattcctaaatgcaa

SEQ ID NO: 185908 - DNA, 25 bp, Mus musculus
agaaatgtgcacttggatctcagtc

SEQ ID NO: 185909 - DNA, 25 bp, Mus musculus
agaaatgttgctgcccaggttcttc

SEQ ID NO: 185910 - DNA, 25 bp, Mus musculus
agaaattaaagtggcagcttgactt

SEQ ID NO: 185911 - DNA, 25 bp, Mus musculus
agaaattaccctaagttatacattg

SEQ ID NO: 185912 - DNA, 25 bp, Mus musculus
agaaattaggcagcaaaacataaag

SEQ ID NO: 185913 - DNA, 25 bp, Mus musculus
agaaattataatcaggctggccagc

SEQ ID NO: 185914 - DNA, 25 bp, Mus musculus
agaaattatttcagagtgccagaag

SEQ ID NO: 185915 - DNA, 25 bp, Mus musculus
agaaattatttcaggtggatctaaa

SEQ ID NO: 185916 - DNA, 25 bp, Mus musculus
agaaattcagagactgcctctttaa

SEQ ID NO: 185917 - DNA, 25 bp, Mus musculus
agaaattccaaggtccccctggagc

SEQ ID NO: 185918 - DNA, 25 bp, Mus musculus
agaaattccaaggtgtgagactgct

SEQ ID NO: 185919 - DNA, 25 bp, Mus musculus
agaaattccaccagcagtatgagcc

SEQ ID NO: 185920 - DNA, 25 bp, Mus musculus
agaaattccaggatgtctgtgttag

SEQ ID NO: 185921 - DNA, 25 bp, Mus musculus
agaaattccaggattgctgtgtcta

SEQ ID NO: 185922 - DNA, 25 bp, Mus musculus
agaaattcctgctgctgaactaacc

SEQ ID NO: 185923 - DNA, 25 bp, Mus musculus
agaaattcgaactggtgttgatcag

SEQ ID NO: 185924 - DNA, 25 bp, Mus musculus
agaaattcgggccaatggtggctgg

SEQ ID NO: 185925 - DNA, 25 bp, Mus musculus
agaaattctcacctccctagcactg

SEQ ID NO: 185926 - DNA, 25 bp, Mus musculus
agaaattgaagagaaacttcatgaa

SEQ ID NO: 185927 - DNA, 25 bp, Mus musculus
agaaattgaagagagagaagcgctt

SEQ ID NO: 185928 - DNA, 25 bp, Mus musculus
agaaattgagtattttatcatcttt

SEQ ID NO: 185929 - DNA, 25 bp, Mus musculus
agaaattgagtgctcctgtgctgtg

SEQ ID NO: 185930 - DNA, 25 bp, Mus musculus
agaaattgagtgggacgacttggcc

SEQ ID NO: 185931 - DNA, 25 bp, Mus musculus
agaaattgcaggtctcacccaaaat

SEQ ID NO: 185932 - DNA, 25 bp, Mus musculus
agaaattgctaagaacaccagaacc

SEQ ID NO: 185933 - DNA, 25 bp, Mus musculus
agaaattgctcaggaaaatggacaa

SEQ ID NO: 185934 - DNA, 25 bp, Mus musculus
agaaattgctcagtgagcaacccta

SEQ ID NO: 185935 - DNA, 25 bp, Mus musculus
agaaattggggttgatcgccttaga

SEQ ID NO: 185936 - DNA, 25 bp, Mus musculus
agaaatttcaaagaggtaactcacg

SEQ ID NO: 185937 - DNA, 25 bp, Mus musculus
agaaatttcactgaggttaatctat

SEQ ID NO: 185938 - DNA, 25 bp, Mus musculus
agaaatttcctaatcaccctcatgt

SEQ ID NO: 185939 - DNA, 25 bp, Mus musculus
agaaatttgaaatttcaacaagaaa

SEQ ID NO: 185940 - DNA, 25 bp, Mus musculus
agaaatttgagagtccaattggtaa

SEQ ID NO: 185941 - DNA, 25 bp, Mus musculus
agaaatttggaggaattgatatttt

SEQ ID NO: 185942 - DNA, 25 bp, Mus musculus
agaacaaaaaaggcctgatggaatc

SEQ ID NO: 185943 - DNA, 25 bp, Mus musculus
agaacaaaaatgcaagctgggcgtg

SEQ ID NO: 185944 - DNA, 25 bp, Mus musculus
agaacaaaaggaagccagatgcccc

SEQ ID NO: 185945 - DNA, 25 bp, Mus musculus
agaacaaaaggctgacgaatgacag

SEQ ID NO: 185946 - DNA, 25 bp, Mus musculus
agaacaaacaagatacatttatata

SEQ ID NO: 185947 - DNA, 25 bp, Mus musculus
agaacaaacaagggaatggcgttta

SEQ ID NO: 185948 - DNA, 25 bp, Mus musculus
agaacaaagatcctctgagtgccag

SEQ ID NO: 185949 - DNA, 25 bp, Mus musculus
agaacaaagatggctgcatgagagc

SEQ ID NO: 185950 - DNA, 25 bp, Mus musculus
agaacaaagtggcctatgagcggca

SEQ ID NO: 185951 - DNA, 25 bp, Mus musculus
agaacaaataagatgttctcaaaca

SEQ ID NO: 185952 - DNA, 25 bp, Mus musculus
agaacaacactgaatatctcctggg

SEQ ID NO: 185953 - DNA, 25 bp, Mus musculus
agaacaacagcgacagctatttgag

SEQ ID NO: 185954 - DNA, 25 bp, Mus musculus
agaacaacaggaacctgaggagaag

SEQ ID NO: 185955 - DNA, 25 bp, Mus musculus
agaacaacaggactccgggagaagc

SEQ ID NO: 185956 - DNA, 25 bp, Mus musculus
agaacaacaggtgttgggagccctt

SEQ ID NO: 185957 - DNA, 25 bp, Mus musculus
agaacaacctggcttcctgctacct

SEQ ID NO: 185958 - DNA, 25 bp, Mus musculus
agaacaacctgtacctgcaaatgag

SEQ ID NO: 185959 - DNA, 25 bp, Mus musculus
agaacaacgaagagcaagctgaact

SEQ ID NO: 185960 - DNA, 25 bp, Mus musculus
agaacaacgtttccctcagtaccgt

SEQ ID NO: 185961 - DNA, 25 bp, Mus musculus
agaacaactaaacaggaatgcttcg

SEQ ID NO: 185962 - DNA, 25 bp, Mus musculus
agaacaactgaacgtttggatgaag

SEQ ID NO: 185963 - DNA, 25 bp, Mus musculus
agaacaagaaagcatctaaagacat

SEQ ID NO: 185964 - DNA, 25 bp, Mus musculus
agaacaagactcagaataagcctgc

SEQ ID NO: 185965 - DNA, 25 bp, Mus musculus
agaacaagagccccttcctctgccc

SEQ ID NO: 185966 - DNA, 25 bp, Mus musculus
agaacaagaggtttgaagatcaact

SEQ ID NO: 185967 - DNA, 25 bp, Mus musculus
agaacaagatcggttctctttgtag

SEQ ID NO: 185968 - DNA, 25 bp, Mus musculus
agaacaagatcgttggaatgccaag

SEQ ID NO: 185969 - DNA, 25 bp, Mus musculus
agaacaagccagggcctcctgctgc

SEQ ID NO: 185970 - DNA, 25 bp, Mus musculus
agaacaagcccatctggctcttgct

SEQ ID NO: 185971 - DNA, 25 bp, Mus musculus
agaacaagtgcaagatgatttacct

SEQ ID NO: 185972 - DNA, 25 bp, Mus musculus
agaacaatcgattggaagaattgtt

SEQ ID NO: 185973 - DNA, 25 bp, Mus musculus
agaacaatcgggaacagactgcttt

SEQ ID NO: 185974 - DNA, 25 bp, Mus musculus
agaacaatggcctagaggtaatcaa

SEQ ID NO: 185975 - DNA, 25 bp, Mus musculus
agaacacaagatggcccgcagagga

SEQ ID NO: 185976 - DNA, 25 bp, Mus musculus
agaacacaaggaaggagcagctgca

SEQ ID NO: 185977 - DNA, 25 bp, Mus musculus
agaacacaagggcaagatcatcatg

SEQ ID NO: 185978 - DNA, 25 bp, Mus musculus
agaacacaccccaggacaccatctt

SEQ ID NO: 185979 - DNA, 25 bp, Mus musculus
agaacacagaaaccgatcatcccag

SEQ ID NO: 185980 - DNA, 25 bp, Mus musculus
agaacacagaaaccggtgctccctt

SEQ ID NO: 185981 - DNA, 25 bp, Mus musculus
agaacacaggctgggaagatgccga

SEQ ID NO: 185982 - DNA, 25 bp, Mus musculus
agaacacagtctcagctgccacccg

SEQ ID NO: 185983 - DNA, 25 bp, Mus musculus
agaacacagtctcagctgcctcctg

SEQ ID NO: 185984 - DNA, 25 bp, Mus musculus
agaacacataaaggcaagaaaactg

SEQ ID NO: 185985 - DNA, 25 bp, Mus musculus
agaacacatagtgtggatccaacta

SEQ ID NO: 185986 - DNA, 25 bp, Mus musculus
agaacacatagttaaccttggtgac

SEQ ID NO: 185987 - DNA, 25 bp, Mus musculus
agaacaccaaagagtgagtaaagga

SEQ ID NO: 185988 - DNA, 25 bp, Mus musculus
agaacaccaaattccggggtgcacc

SEQ ID NO: 185989 - DNA, 25 bp, Mus musculus
agaacaccaaattttaagagtggta

SEQ ID NO: 185990 - DNA, 25 bp, Mus musculus
agaacaccagaagggccggcccacc

SEQ ID NO: 185991 - DNA, 25 bp, Mus musculus
agaacaccatctttgcacccaggat

SEQ ID NO: 185992 - DNA, 25 bp, Mus musculus
agaacaccatctttgcatgaaagcc

SEQ ID NO: 185993 - DNA, 25 bp, Mus musculus
agaacaccatctttggattcaattt

SEQ ID NO: 185994 - DNA, 25 bp, Mus musculus
agaacaccattgaaatcccagcctg

SEQ ID NO: 185995 - DNA, 25 bp, Mus musculus
agaacacccagagggaagtgggcta

SEQ ID NO: 185996 - DNA, 25 bp, Mus musculus
agaacaccctgtgtgtgttttggga

SEQ ID NO: 185997 - DNA, 25 bp, Mus musculus
agaacacctaaagccttagggtcag

SEQ ID NO: 185998 - DNA, 25 bp, Mus musculus
agaacacctaaagcggactcctctg

SEQ ID NO: 185999 - DNA, 25 bp, Mus musculus
agaacacgcaagacagcagtccgtt

SEQ ID NO: 186000 - DNA, 25 bp, Mus musculus
agaacacgcaagggtgagatctttg

SEQ ID NO: 186001 - DNA, 25 bp, Mus musculus
agaacactgtgatctgctcttctgg

SEQ ID NO: 186002 - DNA, 25 bp, Mus musculus
agaacactgtggctctccagagcaa

SEQ ID NO: 186003 - DNA, 25 bp, Mus musculus
agaacactgttttcatgaaccatcg

SEQ ID NO: 186004 - DNA, 25 bp, Mus musculus
agaacactttgagaagcaccaggcg

SEQ ID NO: 186005 - DNA, 25 bp, Mus musculus
agaacagaaatgaaggctccagcca

SEQ ID NO: 186006 - DNA, 25 bp, Mus musculus
agaacagaagaacagatggaggcct

SEQ ID NO: 186007 - DNA, 25 bp, Mus musculus
agaacagaagaacagtgtcccagca

SEQ ID NO: 186008 - DNA, 25 bp, Mus musculus
agaacagaagcagagcagcagacca

SEQ ID NO: 186009 - DNA, 25 bp, Mus musculus
agaacagaagcccacaaggagatac

SEQ ID NO: 186010 - DNA, 25 bp, Mus musculus
agaacagaaggagtgtgtaagcttt

SEQ ID NO: 186011 - DNA, 25 bp, Mus musculus
agaacagacaacctgacagatcgtt

SEQ ID NO: 186012 - DNA, 25 bp, Mus musculus
agaacagacatcatgatcgggaggg

SEQ ID NO: 186013 - DNA, 25 bp, Mus musculus
agaacagaccagagatgggcagcag

SEQ ID NO: 186014 - DNA, 25 bp, Mus musculus
agaacagagagatggatgatccttc

SEQ ID NO: 186015 - DNA, 25 bp, Mus musculus
agaacagatgaacctgtcctaaagg

SEQ ID NO: 186016 - DNA, 25 bp, Mus musculus
agaacagatggaaagtgggaagcca

SEQ ID NO: 186017 - DNA, 25 bp, Mus musculus
agaacagattcagagcctctctccc

SEQ ID NO: 186018 - DNA, 25 bp, Mus musculus
agaacagattcagcagcagcaacag

SEQ ID NO: 186019 - DNA, 25 bp, Mus musculus
agaacagcaagcggaatatctccat

SEQ ID NO: 186020 - DNA, 25 bp, Mus musculus
agaacagcaagcggatttccctttt

SEQ ID NO: 186021 - DNA, 25 bp, Mus musculus
agaacagcaagcggttcagcagagg

SEQ ID NO: 186022 - DNA, 25 bp, Mus musculus
agaacagcagaggttcagaagggtg

SEQ ID NO: 186023 - DNA, 25 bp, Mus musculus
agaacagcagctccattttattcgc

SEQ ID NO: 186024 - DNA, 25 bp, Mus musculus
agaacagcagtaccactagcccagc

SEQ ID NO: 186025 - DNA, 25 bp, Mus musculus
agaacagcgaagccttggagctggt

SEQ ID NO: 186026 - DNA, 25 bp, Mus musculus
agaacagctcggggactttctctag

SEQ ID NO: 186027 - DNA, 25 bp, Mus musculus
agaacagctcgggtttgagtttttt

SEQ ID NO: 186028 - DNA, 25 bp, Mus musculus
agaacaggagcagatcaggaatctt

SEQ ID NO: 186029 - DNA, 25 bp, Mus musculus
agaacaggagcagatccgctctcac

SEQ ID NO: 186030 - DNA, 25 bp, Mus musculus
agaacaggccagtaggagttaaagg

SEQ ID NO: 186031 - DNA, 25 bp, Mus musculus
agaacagggcaaaggggtttcctga

SEQ ID NO: 186032 - DNA, 25 bp, Mus musculus
agaacagggcagctgggcaccacaa

SEQ ID NO: 186033 - DNA, 25 bp, Mus musculus
agaacagtcacagactgtatgagag

SEQ ID NO: 186034 - DNA, 25 bp, Mus musculus
agaacagtcacagagagtggtgaag

SEQ ID NO: 186035 - DNA, 25 bp, Mus musculus
agaacagtcacagatggctttatgg

SEQ ID NO: 186036 - DNA, 25 bp, Mus musculus
agaacagtcacagcgtattgtcagg

SEQ ID NO: 186037 - DNA, 25 bp, Mus musculus
agaacagtcacaggcagatattgta

SEQ ID NO: 186038 - DNA, 25 bp, Mus musculus
agaacagtttggaggacgtaccatg

SEQ ID NO: 186039 - DNA, 25 bp, Mus musculus
agaacagtttggaggctcacccggg

SEQ ID NO: 186040 - DNA, 25 bp, Mus musculus
agaacataagcgtattatttatgtg

SEQ ID NO: 186041 - DNA, 25 bp, Mus musculus
agaacataatggactccctggaact

SEQ ID NO: 186042 - DNA, 25 bp, Mus musculus
agaacataatggatggagaggagaa

SEQ ID NO: 186043 - DNA, 25 bp, Mus musculus
agaacataattagcttgaagtcaat

SEQ ID NO: 186044 - DNA, 25 bp, Mus musculus
agaacatagactgtgaagtatttcg

SEQ ID NO: 186045 - DNA, 25 bp, Mus musculus
agaacatatagaagattttaaacag

SEQ ID NO: 186046 - DNA, 25 bp, Mus musculus
agaacatcaagacaaaccaggtgat

SEQ ID NO: 186047 - DNA, 25 bp, Mus musculus
agaacatcaagactggagtacctgc

SEQ ID NO: 186048 - DNA, 25 bp, Mus musculus
agaacatcacattggcgtcttctgg

SEQ ID NO: 186049 - DNA, 25 bp, Mus musculus
agaacatcatgcaggatccaaacga

SEQ ID NO: 186050 - DNA, 25 bp, Mus musculus
agaacatcatgcagttaaaccatat

SEQ ID NO: 186051 - DNA, 25 bp, Mus musculus
agaacatccagaacaactggcgggg

SEQ ID NO: 186052 - DNA, 25 bp, Mus musculus
agaacatccaggtcctgcctggcag

SEQ ID NO: 186053 - DNA, 25 bp, Mus musculus
agaacatcccagattgctgaagcta

SEQ ID NO: 186054 - DNA, 25 bp, Mus musculus
agaacatcccagcccactggtttgt

SEQ ID NO: 186055 - DNA, 25 bp, Mus musculus
agaacatcgagaagccaggtctctt

SEQ ID NO: 186056 - DNA, 25 bp, Mus musculus
agaacatctagacagttcgaacctc

SEQ ID NO: 186057 - DNA, 25 bp, Mus musculus
agaacatgacagaagctgattggcc

SEQ ID NO: 186058 - DNA, 25 bp, Mus musculus
agaacatgattaatgacttccaccg

SEQ ID NO: 186059 - DNA, 25 bp, Mus musculus
agaacatgcacaaggttcacctgct

SEQ ID NO: 186060 - DNA, 25 bp, Mus musculus
agaacatgcctgaagacgttattgc

SEQ ID NO: 186061 - DNA, 25 bp, Mus musculus
agaacatgcctgaaggctctggtgt

SEQ ID NO: 186062 - DNA, 25 bp, Mus musculus
agaacatggaagacagagctgcatg

SEQ ID NO: 186063 - DNA, 25 bp, Mus musculus
agaacatggacacaggtatacaagg

SEQ ID NO: 186064 - DNA, 25 bp, Mus musculus
agaacatggaggcccctggtgacca

SEQ ID NO: 186065 - DNA, 25 bp, Mus musculus
agaacatggagggccctggtgacca

SEQ ID NO: 186066 - DNA, 25 bp, Mus musculus
agaacatggaggttgctatcggctg

SEQ ID NO: 186067 - DNA, 25 bp, Mus musculus
agaacattaaaaggagtgcaagatc

SEQ ID NO: 186068 - DNA, 25 bp, Mus musculus
agaacattagctcaggtacctgaca

SEQ ID NO: 186069 - DNA, 25 bp, Mus musculus
agaacattccagatacacttcagag

SEQ ID NO: 186070 - DNA, 25 bp, Mus musculus
agaacattgcagggccgtgcaggcc

SEQ ID NO: 186071 - DNA, 25 bp, Mus musculus
agaacattgcaggtaaagatgagcc

SEQ ID NO: 186072 - DNA, 25 bp, Mus musculus
agaacattgccaaatgcaagctgtg

SEQ ID NO: 186073 - DNA, 25 bp, Mus musculus
agaacattggagccatgtcaagcta

SEQ ID NO: 186074 - DNA, 25 bp, Mus musculus
agaacatttccaggttcagctccta

SEQ ID NO: 186075 - DNA, 25 bp, Mus musculus
agaaccaaacagagtctccttaaag

SEQ ID NO: 186076 - DNA, 25 bp, Mus musculus
agaaccaaaccaccgctgaagacga

SEQ ID NO: 186077 - DNA, 25 bp, Mus musculus
agaaccaaaccaccgctgcagccca

SEQ ID NO: 186078 - DNA, 25 bp, Mus musculus
agaaccaaaggacttcaggaaccat

SEQ ID NO: 186079 - DNA, 25 bp, Mus musculus
agaaccaactgataaccaagctgaa

SEQ ID NO: 186080 - DNA, 25 bp, Mus musculus
agaaccaactggagagacttccaga

SEQ ID NO: 186081 - DNA, 25 bp, Mus musculus
agaaccaagccggccctgggcagtg

SEQ ID NO: 186082 - DNA, 25 bp, Mus musculus
agaaccacaaagaggaaatgcaggc

SEQ ID NO: 186083 - DNA, 25 bp, Mus musculus
agaaccacaacccaccaagcagttc

SEQ ID NO: 186084 - DNA, 25 bp, Mus musculus
agaaccacaagaagacccactccga

SEQ ID NO: 186085 - DNA, 25 bp, Mus musculus
agaaccaccacctggggccaggtcg

SEQ ID NO: 186086 - DNA, 25 bp, Mus musculus
agaaccaccataggatacgacttga

SEQ ID NO: 186087 - DNA, 25 bp, Mus musculus
agaaccacgaagaggaaatgcaggc

SEQ ID NO: 186088 - DNA, 25 bp, Mus musculus
agaaccacgagcaggtcctgcgcac

SEQ ID NO: 186089 - DNA, 25 bp, Mus musculus
agaaccacgaggaggaaatgcaggc

SEQ ID NO: 186090 - DNA, 25 bp, Mus musculus
agaaccacgaggaggaaatggcctc

SEQ ID NO: 186091 - DNA, 25 bp, Mus musculus
agaaccacgaggaggtggccaccaa

SEQ ID NO: 186092 - DNA, 25 bp, Mus musculus
agaaccacgtcacctctcacatctc

SEQ ID NO: 186093 - DNA, 25 bp, Mus musculus
agaaccagaagagccaccaaccaaa

SEQ ID NO: 186094 - DNA, 25 bp, Mus musculus
agaaccagaagatgccatctcatct

SEQ ID NO: 186095 - DNA, 25 bp, Mus musculus
agaaccagaaggagcaccgtactgg

SEQ ID NO: 186096 - DNA, 25 bp, Mus musculus
agaaccagagcatcgtgctggagct

SEQ ID NO: 186097 - DNA, 25 bp, Mus musculus
agaaccagagggacagcatcgtgct

SEQ ID NO: 186098 - DNA, 25 bp, Mus musculus
agaaccagcagatgacaccgtacat

SEQ ID NO: 186099 - DNA, 25 bp, Mus musculus
agaaccaggcccctaatcaaggtaa

SEQ ID NO: 186100 - DNA, 25 bp, Mus musculus
agaaccatactatgcattatccaat

SEQ ID NO: 186101 - DNA, 25 bp, Mus musculus
agaaccatactatttgcttttgcca

SEQ ID NO: 186102 - DNA, 25 bp, Mus musculus
agaaccatcaacaagcaaatccgcg

SEQ ID NO: 186103 - DNA, 25 bp, Mus musculus
agaaccatcctgaggcctgactacc

SEQ ID NO: 186104 - DNA, 25 bp, Mus musculus
agaaccatgccgcctgctaagcccc

SEQ ID NO: 186105 - DNA, 25 bp, Mus musculus
agaacccaactgatccccagctcaa

SEQ ID NO: 186106 - DNA, 25 bp, Mus musculus
agaacccaagaggctggggtctcag

SEQ ID NO: 186107 - DNA, 25 bp, Mus musculus
agaacccacacatagagagactgag

SEQ ID NO: 186108 - DNA, 25 bp, Mus musculus
agaacccacagagacgtttcatgta

SEQ ID NO: 186109 - DNA, 25 bp, Mus musculus
agaacccacagagatataaactaca

SEQ ID NO: 186110 - DNA, 25 bp, Mus musculus
agaacccacagcagagtcttctgga

SEQ ID NO: 186111 - DNA, 25 bp, Mus musculus
agaaccccagggtccattcacacag

SEQ ID NO: 186112 - DNA, 25 bp, Mus musculus
agaaccccatcactgggaaaaggac

SEQ ID NO: 186113 - DNA, 25 bp, Mus musculus
agaaccccatcactgggtttggtaa

SEQ ID NO: 186114 - DNA, 25 bp, Mus musculus
agaaccccgaaatgccaggcagatc

SEQ ID NO: 186115 - DNA, 25 bp, Mus musculus
agaaccccgaagacatcggcagaaa

SEQ ID NO: 186116 - DNA, 25 bp, Mus musculus
agaacccgaagagcctcagcttaag

SEQ ID NO: 186117 - DNA, 25 bp, Mus musculus
agaacccgagggtttctctgccgat

SEQ ID NO: 186118 - DNA, 25 bp, Mus musculus
agaacccgataatgctgaggcttgg

SEQ ID NO: 186119 - DNA, 25 bp, Mus musculus
agaacccgatggagggaccttgcca

SEQ ID NO: 186120 - DNA, 25 bp, Mus musculus
agaacccggaggctgtttactttgt

SEQ ID NO: 186121 - DNA, 25 bp, Mus musculus
agaacccggctagagcgccacttag

SEQ ID NO: 186122 - DNA, 25 bp, Mus musculus
agaaccctacagtaggcttcgagct

SEQ ID NO: 186123 - DNA, 25 bp, Mus musculus
agaaccctacagtagggtctcactg

SEQ ID NO: 186124 - DNA, 25 bp, Mus musculus
agaaccctcaaccgtgttaggagtg

SEQ ID NO: 186125 - DNA, 25 bp, Mus musculus
agaaccctcagtgattgtgtgtcgc

SEQ ID NO: 186126 - DNA, 25 bp, Mus musculus
agaaccctcgatggtttcaaggctg

SEQ ID NO: 186127 - DNA, 25 bp, Mus musculus
agaaccctttcagatctcgctgcct

SEQ ID NO: 186128 - DNA, 25 bp, Mus musculus
agaaccctttcagccgttaaccaca

SEQ ID NO: 186129 - DNA, 25 bp, Mus musculus
agaaccgacttaaaacttcaggttg

SEQ ID NO: 186130 - DNA, 25 bp, Mus musculus
agaaccgcaagacaggagcccggca

SEQ ID NO: 186131 - DNA, 25 bp, Mus musculus
agaaccgcaagcttccatacgacag

SEQ ID NO: 186132 - DNA, 25 bp, Mus musculus
agaaccgcctggctgaagagagggc

SEQ ID NO: 186133 - DNA, 25 bp, Mus musculus
agaaccgcgtgttgatcgtgtcctg

SEQ ID NO: 186134 - DNA, 25 bp, Mus musculus
agaaccggccagctgcttgacatct

SEQ ID NO: 186135 - DNA, 25 bp, Mus musculus
agaaccggccagctgtctcctgaag

SEQ ID NO: 186136 - DNA, 25 bp, Mus musculus
agaaccgtcggcgagctgaagcgct

SEQ ID NO: 186137 - DNA, 25 bp, Mus musculus
agaacctaaagaagcatgtcatttg

SEQ ID NO: 186138 - DNA, 25 bp, Mus musculus
agaacctaaggaagatcctgtctct

SEQ ID NO: 186139 - DNA, 25 bp, Mus musculus
agaacctcagcatcatgatccagga

SEQ ID NO: 186140 - DNA, 25 bp, Mus musculus
agaacctcatcttgtacttgttgac

SEQ ID NO: 186141 - DNA, 25 bp, Mus musculus
agaacctccaggaggagatctcaga

SEQ ID NO: 186142 - DNA, 25 bp, Mus musculus
agaacctctgcaaggtttgtctggg

SEQ ID NO: 186143 - DNA, 25 bp, Mus musculus
agaacctgaggcactgaaagaaagc

SEQ ID NO: 186144 - DNA, 25 bp, Mus musculus
agaacctgcaggatagaaagagtgg

SEQ ID NO: 186145 - DNA, 25 bp, Mus musculus
agaacctgcagtaccatcccactga

SEQ ID NO: 186146 - DNA, 25 bp, Mus musculus
agaacctgccctctgaccgtgcttg

SEQ ID NO: 186147 - DNA, 25 bp, Mus musculus
agaacctggagagatgctgtcccct

SEQ ID NO: 186148 - DNA, 25 bp, Mus musculus
agaacctggcctcatctgtatgccc

SEQ ID NO: 186149 - DNA, 25 bp, Mus musculus
agaacctgtcaggaccaccaatgaa

SEQ ID NO: 186150 - DNA, 25 bp, Mus musculus
agaacctgtcaggatataaatgaat

SEQ ID NO: 186151 - DNA, 25 bp, Mus musculus
agaacctgtcttaagaccttcacag

SEQ ID NO: 186152 - DNA, 25 bp, Mus musculus
agaacctgtgaaaagagtggacaag

SEQ ID NO: 186153 - DNA, 25 bp, Mus musculus
agaaccttaaaagaatgctgatgct

SEQ ID NO: 186154 - DNA, 25 bp, Mus musculus
agaaccttcctgacctgggcggccc

SEQ ID NO: 186155 - DNA, 25 bp, Mus musculus
agaaccttcctggggtctgtgatgt

SEQ ID NO: 186156 - DNA, 25 bp, Mus musculus
agaaccttcgaggcgtggtgcaaga

SEQ ID NO: 186157 - DNA, 25 bp, Mus musculus
agaaccttctagaagctcttctgtg

SEQ ID NO: 186158 - DNA, 25 bp, Mus musculus
agaaccttgtggagatgggcagcag

SEQ ID NO: 186159 - DNA, 25 bp, Mus musculus
agaacctttgaggtctcagagcttt

SEQ ID NO: 186160 - DNA, 25 bp, Mus musculus
agaacctttgagttcctcatgaagg

SEQ ID NO: 186161 - DNA, 25 bp, Mus musculus
agaacgaaaagggaactgtgaagca

SEQ ID NO: 186162 - DNA, 25 bp, Mus musculus
agaacgaacccaggagttccgactc

SEQ ID NO: 186163 - DNA, 25 bp, Mus musculus
agaacgaatcacaggattagtcgta

SEQ ID NO: 186164 - DNA, 25 bp, Mus musculus
agaacgacgtaggtcaccccttctc

SEQ ID NO: 186165 - DNA, 25 bp, Mus musculus
agaacgagcagcttttgaaatcctg

SEQ ID NO: 186166 - DNA, 25 bp, Mus musculus
agaacgagcaggcgaaggagatgca

SEQ ID NO: 186167 - DNA, 25 bp, Mus musculus
agaacgagccaagttcaagcgcaaa

SEQ ID NO: 186168 - DNA, 25 bp, Mus musculus
agaacgagccggtccgtgttcacct

SEQ ID NO: 186169 - DNA, 25 bp, Mus musculus
agaacgaggagatatccatcaatag

SEQ ID NO: 186170 - DNA, 25 bp, Mus musculus
agaacgatatgacgaatgggtgaag

SEQ ID NO: 186171 - DNA, 25 bp, Mus musculus
agaacgatatgacgtgggcgaccca

SEQ ID NO: 186172 - DNA, 25 bp, Mus musculus
agaacgatgacactgcaccatctgt

SEQ ID NO: 186173 - DNA, 25 bp, Mus musculus
agaacgatgaggacaatctcctcaa

SEQ ID NO: 186174 - DNA, 25 bp, Mus musculus
agaacgatgtggaacagggaaagga

SEQ ID NO: 186175 - DNA, 25 bp, Mus musculus
agaacgcaccggtagctggagttag

SEQ ID NO: 186176 - DNA, 25 bp, Mus musculus
agaacgcatcccacagctggtgggt

SEQ ID NO: 186177 - DNA, 25 bp, Mus musculus
agaacgctgctcatttgaagacatg

SEQ ID NO: 186178 - DNA, 25 bp, Mus musculus
agaacgctgcttgtgaatggctgct

SEQ ID NO: 186179 - DNA, 25 bp, Mus musculus
agaacgctgtgacagatctgagcac

SEQ ID NO: 186180 - DNA, 25 bp, Mus musculus
agaacgctgtgacagcacctccgtc

SEQ ID NO: 186181 - DNA, 25 bp, Mus musculus
agaacggaagttggttgctgcatcc

SEQ ID NO: 186182 - DNA, 25 bp, Mus musculus
agaacggacagccagatgccaaagc

SEQ ID NO: 186183 - DNA, 25 bp, Mus musculus
agaacggacagccagcaggcgtctg

SEQ ID NO: 186184 - DNA, 25 bp, Mus musculus
agaacggagagatagatctagctag

SEQ ID NO: 186185 - DNA, 25 bp, Mus musculus
agaacggatgggatatttccaccca

SEQ ID NO: 186186 - DNA, 25 bp, Mus musculus
agaacggatgttaaggagagggcgc

SEQ ID NO: 186187 - DNA, 25 bp, Mus musculus
agaacggatgttaaggtgccaagtc

SEQ ID NO: 186188 - DNA, 25 bp, Mus musculus
agaacggcgatgctttccgtcagaa

SEQ ID NO: 186189 - DNA, 25 bp, Mus musculus
agaacgggaaagaagtgagaagata

SEQ ID NO: 186190 - DNA, 25 bp, Mus musculus
agaacggtctgacctgcagcaaatt

SEQ ID NO: 186191 - DNA, 25 bp, Mus musculus
agaacgtcaaggcaatccttaggtg

SEQ ID NO: 186192 - DNA, 25 bp, Mus musculus
agaacgtcaagggtgagtcagcact

SEQ ID NO: 186193 - DNA, 25 bp, Mus musculus
agaacgtcccagggtgatgtgaaca

SEQ ID NO: 186194 - DNA, 25 bp, Mus musculus
agaacgtgcagaggggtaccccaag

SEQ ID NO: 186195 - DNA, 25 bp, Mus musculus
agaacgtgtgctaggtttctgccac

SEQ ID NO: 186196 - DNA, 25 bp, Mus musculus
agaactaaagaatgaagtcttacac

SEQ ID NO: 186197 - DNA, 25 bp, Mus musculus
agaactaaaggataacttcaagcta

SEQ ID NO: 186198 - DNA, 25 bp, Mus musculus
agaactaaagggcttgttgtcatcc

SEQ ID NO: 186199 - DNA, 25 bp, Mus musculus
agaactaaatgaatgccatgagagc

SEQ ID NO: 186200 - DNA, 25 bp, Mus musculus
agaactaaatgcgaaatcaccagga

SEQ ID NO: 186201 - DNA, 25 bp, Mus musculus
agaactaactgagaaatgcaaacag

SEQ ID NO: 186202 - DNA, 25 bp, Mus musculus
agaactaactgagttttagaagcca

SEQ ID NO: 186203 - DNA, 25 bp, Mus musculus
agaactaagcctaaggtgctgtgct

SEQ ID NO: 186204 - DNA, 25 bp, Mus musculus
agaactacaataagtgtttcctcaa

SEQ ID NO: 186205 - DNA, 25 bp, Mus musculus
agaactacaccctgacaactggagt

SEQ ID NO: 186206 - DNA, 25 bp, Mus musculus
agaactacaccctgtccccagaatt

SEQ ID NO: 186207 - DNA, 25 bp, Mus musculus
agaactacatcaggaactggtttga

SEQ ID NO: 186208 - DNA, 25 bp, Mus musculus
agaactacattaaagttctttcaga

SEQ ID NO: 186209 - DNA, 25 bp, Mus musculus
agaactaccacccaggaactaaggc

SEQ ID NO: 186210 - DNA, 25 bp, Mus musculus
agaactaccacccaggctgaccctt

SEQ ID NO: 186211 - DNA, 25 bp, Mus musculus
agaactacccagccacttactggac

SEQ ID NO: 186212 - DNA, 25 bp, Mus musculus
agaactacccaggctccttctagat

SEQ ID NO: 186213 - DNA, 25 bp, Mus musculus
agaactacctggacttccaccgctg

SEQ ID NO: 186214 - DNA, 25 bp, Mus musculus
agaactacctgggtctcagcctggg

SEQ ID NO: 186215 - DNA, 25 bp, Mus musculus
agaactactgagactaaagcaagaa

SEQ ID NO: 186216 - DNA, 25 bp, Mus musculus
agaactactgaggcaaggcagcaaa

SEQ ID NO: 186217 - DNA, 25 bp, Mus musculus
agaactagaaacccagaactggagc

SEQ ID NO: 186218 - DNA, 25 bp, Mus musculus
agaactagaaaccctgaactggagc

SEQ ID NO: 186219 - DNA, 25 bp, Mus musculus
agaactagaaatatgcggctatgga

SEQ ID NO: 186220 - DNA, 25 bp, Mus musculus
agaactagctaaggctcaaactcag

SEQ ID NO: 186221 - DNA, 25 bp, Mus musculus
agaactaggtgctcctgccatgccc

SEQ ID NO: 186222 - DNA, 25 bp, Mus musculus
agaactatcccgtggtctccattga

SEQ ID NO: 186223 - DNA, 25 bp, Mus musculus
agaactatgcaggtattgcagctcg

SEQ ID NO: 186224 - DNA, 25 bp, Mus musculus
agaactatgctgagctggtgaagca

SEQ ID NO: 186225 - DNA, 25 bp, Mus musculus
agaactatgtgcaacctcaagccca

SEQ ID NO: 186226 - DNA, 25 bp, Mus musculus
agaactattgagacccgatcctggc

SEQ ID NO: 186227 - DNA, 25 bp, Mus musculus
agaactattgagaggccctggccca

SEQ ID NO: 186228 - DNA, 25 bp, Mus musculus
agaactattgagagtgtatgggcaa

SEQ ID NO: 186229 - DNA, 25 bp, Mus musculus
agaactcaagaaagatagatttgaa

SEQ ID NO: 186230 - DNA, 25 bp, Mus musculus
agaactcaagaatgatagatttgaa

SEQ ID NO: 186231 - DNA, 25 bp, Mus musculus
agaactcaagcagctggtggcccgg

SEQ ID NO: 186232 - DNA, 25 bp, Mus musculus
agaactcaaggcttctagagaacat

SEQ ID NO: 186233 - DNA, 25 bp, Mus musculus
agaactcagaaatgattcccgttgc

SEQ ID NO: 186234 - DNA, 25 bp, Mus musculus
agaactcagagcacccctggctaca

SEQ ID NO: 186235 - DNA, 25 bp, Mus musculus
agaactcagcaaggagaagacagac

SEQ ID NO: 186236 - DNA, 25 bp, Mus musculus
agaactcaggttcatgatggatgac

SEQ ID NO: 186237 - DNA, 25 bp, Mus musculus
agaactccaaggtcctaggtgaggc

SEQ ID NO: 186238 - DNA, 25 bp, Mus musculus
agaactccacagagcaggagcttga

SEQ ID NO: 186239 - DNA, 25 bp, Mus musculus
agaactccagggaggtcctgatgac

SEQ ID NO: 186240 - DNA, 25 bp, Mus musculus
agaactccaggtctttccagcatgt

SEQ ID NO: 186241 - DNA, 25 bp, Mus musculus
agaactccagtgtttcccgagagac

SEQ ID NO: 186242 - DNA, 25 bp, Mus musculus
agaactccatcatgtccttcagtgc

SEQ ID NO: 186243 - DNA, 25 bp, Mus musculus
agaactcctgagaggttgatcgtgt

SEQ ID NO: 186244 - DNA, 25 bp, Mus musculus
agaactcctgttgaggatattttct

SEQ ID NO: 186245 - DNA, 25 bp, Mus musculus
agaactcctgttgaggcctggaatg

SEQ ID NO: 186246 - DNA, 25 bp, Mus musculus
agaactcgcaccagggtccacgctt

SEQ ID NO: 186247 - DNA, 25 bp, Mus musculus
agaactcgcactatggtccacgctt

SEQ ID NO: 186248 - DNA, 25 bp, Mus musculus
agaactctcctgctgggacacccct

SEQ ID NO: 186249 - DNA, 25 bp, Mus musculus
agaactctcctgctgggtctgtgat

SEQ ID NO: 186250 - DNA, 25 bp, Mus musculus
agaactgaaagtgacaactggaacc

SEQ ID NO: 186251 - DNA, 25 bp, Mus musculus
agaactgaaagtgggtccctgaagt

SEQ ID NO: 186252 - DNA, 25 bp, Mus musculus
agaactgagtgaggccttgttttca

SEQ ID NO: 186253 - DNA, 25 bp, Mus musculus
agaactgatcacagaaggccagcaa

SEQ ID NO: 186254 - DNA, 25 bp, Mus musculus
agaactgattcagacattgcagatg

SEQ ID NO: 186255 - DNA, 25 bp, Mus musculus
agaactgcagaagggagaactttct

SEQ ID NO: 186256 - DNA, 25 bp, Mus musculus
agaactgcagaaggtgctgatggaa

SEQ ID NO: 186257 - DNA, 25 bp, Mus musculus
agaactgcagaattgagctccttga

SEQ ID NO: 186258 - DNA, 25 bp, Mus musculus
agaactgcaggcatcagaaggggac

SEQ ID NO: 186259 - DNA, 25 bp, Mus musculus
agaactgcaggttctcccatgggca

SEQ ID NO: 186260 - DNA, 25 bp, Mus musculus
agaactgcagttggagctgcactgt

SEQ ID NO: 186261 - DNA, 25 bp, Mus musculus
agaactgcatcaggctcactctttg

SEQ ID NO: 186262 - DNA, 25 bp, Mus musculus
agaactgcatcagtgaacggctctt

SEQ ID NO: 186263 - DNA, 25 bp, Mus musculus
agaactgcccaccaggattctcagt

SEQ ID NO: 186264 - DNA, 25 bp, Mus musculus
agaactgccccaccattctccagca

SEQ ID NO: 186265 - DNA, 25 bp, Mus musculus
agaactgccgggttcatcgtggcag

SEQ ID NO: 186266 - DNA, 25 bp, Mus musculus
agaactgctaactctaaactgcgag

SEQ ID NO: 186267 - DNA, 25 bp, Mus musculus
agaactgctaactctagcatatgaa

SEQ ID NO: 186268 - DNA, 25 bp, Mus musculus
agaactgctgtctattgcatctgca

SEQ ID NO: 186269 - DNA, 25 bp, Mus musculus
agaactggagaaaccatggaatggg

SEQ ID NO: 186270 - DNA, 25 bp, Mus musculus
agaactggagcgctgctgggaacgc

SEQ ID NO: 186271 - DNA, 25 bp, Mus musculus
agaactggagtattttaaccacatc

SEQ ID NO: 186272 - DNA, 25 bp, Mus musculus
agaactggatgaaggacattgatgg

SEQ ID NO: 186273 - DNA, 25 bp, Mus musculus
agaactggcaccagctggagaacat

SEQ ID NO: 186274 - DNA, 25 bp, Mus musculus
agaactggcagggagatctgctggc

SEQ ID NO: 186275 - DNA, 25 bp, Mus musculus
agaactggccagacaccttgttgcc

SEQ ID NO: 186276 - DNA, 25 bp, Mus musculus
agaactggccagatccgtctacctt

SEQ ID NO: 186277 - DNA, 25 bp, Mus musculus
agaactggccagccccctgcctttc

SEQ ID NO: 186278 - DNA, 25 bp, Mus musculus
agaactggccggttctgcggtggat

SEQ ID NO: 186279 - DNA, 25 bp, Mus musculus
agaactggcggaagctcaagatgac

SEQ ID NO: 186280 - DNA, 25 bp, Mus musculus
agaactggctgaaagataagcccct

SEQ ID NO: 186281 - DNA, 25 bp, Mus musculus
agaactggtgaagcttatgtgcgag

SEQ ID NO: 186282 - DNA, 25 bp, Mus musculus
agaactgtatttggaataaccacag

SEQ ID NO: 186283 - DNA, 25 bp, Mus musculus
agaactgtccagggccaaggaatat

SEQ ID NO: 186284 - DNA, 25 bp, Mus musculus
agaactgtccagggtgaccaacgcc

SEQ ID NO: 186285 - DNA, 25 bp, Mus musculus
agaactgtgaagtgctttgtttaat

SEQ ID NO: 186286 - DNA, 25 bp, Mus musculus
agaactgtggagtatcacggtgatc

SEQ ID NO: 186287 - DNA, 25 bp, Mus musculus
agaactgtgggcagaaatccctagc

SEQ ID NO: 186288 - DNA, 25 bp, Mus musculus
agaactgtgttagactttcctggaa

SEQ ID NO: 186289 - DNA, 25 bp, Mus musculus
agaactgtgtttggagtaacaactg

SEQ ID NO: 186290 - DNA, 25 bp, Mus musculus
agaacttacctgagagcactgtgga

SEQ ID NO: 186291 - DNA, 25 bp, Mus musculus
agaacttacctgagcacagttccca

SEQ ID NO: 186292 - DNA, 25 bp, Mus musculus
agaacttacgagagtatttggaggt

SEQ ID NO: 186293 - DNA, 25 bp, Mus musculus
agaacttataaggcgtctcttttct

SEQ ID NO: 186294 - DNA, 25 bp, Mus musculus
agaacttcaggctcctgggcaatat

SEQ ID NO: 186295 - DNA, 25 bp, Mus musculus
agaacttcaggtctgctgtaacagt

SEQ ID NO: 186296 - DNA, 25 bp, Mus musculus
agaacttcaggtttgctgtcttatt

SEQ ID NO: 186297 - DNA, 25 bp, Mus musculus
agaacttcgacagtattccggaacc

SEQ ID NO: 186298 - DNA, 25 bp, Mus musculus
agaacttctacaaaggaagtaacca

SEQ ID NO: 186299 - DNA, 25 bp, Mus musculus
agaacttctcagacaattgacatat

SEQ ID NO: 186300 - DNA, 25 bp, Mus musculus
agaacttctctatctgccaaagtaa

SEQ ID NO: 186301 - DNA, 25 bp, Mus musculus
agaacttctgatgtttcttccagca

SEQ ID NO: 186302 - DNA, 25 bp, Mus musculus
agaacttcttaacatatgacatctg

SEQ ID NO: 186303 - DNA, 25 bp, Mus musculus
agaacttgatgaagaagatgaagtg

SEQ ID NO: 186304 - DNA, 25 bp, Mus musculus
agaacttgatgaagagtcagaagat

SEQ ID NO: 186305 - DNA, 25 bp, Mus musculus
agaacttgcggtcttagagccttct

SEQ ID NO: 186306 - DNA, 25 bp, Mus musculus
agaacttgggctctgctctgcttta

SEQ ID NO: 186307 - DNA, 25 bp, Mus musculus
agaacttggtggatggatgagtttc

SEQ ID NO: 186308 - DNA, 25 bp, Mus musculus
agaacttgtaaagcttgtagaccct

SEQ ID NO: 186309 - DNA, 25 bp, Mus musculus
agaacttgttaaggctcaggccatc

SEQ ID NO: 186310 - DNA, 25 bp, Mus musculus
agaactttagctcggttttgtacaa

SEQ ID NO: 186311 - DNA, 25 bp, Mus musculus
agaagaaaaaagattataagagatc

SEQ ID NO: 186312 - DNA, 25 bp, Mus musculus
agaagaaaaagaacgtttgctgaag

SEQ ID NO: 186313 - DNA, 25 bp, Mus musculus
agaagaaaaagctctcttaagagcc

SEQ ID NO: 186314 - DNA, 25 bp, Mus musculus
agaagaaaaagggtgatcctgatac

SEQ ID NO: 186315 - DNA, 25 bp, Mus musculus
agaagaaaaattcatcgttaaagca

SEQ ID NO: 186316 - DNA, 25 bp, Mus musculus
agaagaaaacaggctatggtgaaat

SEQ ID NO: 186317 - DNA, 25 bp, Mus musculus
agaagaaaagaaaaatcaagaactc

SEQ ID NO: 186318 - DNA, 25 bp, Mus musculus
agaagaaaagctcaacagaggcaga

SEQ ID NO: 186319 - DNA, 25 bp, Mus musculus
agaagaaaaggaagagcatggctcc

SEQ ID NO: 186320 - DNA, 25 bp, Mus musculus
agaagaaaaggaatagtctcaagat

SEQ ID NO: 186321 - DNA, 25 bp, Mus musculus
agaagaaaaggactgcatttaccca

SEQ ID NO: 186322 - DNA, 25 bp, Mus musculus
agaagaaaaggagttggaaccctgt

SEQ ID NO: 186323 - DNA, 25 bp, Mus musculus
agaagaaaaggctacagaaacttga

SEQ ID NO: 186324 - DNA, 25 bp, Mus musculus
agaagaaaagtgttgccgggaaaga

SEQ ID NO: 186325 - DNA, 25 bp, Mus musculus
agaagaaaagtttctgtttctattc

SEQ ID NO: 186326 - DNA, 25 bp, Mus musculus
agaagaaaatgaccctgccacatgg

SEQ ID NO: 186327 - DNA, 25 bp, Mus musculus
agaagaaaatgctttacacagattt

SEQ ID NO: 186328 - DNA, 25 bp, Mus musculus
agaagaaaatggagttgaagcagaa

SEQ ID NO: 186329 - DNA, 25 bp, Mus musculus
agaagaaaatggatgtcattgctag

SEQ ID NO: 186330 - DNA, 25 bp, Mus musculus
agaagaaaatggatgttaccattga

SEQ ID NO: 186331 - DNA, 25 bp, Mus musculus
agaagaaacacatggtgatgtggac

SEQ ID NO: 186332 - DNA, 25 bp, Mus musculus
agaagaaacagatggtgatgtggac

SEQ ID NO: 186333 - DNA, 25 bp, Mus musculus
agaagaaacggaaggcatgaaagaa

SEQ ID NO: 186334 - DNA, 25 bp, Mus musculus
agaagaaagaagatagtaaaaagta

SEQ ID NO: 186335 - DNA, 25 bp, Mus musculus
agaagaaagaagtgttgccgggaaa

SEQ ID NO: 186336 - DNA, 25 bp, Mus musculus
agaagaaagaggaagatggacggcc

SEQ ID NO: 186337 - DNA, 25 bp, Mus musculus
agaagaaagaggaagtttgtttgct

SEQ ID NO: 186338 - DNA, 25 bp, Mus musculus
agaagaaagaggatgctctggagga

SEQ ID NO: 186339 - DNA, 25 bp, Mus musculus
agaagaaagaggttatggctttcag

SEQ ID NO: 186340 - DNA, 25 bp, Mus musculus
agaagaaagcagggctttctgtgag

SEQ ID NO: 186341 - DNA, 25 bp, Mus musculus
agaagaaagttggggctgtgcggga

SEQ ID NO: 186342 - DNA, 25 bp, Mus musculus
agaagaaataaccagatatcagttt

SEQ ID NO: 186343 - DNA, 25 bp, Mus musculus
agaagaaataaccaggtgaagcaag

SEQ ID NO: 186344 - DNA, 25 bp, Mus musculus
agaagaaataaggtttgacaactca

SEQ ID NO: 186345 - DNA, 25 bp, Mus musculus
agaagaaatacgatgacagcgatgg

SEQ ID NO: 186346 - DNA, 25 bp, Mus musculus
agaagaaatacggcttcttggtaat

SEQ ID NO: 186347 - DNA, 25 bp, Mus musculus
agaagaaatatctgccacctctgaa

SEQ ID NO: 186348 - DNA, 25 bp, Mus musculus
agaagaaatcaaggaaacactcata

SEQ ID NO: 186349 - DNA, 25 bp, Mus musculus
agaagaaatctctgtcatagacatc

SEQ ID NO: 186350 - DNA, 25 bp, Mus musculus
agaagaaatctgtgtactttattgc

SEQ ID NO: 186351 - DNA, 25 bp, Mus musculus
agaagaaatgaatgcagcagcagca

SEQ ID NO: 186352 - DNA, 25 bp, Mus musculus
agaagaaatgttgctgcccaggttc

SEQ ID NO: 186353 - DNA, 25 bp, Mus musculus
agaagaacaaggatgtccccgtgga

SEQ ID NO: 186354 - DNA, 25 bp, Mus musculus
agaagaacaaggtattgacaaatct

SEQ ID NO: 186355 - DNA, 25 bp, Mus musculus
agaagaacagaaactacataaagca

SEQ ID NO: 186356 - DNA, 25 bp, Mus musculus
agaagaacagatggaggcctttaag

SEQ ID NO: 186357 - DNA, 25 bp, Mus musculus
agaagaacagtgtcccagcagatga

SEQ ID NO: 186358 - DNA, 25 bp, Mus musculus
agaagaacagtgtttagtgtaaggt

SEQ ID NO: 186359 - DNA, 25 bp, Mus musculus
agaagaaccacgagcaggtcctgcg

SEQ ID NO: 186360 - DNA, 25 bp, Mus musculus
agaagaacgaggccatccaggcggc

SEQ ID NO: 186361 - DNA, 25 bp, Mus musculus
agaagaacgaggcggcccatgactc

SEQ ID NO: 186362 - DNA, 25 bp, Mus musculus
agaagaacggtctgacctgcagcaa

SEQ ID NO: 186363 - DNA, 25 bp, Mus musculus
agaagaactaaaggataacttcaag

SEQ ID NO: 186364 - DNA, 25 bp, Mus musculus
agaagaactgagattcctactggac

SEQ ID NO: 186365 - DNA, 25 bp, Mus musculus
agaagaactgtgaagtgctttgttt

SEQ ID NO: 186366 - DNA, 25 bp, Mus musculus
agaagaacttataaggcgtctcttt

SEQ ID NO: 186367 - DNA, 25 bp, Mus musculus
agaagaagaaaagctcaacagaggc

SEQ ID NO: 186368 - DNA, 25 bp, Mus musculus
agaagaagaaaaggctacagaaact

SEQ ID NO: 186369 - DNA, 25 bp, Mus musculus
agaagaagaaaagtgttgccgggaa

SEQ ID NO: 186370 - DNA, 25 bp, Mus musculus
agaagaagaaagaggatgctctgga

SEQ ID NO: 186371 - DNA, 25 bp, Mus musculus
agaagaagaagaggtctaagagtgt

SEQ ID NO: 186372 - DNA, 25 bp, Mus musculus
agaagaagaaggcgtcccatgagaa

SEQ ID NO: 186373 - DNA, 25 bp, Mus musculus
agaagaagaagggtcctgggctgtc

SEQ ID NO: 186374 - DNA, 25 bp, Mus musculus
agaagaagaaggtagctacatcaag

SEQ ID NO: 186375 - DNA, 25 bp, Mus musculus
agaagaagaaggtgaccggagagga

SEQ ID NO: 186376 - DNA, 25 bp, Mus musculus
agaagaagaaggttttcgcatttcc

SEQ ID NO: 186377 - DNA, 25 bp, Mus musculus
agaagaagaagtatgaacgaggctc

SEQ ID NO: 186378 - DNA, 25 bp, Mus musculus
agaagaagaataacccatggctgtg

SEQ ID NO: 186379 - DNA, 25 bp, Mus musculus
agaagaagaattaactctgctgttt

SEQ ID NO: 186380 - DNA, 25 bp, Mus musculus
agaagaagaatttgggcttcctgta

SEQ ID NO: 186381 - DNA, 25 bp, Mus musculus
agaagaagagcagagaaacttttcc

SEQ ID NO: 186382 - DNA, 25 bp, Mus musculus
agaagaagaggcacactggagcggc

SEQ ID NO: 186383 - DNA, 25 bp, Mus musculus
agaagaagaggcttctgtgtcagtc

SEQ ID NO: 186384 - DNA, 25 bp, Mus musculus
agaagaagaggtctaagagtgtcac

SEQ ID NO: 186385 - DNA, 25 bp, Mus musculus
agaagaagaggtgagtaatctggtc

SEQ ID NO: 186386 - DNA, 25 bp, Mus musculus
agaagaagatgcagctgagaaggta

SEQ ID NO: 186387 - DNA, 25 bp, Mus musculus
agaagaagcacaagcttctggcccc

SEQ ID NO: 186388 - DNA, 25 bp, Mus musculus
agaagaagcagaaggcttctcagaa

SEQ ID NO: 186389 - DNA, 25 bp, Mus musculus
agaagaagcagcaacagttggagga

SEQ ID NO: 186390 - DNA, 25 bp, Mus musculus
agaagaagcaggaattcttaggcaa

SEQ ID NO: 186391 - DNA, 25 bp, Mus musculus
agaagaagcaggtcacgatctagat

SEQ ID NO: 186392 - DNA, 25 bp, Mus musculus
agaagaagcaggtttcttcgtttga

SEQ ID NO: 186393 - DNA, 25 bp, Mus musculus
agaagaagcccaaagcatccaaaga

SEQ ID NO: 186394 - DNA, 25 bp, Mus musculus
agaagaagctggtcccgtccatggg

SEQ ID NO: 186395 - DNA, 25 bp, Mus musculus
agaagaaggagaaaatcacttctcc

SEQ ID NO: 186396 - DNA, 25 bp, Mus musculus
agaagaaggagccagctattcactt

SEQ ID NO: 186397 - DNA, 25 bp, Mus musculus
agaagaaggcagataaggaaaaggg

SEQ ID NO: 186398 - DNA, 25 bp, Mus musculus
agaagaaggcagcccagatactcag

SEQ ID NO: 186399 - DNA, 25 bp, Mus musculus
agaagaaggcaggcctccacttaca

SEQ ID NO: 186400 - DNA, 25 bp, Mus musculus
agaagaagggtcctgggctgtcctg

SEQ ID NO: 186401 - DNA, 25 bp, Mus musculus
agaagaagtgccaggaatccgaatc

SEQ ID NO: 186402 - DNA, 25 bp, Mus musculus
agaagaagtgccaggagaaatctga

SEQ ID NO: 186403 - DNA, 25 bp, Mus musculus
agaagaagttatgctgcaggcacac

SEQ ID NO: 186404 - DNA, 25 bp, Mus musculus
agaagaatacaagaagagggcagca

SEQ ID NO: 186405 - DNA, 25 bp, Mus musculus
agaagaatacaagatcaaatgcctg

SEQ ID NO: 186406 - DNA, 25 bp, Mus musculus
agaagaatacgcgggtcagataaca

SEQ ID NO: 186407 - DNA, 25 bp, Mus musculus
agaagaatatgctggaccgcttcga

SEQ ID NO: 186408 - DNA, 25 bp, Mus musculus
agaagaatatggtggcctgggcctc

SEQ ID NO: 186409 - DNA, 25 bp, Mus musculus
agaagaatgggctctacttgaatct

SEQ ID NO: 186410 - DNA, 25 bp, Mus musculus
agaagaatgggtctttccttccagg

SEQ ID NO: 186411 - DNA, 25 bp, Mus musculus
agaagaattctaatgttttgtgatc

SEQ ID NO: 186412 - DNA, 25 bp, Mus musculus
agaagaattctagggtactcaatgc

SEQ ID NO: 186413 - DNA, 25 bp, Mus musculus
agaagaattgtgtctggaattctct

SEQ ID NO: 186414 - DNA, 25 bp, Mus musculus
agaagaatttgtcagttggttactg

SEQ ID NO: 186415 - DNA, 25 bp, Mus musculus
agaagacaaaaagagttcaaaattg

SEQ ID NO: 186416 - DNA, 25 bp, Mus musculus
agaagacaaagacaggatgagagac

SEQ ID NO: 186417 - DNA, 25 bp, Mus musculus
agaagacaaaggaaacagaggctac

SEQ ID NO: 186418 - DNA, 25 bp, Mus musculus
agaagacaaggttctttaacgaagc

SEQ ID NO: 186419 - DNA, 25 bp, Mus musculus
agaagacaatagcacccaggcagac

SEQ ID NO: 186420 - DNA, 25 bp, Mus musculus
agaagacacagagggctgacagctt

SEQ ID NO: 186421 - DNA, 25 bp, Mus musculus
agaagacaccctgatatctgcacac

SEQ ID NO: 186422 - DNA, 25 bp, Mus musculus
agaagacacgaaggcaaccaaggca

SEQ ID NO: 186423 - DNA, 25 bp, Mus musculus
agaagacacggatactgagaactca

SEQ ID NO: 186424 - DNA, 25 bp, Mus musculus
agaagacactagggtggctaccgtc

SEQ ID NO: 186425 - DNA, 25 bp, Mus musculus
agaagacagagcaaggtcctgttta

SEQ ID NO: 186426 - DNA, 25 bp, Mus musculus
agaagacagcgaagggctcacaact

SEQ ID NO: 186427 - DNA, 25 bp, Mus musculus
agaagacagttacggtaaattctac

SEQ ID NO: 186428 - DNA, 25 bp, Mus musculus
agaagacagttacggtatgcttccc

SEQ ID NO: 186429 - DNA, 25 bp, Mus musculus
agaagacatcaagtgctgtaacagt

SEQ ID NO: 186430 - DNA, 25 bp, Mus musculus
agaagacatcgctgaccctgtctct

SEQ ID NO: 186431 - DNA, 25 bp, Mus musculus
agaagacatctactaaaccgcccag

SEQ ID NO: 186432 - DNA, 25 bp, Mus musculus
agaagacatgtcagcttctctgtcc

SEQ ID NO: 186433 - DNA, 25 bp, Mus musculus
agaagaccaagactgtatcccttgc

SEQ ID NO: 186434 - DNA, 25 bp, Mus musculus
agaagaccaaggctttgatccagtg

SEQ ID NO: 186435 - DNA, 25 bp, Mus musculus
agaagaccagaagctctgactatgc

SEQ ID NO: 186436 - DNA, 25 bp, Mus musculus
agaagaccaggcagggtctcctgga

SEQ ID NO: 186437 - DNA, 25 bp, Mus musculus
agaagaccagggaggtgactgactt

SEQ ID NO: 186438 - DNA, 25 bp, Mus musculus
agaagacccaaagcgtctgatggct

SEQ ID NO: 186439 - DNA, 25 bp, Mus musculus
agaagacccaagcttggatctagca

SEQ ID NO: 186440 - DNA, 25 bp, Mus musculus
agaagacccacacctcacaaattga

SEQ ID NO: 186441 - DNA, 25 bp, Mus musculus
agaagacccagaaatttgtatgccc

SEQ ID NO: 186442 - DNA, 25 bp, Mus musculus
agaagaccgaatttatctctgagca

SEQ ID NO: 186443 - DNA, 25 bp, Mus musculus
agaagacctacaaggtcggacatca

SEQ ID NO: 186444 - DNA, 25 bp, Mus musculus
agaagacctcccagatggtgttagc

SEQ ID NO: 186445 - DNA, 25 bp, Mus musculus
agaagacgaggcgggacatgttctc

SEQ ID NO: 186446 - DNA, 25 bp, Mus musculus
agaagacgaggcgggccatccgggt

SEQ ID NO: 186447 - DNA, 25 bp, Mus musculus
agaagactacagatgggcagcagat

SEQ ID NO: 186448 - DNA, 25 bp, Mus musculus
agaagactacagctcgacatgggtt

SEQ ID NO: 186449 - DNA, 25 bp, Mus musculus
agaagactacaggacctgcagggac

SEQ ID NO: 186450 - DNA, 25 bp, Mus musculus
agaagactacagttgcagctcgaca

SEQ ID NO: 186451 - DNA, 25 bp, Mus musculus
agaagactagattgaggaggaggag

SEQ ID NO: 186452 - DNA, 25 bp, Mus musculus
agaagactagccgccgtgccacgtc

SEQ ID NO: 186453 - DNA, 25 bp, Mus musculus
agaagactcgaaacttatagctctc

SEQ ID NO: 186454 - DNA, 25 bp, Mus musculus
agaagactgcaggaggtctccaggt

SEQ ID NO: 186455 - DNA, 25 bp, Mus musculus
agaagactgcgctgagtggaccaga

SEQ ID NO: 186456 - DNA, 25 bp, Mus musculus
agaagactgcggttctacgggtgcc

SEQ ID NO: 186457 - DNA, 25 bp, Mus musculus
agaagactgtgaacaggtatgagaa

SEQ ID NO: 186458 - DNA, 25 bp, Mus musculus
agaagactgtggacgatgtcataaa

SEQ ID NO: 186459 - DNA, 25 bp, Mus musculus
agaagactgtggacgggattctctg

SEQ ID NO: 186460 - DNA, 25 bp, Mus musculus
agaagactttggtggcacgcggtgt

SEQ ID NO: 186461 - DNA, 25 bp, Mus musculus
agaagagaaagaaagaccagagaga

SEQ ID NO: 186462 - DNA, 25 bp, Mus musculus
agaagagaaaggtctgtatccaccc

SEQ ID NO: 186463 - DNA, 25 bp, Mus musculus
agaagagaaataataactgccatgg

SEQ ID NO: 186464 - DNA, 25 bp, Mus musculus
agaagagaaatatattgagcggttt

SEQ ID NO: 186465 - DNA, 25 bp, Mus musculus
agaagagaaatattacagcgactgt

SEQ ID NO: 186466 - DNA, 25 bp, Mus musculus
agaagagaaattttgaaatgccctt

SEQ ID NO: 186467 - DNA, 25 bp, Mus musculus
agaagagaagaagcgcaggaaaggt

SEQ ID NO: 186468 - DNA, 25 bp, Mus musculus
agaagagaagacactaccactgagc

SEQ ID NO: 186469 - DNA, 25 bp, Mus musculus
agaagagaaggaagatccctgtggc

SEQ ID NO: 186470 - DNA, 25 bp, Mus musculus
agaagagaagggactcggccagact

SEQ ID NO: 186471 - DNA, 25 bp, Mus musculus
agaagagaatgcccaggctgaagcg

SEQ ID NO: 186472 - DNA, 25 bp, Mus musculus
agaagagaattgagcgtttatcact

SEQ ID NO: 186473 - DNA, 25 bp, Mus musculus
agaagagacactgcagcggaagatg

SEQ ID NO: 186474 - DNA, 25 bp, Mus musculus
agaagagactacaactaaagcaagc

SEQ ID NO: 186475 - DNA, 25 bp, Mus musculus
agaagagactacggccttattttgg

SEQ ID NO: 186476 - DNA, 25 bp, Mus musculus
agaagagagagaagctcggacctaa

SEQ ID NO: 186477 - DNA, 25 bp, Mus musculus
agaagagagagtacctcagccctgt

SEQ ID NO: 186478 - DNA, 25 bp, Mus musculus
agaagagatacaggtctcgttccag

SEQ ID NO: 186479 - DNA, 25 bp, Mus musculus
agaagagatacagttctaggtctcg

SEQ ID NO: 186480 - DNA, 25 bp, Mus musculus
agaagagatcctggctaagaatcca

SEQ ID NO: 186481 - DNA, 25 bp, Mus musculus
agaagagatggagttttttggacca

SEQ ID NO: 186482 - DNA, 25 bp, Mus musculus
agaagagatggcagatactttggca

SEQ ID NO: 186483 - DNA, 25 bp, Mus musculus
agaagagatggcaggtgtatggtgg

SEQ ID NO: 186484 - DNA, 25 bp, Mus musculus
agaagagattagtggccaagcccag

SEQ ID NO: 186485 - DNA, 25 bp, Mus musculus
agaagagcaagaacctgggagcaga

SEQ ID NO: 186486 - DNA, 25 bp, Mus musculus
agaagagcaagcacgcccccagagg

SEQ ID NO: 186487 - DNA, 25 bp, Mus musculus
agaagagcaagttaagtttgaaagt

SEQ ID NO: 186488 - DNA, 25 bp, Mus musculus
agaagagcagacagataaaggagct

SEQ ID NO: 186489 - DNA, 25 bp, Mus musculus
agaagagcagagaaacttttccatg

SEQ ID NO: 186490 - DNA, 25 bp, Mus musculus
agaagagcaggaaccccagaacatg

SEQ ID NO: 186491 - DNA, 25 bp, Mus musculus
agaagagcagggctgtgtctggctg

SEQ ID NO: 186492 - DNA, 25 bp, Mus musculus
agaagagcagtacactaggtaccag

SEQ ID NO: 186493 - DNA, 25 bp, Mus musculus
agaagagcagtcgggtgctcttacc

SEQ ID NO: 186494 - DNA, 25 bp, Mus musculus
agaagagccactgggctcctagctt

SEQ ID NO: 186495 - DNA, 25 bp, Mus musculus
agaagagccactggggggaggggtt

SEQ ID NO: 186496 - DNA, 25 bp, Mus musculus
agaagagccaggcaggtgcttcaga

SEQ ID NO: 186497 - DNA, 25 bp, Mus musculus
agaagagccatgaagccgaggaaag

SEQ ID NO: 186498 - DNA, 25 bp, Mus musculus
agaagagcccaaagggggaccaggc

SEQ ID NO: 186499 - DNA, 25 bp, Mus musculus
agaagagccccagagtggtaaacag

SEQ ID NO: 186500 - DNA, 25 bp, Mus musculus
agaagagccccagtcacgcggtgtt

SEQ ID NO: 186501 - DNA, 25 bp, Mus musculus
agaagagcgtggagataacaaaaca

SEQ ID NO: 186502 - DNA, 25 bp, Mus musculus
agaagagctcaaaatgttaccagac

SEQ ID NO: 186503 - DNA, 25 bp, Mus musculus
agaagagctcaaagccaagcactcg

SEQ ID NO: 186504 - DNA, 25 bp, Mus musculus
agaagagctgccctctgaagccaag

SEQ ID NO: 186505 - DNA, 25 bp, Mus musculus
agaagagcttagcctatcttcagag

SEQ ID NO: 186506 - DNA, 25 bp, Mus musculus
agaagaggacggctgctgctgaact

SEQ ID NO: 186507 - DNA, 25 bp, Mus musculus
agaagaggagctggcactgcccttt

SEQ ID NO: 186508 - DNA, 25 bp, Mus musculus
agaagaggaggacgagcaagaggag

SEQ ID NO: 186509 - DNA, 25 bp, Mus musculus
agaagaggaggagggtccggaccgc

SEQ ID NO: 186510 - DNA, 25 bp, Mus musculus
agaagaggagggactgatttgctta

SEQ ID NO: 186511 - DNA, 25 bp, Mus musculus
agaagaggatggctgctcccaggca

SEQ ID NO: 186512 - DNA, 25 bp, Mus musculus
agaagaggcaatattgataatacaa

SEQ ID NO: 186513 - DNA, 25 bp, Mus musculus
agaagaggctcagaacactggggat

SEQ ID NO: 186514 - DNA, 25 bp, Mus musculus
agaagaggctctccctgaagtcacc

SEQ ID NO: 186515 - DNA, 25 bp, Mus musculus
agaagaggctgggatcagtacctgt

SEQ ID NO: 186516 - DNA, 25 bp, Mus musculus
agaagaggtgactgcccctgtctta

SEQ ID NO: 186517 - DNA, 25 bp, Mus musculus
agaagagtacacaatgggtacccca

SEQ ID NO: 186518 - DNA, 25 bp, Mus musculus
agaagagtatacaagattatcctgt

SEQ ID NO: 186519 - DNA, 25 bp, Mus musculus
agaagagtatacaaggtatcagtac

SEQ ID NO: 186520 - DNA, 25 bp, Mus musculus
agaagagtgaatatgttttgcattt

SEQ ID NO: 186521 - DNA, 25 bp, Mus musculus
agaagagtgaccaaatgacccagtg

SEQ ID NO: 186522 - DNA, 25 bp, Mus musculus
agaagagtgcagatgggatgcttta

SEQ ID NO: 186523 - DNA, 25 bp, Mus musculus
agaagagtgggacggctgttctcag

SEQ ID NO: 186524 - DNA, 25 bp, Mus musculus
agaagagttggaagcctcgtcttcc

SEQ ID NO: 186525 - DNA, 25 bp, Mus musculus
agaagagttggaaggtcatagaact

SEQ ID NO: 186526 - DNA, 25 bp, Mus musculus
agaagagtttcctggagaaggaact

SEQ ID NO: 186527 - DNA, 25 bp, Mus musculus
agaagataaacagatacagacagaa

SEQ ID NO: 186528 - DNA, 25 bp, Mus musculus
agaagataaacagtgtggcctacca

SEQ ID NO: 186529 - DNA, 25 bp, Mus musculus
agaagataaagcgaggctgaaagga

SEQ ID NO: 186530 - DNA, 25 bp, Mus musculus
agaagataaagcgagtttcactttc

SEQ ID NO: 186531 - DNA, 25 bp, Mus musculus
agaagataaaggaccctgatgctaa

SEQ ID NO: 186532 - DNA, 25 bp, Mus musculus
agaagataccagagtatacccgcaa

SEQ ID NO: 186533 - DNA, 25 bp, Mus musculus
agaagatagcgaaacagagataaac

SEQ ID NO: 186534 - DNA, 25 bp, Mus musculus
agaagatatctcagcaaagctacca

SEQ ID NO: 186535 - DNA, 25 bp, Mus musculus
agaagatatgtagtcagaagatggc

SEQ ID NO: 186536 - DNA, 25 bp, Mus musculus
agaagatattaaacgacacaaggct

SEQ ID NO: 186537 - DNA, 25 bp, Mus musculus
agaagatattaaatgggacctacac

SEQ ID NO: 186538 - DNA, 25 bp, Mus musculus
agaagatattgacacagcagtccga

SEQ ID NO: 186539 - DNA, 25 bp, Mus musculus
agaagatattttttgagaaatggtg

SEQ ID NO: 186540 - DNA, 25 bp, Mus musculus
agaagatcaaggaacgcatccgaaa

SEQ ID NO: 186541 - DNA, 25 bp, Mus musculus
agaagatcattaaggaacgagaact

SEQ ID NO: 186542 - DNA, 25 bp, Mus musculus
agaagatccagggcttggaccgcct

SEQ ID NO: 186543 - DNA, 25 bp, Mus musculus
agaagatccatgagaaattgttccc

SEQ ID NO: 186544 - DNA, 25 bp, Mus musculus
agaagatcccctgaaacatgctggt

SEQ ID NO: 186545 - DNA, 25 bp, Mus musculus
agaagatctagatcccgctcaaggt

SEQ ID NO: 186546 - DNA, 25 bp, Mus musculus
agaagatctatctaagtaagaagta

SEQ ID NO: 186547 - DNA, 25 bp, Mus musculus
agaagatctggcaggccctcagaat

SEQ ID NO: 186548 - DNA, 25 bp, Mus musculus
agaagatctggcaggggactctcct

SEQ ID NO: 186549 - DNA, 25 bp, Mus musculus
agaagatcttctgattcctgccgtt

SEQ ID NO: 186550 - DNA, 25 bp, Mus musculus
agaagatcttctggcacagcttgcc

SEQ ID NO: 186551 - DNA, 25 bp, Mus musculus
agaagatgaaaaagggttcaaagac

SEQ ID NO: 186552 - DNA, 25 bp, Mus musculus
agaagatgaagatgtctggtgagaa

SEQ ID NO: 186553 - DNA, 25 bp, Mus musculus
agaagatgaaggagaaggaggaggt

SEQ ID NO: 186554 - DNA, 25 bp, Mus musculus
agaagatgaaggagagcccatcgca

SEQ ID NO: 186555 - DNA, 25 bp, Mus musculus
agaagatgaccgcggagggcatccg

SEQ ID NO: 186556 - DNA, 25 bp, Mus musculus
agaagatgagattctgttttgaagt

SEQ ID NO: 186557 - DNA, 25 bp, Mus musculus
agaagatgagatttctgctttcact

SEQ ID NO: 186558 - DNA, 25 bp, Mus musculus
agaagatgagtgatgaaaacaacga

SEQ ID NO: 186559 - DNA, 25 bp, Mus musculus
agaagatgagtgatgctgcaggtga

SEQ ID NO: 186560 - DNA, 25 bp, Mus musculus
agaagatgatccccagtgtttccag

SEQ ID NO: 186561 - DNA, 25 bp, Mus musculus
agaagatgatcgtcttcaagcctta

SEQ ID NO: 186562 - DNA, 25 bp, Mus musculus
agaagatgcagctgagaaggtagag

SEQ ID NO: 186563 - DNA, 25 bp, Mus musculus
agaagatgctaggagttaaccagct

SEQ ID NO: 186564 - DNA, 25 bp, Mus musculus
agaagatgctagggtaataatcttc

SEQ ID NO: 186565 - DNA, 25 bp, Mus musculus
agaagatgctgtcagggatggtgaa

SEQ ID NO: 186566 - DNA, 25 bp, Mus musculus
agaagatggagatcagccagatgct

SEQ ID NO: 186567 - DNA, 25 bp, Mus musculus
agaagatggagatggctcttggaca

SEQ ID NO: 186568 - DNA, 25 bp, Mus musculus
agaagatggcagaatagtgattgac

SEQ ID NO: 186569 - DNA, 25 bp, Mus musculus
agaagatggccctctctttcagcgt

SEQ ID NO: 186570 - DNA, 25 bp, Mus musculus
agaagatggccgtggcaaccctggc

SEQ ID NO: 186571 - DNA, 25 bp, Mus musculus
agaagatgtacagattttccagggc

SEQ ID NO: 186572 - DNA, 25 bp, Mus musculus
agaagatgtcatttgaagctgagga

SEQ ID NO: 186573 - DNA, 25 bp, Mus musculus
agaagatgtcatttgggaggactca

SEQ ID NO: 186574 - DNA, 25 bp, Mus musculus
agaagatgtgtaggggagctgtccc

SEQ ID NO: 186575 - DNA, 25 bp, Mus musculus
agaagattaaggacctggagcagaa

SEQ ID NO: 186576 - DNA, 25 bp, Mus musculus
agaagattacgacgggcagaaccca

SEQ ID NO: 186577 - DNA, 25 bp, Mus musculus
agaagattattgatattttcatttc

SEQ ID NO: 186578 - DNA, 25 bp, Mus musculus
agaagattcagatggggctgaggag

SEQ ID NO: 186579 - DNA, 25 bp, Mus musculus
agaagattccagtcctgcaccgagg

SEQ ID NO: 186580 - DNA, 25 bp, Mus musculus
agaagattgaagccatggctgagca

SEQ ID NO: 186581 - DNA, 25 bp, Mus musculus
agaagattgcaaagtatggtataag

SEQ ID NO: 186582 - DNA, 25 bp, Mus musculus
agaagattggatttaccttcaagac

SEQ ID NO: 186583 - DNA, 25 bp, Mus musculus
agaagattgtcaagagcaactgcaa

SEQ ID NO: 186584 - DNA, 25 bp, Mus musculus
agaagcaaaaaggcagaagacttat

SEQ ID NO: 186585 - DNA, 25 bp, Mus musculus
agaagcaaaaaggtctgtctgttac

SEQ ID NO: 186586 - DNA, 25 bp, Mus musculus
agaagcaaaacttttaatccaggtg

SEQ ID NO: 186587 - DNA, 25 bp, Mus musculus
agaagcaaaagcaggcggaacatgt

SEQ ID NO: 186588 - DNA, 25 bp, Mus musculus
agaagcaaagagaaccaacttcttg

SEQ ID NO: 186589 - DNA, 25 bp, Mus musculus
agaagcaaagagcgtgctaatgcgc

SEQ ID NO: 186590 - DNA, 25 bp, Mus musculus
agaagcaaagagggaagaagacatg

SEQ ID NO: 186591 - DNA, 25 bp, Mus musculus
agaagcaaagcataaacaagctgag

SEQ ID NO: 186592 - DNA, 25 bp, Mus musculus
agaagcaaaggaatattttgcagag

SEQ ID NO: 186593 - DNA, 25 bp, Mus musculus
agaagcaaaggataaacaagctgag

SEQ ID NO: 186594 - DNA, 25 bp, Mus musculus
agaagcaaaggtctcagccagtctc

SEQ ID NO: 186595 - DNA, 25 bp, Mus musculus
agaagcaaattgtggaccgggtcag

SEQ ID NO: 186596 - DNA, 25 bp, Mus musculus
agaagcaacaggaggctgatcgaaa

SEQ ID NO: 186597 - DNA, 25 bp, Mus musculus
agaagcaacaggagtgcaggaggat

SEQ ID NO: 186598 - DNA, 25 bp, Mus musculus
agaagcaacaggcatgacttgccaa

SEQ ID NO: 186599 - DNA, 25 bp, Mus musculus
agaagcaagaggaagaggagcagag

SEQ ID NO: 186600 - DNA, 25 bp, Mus musculus
agaagcaagcatgaatgaagtctta

SEQ ID NO: 186601 - DNA, 25 bp, Mus musculus
agaagcaagcatgagaaaggctggg

SEQ ID NO: 186602 - DNA, 25 bp, Mus musculus
agaagcaagggaaaatacagaagag

SEQ ID NO: 186603 - DNA, 25 bp, Mus musculus
agaagcaagggaacctgcaactgca

SEQ ID NO: 186604 - DNA, 25 bp, Mus musculus
agaagcaaggtgaaggctcctcggg

SEQ ID NO: 186605 - DNA, 25 bp, Mus musculus
agaagcaatgatggagcaggaaatg

SEQ ID NO: 186606 - DNA, 25 bp, Mus musculus
agaagcacacacagacactggatcc

SEQ ID NO: 186607 - DNA, 25 bp, Mus musculus
agaagcacacacaggggcagttcca

SEQ ID NO: 186608 - DNA, 25 bp, Mus musculus
agaagcacacagatcgcaagtccta

SEQ ID NO: 186609 - DNA, 25 bp, Mus musculus
agaagcacacttgttgtttacctgc

SEQ ID NO: 186610 - DNA, 25 bp, Mus musculus
agaagcacagaactgctgagtgccc

SEQ ID NO: 186611 - DNA, 25 bp, Mus musculus
agaagcacagagagagattaagaag

SEQ ID NO: 186612 - DNA, 25 bp, Mus musculus
agaagcacagatccatgcatgacca

SEQ ID NO: 186613 - DNA, 25 bp, Mus musculus
agaagcacagggcatctgttatgca

SEQ ID NO: 186614 - DNA, 25 bp, Mus musculus
agaagcacatcaaggtgaacctgat

SEQ ID NO: 186615 - DNA, 25 bp, Mus musculus
agaagcaccagagggtgtctttaag

SEQ ID NO: 186616 - DNA, 25 bp, Mus musculus
agaagcaccagaggtctgagttctt

SEQ ID NO: 186617 - DNA, 25 bp, Mus musculus
agaagcacccagaaggcaagatcct

SEQ ID NO: 186618 - DNA, 25 bp, Mus musculus
agaagcaccctgaggagcaccactc

SEQ ID NO: 186619 - DNA, 25 bp, Mus musculus
agaagcacctgggagagcccccctt

SEQ ID NO: 186620 - DNA, 25 bp, Mus musculus
agaagcactacagactgcagttcta

SEQ ID NO: 186621 - DNA, 25 bp, Mus musculus
agaagcactcagcacggcagctgcg

SEQ ID NO: 186622 - DNA, 25 bp, Mus musculus
agaagcactccataaactaaagctg

SEQ ID NO: 186623 - DNA, 25 bp, Mus musculus
agaagcactccatgtgtgtctgaag

SEQ ID NO: 186624 - DNA, 25 bp, Mus musculus
agaagcagaaggcttctcagaacct

SEQ ID NO: 186625 - DNA, 25 bp, Mus musculus
agaagcagaagtcgacagagcacac

SEQ ID NO: 186626 - DNA, 25 bp, Mus musculus
agaagcagaccaaggtggaattccc

SEQ ID NO: 186627 - DNA, 25 bp, Mus musculus
agaagcagaccaagttccagaatct

SEQ ID NO: 186628 - DNA, 25 bp, Mus musculus
agaagcagagcactggcagatccca

SEQ ID NO: 186629 - DNA, 25 bp, Mus musculus
agaagcagatccggagtagcccctg

SEQ ID NO: 186630 - DNA, 25 bp, Mus musculus
agaagcagatcttgaggttacggaa

SEQ ID NO: 186631 - DNA, 25 bp, Mus musculus
agaagcagcacgagcgggtattccc

SEQ ID NO: 186632 - DNA, 25 bp, Mus musculus
agaagcagcgatgggccagggcttt

SEQ ID NO: 186633 - DNA, 25 bp, Mus musculus
agaagcaggaagtgtacttgatgtg

SEQ ID NO: 186634 - DNA, 25 bp, Mus musculus
agaagcaggcaaggtatacttgaag

SEQ ID NO: 186635 - DNA, 25 bp, Mus musculus
agaagcaggcagtgaggccaggttc

SEQ ID NO: 186636 - DNA, 25 bp, Mus musculus
agaagcaggtccccaagaagcttaa

SEQ ID NO: 186637 - DNA, 25 bp, Mus musculus
agaagcagtgagtacaacacatgga

SEQ ID NO: 186638 - DNA, 25 bp, Mus musculus
agaagcagtggctctagtctggccc

SEQ ID NO: 186639 - DNA, 25 bp, Mus musculus
agaagcagtgggtacaaacaaattt

SEQ ID NO: 186640 - DNA, 25 bp, Mus musculus
agaagcagtggtatttatgagcctc

SEQ ID NO: 186641 - DNA, 25 bp, Mus musculus
agaagcatcaagatgacttacaaga

SEQ ID NO: 186642 - DNA, 25 bp, Mus musculus
agaagcatggaagaaaaagagagag

SEQ ID NO: 186643 - DNA, 25 bp, Mus musculus
agaagcatggaaggatttagacaag

SEQ ID NO: 186644 - DNA, 25 bp, Mus musculus
agaagcatggaaggtggaaaaaacc

SEQ ID NO: 186645 - DNA, 25 bp, Mus musculus
agaagcattagcagcattcacagct

SEQ ID NO: 186646 - DNA, 25 bp, Mus musculus
agaagcattagcagggttggtttcc

SEQ ID NO: 186647 - DNA, 25 bp, Mus musculus
agaagccaagctgctgcattttttc

SEQ ID NO: 186648 - DNA, 25 bp, Mus musculus
agaagccaaggcatgttatttgaaa

SEQ ID NO: 186649 - DNA, 25 bp, Mus musculus
agaagccaagtcccatggcctcgca

SEQ ID NO: 186650 - DNA, 25 bp, Mus musculus
agaagccaagttggcgagaggctcc

SEQ ID NO: 186651 - DNA, 25 bp, Mus musculus
agaagccacacaggttcctttggtt

SEQ ID NO: 186652 - DNA, 25 bp, Mus musculus
agaagccacagccaggatatccctg

SEQ ID NO: 186653 - DNA, 25 bp, Mus musculus
agaagccacaggaatcctgacctct

SEQ ID NO: 186654 - DNA, 25 bp, Mus musculus
agaagccaccaaaggagtaacctat

SEQ ID NO: 186655 - DNA, 25 bp, Mus musculus
agaagccaccaaaggttacagagaa

SEQ ID NO: 186656 - DNA, 25 bp, Mus musculus
agaagccacggatggtctcagcact

SEQ ID NO: 186657 - DNA, 25 bp, Mus musculus
agaagccacggctttctcagggcct

SEQ ID NO: 186658 - DNA, 25 bp, Mus musculus
agaagccagcagggctgtgggacat

SEQ ID NO: 186659 - DNA, 25 bp, Mus musculus
agaagccagccacaggcccaggcct

SEQ ID NO: 186660 - DNA, 25 bp, Mus musculus
agaagccatacgaattagtcctaca

SEQ ID NO: 186661 - DNA, 25 bp, Mus musculus
agaagccatcagacatattggctgg

SEQ ID NO: 186662 - DNA, 25 bp, Mus musculus
agaagccatgggactcgtggggaaa

SEQ ID NO: 186663 - DNA, 25 bp, Mus musculus
agaagccattacaatgtgagatctg

SEQ ID NO: 186664 - DNA, 25 bp, Mus musculus
agaagcccaaagcatccaaagacaa

SEQ ID NO: 186665 - DNA, 25 bp, Mus musculus
agaagcccaagctgcagacggagct

SEQ ID NO: 186666 - DNA, 25 bp, Mus musculus
agaagcccaaggagggtgtgaagac

SEQ ID NO: 186667 - DNA, 25 bp, Mus musculus
agaagcccaaggatgatgaaaacaa

SEQ ID NO: 186668 - DNA, 25 bp, Mus musculus
agaagcccacagaaacgcatcccac

SEQ ID NO: 186669 - DNA, 25 bp, Mus musculus
agaagcccacagtccatggagacaa

SEQ ID NO: 186670 - DNA, 25 bp, Mus musculus
agaagcccagatggtgcagtcactg

SEQ ID NO: 186671 - DNA, 25 bp, Mus musculus
agaagcccagcaagattctgtgatg

SEQ ID NO: 186672 - DNA, 25 bp, Mus musculus
agaagcccagcaaggaccgccttca

SEQ ID NO: 186673 - DNA, 25 bp, Mus musculus
agaagcccccacctagatcaagcac

SEQ ID NO: 186674 - DNA, 25 bp, Mus musculus
agaagcccccacctgaagaaaatgg

SEQ ID NO: 186675 - DNA, 25 bp, Mus musculus
agaagccctcgaaggttgcagctcc

SEQ ID NO: 186676 - DNA, 25 bp, Mus musculus
agaagccctgaactatcctccatgt

SEQ ID NO: 186677 - DNA, 25 bp, Mus musculus
agaagccctgaactgtactctctct

SEQ ID NO: 186678 - DNA, 25 bp, Mus musculus
agaagccgaaagcgaatattaatta

SEQ ID NO: 186679 - DNA, 25 bp, Mus musculus
agaagccggaggttgagaacaaaaa

SEQ ID NO: 186680 - DNA, 25 bp, Mus musculus
agaagccggcctcggtgtggtacat

SEQ ID NO: 186681 - DNA, 25 bp, Mus musculus
agaagccggggagtcccatggtctg

SEQ ID NO: 186682 - DNA, 25 bp, Mus musculus
agaagccgtcaccccaaaattttgt

SEQ ID NO: 186683 - DNA, 25 bp, Mus musculus
agaagcctaaaaagacggcacaaac

SEQ ID NO: 186684 - DNA, 25 bp, Mus musculus
agaagcctaaaaaggtggtgctgtg

SEQ ID NO: 186685 - DNA, 25 bp, Mus musculus
agaagcctaagcctgatttctttat

SEQ ID NO: 186686 - DNA, 25 bp, Mus musculus
agaagcctaagccttgctcagctcc

SEQ ID NO: 186687 - DNA, 25 bp, Mus musculus
agaagcctgaaaagatcccaccaaa

SEQ ID NO: 186688 - DNA, 25 bp, Mus musculus
agaagccttgttcaggacgcacccc

SEQ ID NO: 186689 - DNA, 25 bp, Mus musculus
agaagccttgttcagggggagctgg

SEQ ID NO: 186690 - DNA, 25 bp, Mus musculus
agaagcgcaaggtgtcagacaaaga

SEQ ID NO: 186691 - DNA, 25 bp, Mus musculus
agaagcggagtgttggtaactaaat

SEQ ID NO: 186692 - DNA, 25 bp, Mus musculus
agaagcggcctgcatgacccgccgg

SEQ ID NO: 186693 - DNA, 25 bp, Mus musculus
agaagcgggaattggtctcggtgtg

SEQ ID NO: 186694 - DNA, 25 bp, Mus musculus
agaagcgggaattggtctgggcgtc

SEQ ID NO: 186695 - DNA, 25 bp, Mus musculus
agaagcgggaattggtcttggagtt

SEQ ID NO: 186696 - DNA, 25 bp, Mus musculus
agaagcgtctacaaacttcaccaaa

SEQ ID NO: 186697 - DNA, 25 bp, Mus musculus
agaagcgtctacaaagcccggttcc

SEQ ID NO: 186698 - DNA, 25 bp, Mus musculus
agaagctaacaatcttggcaaagcg

SEQ ID NO: 186699 - DNA, 25 bp, Mus musculus
agaagctaggacctacagactacaa

SEQ ID NO: 186700 - DNA, 25 bp, Mus musculus
agaagctatgaggtaactgtggaga

SEQ ID NO: 186701 - DNA, 25 bp, Mus musculus
agaagctatgaggtcatggagggaa

SEQ ID NO: 186702 - DNA, 25 bp, Mus musculus
agaagctatggcagaaagccctgca

SEQ ID NO: 186703 - DNA, 25 bp, Mus musculus
agaagctatggcagagtgctgggat

SEQ ID NO: 186704 - DNA, 25 bp, Mus musculus
agaagctatggcagctacttaaaat

SEQ ID NO: 186705 - DNA, 25 bp, Mus musculus
agaagctatggcaggtgattggagt

SEQ ID NO: 186706 - DNA, 25 bp, Mus musculus
agaagctatggcagtggttttatga

SEQ ID NO: 186707 - DNA, 25 bp, Mus musculus
agaagctcaagacatactttgaaga

SEQ ID NO: 186708 - DNA, 25 bp, Mus musculus
agaagctcaagacatgaagcgccac

SEQ ID NO: 186709 - DNA, 25 bp, Mus musculus
agaagctcaagtccattacaatgct

SEQ ID NO: 186710 - DNA, 25 bp, Mus musculus
agaagctcagagtctacagtgccct

SEQ ID NO: 186711 - DNA, 25 bp, Mus musculus
agaagctccgcccagacggctcaga

SEQ ID NO: 186712 - DNA, 25 bp, Mus musculus
agaagctcggtcaagggggagtgca

SEQ ID NO: 186713 - DNA, 25 bp, Mus musculus
agaagctctatgactttgtgaagac

SEQ ID NO: 186714 - DNA, 25 bp, Mus musculus
agaagctctcatctgaaaataatga

SEQ ID NO: 186715 - DNA, 25 bp, Mus musculus
agaagctctgaatgacaaaaagcat

SEQ ID NO: 186716 - DNA, 25 bp, Mus musculus
agaagctctgcaaggacatccaggc

SEQ ID NO: 186717 - DNA, 25 bp, Mus musculus
agaagctgaaagaggtggaagcggc

SEQ ID NO: 186718 - DNA, 25 bp, Mus musculus
agaagctgaagcctgcaggtctcca

SEQ ID NO: 186719 - DNA, 25 bp, Mus musculus
agaagctgaatataaactgtcatta

SEQ ID NO: 186720 - DNA, 25 bp, Mus musculus
agaagctgacgaggaaggggaagaa

SEQ ID NO: 186721 - DNA, 25 bp, Mus musculus
agaagctgacgagggttatcagctc

SEQ ID NO: 186722 - DNA, 25 bp, Mus musculus
agaagctgagcagaaaggcgctcta

SEQ ID NO: 186723 - DNA, 25 bp, Mus musculus
agaagctgagcaggcggaggaagaa

SEQ ID NO: 186724 - DNA, 25 bp, Mus musculus
agaagctgaggacaagatctaattt

SEQ ID NO: 186725 - DNA, 25 bp, Mus musculus
agaagctgagggttcaaggaaggtg

SEQ ID NO: 186726 - DNA, 25 bp, Mus musculus
agaagctgatcaaggtcttggataa

SEQ ID NO: 186727 - DNA, 25 bp, Mus musculus
agaagctgcggcccaccaggacctc

SEQ ID NO: 186728 - DNA, 25 bp, Mus musculus
agaagctgctagagcactgggaaaa

SEQ ID NO: 186729 - DNA, 25 bp, Mus musculus
agaagctgctgaggctcacaactca

SEQ ID NO: 186730 - DNA, 25 bp, Mus musculus
agaagctgctggcagaagctggaat

SEQ ID NO: 186731 - DNA, 25 bp, Mus musculus
agaagctgctgggccctaatgctgg

SEQ ID NO: 186732 - DNA, 25 bp, Mus musculus
agaagctggaagatgaagaaaagat

SEQ ID NO: 186733 - DNA, 25 bp, Mus musculus
agaagctggagcagcttgaacttga

SEQ ID NO: 186734 - DNA, 25 bp, Mus musculus
agaagctggagcaggaaagatctat

SEQ ID NO: 186735 - DNA, 25 bp, Mus musculus
agaagctggaggaggccaagcacat

SEQ ID NO: 186736 - DNA, 25 bp, Mus musculus
agaagctgggcttcaacaaatccag

SEQ ID NO: 186737 - DNA, 25 bp, Mus musculus
agaagctggtcaagggtctagagac

SEQ ID NO: 186738 - DNA, 25 bp, Mus musculus
agaagctggtgtggatggagaggtc

SEQ ID NO: 186739 - DNA, 25 bp, Mus musculus
agaagctgtaaagaggatagtgcca

SEQ ID NO: 186740 - DNA, 25 bp, Mus musculus
agaagctgtggctataatgtgcaag

SEQ ID NO: 186741 - DNA, 25 bp, Mus musculus
agaagcttccaagtatgaggatgaa

SEQ ID NO: 186742 - DNA, 25 bp, Mus musculus
agaagcttcgagcagcagtttttac

SEQ ID NO: 186743 - DNA, 25 bp, Mus musculus
agaagcttctccaagactctaaaaa

SEQ ID NO: 186744 - DNA, 25 bp, Mus musculus
agaagcttctccaagaggctactga

SEQ ID NO: 186745 - DNA, 25 bp, Mus musculus
agaagcttctggaggctctttcaca

SEQ ID NO: 186746 - DNA, 25 bp, Mus musculus
agaagcttgccagggcaagaaatac

SEQ ID NO: 186747 - DNA, 25 bp, Mus musculus
agaagcttgctcaggatggctgcag

SEQ ID NO: 186748 - DNA, 25 bp, Mus musculus
agaagcttgctcaggctcctcggat

SEQ ID NO: 186749 - DNA, 25 bp, Mus musculus
agaagctttcaccaaccaatcaaag

SEQ ID NO: 186750 - DNA, 25 bp, Mus musculus
agaagctttcaccaagtgtggattc

SEQ ID NO: 186751 - DNA, 25 bp, Mus musculus
agaaggaaaagaatctgcaggcaca

SEQ ID NO: 186752 - DNA, 25 bp, Mus musculus
agaaggaaaaggaaacacaacctat

SEQ ID NO: 186753 - DNA, 25 bp, Mus musculus
agaaggaaaaggtagagcagatcct

SEQ ID NO: 186754 - DNA, 25 bp, Mus musculus
agaaggaaacagttcagggcgacag

SEQ ID NO: 186755 - DNA, 25 bp, Mus musculus
agaaggaaagattgaagactgagaa

SEQ ID NO: 186756 - DNA, 25 bp, Mus musculus
agaaggaaagatttctaagctcctg

SEQ ID NO: 186757 - DNA, 25 bp, Mus musculus
agaaggaacaaggtctgcaaacagc

SEQ ID NO: 186758 - DNA, 25 bp, Mus musculus
agaaggaacatgtttccagagtgtg

SEQ ID NO: 186759 - DNA, 25 bp, Mus musculus
agaaggaacggaggaagatgacagc

SEQ ID NO: 186760 - DNA, 25 bp, Mus musculus
agaaggaagaactaggctcctacgc

SEQ ID NO: 186761 - DNA, 25 bp, Mus musculus
agaaggaagaactgactcagatttc

SEQ ID NO: 186762 - DNA, 25 bp, Mus musculus
agaaggaagaagaaaagacaccgaa

SEQ ID NO: 186763 - DNA, 25 bp, Mus musculus
agaaggaagaagaggaaaggatttt

SEQ ID NO: 186764 - DNA, 25 bp, Mus musculus
agaaggaagagggtaaactggtgca

SEQ ID NO: 186765 - DNA, 25 bp, Mus musculus
agaaggaagcaggaggtgactttgg

SEQ ID NO: 186766 - DNA, 25 bp, Mus musculus
agaaggaagtggaggcagagttcct

SEQ ID NO: 186767 - DNA, 25 bp, Mus musculus
agaaggaatccaacgatgcagatct

SEQ ID NO: 186768 - DNA, 25 bp, Mus musculus
agaaggaatcctgaggctccagcca

SEQ ID NO: 186769 - DNA, 25 bp, Mus musculus
agaaggaatgccaaccaggcagcgg

SEQ ID NO: 186770 - DNA, 25 bp, Mus musculus
agaaggaatgccccaaagcaaaatc

SEQ ID NO: 186771 - DNA, 25 bp, Mus musculus
agaaggaatgcggcctccttccctg

SEQ ID NO: 186772 - DNA, 25 bp, Mus musculus
agaaggaattacagccgaagaagca

SEQ ID NO: 186773 - DNA, 25 bp, Mus musculus
agaaggacaaaatggcagtggcagc

SEQ ID NO: 186774 - DNA, 25 bp, Mus musculus
agaaggacaaattggagcctgccgg

SEQ ID NO: 186775 - DNA, 25 bp, Mus musculus
agaaggacaagataaacttgatggg

SEQ ID NO: 186776 - DNA, 25 bp, Mus musculus
agaaggacaagatatatctcacaga

SEQ ID NO: 186777 - DNA, 25 bp, Mus musculus
agaaggacaagatgtatatcacttg

SEQ ID NO: 186778 - DNA, 25 bp, Mus musculus
agaaggacaaggttaactgctcttt

SEQ ID NO: 186779 - DNA, 25 bp, Mus musculus
agaaggacaatgaggatggcagtac

SEQ ID NO: 186780 - DNA, 25 bp, Mus musculus
agaaggacacgcatggggtgtgatt

SEQ ID NO: 186781 - DNA, 25 bp, Mus musculus
agaaggacagaaaaaaagcagagga

SEQ ID NO: 186782 - DNA, 25 bp, Mus musculus
agaaggacagctcctgaattcggac

SEQ ID NO: 186783 - DNA, 25 bp, Mus musculus
agaaggaccagctaaccctgagggt

SEQ ID NO: 186784 - DNA, 25 bp, Mus musculus
agaaggaccaggacaaaggccttca

SEQ ID NO: 186785 - DNA, 25 bp, Mus musculus
agaaggaccatgcaggttcgcaacg

SEQ ID NO: 186786 - DNA, 25 bp, Mus musculus
agaaggacccggagggttgctatcg

SEQ ID NO: 186787 - DNA, 25 bp, Mus musculus
agaaggacctaagctgcagaatcga

SEQ ID NO: 186788 - DNA, 25 bp, Mus musculus
agaaggactcagatacctgatggcg

SEQ ID NO: 186789 - DNA, 25 bp, Mus musculus
agaaggactcaggctcaaaatggaa

SEQ ID NO: 186790 - DNA, 25 bp, Mus musculus
agaaggactctgatggtgatggccg

SEQ ID NO: 186791 - DNA, 25 bp, Mus musculus
agaaggactgctaagtcttcagcaa

SEQ ID NO: 186792 - DNA, 25 bp, Mus musculus
agaaggactttatggtagcttttcc

SEQ ID NO: 186793 - DNA, 25 bp, Mus musculus
agaaggactttatggtctttagtag

SEQ ID NO: 186794 - DNA, 25 bp, Mus musculus
agaaggagaagaataccaggaaaaa

SEQ ID NO: 186795 - DNA, 25 bp, Mus musculus
agaaggagaaggaaagcggtacaac

SEQ ID NO: 186796 - DNA, 25 bp, Mus musculus
agaaggagaaggtctcaggagctat

SEQ ID NO: 186797 - DNA, 25 bp, Mus musculus
agaaggagacaatcccagacattga

SEQ ID NO: 186798 - DNA, 25 bp, Mus musculus
agaaggagacaggagtcatccaggg

SEQ ID NO: 186799 - DNA, 25 bp, Mus musculus
agaaggagaccagagcctcagctta

SEQ ID NO: 186800 - DNA, 25 bp, Mus musculus
agaaggagactggctgtgcttgcca

SEQ ID NO: 186801 - DNA, 25 bp, Mus musculus
agaaggagactggcttttcagtttc

SEQ ID NO: 186802 - DNA, 25 bp, Mus musculus
agaaggagactggcttttcccacag

SEQ ID NO: 186803 - DNA, 25 bp, Mus musculus
agaaggagagggaagtccagcggtg

SEQ ID NO: 186804 - DNA, 25 bp, Mus musculus
agaaggagatgaagaaatccatgcg

SEQ ID NO: 186805 - DNA, 25 bp, Mus musculus
agaaggagatgaagggttggtgaaa

SEQ ID NO: 186806 - DNA, 25 bp, Mus musculus
agaaggagatggaggcaaccaaact

SEQ ID NO: 186807 - DNA, 25 bp, Mus musculus
agaaggagcctaaggaaccacggga

SEQ ID NO: 186808 - DNA, 25 bp, Mus musculus
agaaggagctaattcgatgactgca

SEQ ID NO: 186809 - DNA, 25 bp, Mus musculus
agaaggagctaggatgaacagcaac

SEQ ID NO: 186810 - DNA, 25 bp, Mus musculus
agaaggagctagtgacattcatttt

SEQ ID NO: 186811 - DNA, 25 bp, Mus musculus
agaaggagctgatcgaagcgttgca

SEQ ID NO: 186812 - DNA, 25 bp, Mus musculus
agaaggagctgccaaggcggcaact

SEQ ID NO: 186813 - DNA, 25 bp, Mus musculus
agaaggaggaagaggaggacgagaa

SEQ ID NO: 186814 - DNA, 25 bp, Mus musculus
agaaggaggacagcagtaccagcgc

SEQ ID NO: 186815 - DNA, 25 bp, Mus musculus
agaaggaggacattttccgtagatt

SEQ ID NO: 186816 - DNA, 25 bp, Mus musculus
agaaggaggacgaggatataaatgc

SEQ ID NO: 186817 - DNA, 25 bp, Mus musculus
agaaggaggaggcagagcgcccgct

SEQ ID NO: 186818 - DNA, 25 bp, Mus musculus
agaaggaggaggccgaagaagcact

SEQ ID NO: 186819 - DNA, 25 bp, Mus musculus
agaaggaggattattaattggaggc

SEQ ID NO: 186820 - DNA, 25 bp, Mus musculus
agaaggaggattctgataatcagcc

SEQ ID NO: 186821 - DNA, 25 bp, Mus musculus
agaaggaggccaagcctttcatcac

SEQ ID NO: 186822 - DNA, 25 bp, Mus musculus
agaaggagggggagctcaactaagc

SEQ ID NO: 186823 - DNA, 25 bp, Mus musculus
agaaggaggggtgaggctgctggcc

SEQ ID NO: 186824 - DNA, 25 bp, Mus musculus
agaaggaggggttccccatcacagc

SEQ ID NO: 186825 - DNA, 25 bp, Mus musculus
agaaggaggtgaagcccaggaccca

SEQ ID NO: 186826 - DNA, 25 bp, Mus musculus
agaaggaggtgaagtatttaggtca

SEQ ID NO: 186827 - DNA, 25 bp, Mus musculus
agaaggaggtggaactgacagagat

SEQ ID NO: 186828 - DNA, 25 bp, Mus musculus
agaaggagtgccaaggccggcagag

SEQ ID NO: 186829 - DNA, 25 bp, Mus musculus
agaaggataccctgctgggggctct

SEQ ID NO: 186830 - DNA, 25 bp, Mus musculus
agaaggatacgagcaatcatttcca

SEQ ID NO: 186831 - DNA, 25 bp, Mus musculus
agaaggatacgagcagtagtaccgt

SEQ ID NO: 186832 - DNA, 25 bp, Mus musculus
agaaggatcagctgaagaataaatt

SEQ ID NO: 186833 - DNA, 25 bp, Mus musculus
agaaggatgagctgggttcaggagg

SEQ ID NO: 186834 - DNA, 25 bp, Mus musculus
agaaggatgcccactgagcaggacg

SEQ ID NO: 186835 - DNA, 25 bp, Mus musculus
agaaggcaaaaaaagtggacgctca

SEQ ID NO: 186836 - DNA, 25 bp, Mus musculus
agaaggcaaagagagacacaccctg

SEQ ID NO: 186837 - DNA, 25 bp, Mus musculus
agaaggcaaatagcacccaggagcc

SEQ ID NO: 186838 - DNA, 25 bp, Mus musculus
agaaggcaaatgctatgctggatga

SEQ ID NO: 186839 - DNA, 25 bp, Mus musculus
agaaggcaacacagtgctgctctta

SEQ ID NO: 186840 - DNA, 25 bp, Mus musculus
agaaggcaaccaagcattatgagat

SEQ ID NO: 186841 - DNA, 25 bp, Mus musculus
agaaggcaagattactgtgtagcct

SEQ ID NO: 186842 - DNA, 25 bp, Mus musculus
agaaggcaaggaggtggatacgacg

SEQ ID NO: 186843 - DNA, 25 bp, Mus musculus
agaaggcaaggttcggctcctggct

SEQ ID NO: 186844 - DNA, 25 bp, Mus musculus
agaaggcaatgaaggaaaccaaagg

SEQ ID NO: 186845 - DNA, 25 bp, Mus musculus
agaaggcaatggaatgatctcatta

SEQ ID NO: 186846 - DNA, 25 bp, Mus musculus
agaaggcacagatggacagatggat

SEQ ID NO: 186847 - DNA, 25 bp, Mus musculus
agaaggcacaggaagcatttcttaa

SEQ ID NO: 186848 - DNA, 25 bp, Mus musculus
agaaggcacaggtgaaggagacaaa

SEQ ID NO: 186849 - DNA, 25 bp, Mus musculus
agaaggcacctgactttgtgttcta

SEQ ID NO: 186850 - DNA, 25 bp, Mus musculus
agaaggcaccttgggtcctgggcct

SEQ ID NO: 186851 - DNA, 25 bp, Mus musculus
agaaggcagagaactgtgccaagtg

SEQ ID NO: 186852 - DNA, 25 bp, Mus musculus
agaaggcagaggtatgatgatgttc

SEQ ID NO: 186853 - DNA, 25 bp, Mus musculus
agaaggcagaggtggcacggcgaca

SEQ ID NO: 186854 - DNA, 25 bp, Mus musculus
agaaggcagccgacgctgaagctga

SEQ ID NO: 186855 - DNA, 25 bp, Mus musculus
agaaggccaacccagatggcaagaa

SEQ ID NO: 186856 - DNA, 25 bp, Mus musculus
agaaggccaccgacgcattccacaa

SEQ ID NO: 186857 - DNA, 25 bp, Mus musculus
agaaggccagacccccatcccggct

SEQ ID NO: 186858 - DNA, 25 bp, Mus musculus
agaaggccagggtagacagcaagag

SEQ ID NO: 186859 - DNA, 25 bp, Mus musculus
agaaggcccagctctgataagatac

SEQ ID NO: 186860 - DNA, 25 bp, Mus musculus
agaaggcccaggtcgtggacttcct

SEQ ID NO: 186861 - DNA, 25 bp, Mus musculus
agaaggcccaggtggctttcatgac

SEQ ID NO: 186862 - DNA, 25 bp, Mus musculus
agaaggccgtcagaactcggtatat

SEQ ID NO: 186863 - DNA, 25 bp, Mus musculus
agaaggccgtcagatgggtttcaag

SEQ ID NO: 186864 - DNA, 25 bp, Mus musculus
agaaggccgtcagtgcctgatgcca

SEQ ID NO: 186865 - DNA, 25 bp, Mus musculus
agaaggcctggcagtgtgtctccag

SEQ ID NO: 186866 - DNA, 25 bp, Mus musculus
agaaggcgaggaagaaaaaagtcat

SEQ ID NO: 186867 - DNA, 25 bp, Mus musculus
agaaggcgaggaaggcattgggaga

SEQ ID NO: 186868 - DNA, 25 bp, Mus musculus
agaaggcgtctcgagcctatcctct

SEQ ID NO: 186869 - DNA, 25 bp, Mus musculus
agaaggcgtctcgaggaacgcctcg

SEQ ID NO: 186870 - DNA, 25 bp, Mus musculus
agaaggctacaatccctctacttcg

SEQ ID NO: 186871 - DNA, 25 bp, Mus musculus
agaaggctcagtgccatggagaagg

SEQ ID NO: 186872 - DNA, 25 bp, Mus musculus
agaaggctcagtgctgtatgccatg

SEQ ID NO: 186873 - DNA, 25 bp, Mus musculus
agaaggctcggggaacctccgcttc

SEQ ID NO: 186874 - DNA, 25 bp, Mus musculus
agaaggctgaaggcttaactccggc

SEQ ID NO: 186875 - DNA, 25 bp, Mus musculus
agaagggaaaggggaatgatgaaag

SEQ ID NO: 186876 - DNA, 25 bp, Mus musculus
agaagggaagaataggtatcgtgtc

SEQ ID NO: 186877 - DNA, 25 bp, Mus musculus
agaagggaaggtgggctacgaacta

SEQ ID NO: 186878 - DNA, 25 bp, Mus musculus
agaagggacaactgcttcggcccac

SEQ ID NO: 186879 - DNA, 25 bp, Mus musculus
agaagggacaggtgccattgacatt

SEQ ID NO: 186880 - DNA, 25 bp, Mus musculus
agaagggacaggtgtatcatcccta

SEQ ID NO: 186881 - DNA, 25 bp, Mus musculus
agaagggactacatattctgtcccc

SEQ ID NO: 186882 - DNA, 25 bp, Mus musculus
agaagggactacatgacattaagaa

SEQ ID NO: 186883 - DNA, 25 bp, Mus musculus
agaagggactggacccatacaatat

SEQ ID NO: 186884 - DNA, 25 bp, Mus musculus
agaagggactgtcaactcttgtctc

SEQ ID NO: 186885 - DNA, 25 bp, Mus musculus
agaagggagagacgggtatcccagg

SEQ ID NO: 186886 - DNA, 25 bp, Mus musculus
agaagggagtaaaggaaacagacag

SEQ ID NO: 186887 - DNA, 25 bp, Mus musculus
agaagggagtaaaggcagtctaaag

SEQ ID NO: 186888 - DNA, 25 bp, Mus musculus
agaagggcaaagacgatgcggtccc

SEQ ID NO: 186889 - DNA, 25 bp, Mus musculus
agaagggcaaagatgagtggttctc

SEQ ID NO: 186890 - DNA, 25 bp, Mus musculus
agaagggcaaaggctggagcaaaac

SEQ ID NO: 186891 - DNA, 25 bp, Mus musculus
agaagggcaagaagcctggaattgt

SEQ ID NO: 186892 - DNA, 25 bp, Mus musculus
agaagggcaagaagtatttaggtca

SEQ ID NO: 186893 - DNA, 25 bp, Mus musculus
agaagggcaagacgggcgcagttct

SEQ ID NO: 186894 - DNA, 25 bp, Mus musculus
agaagggcagcgccctcggagccct

SEQ ID NO: 186895 - DNA, 25 bp, Mus musculus
agaagggcagcgtggccaagcggcg

SEQ ID NO: 186896 - DNA, 25 bp, Mus musculus
agaagggcagtgttgctgaagcaga

SEQ ID NO: 186897 - DNA, 25 bp, Mus musculus
agaagggctgccaggagatggacat

SEQ ID NO: 186898 - DNA, 25 bp, Mus musculus
agaagggctgccaggttgaattctc

SEQ ID NO: 186899 - DNA, 25 bp, Mus musculus
agaagggctgccgacatgtggacga

SEQ ID NO: 186900 - DNA, 25 bp, Mus musculus
agaagggctgccgagatgtggacga

SEQ ID NO: 186901 - DNA, 25 bp, Mus musculus
agaaggggagcagaaaatgttttca

SEQ ID NO: 186902 - DNA, 25 bp, Mus musculus
agaaggggatcggtatcatgccaaa

SEQ ID NO: 186903 - DNA, 25 bp, Mus musculus
agaaggggctggactgtaacagaag

SEQ ID NO: 186904 - DNA, 25 bp, Mus musculus
agaaggggctggggaacagaaggcg

SEQ ID NO: 186905 - DNA, 25 bp, Mus musculus
agaagggggcaagggtggaccactt

SEQ ID NO: 186906 - DNA, 25 bp, Mus musculus
agaaggggttccgggtggacaagat

SEQ ID NO: 186907 - DNA, 25 bp, Mus musculus
agaagggtgaaaagggtgacatagg

SEQ ID NO: 186908 - DNA, 25 bp, Mus musculus
agaagggtgaacaaggtgttccagg

SEQ ID NO: 186909 - DNA, 25 bp, Mus musculus
agaagggtgagcaattgtgttcgga

SEQ ID NO: 186910 - DNA, 25 bp, Mus musculus
agaagggtggcagggggacacctgg

SEQ ID NO: 186911 - DNA, 25 bp, Mus musculus
agaagggttaggatgatgctgttga

SEQ ID NO: 186912 - DNA, 25 bp, Mus musculus
agaaggtcacccaggtcctgtcctt

SEQ ID NO: 186913 - DNA, 25 bp, Mus musculus
agaaggtgaaagacactcgtaatcg

SEQ ID NO: 186914 - DNA, 25 bp, Mus musculus
agaaggtgaaagtctcacacaggtc

SEQ ID NO: 186915 - DNA, 25 bp, Mus musculus
agaaggtgtctggccctctccaggc

SEQ ID NO: 186916 - DNA, 25 bp, Mus musculus
agaaggttctgatatgtcacatgct

SEQ ID NO: 186917 - DNA, 25 bp, Mus musculus
agaaggttttagggcaagtctgatg

SEQ ID NO: 186918 - DNA, 25 bp, Mus musculus
agaagtaaagcaagagcaccagaag

SEQ ID NO: 186919 - DNA, 25 bp, Mus musculus
agaagtaaagcaaggctgtggctct

SEQ ID NO: 186920 - DNA, 25 bp, Mus musculus
agaagtaaatgacattaaagattca

SEQ ID NO: 186921 - DNA, 25 bp, Mus musculus
agaagtaaatgactttaagaagctt

SEQ ID NO: 186922 - DNA, 25 bp, Mus musculus
agaagtaaatgcttgacaaaaaagg

SEQ ID NO: 186923 - DNA, 25 bp, Mus musculus
agaagtaacttcaaggttatccagg

SEQ ID NO: 186924 - DNA, 25 bp, Mus musculus
agaagtaagcggactggaaacagca

SEQ ID NO: 186925 - DNA, 25 bp, Mus musculus
agaagtaatgggggcctgcatcctt

SEQ ID NO: 186926 - DNA, 25 bp, Mus musculus
agaagtacaaagatgaacgagaccg

SEQ ID NO: 186927 - DNA, 25 bp, Mus musculus
agaagtacggcgtggccttttacaa

SEQ ID NO: 186928 - DNA, 25 bp, Mus musculus
agaagtacgtgggacctcttaaagt

SEQ ID NO: 186929 - DNA, 25 bp, Mus musculus
agaagtacttcttgcacgatgacag

SEQ ID NO: 186930 - DNA, 25 bp, Mus musculus
agaagtagaaagatctaaaggggtg

SEQ ID NO: 186931 - DNA, 25 bp, Mus musculus
agaagtatccatcatcagaagtact

SEQ ID NO: 186932 - DNA, 25 bp, Mus musculus
agaagtatccatcttctgtatctca

SEQ ID NO: 186933 - DNA, 25 bp, Mus musculus
agaagtatcggaagcttgtgtcggc

SEQ ID NO: 186934 - DNA, 25 bp, Mus musculus
agaagtatcttgatcccacctaaac

SEQ ID NO: 186935 - DNA, 25 bp, Mus musculus
agaagtatgaacaggcctgtcgtga

SEQ ID NO: 186936 - DNA, 25 bp, Mus musculus
agaagtatgagaaggatgttgctga

SEQ ID NO: 186937 - DNA, 25 bp, Mus musculus
agaagtatgtggaggaacatgtgta

SEQ ID NO: 186938 - DNA, 25 bp, Mus musculus
agaagtatgtggaggccatgggaag

SEQ ID NO: 186939 - DNA, 25 bp, Mus musculus
agaagtatttatcagataaccacat

SEQ ID NO: 186940 - DNA, 25 bp, Mus musculus
agaagtcaagccaggtgcccaggac

SEQ ID NO: 186941 - DNA, 25 bp, Mus musculus
agaagtcaagggaaaagtatgtcct

SEQ ID NO: 186942 - DNA, 25 bp, Mus musculus
agaagtcacctttcgggcaggtgat

SEQ ID NO: 186943 - DNA, 25 bp, Mus musculus
agaagtcacctttcgggtcatctag

SEQ ID NO: 186944 - DNA, 25 bp, Mus musculus
agaagtcagaagatgattcagctaa

SEQ ID NO: 186945 - DNA, 25 bp, Mus musculus
agaagtcagagcagcagcaagtcct

SEQ ID NO: 186946 - DNA, 25 bp, Mus musculus
agaagtcagaggccttgctcctaaa

SEQ ID NO: 186947 - DNA, 25 bp, Mus musculus
agaagtcagagtgaaagtagaacct

SEQ ID NO: 186948 - DNA, 25 bp, Mus musculus
agaagtcagccaagaaggtgaagga

SEQ ID NO: 186949 - DNA, 25 bp, Mus musculus
agaagtcagcctggaaactgcccgt

SEQ ID NO: 186950 - DNA, 25 bp, Mus musculus
agaagtcagcctggcgcaagatgca

SEQ ID NO: 186951 - DNA, 25 bp, Mus musculus
agaagtcatactggtgaacggcctt

SEQ ID NO: 186952 - DNA, 25 bp, Mus musculus
agaagtcatccttggcatggatgat

SEQ ID NO: 186953 - DNA, 25 bp, Mus musculus
agaagtccaggaagatgggctcctg

SEQ ID NO: 186954 - DNA, 25 bp, Mus musculus
agaagtcccaggactctcggctctc

SEQ ID NO: 186955 - DNA, 25 bp, Mus musculus
agaagtcccaggttgttcagatgtc

SEQ ID NO: 186956 - DNA, 25 bp, Mus musculus
agaagtccctaaatcaaaaagttgc

SEQ ID NO: 186957 - DNA, 25 bp, Mus musculus
agaagtccctactccggaccaaaat

SEQ ID NO: 186958 - DNA, 25 bp, Mus musculus
agaagtcctatataggtgacagtgg

SEQ ID NO: 186959 - DNA, 25 bp, Mus musculus
agaagtcctcagggctgaactgaaa

SEQ ID NO: 186960 - DNA, 25 bp, Mus musculus
agaagtcctgagtttatccatgctg

SEQ ID NO: 186961 - DNA, 25 bp, Mus musculus
agaagtcctggtctttgcctgccta

SEQ ID NO: 186962 - DNA, 25 bp, Mus musculus
agaagtcctgtggaagtgtttgtcc

SEQ ID NO: 186963 - DNA, 25 bp, Mus musculus
agaagtcggaaagtgtggagcaaaa

SEQ ID NO: 186964 - DNA, 25 bp, Mus musculus
agaagtcggaattcctaccctcaga

SEQ ID NO: 186965 - DNA, 25 bp, Mus musculus
agaagtcggccaaaactgttatggt

SEQ ID NO: 186966 - DNA, 25 bp, Mus musculus
agaagtctagaaattctgtgcaagc

SEQ ID NO: 186967 - DNA, 25 bp, Mus musculus
agaagtctagggcacttgatgcact

SEQ ID NO: 186968 - DNA, 25 bp, Mus musculus
agaagtctgagaactcagatgattg

SEQ ID NO: 186969 - DNA, 25 bp, Mus musculus
agaagtctgagatgattgggagaaa

SEQ ID NO: 186970 - DNA, 25 bp, Mus musculus
agaagtctgagggagccagaatcac

SEQ ID NO: 186971 - DNA, 25 bp, Mus musculus
agaagtctgcagagataaagccact

SEQ ID NO: 186972 - DNA, 25 bp, Mus musculus
agaagtctggagaaatctgggctcg

SEQ ID NO: 186973 - DNA, 25 bp, Mus musculus
agaagtctggcaaaatgaacactac

SEQ ID NO: 186974 - DNA, 25 bp, Mus musculus
agaagtcttaagcgtgtagtggaga

SEQ ID NO: 186975 - DNA, 25 bp, Mus musculus
agaagtcttaagggtgtagtggaga

SEQ ID NO: 186976 - DNA, 25 bp, Mus musculus
agaagtgaacaaagtctggtttttg

SEQ ID NO: 186977 - DNA, 25 bp, Mus musculus
agaagtgacgtgaaagccagagacg

SEQ ID NO: 186978 - DNA, 25 bp, Mus musculus
agaagtgagtcaggtgttaaatgaa

SEQ ID NO: 186979 - DNA, 25 bp, Mus musculus
agaagtgatcaagattagacgtggt

SEQ ID NO: 186980 - DNA, 25 bp, Mus musculus
agaagtgatcaagattcaaaataaa

SEQ ID NO: 186981 - DNA, 25 bp, Mus musculus
agaagtgcacgtaagttcatatagc

SEQ ID NO: 186982 - DNA, 25 bp, Mus musculus
agaagtgcagcagccccaccagtgg

SEQ ID NO: 186983 - DNA, 25 bp, Mus musculus
agaagtgcagcagggcaagcttcta

SEQ ID NO: 186984 - DNA, 25 bp, Mus musculus
agaagtgcaggtattggttttcgct

SEQ ID NO: 186985 - DNA, 25 bp, Mus musculus
agaagtgcatctggcctcgaactca

SEQ ID NO: 186986 - DNA, 25 bp, Mus musculus
agaagtgcattgagaaagaagtcaa

SEQ ID NO: 186987 - DNA, 25 bp, Mus musculus
agaagtgcattgagagctgtctgtc

SEQ ID NO: 186988 - DNA, 25 bp, Mus musculus
agaagtgccaggaatccgaatcttg

SEQ ID NO: 186989 - DNA, 25 bp, Mus musculus
agaagtgccaggagaaatctgagct

SEQ ID NO: 186990 - DNA, 25 bp, Mus musculus
agaagtgcctcccacgtcagaaccg

SEQ ID NO: 186991 - DNA, 25 bp, Mus musculus
agaagtgcctgacagaggagggcgc

SEQ ID NO: 186992 - DNA, 25 bp, Mus musculus
agaagtgcctgctcttgctcccagc

SEQ ID NO: 186993 - DNA, 25 bp, Mus musculus
agaagtggaagagacaatgaatatg

SEQ ID NO: 186994 - DNA, 25 bp, Mus musculus
agaagtggacttgatccctgctgtc

SEQ ID NO: 186995 - DNA, 25 bp, Mus musculus
agaagtggaggcaggactctgactc

SEQ ID NO: 186996 - DNA, 25 bp, Mus musculus
agaagtgggacaggagaacgagaag

SEQ ID NO: 186997 - DNA, 25 bp, Mus musculus
agaagtgggcacaagacagacaagg

SEQ ID NO: 186998 - DNA, 25 bp, Mus musculus
agaagtgggcacaagagtcagctct

SEQ ID NO: 186999 - DNA, 25 bp, Mus musculus
agaagtgtggtgctgataatactag

SEQ ID NO: 187000 - DNA, 25 bp, Mus musculus
agaagtgtggtggattgaaccagct

SEQ ID NO: 187001 - DNA, 25 bp, Mus musculus
agaagttaaggaaacatattcaaga

SEQ ID NO: 187002 - DNA, 25 bp, Mus musculus
agaagttacagtttgccccggctga

SEQ ID NO: 187003 - DNA, 25 bp, Mus musculus
agaagttagatctagtgagcagcac

SEQ ID NO: 187004 - DNA, 25 bp, Mus musculus
agaagttagatctagtttttagaga

SEQ ID NO: 187005 - DNA, 25 bp, Mus musculus
agaagttatgctgcaggcacacgga

SEQ ID NO: 187006 - DNA, 25 bp, Mus musculus
agaagttcaagattgatgaccagcg

SEQ ID NO: 187007 - DNA, 25 bp, Mus musculus
agaagttcaccacagtgactccata

SEQ ID NO: 187008 - DNA, 25 bp, Mus musculus
agaagttcaggaagctgatttcaca

SEQ ID NO: 187009 - DNA, 25 bp, Mus musculus
agaagttcaggaaggtgcagacaca

SEQ ID NO: 187010 - DNA, 25 bp, Mus musculus
agaagttccaacctagatacttgtt

SEQ ID NO: 187011 - DNA, 25 bp, Mus musculus
agaagttccaagaccccagatggac

SEQ ID NO: 187012 - DNA, 25 bp, Mus musculus
agaagttcctgggtttgatgaagat

SEQ ID NO: 187013 - DNA, 25 bp, Mus musculus
agaagttcgggcaggtgcagtaagt

SEQ ID NO: 187014 - DNA, 25 bp, Mus musculus
agaagttgaagaagagcctggaagt

SEQ ID NO: 187015 - DNA, 25 bp, Mus musculus
agaagttgaagaagtgggaatccgg

SEQ ID NO: 187016 - DNA, 25 bp, Mus musculus
agaagttgatgcaaggctttccttt

SEQ ID NO: 187017 - DNA, 25 bp, Mus musculus
agaagttgatgcaagggagctggag

SEQ ID NO: 187018 - DNA, 25 bp, Mus musculus
agaagttgcagcggcaatatggttt

SEQ ID NO: 187019 - DNA, 25 bp, Mus musculus
agaagttgcaggaattattgaagcc

SEQ ID NO: 187020 - DNA, 25 bp, Mus musculus
agaagttgctcaagatgctgagtct

SEQ ID NO: 187021 - DNA, 25 bp, Mus musculus
agaagttgctgtgaaaccgggctcc

SEQ ID NO: 187022 - DNA, 25 bp, Mus musculus
agaagttggcatgaaagctgcactg

SEQ ID NO: 187023 - DNA, 25 bp, Mus musculus
agaagttggcttggcttgagatttt

SEQ ID NO: 187024 - DNA, 25 bp, Mus musculus
agaagttgtcctagaatcgaatcaa

SEQ ID NO: 187025 - DNA, 25 bp, Mus musculus
agaagtttgaccctgaggctttaat

SEQ ID NO: 187026 - DNA, 25 bp, Mus musculus
agaagtttgatgaattcttcaaaga

SEQ ID NO: 187027 - DNA, 25 bp, Mus musculus
agaagtttgatgtattcttcaaaga

SEQ ID NO: 187028 - DNA, 25 bp, Mus musculus
agaagtttgcagctaggagccctgg

SEQ ID NO: 187029 - DNA, 25 bp, Mus musculus
agaagtttgcagtgtgtgacatccc

SEQ ID NO: 187030 - DNA, 25 bp, Mus musculus
agaagtttggaaacgccattatttg

SEQ ID NO: 187031 - DNA, 25 bp, Mus musculus
agaagtttggaaacggattctgctc

SEQ ID NO: 187032 - DNA, 25 bp, Mus musculus
agaagtttggcaaggaagcagaaca

SEQ ID NO: 187033 - DNA, 25 bp, Mus musculus
agaagttttcagagattgctggcct

SEQ ID NO: 187034 - DNA, 25 bp, Mus musculus
agaataaaacagaaacatggagctc

SEQ ID NO: 187035 - DNA, 25 bp, Mus musculus
agaataaaagatgcctcaggaacag

SEQ ID NO: 187036 - DNA, 25 bp, Mus musculus
agaataaaaggtgccacaggcacca

SEQ ID NO: 187037 - DNA, 25 bp, Mus musculus
agaataaaccagaactgagcagtgt

SEQ ID NO: 187038 - DNA, 25 bp, Mus musculus
agaataaataccggttcttcctcgg

SEQ ID NO: 187039 - DNA, 25 bp, Mus musculus
agaataaataccggtttggagattc

SEQ ID NO: 187040 - DNA, 25 bp, Mus musculus
agaataaccaggtgaggaaaaccag

SEQ ID NO: 187041 - DNA, 25 bp, Mus musculus
agaataacctggcttcctgctacct

SEQ ID NO: 187042 - DNA, 25 bp, Mus musculus
agaataagacaagagtttgggaaat

SEQ ID NO: 187043 - DNA, 25 bp, Mus musculus
agaataagagatgacagctgaggac

SEQ ID NO: 187044 - DNA, 25 bp, Mus musculus
agaataagagatgacgtcaggggag

SEQ ID NO: 187045 - DNA, 25 bp, Mus musculus
agaataaggaagcggggagtgaggc

SEQ ID NO: 187046 - DNA, 25 bp, Mus musculus
agaataaggtggttcctttggggag

SEQ ID NO: 187047 - DNA, 25 bp, Mus musculus
agaataataaggagaatctgtacta

SEQ ID NO: 187048 - DNA, 25 bp, Mus musculus
agaataatagcagtggcagcaatgt

SEQ ID NO: 187049 - DNA, 25 bp, Mus musculus
agaataatatttctaatgcggcatt

SEQ ID NO: 187050 - DNA, 25 bp, Mus musculus
agaataatcaggttttaaaatcagt

SEQ ID NO: 187051 - DNA, 25 bp, Mus musculus
agaataattgcctgtcacctactca

SEQ ID NO: 187052 - DNA, 25 bp, Mus musculus
agaatacaagaagagggcagcagca

SEQ ID NO: 187053 - DNA, 25 bp, Mus musculus
agaatacaagatcaaatgcctgtgt

SEQ ID NO: 187054 - DNA, 25 bp, Mus musculus
agaatacagggattacagcaatgac

SEQ ID NO: 187055 - DNA, 25 bp, Mus musculus
agaatacagggtctgttcactagag

SEQ ID NO: 187056 - DNA, 25 bp, Mus musculus
agaatacatggcaaaagaaaaacag

SEQ ID NO: 187057 - DNA, 25 bp, Mus musculus
agaatacatgtcaagatgtgaatga

SEQ ID NO: 187058 - DNA, 25 bp, Mus musculus
agaatacatgtcaagatgtggatga

SEQ ID NO: 187059 - DNA, 25 bp, Mus musculus
agaatacatgtcaagcatcagtgaa

SEQ ID NO: 187060 - DNA, 25 bp, Mus musculus
agaataccaaccacagccacagtga

SEQ ID NO: 187061 - DNA, 25 bp, Mus musculus
agaataccattgagtcagacgttcc

SEQ ID NO: 187062 - DNA, 25 bp, Mus musculus
agaataccgcaagggcctgctgaaa

SEQ ID NO: 187063 - DNA, 25 bp, Mus musculus
agaatacctcaggtgcctgaaaaag

SEQ ID NO: 187064 - DNA, 25 bp, Mus musculus
agaatacgcgggtcagataacacta

SEQ ID NO: 187065 - DNA, 25 bp, Mus musculus
agaatacgtgtcgtcagcagccttt

SEQ ID NO: 187066 - DNA, 25 bp, Mus musculus
agaatactataaggcaagaagtgtg

SEQ ID NO: 187067 - DNA, 25 bp, Mus musculus
agaatactatatgtggagacggtca

SEQ ID NO: 187068 - DNA, 25 bp, Mus musculus
agaatactattgagtcagacgttcc

SEQ ID NO: 187069 - DNA, 25 bp, Mus musculus
agaatactgatactggtgaagaaaa

SEQ ID NO: 187070 - DNA, 25 bp, Mus musculus
agaatagaaggccgttgactacttt

SEQ ID NO: 187071 - DNA, 25 bp, Mus musculus
agaatagacaaggctttgatgaggc

SEQ ID NO: 187072 - DNA, 25 bp, Mus musculus
agaatagctaagagctttgaccctg

SEQ ID NO: 187073 - DNA, 25 bp, Mus musculus
agaataggaggcggtaaccatagag

SEQ ID NO: 187074 - DNA, 25 bp, Mus musculus
agaatagggcacaggtatattgaaa

SEQ ID NO: 187075 - DNA, 25 bp, Mus musculus
agaatagtcagacttctgccagagc

SEQ ID NO: 187076 - DNA, 25 bp, Mus musculus
agaatagttctgcagagttctacag

SEQ ID NO: 187077 - DNA, 25 bp, Mus musculus
agaatagttctgcaggacaatgcct

SEQ ID NO: 187078 - DNA, 25 bp, Mus musculus
agaatagttgatctttataagctat

SEQ ID NO: 187079 - DNA, 25 bp, Mus musculus
agaatagttggtcaaaagaagccgg

SEQ ID NO: 187080 - DNA, 25 bp, Mus musculus
agaatataacatctttaactacaag

SEQ ID NO: 187081 - DNA, 25 bp, Mus musculus
agaatatattaaccgggaatcacct

SEQ ID NO: 187082 - DNA, 25 bp, Mus musculus
agaatatcaccggattcatggttgg

SEQ ID NO: 187083 - DNA, 25 bp, Mus musculus
agaatatcagatacacaaaattgtc

SEQ ID NO: 187084 - DNA, 25 bp, Mus musculus
agaatatcagctgcaagaaaaatga

SEQ ID NO: 187085 - DNA, 25 bp, Mus musculus
agaatatcagttacacaaaattgtc

SEQ ID NO: 187086 - DNA, 25 bp, Mus musculus
agaatatcgaacaaaagacgaggcg

SEQ ID NO: 187087 - DNA, 25 bp, Mus musculus
agaatatcgaacctcacatgagccc

SEQ ID NO: 187088 - DNA, 25 bp, Mus musculus
agaatatgaagagcgggcagctaaa

SEQ ID NO: 187089 - DNA, 25 bp, Mus musculus
agaatatgaagctttggttccagtg

SEQ ID NO: 187090 - DNA, 25 bp, Mus musculus
agaatatgaaggcatgatgggtggc

SEQ ID NO: 187091 - DNA, 25 bp, Mus musculus
agaatatgaaggtgtgatgaatcaa

SEQ ID NO: 187092 - DNA, 25 bp, Mus musculus
agaatatgatggaccccagagagat

SEQ ID NO: 187093 - DNA, 25 bp, Mus musculus
agaatattcacagattatttatagc

SEQ ID NO: 187094 - DNA, 25 bp, Mus musculus
agaatattctaagatgctcctgcca

SEQ ID NO: 187095 - DNA, 25 bp, Mus musculus
agaatattgagacggccagagcaga

SEQ ID NO: 187096 - DNA, 25 bp, Mus musculus
agaatattgagcagattctcgacta

SEQ ID NO: 187097 - DNA, 25 bp, Mus musculus
agaatattgccaggagttggcatcc

SEQ ID NO: 187098 - DNA, 25 bp, Mus musculus
agaatatttaaaaacatatgacatc

SEQ ID NO: 187099 - DNA, 25 bp, Mus musculus
agaatatttaatacgaacagaacac

SEQ ID NO: 187100 - DNA, 25 bp, Mus musculus
agaatcaaaaggtggcagatgaggc

SEQ ID NO: 187101 - DNA, 25 bp, Mus musculus
agaatcaaacatttttaagacaatt

SEQ ID NO: 187102 - DNA, 25 bp, Mus musculus
agaatcaaaccacagctgcactggc

SEQ ID NO: 187103 - DNA, 25 bp, Mus musculus
agaatcaaaccacagtgagaagtct

SEQ ID NO: 187104 - DNA, 25 bp, Mus musculus
agaatcaaggtctggatattgaagt

SEQ ID NO: 187105 - DNA, 25 bp, Mus musculus
agaatcaaggtctggtgagaagctg

SEQ ID NO: 187106 - DNA, 25 bp, Mus musculus
agaatcacagacgcagtatgagatg

SEQ ID NO: 187107 - DNA, 25 bp, Mus musculus
agaatcacagatggaacaatgttgc

SEQ ID NO: 187108 - DNA, 25 bp, Mus musculus
agaatcacagctcgccaaatccata

SEQ ID NO: 187109 - DNA, 25 bp, Mus musculus
agaatcacagggctggaccctgcgg

SEQ ID NO: 187110 - DNA, 25 bp, Mus musculus
agaatcaccctcaggaggagaatga

SEQ ID NO: 187111 - DNA, 25 bp, Mus musculus
agaatcaccctcagtttgtgcttgt

SEQ ID NO: 187112 - DNA, 25 bp, Mus musculus
agaatcagacaggaatctgcttgaa

SEQ ID NO: 187113 - DNA, 25 bp, Mus musculus
agaatcagacaggtgatttgaactg

SEQ ID NO: 187114 - DNA, 25 bp, Mus musculus
agaatcagagacaccagagaagaaa

SEQ ID NO: 187115 - DNA, 25 bp, Mus musculus
agaatcagagagacaactggcaggc

SEQ ID NO: 187116 - DNA, 25 bp, Mus musculus
agaatcagagtggtgtctcctttga

SEQ ID NO: 187117 - DNA, 25 bp, Mus musculus
agaatcagcaagactacagatgctg

SEQ ID NO: 187118 - DNA, 25 bp, Mus musculus
agaatcagcaagtctacagatgctg

SEQ ID NO: 187119 - DNA, 25 bp, Mus musculus
agaatcagcaggtctgatcttgctc

SEQ ID NO: 187120 - DNA, 25 bp, Mus musculus
agaatcatagggagaggcggtgaga

SEQ ID NO: 187121 - DNA, 25 bp, Mus musculus
agaatcatcgagaaacctgaaaaat

SEQ ID NO: 187122 - DNA, 25 bp, Mus musculus
agaatcattcaggtctgtctatccc

SEQ ID NO: 187123 - DNA, 25 bp, Mus musculus
agaatcattcagtcttccgtgtctc

SEQ ID NO: 187124 - DNA, 25 bp, Mus musculus
agaatccaaacacagatccgagtgg

SEQ ID NO: 187125 - DNA, 25 bp, Mus musculus
agaatccaaacacagatggatgtag

SEQ ID NO: 187126 - DNA, 25 bp, Mus musculus
agaatccaccacagataactctctt

SEQ ID NO: 187127 - DNA, 25 bp, Mus musculus
agaatccaccacaggaggaaaaaga

SEQ ID NO: 187128 - DNA, 25 bp, Mus musculus
agaatccagaaaatgtaaagcaatt

SEQ ID NO: 187129 - DNA, 25 bp, Mus musculus
agaatccagctcagttctgcgctcg

SEQ ID NO: 187130 - DNA, 25 bp, Mus musculus
agaatccatttgatgaagctcaaca

SEQ ID NO: 187131 - DNA, 25 bp, Mus musculus
agaatcccaaaagatctagatccag

SEQ ID NO: 187132 - DNA, 25 bp, Mus musculus
agaatcccagtctcctcactacttg

SEQ ID NO: 187133 - DNA, 25 bp, Mus musculus
agaatcccagtggggaaacggcatt

SEQ ID NO: 187134 - DNA, 25 bp, Mus musculus
agaatccgaggccacaggcctctgc

SEQ ID NO: 187135 - DNA, 25 bp, Mus musculus
agaatccgcaatgccctggctttcc

SEQ ID NO: 187136 - DNA, 25 bp, Mus musculus
agaatccgcaatgcttctggaattt

SEQ ID NO: 187137 - DNA, 25 bp, Mus musculus
agaatccggtcatgggagttaggga

SEQ ID NO: 187138 - DNA, 25 bp, Mus musculus
agaatccgttgaagactttctgggc

SEQ ID NO: 187139 - DNA, 25 bp, Mus musculus
agaatcctgcgttttctggaagatg

SEQ ID NO: 187140 - DNA, 25 bp, Mus musculus
agaatcctgtgaagatattgacgaa

SEQ ID NO: 187141 - DNA, 25 bp, Mus musculus
agaatcgatatcaggttgatcccca

SEQ ID NO: 187142 - DNA, 25 bp, Mus musculus
agaatcgggttaaggttgaggagcc

SEQ ID NO: 187143 - DNA, 25 bp, Mus musculus
agaatcgtcactgacaccaattcta

SEQ ID NO: 187144 - DNA, 25 bp, Mus musculus
agaatcgtcactgatgcccttcccg

SEQ ID NO: 187145 - DNA, 25 bp, Mus musculus
agaatcgtcactgatgtatgacctg

SEQ ID NO: 187146 - DNA, 25 bp, Mus musculus
agaatcgtgagtggtcctgtccaag

SEQ ID NO: 187147 - DNA, 25 bp, Mus musculus
agaatctaagccaggttgccatgaa

SEQ ID NO: 187148 - DNA, 25 bp, Mus musculus
agaatctagaggtgaacgagattat

SEQ ID NO: 187149 - DNA, 25 bp, Mus musculus
agaatctaggcggcttcagcgggcc

SEQ ID NO: 187150 - DNA, 25 bp, Mus musculus
agaatctagggctcaccatcatgga

SEQ ID NO: 187151 - DNA, 25 bp, Mus musculus
agaatctagttccgagtcccgctca

SEQ ID NO: 187152 - DNA, 25 bp, Mus musculus
agaatctatggagagagtgctgagg

SEQ ID NO: 187153 - DNA, 25 bp, Mus musculus
agaatctattattggtactggcgga

SEQ ID NO: 187154 - DNA, 25 bp, Mus musculus
agaatctctcaagacctcttctaga

SEQ ID NO: 187155 - DNA, 25 bp, Mus musculus
agaatctgaaggtccagcctgatga

SEQ ID NO: 187156 - DNA, 25 bp, Mus musculus
agaatctgaggcctgtgagaagcac

SEQ ID NO: 187157 - DNA, 25 bp, Mus musculus
agaatctggatggctatggtcaagg

SEQ ID NO: 187158 - DNA, 25 bp, Mus musculus
agaatctgtggctgaattacacagt

SEQ ID NO: 187159 - DNA, 25 bp, Mus musculus
agaatcttgccggtcctgttagcct

SEQ ID NO: 187160 - DNA, 25 bp, Mus musculus
agaatcttgtcaggaacctcagctg

SEQ ID NO: 187161 - DNA, 25 bp, Mus musculus
agaatcttgtcaggtgtgatgaatg

SEQ ID NO: 187162 - DNA, 25 bp, Mus musculus
agaatgaaaagtgaagctgaggaca

SEQ ID NO: 187163 - DNA, 25 bp, Mus musculus
agaatgaaaggcgttgcagctcagt

SEQ ID NO: 187164 - DNA, 25 bp, Mus musculus
agaatgaagaaagagctgtgcaact

SEQ ID NO: 187165 - DNA, 25 bp, Mus musculus
agaatgaagccaagccctcccagga

SEQ ID NO: 187166 - DNA, 25 bp, Mus musculus
agaatgaagccaagggcccagtgtg

SEQ ID NO: 187167 - DNA, 25 bp, Mus musculus
agaatgaaggctgaacttccacttt

SEQ ID NO: 187168 - DNA, 25 bp, Mus musculus
agaatgacactgtctctggctttcc

SEQ ID NO: 187169 - DNA, 25 bp, Mus musculus
agaatgacaggagccatccgcaaac

SEQ ID NO: 187170 - DNA, 25 bp, Mus musculus
agaatgacatgggatacaaactgca

SEQ ID NO: 187171 - DNA, 25 bp, Mus musculus
agaatgacattggctcgtgagctga

SEQ ID NO: 187172 - DNA, 25 bp, Mus musculus
agaatgacatttttgccattggctc

SEQ ID NO: 187173 - DNA, 25 bp, Mus musculus
agaatgaccggcagggtgatgctga

SEQ ID NO: 187174 - DNA, 25 bp, Mus musculus
agaatgactctctgtggacgcaagc

SEQ ID NO: 187175 - DNA, 25 bp, Mus musculus
agaatgactggtgggtgtgcaaaca

SEQ ID NO: 187176 - DNA, 25 bp, Mus musculus
agaatgagaaaaaggattcagaatt

SEQ ID NO: 187177 - DNA, 25 bp, Mus musculus
agaatgagacaagagatgtgcttgt

SEQ ID NO: 187178 - DNA, 25 bp, Mus musculus
agaatgagatcaacctgccactgtc

SEQ ID NO: 187179 - DNA, 25 bp, Mus musculus
agaatgagatgagctgcccgacggg

SEQ ID NO: 187180 - DNA, 25 bp, Mus musculus
agaatgaggaagaaaaagagagaga

SEQ ID NO: 187181 - DNA, 25 bp, Mus musculus
agaatgagtccaaaggatcagactg

SEQ ID NO: 187182 - DNA, 25 bp, Mus musculus
agaatgagtccaaagtttccattgg

SEQ ID NO: 187183 - DNA, 25 bp, Mus musculus
agaatgatagcttggagatttcttt

SEQ ID NO: 187184 - DNA, 25 bp, Mus musculus
agaatgatccagctacatcaaaata

SEQ ID NO: 187185 - DNA, 25 bp, Mus musculus
agaatgattttaggttacagccaag

SEQ ID NO: 187186 - DNA, 25 bp, Mus musculus
agaatgcacaggtcctgtggctgtt

SEQ ID NO: 187187 - DNA, 25 bp, Mus musculus
agaatgccaaactccgtgtcgacca

SEQ ID NO: 187188 - DNA, 25 bp, Mus musculus
agaatgccacaactgatgccttaac

SEQ ID NO: 187189 - DNA, 25 bp, Mus musculus
agaatgccacgctgagcaccatcaa

SEQ ID NO: 187190 - DNA, 25 bp, Mus musculus
agaatgcccaatggcacccaggccc

SEQ ID NO: 187191 - DNA, 25 bp, Mus musculus
agaatgccgatggagctgtcttgca

SEQ ID NO: 187192 - DNA, 25 bp, Mus musculus
agaatgccttccaaggaaacctctg

SEQ ID NO: 187193 - DNA, 25 bp, Mus musculus
agaatgccttccaaggttgagagct

SEQ ID NO: 187194 - DNA, 25 bp, Mus musculus
agaatgcgcacggtagcactcagca

SEQ ID NO: 187195 - DNA, 25 bp, Mus musculus
agaatgcgggagaaggtttttcgtt

SEQ ID NO: 187196 - DNA, 25 bp, Mus musculus
agaatgctaacaagagtgaaattcc

SEQ ID NO: 187197 - DNA, 25 bp, Mus musculus
agaatgctgaaaagaatgatggaaa

SEQ ID NO: 187198 - DNA, 25 bp, Mus musculus
agaatgctgaaaagttgccagtagt

SEQ ID NO: 187199 - DNA, 25 bp, Mus musculus
agaatgctggcagaaggagctaact

SEQ ID NO: 187200 - DNA, 25 bp, Mus musculus
agaatgctggtggacaagaagccta

SEQ ID NO: 187201 - DNA, 25 bp, Mus musculus
agaatgctttcagccccagccgttc

SEQ ID NO: 187202 - DNA, 25 bp, Mus musculus
agaatgctttccaggattcacagaa

SEQ ID NO: 187203 - DNA, 25 bp, Mus musculus
agaatggaaataatgctcttcatct

SEQ ID NO: 187204 - DNA, 25 bp, Mus musculus
agaatggaagcagatcctgcctctc

SEQ ID NO: 187205 - DNA, 25 bp, Mus musculus
agaatggaagcccagctcacaggaa

SEQ ID NO: 187206 - DNA, 25 bp, Mus musculus
agaatggactttgaagcatttttca

SEQ ID NO: 187207 - DNA, 25 bp, Mus musculus
agaatggagagaggaggctgctccc

SEQ ID NO: 187208 - DNA, 25 bp, Mus musculus
agaatggagagagtttggaagaact

SEQ ID NO: 187209 - DNA, 25 bp, Mus musculus
agaatggagttggctctgctctgac

SEQ ID NO: 187210 - DNA, 25 bp, Mus musculus
agaatggatcccgggcgtccatgct

SEQ ID NO: 187211 - DNA, 25 bp, Mus musculus
agaatggcagggacggtcaagactc

SEQ ID NO: 187212 - DNA, 25 bp, Mus musculus
agaatggcatgattgaggactggga

SEQ ID NO: 187213 - DNA, 25 bp, Mus musculus
agaatggcccgccctcctcgcccga

SEQ ID NO: 187214 - DNA, 25 bp, Mus musculus
agaatggcgtgcattttctgcagct

SEQ ID NO: 187215 - DNA, 25 bp, Mus musculus
agaatggctgataatgcctgcgttc

SEQ ID NO: 187216 - DNA, 25 bp, Mus musculus
agaatgggacaggagacaagatccc

SEQ ID NO: 187217 - DNA, 25 bp, Mus musculus
agaatgggataatactgtgaatgat

SEQ ID NO: 187218 - DNA, 25 bp, Mus musculus
agaatgggcaggtggcactgatgga

SEQ ID NO: 187219 - DNA, 25 bp, Mus musculus
agaatgggcagttgttacaggtggc

SEQ ID NO: 187220 - DNA, 25 bp, Mus musculus
agaatgggcatgtctacacctgcat

SEQ ID NO: 187221 - DNA, 25 bp, Mus musculus
agaatgggccaagcagaaaagaaat

SEQ ID NO: 187222 - DNA, 25 bp, Mus musculus
agaatgggctaggcaaaagatgtga

SEQ ID NO: 187223 - DNA, 25 bp, Mus musculus
agaatgggctagtcacagttgcaga

SEQ ID NO: 187224 - DNA, 25 bp, Mus musculus
agaatggggacagtgtcttacactt

SEQ ID NO: 187225 - DNA, 25 bp, Mus musculus
agaatggggagctggccccacaggg

SEQ ID NO: 187226 - DNA, 25 bp, Mus musculus
agaatggggagctggctaagctggt

SEQ ID NO: 187227 - DNA, 25 bp, Mus musculus
agaatggttatactaatggaattgc

SEQ ID NO: 187228 - DNA, 25 bp, Mus musculus
agaatggttatactgccttaacatg

SEQ ID NO: 187229 - DNA, 25 bp, Mus musculus
agaatggttatgataattagcacca

SEQ ID NO: 187230 - DNA, 25 bp, Mus musculus
agaatgtacgccaggccagcgtcta

SEQ ID NO: 187231 - DNA, 25 bp, Mus musculus
agaatgtagcccggagccttctgat

SEQ ID NO: 187232 - DNA, 25 bp, Mus musculus
agaatgtatgacgaggagacccgca

SEQ ID NO: 187233 - DNA, 25 bp, Mus musculus
agaatgtatgatgaggagacccgca

SEQ ID NO: 187234 - DNA, 25 bp, Mus musculus
agaatgtattcaagatgctggagac

SEQ ID NO: 187235 - DNA, 25 bp, Mus musculus
agaatgtattcaaggtctgcgacga

SEQ ID NO: 187236 - DNA, 25 bp, Mus musculus
agaatgtcagaaccatcctcctgag

SEQ ID NO: 187237 - DNA, 25 bp, Mus musculus
agaatgtcagattccagattaccag

SEQ ID NO: 187238 - DNA, 25 bp, Mus musculus
agaatgtcagcaggatggcacgctc

SEQ ID NO: 187239 - DNA, 25 bp, Mus musculus
agaatgtcagtctggagcccccaga

SEQ ID NO: 187240 - DNA, 25 bp, Mus musculus
agaatgtccactgttccccattttc

SEQ ID NO: 187241 - DNA, 25 bp, Mus musculus
agaatgtccaggtcctttcctcttc

SEQ ID NO: 187242 - DNA, 25 bp, Mus musculus
agaatgtcccaacaggccatccgct

SEQ ID NO: 187243 - DNA, 25 bp, Mus musculus
agaatgtctaataaaactggatggc

SEQ ID NO: 187244 - DNA, 25 bp, Mus musculus
agaatgtgaacaaagtgaattccaa

SEQ ID NO: 187245 - DNA, 25 bp, Mus musculus
agaatgtgataggtttgccagatct

SEQ ID NO: 187246 - DNA, 25 bp, Mus musculus
agaatgtgccagaaagctgccccac

SEQ ID NO: 187247 - DNA, 25 bp, Mus musculus
agaatgtgctagagatcaataagcg

SEQ ID NO: 187248 - DNA, 25 bp, Mus musculus
agaatgtgctggaattgtctgtaag

SEQ ID NO: 187249 - DNA, 25 bp, Mus musculus
agaatgtgctgggttttctgtctcc

SEQ ID NO: 187250 - DNA, 25 bp, Mus musculus
agaatgtggagccactgtatggctt

SEQ ID NO: 187251 - DNA, 25 bp, Mus musculus
agaatgtggcaaaaaaacatttcaa

SEQ ID NO: 187252 - DNA, 25 bp, Mus musculus
agaatgtggccaggcctgcaccacg

SEQ ID NO: 187253 - DNA, 25 bp, Mus musculus
agaatgtggcgctttggagtctctt

SEQ ID NO: 187254 - DNA, 25 bp, Mus musculus
agaatgtgtatggcctgcaggcgta

SEQ ID NO: 187255 - DNA, 25 bp, Mus musculus
agaatgtgtcctgattaccgacagc

SEQ ID NO: 187256 - DNA, 25 bp, Mus musculus
agaatgtgtcctgtcccacgctcag

SEQ ID NO: 187257 - DNA, 25 bp, Mus musculus
agaatgtgtgcatagagtgttattg

SEQ ID NO: 187258 - DNA, 25 bp, Mus musculus
agaatgtgtgcatagctaatgtctg

SEQ ID NO: 187259 - DNA, 25 bp, Mus musculus
agaattaaaggtttgggatcaaagc

SEQ ID NO: 187260 - DNA, 25 bp, Mus musculus
agaattaatagctaaaaggacaacg

SEQ ID NO: 187261 - DNA, 25 bp, Mus musculus
agaattacaagtgtgaagtagtcgc

SEQ ID NO: 187262 - DNA, 25 bp, Mus musculus
agaattacagtactgtttatcagac

SEQ ID NO: 187263 - DNA, 25 bp, Mus musculus
agaattactgcatctcccctcaact

SEQ ID NO: 187264 - DNA, 25 bp, Mus musculus
agaattagcaaaagtgcttggctgt

SEQ ID NO: 187265 - DNA, 25 bp, Mus musculus
agaattagccctctttgaaccctga

SEQ ID NO: 187266 - DNA, 25 bp, Mus musculus
agaattagccctgtcttcttcccgt

SEQ ID NO: 187267 - DNA, 25 bp, Mus musculus
agaattaggactcagtggcaatgta

SEQ ID NO: 187268 - DNA, 25 bp, Mus musculus
agaattagggaacctgctggtagcc

SEQ ID NO: 187269 - DNA, 25 bp, Mus musculus
agaattatgagctacagaagttatt

SEQ ID NO: 187270 - DNA, 25 bp, Mus musculus
agaattatgaggtctacaagcagga

SEQ ID NO: 187271 - DNA, 25 bp, Mus musculus
agaattattctgctcttcctcccct

SEQ ID NO: 187272 - DNA, 25 bp, Mus musculus
agaattcaaattttgctacaaaagg

SEQ ID NO: 187273 - DNA, 25 bp, Mus musculus
agaattcaaattttggcacgcagct

SEQ ID NO: 187274 - DNA, 25 bp, Mus musculus
agaattcaagcagatttacaagggc

SEQ ID NO: 187275 - DNA, 25 bp, Mus musculus
agaattcaagtcctgagatgagccg

SEQ ID NO: 187276 - DNA, 25 bp, Mus musculus
agaattcaagtcctgctctacagag

SEQ ID NO: 187277 - DNA, 25 bp, Mus musculus
agaattcaagtcctggtgtggaggc

SEQ ID NO: 187278 - DNA, 25 bp, Mus musculus
agaattcagaaacagtggaagcatc

SEQ ID NO: 187279 - DNA, 25 bp, Mus musculus
agaattcaggggggaggatgacttg

SEQ ID NO: 187280 - DNA, 25 bp, Mus musculus
agaattccaaatagcatagcttgtg

SEQ ID NO: 187281 - DNA, 25 bp, Mus musculus
agaattccaaatgcttacttttctg

SEQ ID NO: 187282 - DNA, 25 bp, Mus musculus
agaattccacggacctagactcagc

SEQ ID NO: 187283 - DNA, 25 bp, Mus musculus
agaattccagaattcagtagctttg

SEQ ID NO: 187284 - DNA, 25 bp, Mus musculus
agaattccagacacaagtacccacc

SEQ ID NO: 187285 - DNA, 25 bp, Mus musculus
agaattccagacagcttttcaagat

SEQ ID NO: 187286 - DNA, 25 bp, Mus musculus
agaattccaggacagagatttcctc

SEQ ID NO: 187287 - DNA, 25 bp, Mus musculus
agaattccaggtctatggaaatgca

SEQ ID NO: 187288 - DNA, 25 bp, Mus musculus
agaattccattatgtgagctctcag

SEQ ID NO: 187289 - DNA, 25 bp, Mus musculus
agaattccatttaacgttctgatga

SEQ ID NO: 187290 - DNA, 25 bp, Mus musculus
agaattcccaaatggatgacaagtg

SEQ ID NO: 187291 - DNA, 25 bp, Mus musculus
agaattcccaaatggattttctcta

SEQ ID NO: 187292 - DNA, 25 bp, Mus musculus
agaattccccctcctcaggtacagg

SEQ ID NO: 187293 - DNA, 25 bp, Mus musculus
agaattcctccaggagtacatcata

SEQ ID NO: 187294 - DNA, 25 bp, Mus musculus
agaattccttgaatccgacgtggag

SEQ ID NO: 187295 - DNA, 25 bp, Mus musculus
agaattccttgatccaaacgcacag

SEQ ID NO: 187296 - DNA, 25 bp, Mus musculus
agaattcgaagagccacctaacaaa

SEQ ID NO: 187297 - DNA, 25 bp, Mus musculus
agaattctaatgttttgtgatccaa

SEQ ID NO: 187298 - DNA, 25 bp, Mus musculus
agaattctagggtactcaatgcaag

SEQ ID NO: 187299 - DNA, 25 bp, Mus musculus
agaattctcaggaacatcatgacaa

SEQ ID NO: 187300 - DNA, 25 bp, Mus musculus
agaattctcaggtcctctttcagct

SEQ ID NO: 187301 - DNA, 25 bp, Mus musculus
agaattctcatcaaggataacagca

SEQ ID NO: 187302 - DNA, 25 bp, Mus musculus
agaattctgaagaggacagctctta

SEQ ID NO: 187303 - DNA, 25 bp, Mus musculus
agaattctgcactaggctccgcagg

SEQ ID NO: 187304 - DNA, 25 bp, Mus musculus
agaattgaaaagtttctagatgttg

SEQ ID NO: 187305 - DNA, 25 bp, Mus musculus
agaattgaaggtgcctgaaaaagcc

SEQ ID NO: 187306 - DNA, 25 bp, Mus musculus
agaattgactctgtttcccacagtc

SEQ ID NO: 187307 - DNA, 25 bp, Mus musculus
agaattgattgaggactctcaaaga

SEQ ID NO: 187308 - DNA, 25 bp, Mus musculus
agaattgattgaggggtctcactct

SEQ ID NO: 187309 - DNA, 25 bp, Mus musculus
agaattgcagagggtaattttcaac

SEQ ID NO: 187310 - DNA, 25 bp, Mus musculus
agaattgcagatctgataaaaagag

SEQ ID NO: 187311 - DNA, 25 bp, Mus musculus
agaattgcagttgcctcttttgtcc

SEQ ID NO: 187312 - DNA, 25 bp, Mus musculus
agaattgccaacagtagtcggaaac

SEQ ID NO: 187313 - DNA, 25 bp, Mus musculus
agaattgccaactggtgctctgttg

SEQ ID NO: 187314 - DNA, 25 bp, Mus musculus
agaattgctagattagtggagtacc

SEQ ID NO: 187315 - DNA, 25 bp, Mus musculus
agaattggccttcaaatctgcagaa

SEQ ID NO: 187316 - DNA, 25 bp, Mus musculus
agaattggccttcagaatacccgga

SEQ ID NO: 187317 - DNA, 25 bp, Mus musculus
agaattgtattttaggtacatttta

SEQ ID NO: 187318 - DNA, 25 bp, Mus musculus
agaattgtggaagaataagaatgag

SEQ ID NO: 187319 - DNA, 25 bp, Mus musculus
agaattgtggagattgaagaagttc

SEQ ID NO: 187320 - DNA, 25 bp, Mus musculus
agaattgtggaggttgacgttgatg

SEQ ID NO: 187321 - DNA, 25 bp, Mus musculus
agaattgtggataagcctgagtggc

SEQ ID NO: 187322 - DNA, 25 bp, Mus musculus
agaattgttgtttattcatggtggt

SEQ ID NO: 187323 - DNA, 25 bp, Mus musculus
agaatttcaagactgcgagtgctac

SEQ ID NO: 187324 - DNA, 25 bp, Mus musculus
agaatttccaggcaggctcatggca

SEQ ID NO: 187325 - DNA, 25 bp, Mus musculus
agaatttccattcgagcatcagaca

SEQ ID NO: 187326 - DNA, 25 bp, Mus musculus
agaatttcccaagtggatggagacc

SEQ ID NO: 187327 - DNA, 25 bp, Mus musculus
agaatttctgaaagtgcaacagtat

SEQ ID NO: 187328 - DNA, 25 bp, Mus musculus
agaatttctgtaagtgcaacagtat

SEQ ID NO: 187329 - DNA, 25 bp, Mus musculus
agaatttgaggtctttaagtggaca

SEQ ID NO: 187330 - DNA, 25 bp, Mus musculus
agaatttgatgaggacagtggtgac

SEQ ID NO: 187331 - DNA, 25 bp, Mus musculus
agaatttgctgtagacattttaagt

SEQ ID NO: 187332 - DNA, 25 bp, Mus musculus
agaatttgtcagttggttactggct

SEQ ID NO: 187333 - DNA, 25 bp, Mus musculus
agaatttgtccagccccagcatctc

SEQ ID NO: 187334 - DNA, 25 bp, Mus musculus
agaatttgtggaagaggagacagat

SEQ ID NO: 187335 - DNA, 25 bp, Mus musculus
agaattttccagttccagtgcagac

SEQ ID NO: 187336 - DNA, 25 bp, Mus musculus
agaattttctgggggtcccacagag

SEQ ID NO: 187337 - DNA, 25 bp, Mus musculus
agaatttttatgttgagctaccaat

SEQ ID NO: 187338 - DNA, 25 bp, Mus musculus
agacaaaaaagagttgatcaagagc

SEQ ID NO: 187339 - DNA, 25 bp, Mus musculus
agacaaaaaccaaagaatgacttcg

SEQ ID NO: 187340 - DNA, 25 bp, Mus musculus
agacaaaaaccaaaggccagcgtga

SEQ ID NO: 187341 - DNA, 25 bp, Mus musculus
agacaaaaaccatctttcaggacct

SEQ ID NO: 187342 - DNA, 25 bp, Mus musculus
agacaaaaagagttcaaaattgggg

SEQ ID NO: 187343 - DNA, 25 bp, Mus musculus
agacaaaaccagatcaaattgacat

SEQ ID NO: 187344 - DNA, 25 bp, Mus musculus
agacaaaacgctgagagagatgcca

SEQ ID NO: 187345 - DNA, 25 bp, Mus musculus
agacaaaagactgacacatgcagcc

SEQ ID NO: 187346 - DNA, 25 bp, Mus musculus
agacaaaagaggcttttcagatgtg

SEQ ID NO: 187347 - DNA, 25 bp, Mus musculus
agacaaaagagtttcaactcctagc

SEQ ID NO: 187348 - DNA, 25 bp, Mus musculus
agacaaaatcatagagcccatccag

SEQ ID NO: 187349 - DNA, 25 bp, Mus musculus
agacaaaatgagtctggaatcagtc

SEQ ID NO: 187350 - DNA, 25 bp, Mus musculus
agacaaaattagagaggaggaaaaa

SEQ ID NO: 187351 - DNA, 25 bp, Mus musculus
agacaaaattagtccatttcagtcc

SEQ ID NO: 187352 - DNA, 25 bp, Mus musculus
agacaaaattgcaatgcatgaacca

SEQ ID NO: 187353 - DNA, 25 bp, Mus musculus
agacaaaattgtagaagaacccatc

SEQ ID NO: 187354 - DNA, 25 bp, Mus musculus
agacaaacatggggtcccagcaaca

SEQ ID NO: 187355 - DNA, 25 bp, Mus musculus
agacaaacatgggtttaggcaagag

SEQ ID NO: 187356 - DNA, 25 bp, Mus musculus
agacaaacttgggttctatggccta

SEQ ID NO: 187357 - DNA, 25 bp, Mus musculus
agacaaagacagcaggctgcctttg

SEQ ID NO: 187358 - DNA, 25 bp, Mus musculus
agacaaagacaggatgagagacaat

SEQ ID NO: 187359 - DNA, 25 bp, Mus musculus
agacaaagacccaggagattagccg

SEQ ID NO: 187360 - DNA, 25 bp, Mus musculus
agacaaagacgaggaaccttcagct

SEQ ID NO: 187361 - DNA, 25 bp, Mus musculus
agacaaagcaagctaccaagagcaa

SEQ ID NO: 187362 - DNA, 25 bp, Mus musculus
agacaaagcaaggagtaatataaag

SEQ ID NO: 187363 - DNA, 25 bp, Mus musculus
agacaaaggagagaagagaggctct

SEQ ID NO: 187364 - DNA, 25 bp, Mus musculus
agacaaaggcgacgacctgctgccg

SEQ ID NO: 187365 - DNA, 25 bp, Mus musculus
agacaaaggcgacgatagggccagt

SEQ ID NO: 187366 - DNA, 25 bp, Mus musculus
agacaaagggcctagcagagctcct

SEQ ID NO: 187367 - DNA, 25 bp, Mus musculus
agacaaagggcctagcgccagccag

SEQ ID NO: 187368 - DNA, 25 bp, Mus musculus
agacaaagtgtctgcttttcagaaa

SEQ ID NO: 187369 - DNA, 25 bp, Mus musculus
agacaacaaaaatgaaaagaaagtt

SEQ ID NO: 187370 - DNA, 25 bp, Mus musculus
agacaacaccctattttataggcaa

SEQ ID NO: 187371 - DNA, 25 bp, Mus musculus
agacaacagatttcctctgcccctc

SEQ ID NO: 187372 - DNA, 25 bp, Mus musculus
agacaacatacaggataagaacaag

SEQ ID NO: 187373 - DNA, 25 bp, Mus musculus
agacaaccaggtcagaaaacccagc

SEQ ID NO: 187374 - DNA, 25 bp, Mus musculus
agacaaccccaaggattaaaccaga

SEQ ID NO: 187375 - DNA, 25 bp, Mus musculus
agacaaccccaagttctacagtgag

SEQ ID NO: 187376 - DNA, 25 bp, Mus musculus
agacaacgtgataagaatttattct

SEQ ID NO: 187377 - DNA, 25 bp, Mus musculus
agacaactcaacagcacagtcagca

SEQ ID NO: 187378 - DNA, 25 bp, Mus musculus
agacaactcaattagcaatagcgaa

SEQ ID NO: 187379 - DNA, 25 bp, Mus musculus
agacaactgaaggctgcccgagaga

SEQ ID NO: 187380 - DNA, 25 bp, Mus musculus
agacaactggaacccacagttccca

SEQ ID NO: 187381 - DNA, 25 bp, Mus musculus
agacaactggaggagttggaagagg

SEQ ID NO: 187382 - DNA, 25 bp, Mus musculus
agacaactttgcaggataaggtagc

SEQ ID NO: 187383 - DNA, 25 bp, Mus musculus
agacaagaaaagtgaagaactggtg

SEQ ID NO: 187384 - DNA, 25 bp, Mus musculus
agacaagaaagggatctgtgtggca

SEQ ID NO: 187385 - DNA, 25 bp, Mus musculus
agacaagaaggaaagattgaagact

SEQ ID NO: 187386 - DNA, 25 bp, Mus musculus
agacaagaaggaaagatttctaagc

SEQ ID NO: 187387 - DNA, 25 bp, Mus musculus
agacaagaatacatggcaaaagaaa

SEQ ID NO: 187388 - DNA, 25 bp, Mus musculus
agacaagacaagctgaccttcattg

SEQ ID NO: 187389 - DNA, 25 bp, Mus musculus
agacaagacagagagtggaggatgc

SEQ ID NO: 187390 - DNA, 25 bp, Mus musculus
agacaagacaggaaccctgacccag

SEQ ID NO: 187391 - DNA, 25 bp, Mus musculus
agacaagacagggtgttgacgatgc

SEQ ID NO: 187392 - DNA, 25 bp, Mus musculus
agacaagaccaagccccagctgcga

SEQ ID NO: 187393 - DNA, 25 bp, Mus musculus
agacaagagagatgcctcaggaaca

SEQ ID NO: 187394 - DNA, 25 bp, Mus musculus
agacaagagggagagaatatgctgg

SEQ ID NO: 187395 - DNA, 25 bp, Mus musculus
agacaagcaagagtccggccacaag

SEQ ID NO: 187396 - DNA, 25 bp, Mus musculus
agacaagcaaggaggtgagtgctct

SEQ ID NO: 187397 - DNA, 25 bp, Mus musculus
agacaagcaagggctctgtaaaaga

SEQ ID NO: 187398 - DNA, 25 bp, Mus musculus
agacaagcagatgggacagcaaaga

SEQ ID NO: 187399 - DNA, 25 bp, Mus musculus
agacaagccaaaggcaccatggctg

SEQ ID NO: 187400 - DNA, 25 bp, Mus musculus
agacaagccaagaatgtgctgatca

SEQ ID NO: 187401 - DNA, 25 bp, Mus musculus
agacaagccaaggtcttcttctccg

SEQ ID NO: 187402 - DNA, 25 bp, Mus musculus
agacaagccatgatgaacagctcat

SEQ ID NO: 187403 - DNA, 25 bp, Mus musculus
agacaagcctggaggttcatgtctc

SEQ ID NO: 187404 - DNA, 25 bp, Mus musculus
agacaagcctggagttatgcctctt

SEQ ID NO: 187405 - DNA, 25 bp, Mus musculus
agacaagctgaccttcattgacatg

SEQ ID NO: 187406 - DNA, 25 bp, Mus musculus
agacaaggaaagggatcttgctgga

SEQ ID NO: 187407 - DNA, 25 bp, Mus musculus
agacaaggaaaggtacgacatgatg

SEQ ID NO: 187408 - DNA, 25 bp, Mus musculus
agacaaggacacaagggtgaagagg

SEQ ID NO: 187409 - DNA, 25 bp, Mus musculus
agacaaggagccagatgagaaaacc

SEQ ID NO: 187410 - DNA, 25 bp, Mus musculus
agacaaggagccagcttcacttctt

SEQ ID NO: 187411 - DNA, 25 bp, Mus musculus
agacaaggagccagctttcttggat

SEQ ID NO: 187412 - DNA, 25 bp, Mus musculus
agacaaggcaaagcggtcccaccag

SEQ ID NO: 187413 - DNA, 25 bp, Mus musculus
agacaaggcaggagatcgggaagct

SEQ ID NO: 187414 - DNA, 25 bp, Mus musculus
agacaaggcaggaggctggtcagat

SEQ ID NO: 187415 - DNA, 25 bp, Mus musculus
agacaaggcccctagccccatctct

SEQ ID NO: 187416 - DNA, 25 bp, Mus musculus
agacaagggccaaagggttccattg

SEQ ID NO: 187417 - DNA, 25 bp, Mus musculus
agacaagggtaggtccctgtatacc

SEQ ID NO: 187418 - DNA, 25 bp, Mus musculus
agacaaggtttctacatgaaggaag

SEQ ID NO: 187419 - DNA, 25 bp, Mus musculus
agacaagtatgagcctgccatacag

SEQ ID NO: 187420 - DNA, 25 bp, Mus musculus
agacaagtgcagatgaaatcatgca

SEQ ID NO: 187421 - DNA, 25 bp, Mus musculus
agacaagtgtgagaaaaaacaagaa

SEQ ID NO: 187422 - DNA, 25 bp, Mus musculus
agacaagttcaggtaacgcacagtg

SEQ ID NO: 187423 - DNA, 25 bp, Mus musculus
agacaatacccagagatgtgaatac

SEQ ID NO: 187424 - DNA, 25 bp, Mus musculus
agacaatcaaaagggaagttgtcct

SEQ ID NO: 187425 - DNA, 25 bp, Mus musculus
agacaatcagggcaagaaaattcct

SEQ ID NO: 187426 - DNA, 25 bp, Mus musculus
agacaatccagcggctcctggagga

SEQ ID NO: 187427 - DNA, 25 bp, Mus musculus
agacaatcctatggtctttgccagt

SEQ ID NO: 187428 - DNA, 25 bp, Mus musculus
agacaatctcatttgagatgcttga

SEQ ID NO: 187429 - DNA, 25 bp, Mus musculus
agacaatctcgctgcgaaaagacat

SEQ ID NO: 187430 - DNA, 25 bp, Mus musculus
agacaatgaagataaaattgctact

SEQ ID NO: 187431 - DNA, 25 bp, Mus musculus
agacaatgaagtgtttgctggtgtc

SEQ ID NO: 187432 - DNA, 25 bp, Mus musculus
agacaatgagaggccttcagtttat

SEQ ID NO: 187433 - DNA, 25 bp, Mus musculus
agacaattaaaaagacgctgaaccc

SEQ ID NO: 187434 - DNA, 25 bp, Mus musculus
agacaattccagcacaaggaattcg

SEQ ID NO: 187435 - DNA, 25 bp, Mus musculus
agacaattctaacagagatataccg

SEQ ID NO: 187436 - DNA, 25 bp, Mus musculus
agacaattgaggaaccaacacaaga

SEQ ID NO: 187437 - DNA, 25 bp, Mus musculus
agacaattgcaaagaaaagacccaa

SEQ ID NO: 187438 - DNA, 25 bp, Mus musculus
agacacaaaaaaaaggcagtggact

SEQ ID NO: 187439 - DNA, 25 bp, Mus musculus
agacacaaaccaaatgaacacacac

SEQ ID NO: 187440 - DNA, 25 bp, Mus musculus
agacacaaagctcaagttcatgtgg

SEQ ID NO: 187441 - DNA, 25 bp, Mus musculus
agacacaacagagcaggttaggaaa

SEQ ID NO: 187442 - DNA, 25 bp, Mus musculus
agacacaagaaatttacccaataaa

SEQ ID NO: 187443 - DNA, 25 bp, Mus musculus
agacacaagcaggtcagatgtacca

SEQ ID NO: 187444 - DNA, 25 bp, Mus musculus
agacacaagggtaaggaatcagctg

SEQ ID NO: 187445 - DNA, 25 bp, Mus musculus
agacacaagggtgctgatggagctg

SEQ ID NO: 187446 - DNA, 25 bp, Mus musculus
agacacaattgaattaaacagactg

SEQ ID NO: 187447 - DNA, 25 bp, Mus musculus
agacacacagcccatcctcagccca

SEQ ID NO: 187448 - DNA, 25 bp, Mus musculus
agacacactgtccaaactagcctct

SEQ ID NO: 187449 - DNA, 25 bp, Mus musculus
agacacactgtccaagatctccgag

SEQ ID NO: 187450 - DNA, 25 bp, Mus musculus
agacacagaaagggtgcttcgagtg

SEQ ID NO: 187451 - DNA, 25 bp, Mus musculus
agacacagaccaggtgggagcatgc

SEQ ID NO: 187452 - DNA, 25 bp, Mus musculus
agacacagcacctgcagtggctacc

SEQ ID NO: 187453 - DNA, 25 bp, Mus musculus
agacacagcaggtggatgcagtgac

SEQ ID NO: 187454 - DNA, 25 bp, Mus musculus
agacacagccagtccagtagctcca

SEQ ID NO: 187455 - DNA, 25 bp, Mus musculus
agacacagccagtccgggaacccag

SEQ ID NO: 187456 - DNA, 25 bp, Mus musculus
agacacagccagtccgtaaaagctc

SEQ ID NO: 187457 - DNA, 25 bp, Mus musculus
agacacagcctctgccaagcagttc

SEQ ID NO: 187458 - DNA, 25 bp, Mus musculus
agacacagcctgcttctacctggca

SEQ ID NO: 187459 - DNA, 25 bp, Mus musculus
agacacagcgtgcttttacttggct

SEQ ID NO: 187460 - DNA, 25 bp, Mus musculus
agacacagcgtggccttgggtggac

SEQ ID NO: 187461 - DNA, 25 bp, Mus musculus
agacacagtgaagtcccctcctggc

SEQ ID NO: 187462 - DNA, 25 bp, Mus musculus
agacacagtgctgccacgacccttc

SEQ ID NO: 187463 - DNA, 25 bp, Mus musculus
agacacatgaggtgcacgcctcctc

SEQ ID NO: 187464 - DNA, 25 bp, Mus musculus
agacacatgtagatctttcatttgt

SEQ ID NO: 187465 - DNA, 25 bp, Mus musculus
agacaccacgggtgctggtgacagt

SEQ ID NO: 187466 - DNA, 25 bp, Mus musculus
agacaccagagcagcgtcatctccg

SEQ ID NO: 187467 - DNA, 25 bp, Mus musculus
agacaccatgccagcccactcaaga

SEQ ID NO: 187468 - DNA, 25 bp, Mus musculus
agacaccatttcagacctcaagtgg

SEQ ID NO: 187469 - DNA, 25 bp, Mus musculus
agacacccaagagacacagtctgtc

SEQ ID NO: 187470 - DNA, 25 bp, Mus musculus
agacacccacagagaaatgatctcc

SEQ ID NO: 187471 - DNA, 25 bp, Mus musculus
agacacccacagaggacgacaatga

SEQ ID NO: 187472 - DNA, 25 bp, Mus musculus
agacacccacagggataaggaaggc

SEQ ID NO: 187473 - DNA, 25 bp, Mus musculus
agacacccagaatgggctacacata

SEQ ID NO: 187474 - DNA, 25 bp, Mus musculus
agacacccagaggctggtccaggag

SEQ ID NO: 187475 - DNA, 25 bp, Mus musculus
agacacccagcctggccgcagaaga

SEQ ID NO: 187476 - DNA, 25 bp, Mus musculus
agacacccaggccagccacgctgag

SEQ ID NO: 187477 - DNA, 25 bp, Mus musculus
agacaccgagagtgtgggttcgcag

SEQ ID NO: 187478 - DNA, 25 bp, Mus musculus
agacaccgctcgtgtcttatctagc

SEQ ID NO: 187479 - DNA, 25 bp, Mus musculus
agacaccggcaggtgggtaatgctg

SEQ ID NO: 187480 - DNA, 25 bp, Mus musculus
agacaccggccaggggcgcaagaag

SEQ ID NO: 187481 - DNA, 25 bp, Mus musculus
agacaccggccaggtgctctcacca

SEQ ID NO: 187482 - DNA, 25 bp, Mus musculus
agacacctaaaggctcccctttgat

SEQ ID NO: 187483 - DNA, 25 bp, Mus musculus
agacacctcgccacggcccagttca

SEQ ID NO: 187484 - DNA, 25 bp, Mus musculus
agacacctctcagaaaagttgtatg

SEQ ID NO: 187485 - DNA, 25 bp, Mus musculus
agacacctgagatatcaagttcatt

SEQ ID NO: 187486 - DNA, 25 bp, Mus musculus
agacaccttcaggtggaagggagag

SEQ ID NO: 187487 - DNA, 25 bp, Mus musculus
agacaccttgagagggttttatgga

SEQ ID NO: 187488 - DNA, 25 bp, Mus musculus
agacacgattcacgaggtcctgtaa

SEQ ID NO: 187489 - DNA, 25 bp, Mus musculus
agacacgccagtggctgtttacctg

SEQ ID NO: 187490 - DNA, 25 bp, Mus musculus
agacacgccagtgggttcttctgtg

SEQ ID NO: 187491 - DNA, 25 bp, Mus musculus
agacacgcggagcctctgacctcca

SEQ ID NO: 187492 - DNA, 25 bp, Mus musculus
agacacgcggcataggccttcagaa

SEQ ID NO: 187493 - DNA, 25 bp, Mus musculus
agacacggacaatttgggtatccgg

SEQ ID NO: 187494 - DNA, 25 bp, Mus musculus
agacacggagcggtactgctcacga

SEQ ID NO: 187495 - DNA, 25 bp, Mus musculus
agacacggatagcagacactacaag

SEQ ID NO: 187496 - DNA, 25 bp, Mus musculus
agacactaaccctgagctcttggct

SEQ ID NO: 187497 - DNA, 25 bp, Mus musculus
agacactacaggagagcacacagct

SEQ ID NO: 187498 - DNA, 25 bp, Mus musculus
agacactacagggctcccagtttgt

SEQ ID NO: 187499 - DNA, 25 bp, Mus musculus
agacactacaggtaacaggattgag

SEQ ID NO: 187500 - DNA, 25 bp, Mus musculus
agacactagggtggctaccgtctca

SEQ ID NO: 187501 - DNA, 25 bp, Mus musculus
agacactcaggtccctccagctata

SEQ ID NO: 187502 - DNA, 25 bp, Mus musculus
agacactgaaaagcgccatggctac

SEQ ID NO: 187503 - DNA, 25 bp, Mus musculus
agacactgacctggtgttgctgcac

SEQ ID NO: 187504 - DNA, 25 bp, Mus musculus
agacactgacctggtgtttacagtg

SEQ ID NO: 187505 - DNA, 25 bp, Mus musculus
agacactgaggctttcaggtttcct

SEQ ID NO: 187506 - DNA, 25 bp, Mus musculus
agacactgagggccgatatctcttc

SEQ ID NO: 187507 - DNA, 25 bp, Mus musculus
agacactgcagcggaccttacagaa

SEQ ID NO: 187508 - DNA, 25 bp, Mus musculus
agacactgcagttcatcgtggcaga

SEQ ID NO: 187509 - DNA, 25 bp, Mus musculus
agacactggaaaatggtggtggctt

SEQ ID NO: 187510 - DNA, 25 bp, Mus musculus
agacactggctgatctgcatcccca

SEQ ID NO: 187511 - DNA, 25 bp, Mus musculus
agacactgggcctggttgtggagtt

SEQ ID NO: 187512 - DNA, 25 bp, Mus musculus
agacactgtcaccgactatttgcat

SEQ ID NO: 187513 - DNA, 25 bp, Mus musculus
agacactgtcaccgagtttgtctct

SEQ ID NO: 187514 - DNA, 25 bp, Mus musculus
agacactgtcaccgatgtggataag

SEQ ID NO: 187515 - DNA, 25 bp, Mus musculus
agacacttctgacgatcttgaccgg

SEQ ID NO: 187516 - DNA, 25 bp, Mus musculus
agacacttgtgcggaggcccactga

SEQ ID NO: 187517 - DNA, 25 bp, Mus musculus
agacacttgtgcgggtgactcagga

SEQ ID NO: 187518 - DNA, 25 bp, Mus musculus
agacacttgtggaaggaatctgcta

SEQ ID NO: 187519 - DNA, 25 bp, Mus musculus
agacagaaaagaatgcagtcacagg

SEQ ID NO: 187520 - DNA, 25 bp, Mus musculus
agacagaaacgggacttatctgcag

SEQ ID NO: 187521 - DNA, 25 bp, Mus musculus
agacagaaacggtatctgcagagtt

SEQ ID NO: 187522 - DNA, 25 bp, Mus musculus
agacagaaagctcagaggctgagaa

SEQ ID NO: 187523 - DNA, 25 bp, Mus musculus
agacagaaaggccaggttctgggag

SEQ ID NO: 187524 - DNA, 25 bp, Mus musculus
agacagaaaggcggaacagagtgtt

SEQ ID NO: 187525 - DNA, 25 bp, Mus musculus
agacagaaaggcgggaaagggctgt

SEQ ID NO: 187526 - DNA, 25 bp, Mus musculus
agacagaacagtctaagagtgtcac

SEQ ID NO: 187527 - DNA, 25 bp, Mus musculus
agacagaaccgcaagacaggagccc

SEQ ID NO: 187528 - DNA, 25 bp, Mus musculus
agacagaaccgcaagcttccatacg

SEQ ID NO: 187529 - DNA, 25 bp, Mus musculus
agacagaacggtcattgattacaac

SEQ ID NO: 187530 - DNA, 25 bp, Mus musculus
agacagaacggttgattacaacggc

SEQ ID NO: 187531 - DNA, 25 bp, Mus musculus
agacagaattagggaacctgctggt

SEQ ID NO: 187532 - DNA, 25 bp, Mus musculus
agacagacaaggcttcagaagaggt

SEQ ID NO: 187533 - DNA, 25 bp, Mus musculus
agacagacacatgaggtgcacgcct

SEQ ID NO: 187534 - DNA, 25 bp, Mus musculus
agacagacagctgcagtgcttacag

SEQ ID NO: 187535 - DNA, 25 bp, Mus musculus
agacagacaggcttttgaggctccc

SEQ ID NO: 187536 - DNA, 25 bp, Mus musculus
agacagacatggggagtcttctgag

SEQ ID NO: 187537 - DNA, 25 bp, Mus musculus
agacagaccatccaggtgagcctca

SEQ ID NO: 187538 - DNA, 25 bp, Mus musculus
agacagacctgtcaagagaatccat

SEQ ID NO: 187539 - DNA, 25 bp, Mus musculus
agacagactaaagaagtttccagaa

SEQ ID NO: 187540 - DNA, 25 bp, Mus musculus
agacagactgggaaaacatcgattg

SEQ ID NO: 187541 - DNA, 25 bp, Mus musculus
agacagacttaggcgctaactggga

SEQ ID NO: 187542 - DNA, 25 bp, Mus musculus
agacagagaacaagatttctcctta

SEQ ID NO: 187543 - DNA, 25 bp, Mus musculus
agacagagaacggggagttggctag

SEQ ID NO: 187544 - DNA, 25 bp, Mus musculus
agacagagaatggggagctgtcccg

SEQ ID NO: 187545 - DNA, 25 bp, Mus musculus
agacagagaggctccgcaggaggct

SEQ ID NO: 187546 - DNA, 25 bp, Mus musculus
agacagagcaaggtcctgtttattg

SEQ ID NO: 187547 - DNA, 25 bp, Mus musculus
agacagagcagacgatttacatgga

SEQ ID NO: 187548 - DNA, 25 bp, Mus musculus
agacagagcaggtggctgtaggatg

SEQ ID NO: 187549 - DNA, 25 bp, Mus musculus
agacagagcaggtgttttagaaaca

SEQ ID NO: 187550 - DNA, 25 bp, Mus musculus
agacagaggaggagatacttctgac

SEQ ID NO: 187551 - DNA, 25 bp, Mus musculus
agacagaggaggagggaaaaagaga

SEQ ID NO: 187552 - DNA, 25 bp, Mus musculus
agacagaggaggtggtcctgggggg

SEQ ID NO: 187553 - DNA, 25 bp, Mus musculus
agacagaggggccggggcctgtgca

SEQ ID NO: 187554 - DNA, 25 bp, Mus musculus
agacagagtggtgattagaaattct

SEQ ID NO: 187555 - DNA, 25 bp, Mus musculus
agacagagtttagggaggagcaaaa

SEQ ID NO: 187556 - DNA, 25 bp, Mus musculus
agacagataccagaccttcctgcga

SEQ ID NO: 187557 - DNA, 25 bp, Mus musculus
agacagatcagaagcacaattatat

SEQ ID NO: 187558 - DNA, 25 bp, Mus musculus
agacagatcagaaggcttatggtag

SEQ ID NO: 187559 - DNA, 25 bp, Mus musculus
agacagatctgcagggcgacactcc

SEQ ID NO: 187560 - DNA, 25 bp, Mus musculus
agacagatgccccaacaagggagaa

SEQ ID NO: 187561 - DNA, 25 bp, Mus musculus
agacagatggaccctcctcatccgc

SEQ ID NO: 187562 - DNA, 25 bp, Mus musculus
agacagattacttcgcaacctggct

SEQ ID NO: 187563 - DNA, 25 bp, Mus musculus
agacagattgagcagctctatgccg

SEQ ID NO: 187564 - DNA, 25 bp, Mus musculus
agacagcaaagaaaggcctcctgga

SEQ ID NO: 187565 - DNA, 25 bp, Mus musculus
agacagcaaagcgcaggctatgaag

SEQ ID NO: 187566 - DNA, 25 bp, Mus musculus
agacagcaacaactgtcccaggtct

SEQ ID NO: 187567 - DNA, 25 bp, Mus musculus
agacagcaacaagcttgtagaggag

SEQ ID NO: 187568 - DNA, 25 bp, Mus musculus
agacagcaacatgaaatgtgtctaa

SEQ ID NO: 187569 - DNA, 25 bp, Mus musculus
agacagcaacgcagtacttcatcct

SEQ ID NO: 187570 - DNA, 25 bp, Mus musculus
agacagcaagacaaacgagggcctc

SEQ ID NO: 187571 - DNA, 25 bp, Mus musculus
agacagcaaggcaaagatgcaattt

SEQ ID NO: 187572 - DNA, 25 bp, Mus musculus
agacagcacactagaaaccccattt

SEQ ID NO: 187573 - DNA, 25 bp, Mus musculus
agacagcacagaccggaagaaagac

SEQ ID NO: 187574 - DNA, 25 bp, Mus musculus
agacagcagagcaggtgaagagaag

SEQ ID NO: 187575 - DNA, 25 bp, Mus musculus
agacagcagggagtgtgtgcctctt

SEQ ID NO: 187576 - DNA, 25 bp, Mus musculus
agacagcagggtttcaatgccctgt

SEQ ID NO: 187577 - DNA, 25 bp, Mus musculus
agacagcagtgggaccaggatggaa

SEQ ID NO: 187578 - DNA, 25 bp, Mus musculus
agacagcatcaggattgctgaaaga

SEQ ID NO: 187579 - DNA, 25 bp, Mus musculus
agacagccaagggatttgaattaat

SEQ ID NO: 187580 - DNA, 25 bp, Mus musculus
agacagccagctgttgaggaccctg

SEQ ID NO: 187581 - DNA, 25 bp, Mus musculus
agacagccatgatcaactgggacca

SEQ ID NO: 187582 - DNA, 25 bp, Mus musculus
agacagccatgatcctacagatcaa

SEQ ID NO: 187583 - DNA, 25 bp, Mus musculus
agacagcccaaaggatgactcaaag

SEQ ID NO: 187584 - DNA, 25 bp, Mus musculus
agacagcccaaggatgtcacagtgg

SEQ ID NO: 187585 - DNA, 25 bp, Mus musculus
agacagccctgcgggataagaagta

SEQ ID NO: 187586 - DNA, 25 bp, Mus musculus
agacagcctacggtggatcatgggc

SEQ ID NO: 187587 - DNA, 25 bp, Mus musculus
agacagcctgccccgcgagaaaggg

SEQ ID NO: 187588 - DNA, 25 bp, Mus musculus
agacagcctgccgagggagcgggac

SEQ ID NO: 187589 - DNA, 25 bp, Mus musculus
agacagcgaagggctcacaactcag

SEQ ID NO: 187590 - DNA, 25 bp, Mus musculus
agacagcgaggtggattaagtttga

SEQ ID NO: 187591 - DNA, 25 bp, Mus musculus
agacagcggcagacactctgggttc

SEQ ID NO: 187592 - DNA, 25 bp, Mus musculus
agacagcggccctggcccagcgcct

SEQ ID NO: 187593 - DNA, 25 bp, Mus musculus
agacagctccagtttttcagccgtg

SEQ ID NO: 187594 - DNA, 25 bp, Mus musculus
agacagctccagtttttcaggaatc

SEQ ID NO: 187595 - DNA, 25 bp, Mus musculus
agacagctcttgctgtttccaaatt

SEQ ID NO: 187596 - DNA, 25 bp, Mus musculus
agacagctgcagtgcttacagacac

SEQ ID NO: 187597 - DNA, 25 bp, Mus musculus
agacagctggcagaactcaacaaaa

SEQ ID NO: 187598 - DNA, 25 bp, Mus musculus
agacaggaacgaccgtgctatgttt

SEQ ID NO: 187599 - DNA, 25 bp, Mus musculus
agacaggaactgaggctccggaggg

SEQ ID NO: 187600 - DNA, 25 bp, Mus musculus
agacaggaccagcaatggcaagccg

SEQ ID NO: 187601 - DNA, 25 bp, Mus musculus
agacaggagactctaaagttgcagc

SEQ ID NO: 187602 - DNA, 25 bp, Mus musculus
agacaggagactctgtcttcctgtg

SEQ ID NO: 187603 - DNA, 25 bp, Mus musculus
agacaggagagatgagacaccaatt

SEQ ID NO: 187604 - DNA, 25 bp, Mus musculus
agacaggcaggacaggtcctggaag

SEQ ID NO: 187605 - DNA, 25 bp, Mus musculus
agacaggcaggctaggttcctccgg

SEQ ID NO: 187606 - DNA, 25 bp, Mus musculus
agacaggcagtcatttgaagactga

SEQ ID NO: 187607 - DNA, 25 bp, Mus musculus
agacaggcatccaagagcaactggt

SEQ ID NO: 187608 - DNA, 25 bp, Mus musculus
agacaggcatccaagcaagcgaaga

SEQ ID NO: 187609 - DNA, 25 bp, Mus musculus
agacaggcctagtgccaaaccagag

SEQ ID NO: 187610 - DNA, 25 bp, Mus musculus
agacaggctatgaggtacatccctg

SEQ ID NO: 187611 - DNA, 25 bp, Mus musculus
agacagggaagtaggctgaaccttc

SEQ ID NO: 187612 - DNA, 25 bp, Mus musculus
agacagggtgctggttggtggcact

SEQ ID NO: 187613 - DNA, 25 bp, Mus musculus
agacagggtgtggtgggccgagccg

SEQ ID NO: 187614 - DNA, 25 bp, Mus musculus
agacaggtaacagtgtcagctgact

SEQ ID NO: 187615 - DNA, 25 bp, Mus musculus
agacaggtaacagtttcggccgagt

SEQ ID NO: 187616 - DNA, 25 bp, Mus musculus
agacaggtttaggaatcactgggcc

SEQ ID NO: 187617 - DNA, 25 bp, Mus musculus
agacagtacagaggctttttcaggg

SEQ ID NO: 187618 - DNA, 25 bp, Mus musculus
agacagtacagaggtctatggccag

SEQ ID NO: 187619 - DNA, 25 bp, Mus musculus
agacagtagaggctccgcaggaggc

SEQ ID NO: 187620 - DNA, 25 bp, Mus musculus
agacagtagcttagcatggtttatt

SEQ ID NO: 187621 - DNA, 25 bp, Mus musculus
agacagtcaggatggtgtcacattt

SEQ ID NO: 187622 - DNA, 25 bp, Mus musculus
agacagtctgaggaagcctaacctg

SEQ ID NO: 187623 - DNA, 25 bp, Mus musculus
agacagtctgaggtgtcttcagaag

SEQ ID NO: 187624 - DNA, 25 bp, Mus musculus
agacagtcttcggacatagactgac

SEQ ID NO: 187625 - DNA, 25 bp, Mus musculus
agacagtgacagccctggagatgga

SEQ ID NO: 187626 - DNA, 25 bp, Mus musculus
agacagtgacccagttgacatccga

SEQ ID NO: 187627 - DNA, 25 bp, Mus musculus
agacagtgacggccctggagatgga

SEQ ID NO: 187628 - DNA, 25 bp, Mus musculus
agacagtgaggggaaacaggcactt

SEQ ID NO: 187629 - DNA, 25 bp, Mus musculus
agacagttacggtaaattctacata

SEQ ID NO: 187630 - DNA, 25 bp, Mus musculus
agacagttacggtatgcttccctgt

SEQ ID NO: 187631 - DNA, 25 bp, Mus musculus
agacataatgaaggtttatggaggt

SEQ ID NO: 187632 - DNA, 25 bp, Mus musculus
agacatacaacatgctgttgtgaac

SEQ ID NO: 187633 - DNA, 25 bp, Mus musculus
agacatacaggtgtaaggtctgccc

SEQ ID NO: 187634 - DNA, 25 bp, Mus musculus
agacatacagtatgctcctgaagtt

SEQ ID NO: 187635 - DNA, 25 bp, Mus musculus
agacatagagacctaccttctggag

SEQ ID NO: 187636 - DNA, 25 bp, Mus musculus
agacatagctgcttggaagttggca

SEQ ID NO: 187637 - DNA, 25 bp, Mus musculus
agacataggaagatcaccagcaaaa

SEQ ID NO: 187638 - DNA, 25 bp, Mus musculus
agacatatagagcagtaccaaatat

SEQ ID NO: 187639 - DNA, 25 bp, Mus musculus
agacatatgggctgatgtgatggcg

SEQ ID NO: 187640 - DNA, 25 bp, Mus musculus
agacatatgggtggagccttttgcc

SEQ ID NO: 187641 - DNA, 25 bp, Mus musculus
agacatcaagagttctaacgtgctt

SEQ ID NO: 187642 - DNA, 25 bp, Mus musculus
agacatcaaggcagaagacttattt

SEQ ID NO: 187643 - DNA, 25 bp, Mus musculus
agacatcagaagactcaaatggtca

SEQ ID NO: 187644 - DNA, 25 bp, Mus musculus
agacatcagaagatggtgaggattc

SEQ ID NO: 187645 - DNA, 25 bp, Mus musculus
agacatcagaagttttagagcgaaa

SEQ ID NO: 187646 - DNA, 25 bp, Mus musculus
agacatcagcagcccagtggtactg

SEQ ID NO: 187647 - DNA, 25 bp, Mus musculus
agacatcagcatcgtgtttactcca

SEQ ID NO: 187648 - DNA, 25 bp, Mus musculus
agacatcagtgagaaagtggacacc

SEQ ID NO: 187649 - DNA, 25 bp, Mus musculus
agacatcatcacaggagcgaggcac

SEQ ID NO: 187650 - DNA, 25 bp, Mus musculus
agacatccagaaactgaaggatgag

SEQ ID NO: 187651 - DNA, 25 bp, Mus musculus
agacatccagccggatggcgcagaa

SEQ ID NO: 187652 - DNA, 25 bp, Mus musculus
agacatccaggccaggtacatctat

SEQ ID NO: 187653 - DNA, 25 bp, Mus musculus
agacatccatccgcgaggaaatctc

SEQ ID NO: 187654 - DNA, 25 bp, Mus musculus
agacatccctgactaaggctggacc

SEQ ID NO: 187655 - DNA, 25 bp, Mus musculus
agacatccgagagctagcccaccag

SEQ ID NO: 187656 - DNA, 25 bp, Mus musculus
agacatccgagaggccatcaaaaac

SEQ ID NO: 187657 - DNA, 25 bp, Mus musculus
agacatcctaagatcaaacaaatat

SEQ ID NO: 187658 - DNA, 25 bp, Mus musculus
agacatcctaaggtcctcggcccag

SEQ ID NO: 187659 - DNA, 25 bp, Mus musculus
agacatcctcatgatctcggaccta

SEQ ID NO: 187660 - DNA, 25 bp, Mus musculus
agacatcctcatgtatgtggtcatc

SEQ ID NO: 187661 - DNA, 25 bp, Mus musculus
agacatcgctgaccctgtctctaca

SEQ ID NO: 187662 - DNA, 25 bp, Mus musculus
agacatctactaaaccgcccagaat

SEQ ID NO: 187663 - DNA, 25 bp, Mus musculus
agacatctatctcggtacggacatt

SEQ ID NO: 187664 - DNA, 25 bp, Mus musculus
agacatctatctcgtttttcaaaac

SEQ ID NO: 187665 - DNA, 25 bp, Mus musculus
agacatctatgaggaccggcacgat

SEQ ID NO: 187666 - DNA, 25 bp, Mus musculus
agacatctatgcagtgaatgggatt

SEQ ID NO: 187667 - DNA, 25 bp, Mus musculus
agacatctcagagcctgggacctgg

SEQ ID NO: 187668 - DNA, 25 bp, Mus musculus
agacatctcaggaggctgcggggcc

SEQ ID NO: 187669 - DNA, 25 bp, Mus musculus
agacatctcatgggtttgtggatgc

SEQ ID NO: 187670 - DNA, 25 bp, Mus musculus
agacatctgcaagtgcacgttggtt

SEQ ID NO: 187671 - DNA, 25 bp, Mus musculus
agacatcttacatgctctgaagatg

SEQ ID NO: 187672 - DNA, 25 bp, Mus musculus
agacatcttcaggcgctttggccgt

SEQ ID NO: 187673 - DNA, 25 bp, Mus musculus
agacatgaagaaatattatcacaaa

SEQ ID NO: 187674 - DNA, 25 bp, Mus musculus
agacatgaaggcctttgttgaaaat

SEQ ID NO: 187675 - DNA, 25 bp, Mus musculus
agacatgaggatgcagagagaaatt

SEQ ID NO: 187676 - DNA, 25 bp, Mus musculus
agacatgcactccaccacgcagctg

SEQ ID NO: 187677 - DNA, 25 bp, Mus musculus
agacatgcactccgcttacaagcac

SEQ ID NO: 187678 - DNA, 25 bp, Mus musculus
agacatgcagcctctatttaaggtg

SEQ ID NO: 187679 - DNA, 25 bp, Mus musculus
agacatgctcgcagaaaaagcagcg

SEQ ID NO: 187680 - DNA, 25 bp, Mus musculus
agacatgctggatagtctcactacc

SEQ ID NO: 187681 - DNA, 25 bp, Mus musculus
agacatggaagggctgggactgctc

SEQ ID NO: 187682 - DNA, 25 bp, Mus musculus
agacatggatctggtgtgagtgttg

SEQ ID NO: 187683 - DNA, 25 bp, Mus musculus
agacatggcggagtcttctgagtct

SEQ ID NO: 187684 - DNA, 25 bp, Mus musculus
agacatgggatacaaagtcctctca

SEQ ID NO: 187685 - DNA, 25 bp, Mus musculus
agacatgggatacaagaacaatttt

SEQ ID NO: 187686 - DNA, 25 bp, Mus musculus
agacatgtacgatggctttctgtct

SEQ ID NO: 187687 - DNA, 25 bp, Mus musculus
agacatgtattcgtaacaataaagt

SEQ ID NO: 187688 - DNA, 25 bp, Mus musculus
agacatgtcagcttctctgtccact

SEQ ID NO: 187689 - DNA, 25 bp, Mus musculus
agacatgtgtgtgaggaggttcccc

SEQ ID NO: 187690 - DNA, 25 bp, Mus musculus
agacattaaagggtatagtgccaaa

SEQ ID NO: 187691 - DNA, 25 bp, Mus musculus
agacattacaaagcctcccagacta

SEQ ID NO: 187692 - DNA, 25 bp, Mus musculus
agacattaccaatggacgcatcgtt

SEQ ID NO: 187693 - DNA, 25 bp, Mus musculus
agacattagaagatctcaggaaaaa

SEQ ID NO: 187694 - DNA, 25 bp, Mus musculus
agacattatggaggacactatcgaa

SEQ ID NO: 187695 - DNA, 25 bp, Mus musculus
agacattcacgattgttggtgacgc

SEQ ID NO: 187696 - DNA, 25 bp, Mus musculus
agacattcagagccacaggcaccat

SEQ ID NO: 187697 - DNA, 25 bp, Mus musculus
agacattccagatgtctggccagtc

SEQ ID NO: 187698 - DNA, 25 bp, Mus musculus
agacattccaggtttcgtcttgata

SEQ ID NO: 187699 - DNA, 25 bp, Mus musculus
agacattcgacaggggaatggtttg

SEQ ID NO: 187700 - DNA, 25 bp, Mus musculus
agacattctgaagatactaagcaac

SEQ ID NO: 187701 - DNA, 25 bp, Mus musculus
agacattctgaagatgtgggcacat

SEQ ID NO: 187702 - DNA, 25 bp, Mus musculus
agacattctgaaggatttgacgttg

SEQ ID NO: 187703 - DNA, 25 bp, Mus musculus
agacattctggagccagcagggcct

SEQ ID NO: 187704 - DNA, 25 bp, Mus musculus
agacattctggagggatgagacacc

SEQ ID NO: 187705 - DNA, 25 bp, Mus musculus
agacattcttgaggtggagtctttc

SEQ ID NO: 187706 - DNA, 25 bp, Mus musculus
agacattgaaggagttaaagaccag

SEQ ID NO: 187707 - DNA, 25 bp, Mus musculus
agacattgagactttctttggggta

SEQ ID NO: 187708 - DNA, 25 bp, Mus musculus
agacattgagcaggcatacaaatgc

SEQ ID NO: 187709 - DNA, 25 bp, Mus musculus
agacattgaggcaccacctaccctg

SEQ ID NO: 187710 - DNA, 25 bp, Mus musculus
agacattgagggtcacttttcatat

SEQ ID NO: 187711 - DNA, 25 bp, Mus musculus
agacattgatgacctttggcaagaa

SEQ ID NO: 187712 - DNA, 25 bp, Mus musculus
agacattgcaccagatcacagaact

SEQ ID NO: 187713 - DNA, 25 bp, Mus musculus
agacattgcagaggatttttgcagc

SEQ ID NO: 187714 - DNA, 25 bp, Mus musculus
agacattgcagaggggctacatgac

SEQ ID NO: 187715 - DNA, 25 bp, Mus musculus
agacattgccagccttggggagttc

SEQ ID NO: 187716 - DNA, 25 bp, Mus musculus
agacattgctacagctgcacagagc

SEQ ID NO: 187717 - DNA, 25 bp, Mus musculus
agacattgctagcatttgaagacat

SEQ ID NO: 187718 - DNA, 25 bp, Mus musculus
agacattggacggaagaagtcccag

SEQ ID NO: 187719 - DNA, 25 bp, Mus musculus
agacattggcgtatttgctgcctgc

SEQ ID NO: 187720 - DNA, 25 bp, Mus musculus
agacattgtggagacattgagaaag

SEQ ID NO: 187721 - DNA, 25 bp, Mus musculus
agacattgtggaggcattgaacaag

SEQ ID NO: 187722 - DNA, 25 bp, Mus musculus
agacatttatggtggttatgctgcg

SEQ ID NO: 187723 - DNA, 25 bp, Mus musculus
agacatttcaagaagacagcatccc

SEQ ID NO: 187724 - DNA, 25 bp, Mus musculus
agacatttcaagctcttagcccccc

SEQ ID NO: 187725 - DNA, 25 bp, Mus musculus
agacatttccctgatagattgctaa

SEQ ID NO: 187726 - DNA, 25 bp, Mus musculus
agacatttctggggacacccagaaa

SEQ ID NO: 187727 - DNA, 25 bp, Mus musculus
agacattttagcaggttttctgatt

SEQ ID NO: 187728 - DNA, 25 bp, Mus musculus
agaccaaaacgccagccacctgcta

SEQ ID NO: 187729 - DNA, 25 bp, Mus musculus
agaccaaaacgggggagcagtgcct

SEQ ID NO: 187730 - DNA, 25 bp, Mus musculus
agaccaaaagcccttgccagagtgg

SEQ ID NO: 187731 - DNA, 25 bp, Mus musculus
agaccaaaccgcaggcaatactagc

SEQ ID NO: 187732 - DNA, 25 bp, Mus musculus
agaccaaaccgcaggtataatcaaa

SEQ ID NO: 187733 - DNA, 25 bp, Mus musculus
agaccaaactggatcccactgacct

SEQ ID NO: 187734 - DNA, 25 bp, Mus musculus
agaccaaactgttgattggtgctga

SEQ ID NO: 187735 - DNA, 25 bp, Mus musculus
agaccaaagaagagagggaacttca

SEQ ID NO: 187736 - DNA, 25 bp, Mus musculus
agaccaaagatgggttaatatcctt

SEQ ID NO: 187737 - DNA, 25 bp, Mus musculus
agaccaaatacaatgacccctgaca

SEQ ID NO: 187738 - DNA, 25 bp, Mus musculus
agaccaaatacaatgccctcaagac

SEQ ID NO: 187739 - DNA, 25 bp, Mus musculus
agaccaaatgggaggtgtgtcagaa

SEQ ID NO: 187740 - DNA, 25 bp, Mus musculus
agaccaacaaatagctgtatgaaaa

SEQ ID NO: 187741 - DNA, 25 bp, Mus musculus
agaccaacaaatgacaccgtacatg

SEQ ID NO: 187742 - DNA, 25 bp, Mus musculus
agaccaacagacctgatagcaagaa

SEQ ID NO: 187743 - DNA, 25 bp, Mus musculus
agaccaacagcaagaactggcagta

SEQ ID NO: 187744 - DNA, 25 bp, Mus musculus
agaccaaccattgtaaaacttatgg

SEQ ID NO: 187745 - DNA, 25 bp, Mus musculus
agaccaaccgagtcatttaaggctg

SEQ ID NO: 187746 - DNA, 25 bp, Mus musculus
agaccaacttgagaattggacagcg

SEQ ID NO: 187747 - DNA, 25 bp, Mus musculus
agaccaacttgagagtgacttctgc

SEQ ID NO: 187748 - DNA, 25 bp, Mus musculus
agaccaagacccacatctggcaagt

SEQ ID NO: 187749 - DNA, 25 bp, Mus musculus
agaccaagagaccacagcagtttag

SEQ ID NO: 187750 - DNA, 25 bp, Mus musculus
agaccaagagcaagaccaggtgcta

SEQ ID NO: 187751 - DNA, 25 bp, Mus musculus
agaccaagagcaaggcgacggtgtg

SEQ ID NO: 187752 - DNA, 25 bp, Mus musculus
agaccaagaggttgaaaggaaatgt

SEQ ID NO: 187753 - DNA, 25 bp, Mus musculus
agaccaagatccagatcttactcta

SEQ ID NO: 187754 - DNA, 25 bp, Mus musculus
agaccaagatcctaaaaatactctt

SEQ ID NO: 187755 - DNA, 25 bp, Mus musculus
agaccaagatgatagggatgcaaac

SEQ ID NO: 187756 - DNA, 25 bp, Mus musculus
agaccaagatggaggagatcgggcg

SEQ ID NO: 187757 - DNA, 25 bp, Mus musculus
agaccaagatggaggagattgggag

SEQ ID NO: 187758 - DNA, 25 bp, Mus musculus
agaccaagcaccagaatgcaagggt

SEQ ID NO: 187759 - DNA, 25 bp, Mus musculus
agaccaagcaccagctgcgatacta

SEQ ID NO: 187760 - DNA, 25 bp, Mus musculus
agaccaagcgctggaaggtaggccc

SEQ ID NO: 187761 - DNA, 25 bp, Mus musculus
agaccaagcggatctctttcctgca

SEQ ID NO: 187762 - DNA, 25 bp, Mus musculus
agaccaaggaacagatcctgaagct

SEQ ID NO: 187763 - DNA, 25 bp, Mus musculus
agaccaaggaccagactttgaagaa

SEQ ID NO: 187764 - DNA, 25 bp, Mus musculus
agaccaaggaccaggagatccagac

SEQ ID NO: 187765 - DNA, 25 bp, Mus musculus
agaccaaggtgacaggaccctttgg

SEQ ID NO: 187766 - DNA, 25 bp, Mus musculus
agaccaatgtgaagatatcaatgaa

SEQ ID NO: 187767 - DNA, 25 bp, Mus musculus
agaccaatgtgaagatattgatgaa

SEQ ID NO: 187768 - DNA, 25 bp, Mus musculus
agaccacaaagctagggaagaagat

SEQ ID NO: 187769 - DNA, 25 bp, Mus musculus
agaccacaaatgggcgacttccagt

SEQ ID NO: 187770 - DNA, 25 bp, Mus musculus
agaccacaagccggtgttcctggcc

SEQ ID NO: 187771 - DNA, 25 bp, Mus musculus
agaccacacagagacttgaaaatcg

SEQ ID NO: 187772 - DNA, 25 bp, Mus musculus
agaccacacagagtttatggttcac

SEQ ID NO: 187773 - DNA, 25 bp, Mus musculus
agaccacagatgaagagcaagtaca

SEQ ID NO: 187774 - DNA, 25 bp, Mus musculus
agaccacagatgaagatcttcagga

SEQ ID NO: 187775 - DNA, 25 bp, Mus musculus
agaccacaggaaaggggaatgtgac

SEQ ID NO: 187776 - DNA, 25 bp, Mus musculus
agaccacagtaaggtgtaacacggc

SEQ ID NO: 187777 - DNA, 25 bp, Mus musculus
agaccacagtttctgctgcagttct

SEQ ID NO: 187778 - DNA, 25 bp, Mus musculus
agaccacccaggctttaaagatcct

SEQ ID NO: 187779 - DNA, 25 bp, Mus musculus
agaccacctggacaggtcggaagct

SEQ ID NO: 187780 - DNA, 25 bp, Mus musculus
agaccacgaggagctgaaggaccag

SEQ ID NO: 187781 - DNA, 25 bp, Mus musculus
agaccacgcagaggaaagatggtcc

SEQ ID NO: 187782 - DNA, 25 bp, Mus musculus
agaccacgcagagggaaggtgtgaa

SEQ ID NO: 187783 - DNA, 25 bp, Mus musculus
agaccactgatgagagaggtcctcc

SEQ ID NO: 187784 - DNA, 25 bp, Mus musculus
agaccactgcccagattttcactgt

SEQ ID NO: 187785 - DNA, 25 bp, Mus musculus
agaccactggactgcatggtctgag

SEQ ID NO: 187786 - DNA, 25 bp, Mus musculus
agaccactggttgagatcctcttta

SEQ ID NO: 187787 - DNA, 25 bp, Mus musculus
agaccactggttgagggcaatggca

SEQ ID NO: 187788 - DNA, 25 bp, Mus musculus
agaccactgtgaggatatcaatgaa

SEQ ID NO: 187789 - DNA, 25 bp, Mus musculus
agaccacttaggaggcacatagaca

SEQ ID NO: 187790 - DNA, 25 bp, Mus musculus
agaccacttgccatgcataatcttg

SEQ ID NO: 187791 - DNA, 25 bp, Mus musculus
agaccacttgtgccggtcccgcctg

SEQ ID NO: 187792 - DNA, 25 bp, Mus musculus
agaccagaaacggatgggctgtatg

SEQ ID NO: 187793 - DNA, 25 bp, Mus musculus
agaccagaactaaagggcttgttgt

SEQ ID NO: 187794 - DNA, 25 bp, Mus musculus
agaccagaagattcgtaagacagaa

SEQ ID NO: 187795 - DNA, 25 bp, Mus musculus
agaccagaagctctgactatgcatc

SEQ ID NO: 187796 - DNA, 25 bp, Mus musculus
agaccagaatcagaacattgtcctt

SEQ ID NO: 187797 - DNA, 25 bp, Mus musculus
agaccagaatcagagctgatcataa

SEQ ID NO: 187798 - DNA, 25 bp, Mus musculus
agaccagactgaggctgtgtttcaa

SEQ ID NO: 187799 - DNA, 25 bp, Mus musculus
agaccagcaaaaaatgctatcagaa

SEQ ID NO: 187800 - DNA, 25 bp, Mus musculus
agaccagcaaactgcctactcgccc

SEQ ID NO: 187801 - DNA, 25 bp, Mus musculus
agaccagcaaactgcggggactgaa

SEQ ID NO: 187802 - DNA, 25 bp, Mus musculus
agaccagcaaactggcaccgacagc

SEQ ID NO: 187803 - DNA, 25 bp, Mus musculus
agaccagcaaagccaaacccatgcg

SEQ ID NO: 187804 - DNA, 25 bp, Mus musculus
agaccagcagaacgagatggtgcgg

SEQ ID NO: 187805 - DNA, 25 bp, Mus musculus
agaccagcagactgtaaaacagact

SEQ ID NO: 187806 - DNA, 25 bp, Mus musculus
agaccagcagactttctcctgtcta

SEQ ID NO: 187807 - DNA, 25 bp, Mus musculus
agaccagcagagacgttcacagcct

SEQ ID NO: 187808 - DNA, 25 bp, Mus musculus
agaccagcagcccagagtatgttcc

SEQ ID NO: 187809 - DNA, 25 bp, Mus musculus
agaccagcaggctagatatggattt

SEQ ID NO: 187810 - DNA, 25 bp, Mus musculus
agaccagcaggttacagtcgggctt

SEQ ID NO: 187811 - DNA, 25 bp, Mus musculus
agaccagcggcaagcctgagactgg

SEQ ID NO: 187812 - DNA, 25 bp, Mus musculus
agaccagctaagggtgtcagggtca

SEQ ID NO: 187813 - DNA, 25 bp, Mus musculus
agaccaggcagcgagtactaacagt

SEQ ID NO: 187814 - DNA, 25 bp, Mus musculus
agaccaggcagggtctcctggaaga

SEQ ID NO: 187815 - DNA, 25 bp, Mus musculus
agaccagggaggtgactgacttaca

SEQ ID NO: 187816 - DNA, 25 bp, Mus musculus
agaccaggtaagacccctgggcctc

SEQ ID NO: 187817 - DNA, 25 bp, Mus musculus
agaccaggtggcaggtatttccccc

SEQ ID NO: 187818 - DNA, 25 bp, Mus musculus
agaccaggtggttcgccctagtcga

SEQ ID NO: 187819 - DNA, 25 bp, Mus musculus
agaccagtcactatgtgctgtgagt

SEQ ID NO: 187820 - DNA, 25 bp, Mus musculus
agaccagttgctcaggcagtgcttt

SEQ ID NO: 187821 - DNA, 25 bp, Mus musculus
agaccatacagtcgtttacccttcg

SEQ ID NO: 187822 - DNA, 25 bp, Mus musculus
agaccataggacaaggatgagagcg

SEQ ID NO: 187823 - DNA, 25 bp, Mus musculus
agaccatcaaggcactagatgggga

SEQ ID NO: 187824 - DNA, 25 bp, Mus musculus
agaccatcaccctggaggtcgagcc

SEQ ID NO: 187825 - DNA, 25 bp, Mus musculus
agaccatcagattatgggacagtcg

SEQ ID NO: 187826 - DNA, 25 bp, Mus musculus
agaccatcatgcacatccaggaccc

SEQ ID NO: 187827 - DNA, 25 bp, Mus musculus
agaccatccaggtgagcctcatgtt

SEQ ID NO: 187828 - DNA, 25 bp, Mus musculus
agaccatcctagtcatgggagactt

SEQ ID NO: 187829 - DNA, 25 bp, Mus musculus
agaccatcggcaaggttcagaagaa

SEQ ID NO: 187830 - DNA, 25 bp, Mus musculus
agaccatctccggtcctggcttaac

SEQ ID NO: 187831 - DNA, 25 bp, Mus musculus
agaccatctctagatctccattcgg

SEQ ID NO: 187832 - DNA, 25 bp, Mus musculus
agaccatgaagggctgccaacagtg

SEQ ID NO: 187833 - DNA, 25 bp, Mus musculus
agaccatgaagttggacaacttttc

SEQ ID NO: 187834 - DNA, 25 bp, Mus musculus
agaccatgaccaaggatgaacagca

SEQ ID NO: 187835 - DNA, 25 bp, Mus musculus
agaccatgcaagtgaacgaagcttt

SEQ ID NO: 187836 - DNA, 25 bp, Mus musculus
agaccatgcaagtggaaagtacgca

SEQ ID NO: 187837 - DNA, 25 bp, Mus musculus
agaccatggaagagatctgtgaagg

SEQ ID NO: 187838 - DNA, 25 bp, Mus musculus
agaccatggggccgaggaggacaag

SEQ ID NO: 187839 - DNA, 25 bp, Mus musculus
agaccatggtcatcggaaattaccg

SEQ ID NO: 187840 - DNA, 25 bp, Mus musculus
agaccatggtcatcggcaactatcg

SEQ ID NO: 187841 - DNA, 25 bp, Mus musculus
agaccatggtgagcccattggccgg

SEQ ID NO: 187842 - DNA, 25 bp, Mus musculus
agaccatgtgattctggaggagcaa

SEQ ID NO: 187843 - DNA, 25 bp, Mus musculus
agaccattacagaagctgaaccgga

SEQ ID NO: 187844 - DNA, 25 bp, Mus musculus
agaccattgagactgacaatttatt

SEQ ID NO: 187845 - DNA, 25 bp, Mus musculus
agaccattgagactgccaaacaaga

SEQ ID NO: 187846 - DNA, 25 bp, Mus musculus
agaccattggagaaggagaggaata

SEQ ID NO: 187847 - DNA, 25 bp, Mus musculus
agacccaaaagcagaatacagacat

SEQ ID NO: 187848 - DNA, 25 bp, Mus musculus
agacccaaaagtttgaggatagcca

SEQ ID NO: 187849 - DNA, 25 bp, Mus musculus
agacccaaacggatgaaaaccgtca

SEQ ID NO: 187850 - DNA, 25 bp, Mus musculus
agacccaaagcgtctgatggctata

SEQ ID NO: 187851 - DNA, 25 bp, Mus musculus
agacccaaagtccaggatgttgtac

SEQ ID NO: 187852 - DNA, 25 bp, Mus musculus
agacccaacgttcagaaccccaaat

SEQ ID NO: 187853 - DNA, 25 bp, Mus musculus
agacccaactgtcgacgcataatta

SEQ ID NO: 187854 - DNA, 25 bp, Mus musculus
agacccaagacaagttcgagaaatg

SEQ ID NO: 187855 - DNA, 25 bp, Mus musculus
agacccacaccacgactactgtgaa

SEQ ID NO: 187856 - DNA, 25 bp, Mus musculus
agacccacacctcacaaattgaagt

SEQ ID NO: 187857 - DNA, 25 bp, Mus musculus
agacccacagacttccaaattgaga

SEQ ID NO: 187858 - DNA, 25 bp, Mus musculus
agacccacagaggctcccaaacacc

SEQ ID NO: 187859 - DNA, 25 bp, Mus musculus
agacccacaggaaacaccagctggc

SEQ ID NO: 187860 - DNA, 25 bp, Mus musculus
agacccacatggaatggacctgtca

SEQ ID NO: 187861 - DNA, 25 bp, Mus musculus
agacccacgcaaactacagctgaat

SEQ ID NO: 187862 - DNA, 25 bp, Mus musculus
agacccagagaacaggctgtgaaaa

SEQ ID NO: 187863 - DNA, 25 bp, Mus musculus
agacccagaggacacaaagatcgag

SEQ ID NO: 187864 - DNA, 25 bp, Mus musculus
agacccagaggagaaggaggagcag

SEQ ID NO: 187865 - DNA, 25 bp, Mus musculus
agacccagaggagattgagaaggag

SEQ ID NO: 187866 - DNA, 25 bp, Mus musculus
agacccagaggaggaagagtttgcc

SEQ ID NO: 187867 - DNA, 25 bp, Mus musculus
agacccagcagaataactgccatgg

SEQ ID NO: 187868 - DNA, 25 bp, Mus musculus
agacccagcatacgggcaccttgtt

SEQ ID NO: 187869 - DNA, 25 bp, Mus musculus
agacccagccagggttgtcgccctg

SEQ ID NO: 187870 - DNA, 25 bp, Mus musculus
agacccagcccagaacaagcctgcc

SEQ ID NO: 187871 - DNA, 25 bp, Mus musculus
agacccagcccaggtgaggaatttt

SEQ ID NO: 187872 - DNA, 25 bp, Mus musculus
agacccagcccaggttccgagtccg

SEQ ID NO: 187873 - DNA, 25 bp, Mus musculus
agacccaggagggtgtctccaaaca

SEQ ID NO: 187874 - DNA, 25 bp, Mus musculus
agacccaggctaggttatcaatgct

SEQ ID NO: 187875 - DNA, 25 bp, Mus musculus
agacccagtctaaaatcgatgtcca

SEQ ID NO: 187876 - DNA, 25 bp, Mus musculus
agacccagtctaacacagaggagat

SEQ ID NO: 187877 - DNA, 25 bp, Mus musculus
agacccatcagaagtcctaggtact

SEQ ID NO: 187878 - DNA, 25 bp, Mus musculus
agacccatctttcgactaagatgct

SEQ ID NO: 187879 - DNA, 25 bp, Mus musculus
agacccattgagaagagatgaggct

SEQ ID NO: 187880 - DNA, 25 bp, Mus musculus
agacccattgtgccccaattcctgc

SEQ ID NO: 187881 - DNA, 25 bp, Mus musculus
agaccccaaaggagccaagtcagaa

SEQ ID NO: 187882 - DNA, 25 bp, Mus musculus
agaccccaagagaagggagtggatc

SEQ ID NO: 187883 - DNA, 25 bp, Mus musculus
agaccccaagagagacaacaatcct

SEQ ID NO: 187884 - DNA, 25 bp, Mus musculus
agaccccacgtgatggagtatcccg

SEQ ID NO: 187885 - DNA, 25 bp, Mus musculus
agaccccactcagagatgctgagcc

SEQ ID NO: 187886 - DNA, 25 bp, Mus musculus
agaccccactgactcatcccaggaa

SEQ ID NO: 187887 - DNA, 25 bp, Mus musculus
agaccccagcaaaggctaattctgg

SEQ ID NO: 187888 - DNA, 25 bp, Mus musculus
agaccccagcctatggtatcgctgg

SEQ ID NO: 187889 - DNA, 25 bp, Mus musculus
agaccccagcctccgcatgagcatc

SEQ ID NO: 187890 - DNA, 25 bp, Mus musculus
agaccccagtcagggtctggaggtg

SEQ ID NO: 187891 - DNA, 25 bp, Mus musculus
agaccccagtggtctctctggactt

SEQ ID NO: 187892 - DNA, 25 bp, Mus musculus
agaccccatcagacggaactggtgt

SEQ ID NO: 187893 - DNA, 25 bp, Mus musculus
agaccccatcagacggtatcgagtg

SEQ ID NO: 187894 - DNA, 25 bp, Mus musculus
agaccccattgagctcatgtttgct

SEQ ID NO: 187895 - DNA, 25 bp, Mus musculus
agaccccattgagctggtggttttc

SEQ ID NO: 187896 - DNA, 25 bp, Mus musculus
agaccccatttgggttccagtgcat

SEQ ID NO: 187897 - DNA, 25 bp, Mus musculus
agacccccgagaaaccagctcttcg

SEQ ID NO: 187898 - DNA, 25 bp, Mus musculus
agacccccgctgcaggctttgcttt

SEQ ID NO: 187899 - DNA, 25 bp, Mus musculus
agacccccgctggtctcagctatcc

SEQ ID NO: 187900 - DNA, 25 bp, Mus musculus
agacccccgctgttggagacaggag

SEQ ID NO: 187901 - DNA, 25 bp, Mus musculus
agacccccttgtgaacgaggctgct

SEQ ID NO: 187902 - DNA, 25 bp, Mus musculus
agaccccgcagctcttggcaagtat

SEQ ID NO: 187903 - DNA, 25 bp, Mus musculus
agaccccgcaggagacatatgaaaa

SEQ ID NO: 187904 - DNA, 25 bp, Mus musculus
agaccccgctcaggccccgcgatca

SEQ ID NO: 187905 - DNA, 25 bp, Mus musculus
agaccccgctcaggtttccaggctt

SEQ ID NO: 187906 - DNA, 25 bp, Mus musculus
agaccccgggcaggtttagacacgt

SEQ ID NO: 187907 - DNA, 25 bp, Mus musculus
agaccccttccaaggtgatcctttc

SEQ ID NO: 187908 - DNA, 25 bp, Mus musculus
agaccccttggaggagaggatgctt

SEQ ID NO: 187909 - DNA, 25 bp, Mus musculus
agaccccttgtatccagacttcagt

SEQ ID NO: 187910 - DNA, 25 bp, Mus musculus
agacccctttaggtgttccgaatgc

SEQ ID NO: 187911 - DNA, 25 bp, Mus musculus
agacccgcgcggcccgcgcagccgc

SEQ ID NO: 187912 - DNA, 25 bp, Mus musculus
agacccgcgcgggcccacactcgct

SEQ ID NO: 187913 - DNA, 25 bp, Mus musculus
agacccgctgtctgggaagagcatg

SEQ ID NO: 187914 - DNA, 25 bp, Mus musculus
agacccggccccagcatctgggtgg

SEQ ID NO: 187915 - DNA, 25 bp, Mus musculus
agacccgggaccgggagctgctgca

SEQ ID NO: 187916 - DNA, 25 bp, Mus musculus
agacccgtcagaagccactccgtgt

SEQ ID NO: 187917 - DNA, 25 bp, Mus musculus
agaccctaagtctccccatgcccta

SEQ ID NO: 187918 - DNA, 25 bp, Mus musculus
agaccctacatggcttccttcccag

SEQ ID NO: 187919 - DNA, 25 bp, Mus musculus
agaccctcacctccacgccctaatc

SEQ ID NO: 187920 - DNA, 25 bp, Mus musculus
agaccctcatatagaaaaatactga

SEQ ID NO: 187921 - DNA, 25 bp, Mus musculus
agaccctcatccagcatttccaagc

SEQ ID NO: 187922 - DNA, 25 bp, Mus musculus
agaccctccaggtagtccaggggca

SEQ ID NO: 187923 - DNA, 25 bp, Mus musculus
agaccctccccacagagcgcacgcg

SEQ ID NO: 187924 - DNA, 25 bp, Mus musculus
agaccctccctccaactctacaccc

SEQ ID NO: 187925 - DNA, 25 bp, Mus musculus
agaccctccgaccaggagtcaaact

SEQ ID NO: 187926 - DNA, 25 bp, Mus musculus
agaccctcggctcacgcgccctccc

SEQ ID NO: 187927 - DNA, 25 bp, Mus musculus
agaccctctgtgggtgaacgtgggt

SEQ ID NO: 187928 - DNA, 25 bp, Mus musculus
agaccctgaactcaacatggcaagg

SEQ ID NO: 187929 - DNA, 25 bp, Mus musculus
agaccctgaactcaagttcacgcaa

SEQ ID NO: 187930 - DNA, 25 bp, Mus musculus
agaccctgaagagagcagataagat

SEQ ID NO: 187931 - DNA, 25 bp, Mus musculus
agaccctgaagagatgccacctcgg

SEQ ID NO: 187932 - DNA, 25 bp, Mus musculus
agaccctgaaggagctgcctctgca

SEQ ID NO: 187933 - DNA, 25 bp, Mus musculus
agaccctgaattaccggtattgtaa

SEQ ID NO: 187934 - DNA, 25 bp, Mus musculus
agaccctgacagcaagaccatcacc

SEQ ID NO: 187935 - DNA, 25 bp, Mus musculus
agaccctgagctggccaaaaggcca

SEQ ID NO: 187936 - DNA, 25 bp, Mus musculus
agaccctgagctggctctctgacaa

SEQ ID NO: 187937 - DNA, 25 bp, Mus musculus
agaccctgaggaaatggggattaag

SEQ ID NO: 187938 - DNA, 25 bp, Mus musculus
agaccctgagggagcgcttcagcga

SEQ ID NO: 187939 - DNA, 25 bp, Mus musculus
agaccctgataatgcactgctccct

SEQ ID NO: 187940 - DNA, 25 bp, Mus musculus
agaccctgatccagatctggccgcc

SEQ ID NO: 187941 - DNA, 25 bp, Mus musculus
agaccctgcacggctgtggacttaa

SEQ ID NO: 187942 - DNA, 25 bp, Mus musculus
agaccctgcagggagagagaatcaa

SEQ ID NO: 187943 - DNA, 25 bp, Mus musculus
agaccctgccagggatggcgcggcc

SEQ ID NO: 187944 - DNA, 25 bp, Mus musculus
agaccctggacaacaagaaggggcg

SEQ ID NO: 187945 - DNA, 25 bp, Mus musculus
agaccctggagccaccccgctgggg

SEQ ID NO: 187946 - DNA, 25 bp, Mus musculus
agaccctggagggaagggtggtgat

SEQ ID NO: 187947 - DNA, 25 bp, Mus musculus
agaccctgggaagactaaaatgtca

SEQ ID NO: 187948 - DNA, 25 bp, Mus musculus
agaccctggtcaggcagttccaggg

SEQ ID NO: 187949 - DNA, 25 bp, Mus musculus
agaccctggtggcaggatcaagttc

SEQ ID NO: 187950 - DNA, 25 bp, Mus musculus
agaccctggttcctgtctgcagctg

SEQ ID NO: 187951 - DNA, 25 bp, Mus musculus
agaccctgtacagagagctccaagt

SEQ ID NO: 187952 - DNA, 25 bp, Mus musculus
agaccctgtacagagccaccttgtc

SEQ ID NO: 187953 - DNA, 25 bp, Mus musculus
agaccctgtgtcacgaacccctgcc

SEQ ID NO: 187954 - DNA, 25 bp, Mus musculus
agacccttaaagatgaccttgcttc

SEQ ID NO: 187955 - DNA, 25 bp, Mus musculus
agacccttcaaccaggtcaggctgt

SEQ ID NO: 187956 - DNA, 25 bp, Mus musculus
agacccttgaactgaggaacgggca

SEQ ID NO: 187957 - DNA, 25 bp, Mus musculus
agaccgaagacacaagtagaaggca

SEQ ID NO: 187958 - DNA, 25 bp, Mus musculus
agaccgactgaagcacggtgcaaca

SEQ ID NO: 187959 - DNA, 25 bp, Mus musculus
agaccgaggaggcccagccagcaga

SEQ ID NO: 187960 - DNA, 25 bp, Mus musculus
agaccgaggccaaaactgggtttca

SEQ ID NO: 187961 - DNA, 25 bp, Mus musculus
agaccgaggccaaagttcaggacat

SEQ ID NO: 187962 - DNA, 25 bp, Mus musculus
agaccgagtcctcaggccaatgtgc

SEQ ID NO: 187963 - DNA, 25 bp, Mus musculus
agaccgcaggacgcggaaccatgtg

SEQ ID NO: 187964 - DNA, 25 bp, Mus musculus
agaccgccgccaaggctgaagctga

SEQ ID NO: 187965 - DNA, 25 bp, Mus musculus
agaccgcctacacatccaggtggcc

SEQ ID NO: 187966 - DNA, 25 bp, Mus musculus
agaccgcctgcaggtgatttccgat

SEQ ID NO: 187967 - DNA, 25 bp, Mus musculus
agaccgcgctcaaagatccaggtgc

SEQ ID NO: 187968 - DNA, 25 bp, Mus musculus
agaccgcgctcaaaggactgtgtat

SEQ ID NO: 187969 - DNA, 25 bp, Mus musculus
agaccgcgctcaaaggcaaaggagg

SEQ ID NO: 187970 - DNA, 25 bp, Mus musculus
agaccgctgataagaaaaccactga

SEQ ID NO: 187971 - DNA, 25 bp, Mus musculus
agaccgctgtgacaactgccccctg

SEQ ID NO: 187972 - DNA, 25 bp, Mus musculus
agaccggaagtgacgagagctgtcg

SEQ ID NO: 187973 - DNA, 25 bp, Mus musculus
agaccggacttagcacactcctggg

SEQ ID NO: 187974 - DNA, 25 bp, Mus musculus
agaccggatcagctccccatatata

SEQ ID NO: 187975 - DNA, 25 bp, Mus musculus
agaccgggacagagcgcctcctcaa

SEQ ID NO: 187976 - DNA, 25 bp, Mus musculus
agaccgtaggggttcacgaaccaga

SEQ ID NO: 187977 - DNA, 25 bp, Mus musculus
agaccgtcacggacaattgttccag

SEQ ID NO: 187978 - DNA, 25 bp, Mus musculus
agaccgtcctcagctggcagctgtc

SEQ ID NO: 187979 - DNA, 25 bp, Mus musculus
agaccgtgaaaggagcaatagagct

SEQ ID NO: 187980 - DNA, 25 bp, Mus musculus
agaccgtgaaaggagtcgctttcct

SEQ ID NO: 187981 - DNA, 25 bp, Mus musculus
agaccgtgactctcaactccgaagt

SEQ ID NO: 187982 - DNA, 25 bp, Mus musculus
agaccgtgcgcgctccccaggctag

SEQ ID NO: 187983 - DNA, 25 bp, Mus musculus
agaccgtggatgggagggccccaag

SEQ ID NO: 187984 - DNA, 25 bp, Mus musculus
agaccgtgggggagattttctacct

SEQ ID NO: 187985 - DNA, 25 bp, Mus musculus
agaccgtgggggaggatcccatagc

SEQ ID NO: 187986 - DNA, 25 bp, Mus musculus
agaccgtgggggaggtgacagatta

SEQ ID NO: 187987 - DNA, 25 bp, Mus musculus
agaccgttgtagagtgtgtaatgct

SEQ ID NO: 187988 - DNA, 25 bp, Mus musculus
agacctaaatgactggcttccccag

SEQ ID NO: 187989 - DNA, 25 bp, Mus musculus
agacctaaatggagaactgttccta

SEQ ID NO: 187990 - DNA, 25 bp, Mus musculus
agacctaagaagagatccagagttt

SEQ ID NO: 187991 - DNA, 25 bp, Mus musculus
agacctaatgaaagctgcaccgccc

SEQ ID NO: 187992 - DNA, 25 bp, Mus musculus
agacctaatgcgcctagaaaaggag

SEQ ID NO: 187993 - DNA, 25 bp, Mus musculus
agacctacaaggtcggacatcaaat

SEQ ID NO: 187994 - DNA, 25 bp, Mus musculus
agacctacagctgcaccaaagccag

SEQ ID NO: 187995 - DNA, 25 bp, Mus musculus
agacctacaggaatcacaggttcac

SEQ ID NO: 187996 - DNA, 25 bp, Mus musculus
agacctacaggattgagacaccggt

SEQ ID NO: 187997 - DNA, 25 bp, Mus musculus
agacctaccgagtgaccctgagcaa

SEQ ID NO: 187998 - DNA, 25 bp, Mus musculus
agacctactcccagtgaccttcaga

SEQ ID NO: 187999 - DNA, 25 bp, Mus musculus
agacctactgtgtctctggaccaaa

SEQ ID NO: 188000 - DNA, 25 bp, Mus musculus
agacctagaacaatagaaagcagtc

SEQ ID NO: 188001 - DNA, 25 bp, Mus musculus
agacctatccagcccaccagaaccg

SEQ ID NO: 188002 - DNA, 25 bp, Mus musculus
agacctatgagatggtagacaaaca

SEQ ID NO: 188003 - DNA, 25 bp, Mus musculus
agacctattcccgacataggaggcg

SEQ ID NO: 188004 - DNA, 25 bp, Mus musculus
agacctcaaagacagaaataaaaat

SEQ ID NO: 188005 - DNA, 25 bp, Mus musculus
agacctcaaagacaggccagttaaa

SEQ ID NO: 188006 - DNA, 25 bp, Mus musculus
agacctcaagaattaaaacaggaac

SEQ ID NO: 188007 - DNA, 25 bp, Mus musculus
agacctcaagggagaaggtgatatg

SEQ ID NO: 188008 - DNA, 25 bp, Mus musculus
agacctcaccgacacactggatgcc

SEQ ID NO: 188009 - DNA, 25 bp, Mus musculus
agacctcaccttcctcacaggtctg

SEQ ID NO: 188010 - DNA, 25 bp, Mus musculus
agacctcactccagtcccgctcggc

SEQ ID NO: 188011 - DNA, 25 bp, Mus musculus
agacctcactgacctctcactgccc

SEQ ID NO: 188012 - DNA, 25 bp, Mus musculus
agacctcactgtttctctatataac

SEQ ID NO: 188013 - DNA, 25 bp, Mus musculus
agacctcagaaactgtggcccgagg

SEQ ID NO: 188014 - DNA, 25 bp, Mus musculus
agacctcagatcagaaccagtcttc

SEQ ID NO: 188015 - DNA, 25 bp, Mus musculus
agacctcagcaaatgtggtaaacag

SEQ ID NO: 188016 - DNA, 25 bp, Mus musculus
agacctcagctggttgtgcagacaa

SEQ ID NO: 188017 - DNA, 25 bp, Mus musculus
agacctcagctggttgtgcagtcaa

SEQ ID NO: 188018 - DNA, 25 bp, Mus musculus
agacctcatccagaccagagggcct

SEQ ID NO: 188019 - DNA, 25 bp, Mus musculus
agacctcatccagcttactggcggt

SEQ ID NO: 188020 - DNA, 25 bp, Mus musculus
agacctccaagatctcctacctctg

SEQ ID NO: 188021 - DNA, 25 bp, Mus musculus
agacctccaagggcaccatgaacac

SEQ ID NO: 188022 - DNA, 25 bp, Mus musculus
agacctccacagggacaactcccaa

SEQ ID NO: 188023 - DNA, 25 bp, Mus musculus
agacctccagagtggtggattgtcc

SEQ ID NO: 188024 - DNA, 25 bp, Mus musculus
agacctcccagatggtgttagcagg

SEQ ID NO: 188025 - DNA, 25 bp, Mus musculus
agacctccgaaaggcccgacgactc

SEQ ID NO: 188026 - DNA, 25 bp, Mus musculus
agacctcctgatcacttgtacagcg

SEQ ID NO: 188027 - DNA, 25 bp, Mus musculus
agacctcctgtagagagccatatac

SEQ ID NO: 188028 - DNA, 25 bp, Mus musculus
agacctcctgtagaggtgaggcatg

SEQ ID NO: 188029 - DNA, 25 bp, Mus musculus
agacctcgcaggaaattctacagaa

SEQ ID NO: 188030 - DNA, 25 bp, Mus musculus
agacctcgcaggaagacagatcttc

SEQ ID NO: 188031 - DNA, 25 bp, Mus musculus
agacctcgcggaaaactgtccttgg

SEQ ID NO: 188032 - DNA, 25 bp, Mus musculus
agacctcgcgggcccatcctcccgt

SEQ ID NO: 188033 - DNA, 25 bp, Mus musculus
agacctcgctcaaaggagaaaggat

SEQ ID NO: 188034 - DNA, 25 bp, Mus musculus
agacctcgctcaaaggtcgatcctt

SEQ ID NO: 188035 - DNA, 25 bp, Mus musculus
agacctcggcgcgggaactggcatc

SEQ ID NO: 188036 - DNA, 25 bp, Mus musculus
agacctcggcgcgggtgaacaccat

SEQ ID NO: 188037 - DNA, 25 bp, Mus musculus
agacctcggcgcgggtgagccctat

SEQ ID NO: 188038 - DNA, 25 bp, Mus musculus
agacctctgacaaacagttgctcag

SEQ ID NO: 188039 - DNA, 25 bp, Mus musculus
agacctctgagagatggatttataa

SEQ ID NO: 188040 - DNA, 25 bp, Mus musculus
agacctctgagagctcccaggaggc

SEQ ID NO: 188041 - DNA, 25 bp, Mus musculus
agacctctggaagagaacctgtgga

SEQ ID NO: 188042 - DNA, 25 bp, Mus musculus
agacctgaagagtacagtcgctttg

SEQ ID NO: 188043 - DNA, 25 bp, Mus musculus
agacctgaaggtgtcccccttgtct

SEQ ID NO: 188044 - DNA, 25 bp, Mus musculus
agacctgacttctggatggacagtc

SEQ ID NO: 188045 - DNA, 25 bp, Mus musculus
agacctgagtgaggtagataaagat

SEQ ID NO: 188046 - DNA, 25 bp, Mus musculus
agacctgatcctgtggaagaggtga

SEQ ID NO: 188047 - DNA, 25 bp, Mus musculus
agacctgatgtccgggcactagagc

SEQ ID NO: 188048 - DNA, 25 bp, Mus musculus
agacctgcaagccctacctgacctg

SEQ ID NO: 188049 - DNA, 25 bp, Mus musculus
agacctgcaaggaatctccggttcc

SEQ ID NO: 188050 - DNA, 25 bp, Mus musculus
agacctgcaaggtccccaaccctac

SEQ ID NO: 188051 - DNA, 25 bp, Mus musculus
agacctgccactcacgcgagttcca

SEQ ID NO: 188052 - DNA, 25 bp, Mus musculus
agacctgccaggacgctgagcctgg

SEQ ID NO: 188053 - DNA, 25 bp, Mus musculus
agacctgccaggtgtcaccatgctg

SEQ ID NO: 188054 - DNA, 25 bp, Mus musculus
agacctgcccccaagaggacgagtc

SEQ ID NO: 188055 - DNA, 25 bp, Mus musculus
agacctgcccccaaggtggtgttcg

SEQ ID NO: 188056 - DNA, 25 bp, Mus musculus
agacctgcccgcaggagcgcagcaa

SEQ ID NO: 188057 - DNA, 25 bp, Mus musculus
agacctgcgtggagctcaggcctgc

SEQ ID NO: 188058 - DNA, 25 bp, Mus musculus
agacctgcgtggagtgttcagccaa

SEQ ID NO: 188059 - DNA, 25 bp, Mus musculus
agacctgctggggtgacagtccaaa

SEQ ID NO: 188060 - DNA, 25 bp, Mus musculus
agacctggaacctgatgaagagctg

SEQ ID NO: 188061 - DNA, 25 bp, Mus musculus
agacctggaatcagatgaagagctg

SEQ ID NO: 188062 - DNA, 25 bp, Mus musculus
agacctggacattcggatttccatt

SEQ ID NO: 188063 - DNA, 25 bp, Mus musculus
agacctggacattcggtcacagtct

SEQ ID NO: 188064 - DNA, 25 bp, Mus musculus
agacctggaggaggtgatcacagtt

SEQ ID NO: 188065 - DNA, 25 bp, Mus musculus
agacctggaggatccccaggacgcc

SEQ ID NO: 188066 - DNA, 25 bp, Mus musculus
agacctggaggattacctgttgcag

SEQ ID NO: 188067 - DNA, 25 bp, Mus musculus
agacctggcacagtcaggttttcag

SEQ ID NO: 188068 - DNA, 25 bp, Mus musculus
agacctggcacattcctcttcagat

SEQ ID NO: 188069 - DNA, 25 bp, Mus musculus
agacctggccaactgtaacagaaga

SEQ ID NO: 188070 - DNA, 25 bp, Mus musculus
agacctggccaagcctaccaggtac

SEQ ID NO: 188071 - DNA, 25 bp, Mus musculus
agacctggccaaggtaccacggttc

SEQ ID NO: 188072 - DNA, 25 bp, Mus musculus
agacctggccagtatattattctcc

SEQ ID NO: 188073 - DNA, 25 bp, Mus musculus
agacctggctccagtctgttctcct

SEQ ID NO: 188074 - DNA, 25 bp, Mus musculus
agacctggctccattccatgaggcg

SEQ ID NO: 188075 - DNA, 25 bp, Mus musculus
agacctggtgggtgtgaacaaagac

SEQ ID NO: 188076 - DNA, 25 bp, Mus musculus
agacctgtatagcagaacatcatga

SEQ ID NO: 188077 - DNA, 25 bp, Mus musculus
agacctgtcaatggactatctcatc

SEQ ID NO: 188078 - DNA, 25 bp, Mus musculus
agacctgtcaatggtacggatgaaa

SEQ ID NO: 188079 - DNA, 25 bp, Mus musculus
agacctgtcttgtaaccctgagata

SEQ ID NO: 188080 - DNA, 25 bp, Mus musculus
agacctgtggggtttggtggtgact

SEQ ID NO: 188081 - DNA, 25 bp, Mus musculus
agacctgtgtggagtgttcagcaaa

SEQ ID NO: 188082 - DNA, 25 bp, Mus musculus
agacctgttagggatccttgtgggc

SEQ ID NO: 188083 - DNA, 25 bp, Mus musculus
agacctgttcagtagacagtataac

SEQ ID NO: 188084 - DNA, 25 bp, Mus musculus
agaccttaacaggtgaagatggttc

SEQ ID NO: 188085 - DNA, 25 bp, Mus musculus
agaccttaacctagcttaccatcta

SEQ ID NO: 188086 - DNA, 25 bp, Mus musculus
agaccttaagggatagagaaggctg

SEQ ID NO: 188087 - DNA, 25 bp, Mus musculus
agaccttaccaaggaccgtagcctg

SEQ ID NO: 188088 - DNA, 25 bp, Mus musculus
agaccttataggagtaaagatggga

SEQ ID NO: 188089 - DNA, 25 bp, Mus musculus
agaccttcaaaaagtcaaggtgatt

SEQ ID NO: 188090 - DNA, 25 bp, Mus musculus
agaccttcaccttccagagaaggag

SEQ ID NO: 188091 - DNA, 25 bp, Mus musculus
agaccttcaggatcaagattatagg

SEQ ID NO: 188092 - DNA, 25 bp, Mus musculus
agaccttccaggaacttccattaca

SEQ ID NO: 188093 - DNA, 25 bp, Mus musculus
agaccttccaggtggaggatttttc

SEQ ID NO: 188094 - DNA, 25 bp, Mus musculus
agaccttgagagcaggtttaaacgc

SEQ ID NO: 188095 - DNA, 25 bp, Mus musculus
agaccttgagagctgttctgccaag

SEQ ID NO: 188096 - DNA, 25 bp, Mus musculus
agaccttgagccaaagccctgtttt

SEQ ID NO: 188097 - DNA, 25 bp, Mus musculus
agaccttgcaaagtgcaatacgagg

SEQ ID NO: 188098 - DNA, 25 bp, Mus musculus
agaccttgcaaagtgccacagttga

SEQ ID NO: 188099 - DNA, 25 bp, Mus musculus
agaccttgcatccagtgatgtggcc

SEQ ID NO: 188100 - DNA, 25 bp, Mus musculus
agacctttaaccagcaagccccgcc

SEQ ID NO: 188101 - DNA, 25 bp, Mus musculus
agacctttaccaagagctgggtcga

SEQ ID NO: 188102 - DNA, 25 bp, Mus musculus
agacctttacgacagtgtgaactgg

SEQ ID NO: 188103 - DNA, 25 bp, Mus musculus
agacctttccccagagcccgactct

SEQ ID NO: 188104 - DNA, 25 bp, Mus musculus
agacctttccccaggcccggagcat

SEQ ID NO: 188105 - DNA, 25 bp, Mus musculus
agaccttttctctgagcaaagaacg

SEQ ID NO: 188106 - DNA, 25 bp, Mus musculus
agacgaaagcagcttttaatatatt

SEQ ID NO: 188107 - DNA, 25 bp, Mus musculus
agacgaactaggtcctgtgccattg

SEQ ID NO: 188108 - DNA, 25 bp, Mus musculus
agacgaagaaaggccacggaacaca

SEQ ID NO: 188109 - DNA, 25 bp, Mus musculus
agacgaagaaaggctacttcgtgtc

SEQ ID NO: 188110 - DNA, 25 bp, Mus musculus
agacgaagcgggcagtcagaaaatg

SEQ ID NO: 188111 - DNA, 25 bp, Mus musculus
agacgaagttccgacagcagcccaa

SEQ ID NO: 188112 - DNA, 25 bp, Mus musculus
agacgaattacctattgaagtggac

SEQ ID NO: 188113 - DNA, 25 bp, Mus musculus
agacgaattggaatcccagtcagaa

SEQ ID NO: 188114 - DNA, 25 bp, Mus musculus
agacgacaaaggtcccccctgtggc

SEQ ID NO: 188115 - DNA, 25 bp, Mus musculus
agacgacaccaaggagtcagtccga

SEQ ID NO: 188116 - DNA, 25 bp, Mus musculus
agacgacacttacgagcatacatct

SEQ ID NO: 188117 - DNA, 25 bp, Mus musculus
agacgacacttacgataaactttat

SEQ ID NO: 188118 - DNA, 25 bp, Mus musculus
agacgacagccaggtccccctggag

SEQ ID NO: 188119 - DNA, 25 bp, Mus musculus
agacgaccagaagagagccaagcct

SEQ ID NO: 188120 - DNA, 25 bp, Mus musculus
agacgaccctcaagtgccctgtgat

SEQ ID NO: 188121 - DNA, 25 bp, Mus musculus
agacgacctagagatgtggtcagct

SEQ ID NO: 188122 - DNA, 25 bp, Mus musculus
agacgaccttgttgccgctggtggg

SEQ ID NO: 188123 - DNA, 25 bp, Mus musculus
agacgacgaagcaaacctttgacca

SEQ ID NO: 188124 - DNA, 25 bp, Mus musculus
agacgacgaagcactggggaagagg

SEQ ID NO: 188125 - DNA, 25 bp, Mus musculus
agacgacgaagtcgttctccccgcc

SEQ ID NO: 188126 - DNA, 25 bp, Mus musculus
agacgactgccagtctccctatgag

SEQ ID NO: 188127 - DNA, 25 bp, Mus musculus
agacgagacgagagtgatctcagcg

SEQ ID NO: 188128 - DNA, 25 bp, Mus musculus
agacgagaggctcagagccctgaag

SEQ ID NO: 188129 - DNA, 25 bp, Mus musculus
agacgagatcttaaggacctgggga

SEQ ID NO: 188130 - DNA, 25 bp, Mus musculus
agacgagctccagatgctctccaag

SEQ ID NO: 188131 - DNA, 25 bp, Mus musculus
agacgagctccagggtttctcagtg

SEQ ID NO: 188132 - DNA, 25 bp, Mus musculus
agacgagctcttgaaggatctgcag

SEQ ID NO: 188133 - DNA, 25 bp, Mus musculus
agacgagctgtaaggtgacagaaga

SEQ ID NO: 188134 - DNA, 25 bp, Mus musculus
agacgagctgtaagtgagcttcact

SEQ ID NO: 188135 - DNA, 25 bp, Mus musculus
agacgaggaggtggagttgttacaa

SEQ ID NO: 188136 - DNA, 25 bp, Mus musculus
agacgaggagtggttccgatctaag

SEQ ID NO: 188137 - DNA, 25 bp, Mus musculus
agacgaggcgggacatgttctcaga

SEQ ID NO: 188138 - DNA, 25 bp, Mus musculus
agacgaggcgggccatccgggtatt

SEQ ID NO: 188139 - DNA, 25 bp, Mus musculus
agacgaggcttccagctccagaaat

SEQ ID NO: 188140 - DNA, 25 bp, Mus musculus
agacgataatgaagaaaacgggagt

SEQ ID NO: 188141 - DNA, 25 bp, Mus musculus
agacgatccttgtggacttctggga

SEQ ID NO: 188142 - DNA, 25 bp, Mus musculus
agacgatccttgtgggtatttgatg

SEQ ID NO: 188143 - DNA, 25 bp, Mus musculus
agacgatgaaggtgaagatgccatc

SEQ ID NO: 188144 - DNA, 25 bp, Mus musculus
agacgatgaagtaaggaaagccagc

SEQ ID NO: 188145 - DNA, 25 bp, Mus musculus
agacgatgagatggaactggaggag

SEQ ID NO: 188146 - DNA, 25 bp, Mus musculus
agacgatgaggagaaagaaaagaaa

SEQ ID NO: 188147 - DNA, 25 bp, Mus musculus
agacgatgcacaggccatagaagcc

SEQ ID NO: 188148 - DNA, 25 bp, Mus musculus
agacgatggacccaggtaaacagtt

SEQ ID NO: 188149 - DNA, 25 bp, Mus musculus
agacgatggacccaggttactccag

SEQ ID NO: 188150 - DNA, 25 bp, Mus musculus
agacgcaaaagagtgtgaagattgc

SEQ ID NO: 188151 - DNA, 25 bp, Mus musculus
agacgcaattcagtcaggatggcta

SEQ ID NO: 188152 - DNA, 25 bp, Mus musculus
agacgcacaggcatatctgctgttc

SEQ ID NO: 188153 - DNA, 25 bp, Mus musculus
agacgcaccagctcccttccccgat

SEQ ID NO: 188154 - DNA, 25 bp, Mus musculus
agacgcaccagggggactccctggg

SEQ ID NO: 188155 - DNA, 25 bp, Mus musculus
agacgcaccaggtcacacacacata

SEQ ID NO: 188156 - DNA, 25 bp, Mus musculus
agacgcagctgaaggtgatcaactg

SEQ ID NO: 188157 - DNA, 25 bp, Mus musculus
agacgcaggccaagttggtggaagg

SEQ ID NO: 188158 - DNA, 25 bp, Mus musculus
agacgcaggctggctcaccatcatg

SEQ ID NO: 188159 - DNA, 25 bp, Mus musculus
agacgccaaggttgtggagctgaat

SEQ ID NO: 188160 - DNA, 25 bp, Mus musculus
agacgccatcatcggagaagcttct

SEQ ID NO: 188161 - DNA, 25 bp, Mus musculus
agacgccatcatcggcgctggcgag

SEQ ID NO: 188162 - DNA, 25 bp, Mus musculus
agacgccgctctcagaacccaggaa

SEQ ID NO: 188163 - DNA, 25 bp, Mus musculus
agacgccgctctcaggtcaaatcta

SEQ ID NO: 188164 - DNA, 25 bp, Mus musculus
agacgccggaagatgatgccagacc

SEQ ID NO: 188165 - DNA, 25 bp, Mus musculus
agacgccggtggagggtcaggatgg

SEQ ID NO: 188166 - DNA, 25 bp, Mus musculus
agacgccggtggagggtgtcccctg

SEQ ID NO: 188167 - DNA, 25 bp, Mus musculus
agacgccggtggaggtcgactggcc

SEQ ID NO: 188168 - DNA, 25 bp, Mus musculus
agacgcctaaaaaaggtctgtgcac

SEQ ID NO: 188169 - DNA, 25 bp, Mus musculus
agacgcctatgcaggagcatctgca

SEQ ID NO: 188170 - DNA, 25 bp, Mus musculus
agacgcctatggctcagaggactcc

SEQ ID NO: 188171 - DNA, 25 bp, Mus musculus
agacgcctctcatggtcgctgtctt

SEQ ID NO: 188172 - DNA, 25 bp, Mus musculus
agacgcctgaacggctccaggactg

SEQ ID NO: 188173 - DNA, 25 bp, Mus musculus
agacgcctgctcggtcagtcagcag

SEQ ID NO: 188174 - DNA, 25 bp, Mus musculus
agacgcctgctcgtgtgtataagct

SEQ ID NO: 188175 - DNA, 25 bp, Mus musculus
agacgcctttgaggtcttgctgatc

SEQ ID NO: 188176 - DNA, 25 bp, Mus musculus
agacgcgcctcgataaggaaaaggg

SEQ ID NO: 188177 - DNA, 25 bp, Mus musculus
agacgcgctttggaggtgacaaact

SEQ ID NO: 188178 - DNA, 25 bp, Mus musculus
agacgctaacccaggagaacgtcag

SEQ ID NO: 188179 - DNA, 25 bp, Mus musculus
agacgctcaaatcatgcactctccc

SEQ ID NO: 188180 - DNA, 25 bp, Mus musculus
agacgctcaacttgtcccaaaacaa

SEQ ID NO: 188181 - DNA, 25 bp, Mus musculus
agacgctcaaggatgaagaaacacg

SEQ ID NO: 188182 - DNA, 25 bp, Mus musculus
agacgctcaagtcctcctgcatatg

SEQ ID NO: 188183 - DNA, 25 bp, Mus musculus
agacgctcagatatgctgaaggaca

SEQ ID NO: 188184 - DNA, 25 bp, Mus musculus
agacgctctgccctgattccttctg

SEQ ID NO: 188185 - DNA, 25 bp, Mus musculus
agacgctgcacgatagtatgaccgg

SEQ ID NO: 188186 - DNA, 25 bp, Mus musculus
agacgctgctgcctctgattggcct

SEQ ID NO: 188187 - DNA, 25 bp, Mus musculus
agacgctgctgcctgtattgaccaa

SEQ ID NO: 188188 - DNA, 25 bp, Mus musculus
agacgcttccattgtctaaagccac

SEQ ID NO: 188189 - DNA, 25 bp, Mus musculus
agacgcttgtccggcctctgtagag

SEQ ID NO: 188190 - DNA, 25 bp, Mus musculus
agacgcttgtccgggcgggttgagg

SEQ ID NO: 188191 - DNA, 25 bp, Mus musculus
agacggaaaaccagagtccagcctc

SEQ ID NO: 188192 - DNA, 25 bp, Mus musculus
agacggaaaagtgtcattggtctca

SEQ ID NO: 188193 - DNA, 25 bp, Mus musculus
agacggaaagctcatcaagcaatca

SEQ ID NO: 188194 - DNA, 25 bp, Mus musculus
agacggaaaggagagatctgtaggc

SEQ ID NO: 188195 - DNA, 25 bp, Mus musculus
agacggaagccatggcaggacaaag

SEQ ID NO: 188196 - DNA, 25 bp, Mus musculus
agacggactgaggaaaacaaaaatc

SEQ ID NO: 188197 - DNA, 25 bp, Mus musculus
agacggagcgactcgatcccctgaa

SEQ ID NO: 188198 - DNA, 25 bp, Mus musculus
agacggagcgactcgttctgcctcc

SEQ ID NO: 188199 - DNA, 25 bp, Mus musculus
agacggaggagaaggaactatcccc

SEQ ID NO: 188200 - DNA, 25 bp, Mus musculus
agacggaggagaagtctggacagag

SEQ ID NO: 188201 - DNA, 25 bp, Mus musculus
agacggaggcgagcgggcttggctg

SEQ ID NO: 188202 - DNA, 25 bp, Mus musculus
agacggatctcagataataaccaaa

SEQ ID NO: 188203 - DNA, 25 bp, Mus musculus
agacggatggcacaggagctgatac

SEQ ID NO: 188204 - DNA, 25 bp, Mus musculus
agacggattcctcctcaagtactac

SEQ ID NO: 188205 - DNA, 25 bp, Mus musculus
agacggattcctggtgggtattgtg

SEQ ID NO: 188206 - DNA, 25 bp, Mus musculus
agacggcacccagtaatctttggaa

SEQ ID NO: 188207 - DNA, 25 bp, Mus musculus
agacggccatggaaccacaaaccac

SEQ ID NO: 188208 - DNA, 25 bp, Mus musculus
agacggccctcgatggggcatcctg

SEQ ID NO: 188209 - DNA, 25 bp, Mus musculus
agacggccgaggcggcccagggcct

SEQ ID NO: 188210 - DNA, 25 bp, Mus musculus
agacggcggccagcatcaggaagat

SEQ ID NO: 188211 - DNA, 25 bp, Mus musculus
agacggctatgaatcatccaggttt

SEQ ID NO: 188212 - DNA, 25 bp, Mus musculus
agacggctccagattactacaaggg

SEQ ID NO: 188213 - DNA, 25 bp, Mus musculus
agacgggaagctgtacagagaggca

SEQ ID NO: 188214 - DNA, 25 bp, Mus musculus
agacgggagctgcaggagatgcggg

SEQ ID NO: 188215 - DNA, 25 bp, Mus musculus
agacggggcgcgaggtgcagggaag

SEQ ID NO: 188216 - DNA, 25 bp, Mus musculus
agacgggttgttgccgtaatctagc

SEQ ID NO: 188217 - DNA, 25 bp, Mus musculus
agacggtcaataaggctgtggctct

SEQ ID NO: 188218 - DNA, 25 bp, Mus musculus
agacggtctgattaaacaaattgga

SEQ ID NO: 188219 - DNA, 25 bp, Mus musculus
agacggtgaagaaggtgataaatgc

SEQ ID NO: 188220 - DNA, 25 bp, Mus musculus
agacggtgagcagggatatcgctcg

SEQ ID NO: 188221 - DNA, 25 bp, Mus musculus
agacggtgcttggcctgttcttctt

SEQ ID NO: 188222 - DNA, 25 bp, Mus musculus
agacggtgtgtacaggccccgactc

SEQ ID NO: 188223 - DNA, 25 bp, Mus musculus
agacggttctagatccctttcagct

SEQ ID NO: 188224 - DNA, 25 bp, Mus musculus
agacggttctagttccctttcagct

SEQ ID NO: 188225 - DNA, 25 bp, Mus musculus
agacgtagagcctagccccgtgtct

SEQ ID NO: 188226 - DNA, 25 bp, Mus musculus
agacgtatgatgacatcgactatgg

SEQ ID NO: 188227 - DNA, 25 bp, Mus musculus
agacgtcactggagttcttttcaaa

SEQ ID NO: 188228 - DNA, 25 bp, Mus musculus
agacgtcaggtaatcaaattaaata

SEQ ID NO: 188229 - DNA, 25 bp, Mus musculus
agacgtcatccacggtgtggcctct

SEQ ID NO: 188230 - DNA, 25 bp, Mus musculus
agacgtcgcggccgcatggcggaca

SEQ ID NO: 188231 - DNA, 25 bp, Mus musculus
agacgtcgtgtggcatgtgggcaca

SEQ ID NO: 188232 - DNA, 25 bp, Mus musculus
agacgtctgaggacacagactcaga

SEQ ID NO: 188233 - DNA, 25 bp, Mus musculus
agacgtctgaggcagcgggagccca

SEQ ID NO: 188234 - DNA, 25 bp, Mus musculus
agacgtctgaggtggcttggtttgc

SEQ ID NO: 188235 - DNA, 25 bp, Mus musculus
agacgtctgtcagccatcgtctaga

SEQ ID NO: 188236 - DNA, 25 bp, Mus musculus
agacgtgaaaagtgacgtgaacact

SEQ ID NO: 188237 - DNA, 25 bp, Mus musculus
agacgtgaaaatgttctgcctgcag

SEQ ID NO: 188238 - DNA, 25 bp, Mus musculus
agacgtgaaagataaagcttttaaa

SEQ ID NO: 188239 - DNA, 25 bp, Mus musculus
agacgtgatggttaagatctccatg

SEQ ID NO: 188240 - DNA, 25 bp, Mus musculus
agacgtggaggtactatgcctgcct

SEQ ID NO: 188241 - DNA, 25 bp, Mus musculus
agacgtggcgctgtatactccatgt

SEQ ID NO: 188242 - DNA, 25 bp, Mus musculus
agacgtgggcgatggttgtggagtc

SEQ ID NO: 188243 - DNA, 25 bp, Mus musculus
agacgtgggcggctgttttgagctg

SEQ ID NO: 188244 - DNA, 25 bp, Mus musculus
agacgtgggtgcaggtctcaggagc

SEQ ID NO: 188245 - DNA, 25 bp, Mus musculus
agacgtgttcaattttcacagctga

SEQ ID NO: 188246 - DNA, 25 bp, Mus musculus
agacgtgttcacattctggtggtag

SEQ ID NO: 188247 - DNA, 25 bp, Mus musculus
agacgtgttcagattccagcattct

SEQ ID NO: 188248 - DNA, 25 bp, Mus musculus
agacgttgctgaggtattatgatca

SEQ ID NO: 188249 - DNA, 25 bp, Mus musculus
agacgttgtggaaggctcaaagcag

SEQ ID NO: 188250 - DNA, 25 bp, Mus musculus
agacgtttgtcctgctgtgtttcaa

SEQ ID NO: 188251 - DNA, 25 bp, Mus musculus
agactaaaagatatggagggaaaca

SEQ ID NO: 188252 - DNA, 25 bp, Mus musculus
agactaaaagccatgaaagtatatc

SEQ ID NO: 188253 - DNA, 25 bp, Mus musculus
agactaaaagccatgcagcaccagc

SEQ ID NO: 188254 - DNA, 25 bp, Mus musculus
agactaaaagtgctgaagaggttcc

SEQ ID NO: 188255 - DNA, 25 bp, Mus musculus
agactaaatgggtgaccgaggtcca

SEQ ID NO: 188256 - DNA, 25 bp, Mus musculus
agactaacatattttaatttcagga

SEQ ID NO: 188257 - DNA, 25 bp, Mus musculus
agactaacatattttatccaagttt

SEQ ID NO: 188258 - DNA, 25 bp, Mus musculus
agactaagcaggtggaagaactaag

SEQ ID NO: 188259 - DNA, 25 bp, Mus musculus
agactaaggaacaggtgtggtatca

SEQ ID NO: 188260 - DNA, 25 bp, Mus musculus
agactaaggcagggcctagtaacta

SEQ ID NO: 188261 - DNA, 25 bp, Mus musculus
agactaatgccactaaacctggacc

SEQ ID NO: 188262 - DNA, 25 bp, Mus musculus
agactacagcggtcagcagagcact

SEQ ID NO: 188263 - DNA, 25 bp, Mus musculus
agactacatggaatatgctcagagc

SEQ ID NO: 188264 - DNA, 25 bp, Mus musculus
agactacatgtccttctgcgcgtgc

SEQ ID NO: 188265 - DNA, 25 bp, Mus musculus
agactaccaacagctcttcgcggca

SEQ ID NO: 188266 - DNA, 25 bp, Mus musculus
agactaccaagctccacttcgaagc

SEQ ID NO: 188267 - DNA, 25 bp, Mus musculus
agactaccaagtgaacacctttatg

SEQ ID NO: 188268 - DNA, 25 bp, Mus musculus
agactaccaggttgggataaacatt

SEQ ID NO: 188269 - DNA, 25 bp, Mus musculus
agactacctccaggtcggagtgacc

SEQ ID NO: 188270 - DNA, 25 bp, Mus musculus
agactacctccaggtggttgttgga

SEQ ID NO: 188271 - DNA, 25 bp, Mus musculus
agactacctgaagaaacagcaagtg

SEQ ID NO: 188272 - DNA, 25 bp, Mus musculus
agactacctgacctcatctttgaga

SEQ ID NO: 188273 - DNA, 25 bp, Mus musculus
agactacctgactctttgagataat

SEQ ID NO: 188274 - DNA, 25 bp, Mus musculus
agactacgctgatggcagtgaagac

SEQ ID NO: 188275 - DNA, 25 bp, Mus musculus
agactactacagtcacctgaagaag

SEQ ID NO: 188276 - DNA, 25 bp, Mus musculus
agactactccacggattacctcacg

SEQ ID NO: 188277 - DNA, 25 bp, Mus musculus
agactagatatggaacgggagcgaa

SEQ ID NO: 188278 - DNA, 25 bp, Mus musculus
agactagcaatcagaacccaagaga

SEQ ID NO: 188279 - DNA, 25 bp, Mus musculus
agactagttttccaggtcgtggttc

SEQ ID NO: 188280 - DNA, 25 bp, Mus musculus
agactatacatgtgaatgaactcat

SEQ ID NO: 188281 - DNA, 25 bp, Mus musculus
agactatcatgttccaagatgcctc

SEQ ID NO: 188282 - DNA, 25 bp, Mus musculus
agactatcatttatttccgagagac

SEQ ID NO: 188283 - DNA, 25 bp, Mus musculus
agactatgaaatggtccaccaggct

SEQ ID NO: 188284 - DNA, 25 bp, Mus musculus
agactatgaaatggttttactgggc

SEQ ID NO: 188285 - DNA, 25 bp, Mus musculus
agactatgactcagacaagctattt

SEQ ID NO: 188286 - DNA, 25 bp, Mus musculus
agactatgctgactcgagcattgca

SEQ ID NO: 188287 - DNA, 25 bp, Mus musculus
agactatgggcaggtgttcacctac

SEQ ID NO: 188288 - DNA, 25 bp, Mus musculus
agactattacgcaacttgggaggag

SEQ ID NO: 188289 - DNA, 25 bp, Mus musculus
agactcaaagagcaacttgatttct

SEQ ID NO: 188290 - DNA, 25 bp, Mus musculus
agactcaatgaggccctgctggagg

SEQ ID NO: 188291 - DNA, 25 bp, Mus musculus
agactcacaaggtgaaactaatgaa

SEQ ID NO: 188292 - DNA, 25 bp, Mus musculus
agactcacggcacaggtcagacggg

SEQ ID NO: 188293 - DNA, 25 bp, Mus musculus
agactcagaacttgggagacgactg

SEQ ID NO: 188294 - DNA, 25 bp, Mus musculus
agactcagagagctgcatgcctcat

SEQ ID NO: 188295 - DNA, 25 bp, Mus musculus
agactcagatcagaagagcagcaga

SEQ ID NO: 188296 - DNA, 25 bp, Mus musculus
agactcagatcagccttgcagcaga

SEQ ID NO: 188297 - DNA, 25 bp, Mus musculus
agactcagatcagctgggaagggct

SEQ ID NO: 188298 - DNA, 25 bp, Mus musculus
agactcagattaagggtttcaaaaa

SEQ ID NO: 188299 - DNA, 25 bp, Mus musculus
agactcagatttggggccaggaccc

SEQ ID NO: 188300 - DNA, 25 bp, Mus musculus
agactcagcaggtgatgaggaattt

SEQ ID NO: 188301 - DNA, 25 bp, Mus musculus
agactcagcccactggatcaaacaa

SEQ ID NO: 188302 - DNA, 25 bp, Mus musculus
agactcagcccgtcacaatcattac

SEQ ID NO: 188303 - DNA, 25 bp, Mus musculus
agactcagcgtgatcgcaatgagag

SEQ ID NO: 188304 - DNA, 25 bp, Mus musculus
agactcagtgatggctgtcacgacc

SEQ ID NO: 188305 - DNA, 25 bp, Mus musculus
agactcatgcaatagaaatgatcaa

SEQ ID NO: 188306 - DNA, 25 bp, Mus musculus
agactcatgcaatagttccagttca

SEQ ID NO: 188307 - DNA, 25 bp, Mus musculus
agactcatgggatagacaagaacgg

SEQ ID NO: 188308 - DNA, 25 bp, Mus musculus
agactcattaaaggaaaaggatata

SEQ ID NO: 188309 - DNA, 25 bp, Mus musculus
agactccaagggctactacatgggc

SEQ ID NO: 188310 - DNA, 25 bp, Mus musculus
agactccacggtgagagtctgggat

SEQ ID NO: 188311 - DNA, 25 bp, Mus musculus
agactccagaataagctgaactccc

SEQ ID NO: 188312 - DNA, 25 bp, Mus musculus
agactccagagatctacctggcgta

SEQ ID NO: 188313 - DNA, 25 bp, Mus musculus
agactccagtgagagttgctggaac

SEQ ID NO: 188314 - DNA, 25 bp, Mus musculus
agactccatagaactttccaaagca

SEQ ID NO: 188315 - DNA, 25 bp, Mus musculus
agactccataggaccttctgtctcc

SEQ ID NO: 188316 - DNA, 25 bp, Mus musculus
agactccatgtgctcggcgctctcc

SEQ ID NO: 188317 - DNA, 25 bp, Mus musculus
agactcccaggagattaccaaggaa

SEQ ID NO: 188318 - DNA, 25 bp, Mus musculus
agactcccaggagttgaccctggag

SEQ ID NO: 188319 - DNA, 25 bp, Mus musculus
agactccccagtttctcaagggagg

SEQ ID NO: 188320 - DNA, 25 bp, Mus musculus
agactccccatcagctgtttctcca

SEQ ID NO: 188321 - DNA, 25 bp, Mus musculus
agactccccatcaggtttggacata

SEQ ID NO: 188322 - DNA, 25 bp, Mus musculus
agactcccctgaatttaaggagcag

SEQ ID NO: 188323 - DNA, 25 bp, Mus musculus
agactcccgcaaagacaggtggtgt

SEQ ID NO: 188324 - DNA, 25 bp, Mus musculus
agactcccgcaagacgcttaaagga

SEQ ID NO: 188325 - DNA, 25 bp, Mus musculus
agactccctggaggtttgcctcaaa

SEQ ID NO: 188326 - DNA, 25 bp, Mus musculus
agactccgagggacatctctacact

SEQ ID NO: 188327 - DNA, 25 bp, Mus musculus
agactccgccacctccgccttactc

SEQ ID NO: 188328 - DNA, 25 bp, Mus musculus
agactccggaagaacctcagctatg

SEQ ID NO: 188329 - DNA, 25 bp, Mus musculus
agactccggcatccagtcctctctc

SEQ ID NO: 188330 - DNA, 25 bp, Mus musculus
agactccggtgaagaatgctatcag

SEQ ID NO: 188331 - DNA, 25 bp, Mus musculus
agactccgtgtgtcacattagcttt

SEQ ID NO: 188332 - DNA, 25 bp, Mus musculus
agactcctcacctttacagattgga

SEQ ID NO: 188333 - DNA, 25 bp, Mus musculus
agactcctctgattcagatgccacc

SEQ ID NO: 188334 - DNA, 25 bp, Mus musculus
agactcctgccagccattctgtatt

SEQ ID NO: 188335 - DNA, 25 bp, Mus musculus
agactcctgccagggcgattcaggg

SEQ ID NO: 188336 - DNA, 25 bp, Mus musculus
agactccttggcgcttagtgctgct

SEQ ID NO: 188337 - DNA, 25 bp, Mus musculus
agactcgaaacttatagctctcata

SEQ ID NO: 188338 - DNA, 25 bp, Mus musculus
agactcgatgtgtttacagtggata

SEQ ID NO: 188339 - DNA, 25 bp, Mus musculus
agactcgtggcaggggtactacaag

SEQ ID NO: 188340 - DNA, 25 bp, Mus musculus
agactcgtgtccctcgtttagcttt

SEQ ID NO: 188341 - DNA, 25 bp, Mus musculus
agactctaacaccgcaagccccgcc

SEQ ID NO: 188342 - DNA, 25 bp, Mus musculus
agactctagctgggcgaggacccgt

SEQ ID NO: 188343 - DNA, 25 bp, Mus musculus
agactctcaccaagcggacagagaa

SEQ ID NO: 188344 - DNA, 25 bp, Mus musculus
agactctcaccaaggctctggccta

SEQ ID NO: 188345 - DNA, 25 bp, Mus musculus
agactctcagaccaaatacacactg

SEQ ID NO: 188346 - DNA, 25 bp, Mus musculus
agactctcaggccggggagcgtcat

SEQ ID NO: 188347 - DNA, 25 bp, Mus musculus
agactctcccagggatgaacaggcc

SEQ ID NO: 188348 - DNA, 25 bp, Mus musculus
agactctctcccagatgacagtcat

SEQ ID NO: 188349 - DNA, 25 bp, Mus musculus
agactctctgtggaccccgttcatg

SEQ ID NO: 188350 - DNA, 25 bp, Mus musculus
agactctgaaacagagatggctccc

SEQ ID NO: 188351 - DNA, 25 bp, Mus musculus
agactctgaaacaggtcctgcctaa

SEQ ID NO: 188352 - DNA, 25 bp, Mus musculus
agactctgaagcagattcgctgcct

SEQ ID NO: 188353 - DNA, 25 bp, Mus musculus
agactctgaagcgagaccaccgtgg

SEQ ID NO: 188354 - DNA, 25 bp, Mus musculus
agactctgcaaagcgccatcaaagg

SEQ ID NO: 188355 - DNA, 25 bp, Mus musculus
agactctgcaaagcgctactgttga

SEQ ID NO: 188356 - DNA, 25 bp, Mus musculus
agactctgccaaggagttaatcagt

SEQ ID NO: 188357 - DNA, 25 bp, Mus musculus
agactctgcggcactctgtccagca

SEQ ID NO: 188358 - DNA, 25 bp, Mus musculus
agactctgcttttggcaactcgttg

SEQ ID NO: 188359 - DNA, 25 bp, Mus musculus
agactctgtacggcttgtgaaatgg

SEQ ID NO: 188360 - DNA, 25 bp, Mus musculus
agactctgtcggggctggtgagatg

SEQ ID NO: 188361 - DNA, 25 bp, Mus musculus
agactcttacggaattaattcgaga

SEQ ID NO: 188362 - DNA, 25 bp, Mus musculus
agactcttacggtcttaccacaaac

SEQ ID NO: 188363 - DNA, 25 bp, Mus musculus
agactcttagagaacatgctggata

SEQ ID NO: 188364 - DNA, 25 bp, Mus musculus
agactcttagagaagatccatctga

SEQ ID NO: 188365 - DNA, 25 bp, Mus musculus
agactcttcagacagacccttagag

SEQ ID NO: 188366 - DNA, 25 bp, Mus musculus
agactcttcagacagagggccacag

SEQ ID NO: 188367 - DNA, 25 bp, Mus musculus
agactcttcatttgatgcagcaatt

SEQ ID NO: 188368 - DNA, 25 bp, Mus musculus
agactcttcccaagctaaagcccat

SEQ ID NO: 188369 - DNA, 25 bp, Mus musculus
agactcttctggaagccgctctctc

SEQ ID NO: 188370 - DNA, 25 bp, Mus musculus
agactcttctggaaggatccgccgc

SEQ ID NO: 188371 - DNA, 25 bp, Mus musculus
agactcttgatgagggtccaccaaa

SEQ ID NO: 188372 - DNA, 25 bp, Mus musculus
agactcttggagaaaatccaagttc

SEQ ID NO: 188373 - DNA, 25 bp, Mus musculus
agactcttggagctggaagagaaaa

SEQ ID NO: 188374 - DNA, 25 bp, Mus musculus
agactgaactaagacagaaagacat

SEQ ID NO: 188375 - DNA, 25 bp, Mus musculus
agactgaaggaggaagctgacctag

SEQ ID NO: 188376 - DNA, 25 bp, Mus musculus
agactgaaggagtctccagcctccc

SEQ ID NO: 188377 - DNA, 25 bp, Mus musculus
agactgaccaaggctccagaaatgt

SEQ ID NO: 188378 - DNA, 25 bp, Mus musculus
agactgaccaaggggctgacgggac

SEQ ID NO: 188379 - DNA, 25 bp, Mus musculus
agactgaccttctagctcaccctag

SEQ ID NO: 188380 - DNA, 25 bp, Mus musculus
agactgaccttgaaggggactcaga

SEQ ID NO: 188381 - DNA, 25 bp, Mus musculus
agactgacgcagtctggcttgccac

SEQ ID NO: 188382 - DNA, 25 bp, Mus musculus
agactgactccgtatgaggttgatg

SEQ ID NO: 188383 - DNA, 25 bp, Mus musculus
agactgactgggagacttgtggcaa

SEQ ID NO: 188384 - DNA, 25 bp, Mus musculus
agactgactgtgtgtcccatgggtg

SEQ ID NO: 188385 - DNA, 25 bp, Mus musculus
agactgagaacaggtccaaagagaa

SEQ ID NO: 188386 - DNA, 25 bp, Mus musculus
agactgagaacaggtctaggtccaa

SEQ ID NO: 188387 - DNA, 25 bp, Mus musculus
agactgagaacctgccctgcagtta

SEQ ID NO: 188388 - DNA, 25 bp, Mus musculus
agactgagaagatgggtaatgccat

SEQ ID NO: 188389 - DNA, 25 bp, Mus musculus
agactgagagaggaccatgctcccc

SEQ ID NO: 188390 - DNA, 25 bp, Mus musculus
agactgagagccctgagcccggaga

SEQ ID NO: 188391 - DNA, 25 bp, Mus musculus
agactgagaggctatcagggcgtct

SEQ ID NO: 188392 - DNA, 25 bp, Mus musculus
agactgagatagacaccatcttgct

SEQ ID NO: 188393 - DNA, 25 bp, Mus musculus
agactgagatagatttcaaatatgc

SEQ ID NO: 188394 - DNA, 25 bp, Mus musculus
agactgaggaacctgagaagaagga

SEQ ID NO: 188395 - DNA, 25 bp, Mus musculus
agactgaggaagattgacttctaaa

SEQ ID NO: 188396 - DNA, 25 bp, Mus musculus
agactgaggaccacatgggtggcat

SEQ ID NO: 188397 - DNA, 25 bp, Mus musculus
agactgagtacaaggttggaagtcg

SEQ ID NO: 188398 - DNA, 25 bp, Mus musculus
agactgataggactccagaggacct

SEQ ID NO: 188399 - DNA, 25 bp, Mus musculus
agactgatgtgggaggtacgtggga

SEQ ID NO: 188400 - DNA, 25 bp, Mus musculus
agactgcaaaatgggagccaggagt

SEQ ID NO: 188401 - DNA, 25 bp, Mus musculus
agactgcaaagaggctgatttatcg

SEQ ID NO: 188402 - DNA, 25 bp, Mus musculus
agactgcaaaggtaaccagagcgag

SEQ ID NO: 188403 - DNA, 25 bp, Mus musculus
agactgcaaaggtgaccagagcgag

SEQ ID NO: 188404 - DNA, 25 bp, Mus musculus
agactgcactgtcagagagtgggga

SEQ ID NO: 188405 - DNA, 25 bp, Mus musculus
agactgcactgtcagcagcattcct

SEQ ID NO: 188406 - DNA, 25 bp, Mus musculus
agactgcacttgtggtttgctatct

SEQ ID NO: 188407 - DNA, 25 bp, Mus musculus
agactgcagactcacgcccactgga

SEQ ID NO: 188408 - DNA, 25 bp, Mus musculus
agactgcagaggaggtgttactagt

SEQ ID NO: 188409 - DNA, 25 bp, Mus musculus
agactgcaggaagaaagtctgcacc

SEQ ID NO: 188410 - DNA, 25 bp, Mus musculus
agactgcaggaagcttgggatccgc

SEQ ID NO: 188411 - DNA, 25 bp, Mus musculus
agactgcaggaggtctccaggtggt

SEQ ID NO: 188412 - DNA, 25 bp, Mus musculus
agactgcatggaactacatgaatga

SEQ ID NO: 188413 - DNA, 25 bp, Mus musculus
agactgccaagactcactctgtgga

SEQ ID NO: 188414 - DNA, 25 bp, Mus musculus
agactgccaaggaggccgagttagc

SEQ ID NO: 188415 - DNA, 25 bp, Mus musculus
agactgccacggcctcctcagcagc

SEQ ID NO: 188416 - DNA, 25 bp, Mus musculus
agactgccacggtcatctctcatgg

SEQ ID NO: 188417 - DNA, 25 bp, Mus musculus
agactgcctagtgagtttacaggct

SEQ ID NO: 188418 - DNA, 25 bp, Mus musculus
agactgcgacttggataagaaaact

SEQ ID NO: 188419 - DNA, 25 bp, Mus musculus
agactgcgacttgggcttcctgtat

SEQ ID NO: 188420 - DNA, 25 bp, Mus musculus
agactgcgagcacgtagaagacccg

SEQ ID NO: 188421 - DNA, 25 bp, Mus musculus
agactgcgaggaccgtcacgacggc

SEQ ID NO: 188422 - DNA, 25 bp, Mus musculus
agactgctccagggaaaatagagaa

SEQ ID NO: 188423 - DNA, 25 bp, Mus musculus
agactgctccaggtcctggaggcca

SEQ ID NO: 188424 - DNA, 25 bp, Mus musculus
agactgctcctggtgcatggaggac

SEQ ID NO: 188425 - DNA, 25 bp, Mus musculus
agactgctctacgaagcgctgcgct

SEQ ID NO: 188426 - DNA, 25 bp, Mus musculus
agactgctgacagaaatcttaaaaa

SEQ ID NO: 188427 - DNA, 25 bp, Mus musculus
agactgctgacaggcaccacacagt

SEQ ID NO: 188428 - DNA, 25 bp, Mus musculus
agactgctgccaggtggagagagcc

SEQ ID NO: 188429 - DNA, 25 bp, Mus musculus
agactgcttctaagactctgaattc

SEQ ID NO: 188430 - DNA, 25 bp, Mus musculus
agactgctttttaggaccttgttcc

SEQ ID NO: 188431 - DNA, 25 bp, Mus musculus
agactgctttttagtggtgatcatg

SEQ ID NO: 188432 - DNA, 25 bp, Mus musculus
agactggaaggaacatgacatcgag

SEQ ID NO: 188433 - DNA, 25 bp, Mus musculus
agactggacagaacgattccgggat

SEQ ID NO: 188434 - DNA, 25 bp, Mus musculus
agactggactcaagcggatagccaa

SEQ ID NO: 188435 - DNA, 25 bp, Mus musculus
agactggagaggctcccccaccgaa

SEQ ID NO: 188436 - DNA, 25 bp, Mus musculus
agactggagcttggtgtctgtctct

SEQ ID NO: 188437 - DNA, 25 bp, Mus musculus
agactggaggacggaaaccactgag

SEQ ID NO: 188438 - DNA, 25 bp, Mus musculus
agactggaggagttgaaagaatttg

SEQ ID NO: 188439 - DNA, 25 bp, Mus musculus
agactggaggatacgtcctctgcca

SEQ ID NO: 188440 - DNA, 25 bp, Mus musculus
agactggagggctagatgggatgtg

SEQ ID NO: 188441 - DNA, 25 bp, Mus musculus
agactggagggctaggcttcaactt

SEQ ID NO: 188442 - DNA, 25 bp, Mus musculus
agactggagtccagcaatccaaact

SEQ ID NO: 188443 - DNA, 25 bp, Mus musculus
agactggatactgcctgtgcctcac

SEQ ID NO: 188444 - DNA, 25 bp, Mus musculus
agactggatactggtaacagcatga

SEQ ID NO: 188445 - DNA, 25 bp, Mus musculus
agactggatggggggtgtgccagcc

SEQ ID NO: 188446 - DNA, 25 bp, Mus musculus
agactggcaaggttactttggagta

SEQ ID NO: 188447 - DNA, 25 bp, Mus musculus
agactggcacatgaggtcgggtgga

SEQ ID NO: 188448 - DNA, 25 bp, Mus musculus
agactggcaggacagtttcttgaag

SEQ ID NO: 188449 - DNA, 25 bp, Mus musculus
agactggcgcggccgaggctgcttc

SEQ ID NO: 188450 - DNA, 25 bp, Mus musculus
agactggctaagaactgccagtgta

SEQ ID NO: 188451 - DNA, 25 bp, Mus musculus
agactggctcttggcgacaactggc

SEQ ID NO: 188452 - DNA, 25 bp, Mus musculus
agactgggcagttggtcatcatgga

SEQ ID NO: 188453 - DNA, 25 bp, Mus musculus
agactggggccgtcatcatagccag

SEQ ID NO: 188454 - DNA, 25 bp, Mus musculus
agactggtggcctcaagggttacag

SEQ ID NO: 188455 - DNA, 25 bp, Mus musculus
agactggttaacgcttatttcctca

SEQ ID NO: 188456 - DNA, 25 bp, Mus musculus
agactggttttggaggctgataagc

SEQ ID NO: 188457 - DNA, 25 bp, Mus musculus
agactgtaacctgtcctggttatgg

SEQ ID NO: 188458 - DNA, 25 bp, Mus musculus
agactgtaccaggcccagtctgtgc

SEQ ID NO: 188459 - DNA, 25 bp, Mus musculus
agactgtaccagggccacaccctac

SEQ ID NO: 188460 - DNA, 25 bp, Mus musculus
agactgtaccagtgacttcaatgca

SEQ ID NO: 188461 - DNA, 25 bp, Mus musculus
agactgtagcaaggtgtctgatgcc

SEQ ID NO: 188462 - DNA, 25 bp, Mus musculus
agactgtagcaattccttcttggag

SEQ ID NO: 188463 - DNA, 25 bp, Mus musculus
agactgtatggcacgaatgaggaag

SEQ ID NO: 188464 - DNA, 25 bp, Mus musculus
agactgtattccagaatgcccatat

SEQ ID NO: 188465 - DNA, 25 bp, Mus musculus
agactgtcatccaggaccccatgcc

SEQ ID NO: 188466 - DNA, 25 bp, Mus musculus
agactgtccacagatacttggataa

SEQ ID NO: 188467 - DNA, 25 bp, Mus musculus
agactgtcctcccgggtaaatagct

SEQ ID NO: 188468 - DNA, 25 bp, Mus musculus
agactgtcctggaggagagggaaga

SEQ ID NO: 188469 - DNA, 25 bp, Mus musculus
agactgtgaaagtgtatgagaagtt

SEQ ID NO: 188470 - DNA, 25 bp, Mus musculus
agactgtgaagcgaggtctaagccg

SEQ ID NO: 188471 - DNA, 25 bp, Mus musculus
agactgtgaagcgagtttcagggac

SEQ ID NO: 188472 - DNA, 25 bp, Mus musculus
agactgtgagccaaaaagcagggcc

SEQ ID NO: 188473 - DNA, 25 bp, Mus musculus
agactgtgcagagccaatatgaaga

SEQ ID NO: 188474 - DNA, 25 bp, Mus musculus
agactgtgcagaggttcacctggtc

SEQ ID NO: 188475 - DNA, 25 bp, Mus musculus
agactgtggacgatgtcataaagga

SEQ ID NO: 188476 - DNA, 25 bp, Mus musculus
agactgtggacgggattctctgctc

SEQ ID NO: 188477 - DNA, 25 bp, Mus musculus
agactgtggagaccacagacagcaa

SEQ ID NO: 188478 - DNA, 25 bp, Mus musculus
agactgtggaggtcttctgcgagta

SEQ ID NO: 188479 - DNA, 25 bp, Mus musculus
agactgtgtgccaaggcgaaagccc

SEQ ID NO: 188480 - DNA, 25 bp, Mus musculus
agactgtgtgccaaggtttgacctg

SEQ ID NO: 188481 - DNA, 25 bp, Mus musculus
agactgttctctaattttccaggtg

SEQ ID NO: 188482 - DNA, 25 bp, Mus musculus
agacttaaagatttcacaggtctat

SEQ ID NO: 188483 - DNA, 25 bp, Mus musculus
agacttaaagtggcccagacgtcac

SEQ ID NO: 188484 - DNA, 25 bp, Mus musculus
agacttaatcaccgtcattacccaa

SEQ ID NO: 188485 - DNA, 25 bp, Mus musculus
agacttaatgtttgtgtgtctaaac

SEQ ID NO: 188486 - DNA, 25 bp, Mus musculus
agacttacagattgccaaaatgctt

SEQ ID NO: 188487 - DNA, 25 bp, Mus musculus
agacttacatcacggagaatgtact

SEQ ID NO: 188488 - DNA, 25 bp, Mus musculus
agacttagagaaggaagggaacatg

SEQ ID NO: 188489 - DNA, 25 bp, Mus musculus
agacttattaaggtcacagtaatga

SEQ ID NO: 188490 - DNA, 25 bp, Mus musculus
agacttcaacaaggtaatgcaggtg

SEQ ID NO: 188491 - DNA, 25 bp, Mus musculus
agacttcaagaggacgctggtagag

SEQ ID NO: 188492 - DNA, 25 bp, Mus musculus
agacttcacacacatttaccttcag

SEQ ID NO: 188493 - DNA, 25 bp, Mus musculus
agacttcacactgttccaggcttta

SEQ ID NO: 188494 - DNA, 25 bp, Mus musculus
agacttcaccacagtgtttacaaaa

SEQ ID NO: 188495 - DNA, 25 bp, Mus musculus
agacttcaggaataaagtggtgaca

SEQ ID NO: 188496 - DNA, 25 bp, Mus musculus
agacttccacacgcgcacggaccat

SEQ ID NO: 188497 - DNA, 25 bp, Mus musculus
agacttcccagagaatgttgctgag

SEQ ID NO: 188498 - DNA, 25 bp, Mus musculus
agacttcccagctctcttctccttc

SEQ ID NO: 188499 - DNA, 25 bp, Mus musculus
agacttcccagggctatacatccta

SEQ ID NO: 188500 - DNA, 25 bp, Mus musculus
agacttcccctcggatgcagatggg

SEQ ID NO: 188501 - DNA, 25 bp, Mus musculus
agacttccttcagggccactgatga

SEQ ID NO: 188502 - DNA, 25 bp, Mus musculus
agacttccttcaggtgttagagata

SEQ ID NO: 188503 - DNA, 25 bp, Mus musculus
agacttctaaggcctctcctgcagc

SEQ ID NO: 188504 - DNA, 25 bp, Mus musculus
agacttctacctgtgtcttcctggg

SEQ ID NO: 188505 - DNA, 25 bp, Mus musculus
agacttctcaaggctcagaaatcct

SEQ ID NO: 188506 - DNA, 25 bp, Mus musculus
agacttctcagaggctccatctcca

SEQ ID NO: 188507 - DNA, 25 bp, Mus musculus
agacttctccaggctagaaaatgcc

SEQ ID NO: 188508 - DNA, 25 bp, Mus musculus
agacttctctcagctacagcggaac

SEQ ID NO: 188509 - DNA, 25 bp, Mus musculus
agacttctgcattcctctgtgtacc

SEQ ID NO: 188510 - DNA, 25 bp, Mus musculus
agacttctgcattcgctgtgacagc

SEQ ID NO: 188511 - DNA, 25 bp, Mus musculus
agacttcttcacggcatggatgatg

SEQ ID NO: 188512 - DNA, 25 bp, Mus musculus
agacttgaaagcacagtggttgaag

SEQ ID NO: 188513 - DNA, 25 bp, Mus musculus
agacttgaacagcattgaggatcct

SEQ ID NO: 188514 - DNA, 25 bp, Mus musculus
agacttgacaaggtggtgacagtgg

SEQ ID NO: 188515 - DNA, 25 bp, Mus musculus
agacttgacaatagctctggtgcaa

SEQ ID NO: 188516 - DNA, 25 bp, Mus musculus
agacttgcactggttgttcatcgcc

SEQ ID NO: 188517 - DNA, 25 bp, Mus musculus
agacttgccagggaaaatcatagtg

SEQ ID NO: 188518 - DNA, 25 bp, Mus musculus
agacttgccgggtggagacagagta

SEQ ID NO: 188519 - DNA, 25 bp, Mus musculus
agacttgcctaagttggaaaagcgt

SEQ ID NO: 188520 - DNA, 25 bp, Mus musculus
agacttgctggtacaagtatgaatt

SEQ ID NO: 188521 - DNA, 25 bp, Mus musculus
agacttggagacccagacccagctg

SEQ ID NO: 188522 - DNA, 25 bp, Mus musculus
agacttggagcactttgaggaaaca

SEQ ID NO: 188523 - DNA, 25 bp, Mus musculus
agacttggagctgaccacagtggct

SEQ ID NO: 188524 - DNA, 25 bp, Mus musculus
agacttggccagggagccacagcta

SEQ ID NO: 188525 - DNA, 25 bp, Mus musculus
agacttggctcctactttctgcact

SEQ ID NO: 188526 - DNA, 25 bp, Mus musculus
agacttggctcctgcctgaggagcg

SEQ ID NO: 188527 - DNA, 25 bp, Mus musculus
agacttgggagggggggcctgctgt

SEQ ID NO: 188528 - DNA, 25 bp, Mus musculus
agacttggggtccaggtcgggatgg

SEQ ID NO: 188529 - DNA, 25 bp, Mus musculus
agacttggtggttctccgttctgag

SEQ ID NO: 188530 - DNA, 25 bp, Mus musculus
agacttgtattaagatgggcgtatg

SEQ ID NO: 188531 - DNA, 25 bp, Mus musculus
agacttgtattccctgtgagtgtga

SEQ ID NO: 188532 - DNA, 25 bp, Mus musculus
agacttgtctctggcgtgggtgact

SEQ ID NO: 188533 - DNA, 25 bp, Mus musculus
agacttgttaagtttctagtgggaa

SEQ ID NO: 188534 - DNA, 25 bp, Mus musculus
agactttagtcctgcactagaaacc

SEQ ID NO: 188535 - DNA, 25 bp, Mus musculus
agactttatttgtctgtctcttctc

SEQ ID NO: 188536 - DNA, 25 bp, Mus musculus
agactttcaggctgtggaccttgac

SEQ ID NO: 188537 - DNA, 25 bp, Mus musculus
agactttcaggttccagctgtggac

SEQ ID NO: 188538 - DNA, 25 bp, Mus musculus
agactttccaagaaagtcactgtaa

SEQ ID NO: 188539 - DNA, 25 bp, Mus musculus
agactttccaaggtggaacttgcag

SEQ ID NO: 188540 - DNA, 25 bp, Mus musculus
agactttcccaataaagactgagtt

SEQ ID NO: 188541 - DNA, 25 bp, Mus musculus
agactttgacgagatcatcagtgag

SEQ ID NO: 188542 - DNA, 25 bp, Mus musculus
agactttgacgagtgaggagagatt

SEQ ID NO: 188543 - DNA, 25 bp, Mus musculus
agactttgaggaggaagaagtgcta

SEQ ID NO: 188544 - DNA, 25 bp, Mus musculus
agactttgcaaagacgtgtgcaaga

SEQ ID NO: 188545 - DNA, 25 bp, Mus musculus
agactttgcaaagacgtgtgtgtct

SEQ ID NO: 188546 - DNA, 25 bp, Mus musculus
agactttgcagaaatgaagcagatg

SEQ ID NO: 188547 - DNA, 25 bp, Mus musculus
agactttgctggatgcttttgttaa

SEQ ID NO: 188548 - DNA, 25 bp, Mus musculus
agactttggaccaaagacccagcca

SEQ ID NO: 188549 - DNA, 25 bp, Mus musculus
agactttggaccaactgttctcagt

SEQ ID NO: 188550 - DNA, 25 bp, Mus musculus
agactttgggcaggaaacaagttac

SEQ ID NO: 188551 - DNA, 25 bp, Mus musculus
agactttggtggcacgcggtgtcgc

SEQ ID NO: 188552 - DNA, 25 bp, Mus musculus
agactttgtggctgagttcctgttt

SEQ ID NO: 188553 - DNA, 25 bp, Mus musculus
agactttgtgggcctgctgtccctt

SEQ ID NO: 188554 - DNA, 25 bp, Mus musculus
agacttttaggccatctcttggcgt

SEQ ID NO: 188555 - DNA, 25 bp, Mus musculus
agacttttagggccaaagatctcat

SEQ ID NO: 188556 - DNA, 25 bp, Mus musculus
agacttttgggctctatacaaccat

SEQ ID NO: 188557 - DNA, 25 bp, Mus musculus
agactttttacaaagtgattggagt

SEQ ID NO: 188558 - DNA, 25 bp, Mus musculus
agactttttacataatccccagatg

SEQ ID NO: 188559 - DNA, 25 bp, Mus musculus
agactttttacataatcggggtcta

SEQ ID NO: 188560 - DNA, 25 bp, Mus musculus
agagaaaaaagaatggaatggcaaa

SEQ ID NO: 188561 - DNA, 25 bp, Mus musculus
agagaaaaaagatttgatgttgaat

SEQ ID NO: 188562 - DNA, 25 bp, Mus musculus
agagaaaaacggctcttgcttcttg

SEQ ID NO: 188563 - DNA, 25 bp, Mus musculus
agagaaaaatggaatctctacgaag

SEQ ID NO: 188564 - DNA, 25 bp, Mus musculus
agagaaaaattgaacgagaagtaaa

SEQ ID NO: 188565 - DNA, 25 bp, Mus musculus
agagaaaacaaatggctccagccca

SEQ ID NO: 188566 - DNA, 25 bp, Mus musculus
agagaaaacaggcatgtaatgaatt

SEQ ID NO: 188567 - DNA, 25 bp, Mus musculus
agagaaaacaggtctcagcatcaga

SEQ ID NO: 188568 - DNA, 25 bp, Mus musculus
agagaaaagattaatacacaaaatt

SEQ ID NO: 188569 - DNA, 25 bp, Mus musculus
agagaaaagcaagtgctgtcttcct

SEQ ID NO: 188570 - DNA, 25 bp, Mus musculus
agagaaaagcacagccttcacaggc

SEQ ID NO: 188571 - DNA, 25 bp, Mus musculus
agagaaaagcacaggctgctgagga

SEQ ID NO: 188572 - DNA, 25 bp, Mus musculus
agagaaaaggcggcggtcctttcta

SEQ ID NO: 188573 - DNA, 25 bp, Mus musculus
agagaaaagtcaagaagaacaaaca

SEQ ID NO: 188574 - DNA, 25 bp, Mus musculus
agagaaaagtcaaggtgtactttgt

SEQ ID NO: 188575 - DNA, 25 bp, Mus musculus
agagaaaagttttggcatacaaatg

SEQ ID NO: 188576 - DNA, 25 bp, Mus musculus
agagaaaatgaaagcagaccgcgca

SEQ ID NO: 188577 - DNA, 25 bp, Mus musculus
agagaaacagaggtaatctacaaaa

SEQ ID NO: 188578 - DNA, 25 bp, Mus musculus
agagaaacatggtggcgacagacaa

SEQ ID NO: 188579 - DNA, 25 bp, Mus musculus
agagaaaccaggcagaagaagttag

SEQ ID NO: 188580 - DNA, 25 bp, Mus musculus
agagaaactaaaaatgtcccatctg

SEQ ID NO: 188581 - DNA, 25 bp, Mus musculus
agagaaactggacagagccaatgca

SEQ ID NO: 188582 - DNA, 25 bp, Mus musculus
agagaaagaaaaagtggagtacatg

SEQ ID NO: 188583 - DNA, 25 bp, Mus musculus
agagaaagacaattgcgccgcagag

SEQ ID NO: 188584 - DNA, 25 bp, Mus musculus
agagaaagacaattttgggtgtttg

SEQ ID NO: 188585 - DNA, 25 bp, Mus musculus
agagaaagagagtgtaatccaccta

SEQ ID NO: 188586 - DNA, 25 bp, Mus musculus
agagaaagaggatggaggcctcctg

SEQ ID NO: 188587 - DNA, 25 bp, Mus musculus
agagaaagatatgctggcatcgcca

SEQ ID NO: 188588 - DNA, 25 bp, Mus musculus
agagaaagatatggcagtgaaaatg

SEQ ID NO: 188589 - DNA, 25 bp, Mus musculus
agagaaagatgtgcactaggccttc

SEQ ID NO: 188590 - DNA, 25 bp, Mus musculus
agagaaagattaaggagctatcgaa

SEQ ID NO: 188591 - DNA, 25 bp, Mus musculus
agagaaagcaccagcaccaggtctt

SEQ ID NO: 188592 - DNA, 25 bp, Mus musculus
agagaaagcaccaggtccccggcgc

SEQ ID NO: 188593 - DNA, 25 bp, Mus musculus
agagaaagcaggttcatgttttatc

SEQ ID NO: 188594 - DNA, 25 bp, Mus musculus
agagaaagcataaagaccagtttcc

SEQ ID NO: 188595 - DNA, 25 bp, Mus musculus
agagaaagcataaagatctgggcag

SEQ ID NO: 188596 - DNA, 25 bp, Mus musculus
agagaaagccaatgcaccatgaaca

SEQ ID NO: 188597 - DNA, 25 bp, Mus musculus
agagaaagccagtgtgaataaattt

SEQ ID NO: 188598 - DNA, 25 bp, Mus musculus
agagaaagccgagtccatctaccgc

SEQ ID NO: 188599 - DNA, 25 bp, Mus musculus
agagaaaggttctcaacgcctgctt

SEQ ID NO: 188600 - DNA, 25 bp, Mus musculus
agagaaagtgatgtatcgcctgagc

SEQ ID NO: 188601 - DNA, 25 bp, Mus musculus
agagaaatacagatgtctctttaag

SEQ ID NO: 188602 - DNA, 25 bp, Mus musculus
agagaaatatgtgcatgagctcatt

SEQ ID NO: 188603 - DNA, 25 bp, Mus musculus
agagaaatcaagggcttaaggaata

SEQ ID NO: 188604 - DNA, 25 bp, Mus musculus
agagaaatcaagtttgcttttcctc

SEQ ID NO: 188605 - DNA, 25 bp, Mus musculus
agagaaatggagagaagcccgggac

SEQ ID NO: 188606 - DNA, 25 bp, Mus musculus
agagaaatgggcagagagaaatgtc

SEQ ID NO: 188607 - DNA, 25 bp, Mus musculus
agagaaattgagtattttatcatct

SEQ ID NO: 188608 - DNA, 25 bp, Mus musculus
agagaacaaagatcctctgagtgcc

SEQ ID NO: 188609 - DNA, 25 bp, Mus musculus
agagaacaaattgaaatggatgcag

SEQ ID NO: 188610 - DNA, 25 bp, Mus musculus
agagaacaacgtttccctcagtacc

SEQ ID NO: 188611 - DNA, 25 bp, Mus musculus
agagaacaagaggtttgaagatcaa

SEQ ID NO: 188612 - DNA, 25 bp, Mus musculus
agagaacaagatttctccttattac

SEQ ID NO: 188613 - DNA, 25 bp, Mus musculus
agagaacaaggtccttccatagtga

SEQ ID NO: 188614 - DNA, 25 bp, Mus musculus
agagaacactgtgatctgctcttct

SEQ ID NO: 188615 - DNA, 25 bp, Mus musculus
agagaacactgtggctctccagagc

SEQ ID NO: 188616 - DNA, 25 bp, Mus musculus
agagaacactgttttcatgaaccat

SEQ ID NO: 188617 - DNA, 25 bp, Mus musculus
agagaacagcagaggttcagaaggg

SEQ ID NO: 188618 - DNA, 25 bp, Mus musculus
agagaacagcagctccattttattc

SEQ ID NO: 188619 - DNA, 25 bp, Mus musculus
agagaacatggatgtcagcaattga

SEQ ID NO: 188620 - DNA, 25 bp, Mus musculus
agagaaccaaaggacttcaggaacc

SEQ ID NO: 188621 - DNA, 25 bp, Mus musculus
agagaaccagcattggattgcaatc

SEQ ID NO: 188622 - DNA, 25 bp, Mus musculus
agagaacgagccggtccgtgttcac

SEQ ID NO: 188623 - DNA, 25 bp, Mus musculus
agagaacggaagttggttgctgcat

SEQ ID NO: 188624 - DNA, 25 bp, Mus musculus
agagaacgtcccagggtgatgtgaa

SEQ ID NO: 188625 - DNA, 25 bp, Mus musculus
agagaactacttgtctacccacagc

SEQ ID NO: 188626 - DNA, 25 bp, Mus musculus
agagaactcagaacatacaacatca

SEQ ID NO: 188627 - DNA, 25 bp, Mus musculus
agagaactcagagcacccctggcta

SEQ ID NO: 188628 - DNA, 25 bp, Mus musculus
agagaactcagcagagcacccgact

SEQ ID NO: 188629 - DNA, 25 bp, Mus musculus
agagaactcagctcatggcagctcc

SEQ ID NO: 188630 - DNA, 25 bp, Mus musculus
agagaactcaggccaggaacaagtg

SEQ ID NO: 188631 - DNA, 25 bp, Mus musculus
agagaactggccggttctgcggtgg

SEQ ID NO: 188632 - DNA, 25 bp, Mus musculus
agagaacttacctaaagacgtcaat

SEQ ID NO: 188633 - DNA, 25 bp, Mus musculus
agagaacttggagatctcattccga

SEQ ID NO: 188634 - DNA, 25 bp, Mus musculus
agagaacttggtctctgggccaggg

SEQ ID NO: 188635 - DNA, 25 bp, Mus musculus
agagaagaaaaagctctcttaagag

SEQ ID NO: 188636 - DNA, 25 bp, Mus musculus
agagaagaaaaggagttggaaccct

SEQ ID NO: 188637 - DNA, 25 bp, Mus musculus
agagaagaaagaggaagatggacgg

SEQ ID NO: 188638 - DNA, 25 bp, Mus musculus
agagaagaacaaggtattgacaaat

SEQ ID NO: 188639 - DNA, 25 bp, Mus musculus
agagaagaacagtgtttagtgtaag

SEQ ID NO: 188640 - DNA, 25 bp, Mus musculus
agagaagaagaataacccatggctg

SEQ ID NO: 188641 - DNA, 25 bp, Mus musculus
agagaagaagaattaactctgctgt

SEQ ID NO: 188642 - DNA, 25 bp, Mus musculus
agagaagaagaatttgggcttcctg

SEQ ID NO: 188643 - DNA, 25 bp, Mus musculus
agagaagaagcgcaggaaaggtggg

SEQ ID NO: 188644 - DNA, 25 bp, Mus musculus
agagaagaaggcagataaggaaaag

SEQ ID NO: 188645 - DNA, 25 bp, Mus musculus
agagaagaaggcagcccagatactc

SEQ ID NO: 188646 - DNA, 25 bp, Mus musculus
agagaagaaggcaggcctccactta

SEQ ID NO: 188647 - DNA, 25 bp, Mus musculus
agagaagaagtgtttgaaagacgta

SEQ ID NO: 188648 - DNA, 25 bp, Mus musculus
agagaagagacactgcagcggaaga

SEQ ID NO: 188649 - DNA, 25 bp, Mus musculus
agagaagagcagacagataaaggag

SEQ ID NO: 188650 - DNA, 25 bp, Mus musculus
agagaagaggacggctgctgctgaa

SEQ ID NO: 188651 - DNA, 25 bp, Mus musculus
agagaagatatgtagtcagaagatg

SEQ ID NO: 188652 - DNA, 25 bp, Mus musculus
agagaagatccagggcttggaccgc

SEQ ID NO: 188653 - DNA, 25 bp, Mus musculus
agagaagatgagattctgttttgaa

SEQ ID NO: 188654 - DNA, 25 bp, Mus musculus
agagaagatgagatttctgctttca

SEQ ID NO: 188655 - DNA, 25 bp, Mus musculus
agagaagattgaagccatggctgag

SEQ ID NO: 188656 - DNA, 25 bp, Mus musculus
agagaagcaagcatgaatgaagtct

SEQ ID NO: 188657 - DNA, 25 bp, Mus musculus
agagaagcaagcatgagaaaggctg

SEQ ID NO: 188658 - DNA, 25 bp, Mus musculus
agagaagcagcttgtgaaaaagcag

SEQ ID NO: 188659 - DNA, 25 bp, Mus musculus
agagaagcaggaggatcatgcggca

SEQ ID NO: 188660 - DNA, 25 bp, Mus musculus
agagaagcaggcaaggtatacttga

SEQ ID NO: 188661 - DNA, 25 bp, Mus musculus
agagaagccaggttacaaactacct

SEQ ID NO: 188662 - DNA, 25 bp, Mus musculus
agagaagcccaaggagggtgtgaag

SEQ ID NO: 188663 - DNA, 25 bp, Mus musculus
agagaagcccgagttcgtgagtgtc

SEQ ID NO: 188664 - DNA, 25 bp, Mus musculus
agagaagccggcctctggtgctctt

SEQ ID NO: 188665 - DNA, 25 bp, Mus musculus
agagaagccggttatacaatggtcg

SEQ ID NO: 188666 - DNA, 25 bp, Mus musculus
agagaagctcaagacatactttgaa

SEQ ID NO: 188667 - DNA, 25 bp, Mus musculus
agagaagctgctgggccctaatgct

SEQ ID NO: 188668 - DNA, 25 bp, Mus musculus
agagaagctgttgcaggaagaggcc

SEQ ID NO: 188669 - DNA, 25 bp, Mus musculus
agagaagcttcgagcagcagttttt

SEQ ID NO: 188670 - DNA, 25 bp, Mus musculus
agagaaggaaaaggaaacacaacct

SEQ ID NO: 188671 - DNA, 25 bp, Mus musculus
agagaaggaagacaccaaatcctac

SEQ ID NO: 188672 - DNA, 25 bp, Mus musculus
agagaaggaaggaatgtcactgtct

SEQ ID NO: 188673 - DNA, 25 bp, Mus musculus
agagaaggaaggtatttccaaacta

SEQ ID NO: 188674 - DNA, 25 bp, Mus musculus
agagaaggaccaggacaaaggcctt

SEQ ID NO: 188675 - DNA, 25 bp, Mus musculus
agagaaggagctggagcagagccag

SEQ ID NO: 188676 - DNA, 25 bp, Mus musculus
agagaaggaggaagaggaggacgag

SEQ ID NO: 188677 - DNA, 25 bp, Mus musculus
agagaaggaggccgcatccacgcca

SEQ ID NO: 188678 - DNA, 25 bp, Mus musculus
agagaaggatcagctgaagaataaa

SEQ ID NO: 188679 - DNA, 25 bp, Mus musculus
agagaaggatgcatcttcctggtca

SEQ ID NO: 188680 - DNA, 25 bp, Mus musculus
agagaaggatggcatccccatcagc

SEQ ID NO: 188681 - DNA, 25 bp, Mus musculus
agagaaggcagattctcattgccaa

SEQ ID NO: 188682 - DNA, 25 bp, Mus musculus
agagaaggctcagtgccatggagaa

SEQ ID NO: 188683 - DNA, 25 bp, Mus musculus
agagaaggctcagtgctgtatgcca

SEQ ID NO: 188684 - DNA, 25 bp, Mus musculus
agagaagggaggtgtgaactgaacc

SEQ ID NO: 188685 - DNA, 25 bp, Mus musculus
agagaagggcagtgttgctgaagca

SEQ ID NO: 188686 - DNA, 25 bp, Mus musculus
agagaaggggagcagaaaatgtttt

SEQ ID NO: 188687 - DNA, 25 bp, Mus musculus
agagaaggtgatcatctgtctggat

SEQ ID NO: 188688 - DNA, 25 bp, Mus musculus
agagaagtcagagcagcagcaagtc

SEQ ID NO: 188689 - DNA, 25 bp, Mus musculus
agagaagtcagagtgaaagtagaac

SEQ ID NO: 188690 - DNA, 25 bp, Mus musculus
agagaagtcagcctggaaactgccc

SEQ ID NO: 188691 - DNA, 25 bp, Mus musculus
agagaagtcagcctggcgcaagatg

SEQ ID NO: 188692 - DNA, 25 bp, Mus musculus
agagaagtccaggaagatgggctcc

SEQ ID NO: 188693 - DNA, 25 bp, Mus musculus
agagaagtttgaccctgaggcttta

SEQ ID NO: 188694 - DNA, 25 bp, Mus musculus
agagaataaaacagaaacatggagc

SEQ ID NO: 188695 - DNA, 25 bp, Mus musculus
agagaataaatggcttgttggcaga

SEQ ID NO: 188696 - DNA, 25 bp, Mus musculus
agagaataataaggagaatctgtac

SEQ ID NO: 188697 - DNA, 25 bp, Mus musculus
agagaataatcaggttttaaaatca

SEQ ID NO: 188698 - DNA, 25 bp, Mus musculus
agagaatagtcagacttctgccaga

SEQ ID NO: 188699 - DNA, 25 bp, Mus musculus
agagaatatcagctgcaagaaaaat

SEQ ID NO: 188700 - DNA, 25 bp, Mus musculus
agagaatatgaccacctatctagag

SEQ ID NO: 188701 - DNA, 25 bp, Mus musculus
agagaatatgagatcctgcaacgaa

SEQ ID NO: 188702 - DNA, 25 bp, Mus musculus
agagaatatgagttccagcagcact

SEQ ID NO: 188703 - DNA, 25 bp, Mus musculus
agagaatcaggctgtcaccaacgaa

SEQ ID NO: 188704 - DNA, 25 bp, Mus musculus
agagaatcctgcgttttctggaaga

SEQ ID NO: 188705 - DNA, 25 bp, Mus musculus
agagaatcttataggatttaaacgg

SEQ ID NO: 188706 - DNA, 25 bp, Mus musculus
agagaatcttgccggtcctgttagc

SEQ ID NO: 188707 - DNA, 25 bp, Mus musculus
agagaatgaaaagtgaagctgagga

SEQ ID NO: 188708 - DNA, 25 bp, Mus musculus
agagaatgacactgtctctggcttt

SEQ ID NO: 188709 - DNA, 25 bp, Mus musculus
agagaatgagaaaatgaaaattgaa

SEQ ID NO: 188710 - DNA, 25 bp, Mus musculus
agagaatgatagcttggagatttct

SEQ ID NO: 188711 - DNA, 25 bp, Mus musculus
agagaatgcacaggtcctgtggctg

SEQ ID NO: 188712 - DNA, 25 bp, Mus musculus
agagaatggctgataatgcctgcgt

SEQ ID NO: 188713 - DNA, 25 bp, Mus musculus
agagaattaaggcaccaaggagagg

SEQ ID NO: 188714 - DNA, 25 bp, Mus musculus
agagaattattctgctcttcctccc

SEQ ID NO: 188715 - DNA, 25 bp, Mus musculus
agagaattgagcgtttatcactccg

SEQ ID NO: 188716 - DNA, 25 bp, Mus musculus
agagaatttcccaagtggatggaga

SEQ ID NO: 188717 - DNA, 25 bp, Mus musculus
agagacaaaaaagagttgatcaaga

SEQ ID NO: 188718 - DNA, 25 bp, Mus musculus
agagacaaaagaggcttttcagatg

SEQ ID NO: 188719 - DNA, 25 bp, Mus musculus
agagacaaaagagtttcaactccta

SEQ ID NO: 188720 - DNA, 25 bp, Mus musculus
agagacaaaggaacaagttgatctg

SEQ ID NO: 188721 - DNA, 25 bp, Mus musculus
agagacaaaggttctaatcagagat

SEQ ID NO: 188722 - DNA, 25 bp, Mus musculus
agagacaagggtaggtccctgtata

SEQ ID NO: 188723 - DNA, 25 bp, Mus musculus
agagacaaggttctccccacccacc

SEQ ID NO: 188724 - DNA, 25 bp, Mus musculus
agagacaatctcatttgagatgctt

SEQ ID NO: 188725 - DNA, 25 bp, Mus musculus
agagacaatctcgctgcgaaaagac

SEQ ID NO: 188726 - DNA, 25 bp, Mus musculus
agagacaattgggttcatagtggcg

SEQ ID NO: 188727 - DNA, 25 bp, Mus musculus
agagacacaagggtaaggaatcagc

SEQ ID NO: 188728 - DNA, 25 bp, Mus musculus
agagacacaagggtgctgatggagc

SEQ ID NO: 188729 - DNA, 25 bp, Mus musculus
agagacacagagaacacactctaca

SEQ ID NO: 188730 - DNA, 25 bp, Mus musculus
agagacacagccagctcaggaagaa

SEQ ID NO: 188731 - DNA, 25 bp, Mus musculus
agagacacagcctgagtgcatacaa

SEQ ID NO: 188732 - DNA, 25 bp, Mus musculus
agagacacaggaacctgaggagaag

SEQ ID NO: 188733 - DNA, 25 bp, Mus musculus
agagacacaggcaccattttaacag

SEQ ID NO: 188734 - DNA, 25 bp, Mus musculus
agagacaccagcttgggggccccat

SEQ ID NO: 188735 - DNA, 25 bp, Mus musculus
agagacagaaagctcagaggctgag

SEQ ID NO: 188736 - DNA, 25 bp, Mus musculus
agagacagaagattgtcacaatgcc

SEQ ID NO: 188737 - DNA, 25 bp, Mus musculus
agagacagaggaggccatgtcaggg

SEQ ID NO: 188738 - DNA, 25 bp, Mus musculus
agagacagaggctgcttggtgcggc

SEQ ID NO: 188739 - DNA, 25 bp, Mus musculus
agagacagaggctgctttgggagaa

SEQ ID NO: 188740 - DNA, 25 bp, Mus musculus
agagacagagtttagggaggagcaa

SEQ ID NO: 188741 - DNA, 25 bp, Mus musculus
agagacagcagccttcccagtccac

SEQ ID NO: 188742 - DNA, 25 bp, Mus musculus
agagacagcaggattttcgaaaata

SEQ ID NO: 188743 - DNA, 25 bp, Mus musculus
agagacagcagggtccaccaacagc

SEQ ID NO: 188744 - DNA, 25 bp, Mus musculus
agagacagcagtcttcccagatttg

SEQ ID NO: 188745 - DNA, 25 bp, Mus musculus
agagacaggcagtcatttgaagact

SEQ ID NO: 188746 - DNA, 25 bp, Mus musculus
agagacatcaaggcagaagacttat

SEQ ID NO: 188747 - DNA, 25 bp, Mus musculus
agagacatcagaagatggtgaggat

SEQ ID NO: 188748 - DNA, 25 bp, Mus musculus
agagacatcagaagttttagagcga

SEQ ID NO: 188749 - DNA, 25 bp, Mus musculus
agagacattaaagggtatagtgcca

SEQ ID NO: 188750 - DNA, 25 bp, Mus musculus
agagacattgaaggagttaaagacc

SEQ ID NO: 188751 - DNA, 25 bp, Mus musculus
agagaccaagaaaatccagcctcag

SEQ ID NO: 188752 - DNA, 25 bp, Mus musculus
agagaccaagatgaagaaccacctc

SEQ ID NO: 188753 - DNA, 25 bp, Mus musculus
agagaccagaagattcgtaagacag

SEQ ID NO: 188754 - DNA, 25 bp, Mus musculus
agagaccagaatcagaacattgtcc

SEQ ID NO: 188755 - DNA, 25 bp, Mus musculus
agagaccagaatcagagctgatcat

SEQ ID NO: 188756 - DNA, 25 bp, Mus musculus
agagaccagcaaagccaaacccatg

SEQ ID NO: 188757 - DNA, 25 bp, Mus musculus
agagaccattgacaaagccaacttt

SEQ ID NO: 188758 - DNA, 25 bp, Mus musculus
agagacccaaaagcagaatacagac

SEQ ID NO: 188759 - DNA, 25 bp, Mus musculus
agagacccaaaagtttgaggatagc

SEQ ID NO: 188760 - DNA, 25 bp, Mus musculus
agagacccaagtgcataagtaaagg

SEQ ID NO: 188761 - DNA, 25 bp, Mus musculus
agagacccacaccacgactactgtg

SEQ ID NO: 188762 - DNA, 25 bp, Mus musculus
agagacccagaggagaaggaggagc

SEQ ID NO: 188763 - DNA, 25 bp, Mus musculus
agagacccagaggagattgagaagg

SEQ ID NO: 188764 - DNA, 25 bp, Mus musculus
agagacccaggcactccagaaaacg

SEQ ID NO: 188765 - DNA, 25 bp, Mus musculus
agagaccccgatcctcgtgggactg

SEQ ID NO: 188766 - DNA, 25 bp, Mus musculus
agagaccccggaccaatctccgctg

SEQ ID NO: 188767 - DNA, 25 bp, Mus musculus
agagaccccgggtccagcaccaagc

SEQ ID NO: 188768 - DNA, 25 bp, Mus musculus
agagacccctttaggtgttccgaat

SEQ ID NO: 188769 - DNA, 25 bp, Mus musculus
agagaccctgaagagagcagataag

SEQ ID NO: 188770 - DNA, 25 bp, Mus musculus
agagaccctgaagagatgccacctc

SEQ ID NO: 188771 - DNA, 25 bp, Mus musculus
agagaccctgaattaccggtattgt

SEQ ID NO: 188772 - DNA, 25 bp, Mus musculus
agagaccctgaggaaatggggatta

SEQ ID NO: 188773 - DNA, 25 bp, Mus musculus
agagaccgagggagggagccatcac

SEQ ID NO: 188774 - DNA, 25 bp, Mus musculus
agagaccgcaatctcactggtctgg

SEQ ID NO: 188775 - DNA, 25 bp, Mus musculus
agagaccgcaatgtgtatgtcgaca

SEQ ID NO: 188776 - DNA, 25 bp, Mus musculus
agagaccgtgaaaggagcaatagag

SEQ ID NO: 188777 - DNA, 25 bp, Mus musculus
agagaccgtgaaaggagtcgctttc

SEQ ID NO: 188778 - DNA, 25 bp, Mus musculus
agagacctagaacaatagaaagcag

SEQ ID NO: 188779 - DNA, 25 bp, Mus musculus
agagacctccggaaatttgtgagaa

SEQ ID NO: 188780 - DNA, 25 bp, Mus musculus
agagacctgtcaatggactatctca

SEQ ID NO: 188781 - DNA, 25 bp, Mus musculus
agagacctgtcaatggtacggatga

SEQ ID NO: 188782 - DNA, 25 bp, Mus musculus
agagaccttaacaggtgaagatggt

SEQ ID NO: 188783 - DNA, 25 bp, Mus musculus
agagacgaaagacaatgcagggtga

SEQ ID NO: 188784 - DNA, 25 bp, Mus musculus
agagacgaaagctccggtctgatat

SEQ ID NO: 188785 - DNA, 25 bp, Mus musculus
agagacgcaggctggctcaccatca

SEQ ID NO: 188786 - DNA, 25 bp, Mus musculus
agagacgcaggtcatacctcactcc

SEQ ID NO: 188787 - DNA, 25 bp, Mus musculus
agagacgccagttctacctccagtg

SEQ ID NO: 188788 - DNA, 25 bp, Mus musculus
agagactaaaagatatggagggaaa

SEQ ID NO: 188789 - DNA, 25 bp, Mus musculus
agagactaaaagtgctgaagaggtt

SEQ ID NO: 188790 - DNA, 25 bp, Mus musculus
agagactaaggcaattccagtaaac

SEQ ID NO: 188791 - DNA, 25 bp, Mus musculus
agagactaaggctgtgaaaacagag

SEQ ID NO: 188792 - DNA, 25 bp, Mus musculus
agagactattacgcaacttgggagg

SEQ ID NO: 188793 - DNA, 25 bp, Mus musculus
agagactcaagggactttcggtgcc

SEQ ID NO: 188794 - DNA, 25 bp, Mus musculus
agagactcacaaggtgaaactaatg

SEQ ID NO: 188795 - DNA, 25 bp, Mus musculus
agagactcaggattgaaaagatgaa

SEQ ID NO: 188796 - DNA, 25 bp, Mus musculus
agagactcctgccagccattctgta

SEQ ID NO: 188797 - DNA, 25 bp, Mus musculus
agagactcctgccagggcgattcag

SEQ ID NO: 188798 - DNA, 25 bp, Mus musculus
agagactgaaggaggaagctgacct

SEQ ID NO: 188799 - DNA, 25 bp, Mus musculus
agagactgaaggagtctccagcctc

SEQ ID NO: 188800 - DNA, 25 bp, Mus musculus
agagactgacctagtctggcttgcc

SEQ ID NO: 188801 - DNA, 25 bp, Mus musculus
agagactgacgcagtctggcttgcc

SEQ ID NO: 188802 - DNA, 25 bp, Mus musculus
agagactgactgtgtgtcccatggg

SEQ ID NO: 188803 - DNA, 25 bp, Mus musculus
agagactgctgactcgataccagga

SEQ ID NO: 188804 - DNA, 25 bp, Mus musculus
agagactgctggtgacaagggagat

SEQ ID NO: 188805 - DNA, 25 bp, Mus musculus
agagactggggccgtcatcatagcc

SEQ ID NO: 188806 - DNA, 25 bp, Mus musculus
agagactgtgagccaaaaagcaggg

SEQ ID NO: 188807 - DNA, 25 bp, Mus musculus
agagacttaaaatgaaatggaaggg

SEQ ID NO: 188808 - DNA, 25 bp, Mus musculus
agagacttcccctcggatgcagatg

SEQ ID NO: 188809 - DNA, 25 bp, Mus musculus
agagacttccttcagggccactgat

SEQ ID NO: 188810 - DNA, 25 bp, Mus musculus
agagacttccttcaggtgttagaga

SEQ ID NO: 188811 - DNA, 25 bp, Mus musculus
agagacttgccagggaaaatcatag

SEQ ID NO: 188812 - DNA, 25 bp, Mus musculus
agagactttcaggctgtggaccttg

SEQ ID NO: 188813 - DNA, 25 bp, Mus musculus
agagactttcaggttccagctgtgg

SEQ ID NO: 188814 - DNA, 25 bp, Mus musculus
agagactttgctggatgcttttgtt

SEQ ID NO: 188815 - DNA, 25 bp, Mus musculus
agagactttgtggctgagttcctgt

SEQ ID NO: 188816 - DNA, 25 bp, Mus musculus
agagactttgtgggcctgctgtccc

SEQ ID NO: 188817 - DNA, 25 bp, Mus musculus
agagagaaaaaatcaaccactcaga

SEQ ID NO: 188818 - DNA, 25 bp, Mus musculus
agagagaaaaaatcaatccaggaac

SEQ ID NO: 188819 - DNA, 25 bp, Mus musculus
agagagaaaccaggcagaagaagtt

SEQ ID NO: 188820 - DNA, 25 bp, Mus musculus
agagagaaagaatctggaggtgaac

SEQ ID NO: 188821 - DNA, 25 bp, Mus musculus
agagagaaagacaattgcgccgcag

SEQ ID NO: 188822 - DNA, 25 bp, Mus musculus
agagagaaagacaattttgggtgtt

SEQ ID NO: 188823 - DNA, 25 bp, Mus musculus
agagagaaagggtacagatttattt

SEQ ID NO: 188824 - DNA, 25 bp, Mus musculus
agagagaaataatgaagcattggat

SEQ ID NO: 188825 - DNA, 25 bp, Mus musculus
agagagaaattgagtattttatcat

SEQ ID NO: 188826 - DNA, 25 bp, Mus musculus
agagagaacaacgtttccctcagta

SEQ ID NO: 188827 - DNA, 25 bp, Mus musculus
agagagaacactgtgatctgctctt

SEQ ID NO: 188828 - DNA, 25 bp, Mus musculus
agagagaacactgttttcatgaacc

SEQ ID NO: 188829 - DNA, 25 bp, Mus musculus
agagagaactcagagcacccctggc

SEQ ID NO: 188830 - DNA, 25 bp, Mus musculus
agagagaacttacctaaagacgtca

SEQ ID NO: 188831 - DNA, 25 bp, Mus musculus
agagagaagaacagtgtttagtgta

SEQ ID NO: 188832 - DNA, 25 bp, Mus musculus
agagagaagaggacggctgctgctg

SEQ ID NO: 188833 - DNA, 25 bp, Mus musculus
agagagaagccggcctctggtgctc

SEQ ID NO: 188834 - DNA, 25 bp, Mus musculus
agagagaagccggttatacaatggt

SEQ ID NO: 188835 - DNA, 25 bp, Mus musculus
agagagaaggcagattctcattgcc

SEQ ID NO: 188836 - DNA, 25 bp, Mus musculus
agagagacaattgggttcatagtgg

SEQ ID NO: 188837 - DNA, 25 bp, Mus musculus
agagagacacagtgccctctcccct

SEQ ID NO: 188838 - DNA, 25 bp, Mus musculus
agagagacagcagccttcccagtcc

SEQ ID NO: 188839 - DNA, 25 bp, Mus musculus
agagagacagcagggtccaccaaca

SEQ ID NO: 188840 - DNA, 25 bp, Mus musculus
agagagacccaggcactccagaaaa

SEQ ID NO: 188841 - DNA, 25 bp, Mus musculus
agagagactattacgcaacttggga

SEQ ID NO: 188842 - DNA, 25 bp, Mus musculus
agagagacttgccagggaaaatcat

SEQ ID NO: 188843 - DNA, 25 bp, Mus musculus
agagagactttgtggctgagttcct

SEQ ID NO: 188844 - DNA, 25 bp, Mus musculus
agagagactttgtgggcctgctgtc

SEQ ID NO: 188845 - DNA, 25 bp, Mus musculus
agagagagaaaccaggcagaagaag

SEQ ID NO: 188846 - DNA, 25 bp, Mus musculus
agagagagagaacaggcagttttgg

SEQ ID NO: 188847 - DNA, 25 bp, Mus musculus
agagagagagaagagagagagaggg

SEQ ID NO: 188848 - DNA, 25 bp, Mus musculus
agagagagagagaacaggcagtttt

SEQ ID NO: 188849 - DNA, 25 bp, Mus musculus
agagagagagagagaacaggcagtt

SEQ ID NO: 188850 - DNA, 25 bp, Mus musculus
agagagagaggtacctgtgtcgtgt

SEQ ID NO: 188851 - DNA, 25 bp, Mus musculus
agagagagcaaggttgtagttcccc

SEQ ID NO: 188852 - DNA, 25 bp, Mus musculus
agagagagccgaagccgaaagcggt

SEQ ID NO: 188853 - DNA, 25 bp, Mus musculus
agagagagccgaatattaattaacc

SEQ ID NO: 188854 - DNA, 25 bp, Mus musculus
agagagataagaaggttgtgacaaa

SEQ ID NO: 188855 - DNA, 25 bp, Mus musculus
agagagatacgaaagggcgagaggt

SEQ ID NO: 188856 - DNA, 25 bp, Mus musculus
agagagatacgctccttgctcggat

SEQ ID NO: 188857 - DNA, 25 bp, Mus musculus
agagagatcagaagtaacaggagaa

SEQ ID NO: 188858 - DNA, 25 bp, Mus musculus
agagagatgactggtctggttcaga

SEQ ID NO: 188859 - DNA, 25 bp, Mus musculus
agagagatgagcatccagctcagcg

SEQ ID NO: 188860 - DNA, 25 bp, Mus musculus
agagagatgataaggagagaccccc

SEQ ID NO: 188861 - DNA, 25 bp, Mus musculus
agagagatgataaggtccagagttc

SEQ ID NO: 188862 - DNA, 25 bp, Mus musculus
agagagatgcaggtaacccctctaa

SEQ ID NO: 188863 - DNA, 25 bp, Mus musculus
agagagatgcagtatgacttctcct

SEQ ID NO: 188864 - DNA, 25 bp, Mus musculus
agagagatggcagtggagcaaataa

SEQ ID NO: 188865 - DNA, 25 bp, Mus musculus
agagagcaaaacagaggcccagagt

SEQ ID NO: 188866 - DNA, 25 bp, Mus musculus
agagagcaaaggcttatttcaaaac

SEQ ID NO: 188867 - DNA, 25 bp, Mus musculus
agagagcaacaggagcaccaggcaa

SEQ ID NO: 188868 - DNA, 25 bp, Mus musculus
agagagcaagaaggagcagagagtg

SEQ ID NO: 188869 - DNA, 25 bp, Mus musculus
agagagcaagctcatcattctggcc

SEQ ID NO: 188870 - DNA, 25 bp, Mus musculus
agagagcaaggtcgccgctgaagag

SEQ ID NO: 188871 - DNA, 25 bp, Mus musculus
agagagcaaggttgtagttccccca

SEQ ID NO: 188872 - DNA, 25 bp, Mus musculus
agagagcaagttcattacagcatca

SEQ ID NO: 188873 - DNA, 25 bp, Mus musculus
agagagcagagcatggtggagctga

SEQ ID NO: 188874 - DNA, 25 bp, Mus musculus
agagagcagctgaggggtaatcagg

SEQ ID NO: 188875 - DNA, 25 bp, Mus musculus
agagagcagtgaaagcaatgacatt

SEQ ID NO: 188876 - DNA, 25 bp, Mus musculus
agagagcatctgattgtggggaaat

SEQ ID NO: 188877 - DNA, 25 bp, Mus musculus
agagagccaaatctgccaaggcaca

SEQ ID NO: 188878 - DNA, 25 bp, Mus musculus
agagagccaagagcgccttgctgga

SEQ ID NO: 188879 - DNA, 25 bp, Mus musculus
agagagccatcattgacatgtacac

SEQ ID NO: 188880 - DNA, 25 bp, Mus musculus
agagagcccaggcttacagtgattc

SEQ ID NO: 188881 - DNA, 25 bp, Mus musculus
agagagccccggtgccaaagcctgc

SEQ ID NO: 188882 - DNA, 25 bp, Mus musculus
agagagccggaacaggtacttaaaa

SEQ ID NO: 188883 - DNA, 25 bp, Mus musculus
agagagccggaaggataaagaaatg

SEQ ID NO: 188884 - DNA, 25 bp, Mus musculus
agagagccttagaggcccacgaggc

SEQ ID NO: 188885 - DNA, 25 bp, Mus musculus
agagagcgagagttactacctggac

SEQ ID NO: 188886 - DNA, 25 bp, Mus musculus
agagagcgaggttgcacataggcaa

SEQ ID NO: 188887 - DNA, 25 bp, Mus musculus
agagagcggacaaggagatctgacg

SEQ ID NO: 188888 - DNA, 25 bp, Mus musculus
agagagctaacgagatgaacgtgac

SEQ ID NO: 188889 - DNA, 25 bp, Mus musculus
agagagctaacgaggttgactgcct

SEQ ID NO: 188890 - DNA, 25 bp, Mus musculus
agagagctcaggtttggaggagacc

SEQ ID NO: 188891 - DNA, 25 bp, Mus musculus
agagagctcagtggccctgctcttg

SEQ ID NO: 188892 - DNA, 25 bp, Mus musculus
agagagctctaacaggacccaggtc

SEQ ID NO: 188893 - DNA, 25 bp, Mus musculus
agagagctctaacagggcaggatgg

SEQ ID NO: 188894 - DNA, 25 bp, Mus musculus
agagagctctggcgcaacagcgtga

SEQ ID NO: 188895 - DNA, 25 bp, Mus musculus
agagagctgacacgctggagatgga

SEQ ID NO: 188896 - DNA, 25 bp, Mus musculus
agagagctgcaagcaggggtagagc

SEQ ID NO: 188897 - DNA, 25 bp, Mus musculus
agagagctgcagcagatggagcaga

SEQ ID NO: 188898 - DNA, 25 bp, Mus musculus
agagagctgcagcaggctgttctgc

SEQ ID NO: 188899 - DNA, 25 bp, Mus musculus
agagagctgtcattgaggcggaaat

SEQ ID NO: 188900 - DNA, 25 bp, Mus musculus
agagagctttagtgtagggccaagt

SEQ ID NO: 188901 - DNA, 25 bp, Mus musculus
agagagctttagtgtataggggagc

SEQ ID NO: 188902 - DNA, 25 bp, Mus musculus
agagaggaaaagaacaaattacctg

SEQ ID NO: 188903 - DNA, 25 bp, Mus musculus
agagaggaaaaggcatttatatgtg

SEQ ID NO: 188904 - DNA, 25 bp, Mus musculus
agagaggaaaagggctcggatggcg

SEQ ID NO: 188905 - DNA, 25 bp, Mus musculus
agagaggaagaaacttcacccttac

SEQ ID NO: 188906 - DNA, 25 bp, Mus musculus
agagaggaagacaggagtctgcggt

SEQ ID NO: 188907 - DNA, 25 bp, Mus musculus
agagaggaagatgtttgagacagag

SEQ ID NO: 188908 - DNA, 25 bp, Mus musculus
agagaggaagattacaacaaccctg

SEQ ID NO: 188909 - DNA, 25 bp, Mus musculus
agagaggaagcatcaacaccccctt

SEQ ID NO: 188910 - DNA, 25 bp, Mus musculus
agagaggaagtaaaactcaaaagaa

SEQ ID NO: 188911 - DNA, 25 bp, Mus musculus
agagaggacagaaagctttttacct

SEQ ID NO: 188912 - DNA, 25 bp, Mus musculus
agagaggagaaagaacgtttgctga

SEQ ID NO: 188913 - DNA, 25 bp, Mus musculus
agagaggagagagagagagagagag

SEQ ID NO: 188914 - DNA, 25 bp, Mus musculus
agagaggaggacagttactaccaga

SEQ ID NO: 188915 - DNA, 25 bp, Mus musculus
agagaggagggagatggtgtttccc

SEQ ID NO: 188916 - DNA, 25 bp, Mus musculus
agagaggagtgcaaaggcaagcaga

SEQ ID NO: 188917 - DNA, 25 bp, Mus musculus
agagaggatagaaagagctcagcag

SEQ ID NO: 188918 - DNA, 25 bp, Mus musculus
agagaggcagagacagggcagggca

SEQ ID NO: 188919 - DNA, 25 bp, Mus musculus
agagaggcagatgtgagcccacctg

SEQ ID NO: 188920 - DNA, 25 bp, Mus musculus
agagaggccggagacagtataacaa

SEQ ID NO: 188921 - DNA, 25 bp, Mus musculus
agagaggcgagggttgtgagccccg

SEQ ID NO: 188922 - DNA, 25 bp, Mus musculus
agagaggcggattgcggccaagatc

SEQ ID NO: 188923 - DNA, 25 bp, Mus musculus
agagaggctgtgtcccattgtatcc

SEQ ID NO: 188924 - DNA, 25 bp, Mus musculus
agagaggctttgagtcgctgggttt

SEQ ID NO: 188925 - DNA, 25 bp, Mus musculus
agagagggaccgatgaatccttcac

SEQ ID NO: 188926 - DNA, 25 bp, Mus musculus
agagagggctcaggtggtggagaaa

SEQ ID NO: 188927 - DNA, 25 bp, Mus musculus
agagaggggagaccggtttccaagg

SEQ ID NO: 188928 - DNA, 25 bp, Mus musculus
agagagtaagaactgtgccaagtgg

SEQ ID NO: 188929 - DNA, 25 bp, Mus musculus
agagagtaagacaaacccaggagat

SEQ ID NO: 188930 - DNA, 25 bp, Mus musculus
agagagtaagacaattgcgtgaaga

SEQ ID NO: 188931 - DNA, 25 bp, Mus musculus
agagagtactggcggtgtctctttg

SEQ ID NO: 188932 - DNA, 25 bp, Mus musculus
agagagtatgcacagggtatccaga

SEQ ID NO: 188933 - DNA, 25 bp, Mus musculus
agagagtcaggaacgtggaagtgaa

SEQ ID NO: 188934 - DNA, 25 bp, Mus musculus
agagagtcccgaaggggacagcttc

SEQ ID NO: 188935 - DNA, 25 bp, Mus musculus
agagagtcctcagaatggcaatgtt

SEQ ID NO: 188936 - DNA, 25 bp, Mus musculus
agagagtcctcaggcacctccaagt

SEQ ID NO: 188937 - DNA, 25 bp, Mus musculus
agagagtctaccatatttggtataa

SEQ ID NO: 188938 - DNA, 25 bp, Mus musculus
agagagtgagaaaggagacacggtc

SEQ ID NO: 188939 - DNA, 25 bp, Mus musculus
agagagtgatccagtctgttgtcta

SEQ ID NO: 188940 - DNA, 25 bp, Mus musculus
agagagtgatgcatggagcagtgct

SEQ ID NO: 188941 - DNA, 25 bp, Mus musculus
agagagtgccaggaaatagccttta

SEQ ID NO: 188942 - DNA, 25 bp, Mus musculus
agagagtgccaggctttggggactt

SEQ ID NO: 188943 - DNA, 25 bp, Mus musculus
agagagtgctgggagccgacaggga

SEQ ID NO: 188944 - DNA, 25 bp, Mus musculus
agagagtgctgggagcctcttagct

SEQ ID NO: 188945 - DNA, 25 bp, Mus musculus
agagagtgctgttctctgcagcttg

SEQ ID NO: 188946 - DNA, 25 bp, Mus musculus
agagagttaggctgccaacagctac

SEQ ID NO: 188947 - DNA, 25 bp, Mus musculus
agagagttcaaggggctgagattta

SEQ ID NO: 188948 - DNA, 25 bp, Mus musculus
agagagttgccggctgaatttgaca

SEQ ID NO: 188949 - DNA, 25 bp, Mus musculus
agagagttggaaggaaggcttgcaa

SEQ ID NO: 188950 - DNA, 25 bp, Mus musculus
agagagttggaagggagctagctca

SEQ ID NO: 188951 - DNA, 25 bp, Mus musculus
agagataaacccagctccctacact

SEQ ID NO: 188952 - DNA, 25 bp, Mus musculus
agagataaattgattgagtctgttt

SEQ ID NO: 188953 - DNA, 25 bp, Mus musculus
agagataagaaggttgtgacaaaga

SEQ ID NO: 188954 - DNA, 25 bp, Mus musculus
agagataagagcgttctctggtgca

SEQ ID NO: 188955 - DNA, 25 bp, Mus musculus
agagataagcagagtccagttcagc

SEQ ID NO: 188956 - DNA, 25 bp, Mus musculus
agagataagtatgggagtgaaggat

SEQ ID NO: 188957 - DNA, 25 bp, Mus musculus
agagataagtatgggtggtactgca

SEQ ID NO: 188958 - DNA, 25 bp, Mus musculus
agagatacaaacggtctccctgcaa

SEQ ID NO: 188959 - DNA, 25 bp, Mus musculus
agagatacagaatgaatgaagaaag

SEQ ID NO: 188960 - DNA, 25 bp, Mus musculus
agagatacagagcactggtgaagtg

SEQ ID NO: 188961 - DNA, 25 bp, Mus musculus
agagatacaggtctcgttccagaac

SEQ ID NO: 188962 - DNA, 25 bp, Mus musculus
agagatacagttctaggtctcgttc

SEQ ID NO: 188963 - DNA, 25 bp, Mus musculus
agagatacatcaggaagtggcaagg

SEQ ID NO: 188964 - DNA, 25 bp, Mus musculus
agagatacatcagggtcttggggct

SEQ ID NO: 188965 - DNA, 25 bp, Mus musculus
agagatacccgacccgatttctctg

SEQ ID NO: 188966 - DNA, 25 bp, Mus musculus
agagatacccgacccggcaccagcc

SEQ ID NO: 188967 - DNA, 25 bp, Mus musculus
agagatacgaaagggcgagaggtta

SEQ ID NO: 188968 - DNA, 25 bp, Mus musculus
agagatactgcagagctacgagtct

SEQ ID NO: 188969 - DNA, 25 bp, Mus musculus
agagatacttttggactgaccaagg

SEQ ID NO: 188970 - DNA, 25 bp, Mus musculus
agagatagagaaggtaaaggggaat

SEQ ID NO: 188971 - DNA, 25 bp, Mus musculus
agagatagccgactgcagatgacag

SEQ ID NO: 188972 - DNA, 25 bp, Mus musculus
agagatagccgggcatcagcagtac

SEQ ID NO: 188973 - DNA, 25 bp, Mus musculus
agagatatctcagaaagtgtcaccg

SEQ ID NO: 188974 - DNA, 25 bp, Mus musculus
agagatcagaagtaacaggagaaac

SEQ ID NO: 188975 - DNA, 25 bp, Mus musculus
agagatcagaggatgcagcaccgag

SEQ ID NO: 188976 - DNA, 25 bp, Mus musculus
agagatcagatagtgccggcattgg

SEQ ID NO: 188977 - DNA, 25 bp, Mus musculus
agagatcagtcggtactccctggca

SEQ ID NO: 188978 - DNA, 25 bp, Mus musculus
agagatccaaggacaccacttcaga

SEQ ID NO: 188979 - DNA, 25 bp, Mus musculus
agagatccaaggttgaccacaaggc

SEQ ID NO: 188980 - DNA, 25 bp, Mus musculus
agagatcccaagttctttcagatta

SEQ ID NO: 188981 - DNA, 25 bp, Mus musculus
agagatcccaggatatcaatgagtg

SEQ ID NO: 188982 - DNA, 25 bp, Mus musculus
agagatcccaggttatcaatgagtg

SEQ ID NO: 188983 - DNA, 25 bp, Mus musculus
agagatcccccaggcccggctctac

SEQ ID NO: 188984 - DNA, 25 bp, Mus musculus
agagatcctcgagtgaggacgacga

SEQ ID NO: 188985 - DNA, 25 bp, Mus musculus
agagatcctgaaaaatgtgggggtt

SEQ ID NO: 188986 - DNA, 25 bp, Mus musculus
agagatcctgaaaagtattgataat

SEQ ID NO: 188987 - DNA, 25 bp, Mus musculus
agagatcctttcggctgtcggcgag

SEQ ID NO: 188988 - DNA, 25 bp, Mus musculus
agagatcggcaggatgactgacttt

SEQ ID NO: 188989 - DNA, 25 bp, Mus musculus
agagatctcagtgcccttatgcatg

SEQ ID NO: 188990 - DNA, 25 bp, Mus musculus
agagatctcggcacaacggtcgtcg

SEQ ID NO: 188991 - DNA, 25 bp, Mus musculus
agagatctcgggtgagcacctgcgg

SEQ ID NO: 188992 - DNA, 25 bp, Mus musculus
agagatcttcacaggagagagactg

SEQ ID NO: 188993 - DNA, 25 bp, Mus musculus
agagatgaagaccacatagcccaca

SEQ ID NO: 188994 - DNA, 25 bp, Mus musculus
agagatgaaggactcgctggccgaa

SEQ ID NO: 188995 - DNA, 25 bp, Mus musculus
agagatgaaggatgatgaggaattt

SEQ ID NO: 188996 - DNA, 25 bp, Mus musculus
agagatgaagtcctggcctgcagct

SEQ ID NO: 188997 - DNA, 25 bp, Mus musculus
agagatgacatcgggaggaatgctg

SEQ ID NO: 188998 - DNA, 25 bp, Mus musculus
agagatgagcaagttctatagtcca

SEQ ID NO: 188999 - DNA, 25 bp, Mus musculus
agagatgagtaagctcaatcagaac

SEQ ID NO: 189000 - DNA, 25 bp, Mus musculus
agagatgataaggagagaccccctt

SEQ ID NO: 189001 - DNA, 25 bp, Mus musculus
agagatgataaggtccagagttcaa

SEQ ID NO: 189002 - DNA, 25 bp, Mus musculus
agagatgatcaatggtcgtagttat

SEQ ID NO: 189003 - DNA, 25 bp, Mus musculus
agagatgatcaattcgtagttatga

SEQ ID NO: 189004 - DNA, 25 bp, Mus musculus
agagatgcaagctgataggagcatg

SEQ ID NO: 189005 - DNA, 25 bp, Mus musculus
agagatgcaggtaacccctctaaat

SEQ ID NO: 189006 - DNA, 25 bp, Mus musculus
agagatgcagtatgacttctccttg

SEQ ID NO: 189007 - DNA, 25 bp, Mus musculus
agagatgcccaagagcgatctaggg

SEQ ID NO: 189008 - DNA, 25 bp, Mus musculus
agagatgcttctgtactcacttctg

SEQ ID NO: 189009 - DNA, 25 bp, Mus musculus
agagatgcttctgtggcctacctgt

SEQ ID NO: 189010 - DNA, 25 bp, Mus musculus
agagatggaagatcaccgcctccga

SEQ ID NO: 189011 - DNA, 25 bp, Mus musculus
agagatggaatacgaccataagcgg

SEQ ID NO: 189012 - DNA, 25 bp, Mus musculus
agagatggaatggataatcaaggag

SEQ ID NO: 189013 - DNA, 25 bp, Mus musculus
agagatggagaaggaaaaacacagc

SEQ ID NO: 189014 - DNA, 25 bp, Mus musculus
agagatggagttttttggaccatat

SEQ ID NO: 189015 - DNA, 25 bp, Mus musculus
agagatggatttcaaatctaaagcg

SEQ ID NO: 189016 - DNA, 25 bp, Mus musculus
agagatggcagatactttggcaaaa

SEQ ID NO: 189017 - DNA, 25 bp, Mus musculus
agagatggcaggtgtatggtggctg

SEQ ID NO: 189018 - DNA, 25 bp, Mus musculus
agagatggcagtggagcaaataaga

SEQ ID NO: 189019 - DNA, 25 bp, Mus musculus
agagatggccaaaacaagagttcaa

SEQ ID NO: 189020 - DNA, 25 bp, Mus musculus
agagatggccatatacgcctactat

SEQ ID NO: 189021 - DNA, 25 bp, Mus musculus
agagatggctagcctatgtctcagg

SEQ ID NO: 189022 - DNA, 25 bp, Mus musculus
agagatggctaggtacaaatggatg

SEQ ID NO: 189023 - DNA, 25 bp, Mus musculus
agagatgggtcatggaactcatctt

SEQ ID NO: 189024 - DNA, 25 bp, Mus musculus
agagatgggtggaggcaaagacact

SEQ ID NO: 189025 - DNA, 25 bp, Mus musculus
agagatggttctaggctttgatgac

SEQ ID NO: 189026 - DNA, 25 bp, Mus musculus
agagatgtcaagaaaaatcaggaaa

SEQ ID NO: 189027 - DNA, 25 bp, Mus musculus
agagatgtcaaggggagagacctta

SEQ ID NO: 189028 - DNA, 25 bp, Mus musculus
agagatgtcccagcaacattttgat

SEQ ID NO: 189029 - DNA, 25 bp, Mus musculus
agagatgttagaagatggctccgag

SEQ ID NO: 189030 - DNA, 25 bp, Mus musculus
agagattaaaaggatcttgctgcat

SEQ ID NO: 189031 - DNA, 25 bp, Mus musculus
agagattaaatgagaataaggctca

SEQ ID NO: 189032 - DNA, 25 bp, Mus musculus
agagattaaggagctatcgaagaac

SEQ ID NO: 189033 - DNA, 25 bp, Mus musculus
agagattacaaggagctagaggaag

SEQ ID NO: 189034 - DNA, 25 bp, Mus musculus
agagattacaaggctctaagggatg

SEQ ID NO: 189035 - DNA, 25 bp, Mus musculus
agagattagaagaaaaccacgagct

SEQ ID NO: 189036 - DNA, 25 bp, Mus musculus
agagattagtggccaagcccagcca

SEQ ID NO: 189037 - DNA, 25 bp, Mus musculus
agagattcaaagcagaataccagag

SEQ ID NO: 189038 - DNA, 25 bp, Mus musculus
agagattcaggttctcccctatggg

SEQ ID NO: 189039 - DNA, 25 bp, Mus musculus
agagattcttcaggtctatggaaat

SEQ ID NO: 189040 - DNA, 25 bp, Mus musculus
agagattgaaagctacgggaaagaa

SEQ ID NO: 189041 - DNA, 25 bp, Mus musculus
agagattgaaagctgaaaggaagtt

SEQ ID NO: 189042 - DNA, 25 bp, Mus musculus
agagattgagaaggtcatagaagag

SEQ ID NO: 189043 - DNA, 25 bp, Mus musculus
agagattgagcaggtttaccgacaa

SEQ ID NO: 189044 - DNA, 25 bp, Mus musculus
agagattgcaaggtacaaaagaaaa

SEQ ID NO: 189045 - DNA, 25 bp, Mus musculus
agagattgcaagttctgattcaaag

SEQ ID NO: 189046 - DNA, 25 bp, Mus musculus
agagattgcccaggttcgcggcaag

SEQ ID NO: 189047 - DNA, 25 bp, Mus musculus
agagattgccttcaaggacctactg

SEQ ID NO: 189048 - DNA, 25 bp, Mus musculus
agagattgttcagcaggtcagggtt

SEQ ID NO: 189049 - DNA, 25 bp, Mus musculus
agagatttcgaccaggaaaaaatcc

SEQ ID NO: 189050 - DNA, 25 bp, Mus musculus
agagatttcgaccagttaccttact

SEQ ID NO: 189051 - DNA, 25 bp, Mus musculus
agagatttctattctctacattttg

SEQ ID NO: 189052 - DNA, 25 bp, Mus musculus
agagatttctgctgaatgtgggagt

SEQ ID NO: 189053 - DNA, 25 bp, Mus musculus
agagattttagaaggccccaggaca

SEQ ID NO: 189054 - DNA, 25 bp, Mus musculus
agagattttgactttgtcttcggcc

SEQ ID NO: 189055 - DNA, 25 bp, Mus musculus
agagcaaaaacatagccaaggacat

SEQ ID NO: 189056 - DNA, 25 bp, Mus musculus
agagcaaaaagaacatgtttgggat

SEQ ID NO: 189057 - DNA, 25 bp, Mus musculus
agagcaaaaagaatcgggttgagat

SEQ ID NO: 189058 - DNA, 25 bp, Mus musculus
agagcaaaaagggcatcctggtcaa

SEQ ID NO: 189059 - DNA, 25 bp, Mus musculus
agagcaaaaagtttcgtgaacagac

SEQ ID NO: 189060 - DNA, 25 bp, Mus musculus
agagcaaaacagaggcccagagttt

SEQ ID NO: 189061 - DNA, 25 bp, Mus musculus
agagcaaaaccaaggactctgcttt

SEQ ID NO: 189062 - DNA, 25 bp, Mus musculus
agagcaaaaccaaggagcgcttctg

SEQ ID NO: 189063 - DNA, 25 bp, Mus musculus
agagcaaaaccaagttcttgacatc

SEQ ID NO: 189064 - DNA, 25 bp, Mus musculus
agagcaaaagactgggaacctaccg

SEQ ID NO: 189065 - DNA, 25 bp, Mus musculus
agagcaaaagggaagcagtgcttct

SEQ ID NO: 189066 - DNA, 25 bp, Mus musculus
agagcaaactcagagggcccccccc

SEQ ID NO: 189067 - DNA, 25 bp, Mus musculus
agagcaaactcaggagaggaaacga

SEQ ID NO: 189068 - DNA, 25 bp, Mus musculus
agagcaaagctcaggaacggcgaga

SEQ ID NO: 189069 - DNA, 25 bp, Mus musculus
agagcaaagctcaggctctcatgca

SEQ ID NO: 189070 - DNA, 25 bp, Mus musculus
agagcaaaggggggctctactacat

SEQ ID NO: 189071 - DNA, 25 bp, Mus musculus
agagcaaatgtgaaacgctaccatt

SEQ ID NO: 189072 - DNA, 25 bp, Mus musculus
agagcaacaggagcaccaggcaagc

SEQ ID NO: 189073 - DNA, 25 bp, Mus musculus
agagcaacatgaccatgtggagctc

SEQ ID NO: 189074 - DNA, 25 bp, Mus musculus
agagcaaccggtgaaaaaagccaag

SEQ ID NO: 189075 - DNA, 25 bp, Mus musculus
agagcaaccgtcaagtaaacaaccc

SEQ ID NO: 189076 - DNA, 25 bp, Mus musculus
agagcaaccgtttctatggcgttat

SEQ ID NO: 189077 - DNA, 25 bp, Mus musculus
agagcaacgcgtttgggtctcttac

SEQ ID NO: 189078 - DNA, 25 bp, Mus musculus
agagcaagaaggagagcgtggcaaa

SEQ ID NO: 189079 - DNA, 25 bp, Mus musculus
agagcaagaaggtcagtcaggagat

SEQ ID NO: 189080 - DNA, 25 bp, Mus musculus
agagcaagaccacaacagcatgtag

SEQ ID NO: 189081 - DNA, 25 bp, Mus musculus
agagcaagaggatattatcaggaga

SEQ ID NO: 189082 - DNA, 25 bp, Mus musculus
agagcaagagggtttgttccttaca

SEQ ID NO: 189083 - DNA, 25 bp, Mus musculus
agagcaagatatgaaatcgtggaca

SEQ ID NO: 189084 - DNA, 25 bp, Mus musculus
agagcaagatgatttttgaatgtca

SEQ ID NO: 189085 - DNA, 25 bp, Mus musculus
agagcaagcacgcccccagaggtac

SEQ ID NO: 189086 - DNA, 25 bp, Mus musculus
agagcaagcacgtggttgaagactt

SEQ ID NO: 189087 - DNA, 25 bp, Mus musculus
agagcaagcagaaacacaggaaaag

SEQ ID NO: 189088 - DNA, 25 bp, Mus musculus
agagcaagcaggaaaaggaagttct

SEQ ID NO: 189089 - DNA, 25 bp, Mus musculus
agagcaagcctgagcctgaagagac

SEQ ID NO: 189090 - DNA, 25 bp, Mus musculus
agagcaagctaacgcctactctgta

SEQ ID NO: 189091 - DNA, 25 bp, Mus musculus
agagcaaggaggagtgttgagtgga

SEQ ID NO: 189092 - DNA, 25 bp, Mus musculus
agagcaaggatttatatgaatactc

SEQ ID NO: 189093 - DNA, 25 bp, Mus musculus
agagcaaggcaaagtttgaaactgc

SEQ ID NO: 189094 - DNA, 25 bp, Mus musculus
agagcaaggcgagagggtatcccag

SEQ ID NO: 189095 - DNA, 25 bp, Mus musculus
agagcaagggcgattccccaaaggc

SEQ ID NO: 189096 - DNA, 25 bp, Mus musculus
agagcaaggtatggcgtgatcattg

SEQ ID NO: 189097 - DNA, 25 bp, Mus musculus
agagcaagtagctgatattgacggg

SEQ ID NO: 189098 - DNA, 25 bp, Mus musculus
agagcaatagactgatgatgcttcg

SEQ ID NO: 189099 - DNA, 25 bp, Mus musculus
agagcaatgagtccagatccgaaac

SEQ ID NO: 189100 - DNA, 25 bp, Mus musculus
agagcaatgcaggggggcttggtgg

SEQ ID NO: 189101 - DNA, 25 bp, Mus musculus
agagcacaaattaatcacaatatcg

SEQ ID NO: 189102 - DNA, 25 bp, Mus musculus
agagcacacagagccatgaggctgg

SEQ ID NO: 189103 - DNA, 25 bp, Mus musculus
agagcacacattgaaaagggcaggc

SEQ ID NO: 189104 - DNA, 25 bp, Mus musculus
agagcacagaaaggagcttgaagga

SEQ ID NO: 189105 - DNA, 25 bp, Mus musculus
agagcacagaggcgccgagcgcggt

SEQ ID NO: 189106 - DNA, 25 bp, Mus musculus
agagcacagccccaggccagcagag

SEQ ID NO: 189107 - DNA, 25 bp, Mus musculus
agagcacagccccagtgctctctct

SEQ ID NO: 189108 - DNA, 25 bp, Mus musculus
agagcacagcctaagatggtcactc

SEQ ID NO: 189109 - DNA, 25 bp, Mus musculus
agagcacagcgttgaatctgcgtgg

SEQ ID NO: 189110 - DNA, 25 bp, Mus musculus
agagcacaggaaagaagattcttga

SEQ ID NO: 189111 - DNA, 25 bp, Mus musculus
agagcacagtgggtgttggacgtca

SEQ ID NO: 189112 - DNA, 25 bp, Mus musculus
agagcacagtggtttattgctgtgc

SEQ ID NO: 189113 - DNA, 25 bp, Mus musculus
agagcacatgctgattttgggcatc

SEQ ID NO: 189114 - DNA, 25 bp, Mus musculus
agagcaccaaaccggattgagttta

SEQ ID NO: 189115 - DNA, 25 bp, Mus musculus
agagcaccaaaccgggtgaggcaca

SEQ ID NO: 189116 - DNA, 25 bp, Mus musculus
agagcaccagaattcatcctacaaa

SEQ ID NO: 189117 - DNA, 25 bp, Mus musculus
agagcaccatacagaaatatgatcc

SEQ ID NO: 189118 - DNA, 25 bp, Mus musculus
agagcacccagaggtccatggctgg

SEQ ID NO: 189119 - DNA, 25 bp, Mus musculus
agagcacccaggcttccactgctgg

SEQ ID NO: 189120 - DNA, 25 bp, Mus musculus
agagcaccccgatcccagagagctt

SEQ ID NO: 189121 - DNA, 25 bp, Mus musculus
agagcaccctgctgctgaataatga

SEQ ID NO: 189122 - DNA, 25 bp, Mus musculus
agagcaccctggactacattgcaga

SEQ ID NO: 189123 - DNA, 25 bp, Mus musculus
agagcaccgggcaagagtccatcct

SEQ ID NO: 189124 - DNA, 25 bp, Mus musculus
agagcaccggggactcctgagacat

SEQ ID NO: 189125 - DNA, 25 bp, Mus musculus
agagcacgcgaggagcatgtcatgt

SEQ ID NO: 189126 - DNA, 25 bp, Mus musculus
agagcacggaccgaaagtgagaagc

SEQ ID NO: 189127 - DNA, 25 bp, Mus musculus
agagcacggactagaagtgagaagc

SEQ ID NO: 189128 - DNA, 25 bp, Mus musculus
agagcactacccaggaaaatggcag

SEQ ID NO: 189129 - DNA, 25 bp, Mus musculus
agagcactagtgggactctgtaagc

SEQ ID NO: 189130 - DNA, 25 bp, Mus musculus
agagcactatgacccctcccagtcc

SEQ ID NO: 189131 - DNA, 25 bp, Mus musculus
agagcactgctagggctctgtgccg

SEQ ID NO: 189132 - DNA, 25 bp, Mus musculus
agagcacttgaacagatggggtgtt

SEQ ID NO: 189133 - DNA, 25 bp, Mus musculus
agagcacttgaacagattcattatg

SEQ ID NO: 189134 - DNA, 25 bp, Mus musculus
agagcacttttgagcacaagtgcag

SEQ ID NO: 189135 - DNA, 25 bp, Mus musculus
agagcacttttggactacattgcag

SEQ ID NO: 189136 - DNA, 25 bp, Mus musculus
agagcagaaagccaatgctcttcat

SEQ ID NO: 189137 - DNA, 25 bp, Mus musculus
agagcagaaggaacttgacctcatg

SEQ ID NO: 189138 - DNA, 25 bp, Mus musculus
agagcagacagataaaggagctgga

SEQ ID NO: 189139 - DNA, 25 bp, Mus musculus
agagcagagaatgagaaaatgaaaa

SEQ ID NO: 189140 - DNA, 25 bp, Mus musculus
agagcagagcatggtggagctgaag

SEQ ID NO: 189141 - DNA, 25 bp, Mus musculus
agagcagaggaagctgaaccaataa

SEQ ID NO: 189142 - DNA, 25 bp, Mus musculus
agagcagatgggatgagccggcagg

SEQ ID NO: 189143 - DNA, 25 bp, Mus musculus
agagcagattgcagagttcaaagaa

SEQ ID NO: 189144 - DNA, 25 bp, Mus musculus
agagcagcaaggagctggaagacat

SEQ ID NO: 189145 - DNA, 25 bp, Mus musculus
agagcagcaatgttaagtcttctta

SEQ ID NO: 189146 - DNA, 25 bp, Mus musculus
agagcagcagaaaattgtccagcgc

SEQ ID NO: 189147 - DNA, 25 bp, Mus musculus
agagcagcagaaactagacaccatg

SEQ ID NO: 189148 - DNA, 25 bp, Mus musculus
agagcagcagacaccatgtgcgacg

SEQ ID NO: 189149 - DNA, 25 bp, Mus musculus
agagcagcagactcctccctcccct

SEQ ID NO: 189150 - DNA, 25 bp, Mus musculus
agagcagcagagtggtaggattgaa

SEQ ID NO: 189151 - DNA, 25 bp, Mus musculus
agagcagcagatcagacctactgtg

SEQ ID NO: 189152 - DNA, 25 bp, Mus musculus
agagcagcaggaggatatggctcgg

SEQ ID NO: 189153 - DNA, 25 bp, Mus musculus
agagcagcagggccctgttctccgg

SEQ ID NO: 189154 - DNA, 25 bp, Mus musculus
agagcagcaggtatggacaacaggc

SEQ ID NO: 189155 - DNA, 25 bp, Mus musculus
agagcagcaggtttccaggcaacaa

SEQ ID NO: 189156 - DNA, 25 bp, Mus musculus
agagcagccacacagagccagacct

SEQ ID NO: 189157 - DNA, 25 bp, Mus musculus
agagcagccaggacaatcccagaac

SEQ ID NO: 189158 - DNA, 25 bp, Mus musculus
agagcagcctccggctggcttaact

SEQ ID NO: 189159 - DNA, 25 bp, Mus musculus
agagcagcctccgggacccccgagg

SEQ ID NO: 189160 - DNA, 25 bp, Mus musculus
agagcagctacgagacgctctgtct

SEQ ID NO: 189161 - DNA, 25 bp, Mus musculus
agagcagctactaagcgactctcgc

SEQ ID NO: 189162 - DNA, 25 bp, Mus musculus
agagcagctgaggggtaatcaggaa

SEQ ID NO: 189163 - DNA, 25 bp, Mus musculus
agagcagctgctgaaagacctaagt

SEQ ID NO: 189164 - DNA, 25 bp, Mus musculus
agagcaggagaacaaaatccagtct

SEQ ID NO: 189165 - DNA, 25 bp, Mus musculus
agagcaggagcgcctttgacctgag

SEQ ID NO: 189166 - DNA, 25 bp, Mus musculus
agagcaggagctgacattcacactc

SEQ ID NO: 189167 - DNA, 25 bp, Mus musculus
agagcaggagctgtctgaggaggac

SEQ ID NO: 189168 - DNA, 25 bp, Mus musculus
agagcaggattcaccatgactctgc

SEQ ID NO: 189169 - DNA, 25 bp, Mus musculus
agagcaggcgggactgtcctgtgca

SEQ ID NO: 189170 - DNA, 25 bp, Mus musculus
agagcagggccagatgtagtgctga

SEQ ID NO: 189171 - DNA, 25 bp, Mus musculus
agagcagggccagtgctgagcagcg

SEQ ID NO: 189172 - DNA, 25 bp, Mus musculus
agagcaggtaaagtaccaaatatgc

SEQ ID NO: 189173 - DNA, 25 bp, Mus musculus
agagcaggtttgagatgttctcaaa

SEQ ID NO: 189174 - DNA, 25 bp, Mus musculus
agagcagtagtggcttcacggaaac

SEQ ID NO: 189175 - DNA, 25 bp, Mus musculus
agagcagtctgaggcctctggggac

SEQ ID NO: 189176 - DNA, 25 bp, Mus musculus
agagcagtgaaagcaatgacatttc

SEQ ID NO: 189177 - DNA, 25 bp, Mus musculus
agagcagtgagcagtgggagacatt

SEQ ID NO: 189178 - DNA, 25 bp, Mus musculus
agagcagtgaggataccgctattgt

SEQ ID NO: 189179 - DNA, 25 bp, Mus musculus
agagcagtgcaaaggtgattcttac

SEQ ID NO: 189180 - DNA, 25 bp, Mus musculus
agagcagttaagctaccttaagggc

SEQ ID NO: 189181 - DNA, 25 bp, Mus musculus
agagcataaggtttatctcaagtct

SEQ ID NO: 189182 - DNA, 25 bp, Mus musculus
agagcatataaggagaagtgcccgg

SEQ ID NO: 189183 - DNA, 25 bp, Mus musculus
agagcatataaggagcttttcatcc

SEQ ID NO: 189184 - DNA, 25 bp, Mus musculus
agagcatcacgaaatagatatgatt

SEQ ID NO: 189185 - DNA, 25 bp, Mus musculus
agagcatcacgccagtagaaataga

SEQ ID NO: 189186 - DNA, 25 bp, Mus musculus
agagcatcagacctttgaagaccct

SEQ ID NO: 189187 - DNA, 25 bp, Mus musculus
agagcatcagcaaggtactgccctt

SEQ ID NO: 189188 - DNA, 25 bp, Mus musculus
agagcatcccagaggaattcaaggg

SEQ ID NO: 189189 - DNA, 25 bp, Mus musculus
agagcatcctggtgaccagccagga

SEQ ID NO: 189190 - DNA, 25 bp, Mus musculus
agagcatctctcggattgggctatc

SEQ ID NO: 189191 - DNA, 25 bp, Mus musculus
agagcatctgattgtggggaaatga

SEQ ID NO: 189192 - DNA, 25 bp, Mus musculus
agagcatgaaactcgactccaggga

SEQ ID NO: 189193 - DNA, 25 bp, Mus musculus
agagcatgaagactccgtggtttcc

SEQ ID NO: 189194 - DNA, 25 bp, Mus musculus
agagcatgaagggcgttttttctat

SEQ ID NO: 189195 - DNA, 25 bp, Mus musculus
agagcatgaagtgggccaatccgag

SEQ ID NO: 189196 - DNA, 25 bp, Mus musculus
agagcatgcagcaatgttgctttgt

SEQ ID NO: 189197 - DNA, 25 bp, Mus musculus
agagcatgcagcacccaatgatgat

SEQ ID NO: 189198 - DNA, 25 bp, Mus musculus
agagcatggaaaaccgtggacttgc

SEQ ID NO: 189199 - DNA, 25 bp, Mus musculus
agagcatgggaagcaaatgaagaag

SEQ ID NO: 189200 - DNA, 25 bp, Mus musculus
agagcatgggtcaggttttctacta

SEQ ID NO: 189201 - DNA, 25 bp, Mus musculus
agagcatgtcggctaccttgagagg

SEQ ID NO: 189202 - DNA, 25 bp, Mus musculus
agagcattaagcatccagcatgtgt

SEQ ID NO: 189203 - DNA, 25 bp, Mus musculus
agagcattctggctgcagcagtgaa

SEQ ID NO: 189204 - DNA, 25 bp, Mus musculus
agagccaaaagattcttcagtttga

SEQ ID NO: 189205 - DNA, 25 bp, Mus musculus
agagccaaacgagccacaatcatgt

SEQ ID NO: 189206 - DNA, 25 bp, Mus musculus
agagccaaagaacaaattggaagaa

SEQ ID NO: 189207 - DNA, 25 bp, Mus musculus
agagccaacagatgaagaaacaact

SEQ ID NO: 189208 - DNA, 25 bp, Mus musculus
agagccaagaaggtaaggcgagttc

SEQ ID NO: 189209 - DNA, 25 bp, Mus musculus
agagccaatggaccttgccaccatg

SEQ ID NO: 189210 - DNA, 25 bp, Mus musculus
agagccaatgggtctcataacaaca

SEQ ID NO: 189211 - DNA, 25 bp, Mus musculus
agagccacagaactgtcctggctcc

SEQ ID NO: 189212 - DNA, 25 bp, Mus musculus
agagccacagagacagtgtttcact

SEQ ID NO: 189213 - DNA, 25 bp, Mus musculus
agagccacaggatctcaattcacag

SEQ ID NO: 189214 - DNA, 25 bp, Mus musculus
agagccacctcaggatggtagagca

SEQ ID NO: 189215 - DNA, 25 bp, Mus musculus
agagccactgattgccacagcagtg

SEQ ID NO: 189216 - DNA, 25 bp, Mus musculus
agagccactggactgacagacgaag

SEQ ID NO: 189217 - DNA, 25 bp, Mus musculus
agagccactgggctcctagcttaca

SEQ ID NO: 189218 - DNA, 25 bp, Mus musculus
agagccactggggggaggggttgca

SEQ ID NO: 189219 - DNA, 25 bp, Mus musculus
agagccagaaaagagctggactaca

SEQ ID NO: 189220 - DNA, 25 bp, Mus musculus
agagccagaagaccagtgaagtcaa

SEQ ID NO: 189221 - DNA, 25 bp, Mus musculus
agagccagaccgcggcgggcaggaa

SEQ ID NO: 189222 - DNA, 25 bp, Mus musculus
agagccagaccgcgggcagcgtgga

SEQ ID NO: 189223 - DNA, 25 bp, Mus musculus
agagccagaggcactgagagtatga

SEQ ID NO: 189224 - DNA, 25 bp, Mus musculus
agagccagcctggcgacccagtgga

SEQ ID NO: 189225 - DNA, 25 bp, Mus musculus
agagccaggaagtgactgtggactc

SEQ ID NO: 189226 - DNA, 25 bp, Mus musculus
agagccaggatgcgctcctccgcct

SEQ ID NO: 189227 - DNA, 25 bp, Mus musculus
agagccaggcaggtgcttcagaact

SEQ ID NO: 189228 - DNA, 25 bp, Mus musculus
agagccaggccaaggcatactttga

SEQ ID NO: 189229 - DNA, 25 bp, Mus musculus
agagccaggcggagcacgccccaga

SEQ ID NO: 189230 - DNA, 25 bp, Mus musculus
agagccagggaagggcaatgcgagc

SEQ ID NO: 189231 - DNA, 25 bp, Mus musculus
agagccagtatgcaggtgtcactga

SEQ ID NO: 189232 - DNA, 25 bp, Mus musculus
agagccagtatgcaggttgtccttg

SEQ ID NO: 189233 - DNA, 25 bp, Mus musculus
agagccagtgagccctgcctagccc

SEQ ID NO: 189234 - DNA, 25 bp, Mus musculus
agagccagtgcctggggttctgcag

SEQ ID NO: 189235 - DNA, 25 bp, Mus musculus
agagccatagaggtggagtacatgt

SEQ ID NO: 189236 - DNA, 25 bp, Mus musculus
agagccatcaccaagcccccgaggc

SEQ ID NO: 189237 - DNA, 25 bp, Mus musculus
agagccatcaccaagtcagaaggtc

SEQ ID NO: 189238 - DNA, 25 bp, Mus musculus
agagccatcacccgaaacaggccac

SEQ ID NO: 189239 - DNA, 25 bp, Mus musculus
agagccatcaggtcctaatcaaagt

SEQ ID NO: 189240 - DNA, 25 bp, Mus musculus
agagccatctacttgcaccggaagg

SEQ ID NO: 189241 - DNA, 25 bp, Mus musculus
agagccatgaagcaggtggcaggta

SEQ ID NO: 189242 - DNA, 25 bp, Mus musculus
agagccatgaagccgaggaaagcag

SEQ ID NO: 189243 - DNA, 25 bp, Mus musculus
agagccatggagatggagcagttga

SEQ ID NO: 189244 - DNA, 25 bp, Mus musculus
agagccatggaggaggctacgcaag

SEQ ID NO: 189245 - DNA, 25 bp, Mus musculus
agagccatggaggaggggccttcat

SEQ ID NO: 189246 - DNA, 25 bp, Mus musculus
agagccatggggaagctctttgtgg

SEQ ID NO: 189247 - DNA, 25 bp, Mus musculus
agagccatgtagaaccaggcccaac

SEQ ID NO: 189248 - DNA, 25 bp, Mus musculus
agagcccaaagggggaccaggctct

SEQ ID NO: 189249 - DNA, 25 bp, Mus musculus
agagcccacagtcgaaggatctcat

SEQ ID NO: 189250 - DNA, 25 bp, Mus musculus
agagcccacttaaactccgaggtga

SEQ ID NO: 189251 - DNA, 25 bp, Mus musculus
agagcccagacagagaagagccatg

SEQ ID NO: 189252 - DNA, 25 bp, Mus musculus
agagcccagctagccctcctgtaag

SEQ ID NO: 189253 - DNA, 25 bp, Mus musculus
agagcccatcaggtggttgaagatg

SEQ ID NO: 189254 - DNA, 25 bp, Mus musculus
agagcccattgatgtcacagctaag

SEQ ID NO: 189255 - DNA, 25 bp, Mus musculus
agagccccaagcaggtgaggaattt

SEQ ID NO: 189256 - DNA, 25 bp, Mus musculus
agagccccagaaccaaggctctggt

SEQ ID NO: 189257 - DNA, 25 bp, Mus musculus
agagccccagagtggtaaacagctg

SEQ ID NO: 189258 - DNA, 25 bp, Mus musculus
agagccccgaaggactgctgcagag

SEQ ID NO: 189259 - DNA, 25 bp, Mus musculus
agagccccgaaggcacacatgatgt

SEQ ID NO: 189260 - DNA, 25 bp, Mus musculus
agagccccggaggaggtgacagagt

SEQ ID NO: 189261 - DNA, 25 bp, Mus musculus
agagccccggtgccaaagcctgcgc

SEQ ID NO: 189262 - DNA, 25 bp, Mus musculus
agagcccctgggctggtggctctcg

SEQ ID NO: 189263 - DNA, 25 bp, Mus musculus
agagcccgcgcaggatccaagacac

SEQ ID NO: 189264 - DNA, 25 bp, Mus musculus
agagcccgcggcagatgaggaaacc

SEQ ID NO: 189265 - DNA, 25 bp, Mus musculus
agagcccgcggcagggaatgatttt

SEQ ID NO: 189266 - DNA, 25 bp, Mus musculus
agagcccggcagatgcccccacgac

SEQ ID NO: 189267 - DNA, 25 bp, Mus musculus
agagcccggcagtcaggagtggcag

SEQ ID NO: 189268 - DNA, 25 bp, Mus musculus
agagcccgtcagtgtgggtgctctt

SEQ ID NO: 189269 - DNA, 25 bp, Mus musculus
agagccctccatggacatagtcttg

SEQ ID NO: 189270 - DNA, 25 bp, Mus musculus
agagccctgggcccttcctgtccca

SEQ ID NO: 189271 - DNA, 25 bp, Mus musculus
agagccctttggatccagccatatt

SEQ ID NO: 189272 - DNA, 25 bp, Mus musculus
agagccgacagagcaagtgtttgcc

SEQ ID NO: 189273 - DNA, 25 bp, Mus musculus
agagccgacagagcttcgtccacaa

SEQ ID NO: 189274 - DNA, 25 bp, Mus musculus
agagccgcagcatggagacaaaaaa

SEQ ID NO: 189275 - DNA, 25 bp, Mus musculus
agagccgcagcatgggaaattaagc

SEQ ID NO: 189276 - DNA, 25 bp, Mus musculus
agagccgccaccacggcgggcgtcc

SEQ ID NO: 189277 - DNA, 25 bp, Mus musculus
agagccggaacaggtacttaaaatg

SEQ ID NO: 189278 - DNA, 25 bp, Mus musculus
agagccggaaggataaagaaatgga

SEQ ID NO: 189279 - DNA, 25 bp, Mus musculus
agagccggagtccagggtctccata

SEQ ID NO: 189280 - DNA, 25 bp, Mus musculus
agagccggagtccgtctacagagag

SEQ ID NO: 189281 - DNA, 25 bp, Mus musculus
agagccggattcaggaggtggatgc

SEQ ID NO: 189282 - DNA, 25 bp, Mus musculus
agagccggcagccatcatgttaagg

SEQ ID NO: 189283 - DNA, 25 bp, Mus musculus
agagccggcaggatttctccatata

SEQ ID NO: 189284 - DNA, 25 bp, Mus musculus
agagccggcccgcgtacggcatcca

SEQ ID NO: 189285 - DNA, 25 bp, Mus musculus
agagccgtcaagctgatttatccag

SEQ ID NO: 189286 - DNA, 25 bp, Mus musculus
agagccgtctctacttaagaagctc

SEQ ID NO: 189287 - DNA, 25 bp, Mus musculus
agagccgtctgggcaagcaggagga

SEQ ID NO: 189288 - DNA, 25 bp, Mus musculus
agagccgtctggtgtggagggtgca

SEQ ID NO: 189289 - DNA, 25 bp, Mus musculus
agagccgtgagccagcttcacctat

SEQ ID NO: 189290 - DNA, 25 bp, Mus musculus
agagcctaacacaggtggtgaccgt

SEQ ID NO: 189291 - DNA, 25 bp, Mus musculus
agagcctacccagagaactggcaga

SEQ ID NO: 189292 - DNA, 25 bp, Mus musculus
agagcctacccagagataagaagca

SEQ ID NO: 189293 - DNA, 25 bp, Mus musculus
agagcctactgaagatcgacttgga

SEQ ID NO: 189294 - DNA, 25 bp, Mus musculus
agagcctactgaaggcctcctcaaa

SEQ ID NO: 189295 - DNA, 25 bp, Mus musculus
agagcctagaggagaaagtctcgcg

SEQ ID NO: 189296 - DNA, 25 bp, Mus musculus
agagcctatgcatctgactgtagta

SEQ ID NO: 189297 - DNA, 25 bp, Mus musculus
agagcctatggatctgactgtagta

SEQ ID NO: 189298 - DNA, 25 bp, Mus musculus
agagcctcagaattgctcagccacc

SEQ ID NO: 189299 - DNA, 25 bp, Mus musculus
agagcctcagggggcctgtggcagc

SEQ ID NO: 189300 - DNA, 25 bp, Mus musculus
agagcctccagggacagtgtcttgg

SEQ ID NO: 189301 - DNA, 25 bp, Mus musculus
agagcctccggggaccttcctggtg

SEQ ID NO: 189302 - DNA, 25 bp, Mus musculus
agagcctccgggggtgtctctttgg

SEQ ID NO: 189303 - DNA, 25 bp, Mus musculus
agagcctcctgacatgatgtagctc

SEQ ID NO: 189304 - DNA, 25 bp, Mus musculus
agagcctcctggagctggtggagta

SEQ ID NO: 189305 - DNA, 25 bp, Mus musculus
agagcctcctggatatatctattct

SEQ ID NO: 189306 - DNA, 25 bp, Mus musculus
agagcctctaggccctaggaccatg

SEQ ID NO: 189307 - DNA, 25 bp, Mus musculus
agagcctctcagagataaaatcaaa

SEQ ID NO: 189308 - DNA, 25 bp, Mus musculus
agagcctgaacagagagctgaaatt

SEQ ID NO: 189309 - DNA, 25 bp, Mus musculus
agagcctgaaggaagagagatatac

SEQ ID NO: 189310 - DNA, 25 bp, Mus musculus
agagcctgaaggctagatatggatt

SEQ ID NO: 189311 - DNA, 25 bp, Mus musculus
agagcctgaaggttaaaatgagctt

SEQ ID NO: 189312 - DNA, 25 bp, Mus musculus
agagcctgacagaaggtctccgggc

SEQ ID NO: 189313 - DNA, 25 bp, Mus musculus
agagcctgagatctggtggctctga

SEQ ID NO: 189314 - DNA, 25 bp, Mus musculus
agagcctgaggcccaggatgggtga

SEQ ID NO: 189315 - DNA, 25 bp, Mus musculus
agagcctgatgaatgaggtgtgtac

SEQ ID NO: 189316 - DNA, 25 bp, Mus musculus
agagcctgatgtgaggctcctcata

SEQ ID NO: 189317 - DNA, 25 bp, Mus musculus
agagcctgcagcctgtggtatcctg

SEQ ID NO: 189318 - DNA, 25 bp, Mus musculus
agagcctgctggcaatcatctgggg

SEQ ID NO: 189319 - DNA, 25 bp, Mus musculus
agagcctggctggcacgttttgtgc

SEQ ID NO: 189320 - DNA, 25 bp, Mus musculus
agagcctgggcggagccccttaggt

SEQ ID NO: 189321 - DNA, 25 bp, Mus musculus
agagcctgggcggagtagcgctggg

SEQ ID NO: 189322 - DNA, 25 bp, Mus musculus
agagcctggtgggcagcctggagat

SEQ ID NO: 189323 - DNA, 25 bp, Mus musculus
agagcctgtgagaaaactaactgct

SEQ ID NO: 189324 - DNA, 25 bp, Mus musculus
agagcctgtgagcttcaaactggat

SEQ ID NO: 189325 - DNA, 25 bp, Mus musculus
agagcctgtgcaagggcggcctgag

SEQ ID NO: 189326 - DNA, 25 bp, Mus musculus
agagccttagaggcccacgaggctt

SEQ ID NO: 189327 - DNA, 25 bp, Mus musculus
agagccttcaagaagttgctctggg

SEQ ID NO: 189328 - DNA, 25 bp, Mus musculus
agagccttcgagaggtgctgagctt

SEQ ID NO: 189329 - DNA, 25 bp, Mus musculus
agagccttctcctgaaacactgtgc

SEQ ID NO: 189330 - DNA, 25 bp, Mus musculus
agagccttggagagtctccaaggac

SEQ ID NO: 189331 - DNA, 25 bp, Mus musculus
agagcctttggaaagtgacactgat

SEQ ID NO: 189332 - DNA, 25 bp, Mus musculus
agagcgaagacgggagcgggagcag

SEQ ID NO: 189333 - DNA, 25 bp, Mus musculus
agagcgacaggctccgtgaagactg

SEQ ID NO: 189334 - DNA, 25 bp, Mus musculus
agagcgacccacacgtcaaactaca

SEQ ID NO: 189335 - DNA, 25 bp, Mus musculus
agagcgaccctgacagagtcatgtg

SEQ ID NO: 189336 - DNA, 25 bp, Mus musculus
agagcgacctgtggaggcttggcaa

SEQ ID NO: 189337 - DNA, 25 bp, Mus musculus
agagcgagcgaagagagcaaagacc

SEQ ID NO: 189338 - DNA, 25 bp, Mus musculus
agagcgaggagacgagcaaaaatca

SEQ ID NO: 189339 - DNA, 25 bp, Mus musculus
agagcgaggaggtggaagatatcaa

SEQ ID NO: 189340 - DNA, 25 bp, Mus musculus
agagcgaggggtccgtctcccaggg

SEQ ID NO: 189341 - DNA, 25 bp, Mus musculus
agagcgaggtaaagaaatccaccgt

SEQ ID NO: 189342 - DNA, 25 bp, Mus musculus
agagcgagtcgaattggcagagggg

SEQ ID NO: 189343 - DNA, 25 bp, Mus musculus
agagcgatccagtttgacgccgagt

SEQ ID NO: 189344 - DNA, 25 bp, Mus musculus
agagcgatgtctggtccttcggggt

SEQ ID NO: 189345 - DNA, 25 bp, Mus musculus
agagcgatgtggtatgccctgatgt

SEQ ID NO: 189346 - DNA, 25 bp, Mus musculus
agagcgatgtgtgatcttttggagt

SEQ ID NO: 189347 - DNA, 25 bp, Mus musculus
agagcgatgtgtggtccttcggtgt

SEQ ID NO: 189348 - DNA, 25 bp, Mus musculus
agagcgatgtgtggtcttttggagt

SEQ ID NO: 189349 - DNA, 25 bp, Mus musculus
agagcgcagaggctggggacagtac

SEQ ID NO: 189350 - DNA, 25 bp, Mus musculus
agagcgcagcttgggatcctggtat

SEQ ID NO: 189351 - DNA, 25 bp, Mus musculus
agagcgcatcagctgcagttaaagc

SEQ ID NO: 189352 - DNA, 25 bp, Mus musculus
agagcgcattaggcggtgggtctcg

SEQ ID NO: 189353 - DNA, 25 bp, Mus musculus
agagcgcattagggccaatgaggcg

SEQ ID NO: 189354 - DNA, 25 bp, Mus musculus
agagcgcctcatcgggggcacagag

SEQ ID NO: 189355 - DNA, 25 bp, Mus musculus
agagcgcgcgatttctaacgagcgt

SEQ ID NO: 189356 - DNA, 25 bp, Mus musculus
agagcgcgcgtggaaagaagaaagc

SEQ ID NO: 189357 - DNA, 25 bp, Mus musculus
agagcgctacattgcccccacagtg

SEQ ID NO: 189358 - DNA, 25 bp, Mus musculus
agagcgctacattggtcatcaaaca

SEQ ID NO: 189359 - DNA, 25 bp, Mus musculus
agagcggacaaggagatctgacggg

SEQ ID NO: 189360 - DNA, 25 bp, Mus musculus
agagcggagcagattgaggacataa

SEQ ID NO: 189361 - DNA, 25 bp, Mus musculus
agagcggagcaggaaggagatgact

SEQ ID NO: 189362 - DNA, 25 bp, Mus musculus
agagcggagccaacatcaacagaat

SEQ ID NO: 189363 - DNA, 25 bp, Mus musculus
agagcggaggcaggcaaaacccacg

SEQ ID NO: 189364 - DNA, 25 bp, Mus musculus
agagcggcgagagtaatccatatgc

SEQ ID NO: 189365 - DNA, 25 bp, Mus musculus
agagcggcgcgggtccaacccagac

SEQ ID NO: 189366 - DNA, 25 bp, Mus musculus
agagcggcgcggtccccagagccag

SEQ ID NO: 189367 - DNA, 25 bp, Mus musculus
agagcggcggaccgcagcagaagaa

SEQ ID NO: 189368 - DNA, 25 bp, Mus musculus
agagcgggcgatactgcagcctctg

SEQ ID NO: 189369 - DNA, 25 bp, Mus musculus
agagcggggtgtgggccctcccagg

SEQ ID NO: 189370 - DNA, 25 bp, Mus musculus
agagcggggtgtggggatttcgctt

SEQ ID NO: 189371 - DNA, 25 bp, Mus musculus
agagcggtgagcgacatgtccttcc

SEQ ID NO: 189372 - DNA, 25 bp, Mus musculus
agagcggtttgccagggaaaatcat

SEQ ID NO: 189373 - DNA, 25 bp, Mus musculus
agagcggtttgccaggtcggatgat

SEQ ID NO: 189374 - DNA, 25 bp, Mus musculus
agagcgtcaaggtgtgggataagag

SEQ ID NO: 189375 - DNA, 25 bp, Mus musculus
agagcgtctcatgatggagagaaga

SEQ ID NO: 189376 - DNA, 25 bp, Mus musculus
agagcgtcttggggggtgtgaagaa

SEQ ID NO: 189377 - DNA, 25 bp, Mus musculus
agagcgtgatctcggagtcctccgg

SEQ ID NO: 189378 - DNA, 25 bp, Mus musculus
agagcgtgatctcgggcaatggcag

SEQ ID NO: 189379 - DNA, 25 bp, Mus musculus
agagcgtgcgccaggtgtcttctgc

SEQ ID NO: 189380 - DNA, 25 bp, Mus musculus
agagcgtggagataacaaaacagga

SEQ ID NO: 189381 - DNA, 25 bp, Mus musculus
agagcgtgtccggccctgaacgcca

SEQ ID NO: 189382 - DNA, 25 bp, Mus musculus
agagcgtgtgggcatcgttctgcct

SEQ ID NO: 189383 - DNA, 25 bp, Mus musculus
agagcgtgtgttaagccatcaaaca

SEQ ID NO: 189384 - DNA, 25 bp, Mus musculus
agagcgtgtgttaaggtctcatttt

SEQ ID NO: 189385 - DNA, 25 bp, Mus musculus
agagcgtgtgttaaggttaccaaca

SEQ ID NO: 189386 - DNA, 25 bp, Mus musculus
agagcgtttggaacacctttcccaa

SEQ ID NO: 189387 - DNA, 25 bp, Mus musculus
agagctaaacaagaatttaaagagg

SEQ ID NO: 189388 - DNA, 25 bp, Mus musculus
agagctaaagggtttggatccagct

SEQ ID NO: 189389 - DNA, 25 bp, Mus musculus
agagctaacgagatgaacgtgacgc

SEQ ID NO: 189390 - DNA, 25 bp, Mus musculus
agagctaacgaggttgactgcctcc

SEQ ID NO: 189391 - DNA, 25 bp, Mus musculus
agagctaagcccagatggctctgac

SEQ ID NO: 189392 - DNA, 25 bp, Mus musculus
agagctaaggaagggtcttctactt

SEQ ID NO: 189393 - DNA, 25 bp, Mus musculus
agagctaaggatcaagcacttcctg

SEQ ID NO: 189394 - DNA, 25 bp, Mus musculus
agagctaaggttcccgaggagactt

SEQ ID NO: 189395 - DNA, 25 bp, Mus musculus
agagctacagaatcatacgatgact

SEQ ID NO: 189396 - DNA, 25 bp, Mus musculus
agagctacagtggcacctgacaaaa

SEQ ID NO: 189397 - DNA, 25 bp, Mus musculus
agagctaccggagccgcatcaatga

SEQ ID NO: 189398 - DNA, 25 bp, Mus musculus
agagctaccggaggtatggggcaga

SEQ ID NO: 189399 - DNA, 25 bp, Mus musculus
agagctagaaaagaaagtgagttcc

SEQ ID NO: 189400 - DNA, 25 bp, Mus musculus
agagctagagatatgtgtcacaaag

SEQ ID NO: 189401 - DNA, 25 bp, Mus musculus
agagctagaggatgtggagaaagag

SEQ ID NO: 189402 - DNA, 25 bp, Mus musculus
agagctagaggtcacctggaggaag

SEQ ID NO: 189403 - DNA, 25 bp, Mus musculus
agagctagcagacatctctgtgagt

SEQ ID NO: 189404 - DNA, 25 bp, Mus musculus
agagctagcagttccagtgcagact

SEQ ID NO: 189405 - DNA, 25 bp, Mus musculus
agagctagcgggttatgcctccacc

SEQ ID NO: 189406 - DNA, 25 bp, Mus musculus
agagctaggaagaggtcagccatgt

SEQ ID NO: 189407 - DNA, 25 bp, Mus musculus
agagctatcttataatctggaggct

SEQ ID NO: 189408 - DNA, 25 bp, Mus musculus
agagctattgcacggatggtgaact

SEQ ID NO: 189409 - DNA, 25 bp, Mus musculus
agagctcaaaatgttaccagactta

SEQ ID NO: 189410 - DNA, 25 bp, Mus musculus
agagctcaaagccaagcactcgcct

SEQ ID NO: 189411 - DNA, 25 bp, Mus musculus
agagctcaaggagcgaatctgcatg

SEQ ID NO: 189412 - DNA, 25 bp, Mus musculus
agagctcaaggatgcaggagctggg

SEQ ID NO: 189413 - DNA, 25 bp, Mus musculus
agagctcaaggctaaccctttcaag

SEQ ID NO: 189414 - DNA, 25 bp, Mus musculus
agagctcactcaaggtaatagcgct

SEQ ID NO: 189415 - DNA, 25 bp, Mus musculus
agagctcagagcagaaaacttatag

SEQ ID NO: 189416 - DNA, 25 bp, Mus musculus
agagctcagaggagaattctgtggc

SEQ ID NO: 189417 - DNA, 25 bp, Mus musculus
agagctcagagggtgctctgtgtgg

SEQ ID NO: 189418 - DNA, 25 bp, Mus musculus
agagctcagctgagcccagtccctg

SEQ ID NO: 189419 - DNA, 25 bp, Mus musculus
agagctcagtggccctgctcttgga

SEQ ID NO: 189420 - DNA, 25 bp, Mus musculus
agagctcatagaagttaatggaacc

SEQ ID NO: 189421 - DNA, 25 bp, Mus musculus
agagctccagtgtagagggccaagt

SEQ ID NO: 189422 - DNA, 25 bp, Mus musculus
agagctccagtgtagatttattttt

SEQ ID NO: 189423 - DNA, 25 bp, Mus musculus
agagctccagtgtaggctctcagac

SEQ ID NO: 189424 - DNA, 25 bp, Mus musculus
agagctccagtgtaggtgttggaac

SEQ ID NO: 189425 - DNA, 25 bp, Mus musculus
agagctcccagacttcttcgagggc

SEQ ID NO: 189426 - DNA, 25 bp, Mus musculus
agagctccctgacaggcccgagcct

SEQ ID NO: 189427 - DNA, 25 bp, Mus musculus
agagctccctgacaggggagagcac

SEQ ID NO: 189428 - DNA, 25 bp, Mus musculus
agagctccgggctcaagtccacccc

SEQ ID NO: 189429 - DNA, 25 bp, Mus musculus
agagctcgggaggtacagtggtccc

SEQ ID NO: 189430 - DNA, 25 bp, Mus musculus
agagctcgggaggttcccgtgagaa

SEQ ID NO: 189431 - DNA, 25 bp, Mus musculus
agagctctaacaggacccaggtctc

SEQ ID NO: 189432 - DNA, 25 bp, Mus musculus
agagctctaacagggcaggatggcc

SEQ ID NO: 189433 - DNA, 25 bp, Mus musculus
agagctctcagcacgggggcgtgat

SEQ ID NO: 189434 - DNA, 25 bp, Mus musculus
agagctctcaggtactgtactgatg

SEQ ID NO: 189435 - DNA, 25 bp, Mus musculus
agagctctcaggttcctcagtggtg

SEQ ID NO: 189436 - DNA, 25 bp, Mus musculus
agagctctcgtgacagccttgagac

SEQ ID NO: 189437 - DNA, 25 bp, Mus musculus
agagctctttctgagacaccccctg

SEQ ID NO: 189438 - DNA, 25 bp, Mus musculus
agagctctttgatgacttgggtgtc

SEQ ID NO: 189439 - DNA, 25 bp, Mus musculus
agagctgaagaaggttatgagaacc

SEQ ID NO: 189440 - DNA, 25 bp, Mus musculus
agagctgaagaatggctttgctgtg

SEQ ID NO: 189441 - DNA, 25 bp, Mus musculus
agagctgaagagccagatgaagtca

SEQ ID NO: 189442 - DNA, 25 bp, Mus musculus
agagctgaagccagcaagcctgcct

SEQ ID NO: 189443 - DNA, 25 bp, Mus musculus
agagctgaaggctattctagactca

SEQ ID NO: 189444 - DNA, 25 bp, Mus musculus
agagctgacacgctggagatggagt

SEQ ID NO: 189445 - DNA, 25 bp, Mus musculus
agagctgacccaagccattttgagt

SEQ ID NO: 189446 - DNA, 25 bp, Mus musculus
agagctgacgggggtggcaccgaaa

SEQ ID NO: 189447 - DNA, 25 bp, Mus musculus
agagctgagatactagtgactgctc

SEQ ID NO: 189448 - DNA, 25 bp, Mus musculus
agagctgagtgcaagtgtcctgcag

SEQ ID NO: 189449 - DNA, 25 bp, Mus musculus
agagctgatctgcagactcagcctt

SEQ ID NO: 189450 - DNA, 25 bp, Mus musculus
agagctgatctgcagtcagcaactc

SEQ ID NO: 189451 - DNA, 25 bp, Mus musculus
agagctgcaagcaggggtagagcca

SEQ ID NO: 189452 - DNA, 25 bp, Mus musculus
agagctgcagagtgaaatgacactg

SEQ ID NO: 189453 - DNA, 25 bp, Mus musculus
agagctgcagagtgagcaccaggtt

SEQ ID NO: 189454 - DNA, 25 bp, Mus musculus
agagctgcagcagatggagcagagg

SEQ ID NO: 189455 - DNA, 25 bp, Mus musculus
agagctgcagcaggctgttctgcag

SEQ ID NO: 189456 - DNA, 25 bp, Mus musculus
agagctgcccagagacccttcggaa

SEQ ID NO: 189457 - DNA, 25 bp, Mus musculus
agagctgccccggttcagaaactta

SEQ ID NO: 189458 - DNA, 25 bp, Mus musculus
agagctgcctcagagtggggagtag

SEQ ID NO: 189459 - DNA, 25 bp, Mus musculus
agagctgcctcaggctacaaggaag

SEQ ID NO: 189460 - DNA, 25 bp, Mus musculus
agagctgctacgatgcagacagaca

SEQ ID NO: 189461 - DNA, 25 bp, Mus musculus
agagctgctacgccacacagtctca

SEQ ID NO: 189462 - DNA, 25 bp, Mus musculus
agagctgctagaaggctgaagaacc

SEQ ID NO: 189463 - DNA, 25 bp, Mus musculus
agagctgctatgtggccaccctgga

SEQ ID NO: 189464 - DNA, 25 bp, Mus musculus
agagctgctcccgtccccaccgaca

SEQ ID NO: 189465 - DNA, 25 bp, Mus musculus
agagctgctctagcaccacatctgc

SEQ ID NO: 189466 - DNA, 25 bp, Mus musculus
agagctgctgtgctctcctgctatg

SEQ ID NO: 189467 - DNA, 25 bp, Mus musculus
agagctgcttcaggaattctctgat

SEQ ID NO: 189468 - DNA, 25 bp, Mus musculus
agagctggaacggctgctggtccag

SEQ ID NO: 189469 - DNA, 25 bp, Mus musculus
agagctggaacggctggtggtgagg

SEQ ID NO: 189470 - DNA, 25 bp, Mus musculus
agagctggacacggctgtccagggc

SEQ ID NO: 189471 - DNA, 25 bp, Mus musculus
agagctggagagacaaaagatagag

SEQ ID NO: 189472 - DNA, 25 bp, Mus musculus
agagctggagcagaggagataatcg

SEQ ID NO: 189473 - DNA, 25 bp, Mus musculus
agagctggagcagaggagatcatcg

SEQ ID NO: 189474 - DNA, 25 bp, Mus musculus
agagctggagcattttctgcagcta

SEQ ID NO: 189475 - DNA, 25 bp, Mus musculus
agagctggaggataaataaggaaaa

SEQ ID NO: 189476 - DNA, 25 bp, Mus musculus
agagctggatagagcggcagtacat

SEQ ID NO: 189477 - DNA, 25 bp, Mus musculus
agagctggcactcagggagcatggc

SEQ ID NO: 189478 - DNA, 25 bp, Mus musculus
agagctggctcccttccccaggact

SEQ ID NO: 189479 - DNA, 25 bp, Mus musculus
agagctgggagatcatcacagttga

SEQ ID NO: 189480 - DNA, 25 bp, Mus musculus
agagctgggtgcagaaactggaaac

SEQ ID NO: 189481 - DNA, 25 bp, Mus musculus
agagctggtacagtatgctgtgtcc

SEQ ID NO: 189482 - DNA, 25 bp, Mus musculus
agagctggtggaaggatcatcgaat

SEQ ID NO: 189483 - DNA, 25 bp, Mus musculus
agagctgtaaggccgtggcagagca

SEQ ID NO: 189484 - DNA, 25 bp, Mus musculus
agagctgtaatagttccgaggatga

SEQ ID NO: 189485 - DNA, 25 bp, Mus musculus
agagctgtcactcagaagaaaccca

SEQ ID NO: 189486 - DNA, 25 bp, Mus musculus
agagctgtcactcaggtctgtggag

SEQ ID NO: 189487 - DNA, 25 bp, Mus musculus
agagctgtcagggacggtcaagact

SEQ ID NO: 189488 - DNA, 25 bp, Mus musculus
agagctgtcagtgacccaccctctg

SEQ ID NO: 189489 - DNA, 25 bp, Mus musculus
agagctgtgagcaagtgaacacgga

SEQ ID NO: 189490 - DNA, 25 bp, Mus musculus
agagctgtggcacacatcactcaac

SEQ ID NO: 189491 - DNA, 25 bp, Mus musculus
agagcttacataggtccccttcccc

SEQ ID NO: 189492 - DNA, 25 bp, Mus musculus
agagcttacatagtgcaactacaga

SEQ ID NO: 189493 - DNA, 25 bp, Mus musculus
agagcttacggtcattcctgatcgg

SEQ ID NO: 189494 - DNA, 25 bp, Mus musculus
agagcttcagcgagggaagcttctt

SEQ ID NO: 189495 - DNA, 25 bp, Mus musculus
agagcttcaggaggaatttggctat

SEQ ID NO: 189496 - DNA, 25 bp, Mus musculus
agagcttccaaagccacccgcggtc

SEQ ID NO: 189497 - DNA, 25 bp, Mus musculus
agagcttccaaagcgcggctgggtt

SEQ ID NO: 189498 - DNA, 25 bp, Mus musculus
agagcttcccaggtctctttgagcc

SEQ ID NO: 189499 - DNA, 25 bp, Mus musculus
agagcttcctgagcctcctctttca

SEQ ID NO: 189500 - DNA, 25 bp, Mus musculus
agagcttcctgcagccaggtgggaa

SEQ ID NO: 189501 - DNA, 25 bp, Mus musculus
agagcttcgagaaggccaaagaatc

SEQ ID NO: 189502 - DNA, 25 bp, Mus musculus
agagcttcgcctgaaacctcagctt

SEQ ID NO: 189503 - DNA, 25 bp, Mus musculus
agagcttctcagtagtgatcaagct

SEQ ID NO: 189504 - DNA, 25 bp, Mus musculus
agagcttctccgagaacgggcagag

SEQ ID NO: 189505 - DNA, 25 bp, Mus musculus
agagcttctcggtgtggatcatatg

SEQ ID NO: 189506 - DNA, 25 bp, Mus musculus
agagcttgagttcatcacgctgatc

SEQ ID NO: 189507 - DNA, 25 bp, Mus musculus
agagcttgctacaatgggtgacaag

SEQ ID NO: 189508 - DNA, 25 bp, Mus musculus
agagcttgggattttctttgaggtc

SEQ ID NO: 189509 - DNA, 25 bp, Mus musculus
agagcttggggttttatggcaatta

SEQ ID NO: 189510 - DNA, 25 bp, Mus musculus
agagcttgggtggtcgttgaagtta

SEQ ID NO: 189511 - DNA, 25 bp, Mus musculus
agagcttggttccagatgggtgtgt

SEQ ID NO: 189512 - DNA, 25 bp, Mus musculus
agagcttggttccagggtgactgac

SEQ ID NO: 189513 - DNA, 25 bp, Mus musculus
agagcttgtcagaatcaggtctgat

SEQ ID NO: 189514 - DNA, 25 bp, Mus musculus
agagcttgtcagtatcaggtctgat

SEQ ID NO: 189515 - DNA, 25 bp, Mus musculus
agagctttactctggactttggaga

SEQ ID NO: 189516 - DNA, 25 bp, Mus musculus
agagctttagtgtagggccaagtcc

SEQ ID NO: 189517 - DNA, 25 bp, Mus musculus
agagctttagtgtataggggagcag

SEQ ID NO: 189518 - DNA, 25 bp, Mus musculus
agagctttcaaagtgaaacctccac

SEQ ID NO: 189519 - DNA, 25 bp, Mus musculus
agagctttgggaccggttcggacca

SEQ ID NO: 189520 - DNA, 25 bp, Mus musculus
agagctttttccaggatcccattgt

SEQ ID NO: 189521 - DNA, 25 bp, Mus musculus
agaggaaaaacagagagagagaaag

SEQ ID NO: 189522 - DNA, 25 bp, Mus musculus
agaggaaaaagagagaaaaggaaca

SEQ ID NO: 189523 - DNA, 25 bp, Mus musculus
agaggaaaaagcgaccagctacatt

SEQ ID NO: 189524 - DNA, 25 bp, Mus musculus
agaggaaaaagttgccaggaaacaa

SEQ ID NO: 189525 - DNA, 25 bp, Mus musculus
agaggaaaagaacaaattacctgct

SEQ ID NO: 189526 - DNA, 25 bp, Mus musculus
agaggaaaagagtgtttgagcacca

SEQ ID NO: 189527 - DNA, 25 bp, Mus musculus
agaggaaaagattgataagtatctg

SEQ ID NO: 189528 - DNA, 25 bp, Mus musculus
agaggaaaagcagacttgtgtcctg

SEQ ID NO: 189529 - DNA, 25 bp, Mus musculus
agaggaaaagcagcagatataccag

SEQ ID NO: 189530 - DNA, 25 bp, Mus musculus
agaggaaaaggcatttatatgtggg

SEQ ID NO: 189531 - DNA, 25 bp, Mus musculus
agaggaaaagggctcggatggcgtc

SEQ ID NO: 189532 - DNA, 25 bp, Mus musculus
agaggaaaataaggtacttcaattt

SEQ ID NO: 189533 - DNA, 25 bp, Mus musculus
agaggaaaatccagttcacagtgta

SEQ ID NO: 189534 - DNA, 25 bp, Mus musculus
agaggaaacgatcctggggcagagt

SEQ ID NO: 189535 - DNA, 25 bp, Mus musculus
agaggaaaggagttctctgaacgag

SEQ ID NO: 189536 - DNA, 25 bp, Mus musculus
agaggaaatcagtgttgaagatgaa

SEQ ID NO: 189537 - DNA, 25 bp, Mus musculus
agaggaaatccaacagcttcccctt

SEQ ID NO: 189538 - DNA, 25 bp, Mus musculus
agaggaaatggagcctgtgaccttt

SEQ ID NO: 189539 - DNA, 25 bp, Mus musculus
agaggaaattacacctgctcctgag

SEQ ID NO: 189540 - DNA, 25 bp, Mus musculus
agaggaaattgatgagctccttcag

SEQ ID NO: 189541 - DNA, 25 bp, Mus musculus
agaggaacaggatctcatcatgttc

SEQ ID NO: 189542 - DNA, 25 bp, Mus musculus
agaggaacatgcagaggcacggact

SEQ ID NO: 189543 - DNA, 25 bp, Mus musculus
agaggaacatgggatgtgaagtgtt

SEQ ID NO: 189544 - DNA, 25 bp, Mus musculus
agaggaacattgtaaattcaagatg

SEQ ID NO: 189545 - DNA, 25 bp, Mus musculus
agaggaacgagtgtggccagacgcc

SEQ ID NO: 189546 - DNA, 25 bp, Mus musculus
agaggaactatcggctctttctaca

SEQ ID NO: 189547 - DNA, 25 bp, Mus musculus
agaggaactatcgtcttgaagaacc

SEQ ID NO: 189548 - DNA, 25 bp, Mus musculus
agaggaacttggagggccatggcgg

SEQ ID NO: 189549 - DNA, 25 bp, Mus musculus
agaggaagaagagtcaagcgaaggc

SEQ ID NO: 189550 - DNA, 25 bp, Mus musculus
agaggaagaagcgacttgaagagat

SEQ ID NO: 189551 - DNA, 25 bp, Mus musculus
agaggaagaaggaggttccattttg

SEQ ID NO: 189552 - DNA, 25 bp, Mus musculus
agaggaagaagtctgttcccagttc

SEQ ID NO: 189553 - DNA, 25 bp, Mus musculus
agaggaagacaggagtctgcggtgt

SEQ ID NO: 189554 - DNA, 25 bp, Mus musculus
agaggaagactctgcagcttcaacc

SEQ ID NO: 189555 - DNA, 25 bp, Mus musculus
agaggaagagatcaagcacttcctg

SEQ ID NO: 189556 - DNA, 25 bp, Mus musculus
agaggaagaggatacagtcatcaca

SEQ ID NO: 189557 - DNA, 25 bp, Mus musculus
agaggaagatgacagcctgtttgag

SEQ ID NO: 189558 - DNA, 25 bp, Mus musculus
agaggaagatggaggttccattttg

SEQ ID NO: 189559 - DNA, 25 bp, Mus musculus
agaggaagcactggaggaggcagat

SEQ ID NO: 189560 - DNA, 25 bp, Mus musculus
agaggaagcactggcaaggggacca

SEQ ID NO: 189561 - DNA, 25 bp, Mus musculus
agaggaaggaagaggtttatgggac

SEQ ID NO: 189562 - DNA, 25 bp, Mus musculus
agaggaagtagacaatcctcctgat

SEQ ID NO: 189563 - DNA, 25 bp, Mus musculus
agaggaagtgctggaaagcacagaa

SEQ ID NO: 189564 - DNA, 25 bp, Mus musculus
agaggaagtgctggttcctacagca

SEQ ID NO: 189565 - DNA, 25 bp, Mus musculus
agaggaatcagaatcagactggatc

SEQ ID NO: 189566 - DNA, 25 bp, Mus musculus
agaggaatcagttcacagcgctgtg

SEQ ID NO: 189567 - DNA, 25 bp, Mus musculus
agaggaatccaacctcagtgcagaa

SEQ ID NO: 189568 - DNA, 25 bp, Mus musculus
agaggaatggagaacatcccaaccc

SEQ ID NO: 189569 - DNA, 25 bp, Mus musculus
agaggaatggaggtggacattgcat

SEQ ID NO: 189570 - DNA, 25 bp, Mus musculus
agaggaatggcgtactcagttcgtg

SEQ ID NO: 189571 - DNA, 25 bp, Mus musculus
agaggaattttatgctcgacgccaa

SEQ ID NO: 189572 - DNA, 25 bp, Mus musculus
agaggacaaaccaaggctcatctgc

SEQ ID NO: 189573 - DNA, 25 bp, Mus musculus
agaggacaagaaggcacatgcaact

SEQ ID NO: 189574 - DNA, 25 bp, Mus musculus
agaggacaccaagggtccaccaaca

SEQ ID NO: 189575 - DNA, 25 bp, Mus musculus
agaggacacccaaggatgtgaatga

SEQ ID NO: 189576 - DNA, 25 bp, Mus musculus
agaggacagaaagctttttaccttt

SEQ ID NO: 189577 - DNA, 25 bp, Mus musculus
agaggacagaagagtgtgtttgaca

SEQ ID NO: 189578 - DNA, 25 bp, Mus musculus
agaggacatcgatccctttgacgtg

SEQ ID NO: 189579 - DNA, 25 bp, Mus musculus
agaggacatgtcgtccctaatgtgg

SEQ ID NO: 189580 - DNA, 25 bp, Mus musculus
agaggacatgtcgtgtttctttcag

SEQ ID NO: 189581 - DNA, 25 bp, Mus musculus
agaggacattcaaagtaccattact

SEQ ID NO: 189582 - DNA, 25 bp, Mus musculus
agaggacattcgccaatggcagtgc

SEQ ID NO: 189583 - DNA, 25 bp, Mus musculus
agaggacattcgtctgtattcatgc

SEQ ID NO: 189584 - DNA, 25 bp, Mus musculus
agaggaccaaggaagccgtgaaggc

SEQ ID NO: 189585 - DNA, 25 bp, Mus musculus
agaggacccacagcgacccatacgt

SEQ ID NO: 189586 - DNA, 25 bp, Mus musculus
agaggaccccgggttccagtgacag

SEQ ID NO: 189587 - DNA, 25 bp, Mus musculus
agaggacccgcaaggttaataactt

SEQ ID NO: 189588 - DNA, 25 bp, Mus musculus
agaggaccgaggatccagatcgagg

SEQ ID NO: 189589 - DNA, 25 bp, Mus musculus
agaggaccgaggcgttatcgaactc

SEQ ID NO: 189590 - DNA, 25 bp, Mus musculus
agaggacctaaaggagacttgggag

SEQ ID NO: 189591 - DNA, 25 bp, Mus musculus
agaggacctccaagacagggttttt

SEQ ID NO: 189592 - DNA, 25 bp, Mus musculus
agaggacctccaagcgctcatcgac

SEQ ID NO: 189593 - DNA, 25 bp, Mus musculus
agaggaccttcggggctgggcttca

SEQ ID NO: 189594 - DNA, 25 bp, Mus musculus
agaggaccttcgggtaaatggccaa

SEQ ID NO: 189595 - DNA, 25 bp, Mus musculus
agaggacgactggcgaagcagtgcc

SEQ ID NO: 189596 - DNA, 25 bp, Mus musculus
agaggacgcagagcttgttgatgtt

SEQ ID NO: 189597 - DNA, 25 bp, Mus musculus
agaggactaacactgtgtccgtgcg

SEQ ID NO: 189598 - DNA, 25 bp, Mus musculus
agaggactgggccccacaggatcgc

SEQ ID NO: 189599 - DNA, 25 bp, Mus musculus
agaggactgttatgaaagagaagat

SEQ ID NO: 189600 - DNA, 25 bp, Mus musculus
agaggacttctcaagatgaggttcc

SEQ ID NO: 189601 - DNA, 25 bp, Mus musculus
agaggacttctcaaggaatctgaat

SEQ ID NO: 189602 - DNA, 25 bp, Mus musculus
agaggacttctcaagtctattgcat

SEQ ID NO: 189603 - DNA, 25 bp, Mus musculus
agaggagaaaacgatgggatattca

SEQ ID NO: 189604 - DNA, 25 bp, Mus musculus
agaggagaaaacggcacacatgttg

SEQ ID NO: 189605 - DNA, 25 bp, Mus musculus
agaggagaaagaacgtttgctgaag

SEQ ID NO: 189606 - DNA, 25 bp, Mus musculus
agaggagaaagagatgaaaccggct

SEQ ID NO: 189607 - DNA, 25 bp, Mus musculus
agaggagaaagaggacagagctgct

SEQ ID NO: 189608 - DNA, 25 bp, Mus musculus
agaggagaaagggaagaaggcagag

SEQ ID NO: 189609 - DNA, 25 bp, Mus musculus
agaggagaaattgtgaaaatgtcca

SEQ ID NO: 189610 - DNA, 25 bp, Mus musculus
agaggagaacagtgccaggtcacca

SEQ ID NO: 189611 - DNA, 25 bp, Mus musculus
agaggagaaccgggtgagccctatt

SEQ ID NO: 189612 - DNA, 25 bp, Mus musculus
agaggagaacgcggtgtgtgagtca

SEQ ID NO: 189613 - DNA, 25 bp, Mus musculus
agaggagaagagcagccagcaccca

SEQ ID NO: 189614 - DNA, 25 bp, Mus musculus
agaggagaagagggtccacctggca

SEQ ID NO: 189615 - DNA, 25 bp, Mus musculus
agaggagacagaggtattgacctca

SEQ ID NO: 189616 - DNA, 25 bp, Mus musculus
agaggagacgaaacagcttggattc

SEQ ID NO: 189617 - DNA, 25 bp, Mus musculus
agaggagagaaaagggagctgtgat

SEQ ID NO: 189618 - DNA, 25 bp, Mus musculus
agaggagagaagcagaaaaaaaaat

SEQ ID NO: 189619 - DNA, 25 bp, Mus musculus
agaggagagagagagagagagagag

SEQ ID NO: 189620 - DNA, 25 bp, Mus musculus
agaggagagccaggttctcgaggcc

SEQ ID NO: 189621 - DNA, 25 bp, Mus musculus
agaggagaggctggtgcacaaggtc

SEQ ID NO: 189622 - DNA, 25 bp, Mus musculus
agaggagaggtgtgaaggcatttgt

SEQ ID NO: 189623 - DNA, 25 bp, Mus musculus
agaggagagtcacagctaaagaacg

SEQ ID NO: 189624 - DNA, 25 bp, Mus musculus
agaggagataaagggcagtcattca

SEQ ID NO: 189625 - DNA, 25 bp, Mus musculus
agaggagataaaggggagatccctg

SEQ ID NO: 189626 - DNA, 25 bp, Mus musculus
agaggagatgcggtggacaccaaag

SEQ ID NO: 189627 - DNA, 25 bp, Mus musculus
agaggagatgcggtggtggtacgcc

SEQ ID NO: 189628 - DNA, 25 bp, Mus musculus
agaggagatgggtggtggaagatac

SEQ ID NO: 189629 - DNA, 25 bp, Mus musculus
agaggagcaacagcggcaacctttg

SEQ ID NO: 189630 - DNA, 25 bp, Mus musculus
agaggagcaagatatctgttgcttc

SEQ ID NO: 189631 - DNA, 25 bp, Mus musculus
agaggagcacaggaccatcagaatc

SEQ ID NO: 189632 - DNA, 25 bp, Mus musculus
agaggagcagggcttctattttgat

SEQ ID NO: 189633 - DNA, 25 bp, Mus musculus
agaggagcagtaaaagctggcaggc

SEQ ID NO: 189634 - DNA, 25 bp, Mus musculus
agaggagcagtgaaatatttcagcg

SEQ ID NO: 189635 - DNA, 25 bp, Mus musculus
agaggagcagtgaggtaatgacaga

SEQ ID NO: 189636 - DNA, 25 bp, Mus musculus
agaggagccatgaatgtatcattga

SEQ ID NO: 189637 - DNA, 25 bp, Mus musculus
agaggagcctcgagcatttagctcc

SEQ ID NO: 189638 - DNA, 25 bp, Mus musculus
agaggagcctggccccttcatggct

SEQ ID NO: 189639 - DNA, 25 bp, Mus musculus
agaggagcctgtagaccaggatgga

SEQ ID NO: 189640 - DNA, 25 bp, Mus musculus
agaggagctgaaagcactgacacac

SEQ ID NO: 189641 - DNA, 25 bp, Mus musculus
agaggagctgaaagggactgccctg

SEQ ID NO: 189642 - DNA, 25 bp, Mus musculus
agaggagctggcactgcccttttta

SEQ ID NO: 189643 - DNA, 25 bp, Mus musculus
agaggaggacaaagaaatggtcctt

SEQ ID NO: 189644 - DNA, 25 bp, Mus musculus
agaggaggacgagcaagaggaggca

SEQ ID NO: 189645 - DNA, 25 bp, Mus musculus
agaggaggagatacttctgacactg

SEQ ID NO: 189646 - DNA, 25 bp, Mus musculus
agaggaggagctggagcgctcggaa

SEQ ID NO: 189647 - DNA, 25 bp, Mus musculus
agaggaggaggaaaagccgcacatg

SEQ ID NO: 189648 - DNA, 25 bp, Mus musculus
agaggaggaggaggaggagtaggag

SEQ ID NO: 189649 - DNA, 25 bp, Mus musculus
agaggaggaggaggctccgccccca

SEQ ID NO: 189650 - DNA, 25 bp, Mus musculus
agaggaggagggaaaaagagagaga

SEQ ID NO: 189651 - DNA, 25 bp, Mus musculus
agaggaggagggtccggaccgctgt

SEQ ID NO: 189652 - DNA, 25 bp, Mus musculus
agaggaggaggtcacgctcacgctg

SEQ ID NO: 189653 - DNA, 25 bp, Mus musculus
agaggaggagtattccaccaaagag

SEQ ID NO: 189654 - DNA, 25 bp, Mus musculus
agaggaggatgccctctgaagccaa

SEQ ID NO: 189655 - DNA, 25 bp, Mus musculus
agaggaggccacagcaggtttccac

SEQ ID NO: 189656 - DNA, 25 bp, Mus musculus
agaggaggcctcattgcatacatcc

SEQ ID NO: 189657 - DNA, 25 bp, Mus musculus
agaggaggcctcctcctggactgcc

SEQ ID NO: 189658 - DNA, 25 bp, Mus musculus
agaggagggcacagcatttgacatt

SEQ ID NO: 189659 - DNA, 25 bp, Mus musculus
agaggagggctcagatctggagctg

SEQ ID NO: 189660 - DNA, 25 bp, Mus musculus
agaggagggggcatgaatcctacaa

SEQ ID NO: 189661 - DNA, 25 bp, Mus musculus
agaggaggggttatcatgcttttgg

SEQ ID NO: 189662 - DNA, 25 bp, Mus musculus
agaggagtaagctggatggtccacc

SEQ ID NO: 189663 - DNA, 25 bp, Mus musculus
agaggagtgcaaaggcaagcagaag

SEQ ID NO: 189664 - DNA, 25 bp, Mus musculus
agaggagtgtgaggaggtaaatgaa

SEQ ID NO: 189665 - DNA, 25 bp, Mus musculus
agaggagtgtgagggaggagatagg

SEQ ID NO: 189666 - DNA, 25 bp, Mus musculus
agaggagtgttgagagtcctttgct

SEQ ID NO: 189667 - DNA, 25 bp, Mus musculus
agaggagttaatcttgtctcctcga

SEQ ID NO: 189668 - DNA, 25 bp, Mus musculus
agaggagttaatcttgtctcttctc

SEQ ID NO: 189669 - DNA, 25 bp, Mus musculus
agaggagttaatcttgtttgagtct

SEQ ID NO: 189670 - DNA, 25 bp, Mus musculus
agaggagttggaaaatcttcaagct

SEQ ID NO: 189671 - DNA, 25 bp, Mus musculus
agaggataaattaggaatccccact

SEQ ID NO: 189672 - DNA, 25 bp, Mus musculus
agaggataagtactctcagaaggaa

SEQ ID NO: 189673 - DNA, 25 bp, Mus musculus
agaggatagaaagagctcagcagtc

SEQ ID NO: 189674 - DNA, 25 bp, Mus musculus
agaggatagtgaagatgaagatgat

SEQ ID NO: 189675 - DNA, 25 bp, Mus musculus
agaggatcacaagctgaagattcca

SEQ ID NO: 189676 - DNA, 25 bp, Mus musculus
agaggatcatcagtttgttttcttt

SEQ ID NO: 189677 - DNA, 25 bp, Mus musculus
agaggatcatgacagaattccagag

SEQ ID NO: 189678 - DNA, 25 bp, Mus musculus
agaggatccaacaggtgtgggcccc

SEQ ID NO: 189679 - DNA, 25 bp, Mus musculus
agaggatccagcaaccagacctcat

SEQ ID NO: 189680 - DNA, 25 bp, Mus musculus
agaggatccaggagctcgaacagtc

SEQ ID NO: 189681 - DNA, 25 bp, Mus musculus
agaggatcctgccagaggaagcccg

SEQ ID NO: 189682 - DNA, 25 bp, Mus musculus
agaggatcgaagcggccttgggatg

SEQ ID NO: 189683 - DNA, 25 bp, Mus musculus
agaggatctcagttcacatatggag

SEQ ID NO: 189684 - DNA, 25 bp, Mus musculus
agaggatctctgggtctgaaaagga

SEQ ID NO: 189685 - DNA, 25 bp, Mus musculus
agaggatgaagtgaaacgcttcgtt

SEQ ID NO: 189686 - DNA, 25 bp, Mus musculus
agaggatgagatcgactggggtgac

SEQ ID NO: 189687 - DNA, 25 bp, Mus musculus
agaggatgaggaagccatggcagaa

SEQ ID NO: 189688 - DNA, 25 bp, Mus musculus
agaggatgaggagaacaacgagaac

SEQ ID NO: 189689 - DNA, 25 bp, Mus musculus
agaggatgatattgggtttgatctg

SEQ ID NO: 189690 - DNA, 25 bp, Mus musculus
agaggatgctgagagtccatgccaa

SEQ ID NO: 189691 - DNA, 25 bp, Mus musculus
agaggatgctggctttttcacttga

SEQ ID NO: 189692 - DNA, 25 bp, Mus musculus
agaggatggctccccttccaatgag

SEQ ID NO: 189693 - DNA, 25 bp, Mus musculus
agaggatggctgttttaaaatcagt

SEQ ID NO: 189694 - DNA, 25 bp, Mus musculus
agaggattcacacagattctggaac

SEQ ID NO: 189695 - DNA, 25 bp, Mus musculus
agaggattcccaagccatgtattct

SEQ ID NO: 189696 - DNA, 25 bp, Mus musculus
agaggattgcgaggatcgccacgac

SEQ ID NO: 189697 - DNA, 25 bp, Mus musculus
agaggatttccccagccagatcttc

SEQ ID NO: 189698 - DNA, 25 bp, Mus musculus
agaggattttaaagacggctatgga

SEQ ID NO: 189699 - DNA, 25 bp, Mus musculus
agaggattttaaagagtattcaaat

SEQ ID NO: 189700 - DNA, 25 bp, Mus musculus
agaggcaaacagtggctctgaagcg

SEQ ID NO: 189701 - DNA, 25 bp, Mus musculus
agaggcaaagctgaccagaaggaaa

SEQ ID NO: 189702 - DNA, 25 bp, Mus musculus
agaggcaagacatgtaccagtgctt

SEQ ID NO: 189703 - DNA, 25 bp, Mus musculus
agaggcaagctgagtcaaagcagca

SEQ ID NO: 189704 - DNA, 25 bp, Mus musculus
agaggcacagagaaagaatcatagc

SEQ ID NO: 189705 - DNA, 25 bp, Mus musculus
agaggcacagagatcaaaggcacag

SEQ ID NO: 189706 - DNA, 25 bp, Mus musculus
agaggcacagatcttagatgagttt

SEQ ID NO: 189707 - DNA, 25 bp, Mus musculus
agaggcacaggctcgaagcaccaac

SEQ ID NO: 189708 - DNA, 25 bp, Mus musculus
agaggcaccgaagagagtgtgaaca

SEQ ID NO: 189709 - DNA, 25 bp, Mus musculus
agaggcaccgcgatgtgctggctgc

SEQ ID NO: 189710 - DNA, 25 bp, Mus musculus
agaggcaccgcggaccgtctgggca

SEQ ID NO: 189711 - DNA, 25 bp, Mus musculus
agaggcagaagaacctgtgctggct

SEQ ID NO: 189712 - DNA, 25 bp, Mus musculus
agaggcagacctaacgattcaggcc

SEQ ID NO: 189713 - DNA, 25 bp, Mus musculus
agaggcagacctaaggattcaggcc

SEQ ID NO: 189714 - DNA, 25 bp, Mus musculus
agaggcagactggtgccctgggaca

SEQ ID NO: 189715 - DNA, 25 bp, Mus musculus
agaggcagagatggacttcctgagg

SEQ ID NO: 189716 - DNA, 25 bp, Mus musculus
agaggcagagcaggtgacggtgtgg

SEQ ID NO: 189717 - DNA, 25 bp, Mus musculus
agaggcagagccccactccacagcg

SEQ ID NO: 189718 - DNA, 25 bp, Mus musculus
agaggcagaggaacgggtttccgct

SEQ ID NO: 189719 - DNA, 25 bp, Mus musculus
agaggcagagggtgctctggcctct

SEQ ID NO: 189720 - DNA, 25 bp, Mus musculus
agaggcagataaagataatggaggt

SEQ ID NO: 189721 - DNA, 25 bp, Mus musculus
agaggcagatcagcagggatggcaa

SEQ ID NO: 189722 - DNA, 25 bp, Mus musculus
agaggcagcagagaaccatgtgtgc

SEQ ID NO: 189723 - DNA, 25 bp, Mus musculus
agaggcagccaggagcccttgaacc

SEQ ID NO: 189724 - DNA, 25 bp, Mus musculus
agaggcagggtgctgaggggtggtc

SEQ ID NO: 189725 - DNA, 25 bp, Mus musculus
agaggcaggtccaaggcttgagatt

SEQ ID NO: 189726 - DNA, 25 bp, Mus musculus
agaggcagtttgaggagtgcatttc

SEQ ID NO: 189727 - DNA, 25 bp, Mus musculus
agaggcatcaagagtcattcccgag

SEQ ID NO: 189728 - DNA, 25 bp, Mus musculus
agaggcatgttggagcctgctatgg

SEQ ID NO: 189729 - DNA, 25 bp, Mus musculus
agaggcatgttggagcttcaaggag

SEQ ID NO: 189730 - DNA, 25 bp, Mus musculus
agaggcatgttggaggtaataaagc

SEQ ID NO: 189731 - DNA, 25 bp, Mus musculus
agaggcatttagagagacactgtac

SEQ ID NO: 189732 - DNA, 25 bp, Mus musculus
agaggccaaaggaaatttgtgagaa

SEQ ID NO: 189733 - DNA, 25 bp, Mus musculus
agaggccaaagtaacctcaggcttg

SEQ ID NO: 189734 - DNA, 25 bp, Mus musculus
agaggccagaagacaccagtgcaag

SEQ ID NO: 189735 - DNA, 25 bp, Mus musculus
agaggccagacctcgggacagattg

SEQ ID NO: 189736 - DNA, 25 bp, Mus musculus
agaggccagatgagctcctcttgcg

SEQ ID NO: 189737 - DNA, 25 bp, Mus musculus
agaggccagcagcagaatcggaaga

SEQ ID NO: 189738 - DNA, 25 bp, Mus musculus
agaggccagccatagctcttggatg

SEQ ID NO: 189739 - DNA, 25 bp, Mus musculus
agaggcccaggacagctggatcgcc

SEQ ID NO: 189740 - DNA, 25 bp, Mus musculus
agaggcccaggcctctctttctgat

SEQ ID NO: 189741 - DNA, 25 bp, Mus musculus
agaggcccaggtgcgggcgagtcag

SEQ ID NO: 189742 - DNA, 25 bp, Mus musculus
agaggccctcgaatgtgccgttctc

SEQ ID NO: 189743 - DNA, 25 bp, Mus musculus
agaggccctggaagaagaaaggcaa

SEQ ID NO: 189744 - DNA, 25 bp, Mus musculus
agaggccgaaagtggggatgcaaac

SEQ ID NO: 189745 - DNA, 25 bp, Mus musculus
agaggccgaagcccccagttgtacc

SEQ ID NO: 189746 - DNA, 25 bp, Mus musculus
agaggccgaatccctttctaaataa

SEQ ID NO: 189747 - DNA, 25 bp, Mus musculus
agaggccggagacagtataacaaac

SEQ ID NO: 189748 - DNA, 25 bp, Mus musculus
agaggccgtgcggagctcttggatg

SEQ ID NO: 189749 - DNA, 25 bp, Mus musculus
agaggcctcactagggcagggcctg

SEQ ID NO: 189750 - DNA, 25 bp, Mus musculus
agaggcctccagcagataagagtaa

SEQ ID NO: 189751 - DNA, 25 bp, Mus musculus
agaggcctccagcaggggctggatt

SEQ ID NO: 189752 - DNA, 25 bp, Mus musculus
agaggcctgggaggcccggcacaag

SEQ ID NO: 189753 - DNA, 25 bp, Mus musculus
agaggccttcagccacatcccagag

SEQ ID NO: 189754 - DNA, 25 bp, Mus musculus
agaggccttcagccggtttcaccgc

SEQ ID NO: 189755 - DNA, 25 bp, Mus musculus
agaggccttggaaggaggtgggcct

SEQ ID NO: 189756 - DNA, 25 bp, Mus musculus
agaggcctttcagcttcaagaaaag

SEQ ID NO: 189757 - DNA, 25 bp, Mus musculus
agaggcctttcaggtctgcctcggc

SEQ ID NO: 189758 - DNA, 25 bp, Mus musculus
agaggcgcagcccgggtgcaattaa

SEQ ID NO: 189759 - DNA, 25 bp, Mus musculus
agaggcgcaggcggaggtcagacct

SEQ ID NO: 189760 - DNA, 25 bp, Mus musculus
agaggcgcgaggccgcaaaacggga

SEQ ID NO: 189761 - DNA, 25 bp, Mus musculus
agaggcggaccaagcacagcctcct

SEQ ID NO: 189762 - DNA, 25 bp, Mus musculus
agaggcggacccaccctcagcgcca

SEQ ID NO: 189763 - DNA, 25 bp, Mus musculus
agaggcggatctgggtacgcgtcta

SEQ ID NO: 189764 - DNA, 25 bp, Mus musculus
agaggcggattgcggccaagatcgc

SEQ ID NO: 189765 - DNA, 25 bp, Mus musculus
agaggcggcgccacgagctggtgat

SEQ ID NO: 189766 - DNA, 25 bp, Mus musculus
agaggcggctcaggtgttatagact

SEQ ID NO: 189767 - DNA, 25 bp, Mus musculus
agaggcggctcaggtttctcccatt

SEQ ID NO: 189768 - DNA, 25 bp, Mus musculus
agaggcggctggcagaacttgatca

SEQ ID NO: 189769 - DNA, 25 bp, Mus musculus
agaggcggctggcagctgcagaaga

SEQ ID NO: 189770 - DNA, 25 bp, Mus musculus
agaggcggtttcaggacaatctctc

SEQ ID NO: 189771 - DNA, 25 bp, Mus musculus
agaggcgtaacgtgatgtcctcttc

SEQ ID NO: 189772 - DNA, 25 bp, Mus musculus
agaggcgtctaaagccattgaaaag

SEQ ID NO: 189773 - DNA, 25 bp, Mus musculus
agaggcgtctaaagccgccctcacc

SEQ ID NO: 189774 - DNA, 25 bp, Mus musculus
agaggcgtgatcagaggtcaacagt

SEQ ID NO: 189775 - DNA, 25 bp, Mus musculus
agaggcgtgatcaggggttcttatt

SEQ ID NO: 189776 - DNA, 25 bp, Mus musculus
agaggcgtgcagatccaagcaagct

SEQ ID NO: 189777 - DNA, 25 bp, Mus musculus
agaggcgttcaagttaattatgacc

SEQ ID NO: 189778 - DNA, 25 bp, Mus musculus
agaggcgttcaagttaattctgtca

SEQ ID NO: 189779 - DNA, 25 bp, Mus musculus
agaggctacagtctgcctttcagtc

SEQ ID NO: 189780 - DNA, 25 bp, Mus musculus
agaggctagtgggtcatcttggaag

SEQ ID NO: 189781 - DNA, 25 bp, Mus musculus
agaggctagtggttacttacacatt

SEQ ID NO: 189782 - DNA, 25 bp, Mus musculus
agaggctagtggttacttacagttt

SEQ ID NO: 189783 - DNA, 25 bp, Mus musculus
agaggctatggaattggaagcctgc

SEQ ID NO: 189784 - DNA, 25 bp, Mus musculus
agaggctcagcaggaaacaaggacc

SEQ ID NO: 189785 - DNA, 25 bp, Mus musculus
agaggctcagcagggtgctacagtg

SEQ ID NO: 189786 - DNA, 25 bp, Mus musculus
agaggctcaggcagaagatcctgaa

SEQ ID NO: 189787 - DNA, 25 bp, Mus musculus
agaggctcagggtccggaccgctgt

SEQ ID NO: 189788 - DNA, 25 bp, Mus musculus
agaggctcctgaggaagaagctgag

SEQ ID NO: 189789 - DNA, 25 bp, Mus musculus
agaggctctcgagagaagcgagaga

SEQ ID NO: 189790 - DNA, 25 bp, Mus musculus
agaggctctgcagactgcacagaag

SEQ ID NO: 189791 - DNA, 25 bp, Mus musculus
agaggctctgcagcatctcagctgc

SEQ ID NO: 189792 - DNA, 25 bp, Mus musculus
agaggctctgcagcctgaagaacag

SEQ ID NO: 189793 - DNA, 25 bp, Mus musculus
agaggctgaatcagctcaaatctaa

SEQ ID NO: 189794 - DNA, 25 bp, Mus musculus
agaggctgaatgggagccatcgaga

SEQ ID NO: 189795 - DNA, 25 bp, Mus musculus
agaggctgacaaggacacctgcttt

SEQ ID NO: 189796 - DNA, 25 bp, Mus musculus
agaggctgacaaggctacagcggag

SEQ ID NO: 189797 - DNA, 25 bp, Mus musculus
agaggctgacaggcggaacttgcca

SEQ ID NO: 189798 - DNA, 25 bp, Mus musculus
agaggctgactgggtttaccagccc

SEQ ID NO: 189799 - DNA, 25 bp, Mus musculus
agaggctgagaaaataatgttgagt

SEQ ID NO: 189800 - DNA, 25 bp, Mus musculus
agaggctgaggacaaatgagaagca

SEQ ID NO: 189801 - DNA, 25 bp, Mus musculus
agaggctgcaggctacagaacctga

SEQ ID NO: 189802 - DNA, 25 bp, Mus musculus
agaggctgggctggagaaagaggta

SEQ ID NO: 189803 - DNA, 25 bp, Mus musculus
agaggctgggtcgctaccaccagtg

SEQ ID NO: 189804 - DNA, 25 bp, Mus musculus
agaggctgtgggtctgcagctgtgt

SEQ ID NO: 189805 - DNA, 25 bp, Mus musculus
agaggcttccaaggctaaggtggca

SEQ ID NO: 189806 - DNA, 25 bp, Mus musculus
agaggcttccagatgggaaccaggg

SEQ ID NO: 189807 - DNA, 25 bp, Mus musculus
agaggcttccaggtcagaagccttt

SEQ ID NO: 189808 - DNA, 25 bp, Mus musculus
agaggcttcctgactttggcaccga

SEQ ID NO: 189809 - DNA, 25 bp, Mus musculus
agaggcttcctgtctttggcaccga

SEQ ID NO: 189810 - DNA, 25 bp, Mus musculus
agaggcttggttgggaagtggatta

SEQ ID NO: 189811 - DNA, 25 bp, Mus musculus
agaggcttgtccagggtatcttatt

SEQ ID NO: 189812 - DNA, 25 bp, Mus musculus
agaggctttgagtcgctgggtttac

SEQ ID NO: 189813 - DNA, 25 bp, Mus musculus
agagggaaaaatgccagatctctat

SEQ ID NO: 189814 - DNA, 25 bp, Mus musculus
agagggaaaggtctgaaaaggagcc

SEQ ID NO: 189815 - DNA, 25 bp, Mus musculus
agagggaactggtggaaactgaagt

SEQ ID NO: 189816 - DNA, 25 bp, Mus musculus
agagggacattgcacgtggtggtaa

SEQ ID NO: 189817 - DNA, 25 bp, Mus musculus
agagggaccgatgaatccttcacac

SEQ ID NO: 189818 - DNA, 25 bp, Mus musculus
agagggagagaatatgctggcttat

SEQ ID NO: 189819 - DNA, 25 bp, Mus musculus
agagggagatccacttaaatggatg

SEQ ID NO: 189820 - DNA, 25 bp, Mus musculus
agagggagcaggaacctgtcacagg

SEQ ID NO: 189821 - DNA, 25 bp, Mus musculus
agagggaggaccagcatttaagaag

SEQ ID NO: 189822 - DNA, 25 bp, Mus musculus
agagggaggaccaggagggcactcc

SEQ ID NO: 189823 - DNA, 25 bp, Mus musculus
agagggaggaggaacgctatcaagc

SEQ ID NO: 189824 - DNA, 25 bp, Mus musculus
agagggaggggctctgcctccttac

SEQ ID NO: 189825 - DNA, 25 bp, Mus musculus
agagggagtagaggaacattgacca

SEQ ID NO: 189826 - DNA, 25 bp, Mus musculus
agagggagtcggttctggccgagaa

SEQ ID NO: 189827 - DNA, 25 bp, Mus musculus
agagggataataaagaagaagtacc

SEQ ID NO: 189828 - DNA, 25 bp, Mus musculus
agagggataataaagatatccaatt

SEQ ID NO: 189829 - DNA, 25 bp, Mus musculus
agagggatatcaagtttgcttgtcg

SEQ ID NO: 189830 - DNA, 25 bp, Mus musculus
agagggatccttggatggtggcacc

SEQ ID NO: 189831 - DNA, 25 bp, Mus musculus
agagggatcggcattgcctgcaggt

SEQ ID NO: 189832 - DNA, 25 bp, Mus musculus
agagggatggatgtgattttttcag

SEQ ID NO: 189833 - DNA, 25 bp, Mus musculus
agagggatggcagaggagctggctt

SEQ ID NO: 189834 - DNA, 25 bp, Mus musculus
agagggatggcaggtagaagaggca

SEQ ID NO: 189835 - DNA, 25 bp, Mus musculus
agagggattcagcacccggagcgtg

SEQ ID NO: 189836 - DNA, 25 bp, Mus musculus
agagggattcaggggttccagtgtc

SEQ ID NO: 189837 - DNA, 25 bp, Mus musculus
agagggcaaatatggttatgtcctt

SEQ ID NO: 189838 - DNA, 25 bp, Mus musculus
agagggcagcggccgtctgggctga

SEQ ID NO: 189839 - DNA, 25 bp, Mus musculus
agagggcagcggttccttcctccac

SEQ ID NO: 189840 - DNA, 25 bp, Mus musculus
agagggcattgacctagagactgat

SEQ ID NO: 189841 - DNA, 25 bp, Mus musculus
agagggcgaatattcgcctcccacc

SEQ ID NO: 189842 - DNA, 25 bp, Mus musculus
agagggcgaattgtggagccccggg

SEQ ID NO: 189843 - DNA, 25 bp, Mus musculus
agagggcgaggcagaggtagaggtg

SEQ ID NO: 189844 - DNA, 25 bp, Mus musculus
agagggcggaaggccaccaggcctt

SEQ ID NO: 189845 - DNA, 25 bp, Mus musculus
agagggctagatgtggaagatgtga

SEQ ID NO: 189846 - DNA, 25 bp, Mus musculus
agagggctaggcctgcctgccccaa

SEQ ID NO: 189847 - DNA, 25 bp, Mus musculus
agagggctcaggtggtggagaaaaa

SEQ ID NO: 189848 - DNA, 25 bp, Mus musculus
agagggctgaagagaatatccggtc

SEQ ID NO: 189849 - DNA, 25 bp, Mus musculus
agagggctgaagagtgatgacatta

SEQ ID NO: 189850 - DNA, 25 bp, Mus musculus
agagggcttccaaaccctgctcaca

SEQ ID NO: 189851 - DNA, 25 bp, Mus musculus
agagggcttccaaagggtcctctgc

SEQ ID NO: 189852 - DNA, 25 bp, Mus musculus
agaggggaagcatccacaaactaaa

SEQ ID NO: 189853 - DNA, 25 bp, Mus musculus
agaggggagaccggtttccaaggca

SEQ ID NO: 189854 - DNA, 25 bp, Mus musculus
agaggggcaggagctccgggtcatt

SEQ ID NO: 189855 - DNA, 25 bp, Mus musculus
agaggggcaggtggcagctcagcag

SEQ ID NO: 189856 - DNA, 25 bp, Mus musculus
agaggggcatccagataagatctgt

SEQ ID NO: 189857 - DNA, 25 bp, Mus musculus
agaggggccggggcctgtgcaggtg

SEQ ID NO: 189858 - DNA, 25 bp, Mus musculus
agagggggaggaagaaattgtcact

SEQ ID NO: 189859 - DNA, 25 bp, Mus musculus
agagggggaggcatttgcaggccca

SEQ ID NO: 189860 - DNA, 25 bp, Mus musculus
agagggggatgaagtcattgagaag

SEQ ID NO: 189861 - DNA, 25 bp, Mus musculus
agagggtaaggatcctgtttgaaga

SEQ ID NO: 189862 - DNA, 25 bp, Mus musculus
agagggtcagagagatggcacatac

SEQ ID NO: 189863 - DNA, 25 bp, Mus musculus
agagggtcagttccaggaagacagc

SEQ ID NO: 189864 - DNA, 25 bp, Mus musculus
agagggtcattggaggccttgagaa

SEQ ID NO: 189865 - DNA, 25 bp, Mus musculus
agagggtcattggaggtgtccatca

SEQ ID NO: 189866 - DNA, 25 bp, Mus musculus
agagggtccctaagagctctcttcc

SEQ ID NO: 189867 - DNA, 25 bp, Mus musculus
agagggtccgagattgtctaaagcc

SEQ ID NO: 189868 - DNA, 25 bp, Mus musculus
agagggtgaagaaactgaaggctca

SEQ ID NO: 189869 - DNA, 25 bp, Mus musculus
agagggtgaagcaggagcttctgga

SEQ ID NO: 189870 - DNA, 25 bp, Mus musculus
agaggtaaaggtcgatcgcgatcgg

SEQ ID NO: 189871 - DNA, 25 bp, Mus musculus
agaggtaagcttgtctcctctctct

SEQ ID NO: 189872 - DNA, 25 bp, Mus musculus
agaggtaatgcctgtggtcgtcgta

SEQ ID NO: 189873 - DNA, 25 bp, Mus musculus
agaggtaggaagatgaggacctagt

SEQ ID NO: 189874 - DNA, 25 bp, Mus musculus
agaggtcaaagaggcgccagctgac

SEQ ID NO: 189875 - DNA, 25 bp, Mus musculus
agaggtcaaggccccacgcatgggc

SEQ ID NO: 189876 - DNA, 25 bp, Mus musculus
agaggtcaatgaggaagtaagtgca

SEQ ID NO: 189877 - DNA, 25 bp, Mus musculus
agaggtcaatgaggtggacatggaa

SEQ ID NO: 189878 - DNA, 25 bp, Mus musculus
agaggtcacaacttctcacacatag

SEQ ID NO: 189879 - DNA, 25 bp, Mus musculus
agaggtcagagacacctaccgctat

SEQ ID NO: 189880 - DNA, 25 bp, Mus musculus
agaggtcagaggatgcaaagaaggg

SEQ ID NO: 189881 - DNA, 25 bp, Mus musculus
agaggtcagaggctgtcaaaataca

SEQ ID NO: 189882 - DNA, 25 bp, Mus musculus
agaggtcaggaaagaatccaccttg

SEQ ID NO: 189883 - DNA, 25 bp, Mus musculus
agaggtcatctgagggaaagccacc

SEQ ID NO: 189884 - DNA, 25 bp, Mus musculus
agaggtccaagagaacagaaagagc

SEQ ID NO: 189885 - DNA, 25 bp, Mus musculus
agaggtccagacgtcgcctcatctc

SEQ ID NO: 189886 - DNA, 25 bp, Mus musculus
agaggtcggaggaggtgggcgttgg

SEQ ID NO: 189887 - DNA, 25 bp, Mus musculus
agaggtcggaggaggttgctgaacg

SEQ ID NO: 189888 - DNA, 25 bp, Mus musculus
agaggtcggcctcgatgtggaggcc

SEQ ID NO: 189889 - DNA, 25 bp, Mus musculus
agaggtcggcctcgcaatacttcgt

SEQ ID NO: 189890 - DNA, 25 bp, Mus musculus
agaggtctgctcagaaaaaactggc

SEQ ID NO: 189891 - DNA, 25 bp, Mus musculus
agaggtcttccagatcacagacctg

SEQ ID NO: 189892 - DNA, 25 bp, Mus musculus
agaggtcttggtccacagatgagca

SEQ ID NO: 189893 - DNA, 25 bp, Mus musculus
agaggtgaagcagaatgatatggaa

SEQ ID NO: 189894 - DNA, 25 bp, Mus musculus
agaggtgaagggaagacaaaggtca

SEQ ID NO: 189895 - DNA, 25 bp, Mus musculus
agaggtgacacgtttcatcacttca

SEQ ID NO: 189896 - DNA, 25 bp, Mus musculus
agaggtgacagatcccacaacgtct

SEQ ID NO: 189897 - DNA, 25 bp, Mus musculus
agaggtgacatttgaaaatgtcaag

SEQ ID NO: 189898 - DNA, 25 bp, Mus musculus
agaggtgaccagtgtgagaagaaac

SEQ ID NO: 189899 - DNA, 25 bp, Mus musculus
agaggtgactgcccctgtcttagga

SEQ ID NO: 189900 - DNA, 25 bp, Mus musculus
agaggtgagcacctgaagatggaaa

SEQ ID NO: 189901 - DNA, 25 bp, Mus musculus
agaggtgattgaggacgcctcatgc

SEQ ID NO: 189902 - DNA, 25 bp, Mus musculus
agaggtgcaccaaacaggaccagag

SEQ ID NO: 189903 - DNA, 25 bp, Mus musculus
agaggtgcaccaaacccagctgtgt

SEQ ID NO: 189904 - DNA, 25 bp, Mus musculus
agaggtgcaccaaacggttgcagac

SEQ ID NO: 189905 - DNA, 25 bp, Mus musculus
agaggtgcagaaggtttttcaagac

SEQ ID NO: 189906 - DNA, 25 bp, Mus musculus
agaggtgccagctacatcagaagat

SEQ ID NO: 189907 - DNA, 25 bp, Mus musculus
agaggtgccaggtatgcaaagtgca

SEQ ID NO: 189908 - DNA, 25 bp, Mus musculus
agaggtgccaggtctgcaaagtgca

SEQ ID NO: 189909 - DNA, 25 bp, Mus musculus
agaggtgccgagtaacttgtcgtaa

SEQ ID NO: 189910 - DNA, 25 bp, Mus musculus
agaggtgccgcaccatggccagccc

SEQ ID NO: 189911 - DNA, 25 bp, Mus musculus
agaggtgctgcccgagcacgcatgc

SEQ ID NO: 189912 - DNA, 25 bp, Mus musculus
agaggtgctgcccggaataacagaa

SEQ ID NO: 189913 - DNA, 25 bp, Mus musculus
agaggtggaaagctgctaacgaggc

SEQ ID NO: 189914 - DNA, 25 bp, Mus musculus
agaggtggagatcagcagagtggtt

SEQ ID NO: 189915 - DNA, 25 bp, Mus musculus
agaggtggaggatgacaaaatcccc

SEQ ID NO: 189916 - DNA, 25 bp, Mus musculus
agaggtggaggccccagtcaaaact

SEQ ID NO: 189917 - DNA, 25 bp, Mus musculus
agaggtggcaacgagtctccagtta

SEQ ID NO: 189918 - DNA, 25 bp, Mus musculus
agaggtggcacggaggcaagaagga

SEQ ID NO: 189919 - DNA, 25 bp, Mus musculus
agaggtgggccaaggattctcccag

SEQ ID NO: 189920 - DNA, 25 bp, Mus musculus
agaggtggtaaaagagaagtccaca

SEQ ID NO: 189921 - DNA, 25 bp, Mus musculus
agaggtggtcagtgctcaagaacct

SEQ ID NO: 189922 - DNA, 25 bp, Mus musculus
agaggtgtcacgacgaggaacaagg

SEQ ID NO: 189923 - DNA, 25 bp, Mus musculus
agaggtgtcccaggaagtcacccgg

SEQ ID NO: 189924 - DNA, 25 bp, Mus musculus
agaggtgtggacacgttggtcagac

SEQ ID NO: 189925 - DNA, 25 bp, Mus musculus
agaggttaaagataacagtggaata

SEQ ID NO: 189926 - DNA, 25 bp, Mus musculus
agaggttacttttgaggatgtcaag

SEQ ID NO: 189927 - DNA, 25 bp, Mus musculus
agaggttacttttggaaatacagtt

SEQ ID NO: 189928 - DNA, 25 bp, Mus musculus
agaggttcagaagggccagctgacg

SEQ ID NO: 189929 - DNA, 25 bp, Mus musculus
agaggttccacaacttagaaggctt

SEQ ID NO: 189930 - DNA, 25 bp, Mus musculus
agaggttccagatggagctgaaaga

SEQ ID NO: 189931 - DNA, 25 bp, Mus musculus
agaggttccagttaccagtaagatt

SEQ ID NO: 189932 - DNA, 25 bp, Mus musculus
agaggttccccagcagagatgaact

SEQ ID NO: 189933 - DNA, 25 bp, Mus musculus
agaggttccccagtcaatcgcaggc

SEQ ID NO: 189934 - DNA, 25 bp, Mus musculus
agaggttgaagagaactctgataag

SEQ ID NO: 189935 - DNA, 25 bp, Mus musculus
agaggttgaagagatgaaaagaaaa

SEQ ID NO: 189936 - DNA, 25 bp, Mus musculus
agaggttgaagagatttgacatcct

SEQ ID NO: 189937 - DNA, 25 bp, Mus musculus
agaggttgagaaaggaactcaacag

SEQ ID NO: 189938 - DNA, 25 bp, Mus musculus
agaggttgagacagcaacggtggac

SEQ ID NO: 189939 - DNA, 25 bp, Mus musculus
agaggtttcacagagatgctgatga

SEQ ID NO: 189940 - DNA, 25 bp, Mus musculus
agaggtttgagatggaagctctatc

SEQ ID NO: 189941 - DNA, 25 bp, Mus musculus
agaggtttggagaagcctgaaagga

SEQ ID NO: 189942 - DNA, 25 bp, Mus musculus
agagtaaaaaagaatgcactgctcc

SEQ ID NO: 189943 - DNA, 25 bp, Mus musculus
agagtaaaagtgaaatgactgttcc

SEQ ID NO: 189944 - DNA, 25 bp, Mus musculus
agagtaaacgcaggtgacctggcct

SEQ ID NO: 189945 - DNA, 25 bp, Mus musculus
agagtaaatggaaggttgcttttaa

SEQ ID NO: 189946 - DNA, 25 bp, Mus musculus
agagtaactagctttgcatcatgcc

SEQ ID NO: 189947 - DNA, 25 bp, Mus musculus
agagtaagacaaacccaggagatga

SEQ ID NO: 189948 - DNA, 25 bp, Mus musculus
agagtaagacaattgcgtgaagaat

SEQ ID NO: 189949 - DNA, 25 bp, Mus musculus
agagtaatgaggactctctgattct

SEQ ID NO: 189950 - DNA, 25 bp, Mus musculus
agagtacaaagctcccaggaggcaa

SEQ ID NO: 189951 - DNA, 25 bp, Mus musculus
agagtacaaaggcgtggtttctgtc

SEQ ID NO: 189952 - DNA, 25 bp, Mus musculus
agagtacaaggtggtaaatctgtac

SEQ ID NO: 189953 - DNA, 25 bp, Mus musculus
agagtacacaatgggtaccccaatg

SEQ ID NO: 189954 - DNA, 25 bp, Mus musculus
agagtacacagctccttccatccaa

SEQ ID NO: 189955 - DNA, 25 bp, Mus musculus
agagtacacaggtgtgtgccatccc

SEQ ID NO: 189956 - DNA, 25 bp, Mus musculus
agagtacagatatggagaaagagaa

SEQ ID NO: 189957 - DNA, 25 bp, Mus musculus
agagtacagcacaggctaaataaaa

SEQ ID NO: 189958 - DNA, 25 bp, Mus musculus
agagtacagcacaggttaccagtgc

SEQ ID NO: 189959 - DNA, 25 bp, Mus musculus
agagtacagcacaggttgctggttg

SEQ ID NO: 189960 - DNA, 25 bp, Mus musculus
agagtacaggtagggtttcgatgag

SEQ ID NO: 189961 - DNA, 25 bp, Mus musculus
agagtacatatgagtcgaacaccaa

SEQ ID NO: 189962 - DNA, 25 bp, Mus musculus
agagtacgacatggctgccagaaaa

SEQ ID NO: 189963 - DNA, 25 bp, Mus musculus
agagtacgggcgtcctagtgtgtca

SEQ ID NO: 189964 - DNA, 25 bp, Mus musculus
agagtactgcagaaatatgccgagc

SEQ ID NO: 189965 - DNA, 25 bp, Mus musculus
agagtactggcggtgtctctttgga

SEQ ID NO: 189966 - DNA, 25 bp, Mus musculus
agagtacttgagctaccaggagccc

SEQ ID NO: 189967 - DNA, 25 bp, Mus musculus
agagtacttgggaatcatgaccaac

SEQ ID NO: 189968 - DNA, 25 bp, Mus musculus
agagtacttgggagctaggagacca

SEQ ID NO: 189969 - DNA, 25 bp, Mus musculus
agagtagagaaaaggttttctgtcc

SEQ ID NO: 189970 - DNA, 25 bp, Mus musculus
agagtagctatggacgtggaggacc

SEQ ID NO: 189971 - DNA, 25 bp, Mus musculus
agagtaggaggtggtgcccatggta

SEQ ID NO: 189972 - DNA, 25 bp, Mus musculus
agagtatacaagattatcctgtcct

SEQ ID NO: 189973 - DNA, 25 bp, Mus musculus
agagtatacaaggtatcagtacttt

SEQ ID NO: 189974 - DNA, 25 bp, Mus musculus
agagtatacaggatcccaaactgtc

SEQ ID NO: 189975 - DNA, 25 bp, Mus musculus
agagtatacaggtctgtgagtttca

SEQ ID NO: 189976 - DNA, 25 bp, Mus musculus
agagtatagataaggtgaagaaact

SEQ ID NO: 189977 - DNA, 25 bp, Mus musculus
agagtatagataagtgtcatatttg

SEQ ID NO: 189978 - DNA, 25 bp, Mus musculus
agagtatatcgcggacctgtactcc

SEQ ID NO: 189979 - DNA, 25 bp, Mus musculus
agagtatcacaccatagatgaccac

SEQ ID NO: 189980 - DNA, 25 bp, Mus musculus
agagtatctaagagtgcttggctgt

SEQ ID NO: 189981 - DNA, 25 bp, Mus musculus
agagtatctttaccttctacttcca

SEQ ID NO: 189982 - DNA, 25 bp, Mus musculus
agagtatgagaaaataaaggactcc

SEQ ID NO: 189983 - DNA, 25 bp, Mus musculus
agagtatgagaacttctatgcggat

SEQ ID NO: 189984 - DNA, 25 bp, Mus musculus
agagtatgagaggctgttatgttta

SEQ ID NO: 189985 - DNA, 25 bp, Mus musculus
agagtatgaggaagaagattccaga

SEQ ID NO: 189986 - DNA, 25 bp, Mus musculus
agagtatgagtctcttcagcgtcaa

SEQ ID NO: 189987 - DNA, 25 bp, Mus musculus
agagtatgagtttctcctcatctat

SEQ ID NO: 189988 - DNA, 25 bp, Mus musculus
agagtatgcacagggtatccagaag

SEQ ID NO: 189989 - DNA, 25 bp, Mus musculus
agagtatgcagtccttcagctcact

SEQ ID NO: 189990 - DNA, 25 bp, Mus musculus
agagtatgtgtcttcaccctgctgc

SEQ ID NO: 189991 - DNA, 25 bp, Mus musculus
agagtattaaaaatgatacatccat

SEQ ID NO: 189992 - DNA, 25 bp, Mus musculus
agagtattaattacagttctccaag

SEQ ID NO: 189993 - DNA, 25 bp, Mus musculus
agagtattgtggaggaattaattcg

SEQ ID NO: 189994 - DNA, 25 bp, Mus musculus
agagtcaaaacagcagtgacagcag

SEQ ID NO: 189995 - DNA, 25 bp, Mus musculus
agagtcaaagatgttgatcctgtct

SEQ ID NO: 189996 - DNA, 25 bp, Mus musculus
agagtcaaagccagggtctcttgtg

SEQ ID NO: 189997 - DNA, 25 bp, Mus musculus
agagtcaaagccaggtgccagctgg

SEQ ID NO: 189998 - DNA, 25 bp, Mus musculus
agagtcaacaaggtcccagtgaaga

SEQ ID NO: 189999 - DNA, 25 bp, Mus musculus
agagtcaacaaggtgatcattggca

SEQ ID NO: 190000 - DNA, 25 bp, Mus musculus
agagtcaatttcaggaaaatctggg

SEQ ID NO: 190001 - DNA, 25 bp, Mus musculus
agagtcaatttcaggatactggctc

SEQ ID NO: 190002 - DNA, 25 bp, Mus musculus
agagtcaatttcaggggctctctaa

SEQ ID NO: 190003 - DNA, 25 bp, Mus musculus
agagtcacaccaagattgtttattt

SEQ ID NO: 190004 - DNA, 25 bp, Mus musculus
agagtcacaccaagcaaaacaattg

SEQ ID NO: 190005 - DNA, 25 bp, Mus musculus
agagtcacagaaatcactcaaggac

SEQ ID NO: 190006 - DNA, 25 bp, Mus musculus
agagtcacagctaaagaacgcttct

SEQ ID NO: 190007 - DNA, 25 bp, Mus musculus
agagtcaccaaatgaccccaagggt

SEQ ID NO: 190008 - DNA, 25 bp, Mus musculus
agagtcaccacactgctccgcagga

SEQ ID NO: 190009 - DNA, 25 bp, Mus musculus
agagtcacttgtgctgcttctcagg

SEQ ID NO: 190010 - DNA, 25 bp, Mus musculus
agagtcagaaaagttgtcctctcta

SEQ ID NO: 190011 - DNA, 25 bp, Mus musculus
agagtcagagcacaggctcagaaat

SEQ ID NO: 190012 - DNA, 25 bp, Mus musculus
agagtcagattacagatcccaggca

SEQ ID NO: 190013 - DNA, 25 bp, Mus musculus
agagtcaggaaaggaatcccaatct

SEQ ID NO: 190014 - DNA, 25 bp, Mus musculus
agagtcaggaaaggcacatgaatgc

SEQ ID NO: 190015 - DNA, 25 bp, Mus musculus
agagtcaggaaaggtgccctgggac

SEQ ID NO: 190016 - DNA, 25 bp, Mus musculus
agagtcatgagtcgaaggagtctct

SEQ ID NO: 190017 - DNA, 25 bp, Mus musculus
agagtcatgagtggaaggagtctct

SEQ ID NO: 190018 - DNA, 25 bp, Mus musculus
agagtcatgcccagcttcccatcat

SEQ ID NO: 190019 - DNA, 25 bp, Mus musculus
agagtcatgcccagggagtcccccc

SEQ ID NO: 190020 - DNA, 25 bp, Mus musculus
agagtcattgattaggttatacctg

SEQ ID NO: 190021 - DNA, 25 bp, Mus musculus
agagtcattgcaggcccggcacaag

SEQ ID NO: 190022 - DNA, 25 bp, Mus musculus
agagtccacaggcagatgaacacaa

SEQ ID NO: 190023 - DNA, 25 bp, Mus musculus
agagtccaccgatttactaaattat

SEQ ID NO: 190024 - DNA, 25 bp, Mus musculus
agagtccaccgttatatttcagagc

SEQ ID NO: 190025 - DNA, 25 bp, Mus musculus
agagtccacctgggatcatgggctc

SEQ ID NO: 190026 - DNA, 25 bp, Mus musculus
agagtccacgagaaatggaagattc

SEQ ID NO: 190027 - DNA, 25 bp, Mus musculus
agagtccacgatatgttttcttctc

SEQ ID NO: 190028 - DNA, 25 bp, Mus musculus
agagtccacggttttctctgtgtaa

SEQ ID NO: 190029 - DNA, 25 bp, Mus musculus
agagtccagcaagaggaccagagtt

SEQ ID NO: 190030 - DNA, 25 bp, Mus musculus
agagtccagtttgggaagaaaggtg

SEQ ID NO: 190031 - DNA, 25 bp, Mus musculus
agagtccagtttgggtgtctggaga

SEQ ID NO: 190032 - DNA, 25 bp, Mus musculus
agagtccatgagtttacaggaacag

SEQ ID NO: 190033 - DNA, 25 bp, Mus musculus
agagtcccagacaggcctcatggtt

SEQ ID NO: 190034 - DNA, 25 bp, Mus musculus
agagtcccagctgcctgctgaataa

SEQ ID NO: 190035 - DNA, 25 bp, Mus musculus
agagtcccagtgcaggatttactag

SEQ ID NO: 190036 - DNA, 25 bp, Mus musculus
agagtcccagtgcagggataacaac

SEQ ID NO: 190037 - DNA, 25 bp, Mus musculus
agagtcccgaaggggacagcttcgt

SEQ ID NO: 190038 - DNA, 25 bp, Mus musculus
agagtccgggagactcgatctgccc

SEQ ID NO: 190039 - DNA, 25 bp, Mus musculus
agagtccggggaaaacagtaagaag

SEQ ID NO: 190040 - DNA, 25 bp, Mus musculus
agagtcctcacacagtgtccaacct

SEQ ID NO: 190041 - DNA, 25 bp, Mus musculus
agagtcctcagaatggcaatgttcc

SEQ ID NO: 190042 - DNA, 25 bp, Mus musculus
agagtcctcaggcacctccaagtgg

SEQ ID NO: 190043 - DNA, 25 bp, Mus musculus
agagtcctcctccacctaaggtggt

SEQ ID NO: 190044 - DNA, 25 bp, Mus musculus
agagtccttcccaggagtacacggt

SEQ ID NO: 190045 - DNA, 25 bp, Mus musculus
agagtcggacaataataaaagacta

SEQ ID NO: 190046 - DNA, 25 bp, Mus musculus
agagtcggcctgcaggcctgtcgag

SEQ ID NO: 190047 - DNA, 25 bp, Mus musculus
agagtcggcctgcaggtgcggacct

SEQ ID NO: 190048 - DNA, 25 bp, Mus musculus
agagtcggcctgcagtttcaggcct

SEQ ID NO: 190049 - DNA, 25 bp, Mus musculus
agagtctaccatatttggtataagg

SEQ ID NO: 190050 - DNA, 25 bp, Mus musculus
agagtctcaaggctacatgtgagcg

SEQ ID NO: 190051 - DNA, 25 bp, Mus musculus
agagtctccgacgggcactatgaac

SEQ ID NO: 190052 - DNA, 25 bp, Mus musculus
agagtctgaggatcctaaacacttc

SEQ ID NO: 190053 - DNA, 25 bp, Mus musculus
agagtctgctcagggcggcttcatt

SEQ ID NO: 190054 - DNA, 25 bp, Mus musculus
agagtctggacaacatgtgcatcgt

SEQ ID NO: 190055 - DNA, 25 bp, Mus musculus
agagtctgtgctgcaggctgtgaca

SEQ ID NO: 190056 - DNA, 25 bp, Mus musculus
agagtcttctctggcttttctcatg

SEQ ID NO: 190057 - DNA, 25 bp, Mus musculus
agagtcttctctgtcacttgcctcg

SEQ ID NO: 190058 - DNA, 25 bp, Mus musculus
agagtgaaaacacttcagctaatga

SEQ ID NO: 190059 - DNA, 25 bp, Mus musculus
agagtgaagaagaactcctacctgg

SEQ ID NO: 190060 - DNA, 25 bp, Mus musculus
agagtgaagaagcgagatcatcagt

SEQ ID NO: 190061 - DNA, 25 bp, Mus musculus
agagtgaatatgttttgcattttct

SEQ ID NO: 190062 - DNA, 25 bp, Mus musculus
agagtgaatgaaggctttaacagaa

SEQ ID NO: 190063 - DNA, 25 bp, Mus musculus
agagtgaattagatataatgtttaa

SEQ ID NO: 190064 - DNA, 25 bp, Mus musculus
agagtgacatggaagctatggataa

SEQ ID NO: 190065 - DNA, 25 bp, Mus musculus
agagtgacatggccgcagccacgcc

SEQ ID NO: 190066 - DNA, 25 bp, Mus musculus
agagtgacatgtgcgaccaagacca

SEQ ID NO: 190067 - DNA, 25 bp, Mus musculus
agagtgaccagccgtgggaatggtg

SEQ ID NO: 190068 - DNA, 25 bp, Mus musculus
agagtgaccattgagcaagaactat

SEQ ID NO: 190069 - DNA, 25 bp, Mus musculus
agagtgaccattgaggttatctggc

SEQ ID NO: 190070 - DNA, 25 bp, Mus musculus
agagtgactcaggaagccataattt

SEQ ID NO: 190071 - DNA, 25 bp, Mus musculus
agagtgactgtatacgacatttcat

SEQ ID NO: 190072 - DNA, 25 bp, Mus musculus
agagtgagaaaggagacacggtctc

SEQ ID NO: 190073 - DNA, 25 bp, Mus musculus
agagtgagaacaggtcctatgaggg

SEQ ID NO: 190074 - DNA, 25 bp, Mus musculus
agagtgagaagcatttcttcacttc

SEQ ID NO: 190075 - DNA, 25 bp, Mus musculus
agagtgagaaggagttgatgtgccg

SEQ ID NO: 190076 - DNA, 25 bp, Mus musculus
agagtgagagaggcatgaaagtcat

SEQ ID NO: 190077 - DNA, 25 bp, Mus musculus
agagtgagagcaagagatacttcaa

SEQ ID NO: 190078 - DNA, 25 bp, Mus musculus
agagtgagatcatcatccaagtctg

SEQ ID NO: 190079 - DNA, 25 bp, Mus musculus
agagtgagcagccccacagtgaaca

SEQ ID NO: 190080 - DNA, 25 bp, Mus musculus
agagtgaggccacagtgtgtcagaa

SEQ ID NO: 190081 - DNA, 25 bp, Mus musculus
agagtgaggtgggccagacatcaga

SEQ ID NO: 190082 - DNA, 25 bp, Mus musculus
agagtgagtgccaaggttcatatgg

SEQ ID NO: 190083 - DNA, 25 bp, Mus musculus
agagtgatccagtctgttgtctact

SEQ ID NO: 190084 - DNA, 25 bp, Mus musculus
agagtgattgacagggagggtgtgt

SEQ ID NO: 190085 - DNA, 25 bp, Mus musculus
agagtgatttaaaggatgacgagaa

SEQ ID NO: 190086 - DNA, 25 bp, Mus musculus
agagtgcaagggtagctaagaaaaa

SEQ ID NO: 190087 - DNA, 25 bp, Mus musculus
agagtgcaaggtaaatctttatttt

SEQ ID NO: 190088 - DNA, 25 bp, Mus musculus
agagtgcaatccagcccttacagag

SEQ ID NO: 190089 - DNA, 25 bp, Mus musculus
agagtgcaatccaggtcctggaatc

SEQ ID NO: 190090 - DNA, 25 bp, Mus musculus
agagtgcaatgcaggacagtggtga

SEQ ID NO: 190091 - DNA, 25 bp, Mus musculus
agagtgcaatgcagtccgtggtgga

SEQ ID NO: 190092 - DNA, 25 bp, Mus musculus
agagtgcagagtaaatccctgtctc

SEQ ID NO: 190093 - DNA, 25 bp, Mus musculus
agagtgcagcattattgattgtggc

SEQ ID NO: 190094 - DNA, 25 bp, Mus musculus
agagtgcatcaaacaagttgatcaa

SEQ ID NO: 190095 - DNA, 25 bp, Mus musculus
agagtgcatcaaacagtatgaagaa

SEQ ID NO: 190096 - DNA, 25 bp, Mus musculus
agagtgccaatgaagaatctggtcc

SEQ ID NO: 190097 - DNA, 25 bp, Mus musculus
agagtgccacagctcctccctggcc

SEQ ID NO: 190098 - DNA, 25 bp, Mus musculus
agagtgccaggaaatagcctttaaa

SEQ ID NO: 190099 - DNA, 25 bp, Mus musculus
agagtgccaggctgaacctgtggcg

SEQ ID NO: 190100 - DNA, 25 bp, Mus musculus
agagtgccaggctttggggacttga

SEQ ID NO: 190101 - DNA, 25 bp, Mus musculus
agagtgctgcctgagccctaggacc

SEQ ID NO: 190102 - DNA, 25 bp, Mus musculus
agagtgctgcctgaggtagtgactg

SEQ ID NO: 190103 - DNA, 25 bp, Mus musculus
agagtgctggacaggccggggcccg

SEQ ID NO: 190104 - DNA, 25 bp, Mus musculus
agagtgctgggagccgacagggagt

SEQ ID NO: 190105 - DNA, 25 bp, Mus musculus
agagtgctgggagcctcttagctgc

SEQ ID NO: 190106 - DNA, 25 bp, Mus musculus
agagtgcttgttcaggtgtcctatg

SEQ ID NO: 190107 - DNA, 25 bp, Mus musculus
agagtggaacagatcgctgtagtgc

SEQ ID NO: 190108 - DNA, 25 bp, Mus musculus
agagtggaaggggttccatgatgga

SEQ ID NO: 190109 - DNA, 25 bp, Mus musculus
agagtggaagtgtgatcaggtgtaa

SEQ ID NO: 190110 - DNA, 25 bp, Mus musculus
agagtggaatgggatgagaaagatg

SEQ ID NO: 190111 - DNA, 25 bp, Mus musculus
agagtggaatggggatggcactgga

SEQ ID NO: 190112 - DNA, 25 bp, Mus musculus
agagtggaatggggcctagccgccc

SEQ ID NO: 190113 - DNA, 25 bp, Mus musculus
agagtggagaagagatgctggtccc

SEQ ID NO: 190114 - DNA, 25 bp, Mus musculus
agagtggagaagaggatgcccctgt

SEQ ID NO: 190115 - DNA, 25 bp, Mus musculus
agagtggcaccagtgggaggtctgg

SEQ ID NO: 190116 - DNA, 25 bp, Mus musculus
agagtggcagcacgatggtcctaca

SEQ ID NO: 190117 - DNA, 25 bp, Mus musculus
agagtggcaggaagaagtcccagac

SEQ ID NO: 190118 - DNA, 25 bp, Mus musculus
agagtggcatggaaggtgaaggaga

SEQ ID NO: 190119 - DNA, 25 bp, Mus musculus
agagtggcatgttcccaaatagctt

SEQ ID NO: 190120 - DNA, 25 bp, Mus musculus
agagtggcctcgcatggtcatggtc

SEQ ID NO: 190121 - DNA, 25 bp, Mus musculus
agagtggccttgaacaggacaggcc

SEQ ID NO: 190122 - DNA, 25 bp, Mus musculus
agagtggcggaacatgaagttcctt

SEQ ID NO: 190123 - DNA, 25 bp, Mus musculus
agagtggcggtcctggagtttgaac

SEQ ID NO: 190124 - DNA, 25 bp, Mus musculus
agagtgggaagaacttccattacat

SEQ ID NO: 190125 - DNA, 25 bp, Mus musculus
agagtgggtacagagtataaaggag

SEQ ID NO: 190126 - DNA, 25 bp, Mus musculus
agagtgggtaccaggcacaggctac

SEQ ID NO: 190127 - DNA, 25 bp, Mus musculus
agagtggtaaaaagagctgtaatag

SEQ ID NO: 190128 - DNA, 25 bp, Mus musculus
agagtgtaaattccccttttatgct

SEQ ID NO: 190129 - DNA, 25 bp, Mus musculus
agagtgtatgagggccagaacgtct

SEQ ID NO: 190130 - DNA, 25 bp, Mus musculus
agagtgtcaaaggatcaatgtgacc

SEQ ID NO: 190131 - DNA, 25 bp, Mus musculus
agagtgtcaaagtacttcaactcct

SEQ ID NO: 190132 - DNA, 25 bp, Mus musculus
agagtgtcagagaaggtctcccatg

SEQ ID NO: 190133 - DNA, 25 bp, Mus musculus
agagtgtcagccagggcggagctac

SEQ ID NO: 190134 - DNA, 25 bp, Mus musculus
agagtgtcctagaatcaataagctt

SEQ ID NO: 190135 - DNA, 25 bp, Mus musculus
agagtgtcttaggttcttgtagtgc

SEQ ID NO: 190136 - DNA, 25 bp, Mus musculus
agagtgtggaaacagaccacaggat

SEQ ID NO: 190137 - DNA, 25 bp, Mus musculus
agagtgtgtggaggagtgatgggca

SEQ ID NO: 190138 - DNA, 25 bp, Mus musculus
agagtgtgtgggaaagggccgatat

SEQ ID NO: 190139 - DNA, 25 bp, Mus musculus
agagtgtgtgtcgtgctggtctgtg

SEQ ID NO: 190140 - DNA, 25 bp, Mus musculus
agagtgtttgctcagtgctggcctt

SEQ ID NO: 190141 - DNA, 25 bp, Mus musculus
agagtgttttcagaatggcttcctt

SEQ ID NO: 190142 - DNA, 25 bp, Mus musculus
agagttaagggcacagagaactgaa

SEQ ID NO: 190143 - DNA, 25 bp, Mus musculus
agagttacaggaacgtcatccatgc

SEQ ID NO: 190144 - DNA, 25 bp, Mus musculus
agagttacaggggcccagactgatc

SEQ ID NO: 190145 - DNA, 25 bp, Mus musculus
agagttacagggtatttttcttact

SEQ ID NO: 190146 - DNA, 25 bp, Mus musculus
agagttaccgtaatggacggatctt

SEQ ID NO: 190147 - DNA, 25 bp, Mus musculus
agagttaggaaaggaaagcactgcc

SEQ ID NO: 190148 - DNA, 25 bp, Mus musculus
agagttagtggccagggttgaagac

SEQ ID NO: 190149 - DNA, 25 bp, Mus musculus
agagttataccaaattcttctggaa

SEQ ID NO: 190150 - DNA, 25 bp, Mus musculus
agagttataccaaattgaaaagata

SEQ ID NO: 190151 - DNA, 25 bp, Mus musculus
agagttatgatgaggccaagcacgt

SEQ ID NO: 190152 - DNA, 25 bp, Mus musculus
agagttattttggggaaggatattc

SEQ ID NO: 190153 - DNA, 25 bp, Mus musculus
agagttcaaaggcggcgagtccacg

SEQ ID NO: 190154 - DNA, 25 bp, Mus musculus
agagttcaaggggctgagatttatt

SEQ ID NO: 190155 - DNA, 25 bp, Mus musculus
agagttcagcagaggagacagcagt

SEQ ID NO: 190156 - DNA, 25 bp, Mus musculus
agagttcagtgacagattgctgttc

SEQ ID NO: 190157 - DNA, 25 bp, Mus musculus
agagttcatcacgactgtgcaacag

SEQ ID NO: 190158 - DNA, 25 bp, Mus musculus
agagttccacagaggttctatggta

SEQ ID NO: 190159 - DNA, 25 bp, Mus musculus
agagttccagaagaagaaataaagt

SEQ ID NO: 190160 - DNA, 25 bp, Mus musculus
agagttcccagatgaagaaactgaa

SEQ ID NO: 190161 - DNA, 25 bp, Mus musculus
agagttccctcctggccttcccaga

SEQ ID NO: 190162 - DNA, 25 bp, Mus musculus
agagttcccttctggccttcccaga

SEQ ID NO: 190163 - DNA, 25 bp, Mus musculus
agagttcgaattgctctggcgttaa

SEQ ID NO: 190164 - DNA, 25 bp, Mus musculus
agagttcgaattgttcactgaggaa

SEQ ID NO: 190165 - DNA, 25 bp, Mus musculus
agagttcgcaggagggcgaagagaa

SEQ ID NO: 190166 - DNA, 25 bp, Mus musculus
agagttctctagaaccaggcagcgg

SEQ ID NO: 190167 - DNA, 25 bp, Mus musculus
agagttctctctaaacctttgacat

SEQ ID NO: 190168 - DNA, 25 bp, Mus musculus
agagttctgactgcgacatttacat

SEQ ID NO: 190169 - DNA, 25 bp, Mus musculus
agagttctgactgcggttgaaatgg

SEQ ID NO: 190170 - DNA, 25 bp, Mus musculus
agagttgcagctaggacttctctca

SEQ ID NO: 190171 - DNA, 25 bp, Mus musculus
agagttgccggctgaatttgacaaa

SEQ ID NO: 190172 - DNA, 25 bp, Mus musculus
agagttgcctacatgtagctgagac

SEQ ID NO: 190173 - DNA, 25 bp, Mus musculus
agagttgcgagcgaatacaggagga

SEQ ID NO: 190174 - DNA, 25 bp, Mus musculus
agagttgcgaggccaggtggttgca

SEQ ID NO: 190175 - DNA, 25 bp, Mus musculus
agagttggaagcctcgtcttccctg

SEQ ID NO: 190176 - DNA, 25 bp, Mus musculus
agagttggaaggaaggcttgcaaag

SEQ ID NO: 190177 - DNA, 25 bp, Mus musculus
agagttggaagggagctagctcatg

SEQ ID NO: 190178 - DNA, 25 bp, Mus musculus
agagttggaaggtcatagaactctg

SEQ ID NO: 190179 - DNA, 25 bp, Mus musculus
agagttggaatcagggctacggcta

SEQ ID NO: 190180 - DNA, 25 bp, Mus musculus
agagttggcaggaatagtgggcagc

SEQ ID NO: 190181 - DNA, 25 bp, Mus musculus
agagttggtccatatatttcttctg

SEQ ID NO: 190182 - DNA, 25 bp, Mus musculus
agagttggtgaagaaacttgtggaa

SEQ ID NO: 190183 - DNA, 25 bp, Mus musculus
agagttggtgtggaggctcatctca

SEQ ID NO: 190184 - DNA, 25 bp, Mus musculus
agagttggtgtggaggggctcctct

SEQ ID NO: 190185 - DNA, 25 bp, Mus musculus
agagttgtgaggagatcccccaaga

SEQ ID NO: 190186 - DNA, 25 bp, Mus musculus
agagtttatggatccgcctccgact

SEQ ID NO: 190187 - DNA, 25 bp, Mus musculus
agagtttcaaggcaaacgaatgcac

SEQ ID NO: 190188 - DNA, 25 bp, Mus musculus
agagtttcaaggcaaacgaatgcat

SEQ ID NO: 190189 - DNA, 25 bp, Mus musculus
agagtttcaaggcagcagtgaatgc

SEQ ID NO: 190190 - DNA, 25 bp, Mus musculus
agagtttcaaggtgggatgtgtgtg

SEQ ID NO: 190191 - DNA, 25 bp, Mus musculus
agagtttcagatacaccaagtatca

SEQ ID NO: 190192 - DNA, 25 bp, Mus musculus
agagtttcagcacccacagagttga

SEQ ID NO: 190193 - DNA, 25 bp, Mus musculus
agagtttccaaaagctcctggctag

SEQ ID NO: 190194 - DNA, 25 bp, Mus musculus
agagtttcctagattgcttcctgag

SEQ ID NO: 190195 - DNA, 25 bp, Mus musculus
agagtttcctggagaaggaacttgg

SEQ ID NO: 190196 - DNA, 25 bp, Mus musculus
agagtttcctgggagaaacactcat

SEQ ID NO: 190197 - DNA, 25 bp, Mus musculus
agagtttgaactctcttgctctctg

SEQ ID NO: 190198 - DNA, 25 bp, Mus musculus
agagtttgaatctgtcggggctgca

SEQ ID NO: 190199 - DNA, 25 bp, Mus musculus
agagtttggcagagtatacgaagca

SEQ ID NO: 190200 - DNA, 25 bp, Mus musculus
agagtttggcagtgtcaaaggtccc

SEQ ID NO: 190201 - DNA, 25 bp, Mus musculus
agagttttgtcaagacaatggattc

SEQ ID NO: 190202 - DNA, 25 bp, Mus musculus
agagttttgtgagcaccttcagctt

SEQ ID NO: 190203 - DNA, 25 bp, Mus musculus
agagttttgttttgttatgaatgca

SEQ ID NO: 190204 - DNA, 25 bp, Mus musculus
agataaaaaaggctgcctcaccaag

SEQ ID NO: 190205 - DNA, 25 bp, Mus musculus
agataaaaacagaaggcgaaggacg

SEQ ID NO: 190206 - DNA, 25 bp, Mus musculus
agataaaaagcaggggttccttgtg

SEQ ID NO: 190207 - DNA, 25 bp, Mus musculus
agataaaacagaaagagtaggaaac

SEQ ID NO: 190208 - DNA, 25 bp, Mus musculus
agataaaagctgaagtgaagtctgg

SEQ ID NO: 190209 - DNA, 25 bp, Mus musculus
agataaaatggagagaggtaagaag

SEQ ID NO: 190210 - DNA, 25 bp, Mus musculus
agataaaatggagagtctggatgtg

SEQ ID NO: 190211 - DNA, 25 bp, Mus musculus
agataaacagatacagacagaagct

SEQ ID NO: 190212 - DNA, 25 bp, Mus musculus
agataaacagtgtggcctaccaaca

SEQ ID NO: 190213 - DNA, 25 bp, Mus musculus
agataaacccagctccctacactat

SEQ ID NO: 190214 - DNA, 25 bp, Mus musculus
agataaacgaaattaggtccagagt

SEQ ID NO: 190215 - DNA, 25 bp, Mus musculus
agataaacgagcaagcttctacata

SEQ ID NO: 190216 - DNA, 25 bp, Mus musculus
agataaacgagtgtgcaactgcgta

SEQ ID NO: 190217 - DNA, 25 bp, Mus musculus
agataaacttgaaagatgacagtcc

SEQ ID NO: 190218 - DNA, 25 bp, Mus musculus
agataaagaggactcacggagctct

SEQ ID NO: 190219 - DNA, 25 bp, Mus musculus
agataaagagggctacacatctttc

SEQ ID NO: 190220 - DNA, 25 bp, Mus musculus
agataaagaggtgctaggacctcag

SEQ ID NO: 190221 - DNA, 25 bp, Mus musculus
agataaagagtgtgactggctcaac

SEQ ID NO: 190222 - DNA, 25 bp, Mus musculus
agataaagcgaggctgaaaggaaat

SEQ ID NO: 190223 - DNA, 25 bp, Mus musculus
agataaagcgagtttcactttcagg

SEQ ID NO: 190224 - DNA, 25 bp, Mus musculus
agataaaggaccctgatgctaagaa

SEQ ID NO: 190225 - DNA, 25 bp, Mus musculus
agataaagggcagtcattcaatgac

SEQ ID NO: 190226 - DNA, 25 bp, Mus musculus
agataaaggggagatccctgacgac

SEQ ID NO: 190227 - DNA, 25 bp, Mus musculus
agataaagttttgagagaagcagaa

SEQ ID NO: 190228 - DNA, 25 bp, Mus musculus
agataaagtttttggaagctttgct

SEQ ID NO: 190229 - DNA, 25 bp, Mus musculus
agataaagtttttggtatgctggtg

SEQ ID NO: 190230 - DNA, 25 bp, Mus musculus
agataaatagatatgttttcttctc

SEQ ID NO: 190231 - DNA, 25 bp, Mus musculus
agataaataggtgaggctgctggcc

SEQ ID NO: 190232 - DNA, 25 bp, Mus musculus
agataaatagttcaattatcagatt

SEQ ID NO: 190233 - DNA, 25 bp, Mus musculus
agataaatcagatgttttcggtgca

SEQ ID NO: 190234 - DNA, 25 bp, Mus musculus
agataaatcagcttctctccacgat

SEQ ID NO: 190235 - DNA, 25 bp, Mus musculus
agataaattgattgagtctgtttct

SEQ ID NO: 190236 - DNA, 25 bp, Mus musculus
agataacaagaacactccagggttt

SEQ ID NO: 190237 - DNA, 25 bp, Mus musculus
agataacaagactcagattagcccc

SEQ ID NO: 190238 - DNA, 25 bp, Mus musculus
agataacagcaatggcctccaactg

SEQ ID NO: 190239 - DNA, 25 bp, Mus musculus
agataacagcaatgggccaccagaa

SEQ ID NO: 190240 - DNA, 25 bp, Mus musculus
agataaccaggtgattgttcagtcc

SEQ ID NO: 190241 - DNA, 25 bp, Mus musculus
agataacccaaggtggctggatcca

SEQ ID NO: 190242 - DNA, 25 bp, Mus musculus
agataacccagaggatcaccttaca

SEQ ID NO: 190243 - DNA, 25 bp, Mus musculus
agataacccagtatcagtacttttt

SEQ ID NO: 190244 - DNA, 25 bp, Mus musculus
agataacccggcactgaatgcacag

SEQ ID NO: 190245 - DNA, 25 bp, Mus musculus
agataacctaagtaccagcagtgct

SEQ ID NO: 190246 - DNA, 25 bp, Mus musculus
agataacgtacacagatatgaggaa

SEQ ID NO: 190247 - DNA, 25 bp, Mus musculus
agataacgtacacaggtttgcagct

SEQ ID NO: 190248 - DNA, 25 bp, Mus musculus
agataactcaatgggatttggtgca

SEQ ID NO: 190249 - DNA, 25 bp, Mus musculus
agataactcagcaggaactatgaat

SEQ ID NO: 190250 - DNA, 25 bp, Mus musculus
agataagaaagatggcttgccagta

SEQ ID NO: 190251 - DNA, 25 bp, Mus musculus
agataagaaggacttcctagggaaa

SEQ ID NO: 190252 - DNA, 25 bp, Mus musculus
agataagaagggcaggattctggga

SEQ ID NO: 190253 - DNA, 25 bp, Mus musculus
agataagaaggtcggagctgaaagg

SEQ ID NO: 190254 - DNA, 25 bp, Mus musculus
agataagaaggttgtgacaaagact

SEQ ID NO: 190255 - DNA, 25 bp, Mus musculus
agataagagatatgccagaatttca

SEQ ID NO: 190256 - DNA, 25 bp, Mus musculus
agataagagcgttctctggtgcaag

SEQ ID NO: 190257 - DNA, 25 bp, Mus musculus
agataagcagagtccagttcagctg

SEQ ID NO: 190258 - DNA, 25 bp, Mus musculus
agataagctaaaagaattgggatat

SEQ ID NO: 190259 - DNA, 25 bp, Mus musculus
agataagctaaaagcatggctgctc

SEQ ID NO: 190260 - DNA, 25 bp, Mus musculus
agataaggaaaaggggctgtctaca

SEQ ID NO: 190261 - DNA, 25 bp, Mus musculus
agataaggagcagaatgagaagact

SEQ ID NO: 190262 - DNA, 25 bp, Mus musculus
agataagtatgggagtgaaggatat

SEQ ID NO: 190263 - DNA, 25 bp, Mus musculus
agataagtatgggtggtactgcaga

SEQ ID NO: 190264 - DNA, 25 bp, Mus musculus
agataagttgtgtgccaccatttga

SEQ ID NO: 190265 - DNA, 25 bp, Mus musculus
agataagttgtgtgccattgctgct

SEQ ID NO: 190266 - DNA, 25 bp, Mus musculus
agataataaaggtagtggatggctc

SEQ ID NO: 190267 - DNA, 25 bp, Mus musculus
agataataaagtacaaaatggttct

SEQ ID NO: 190268 - DNA, 25 bp, Mus musculus
agataataccatccggttatgggat

SEQ ID NO: 190269 - DNA, 25 bp, Mus musculus
agataatcagattataccgaaaaga

SEQ ID NO: 190270 - DNA, 25 bp, Mus musculus
agataatcagccgtggggccaattt

SEQ ID NO: 190271 - DNA, 25 bp, Mus musculus
agataatccaccatgactggtggaa

SEQ ID NO: 190272 - DNA, 25 bp, Mus musculus
agataatccacttaaacatttaaaa

SEQ ID NO: 190273 - DNA, 25 bp, Mus musculus
agataatggcagtggtcctacggct

SEQ ID NO: 190274 - DNA, 25 bp, Mus musculus
agatacaaaagcacaaccagtgccc

SEQ ID NO: 190275 - DNA, 25 bp, Mus musculus
agatacaaaagtaagaagttgtttt

SEQ ID NO: 190276 - DNA, 25 bp, Mus musculus
agatacaaacggtctccctgcaaca

SEQ ID NO: 190277 - DNA, 25 bp, Mus musculus
agatacaagcaggtttttctccagg

SEQ ID NO: 190278 - DNA, 25 bp, Mus musculus
agatacaagcgggctttgctgctgc

SEQ ID NO: 190279 - DNA, 25 bp, Mus musculus
agatacaatattagaaggaacaact

SEQ ID NO: 190280 - DNA, 25 bp, Mus musculus
agatacaatttctggaaatgatata

SEQ ID NO: 190281 - DNA, 25 bp, Mus musculus
agatacaccagttgtgacacaggat

SEQ ID NO: 190282 - DNA, 25 bp, Mus musculus
agatacacgtgcaggtactgtggca

SEQ ID NO: 190283 - DNA, 25 bp, Mus musculus
agatacactataaggtttgctatgc

SEQ ID NO: 190284 - DNA, 25 bp, Mus musculus
agatacagatatggagtaacaactg

SEQ ID NO: 190285 - DNA, 25 bp, Mus musculus
agatacagatatggagtatacaata

SEQ ID NO: 190286 - DNA, 25 bp, Mus musculus
agatacagccctgctggtagctgct

SEQ ID NO: 190287 - DNA, 25 bp, Mus musculus
agatacaggaagactccttctaatg

SEQ ID NO: 190288 - DNA, 25 bp, Mus musculus
agatacatcaggaagtggcaaggct

SEQ ID NO: 190289 - DNA, 25 bp, Mus musculus
agatacatcagggtcttggggctgg

SEQ ID NO: 190290 - DNA, 25 bp, Mus musculus
agatacattctcaaggtttctttta

SEQ ID NO: 190291 - DNA, 25 bp, Mus musculus
agataccaaaaatagcgaccagttc

SEQ ID NO: 190292 - DNA, 25 bp, Mus musculus
agataccaagctaatgagcgagtga

SEQ ID NO: 190293 - DNA, 25 bp, Mus musculus
agataccaaggactgctacacctta

SEQ ID NO: 190294 - DNA, 25 bp, Mus musculus
agataccaaggactggccttctcag

SEQ ID NO: 190295 - DNA, 25 bp, Mus musculus
agataccacggccagagatcctcag

SEQ ID NO: 190296 - DNA, 25 bp, Mus musculus
agataccagaatgaggatcccagaa

SEQ ID NO: 190297 - DNA, 25 bp, Mus musculus
agataccagagatagagacaaaaga

SEQ ID NO: 190298 - DNA, 25 bp, Mus musculus
agataccagagtatacccgcaatgg

SEQ ID NO: 190299 - DNA, 25 bp, Mus musculus
agatacccaagagccagaaactccg

SEQ ID NO: 190300 - DNA, 25 bp, Mus musculus
agatacccagagccctgcaactccc

SEQ ID NO: 190301 - DNA, 25 bp, Mus musculus
agatacccgacccgatttctctgtg

SEQ ID NO: 190302 - DNA, 25 bp, Mus musculus
agatacccgacccggcaccagccac

SEQ ID NO: 190303 - DNA, 25 bp, Mus musculus
agataccctaactcagattagcccc

SEQ ID NO: 190304 - DNA, 25 bp, Mus musculus
agatacgaaagggcgagaggttaat

SEQ ID NO: 190305 - DNA, 25 bp, Mus musculus
agatacgaagaggaatcttttgtgt

SEQ ID NO: 190306 - DNA, 25 bp, Mus musculus
agatacgaaggaagaagttctaaga

SEQ ID NO: 190307 - DNA, 25 bp, Mus musculus
agatacgaagtgatgtcctggtggt

SEQ ID NO: 190308 - DNA, 25 bp, Mus musculus
agatacgggcgcgagggcgccgagc

SEQ ID NO: 190309 - DNA, 25 bp, Mus musculus
agatactattgttgcaatcatggca

SEQ ID NO: 190310 - DNA, 25 bp, Mus musculus
agatactcaactcaaatattatgag

SEQ ID NO: 190311 - DNA, 25 bp, Mus musculus
agatactcaactcaaatattttgaa

SEQ ID NO: 190312 - DNA, 25 bp, Mus musculus
agatactcaactcaactctctgaaa

SEQ ID NO: 190313 - DNA, 25 bp, Mus musculus
agatactcgagccaggttctctcca

SEQ ID NO: 190314 - DNA, 25 bp, Mus musculus
agatactctcagagatgctggagtg

SEQ ID NO: 190315 - DNA, 25 bp, Mus musculus
agatactgaagaaggacagctcctc

SEQ ID NO: 190316 - DNA, 25 bp, Mus musculus
agatactgcagagctacgagtctgg

SEQ ID NO: 190317 - DNA, 25 bp, Mus musculus
agatactgttacagccctgccctgc

SEQ ID NO: 190318 - DNA, 25 bp, Mus musculus
agatacttacagattggccaggatt

SEQ ID NO: 190319 - DNA, 25 bp, Mus musculus
agatacttacagtcacatgtggcct

SEQ ID NO: 190320 - DNA, 25 bp, Mus musculus
agatacttcactcgctcgaagagcc

SEQ ID NO: 190321 - DNA, 25 bp, Mus musculus
agatacttccaatcacttccatgtg

SEQ ID NO: 190322 - DNA, 25 bp, Mus musculus
agatacttctgtgagtgcaaagagc

SEQ ID NO: 190323 - DNA, 25 bp, Mus musculus
agatacttgcaagggtgactcagga

SEQ ID NO: 190324 - DNA, 25 bp, Mus musculus
agatactttgtgaaggacatctttg

SEQ ID NO: 190325 - DNA, 25 bp, Mus musculus
agatactttgtgaaggggcagcatt

SEQ ID NO: 190326 - DNA, 25 bp, Mus musculus
agatacttttggactgaccaaggcc

SEQ ID NO: 190327 - DNA, 25 bp, Mus musculus
agatagactttgcagaaatgaagca

SEQ ID NO: 190328 - DNA, 25 bp, Mus musculus
agatagagaaaaagtaaagacattt

SEQ ID NO: 190329 - DNA, 25 bp, Mus musculus
agatagagaaaagtacaacagaata

SEQ ID NO: 190330 - DNA, 25 bp, Mus musculus
agatagagaaaccaactgaggtgaa

SEQ ID NO: 190331 - DNA, 25 bp, Mus musculus
agatagagaaggtaaaggggaatgc

SEQ ID NO: 190332 - DNA, 25 bp, Mus musculus
agatagagcggggaaaaatggagta

SEQ ID NO: 190333 - DNA, 25 bp, Mus musculus
agatagatttggaagcaggaatgtc

SEQ ID NO: 190334 - DNA, 25 bp, Mus musculus
agatagcaaggagaaagaaaagtca

SEQ ID NO: 190335 - DNA, 25 bp, Mus musculus
agatagcaaggagggattttgaact

SEQ ID NO: 190336 - DNA, 25 bp, Mus musculus
agatagcagcttgggtcttgacgaa

SEQ ID NO: 190337 - DNA, 25 bp, Mus musculus
agatagcagtagtcctaccgggata

SEQ ID NO: 190338 - DNA, 25 bp, Mus musculus
agatagccaatgagatagatggaac

SEQ ID NO: 190339 - DNA, 25 bp, Mus musculus
agatagcctaggttcaaccaggccc

SEQ ID NO: 190340 - DNA, 25 bp, Mus musculus
agatagccttctgcaccaaggagat

SEQ ID NO: 190341 - DNA, 25 bp, Mus musculus
agatagctcagttgtggtagtgtga

SEQ ID NO: 190342 - DNA, 25 bp, Mus musculus
agatagctgcagtagaaaaagttaa

SEQ ID NO: 190343 - DNA, 25 bp, Mus musculus
agataggaggctccctgctatgtgg

SEQ ID NO: 190344 - DNA, 25 bp, Mus musculus
agataggcagcatgtctgatgaaag

SEQ ID NO: 190345 - DNA, 25 bp, Mus musculus
agataggcagcatttccagacagtc

SEQ ID NO: 190346 - DNA, 25 bp, Mus musculus
agataggcctgagacttccttaccg

SEQ ID NO: 190347 - DNA, 25 bp, Mus musculus
agataggctgagcatcccagccttg

SEQ ID NO: 190348 - DNA, 25 bp, Mus musculus
agataggctggagtcccctcccccc

SEQ ID NO: 190349 - DNA, 25 bp, Mus musculus
agataggtgacaaggaaggagcttt

SEQ ID NO: 190350 - DNA, 25 bp, Mus musculus
agatagtagaagagaaaactctcta

SEQ ID NO: 190351 - DNA, 25 bp, Mus musculus
agatagtccttgtgaggcccagcct

SEQ ID NO: 190352 - DNA, 25 bp, Mus musculus
agatagtcgggcaatcctgtgtcga

SEQ ID NO: 190353 - DNA, 25 bp, Mus musculus
agatagtgcgtacagaagaactcct

SEQ ID NO: 190354 - DNA, 25 bp, Mus musculus
agatagtgcgtacagagaacttacc

SEQ ID NO: 190355 - DNA, 25 bp, Mus musculus
agatagttaaagagggttgccccgg

SEQ ID NO: 190356 - DNA, 25 bp, Mus musculus
agatagtttctgaattagtgtcctt

SEQ ID NO: 190357 - DNA, 25 bp, Mus musculus
agatagtttgctgtagtaattcttc

SEQ ID NO: 190358 - DNA, 25 bp, Mus musculus
agatataaaattcacagaggagatt

SEQ ID NO: 190359 - DNA, 25 bp, Mus musculus
agatataaaggattctaaggtgaag

SEQ ID NO: 190360 - DNA, 25 bp, Mus musculus
agatataccaggtgaacctgagtgc

SEQ ID NO: 190361 - DNA, 25 bp, Mus musculus
agatataccagtccggttctccacc

SEQ ID NO: 190362 - DNA, 25 bp, Mus musculus
agatatacgggctgattcgctactc

SEQ ID NO: 190363 - DNA, 25 bp, Mus musculus
agatatacgggctggccaagcccag

SEQ ID NO: 190364 - DNA, 25 bp, Mus musculus
agatatacgggctggtccaaaagga

SEQ ID NO: 190365 - DNA, 25 bp, Mus musculus
agatatcaaaaagggaatcttactt

SEQ ID NO: 190366 - DNA, 25 bp, Mus musculus
agatatcaaagctgccaacgtgctg

SEQ ID NO: 190367 - DNA, 25 bp, Mus musculus
agatatcaacttgattcgaggaact

SEQ ID NO: 190368 - DNA, 25 bp, Mus musculus
agatatcactctgggaggcccggtg

SEQ ID NO: 190369 - DNA, 25 bp, Mus musculus
agatatcactctgttccatgccatg

SEQ ID NO: 190370 - DNA, 25 bp, Mus musculus
agatatcagaatggtcatttatcaa

SEQ ID NO: 190371 - DNA, 25 bp, Mus musculus
agatatcagagatatcataggaccc

SEQ ID NO: 190372 - DNA, 25 bp, Mus musculus
agatatcagagatggacctgcaggt

SEQ ID NO: 190373 - DNA, 25 bp, Mus musculus
agatatcctcagtgtttgtgcctgt

SEQ ID NO: 190374 - DNA, 25 bp, Mus musculus
agatatcctgagcagaggggcaggc

SEQ ID NO: 190375 - DNA, 25 bp, Mus musculus
agatatcgaaggatgttttatttcc

SEQ ID NO: 190376 - DNA, 25 bp, Mus musculus
agatatctaaagtggttccctcaac

SEQ ID NO: 190377 - DNA, 25 bp, Mus musculus
agatatctcagaaagtgtcaccgtg

SEQ ID NO: 190378 - DNA, 25 bp, Mus musculus
agatatctcagcaaagctaccacgt

SEQ ID NO: 190379 - DNA, 25 bp, Mus musculus
agatatctcagcaggtaaatgagaa

SEQ ID NO: 190380 - DNA, 25 bp, Mus musculus
agatatctcagcaggtggcagctag

SEQ ID NO: 190381 - DNA, 25 bp, Mus musculus
agatatctcttcaggtgccagcctc

SEQ ID NO: 190382 - DNA, 25 bp, Mus musculus
agatatgacttgggagaagagactt

SEQ ID NO: 190383 - DNA, 25 bp, Mus musculus
agatatgacttgtttggatttaggg

SEQ ID NO: 190384 - DNA, 25 bp, Mus musculus
agatatgcaaaccatgtttcctgaa

SEQ ID NO: 190385 - DNA, 25 bp, Mus musculus
agatatgcaaatagagtaaaggagt

SEQ ID NO: 190386 - DNA, 25 bp, Mus musculus
agatatgcaaatagggtgaaagaat

SEQ ID NO: 190387 - DNA, 25 bp, Mus musculus
agatatgctcggactcaaccgtgaa

SEQ ID NO: 190388 - DNA, 25 bp, Mus musculus
agatatggaggccaggaaacaagct

SEQ ID NO: 190389 - DNA, 25 bp, Mus musculus
agatatggattcagattactcggga

SEQ ID NO: 190390 - DNA, 25 bp, Mus musculus
agatatggattcagggctgaggcac

SEQ ID NO: 190391 - DNA, 25 bp, Mus musculus
agatatgtttagagcttcccccacc

SEQ ID NO: 190392 - DNA, 25 bp, Mus musculus
agatattaaatgggacctacacact

SEQ ID NO: 190393 - DNA, 25 bp, Mus musculus
agatattattgatacatccatgggg

SEQ ID NO: 190394 - DNA, 25 bp, Mus musculus
agatattattgatattgacccattg

SEQ ID NO: 190395 - DNA, 25 bp, Mus musculus
agatattcagcaagccccgcccaac

SEQ ID NO: 190396 - DNA, 25 bp, Mus musculus
agatattcaggtccttaaaattctg

SEQ ID NO: 190397 - DNA, 25 bp, Mus musculus
agatattccagcctcactgcagtgt

SEQ ID NO: 190398 - DNA, 25 bp, Mus musculus
agatattcctccaaaatactgttca

SEQ ID NO: 190399 - DNA, 25 bp, Mus musculus
agatattcctccaaagtgtgactta

SEQ ID NO: 190400 - DNA, 25 bp, Mus musculus
agatattcctccatacgaacagcaa

SEQ ID NO: 190401 - DNA, 25 bp, Mus musculus
agatattcgtgagcgctctctgctc

SEQ ID NO: 190402 - DNA, 25 bp, Mus musculus
agatattcgtgagcggcaattcaaa

SEQ ID NO: 190403 - DNA, 25 bp, Mus musculus
agatattgataaacgccaccgctcc

SEQ ID NO: 190404 - DNA, 25 bp, Mus musculus
agatattgataaagttcaacttctt

SEQ ID NO: 190405 - DNA, 25 bp, Mus musculus
agatatttaaagctgcaggcacacg

SEQ ID NO: 190406 - DNA, 25 bp, Mus musculus
agatatttagaaggttctacttagc

SEQ ID NO: 190407 - DNA, 25 bp, Mus musculus
agatatttcacggacgtcagggccg

SEQ ID NO: 190408 - DNA, 25 bp, Mus musculus
agatatttgcgaacaaggagcaagc

SEQ ID NO: 190409 - DNA, 25 bp, Mus musculus
agatatttgtgaaaggcactgaaga

SEQ ID NO: 190410 - DNA, 25 bp, Mus musculus
agatattttgcttttagatactctg

SEQ ID NO: 190411 - DNA, 25 bp, Mus musculus
agatcaaaatggctcgcgctgtatg

SEQ ID NO: 190412 - DNA, 25 bp, Mus musculus
agatcaaagcactggcgcctgcgct

SEQ ID NO: 190413 - DNA, 25 bp, Mus musculus
agatcaaagcactgggggagctgct

SEQ ID NO: 190414 - DNA, 25 bp, Mus musculus
agatcaaagcattcgctatggagtt

SEQ ID NO: 190415 - DNA, 25 bp, Mus musculus
agatcaaagtgagaggttcagacag

SEQ ID NO: 190416 - DNA, 25 bp, Mus musculus
agatcaaatttgcaccccaggggtg

SEQ ID NO: 190417 - DNA, 25 bp, Mus musculus
agatcaacccctagtggtgaccaaa

SEQ ID NO: 190418 - DNA, 25 bp, Mus musculus
agatcaagaaaagaggagcgctggc

SEQ ID NO: 190419 - DNA, 25 bp, Mus musculus
agatcaagagattggtgagctccta

SEQ ID NO: 190420 - DNA, 25 bp, Mus musculus
agatcaagaggcctgggattgatca

SEQ ID NO: 190421 - DNA, 25 bp, Mus musculus
agatcaagaggtcagggccaaaact

SEQ ID NO: 190422 - DNA, 25 bp, Mus musculus
agatcaagcgcagcgggagaacagt

SEQ ID NO: 190423 - DNA, 25 bp, Mus musculus
agatcaaggcacaggatctagataa

SEQ ID NO: 190424 - DNA, 25 bp, Mus musculus
agatcaatatgagtggtactgcaga

SEQ ID NO: 190425 - DNA, 25 bp, Mus musculus
agatcaatcaagatgactgtgatga

SEQ ID NO: 190426 - DNA, 25 bp, Mus musculus
agatcaatcgggagttcctctgtga

SEQ ID NO: 190427 - DNA, 25 bp, Mus musculus
agatcaatgctgaagaaagcgaaat

SEQ ID NO: 190428 - DNA, 25 bp, Mus musculus
agatcaatgttaagggatcgcttac

SEQ ID NO: 190429 - DNA, 25 bp, Mus musculus
agatcacaacccagttcccacttgg

SEQ ID NO: 190430 - DNA, 25 bp, Mus musculus
agatcacaagggttctcttggaacg

SEQ ID NO: 190431 - DNA, 25 bp, Mus musculus
agatcacagaaaagaaccggcactg

SEQ ID NO: 190432 - DNA, 25 bp, Mus musculus
agatcacagaaaagggaacagagag

SEQ ID NO: 190433 - DNA, 25 bp, Mus musculus
agatcaccaggcagttgcccatgga

SEQ ID NO: 190434 - DNA, 25 bp, Mus musculus
agatcaccatcaatgagatcagtga

SEQ ID NO: 190435 - DNA, 25 bp, Mus musculus
agatcacccacgtctcttcaacaga

SEQ ID NO: 190436 - DNA, 25 bp, Mus musculus
agatcacctcagaggatacaagcag

SEQ ID NO: 190437 - DNA, 25 bp, Mus musculus
agatcacctcagtggctctggagca

SEQ ID NO: 190438 - DNA, 25 bp, Mus musculus
agatcactcaggagaagccctcgaa

SEQ ID NO: 190439 - DNA, 25 bp, Mus musculus
agatcactcaggaggttctgacggg

SEQ ID NO: 190440 - DNA, 25 bp, Mus musculus
agatcactcaggagttgcagctcca

SEQ ID NO: 190441 - DNA, 25 bp, Mus musculus
agatcactgccaaggacgaaaaggg

SEQ ID NO: 190442 - DNA, 25 bp, Mus musculus
agatcacttcaagtgggtaaagcag

SEQ ID NO: 190443 - DNA, 25 bp, Mus musculus
agatcagaaagcctaggacctgcct

SEQ ID NO: 190444 - DNA, 25 bp, Mus musculus
agatcagaaaggcagtttgtgcact

SEQ ID NO: 190445 - DNA, 25 bp, Mus musculus
agatcagaaagggtgtgtgggatga

SEQ ID NO: 190446 - DNA, 25 bp, Mus musculus
agatcagaagaacagtctatccgtc

SEQ ID NO: 190447 - DNA, 25 bp, Mus musculus
agatcagaagaccaggaacccacga

SEQ ID NO: 190448 - DNA, 25 bp, Mus musculus
agatcagaagagctctgcaggtcca

SEQ ID NO: 190449 - DNA, 25 bp, Mus musculus
agatcagaagcacaattatatgaaa

SEQ ID NO: 190450 - DNA, 25 bp, Mus musculus
agatcagaaggcttatggtagcatc

SEQ ID NO: 190451 - DNA, 25 bp, Mus musculus
agatcagaagtaacaggagaaacat

SEQ ID NO: 190452 - DNA, 25 bp, Mus musculus
agatcagacagaggactactgttga

SEQ ID NO: 190453 - DNA, 25 bp, Mus musculus
agatcagaccttaggggacttactt

SEQ ID NO: 190454 - DNA, 25 bp, Mus musculus
agatcagagatggacagcagcatca

SEQ ID NO: 190455 - DNA, 25 bp, Mus musculus
agatcagagatgttactctcgtccc

SEQ ID NO: 190456 - DNA, 25 bp, Mus musculus
agatcagatagtgccggcattggca

SEQ ID NO: 190457 - DNA, 25 bp, Mus musculus
agatcagatccgtgccatcgctgaa

SEQ ID NO: 190458 - DNA, 25 bp, Mus musculus
agatcagatttaaaggttatagtta

SEQ ID NO: 190459 - DNA, 25 bp, Mus musculus
agatcagcaagcagcttcaggatct

SEQ ID NO: 190460 - DNA, 25 bp, Mus musculus
agatcagcaagctgattaccaggaa

SEQ ID NO: 190461 - DNA, 25 bp, Mus musculus
agatcagcagagaactactttctcc

SEQ ID NO: 190462 - DNA, 25 bp, Mus musculus
agatcagcatacaagggagactctg

SEQ ID NO: 190463 - DNA, 25 bp, Mus musculus
agatcagccctgagggcagagcagc

SEQ ID NO: 190464 - DNA, 25 bp, Mus musculus
agatcagctaattaagaacctagct

SEQ ID NO: 190465 - DNA, 25 bp, Mus musculus
agatcagctcgagtgccatccgtga

SEQ ID NO: 190466 - DNA, 25 bp, Mus musculus
agatcaggaagaagactgcccgtgg

SEQ ID NO: 190467 - DNA, 25 bp, Mus musculus
agatcaggcaagcagctccagtcag

SEQ ID NO: 190468 - DNA, 25 bp, Mus musculus
agatcaggggctggaaaacgagaac

SEQ ID NO: 190469 - DNA, 25 bp, Mus musculus
agatcagggtcaagacaaatcttcc

SEQ ID NO: 190470 - DNA, 25 bp, Mus musculus
agatcagggtcaaggttgtagttcc

SEQ ID NO: 190471 - DNA, 25 bp, Mus musculus
agatcaggtaatcacaggtccttct

SEQ ID NO: 190472 - DNA, 25 bp, Mus musculus
agatcagtatggtccatattgtggg

SEQ ID NO: 190473 - DNA, 25 bp, Mus musculus
agatcagtcggtactccctggcatc

SEQ ID NO: 190474 - DNA, 25 bp, Mus musculus
agatcagtggtccagaccctcagtg

SEQ ID NO: 190475 - DNA, 25 bp, Mus musculus
agatcagtggtccaggttctaagcg

SEQ ID NO: 190476 - DNA, 25 bp, Mus musculus
agatcatatacaggagcagtacagt

SEQ ID NO: 190477 - DNA, 25 bp, Mus musculus
agatcatcaaaccagaagatttctt

SEQ ID NO: 190478 - DNA, 25 bp, Mus musculus
agatcatcaagggccactccagaag

SEQ ID NO: 190479 - DNA, 25 bp, Mus musculus
agatcatccggaagaagattccttt

SEQ ID NO: 190480 - DNA, 25 bp, Mus musculus
agatcatcgaaatgaagattggata

SEQ ID NO: 190481 - DNA, 25 bp, Mus musculus
agatcatcgaaatgatgccagaatt

SEQ ID NO: 190482 - DNA, 25 bp, Mus musculus
agatcatcgaaatggaaatcagaga

SEQ ID NO: 190483 - DNA, 25 bp, Mus musculus
agatcatctcacaggttcaaaagag

SEQ ID NO: 190484 - DNA, 25 bp, Mus musculus
agatcatctcacagtctgttgcagg

SEQ ID NO: 190485 - DNA, 25 bp, Mus musculus
agatcatgaagacagtaaagactgt

SEQ ID NO: 190486 - DNA, 25 bp, Mus musculus
agatcatgaaggacatctgggttct

SEQ ID NO: 190487 - DNA, 25 bp, Mus musculus
agatcatgaaggtacattttatact

SEQ ID NO: 190488 - DNA, 25 bp, Mus musculus
agatcatggagatgctccaagctga

SEQ ID NO: 190489 - DNA, 25 bp, Mus musculus
agatcatggttgcccccaaggtctc

SEQ ID NO: 190490 - DNA, 25 bp, Mus musculus
agatcatgtagggagcaacatcctt

SEQ ID NO: 190491 - DNA, 25 bp, Mus musculus
agatcatgtagggagtatgaaggtc

SEQ ID NO: 190492 - DNA, 25 bp, Mus musculus
agatcatgtcatcaggcagcctgat

SEQ ID NO: 190493 - DNA, 25 bp, Mus musculus
agatcattaaggaacgagaactgga

SEQ ID NO: 190494 - DNA, 25 bp, Mus musculus
agatcattaggaaacaggtctcagc

SEQ ID NO: 190495 - DNA, 25 bp, Mus musculus
agatcattaggtctcagccactaaa

SEQ ID NO: 190496 - DNA, 25 bp, Mus musculus
agatcattgcagatgttcgagctgc

SEQ ID NO: 190497 - DNA, 25 bp, Mus musculus
agatccaaaacacacagtgtatgaa

SEQ ID NO: 190498 - DNA, 25 bp, Mus musculus
agatccaaatcagacccggcactga

SEQ ID NO: 190499 - DNA, 25 bp, Mus musculus
agatccaagggggtgcctgtgggcc

SEQ ID NO: 190500 - DNA, 25 bp, Mus musculus
agatccacaaagaggcggttacagg

SEQ ID NO: 190501 - DNA, 25 bp, Mus musculus
agatccagacaacggccccacctgt

SEQ ID NO: 190502 - DNA, 25 bp, Mus musculus
agatccagcagttacacctggagca

SEQ ID NO: 190503 - DNA, 25 bp, Mus musculus
agatccagccttggatccaattata

SEQ ID NO: 190504 - DNA, 25 bp, Mus musculus
agatccagctgatggtagaagagag

SEQ ID NO: 190505 - DNA, 25 bp, Mus musculus
agatccagctgtaggagactttgtg

SEQ ID NO: 190506 - DNA, 25 bp, Mus musculus
agatccaggagacaaattgagacct

SEQ ID NO: 190507 - DNA, 25 bp, Mus musculus
agatccaggagacaagcatctaatg

SEQ ID NO: 190508 - DNA, 25 bp, Mus musculus
agatccaggagctggtggaagccat

SEQ ID NO: 190509 - DNA, 25 bp, Mus musculus
agatccaggaggacttcttcctggc

SEQ ID NO: 190510 - DNA, 25 bp, Mus musculus
agatccagtaaagccaacaaattac

SEQ ID NO: 190511 - DNA, 25 bp, Mus musculus
agatccagtaaagtccaggtacata

SEQ ID NO: 190512 - DNA, 25 bp, Mus musculus
agatccatagggatttgaaagctgg

SEQ ID NO: 190513 - DNA, 25 bp, Mus musculus
agatccatcaagtgggttcatgtac

SEQ ID NO: 190514 - DNA, 25 bp, Mus musculus
agatccatctaaatgggtacaagtt

SEQ ID NO: 190515 - DNA, 25 bp, Mus musculus
agatccatgaaaagcaagatgggca

SEQ ID NO: 190516 - DNA, 25 bp, Mus musculus
agatccatgagaaattgttcccctc

SEQ ID NO: 190517 - DNA, 25 bp, Mus musculus
agatccatgagaaggtactgaatga

SEQ ID NO: 190518 - DNA, 25 bp, Mus musculus
agatccattcaaaggcattggccag

SEQ ID NO: 190519 - DNA, 25 bp, Mus musculus
agatccattccggcgcccatggcga

SEQ ID NO: 190520 - DNA, 25 bp, Mus musculus
agatcccaagttctttcagattacg

SEQ ID NO: 190521 - DNA, 25 bp, Mus musculus
agatcccaccaaggtgaaggcccac

SEQ ID NO: 190522 - DNA, 25 bp, Mus musculus
agatcccagcagcattctgcagacc

SEQ ID NO: 190523 - DNA, 25 bp, Mus musculus
agatcccagcccccgaaactctgga

SEQ ID NO: 190524 - DNA, 25 bp, Mus musculus
agatcccagccctgtccctaggagg

SEQ ID NO: 190525 - DNA, 25 bp, Mus musculus
agatcccagctgagaaagcgctgca

SEQ ID NO: 190526 - DNA, 25 bp, Mus musculus
agatcccaggaacaggtatacaaga

SEQ ID NO: 190527 - DNA, 25 bp, Mus musculus
agatcccaggatatcaatgagtgcc

SEQ ID NO: 190528 - DNA, 25 bp, Mus musculus
agatcccaggggaaggctactacat

SEQ ID NO: 190529 - DNA, 25 bp, Mus musculus
agatcccaggttatcaatgagtgcc

SEQ ID NO: 190530 - DNA, 25 bp, Mus musculus
agatcccagtgctgcacatgatggc

SEQ ID NO: 190531 - DNA, 25 bp, Mus musculus
agatcccagtgctgggtctctttta

SEQ ID NO: 190532 - DNA, 25 bp, Mus musculus
agatccccaaggcgagttctggctg

SEQ ID NO: 190533 - DNA, 25 bp, Mus musculus
agatccccagagacagaacttctgt

SEQ ID NO: 190534 - DNA, 25 bp, Mus musculus
agatccccagagactttgcaatttt

SEQ ID NO: 190535 - DNA, 25 bp, Mus musculus
agatccccagtgactttgcaatttt

SEQ ID NO: 190536 - DNA, 25 bp, Mus musculus
agatcccccaagagcaagagaagca

SEQ ID NO: 190537 - DNA, 25 bp, Mus musculus
agatcccccaaggaagctctttgtg

SEQ ID NO: 190538 - DNA, 25 bp, Mus musculus
agatcccccaggcccggctctactc

SEQ ID NO: 190539 - DNA, 25 bp, Mus musculus
agatcccctgaaacatgctggtgtc

SEQ ID NO: 190540 - DNA, 25 bp, Mus musculus
agatcccgagaatacgcagaccaaa

SEQ ID NO: 190541 - DNA, 25 bp, Mus musculus
agatcccgatcaagatcatactctc

SEQ ID NO: 190542 - DNA, 25 bp, Mus musculus
agatccctctcagccccctggtgct

SEQ ID NO: 190543 - DNA, 25 bp, Mus musculus
agatccctctcaggtttacagcccc

SEQ ID NO: 190544 - DNA, 25 bp, Mus musculus
agatccctgcaaggaaagagtgcca

SEQ ID NO: 190545 - DNA, 25 bp, Mus musculus
agatccgagagactacaggagccca

SEQ ID NO: 190546 - DNA, 25 bp, Mus musculus
agatccgcagtatgttccggaagct

SEQ ID NO: 190547 - DNA, 25 bp, Mus musculus
agatccgcagtggtttctctgtata

SEQ ID NO: 190548 - DNA, 25 bp, Mus musculus
agatccggaaccagcctctgacctc

SEQ ID NO: 190549 - DNA, 25 bp, Mus musculus
agatccggaggatccaaggactgtg

SEQ ID NO: 190550 - DNA, 25 bp, Mus musculus
agatccgggacagaggaccaggagg

SEQ ID NO: 190551 - DNA, 25 bp, Mus musculus
agatccgggacagcaagaagttcct

SEQ ID NO: 190552 - DNA, 25 bp, Mus musculus
agatccgggagaaggtcctgggcaa

SEQ ID NO: 190553 - DNA, 25 bp, Mus musculus
agatccgggagctggagtcctttgg

SEQ ID NO: 190554 - DNA, 25 bp, Mus musculus
agatccgtttacaggtgctgggcgt

SEQ ID NO: 190555 - DNA, 25 bp, Mus musculus
agatccgtttacaggtggtggtcgc

SEQ ID NO: 190556 - DNA, 25 bp, Mus musculus
agatcctaagcaaaaggctgaggag

SEQ ID NO: 190557 - DNA, 25 bp, Mus musculus
agatcctcaaggggaaactgtttga

SEQ ID NO: 190558 - DNA, 25 bp, Mus musculus
agatcctccgacagttcaaccagac

SEQ ID NO: 190559 - DNA, 25 bp, Mus musculus
agatcctccgacagttcagtcaaca

SEQ ID NO: 190560 - DNA, 25 bp, Mus musculus
agatcctcctagcccacagacgctt

SEQ ID NO: 190561 - DNA, 25 bp, Mus musculus
agatcctcggcctggtcaccgaagt

SEQ ID NO: 190562 - DNA, 25 bp, Mus musculus
agatcctctcggtaaatggccaaga

SEQ ID NO: 190563 - DNA, 25 bp, Mus musculus
agatcctctgatggagccagagaac

SEQ ID NO: 190564 - DNA, 25 bp, Mus musculus
agatcctctgcactgctctcaggag

SEQ ID NO: 190565 - DNA, 25 bp, Mus musculus
agatcctgaaaaatgtgggggttgc

SEQ ID NO: 190566 - DNA, 25 bp, Mus musculus
agatcctgaaaagtattgataatga

SEQ ID NO: 190567 - DNA, 25 bp, Mus musculus
agatcctgaagactgctggagttaa

SEQ ID NO: 190568 - DNA, 25 bp, Mus musculus
agatcctgaagatgttgctgtgcat

SEQ ID NO: 190569 - DNA, 25 bp, Mus musculus
agatcctgaagcattcgggaattaa

SEQ ID NO: 190570 - DNA, 25 bp, Mus musculus
agatcctgaagctgcgacaagggtc

SEQ ID NO: 190571 - DNA, 25 bp, Mus musculus
agatcctgaatgttgctgtgcatct

SEQ ID NO: 190572 - DNA, 25 bp, Mus musculus
agatcctgacaagggcacgtggaga

SEQ ID NO: 190573 - DNA, 25 bp, Mus musculus
agatcctgataaacttcccacgaca

SEQ ID NO: 190574 - DNA, 25 bp, Mus musculus
agatcctgatctgtgtgggcgggtg

SEQ ID NO: 190575 - DNA, 25 bp, Mus musculus
agatcctgccggcgagtgaggaagt

SEQ ID NO: 190576 - DNA, 25 bp, Mus musculus
agatcctgccggcgctctgaaatca

SEQ ID NO: 190577 - DNA, 25 bp, Mus musculus
agatcctggagcacttggaatctca

SEQ ID NO: 190578 - DNA, 25 bp, Mus musculus
agatcctgggggcagtgtatggggt

SEQ ID NO: 190579 - DNA, 25 bp, Mus musculus
agatcctgtggctaagtaagaaatc

SEQ ID NO: 190580 - DNA, 25 bp, Mus musculus
agatcctgtggctaagtgactaata

SEQ ID NO: 190581 - DNA, 25 bp, Mus musculus
agatcctgtggctaatcctgtctgt

SEQ ID NO: 190582 - DNA, 25 bp, Mus musculus
agatcctgtggctaatttcagagtg

SEQ ID NO: 190583 - DNA, 25 bp, Mus musculus
agatccttccaaaaggcccacagca

SEQ ID NO: 190584 - DNA, 25 bp, Mus musculus
agatccttccaagactcagattagc

SEQ ID NO: 190585 - DNA, 25 bp, Mus musculus
agatccttctttgttgggtgggact

SEQ ID NO: 190586 - DNA, 25 bp, Mus musculus
agatcctttcacaggtgctgggcgt

SEQ ID NO: 190587 - DNA, 25 bp, Mus musculus
agatcctttcaggagcccagctccc

SEQ ID NO: 190588 - DNA, 25 bp, Mus musculus
agatcctttcaggtgctgtaggagc

SEQ ID NO: 190589 - DNA, 25 bp, Mus musculus
agatcctttcggctgtcggcgagcc

SEQ ID NO: 190590 - DNA, 25 bp, Mus musculus
agatcctttgtgtggttcttcttgc

SEQ ID NO: 190591 - DNA, 25 bp, Mus musculus
agatcgaaataaattgaaaaacatg

SEQ ID NO: 190592 - DNA, 25 bp, Mus musculus
agatcgaagttaaaattgaagagct

SEQ ID NO: 190593 - DNA, 25 bp, Mus musculus
agatcgacaggaagcccgcaatgca

SEQ ID NO: 190594 - DNA, 25 bp, Mus musculus
agatcgagcaggtgaatgagcgagt

SEQ ID NO: 190595 - DNA, 25 bp, Mus musculus
agatcgagcaggttcctcatgaggg

SEQ ID NO: 190596 - DNA, 25 bp, Mus musculus
agatcgatgagctatgtgccacctt

SEQ ID NO: 190597 - DNA, 25 bp, Mus musculus
agatcgatgagctttcactctactc

SEQ ID NO: 190598 - DNA, 25 bp, Mus musculus
agatcgatgaggaagggaacctgat

SEQ ID NO: 190599 - DNA, 25 bp, Mus musculus
agatcgccaagcggacccagccacc

SEQ ID NO: 190600 - DNA, 25 bp, Mus musculus
agatcgcccggcaggcctatgagaa

SEQ ID NO: 190601 - DNA, 25 bp, Mus musculus
agatcgcctccagcctatttaagag

SEQ ID NO: 190602 - DNA, 25 bp, Mus musculus
agatcgcctccaggccagcagcaac

SEQ ID NO: 190603 - DNA, 25 bp, Mus musculus
agatcgcctgtagcaaagtccgagg

SEQ ID NO: 190604 - DNA, 25 bp, Mus musculus
agatcgcgcgcgaggcggaggccag

SEQ ID NO: 190605 - DNA, 25 bp, Mus musculus
agatcgctgtgtctatcgtgcgggc

SEQ ID NO: 190606 - DNA, 25 bp, Mus musculus
agatcgctgtgtctatgtgaagcca

SEQ ID NO: 190607 - DNA, 25 bp, Mus musculus
agatcggcaggatgactgactttcc

SEQ ID NO: 190608 - DNA, 25 bp, Mus musculus
agatcggctacacagaagttcagtt

SEQ ID NO: 190609 - DNA, 25 bp, Mus musculus
agatcggctacacagatgttcactg

SEQ ID NO: 190610 - DNA, 25 bp, Mus musculus
agatcggctacacagtctgggtgtt

SEQ ID NO: 190611 - DNA, 25 bp, Mus musculus
agatcgggctgcctggcgtggccga

SEQ ID NO: 190612 - DNA, 25 bp, Mus musculus
agatcgggctgcctgtctccctcca

SEQ ID NO: 190613 - DNA, 25 bp, Mus musculus
agatcgggcttgggcccagagtatg

SEQ ID NO: 190614 - DNA, 25 bp, Mus musculus
agatcgtagaggcggatcacattcc

SEQ ID NO: 190615 - DNA, 25 bp, Mus musculus
agatcgtagaggcggggctctgcca

SEQ ID NO: 190616 - DNA, 25 bp, Mus musculus
agatcgtcatatcaggtaacgggca

SEQ ID NO: 190617 - DNA, 25 bp, Mus musculus
agatcgtccaaccttctgtgttagc

SEQ ID NO: 190618 - DNA, 25 bp, Mus musculus
agatcgtccaagttgaaaggccact

SEQ ID NO: 190619 - DNA, 25 bp, Mus musculus
agatcgtgcccgatgaacgagaccg

SEQ ID NO: 190620 - DNA, 25 bp, Mus musculus
agatctaaaggagctgtgaaatcag

SEQ ID NO: 190621 - DNA, 25 bp, Mus musculus
agatctaaccatataccagaggagg

SEQ ID NO: 190622 - DNA, 25 bp, Mus musculus
agatctaccagcaaaatcttgctag

SEQ ID NO: 190623 - DNA, 25 bp, Mus musculus
agatctaccagggatgagtttgtgg

SEQ ID NO: 190624 - DNA, 25 bp, Mus musculus
agatctactaagaaatgtcataaag

SEQ ID NO: 190625 - DNA, 25 bp, Mus musculus
agatctataaaacatatttccaggg

SEQ ID NO: 190626 - DNA, 25 bp, Mus musculus
agatctatgaatgcactgacactga

SEQ ID NO: 190627 - DNA, 25 bp, Mus musculus
agatctatgccgtggacaacaatta

SEQ ID NO: 190628 - DNA, 25 bp, Mus musculus
agatctatgccgtggatgaacgggg

SEQ ID NO: 190629 - DNA, 25 bp, Mus musculus
agatctcaaaggaaaaccagtggct

SEQ ID NO: 190630 - DNA, 25 bp, Mus musculus
agatctcaaagggggaaaaaccaat

SEQ ID NO: 190631 - DNA, 25 bp, Mus musculus
agatctcaaagtgagaaaacaagaa

SEQ ID NO: 190632 - DNA, 25 bp, Mus musculus
agatctcacgagacatatctgaaga

SEQ ID NO: 190633 - DNA, 25 bp, Mus musculus
agatctcacgagggagaaactgcct

SEQ ID NO: 190634 - DNA, 25 bp, Mus musculus
agatctccatcaaagaaattagcca

SEQ ID NO: 190635 - DNA, 25 bp, Mus musculus
agatctccatcaaaggacctgatag

SEQ ID NO: 190636 - DNA, 25 bp, Mus musculus
agatctccatgctggagaacatagg

SEQ ID NO: 190637 - DNA, 25 bp, Mus musculus
agatctcccaggagattggagaccg

SEQ ID NO: 190638 - DNA, 25 bp, Mus musculus
agatctcccaggctgtgacctctct

SEQ ID NO: 190639 - DNA, 25 bp, Mus musculus
agatctccgaagatacttgaaccag

SEQ ID NO: 190640 - DNA, 25 bp, Mus musculus
agatctccgccagaagcctgcatcc

SEQ ID NO: 190641 - DNA, 25 bp, Mus musculus
agatctcctgagccacagcctgcct

SEQ ID NO: 190642 - DNA, 25 bp, Mus musculus
agatctcctgggccctcaccagagc

SEQ ID NO: 190643 - DNA, 25 bp, Mus musculus
agatctcgaaacggtaataagccag

SEQ ID NO: 190644 - DNA, 25 bp, Mus musculus
agatctcgaaacttcagaggatgaa

SEQ ID NO: 190645 - DNA, 25 bp, Mus musculus
agatctcgcctgtggttggtgacaa

SEQ ID NO: 190646 - DNA, 25 bp, Mus musculus
agatctcgctcaagaagtcctgaca

SEQ ID NO: 190647 - DNA, 25 bp, Mus musculus
agatctctacagaggaaggcattac

SEQ ID NO: 190648 - DNA, 25 bp, Mus musculus
agatctctacaggtagggacccgaa

SEQ ID NO: 190649 - DNA, 25 bp, Mus musculus
agatctctatggtcccttttggata

SEQ ID NO: 190650 - DNA, 25 bp, Mus musculus
agatctctcaggggagacccagcgg

SEQ ID NO: 190651 - DNA, 25 bp, Mus musculus
agatctctcaggggatcatgaggga

SEQ ID NO: 190652 - DNA, 25 bp, Mus musculus
agatctctggaagggtttctctgta

SEQ ID NO: 190653 - DNA, 25 bp, Mus musculus
agatctctggaaggtgagcctcagg

SEQ ID NO: 190654 - DNA, 25 bp, Mus musculus
agatctctgtacgcatgtgacacca

SEQ ID NO: 190655 - DNA, 25 bp, Mus musculus
agatctctgtggcaaggattaatgt

SEQ ID NO: 190656 - DNA, 25 bp, Mus musculus
agatctctgtgtggagctggcctga

SEQ ID NO: 190657 - DNA, 25 bp, Mus musculus
agatctgaaagttgggatggctacc

SEQ ID NO: 190658 - DNA, 25 bp, Mus musculus
agatctgaattcaagggaaacaact

SEQ ID NO: 190659 - DNA, 25 bp, Mus musculus
agatctgacaaggacccacattgtg

SEQ ID NO: 190660 - DNA, 25 bp, Mus musculus
agatctgacccaagagattgctatg

SEQ ID NO: 190661 - DNA, 25 bp, Mus musculus
agatctgacccaagcttatgatgga

SEQ ID NO: 190662 - DNA, 25 bp, Mus musculus
agatctgcaaaatcatggaccaggc

SEQ ID NO: 190663 - DNA, 25 bp, Mus musculus
agatctgcactgaacagtcaaattc

SEQ ID NO: 190664 - DNA, 25 bp, Mus musculus
agatctgcagggcgacactccccgg

SEQ ID NO: 190665 - DNA, 25 bp, Mus musculus
agatctgcattcacacaaatagcat

SEQ ID NO: 190666 - DNA, 25 bp, Mus musculus
agatctgcattcacacaattaccag

SEQ ID NO: 190667 - DNA, 25 bp, Mus musculus
agatctgcccagaggacgaggcgga

SEQ ID NO: 190668 - DNA, 25 bp, Mus musculus
agatctgccggatcatgcgtccaga

SEQ ID NO: 190669 - DNA, 25 bp, Mus musculus
agatctgccgggctgcctctagctg

SEQ ID NO: 190670 - DNA, 25 bp, Mus musculus
agatctgcctcagagaacatgagct

SEQ ID NO: 190671 - DNA, 25 bp, Mus musculus
agatctgcctcagagcacctacgct

SEQ ID NO: 190672 - DNA, 25 bp, Mus musculus
agatctgccttcagaaaaaatgctg

SEQ ID NO: 190673 - DNA, 25 bp, Mus musculus
agatctgctcatccgctcccatctc

SEQ ID NO: 190674 - DNA, 25 bp, Mus musculus
agatctggaaaacaggcccacagaa

SEQ ID NO: 190675 - DNA, 25 bp, Mus musculus
agatctggaagtgccaaagtagaag

SEQ ID NO: 190676 - DNA, 25 bp, Mus musculus
agatctggagttacggtgaaactag

SEQ ID NO: 190677 - DNA, 25 bp, Mus musculus
agatctggcaggccctcagaatatg

SEQ ID NO: 190678 - DNA, 25 bp, Mus musculus
agatctggcaggggactctcctgct

SEQ ID NO: 190679 - DNA, 25 bp, Mus musculus
agatctggcgggcaatggtgaatga

SEQ ID NO: 190680 - DNA, 25 bp, Mus musculus
agatctgtgacgggtttcgtgctac

SEQ ID NO: 190681 - DNA, 25 bp, Mus musculus
agatctgtgaggaaggtctacgagt

SEQ ID NO: 190682 - DNA, 25 bp, Mus musculus
agatctgtgcacagactgactttgc

SEQ ID NO: 190683 - DNA, 25 bp, Mus musculus
agatctgttgaagagcaagttgctc

SEQ ID NO: 190684 - DNA, 25 bp, Mus musculus
agatctgttttagcaatcccacagg

SEQ ID NO: 190685 - DNA, 25 bp, Mus musculus
agatcttaaaggttgccaggatgca

SEQ ID NO: 190686 - DNA, 25 bp, Mus musculus
agatcttaaggacctggggattccg

SEQ ID NO: 190687 - DNA, 25 bp, Mus musculus
agatcttaccaagattctaaggtga

SEQ ID NO: 190688 - DNA, 25 bp, Mus musculus
agatcttattccagtcccactcact

SEQ ID NO: 190689 - DNA, 25 bp, Mus musculus
agatcttcaaggcctgggctgtggc

SEQ ID NO: 190690 - DNA, 25 bp, Mus musculus
agatcttcacaggagagagactgag

SEQ ID NO: 190691 - DNA, 25 bp, Mus musculus
agatcttccaagattagaacaccta

SEQ ID NO: 190692 - DNA, 25 bp, Mus musculus
agatcttcgatttcaacagctttga

SEQ ID NO: 190693 - DNA, 25 bp, Mus musculus
agatcttctatggagagaaacaacc

SEQ ID NO: 190694 - DNA, 25 bp, Mus musculus
agatcttctcagtcctagaccaaag

SEQ ID NO: 190695 - DNA, 25 bp, Mus musculus
agatcttctgattcctgccgtttgt

SEQ ID NO: 190696 - DNA, 25 bp, Mus musculus
agatcttctggagagaagtgtgctg

SEQ ID NO: 190697 - DNA, 25 bp, Mus musculus
agatcttctggagagggcatcatgg

SEQ ID NO: 190698 - DNA, 25 bp, Mus musculus
agatcttctggcacagcttgccctg

SEQ ID NO: 190699 - DNA, 25 bp, Mus musculus
agatcttgaagccatgatcaaagct

SEQ ID NO: 190700 - DNA, 25 bp, Mus musculus
agatcttgaaggataccagaatacc

SEQ ID NO: 190701 - DNA, 25 bp, Mus musculus
agatcttgatctaggccttcctata

SEQ ID NO: 190702 - DNA, 25 bp, Mus musculus
agatcttgcttagatggcaggttca

SEQ ID NO: 190703 - DNA, 25 bp, Mus musculus
agatcttggaggactccctgcagtg

SEQ ID NO: 190704 - DNA, 25 bp, Mus musculus
agatcttgtggtcaagagcaatctg

SEQ ID NO: 190705 - DNA, 25 bp, Mus musculus
agatctttaaaaggctactgaaaga

SEQ ID NO: 190706 - DNA, 25 bp, Mus musculus
agatctttcctggctagaccacatt

SEQ ID NO: 190707 - DNA, 25 bp, Mus musculus
agatctttcctggtccatcaacctg

SEQ ID NO: 190708 - DNA, 25 bp, Mus musculus
agatctttgacaagcactataagac

SEQ ID NO: 190709 - DNA, 25 bp, Mus musculus
agatctttgagaatccccggcagcc

SEQ ID NO: 190710 - DNA, 25 bp, Mus musculus
agatcttttcgcagaagccacagaa

SEQ ID NO: 190711 - DNA, 25 bp, Mus musculus
agatctttttaaaaagtgtgttcaa

SEQ ID NO: 190712 - DNA, 25 bp, Mus musculus
agatgaaacaaagatgcccttagac

SEQ ID NO: 190713 - DNA, 25 bp, Mus musculus
agatgaaaccttccgacttgtctca

SEQ ID NO: 190714 - DNA, 25 bp, Mus musculus
agatgaaactgctgccacaggtgac

SEQ ID NO: 190715 - DNA, 25 bp, Mus musculus
agatgaaatcaagaatctcgatctg

SEQ ID NO: 190716 - DNA, 25 bp, Mus musculus
agatgaaatcaaggttccgtgttgc

SEQ ID NO: 190717 - DNA, 25 bp, Mus musculus
agatgaaatcaagtatgcaacccag

SEQ ID NO: 190718 - DNA, 25 bp, Mus musculus
agatgaaatcacagaactagacacc

SEQ ID NO: 190719 - DNA, 25 bp, Mus musculus
agatgaaatcacaggtcctgctgtc

SEQ ID NO: 190720 - DNA, 25 bp, Mus musculus
agatgaaatcccaggtgatgacaca

SEQ ID NO: 190721 - DNA, 25 bp, Mus musculus
agatgaaatttcaggtcacgttcat

SEQ ID NO: 190722 - DNA, 25 bp, Mus musculus
agatgaacagatttgccagggagat

SEQ ID NO: 190723 - DNA, 25 bp, Mus musculus
agatgaacagcaattatagtgaaca

SEQ ID NO: 190724 - DNA, 25 bp, Mus musculus
agatgaacagggagcattggcggct

SEQ ID NO: 190725 - DNA, 25 bp, Mus musculus
agatgaacagttaatgtctgattgt

SEQ ID NO: 190726 - DNA, 25 bp, Mus musculus
agatgaacctggaaggccaaatcct

SEQ ID NO: 190727 - DNA, 25 bp, Mus musculus
agatgaacctgtcctaaaggaaatc

SEQ ID NO: 190728 - DNA, 25 bp, Mus musculus
agatgaacttgggaatgtacctgaa

SEQ ID NO: 190729 - DNA, 25 bp, Mus musculus
agatgaacttgggttttatgattcc

SEQ ID NO: 190730 - DNA, 25 bp, Mus musculus
agatgaagaaaagcccctttcctcg

SEQ ID NO: 190731 - DNA, 25 bp, Mus musculus
agatgaagaaaagcgcagaagagca

SEQ ID NO: 190732 - DNA, 25 bp, Mus musculus
agatgaagacagggaacagacatcc

SEQ ID NO: 190733 - DNA, 25 bp, Mus musculus
agatgaagacagttcagagtgcagt

SEQ ID NO: 190734 - DNA, 25 bp, Mus musculus
agatgaagaggagagtgatgctgtt

SEQ ID NO: 190735 - DNA, 25 bp, Mus musculus
agatgaagctgagagcactctgtgg

SEQ ID NO: 190736 - DNA, 25 bp, Mus musculus
agatgaaggagaaggaggaggtaaa

SEQ ID NO: 190737 - DNA, 25 bp, Mus musculus
agatgaaggagagcccatcgcacct

SEQ ID NO: 190738 - DNA, 25 bp, Mus musculus
agatgaaggatgatgaggaatttaa

SEQ ID NO: 190739 - DNA, 25 bp, Mus musculus
agatgaagggcagagggaaggctcc

SEQ ID NO: 190740 - DNA, 25 bp, Mus musculus
agatgaagggcaggctccggcttcg

SEQ ID NO: 190741 - DNA, 25 bp, Mus musculus
agatgaagtacaagaatcttatggc

SEQ ID NO: 190742 - DNA, 25 bp, Mus musculus
agatgaagtagacagcctgatgtgt

SEQ ID NO: 190743 - DNA, 25 bp, Mus musculus
agatgaagtagacaggcattggact

SEQ ID NO: 190744 - DNA, 25 bp, Mus musculus
agatgaagtcagagggtgctggtga

SEQ ID NO: 190745 - DNA, 25 bp, Mus musculus
agatgaagtcctggcctgcagctga

SEQ ID NO: 190746 - DNA, 25 bp, Mus musculus
agatgaagtgacttcaatccccgac

SEQ ID NO: 190747 - DNA, 25 bp, Mus musculus
agatgaagtgatgactcgttggcta

SEQ ID NO: 190748 - DNA, 25 bp, Mus musculus
agatgaatagcccagccaagcggct

SEQ ID NO: 190749 - DNA, 25 bp, Mus musculus
agatgaatatccagagactaagtct

SEQ ID NO: 190750 - DNA, 25 bp, Mus musculus
agatgaatatgaaaaggtggacaag

SEQ ID NO: 190751 - DNA, 25 bp, Mus musculus
agatgaattacaggaaatgcttgat

SEQ ID NO: 190752 - DNA, 25 bp, Mus musculus
agatgaatttcagactctgaattcg

SEQ ID NO: 190753 - DNA, 25 bp, Mus musculus
agatgacaaccccaagcatccaaca

SEQ ID NO: 190754 - DNA, 25 bp, Mus musculus
agatgacaagacagttcccttcagc

SEQ ID NO: 190755 - DNA, 25 bp, Mus musculus
agatgacaatgggggtgaagcttct

SEQ ID NO: 190756 - DNA, 25 bp, Mus musculus
agatgacacagaccattctttaaag

SEQ ID NO: 190757 - DNA, 25 bp, Mus musculus
agatgacagcaacttcaaagctgtg

SEQ ID NO: 190758 - DNA, 25 bp, Mus musculus
agatgacagcagaagtccataactt

SEQ ID NO: 190759 - DNA, 25 bp, Mus musculus
agatgacagcagccttcaagggttc

SEQ ID NO: 190760 - DNA, 25 bp, Mus musculus
agatgacagggcggaacttgccaag

SEQ ID NO: 190761 - DNA, 25 bp, Mus musculus
agatgacatccctttcttgagatgc

SEQ ID NO: 190762 - DNA, 25 bp, Mus musculus
agatgacatcgggaggaatgctgtg

SEQ ID NO: 190763 - DNA, 25 bp, Mus musculus
agatgaccaaaagggcaacatcccc

SEQ ID NO: 190764 - DNA, 25 bp, Mus musculus
agatgaccaaacgttagaaaagtcc

SEQ ID NO: 190765 - DNA, 25 bp, Mus musculus
agatgaccagcaaactcacccagga

SEQ ID NO: 190766 - DNA, 25 bp, Mus musculus
agatgacccaggagttgcaagcaca

SEQ ID NO: 190767 - DNA, 25 bp, Mus musculus
agatgaccggaagtcactggtgacg

SEQ ID NO: 190768 - DNA, 25 bp, Mus musculus
agatgaccgtgccgaacgtgctggc

SEQ ID NO: 190769 - DNA, 25 bp, Mus musculus
agatgacctaggaaacacactggag

SEQ ID NO: 190770 - DNA, 25 bp, Mus musculus
agatgacctccaagggcccaatgta

SEQ ID NO: 190771 - DNA, 25 bp, Mus musculus
agatgacctttaagaggtgtgctga

SEQ ID NO: 190772 - DNA, 25 bp, Mus musculus
agatgaccttttcggggtcatcttg

SEQ ID NO: 190773 - DNA, 25 bp, Mus musculus
agatgacgacaagactggccaggtc

SEQ ID NO: 190774 - DNA, 25 bp, Mus musculus
agatgactaagatgctaaaaggatt

SEQ ID NO: 190775 - DNA, 25 bp, Mus musculus
agatgactcaacgggggggcagtgc

SEQ ID NO: 190776 - DNA, 25 bp, Mus musculus
agatgactcagaagaaaaaaagtat

SEQ ID NO: 190777 - DNA, 25 bp, Mus musculus
agatgactcagaagctcttgtcctg

SEQ ID NO: 190778 - DNA, 25 bp, Mus musculus
agatgactgccttgggctggtgaga

SEQ ID NO: 190779 - DNA, 25 bp, Mus musculus
agatgacttaccgattctgttccca

SEQ ID NO: 190780 - DNA, 25 bp, Mus musculus
agatgacttcagatggaggctggac

SEQ ID NO: 190781 - DNA, 25 bp, Mus musculus
agatgagaaaggtcatttactacat

SEQ ID NO: 190782 - DNA, 25 bp, Mus musculus
agatgagaatgacaggagccatccg

SEQ ID NO: 190783 - DNA, 25 bp, Mus musculus
agatgagaatgcacctgtctgctcc

SEQ ID NO: 190784 - DNA, 25 bp, Mus musculus
agatgagaattttacagaatcctga

SEQ ID NO: 190785 - DNA, 25 bp, Mus musculus
agatgagacaggagacaatcaggct

SEQ ID NO: 190786 - DNA, 25 bp, Mus musculus
agatgagacgggcatagaacaattg

SEQ ID NO: 190787 - DNA, 25 bp, Mus musculus
agatgagacgggtattgaacgcctc

SEQ ID NO: 190788 - DNA, 25 bp, Mus musculus
agatgagagaaaacttttatccatg

SEQ ID NO: 190789 - DNA, 25 bp, Mus musculus
agatgagagaaaaggcctgctggtg

SEQ ID NO: 190790 - DNA, 25 bp, Mus musculus
agatgagaggatgcctcctggaaca

SEQ ID NO: 190791 - DNA, 25 bp, Mus musculus
agatgagagggaagagtgtattggg

SEQ ID NO: 190792 - DNA, 25 bp, Mus musculus
agatgagagtgagagaggcatgaaa

SEQ ID NO: 190793 - DNA, 25 bp, Mus musculus
agatgagatacaagggtcaatatag

SEQ ID NO: 190794 - DNA, 25 bp, Mus musculus
agatgagatacaaggtgtagtggct

SEQ ID NO: 190795 - DNA, 25 bp, Mus musculus
agatgagatcctgggcaacttcact

SEQ ID NO: 190796 - DNA, 25 bp, Mus musculus
agatgagattagcattaagaagaag

SEQ ID NO: 190797 - DNA, 25 bp, Mus musculus
agatgagattgactgggaaacagaa

SEQ ID NO: 190798 - DNA, 25 bp, Mus musculus
agatgagattgatgatgaatatgaa

SEQ ID NO: 190799 - DNA, 25 bp, Mus musculus
agatgagcaagttctatagtccacc

SEQ ID NO: 190800 - DNA, 25 bp, Mus musculus
agatgagcagcctaacatccactta

SEQ ID NO: 190801 - DNA, 25 bp, Mus musculus
agatgagcaggagccggccccgtga

SEQ ID NO: 190802 - DNA, 25 bp, Mus musculus
agatgagcaggctaacatccactta

SEQ ID NO: 190803 - DNA, 25 bp, Mus musculus
agatgagctacttgaaaagtaaaga

SEQ ID NO: 190804 - DNA, 25 bp, Mus musculus
agatgagctggatccagccatatta

SEQ ID NO: 190805 - DNA, 25 bp, Mus musculus
agatgaggagaaaaagttacgtcga

SEQ ID NO: 190806 - DNA, 25 bp, Mus musculus
agatgaggatagggttgtcgatgag

SEQ ID NO: 190807 - DNA, 25 bp, Mus musculus
agatgaggcttacagatttgtgaaa

SEQ ID NO: 190808 - DNA, 25 bp, Mus musculus
agatgaggcttacaggcggcagaag

SEQ ID NO: 190809 - DNA, 25 bp, Mus musculus
agatgagtaagctcaatcagaacct

SEQ ID NO: 190810 - DNA, 25 bp, Mus musculus
agatgagtatgggaagagtcactcc

SEQ ID NO: 190811 - DNA, 25 bp, Mus musculus
agatgagtcaagattactatgacat

SEQ ID NO: 190812 - DNA, 25 bp, Mus musculus
agatgagtcaagccgagatgactga

SEQ ID NO: 190813 - DNA, 25 bp, Mus musculus
agatgagtctcaggaacctgacaga

SEQ ID NO: 190814 - DNA, 25 bp, Mus musculus
agatgagtctcaggttccacgagta

SEQ ID NO: 190815 - DNA, 25 bp, Mus musculus
agatgagtgatgaaaacaacgaatt

SEQ ID NO: 190816 - DNA, 25 bp, Mus musculus
agatgagtgatgctgcaggtgattt

SEQ ID NO: 190817 - DNA, 25 bp, Mus musculus
agatgagttagagagagagagagag

SEQ ID NO: 190818 - DNA, 25 bp, Mus musculus
agatgagttcaaggccttgctgtat

SEQ ID NO: 190819 - DNA, 25 bp, Mus musculus
agatgagttcaaggtggtggtcgtg

SEQ ID NO: 190820 - DNA, 25 bp, Mus musculus
agatgataaggagagaccccctttc

SEQ ID NO: 190821 - DNA, 25 bp, Mus musculus
agatgataaggtccagagttcaaat

SEQ ID NO: 190822 - DNA, 25 bp, Mus musculus
agatgataatgagtattctagtcaa

SEQ ID NO: 190823 - DNA, 25 bp, Mus musculus
agatgatagcctcgtggaactggaa

SEQ ID NO: 190824 - DNA, 25 bp, Mus musculus
agatgatatgctggacaaatttgcc

SEQ ID NO: 190825 - DNA, 25 bp, Mus musculus
agatgatatggagagcaccacttca

SEQ ID NO: 190826 - DNA, 25 bp, Mus musculus
agatgatatggcccactatgacttg

SEQ ID NO: 190827 - DNA, 25 bp, Mus musculus
agatgatcaatggtcgtagttatga

SEQ ID NO: 190828 - DNA, 25 bp, Mus musculus
agatgatcaattcgtagttatgatg

SEQ ID NO: 190829 - DNA, 25 bp, Mus musculus
agatgatcagagtggtaagaaaagt

SEQ ID NO: 190830 - DNA, 25 bp, Mus musculus
agatgatcaggagttagtgagcttt

SEQ ID NO: 190831 - DNA, 25 bp, Mus musculus
agatgatccgagaggccttggaagc

SEQ ID NO: 190832 - DNA, 25 bp, Mus musculus
agatgatccgccagtttacagacct

SEQ ID NO: 190833 - DNA, 25 bp, Mus musculus
agatgatctctgggacctggaattc

SEQ ID NO: 190834 - DNA, 25 bp, Mus musculus
agatgatctttaagaatggtcctcc

SEQ ID NO: 190835 - DNA, 25 bp, Mus musculus
agatgatctttaagaatggtgacaa

SEQ ID NO: 190836 - DNA, 25 bp, Mus musculus
agatgatgaaaaacgtgaagcttcc

SEQ ID NO: 190837 - DNA, 25 bp, Mus musculus
agatgatgaaagccctctctatagc

SEQ ID NO: 190838 - DNA, 25 bp, Mus musculus
agatgatgaagatcgctgagatccg

SEQ ID NO: 190839 - DNA, 25 bp, Mus musculus
agatgatgacgatggtctcccttct

SEQ ID NO: 190840 - DNA, 25 bp, Mus musculus
agatgatgaggctgagaaggcagac

SEQ ID NO: 190841 - DNA, 25 bp, Mus musculus
agatgatgagtctgatgacagtcaa

SEQ ID NO: 190842 - DNA, 25 bp, Mus musculus
agatgatgatcaggaatctagagaa

SEQ ID NO: 190843 - DNA, 25 bp, Mus musculus
agatgatgatgagaagggcaggtcc

SEQ ID NO: 190844 - DNA, 25 bp, Mus musculus
agatgatgcaagggttctggaatac

SEQ ID NO: 190845 - DNA, 25 bp, Mus musculus
agatgatgcagaacatgttggagca

SEQ ID NO: 190846 - DNA, 25 bp, Mus musculus
agatgatggaacaagacttgatttc

SEQ ID NO: 190847 - DNA, 25 bp, Mus musculus
agatgatggaacaagtgcatggagg

SEQ ID NO: 190848 - DNA, 25 bp, Mus musculus
agatgatggacaagaaaaagaataa

SEQ ID NO: 190849 - DNA, 25 bp, Mus musculus
agatgatggacaaggtggagtttgt

SEQ ID NO: 190850 - DNA, 25 bp, Mus musculus
agatgatggacaggaaacagacagc

SEQ ID NO: 190851 - DNA, 25 bp, Mus musculus
agatgatggaccatgaagcaaagct

SEQ ID NO: 190852 - DNA, 25 bp, Mus musculus
agatgatggcgagtcattcgacgtg

SEQ ID NO: 190853 - DNA, 25 bp, Mus musculus
agatgatggctgagatccggggttc

SEQ ID NO: 190854 - DNA, 25 bp, Mus musculus
agatgatgtccaagtacaaatatag

SEQ ID NO: 190855 - DNA, 25 bp, Mus musculus
agatgatgttggtgatctgaaaaca

SEQ ID NO: 190856 - DNA, 25 bp, Mus musculus
agatgattttggaagttgctttaaa

SEQ ID NO: 190857 - DNA, 25 bp, Mus musculus
agatgcaaagttctgctttcacttt

SEQ ID NO: 190858 - DNA, 25 bp, Mus musculus
agatgcaatcaaagttgtcctgggg

SEQ ID NO: 190859 - DNA, 25 bp, Mus musculus
agatgcacaaacaggcggaaattgt

SEQ ID NO: 190860 - DNA, 25 bp, Mus musculus
agatgcacaaacagtgccccaggta

SEQ ID NO: 190861 - DNA, 25 bp, Mus musculus
agatgcacaaccaggcggaaattgt

SEQ ID NO: 190862 - DNA, 25 bp, Mus musculus
agatgcacaaggccacagatgactg

SEQ ID NO: 190863 - DNA, 25 bp, Mus musculus
agatgcacaagttcatattctctct

SEQ ID NO: 190864 - DNA, 25 bp, Mus musculus
agatgcacagatttgacataattga

SEQ ID NO: 190865 - DNA, 25 bp, Mus musculus
agatgcacatatggatgcatctgga

SEQ ID NO: 190866 - DNA, 25 bp, Mus musculus
agatgcacatcctcttctagaaaac

SEQ ID NO: 190867 - DNA, 25 bp, Mus musculus
agatgcagaaattgctgcccgggaa

SEQ ID NO: 190868 - DNA, 25 bp, Mus musculus
agatgcagaagacggacaagacgat

SEQ ID NO: 190869 - DNA, 25 bp, Mus musculus
agatgcagaagtgtatgagagagga

SEQ ID NO: 190870 - DNA, 25 bp, Mus musculus
agatgcagaagttcctgctttgtat

SEQ ID NO: 190871 - DNA, 25 bp, Mus musculus
agatgcagacaaagatggggcaaat

SEQ ID NO: 190872 - DNA, 25 bp, Mus musculus
agatgcagacaggcttcgccggcag

SEQ ID NO: 190873 - DNA, 25 bp, Mus musculus
agatgcagacagtgtggcatcagct

SEQ ID NO: 190874 - DNA, 25 bp, Mus musculus
agatgcagactaaaggcatgcagta

SEQ ID NO: 190875 - DNA, 25 bp, Mus musculus
agatgcagactaaaggtgttgacag

SEQ ID NO: 190876 - DNA, 25 bp, Mus musculus
agatgcagatggtgaaagtgatgaa

SEQ ID NO: 190877 - DNA, 25 bp, Mus musculus
agatgcagccgctggatccagccgc

SEQ ID NO: 190878 - DNA, 25 bp, Mus musculus
agatgcaggagaagattcgatgaaa

SEQ ID NO: 190879 - DNA, 25 bp, Mus musculus
agatgcaggaggattggaagctgac

SEQ ID NO: 190880 - DNA, 25 bp, Mus musculus
agatgcaggagtgagattatatagt

SEQ ID NO: 190881 - DNA, 25 bp, Mus musculus
agatgcagggctgctaaccccgaga

SEQ ID NO: 190882 - DNA, 25 bp, Mus musculus
agatgcagggctgctctagaagtca

SEQ ID NO: 190883 - DNA, 25 bp, Mus musculus
agatgcataaacaggctgagattgt

SEQ ID NO: 190884 - DNA, 25 bp, Mus musculus
agatgcataaacaggctgagatttg

SEQ ID NO: 190885 - DNA, 25 bp, Mus musculus
agatgccaaatagaccttctggacc

SEQ ID NO: 190886 - DNA, 25 bp, Mus musculus
agatgccaaattggatgaatatatc

SEQ ID NO: 190887 - DNA, 25 bp, Mus musculus
agatgccacagcccgtgttcctctt

SEQ ID NO: 190888 - DNA, 25 bp, Mus musculus
agatgccacagctcccaacccctcc

SEQ ID NO: 190889 - DNA, 25 bp, Mus musculus
agatgccagcgccgctttcccgaaa

SEQ ID NO: 190890 - DNA, 25 bp, Mus musculus
agatgccaggatgttgatgaatgtg

SEQ ID NO: 190891 - DNA, 25 bp, Mus musculus
agatgccaggttgttgatgaatgtg

SEQ ID NO: 190892 - DNA, 25 bp, Mus musculus
agatgccagttaatgcttcaaactg

SEQ ID NO: 190893 - DNA, 25 bp, Mus musculus
agatgcccaagagcgatctagggcg

SEQ ID NO: 190894 - DNA, 25 bp, Mus musculus
agatgcccaccagagcgagtacatt

SEQ ID NO: 190895 - DNA, 25 bp, Mus musculus
agatgcccaccagttgacagggctg

SEQ ID NO: 190896 - DNA, 25 bp, Mus musculus
agatgcccagatcatgagccacggg

SEQ ID NO: 190897 - DNA, 25 bp, Mus musculus
agatgcccagcaccccttggggaaa

SEQ ID NO: 190898 - DNA, 25 bp, Mus musculus
agatgcccaggaaatagcagacacc

SEQ ID NO: 190899 - DNA, 25 bp, Mus musculus
agatgcccaggtggctgctgagatc

SEQ ID NO: 190900 - DNA, 25 bp, Mus musculus
agatgccccaaatattcttacaagc

SEQ ID NO: 190901 - DNA, 25 bp, Mus musculus
agatgccccagctgaaaaaaaaccc

SEQ ID NO: 190902 - DNA, 25 bp, Mus musculus
agatgccccagctgagaaaaaacgc

SEQ ID NO: 190903 - DNA, 25 bp, Mus musculus
agatgccgacttggacattgctgtt

SEQ ID NO: 190904 - DNA, 25 bp, Mus musculus
agatgcctgagggcaggatggccca

SEQ ID NO: 190905 - DNA, 25 bp, Mus musculus
agatgcctttgacgtcctattacca

SEQ ID NO: 190906 - DNA, 25 bp, Mus musculus
agatgcgaagatgtggatgagtgtg

SEQ ID NO: 190907 - DNA, 25 bp, Mus musculus
agatgcgaagttgtggatgagtgtg

SEQ ID NO: 190908 - DNA, 25 bp, Mus musculus
agatgcgccccagcgccctgtgtgt

SEQ ID NO: 190909 - DNA, 25 bp, Mus musculus
agatgcgggcgtcggttgggtttct

SEQ ID NO: 190910 - DNA, 25 bp, Mus musculus
agatgcggtggacaccaaagtgaat

SEQ ID NO: 190911 - DNA, 25 bp, Mus musculus
agatgcggtggtggtacgcctggag

SEQ ID NO: 190912 - DNA, 25 bp, Mus musculus
agatgctaaatatgttctagaagcc

SEQ ID NO: 190913 - DNA, 25 bp, Mus musculus
agatgctaaggatgatctgatgatg

SEQ ID NO: 190914 - DNA, 25 bp, Mus musculus
agatgctaatggcccagatggagtt

SEQ ID NO: 190915 - DNA, 25 bp, Mus musculus
agatgctaatggcctctttatggca

SEQ ID NO: 190916 - DNA, 25 bp, Mus musculus
agatgctaatggcctggtccagatc

SEQ ID NO: 190917 - DNA, 25 bp, Mus musculus
agatgctaccggtactaaacagacc

SEQ ID NO: 190918 - DNA, 25 bp, Mus musculus
agatgctagaagaatataaaaatag

SEQ ID NO: 190919 - DNA, 25 bp, Mus musculus
agatgctagaaggtcccttcagcac

SEQ ID NO: 190920 - DNA, 25 bp, Mus musculus
agatgctaggagttaaccagcttat

SEQ ID NO: 190921 - DNA, 25 bp, Mus musculus
agatgctagggtaataatcttcagt

SEQ ID NO: 190922 - DNA, 25 bp, Mus musculus
agatgctcagcaaccagacctcatg

SEQ ID NO: 190923 - DNA, 25 bp, Mus musculus
agatgctcagcaagccccgcccaac

SEQ ID NO: 190924 - DNA, 25 bp, Mus musculus
agatgctcaggtatgggcttatttt

SEQ ID NO: 190925 - DNA, 25 bp, Mus musculus
agatgctcgggctgtcatttcgctg

SEQ ID NO: 190926 - DNA, 25 bp, Mus musculus
agatgctctcacaggtccgctacag

SEQ ID NO: 190927 - DNA, 25 bp, Mus musculus
agatgctgaaattggatgcaaaaca

SEQ ID NO: 190928 - DNA, 25 bp, Mus musculus
agatgctgacaaagcaaatgaaaag

SEQ ID NO: 190929 - DNA, 25 bp, Mus musculus
agatgctgacatggtcaaccagtac

SEQ ID NO: 190930 - DNA, 25 bp, Mus musculus
agatgctgagagctctggtgtactt

SEQ ID NO: 190931 - DNA, 25 bp, Mus musculus
agatgctgagctgtcgatgccaccg

SEQ ID NO: 190932 - DNA, 25 bp, Mus musculus
agatgctgagggtggttagaaagct

SEQ ID NO: 190933 - DNA, 25 bp, Mus musculus
agatgctgcaggcaccagaaagcat

SEQ ID NO: 190934 - DNA, 25 bp, Mus musculus
agatgctgcaggtctgggaaggccc

SEQ ID NO: 190935 - DNA, 25 bp, Mus musculus
agatgctgccttttcctgggatcag

SEQ ID NO: 190936 - DNA, 25 bp, Mus musculus
agatgctgggtggagagatcattcc

SEQ ID NO: 190937 - DNA, 25 bp, Mus musculus
agatgctgtcagggatggtgaagag

SEQ ID NO: 190938 - DNA, 25 bp, Mus musculus
agatgctgtctatgtactgtgctac

SEQ ID NO: 190939 - DNA, 25 bp, Mus musculus
agatgcttacagctcaaaggtgaca

SEQ ID NO: 190940 - DNA, 25 bp, Mus musculus
agatgcttaggagagtgacagctag

SEQ ID NO: 190941 - DNA, 25 bp, Mus musculus
agatgcttcagattctgaagggagt

SEQ ID NO: 190942 - DNA, 25 bp, Mus musculus
agatgcttcagcaggagctgctaag

SEQ ID NO: 190943 - DNA, 25 bp, Mus musculus
agatgcttcaggactctctgattct

SEQ ID NO: 190944 - DNA, 25 bp, Mus musculus
agatgcttctgtactcacttctgct

SEQ ID NO: 190945 - DNA, 25 bp, Mus musculus
agatgcttctgtggcctacctgttt

SEQ ID NO: 190946 - DNA, 25 bp, Mus musculus
agatgcttgagaagatgaggtgaac

SEQ ID NO: 190947 - DNA, 25 bp, Mus musculus
agatgcttgccacagagcccttgct

SEQ ID NO: 190948 - DNA, 25 bp, Mus musculus
agatgcttgccacaggagacgtggc

SEQ ID NO: 190949 - DNA, 25 bp, Mus musculus
agatgcttgtcccctgctctgccgc

SEQ ID NO: 190950 - DNA, 25 bp, Mus musculus
agatggaaaaaagggaacgaagagc

SEQ ID NO: 190951 - DNA, 25 bp, Mus musculus
agatggaaaaaagggtggccggcaa

SEQ ID NO: 190952 - DNA, 25 bp, Mus musculus
agatggaaaagcaaaaggtggcgcg

SEQ ID NO: 190953 - DNA, 25 bp, Mus musculus
agatggaaaagctggtggacaataa

SEQ ID NO: 190954 - DNA, 25 bp, Mus musculus
agatggaaaaggtggcgcgttactt

SEQ ID NO: 190955 - DNA, 25 bp, Mus musculus
agatggaaaccagcaggtgcagcag

SEQ ID NO: 190956 - DNA, 25 bp, Mus musculus
agatggaaaccaggacaagaagaca

SEQ ID NO: 190957 - DNA, 25 bp, Mus musculus
agatggaaaggtcgtgtcttatgca

SEQ ID NO: 190958 - DNA, 25 bp, Mus musculus
agatggaaaggtgtcgcaacatccc

SEQ ID NO: 190959 - DNA, 25 bp, Mus musculus
agatggaacaagtaaggatagatgg

SEQ ID NO: 190960 - DNA, 25 bp, Mus musculus
agatggaagaaaagttcctagtctc

SEQ ID NO: 190961 - DNA, 25 bp, Mus musculus
agatggaagaagccctctgggcgtg

SEQ ID NO: 190962 - DNA, 25 bp, Mus musculus
agatggaagatcaccgcctccgaca

SEQ ID NO: 190963 - DNA, 25 bp, Mus musculus
agatggaagttgactgagcacgtga

SEQ ID NO: 190964 - DNA, 25 bp, Mus musculus
agatggaatctgtctctctcctctc

SEQ ID NO: 190965 - DNA, 25 bp, Mus musculus
agatggaatgaagaaaagcaatggg

SEQ ID NO: 190966 - DNA, 25 bp, Mus musculus
agatggaatggaaggccttgttacc

SEQ ID NO: 190967 - DNA, 25 bp, Mus musculus
agatggaatggataatcaaggagga

SEQ ID NO: 190968 - DNA, 25 bp, Mus musculus
agatggaattataagtactattaat

SEQ ID NO: 190969 - DNA, 25 bp, Mus musculus
agatggaattcctgggcatccaggg

SEQ ID NO: 190970 - DNA, 25 bp, Mus musculus
agatggacaggcagcgggcaggcac

SEQ ID NO: 190971 - DNA, 25 bp, Mus musculus
agatggagaaggaaaaacacagcca

SEQ ID NO: 190972 - DNA, 25 bp, Mus musculus
agatggagaatggtaccgcgcccgg

SEQ ID NO: 190973 - DNA, 25 bp, Mus musculus
agatggagacgagggctcttgtgtt

SEQ ID NO: 190974 - DNA, 25 bp, Mus musculus
agatggagagcagattgaaggtgct

SEQ ID NO: 190975 - DNA, 25 bp, Mus musculus
agatggagaggtgaggctgctggcc

SEQ ID NO: 190976 - DNA, 25 bp, Mus musculus
agatggagcaagtgatgacagactc

SEQ ID NO: 190977 - DNA, 25 bp, Mus musculus
agatggagccagagaacctacaaca

SEQ ID NO: 190978 - DNA, 25 bp, Mus musculus
agatggatacagccttccagagatt

SEQ ID NO: 190979 - DNA, 25 bp, Mus musculus
agatggatccctctatgctgtggga

SEQ ID NO: 190980 - DNA, 25 bp, Mus musculus
agatggatgaggaagacatggggat

SEQ ID NO: 190981 - DNA, 25 bp, Mus musculus
agatggatgattaaggactttctga

SEQ ID NO: 190982 - DNA, 25 bp, Mus musculus
agatggatggaaggggtgaccactg

SEQ ID NO: 190983 - DNA, 25 bp, Mus musculus
agatggatggagagaatgccacggt

SEQ ID NO: 190984 - DNA, 25 bp, Mus musculus
agatggatggagaggttacagctgt

SEQ ID NO: 190985 - DNA, 25 bp, Mus musculus
agatggatttcaaatctaaagcggg

SEQ ID NO: 190986 - DNA, 25 bp, Mus musculus
agatggatttgacggagccacggcc

SEQ ID NO: 190987 - DNA, 25 bp, Mus musculus
agatggattttaaggtgagactgtg

SEQ ID NO: 190988 - DNA, 25 bp, Mus musculus
agatggcaaagcaacagaaaagtaa

SEQ ID NO: 190989 - DNA, 25 bp, Mus musculus
agatggcaaaggaagactccctgat

SEQ ID NO: 190990 - DNA, 25 bp, Mus musculus
agatggcaaattttggtgctgggga

SEQ ID NO: 190991 - DNA, 25 bp, Mus musculus
agatggcaaggagctttggaacctc

SEQ ID NO: 190992 - DNA, 25 bp, Mus musculus
agatggcagagagtgcagcagctgc

SEQ ID NO: 190993 - DNA, 25 bp, Mus musculus
agatggcagagctcgtcagtgtcta

SEQ ID NO: 190994 - DNA, 25 bp, Mus musculus
agatggcagtggagcaaataagagg

SEQ ID NO: 190995 - DNA, 25 bp, Mus musculus
agatggcattgatggtgaccgaggt

SEQ ID NO: 190996 - DNA, 25 bp, Mus musculus
agatggccaaaacaagagttcaagt

SEQ ID NO: 190997 - DNA, 25 bp, Mus musculus
agatggccaagggcactcaacgctt

SEQ ID NO: 190998 - DNA, 25 bp, Mus musculus
agatggccaagtcaagctgtgatag

SEQ ID NO: 190999 - DNA, 25 bp, Mus musculus
agatggccatatacgcctactatta

SEQ ID NO: 191000 - DNA, 25 bp, Mus musculus
agatggcccaggtacttcaatttag

SEQ ID NO: 191001 - DNA, 25 bp, Mus musculus
agatggcccccatggttcagcatgg

SEQ ID NO: 191002 - DNA, 25 bp, Mus musculus
agatggcccctgttggcatcctcaa

SEQ ID NO: 191003 - DNA, 25 bp, Mus musculus
agatggcctcacagatccgtgaaga

SEQ ID NO: 191004 - DNA, 25 bp, Mus musculus
agatggcgaaattgggaaagaaagt

SEQ ID NO: 191005 - DNA, 25 bp, Mus musculus
agatggcgaatcaccgcctccgaca

SEQ ID NO: 191006 - DNA, 25 bp, Mus musculus
agatggcgctggcgatggagacctg

SEQ ID NO: 191007 - DNA, 25 bp, Mus musculus
agatggcggacagtttcctgtggcc

SEQ ID NO: 191008 - DNA, 25 bp, Mus musculus
agatggcgggccggactatgcaagc

SEQ ID NO: 191009 - DNA, 25 bp, Mus musculus
agatggcgggccgggtttctgttga

SEQ ID NO: 191010 - DNA, 25 bp, Mus musculus
agatggctaagtgggccctgcatta

SEQ ID NO: 191011 - DNA, 25 bp, Mus musculus
agatggctagcctatgtctcaggta

SEQ ID NO: 191012 - DNA, 25 bp, Mus musculus
agatggctaggagtaaaaatggctt

SEQ ID NO: 191013 - DNA, 25 bp, Mus musculus
agatggctagggaatgtggagctgg

SEQ ID NO: 191014 - DNA, 25 bp, Mus musculus
agatggctaggtacaaatggatgcc

SEQ ID NO: 191015 - DNA, 25 bp, Mus musculus
agatggctatccagatattgctgtt

SEQ ID NO: 191016 - DNA, 25 bp, Mus musculus
agatggctcagtgggctccgtgaag

SEQ ID NO: 191017 - DNA, 25 bp, Mus musculus
agatggctcatcagctggctctgtc

SEQ ID NO: 191018 - DNA, 25 bp, Mus musculus
agatggctgacagatctcggcaaaa

SEQ ID NO: 191019 - DNA, 25 bp, Mus musculus
agatggctgacagcttggatctgtc

SEQ ID NO: 191020 - DNA, 25 bp, Mus musculus
agatggctgtatttgaaaaaactgg

SEQ ID NO: 191021 - DNA, 25 bp, Mus musculus
agatggctgtatttggaatgggctg

SEQ ID NO: 191022 - DNA, 25 bp, Mus musculus
agatggcttcacctgggagaagaga

SEQ ID NO: 191023 - DNA, 25 bp, Mus musculus
agatggcttctctctcggtggagac

SEQ ID NO: 191024 - DNA, 25 bp, Mus musculus
agatggcttctctcttccacttgta

SEQ ID NO: 191025 - DNA, 25 bp, Mus musculus
agatgggaaggaaaaagtgtgagcg

SEQ ID NO: 191026 - DNA, 25 bp, Mus musculus
agatgggaagggaaaatgaacaagc

SEQ ID NO: 191027 - DNA, 25 bp, Mus musculus
agatgggacccaggctgccctgccc

SEQ ID NO: 191028 - DNA, 25 bp, Mus musculus
agatgggagaagagacaattgggaa

SEQ ID NO: 191029 - DNA, 25 bp, Mus musculus
agatgggagaccgggtgacactgga

SEQ ID NO: 191030 - DNA, 25 bp, Mus musculus
agatgggagcctctttttcctgcaa

SEQ ID NO: 191031 - DNA, 25 bp, Mus musculus
agatgggagtgaggtgacttctgtg

SEQ ID NO: 191032 - DNA, 25 bp, Mus musculus
agatgggatgcctggattctgcacg

SEQ ID NO: 191033 - DNA, 25 bp, Mus musculus
agatgggattcagaagataattgga

SEQ ID NO: 191034 - DNA, 25 bp, Mus musculus
agatgggattgatgatgattctgat

SEQ ID NO: 191035 - DNA, 25 bp, Mus musculus
agatgggcaagggtgaggaggggta

SEQ ID NO: 191036 - DNA, 25 bp, Mus musculus
agatgggcaaggtatcaatctattc

SEQ ID NO: 191037 - DNA, 25 bp, Mus musculus
agatgggccacgctctgtgcaccga

SEQ ID NO: 191038 - DNA, 25 bp, Mus musculus
agatgggccacggaactcatcttcg

SEQ ID NO: 191039 - DNA, 25 bp, Mus musculus
agatggggagtaaagacctgttgta

SEQ ID NO: 191040 - DNA, 25 bp, Mus musculus
agatggggagtaaagtggcagacct

SEQ ID NO: 191041 - DNA, 25 bp, Mus musculus
agatggggtaaagataaacaacaaa

SEQ ID NO: 191042 - DNA, 25 bp, Mus musculus
agatggggtaaaggagtcaactgag

SEQ ID NO: 191043 - DNA, 25 bp, Mus musculus
agatgggtcatggaactcatcttcg

SEQ ID NO: 191044 - DNA, 25 bp, Mus musculus
agatgggtggaggcaaagacacttg

SEQ ID NO: 191045 - DNA, 25 bp, Mus musculus
agatggtagaaccagacgatggagg

SEQ ID NO: 191046 - DNA, 25 bp, Mus musculus
agatggtcaagcaagaagcgaaacc

SEQ ID NO: 191047 - DNA, 25 bp, Mus musculus
agatggtccaatttgtctagtgctg

SEQ ID NO: 191048 - DNA, 25 bp, Mus musculus
agatggtctggagcaagcccacacc

SEQ ID NO: 191049 - DNA, 25 bp, Mus musculus
agatggtctggtgtagccgtcctcg

SEQ ID NO: 191050 - DNA, 25 bp, Mus musculus
agatggtcttctatccccaatatct

SEQ ID NO: 191051 - DNA, 25 bp, Mus musculus
agatggtcttctatgcccaatatct

SEQ ID NO: 191052 - DNA, 25 bp, Mus musculus
agatggtgaattgggatgatgagga

SEQ ID NO: 191053 - DNA, 25 bp, Mus musculus
agatggtgcagattccatggagagt

SEQ ID NO: 191054 - DNA, 25 bp, Mus musculus
agatggtgcaggacatgggggccgg

SEQ ID NO: 191055 - DNA, 25 bp, Mus musculus
agatggtggcaggtgactccagctc

SEQ ID NO: 191056 - DNA, 25 bp, Mus musculus
agatggtggcaggtgggacctgacc

SEQ ID NO: 191057 - DNA, 25 bp, Mus musculus
agatggtggccagggttttaatgta

SEQ ID NO: 191058 - DNA, 25 bp, Mus musculus
agatggtggtgagtgcctatgaagt

SEQ ID NO: 191059 - DNA, 25 bp, Mus musculus
agatggttcaagtgggtgttccagt

SEQ ID NO: 191060 - DNA, 25 bp, Mus musculus
agatggttcaagtgttcctgtccac

SEQ ID NO: 191061 - DNA, 25 bp, Mus musculus
agatggttctaggctttgatgacag

SEQ ID NO: 191062 - DNA, 25 bp, Mus musculus
agatgtaaccatagatcgcaagcca

SEQ ID NO: 191063 - DNA, 25 bp, Mus musculus
agatgtaaccataggcccgaggacg

SEQ ID NO: 191064 - DNA, 25 bp, Mus musculus
agatgtaactgcttggacccttctg

SEQ ID NO: 191065 - DNA, 25 bp, Mus musculus
agatgtaagctgcagagaagctaga

SEQ ID NO: 191066 - DNA, 25 bp, Mus musculus
agatgtacagaagtttgcccggctc

SEQ ID NO: 191067 - DNA, 25 bp, Mus musculus
agatgtacagattttccagggcagc

SEQ ID NO: 191068 - DNA, 25 bp, Mus musculus
agatgtacagctgggtccttggctg

SEQ ID NO: 191069 - DNA, 25 bp, Mus musculus
agatgtacaggggtggcaaaatatg

SEQ ID NO: 191070 - DNA, 25 bp, Mus musculus
agatgtaccttgaaaccatgtagaa

SEQ ID NO: 191071 - DNA, 25 bp, Mus musculus
agatgtaccttgaaaccatgtgaat

SEQ ID NO: 191072 - DNA, 25 bp, Mus musculus
agatgtacggttcctcatttgactt

SEQ ID NO: 191073 - DNA, 25 bp, Mus musculus
agatgtatcagattcagctactagt

SEQ ID NO: 191074 - DNA, 25 bp, Mus musculus
agatgtcaagaaaaatcaggaaatg

SEQ ID NO: 191075 - DNA, 25 bp, Mus musculus
agatgtcaagaaagcgtgtaccttc

SEQ ID NO: 191076 - DNA, 25 bp, Mus musculus
agatgtcaagatatctgtttcaaat

SEQ ID NO: 191077 - DNA, 25 bp, Mus musculus
agatgtcaaggggagagaccttata

SEQ ID NO: 191078 - DNA, 25 bp, Mus musculus
agatgtcacaggttaaagaaactct

SEQ ID NO: 191079 - DNA, 25 bp, Mus musculus
agatgtcacttgtgactgaggctcc

SEQ ID NO: 191080 - DNA, 25 bp, Mus musculus
agatgtcatgctgtgtgcaggagag

SEQ ID NO: 191081 - DNA, 25 bp, Mus musculus
agatgtcatgttgtgtgcaggagag

SEQ ID NO: 191082 - DNA, 25 bp, Mus musculus
agatgtcatttgaagctgaggagga

SEQ ID NO: 191083 - DNA, 25 bp, Mus musculus
agatgtcatttgggaggactcagaa

SEQ ID NO: 191084 - DNA, 25 bp, Mus musculus
agatgtccaagcccccaccttctgg

SEQ ID NO: 191085 - DNA, 25 bp, Mus musculus
agatgtccaaggtcagagtacacct

SEQ ID NO: 191086 - DNA, 25 bp, Mus musculus
agatgtccaagtttggcaatgagga

SEQ ID NO: 191087 - DNA, 25 bp, Mus musculus
agatgtccagatctgctggaacgaa

SEQ ID NO: 191088 - DNA, 25 bp, Mus musculus
agatgtcccagcaacattttgatgg

SEQ ID NO: 191089 - DNA, 25 bp, Mus musculus
agatgtcctcggtgactcagaagaa

SEQ ID NO: 191090 - DNA, 25 bp, Mus musculus
agatgtcctgcctgacctgcaggaa

SEQ ID NO: 191091 - DNA, 25 bp, Mus musculus
agatgtcgccctgatgattcgggcc

SEQ ID NO: 191092 - DNA, 25 bp, Mus musculus
agatgtctccagaacacttcagtta

SEQ ID NO: 191093 - DNA, 25 bp, Mus musculus
agatgtgaaagatgcaggtgatgaa

SEQ ID NO: 191094 - DNA, 25 bp, Mus musculus
agatgtgaaaggtgatgaaagggaa

SEQ ID NO: 191095 - DNA, 25 bp, Mus musculus
agatgtgaagatgatcagtgcagaa

SEQ ID NO: 191096 - DNA, 25 bp, Mus musculus
agatgtgaatatcagacatgtacat

SEQ ID NO: 191097 - DNA, 25 bp, Mus musculus
agatgtgaatatcaggacaatgggc

SEQ ID NO: 191098 - DNA, 25 bp, Mus musculus
agatgtgaccagctcattgcctgag

SEQ ID NO: 191099 - DNA, 25 bp, Mus musculus
agatgtgaccaggcctgaagggaaa

SEQ ID NO: 191100 - DNA, 25 bp, Mus musculus
agatgtgagcaggaggcctctgaag

SEQ ID NO: 191101 - DNA, 25 bp, Mus musculus
agatgtgagggatctaccaaggcca

SEQ ID NO: 191102 - DNA, 25 bp, Mus musculus
agatgtgcacaggacattgccctaa

SEQ ID NO: 191103 - DNA, 25 bp, Mus musculus
agatgtgcacaggctacattgctgg

SEQ ID NO: 191104 - DNA, 25 bp, Mus musculus
agatgtgcagaaagacgctccttgg

SEQ ID NO: 191105 - DNA, 25 bp, Mus musculus
agatgtgcagaggtccctgctggag

SEQ ID NO: 191106 - DNA, 25 bp, Mus musculus
agatgtgcagcgccgagtacaacag

SEQ ID NO: 191107 - DNA, 25 bp, Mus musculus
agatgtgcaggtcttgcctcagcat

SEQ ID NO: 191108 - DNA, 25 bp, Mus musculus
agatgtggagactggcacccagctg

SEQ ID NO: 191109 - DNA, 25 bp, Mus musculus
agatgtggagatgacttggactgat

SEQ ID NO: 191110 - DNA, 25 bp, Mus musculus
agatgtggagatggagtatacaatg

SEQ ID NO: 191111 - DNA, 25 bp, Mus musculus
agatgtggatggcgagaaataccag

SEQ ID NO: 191112 - DNA, 25 bp, Mus musculus
agatgtggcccaagataaagactga

SEQ ID NO: 191113 - DNA, 25 bp, Mus musculus
agatgtggcccaaggacactcctcc

SEQ ID NO: 191114 - DNA, 25 bp, Mus musculus
agatgtggtcgagaaaagacaactg

SEQ ID NO: 191115 - DNA, 25 bp, Mus musculus
agatgtggtcgagttgcagtaatgt

SEQ ID NO: 191116 - DNA, 25 bp, Mus musculus
agatgtggtgatggtacaccagggg

SEQ ID NO: 191117 - DNA, 25 bp, Mus musculus
agatgtgtaggggagctgtcccgac

SEQ ID NO: 191118 - DNA, 25 bp, Mus musculus
agatgtgtatagcgagatctttgca

SEQ ID NO: 191119 - DNA, 25 bp, Mus musculus
agatgtgtcggtgtcccgatgctgc

SEQ ID NO: 191120 - DNA, 25 bp, Mus musculus
agatgtgtcgtaacatatcgcagct

SEQ ID NO: 191121 - DNA, 25 bp, Mus musculus
agatgtgttcagaatgatgatgcca

SEQ ID NO: 191122 - DNA, 25 bp, Mus musculus
agatgtgttcagtctgggtctcacc

SEQ ID NO: 191123 - DNA, 25 bp, Mus musculus
agatgttagaagatggctccgagcg

SEQ ID NO: 191124 - DNA, 25 bp, Mus musculus
agatgttattgcttcaggagctcta

SEQ ID NO: 191125 - DNA, 25 bp, Mus musculus
agatgttcacttcaggtattgacct

SEQ ID NO: 191126 - DNA, 25 bp, Mus musculus
agatgttcacttcaggtgtggacct

SEQ ID NO: 191127 - DNA, 25 bp, Mus musculus
agatgttcagccagtatccgcctca

SEQ ID NO: 191128 - DNA, 25 bp, Mus musculus
agatgttcagctacgagtcctcggc

SEQ ID NO: 191129 - DNA, 25 bp, Mus musculus
agatgttcagttatgaggagtccaa

SEQ ID NO: 191130 - DNA, 25 bp, Mus musculus
agatgttcatgataggagacaaatt

SEQ ID NO: 191131 - DNA, 25 bp, Mus musculus
agatgttcatgggactttcagttac

SEQ ID NO: 191132 - DNA, 25 bp, Mus musculus
agatgttccagaagaagctggttag

SEQ ID NO: 191133 - DNA, 25 bp, Mus musculus
agatgttccaggagggagtatgatt

SEQ ID NO: 191134 - DNA, 25 bp, Mus musculus
agatgttctgcgccccactcaccgt

SEQ ID NO: 191135 - DNA, 25 bp, Mus musculus
agatgttctggccaacctctccctg

SEQ ID NO: 191136 - DNA, 25 bp, Mus musculus
agatgttgaaagatgatgccacaga

SEQ ID NO: 191137 - DNA, 25 bp, Mus musculus
agatgttgctgaggggcggcctgag

SEQ ID NO: 191138 - DNA, 25 bp, Mus musculus
agatgttgtgaggctggtggaggag

SEQ ID NO: 191139 - DNA, 25 bp, Mus musculus
agatgtttccaagaaggtcacagaa

SEQ ID NO: 191140 - DNA, 25 bp, Mus musculus
agatgtttccaggagccctgacata

SEQ ID NO: 191141 - DNA, 25 bp, Mus musculus
agatgtttgttggattcagtccttc

SEQ ID NO: 191142 - DNA, 25 bp, Mus musculus
agatgttttaatggctgttagcgtc

SEQ ID NO: 191143 - DNA, 25 bp, Mus musculus
agatgttttccaggaggtggtgtgg

SEQ ID NO: 191144 - DNA, 25 bp, Mus musculus
agatgttttcgaaggcagtataatt

SEQ ID NO: 191145 - DNA, 25 bp, Mus musculus
agatgttttcgaaggcatgcttgta

SEQ ID NO: 191146 - DNA, 25 bp, Mus musculus
agatgttttctctgacagctgtcat

SEQ ID NO: 191147 - DNA, 25 bp, Mus musculus
agattaaaaggatcttgctgcatag

SEQ ID NO: 191148 - DNA, 25 bp, Mus musculus
agattaaacaagccgctgcgcctgt

SEQ ID NO: 191149 - DNA, 25 bp, Mus musculus
agattaaacaaggctggagccagtt

SEQ ID NO: 191150 - DNA, 25 bp, Mus musculus
agattaaatgagaataaggctcaag

SEQ ID NO: 191151 - DNA, 25 bp, Mus musculus
agattaaatttccaaggcccgagaa

SEQ ID NO: 191152 - DNA, 25 bp, Mus musculus
agattaacaagaagattgacctgaa

SEQ ID NO: 191153 - DNA, 25 bp, Mus musculus
agattaacaagaagatttacaagat

SEQ ID NO: 191154 - DNA, 25 bp, Mus musculus
agattaagacataggtggcaggatc

SEQ ID NO: 191155 - DNA, 25 bp, Mus musculus
agattaagagctgggccagcaagat

SEQ ID NO: 191156 - DNA, 25 bp, Mus musculus
agattaatttgaagggtgattcaga

SEQ ID NO: 191157 - DNA, 25 bp, Mus musculus
agattacaaagtgcgggtcgatgag

SEQ ID NO: 191158 - DNA, 25 bp, Mus musculus
agattacaaggagctagaggaagaa

SEQ ID NO: 191159 - DNA, 25 bp, Mus musculus
agattacaaggctctaagggatgga

SEQ ID NO: 191160 - DNA, 25 bp, Mus musculus
agattacatacttctacactccaga

SEQ ID NO: 191161 - DNA, 25 bp, Mus musculus
agattacgccaggtggtgccacaga

SEQ ID NO: 191162 - DNA, 25 bp, Mus musculus
agattactaaggacaacatagaaaa

SEQ ID NO: 191163 - DNA, 25 bp, Mus musculus
agattactctaaggccttcctcctg

SEQ ID NO: 191164 - DNA, 25 bp, Mus musculus
agattagaagaaaaccacgagctgt

SEQ ID NO: 191165 - DNA, 25 bp, Mus musculus
agattagaaggacctcttcctgatg

SEQ ID NO: 191166 - DNA, 25 bp, Mus musculus
agattagacctggttggctcaaaaa

SEQ ID NO: 191167 - DNA, 25 bp, Mus musculus
agattagctctgccccaggcctcct

SEQ ID NO: 191168 - DNA, 25 bp, Mus musculus
agattagtggccaagcccagccact

SEQ ID NO: 191169 - DNA, 25 bp, Mus musculus
agattagtggccaggtcctgctctc

SEQ ID NO: 191170 - DNA, 25 bp, Mus musculus
agattagttttaaggccgaagtcaa

SEQ ID NO: 191171 - DNA, 25 bp, Mus musculus
agattagttttaagtatggcgccca

SEQ ID NO: 191172 - DNA, 25 bp, Mus musculus
agattatactttaagaggctggatt

SEQ ID NO: 191173 - DNA, 25 bp, Mus musculus
agattatcactcagataacccttcc

SEQ ID NO: 191174 - DNA, 25 bp, Mus musculus
agattatcactcaggcccaggcctg

SEQ ID NO: 191175 - DNA, 25 bp, Mus musculus
agattatccagaggagacagcactc

SEQ ID NO: 191176 - DNA, 25 bp, Mus musculus
agattatccagagtcctattgtcga

SEQ ID NO: 191177 - DNA, 25 bp, Mus musculus
agattatccagggaaaggaagatga

SEQ ID NO: 191178 - DNA, 25 bp, Mus musculus
agattatctttataggctgaaggcg

SEQ ID NO: 191179 - DNA, 25 bp, Mus musculus
agattattagatatgctctccaaag

SEQ ID NO: 191180 - DNA, 25 bp, Mus musculus
agattatttttaagaggcaagaaac

SEQ ID NO: 191181 - DNA, 25 bp, Mus musculus
agattcaaaaggataaaccagaaac

SEQ ID NO: 191182 - DNA, 25 bp, Mus musculus
agattcaaactgccgtggtgagaag

SEQ ID NO: 191183 - DNA, 25 bp, Mus musculus
agattcacttgctgtaagaactaaa

SEQ ID NO: 191184 - DNA, 25 bp, Mus musculus
agattcacttggcttgttacatgag

SEQ ID NO: 191185 - DNA, 25 bp, Mus musculus
agattcagaaactgtacggacatgg

SEQ ID NO: 191186 - DNA, 25 bp, Mus musculus
agattcagaaagattccaggttgac

SEQ ID NO: 191187 - DNA, 25 bp, Mus musculus
agattcagagccaggttgtaaaagt

SEQ ID NO: 191188 - DNA, 25 bp, Mus musculus
agattcagatgtaccctcctgaaaa

SEQ ID NO: 191189 - DNA, 25 bp, Mus musculus
agattcagcagcaggtccaggggca

SEQ ID NO: 191190 - DNA, 25 bp, Mus musculus
agattcagctcccaggttgaagaaa

SEQ ID NO: 191191 - DNA, 25 bp, Mus musculus
agattcaggagctgctactcaggtg

SEQ ID NO: 191192 - DNA, 25 bp, Mus musculus
agattcaggcttccagttcacgtgg

SEQ ID NO: 191193 - DNA, 25 bp, Mus musculus
agattcattgaattctgtctttatt

SEQ ID NO: 191194 - DNA, 25 bp, Mus musculus
agattccaactaaaaataggaaatc

SEQ ID NO: 191195 - DNA, 25 bp, Mus musculus
agattccaactaagagttggccatg

SEQ ID NO: 191196 - DNA, 25 bp, Mus musculus
agattccagaaggagaaaaaaaagc

SEQ ID NO: 191197 - DNA, 25 bp, Mus musculus
agattccccgctgtcctacagtctg

SEQ ID NO: 191198 - DNA, 25 bp, Mus musculus
agattccgatttgggacgaggacct

SEQ ID NO: 191199 - DNA, 25 bp, Mus musculus
agattcctcagttccaccagaggag

SEQ ID NO: 191200 - DNA, 25 bp, Mus musculus
agattcctcccagatgatgggcgtc

SEQ ID NO: 191201 - DNA, 25 bp, Mus musculus
agattcctgagatgaccacagggcc

SEQ ID NO: 191202 - DNA, 25 bp, Mus musculus
agattcctgccagggtgactctgat

SEQ ID NO: 191203 - DNA, 25 bp, Mus musculus
agattcctgccagggtgactctggt

SEQ ID NO: 191204 - DNA, 25 bp, Mus musculus
agattcctgccaggtgactctggtg

SEQ ID NO: 191205 - DNA, 25 bp, Mus musculus
agattcctggtataactatggtatc

SEQ ID NO: 191206 - DNA, 25 bp, Mus musculus
agattccttaactcatgcagatgtc

SEQ ID NO: 191207 - DNA, 25 bp, Mus musculus
agattccttaactgcaacaagtttt

SEQ ID NO: 191208 - DNA, 25 bp, Mus musculus
agattcgcagaatagcagagaaagg

SEQ ID NO: 191209 - DNA, 25 bp, Mus musculus
agattcggcgacctgacaaagccct

SEQ ID NO: 191210 - DNA, 25 bp, Mus musculus
agattcggcggtttatcaagagcta

SEQ ID NO: 191211 - DNA, 25 bp, Mus musculus
agattcggctgctgaactaagaact

SEQ ID NO: 191212 - DNA, 25 bp, Mus musculus
agattctacaagcaagacccaagag

SEQ ID NO: 191213 - DNA, 25 bp, Mus musculus
agattctactcagcttcagaggatg

SEQ ID NO: 191214 - DNA, 25 bp, Mus musculus
agattctataggagctgagaccctt

SEQ ID NO: 191215 - DNA, 25 bp, Mus musculus
agattctatgctaggtattctctga

SEQ ID NO: 191216 - DNA, 25 bp, Mus musculus
agattctcagagttctgaacttcag

SEQ ID NO: 191217 - DNA, 25 bp, Mus musculus
agattctcagcttttaatatatttt

SEQ ID NO: 191218 - DNA, 25 bp, Mus musculus
agattctcaggtaagctctgatgga

SEQ ID NO: 191219 - DNA, 25 bp, Mus musculus
agattctcgaggctaaaaagaaaaa

SEQ ID NO: 191220 - DNA, 25 bp, Mus musculus
agattctgaccaagtgttgtacact

SEQ ID NO: 191221 - DNA, 25 bp, Mus musculus
agattctgacccatgcttctctgct

SEQ ID NO: 191222 - DNA, 25 bp, Mus musculus
agattctgagaccttgctacatctc

SEQ ID NO: 191223 - DNA, 25 bp, Mus musculus
agattctgagagtctgctagtctgg

SEQ ID NO: 191224 - DNA, 25 bp, Mus musculus
agattctgaggcgaatggacccgct

SEQ ID NO: 191225 - DNA, 25 bp, Mus musculus
agattctgagtctgatatccttttg

SEQ ID NO: 191226 - DNA, 25 bp, Mus musculus
agattctgagtggggacctcatcag

SEQ ID NO: 191227 - DNA, 25 bp, Mus musculus
agattctgcatggctgatccttcct

SEQ ID NO: 191228 - DNA, 25 bp, Mus musculus
agattctgcctttgggctgtacctt

SEQ ID NO: 191229 - DNA, 25 bp, Mus musculus
agattctgcttatggcgtgcgcagg

SEQ ID NO: 191230 - DNA, 25 bp, Mus musculus
agattctgcttatgtgcttctgggt

SEQ ID NO: 191231 - DNA, 25 bp, Mus musculus
agattctggtggctttgatgaacta

SEQ ID NO: 191232 - DNA, 25 bp, Mus musculus
agattctggtggtggacttctcaaa

SEQ ID NO: 191233 - DNA, 25 bp, Mus musculus
agattcttaagagaatacggacggg

SEQ ID NO: 191234 - DNA, 25 bp, Mus musculus
agattcttaagagcatggataagaa

SEQ ID NO: 191235 - DNA, 25 bp, Mus musculus
agattcttagaagggctggaaaaag

SEQ ID NO: 191236 - DNA, 25 bp, Mus musculus
agattcttcaggtctatggaaatgc

SEQ ID NO: 191237 - DNA, 25 bp, Mus musculus
agattcttggataaggaattggaac

SEQ ID NO: 191238 - DNA, 25 bp, Mus musculus
agattgaaaagcttactaagcacct

SEQ ID NO: 191239 - DNA, 25 bp, Mus musculus
agattgaaagctacgggaaagaaag

SEQ ID NO: 191240 - DNA, 25 bp, Mus musculus
agattgaaagctgaaaggaagttct

SEQ ID NO: 191241 - DNA, 25 bp, Mus musculus
agattgaacaaagaccggcaactat

SEQ ID NO: 191242 - DNA, 25 bp, Mus musculus
agattgaacgcaagggggaagcatg

SEQ ID NO: 191243 - DNA, 25 bp, Mus musculus
agattgaactcatcaagatgtttga

SEQ ID NO: 191244 - DNA, 25 bp, Mus musculus
agattgagaaggtcatagaagagct

SEQ ID NO: 191245 - DNA, 25 bp, Mus musculus
agattgagaagtggatgactacagc

SEQ ID NO: 191246 - DNA, 25 bp, Mus musculus
agattgagaagtttctagatccaga

SEQ ID NO: 191247 - DNA, 25 bp, Mus musculus
agattgagcaggtttaccgacaaga

SEQ ID NO: 191248 - DNA, 25 bp, Mus musculus
agattgaggagaagaaggtggcaga

SEQ ID NO: 191249 - DNA, 25 bp, Mus musculus
agattgatacagggacaagtgacca

SEQ ID NO: 191250 - DNA, 25 bp, Mus musculus
agattgatgtggccagcctgcggac

SEQ ID NO: 191251 - DNA, 25 bp, Mus musculus
agattgcaaaggtcatttggtgtct

SEQ ID NO: 191252 - DNA, 25 bp, Mus musculus
agattgcaaagtatggtataaggaa

SEQ ID NO: 191253 - DNA, 25 bp, Mus musculus
agattgcaaggtacaaaagaaaact

SEQ ID NO: 191254 - DNA, 25 bp, Mus musculus
agattgcaagttctgattcaaagga

SEQ ID NO: 191255 - DNA, 25 bp, Mus musculus
agattgcagagaacaatgacctact

SEQ ID NO: 191256 - DNA, 25 bp, Mus musculus
agattgcagaggcccagcagctcat

SEQ ID NO: 191257 - DNA, 25 bp, Mus musculus
agattgcagagtgaaccatgagcca

SEQ ID NO: 191258 - DNA, 25 bp, Mus musculus
agattgccaagaacggtatttgaat

SEQ ID NO: 191259 - DNA, 25 bp, Mus musculus
agattgccagagctccacgcaggag

SEQ ID NO: 191260 - DNA, 25 bp, Mus musculus
agattgccaggcccgacgactcttt

SEQ ID NO: 191261 - DNA, 25 bp, Mus musculus
agattgcccaatgagctgctaagtc

SEQ ID NO: 191262 - DNA, 25 bp, Mus musculus
agattgcccaggatgccctgaagtt

SEQ ID NO: 191263 - DNA, 25 bp, Mus musculus
agattgcccaggttcgcggcaaggc

SEQ ID NO: 191264 - DNA, 25 bp, Mus musculus
agattgccctcacgatcaacaaggc

SEQ ID NO: 191265 - DNA, 25 bp, Mus musculus
agattgccctcacgcataaaaataa

SEQ ID NO: 191266 - DNA, 25 bp, Mus musculus
agattgccctggatcgtgcagaaag

SEQ ID NO: 191267 - DNA, 25 bp, Mus musculus
agattgccttcaaggacctactgaa

SEQ ID NO: 191268 - DNA, 25 bp, Mus musculus
agattgctaaaagtactattaatcc

SEQ ID NO: 191269 - DNA, 25 bp, Mus musculus
agattgctaaagaccagagtaatgc

SEQ ID NO: 191270 - DNA, 25 bp, Mus musculus
agattgctaaagcagtgggaactca

SEQ ID NO: 191271 - DNA, 25 bp, Mus musculus
agattgctcacgtatcacgacatcg

SEQ ID NO: 191272 - DNA, 25 bp, Mus musculus
agattgctccaagtaaggcccccat

SEQ ID NO: 191273 - DNA, 25 bp, Mus musculus
agattgctctgccatcacctgtttg

SEQ ID NO: 191274 - DNA, 25 bp, Mus musculus
agattgctttggcctggagagagac

SEQ ID NO: 191275 - DNA, 25 bp, Mus musculus
agattggaaaagcgcagcctggagg

SEQ ID NO: 191276 - DNA, 25 bp, Mus musculus
agattggaagagcaggggaaggaag

SEQ ID NO: 191277 - DNA, 25 bp, Mus musculus
agattggaaggagacttcaaaagaa

SEQ ID NO: 191278 - DNA, 25 bp, Mus musculus
agattggaaggtattcccatctgtc

SEQ ID NO: 191279 - DNA, 25 bp, Mus musculus
agattggaagtggttctgtgtataa

SEQ ID NO: 191280 - DNA, 25 bp, Mus musculus
agattggaagttcctgtggaagacc

SEQ ID NO: 191281 - DNA, 25 bp, Mus musculus
agattggactcgagctcagagctct

SEQ ID NO: 191282 - DNA, 25 bp, Mus musculus
agattggactcgagtgtgacagttg

SEQ ID NO: 191283 - DNA, 25 bp, Mus musculus
agattggcagagaagcttaagtgtg

SEQ ID NO: 191284 - DNA, 25 bp, Mus musculus
agattggcagagaaggcagtattgc

SEQ ID NO: 191285 - DNA, 25 bp, Mus musculus
agattggccatgtgttcaagcgctg

SEQ ID NO: 191286 - DNA, 25 bp, Mus musculus
agattggcctggcaggcccttttag

SEQ ID NO: 191287 - DNA, 25 bp, Mus musculus
agattggcgtttcagtgaacaacgt

SEQ ID NO: 191288 - DNA, 25 bp, Mus musculus
agattggcgttttagtgaacaacgt

SEQ ID NO: 191289 - DNA, 25 bp, Mus musculus
agattggctccagagctctctgtgg

SEQ ID NO: 191290 - DNA, 25 bp, Mus musculus
agattggctgccagtagataaaaga

SEQ ID NO: 191291 - DNA, 25 bp, Mus musculus
agattggctgccagtcttcaattag

SEQ ID NO: 191292 - DNA, 25 bp, Mus musculus
agattgggaaggtggccttagtaga

SEQ ID NO: 191293 - DNA, 25 bp, Mus musculus
agattggggacacggcatcctttga

SEQ ID NO: 191294 - DNA, 25 bp, Mus musculus
agattgggggcagcaactcttacaa

SEQ ID NO: 191295 - DNA, 25 bp, Mus musculus
agattggttcaaggagtcctttggg

SEQ ID NO: 191296 - DNA, 25 bp, Mus musculus
agattggttgtgcccatcttttgat

SEQ ID NO: 191297 - DNA, 25 bp, Mus musculus
agattggttgtggccatcttttgat

SEQ ID NO: 191298 - DNA, 25 bp, Mus musculus
agattgtaaagcgtgaagacagctg

SEQ ID NO: 191299 - DNA, 25 bp, Mus musculus
agattgtaaagtgatggttcatgac

SEQ ID NO: 191300 - DNA, 25 bp, Mus musculus
agattgtcaagagcaactgcaatgt

SEQ ID NO: 191301 - DNA, 25 bp, Mus musculus
agattgtcaagatgaaatgtcctga

SEQ ID NO: 191302 - DNA, 25 bp, Mus musculus
agattgtcactggggtgcggctacc

SEQ ID NO: 191303 - DNA, 25 bp, Mus musculus
agattgtcactgggttttacctgct

SEQ ID NO: 191304 - DNA, 25 bp, Mus musculus
agattgtccagacggctgctcttcc

SEQ ID NO: 191305 - DNA, 25 bp, Mus musculus
agattgtctggagatggctgcagca

SEQ ID NO: 191306 - DNA, 25 bp, Mus musculus
agattgtcttgagctggaagccggt

SEQ ID NO: 191307 - DNA, 25 bp, Mus musculus
agattgtcttgagctggcccatcat

SEQ ID NO: 191308 - DNA, 25 bp, Mus musculus
agattgtgccaaagataaatttgaa

SEQ ID NO: 191309 - DNA, 25 bp, Mus musculus
agattgtggaggagggggatatgaa

SEQ ID NO: 191310 - DNA, 25 bp, Mus musculus
agattgttcagcaggtcagggtttg

SEQ ID NO: 191311 - DNA, 25 bp, Mus musculus
agattgttggataaaagcttatacc

SEQ ID NO: 191312 - DNA, 25 bp, Mus musculus
agattgtttttgctgatgggaactt

SEQ ID NO: 191313 - DNA, 25 bp, Mus musculus
agattgtttttgctgatttctaagt

SEQ ID NO: 191314 - DNA, 25 bp, Mus musculus
agatttaaaaggtatgggtgagagc

SEQ ID NO: 191315 - DNA, 25 bp, Mus musculus
agatttaaaggttatagttatgagt

SEQ ID NO: 191316 - DNA, 25 bp, Mus musculus
agatttaaagtgttcctaggatccc

SEQ ID NO: 191317 - DNA, 25 bp, Mus musculus
agatttaataactggcatcctcgtg

SEQ ID NO: 191318 - DNA, 25 bp, Mus musculus
agatttacaaagttgcttcagatcg

SEQ ID NO: 191319 - DNA, 25 bp, Mus musculus
agatttacctctgggacaaggacaa

SEQ ID NO: 191320 - DNA, 25 bp, Mus musculus
agatttacgacaaatgtgtgccaaa

SEQ ID NO: 191321 - DNA, 25 bp, Mus musculus
agatttagaagatcttttacaggat

SEQ ID NO: 191322 - DNA, 25 bp, Mus musculus
agatttagaagatgatggtgaggat

SEQ ID NO: 191323 - DNA, 25 bp, Mus musculus
agatttagctggggaggaagagaca

SEQ ID NO: 191324 - DNA, 25 bp, Mus musculus
agatttagctggggggccgaggggc

SEQ ID NO: 191325 - DNA, 25 bp, Mus musculus
agatttatggagtgtttgatgagaa

SEQ ID NO: 191326 - DNA, 25 bp, Mus musculus
agatttattattcggcatacccatg

SEQ ID NO: 191327 - DNA, 25 bp, Mus musculus
agatttattgttgattcttccaaga

SEQ ID NO: 191328 - DNA, 25 bp, Mus musculus
agatttcacagagacagccattctg

SEQ ID NO: 191329 - DNA, 25 bp, Mus musculus
agatttcagacatagtcacagccca

SEQ ID NO: 191330 - DNA, 25 bp, Mus musculus
agatttcattgaggagtttgacaat

SEQ ID NO: 191331 - DNA, 25 bp, Mus musculus
agatttccagaggataacgaaaaga

SEQ ID NO: 191332 - DNA, 25 bp, Mus musculus
agatttccagccgtggtcaagttca

SEQ ID NO: 191333 - DNA, 25 bp, Mus musculus
agatttcccagaccacgaactgtct

SEQ ID NO: 191334 - DNA, 25 bp, Mus musculus
agatttcccagggatccggcactgg

SEQ ID NO: 191335 - DNA, 25 bp, Mus musculus
agatttccctggcctcagaaacact

SEQ ID NO: 191336 - DNA, 25 bp, Mus musculus
agatttccctggcttcccctccagc

SEQ ID NO: 191337 - DNA, 25 bp, Mus musculus
agatttccgaaggtacattttatac

SEQ ID NO: 191338 - DNA, 25 bp, Mus musculus
agatttcctacagggaaatcagtca

SEQ ID NO: 191339 - DNA, 25 bp, Mus musculus
agatttcctacaggtggggctttaa

SEQ ID NO: 191340 - DNA, 25 bp, Mus musculus
agatttcctctccaagcttttcatc

SEQ ID NO: 191341 - DNA, 25 bp, Mus musculus
agatttcctctccacccatctgctg

SEQ ID NO: 191342 - DNA, 25 bp, Mus musculus
agatttccttctgggttctcaaaat

SEQ ID NO: 191343 - DNA, 25 bp, Mus musculus
agatttcgaccaggaaaaaatcctg

SEQ ID NO: 191344 - DNA, 25 bp, Mus musculus
agatttcgaccagttaccttactct

SEQ ID NO: 191345 - DNA, 25 bp, Mus musculus
agatttctcatgaagccattgatct

SEQ ID NO: 191346 - DNA, 25 bp, Mus musculus
agatttctgaaggggcttgtcaatg

SEQ ID NO: 191347 - DNA, 25 bp, Mus musculus
agatttcttcccaggagaaatatga

SEQ ID NO: 191348 - DNA, 25 bp, Mus musculus
agatttgagccgaggattaacacct

SEQ ID NO: 191349 - DNA, 25 bp, Mus musculus
agatttgcaagacagttcggcatgg

SEQ ID NO: 191350 - DNA, 25 bp, Mus musculus
agatttgcaagggagttgatttact

SEQ ID NO: 191351 - DNA, 25 bp, Mus musculus
agatttgcagtccaacgtcgtgcac

SEQ ID NO: 191352 - DNA, 25 bp, Mus musculus
agatttggaagagacctcaattatt

SEQ ID NO: 191353 - DNA, 25 bp, Mus musculus
agatttggaagatggagaactctca

SEQ ID NO: 191354 - DNA, 25 bp, Mus musculus
agatttggaagcaggaatgtctgac

SEQ ID NO: 191355 - DNA, 25 bp, Mus musculus
agatttggaagggtggatgtcactg

SEQ ID NO: 191356 - DNA, 25 bp, Mus musculus
agatttggaagtcaagaagttttct

SEQ ID NO: 191357 - DNA, 25 bp, Mus musculus
agatttggacagcttccttgtgact

SEQ ID NO: 191358 - DNA, 25 bp, Mus musculus
agatttggacagtttccagcaggag

SEQ ID NO: 191359 - DNA, 25 bp, Mus musculus
agatttggacgacagtgatcacagt

SEQ ID NO: 191360 - DNA, 25 bp, Mus musculus
agatttgtacaaaagccctatagtc

SEQ ID NO: 191361 - DNA, 25 bp, Mus musculus
agatttgtacaaaaggttgaagaaa

SEQ ID NO: 191362 - DNA, 25 bp, Mus musculus
agattttaaactgtttcagaaagac

SEQ ID NO: 191363 - DNA, 25 bp, Mus musculus
agattttagaaggccccaggacaca

SEQ ID NO: 191364 - DNA, 25 bp, Mus musculus
agattttagacatagtagcaaccca

SEQ ID NO: 191365 - DNA, 25 bp, Mus musculus
agattttagcagcttcttactgtgt

SEQ ID NO: 191366 - DNA, 25 bp, Mus musculus
agattttagcaggtgaatatgacca

SEQ ID NO: 191367 - DNA, 25 bp, Mus musculus
agattttcagggcattgtgcttctt

SEQ ID NO: 191368 - DNA, 25 bp, Mus musculus
agattttcttggggacagtgaaatg

SEQ ID NO: 191369 - DNA, 25 bp, Mus musculus
agattttgaaagacaagaagctgat

SEQ ID NO: 191370 - DNA, 25 bp, Mus musculus
agattttgagaaggtcatcttggaa

SEQ ID NO: 191371 - DNA, 25 bp, Mus musculus
agattttgaggtattcgtggagtgg

SEQ ID NO: 191372 - DNA, 25 bp, Mus musculus
agattttgaggtcttgccgtggaat

SEQ ID NO: 191373 - DNA, 25 bp, Mus musculus
agattttgctctgatggttggcact

SEQ ID NO: 191374 - DNA, 25 bp, Mus musculus
agatttttagatatgcttggcctgt

SEQ ID NO: 191375 - DNA, 25 bp, Mus musculus
agatttttctcagtaccaacaaaag

SEQ ID NO: 191376 - DNA, 25 bp, Mus musculus
agatttttctgggattgggtcgaaa

SEQ ID NO: 191377 - DNA, 25 bp, Mus musculus
agatttttctgggcccctgatgatt

SEQ ID NO: 191378 - DNA, 25 bp, Mus musculus
agattttttcagtattggaaaagtg

SEQ ID NO: 191379 - DNA, 25 bp, Mus musculus
agatttttttctatctgcccgcggt

SEQ ID NO: 191380 - DNA, 25 bp, Mus musculus
agcaaaaaagggtctcgtagcatct

SEQ ID NO: 191381 - DNA, 25 bp, Mus musculus
agcaaaaaaggtgttcctcagcact

SEQ ID NO: 191382 - DNA, 25 bp, Mus musculus
agcaaaaacaaatcattgcaacgat

SEQ ID NO: 191383 - DNA, 25 bp, Mus musculus
agcaaaaacacagaatctgctggat

SEQ ID NO: 191384 - DNA, 25 bp, Mus musculus
agcaaaaacacaggcagagctcaga

SEQ ID NO: 191385 - DNA, 25 bp, Mus musculus
agcaaaaacatagccaaggacatga

SEQ ID NO: 191386 - DNA, 25 bp, Mus musculus
agcaaaaaccatgccttttgccttt

SEQ ID NO: 191387 - DNA, 25 bp, Mus musculus
agcaaaaaccatgtgtgagtgttat

SEQ ID NO: 191388 - DNA, 25 bp, Mus musculus
agcaaaaagggcatcctggtcaaca

SEQ ID NO: 191389 - DNA, 25 bp, Mus musculus
agcaaaacaggccaggtggccttgc

SEQ ID NO: 191390 - DNA, 25 bp, Mus musculus
agcaaaacagggagccacccaagac

SEQ ID NO: 191391 - DNA, 25 bp, Mus musculus
agcaaaaccaaggactctgcttttg

SEQ ID NO: 191392 - DNA, 25 bp, Mus musculus
agcaaaaccaaggagcgcttctggg

SEQ ID NO: 191393 - DNA, 25 bp, Mus musculus
agcaaaaccaaggctgagccgagct

SEQ ID NO: 191394 - DNA, 25 bp, Mus musculus
agcaaaaccaaggctgaggcgagcc

SEQ ID NO: 191395 - DNA, 25 bp, Mus musculus
agcaaaaccaagttcttgacatctt

SEQ ID NO: 191396 - DNA, 25 bp, Mus musculus
agcaaaactgaaggatctgaaccaa

SEQ ID NO: 191397 - DNA, 25 bp, Mus musculus
agcaaaactgaaggatggcgtggtt

SEQ ID NO: 191398 - DNA, 25 bp, Mus musculus
agcaaaagaaaagatgagaggctgt

SEQ ID NO: 191399 - DNA, 25 bp, Mus musculus
agcaaaagcaggcggaacatgttcc

SEQ ID NO: 191400 - DNA, 25 bp, Mus musculus
agcaaaagccagagcccaggctgtc

SEQ ID NO: 191401 - DNA, 25 bp, Mus musculus
agcaaaagccagtgttggaggtgag

SEQ ID NO: 191402 - DNA, 25 bp, Mus musculus
agcaaaagctaaggatgaccagact

SEQ ID NO: 191403 - DNA, 25 bp, Mus musculus
agcaaaagctggtgcaacacgtggt

SEQ ID NO: 191404 - DNA, 25 bp, Mus musculus
agcaaaaggaaagaaccagatttct

SEQ ID NO: 191405 - DNA, 25 bp, Mus musculus
agcaaaaggaaagaatcttctcaaa

SEQ ID NO: 191406 - DNA, 25 bp, Mus musculus
agcaaaaggacaggatgtagatatg

SEQ ID NO: 191407 - DNA, 25 bp, Mus musculus
agcaaaagtgacgtgtgggcttttg

SEQ ID NO: 191408 - DNA, 25 bp, Mus musculus
agcaaaataggaaacctcgtgttgc

SEQ ID NO: 191409 - DNA, 25 bp, Mus musculus
agcaaaataggacggaaagttatac

SEQ ID NO: 191410 - DNA, 25 bp, Mus musculus
agcaaaatctcaaattgctcttaaa

SEQ ID NO: 191411 - DNA, 25 bp, Mus musculus
agcaaaatggcccaccaagaaaaca

SEQ ID NO: 191412 - DNA, 25 bp, Mus musculus
agcaaaatggtaaccctggcactgt

SEQ ID NO: 191413 - DNA, 25 bp, Mus musculus
agcaaaatgtggattttgttgacct

SEQ ID NO: 191414 - DNA, 25 bp, Mus musculus
agcaaacagttccaggaagggaaca

SEQ ID NO: 191415 - DNA, 25 bp, Mus musculus
agcaaacagttccagtcactattac

SEQ ID NO: 191416 - DNA, 25 bp, Mus musculus
agcaaacataatgtgaccccatctc

SEQ ID NO: 191417 - DNA, 25 bp, Mus musculus
agcaaacatggcagcagagtcactc

SEQ ID NO: 191418 - DNA, 25 bp, Mus musculus
agcaaacatggcaggctctacacag

SEQ ID NO: 191419 - DNA, 25 bp, Mus musculus
agcaaacatgtttccttttagacca

SEQ ID NO: 191420 - DNA, 25 bp, Mus musculus
agcaaaccacagaagacagttgctc

SEQ ID NO: 191421 - DNA, 25 bp, Mus musculus
agcaaaccacagaaggccctgaccc

SEQ ID NO: 191422 - DNA, 25 bp, Mus musculus
agcaaaccacagaaggtgcagacct

SEQ ID NO: 191423 - DNA, 25 bp, Mus musculus
agcaaaccagaagagcccttggtta

SEQ ID NO: 191424 - DNA, 25 bp, Mus musculus
agcaaaccattcagtttgcaggaga

SEQ ID NO: 191425 - DNA, 25 bp, Mus musculus
agcaaacccaaagagatgtggttgc

SEQ ID NO: 191426 - DNA, 25 bp, Mus musculus
agcaaacccaggaagagcggtcgag

SEQ ID NO: 191427 - DNA, 25 bp, Mus musculus
agcaaacccaggagacacaccctga

SEQ ID NO: 191428 - DNA, 25 bp, Mus musculus
agcaaacccagttgagcaaaaagaa

SEQ ID NO: 191429 - DNA, 25 bp, Mus musculus
agcaaaccggtggccagaaccccgt

SEQ ID NO: 191430 - DNA, 25 bp, Mus musculus
agcaaacgaggcctaagtcacccct

SEQ ID NO: 191431 - DNA, 25 bp, Mus musculus
agcaaactcagagggccccccccac

SEQ ID NO: 191432 - DNA, 25 bp, Mus musculus
agcaaactcaggagaggaaacgagg

SEQ ID NO: 191433 - DNA, 25 bp, Mus musculus
agcaaactcctcaagggttggtggt

SEQ ID NO: 191434 - DNA, 25 bp, Mus musculus
agcaaagaaaggcctcctggaacat

SEQ ID NO: 191435 - DNA, 25 bp, Mus musculus
agcaaagaagcaaacgataaacaag

SEQ ID NO: 191436 - DNA, 25 bp, Mus musculus
agcaaagaagcaaaggataaacaag

SEQ ID NO: 191437 - DNA, 25 bp, Mus musculus
agcaaagacctggaggattacctgt

SEQ ID NO: 191438 - DNA, 25 bp, Mus musculus
agcaaagagaaagaaaaatttccta

SEQ ID NO: 191439 - DNA, 25 bp, Mus musculus
agcaaagagcttgagttcatcacgc

SEQ ID NO: 191440 - DNA, 25 bp, Mus musculus
agcaaagaggaaaggagttctctga

SEQ ID NO: 191441 - DNA, 25 bp, Mus musculus
agcaaagatgtacagctgggtcctt

SEQ ID NO: 191442 - DNA, 25 bp, Mus musculus
agcaaagatgtacaggggtggcaaa

SEQ ID NO: 191443 - DNA, 25 bp, Mus musculus
agcaaagcaacaggtttcagataga

SEQ ID NO: 191444 - DNA, 25 bp, Mus musculus
agcaaagccaagatctccaagccag

SEQ ID NO: 191445 - DNA, 25 bp, Mus musculus
agcaaagccaagatgtttgaagcta

SEQ ID NO: 191446 - DNA, 25 bp, Mus musculus
agcaaagccgaagagtgtaggcttg

SEQ ID NO: 191447 - DNA, 25 bp, Mus musculus
agcaaagctcaggaacggcgagaag

SEQ ID NO: 191448 - DNA, 25 bp, Mus musculus
agcaaagctcaggctctcatgcagc

SEQ ID NO: 191449 - DNA, 25 bp, Mus musculus
agcaaagctccacaggggatctttc

SEQ ID NO: 191450 - DNA, 25 bp, Mus musculus
agcaaaggactgtggtcaatgtgcg

SEQ ID NO: 191451 - DNA, 25 bp, Mus musculus
agcaaaggcaaagactctgagcagg

SEQ ID NO: 191452 - DNA, 25 bp, Mus musculus
agcaaaggcagacgtattgcagact

SEQ ID NO: 191453 - DNA, 25 bp, Mus musculus
agcaaagggcaagaccaaaaacctc

SEQ ID NO: 191454 - DNA, 25 bp, Mus musculus
agcaaagtacaggtgttgctggagg

SEQ ID NO: 191455 - DNA, 25 bp, Mus musculus
agcaaagtatgatgatataagctta

SEQ ID NO: 191456 - DNA, 25 bp, Mus musculus
agcaaagtgcagagatccgtggaca

SEQ ID NO: 191457 - DNA, 25 bp, Mus musculus
agcaaagtgcagaggattcctacga

SEQ ID NO: 191458 - DNA, 25 bp, Mus musculus
agcaaagtgcagaggttcaaggcaa

SEQ ID NO: 191459 - DNA, 25 bp, Mus musculus
agcaaagtgctcaggaagtctaaag

SEQ ID NO: 191460 - DNA, 25 bp, Mus musculus
agcaaagtgtccgtcgatgaccatg

SEQ ID NO: 191461 - DNA, 25 bp, Mus musculus
agcaaagtgtccgtcgtgaacccca

SEQ ID NO: 191462 - DNA, 25 bp, Mus musculus
agcaaagtgtccgtggatgaccatg

SEQ ID NO: 191463 - DNA, 25 bp, Mus musculus
agcaaagtgtccgtggtgaacccca

SEQ ID NO: 191464 - DNA, 25 bp, Mus musculus
agcaaataaggagacagtgatggca

SEQ ID NO: 191465 - DNA, 25 bp, Mus musculus
agcaaataatcagagctgagggaat

SEQ ID NO: 191466 - DNA, 25 bp, Mus musculus
agcaaataatcagaggtatgccttc

SEQ ID NO: 191467 - DNA, 25 bp, Mus musculus
agcaaatagtgaaagtcctcaggac

SEQ ID NO: 191468 - DNA, 25 bp, Mus musculus
agcaaatatgcaacacagatatgta

SEQ ID NO: 191469 - DNA, 25 bp, Mus musculus
agcaaatcagaagttacgagactac

SEQ ID NO: 191470 - DNA, 25 bp, Mus musculus
agcaaatcaggaggtgcttgtctgg

SEQ ID NO: 191471 - DNA, 25 bp, Mus musculus
agcaaatccagaggatctctctcaa

SEQ ID NO: 191472 - DNA, 25 bp, Mus musculus
agcaaatccagaggtgaaaatccag

SEQ ID NO: 191473 - DNA, 25 bp, Mus musculus
agcaaatcctagagagcctttccac

SEQ ID NO: 191474 - DNA, 25 bp, Mus musculus
agcaaatctcactggaagctcctgg

SEQ ID NO: 191475 - DNA, 25 bp, Mus musculus
agcaaatgaaattggacaggtcctt

SEQ ID NO: 191476 - DNA, 25 bp, Mus musculus
agcaaatgagggcgaacagctaatc

SEQ ID NO: 191477 - DNA, 25 bp, Mus musculus
agcaaatgattcggatatcaggata

SEQ ID NO: 191478 - DNA, 25 bp, Mus musculus
agcaaatgattcgtccaaggcggtt

SEQ ID NO: 191479 - DNA, 25 bp, Mus musculus
agcaaatgcacccaaattaaaacgg

SEQ ID NO: 191480 - DNA, 25 bp, Mus musculus
agcaaatgcgaagggtatgtcggag

SEQ ID NO: 191481 - DNA, 25 bp, Mus musculus
agcaaatgcgaagtgtgcaagtatg

SEQ ID NO: 191482 - DNA, 25 bp, Mus musculus
agcaaatgtcccagggcggcaatct

SEQ ID NO: 191483 - DNA, 25 bp, Mus musculus
agcaaatgtgaaacgctaccattgt

SEQ ID NO: 191484 - DNA, 25 bp, Mus musculus
agcaaatgtgaaaggctaccttgga

SEQ ID NO: 191485 - DNA, 25 bp, Mus musculus
agcaaatgtgaaaggctggcacaga

SEQ ID NO: 191486 - DNA, 25 bp, Mus musculus
agcaaattaacagagtgtccaagca

SEQ ID NO: 191487 - DNA, 25 bp, Mus musculus
agcaaattcaactacagtgggagtg

SEQ ID NO: 191488 - DNA, 25 bp, Mus musculus
agcaaattcagatataaaaagatct

SEQ ID NO: 191489 - DNA, 25 bp, Mus musculus
agcaaattcagctaataattttcaa

SEQ ID NO: 191490 - DNA, 25 bp, Mus musculus
agcaaattcccaggtgaagcctttg

SEQ ID NO: 191491 - DNA, 25 bp, Mus musculus
agcaaattggctgagctccccttgg

SEQ ID NO: 191492 - DNA, 25 bp, Mus musculus
agcaacaaacaattcctccatctgc

SEQ ID NO: 191493 - DNA, 25 bp, Mus musculus
agcaacaacagccatgggttctccg

SEQ ID NO: 191494 - DNA, 25 bp, Mus musculus
agcaacaacaggtgactgtggtctg

SEQ ID NO: 191495 - DNA, 25 bp, Mus musculus
agcaacaactgtcccaggtctttat

SEQ ID NO: 191496 - DNA, 25 bp, Mus musculus
agcaacaaggcgggaggaagcactg

SEQ ID NO: 191497 - DNA, 25 bp, Mus musculus
agcaacaatagaattttcatttctt

SEQ ID NO: 191498 - DNA, 25 bp, Mus musculus
agcaacaataggtgttgactttaag

SEQ ID NO: 191499 - DNA, 25 bp, Mus musculus
agcaacaatgcaggggttgacaact

SEQ ID NO: 191500 - DNA, 25 bp, Mus musculus
agcaacacaaggaggcatggtccag

SEQ ID NO: 191501 - DNA, 25 bp, Mus musculus
agcaacacagggactattccaacaa

SEQ ID NO: 191502 - DNA, 25 bp, Mus musculus
agcaacacatctgctctcctctgat

SEQ ID NO: 191503 - DNA, 25 bp, Mus musculus
agcaacacctctactgccgcccacg

SEQ ID NO: 191504 - DNA, 25 bp, Mus musculus
agcaacactcaaagattgacatggt

SEQ ID NO: 191505 - DNA, 25 bp, Mus musculus
agcaacactcaaaggagttgcaagc

SEQ ID NO: 191506 - DNA, 25 bp, Mus musculus
agcaacagagagaaggcttcgtgag

SEQ ID NO: 191507 - DNA, 25 bp, Mus musculus
agcaacagagagaagggcccgaggg

SEQ ID NO: 191508 - DNA, 25 bp, Mus musculus
agcaacagagagtgcactgaccttg

SEQ ID NO: 191509 - DNA, 25 bp, Mus musculus
agcaacagaggaacatgtgtatgtg

SEQ ID NO: 191510 - DNA, 25 bp, Mus musculus
agcaacagagtggatcacattccag

SEQ ID NO: 191511 - DNA, 25 bp, Mus musculus
agcaacagagttcttgcctctcgcc

SEQ ID NO: 191512 - DNA, 25 bp, Mus musculus
agcaacagatccaggttcaggggca

SEQ ID NO: 191513 - DNA, 25 bp, Mus musculus
agcaacagcaggcccagcctgcagg

SEQ ID NO: 191514 - DNA, 25 bp, Mus musculus
agcaacagcctgggcatatggcctc

SEQ ID NO: 191515 - DNA, 25 bp, Mus musculus
agcaacagcgatggtgagaaggcca

SEQ ID NO: 191516 - DNA, 25 bp, Mus musculus
agcaacagcgcgggatgggggcaca

SEQ ID NO: 191517 - DNA, 25 bp, Mus musculus
agcaacaggaactttgcatcatgcc

SEQ ID NO: 191518 - DNA, 25 bp, Mus musculus
agcaacaggaggacttcaaggaggc

SEQ ID NO: 191519 - DNA, 25 bp, Mus musculus
agcaacagggatgaagtacaacttg

SEQ ID NO: 191520 - DNA, 25 bp, Mus musculus
agcaacaggtgtgaacaggttccac

SEQ ID NO: 191521 - DNA, 25 bp, Mus musculus
agcaacagttggcatccagcattcg

SEQ ID NO: 191522 - DNA, 25 bp, Mus musculus
agcaacagttgggttctccccaggg

SEQ ID NO: 191523 - DNA, 25 bp, Mus musculus
agcaacagttggtcccatgcatcat

SEQ ID NO: 191524 - DNA, 25 bp, Mus musculus
agcaacataccagaatccacacagg

SEQ ID NO: 191525 - DNA, 25 bp, Mus musculus
agcaacataccagagtcctctgatg

SEQ ID NO: 191526 - DNA, 25 bp, Mus musculus
agcaacatacgtgatggaccaagag

SEQ ID NO: 191527 - DNA, 25 bp, Mus musculus
agcaacatcacagcaaagtctcgac

SEQ ID NO: 191528 - DNA, 25 bp, Mus musculus
agcaacatcacaggtggtagcagga

SEQ ID NO: 191529 - DNA, 25 bp, Mus musculus
agcaacatcacagttcatagccaga

SEQ ID NO: 191530 - DNA, 25 bp, Mus musculus
agcaacatcaggtctcggacaaaat

SEQ ID NO: 191531 - DNA, 25 bp, Mus musculus
agcaacatcatcagacttgcgtgcg

SEQ ID NO: 191532 - DNA, 25 bp, Mus musculus
agcaacatcatcagatagagactag

SEQ ID NO: 191533 - DNA, 25 bp, Mus musculus
agcaacatgaaatgtgtctaaacca

SEQ ID NO: 191534 - DNA, 25 bp, Mus musculus
agcaacatgaaggtcatgtaggaaa

SEQ ID NO: 191535 - DNA, 25 bp, Mus musculus
agcaacatgcacagcctatttaaga

SEQ ID NO: 191536 - DNA, 25 bp, Mus musculus
agcaacatggctgagcctttcagtg

SEQ ID NO: 191537 - DNA, 25 bp, Mus musculus
agcaacatggctgagtgctacggag

SEQ ID NO: 191538 - DNA, 25 bp, Mus musculus
agcaaccaagctgtgattggactgg

SEQ ID NO: 191539 - DNA, 25 bp, Mus musculus
agcaaccaaggagacagtgatggca

SEQ ID NO: 191540 - DNA, 25 bp, Mus musculus
agcaaccaaggagtcaaatattgga

SEQ ID NO: 191541 - DNA, 25 bp, Mus musculus
agcaaccagagagcaccgtactgga

SEQ ID NO: 191542 - DNA, 25 bp, Mus musculus
agcaaccagagcacctgtctcctgt

SEQ ID NO: 191543 - DNA, 25 bp, Mus musculus
agcaaccatgcgtgagtgcatctcc

SEQ ID NO: 191544 - DNA, 25 bp, Mus musculus
agcaaccccagattccagaggggtg

SEQ ID NO: 191545 - DNA, 25 bp, Mus musculus
agcaacccgaagcagaagcaggtat

SEQ ID NO: 191546 - DNA, 25 bp, Mus musculus
agcaaccgcgccatggtctgccagg

SEQ ID NO: 191547 - DNA, 25 bp, Mus musculus
agcaaccgcgccatgtgatctcagc

SEQ ID NO: 191548 - DNA, 25 bp, Mus musculus
agcaaccgctatggaattgccatgt

SEQ ID NO: 191549 - DNA, 25 bp, Mus musculus
agcaaccgtgcaggactagcctgag

SEQ ID NO: 191550 - DNA, 25 bp, Mus musculus
agcaacctagccaagtgcattgttg

SEQ ID NO: 191551 - DNA, 25 bp, Mus musculus
agcaacctcatacattaaagtgatg

SEQ ID NO: 191552 - DNA, 25 bp, Mus musculus
agcaacctcatccctggcagcccct

SEQ ID NO: 191553 - DNA, 25 bp, Mus musculus
agcaacctcatttccctgactgaac

SEQ ID NO: 191554 - DNA, 25 bp, Mus musculus
agcaacctccaaagatggaaaagcc

SEQ ID NO: 191555 - DNA, 25 bp, Mus musculus
agcaacctccaagcctgaagggcac

SEQ ID NO: 191556 - DNA, 25 bp, Mus musculus
agcaacctccaaggagtgtctaaaa

SEQ ID NO: 191557 - DNA, 25 bp, Mus musculus
agcaacctccagctctcttccggct

SEQ ID NO: 191558 - DNA, 25 bp, Mus musculus
agcaacctgctgaatttgttggagc

SEQ ID NO: 191559 - DNA, 25 bp, Mus musculus
agcaacctgctggccgtggagactg

SEQ ID NO: 191560 - DNA, 25 bp, Mus musculus
agcaaccttgacgcatcgtggctga

SEQ ID NO: 191561 - DNA, 25 bp, Mus musculus
agcaacgaaagatgtgatacaaagc

SEQ ID NO: 191562 - DNA, 25 bp, Mus musculus
agcaacgaaagctcctgcaaagcag

SEQ ID NO: 191563 - DNA, 25 bp, Mus musculus
agcaacgaatccttagtggccaata

SEQ ID NO: 191564 - DNA, 25 bp, Mus musculus
agcaacgaccctgaggacggggccc

SEQ ID NO: 191565 - DNA, 25 bp, Mus musculus
agcaacgagtgcaaggctgatatag

SEQ ID NO: 191566 - DNA, 25 bp, Mus musculus
agcaacgagtgcaaggtttgacttt

SEQ ID NO: 191567 - DNA, 25 bp, Mus musculus
agcaacgatagtatttttgacagtg

SEQ ID NO: 191568 - DNA, 25 bp, Mus musculus
agcaacgcccagagagatgtcttca

SEQ ID NO: 191569 - DNA, 25 bp, Mus musculus
agcaacgcgtttgggtctcttacaa

SEQ ID NO: 191570 - DNA, 25 bp, Mus musculus
agcaacgctaggttcggagcgaccg

SEQ ID NO: 191571 - DNA, 25 bp, Mus musculus
agcaacggcaaggtggttgctgtat

SEQ ID NO: 191572 - DNA, 25 bp, Mus musculus
agcaacggcagctggaaccaccatc

SEQ ID NO: 191573 - DNA, 25 bp, Mus musculus
agcaacggcagctggcctcctatgc

SEQ ID NO: 191574 - DNA, 25 bp, Mus musculus
agcaacggccctgattgaagatatt

SEQ ID NO: 191575 - DNA, 25 bp, Mus musculus
agcaacggtgcggcagcgtgcttcc

SEQ ID NO: 191576 - DNA, 25 bp, Mus musculus
agcaacgtcagggctacacatcttt

SEQ ID NO: 191577 - DNA, 25 bp, Mus musculus
agcaacgtcaggtaagaatgacaac

SEQ ID NO: 191578 - DNA, 25 bp, Mus musculus
agcaacgtggaaatacttcggatat

SEQ ID NO: 191579 - DNA, 25 bp, Mus musculus
agcaacgtggggttgagactcacac

SEQ ID NO: 191580 - DNA, 25 bp, Mus musculus
agcaactaagattcctctcgtggct

SEQ ID NO: 191581 - DNA, 25 bp, Mus musculus
agcaactaaggttcagagaaacagt

SEQ ID NO: 191582 - DNA, 25 bp, Mus musculus
agcaactccgcctccctgcctctgt

SEQ ID NO: 191583 - DNA, 25 bp, Mus musculus
agcaactccggagcctggtgaaaaa

SEQ ID NO: 191584 - DNA, 25 bp, Mus musculus
agcaactgaagactgtcactagatg

SEQ ID NO: 191585 - DNA, 25 bp, Mus musculus
agcaactgagaggggagcaaatttt

SEQ ID NO: 191586 - DNA, 25 bp, Mus musculus
agcaactgcaggacagtctccgtaa

SEQ ID NO: 191587 - DNA, 25 bp, Mus musculus
agcaactgcaggtggaagagctgtt

SEQ ID NO: 191588 - DNA, 25 bp, Mus musculus
agcaactgccaagagtctgacagca

SEQ ID NO: 191589 - DNA, 25 bp, Mus musculus
agcaactgccaggagaatcccagtg

SEQ ID NO: 191590 - DNA, 25 bp, Mus musculus
agcaactggaatgaggccctgctcc

SEQ ID NO: 191591 - DNA, 25 bp, Mus musculus
agcaactgtggaagaatttgagcat

SEQ ID NO: 191592 - DNA, 25 bp, Mus musculus
agcaactgtggaagattcttgacaa

SEQ ID NO: 191593 - DNA, 25 bp, Mus musculus
agcaacttatccagatcacctcagc

SEQ ID NO: 191594 - DNA, 25 bp, Mus musculus
agcaacttcgtgcaggtgacccggt

SEQ ID NO: 191595 - DNA, 25 bp, Mus musculus
agcaacttgaggctcctgagcatct

SEQ ID NO: 191596 - DNA, 25 bp, Mus musculus
agcaacttgtcttcactctgcctac

SEQ ID NO: 191597 - DNA, 25 bp, Mus musculus
agcaactttttctgctaatgcctcg

SEQ ID NO: 191598 - DNA, 25 bp, Mus musculus
agcaagaaaagaaagaatgcgtcca

SEQ ID NO: 191599 - DNA, 25 bp, Mus musculus
agcaagaaagatgttattcttcaaa

SEQ ID NO: 191600 - DNA, 25 bp, Mus musculus
agcaagaaagctcaggaagtggagg

SEQ ID NO: 191601 - DNA, 25 bp, Mus musculus
agcaagaaagctgcaggaatgagca

SEQ ID NO: 191602 - DNA, 25 bp, Mus musculus
agcaagaacaccttcagtgagatga

SEQ ID NO: 191603 - DNA, 25 bp, Mus musculus
agcaagaagaaagagaagcagggtc

SEQ ID NO: 191604 - DNA, 25 bp, Mus musculus
agcaagaagaacaaggatgtccccg

SEQ ID NO: 191605 - DNA, 25 bp, Mus musculus
agcaagaaggacctagaccgcgact

SEQ ID NO: 191606 - DNA, 25 bp, Mus musculus
agcaagaagggtcttgttgcagcat

SEQ ID NO: 191607 - DNA, 25 bp, Mus musculus
agcaagaagtggaggcaggactctg

SEQ ID NO: 191608 - DNA, 25 bp, Mus musculus
agcaagaatacaggtatggttttct

SEQ ID NO: 191609 - DNA, 25 bp, Mus musculus
agcaagaatctgaggcctgtgagaa

SEQ ID NO: 191610 - DNA, 25 bp, Mus musculus
agcaagaattaagtcagtggtgcag

SEQ ID NO: 191611 - DNA, 25 bp, Mus musculus
agcaagacatgcagcctctatttaa

SEQ ID NO: 191612 - DNA, 25 bp, Mus musculus
agcaagaccacaacagcatgtagtt

SEQ ID NO: 191613 - DNA, 25 bp, Mus musculus
agcaagaccatgactggccaaaaca

SEQ ID NO: 191614 - DNA, 25 bp, Mus musculus
agcaagacccagatcctctcttctc

SEQ ID NO: 191615 - DNA, 25 bp, Mus musculus
agcaagacccaggacctgttccgca

SEQ ID NO: 191616 - DNA, 25 bp, Mus musculus
agcaagagcgatgtggtatgccctg

SEQ ID NO: 191617 - DNA, 25 bp, Mus musculus
agcaagagcgatgtgtggtccttcg

SEQ ID NO: 191618 - DNA, 25 bp, Mus musculus
agcaagagtaatgaggactctctga

SEQ ID NO: 191619 - DNA, 25 bp, Mus musculus
agcaagatacagccctgctggtagc

SEQ ID NO: 191620 - DNA, 25 bp, Mus musculus
agcaagatactgggatctcgctgga

SEQ ID NO: 191621 - DNA, 25 bp, Mus musculus
agcaagatactggggtctcactatg

SEQ ID NO: 191622 - DNA, 25 bp, Mus musculus
agcaagatatggaggccaggaaaca

SEQ ID NO: 191623 - DNA, 25 bp, Mus musculus
agcaagatcaaggcattatgttatc

SEQ ID NO: 191624 - DNA, 25 bp, Mus musculus
agcaagatccgagccttcatcctcc

SEQ ID NO: 191625 - DNA, 25 bp, Mus musculus
agcaagatcctgcttgagaaaagca

SEQ ID NO: 191626 - DNA, 25 bp, Mus musculus
agcaagatgctaggcaagtcttgga

SEQ ID NO: 191627 - DNA, 25 bp, Mus musculus
agcaagatgtggaaaaagccaaacc

SEQ ID NO: 191628 - DNA, 25 bp, Mus musculus
agcaagatgtggaaaaagccacaaa

SEQ ID NO: 191629 - DNA, 25 bp, Mus musculus
agcaagatgtggcaatccccagaga

SEQ ID NO: 191630 - DNA, 25 bp, Mus musculus
agcaagcaagcagacttgtccttct

SEQ ID NO: 191631 - DNA, 25 bp, Mus musculus
agcaagcacatcgtatggcgcccag

SEQ ID NO: 191632 - DNA, 25 bp, Mus musculus
agcaagcacgcccccagaggtactc

SEQ ID NO: 191633 - DNA, 25 bp, Mus musculus
agcaagcacgtggttgaagacttga

SEQ ID NO: 191634 - DNA, 25 bp, Mus musculus
agcaagcagcaggagaaaaaaatgc

SEQ ID NO: 191635 - DNA, 25 bp, Mus musculus
agcaagcagcaggagacagtgaccc

SEQ ID NO: 191636 - DNA, 25 bp, Mus musculus
agcaagcagcaggagatgaggcccg

SEQ ID NO: 191637 - DNA, 25 bp, Mus musculus
agcaagcaggaggcagacaaaaagt

SEQ ID NO: 191638 - DNA, 25 bp, Mus musculus
agcaagcatgaatgaagtcttacac

SEQ ID NO: 191639 - DNA, 25 bp, Mus musculus
agcaagcatgagaaaggctgggatt

SEQ ID NO: 191640 - DNA, 25 bp, Mus musculus
agcaagccaagctgatctataagtg

SEQ ID NO: 191641 - DNA, 25 bp, Mus musculus
agcaagccacgagaggtgagggagt

SEQ ID NO: 191642 - DNA, 25 bp, Mus musculus
agcaagccagagggcacccacaaaa

SEQ ID NO: 191643 - DNA, 25 bp, Mus musculus
agcaagccagaggtgtttgggaaca

SEQ ID NO: 191644 - DNA, 25 bp, Mus musculus
agcaagccagtctggagttggtgtg

SEQ ID NO: 191645 - DNA, 25 bp, Mus musculus
agcaagccatcagaaggagtgaaaa

SEQ ID NO: 191646 - DNA, 25 bp, Mus musculus
agcaagccatcaggaaatcccttga

SEQ ID NO: 191647 - DNA, 25 bp, Mus musculus
agcaagccatctaagcccagagtga

SEQ ID NO: 191648 - DNA, 25 bp, Mus musculus
agcaagcctgagcctgaagagactt

SEQ ID NO: 191649 - DNA, 25 bp, Mus musculus
agcaagcgactccgattctgacagt

SEQ ID NO: 191650 - DNA, 25 bp, Mus musculus
agcaagcgcaccagagaatccgtga

SEQ ID NO: 191651 - DNA, 25 bp, Mus musculus
agcaagcggccgaccttgcacttga

SEQ ID NO: 191652 - DNA, 25 bp, Mus musculus
agcaagcggccggcttcctttctga

SEQ ID NO: 191653 - DNA, 25 bp, Mus musculus
agcaagcgtttgcaggccatcgaag

SEQ ID NO: 191654 - DNA, 25 bp, Mus musculus
agcaagctaacgcctactctgtatg

SEQ ID NO: 191655 - DNA, 25 bp, Mus musculus
agcaagctagtgagcagtgggaaga

SEQ ID NO: 191656 - DNA, 25 bp, Mus musculus
agcaagctgctcgactggctggtgg

SEQ ID NO: 191657 - DNA, 25 bp, Mus musculus
agcaagctggaagaagagacttttc

SEQ ID NO: 191658 - DNA, 25 bp, Mus musculus
agcaagctggaagaagctgggaggg

SEQ ID NO: 191659 - DNA, 25 bp, Mus musculus
agcaagctggaagctgaaattaaaa

SEQ ID NO: 191660 - DNA, 25 bp, Mus musculus
agcaagctggaaggggctgcagtgc

SEQ ID NO: 191661 - DNA, 25 bp, Mus musculus
agcaagcttccctgtttttagcaac

SEQ ID NO: 191662 - DNA, 25 bp, Mus musculus
agcaagcttcggaggggaaaatgga

SEQ ID NO: 191663 - DNA, 25 bp, Mus musculus
agcaaggaaatctgggtcttcggat

SEQ ID NO: 191664 - DNA, 25 bp, Mus musculus
agcaaggaaggaatggtgagccttc

SEQ ID NO: 191665 - DNA, 25 bp, Mus musculus
agcaaggacacagggtctcttacaa

SEQ ID NO: 191666 - DNA, 25 bp, Mus musculus
agcaaggacagtactctcccatggc

SEQ ID NO: 191667 - DNA, 25 bp, Mus musculus
agcaaggacccaagcaaccgacgcc

SEQ ID NO: 191668 - DNA, 25 bp, Mus musculus
agcaaggagaagctggtccctccag

SEQ ID NO: 191669 - DNA, 25 bp, Mus musculus
agcaaggaggaggagggcagaaggc

SEQ ID NO: 191670 - DNA, 25 bp, Mus musculus
agcaaggaggaggagtcaagttgga

SEQ ID NO: 191671 - DNA, 25 bp, Mus musculus
agcaaggaggagtgttgagtggaga

SEQ ID NO: 191672 - DNA, 25 bp, Mus musculus
agcaaggaggggctgagaaaataaa

SEQ ID NO: 191673 - DNA, 25 bp, Mus musculus
agcaaggcaaagtttgaaactgctc

SEQ ID NO: 191674 - DNA, 25 bp, Mus musculus
agcaaggcatggaactcagtggctc

SEQ ID NO: 191675 - DNA, 25 bp, Mus musculus
agcaaggccagatgctgaaattacc

SEQ ID NO: 191676 - DNA, 25 bp, Mus musculus
agcaaggccagatggatgctgttcg

SEQ ID NO: 191677 - DNA, 25 bp, Mus musculus
agcaaggccagatgtgatgctgttg

SEQ ID NO: 191678 - DNA, 25 bp, Mus musculus
agcaaggccaggaggaagaaaatta

SEQ ID NO: 191679 - DNA, 25 bp, Mus musculus
agcaaggccaggaggaggacccagg

SEQ ID NO: 191680 - DNA, 25 bp, Mus musculus
agcaaggccaggcggaaaaagtgga

SEQ ID NO: 191681 - DNA, 25 bp, Mus musculus
agcaaggccaggcggaaggtgatgt

SEQ ID NO: 191682 - DNA, 25 bp, Mus musculus
agcaaggcctcaagttgggatatct

SEQ ID NO: 191683 - DNA, 25 bp, Mus musculus
agcaaggcctggacgaaaaccacga

SEQ ID NO: 191684 - DNA, 25 bp, Mus musculus
agcaaggcctggacgacgctgagca

SEQ ID NO: 191685 - DNA, 25 bp, Mus musculus
agcaaggcgagagggtatcccagga

SEQ ID NO: 191686 - DNA, 25 bp, Mus musculus
agcaaggctacggaggctatggggc

SEQ ID NO: 191687 - DNA, 25 bp, Mus musculus
agcaaggctggagcggaagggtttg

SEQ ID NO: 191688 - DNA, 25 bp, Mus musculus
agcaagggatacccggcgtaatctc

SEQ ID NO: 191689 - DNA, 25 bp, Mus musculus
agcaagggcaggactcctttacact

SEQ ID NO: 191690 - DNA, 25 bp, Mus musculus
agcaagggcgattccccaaaggccc

SEQ ID NO: 191691 - DNA, 25 bp, Mus musculus
agcaaggtaagctctgaggatgagg

SEQ ID NO: 191692 - DNA, 25 bp, Mus musculus
agcaaggtcaggacccagctgtggc

SEQ ID NO: 191693 - DNA, 25 bp, Mus musculus
agcaaggtgaccagggtattcctgg

SEQ ID NO: 191694 - DNA, 25 bp, Mus musculus
agcaaggtgacgatgctgcttgttg

SEQ ID NO: 191695 - DNA, 25 bp, Mus musculus
agcaaggtgacgttgctgcttgttg

SEQ ID NO: 191696 - DNA, 25 bp, Mus musculus
agcaagtaccttgggatcagagggc

SEQ ID NO: 191697 - DNA, 25 bp, Mus musculus
agcaagtaccttgggggccggcaca

SEQ ID NO: 191698 - DNA, 25 bp, Mus musculus
agcaagtagctgatattgacgggca

SEQ ID NO: 191699 - DNA, 25 bp, Mus musculus
agcaagtattaccgtaataaaagag

SEQ ID NO: 191700 - DNA, 25 bp, Mus musculus
agcaagtcagaaggcttcggagttg

SEQ ID NO: 191701 - DNA, 25 bp, Mus musculus
agcaagtcagaagttttggggttac

SEQ ID NO: 191702 - DNA, 25 bp, Mus musculus
agcaagtcagatgaatggaaacttt

SEQ ID NO: 191703 - DNA, 25 bp, Mus musculus
agcaagtgcaagcaatagctgtctg

SEQ ID NO: 191704 - DNA, 25 bp, Mus musculus
agcaagtgcaaggcaaaggcagagc

SEQ ID NO: 191705 - DNA, 25 bp, Mus musculus
agcaagtgcaaggtttctgaaagac

SEQ ID NO: 191706 - DNA, 25 bp, Mus musculus
agcaagtgccaattcctgaatgcca

SEQ ID NO: 191707 - DNA, 25 bp, Mus musculus
agcaagtgtctgaacgagaagaact

SEQ ID NO: 191708 - DNA, 25 bp, Mus musculus
agcaagttccagaacctgggtgtgg

SEQ ID NO: 191709 - DNA, 25 bp, Mus musculus
agcaataaggaacaggacggacgga

SEQ ID NO: 191710 - DNA, 25 bp, Mus musculus
agcaataaggaacagtcagagctaa

SEQ ID NO: 191711 - DNA, 25 bp, Mus musculus
agcaatacaaagcttcaagaaaaat

SEQ ID NO: 191712 - DNA, 25 bp, Mus musculus
agcaatacaaagtacctacgcatgc

SEQ ID NO: 191713 - DNA, 25 bp, Mus musculus
agcaataccctcacaaccccggcta

SEQ ID NO: 191714 - DNA, 25 bp, Mus musculus
agcaatcaaagcttatttccaaaga

SEQ ID NO: 191715 - DNA, 25 bp, Mus musculus
agcaatcaaaggtgagacgacaaga

SEQ ID NO: 191716 - DNA, 25 bp, Mus musculus
agcaatcaaggctttacaagatgaa

SEQ ID NO: 191717 - DNA, 25 bp, Mus musculus
agcaatcagcctgttgttgctcacc

SEQ ID NO: 191718 - DNA, 25 bp, Mus musculus
agcaatcattcccaagaatctgggt

SEQ ID NO: 191719 - DNA, 25 bp, Mus musculus
agcaatcattcccaagacaagcagt

SEQ ID NO: 191720 - DNA, 25 bp, Mus musculus
agcaatcattcccaagcatccagcg

SEQ ID NO: 191721 - DNA, 25 bp, Mus musculus
agcaatccatgagatcagggcactg

SEQ ID NO: 191722 - DNA, 25 bp, Mus musculus
agcaatcccatctgcttcgagagct

SEQ ID NO: 191723 - DNA, 25 bp, Mus musculus
agcaatctcaacaggacaagaaaag

SEQ ID NO: 191724 - DNA, 25 bp, Mus musculus
agcaatctcaacaggtttatttatt

SEQ ID NO: 191725 - DNA, 25 bp, Mus musculus
agcaatctcagggttttggcaagga

SEQ ID NO: 191726 - DNA, 25 bp, Mus musculus
agcaatctctgcacctttggggaac

SEQ ID NO: 191727 - DNA, 25 bp, Mus musculus
agcaatctcttagtgagaagccagt

SEQ ID NO: 191728 - DNA, 25 bp, Mus musculus
agcaatctcttagtgataacaaaga

SEQ ID NO: 191729 - DNA, 25 bp, Mus musculus
agcaatcttccctggcacagaaaca

SEQ ID NO: 191730 - DNA, 25 bp, Mus musculus
agcaatgagaatgattcccttcagg

SEQ ID NO: 191731 - DNA, 25 bp, Mus musculus
agcaatgaggccggcgtcctccgcc

SEQ ID NO: 191732 - DNA, 25 bp, Mus musculus
agcaatgatattgacttagaaggtt

SEQ ID NO: 191733 - DNA, 25 bp, Mus musculus
agcaatgcaggggggcttggtgggg

SEQ ID NO: 191734 - DNA, 25 bp, Mus musculus
agcaatgccagaggagtctaagtct

SEQ ID NO: 191735 - DNA, 25 bp, Mus musculus
agcaatgccagaggagtctaatgac

SEQ ID NO: 191736 - DNA, 25 bp, Mus musculus
agcaatgccagagtctgttataatg

SEQ ID NO: 191737 - DNA, 25 bp, Mus musculus
agcaatgccagtgccttcgtgcatc

SEQ ID NO: 191738 - DNA, 25 bp, Mus musculus
agcaatgccagttttcccatgaccc

SEQ ID NO: 191739 - DNA, 25 bp, Mus musculus
agcaatgcttctgattcttataaac

SEQ ID NO: 191740 - DNA, 25 bp, Mus musculus
agcaatgcttctggtgaccttgggg

SEQ ID NO: 191741 - DNA, 25 bp, Mus musculus
agcaatggaagggcagcagagcttt

SEQ ID NO: 191742 - DNA, 25 bp, Mus musculus
agcaatggaatcctctggcaagcgc

SEQ ID NO: 191743 - DNA, 25 bp, Mus musculus
agcaatggagaaaaagtaaatataa

SEQ ID NO: 191744 - DNA, 25 bp, Mus musculus
agcaatggagaaaacttctaaagat

SEQ ID NO: 191745 - DNA, 25 bp, Mus musculus
agcaatggagaaaatttgccttgaa

SEQ ID NO: 191746 - DNA, 25 bp, Mus musculus
agcaatggagcttggcatggatccc

SEQ ID NO: 191747 - DNA, 25 bp, Mus musculus
agcaatggaggaattttgacaactt

SEQ ID NO: 191748 - DNA, 25 bp, Mus musculus
agcaatggaggcaggtggaagagct

SEQ ID NO: 191749 - DNA, 25 bp, Mus musculus
agcaatggctcagggccatcgaaga

SEQ ID NO: 191750 - DNA, 25 bp, Mus musculus
agcaatggtgacctgctccagtgtg

SEQ ID NO: 191751 - DNA, 25 bp, Mus musculus
agcaatggtgtgaacaacccagacc

SEQ ID NO: 191752 - DNA, 25 bp, Mus musculus
agcaatgtcaggcgtccgacctccc

SEQ ID NO: 191753 - DNA, 25 bp, Mus musculus
agcaatgtggaaatctctcaggaga

SEQ ID NO: 191754 - DNA, 25 bp, Mus musculus
agcaatgtggaaatgtgttctgccc

SEQ ID NO: 191755 - DNA, 25 bp, Mus musculus
agcaatgtggaaattttatagaaca

SEQ ID NO: 191756 - DNA, 25 bp, Mus musculus
agcaatgtggacctggccatgggca

SEQ ID NO: 191757 - DNA, 25 bp, Mus musculus
agcaatgtgtgggttgaatttacta

SEQ ID NO: 191758 - DNA, 25 bp, Mus musculus
agcaattaaggaactagaggctgcc

SEQ ID NO: 191759 - DNA, 25 bp, Mus musculus
agcaattaagggagtggccaggttc

SEQ ID NO: 191760 - DNA, 25 bp, Mus musculus
agcaattacagaaggtcaccagaaa

SEQ ID NO: 191761 - DNA, 25 bp, Mus musculus
agcaattcaaggtattcacactgcc

SEQ ID NO: 191762 - DNA, 25 bp, Mus musculus
agcaattcagtgaggccttggaaac

SEQ ID NO: 191763 - DNA, 25 bp, Mus musculus
agcaattcagtgaggtcaaaggact

SEQ ID NO: 191764 - DNA, 25 bp, Mus musculus
agcaattcgtgcaccgtaacgtacc

SEQ ID NO: 191765 - DNA, 25 bp, Mus musculus
agcaattctggatatgctctccatt

SEQ ID NO: 191766 - DNA, 25 bp, Mus musculus
agcaattctgttcaggaggaagcag

SEQ ID NO: 191767 - DNA, 25 bp, Mus musculus
agcaattgaaatcacagctcccgag

SEQ ID NO: 191768 - DNA, 25 bp, Mus musculus
agcaattgaaatcagggaagctgct

SEQ ID NO: 191769 - DNA, 25 bp, Mus musculus
agcaattgcaggactctgatgggga

SEQ ID NO: 191770 - DNA, 25 bp, Mus musculus
agcaattgcgagctctgcaggagcg

SEQ ID NO: 191771 - DNA, 25 bp, Mus musculus
agcaattggcacacactggttctgg

SEQ ID NO: 191772 - DNA, 25 bp, Mus musculus
agcaattggcgaggactttgtgttg

SEQ ID NO: 191773 - DNA, 25 bp, Mus musculus
agcacaaacagaggcaaatattgtg

SEQ ID NO: 191774 - DNA, 25 bp, Mus musculus
agcacaaacaggccaaactcaaaga

SEQ ID NO: 191775 - DNA, 25 bp, Mus musculus
agcacaaagcagatttcaggtatat

SEQ ID NO: 191776 - DNA, 25 bp, Mus musculus
agcacaaagcagtgtggtcatccca

SEQ ID NO: 191777 - DNA, 25 bp, Mus musculus
agcacaaataatagtgcttacagac

SEQ ID NO: 191778 - DNA, 25 bp, Mus musculus
agcacaaattaatcacaatatcgcc

SEQ ID NO: 191779 - DNA, 25 bp, Mus musculus
agcacaacacaatggaagtcgatgg

SEQ ID NO: 191780 - DNA, 25 bp, Mus musculus
agcacaacagagacacagtgtcgta

SEQ ID NO: 191781 - DNA, 25 bp, Mus musculus
agcacaaccagcagaaaacatggtg

SEQ ID NO: 191782 - DNA, 25 bp, Mus musculus
agcacaaccagcagaatgtggctgc

SEQ ID NO: 191783 - DNA, 25 bp, Mus musculus
agcacaactcaagcctaccaccact

SEQ ID NO: 191784 - DNA, 25 bp, Mus musculus
agcacaactcaaggtgaaatttgaa

SEQ ID NO: 191785 - DNA, 25 bp, Mus musculus
agcacaagaaaaggctgcagaagag

SEQ ID NO: 191786 - DNA, 25 bp, Mus musculus
agcacaagcccaaggctgctgacaa

SEQ ID NO: 191787 - DNA, 25 bp, Mus musculus
agcacaagcgagggaagctaacagc

SEQ ID NO: 191788 - DNA, 25 bp, Mus musculus
agcacaatattccaacggtgcccct

SEQ ID NO: 191789 - DNA, 25 bp, Mus musculus
agcacaatcaagtctaaactagagt

SEQ ID NO: 191790 - DNA, 25 bp, Mus musculus
agcacaatcagagctattctcaagc

SEQ ID NO: 191791 - DNA, 25 bp, Mus musculus
agcacaatcaggtggaaacttcaca

SEQ ID NO: 191792 - DNA, 25 bp, Mus musculus
agcacaatcaggtggccaataggtt

SEQ ID NO: 191793 - DNA, 25 bp, Mus musculus
agcacaatcaggtgggagaaaaaac

SEQ ID NO: 191794 - DNA, 25 bp, Mus musculus
agcacaatcgagagcagcaaaagcg

SEQ ID NO: 191795 - DNA, 25 bp, Mus musculus
agcacaatcgagatcctgcctcaga

SEQ ID NO: 191796 - DNA, 25 bp, Mus musculus
agcacacaagcggatgaaggttaag

SEQ ID NO: 191797 - DNA, 25 bp, Mus musculus
agcacacacaagggctgggtatggt

SEQ ID NO: 191798 - DNA, 25 bp, Mus musculus
agcacacacagacactggatcccta

SEQ ID NO: 191799 - DNA, 25 bp, Mus musculus
agcacacacaggggcagttccagaa

SEQ ID NO: 191800 - DNA, 25 bp, Mus musculus
agcacacagacctatgcttggatgc

SEQ ID NO: 191801 - DNA, 25 bp, Mus musculus
agcacacagggttttggtaaaacta

SEQ ID NO: 191802 - DNA, 25 bp, Mus musculus
agcacacagtagacactacttcatc

SEQ ID NO: 191803 - DNA, 25 bp, Mus musculus
agcacacagttcctagtcactcgag

SEQ ID NO: 191804 - DNA, 25 bp, Mus musculus
agcacacatggaaccatgaatttgt

SEQ ID NO: 191805 - DNA, 25 bp, Mus musculus
agcacaccagaactatgccgagtgg

SEQ ID NO: 191806 - DNA, 25 bp, Mus musculus
agcacacccagaactgagcacaaca

SEQ ID NO: 191807 - DNA, 25 bp, Mus musculus
agcacacccagcagcccgagcaaca

SEQ ID NO: 191808 - DNA, 25 bp, Mus musculus
agcacacccaggtgccagcctcaca

SEQ ID NO: 191809 - DNA, 25 bp, Mus musculus
agcacaccggagtgcaatcaaaacc

SEQ ID NO: 191810 - DNA, 25 bp, Mus musculus
agcacaccggagtggtgacaaatgg

SEQ ID NO: 191811 - DNA, 25 bp, Mus musculus
agcacacctggagcctgttattctc

SEQ ID NO: 191812 - DNA, 25 bp, Mus musculus
agcacacgagatttttatcaccgtg

SEQ ID NO: 191813 - DNA, 25 bp, Mus musculus
agcacacggcagccggttgcctctt

SEQ ID NO: 191814 - DNA, 25 bp, Mus musculus
agcacacggcagtgactgatcacac

SEQ ID NO: 191815 - DNA, 25 bp, Mus musculus
agcacacgtgctcagagcagagcct

SEQ ID NO: 191816 - DNA, 25 bp, Mus musculus
agcacacgtgctcagccctttgttc

SEQ ID NO: 191817 - DNA, 25 bp, Mus musculus
agcacactggccatgaacgtcctgt

SEQ ID NO: 191818 - DNA, 25 bp, Mus musculus
agcacacttgtatggggatcctgcc

SEQ ID NO: 191819 - DNA, 25 bp, Mus musculus
agcacacttgtccaacaaagttcct

SEQ ID NO: 191820 - DNA, 25 bp, Mus musculus
agcacacttgttgtttacctgctgc

SEQ ID NO: 191821 - DNA, 25 bp, Mus musculus
agcacagaaaaagagaagctgatgg

SEQ ID NO: 191822 - DNA, 25 bp, Mus musculus
agcacagaaaggagcttgaaggatg

SEQ ID NO: 191823 - DNA, 25 bp, Mus musculus
agcacagaaggaacagattctggtt

SEQ ID NO: 191824 - DNA, 25 bp, Mus musculus
agcacagaagggaaggtgggctacg

SEQ ID NO: 191825 - DNA, 25 bp, Mus musculus
agcacagacaaagtggacaccatgg

SEQ ID NO: 191826 - DNA, 25 bp, Mus musculus
agcacagacctcctgatcacttgta

SEQ ID NO: 191827 - DNA, 25 bp, Mus musculus
agcacagcaaagcgccaggctccga

SEQ ID NO: 191828 - DNA, 25 bp, Mus musculus
agcacagcaactttctccggctgtc

SEQ ID NO: 191829 - DNA, 25 bp, Mus musculus
agcacagcaagagtgctgtcgactg

SEQ ID NO: 191830 - DNA, 25 bp, Mus musculus
agcacagcagatttaggaccgataa

SEQ ID NO: 191831 - DNA, 25 bp, Mus musculus
agcacagcagggacagggtggtggg

SEQ ID NO: 191832 - DNA, 25 bp, Mus musculus
agcacagcatgagaaactctctgga

SEQ ID NO: 191833 - DNA, 25 bp, Mus musculus
agcacagccatcttgcttcctcaca

SEQ ID NO: 191834 - DNA, 25 bp, Mus musculus
agcacagccatgctgtcaatcaact

SEQ ID NO: 191835 - DNA, 25 bp, Mus musculus
agcacagccccaggccagcagagga

SEQ ID NO: 191836 - DNA, 25 bp, Mus musculus
agcacagccccagtgctctctctgt

SEQ ID NO: 191837 - DNA, 25 bp, Mus musculus
agcacagcccccactatcttgcctc

SEQ ID NO: 191838 - DNA, 25 bp, Mus musculus
agcacagcccccactcactcgcctc

SEQ ID NO: 191839 - DNA, 25 bp, Mus musculus
agcacagcccccactgtccaggtgc

SEQ ID NO: 191840 - DNA, 25 bp, Mus musculus
agcacagcccccagctcgtagtgca

SEQ ID NO: 191841 - DNA, 25 bp, Mus musculus
agcacagcctaagatggtcactcgg

SEQ ID NO: 191842 - DNA, 25 bp, Mus musculus
agcacagcctctacccccttcctgc

SEQ ID NO: 191843 - DNA, 25 bp, Mus musculus
agcacagcgtggtcacctccagccc

SEQ ID NO: 191844 - DNA, 25 bp, Mus musculus
agcacagctaccgaggagagagtca

SEQ ID NO: 191845 - DNA, 25 bp, Mus musculus
agcacagctaccgaggtgctgcagg

SEQ ID NO: 191846 - DNA, 25 bp, Mus musculus
agcacagcttcagaacaaaagtcca

SEQ ID NO: 191847 - DNA, 25 bp, Mus musculus
agcacagcttcagattccatcaatc

SEQ ID NO: 191848 - DNA, 25 bp, Mus musculus
agcacaggaaagaagattcttgaca

SEQ ID NO: 191849 - DNA, 25 bp, Mus musculus
agcacaggaagattcatgagatatt

SEQ ID NO: 191850 - DNA, 25 bp, Mus musculus
agcacaggattgaggtccagaagga

SEQ ID NO: 191851 - DNA, 25 bp, Mus musculus
agcacaggccttgggctggagcacc

SEQ ID NO: 191852 - DNA, 25 bp, Mus musculus
agcacagggtggagcatctgatgac

SEQ ID NO: 191853 - DNA, 25 bp, Mus musculus
agcacaggtccagagcatggggggg

SEQ ID NO: 191854 - DNA, 25 bp, Mus musculus
agcacagtaaaggtctgtggaggaa

SEQ ID NO: 191855 - DNA, 25 bp, Mus musculus
agcacagtcggagccagggagagcg

SEQ ID NO: 191856 - DNA, 25 bp, Mus musculus
agcacagtgaaggcagtcggagcag

SEQ ID NO: 191857 - DNA, 25 bp, Mus musculus
agcacagtgggtgttggacgtcagg

SEQ ID NO: 191858 - DNA, 25 bp, Mus musculus
agcacagtggtttattgctgtgcgt

SEQ ID NO: 191859 - DNA, 25 bp, Mus musculus
agcacagttggccgatatgaaaatc

SEQ ID NO: 191860 - DNA, 25 bp, Mus musculus
agcacatacagggagcctgctttgg

SEQ ID NO: 191861 - DNA, 25 bp, Mus musculus
agcacatcaaggaacagagagaccc

SEQ ID NO: 191862 - DNA, 25 bp, Mus musculus
agcacatcaaggaacttctagccat

SEQ ID NO: 191863 - DNA, 25 bp, Mus musculus
agcacatcaagttacaacaggaact

SEQ ID NO: 191864 - DNA, 25 bp, Mus musculus
agcacatcagctgcacctcagtccc

SEQ ID NO: 191865 - DNA, 25 bp, Mus musculus
agcacatcagctggtcctatgtatg

SEQ ID NO: 191866 - DNA, 25 bp, Mus musculus
agcacatccagaaggagcttgtgga

SEQ ID NO: 191867 - DNA, 25 bp, Mus musculus
agcacatgagctgggctgtagcagt

SEQ ID NO: 191868 - DNA, 25 bp, Mus musculus
agcacatgctgattttgggcatcac

SEQ ID NO: 191869 - DNA, 25 bp, Mus musculus
agcacattagctcggttatgtacaa

SEQ ID NO: 191870 - DNA, 25 bp, Mus musculus
agcacattagctcggttttgtacaa

SEQ ID NO: 191871 - DNA, 25 bp, Mus musculus
agcacattatagtggaacaccagta

SEQ ID NO: 191872 - DNA, 25 bp, Mus musculus
agcaccaaaccggattgagtttatc

SEQ ID NO: 191873 - DNA, 25 bp, Mus musculus
agcaccaaaccgggtgaggcacaga

SEQ ID NO: 191874 - DNA, 25 bp, Mus musculus
agcaccaaagcttcgcataaggaat

SEQ ID NO: 191875 - DNA, 25 bp, Mus musculus
agcaccaaagtaccatttaggtcca

SEQ ID NO: 191876 - DNA, 25 bp, Mus musculus
agcaccaacaaagttattcatggtg

SEQ ID NO: 191877 - DNA, 25 bp, Mus musculus
agcaccaagaaattcattcctgagt

SEQ ID NO: 191878 - DNA, 25 bp, Mus musculus
agcaccaagagcccgaccgtccgct

SEQ ID NO: 191879 - DNA, 25 bp, Mus musculus
agcaccaagcagccttctctccgtg

SEQ ID NO: 191880 - DNA, 25 bp, Mus musculus
agcaccaaggaggagacagcctgtg

SEQ ID NO: 191881 - DNA, 25 bp, Mus musculus
agcaccactggcaagatgtgctagt

SEQ ID NO: 191882 - DNA, 25 bp, Mus musculus
agcaccactggcaaggctggtacaa

SEQ ID NO: 191883 - DNA, 25 bp, Mus musculus
agcaccagagggtgtctttaagaag

SEQ ID NO: 191884 - DNA, 25 bp, Mus musculus
agcaccagaggtctgagttcttcca

SEQ ID NO: 191885 - DNA, 25 bp, Mus musculus
agcaccagatcagaatttcagcata

SEQ ID NO: 191886 - DNA, 25 bp, Mus musculus
agcaccagtcgcggacagtggcaac

SEQ ID NO: 191887 - DNA, 25 bp, Mus musculus
agcaccatacagaaatatgatcctc

SEQ ID NO: 191888 - DNA, 25 bp, Mus musculus
agcaccatcaatggtgcagtgcagt

SEQ ID NO: 191889 - DNA, 25 bp, Mus musculus
agcaccatcaatgttgcctaatggg

SEQ ID NO: 191890 - DNA, 25 bp, Mus musculus
agcaccatcagggtatatccgaata

SEQ ID NO: 191891 - DNA, 25 bp, Mus musculus
agcaccatcttcaccatggaaaaga

SEQ ID NO: 191892 - DNA, 25 bp, Mus musculus
agcaccatgcaggctgtcttctcgt

SEQ ID NO: 191893 - DNA, 25 bp, Mus musculus
agcaccatgtcaaatcctctgggcc

SEQ ID NO: 191894 - DNA, 25 bp, Mus musculus
agcacccaatgtcagaatacaagag

SEQ ID NO: 191895 - DNA, 25 bp, Mus musculus
agcacccagaaggcaagatcctcat

SEQ ID NO: 191896 - DNA, 25 bp, Mus musculus
agcacccagaggtccatggctgggg

SEQ ID NO: 191897 - DNA, 25 bp, Mus musculus
agcacccaggttcaggaataagact

SEQ ID NO: 191898 - DNA, 25 bp, Mus musculus
agcacccagttaaatcatcgggtta

SEQ ID NO: 191899 - DNA, 25 bp, Mus musculus
agcacccatacaggtagtgctgccc

SEQ ID NO: 191900 - DNA, 25 bp, Mus musculus
agcaccccacgatggtacctcacac

SEQ ID NO: 191901 - DNA, 25 bp, Mus musculus
agcaccccacggacagacagctgtt

SEQ ID NO: 191902 - DNA, 25 bp, Mus musculus
agcaccccaggtgttgactgtcttc

SEQ ID NO: 191903 - DNA, 25 bp, Mus musculus
agcaccccagtgcccgaggcgcccg

SEQ ID NO: 191904 - DNA, 25 bp, Mus musculus
agcaccccagttcttgcaggtgttg

SEQ ID NO: 191905 - DNA, 25 bp, Mus musculus
agcaccccccaaggatcgtgaactg

SEQ ID NO: 191906 - DNA, 25 bp, Mus musculus
agcacccctgccagataatcagcct

SEQ ID NO: 191907 - DNA, 25 bp, Mus musculus
agcacccctgccagtctcctggctg

SEQ ID NO: 191908 - DNA, 25 bp, Mus musculus
agcacccctttgagcccgctgtgag

SEQ ID NO: 191909 - DNA, 25 bp, Mus musculus
agcacccctttgtactatgcctgcc

SEQ ID NO: 191910 - DNA, 25 bp, Mus musculus
agcacccgggatacacttttggcgt

SEQ ID NO: 191911 - DNA, 25 bp, Mus musculus
agcacccggggaggcagagtaagaa

SEQ ID NO: 191912 - DNA, 25 bp, Mus musculus
agcaccctcagcagtcccgtctact

SEQ ID NO: 191913 - DNA, 25 bp, Mus musculus
agcaccctcagggaacagaagtcaa

SEQ ID NO: 191914 - DNA, 25 bp, Mus musculus
agcaccctgaagcaatcccacaggg

SEQ ID NO: 191915 - DNA, 25 bp, Mus musculus
agcaccctgaggagcaccactccca

SEQ ID NO: 191916 - DNA, 25 bp, Mus musculus
agcaccctgcttatgaaagccatca

SEQ ID NO: 191917 - DNA, 25 bp, Mus musculus
agcaccctgcttatgagtcagcagt

SEQ ID NO: 191918 - DNA, 25 bp, Mus musculus
agcacccttgcatcctctaccccct

SEQ ID NO: 191919 - DNA, 25 bp, Mus musculus
agcaccgaatgcacaatctctgctg

SEQ ID NO: 191920 - DNA, 25 bp, Mus musculus
agcaccgaggagagcactgcctgca

SEQ ID NO: 191921 - DNA, 25 bp, Mus musculus
agcaccgaggagagccggatggcgc

SEQ ID NO: 191922 - DNA, 25 bp, Mus musculus
agcaccgaggcaaatacctcgctat

SEQ ID NO: 191923 - DNA, 25 bp, Mus musculus
agcaccgaggcaaatcctggatggt

SEQ ID NO: 191924 - DNA, 25 bp, Mus musculus
agcaccgaggcaatctacgggctgg

SEQ ID NO: 191925 - DNA, 25 bp, Mus musculus
agcaccgcaggtatcagcctagcag

SEQ ID NO: 191926 - DNA, 25 bp, Mus musculus
agcaccggaacaggttcaagttctt

SEQ ID NO: 191927 - DNA, 25 bp, Mus musculus
agcaccggcgcgtaagcaatggctt

SEQ ID NO: 191928 - DNA, 25 bp, Mus musculus
agcaccggcttctgccccccactgc

SEQ ID NO: 191929 - DNA, 25 bp, Mus musculus
agcaccggcttctggaagtcacctg

SEQ ID NO: 191930 - DNA, 25 bp, Mus musculus
agcaccgtgaaggtctggacatgct

SEQ ID NO: 191931 - DNA, 25 bp, Mus musculus
agcaccgtgacatggggggatggac

SEQ ID NO: 191932 - DNA, 25 bp, Mus musculus
agcacctaagggcagccagtccatc

SEQ ID NO: 191933 - DNA, 25 bp, Mus musculus
agcacctaagggtgctggagagtct

SEQ ID NO: 191934 - DNA, 25 bp, Mus musculus
agcacctacgtttgttgaaggagct

SEQ ID NO: 191935 - DNA, 25 bp, Mus musculus
agcacctagagacaagtaagcagct

SEQ ID NO: 191936 - DNA, 25 bp, Mus musculus
agcacctatgagagtcatcagagag

SEQ ID NO: 191937 - DNA, 25 bp, Mus musculus
agcacctatgagtacttacagctac

SEQ ID NO: 191938 - DNA, 25 bp, Mus musculus
agcacctattatggtaactttcggc

SEQ ID NO: 191939 - DNA, 25 bp, Mus musculus
agcacctcagggatttgcaaatcat

SEQ ID NO: 191940 - DNA, 25 bp, Mus musculus
agcacctcagggccaataataagaa

SEQ ID NO: 191941 - DNA, 25 bp, Mus musculus
agcacctcagtgccttcccagacct

SEQ ID NO: 191942 - DNA, 25 bp, Mus musculus
agcacctcatggagatacattggtc

SEQ ID NO: 191943 - DNA, 25 bp, Mus musculus
agcacctcatggtgatacattggtc

SEQ ID NO: 191944 - DNA, 25 bp, Mus musculus
agcacctcctccagggagtgagtgc

SEQ ID NO: 191945 - DNA, 25 bp, Mus musculus
agcacctcctgattccactgtatca

SEQ ID NO: 191946 - DNA, 25 bp, Mus musculus
agcacctctccagattcactaaaaa

SEQ ID NO: 191947 - DNA, 25 bp, Mus musculus
agcacctctccagcgttccctgctg

SEQ ID NO: 191948 - DNA, 25 bp, Mus musculus
agcacctctccagtctctagataag

SEQ ID NO: 191949 - DNA, 25 bp, Mus musculus
agcacctctggaaggggcgtatgat

SEQ ID NO: 191950 - DNA, 25 bp, Mus musculus
agcacctctggaggctcctgctcct

SEQ ID NO: 191951 - DNA, 25 bp, Mus musculus
agcacctctgtggaggaaatcctga

SEQ ID NO: 191952 - DNA, 25 bp, Mus musculus
agcacctgagggatatgatgctgcc

SEQ ID NO: 191953 - DNA, 25 bp, Mus musculus
agcacctgccaatgttctctcggga

SEQ ID NO: 191954 - DNA, 25 bp, Mus musculus
agcacctgcctcctcagaagactca

SEQ ID NO: 191955 - DNA, 25 bp, Mus musculus
agcacctgtcagaaccacccccgcc

SEQ ID NO: 191956 - DNA, 25 bp, Mus musculus
agcacctgtcagacaccactaactg

SEQ ID NO: 191957 - DNA, 25 bp, Mus musculus
agcacctgtcagacgagaagaacgg

SEQ ID NO: 191958 - DNA, 25 bp, Mus musculus
agcaccttaggagtgtaaagagctg

SEQ ID NO: 191959 - DNA, 25 bp, Mus musculus
agcaccttcagctatctaacttcac

SEQ ID NO: 191960 - DNA, 25 bp, Mus musculus
agcaccttggacaaagtctcgactg

SEQ ID NO: 191961 - DNA, 25 bp, Mus musculus
agcacctttagagggtctgatatgc

SEQ ID NO: 191962 - DNA, 25 bp, Mus musculus
agcacctttcagggaagccagctgc

SEQ ID NO: 191963 - DNA, 25 bp, Mus musculus
agcacctttcctcagatttcctccc

SEQ ID NO: 191964 - DNA, 25 bp, Mus musculus
agcacctttctcagtacattcgctc

SEQ ID NO: 191965 - DNA, 25 bp, Mus musculus
agcacgaaagagaccagctatggag

SEQ ID NO: 191966 - DNA, 25 bp, Mus musculus
agcacgaagcaataagtcctatgaa

SEQ ID NO: 191967 - DNA, 25 bp, Mus musculus
agcacgaagtcacgagcttcgttac

SEQ ID NO: 191968 - DNA, 25 bp, Mus musculus
agcacgaatggtgcagtctttgtca

SEQ ID NO: 191969 - DNA, 25 bp, Mus musculus
agcacgacttggctctgctgcgcct

SEQ ID NO: 191970 - DNA, 25 bp, Mus musculus
agcacgagaacagcgactactgtga

SEQ ID NO: 191971 - DNA, 25 bp, Mus musculus
agcacgagacagaagcaccattgca

SEQ ID NO: 191972 - DNA, 25 bp, Mus musculus
agcacgataaggaagagcggatccg

SEQ ID NO: 191973 - DNA, 25 bp, Mus musculus
agcacgatctggagatgaaaccaat

SEQ ID NO: 191974 - DNA, 25 bp, Mus musculus
agcacgatctggatatgatgaatgg

SEQ ID NO: 191975 - DNA, 25 bp, Mus musculus
agcacgcaactgatttagatgaaaa

SEQ ID NO: 191976 - DNA, 25 bp, Mus musculus
agcacgcacctggaagggtctgttc

SEQ ID NO: 191977 - DNA, 25 bp, Mus musculus
agcacgcccattcaggtgcgctgct

SEQ ID NO: 191978 - DNA, 25 bp, Mus musculus
agcacgccgggcaggcctcagcatt

SEQ ID NO: 191979 - DNA, 25 bp, Mus musculus
agcacgcgaggagcatgtcatgttg

SEQ ID NO: 191980 - DNA, 25 bp, Mus musculus
agcacgctcaggaacaagaatttgt

SEQ ID NO: 191981 - DNA, 25 bp, Mus musculus
agcacgctgatgtgggtgtagcact

SEQ ID NO: 191982 - DNA, 25 bp, Mus musculus
agcacgcttgatgtggggcctgcgc

SEQ ID NO: 191983 - DNA, 25 bp, Mus musculus
agcacggaccgaaagtgagaagcaa

SEQ ID NO: 191984 - DNA, 25 bp, Mus musculus
agcacggagtgtgatcgtttggaaa

SEQ ID NO: 191985 - DNA, 25 bp, Mus musculus
agcacggatgatgttgcctccagaa

SEQ ID NO: 191986 - DNA, 25 bp, Mus musculus
agcacgggaaagaaaacaaacatta

SEQ ID NO: 191987 - DNA, 25 bp, Mus musculus
agcacgggaaagaaacactcatcat

SEQ ID NO: 191988 - DNA, 25 bp, Mus musculus
agcacgggctacaggttgcgttaca

SEQ ID NO: 191989 - DNA, 25 bp, Mus musculus
agcacggggtagtgatccattgtag

SEQ ID NO: 191990 - DNA, 25 bp, Mus musculus
agcacggttagtgctggattcgagt

SEQ ID NO: 191991 - DNA, 25 bp, Mus musculus
agcacggttcagatcctgagggaag

SEQ ID NO: 191992 - DNA, 25 bp, Mus musculus
agcacggttgcccaggtgacagatt

SEQ ID NO: 191993 - DNA, 25 bp, Mus musculus
agcacgtacaagagagaaatgtctt

SEQ ID NO: 191994 - DNA, 25 bp, Mus musculus
agcacgtcaaccaggaaaccaaaaa

SEQ ID NO: 191995 - DNA, 25 bp, Mus musculus
agcacgtctttgaccatccatggga

SEQ ID NO: 191996 - DNA, 25 bp, Mus musculus
agcacgtctttgacttattggtgca

SEQ ID NO: 191997 - DNA, 25 bp, Mus musculus
agcacgtgaggacaagtttttactt

SEQ ID NO: 191998 - DNA, 25 bp, Mus musculus
agcacgtgctgcaaggtgatgaagt

SEQ ID NO: 191999 - DNA, 25 bp, Mus musculus
agcacgtggaacaagtgctagccat

SEQ ID NO: 192000 - DNA, 25 bp, Mus musculus
agcacgtggctgttttgcccattgg

SEQ ID NO: 192001 - DNA, 25 bp, Mus musculus
agcactaacaggaatgcagaaacaa

SEQ ID NO: 192002 - DNA, 25 bp, Mus musculus
agcactaagaaggagaagaccacca

SEQ ID NO: 192003 - DNA, 25 bp, Mus musculus
agcactaatcaggaaaatggcagac

SEQ ID NO: 192004 - DNA, 25 bp, Mus musculus
agcactaatgagatggatcccccgg

SEQ ID NO: 192005 - DNA, 25 bp, Mus musculus
agcactacacagcagcgtaccccgc

SEQ ID NO: 192006 - DNA, 25 bp, Mus musculus
agcactacacagcctccagccctgg

SEQ ID NO: 192007 - DNA, 25 bp, Mus musculus
agcactacacgtacctgaaggaatt

SEQ ID NO: 192008 - DNA, 25 bp, Mus musculus
agcactacacgtacgtgaaggaatt

SEQ ID NO: 192009 - DNA, 25 bp, Mus musculus
agcactacagactgcagttctatat

SEQ ID NO: 192010 - DNA, 25 bp, Mus musculus
agcactaccaggaagacatgggatc

SEQ ID NO: 192011 - DNA, 25 bp, Mus musculus
agcactacccaggaaaatggcagac

SEQ ID NO: 192012 - DNA, 25 bp, Mus musculus
agcactaccctggctgtatcaacct

SEQ ID NO: 192013 - DNA, 25 bp, Mus musculus
agcactagctagtccgtgtactttg

SEQ ID NO: 192014 - DNA, 25 bp, Mus musculus
agcactagtgggactctgtaagctc

SEQ ID NO: 192015 - DNA, 25 bp, Mus musculus
agcactatcccgctcgggcaaagtc

SEQ ID NO: 192016 - DNA, 25 bp, Mus musculus
agcactatgacccctcccagtcccc

SEQ ID NO: 192017 - DNA, 25 bp, Mus musculus
agcactatgggaaagagattctgaa

SEQ ID NO: 192018 - DNA, 25 bp, Mus musculus
agcactattaaggaggccttgtcag

SEQ ID NO: 192019 - DNA, 25 bp, Mus musculus
agcactcaaggcagcccctgttaca

SEQ ID NO: 192020 - DNA, 25 bp, Mus musculus
agcactcacagcagggaccctgggt

SEQ ID NO: 192021 - DNA, 25 bp, Mus musculus
agcactcatccagctcttcttacat

SEQ ID NO: 192022 - DNA, 25 bp, Mus musculus
agcactccataaactaaagctgcag

SEQ ID NO: 192023 - DNA, 25 bp, Mus musculus
agcactccatgtgtgtctgaagaca

SEQ ID NO: 192024 - DNA, 25 bp, Mus musculus
agcactcccactgggtgtggagtgt

SEQ ID NO: 192025 - DNA, 25 bp, Mus musculus
agcactccttctggagatcctttca

SEQ ID NO: 192026 - DNA, 25 bp, Mus musculus
agcactcggatcaaacagggttcct

SEQ ID NO: 192027 - DNA, 25 bp, Mus musculus
agcactcggatcaatgcacaaagaa

SEQ ID NO: 192028 - DNA, 25 bp, Mus musculus
agcactcgggaggcagaggcaggcg

SEQ ID NO: 192029 - DNA, 25 bp, Mus musculus
agcactcgtgtccgacttcagagga

SEQ ID NO: 192030 - DNA, 25 bp, Mus musculus
agcactcgtgtccgatttattaacc

SEQ ID NO: 192031 - DNA, 25 bp, Mus musculus
agcactctcaggctaccggctctct

SEQ ID NO: 192032 - DNA, 25 bp, Mus musculus
agcactctcctccaggcacaactgt

SEQ ID NO: 192033 - DNA, 25 bp, Mus musculus
agcactctgcgaagggaaatgctca

SEQ ID NO: 192034 - DNA, 25 bp, Mus musculus
agcactctggctgggcgctcaccct

SEQ ID NO: 192035 - DNA, 25 bp, Mus musculus
agcactgaagaggaacctgctttgg

SEQ ID NO: 192036 - DNA, 25 bp, Mus musculus
agcactgcacaattgagggttgccc

SEQ ID NO: 192037 - DNA, 25 bp, Mus musculus
agcactgcacaattgctcactattt

SEQ ID NO: 192038 - DNA, 25 bp, Mus musculus
agcactgcaccatcgagggctgtcc

SEQ ID NO: 192039 - DNA, 25 bp, Mus musculus
agcactgcaccatcgctcactatct

SEQ ID NO: 192040 - DNA, 25 bp, Mus musculus
agcactgcaggagcctgtgaccttt

SEQ ID NO: 192041 - DNA, 25 bp, Mus musculus
agcactgcatgagaaactctctgga

SEQ ID NO: 192042 - DNA, 25 bp, Mus musculus
agcactgccaacagatctacacaca

SEQ ID NO: 192043 - DNA, 25 bp, Mus musculus
agcactgccaacagggtgcatcgct

SEQ ID NO: 192044 - DNA, 25 bp, Mus musculus
agcactgcggagagccagctgctcc

SEQ ID NO: 192045 - DNA, 25 bp, Mus musculus
agcactgcggagttgagagctgctg

SEQ ID NO: 192046 - DNA, 25 bp, Mus musculus
agcactgctagggctctgtgccgag

SEQ ID NO: 192047 - DNA, 25 bp, Mus musculus
agcactgctcatgggggcacctatg

SEQ ID NO: 192048 - DNA, 25 bp, Mus musculus
agcactggagagaaacttgatggga

SEQ ID NO: 192049 - DNA, 25 bp, Mus musculus
agcactggagagaccagccacgatg

SEQ ID NO: 192050 - DNA, 25 bp, Mus musculus
agcactggaggagttgtaatggctc

SEQ ID NO: 192051 - DNA, 25 bp, Mus musculus
agcactggcaggctgaagatggaaa

SEQ ID NO: 192052 - DNA, 25 bp, Mus musculus
agcactggcaggtccaggaggtcca

SEQ ID NO: 192053 - DNA, 25 bp, Mus musculus
agcactggcaggtgcaggacgttgt

SEQ ID NO: 192054 - DNA, 25 bp, Mus musculus
agcactggcaggtgtcagcggaaac

SEQ ID NO: 192055 - DNA, 25 bp, Mus musculus
agcactggccccgggccctcagcat

SEQ ID NO: 192056 - DNA, 25 bp, Mus musculus
agcactggccctctctggggggtca

SEQ ID NO: 192057 - DNA, 25 bp, Mus musculus
agcactggctgaaggtaccttaaca

SEQ ID NO: 192058 - DNA, 25 bp, Mus musculus
agcactggggatgtccagctcgccg

SEQ ID NO: 192059 - DNA, 25 bp, Mus musculus
agcactgggtatctctctttctctt

SEQ ID NO: 192060 - DNA, 25 bp, Mus musculus
agcactgggtattttcttgttacct

SEQ ID NO: 192061 - DNA, 25 bp, Mus musculus
agcactgtcaagcggaagatggaga

SEQ ID NO: 192062 - DNA, 25 bp, Mus musculus
agcactgtcaagcttctcatgctgc

SEQ ID NO: 192063 - DNA, 25 bp, Mus musculus
agcactgtcaaggatgtgtttgagt

SEQ ID NO: 192064 - DNA, 25 bp, Mus musculus
agcactgtggttggctgggacccac

SEQ ID NO: 192065 - DNA, 25 bp, Mus musculus
agcactgtggttggtgagcggggca

SEQ ID NO: 192066 - DNA, 25 bp, Mus musculus
agcactgtgttttcagtaaatgaag

SEQ ID NO: 192067 - DNA, 25 bp, Mus musculus
agcacttagttggtcgaccgcccct

SEQ ID NO: 192068 - DNA, 25 bp, Mus musculus
agcacttatcggaaatggtgaagca

SEQ ID NO: 192069 - DNA, 25 bp, Mus musculus
agcacttatgaaggtccttcagtag

SEQ ID NO: 192070 - DNA, 25 bp, Mus musculus
agcacttatgtgatccgtgatgagt

SEQ ID NO: 192071 - DNA, 25 bp, Mus musculus
agcacttcaagatgtatcgcctgag

SEQ ID NO: 192072 - DNA, 25 bp, Mus musculus
agcacttcacaagaaattaccatgg

SEQ ID NO: 192073 - DNA, 25 bp, Mus musculus
agcacttcaggaagctgatgaagag

SEQ ID NO: 192074 - DNA, 25 bp, Mus musculus
agcacttcagtgctgtcttcctgct

SEQ ID NO: 192075 - DNA, 25 bp, Mus musculus
agcacttcatcaataggaagaagag

SEQ ID NO: 192076 - DNA, 25 bp, Mus musculus
agcacttcatcaatatgaagagtgt

SEQ ID NO: 192077 - DNA, 25 bp, Mus musculus
agcacttccacagatctgcagactc

SEQ ID NO: 192078 - DNA, 25 bp, Mus musculus
agcacttcctgaaagatgatggcgt

SEQ ID NO: 192079 - DNA, 25 bp, Mus musculus
agcacttcctgagctttctatcgga

SEQ ID NO: 192080 - DNA, 25 bp, Mus musculus
agcacttcctgaggatgttgatcca

SEQ ID NO: 192081 - DNA, 25 bp, Mus musculus
agcacttgaacagatggggtgtttg

SEQ ID NO: 192082 - DNA, 25 bp, Mus musculus
agcacttgaacagattcattatgtc

SEQ ID NO: 192083 - DNA, 25 bp, Mus musculus
agcacttggcagaatcgtatggaag

SEQ ID NO: 192084 - DNA, 25 bp, Mus musculus
agcacttggggccctagagaaacag

SEQ ID NO: 192085 - DNA, 25 bp, Mus musculus
agcactttgaaagggagaagacacc

SEQ ID NO: 192086 - DNA, 25 bp, Mus musculus
agcactttgaaagtattgagcaagt

SEQ ID NO: 192087 - DNA, 25 bp, Mus musculus
agcactttgaagagaattgttgtgt

SEQ ID NO: 192088 - DNA, 25 bp, Mus musculus
agcactttgaagaggtgtgagtgtt

SEQ ID NO: 192089 - DNA, 25 bp, Mus musculus
agcactttgaagagtatcacagaca

SEQ ID NO: 192090 - DNA, 25 bp, Mus musculus
agcactttgagaaaggtttgcagct

SEQ ID NO: 192091 - DNA, 25 bp, Mus musculus
agcactttggtaaacttcctacagc

SEQ ID NO: 192092 - DNA, 25 bp, Mus musculus
agcacttttcaacagattttgttcc

SEQ ID NO: 192093 - DNA, 25 bp, Mus musculus
agcacttttcctttgatcgctgcca

SEQ ID NO: 192094 - DNA, 25 bp, Mus musculus
agcacttttcctttgatctctgacc

SEQ ID NO: 192095 - DNA, 25 bp, Mus musculus
agcacttttgagcacaagtgcagcc

SEQ ID NO: 192096 - DNA, 25 bp, Mus musculus
agcacttttggactacattgcagaa

SEQ ID NO: 192097 - DNA, 25 bp, Mus musculus
agcagaaaaaaaggtttatgaagct

SEQ ID NO: 192098 - DNA, 25 bp, Mus musculus
agcagaaaaccggttgctgtggttc

SEQ ID NO: 192099 - DNA, 25 bp, Mus musculus
agcagaaacagagatagccagcagg

SEQ ID NO: 192100 - DNA, 25 bp, Mus musculus
agcagaaacagagtgctactgtcta

SEQ ID NO: 192101 - DNA, 25 bp, Mus musculus
agcagaaaccgtaaaagccttgata

SEQ ID NO: 192102 - DNA, 25 bp, Mus musculus
agcagaaagagactaacggttatga

SEQ ID NO: 192103 - DNA, 25 bp, Mus musculus
agcagaaagagatctatcaagtcca

SEQ ID NO: 192104 - DNA, 25 bp, Mus musculus
agcagaaagagcacagagaacccca

SEQ ID NO: 192105 - DNA, 25 bp, Mus musculus
agcagaaagaggagttcgtgagtgt

SEQ ID NO: 192106 - DNA, 25 bp, Mus musculus
agcagaaagaggtagaagaaagacc

SEQ ID NO: 192107 - DNA, 25 bp, Mus musculus
agcagaaagatagaagctagaaact

SEQ ID NO: 192108 - DNA, 25 bp, Mus musculus
agcagaaatttacctaaagcctttc

SEQ ID NO: 192109 - DNA, 25 bp, Mus musculus
agcagaacagccttccagaaatgcc

SEQ ID NO: 192110 - DNA, 25 bp, Mus musculus
agcagaacagggcggcagatcaaaa

SEQ ID NO: 192111 - DNA, 25 bp, Mus musculus
agcagaacaggtgtttggatttgtg

SEQ ID NO: 192112 - DNA, 25 bp, Mus musculus
agcagaacaggtttgccagatctgc

SEQ ID NO: 192113 - DNA, 25 bp, Mus musculus
agcagaaccctcagtgattgtgtgt

SEQ ID NO: 192114 - DNA, 25 bp, Mus musculus
agcagaacctggaagctatgctcta

SEQ ID NO: 192115 - DNA, 25 bp, Mus musculus
agcagaacctggattcagatggtcc

SEQ ID NO: 192116 - DNA, 25 bp, Mus musculus
agcagaacctgggggctaaactctc

SEQ ID NO: 192117 - DNA, 25 bp, Mus musculus
agcagaacgctgctcatttgaagac

SEQ ID NO: 192118 - DNA, 25 bp, Mus musculus
agcagaacgctgcttgtgaatggct

SEQ ID NO: 192119 - DNA, 25 bp, Mus musculus
agcagaagaaaagactggacaatct

SEQ ID NO: 192120 - DNA, 25 bp, Mus musculus
agcagaagaaaccttgttccccctc

SEQ ID NO: 192121 - DNA, 25 bp, Mus musculus
agcagaagaaaggggctcgctccca

SEQ ID NO: 192122 - DNA, 25 bp, Mus musculus
agcagaagacccaagcttggatcta

SEQ ID NO: 192123 - DNA, 25 bp, Mus musculus
agcagaagagaatggaagtgaggcc

SEQ ID NO: 192124 - DNA, 25 bp, Mus musculus
agcagaagaggaccacgacttcttg

SEQ ID NO: 192125 - DNA, 25 bp, Mus musculus
agcagaagaggagagtgataatgaa

SEQ ID NO: 192126 - DNA, 25 bp, Mus musculus
agcagaagaggatcctgggcatgct

SEQ ID NO: 192127 - DNA, 25 bp, Mus musculus
agcagaagagtgaccaaatgaccca

SEQ ID NO: 192128 - DNA, 25 bp, Mus musculus
agcagaagagtgggacggctgttct

SEQ ID NO: 192129 - DNA, 25 bp, Mus musculus
agcagaagattaaggacctggagca

SEQ ID NO: 192130 - DNA, 25 bp, Mus musculus
agcagaagcaaagagaaccaacttc

SEQ ID NO: 192131 - DNA, 25 bp, Mus musculus
agcagaagcaaagagcgtgctaatg

SEQ ID NO: 192132 - DNA, 25 bp, Mus musculus
agcagaagcaaagagggaagaagac

SEQ ID NO: 192133 - DNA, 25 bp, Mus musculus
agcagaagcaaaggtctcagccagt

SEQ ID NO: 192134 - DNA, 25 bp, Mus musculus
agcagaagcaaattgtggaccgggt

SEQ ID NO: 192135 - DNA, 25 bp, Mus musculus
agcagaagcaacagcagaagcaggt

SEQ ID NO: 192136 - DNA, 25 bp, Mus musculus
agcagaagctgggtgccattgtggc

SEQ ID NO: 192137 - DNA, 25 bp, Mus musculus
agcagaagggttaggatgatgctgt

SEQ ID NO: 192138 - DNA, 25 bp, Mus musculus
agcagaaggtattgtcatcactagc

SEQ ID NO: 192139 - DNA, 25 bp, Mus musculus
agcagaagtcagaaattacacttgt

SEQ ID NO: 192140 - DNA, 25 bp, Mus musculus
agcagaagtcgacagagcacactcc

SEQ ID NO: 192141 - DNA, 25 bp, Mus musculus
agcagaagtgcaggtattggttttc

SEQ ID NO: 192142 - DNA, 25 bp, Mus musculus
agcagaataccaaccacagccacag

SEQ ID NO: 192143 - DNA, 25 bp, Mus musculus
agcagaatatcgaacaaaagacgag

SEQ ID NO: 192144 - DNA, 25 bp, Mus musculus
agcagaatatcgaacctcacatgag

SEQ ID NO: 192145 - DNA, 25 bp, Mus musculus
agcagaatatgaagagcgggcagct

SEQ ID NO: 192146 - DNA, 25 bp, Mus musculus
agcagaatatgaaggcatgatgggt

SEQ ID NO: 192147 - DNA, 25 bp, Mus musculus
agcagaatatgaaggtgtgatgaat

SEQ ID NO: 192148 - DNA, 25 bp, Mus musculus
agcagaattctgagatcttgagttc

SEQ ID NO: 192149 - DNA, 25 bp, Mus musculus
agcagaattctggttttggtaaaac

SEQ ID NO: 192150 - DNA, 25 bp, Mus musculus
agcagaattgaaaagtttctagatg

SEQ ID NO: 192151 - DNA, 25 bp, Mus musculus
agcagacacagattcaaaataaacc

SEQ ID NO: 192152 - DNA, 25 bp, Mus musculus
agcagacacagtccggttctccacc

SEQ ID NO: 192153 - DNA, 25 bp, Mus musculus
agcagacacccaagagacacagtct

SEQ ID NO: 192154 - DNA, 25 bp, Mus musculus
agcagacactcatcagcctgaagtc

SEQ ID NO: 192155 - DNA, 25 bp, Mus musculus
agcagacagcaacgcagtacttcat

SEQ ID NO: 192156 - DNA, 25 bp, Mus musculus
agcagacagccaagggatttgaatt

SEQ ID NO: 192157 - DNA, 25 bp, Mus musculus
agcagacatcagaaaccttacaatc

SEQ ID NO: 192158 - DNA, 25 bp, Mus musculus
agcagacatcagataatggaggtga

SEQ ID NO: 192159 - DNA, 25 bp, Mus musculus
agcagacatgaaggcctttgttgaa

SEQ ID NO: 192160 - DNA, 25 bp, Mus musculus
agcagaccaaaagcccttgccagag

SEQ ID NO: 192161 - DNA, 25 bp, Mus musculus
agcagaccaaaatcacccaggacat

SEQ ID NO: 192162 - DNA, 25 bp, Mus musculus
agcagaccaaggtggaattcccaga

SEQ ID NO: 192163 - DNA, 25 bp, Mus musculus
agcagaccaaggtggaattccctga

SEQ ID NO: 192164 - DNA, 25 bp, Mus musculus
agcagaccaagttccagaatctact

SEQ ID NO: 192165 - DNA, 25 bp, Mus musculus
agcagaccacaaagctagggaagaa

SEQ ID NO: 192166 - DNA, 25 bp, Mus musculus
agcagaccagccctagtcgagggaa

SEQ ID NO: 192167 - DNA, 25 bp, Mus musculus
agcagaccaggtgactggttatcct

SEQ ID NO: 192168 - DNA, 25 bp, Mus musculus
agcagaccagtaggggcaagcgcaa

SEQ ID NO: 192169 - DNA, 25 bp, Mus musculus
agcagaccatctccggtcctggctt

SEQ ID NO: 192170 - DNA, 25 bp, Mus musculus
agcagacccgggcagatatcaagaa

SEQ ID NO: 192171 - DNA, 25 bp, Mus musculus
agcagaccgtggatgggagggcccc

SEQ ID NO: 192172 - DNA, 25 bp, Mus musculus
agcagacgcgaaactggatggcttc

SEQ ID NO: 192173 - DNA, 25 bp, Mus musculus
agcagacggtgcaaccaggtacacg

SEQ ID NO: 192174 - DNA, 25 bp, Mus musculus
agcagacggtggaaattgacaactt

SEQ ID NO: 192175 - DNA, 25 bp, Mus musculus
agcagactaagcaggtggaagaact

SEQ ID NO: 192176 - DNA, 25 bp, Mus musculus
agcagactaggaatctcgatctgcc

SEQ ID NO: 192177 - DNA, 25 bp, Mus musculus
agcagactcgtctcaaggagctgga

SEQ ID NO: 192178 - DNA, 25 bp, Mus musculus
agcagactcttggagaaaatccaag

SEQ ID NO: 192179 - DNA, 25 bp, Mus musculus
agcagactcttggagctggaagaga

SEQ ID NO: 192180 - DNA, 25 bp, Mus musculus
agcagactgagtcgtggtcctgcca

SEQ ID NO: 192181 - DNA, 25 bp, Mus musculus
agcagactgcaggaaactacaacct

SEQ ID NO: 192182 - DNA, 25 bp, Mus musculus
agcagactgggattgtcttgagaat

SEQ ID NO: 192183 - DNA, 25 bp, Mus musculus
agcagagaaagccgagtccatctac

SEQ ID NO: 192184 - DNA, 25 bp, Mus musculus
agcagagaagaaagcccgctgggtc

SEQ ID NO: 192185 - DNA, 25 bp, Mus musculus
agcagagaagagtccagacagaagc

SEQ ID NO: 192186 - DNA, 25 bp, Mus musculus
agcagagaagagtgtagctgcaacc

SEQ ID NO: 192187 - DNA, 25 bp, Mus musculus
agcagagaagggcggtgctggtgga

SEQ ID NO: 192188 - DNA, 25 bp, Mus musculus
agcagagaaggtgacagaaggtgac

SEQ ID NO: 192189 - DNA, 25 bp, Mus musculus
agcagagaatgagaaaatgaaaatt

SEQ ID NO: 192190 - DNA, 25 bp, Mus musculus
agcagagaatggagcctgtgacctt

SEQ ID NO: 192191 - DNA, 25 bp, Mus musculus
agcagagaatgtggacatctcgtgg

SEQ ID NO: 192192 - DNA, 25 bp, Mus musculus
agcagagacaaattgaacaagaaaa

SEQ ID NO: 192193 - DNA, 25 bp, Mus musculus
agcagagacagcaggattttcgaaa

SEQ ID NO: 192194 - DNA, 25 bp, Mus musculus
agcagagactggacgcggattctga

SEQ ID NO: 192195 - DNA, 25 bp, Mus musculus
agcagagactggactacgagagtaa

SEQ ID NO: 192196 - DNA, 25 bp, Mus musculus
agcagagagacacagtgccctctcc

SEQ ID NO: 192197 - DNA, 25 bp, Mus musculus
agcagagagagggagttgaggatac

SEQ ID NO: 192198 - DNA, 25 bp, Mus musculus
agcagagagagttggatgaaaaatc

SEQ ID NO: 192199 - DNA, 25 bp, Mus musculus
agcagagagctcaggtttggaggag

SEQ ID NO: 192200 - DNA, 25 bp, Mus musculus
agcagagaggagcttggctttgatc

SEQ ID NO: 192201 - DNA, 25 bp, Mus musculus
agcagagattgtatgtttatcattc

SEQ ID NO: 192202 - DNA, 25 bp, Mus musculus
agcagagcaaaagactgggaaccta

SEQ ID NO: 192203 - DNA, 25 bp, Mus musculus
agcagagcaaaagggaagcagtgct

SEQ ID NO: 192204 - DNA, 25 bp, Mus musculus
agcagagcaagaaggtcagtcagga

SEQ ID NO: 192205 - DNA, 25 bp, Mus musculus
agcagagcaagagacgaattatcaa

SEQ ID NO: 192206 - DNA, 25 bp, Mus musculus
agcagagcaagatctggtgctttgg

SEQ ID NO: 192207 - DNA, 25 bp, Mus musculus
agcagagcacacagagccatgaggc

SEQ ID NO: 192208 - DNA, 25 bp, Mus musculus
agcagagcagagagatcaataagcg

SEQ ID NO: 192209 - DNA, 25 bp, Mus musculus
agcagagcagctacgagacgctctg

SEQ ID NO: 192210 - DNA, 25 bp, Mus musculus
agcagagcagctactaagcgactct

SEQ ID NO: 192211 - DNA, 25 bp, Mus musculus
agcagagcaggatccaagtgaacga

SEQ ID NO: 192212 - DNA, 25 bp, Mus musculus
agcagagcaggggaagcactgcatc

SEQ ID NO: 192213 - DNA, 25 bp, Mus musculus
agcagagcaggtgaagagaaggagg

SEQ ID NO: 192214 - DNA, 25 bp, Mus musculus
agcagagcatggtggagctgaaggt

SEQ ID NO: 192215 - DNA, 25 bp, Mus musculus
agcagagccatggacaaggaatatg

SEQ ID NO: 192216 - DNA, 25 bp, Mus musculus
agcagagcccacagcaacctcaagc

SEQ ID NO: 192217 - DNA, 25 bp, Mus musculus
agcagagcgaggggtccgtctccca

SEQ ID NO: 192218 - DNA, 25 bp, Mus musculus
agcagagctgaagaaggttatgaga

SEQ ID NO: 192219 - DNA, 25 bp, Mus musculus
agcagaggaagacgttcacagcctg

SEQ ID NO: 192220 - DNA, 25 bp, Mus musculus
agcagaggaagctgaaccaataacg

SEQ ID NO: 192221 - DNA, 25 bp, Mus musculus
agcagaggagactctaacacgtgaa

SEQ ID NO: 192222 - DNA, 25 bp, Mus musculus
agcagaggagatgggtggtggaaga

SEQ ID NO: 192223 - DNA, 25 bp, Mus musculus
agcagaggaggaggtcacgctcacg

SEQ ID NO: 192224 - DNA, 25 bp, Mus musculus
agcagaggcgatgctttttaaattg

SEQ ID NO: 192225 - DNA, 25 bp, Mus musculus
agcagagggaaggcctggccttgat

SEQ ID NO: 192226 - DNA, 25 bp, Mus musculus
agcagagggaaggtgaccaaccact

SEQ ID NO: 192227 - DNA, 25 bp, Mus musculus
agcagagggtcgaatcaacaccttt

SEQ ID NO: 192228 - DNA, 25 bp, Mus musculus
agcagagtacaaggtggtaaatctg

SEQ ID NO: 192229 - DNA, 25 bp, Mus musculus
agcagagtacaggtggagtttcgat

SEQ ID NO: 192230 - DNA, 25 bp, Mus musculus
agcagagtcaggagcgcagggcaga

SEQ ID NO: 192231 - DNA, 25 bp, Mus musculus
agcagagtcagggaccaggactgag

SEQ ID NO: 192232 - DNA, 25 bp, Mus musculus
agcagagtgaaaacacttcagctaa

SEQ ID NO: 192233 - DNA, 25 bp, Mus musculus
agcagagtggaagtgtgatcaggtg

SEQ ID NO: 192234 - DNA, 25 bp, Mus musculus
agcagagtggcagcacgatggtcct

SEQ ID NO: 192235 - DNA, 25 bp, Mus musculus
agcagataccgggcccaacgaagga

SEQ ID NO: 192236 - DNA, 25 bp, Mus musculus
agcagataccgggtggggacgacga

SEQ ID NO: 192237 - DNA, 25 bp, Mus musculus
agcagatagcagtagtcctaccggg

SEQ ID NO: 192238 - DNA, 25 bp, Mus musculus
agcagatagtttctgaattagtgtc

SEQ ID NO: 192239 - DNA, 25 bp, Mus musculus
agcagatatcggcacaacgatggcc

SEQ ID NO: 192240 - DNA, 25 bp, Mus musculus
agcagatatgacttgggagaagaga

SEQ ID NO: 192241 - DNA, 25 bp, Mus musculus
agcagatatgacttgtttggattta

SEQ ID NO: 192242 - DNA, 25 bp, Mus musculus
agcagatattttgcttttagatact

SEQ ID NO: 192243 - DNA, 25 bp, Mus musculus
agcagatcaagaattttctgaattc

SEQ ID NO: 192244 - DNA, 25 bp, Mus musculus
agcagatcaatgaaattggagatct

SEQ ID NO: 192245 - DNA, 25 bp, Mus musculus
agcagatcagatgtggcaggcaggg

SEQ ID NO: 192246 - DNA, 25 bp, Mus musculus
agcagatcaggctcctggagtccat

SEQ ID NO: 192247 - DNA, 25 bp, Mus musculus
agcagatccaatactgcagcaatgg

SEQ ID NO: 192248 - DNA, 25 bp, Mus musculus
agcagatccaatcacgagaccaggc

SEQ ID NO: 192249 - DNA, 25 bp, Mus musculus
agcagatccaggagctggtggaagc

SEQ ID NO: 192250 - DNA, 25 bp, Mus musculus
agcagatccaggaggacttcttcct

SEQ ID NO: 192251 - DNA, 25 bp, Mus musculus
agcagatccggagtagcccctggaa

SEQ ID NO: 192252 - DNA, 25 bp, Mus musculus
agcagatctctcaggggagacccag

SEQ ID NO: 192253 - DNA, 25 bp, Mus musculus
agcagatctctcaggggatcatgag

SEQ ID NO: 192254 - DNA, 25 bp, Mus musculus
agcagatctggatccctagcccctg

SEQ ID NO: 192255 - DNA, 25 bp, Mus musculus
agcagatcttccaagattagaacac

SEQ ID NO: 192256 - DNA, 25 bp, Mus musculus
agcagatcttgaggttacggaaaca

SEQ ID NO: 192257 - DNA, 25 bp, Mus musculus
agcagatgaagatcatccatgaaga

SEQ ID NO: 192258 - DNA, 25 bp, Mus musculus
agcagatgaagatctcaggcccatg

SEQ ID NO: 192259 - DNA, 25 bp, Mus musculus
agcagatgaccagcaaactcaccca

SEQ ID NO: 192260 - DNA, 25 bp, Mus musculus
agcagatgctcagcaaccagacctc

SEQ ID NO: 192261 - DNA, 25 bp, Mus musculus
agcagatgctcgggctgtcatttcg

SEQ ID NO: 192262 - DNA, 25 bp, Mus musculus
agcagatgctggacatccaggcaga

SEQ ID NO: 192263 - DNA, 25 bp, Mus musculus
agcagatggaaaggtcgtgtcttat

SEQ ID NO: 192264 - DNA, 25 bp, Mus musculus
agcagatgggacagcaaagagccct

SEQ ID NO: 192265 - DNA, 25 bp, Mus musculus
agcagatggtctggtgtagccgtcc

SEQ ID NO: 192266 - DNA, 25 bp, Mus musculus
agcagatgtagttcatcctatctaa

SEQ ID NO: 192267 - DNA, 25 bp, Mus musculus
agcagatgtgttcagaatgatgatg

SEQ ID NO: 192268 - DNA, 25 bp, Mus musculus
agcagatgtgttcagtctgggtctc

SEQ ID NO: 192269 - DNA, 25 bp, Mus musculus
agcagatgtttccaagaaggtcaca

SEQ ID NO: 192270 - DNA, 25 bp, Mus musculus
agcagattaacagagactctgcaga

SEQ ID NO: 192271 - DNA, 25 bp, Mus musculus
agcagattcgcagaatagcagagaa

SEQ ID NO: 192272 - DNA, 25 bp, Mus musculus
agcagattctcgaggctaaaaagaa

SEQ ID NO: 192273 - DNA, 25 bp, Mus musculus
agcagattgcagagttcaaagaagc

SEQ ID NO: 192274 - DNA, 25 bp, Mus musculus
agcagattgccctggatcgtgcaga

SEQ ID NO: 192275 - DNA, 25 bp, Mus musculus
agcagatttaaagaacccaatatgg

SEQ ID NO: 192276 - DNA, 25 bp, Mus musculus
agcagatttagctggggaggaagag

SEQ ID NO: 192277 - DNA, 25 bp, Mus musculus
agcagatttagctggggggccgagg

SEQ ID NO: 192278 - DNA, 25 bp, Mus musculus
agcagatttccctggcctcagaaac

SEQ ID NO: 192279 - DNA, 25 bp, Mus musculus
agcagatttccctggcttcccctcc

SEQ ID NO: 192280 - DNA, 25 bp, Mus musculus
agcagattttaaactgtttcagaaa

SEQ ID NO: 192281 - DNA, 25 bp, Mus musculus
agcagattttagcagcttcttactg

SEQ ID NO: 192282 - DNA, 25 bp, Mus musculus
agcagattttagcaggtgaatatga

SEQ ID NO: 192283 - DNA, 25 bp, Mus musculus
agcagattttgaggtattcgtggag

SEQ ID NO: 192284 - DNA, 25 bp, Mus musculus
agcagattttgaggtcttgccgtgg

SEQ ID NO: 192285 - DNA, 25 bp, Mus musculus
agcagcaaaatggcccaccaagaaa

SEQ ID NO: 192286 - DNA, 25 bp, Mus musculus
agcagcaaaatggtaaccctggcac

SEQ ID NO: 192287 - DNA, 25 bp, Mus musculus
agcagcaaacataatgtgaccccat

SEQ ID NO: 192288 - DNA, 25 bp, Mus musculus
agcagcaacagcaggcccagcctgc

SEQ ID NO: 192289 - DNA, 25 bp, Mus musculus
agcagcaacagttggcatccagcat

SEQ ID NO: 192290 - DNA, 25 bp, Mus musculus
agcagcaacagttgggttctcccca

SEQ ID NO: 192291 - DNA, 25 bp, Mus musculus
agcagcaacagttggtcccatgcat

SEQ ID NO: 192292 - DNA, 25 bp, Mus musculus
agcagcaaccatgcgtgagtgcatc

SEQ ID NO: 192293 - DNA, 25 bp, Mus musculus
agcagcaaccccagattccagaggg

SEQ ID NO: 192294 - DNA, 25 bp, Mus musculus
agcagcaacctgctgaatttgttgg

SEQ ID NO: 192295 - DNA, 25 bp, Mus musculus
agcagcaacctgctggccgtggaga

SEQ ID NO: 192296 - DNA, 25 bp, Mus musculus
agcagcaacgtcggagtcttctaac

SEQ ID NO: 192297 - DNA, 25 bp, Mus musculus
agcagcaaggagctggaagacatga

SEQ ID NO: 192298 - DNA, 25 bp, Mus musculus
agcagcaaggcctcaagttgggata

SEQ ID NO: 192299 - DNA, 25 bp, Mus musculus
agcagcaatggagcttggcatggat

SEQ ID NO: 192300 - DNA, 25 bp, Mus musculus
agcagcaatggaggaattttgacaa

SEQ ID NO: 192301 - DNA, 25 bp, Mus musculus
agcagcaatggaggcaggtggaaga

SEQ ID NO: 192302 - DNA, 25 bp, Mus musculus
agcagcaatggtaaatatgtgtgtg

SEQ ID NO: 192303 - DNA, 25 bp, Mus musculus
agcagcacaaggccgaggccgtggc

SEQ ID NO: 192304 - DNA, 25 bp, Mus musculus
agcagcacagattctaactcagaat

SEQ ID NO: 192305 - DNA, 25 bp, Mus musculus
agcagcaccaaggaaacgtgtcccc

SEQ ID NO: 192306 - DNA, 25 bp, Mus musculus
agcagcaccaagtgtgggttgtttt

SEQ ID NO: 192307 - DNA, 25 bp, Mus musculus
agcagcaccagaaataccggtatca

SEQ ID NO: 192308 - DNA, 25 bp, Mus musculus
agcagcaccagatttcaatgggaga

SEQ ID NO: 192309 - DNA, 25 bp, Mus musculus
agcagcaccagggcctgtccaccag

SEQ ID NO: 192310 - DNA, 25 bp, Mus musculus
agcagcacctggctgactgccttcg

SEQ ID NO: 192311 - DNA, 25 bp, Mus musculus
agcagcacgagcgggtattccccta

SEQ ID NO: 192312 - DNA, 25 bp, Mus musculus
agcagcacggaggacttccctgacc

SEQ ID NO: 192313 - DNA, 25 bp, Mus musculus
agcagcacggatgatgttgcctcca

SEQ ID NO: 192314 - DNA, 25 bp, Mus musculus
agcagcacggtggacttccctgacc

SEQ ID NO: 192315 - DNA, 25 bp, Mus musculus
agcagcactaccctggctgtatcaa

SEQ ID NO: 192316 - DNA, 25 bp, Mus musculus
agcagcactgcggagagccagctgc

SEQ ID NO: 192317 - DNA, 25 bp, Mus musculus
agcagcactgcggagttgagagctg

SEQ ID NO: 192318 - DNA, 25 bp, Mus musculus
agcagcacttctcctctctgaccgg

SEQ ID NO: 192319 - DNA, 25 bp, Mus musculus
agcagcagaaagagccgtctctcag

SEQ ID NO: 192320 - DNA, 25 bp, Mus musculus
agcagcagactcgtctcaaggagct

SEQ ID NO: 192321 - DNA, 25 bp, Mus musculus
agcagcagagactggacgcggattc

SEQ ID NO: 192322 - DNA, 25 bp, Mus musculus
agcagcagagactggactacgagag

SEQ ID NO: 192323 - DNA, 25 bp, Mus musculus
agcagcagaggaagacgttcacagc

SEQ ID NO: 192324 - DNA, 25 bp, Mus musculus
agcagcagatagtttcttaatgagt

SEQ ID NO: 192325 - DNA, 25 bp, Mus musculus
agcagcagatcccagagtcccaggg

SEQ ID NO: 192326 - DNA, 25 bp, Mus musculus
agcagcagatgttcaagtttggacg

SEQ ID NO: 192327 - DNA, 25 bp, Mus musculus
agcagcagattttgtggccctaata

SEQ ID NO: 192328 - DNA, 25 bp, Mus musculus
agcagcagcaaagtctgcatctggc

SEQ ID NO: 192329 - DNA, 25 bp, Mus musculus
agcagcagcaacctcattgggcgct

SEQ ID NO: 192330 - DNA, 25 bp, Mus musculus
agcagcagcagaaacagcccccaca

SEQ ID NO: 192331 - DNA, 25 bp, Mus musculus
agcagcagcagactcaagaatgaat

SEQ ID NO: 192332 - DNA, 25 bp, Mus musculus
agcagcagcagcaacagcaacagca

SEQ ID NO: 192333 - DNA, 25 bp, Mus musculus
agcagcagcagcagaaacagccccc

SEQ ID NO: 192334 - DNA, 25 bp, Mus musculus
agcagcagcagcagcagcagcagca

SEQ ID NO: 192335 - DNA, 25 bp, Mus musculus
agcagcagcagcagccagtttctga

SEQ ID NO: 192336 - DNA, 25 bp, Mus musculus
agcagcagcagcagggatggctcgg

SEQ ID NO: 192337 - DNA, 25 bp, Mus musculus
agcagcagcagcagggctctaccac

SEQ ID NO: 192338 - DNA, 25 bp, Mus musculus
agcagcagcagccagtttctgatgc

SEQ ID NO: 192339 - DNA, 25 bp, Mus musculus
agcagcagcagggatggctcggatg

SEQ ID NO: 192340 - DNA, 25 bp, Mus musculus
agcagcagcagggctctaccactca

SEQ ID NO: 192341 - DNA, 25 bp, Mus musculus
agcagcagcagtaggcactggtgaa

SEQ ID NO: 192342 - DNA, 25 bp, Mus musculus
agcagcagcccatacaatcctcctg

SEQ ID NO: 192343 - DNA, 25 bp, Mus musculus
agcagcagcctgaaaatgccacctc

SEQ ID NO: 192344 - DNA, 25 bp, Mus musculus
agcagcagcgaaatgaccagcccat

SEQ ID NO: 192345 - DNA, 25 bp, Mus musculus
agcagcagcgaaatggttgtacttt

SEQ ID NO: 192346 - DNA, 25 bp, Mus musculus
agcagcagcgagaatgcttcgtggc

SEQ ID NO: 192347 - DNA, 25 bp, Mus musculus
agcagcagcgcaagaccttcacagc

SEQ ID NO: 192348 - DNA, 25 bp, Mus musculus
agcagcagcggcaggaaaagcccag

SEQ ID NO: 192349 - DNA, 25 bp, Mus musculus
agcagcagcttggtctgggaacgta

SEQ ID NO: 192350 - DNA, 25 bp, Mus musculus
agcagcaggagacagtgacccgcct

SEQ ID NO: 192351 - DNA, 25 bp, Mus musculus
agcagcaggagaggctacagcagga

SEQ ID NO: 192352 - DNA, 25 bp, Mus musculus
agcagcaggagatgaggcccgccct

SEQ ID NO: 192353 - DNA, 25 bp, Mus musculus
agcagcaggaggatatggctcggcc

SEQ ID NO: 192354 - DNA, 25 bp, Mus musculus
agcagcaggatcagatgcgatacaa

SEQ ID NO: 192355 - DNA, 25 bp, Mus musculus
agcagcaggatcaggagctggtggg

SEQ ID NO: 192356 - DNA, 25 bp, Mus musculus
agcagcaggcgttgcagaaactgag

SEQ ID NO: 192357 - DNA, 25 bp, Mus musculus
agcagcaggtgcgagaacgcaacct

SEQ ID NO: 192358 - DNA, 25 bp, Mus musculus
agcagcaggttcctgtgtggtgggg

SEQ ID NO: 192359 - DNA, 25 bp, Mus musculus
agcagcagtcccgttctgcagacct

SEQ ID NO: 192360 - DNA, 25 bp, Mus musculus
agcagcagtgtgaggatgacccggc

SEQ ID NO: 192361 - DNA, 25 bp, Mus musculus
agcagcagttgcaggaatctcagca

SEQ ID NO: 192362 - DNA, 25 bp, Mus musculus
agcagcatacaaggtcaacatggcc

SEQ ID NO: 192363 - DNA, 25 bp, Mus musculus
agcagcatccagtgttgcctgtgcc

SEQ ID NO: 192364 - DNA, 25 bp, Mus musculus
agcagcatccagttcgtgaagagag

SEQ ID NO: 192365 - DNA, 25 bp, Mus musculus
agcagcatcttcggcttcagtgtgt

SEQ ID NO: 192366 - DNA, 25 bp, Mus musculus
agcagcatgcactgcgcaatgagct

SEQ ID NO: 192367 - DNA, 25 bp, Mus musculus
agcagcatgcagggctttcagataa

SEQ ID NO: 192368 - DNA, 25 bp, Mus musculus
agcagcatgcagggtaagcgcaaag

SEQ ID NO: 192369 - DNA, 25 bp, Mus musculus
agcagcatggaactaagctctgggg

SEQ ID NO: 192370 - DNA, 25 bp, Mus musculus
agcagcatggaagtgtgattttaaa

SEQ ID NO: 192371 - DNA, 25 bp, Mus musculus
agcagcatggaagtgttctgtacct

SEQ ID NO: 192372 - DNA, 25 bp, Mus musculus
agcagcatggctacaaaatgcacaa

SEQ ID NO: 192373 - DNA, 25 bp, Mus musculus
agcagcattagattgtcttcgatcc

SEQ ID NO: 192374 - DNA, 25 bp, Mus musculus
agcagcattctcctggtgcagatca

SEQ ID NO: 192375 - DNA, 25 bp, Mus musculus
agcagcattgtccaggagcgcccct

SEQ ID NO: 192376 - DNA, 25 bp, Mus musculus
agcagccaagctcagagtgcctgct

SEQ ID NO: 192377 - DNA, 25 bp, Mus musculus
agcagccaaggacacttagcctgtg

SEQ ID NO: 192378 - DNA, 25 bp, Mus musculus
agcagccaattgcctgtgatggtgt

SEQ ID NO: 192379 - DNA, 25 bp, Mus musculus
agcagccacacagagccagacctag

SEQ ID NO: 192380 - DNA, 25 bp, Mus musculus
agcagccacagagggagggagcttg

SEQ ID NO: 192381 - DNA, 25 bp, Mus musculus
agcagccacagcgggcagctcagtg

SEQ ID NO: 192382 - DNA, 25 bp, Mus musculus
agcagccaccaaggacggaattaaa

SEQ ID NO: 192383 - DNA, 25 bp, Mus musculus
agcagccaccaagtgctgagggtta

SEQ ID NO: 192384 - DNA, 25 bp, Mus musculus
agcagccactgcaaggggagcagcg

SEQ ID NO: 192385 - DNA, 25 bp, Mus musculus
agcagccagaatgaaggcttgacta

SEQ ID NO: 192386 - DNA, 25 bp, Mus musculus
agcagccagatgaaggtctgacagt

SEQ ID NO: 192387 - DNA, 25 bp, Mus musculus
agcagccagctgacgctgagagggc

SEQ ID NO: 192388 - DNA, 25 bp, Mus musculus
agcagccagggccggccctcgaaca

SEQ ID NO: 192389 - DNA, 25 bp, Mus musculus
agcagccaggggactctgatggttt

SEQ ID NO: 192390 - DNA, 25 bp, Mus musculus
agcagccaggggggagctgctgcag

SEQ ID NO: 192391 - DNA, 25 bp, Mus musculus
agcagccagggtcggccctcgaaca

SEQ ID NO: 192392 - DNA, 25 bp, Mus musculus
agcagccattaaagatttcattatg

SEQ ID NO: 192393 - DNA, 25 bp, Mus musculus
agcagcccaagcagctggagattca

SEQ ID NO: 192394 - DNA, 25 bp, Mus musculus
agcagcccaaggaggctccgccccc

SEQ ID NO: 192395 - DNA, 25 bp, Mus musculus
agcagcccagaccctacaagtaccc

SEQ ID NO: 192396 - DNA, 25 bp, Mus musculus
agcagcccagagcaatcaggtggtg

SEQ ID NO: 192397 - DNA, 25 bp, Mus musculus
agcagcccagatctactcttcagct

SEQ ID NO: 192398 - DNA, 25 bp, Mus musculus
agcagcccagcccactgagtgtttc

SEQ ID NO: 192399 - DNA, 25 bp, Mus musculus
agcagcccaggatcaaagaatcccg

SEQ ID NO: 192400 - DNA, 25 bp, Mus musculus
agcagcccaggggaacggggggtct

SEQ ID NO: 192401 - DNA, 25 bp, Mus musculus
agcagcccaggggtggaggagaagc

SEQ ID NO: 192402 - DNA, 25 bp, Mus musculus
agcagcccagggtcaggtacctgga

SEQ ID NO: 192403 - DNA, 25 bp, Mus musculus
agcagcccagggttggaagctgtgc

SEQ ID NO: 192404 - DNA, 25 bp, Mus musculus
agcagcccagtgcaggcctgccaac

SEQ ID NO: 192405 - DNA, 25 bp, Mus musculus
agcagcccagtgcaggcctgccact

SEQ ID NO: 192406 - DNA, 25 bp, Mus musculus
agcagcccagtgtcacgagcaagag

SEQ ID NO: 192407 - DNA, 25 bp, Mus musculus
agcagcccatacaatcctcctgatc

SEQ ID NO: 192408 - DNA, 25 bp, Mus musculus
agcagccccagagctgaactcccac

SEQ ID NO: 192409 - DNA, 25 bp, Mus musculus
agcagccctggtgtctgagagcaag

SEQ ID NO: 192410 - DNA, 25 bp, Mus musculus
agcagccgagagtacaaacaggcca

SEQ ID NO: 192411 - DNA, 25 bp, Mus musculus
agcagccgagcctcgggatggatgg

SEQ ID NO: 192412 - DNA, 25 bp, Mus musculus
agcagccgcccctgccttagacttg

SEQ ID NO: 192413 - DNA, 25 bp, Mus musculus
agcagccggaggggcacacaaagaa

SEQ ID NO: 192414 - DNA, 25 bp, Mus musculus
agcagccggaggtgtgtttcatagg

SEQ ID NO: 192415 - DNA, 25 bp, Mus musculus
agcagccggagtttgaagaggacat

SEQ ID NO: 192416 - DNA, 25 bp, Mus musculus
agcagccgggcaggtttgccaagct

SEQ ID NO: 192417 - DNA, 25 bp, Mus musculus
agcagcctaaaaaagggcaagaaat

SEQ ID NO: 192418 - DNA, 25 bp, Mus musculus
agcagcctaaaatagggcaagaaat

SEQ ID NO: 192419 - DNA, 25 bp, Mus musculus
agcagcctccgaaagagcccagtga

SEQ ID NO: 192420 - DNA, 25 bp, Mus musculus
agcagcctccggctggcttaactct

SEQ ID NO: 192421 - DNA, 25 bp, Mus musculus
agcagcctccgggacccccgaggct

SEQ ID NO: 192422 - DNA, 25 bp, Mus musculus
agcagcctgaaaatgccacctcggc

SEQ ID NO: 192423 - DNA, 25 bp, Mus musculus
agcagcctggagcattgctgaatat

SEQ ID NO: 192424 - DNA, 25 bp, Mus musculus
agcagcctggccagcattcaggagc

SEQ ID NO: 192425 - DNA, 25 bp, Mus musculus
agcagcctggtacccccttgcagaa

SEQ ID NO: 192426 - DNA, 25 bp, Mus musculus
agcagcctgttcaagaaatcaacat

SEQ ID NO: 192427 - DNA, 25 bp, Mus musculus
agcagcctgttcaaggttcgcccag

SEQ ID NO: 192428 - DNA, 25 bp, Mus musculus
agcagccttagtcctgtcccccagc

SEQ ID NO: 192429 - DNA, 25 bp, Mus musculus
agcagcctttaccagccctttggga

SEQ ID NO: 192430 - DNA, 25 bp, Mus musculus
agcagcctttggcctctctgtccct

SEQ ID NO: 192431 - DNA, 25 bp, Mus musculus
agcagcctttggtgcgcccggcata

SEQ ID NO: 192432 - DNA, 25 bp, Mus musculus
agcagcgaaatgaccagcccatcaa

SEQ ID NO: 192433 - DNA, 25 bp, Mus musculus
agcagcgaaatggttgtactttccc

SEQ ID NO: 192434 - DNA, 25 bp, Mus musculus
agcagcgaaatggttgtactttctc

SEQ ID NO: 192435 - DNA, 25 bp, Mus musculus
agcagcgacagccaggtatgccatc

SEQ ID NO: 192436 - DNA, 25 bp, Mus musculus
agcagcgagcagatgtctcatttcc

SEQ ID NO: 192437 - DNA, 25 bp, Mus musculus
agcagcgagctgaaattctgtcccc

SEQ ID NO: 192438 - DNA, 25 bp, Mus musculus
agcagcgagtcagtaccatctgcca

SEQ ID NO: 192439 - DNA, 25 bp, Mus musculus
agcagcgagtggcagagttgcacag

SEQ ID NO: 192440 - DNA, 25 bp, Mus musculus
agcagcgatgggccagggctttgac

SEQ ID NO: 192441 - DNA, 25 bp, Mus musculus
agcagcgcaagaccttcacagcctg

SEQ ID NO: 192442 - DNA, 25 bp, Mus musculus
agcagcgcagcctcaggctggctac

SEQ ID NO: 192443 - DNA, 25 bp, Mus musculus
agcagcgcccggacgtcctccccaa

SEQ ID NO: 192444 - DNA, 25 bp, Mus musculus
agcagcgcggcaggccgcggtagcg

SEQ ID NO: 192445 - DNA, 25 bp, Mus musculus
agcagcgcggcggaggttgccccgg

SEQ ID NO: 192446 - DNA, 25 bp, Mus musculus
agcagcggcacggcggagggaggaa

SEQ ID NO: 192447 - DNA, 25 bp, Mus musculus
agcagcggcacggcggggatcccac

SEQ ID NO: 192448 - DNA, 25 bp, Mus musculus
agcagcggcaggaggatgagtctga

SEQ ID NO: 192449 - DNA, 25 bp, Mus musculus
agcagcggccacaggccactgcaga

SEQ ID NO: 192450 - DNA, 25 bp, Mus musculus
agcagcggcctcaaggtctgaggcg

SEQ ID NO: 192451 - DNA, 25 bp, Mus musculus
agcagcggcctcaaggttggagacc

SEQ ID NO: 192452 - DNA, 25 bp, Mus musculus
agcagcggcctcaagtgaccttgca

SEQ ID NO: 192453 - DNA, 25 bp, Mus musculus
agcagcggcctcaggtccattcaga

SEQ ID NO: 192454 - DNA, 25 bp, Mus musculus
agcagcggcgagagatgctcagaga

SEQ ID NO: 192455 - DNA, 25 bp, Mus musculus
agcagcggcgagtgggaaagacaag

SEQ ID NO: 192456 - DNA, 25 bp, Mus musculus
agcagcggcgcaggttgccccggag

SEQ ID NO: 192457 - DNA, 25 bp, Mus musculus
agcagcgggtttgggtctgtacaca

SEQ ID NO: 192458 - DNA, 25 bp, Mus musculus
agcagcgtcatggagatgctcagac

SEQ ID NO: 192459 - DNA, 25 bp, Mus musculus
agcagcgtccttgagctgaggctgc

SEQ ID NO: 192460 - DNA, 25 bp, Mus musculus
agcagctaaagactgtttttgttaa

SEQ ID NO: 192461 - DNA, 25 bp, Mus musculus
agcagctaaagagaggatcacctta

SEQ ID NO: 192462 - DNA, 25 bp, Mus musculus
agcagctagagattgcgctggctcc

SEQ ID NO: 192463 - DNA, 25 bp, Mus musculus
agcagctagagcgacagcagttgga

SEQ ID NO: 192464 - DNA, 25 bp, Mus musculus
agcagctagtcttttaatggagaat

SEQ ID NO: 192465 - DNA, 25 bp, Mus musculus
agcagctagtcttttaggtaagaag

SEQ ID NO: 192466 - DNA, 25 bp, Mus musculus
agcagctcagggactcagcgatgtc

SEQ ID NO: 192467 - DNA, 25 bp, Mus musculus
agcagctccacacaatatgacgtgt

SEQ ID NO: 192468 - DNA, 25 bp, Mus musculus
agcagctcccaggaggttcatgagt

SEQ ID NO: 192469 - DNA, 25 bp, Mus musculus
agcagctcctgacaaacgtcctgga

SEQ ID NO: 192470 - DNA, 25 bp, Mus musculus
agcagctctattggctaatgggcca

SEQ ID NO: 192471 - DNA, 25 bp, Mus musculus
agcagctctgacagttccaggaggc

SEQ ID NO: 192472 - DNA, 25 bp, Mus musculus
agcagctctgcagtatgctgaccct

SEQ ID NO: 192473 - DNA, 25 bp, Mus musculus
agcagctctgtgctgtattttcatc

SEQ ID NO: 192474 - DNA, 25 bp, Mus musculus
agcagctctgtggtttgggctcagt

SEQ ID NO: 192475 - DNA, 25 bp, Mus musculus
agcagctctttagggttctacttta

SEQ ID NO: 192476 - DNA, 25 bp, Mus musculus
agcagctgacaggattcagtttgcc

SEQ ID NO: 192477 - DNA, 25 bp, Mus musculus
agcagctgacccagatatatttgta

SEQ ID NO: 192478 - DNA, 25 bp, Mus musculus
agcagctgacccaggacatttgaca

SEQ ID NO: 192479 - DNA, 25 bp, Mus musculus
agcagctgacccagtttgctgagaa

SEQ ID NO: 192480 - DNA, 25 bp, Mus musculus
agcagctgacccgactcagccttat

SEQ ID NO: 192481 - DNA, 25 bp, Mus musculus
agcagctgagcctccccctgcagga

SEQ ID NO: 192482 - DNA, 25 bp, Mus musculus
agcagctgaggcagagaaaaggcag

SEQ ID NO: 192483 - DNA, 25 bp, Mus musculus
agcagctgaggcagggtcagaaagc

SEQ ID NO: 192484 - DNA, 25 bp, Mus musculus
agcagctgaggggtaatcaggaagc

SEQ ID NO: 192485 - DNA, 25 bp, Mus musculus
agcagctgcagcagggctcatggca

SEQ ID NO: 192486 - DNA, 25 bp, Mus musculus
agcagctgccagactctgatagact

SEQ ID NO: 192487 - DNA, 25 bp, Mus musculus
agcagctgcgctgggttgtggcagc

SEQ ID NO: 192488 - DNA, 25 bp, Mus musculus
agcagctgctgaccacactgggtcc

SEQ ID NO: 192489 - DNA, 25 bp, Mus musculus
agcagctgctggcaggctgcatgct

SEQ ID NO: 192490 - DNA, 25 bp, Mus musculus
agcagctggacagggtccgcaagca

SEQ ID NO: 192491 - DNA, 25 bp, Mus musculus
agcagctggaggtggtcaagctgcc

SEQ ID NO: 192492 - DNA, 25 bp, Mus musculus
agcagctggagttgaactttctaga

SEQ ID NO: 192493 - DNA, 25 bp, Mus musculus
agcagctggcccaggcctccaggac

SEQ ID NO: 192494 - DNA, 25 bp, Mus musculus
agcagctggctaagaatgtgactgt

SEQ ID NO: 192495 - DNA, 25 bp, Mus musculus
agcagctgggaaagggagcctttac

SEQ ID NO: 192496 - DNA, 25 bp, Mus musculus
agcagctgtaaggagcttcaccctg

SEQ ID NO: 192497 - DNA, 25 bp, Mus musculus
agcagctgtcaaggaactgaatgcc

SEQ ID NO: 192498 - DNA, 25 bp, Mus musculus
agcagctgtggggttccacagcact

SEQ ID NO: 192499 - DNA, 25 bp, Mus musculus
agcagcttagagaagctgatggtcc

SEQ ID NO: 192500 - DNA, 25 bp, Mus musculus
agcagcttagatggcaggcatgccc

SEQ ID NO: 192501 - DNA, 25 bp, Mus musculus
agcagcttagggatacaagttgatg

SEQ ID NO: 192502 - DNA, 25 bp, Mus musculus
agcagcttcatcaggaatggccttg

SEQ ID NO: 192503 - DNA, 25 bp, Mus musculus
agcagcttcatcaggagcaagagca

SEQ ID NO: 192504 - DNA, 25 bp, Mus musculus
agcagcttccagaaccacgtcaacc

SEQ ID NO: 192505 - DNA, 25 bp, Mus musculus
agcagcttccagatttgtctcaaag

SEQ ID NO: 192506 - DNA, 25 bp, Mus musculus
agcagcttccaggcgtccgcgagtt

SEQ ID NO: 192507 - DNA, 25 bp, Mus musculus
agcagcttgggtcttgacgaagtga

SEQ ID NO: 192508 - DNA, 25 bp, Mus musculus
agcaggaaaaggtggtcactaactg

SEQ ID NO: 192509 - DNA, 25 bp, Mus musculus
agcaggaaacaagattatccagctg

SEQ ID NO: 192510 - DNA, 25 bp, Mus musculus
agcaggaaacagttacctgcagaat

SEQ ID NO: 192511 - DNA, 25 bp, Mus musculus
agcaggaaagcagaaaaccgtcaag

SEQ ID NO: 192512 - DNA, 25 bp, Mus musculus
agcaggaaagcgaggatgagaagca

SEQ ID NO: 192513 - DNA, 25 bp, Mus musculus
agcaggaaagttccaggggaacata

SEQ ID NO: 192514 - DNA, 25 bp, Mus musculus
agcaggaacagggtcaagtcctcca

SEQ ID NO: 192515 - DNA, 25 bp, Mus musculus
agcaggaacagggtttaatgtggag

SEQ ID NO: 192516 - DNA, 25 bp, Mus musculus
agcaggaacgattcaatcccaagac

SEQ ID NO: 192517 - DNA, 25 bp, Mus musculus
agcaggaacgtatatgactgctgct

SEQ ID NO: 192518 - DNA, 25 bp, Mus musculus
agcaggaactcaggtggccactcta

SEQ ID NO: 192519 - DNA, 25 bp, Mus musculus
agcaggaagcctgtgcccagtatag

SEQ ID NO: 192520 - DNA, 25 bp, Mus musculus
agcaggaaggaggatgctgtcctta

SEQ ID NO: 192521 - DNA, 25 bp, Mus musculus
agcaggaagtgaggtggaagaaaag

SEQ ID NO: 192522 - DNA, 25 bp, Mus musculus
agcaggaagtgtacttgatgtgtgc

SEQ ID NO: 192523 - DNA, 25 bp, Mus musculus
agcaggaatgaaagatttatgataa

SEQ ID NO: 192524 - DNA, 25 bp, Mus musculus
agcaggaatgaaaggtttcaacagc

SEQ ID NO: 192525 - DNA, 25 bp, Mus musculus
agcaggaattccgggtcagctgcta

SEQ ID NO: 192526 - DNA, 25 bp, Mus musculus
agcaggacaaagaccaaggattact

SEQ ID NO: 192527 - DNA, 25 bp, Mus musculus
agcaggacaaagagactgcatcgac

SEQ ID NO: 192528 - DNA, 25 bp, Mus musculus
agcaggacaaagcatgtggggcagt

SEQ ID NO: 192529 - DNA, 25 bp, Mus musculus
agcaggacaaaggagtctcacctga

SEQ ID NO: 192530 - DNA, 25 bp, Mus musculus
agcaggacagtgacagcatcacggc

SEQ ID NO: 192531 - DNA, 25 bp, Mus musculus
agcaggacatgatagacggcttgaa

SEQ ID NO: 192532 - DNA, 25 bp, Mus musculus
agcaggacatgctggcctcaaactt

SEQ ID NO: 192533 - DNA, 25 bp, Mus musculus
agcaggacatgtttgcacaccctta

SEQ ID NO: 192534 - DNA, 25 bp, Mus musculus
agcaggaccaagctggcaagcgcgc

SEQ ID NO: 192535 - DNA, 25 bp, Mus musculus
agcaggaccaaggatcagacaaggg

SEQ ID NO: 192536 - DNA, 25 bp, Mus musculus
agcaggaccagagggtcctcctggt

SEQ ID NO: 192537 - DNA, 25 bp, Mus musculus
agcaggaccaggcaggagtacctgg

SEQ ID NO: 192538 - DNA, 25 bp, Mus musculus
agcaggaccaggcagtacacctatg

SEQ ID NO: 192539 - DNA, 25 bp, Mus musculus
agcaggaccaggcggttgtggatct

SEQ ID NO: 192540 - DNA, 25 bp, Mus musculus
agcaggacctgaaaggattaatagg

SEQ ID NO: 192541 - DNA, 25 bp, Mus musculus
agcaggacctgaaatttcagattgg

SEQ ID NO: 192542 - DNA, 25 bp, Mus musculus
agcaggacgcccaggaactgtatga

SEQ ID NO: 192543 - DNA, 25 bp, Mus musculus
agcaggacgcccaggtctttcaaca

SEQ ID NO: 192544 - DNA, 25 bp, Mus musculus
agcaggacgggaaggatgcgaacgc

SEQ ID NO: 192545 - DNA, 25 bp, Mus musculus
agcaggacgtggtgacagagttagt

SEQ ID NO: 192546 - DNA, 25 bp, Mus musculus
agcaggactccagagatcccgatgt

SEQ ID NO: 192547 - DNA, 25 bp, Mus musculus
agcaggactcggatgaggccatcct

SEQ ID NO: 192548 - DNA, 25 bp, Mus musculus
agcaggagaagagtatcgatgatga

SEQ ID NO: 192549 - DNA, 25 bp, Mus musculus
agcaggagagattgttgacgctgct

SEQ ID NO: 192550 - DNA, 25 bp, Mus musculus
agcaggagagcgtgaaagagttcct

SEQ ID NO: 192551 - DNA, 25 bp, Mus musculus
agcaggagatgcctgatcaacatga

SEQ ID NO: 192552 - DNA, 25 bp, Mus musculus
agcaggagccagggatgccctgctg

SEQ ID NO: 192553 - DNA, 25 bp, Mus musculus
agcaggagcccaacttgcaggtgga

SEQ ID NO: 192554 - DNA, 25 bp, Mus musculus
agcaggagcgcaggttcctcatgag

SEQ ID NO: 192555 - DNA, 25 bp, Mus musculus
agcaggagctgacattcacactctt

SEQ ID NO: 192556 - DNA, 25 bp, Mus musculus
agcaggagctgtctgaggaggacaa

SEQ ID NO: 192557 - DNA, 25 bp, Mus musculus
agcaggaggacgaggtgctgctggt

SEQ ID NO: 192558 - DNA, 25 bp, Mus musculus
agcaggaggagcagacgggcagcgg

SEQ ID NO: 192559 - DNA, 25 bp, Mus musculus
agcaggaggagcaggatatcctcac

SEQ ID NO: 192560 - DNA, 25 bp, Mus musculus
agcaggaggccatggttaaaccata

SEQ ID NO: 192561 - DNA, 25 bp, Mus musculus
agcaggaggcccaagcctttccacg

SEQ ID NO: 192562 - DNA, 25 bp, Mus musculus
agcaggaggcccaatgattagcatt

SEQ ID NO: 192563 - DNA, 25 bp, Mus musculus
agcaggagtgaacagtccctggatg

SEQ ID NO: 192564 - DNA, 25 bp, Mus musculus
agcaggagtgcactgccccccaaac

SEQ ID NO: 192565 - DNA, 25 bp, Mus musculus
agcaggagttgaggacctgtttact

SEQ ID NO: 192566 - DNA, 25 bp, Mus musculus
agcaggataaaggcataatcaaccc

SEQ ID NO: 192567 - DNA, 25 bp, Mus musculus
agcaggatcagatgcgatacaacca

SEQ ID NO: 192568 - DNA, 25 bp, Mus musculus
agcaggatcaggagctggtggggag

SEQ ID NO: 192569 - DNA, 25 bp, Mus musculus
agcaggatcgcatgggctaccagct

SEQ ID NO: 192570 - DNA, 25 bp, Mus musculus
agcaggatgagagcagacactgcag

SEQ ID NO: 192571 - DNA, 25 bp, Mus musculus
agcaggatgaggaggaagatgaggt

SEQ ID NO: 192572 - DNA, 25 bp, Mus musculus
agcaggatgattgaggatgcaattc

SEQ ID NO: 192573 - DNA, 25 bp, Mus musculus
agcaggatgcagagggacgccctga

SEQ ID NO: 192574 - DNA, 25 bp, Mus musculus
agcaggatgcagaggttcgccatcg

SEQ ID NO: 192575 - DNA, 25 bp, Mus musculus
agcaggatgcgaagaaagccttcaa

SEQ ID NO: 192576 - DNA, 25 bp, Mus musculus
agcaggatggaagagaagctgaaga

SEQ ID NO: 192577 - DNA, 25 bp, Mus musculus
agcaggatggccagacgggcagcgg

SEQ ID NO: 192578 - DNA, 25 bp, Mus musculus
agcaggatggccagctaccatattt

SEQ ID NO: 192579 - DNA, 25 bp, Mus musculus
agcaggatggccaggatatcctcac

SEQ ID NO: 192580 - DNA, 25 bp, Mus musculus
agcaggatggccagtttgtcccttt

SEQ ID NO: 192581 - DNA, 25 bp, Mus musculus
agcaggattcaccatgactctgctg

SEQ ID NO: 192582 - DNA, 25 bp, Mus musculus
agcaggcaacagatcagcacggccc

SEQ ID NO: 192583 - DNA, 25 bp, Mus musculus
agcaggcaaggagacggaagagtaa

SEQ ID NO: 192584 - DNA, 25 bp, Mus musculus
agcaggcaaggtatacttgaaggct

SEQ ID NO: 192585 - DNA, 25 bp, Mus musculus
agcaggcaaggtgaccacattagtc

SEQ ID NO: 192586 - DNA, 25 bp, Mus musculus
agcaggcaccatgggaccctctaga

SEQ ID NO: 192587 - DNA, 25 bp, Mus musculus
agcaggcaccatggggtgcagggaa

SEQ ID NO: 192588 - DNA, 25 bp, Mus musculus
agcaggcacgcagggcagaagtcgt

SEQ ID NO: 192589 - DNA, 25 bp, Mus musculus
agcaggcagcaaaaggtctccatag

SEQ ID NO: 192590 - DNA, 25 bp, Mus musculus
agcaggcagccagcccagtgggcag

SEQ ID NO: 192591 - DNA, 25 bp, Mus musculus
agcaggcatgggtaggatttgcggg

SEQ ID NO: 192592 - DNA, 25 bp, Mus musculus
agcaggcatggtttggatttgcggg

SEQ ID NO: 192593 - DNA, 25 bp, Mus musculus
agcaggccaactctacaatggcttc

SEQ ID NO: 192594 - DNA, 25 bp, Mus musculus
agcaggccaagcaggcttgtgatgc

SEQ ID NO: 192595 - DNA, 25 bp, Mus musculus
agcaggccaaggccaaggctgccgg

SEQ ID NO: 192596 - DNA, 25 bp, Mus musculus
agcaggccacaggcaatgtgagcat

SEQ ID NO: 192597 - DNA, 25 bp, Mus musculus
agcaggccgcgctagaaaatgctac

SEQ ID NO: 192598 - DNA, 25 bp, Mus musculus
agcaggcctctgaggccttcttgct

SEQ ID NO: 192599 - DNA, 25 bp, Mus musculus
agcaggcgcttgcagaaggggcgcc

SEQ ID NO: 192600 - DNA, 25 bp, Mus musculus
agcaggcgcttgcaggcatgacgag

SEQ ID NO: 192601 - DNA, 25 bp, Mus musculus
agcaggcggaggtgcgtggtccaac

SEQ ID NO: 192602 - DNA, 25 bp, Mus musculus
agcaggctacagtcagttctacagc

SEQ ID NO: 192603 - DNA, 25 bp, Mus musculus
agcaggctacagtgactttttcaca

SEQ ID NO: 192604 - DNA, 25 bp, Mus musculus
agcaggctcagagatgggcccagtg

SEQ ID NO: 192605 - DNA, 25 bp, Mus musculus
agcaggctctattcccaactttcag

SEQ ID NO: 192606 - DNA, 25 bp, Mus musculus
agcaggctcttgcatcccctcagca

SEQ ID NO: 192607 - DNA, 25 bp, Mus musculus
agcaggctgtatgggtctgacagaa

SEQ ID NO: 192608 - DNA, 25 bp, Mus musculus
agcaggctgtcaaaggggagaagct

SEQ ID NO: 192609 - DNA, 25 bp, Mus musculus
agcaggctgttcagagtcatgcagt

SEQ ID NO: 192610 - DNA, 25 bp, Mus musculus
agcagggaagcctggacccccaggt

SEQ ID NO: 192611 - DNA, 25 bp, Mus musculus
agcagggaagttggggggactctgg

SEQ ID NO: 192612 - DNA, 25 bp, Mus musculus
agcagggaccaggccctctgccaac

SEQ ID NO: 192613 - DNA, 25 bp, Mus musculus
agcagggaccatggttggggtgctt

SEQ ID NO: 192614 - DNA, 25 bp, Mus musculus
agcagggacgcccgaggagctcacc

SEQ ID NO: 192615 - DNA, 25 bp, Mus musculus
agcagggagcaggatatggttactg

SEQ ID NO: 192616 - DNA, 25 bp, Mus musculus
agcagggcaatgttctgtcttcccc

SEQ ID NO: 192617 - DNA, 25 bp, Mus musculus
agcagggcaggatgagtacagcatt

SEQ ID NO: 192618 - DNA, 25 bp, Mus musculus
agcagggcatcaagaagtcaacaaa

SEQ ID NO: 192619 - DNA, 25 bp, Mus musculus
agcagggcatcaagtattggctgga

SEQ ID NO: 192620 - DNA, 25 bp, Mus musculus
agcagggccagatgtagtgctgagc

SEQ ID NO: 192621 - DNA, 25 bp, Mus musculus
agcagggccagtgctgagcagcggc

SEQ ID NO: 192622 - DNA, 25 bp, Mus musculus
agcagggccctcaggaacaatggcc

SEQ ID NO: 192623 - DNA, 25 bp, Mus musculus
agcagggccctcaggccagggggaa

SEQ ID NO: 192624 - DNA, 25 bp, Mus musculus
agcagggcctgctcaggctgtggct

SEQ ID NO: 192625 - DNA, 25 bp, Mus musculus
agcagggcgaaggagcagggcgcgg

SEQ ID NO: 192626 - DNA, 25 bp, Mus musculus
agcagggcgccgggcttcttcacaa

SEQ ID NO: 192627 - DNA, 25 bp, Mus musculus
agcagggcgcctagcgctttgagct

SEQ ID NO: 192628 - DNA, 25 bp, Mus musculus
agcagggctgtggcctggagatgcc

SEQ ID NO: 192629 - DNA, 25 bp, Mus musculus
agcagggcttgctgttctcctcttg

SEQ ID NO: 192630 - DNA, 25 bp, Mus musculus
agcaggggcctcaggtggatgaaac

SEQ ID NO: 192631 - DNA, 25 bp, Mus musculus
agcaggggctgcaggggacacccgt

SEQ ID NO: 192632 - DNA, 25 bp, Mus musculus
agcagggggacaaggttggggaggc

SEQ ID NO: 192633 - DNA, 25 bp, Mus musculus
agcaggggtttcaggcagaaaatgt

SEQ ID NO: 192634 - DNA, 25 bp, Mus musculus
agcaggggtttcaggtctgcattac

SEQ ID NO: 192635 - DNA, 25 bp, Mus musculus
agcagggtaccgcgagatactactc

SEQ ID NO: 192636 - DNA, 25 bp, Mus musculus
agcagggtcagaccacacccgtgac

SEQ ID NO: 192637 - DNA, 25 bp, Mus musculus
agcagggtcagggactcatgcagtg

SEQ ID NO: 192638 - DNA, 25 bp, Mus musculus
agcaggtaaagtaccaaatatgccc

SEQ ID NO: 192639 - DNA, 25 bp, Mus musculus
agcaggtaagcagctgctccctttg

SEQ ID NO: 192640 - DNA, 25 bp, Mus musculus
agcaggtaattaacgagatggtgcg

SEQ ID NO: 192641 - DNA, 25 bp, Mus musculus
agcaggtaattagtgaaatggttaa

SEQ ID NO: 192642 - DNA, 25 bp, Mus musculus
agcaggtaggcctcgggacggcctc

SEQ ID NO: 192643 - DNA, 25 bp, Mus musculus
agcaggtatcgaggaattctatacc

SEQ ID NO: 192644 - DNA, 25 bp, Mus musculus
agcaggtcccagttgtactgcagcc

SEQ ID NO: 192645 - DNA, 25 bp, Mus musculus
agcaggtccccaagaagcttaagac

SEQ ID NO: 192646 - DNA, 25 bp, Mus musculus
agcaggtccgcaaagagaaaagatg

SEQ ID NO: 192647 - DNA, 25 bp, Mus musculus
agcaggtccgcaaagctccttctgg

SEQ ID NO: 192648 - DNA, 25 bp, Mus musculus
agcaggtccgcaaagtggcatggat

SEQ ID NO: 192649 - DNA, 25 bp, Mus musculus
agcaggtccttgaaatcaagatgct

SEQ ID NO: 192650 - DNA, 25 bp, Mus musculus
agcaggtctcaaaagcgctcctgga

SEQ ID NO: 192651 - DNA, 25 bp, Mus musculus
agcaggtctgggtattggatggccg

SEQ ID NO: 192652 - DNA, 25 bp, Mus musculus
agcaggtgagaggccacgattgctg

SEQ ID NO: 192653 - DNA, 25 bp, Mus musculus
agcaggtgagggggtcggggtttgc

SEQ ID NO: 192654 - DNA, 25 bp, Mus musculus
agcaggtgcgagaacgcaacctgaa

SEQ ID NO: 192655 - DNA, 25 bp, Mus musculus
agcaggtgctgcaggttcttctgaa

SEQ ID NO: 192656 - DNA, 25 bp, Mus musculus
agcaggtgctgcagtctcaggactc

SEQ ID NO: 192657 - DNA, 25 bp, Mus musculus
agcaggtggatgatctggagggatc

SEQ ID NO: 192658 - DNA, 25 bp, Mus musculus
agcaggtggcaacgctgacagagcg

SEQ ID NO: 192659 - DNA, 25 bp, Mus musculus
agcaggtggcagagaaggaagccaa

SEQ ID NO: 192660 - DNA, 25 bp, Mus musculus
agcaggtggctgaggtaccacgtac

SEQ ID NO: 192661 - DNA, 25 bp, Mus musculus
agcaggtgtactgtggttcactaca

SEQ ID NO: 192662 - DNA, 25 bp, Mus musculus
agcaggttccagacaatcctcctga

SEQ ID NO: 192663 - DNA, 25 bp, Mus musculus
agcaggttccagctctcccaggaaa

SEQ ID NO: 192664 - DNA, 25 bp, Mus musculus
agcaggttcctgcctaccactgttc

SEQ ID NO: 192665 - DNA, 25 bp, Mus musculus
agcaggttcctgcctgtgacatgga

SEQ ID NO: 192666 - DNA, 25 bp, Mus musculus
agcaggttcctgtgtggtggggacc

SEQ ID NO: 192667 - DNA, 25 bp, Mus musculus
agcaggtttagaagacagcgtggaa

SEQ ID NO: 192668 - DNA, 25 bp, Mus musculus
agcaggtttgagatgttctcaaaca

SEQ ID NO: 192669 - DNA, 25 bp, Mus musculus
agcagtaaagcttgtgaaggcgctg

SEQ ID NO: 192670 - DNA, 25 bp, Mus musculus
agcagtaacaacggcctcagcatcc

SEQ ID NO: 192671 - DNA, 25 bp, Mus musculus
agcagtaatacgaaagccgcaaagg

SEQ ID NO: 192672 - DNA, 25 bp, Mus musculus
agcagtaataggaaagccgcaaagg

SEQ ID NO: 192673 - DNA, 25 bp, Mus musculus
agcagtaatggtaagtatactgtag

SEQ ID NO: 192674 - DNA, 25 bp, Mus musculus
agcagtaatggtccatcctgataaa

SEQ ID NO: 192675 - DNA, 25 bp, Mus musculus
agcagtacaaacctctttctcatca

SEQ ID NO: 192676 - DNA, 25 bp, Mus musculus
agcagtacaatgagaaaaaaagaca

SEQ ID NO: 192677 - DNA, 25 bp, Mus musculus
agcagtacagacgaaatgcctggaa

SEQ ID NO: 192678 - DNA, 25 bp, Mus musculus
agcagtacaggccggccacgaagac

SEQ ID NO: 192679 - DNA, 25 bp, Mus musculus
agcagtaccagtttgctagtggtgc

SEQ ID NO: 192680 - DNA, 25 bp, Mus musculus
agcagtacctgaagggaaccccaat

SEQ ID NO: 192681 - DNA, 25 bp, Mus musculus
agcagtacctgaaggtggagagctg

SEQ ID NO: 192682 - DNA, 25 bp, Mus musculus
agcagtagatgaagtgccagaacca

SEQ ID NO: 192683 - DNA, 25 bp, Mus musculus
agcagtagcgagccacaggttgtgt

SEQ ID NO: 192684 - DNA, 25 bp, Mus musculus
agcagtagcggaaagctgagcagca

SEQ ID NO: 192685 - DNA, 25 bp, Mus musculus
agcagtaggtatcagggtggactca

SEQ ID NO: 192686 - DNA, 25 bp, Mus musculus
agcagtagtggcttcacggaaaccc

SEQ ID NO: 192687 - DNA, 25 bp, Mus musculus
agcagtagtttgatgagtcttgatt

SEQ ID NO: 192688 - DNA, 25 bp, Mus musculus
agcagtatggaaatagtttcttgga

SEQ ID NO: 192689 - DNA, 25 bp, Mus musculus
agcagtatggaaatgtcctacccta

SEQ ID NO: 192690 - DNA, 25 bp, Mus musculus
agcagtatggaagtggcttggctga

SEQ ID NO: 192691 - DNA, 25 bp, Mus musculus
agcagtatggaagtgtttgccgaag

SEQ ID NO: 192692 - DNA, 25 bp, Mus musculus
agcagtatggaattcttcctttgca

SEQ ID NO: 192693 - DNA, 25 bp, Mus musculus
agcagtatgttgatgcaacgtgtaa

SEQ ID NO: 192694 - DNA, 25 bp, Mus musculus
agcagtatgttgatggagatcagtg

SEQ ID NO: 192695 - DNA, 25 bp, Mus musculus
agcagtattcctcctgcttctaacg

SEQ ID NO: 192696 - DNA, 25 bp, Mus musculus
agcagtattggcaagaaccgagctc

SEQ ID NO: 192697 - DNA, 25 bp, Mus musculus
agcagtattggcaagagtccagaaa

SEQ ID NO: 192698 - DNA, 25 bp, Mus musculus
agcagtcagagagaacgtgaggcta

SEQ ID NO: 192699 - DNA, 25 bp, Mus musculus
agcagtcagagagactcaagaacgt

SEQ ID NO: 192700 - DNA, 25 bp, Mus musculus
agcagtcagagccggcttcggagtt

SEQ ID NO: 192701 - DNA, 25 bp, Mus musculus
agcagtcaggatgatgcagctagtg

SEQ ID NO: 192702 - DNA, 25 bp, Mus musculus
agcagtcagggcaatggcagcgctg

SEQ ID NO: 192703 - DNA, 25 bp, Mus musculus
agcagtccaagaaaacatcgctctc

SEQ ID NO: 192704 - DNA, 25 bp, Mus musculus
agcagtccaagatctgatgttttga

SEQ ID NO: 192705 - DNA, 25 bp, Mus musculus
agcagtccaagcgctctctcagatt

SEQ ID NO: 192706 - DNA, 25 bp, Mus musculus
agcagtccagatttcatcctgatgg

SEQ ID NO: 192707 - DNA, 25 bp, Mus musculus
agcagtccagccctattctgaaaag

SEQ ID NO: 192708 - DNA, 25 bp, Mus musculus
agcagtccagctcgtctgatccttc

SEQ ID NO: 192709 - DNA, 25 bp, Mus musculus
agcagtccaggttcttactctgtag

SEQ ID NO: 192710 - DNA, 25 bp, Mus musculus
agcagtccagttcgataccgttcct

SEQ ID NO: 192711 - DNA, 25 bp, Mus musculus
agcagtccagttcgatttgatatcc

SEQ ID NO: 192712 - DNA, 25 bp, Mus musculus
agcagtcccggctgagtttgaatgt

SEQ ID NO: 192713 - DNA, 25 bp, Mus musculus
agcagtcccgttctgcagacctccc

SEQ ID NO: 192714 - DNA, 25 bp, Mus musculus
agcagtccctgcaggtgaagaagac

SEQ ID NO: 192715 - DNA, 25 bp, Mus musculus
agcagtccgcaggtctttggccagt

SEQ ID NO: 192716 - DNA, 25 bp, Mus musculus
agcagtcgaaagaggcagacatcga

SEQ ID NO: 192717 - DNA, 25 bp, Mus musculus
agcagtctaaggtgtctgaacacac

SEQ ID NO: 192718 - DNA, 25 bp, Mus musculus
agcagtctcaccttgtctgtctgca

SEQ ID NO: 192719 - DNA, 25 bp, Mus musculus
agcagtctgaggcctctggggacct

SEQ ID NO: 192720 - DNA, 25 bp, Mus musculus
agcagtctggcatgctcccaaatgg

SEQ ID NO: 192721 - DNA, 25 bp, Mus musculus
agcagtctgtatgaggattgtggcc

SEQ ID NO: 192722 - DNA, 25 bp, Mus musculus
agcagtctgtgcacttagtagaaaa

SEQ ID NO: 192723 - DNA, 25 bp, Mus musculus
agcagtcttcatctgactctggctc

SEQ ID NO: 192724 - DNA, 25 bp, Mus musculus
agcagtgaaagcaatgacatttctt

SEQ ID NO: 192725 - DNA, 25 bp, Mus musculus
agcagtgacagtgagagcgggtccg

SEQ ID NO: 192726 - DNA, 25 bp, Mus musculus
agcagtgagcgagatgcagcaccga

SEQ ID NO: 192727 - DNA, 25 bp, Mus musculus
agcagtgatggtaagcttctctcta

SEQ ID NO: 192728 - DNA, 25 bp, Mus musculus
agcagtgcaaaggtgattcttactg

SEQ ID NO: 192729 - DNA, 25 bp, Mus musculus
agcagtgcaagacagcacaccctaa

SEQ ID NO: 192730 - DNA, 25 bp, Mus musculus
agcagtgcaaggtgtccgcaaatat

SEQ ID NO: 192731 - DNA, 25 bp, Mus musculus
agcagtgcaggaagaacagaggcgt

SEQ ID NO: 192732 - DNA, 25 bp, Mus musculus
agcagtgcccgaattgagagaaaaa

SEQ ID NO: 192733 - DNA, 25 bp, Mus musculus
agcagtgccgaaagtggctatgcaa

SEQ ID NO: 192734 - DNA, 25 bp, Mus musculus
agcagtgcctaccaggtgctgagga

SEQ ID NO: 192735 - DNA, 25 bp, Mus musculus
agcagtgcctaccaggtgtccgtaa

SEQ ID NO: 192736 - DNA, 25 bp, Mus musculus
agcagtgctaattcaggtcttgccg

SEQ ID NO: 192737 - DNA, 25 bp, Mus musculus
agcagtgctagttgggtgcaaagct

SEQ ID NO: 192738 - DNA, 25 bp, Mus musculus
agcagtgcttcctcgagaagccaac

SEQ ID NO: 192739 - DNA, 25 bp, Mus musculus
agcagtgcttcctcgatgagatcgt

SEQ ID NO: 192740 - DNA, 25 bp, Mus musculus
agcagtggacgcgaggtacaacgcc

SEQ ID NO: 192741 - DNA, 25 bp, Mus musculus
agcagtggacgcgagtttcggaccc

SEQ ID NO: 192742 - DNA, 25 bp, Mus musculus
agcagtggagactgagcaaatcggc

SEQ ID NO: 192743 - DNA, 25 bp, Mus musculus
agcagtggagactggtcttgctttg

SEQ ID NO: 192744 - DNA, 25 bp, Mus musculus
agcagtggaggaagcacctcccact

SEQ ID NO: 192745 - DNA, 25 bp, Mus musculus
agcagtggaggaagctcatctacgg

SEQ ID NO: 192746 - DNA, 25 bp, Mus musculus
agcagtggaggctctttgccgacat

SEQ ID NO: 192747 - DNA, 25 bp, Mus musculus
agcagtggatggaagacagcgagcg

SEQ ID NO: 192748 - DNA, 25 bp, Mus musculus
agcagtggcactgtcctcccagtgg

SEQ ID NO: 192749 - DNA, 25 bp, Mus musculus
agcagtggcgaggccatggtggcgt

SEQ ID NO: 192750 - DNA, 25 bp, Mus musculus
agcagtggctcaagaccctgaaggc

SEQ ID NO: 192751 - DNA, 25 bp, Mus musculus
agcagtggctcaaggctatcgagga

SEQ ID NO: 192752 - DNA, 25 bp, Mus musculus
agcagtgggagaaagatgatgacat

SEQ ID NO: 192753 - DNA, 25 bp, Mus musculus
agcagtggtccagggatgaactgtg

SEQ ID NO: 192754 - DNA, 25 bp, Mus musculus
agcagtgtaaagatattgatgaatg

SEQ ID NO: 192755 - DNA, 25 bp, Mus musculus
agcagtgtcagtgggttatttcgct

SEQ ID NO: 192756 - DNA, 25 bp, Mus musculus
agcagtgtgaagggctcaggatgct

SEQ ID NO: 192757 - DNA, 25 bp, Mus musculus
agcagtgtggaagtctggtcatctg

SEQ ID NO: 192758 - DNA, 25 bp, Mus musculus
agcagtgtggaagttctgcaactgt

SEQ ID NO: 192759 - DNA, 25 bp, Mus musculus
agcagtgtggtgactgttggtcctg

SEQ ID NO: 192760 - DNA, 25 bp, Mus musculus
agcagttaaccagtgctgagcctac

SEQ ID NO: 192761 - DNA, 25 bp, Mus musculus
agcagttaagctaccttaagggcgt

SEQ ID NO: 192762 - DNA, 25 bp, Mus musculus
agcagttaagtcaggaaaccaagcg

SEQ ID NO: 192763 - DNA, 25 bp, Mus musculus
agcagttaattgagtgtgttctcag

SEQ ID NO: 192764 - DNA, 25 bp, Mus musculus
agcagttcacgattctcgagcaggt

SEQ ID NO: 192765 - DNA, 25 bp, Mus musculus
agcagttcagggaagaatcggtttc

SEQ ID NO: 192766 - DNA, 25 bp, Mus musculus
agcagttcagtagctatgagccaga

SEQ ID NO: 192767 - DNA, 25 bp, Mus musculus
agcagttccagtcagctgcgggcag

SEQ ID NO: 192768 - DNA, 25 bp, Mus musculus
agcagttcgcagaacagaaactgga

SEQ ID NO: 192769 - DNA, 25 bp, Mus musculus
agcagttcttcaccagcccagagaa

SEQ ID NO: 192770 - DNA, 25 bp, Mus musculus
agcagttgaaaggagaggatgctta

SEQ ID NO: 192771 - DNA, 25 bp, Mus musculus
agcagttgaccccaggccctgcagg

SEQ ID NO: 192772 - DNA, 25 bp, Mus musculus
agcagttgagaatcccagctggcta

SEQ ID NO: 192773 - DNA, 25 bp, Mus musculus
agcagttgcaaggactggaccagtt

SEQ ID NO: 192774 - DNA, 25 bp, Mus musculus
agcagttgcaaggtaacctccgtgc

SEQ ID NO: 192775 - DNA, 25 bp, Mus musculus
agcagttgcaggaatctcagcaaat

SEQ ID NO: 192776 - DNA, 25 bp, Mus musculus
agcagttggggaccagagttggcct

SEQ ID NO: 192777 - DNA, 25 bp, Mus musculus
agcagttgtttgtctgccaggaact

SEQ ID NO: 192778 - DNA, 25 bp, Mus musculus
agcagtttccggagggactcaaagc

SEQ ID NO: 192779 - DNA, 25 bp, Mus musculus
agcagtttgaaagggtacagtaagc

SEQ ID NO: 192780 - DNA, 25 bp, Mus musculus
agcagttttaaaagcaagtctgcgt

SEQ ID NO: 192781 - DNA, 25 bp, Mus musculus
agcagttttaaaagcctggctccgt

SEQ ID NO: 192782 - DNA, 25 bp, Mus musculus
agcagttttaaaagtccagccattt

SEQ ID NO: 192783 - DNA, 25 bp, Mus musculus
agcagttttgaattacctgaagacc

SEQ ID NO: 192784 - DNA, 25 bp, Mus musculus
agcagttttgttagttttcatggag

SEQ ID NO: 192785 - DNA, 25 bp, Mus musculus
agcataaaagaatgatgccagcatg

SEQ ID NO: 192786 - DNA, 25 bp, Mus musculus
agcataaacgatatgtgtcacaaag

SEQ ID NO: 192787 - DNA, 25 bp, Mus musculus
agcataaagaaggaatcacccactt

SEQ ID NO: 192788 - DNA, 25 bp, Mus musculus
agcataaagatagatgtgctaacga

SEQ ID NO: 192789 - DNA, 25 bp, Mus musculus
agcataaaggaacatgcctctggac

SEQ ID NO: 192790 - DNA, 25 bp, Mus musculus
agcataactcaggtccaaaggccaa

SEQ ID NO: 192791 - DNA, 25 bp, Mus musculus
agcataagaggcggtgactccatac

SEQ ID NO: 192792 - DNA, 25 bp, Mus musculus
agcataaggccaaggtttcctttgc

SEQ ID NO: 192793 - DNA, 25 bp, Mus musculus
agcataaggtataaggcttgctctt

SEQ ID NO: 192794 - DNA, 25 bp, Mus musculus
agcataatattacgcaacatatgaa

SEQ ID NO: 192795 - DNA, 25 bp, Mus musculus
agcataattcagaaaatcagaaaat

SEQ ID NO: 192796 - DNA, 25 bp, Mus musculus
agcatacaagacgagaaggacatag

SEQ ID NO: 192797 - DNA, 25 bp, Mus musculus
agcatacaagggagactctggagga

SEQ ID NO: 192798 - DNA, 25 bp, Mus musculus
agcatacaaggtcaacatggccatg

SEQ ID NO: 192799 - DNA, 25 bp, Mus musculus
agcatacaagtcctcaagggccctc

SEQ ID NO: 192800 - DNA, 25 bp, Mus musculus
agcatactcagcgagagaagcggga

SEQ ID NO: 192801 - DNA, 25 bp, Mus musculus
agcatactgttgagcctgagaaatg

SEQ ID NO: 192802 - DNA, 25 bp, Mus musculus
agcatagagggactcatgggccgcg

SEQ ID NO: 192803 - DNA, 25 bp, Mus musculus
agcatagcgggtttggcttgtgcta

SEQ ID NO: 192804 - DNA, 25 bp, Mus musculus
agcataggacattttccttcccgtc

SEQ ID NO: 192805 - DNA, 25 bp, Mus musculus
agcatagtgaagggcgagcttcaca

SEQ ID NO: 192806 - DNA, 25 bp, Mus musculus
agcatataaaatagaaatgtgaatc

SEQ ID NO: 192807 - DNA, 25 bp, Mus musculus
agcatataacaggaacggtcatcaa

SEQ ID NO: 192808 - DNA, 25 bp, Mus musculus
agcatataacaggaatttctcttgg

SEQ ID NO: 192809 - DNA, 25 bp, Mus musculus
agcatataaggagaagtgcccggct

SEQ ID NO: 192810 - DNA, 25 bp, Mus musculus
agcatataaggagcttttcatcctt

SEQ ID NO: 192811 - DNA, 25 bp, Mus musculus
agcatataattcattttgaccagcc

SEQ ID NO: 192812 - DNA, 25 bp, Mus musculus
agcatataggcatagactactttta

SEQ ID NO: 192813 - DNA, 25 bp, Mus musculus
agcatatgctgatcctgggcataac

SEQ ID NO: 192814 - DNA, 25 bp, Mus musculus
agcatatggaaaatgattcaaggcc

SEQ ID NO: 192815 - DNA, 25 bp, Mus musculus
agcatatggaaaatggtgttgctgt

SEQ ID NO: 192816 - DNA, 25 bp, Mus musculus
agcatatggaaaatgtttcaacctg

SEQ ID NO: 192817 - DNA, 25 bp, Mus musculus
agcatattcaaaaaggtatctggag

SEQ ID NO: 192818 - DNA, 25 bp, Mus musculus
agcatattcaaaaagtatgtttcat

SEQ ID NO: 192819 - DNA, 25 bp, Mus musculus
agcatattccagatgttctgatggc

SEQ ID NO: 192820 - DNA, 25 bp, Mus musculus
agcatcaaacaatttgtcgtcctac

SEQ ID NO: 192821 - DNA, 25 bp, Mus musculus
agcatcaaacatggaggaatcgtct

SEQ ID NO: 192822 - DNA, 25 bp, Mus musculus
agcatcaaagatcttcaggatttat

SEQ ID NO: 192823 - DNA, 25 bp, Mus musculus
agcatcaaagcctgctcccagtgac

SEQ ID NO: 192824 - DNA, 25 bp, Mus musculus
agcatcaaaggccagaaacatcaga

SEQ ID NO: 192825 - DNA, 25 bp, Mus musculus
agcatcaacccactgggtggctttg

SEQ ID NO: 192826 - DNA, 25 bp, Mus musculus
agcatcaatctgcagaagcggcctc

SEQ ID NO: 192827 - DNA, 25 bp, Mus musculus
agcatcacaggaggcacctcaccag

SEQ ID NO: 192828 - DNA, 25 bp, Mus musculus
agcatcaccagcagtgcccggggtc

SEQ ID NO: 192829 - DNA, 25 bp, Mus musculus
agcatcactcaaggagaagctgtgt

SEQ ID NO: 192830 - DNA, 25 bp, Mus musculus
agcatcagaaaggcaacatgtcggc

SEQ ID NO: 192831 - DNA, 25 bp, Mus musculus
agcatcagcaaggtactgccctttc

SEQ ID NO: 192832 - DNA, 25 bp, Mus musculus
agcatcagcgggcaaatcatttagc

SEQ ID NO: 192833 - DNA, 25 bp, Mus musculus
agcatcaggactctcaggtaaatgc

SEQ ID NO: 192834 - DNA, 25 bp, Mus musculus
agcatcaggtctccttcccttgaac

SEQ ID NO: 192835 - DNA, 25 bp, Mus musculus
agcatcatacagaccagagggatta

SEQ ID NO: 192836 - DNA, 25 bp, Mus musculus
agcatcatattgaacgagaaaaaga

SEQ ID NO: 192837 - DNA, 25 bp, Mus musculus
agcatcatcataaatgttaaaattc

SEQ ID NO: 192838 - DNA, 25 bp, Mus musculus
agcatcatctaccctgaggagaatg

SEQ ID NO: 192839 - DNA, 25 bp, Mus musculus
agcatcatgatatccgagtggtgaa

SEQ ID NO: 192840 - DNA, 25 bp, Mus musculus
agcatcatgctgagcacttttgtgt

SEQ ID NO: 192841 - DNA, 25 bp, Mus musculus
agcatcatttaatggtcaggggagt

SEQ ID NO: 192842 - DNA, 25 bp, Mus musculus
agcatccacgcacatgaggaagcag

SEQ ID NO: 192843 - DNA, 25 bp, Mus musculus
agcatccagcagaggaaaggagagt

SEQ ID NO: 192844 - DNA, 25 bp, Mus musculus
agcatccagcagaggtgcagttaaa

SEQ ID NO: 192845 - DNA, 25 bp, Mus musculus
agcatccagggtgagtgtccatgtg

SEQ ID NO: 192846 - DNA, 25 bp, Mus musculus
agcatccagtgttgcctgtgcctgg

SEQ ID NO: 192847 - DNA, 25 bp, Mus musculus
agcatcccagaggaattcaagggct

SEQ ID NO: 192848 - DNA, 25 bp, Mus musculus
agcatcccaggctgcgagacaaaac

SEQ ID NO: 192849 - DNA, 25 bp, Mus musculus
agcatcccctaggacccccactcag

SEQ ID NO: 192850 - DNA, 25 bp, Mus musculus
agcatcccctagggagctccgggag

SEQ ID NO: 192851 - DNA, 25 bp, Mus musculus
agcatcccgagatgacacgaattta

SEQ ID NO: 192852 - DNA, 25 bp, Mus musculus
agcatcccgaggtgtttacaattga

SEQ ID NO: 192853 - DNA, 25 bp, Mus musculus
agcatccgccacgccgtctgggtac

SEQ ID NO: 192854 - DNA, 25 bp, Mus musculus
agcatccgtgaggtatttgaatatc

SEQ ID NO: 192855 - DNA, 25 bp, Mus musculus
agcatcctcagctctgggccccaga

SEQ ID NO: 192856 - DNA, 25 bp, Mus musculus
agcatcctccaagaggcggagtcgc

SEQ ID NO: 192857 - DNA, 25 bp, Mus musculus
agcatcctctaccacacccgtgacc

SEQ ID NO: 192858 - DNA, 25 bp, Mus musculus
agcatcctctctgaggtgaccccta

SEQ ID NO: 192859 - DNA, 25 bp, Mus musculus
agcatcctgagcgcgagaactttca

SEQ ID NO: 192860 - DNA, 25 bp, Mus musculus
agcatcctgccagccaggagacaca

SEQ ID NO: 192861 - DNA, 25 bp, Mus musculus
agcatcctgccgtggtgaaggcatt

SEQ ID NO: 192862 - DNA, 25 bp, Mus musculus
agcatcctggtccagggctaagtct

SEQ ID NO: 192863 - DNA, 25 bp, Mus musculus
agcatccttgcagctggccagcttc

SEQ ID NO: 192864 - DNA, 25 bp, Mus musculus
agcatcgagctggaatacgtctaca

SEQ ID NO: 192865 - DNA, 25 bp, Mus musculus
agcatcgatttgactttattgacta

SEQ ID NO: 192866 - DNA, 25 bp, Mus musculus
agcatcgcaaggaaactcattttca

SEQ ID NO: 192867 - DNA, 25 bp, Mus musculus
agcatcgcaaggcctctgcaggtgt

SEQ ID NO: 192868 - DNA, 25 bp, Mus musculus
agcatcgcaagggtactggcggagg

SEQ ID NO: 192869 - DNA, 25 bp, Mus musculus
agcatcgccgaaaagaaatggaaga

SEQ ID NO: 192870 - DNA, 25 bp, Mus musculus
agcatcggaaccatggctagcctct

SEQ ID NO: 192871 - DNA, 25 bp, Mus musculus
agcatcggaaccatgtgaaaccttc

SEQ ID NO: 192872 - DNA, 25 bp, Mus musculus
agcatcggcaggacagcagcgctct

SEQ ID NO: 192873 - DNA, 25 bp, Mus musculus
agcatcggggacaagggtgacaagg

SEQ ID NO: 192874 - DNA, 25 bp, Mus musculus
agcatcggtggcggaagctggaatg

SEQ ID NO: 192875 - DNA, 25 bp, Mus musculus
agcatcgtcaagagccgcctgcacc

SEQ ID NO: 192876 - DNA, 25 bp, Mus musculus
agcatcgtcagacagcacatcgtca

SEQ ID NO: 192877 - DNA, 25 bp, Mus musculus
agcatcgtcagacagctacagcaca

SEQ ID NO: 192878 - DNA, 25 bp, Mus musculus
agcatcgtgggagggaatagccaga

SEQ ID NO: 192879 - DNA, 25 bp, Mus musculus
agcatctacgacaggctcatcagcg

SEQ ID NO: 192880 - DNA, 25 bp, Mus musculus
agcatctacttacggctggcccgct

SEQ ID NO: 192881 - DNA, 25 bp, Mus musculus
agcatctacttcagctgcgtgcaga

SEQ ID NO: 192882 - DNA, 25 bp, Mus musculus
agcatctaggaggctttgatgaggc

SEQ ID NO: 192883 - DNA, 25 bp, Mus musculus
agcatctagtaatgacaagccctca

SEQ ID NO: 192884 - DNA, 25 bp, Mus musculus
agcatctatagcctggctcggttct

SEQ ID NO: 192885 - DNA, 25 bp, Mus musculus
agcatctatcaagggagcaccatca

SEQ ID NO: 192886 - DNA, 25 bp, Mus musculus
agcatctcaagaacactcaccagtc

SEQ ID NO: 192887 - DNA, 25 bp, Mus musculus
agcatctcaagcaaaacgaagagat

SEQ ID NO: 192888 - DNA, 25 bp, Mus musculus
agcatctcaagcccaagcagtagct

SEQ ID NO: 192889 - DNA, 25 bp, Mus musculus
agcatctcagctgcctttggcaacc

SEQ ID NO: 192890 - DNA, 25 bp, Mus musculus
agcatctctcggattgggctatccc

SEQ ID NO: 192891 - DNA, 25 bp, Mus musculus
agcatctgacattgagattcttttc

SEQ ID NO: 192892 - DNA, 25 bp, Mus musculus
agcatctgagagcaaccaggacctg

SEQ ID NO: 192893 - DNA, 25 bp, Mus musculus
agcatctgagaggtggactctgtgc

SEQ ID NO: 192894 - DNA, 25 bp, Mus musculus
agcatctgaggaacaagcaatggca

SEQ ID NO: 192895 - DNA, 25 bp, Mus musculus
agcatctgaggaagactcttcaatc

SEQ ID NO: 192896 - DNA, 25 bp, Mus musculus
agcatctgatgatggtcgggtgaga

SEQ ID NO: 192897 - DNA, 25 bp, Mus musculus
agcatctgccaacagacccagtgtt

SEQ ID NO: 192898 - DNA, 25 bp, Mus musculus
agcatctgccaacaggaatgggtag

SEQ ID NO: 192899 - DNA, 25 bp, Mus musculus
agcatctgggaagaagccaccatgg

SEQ ID NO: 192900 - DNA, 25 bp, Mus musculus
agcatctgtaatagcaggatgctgg

SEQ ID NO: 192901 - DNA, 25 bp, Mus musculus
agcatctgtaataggtgtgtgctga

SEQ ID NO: 192902 - DNA, 25 bp, Mus musculus
agcatctgtgcagggtgatagcaca

SEQ ID NO: 192903 - DNA, 25 bp, Mus musculus
agcatctgttgaattgtggaacaag

SEQ ID NO: 192904 - DNA, 25 bp, Mus musculus
agcatctgttgacttgactgaaaac

SEQ ID NO: 192905 - DNA, 25 bp, Mus musculus
agcatctgttgggccagagggcatc

SEQ ID NO: 192906 - DNA, 25 bp, Mus musculus
agcatcttatctctgtgtgtgccga

SEQ ID NO: 192907 - DNA, 25 bp, Mus musculus
agcatcttccagtcaaaagaatcct

SEQ ID NO: 192908 - DNA, 25 bp, Mus musculus
agcatcttcggcttcagtgtgtgat

SEQ ID NO: 192909 - DNA, 25 bp, Mus musculus
agcatcttctggtaaatccatttct

SEQ ID NO: 192910 - DNA, 25 bp, Mus musculus
agcatcttgacaagacagaggaggg

SEQ ID NO: 192911 - DNA, 25 bp, Mus musculus
agcatcttgctcctgcactggtgca

SEQ ID NO: 192912 - DNA, 25 bp, Mus musculus
agcatctttcatgataaaggtgatc

SEQ ID NO: 192913 - DNA, 25 bp, Mus musculus
agcatgaaactcgactccagggaag

SEQ ID NO: 192914 - DNA, 25 bp, Mus musculus
agcatgaaagatcagacctgtcgcc

SEQ ID NO: 192915 - DNA, 25 bp, Mus musculus
agcatgaaaggacgtccacgtctgg

SEQ ID NO: 192916 - DNA, 25 bp, Mus musculus
agcatgaaaggatcttctacctgct

SEQ ID NO: 192917 - DNA, 25 bp, Mus musculus
agcatgaacgggtgtgactctcttt

SEQ ID NO: 192918 - DNA, 25 bp, Mus musculus
agcatgaagaaaggctacagcagga

SEQ ID NO: 192919 - DNA, 25 bp, Mus musculus
agcatgaagaagcctccaggactga

SEQ ID NO: 192920 - DNA, 25 bp, Mus musculus
agcatgaatcttcaggggctggctg

SEQ ID NO: 192921 - DNA, 25 bp, Mus musculus
agcatgacaccatgcctgctgacaa

SEQ ID NO: 192922 - DNA, 25 bp, Mus musculus
agcatgactgtgtgtccattgtcca

SEQ ID NO: 192923 - DNA, 25 bp, Mus musculus
agcatgagacacacgcgcttgttct

SEQ ID NO: 192924 - DNA, 25 bp, Mus musculus
agcatgagagctggattgtcattgc

SEQ ID NO: 192925 - DNA, 25 bp, Mus musculus
agcatgagaggaaccatttgtaacc

SEQ ID NO: 192926 - DNA, 25 bp, Mus musculus
agcatgagcaggctactgccctgtg

SEQ ID NO: 192927 - DNA, 25 bp, Mus musculus
agcatgagttctgaatgtgatgttg

SEQ ID NO: 192928 - DNA, 25 bp, Mus musculus
agcatgatgcagaggccaagaagat

SEQ ID NO: 192929 - DNA, 25 bp, Mus musculus
agcatgatgttcaaacacttcgaca

SEQ ID NO: 192930 - DNA, 25 bp, Mus musculus
agcatgcacaggaaaagttattgat

SEQ ID NO: 192931 - DNA, 25 bp, Mus musculus
agcatgcactaggaggaatttggct

SEQ ID NO: 192932 - DNA, 25 bp, Mus musculus
agcatgcagaacagtcacagcggag

SEQ ID NO: 192933 - DNA, 25 bp, Mus musculus
agcatgcagagacagatttgatcaa

SEQ ID NO: 192934 - DNA, 25 bp, Mus musculus
agcatgcagcaatgttgctttgtgt

SEQ ID NO: 192935 - DNA, 25 bp, Mus musculus
agcatgcagcacccaatgatgatca

SEQ ID NO: 192936 - DNA, 25 bp, Mus musculus
agcatgcagcgactggctctggtcc

SEQ ID NO: 192937 - DNA, 25 bp, Mus musculus
agcatgcagggctttcagataaact

SEQ ID NO: 192938 - DNA, 25 bp, Mus musculus
agcatgcagggtaagcgcaaagcac

SEQ ID NO: 192939 - DNA, 25 bp, Mus musculus
agcatgcagtattagtgctacagcc

SEQ ID NO: 192940 - DNA, 25 bp, Mus musculus
agcatgccaaggaggagtcagacac

SEQ ID NO: 192941 - DNA, 25 bp, Mus musculus
agcatgccaaggaggtgagacggaa

SEQ ID NO: 192942 - DNA, 25 bp, Mus musculus
agcatgccaggcaagaaaaggaaca

SEQ ID NO: 192943 - DNA, 25 bp, Mus musculus
agcatgccatcactggccgagctct

SEQ ID NO: 192944 - DNA, 25 bp, Mus musculus
agcatgccctgggagacggggttga

SEQ ID NO: 192945 - DNA, 25 bp, Mus musculus
agcatgccgagatggcacgttttgt

SEQ ID NO: 192946 - DNA, 25 bp, Mus musculus
agcatgcgcaggtggtggagctggt

SEQ ID NO: 192947 - DNA, 25 bp, Mus musculus
agcatgctgccagggcaccagcgtc

SEQ ID NO: 192948 - DNA, 25 bp, Mus musculus
agcatgcttctgcccaggtgagagg

SEQ ID NO: 192949 - DNA, 25 bp, Mus musculus
agcatgctttcatgagcatgttttt

SEQ ID NO: 192950 - DNA, 25 bp, Mus musculus
agcatggaaaaccgtggacttgcac

SEQ ID NO: 192951 - DNA, 25 bp, Mus musculus
agcatggaactaagctctggggtct

SEQ ID NO: 192952 - DNA, 25 bp, Mus musculus
agcatggaagaaaaagagagagaga

SEQ ID NO: 192953 - DNA, 25 bp, Mus musculus
agcatggaaggatttagacaagagt

SEQ ID NO: 192954 - DNA, 25 bp, Mus musculus
agcatggaaggtggaaaaaacccac

SEQ ID NO: 192955 - DNA, 25 bp, Mus musculus
agcatggaagtgtgattttaaaaat

SEQ ID NO: 192956 - DNA, 25 bp, Mus musculus
agcatggaagtgttctgtacctcac

SEQ ID NO: 192957 - DNA, 25 bp, Mus musculus
agcatggaccatggtggagtttggg

SEQ ID NO: 192958 - DNA, 25 bp, Mus musculus
agcatggatgagttggcagagttgg

SEQ ID NO: 192959 - DNA, 25 bp, Mus musculus
agcatggcagaggctcctcttccag

SEQ ID NO: 192960 - DNA, 25 bp, Mus musculus
agcatggcagatgaaccggacaaaa

SEQ ID NO: 192961 - DNA, 25 bp, Mus musculus
agcatggccgaccgcattccagagg

SEQ ID NO: 192962 - DNA, 25 bp, Mus musculus
agcatggcctcagaagctcgaagcg

SEQ ID NO: 192963 - DNA, 25 bp, Mus musculus
agcatggctcaggaattttattgag

SEQ ID NO: 192964 - DNA, 25 bp, Mus musculus
agcatggctcaggcaagtcttctgg

SEQ ID NO: 192965 - DNA, 25 bp, Mus musculus
agcatggcttaaacgccataaccca

SEQ ID NO: 192966 - DNA, 25 bp, Mus musculus
agcatgggaagcaaatgaagaagca

SEQ ID NO: 192967 - DNA, 25 bp, Mus musculus
agcatgggagagttgcagcttcata

SEQ ID NO: 192968 - DNA, 25 bp, Mus musculus
agcatgggaggaagggagatataaa

SEQ ID NO: 192969 - DNA, 25 bp, Mus musculus
agcatgggtcaggttttctactatt

SEQ ID NO: 192970 - DNA, 25 bp, Mus musculus
agcatggtgaacgcttctagggacc

SEQ ID NO: 192971 - DNA, 25 bp, Mus musculus
agcatggtgaacgggacctattaaa

SEQ ID NO: 192972 - DNA, 25 bp, Mus musculus
agcatgtaagctctggcttctcctt

SEQ ID NO: 192973 - DNA, 25 bp, Mus musculus
agcatgtatccagaggatgttgggc

SEQ ID NO: 192974 - DNA, 25 bp, Mus musculus
agcatgtccagctgcccgagagatt

SEQ ID NO: 192975 - DNA, 25 bp, Mus musculus
agcatgtcggctaccttgagaggca

SEQ ID NO: 192976 - DNA, 25 bp, Mus musculus
agcatgtctgacctgtcaaactggg

SEQ ID NO: 192977 - DNA, 25 bp, Mus musculus
agcatgtgaaagactggaagaagcg

SEQ ID NO: 192978 - DNA, 25 bp, Mus musculus
agcatgtgaaagccctctcaccagc

SEQ ID NO: 192979 - DNA, 25 bp, Mus musculus
agcatgtggggccaggtgtcctgtc

SEQ ID NO: 192980 - DNA, 25 bp, Mus musculus
agcatgtggtcaaggacttaatggg

SEQ ID NO: 192981 - DNA, 25 bp, Mus musculus
agcatgtggtcaaggttcttgcaga

SEQ ID NO: 192982 - DNA, 25 bp, Mus musculus
agcatgtgtaggacccagccacctc

SEQ ID NO: 192983 - DNA, 25 bp, Mus musculus
agcatgtgtcatctttccaaagaac

SEQ ID NO: 192984 - DNA, 25 bp, Mus musculus
agcatgtgtccatcctgtcctcagc

SEQ ID NO: 192985 - DNA, 25 bp, Mus musculus
agcatgtgtggctgacctgatcgcc

SEQ ID NO: 192986 - DNA, 25 bp, Mus musculus
agcatgttgtccggcattggaagaa

SEQ ID NO: 192987 - DNA, 25 bp, Mus musculus
agcattaaatgccaaacacactggc

SEQ ID NO: 192988 - DNA, 25 bp, Mus musculus
agcattaaatgccaatccttcccag

SEQ ID NO: 192989 - DNA, 25 bp, Mus musculus
agcattaacaggagaagggaagaaa

SEQ ID NO: 192990 - DNA, 25 bp, Mus musculus
agcattacaaggaggtgcccctgaa

SEQ ID NO: 192991 - DNA, 25 bp, Mus musculus
agcattacaggaagggtctgcttgg

SEQ ID NO: 192992 - DNA, 25 bp, Mus musculus
agcattacaggaaggtgtcagacaa

SEQ ID NO: 192993 - DNA, 25 bp, Mus musculus
agcattacctggttcataagccaga

SEQ ID NO: 192994 - DNA, 25 bp, Mus musculus
agcattactcagagaaagctgatgg

SEQ ID NO: 192995 - DNA, 25 bp, Mus musculus
agcattactcagagagagccgcagg

SEQ ID NO: 192996 - DNA, 25 bp, Mus musculus
agcattagaagtcttcccagagttt

SEQ ID NO: 192997 - DNA, 25 bp, Mus musculus
agcattagaggagctgaccaaggcc

SEQ ID NO: 192998 - DNA, 25 bp, Mus musculus
agcattagatatgactgaaatggca

SEQ ID NO: 192999 - DNA, 25 bp, Mus musculus
agcattagatgaagaattcatccta

SEQ ID NO: 193000 - DNA, 25 bp, Mus musculus
agcattagcagcattcacagctctg

SEQ ID NO: 193001 - DNA, 25 bp, Mus musculus
agcattagcagggttggtttccccc

SEQ ID NO: 193002 - DNA, 25 bp, Mus musculus
agcattatgtctggatctcttagag

SEQ ID NO: 193003 - DNA, 25 bp, Mus musculus
agcattcagaagatgacttacaaga

SEQ ID NO: 193004 - DNA, 25 bp, Mus musculus
agcattcagacaagattttcgaaaa

SEQ ID NO: 193005 - DNA, 25 bp, Mus musculus
agcattccccaatggtccatttact

SEQ ID NO: 193006 - DNA, 25 bp, Mus musculus
agcattctccattccatttctgggc

SEQ ID NO: 193007 - DNA, 25 bp, Mus musculus
agcattctcctggtgcagatcactg

SEQ ID NO: 193008 - DNA, 25 bp, Mus musculus
agcattctgcaagtgggtgggacca

SEQ ID NO: 193009 - DNA, 25 bp, Mus musculus
agcattctggctgcagcagtgaagg

SEQ ID NO: 193010 - DNA, 25 bp, Mus musculus
agcattctgggggtcaaccggatgc

SEQ ID NO: 193011 - DNA, 25 bp, Mus musculus
agcattcttaatttaccgagagaaa

SEQ ID NO: 193012 - DNA, 25 bp, Mus musculus
agcattgacataggctcgttcaggc

SEQ ID NO: 193013 - DNA, 25 bp, Mus musculus
agcattgacatagggaacgtctagc

SEQ ID NO: 193014 - DNA, 25 bp, Mus musculus
agcattgagcagttggtaagtggag

SEQ ID NO: 193015 - DNA, 25 bp, Mus musculus
agcattgatagacagatcctacttc

SEQ ID NO: 193016 - DNA, 25 bp, Mus musculus
agcattgatgggaagaaccagcaag

SEQ ID NO: 193017 - DNA, 25 bp, Mus musculus
agcattgattaatggaccacagacc

SEQ ID NO: 193018 - DNA, 25 bp, Mus musculus
agcattgcaggaagaattctttcat

SEQ ID NO: 193019 - DNA, 25 bp, Mus musculus
agcattgcccaggtgcactggagtg

SEQ ID NO: 193020 - DNA, 25 bp, Mus musculus
agcattgctgagcagatgggccgca

SEQ ID NO: 193021 - DNA, 25 bp, Mus musculus
agcattgctgaggttgaaaatgagg

SEQ ID NO: 193022 - DNA, 25 bp, Mus musculus
agcattgctgcggtgacagaggcct

SEQ ID NO: 193023 - DNA, 25 bp, Mus musculus
agcattgctgtctctgaaaaatgaa

SEQ ID NO: 193024 - DNA, 25 bp, Mus musculus
agcattgcttacaagattccgggct

SEQ ID NO: 193025 - DNA, 25 bp, Mus musculus
agcattgcttacaaggccacagtga

SEQ ID NO: 193026 - DNA, 25 bp, Mus musculus
agcattggaagagtgtatcctcaga

SEQ ID NO: 193027 - DNA, 25 bp, Mus musculus
agcattggatcttctgcgtgctggt

SEQ ID NO: 193028 - DNA, 25 bp, Mus musculus
agcattggatcttttgggatgactg

SEQ ID NO: 193029 - DNA, 25 bp, Mus musculus
agcattggcgtcccccatccacctg

SEQ ID NO: 193030 - DNA, 25 bp, Mus musculus
agcattggtctcatctgccatggtg

SEQ ID NO: 193031 - DNA, 25 bp, Mus musculus
agcattggtctcatctgtctgcaat

SEQ ID NO: 193032 - DNA, 25 bp, Mus musculus
agcattggtgatgttatctatgcgg

SEQ ID NO: 193033 - DNA, 25 bp, Mus musculus
agcattgtacagaggcctatggatt

SEQ ID NO: 193034 - DNA, 25 bp, Mus musculus
agcattgtacagagggatgaaatgc

SEQ ID NO: 193035 - DNA, 25 bp, Mus musculus
agcattgtaggagcagtttctccac

SEQ ID NO: 193036 - DNA, 25 bp, Mus musculus
agcattgtccaggagcgccccttgt

SEQ ID NO: 193037 - DNA, 25 bp, Mus musculus
agcattgtgaaagctcgtccctgcc

SEQ ID NO: 193038 - DNA, 25 bp, Mus musculus
agcattgtgaaagggcagcggagcc

SEQ ID NO: 193039 - DNA, 25 bp, Mus musculus
agcattgtgagagctgtggaacgac

SEQ ID NO: 193040 - DNA, 25 bp, Mus musculus
agcattgtgagagtgaaaagctttt

SEQ ID NO: 193041 - DNA, 25 bp, Mus musculus
agcatttaatgcctcctgcctgtcc

SEQ ID NO: 193042 - DNA, 25 bp, Mus musculus
agcatttacacccagcaatcccagg

SEQ ID NO: 193043 - DNA, 25 bp, Mus musculus
agcatttagaatgcacaaaacaact

SEQ ID NO: 193044 - DNA, 25 bp, Mus musculus
agcatttcaagacccactccctctc

SEQ ID NO: 193045 - DNA, 25 bp, Mus musculus
agcatttcaaggagaaatacccaga

SEQ ID NO: 193046 - DNA, 25 bp, Mus musculus
agcatttcaagggtctcatataccc

SEQ ID NO: 193047 - DNA, 25 bp, Mus musculus
agcatttcaatacgcgctaccctga

SEQ ID NO: 193048 - DNA, 25 bp, Mus musculus
agcatttcacagctattgtccaggg

SEQ ID NO: 193049 - DNA, 25 bp, Mus musculus
agcatttcagcagagactaaaggag

SEQ ID NO: 193050 - DNA, 25 bp, Mus musculus
agcatttcaggatggaaccgcgcca

SEQ ID NO: 193051 - DNA, 25 bp, Mus musculus
agcatttcctcacaacaaacaattg

SEQ ID NO: 193052 - DNA, 25 bp, Mus musculus
agcatttcctcacctccatctgcta

SEQ ID NO: 193053 - DNA, 25 bp, Mus musculus
agcatttctcaaaaactgttctgca

SEQ ID NO: 193054 - DNA, 25 bp, Mus musculus
agcatttctcaaatcatctgaaaag

SEQ ID NO: 193055 - DNA, 25 bp, Mus musculus
agcatttctcttgtgatgaggagac

SEQ ID NO: 193056 - DNA, 25 bp, Mus musculus
agcatttctcttgtgctgccacagg

SEQ ID NO: 193057 - DNA, 25 bp, Mus musculus
agcatttgagacagttccgacgaga

SEQ ID NO: 193058 - DNA, 25 bp, Mus musculus
agcatttgattaaagcaccgtgaag

SEQ ID NO: 193059 - DNA, 25 bp, Mus musculus
agcatttggaggagtatagaacatt

SEQ ID NO: 193060 - DNA, 25 bp, Mus musculus
agcatttggcagagagcactcccca

SEQ ID NO: 193061 - DNA, 25 bp, Mus musculus
agcatttgtcctgggaacagaaatt

SEQ ID NO: 193062 - DNA, 25 bp, Mus musculus
agcattttctagaaaatggaactat

SEQ ID NO: 193063 - DNA, 25 bp, Mus musculus
agcattttctagatggaagctctat

SEQ ID NO: 193064 - DNA, 25 bp, Mus musculus
agcattttctggggaatgaattcca

SEQ ID NO: 193065 - DNA, 25 bp, Mus musculus
agcattttcttggggctccagcctt

SEQ ID NO: 193066 - DNA, 25 bp, Mus musculus
agcattttgagaaagcaattgagct

SEQ ID NO: 193067 - DNA, 25 bp, Mus musculus
agcattttgaggttttctctgtgta

SEQ ID NO: 193068 - DNA, 25 bp, Mus musculus
agcatttttcaggtcacctgccctg

SEQ ID NO: 193069 - DNA, 25 bp, Mus musculus
agcatttttcagtccaaagaatcat

SEQ ID NO: 193070 - DNA, 25 bp, Mus musculus
agccaaaaagaagaagcacttaaag

SEQ ID NO: 193071 - DNA, 25 bp, Mus musculus
agccaaaaagagcaagaagcggaac

SEQ ID NO: 193072 - DNA, 25 bp, Mus musculus
agccaaaaccctgaggccacaagaa

SEQ ID NO: 193073 - DNA, 25 bp, Mus musculus
agccaaaaccctgctatcttccaga

SEQ ID NO: 193074 - DNA, 25 bp, Mus musculus
agccaaaatgggctccgggcctttg

SEQ ID NO: 193075 - DNA, 25 bp, Mus musculus
agccaaaatgggttttatggaagac

SEQ ID NO: 193076 - DNA, 25 bp, Mus musculus
agccaaacagcccatcacggtgcac

SEQ ID NO: 193077 - DNA, 25 bp, Mus musculus
agccaaacatgatactggatgatgg

SEQ ID NO: 193078 - DNA, 25 bp, Mus musculus
agccaaactaggaaatgccgcttgg

SEQ ID NO: 193079 - DNA, 25 bp, Mus musculus
agccaaactgctcaggaataaagct

SEQ ID NO: 193080 - DNA, 25 bp, Mus musculus
agccaaagaaggctcggcgcatccc

SEQ ID NO: 193081 - DNA, 25 bp, Mus musculus
agccaaagaagtatccgagttccag

SEQ ID NO: 193082 - DNA, 25 bp, Mus musculus
agccaaagaccttgagttgctggaa

SEQ ID NO: 193083 - DNA, 25 bp, Mus musculus
agccaaagcgagaagactgagaaaa

SEQ ID NO: 193084 - DNA, 25 bp, Mus musculus
agccaaagctgaatcgcggctggag

SEQ ID NO: 193085 - DNA, 25 bp, Mus musculus
agccaaagctgagagacacagaagg

SEQ ID NO: 193086 - DNA, 25 bp, Mus musculus
agccaaaggctatagggtcggtgat

SEQ ID NO: 193087 - DNA, 25 bp, Mus musculus
agccaaaggtgtgtgccaaaaccac

SEQ ID NO: 193088 - DNA, 25 bp, Mus musculus
agccaaatccccagtgaatggaact

SEQ ID NO: 193089 - DNA, 25 bp, Mus musculus
agccaacaaatgcctcaaggagaag

SEQ ID NO: 193090 - DNA, 25 bp, Mus musculus
agccaacaagatgtcatggcacccc

SEQ ID NO: 193091 - DNA, 25 bp, Mus musculus
agccaacaaggacaaagtcggtgtg

SEQ ID NO: 193092 - DNA, 25 bp, Mus musculus
agccaacacagcagcaccataggtt

SEQ ID NO: 193093 - DNA, 25 bp, Mus musculus
agccaacacagcaggtcatcaccat

SEQ ID NO: 193094 - DNA, 25 bp, Mus musculus
agccaacagatgaagaaacaactgg

SEQ ID NO: 193095 - DNA, 25 bp, Mus musculus
agccaacaggaatgatccaagcagc

SEQ ID NO: 193096 - DNA, 25 bp, Mus musculus
agccaacatcaaagtgtgctccctt

SEQ ID NO: 193097 - DNA, 25 bp, Mus musculus
agccaacatcaatgtgtgctccctt

SEQ ID NO: 193098 - DNA, 25 bp, Mus musculus
agccaacatggtcgtgaaaatacat

SEQ ID NO: 193099 - DNA, 25 bp, Mus musculus
agccaaccagacatgccatgtcgga

SEQ ID NO: 193100 - DNA, 25 bp, Mus musculus
agccaaccagatacccataatatct

SEQ ID NO: 193101 - DNA, 25 bp, Mus musculus
agccaaccagcggaaatgtgagcgt

SEQ ID NO: 193102 - DNA, 25 bp, Mus musculus
agccaacccagatcaggcgtcagaa

SEQ ID NO: 193103 - DNA, 25 bp, Mus musculus
agccaacgggattggtcgcctggtt

SEQ ID NO: 193104 - DNA, 25 bp, Mus musculus
agccaactctcctctgctaagtatg

SEQ ID NO: 193105 - DNA, 25 bp, Mus musculus
agccaagaagaccaccaagttttta

SEQ ID NO: 193106 - DNA, 25 bp, Mus musculus
agccaagaaggccagcaccctgcgg

SEQ ID NO: 193107 - DNA, 25 bp, Mus musculus
agccaagaaggtaaggcgagttcct

SEQ ID NO: 193108 - DNA, 25 bp, Mus musculus
agccaagaagtcagactgtgttgtc

SEQ ID NO: 193109 - DNA, 25 bp, Mus musculus
agccaagaagtcaggacaaaagact

SEQ ID NO: 193110 - DNA, 25 bp, Mus musculus
agccaagagacagaggctgcttggt

SEQ ID NO: 193111 - DNA, 25 bp, Mus musculus
agccaagagaggtcactatggtgct

SEQ ID NO: 193112 - DNA, 25 bp, Mus musculus
agccaagagagttctgttggctcat

SEQ ID NO: 193113 - DNA, 25 bp, Mus musculus
agccaagagtgagagtggatcatga

SEQ ID NO: 193114 - DNA, 25 bp, Mus musculus
agccaagcaggacagagaagaaggt

SEQ ID NO: 193115 - DNA, 25 bp, Mus musculus
agccaagcatccaaatatccagggt

SEQ ID NO: 193116 - DNA, 25 bp, Mus musculus
agccaagcatccagaaggacattcc

SEQ ID NO: 193117 - DNA, 25 bp, Mus musculus
agccaagcccatgtaaaacagacta

SEQ ID NO: 193118 - DNA, 25 bp, Mus musculus
agccaagccgcaggcatgaggtgaa

SEQ ID NO: 193119 - DNA, 25 bp, Mus musculus
agccaagccgctgcccagactacag

SEQ ID NO: 193120 - DNA, 25 bp, Mus musculus
agccaagctcagagtgcctgctcac

SEQ ID NO: 193121 - DNA, 25 bp, Mus musculus
agccaagctggagaaattttcctcg

SEQ ID NO: 193122 - DNA, 25 bp, Mus musculus
agccaagctgtgcggatgccgggag

SEQ ID NO: 193123 - DNA, 25 bp, Mus musculus
agccaaggaaaggtaccgagcttat

SEQ ID NO: 193124 - DNA, 25 bp, Mus musculus
agccaaggaagccaattaaaatgct

SEQ ID NO: 193125 - DNA, 25 bp, Mus musculus
agccaaggaaggagggtctctaatc

SEQ ID NO: 193126 - DNA, 25 bp, Mus musculus
agccaaggacaagaaacatctttct

SEQ ID NO: 193127 - DNA, 25 bp, Mus musculus
agccaaggacaagagtttcttggat

SEQ ID NO: 193128 - DNA, 25 bp, Mus musculus
agccaaggacaggctgagggtatcg

SEQ ID NO: 193129 - DNA, 25 bp, Mus musculus
agccaaggagaacagcatgttgttt

SEQ ID NO: 193130 - DNA, 25 bp, Mus musculus
agccaaggagatcgttgtccaactc

SEQ ID NO: 193131 - DNA, 25 bp, Mus musculus
agccaaggatccagacttggagaag

SEQ ID NO: 193132 - DNA, 25 bp, Mus musculus
agccaaggcaggatggaaccgcgcc

SEQ ID NO: 193133 - DNA, 25 bp, Mus musculus
agccaaggcatgagacactgcccca

SEQ ID NO: 193134 - DNA, 25 bp, Mus musculus
agccaaggcatggtcttttccctag

SEQ ID NO: 193135 - DNA, 25 bp, Mus musculus
agccaaggcttaggcatcgtcttca

SEQ ID NO: 193136 - DNA, 25 bp, Mus musculus
agccaagggcaggcatcagaaacac

SEQ ID NO: 193137 - DNA, 25 bp, Mus musculus
agccaaggtcgtccaatgccgagac

SEQ ID NO: 193138 - DNA, 25 bp, Mus musculus
agccaaggtcgtccagctgaagaac

SEQ ID NO: 193139 - DNA, 25 bp, Mus musculus
agccaaggtcgtccatgctggagtt

SEQ ID NO: 193140 - DNA, 25 bp, Mus musculus
agccaagtaccacagggagtccccc

SEQ ID NO: 193141 - DNA, 25 bp, Mus musculus
agccaagtggaccattgacctgaag

SEQ ID NO: 193142 - DNA, 25 bp, Mus musculus
agccaagtggaccccacagagcaga

SEQ ID NO: 193143 - DNA, 25 bp, Mus musculus
agccaagttcaaatgagacatccta

SEQ ID NO: 193144 - DNA, 25 bp, Mus musculus
agccaagttcaagagagcaggcaag

SEQ ID NO: 193145 - DNA, 25 bp, Mus musculus
agccaagttcaagcggtatgaatat

SEQ ID NO: 193146 - DNA, 25 bp, Mus musculus
agccaatagtaggaattccaggcag

SEQ ID NO: 193147 - DNA, 25 bp, Mus musculus
agccaatatctatctactactctga

SEQ ID NO: 193148 - DNA, 25 bp, Mus musculus
agccaatatgaatatgtatgtgttt

SEQ ID NO: 193149 - DNA, 25 bp, Mus musculus
agccaatcagataattctgaaataa

SEQ ID NO: 193150 - DNA, 25 bp, Mus musculus
agccaatctgccaagagacaaacag

SEQ ID NO: 193151 - DNA, 25 bp, Mus musculus
agccaatctgccaagtggtccagtg

SEQ ID NO: 193152 - DNA, 25 bp, Mus musculus
agccaatgagaaagagaaaactgcc

SEQ ID NO: 193153 - DNA, 25 bp, Mus musculus
agccaatgagagaggacacaatgta

SEQ ID NO: 193154 - DNA, 25 bp, Mus musculus
agccaatgatcatgaagaagatttt

SEQ ID NO: 193155 - DNA, 25 bp, Mus musculus
agccaatgatttatctgttttctta

SEQ ID NO: 193156 - DNA, 25 bp, Mus musculus
agccaatgccaacgccacgccttct

SEQ ID NO: 193157 - DNA, 25 bp, Mus musculus
agccaatgctgagagcaactgtggg

SEQ ID NO: 193158 - DNA, 25 bp, Mus musculus
agccaatgctgaggatgcccaagaa

SEQ ID NO: 193159 - DNA, 25 bp, Mus musculus
agccaattacagaatctgggagcag

SEQ ID NO: 193160 - DNA, 25 bp, Mus musculus
agccaattctcccacacagatctgg

SEQ ID NO: 193161 - DNA, 25 bp, Mus musculus
agccaattgcctgtgatggtgtgga

SEQ ID NO: 193162 - DNA, 25 bp, Mus musculus
agccacaacaccaaactttaagaag

SEQ ID NO: 193163 - DNA, 25 bp, Mus musculus
agccacaagagataagatgaaagat

SEQ ID NO: 193164 - DNA, 25 bp, Mus musculus
agccacaagccaagaaagctcgctt

SEQ ID NO: 193165 - DNA, 25 bp, Mus musculus
agccacaagccaaggacctctaatt

SEQ ID NO: 193166 - DNA, 25 bp, Mus musculus
agccacacagagccagacctagaag

SEQ ID NO: 193167 - DNA, 25 bp, Mus musculus
agccacacaggttcctttggtttca

SEQ ID NO: 193168 - DNA, 25 bp, Mus musculus
agccacaccacccagactatgaaat

SEQ ID NO: 193169 - DNA, 25 bp, Mus musculus
agccacaccggacggtgggattgtg

SEQ ID NO: 193170 - DNA, 25 bp, Mus musculus
agccacaccggacgtgggaagctgc

SEQ ID NO: 193171 - DNA, 25 bp, Mus musculus
agccacactcaccaggcacttgtgg

SEQ ID NO: 193172 - DNA, 25 bp, Mus musculus
agccacactcagggcaggaggacct

SEQ ID NO: 193173 - DNA, 25 bp, Mus musculus
agccacactcagggcgcttattcgg

SEQ ID NO: 193174 - DNA, 25 bp, Mus musculus
agccacagaacagagggggaagaaa

SEQ ID NO: 193175 - DNA, 25 bp, Mus musculus
agccacagaagaggccagatatcac

SEQ ID NO: 193176 - DNA, 25 bp, Mus musculus
agccacagagtgagagaatagaacc

SEQ ID NO: 193177 - DNA, 25 bp, Mus musculus
agccacagagtgagttactagagcc

SEQ ID NO: 193178 - DNA, 25 bp, Mus musculus
agccacagcagaaagctggtttatt

SEQ ID NO: 193179 - DNA, 25 bp, Mus musculus
agccacagcagcagcgcaacgaagt

SEQ ID NO: 193180 - DNA, 25 bp, Mus musculus
agccacagccaggatatccctgtga

SEQ ID NO: 193181 - DNA, 25 bp, Mus musculus
agccacagcccgccggtggcagctg

SEQ ID NO: 193182 - DNA, 25 bp, Mus musculus
agccacagccgcgaccatagtctgt

SEQ ID NO: 193183 - DNA, 25 bp, Mus musculus
agccacagccgcgcctggtgcagcc

SEQ ID NO: 193184 - DNA, 25 bp, Mus musculus
agccacaggatgaaataacagttac

SEQ ID NO: 193185 - DNA, 25 bp, Mus musculus
agccacaggatgatggcagtgaaat

SEQ ID NO: 193186 - DNA, 25 bp, Mus musculus
agccacagtttcttggtctggaata

SEQ ID NO: 193187 - DNA, 25 bp, Mus musculus
agccacatcagagagtgtccaggtt

SEQ ID NO: 193188 - DNA, 25 bp, Mus musculus
agccacatcgcaaggggctccacgg

SEQ ID NO: 193189 - DNA, 25 bp, Mus musculus
agccacatttgccaaaaagcagggc

SEQ ID NO: 193190 - DNA, 25 bp, Mus musculus
agccaccaaaaaggaatcactgggc

SEQ ID NO: 193191 - DNA, 25 bp, Mus musculus
agccaccaaagcgatgttaaagaag

SEQ ID NO: 193192 - DNA, 25 bp, Mus musculus
agccaccaaaggagtaacctatctt

SEQ ID NO: 193193 - DNA, 25 bp, Mus musculus
agccaccaaaggttacagagaatat

SEQ ID NO: 193194 - DNA, 25 bp, Mus musculus
agccaccaagatcctgagacatttt

SEQ ID NO: 193195 - DNA, 25 bp, Mus musculus
agccaccaaggacggaattaaagcc

SEQ ID NO: 193196 - DNA, 25 bp, Mus musculus
agccaccaaggtgacagcttcctct

SEQ ID NO: 193197 - DNA, 25 bp, Mus musculus
agccaccaagtgctgagggttatcc

SEQ ID NO: 193198 - DNA, 25 bp, Mus musculus
agccaccaatcaaagcaagctcatg

SEQ ID NO: 193199 - DNA, 25 bp, Mus musculus
agccaccaatgtcaggttgaaaact

SEQ ID NO: 193200 - DNA, 25 bp, Mus musculus
agccaccaatgtcagtgtgcgggat

SEQ ID NO: 193201 - DNA, 25 bp, Mus musculus
agccaccaccacctcctcgccctca

SEQ ID NO: 193202 - DNA, 25 bp, Mus musculus
agccaccagagagctgtgcctgaga

SEQ ID NO: 193203 - DNA, 25 bp, Mus musculus
agccaccagaggatgacagaggagt

SEQ ID NO: 193204 - DNA, 25 bp, Mus musculus
agccaccagaggtgatccaacagta

SEQ ID NO: 193205 - DNA, 25 bp, Mus musculus
agccaccccagacccaagaatcttt

SEQ ID NO: 193206 - DNA, 25 bp, Mus musculus
agccaccccgaggtcaggacgacca

SEQ ID NO: 193207 - DNA, 25 bp, Mus musculus
agccaccctccagggatacggacag

SEQ ID NO: 193208 - DNA, 25 bp, Mus musculus
agccaccgaacacagtgaggatgcc

SEQ ID NO: 193209 - DNA, 25 bp, Mus musculus
agccaccgacaaggtacaaccacgt

SEQ ID NO: 193210 - DNA, 25 bp, Mus musculus
agccaccgagactccagacctcgac

SEQ ID NO: 193211 - DNA, 25 bp, Mus musculus
agccaccgagccgtcaagctgaacc

SEQ ID NO: 193212 - DNA, 25 bp, Mus musculus
agccacctaaggtgacaaaagaact

SEQ ID NO: 193213 - DNA, 25 bp, Mus musculus
agccacctattgacccaaggatgtg

SEQ ID NO: 193214 - DNA, 25 bp, Mus musculus
agccacctcaggatggtagagcact

SEQ ID NO: 193215 - DNA, 25 bp, Mus musculus
agccacctccagtcgcagatatggc

SEQ ID NO: 193216 - DNA, 25 bp, Mus musculus
agccacctctaaaggaggaagatga

SEQ ID NO: 193217 - DNA, 25 bp, Mus musculus
agccacctgagcctgctgctccagc

SEQ ID NO: 193218 - DNA, 25 bp, Mus musculus
agccaccttcagaatgaagaggaat

SEQ ID NO: 193219 - DNA, 25 bp, Mus musculus
agccaccttcagtgattttataggt

SEQ ID NO: 193220 - DNA, 25 bp, Mus musculus
agccaccttcggcactgcagtaact

SEQ ID NO: 193221 - DNA, 25 bp, Mus musculus
agccaccttgtgtgtggaatgtcat

SEQ ID NO: 193222 - DNA, 25 bp, Mus musculus
agccacgagaggtgagggagtttaa

SEQ ID NO: 193223 - DNA, 25 bp, Mus musculus
agccacgatgagtgaacagagtatc

SEQ ID NO: 193224 - DNA, 25 bp, Mus musculus
agccacgatgtgtggaaattctctg

SEQ ID NO: 193225 - DNA, 25 bp, Mus musculus
agccacgctatggacgcactgacat

SEQ ID NO: 193226 - DNA, 25 bp, Mus musculus
agccacgctatgggattccaacctc

SEQ ID NO: 193227 - DNA, 25 bp, Mus musculus
agccacggagaggagggagggagcc

SEQ ID NO: 193228 - DNA, 25 bp, Mus musculus
agccacggatggaggaggagacaac

SEQ ID NO: 193229 - DNA, 25 bp, Mus musculus
agccactagacggttcttcatgaga

SEQ ID NO: 193230 - DNA, 25 bp, Mus musculus
agccactcacgacggctccagggaa

SEQ ID NO: 193231 - DNA, 25 bp, Mus musculus
agccactcagaacccctggcctcct

SEQ ID NO: 193232 - DNA, 25 bp, Mus musculus
agccactcagtacccctggcctcct

SEQ ID NO: 193233 - DNA, 25 bp, Mus musculus
agccactccagctcccggcaacttc

SEQ ID NO: 193234 - DNA, 25 bp, Mus musculus
agccactccctctggctctctcaaa

SEQ ID NO: 193235 - DNA, 25 bp, Mus musculus
agccactctagcagtgttccgaatg

SEQ ID NO: 193236 - DNA, 25 bp, Mus musculus
agccactctcagagttttgtacact

SEQ ID NO: 193237 - DNA, 25 bp, Mus musculus
agccactctgggaggagcctgagtt

SEQ ID NO: 193238 - DNA, 25 bp, Mus musculus
agccactgaaagactcgccagtgat

SEQ ID NO: 193239 - DNA, 25 bp, Mus musculus
agccactgaagactgagataccaga

SEQ ID NO: 193240 - DNA, 25 bp, Mus musculus
agccactgacggaccagagtgaggg

SEQ ID NO: 193241 - DNA, 25 bp, Mus musculus
agccactgacgtggacgacaacctg

SEQ ID NO: 193242 - DNA, 25 bp, Mus musculus
agccactgatgcttctctgcgaggg

SEQ ID NO: 193243 - DNA, 25 bp, Mus musculus
agccactgcaaggggagcagcgcgg

SEQ ID NO: 193244 - DNA, 25 bp, Mus musculus
agccactgcgtctcttggcctgtgg

SEQ ID NO: 193245 - DNA, 25 bp, Mus musculus
agccactggagaggaactgtccgac

SEQ ID NO: 193246 - DNA, 25 bp, Mus musculus
agccactggagcagggtcggtgatg

SEQ ID NO: 193247 - DNA, 25 bp, Mus musculus
agccactgtaccaaggcagctcagg

SEQ ID NO: 193248 - DNA, 25 bp, Mus musculus
agccactgtaccaagtgcagctcag

SEQ ID NO: 193249 - DNA, 25 bp, Mus musculus
agccactgtcagaagagaaaactgc

SEQ ID NO: 193250 - DNA, 25 bp, Mus musculus
agccactgtcagagctaaacagaaa

SEQ ID NO: 193251 - DNA, 25 bp, Mus musculus
agccactgtggccaggtccttcatt

SEQ ID NO: 193252 - DNA, 25 bp, Mus musculus
agccacttactacaatttctgaagt

SEQ ID NO: 193253 - DNA, 25 bp, Mus musculus
agccacttctcaggcctacagggtg

SEQ ID NO: 193254 - DNA, 25 bp, Mus musculus
agccactttccaaggaatttgaagc

SEQ ID NO: 193255 - DNA, 25 bp, Mus musculus
agccactttgggaggggggatcgca

SEQ ID NO: 193256 - DNA, 25 bp, Mus musculus
agccagaaaaaaaatcagttcgagg

SEQ ID NO: 193257 - DNA, 25 bp, Mus musculus
agccagaaaagagctggactacaga

SEQ ID NO: 193258 - DNA, 25 bp, Mus musculus
agccagaaaatcactgtgagccttg

SEQ ID NO: 193259 - DNA, 25 bp, Mus musculus
agccagaaacatgtaggcctcattc

SEQ ID NO: 193260 - DNA, 25 bp, Mus musculus
agccagaaaggtccacaccagtcac

SEQ ID NO: 193261 - DNA, 25 bp, Mus musculus
agccagaaagtttcaggccatccat

SEQ ID NO: 193262 - DNA, 25 bp, Mus musculus
agccagaaatggggctggtgtcatt

SEQ ID NO: 193263 - DNA, 25 bp, Mus musculus
agccagaaattggggttgatcgcct

SEQ ID NO: 193264 - DNA, 25 bp, Mus musculus
agccagaacagcaccgggttgtagt

SEQ ID NO: 193265 - DNA, 25 bp, Mus musculus
agccagaacccagctaacagagaag

SEQ ID NO: 193266 - DNA, 25 bp, Mus musculus
agccagaacccgattcatcagtggg

SEQ ID NO: 193267 - DNA, 25 bp, Mus musculus
agccagaacccgcctagtgatgagg

SEQ ID NO: 193268 - DNA, 25 bp, Mus musculus
agccagaacccgtcttttcatctca

SEQ ID NO: 193269 - DNA, 25 bp, Mus musculus
agccagaagagatcctcagctctct

SEQ ID NO: 193270 - DNA, 25 bp, Mus musculus
agccagaagagccatggcgagtgcc

SEQ ID NO: 193271 - DNA, 25 bp, Mus musculus
agccagaagcaaacgatggaggctc

SEQ ID NO: 193272 - DNA, 25 bp, Mus musculus
agccagaagcaaagggtgtgagttc

SEQ ID NO: 193273 - DNA, 25 bp, Mus musculus
agccagaatacaatattggccagcc

SEQ ID NO: 193274 - DNA, 25 bp, Mus musculus
agccagacagagtccggccacaaga

SEQ ID NO: 193275 - DNA, 25 bp, Mus musculus
agccagacagccccaggatcctctg

SEQ ID NO: 193276 - DNA, 25 bp, Mus musculus
agccagacagggttgccatacccca

SEQ ID NO: 193277 - DNA, 25 bp, Mus musculus
agccagaccaggatcaagttactgg

SEQ ID NO: 193278 - DNA, 25 bp, Mus musculus
agccagaccagttccaagaattacc

SEQ ID NO: 193279 - DNA, 25 bp, Mus musculus
agccagaccgagatgccttggatga

SEQ ID NO: 193280 - DNA, 25 bp, Mus musculus
agccagaccgaggatcaaccattcc

SEQ ID NO: 193281 - DNA, 25 bp, Mus musculus
agccagaccgcggcgggcaggaaga

SEQ ID NO: 193282 - DNA, 25 bp, Mus musculus
agccagaccgcgggcagcgtggaca

SEQ ID NO: 193283 - DNA, 25 bp, Mus musculus
agccagagaaggaaaaggaaacaca

SEQ ID NO: 193284 - DNA, 25 bp, Mus musculus
agccagagaagtgtgtgacaacttg

SEQ ID NO: 193285 - DNA, 25 bp, Mus musculus
agccagagaccgagggagggagcca

SEQ ID NO: 193286 - DNA, 25 bp, Mus musculus
agccagagagatgggtgtgattgct

SEQ ID NO: 193287 - DNA, 25 bp, Mus musculus
agccagagagccctggcacaaaaac

SEQ ID NO: 193288 - DNA, 25 bp, Mus musculus
agccagagagggtctgcgagcttta

SEQ ID NO: 193289 - DNA, 25 bp, Mus musculus
agccagagagtgctcaacctcacag

SEQ ID NO: 193290 - DNA, 25 bp, Mus musculus
agccagagcaaagtaaagacatttc

SEQ ID NO: 193291 - DNA, 25 bp, Mus musculus
agccagagcaccctggactacattg

SEQ ID NO: 193292 - DNA, 25 bp, Mus musculus
agccagaggcagagtgaagaaatcg

SEQ ID NO: 193293 - DNA, 25 bp, Mus musculus
agccagagggagccgtgtgcccagc

SEQ ID NO: 193294 - DNA, 25 bp, Mus musculus
agccagagggaggcttcagttgtgt

SEQ ID NO: 193295 - DNA, 25 bp, Mus musculus
agccagagtacgggcgtcctagtgt

SEQ ID NO: 193296 - DNA, 25 bp, Mus musculus
agccagagtgagaaggagttgatgt

SEQ ID NO: 193297 - DNA, 25 bp, Mus musculus
agccagagttacaggaacgtcatcc

SEQ ID NO: 193298 - DNA, 25 bp, Mus musculus
agccagataaaggatgccccaggtg

SEQ ID NO: 193299 - DNA, 25 bp, Mus musculus
agccagatcgacagcaaagagccct

SEQ ID NO: 193300 - DNA, 25 bp, Mus musculus
agccagatcgccctacatgaagatc

SEQ ID NO: 193301 - DNA, 25 bp, Mus musculus
agccagatgaacagggagcattggc

SEQ ID NO: 193302 - DNA, 25 bp, Mus musculus
agccagatgaacagttaatgtctga

SEQ ID NO: 193303 - DNA, 25 bp, Mus musculus
agccagcaagaaaccgaagaaaaca

SEQ ID NO: 193304 - DNA, 25 bp, Mus musculus
agccagcaagggggaagaaaccgat

SEQ ID NO: 193305 - DNA, 25 bp, Mus musculus
agccagcaagtggatctggcgagtg

SEQ ID NO: 193306 - DNA, 25 bp, Mus musculus
agccagcacaaacaggccaaactca

SEQ ID NO: 193307 - DNA, 25 bp, Mus musculus
agccagcacatctcagccagtgagg

SEQ ID NO: 193308 - DNA, 25 bp, Mus musculus
agccagcaccagcactgccccccaa

SEQ ID NO: 193309 - DNA, 25 bp, Mus musculus
agccagcacgctcaggaacaagaat

SEQ ID NO: 193310 - DNA, 25 bp, Mus musculus
agccagcagaaaccacagatgacat

SEQ ID NO: 193311 - DNA, 25 bp, Mus musculus
agccagcagagaagagtccagacag

SEQ ID NO: 193312 - DNA, 25 bp, Mus musculus
agccagcagagaaggtgacagaagg

SEQ ID NO: 193313 - DNA, 25 bp, Mus musculus
agccagcagcagatcccagagtccc

SEQ ID NO: 193314 - DNA, 25 bp, Mus musculus
agccagcagcagattttgtggccct

SEQ ID NO: 193315 - DNA, 25 bp, Mus musculus
agccagcagcatggctacaaaatgc

SEQ ID NO: 193316 - DNA, 25 bp, Mus musculus
agccagcagccagaaatctcataag

SEQ ID NO: 193317 - DNA, 25 bp, Mus musculus
agccagcaggcggaggtgcgtggtc

SEQ ID NO: 193318 - DNA, 25 bp, Mus musculus
agccagcatagagggactcatgggc

SEQ ID NO: 193319 - DNA, 25 bp, Mus musculus
agccagcataggtgcaacaagcaac

SEQ ID NO: 193320 - DNA, 25 bp, Mus musculus
agccagcatcatgatatccgagtgg

SEQ ID NO: 193321 - DNA, 25 bp, Mus musculus
agccagcatgaatcagctgcccgag

SEQ ID NO: 193322 - DNA, 25 bp, Mus musculus
agccagcatgccttcctgggcgcag

SEQ ID NO: 193323 - DNA, 25 bp, Mus musculus
agccagcatgctcgtcaaggtgagg

SEQ ID NO: 193324 - DNA, 25 bp, Mus musculus
agccagccacaggcccaggccttgt

SEQ ID NO: 193325 - DNA, 25 bp, Mus musculus
agccagccagagaaagaagtggcgg

SEQ ID NO: 193326 - DNA, 25 bp, Mus musculus
agccagccagccagggtcccaaagg

SEQ ID NO: 193327 - DNA, 25 bp, Mus musculus
agccagccagctttcagctggccgc

SEQ ID NO: 193328 - DNA, 25 bp, Mus musculus
agccagccaggcctgtccaccatca

SEQ ID NO: 193329 - DNA, 25 bp, Mus musculus
agccagccagggtcccaaaggccgc

SEQ ID NO: 193330 - DNA, 25 bp, Mus musculus
agccagcccaaccatgctgctgaac

SEQ ID NO: 193331 - DNA, 25 bp, Mus musculus
agccagcccaggtgcatacacagac

SEQ ID NO: 193332 - DNA, 25 bp, Mus musculus
agccagcccaggttttacttggggt

SEQ ID NO: 193333 - DNA, 25 bp, Mus musculus
agccagccgaccaggaactaggaag

SEQ ID NO: 193334 - DNA, 25 bp, Mus musculus
agccagccgaccgaggatttggagt

SEQ ID NO: 193335 - DNA, 25 bp, Mus musculus
agccagcctattcttttacttttgg

SEQ ID NO: 193336 - DNA, 25 bp, Mus musculus
agccagcctcccaggtccacttgaa

SEQ ID NO: 193337 - DNA, 25 bp, Mus musculus
agccagcctcctgggtgttctcttc

SEQ ID NO: 193338 - DNA, 25 bp, Mus musculus
agccagcctcctgggttggctgcaa

SEQ ID NO: 193339 - DNA, 25 bp, Mus musculus
agccagcctgagcgagccagaggaa

SEQ ID NO: 193340 - DNA, 25 bp, Mus musculus
agccagcctggagaggtccatatcc

SEQ ID NO: 193341 - DNA, 25 bp, Mus musculus
agccagcctggagccatcgtggctg

SEQ ID NO: 193342 - DNA, 25 bp, Mus musculus
agccagcctggcgacccagtggaat

SEQ ID NO: 193343 - DNA, 25 bp, Mus musculus
agccagcctgtccagcaccatggct

SEQ ID NO: 193344 - DNA, 25 bp, Mus musculus
agccagcgtagaagatccaggtgct

SEQ ID NO: 193345 - DNA, 25 bp, Mus musculus
agccagcgtggggaaacctgctcgg

SEQ ID NO: 193346 - DNA, 25 bp, Mus musculus
agccagcgtggggtctgagatccca

SEQ ID NO: 193347 - DNA, 25 bp, Mus musculus
agccagctaaaggtatgctaacaga

SEQ ID NO: 193348 - DNA, 25 bp, Mus musculus
agccagctacagatgcagactcagc

SEQ ID NO: 193349 - DNA, 25 bp, Mus musculus
agccagctcgctgagcctgttcctg

SEQ ID NO: 193350 - DNA, 25 bp, Mus musculus
agccagctctcaccgagcgcagcct

SEQ ID NO: 193351 - DNA, 25 bp, Mus musculus
agccagctgacgctgagagggcctt

SEQ ID NO: 193352 - DNA, 25 bp, Mus musculus
agccagctgcctgagggtacaagtt

SEQ ID NO: 193353 - DNA, 25 bp, Mus musculus
agccagctgctgagaacccaatatg

SEQ ID NO: 193354 - DNA, 25 bp, Mus musculus
agccagctggctttttctaaaagcc

SEQ ID NO: 193355 - DNA, 25 bp, Mus musculus
agccagctgggagggcgtggagctg

SEQ ID NO: 193356 - DNA, 25 bp, Mus musculus
agccagcttcagattcccaggaaaa

SEQ ID NO: 193357 - DNA, 25 bp, Mus musculus
agccagcttggtctgacagaagttg

SEQ ID NO: 193358 - DNA, 25 bp, Mus musculus
agccaggaaaataagcaaaaattcc

SEQ ID NO: 193359 - DNA, 25 bp, Mus musculus
agccaggaaaataaggtgttttcac

SEQ ID NO: 193360 - DNA, 25 bp, Mus musculus
agccaggaaaataagttctgaaaat

SEQ ID NO: 193361 - DNA, 25 bp, Mus musculus
agccaggaacctctcagtcaacagc

SEQ ID NO: 193362 - DNA, 25 bp, Mus musculus
agccaggaacttctcagccagccac

SEQ ID NO: 193363 - DNA, 25 bp, Mus musculus
agccaggaagaaaggaaaatcagag

SEQ ID NO: 193364 - DNA, 25 bp, Mus musculus
agccaggaatgccatttatgtcgtg

SEQ ID NO: 193365 - DNA, 25 bp, Mus musculus
agccaggacacagaccgtgctggaa

SEQ ID NO: 193366 - DNA, 25 bp, Mus musculus
agccaggaccaaaggagccaaacca

SEQ ID NO: 193367 - DNA, 25 bp, Mus musculus
agccaggaccaaagggaccactttc

SEQ ID NO: 193368 - DNA, 25 bp, Mus musculus
agccaggaccactgctctgctgcct

SEQ ID NO: 193369 - DNA, 25 bp, Mus musculus
agccaggaccactggttctacgggt

SEQ ID NO: 193370 - DNA, 25 bp, Mus musculus
agccaggaccaggctttcttgatca

SEQ ID NO: 193371 - DNA, 25 bp, Mus musculus
agccaggagaaggctgctattttga

SEQ ID NO: 193372 - DNA, 25 bp, Mus musculus
agccaggagaatggtccgtctccca

SEQ ID NO: 193373 - DNA, 25 bp, Mus musculus
agccaggagacacgagattccgggg

SEQ ID NO: 193374 - DNA, 25 bp, Mus musculus
agccaggagacacgggacgctgtat

SEQ ID NO: 193375 - DNA, 25 bp, Mus musculus
agccaggagagggctgctattttga

SEQ ID NO: 193376 - DNA, 25 bp, Mus musculus
agccaggagcacagatctgggagcc

SEQ ID NO: 193377 - DNA, 25 bp, Mus musculus
agccaggagcagctggctgcagagc

SEQ ID NO: 193378 - DNA, 25 bp, Mus musculus
agccaggagggacgattctgacgtt

SEQ ID NO: 193379 - DNA, 25 bp, Mus musculus
agccaggatctcttgcctcaatcaa

SEQ ID NO: 193380 - DNA, 25 bp, Mus musculus
agccaggatgcgctcctccgcctct

SEQ ID NO: 193381 - DNA, 25 bp, Mus musculus
agccaggcaggtgcttcagaactgg

SEQ ID NO: 193382 - DNA, 25 bp, Mus musculus
agccaggcagtgaaggaccgtgcag

SEQ ID NO: 193383 - DNA, 25 bp, Mus musculus
agccaggcagtgaaggcccttgctg

SEQ ID NO: 193384 - DNA, 25 bp, Mus musculus
agccaggcatctatgttctgcggtt

SEQ ID NO: 193385 - DNA, 25 bp, Mus musculus
agccaggccaaggcatactttgaga

SEQ ID NO: 193386 - DNA, 25 bp, Mus musculus
agccaggccagcagccctagctagc

SEQ ID NO: 193387 - DNA, 25 bp, Mus musculus
agccaggccagcagcttcaccaatc

SEQ ID NO: 193388 - DNA, 25 bp, Mus musculus
agccaggccccgcaggtcaagacgg

SEQ ID NO: 193389 - DNA, 25 bp, Mus musculus
agccaggcccctagccaccttctag

SEQ ID NO: 193390 - DNA, 25 bp, Mus musculus
agccaggcccttcgggagcagatgg

SEQ ID NO: 193391 - DNA, 25 bp, Mus musculus
agccaggccgcaggcatcaatactt

SEQ ID NO: 193392 - DNA, 25 bp, Mus musculus
agccaggcgcaacctgcgggaggca

SEQ ID NO: 193393 - DNA, 25 bp, Mus musculus
agccaggcgcggcgggatatgtggt

SEQ ID NO: 193394 - DNA, 25 bp, Mus musculus
agccaggcggagcacgccccagaga

SEQ ID NO: 193395 - DNA, 25 bp, Mus musculus
agccaggcgtcccaaaaagcctcta

SEQ ID NO: 193396 - DNA, 25 bp, Mus musculus
agccaggcgtggggccgcagcctcg

SEQ ID NO: 193397 - DNA, 25 bp, Mus musculus
agccaggctgtgctggccagctcag

SEQ ID NO: 193398 - DNA, 25 bp, Mus musculus
agccagggaaaaggtacaactgatg

SEQ ID NO: 193399 - DNA, 25 bp, Mus musculus
agccagggagtgtggtcttctcagt

SEQ ID NO: 193400 - DNA, 25 bp, Mus musculus
agccagggcggttaaactcactttc

SEQ ID NO: 193401 - DNA, 25 bp, Mus musculus
agccaggggcgagagggagctgctg

SEQ ID NO: 193402 - DNA, 25 bp, Mus musculus
agccaggtaagaatctacccagcag

SEQ ID NO: 193403 - DNA, 25 bp, Mus musculus
agccaggtaccaggatttccaattt

SEQ ID NO: 193404 - DNA, 25 bp, Mus musculus
agccaggtaccaggcatacttctcc

SEQ ID NO: 193405 - DNA, 25 bp, Mus musculus
agccaggtacctgatgtgatggtgg

SEQ ID NO: 193406 - DNA, 25 bp, Mus musculus
agccaggtataaaagcttatgcact

SEQ ID NO: 193407 - DNA, 25 bp, Mus musculus
agccaggtgcaccagcgagcctgtc

SEQ ID NO: 193408 - DNA, 25 bp, Mus musculus
agccaggttatacaggacattgccc

SEQ ID NO: 193409 - DNA, 25 bp, Mus musculus
agccagtaaacaaggccagggccat

SEQ ID NO: 193410 - DNA, 25 bp, Mus musculus
agccagtaacagcacccaggcagac

SEQ ID NO: 193411 - DNA, 25 bp, Mus musculus
agccagtaattgggtgctgtacctg

SEQ ID NO: 193412 - DNA, 25 bp, Mus musculus
agccagtatgcaggtgtcactgaac

SEQ ID NO: 193413 - DNA, 25 bp, Mus musculus
agccagtatgcaggttgtccttgtt

SEQ ID NO: 193414 - DNA, 25 bp, Mus musculus
agccagtatttcaggagcctctttc

SEQ ID NO: 193415 - DNA, 25 bp, Mus musculus
agccagtatttcaggcaggcaacct

SEQ ID NO: 193416 - DNA, 25 bp, Mus musculus
agccagtcaatcaggaatgtcaagt

SEQ ID NO: 193417 - DNA, 25 bp, Mus musculus
agccagtcagccaggttcaataagc

SEQ ID NO: 193418 - DNA, 25 bp, Mus musculus
agccagtccaggcgcctctagcagc

SEQ ID NO: 193419 - DNA, 25 bp, Mus musculus
agccagtccccctactgtgacagat

SEQ ID NO: 193420 - DNA, 25 bp, Mus musculus
agccagtctggagttggtgtggacc

SEQ ID NO: 193421 - DNA, 25 bp, Mus musculus
agccagtgcagcctggagatgccca

SEQ ID NO: 193422 - DNA, 25 bp, Mus musculus
agccagtgcaggcaggatctctatc

SEQ ID NO: 193423 - DNA, 25 bp, Mus musculus
agccagtgcaggcgcctcattgtga

SEQ ID NO: 193424 - DNA, 25 bp, Mus musculus
agccagtgcctggggttctgcagct

SEQ ID NO: 193425 - DNA, 25 bp, Mus musculus
agccagtggtggagccttcccatca

SEQ ID NO: 193426 - DNA, 25 bp, Mus musculus
agccagtgtgttaagccaaatttac

SEQ ID NO: 193427 - DNA, 25 bp, Mus musculus
agccagtgtgttaagtattttggaa

SEQ ID NO: 193428 - DNA, 25 bp, Mus musculus
agccagtgtttgaatgaccttcttt

SEQ ID NO: 193429 - DNA, 25 bp, Mus musculus
agccataaagaggaaaccactgaga

SEQ ID NO: 193430 - DNA, 25 bp, Mus musculus
agccataaagaggaaccaggccatt

SEQ ID NO: 193431 - DNA, 25 bp, Mus musculus
agccatacatccggggactgagtgg

SEQ ID NO: 193432 - DNA, 25 bp, Mus musculus
agccataccggcgaacgcccgttcc

SEQ ID NO: 193433 - DNA, 25 bp, Mus musculus
agccatacggacacatgtgctgaag

SEQ ID NO: 193434 - DNA, 25 bp, Mus musculus
agccatacggagtgagcctgtgact

SEQ ID NO: 193435 - DNA, 25 bp, Mus musculus
agccatactatgatccctcaagaac

SEQ ID NO: 193436 - DNA, 25 bp, Mus musculus
agccatagaggtggagtacatgttg

SEQ ID NO: 193437 - DNA, 25 bp, Mus musculus
agccatagtgataagcaccctgtga

SEQ ID NO: 193438 - DNA, 25 bp, Mus musculus
agccatattcagcagatttgtgaaa

SEQ ID NO: 193439 - DNA, 25 bp, Mus musculus
agccatattgccctctgttttctgt

SEQ ID NO: 193440 - DNA, 25 bp, Mus musculus
agccatcaactggaccctcattcat

SEQ ID NO: 193441 - DNA, 25 bp, Mus musculus
agccatcacaggccggatcccagat

SEQ ID NO: 193442 - DNA, 25 bp, Mus musculus
agccatcaccaagcccccgaggcat

SEQ ID NO: 193443 - DNA, 25 bp, Mus musculus
agccatcaccaagtcagaaggtcag

SEQ ID NO: 193444 - DNA, 25 bp, Mus musculus
agccatcacccgaaacaggccacca

SEQ ID NO: 193445 - DNA, 25 bp, Mus musculus
agccatcactctccggatgttggga

SEQ ID NO: 193446 - DNA, 25 bp, Mus musculus
agccatcagacatattggctggatc

SEQ ID NO: 193447 - DNA, 25 bp, Mus musculus
agccatcagagagacatcttctctg

SEQ ID NO: 193448 - DNA, 25 bp, Mus musculus
agccatcaggaagggatgcggtaaa

SEQ ID NO: 193449 - DNA, 25 bp, Mus musculus
agccatcagggaagatacattgtgt

SEQ ID NO: 193450 - DNA, 25 bp, Mus musculus
agccatcagggaagcttccctgttg

SEQ ID NO: 193451 - DNA, 25 bp, Mus musculus
agccatcatcacaggtattccagca

SEQ ID NO: 193452 - DNA, 25 bp, Mus musculus
agccatccaaggatgaggccatcct

SEQ ID NO: 193453 - DNA, 25 bp, Mus musculus
agccatcccaagaccctcctcatcc

SEQ ID NO: 193454 - DNA, 25 bp, Mus musculus
agccatcccagtgatgaatctggct

SEQ ID NO: 193455 - DNA, 25 bp, Mus musculus
agccatcccagtgatggctaccata

SEQ ID NO: 193456 - DNA, 25 bp, Mus musculus
agccatccccagaggattatcacaa

SEQ ID NO: 193457 - DNA, 25 bp, Mus musculus
agccatcccccgcttgaaagatgcc

SEQ ID NO: 193458 - DNA, 25 bp, Mus musculus
agccatcccgagcgagaaatgtctg

SEQ ID NO: 193459 - DNA, 25 bp, Mus musculus
agccatcccgagggagaaatgtctg

SEQ ID NO: 193460 - DNA, 25 bp, Mus musculus
agccatccgggaagggaaactgccc

SEQ ID NO: 193461 - DNA, 25 bp, Mus musculus
agccatccggttgttgccgaataca

SEQ ID NO: 193462 - DNA, 25 bp, Mus musculus
agccatcgatgcagtgaagcctggt

SEQ ID NO: 193463 - DNA, 25 bp, Mus musculus
agccatcggtacagggactgagact

SEQ ID NO: 193464 - DNA, 25 bp, Mus musculus
agccatcgttaaggtcttccatggt

SEQ ID NO: 193465 - DNA, 25 bp, Mus musculus
agccatctaagcccagagtgacctc

SEQ ID NO: 193466 - DNA, 25 bp, Mus musculus
agccatctacttgcaccggaaggaa

SEQ ID NO: 193467 - DNA, 25 bp, Mus musculus
agccatctgggaaagatgtggacga

SEQ ID NO: 193468 - DNA, 25 bp, Mus musculus
agccatctgggaagatgtctgcaat

SEQ ID NO: 193469 - DNA, 25 bp, Mus musculus
agccatctgtactgtgtacagtgct

SEQ ID NO: 193470 - DNA, 25 bp, Mus musculus
agccatctttgaaatgcccatttgg

SEQ ID NO: 193471 - DNA, 25 bp, Mus musculus
agccatctttgatcgggtgctgaca

SEQ ID NO: 193472 - DNA, 25 bp, Mus musculus
agccatctttgatcggtccctctcc

SEQ ID NO: 193473 - DNA, 25 bp, Mus musculus
agccatgaaaggaacagagtgggtg

SEQ ID NO: 193474 - DNA, 25 bp, Mus musculus
agccatgaagcaggtggcaggtacc

SEQ ID NO: 193475 - DNA, 25 bp, Mus musculus
agccatgaagccgaggaaagcagaa

SEQ ID NO: 193476 - DNA, 25 bp, Mus musculus
agccatgaccacagctgttggtctg

SEQ ID NO: 193477 - DNA, 25 bp, Mus musculus
agccatgatgaacagctcatgcgtg

SEQ ID NO: 193478 - DNA, 25 bp, Mus musculus
agccatgatgattgtgggttctgta

SEQ ID NO: 193479 - DNA, 25 bp, Mus musculus
agccatgatggttactaactttcag

SEQ ID NO: 193480 - DNA, 25 bp, Mus musculus
agccatgcattggaatttgaactcc

SEQ ID NO: 193481 - DNA, 25 bp, Mus musculus
agccatgcggcttctccatgatcag

SEQ ID NO: 193482 - DNA, 25 bp, Mus musculus
agccatgctctctggtcttgtgcaa

SEQ ID NO: 193483 - DNA, 25 bp, Mus musculus
agccatgctgagcaagctcatgttg

SEQ ID NO: 193484 - DNA, 25 bp, Mus musculus
agccatgctgcaggtgctgggcccc

SEQ ID NO: 193485 - DNA, 25 bp, Mus musculus
agccatgctggccaagacggaagag

SEQ ID NO: 193486 - DNA, 25 bp, Mus musculus
agccatgctgtcaatcaactgaaag

SEQ ID NO: 193487 - DNA, 25 bp, Mus musculus
agccatgctgtccagagatgggtgg

SEQ ID NO: 193488 - DNA, 25 bp, Mus musculus
agccatggagatggagcagttgacc

SEQ ID NO: 193489 - DNA, 25 bp, Mus musculus
agccatggaggaggctacgcaaggg

SEQ ID NO: 193490 - DNA, 25 bp, Mus musculus
agccatggaggaggggccttcatga

SEQ ID NO: 193491 - DNA, 25 bp, Mus musculus
agccatggtgaaggtgtttagctct

SEQ ID NO: 193492 - DNA, 25 bp, Mus musculus
agccatgtataaagatgtggtgaag

SEQ ID NO: 193493 - DNA, 25 bp, Mus musculus
agccatgtataaagttctagatgtg

SEQ ID NO: 193494 - DNA, 25 bp, Mus musculus
agccatgtctccatgtcttcctcca

SEQ ID NO: 193495 - DNA, 25 bp, Mus musculus
agccattaaagatttcattatgaaa

SEQ ID NO: 193496 - DNA, 25 bp, Mus musculus
agccattacaatgtgagatctgtgg

SEQ ID NO: 193497 - DNA, 25 bp, Mus musculus
agccattactcgcagggcaacaaag

SEQ ID NO: 193498 - DNA, 25 bp, Mus musculus
agccattactcgcagtgagatgagt

SEQ ID NO: 193499 - DNA, 25 bp, Mus musculus
agccattactgctgacctcaggatg

SEQ ID NO: 193500 - DNA, 25 bp, Mus musculus
agccattagagagaggcaggagtac

SEQ ID NO: 193501 - DNA, 25 bp, Mus musculus
agccattcacaagaattggcctaca

SEQ ID NO: 193502 - DNA, 25 bp, Mus musculus
agccattcacaagctaattctgatc

SEQ ID NO: 193503 - DNA, 25 bp, Mus musculus
agccattcagcctttggctacaatg

SEQ ID NO: 193504 - DNA, 25 bp, Mus musculus
agccattcggcaaagatgacagaag

SEQ ID NO: 193505 - DNA, 25 bp, Mus musculus
agccattctaacagcctgcagactg

SEQ ID NO: 193506 - DNA, 25 bp, Mus musculus
agccattctgattggggtactggaa

SEQ ID NO: 193507 - DNA, 25 bp, Mus musculus
agccattgaatatagacctgaaaac

SEQ ID NO: 193508 - DNA, 25 bp, Mus musculus
agccattgctcaaggctgccttaga

SEQ ID NO: 193509 - DNA, 25 bp, Mus musculus
agccattgctgcatgcctgtggtcc

SEQ ID NO: 193510 - DNA, 25 bp, Mus musculus
agccattgcttttgggactcgcttc

SEQ ID NO: 193511 - DNA, 25 bp, Mus musculus
agccattgttcaggctccaggccgg

SEQ ID NO: 193512 - DNA, 25 bp, Mus musculus
agccatttacagggggtgatgtgca

SEQ ID NO: 193513 - DNA, 25 bp, Mus musculus
agccatttacagttgtaacagttgg

SEQ ID NO: 193514 - DNA, 25 bp, Mus musculus
agccatttagaaggtgtgccgatgc

SEQ ID NO: 193515 - DNA, 25 bp, Mus musculus
agccatttttacaaggcatcaagga

SEQ ID NO: 193516 - DNA, 25 bp, Mus musculus
agcccaaaaagatggcacttccaaa

SEQ ID NO: 193517 - DNA, 25 bp, Mus musculus
agcccaaaacagactgagaatgaag

SEQ ID NO: 193518 - DNA, 25 bp, Mus musculus
agcccaaacacacaccagtcatctt

SEQ ID NO: 193519 - DNA, 25 bp, Mus musculus
agcccaaaccaacaggtgtgcccaa

SEQ ID NO: 193520 - DNA, 25 bp, Mus musculus
agcccaaagggggaccaggctctgg

SEQ ID NO: 193521 - DNA, 25 bp, Mus musculus
agcccaaaggtcctctgacactaca

SEQ ID NO: 193522 - DNA, 25 bp, Mus musculus
agcccaaagtcagtcgaaacgttga

SEQ ID NO: 193523 - DNA, 25 bp, Mus musculus
agcccaaagtcagtgaacttctggg

SEQ ID NO: 193524 - DNA, 25 bp, Mus musculus
agcccaacaaaaagttgattcacca

SEQ ID NO: 193525 - DNA, 25 bp, Mus musculus
agcccaacaaccaggtagctaagtg

SEQ ID NO: 193526 - DNA, 25 bp, Mus musculus
agcccaaccatgctgctgaaccgaa

SEQ ID NO: 193527 - DNA, 25 bp, Mus musculus
agcccaacctggctcggaagaggag

SEQ ID NO: 193528 - DNA, 25 bp, Mus musculus
agcccaacgcaaatctggtgcaata

SEQ ID NO: 193529 - DNA, 25 bp, Mus musculus
agcccaacgctagaacatacaacat

SEQ ID NO: 193530 - DNA, 25 bp, Mus musculus
agcccaagaacccaggtggaaagca

SEQ ID NO: 193531 - DNA, 25 bp, Mus musculus
agcccaagaagaaccaagagccgga

SEQ ID NO: 193532 - DNA, 25 bp, Mus musculus
agcccaagaagacgcaaatccagat

SEQ ID NO: 193533 - DNA, 25 bp, Mus musculus
agcccaagatgtctgacagaacagt

SEQ ID NO: 193534 - DNA, 25 bp, Mus musculus
agcccaagatgtctgtatggggaga

SEQ ID NO: 193535 - DNA, 25 bp, Mus musculus
agcccaagcagctggagattcacgt

SEQ ID NO: 193536 - DNA, 25 bp, Mus musculus
agcccaagcgaaccccagctgaaag

SEQ ID NO: 193537 - DNA, 25 bp, Mus musculus
agcccaaggaggctcgaagcaccaa

SEQ ID NO: 193538 - DNA, 25 bp, Mus musculus
agcccaagtatgcaggctgctcgtc

SEQ ID NO: 193539 - DNA, 25 bp, Mus musculus
agcccaagtatgcagtgctcgatga

SEQ ID NO: 193540 - DNA, 25 bp, Mus musculus
agcccaagtggaaagctgcggctgc

SEQ ID NO: 193541 - DNA, 25 bp, Mus musculus
agcccaatgaatccccagcttcaca

SEQ ID NO: 193542 - DNA, 25 bp, Mus musculus
agcccaattccaagagatatgtccg

SEQ ID NO: 193543 - DNA, 25 bp, Mus musculus
agcccacacaggtgatccagcagcc

SEQ ID NO: 193544 - DNA, 25 bp, Mus musculus
agcccacaccaggatgcaggcagcc

SEQ ID NO: 193545 - DNA, 25 bp, Mus musculus
agcccaccacacctgtctcctcctt

SEQ ID NO: 193546 - DNA, 25 bp, Mus musculus
agcccaccaggccatcatgattggc

SEQ ID NO: 193547 - DNA, 25 bp, Mus musculus
agcccaccctgtcagaagcccagag

SEQ ID NO: 193548 - DNA, 25 bp, Mus musculus
agcccaccctgtcaggccttgccag

SEQ ID NO: 193549 - DNA, 25 bp, Mus musculus
agcccacctatccacccatgaaccc

SEQ ID NO: 193550 - DNA, 25 bp, Mus musculus
agcccacctgcaagacagccccgga

SEQ ID NO: 193551 - DNA, 25 bp, Mus musculus
agcccacctgcaagctacagacagc

SEQ ID NO: 193552 - DNA, 25 bp, Mus musculus
agcccacgtgtgcagggtcctgtgg

SEQ ID NO: 193553 - DNA, 25 bp, Mus musculus
agcccactcagtgaatggcattact

SEQ ID NO: 193554 - DNA, 25 bp, Mus musculus
agcccactctggagccccatgtgga

SEQ ID NO: 193555 - DNA, 25 bp, Mus musculus
agcccactcttcagttctgagaaga

SEQ ID NO: 193556 - DNA, 25 bp, Mus musculus
agcccactgccagacccaggcaccc

SEQ ID NO: 193557 - DNA, 25 bp, Mus musculus
agcccactggcctcttcaggtggag

SEQ ID NO: 193558 - DNA, 25 bp, Mus musculus
agcccacttaaactccgaggtgact

SEQ ID NO: 193559 - DNA, 25 bp, Mus musculus
agcccagaaaagcggtttccaactt

SEQ ID NO: 193560 - DNA, 25 bp, Mus musculus
agcccagaaaagcttccgtagtgtg

SEQ ID NO: 193561 - DNA, 25 bp, Mus musculus
agcccagaaagaactagaagaacag

SEQ ID NO: 193562 - DNA, 25 bp, Mus musculus
agcccagaaaggatgtataataaaa

SEQ ID NO: 193563 - DNA, 25 bp, Mus musculus
agcccagaaatgtacggagtttgaa

SEQ ID NO: 193564 - DNA, 25 bp, Mus musculus
agcccagaaattatttggtatgatc

SEQ ID NO: 193565 - DNA, 25 bp, Mus musculus
agcccagaaccaaggcaagaaggga

SEQ ID NO: 193566 - DNA, 25 bp, Mus musculus
agcccagaaccaggccaagaaagga

SEQ ID NO: 193567 - DNA, 25 bp, Mus musculus
agcccagaaccaggcccctaatcaa

SEQ ID NO: 193568 - DNA, 25 bp, Mus musculus
agcccagaactaaagaatgaagtct

SEQ ID NO: 193569 - DNA, 25 bp, Mus musculus
agcccagaagatcgtgattttaaaa

SEQ ID NO: 193570 - DNA, 25 bp, Mus musculus
agcccagaagcacagcaagaaggcc

SEQ ID NO: 193571 - DNA, 25 bp, Mus musculus
agcccagaagccctacccatgtctc

SEQ ID NO: 193572 - DNA, 25 bp, Mus musculus
agcccagaagctgtgattggactgg

SEQ ID NO: 193573 - DNA, 25 bp, Mus musculus
agcccagaaggcgggcaggaagacc

SEQ ID NO: 193574 - DNA, 25 bp, Mus musculus
agcccagaagggtgtgcagattata

SEQ ID NO: 193575 - DNA, 25 bp, Mus musculus
agcccagaagtaccattcccggagc

SEQ ID NO: 193576 - DNA, 25 bp, Mus musculus
agcccagacagagaagagccatgga

SEQ ID NO: 193577 - DNA, 25 bp, Mus musculus
agcccagacccaagaccatttccca

SEQ ID NO: 193578 - DNA, 25 bp, Mus musculus
agcccagacccaagactctccctct

SEQ ID NO: 193579 - DNA, 25 bp, Mus musculus
agcccagaccctgaaggagctgcct

SEQ ID NO: 193580 - DNA, 25 bp, Mus musculus
agcccagacgcacgaagctctttgt

SEQ ID NO: 193581 - DNA, 25 bp, Mus musculus
agcccagagagaggtcatcttccat

SEQ ID NO: 193582 - DNA, 25 bp, Mus musculus
agcccagagagaggtcttttggctg

SEQ ID NO: 193583 - DNA, 25 bp, Mus musculus
agcccagagctagatttgtcaaatc

SEQ ID NO: 193584 - DNA, 25 bp, Mus musculus
agcccagaggcagactcacctcaac

SEQ ID NO: 193585 - DNA, 25 bp, Mus musculus
agcccagaggctcagggtccggacc

SEQ ID NO: 193586 - DNA, 25 bp, Mus musculus
agcccagcaagattctgtgatgagg

SEQ ID NO: 193587 - DNA, 25 bp, Mus musculus
agcccagcaaggaacaccagtgtac

SEQ ID NO: 193588 - DNA, 25 bp, Mus musculus
agcccagcaaggaccgccttcaaca

SEQ ID NO: 193589 - DNA, 25 bp, Mus musculus
agcccagcacacaggaggtctggca

SEQ ID NO: 193590 - DNA, 25 bp, Mus musculus
agcccagcaccgatcggtcagcacc

SEQ ID NO: 193591 - DNA, 25 bp, Mus musculus
agcccagcagatttggcctggcacg

SEQ ID NO: 193592 - DNA, 25 bp, Mus musculus
agcccagcagcgtaaacgaccccgg

SEQ ID NO: 193593 - DNA, 25 bp, Mus musculus
agcccagcagctacattttcttaaa

SEQ ID NO: 193594 - DNA, 25 bp, Mus musculus
agcccagcagctctactgacagtct

SEQ ID NO: 193595 - DNA, 25 bp, Mus musculus
agcccagcaggaagcaacttcttca

SEQ ID NO: 193596 - DNA, 25 bp, Mus musculus
agcccagcaggaggagactgcagtg

SEQ ID NO: 193597 - DNA, 25 bp, Mus musculus
agcccagcaggccagtgtgctttct

SEQ ID NO: 193598 - DNA, 25 bp, Mus musculus
agcccagcagggcagccaatgaagc

SEQ ID NO: 193599 - DNA, 25 bp, Mus musculus
agcccagcagggcatcctggcccag

SEQ ID NO: 193600 - DNA, 25 bp, Mus musculus
agcccagcaggtgaccaaccacttg

SEQ ID NO: 193601 - DNA, 25 bp, Mus musculus
agcccagcagtattcctcctgcttc

SEQ ID NO: 193602 - DNA, 25 bp, Mus musculus
agcccagcccctggttccacaccct

SEQ ID NO: 193603 - DNA, 25 bp, Mus musculus
agcccagcccctgtgccgggagccc

SEQ ID NO: 193604 - DNA, 25 bp, Mus musculus
agcccagccgctatggagatggaaa

SEQ ID NO: 193605 - DNA, 25 bp, Mus musculus
agcccagcctcaagctcccagggct

SEQ ID NO: 193606 - DNA, 25 bp, Mus musculus
agcccagcctcaagggcttgccaac

SEQ ID NO: 193607 - DNA, 25 bp, Mus musculus
agcccagcctcaaggtgagcaaagc

SEQ ID NO: 193608 - DNA, 25 bp, Mus musculus
agcccagcgcgtggcatgaagcact

SEQ ID NO: 193609 - DNA, 25 bp, Mus musculus
agcccagcgcgtgggacgaattcat

SEQ ID NO: 193610 - DNA, 25 bp, Mus musculus
agcccagctagccctcctgtaagta

SEQ ID NO: 193611 - DNA, 25 bp, Mus musculus
agcccagctctggacgctatgctgc

SEQ ID NO: 193612 - DNA, 25 bp, Mus musculus
agcccagctctggggagaatgtact

SEQ ID NO: 193613 - DNA, 25 bp, Mus musculus
agcccaggaccttgctgcaggcacc

SEQ ID NO: 193614 - DNA, 25 bp, Mus musculus
agcccaggagagcaggtcggcagct

SEQ ID NO: 193615 - DNA, 25 bp, Mus musculus
agcccaggatgcggggtaccgaatg

SEQ ID NO: 193616 - DNA, 25 bp, Mus musculus
agcccaggcactcagagaatgggac

SEQ ID NO: 193617 - DNA, 25 bp, Mus musculus
agcccaggcactcagtttttcagtt

SEQ ID NO: 193618 - DNA, 25 bp, Mus musculus
agcccaggccttaaggctgccctgc

SEQ ID NO: 193619 - DNA, 25 bp, Mus musculus
agcccagggaagtggctacagatgt

SEQ ID NO: 193620 - DNA, 25 bp, Mus musculus
agcccaggggttagtgtggagagga

SEQ ID NO: 193621 - DNA, 25 bp, Mus musculus
agcccaggtacaagatcaagtctcc

SEQ ID NO: 193622 - DNA, 25 bp, Mus musculus
agcccaggtccatggtaccaaccaa

SEQ ID NO: 193623 - DNA, 25 bp, Mus musculus
agcccaggtgttcatgaagcctgga

SEQ ID NO: 193624 - DNA, 25 bp, Mus musculus
agcccaggtttaattcagaagtgag

SEQ ID NO: 193625 - DNA, 25 bp, Mus musculus
agcccagtcccgaagatccgcctcc

SEQ ID NO: 193626 - DNA, 25 bp, Mus musculus
agcccagtgaccaatgggaacagtc

SEQ ID NO: 193627 - DNA, 25 bp, Mus musculus
agcccagtgagcacttgcaggtgga

SEQ ID NO: 193628 - DNA, 25 bp, Mus musculus
agcccagtgcaggcctgccaacatc

SEQ ID NO: 193629 - DNA, 25 bp, Mus musculus
agcccagtgcaggcctgccactggt

SEQ ID NO: 193630 - DNA, 25 bp, Mus musculus
agcccagtgcgactgaagcgaaggc

SEQ ID NO: 193631 - DNA, 25 bp, Mus musculus
agcccagtgttctggtacccactgt

SEQ ID NO: 193632 - DNA, 25 bp, Mus musculus
agcccagtgttctggtacgctccgg

SEQ ID NO: 193633 - DNA, 25 bp, Mus musculus
agcccataggcctggtcagaaagag

SEQ ID NO: 193634 - DNA, 25 bp, Mus musculus
agcccatatccatgttccagcccat

SEQ ID NO: 193635 - DNA, 25 bp, Mus musculus
agcccatatgcaactgccccctgag

SEQ ID NO: 193636 - DNA, 25 bp, Mus musculus
agcccatcaccaagaacaagaaaac

SEQ ID NO: 193637 - DNA, 25 bp, Mus musculus
agcccatcagaaaatcaccgtgctg

SEQ ID NO: 193638 - DNA, 25 bp, Mus musculus
agcccatcagaagttttcctgactt

SEQ ID NO: 193639 - DNA, 25 bp, Mus musculus
agcccatcagagagccctctccagg

SEQ ID NO: 193640 - DNA, 25 bp, Mus musculus
agcccatcaggtggttgaagatggc

SEQ ID NO: 193641 - DNA, 25 bp, Mus musculus
agcccatccgctgagttcctgagca

SEQ ID NO: 193642 - DNA, 25 bp, Mus musculus
agcccatctgggcttttctccagag

SEQ ID NO: 193643 - DNA, 25 bp, Mus musculus
agcccatgaagcaagcttgggcaac

SEQ ID NO: 193644 - DNA, 25 bp, Mus musculus
agcccatgagcagatgaacgaattc

SEQ ID NO: 193645 - DNA, 25 bp, Mus musculus
agcccatgagtggaaacaagttgag

SEQ ID NO: 193646 - DNA, 25 bp, Mus musculus
agcccatgatcaccagtgattcagg

SEQ ID NO: 193647 - DNA, 25 bp, Mus musculus
agcccatgatggcggagtgtctgga

SEQ ID NO: 193648 - DNA, 25 bp, Mus musculus
agcccatggaaaagacgaagagagt

SEQ ID NO: 193649 - DNA, 25 bp, Mus musculus
agcccattatctccagcctgctatc

SEQ ID NO: 193650 - DNA, 25 bp, Mus musculus
agcccattcaaccatggatgtgtaa

SEQ ID NO: 193651 - DNA, 25 bp, Mus musculus
agcccattcttaagattcctttgag

SEQ ID NO: 193652 - DNA, 25 bp, Mus musculus
agcccattgatgtcacagctaagct

SEQ ID NO: 193653 - DNA, 25 bp, Mus musculus
agccccaaccagaccgtggacatgc

SEQ ID NO: 193654 - DNA, 25 bp, Mus musculus
agccccaagcaggtgaggaatttta

SEQ ID NO: 193655 - DNA, 25 bp, Mus musculus
agccccaatcaggaaattaccggac

SEQ ID NO: 193656 - DNA, 25 bp, Mus musculus
agccccacaggaaaggaatggagag

SEQ ID NO: 193657 - DNA, 25 bp, Mus musculus
agccccacaggaaagtacctggcca

SEQ ID NO: 193658 - DNA, 25 bp, Mus musculus
agccccacattcaacccatggggcc

SEQ ID NO: 193659 - DNA, 25 bp, Mus musculus
agccccacattcaactccagcgccg

SEQ ID NO: 193660 - DNA, 25 bp, Mus musculus
agccccaccaagctcagtaacaagt

SEQ ID NO: 193661 - DNA, 25 bp, Mus musculus
agccccacctgatgagccaggtctg

SEQ ID NO: 193662 - DNA, 25 bp, Mus musculus
agccccacgccaggattacatcttc

SEQ ID NO: 193663 - DNA, 25 bp, Mus musculus
agccccacgggtctcagaggtgggt

SEQ ID NO: 193664 - DNA, 25 bp, Mus musculus
agccccactagagtgcggccaagga

SEQ ID NO: 193665 - DNA, 25 bp, Mus musculus
agccccactattggcttaagtttgc

SEQ ID NO: 193666 - DNA, 25 bp, Mus musculus
agccccactattggggcatctttca

SEQ ID NO: 193667 - DNA, 25 bp, Mus musculus
agccccactccaggatcttttcccc

SEQ ID NO: 193668 - DNA, 25 bp, Mus musculus
agccccactccaggcacactggcaa

SEQ ID NO: 193669 - DNA, 25 bp, Mus musculus
agccccagaagcagcccactgagtc

SEQ ID NO: 193670 - DNA, 25 bp, Mus musculus
agccccagaagcagtaccccacccc

SEQ ID NO: 193671 - DNA, 25 bp, Mus musculus
agccccagactggtgaatgagagtg

SEQ ID NO: 193672 - DNA, 25 bp, Mus musculus
agccccagagcacagaggacatcat

SEQ ID NO: 193673 - DNA, 25 bp, Mus musculus
agccccagagctgaactcccacctc

SEQ ID NO: 193674 - DNA, 25 bp, Mus musculus
agccccagaggccttcggacagttc

SEQ ID NO: 193675 - DNA, 25 bp, Mus musculus
agccccagaggtctcagcaatctgt

SEQ ID NO: 193676 - DNA, 25 bp, Mus musculus
agccccagagtggtaaacagctgga

SEQ ID NO: 193677 - DNA, 25 bp, Mus musculus
agccccagcgagacagaggcttaca

SEQ ID NO: 193678 - DNA, 25 bp, Mus musculus
agccccagcgagagctagctgagcc

SEQ ID NO: 193679 - DNA, 25 bp, Mus musculus
agccccagcgagtccttcggggagc

SEQ ID NO: 193680 - DNA, 25 bp, Mus musculus
agccccaggagccctcccaggccca

SEQ ID NO: 193681 - DNA, 25 bp, Mus musculus
agccccagggaagaggaacagctca

SEQ ID NO: 193682 - DNA, 25 bp, Mus musculus
agccccagggcaaggattctgtacc

SEQ ID NO: 193683 - DNA, 25 bp, Mus musculus
agccccagggcaaggtggctgcctt

SEQ ID NO: 193684 - DNA, 25 bp, Mus musculus
agccccatgaaagaggcgccagcca

SEQ ID NO: 193685 - DNA, 25 bp, Mus musculus
agccccatgatgatactgaggacag

SEQ ID NO: 193686 - DNA, 25 bp, Mus musculus
agccccatgatgatcgcaaaagatg

SEQ ID NO: 193687 - DNA, 25 bp, Mus musculus
agccccatgatggcttcttttcttc

SEQ ID NO: 193688 - DNA, 25 bp, Mus musculus
agccccatttccctggcaggttcac

SEQ ID NO: 193689 - DNA, 25 bp, Mus musculus
agcccccaaaggttgctttcactac

SEQ ID NO: 193690 - DNA, 25 bp, Mus musculus
agcccccaaccatcaaatcgggaca

SEQ ID NO: 193691 - DNA, 25 bp, Mus musculus
agcccccaagttcctggccttcacc

SEQ ID NO: 193692 - DNA, 25 bp, Mus musculus
agcccccacagctccttcccagctg

SEQ ID NO: 193693 - DNA, 25 bp, Mus musculus
agcccccaccagcttcccttcaggg

SEQ ID NO: 193694 - DNA, 25 bp, Mus musculus
agcccccaccaggcctcggtgtctc

SEQ ID NO: 193695 - DNA, 25 bp, Mus musculus
agcccccacctagatcaagcactgg

SEQ ID NO: 193696 - DNA, 25 bp, Mus musculus
agcccccacctgaagaaaatggaga

SEQ ID NO: 193697 - DNA, 25 bp, Mus musculus
agcccccactatcttgcctcatctc

SEQ ID NO: 193698 - DNA, 25 bp, Mus musculus
agcccccactcactcgcctcgctag

SEQ ID NO: 193699 - DNA, 25 bp, Mus musculus
agcccccactgtccaggtgctgtgg

SEQ ID NO: 193700 - DNA, 25 bp, Mus musculus
agcccccagcccagtgcactaaggg

SEQ ID NO: 193701 - DNA, 25 bp, Mus musculus
agcccccatttgaataagactgtca

SEQ ID NO: 193702 - DNA, 25 bp, Mus musculus
agccccccaactgagggcaggctgg

SEQ ID NO: 193703 - DNA, 25 bp, Mus musculus
agccccccaaggaggagtcaggcct

SEQ ID NO: 193704 - DNA, 25 bp, Mus musculus
agccccccttttctgaatgaagata

SEQ ID NO: 193705 - DNA, 25 bp, Mus musculus
agcccccgcaggataaggaagcctg

SEQ ID NO: 193706 - DNA, 25 bp, Mus musculus
agcccccgcagggagctccgctttg

SEQ ID NO: 193707 - DNA, 25 bp, Mus musculus
agcccccgcaggtgcgcttgagaag

SEQ ID NO: 193708 - DNA, 25 bp, Mus musculus
agcccccggcagtcaggagatggag

SEQ ID NO: 193709 - DNA, 25 bp, Mus musculus
agcccccgtccagacactactttgc

SEQ ID NO: 193710 - DNA, 25 bp, Mus musculus
agccccctagacaggataagacgct

SEQ ID NO: 193711 - DNA, 25 bp, Mus musculus
agccccctcaccagccccggctgca

SEQ ID NO: 193712 - DNA, 25 bp, Mus musculus
agccccctctagtgagcactcccag

SEQ ID NO: 193713 - DNA, 25 bp, Mus musculus
agccccctgaaagcctctggagatg

SEQ ID NO: 193714 - DNA, 25 bp, Mus musculus
agccccctggcaggttcagagcatt

SEQ ID NO: 193715 - DNA, 25 bp, Mus musculus
agccccgaaggactgctgcagagct

SEQ ID NO: 193716 - DNA, 25 bp, Mus musculus
agccccgaaggcacacatgatgtcc

SEQ ID NO: 193717 - DNA, 25 bp, Mus musculus
agccccgacccaggggagcagcgcg

SEQ ID NO: 193718 - DNA, 25 bp, Mus musculus
agccccgacccagtggctagaccta

SEQ ID NO: 193719 - DNA, 25 bp, Mus musculus
agccccgaccctgagttctgaggct

SEQ ID NO: 193720 - DNA, 25 bp, Mus musculus
agccccgagaaagaggtgggacttc

SEQ ID NO: 193721 - DNA, 25 bp, Mus musculus
agccccgagaacgacccaggttcaa

SEQ ID NO: 193722 - DNA, 25 bp, Mus musculus
agccccgaggataatagaatctgtc

SEQ ID NO: 193723 - DNA, 25 bp, Mus musculus
agccccgaggcagaatctagatctt

SEQ ID NO: 193724 - DNA, 25 bp, Mus musculus
agccccgaggcagatgtgtccttcc

SEQ ID NO: 193725 - DNA, 25 bp, Mus musculus
agccccgaggcaggtctctgctgac

SEQ ID NO: 193726 - DNA, 25 bp, Mus musculus
agccccgatcttggtcattgccttt

SEQ ID NO: 193727 - DNA, 25 bp, Mus musculus
agccccgcagggccagttcctgatc

SEQ ID NO: 193728 - DNA, 25 bp, Mus musculus
agccccgccccagaaacatcgaatg

SEQ ID NO: 193729 - DNA, 25 bp, Mus musculus
agccccgccccagtgcaaacagcta

SEQ ID NO: 193730 - DNA, 25 bp, Mus musculus
agccccgcgaatgctgctgctaggg

SEQ ID NO: 193731 - DNA, 25 bp, Mus musculus
agccccgcgagttgcacgatttcaa

SEQ ID NO: 193732 - DNA, 25 bp, Mus musculus
agccccgcgatgtggccgtggctga

SEQ ID NO: 193733 - DNA, 25 bp, Mus musculus
agccccggagaagagccctaggcga

SEQ ID NO: 193734 - DNA, 25 bp, Mus musculus
agccccggagaaggagtgagagaga

SEQ ID NO: 193735 - DNA, 25 bp, Mus musculus
agccccggaggaggtgacagagtta

SEQ ID NO: 193736 - DNA, 25 bp, Mus musculus
agccccggatggcatggaggagcca

SEQ ID NO: 193737 - DNA, 25 bp, Mus musculus
agccccggatggccgggctcgtggc

SEQ ID NO: 193738 - DNA, 25 bp, Mus musculus
agccccggatgtggatggaaaagcc

SEQ ID NO: 193739 - DNA, 25 bp, Mus musculus
agccccggatgtggttgccaaaaca

SEQ ID NO: 193740 - DNA, 25 bp, Mus musculus
agccccggctgcccactccgccttg

SEQ ID NO: 193741 - DNA, 25 bp, Mus musculus
agccccgggaaggaaaagcgcaatg

SEQ ID NO: 193742 - DNA, 25 bp, Mus musculus
agccccgggccagacctcagctcgc

SEQ ID NO: 193743 - DNA, 25 bp, Mus musculus
agccccggggctgagctggctagag

SEQ ID NO: 193744 - DNA, 25 bp, Mus musculus
agccccgggtgacgttgcacaggca

SEQ ID NO: 193745 - DNA, 25 bp, Mus musculus
agccccggtacatggagcttgtgga

SEQ ID NO: 193746 - DNA, 25 bp, Mus musculus
agccccggtagaggtatggatggat

SEQ ID NO: 193747 - DNA, 25 bp, Mus musculus
agccccggtcaatgggtcctaaatg

SEQ ID NO: 193748 - DNA, 25 bp, Mus musculus
agccccggtcagagaaaatgtcaag

SEQ ID NO: 193749 - DNA, 25 bp, Mus musculus
agccccggtgccaaagcctgcgcga

SEQ ID NO: 193750 - DNA, 25 bp, Mus musculus
agccccgtctgagggcagtccttta

SEQ ID NO: 193751 - DNA, 25 bp, Mus musculus
agccccgtggacccagcagctgtca

SEQ ID NO: 193752 - DNA, 25 bp, Mus musculus
agccccgtgggtgctcgtgtgcagt

SEQ ID NO: 193753 - DNA, 25 bp, Mus musculus
agcccctaaaggtctcagaggtggg

SEQ ID NO: 193754 - DNA, 25 bp, Mus musculus
agcccctactcatgatgacgtgtct

SEQ ID NO: 193755 - DNA, 25 bp, Mus musculus
agcccctagtggcaagggaaaacga

SEQ ID NO: 193756 - DNA, 25 bp, Mus musculus
agcccctatcccaggaatttgaagc

SEQ ID NO: 193757 - DNA, 25 bp, Mus musculus
agcccctccagcaggaagaactagg

SEQ ID NO: 193758 - DNA, 25 bp, Mus musculus
agcccctcggatgttctctatgtag

SEQ ID NO: 193759 - DNA, 25 bp, Mus musculus
agcccctcgggccaatcccagtggc

SEQ ID NO: 193760 - DNA, 25 bp, Mus musculus
agcccctctcactgggtcttctggg

SEQ ID NO: 193761 - DNA, 25 bp, Mus musculus
agcccctctctcaggaatttgaagc

SEQ ID NO: 193762 - DNA, 25 bp, Mus musculus
agcccctctgcacctaccctgtgcc

SEQ ID NO: 193763 - DNA, 25 bp, Mus musculus
agcccctgaccagttagtcctctat

SEQ ID NO: 193764 - DNA, 25 bp, Mus musculus
agcccctggacttcagggagaggaa

SEQ ID NO: 193765 - DNA, 25 bp, Mus musculus
agcccctgggctggtggctctcgag

SEQ ID NO: 193766 - DNA, 25 bp, Mus musculus
agcccctggggtgtccgatccgtac

SEQ ID NO: 193767 - DNA, 25 bp, Mus musculus
agcccctgttctggtgattgaggct

SEQ ID NO: 193768 - DNA, 25 bp, Mus musculus
agccccttcacccagtgctgtcaat

SEQ ID NO: 193769 - DNA, 25 bp, Mus musculus
agccccttcagaacctgtctgtcct

SEQ ID NO: 193770 - DNA, 25 bp, Mus musculus
agccccttcagctgtgcagaacctg

SEQ ID NO: 193771 - DNA, 25 bp, Mus musculus
agccccttcctgagcatctgtgggt

SEQ ID NO: 193772 - DNA, 25 bp, Mus musculus
agccccttctcaatctgaaattcag

SEQ ID NO: 193773 - DNA, 25 bp, Mus musculus
agccccttctcaatgtgaaattcag

SEQ ID NO: 193774 - DNA, 25 bp, Mus musculus
agccccttgagtatggcaagaagaa

SEQ ID NO: 193775 - DNA, 25 bp, Mus musculus
agccccttgtatagctgtcagggtg

SEQ ID NO: 193776 - DNA, 25 bp, Mus musculus
agcccctttgagcagcatatgaaga

SEQ ID NO: 193777 - DNA, 25 bp, Mus musculus
agcccgaaagaccacaactcgacgg

SEQ ID NO: 193778 - DNA, 25 bp, Mus musculus
agcccgaaggccgaatgttttggct

SEQ ID NO: 193779 - DNA, 25 bp, Mus musculus
agcccgaaggccggtcgctgtggtt

SEQ ID NO: 193780 - DNA, 25 bp, Mus musculus
agcccgaccagaaccgggtggtggg

SEQ ID NO: 193781 - DNA, 25 bp, Mus musculus
agcccgactgcagaggacccgcgcg

SEQ ID NO: 193782 - DNA, 25 bp, Mus musculus
agcccgagacagggactattccaac

SEQ ID NO: 193783 - DNA, 25 bp, Mus musculus
agcccgagaggagccacagacccgg

SEQ ID NO: 193784 - DNA, 25 bp, Mus musculus
agcccgagaggcccatctgaacagc

SEQ ID NO: 193785 - DNA, 25 bp, Mus musculus
agcccgagagtttccaaggagtctt

SEQ ID NO: 193786 - DNA, 25 bp, Mus musculus
agcccgagcaggacttggatgttgt

SEQ ID NO: 193787 - DNA, 25 bp, Mus musculus
agcccgagcggcggggtgaccatgg

SEQ ID NO: 193788 - DNA, 25 bp, Mus musculus
agcccgaggccagagcatcccagcc

SEQ ID NO: 193789 - DNA, 25 bp, Mus musculus
agcccgaggggaccctgttgactga

SEQ ID NO: 193790 - DNA, 25 bp, Mus musculus
agcccgaggtctcctctgatgaaga

SEQ ID NO: 193791 - DNA, 25 bp, Mus musculus
agcccgatgccaaaatccaacaaac

SEQ ID NO: 193792 - DNA, 25 bp, Mus musculus
agcccgatgccaaaattccaccaaa

SEQ ID NO: 193793 - DNA, 25 bp, Mus musculus
agcccgcaaaagctccctccaacat

SEQ ID NO: 193794 - DNA, 25 bp, Mus musculus
agcccgcaggacagagagtcgatat

SEQ ID NO: 193795 - DNA, 25 bp, Mus musculus
agcccgcagtaacttggattccagg

SEQ ID NO: 193796 - DNA, 25 bp, Mus musculus
agcccgccccaaagcctgccgacat

SEQ ID NO: 193797 - DNA, 25 bp, Mus musculus
agcccgccgctcgaaacctcgacct

SEQ ID NO: 193798 - DNA, 25 bp, Mus musculus
agcccgcctttggctcccatccaag

SEQ ID NO: 193799 - DNA, 25 bp, Mus musculus
agcccgcgaagctctcggagactgg

SEQ ID NO: 193800 - DNA, 25 bp, Mus musculus
agcccgcgaggaacagtctgagatc

SEQ ID NO: 193801 - DNA, 25 bp, Mus musculus
agcccgcgaggtcactatcgtctga

SEQ ID NO: 193802 - DNA, 25 bp, Mus musculus
agcccgcgcaggatccaagacactt

SEQ ID NO: 193803 - DNA, 25 bp, Mus musculus
agcccgcggcagatgaggaaaccca

SEQ ID NO: 193804 - DNA, 25 bp, Mus musculus
agcccgcggcagggaatgattttgc

SEQ ID NO: 193805 - DNA, 25 bp, Mus musculus
agcccgctactttggtgacacacac

SEQ ID NO: 193806 - DNA, 25 bp, Mus musculus
agcccgctctggccgacctaatccc

SEQ ID NO: 193807 - DNA, 25 bp, Mus musculus
agcccgctctggccggagtgagaga

SEQ ID NO: 193808 - DNA, 25 bp, Mus musculus
agcccggaacaaagtaagaagctgt

SEQ ID NO: 193809 - DNA, 25 bp, Mus musculus
agcccggagaagatggtgaacctgg

SEQ ID NO: 193810 - DNA, 25 bp, Mus musculus
agcccggagggatccttttgtggca

SEQ ID NO: 193811 - DNA, 25 bp, Mus musculus
agcccggagtggcagtccggctctc

SEQ ID NO: 193812 - DNA, 25 bp, Mus musculus
agcccggatgaggtggctctggtcc

SEQ ID NO: 193813 - DNA, 25 bp, Mus musculus
agcccggcaccaggcaatctttggc

SEQ ID NO: 193814 - DNA, 25 bp, Mus musculus
agcccggcagatgcccccacgactc

SEQ ID NO: 193815 - DNA, 25 bp, Mus musculus
agcccggcagccacatgttcccaac

SEQ ID NO: 193816 - DNA, 25 bp, Mus musculus
agcccggcagccgaggttcctgcct

SEQ ID NO: 193817 - DNA, 25 bp, Mus musculus
agcccggcagtcaggagtggcagga

SEQ ID NO: 193818 - DNA, 25 bp, Mus musculus
agcccggcctcgggtgtttctgttt

SEQ ID NO: 193819 - DNA, 25 bp, Mus musculus
agcccggctcaggacaatggatttt

SEQ ID NO: 193820 - DNA, 25 bp, Mus musculus
agcccgggaaagaacgcacagtggt

SEQ ID NO: 193821 - DNA, 25 bp, Mus musculus
agcccgggagcgacgatgtcaacct

SEQ ID NO: 193822 - DNA, 25 bp, Mus musculus
agcccgggcaggtaaatttaacaca

SEQ ID NO: 193823 - DNA, 25 bp, Mus musculus
agcccgggcggcaggacctgctaga

SEQ ID NO: 193824 - DNA, 25 bp, Mus musculus
agcccgggtaacatccggatatgta

SEQ ID NO: 193825 - DNA, 25 bp, Mus musculus
agcccggtgcacgatgcccccgaaa

SEQ ID NO: 193826 - DNA, 25 bp, Mus musculus
agcccggtttcacttgagagcacat

SEQ ID NO: 193827 - DNA, 25 bp, Mus musculus
agcccggtttcagttgagagcacat

SEQ ID NO: 193828 - DNA, 25 bp, Mus musculus
agcccgtatgaccaggtcacaatca

SEQ ID NO: 193829 - DNA, 25 bp, Mus musculus
agcccgtcagccccacaccaaggag

SEQ ID NO: 193830 - DNA, 25 bp, Mus musculus
agcccgtcagtgtgggtgctctttc

SEQ ID NO: 193831 - DNA, 25 bp, Mus musculus
agcccgtgctagaggaaccagcaga

SEQ ID NO: 193832 - DNA, 25 bp, Mus musculus
agcccgtgctgaaagtgtctgatgc

SEQ ID NO: 193833 - DNA, 25 bp, Mus musculus
agcccgtggttgtgccccctctcta

SEQ ID NO: 193834 - DNA, 25 bp, Mus musculus
agcccgtgtctgcaggtatatccga

SEQ ID NO: 193835 - DNA, 25 bp, Mus musculus
agcccgtgttccagcaccacctctg

SEQ ID NO: 193836 - DNA, 25 bp, Mus musculus
agcccgttctgccagcctccgctcc

SEQ ID NO: 193837 - DNA, 25 bp, Mus musculus
agcccgttctgccagttcggatagg

SEQ ID NO: 193838 - DNA, 25 bp, Mus musculus
agcccgtttgcaggatgccggtgca

SEQ ID NO: 193839 - DNA, 25 bp, Mus musculus
agccctaaatgatggtgagctccag

SEQ ID NO: 193840 - DNA, 25 bp, Mus musculus
agccctaccaccaaactggctgata

SEQ ID NO: 193841 - DNA, 25 bp, Mus musculus
agccctaccacggagtttgtcacag

SEQ ID NO: 193842 - DNA, 25 bp, Mus musculus
agccctaccaggggtttctctgtgt

SEQ ID NO: 193843 - DNA, 25 bp, Mus musculus
agccctaccagggtgtgggaacaag

SEQ ID NO: 193844 - DNA, 25 bp, Mus musculus
agccctagggcagaaaacaaaaatc

SEQ ID NO: 193845 - DNA, 25 bp, Mus musculus
agccctatgaggtgccattgacatt

SEQ ID NO: 193846 - DNA, 25 bp, Mus musculus
agccctatttcaggaaactcccatc

SEQ ID NO: 193847 - DNA, 25 bp, Mus musculus
agccctatttcaggttgtctacttt

SEQ ID NO: 193848 - DNA, 25 bp, Mus musculus
agccctcaacagagttcatgttctg

SEQ ID NO: 193849 - DNA, 25 bp, Mus musculus
agccctcaactcaagtagtaggcgc

SEQ ID NO: 193850 - DNA, 25 bp, Mus musculus
agccctcatcaatgaggaactctat

SEQ ID NO: 193851 - DNA, 25 bp, Mus musculus
agccctccaagaaagataaactcat

SEQ ID NO: 193852 - DNA, 25 bp, Mus musculus
agccctccagtagagaaataccggt

SEQ ID NO: 193853 - DNA, 25 bp, Mus musculus
agccctccatggacatagtcttgaa

SEQ ID NO: 193854 - DNA, 25 bp, Mus musculus
agccctcccaaaacatgactttggg

SEQ ID NO: 193855 - DNA, 25 bp, Mus musculus
agccctcccaatgattttcagaata

SEQ ID NO: 193856 - DNA, 25 bp, Mus musculus
agccctccgtctggctggttcttct

SEQ ID NO: 193857 - DNA, 25 bp, Mus musculus
agccctcctcagccccctcccgcct

SEQ ID NO: 193858 - DNA, 25 bp, Mus musculus
agccctcctgcaagtttctccagga

SEQ ID NO: 193859 - DNA, 25 bp, Mus musculus
agccctcgaaggttgcagctccacc

SEQ ID NO: 193860 - DNA, 25 bp, Mus musculus
agccctcggcgggcatggcccctgc

SEQ ID NO: 193861 - DNA, 25 bp, Mus musculus
agccctcggctgtagagagtcagtc

SEQ ID NO: 193862 - DNA, 25 bp, Mus musculus
agccctctacagtttcaggcctggt

SEQ ID NO: 193863 - DNA, 25 bp, Mus musculus
agccctctcaggttgtctcaactgc

SEQ ID NO: 193864 - DNA, 25 bp, Mus musculus
agccctctgattgaaattttcttct

SEQ ID NO: 193865 - DNA, 25 bp, Mus musculus
agccctctgccagagcacaagagac

SEQ ID NO: 193866 - DNA, 25 bp, Mus musculus
agccctcttatgtcctcagagagta

SEQ ID NO: 193867 - DNA, 25 bp, Mus musculus
agccctgaactatcctccatgtgaa

SEQ ID NO: 193868 - DNA, 25 bp, Mus musculus
agccctgaactgtactctctctata

SEQ ID NO: 193869 - DNA, 25 bp, Mus musculus
agccctgaagattttctgcatttat

SEQ ID NO: 193870 - DNA, 25 bp, Mus musculus
agccctgaagccgaacaaaaaaggc

SEQ ID NO: 193871 - DNA, 25 bp, Mus musculus
agccctgaaggcactaagtgaccgc

SEQ ID NO: 193872 - DNA, 25 bp, Mus musculus
agccctgaatgttctccctcctgat

SEQ ID NO: 193873 - DNA, 25 bp, Mus musculus
agccctgacaacaagagcctggcca

SEQ ID NO: 193874 - DNA, 25 bp, Mus musculus
agccctgaccacagactactggtgc

SEQ ID NO: 193875 - DNA, 25 bp, Mus musculus
agccctgagaaactgggtgctcttc

SEQ ID NO: 193876 - DNA, 25 bp, Mus musculus
agccctgagacagactcacaccgct

SEQ ID NO: 193877 - DNA, 25 bp, Mus musculus
agccctgagagggagattcgtaatg

SEQ ID NO: 193878 - DNA, 25 bp, Mus musculus
agccctgagcaggagtctgcaggtg

SEQ ID NO: 193879 - DNA, 25 bp, Mus musculus
agccctgaggtgagagcagccatgg

SEQ ID NO: 193880 - DNA, 25 bp, Mus musculus
agccctgattccacgcttcttgcca

SEQ ID NO: 193881 - DNA, 25 bp, Mus musculus
agccctgcacaggctagccctgctc

SEQ ID NO: 193882 - DNA, 25 bp, Mus musculus
agccctgcaccagagaaatcataaa

SEQ ID NO: 193883 - DNA, 25 bp, Mus musculus
agccctgcaccaggcctgtattgat

SEQ ID NO: 193884 - DNA, 25 bp, Mus musculus
agccctgcacccaagcccctccagt

SEQ ID NO: 193885 - DNA, 25 bp, Mus musculus
agccctgcacccaagggcacagacc

SEQ ID NO: 193886 - DNA, 25 bp, Mus musculus
agccctgcagagaaactcatcaagc

SEQ ID NO: 193887 - DNA, 25 bp, Mus musculus
agccctgcagagaaagaacatttca

SEQ ID NO: 193888 - DNA, 25 bp, Mus musculus
agccctgcaggtactccctggcatc

SEQ ID NO: 193889 - DNA, 25 bp, Mus musculus
agccctgccccagcaccacctaccc

SEQ ID NO: 193890 - DNA, 25 bp, Mus musculus
agccctgcctaccctaacccagaat

SEQ ID NO: 193891 - DNA, 25 bp, Mus musculus
agccctgcgcagatggtggacctgc

SEQ ID NO: 193892 - DNA, 25 bp, Mus musculus
agccctgcggagagtaagcggaggc

SEQ ID NO: 193893 - DNA, 25 bp, Mus musculus
agccctgcgggataagaagtatgct

SEQ ID NO: 193894 - DNA, 25 bp, Mus musculus
agccctgctacattaataccctgga

SEQ ID NO: 193895 - DNA, 25 bp, Mus musculus
agccctgctgctagtaacgaaggca

SEQ ID NO: 193896 - DNA, 25 bp, Mus musculus
agccctgctgctggctgtcatctac

SEQ ID NO: 193897 - DNA, 25 bp, Mus musculus
agccctgctgctgtggtgaaaggac

SEQ ID NO: 193898 - DNA, 25 bp, Mus musculus
agccctggagctcagcacaggggat

SEQ ID NO: 193899 - DNA, 25 bp, Mus musculus
agccctggaggagtctcagctagtt

SEQ ID NO: 193900 - DNA, 25 bp, Mus musculus
agccctggaggattaccaggcaatt

SEQ ID NO: 193901 - DNA, 25 bp, Mus musculus
agccctggaggcactggttccagtc

SEQ ID NO: 193902 - DNA, 25 bp, Mus musculus
agccctggatccaggtgaaccttct

SEQ ID NO: 193903 - DNA, 25 bp, Mus musculus
agccctggcacacgccccaaggaaa

SEQ ID NO: 193904 - DNA, 25 bp, Mus musculus
agccctggcaggaaggagactgcgg

SEQ ID NO: 193905 - DNA, 25 bp, Mus musculus
agccctggcgcccagggcaaggaca

SEQ ID NO: 193906 - DNA, 25 bp, Mus musculus
agccctggcgcccagtgagtgaacc

SEQ ID NO: 193907 - DNA, 25 bp, Mus musculus
agccctggctgggggatgggctcct

SEQ ID NO: 193908 - DNA, 25 bp, Mus musculus
agccctggctgggggatgggctctt

SEQ ID NO: 193909 - DNA, 25 bp, Mus musculus
agccctgggcttgaagaaccagtag

SEQ ID NO: 193910 - DNA, 25 bp, Mus musculus
agccctgggtgtgagattctctcca

SEQ ID NO: 193911 - DNA, 25 bp, Mus musculus
agccctggtgattaggacaaagcca

SEQ ID NO: 193912 - DNA, 25 bp, Mus musculus
agccctgtaaatggcttgctgaaag

SEQ ID NO: 193913 - DNA, 25 bp, Mus musculus
agccctgtacaaaggggcagccaca

SEQ ID NO: 193914 - DNA, 25 bp, Mus musculus
agccctgtcagactttgtagacacg

SEQ ID NO: 193915 - DNA, 25 bp, Mus musculus
agccctgtcagagtttgtagacacg

SEQ ID NO: 193916 - DNA, 25 bp, Mus musculus
agccctgtgacgaatggcacacgaa

SEQ ID NO: 193917 - DNA, 25 bp, Mus musculus
agccctgtgagcactctgactctgg

SEQ ID NO: 193918 - DNA, 25 bp, Mus musculus
agccctgtgaggacctggaacgagg

SEQ ID NO: 193919 - DNA, 25 bp, Mus musculus
agccctgtgaggttgaacttccggc

SEQ ID NO: 193920 - DNA, 25 bp, Mus musculus
agccctgtgcagatttccctcaggg

SEQ ID NO: 193921 - DNA, 25 bp, Mus musculus
agccctgtgcagccttgtgacagat

SEQ ID NO: 193922 - DNA, 25 bp, Mus musculus
agccctgtgcagtatcgtaccgaga

SEQ ID NO: 193923 - DNA, 25 bp, Mus musculus
agccctgtggaggagtctctatgga

SEQ ID NO: 193924 - DNA, 25 bp, Mus musculus
agccctgttgagcaggccacagaag

SEQ ID NO: 193925 - DNA, 25 bp, Mus musculus
agcccttcaagagcttctgcagttt

SEQ ID NO: 193926 - DNA, 25 bp, Mus musculus
agcccttcaaggatatggactattc

SEQ ID NO: 193927 - DNA, 25 bp, Mus musculus
agcccttcacagctgacattatctc

SEQ ID NO: 193928 - DNA, 25 bp, Mus musculus
agcccttcacagtggagattgtgga

SEQ ID NO: 193929 - DNA, 25 bp, Mus musculus
agcccttcactggccccttcatggc

SEQ ID NO: 193930 - DNA, 25 bp, Mus musculus
agcccttcagaaagtactgtccctg

SEQ ID NO: 193931 - DNA, 25 bp, Mus musculus
agcccttcatctggctatctacagt

SEQ ID NO: 193932 - DNA, 25 bp, Mus musculus
agcccttcatctgggtatctacagt

SEQ ID NO: 193933 - DNA, 25 bp, Mus musculus
agcccttcccttggtatgtctacgt

SEQ ID NO: 193934 - DNA, 25 bp, Mus musculus
agcccttcggtgttggtctggtcag

SEQ ID NO: 193935 - DNA, 25 bp, Mus musculus
agcccttgcagcatgagttcaaaga

SEQ ID NO: 193936 - DNA, 25 bp, Mus musculus
agcccttgcagcatggctgaccaac

SEQ ID NO: 193937 - DNA, 25 bp, Mus musculus
agcccttgcccaaggagtctctctg

SEQ ID NO: 193938 - DNA, 25 bp, Mus musculus
agcccttgcccaaggatctgggaaa

SEQ ID NO: 193939 - DNA, 25 bp, Mus musculus
agcccttggatggagccaaaaacaa

SEQ ID NO: 193940 - DNA, 25 bp, Mus musculus
agcccttggttgcagatttgcaata

SEQ ID NO: 193941 - DNA, 25 bp, Mus musculus
agcccttgtgcagcacttagctagc

SEQ ID NO: 193942 - DNA, 25 bp, Mus musculus
agcccttgtgcaggaagcatgcatt

SEQ ID NO: 193943 - DNA, 25 bp, Mus musculus
agcccttgttccaagaagaacgttg

SEQ ID NO: 193944 - DNA, 25 bp, Mus musculus
agcccttgttccaagtatctccata

SEQ ID NO: 193945 - DNA, 25 bp, Mus musculus
agccctttaaggcctccagcataaa

SEQ ID NO: 193946 - DNA, 25 bp, Mus musculus
agccctttatctgacttgttggcaa

SEQ ID NO: 193947 - DNA, 25 bp, Mus musculus
agccctttatctgtgaggtctgcca

SEQ ID NO: 193948 - DNA, 25 bp, Mus musculus
agccctttcttgcatttagtaaaga

SEQ ID NO: 193949 - DNA, 25 bp, Mus musculus
agccctttgaggacaccgctcagtg

SEQ ID NO: 193950 - DNA, 25 bp, Mus musculus
agccctttggaaaaatacatttata

SEQ ID NO: 193951 - DNA, 25 bp, Mus musculus
agccgaaaccatgcatgggcgcctg

SEQ ID NO: 193952 - DNA, 25 bp, Mus musculus
agccgaaagcgaatattaattaacc

SEQ ID NO: 193953 - DNA, 25 bp, Mus musculus
agccgaagcgatctgctaatgcctc

SEQ ID NO: 193954 - DNA, 25 bp, Mus musculus
agccgaagctaaccccccctggtgc

SEQ ID NO: 193955 - DNA, 25 bp, Mus musculus
agccgaagctcaatgacaatgtcag

SEQ ID NO: 193956 - DNA, 25 bp, Mus musculus
agccgaaggacgcgctatgaagtct

SEQ ID NO: 193957 - DNA, 25 bp, Mus musculus
agccgaaggcagcttggagaagaga

SEQ ID NO: 193958 - DNA, 25 bp, Mus musculus
agccgaaggcagtctttcagaaatt

SEQ ID NO: 193959 - DNA, 25 bp, Mus musculus
agccgaataagggaagaaaggaaag

SEQ ID NO: 193960 - DNA, 25 bp, Mus musculus
agccgacagaaaaatctcatcagag

SEQ ID NO: 193961 - DNA, 25 bp, Mus musculus
agccgacagaaaaatgcatacacag

SEQ ID NO: 193962 - DNA, 25 bp, Mus musculus
agccgacagcagctcctgagaaatg

SEQ ID NO: 193963 - DNA, 25 bp, Mus musculus
agccgacagcagtaatctacagtag

SEQ ID NO: 193964 - DNA, 25 bp, Mus musculus
agccgaccaggaactaggaagtaac

SEQ ID NO: 193965 - DNA, 25 bp, Mus musculus
agccgacccaggtctgtgcagacgt

SEQ ID NO: 193966 - DNA, 25 bp, Mus musculus
agccgacccatgaagactcttggga

SEQ ID NO: 193967 - DNA, 25 bp, Mus musculus
agccgacccatgaagatcccaatta

SEQ ID NO: 193968 - DNA, 25 bp, Mus musculus
agccgacccctgcaggaagtggcca

SEQ ID NO: 193969 - DNA, 25 bp, Mus musculus
agccgaccgaggatttggagtttca

SEQ ID NO: 193970 - DNA, 25 bp, Mus musculus
agccgactcagatccgtgatgagtg

SEQ ID NO: 193971 - DNA, 25 bp, Mus musculus
agccgactggcagcaccgagtgccc

SEQ ID NO: 193972 - DNA, 25 bp, Mus musculus
agccgactttgccagtatgttactg

SEQ ID NO: 193973 - DNA, 25 bp, Mus musculus
agccgagcaagacaatcctaaccag

SEQ ID NO: 193974 - DNA, 25 bp, Mus musculus
agccgagcagcggatcttcctcctg

SEQ ID NO: 193975 - DNA, 25 bp, Mus musculus
agccgagcagcggattggccaacgg

SEQ ID NO: 193976 - DNA, 25 bp, Mus musculus
agccgagccatgaggtattactaca

SEQ ID NO: 193977 - DNA, 25 bp, Mus musculus
agccgagcccggtccccagccaaga

SEQ ID NO: 193978 - DNA, 25 bp, Mus musculus
agccgagcccgtaggtgagcctgat

SEQ ID NO: 193979 - DNA, 25 bp, Mus musculus
agccgagcgtaagatcccctgcttc

SEQ ID NO: 193980 - DNA, 25 bp, Mus musculus
agccgagcgtaaggctgatggatgt

SEQ ID NO: 193981 - DNA, 25 bp, Mus musculus
agccgagctcagccaaccccaccag

SEQ ID NO: 193982 - DNA, 25 bp, Mus musculus
agccgaggagggatccaagaacctg

SEQ ID NO: 193983 - DNA, 25 bp, Mus musculus
agccgaggagggtatttcctggtgg

SEQ ID NO: 193984 - DNA, 25 bp, Mus musculus
agccgaggctgtgtgtgtgaagttc

SEQ ID NO: 193985 - DNA, 25 bp, Mus musculus
agccgagggagaggcaatacagagt

SEQ ID NO: 193986 - DNA, 25 bp, Mus musculus
agccgagggagaggcactgatggag

SEQ ID NO: 193987 - DNA, 25 bp, Mus musculus
agccgagtctagagctcctccggga

SEQ ID NO: 193988 - DNA, 25 bp, Mus musculus
agccgagtgatggggcgttgggcgc

SEQ ID NO: 193989 - DNA, 25 bp, Mus musculus
agccgagttcagattctccgagtca

SEQ ID NO: 193990 - DNA, 25 bp, Mus musculus
agccgagttcagggaacagattctc

SEQ ID NO: 193991 - DNA, 25 bp, Mus musculus
agccgatccagggagaagtcaataa

SEQ ID NO: 193992 - DNA, 25 bp, Mus musculus
agccgatccaggtcccggtccttct

SEQ ID NO: 193993 - DNA, 25 bp, Mus musculus
agccgatgcccactggacttcagga

SEQ ID NO: 193994 - DNA, 25 bp, Mus musculus
agccgattgccgacgtgttcttaat

SEQ ID NO: 193995 - DNA, 25 bp, Mus musculus
agccgcaaacagggcctggatcctg

SEQ ID NO: 193996 - DNA, 25 bp, Mus musculus
agccgcaaagaagttccaccaggtg

SEQ ID NO: 193997 - DNA, 25 bp, Mus musculus
agccgcaaagaatggctatacacca

SEQ ID NO: 193998 - DNA, 25 bp, Mus musculus
agccgcaaaggatgaaacgaggagg

SEQ ID NO: 193999 - DNA, 25 bp, Mus musculus
agccgcacaggcagcatatctagtt

SEQ ID NO: 194000 - DNA, 25 bp, Mus musculus
agccgcacctacgagctcctggaaa

SEQ ID NO: 194001 - DNA, 25 bp, Mus musculus
agccgcacggcggacaaatgaagag

SEQ ID NO: 194002 - DNA, 25 bp, Mus musculus
agccgcacggcgggaatctcttcct

SEQ ID NO: 194003 - DNA, 25 bp, Mus musculus
agccgcagaagtatgaggcttgggt

SEQ ID NO: 194004 - DNA, 25 bp, Mus musculus
agccgcagaccggactccagattcc

SEQ ID NO: 194005 - DNA, 25 bp, Mus musculus
agccgcagagagaggttaccctgca

SEQ ID NO: 194006 - DNA, 25 bp, Mus musculus
agccgcagcatggagacaaaaaagc

SEQ ID NO: 194007 - DNA, 25 bp, Mus musculus
agccgcagcatgggaaattaagcga

SEQ ID NO: 194008 - DNA, 25 bp, Mus musculus
agccgcagcccaaggagatacagaa

SEQ ID NO: 194009 - DNA, 25 bp, Mus musculus
agccgcaggaatcagccatgcatca

SEQ ID NO: 194010 - DNA, 25 bp, Mus musculus
agccgcaggatgcaggctggggctg

SEQ ID NO: 194011 - DNA, 25 bp, Mus musculus
agccgcagtgtaatgatcgatgaag

SEQ ID NO: 194012 - DNA, 25 bp, Mus musculus
agccgcatcgctctgaagaaagagg

SEQ ID NO: 194013 - DNA, 25 bp, Mus musculus
agccgcattaaggacagccttctgc

SEQ ID NO: 194014 - DNA, 25 bp, Mus musculus
agccgccaagtgcctgaagacctgt

SEQ ID NO: 194015 - DNA, 25 bp, Mus musculus
agccgccacaggaactggtgtgcct

SEQ ID NO: 194016 - DNA, 25 bp, Mus musculus
agccgccacaggtcctgttgagtca

SEQ ID NO: 194017 - DNA, 25 bp, Mus musculus
agccgccaccacggcgggcgtccga

SEQ ID NO: 194018 - DNA, 25 bp, Mus musculus
agccgccagcgccgtccgtgacctc

SEQ ID NO: 194019 - DNA, 25 bp, Mus musculus
agccgccagggaaggctccccagag

SEQ ID NO: 194020 - DNA, 25 bp, Mus musculus
agccgccattaaggtgtctagtcac

SEQ ID NO: 194021 - DNA, 25 bp, Mus musculus
agccgccattgaaacggataaggaa

SEQ ID NO: 194022 - DNA, 25 bp, Mus musculus
agccgccattgaaacgggatgggaa

SEQ ID NO: 194023 - DNA, 25 bp, Mus musculus
agccgccccacggcggagcctgacc

SEQ ID NO: 194024 - DNA, 25 bp, Mus musculus
agccgccccacgggccatggaggaa

SEQ ID NO: 194025 - DNA, 25 bp, Mus musculus
agccgcccccaggagttattcctca

SEQ ID NO: 194026 - DNA, 25 bp, Mus musculus
agccgcccgcacggagcggcggcat

SEQ ID NO: 194027 - DNA, 25 bp, Mus musculus
agccgcccgcctggacaggatgttt

SEQ ID NO: 194028 - DNA, 25 bp, Mus musculus
agccgcccgcgcagagccggctgat

SEQ ID NO: 194029 - DNA, 25 bp, Mus musculus
agccgcccgcgcaggttggtgggaa

SEQ ID NO: 194030 - DNA, 25 bp, Mus musculus
agccgcccgcgcaggtttggacgtc

SEQ ID NO: 194031 - DNA, 25 bp, Mus musculus
agccgcccggaggtgcttgaggcga

SEQ ID NO: 194032 - DNA, 25 bp, Mus musculus
agccgccgcccaggtaactatagtc

SEQ ID NO: 194033 - DNA, 25 bp, Mus musculus
agccgccgcccaggttctgggaaat

SEQ ID NO: 194034 - DNA, 25 bp, Mus musculus
agccgccgcggaggtctttggccag

SEQ ID NO: 194035 - DNA, 25 bp, Mus musculus
agccgccgggagatgctgttgacgg

SEQ ID NO: 194036 - DNA, 25 bp, Mus musculus
agccgccgtggaagaaaccctgatg

SEQ ID NO: 194037 - DNA, 25 bp, Mus musculus
agccgcctctcgcagagttcgagga

SEQ ID NO: 194038 - DNA, 25 bp, Mus musculus
agccgccttgctaggcccggtcggt

SEQ ID NO: 194039 - DNA, 25 bp, Mus musculus
agccgcgacatggcctcagtgagct

SEQ ID NO: 194040 - DNA, 25 bp, Mus musculus
agccgcgccatggatttggtgagct

SEQ ID NO: 194041 - DNA, 25 bp, Mus musculus
agccgcgcccgggaggtgaagggcc

SEQ ID NO: 194042 - DNA, 25 bp, Mus musculus
agccgcgcccgggagtttcaggcat

SEQ ID NO: 194043 - DNA, 25 bp, Mus musculus
agccgcgcgtgtctccacagaggcg

SEQ ID NO: 194044 - DNA, 25 bp, Mus musculus
agccgcgcttccgctccggccctcg

SEQ ID NO: 194045 - DNA, 25 bp, Mus musculus
agccgcggaggacgtggcctgggga

SEQ ID NO: 194046 - DNA, 25 bp, Mus musculus
agccgcggatccgcatttgcaggcc

SEQ ID NO: 194047 - DNA, 25 bp, Mus musculus
agccgcgggttaccgtgcagacatg

SEQ ID NO: 194048 - DNA, 25 bp, Mus musculus
agccgcgtagactttaagaaacaat

SEQ ID NO: 194049 - DNA, 25 bp, Mus musculus
agccgcgtccagaccatttttgccc

SEQ ID NO: 194050 - DNA, 25 bp, Mus musculus
agccgcgtgcgaggatgaaacgagg

SEQ ID NO: 194051 - DNA, 25 bp, Mus musculus
agccgctatggagatggaaacccca

SEQ ID NO: 194052 - DNA, 25 bp, Mus musculus
agccgctcatgtgggatatgagcct

SEQ ID NO: 194053 - DNA, 25 bp, Mus musculus
agccgctccttctagtggcagacct

SEQ ID NO: 194054 - DNA, 25 bp, Mus musculus
agccgctcgagcccgctgcctgtgc

SEQ ID NO: 194055 - DNA, 25 bp, Mus musculus
agccgctcgagcccggggactttgt

SEQ ID NO: 194056 - DNA, 25 bp, Mus musculus
agccgctcgagcccggtacctgggc

SEQ ID NO: 194057 - DNA, 25 bp, Mus musculus
agccgctctgaggtcgaatggtatg

SEQ ID NO: 194058 - DNA, 25 bp, Mus musculus
agccgctgaagatgtgcctcatcca

SEQ ID NO: 194059 - DNA, 25 bp, Mus musculus
agccgctgcacgatttaccttcaag

SEQ ID NO: 194060 - DNA, 25 bp, Mus musculus
agccgctgccgcgagataaaatcaa

SEQ ID NO: 194061 - DNA, 25 bp, Mus musculus
agccgctgcggccagagcttcggtg

SEQ ID NO: 194062 - DNA, 25 bp, Mus musculus
agccgctgtggtgactgggctggtc

SEQ ID NO: 194063 - DNA, 25 bp, Mus musculus
agccgctgtggtgatgagatggacc

SEQ ID NO: 194064 - DNA, 25 bp, Mus musculus
agccgctgttgacagggtctgcagc

SEQ ID NO: 194065 - DNA, 25 bp, Mus musculus
agccgcttatcattaccagttcaag

SEQ ID NO: 194066 - DNA, 25 bp, Mus musculus
agccgcttcggcattctggaattta

SEQ ID NO: 194067 - DNA, 25 bp, Mus musculus
agccgctttaggatcgctactctta

SEQ ID NO: 194068 - DNA, 25 bp, Mus musculus
agccggaaaggcggaggccaggctc

SEQ ID NO: 194069 - DNA, 25 bp, Mus musculus
agccggaacttcaaggatgaagaaa

SEQ ID NO: 194070 - DNA, 25 bp, Mus musculus
agccggaacttcaagtcctcctgca

SEQ ID NO: 194071 - DNA, 25 bp, Mus musculus
agccggaaggagtcccagccaagcg

SEQ ID NO: 194072 - DNA, 25 bp, Mus musculus
agccggacacattttaactgtgaca

SEQ ID NO: 194073 - DNA, 25 bp, Mus musculus
agccggagcctccggttaagcctga

SEQ ID NO: 194074 - DNA, 25 bp, Mus musculus
agccggagcgatctttgggttcctg

SEQ ID NO: 194075 - DNA, 25 bp, Mus musculus
agccggagctgctggacatgctgct

SEQ ID NO: 194076 - DNA, 25 bp, Mus musculus
agccggaggaagagggctgcctctg

SEQ ID NO: 194077 - DNA, 25 bp, Mus musculus
agccggaggatactcagctctggag

SEQ ID NO: 194078 - DNA, 25 bp, Mus musculus
agccggaggcgagaggccccacgca

SEQ ID NO: 194079 - DNA, 25 bp, Mus musculus
agccggagtccagggtctccataga

SEQ ID NO: 194080 - DNA, 25 bp, Mus musculus
agccggagtccgtctacagagagcc

SEQ ID NO: 194081 - DNA, 25 bp, Mus musculus
agccggagtgcccatgaacgggaag

SEQ ID NO: 194082 - DNA, 25 bp, Mus musculus
agccggataatgacggcgtggagcc

SEQ ID NO: 194083 - DNA, 25 bp, Mus musculus
agccggataatgtgctagaatttgt

SEQ ID NO: 194084 - DNA, 25 bp, Mus musculus
agccggatactggacatgctggtgt

SEQ ID NO: 194085 - DNA, 25 bp, Mus musculus
agccggatactggatgaagacagct

SEQ ID NO: 194086 - DNA, 25 bp, Mus musculus
agccggatcccagggcctagtaact

SEQ ID NO: 194087 - DNA, 25 bp, Mus musculus
agccggatgctgagatggtttttga

SEQ ID NO: 194088 - DNA, 25 bp, Mus musculus
agccggattcaggaggtggatgccc

SEQ ID NO: 194089 - DNA, 25 bp, Mus musculus
agccggattgcctggagagtgtgaa

SEQ ID NO: 194090 - DNA, 25 bp, Mus musculus
agccggcagagcaagccactcaggc

SEQ ID NO: 194091 - DNA, 25 bp, Mus musculus
agccggcagagcaaggtggagctca

SEQ ID NO: 194092 - DNA, 25 bp, Mus musculus
agccggcaggaccagtggctgctct

SEQ ID NO: 194093 - DNA, 25 bp, Mus musculus
agccggcatatcattgcttattccc

SEQ ID NO: 194094 - DNA, 25 bp, Mus musculus
agccggcatatccctgattgtccct

SEQ ID NO: 194095 - DNA, 25 bp, Mus musculus
agccggcatcagctgatttccaaag

SEQ ID NO: 194096 - DNA, 25 bp, Mus musculus
agccggcccgcgtacggcatccaga

SEQ ID NO: 194097 - DNA, 25 bp, Mus musculus
agccggcctaaaaggctgctctttg

SEQ ID NO: 194098 - DNA, 25 bp, Mus musculus
agccggcctaaaagggctccttctc

SEQ ID NO: 194099 - DNA, 25 bp, Mus musculus
agccggcctcggtgtggtacatgga

SEQ ID NO: 194100 - DNA, 25 bp, Mus musculus
agccggccttcagcacacagcacac

SEQ ID NO: 194101 - DNA, 25 bp, Mus musculus
agccggcgactctaggttgcagtgt

SEQ ID NO: 194102 - DNA, 25 bp, Mus musculus
agccggcggcacgatgccggtgcag

SEQ ID NO: 194103 - DNA, 25 bp, Mus musculus
agccggcgggaggctgacaatttcc

SEQ ID NO: 194104 - DNA, 25 bp, Mus musculus
agccggctgatctggaccccgaggc

SEQ ID NO: 194105 - DNA, 25 bp, Mus musculus
agccggctgatgccaagacggaaga

SEQ ID NO: 194106 - DNA, 25 bp, Mus musculus
agccgggaagaggtgctgagctatg

SEQ ID NO: 194107 - DNA, 25 bp, Mus musculus
agccgggaagcctatcctctactcc

SEQ ID NO: 194108 - DNA, 25 bp, Mus musculus
agccgggacagagagggtccgtcgt

SEQ ID NO: 194109 - DNA, 25 bp, Mus musculus
agccgggaggctacagactacaaga

SEQ ID NO: 194110 - DNA, 25 bp, Mus musculus
agccgggatacaggtgtgaatgagg

SEQ ID NO: 194111 - DNA, 25 bp, Mus musculus
agccgggatgctgtccaggcccccg

SEQ ID NO: 194112 - DNA, 25 bp, Mus musculus
agccgggcagcgcaggtatcgccag

SEQ ID NO: 194113 - DNA, 25 bp, Mus musculus
agccgggcagcgcaggtgccccgtg

SEQ ID NO: 194114 - DNA, 25 bp, Mus musculus
agccgggcagcggcctggaggaggg

SEQ ID NO: 194115 - DNA, 25 bp, Mus musculus
agccgggcaggtttgccaagctgct

SEQ ID NO: 194116 - DNA, 25 bp, Mus musculus
agccgggctatgagatattactaca

SEQ ID NO: 194117 - DNA, 25 bp, Mus musculus
agccggggaaaggtgctctcccagg

SEQ ID NO: 194118 - DNA, 25 bp, Mus musculus
agccggggaaaggtgtctaaggatg

SEQ ID NO: 194119 - DNA, 25 bp, Mus musculus
agccggggagccgggggcactatga

SEQ ID NO: 194120 - DNA, 25 bp, Mus musculus
agccggggccgcaggaggcccagcc

SEQ ID NO: 194121 - DNA, 25 bp, Mus musculus
agccggggctcgatgtctacactac

SEQ ID NO: 194122 - DNA, 25 bp, Mus musculus
agccggggtgagaaggtcatccttt

SEQ ID NO: 194123 - DNA, 25 bp, Mus musculus
agccggtcctcactgccaaggcagc

SEQ ID NO: 194124 - DNA, 25 bp, Mus musculus
agccggtctccagcttcctgcgctt

SEQ ID NO: 194125 - DNA, 25 bp, Mus musculus
agccggtctccagtgttcacaccgc

SEQ ID NO: 194126 - DNA, 25 bp, Mus musculus
agccggtgacgccgccgaagatggc

SEQ ID NO: 194127 - DNA, 25 bp, Mus musculus
agccggtgccgggctttcaggtagc

SEQ ID NO: 194128 - DNA, 25 bp, Mus musculus
agccggtggcccagcctgcagcatc

SEQ ID NO: 194129 - DNA, 25 bp, Mus musculus
agccgtaaccgagccccaatccatg

SEQ ID NO: 194130 - DNA, 25 bp, Mus musculus
agccgtacaagcagtgagcttatgg

SEQ ID NO: 194131 - DNA, 25 bp, Mus musculus
agccgtacagtaagcactaccccgt

SEQ ID NO: 194132 - DNA, 25 bp, Mus musculus
agccgtcaccccaaaattttgtgaa

SEQ ID NO: 194133 - DNA, 25 bp, Mus musculus
agccgtcagacaaggaggaaggctc

SEQ ID NO: 194134 - DNA, 25 bp, Mus musculus
agccgtcagacaaggtaaggaatta

SEQ ID NO: 194135 - DNA, 25 bp, Mus musculus
agccgtcagcccagagctgatttat

SEQ ID NO: 194136 - DNA, 25 bp, Mus musculus
agccgtccagacggtgcagagactg

SEQ ID NO: 194137 - DNA, 25 bp, Mus musculus
agccgtccagcacttccacgtgcta

SEQ ID NO: 194138 - DNA, 25 bp, Mus musculus
agccgtcctcaaagcctatgaagac

SEQ ID NO: 194139 - DNA, 25 bp, Mus musculus
agccgtctctacttaagaagctctt

SEQ ID NO: 194140 - DNA, 25 bp, Mus musculus
agccgtctgaagaactgagtgtgat

SEQ ID NO: 194141 - DNA, 25 bp, Mus musculus
agccgtctgaagactgctctttgat

SEQ ID NO: 194142 - DNA, 25 bp, Mus musculus
agccgtgaagacctgctgccgacaa

SEQ ID NO: 194143 - DNA, 25 bp, Mus musculus
agccgtgacggagatgctcacgtag

SEQ ID NO: 194144 - DNA, 25 bp, Mus musculus
agccgtgacggagatttcttgacct

SEQ ID NO: 194145 - DNA, 25 bp, Mus musculus
agccgtgagccagcttcacctatct

SEQ ID NO: 194146 - DNA, 25 bp, Mus musculus
agccgtgaggagccggtccagatta

SEQ ID NO: 194147 - DNA, 25 bp, Mus musculus
agccgtgcagagaaaatttcctgat

SEQ ID NO: 194148 - DNA, 25 bp, Mus musculus
agccgtgcagagatcctgtacattc

SEQ ID NO: 194149 - DNA, 25 bp, Mus musculus
agccgtgcagagcaagccatacagg

SEQ ID NO: 194150 - DNA, 25 bp, Mus musculus
agccgtgcagagcatctactgccga

SEQ ID NO: 194151 - DNA, 25 bp, Mus musculus
agccgtgcaggcagcggctgcgtag

SEQ ID NO: 194152 - DNA, 25 bp, Mus musculus
agccgtgcagggttcactatcgttg

SEQ ID NO: 194153 - DNA, 25 bp, Mus musculus
agccgtggatgagttttgaagtgag

SEQ ID NO: 194154 - DNA, 25 bp, Mus musculus
agccgtggccccagggttgtgagcc

SEQ ID NO: 194155 - DNA, 25 bp, Mus musculus
agccgtgggcagagttctctgaacg

SEQ ID NO: 194156 - DNA, 25 bp, Mus musculus
agccgtgtagtttccatttatttct

SEQ ID NO: 194157 - DNA, 25 bp, Mus musculus
agccgttcagaaaagttggactaca

SEQ ID NO: 194158 - DNA, 25 bp, Mus musculus
agcctaaaaaagcattcaactcgga

SEQ ID NO: 194159 - DNA, 25 bp, Mus musculus
agcctaaaaagacggcacaaacacc

SEQ ID NO: 194160 - DNA, 25 bp, Mus musculus
agcctaaaaaggtggtgctgtgatg

SEQ ID NO: 194161 - DNA, 25 bp, Mus musculus
agcctaacacaggtggtgaccgtta

SEQ ID NO: 194162 - DNA, 25 bp, Mus musculus
agcctaaccagacagatggagaaag

SEQ ID NO: 194163 - DNA, 25 bp, Mus musculus
agcctaagaaacgagcaaaaaattc

SEQ ID NO: 194164 - DNA, 25 bp, Mus musculus
agcctaagaaggcaccgacagcccg

SEQ ID NO: 194165 - DNA, 25 bp, Mus musculus
agcctaagcctgatttctttattca

SEQ ID NO: 194166 - DNA, 25 bp, Mus musculus
agcctaagccttgctcagctccttt

SEQ ID NO: 194167 - DNA, 25 bp, Mus musculus
agcctaagtcctggtacgccatacc

SEQ ID NO: 194168 - DNA, 25 bp, Mus musculus
agcctaatatggcggtgtggctaca

SEQ ID NO: 194169 - DNA, 25 bp, Mus musculus
agcctaatggaccagctagtggaac

SEQ ID NO: 194170 - DNA, 25 bp, Mus musculus
agcctaatgtaaaggggctctttcc

SEQ ID NO: 194171 - DNA, 25 bp, Mus musculus
agcctacaaagaggcctttgccagt

SEQ ID NO: 194172 - DNA, 25 bp, Mus musculus
agcctacaatctgaatgaagaaaga

SEQ ID NO: 194173 - DNA, 25 bp, Mus musculus
agcctacagccatcgggtgggaaaa

SEQ ID NO: 194174 - DNA, 25 bp, Mus musculus
agcctacagtctgaatgaagaaaga

SEQ ID NO: 194175 - DNA, 25 bp, Mus musculus
agcctaccagaaagccttgtgcctc

SEQ ID NO: 194176 - DNA, 25 bp, Mus musculus
agcctaccagaaagtttgcttacct

SEQ ID NO: 194177 - DNA, 25 bp, Mus musculus
agcctaccagggatggctctgagct

SEQ ID NO: 194178 - DNA, 25 bp, Mus musculus
agcctaccaggtacaaccacgttga

SEQ ID NO: 194179 - DNA, 25 bp, Mus musculus
agcctacccaaggaaactgccagga

SEQ ID NO: 194180 - DNA, 25 bp, Mus musculus
agcctacccaaggaaactgccaggc

SEQ ID NO: 194181 - DNA, 25 bp, Mus musculus
agcctacccagagaactggcagaag

SEQ ID NO: 194182 - DNA, 25 bp, Mus musculus
agcctacccagagataagaagcatt

SEQ ID NO: 194183 - DNA, 25 bp, Mus musculus
agcctacccaggaagaagctcacta

SEQ ID NO: 194184 - DNA, 25 bp, Mus musculus
agcctacccatctgacagatcacag

SEQ ID NO: 194185 - DNA, 25 bp, Mus musculus
agcctacccctgaccatcccctcat

SEQ ID NO: 194186 - DNA, 25 bp, Mus musculus
agcctacccgacagccccataaggc

SEQ ID NO: 194187 - DNA, 25 bp, Mus musculus
agcctacccgacaggaaggtctata

SEQ ID NO: 194188 - DNA, 25 bp, Mus musculus
agcctacctgccgcaaatctcccag

SEQ ID NO: 194189 - DNA, 25 bp, Mus musculus
agcctacggtggatcatgggctcta

SEQ ID NO: 194190 - DNA, 25 bp, Mus musculus
agcctactatcccagccccccaggt

SEQ ID NO: 194191 - DNA, 25 bp, Mus musculus
agcctactatcccagtatgcaaccg

SEQ ID NO: 194192 - DNA, 25 bp, Mus musculus
agcctactatcccagtgtttgaaag

SEQ ID NO: 194193 - DNA, 25 bp, Mus musculus
agcctactgaagatcgacttggaga

SEQ ID NO: 194194 - DNA, 25 bp, Mus musculus
agcctactgaaggcctcctcaaaag

SEQ ID NO: 194195 - DNA, 25 bp, Mus musculus
agcctactgtttacagtacagcaat

SEQ ID NO: 194196 - DNA, 25 bp, Mus musculus
agcctacttcagcaggtccctgcat

SEQ ID NO: 194197 - DNA, 25 bp, Mus musculus
agcctacttcttcaggttccggaag

SEQ ID NO: 194198 - DNA, 25 bp, Mus musculus
agcctagaacaggcagcagaagaag

SEQ ID NO: 194199 - DNA, 25 bp, Mus musculus
agcctagaagagctccgaggttgca

SEQ ID NO: 194200 - DNA, 25 bp, Mus musculus
agcctagaagagtatgagcccagag

SEQ ID NO: 194201 - DNA, 25 bp, Mus musculus
agcctagacctgacgggacatcctg

SEQ ID NO: 194202 - DNA, 25 bp, Mus musculus
agcctagacctgtcagaggcctgta

SEQ ID NO: 194203 - DNA, 25 bp, Mus musculus
agcctagccaaagatatgaggatca

SEQ ID NO: 194204 - DNA, 25 bp, Mus musculus
agcctagcgggtgcaaagaaatggc

SEQ ID NO: 194205 - DNA, 25 bp, Mus musculus
agcctagctctcagagctcctcctc

SEQ ID NO: 194206 - DNA, 25 bp, Mus musculus
agcctaggctataaagagcaaaaca

SEQ ID NO: 194207 - DNA, 25 bp, Mus musculus
agcctagggagccgtgtggagcaaa

SEQ ID NO: 194208 - DNA, 25 bp, Mus musculus
agcctagtactgccaaccccacggg

SEQ ID NO: 194209 - DNA, 25 bp, Mus musculus
agcctagtactggaggagagttaat

SEQ ID NO: 194210 - DNA, 25 bp, Mus musculus
agcctatacaaggctggacgtaaag

SEQ ID NO: 194211 - DNA, 25 bp, Mus musculus
agcctatactacctacaataccctt

SEQ ID NO: 194212 - DNA, 25 bp, Mus musculus
agcctatatattgaaaatccctgac

SEQ ID NO: 194213 - DNA, 25 bp, Mus musculus
agcctatatattgaagtgcggtgtt

SEQ ID NO: 194214 - DNA, 25 bp, Mus musculus
agcctatattggtgctggccaacaa

SEQ ID NO: 194215 - DNA, 25 bp, Mus musculus
agcctatccagagaaccattctgat

SEQ ID NO: 194216 - DNA, 25 bp, Mus musculus
agcctatctgtttgtctctagataa

SEQ ID NO: 194217 - DNA, 25 bp, Mus musculus
agcctatggagtggcaaaaactact

SEQ ID NO: 194218 - DNA, 25 bp, Mus musculus
agcctatggagtgttggcagatatc

SEQ ID NO: 194219 - DNA, 25 bp, Mus musculus
agcctcaactcgaagctcctcccaa

SEQ ID NO: 194220 - DNA, 25 bp, Mus musculus
agcctcaagatgaaggtctcagatc

SEQ ID NO: 194221 - DNA, 25 bp, Mus musculus
agcctcaccccgagcaggggagatg

SEQ ID NO: 194222 - DNA, 25 bp, Mus musculus
agcctcacccgagcgcagaccctga

SEQ ID NO: 194223 - DNA, 25 bp, Mus musculus
agcctcactctagggtgaagcctgc

SEQ ID NO: 194224 - DNA, 25 bp, Mus musculus
agcctcactgaaagctgggaagtca

SEQ ID NO: 194225 - DNA, 25 bp, Mus musculus
agcctcactggtgggtgtgcaaaca

SEQ ID NO: 194226 - DNA, 25 bp, Mus musculus
agcctcagaacgcgagcactttcat

SEQ ID NO: 194227 - DNA, 25 bp, Mus musculus
agcctcagaaggatgcgggctcctg

SEQ ID NO: 194228 - DNA, 25 bp, Mus musculus
agcctcagaattcagggaagctacc

SEQ ID NO: 194229 - DNA, 25 bp, Mus musculus
agcctcagaattcaggtgttccatg

SEQ ID NO: 194230 - DNA, 25 bp, Mus musculus
agcctcagagatgctggagtgtcaa

SEQ ID NO: 194231 - DNA, 25 bp, Mus musculus
agcctcagagatgctggagtgtcca

SEQ ID NO: 194232 - DNA, 25 bp, Mus musculus
agcctcagaggccagaaaggacacc

SEQ ID NO: 194233 - DNA, 25 bp, Mus musculus
agcctcagaggccagaagaaggcat

SEQ ID NO: 194234 - DNA, 25 bp, Mus musculus
agcctcaggaagaaactatcaatac

SEQ ID NO: 194235 - DNA, 25 bp, Mus musculus
agcctcaggaatacatcatggaatt

SEQ ID NO: 194236 - DNA, 25 bp, Mus musculus
agcctcagtacctggtactggtctc

SEQ ID NO: 194237 - DNA, 25 bp, Mus musculus
agcctcatcaagagggctgggtcaa

SEQ ID NO: 194238 - DNA, 25 bp, Mus musculus
agcctcatcggaaatttgtatgccc

SEQ ID NO: 194239 - DNA, 25 bp, Mus musculus
agcctccaaaagccctgcccttcga

SEQ ID NO: 194240 - DNA, 25 bp, Mus musculus
agcctccaacaaagcaaagtaacaa

SEQ ID NO: 194241 - DNA, 25 bp, Mus musculus
agcctccaacaaaggtcgtcctcct

SEQ ID NO: 194242 - DNA, 25 bp, Mus musculus
agcctccaagtatgagaaagagcta

SEQ ID NO: 194243 - DNA, 25 bp, Mus musculus
agcctccacccccagaaacgtgtgc

SEQ ID NO: 194244 - DNA, 25 bp, Mus musculus
agcctccacctcctcagtggcatgc

SEQ ID NO: 194245 - DNA, 25 bp, Mus musculus
agcctccagaaccgcaaagatgctg

SEQ ID NO: 194246 - DNA, 25 bp, Mus musculus
agcctccagggacagtgtcttggta

SEQ ID NO: 194247 - DNA, 25 bp, Mus musculus
agcctccatcaggattccatggaca

SEQ ID NO: 194248 - DNA, 25 bp, Mus musculus
agcctcccactggttatagcactcc

SEQ ID NO: 194249 - DNA, 25 bp, Mus musculus
agcctcccactgtagaagggaccag

SEQ ID NO: 194250 - DNA, 25 bp, Mus musculus
agcctcccagagatcctcttcccag

SEQ ID NO: 194251 - DNA, 25 bp, Mus musculus
agcctcccaggaagagagggagaag

SEQ ID NO: 194252 - DNA, 25 bp, Mus musculus
agcctcccaggtccacttgaagacc

SEQ ID NO: 194253 - DNA, 25 bp, Mus musculus
agcctcccaggtggaatgaacctta

SEQ ID NO: 194254 - DNA, 25 bp, Mus musculus
agcctccccacagaggtggaagcac

SEQ ID NO: 194255 - DNA, 25 bp, Mus musculus
agcctccccgactcggccatcgaca

SEQ ID NO: 194256 - DNA, 25 bp, Mus musculus
agcctccctggaacgggtgaagttg

SEQ ID NO: 194257 - DNA, 25 bp, Mus musculus
agcctccgctgggtggtaaatgcag

SEQ ID NO: 194258 - DNA, 25 bp, Mus musculus
agcctccggccaggcgagcagacta

SEQ ID NO: 194259 - DNA, 25 bp, Mus musculus
agcctccggggaccttcctggtgcg

SEQ ID NO: 194260 - DNA, 25 bp, Mus musculus
agcctccgggggtgtctctttggag

SEQ ID NO: 194261 - DNA, 25 bp, Mus musculus
agcctccgtcatgacgcaacttcgg

SEQ ID NO: 194262 - DNA, 25 bp, Mus musculus
agcctcctaaggaagcacctccctt

SEQ ID NO: 194263 - DNA, 25 bp, Mus musculus
agcctcctaaggaaggctcagagaa

SEQ ID NO: 194264 - DNA, 25 bp, Mus musculus
agcctcctaaggaagggtacctgga

SEQ ID NO: 194265 - DNA, 25 bp, Mus musculus
agcctcctaggcacccgagggacta

SEQ ID NO: 194266 - DNA, 25 bp, Mus musculus
agcctcctccatgaagcttcgtgga

SEQ ID NO: 194267 - DNA, 25 bp, Mus musculus
agcctcctccgagaattatatcaga

SEQ ID NO: 194268 - DNA, 25 bp, Mus musculus
agcctcctcgaggctgtgtgactct

SEQ ID NO: 194269 - DNA, 25 bp, Mus musculus
agcctcctctgaactggatgccagt

SEQ ID NO: 194270 - DNA, 25 bp, Mus musculus
agcctcctctgaactgtataaaatg

SEQ ID NO: 194271 - DNA, 25 bp, Mus musculus
agcctcctcttgtgatgaagctcaa

SEQ ID NO: 194272 - DNA, 25 bp, Mus musculus
agcctcctggatatatctattcttc

SEQ ID NO: 194273 - DNA, 25 bp, Mus musculus
agcctcctgggtgttctcttccaca

SEQ ID NO: 194274 - DNA, 25 bp, Mus musculus
agcctcctgggttggctgcaagctc

SEQ ID NO: 194275 - DNA, 25 bp, Mus musculus
agcctcctgttccaggatggaggta

SEQ ID NO: 194276 - DNA, 25 bp, Mus musculus
agcctccttcaggcctcaggcttgg

SEQ ID NO: 194277 - DNA, 25 bp, Mus musculus
agcctcgaaacagaggcgctccagc

SEQ ID NO: 194278 - DNA, 25 bp, Mus musculus
agcctcgaaacatgagcatgcccac

SEQ ID NO: 194279 - DNA, 25 bp, Mus musculus
agcctcgactgaccctgactgcacc

SEQ ID NO: 194280 - DNA, 25 bp, Mus musculus
agcctcgcaaactatttcaatggaa

SEQ ID NO: 194281 - DNA, 25 bp, Mus musculus
agcctcgcggcttgactaaaatgtc

SEQ ID NO: 194282 - DNA, 25 bp, Mus musculus
agcctcgcggggcaggtgtccatgt

SEQ ID NO: 194283 - DNA, 25 bp, Mus musculus
agcctcgtgatcaggaagaaaagca

SEQ ID NO: 194284 - DNA, 25 bp, Mus musculus
agcctcgtgatcaggaggaatctga

SEQ ID NO: 194285 - DNA, 25 bp, Mus musculus
agcctcgtgatcagtagcaagattg

SEQ ID NO: 194286 - DNA, 25 bp, Mus musculus
agcctcgtgcccagcagcaggagtc

SEQ ID NO: 194287 - DNA, 25 bp, Mus musculus
agcctctaccccctgctgaatgagg

SEQ ID NO: 194288 - DNA, 25 bp, Mus musculus
agcctctactcaatagtcaaggagg

SEQ ID NO: 194289 - DNA, 25 bp, Mus musculus
agcctctaggccctaggaccatgaa

SEQ ID NO: 194290 - DNA, 25 bp, Mus musculus
agcctctcaacgattcccacgccta

SEQ ID NO: 194291 - DNA, 25 bp, Mus musculus
agcctctcaatgggtgttcaggata

SEQ ID NO: 194292 - DNA, 25 bp, Mus musculus
agcctctcagagataaaatcaaaga

SEQ ID NO: 194293 - DNA, 25 bp, Mus musculus
agcctctccaaggtggcccagctgc

SEQ ID NO: 194294 - DNA, 25 bp, Mus musculus
agcctctccagggccctgacgtcaa

SEQ ID NO: 194295 - DNA, 25 bp, Mus musculus
agcctctccaggggaaaataagtca

SEQ ID NO: 194296 - DNA, 25 bp, Mus musculus
agcctctccagttcctttgtccctg

SEQ ID NO: 194297 - DNA, 25 bp, Mus musculus
agcctctccgtacagatcttcgtcc

SEQ ID NO: 194298 - DNA, 25 bp, Mus musculus
agcctctccgtacagcgccatggct

SEQ ID NO: 194299 - DNA, 25 bp, Mus musculus
agcctctctgagcagtggtagtgtg

SEQ ID NO: 194300 - DNA, 25 bp, Mus musculus
agcctctctggaactgaaaagctcc

SEQ ID NO: 194301 - DNA, 25 bp, Mus musculus
agcctctctggagtccatgtatctg

SEQ ID NO: 194302 - DNA, 25 bp, Mus musculus
agcctctctggtacatggcttcttc

SEQ ID NO: 194303 - DNA, 25 bp, Mus musculus
agcctctgaactggaaatcccacct

SEQ ID NO: 194304 - DNA, 25 bp, Mus musculus
agcctctgaggaaagatataaaaac

SEQ ID NO: 194305 - DNA, 25 bp, Mus musculus
agcctctgagggaactacatgaatg

SEQ ID NO: 194306 - DNA, 25 bp, Mus musculus
agcctctgcagatgcctgagcactc

SEQ ID NO: 194307 - DNA, 25 bp, Mus musculus
agcctctgcagcactgccagagttg

SEQ ID NO: 194308 - DNA, 25 bp, Mus musculus
agcctctgcccacagagagcccaga

SEQ ID NO: 194309 - DNA, 25 bp, Mus musculus
agcctctggatttatcactttttaa

SEQ ID NO: 194310 - DNA, 25 bp, Mus musculus
agcctctgtacacgtccggatagct

SEQ ID NO: 194311 - DNA, 25 bp, Mus musculus
agcctcttaaggtcattttcttggt

SEQ ID NO: 194312 - DNA, 25 bp, Mus musculus
agcctcttcaagccctctccaggcc

SEQ ID NO: 194313 - DNA, 25 bp, Mus musculus
agcctcttctctgagtttctcagtg

SEQ ID NO: 194314 - DNA, 25 bp, Mus musculus
agcctcttctctgtgcctttcttcc

SEQ ID NO: 194315 - DNA, 25 bp, Mus musculus
agcctcttgctcagccacagaacat

SEQ ID NO: 194316 - DNA, 25 bp, Mus musculus
agcctcttgctcagggtcctcttaa

SEQ ID NO: 194317 - DNA, 25 bp, Mus musculus
agcctctttgactatgaacaacatt

SEQ ID NO: 194318 - DNA, 25 bp, Mus musculus
agcctctttgggttcgtttccatta

SEQ ID NO: 194319 - DNA, 25 bp, Mus musculus
agcctgaaaaatacattgccctaga

SEQ ID NO: 194320 - DNA, 25 bp, Mus musculus
agcctgaaaagatcccaccaaatat

SEQ ID NO: 194321 - DNA, 25 bp, Mus musculus
agcctgaacagagagctgaaattat

SEQ ID NO: 194322 - DNA, 25 bp, Mus musculus
agcctgaaccgcccgttgaccgaga

SEQ ID NO: 194323 - DNA, 25 bp, Mus musculus
agcctgaacctggctgcttttgctg

SEQ ID NO: 194324 - DNA, 25 bp, Mus musculus
agcctgaactcgcaggcaccttttg

SEQ ID NO: 194325 - DNA, 25 bp, Mus musculus
agcctgaactcgcaggttctggctg

SEQ ID NO: 194326 - DNA, 25 bp, Mus musculus
agcctgaagaagatgactttgaaaa

SEQ ID NO: 194327 - DNA, 25 bp, Mus musculus
agcctgaagaagatggattatgaca

SEQ ID NO: 194328 - DNA, 25 bp, Mus musculus
agcctgaagacctcccataacacga

SEQ ID NO: 194329 - DNA, 25 bp, Mus musculus
agcctgaatctcctggagaaagaaa

SEQ ID NO: 194330 - DNA, 25 bp, Mus musculus
agcctgacagaaggtctccgggcac

SEQ ID NO: 194331 - DNA, 25 bp, Mus musculus
agcctgacatgggattctctccaac

SEQ ID NO: 194332 - DNA, 25 bp, Mus musculus
agcctgacatgggcctccttgaatc

SEQ ID NO: 194333 - DNA, 25 bp, Mus musculus
agcctgaccaaggagcaggcggagc

SEQ ID NO: 194334 - DNA, 25 bp, Mus musculus
agcctgacgaggggtctccgggcac

SEQ ID NO: 194335 - DNA, 25 bp, Mus musculus
agcctgactggttgtgtcaccaaca

SEQ ID NO: 194336 - DNA, 25 bp, Mus musculus
agcctgactttttcgctgccttggg

SEQ ID NO: 194337 - DNA, 25 bp, Mus musculus
agcctgactttttcggtgcctcctg

SEQ ID NO: 194338 - DNA, 25 bp, Mus musculus
agcctgagacccaacagaaaaatgg

SEQ ID NO: 194339 - DNA, 25 bp, Mus musculus
agcctgagagtgaatgggcaagaga

SEQ ID NO: 194340 - DNA, 25 bp, Mus musculus
agcctgagagtggtaatcttttggt

SEQ ID NO: 194341 - DNA, 25 bp, Mus musculus
agcctgagcctcgttccagggtcac

SEQ ID NO: 194342 - DNA, 25 bp, Mus musculus
agcctgagcgcattgaggaaagcgg

SEQ ID NO: 194343 - DNA, 25 bp, Mus musculus
agcctgaggagacgcagaggcaggg

SEQ ID NO: 194344 - DNA, 25 bp, Mus musculus
agcctgaggtacaaggtgaactgtg

SEQ ID NO: 194345 - DNA, 25 bp, Mus musculus
agcctgagtacgaggaggaaatctc

SEQ ID NO: 194346 - DNA, 25 bp, Mus musculus
agcctgagtgaggatcatggctgct

SEQ ID NO: 194347 - DNA, 25 bp, Mus musculus
agcctgatgaaaatgcctttgagta

SEQ ID NO: 194348 - DNA, 25 bp, Mus musculus
agcctgatgaaagcatctgtggcaa

SEQ ID NO: 194349 - DNA, 25 bp, Mus musculus
agcctgatgaatgaggtgtgtactt

SEQ ID NO: 194350 - DNA, 25 bp, Mus musculus
agcctgatgtgaggctcctcatagt

SEQ ID NO: 194351 - DNA, 25 bp, Mus musculus
agcctgcaaaaggaggtgttcctgc

SEQ ID NO: 194352 - DNA, 25 bp, Mus musculus
agcctgcaagccaggccattcccca

SEQ ID NO: 194353 - DNA, 25 bp, Mus musculus
agcctgcaagccaggtggagcagcc

SEQ ID NO: 194354 - DNA, 25 bp, Mus musculus
agcctgcaagccaggttccttaaaa

SEQ ID NO: 194355 - DNA, 25 bp, Mus musculus
agcctgcaccagagcaatgttcttc

SEQ ID NO: 194356 - DNA, 25 bp, Mus musculus
agcctgcacgtggaccacagtgaac

SEQ ID NO: 194357 - DNA, 25 bp, Mus musculus
agcctgcacgtgggtccctggaggc

SEQ ID NO: 194358 - DNA, 25 bp, Mus musculus
agcctgcagccacgatggacagtct

SEQ ID NO: 194359 - DNA, 25 bp, Mus musculus
agcctgcagcctgtggtatcctgtg

SEQ ID NO: 194360 - DNA, 25 bp, Mus musculus
agcctgcagtcaaaatcaagcactg

SEQ ID NO: 194361 - DNA, 25 bp, Mus musculus
agcctgcagtcaaatggatctggct

SEQ ID NO: 194362 - DNA, 25 bp, Mus musculus
agcctgcagtccagagtggaccaga

SEQ ID NO: 194363 - DNA, 25 bp, Mus musculus
agcctgcagtccaggatagatatga

SEQ ID NO: 194364 - DNA, 25 bp, Mus musculus
agcctgcagtccaggtcctgcgact

SEQ ID NO: 194365 - DNA, 25 bp, Mus musculus
agcctgcagttctgtttctctctgt

SEQ ID NO: 194366 - DNA, 25 bp, Mus musculus
agcctgcagttcttccacttgatcc

SEQ ID NO: 194367 - DNA, 25 bp, Mus musculus
agcctgcataaggctgcggagaagg

SEQ ID NO: 194368 - DNA, 25 bp, Mus musculus
agcctgcatcaggtcctagaccaaa

SEQ ID NO: 194369 - DNA, 25 bp, Mus musculus
agcctgcattttaaggagtgcatgc

SEQ ID NO: 194370 - DNA, 25 bp, Mus musculus
agcctgccaactctgaaaagaagaa

SEQ ID NO: 194371 - DNA, 25 bp, Mus musculus
agcctgccaagaccctaccactgaa

SEQ ID NO: 194372 - DNA, 25 bp, Mus musculus
agcctgccaagttctggaaattgga

SEQ ID NO: 194373 - DNA, 25 bp, Mus musculus
agcctgccaagtttgatgaagcgga

SEQ ID NO: 194374 - DNA, 25 bp, Mus musculus
agcctgccacaggaagagagctcag

SEQ ID NO: 194375 - DNA, 25 bp, Mus musculus
agcctgccaggctctagttcattga

SEQ ID NO: 194376 - DNA, 25 bp, Mus musculus
agcctgcccaagtcttcaactgctc

SEQ ID NO: 194377 - DNA, 25 bp, Mus musculus
agcctgcgcaaaatcacgcttaaag

SEQ ID NO: 194378 - DNA, 25 bp, Mus musculus
agcctgctaacaggtgatatttttg

SEQ ID NO: 194379 - DNA, 25 bp, Mus musculus
agcctgctctacagaaaataaatca

SEQ ID NO: 194380 - DNA, 25 bp, Mus musculus
agcctgctgctgcctccaggtggag

SEQ ID NO: 194381 - DNA, 25 bp, Mus musculus
agcctgctggaaagagattgctctc

SEQ ID NO: 194382 - DNA, 25 bp, Mus musculus
agcctgctggcaatcatctggggaa

SEQ ID NO: 194383 - DNA, 25 bp, Mus musculus
agcctgctggccaaaataccgactg

SEQ ID NO: 194384 - DNA, 25 bp, Mus musculus
agcctgctggccaatgacactctga

SEQ ID NO: 194385 - DNA, 25 bp, Mus musculus
agcctggaaaatgccatcgagacac

SEQ ID NO: 194386 - DNA, 25 bp, Mus musculus
agcctggaaaccagggatcctggta

SEQ ID NO: 194387 - DNA, 25 bp, Mus musculus
agcctggaaggagctttggttaaga

SEQ ID NO: 194388 - DNA, 25 bp, Mus musculus
agcctggaagggcatactttgagaa

SEQ ID NO: 194389 - DNA, 25 bp, Mus musculus
agcctggaatagagcaatcaagatg

SEQ ID NO: 194390 - DNA, 25 bp, Mus musculus
agcctggaatctcaggcaaaaccca

SEQ ID NO: 194391 - DNA, 25 bp, Mus musculus
agcctggacagaaggtctgtgtgtg

SEQ ID NO: 194392 - DNA, 25 bp, Mus musculus
agcctggaccaatgggtccaattgg

SEQ ID NO: 194393 - DNA, 25 bp, Mus musculus
agcctggagaaggtcccacctgctc

SEQ ID NO: 194394 - DNA, 25 bp, Mus musculus
agcctggagaggtccatatcctgta

SEQ ID NO: 194395 - DNA, 25 bp, Mus musculus
agcctggagcatgagagcgtagcag

SEQ ID NO: 194396 - DNA, 25 bp, Mus musculus
agcctggagcatgaggagtggtgga

SEQ ID NO: 194397 - DNA, 25 bp, Mus musculus
agcctggagcattgctgaatatgct

SEQ ID NO: 194398 - DNA, 25 bp, Mus musculus
agcctggagctgcaggttcggggtg

SEQ ID NO: 194399 - DNA, 25 bp, Mus musculus
agcctggaggagctgaattttctga

SEQ ID NO: 194400 - DNA, 25 bp, Mus musculus
agcctggaggagctgttttctgaag

SEQ ID NO: 194401 - DNA, 25 bp, Mus musculus
agcctggatgttgccaaggcacctg

SEQ ID NO: 194402 - DNA, 25 bp, Mus musculus
agcctggattcacaggaattcactg

SEQ ID NO: 194403 - DNA, 25 bp, Mus musculus
agcctggcaagggctactgacagtc

SEQ ID NO: 194404 - DNA, 25 bp, Mus musculus
agcctggcaagtcacgtgacttcta

SEQ ID NO: 194405 - DNA, 25 bp, Mus musculus
agcctggcaatggtctgccaggaac

SEQ ID NO: 194406 - DNA, 25 bp, Mus musculus
agcctggcagcaaccttagtgtccc

SEQ ID NO: 194407 - DNA, 25 bp, Mus musculus
agcctggcagtgtcagcagctatga

SEQ ID NO: 194408 - DNA, 25 bp, Mus musculus
agcctggccagcattcaggagcttc

SEQ ID NO: 194409 - DNA, 25 bp, Mus musculus
agcctggccagggagaggagatcga

SEQ ID NO: 194410 - DNA, 25 bp, Mus musculus
agcctggccctaagggcaactccgg

SEQ ID NO: 194411 - DNA, 25 bp, Mus musculus
agcctggccctcacggtatatgcta

SEQ ID NO: 194412 - DNA, 25 bp, Mus musculus
agcctggcgaggctcaaagcccgat

SEQ ID NO: 194413 - DNA, 25 bp, Mus musculus
agcctggctggcacgttttgtgccc

SEQ ID NO: 194414 - DNA, 25 bp, Mus musculus
agcctggcttctaataacatgctgt

SEQ ID NO: 194415 - DNA, 25 bp, Mus musculus
agcctgggaagagaagaaccaaaga

SEQ ID NO: 194416 - DNA, 25 bp, Mus musculus
agcctgggaagctccaggtgcggtt

SEQ ID NO: 194417 - DNA, 25 bp, Mus musculus
agcctgggagcgagttaagagaaaa

SEQ ID NO: 194418 - DNA, 25 bp, Mus musculus
agcctgggcaagctggtggtaacgg

SEQ ID NO: 194419 - DNA, 25 bp, Mus musculus
agcctgggccaagatgaaagcttgc

SEQ ID NO: 194420 - DNA, 25 bp, Mus musculus
agcctgggccacggagcagctgaag

SEQ ID NO: 194421 - DNA, 25 bp, Mus musculus
agcctgggcctcaagtccccaagac

SEQ ID NO: 194422 - DNA, 25 bp, Mus musculus
agcctgggcggagccccttaggtga

SEQ ID NO: 194423 - DNA, 25 bp, Mus musculus
agcctgggcggagtagcgctgggga

SEQ ID NO: 194424 - DNA, 25 bp, Mus musculus
agcctgggctacaaagctgctgatg

SEQ ID NO: 194425 - DNA, 25 bp, Mus musculus
agcctgggctacagagctcaccatg

SEQ ID NO: 194426 - DNA, 25 bp, Mus musculus
agcctgggctgagatgaggtgccac

SEQ ID NO: 194427 - DNA, 25 bp, Mus musculus
agcctgggcttcaggtgctgtggga

SEQ ID NO: 194428 - DNA, 25 bp, Mus musculus
agcctggggagaggccgacccgtgg

SEQ ID NO: 194429 - DNA, 25 bp, Mus musculus
agcctggggatggtgtgaccccaca

SEQ ID NO: 194430 - DNA, 25 bp, Mus musculus
agcctggggcaggtcacctagcatt

SEQ ID NO: 194431 - DNA, 25 bp, Mus musculus
agcctggggcgaggaaccaccgacc

SEQ ID NO: 194432 - DNA, 25 bp, Mus musculus
agcctggggcggagtggcagcccag

SEQ ID NO: 194433 - DNA, 25 bp, Mus musculus
agcctggggcggtcagtttagaatg

SEQ ID NO: 194434 - DNA, 25 bp, Mus musculus
agcctggggtcccggacaagagtac

SEQ ID NO: 194435 - DNA, 25 bp, Mus musculus
agcctggggtcccggatatttggaa

SEQ ID NO: 194436 - DNA, 25 bp, Mus musculus
agcctgggtctcccagtttgtcact

SEQ ID NO: 194437 - DNA, 25 bp, Mus musculus
agcctgggtggacaggtgagcaatg

SEQ ID NO: 194438 - DNA, 25 bp, Mus musculus
agcctggtcaggcagtccctcgaga

SEQ ID NO: 194439 - DNA, 25 bp, Mus musculus
agcctggtcaggtgaaagcagccat

SEQ ID NO: 194440 - DNA, 25 bp, Mus musculus
agcctggtcaggtgagcagattgat

SEQ ID NO: 194441 - DNA, 25 bp, Mus musculus
agcctggtcctacgatcccaggctc

SEQ ID NO: 194442 - DNA, 25 bp, Mus musculus
agcctggtcctacggctgtgtggtg

SEQ ID NO: 194443 - DNA, 25 bp, Mus musculus
agcctggtctaaagaatcagaagta

SEQ ID NO: 194444 - DNA, 25 bp, Mus musculus
agcctggtctacaaagaaatgttct

SEQ ID NO: 194445 - DNA, 25 bp, Mus musculus
agcctggtctacaagatcacagagc

SEQ ID NO: 194446 - DNA, 25 bp, Mus musculus
agcctggtctacagaatagacatgc

SEQ ID NO: 194447 - DNA, 25 bp, Mus musculus
agcctggtctacagagctctcagac

SEQ ID NO: 194448 - DNA, 25 bp, Mus musculus
agcctggtctacagatacaaatata

SEQ ID NO: 194449 - DNA, 25 bp, Mus musculus
agcctggtctacatagggctccaac

SEQ ID NO: 194450 - DNA, 25 bp, Mus musculus
agcctggtgacaagaagactagcag

SEQ ID NO: 194451 - DNA, 25 bp, Mus musculus
agcctggtgtcccgggatgccaagc

SEQ ID NO: 194452 - DNA, 25 bp, Mus musculus
agcctggtgtctctggtcccatggg

SEQ ID NO: 194453 - DNA, 25 bp, Mus musculus
agcctggttgccaaggctacataaa

SEQ ID NO: 194454 - DNA, 25 bp, Mus musculus
agcctggttgccaaggtccaaggac

SEQ ID NO: 194455 - DNA, 25 bp, Mus musculus
agcctgtaagcccagcactatggtg

SEQ ID NO: 194456 - DNA, 25 bp, Mus musculus
agcctgtaagcccagcatgtgcagg

SEQ ID NO: 194457 - DNA, 25 bp, Mus musculus
agcctgtaagttcttgcagatacag

SEQ ID NO: 194458 - DNA, 25 bp, Mus musculus
agcctgtataagagccctgaagaca

SEQ ID NO: 194459 - DNA, 25 bp, Mus musculus
agcctgtataaggtaggtgcacgcc

SEQ ID NO: 194460 - DNA, 25 bp, Mus musculus
agcctgtatgagaagctgaagcagt

SEQ ID NO: 194461 - DNA, 25 bp, Mus musculus
agcctgtcaacaatggctcaacaac

SEQ ID NO: 194462 - DNA, 25 bp, Mus musculus
agcctgtcaagaatatcgccaacag

SEQ ID NO: 194463 - DNA, 25 bp, Mus musculus
agcctgtcatccagaatgccttatt

SEQ ID NO: 194464 - DNA, 25 bp, Mus musculus
agcctgtcatccagggcttcctact

SEQ ID NO: 194465 - DNA, 25 bp, Mus musculus
agcctgtccagcaccatggctggca

SEQ ID NO: 194466 - DNA, 25 bp, Mus musculus
agcctgtctgaaaagggccggcagg

SEQ ID NO: 194467 - DNA, 25 bp, Mus musculus
agcctgtctgccccatgtccatcat

SEQ ID NO: 194468 - DNA, 25 bp, Mus musculus
agcctgtgagaaaactaactgctta

SEQ ID NO: 194469 - DNA, 25 bp, Mus musculus
agcctgtgagcaaaaacctgtgctg

SEQ ID NO: 194470 - DNA, 25 bp, Mus musculus
agcctgtgagcaaagaggcaagaga

SEQ ID NO: 194471 - DNA, 25 bp, Mus musculus
agcctgtgagcttcaaactggattt

SEQ ID NO: 194472 - DNA, 25 bp, Mus musculus
agcctgtgcaagggcggcctgagct

SEQ ID NO: 194473 - DNA, 25 bp, Mus musculus
agcctgtgcagtggcactccaaagt

SEQ ID NO: 194474 - DNA, 25 bp, Mus musculus
agcctgtgccttggacggctgttct

SEQ ID NO: 194475 - DNA, 25 bp, Mus musculus
agcctgtgcttagagctcctcctcc

SEQ ID NO: 194476 - DNA, 25 bp, Mus musculus
agcctgtggaagtcggtgatggcat

SEQ ID NO: 194477 - DNA, 25 bp, Mus musculus
agcctgtgtggctcaagtggccttt

SEQ ID NO: 194478 - DNA, 25 bp, Mus musculus
agcctgtgtgggcctgggactttgc

SEQ ID NO: 194479 - DNA, 25 bp, Mus musculus
agcctgttacacagcccagggaata

SEQ ID NO: 194480 - DNA, 25 bp, Mus musculus
agcctgttcaagaaatcaacatgca

SEQ ID NO: 194481 - DNA, 25 bp, Mus musculus
agcctgttcaaggttcgcccagaga

SEQ ID NO: 194482 - DNA, 25 bp, Mus musculus
agcctgttcctctgaaaaggaaaag

SEQ ID NO: 194483 - DNA, 25 bp, Mus musculus
agcctgttcttgtggctcaggggac

SEQ ID NO: 194484 - DNA, 25 bp, Mus musculus
agcctgttttggacccaacagactg

SEQ ID NO: 194485 - DNA, 25 bp, Mus musculus
agccttaaattgggtgcttccaata

SEQ ID NO: 194486 - DNA, 25 bp, Mus musculus
agccttaaattggttctactagtgc

SEQ ID NO: 194487 - DNA, 25 bp, Mus musculus
agccttaactaactccacggacaat

SEQ ID NO: 194488 - DNA, 25 bp, Mus musculus
agccttaactggctccataggaatc

SEQ ID NO: 194489 - DNA, 25 bp, Mus musculus
agccttacactacttctaaagatgg

SEQ ID NO: 194490 - DNA, 25 bp, Mus musculus
agccttaccctgattaacctggcct

SEQ ID NO: 194491 - DNA, 25 bp, Mus musculus
agccttactggggtttggaaatagt

SEQ ID NO: 194492 - DNA, 25 bp, Mus musculus
agccttagaacaagatttaccggac

SEQ ID NO: 194493 - DNA, 25 bp, Mus musculus
agccttagaggacgtagagatttta

SEQ ID NO: 194494 - DNA, 25 bp, Mus musculus
agccttagcatccagtgggtgtata

SEQ ID NO: 194495 - DNA, 25 bp, Mus musculus
agccttagctaccgccaccagaagc

SEQ ID NO: 194496 - DNA, 25 bp, Mus musculus
agccttagtcctgtcccccagctct

SEQ ID NO: 194497 - DNA, 25 bp, Mus musculus
agccttatacccggagagagaagcg

SEQ ID NO: 194498 - DNA, 25 bp, Mus musculus
agccttatgccctggttccacggca

SEQ ID NO: 194499 - DNA, 25 bp, Mus musculus
agccttattccagaactttgtgccc

SEQ ID NO: 194500 - DNA, 25 bp, Mus musculus
agccttcaaaagaatggcagtctgc

SEQ ID NO: 194501 - DNA, 25 bp, Mus musculus
agccttcaaaagtgtgctggggaac

SEQ ID NO: 194502 - DNA, 25 bp, Mus musculus
agccttcaaagaatgtctgtaaggc

SEQ ID NO: 194503 - DNA, 25 bp, Mus musculus
agccttcaacctgacgctgtccatg

SEQ ID NO: 194504 - DNA, 25 bp, Mus musculus
agccttcaacctggatgccctccac

SEQ ID NO: 194505 - DNA, 25 bp, Mus musculus
agccttcaagaagttgctctgggct

SEQ ID NO: 194506 - DNA, 25 bp, Mus musculus
agccttcaaggcgccccccacaggc

SEQ ID NO: 194507 - DNA, 25 bp, Mus musculus
agccttcaaggtgaagtacatggag

SEQ ID NO: 194508 - DNA, 25 bp, Mus musculus
agccttcacatggtctcttcagatg

SEQ ID NO: 194509 - DNA, 25 bp, Mus musculus
agccttcaccgtatggtgtggaagc

SEQ ID NO: 194510 - DNA, 25 bp, Mus musculus
agccttcaggagcgggcctgtgtga

SEQ ID NO: 194511 - DNA, 25 bp, Mus musculus
agccttcaggaggtatgctgcttgg

SEQ ID NO: 194512 - DNA, 25 bp, Mus musculus
agccttcattcaacgtgatgaaagg

SEQ ID NO: 194513 - DNA, 25 bp, Mus musculus
agccttcattcaagggttttatgga

SEQ ID NO: 194514 - DNA, 25 bp, Mus musculus
agccttccaaacagaacctttccct

SEQ ID NO: 194515 - DNA, 25 bp, Mus musculus
agccttccaaacagtttcaaagagg

SEQ ID NO: 194516 - DNA, 25 bp, Mus musculus
agccttccagaccggtggcagacat

SEQ ID NO: 194517 - DNA, 25 bp, Mus musculus
agccttccagatacattgacatcag

SEQ ID NO: 194518 - DNA, 25 bp, Mus musculus
agccttccagatacgtcttccaagt

SEQ ID NO: 194519 - DNA, 25 bp, Mus musculus
agccttccatatgaccaaaggctac

SEQ ID NO: 194520 - DNA, 25 bp, Mus musculus
agccttcctgagatactgcagcctc

SEQ ID NO: 194521 - DNA, 25 bp, Mus musculus
agccttcctggagcatgcagacgga

SEQ ID NO: 194522 - DNA, 25 bp, Mus musculus
agccttcctgtcagtgctctggatg

SEQ ID NO: 194523 - DNA, 25 bp, Mus musculus
agccttccttatcagaggtcgactc

SEQ ID NO: 194524 - DNA, 25 bp, Mus musculus
agccttccttatcaggaactcaata

SEQ ID NO: 194525 - DNA, 25 bp, Mus musculus
agccttccttatcagtgtagcccag

SEQ ID NO: 194526 - DNA, 25 bp, Mus musculus
agccttcctttgaggagagtactaa

SEQ ID NO: 194527 - DNA, 25 bp, Mus musculus
agccttcgagaggtgctgagcttgt

SEQ ID NO: 194528 - DNA, 25 bp, Mus musculus
agccttcgataccgacatccatgct

SEQ ID NO: 194529 - DNA, 25 bp, Mus musculus
agccttcgccatgtccttatgtggg

SEQ ID NO: 194530 - DNA, 25 bp, Mus musculus
agccttcgcgaggtggtggctgagc

SEQ ID NO: 194531 - DNA, 25 bp, Mus musculus
agccttctaagctacctgaaccagc

SEQ ID NO: 194532 - DNA, 25 bp, Mus musculus
agccttctcaggccagattttagct

SEQ ID NO: 194533 - DNA, 25 bp, Mus musculus
agccttctcctgaaacactgtgccc

SEQ ID NO: 194534 - DNA, 25 bp, Mus musculus
agccttctgagatagcaagcagatt

SEQ ID NO: 194535 - DNA, 25 bp, Mus musculus
agccttctggcagggtccctgcatg

SEQ ID NO: 194536 - DNA, 25 bp, Mus musculus
agccttcttttatgaggtctcccgc

SEQ ID NO: 194537 - DNA, 25 bp, Mus musculus
agccttcttttgacccacataataa

SEQ ID NO: 194538 - DNA, 25 bp, Mus musculus
agccttgaaaaccagatacaatgga

SEQ ID NO: 194539 - DNA, 25 bp, Mus musculus
agccttgaaagcagccgctaacgtc

SEQ ID NO: 194540 - DNA, 25 bp, Mus musculus
agccttgagtgagcataatgaagct

SEQ ID NO: 194541 - DNA, 25 bp, Mus musculus
agccttgagtgaggcatttcatgag

SEQ ID NO: 194542 - DNA, 25 bp, Mus musculus
agccttgataggaccttcgagaagt

SEQ ID NO: 194543 - DNA, 25 bp, Mus musculus
agccttgataggagctgtttacttg

SEQ ID NO: 194544 - DNA, 25 bp, Mus musculus
agccttgatttgaaggagccaagca

SEQ ID NO: 194545 - DNA, 25 bp, Mus musculus
agccttgcatagtcccagaagtatc

SEQ ID NO: 194546 - DNA, 25 bp, Mus musculus
agccttgctcaggagtatcccggca

SEQ ID NO: 194547 - DNA, 25 bp, Mus musculus
agccttgctcaggtttcccttcctc

SEQ ID NO: 194548 - DNA, 25 bp, Mus musculus
agccttgctgattttcagaaagaag

SEQ ID NO: 194549 - DNA, 25 bp, Mus musculus
agccttggagaaaacagagaaacag

SEQ ID NO: 194550 - DNA, 25 bp, Mus musculus
agccttggagagtctccaaggactt

SEQ ID NO: 194551 - DNA, 25 bp, Mus musculus
agccttggcctgtggtcaaaatcca

SEQ ID NO: 194552 - DNA, 25 bp, Mus musculus
agccttggcgcggactggtatccgg

SEQ ID NO: 194553 - DNA, 25 bp, Mus musculus
agccttggtacaggcagcagttatg

SEQ ID NO: 194554 - DNA, 25 bp, Mus musculus
agccttggtccggagaaacattcat

SEQ ID NO: 194555 - DNA, 25 bp, Mus musculus
agccttggtggaggaaccagagtct

SEQ ID NO: 194556 - DNA, 25 bp, Mus musculus
agccttgtaaaaaggtatatcatgt

SEQ ID NO: 194557 - DNA, 25 bp, Mus musculus
agccttgtacaaaggtctctggtaa

SEQ ID NO: 194558 - DNA, 25 bp, Mus musculus
agccttgtacaaaggttggtgttca

SEQ ID NO: 194559 - DNA, 25 bp, Mus musculus
agccttgtataaagtacactggaca

SEQ ID NO: 194560 - DNA, 25 bp, Mus musculus
agccttgtcagaacctggcaccacc

SEQ ID NO: 194561 - DNA, 25 bp, Mus musculus
agccttgttcaggacgcacccctct

SEQ ID NO: 194562 - DNA, 25 bp, Mus musculus
agccttgttcagggggagctggtga

SEQ ID NO: 194563 - DNA, 25 bp, Mus musculus
agcctttaatctgagaggccagtca

SEQ ID NO: 194564 - DNA, 25 bp, Mus musculus
agcctttacaagcccttgtcccagc

SEQ ID NO: 194565 - DNA, 25 bp, Mus musculus
agcctttaccagccctttgggagaa

SEQ ID NO: 194566 - DNA, 25 bp, Mus musculus
agcctttacgagcagagggagccaa

SEQ ID NO: 194567 - DNA, 25 bp, Mus musculus
agcctttagcaccagttcctctttc

SEQ ID NO: 194568 - DNA, 25 bp, Mus musculus
agcctttcaaaggtagtttacaaat

SEQ ID NO: 194569 - DNA, 25 bp, Mus musculus
agcctttcaggatgaagaccttgaa

SEQ ID NO: 194570 - DNA, 25 bp, Mus musculus
agcctttcaggtgcctctcccaccg

SEQ ID NO: 194571 - DNA, 25 bp, Mus musculus
agcctttcatcttccaattctcctc

SEQ ID NO: 194572 - DNA, 25 bp, Mus musculus
agcctttccattgtaaatcttagtg

SEQ ID NO: 194573 - DNA, 25 bp, Mus musculus
agcctttcccggtgggacgctcgtc

SEQ ID NO: 194574 - DNA, 25 bp, Mus musculus
agcctttcctactggctggacccat

SEQ ID NO: 194575 - DNA, 25 bp, Mus musculus
agcctttcctgcaagcatttgacat

SEQ ID NO: 194576 - DNA, 25 bp, Mus musculus
agcctttctgtgaagaaaagacatg

SEQ ID NO: 194577 - DNA, 25 bp, Mus musculus
agcctttgacaaaaaatcagctgcc

SEQ ID NO: 194578 - DNA, 25 bp, Mus musculus
agcctttgagaggaacaaatgtggt

SEQ ID NO: 194579 - DNA, 25 bp, Mus musculus
agcctttgaggaaagggaacgggag

SEQ ID NO: 194580 - DNA, 25 bp, Mus musculus
agcctttgaggtgtgcctgcagtcc

SEQ ID NO: 194581 - DNA, 25 bp, Mus musculus
agcctttgcaaaacatggcagaaga

SEQ ID NO: 194582 - DNA, 25 bp, Mus musculus
agcctttgcaaaagactggctggaa

SEQ ID NO: 194583 - DNA, 25 bp, Mus musculus
agcctttgcaaaagtgatctgcaat

SEQ ID NO: 194584 - DNA, 25 bp, Mus musculus
agcctttgctgcccagtttgaagga

SEQ ID NO: 194585 - DNA, 25 bp, Mus musculus
agcctttgctggggacacccagaat

SEQ ID NO: 194586 - DNA, 25 bp, Mus musculus
agcctttgctttgacactggccaaa

SEQ ID NO: 194587 - DNA, 25 bp, Mus musculus
agcctttggaaagtgacactgatga

SEQ ID NO: 194588 - DNA, 25 bp, Mus musculus
agcctttggagggagttatgggggg

SEQ ID NO: 194589 - DNA, 25 bp, Mus musculus
agcctttgggaaggcgacagactta

SEQ ID NO: 194590 - DNA, 25 bp, Mus musculus
agcctttgtttggtgctcctaaaag

SEQ ID NO: 194591 - DNA, 25 bp, Mus musculus
agcctttgtttggtgttaggcagga

SEQ ID NO: 194592 - DNA, 25 bp, Mus musculus
agccttttgtgaagatcatcacagt

SEQ ID NO: 194593 - DNA, 25 bp, Mus musculus
agcctttttcaagaccaacagcaac

SEQ ID NO: 194594 - DNA, 25 bp, Mus musculus
agcgaaaaggccaagattcttcagg

SEQ ID NO: 194595 - DNA, 25 bp, Mus musculus
agcgaaacagcagtgaccagctcac

SEQ ID NO: 194596 - DNA, 25 bp, Mus musculus
agcgaaaccaggtccacaggatgat

SEQ ID NO: 194597 - DNA, 25 bp, Mus musculus
agcgaaagaaggtaaaatttatgaa

SEQ ID NO: 194598 - DNA, 25 bp, Mus musculus
agcgaaaggctccaggggtgatgga

SEQ ID NO: 194599 - DNA, 25 bp, Mus musculus
agcgaacaatacaggtggccaagaa

SEQ ID NO: 194600 - DNA, 25 bp, Mus musculus
agcgaacaatacagtcaggatggct

SEQ ID NO: 194601 - DNA, 25 bp, Mus musculus
agcgaacatgctcactgttggtata

SEQ ID NO: 194602 - DNA, 25 bp, Mus musculus
agcgaacatggcctcaggagttcag

SEQ ID NO: 194603 - DNA, 25 bp, Mus musculus
agcgaaccagtaatggtcagcaaga

SEQ ID NO: 194604 - DNA, 25 bp, Mus musculus
agcgaagaataggtgtgatgaatgc

SEQ ID NO: 194605 - DNA, 25 bp, Mus musculus
agcgaagacgggagcgggagcagcg

SEQ ID NO: 194606 - DNA, 25 bp, Mus musculus
agcgaagccataccggcgaacgccc

SEQ ID NO: 194607 - DNA, 25 bp, Mus musculus
agcgaagccgaagtcttactcctaa

SEQ ID NO: 194608 - DNA, 25 bp, Mus musculus
agcgaagccggagactatctggtag

SEQ ID NO: 194609 - DNA, 25 bp, Mus musculus
agcgaaggatgggacaaggcctggg

SEQ ID NO: 194610 - DNA, 25 bp, Mus musculus
agcgaaggatggtggaagaaaagtg

SEQ ID NO: 194611 - DNA, 25 bp, Mus musculus
agcgaatcaaagagatggatctgtc

SEQ ID NO: 194612 - DNA, 25 bp, Mus musculus
agcgaatcaaagaggatgtatatac

SEQ ID NO: 194613 - DNA, 25 bp, Mus musculus
agcgaatccccaggcacagaaggag

SEQ ID NO: 194614 - DNA, 25 bp, Mus musculus
agcgaatccccagtatgcagtgtat

SEQ ID NO: 194615 - DNA, 25 bp, Mus musculus
agcgaatccgaaatgaagcagatga

SEQ ID NO: 194616 - DNA, 25 bp, Mus musculus
agcgaatccgtgaaatggccaaacg

SEQ ID NO: 194617 - DNA, 25 bp, Mus musculus
agcgaatggagggtggagcttttgt

SEQ ID NO: 194618 - DNA, 25 bp, Mus musculus
agcgaattgttgggatgattgcgaa

SEQ ID NO: 194619 - DNA, 25 bp, Mus musculus
agcgacaacatctggagagagactt

SEQ ID NO: 194620 - DNA, 25 bp, Mus musculus
agcgacaagatgcctggccgagtgg

SEQ ID NO: 194621 - DNA, 25 bp, Mus musculus
agcgacaaggtaaaagaagaaatga

SEQ ID NO: 194622 - DNA, 25 bp, Mus musculus
agcgacaatgacgatagaaagatcc

SEQ ID NO: 194623 - DNA, 25 bp, Mus musculus
agcgacaatgacgattctgactgcc

SEQ ID NO: 194624 - DNA, 25 bp, Mus musculus
agcgacaccaggaacaccggacaga

SEQ ID NO: 194625 - DNA, 25 bp, Mus musculus
agcgacacttgtccttcacacaccc

SEQ ID NO: 194626 - DNA, 25 bp, Mus musculus
agcgacagaaagatgtccgaccccg

SEQ ID NO: 194627 - DNA, 25 bp, Mus musculus
agcgacagagagcacctaaaggaac

SEQ ID NO: 194628 - DNA, 25 bp, Mus musculus
agcgacagccaggtatgccatcatg

SEQ ID NO: 194629 - DNA, 25 bp, Mus musculus
agcgacagcggcaaaatagtgtttc

SEQ ID NO: 194630 - DNA, 25 bp, Mus musculus
agcgacatcgatggagatgggtgtt

SEQ ID NO: 194631 - DNA, 25 bp, Mus musculus
agcgacatcgctgacttcagggacc

SEQ ID NO: 194632 - DNA, 25 bp, Mus musculus
agcgacatctcaggtgtcgttgaca

SEQ ID NO: 194633 - DNA, 25 bp, Mus musculus
agcgacatgttcaaggtaattcaga

SEQ ID NO: 194634 - DNA, 25 bp, Mus musculus
agcgaccagaggcagagtgaagaaa

SEQ ID NO: 194635 - DNA, 25 bp, Mus musculus
agcgacccaagttgcatttaaatat

SEQ ID NO: 194636 - DNA, 25 bp, Mus musculus
agcgacccaagttgctggacaaatt

SEQ ID NO: 194637 - DNA, 25 bp, Mus musculus
agcgacccacacgtcaaactacaac

SEQ ID NO: 194638 - DNA, 25 bp, Mus musculus
agcgacccagcgtctgatggctata

SEQ ID NO: 194639 - DNA, 25 bp, Mus musculus
agcgaccctgacagagtcatgtggc

SEQ ID NO: 194640 - DNA, 25 bp, Mus musculus
agcgacctgtggaggcttggcaatc

SEQ ID NO: 194641 - DNA, 25 bp, Mus musculus
agcgacgcagaaaaccaacagaacc

SEQ ID NO: 194642 - DNA, 25 bp, Mus musculus
agcgacgcagaggagcctttgggat

SEQ ID NO: 194643 - DNA, 25 bp, Mus musculus
agcgacgctggctctctcttggcct

SEQ ID NO: 194644 - DNA, 25 bp, Mus musculus
agcgacgtctggagaatgctgggac

SEQ ID NO: 194645 - DNA, 25 bp, Mus musculus
agcgacgtctggagcttcggggttc

SEQ ID NO: 194646 - DNA, 25 bp, Mus musculus
agcgacgtggaggaggtattcacag

SEQ ID NO: 194647 - DNA, 25 bp, Mus musculus
agcgactaagcaggaagggatggaa

SEQ ID NO: 194648 - DNA, 25 bp, Mus musculus
agcgactccgattctgacagtggat

SEQ ID NO: 194649 - DNA, 25 bp, Mus musculus
agcgactgaggcaattaaaaacccg

SEQ ID NO: 194650 - DNA, 25 bp, Mus musculus
agcgactgaggtctgccgacggggc

SEQ ID NO: 194651 - DNA, 25 bp, Mus musculus
agcgactttcctcaggacccctcat

SEQ ID NO: 194652 - DNA, 25 bp, Mus musculus
agcgagaaaggagacaccgtggcct

SEQ ID NO: 194653 - DNA, 25 bp, Mus musculus
agcgagacaactggaacccacagtt

SEQ ID NO: 194654 - DNA, 25 bp, Mus musculus
agcgagacagggactctgatggttt

SEQ ID NO: 194655 - DNA, 25 bp, Mus musculus
agcgagaccctgatctgggggatgg

SEQ ID NO: 194656 - DNA, 25 bp, Mus musculus
agcgagacctgtatagcagaacatc

SEQ ID NO: 194657 - DNA, 25 bp, Mus musculus
agcgagacgtggaggtactatgcct

SEQ ID NO: 194658 - DNA, 25 bp, Mus musculus
agcgagacttgcaaaaggtgctgga

SEQ ID NO: 194659 - DNA, 25 bp, Mus musculus
agcgagagagggaactggaggagtg

SEQ ID NO: 194660 - DNA, 25 bp, Mus musculus
agcgagagggtggtccggtgagcaa

SEQ ID NO: 194661 - DNA, 25 bp, Mus musculus
agcgagatgaagcacacaggcattt

SEQ ID NO: 194662 - DNA, 25 bp, Mus musculus
agcgagcaaaaagatttaaggcaag

SEQ ID NO: 194663 - DNA, 25 bp, Mus musculus
agcgagcaaaaagggcaacaatagt

SEQ ID NO: 194664 - DNA, 25 bp, Mus musculus
agcgagcactcaggagttttgggaa

SEQ ID NO: 194665 - DNA, 25 bp, Mus musculus
agcgagcagccatgatgagtctcct

SEQ ID NO: 194666 - DNA, 25 bp, Mus musculus
agcgagcagggcgtaagaacaagag

SEQ ID NO: 194667 - DNA, 25 bp, Mus musculus
agcgagcccagcaggaagatgcatt

SEQ ID NO: 194668 - DNA, 25 bp, Mus musculus
agcgagcccaggcaagaagacagca

SEQ ID NO: 194669 - DNA, 25 bp, Mus musculus
agcgagccgagctgtcacgaccgga

SEQ ID NO: 194670 - DNA, 25 bp, Mus musculus
agcgagcgaagagagcaaagaccat

SEQ ID NO: 194671 - DNA, 25 bp, Mus musculus
agcgagcgagtggtgatcatgtgtg

SEQ ID NO: 194672 - DNA, 25 bp, Mus musculus
agcgagcgcggggccgcaagcagtg

SEQ ID NO: 194673 - DNA, 25 bp, Mus musculus
agcgagcggggtgctgagttctgta

SEQ ID NO: 194674 - DNA, 25 bp, Mus musculus
agcgagcggtcctaacatttaaaaa

SEQ ID NO: 194675 - DNA, 25 bp, Mus musculus
agcgagcggtcctagtcttctcagt

SEQ ID NO: 194676 - DNA, 25 bp, Mus musculus
agcgagctgaaattctgtcccctct

SEQ ID NO: 194677 - DNA, 25 bp, Mus musculus
agcgagcttaaagatcgatcccgca

SEQ ID NO: 194678 - DNA, 25 bp, Mus musculus
agcgaggaaacaggcactctcgatt

SEQ ID NO: 194679 - DNA, 25 bp, Mus musculus
agcgaggaagatgaggacgatgtgc

SEQ ID NO: 194680 - DNA, 25 bp, Mus musculus
agcgaggaaggcacctgatgcagta

SEQ ID NO: 194681 - DNA, 25 bp, Mus musculus
agcgaggaagggatcgcttacactt

SEQ ID NO: 194682 - DNA, 25 bp, Mus musculus
agcgaggacagaaccatccgagtat

SEQ ID NO: 194683 - DNA, 25 bp, Mus musculus
agcgaggacagccccttgctctgcc

SEQ ID NO: 194684 - DNA, 25 bp, Mus musculus
agcgaggacgggctgtccttgttgg

SEQ ID NO: 194685 - DNA, 25 bp, Mus musculus
agcgaggactgcaagctaccttgca

SEQ ID NO: 194686 - DNA, 25 bp, Mus musculus
agcgaggactgcaagctgccctgca

SEQ ID NO: 194687 - DNA, 25 bp, Mus musculus
agcgaggaggagctggagcacagcc

SEQ ID NO: 194688 - DNA, 25 bp, Mus musculus
agcgaggatggtcatgaaagtccac

SEQ ID NO: 194689 - DNA, 25 bp, Mus musculus
agcgaggcagttgttctccatggcc

SEQ ID NO: 194690 - DNA, 25 bp, Mus musculus
agcgaggccaggcgggctgggaagg

SEQ ID NO: 194691 - DNA, 25 bp, Mus musculus
agcgaggccctggtcacaggctctc

SEQ ID NO: 194692 - DNA, 25 bp, Mus musculus
agcgaggccctggtcacaggctctg

SEQ ID NO: 194693 - DNA, 25 bp, Mus musculus
agcgaggccgagatctgtcgcttta

SEQ ID NO: 194694 - DNA, 25 bp, Mus musculus
agcgaggccgaggttgcttcctaga

SEQ ID NO: 194695 - DNA, 25 bp, Mus musculus
agcgaggcgagcgtgcacagtgctc

SEQ ID NO: 194696 - DNA, 25 bp, Mus musculus
agcgaggcgaggcaccatgacaacc

SEQ ID NO: 194697 - DNA, 25 bp, Mus musculus
agcgaggctccaagggatttggttt

SEQ ID NO: 194698 - DNA, 25 bp, Mus musculus
agcgaggctccaaggttaataatgc

SEQ ID NO: 194699 - DNA, 25 bp, Mus musculus
agcgaggctggaggcaccatgagcc

SEQ ID NO: 194700 - DNA, 25 bp, Mus musculus
agcgagggcgaggatcatctgtctg

SEQ ID NO: 194701 - DNA, 25 bp, Mus musculus
agcgagggcggcagacgccagtgct

SEQ ID NO: 194702 - DNA, 25 bp, Mus musculus
agcgaggggtgagctgaacccccgt

SEQ ID NO: 194703 - DNA, 25 bp, Mus musculus
agcgaggtaaagaaatccaccgtct

SEQ ID NO: 194704 - DNA, 25 bp, Mus musculus
agcgagtcagtaccatctgccagca

SEQ ID NO: 194705 - DNA, 25 bp, Mus musculus
agcgagtcgccggaggacacagagc

SEQ ID NO: 194706 - DNA, 25 bp, Mus musculus
agcgagtctttcaggaagaagacct

SEQ ID NO: 194707 - DNA, 25 bp, Mus musculus
agcgagtgactgtgtaacggagcac

SEQ ID NO: 194708 - DNA, 25 bp, Mus musculus
agcgagtggcagagttgcacagcaa

SEQ ID NO: 194709 - DNA, 25 bp, Mus musculus
agcgagttattaggatgcctggtgt

SEQ ID NO: 194710 - DNA, 25 bp, Mus musculus
agcgagttattaggcacatgactca

SEQ ID NO: 194711 - DNA, 25 bp, Mus musculus
agcgagttcaagaacctggacatca

SEQ ID NO: 194712 - DNA, 25 bp, Mus musculus
agcgagttcaagctgatcatggctc

SEQ ID NO: 194713 - DNA, 25 bp, Mus musculus
agcgagttcaagggcagagaacatg

SEQ ID NO: 194714 - DNA, 25 bp, Mus musculus
agcgatacgacgaaatggtggaatc

SEQ ID NO: 194715 - DNA, 25 bp, Mus musculus
agcgatacgacggttgaaactgagc

SEQ ID NO: 194716 - DNA, 25 bp, Mus musculus
agcgatcagaggaacaaggagccca

SEQ ID NO: 194717 - DNA, 25 bp, Mus musculus
agcgatccagtttgacgccgagttc

SEQ ID NO: 194718 - DNA, 25 bp, Mus musculus
agcgatcgcaggattgaaattccaa

SEQ ID NO: 194719 - DNA, 25 bp, Mus musculus
agcgatctggagccccgcaagtgcc

SEQ ID NO: 194720 - DNA, 25 bp, Mus musculus
agcgatctggagctgcagcgctcac

SEQ ID NO: 194721 - DNA, 25 bp, Mus musculus
agcgatgaagcagaactgcggacat

SEQ ID NO: 194722 - DNA, 25 bp, Mus musculus
agcgatgaagcagtatcaggaggaa

SEQ ID NO: 194723 - DNA, 25 bp, Mus musculus
agcgatgacgatagtggttccggaa

SEQ ID NO: 194724 - DNA, 25 bp, Mus musculus
agcgatgagaaagatgtctcaaccc

SEQ ID NO: 194725 - DNA, 25 bp, Mus musculus
agcgatgataactttgtgatgtctg

SEQ ID NO: 194726 - DNA, 25 bp, Mus musculus
agcgatgccatcgtgaccatgctca

SEQ ID NO: 194727 - DNA, 25 bp, Mus musculus
agcgatggaggtagaaaatcttctg

SEQ ID NO: 194728 - DNA, 25 bp, Mus musculus
agcgatggatcataattgggtttct

SEQ ID NO: 194729 - DNA, 25 bp, Mus musculus
agcgatgtactgaaggtctttgacg

SEQ ID NO: 194730 - DNA, 25 bp, Mus musculus
agcgatgtgtgatcttttggagtgc

SEQ ID NO: 194731 - DNA, 25 bp, Mus musculus
agcgattcaagaatttgcatcatga

SEQ ID NO: 194732 - DNA, 25 bp, Mus musculus
agcgattcaagagtgcactcttcct

SEQ ID NO: 194733 - DNA, 25 bp, Mus musculus
agcgattctcatcgcttttatgaaa

SEQ ID NO: 194734 - DNA, 25 bp, Mus musculus
agcgattctgaaggtgaagagattg

SEQ ID NO: 194735 - DNA, 25 bp, Mus musculus
agcgattggaagaaatcaagaagtt

SEQ ID NO: 194736 - DNA, 25 bp, Mus musculus
agcgattggaagaagaatgaagacc

SEQ ID NO: 194737 - DNA, 25 bp, Mus musculus
agcgatttccgggacctcatgtctt

SEQ ID NO: 194738 - DNA, 25 bp, Mus musculus
agcgcaaactgggcaaacgctacaa

SEQ ID NO: 194739 - DNA, 25 bp, Mus musculus
agcgcaacaggtcacctggaggaag

SEQ ID NO: 194740 - DNA, 25 bp, Mus musculus
agcgcaaccaggcccaggagggtga

SEQ ID NO: 194741 - DNA, 25 bp, Mus musculus
agcgcaactcagatggctccagatg

SEQ ID NO: 194742 - DNA, 25 bp, Mus musculus
agcgcaactcaggctgactccccta

SEQ ID NO: 194743 - DNA, 25 bp, Mus musculus
agcgcaagtattttccgccaagagc

SEQ ID NO: 194744 - DNA, 25 bp, Mus musculus
agcgcaagttcacagatgtgacctt

SEQ ID NO: 194745 - DNA, 25 bp, Mus musculus
agcgcaccagagaatccgtgaccta

SEQ ID NO: 194746 - DNA, 25 bp, Mus musculus
agcgcacctacgggctgactcctca

SEQ ID NO: 194747 - DNA, 25 bp, Mus musculus
agcgcacctgaggggaagattgctg

SEQ ID NO: 194748 - DNA, 25 bp, Mus musculus
agcgcacctggtgattttacccaaa

SEQ ID NO: 194749 - DNA, 25 bp, Mus musculus
agcgcacgaccggtggcttgttggc

SEQ ID NO: 194750 - DNA, 25 bp, Mus musculus
agcgcacgtgcatagatacctgctg

SEQ ID NO: 194751 - DNA, 25 bp, Mus musculus
agcgcactctgagatcttggcatat

SEQ ID NO: 194752 - DNA, 25 bp, Mus musculus
agcgcactgtcagatgtagaaatcc

SEQ ID NO: 194753 - DNA, 25 bp, Mus musculus
agcgcactgtcaggtaaatccattt

SEQ ID NO: 194754 - DNA, 25 bp, Mus musculus
agcgcagaaggctgagaccgctgcc

SEQ ID NO: 194755 - DNA, 25 bp, Mus musculus
agcgcagacatggcggagtcttctg

SEQ ID NO: 194756 - DNA, 25 bp, Mus musculus
agcgcagagctagaggtcacctgga

SEQ ID NO: 194757 - DNA, 25 bp, Mus musculus
agcgcagaggctggggacagtactt

SEQ ID NO: 194758 - DNA, 25 bp, Mus musculus
agcgcagcaaggtgtatgatgaaaa

SEQ ID NO: 194759 - DNA, 25 bp, Mus musculus
agcgcagcagggaagttggggggac

SEQ ID NO: 194760 - DNA, 25 bp, Mus musculus
agcgcagcataatgctaaagaagta

SEQ ID NO: 194761 - DNA, 25 bp, Mus musculus
agcgcagccatggagccccgcgcga

SEQ ID NO: 194762 - DNA, 25 bp, Mus musculus
agcgcagctcgaacgatcgccgggg

SEQ ID NO: 194763 - DNA, 25 bp, Mus musculus
agcgcagcttgggatcctggtatct

SEQ ID NO: 194764 - DNA, 25 bp, Mus musculus
agcgcaggaagccagcgagtcatcc

SEQ ID NO: 194765 - DNA, 25 bp, Mus musculus
agcgcagggacttacaaagagcttt

SEQ ID NO: 194766 - DNA, 25 bp, Mus musculus
agcgcagggagcgagagtgtgaaca

SEQ ID NO: 194767 - DNA, 25 bp, Mus musculus
agcgcagtatcacagcctgaagctg

SEQ ID NO: 194768 - DNA, 25 bp, Mus musculus
agcgcagtgacgtgggctggcgctt

SEQ ID NO: 194769 - DNA, 25 bp, Mus musculus
agcgcagtgggagatttgaaaaatt

SEQ ID NO: 194770 - DNA, 25 bp, Mus musculus
agcgcagtgtgaaactggcccagga

SEQ ID NO: 194771 - DNA, 25 bp, Mus musculus
agcgcagtgttgcatgatcaaaagg

SEQ ID NO: 194772 - DNA, 25 bp, Mus musculus
agcgcatcaagacccttcgcaggtg

SEQ ID NO: 194773 - DNA, 25 bp, Mus musculus
agcgcatcaaggagctggagtcaga

SEQ ID NO: 194774 - DNA, 25 bp, Mus musculus
agcgcatcaaggggatatctagttg

SEQ ID NO: 194775 - DNA, 25 bp, Mus musculus
agcgcatcagctgcagttaaagcaa

SEQ ID NO: 194776 - DNA, 25 bp, Mus musculus
agcgcatcagtttagtgctgacagt

SEQ ID NO: 194777 - DNA, 25 bp, Mus musculus
agcgcatcggcaagctggtcgtttg

SEQ ID NO: 194778 - DNA, 25 bp, Mus musculus
agcgcatcgtgaaggagatgctccg

SEQ ID NO: 194779 - DNA, 25 bp, Mus musculus
agcgcatctgtgagatggcagccta

SEQ ID NO: 194780 - DNA, 25 bp, Mus musculus
agcgcatgaaagggtctggtgagaa

SEQ ID NO: 194781 - DNA, 25 bp, Mus musculus
agcgcatgaggagccgagaggatga

SEQ ID NO: 194782 - DNA, 25 bp, Mus musculus
agcgcatgcagagcagggtgggcca

SEQ ID NO: 194783 - DNA, 25 bp, Mus musculus
agcgcatggtgcagtctgttgtcta

SEQ ID NO: 194784 - DNA, 25 bp, Mus musculus
agcgcattaggcggtgggtctcgga

SEQ ID NO: 194785 - DNA, 25 bp, Mus musculus
agcgcattagggccaatgaggcgag

SEQ ID NO: 194786 - DNA, 25 bp, Mus musculus
agcgcatttaaatcgttctgatgaa

SEQ ID NO: 194787 - DNA, 25 bp, Mus musculus
agcgcattttcacagggaacaagtt

SEQ ID NO: 194788 - DNA, 25 bp, Mus musculus
agcgccaagtgagagtcagcttgcg

SEQ ID NO: 194789 - DNA, 25 bp, Mus musculus
agcgccacaggcatggggaggattc

SEQ ID NO: 194790 - DNA, 25 bp, Mus musculus
agcgccaccccctgctcctgctgct

SEQ ID NO: 194791 - DNA, 25 bp, Mus musculus
agcgccacgcttagactagctgtgt

SEQ ID NO: 194792 - DNA, 25 bp, Mus musculus
agcgccagagccggtggcggtggga

SEQ ID NO: 194793 - DNA, 25 bp, Mus musculus
agcgccagaggcaggcaatgataca

SEQ ID NO: 194794 - DNA, 25 bp, Mus musculus
agcgccagaggcaggtaacctcggc

SEQ ID NO: 194795 - DNA, 25 bp, Mus musculus
agcgccatcagcgaggctgctgcgc

SEQ ID NO: 194796 - DNA, 25 bp, Mus musculus
agcgccatcatcagatggcaaggtc

SEQ ID NO: 194797 - DNA, 25 bp, Mus musculus
agcgccatcatcagctctaggagtt

SEQ ID NO: 194798 - DNA, 25 bp, Mus musculus
agcgccattgaagtgtggggctttg

SEQ ID NO: 194799 - DNA, 25 bp, Mus musculus
agcgcccagtctgatacacttttgg

SEQ ID NO: 194800 - DNA, 25 bp, Mus musculus
agcgccccagcagatggtaacaaaa

SEQ ID NO: 194801 - DNA, 25 bp, Mus musculus
agcgcccgagcagcttggccgacag

SEQ ID NO: 194802 - DNA, 25 bp, Mus musculus
agcgcccgcgatgactgccactctc

SEQ ID NO: 194803 - DNA, 25 bp, Mus musculus
agcgcccgcgcgggtcgcccaatga

SEQ ID NO: 194804 - DNA, 25 bp, Mus musculus
agcgccctgagctggacaagtgacg

SEQ ID NO: 194805 - DNA, 25 bp, Mus musculus
agcgccctgccaagattttcacctg

SEQ ID NO: 194806 - DNA, 25 bp, Mus musculus
agcgccgaggcccagcgatccctct

SEQ ID NO: 194807 - DNA, 25 bp, Mus musculus
agcgccgaggcccaggtcagtctgg

SEQ ID NO: 194808 - DNA, 25 bp, Mus musculus
agcgccgagtgcagagagcaaagac

SEQ ID NO: 194809 - DNA, 25 bp, Mus musculus
agcgccgcacaggtcccacacagca

SEQ ID NO: 194810 - DNA, 25 bp, Mus musculus
agcgccgccagctcgtatgaaaatc

SEQ ID NO: 194811 - DNA, 25 bp, Mus musculus
agcgccgccgctggagagatgtctg

SEQ ID NO: 194812 - DNA, 25 bp, Mus musculus
agcgccggaggactgcatgagtttc

SEQ ID NO: 194813 - DNA, 25 bp, Mus musculus
agcgccgggagccggcaggcatgcc

SEQ ID NO: 194814 - DNA, 25 bp, Mus musculus
agcgccgtgcagaagaatgccacca

SEQ ID NO: 194815 - DNA, 25 bp, Mus musculus
agcgcctacaacagccggagagacc

SEQ ID NO: 194816 - DNA, 25 bp, Mus musculus
agcgcctagttgaaggaatttgaca

SEQ ID NO: 194817 - DNA, 25 bp, Mus musculus
agcgcctcatcgggggcacagagat

SEQ ID NO: 194818 - DNA, 25 bp, Mus musculus
agcgcctcatcgtggattactcctg

SEQ ID NO: 194819 - DNA, 25 bp, Mus musculus
agcgcctctggagttagtgagcttt

SEQ ID NO: 194820 - DNA, 25 bp, Mus musculus
agcgcctctggtgacagagtgccac

SEQ ID NO: 194821 - DNA, 25 bp, Mus musculus
agcgcctctgtcttgttttcagact

SEQ ID NO: 194822 - DNA, 25 bp, Mus musculus
agcgcctgagtacagacgtgacttg

SEQ ID NO: 194823 - DNA, 25 bp, Mus musculus
agcgcctgcaggcttttgaggctcc

SEQ ID NO: 194824 - DNA, 25 bp, Mus musculus
agcgcctgcaggggctccctccaga

SEQ ID NO: 194825 - DNA, 25 bp, Mus musculus
agcgcctggagcatgcagccaagca

SEQ ID NO: 194826 - DNA, 25 bp, Mus musculus
agcgcctggccataggcttcttccc

SEQ ID NO: 194827 - DNA, 25 bp, Mus musculus
agcgcctgtgtcaggagcatatgca

SEQ ID NO: 194828 - DNA, 25 bp, Mus musculus
agcgccttccctcaggacatcaatg

SEQ ID NO: 194829 - DNA, 25 bp, Mus musculus
agcgccttccctcaggtgtcagatc

SEQ ID NO: 194830 - DNA, 25 bp, Mus musculus
agcgccttctttcaggaaatgctgt

SEQ ID NO: 194831 - DNA, 25 bp, Mus musculus
agcgcctttctttagtgtacactct

SEQ ID NO: 194832 - DNA, 25 bp, Mus musculus
agcgcgagcgagcgtgacctacagc

SEQ ID NO: 194833 - DNA, 25 bp, Mus musculus
agcgcgcaccgggttacacaataaa

SEQ ID NO: 194834 - DNA, 25 bp, Mus musculus
agcgcgccaagagaaaattcaggac

SEQ ID NO: 194835 - DNA, 25 bp, Mus musculus
agcgcgccaagagacgaggatggcc

SEQ ID NO: 194836 - DNA, 25 bp, Mus musculus
agcgcgccctggccaacagcctcgc

SEQ ID NO: 194837 - DNA, 25 bp, Mus musculus
agcgcgcctttaaagtgaaggacac

SEQ ID NO: 194838 - DNA, 25 bp, Mus musculus
agcgcgcggacagagacactgtact

SEQ ID NO: 194839 - DNA, 25 bp, Mus musculus
agcgcgcggccaggtgagttggagt

SEQ ID NO: 194840 - DNA, 25 bp, Mus musculus
agcgcgctcaagaatttgtcttcgg

SEQ ID NO: 194841 - DNA, 25 bp, Mus musculus
agcgcgctttgagggcctgaagaag

SEQ ID NO: 194842 - DNA, 25 bp, Mus musculus
agcgcggatgacaacctcaagtctt

SEQ ID NO: 194843 - DNA, 25 bp, Mus musculus
agcgcggatgggtaactcgtcctca

SEQ ID NO: 194844 - DNA, 25 bp, Mus musculus
agcgcggcaggccgcggtagcgggt

SEQ ID NO: 194845 - DNA, 25 bp, Mus musculus
agcgcggcagtggagctggcctgaa

SEQ ID NO: 194846 - DNA, 25 bp, Mus musculus
agcgcggcggaggttgccccggagg

SEQ ID NO: 194847 - DNA, 25 bp, Mus musculus
agcgcggctctcaagcagaaaaatg

SEQ ID NO: 194848 - DNA, 25 bp, Mus musculus
agcgcggctctcaaggaggccaaag

SEQ ID NO: 194849 - DNA, 25 bp, Mus musculus
agcgcgggccggtgtacattggtga

SEQ ID NO: 194850 - DNA, 25 bp, Mus musculus
agcgcggggagatggtggcctggag

SEQ ID NO: 194851 - DNA, 25 bp, Mus musculus
agcgcggggcaaggaggaggagttt

SEQ ID NO: 194852 - DNA, 25 bp, Mus musculus
agcgcggggcaagtgtggtccccgc

SEQ ID NO: 194853 - DNA, 25 bp, Mus musculus
agcgcggggccgcaagcagtgcaag

SEQ ID NO: 194854 - DNA, 25 bp, Mus musculus
agcgcggggtcagcacatggtttgg

SEQ ID NO: 194855 - DNA, 25 bp, Mus musculus
agcgcgtctcagggaactgagccgt

SEQ ID NO: 194856 - DNA, 25 bp, Mus musculus
agcgctaagaggatccagaaggagc

SEQ ID NO: 194857 - DNA, 25 bp, Mus musculus
agcgctacaaagatgagcgggaccg

SEQ ID NO: 194858 - DNA, 25 bp, Mus musculus
agcgctacataaggtatctttccga

SEQ ID NO: 194859 - DNA, 25 bp, Mus musculus
agcgctacattgcccccacagtgct

SEQ ID NO: 194860 - DNA, 25 bp, Mus musculus
agcgctacattggtcatcaaacagg

SEQ ID NO: 194861 - DNA, 25 bp, Mus musculus
agcgctacctccttctggccggggc

SEQ ID NO: 194862 - DNA, 25 bp, Mus musculus
agcgctatgagaaaattattttcgc

SEQ ID NO: 194863 - DNA, 25 bp, Mus musculus
agcgctatgagaaattactcttctg

SEQ ID NO: 194864 - DNA, 25 bp, Mus musculus
agcgctcacgggaaccagtgacctt

SEQ ID NO: 194865 - DNA, 25 bp, Mus musculus
agcgctcagatccgtatgtaaagac

SEQ ID NO: 194866 - DNA, 25 bp, Mus musculus
agcgctccggaccctggctgggcat

SEQ ID NO: 194867 - DNA, 25 bp, Mus musculus
agcgctcctcgagggcataacctgg

SEQ ID NO: 194868 - DNA, 25 bp, Mus musculus
agcgctcctggcaggaaggcctgcg

SEQ ID NO: 194869 - DNA, 25 bp, Mus musculus
agcgctctacaggggaggtggatgc

SEQ ID NO: 194870 - DNA, 25 bp, Mus musculus
agcgctctctgctgacctatgagga

SEQ ID NO: 194871 - DNA, 25 bp, Mus musculus
agcgctctctgctgagtctgaagat

SEQ ID NO: 194872 - DNA, 25 bp, Mus musculus
agcgctctgcgaccagctcccaagt

SEQ ID NO: 194873 - DNA, 25 bp, Mus musculus
agcgctctgtgttagcggggtgcca

SEQ ID NO: 194874 - DNA, 25 bp, Mus musculus
agcgctcttctgttatgttcttgct

SEQ ID NO: 194875 - DNA, 25 bp, Mus musculus
agcgctcttttttgctggatagaga

SEQ ID NO: 194876 - DNA, 25 bp, Mus musculus
agcgctgacaggtacagagctatcg

SEQ ID NO: 194877 - DNA, 25 bp, Mus musculus
agcgctgactttgagaaacggaagc

SEQ ID NO: 194878 - DNA, 25 bp, Mus musculus
agcgctgactttggcctgcatgagg

SEQ ID NO: 194879 - DNA, 25 bp, Mus musculus
agcgctgcaacaatgaatggcatgc

SEQ ID NO: 194880 - DNA, 25 bp, Mus musculus
agcgctgcaacaatggcgccccctg

SEQ ID NO: 194881 - DNA, 25 bp, Mus musculus
agcgctgcagctattatctggaaag

SEQ ID NO: 194882 - DNA, 25 bp, Mus musculus
agcgctgccagccggaacagtgagc

SEQ ID NO: 194883 - DNA, 25 bp, Mus musculus
agcgctgcccgggatctccatcttt

SEQ ID NO: 194884 - DNA, 25 bp, Mus musculus
agcgctgcctcagagcccaccgcaa

SEQ ID NO: 194885 - DNA, 25 bp, Mus musculus
agcgctgcggcgtggagcaaaacaa

SEQ ID NO: 194886 - DNA, 25 bp, Mus musculus
agcgctgctgaggagaatgcggagg

SEQ ID NO: 194887 - DNA, 25 bp, Mus musculus
agcgctgcttcagagatgagtgaaa

SEQ ID NO: 194888 - DNA, 25 bp, Mus musculus
agcgctgcttcagcacctctgggag

SEQ ID NO: 194889 - DNA, 25 bp, Mus musculus
agcgctggacgggtggagtgtcatc

SEQ ID NO: 194890 - DNA, 25 bp, Mus musculus
agcgctggagcgaccgccaggctcc

SEQ ID NO: 194891 - DNA, 25 bp, Mus musculus
agcgctgggcagggagatctgacgg

SEQ ID NO: 194892 - DNA, 25 bp, Mus musculus
agcgctgggtgaaagtgttgacagc

SEQ ID NO: 194893 - DNA, 25 bp, Mus musculus
agcgctgggtggagaaaaatgtttt

SEQ ID NO: 194894 - DNA, 25 bp, Mus musculus
agcgctgtcttcgagagaaaagttg

SEQ ID NO: 194895 - DNA, 25 bp, Mus musculus
agcgctgtcttcggctcttcatagc

SEQ ID NO: 194896 - DNA, 25 bp, Mus musculus
agcgctgtgcaggggagcaccgcgg

SEQ ID NO: 194897 - DNA, 25 bp, Mus musculus
agcgcttcaacagggccatggagga

SEQ ID NO: 194898 - DNA, 25 bp, Mus musculus
agcgcttcagcaccgcacagtgtgt

SEQ ID NO: 194899 - DNA, 25 bp, Mus musculus
agcgcttcagggagcgacaggcagg

SEQ ID NO: 194900 - DNA, 25 bp, Mus musculus
agcgcttccggtcagatgttcacac

SEQ ID NO: 194901 - DNA, 25 bp, Mus musculus
agcgcttcggagaagatgtggaccc

SEQ ID NO: 194902 - DNA, 25 bp, Mus musculus
agcgcttcggagaaggcctcctgcc

SEQ ID NO: 194903 - DNA, 25 bp, Mus musculus
agcgcttctcccacagtgcgtgcta

SEQ ID NO: 194904 - DNA, 25 bp, Mus musculus
agcgcttggaaaagcacttggagct

SEQ ID NO: 194905 - DNA, 25 bp, Mus musculus
agcgcttggaaaagtgctcatgacc

SEQ ID NO: 194906 - DNA, 25 bp, Mus musculus
agcgctttcaagctcctgctgaacc

SEQ ID NO: 194907 - DNA, 25 bp, Mus musculus
agcgctttcaggcccgcacaggcgc

SEQ ID NO: 194908 - DNA, 25 bp, Mus musculus
agcgctttggagctgtgtgtgggag

SEQ ID NO: 194909 - DNA, 25 bp, Mus musculus
agcgctttgtgcaggcccagaggaa

SEQ ID NO: 194910 - DNA, 25 bp, Mus musculus
agcggaaactcacaggctaagctcg

SEQ ID NO: 194911 - DNA, 25 bp, Mus musculus
agcggaaactggatcgcttcaagca

SEQ ID NO: 194912 - DNA, 25 bp, Mus musculus
agcggaaagtgcgagacggtcgcag

SEQ ID NO: 194913 - DNA, 25 bp, Mus musculus
agcggaaagtgcgaggagatgctca

SEQ ID NO: 194914 - DNA, 25 bp, Mus musculus
agcggaaatatccagagcgacgaga

SEQ ID NO: 194915 - DNA, 25 bp, Mus musculus
agcggaaatatccagatttagagcg

SEQ ID NO: 194916 - DNA, 25 bp, Mus musculus
agcggaaccgacaaaggttacctga

SEQ ID NO: 194917 - DNA, 25 bp, Mus musculus
agcggaaccgcttcttcacttgtct

SEQ ID NO: 194918 - DNA, 25 bp, Mus musculus
agcggaaccggacgccctggcctct

SEQ ID NO: 194919 - DNA, 25 bp, Mus musculus
agcggaagagccccagcgggaagaa

SEQ ID NO: 194920 - DNA, 25 bp, Mus musculus
agcggaagcatggaaactagagaga

SEQ ID NO: 194921 - DNA, 25 bp, Mus musculus
agcggaagcgagtgggcgtgtggaa

SEQ ID NO: 194922 - DNA, 25 bp, Mus musculus
agcggaagggaagggatgcatgggc

SEQ ID NO: 194923 - DNA, 25 bp, Mus musculus
agcggaagggaagggctcgggtccg

SEQ ID NO: 194924 - DNA, 25 bp, Mus musculus
agcggaatagagggaaacaggccac

SEQ ID NO: 194925 - DNA, 25 bp, Mus musculus
agcggacaaagcagatctgcaggtg

SEQ ID NO: 194926 - DNA, 25 bp, Mus musculus
agcggacaaagcagcttccaggagc

SEQ ID NO: 194927 - DNA, 25 bp, Mus musculus
agcggacaaagcaggggtcgggtca

SEQ ID NO: 194928 - DNA, 25 bp, Mus musculus
agcggacaagtattccaccaaagag

SEQ ID NO: 194929 - DNA, 25 bp, Mus musculus
agcggacatcatggagtatgctgtg

SEQ ID NO: 194930 - DNA, 25 bp, Mus musculus
agcggacatgtcagtggaaacctct

SEQ ID NO: 194931 - DNA, 25 bp, Mus musculus
agcggacccagttcagcttgctcag

SEQ ID NO: 194932 - DNA, 25 bp, Mus musculus
agcggaccgaggacttgtgtgagga

SEQ ID NO: 194933 - DNA, 25 bp, Mus musculus
agcggactcagacggtcagcgtcaa

SEQ ID NO: 194934 - DNA, 25 bp, Mus musculus
agcggactctgggagtctgtcccag

SEQ ID NO: 194935 - DNA, 25 bp, Mus musculus
agcggactggcttttatgaaacaga

SEQ ID NO: 194936 - DNA, 25 bp, Mus musculus
agcggactgtgacaggcatcatagc

SEQ ID NO: 194937 - DNA, 25 bp, Mus musculus
agcggagaagagaatacagacagat

SEQ ID NO: 194938 - DNA, 25 bp, Mus musculus
agcggagaagaggaattcatgaagt

SEQ ID NO: 194939 - DNA, 25 bp, Mus musculus
agcggagaagtcaggttccaaggag

SEQ ID NO: 194940 - DNA, 25 bp, Mus musculus
agcggagaagtggatgtcgcgtgga

SEQ ID NO: 194941 - DNA, 25 bp, Mus musculus
agcggagaagtggtgaaggccttgg

SEQ ID NO: 194942 - DNA, 25 bp, Mus musculus
agcggagagaggtcttatcagctgc

SEQ ID NO: 194943 - DNA, 25 bp, Mus musculus
agcggagagcaagactggtagtggc

SEQ ID NO: 194944 - DNA, 25 bp, Mus musculus
agcggagagcgacatgtccttccga

SEQ ID NO: 194945 - DNA, 25 bp, Mus musculus
agcggagatgtacggttcctcattt

SEQ ID NO: 194946 - DNA, 25 bp, Mus musculus
agcggagcaactgaagactcaggac

SEQ ID NO: 194947 - DNA, 25 bp, Mus musculus
agcggagcagattgaggacataaac

SEQ ID NO: 194948 - DNA, 25 bp, Mus musculus
agcggagcaggaaggagatgactca

SEQ ID NO: 194949 - DNA, 25 bp, Mus musculus
agcggagccaacatcaacagaatca

SEQ ID NO: 194950 - DNA, 25 bp, Mus musculus
agcggagccagcaagccccgcccaa

SEQ ID NO: 194951 - DNA, 25 bp, Mus musculus
agcggagccccatcttgatatggaa

SEQ ID NO: 194952 - DNA, 25 bp, Mus musculus
agcggaggaaggagctaactctccc

SEQ ID NO: 194953 - DNA, 25 bp, Mus musculus
agcggaggaagtccttccgaggttg

SEQ ID NO: 194954 - DNA, 25 bp, Mus musculus
agcggaggaggttgtaagcatcaat

SEQ ID NO: 194955 - DNA, 25 bp, Mus musculus
agcggaggataggtcggccagtgag

SEQ ID NO: 194956 - DNA, 25 bp, Mus musculus
agcggaggcaggcaaaacccacggt

SEQ ID NO: 194957 - DNA, 25 bp, Mus musculus
agcggagtgttggtaactaaatgac

SEQ ID NO: 194958 - DNA, 25 bp, Mus musculus
agcggagttgagattcccaccctgc

SEQ ID NO: 194959 - DNA, 25 bp, Mus musculus
agcggataacaggctgaccacagtg

SEQ ID NO: 194960 - DNA, 25 bp, Mus musculus
agcggataccaaactgttttctgga

SEQ ID NO: 194961 - DNA, 25 bp, Mus musculus
agcggatactgtaaggtatgtcact

SEQ ID NO: 194962 - DNA, 25 bp, Mus musculus
agcggatactgtaagtgagggagct

SEQ ID NO: 194963 - DNA, 25 bp, Mus musculus
agcggatatgaccaagttttacagg

SEQ ID NO: 194964 - DNA, 25 bp, Mus musculus
agcggatatggtagccaaggagcag

SEQ ID NO: 194965 - DNA, 25 bp, Mus musculus
agcggatccgggagcctgagccttt

SEQ ID NO: 194966 - DNA, 25 bp, Mus musculus
agcggatcctgagagaaggctttgg

SEQ ID NO: 194967 - DNA, 25 bp, Mus musculus
agcggatgctcacggaacgaatgtt

SEQ ID NO: 194968 - DNA, 25 bp, Mus musculus
agcggcaaaacccaggcaagtgctc

SEQ ID NO: 194969 - DNA, 25 bp, Mus musculus
agcggcaaaagagctttatggattt

SEQ ID NO: 194970 - DNA, 25 bp, Mus musculus
agcggcaaaagagtgatagaaggaa

SEQ ID NO: 194971 - DNA, 25 bp, Mus musculus
agcggcaacctggcctctagacgtc

SEQ ID NO: 194972 - DNA, 25 bp, Mus musculus
agcggcacggcggagggaggaaata

SEQ ID NO: 194973 - DNA, 25 bp, Mus musculus
agcggcacggcgggagtcagcattg

SEQ ID NO: 194974 - DNA, 25 bp, Mus musculus
agcggcacggcggggatcccactgc

SEQ ID NO: 194975 - DNA, 25 bp, Mus musculus
agcggcacggcgggtttcaaatgat

SEQ ID NO: 194976 - DNA, 25 bp, Mus musculus
agcggcagaggagaaccctcttggc

SEQ ID NO: 194977 - DNA, 25 bp, Mus musculus
agcggcagcaggaacggagcacctc

SEQ ID NO: 194978 - DNA, 25 bp, Mus musculus
agcggcagcagggccgggagcaggc

SEQ ID NO: 194979 - DNA, 25 bp, Mus musculus
agcggcagccagcaccagctgctct

SEQ ID NO: 194980 - DNA, 25 bp, Mus musculus
agcggcagccaggacatagtcacat

SEQ ID NO: 194981 - DNA, 25 bp, Mus musculus
agcggcagccagggaacatctcaag

SEQ ID NO: 194982 - DNA, 25 bp, Mus musculus
agcggcagccaggtgcagggcagtc

SEQ ID NO: 194983 - DNA, 25 bp, Mus musculus
agcggcagccaggtgggatgctatg

SEQ ID NO: 194984 - DNA, 25 bp, Mus musculus
agcggcagctgctgaccctgagcaa

SEQ ID NO: 194985 - DNA, 25 bp, Mus musculus
agcggcaggtaactgtagctgtctt

SEQ ID NO: 194986 - DNA, 25 bp, Mus musculus
agcggcagtagagtcagatacagag

SEQ ID NO: 194987 - DNA, 25 bp, Mus musculus
agcggccaaggatccatctgcagtt

SEQ ID NO: 194988 - DNA, 25 bp, Mus musculus
agcggccacagccccactccacagc

SEQ ID NO: 194989 - DNA, 25 bp, Mus musculus
agcggccacaggccactgcagagca

SEQ ID NO: 194990 - DNA, 25 bp, Mus musculus
agcggccacggcagggttaacctct

SEQ ID NO: 194991 - DNA, 25 bp, Mus musculus
agcggccagtcagaatacagtttgg

SEQ ID NO: 194992 - DNA, 25 bp, Mus musculus
agcggcccagcgtccgatgcaagcc

SEQ ID NO: 194993 - DNA, 25 bp, Mus musculus
agcggcccaggcccaccctgcaact

SEQ ID NO: 194994 - DNA, 25 bp, Mus musculus
agcggcccaggcccattattgtgat

SEQ ID NO: 194995 - DNA, 25 bp, Mus musculus
agcggcccatgtccatccctatcat

SEQ ID NO: 194996 - DNA, 25 bp, Mus musculus
agcggccgccagtctccacagaggc

SEQ ID NO: 194997 - DNA, 25 bp, Mus musculus
agcggccggaagatggcagactttc

SEQ ID NO: 194998 - DNA, 25 bp, Mus musculus
agcggccggaaggagtggaatgtga

SEQ ID NO: 194999 - DNA, 25 bp, Mus musculus
agcggccggaagtgttactgtgaca

SEQ ID NO: 195000 - DNA, 25 bp, Mus musculus
agcggccgggggaacacacccgtgc

SEQ ID NO: 195001 - DNA, 25 bp, Mus musculus
agcggccgtaaggattcacctgagg

SEQ ID NO: 195002 - DNA, 25 bp, Mus musculus
agcggccgtaagtttgctaactgtg

SEQ ID NO: 195003 - DNA, 25 bp, Mus musculus
agcggcctcaaggtctgaggcgtca

SEQ ID NO: 195004 - DNA, 25 bp, Mus musculus
agcggcctcaaggttggagaccaga

SEQ ID NO: 195005 - DNA, 25 bp, Mus musculus
agcggcctcaagtgaccttgcaagg

SEQ ID NO: 195006 - DNA, 25 bp, Mus musculus
agcggcctcactagtgttcccagga

SEQ ID NO: 195007 - DNA, 25 bp, Mus musculus
agcggcctcactatcagacatgcag

SEQ ID NO: 195008 - DNA, 25 bp, Mus musculus
agcggcctcaggtccattcagaagc

SEQ ID NO: 195009 - DNA, 25 bp, Mus musculus
agcggcctgagatccagagacaatg

SEQ ID NO: 195010 - DNA, 25 bp, Mus musculus
agcggcctggcccggacttagcatt

SEQ ID NO: 195011 - DNA, 25 bp, Mus musculus
agcggcgaggccccactcctgaaag

SEQ ID NO: 195012 - DNA, 25 bp, Mus musculus
agcggcgagtgggaaagacaagaaa

SEQ ID NO: 195013 - DNA, 25 bp, Mus musculus
agcggcgcagaaacatctgtggcca

SEQ ID NO: 195014 - DNA, 25 bp, Mus musculus
agcggcgcaggtgattcctcctaag

SEQ ID NO: 195015 - DNA, 25 bp, Mus musculus
agcggcgcaggttgccccggaggcc

SEQ ID NO: 195016 - DNA, 25 bp, Mus musculus
agcggcgccagccaggagcatagaa

SEQ ID NO: 195017 - DNA, 25 bp, Mus musculus
agcggcgcgggtccaacccagactt

SEQ ID NO: 195018 - DNA, 25 bp, Mus musculus
agcggcgcggtccccagagccagaa

SEQ ID NO: 195019 - DNA, 25 bp, Mus musculus
agcggcgctcagagatggagagaga

SEQ ID NO: 195020 - DNA, 25 bp, Mus musculus
agcggcgctggtacaaagtaagaaa

SEQ ID NO: 195021 - DNA, 25 bp, Mus musculus
agcggcggaagggttaccctcgatc

SEQ ID NO: 195022 - DNA, 25 bp, Mus musculus
agcggcggacagggagaatcccgta

SEQ ID NO: 195023 - DNA, 25 bp, Mus musculus
agcggcggaccgcagcagaagaagg

SEQ ID NO: 195024 - DNA, 25 bp, Mus musculus
agcggcggcagaaatgatggaagaa

SEQ ID NO: 195025 - DNA, 25 bp, Mus musculus
agcggcggccccggagaagatggag

SEQ ID NO: 195026 - DNA, 25 bp, Mus musculus
agcggcggcgggttaacttcggctg

SEQ ID NO: 195027 - DNA, 25 bp, Mus musculus
agcggcggcgggttggagttcaagg

SEQ ID NO: 195028 - DNA, 25 bp, Mus musculus
agcggcggtggtgtgccaagtgttt

SEQ ID NO: 195029 - DNA, 25 bp, Mus musculus
agcggcggtgtgatccattgtaggt

SEQ ID NO: 195030 - DNA, 25 bp, Mus musculus
agcggctacaggcggcaggaaatgc

SEQ ID NO: 195031 - DNA, 25 bp, Mus musculus
agcggctcagagcaatcaggaccga

SEQ ID NO: 195032 - DNA, 25 bp, Mus musculus
agcggctcagagctaccaggagccc

SEQ ID NO: 195033 - DNA, 25 bp, Mus musculus
agcggctcagaggaaagaataccca

SEQ ID NO: 195034 - DNA, 25 bp, Mus musculus
agcggctcaggatggcctcaggcaa

SEQ ID NO: 195035 - DNA, 25 bp, Mus musculus
agcggctcaggccctgcccatttct

SEQ ID NO: 195036 - DNA, 25 bp, Mus musculus
agcggctcaggttccagctacggtc

SEQ ID NO: 195037 - DNA, 25 bp, Mus musculus
agcggctccaaagagggctatgtgc

SEQ ID NO: 195038 - DNA, 25 bp, Mus musculus
agcggctccggaaaatccactgtgg

SEQ ID NO: 195039 - DNA, 25 bp, Mus musculus
agcggctccggaaactgctccccag

SEQ ID NO: 195040 - DNA, 25 bp, Mus musculus
agcggctcgtgcaagcgtgccaagt

SEQ ID NO: 195041 - DNA, 25 bp, Mus musculus
agcggctgacactagctgcagccga

SEQ ID NO: 195042 - DNA, 25 bp, Mus musculus
agcggctgacagaaggacatttgga

SEQ ID NO: 195043 - DNA, 25 bp, Mus musculus
agcggctgctcagagtatagaaata

SEQ ID NO: 195044 - DNA, 25 bp, Mus musculus
agcggctgctcaggtccaatcagca

SEQ ID NO: 195045 - DNA, 25 bp, Mus musculus
agcggctggtaaagctgtcctgcct

SEQ ID NO: 195046 - DNA, 25 bp, Mus musculus
agcggctgtatgtggacggatgacg

SEQ ID NO: 195047 - DNA, 25 bp, Mus musculus
agcggcttctgcacgcccctccagg

SEQ ID NO: 195048 - DNA, 25 bp, Mus musculus
agcgggaacaagagaataaaggccg

SEQ ID NO: 195049 - DNA, 25 bp, Mus musculus
agcgggaacaagagataaaactatt

SEQ ID NO: 195050 - DNA, 25 bp, Mus musculus
agcgggaagaatggaaaatgtttat

SEQ ID NO: 195051 - DNA, 25 bp, Mus musculus
agcgggaagctaagaaactgaggct

SEQ ID NO: 195052 - DNA, 25 bp, Mus musculus
agcgggaattggtctcggtgtgatt

SEQ ID NO: 195053 - DNA, 25 bp, Mus musculus
agcgggaattggtctgggcgtcatc

SEQ ID NO: 195054 - DNA, 25 bp, Mus musculus
agcgggaattggtcttggagttctt

SEQ ID NO: 195055 - DNA, 25 bp, Mus musculus
agcgggacaggtggtgtccctcagg

SEQ ID NO: 195056 - DNA, 25 bp, Mus musculus
agcgggacagtgacgttgcccgcca

SEQ ID NO: 195057 - DNA, 25 bp, Mus musculus
agcgggaccaagactccacttcagt

SEQ ID NO: 195058 - DNA, 25 bp, Mus musculus
agcgggaccaaggttatttcgtcat

SEQ ID NO: 195059 - DNA, 25 bp, Mus musculus
agcgggacgcaaaggaggaagccag

SEQ ID NO: 195060 - DNA, 25 bp, Mus musculus
agcgggagaagatggttggtaaagg

SEQ ID NO: 195061 - DNA, 25 bp, Mus musculus
agcgggagaaggctctgcaccccga

SEQ ID NO: 195062 - DNA, 25 bp, Mus musculus
agcgggagaaggctctgtccaacat

SEQ ID NO: 195063 - DNA, 25 bp, Mus musculus
agcgggagaaggttgatccaaaaga

SEQ ID NO: 195064 - DNA, 25 bp, Mus musculus
agcgggagagacagctttttcctgc

SEQ ID NO: 195065 - DNA, 25 bp, Mus musculus
agcgggagcacatcgactccagcac

SEQ ID NO: 195066 - DNA, 25 bp, Mus musculus
agcgggatctctaccagaagtggaa

SEQ ID NO: 195067 - DNA, 25 bp, Mus musculus
agcgggcaagtctgaccttcatcac

SEQ ID NO: 195068 - DNA, 25 bp, Mus musculus
agcgggcaagtctgccctgacggtg

SEQ ID NO: 195069 - DNA, 25 bp, Mus musculus
agcgggcaataatctatagaccatg

SEQ ID NO: 195070 - DNA, 25 bp, Mus musculus
agcgggcaccagtgagatcccattt

SEQ ID NO: 195071 - DNA, 25 bp, Mus musculus
agcgggcagagaggaactaggaagt

SEQ ID NO: 195072 - DNA, 25 bp, Mus musculus
agcgggcagagatgaacgggcttgc

SEQ ID NO: 195073 - DNA, 25 bp, Mus musculus
agcgggcagagtctgctcattgaat

SEQ ID NO: 195074 - DNA, 25 bp, Mus musculus
agcgggcagagttttatctttaagc

SEQ ID NO: 195075 - DNA, 25 bp, Mus musculus
agcgggcaggatcctcttcgctgtc

SEQ ID NO: 195076 - DNA, 25 bp, Mus musculus
agcgggcaggggcctccctgtggag

SEQ ID NO: 195077 - DNA, 25 bp, Mus musculus
agcgggcattgcagatggaaggatt

SEQ ID NO: 195078 - DNA, 25 bp, Mus musculus
agcgggcattgcagcgtgcaatgat

SEQ ID NO: 195079 - DNA, 25 bp, Mus musculus
agcgggccagctacgaatacatgcg

SEQ ID NO: 195080 - DNA, 25 bp, Mus musculus
agcgggccaggaatgagatcaggaa

SEQ ID NO: 195081 - DNA, 25 bp, Mus musculus
agcgggccctgacgatctgctggta

SEQ ID NO: 195082 - DNA, 25 bp, Mus musculus
agcgggccgagatgtggtgatctac

SEQ ID NO: 195083 - DNA, 25 bp, Mus musculus
agcgggccgaggttggatcatggta

SEQ ID NO: 195084 - DNA, 25 bp, Mus musculus
agcgggcgacaggaagaactaggaa

SEQ ID NO: 195085 - DNA, 25 bp, Mus musculus
agcgggcgacaggtggtttcactcc

SEQ ID NO: 195086 - DNA, 25 bp, Mus musculus
agcgggcgactcaggcaccatgagc

SEQ ID NO: 195087 - DNA, 25 bp, Mus musculus
agcgggcgggattcccgaagcccag

SEQ ID NO: 195088 - DNA, 25 bp, Mus musculus
agcgggctagcgcatttcagatctg

SEQ ID NO: 195089 - DNA, 25 bp, Mus musculus
agcggggagagccttttccagggct

SEQ ID NO: 195090 - DNA, 25 bp, Mus musculus
agcggggagaggggcgtagtggcaa

SEQ ID NO: 195091 - DNA, 25 bp, Mus musculus
agcggggccgtgaggaggataaaag

SEQ ID NO: 195092 - DNA, 25 bp, Mus musculus
agcggggccgtgaggtatccagctc

SEQ ID NO: 195093 - DNA, 25 bp, Mus musculus
agcggggctcacgagaatcatcatt

SEQ ID NO: 195094 - DNA, 25 bp, Mus musculus
agcggggctcacgtttcagatgagt

SEQ ID NO: 195095 - DNA, 25 bp, Mus musculus
agcggggctgcgaggggcatgaagg

SEQ ID NO: 195096 - DNA, 25 bp, Mus musculus
agcggggctgtggatctttccagaa

SEQ ID NO: 195097 - DNA, 25 bp, Mus musculus
agcgggggcagctccccaggcctca

SEQ ID NO: 195098 - DNA, 25 bp, Mus musculus
agcgggggcagctccccagtgaggt

SEQ ID NO: 195099 - DNA, 25 bp, Mus musculus
agcgggggcgcggtctggaagctga

SEQ ID NO: 195100 - DNA, 25 bp, Mus musculus
agcggggggaagtgggcacatacaa

SEQ ID NO: 195101 - DNA, 25 bp, Mus musculus
agcgggggtgagttgtcagtggggc

SEQ ID NO: 195102 - DNA, 25 bp, Mus musculus
agcggggtgagaaagaggagacaga

SEQ ID NO: 195103 - DNA, 25 bp, Mus musculus
agcggggtgtgggccctcccaggcc

SEQ ID NO: 195104 - DNA, 25 bp, Mus musculus
agcggggtgtggggatttcgcttta

SEQ ID NO: 195105 - DNA, 25 bp, Mus musculus
agcggggttacaaatagcacgctga

SEQ ID NO: 195106 - DNA, 25 bp, Mus musculus
agcggggttacaaatatgagctccc

SEQ ID NO: 195107 - DNA, 25 bp, Mus musculus
agcgggtaagcagttatgcctccac

SEQ ID NO: 195108 - DNA, 25 bp, Mus musculus
agcgggtcaagttacagatttggga

SEQ ID NO: 195109 - DNA, 25 bp, Mus musculus
agcgggtcaggtaaaacatcagaga

SEQ ID NO: 195110 - DNA, 25 bp, Mus musculus
agcgggtcaggtatatgcaccatcc

SEQ ID NO: 195111 - DNA, 25 bp, Mus musculus
agcgggtcaggtatggatgagcgtg

SEQ ID NO: 195112 - DNA, 25 bp, Mus musculus
agcgggtcattcagtacctcagtag

SEQ ID NO: 195113 - DNA, 25 bp, Mus musculus
agcgggtcattcagtagtaacagat

SEQ ID NO: 195114 - DNA, 25 bp, Mus musculus
agcgggttgctgaggacaggacccg

SEQ ID NO: 195115 - DNA, 25 bp, Mus musculus
agcgggtttcgacttctcgccgagg

SEQ ID NO: 195116 - DNA, 25 bp, Mus musculus
agcgggtttgggtctgtacacatga

SEQ ID NO: 195117 - DNA, 25 bp, Mus musculus
agcggtaactcgatcccgtactctt

SEQ ID NO: 195118 - DNA, 25 bp, Mus musculus
agcggtagaggcaagagcttcactc

SEQ ID NO: 195119 - DNA, 25 bp, Mus musculus
agcggtagagggagttgcatggtgg

SEQ ID NO: 195120 - DNA, 25 bp, Mus musculus
agcggtaggagggaactgagccgtg

SEQ ID NO: 195121 - DNA, 25 bp, Mus musculus
agcggtcactcagctcacagtggta

SEQ ID NO: 195122 - DNA, 25 bp, Mus musculus
agcggtccatgagcaatggcaacag

SEQ ID NO: 195123 - DNA, 25 bp, Mus musculus
agcggtccatgagtgaattagtaga

SEQ ID NO: 195124 - DNA, 25 bp, Mus musculus
agcggtcctaacatttaaaaagcag

SEQ ID NO: 195125 - DNA, 25 bp, Mus musculus
agcggtcctacagttggggaatggc

SEQ ID NO: 195126 - DNA, 25 bp, Mus musculus
agcggtcctagtcttctcagtacag

SEQ ID NO: 195127 - DNA, 25 bp, Mus musculus
agcggtccttggacttcaggaacca

SEQ ID NO: 195128 - DNA, 25 bp, Mus musculus
agcggtcgccggttcccactatgta

SEQ ID NO: 195129 - DNA, 25 bp, Mus musculus
agcggtcggggctggtcaggacaaa

SEQ ID NO: 195130 - DNA, 25 bp, Mus musculus
agcggtctgggccagagcttcgagt

SEQ ID NO: 195131 - DNA, 25 bp, Mus musculus
agcggtctgggccaggtgcgtgcta

SEQ ID NO: 195132 - DNA, 25 bp, Mus musculus
agcggtcttaagaatcaacataaag

SEQ ID NO: 195133 - DNA, 25 bp, Mus musculus
agcggtgaagcggagccctgcaggc

SEQ ID NO: 195134 - DNA, 25 bp, Mus musculus
agcggtgaagcgggtcgccctcccg

SEQ ID NO: 195135 - DNA, 25 bp, Mus musculus
agcggtgagcgacatgtccttccga

SEQ ID NO: 195136 - DNA, 25 bp, Mus musculus
agcggtgagcgacgggccgcattga

SEQ ID NO: 195137 - DNA, 25 bp, Mus musculus
agcggtgagtgatcgtgagacatga

SEQ ID NO: 195138 - DNA, 25 bp, Mus musculus
agcggtgatctcagacgggtcaccc

SEQ ID NO: 195139 - DNA, 25 bp, Mus musculus
agcggtgatctcagccttgccggag

SEQ ID NO: 195140 - DNA, 25 bp, Mus musculus
agcggtgccccaaaccagcgtgcct

SEQ ID NO: 195141 - DNA, 25 bp, Mus musculus
agcggtggagacaaggagtttttgg

SEQ ID NO: 195142 - DNA, 25 bp, Mus musculus
agcggtggcaacggggaggcacacg

SEQ ID NO: 195143 - DNA, 25 bp, Mus musculus
agcggttacaggatgagctgagtga

SEQ ID NO: 195144 - DNA, 25 bp, Mus musculus
agcggttacagggtcttacttattc

SEQ ID NO: 195145 - DNA, 25 bp, Mus musculus
agcggttcagctctgtgacgagaag

SEQ ID NO: 195146 - DNA, 25 bp, Mus musculus
agcggttcaggtctgtgacgagaag

SEQ ID NO: 195147 - DNA, 25 bp, Mus musculus
agcggttgcagacggcacgaccatg

SEQ ID NO: 195148 - DNA, 25 bp, Mus musculus
agcggttgcaggcctggcgtccgcc

SEQ ID NO: 195149 - DNA, 25 bp, Mus musculus
agcggtttgccagggaaaatcatag

SEQ ID NO: 195150 - DNA, 25 bp, Mus musculus
agcggtttgccagggcgacggaaca

SEQ ID NO: 195151 - DNA, 25 bp, Mus musculus
agcggtttgccaggtcggatgatga

SEQ ID NO: 195152 - DNA, 25 bp, Mus musculus
agcggttttgcgaaggatgcacctc

SEQ ID NO: 195153 - DNA, 25 bp, Mus musculus
agcggttttgcgccccctcctctct

SEQ ID NO: 195154 - DNA, 25 bp, Mus musculus
agcgtaaaaatgagtgaaaaagatg

SEQ ID NO: 195155 - DNA, 25 bp, Mus musculus
agcgtaaaaatggaaatgcttgatg

SEQ ID NO: 195156 - DNA, 25 bp, Mus musculus
agcgtaaggagccttagctgccagc

SEQ ID NO: 195157 - DNA, 25 bp, Mus musculus
agcgtaaggagccttgccctgtgtg

SEQ ID NO: 195158 - DNA, 25 bp, Mus musculus
agcgtacgaggcagaaatgctgagc

SEQ ID NO: 195159 - DNA, 25 bp, Mus musculus
agcgtagaagatccaggtgctgtgg

SEQ ID NO: 195160 - DNA, 25 bp, Mus musculus
agcgtagaagccgaactcccgtcgt

SEQ ID NO: 195161 - DNA, 25 bp, Mus musculus
agcgtagagaaggctggcaagagat

SEQ ID NO: 195162 - DNA, 25 bp, Mus musculus
agcgtagcaagcccgtcctggacaa

SEQ ID NO: 195163 - DNA, 25 bp, Mus musculus
agcgtatcagcagtgtagtgatttt

SEQ ID NO: 195164 - DNA, 25 bp, Mus musculus
agcgtatcccagaacaacctgcggc

SEQ ID NO: 195165 - DNA, 25 bp, Mus musculus
agcgtattaacaagtaagtgtggac

SEQ ID NO: 195166 - DNA, 25 bp, Mus musculus
agcgtcaagcagactcgccagtgat

SEQ ID NO: 195167 - DNA, 25 bp, Mus musculus
agcgtcagcgggggaacagtacatt

SEQ ID NO: 195168 - DNA, 25 bp, Mus musculus
agcgtcagtctgaaggtgcttcctg

SEQ ID NO: 195169 - DNA, 25 bp, Mus musculus
agcgtcagtctgcctttgcctgatc

SEQ ID NO: 195170 - DNA, 25 bp, Mus musculus
agcgtcatgtgcagagacaggcttt

SEQ ID NO: 195171 - DNA, 25 bp, Mus musculus
agcgtcatgtgcaggctttgatatg

SEQ ID NO: 195172 - DNA, 25 bp, Mus musculus
agcgtccagcgtgcgcccctccagc

SEQ ID NO: 195173 - DNA, 25 bp, Mus musculus
agcgtccatctgaagaaaaagaaag

SEQ ID NO: 195174 - DNA, 25 bp, Mus musculus
agcgtccatctgacaatggattctg

SEQ ID NO: 195175 - DNA, 25 bp, Mus musculus
agcgtccatctgcaaggaccatggt

SEQ ID NO: 195176 - DNA, 25 bp, Mus musculus
agcgtcccatggcctagccgcccgc

SEQ ID NO: 195177 - DNA, 25 bp, Mus musculus
agcgtccccaactcttcctcccctc

SEQ ID NO: 195178 - DNA, 25 bp, Mus musculus
agcgtccccggtggaatgcaagact

SEQ ID NO: 195179 - DNA, 25 bp, Mus musculus
agcgtccgctgctgccatccctcag

SEQ ID NO: 195180 - DNA, 25 bp, Mus musculus
agcgtcctaacgggcaatgtcatca

SEQ ID NO: 195181 - DNA, 25 bp, Mus musculus
agcgtcctcatacacagcgtgcagg

SEQ ID NO: 195182 - DNA, 25 bp, Mus musculus
agcgtcctccgcagcctctactcaa

SEQ ID NO: 195183 - DNA, 25 bp, Mus musculus
agcgtcctccgcaggttcgtggtac

SEQ ID NO: 195184 - DNA, 25 bp, Mus musculus
agcgtcctccgggtagctgggagta

SEQ ID NO: 195185 - DNA, 25 bp, Mus musculus
agcgtcctctcgagacatgaaaaat

SEQ ID NO: 195186 - DNA, 25 bp, Mus musculus
agcgtcctctcggaggtaacagcta

SEQ ID NO: 195187 - DNA, 25 bp, Mus musculus
agcgtccttgagctgaggctgcagc

SEQ ID NO: 195188 - DNA, 25 bp, Mus musculus
agcgtcgagcccaggaggaagaagg

SEQ ID NO: 195189 - DNA, 25 bp, Mus musculus
agcgtcgatcccagatgtagaactc

SEQ ID NO: 195190 - DNA, 25 bp, Mus musculus
agcgtcgatcccaggtgcacctccg

SEQ ID NO: 195191 - DNA, 25 bp, Mus musculus
agcgtcgatcccaggtgcttgtcct

SEQ ID NO: 195192 - DNA, 25 bp, Mus musculus
agcgtcgccaagcaggtagggcctt

SEQ ID NO: 195193 - DNA, 25 bp, Mus musculus
agcgtcgccaccatgaccaccgcgt

SEQ ID NO: 195194 - DNA, 25 bp, Mus musculus
agcgtctaaagcttcaagttatata

SEQ ID NO: 195195 - DNA, 25 bp, Mus musculus
agcgtctaaaggaaattgatgggaa

SEQ ID NO: 195196 - DNA, 25 bp, Mus musculus
agcgtctaaggttcctgtgtccgca

SEQ ID NO: 195197 - DNA, 25 bp, Mus musculus
agcgtctacaaacttcaccaaactg

SEQ ID NO: 195198 - DNA, 25 bp, Mus musculus
agcgtctacaaagcccggttcctgg

SEQ ID NO: 195199 - DNA, 25 bp, Mus musculus
agcgtctatctgagatgccttattg

SEQ ID NO: 195200 - DNA, 25 bp, Mus musculus
agcgtctcagagtgcctggtgaaga

SEQ ID NO: 195201 - DNA, 25 bp, Mus musculus
agcgtctcagccaacaagatagctg

SEQ ID NO: 195202 - DNA, 25 bp, Mus musculus
agcgtctcatgatggagagaagagg

SEQ ID NO: 195203 - DNA, 25 bp, Mus musculus
agcgtctctcgaatctacactgacc

SEQ ID NO: 195204 - DNA, 25 bp, Mus musculus
agcgtctctcgaggttgcctgatat

SEQ ID NO: 195205 - DNA, 25 bp, Mus musculus
agcgtctgcaaagataaaagctttg

SEQ ID NO: 195206 - DNA, 25 bp, Mus musculus
agcgtctggcaggtccaagggtagc

SEQ ID NO: 195207 - DNA, 25 bp, Mus musculus
agcgtcttggggggtgtgaagaagt

SEQ ID NO: 195208 - DNA, 25 bp, Mus musculus
agcgtcttgttacaggaagaacccc

SEQ ID NO: 195209 - DNA, 25 bp, Mus musculus
agcgtctttccagcccctgctggct

SEQ ID NO: 195210 - DNA, 25 bp, Mus musculus
agcgtctttccaggtcatcctgttc

SEQ ID NO: 195211 - DNA, 25 bp, Mus musculus
agcgtgaacacagaaatcccttcac

SEQ ID NO: 195212 - DNA, 25 bp, Mus musculus
agcgtgaacacagggggcttccgaa

SEQ ID NO: 195213 - DNA, 25 bp, Mus musculus
agcgtgaacacagtaacctcagtca

SEQ ID NO: 195214 - DNA, 25 bp, Mus musculus
agcgtgaagatgtactggttccgcc

SEQ ID NO: 195215 - DNA, 25 bp, Mus musculus
agcgtgaatgggggcaatggcatct

SEQ ID NO: 195216 - DNA, 25 bp, Mus musculus
agcgtgactgtttggtgctgcagag

SEQ ID NO: 195217 - DNA, 25 bp, Mus musculus
agcgtgagcggagagtgaagtgtgt

SEQ ID NO: 195218 - DNA, 25 bp, Mus musculus
agcgtgagtgagattccctgttctg

SEQ ID NO: 195219 - DNA, 25 bp, Mus musculus
agcgtgatctcggagtcctccgggc

SEQ ID NO: 195220 - DNA, 25 bp, Mus musculus
agcgtgatctcgggcaatggcagca

SEQ ID NO: 195221 - DNA, 25 bp, Mus musculus
agcgtgcacctaatgccacagagca

SEQ ID NO: 195222 - DNA, 25 bp, Mus musculus
agcgtgccaagcaggcagctgtgtt

SEQ ID NO: 195223 - DNA, 25 bp, Mus musculus
agcgtgccaatgcgcttaagaaaat

SEQ ID NO: 195224 - DNA, 25 bp, Mus musculus
agcgtgccaatgcgtgcatgtcctg

SEQ ID NO: 195225 - DNA, 25 bp, Mus musculus
agcgtgcgcatcacccagaacacac

SEQ ID NO: 195226 - DNA, 25 bp, Mus musculus
agcgtgcgccaggtgtcttctgcag

SEQ ID NO: 195227 - DNA, 25 bp, Mus musculus
agcgtggagaatgtgggctcatggc

SEQ ID NO: 195228 - DNA, 25 bp, Mus musculus
agcgtggagaccatcttcaacaagg

SEQ ID NO: 195229 - DNA, 25 bp, Mus musculus
agcgtggatcacgaaggtaacttca

SEQ ID NO: 195230 - DNA, 25 bp, Mus musculus
agcgtggatcacgaattgggccggt

SEQ ID NO: 195231 - DNA, 25 bp, Mus musculus
agcgtggccttaaagtctttaagaa

SEQ ID NO: 195232 - DNA, 25 bp, Mus musculus
agcgtggcggacctcatccgcatct

SEQ ID NO: 195233 - DNA, 25 bp, Mus musculus
agcgtggctgggaaccaccgtcact

SEQ ID NO: 195234 - DNA, 25 bp, Mus musculus
agcgtggctggtcttgagaccatcc

SEQ ID NO: 195235 - DNA, 25 bp, Mus musculus
agcgtgggaaaaagaccaaagattc

SEQ ID NO: 195236 - DNA, 25 bp, Mus musculus
agcgtgggaaactgctctcctatgt

SEQ ID NO: 195237 - DNA, 25 bp, Mus musculus
agcgtggttgatctggtggctctga

SEQ ID NO: 195238 - DNA, 25 bp, Mus musculus
agcgtgtccggccctgaacgccatg

SEQ ID NO: 195239 - DNA, 25 bp, Mus musculus
agcgtgtcctatgactggccactga

SEQ ID NO: 195240 - DNA, 25 bp, Mus musculus
agcgtgtcctatgactggctgatcc

SEQ ID NO: 195241 - DNA, 25 bp, Mus musculus
agcgtgtctcatactacaaggaacc

SEQ ID NO: 195242 - DNA, 25 bp, Mus musculus
agcgtgtgcgccctgggtccaactg

SEQ ID NO: 195243 - DNA, 25 bp, Mus musculus
agcgtgtgttaagccatcaaacaat

SEQ ID NO: 195244 - DNA, 25 bp, Mus musculus
agcgtgtgttaaggtctcatttttt

SEQ ID NO: 195245 - DNA, 25 bp, Mus musculus
agcgtgtgttaaggttaccaacata

SEQ ID NO: 195246 - DNA, 25 bp, Mus musculus
agcgtgttagaggagatttaccttc

SEQ ID NO: 195247 - DNA, 25 bp, Mus musculus
agcgtgttagatatcgatgagtgcg

SEQ ID NO: 195248 - DNA, 25 bp, Mus musculus
agcgtgttctcccggacgagggatc

SEQ ID NO: 195249 - DNA, 25 bp, Mus musculus
agcgtgttggggacaaagagaaagt

SEQ ID NO: 195250 - DNA, 25 bp, Mus musculus
agcgttacagccaggcatgctgagc

SEQ ID NO: 195251 - DNA, 25 bp, Mus musculus
agcgttactgccgatgcaatgccac

SEQ ID NO: 195252 - DNA, 25 bp, Mus musculus
agcgttcacaagatcatttccatgt

SEQ ID NO: 195253 - DNA, 25 bp, Mus musculus
agcgttcacaagtctgagttcactt

SEQ ID NO: 195254 - DNA, 25 bp, Mus musculus
agcgttcagttaatggaatcttctg

SEQ ID NO: 195255 - DNA, 25 bp, Mus musculus
agcgttccaaaagctgccgcagtgg

SEQ ID NO: 195256 - DNA, 25 bp, Mus musculus
agcgttcgaggagcgacacaacgct

SEQ ID NO: 195257 - DNA, 25 bp, Mus musculus
agcgttcgaggtcgtgagtcagctc

SEQ ID NO: 195258 - DNA, 25 bp, Mus musculus
agcgttggggagtatccgcctccga

SEQ ID NO: 195259 - DNA, 25 bp, Mus musculus
agcgttggtttttcagaagatatgg

SEQ ID NO: 195260 - DNA, 25 bp, Mus musculus
agcgttggtttttctaggaaatcaa

SEQ ID NO: 195261 - DNA, 25 bp, Mus musculus
agcgttggtttttgtctccctgcaa

SEQ ID NO: 195262 - DNA, 25 bp, Mus musculus
agcgttgtcagtcttatggggccca

SEQ ID NO: 195263 - DNA, 25 bp, Mus musculus
agcgtttatttcaagtgtcaccaga

SEQ ID NO: 195264 - DNA, 25 bp, Mus musculus
agcgtttgcaggccatcgaagacgg

SEQ ID NO: 195265 - DNA, 25 bp, Mus musculus
agcgtttgcttcatgactttatatg

SEQ ID NO: 195266 - DNA, 25 bp, Mus musculus
agcgtttggaggtgccctccaagac

SEQ ID NO: 195267 - DNA, 25 bp, Mus musculus
agcgttttcagaaaagatgtctttg

SEQ ID NO: 195268 - DNA, 25 bp, Mus musculus
agctaaaaagtgggaaatgaaagct

SEQ ID NO: 195269 - DNA, 25 bp, Mus musculus
agctaaaactacaagagtggatcat

SEQ ID NO: 195270 - DNA, 25 bp, Mus musculus
agctaaaatttccacctgctgatct

SEQ ID NO: 195271 - DNA, 25 bp, Mus musculus
agctaaacaacaagatctgtgatat

SEQ ID NO: 195272 - DNA, 25 bp, Mus musculus
agctaaacaagaatttaaagaggac

SEQ ID NO: 195273 - DNA, 25 bp, Mus musculus
agctaaactcagcccaaggcttgca

SEQ ID NO: 195274 - DNA, 25 bp, Mus musculus
agctaaagacgggccagcaggcctg

SEQ ID NO: 195275 - DNA, 25 bp, Mus musculus
agctaaagagaatggactcgctaca

SEQ ID NO: 195276 - DNA, 25 bp, Mus musculus
agctaaagatggagaaggagaggaa

SEQ ID NO: 195277 - DNA, 25 bp, Mus musculus
agctaaagccgatgctcaggaaaag

SEQ ID NO: 195278 - DNA, 25 bp, Mus musculus
agctaaagccgatggcttcgggagc

SEQ ID NO: 195279 - DNA, 25 bp, Mus musculus
agctaaaggaggctgtgaggggaag

SEQ ID NO: 195280 - DNA, 25 bp, Mus musculus
agctaaaggcagaccattccacatt

SEQ ID NO: 195281 - DNA, 25 bp, Mus musculus
agctaaagtgtatactcctgatcat

SEQ ID NO: 195282 - DNA, 25 bp, Mus musculus
agctaacaatcttggcaaagcgcaa

SEQ ID NO: 195283 - DNA, 25 bp, Mus musculus
agctaaccaaggaagggatgctaca

SEQ ID NO: 195284 - DNA, 25 bp, Mus musculus
agctaaccaaggtttgcccacagga

SEQ ID NO: 195285 - DNA, 25 bp, Mus musculus
agctaacctcaccaaaggctattcg

SEQ ID NO: 195286 - DNA, 25 bp, Mus musculus
agctaacctcaccaagtaccgggaa

SEQ ID NO: 195287 - DNA, 25 bp, Mus musculus
agctaacctgagattacaagagcga

SEQ ID NO: 195288 - DNA, 25 bp, Mus musculus
agctaacctgaggcatgtctaggcc

SEQ ID NO: 195289 - DNA, 25 bp, Mus musculus
agctaacgagatgaacgtgacgccc

SEQ ID NO: 195290 - DNA, 25 bp, Mus musculus
agctaacgaggttgactgcctcctc

SEQ ID NO: 195291 - DNA, 25 bp, Mus musculus
agctaacggggaataaaagctgtgg

SEQ ID NO: 195292 - DNA, 25 bp, Mus musculus
agctaactgataaaattctaccagt

SEQ ID NO: 195293 - DNA, 25 bp, Mus musculus
agctaactgataaactccagggatt

SEQ ID NO: 195294 - DNA, 25 bp, Mus musculus
agctaagaaactgccaggagtagga

SEQ ID NO: 195295 - DNA, 25 bp, Mus musculus
agctaagaacggaaagaccaagaag

SEQ ID NO: 195296 - DNA, 25 bp, Mus musculus
agctaagagccaggtaatttctaat

SEQ ID NO: 195297 - DNA, 25 bp, Mus musculus
agctaagcaggtctgaagaaaggtc

SEQ ID NO: 195298 - DNA, 25 bp, Mus musculus
agctaagccagtgggagtgtgcagc

SEQ ID NO: 195299 - DNA, 25 bp, Mus musculus
agctaagcccagatggctctgactc

SEQ ID NO: 195300 - DNA, 25 bp, Mus musculus
agctaaggaaaggtacaaaaatata

SEQ ID NO: 195301 - DNA, 25 bp, Mus musculus
agctaaggaagggtcttctacttac

SEQ ID NO: 195302 - DNA, 25 bp, Mus musculus
agctaaggatccagcgtctgttgac

SEQ ID NO: 195303 - DNA, 25 bp, Mus musculus
agctaaggatccaggaccacaagcc

SEQ ID NO: 195304 - DNA, 25 bp, Mus musculus
agctaaggatccagggctcactgat

SEQ ID NO: 195305 - DNA, 25 bp, Mus musculus
agctaaggcaaccagagtaccagtg

SEQ ID NO: 195306 - DNA, 25 bp, Mus musculus
agctaagggtgtcagggtcactgtt

SEQ ID NO: 195307 - DNA, 25 bp, Mus musculus
agctaatacgagggagaagacaccc

SEQ ID NO: 195308 - DNA, 25 bp, Mus musculus
agctaatatcccaacggagtcctcc

SEQ ID NO: 195309 - DNA, 25 bp, Mus musculus
agctaatcctggaggtcctagaaga

SEQ ID NO: 195310 - DNA, 25 bp, Mus musculus
agctaatcctggagttagcagccca

SEQ ID NO: 195311 - DNA, 25 bp, Mus musculus
agctaatgaatggattggtatgtgt

SEQ ID NO: 195312 - DNA, 25 bp, Mus musculus
agctaatgatactgtcggccagtga

SEQ ID NO: 195313 - DNA, 25 bp, Mus musculus
agctaatgcagtcccaccccctgta

SEQ ID NO: 195314 - DNA, 25 bp, Mus musculus
agctacaaagtgaagtgctcaggag

SEQ ID NO: 195315 - DNA, 25 bp, Mus musculus
agctacaaagtgtctttgccatgaa

SEQ ID NO: 195316 - DNA, 25 bp, Mus musculus
agctacaacaaccgccgagacctga

SEQ ID NO: 195317 - DNA, 25 bp, Mus musculus
agctacaacagcgtttatggggccc

SEQ ID NO: 195318 - DNA, 25 bp, Mus musculus
agctacaagaggaatcattgacctg

SEQ ID NO: 195319 - DNA, 25 bp, Mus musculus
agctacaatgcaacgtggccctgaa

SEQ ID NO: 195320 - DNA, 25 bp, Mus musculus
agctacacatgcaactgtgttattg

SEQ ID NO: 195321 - DNA, 25 bp, Mus musculus
agctacaccatccccccgcaggctg

SEQ ID NO: 195322 - DNA, 25 bp, Mus musculus
agctacacctgccggtcagggatcc

SEQ ID NO: 195323 - DNA, 25 bp, Mus musculus
agctacacctgccggtccaaccgtg

SEQ ID NO: 195324 - DNA, 25 bp, Mus musculus
agctacagaactcaggtttaacaga

SEQ ID NO: 195325 - DNA, 25 bp, Mus musculus
agctacagaataagcttagatatgc

SEQ ID NO: 195326 - DNA, 25 bp, Mus musculus
agctacagatatgggacacagcagg

SEQ ID NO: 195327 - DNA, 25 bp, Mus musculus
agctacaggaatggagagtggcaag

SEQ ID NO: 195328 - DNA, 25 bp, Mus musculus
agctacaggcagcagctccggtctg

SEQ ID NO: 195329 - DNA, 25 bp, Mus musculus
agctacaggtgtctagtggtaaagc

SEQ ID NO: 195330 - DNA, 25 bp, Mus musculus
agctacagtggcacctgacaaaaaa

SEQ ID NO: 195331 - DNA, 25 bp, Mus musculus
agctacatcaaaagaggcttccagt

SEQ ID NO: 195332 - DNA, 25 bp, Mus musculus
agctacatcaaaaggtacttcgagt

SEQ ID NO: 195333 - DNA, 25 bp, Mus musculus
agctacatcgctgggactaatggca

SEQ ID NO: 195334 - DNA, 25 bp, Mus musculus
agctacatctcaggccagggctttg

SEQ ID NO: 195335 - DNA, 25 bp, Mus musculus
agctacatctcaggcccctggtttg

SEQ ID NO: 195336 - DNA, 25 bp, Mus musculus
agctacattgaggggtacgtgccat

SEQ ID NO: 195337 - DNA, 25 bp, Mus musculus
agctacattgaggggtctgtgcact

SEQ ID NO: 195338 - DNA, 25 bp, Mus musculus
agctaccaaacgcaagcaccaggag

SEQ ID NO: 195339 - DNA, 25 bp, Mus musculus
agctaccaagaccgagatgccgcgc

SEQ ID NO: 195340 - DNA, 25 bp, Mus musculus
agctaccagcggctctgctctgctt

SEQ ID NO: 195341 - DNA, 25 bp, Mus musculus
agctaccatctgaagagtctactcg

SEQ ID NO: 195342 - DNA, 25 bp, Mus musculus
agctacccaggttgaggctgaggag

SEQ ID NO: 195343 - DNA, 25 bp, Mus musculus
agctaccccaacaatgcaccttccg

SEQ ID NO: 195344 - DNA, 25 bp, Mus musculus
agctaccccaacaggccccgggtgc

SEQ ID NO: 195345 - DNA, 25 bp, Mus musculus
agctacccccagatccctgcagccc

SEQ ID NO: 195346 - DNA, 25 bp, Mus musculus
agctacccttcctgcacccaggacg

SEQ ID NO: 195347 - DNA, 25 bp, Mus musculus
agctaccgaggagagagtcagaaag

SEQ ID NO: 195348 - DNA, 25 bp, Mus musculus
agctaccgaggtgctgcaggagtta

SEQ ID NO: 195349 - DNA, 25 bp, Mus musculus
agctaccggagccgcatcaatgaga

SEQ ID NO: 195350 - DNA, 25 bp, Mus musculus
agctaccggaggtatggggcagatg

SEQ ID NO: 195351 - DNA, 25 bp, Mus musculus
agctaccggagttggatcggtcatg

SEQ ID NO: 195352 - DNA, 25 bp, Mus musculus
agctaccggggagcattcagcctgt

SEQ ID NO: 195353 - DNA, 25 bp, Mus musculus
agctaccggggagtaacaatgaaga

SEQ ID NO: 195354 - DNA, 25 bp, Mus musculus
agctacctagcatgtccaaaattct

SEQ ID NO: 195355 - DNA, 25 bp, Mus musculus
agctacctcggtaccagtacttgaa

SEQ ID NO: 195356 - DNA, 25 bp, Mus musculus
agctacctgcctaaccagcccctcc

SEQ ID NO: 195357 - DNA, 25 bp, Mus musculus
agctacctggacttaactgtgccac

SEQ ID NO: 195358 - DNA, 25 bp, Mus musculus
agctacctggagatgttccgagaac

SEQ ID NO: 195359 - DNA, 25 bp, Mus musculus
agctacgaagcaggctgcaccctgg

SEQ ID NO: 195360 - DNA, 25 bp, Mus musculus
agctacgcaccaaaggtgtgacttt

SEQ ID NO: 195361 - DNA, 25 bp, Mus musculus
agctacgcatcatgccactgccttc

SEQ ID NO: 195362 - DNA, 25 bp, Mus musculus
agctacgccaggcacaaatatgcca

SEQ ID NO: 195363 - DNA, 25 bp, Mus musculus
agctacgctttggccccaaacccat

SEQ ID NO: 195364 - DNA, 25 bp, Mus musculus
agctacggctgggttacccagtgag

SEQ ID NO: 195365 - DNA, 25 bp, Mus musculus
agctacggtctctgctgcgctacat

SEQ ID NO: 195366 - DNA, 25 bp, Mus musculus
agctacgtcctcccgaccatgctcg

SEQ ID NO: 195367 - DNA, 25 bp, Mus musculus
agctactatgagaagctccataagt

SEQ ID NO: 195368 - DNA, 25 bp, Mus musculus
agctactcaggcagatccgttttgt

SEQ ID NO: 195369 - DNA, 25 bp, Mus musculus
agctactcaggcagtatctccagga

SEQ ID NO: 195370 - DNA, 25 bp, Mus musculus
agctactcaggcctgcctactttgg

SEQ ID NO: 195371 - DNA, 25 bp, Mus musculus
agctactcaggtcaaggctttgaca

SEQ ID NO: 195372 - DNA, 25 bp, Mus musculus
agctactccagaaaaatcttcaaat

SEQ ID NO: 195373 - DNA, 25 bp, Mus musculus
agctactccaggtacgtaggtgcca

SEQ ID NO: 195374 - DNA, 25 bp, Mus musculus
agctactctccagggtcttcctggc

SEQ ID NO: 195375 - DNA, 25 bp, Mus musculus
agctactgcagagccatcctgactc

SEQ ID NO: 195376 - DNA, 25 bp, Mus musculus
agctactggagaagaagtcttggac

SEQ ID NO: 195377 - DNA, 25 bp, Mus musculus
agctactggagaagccagatgcccc

SEQ ID NO: 195378 - DNA, 25 bp, Mus musculus
agctactggagaaggtgcaaaacat

SEQ ID NO: 195379 - DNA, 25 bp, Mus musculus
agctacttaaaccagaatgcataca

SEQ ID NO: 195380 - DNA, 25 bp, Mus musculus
agctacttaaaccaggtttgcatgc

SEQ ID NO: 195381 - DNA, 25 bp, Mus musculus
agctacttcgtaagaatgtcttcca

SEQ ID NO: 195382 - DNA, 25 bp, Mus musculus
agctacttctcaaggaaacttcatt

SEQ ID NO: 195383 - DNA, 25 bp, Mus musculus
agctacttctcaaggaggcgcttcc

SEQ ID NO: 195384 - DNA, 25 bp, Mus musculus
agctagaaaagaaagtgagttcctc

SEQ ID NO: 195385 - DNA, 25 bp, Mus musculus
agctagaacaacagcgacagctatt

SEQ ID NO: 195386 - DNA, 25 bp, Mus musculus
agctagaacaacaggtgttgggagc

SEQ ID NO: 195387 - DNA, 25 bp, Mus musculus
agctagaagggaagtctcagcgctg

SEQ ID NO: 195388 - DNA, 25 bp, Mus musculus
agctagaccaactttgcagagttca

SEQ ID NO: 195389 - DNA, 25 bp, Mus musculus
agctagacgccaaggttgtggagct

SEQ ID NO: 195390 - DNA, 25 bp, Mus musculus
agctagactgggtctatggctatcg

SEQ ID NO: 195391 - DNA, 25 bp, Mus musculus
agctagagaccaaaaccaacaaaac

SEQ ID NO: 195392 - DNA, 25 bp, Mus musculus
agctagagagaattccagaattgga

SEQ ID NO: 195393 - DNA, 25 bp, Mus musculus
agctagagaggacccttatggtgta

SEQ ID NO: 195394 - DNA, 25 bp, Mus musculus
agctagagcgacagcagttggaaac

SEQ ID NO: 195395 - DNA, 25 bp, Mus musculus
agctagagctgacgggggtggcacc

SEQ ID NO: 195396 - DNA, 25 bp, Mus musculus
agctagaggaagcctccatttacag

SEQ ID NO: 195397 - DNA, 25 bp, Mus musculus
agctagaggaaggcagagcatgggc

SEQ ID NO: 195398 - DNA, 25 bp, Mus musculus
agctagaggagggcatggataatta

SEQ ID NO: 195399 - DNA, 25 bp, Mus musculus
agctagagttcaaaggcggcgagtc

SEQ ID NO: 195400 - DNA, 25 bp, Mus musculus
agctagatgaggttgatatgtcaga

SEQ ID NO: 195401 - DNA, 25 bp, Mus musculus
agctagcaaagcactgctgttcttg

SEQ ID NO: 195402 - DNA, 25 bp, Mus musculus
agctagcaatctctgcacctttggg

SEQ ID NO: 195403 - DNA, 25 bp, Mus musculus
agctagcagtaatggtaagtatact

SEQ ID NO: 195404 - DNA, 25 bp, Mus musculus
agctagcagtaatggtccatcctga

SEQ ID NO: 195405 - DNA, 25 bp, Mus musculus
agctagctactccaggtacgtaggt

SEQ ID NO: 195406 - DNA, 25 bp, Mus musculus
agctagctatgacctatgaggagat

SEQ ID NO: 195407 - DNA, 25 bp, Mus musculus
agctagctggttgcagaggttttgg

SEQ ID NO: 195408 - DNA, 25 bp, Mus musculus
agctaggaagaggtcagccatgtca

SEQ ID NO: 195409 - DNA, 25 bp, Mus musculus
agctaggataacagtgacgtatgac

SEQ ID NO: 195410 - DNA, 25 bp, Mus musculus
agctagggaatgaaggtgaagagat

SEQ ID NO: 195411 - DNA, 25 bp, Mus musculus
agctagtagagctggaggtggagtg

SEQ ID NO: 195412 - DNA, 25 bp, Mus musculus
agctagtagagtatatggaggaacg

SEQ ID NO: 195413 - DNA, 25 bp, Mus musculus
agctagtagcagaagctgggagggc

SEQ ID NO: 195414 - DNA, 25 bp, Mus musculus
agctagtcttttaatggagaatgga

SEQ ID NO: 195415 - DNA, 25 bp, Mus musculus
agctagtcttttaggtaagaagtat

SEQ ID NO: 195416 - DNA, 25 bp, Mus musculus
agctagtgaccagatactgttaaag

SEQ ID NO: 195417 - DNA, 25 bp, Mus musculus
agctagtgaccaggatcgactgcgg

SEQ ID NO: 195418 - DNA, 25 bp, Mus musculus
agctagtgcaaaactgccagtgtat

SEQ ID NO: 195419 - DNA, 25 bp, Mus musculus
agctagtgcagcttgagtagcttat

SEQ ID NO: 195420 - DNA, 25 bp, Mus musculus
agctagtgcagcttggagtggattt

SEQ ID NO: 195421 - DNA, 25 bp, Mus musculus
agctagtgtaaaagaaagatgatga

SEQ ID NO: 195422 - DNA, 25 bp, Mus musculus
agctagttcaggcactggctccagc

SEQ ID NO: 195423 - DNA, 25 bp, Mus musculus
agctagttggaaaggcatttacact

SEQ ID NO: 195424 - DNA, 25 bp, Mus musculus
agctatacaaggtgggcctgggtct

SEQ ID NO: 195425 - DNA, 25 bp, Mus musculus
agctatagacttcagtttgatttcc

SEQ ID NO: 195426 - DNA, 25 bp, Mus musculus
agctatagcctggacctgctctcct

SEQ ID NO: 195427 - DNA, 25 bp, Mus musculus
agctatagcctggtgcttgagaagg

SEQ ID NO: 195428 - DNA, 25 bp, Mus musculus
agctatagctcagctgcctcatata

SEQ ID NO: 195429 - DNA, 25 bp, Mus musculus
agctatagtcatttacaaaatggtt

SEQ ID NO: 195430 - DNA, 25 bp, Mus musculus
agctatatcggagacacagcttcat

SEQ ID NO: 195431 - DNA, 25 bp, Mus musculus
agctatcaactgagacattgtcttt

SEQ ID NO: 195432 - DNA, 25 bp, Mus musculus
agctatcacaaataaagaaaaggaa

SEQ ID NO: 195433 - DNA, 25 bp, Mus musculus
agctatcacaaatatttcctcttct

SEQ ID NO: 195434 - DNA, 25 bp, Mus musculus
agctatcagaataaggttcagccta

SEQ ID NO: 195435 - DNA, 25 bp, Mus musculus
agctatcccaggaccgggacttcat

SEQ ID NO: 195436 - DNA, 25 bp, Mus musculus
agctatcccaggcccctctgccccc

SEQ ID NO: 195437 - DNA, 25 bp, Mus musculus
agctatctccggtccaaatatcaca

SEQ ID NO: 195438 - DNA, 25 bp, Mus musculus
agctatctggaggtgacccctgatt

SEQ ID NO: 195439 - DNA, 25 bp, Mus musculus
agctatcttgcagttcatggcatct

SEQ ID NO: 195440 - DNA, 25 bp, Mus musculus
agctatgaagccaagattgtaaggg

SEQ ID NO: 195441 - DNA, 25 bp, Mus musculus
agctatgaaggagatgaagaggaag

SEQ ID NO: 195442 - DNA, 25 bp, Mus musculus
agctatgacattgcctcccacccgc

SEQ ID NO: 195443 - DNA, 25 bp, Mus musculus
agctatgagtgcagaaaatattaat

SEQ ID NO: 195444 - DNA, 25 bp, Mus musculus
agctatgagtgcagcgtgttaccca

SEQ ID NO: 195445 - DNA, 25 bp, Mus musculus
agctatgagtgcagttttcagcaga

SEQ ID NO: 195446 - DNA, 25 bp, Mus musculus
agctatgccccaagattcagtccca

SEQ ID NO: 195447 - DNA, 25 bp, Mus musculus
agctatgccccaaggaaagagtgcc

SEQ ID NO: 195448 - DNA, 25 bp, Mus musculus
agctatgcccggaattgaaagaatt

SEQ ID NO: 195449 - DNA, 25 bp, Mus musculus
agctatgctgcaggaaatgacctgc

SEQ ID NO: 195450 - DNA, 25 bp, Mus musculus
agctatggcagaaagccctgcagga

SEQ ID NO: 195451 - DNA, 25 bp, Mus musculus
agctatggcagagtgctgggattac

SEQ ID NO: 195452 - DNA, 25 bp, Mus musculus
agctatggcagctacttaaaattct

SEQ ID NO: 195453 - DNA, 25 bp, Mus musculus
agctatggcaggtgattggagttgt

SEQ ID NO: 195454 - DNA, 25 bp, Mus musculus
agctatggcagtggttttatgaaga

SEQ ID NO: 195455 - DNA, 25 bp, Mus musculus
agctatgggggcctgggtccaagcc

SEQ ID NO: 195456 - DNA, 25 bp, Mus musculus
agctatggtaaaagtttcatttgat

SEQ ID NO: 195457 - DNA, 25 bp, Mus musculus
agctatggtttaagacgcttaaagg

SEQ ID NO: 195458 - DNA, 25 bp, Mus musculus
agctattaagaagaagacaaaaaag

SEQ ID NO: 195459 - DNA, 25 bp, Mus musculus
agctattcccagctccaccagagaa

SEQ ID NO: 195460 - DNA, 25 bp, Mus musculus
agctattctgctcgtcagcacatca

SEQ ID NO: 195461 - DNA, 25 bp, Mus musculus
agctattgcacggatggtgaacttt

SEQ ID NO: 195462 - DNA, 25 bp, Mus musculus
agctattttggattactataagaca

SEQ ID NO: 195463 - DNA, 25 bp, Mus musculus
agctcaaaagctttgcagccagctg

SEQ ID NO: 195464 - DNA, 25 bp, Mus musculus
agctcaaaaggcactaagcaagagc

SEQ ID NO: 195465 - DNA, 25 bp, Mus musculus
agctcaaaggagagaaatgtcaacg

SEQ ID NO: 195466 - DNA, 25 bp, Mus musculus
agctcaaagggaaggaaaacgcttg

SEQ ID NO: 195467 - DNA, 25 bp, Mus musculus
agctcaacaagactgcaagtggcaa

SEQ ID NO: 195468 - DNA, 25 bp, Mus musculus
agctcaacaaggagctggtgattgc

SEQ ID NO: 195469 - DNA, 25 bp, Mus musculus
agctcaacaaggctctccagagcaa

SEQ ID NO: 195470 - DNA, 25 bp, Mus musculus
agctcaacatgtatggcttccgaaa

SEQ ID NO: 195471 - DNA, 25 bp, Mus musculus
agctcaacatgtctcattcagttcc

SEQ ID NO: 195472 - DNA, 25 bp, Mus musculus
agctcaacctcaagggctgtgaggt

SEQ ID NO: 195473 - DNA, 25 bp, Mus musculus
agctcaagaagaaagagttcgacat

SEQ ID NO: 195474 - DNA, 25 bp, Mus musculus
agctcaaggaagcctctgtgcctct

SEQ ID NO: 195475 - DNA, 25 bp, Mus musculus
agctcaaggaggctcaacgcacagc

SEQ ID NO: 195476 - DNA, 25 bp, Mus musculus
agctcaaggagtgtctagcccacac

SEQ ID NO: 195477 - DNA, 25 bp, Mus musculus
agctcaagttaaagagaatgaaaat

SEQ ID NO: 195478 - DNA, 25 bp, Mus musculus
agctcaagttttctacagagatccc

SEQ ID NO: 195479 - DNA, 25 bp, Mus musculus
agctcaatacttctaccagaatcga

SEQ ID NO: 195480 - DNA, 25 bp, Mus musculus
agctcaatacttctatttttttatt

SEQ ID NO: 195481 - DNA, 25 bp, Mus musculus
agctcaatgagacagccaagcagca

SEQ ID NO: 195482 - DNA, 25 bp, Mus musculus
agctcaatgagacaggacatgggtc

SEQ ID NO: 195483 - DNA, 25 bp, Mus musculus
agctcaatgcacatcttcaagaaaa

SEQ ID NO: 195484 - DNA, 25 bp, Mus musculus
agctcaatgtcacctataattcaca

SEQ ID NO: 195485 - DNA, 25 bp, Mus musculus
agctcacacacagggcgtgcgcagg

SEQ ID NO: 195486 - DNA, 25 bp, Mus musculus
agctcacagaagcctgcagagccta

SEQ ID NO: 195487 - DNA, 25 bp, Mus musculus
agctcacagtctcagaaaccattga

SEQ ID NO: 195488 - DNA, 25 bp, Mus musculus
agctcacagtctcagccacagagaa

SEQ ID NO: 195489 - DNA, 25 bp, Mus musculus
agctcacatgaaaccaaagatgacc

SEQ ID NO: 195490 - DNA, 25 bp, Mus musculus
agctcaccaagcgggtcaaaaatgc

SEQ ID NO: 195491 - DNA, 25 bp, Mus musculus
agctcaccaagctactccattcccg

SEQ ID NO: 195492 - DNA, 25 bp, Mus musculus
agctcaccaccctgaggcaaagaaa

SEQ ID NO: 195493 - DNA, 25 bp, Mus musculus
agctcaccaccctgagtccagacag

SEQ ID NO: 195494 - DNA, 25 bp, Mus musculus
agctcacccgagacgtgatcgtccg

SEQ ID NO: 195495 - DNA, 25 bp, Mus musculus
agctcacctccgctgcctgccttgt

SEQ ID NO: 195496 - DNA, 25 bp, Mus musculus
agctcacgagaagatgtgtatgtcg

SEQ ID NO: 195497 - DNA, 25 bp, Mus musculus
agctcacgatccaggtcagagcagc

SEQ ID NO: 195498 - DNA, 25 bp, Mus musculus
agctcacgatccaggtgttcactgg

SEQ ID NO: 195499 - DNA, 25 bp, Mus musculus
agctcacgccgagcagctgccccag

SEQ ID NO: 195500 - DNA, 25 bp, Mus musculus
agctcacgcctctcttctgtattat

SEQ ID NO: 195501 - DNA, 25 bp, Mus musculus
agctcacgcctcttgaccagcagtt

SEQ ID NO: 195502 - DNA, 25 bp, Mus musculus
agctcactcaaggtaatagcgctca

SEQ ID NO: 195503 - DNA, 25 bp, Mus musculus
agctcactgtggaggagctgaagtt

SEQ ID NO: 195504 - DNA, 25 bp, Mus musculus
agctcacttgaaggacacccagctc

SEQ ID NO: 195505 - DNA, 25 bp, Mus musculus
agctcagaaacaggcggaaaaactg

SEQ ID NO: 195506 - DNA, 25 bp, Mus musculus
agctcagaaagcctttccctaacag

SEQ ID NO: 195507 - DNA, 25 bp, Mus musculus
agctcagaaagctgtgtatgatcgg

SEQ ID NO: 195508 - DNA, 25 bp, Mus musculus
agctcagaagcccagatggtgcagt

SEQ ID NO: 195509 - DNA, 25 bp, Mus musculus
agctcagacagtgggtgtccaccca

SEQ ID NO: 195510 - DNA, 25 bp, Mus musculus
agctcagaccagatggccaagctgc

SEQ ID NO: 195511 - DNA, 25 bp, Mus musculus
agctcagagacccaagtgcataagt

SEQ ID NO: 195512 - DNA, 25 bp, Mus musculus
agctcagagagaatccaccttgaca

SEQ ID NO: 195513 - DNA, 25 bp, Mus musculus
agctcagagcagctttgacctcgaa

SEQ ID NO: 195514 - DNA, 25 bp, Mus musculus
agctcagagggaagctcacaagatg

SEQ ID NO: 195515 - DNA, 25 bp, Mus musculus
agctcagagggaattgaagttaaaa

SEQ ID NO: 195516 - DNA, 25 bp, Mus musculus
agctcagagggatcagaaacatcga

SEQ ID NO: 195517 - DNA, 25 bp, Mus musculus
agctcagagggcgggatgtctctgt

SEQ ID NO: 195518 - DNA, 25 bp, Mus musculus
agctcagatcaggtaagggagcaca

SEQ ID NO: 195519 - DNA, 25 bp, Mus musculus
agctcagcaaagaagttgggatatc

SEQ ID NO: 195520 - DNA, 25 bp, Mus musculus
agctcagcaagtattcgactcacct

SEQ ID NO: 195521 - DNA, 25 bp, Mus musculus
agctcagcaatagtctggaagaaag

SEQ ID NO: 195522 - DNA, 25 bp, Mus musculus
agctcagcagaaaatgaaaattgaa

SEQ ID NO: 195523 - DNA, 25 bp, Mus musculus
agctcagcagacaagaaaaatctta

SEQ ID NO: 195524 - DNA, 25 bp, Mus musculus
agctcagcaggaaataacagtccaa

SEQ ID NO: 195525 - DNA, 25 bp, Mus musculus
agctcagcatcagggagccataatt

SEQ ID NO: 195526 - DNA, 25 bp, Mus musculus
agctcagcatcagggattgttacag

SEQ ID NO: 195527 - DNA, 25 bp, Mus musculus
agctcagcatgaaagcatccctgga

SEQ ID NO: 195528 - DNA, 25 bp, Mus musculus
agctcagccacaggggcattaggag

SEQ ID NO: 195529 - DNA, 25 bp, Mus musculus
agctcagccagacagagtccggcca

SEQ ID NO: 195530 - DNA, 25 bp, Mus musculus
agctcagcctggaagacctgccagg

SEQ ID NO: 195531 - DNA, 25 bp, Mus musculus
agctcagctatggagtcagtgactt

SEQ ID NO: 195532 - DNA, 25 bp, Mus musculus
agctcagctatggagtctgtatctt

SEQ ID NO: 195533 - DNA, 25 bp, Mus musculus
agctcagctcagcacaatcctggag

SEQ ID NO: 195534 - DNA, 25 bp, Mus musculus
agctcagctgagcccagtccctgca

SEQ ID NO: 195535 - DNA, 25 bp, Mus musculus
agctcagcttggcagaacacatgtc

SEQ ID NO: 195536 - DNA, 25 bp, Mus musculus
agctcaggacagagggactgctgca

SEQ ID NO: 195537 - DNA, 25 bp, Mus musculus
agctcaggagcagcgggtttattgc

SEQ ID NO: 195538 - DNA, 25 bp, Mus musculus
agctcaggagcgccccacccatccc

SEQ ID NO: 195539 - DNA, 25 bp, Mus musculus
agctcaggaggcctcctgatgacgg

SEQ ID NO: 195540 - DNA, 25 bp, Mus musculus
agctcaggctgcaagcctgaggaag

SEQ ID NO: 195541 - DNA, 25 bp, Mus musculus
agctcaggctggcaaatgaggagat

SEQ ID NO: 195542 - DNA, 25 bp, Mus musculus
agctcagggaatggactatttgcat

SEQ ID NO: 195543 - DNA, 25 bp, Mus musculus
agctcagggtgaggcgacccctctg

SEQ ID NO: 195544 - DNA, 25 bp, Mus musculus
agctcagtcactcagctgcagcaga

SEQ ID NO: 195545 - DNA, 25 bp, Mus musculus
agctcagtcctagtactgatgtcaa

SEQ ID NO: 195546 - DNA, 25 bp, Mus musculus
agctcagtcctagtaggagagatcc

SEQ ID NO: 195547 - DNA, 25 bp, Mus musculus
agctcagtgctcagggtttaagtct

SEQ ID NO: 195548 - DNA, 25 bp, Mus musculus
agctcagtggccctgctcttggaca

SEQ ID NO: 195549 - DNA, 25 bp, Mus musculus
agctcagttgtggtagtgtgaagcc

SEQ ID NO: 195550 - DNA, 25 bp, Mus musculus
agctcatacagagtccaggctgtca

SEQ ID NO: 195551 - DNA, 25 bp, Mus musculus
agctcatacagtctcaacagatcac

SEQ ID NO: 195552 - DNA, 25 bp, Mus musculus
agctcatagaagttaatggaacccc

SEQ ID NO: 195553 - DNA, 25 bp, Mus musculus
agctcatattaaggaggccttgtca

SEQ ID NO: 195554 - DNA, 25 bp, Mus musculus
agctcatcaaagaaacccatcttca

SEQ ID NO: 195555 - DNA, 25 bp, Mus musculus
agctcatcaagaaagggtacaccca

SEQ ID NO: 195556 - DNA, 25 bp, Mus musculus
agctcatcaagtgaggaatctgagg

SEQ ID NO: 195557 - DNA, 25 bp, Mus musculus
agctcatccaaggaggcgagtactt

SEQ ID NO: 195558 - DNA, 25 bp, Mus musculus
agctcatccaagtcctaccaggaac

SEQ ID NO: 195559 - DNA, 25 bp, Mus musculus
agctcatcctagcaggtatgccaca

SEQ ID NO: 195560 - DNA, 25 bp, Mus musculus
agctcatcctgagccttgagccaga

SEQ ID NO: 195561 - DNA, 25 bp, Mus musculus
agctcatcctgagttctccacaccc

SEQ ID NO: 195562 - DNA, 25 bp, Mus musculus
agctcatcctggaccctgcatgctg

SEQ ID NO: 195563 - DNA, 25 bp, Mus musculus
agctcatcgagaaacatggcttagt

SEQ ID NO: 195564 - DNA, 25 bp, Mus musculus
agctcatcgaggagaatcagcgcct

SEQ ID NO: 195565 - DNA, 25 bp, Mus musculus
agctcatgaaggagctctttgatcg

SEQ ID NO: 195566 - DNA, 25 bp, Mus musculus
agctcatgaaggctctggtctcagt

SEQ ID NO: 195567 - DNA, 25 bp, Mus musculus
agctcatggaagaggttcaaacctt

SEQ ID NO: 195568 - DNA, 25 bp, Mus musculus
agctcatggaagaggtttattaaca

SEQ ID NO: 195569 - DNA, 25 bp, Mus musculus
agctcatggagagagcagtagagat

SEQ ID NO: 195570 - DNA, 25 bp, Mus musculus
agctcatggagcttgagatcttctt

SEQ ID NO: 195571 - DNA, 25 bp, Mus musculus
agctcatgggacaggtgaacacctt

SEQ ID NO: 195572 - DNA, 25 bp, Mus musculus
agctcatgtcagcagataggatctg

SEQ ID NO: 195573 - DNA, 25 bp, Mus musculus
agctcatgtcagcaggaaatgatgg

SEQ ID NO: 195574 - DNA, 25 bp, Mus musculus
agctcatgtcagcaggctggcgcat

SEQ ID NO: 195575 - DNA, 25 bp, Mus musculus
agctcatgttgatccgtggcttcag

SEQ ID NO: 195576 - DNA, 25 bp, Mus musculus
agctcattactacactgctctgctc

SEQ ID NO: 195577 - DNA, 25 bp, Mus musculus
agctcattgtccttgattggctctt

SEQ ID NO: 195578 - DNA, 25 bp, Mus musculus
agctcattgtccttggcaggacctc

SEQ ID NO: 195579 - DNA, 25 bp, Mus musculus
agctcattgtccttgtttatgctgc

SEQ ID NO: 195580 - DNA, 25 bp, Mus musculus
agctcattgtgggaaactccaaaca

SEQ ID NO: 195581 - DNA, 25 bp, Mus musculus
agctcattgtggggaccagcgggaa

SEQ ID NO: 195582 - DNA, 25 bp, Mus musculus
agctcatttcaggttgctcaccaca

SEQ ID NO: 195583 - DNA, 25 bp, Mus musculus
agctccaaaggaccagtccatgatg

SEQ ID NO: 195584 - DNA, 25 bp, Mus musculus
agctccaaaggttgtcgctgcttgt

SEQ ID NO: 195585 - DNA, 25 bp, Mus musculus
agctccaaccaccagttttggttca

SEQ ID NO: 195586 - DNA, 25 bp, Mus musculus
agctccaacgatgtgaaagagttcc

SEQ ID NO: 195587 - DNA, 25 bp, Mus musculus
agctccaagaatggcgggcatatcg

SEQ ID NO: 195588 - DNA, 25 bp, Mus musculus
agctccaagacagcgcatagaagct

SEQ ID NO: 195589 - DNA, 25 bp, Mus musculus
agctccaagacagcgcccatgcagg

SEQ ID NO: 195590 - DNA, 25 bp, Mus musculus
agctccaagagctgttagctgatca

SEQ ID NO: 195591 - DNA, 25 bp, Mus musculus
agctccaagaggtgtgtgatagcac

SEQ ID NO: 195592 - DNA, 25 bp, Mus musculus
agctccaaggcgtctgaatttcctg

SEQ ID NO: 195593 - DNA, 25 bp, Mus musculus
agctccaagtccgagctctgaactc

SEQ ID NO: 195594 - DNA, 25 bp, Mus musculus
agctccacacaatatgacgtgttca

SEQ ID NO: 195595 - DNA, 25 bp, Mus musculus
agctccacagcaggtggctggattc

SEQ ID NO: 195596 - DNA, 25 bp, Mus musculus
agctccacaggggatctttccagca

SEQ ID NO: 195597 - DNA, 25 bp, Mus musculus
agctccacatgaactcacagaagaa

SEQ ID NO: 195598 - DNA, 25 bp, Mus musculus
agctccacatgacattctctggctt

SEQ ID NO: 195599 - DNA, 25 bp, Mus musculus
agctccacatgccatttaccaatct

SEQ ID NO: 195600 - DNA, 25 bp, Mus musculus
agctccaccatcatctggctatgta

SEQ ID NO: 195601 - DNA, 25 bp, Mus musculus
agctccaccccctactccccgagcc

SEQ ID NO: 195602 - DNA, 25 bp, Mus musculus
agctccacctggaaatgttctgcga

SEQ ID NO: 195603 - DNA, 25 bp, Mus musculus
agctccacctgttatttggccggtc

SEQ ID NO: 195604 - DNA, 25 bp, Mus musculus
agctccaccttcagacccaggcctg

SEQ ID NO: 195605 - DNA, 25 bp, Mus musculus
agctccacggtccaggaagaatgtt

SEQ ID NO: 195606 - DNA, 25 bp, Mus musculus
agctccagaagacaggactcagctg

SEQ ID NO: 195607 - DNA, 25 bp, Mus musculus
agctccagagcacagatacctgact

SEQ ID NO: 195608 - DNA, 25 bp, Mus musculus
agctccagagccggggaatggtcta

SEQ ID NO: 195609 - DNA, 25 bp, Mus musculus
agctccagagccggtttagtctcca

SEQ ID NO: 195610 - DNA, 25 bp, Mus musculus
agctccagcacaggatgcgggctcc

SEQ ID NO: 195611 - DNA, 25 bp, Mus musculus
agctccagcaccagctcttttgata

SEQ ID NO: 195612 - DNA, 25 bp, Mus musculus
agctccagcaccagcttgctttctc

SEQ ID NO: 195613 - DNA, 25 bp, Mus musculus
agctccagcacgatggagaataggg

SEQ ID NO: 195614 - DNA, 25 bp, Mus musculus
agctccagcaggaccttctaccgtt

SEQ ID NO: 195615 - DNA, 25 bp, Mus musculus
agctccagcaggctcttgcttgata

SEQ ID NO: 195616 - DNA, 25 bp, Mus musculus
agctccagccagggatagagaaggc

SEQ ID NO: 195617 - DNA, 25 bp, Mus musculus
agctccagccccctgaagacgatga

SEQ ID NO: 195618 - DNA, 25 bp, Mus musculus
agctccagcgccggggactctgatg

SEQ ID NO: 195619 - DNA, 25 bp, Mus musculus
agctccagctaccagtgtccaaatg

SEQ ID NO: 195620 - DNA, 25 bp, Mus musculus
agctccagctgctgacccaggtcct

SEQ ID NO: 195621 - DNA, 25 bp, Mus musculus
agctccaggagctgattcagaaagg

SEQ ID NO: 195622 - DNA, 25 bp, Mus musculus
agctccaggaggcactgaagaaaca

SEQ ID NO: 195623 - DNA, 25 bp, Mus musculus
agctccaggaggttatttccatgct

SEQ ID NO: 195624 - DNA, 25 bp, Mus musculus
agctccaggtaagtgctggccattc

SEQ ID NO: 195625 - DNA, 25 bp, Mus musculus
agctccagtgtagagggccaagtcc

SEQ ID NO: 195626 - DNA, 25 bp, Mus musculus
agctccagtgtagatttatttttat

SEQ ID NO: 195627 - DNA, 25 bp, Mus musculus
agctccagtgtaggctctcagacac

SEQ ID NO: 195628 - DNA, 25 bp, Mus musculus
agctccagtgtaggtgttggaactg

SEQ ID NO: 195629 - DNA, 25 bp, Mus musculus
agctccagtttttcagccgtgccag

SEQ ID NO: 195630 - DNA, 25 bp, Mus musculus
agctccatcaacaggatcattcgga

SEQ ID NO: 195631 - DNA, 25 bp, Mus musculus
agctccatccccaggtgctgctttc

SEQ ID NO: 195632 - DNA, 25 bp, Mus musculus
agctccatgctgtcagccgttgact

SEQ ID NO: 195633 - DNA, 25 bp, Mus musculus
agctcccaacccctccaaggcccga

SEQ ID NO: 195634 - DNA, 25 bp, Mus musculus
agctcccaaggtggatgaagactca

SEQ ID NO: 195635 - DNA, 25 bp, Mus musculus
agctcccaccgcagcccagggagaa

SEQ ID NO: 195636 - DNA, 25 bp, Mus musculus
agctcccaccgcaggtatcatccgg

SEQ ID NO: 195637 - DNA, 25 bp, Mus musculus
agctcccacctgcaccttatagcca

SEQ ID NO: 195638 - DNA, 25 bp, Mus musculus
agctcccacctggttttctctgtat

SEQ ID NO: 195639 - DNA, 25 bp, Mus musculus
agctcccagagggaattcctgagca

SEQ ID NO: 195640 - DNA, 25 bp, Mus musculus
agctcccagcggcagagatagctgt

SEQ ID NO: 195641 - DNA, 25 bp, Mus musculus
agctcccagcggcagctgagcagaa

SEQ ID NO: 195642 - DNA, 25 bp, Mus musculus
agctcccaggactggtcaatgtggc

SEQ ID NO: 195643 - DNA, 25 bp, Mus musculus
agctcccaggccctgaatgaagaag

SEQ ID NO: 195644 - DNA, 25 bp, Mus musculus
agctccccctcagatccaacactcc

SEQ ID NO: 195645 - DNA, 25 bp, Mus musculus
agctccccctcagggatccgtgaac

SEQ ID NO: 195646 - DNA, 25 bp, Mus musculus
agctccccctggggtctggagggag

SEQ ID NO: 195647 - DNA, 25 bp, Mus musculus
agctccccggctgagagtctccaga

SEQ ID NO: 195648 - DNA, 25 bp, Mus musculus
agctccccgttaggccagcaggtgg

SEQ ID NO: 195649 - DNA, 25 bp, Mus musculus
agctcccctcgaagcagcaccggga

SEQ ID NO: 195650 - DNA, 25 bp, Mus musculus
agctcccgccaaacgccatgagaat

SEQ ID NO: 195651 - DNA, 25 bp, Mus musculus
agctcccggaaagtgaattatactt

SEQ ID NO: 195652 - DNA, 25 bp, Mus musculus
agctcccgggccaaggctagccaac

SEQ ID NO: 195653 - DNA, 25 bp, Mus musculus
agctccctagaagatggattcatgg

SEQ ID NO: 195654 - DNA, 25 bp, Mus musculus
agctccctagaagggcaacaacccg

SEQ ID NO: 195655 - DNA, 25 bp, Mus musculus
agctccctcaaagatgaacgagacc

SEQ ID NO: 195656 - DNA, 25 bp, Mus musculus
agctccctccgatgtcatatgcctg

SEQ ID NO: 195657 - DNA, 25 bp, Mus musculus
agctccctgacagaggatggtttgt

SEQ ID NO: 195658 - DNA, 25 bp, Mus musculus
agctccctgacagctatattgtctt

SEQ ID NO: 195659 - DNA, 25 bp, Mus musculus
agctccctgacaggcccgagcctac

SEQ ID NO: 195660 - DNA, 25 bp, Mus musculus
agctccctgacaggggagagcaccc

SEQ ID NO: 195661 - DNA, 25 bp, Mus musculus
agctccctgatcaagatggactgta

SEQ ID NO: 195662 - DNA, 25 bp, Mus musculus
agctccctgctccggcaagacattg

SEQ ID NO: 195663 - DNA, 25 bp, Mus musculus
agctccgactggaaataccagaggg

SEQ ID NO: 195664 - DNA, 25 bp, Mus musculus
agctccgactggagtctccaaaacc

SEQ ID NO: 195665 - DNA, 25 bp, Mus musculus
agctccgagagcaggtctggggatg

SEQ ID NO: 195666 - DNA, 25 bp, Mus musculus
agctccgagaggagacattccaaat

SEQ ID NO: 195667 - DNA, 25 bp, Mus musculus
agctccgagaggtagctctggctgg

SEQ ID NO: 195668 - DNA, 25 bp, Mus musculus
agctccgagaggtcctggcccagac

SEQ ID NO: 195669 - DNA, 25 bp, Mus musculus
agctccgagggcagctactgcaaga

SEQ ID NO: 195670 - DNA, 25 bp, Mus musculus
agctccgagtctggatcatctctgg

SEQ ID NO: 195671 - DNA, 25 bp, Mus musculus
agctccgcaaagagaggcagatgaa

SEQ ID NO: 195672 - DNA, 25 bp, Mus musculus
agctccgcaaagccaaatcaaatag

SEQ ID NO: 195673 - DNA, 25 bp, Mus musculus
agctccgcccagacggctcagaggt

SEQ ID NO: 195674 - DNA, 25 bp, Mus musculus
agctccgcgccgagaatcaagaact

SEQ ID NO: 195675 - DNA, 25 bp, Mus musculus
agctccgcgccgagattaaaagaaa

SEQ ID NO: 195676 - DNA, 25 bp, Mus musculus
agctccggcaaatcagccacacaga

SEQ ID NO: 195677 - DNA, 25 bp, Mus musculus
agctccggcgggcggcctcattgct

SEQ ID NO: 195678 - DNA, 25 bp, Mus musculus
agctccggcgggcggtggtacagga

SEQ ID NO: 195679 - DNA, 25 bp, Mus musculus
agctccgggctgagtcaagtccatc

SEQ ID NO: 195680 - DNA, 25 bp, Mus musculus
agctcctaacttatctacactgacc

SEQ ID NO: 195681 - DNA, 25 bp, Mus musculus
agctcctaggtgcaggcagtctaaa

SEQ ID NO: 195682 - DNA, 25 bp, Mus musculus
agctcctattcaggccatgtggctg

SEQ ID NO: 195683 - DNA, 25 bp, Mus musculus
agctcctcaccgcagcacccccact

SEQ ID NO: 195684 - DNA, 25 bp, Mus musculus
agctcctcaccggaacaaggagccc

SEQ ID NO: 195685 - DNA, 25 bp, Mus musculus
agctcctcacctgcctgcagcaaca

SEQ ID NO: 195686 - DNA, 25 bp, Mus musculus
agctcctccagagctcccagacctc

SEQ ID NO: 195687 - DNA, 25 bp, Mus musculus
agctcctccgacgtggtgacgtatg

SEQ ID NO: 195688 - DNA, 25 bp, Mus musculus
agctcctccggcactttgacacaga

SEQ ID NO: 195689 - DNA, 25 bp, Mus musculus
agctcctccggtacaaggttctgct

SEQ ID NO: 195690 - DNA, 25 bp, Mus musculus
agctcctcctctcggtacttctcca

SEQ ID NO: 195691 - DNA, 25 bp, Mus musculus
agctcctcggaagaggagaagggga

SEQ ID NO: 195692 - DNA, 25 bp, Mus musculus
agctcctcggaagcactgctacagg

SEQ ID NO: 195693 - DNA, 25 bp, Mus musculus
agctcctcggaagcatctcctctgg

SEQ ID NO: 195694 - DNA, 25 bp, Mus musculus
agctcctctcttagactatcccccg

SEQ ID NO: 195695 - DNA, 25 bp, Mus musculus
agctcctctggaaagaccccccttt

SEQ ID NO: 195696 - DNA, 25 bp, Mus musculus
agctcctcttgagaatattctcctt

SEQ ID NO: 195697 - DNA, 25 bp, Mus musculus
agctcctcttgagcattgcgccagc

SEQ ID NO: 195698 - DNA, 25 bp, Mus musculus
agctcctgaaccagctggtccctga

SEQ ID NO: 195699 - DNA, 25 bp, Mus musculus
agctcctgaagacccagggggcaag

SEQ ID NO: 195700 - DNA, 25 bp, Mus musculus
agctcctgaaggaagaagaactgaa

SEQ ID NO: 195701 - DNA, 25 bp, Mus musculus
agctcctgaatgtacccctctagac

SEQ ID NO: 195702 - DNA, 25 bp, Mus musculus
agctcctgagcccggctgtgctgga

SEQ ID NO: 195703 - DNA, 25 bp, Mus musculus
agctcctgcagccggatgtatggaa

SEQ ID NO: 195704 - DNA, 25 bp, Mus musculus
agctcctggaactatgtcttcagta

SEQ ID NO: 195705 - DNA, 25 bp, Mus musculus
agctcctggaactgaataaaagctg

SEQ ID NO: 195706 - DNA, 25 bp, Mus musculus
agctcctggaactgtgttacatcct

SEQ ID NO: 195707 - DNA, 25 bp, Mus musculus
agctcctggagcaagaaaagcagag

SEQ ID NO: 195708 - DNA, 25 bp, Mus musculus
agctcctggagcagcctgactctga

SEQ ID NO: 195709 - DNA, 25 bp, Mus musculus
agctcctggcggaggccatgaagct

SEQ ID NO: 195710 - DNA, 25 bp, Mus musculus
agctcctggcggatgccatgaagct

SEQ ID NO: 195711 - DNA, 25 bp, Mus musculus
agctcctggctgttggagacaggag

SEQ ID NO: 195712 - DNA, 25 bp, Mus musculus
agctcctgggatcctataaatttga

SEQ ID NO: 195713 - DNA, 25 bp, Mus musculus
agctcctggtacagtgacagctctt

SEQ ID NO: 195714 - DNA, 25 bp, Mus musculus
agctcctggtctcaggaatctatga

SEQ ID NO: 195715 - DNA, 25 bp, Mus musculus
agctcctggtctcaggtaatctcca

SEQ ID NO: 195716 - DNA, 25 bp, Mus musculus
agctcctgtccaggagatggcagct

SEQ ID NO: 195717 - DNA, 25 bp, Mus musculus
agctccttaagaaggcagatgaggg

SEQ ID NO: 195718 - DNA, 25 bp, Mus musculus
agctccttacttcagaggagctggc

SEQ ID NO: 195719 - DNA, 25 bp, Mus musculus
agctccttacttcagtacaggtcaa

SEQ ID NO: 195720 - DNA, 25 bp, Mus musculus
agctccttgaaagacctgcctggag

SEQ ID NO: 195721 - DNA, 25 bp, Mus musculus
agctcgaaactgcatgttgcgggat

SEQ ID NO: 195722 - DNA, 25 bp, Mus musculus
agctcgaacgatcgccggggctctg

SEQ ID NO: 195723 - DNA, 25 bp, Mus musculus
agctcgaagcagaatcagagaagct

SEQ ID NO: 195724 - DNA, 25 bp, Mus musculus
agctcgaatttaagcgtctagccag

SEQ ID NO: 195725 - DNA, 25 bp, Mus musculus
agctcgacagatgccaaagtctgag

SEQ ID NO: 195726 - DNA, 25 bp, Mus musculus
agctcgacaggtgcagggccctgtc

SEQ ID NO: 195727 - DNA, 25 bp, Mus musculus
agctcgagaagggcagttatacgac

SEQ ID NO: 195728 - DNA, 25 bp, Mus musculus
agctcgagaagtctgatcagcggat

SEQ ID NO: 195729 - DNA, 25 bp, Mus musculus
agctcgagcaggacttccaatagta

SEQ ID NO: 195730 - DNA, 25 bp, Mus musculus
agctcgagcaggttaggagaaggac

SEQ ID NO: 195731 - DNA, 25 bp, Mus musculus
agctcgagccagacagattccctcc

SEQ ID NO: 195732 - DNA, 25 bp, Mus musculus
agctcgagtgccatccgtgagcgcc

SEQ ID NO: 195733 - DNA, 25 bp, Mus musculus
agctcgcaaaggctggcaaaaccca

SEQ ID NO: 195734 - DNA, 25 bp, Mus musculus
agctcgcacagtgatgatgtgctga

SEQ ID NO: 195735 - DNA, 25 bp, Mus musculus
agctcgcacagtgggctgttggtgc

SEQ ID NO: 195736 - DNA, 25 bp, Mus musculus
agctcgcacagtggtttcaagtgcc

SEQ ID NO: 195737 - DNA, 25 bp, Mus musculus
agctcgccaaggctggctggctact

SEQ ID NO: 195738 - DNA, 25 bp, Mus musculus
agctcgcccaacttcatcaagccag

SEQ ID NO: 195739 - DNA, 25 bp, Mus musculus
agctcgccccgagagactgaattcc

SEQ ID NO: 195740 - DNA, 25 bp, Mus musculus
agctcgcctaccctgggagtttttc

SEQ ID NO: 195741 - DNA, 25 bp, Mus musculus
agctcgcctcagagtgtgttcagtt

SEQ ID NO: 195742 - DNA, 25 bp, Mus musculus
agctcgcctcagagttccctggcag

SEQ ID NO: 195743 - DNA, 25 bp, Mus musculus
agctcgcggccgagggtacttgtgg

SEQ ID NO: 195744 - DNA, 25 bp, Mus musculus
agctcgcggcggatagaaggacaag

SEQ ID NO: 195745 - DNA, 25 bp, Mus musculus
agctcgcggcgggtaccttaacatg

SEQ ID NO: 195746 - DNA, 25 bp, Mus musculus
agctcggagatggaggctcagctgt

SEQ ID NO: 195747 - DNA, 25 bp, Mus musculus
agctcggagcaggctcaggccatcc

SEQ ID NO: 195748 - DNA, 25 bp, Mus musculus
agctcggaggacaggtcaatggcca

SEQ ID NO: 195749 - DNA, 25 bp, Mus musculus
agctcggatgtggataaaaatatcc

SEQ ID NO: 195750 - DNA, 25 bp, Mus musculus
agctcggatgtggatgcaaatgaaa

SEQ ID NO: 195751 - DNA, 25 bp, Mus musculus
agctcggcaggcatttcagggaaga

SEQ ID NO: 195752 - DNA, 25 bp, Mus musculus
agctcggccacctccggggccaaga

SEQ ID NO: 195753 - DNA, 25 bp, Mus musculus
agctcggccttccagttttacctgc

SEQ ID NO: 195754 - DNA, 25 bp, Mus musculus
agctcggcgccaaagctgatggtga

SEQ ID NO: 195755 - DNA, 25 bp, Mus musculus
agctcgggaaagccatgtggagatt

SEQ ID NO: 195756 - DNA, 25 bp, Mus musculus
agctcgggaggtacagtggtcccac

SEQ ID NO: 195757 - DNA, 25 bp, Mus musculus
agctcgggaggttcccgtgagaacg

SEQ ID NO: 195758 - DNA, 25 bp, Mus musculus
agctcgggcggggaccggagctgat

SEQ ID NO: 195759 - DNA, 25 bp, Mus musculus
agctcggtcaagggggagtgcagaa

SEQ ID NO: 195760 - DNA, 25 bp, Mus musculus
agctcggtgggacagaaactcatca

SEQ ID NO: 195761 - DNA, 25 bp, Mus musculus
agctcggtgggacagctgggaacac

SEQ ID NO: 195762 - DNA, 25 bp, Mus musculus
agctcgtaaagctcaatgtcgacag

SEQ ID NO: 195763 - DNA, 25 bp, Mus musculus
agctcgtcagaagagaagacgccag

SEQ ID NO: 195764 - DNA, 25 bp, Mus musculus
agctcgtcagaagaggagtccaaaa

SEQ ID NO: 195765 - DNA, 25 bp, Mus musculus
agctcgttcaagagggagcccgcct

SEQ ID NO: 195766 - DNA, 25 bp, Mus musculus
agctcgttcaagggggcgactttct

SEQ ID NO: 195767 - DNA, 25 bp, Mus musculus
agctcgtttcaagagaacggcaggc

SEQ ID NO: 195768 - DNA, 25 bp, Mus musculus
agctctaaagcgagacctagatgcc

SEQ ID NO: 195769 - DNA, 25 bp, Mus musculus
agctctaacaggacccaggtctccc

SEQ ID NO: 195770 - DNA, 25 bp, Mus musculus
agctctaacagggcaggatggccca

SEQ ID NO: 195771 - DNA, 25 bp, Mus musculus
agctctaagttaggcaagagttcaa

SEQ ID NO: 195772 - DNA, 25 bp, Mus musculus
agctctaattggtttcaaatgtatt

SEQ ID NO: 195773 - DNA, 25 bp, Mus musculus
agctctacaaggtctccaacggtgc

SEQ ID NO: 195774 - DNA, 25 bp, Mus musculus
agctctacagagaatccccggcagc

SEQ ID NO: 195775 - DNA, 25 bp, Mus musculus
agctctacagataacccccggcagc

SEQ ID NO: 195776 - DNA, 25 bp, Mus musculus
agctctaccagaacctgacccggga

SEQ ID NO: 195777 - DNA, 25 bp, Mus musculus
agctctaccggcttgatctcagtga

SEQ ID NO: 195778 - DNA, 25 bp, Mus musculus
agctctacctaggcacaaaaggcaa

SEQ ID NO: 195779 - DNA, 25 bp, Mus musculus
agctctattggctaatgggccaatt

SEQ ID NO: 195780 - DNA, 25 bp, Mus musculus
agctctattgggtaatgggccaatt

SEQ ID NO: 195781 - DNA, 25 bp, Mus musculus
agctctcaccgagcgcagccttggg

SEQ ID NO: 195782 - DNA, 25 bp, Mus musculus
agctctcagaaggcaaatgtgccga

SEQ ID NO: 195783 - DNA, 25 bp, Mus musculus
agctctcagaaggccaagttcgaca

SEQ ID NO: 195784 - DNA, 25 bp, Mus musculus
agctctcagacaggaacagaaattc

SEQ ID NO: 195785 - DNA, 25 bp, Mus musculus
agctctcagacaggtttggtcgcaa

SEQ ID NO: 195786 - DNA, 25 bp, Mus musculus
agctctcagaggcagatgacctgga

SEQ ID NO: 195787 - DNA, 25 bp, Mus musculus
agctctcagctcagcggaacctgcc

SEQ ID NO: 195788 - DNA, 25 bp, Mus musculus
agctctcagctcagcggtcacacag

SEQ ID NO: 195789 - DNA, 25 bp, Mus musculus
agctctccagatcatggctccttgg

SEQ ID NO: 195790 - DNA, 25 bp, Mus musculus
agctctccagtgtggatgccacctc

SEQ ID NO: 195791 - DNA, 25 bp, Mus musculus
agctctccccgatggctcattgcgt

SEQ ID NO: 195792 - DNA, 25 bp, Mus musculus
agctctccccggattgacttggcct

SEQ ID NO: 195793 - DNA, 25 bp, Mus musculus
agctctccccgtctaaaagttggtt

SEQ ID NO: 195794 - DNA, 25 bp, Mus musculus
agctctccgcagcaggatgagccgg

SEQ ID NO: 195795 - DNA, 25 bp, Mus musculus
agctctccgcagcagtttacaatct

SEQ ID NO: 195796 - DNA, 25 bp, Mus musculus
agctctcctgcaaaggctgaggagc

SEQ ID NO: 195797 - DNA, 25 bp, Mus musculus
agctctcctgcaaatgtccaaacgg

SEQ ID NO: 195798 - DNA, 25 bp, Mus musculus
agctctcctgcaagtgtcctgtggg

SEQ ID NO: 195799 - DNA, 25 bp, Mus musculus
agctctcctgttaggcgtctctttt

SEQ ID NO: 195800 - DNA, 25 bp, Mus musculus
agctctcgcagagacgtggagctat

SEQ ID NO: 195801 - DNA, 25 bp, Mus musculus
agctctcggcaggccgtttagggac

SEQ ID NO: 195802 - DNA, 25 bp, Mus musculus
agctctcggggatcttgaaacagga

SEQ ID NO: 195803 - DNA, 25 bp, Mus musculus
agctctcgtcctaggctaggcggcc

SEQ ID NO: 195804 - DNA, 25 bp, Mus musculus
agctctcgtcctagggggagcttct

SEQ ID NO: 195805 - DNA, 25 bp, Mus musculus
agctctctatgatcttaccaatata

SEQ ID NO: 195806 - DNA, 25 bp, Mus musculus
agctctctcaggagttaaaaataaa

SEQ ID NO: 195807 - DNA, 25 bp, Mus musculus
agctctctccccatgactgacttgg

SEQ ID NO: 195808 - DNA, 25 bp, Mus musculus
agctctctgaagcaggacctggagt

SEQ ID NO: 195809 - DNA, 25 bp, Mus musculus
agctctctgacaggtgtccccagaa

SEQ ID NO: 195810 - DNA, 25 bp, Mus musculus
agctctctttcagggagacatagcc

SEQ ID NO: 195811 - DNA, 25 bp, Mus musculus
agctctgaaaaagtcaccttaattt

SEQ ID NO: 195812 - DNA, 25 bp, Mus musculus
agctctgacagttccaggaggcagc

SEQ ID NO: 195813 - DNA, 25 bp, Mus musculus
agctctgacttctgtttctcttcag

SEQ ID NO: 195814 - DNA, 25 bp, Mus musculus
agctctgagaggatgtgcccgatat

SEQ ID NO: 195815 - DNA, 25 bp, Mus musculus
agctctgattccaagcctggaaggg

SEQ ID NO: 195816 - DNA, 25 bp, Mus musculus
agctctgatttcttggaatagaaac

SEQ ID NO: 195817 - DNA, 25 bp, Mus musculus
agctctgatttcttgggtgaagaaa

SEQ ID NO: 195818 - DNA, 25 bp, Mus musculus
agctctgcaacaaaggcttcaccac

SEQ ID NO: 195819 - DNA, 25 bp, Mus musculus
agctctgcaacaaaggtactggtga

SEQ ID NO: 195820 - DNA, 25 bp, Mus musculus
agctctgcaagagaagctgatggtc

SEQ ID NO: 195821 - DNA, 25 bp, Mus musculus
agctctgcaaggacatccaggcaga

SEQ ID NO: 195822 - DNA, 25 bp, Mus musculus
agctctgcaagtacggttagaacac

SEQ ID NO: 195823 - DNA, 25 bp, Mus musculus
agctctgcaccagagattgtgcacg

SEQ ID NO: 195824 - DNA, 25 bp, Mus musculus
agctctgcaccaggtctacctgggt

SEQ ID NO: 195825 - DNA, 25 bp, Mus musculus
agctctgcagccccatgtgcatgca

SEQ ID NO: 195826 - DNA, 25 bp, Mus musculus
agctctgcaggggactccttttcac

SEQ ID NO: 195827 - DNA, 25 bp, Mus musculus
agctctgcatacggtagtcttttac

SEQ ID NO: 195828 - DNA, 25 bp, Mus musculus
agctctgccctggattggtagctta

SEQ ID NO: 195829 - DNA, 25 bp, Mus musculus
agctctgcctatttgatcaagagga

SEQ ID NO: 195830 - DNA, 25 bp, Mus musculus
agctctgcggaggtgctgctgggga

SEQ ID NO: 195831 - DNA, 25 bp, Mus musculus
agctctgctgacagggcagtttcac

SEQ ID NO: 195832 - DNA, 25 bp, Mus musculus
agctctgctgactgtgcagaatcgg

SEQ ID NO: 195833 - DNA, 25 bp, Mus musculus
agctctgcttgtgggccaccccttc

SEQ ID NO: 195834 - DNA, 25 bp, Mus musculus
agctctggagctgccatcaacaccc

SEQ ID NO: 195835 - DNA, 25 bp, Mus musculus
agctctggaggttgctgaacgaaag

SEQ ID NO: 195836 - DNA, 25 bp, Mus musculus
agctctggagttgctttttgcaatg

SEQ ID NO: 195837 - DNA, 25 bp, Mus musculus
agctctggagttggctgcaacaggt

SEQ ID NO: 195838 - DNA, 25 bp, Mus musculus
agctctggggaagccttggccacga

SEQ ID NO: 195839 - DNA, 25 bp, Mus musculus
agctctggggaagctgctgcccaga

SEQ ID NO: 195840 - DNA, 25 bp, Mus musculus
agctctgggtacccgctttcttgat

SEQ ID NO: 195841 - DNA, 25 bp, Mus musculus
agctctggtcgaggaagatgggctc

SEQ ID NO: 195842 - DNA, 25 bp, Mus musculus
agctctggtgatgatgtggccctca

SEQ ID NO: 195843 - DNA, 25 bp, Mus musculus
agctctggtgatgtactccaacctg

SEQ ID NO: 195844 - DNA, 25 bp, Mus musculus
agctctggttagaggtgaagaatat

SEQ ID NO: 195845 - DNA, 25 bp, Mus musculus
agctctgtaccttggacaaagtggg

SEQ ID NO: 195846 - DNA, 25 bp, Mus musculus
agctctgtgaaaggtaaccccaggt

SEQ ID NO: 195847 - DNA, 25 bp, Mus musculus
agctctgtggaatcaccctgcccca

SEQ ID NO: 195848 - DNA, 25 bp, Mus musculus
agctctgtgggaagacaaagccatt

SEQ ID NO: 195849 - DNA, 25 bp, Mus musculus
agctctgttactgccaggcatctgg

SEQ ID NO: 195850 - DNA, 25 bp, Mus musculus
agctctgttactgcccatgaaaccc

SEQ ID NO: 195851 - DNA, 25 bp, Mus musculus
agctcttaagaaggactgcagtgag

SEQ ID NO: 195852 - DNA, 25 bp, Mus musculus
agctcttacaggcaccaacagagag

SEQ ID NO: 195853 - DNA, 25 bp, Mus musculus
agctcttagagattcccaccctgct

SEQ ID NO: 195854 - DNA, 25 bp, Mus musculus
agctcttcacggcactggttctaag

SEQ ID NO: 195855 - DNA, 25 bp, Mus musculus
agctcttcagctctggggacactgt

SEQ ID NO: 195856 - DNA, 25 bp, Mus musculus
agctcttcaggactgggcagctcag

SEQ ID NO: 195857 - DNA, 25 bp, Mus musculus
agctcttcaggttgatcgccttaga

SEQ ID NO: 195858 - DNA, 25 bp, Mus musculus
agctcttccaacacttcgacaaaat

SEQ ID NO: 195859 - DNA, 25 bp, Mus musculus
agctcttcctgggcggcggccagcg

SEQ ID NO: 195860 - DNA, 25 bp, Mus musculus
agctcttcgtcaaggaaacctgcag

SEQ ID NO: 195861 - DNA, 25 bp, Mus musculus
agctcttcgtcaaggccggaagtga

SEQ ID NO: 195862 - DNA, 25 bp, Mus musculus
agctcttctcagagaagaaaagcga

SEQ ID NO: 195863 - DNA, 25 bp, Mus musculus
agctcttgaaggatctgcagcagag

SEQ ID NO: 195864 - DNA, 25 bp, Mus musculus
agctcttgaccaagttccaggaaga

SEQ ID NO: 195865 - DNA, 25 bp, Mus musculus
agctcttgactcgagaagtcgtcac

SEQ ID NO: 195866 - DNA, 25 bp, Mus musculus
agctcttggagatttttgcagctca

SEQ ID NO: 195867 - DNA, 25 bp, Mus musculus
agctcttgggagagcgcattaaaga

SEQ ID NO: 195868 - DNA, 25 bp, Mus musculus
agctcttggtgtggacacttcccga

SEQ ID NO: 195869 - DNA, 25 bp, Mus musculus
agctcttggtgtgggacgcccctaa

SEQ ID NO: 195870 - DNA, 25 bp, Mus musculus
agctctttagggttctactttacca

SEQ ID NO: 195871 - DNA, 25 bp, Mus musculus
agctctttaggtctgaacggcgttc

SEQ ID NO: 195872 - DNA, 25 bp, Mus musculus
agctctttattctgtcaaccacaga

SEQ ID NO: 195873 - DNA, 25 bp, Mus musculus
agctctttctgagacaccccctgtt

SEQ ID NO: 195874 - DNA, 25 bp, Mus musculus
agctcttttccaggcatggtttatt

SEQ ID NO: 195875 - DNA, 25 bp, Mus musculus
agctcttttctcagagcaacacgtt

SEQ ID NO: 195876 - DNA, 25 bp, Mus musculus
agctgaaaaacattggattgcaatc

SEQ ID NO: 195877 - DNA, 25 bp, Mus musculus
agctgaaaaactacaaaatccacag

SEQ ID NO: 195878 - DNA, 25 bp, Mus musculus
agctgaaaaactacagaagttaaat

SEQ ID NO: 195879 - DNA, 25 bp, Mus musculus
agctgaaaagaaagggccaaataaa

SEQ ID NO: 195880 - DNA, 25 bp, Mus musculus
agctgaaaagaagatccagccgcag

SEQ ID NO: 195881 - DNA, 25 bp, Mus musculus
agctgaaaaggtgtctctggttggt

SEQ ID NO: 195882 - DNA, 25 bp, Mus musculus
agctgaaacagggaccgcgtggcgc

SEQ ID NO: 195883 - DNA, 25 bp, Mus musculus
agctgaaacccagatccttactgac

SEQ ID NO: 195884 - DNA, 25 bp, Mus musculus
agctgaaactgaaggctggcaacat

SEQ ID NO: 195885 - DNA, 25 bp, Mus musculus
agctgaaagaggtggaagcggcaaa

SEQ ID NO: 195886 - DNA, 25 bp, Mus musculus
agctgaaagcagggtgtggacaggc

SEQ ID NO: 195887 - DNA, 25 bp, Mus musculus
agctgaacaagaagatctaccgcat

SEQ ID NO: 195888 - DNA, 25 bp, Mus musculus
agctgaacaagtactctacgcacct

SEQ ID NO: 195889 - DNA, 25 bp, Mus musculus
agctgaaccaagtctgtgatgagga

SEQ ID NO: 195890 - DNA, 25 bp, Mus musculus
agctgaaccacaggaattcaaaccc

SEQ ID NO: 195891 - DNA, 25 bp, Mus musculus
agctgaaccacaggatgtgaactac

SEQ ID NO: 195892 - DNA, 25 bp, Mus musculus
agctgaaccagctcaaaggcaaatc

SEQ ID NO: 195893 - DNA, 25 bp, Mus musculus
agctgaaccaggccgcgttgtctgt

SEQ ID NO: 195894 - DNA, 25 bp, Mus musculus
agctgaacctaaggctgctgacttt

SEQ ID NO: 195895 - DNA, 25 bp, Mus musculus
agctgaaccttgagaggcttatacc

SEQ ID NO: 195896 - DNA, 25 bp, Mus musculus
agctgaactgagctgagctgggtga

SEQ ID NO: 195897 - DNA, 25 bp, Mus musculus
agctgaactggcagaacagctgatt

SEQ ID NO: 195898 - DNA, 25 bp, Mus musculus
agctgaagaaaaggccttggcaatt

SEQ ID NO: 195899 - DNA, 25 bp, Mus musculus
agctgaagaaccaagcaatgtcttc

SEQ ID NO: 195900 - DNA, 25 bp, Mus musculus
agctgaagaagcaatatggtattca

SEQ ID NO: 195901 - DNA, 25 bp, Mus musculus
agctgaagaagcaatgaactcccag

SEQ ID NO: 195902 - DNA, 25 bp, Mus musculus
agctgaagaaggcgccctttgtggc

SEQ ID NO: 195903 - DNA, 25 bp, Mus musculus
agctgaagaaggtggctgctgggaa

SEQ ID NO: 195904 - DNA, 25 bp, Mus musculus
agctgaagagagagagaagacagtt

SEQ ID NO: 195905 - DNA, 25 bp, Mus musculus
agctgaagagctcaggtgtaccagc

SEQ ID NO: 195906 - DNA, 25 bp, Mus musculus
agctgaagagttgtgttagggtttt

SEQ ID NO: 195907 - DNA, 25 bp, Mus musculus
agctgaagcctgaaggtctccacca

SEQ ID NO: 195908 - DNA, 25 bp, Mus musculus
agctgaagctgaacctgagccagcg

SEQ ID NO: 195909 - DNA, 25 bp, Mus musculus
agctgaaggacgagggccttgggta

SEQ ID NO: 195910 - DNA, 25 bp, Mus musculus
agctgaaggctcgcaacaccaagaa

SEQ ID NO: 195911 - DNA, 25 bp, Mus musculus
agctgaagggaagtgaccaagcctc

SEQ ID NO: 195912 - DNA, 25 bp, Mus musculus
agctgaagggctctcctgctgccaa

SEQ ID NO: 195913 - DNA, 25 bp, Mus musculus
agctgaagtcaggaaagtcagcagg

SEQ ID NO: 195914 - DNA, 25 bp, Mus musculus
agctgaagtggtgtgctcggaggac

SEQ ID NO: 195915 - DNA, 25 bp, Mus musculus
agctgaagttcggttcctgtgtgac

SEQ ID NO: 195916 - DNA, 25 bp, Mus musculus
agctgaatataaactgtcattattg

SEQ ID NO: 195917 - DNA, 25 bp, Mus musculus
agctgaatgaaagggagaagaagga

SEQ ID NO: 195918 - DNA, 25 bp, Mus musculus
agctgaatgccatcaaactacaact

SEQ ID NO: 195919 - DNA, 25 bp, Mus musculus
agctgaattcagaggtggcgagtga

SEQ ID NO: 195920 - DNA, 25 bp, Mus musculus
agctgacaacaaatggaccccttct

SEQ ID NO: 195921 - DNA, 25 bp, Mus musculus
agctgacaacaaatgtcactagtgc

SEQ ID NO: 195922 - DNA, 25 bp, Mus musculus
agctgacacctcagggcacacttgc

SEQ ID NO: 195923 - DNA, 25 bp, Mus musculus
agctgacacgctggagatggagttg

SEQ ID NO: 195924 - DNA, 25 bp, Mus musculus
agctgacagacagtatctgaacaca

SEQ ID NO: 195925 - DNA, 25 bp, Mus musculus
agctgacagaccaagtctgctgaag

SEQ ID NO: 195926 - DNA, 25 bp, Mus musculus
agctgacagagcttttcttcatgca

SEQ ID NO: 195927 - DNA, 25 bp, Mus musculus
agctgacaggggttccacagcactg

SEQ ID NO: 195928 - DNA, 25 bp, Mus musculus
agctgaccaaagcggagaagctgca

SEQ ID NO: 195929 - DNA, 25 bp, Mus musculus
agctgaccaagggactgcacaggac

SEQ ID NO: 195930 - DNA, 25 bp, Mus musculus
agctgaccaagttacagtccatcat

SEQ ID NO: 195931 - DNA, 25 bp, Mus musculus
agctgacccactgaagctgggggcg

SEQ ID NO: 195932 - DNA, 25 bp, Mus musculus
agctgacccagatatatttgtatgc

SEQ ID NO: 195933 - DNA, 25 bp, Mus musculus
agctgacccaggacatttgacacct

SEQ ID NO: 195934 - DNA, 25 bp, Mus musculus
agctgacccagtttgctgagaagtt

SEQ ID NO: 195935 - DNA, 25 bp, Mus musculus
agctgaccccagagcaccagactgt

SEQ ID NO: 195936 - DNA, 25 bp, Mus musculus
agctgacccccaagaggccattaac

SEQ ID NO: 195937 - DNA, 25 bp, Mus musculus
agctgacccccaaggccatcgccca

SEQ ID NO: 195938 - DNA, 25 bp, Mus musculus
agctgacccgactcagccttatgga

SEQ ID NO: 195939 - DNA, 25 bp, Mus musculus
agctgaccgtgctattcactggcaa

SEQ ID NO: 195940 - DNA, 25 bp, Mus musculus
agctgaccgtggtgagttgaggggt

SEQ ID NO: 195941 - DNA, 25 bp, Mus musculus
agctgacctactaggtcactgccca

SEQ ID NO: 195942 - DNA, 25 bp, Mus musculus
agctgacctcgaggaagtggacatt

SEQ ID NO: 195943 - DNA, 25 bp, Mus musculus
agctgacgaggaaggggaagaagaa

SEQ ID NO: 195944 - DNA, 25 bp, Mus musculus
agctgacgagggttatcagctcttt

SEQ ID NO: 195945 - DNA, 25 bp, Mus musculus
agctgacgcgggtgggtcatcgtgg

SEQ ID NO: 195946 - DNA, 25 bp, Mus musculus
agctgacggagacagggagttctca

SEQ ID NO: 195947 - DNA, 25 bp, Mus musculus
agctgactactccagtcactgtggg

SEQ ID NO: 195948 - DNA, 25 bp, Mus musculus
agctgactactccatgcggctctgc

SEQ ID NO: 195949 - DNA, 25 bp, Mus musculus
agctgactatgctcactctttgggt

SEQ ID NO: 195950 - DNA, 25 bp, Mus musculus
agctgactcagcaaatggaacttcc

SEQ ID NO: 195951 - DNA, 25 bp, Mus musculus
agctgactcagcccggcaagctgac

SEQ ID NO: 195952 - DNA, 25 bp, Mus musculus
agctgactcaggaatttgaagccta

SEQ ID NO: 195953 - DNA, 25 bp, Mus musculus
agctgactcatatgagtccaacact

SEQ ID NO: 195954 - DNA, 25 bp, Mus musculus
agctgactcatatgccctggtgtgg

SEQ ID NO: 195955 - DNA, 25 bp, Mus musculus
agctgactcgcaacgagtctgtagc

SEQ ID NO: 195956 - DNA, 25 bp, Mus musculus
agctgactgagcacactctgcagag

SEQ ID NO: 195957 - DNA, 25 bp, Mus musculus
agctgactgagcacgcggtggaggg

SEQ ID NO: 195958 - DNA, 25 bp, Mus musculus
agctgacttgcaggttgatatgtca

SEQ ID NO: 195959 - DNA, 25 bp, Mus musculus
agctgagaaagaagctgctccagct

SEQ ID NO: 195960 - DNA, 25 bp, Mus musculus
agctgagagtaagatttatgacatt

SEQ ID NO: 195961 - DNA, 25 bp, Mus musculus
agctgagatactagtgactgctccc

SEQ ID NO: 195962 - DNA, 25 bp, Mus musculus
agctgagattaaagacagctgcagc

SEQ ID NO: 195963 - DNA, 25 bp, Mus musculus
agctgagcaaacagctgcccgggag

SEQ ID NO: 195964 - DNA, 25 bp, Mus musculus
agctgagcacggagcctggtggagg

SEQ ID NO: 195965 - DNA, 25 bp, Mus musculus
agctgagcacgttgagccacgtggt

SEQ ID NO: 195966 - DNA, 25 bp, Mus musculus
agctgagcagaaaggcgctctaatg

SEQ ID NO: 195967 - DNA, 25 bp, Mus musculus
agctgagcaggcggaggaagaaggt

SEQ ID NO: 195968 - DNA, 25 bp, Mus musculus
agctgagccctgcgccaaaacgaca

SEQ ID NO: 195969 - DNA, 25 bp, Mus musculus
agctgagcctccccctgcaggaggc

SEQ ID NO: 195970 - DNA, 25 bp, Mus musculus
agctgagcggcagccgccacctagt

SEQ ID NO: 195971 - DNA, 25 bp, Mus musculus
agctgagcggtcaaagcagccgcca

SEQ ID NO: 195972 - DNA, 25 bp, Mus musculus
agctgagctgaactgagctgagctg

SEQ ID NO: 195973 - DNA, 25 bp, Mus musculus
agctgagctgagctggagagtcagt

SEQ ID NO: 195974 - DNA, 25 bp, Mus musculus
agctgagctgcgaggggtcctgaga

SEQ ID NO: 195975 - DNA, 25 bp, Mus musculus
agctgagctggagagtcagtccttc

SEQ ID NO: 195976 - DNA, 25 bp, Mus musculus
agctgagctgggagagtcagtcctt

SEQ ID NO: 195977 - DNA, 25 bp, Mus musculus
agctgaggaacatctgattgccttc

SEQ ID NO: 195978 - DNA, 25 bp, Mus musculus
agctgaggaatgtgatggttctcca

SEQ ID NO: 195979 - DNA, 25 bp, Mus musculus
agctgaggaatgtgcccctgtccct

SEQ ID NO: 195980 - DNA, 25 bp, Mus musculus
agctgaggagctcttccaggaatct

SEQ ID NO: 195981 - DNA, 25 bp, Mus musculus
agctgaggaggtcataacttcctca

SEQ ID NO: 195982 - DNA, 25 bp, Mus musculus
agctgaggcagagaaaaggcaggag

SEQ ID NO: 195983 - DNA, 25 bp, Mus musculus
agctgaggcaggaaggttcgttctc

SEQ ID NO: 195984 - DNA, 25 bp, Mus musculus
agctgaggcaggacggattctgatg

SEQ ID NO: 195985 - DNA, 25 bp, Mus musculus
agctgaggcaggacggctgctgtga

SEQ ID NO: 195986 - DNA, 25 bp, Mus musculus
agctgaggcagggtcagaaagcatg

SEQ ID NO: 195987 - DNA, 25 bp, Mus musculus
agctgaggcggggcatcgtgaagct

SEQ ID NO: 195988 - DNA, 25 bp, Mus musculus
agctgagggagacgcactacttcgg

SEQ ID NO: 195989 - DNA, 25 bp, Mus musculus
agctgagtatagaggtgctccagac

SEQ ID NO: 195990 - DNA, 25 bp, Mus musculus
agctgagtgacaggggacccatgag

SEQ ID NO: 195991 - DNA, 25 bp, Mus musculus
agctgagtgcaagtgtcctgcagga

SEQ ID NO: 195992 - DNA, 25 bp, Mus musculus
agctgagtgtaagggttcccgagag

SEQ ID NO: 195993 - DNA, 25 bp, Mus musculus
agctgagttcacagaaacttcgtgg

SEQ ID NO: 195994 - DNA, 25 bp, Mus musculus
agctgagttcacagagttctcagta

SEQ ID NO: 195995 - DNA, 25 bp, Mus musculus
agctgagtttacaatccaagagaaa

SEQ ID NO: 195996 - DNA, 25 bp, Mus musculus
agctgagtttacaattttctaatga

SEQ ID NO: 195997 - DNA, 25 bp, Mus musculus
agctgagtttactatccaagagaaa

SEQ ID NO: 195998 - DNA, 25 bp, Mus musculus
agctgagtttactattttctaatga

SEQ ID NO: 195999 - DNA, 25 bp, Mus musculus
agctgataaccacggctctgaagcg

SEQ ID NO: 196000 - DNA, 25 bp, Mus musculus
agctgataaccacgtctctgggtcc

SEQ ID NO: 196001 - DNA, 25 bp, Mus musculus
agctgatcaagaggcctgccaagcc

SEQ ID NO: 196002 - DNA, 25 bp, Mus musculus
agctgatcaagccagccatctcccc

SEQ ID NO: 196003 - DNA, 25 bp, Mus musculus
agctgatcaaggaaccttctgtgga

SEQ ID NO: 196004 - DNA, 25 bp, Mus musculus
agctgatcaaggtcttggataaact

SEQ ID NO: 196005 - DNA, 25 bp, Mus musculus
agctgatcaggctctaagggatgga

SEQ ID NO: 196006 - DNA, 25 bp, Mus musculus
agctgatcctgataccgctattgtg

SEQ ID NO: 196007 - DNA, 25 bp, Mus musculus
agctgatcgaagagttagcaatagc

SEQ ID NO: 196008 - DNA, 25 bp, Mus musculus
agctgatcgagaaaacataaagaac

SEQ ID NO: 196009 - DNA, 25 bp, Mus musculus
agctgatctcctaggagtgcgcgat

SEQ ID NO: 196010 - DNA, 25 bp, Mus musculus
agctgatctcctaggtttcaggaat

SEQ ID NO: 196011 - DNA, 25 bp, Mus musculus
agctgatctgcagactcagccttat

SEQ ID NO: 196012 - DNA, 25 bp, Mus musculus
agctgatctgcagtcagcaactctt

SEQ ID NO: 196013 - DNA, 25 bp, Mus musculus
agctgatgacacagattctgagctg

SEQ ID NO: 196014 - DNA, 25 bp, Mus musculus
agctgatgactccgaaccaactgtg

SEQ ID NO: 196015 - DNA, 25 bp, Mus musculus
agctgatgaggatcctcagctcctc

SEQ ID NO: 196016 - DNA, 25 bp, Mus musculus
agctgatgagggttctggggacatg

SEQ ID NO: 196017 - DNA, 25 bp, Mus musculus
agctgatgccagtcattgcattcag

SEQ ID NO: 196018 - DNA, 25 bp, Mus musculus
agctgatgccagtcattgtatacaa

SEQ ID NO: 196019 - DNA, 25 bp, Mus musculus
agctgatggagagaggtgccagcgt

SEQ ID NO: 196020 - DNA, 25 bp, Mus musculus
agctgatggagagttatttgcttgg

SEQ ID NO: 196021 - DNA, 25 bp, Mus musculus
agctgatgtcattctcccatgtgtg

SEQ ID NO: 196022 - DNA, 25 bp, Mus musculus
agctgattgagaagctgggaggctg

SEQ ID NO: 196023 - DNA, 25 bp, Mus musculus
agctgcaaaggagggctgctggcct

SEQ ID NO: 196024 - DNA, 25 bp, Mus musculus
agctgcaaataacgtgaactgtgga

SEQ ID NO: 196025 - DNA, 25 bp, Mus musculus
agctgcaagactaggtttgccagat

SEQ ID NO: 196026 - DNA, 25 bp, Mus musculus
agctgcaagccctgagcttgtccca

SEQ ID NO: 196027 - DNA, 25 bp, Mus musculus
agctgcaagccctggctgcttttag

SEQ ID NO: 196028 - DNA, 25 bp, Mus musculus
agctgcaaggcaggttggcgtgggt

SEQ ID NO: 196029 - DNA, 25 bp, Mus musculus
agctgcaatggcagaacacaagaat

SEQ ID NO: 196030 - DNA, 25 bp, Mus musculus
agctgcaatggcagcctggactgca

SEQ ID NO: 196031 - DNA, 25 bp, Mus musculus
agctgcaatggcaggttttactgca

SEQ ID NO: 196032 - DNA, 25 bp, Mus musculus
agctgcacaagtcacgggtcacagt

SEQ ID NO: 196033 - DNA, 25 bp, Mus musculus
agctgcacacttacgtccacgccac

SEQ ID NO: 196034 - DNA, 25 bp, Mus musculus
agctgcacagcagaggtggaaaatg

SEQ ID NO: 196035 - DNA, 25 bp, Mus musculus
agctgcacatatgaggtgcttgagc

SEQ ID NO: 196036 - DNA, 25 bp, Mus musculus
agctgcacatatgagtgttttaaaa

SEQ ID NO: 196037 - DNA, 25 bp, Mus musculus
agctgcacatcaagacctgtgttcc

SEQ ID NO: 196038 - DNA, 25 bp, Mus musculus
agctgcacatcaaggtccctttgtg

SEQ ID NO: 196039 - DNA, 25 bp, Mus musculus
agctgcacgtcaggacaaagtgggg

SEQ ID NO: 196040 - DNA, 25 bp, Mus musculus
agctgcactcaaaagtcagcgtggg

SEQ ID NO: 196041 - DNA, 25 bp, Mus musculus
agctgcactcaggaagaggagacag

SEQ ID NO: 196042 - DNA, 25 bp, Mus musculus
agctgcacttcagacgaattatcaa

SEQ ID NO: 196043 - DNA, 25 bp, Mus musculus
agctgcagaaaggtcagacgggaac

SEQ ID NO: 196044 - DNA, 25 bp, Mus musculus
agctgcagaaccaggtggagaatct

SEQ ID NO: 196045 - DNA, 25 bp, Mus musculus
agctgcagaatgctggccttgcaga

SEQ ID NO: 196046 - DNA, 25 bp, Mus musculus
agctgcagaatggtaatacacagct

SEQ ID NO: 196047 - DNA, 25 bp, Mus musculus
agctgcagactctgatactaccaca

SEQ ID NO: 196048 - DNA, 25 bp, Mus musculus
agctgcagaggactgtatgaacgag

SEQ ID NO: 196049 - DNA, 25 bp, Mus musculus
agctgcagaggagcaactttcagcc

SEQ ID NO: 196050 - DNA, 25 bp, Mus musculus
agctgcagaggccagagctattaag

SEQ ID NO: 196051 - DNA, 25 bp, Mus musculus
agctgcagagtgaaatgacactgct

SEQ ID NO: 196052 - DNA, 25 bp, Mus musculus
agctgcagagtgagcaccaggtttt

SEQ ID NO: 196053 - DNA, 25 bp, Mus musculus
agctgcagagtgatgtcaagtacaa

SEQ ID NO: 196054 - DNA, 25 bp, Mus musculus
agctgcagagtttcatgatggctac

SEQ ID NO: 196055 - DNA, 25 bp, Mus musculus
agctgcagatttgggacacagcagg

SEQ ID NO: 196056 - DNA, 25 bp, Mus musculus
agctgcagcaagagttccactgttg

SEQ ID NO: 196057 - DNA, 25 bp, Mus musculus
agctgcagcaataccctgcagcaag

SEQ ID NO: 196058 - DNA, 25 bp, Mus musculus
agctgcagcagaagattctctgtgg

SEQ ID NO: 196059 - DNA, 25 bp, Mus musculus
agctgcagcagatggagcagaggaa

SEQ ID NO: 196060 - DNA, 25 bp, Mus musculus
agctgcagcaggagttaaaaataaa

SEQ ID NO: 196061 - DNA, 25 bp, Mus musculus
agctgcagcaggctgttctgcagat

SEQ ID NO: 196062 - DNA, 25 bp, Mus musculus
agctgcagcagggctcatggcagat

SEQ ID NO: 196063 - DNA, 25 bp, Mus musculus
agctgcagcccacttcttagatgca

SEQ ID NO: 196064 - DNA, 25 bp, Mus musculus
agctgcagccccagggcctgcttcc

SEQ ID NO: 196065 - DNA, 25 bp, Mus musculus
agctgcagcccctgtccaggtgatt

SEQ ID NO: 196066 - DNA, 25 bp, Mus musculus
agctgcagcctctgtccggatagct

SEQ ID NO: 196067 - DNA, 25 bp, Mus musculus
agctgcagcgctatgcttggcgcaa

SEQ ID NO: 196068 - DNA, 25 bp, Mus musculus
agctgcagcgctatgtgatgtacaa

SEQ ID NO: 196069 - DNA, 25 bp, Mus musculus
agctgcagcggcttcctctgggggg

SEQ ID NO: 196070 - DNA, 25 bp, Mus musculus
agctgcagctgctgaaggaagcaat

SEQ ID NO: 196071 - DNA, 25 bp, Mus musculus
agctgcaggagagcgcacacacgta

SEQ ID NO: 196072 - DNA, 25 bp, Mus musculus
agctgcaggagtggcatctcccact

SEQ ID NO: 196073 - DNA, 25 bp, Mus musculus
agctgcagggcaagatccggactct

SEQ ID NO: 196074 - DNA, 25 bp, Mus musculus
agctgcagtagaaaaagttaagaag

SEQ ID NO: 196075 - DNA, 25 bp, Mus musculus
agctgcagtcccacttgttcggcca

SEQ ID NO: 196076 - DNA, 25 bp, Mus musculus
agctgcagttccaggaggaggactt

SEQ ID NO: 196077 - DNA, 25 bp, Mus musculus
agctgcagttccaggtccctgaggg

SEQ ID NO: 196078 - DNA, 25 bp, Mus musculus
agctgcatatctaggggagtatgtg

SEQ ID NO: 196079 - DNA, 25 bp, Mus musculus
agctgcatccttcgaatgctgactc

SEQ ID NO: 196080 - DNA, 25 bp, Mus musculus
agctgcatctgcctgcaccgtacta

SEQ ID NO: 196081 - DNA, 25 bp, Mus musculus
agctgcatctgcctgctgggctcag

SEQ ID NO: 196082 - DNA, 25 bp, Mus musculus
agctgcatgaccagtgtagtccatg

SEQ ID NO: 196083 - DNA, 25 bp, Mus musculus
agctgcatgtgctccctctctatag

SEQ ID NO: 196084 - DNA, 25 bp, Mus musculus
agctgccaaccaggactgggcaaag

SEQ ID NO: 196085 - DNA, 25 bp, Mus musculus
agctgccaaccagttgtctaatggg

SEQ ID NO: 196086 - DNA, 25 bp, Mus musculus
agctgccaatgggattggtcgcctg

SEQ ID NO: 196087 - DNA, 25 bp, Mus musculus
agctgccactttcagacctagatac

SEQ ID NO: 196088 - DNA, 25 bp, Mus musculus
agctgccagcaggtagatcatgatc

SEQ ID NO: 196089 - DNA, 25 bp, Mus musculus
agctgccagcaggtctccccctcct

SEQ ID NO: 196090 - DNA, 25 bp, Mus musculus
agctgccatccctggatgtcagtgc

SEQ ID NO: 196091 - DNA, 25 bp, Mus musculus
agctgccatgactcagtcggctgtc

SEQ ID NO: 196092 - DNA, 25 bp, Mus musculus
agctgccatgggaattcctcaagct

SEQ ID NO: 196093 - DNA, 25 bp, Mus musculus
agctgcccaagaggtcactgagcac

SEQ ID NO: 196094 - DNA, 25 bp, Mus musculus
agctgcccacttgggaggcagaggc

SEQ ID NO: 196095 - DNA, 25 bp, Mus musculus
agctgcccagaaggagtcgaaagcc

SEQ ID NO: 196096 - DNA, 25 bp, Mus musculus
agctgcccagagacccttcggaagc

SEQ ID NO: 196097 - DNA, 25 bp, Mus musculus
agctgcccagcaaaaatcccaggat

SEQ ID NO: 196098 - DNA, 25 bp, Mus musculus
agctgcccagcaaaaatgggggcag

SEQ ID NO: 196099 - DNA, 25 bp, Mus musculus
agctgccccccaggtcaagtggctg

SEQ ID NO: 196100 - DNA, 25 bp, Mus musculus
agctgccccccaggtcttgactcag

SEQ ID NO: 196101 - DNA, 25 bp, Mus musculus
agctgccccggttcagaaacttagt

SEQ ID NO: 196102 - DNA, 25 bp, Mus musculus
agctgcccgtggaggaggtggacat

SEQ ID NO: 196103 - DNA, 25 bp, Mus musculus
agctgccgacacagccacagcattt

SEQ ID NO: 196104 - DNA, 25 bp, Mus musculus
agctgccgactagaagttattttag

SEQ ID NO: 196105 - DNA, 25 bp, Mus musculus
agctgccgactatactgaagcagaa

SEQ ID NO: 196106 - DNA, 25 bp, Mus musculus
agctgccgactcctgatagaggaag

SEQ ID NO: 196107 - DNA, 25 bp, Mus musculus
agctgccgacttaaccgtgtggaag

SEQ ID NO: 196108 - DNA, 25 bp, Mus musculus
agctgccgataagtacgccctggag

SEQ ID NO: 196109 - DNA, 25 bp, Mus musculus
agctgccgcccctgctattacaagc

SEQ ID NO: 196110 - DNA, 25 bp, Mus musculus
agctgccgccgtcatggccgactac

SEQ ID NO: 196111 - DNA, 25 bp, Mus musculus
agctgccgccttcagggccgactac

SEQ ID NO: 196112 - DNA, 25 bp, Mus musculus
agctgccgctccacagtggctccac

SEQ ID NO: 196113 - DNA, 25 bp, Mus musculus
agctgccgtgggttgaaaaatacag

SEQ ID NO: 196114 - DNA, 25 bp, Mus musculus
agctgcctacagataccatggcgtt

SEQ ID NO: 196115 - DNA, 25 bp, Mus musculus
agctgcctacagctcagcagagaaa

SEQ ID NO: 196116 - DNA, 25 bp, Mus musculus
agctgcctacaggaaaaaaaatccc

SEQ ID NO: 196117 - DNA, 25 bp, Mus musculus
agctgcctacaggtgactggatggc

SEQ ID NO: 196118 - DNA, 25 bp, Mus musculus
agctgcctaccagatatgaaagatc

SEQ ID NO: 196119 - DNA, 25 bp, Mus musculus
agctgcctcagagtggggagtagtc

SEQ ID NO: 196120 - DNA, 25 bp, Mus musculus
agctgcctcaggctacaaggaagga

SEQ ID NO: 196121 - DNA, 25 bp, Mus musculus
agctgcctcctcaagagctttcatc

SEQ ID NO: 196122 - DNA, 25 bp, Mus musculus
agctgcctcctcaaggttggctcaa

SEQ ID NO: 196123 - DNA, 25 bp, Mus musculus
agctgcctcttgaagaagtggatga

SEQ ID NO: 196124 - DNA, 25 bp, Mus musculus
agctgcctcttgaagtcagtttcag

SEQ ID NO: 196125 - DNA, 25 bp, Mus musculus
agctgcctgagcttcatgccctcac

SEQ ID NO: 196126 - DNA, 25 bp, Mus musculus
agctgcctgagggtacaagttcagt

SEQ ID NO: 196127 - DNA, 25 bp, Mus musculus
agctgccttgaaagatttacaaggg

SEQ ID NO: 196128 - DNA, 25 bp, Mus musculus
agctgccttgaaagcccccaaaata

SEQ ID NO: 196129 - DNA, 25 bp, Mus musculus
agctgccttgccttactcagacact

SEQ ID NO: 196130 - DNA, 25 bp, Mus musculus
agctgccttttgacatcccagagga

SEQ ID NO: 196131 - DNA, 25 bp, Mus musculus
agctgcgacagattggttctaggtc

SEQ ID NO: 196132 - DNA, 25 bp, Mus musculus
agctgcgaccttgccctcctgcgtg

SEQ ID NO: 196133 - DNA, 25 bp, Mus musculus
agctgcgaggccgcaatctgtcgct

SEQ ID NO: 196134 - DNA, 25 bp, Mus musculus
agctgcgatgagcttaaaagatgat

SEQ ID NO: 196135 - DNA, 25 bp, Mus musculus
agctgcgcagactactttactggaa

SEQ ID NO: 196136 - DNA, 25 bp, Mus musculus
agctgcgcgcgcagacttacacttt

SEQ ID NO: 196137 - DNA, 25 bp, Mus musculus
agctgcgcgcgcagagccaacagag

SEQ ID NO: 196138 - DNA, 25 bp, Mus musculus
agctgcgcgcgcagccaaagtgtat

SEQ ID NO: 196139 - DNA, 25 bp, Mus musculus
agctgcgctgggttgtggcagcatt

SEQ ID NO: 196140 - DNA, 25 bp, Mus musculus
agctgcggaaggatgatccagtcac

SEQ ID NO: 196141 - DNA, 25 bp, Mus musculus
agctgcggccaatagctctcagggc

SEQ ID NO: 196142 - DNA, 25 bp, Mus musculus
agctgcggccacacgtgacactggc

SEQ ID NO: 196143 - DNA, 25 bp, Mus musculus
agctgcggccacacgttctgcgggg

SEQ ID NO: 196144 - DNA, 25 bp, Mus musculus
agctgcgggaaaccgctgaagctga

SEQ ID NO: 196145 - DNA, 25 bp, Mus musculus
agctgcgggctcgggaatgggaaac

SEQ ID NO: 196146 - DNA, 25 bp, Mus musculus
agctgcgggtgaatgatccccaatc

SEQ ID NO: 196147 - DNA, 25 bp, Mus musculus
agctgcgggtgaatgggccaccacc

SEQ ID NO: 196148 - DNA, 25 bp, Mus musculus
agctgcgtgcccagggcctagtgct

SEQ ID NO: 196149 - DNA, 25 bp, Mus musculus
agctgcgtgcccaggttgtgtagcc

SEQ ID NO: 196150 - DNA, 25 bp, Mus musculus
agctgctaagggaagatacacctat

SEQ ID NO: 196151 - DNA, 25 bp, Mus musculus
agctgctacgatgcagacagacatg

SEQ ID NO: 196152 - DNA, 25 bp, Mus musculus
agctgctacgccacacagtctcatc

SEQ ID NO: 196153 - DNA, 25 bp, Mus musculus
agctgctagaaggctgaagaacctg

SEQ ID NO: 196154 - DNA, 25 bp, Mus musculus
agctgctagaattcgatttcagaaa

SEQ ID NO: 196155 - DNA, 25 bp, Mus musculus
agctgctagaattcggtgggctggt

SEQ ID NO: 196156 - DNA, 25 bp, Mus musculus
agctgctagagcactgggaaaacac

SEQ ID NO: 196157 - DNA, 25 bp, Mus musculus
agctgctagtggagcaccaaggagt

SEQ ID NO: 196158 - DNA, 25 bp, Mus musculus
agctgctagtggaggagtttcattt

SEQ ID NO: 196159 - DNA, 25 bp, Mus musculus
agctgctatacgaaggggctcctgg

SEQ ID NO: 196160 - DNA, 25 bp, Mus musculus
agctgctatcgggggaggagtgtct

SEQ ID NO: 196161 - DNA, 25 bp, Mus musculus
agctgctatgtggccaccctggaga

SEQ ID NO: 196162 - DNA, 25 bp, Mus musculus
agctgctcaaggactcggagactcc

SEQ ID NO: 196163 - DNA, 25 bp, Mus musculus
agctgctcaaggtactccaggactc

SEQ ID NO: 196164 - DNA, 25 bp, Mus musculus
agctgctcaggaaaggactttcctg

SEQ ID NO: 196165 - DNA, 25 bp, Mus musculus
agctgctcagggcagccaagcctga

SEQ ID NO: 196166 - DNA, 25 bp, Mus musculus
agctgctcagggcagtggtcctcat

SEQ ID NO: 196167 - DNA, 25 bp, Mus musculus
agctgctccagagaatgacggacaa

SEQ ID NO: 196168 - DNA, 25 bp, Mus musculus
agctgctccaggagcctgaagctac

SEQ ID NO: 196169 - DNA, 25 bp, Mus musculus
agctgctcccggcaggaaaaggaag

SEQ ID NO: 196170 - DNA, 25 bp, Mus musculus
agctgctcccgtccccaccgacaac

SEQ ID NO: 196171 - DNA, 25 bp, Mus musculus
agctgctctagcaccacatctgcca

SEQ ID NO: 196172 - DNA, 25 bp, Mus musculus
agctgctctggttgaaggtttgaaa

SEQ ID NO: 196173 - DNA, 25 bp, Mus musculus
agctgctgacaggccgggtgaccaa

SEQ ID NO: 196174 - DNA, 25 bp, Mus musculus
agctgctgacagtatccctggaaga

SEQ ID NO: 196175 - DNA, 25 bp, Mus musculus
agctgctgagactataagcggaaag

SEQ ID NO: 196176 - DNA, 25 bp, Mus musculus
agctgctgagactttccagttctca

SEQ ID NO: 196177 - DNA, 25 bp, Mus musculus
agctgctgagatcttagcctcctcg

SEQ ID NO: 196178 - DNA, 25 bp, Mus musculus
agctgctgagatggctccgagcgat

SEQ ID NO: 196179 - DNA, 25 bp, Mus musculus
agctgctgagcagctgcagcagccc

SEQ ID NO: 196180 - DNA, 25 bp, Mus musculus
agctgctgagcaggttcaattttat

SEQ ID NO: 196181 - DNA, 25 bp, Mus musculus
agctgctgaggaacttgtatgaaag

SEQ ID NO: 196182 - DNA, 25 bp, Mus musculus
agctgctgaggctcacaactcagtg

SEQ ID NO: 196183 - DNA, 25 bp, Mus musculus
agctgctgagggagctgaatctgag

SEQ ID NO: 196184 - DNA, 25 bp, Mus musculus
agctgctgagggccttgcgggtgag

SEQ ID NO: 196185 - DNA, 25 bp, Mus musculus
agctgctgaggttatttaaactgaa

SEQ ID NO: 196186 - DNA, 25 bp, Mus musculus
agctgctgagtgaagagagacttct

SEQ ID NO: 196187 - DNA, 25 bp, Mus musculus
agctgctgatgaaccacgccttcat

SEQ ID NO: 196188 - DNA, 25 bp, Mus musculus
agctgctgatgaaggagagagaagt

SEQ ID NO: 196189 - DNA, 25 bp, Mus musculus
agctgctgatgaagggtccgcaggt

SEQ ID NO: 196190 - DNA, 25 bp, Mus musculus
agctgctgatggtcgacacccgcac

SEQ ID NO: 196191 - DNA, 25 bp, Mus musculus
agctgctgattgggaacaagtcaga

SEQ ID NO: 196192 - DNA, 25 bp, Mus musculus
agctgctgcagccctgccagtttga

SEQ ID NO: 196193 - DNA, 25 bp, Mus musculus
agctgctgccagagggaaattgtgg

SEQ ID NO: 196194 - DNA, 25 bp, Mus musculus
agctgctgcgcagaagaagagctgt

SEQ ID NO: 196195 - DNA, 25 bp, Mus musculus
agctgctgctaactgtgtggtttaa

SEQ ID NO: 196196 - DNA, 25 bp, Mus musculus
agctgctgctcggagagcgggacta

SEQ ID NO: 196197 - DNA, 25 bp, Mus musculus
agctgctgctgagtgagcgggtgag

SEQ ID NO: 196198 - DNA, 25 bp, Mus musculus
agctgctgctgctcggcgctggaga

SEQ ID NO: 196199 - DNA, 25 bp, Mus musculus
agctgctggactttcgttcagaaaa

SEQ ID NO: 196200 - DNA, 25 bp, Mus musculus
agctgctggactttggttcagaaaa

SEQ ID NO: 196201 - DNA, 25 bp, Mus musculus
agctgctggagaggttatcaatgct

SEQ ID NO: 196202 - DNA, 25 bp, Mus musculus
agctgctggatgagattctggactt

SEQ ID NO: 196203 - DNA, 25 bp, Mus musculus
agctgctggcagaagctggaatgcc

SEQ ID NO: 196204 - DNA, 25 bp, Mus musculus
agctgctgggaaaggaaggatttaa

SEQ ID NO: 196205 - DNA, 25 bp, Mus musculus
agctgctgggaaggatctggttcta

SEQ ID NO: 196206 - DNA, 25 bp, Mus musculus
agctgctgggaagggagagcacctg

SEQ ID NO: 196207 - DNA, 25 bp, Mus musculus
agctgctgggactccgaggtgactc

SEQ ID NO: 196208 - DNA, 25 bp, Mus musculus
agctgctgggcaccaagccaaagga

SEQ ID NO: 196209 - DNA, 25 bp, Mus musculus
agctgctggtagatgctgacggcta

SEQ ID NO: 196210 - DNA, 25 bp, Mus musculus
agctgctggtagatggtgactagag

SEQ ID NO: 196211 - DNA, 25 bp, Mus musculus
agctgctgtgctctcctgctatgca

SEQ ID NO: 196212 - DNA, 25 bp, Mus musculus
agctgctgttgctcggtgcgggcga

SEQ ID NO: 196213 - DNA, 25 bp, Mus musculus
agctgcttagagagttttgtcaaga

SEQ ID NO: 196214 - DNA, 25 bp, Mus musculus
agctgcttcaggaattctctgatca

SEQ ID NO: 196215 - DNA, 25 bp, Mus musculus
agctgcttccagcagaataacaaca

SEQ ID NO: 196216 - DNA, 25 bp, Mus musculus
agctgcttccctctttccatgaagt

SEQ ID NO: 196217 - DNA, 25 bp, Mus musculus
agctgcttcttcacgtgacctgaca

SEQ ID NO: 196218 - DNA, 25 bp, Mus musculus
agctgcttcttgaaaggaactctgt

SEQ ID NO: 196219 - DNA, 25 bp, Mus musculus
agctgcttgcaaaggtggtacccgg

SEQ ID NO: 196220 - DNA, 25 bp, Mus musculus
agctgctttaaacatggtaccgggt

SEQ ID NO: 196221 - DNA, 25 bp, Mus musculus
agctgctttaaacatgtacccctct

SEQ ID NO: 196222 - DNA, 25 bp, Mus musculus
agctgcttttaagtaacggcacagc

SEQ ID NO: 196223 - DNA, 25 bp, Mus musculus
agctggaaaacagctttcctagcaa

SEQ ID NO: 196224 - DNA, 25 bp, Mus musculus
agctggaaaagccgctggacgactc

SEQ ID NO: 196225 - DNA, 25 bp, Mus musculus
agctggaaaagccgtcccgcacggt

SEQ ID NO: 196226 - DNA, 25 bp, Mus musculus
agctggaaatggaaccagtgacctt

SEQ ID NO: 196227 - DNA, 25 bp, Mus musculus
agctggaaatgtaggtggttgtgag

SEQ ID NO: 196228 - DNA, 25 bp, Mus musculus
agctggaacagtggccgcacgaggg

SEQ ID NO: 196229 - DNA, 25 bp, Mus musculus
agctggaacggctgctggtccaggt

SEQ ID NO: 196230 - DNA, 25 bp, Mus musculus
agctggaacggctggtggtgaggtc

SEQ ID NO: 196231 - DNA, 25 bp, Mus musculus
agctggaagaggacaagctgggctg

SEQ ID NO: 196232 - DNA, 25 bp, Mus musculus
agctggaagaggactagtgtctgtc

SEQ ID NO: 196233 - DNA, 25 bp, Mus musculus
agctggaagagtaccgttccccagc

SEQ ID NO: 196234 - DNA, 25 bp, Mus musculus
agctggaagagtatctgtgggaggc

SEQ ID NO: 196235 - DNA, 25 bp, Mus musculus
agctggaaggaggaagatgggctcc

SEQ ID NO: 196236 - DNA, 25 bp, Mus musculus
agctggaaggggagtgggctcaccc

SEQ ID NO: 196237 - DNA, 25 bp, Mus musculus
agctggaagtaaaggtcaccttggc

SEQ ID NO: 196238 - DNA, 25 bp, Mus musculus
agctggaagtgaagaacccagattc

SEQ ID NO: 196239 - DNA, 25 bp, Mus musculus
agctggaagtgaaggcctgaaccaa

SEQ ID NO: 196240 - DNA, 25 bp, Mus musculus
agctggaatcggaaggcaggagagt

SEQ ID NO: 196241 - DNA, 25 bp, Mus musculus
agctggaatgttacagaattttgaa

SEQ ID NO: 196242 - DNA, 25 bp, Mus musculus
agctggacaaaatggggtggatggt

SEQ ID NO: 196243 - DNA, 25 bp, Mus musculus
agctggacacggctgtccagggcac

SEQ ID NO: 196244 - DNA, 25 bp, Mus musculus
agctggacagaactcagcagatatc

SEQ ID NO: 196245 - DNA, 25 bp, Mus musculus
agctggacagagagttaattgacaa

SEQ ID NO: 196246 - DNA, 25 bp, Mus musculus
agctggacagggtccgcaagcaggt

SEQ ID NO: 196247 - DNA, 25 bp, Mus musculus
agctggaccctgtggaagggcggct

SEQ ID NO: 196248 - DNA, 25 bp, Mus musculus
agctggacctagcacgcttacagtt

SEQ ID NO: 196249 - DNA, 25 bp, Mus musculus
agctggacctagcaggcttacagtt

SEQ ID NO: 196250 - DNA, 25 bp, Mus musculus
agctggacctcaatggcaatgccct

SEQ ID NO: 196251 - DNA, 25 bp, Mus musculus
agctggacgagaactacaatatgta

SEQ ID NO: 196252 - DNA, 25 bp, Mus musculus
agctggacgcgggagagaagatgga

SEQ ID NO: 196253 - DNA, 25 bp, Mus musculus
agctggacgctcggactgggctata

SEQ ID NO: 196254 - DNA, 25 bp, Mus musculus
agctggacgggacctcattcctctc

SEQ ID NO: 196255 - DNA, 25 bp, Mus musculus
agctggactgaaggacgcagataga

SEQ ID NO: 196256 - DNA, 25 bp, Mus musculus
agctggactgcctgaacagggacaa

SEQ ID NO: 196257 - DNA, 25 bp, Mus musculus
agctggactgttatccaactgagga

SEQ ID NO: 196258 - DNA, 25 bp, Mus musculus
agctggagaagaatatggagaagat

SEQ ID NO: 196259 - DNA, 25 bp, Mus musculus
agctggagaagctccatttctgaca

SEQ ID NO: 196260 - DNA, 25 bp, Mus musculus
agctggagaaggcattcggggcacg

SEQ ID NO: 196261 - DNA, 25 bp, Mus musculus
agctggagaaggtggacggtatcct

SEQ ID NO: 196262 - DNA, 25 bp, Mus musculus
agctggagaagttgtgtgactccct

SEQ ID NO: 196263 - DNA, 25 bp, Mus musculus
agctggagaatggcaaagcgcaagt

SEQ ID NO: 196264 - DNA, 25 bp, Mus musculus
agctggagagaaaaatatcaggatt

SEQ ID NO: 196265 - DNA, 25 bp, Mus musculus
agctggagagacaaaagatagagga

SEQ ID NO: 196266 - DNA, 25 bp, Mus musculus
agctggagaggaaagccatagagga

SEQ ID NO: 196267 - DNA, 25 bp, Mus musculus
agctggagaggaaggcacagagaac

SEQ ID NO: 196268 - DNA, 25 bp, Mus musculus
agctggagagtaggtggcattgacc

SEQ ID NO: 196269 - DNA, 25 bp, Mus musculus
agctggagatcaggaggcgccagct

SEQ ID NO: 196270 - DNA, 25 bp, Mus musculus
agctggagatcaggattgacttgtg

SEQ ID NO: 196271 - DNA, 25 bp, Mus musculus
agctggagatcaggttcaatgctcc

SEQ ID NO: 196272 - DNA, 25 bp, Mus musculus
agctggagcaaagattgcgccaggc

SEQ ID NO: 196273 - DNA, 25 bp, Mus musculus
agctggagcaaagtgaaaaagattt

SEQ ID NO: 196274 - DNA, 25 bp, Mus musculus
agctggagcagaggagataatcgga

SEQ ID NO: 196275 - DNA, 25 bp, Mus musculus
agctggagcagaggagatcatcggg

SEQ ID NO: 196276 - DNA, 25 bp, Mus musculus
agctggagcagaggatttcagcgtc

SEQ ID NO: 196277 - DNA, 25 bp, Mus musculus
agctggagcagcttgaacttgagaa

SEQ ID NO: 196278 - DNA, 25 bp, Mus musculus
agctggagcaggaaagatctatacc

SEQ ID NO: 196279 - DNA, 25 bp, Mus musculus
agctggagccacaaactcctgcttc

SEQ ID NO: 196280 - DNA, 25 bp, Mus musculus
agctggagccacaaattgcggttgc

SEQ ID NO: 196281 - DNA, 25 bp, Mus musculus
agctggagcccacgaaccttctttt

SEQ ID NO: 196282 - DNA, 25 bp, Mus musculus
agctggagccccgagcccttccagc

SEQ ID NO: 196283 - DNA, 25 bp, Mus musculus
agctggagccccgagctcctctaat

SEQ ID NO: 196284 - DNA, 25 bp, Mus musculus
agctggagcccctgaaagagatgac

SEQ ID NO: 196285 - DNA, 25 bp, Mus musculus
agctggaggacaaaggtcaagcagg

SEQ ID NO: 196286 - DNA, 25 bp, Mus musculus
agctggaggaggccaagcacattgc

SEQ ID NO: 196287 - DNA, 25 bp, Mus musculus
agctggaggcccaggtgcgcaagtt

SEQ ID NO: 196288 - DNA, 25 bp, Mus musculus
agctggaggtcatggtgaaacatcc

SEQ ID NO: 196289 - DNA, 25 bp, Mus musculus
agctggaggtcatggtgaaacatga

SEQ ID NO: 196290 - DNA, 25 bp, Mus musculus
agctggagtagacaggctcctcata

SEQ ID NO: 196291 - DNA, 25 bp, Mus musculus
agctggagtcaagggagatcgtggt

SEQ ID NO: 196292 - DNA, 25 bp, Mus musculus
agctggagtcacgggaagtcctgca

SEQ ID NO: 196293 - DNA, 25 bp, Mus musculus
agctggatagaaggaagcaggccag

SEQ ID NO: 196294 - DNA, 25 bp, Mus musculus
agctggatagagcggcagtacatcc

SEQ ID NO: 196295 - DNA, 25 bp, Mus musculus
agctggatagtaaggtgaacatcat

SEQ ID NO: 196296 - DNA, 25 bp, Mus musculus
agctggatcaggatgcgggctcctg

SEQ ID NO: 196297 - DNA, 25 bp, Mus musculus
agctggatccgggaggaacatcaca

SEQ ID NO: 196298 - DNA, 25 bp, Mus musculus
agctggatctgaagatccttcttga

SEQ ID NO: 196299 - DNA, 25 bp, Mus musculus
agctggatctgaaggcggcacgttt

SEQ ID NO: 196300 - DNA, 25 bp, Mus musculus
agctggatgaagatgggtttgtgga

SEQ ID NO: 196301 - DNA, 25 bp, Mus musculus
agctggcaaagattttctttgaggt

SEQ ID NO: 196302 - DNA, 25 bp, Mus musculus
agctggcaaggcttttgctgttggt

SEQ ID NO: 196303 - DNA, 25 bp, Mus musculus
agctggcaaggtacggactcgagac

SEQ ID NO: 196304 - DNA, 25 bp, Mus musculus
agctggcaaggttatgaaaactaca

SEQ ID NO: 196305 - DNA, 25 bp, Mus musculus
agctggcaaggttcgaacctcagat

SEQ ID NO: 196306 - DNA, 25 bp, Mus musculus
agctggcaccagctgaggatggttc

SEQ ID NO: 196307 - DNA, 25 bp, Mus musculus
agctggcactcagggagcatggcac

SEQ ID NO: 196308 - DNA, 25 bp, Mus musculus
agctggcagaagtagagaaggatgt

SEQ ID NO: 196309 - DNA, 25 bp, Mus musculus
agctggcagagtcccgttgccgaga

SEQ ID NO: 196310 - DNA, 25 bp, Mus musculus
agctggcagagtctaagtgttctga

SEQ ID NO: 196311 - DNA, 25 bp, Mus musculus
agctggcatggaagatgaaagagaa

SEQ ID NO: 196312 - DNA, 25 bp, Mus musculus
agctggccactgagctcaccctcgt

SEQ ID NO: 196313 - DNA, 25 bp, Mus musculus
agctggccactgaggacccctataa

SEQ ID NO: 196314 - DNA, 25 bp, Mus musculus
agctggccactgtggtcaaagcacg

SEQ ID NO: 196315 - DNA, 25 bp, Mus musculus
agctggccactgtgtttacttattt

SEQ ID NO: 196316 - DNA, 25 bp, Mus musculus
agctggccagctttggaatctctgt

SEQ ID NO: 196317 - DNA, 25 bp, Mus musculus
agctggccagctttggcactttcta

SEQ ID NO: 196318 - DNA, 25 bp, Mus musculus
agctggccaggactgccgcttcgct

SEQ ID NO: 196319 - DNA, 25 bp, Mus musculus
agctggcccaggcctccaggactga

SEQ ID NO: 196320 - DNA, 25 bp, Mus musculus
agctggcccctgtcgatctttgggt

SEQ ID NO: 196321 - DNA, 25 bp, Mus musculus
agctggcccctgtcggaactgctgc

SEQ ID NO: 196322 - DNA, 25 bp, Mus musculus
agctggccgagaaaaacgggtatgt

SEQ ID NO: 196323 - DNA, 25 bp, Mus musculus
agctggccgaggaacacctgctgaa

SEQ ID NO: 196324 - DNA, 25 bp, Mus musculus
agctggcctggaaaggtacagttaa

SEQ ID NO: 196325 - DNA, 25 bp, Mus musculus
agctggccttgcaggtctctcttca

SEQ ID NO: 196326 - DNA, 25 bp, Mus musculus
agctggccttggcagcacaaacttg

SEQ ID NO: 196327 - DNA, 25 bp, Mus musculus
agctggccttggcaggtctctcttc

SEQ ID NO: 196328 - DNA, 25 bp, Mus musculus
agctggcgaaagctgataacacatg

SEQ ID NO: 196329 - DNA, 25 bp, Mus musculus
agctggcgaaagctggttccttgtg

SEQ ID NO: 196330 - DNA, 25 bp, Mus musculus
agctggcgaggtgttggcagccgag

SEQ ID NO: 196331 - DNA, 25 bp, Mus musculus
agctggctaagaatgtgactgtggc

SEQ ID NO: 196332 - DNA, 25 bp, Mus musculus
agctggctctctgaacccccacatt

SEQ ID NO: 196333 - DNA, 25 bp, Mus musculus
agctggctgaatagcctgagaaatg

SEQ ID NO: 196334 - DNA, 25 bp, Mus musculus
agctggctgatagggtgggagaggg

SEQ ID NO: 196335 - DNA, 25 bp, Mus musculus
agctggctggaggcactttcccaga

SEQ ID NO: 196336 - DNA, 25 bp, Mus musculus
agctggctgggtttgactctgctga

SEQ ID NO: 196337 - DNA, 25 bp, Mus musculus
agctggctggtgctggcatgaactg

SEQ ID NO: 196338 - DNA, 25 bp, Mus musculus
agctggctttgaagaatcaggccca

SEQ ID NO: 196339 - DNA, 25 bp, Mus musculus
agctggcttttacagacccataact

SEQ ID NO: 196340 - DNA, 25 bp, Mus musculus
agctggcttttacagggagggtaga

SEQ ID NO: 196341 - DNA, 25 bp, Mus musculus
agctggcttttacagttgttctgat

SEQ ID NO: 196342 - DNA, 25 bp, Mus musculus
agctggcttttctgattcaccccac

SEQ ID NO: 196343 - DNA, 25 bp, Mus musculus
agctggcttttctgattttcagaaa

SEQ ID NO: 196344 - DNA, 25 bp, Mus musculus
agctgggaaagaagatgaaagcaga

SEQ ID NO: 196345 - DNA, 25 bp, Mus musculus
agctgggaaagaagggactcgtact

SEQ ID NO: 196346 - DNA, 25 bp, Mus musculus
agctgggaaagggagcctttacttt

SEQ ID NO: 196347 - DNA, 25 bp, Mus musculus
agctgggaagccctggcacaaaaac

SEQ ID NO: 196348 - DNA, 25 bp, Mus musculus
agctgggaattcatatgactgtgat

SEQ ID NO: 196349 - DNA, 25 bp, Mus musculus
agctgggaattcatgtctgcccgga

SEQ ID NO: 196350 - DNA, 25 bp, Mus musculus
agctgggacacaaggtgtcccaaat

SEQ ID NO: 196351 - DNA, 25 bp, Mus musculus
agctgggacaggtggccctaagaac

SEQ ID NO: 196352 - DNA, 25 bp, Mus musculus
agctgggacatgatgtgattaagac

SEQ ID NO: 196353 - DNA, 25 bp, Mus musculus
agctgggacctacctgaactacctg

SEQ ID NO: 196354 - DNA, 25 bp, Mus musculus
agctgggacctacgtatcacaaggc

SEQ ID NO: 196355 - DNA, 25 bp, Mus musculus
agctgggacgagcggatacgggcca

SEQ ID NO: 196356 - DNA, 25 bp, Mus musculus
agctgggagagacttcataagggct

SEQ ID NO: 196357 - DNA, 25 bp, Mus musculus
agctgggagccgggagccccgatga

SEQ ID NO: 196358 - DNA, 25 bp, Mus musculus
agctgggaggtggagatgtcatcag

SEQ ID NO: 196359 - DNA, 25 bp, Mus musculus
agctgggcaagatggtgtcacattt

SEQ ID NO: 196360 - DNA, 25 bp, Mus musculus
agctgggcactcagggcccaggacg

SEQ ID NO: 196361 - DNA, 25 bp, Mus musculus
agctgggcactcaggtgaagccaac

SEQ ID NO: 196362 - DNA, 25 bp, Mus musculus
agctgggccaatgaaaaccaactct

SEQ ID NO: 196363 - DNA, 25 bp, Mus musculus
agctgggcccagaccctggcctatg

SEQ ID NO: 196364 - DNA, 25 bp, Mus musculus
agctgggcccaggggagaaatacga

SEQ ID NO: 196365 - DNA, 25 bp, Mus musculus
agctgggcccagtatcgttgatctg

SEQ ID NO: 196366 - DNA, 25 bp, Mus musculus
agctgggccgggattctgaaaggcc

SEQ ID NO: 196367 - DNA, 25 bp, Mus musculus
agctgggcgagtacatggagaagct

SEQ ID NO: 196368 - DNA, 25 bp, Mus musculus
agctgggcgctcagcagttctccga

SEQ ID NO: 196369 - DNA, 25 bp, Mus musculus
agctgggcgtggaagctatggaggt

SEQ ID NO: 196370 - DNA, 25 bp, Mus musculus
agctgggctacaaggtgaagaagca

SEQ ID NO: 196371 - DNA, 25 bp, Mus musculus
agctgggctgcctgcctgcctgcct

SEQ ID NO: 196372 - DNA, 25 bp, Mus musculus
agctgggcttggaggcaagggcagt

SEQ ID NO: 196373 - DNA, 25 bp, Mus musculus
agctggggaccgagccctctgattg

SEQ ID NO: 196374 - DNA, 25 bp, Mus musculus
agctggggacttggggacggctgtt

SEQ ID NO: 196375 - DNA, 25 bp, Mus musculus
agctggggcagaagtggcagtgtgt

SEQ ID NO: 196376 - DNA, 25 bp, Mus musculus
agctggggcccgagttctctgggct

SEQ ID NO: 196377 - DNA, 25 bp, Mus musculus
agctggggccttggtgttgggagcc

SEQ ID NO: 196378 - DNA, 25 bp, Mus musculus
agctggggctggacgttgagatcac

SEQ ID NO: 196379 - DNA, 25 bp, Mus musculus
agctgggtcaggtggccactctagc

SEQ ID NO: 196380 - DNA, 25 bp, Mus musculus
agctgggtccagcggctggaggaag

SEQ ID NO: 196381 - DNA, 25 bp, Mus musculus
agctgggtgataggtgaccatggag

SEQ ID NO: 196382 - DNA, 25 bp, Mus musculus
agctgggtgcagaaactggaaacaa

SEQ ID NO: 196383 - DNA, 25 bp, Mus musculus
agctgggttcggacccagcaatgtc

SEQ ID NO: 196384 - DNA, 25 bp, Mus musculus
agctgggttcggtcccagcaatgtc

SEQ ID NO: 196385 - DNA, 25 bp, Mus musculus
agctgggtttgccgattcccacccc

SEQ ID NO: 196386 - DNA, 25 bp, Mus musculus
agctgggtttgccggattatcacaa

SEQ ID NO: 196387 - DNA, 25 bp, Mus musculus
agctggtacagtatgctgtgtccca

SEQ ID NO: 196388 - DNA, 25 bp, Mus musculus
agctggtagagaagggaccacagta

SEQ ID NO: 196389 - DNA, 25 bp, Mus musculus
agctggtatgttgccagatggattt

SEQ ID NO: 196390 - DNA, 25 bp, Mus musculus
agctggtattccaggaatcatggcc

SEQ ID NO: 196391 - DNA, 25 bp, Mus musculus
agctggtcaagggtctagagacatg

SEQ ID NO: 196392 - DNA, 25 bp, Mus musculus
agctggtcacaggagtcctttggaa

SEQ ID NO: 196393 - DNA, 25 bp, Mus musculus
agctggtcacaggtgcccagcagag

SEQ ID NO: 196394 - DNA, 25 bp, Mus musculus
agctggtcatcgaggtcttccagaa

SEQ ID NO: 196395 - DNA, 25 bp, Mus musculus
agctggtccgagggctactgacagt

SEQ ID NO: 196396 - DNA, 25 bp, Mus musculus
agctggtgaagagcatattccgcgt

SEQ ID NO: 196397 - DNA, 25 bp, Mus musculus
agctggtgaagcacctcctggacct

SEQ ID NO: 196398 - DNA, 25 bp, Mus musculus
agctggtgagaagaacagcagtggt

SEQ ID NO: 196399 - DNA, 25 bp, Mus musculus
agctggtgccttcagaattgtttta

SEQ ID NO: 196400 - DNA, 25 bp, Mus musculus
agctggtggagcactacaccacaga

SEQ ID NO: 196401 - DNA, 25 bp, Mus musculus
agctggtggaggaggaagtgaacat

SEQ ID NO: 196402 - DNA, 25 bp, Mus musculus
agctggtggaggcatggctggaaag

SEQ ID NO: 196403 - DNA, 25 bp, Mus musculus
agctggtgtcactgcagatgagagt

SEQ ID NO: 196404 - DNA, 25 bp, Mus musculus
agctggtgtcagacatggctaaaga

SEQ ID NO: 196405 - DNA, 25 bp, Mus musculus
agctggtgtcagtctctgcttcctt

SEQ ID NO: 196406 - DNA, 25 bp, Mus musculus
agctggtgtggatggagaggtccct

SEQ ID NO: 196407 - DNA, 25 bp, Mus musculus
agctggtgttttcaggcctctgctc

SEQ ID NO: 196408 - DNA, 25 bp, Mus musculus
agctggttaagagaaaatccctgag

SEQ ID NO: 196409 - DNA, 25 bp, Mus musculus
agctggttcgaaggccatgacagta

SEQ ID NO: 196410 - DNA, 25 bp, Mus musculus
agctggttcgaaggggctcatcctg

SEQ ID NO: 196411 - DNA, 25 bp, Mus musculus
agctggttctgcaggagcagagccc

SEQ ID NO: 196412 - DNA, 25 bp, Mus musculus
agctggttcttaagtcagagagcga

SEQ ID NO: 196413 - DNA, 25 bp, Mus musculus
agctggttgaagagggtgctgatac

SEQ ID NO: 196414 - DNA, 25 bp, Mus musculus
agctggttgaagaggtgcacacttt

SEQ ID NO: 196415 - DNA, 25 bp, Mus musculus
agctggttggagaaatctctggtcg

SEQ ID NO: 196416 - DNA, 25 bp, Mus musculus
agctggtttcagaggaggcctttcc

SEQ ID NO: 196417 - DNA, 25 bp, Mus musculus
agctggtttcccgggtatgcatgga

SEQ ID NO: 196418 - DNA, 25 bp, Mus musculus
agctgtaaagaggatagtgccatgt

SEQ ID NO: 196419 - DNA, 25 bp, Mus musculus
agctgtaatgaaggaaaatatctgc

SEQ ID NO: 196420 - DNA, 25 bp, Mus musculus
agctgtaatggtgcgtctaatgctg

SEQ ID NO: 196421 - DNA, 25 bp, Mus musculus
agctgtaattgtagctgatgaagag

SEQ ID NO: 196422 - DNA, 25 bp, Mus musculus
agctgtaattgtaggtgccgcacca

SEQ ID NO: 196423 - DNA, 25 bp, Mus musculus
agctgtacaaggtgctgagttccct

SEQ ID NO: 196424 - DNA, 25 bp, Mus musculus
agctgtacaggttgggcttaggtca

SEQ ID NO: 196425 - DNA, 25 bp, Mus musculus
agctgtaccacttagatagttgaag

SEQ ID NO: 196426 - DNA, 25 bp, Mus musculus
agctgtaccagataacatgtttagg

SEQ ID NO: 196427 - DNA, 25 bp, Mus musculus
agctgtaccccgggagggacattgc

SEQ ID NO: 196428 - DNA, 25 bp, Mus musculus
agctgtacctagaaggaagagaaaa

SEQ ID NO: 196429 - DNA, 25 bp, Mus musculus
agctgtactacgtaaccaccaaaga

SEQ ID NO: 196430 - DNA, 25 bp, Mus musculus
agctgtataaggtacatttgaagaa

SEQ ID NO: 196431 - DNA, 25 bp, Mus musculus
agctgtatccttcaggagcccaagc

SEQ ID NO: 196432 - DNA, 25 bp, Mus musculus
agctgtatgaggaagtaaagctcta

SEQ ID NO: 196433 - DNA, 25 bp, Mus musculus
agctgtatggaaagatggcctctgc

SEQ ID NO: 196434 - DNA, 25 bp, Mus musculus
agctgtcaacaaggtctaggaaacc

SEQ ID NO: 196435 - DNA, 25 bp, Mus musculus
agctgtcaaggaactgaatgccagc

SEQ ID NO: 196436 - DNA, 25 bp, Mus musculus
agctgtcacccatatggcccacacg

SEQ ID NO: 196437 - DNA, 25 bp, Mus musculus
agctgtcacccatggtccgactttt

SEQ ID NO: 196438 - DNA, 25 bp, Mus musculus
agctgtcactcagaagaaacccaga

SEQ ID NO: 196439 - DNA, 25 bp, Mus musculus
agctgtcactcaggtctgtggagga

SEQ ID NO: 196440 - DNA, 25 bp, Mus musculus
agctgtcagaactcaaataattttg

SEQ ID NO: 196441 - DNA, 25 bp, Mus musculus
agctgtcagaactcagcatcttatg

SEQ ID NO: 196442 - DNA, 25 bp, Mus musculus
agctgtcagaactcagtcaggctgt

SEQ ID NO: 196443 - DNA, 25 bp, Mus musculus
agctgtcagtgggtttcaccagcta

SEQ ID NO: 196444 - DNA, 25 bp, Mus musculus
agctgtcatggaaagttacttcaat

SEQ ID NO: 196445 - DNA, 25 bp, Mus musculus
agctgtcatggacagttacttcaat

SEQ ID NO: 196446 - DNA, 25 bp, Mus musculus
agctgtccaatgacgaagctgcggg

SEQ ID NO: 196447 - DNA, 25 bp, Mus musculus
agctgtccaatttttggcctttgaa

SEQ ID NO: 196448 - DNA, 25 bp, Mus musculus
agctgtccagcaggccacgattgct

SEQ ID NO: 196449 - DNA, 25 bp, Mus musculus
agctgtcccagatgaacgggcttgc

SEQ ID NO: 196450 - DNA, 25 bp, Mus musculus
agctgtcccaggggtgactttcctg

SEQ ID NO: 196451 - DNA, 25 bp, Mus musculus
agctgtcccctcagttccccagtga

SEQ ID NO: 196452 - DNA, 25 bp, Mus musculus
agctgtccgcactgtgagaaggagg

SEQ ID NO: 196453 - DNA, 25 bp, Mus musculus
agctgtcctgtggagagcctccaac

SEQ ID NO: 196454 - DNA, 25 bp, Mus musculus
agctgtccttgaagagcccacctga

SEQ ID NO: 196455 - DNA, 25 bp, Mus musculus
agctgtctacgagaccctgaagaat

SEQ ID NO: 196456 - DNA, 25 bp, Mus musculus
agctgtctagctgtttcctcttgag

SEQ ID NO: 196457 - DNA, 25 bp, Mus musculus
agctgtctagtccccatggacacct

SEQ ID NO: 196458 - DNA, 25 bp, Mus musculus
agctgtctatgagacattgaaaaat

SEQ ID NO: 196459 - DNA, 25 bp, Mus musculus
agctgtctctgacaaatcgccagta

SEQ ID NO: 196460 - DNA, 25 bp, Mus musculus
agctgtctctgacaaattctctcca

SEQ ID NO: 196461 - DNA, 25 bp, Mus musculus
agctgtctgagtctgaagaagacaa

SEQ ID NO: 196462 - DNA, 25 bp, Mus musculus
agctgtctgcaatcccaaaccttgt

SEQ ID NO: 196463 - DNA, 25 bp, Mus musculus
agctgtcttactcatcagagttgta

SEQ ID NO: 196464 - DNA, 25 bp, Mus musculus
agctgtcttgcaggtggaatgccat

SEQ ID NO: 196465 - DNA, 25 bp, Mus musculus
agctgtcttggtcgatgggatgctt

SEQ ID NO: 196466 - DNA, 25 bp, Mus musculus
agctgtcttggtcggaggtggctat

SEQ ID NO: 196467 - DNA, 25 bp, Mus musculus
agctgtctttacagtatgtaggcca

SEQ ID NO: 196468 - DNA, 25 bp, Mus musculus
agctgtgaaaagccattggcacagc

SEQ ID NO: 196469 - DNA, 25 bp, Mus musculus
agctgtgaaaagggtcaagcagtgt

SEQ ID NO: 196470 - DNA, 25 bp, Mus musculus
agctgtgaatgtctgtgtcagcagc

SEQ ID NO: 196471 - DNA, 25 bp, Mus musculus
agctgtgacaaaggggaggaaatct

SEQ ID NO: 196472 - DNA, 25 bp, Mus musculus
agctgtgagacagacattgacgagt

SEQ ID NO: 196473 - DNA, 25 bp, Mus musculus
agctgtgagacagactcttcctgag

SEQ ID NO: 196474 - DNA, 25 bp, Mus musculus
agctgtgagcaagtgaacacggatt

SEQ ID NO: 196475 - DNA, 25 bp, Mus musculus
agctgtgcaagctgacttcggagat

SEQ ID NO: 196476 - DNA, 25 bp, Mus musculus
agctgtgcagacagcccctgcagga

SEQ ID NO: 196477 - DNA, 25 bp, Mus musculus
agctgtgcatcggaggtcaccttcg

SEQ ID NO: 196478 - DNA, 25 bp, Mus musculus
agctgtgccaacaaggcagagatgg

SEQ ID NO: 196479 - DNA, 25 bp, Mus musculus
agctgtggaagagtccctgattgtc

SEQ ID NO: 196480 - DNA, 25 bp, Mus musculus
agctgtggcacaaggcaaagacatc

SEQ ID NO: 196481 - DNA, 25 bp, Mus musculus
agctgtggcacacatcactcaactg

SEQ ID NO: 196482 - DNA, 25 bp, Mus musculus
agctgtggctataatgtgcaagatg

SEQ ID NO: 196483 - DNA, 25 bp, Mus musculus
agctgtggtgcacaggacacaaaaa

SEQ ID NO: 196484 - DNA, 25 bp, Mus musculus
agctgtggtgcacagtttccctcag

SEQ ID NO: 196485 - DNA, 25 bp, Mus musculus
agctgtgtaaaaagagtattacaac

SEQ ID NO: 196486 - DNA, 25 bp, Mus musculus
agctgtgtaaaaaggaagtgttaaa

SEQ ID NO: 196487 - DNA, 25 bp, Mus musculus
agctgtgtaatgaagaaaagtccat

SEQ ID NO: 196488 - DNA, 25 bp, Mus musculus
agctgtgtaatgaagacttgtgaca

SEQ ID NO: 196489 - DNA, 25 bp, Mus musculus
agctgtgtagatgtcaatgagtgtc

SEQ ID NO: 196490 - DNA, 25 bp, Mus musculus
agctgtgtagttgtcaatgagtgtc

SEQ ID NO: 196491 - DNA, 25 bp, Mus musculus
agctgtgtccaagctgtcagtagaa

SEQ ID NO: 196492 - DNA, 25 bp, Mus musculus
agctgtgtgatgattgaagattatg

SEQ ID NO: 196493 - DNA, 25 bp, Mus musculus
agctgtgtggaaaaaatgtggggat

SEQ ID NO: 196494 - DNA, 25 bp, Mus musculus
agctgtgtggtgacttaccaattta

SEQ ID NO: 196495 - DNA, 25 bp, Mus musculus
agctgtgttcagccctgacagaagc

SEQ ID NO: 196496 - DNA, 25 bp, Mus musculus
agctgtgttcaggctcttcaaacgg

SEQ ID NO: 196497 - DNA, 25 bp, Mus musculus
agctgttaacagttcaaggcctggc

SEQ ID NO: 196498 - DNA, 25 bp, Mus musculus
agctgttacaggtactgcgaatgat

SEQ ID NO: 196499 - DNA, 25 bp, Mus musculus
agctgttacagtttttcagctgccc

SEQ ID NO: 196500 - DNA, 25 bp, Mus musculus
agctgttatgtcagtatatgactgc

SEQ ID NO: 196501 - DNA, 25 bp, Mus musculus
agctgttcagaatgaattagcctga

SEQ ID NO: 196502 - DNA, 25 bp, Mus musculus
agctgttcagacggtgcgcagtgcc

SEQ ID NO: 196503 - DNA, 25 bp, Mus musculus
agctgttcagagacagatggggctg

SEQ ID NO: 196504 - DNA, 25 bp, Mus musculus
agctgttcagagtaggtggcgatgt

SEQ ID NO: 196505 - DNA, 25 bp, Mus musculus
agctgttccaccaggctgggccggt

SEQ ID NO: 196506 - DNA, 25 bp, Mus musculus
agctgttccaccagtatttgaggca

SEQ ID NO: 196507 - DNA, 25 bp, Mus musculus
agctgttccagttacagattcatgg

SEQ ID NO: 196508 - DNA, 25 bp, Mus musculus
agctgttcccatttatgtacaggtg

SEQ ID NO: 196509 - DNA, 25 bp, Mus musculus
agctgttccttcctggaggacgact

SEQ ID NO: 196510 - DNA, 25 bp, Mus musculus
agctgttctgtatgcttcctgcggg

SEQ ID NO: 196511 - DNA, 25 bp, Mus musculus
agctgttcttgcgacatttgtgaca

SEQ ID NO: 196512 - DNA, 25 bp, Mus musculus
agctgttgcagtcttcgcataagga

SEQ ID NO: 196513 - DNA, 25 bp, Mus musculus
agctgttggacaagccccacgcaat

SEQ ID NO: 196514 - DNA, 25 bp, Mus musculus
agctgttggccgaggtggtcctgcc

SEQ ID NO: 196515 - DNA, 25 bp, Mus musculus
agctgttgggaagatttctgggctt

SEQ ID NO: 196516 - DNA, 25 bp, Mus musculus
agctgttgggaagggtctctcattg

SEQ ID NO: 196517 - DNA, 25 bp, Mus musculus
agctgttgggcatggaaccatctgg

SEQ ID NO: 196518 - DNA, 25 bp, Mus musculus
agctgttgtgatctcagttcacggg

SEQ ID NO: 196519 - DNA, 25 bp, Mus musculus
agctgtttaattcagattccaagga

SEQ ID NO: 196520 - DNA, 25 bp, Mus musculus
agctgtttgaggcgatggattgtaa

SEQ ID NO: 196521 - DNA, 25 bp, Mus musculus
agctgttttaaaaggattgcgggct

SEQ ID NO: 196522 - DNA, 25 bp, Mus musculus
agctgttttaaagcaaacggtgctg

SEQ ID NO: 196523 - DNA, 25 bp, Mus musculus
agctgttttggaatgagagacatgt

SEQ ID NO: 196524 - DNA, 25 bp, Mus musculus
agctgtttttgttgtacggacattg

SEQ ID NO: 196525 - DNA, 25 bp, Mus musculus
agcttaaagatcgatcccgcagaaa

SEQ ID NO: 196526 - DNA, 25 bp, Mus musculus
agcttaacaggcaaacattctgcag

SEQ ID NO: 196527 - DNA, 25 bp, Mus musculus
agcttaacagtttggaatggtcagc

SEQ ID NO: 196528 - DNA, 25 bp, Mus musculus
agcttaatagttgaaccaagactct

SEQ ID NO: 196529 - DNA, 25 bp, Mus musculus
agcttacaaagaatggaattgctag

SEQ ID NO: 196530 - DNA, 25 bp, Mus musculus
agcttacagacgggctgactcctca

SEQ ID NO: 196531 - DNA, 25 bp, Mus musculus
agcttacagacgggctttgctgttg

SEQ ID NO: 196532 - DNA, 25 bp, Mus musculus
agcttacagtaagaggtaaagttca

SEQ ID NO: 196533 - DNA, 25 bp, Mus musculus
agcttacataggtccccttcccctg

SEQ ID NO: 196534 - DNA, 25 bp, Mus musculus
agcttacatagtgcaactacagata

SEQ ID NO: 196535 - DNA, 25 bp, Mus musculus
agcttaccaaaaggatatccaggta

SEQ ID NO: 196536 - DNA, 25 bp, Mus musculus
agcttaccaaaaggtacctgtgtgc

SEQ ID NO: 196537 - DNA, 25 bp, Mus musculus
agcttaccaggaagcatctgtctga

SEQ ID NO: 196538 - DNA, 25 bp, Mus musculus
agcttaccagtgattttgaggaagt

SEQ ID NO: 196539 - DNA, 25 bp, Mus musculus
agcttaccattgatcatgctactaa

SEQ ID NO: 196540 - DNA, 25 bp, Mus musculus
agcttacggacatgctcccaaatgg

SEQ ID NO: 196541 - DNA, 25 bp, Mus musculus
agcttacgtagatgaagaacttcct

SEQ ID NO: 196542 - DNA, 25 bp, Mus musculus
agcttacgtaggctccatggtgtat

SEQ ID NO: 196543 - DNA, 25 bp, Mus musculus
agcttactctcttagcagtgaagca

SEQ ID NO: 196544 - DNA, 25 bp, Mus musculus
agcttactggccgcagcaagaacaa

SEQ ID NO: 196545 - DNA, 25 bp, Mus musculus
agcttactggcctttcaggcagcaa

SEQ ID NO: 196546 - DNA, 25 bp, Mus musculus
agcttacttcagccctgcattttgc

SEQ ID NO: 196547 - DNA, 25 bp, Mus musculus
agcttacttctacagtgatggagaa

SEQ ID NO: 196548 - DNA, 25 bp, Mus musculus
agcttagaaggctgtgaatgaagta

SEQ ID NO: 196549 - DNA, 25 bp, Mus musculus
agcttagatggcaggcatgccccgg

SEQ ID NO: 196550 - DNA, 25 bp, Mus musculus
agcttagcgagcagggcgtaagaac

SEQ ID NO: 196551 - DNA, 25 bp, Mus musculus
agcttaggaacccagattttgttcc

SEQ ID NO: 196552 - DNA, 25 bp, Mus musculus
agcttaggacctgggatggattgta

SEQ ID NO: 196553 - DNA, 25 bp, Mus musculus
agcttatcaggtgcccagatagatg

SEQ ID NO: 196554 - DNA, 25 bp, Mus musculus
agcttatcctggactgagctcctgg

SEQ ID NO: 196555 - DNA, 25 bp, Mus musculus
agcttatcttcctgagatgctgtcc

SEQ ID NO: 196556 - DNA, 25 bp, Mus musculus
agcttatggcagctgctgtgtggat

SEQ ID NO: 196557 - DNA, 25 bp, Mus musculus
agcttattaaaaacaatctggaact

SEQ ID NO: 196558 - DNA, 25 bp, Mus musculus
agcttattccagaggcatttggatt

SEQ ID NO: 196559 - DNA, 25 bp, Mus musculus
agcttattgccaaagatactgatca

SEQ ID NO: 196560 - DNA, 25 bp, Mus musculus
agcttattgccaaagctagttatga

SEQ ID NO: 196561 - DNA, 25 bp, Mus musculus
agcttattgccaaagctgcgtcttt

SEQ ID NO: 196562 - DNA, 25 bp, Mus musculus
agcttattgtggggcatgaaggatg

SEQ ID NO: 196563 - DNA, 25 bp, Mus musculus
agcttatttggtatgctaacagaac

SEQ ID NO: 196564 - DNA, 25 bp, Mus musculus
agcttcaaagccaaggcaaagctga

SEQ ID NO: 196565 - DNA, 25 bp, Mus musculus
agcttcaaagccaaggctgcctacc

SEQ ID NO: 196566 - DNA, 25 bp, Mus musculus
agcttcaacaaaggtgatctgcaat

SEQ ID NO: 196567 - DNA, 25 bp, Mus musculus
agcttcaagagaaagccttgtttgc

SEQ ID NO: 196568 - DNA, 25 bp, Mus musculus
agcttcaagagaaaggttcaatttt

SEQ ID NO: 196569 - DNA, 25 bp, Mus musculus
agcttcaaggccaggttgatggaaa

SEQ ID NO: 196570 - DNA, 25 bp, Mus musculus
agcttcaccacgaccctggtgaacc

SEQ ID NO: 196571 - DNA, 25 bp, Mus musculus
agcttcactgataaaacacggacct

SEQ ID NO: 196572 - DNA, 25 bp, Mus musculus
agcttcagagagatggtgtcttgtc

SEQ ID NO: 196573 - DNA, 25 bp, Mus musculus
agcttcagagagctgccaggccgca

SEQ ID NO: 196574 - DNA, 25 bp, Mus musculus
agcttcagagagtgtttaattcctt

SEQ ID NO: 196575 - DNA, 25 bp, Mus musculus
agcttcagcagcatctacaggggca

SEQ ID NO: 196576 - DNA, 25 bp, Mus musculus
agcttcagcagctctagccaagagt

SEQ ID NO: 196577 - DNA, 25 bp, Mus musculus
agcttcagcaggcatccatcctgga

SEQ ID NO: 196578 - DNA, 25 bp, Mus musculus
agcttcagcgagggaagcttcttga

SEQ ID NO: 196579 - DNA, 25 bp, Mus musculus
agcttcaggttaggattcccaggaa

SEQ ID NO: 196580 - DNA, 25 bp, Mus musculus
agcttcatcaggaatggccttgatg

SEQ ID NO: 196581 - DNA, 25 bp, Mus musculus
agcttcatcaggagcaagagcagct

SEQ ID NO: 196582 - DNA, 25 bp, Mus musculus
agcttcatgaagaacatatgacatc

SEQ ID NO: 196583 - DNA, 25 bp, Mus musculus
agcttcatggaagagggtagcacat

SEQ ID NO: 196584 - DNA, 25 bp, Mus musculus
agcttcatggaagaggtccagaaag

SEQ ID NO: 196585 - DNA, 25 bp, Mus musculus
agcttcatgggaggatccaaaggga

SEQ ID NO: 196586 - DNA, 25 bp, Mus musculus
agcttcattgatgaagcccgctcca

SEQ ID NO: 196587 - DNA, 25 bp, Mus musculus
agcttcattggggttccttggagat

SEQ ID NO: 196588 - DNA, 25 bp, Mus musculus
agcttcatttcaggctcctgtggct

SEQ ID NO: 196589 - DNA, 25 bp, Mus musculus
agcttccaaagccacccgcggtcag

SEQ ID NO: 196590 - DNA, 25 bp, Mus musculus
agcttccaaagcgcggctgggttcc

SEQ ID NO: 196591 - DNA, 25 bp, Mus musculus
agcttccaatacaagcacaggggag

SEQ ID NO: 196592 - DNA, 25 bp, Mus musculus
agcttccacagaaactcaagtcaag

SEQ ID NO: 196593 - DNA, 25 bp, Mus musculus
agcttccacagaccatgccttaaga

SEQ ID NO: 196594 - DNA, 25 bp, Mus musculus
agcttccacaggtttcctttggatc

SEQ ID NO: 196595 - DNA, 25 bp, Mus musculus
agcttccacctagggactgccgctt

SEQ ID NO: 196596 - DNA, 25 bp, Mus musculus
agcttccacgacagctccctcttga

SEQ ID NO: 196597 - DNA, 25 bp, Mus musculus
agcttccactaaagattcagagtca

SEQ ID NO: 196598 - DNA, 25 bp, Mus musculus
agcttccaggcatgctcagggtatg

SEQ ID NO: 196599 - DNA, 25 bp, Mus musculus
agcttcccagccggaacccagactg

SEQ ID NO: 196600 - DNA, 25 bp, Mus musculus
agcttcccaggagatgtacgactaa

SEQ ID NO: 196601 - DNA, 25 bp, Mus musculus
agcttcccagggggatatccgcctg

SEQ ID NO: 196602 - DNA, 25 bp, Mus musculus
agcttcccaggtctctttgagcccg

SEQ ID NO: 196603 - DNA, 25 bp, Mus musculus
agcttccccctggagtcctttcact

SEQ ID NO: 196604 - DNA, 25 bp, Mus musculus
agcttccctcgcaacctcctgacct

SEQ ID NO: 196605 - DNA, 25 bp, Mus musculus
agcttccctcgcggggctgcggtcc

SEQ ID NO: 196606 - DNA, 25 bp, Mus musculus
agcttccctcggaggcacgcgccta

SEQ ID NO: 196607 - DNA, 25 bp, Mus musculus
agcttccctcggagtacaacacaga

SEQ ID NO: 196608 - DNA, 25 bp, Mus musculus
agcttccctgcccgaagggacagtt

SEQ ID NO: 196609 - DNA, 25 bp, Mus musculus
agcttccctggcacagaaacatcat

SEQ ID NO: 196610 - DNA, 25 bp, Mus musculus
agcttccctgtctgtacctacagcc

SEQ ID NO: 196611 - DNA, 25 bp, Mus musculus
agcttccctgtttttagcaaccttc

SEQ ID NO: 196612 - DNA, 25 bp, Mus musculus
agcttccgaccattagccaagtcca

SEQ ID NO: 196613 - DNA, 25 bp, Mus musculus
agcttccgagcaggggaagagttgc

SEQ ID NO: 196614 - DNA, 25 bp, Mus musculus
agcttccgcaggcgccatggaaaag

SEQ ID NO: 196615 - DNA, 25 bp, Mus musculus
agcttccgcgtcgagatttggtgac

SEQ ID NO: 196616 - DNA, 25 bp, Mus musculus
agcttcctagagaccaagatcacaa

SEQ ID NO: 196617 - DNA, 25 bp, Mus musculus
agcttcctcttcagcagccgctctt

SEQ ID NO: 196618 - DNA, 25 bp, Mus musculus
agcttcctcttcgttattttaactg

SEQ ID NO: 196619 - DNA, 25 bp, Mus musculus
agcttcctgagagtgcccgaggcgc

SEQ ID NO: 196620 - DNA, 25 bp, Mus musculus
agcttcctgagcctcctctttcagg

SEQ ID NO: 196621 - DNA, 25 bp, Mus musculus
agcttcctgagtggtatccttggca

SEQ ID NO: 196622 - DNA, 25 bp, Mus musculus
agcttcctgatgaagttatagtgcc

SEQ ID NO: 196623 - DNA, 25 bp, Mus musculus
agcttcctgatgaatgtcattggtc

SEQ ID NO: 196624 - DNA, 25 bp, Mus musculus
agcttcctgatgaggagtctctgtt

SEQ ID NO: 196625 - DNA, 25 bp, Mus musculus
agcttcctgcagccaggtgggaaga

SEQ ID NO: 196626 - DNA, 25 bp, Mus musculus
agcttcctttgaggaggattctgga

SEQ ID NO: 196627 - DNA, 25 bp, Mus musculus
agcttcgaatgcctggtgcagccgg

SEQ ID NO: 196628 - DNA, 25 bp, Mus musculus
agcttcgagaaggccaaagaatctt

SEQ ID NO: 196629 - DNA, 25 bp, Mus musculus
agcttcgagaagtacgatgaagacc

SEQ ID NO: 196630 - DNA, 25 bp, Mus musculus
agcttcgagtcacagggggtgacat

SEQ ID NO: 196631 - DNA, 25 bp, Mus musculus
agcttcgccatgtactattttacct

SEQ ID NO: 196632 - DNA, 25 bp, Mus musculus
agcttcgcctgaaacctcagcttct

SEQ ID NO: 196633 - DNA, 25 bp, Mus musculus
agcttcggacccacatggtggacct

SEQ ID NO: 196634 - DNA, 25 bp, Mus musculus
agcttcggcaaaaatgagtctcata

SEQ ID NO: 196635 - DNA, 25 bp, Mus musculus
agcttcgggcccagctctccagtct

SEQ ID NO: 196636 - DNA, 25 bp, Mus musculus
agcttcgggggccagccgccgccat

SEQ ID NO: 196637 - DNA, 25 bp, Mus musculus
agcttcggtgtcaggaggacatgtc

SEQ ID NO: 196638 - DNA, 25 bp, Mus musculus
agcttcggtgtcaggggacactctt

SEQ ID NO: 196639 - DNA, 25 bp, Mus musculus
agcttcgtggctggcggactatttc

SEQ ID NO: 196640 - DNA, 25 bp, Mus musculus
agcttcgtggctggtttgactcaga

SEQ ID NO: 196641 - DNA, 25 bp, Mus musculus
agcttctaaagaaaggtattgaggc

SEQ ID NO: 196642 - DNA, 25 bp, Mus musculus
agcttctagagatcatgagggccca

SEQ ID NO: 196643 - DNA, 25 bp, Mus musculus
agcttctagagcctgtttctctctc

SEQ ID NO: 196644 - DNA, 25 bp, Mus musculus
agcttctattaacagcttcgacctt

SEQ ID NO: 196645 - DNA, 25 bp, Mus musculus
agcttctcagtagtgatcaagctcg

SEQ ID NO: 196646 - DNA, 25 bp, Mus musculus
agcttctcatgctcatctttccttc

SEQ ID NO: 196647 - DNA, 25 bp, Mus musculus
agcttctcatgtgcaggctgagcgg

SEQ ID NO: 196648 - DNA, 25 bp, Mus musculus
agcttctccaagactctaaaaaacg

SEQ ID NO: 196649 - DNA, 25 bp, Mus musculus
agcttctccaagaggctactgaaag

SEQ ID NO: 196650 - DNA, 25 bp, Mus musculus
agcttctccctccggaaagaacaag

SEQ ID NO: 196651 - DNA, 25 bp, Mus musculus
agcttctccgagaacgggcagagaa

SEQ ID NO: 196652 - DNA, 25 bp, Mus musculus
agcttctcctgggagggtcatctat

SEQ ID NO: 196653 - DNA, 25 bp, Mus musculus
agcttctcctgggttggattgatct

SEQ ID NO: 196654 - DNA, 25 bp, Mus musculus
agcttctcctggtggaccacagacc

SEQ ID NO: 196655 - DNA, 25 bp, Mus musculus
agcttctcgtgtaaggatcttctgc

SEQ ID NO: 196656 - DNA, 25 bp, Mus musculus
agcttctctccttggtcacgcccgg

SEQ ID NO: 196657 - DNA, 25 bp, Mus musculus
agcttctgagaaagattgtctaaag

SEQ ID NO: 196658 - DNA, 25 bp, Mus musculus
agcttctgaggagctagaagcgatc

SEQ ID NO: 196659 - DNA, 25 bp, Mus musculus
agcttctgcaaaagaaatacaaaga

SEQ ID NO: 196660 - DNA, 25 bp, Mus musculus
agcttctgcaaaagagctgcaggga

SEQ ID NO: 196661 - DNA, 25 bp, Mus musculus
agcttctgcaaggttctgtccccct

SEQ ID NO: 196662 - DNA, 25 bp, Mus musculus
agcttctggagaagctccagcaccc

SEQ ID NO: 196663 - DNA, 25 bp, Mus musculus
agcttctgggaggttgggaactaca

SEQ ID NO: 196664 - DNA, 25 bp, Mus musculus
agcttctggggaaggtgcagctgga

SEQ ID NO: 196665 - DNA, 25 bp, Mus musculus
agcttctgggtcagggggattgatg

SEQ ID NO: 196666 - DNA, 25 bp, Mus musculus
agcttctgtgaagtcaccttaattt

SEQ ID NO: 196667 - DNA, 25 bp, Mus musculus
agcttctgtttccgggtgccatgca

SEQ ID NO: 196668 - DNA, 25 bp, Mus musculus
agcttcttagtcaagggtctcatgt

SEQ ID NO: 196669 - DNA, 25 bp, Mus musculus
agcttcttagtcaaggttggcttcc

SEQ ID NO: 196670 - DNA, 25 bp, Mus musculus
agcttctttcccgagggagcacggg

SEQ ID NO: 196671 - DNA, 25 bp, Mus musculus
agcttctttcccgaggtgttcacct

SEQ ID NO: 196672 - DNA, 25 bp, Mus musculus
agcttctttctttgaaggtgacggg

SEQ ID NO: 196673 - DNA, 25 bp, Mus musculus
agcttcttttgggatccgagcacca

SEQ ID NO: 196674 - DNA, 25 bp, Mus musculus
agcttgaaaatgcagaacagctttt

SEQ ID NO: 196675 - DNA, 25 bp, Mus musculus
agcttgaagaacctaaggcccgtgt

SEQ ID NO: 196676 - DNA, 25 bp, Mus musculus
agcttgaagaagaccttccccagga

SEQ ID NO: 196677 - DNA, 25 bp, Mus musculus
agcttgaagactctggtaggaacaa

SEQ ID NO: 196678 - DNA, 25 bp, Mus musculus
agcttgaagactctgtgcctggaat

SEQ ID NO: 196679 - DNA, 25 bp, Mus musculus
agcttgaagcatggcaatgaaatct

SEQ ID NO: 196680 - DNA, 25 bp, Mus musculus
agcttgaagcatggccagaagacat

SEQ ID NO: 196681 - DNA, 25 bp, Mus musculus
agcttgagaaaaaccatggtgaatc

SEQ ID NO: 196682 - DNA, 25 bp, Mus musculus
agcttgagcagcatcagaaaagttc

SEQ ID NO: 196683 - DNA, 25 bp, Mus musculus
agcttgagcagctgagtcccttccc

SEQ ID NO: 196684 - DNA, 25 bp, Mus musculus
agcttgagcagggagatggcggtaa

SEQ ID NO: 196685 - DNA, 25 bp, Mus musculus
agcttgagtgcaagaggcaagtgca

SEQ ID NO: 196686 - DNA, 25 bp, Mus musculus
agcttgagtgcaaggcaccccggct

SEQ ID NO: 196687 - DNA, 25 bp, Mus musculus
agcttgagtgtgcgcgggtcactca

SEQ ID NO: 196688 - DNA, 25 bp, Mus musculus
agcttgatgcaaggactcgtgggga

SEQ ID NO: 196689 - DNA, 25 bp, Mus musculus
agcttgatgcagaatccaaatccag

SEQ ID NO: 196690 - DNA, 25 bp, Mus musculus
agcttgatgcagctgtggcagaagt

SEQ ID NO: 196691 - DNA, 25 bp, Mus musculus
agcttgcaagaagaacatccagagt

SEQ ID NO: 196692 - DNA, 25 bp, Mus musculus
agcttgcaagaaggggaccagctgc

SEQ ID NO: 196693 - DNA, 25 bp, Mus musculus
agcttgcatgcctgggccctggccc

SEQ ID NO: 196694 - DNA, 25 bp, Mus musculus
agcttgccagcgtttttcgttggaa

SEQ ID NO: 196695 - DNA, 25 bp, Mus musculus
agcttgccagggcaagaaatacagc

SEQ ID NO: 196696 - DNA, 25 bp, Mus musculus
agcttgcccagtatgtgggatcctt

SEQ ID NO: 196697 - DNA, 25 bp, Mus musculus
agcttgccccagcggggacgaagca

SEQ ID NO: 196698 - DNA, 25 bp, Mus musculus
agcttgccccagctgacgagatgac

SEQ ID NO: 196699 - DNA, 25 bp, Mus musculus
agcttgccctcagagcctgtggaca

SEQ ID NO: 196700 - DNA, 25 bp, Mus musculus
agcttgccctcagagggccgggtta

SEQ ID NO: 196701 - DNA, 25 bp, Mus musculus
agcttgccctggtcaggcagcagtt

SEQ ID NO: 196702 - DNA, 25 bp, Mus musculus
agcttgctaagctacaagaagactc

SEQ ID NO: 196703 - DNA, 25 bp, Mus musculus
agcttgctaaggtggaagaagaaat

SEQ ID NO: 196704 - DNA, 25 bp, Mus musculus
agcttgctaatgacggtgcaggcaa

SEQ ID NO: 196705 - DNA, 25 bp, Mus musculus
agcttgctcaggatggctgcagcaa

SEQ ID NO: 196706 - DNA, 25 bp, Mus musculus
agcttgctcaggctcctcggattaa

SEQ ID NO: 196707 - DNA, 25 bp, Mus musculus
agcttgctgagactctccgctggtg

SEQ ID NO: 196708 - DNA, 25 bp, Mus musculus
agcttgctgaggcctcttaagcaat

SEQ ID NO: 196709 - DNA, 25 bp, Mus musculus
agcttgctgagggtttcccagtgta

SEQ ID NO: 196710 - DNA, 25 bp, Mus musculus
agcttgctggcaagagtattcagga

SEQ ID NO: 196711 - DNA, 25 bp, Mus musculus
agcttgctggcaaggtggcgacctg

SEQ ID NO: 196712 - DNA, 25 bp, Mus musculus
agcttgcttaaaacatgctaattcc

SEQ ID NO: 196713 - DNA, 25 bp, Mus musculus
agcttggacaacataaggaagtcag

SEQ ID NO: 196714 - DNA, 25 bp, Mus musculus
agcttggagaagggtcttatggaag

SEQ ID NO: 196715 - DNA, 25 bp, Mus musculus
agcttggagcagctgggaacactcc

SEQ ID NO: 196716 - DNA, 25 bp, Mus musculus
agcttggaggcgaatgaagtgtatc

SEQ ID NO: 196717 - DNA, 25 bp, Mus musculus
agcttggagttgactgtgttccctg

SEQ ID NO: 196718 - DNA, 25 bp, Mus musculus
agcttggagttgggaatgagcaatt

SEQ ID NO: 196719 - DNA, 25 bp, Mus musculus
agcttggatcacacagtgagaccct

SEQ ID NO: 196720 - DNA, 25 bp, Mus musculus
agcttggatctactgagcgcagcct

SEQ ID NO: 196721 - DNA, 25 bp, Mus musculus
agcttggatctactggttctgcagt

SEQ ID NO: 196722 - DNA, 25 bp, Mus musculus
agcttggatctactgtgggcccagc

SEQ ID NO: 196723 - DNA, 25 bp, Mus musculus
agcttggatggagaggttggtacag

SEQ ID NO: 196724 - DNA, 25 bp, Mus musculus
agcttggatggagcgtcagtgagtg

SEQ ID NO: 196725 - DNA, 25 bp, Mus musculus
agcttggcagaacacatgtcggagg

SEQ ID NO: 196726 - DNA, 25 bp, Mus musculus
agcttggcagactgtataacaaaga

SEQ ID NO: 196727 - DNA, 25 bp, Mus musculus
agcttgggagccagccccagcagtt

SEQ ID NO: 196728 - DNA, 25 bp, Mus musculus
agcttgggaggggtcatccttcggg

SEQ ID NO: 196729 - DNA, 25 bp, Mus musculus
agcttggggaatctggagcaattca

SEQ ID NO: 196730 - DNA, 25 bp, Mus musculus
agcttggggaatcttgctctttgat

SEQ ID NO: 196731 - DNA, 25 bp, Mus musculus
agcttggtatttggaatgcagaaac

SEQ ID NO: 196732 - DNA, 25 bp, Mus musculus
agcttggtattttgaagtccctgga

SEQ ID NO: 196733 - DNA, 25 bp, Mus musculus
agcttggtccaggaaaatggacaaa

SEQ ID NO: 196734 - DNA, 25 bp, Mus musculus
agcttggttccagatgggtgtgttt

SEQ ID NO: 196735 - DNA, 25 bp, Mus musculus
agcttggttccagggtgactgactg

SEQ ID NO: 196736 - DNA, 25 bp, Mus musculus
agcttgtacaagcttcaaaaccgct

SEQ ID NO: 196737 - DNA, 25 bp, Mus musculus
agcttgtacaagtctgcagatggcc

SEQ ID NO: 196738 - DNA, 25 bp, Mus musculus
agcttgtaccaccggtaactaaatg

SEQ ID NO: 196739 - DNA, 25 bp, Mus musculus
agcttgtaccaccggtatccatgcc

SEQ ID NO: 196740 - DNA, 25 bp, Mus musculus
agcttgtagatgtggaatggacaga

SEQ ID NO: 196741 - DNA, 25 bp, Mus musculus
agcttgtagatgtggatgaaaagaa

SEQ ID NO: 196742 - DNA, 25 bp, Mus musculus
agcttgtcataaaagaaatgtaccc

SEQ ID NO: 196743 - DNA, 25 bp, Mus musculus
agcttgtcataaaagatgggcgaac

SEQ ID NO: 196744 - DNA, 25 bp, Mus musculus
agcttgtctggaacctctcaggagc

SEQ ID NO: 196745 - DNA, 25 bp, Mus musculus
agcttgtgaaggaatctgattgcct

SEQ ID NO: 196746 - DNA, 25 bp, Mus musculus
agcttgtgaggttcttgtttcctga

SEQ ID NO: 196747 - DNA, 25 bp, Mus musculus
agcttgtgcagccacgacccaccgt

SEQ ID NO: 196748 - DNA, 25 bp, Mus musculus
agcttgtgcaggtgacagcagcatg

SEQ ID NO: 196749 - DNA, 25 bp, Mus musculus
agcttgtgcggctagaagaggaaca

SEQ ID NO: 196750 - DNA, 25 bp, Mus musculus
agcttgtgcgtgatattgtggtcca

SEQ ID NO: 196751 - DNA, 25 bp, Mus musculus
agcttgtggctttgaccatccacga

SEQ ID NO: 196752 - DNA, 25 bp, Mus musculus
agcttgtggctttgagtctgacaag

SEQ ID NO: 196753 - DNA, 25 bp, Mus musculus
agcttgtgtctgaaggtgcttcctg

SEQ ID NO: 196754 - DNA, 25 bp, Mus musculus
agctttaaacaagaggctcaagatg

SEQ ID NO: 196755 - DNA, 25 bp, Mus musculus
agctttaaacaaggggcgcagagaa

SEQ ID NO: 196756 - DNA, 25 bp, Mus musculus
agctttacaataagattacatctcg

SEQ ID NO: 196757 - DNA, 25 bp, Mus musculus
agctttactctggactttggagact

SEQ ID NO: 196758 - DNA, 25 bp, Mus musculus
agctttacttttggtatatcatgta

SEQ ID NO: 196759 - DNA, 25 bp, Mus musculus
agctttagaaggcatggatgataca

SEQ ID NO: 196760 - DNA, 25 bp, Mus musculus
agctttagtcctcaaaggccagttg

SEQ ID NO: 196761 - DNA, 25 bp, Mus musculus
agctttagtgataggctctctccta

SEQ ID NO: 196762 - DNA, 25 bp, Mus musculus
agctttagtgatagggttcactgtg

SEQ ID NO: 196763 - DNA, 25 bp, Mus musculus
agctttagtgtagggccaagtccac

SEQ ID NO: 196764 - DNA, 25 bp, Mus musculus
agctttagtgtataggggagcaggc

SEQ ID NO: 196765 - DNA, 25 bp, Mus musculus
agctttatacagaaagatgttggat

SEQ ID NO: 196766 - DNA, 25 bp, Mus musculus
agctttatcaggtccacagagttgg

SEQ ID NO: 196767 - DNA, 25 bp, Mus musculus
agctttatgtcagtcagccccagca

SEQ ID NO: 196768 - DNA, 25 bp, Mus musculus
agctttcaaagccattggcacagcg

SEQ ID NO: 196769 - DNA, 25 bp, Mus musculus
agctttcaaagtgaaacctccacat

SEQ ID NO: 196770 - DNA, 25 bp, Mus musculus
agctttcaccaaccaatcaaagttg

SEQ ID NO: 196771 - DNA, 25 bp, Mus musculus
agctttcaccaagtgtggattcgca

SEQ ID NO: 196772 - DNA, 25 bp, Mus musculus
agctttcagccagagatcaccagaa

SEQ ID NO: 196773 - DNA, 25 bp, Mus musculus
agctttcagccagagggggctttta

SEQ ID NO: 196774 - DNA, 25 bp, Mus musculus
agctttccagaattcctcagagaga

SEQ ID NO: 196775 - DNA, 25 bp, Mus musculus
agctttccagacttacaacagctgt

SEQ ID NO: 196776 - DNA, 25 bp, Mus musculus
agctttccagcacctcctaccggca

SEQ ID NO: 196777 - DNA, 25 bp, Mus musculus
agctttccaggacaagaagatgcca

SEQ ID NO: 196778 - DNA, 25 bp, Mus musculus
agctttccaggtctttgactcagaa

SEQ ID NO: 196779 - DNA, 25 bp, Mus musculus
agctttcccatcagaaaccaactta

SEQ ID NO: 196780 - DNA, 25 bp, Mus musculus
agctttcccgagacagcctgccagg

SEQ ID NO: 196781 - DNA, 25 bp, Mus musculus
agctttcctttgaagcacctaaagt

SEQ ID NO: 196782 - DNA, 25 bp, Mus musculus
agctttcgacccgaggactatctcc

SEQ ID NO: 196783 - DNA, 25 bp, Mus musculus
agctttcgacccggattctcaaaac

SEQ ID NO: 196784 - DNA, 25 bp, Mus musculus
agctttcggagcattttctgcagct

SEQ ID NO: 196785 - DNA, 25 bp, Mus musculus
agctttctcccaggtgctcaccatt

SEQ ID NO: 196786 - DNA, 25 bp, Mus musculus
agctttgaacgctgtgtgagaattg

SEQ ID NO: 196787 - DNA, 25 bp, Mus musculus
agctttgaactgataagacgccttg

SEQ ID NO: 196788 - DNA, 25 bp, Mus musculus
agctttgaactgataatggcaaaga

SEQ ID NO: 196789 - DNA, 25 bp, Mus musculus
agctttgaagaatgaagaggaataa

SEQ ID NO: 196790 - DNA, 25 bp, Mus musculus
agctttgaagatgggaaacctgtgt

SEQ ID NO: 196791 - DNA, 25 bp, Mus musculus
agctttgaagttgggaaacctgtgt

SEQ ID NO: 196792 - DNA, 25 bp, Mus musculus
agctttgaatcgggaggaagcactg

SEQ ID NO: 196793 - DNA, 25 bp, Mus musculus
agctttgagatgggtaaccttttgg

SEQ ID NO: 196794 - DNA, 25 bp, Mus musculus
agctttgagatggtctgctttacgg

SEQ ID NO: 196795 - DNA, 25 bp, Mus musculus
agctttgaggaaagatcaaactcag

SEQ ID NO: 196796 - DNA, 25 bp, Mus musculus
agctttgaggaagattgcaagccca

SEQ ID NO: 196797 - DNA, 25 bp, Mus musculus
agctttgaggaagcgagtctccagt

SEQ ID NO: 196798 - DNA, 25 bp, Mus musculus
agctttgaggaagttatcaacatag

SEQ ID NO: 196799 - DNA, 25 bp, Mus musculus
agctttgataaatttgaattctgtg

SEQ ID NO: 196800 - DNA, 25 bp, Mus musculus
agctttgatgctgcattccgtggtc

SEQ ID NO: 196801 - DNA, 25 bp, Mus musculus
agctttgcagcatgctcacgcacat

SEQ ID NO: 196802 - DNA, 25 bp, Mus musculus
agctttgccaggaatctggtctgtc

SEQ ID NO: 196803 - DNA, 25 bp, Mus musculus
agctttgctcagtatgggtgagagc

SEQ ID NO: 196804 - DNA, 25 bp, Mus musculus
agctttgctcgaagttgtccagtct

SEQ ID NO: 196805 - DNA, 25 bp, Mus musculus
agctttgctcttggcactaaacaag

SEQ ID NO: 196806 - DNA, 25 bp, Mus musculus
agctttgctcttggggagatgcgaa

SEQ ID NO: 196807 - DNA, 25 bp, Mus musculus
agctttggagctgttggttttgacc

SEQ ID NO: 196808 - DNA, 25 bp, Mus musculus
agctttggagggctccactctagcc

SEQ ID NO: 196809 - DNA, 25 bp, Mus musculus
agctttggctcttttacagacctca

SEQ ID NO: 196810 - DNA, 25 bp, Mus musculus
agctttggctgaaaggacttctaga

SEQ ID NO: 196811 - DNA, 25 bp, Mus musculus
agctttgggaccggttcggaccata

SEQ ID NO: 196812 - DNA, 25 bp, Mus musculus
agctttggggggctggctgtgggct

SEQ ID NO: 196813 - DNA, 25 bp, Mus musculus
agctttggggtggtaatactggaga

SEQ ID NO: 196814 - DNA, 25 bp, Mus musculus
agctttgggtctcggcaaccaaact

SEQ ID NO: 196815 - DNA, 25 bp, Mus musculus
agctttgtcaagaacctacatggac

SEQ ID NO: 196816 - DNA, 25 bp, Mus musculus
agctttgtcaagggatacctccttc

SEQ ID NO: 196817 - DNA, 25 bp, Mus musculus
agctttgtcaagggctggggagcag

SEQ ID NO: 196818 - DNA, 25 bp, Mus musculus
agctttgtttctcccaggactcatg

SEQ ID NO: 196819 - DNA, 25 bp, Mus musculus
agctttgttttttgccatctctgga

SEQ ID NO: 196820 - DNA, 25 bp, Mus musculus
agcttttaaaaattgttgcttcctg

SEQ ID NO: 196821 - DNA, 25 bp, Mus musculus
agcttttaaagcatgcgcagatgac

SEQ ID NO: 196822 - DNA, 25 bp, Mus musculus
agcttttaaagcatgggcagtagct

SEQ ID NO: 196823 - DNA, 25 bp, Mus musculus
agcttttaattcagttgaaaagggc

SEQ ID NO: 196824 - DNA, 25 bp, Mus musculus
agcttttacatgaaggtgcatctgc

SEQ ID NO: 196825 - DNA, 25 bp, Mus musculus
agcttttactcggaccaacatatgc

SEQ ID NO: 196826 - DNA, 25 bp, Mus musculus
agcttttagagtcgctgactcccct

SEQ ID NO: 196827 - DNA, 25 bp, Mus musculus
agcttttagtacagagtcttgctgt

SEQ ID NO: 196828 - DNA, 25 bp, Mus musculus
agcttttagtgccaaagcctcactg

SEQ ID NO: 196829 - DNA, 25 bp, Mus musculus
agcttttagtgttgtaggaagtgtc

SEQ ID NO: 196830 - DNA, 25 bp, Mus musculus
agcttttatcaaaggtgtgccattt

SEQ ID NO: 196831 - DNA, 25 bp, Mus musculus
agcttttatcccagaaatgtgaatc

SEQ ID NO: 196832 - DNA, 25 bp, Mus musculus
agcttttatcccaggtgtgccattt

SEQ ID NO: 196833 - DNA, 25 bp, Mus musculus
agcttttatggcgcgagcttcattt

SEQ ID NO: 196834 - DNA, 25 bp, Mus musculus
agcttttcagcacctttggggaact

SEQ ID NO: 196835 - DNA, 25 bp, Mus musculus
agcttttccaacgccgagatgactg

SEQ ID NO: 196836 - DNA, 25 bp, Mus musculus
agcttttctaaggcatcaatacttg

SEQ ID NO: 196837 - DNA, 25 bp, Mus musculus
agcttttcttctggcggcatcgctg

SEQ ID NO: 196838 - DNA, 25 bp, Mus musculus
agcttttgcagatgaatatgaagga

SEQ ID NO: 196839 - DNA, 25 bp, Mus musculus
agcttttgcagggggcaccctcccg

SEQ ID NO: 196840 - DNA, 25 bp, Mus musculus
agcttttgcaggtggctttgcagct

SEQ ID NO: 196841 - DNA, 25 bp, Mus musculus
agcttttgcagtggacatcccagaa

SEQ ID NO: 196842 - DNA, 25 bp, Mus musculus
agcttttgcggtttgtagtgcatcc

SEQ ID NO: 196843 - DNA, 25 bp, Mus musculus
agcttttgcgttcagttcggtggca

SEQ ID NO: 196844 - DNA, 25 bp, Mus musculus
agctttttaacaaggtgaactgaag

SEQ ID NO: 196845 - DNA, 25 bp, Mus musculus
agctttttagatgggagaccgttag

SEQ ID NO: 196846 - DNA, 25 bp, Mus musculus
agctttttccaggatcccattgtta

SEQ ID NO: 196847 - DNA, 25 bp, Mus musculus
agcttttttacaggagaaaccctgt

SEQ ID NO: 196848 - DNA, 25 bp, Mus musculus
aggaaaaaaagtggtcatgctgcca

SEQ ID NO: 196849 - DNA, 25 bp, Mus musculus
aggaaaaaagcacctgacgttcacg

SEQ ID NO: 196850 - DNA, 25 bp, Mus musculus
aggaaaaaagtctgatgccaacgca

SEQ ID NO: 196851 - DNA, 25 bp, Mus musculus
aggaaaaacagagagagagaaagaa

SEQ ID NO: 196852 - DNA, 25 bp, Mus musculus
aggaaaaagctcgccacccccatca

SEQ ID NO: 196853 - DNA, 25 bp, Mus musculus
aggaaaaagtcaagccgagatgact

SEQ ID NO: 196854 - DNA, 25 bp, Mus musculus
aggaaaaagtcaaggaactcaacag

SEQ ID NO: 196855 - DNA, 25 bp, Mus musculus
aggaaaaagttgccaggaaacaagc

SEQ ID NO: 196856 - DNA, 25 bp, Mus musculus
aggaaaacaaattagtgacagatca

SEQ ID NO: 196857 - DNA, 25 bp, Mus musculus
aggaaaacaggacccatcctctgtc

SEQ ID NO: 196858 - DNA, 25 bp, Mus musculus
aggaaaacaggtttcaagtgcccca

SEQ ID NO: 196859 - DNA, 25 bp, Mus musculus
aggaaaacagtctataaagcaccat

SEQ ID NO: 196860 - DNA, 25 bp, Mus musculus
aggaaaaccaagggctcaccttgtg

SEQ ID NO: 196861 - DNA, 25 bp, Mus musculus
aggaaaaccaatggctcaccctgtg

SEQ ID NO: 196862 - DNA, 25 bp, Mus musculus
aggaaaaccaggcacgcatcgagga

SEQ ID NO: 196863 - DNA, 25 bp, Mus musculus
aggaaaaccaggttgctggtgacca

SEQ ID NO: 196864 - DNA, 25 bp, Mus musculus
aggaaaagaaagagagttcgatgcc

SEQ ID NO: 196865 - DNA, 25 bp, Mus musculus
aggaaaagaaagctgttcagagcta

SEQ ID NO: 196866 - DNA, 25 bp, Mus musculus
aggaaaagaaagtctgccaaggcac

SEQ ID NO: 196867 - DNA, 25 bp, Mus musculus
aggaaaagaacacagaacttgtcct

SEQ ID NO: 196868 - DNA, 25 bp, Mus musculus
aggaaaagaacacagtgccctggtt

SEQ ID NO: 196869 - DNA, 25 bp, Mus musculus
aggaaaagaaggtgggcgactgctg

SEQ ID NO: 196870 - DNA, 25 bp, Mus musculus
aggaaaagaagttctgggagtcagc

SEQ ID NO: 196871 - DNA, 25 bp, Mus musculus
aggaaaagaatctgcaggcacacgg

SEQ ID NO: 196872 - DNA, 25 bp, Mus musculus
aggaaaagaggaccccaggacttct

SEQ ID NO: 196873 - DNA, 25 bp, Mus musculus
aggaaaagaggagtgggagctcaac

SEQ ID NO: 196874 - DNA, 25 bp, Mus musculus
aggaaaagaggccttggaagatcgt

SEQ ID NO: 196875 - DNA, 25 bp, Mus musculus
aggaaaagcagacttgtgtcctggc

SEQ ID NO: 196876 - DNA, 25 bp, Mus musculus
aggaaaagcagcagatataccagat

SEQ ID NO: 196877 - DNA, 25 bp, Mus musculus
aggaaaaggaagatgacaagagaag

SEQ ID NO: 196878 - DNA, 25 bp, Mus musculus
aggaaaaggaagatggaggaaagac

SEQ ID NO: 196879 - DNA, 25 bp, Mus musculus
aggaaaaggagctctgtcaggtggt

SEQ ID NO: 196880 - DNA, 25 bp, Mus musculus
aggaaaaggaggagtcagacacaga

SEQ ID NO: 196881 - DNA, 25 bp, Mus musculus
aggaaaataagcaaaaattcccaga

SEQ ID NO: 196882 - DNA, 25 bp, Mus musculus
aggaaaataaggtacttcaatttag

SEQ ID NO: 196883 - DNA, 25 bp, Mus musculus
aggaaaataaggtgttttcacgtct

SEQ ID NO: 196884 - DNA, 25 bp, Mus musculus
aggaaaataagttctgaaaatcaac

SEQ ID NO: 196885 - DNA, 25 bp, Mus musculus
aggaaaatatgggctggcgctgcaa

SEQ ID NO: 196886 - DNA, 25 bp, Mus musculus
aggaaaatcagtgtctttacatcca

SEQ ID NO: 196887 - DNA, 25 bp, Mus musculus
aggaaaatccagttcacagtgtaga

SEQ ID NO: 196888 - DNA, 25 bp, Mus musculus
aggaaaatgggaagacagatgtctg

SEQ ID NO: 196889 - DNA, 25 bp, Mus musculus
aggaaaatgggatggagacaacaga

SEQ ID NO: 196890 - DNA, 25 bp, Mus musculus
aggaaaatggtgaggaggttggact

SEQ ID NO: 196891 - DNA, 25 bp, Mus musculus
aggaaaattggaacaatccactttc

SEQ ID NO: 196892 - DNA, 25 bp, Mus musculus
aggaaacaaaccagactgacctcgg

SEQ ID NO: 196893 - DNA, 25 bp, Mus musculus
aggaaacaaaccagatcccccacct

SEQ ID NO: 196894 - DNA, 25 bp, Mus musculus
aggaaacaagaacgtatctcctcga

SEQ ID NO: 196895 - DNA, 25 bp, Mus musculus
aggaaacaagattatccagctgatc

SEQ ID NO: 196896 - DNA, 25 bp, Mus musculus
aggaaacacaagagcaggcaaggcc

SEQ ID NO: 196897 - DNA, 25 bp, Mus musculus
aggaaacacagatacctctgaaatt

SEQ ID NO: 196898 - DNA, 25 bp, Mus musculus
aggaaacagaagagtctgaggttat

SEQ ID NO: 196899 - DNA, 25 bp, Mus musculus
aggaaacagacacaggtaccagaga

SEQ ID NO: 196900 - DNA, 25 bp, Mus musculus
aggaaacagacacaggtggggtgaa

SEQ ID NO: 196901 - DNA, 25 bp, Mus musculus
aggaaacagcagattcctcagacaa

SEQ ID NO: 196902 - DNA, 25 bp, Mus musculus
aggaaacagcagggaaggatctgtc

SEQ ID NO: 196903 - DNA, 25 bp, Mus musculus
aggaaacagccaaggaggcaccgag

SEQ ID NO: 196904 - DNA, 25 bp, Mus musculus
aggaaacaggggaacacctctactg

SEQ ID NO: 196905 - DNA, 25 bp, Mus musculus
aggaaacagttacctgcagaatgtg

SEQ ID NO: 196906 - DNA, 25 bp, Mus musculus
aggaaacatacagtggatgaatata

SEQ ID NO: 196907 - DNA, 25 bp, Mus musculus
aggaaacatagagaggaactacaag

SEQ ID NO: 196908 - DNA, 25 bp, Mus musculus
aggaaacatggaaataagcagcaag

SEQ ID NO: 196909 - DNA, 25 bp, Mus musculus
aggaaaccagccaaggactaactac

SEQ ID NO: 196910 - DNA, 25 bp, Mus musculus
aggaaaccaggaatgacacgggatg

SEQ ID NO: 196911 - DNA, 25 bp, Mus musculus
aggaaaccaggaatgggccttgaca

SEQ ID NO: 196912 - DNA, 25 bp, Mus musculus
aggaaacccagtcgcatagggcatg

SEQ ID NO: 196913 - DNA, 25 bp, Mus musculus
aggaaactcagactaaggctggacc

SEQ ID NO: 196914 - DNA, 25 bp, Mus musculus
aggaaactggagtgtgggttcgcag

SEQ ID NO: 196915 - DNA, 25 bp, Mus musculus
aggaaactggccaggtgctctcctg

SEQ ID NO: 196916 - DNA, 25 bp, Mus musculus
aggaaactggttggctgggaagacc

SEQ ID NO: 196917 - DNA, 25 bp, Mus musculus
aggaaacttcaggacccctgtgcag

SEQ ID NO: 196918 - DNA, 25 bp, Mus musculus
aggaaagaaaagggctgaagaagag

SEQ ID NO: 196919 - DNA, 25 bp, Mus musculus
aggaaagaacaagagacatgtttgg

SEQ ID NO: 196920 - DNA, 25 bp, Mus musculus
aggaaagaagaagacctgtctgaaa

SEQ ID NO: 196921 - DNA, 25 bp, Mus musculus
aggaaagaagaagaggcacactgga

SEQ ID NO: 196922 - DNA, 25 bp, Mus musculus
aggaaagaagaagaggtgagtaatc

SEQ ID NO: 196923 - DNA, 25 bp, Mus musculus
aggaaagaaggtggtggaagatacc

SEQ ID NO: 196924 - DNA, 25 bp, Mus musculus
aggaaagacatgatactgtcagcag

SEQ ID NO: 196925 - DNA, 25 bp, Mus musculus
aggaaagaggaagaagtcgtcacat

SEQ ID NO: 196926 - DNA, 25 bp, Mus musculus
aggaaagatgagatcctgggcaact

SEQ ID NO: 196927 - DNA, 25 bp, Mus musculus
aggaaagcaaggaatcttcaaagtc

SEQ ID NO: 196928 - DNA, 25 bp, Mus musculus
aggaaagcaaggcatgccgcttttc

SEQ ID NO: 196929 - DNA, 25 bp, Mus musculus
aggaaagcaagggaacctagtaaca

SEQ ID NO: 196930 - DNA, 25 bp, Mus musculus
aggaaagcacagagaccagctatgg

SEQ ID NO: 196931 - DNA, 25 bp, Mus musculus
aggaaagcacagggaagctgggaaa

SEQ ID NO: 196932 - DNA, 25 bp, Mus musculus
aggaaagcaccgcaggtatcagcct

SEQ ID NO: 196933 - DNA, 25 bp, Mus musculus
aggaaagcagaaaaccgtcaaggaa

SEQ ID NO: 196934 - DNA, 25 bp, Mus musculus
aggaaagcagcccatacccagccat

SEQ ID NO: 196935 - DNA, 25 bp, Mus musculus
aggaaagcatgaagacgtggccatt

SEQ ID NO: 196936 - DNA, 25 bp, Mus musculus
aggaaagccagcggaaatggtcctt

SEQ ID NO: 196937 - DNA, 25 bp, Mus musculus
aggaaagccagtaatggtcagcaag

SEQ ID NO: 196938 - DNA, 25 bp, Mus musculus
aggaaagcctcagaaaccttgattt

SEQ ID NO: 196939 - DNA, 25 bp, Mus musculus
aggaaagcctcagagccttttcagc

SEQ ID NO: 196940 - DNA, 25 bp, Mus musculus
aggaaagcgaactgacaagttggat

SEQ ID NO: 196941 - DNA, 25 bp, Mus musculus
aggaaagcgaactgggttacattcc

SEQ ID NO: 196942 - DNA, 25 bp, Mus musculus
aggaaagcgaggatgagaagcagct

SEQ ID NO: 196943 - DNA, 25 bp, Mus musculus
aggaaagcgtcaaaccggtgcccaa

SEQ ID NO: 196944 - DNA, 25 bp, Mus musculus
aggaaagcgtcaaactccctgaatt

SEQ ID NO: 196945 - DNA, 25 bp, Mus musculus
aggaaagctgccttcaccttccact

SEQ ID NO: 196946 - DNA, 25 bp, Mus musculus
aggaaagctttcatagtgcctgcag

SEQ ID NO: 196947 - DNA, 25 bp, Mus musculus
aggaaaggaaaaaagcacctgacgt

SEQ ID NO: 196948 - DNA, 25 bp, Mus musculus
aggaaaggaaaaaagtctgatgcca

SEQ ID NO: 196949 - DNA, 25 bp, Mus musculus
aggaaaggagtgactggtcagaaag

SEQ ID NO: 196950 - DNA, 25 bp, Mus musculus
aggaaaggccgttttggactacatc

SEQ ID NO: 196951 - DNA, 25 bp, Mus musculus
aggaaaggcgagaagatccttatcc

SEQ ID NO: 196952 - DNA, 25 bp, Mus musculus
aggaaaggcgagaagatgggctgca

SEQ ID NO: 196953 - DNA, 25 bp, Mus musculus
aggaaagtgaccagccgagaacgag

SEQ ID NO: 196954 - DNA, 25 bp, Mus musculus
aggaaagtgaccagcgtgtccaccc

SEQ ID NO: 196955 - DNA, 25 bp, Mus musculus
aggaaagtgagcaagcaggaggagg

SEQ ID NO: 196956 - DNA, 25 bp, Mus musculus
aggaaagttcaaatagcccgtccct

SEQ ID NO: 196957 - DNA, 25 bp, Mus musculus
aggaaagttccaggggaacatagcc

SEQ ID NO: 196958 - DNA, 25 bp, Mus musculus
aggaaagttctcaatctcacaggca

SEQ ID NO: 196959 - DNA, 25 bp, Mus musculus
aggaaataaaatggttatgtccttc

SEQ ID NO: 196960 - DNA, 25 bp, Mus musculus
aggaaataatccctccatattacaa

SEQ ID NO: 196961 - DNA, 25 bp, Mus musculus
aggaaatacagatgctggcccgtga

SEQ ID NO: 196962 - DNA, 25 bp, Mus musculus
aggaaatacatgctgtctgtgcttc

SEQ ID NO: 196963 - DNA, 25 bp, Mus musculus
aggaaatacatggtgtctgtgcttc

SEQ ID NO: 196964 - DNA, 25 bp, Mus musculus
aggaaatcagtgttgaagatgaagc

SEQ ID NO: 196965 - DNA, 25 bp, Mus musculus
aggaaatcatcgaagtctttgtcca

SEQ ID NO: 196966 - DNA, 25 bp, Mus musculus
aggaaatccttacgatgctgatgac

SEQ ID NO: 196967 - DNA, 25 bp, Mus musculus
aggaaatccttacggcatttttctg

SEQ ID NO: 196968 - DNA, 25 bp, Mus musculus
aggaaatctatgatgattcttttat

SEQ ID NO: 196969 - DNA, 25 bp, Mus musculus
aggaaatctgaaaaaagacgagatg

SEQ ID NO: 196970 - DNA, 25 bp, Mus musculus
aggaaatctgataactgatttgaat

SEQ ID NO: 196971 - DNA, 25 bp, Mus musculus
aggaaatctgataagtcctttgcaa

SEQ ID NO: 196972 - DNA, 25 bp, Mus musculus
aggaaatctgatctccaagagggtt

SEQ ID NO: 196973 - DNA, 25 bp, Mus musculus
aggaaatctgccttaagaactgtcc

SEQ ID NO: 196974 - DNA, 25 bp, Mus musculus
aggaaatctgggtcttcggatcagt

SEQ ID NO: 196975 - DNA, 25 bp, Mus musculus
aggaaatctggtaaagacgagatgc

SEQ ID NO: 196976 - DNA, 25 bp, Mus musculus
aggaaatctgtattatgttccactc

SEQ ID NO: 196977 - DNA, 25 bp, Mus musculus
aggaaatcttgcatctgaaagctgg

SEQ ID NO: 196978 - DNA, 25 bp, Mus musculus
aggaaatcttgcatgacaacctgga

SEQ ID NO: 196979 - DNA, 25 bp, Mus musculus
aggaaatgaccgaggtgaaggcagc

SEQ ID NO: 196980 - DNA, 25 bp, Mus musculus
aggaaatgagcaaagccaaacacca

SEQ ID NO: 196981 - DNA, 25 bp, Mus musculus
aggaaatgagtccacagatgatttt

SEQ ID NO: 196982 - DNA, 25 bp, Mus musculus
aggaaatgcagaccagcagaacttc

SEQ ID NO: 196983 - DNA, 25 bp, Mus musculus
aggaaatgcaggttttccttactgc

SEQ ID NO: 196984 - DNA, 25 bp, Mus musculus
aggaaatgcgccagttgatgaaggt

SEQ ID NO: 196985 - DNA, 25 bp, Mus musculus
aggaaatggagcaggagccctgcct

SEQ ID NO: 196986 - DNA, 25 bp, Mus musculus
aggaaatggaggcaagaagacagca

SEQ ID NO: 196987 - DNA, 25 bp, Mus musculus
aggaaatgtttattggaaaaggaag

SEQ ID NO: 196988 - DNA, 25 bp, Mus musculus
aggaaatgtttgcatctggccatcc

SEQ ID NO: 196989 - DNA, 25 bp, Mus musculus
aggaaatgtttgtgacccccctcca

SEQ ID NO: 196990 - DNA, 25 bp, Mus musculus
aggaaattacacctgctcctgaggt

SEQ ID NO: 196991 - DNA, 25 bp, Mus musculus
aggaaattcagcctcaagtacctgg

SEQ ID NO: 196992 - DNA, 25 bp, Mus musculus
aggaaattcaggcgatgctgggcct

SEQ ID NO: 196993 - DNA, 25 bp, Mus musculus
aggaaattcatagtgaccatctttc

SEQ ID NO: 196994 - DNA, 25 bp, Mus musculus
aggaaattcgcagggctatgtgctc

SEQ ID NO: 196995 - DNA, 25 bp, Mus musculus
aggaaattgtgaaggccctgtctca

SEQ ID NO: 196996 - DNA, 25 bp, Mus musculus
aggaaattgtgaaggtttgtctggg

SEQ ID NO: 196997 - DNA, 25 bp, Mus musculus
aggaacaaaacagattaatagagac

SEQ ID NO: 196998 - DNA, 25 bp, Mus musculus
aggaacaaaacaggcattggcagag

SEQ ID NO: 196999 - DNA, 25 bp, Mus musculus
aggaacaaacattcaggccaaacag

SEQ ID NO: 197000 - DNA, 25 bp, Mus musculus
aggaacaaactggttattaaataga

SEQ ID NO: 197001 - DNA, 25 bp, Mus musculus
aggaacaaagacaggaaatctgcaa

SEQ ID NO: 197002 - DNA, 25 bp, Mus musculus
aggaacaaagagaacctgcacccac

SEQ ID NO: 197003 - DNA, 25 bp, Mus musculus
aggaacaaagagaagtgcagccccc

SEQ ID NO: 197004 - DNA, 25 bp, Mus musculus
aggaacaaagagaccccgaggcaag

SEQ ID NO: 197005 - DNA, 25 bp, Mus musculus
aggaacaaaggtcaggtgcccattt

SEQ ID NO: 197006 - DNA, 25 bp, Mus musculus
aggaacaaataagacggttagcaca

SEQ ID NO: 197007 - DNA, 25 bp, Mus musculus
aggaacaaataagcctggggaactc

SEQ ID NO: 197008 - DNA, 25 bp, Mus musculus
aggaacaaatggggagaaactcctt

SEQ ID NO: 197009 - DNA, 25 bp, Mus musculus
aggaacaaggacagggagatttgaa

SEQ ID NO: 197010 - DNA, 25 bp, Mus musculus
aggaacacaaaggtaagaaagcacg

SEQ ID NO: 197011 - DNA, 25 bp, Mus musculus
aggaacacacagtggggaggggagg

SEQ ID NO: 197012 - DNA, 25 bp, Mus musculus
aggaacacagagttcagaaagaaca

SEQ ID NO: 197013 - DNA, 25 bp, Mus musculus
aggaacacaggattgagctgacctc

SEQ ID NO: 197014 - DNA, 25 bp, Mus musculus
aggaacacatagcagataaacttct

SEQ ID NO: 197015 - DNA, 25 bp, Mus musculus
aggaacacctgctgacctctgtgtc

SEQ ID NO: 197016 - DNA, 25 bp, Mus musculus
aggaacacctttatctgaattatga

SEQ ID NO: 197017 - DNA, 25 bp, Mus musculus
aggaacacgggggcttcttcacatg

SEQ ID NO: 197018 - DNA, 25 bp, Mus musculus
aggaacactatccaggtcaggctgc

SEQ ID NO: 197019 - DNA, 25 bp, Mus musculus
aggaacactatccagtgggatctgc

SEQ ID NO: 197020 - DNA, 25 bp, Mus musculus
aggaacactgcttgggaaatcctca

SEQ ID NO: 197021 - DNA, 25 bp, Mus musculus
aggaacactgcttggttcgttccac

SEQ ID NO: 197022 - DNA, 25 bp, Mus musculus
aggaacactgcttggttggtgttaa

SEQ ID NO: 197023 - DNA, 25 bp, Mus musculus
aggaacagaacggagtgcaagatcc

SEQ ID NO: 197024 - DNA, 25 bp, Mus musculus
aggaacagaacgggaggaactatac

SEQ ID NO: 197025 - DNA, 25 bp, Mus musculus
aggaacagacacagctcacagactt

SEQ ID NO: 197026 - DNA, 25 bp, Mus musculus
aggaacagagaagctcccgtccgtg

SEQ ID NO: 197027 - DNA, 25 bp, Mus musculus
aggaacagagtgacttaaccactct

SEQ ID NO: 197028 - DNA, 25 bp, Mus musculus
aggaacagcaggcagttcctggcag

SEQ ID NO: 197029 - DNA, 25 bp, Mus musculus
aggaacagctgggccctgtctcaag

SEQ ID NO: 197030 - DNA, 25 bp, Mus musculus
aggaacataaacaaggcataatcaa

SEQ ID NO: 197031 - DNA, 25 bp, Mus musculus
aggaacataaacagtctgatgaaag

SEQ ID NO: 197032 - DNA, 25 bp, Mus musculus
aggaacatcgtgactttatatggag

SEQ ID NO: 197033 - DNA, 25 bp, Mus musculus
aggaacatcttggaacctaggtcct

SEQ ID NO: 197034 - DNA, 25 bp, Mus musculus
aggaacatgccggagttctctgggg

SEQ ID NO: 197035 - DNA, 25 bp, Mus musculus
aggaacatggggcagcaggagcaat

SEQ ID NO: 197036 - DNA, 25 bp, Mus musculus
aggaacatgggtgtagtgattttga

SEQ ID NO: 197037 - DNA, 25 bp, Mus musculus
aggaacatgtaacaggtccactgcc

SEQ ID NO: 197038 - DNA, 25 bp, Mus musculus
aggaacattgtaaattcaagatgga

SEQ ID NO: 197039 - DNA, 25 bp, Mus musculus
aggaacattttccctcctgtccttc

SEQ ID NO: 197040 - DNA, 25 bp, Mus musculus
aggaaccaaccaaagccagacccac

SEQ ID NO: 197041 - DNA, 25 bp, Mus musculus
aggaaccaagaagagtttgtccctg

SEQ ID NO: 197042 - DNA, 25 bp, Mus musculus
aggaaccaagaaggcctcaggtcca

SEQ ID NO: 197043 - DNA, 25 bp, Mus musculus
aggaaccaagaatgcttttgggtcg

SEQ ID NO: 197044 - DNA, 25 bp, Mus musculus
aggaaccaaggtagcttctccataa

SEQ ID NO: 197045 - DNA, 25 bp, Mus musculus
aggaaccaatgagacaccatgattc

SEQ ID NO: 197046 - DNA, 25 bp, Mus musculus
aggaaccaatggagccattccgtag

SEQ ID NO: 197047 - DNA, 25 bp, Mus musculus
aggaaccacagcgagggggcgctcc

SEQ ID NO: 197048 - DNA, 25 bp, Mus musculus
aggaaccactgaactggcattatgg

SEQ ID NO: 197049 - DNA, 25 bp, Mus musculus
aggaaccagtaattccacgatggct

SEQ ID NO: 197050 - DNA, 25 bp, Mus musculus
aggaaccatctggagaatgtgaggt

SEQ ID NO: 197051 - DNA, 25 bp, Mus musculus
aggaaccatgaaaagaagagatgag

SEQ ID NO: 197052 - DNA, 25 bp, Mus musculus
aggaaccatgaagaggaagttggtg

SEQ ID NO: 197053 - DNA, 25 bp, Mus musculus
aggaaccatggcacagcgatggcag

SEQ ID NO: 197054 - DNA, 25 bp, Mus musculus
aggaacccaagaatttattgccaag

SEQ ID NO: 197055 - DNA, 25 bp, Mus musculus
aggaacccacaggtgattcacatac

SEQ ID NO: 197056 - DNA, 25 bp, Mus musculus
aggaacccacagttacagatcaaca

SEQ ID NO: 197057 - DNA, 25 bp, Mus musculus
aggaacccaccagagagtgctgatc

SEQ ID NO: 197058 - DNA, 25 bp, Mus musculus
aggaacccaccagagcccgagacag

SEQ ID NO: 197059 - DNA, 25 bp, Mus musculus
aggaacccagattttgttcctggca

SEQ ID NO: 197060 - DNA, 25 bp, Mus musculus
aggaaccccggaagcacaaatacag

SEQ ID NO: 197061 - DNA, 25 bp, Mus musculus
aggaacccgtgaggtcaatatccaa

SEQ ID NO: 197062 - DNA, 25 bp, Mus musculus
aggaaccctgaaggatgatgactgg

SEQ ID NO: 197063 - DNA, 25 bp, Mus musculus
aggaaccctggggcatcccccgcag

SEQ ID NO: 197064 - DNA, 25 bp, Mus musculus
aggaaccgcaggctgttgccgcaca

SEQ ID NO: 197065 - DNA, 25 bp, Mus musculus
aggaaccgccaaagccgagggttga

SEQ ID NO: 197066 - DNA, 25 bp, Mus musculus
aggaaccgccaaaggctttctcctg

SEQ ID NO: 197067 - DNA, 25 bp, Mus musculus
aggaaccgcgtctcttgcaaaaccc

SEQ ID NO: 197068 - DNA, 25 bp, Mus musculus
aggaacctctccacgtgctttagct

SEQ ID NO: 197069 - DNA, 25 bp, Mus musculus
aggaacctggttggcaaagtgatcg

SEQ ID NO: 197070 - DNA, 25 bp, Mus musculus
aggaacctttcacgatgacagagat

SEQ ID NO: 197071 - DNA, 25 bp, Mus musculus
aggaacgaaataatttgaagaggac

SEQ ID NO: 197072 - DNA, 25 bp, Mus musculus
aggaacgaattttagatgcacagag

SEQ ID NO: 197073 - DNA, 25 bp, Mus musculus
aggaacgaattttgttaagagcagg

SEQ ID NO: 197074 - DNA, 25 bp, Mus musculus
aggaacgaccgtgctatgtttcagg

SEQ ID NO: 197075 - DNA, 25 bp, Mus musculus
aggaacgcagcaactgctgctgaga

SEQ ID NO: 197076 - DNA, 25 bp, Mus musculus
aggaacgcattcagccagaagacat

SEQ ID NO: 197077 - DNA, 25 bp, Mus musculus
aggaacggaatgacttgtgtgcaaa

SEQ ID NO: 197078 - DNA, 25 bp, Mus musculus
aggaacggagggcatggctgccagc

SEQ ID NO: 197079 - DNA, 25 bp, Mus musculus
aggaacggagttatggcattccttg

SEQ ID NO: 197080 - DNA, 25 bp, Mus musculus
aggaacgtcccggagcttggccaga

SEQ ID NO: 197081 - DNA, 25 bp, Mus musculus
aggaactacgagcgcgaggtagatc

SEQ ID NO: 197082 - DNA, 25 bp, Mus musculus
aggaactatccgcaaagaagatatc

SEQ ID NO: 197083 - DNA, 25 bp, Mus musculus
aggaactatcggctctttctacaca

SEQ ID NO: 197084 - DNA, 25 bp, Mus musculus
aggaactatcgtcttgaagaaccac

SEQ ID NO: 197085 - DNA, 25 bp, Mus musculus
aggaactcaaggaatgactattcca

SEQ ID NO: 197086 - DNA, 25 bp, Mus musculus
aggaactcaagggagctaagaagat

SEQ ID NO: 197087 - DNA, 25 bp, Mus musculus
aggaactcaagttgaccgccttgct

SEQ ID NO: 197088 - DNA, 25 bp, Mus musculus
aggaactcaggtggccactctagct

SEQ ID NO: 197089 - DNA, 25 bp, Mus musculus
aggaactcccaggctatgaagagac

SEQ ID NO: 197090 - DNA, 25 bp, Mus musculus
aggaactcgaggctcctggaggaat

SEQ ID NO: 197091 - DNA, 25 bp, Mus musculus
aggaactcgcggcggaagactgcta

SEQ ID NO: 197092 - DNA, 25 bp, Mus musculus
aggaactctgcgggaccttctgtca

SEQ ID NO: 197093 - DNA, 25 bp, Mus musculus
aggaactctggaagatgggtgtgtt

SEQ ID NO: 197094 - DNA, 25 bp, Mus musculus
aggaactctttgggcctgccttaag

SEQ ID NO: 197095 - DNA, 25 bp, Mus musculus
aggaactgaaagtgcctttgaagga

SEQ ID NO: 197096 - DNA, 25 bp, Mus musculus
aggaactgaagcgcctttcagtgga

SEQ ID NO: 197097 - DNA, 25 bp, Mus musculus
aggaactgaagcgttctgagaagaa

SEQ ID NO: 197098 - DNA, 25 bp, Mus musculus
aggaactgaaggagtctttgtctga

SEQ ID NO: 197099 - DNA, 25 bp, Mus musculus
aggaactgagaagacattttcactt

SEQ ID NO: 197100 - DNA, 25 bp, Mus musculus
aggaactgaggctccggagggtgta

SEQ ID NO: 197101 - DNA, 25 bp, Mus musculus
aggaactgattgacccttcccatgc

SEQ ID NO: 197102 - DNA, 25 bp, Mus musculus
aggaactgcaggacagtaatgatga

SEQ ID NO: 197103 - DNA, 25 bp, Mus musculus
aggaactgcaggcagggaggtgtga

SEQ ID NO: 197104 - DNA, 25 bp, Mus musculus
aggaactgcaggggaagcacaggct

SEQ ID NO: 197105 - DNA, 25 bp, Mus musculus
aggaactgcaggttgacgtgattgt

SEQ ID NO: 197106 - DNA, 25 bp, Mus musculus
aggaactgcctaaggagcctcaagg

SEQ ID NO: 197107 - DNA, 25 bp, Mus musculus
aggaactggacaaggccctgtgtgc

SEQ ID NO: 197108 - DNA, 25 bp, Mus musculus
aggaactggcggtcttctgttcccc

SEQ ID NO: 197109 - DNA, 25 bp, Mus musculus
aggaactgggaaagggagccttctc

SEQ ID NO: 197110 - DNA, 25 bp, Mus musculus
aggaactgggcagaatgaacacgaa

SEQ ID NO: 197111 - DNA, 25 bp, Mus musculus
aggaactgggcagagaagaatatca

SEQ ID NO: 197112 - DNA, 25 bp, Mus musculus
aggaactgggtcaaggacacggcaa

SEQ ID NO: 197113 - DNA, 25 bp, Mus musculus
aggaactgggtcaagtcaccctgtg

SEQ ID NO: 197114 - DNA, 25 bp, Mus musculus
aggaactgtcaggctggtctgctca

SEQ ID NO: 197115 - DNA, 25 bp, Mus musculus
aggaactgtggaggcagctgtgtct

SEQ ID NO: 197116 - DNA, 25 bp, Mus musculus
aggaacttaaaaaggagcttcgacg

SEQ ID NO: 197117 - DNA, 25 bp, Mus musculus
aggaacttaaaaaggtgattgaagc

SEQ ID NO: 197118 - DNA, 25 bp, Mus musculus
aggaacttaaaaaggtgtcctcaga

SEQ ID NO: 197119 - DNA, 25 bp, Mus musculus
aggaacttaaggtgagggtggaact

SEQ ID NO: 197120 - DNA, 25 bp, Mus musculus
aggaacttatccagtgaagaagttg

SEQ ID NO: 197121 - DNA, 25 bp, Mus musculus
aggaacttcagtttgaaaatgaaaa

SEQ ID NO: 197122 - DNA, 25 bp, Mus musculus
aggaacttggagggccatggcggac

SEQ ID NO: 197123 - DNA, 25 bp, Mus musculus
aggaactttgacaagatcctggctg

SEQ ID NO: 197124 - DNA, 25 bp, Mus musculus
aggaacttttcagctgccaaaagcc

SEQ ID NO: 197125 - DNA, 25 bp, Mus musculus
aggaacttttcagttggcaggcaga

SEQ ID NO: 197126 - DNA, 25 bp, Mus musculus
aggaacttttttgtaagaagacaag

SEQ ID NO: 197127 - DNA, 25 bp, Mus musculus
aggaagaaaaaccagaaccagatgg

SEQ ID NO: 197128 - DNA, 25 bp, Mus musculus
aggaagaaaaaccagaagaacagga

SEQ ID NO: 197129 - DNA, 25 bp, Mus musculus
aggaagaaaagcactgcccctcgaa

SEQ ID NO: 197130 - DNA, 25 bp, Mus musculus
aggaagaaaagtggccctgtctccg

SEQ ID NO: 197131 - DNA, 25 bp, Mus musculus
aggaagaaagcaaggaaggaaggtc

SEQ ID NO: 197132 - DNA, 25 bp, Mus musculus
aggaagaaaggaaaatcagaggctc

SEQ ID NO: 197133 - DNA, 25 bp, Mus musculus
aggaagaaaggtcaggatcgcagcg

SEQ ID NO: 197134 - DNA, 25 bp, Mus musculus
aggaagaacaaaaatgcaagctggg

SEQ ID NO: 197135 - DNA, 25 bp, Mus musculus
aggaagaacctgcaggatagaaaga

SEQ ID NO: 197136 - DNA, 25 bp, Mus musculus
aggaagaacctgcagtaccatccca

SEQ ID NO: 197137 - DNA, 25 bp, Mus musculus
aggaagaacgcggagggagctatgg

SEQ ID NO: 197138 - DNA, 25 bp, Mus musculus
aggaagaactaggctcctacgcgcg

SEQ ID NO: 197139 - DNA, 25 bp, Mus musculus
aggaagaactgactcagatttcatt

SEQ ID NO: 197140 - DNA, 25 bp, Mus musculus
aggaagaagaagaggcttctgtgtc

SEQ ID NO: 197141 - DNA, 25 bp, Mus musculus
aggaagaagacagatgagcttcccc

SEQ ID NO: 197142 - DNA, 25 bp, Mus musculus
aggaagaagacaggacaggaagctc

SEQ ID NO: 197143 - DNA, 25 bp, Mus musculus
aggaagaagacagttcaaaagaccc

SEQ ID NO: 197144 - DNA, 25 bp, Mus musculus
aggaagaagagaatggaccgggttc

SEQ ID NO: 197145 - DNA, 25 bp, Mus musculus
aggaagaagagtcaagcgaaggcag

SEQ ID NO: 197146 - DNA, 25 bp, Mus musculus
aggaagaagcacagagagagattaa

SEQ ID NO: 197147 - DNA, 25 bp, Mus musculus
aggaagaagcaggtgattaaagttt

SEQ ID NO: 197148 - DNA, 25 bp, Mus musculus
aggaagaagccaagtcccatggcct

SEQ ID NO: 197149 - DNA, 25 bp, Mus musculus
aggaagaagccaagttggcgagagg

SEQ ID NO: 197150 - DNA, 25 bp, Mus musculus
aggaagaaggagaaagcaagctgtt

SEQ ID NO: 197151 - DNA, 25 bp, Mus musculus
aggaagaaggagagctcactactat

SEQ ID NO: 197152 - DNA, 25 bp, Mus musculus
aggaagaaggaggttccattttggg

SEQ ID NO: 197153 - DNA, 25 bp, Mus musculus
aggaagaagttcaagattgatgacc

SEQ ID NO: 197154 - DNA, 25 bp, Mus musculus
aggaagaatgtggcaaaaaaacatt

SEQ ID NO: 197155 - DNA, 25 bp, Mus musculus
aggaagaatgtggcgctttggagtc

SEQ ID NO: 197156 - DNA, 25 bp, Mus musculus
aggaagacagaacctctggtttgcc

SEQ ID NO: 197157 - DNA, 25 bp, Mus musculus
aggaagacaggagtctgcggtgttg

SEQ ID NO: 197158 - DNA, 25 bp, Mus musculus
aggaagacagggttccagtgatctg

SEQ ID NO: 197159 - DNA, 25 bp, Mus musculus
aggaagacagtgatgaggatgaaga

SEQ ID NO: 197160 - DNA, 25 bp, Mus musculus
aggaagacattcacgattgttggtg

SEQ ID NO: 197161 - DNA, 25 bp, Mus musculus
aggaagacgcctatgcaggagcatc

SEQ ID NO: 197162 - DNA, 25 bp, Mus musculus
aggaagacgcctatggctcagagga

SEQ ID NO: 197163 - DNA, 25 bp, Mus musculus
aggaagactgaaccagctctccagg

SEQ ID NO: 197164 - DNA, 25 bp, Mus musculus
aggaagactggtgggaacacaggct

SEQ ID NO: 197165 - DNA, 25 bp, Mus musculus
aggaagacttcaagaggacgctggt

SEQ ID NO: 197166 - DNA, 25 bp, Mus musculus
aggaagagaaagggcggtctggtcg

SEQ ID NO: 197167 - DNA, 25 bp, Mus musculus
aggaagagaaggctgaggcagacaa

SEQ ID NO: 197168 - DNA, 25 bp, Mus musculus
aggaagagaaggcttcagatgctag

SEQ ID NO: 197169 - DNA, 25 bp, Mus musculus
aggaagagacttcacagctcaggcg

SEQ ID NO: 197170 - DNA, 25 bp, Mus musculus
aggaagagagacgggtccagtgaag

SEQ ID NO: 197171 - DNA, 25 bp, Mus musculus
aggaagagcaaagaaatctgcaggt

SEQ ID NO: 197172 - DNA, 25 bp, Mus musculus
aggaagagcaacatgaccatgtgga

SEQ ID NO: 197173 - DNA, 25 bp, Mus musculus
aggaagagcaatgtggactttgtga

SEQ ID NO: 197174 - DNA, 25 bp, Mus musculus
aggaagagcagcagagtggtaggat

SEQ ID NO: 197175 - DNA, 25 bp, Mus musculus
aggaagagcagcagatcagacctac

SEQ ID NO: 197176 - DNA, 25 bp, Mus musculus
aggaagagccggaatcggtgggacc

SEQ ID NO: 197177 - DNA, 25 bp, Mus musculus
aggaagagctggattttgccatgcc

SEQ ID NO: 197178 - DNA, 25 bp, Mus musculus
aggaagagctgggctctcccgcaat

SEQ ID NO: 197179 - DNA, 25 bp, Mus musculus
aggaagaggaaagagatgagccgcc

SEQ ID NO: 197180 - DNA, 25 bp, Mus musculus
aggaagaggaacacgcagcactgtc

SEQ ID NO: 197181 - DNA, 25 bp, Mus musculus
aggaagaggaacaggatctcatcat

SEQ ID NO: 197182 - DNA, 25 bp, Mus musculus
aggaagaggaagaggatacagtcat

SEQ ID NO: 197183 - DNA, 25 bp, Mus musculus
aggaagaggagaaagaggacagagc

SEQ ID NO: 197184 - DNA, 25 bp, Mus musculus
aggaagaggaggaggaggctccgcc

SEQ ID NO: 197185 - DNA, 25 bp, Mus musculus
aggaagaggagttggaaaatcttca

SEQ ID NO: 197186 - DNA, 25 bp, Mus musculus
aggaagaggtggcaacgagtctcca

SEQ ID NO: 197187 - DNA, 25 bp, Mus musculus
aggaagagtacacagctccttccat

SEQ ID NO: 197188 - DNA, 25 bp, Mus musculus
aggaagagtacacaggtgtgtgcca

SEQ ID NO: 197189 - DNA, 25 bp, Mus musculus
aggaagatctaagtacaccaaatga

SEQ ID NO: 197190 - DNA, 25 bp, Mus musculus
aggaagatgacagcctgtttgagct

SEQ ID NO: 197191 - DNA, 25 bp, Mus musculus
aggaagatgaccgttcacctgcaga

SEQ ID NO: 197192 - DNA, 25 bp, Mus musculus
aggaagatgatgagtctgatgacag

SEQ ID NO: 197193 - DNA, 25 bp, Mus musculus
aggaagatgcccaggaaatagcaga

SEQ ID NO: 197194 - DNA, 25 bp, Mus musculus
aggaagatgcccaggtggctgctga

SEQ ID NO: 197195 - DNA, 25 bp, Mus musculus
aggaagatggaggttccattttggg

SEQ ID NO: 197196 - DNA, 25 bp, Mus musculus
aggaagattgatgtcggcagctctg

SEQ ID NO: 197197 - DNA, 25 bp, Mus musculus
aggaagatttccgaactgaaagaca

SEQ ID NO: 197198 - DNA, 25 bp, Mus musculus
aggaagcaagatttcctttcctgga

SEQ ID NO: 197199 - DNA, 25 bp, Mus musculus
aggaagcacagaccagaagcccctg

SEQ ID NO: 197200 - DNA, 25 bp, Mus musculus
aggaagcacagctctggatgggtcc

SEQ ID NO: 197201 - DNA, 25 bp, Mus musculus
aggaagcacctgccattgtggctgg

SEQ ID NO: 197202 - DNA, 25 bp, Mus musculus
aggaagcacgggggtaccattccca

SEQ ID NO: 197203 - DNA, 25 bp, Mus musculus
aggaagcacgggtggctgcaagaag

SEQ ID NO: 197204 - DNA, 25 bp, Mus musculus
aggaagcactggaggaggcagatga

SEQ ID NO: 197205 - DNA, 25 bp, Mus musculus
aggaagcactggcaaggggaccagg

SEQ ID NO: 197206 - DNA, 25 bp, Mus musculus
aggaagcagaagatgccatactcca

SEQ ID NO: 197207 - DNA, 25 bp, Mus musculus
aggaagcagaatcgtatcgaattaa

SEQ ID NO: 197208 - DNA, 25 bp, Mus musculus
aggaagcagaatcgttttggatccc

SEQ ID NO: 197209 - DNA, 25 bp, Mus musculus
aggaagcagagaggagaaaaggagg

SEQ ID NO: 197210 - DNA, 25 bp, Mus musculus
aggaagcagagatgcccggaaccgc

SEQ ID NO: 197211 - DNA, 25 bp, Mus musculus
aggaagcagagggctgagcccccgc

SEQ ID NO: 197212 - DNA, 25 bp, Mus musculus
aggaagcagctggaggtggtcaagc

SEQ ID NO: 197213 - DNA, 25 bp, Mus musculus
aggaagcagctggagttgaactttc

SEQ ID NO: 197214 - DNA, 25 bp, Mus musculus
aggaagcattctgggggtcaaccgg

SEQ ID NO: 197215 - DNA, 25 bp, Mus musculus
aggaagccaaaaagaagaagcactt

SEQ ID NO: 197216 - DNA, 25 bp, Mus musculus
aggaagccaaaaagagcaagaagcg

SEQ ID NO: 197217 - DNA, 25 bp, Mus musculus
aggaagccaagaagaagctggctca

SEQ ID NO: 197218 - DNA, 25 bp, Mus musculus
aggaagccaagatttctcagctgat

SEQ ID NO: 197219 - DNA, 25 bp, Mus musculus
aggaagccagatatctcacagacaa

SEQ ID NO: 197220 - DNA, 25 bp, Mus musculus
aggaagccagcgagtcatcctccac

SEQ ID NO: 197221 - DNA, 25 bp, Mus musculus
aggaagccaggtctttggccagtat

SEQ ID NO: 197222 - DNA, 25 bp, Mus musculus
aggaagccagtgacgccaagagact

SEQ ID NO: 197223 - DNA, 25 bp, Mus musculus
aggaagcccagcaggaggagactgc

SEQ ID NO: 197224 - DNA, 25 bp, Mus musculus
aggaagcccagcagggcagccaatg

SEQ ID NO: 197225 - DNA, 25 bp, Mus musculus
aggaagcccccaagttcctggcctt

SEQ ID NO: 197226 - DNA, 25 bp, Mus musculus
aggaagccctgaggtcacttggtcg

SEQ ID NO: 197227 - DNA, 25 bp, Mus musculus
aggaagccctgaggtgtggttccca

SEQ ID NO: 197228 - DNA, 25 bp, Mus musculus
aggaagccctggaggcactggttcc

SEQ ID NO: 197229 - DNA, 25 bp, Mus musculus
aggaagcctaaggatgatgctgttg

SEQ ID NO: 197230 - DNA, 25 bp, Mus musculus
aggaagcctgtgcccagtatagtgg

SEQ ID NO: 197231 - DNA, 25 bp, Mus musculus
aggaagcgagaagagaaaaggaaca

SEQ ID NO: 197232 - DNA, 25 bp, Mus musculus
aggaagcgccacacccccagaggaa

SEQ ID NO: 197233 - DNA, 25 bp, Mus musculus
aggaagctaagctgtggtcctctaa

SEQ ID NO: 197234 - DNA, 25 bp, Mus musculus
aggaagctactgggccgcgttggcc

SEQ ID NO: 197235 - DNA, 25 bp, Mus musculus
aggaagctcagatgctgcagttcgt

SEQ ID NO: 197236 - DNA, 25 bp, Mus musculus
aggaagctgctgggcaccaagccaa

SEQ ID NO: 197237 - DNA, 25 bp, Mus musculus
aggaagcttcagattataccgaaaa

SEQ ID NO: 197238 - DNA, 25 bp, Mus musculus
aggaagcttcagcgacagcagtctc

SEQ ID NO: 197239 - DNA, 25 bp, Mus musculus
aggaagcttcaggctatgtctttca

SEQ ID NO: 197240 - DNA, 25 bp, Mus musculus
aggaagctttgcagatctgaacgat

SEQ ID NO: 197241 - DNA, 25 bp, Mus musculus
aggaagcttttagtacagagtcttg

SEQ ID NO: 197242 - DNA, 25 bp, Mus musculus
aggaagcttttagtgccaaagcctc

SEQ ID NO: 197243 - DNA, 25 bp, Mus musculus
aggaagcttttagtgttgtaggaag

SEQ ID NO: 197244 - DNA, 25 bp, Mus musculus
aggaaggaaaagaggccttggaaga

SEQ ID NO: 197245 - DNA, 25 bp, Mus musculus
aggaaggaagaggtttatgggactg

SEQ ID NO: 197246 - DNA, 25 bp, Mus musculus
aggaaggaatggtgagccttcccgg

SEQ ID NO: 197247 - DNA, 25 bp, Mus musculus
aggaaggagaccggggaatcaagga

SEQ ID NO: 197248 - DNA, 25 bp, Mus musculus
aggaaggagtccatggcaacgggca

SEQ ID NO: 197249 - DNA, 25 bp, Mus musculus
aggaaggcaaattcgtgattactgg

SEQ ID NO: 197250 - DNA, 25 bp, Mus musculus
aggaaggcaagaagagacttgaggc

SEQ ID NO: 197251 - DNA, 25 bp, Mus musculus
aggaaggcaaggccaagaacgccct

SEQ ID NO: 197252 - DNA, 25 bp, Mus musculus
aggaaggcaggaaagaagaggttac

SEQ ID NO: 197253 - DNA, 25 bp, Mus musculus
aggaaggcctgtgagtgctgccgac

SEQ ID NO: 197254 - DNA, 25 bp, Mus musculus
aggaaggcgaagatgagcgttcggc

SEQ ID NO: 197255 - DNA, 25 bp, Mus musculus
aggaaggctcatagacagggtttct

SEQ ID NO: 197256 - DNA, 25 bp, Mus musculus
aggaaggctcataggccaaactcaa

SEQ ID NO: 197257 - DNA, 25 bp, Mus musculus
aggaaggctttccagccatggccat

SEQ ID NO: 197258 - DNA, 25 bp, Mus musculus
aggaaggctttccagctccagcacc

SEQ ID NO: 197259 - DNA, 25 bp, Mus musculus
aggaagggaagttcttccatcagtg

SEQ ID NO: 197260 - DNA, 25 bp, Mus musculus
aggaagggactatattgatcagtgg

SEQ ID NO: 197261 - DNA, 25 bp, Mus musculus
aggaagggaggtgcatggagactca

SEQ ID NO: 197262 - DNA, 25 bp, Mus musculus
aggaaggggaaggtgatctgagcat

SEQ ID NO: 197263 - DNA, 25 bp, Mus musculus
aggaaggtggagaagctcaaggcaa

SEQ ID NO: 197264 - DNA, 25 bp, Mus musculus
aggaagtaacagacctgaccaaagt

SEQ ID NO: 197265 - DNA, 25 bp, Mus musculus
aggaagtaacagactttgcatgaag

SEQ ID NO: 197266 - DNA, 25 bp, Mus musculus
aggaagtagagccgccatgactacc

SEQ ID NO: 197267 - DNA, 25 bp, Mus musculus
aggaagtagctaaaacattctcata

SEQ ID NO: 197268 - DNA, 25 bp, Mus musculus
aggaagtataactcagggaatggga

SEQ ID NO: 197269 - DNA, 25 bp, Mus musculus
aggaagtatattacaggattcacta

SEQ ID NO: 197270 - DNA, 25 bp, Mus musculus
aggaagtatgaagaggtggctcgta

SEQ ID NO: 197271 - DNA, 25 bp, Mus musculus
aggaagtatgacccacagggctctc

SEQ ID NO: 197272 - DNA, 25 bp, Mus musculus
aggaagtcaaaaggatcgtcagtgg

SEQ ID NO: 197273 - DNA, 25 bp, Mus musculus
aggaagtcagctagcagccacatag

SEQ ID NO: 197274 - DNA, 25 bp, Mus musculus
aggaagtcagtgaaaaaaaattcaa

SEQ ID NO: 197275 - DNA, 25 bp, Mus musculus
aggaagtcagtgaaaaaattgtaca

SEQ ID NO: 197276 - DNA, 25 bp, Mus musculus
aggaagtccaagaagaggagaaacc

SEQ ID NO: 197277 - DNA, 25 bp, Mus musculus
aggaagtccaagaagatgctgtcgc

SEQ ID NO: 197278 - DNA, 25 bp, Mus musculus
aggaagtccgagaaggaaaagtggt

SEQ ID NO: 197279 - DNA, 25 bp, Mus musculus
aggaagtccgagaaggcctgtgtgg

SEQ ID NO: 197280 - DNA, 25 bp, Mus musculus
aggaagtccggcagtaggacagtcc

SEQ ID NO: 197281 - DNA, 25 bp, Mus musculus
aggaagtcggtgtgttatctctgat

SEQ ID NO: 197282 - DNA, 25 bp, Mus musculus
aggaagtctgcactggaaccacctg

SEQ ID NO: 197283 - DNA, 25 bp, Mus musculus
aggaagtctgcagtgccggtgcccc

SEQ ID NO: 197284 - DNA, 25 bp, Mus musculus
aggaagtgaagggggaggtgaccat

SEQ ID NO: 197285 - DNA, 25 bp, Mus musculus
aggaagtgaagtgttgaagaaagtc

SEQ ID NO: 197286 - DNA, 25 bp, Mus musculus
aggaagtgaggtggaagaaaagtgt

SEQ ID NO: 197287 - DNA, 25 bp, Mus musculus
aggaagtgcataggaggagcttcct

SEQ ID NO: 197288 - DNA, 25 bp, Mus musculus
aggaagtgcataggagtggctgcta

SEQ ID NO: 197289 - DNA, 25 bp, Mus musculus
aggaagtgccagcatcacaacgaat

SEQ ID NO: 197290 - DNA, 25 bp, Mus musculus
aggaagtgccaggatcacaacgaat

SEQ ID NO: 197291 - DNA, 25 bp, Mus musculus
aggaagtgctccaaggatcgtggag

SEQ ID NO: 197292 - DNA, 25 bp, Mus musculus
aggaagtgctggaaagcacagaact

SEQ ID NO: 197293 - DNA, 25 bp, Mus musculus
aggaagtgctggttcctacagcacc

SEQ ID NO: 197294 - DNA, 25 bp, Mus musculus
aggaagtggaaagcgtgactccaga

SEQ ID NO: 197295 - DNA, 25 bp, Mus musculus
aggaagtggaggcagagttcctcag

SEQ ID NO: 197296 - DNA, 25 bp, Mus musculus
aggaagtggagggactgaacttttg

SEQ ID NO: 197297 - DNA, 25 bp, Mus musculus
aggaagtggaggtggaggaatgtgt

SEQ ID NO: 197298 - DNA, 25 bp, Mus musculus
aggaagtgggctgcggtatcagcct

SEQ ID NO: 197299 - DNA, 25 bp, Mus musculus
aggaagtggtataggatcttgaaac

SEQ ID NO: 197300 - DNA, 25 bp, Mus musculus
aggaagtgtactggataagaacaag

SEQ ID NO: 197301 - DNA, 25 bp, Mus musculus
aggaagtgtctatggacgaccataa

SEQ ID NO: 197302 - DNA, 25 bp, Mus musculus
aggaagtgtgtggacatcaatgagt

SEQ ID NO: 197303 - DNA, 25 bp, Mus musculus
aggaagttacaatccaagtaaacgc

SEQ ID NO: 197304 - DNA, 25 bp, Mus musculus
aggaagttcacaagataaccaacaa

SEQ ID NO: 197305 - DNA, 25 bp, Mus musculus
aggaagttcacaaggaatgtatcat

SEQ ID NO: 197306 - DNA, 25 bp, Mus musculus
aggaagttccgattaatggaacggc

SEQ ID NO: 197307 - DNA, 25 bp, Mus musculus
aggaagttcgtggaagggtggctgg

SEQ ID NO: 197308 - DNA, 25 bp, Mus musculus
aggaagttctacaggcacatcatct

SEQ ID NO: 197309 - DNA, 25 bp, Mus musculus
aggaagttgagaatgaaaagtcccc

SEQ ID NO: 197310 - DNA, 25 bp, Mus musculus
aggaagttgagaatttcaggaattg

SEQ ID NO: 197311 - DNA, 25 bp, Mus musculus
aggaagttgaggtttaatagtcttg

SEQ ID NO: 197312 - DNA, 25 bp, Mus musculus
aggaagttggttgggtgaatttcat

SEQ ID NO: 197313 - DNA, 25 bp, Mus musculus
aggaagttgttggagacaaagctgg

SEQ ID NO: 197314 - DNA, 25 bp, Mus musculus
aggaagtttgtgaatgattcccatc

SEQ ID NO: 197315 - DNA, 25 bp, Mus musculus
aggaataaagaaaggtgaccagaat

SEQ ID NO: 197316 - DNA, 25 bp, Mus musculus
aggaataagaccagatcatctttag

SEQ ID NO: 197317 - DNA, 25 bp, Mus musculus
aggaataagatgaggtcctccacct

SEQ ID NO: 197318 - DNA, 25 bp, Mus musculus
aggaataataaaaagtgctctatgc

SEQ ID NO: 197319 - DNA, 25 bp, Mus musculus
aggaatacaacttctcgccgaggga

SEQ ID NO: 197320 - DNA, 25 bp, Mus musculus
aggaatacaagagaggactagaagg

SEQ ID NO: 197321 - DNA, 25 bp, Mus musculus
aggaatacaagttgactgcattcag

SEQ ID NO: 197322 - DNA, 25 bp, Mus musculus
aggaatacagagaccgtctcgacaa

SEQ ID NO: 197323 - DNA, 25 bp, Mus musculus
aggaatacaggattttggttccaga

SEQ ID NO: 197324 - DNA, 25 bp, Mus musculus
aggaataccaggaaaatagtgatgt

SEQ ID NO: 197325 - DNA, 25 bp, Mus musculus
aggaataccaggaaatgataatgca

SEQ ID NO: 197326 - DNA, 25 bp, Mus musculus
aggaatacctagcaggtcctcatgg

SEQ ID NO: 197327 - DNA, 25 bp, Mus musculus
aggaatacgagaaagccctgcagga

SEQ ID NO: 197328 - DNA, 25 bp, Mus musculus
aggaatactgtttggcatggctgcc

SEQ ID NO: 197329 - DNA, 25 bp, Mus musculus
aggaataggcgaggacgcggacctc

SEQ ID NO: 197330 - DNA, 25 bp, Mus musculus
aggaatagtgtgataattggccttt

SEQ ID NO: 197331 - DNA, 25 bp, Mus musculus
aggaatagtgtgtgcagcttatgat

SEQ ID NO: 197332 - DNA, 25 bp, Mus musculus
aggaatatacagctggcagggaagc

SEQ ID NO: 197333 - DNA, 25 bp, Mus musculus
aggaatatgtagatttgggtatccg

SEQ ID NO: 197334 - DNA, 25 bp, Mus musculus
aggaatcaagttactggacagtgac

SEQ ID NO: 197335 - DNA, 25 bp, Mus musculus
aggaatcagtggcaacagtaccatt

SEQ ID NO: 197336 - DNA, 25 bp, Mus musculus
aggaatccaacctcagtgcagaaga

SEQ ID NO: 197337 - DNA, 25 bp, Mus musculus
aggaatccccatgatgaatcagcag

SEQ ID NO: 197338 - DNA, 25 bp, Mus musculus
aggaatcctgaggctccagccaggc

SEQ ID NO: 197339 - DNA, 25 bp, Mus musculus
aggaatcctttttgtgttcttggga

SEQ ID NO: 197340 - DNA, 25 bp, Mus musculus
aggaatcgcgcgcgggggtgttccc

SEQ ID NO: 197341 - DNA, 25 bp, Mus musculus
aggaatcggaaccagttccctcagc

SEQ ID NO: 197342 - DNA, 25 bp, Mus musculus
aggaatctaagaaggctacaaggtg

SEQ ID NO: 197343 - DNA, 25 bp, Mus musculus
aggaatgaaagatttatgataaatc

SEQ ID NO: 197344 - DNA, 25 bp, Mus musculus
aggaatgaaaggtttcaacagctcc

SEQ ID NO: 197345 - DNA, 25 bp, Mus musculus
aggaatgaagaacggcccctccggc

SEQ ID NO: 197346 - DNA, 25 bp, Mus musculus
aggaatgaagatggccagctgaggc

SEQ ID NO: 197347 - DNA, 25 bp, Mus musculus
aggaatgaatgcgggctttgaagac

SEQ ID NO: 197348 - DNA, 25 bp, Mus musculus
aggaatgaggctgctgcagagccta

SEQ ID NO: 197349 - DNA, 25 bp, Mus musculus
aggaatgcccgaaggagccgggtca

SEQ ID NO: 197350 - DNA, 25 bp, Mus musculus
aggaatgcccgaaggtagagaaacc

SEQ ID NO: 197351 - DNA, 25 bp, Mus musculus
aggaatgctcgccaaaacaacttca

SEQ ID NO: 197352 - DNA, 25 bp, Mus musculus
aggaatgctctctttggggtgttca

SEQ ID NO: 197353 - DNA, 25 bp, Mus musculus
aggaatgctgatcaaccattgcaga

SEQ ID NO: 197354 - DNA, 25 bp, Mus musculus
aggaatgctgatcaagcaccacaca

SEQ ID NO: 197355 - DNA, 25 bp, Mus musculus
aggaatgcttgggaattgaatccag

SEQ ID NO: 197356 - DNA, 25 bp, Mus musculus
aggaatgcttgggagagttaacctt

SEQ ID NO: 197357 - DNA, 25 bp, Mus musculus
aggaatggagaacatcccaacccag

SEQ ID NO: 197358 - DNA, 25 bp, Mus musculus
aggaatggaggtggacattgcatca

SEQ ID NO: 197359 - DNA, 25 bp, Mus musculus
aggaatgggaaaagtacgagatgag

SEQ ID NO: 197360 - DNA, 25 bp, Mus musculus
aggaatgggagaatgaagggggaga

SEQ ID NO: 197361 - DNA, 25 bp, Mus musculus
aggaatgggagacgtacgcagcagt

SEQ ID NO: 197362 - DNA, 25 bp, Mus musculus
aggaatgggagctgatgttcaggta

SEQ ID NO: 197363 - DNA, 25 bp, Mus musculus
aggaatgggagctggtaaatgatga

SEQ ID NO: 197364 - DNA, 25 bp, Mus musculus
aggaatggtcatgatggtaccagga

SEQ ID NO: 197365 - DNA, 25 bp, Mus musculus
aggaatgtctcctgaacttcgaggc

SEQ ID NO: 197366 - DNA, 25 bp, Mus musculus
aggaatgtctcctgtctgtggtgca

SEQ ID NO: 197367 - DNA, 25 bp, Mus musculus
aggaatgtgtgttggcgctaccctg

SEQ ID NO: 197368 - DNA, 25 bp, Mus musculus
aggaatgtttcacagatagaagctt

SEQ ID NO: 197369 - DNA, 25 bp, Mus musculus
aggaatgtttcacagttcttccaga

SEQ ID NO: 197370 - DNA, 25 bp, Mus musculus
aggaattaagcaagatgagaagcca

SEQ ID NO: 197371 - DNA, 25 bp, Mus musculus
aggaattaagcaaggctgtggactt

SEQ ID NO: 197372 - DNA, 25 bp, Mus musculus
aggaattacagccgaagaagcaggc

SEQ ID NO: 197373 - DNA, 25 bp, Mus musculus
aggaattcaaaagaattactcagaa

SEQ ID NO: 197374 - DNA, 25 bp, Mus musculus
aggaattcaagatggtcaaataaaa

SEQ ID NO: 197375 - DNA, 25 bp, Mus musculus
aggaattcagcaccccatgaacaat

SEQ ID NO: 197376 - DNA, 25 bp, Mus musculus
aggaattcaggaaatattttcaaga

SEQ ID NO: 197377 - DNA, 25 bp, Mus musculus
aggaattctccaagaatgggaaatg

SEQ ID NO: 197378 - DNA, 25 bp, Mus musculus
aggaattggtcctcatctctccagg

SEQ ID NO: 197379 - DNA, 25 bp, Mus musculus
aggaattgtagagaatttcttgctg

SEQ ID NO: 197380 - DNA, 25 bp, Mus musculus
aggaattgtagagttgctcacagac

SEQ ID NO: 197381 - DNA, 25 bp, Mus musculus
aggaattgtagagttggctcacgtc

SEQ ID NO: 197382 - DNA, 25 bp, Mus musculus
aggaatttctaaagaagttggcatc

SEQ ID NO: 197383 - DNA, 25 bp, Mus musculus
aggaattttatgctcgacgccaatg

SEQ ID NO: 197384 - DNA, 25 bp, Mus musculus
aggacaaaaacacagagcttaccat

SEQ ID NO: 197385 - DNA, 25 bp, Mus musculus
aggacaaaaacacagggggaagagg

SEQ ID NO: 197386 - DNA, 25 bp, Mus musculus
aggacaaaacaggaatggaagccct

SEQ ID NO: 197387 - DNA, 25 bp, Mus musculus
aggacaaaacagtgaccaagaagaa

SEQ ID NO: 197388 - DNA, 25 bp, Mus musculus
aggacaaaaccaaggatgtggagta

SEQ ID NO: 197389 - DNA, 25 bp, Mus musculus
aggacaaaatggcagtggcagccca

SEQ ID NO: 197390 - DNA, 25 bp, Mus musculus
aggacaaaccaaggctcatctgcgg

SEQ ID NO: 197391 - DNA, 25 bp, Mus musculus
aggacaaagaccaaggattactgca

SEQ ID NO: 197392 - DNA, 25 bp, Mus musculus
aggacaaagagaaagccagtgagac

SEQ ID NO: 197393 - DNA, 25 bp, Mus musculus
aggacaaagagaatgatggatatat

SEQ ID NO: 197394 - DNA, 25 bp, Mus musculus
aggacaaagagactgcatcgacgta

SEQ ID NO: 197395 - DNA, 25 bp, Mus musculus
aggacaaagagcatctaaagaaaaa

SEQ ID NO: 197396 - DNA, 25 bp, Mus musculus
aggacaaagcagaaaatggatcgaa

SEQ ID NO: 197397 - DNA, 25 bp, Mus musculus
aggacaaagcagacgttgattccga

SEQ ID NO: 197398 - DNA, 25 bp, Mus musculus
aggacaaatgtaaggcaaatgacca

SEQ ID NO: 197399 - DNA, 25 bp, Mus musculus
aggacaacagtccagattccttctg

SEQ ID NO: 197400 - DNA, 25 bp, Mus musculus
aggacaacatcaaggtgtctttgga

SEQ ID NO: 197401 - DNA, 25 bp, Mus musculus
aggacaaccacagcgacccatacgt

SEQ ID NO: 197402 - DNA, 25 bp, Mus musculus
aggacaaccacgagatgtctgcagt

SEQ ID NO: 197403 - DNA, 25 bp, Mus musculus
aggacaaccacgtcattcacccatc

SEQ ID NO: 197404 - DNA, 25 bp, Mus musculus
aggacaagaacttagtgatgtggag

SEQ ID NO: 197405 - DNA, 25 bp, Mus musculus
aggacaagaagaaagccggtggctg

SEQ ID NO: 197406 - DNA, 25 bp, Mus musculus
aggacaagaagaattaaagcacgca

SEQ ID NO: 197407 - DNA, 25 bp, Mus musculus
aggacaagaagacagagccaagtca

SEQ ID NO: 197408 - DNA, 25 bp, Mus musculus
aggacaagaagacagatgttaagga

SEQ ID NO: 197409 - DNA, 25 bp, Mus musculus
aggacaagaaggacctgagggaccg

SEQ ID NO: 197410 - DNA, 25 bp, Mus musculus
aggacaagaaggcacatgcaactat

SEQ ID NO: 197411 - DNA, 25 bp, Mus musculus
aggacaagagcaacagtaccattca

SEQ ID NO: 197412 - DNA, 25 bp, Mus musculus
aggacaagataaacttgatgggaag

SEQ ID NO: 197413 - DNA, 25 bp, Mus musculus
aggacaagatatatctcacagacaa

SEQ ID NO: 197414 - DNA, 25 bp, Mus musculus
aggacaagatgctcatgagcagcgt

SEQ ID NO: 197415 - DNA, 25 bp, Mus musculus
aggacaagatgtatatcacttgtgc

SEQ ID NO: 197416 - DNA, 25 bp, Mus musculus
aggacaagcaggtcccatgcatcat

SEQ ID NO: 197417 - DNA, 25 bp, Mus musculus
aggacaaggaaatgacaaatggtta

SEQ ID NO: 197418 - DNA, 25 bp, Mus musculus
aggacaataaaaggaaagacaaaga

SEQ ID NO: 197419 - DNA, 25 bp, Mus musculus
aggacaataaggagaagaagaagcc

SEQ ID NO: 197420 - DNA, 25 bp, Mus musculus
aggacaatcgggtgatccaggagtt

SEQ ID NO: 197421 - DNA, 25 bp, Mus musculus
aggacaatgaggatggcagtacctg

SEQ ID NO: 197422 - DNA, 25 bp, Mus musculus
aggacaatgcagcttcacttggttc

SEQ ID NO: 197423 - DNA, 25 bp, Mus musculus
aggacaatgcagtgctgaaaggagg

SEQ ID NO: 197424 - DNA, 25 bp, Mus musculus
aggacaatgtctgttctgagtacag

SEQ ID NO: 197425 - DNA, 25 bp, Mus musculus
aggacaatgttttgatgagtggtgt

SEQ ID NO: 197426 - DNA, 25 bp, Mus musculus
aggacacaagaaaagtcaggccctg

SEQ ID NO: 197427 - DNA, 25 bp, Mus musculus
aggacacaagggtgaagagggtgac

SEQ ID NO: 197428 - DNA, 25 bp, Mus musculus
aggacacacaattggcggcggctgc

SEQ ID NO: 197429 - DNA, 25 bp, Mus musculus
aggacacacaattgggccggcggcg

SEQ ID NO: 197430 - DNA, 25 bp, Mus musculus
aggacacacaattggtggacgcaga

SEQ ID NO: 197431 - DNA, 25 bp, Mus musculus
aggacacacagacactgtcctgttg

SEQ ID NO: 197432 - DNA, 25 bp, Mus musculus
aggacacactccacgcagtatgaga

SEQ ID NO: 197433 - DNA, 25 bp, Mus musculus
aggacacagagatgactcgttggct

SEQ ID NO: 197434 - DNA, 25 bp, Mus musculus
aggacacagagctgtcccacattgg

SEQ ID NO: 197435 - DNA, 25 bp, Mus musculus
aggacacagagctgttgccaaaaca

SEQ ID NO: 197436 - DNA, 25 bp, Mus musculus
aggacacatggaagatctcaggccc

SEQ ID NO: 197437 - DNA, 25 bp, Mus musculus
aggacacattctggtgctggagaca

SEQ ID NO: 197438 - DNA, 25 bp, Mus musculus
aggacaccaagagggaagctgctca

SEQ ID NO: 197439 - DNA, 25 bp, Mus musculus
aggacaccaagggtccaccaacagc

SEQ ID NO: 197440 - DNA, 25 bp, Mus musculus
aggacaccagctgaggagggcagga

SEQ ID NO: 197441 - DNA, 25 bp, Mus musculus
aggacaccatggctgatcatcactc

SEQ ID NO: 197442 - DNA, 25 bp, Mus musculus
aggacacccaaggatgtgaatgagt

SEQ ID NO: 197443 - DNA, 25 bp, Mus musculus
aggacacccctcatgtttctgcagg

SEQ ID NO: 197444 - DNA, 25 bp, Mus musculus
aggacaccgcgcagatctcaagcat

SEQ ID NO: 197445 - DNA, 25 bp, Mus musculus
aggacaccttaggtattggaaaagt

SEQ ID NO: 197446 - DNA, 25 bp, Mus musculus
aggacacgcaccagtggtatgtgtg

SEQ ID NO: 197447 - DNA, 25 bp, Mus musculus
aggacacgcatggggtgtgattttg

SEQ ID NO: 197448 - DNA, 25 bp, Mus musculus
aggacacggtccagctgcccaccat

SEQ ID NO: 197449 - DNA, 25 bp, Mus musculus
aggacactacgaacagcacattagt

SEQ ID NO: 197450 - DNA, 25 bp, Mus musculus
aggacactcaagtggctgatgtgac

SEQ ID NO: 197451 - DNA, 25 bp, Mus musculus
aggacactgcgtgggcccagtgggc

SEQ ID NO: 197452 - DNA, 25 bp, Mus musculus
aggacactggagatgatccttacag

SEQ ID NO: 197453 - DNA, 25 bp, Mus musculus
aggacactggcagcagggcagtttc

SEQ ID NO: 197454 - DNA, 25 bp, Mus musculus
aggacactggtgttagaaatgaagc

SEQ ID NO: 197455 - DNA, 25 bp, Mus musculus
aggacactgtatcggttccatgtaa

SEQ ID NO: 197456 - DNA, 25 bp, Mus musculus
aggacagaaagctttttacctttgt

SEQ ID NO: 197457 - DNA, 25 bp, Mus musculus
aggacagaaaggaagcagaggcctg

SEQ ID NO: 197458 - DNA, 25 bp, Mus musculus
aggacagaagagatctgctggcagc

SEQ ID NO: 197459 - DNA, 25 bp, Mus musculus
aggacagaagagtgtgtttgacatc

SEQ ID NO: 197460 - DNA, 25 bp, Mus musculus
aggacagaagatacaatggagaggt

SEQ ID NO: 197461 - DNA, 25 bp, Mus musculus
aggacagaagggctctgcgtttgtt

SEQ ID NO: 197462 - DNA, 25 bp, Mus musculus
aggacagaagtcctccacagagcac

SEQ ID NO: 197463 - DNA, 25 bp, Mus musculus
aggacagacaagaaattgcaaattc

SEQ ID NO: 197464 - DNA, 25 bp, Mus musculus
aggacagacaggctttccagggctc

SEQ ID NO: 197465 - DNA, 25 bp, Mus musculus
aggacagacctgcaaatctcccagc

SEQ ID NO: 197466 - DNA, 25 bp, Mus musculus
aggacagactggaggcattctggaa

SEQ ID NO: 197467 - DNA, 25 bp, Mus musculus
aggacagagagattgtgacacgggt

SEQ ID NO: 197468 - DNA, 25 bp, Mus musculus
aggacagagatcggtaccgttgctc

SEQ ID NO: 197469 - DNA, 25 bp, Mus musculus
aggacagaggacctgaaggctgaaa

SEQ ID NO: 197470 - DNA, 25 bp, Mus musculus
aggacagagggactgctgcagagct

SEQ ID NO: 197471 - DNA, 25 bp, Mus musculus
aggacagagggataagaaaaataag

SEQ ID NO: 197472 - DNA, 25 bp, Mus musculus
aggacagagggtagacaaacacatt

SEQ ID NO: 197473 - DNA, 25 bp, Mus musculus
aggacagagggtcagagagatggca

SEQ ID NO: 197474 - DNA, 25 bp, Mus musculus
aggacagagggtcagttccaggaag

SEQ ID NO: 197475 - DNA, 25 bp, Mus musculus
aggacagattgctctgccatcacct

SEQ ID NO: 197476 - DNA, 25 bp, Mus musculus
aggacagcaaggccctcctttttct

SEQ ID NO: 197477 - DNA, 25 bp, Mus musculus
aggacagcaaggtggtgtgggaccc

SEQ ID NO: 197478 - DNA, 25 bp, Mus musculus
aggacagcagacactcatcagcctg

SEQ ID NO: 197479 - DNA, 25 bp, Mus musculus
aggacagcagggtgtgcaggggcct

SEQ ID NO: 197480 - DNA, 25 bp, Mus musculus
aggacagccagggtctctggaactc

SEQ ID NO: 197481 - DNA, 25 bp, Mus musculus
aggacagccagggtgagtccagtga

SEQ ID NO: 197482 - DNA, 25 bp, Mus musculus
aggacagccctcccacagaattcca

SEQ ID NO: 197483 - DNA, 25 bp, Mus musculus
aggacagccgtgtagtttccattta

SEQ ID NO: 197484 - DNA, 25 bp, Mus musculus
aggacagctcaatcgagctgggagc

SEQ ID NO: 197485 - DNA, 25 bp, Mus musculus
aggacagctcagctgttgaatcaca

SEQ ID NO: 197486 - DNA, 25 bp, Mus musculus
aggacagctgtggagctggcctgaa

SEQ ID NO: 197487 - DNA, 25 bp, Mus musculus
aggacagcttgtcccaggtaaatca

SEQ ID NO: 197488 - DNA, 25 bp, Mus musculus
aggacaggaaagattgttttctgct

SEQ ID NO: 197489 - DNA, 25 bp, Mus musculus
aggacaggaaagcccatgttaccag

SEQ ID NO: 197490 - DNA, 25 bp, Mus musculus
aggacaggaaagggcactgtggagt

SEQ ID NO: 197491 - DNA, 25 bp, Mus musculus
aggacaggaaaggtgtactcgggca

SEQ ID NO: 197492 - DNA, 25 bp, Mus musculus
aggacaggaagaggacgccctacct

SEQ ID NO: 197493 - DNA, 25 bp, Mus musculus
aggacaggaaggtacttctccatac

SEQ ID NO: 197494 - DNA, 25 bp, Mus musculus
aggacaggaattgtttgttccttac

SEQ ID NO: 197495 - DNA, 25 bp, Mus musculus
aggacaggacctttcctagcaagaa

SEQ ID NO: 197496 - DNA, 25 bp, Mus musculus
aggacaggacgagtattatatagtt

SEQ ID NO: 197497 - DNA, 25 bp, Mus musculus
aggacaggacggaaaaagagagaga

SEQ ID NO: 197498 - DNA, 25 bp, Mus musculus
aggacaggacggggtccctccaatc

SEQ ID NO: 197499 - DNA, 25 bp, Mus musculus
aggacaggaggggaagaaaatggag

SEQ ID NO: 197500 - DNA, 25 bp, Mus musculus
aggacaggccattggtggctatggc

SEQ ID NO: 197501 - DNA, 25 bp, Mus musculus
aggacagggaggtactgatactaac

SEQ ID NO: 197502 - DNA, 25 bp, Mus musculus
aggacagggaggttccagaatacct

SEQ ID NO: 197503 - DNA, 25 bp, Mus musculus
aggacagtaaaggaggcagcccgcg

SEQ ID NO: 197504 - DNA, 25 bp, Mus musculus
aggacagtactctcccatggctatt

SEQ ID NO: 197505 - DNA, 25 bp, Mus musculus
aggacagtcactcggaggcttactg

SEQ ID NO: 197506 - DNA, 25 bp, Mus musculus
aggacagtcatggtggaccagcaca

SEQ ID NO: 197507 - DNA, 25 bp, Mus musculus
aggacagtgacagcatcacggctgc

SEQ ID NO: 197508 - DNA, 25 bp, Mus musculus
aggacagtgtgaccgtaccgaccct

SEQ ID NO: 197509 - DNA, 25 bp, Mus musculus
aggacatacccggttacataggatg

SEQ ID NO: 197510 - DNA, 25 bp, Mus musculus
aggacatactgccatttgatcacag

SEQ ID NO: 197511 - DNA, 25 bp, Mus musculus
aggacatagagaccatagaatccaa

SEQ ID NO: 197512 - DNA, 25 bp, Mus musculus
aggacatcaggctctgtgtgagtgt

SEQ ID NO: 197513 - DNA, 25 bp, Mus musculus
aggacatcatcacagatcttcggaa

SEQ ID NO: 197514 - DNA, 25 bp, Mus musculus
aggacatcatcacagtgctgaagac

SEQ ID NO: 197515 - DNA, 25 bp, Mus musculus
aggacatcattcagaaatggcaaaa

SEQ ID NO: 197516 - DNA, 25 bp, Mus musculus
aggacatcattcagggctgcaaaat

SEQ ID NO: 197517 - DNA, 25 bp, Mus musculus
aggacatcccagacaattttggaaa

SEQ ID NO: 197518 - DNA, 25 bp, Mus musculus
aggacatcccagcaaagaaacgatg

SEQ ID NO: 197519 - DNA, 25 bp, Mus musculus
aggacatcgtcacgagctgaggtca

SEQ ID NO: 197520 - DNA, 25 bp, Mus musculus
aggacatctcacaaaaaacatcgga

SEQ ID NO: 197521 - DNA, 25 bp, Mus musculus
aggacatctgaaagctgagccccag

SEQ ID NO: 197522 - DNA, 25 bp, Mus musculus
aggacatctgcaggatctgccactg

SEQ ID NO: 197523 - DNA, 25 bp, Mus musculus
aggacatctggaagtaacttgaatc

SEQ ID NO: 197524 - DNA, 25 bp, Mus musculus
aggacatgaaacagtacctttgacc

SEQ ID NO: 197525 - DNA, 25 bp, Mus musculus
aggacatgaccccctgcccggcgtc

SEQ ID NO: 197526 - DNA, 25 bp, Mus musculus
aggacatgacccggtctcaagggag

SEQ ID NO: 197527 - DNA, 25 bp, Mus musculus
aggacatgagctactatagaaaact

SEQ ID NO: 197528 - DNA, 25 bp, Mus musculus
aggacatgatagacggcttgaagcc

SEQ ID NO: 197529 - DNA, 25 bp, Mus musculus
aggacatgggactaggatgatgtct

SEQ ID NO: 197530 - DNA, 25 bp, Mus musculus
aggacatgtcgtccctaatgtggat

SEQ ID NO: 197531 - DNA, 25 bp, Mus musculus
aggacatgtcgtgtttctttcagtc

SEQ ID NO: 197532 - DNA, 25 bp, Mus musculus
aggacattaagagtggaaagctgag

SEQ ID NO: 197533 - DNA, 25 bp, Mus musculus
aggacattaaggccacccgagacct

SEQ ID NO: 197534 - DNA, 25 bp, Mus musculus
aggacattagattgatcagggacca

SEQ ID NO: 197535 - DNA, 25 bp, Mus musculus
aggacattaggaaattagataggtt

SEQ ID NO: 197536 - DNA, 25 bp, Mus musculus
aggacattcaaagtaccattactat

SEQ ID NO: 197537 - DNA, 25 bp, Mus musculus
aggacattcgccaatggcagtgcgg

SEQ ID NO: 197538 - DNA, 25 bp, Mus musculus
aggacattcgtctgtattcatgcct

SEQ ID NO: 197539 - DNA, 25 bp, Mus musculus
aggacattgagacagaaagacatgg

SEQ ID NO: 197540 - DNA, 25 bp, Mus musculus
aggacattggcacagaggctcagat

SEQ ID NO: 197541 - DNA, 25 bp, Mus musculus
aggacatttcaaaagaaaggaccta

SEQ ID NO: 197542 - DNA, 25 bp, Mus musculus
aggacatttcaaaagtttgatttcc

SEQ ID NO: 197543 - DNA, 25 bp, Mus musculus
aggaccaaaggagccaaaccagcaa

SEQ ID NO: 197544 - DNA, 25 bp, Mus musculus
aggaccaaagggaccactttccact

SEQ ID NO: 197545 - DNA, 25 bp, Mus musculus
aggaccaaattaatgacaagaacgg

SEQ ID NO: 197546 - DNA, 25 bp, Mus musculus
aggaccaaattaatgagtacaagga

SEQ ID NO: 197547 - DNA, 25 bp, Mus musculus
aggaccaaattaatgtggatgatct

SEQ ID NO: 197548 - DNA, 25 bp, Mus musculus
aggaccacagaactacagctgaatc

SEQ ID NO: 197549 - DNA, 25 bp, Mus musculus
aggaccacagagggtggctgtctgc

SEQ ID NO: 197550 - DNA, 25 bp, Mus musculus
aggaccacagttatatatcttcagg

SEQ ID NO: 197551 - DNA, 25 bp, Mus musculus
aggaccaccaagacatccaggagct

SEQ ID NO: 197552 - DNA, 25 bp, Mus musculus
aggaccaccaagactcacaccctac

SEQ ID NO: 197553 - DNA, 25 bp, Mus musculus
aggaccacccagctgtggctgcgac

SEQ ID NO: 197554 - DNA, 25 bp, Mus musculus
aggaccactgctctgctgcctgcat

SEQ ID NO: 197555 - DNA, 25 bp, Mus musculus
aggaccactggttctacgggtgccg

SEQ ID NO: 197556 - DNA, 25 bp, Mus musculus
aggaccagagggtcctcctggtgaa

SEQ ID NO: 197557 - DNA, 25 bp, Mus musculus
aggaccagcctttacaggacgcctt

SEQ ID NO: 197558 - DNA, 25 bp, Mus musculus
aggaccagcgcaacaaaaagatcga

SEQ ID NO: 197559 - DNA, 25 bp, Mus musculus
aggaccaggaagcaggtgtctagtc

SEQ ID NO: 197560 - DNA, 25 bp, Mus musculus
aggaccaggcacccagagttttgct

SEQ ID NO: 197561 - DNA, 25 bp, Mus musculus
aggaccaggcaggagtacctggagt

SEQ ID NO: 197562 - DNA, 25 bp, Mus musculus
aggaccaggcagtacacctatggcg

SEQ ID NO: 197563 - DNA, 25 bp, Mus musculus
aggaccaggcggttgtggatctcct

SEQ ID NO: 197564 - DNA, 25 bp, Mus musculus
aggaccatgcaggttcgcaacgttc

SEQ ID NO: 197565 - DNA, 25 bp, Mus musculus
aggaccatgcgcaatcaggattcag

SEQ ID NO: 197566 - DNA, 25 bp, Mus musculus
aggaccatgcgcctgcggagttcta

SEQ ID NO: 197567 - DNA, 25 bp, Mus musculus
aggaccatgctccccacccccgatc

SEQ ID NO: 197568 - DNA, 25 bp, Mus musculus
aggaccattaaagtgtggagcacga

SEQ ID NO: 197569 - DNA, 25 bp, Mus musculus
aggacccaagtacattcacctgcag

SEQ ID NO: 197570 - DNA, 25 bp, Mus musculus
aggacccacagcgacccatacgtga

SEQ ID NO: 197571 - DNA, 25 bp, Mus musculus
aggacccacagggccctgtgtgctg

SEQ ID NO: 197572 - DNA, 25 bp, Mus musculus
aggacccagaaagcatctgcatctc

SEQ ID NO: 197573 - DNA, 25 bp, Mus musculus
aggacccagagcaagtccacatgcg

SEQ ID NO: 197574 - DNA, 25 bp, Mus musculus
aggacccagctggagaaagattcca

SEQ ID NO: 197575 - DNA, 25 bp, Mus musculus
aggacccagctggaggtcacctcag

SEQ ID NO: 197576 - DNA, 25 bp, Mus musculus
aggacccaggcataggtcacctcca

SEQ ID NO: 197577 - DNA, 25 bp, Mus musculus
aggacccagggaaggtgctgtggga

SEQ ID NO: 197578 - DNA, 25 bp, Mus musculus
aggacccagtgacgggtgagcctgc

SEQ ID NO: 197579 - DNA, 25 bp, Mus musculus
aggacccagtggaacaattggattt

SEQ ID NO: 197580 - DNA, 25 bp, Mus musculus
aggaccccaaagtggttgatcggtt

SEQ ID NO: 197581 - DNA, 25 bp, Mus musculus
aggaccccacagtgcaagaatccct

SEQ ID NO: 197582 - DNA, 25 bp, Mus musculus
aggaccccacctggattccgagctg

SEQ ID NO: 197583 - DNA, 25 bp, Mus musculus
aggaccccagccaggcccccagcaa

SEQ ID NO: 197584 - DNA, 25 bp, Mus musculus
aggaccccagccaggtcagtggcta

SEQ ID NO: 197585 - DNA, 25 bp, Mus musculus
aggaccccagctctgtcagcatccc

SEQ ID NO: 197586 - DNA, 25 bp, Mus musculus
aggaccccaggaccttgccacactg

SEQ ID NO: 197587 - DNA, 25 bp, Mus musculus
aggacccccaccaggagagaaagga

SEQ ID NO: 197588 - DNA, 25 bp, Mus musculus
aggacccccaggtgatgctggcgcc

SEQ ID NO: 197589 - DNA, 25 bp, Mus musculus
aggacccccgaggtgattcatggca

SEQ ID NO: 197590 - DNA, 25 bp, Mus musculus
aggacccccgagtgtccaggttatg

SEQ ID NO: 197591 - DNA, 25 bp, Mus musculus
aggaccccgaagcagaggatgaagg

SEQ ID NO: 197592 - DNA, 25 bp, Mus musculus
aggaccccgagcaggatggtgagga

SEQ ID NO: 197593 - DNA, 25 bp, Mus musculus
aggaccccgggttccagtgacagca

SEQ ID NO: 197594 - DNA, 25 bp, Mus musculus
aggacccgcaaggttaataacttga

SEQ ID NO: 197595 - DNA, 25 bp, Mus musculus
aggacccgcgagatgctgaggatgc

SEQ ID NO: 197596 - DNA, 25 bp, Mus musculus
aggacccgctcagatcttgacagtt

SEQ ID NO: 197597 - DNA, 25 bp, Mus musculus
aggacccgctcagggaaacagatct

SEQ ID NO: 197598 - DNA, 25 bp, Mus musculus
aggacccggaactgaaagcaaaatc

SEQ ID NO: 197599 - DNA, 25 bp, Mus musculus
aggacccggagggttgctatcggct

SEQ ID NO: 197600 - DNA, 25 bp, Mus musculus
aggacccgtgtgagaaagtcagctc

SEQ ID NO: 197601 - DNA, 25 bp, Mus musculus
aggacccgtgtgaggctgaaaagac

SEQ ID NO: 197602 - DNA, 25 bp, Mus musculus
aggaccctaacagagtacacacgaa

SEQ ID NO: 197603 - DNA, 25 bp, Mus musculus
aggaccctatgaagttgaaaacaca

SEQ ID NO: 197604 - DNA, 25 bp, Mus musculus
aggaccctcaggcattatgagagac

SEQ ID NO: 197605 - DNA, 25 bp, Mus musculus
aggaccctcaggtactaggcggcct

SEQ ID NO: 197606 - DNA, 25 bp, Mus musculus
aggaccctcaggtttgatgaagata

SEQ ID NO: 197607 - DNA, 25 bp, Mus musculus
aggaccctcgaccgtttccaggata

SEQ ID NO: 197608 - DNA, 25 bp, Mus musculus
aggaccctcgacgccttattcagga

SEQ ID NO: 197609 - DNA, 25 bp, Mus musculus
aggaccctgagcaggctcctgctga

SEQ ID NO: 197610 - DNA, 25 bp, Mus musculus
aggaccctgctctgacgtatgactt

SEQ ID NO: 197611 - DNA, 25 bp, Mus musculus
aggaccctgtgacgaaagaagaaat

SEQ ID NO: 197612 - DNA, 25 bp, Mus musculus
aggaccctgtgagctcggtcgagga

SEQ ID NO: 197613 - DNA, 25 bp, Mus musculus
aggacccttcagcagatgaatggaa

SEQ ID NO: 197614 - DNA, 25 bp, Mus musculus
aggaccgacgagcccttgctgctct

SEQ ID NO: 197615 - DNA, 25 bp, Mus musculus
aggaccgagacagctccttccgctt

SEQ ID NO: 197616 - DNA, 25 bp, Mus musculus
aggaccgagagggttacacatcatt

SEQ ID NO: 197617 - DNA, 25 bp, Mus musculus
aggaccgagaggtgagacgtggaat

SEQ ID NO: 197618 - DNA, 25 bp, Mus musculus
aggaccgagaggtgatctgtaaatc

SEQ ID NO: 197619 - DNA, 25 bp, Mus musculus
aggaccgaggatccagatcgaggga

SEQ ID NO: 197620 - DNA, 25 bp, Mus musculus
aggaccgaggattgaagtgagtgaa

SEQ ID NO: 197621 - DNA, 25 bp, Mus musculus
aggaccgaggcgttatcgaactcct

SEQ ID NO: 197622 - DNA, 25 bp, Mus musculus
aggaccgatcacaggtcacttggca

SEQ ID NO: 197623 - DNA, 25 bp, Mus musculus
aggaccgcagcacttcatccaccag

SEQ ID NO: 197624 - DNA, 25 bp, Mus musculus
aggaccgccacgggaagaagcgcac

SEQ ID NO: 197625 - DNA, 25 bp, Mus musculus
aggaccgcctgagattgtcgcagca

SEQ ID NO: 197626 - DNA, 25 bp, Mus musculus
aggaccgcgaagaggatgaaccttc

SEQ ID NO: 197627 - DNA, 25 bp, Mus musculus
aggaccgcgaaggtcatctaacttg

SEQ ID NO: 197628 - DNA, 25 bp, Mus musculus
aggaccgctacagctcccaagtgcc

SEQ ID NO: 197629 - DNA, 25 bp, Mus musculus
aggaccgcttatagcccaaggaaca

SEQ ID NO: 197630 - DNA, 25 bp, Mus musculus
aggaccgcttataggcttggggcat

SEQ ID NO: 197631 - DNA, 25 bp, Mus musculus
aggaccgcttggctctacagaggga

SEQ ID NO: 197632 - DNA, 25 bp, Mus musculus
aggaccggaaagcgtctgcaccagg

SEQ ID NO: 197633 - DNA, 25 bp, Mus musculus
aggacctaaaggagacttgggagaa

SEQ ID NO: 197634 - DNA, 25 bp, Mus musculus
aggacctaagctgcagaatcgagga

SEQ ID NO: 197635 - DNA, 25 bp, Mus musculus
aggacctaccatggggcgcagttct

SEQ ID NO: 197636 - DNA, 25 bp, Mus musculus
aggacctactaagatcgagagcgat

SEQ ID NO: 197637 - DNA, 25 bp, Mus musculus
aggacctacttggagccctataata

SEQ ID NO: 197638 - DNA, 25 bp, Mus musculus
aggacctaggctggcacgcttcagc

SEQ ID NO: 197639 - DNA, 25 bp, Mus musculus
aggacctcaaggacggtatttatat

SEQ ID NO: 197640 - DNA, 25 bp, Mus musculus
aggacctcacagcagagtgccatct

SEQ ID NO: 197641 - DNA, 25 bp, Mus musculus
aggacctccaagacagggtttttct

SEQ ID NO: 197642 - DNA, 25 bp, Mus musculus
aggacctccaagcgctcatcgacat

SEQ ID NO: 197643 - DNA, 25 bp, Mus musculus
aggacctccaggacctcagggtctg

SEQ ID NO: 197644 - DNA, 25 bp, Mus musculus
aggacctcccacagtgttatctttg

SEQ ID NO: 197645 - DNA, 25 bp, Mus musculus
aggacctcgagtataactgcaaccc

SEQ ID NO: 197646 - DNA, 25 bp, Mus musculus
aggacctcggggagaaagagggaat

SEQ ID NO: 197647 - DNA, 25 bp, Mus musculus
aggacctctgtgaaggcaatggtgc

SEQ ID NO: 197648 - DNA, 25 bp, Mus musculus
aggacctgaaaggattaataggcag

SEQ ID NO: 197649 - DNA, 25 bp, Mus musculus
aggacctgaaatttcagattggaga

SEQ ID NO: 197650 - DNA, 25 bp, Mus musculus
aggacctgacgcaggcaaaacccat

SEQ ID NO: 197651 - DNA, 25 bp, Mus musculus
aggacctgactcagagaggaagaac

SEQ ID NO: 197652 - DNA, 25 bp, Mus musculus
aggacctgagtgatgatggaatcag

SEQ ID NO: 197653 - DNA, 25 bp, Mus musculus
aggacctgcagctcttatgctctag

SEQ ID NO: 197654 - DNA, 25 bp, Mus musculus
aggacctgcaggccccccaggatca

SEQ ID NO: 197655 - DNA, 25 bp, Mus musculus
aggacctgcaggctgtgtggagatg

SEQ ID NO: 197656 - DNA, 25 bp, Mus musculus
aggacctgcagtgctcccaccacct

SEQ ID NO: 197657 - DNA, 25 bp, Mus musculus
aggacctgccaaaagttgtggagct

SEQ ID NO: 197658 - DNA, 25 bp, Mus musculus
aggacctggaaaccaacctgacctt

SEQ ID NO: 197659 - DNA, 25 bp, Mus musculus
aggacctggaaaccactaagaaact

SEQ ID NO: 197660 - DNA, 25 bp, Mus musculus
aggacctggaactgctggcctctgg

SEQ ID NO: 197661 - DNA, 25 bp, Mus musculus
aggacctggaggaaattatggaagt

SEQ ID NO: 197662 - DNA, 25 bp, Mus musculus
aggacctggaggtggcaattttgga

SEQ ID NO: 197663 - DNA, 25 bp, Mus musculus
aggacctgggatggattgtaagcgg

SEQ ID NO: 197664 - DNA, 25 bp, Mus musculus
aggacctgtagagaacctccatgta

SEQ ID NO: 197665 - DNA, 25 bp, Mus musculus
aggaccttacacaggtcaccactca

SEQ ID NO: 197666 - DNA, 25 bp, Mus musculus
aggaccttatcaggtttgcacagac

SEQ ID NO: 197667 - DNA, 25 bp, Mus musculus
aggaccttcggggctgggcttcaac

SEQ ID NO: 197668 - DNA, 25 bp, Mus musculus
aggaccttcgggtaaatggccaaga

SEQ ID NO: 197669 - DNA, 25 bp, Mus musculus
aggaccttctcttggtcttcatgcc

SEQ ID NO: 197670 - DNA, 25 bp, Mus musculus
aggaccttctttggggttccttgtg

SEQ ID NO: 197671 - DNA, 25 bp, Mus musculus
aggaccttgagcagcccaaagaagt

SEQ ID NO: 197672 - DNA, 25 bp, Mus musculus
aggaccttgagcaggaggcttctca

SEQ ID NO: 197673 - DNA, 25 bp, Mus musculus
aggaccttgcacgacctagtggttt

SEQ ID NO: 197674 - DNA, 25 bp, Mus musculus
aggaccttggcaggggaatcaaaga

SEQ ID NO: 197675 - DNA, 25 bp, Mus musculus
aggaccttgtgcaggcaccttttgt

SEQ ID NO: 197676 - DNA, 25 bp, Mus musculus
aggaccttttcggactgggtgaaag

SEQ ID NO: 197677 - DNA, 25 bp, Mus musculus
aggaccttttcggatcaagattata

SEQ ID NO: 197678 - DNA, 25 bp, Mus musculus
aggaccttttcgtgggagccaagaa

SEQ ID NO: 197679 - DNA, 25 bp, Mus musculus
aggacgaaacaaaagtggtccatgc

SEQ ID NO: 197680 - DNA, 25 bp, Mus musculus
aggacgaaaccacgaaccgcatgca

SEQ ID NO: 197681 - DNA, 25 bp, Mus musculus
aggacgaagggtcctgtgcgcaggt

SEQ ID NO: 197682 - DNA, 25 bp, Mus musculus
aggacgaagtgtttgactttggcga

SEQ ID NO: 197683 - DNA, 25 bp, Mus musculus
aggacgacagatctatgtaagagca

SEQ ID NO: 197684 - DNA, 25 bp, Mus musculus
aggacgacagggccccaaaggagag

SEQ ID NO: 197685 - DNA, 25 bp, Mus musculus
aggacgacccaggaagagaaagaga

SEQ ID NO: 197686 - DNA, 25 bp, Mus musculus
aggacgacccaggcaaagggaatta

SEQ ID NO: 197687 - DNA, 25 bp, Mus musculus
aggacgactccttctatgaaatcat

SEQ ID NO: 197688 - DNA, 25 bp, Mus musculus
aggacgactgccccaagaggacctg

SEQ ID NO: 197689 - DNA, 25 bp, Mus musculus
aggacgactggcgaagcagtgcccc

SEQ ID NO: 197690 - DNA, 25 bp, Mus musculus
aggacgacttggagccccacgcaat

SEQ ID NO: 197691 - DNA, 25 bp, Mus musculus
aggacgagaaaacgcagaggtgacc

SEQ ID NO: 197692 - DNA, 25 bp, Mus musculus
aggacgagaaggaccacttgattga

SEQ ID NO: 197693 - DNA, 25 bp, Mus musculus
aggacgagagctctatttcagtgct

SEQ ID NO: 197694 - DNA, 25 bp, Mus musculus
aggacgagagctctggtgcaagtgt

SEQ ID NO: 197695 - DNA, 25 bp, Mus musculus
aggacgagctaaagcggctgctgcc

SEQ ID NO: 197696 - DNA, 25 bp, Mus musculus
aggacgagctacagccctacacgaa

SEQ ID NO: 197697 - DNA, 25 bp, Mus musculus
aggacgagctgaattctttatacaa

SEQ ID NO: 197698 - DNA, 25 bp, Mus musculus
aggacgaggaagaggagaaaccaag

SEQ ID NO: 197699 - DNA, 25 bp, Mus musculus
aggacgaggagcaggttgctatcgg

SEQ ID NO: 197700 - DNA, 25 bp, Mus musculus
aggacgaggagtctggctcgggtct

SEQ ID NO: 197701 - DNA, 25 bp, Mus musculus
aggacgaggagtctggtggaggctc

SEQ ID NO: 197702 - DNA, 25 bp, Mus musculus
aggacgaggatgaggactcgtccag

SEQ ID NO: 197703 - DNA, 25 bp, Mus musculus
aggacgatgactgaggtgcttcacc

SEQ ID NO: 197704 - DNA, 25 bp, Mus musculus
aggacgatgagcgaggctgctgcgc

SEQ ID NO: 197705 - DNA, 25 bp, Mus musculus
aggacgatgatgtttgtgatcctgt

SEQ ID NO: 197706 - DNA, 25 bp, Mus musculus
aggacgatttggggctcatcacaag

SEQ ID NO: 197707 - DNA, 25 bp, Mus musculus
aggacgatttgggtgtcctgctccc

SEQ ID NO: 197708 - DNA, 25 bp, Mus musculus
aggacgcaaggaaatgcccggaacc

SEQ ID NO: 197709 - DNA, 25 bp, Mus musculus
aggacgcagaagagactgagaggaa

SEQ ID NO: 197710 - DNA, 25 bp, Mus musculus
aggacgcagaagagcctaccgagga

SEQ ID NO: 197711 - DNA, 25 bp, Mus musculus
aggacgcagaagagtttgactttgg

SEQ ID NO: 197712 - DNA, 25 bp, Mus musculus
aggacgcagagaagggcccagtgtg

SEQ ID NO: 197713 - DNA, 25 bp, Mus musculus
aggacgcagagcttgttgatgttgg

SEQ ID NO: 197714 - DNA, 25 bp, Mus musculus
aggacgcagccagagagggaaactg

SEQ ID NO: 197715 - DNA, 25 bp, Mus musculus
aggacgcagccagagcttgtccagg

SEQ ID NO: 197716 - DNA, 25 bp, Mus musculus
aggacgcagtctatgggacgcctca

SEQ ID NO: 197717 - DNA, 25 bp, Mus musculus
aggacgcccaggaactgtatgaggc

SEQ ID NO: 197718 - DNA, 25 bp, Mus musculus
aggacgcccaggccggtcccggatg

SEQ ID NO: 197719 - DNA, 25 bp, Mus musculus
aggacgcccaggtctttcaacactc

SEQ ID NO: 197720 - DNA, 25 bp, Mus musculus
aggacgccctctgatgtgaaagagc

SEQ ID NO: 197721 - DNA, 25 bp, Mus musculus
aggacgcgatagttctgacacaaca

SEQ ID NO: 197722 - DNA, 25 bp, Mus musculus
aggacgcggacggacccctggactt

SEQ ID NO: 197723 - DNA, 25 bp, Mus musculus
aggacgcggacggacttgatgtgga

SEQ ID NO: 197724 - DNA, 25 bp, Mus musculus
aggacgcgtgtgtgcagttcacctt

SEQ ID NO: 197725 - DNA, 25 bp, Mus musculus
aggacgcgtgtgtggagttcacctt

SEQ ID NO: 197726 - DNA, 25 bp, Mus musculus
aggacgctgccggccatcgtcgttc

SEQ ID NO: 197727 - DNA, 25 bp, Mus musculus
aggacgctgccgggtctcttccact

SEQ ID NO: 197728 - DNA, 25 bp, Mus musculus
aggacggaaagcgaatggacccgct

SEQ ID NO: 197729 - DNA, 25 bp, Mus musculus
aggacggaaatcaaggattcttaat

SEQ ID NO: 197730 - DNA, 25 bp, Mus musculus
aggacggaataggaaccaagatgac

SEQ ID NO: 197731 - DNA, 25 bp, Mus musculus
aggacggaataggggtcgaggatgt

SEQ ID NO: 197732 - DNA, 25 bp, Mus musculus
aggacggaccctgggagcctacttc

SEQ ID NO: 197733 - DNA, 25 bp, Mus musculus
aggacggagactgaggatgaggctg

SEQ ID NO: 197734 - DNA, 25 bp, Mus musculus
aggacggagcatggttggagcctct

SEQ ID NO: 197735 - DNA, 25 bp, Mus musculus
aggacggatggcgggtttccgcttc

SEQ ID NO: 197736 - DNA, 25 bp, Mus musculus
aggacggcagagaatccgtgaccta

SEQ ID NO: 197737 - DNA, 25 bp, Mus musculus
aggacggcatgccccccatcaacac

SEQ ID NO: 197738 - DNA, 25 bp, Mus musculus
aggacggcatggagccgttggtatt

SEQ ID NO: 197739 - DNA, 25 bp, Mus musculus
aggacggcatgggctcaagcccctg

SEQ ID NO: 197740 - DNA, 25 bp, Mus musculus
aggacggcatgtacgctaacttggg

SEQ ID NO: 197741 - DNA, 25 bp, Mus musculus
aggacgggaaagaacacatgtcgga

SEQ ID NO: 197742 - DNA, 25 bp, Mus musculus
aggacggggagacccatataatgcc

SEQ ID NO: 197743 - DNA, 25 bp, Mus musculus
aggacggggcttggcagagatggag

SEQ ID NO: 197744 - DNA, 25 bp, Mus musculus
aggacggggcttgtgtgttgcatac

SEQ ID NO: 197745 - DNA, 25 bp, Mus musculus
aggacggtcaatgacaaatcaggac

SEQ ID NO: 197746 - DNA, 25 bp, Mus musculus
aggacggtcctagcctcagcgttct

SEQ ID NO: 197747 - DNA, 25 bp, Mus musculus
aggacggtggatttggtggagctag

SEQ ID NO: 197748 - DNA, 25 bp, Mus musculus
aggacggttgtgaggtagatgttgt

SEQ ID NO: 197749 - DNA, 25 bp, Mus musculus
aggacgtccaggagataattgtgtg

SEQ ID NO: 197750 - DNA, 25 bp, Mus musculus
aggacgtcccgcacgtagaagaccc

SEQ ID NO: 197751 - DNA, 25 bp, Mus musculus
aggacgtctttcagacagacatgag

SEQ ID NO: 197752 - DNA, 25 bp, Mus musculus
aggacgtgacagaaaagatcaaggg

SEQ ID NO: 197753 - DNA, 25 bp, Mus musculus
aggacgtgacagggaggcccggatg

SEQ ID NO: 197754 - DNA, 25 bp, Mus musculus
aggacgtgccaagcccagcactatg

SEQ ID NO: 197755 - DNA, 25 bp, Mus musculus
aggacgtgtcgccaggtcagccatg

SEQ ID NO: 197756 - DNA, 25 bp, Mus musculus
aggacgtgtcgccagtgtggaaggg

SEQ ID NO: 197757 - DNA, 25 bp, Mus musculus
aggacgttctaaagaccaaggacaa

SEQ ID NO: 197758 - DNA, 25 bp, Mus musculus
aggacgtttgagcgaatctcattag

SEQ ID NO: 197759 - DNA, 25 bp, Mus musculus
aggactaacactgtgtccgtgcgag

SEQ ID NO: 197760 - DNA, 25 bp, Mus musculus
aggactacaaacagtactttgtgtt

SEQ ID NO: 197761 - DNA, 25 bp, Mus musculus
aggactacacagcatcctgcctctg

SEQ ID NO: 197762 - DNA, 25 bp, Mus musculus
aggactacatcgactccctgggctg

SEQ ID NO: 197763 - DNA, 25 bp, Mus musculus
aggactacatgctcacagttacgta

SEQ ID NO: 197764 - DNA, 25 bp, Mus musculus
aggactagagaaagtgtgcaatgta

SEQ ID NO: 197765 - DNA, 25 bp, Mus musculus
aggactagattttagcaggtcaatg

SEQ ID NO: 197766 - DNA, 25 bp, Mus musculus
aggactagtggcgagaatttgctga

SEQ ID NO: 197767 - DNA, 25 bp, Mus musculus
aggactagtggcgagactttatgat

SEQ ID NO: 197768 - DNA, 25 bp, Mus musculus
aggactagtggcgagcacatgccaa

SEQ ID NO: 197769 - DNA, 25 bp, Mus musculus
aggactatcgataattccggcggga

SEQ ID NO: 197770 - DNA, 25 bp, Mus musculus
aggactatggcagcagttttttatg

SEQ ID NO: 197771 - DNA, 25 bp, Mus musculus
aggactatggcgtttactggcccct

SEQ ID NO: 197772 - DNA, 25 bp, Mus musculus
aggactatggggtcacatatgactc

SEQ ID NO: 197773 - DNA, 25 bp, Mus musculus
aggactcaaggtaagaaatccagtc

SEQ ID NO: 197774 - DNA, 25 bp, Mus musculus
aggactcaagtcctccacagagcac

SEQ ID NO: 197775 - DNA, 25 bp, Mus musculus
aggactcaagtttcagagtgataaa

SEQ ID NO: 197776 - DNA, 25 bp, Mus musculus
aggactcaggtagatgagaggccag

SEQ ID NO: 197777 - DNA, 25 bp, Mus musculus
aggactcaggtaggttgatggaaac

SEQ ID NO: 197778 - DNA, 25 bp, Mus musculus
aggactccagaaaacatctcgggca

SEQ ID NO: 197779 - DNA, 25 bp, Mus musculus
aggactccagagatcccgatgtgtg

SEQ ID NO: 197780 - DNA, 25 bp, Mus musculus
aggactccaggcatgtcatgttacc

SEQ ID NO: 197781 - DNA, 25 bp, Mus musculus
aggactccatttacaacttcagggt

SEQ ID NO: 197782 - DNA, 25 bp, Mus musculus
aggactcccccaagcaggcggacgc

SEQ ID NO: 197783 - DNA, 25 bp, Mus musculus
aggactcggaagtggacagtggcat

SEQ ID NO: 197784 - DNA, 25 bp, Mus musculus
aggactcggacacagagaagcaggg

SEQ ID NO: 197785 - DNA, 25 bp, Mus musculus
aggactcggacacagatgcctccag

SEQ ID NO: 197786 - DNA, 25 bp, Mus musculus
aggactcggaggcgggttcagccga

SEQ ID NO: 197787 - DNA, 25 bp, Mus musculus
aggactcgggtggtggaggacaacc

SEQ ID NO: 197788 - DNA, 25 bp, Mus musculus
aggactcgggtggtggctctgtctc

SEQ ID NO: 197789 - DNA, 25 bp, Mus musculus
aggactctcagagctgtggcagctc

SEQ ID NO: 197790 - DNA, 25 bp, Mus musculus
aggactctgacatagcctaggaagt

SEQ ID NO: 197791 - DNA, 25 bp, Mus musculus
aggactctgacatatggggcatcat

SEQ ID NO: 197792 - DNA, 25 bp, Mus musculus
aggactctgatggtgatggccgagg

SEQ ID NO: 197793 - DNA, 25 bp, Mus musculus
aggactctttgatgtaacccacggc

SEQ ID NO: 197794 - DNA, 25 bp, Mus musculus
aggactgaagggagtggaaaatgtg

SEQ ID NO: 197795 - DNA, 25 bp, Mus musculus
aggactgaccaggttccccaggatg

SEQ ID NO: 197796 - DNA, 25 bp, Mus musculus
aggactgaggcaggcagaagaagct

SEQ ID NO: 197797 - DNA, 25 bp, Mus musculus
aggactgaggggggtccgcctacca

SEQ ID NO: 197798 - DNA, 25 bp, Mus musculus
aggactgagtcagccaaggtagcca

SEQ ID NO: 197799 - DNA, 25 bp, Mus musculus
aggactgagtccaagaaatggcctc

SEQ ID NO: 197800 - DNA, 25 bp, Mus musculus
aggactgatagaaaggtttacgaaa

SEQ ID NO: 197801 - DNA, 25 bp, Mus musculus
aggactgatagaaagttgatcttct

SEQ ID NO: 197802 - DNA, 25 bp, Mus musculus
aggactgatgggatggctctgagct

SEQ ID NO: 197803 - DNA, 25 bp, Mus musculus
aggactgatttaaggcttttgccta

SEQ ID NO: 197804 - DNA, 25 bp, Mus musculus
aggactgatttaagggcagcaggga

SEQ ID NO: 197805 - DNA, 25 bp, Mus musculus
aggactgcaagctaccttgcaaccc

SEQ ID NO: 197806 - DNA, 25 bp, Mus musculus
aggactgcaagctgccctgcaaccc

SEQ ID NO: 197807 - DNA, 25 bp, Mus musculus
aggactgcacagtgtacaaggcaga

SEQ ID NO: 197808 - DNA, 25 bp, Mus musculus
aggactgcagcacaggttctgattc

SEQ ID NO: 197809 - DNA, 25 bp, Mus musculus
aggactgccagtgggatcccactaa

SEQ ID NO: 197810 - DNA, 25 bp, Mus musculus
aggactgccagtgggatcgctgttg

SEQ ID NO: 197811 - DNA, 25 bp, Mus musculus
aggactgccatgcagtgagctgctg

SEQ ID NO: 197812 - DNA, 25 bp, Mus musculus
aggactgccccaaggctgacttccc

SEQ ID NO: 197813 - DNA, 25 bp, Mus musculus
aggactgccttcaggacgaatgcta

SEQ ID NO: 197814 - DNA, 25 bp, Mus musculus
aggactgcgggccttcatcaagtag

SEQ ID NO: 197815 - DNA, 25 bp, Mus musculus
aggactgctaagtcttcagcaaacg

SEQ ID NO: 197816 - DNA, 25 bp, Mus musculus
aggactgctgatggaattgtcagcc

SEQ ID NO: 197817 - DNA, 25 bp, Mus musculus
aggactggcctggggtctacatcac

SEQ ID NO: 197818 - DNA, 25 bp, Mus musculus
aggactggcgcaaggttcccaatca

SEQ ID NO: 197819 - DNA, 25 bp, Mus musculus
aggactgggaaaggacccagctgtt

SEQ ID NO: 197820 - DNA, 25 bp, Mus musculus
aggactgggaaaggagtgtgctcgg

SEQ ID NO: 197821 - DNA, 25 bp, Mus musculus
aggactgggaaaggatcatcgggtt

SEQ ID NO: 197822 - DNA, 25 bp, Mus musculus
aggactgggaaagggtgactgtggc

SEQ ID NO: 197823 - DNA, 25 bp, Mus musculus
aggactgggagagaaatatccaccc

SEQ ID NO: 197824 - DNA, 25 bp, Mus musculus
aggactgggagagggtgttacgttt

SEQ ID NO: 197825 - DNA, 25 bp, Mus musculus
aggactggtgtgagccttctctgag

SEQ ID NO: 197826 - DNA, 25 bp, Mus musculus
aggactgtacaccaggtcctgataa

SEQ ID NO: 197827 - DNA, 25 bp, Mus musculus
aggactgtaccccagctatcatgaa

SEQ ID NO: 197828 - DNA, 25 bp, Mus musculus
aggactgtcctttcccatggccgga

SEQ ID NO: 197829 - DNA, 25 bp, Mus musculus
aggactgtgtgggtgaaagccggcg

SEQ ID NO: 197830 - DNA, 25 bp, Mus musculus
aggactgttaggcaccgtgggccta

SEQ ID NO: 197831 - DNA, 25 bp, Mus musculus
aggacttaagggaacgaatggagct

SEQ ID NO: 197832 - DNA, 25 bp, Mus musculus
aggacttaggagtacagagactcag

SEQ ID NO: 197833 - DNA, 25 bp, Mus musculus
aggacttatatatgacattatgcag

SEQ ID NO: 197834 - DNA, 25 bp, Mus musculus
aggacttcaagaaaggtttcagact

SEQ ID NO: 197835 - DNA, 25 bp, Mus musculus
aggacttcaaggaaggaatcttttg

SEQ ID NO: 197836 - DNA, 25 bp, Mus musculus
aggacttcactacacaacatgccta

SEQ ID NO: 197837 - DNA, 25 bp, Mus musculus
aggacttcactggaccttcaggcaa

SEQ ID NO: 197838 - DNA, 25 bp, Mus musculus
aggacttcactggaccttcatctcg

SEQ ID NO: 197839 - DNA, 25 bp, Mus musculus
aggacttcagcaaaggcacacaccg

SEQ ID NO: 197840 - DNA, 25 bp, Mus musculus
aggacttcaggtatccgtggtcacc

SEQ ID NO: 197841 - DNA, 25 bp, Mus musculus
aggacttcaggtggaccagcacaca

SEQ ID NO: 197842 - DNA, 25 bp, Mus musculus
aggacttcagtgtgtctccaggcta

SEQ ID NO: 197843 - DNA, 25 bp, Mus musculus
aggacttccacaagaaatttgcccc

SEQ ID NO: 197844 - DNA, 25 bp, Mus musculus
aggacttccccacgatctccctgga

SEQ ID NO: 197845 - DNA, 25 bp, Mus musculus
aggacttccccacggaagacggcgc

SEQ ID NO: 197846 - DNA, 25 bp, Mus musculus
aggacttccggattaagcaatgcac

SEQ ID NO: 197847 - DNA, 25 bp, Mus musculus
aggacttcctggcgagaaaggtcca

SEQ ID NO: 197848 - DNA, 25 bp, Mus musculus
aggacttctcaagatgaggttccag

SEQ ID NO: 197849 - DNA, 25 bp, Mus musculus
aggacttctcaaggaatctgaattt

SEQ ID NO: 197850 - DNA, 25 bp, Mus musculus
aggacttctcaagtctattgcatct

SEQ ID NO: 197851 - DNA, 25 bp, Mus musculus
aggacttctcagagtctgtcccagg

SEQ ID NO: 197852 - DNA, 25 bp, Mus musculus
aggacttcttcaagggtggggtaat

SEQ ID NO: 197853 - DNA, 25 bp, Mus musculus
aggacttgaggaacttcctgtagaa

SEQ ID NO: 197854 - DNA, 25 bp, Mus musculus
aggacttgctccaagggccccgccg

SEQ ID NO: 197855 - DNA, 25 bp, Mus musculus
aggacttggacatgtcatctcctga

SEQ ID NO: 197856 - DNA, 25 bp, Mus musculus
aggactttatggtagcttttcccaa

SEQ ID NO: 197857 - DNA, 25 bp, Mus musculus
aggactttatggtctttagtagctt

SEQ ID NO: 197858 - DNA, 25 bp, Mus musculus
aggactttgaaaaccaaatcactga

SEQ ID NO: 197859 - DNA, 25 bp, Mus musculus
aggactttgaaaacttgtctttgca

SEQ ID NO: 197860 - DNA, 25 bp, Mus musculus
aggactttgaggacaatggtgacag

SEQ ID NO: 197861 - DNA, 25 bp, Mus musculus
aggactttgccaggcgctgtgcttt

SEQ ID NO: 197862 - DNA, 25 bp, Mus musculus
aggactttgggattttcagaaagaa

SEQ ID NO: 197863 - DNA, 25 bp, Mus musculus
aggacttttatacaggactgacaga

SEQ ID NO: 197864 - DNA, 25 bp, Mus musculus
aggacttttttgagacagaaaccaa

SEQ ID NO: 197865 - DNA, 25 bp, Mus musculus
aggagaaaacgatgggatattcaga

SEQ ID NO: 197866 - DNA, 25 bp, Mus musculus
aggagaaaacggcacacatgttggc

SEQ ID NO: 197867 - DNA, 25 bp, Mus musculus
aggagaaaagggtgctcggggattt

SEQ ID NO: 197868 - DNA, 25 bp, Mus musculus
aggagaaacacagcttttcttctca

SEQ ID NO: 197869 - DNA, 25 bp, Mus musculus
aggagaaacacaggtggaaaaggag

SEQ ID NO: 197870 - DNA, 25 bp, Mus musculus
aggagaaacaggcaagtgctctcca

SEQ ID NO: 197871 - DNA, 25 bp, Mus musculus
aggagaaaccaagacccagacttac

SEQ ID NO: 197872 - DNA, 25 bp, Mus musculus
aggagaaagagatgaaaccggcttg

SEQ ID NO: 197873 - DNA, 25 bp, Mus musculus
aggagaaagagggtggagaggtcgt

SEQ ID NO: 197874 - DNA, 25 bp, Mus musculus
aggagaaagcagccgtgaagccgct

SEQ ID NO: 197875 - DNA, 25 bp, Mus musculus
aggagaaaggaaaggccttcgatat

SEQ ID NO: 197876 - DNA, 25 bp, Mus musculus
aggagaaaggctggagctggaacct

SEQ ID NO: 197877 - DNA, 25 bp, Mus musculus
aggagaaaggctgggtgaagaccct

SEQ ID NO: 197878 - DNA, 25 bp, Mus musculus
aggagaaagtgaggacttttgctgc

SEQ ID NO: 197879 - DNA, 25 bp, Mus musculus
aggagaaatagaagaggagcctgca

SEQ ID NO: 197880 - DNA, 25 bp, Mus musculus
aggagaaatagaagtggacgacaac

SEQ ID NO: 197881 - DNA, 25 bp, Mus musculus
aggagaaatagcatgattcagctac

SEQ ID NO: 197882 - DNA, 25 bp, Mus musculus
aggagaaatccaagcttttagccag

SEQ ID NO: 197883 - DNA, 25 bp, Mus musculus
aggagaaattggtccttaccctatt

SEQ ID NO: 197884 - DNA, 25 bp, Mus musculus
aggagaacaaggctgaatcagagat

SEQ ID NO: 197885 - DNA, 25 bp, Mus musculus
aggagaacaagtgccagaaccagct

SEQ ID NO: 197886 - DNA, 25 bp, Mus musculus
aggagaacagataagccaaagagcc

SEQ ID NO: 197887 - DNA, 25 bp, Mus musculus
aggagaacagcagtaccactagccc

SEQ ID NO: 197888 - DNA, 25 bp, Mus musculus
aggagaacagcatgttgttttgcta

SEQ ID NO: 197889 - DNA, 25 bp, Mus musculus
aggagaacagctcggggactttctc

SEQ ID NO: 197890 - DNA, 25 bp, Mus musculus
aggagaacagctcgggtttgagttt

SEQ ID NO: 197891 - DNA, 25 bp, Mus musculus
aggagaacagggcgtggtacccact

SEQ ID NO: 197892 - DNA, 25 bp, Mus musculus
aggagaacagtgccaggtcaccaga

SEQ ID NO: 197893 - DNA, 25 bp, Mus musculus
aggagaacattgcagggccgtgcag

SEQ ID NO: 197894 - DNA, 25 bp, Mus musculus
aggagaacattgcaggtaaagatga

SEQ ID NO: 197895 - DNA, 25 bp, Mus musculus
aggagaaccaaaaataatctataag

SEQ ID NO: 197896 - DNA, 25 bp, Mus musculus
aggagaaccaaacaaatgaagaagc

SEQ ID NO: 197897 - DNA, 25 bp, Mus musculus
aggagaaccaggagctctggttaga

SEQ ID NO: 197898 - DNA, 25 bp, Mus musculus
aggagaaccgggtgagccctatttc

SEQ ID NO: 197899 - DNA, 25 bp, Mus musculus
aggagaacctggagagatgctgtcc

SEQ ID NO: 197900 - DNA, 25 bp, Mus musculus
aggagaacgaggagatatccatcaa

SEQ ID NO: 197901 - DNA, 25 bp, Mus musculus
aggagaactcaaggcttctagagaa

SEQ ID NO: 197902 - DNA, 25 bp, Mus musculus
aggagaactgcacagcgaaccccct

SEQ ID NO: 197903 - DNA, 25 bp, Mus musculus
aggagaactgcaggcatcagaaggg

SEQ ID NO: 197904 - DNA, 25 bp, Mus musculus
aggagaactgcaggttctcccatgg

SEQ ID NO: 197905 - DNA, 25 bp, Mus musculus
aggagaagaaaatgaccctgccaca

SEQ ID NO: 197906 - DNA, 25 bp, Mus musculus
aggagaagaaaatgctttacacaga

SEQ ID NO: 197907 - DNA, 25 bp, Mus musculus
aggagaagaaaatggagttgaagca

SEQ ID NO: 197908 - DNA, 25 bp, Mus musculus
aggagaagaagaaggtagctacatc

SEQ ID NO: 197909 - DNA, 25 bp, Mus musculus
aggagaagaagaatttggaatttta

SEQ ID NO: 197910 - DNA, 25 bp, Mus musculus
aggagaagaagcaatgtctgaccgt

SEQ ID NO: 197911 - DNA, 25 bp, Mus musculus
aggagaagaagggctccagcaccac

SEQ ID NO: 197912 - DNA, 25 bp, Mus musculus
aggagaagagaacagaaagccttgg

SEQ ID NO: 197913 - DNA, 25 bp, Mus musculus
aggagaagagcagccagcacccaag

SEQ ID NO: 197914 - DNA, 25 bp, Mus musculus
aggagaagagccccagtcacgcggt

SEQ ID NO: 197915 - DNA, 25 bp, Mus musculus
aggagaagagggtccacctggcatg

SEQ ID NO: 197916 - DNA, 25 bp, Mus musculus
aggagaagatattgacacagcagtc

SEQ ID NO: 197917 - DNA, 25 bp, Mus musculus
aggagaagatcacaagagggaagta

SEQ ID NO: 197918 - DNA, 25 bp, Mus musculus
aggagaagatggtggatcgcactcg

SEQ ID NO: 197919 - DNA, 25 bp, Mus musculus
aggagaagcaaaacttttaatccag

SEQ ID NO: 197920 - DNA, 25 bp, Mus musculus
aggagaagcagagcactggcagatc

SEQ ID NO: 197921 - DNA, 25 bp, Mus musculus
aggagaagcagagcggaattcctaa

SEQ ID NO: 197922 - DNA, 25 bp, Mus musculus
aggagaagcaggtctccctgggact

SEQ ID NO: 197923 - DNA, 25 bp, Mus musculus
aggagaagcccaacaggagggcctc

SEQ ID NO: 197924 - DNA, 25 bp, Mus musculus
aggagaagctgcggcccaccaggac

SEQ ID NO: 197925 - DNA, 25 bp, Mus musculus
aggagaagctggtccctccaggagg

SEQ ID NO: 197926 - DNA, 25 bp, Mus musculus
aggagaaggatagagatggttgtcc

SEQ ID NO: 197927 - DNA, 25 bp, Mus musculus
aggagaagggaaaggggaatgatga

SEQ ID NO: 197928 - DNA, 25 bp, Mus musculus
aggagaagggaaatatgctggctta

SEQ ID NO: 197929 - DNA, 25 bp, Mus musculus
aggagaagggagtaaaggtatcagg

SEQ ID NO: 197930 - DNA, 25 bp, Mus musculus
aggagaagtaaatgacattaaagat

SEQ ID NO: 197931 - DNA, 25 bp, Mus musculus
aggagaagtaaatgactttaagaag

SEQ ID NO: 197932 - DNA, 25 bp, Mus musculus
aggagaagtaaatgcttgacaaaaa

SEQ ID NO: 197933 - DNA, 25 bp, Mus musculus
aggagaagtgaacaaagtctggttt

SEQ ID NO: 197934 - DNA, 25 bp, Mus musculus
aggagaagtggtgcatggatgtttt

SEQ ID NO: 197935 - DNA, 25 bp, Mus musculus
aggagaagtggtggcctgcttgatt

SEQ ID NO: 197936 - DNA, 25 bp, Mus musculus
aggagaataaaggacctttttcaga

SEQ ID NO: 197937 - DNA, 25 bp, Mus musculus
aggagaatactataaggcaagaagt

SEQ ID NO: 197938 - DNA, 25 bp, Mus musculus
aggagaatactatatgtggagacgg

SEQ ID NO: 197939 - DNA, 25 bp, Mus musculus
aggagaatactattgagtcagacgt

SEQ ID NO: 197940 - DNA, 25 bp, Mus musculus
aggagaatctaggcggcttcagcgg

SEQ ID NO: 197941 - DNA, 25 bp, Mus musculus
aggagaatctagggctcaccatcat

SEQ ID NO: 197942 - DNA, 25 bp, Mus musculus
aggagaatgactggtgggtgtgcaa

SEQ ID NO: 197943 - DNA, 25 bp, Mus musculus
aggagaatggcccgccctcctcgcc

SEQ ID NO: 197944 - DNA, 25 bp, Mus musculus
aggagaatgtgtatggcctgcaggc

SEQ ID NO: 197945 - DNA, 25 bp, Mus musculus
aggagaattatgagctacagaagtt

SEQ ID NO: 197946 - DNA, 25 bp, Mus musculus
aggagaattatgaggtctacaagca

SEQ ID NO: 197947 - DNA, 25 bp, Mus musculus
aggagacaaaatgagtctggaatca

SEQ ID NO: 197948 - DNA, 25 bp, Mus musculus
aggagacaagaacttcatcactgct

SEQ ID NO: 197949 - DNA, 25 bp, Mus musculus
aggagacaagaccccagcgcatctc

SEQ ID NO: 197950 - DNA, 25 bp, Mus musculus
aggagacaagggtgatatgggacct

SEQ ID NO: 197951 - DNA, 25 bp, Mus musculus
aggagacaaggtgagccctagattg

SEQ ID NO: 197952 - DNA, 25 bp, Mus musculus
aggagacacaggtgacaaacttgaa

SEQ ID NO: 197953 - DNA, 25 bp, Mus musculus
aggagacacaggttttggctatgga

SEQ ID NO: 197954 - DNA, 25 bp, Mus musculus
aggagacacatcaagttggacccac

SEQ ID NO: 197955 - DNA, 25 bp, Mus musculus
aggagacacgagattccggggatgg

SEQ ID NO: 197956 - DNA, 25 bp, Mus musculus
aggagacacgggacgctgtatcaac

SEQ ID NO: 197957 - DNA, 25 bp, Mus musculus
aggagacacgggcttgccaggtgta

SEQ ID NO: 197958 - DNA, 25 bp, Mus musculus
aggagacagagcaggtggctgtagg

SEQ ID NO: 197959 - DNA, 25 bp, Mus musculus
aggagacagagcaggtgttttagaa

SEQ ID NO: 197960 - DNA, 25 bp, Mus musculus
aggagacagagggcatggtggcagt

SEQ ID NO: 197961 - DNA, 25 bp, Mus musculus
aggagacagaggtattgacctcatg

SEQ ID NO: 197962 - DNA, 25 bp, Mus musculus
aggagacagccatgatcaactggga

SEQ ID NO: 197963 - DNA, 25 bp, Mus musculus
aggagacagccatgatcctacagat

SEQ ID NO: 197964 - DNA, 25 bp, Mus musculus
aggagacagcctgccccgcgagaaa

SEQ ID NO: 197965 - DNA, 25 bp, Mus musculus
aggagacagcctgccgagggagcgg

SEQ ID NO: 197966 - DNA, 25 bp, Mus musculus
aggagacagcgaggtggattaagtt

SEQ ID NO: 197967 - DNA, 25 bp, Mus musculus
aggagaccaaactggatcccactga

SEQ ID NO: 197968 - DNA, 25 bp, Mus musculus
aggagaccagaaggactccatgaaa

SEQ ID NO: 197969 - DNA, 25 bp, Mus musculus
aggagaccagagcctcagcttaagg

SEQ ID NO: 197970 - DNA, 25 bp, Mus musculus
aggagaccagggagagaaatacatc

SEQ ID NO: 197971 - DNA, 25 bp, Mus musculus
aggagaccaggtaagacccctgggc

SEQ ID NO: 197972 - DNA, 25 bp, Mus musculus
aggagacccacagtatcagaaatta

SEQ ID NO: 197973 - DNA, 25 bp, Mus musculus
aggagacccaggctaggttatcaat

SEQ ID NO: 197974 - DNA, 25 bp, Mus musculus
aggagacctggtgggtgtgaacaaa

SEQ ID NO: 197975 - DNA, 25 bp, Mus musculus
aggagaccttataggagtaaagatg

SEQ ID NO: 197976 - DNA, 25 bp, Mus musculus
aggagacgaaacagcttggattctg

SEQ ID NO: 197977 - DNA, 25 bp, Mus musculus
aggagacgacgaagcaaacctttga

SEQ ID NO: 197978 - DNA, 25 bp, Mus musculus
aggagacgacgaagcactggggaag

SEQ ID NO: 197979 - DNA, 25 bp, Mus musculus
aggagacgacgaagtcgttctcccc

SEQ ID NO: 197980 - DNA, 25 bp, Mus musculus
aggagacggccctcgatggggcatc

SEQ ID NO: 197981 - DNA, 25 bp, Mus musculus
aggagacggtggtgaccatgaaaga

SEQ ID NO: 197982 - DNA, 25 bp, Mus musculus
aggagactaagccttctgatgatga

SEQ ID NO: 197983 - DNA, 25 bp, Mus musculus
aggagactctaaagttgcagcagaa

SEQ ID NO: 197984 - DNA, 25 bp, Mus musculus
aggagactctgtcttcctgtgtttt

SEQ ID NO: 197985 - DNA, 25 bp, Mus musculus
aggagactcttacggaattaattcg

SEQ ID NO: 197986 - DNA, 25 bp, Mus musculus
aggagactcttacggtcttaccaca

SEQ ID NO: 197987 - DNA, 25 bp, Mus musculus
aggagactgaaggccttcggatgcc

SEQ ID NO: 197988 - DNA, 25 bp, Mus musculus
aggagactgaaggtgctggggggac

SEQ ID NO: 197989 - DNA, 25 bp, Mus musculus
aggagactggacagaacgattccgg

SEQ ID NO: 197990 - DNA, 25 bp, Mus musculus
aggagactggctaagaactgccagt

SEQ ID NO: 197991 - DNA, 25 bp, Mus musculus
aggagactggctgtgcttgccatca

SEQ ID NO: 197992 - DNA, 25 bp, Mus musculus
aggagactggcttttcagtttccca

SEQ ID NO: 197993 - DNA, 25 bp, Mus musculus
aggagactggcttttcccacagtca

SEQ ID NO: 197994 - DNA, 25 bp, Mus musculus
aggagactgtagcaaggtgtctgat

SEQ ID NO: 197995 - DNA, 25 bp, Mus musculus
aggagactgtagcaattccttcttg

SEQ ID NO: 197996 - DNA, 25 bp, Mus musculus
aggagacttcaggctccaggatgac

SEQ ID NO: 197997 - DNA, 25 bp, Mus musculus
aggagacttggagacccagacccag

SEQ ID NO: 197998 - DNA, 25 bp, Mus musculus
aggagacttggagctgaccacagtg

SEQ ID NO: 197999 - DNA, 25 bp, Mus musculus
aggagagaaaacggtgtattgaggc

SEQ ID NO: 198000 - DNA, 25 bp, Mus musculus
aggagagaaaagattaatacacaaa

SEQ ID NO: 198001 - DNA, 25 bp, Mus musculus
aggagagaaaagcatctgtccatca

SEQ ID NO: 198002 - DNA, 25 bp, Mus musculus
aggagagaaaagggagctgtgattg

SEQ ID NO: 198003 - DNA, 25 bp, Mus musculus
aggagagaaagatcagccacaaccg

SEQ ID NO: 198004 - DNA, 25 bp, Mus musculus
aggagagaacttggagatctcattc

SEQ ID NO: 198005 - DNA, 25 bp, Mus musculus
aggagagaagcatcaagatgacctg

SEQ ID NO: 198006 - DNA, 25 bp, Mus musculus
aggagagaaggattggaagaaagaa

SEQ ID NO: 198007 - DNA, 25 bp, Mus musculus
aggagagaaggcattggaagaagga

SEQ ID NO: 198008 - DNA, 25 bp, Mus musculus
aggagagaagggccaatcaggcgag

SEQ ID NO: 198009 - DNA, 25 bp, Mus musculus
aggagagaagggtcaccgctagaag

SEQ ID NO: 198010 - DNA, 25 bp, Mus musculus
aggagagaatatcagctgcaagaaa

SEQ ID NO: 198011 - DNA, 25 bp, Mus musculus
aggagagacaaggcaagaaatacag

SEQ ID NO: 198012 - DNA, 25 bp, Mus musculus
aggagagacaaggggatgacaattt

SEQ ID NO: 198013 - DNA, 25 bp, Mus musculus
aggagagacagcagtcttcccagat

SEQ ID NO: 198014 - DNA, 25 bp, Mus musculus
aggagagaccagaagattcgtaaga

SEQ ID NO: 198015 - DNA, 25 bp, Mus musculus
aggagagagagagaagagagagaga

SEQ ID NO: 198016 - DNA, 25 bp, Mus musculus
aggagagagagagagagagagagaa

SEQ ID NO: 198017 - DNA, 25 bp, Mus musculus
aggagagagccatcattgacatgta

SEQ ID NO: 198018 - DNA, 25 bp, Mus musculus
aggagagaggcagatgtgagcccac

SEQ ID NO: 198019 - DNA, 25 bp, Mus musculus
aggagagaggggagaaaggggagag

SEQ ID NO: 198020 - DNA, 25 bp, Mus musculus
aggagagatcagtgttgaagatgaa

SEQ ID NO: 198021 - DNA, 25 bp, Mus musculus
aggagagatgacttgtaccagagag

SEQ ID NO: 198022 - DNA, 25 bp, Mus musculus
aggagagatgagagcaatcacctca

SEQ ID NO: 198023 - DNA, 25 bp, Mus musculus
aggagagattgatgctgcacctcct

SEQ ID NO: 198024 - DNA, 25 bp, Mus musculus
aggagagcaaaaagaatcgggttga

SEQ ID NO: 198025 - DNA, 25 bp, Mus musculus
aggagagcaaaaagtttcgtgaaca

SEQ ID NO: 198026 - DNA, 25 bp, Mus musculus
aggagagcaagctgatcatcctggc

SEQ ID NO: 198027 - DNA, 25 bp, Mus musculus
aggagagcaaggataagcgccggga

SEQ ID NO: 198028 - DNA, 25 bp, Mus musculus
aggagagcaaggctctgtacaactc

SEQ ID NO: 198029 - DNA, 25 bp, Mus musculus
aggagagcacagcgttgaatctgcg

SEQ ID NO: 198030 - DNA, 25 bp, Mus musculus
aggagagcagctgctgaaagaccta

SEQ ID NO: 198031 - DNA, 25 bp, Mus musculus
aggagagcaggtcggcagctctgct

SEQ ID NO: 198032 - DNA, 25 bp, Mus musculus
aggagagccaacagatgaagaaaca

SEQ ID NO: 198033 - DNA, 25 bp, Mus musculus
aggagagccaggcttagaatcagac

SEQ ID NO: 198034 - DNA, 25 bp, Mus musculus
aggagagccaggttctcgaggccct

SEQ ID NO: 198035 - DNA, 25 bp, Mus musculus
aggagagcctgggcccccagattgc

SEQ ID NO: 198036 - DNA, 25 bp, Mus musculus
aggagagcctgtgtgctgatatttt

SEQ ID NO: 198037 - DNA, 25 bp, Mus musculus
aggagagcgagatttcaacaagaaa

SEQ ID NO: 198038 - DNA, 25 bp, Mus musculus
aggagagcgagtctgcggtgtggga

SEQ ID NO: 198039 - DNA, 25 bp, Mus musculus
aggagagctgaggcacctccaagtg

SEQ ID NO: 198040 - DNA, 25 bp, Mus musculus
aggagagctgggtcgcccaatgagg

SEQ ID NO: 198041 - DNA, 25 bp, Mus musculus
aggagaggaaaaacagagagagaga

SEQ ID NO: 198042 - DNA, 25 bp, Mus musculus
aggagaggcagactggtgccctggg

SEQ ID NO: 198043 - DNA, 25 bp, Mus musculus
aggagaggcgcaggcggaggtcaga

SEQ ID NO: 198044 - DNA, 25 bp, Mus musculus
aggagaggctggtgcacaaggtcct

SEQ ID NO: 198045 - DNA, 25 bp, Mus musculus
aggagagggaaaggtctgaaaagga

SEQ ID NO: 198046 - DNA, 25 bp, Mus musculus
aggagagggaagtccagcggtggtg

SEQ ID NO: 198047 - DNA, 25 bp, Mus musculus
aggagagggggaggcatttgcaggc

SEQ ID NO: 198048 - DNA, 25 bp, Mus musculus
aggagaggtgtgaaggcatttgtgg

SEQ ID NO: 198049 - DNA, 25 bp, Mus musculus
aggagaggtttggagaagcctgaaa

SEQ ID NO: 198050 - DNA, 25 bp, Mus musculus
aggagaggtttgggaaaagcttgtt

SEQ ID NO: 198051 - DNA, 25 bp, Mus musculus
aggagagtcacagctaaagaacgct

SEQ ID NO: 198052 - DNA, 25 bp, Mus musculus
aggagagtcgggtgttaggagcaac

SEQ ID NO: 198053 - DNA, 25 bp, Mus musculus
aggagagtgagccaaggagatggag

SEQ ID NO: 198054 - DNA, 25 bp, Mus musculus
aggagagtgaggaagaagacgatga

SEQ ID NO: 198055 - DNA, 25 bp, Mus musculus
aggagagtgaggtgctggtaactca

SEQ ID NO: 198056 - DNA, 25 bp, Mus musculus
aggagagtggaaggggttccatgat

SEQ ID NO: 198057 - DNA, 25 bp, Mus musculus
aggagataaaaggacggactgtggc

SEQ ID NO: 198058 - DNA, 25 bp, Mus musculus
aggagataaagggcagtcattcaat

SEQ ID NO: 198059 - DNA, 25 bp, Mus musculus
aggagataaaggggagatccctgac

SEQ ID NO: 198060 - DNA, 25 bp, Mus musculus
aggagatataccaggtgaacctgag

SEQ ID NO: 198061 - DNA, 25 bp, Mus musculus
aggagatataccagtccggttctcc

SEQ ID NO: 198062 - DNA, 25 bp, Mus musculus
aggagatatgagcaacaaaagcggt

SEQ ID NO: 198063 - DNA, 25 bp, Mus musculus
aggagatatgcgcaacaaaagcggt

SEQ ID NO: 198064 - DNA, 25 bp, Mus musculus
aggagatattggtccttcattccag

SEQ ID NO: 198065 - DNA, 25 bp, Mus musculus
aggagatcaagaggatagataggtt

SEQ ID NO: 198066 - DNA, 25 bp, Mus musculus
aggagatcaaggacttgcaccagag

SEQ ID NO: 198067 - DNA, 25 bp, Mus musculus
aggagatcaatcgggagttcctctg

SEQ ID NO: 198068 - DNA, 25 bp, Mus musculus
aggagatcagggcatcacaggtcct

SEQ ID NO: 198069 - DNA, 25 bp, Mus musculus
aggagatcagggtctgatgtttggc

SEQ ID NO: 198070 - DNA, 25 bp, Mus musculus
aggagatcaggtaatcacaggtcct

SEQ ID NO: 198071 - DNA, 25 bp, Mus musculus
aggagatcatgcctcccgcagcaac

SEQ ID NO: 198072 - DNA, 25 bp, Mus musculus
aggagatccaggagtggtacgagga

SEQ ID NO: 198073 - DNA, 25 bp, Mus musculus
aggagatccgagagactacaggagc

SEQ ID NO: 198074 - DNA, 25 bp, Mus musculus
aggagatcctcctagcccacagacg

SEQ ID NO: 198075 - DNA, 25 bp, Mus musculus
aggagatcgagggcctgatctcagc

SEQ ID NO: 198076 - DNA, 25 bp, Mus musculus
aggagatcgcaggggtgccttctgt

SEQ ID NO: 198077 - DNA, 25 bp, Mus musculus
aggagatgaaatcaagaatctcgat

SEQ ID NO: 198078 - DNA, 25 bp, Mus musculus
aggagatgaagaaatccatgcgaca

SEQ ID NO: 198079 - DNA, 25 bp, Mus musculus
aggagatgaagggttggtgaaattc

SEQ ID NO: 198080 - DNA, 25 bp, Mus musculus
aggagatgaagtgataattatggtg

SEQ ID NO: 198081 - DNA, 25 bp, Mus musculus
aggagatgagattagcattaagaag

SEQ ID NO: 198082 - DNA, 25 bp, Mus musculus
aggagatgagattgactgggaaaca

SEQ ID NO: 198083 - DNA, 25 bp, Mus musculus
aggagatgagcaggagccggccccg

SEQ ID NO: 198084 - DNA, 25 bp, Mus musculus
aggagatgccccagctgaaaaaaaa

SEQ ID NO: 198085 - DNA, 25 bp, Mus musculus
aggagatgccccagctgagaaaaaa

SEQ ID NO: 198086 - DNA, 25 bp, Mus musculus
aggagatgcctgatcaacatgacac

SEQ ID NO: 198087 - DNA, 25 bp, Mus musculus
aggagatgcggtggacaccaaagtg

SEQ ID NO: 198088 - DNA, 25 bp, Mus musculus
aggagatgcggtggtggtacgcctg

SEQ ID NO: 198089 - DNA, 25 bp, Mus musculus
aggagatgcttggtactacatgagg

SEQ ID NO: 198090 - DNA, 25 bp, Mus musculus
aggagatggaggcaaccaaactgaa

SEQ ID NO: 198091 - DNA, 25 bp, Mus musculus
aggagatgtgggagcgagaggcgtc

SEQ ID NO: 198092 - DNA, 25 bp, Mus musculus
aggagattccagcctccaccgtcgt

SEQ ID NO: 198093 - DNA, 25 bp, Mus musculus
aggagattccagtactacagagcca

SEQ ID NO: 198094 - DNA, 25 bp, Mus musculus
aggagattctgagaccttgctacat

SEQ ID NO: 198095 - DNA, 25 bp, Mus musculus
aggagattctgaggcgaatggaccc

SEQ ID NO: 198096 - DNA, 25 bp, Mus musculus
aggagattgagaagtggatgactac

SEQ ID NO: 198097 - DNA, 25 bp, Mus musculus
aggagattgagaagtttctagatcc

SEQ ID NO: 198098 - DNA, 25 bp, Mus musculus
aggagattgcagaggcccagcagct

SEQ ID NO: 198099 - DNA, 25 bp, Mus musculus
aggagattgcccaggatgccctgaa

SEQ ID NO: 198100 - DNA, 25 bp, Mus musculus
aggagattttgaaagacaagaagct

SEQ ID NO: 198101 - DNA, 25 bp, Mus musculus
aggagcaaaagccagagcccaggct

SEQ ID NO: 198102 - DNA, 25 bp, Mus musculus
aggagcaaaagccagtgttggaggt

SEQ ID NO: 198103 - DNA, 25 bp, Mus musculus
aggagcaaacggaagcgagaaaaca

SEQ ID NO: 198104 - DNA, 25 bp, Mus musculus
aggagcaacacagggactattccaa

SEQ ID NO: 198105 - DNA, 25 bp, Mus musculus
aggagcaacagcggcaacctttggc

SEQ ID NO: 198106 - DNA, 25 bp, Mus musculus
aggagcaacaggaggacttcaagga

SEQ ID NO: 198107 - DNA, 25 bp, Mus musculus
aggagcaaccagagagcaccgtact

SEQ ID NO: 198108 - DNA, 25 bp, Mus musculus
aggagcaaccagagcacctgtctcc

SEQ ID NO: 198109 - DNA, 25 bp, Mus musculus
aggagcaacgtcagggctacacatc

SEQ ID NO: 198110 - DNA, 25 bp, Mus musculus
aggagcaacgtcaggtaagaatgac

SEQ ID NO: 198111 - DNA, 25 bp, Mus musculus
aggagcaagaagcagcaaagctggc

SEQ ID NO: 198112 - DNA, 25 bp, Mus musculus
aggagcaaggggtcagccaggggca

SEQ ID NO: 198113 - DNA, 25 bp, Mus musculus
aggagcaattcaaggtattcacact

SEQ ID NO: 198114 - DNA, 25 bp, Mus musculus
aggagcacagatctgggagccgcaa

SEQ ID NO: 198115 - DNA, 25 bp, Mus musculus
aggagcacaggaagattcatgagat

SEQ ID NO: 198116 - DNA, 25 bp, Mus musculus
aggagcacaggaccatcagaatcca

SEQ ID NO: 198117 - DNA, 25 bp, Mus musculus
aggagcacatcaaggaacttctagc

SEQ ID NO: 198118 - DNA, 25 bp, Mus musculus
aggagcacatcaagttacaacagga

SEQ ID NO: 198119 - DNA, 25 bp, Mus musculus
aggagcacctaagggcagccagtcc

SEQ ID NO: 198120 - DNA, 25 bp, Mus musculus
aggagcacctaagggtgctggagag

SEQ ID NO: 198121 - DNA, 25 bp, Mus musculus
aggagcacgataaggaagagcggat

SEQ ID NO: 198122 - DNA, 25 bp, Mus musculus
aggagcagaaggtatatgtggttgc

SEQ ID NO: 198123 - DNA, 25 bp, Mus musculus
aggagcagacatcagaaaccttaca

SEQ ID NO: 198124 - DNA, 25 bp, Mus musculus
aggagcagacatcagataatggagg

SEQ ID NO: 198125 - DNA, 25 bp, Mus musculus
aggagcagagagtgacaacagtgct

SEQ ID NO: 198126 - DNA, 25 bp, Mus musculus
aggagcagagatcatagcagtctgc

SEQ ID NO: 198127 - DNA, 25 bp, Mus musculus
aggagcagaggctcatctacctgcc

SEQ ID NO: 198128 - DNA, 25 bp, Mus musculus
aggagcagaggctgtgtgaaggcgt

SEQ ID NO: 198129 - DNA, 25 bp, Mus musculus
aggagcagagggggatgccccatac

SEQ ID NO: 198130 - DNA, 25 bp, Mus musculus
aggagcagagtcaggagcgcagggc

SEQ ID NO: 198131 - DNA, 25 bp, Mus musculus
aggagcagagtcagggaccaggact

SEQ ID NO: 198132 - DNA, 25 bp, Mus musculus
aggagcagcacaaggccgaggccgt

SEQ ID NO: 198133 - DNA, 25 bp, Mus musculus
aggagcagcccggacaccaaggact

SEQ ID NO: 198134 - DNA, 25 bp, Mus musculus
aggagcagcgggtttattgcctaga

SEQ ID NO: 198135 - DNA, 25 bp, Mus musculus
aggagcagctagagattgcgctggc

SEQ ID NO: 198136 - DNA, 25 bp, Mus musculus
aggagcagctgacaggtctgatccc

SEQ ID NO: 198137 - DNA, 25 bp, Mus musculus
aggagcagctgcccagagcataaat

SEQ ID NO: 198138 - DNA, 25 bp, Mus musculus
aggagcagctggctgcagagctggc

SEQ ID NO: 198139 - DNA, 25 bp, Mus musculus
aggagcagctgtggggttccacagc

SEQ ID NO: 198140 - DNA, 25 bp, Mus musculus
aggagcagcttggctatattgtctt

SEQ ID NO: 198141 - DNA, 25 bp, Mus musculus
aggagcaggaaaaggtggtcactaa

SEQ ID NO: 198142 - DNA, 25 bp, Mus musculus
aggagcaggacatggctgccaactg

SEQ ID NO: 198143 - DNA, 25 bp, Mus musculus
aggagcaggatgagagcagacactg

SEQ ID NO: 198144 - DNA, 25 bp, Mus musculus
aggagcaggatgaggaggaagatga

SEQ ID NO: 198145 - DNA, 25 bp, Mus musculus
aggagcaggccaaggccaaggctgc

SEQ ID NO: 198146 - DNA, 25 bp, Mus musculus
aggagcagtctcatggagccagatc

SEQ ID NO: 198147 - DNA, 25 bp, Mus musculus
aggagcagtgaaatatttcagcggc

SEQ ID NO: 198148 - DNA, 25 bp, Mus musculus
aggagcagtgaggtaatgacagagc

SEQ ID NO: 198149 - DNA, 25 bp, Mus musculus
aggagcagttgtttgtctgccagga

SEQ ID NO: 198150 - DNA, 25 bp, Mus musculus
aggagcataactcaggtccaaaggc

SEQ ID NO: 198151 - DNA, 25 bp, Mus musculus
aggagcatcagaatttcagatgaca

SEQ ID NO: 198152 - DNA, 25 bp, Mus musculus
aggagcatcagattccagaatttga

SEQ ID NO: 198153 - DNA, 25 bp, Mus musculus
aggagcatccgtgaggtatttgaat

SEQ ID NO: 198154 - DNA, 25 bp, Mus musculus
aggagcatcctggtccagggctaag

SEQ ID NO: 198155 - DNA, 25 bp, Mus musculus
aggagcatcgagctggaatacgtct

SEQ ID NO: 198156 - DNA, 25 bp, Mus musculus
aggagcatctcaagcaaaacgaaga

SEQ ID NO: 198157 - DNA, 25 bp, Mus musculus
aggagcatctcaagcccaagcagta

SEQ ID NO: 198158 - DNA, 25 bp, Mus musculus
aggagcatgcgcaggtggtggagct

SEQ ID NO: 198159 - DNA, 25 bp, Mus musculus
aggagcatttcctcacaacaaacaa

SEQ ID NO: 198160 - DNA, 25 bp, Mus musculus
aggagcatttcctcacctccatctg

SEQ ID NO: 198161 - DNA, 25 bp, Mus musculus
aggagcattttgagaaagcaattga

SEQ ID NO: 198162 - DNA, 25 bp, Mus musculus
aggagcattttgaggttttctctgt

SEQ ID NO: 198163 - DNA, 25 bp, Mus musculus
aggagccaaactaggaaatgccgct

SEQ ID NO: 198164 - DNA, 25 bp, Mus musculus
aggagccaagagctatgagccagaa

SEQ ID NO: 198165 - DNA, 25 bp, Mus musculus
aggagccaagaggagtgaatggtgt

SEQ ID NO: 198166 - DNA, 25 bp, Mus musculus
aggagccaagaggggtctccaatga

SEQ ID NO: 198167 - DNA, 25 bp, Mus musculus
aggagccaagagtgaagaacaatcc

SEQ ID NO: 198168 - DNA, 25 bp, Mus musculus
aggagccaaggagatcgttgtccaa

SEQ ID NO: 198169 - DNA, 25 bp, Mus musculus
aggagccaatatctatctactactc

SEQ ID NO: 198170 - DNA, 25 bp, Mus musculus
aggagccaccaggttgacagacaag

SEQ ID NO: 198171 - DNA, 25 bp, Mus musculus
aggagccagaagcgacttgaagaga

SEQ ID NO: 198172 - DNA, 25 bp, Mus musculus
aggagccagcaggtctattttgtgg

SEQ ID NO: 198173 - DNA, 25 bp, Mus musculus
aggagccagcaggtggagcacgccc

SEQ ID NO: 198174 - DNA, 25 bp, Mus musculus
aggagccagcttcagattcccagga

SEQ ID NO: 198175 - DNA, 25 bp, Mus musculus
aggagccaggaccaggctttcttga

SEQ ID NO: 198176 - DNA, 25 bp, Mus musculus
aggagccagggatgccctgctggca

SEQ ID NO: 198177 - DNA, 25 bp, Mus musculus
aggagccagtgcagcctggagatgc

SEQ ID NO: 198178 - DNA, 25 bp, Mus musculus
aggagccagtgcaggcaggatctct

SEQ ID NO: 198179 - DNA, 25 bp, Mus musculus
aggagccagtgcaggcgcctcattg

SEQ ID NO: 198180 - DNA, 25 bp, Mus musculus
aggagcccaggccggctcaacatta

SEQ ID NO: 198181 - DNA, 25 bp, Mus musculus
aggagcccagggaagtggctacaga

SEQ ID NO: 198182 - DNA, 25 bp, Mus musculus
aggagcccagtgagcacttgcaggt

SEQ ID NO: 198183 - DNA, 25 bp, Mus musculus
aggagcccatatccatgttccagcc

SEQ ID NO: 198184 - DNA, 25 bp, Mus musculus
aggagccccgcagggccagttcctg

SEQ ID NO: 198185 - DNA, 25 bp, Mus musculus
aggagcccctcggatgttctctatg

SEQ ID NO: 198186 - DNA, 25 bp, Mus musculus
aggagcccgagacagggactattcc

SEQ ID NO: 198187 - DNA, 25 bp, Mus musculus
aggagccctgcaggtactccctggc

SEQ ID NO: 198188 - DNA, 25 bp, Mus musculus
aggagccctgccacattgtccaagg

SEQ ID NO: 198189 - DNA, 25 bp, Mus musculus
aggagccctgtgcttgatgggcggc

SEQ ID NO: 198190 - DNA, 25 bp, Mus musculus
aggagccgagtgcagttcctccatc

SEQ ID NO: 198191 - DNA, 25 bp, Mus musculus
aggagccgctggcttacagggttcc

SEQ ID NO: 198192 - DNA, 25 bp, Mus musculus
aggagccggaaaggcggaggccagg

SEQ ID NO: 198193 - DNA, 25 bp, Mus musculus
aggagcctaaggaaccacgggaagg

SEQ ID NO: 198194 - DNA, 25 bp, Mus musculus
aggagcctcgagcatttagctcctc

SEQ ID NO: 198195 - DNA, 25 bp, Mus musculus
aggagcctgaaccgcccgttgaccg

SEQ ID NO: 198196 - DNA, 25 bp, Mus musculus
aggagcctgtagaccaggatggaaa

SEQ ID NO: 198197 - DNA, 25 bp, Mus musculus
aggagcctgttttggacccaacaga

SEQ ID NO: 198198 - DNA, 25 bp, Mus musculus
aggagcgaaagtgacaccagcagtc

SEQ ID NO: 198199 - DNA, 25 bp, Mus musculus
aggagcgagaccctgatctggggga

SEQ ID NO: 198200 - DNA, 25 bp, Mus musculus
aggagcgagagtaccccaggctggc

SEQ ID NO: 198201 - DNA, 25 bp, Mus musculus
aggagcgagagtttccactgtatcc

SEQ ID NO: 198202 - DNA, 25 bp, Mus musculus
aggagcgagcccagcaggaagatgc

SEQ ID NO: 198203 - DNA, 25 bp, Mus musculus
aggagcgagcccaggcaagaagaca

SEQ ID NO: 198204 - DNA, 25 bp, Mus musculus
aggagcgcagaaggctgagaccgct

SEQ ID NO: 198205 - DNA, 25 bp, Mus musculus
aggagcgcaggggccccacctgtca

SEQ ID NO: 198206 - DNA, 25 bp, Mus musculus
aggagcgcaggttcctcatgagggt

SEQ ID NO: 198207 - DNA, 25 bp, Mus musculus
aggagcgcaggttgtgtcaccaaca

SEQ ID NO: 198208 - DNA, 25 bp, Mus musculus
aggagcgcatgaggagccgagagga

SEQ ID NO: 198209 - DNA, 25 bp, Mus musculus
aggagcggacgtgacgtatgacttc

SEQ ID NO: 198210 - DNA, 25 bp, Mus musculus
aggagcggcaaaagagctttatgga

SEQ ID NO: 198211 - DNA, 25 bp, Mus musculus
aggagcggcaaaagagtgatagaag

SEQ ID NO: 198212 - DNA, 25 bp, Mus musculus
aggagcggcacatttgacctgctgg

SEQ ID NO: 198213 - DNA, 25 bp, Mus musculus
aggagcggcaggtaactgtagctgt

SEQ ID NO: 198214 - DNA, 25 bp, Mus musculus
aggagcggcagtctcagagagaagc

SEQ ID NO: 198215 - DNA, 25 bp, Mus musculus
aggagcgggcaggatcctcttcgct

SEQ ID NO: 198216 - DNA, 25 bp, Mus musculus
aggagcgggcaggggcctccctgtg

SEQ ID NO: 198217 - DNA, 25 bp, Mus musculus
aggagcggtgtcctgtgccatctct

SEQ ID NO: 198218 - DNA, 25 bp, Mus musculus
aggagcggttcacgtctgtgacgag

SEQ ID NO: 198219 - DNA, 25 bp, Mus musculus
aggagcggttcaggtctgtgacgag

SEQ ID NO: 198220 - DNA, 25 bp, Mus musculus
aggagcggttgcagacggcacgacc

SEQ ID NO: 198221 - DNA, 25 bp, Mus musculus
aggagcggttgcaggcctggcgtcc

SEQ ID NO: 198222 - DNA, 25 bp, Mus musculus
aggagctaaagatccttcgtaccta

SEQ ID NO: 198223 - DNA, 25 bp, Mus musculus
aggagctaaagttctccctgggcag

SEQ ID NO: 198224 - DNA, 25 bp, Mus musculus
aggagctacggaggaggcaaaaaac

SEQ ID NO: 198225 - DNA, 25 bp, Mus musculus
aggagctacggatagcgaggttgca

SEQ ID NO: 198226 - DNA, 25 bp, Mus musculus
aggagctagagaactacatggaccc

SEQ ID NO: 198227 - DNA, 25 bp, Mus musculus
aggagctagtgcaaaactgccagtg

SEQ ID NO: 198228 - DNA, 25 bp, Mus musculus
aggagctcaacaagactgcaagtgg

SEQ ID NO: 198229 - DNA, 25 bp, Mus musculus
aggagctcaacgagctggactacta

SEQ ID NO: 198230 - DNA, 25 bp, Mus musculus
aggagctcacagcagagaaggagat

SEQ ID NO: 198231 - DNA, 25 bp, Mus musculus
aggagctcacaggagagaaggagat

SEQ ID NO: 198232 - DNA, 25 bp, Mus musculus
aggagctcagaaggagtgaaaaggc

SEQ ID NO: 198233 - DNA, 25 bp, Mus musculus
aggagctcagcaagtattcgactca

SEQ ID NO: 198234 - DNA, 25 bp, Mus musculus
aggagctcatgaaggagctctttga

SEQ ID NO: 198235 - DNA, 25 bp, Mus musculus
aggagctcatgaaggctctggtctc

SEQ ID NO: 198236 - DNA, 25 bp, Mus musculus
aggagctccgagaggagacattcca

SEQ ID NO: 198237 - DNA, 25 bp, Mus musculus
aggagctccgagaggtagctctggc

SEQ ID NO: 198238 - DNA, 25 bp, Mus musculus
aggagctccggcaaatcagccacac

SEQ ID NO: 198239 - DNA, 25 bp, Mus musculus
aggagctcgaagcagaatcagagaa

SEQ ID NO: 198240 - DNA, 25 bp, Mus musculus
aggagctcgagaacttcaagttgga

SEQ ID NO: 198241 - DNA, 25 bp, Mus musculus
aggagctcgccaaggctggctggct

SEQ ID NO: 198242 - DNA, 25 bp, Mus musculus
aggagctctaccagaacctgacccg

SEQ ID NO: 198243 - DNA, 25 bp, Mus musculus
aggagctctgaggtctacgctcagc

SEQ ID NO: 198244 - DNA, 25 bp, Mus musculus
aggagctctgggaacctcctctggg

SEQ ID NO: 198245 - DNA, 25 bp, Mus musculus
aggagctctggggcccagcaacctc

SEQ ID NO: 198246 - DNA, 25 bp, Mus musculus
aggagctctgtggtctacgctcagc

SEQ ID NO: 198247 - DNA, 25 bp, Mus musculus
aggagctcttcctgggcctctccaa

SEQ ID NO: 198248 - DNA, 25 bp, Mus musculus
aggagctgaaagcactgacacacag

SEQ ID NO: 198249 - DNA, 25 bp, Mus musculus
aggagctgaaagcagggtgtggaca

SEQ ID NO: 198250 - DNA, 25 bp, Mus musculus
aggagctgaaagggactgccctgta

SEQ ID NO: 198251 - DNA, 25 bp, Mus musculus
aggagctgaacaagtactctacgca

SEQ ID NO: 198252 - DNA, 25 bp, Mus musculus
aggagctgaagaaggcgccctttgt

SEQ ID NO: 198253 - DNA, 25 bp, Mus musculus
aggagctgaagaaggtggctgctgg

SEQ ID NO: 198254 - DNA, 25 bp, Mus musculus
aggagctgaattcagaggtggcgag

SEQ ID NO: 198255 - DNA, 25 bp, Mus musculus
aggagctgacagatgaggaaactga

SEQ ID NO: 198256 - DNA, 25 bp, Mus musculus
aggagctgacaggcagtatctgaac

SEQ ID NO: 198257 - DNA, 25 bp, Mus musculus
aggagctgacaggggttccacagca

SEQ ID NO: 198258 - DNA, 25 bp, Mus musculus
aggagctgagctgtagccctcatgc

SEQ ID NO: 198259 - DNA, 25 bp, Mus musculus
aggagctgaggagagaacattgaaa

SEQ ID NO: 198260 - DNA, 25 bp, Mus musculus
aggagctgaggtgggctggtatgtc

SEQ ID NO: 198261 - DNA, 25 bp, Mus musculus
aggagctgagtgataacattcagca

SEQ ID NO: 198262 - DNA, 25 bp, Mus musculus
aggagctgagtgattttgaggaagt

SEQ ID NO: 198263 - DNA, 25 bp, Mus musculus
aggagctgcacaagtcacgggtcac

SEQ ID NO: 198264 - DNA, 25 bp, Mus musculus
aggagctgcaggagaagaggaggag

SEQ ID NO: 198265 - DNA, 25 bp, Mus musculus
aggagctgccagaaaagcctttggc

SEQ ID NO: 198266 - DNA, 25 bp, Mus musculus
aggagctgctccagagaatgacgga

SEQ ID NO: 198267 - DNA, 25 bp, Mus musculus
aggagctgctgaggaacttgtatga

SEQ ID NO: 198268 - DNA, 25 bp, Mus musculus
aggagctgctggagtgggaactggt

SEQ ID NO: 198269 - DNA, 25 bp, Mus musculus
aggagctgctgttccaggtgctgct

SEQ ID NO: 198270 - DNA, 25 bp, Mus musculus
aggagctggagagaaaaatatcagg

SEQ ID NO: 198271 - DNA, 25 bp, Mus musculus
aggagctggagaggaaagccataga

SEQ ID NO: 198272 - DNA, 25 bp, Mus musculus
aggagctggaggaggtgcgctccaa

SEQ ID NO: 198273 - DNA, 25 bp, Mus musculus
aggagctggaggttgcgagaacatg

SEQ ID NO: 198274 - DNA, 25 bp, Mus musculus
aggagctggcactgccctttttacg

SEQ ID NO: 198275 - DNA, 25 bp, Mus musculus
aggagctgggccaggagctgaagga

SEQ ID NO: 198276 - DNA, 25 bp, Mus musculus
aggagctgggcttgcaggcaagggc

SEQ ID NO: 198277 - DNA, 25 bp, Mus musculus
aggagctgggctttgactacggtga

SEQ ID NO: 198278 - DNA, 25 bp, Mus musculus
aggagctgggtcaggtggccactct

SEQ ID NO: 198279 - DNA, 25 bp, Mus musculus
aggagctggtccgagggctactgac

SEQ ID NO: 198280 - DNA, 25 bp, Mus musculus
aggagctgtataaggtacatttgaa

SEQ ID NO: 198281 - DNA, 25 bp, Mus musculus
aggagctgttcagagtaggtggcga

SEQ ID NO: 198282 - DNA, 25 bp, Mus musculus
aggagcttaacaggcaaacattctg

SEQ ID NO: 198283 - DNA, 25 bp, Mus musculus
aggagcttaacagtttggaatggtc

SEQ ID NO: 198284 - DNA, 25 bp, Mus musculus
aggagcttacgtagatgaagaactt

SEQ ID NO: 198285 - DNA, 25 bp, Mus musculus
aggagcttacgtaggctccatggtg

SEQ ID NO: 198286 - DNA, 25 bp, Mus musculus
aggagcttagtgctttgggctccga

SEQ ID NO: 198287 - DNA, 25 bp, Mus musculus
aggagcttcaggcacgcatcgagga

SEQ ID NO: 198288 - DNA, 25 bp, Mus musculus
aggagcttcatgggaggatccaaag

SEQ ID NO: 198289 - DNA, 25 bp, Mus musculus
aggagcttgaggcgggcagggagct

SEQ ID NO: 198290 - DNA, 25 bp, Mus musculus
aggagcttgctaatgacggtgcagg

SEQ ID NO: 198291 - DNA, 25 bp, Mus musculus
aggagctttactgaagactgttttt

SEQ ID NO: 198292 - DNA, 25 bp, Mus musculus
aggagctttgaggaaagatcaaact

SEQ ID NO: 198293 - DNA, 25 bp, Mus musculus
aggagctttgaggaagttatcaaca

SEQ ID NO: 198294 - DNA, 25 bp, Mus musculus
aggagctttgccaggaatctggtct

SEQ ID NO: 198295 - DNA, 25 bp, Mus musculus
aggagctttgttttttgccatctct

SEQ ID NO: 198296 - DNA, 25 bp, Mus musculus
aggaggaaaagccgcacatgcctac

SEQ ID NO: 198297 - DNA, 25 bp, Mus musculus
aggaggaaaaggaggagtcagacac

SEQ ID NO: 198298 - DNA, 25 bp, Mus musculus
aggaggaaaaggcatgaggatcgtt

SEQ ID NO: 198299 - DNA, 25 bp, Mus musculus
aggaggaaaatgggatggagacaac

SEQ ID NO: 198300 - DNA, 25 bp, Mus musculus
aggaggaaaatggtgaggaggttgg

SEQ ID NO: 198301 - DNA, 25 bp, Mus musculus
aggaggaaaggacccaggagagcat

SEQ ID NO: 198302 - DNA, 25 bp, Mus musculus
aggaggaacacagagttcagaaaga

SEQ ID NO: 198303 - DNA, 25 bp, Mus musculus
aggaggaacacaggattgagctgac

SEQ ID NO: 198304 - DNA, 25 bp, Mus musculus
aggaggaacttaaggtgagggtgga

SEQ ID NO: 198305 - DNA, 25 bp, Mus musculus
aggaggaagaaaagcactgcccctc

SEQ ID NO: 198306 - DNA, 25 bp, Mus musculus
aggaggaagaaaagtggccctgtct

SEQ ID NO: 198307 - DNA, 25 bp, Mus musculus
aggaggaagagagacgggtccagtg

SEQ ID NO: 198308 - DNA, 25 bp, Mus musculus
aggaggaagaggctcacgaggccct

SEQ ID NO: 198309 - DNA, 25 bp, Mus musculus
aggaggaagagttaacactcacgat

SEQ ID NO: 198310 - DNA, 25 bp, Mus musculus
aggaggaagatgaccgttcacctgc

SEQ ID NO: 198311 - DNA, 25 bp, Mus musculus
aggaggaagcagagggctgagcccc

SEQ ID NO: 198312 - DNA, 25 bp, Mus musculus
aggaggaaggcaaggccaagaacgc

SEQ ID NO: 198313 - DNA, 25 bp, Mus musculus
aggaggaagtggagggactgaactt

SEQ ID NO: 198314 - DNA, 25 bp, Mus musculus
aggaggaatgccctgctggaggcct

SEQ ID NO: 198315 - DNA, 25 bp, Mus musculus
aggaggaatggcctactgaaccaac

SEQ ID NO: 198316 - DNA, 25 bp, Mus musculus
aggaggacaaagaaatggtccttct

SEQ ID NO: 198317 - DNA, 25 bp, Mus musculus
aggaggacaaggagcgccatgaagc

SEQ ID NO: 198318 - DNA, 25 bp, Mus musculus
aggaggacaataaggagaagaagaa

SEQ ID NO: 198319 - DNA, 25 bp, Mus musculus
aggaggacactcaagtggctgatgt

SEQ ID NO: 198320 - DNA, 25 bp, Mus musculus
aggaggacactgaactcctacctgg

SEQ ID NO: 198321 - DNA, 25 bp, Mus musculus
aggaggacagatcttctatcgggca

SEQ ID NO: 198322 - DNA, 25 bp, Mus musculus
aggaggacagattaattgtggtgag

SEQ ID NO: 198323 - DNA, 25 bp, Mus musculus
aggaggacagcagtaccagcgctga

SEQ ID NO: 198324 - DNA, 25 bp, Mus musculus
aggaggacagcgagacggtcatctg

SEQ ID NO: 198325 - DNA, 25 bp, Mus musculus
aggaggacagctacaagcccatcgt

SEQ ID NO: 198326 - DNA, 25 bp, Mus musculus
aggaggacaggaaagattgttttct

SEQ ID NO: 198327 - DNA, 25 bp, Mus musculus
aggaggacaggaaagcccatgttac

SEQ ID NO: 198328 - DNA, 25 bp, Mus musculus
aggaggacaggaaaggtgtactcgg

SEQ ID NO: 198329 - DNA, 25 bp, Mus musculus
aggaggacaggacaaaagaggctgg

SEQ ID NO: 198330 - DNA, 25 bp, Mus musculus
aggaggaccctggggtcaagagtgt

SEQ ID NO: 198331 - DNA, 25 bp, Mus musculus
aggaggacctgcaggctgtgtggag

SEQ ID NO: 198332 - DNA, 25 bp, Mus musculus
aggaggacctggaggaaattatgga

SEQ ID NO: 198333 - DNA, 25 bp, Mus musculus
aggaggacctggaggtggcaatttt

SEQ ID NO: 198334 - DNA, 25 bp, Mus musculus
aggaggacgaggaagaggagaaacc

SEQ ID NO: 198335 - DNA, 25 bp, Mus musculus
aggaggacgaggtgctgctggtgag

SEQ ID NO: 198336 - DNA, 25 bp, Mus musculus
aggaggacggcatgccccccatcaa

SEQ ID NO: 198337 - DNA, 25 bp, Mus musculus
aggaggacggcatggagccgttggt

SEQ ID NO: 198338 - DNA, 25 bp, Mus musculus
aggaggacggcatgggctcaagccc

SEQ ID NO: 198339 - DNA, 25 bp, Mus musculus
aggaggagaaagagggtggagaggt

SEQ ID NO: 198340 - DNA, 25 bp, Mus musculus
aggaggagacagatgtgaggtgaga

SEQ ID NO: 198341 - DNA, 25 bp, Mus musculus
aggaggagacaggaaggcgtaggga

SEQ ID NO: 198342 - DNA, 25 bp, Mus musculus
aggaggagagacaaggcaagaaata

SEQ ID NO: 198343 - DNA, 25 bp, Mus musculus
aggaggagagacaaggggatgacaa

SEQ ID NO: 198344 - DNA, 25 bp, Mus musculus
aggaggagagatactgttatctgtt

SEQ ID NO: 198345 - DNA, 25 bp, Mus musculus
aggaggagagcaataaactggtctc

SEQ ID NO: 198346 - DNA, 25 bp, Mus musculus
aggaggagagcaattatgaagccct

SEQ ID NO: 198347 - DNA, 25 bp, Mus musculus
aggaggagagcaccaatggaacagt

SEQ ID NO: 198348 - DNA, 25 bp, Mus musculus
aggaggagaggctgtgacctctctt

SEQ ID NO: 198349 - DNA, 25 bp, Mus musculus
aggaggagagttgctcttctggatg

SEQ ID NO: 198350 - DNA, 25 bp, Mus musculus
aggaggagatccaggagtggtacga

SEQ ID NO: 198351 - DNA, 25 bp, Mus musculus
aggaggagcaaacggaagcgagaaa

SEQ ID NO: 198352 - DNA, 25 bp, Mus musculus
aggaggagcagacgggcagcgggca

SEQ ID NO: 198353 - DNA, 25 bp, Mus musculus
aggaggagcaggatatcctcactct

SEQ ID NO: 198354 - DNA, 25 bp, Mus musculus
aggaggagccaccaggttgacagac

SEQ ID NO: 198355 - DNA, 25 bp, Mus musculus
aggaggagccggagccgttggtatt

SEQ ID NO: 198356 - DNA, 25 bp, Mus musculus
aggaggagctaaagatccttcgtac

SEQ ID NO: 198357 - DNA, 25 bp, Mus musculus
aggaggagctaaagttctccctggg

SEQ ID NO: 198358 - DNA, 25 bp, Mus musculus
aggaggagctgacagatgaggaaac

SEQ ID NO: 198359 - DNA, 25 bp, Mus musculus
aggaggagctgcagttctccctggg

SEQ ID NO: 198360 - DNA, 25 bp, Mus musculus
aggaggagctggagcacagccagga

SEQ ID NO: 198361 - DNA, 25 bp, Mus musculus
aggaggaggaaaagccgcacatgcc

SEQ ID NO: 198362 - DNA, 25 bp, Mus musculus
aggaggaggacactgaactcctacc

SEQ ID NO: 198363 - DNA, 25 bp, Mus musculus
aggaggaggagccggagccgttggt

SEQ ID NO: 198364 - DNA, 25 bp, Mus musculus
aggaggaggaggaggaggctccgcc

SEQ ID NO: 198365 - DNA, 25 bp, Mus musculus
aggaggaggaggaggagtaggagga

SEQ ID NO: 198366 - DNA, 25 bp, Mus musculus
aggaggaggaggaggctccgccccc

SEQ ID NO: 198367 - DNA, 25 bp, Mus musculus
aggaggaggagggcagaaggctgga

SEQ ID NO: 198368 - DNA, 25 bp, Mus musculus
aggaggaggagtcaagttggaccca

SEQ ID NO: 198369 - DNA, 25 bp, Mus musculus
aggaggaggagtcagatgatctagc

SEQ ID NO: 198370 - DNA, 25 bp, Mus musculus
aggaggaggagtcagtgcaagggcc

SEQ ID NO: 198371 - DNA, 25 bp, Mus musculus
aggaggaggatggcttccgcctttt

SEQ ID NO: 198372 - DNA, 25 bp, Mus musculus
aggaggaggcagagcgcccgctgca

SEQ ID NO: 198373 - DNA, 25 bp, Mus musculus
aggaggaggccgaagaagcacttaa

SEQ ID NO: 198374 - DNA, 25 bp, Mus musculus
aggaggaggcgcgggctgtggagga

SEQ ID NO: 198375 - DNA, 25 bp, Mus musculus
aggaggaggctgagatccagccgca

SEQ ID NO: 198376 - DNA, 25 bp, Mus musculus
aggaggagggaaggacaggcctggc

SEQ ID NO: 198377 - DNA, 25 bp, Mus musculus
aggaggaggtcaaggccaagaacgc

SEQ ID NO: 198378 - DNA, 25 bp, Mus musculus
aggaggagtcagatgatctagcact

SEQ ID NO: 198379 - DNA, 25 bp, Mus musculus
aggaggagtcagtgcaagggccatc

SEQ ID NO: 198380 - DNA, 25 bp, Mus musculus
aggaggatcaaggaactgcattggg

SEQ ID NO: 198381 - DNA, 25 bp, Mus musculus
aggaggatgaaggccattcaaactc

SEQ ID NO: 198382 - DNA, 25 bp, Mus musculus
aggaggatgaagggaaaatgtttat

SEQ ID NO: 198383 - DNA, 25 bp, Mus musculus
aggaggatgaggatggtgggcattg

SEQ ID NO: 198384 - DNA, 25 bp, Mus musculus
aggaggatgaggattttgattgggt

SEQ ID NO: 198385 - DNA, 25 bp, Mus musculus
aggaggatggatcagacagaaagtg

SEQ ID NO: 198386 - DNA, 25 bp, Mus musculus
aggaggattactgtccagtttgatg

SEQ ID NO: 198387 - DNA, 25 bp, Mus musculus
aggaggattgtgacctgcctgttca

SEQ ID NO: 198388 - DNA, 25 bp, Mus musculus
aggaggatttgagttttaagctata

SEQ ID NO: 198389 - DNA, 25 bp, Mus musculus
aggaggcaaagatttttatcaccgt

SEQ ID NO: 198390 - DNA, 25 bp, Mus musculus
aggaggcaaggcaagaggaagaata

SEQ ID NO: 198391 - DNA, 25 bp, Mus musculus
aggaggcaaggcaagtacccagtgg

SEQ ID NO: 198392 - DNA, 25 bp, Mus musculus
aggaggcacggagcacttgtctctg

SEQ ID NO: 198393 - DNA, 25 bp, Mus musculus
aggaggcagaagcctcacaggcctc

SEQ ID NO: 198394 - DNA, 25 bp, Mus musculus
aggaggcagagagtgctacaataac

SEQ ID NO: 198395 - DNA, 25 bp, Mus musculus
aggaggcagagggaagacttgccag

SEQ ID NO: 198396 - DNA, 25 bp, Mus musculus
aggaggcagaggtaagaaagtgctc

SEQ ID NO: 198397 - DNA, 25 bp, Mus musculus
aggaggcagaggtccctggctgcat

SEQ ID NO: 198398 - DNA, 25 bp, Mus musculus
aggaggcagtaggacttagaagagt

SEQ ID NO: 198399 - DNA, 25 bp, Mus musculus
aggaggcagtcttggattacctgtt

SEQ ID NO: 198400 - DNA, 25 bp, Mus musculus
aggaggccaagcctttcatcaccta

SEQ ID NO: 198401 - DNA, 25 bp, Mus musculus
aggaggccacaagatatcagtatta

SEQ ID NO: 198402 - DNA, 25 bp, Mus musculus
aggaggccacaagcctacttggagg

SEQ ID NO: 198403 - DNA, 25 bp, Mus musculus
aggaggccacagcaggtttccactg

SEQ ID NO: 198404 - DNA, 25 bp, Mus musculus
aggaggccatgagcataccaacatt

SEQ ID NO: 198405 - DNA, 25 bp, Mus musculus
aggaggccatgagcatccagaggtt

SEQ ID NO: 198406 - DNA, 25 bp, Mus musculus
aggaggccatgagcgtaatctgcag

SEQ ID NO: 198407 - DNA, 25 bp, Mus musculus
aggaggccatggttaaaccatatga

SEQ ID NO: 198408 - DNA, 25 bp, Mus musculus
aggaggccatttcaggtttggtatg

SEQ ID NO: 198409 - DNA, 25 bp, Mus musculus
aggaggcccaagcctttccacgtct

SEQ ID NO: 198410 - DNA, 25 bp, Mus musculus
aggaggcccaatgattagcatttat

SEQ ID NO: 198411 - DNA, 25 bp, Mus musculus
aggaggccctggaccttggtgtgac

SEQ ID NO: 198412 - DNA, 25 bp, Mus musculus
aggaggccctgttcacctctggggg

SEQ ID NO: 198413 - DNA, 25 bp, Mus musculus
aggaggccgaccagcccccgtcctg

SEQ ID NO: 198414 - DNA, 25 bp, Mus musculus
aggaggccgagaaggctgcatctgt

SEQ ID NO: 198415 - DNA, 25 bp, Mus musculus
aggaggccgagaagtactctcagaa

SEQ ID NO: 198416 - DNA, 25 bp, Mus musculus
aggaggccgagcagaaggagggaga

SEQ ID NO: 198417 - DNA, 25 bp, Mus musculus
aggaggccgccaggctggctcagga

SEQ ID NO: 198418 - DNA, 25 bp, Mus musculus
aggaggccgccaggttcacggctca

SEQ ID NO: 198419 - DNA, 25 bp, Mus musculus
aggaggccgggccaaagtagagaaa

SEQ ID NO: 198420 - DNA, 25 bp, Mus musculus
aggaggccgggtccagatagtatcc

SEQ ID NO: 198421 - DNA, 25 bp, Mus musculus
aggaggccgggttcagattcagaac

SEQ ID NO: 198422 - DNA, 25 bp, Mus musculus
aggaggcctcagattttacatgtgt

SEQ ID NO: 198423 - DNA, 25 bp, Mus musculus
aggaggcctcagttcctggccccag

SEQ ID NO: 198424 - DNA, 25 bp, Mus musculus
aggaggccttctatcgaattcgctc

SEQ ID NO: 198425 - DNA, 25 bp, Mus musculus
aggaggcgcgaggggacaaaggcgt

SEQ ID NO: 198426 - DNA, 25 bp, Mus musculus
aggaggcgcggcaggcggtgatact

SEQ ID NO: 198427 - DNA, 25 bp, Mus musculus
aggaggcgcggcaggtggagggagc

SEQ ID NO: 198428 - DNA, 25 bp, Mus musculus
aggaggcgcgggctgtggaggagct

SEQ ID NO: 198429 - DNA, 25 bp, Mus musculus
aggaggcgctcccaggtaggtgagc

SEQ ID NO: 198430 - DNA, 25 bp, Mus musculus
aggaggcgctgcgggtggcctggag

SEQ ID NO: 198431 - DNA, 25 bp, Mus musculus
aggaggctcaggattcagactcgga

SEQ ID NO: 198432 - DNA, 25 bp, Mus musculus
aggaggctcctgatgcaccagattg

SEQ ID NO: 198433 - DNA, 25 bp, Mus musculus
aggaggctcctgatggtgcctgatg

SEQ ID NO: 198434 - DNA, 25 bp, Mus musculus
aggaggctctgactgttctctctct

SEQ ID NO: 198435 - DNA, 25 bp, Mus musculus
aggaggctgagatccagccgcagcc

SEQ ID NO: 198436 - DNA, 25 bp, Mus musculus
aggaggctgatgaaggacaaccctc

SEQ ID NO: 198437 - DNA, 25 bp, Mus musculus
aggaggctgatgaaggagcttgaag

SEQ ID NO: 198438 - DNA, 25 bp, Mus musculus
aggaggctggagagtccttagccag

SEQ ID NO: 198439 - DNA, 25 bp, Mus musculus
aggagggaaatctggaactttgttg

SEQ ID NO: 198440 - DNA, 25 bp, Mus musculus
aggagggaagataattatgccaccc

SEQ ID NO: 198441 - DNA, 25 bp, Mus musculus
aggagggaagatatgaatctgaaaa

SEQ ID NO: 198442 - DNA, 25 bp, Mus musculus
aggagggaagatcctccctcatctt

SEQ ID NO: 198443 - DNA, 25 bp, Mus musculus
aggagggaaggacaggcctggcaga

SEQ ID NO: 198444 - DNA, 25 bp, Mus musculus
aggagggaaggggctggaaagtgcc

SEQ ID NO: 198445 - DNA, 25 bp, Mus musculus
aggagggacagcgtccgatgcaagc

SEQ ID NO: 198446 - DNA, 25 bp, Mus musculus
aggagggacaggaggtcagtggagc

SEQ ID NO: 198447 - DNA, 25 bp, Mus musculus
aggagggacccaggcattttcccga

SEQ ID NO: 198448 - DNA, 25 bp, Mus musculus
aggagggacgattctgacgttgggt

SEQ ID NO: 198449 - DNA, 25 bp, Mus musculus
aggagggagaaatgggccagcaatg

SEQ ID NO: 198450 - DNA, 25 bp, Mus musculus
aggagggagatgaagatggagtttt

SEQ ID NO: 198451 - DNA, 25 bp, Mus musculus
aggagggagatggaaaagacatccc

SEQ ID NO: 198452 - DNA, 25 bp, Mus musculus
aggagggagctgaggttttatctgt

SEQ ID NO: 198453 - DNA, 25 bp, Mus musculus
aggagggagtgacgtttgagtacag

SEQ ID NO: 198454 - DNA, 25 bp, Mus musculus
aggagggattgatgctgcacctcct

SEQ ID NO: 198455 - DNA, 25 bp, Mus musculus
aggagggattgatgctgcgcctcct

SEQ ID NO: 198456 - DNA, 25 bp, Mus musculus
aggagggcaaaggtcccaatgctcg

SEQ ID NO: 198457 - DNA, 25 bp, Mus musculus
aggagggcacagcatttgacattgt

SEQ ID NO: 198458 - DNA, 25 bp, Mus musculus
aggagggcacaggctggcaacatgg

SEQ ID NO: 198459 - DNA, 25 bp, Mus musculus
aggagggcagaaggaagaaaacggc

SEQ ID NO: 198460 - DNA, 25 bp, Mus musculus
aggagggcagaatctagatcttgag

SEQ ID NO: 198461 - DNA, 25 bp, Mus musculus
aggagggcagcagaaccagacatca

SEQ ID NO: 198462 - DNA, 25 bp, Mus musculus
aggagggcaggaatcccagccatct

SEQ ID NO: 198463 - DNA, 25 bp, Mus musculus
aggagggcataactgagaatattta

SEQ ID NO: 198464 - DNA, 25 bp, Mus musculus
aggagggcataactgttatagagaa

SEQ ID NO: 198465 - DNA, 25 bp, Mus musculus
aggagggcatgggcaacaggacctg

SEQ ID NO: 198466 - DNA, 25 bp, Mus musculus
aggagggcatgggcgttaagatcat

SEQ ID NO: 198467 - DNA, 25 bp, Mus musculus
aggagggccatcaagaatgactctg

SEQ ID NO: 198468 - DNA, 25 bp, Mus musculus
aggagggccatcatcagctgcagtt

SEQ ID NO: 198469 - DNA, 25 bp, Mus musculus
aggagggcctggtttctcacttgag

SEQ ID NO: 198470 - DNA, 25 bp, Mus musculus
aggagggctcagatctggagctgct

SEQ ID NO: 198471 - DNA, 25 bp, Mus musculus
aggagggctgaggtacagtcatgtc

SEQ ID NO: 198472 - DNA, 25 bp, Mus musculus
aggagggctgcagtgtcctgctggg

SEQ ID NO: 198473 - DNA, 25 bp, Mus musculus
aggaggggaaaatgcgtcccatgag

SEQ ID NO: 198474 - DNA, 25 bp, Mus musculus
aggaggggaaaatggcattgtatca

SEQ ID NO: 198475 - DNA, 25 bp, Mus musculus
aggaggggaaaatgttttcgcattt

SEQ ID NO: 198476 - DNA, 25 bp, Mus musculus
aggaggggaaagaaggaatcacagg

SEQ ID NO: 198477 - DNA, 25 bp, Mus musculus
aggaggggaaagaggtgctggtggt

SEQ ID NO: 198478 - DNA, 25 bp, Mus musculus
aggaggggacgcgaggcgaggccgg

SEQ ID NO: 198479 - DNA, 25 bp, Mus musculus
aggaggggctgaggaaaggaaacct

SEQ ID NO: 198480 - DNA, 25 bp, Mus musculus
aggagggggtaagggaggccgctca

SEQ ID NO: 198481 - DNA, 25 bp, Mus musculus
aggaggggtggcggctcctccaggc

SEQ ID NO: 198482 - DNA, 25 bp, Mus musculus
aggagggtatgagcgaagagaaaga

SEQ ID NO: 198483 - DNA, 25 bp, Mus musculus
aggagggtattcaaacacatagaca

SEQ ID NO: 198484 - DNA, 25 bp, Mus musculus
aggagggtgcagcggccagaagatg

SEQ ID NO: 198485 - DNA, 25 bp, Mus musculus
aggagggttcagcccttcccctggg

SEQ ID NO: 198486 - DNA, 25 bp, Mus musculus
aggagggttcagctcggatgtggaa

SEQ ID NO: 198487 - DNA, 25 bp, Mus musculus
aggaggtagaagaggaacgtacgaa

SEQ ID NO: 198488 - DNA, 25 bp, Mus musculus
aggaggtagatgcaggagatccccc

SEQ ID NO: 198489 - DNA, 25 bp, Mus musculus
aggaggtcaagattcgggaagaagc

SEQ ID NO: 198490 - DNA, 25 bp, Mus musculus
aggaggtcaaggccaagaacgcgct

SEQ ID NO: 198491 - DNA, 25 bp, Mus musculus
aggaggtcagaagattttgttgacc

SEQ ID NO: 198492 - DNA, 25 bp, Mus musculus
aggaggtcagaaggtgtgttatatt

SEQ ID NO: 198493 - DNA, 25 bp, Mus musculus
aggaggtcatgactgccatttgctt

SEQ ID NO: 198494 - DNA, 25 bp, Mus musculus
aggaggtcatgactggggtgatctg

SEQ ID NO: 198495 - DNA, 25 bp, Mus musculus
aggaggtccagctgctcggcactgc

SEQ ID NO: 198496 - DNA, 25 bp, Mus musculus
aggaggtccagctgttcatgactga

SEQ ID NO: 198497 - DNA, 25 bp, Mus musculus
aggaggtccggagtcaccggcctga

SEQ ID NO: 198498 - DNA, 25 bp, Mus musculus
aggaggtcctaacaagacagaactg

SEQ ID NO: 198499 - DNA, 25 bp, Mus musculus
aggaggtgaagcccaggacccaggc

SEQ ID NO: 198500 - DNA, 25 bp, Mus musculus
aggaggtgaagtatttaggtcagtt

SEQ ID NO: 198501 - DNA, 25 bp, Mus musculus
aggaggtgacgggtctcactctagc

SEQ ID NO: 198502 - DNA, 25 bp, Mus musculus
aggaggtgacggtgcagcggaactg

SEQ ID NO: 198503 - DNA, 25 bp, Mus musculus
aggaggtgacgttgctgtcccagaa

SEQ ID NO: 198504 - DNA, 25 bp, Mus musculus
aggaggtgaggggacttcaaaacat

SEQ ID NO: 198505 - DNA, 25 bp, Mus musculus
aggaggtgccacagccaccatgcca

SEQ ID NO: 198506 - DNA, 25 bp, Mus musculus
aggaggtggaggacctcatggaacc

SEQ ID NO: 198507 - DNA, 25 bp, Mus musculus
aggaggtggcaaggtgcaaatagtc

SEQ ID NO: 198508 - DNA, 25 bp, Mus musculus
aggaggtggcaaggtgcagataatt

SEQ ID NO: 198509 - DNA, 25 bp, Mus musculus
aggaggtggcaatgccccagttcct

SEQ ID NO: 198510 - DNA, 25 bp, Mus musculus
aggaggtggcaatggaaaaagatct

SEQ ID NO: 198511 - DNA, 25 bp, Mus musculus
aggaggtggcagggttaaggcagct

SEQ ID NO: 198512 - DNA, 25 bp, Mus musculus
aggaggtggtccgagaggtgtgctc

SEQ ID NO: 198513 - DNA, 25 bp, Mus musculus
aggaggtggtccgagttcccacgac

SEQ ID NO: 198514 - DNA, 25 bp, Mus musculus
aggaggttatcggcagcggagcaac

SEQ ID NO: 198515 - DNA, 25 bp, Mus musculus
aggaggttatcggtaaggcgagttc

SEQ ID NO: 198516 - DNA, 25 bp, Mus musculus
aggaggttggaggctcggatggcgt

SEQ ID NO: 198517 - DNA, 25 bp, Mus musculus
aggaggtttactgccggctcctgta

SEQ ID NO: 198518 - DNA, 25 bp, Mus musculus
aggaggtttctgaggtggagtcttt

SEQ ID NO: 198519 - DNA, 25 bp, Mus musculus
aggagtaaagcagtcagtggaagag

SEQ ID NO: 198520 - DNA, 25 bp, Mus musculus
aggagtaaagctgcttctaaacaaa

SEQ ID NO: 198521 - DNA, 25 bp, Mus musculus
aggagtaagctggatggtccacctc

SEQ ID NO: 198522 - DNA, 25 bp, Mus musculus
aggagtacaaaaagctgtgagtacc

SEQ ID NO: 198523 - DNA, 25 bp, Mus musculus
aggagtacaaaaaggtgcatccaag

SEQ ID NO: 198524 - DNA, 25 bp, Mus musculus
aggagtacaagagccagatgaagtc

SEQ ID NO: 198525 - DNA, 25 bp, Mus musculus
aggagtacaaggccaagctacaagg

SEQ ID NO: 198526 - DNA, 25 bp, Mus musculus
aggagtacaccaccacgcccggctt

SEQ ID NO: 198527 - DNA, 25 bp, Mus musculus
aggagtaccaggagaccctgagcag

SEQ ID NO: 198528 - DNA, 25 bp, Mus musculus
aggagtaccaggaggagctggagtt

SEQ ID NO: 198529 - DNA, 25 bp, Mus musculus
aggagtacgaggagagagcaagagg

SEQ ID NO: 198530 - DNA, 25 bp, Mus musculus
aggagtacgaggagattatgcggga

SEQ ID NO: 198531 - DNA, 25 bp, Mus musculus
aggagtacgaggaggaacaggaagg

SEQ ID NO: 198532 - DNA, 25 bp, Mus musculus
aggagtacgcagtggaagcccactt

SEQ ID NO: 198533 - DNA, 25 bp, Mus musculus
aggagtagcaactggtctctggact

SEQ ID NO: 198534 - DNA, 25 bp, Mus musculus
aggagtatgagggagccgtctaccc

SEQ ID NO: 198535 - DNA, 25 bp, Mus musculus
aggagtatgctaagttctttgaaac

SEQ ID NO: 198536 - DNA, 25 bp, Mus musculus
aggagtatgctcgggagcatggctt

SEQ ID NO: 198537 - DNA, 25 bp, Mus musculus
aggagtatggcagactgcacgggcg

SEQ ID NO: 198538 - DNA, 25 bp, Mus musculus
aggagtcaaaggtccacgaaccagt

SEQ ID NO: 198539 - DNA, 25 bp, Mus musculus
aggagtcacctctgtctggtagcag

SEQ ID NO: 198540 - DNA, 25 bp, Mus musculus
aggagtcataagaagacacacacag

SEQ ID NO: 198541 - DNA, 25 bp, Mus musculus
aggagtccatggcaacgggcagcat

SEQ ID NO: 198542 - DNA, 25 bp, Mus musculus
aggagtcccagatccagtatgtacc

SEQ ID NO: 198543 - DNA, 25 bp, Mus musculus
aggagtcccagtgtcttgctgcatg

SEQ ID NO: 198544 - DNA, 25 bp, Mus musculus
aggagtcccagttcttgcttcagca

SEQ ID NO: 198545 - DNA, 25 bp, Mus musculus
aggagtcccggcgtggagcgttact

SEQ ID NO: 198546 - DNA, 25 bp, Mus musculus
aggagtcccggctcatcactcttcc

SEQ ID NO: 198547 - DNA, 25 bp, Mus musculus
aggagtcgacttcaggtacaggtcc

SEQ ID NO: 198548 - DNA, 25 bp, Mus musculus
aggagtcgacttcaggtggtaagag

SEQ ID NO: 198549 - DNA, 25 bp, Mus musculus
aggagtcggagatggcagccacaga

SEQ ID NO: 198550 - DNA, 25 bp, Mus musculus
aggagtcggtgcttggctctggctg

SEQ ID NO: 198551 - DNA, 25 bp, Mus musculus
aggagtctgagagcccaccttctcc

SEQ ID NO: 198552 - DNA, 25 bp, Mus musculus
aggagtctgagaggcggaagaagct

SEQ ID NO: 198553 - DNA, 25 bp, Mus musculus
aggagtctggaggagattggcatcc

SEQ ID NO: 198554 - DNA, 25 bp, Mus musculus
aggagtctggaggaggttcttcgtg

SEQ ID NO: 198555 - DNA, 25 bp, Mus musculus
aggagtcttcctgtagaaatgcctc

SEQ ID NO: 198556 - DNA, 25 bp, Mus musculus
aggagtgaacagtccctggatgacg

SEQ ID NO: 198557 - DNA, 25 bp, Mus musculus
aggagtgaagaccttgcacttgact

SEQ ID NO: 198558 - DNA, 25 bp, Mus musculus
aggagtgagcacggttatttttgaa

SEQ ID NO: 198559 - DNA, 25 bp, Mus musculus
aggagtgaggagtcaccactacttt

SEQ ID NO: 198560 - DNA, 25 bp, Mus musculus
aggagtgatcacaggattgctgctg

SEQ ID NO: 198561 - DNA, 25 bp, Mus musculus
aggagtgatcacaggcctgggcatg

SEQ ID NO: 198562 - DNA, 25 bp, Mus musculus
aggagtgatcacagggccaaaggcg

SEQ ID NO: 198563 - DNA, 25 bp, Mus musculus
aggagtgcaaaggcaagcagaagga

SEQ ID NO: 198564 - DNA, 25 bp, Mus musculus
aggagtgcaagaacctgatcctcca

SEQ ID NO: 198565 - DNA, 25 bp, Mus musculus
aggagtgcaagggctccagcataaa

SEQ ID NO: 198566 - DNA, 25 bp, Mus musculus
aggagtgccaagatatcgatgagtg

SEQ ID NO: 198567 - DNA, 25 bp, Mus musculus
aggagtgccaaggccggcagaggac

SEQ ID NO: 198568 - DNA, 25 bp, Mus musculus
aggagtgccaagttatcgatgagtg

SEQ ID NO: 198569 - DNA, 25 bp, Mus musculus
aggagtgcccaggcgaccacctcca

SEQ ID NO: 198570 - DNA, 25 bp, Mus musculus
aggagtgcgcccgggagaaggaact

SEQ ID NO: 198571 - DNA, 25 bp, Mus musculus
aggagtggagacgtcggatgcgcca

SEQ ID NO: 198572 - DNA, 25 bp, Mus musculus
aggagtggggaacaggtctttcata

SEQ ID NO: 198573 - DNA, 25 bp, Mus musculus
aggagtggggtcccgggctactctt

SEQ ID NO: 198574 - DNA, 25 bp, Mus musculus
aggagtgtgaaaaaagtcattgaag

SEQ ID NO: 198575 - DNA, 25 bp, Mus musculus
aggagtgtgaagagatccaggctta

SEQ ID NO: 198576 - DNA, 25 bp, Mus musculus
aggagtgtgaggaggtaaatgaaaa

SEQ ID NO: 198577 - DNA, 25 bp, Mus musculus
aggagtgtgaggcatgggtgtcagt

SEQ ID NO: 198578 - DNA, 25 bp, Mus musculus
aggagtgtgagggaggagataggtg

SEQ ID NO: 198579 - DNA, 25 bp, Mus musculus
aggagtgtgcgcctgccccgcgaga

SEQ ID NO: 198580 - DNA, 25 bp, Mus musculus
aggagtgttgagagtcctttgctgt

SEQ ID NO: 198581 - DNA, 25 bp, Mus musculus
aggagttaatcttgtctcctcgaag

SEQ ID NO: 198582 - DNA, 25 bp, Mus musculus
aggagttaatcttgtctcttctcac

SEQ ID NO: 198583 - DNA, 25 bp, Mus musculus
aggagttaatcttgtttgagtcttc

SEQ ID NO: 198584 - DNA, 25 bp, Mus musculus
aggagttagaaacaggtgagaactc

SEQ ID NO: 198585 - DNA, 25 bp, Mus musculus
aggagttagagaaggctcatacaac

SEQ ID NO: 198586 - DNA, 25 bp, Mus musculus
aggagttcaaacatacagctttgta

SEQ ID NO: 198587 - DNA, 25 bp, Mus musculus
aggagttcaacatagactacacgat

SEQ ID NO: 198588 - DNA, 25 bp, Mus musculus
aggagttcaaggacgacagccatgt

SEQ ID NO: 198589 - DNA, 25 bp, Mus musculus
aggagttcacagcatgaaggacttt

SEQ ID NO: 198590 - DNA, 25 bp, Mus musculus
aggagttcacagcgcactgtttgat

SEQ ID NO: 198591 - DNA, 25 bp, Mus musculus
aggagttcaggaggacccgctctct

SEQ ID NO: 198592 - DNA, 25 bp, Mus musculus
aggagttcctgaaggttgctagacc

SEQ ID NO: 198593 - DNA, 25 bp, Mus musculus
aggagttcgggactctgctgacagg

SEQ ID NO: 198594 - DNA, 25 bp, Mus musculus
aggagttctaggaaacagctcaaag

SEQ ID NO: 198595 - DNA, 25 bp, Mus musculus
aggagttctagggtatccctcctaa

SEQ ID NO: 198596 - DNA, 25 bp, Mus musculus
aggagttctttctgaggtgtcagat

SEQ ID NO: 198597 - DNA, 25 bp, Mus musculus
aggagttgaaagattcccccacagc

SEQ ID NO: 198598 - DNA, 25 bp, Mus musculus
aggagttgaaaggagtgagcagcgg

SEQ ID NO: 198599 - DNA, 25 bp, Mus musculus
aggagttgaatgcccaaaggataag

SEQ ID NO: 198600 - DNA, 25 bp, Mus musculus
aggagttgaggacctgtttactggt

SEQ ID NO: 198601 - DNA, 25 bp, Mus musculus
aggagttgagttaaaagaagatgga

SEQ ID NO: 198602 - DNA, 25 bp, Mus musculus
aggagttggttcaggtggaacatcc

SEQ ID NO: 198603 - DNA, 25 bp, Mus musculus
aggagttggttcagtatcctgtgga

SEQ ID NO: 198604 - DNA, 25 bp, Mus musculus
aggagtttgaaaggatgtcttccaa

SEQ ID NO: 198605 - DNA, 25 bp, Mus musculus
aggagtttgccgcagccagccctct

SEQ ID NO: 198606 - DNA, 25 bp, Mus musculus
aggagtttgccgcaggcccggcaca

SEQ ID NO: 198607 - DNA, 25 bp, Mus musculus
aggagtttgggttaatatttgccaa

SEQ ID NO: 198608 - DNA, 25 bp, Mus musculus
aggataaaaagaaacggcggctggc

SEQ ID NO: 198609 - DNA, 25 bp, Mus musculus
aggataaattaggaatccccactgt

SEQ ID NO: 198610 - DNA, 25 bp, Mus musculus
aggataacacctgacactgaagatg

SEQ ID NO: 198611 - DNA, 25 bp, Mus musculus
aggataacacgtccctagctgttgg

SEQ ID NO: 198612 - DNA, 25 bp, Mus musculus
aggataacaggtccagttgtccctt

SEQ ID NO: 198613 - DNA, 25 bp, Mus musculus
aggataacagtgacgtatgacttct

SEQ ID NO: 198614 - DNA, 25 bp, Mus musculus
aggataactcaattcctctattgta

SEQ ID NO: 198615 - DNA, 25 bp, Mus musculus
aggataactctctggacgcccctgt

SEQ ID NO: 198616 - DNA, 25 bp, Mus musculus
aggataactttaaccagacacaccg

SEQ ID NO: 198617 - DNA, 25 bp, Mus musculus
aggataactttgatgtgtatgctgg

SEQ ID NO: 198618 - DNA, 25 bp, Mus musculus
aggataagatgaaggctcacagcga

SEQ ID NO: 198619 - DNA, 25 bp, Mus musculus
aggataataaacaaatttctttcaa

SEQ ID NO: 198620 - DNA, 25 bp, Mus musculus
aggatacaaggcaaaaacagctctg

SEQ ID NO: 198621 - DNA, 25 bp, Mus musculus
aggataccaaggctcctgtgatgcc

SEQ ID NO: 198622 - DNA, 25 bp, Mus musculus
aggataccctgctgggggctctctt

SEQ ID NO: 198623 - DNA, 25 bp, Mus musculus
aggatacctcacaggacctggagtt

SEQ ID NO: 198624 - DNA, 25 bp, Mus musculus
aggatacgagcaatcatttccatgt

SEQ ID NO: 198625 - DNA, 25 bp, Mus musculus
aggatacgagcagtagtaccgttgt

SEQ ID NO: 198626 - DNA, 25 bp, Mus musculus
aggatacgccacaagaactggaaca

SEQ ID NO: 198627 - DNA, 25 bp, Mus musculus
aggatacgccacaagtaatcagcca

SEQ ID NO: 198628 - DNA, 25 bp, Mus musculus
aggatacggttcggtcaccactcaa

SEQ ID NO: 198629 - DNA, 25 bp, Mus musculus
aggatactatgtatataacaggcaa

SEQ ID NO: 198630 - DNA, 25 bp, Mus musculus
aggatactccagatgccaacgcaat

SEQ ID NO: 198631 - DNA, 25 bp, Mus musculus
aggatactggagcttgcctctccac

SEQ ID NO: 198632 - DNA, 25 bp, Mus musculus
aggatagaaagagctcagcagtcag

SEQ ID NO: 198633 - DNA, 25 bp, Mus musculus
aggatagaaccatcaggctgcagct

SEQ ID NO: 198634 - DNA, 25 bp, Mus musculus
aggatagaaccgtgcgattgcaatt

SEQ ID NO: 198635 - DNA, 25 bp, Mus musculus
aggatagagcagctcagtcctccgt

SEQ ID NO: 198636 - DNA, 25 bp, Mus musculus
aggatagatgtgaggtcacctcagc

SEQ ID NO: 198637 - DNA, 25 bp, Mus musculus
aggatagcagcctggcccatctccg

SEQ ID NO: 198638 - DNA, 25 bp, Mus musculus
aggatagccaggtcaaagcccagcg

SEQ ID NO: 198639 - DNA, 25 bp, Mus musculus
aggatagtgaagatgaagatgatag

SEQ ID NO: 198640 - DNA, 25 bp, Mus musculus
aggatagtgacagtgacgatgggga

SEQ ID NO: 198641 - DNA, 25 bp, Mus musculus
aggatataaagaaaccagaccgtga

SEQ ID NO: 198642 - DNA, 25 bp, Mus musculus
aggatataaagaccgtgatgactgg

SEQ ID NO: 198643 - DNA, 25 bp, Mus musculus
aggatatcaaagaggtagtagtctg

SEQ ID NO: 198644 - DNA, 25 bp, Mus musculus
aggatatcagaaggactcagtctcc

SEQ ID NO: 198645 - DNA, 25 bp, Mus musculus
aggatatcgacgtgatcatgggtgg

SEQ ID NO: 198646 - DNA, 25 bp, Mus musculus
aggatatcgatggccgccctgtcaa

SEQ ID NO: 198647 - DNA, 25 bp, Mus musculus
aggatatgacagaagtctgcgtggt

SEQ ID NO: 198648 - DNA, 25 bp, Mus musculus
aggatatgagtgttttatggctata

SEQ ID NO: 198649 - DNA, 25 bp, Mus musculus
aggatattagggtctctgctactgg

SEQ ID NO: 198650 - DNA, 25 bp, Mus musculus
aggatattcctaggaccttctaccg

SEQ ID NO: 198651 - DNA, 25 bp, Mus musculus
aggatattgagaccctacacttatt

SEQ ID NO: 198652 - DNA, 25 bp, Mus musculus
aggatattggagctccagccacaat

SEQ ID NO: 198653 - DNA, 25 bp, Mus musculus
aggatattgtgtagaatatatttga

SEQ ID NO: 198654 - DNA, 25 bp, Mus musculus
aggatattttcaggtgaaccagaac

SEQ ID NO: 198655 - DNA, 25 bp, Mus musculus
aggatcaaaagcaggaggagccatc

SEQ ID NO: 198656 - DNA, 25 bp, Mus musculus
aggatcaacagtgagcaactgatgg

SEQ ID NO: 198657 - DNA, 25 bp, Mus musculus
aggatcaagacgaaactgcagcaga

SEQ ID NO: 198658 - DNA, 25 bp, Mus musculus
aggatcaagagttgaaagcgctggt

SEQ ID NO: 198659 - DNA, 25 bp, Mus musculus
aggatcaaggtcagatctatacctt

SEQ ID NO: 198660 - DNA, 25 bp, Mus musculus
aggatcacaaagacctgtgcccctc

SEQ ID NO: 198661 - DNA, 25 bp, Mus musculus
aggatcacaaagtgagtttcctgcg

SEQ ID NO: 198662 - DNA, 25 bp, Mus musculus
aggatcacagaaggtccctagcagg

SEQ ID NO: 198663 - DNA, 25 bp, Mus musculus
aggatcaccaggtgctcgaggcttc

SEQ ID NO: 198664 - DNA, 25 bp, Mus musculus
aggatcacgaggttgtacttgtttt

SEQ ID NO: 198665 - DNA, 25 bp, Mus musculus
aggatcagaagcaaggttttcgggt

SEQ ID NO: 198666 - DNA, 25 bp, Mus musculus
aggatcagacactgacaaagcaata

SEQ ID NO: 198667 - DNA, 25 bp, Mus musculus
aggatcagacactggcactggtggg

SEQ ID NO: 198668 - DNA, 25 bp, Mus musculus
aggatcagaggtcaccttccgaacg

SEQ ID NO: 198669 - DNA, 25 bp, Mus musculus
aggatcagataaagcaaattaaaaa

SEQ ID NO: 198670 - DNA, 25 bp, Mus musculus
aggatcagcatagaagctgcgttgg

SEQ ID NO: 198671 - DNA, 25 bp, Mus musculus
aggatcagcataggatcaagtagac

SEQ ID NO: 198672 - DNA, 25 bp, Mus musculus
aggatcagtggaagccaaggataac

SEQ ID NO: 198673 - DNA, 25 bp, Mus musculus
aggatcagtggaaggcagttaaacc

SEQ ID NO: 198674 - DNA, 25 bp, Mus musculus
aggatcagtggaagtcttgaaatac

SEQ ID NO: 198675 - DNA, 25 bp, Mus musculus
aggatcagttatgagacttcagact

SEQ ID NO: 198676 - DNA, 25 bp, Mus musculus
aggatcagttatggcagtaatggaa

SEQ ID NO: 198677 - DNA, 25 bp, Mus musculus
aggatcagttatgtttttatttcag

SEQ ID NO: 198678 - DNA, 25 bp, Mus musculus
aggatcatcagtttgttttctttgc

SEQ ID NO: 198679 - DNA, 25 bp, Mus musculus
aggatcatgacagaattccagaggc

SEQ ID NO: 198680 - DNA, 25 bp, Mus musculus
aggatcatgagaaggctgctttgat

SEQ ID NO: 198681 - DNA, 25 bp, Mus musculus
aggatcatggggtactcaatgcagg

SEQ ID NO: 198682 - DNA, 25 bp, Mus musculus
aggatcatgggttcctcggcctctg

SEQ ID NO: 198683 - DNA, 25 bp, Mus musculus
aggatccaacaggtgtgggcccctc

SEQ ID NO: 198684 - DNA, 25 bp, Mus musculus
aggatccacacagcaggacagttgt

SEQ ID NO: 198685 - DNA, 25 bp, Mus musculus
aggatccacacaggcgagaagcctc

SEQ ID NO: 198686 - DNA, 25 bp, Mus musculus
aggatccaggcgccaggcagcacga

SEQ ID NO: 198687 - DNA, 25 bp, Mus musculus
aggatccaggttttatccagagggg

SEQ ID NO: 198688 - DNA, 25 bp, Mus musculus
aggatcccagcgaaaagcccattgg

SEQ ID NO: 198689 - DNA, 25 bp, Mus musculus
aggatcccaggaaagaaaagtttca

SEQ ID NO: 198690 - DNA, 25 bp, Mus musculus
aggatcccagtcaggaaccagcatc

SEQ ID NO: 198691 - DNA, 25 bp, Mus musculus
aggatccccaggctgcccttggggc

SEQ ID NO: 198692 - DNA, 25 bp, Mus musculus
aggatcccctcctgtgcccctggcc

SEQ ID NO: 198693 - DNA, 25 bp, Mus musculus
aggatcccctggcctcgctggaccc

SEQ ID NO: 198694 - DNA, 25 bp, Mus musculus
aggatccctggagtccctggctcca

SEQ ID NO: 198695 - DNA, 25 bp, Mus musculus
aggatccgctggtgctcctggaatt

SEQ ID NO: 198696 - DNA, 25 bp, Mus musculus
aggatccggaagtaaaagccggaag

SEQ ID NO: 198697 - DNA, 25 bp, Mus musculus
aggatccggaagtataagccggaag

SEQ ID NO: 198698 - DNA, 25 bp, Mus musculus
aggatccggatggagcttttaagga

SEQ ID NO: 198699 - DNA, 25 bp, Mus musculus
aggatccggatgggtatagtgccaa

SEQ ID NO: 198700 - DNA, 25 bp, Mus musculus
aggatcctaccctctagacgtcctc

SEQ ID NO: 198701 - DNA, 25 bp, Mus musculus
aggatcctcaggaggaagaacctgc

SEQ ID NO: 198702 - DNA, 25 bp, Mus musculus
aggatcctccaggtggccacggtga

SEQ ID NO: 198703 - DNA, 25 bp, Mus musculus
aggatcctccaggtggctttgctga

SEQ ID NO: 198704 - DNA, 25 bp, Mus musculus
aggatcctccagtgtctccagaaca

SEQ ID NO: 198705 - DNA, 25 bp, Mus musculus
aggatcctccgagagttctgtcctt

SEQ ID NO: 198706 - DNA, 25 bp, Mus musculus
aggatcctccggggcaacattttga

SEQ ID NO: 198707 - DNA, 25 bp, Mus musculus
aggatcctccggggcatccagggaa

SEQ ID NO: 198708 - DNA, 25 bp, Mus musculus
aggatcctgccagaggaagcccgtg

SEQ ID NO: 198709 - DNA, 25 bp, Mus musculus
aggatcctgcccagtgttgaagaaa

SEQ ID NO: 198710 - DNA, 25 bp, Mus musculus
aggatcgaagcggccttgggatgtc

SEQ ID NO: 198711 - DNA, 25 bp, Mus musculus
aggatcgaaggcctgcaagacgaca

SEQ ID NO: 198712 - DNA, 25 bp, Mus musculus
aggatcgaaggcctggtcattcaat

SEQ ID NO: 198713 - DNA, 25 bp, Mus musculus
aggatcgacgacctccacaaggttc

SEQ ID NO: 198714 - DNA, 25 bp, Mus musculus
aggatcgattccgaatctgcctcag

SEQ ID NO: 198715 - DNA, 25 bp, Mus musculus
aggatcgattccgatttgtgctagt

SEQ ID NO: 198716 - DNA, 25 bp, Mus musculus
aggatcgcagaggggacaatgccaa

SEQ ID NO: 198717 - DNA, 25 bp, Mus musculus
aggatcgcatgggctaccagctgca

SEQ ID NO: 198718 - DNA, 25 bp, Mus musculus
aggatcgcgtcccggcccagggcct

SEQ ID NO: 198719 - DNA, 25 bp, Mus musculus
aggatcggaacaagtctgggacctg

SEQ ID NO: 198720 - DNA, 25 bp, Mus musculus
aggatcggaacaattggtacccttg

SEQ ID NO: 198721 - DNA, 25 bp, Mus musculus
aggatcggactaggtctgcctgggc

SEQ ID NO: 198722 - DNA, 25 bp, Mus musculus
aggatcggactagtggccacagtta

SEQ ID NO: 198723 - DNA, 25 bp, Mus musculus
aggatcggggcaggatggcagccac

SEQ ID NO: 198724 - DNA, 25 bp, Mus musculus
aggatctacagaagagagacatctc

SEQ ID NO: 198725 - DNA, 25 bp, Mus musculus
aggatctacaggtgaaagagctggt

SEQ ID NO: 198726 - DNA, 25 bp, Mus musculus
aggatctatgaggaaatgaataaca

SEQ ID NO: 198727 - DNA, 25 bp, Mus musculus
aggatctatgagttaaacgccaagc

SEQ ID NO: 198728 - DNA, 25 bp, Mus musculus
aggatctcagttcacatatggagat

SEQ ID NO: 198729 - DNA, 25 bp, Mus musculus
aggatctctgggtctgaaaaggagc

SEQ ID NO: 198730 - DNA, 25 bp, Mus musculus
aggatctcttgcctcaatcaagaca

SEQ ID NO: 198731 - DNA, 25 bp, Mus musculus
aggatctcttggccagagaacagct

SEQ ID NO: 198732 - DNA, 25 bp, Mus musculus
aggatctcttggtaggccaggaaat

SEQ ID NO: 198733 - DNA, 25 bp, Mus musculus
aggatctgaaagaggatatcaagtt

SEQ ID NO: 198734 - DNA, 25 bp, Mus musculus
aggatcttaaagagcaaatcccata

SEQ ID NO: 198735 - DNA, 25 bp, Mus musculus
aggatcttcagagggttcccagccc

SEQ ID NO: 198736 - DNA, 25 bp, Mus musculus
aggatcttcgggtatttggctccca

SEQ ID NO: 198737 - DNA, 25 bp, Mus musculus
aggatcttctagtgaacagcgtcac

SEQ ID NO: 198738 - DNA, 25 bp, Mus musculus
aggatcttctgaaagctctgtacaa

SEQ ID NO: 198739 - DNA, 25 bp, Mus musculus
aggatcttgagactaccaaaggagc

SEQ ID NO: 198740 - DNA, 25 bp, Mus musculus
aggatcttgagtttaccaaattacc

SEQ ID NO: 198741 - DNA, 25 bp, Mus musculus
aggatctttccagttacaaatttcc

SEQ ID NO: 198742 - DNA, 25 bp, Mus musculus
aggatgaaaagcttattcgtctgat

SEQ ID NO: 198743 - DNA, 25 bp, Mus musculus
aggatgaagaactacaaagcaattg

SEQ ID NO: 198744 - DNA, 25 bp, Mus musculus
aggatgaagagctaaggcgcatgca

SEQ ID NO: 198745 - DNA, 25 bp, Mus musculus
aggatgaagaggagaagacacccat

SEQ ID NO: 198746 - DNA, 25 bp, Mus musculus
aggatgaagagggccccgtggggcg

SEQ ID NO: 198747 - DNA, 25 bp, Mus musculus
aggatgaagccagagatttaaggca

SEQ ID NO: 198748 - DNA, 25 bp, Mus musculus
aggatgaagccaggtaattcagaga

SEQ ID NO: 198749 - DNA, 25 bp, Mus musculus
aggatgaaggacggtggcgcctcat

SEQ ID NO: 198750 - DNA, 25 bp, Mus musculus
aggatgaaggactttacctcgctga

SEQ ID NO: 198751 - DNA, 25 bp, Mus musculus
aggatgaaggccattcaaactcctc

SEQ ID NO: 198752 - DNA, 25 bp, Mus musculus
aggatgaagggaaaatgtttatagg

SEQ ID NO: 198753 - DNA, 25 bp, Mus musculus
aggatgaagtgaaacgcttcgttaa

SEQ ID NO: 198754 - DNA, 25 bp, Mus musculus
aggatgacaaaaaggtttgcacctg

SEQ ID NO: 198755 - DNA, 25 bp, Mus musculus
aggatgacactggacccccctttgt

SEQ ID NO: 198756 - DNA, 25 bp, Mus musculus
aggatgaccaggtagagaccttttc

SEQ ID NO: 198757 - DNA, 25 bp, Mus musculus
aggatgaccagtttcagaaagctct

SEQ ID NO: 198758 - DNA, 25 bp, Mus musculus
aggatgacctgggccttttgctcga

SEQ ID NO: 198759 - DNA, 25 bp, Mus musculus
aggatgactacagcattacacccgt

SEQ ID NO: 198760 - DNA, 25 bp, Mus musculus
aggatgactatcgatgatgtgatga

SEQ ID NO: 198761 - DNA, 25 bp, Mus musculus
aggatgacttggagattttgcatgg

SEQ ID NO: 198762 - DNA, 25 bp, Mus musculus
aggatgagaataatctttgtgcgct

SEQ ID NO: 198763 - DNA, 25 bp, Mus musculus
aggatgagaataatgtttgctttga

SEQ ID NO: 198764 - DNA, 25 bp, Mus musculus
aggatgagattctggtcattcgaaa

SEQ ID NO: 198765 - DNA, 25 bp, Mus musculus
aggatgagcaagatgaacgagaccg

SEQ ID NO: 198766 - DNA, 25 bp, Mus musculus
aggatgagcggcaggttgggtcgga

SEQ ID NO: 198767 - DNA, 25 bp, Mus musculus
aggatgagctgggttcaggaggtga

SEQ ID NO: 198768 - DNA, 25 bp, Mus musculus
aggatgaggaagctctgtgaagtcc

SEQ ID NO: 198769 - DNA, 25 bp, Mus musculus
aggatgaggagaacaacgagaacga

SEQ ID NO: 198770 - DNA, 25 bp, Mus musculus
aggatgaggaggaagtttacagtag

SEQ ID NO: 198771 - DNA, 25 bp, Mus musculus
aggatgaggaggagaaagaaaagaa

SEQ ID NO: 198772 - DNA, 25 bp, Mus musculus
aggatgaggtccaggagatacttca

SEQ ID NO: 198773 - DNA, 25 bp, Mus musculus
aggatgaggtccaggtgacaataaa

SEQ ID NO: 198774 - DNA, 25 bp, Mus musculus
aggatgagtacgccatgaacgacac

SEQ ID NO: 198775 - DNA, 25 bp, Mus musculus
aggatgagtacggtgggaatgctga

SEQ ID NO: 198776 - DNA, 25 bp, Mus musculus
aggatgagtatgtgctggaggatct

SEQ ID NO: 198777 - DNA, 25 bp, Mus musculus
aggatgagtgggatgcagtcatgct

SEQ ID NO: 198778 - DNA, 25 bp, Mus musculus
aggatgagtggggttggccgaattc

SEQ ID NO: 198779 - DNA, 25 bp, Mus musculus
aggatgagtgggtggaagagcagag

SEQ ID NO: 198780 - DNA, 25 bp, Mus musculus
aggatgagttgcttcagaggttcag

SEQ ID NO: 198781 - DNA, 25 bp, Mus musculus
aggatgataaagaggaagaagaaag

SEQ ID NO: 198782 - DNA, 25 bp, Mus musculus
aggatgatattgggtttgatctgtg

SEQ ID NO: 198783 - DNA, 25 bp, Mus musculus
aggatgatcggggaatcatcactgc

SEQ ID NO: 198784 - DNA, 25 bp, Mus musculus
aggatgatgacaattttgaagaagg

SEQ ID NO: 198785 - DNA, 25 bp, Mus musculus
aggatgatgagctgaactttgacct

SEQ ID NO: 198786 - DNA, 25 bp, Mus musculus
aggatgatgaggagaaagagaagaa

SEQ ID NO: 198787 - DNA, 25 bp, Mus musculus
aggatgatgatggaaaggaagaaga

SEQ ID NO: 198788 - DNA, 25 bp, Mus musculus
aggatgatgatggtacaaaatgcta

SEQ ID NO: 198789 - DNA, 25 bp, Mus musculus
aggatgatgggccagatcatctgtc

SEQ ID NO: 198790 - DNA, 25 bp, Mus musculus
aggatgattgaggatgcaattcgaa

SEQ ID NO: 198791 - DNA, 25 bp, Mus musculus
aggatgcacatagaagccgtatcaa

SEQ ID NO: 198792 - DNA, 25 bp, Mus musculus
aggatgcagagggacgccctgacta

SEQ ID NO: 198793 - DNA, 25 bp, Mus musculus
aggatgcagaggttcgccatcgatg

SEQ ID NO: 198794 - DNA, 25 bp, Mus musculus
aggatgcagggcattttcccgactc

SEQ ID NO: 198795 - DNA, 25 bp, Mus musculus
aggatgcaggggtctcactgtgtag

SEQ ID NO: 198796 - DNA, 25 bp, Mus musculus
aggatgccaataaggctgtggaaga

SEQ ID NO: 198797 - DNA, 25 bp, Mus musculus
aggatgccacgaaagcgctaactga

SEQ ID NO: 198798 - DNA, 25 bp, Mus musculus
aggatgccacggatccttttgtggc

SEQ ID NO: 198799 - DNA, 25 bp, Mus musculus
aggatgccagagcacagggcactcg

SEQ ID NO: 198800 - DNA, 25 bp, Mus musculus
aggatgccagcccaaaccaggtggc

SEQ ID NO: 198801 - DNA, 25 bp, Mus musculus
aggatgccagccctccagggccagc

SEQ ID NO: 198802 - DNA, 25 bp, Mus musculus
aggatgccaggagctccggcccatt

SEQ ID NO: 198803 - DNA, 25 bp, Mus musculus
aggatgccgttgactgtgtactcga

SEQ ID NO: 198804 - DNA, 25 bp, Mus musculus
aggatgcctcggcggtgttcaccta

SEQ ID NO: 198805 - DNA, 25 bp, Mus musculus
aggatgcctggcggaaagcttcccg

SEQ ID NO: 198806 - DNA, 25 bp, Mus musculus
aggatgcgaagaaagccttcaatgc

SEQ ID NO: 198807 - DNA, 25 bp, Mus musculus
aggatgcgatacaaatctcaaacat

SEQ ID NO: 198808 - DNA, 25 bp, Mus musculus
aggatgcgatgccctgtggaatcct

SEQ ID NO: 198809 - DNA, 25 bp, Mus musculus
aggatgcgctgaggcccagtatagt

SEQ ID NO: 198810 - DNA, 25 bp, Mus musculus
aggatgcggggtaccgaatgtatag

SEQ ID NO: 198811 - DNA, 25 bp, Mus musculus
aggatgctacggaggtgccttagct

SEQ ID NO: 198812 - DNA, 25 bp, Mus musculus
aggatgctggacgctggatcgcgga

SEQ ID NO: 198813 - DNA, 25 bp, Mus musculus
aggatgctggcaggtatctgtgtga

SEQ ID NO: 198814 - DNA, 25 bp, Mus musculus
aggatgctggctttttcacttgata

SEQ ID NO: 198815 - DNA, 25 bp, Mus musculus
aggatgctgtcaaggcccgcctggc

SEQ ID NO: 198816 - DNA, 25 bp, Mus musculus
aggatgcttaggacctgatatttgt

SEQ ID NO: 198817 - DNA, 25 bp, Mus musculus
aggatgcttcctttctagtgagtgc

SEQ ID NO: 198818 - DNA, 25 bp, Mus musculus
aggatgcttcggcaggttttgtcgc

SEQ ID NO: 198819 - DNA, 25 bp, Mus musculus
aggatgctttaaaagcaaggatcat

SEQ ID NO: 198820 - DNA, 25 bp, Mus musculus
aggatgctttaaaaggaaaatacat

SEQ ID NO: 198821 - DNA, 25 bp, Mus musculus
aggatggaaagaaagatctgatgtt

SEQ ID NO: 198822 - DNA, 25 bp, Mus musculus
aggatggaaagagcttaacaaaaga

SEQ ID NO: 198823 - DNA, 25 bp, Mus musculus
aggatggaaaggtgaagctggagac

SEQ ID NO: 198824 - DNA, 25 bp, Mus musculus
aggatggaaccgggcgcagcgcgtt

SEQ ID NO: 198825 - DNA, 25 bp, Mus musculus
aggatggaacggtgtggaccgtgtc

SEQ ID NO: 198826 - DNA, 25 bp, Mus musculus
aggatggaagagaagctgaagaagg

SEQ ID NO: 198827 - DNA, 25 bp, Mus musculus
aggatggacaaagctggtcagtaca

SEQ ID NO: 198828 - DNA, 25 bp, Mus musculus
aggatggacacattcattacttccg

SEQ ID NO: 198829 - DNA, 25 bp, Mus musculus
aggatggacacggtggatggagcga

SEQ ID NO: 198830 - DNA, 25 bp, Mus musculus
aggatggaccttcccctgtctctgc

SEQ ID NO: 198831 - DNA, 25 bp, Mus musculus
aggatggagccaaacatttctcggg

SEQ ID NO: 198832 - DNA, 25 bp, Mus musculus
aggatggagccaaagaatgaataaa

SEQ ID NO: 198833 - DNA, 25 bp, Mus musculus
aggatggatcagacagaaagtgtgg

SEQ ID NO: 198834 - DNA, 25 bp, Mus musculus
aggatggcagctcagctgttctgga

SEQ ID NO: 198835 - DNA, 25 bp, Mus musculus
aggatggcagggccaggttgcttcc

SEQ ID NO: 198836 - DNA, 25 bp, Mus musculus
aggatggcagggtatttatgagcct

SEQ ID NO: 198837 - DNA, 25 bp, Mus musculus
aggatggcatcacctttattgacag

SEQ ID NO: 198838 - DNA, 25 bp, Mus musculus
aggatggccagacgggcagcgggca

SEQ ID NO: 198839 - DNA, 25 bp, Mus musculus
aggatggccagctaccatatttgca

SEQ ID NO: 198840 - DNA, 25 bp, Mus musculus
aggatggccaggatatcctcactct

SEQ ID NO: 198841 - DNA, 25 bp, Mus musculus
aggatggccaggtactgcagggtgc

SEQ ID NO: 198842 - DNA, 25 bp, Mus musculus
aggatggccagtcgtggggcctgtg

SEQ ID NO: 198843 - DNA, 25 bp, Mus musculus
aggatggccagtggaagaaacactg

SEQ ID NO: 198844 - DNA, 25 bp, Mus musculus
aggatggccagtttgtccctttatt

SEQ ID NO: 198845 - DNA, 25 bp, Mus musculus
aggatggcccaaagagggagcggaa

SEQ ID NO: 198846 - DNA, 25 bp, Mus musculus
aggatggcgacgatttccagagcag

SEQ ID NO: 198847 - DNA, 25 bp, Mus musculus
aggatggcgaggaggatctgatgga

SEQ ID NO: 198848 - DNA, 25 bp, Mus musculus
aggatggcggccgaggtctgactgg

SEQ ID NO: 198849 - DNA, 25 bp, Mus musculus
aggatggctgatatagacagaatca

SEQ ID NO: 198850 - DNA, 25 bp, Mus musculus
aggatgggaagatggaccggcagat

SEQ ID NO: 198851 - DNA, 25 bp, Mus musculus
aggatgggccgaaagaattcagtag

SEQ ID NO: 198852 - DNA, 25 bp, Mus musculus
aggatgggccgccagaattcagtag

SEQ ID NO: 198853 - DNA, 25 bp, Mus musculus
aggatgggctccccaggagatggcc

SEQ ID NO: 198854 - DNA, 25 bp, Mus musculus
aggatggggacgaaagcatccacaa

SEQ ID NO: 198855 - DNA, 25 bp, Mus musculus
aggatggtctccgacatcaacaatg

SEQ ID NO: 198856 - DNA, 25 bp, Mus musculus
aggatggtgagctccctgtggagga

SEQ ID NO: 198857 - DNA, 25 bp, Mus musculus
aggatggtgcttcggtacctgggcc

SEQ ID NO: 198858 - DNA, 25 bp, Mus musculus
aggatggtggccacctgggtgcagt

SEQ ID NO: 198859 - DNA, 25 bp, Mus musculus
aggatggtgtagcacatttccttct

SEQ ID NO: 198860 - DNA, 25 bp, Mus musculus
aggatgtacaggggagcagcgcggt

SEQ ID NO: 198861 - DNA, 25 bp, Mus musculus
aggatgtagaaaagaagctcaataa

SEQ ID NO: 198862 - DNA, 25 bp, Mus musculus
aggatgtcgagatgcagatctcttg

SEQ ID NO: 198863 - DNA, 25 bp, Mus musculus
aggatgtcgaggtacggtcagaata

SEQ ID NO: 198864 - DNA, 25 bp, Mus musculus
aggatgtctagaagctctaggaatg

SEQ ID NO: 198865 - DNA, 25 bp, Mus musculus
aggatgtctgtgagcagtctcgaat

SEQ ID NO: 198866 - DNA, 25 bp, Mus musculus
aggatgtgagtggcgttatatgaat

SEQ ID NO: 198867 - DNA, 25 bp, Mus musculus
aggatgtgatggaggatgtggtgga

SEQ ID NO: 198868 - DNA, 25 bp, Mus musculus
aggatgtgccagaacaagctgtttg

SEQ ID NO: 198869 - DNA, 25 bp, Mus musculus
aggatgtggagctggaccagatctg

SEQ ID NO: 198870 - DNA, 25 bp, Mus musculus
aggatgtggatgggttgacgagcgt

SEQ ID NO: 198871 - DNA, 25 bp, Mus musculus
aggatgtgggccagctacctgggtg

SEQ ID NO: 198872 - DNA, 25 bp, Mus musculus
aggatgttacggaggacccgagtca

SEQ ID NO: 198873 - DNA, 25 bp, Mus musculus
aggatgttatggagggagtgaagcc

SEQ ID NO: 198874 - DNA, 25 bp, Mus musculus
aggatgtttaacagtattgcagaaa

SEQ ID NO: 198875 - DNA, 25 bp, Mus musculus
aggatgtttcctgagatgtaaagaa

SEQ ID NO: 198876 - DNA, 25 bp, Mus musculus
aggatgtttcctgaggctactgaaa

SEQ ID NO: 198877 - DNA, 25 bp, Mus musculus
aggatgtttcctgtctagtgagtgc

SEQ ID NO: 198878 - DNA, 25 bp, Mus musculus
aggatgtttcctgtctggtgagtgt

SEQ ID NO: 198879 - DNA, 25 bp, Mus musculus
aggattaattagaaaaggaggcgct

SEQ ID NO: 198880 - DNA, 25 bp, Mus musculus
aggattacaggactggatcctgtag

SEQ ID NO: 198881 - DNA, 25 bp, Mus musculus
aggattacaggcgaccccctcggct

SEQ ID NO: 198882 - DNA, 25 bp, Mus musculus
aggattaccgaaggcaaatggaaaa

SEQ ID NO: 198883 - DNA, 25 bp, Mus musculus
aggattagggatcttggcaaccatg

SEQ ID NO: 198884 - DNA, 25 bp, Mus musculus
aggattatagatcctggcagccacc

SEQ ID NO: 198885 - DNA, 25 bp, Mus musculus
aggattattccagtacttccaggtg

SEQ ID NO: 198886 - DNA, 25 bp, Mus musculus
aggattcaagggagccccgggcgtt

SEQ ID NO: 198887 - DNA, 25 bp, Mus musculus
aggattcacacagattctggaacaa

SEQ ID NO: 198888 - DNA, 25 bp, Mus musculus
aggattcaccatgactctgctgcag

SEQ ID NO: 198889 - DNA, 25 bp, Mus musculus
aggattcagacccgattagtggagt

SEQ ID NO: 198890 - DNA, 25 bp, Mus musculus
aggattcatgaaagtcctgaagtgt

SEQ ID NO: 198891 - DNA, 25 bp, Mus musculus
aggattccaagctaccacagtgaac

SEQ ID NO: 198892 - DNA, 25 bp, Mus musculus
aggattccaagctcctactactcag

SEQ ID NO: 198893 - DNA, 25 bp, Mus musculus
aggattccagccagaccagcggagt

SEQ ID NO: 198894 - DNA, 25 bp, Mus musculus
aggattccaggagtccctggctcca

SEQ ID NO: 198895 - DNA, 25 bp, Mus musculus
aggattccagtgtgacctgctgtct

SEQ ID NO: 198896 - DNA, 25 bp, Mus musculus
aggattccagtgtgtgtttcctggc

SEQ ID NO: 198897 - DNA, 25 bp, Mus musculus
aggattcccaagccatgtattctca

SEQ ID NO: 198898 - DNA, 25 bp, Mus musculus
aggattcccaggtgctcctggctct

SEQ ID NO: 198899 - DNA, 25 bp, Mus musculus
aggattcctcacaggaaagcaaaga

SEQ ID NO: 198900 - DNA, 25 bp, Mus musculus
aggattcgttaagagaggagaactt

SEQ ID NO: 198901 - DNA, 25 bp, Mus musculus
aggattctaaaaggaatattattgg

SEQ ID NO: 198902 - DNA, 25 bp, Mus musculus
aggattctatgacccctcaccatcc

SEQ ID NO: 198903 - DNA, 25 bp, Mus musculus
aggattctatgctgggcacacagga

SEQ ID NO: 198904 - DNA, 25 bp, Mus musculus
aggattctcgatccagagacaatgg

SEQ ID NO: 198905 - DNA, 25 bp, Mus musculus
aggattctgaagtgagtaatagttc

SEQ ID NO: 198906 - DNA, 25 bp, Mus musculus
aggattctgacatcctgcagagcct

SEQ ID NO: 198907 - DNA, 25 bp, Mus musculus
aggattctgacattgatggcgaggc

SEQ ID NO: 198908 - DNA, 25 bp, Mus musculus
aggattctgctcttgctgtccatct

SEQ ID NO: 198909 - DNA, 25 bp, Mus musculus
aggattctgggaggctccccagcac

SEQ ID NO: 198910 - DNA, 25 bp, Mus musculus
aggattcttagcaagggtctgtcac

SEQ ID NO: 198911 - DNA, 25 bp, Mus musculus
aggattcttccttgaaatttgcctt

SEQ ID NO: 198912 - DNA, 25 bp, Mus musculus
aggattctttgggaatgccctctac

SEQ ID NO: 198913 - DNA, 25 bp, Mus musculus
aggattgaccacaggaataactcaa

SEQ ID NO: 198914 - DNA, 25 bp, Mus musculus
aggattgcagcacctaccctcaggc

SEQ ID NO: 198915 - DNA, 25 bp, Mus musculus
aggattgcattaggaaagaatgttt

SEQ ID NO: 198916 - DNA, 25 bp, Mus musculus
aggattgcgaggatcgccacgactc

SEQ ID NO: 198917 - DNA, 25 bp, Mus musculus
aggattggaaaggttccaggatggc

SEQ ID NO: 198918 - DNA, 25 bp, Mus musculus
aggattggaagatcgaagcctgttc

SEQ ID NO: 198919 - DNA, 25 bp, Mus musculus
aggattgggaagaaaaagaagagga

SEQ ID NO: 198920 - DNA, 25 bp, Mus musculus
aggattgggaagggctcctgtgcta

SEQ ID NO: 198921 - DNA, 25 bp, Mus musculus
aggattgtagcctctatcacacggt

SEQ ID NO: 198922 - DNA, 25 bp, Mus musculus
aggattgtcccgaaagggtctcctg

SEQ ID NO: 198923 - DNA, 25 bp, Mus musculus
aggattgtcccgatgtgaaacattt

SEQ ID NO: 198924 - DNA, 25 bp, Mus musculus
aggattgtgacctgcctgttcacct

SEQ ID NO: 198925 - DNA, 25 bp, Mus musculus
aggattgtgatatcgtgtcccgaga

SEQ ID NO: 198926 - DNA, 25 bp, Mus musculus
aggattgtggtaacaaataacaaag

SEQ ID NO: 198927 - DNA, 25 bp, Mus musculus
aggattgtgtgtctggcttatggta

SEQ ID NO: 198928 - DNA, 25 bp, Mus musculus
aggattgtgtgtctgggagaagatg

SEQ ID NO: 198929 - DNA, 25 bp, Mus musculus
aggatttaaccctgagataccagag

SEQ ID NO: 198930 - DNA, 25 bp, Mus musculus
aggatttaatggttgctctctgaaa

SEQ ID NO: 198931 - DNA, 25 bp, Mus musculus
aggatttcagtttacccatcatggc

SEQ ID NO: 198932 - DNA, 25 bp, Mus musculus
aggatttcatcaagctcctggttga

SEQ ID NO: 198933 - DNA, 25 bp, Mus musculus
aggatttcatcaaggctatggcaat

SEQ ID NO: 198934 - DNA, 25 bp, Mus musculus
aggatttcatgtttgagatcagtcg

SEQ ID NO: 198935 - DNA, 25 bp, Mus musculus
aggatttcccaggtaagcttcaagc

SEQ ID NO: 198936 - DNA, 25 bp, Mus musculus
aggatttccccagccagatcttctg

SEQ ID NO: 198937 - DNA, 25 bp, Mus musculus
aggatttcctgattccacgaggacc

SEQ ID NO: 198938 - DNA, 25 bp, Mus musculus
aggatttctaagcattccatattgg

SEQ ID NO: 198939 - DNA, 25 bp, Mus musculus
aggatttctaaggcttcagaagagg

SEQ ID NO: 198940 - DNA, 25 bp, Mus musculus
aggatttgaggcctacctaggactc

SEQ ID NO: 198941 - DNA, 25 bp, Mus musculus
aggatttgagttttaagctataaca

SEQ ID NO: 198942 - DNA, 25 bp, Mus musculus
aggatttggagtagatcaatcccct

SEQ ID NO: 198943 - DNA, 25 bp, Mus musculus
aggatttggagtctgtctccaagga

SEQ ID NO: 198944 - DNA, 25 bp, Mus musculus
aggatttgggagccaaagactctgt

SEQ ID NO: 198945 - DNA, 25 bp, Mus musculus
aggatttggggtggtatcacggcaa

SEQ ID NO: 198946 - DNA, 25 bp, Mus musculus
aggatttgtgaagaaacccccagtt

SEQ ID NO: 198947 - DNA, 25 bp, Mus musculus
aggatttgtgaaggtatccgccccc

SEQ ID NO: 198948 - DNA, 25 bp, Mus musculus
aggatttgtgaaggtttcagaggat

SEQ ID NO: 198949 - DNA, 25 bp, Mus musculus
aggatttgttgtggctttttaaagt

SEQ ID NO: 198950 - DNA, 25 bp, Mus musculus
aggattttaaagacggctatggatg

SEQ ID NO: 198951 - DNA, 25 bp, Mus musculus
aggattttaaagagtattcaaattg

SEQ ID NO: 198952 - DNA, 25 bp, Mus musculus
aggattttaaagtggacatcccaga

SEQ ID NO: 198953 - DNA, 25 bp, Mus musculus
aggattttctcacaaacattaacca

SEQ ID NO: 198954 - DNA, 25 bp, Mus musculus
aggattttctcacaataggtgacct

SEQ ID NO: 198955 - DNA, 25 bp, Mus musculus
aggattttctcacatcttggaggag

SEQ ID NO: 198956 - DNA, 25 bp, Mus musculus
aggattttctcagggaggcgccttg

SEQ ID NO: 198957 - DNA, 25 bp, Mus musculus
aggattttctcaggggccgatcaac

SEQ ID NO: 198958 - DNA, 25 bp, Mus musculus
aggattttctgtgcagcagatttac

SEQ ID NO: 198959 - DNA, 25 bp, Mus musculus
aggattttctgtgcctttattgctt

SEQ ID NO: 198960 - DNA, 25 bp, Mus musculus
aggattttgagaacctgggtgtggt

SEQ ID NO: 198961 - DNA, 25 bp, Mus musculus
aggattttgagatgtccatatgtgg

SEQ ID NO: 198962 - DNA, 25 bp, Mus musculus
aggatttttctagcaagttgcgaat

SEQ ID NO: 198963 - DNA, 25 bp, Mus musculus
aggatttttctaggacatgtatgca

SEQ ID NO: 198964 - DNA, 25 bp, Mus musculus
aggatttttgtcctacttggaggaa

SEQ ID NO: 198965 - DNA, 25 bp, Mus musculus
aggcaaaaaaagtggacgctcaggg

SEQ ID NO: 198966 - DNA, 25 bp, Mus musculus
aggcaaaaaggccaaagcctcactg

SEQ ID NO: 198967 - DNA, 25 bp, Mus musculus
aggcaaaacagaaacgttcctgaga

SEQ ID NO: 198968 - DNA, 25 bp, Mus musculus
aggcaaaactgagtgaccttcagaa

SEQ ID NO: 198969 - DNA, 25 bp, Mus musculus
aggcaaaagcagaaccgggatggac

SEQ ID NO: 198970 - DNA, 25 bp, Mus musculus
aggcaaaagcagattttatcatgtg

SEQ ID NO: 198971 - DNA, 25 bp, Mus musculus
aggcaaaagcagctacctgtttgca

SEQ ID NO: 198972 - DNA, 25 bp, Mus musculus
aggcaaaagcaggtacctgtttgca

SEQ ID NO: 198973 - DNA, 25 bp, Mus musculus
aggcaaaagccagtgggaagagcat

SEQ ID NO: 198974 - DNA, 25 bp, Mus musculus
aggcaaaagtgagtggagctcctct

SEQ ID NO: 198975 - DNA, 25 bp, Mus musculus
aggcaaaatagcgatgtctggaata

SEQ ID NO: 198976 - DNA, 25 bp, Mus musculus
aggcaaaattggaaagagaacttga

SEQ ID NO: 198977 - DNA, 25 bp, Mus musculus
aggcaaaattgtctgtccactctgt

SEQ ID NO: 198978 - DNA, 25 bp, Mus musculus
aggcaaacaacagggcagcagaaga

SEQ ID NO: 198979 - DNA, 25 bp, Mus musculus
aggcaaacaacagggtggcagacga

SEQ ID NO: 198980 - DNA, 25 bp, Mus musculus
aggcaaacagacagtgattgtatgt

SEQ ID NO: 198981 - DNA, 25 bp, Mus musculus
aggcaaacaggggcaattattgctg

SEQ ID NO: 198982 - DNA, 25 bp, Mus musculus
aggcaaacagggtacctttcacagt

SEQ ID NO: 198983 - DNA, 25 bp, Mus musculus
aggcaaacagtggctctgaagcgga

SEQ ID NO: 198984 - DNA, 25 bp, Mus musculus
aggcaaactaacaaggacaatcagt

SEQ ID NO: 198985 - DNA, 25 bp, Mus musculus
aggcaaactaacaaggatattacaa

SEQ ID NO: 198986 - DNA, 25 bp, Mus musculus
aggcaaactcttcctaagaaacctc

SEQ ID NO: 198987 - DNA, 25 bp, Mus musculus
aggcaaagacaaggaggcagaagat

SEQ ID NO: 198988 - DNA, 25 bp, Mus musculus
aggcaaagagaaagggaaaaactct

SEQ ID NO: 198989 - DNA, 25 bp, Mus musculus
aggcaaagaggaacagagtgtttga

SEQ ID NO: 198990 - DNA, 25 bp, Mus musculus
aggcaaagatacagagtcaggggat

SEQ ID NO: 198991 - DNA, 25 bp, Mus musculus
aggcaaagatccagacaaggagggc

SEQ ID NO: 198992 - DNA, 25 bp, Mus musculus
aggcaaagatgcagctgtgtcggct

SEQ ID NO: 198993 - DNA, 25 bp, Mus musculus
aggcaaagattgtgtgctgttccac

SEQ ID NO: 198994 - DNA, 25 bp, Mus musculus
aggcaaagccgacgcagtatgagat

SEQ ID NO: 198995 - DNA, 25 bp, Mus musculus
aggcaaagccggctccagccacaat

SEQ ID NO: 198996 - DNA, 25 bp, Mus musculus
aggcaaagcgtagaatgagaagact

SEQ ID NO: 198997 - DNA, 25 bp, Mus musculus
aggcaaagcgtagcttcatactagg

SEQ ID NO: 198998 - DNA, 25 bp, Mus musculus
aggcaaagcgtagcttgaagtcaat

SEQ ID NO: 198999 - DNA, 25 bp, Mus musculus
aggcaaagctagacaagttggatgg

SEQ ID NO: 199000 - DNA, 25 bp, Mus musculus
aggcaaagctgaccagaaggaaaag

SEQ ID NO: 199001 - DNA, 25 bp, Mus musculus
aggcaaaggtgtgccccagctcctg

SEQ ID NO: 199002 - DNA, 25 bp, Mus musculus
aggcaaatcagaatgagttgcaagc

SEQ ID NO: 199003 - DNA, 25 bp, Mus musculus
aggcaaatggaaggaaacttcatgg

SEQ ID NO: 199004 - DNA, 25 bp, Mus musculus
aggcaaatgtcagccatgcaagtgc

SEQ ID NO: 199005 - DNA, 25 bp, Mus musculus
aggcaaatgtccctccacctcctgg

SEQ ID NO: 199006 - DNA, 25 bp, Mus musculus
aggcaacaagatgaagaacaacgag

SEQ ID NO: 199007 - DNA, 25 bp, Mus musculus
aggcaacaaggatgctacagctatg

SEQ ID NO: 199008 - DNA, 25 bp, Mus musculus
aggcaacacagtgctgctcttagca

SEQ ID NO: 199009 - DNA, 25 bp, Mus musculus
aggcaacactggccggacccacatt

SEQ ID NO: 199010 - DNA, 25 bp, Mus musculus
aggcaacaggccaggaaggaaaaac

SEQ ID NO: 199011 - DNA, 25 bp, Mus musculus
aggcaacatcagaaagtgactcaga

SEQ ID NO: 199012 - DNA, 25 bp, Mus musculus
aggcaacatcagaattggaaaagtc

SEQ ID NO: 199013 - DNA, 25 bp, Mus musculus
aggcaacatcgctgtgggcaaatcc

SEQ ID NO: 199014 - DNA, 25 bp, Mus musculus
aggcaacatcggatggcacttccaa

SEQ ID NO: 199015 - DNA, 25 bp, Mus musculus
aggcaacatggaagtgaaggatgcg

SEQ ID NO: 199016 - DNA, 25 bp, Mus musculus
aggcaaccaagcattatgagatgct

SEQ ID NO: 199017 - DNA, 25 bp, Mus musculus
aggcaaccagagtaccagtgatggg

SEQ ID NO: 199018 - DNA, 25 bp, Mus musculus
aggcaaccgcaggactactggtgcc

SEQ ID NO: 199019 - DNA, 25 bp, Mus musculus
aggcaacgggggtctctttaggtgg

SEQ ID NO: 199020 - DNA, 25 bp, Mus musculus
aggcaactaggaggctggattgtcc

SEQ ID NO: 199021 - DNA, 25 bp, Mus musculus
aggcaactagggtttcaactctgag

SEQ ID NO: 199022 - DNA, 25 bp, Mus musculus
aggcaactccgagtttgtggggaca

SEQ ID NO: 199023 - DNA, 25 bp, Mus musculus
aggcaagaaccggagacaatcaggc

SEQ ID NO: 199024 - DNA, 25 bp, Mus musculus
aggcaagaaccgttctcaagaaccc

SEQ ID NO: 199025 - DNA, 25 bp, Mus musculus
aggcaagaagacagtaaccagtttt

SEQ ID NO: 199026 - DNA, 25 bp, Mus musculus
aggcaagaagagacttgaggcttct

SEQ ID NO: 199027 - DNA, 25 bp, Mus musculus
aggcaagaagtcctgccacactggg

SEQ ID NO: 199028 - DNA, 25 bp, Mus musculus
aggcaagaatgggataatactgtga

SEQ ID NO: 199029 - DNA, 25 bp, Mus musculus
aggcaagacagattacaaaagaaga

SEQ ID NO: 199030 - DNA, 25 bp, Mus musculus
aggcaagacatgtaccagtgcttgg

SEQ ID NO: 199031 - DNA, 25 bp, Mus musculus
aggcaagatcaaagcctcagcgttc

SEQ ID NO: 199032 - DNA, 25 bp, Mus musculus
aggcaagatgcctttgcggggcctt

SEQ ID NO: 199033 - DNA, 25 bp, Mus musculus
aggcaagcagcaggggaccagcctc

SEQ ID NO: 199034 - DNA, 25 bp, Mus musculus
aggcaagcagctccagtcagtctca

SEQ ID NO: 199035 - DNA, 25 bp, Mus musculus
aggcaagctctggaggttgctgaac

SEQ ID NO: 199036 - DNA, 25 bp, Mus musculus
aggcaagctgagtcaaagcagcatg

SEQ ID NO: 199037 - DNA, 25 bp, Mus musculus
aggcaaggaaccagaggaattctgg

SEQ ID NO: 199038 - DNA, 25 bp, Mus musculus
aggcaaggaagacatacatgggcct

SEQ ID NO: 199039 - DNA, 25 bp, Mus musculus
aggcaaggagaggtacaaaatgaag

SEQ ID NO: 199040 - DNA, 25 bp, Mus musculus
aggcaaggaggtggatacgacgctg

SEQ ID NO: 199041 - DNA, 25 bp, Mus musculus
aggcaaggatagcatccatgtctta

SEQ ID NO: 199042 - DNA, 25 bp, Mus musculus
aggcaaggatagggagcgcctcatc

SEQ ID NO: 199043 - DNA, 25 bp, Mus musculus
aggcaaggcaagaggaagaatacaa

SEQ ID NO: 199044 - DNA, 25 bp, Mus musculus
aggcaaggcaagtacccagtggatt

SEQ ID NO: 199045 - DNA, 25 bp, Mus musculus
aggcaaggcgggcatctcctcccaa

SEQ ID NO: 199046 - DNA, 25 bp, Mus musculus
aggcaaggcgttcacagacgaggag

SEQ ID NO: 199047 - DNA, 25 bp, Mus musculus
aggcaaggggatgaaagcttgcggc

SEQ ID NO: 199048 - DNA, 25 bp, Mus musculus
aggcaagtccctcagggtgatgtga

SEQ ID NO: 199049 - DNA, 25 bp, Mus musculus
aggcaagtgagtccgatgccttacg

SEQ ID NO: 199050 - DNA, 25 bp, Mus musculus
aggcaagtgagtccgcaccttcagg

SEQ ID NO: 199051 - DNA, 25 bp, Mus musculus
aggcaagtggaggatccattttctc

SEQ ID NO: 199052 - DNA, 25 bp, Mus musculus
aggcaagttaactgctcttcagggc

SEQ ID NO: 199053 - DNA, 25 bp, Mus musculus
aggcaataaattggagagaggtcag

SEQ ID NO: 199054 - DNA, 25 bp, Mus musculus
aggcaatacgtgtcatagaatgtcg

SEQ ID NO: 199055 - DNA, 25 bp, Mus musculus
aggcaatcaagtattctgagagaag

SEQ ID NO: 199056 - DNA, 25 bp, Mus musculus
aggcaatcgtgaagtcctacctata

SEQ ID NO: 199057 - DNA, 25 bp, Mus musculus
aggcaatgaaggaagaagaaagaaa

SEQ ID NO: 199058 - DNA, 25 bp, Mus musculus
aggcaatgaaggctccatatattta

SEQ ID NO: 199059 - DNA, 25 bp, Mus musculus
aggcaatgaaggtaaatgatctccg

SEQ ID NO: 199060 - DNA, 25 bp, Mus musculus
aggcaattctagtggctgcggcttc

SEQ ID NO: 199061 - DNA, 25 bp, Mus musculus
aggcaattgttatcccaactgtaaa

SEQ ID NO: 199062 - DNA, 25 bp, Mus musculus
aggcacaaacgccagacgtgaaaaa

SEQ ID NO: 199063 - DNA, 25 bp, Mus musculus
aggcacacagagcaggtcatacctc

SEQ ID NO: 199064 - DNA, 25 bp, Mus musculus
aggcacacagagcagtacctcaaat

SEQ ID NO: 199065 - DNA, 25 bp, Mus musculus
aggcacaccagggcaccctcagatc

SEQ ID NO: 199066 - DNA, 25 bp, Mus musculus
aggcacacgcaggtgcctcctcctg

SEQ ID NO: 199067 - DNA, 25 bp, Mus musculus
aggcacagaaccaaaggacacagct

SEQ ID NO: 199068 - DNA, 25 bp, Mus musculus
aggcacagagaaagaatcatagcaa

SEQ ID NO: 199069 - DNA, 25 bp, Mus musculus
aggcacagagatcaaaggcacagct

SEQ ID NO: 199070 - DNA, 25 bp, Mus musculus
aggcacagcaggagatagggtttca

SEQ ID NO: 199071 - DNA, 25 bp, Mus musculus
aggcacagcaggagttcaagaacgc

SEQ ID NO: 199072 - DNA, 25 bp, Mus musculus
aggcacaggaaactggccaaggtgg

SEQ ID NO: 199073 - DNA, 25 bp, Mus musculus
aggcacaggctccaggctgttggaa

SEQ ID NO: 199074 - DNA, 25 bp, Mus musculus
aggcacagtggagttaccctgcatc

SEQ ID NO: 199075 - DNA, 25 bp, Mus musculus
aggcacatacccaggatcaaaaccc

SEQ ID NO: 199076 - DNA, 25 bp, Mus musculus
aggcacatacccaggttgctgcctt

SEQ ID NO: 199077 - DNA, 25 bp, Mus musculus
aggcacatcttcaggactcggaagg

SEQ ID NO: 199078 - DNA, 25 bp, Mus musculus
aggcacattgtcggtgtacttggga

SEQ ID NO: 199079 - DNA, 25 bp, Mus musculus
aggcaccaacaggcctgatgggacc

SEQ ID NO: 199080 - DNA, 25 bp, Mus musculus
aggcaccaacaggggagtatgtgct

SEQ ID NO: 199081 - DNA, 25 bp, Mus musculus
aggcaccaataaaatggatcttcat

SEQ ID NO: 199082 - DNA, 25 bp, Mus musculus
aggcaccaataaaattggtgttccc

SEQ ID NO: 199083 - DNA, 25 bp, Mus musculus
aggcaccagaagcagccaggcttct

SEQ ID NO: 199084 - DNA, 25 bp, Mus musculus
aggcaccagaagcagccatggaccc

SEQ ID NO: 199085 - DNA, 25 bp, Mus musculus
aggcaccagcgcagggaatggatac

SEQ ID NO: 199086 - DNA, 25 bp, Mus musculus
aggcaccagtctgcgttaagcatct

SEQ ID NO: 199087 - DNA, 25 bp, Mus musculus
aggcaccatgccggcccgcaggccc

SEQ ID NO: 199088 - DNA, 25 bp, Mus musculus
aggcaccatgccgggtggatacctt

SEQ ID NO: 199089 - DNA, 25 bp, Mus musculus
aggcaccatgggaccctctagagta

SEQ ID NO: 199090 - DNA, 25 bp, Mus musculus
aggcaccatggggtgcagggaaggg

SEQ ID NO: 199091 - DNA, 25 bp, Mus musculus
aggcacccatggctcaaactaccat

SEQ ID NO: 199092 - DNA, 25 bp, Mus musculus
aggcacccgccgaggtatttcaaca

SEQ ID NO: 199093 - DNA, 25 bp, Mus musculus
aggcaccgaagagagtgtgaacatg

SEQ ID NO: 199094 - DNA, 25 bp, Mus musculus
aggcaccgcaaatgagagtcagtcc

SEQ ID NO: 199095 - DNA, 25 bp, Mus musculus
aggcaccgcgatgtgctggctgctg

SEQ ID NO: 199096 - DNA, 25 bp, Mus musculus
aggcaccgcggaccgtctgggcaga

SEQ ID NO: 199097 - DNA, 25 bp, Mus musculus
aggcacctgaaaacagcaatgcagg

SEQ ID NO: 199098 - DNA, 25 bp, Mus musculus
aggcacctggctgagttcactcacg

SEQ ID NO: 199099 - DNA, 25 bp, Mus musculus
aggcaccttgaagatccttcgtacc

SEQ ID NO: 199100 - DNA, 25 bp, Mus musculus
aggcaccttgggtcctgggccttgt

SEQ ID NO: 199101 - DNA, 25 bp, Mus musculus
aggcacgaaagtgagggaagactcc

SEQ ID NO: 199102 - DNA, 25 bp, Mus musculus
aggcacgagaggacaatagccttaa

SEQ ID NO: 199103 - DNA, 25 bp, Mus musculus
aggcacgagcaagagtactgtttgg

SEQ ID NO: 199104 - DNA, 25 bp, Mus musculus
aggcacgcagggcagaagtcgtgtt

SEQ ID NO: 199105 - DNA, 25 bp, Mus musculus
aggcacggagcacttgtctctgcat

SEQ ID NO: 199106 - DNA, 25 bp, Mus musculus
aggcacgtctacaagacgctgaagg

SEQ ID NO: 199107 - DNA, 25 bp, Mus musculus
aggcacgtctacaaggccatgacgt

SEQ ID NO: 199108 - DNA, 25 bp, Mus musculus
aggcacgtgtgggatctttctcaag

SEQ ID NO: 199109 - DNA, 25 bp, Mus musculus
aggcactacagatgttcatctagaa

SEQ ID NO: 199110 - DNA, 25 bp, Mus musculus
aggcactatgggagaaataccgaca

SEQ ID NO: 199111 - DNA, 25 bp, Mus musculus
aggcactcaaatgaacatggttggt

SEQ ID NO: 199112 - DNA, 25 bp, Mus musculus
aggcactcagagaatgggacaccct

SEQ ID NO: 199113 - DNA, 25 bp, Mus musculus
aggcactcagtttttcagttctacc

SEQ ID NO: 199114 - DNA, 25 bp, Mus musculus
aggcactcatgggtggaggtgggaa

SEQ ID NO: 199115 - DNA, 25 bp, Mus musculus
aggcactccagatgaaagcttgcgg

SEQ ID NO: 199116 - DNA, 25 bp, Mus musculus
aggcactccagtcaatgggtcacag

SEQ ID NO: 199117 - DNA, 25 bp, Mus musculus
aggcactgaagggccacacatggtt

SEQ ID NO: 199118 - DNA, 25 bp, Mus musculus
aggcactgaagtggactgcctgcga

SEQ ID NO: 199119 - DNA, 25 bp, Mus musculus
aggcactgatatcaggaggagccat

SEQ ID NO: 199120 - DNA, 25 bp, Mus musculus
aggcactgccaccgcgttcacattc

SEQ ID NO: 199121 - DNA, 25 bp, Mus musculus
aggcactgccaccgctcacgaagtt

SEQ ID NO: 199122 - DNA, 25 bp, Mus musculus
aggcactggcctcgatctactcccc

SEQ ID NO: 199123 - DNA, 25 bp, Mus musculus
aggcactgtggatggaccagggaaa

SEQ ID NO: 199124 - DNA, 25 bp, Mus musculus
aggcacttaaggaaattggggatgt

SEQ ID NO: 199125 - DNA, 25 bp, Mus musculus
aggcagaaagaattgcctatcagag

SEQ ID NO: 199126 - DNA, 25 bp, Mus musculus
aggcagaacgaggcaaagacaagaa

SEQ ID NO: 199127 - DNA, 25 bp, Mus musculus
aggcagaagatctatctaagtaaga

SEQ ID NO: 199128 - DNA, 25 bp, Mus musculus
aggcagaaggcaaggttcggctcct

SEQ ID NO: 199129 - DNA, 25 bp, Mus musculus
aggcagaaggtgatgtgggtcctcc

SEQ ID NO: 199130 - DNA, 25 bp, Mus musculus
aggcagaatgctatcaaaagcccca

SEQ ID NO: 199131 - DNA, 25 bp, Mus musculus
aggcagacctaacgattcaggccac

SEQ ID NO: 199132 - DNA, 25 bp, Mus musculus
aggcagacctaaggattcaggccac

SEQ ID NO: 199133 - DNA, 25 bp, Mus musculus
aggcagacgatgttgaatgacaaag

SEQ ID NO: 199134 - DNA, 25 bp, Mus musculus
aggcagacgtattgcagactgtgct

SEQ ID NO: 199135 - DNA, 25 bp, Mus musculus
aggcagactggtgccctgggacaac

SEQ ID NO: 199136 - DNA, 25 bp, Mus musculus
aggcagagacgatagattgctaaca

SEQ ID NO: 199137 - DNA, 25 bp, Mus musculus
aggcagagagtaagaactgtgccaa

SEQ ID NO: 199138 - DNA, 25 bp, Mus musculus
aggcagagatctcggcacaacggtc

SEQ ID NO: 199139 - DNA, 25 bp, Mus musculus
aggcagagatctcgggtgagcacct

SEQ ID NO: 199140 - DNA, 25 bp, Mus musculus
aggcagagcagatgggatgagccgg

SEQ ID NO: 199141 - DNA, 25 bp, Mus musculus
aggcagagcagcaggtttccaggca

SEQ ID NO: 199142 - DNA, 25 bp, Mus musculus
aggcagagcaggtgacggtgtggga

SEQ ID NO: 199143 - DNA, 25 bp, Mus musculus
aggcagagcaggttatttcgcttgg

SEQ ID NO: 199144 - DNA, 25 bp, Mus musculus
aggcagagcctgagatctggtggct

SEQ ID NO: 199145 - DNA, 25 bp, Mus musculus
aggcagagcctgaggcccaggatgg

SEQ ID NO: 199146 - DNA, 25 bp, Mus musculus
aggcagagcctggatttatcgaatt

SEQ ID NO: 199147 - DNA, 25 bp, Mus musculus
aggcagagcctggtgctgatgggaa

SEQ ID NO: 199148 - DNA, 25 bp, Mus musculus
aggcagagctggaaaaggtgcagca

SEQ ID NO: 199149 - DNA, 25 bp, Mus musculus
aggcagagctggcaccagaaaccag

SEQ ID NO: 199150 - DNA, 25 bp, Mus musculus
aggcagaggaacgggtttccgcttc

SEQ ID NO: 199151 - DNA, 25 bp, Mus musculus
aggcagaggaggcattatgagagac

SEQ ID NO: 199152 - DNA, 25 bp, Mus musculus
aggcagaggaggtagaggaggcttc

SEQ ID NO: 199153 - DNA, 25 bp, Mus musculus
aggcagaggcaggcgtgcccacact

SEQ ID NO: 199154 - DNA, 25 bp, Mus musculus
aggcagaggtgaagggaagacaaag

SEQ ID NO: 199155 - DNA, 25 bp, Mus musculus
aggcagaggttgtatggagagactc

SEQ ID NO: 199156 - DNA, 25 bp, Mus musculus
aggcagataaagataatggaggtga

SEQ ID NO: 199157 - DNA, 25 bp, Mus musculus
aggcagatacaaaagcacaaccagt

SEQ ID NO: 199158 - DNA, 25 bp, Mus musculus
aggcagatacaaaagtaagaagttg

SEQ ID NO: 199159 - DNA, 25 bp, Mus musculus
aggcagatacaacagcacaaccagt

SEQ ID NO: 199160 - DNA, 25 bp, Mus musculus
aggcagatcagcagggatggcaaga

SEQ ID NO: 199161 - DNA, 25 bp, Mus musculus
aggcagatccggcgaatacaggagg

SEQ ID NO: 199162 - DNA, 25 bp, Mus musculus
aggcagatgcccgacactccagaag

SEQ ID NO: 199163 - DNA, 25 bp, Mus musculus
aggcagatgcccggatgctgatgta

SEQ ID NO: 199164 - DNA, 25 bp, Mus musculus
aggcagattgaacgcaagggggaag

SEQ ID NO: 199165 - DNA, 25 bp, Mus musculus
aggcagattgctcacgtatcacgac

SEQ ID NO: 199166 - DNA, 25 bp, Mus musculus
aggcagatttaagattattaaaaac

SEQ ID NO: 199167 - DNA, 25 bp, Mus musculus
aggcagcaaaaggtctccatagaac

SEQ ID NO: 199168 - DNA, 25 bp, Mus musculus
aggcagcacacgagatttttatcac

SEQ ID NO: 199169 - DNA, 25 bp, Mus musculus
aggcagcactggattcccggtcggg

SEQ ID NO: 199170 - DNA, 25 bp, Mus musculus
aggcagcagaaaccgtaaaagcctt

SEQ ID NO: 199171 - DNA, 25 bp, Mus musculus
aggcagcagagaaccatgtgtgctc

SEQ ID NO: 199172 - DNA, 25 bp, Mus musculus
aggcagcagagaagaaagcccgctg

SEQ ID NO: 199173 - DNA, 25 bp, Mus musculus
aggcagcagagaagggcggtgctgg

SEQ ID NO: 199174 - DNA, 25 bp, Mus musculus
aggcagcagcagaaggtttgatgag

SEQ ID NO: 199175 - DNA, 25 bp, Mus musculus
aggcagcagcaggagaggctacagc

SEQ ID NO: 199176 - DNA, 25 bp, Mus musculus
aggcagcagttgagaatcccagctg

SEQ ID NO: 199177 - DNA, 25 bp, Mus musculus
aggcagcattagaggagctgaccaa

SEQ ID NO: 199178 - DNA, 25 bp, Mus musculus
aggcagccacacgaatctgcagaag

SEQ ID NO: 199179 - DNA, 25 bp, Mus musculus
aggcagccacacggaatacccggag

SEQ ID NO: 199180 - DNA, 25 bp, Mus musculus
aggcagccacacggtgcagcacagt

SEQ ID NO: 199181 - DNA, 25 bp, Mus musculus
aggcagccagcaagtggatctggcg

SEQ ID NO: 199182 - DNA, 25 bp, Mus musculus
aggcagccaggagcccttgaaccca

SEQ ID NO: 199183 - DNA, 25 bp, Mus musculus
aggcagcccagcagggcatcctggc

SEQ ID NO: 199184 - DNA, 25 bp, Mus musculus
aggcagccctggccctgtgggcttt

SEQ ID NO: 199185 - DNA, 25 bp, Mus musculus
aggcagccgacgctgaagctgaggt

SEQ ID NO: 199186 - DNA, 25 bp, Mus musculus
aggcagccgatccagggagaagtca

SEQ ID NO: 199187 - DNA, 25 bp, Mus musculus
aggcagccgatccaggtcccggtcc

SEQ ID NO: 199188 - DNA, 25 bp, Mus musculus
aggcagccgcacaggcagcatatct

SEQ ID NO: 199189 - DNA, 25 bp, Mus musculus
aggcagccggcatatcattgcttat

SEQ ID NO: 199190 - DNA, 25 bp, Mus musculus
aggcagccggcatatccctgattgt

SEQ ID NO: 199191 - DNA, 25 bp, Mus musculus
aggcagccggggcgagaagggtact

SEQ ID NO: 199192 - DNA, 25 bp, Mus musculus
aggcagcctaagggaggaatttggc

SEQ ID NO: 199193 - DNA, 25 bp, Mus musculus
aggcagccttggctggtcgtttgat

SEQ ID NO: 199194 - DNA, 25 bp, Mus musculus
aggcagcgagcgagtggtgatcatg

SEQ ID NO: 199195 - DNA, 25 bp, Mus musculus
aggcagcgcaactacagggctgccc

SEQ ID NO: 199196 - DNA, 25 bp, Mus musculus
aggcagcgcaactgctgcaggctct

SEQ ID NO: 199197 - DNA, 25 bp, Mus musculus
aggcagcgggagctggaacagcagc

SEQ ID NO: 199198 - DNA, 25 bp, Mus musculus
aggcagcgggagggagctgaatctg

SEQ ID NO: 199199 - DNA, 25 bp, Mus musculus
aggcagctagaatgcactggggctg

SEQ ID NO: 199200 - DNA, 25 bp, Mus musculus
aggcagctccaggtataatggccgg

SEQ ID NO: 199201 - DNA, 25 bp, Mus musculus
aggcagctcgacagatgccaaagtc

SEQ ID NO: 199202 - DNA, 25 bp, Mus musculus
aggcagctcgacaggtgcagggccc

SEQ ID NO: 199203 - DNA, 25 bp, Mus musculus
aggcagctgatgagggttctgggga

SEQ ID NO: 199204 - DNA, 25 bp, Mus musculus
aggcagcttgatcagtggaccatcc

SEQ ID NO: 199205 - DNA, 25 bp, Mus musculus
aggcagcttggaggaagagtcactc

SEQ ID NO: 199206 - DNA, 25 bp, Mus musculus
aggcagctttgcagcatgctcacgc

SEQ ID NO: 199207 - DNA, 25 bp, Mus musculus
aggcaggaagctgggccggcacatg

SEQ ID NO: 199208 - DNA, 25 bp, Mus musculus
aggcaggaaggttcgttctcccaga

SEQ ID NO: 199209 - DNA, 25 bp, Mus musculus
aggcaggacaagaaggcaaattaga

SEQ ID NO: 199210 - DNA, 25 bp, Mus musculus
aggcaggacggattctgatgcaatc

SEQ ID NO: 199211 - DNA, 25 bp, Mus musculus
aggcaggacggctgctgtgaaggga

SEQ ID NO: 199212 - DNA, 25 bp, Mus musculus
aggcaggagctgctttttaaattgg

SEQ ID NO: 199213 - DNA, 25 bp, Mus musculus
aggcaggcagattgaccttggccca

SEQ ID NO: 199214 - DNA, 25 bp, Mus musculus
aggcaggctaggtatctccggttta

SEQ ID NO: 199215 - DNA, 25 bp, Mus musculus
aggcaggctaggttcctccggttta

SEQ ID NO: 199216 - DNA, 25 bp, Mus musculus
aggcaggctgccccagcagttgtct

SEQ ID NO: 199217 - DNA, 25 bp, Mus musculus
aggcagggactgggctgcaggtcct

SEQ ID NO: 199218 - DNA, 25 bp, Mus musculus
aggcaggggcggaggatcaacgagg

SEQ ID NO: 199219 - DNA, 25 bp, Mus musculus
aggcaggtcaaccagggaaaatgcc

SEQ ID NO: 199220 - DNA, 25 bp, Mus musculus
aggcaggtccaaggcttgagatttt

SEQ ID NO: 199221 - DNA, 25 bp, Mus musculus
aggcaggtgcaagctggccattctg

SEQ ID NO: 199222 - DNA, 25 bp, Mus musculus
aggcagtcagagaatttaagaagtg

SEQ ID NO: 199223 - DNA, 25 bp, Mus musculus
aggcagtcagagatttgattgagca

SEQ ID NO: 199224 - DNA, 25 bp, Mus musculus
aggcagtctctgggttcagacaatg

SEQ ID NO: 199225 - DNA, 25 bp, Mus musculus
aggcagtcttggattacctgttgca

SEQ ID NO: 199226 - DNA, 25 bp, Mus musculus
aggcagtgaaggaccgtgcaggcag

SEQ ID NO: 199227 - DNA, 25 bp, Mus musculus
aggcagtgaaggcccttgctgctgg

SEQ ID NO: 199228 - DNA, 25 bp, Mus musculus
aggcagtgagatgtccctagacatt

SEQ ID NO: 199229 - DNA, 25 bp, Mus musculus
aggcagtgcagcaggttcaccgtct

SEQ ID NO: 199230 - DNA, 25 bp, Mus musculus
aggcagtgcttctgtgaaagaattg

SEQ ID NO: 199231 - DNA, 25 bp, Mus musculus
aggcagtggcgagactgaaacagtc

SEQ ID NO: 199232 - DNA, 25 bp, Mus musculus
aggcagtggcgaggagtccgctcag

SEQ ID NO: 199233 - DNA, 25 bp, Mus musculus
aggcagtggcgaggtgagccatgat

SEQ ID NO: 199234 - DNA, 25 bp, Mus musculus
aggcagtgggaaagggagtcatgtg

SEQ ID NO: 199235 - DNA, 25 bp, Mus musculus
aggcagtggtggaggtcagagtcag

SEQ ID NO: 199236 - DNA, 25 bp, Mus musculus
aggcagtggtggaggtcagggtagt

SEQ ID NO: 199237 - DNA, 25 bp, Mus musculus
aggcagtgtccatgctcttttgtga

SEQ ID NO: 199238 - DNA, 25 bp, Mus musculus
aggcagtgtccccaccttcaaacac

SEQ ID NO: 199239 - DNA, 25 bp, Mus musculus
aggcagttaaagaggtgaactgccc

SEQ ID NO: 199240 - DNA, 25 bp, Mus musculus
aggcagttagacttgcaagcacctt

SEQ ID NO: 199241 - DNA, 25 bp, Mus musculus
aggcagttcaaggcaataaaagcga

SEQ ID NO: 199242 - DNA, 25 bp, Mus musculus
aggcagttcaagggctaacttaaag

SEQ ID NO: 199243 - DNA, 25 bp, Mus musculus
aggcagtttgaggagtgcatttccc

SEQ ID NO: 199244 - DNA, 25 bp, Mus musculus
aggcatacaggcaaagcgagtggat

SEQ ID NO: 199245 - DNA, 25 bp, Mus musculus
aggcatacaggcctagctctgctag

SEQ ID NO: 199246 - DNA, 25 bp, Mus musculus
aggcataccaggctccagaaatgtt

SEQ ID NO: 199247 - DNA, 25 bp, Mus musculus
aggcatagctggtctgaagagccat

SEQ ID NO: 199248 - DNA, 25 bp, Mus musculus
aggcatagtggagtcccagaggcac

SEQ ID NO: 199249 - DNA, 25 bp, Mus musculus
aggcatatgcttccttggggactga

SEQ ID NO: 199250 - DNA, 25 bp, Mus musculus
aggcatatgcttcggagactcgggc

SEQ ID NO: 199251 - DNA, 25 bp, Mus musculus
aggcatattgggaacgaccaaggac

SEQ ID NO: 199252 - DNA, 25 bp, Mus musculus
aggcatatttgagggattttatata

SEQ ID NO: 199253 - DNA, 25 bp, Mus musculus
aggcatattttggaaaccagtaaag

SEQ ID NO: 199254 - DNA, 25 bp, Mus musculus
aggcatattttggttcttcatgctt

SEQ ID NO: 199255 - DNA, 25 bp, Mus musculus
aggcatcaaaacaaatggcctccac

SEQ ID NO: 199256 - DNA, 25 bp, Mus musculus
aggcatcaagagtcattcccgagcc

SEQ ID NO: 199257 - DNA, 25 bp, Mus musculus
aggcatcaagcacggcacagtttgt

SEQ ID NO: 199258 - DNA, 25 bp, Mus musculus
aggcatcaatgctgttttctactat

SEQ ID NO: 199259 - DNA, 25 bp, Mus musculus
aggcatcacagagctctgcaggtcc

SEQ ID NO: 199260 - DNA, 25 bp, Mus musculus
aggcatcacatgaccagtggctgct

SEQ ID NO: 199261 - DNA, 25 bp, Mus musculus
aggcatcatggctcacctgtgccag

SEQ ID NO: 199262 - DNA, 25 bp, Mus musculus
aggcatccaagagcaactggtggtt

SEQ ID NO: 199263 - DNA, 25 bp, Mus musculus
aggcatccaagcaagcgaagatgtc

SEQ ID NO: 199264 - DNA, 25 bp, Mus musculus
aggcatccaagcatttgtggtccta

SEQ ID NO: 199265 - DNA, 25 bp, Mus musculus
aggcatccacggaagaagtgccttc

SEQ ID NO: 199266 - DNA, 25 bp, Mus musculus
aggcatccacggccatgggttctcc

SEQ ID NO: 199267 - DNA, 25 bp, Mus musculus
aggcatccagggccttttgctcgag

SEQ ID NO: 199268 - DNA, 25 bp, Mus musculus
aggcatccagtgagctgcttatcat

SEQ ID NO: 199269 - DNA, 25 bp, Mus musculus
aggcatccgggtgatcatggtgacc

SEQ ID NO: 199270 - DNA, 25 bp, Mus musculus
aggcatcctcaaggacacccagttg

SEQ ID NO: 199271 - DNA, 25 bp, Mus musculus
aggcatcctggtcatttgaagactg

SEQ ID NO: 199272 - DNA, 25 bp, Mus musculus
aggcatcgagggcttcttcggcttc

SEQ ID NO: 199273 - DNA, 25 bp, Mus musculus
aggcatctctcccttctgcatgcag

SEQ ID NO: 199274 - DNA, 25 bp, Mus musculus
aggcatctgagtgatataaaaacaa

SEQ ID NO: 199275 - DNA, 25 bp, Mus musculus
aggcatgaactatgaagatgactgt

SEQ ID NO: 199276 - DNA, 25 bp, Mus musculus
aggcatgaagtagacaccatccatg

SEQ ID NO: 199277 - DNA, 25 bp, Mus musculus
aggcatgaagtagagaccatccatg

SEQ ID NO: 199278 - DNA, 25 bp, Mus musculus
aggcatgacaggagctggagaagct

SEQ ID NO: 199279 - DNA, 25 bp, Mus musculus
aggcatgaggggccataaaggggcg

SEQ ID NO: 199280 - DNA, 25 bp, Mus musculus
aggcatgagtggagccagagaacag

SEQ ID NO: 199281 - DNA, 25 bp, Mus musculus
aggcatgatatggttccttgttccc

SEQ ID NO: 199282 - DNA, 25 bp, Mus musculus
aggcatgcagtaaaggccaaaaatc

SEQ ID NO: 199283 - DNA, 25 bp, Mus musculus
aggcatgccgggtggctttgctgag

SEQ ID NO: 199284 - DNA, 25 bp, Mus musculus
aggcatgctccctgacctcagctcc

SEQ ID NO: 199285 - DNA, 25 bp, Mus musculus
aggcatggattcagaaaattaatga

SEQ ID NO: 199286 - DNA, 25 bp, Mus musculus
aggcatgggcagaggtatatgtggt

SEQ ID NO: 199287 - DNA, 25 bp, Mus musculus
aggcatgggctacatgccctcagcc

SEQ ID NO: 199288 - DNA, 25 bp, Mus musculus
aggcatgggctacatggcctcttcc

SEQ ID NO: 199289 - DNA, 25 bp, Mus musculus
aggcatgggctacattgcacacttg

SEQ ID NO: 199290 - DNA, 25 bp, Mus musculus
aggcatgggcttgtcaaaccagtcc

SEQ ID NO: 199291 - DNA, 25 bp, Mus musculus
aggcatgggtttgtcaaaccagtcc

SEQ ID NO: 199292 - DNA, 25 bp, Mus musculus
aggcatggtttggatttgcgggaac

SEQ ID NO: 199293 - DNA, 25 bp, Mus musculus
aggcatgtggctctggtttccagtc

SEQ ID NO: 199294 - DNA, 25 bp, Mus musculus
aggcatgttggaagttcccatggcc

SEQ ID NO: 199295 - DNA, 25 bp, Mus musculus
aggcatgttggagcctgctatggga

SEQ ID NO: 199296 - DNA, 25 bp, Mus musculus
aggcatgttggagcttcaaggagaa

SEQ ID NO: 199297 - DNA, 25 bp, Mus musculus
aggcatgttggaggtaataaagctc

SEQ ID NO: 199298 - DNA, 25 bp, Mus musculus
aggcattaaacaggacattcacctt

SEQ ID NO: 199299 - DNA, 25 bp, Mus musculus
aggcattacgtcatgtactatgaga

SEQ ID NO: 199300 - DNA, 25 bp, Mus musculus
aggcattatgtgatggctgcacccc

SEQ ID NO: 199301 - DNA, 25 bp, Mus musculus
aggcattatgtgatgtactacgaga

SEQ ID NO: 199302 - DNA, 25 bp, Mus musculus
aggcattcatgcggaaagacgtgcg

SEQ ID NO: 199303 - DNA, 25 bp, Mus musculus
aggcattcatgcggatgcgttttga

SEQ ID NO: 199304 - DNA, 25 bp, Mus musculus
aggcattgacccttcttggagcttg

SEQ ID NO: 199305 - DNA, 25 bp, Mus musculus
aggcattgaccgctcatcctaaagt

SEQ ID NO: 199306 - DNA, 25 bp, Mus musculus
aggcattgcacaagaaaagaaggct

SEQ ID NO: 199307 - DNA, 25 bp, Mus musculus
aggcattgctaaaagaggcatccac

SEQ ID NO: 199308 - DNA, 25 bp, Mus musculus
aggcattgtggactctagaaaaaga

SEQ ID NO: 199309 - DNA, 25 bp, Mus musculus
aggcattgtggattatcagactcta

SEQ ID NO: 199310 - DNA, 25 bp, Mus musculus
aggcattgttcgaggaaatgctgtc

SEQ ID NO: 199311 - DNA, 25 bp, Mus musculus
aggcatttagagagacactgtacta

SEQ ID NO: 199312 - DNA, 25 bp, Mus musculus
aggccaaaaagagcttggacagagt

SEQ ID NO: 199313 - DNA, 25 bp, Mus musculus
aggccaaaaagagtgtgcaaagacc

SEQ ID NO: 199314 - DNA, 25 bp, Mus musculus
aggccaaaaatgtcagcagctatga

SEQ ID NO: 199315 - DNA, 25 bp, Mus musculus
aggccaaaagcctgatagaggaagg

SEQ ID NO: 199316 - DNA, 25 bp, Mus musculus
aggccaaaatgatgaagaaaatact

SEQ ID NO: 199317 - DNA, 25 bp, Mus musculus
aggccaaaatgatggatgcatccct

SEQ ID NO: 199318 - DNA, 25 bp, Mus musculus
aggccaaaattagatcatagcagtc

SEQ ID NO: 199319 - DNA, 25 bp, Mus musculus
aggccaaacaaaagccgaaatagaa

SEQ ID NO: 199320 - DNA, 25 bp, Mus musculus
aggccaaacaaagagcacagtcaga

SEQ ID NO: 199321 - DNA, 25 bp, Mus musculus
aggccaaacaagttgtcaagttgct

SEQ ID NO: 199322 - DNA, 25 bp, Mus musculus
aggccaaacagctcaggcctgcatg

SEQ ID NO: 199323 - DNA, 25 bp, Mus musculus
aggccaaaccccaagaatctcgaga

SEQ ID NO: 199324 - DNA, 25 bp, Mus musculus
aggccaaaccccaaggagcggctgc

SEQ ID NO: 199325 - DNA, 25 bp, Mus musculus
aggccaaactcaaggaccaggcagc

SEQ ID NO: 199326 - DNA, 25 bp, Mus musculus
aggccaaactcaagttttggcaagg

SEQ ID NO: 199327 - DNA, 25 bp, Mus musculus
aggccaaagcaaaaatgaggagtgg

SEQ ID NO: 199328 - DNA, 25 bp, Mus musculus
aggccaaagtaacctcaggcttggt

SEQ ID NO: 199329 - DNA, 25 bp, Mus musculus
aggccaacaagcaggatggacgaca

SEQ ID NO: 199330 - DNA, 25 bp, Mus musculus
aggccaacaaggtacgcacgcggtc

SEQ ID NO: 199331 - DNA, 25 bp, Mus musculus
aggccaacaatcctactccaggtct

SEQ ID NO: 199332 - DNA, 25 bp, Mus musculus
aggccaacccagatggcaagaagaa

SEQ ID NO: 199333 - DNA, 25 bp, Mus musculus
aggccaaccgctatggattacagcc

SEQ ID NO: 199334 - DNA, 25 bp, Mus musculus
aggccaagaaacgagagcttaaaga

SEQ ID NO: 199335 - DNA, 25 bp, Mus musculus
aggccaagaagggggatggaaatcc

SEQ ID NO: 199336 - DNA, 25 bp, Mus musculus
aggccaagacatagctcattctgga

SEQ ID NO: 199337 - DNA, 25 bp, Mus musculus
aggccaagacatagtcttgccatgt

SEQ ID NO: 199338 - DNA, 25 bp, Mus musculus
aggccaagacatgcccggaaccgcg

SEQ ID NO: 199339 - DNA, 25 bp, Mus musculus
aggccaagacgcccacagattaaaa

SEQ ID NO: 199340 - DNA, 25 bp, Mus musculus
aggccaagactaaggggtccccagg

SEQ ID NO: 199341 - DNA, 25 bp, Mus musculus
aggccaagattagattgctttattc

SEQ ID NO: 199342 - DNA, 25 bp, Mus musculus
aggccaagcacgataaatacatggc

SEQ ID NO: 199343 - DNA, 25 bp, Mus musculus
aggccaagcacgtggacgagaaaag

SEQ ID NO: 199344 - DNA, 25 bp, Mus musculus
aggccaagcaggcttgtgatgcctg

SEQ ID NO: 199345 - DNA, 25 bp, Mus musculus
aggccaagctatggtccttcccaaa

SEQ ID NO: 199346 - DNA, 25 bp, Mus musculus
aggccaagctatgtttttgaggaca

SEQ ID NO: 199347 - DNA, 25 bp, Mus musculus
aggccaagctggccctgcttgtcaa

SEQ ID NO: 199348 - DNA, 25 bp, Mus musculus
aggccaagcttgccctgcttgtcaa

SEQ ID NO: 199349 - DNA, 25 bp, Mus musculus
aggccaaggaaggcaccagacctgt

SEQ ID NO: 199350 - DNA, 25 bp, Mus musculus
aggccaagttcaaggacagcagcct

SEQ ID NO: 199351 - DNA, 25 bp, Mus musculus
aggccaagttgtgctggtaactcaa

SEQ ID NO: 199352 - DNA, 25 bp, Mus musculus
aggccaatgtgggaagcaaagctgc

SEQ ID NO: 199353 - DNA, 25 bp, Mus musculus
aggccaattactgagcaaattgctg

SEQ ID NO: 199354 - DNA, 25 bp, Mus musculus
aggccaattgttcctgtaccaggcc

SEQ ID NO: 199355 - DNA, 25 bp, Mus musculus
aggccacaagatatcagtattacct

SEQ ID NO: 199356 - DNA, 25 bp, Mus musculus
aggccacaagcctacttggaggaaa

SEQ ID NO: 199357 - DNA, 25 bp, Mus musculus
aggccacactgctatcatccagcag

SEQ ID NO: 199358 - DNA, 25 bp, Mus musculus
aggccacagatgctgaagctgacgt

SEQ ID NO: 199359 - DNA, 25 bp, Mus musculus
aggccacagctcggctcctgggcag

SEQ ID NO: 199360 - DNA, 25 bp, Mus musculus
aggccacaggattaccaccatgttc

SEQ ID NO: 199361 - DNA, 25 bp, Mus musculus
aggccaccaaccagattctcagcca

SEQ ID NO: 199362 - DNA, 25 bp, Mus musculus
aggccaccccttaaatgtaggtata

SEQ ID NO: 199363 - DNA, 25 bp, Mus musculus
aggccaccccttcctgcaaggccat

SEQ ID NO: 199364 - DNA, 25 bp, Mus musculus
aggccacccttgaaggtgaacaagg

SEQ ID NO: 199365 - DNA, 25 bp, Mus musculus
aggccaccgccgcggcatggatggg

SEQ ID NO: 199366 - DNA, 25 bp, Mus musculus
aggccaccggacagcattcacaacg

SEQ ID NO: 199367 - DNA, 25 bp, Mus musculus
aggccaccggacagcccaacggtag

SEQ ID NO: 199368 - DNA, 25 bp, Mus musculus
aggccacctcgggcaaggtggctgc

SEQ ID NO: 199369 - DNA, 25 bp, Mus musculus
aggccacgcatcctccacctgtccc

SEQ ID NO: 199370 - DNA, 25 bp, Mus musculus
aggccacgccagagtttctcaggaa

SEQ ID NO: 199371 - DNA, 25 bp, Mus musculus
aggccacggggacaggcaagtacat

SEQ ID NO: 199372 - DNA, 25 bp, Mus musculus
aggccactcaggatcggaacgtcaa

SEQ ID NO: 199373 - DNA, 25 bp, Mus musculus
aggccactcattcagggagtgttgt

SEQ ID NO: 199374 - DNA, 25 bp, Mus musculus
aggccactgagtcttctggccgaac

SEQ ID NO: 199375 - DNA, 25 bp, Mus musculus
aggccagaaatcacaaacttcgtgt

SEQ ID NO: 199376 - DNA, 25 bp, Mus musculus
aggccagaagaattgtgtctggaat

SEQ ID NO: 199377 - DNA, 25 bp, Mus musculus
aggccagacagacgggtccacctca

SEQ ID NO: 199378 - DNA, 25 bp, Mus musculus
aggccagacctcgggacagattgtg

SEQ ID NO: 199379 - DNA, 25 bp, Mus musculus
aggccagagcagagaggaggtggac

SEQ ID NO: 199380 - DNA, 25 bp, Mus musculus
aggccagagcagatgaagtgagaga

SEQ ID NO: 199381 - DNA, 25 bp, Mus musculus
aggccagagcaggctccttaggctt

SEQ ID NO: 199382 - DNA, 25 bp, Mus musculus
aggccagatgagctcctcttgcggc

SEQ ID NO: 199383 - DNA, 25 bp, Mus musculus
aggccagatgctgaaattaccccag

SEQ ID NO: 199384 - DNA, 25 bp, Mus musculus
aggccagatggatgctgttcgaatc

SEQ ID NO: 199385 - DNA, 25 bp, Mus musculus
aggccagatgtgatgctgttgtgtc

SEQ ID NO: 199386 - DNA, 25 bp, Mus musculus
aggccagcagacacacaaccttttt

SEQ ID NO: 199387 - DNA, 25 bp, Mus musculus
aggccagcagattgtgatatcttta

SEQ ID NO: 199388 - DNA, 25 bp, Mus musculus
aggccagcagcagaatcggaagact

SEQ ID NO: 199389 - DNA, 25 bp, Mus musculus
aggccagcagccagaatgaaggctt

SEQ ID NO: 199390 - DNA, 25 bp, Mus musculus
aggccagcagccagatgaaggtctg

SEQ ID NO: 199391 - DNA, 25 bp, Mus musculus
aggccagcagccctagctagcatgg

SEQ ID NO: 199392 - DNA, 25 bp, Mus musculus
aggccagcagccctgtctccaggat

SEQ ID NO: 199393 - DNA, 25 bp, Mus musculus
aggccagcagctctgcggagtcgga

SEQ ID NO: 199394 - DNA, 25 bp, Mus musculus
aggccagcagcttcaccaatcttcc

SEQ ID NO: 199395 - DNA, 25 bp, Mus musculus
aggccagcaggtctcataacaacaa

SEQ ID NO: 199396 - DNA, 25 bp, Mus musculus
aggccagcaggtgtacagtgggctc

SEQ ID NO: 199397 - DNA, 25 bp, Mus musculus
aggccagcagtgggctctggcaaga

SEQ ID NO: 199398 - DNA, 25 bp, Mus musculus
aggccagccatagctcttggatgcg

SEQ ID NO: 199399 - DNA, 25 bp, Mus musculus
aggccagcctggtctccgttatgac

SEQ ID NO: 199400 - DNA, 25 bp, Mus musculus
aggccagcggggctggcgctgtgac

SEQ ID NO: 199401 - DNA, 25 bp, Mus musculus
aggccagcgggggctggcttacagt

SEQ ID NO: 199402 - DNA, 25 bp, Mus musculus
aggccagctgatcgctggtgttcga

SEQ ID NO: 199403 - DNA, 25 bp, Mus musculus
aggccagcttgcttgaaactttggg

SEQ ID NO: 199404 - DNA, 25 bp, Mus musculus
aggccagcttgcttggctgaagcca

SEQ ID NO: 199405 - DNA, 25 bp, Mus musculus
aggccaggacggaataggaaccaag

SEQ ID NO: 199406 - DNA, 25 bp, Mus musculus
aggccaggagagaggggagaaaggg

SEQ ID NO: 199407 - DNA, 25 bp, Mus musculus
aggccaggaggaagaaaattatgat

SEQ ID NO: 199408 - DNA, 25 bp, Mus musculus
aggccaggaggaggacccaggtcaa

SEQ ID NO: 199409 - DNA, 25 bp, Mus musculus
aggccaggagggctcgctcgaagag

SEQ ID NO: 199410 - DNA, 25 bp, Mus musculus
aggccaggcggaaaaagtggataat

SEQ ID NO: 199411 - DNA, 25 bp, Mus musculus
aggccaggcggaaggtgatgttcgt

SEQ ID NO: 199412 - DNA, 25 bp, Mus musculus
aggccaggcgggctgggaaggtggc

SEQ ID NO: 199413 - DNA, 25 bp, Mus musculus
aggccagggaagagagagagagaga

SEQ ID NO: 199414 - DNA, 25 bp, Mus musculus
aggccagggccattgtgacttcttc

SEQ ID NO: 199415 - DNA, 25 bp, Mus musculus
aggccagggctgaggcttgttcccc

SEQ ID NO: 199416 - DNA, 25 bp, Mus musculus
aggccaggtaaagcctgccgggagt

SEQ ID NO: 199417 - DNA, 25 bp, Mus musculus
aggccaggtacctgggagcccgaac

SEQ ID NO: 199418 - DNA, 25 bp, Mus musculus
aggccaggtccagaacggaggttcc

SEQ ID NO: 199419 - DNA, 25 bp, Mus musculus
aggccaggtccagctggacccccaa

SEQ ID NO: 199420 - DNA, 25 bp, Mus musculus
aggccaggtgagaaatgtctcaggc

SEQ ID NO: 199421 - DNA, 25 bp, Mus musculus
aggccagtacccaggtctgtgaact

SEQ ID NO: 199422 - DNA, 25 bp, Mus musculus
aggccagtaggagttaaagggaatg

SEQ ID NO: 199423 - DNA, 25 bp, Mus musculus
aggccagttcctgagggcagtggct

SEQ ID NO: 199424 - DNA, 25 bp, Mus musculus
aggccagttgggctgtgactcgagg

SEQ ID NO: 199425 - DNA, 25 bp, Mus musculus
aggccataaagactcactccgaagc

SEQ ID NO: 199426 - DNA, 25 bp, Mus musculus
aggccataaaggcttctggggatgg

SEQ ID NO: 199427 - DNA, 25 bp, Mus musculus
aggccataaggagctggtggggagt

SEQ ID NO: 199428 - DNA, 25 bp, Mus musculus
aggccatacagctggtaaacaccag

SEQ ID NO: 199429 - DNA, 25 bp, Mus musculus
aggccataccctgttgtggcctctt
